United States Patent 7,888,497 (BIOINFORMATICALLY DETECTABLE GROUP OF NOVEL REGULATORY OLIGONUCLEOTIDES AND USES THEREOF) - sequence listing, part 111

SEQ ID NO: 4698374 - DNA, 15 bp, Homo sapiens
ctccctttcactaaa

SEQ ID NO: 4698375 - DNA, 12 bp, Homo sapiens
ctccctttctcc

SEQ ID NO: 4698376 - DNA, 14 bp, Homo sapiens
ctccctttctcccc

SEQ ID NO: 4698377 - DNA, 15 bp, Homo sapiens
ctccctttctcccct

SEQ ID NO: 4698378 - DNA, 23 bp, Homo sapiens
ctccctttctcccctgcccccag

SEQ ID NO: 4698379 - DNA, 21 bp, Homo sapiens
ctccctttttttctctcttcc

SEQ ID NO: 4698380 - DNA, 18 bp, Homo sapiens
ctccgcacacctctggct

SEQ ID NO: 4698381 - DNA, 13 bp, Homo sapiens
ctccgtggagcag

SEQ ID NO: 4698382 - DNA, 17 bp, Homo sapiens
ctcctacccctcccagc

SEQ ID NO: 4698383 - DNA, 19 bp, Homo sapiens
ctcctacccctcccagctg

SEQ ID NO: 4698384 - DNA, 20 bp, Homo sapiens
ctcctcaccacgtggggcca

SEQ ID NO: 4698385 - DNA, 16 bp, Homo sapiens
ctcctcatccagggct

SEQ ID NO: 4698386 - DNA, 20 bp, Homo sapiens
ctcctcatccagggctctga

SEQ ID NO: 4698387 - DNA, 22 bp, Homo sapiens
ctcctccaccgccatggcttcc

SEQ ID NO: 4698388 - DNA, 16 bp, Homo sapiens
ctcctccactctcccc

SEQ ID NO: 4698389 - DNA, 15 bp, Homo sapiens
ctcctctccccagca

SEQ ID NO: 4698390 - DNA, 17 bp, Homo sapiens
ctcctctcccctaccac

SEQ ID NO: 4698391 - DNA, 13 bp, Homo sapiens
ctcctctctgccc

SEQ ID NO: 4698392 - DNA, 15 bp, Homo sapiens
ctcctctctgcccta

SEQ ID NO: 4698393 - DNA, 11 bp, Homo sapiens
ctcctctgtga

SEQ ID NO: 4698394 - DNA, 12 bp, Homo sapiens
ctcctctgtgaa

SEQ ID NO: 4698395 - DNA, 13 bp, Homo sapiens
ctcctctgtgaaa

SEQ ID NO: 4698396 - DNA, 14 bp, Homo sapiens
ctcctgacctcagg

SEQ ID NO: 4698397 - DNA, 17 bp, Homo sapiens
ctcctgagtagctggga

SEQ ID NO: 4698398 - DNA, 11 bp, Homo sapiens
ctcctgcaggc

SEQ ID NO: 4698399 - DNA, 13 bp, Homo sapiens
ctcctgcaggcag

SEQ ID NO: 4698400 - DNA, 16 bp, Homo sapiens
ctcctgcaggcagcca

SEQ ID NO: 4698401 - DNA, 22 bp, Homo sapiens
ctcctgcaggcagccaggccac

SEQ ID NO: 4698402 - DNA, 11 bp, Homo sapiens
ctcctgccacc

SEQ ID NO: 4698403 - DNA, 14 bp, Homo sapiens
ctcctgccgcagag

SEQ ID NO: 4698404 - DNA, 11 bp, Homo sapiens
ctcctgcctca

SEQ ID NO: 4698405 - DNA, 12 bp, Homo sapiens
ctcctgcctcag

SEQ ID NO: 4698406 - DNA, 15 bp, Homo sapiens
ctcctgcctcagcct

SEQ ID NO: 4698407 - DNA, 17 bp, Homo sapiens
ctcctgcctcagcctcc

SEQ ID NO: 4698408 - DNA, 21 bp, Homo sapiens
ctcctgcctcgaactggctgc

SEQ ID NO: 4698409 - DNA, 16 bp, Homo sapiens
ctcctgccttcctcct

SEQ ID NO: 4698410 - DNA, 17 bp, Homo sapiens
ctgagaacactgtgaaa

SEQ ID NO: 4698411 - DNA, 14 bp, Homo sapiens
ctgagacagcccgg

SEQ ID NO: 4698412 - DNA, 17 bp, Homo sapiens
ctgagacagcccgggct

SEQ ID NO: 4698413 - DNA, 23 bp, Homo sapiens
ctgagacagcccgggctctgcct

SEQ ID NO: 4698414 - DNA, 18 bp, Homo sapiens
ctgagataccagcgagga

SEQ ID NO: 4698415 - DNA, 23 bp, Homo sapiens
ctgagattataggcacctaccac

SEQ ID NO: 4698416 - DNA, 16 bp, Homo sapiens
ctgagatttcatctgc

SEQ ID NO: 4698417 - DNA, 19 bp, Homo sapiens
ctgagatttcatctgctct

SEQ ID NO: 4698418 - DNA, 17 bp, Homo sapiens
ctgagcagaatactggt

SEQ ID NO: 4698419 - DNA, 12 bp, Homo sapiens
ctgagcatctcc

SEQ ID NO: 4698420 - DNA, 19 bp, Homo sapiens
ctgagccacactgaaaagg

SEQ ID NO: 4698421 - DNA, 11 bp, Homo sapiens
ctgagcccctc

SEQ ID NO: 4698422 - DNA, 22 bp, Homo sapiens
ctgagcctcagtctccctccct

SEQ ID NO: 4698423 - DNA, 12 bp, Homo sapiens
ctgagctgggat

SEQ ID NO: 4698424 - DNA, 18 bp, Homo sapiens
ctgagctgggcagctgga

SEQ ID NO: 4698425 - DNA, 15 bp, Homo sapiens
ctgagctgtgcaggt

SEQ ID NO: 4698426 - DNA, 22 bp, Homo sapiens
ctgaggaacccttacagtagga

SEQ ID NO: 4698427 - DNA, 15 bp, Homo sapiens
ctgaggaagaacggg

SEQ ID NO: 4698428 - DNA, 23 bp, Homo sapiens
ctgaggaatccagacccggctgc

SEQ ID NO: 4698429 - DNA, 20 bp, Homo sapiens
ctgaggacactaaccacgct

SEQ ID NO: 4698430 - DNA, 23 bp, Homo sapiens
ctgaggacactaaccacgctgga

SEQ ID NO: 4698431 - DNA, 15 bp, Homo sapiens
ctgaggcccagaggg

SEQ ID NO: 4698432 - DNA, 16 bp, Homo sapiens
ctgaggcccagagggc

SEQ ID NO: 4698433 - DNA, 17 bp, Homo sapiens
ctgaggcccagagggcc

SEQ ID NO: 4698434 - DNA, 21 bp, Homo sapiens
ctgaggccccttctaggtggc

SEQ ID NO: 4698435 - DNA, 13 bp, Homo sapiens
ctgaggctgggct

SEQ ID NO: 4698436 - DNA, 17 bp, Homo sapiens
ctgagggagcctggccc

SEQ ID NO: 4698437 - DNA, 15 bp, Homo sapiens
ctgagggatctttac

SEQ ID NO: 4698438 - DNA, 14 bp, Homo sapiens
ctgaggggcctctt

SEQ ID NO: 4698439 - DNA, 14 bp, Homo sapiens
ctgagtagctggga

SEQ ID NO: 4698440 - DNA, 19 bp, Homo sapiens
ctgagtcagctgaccccct

SEQ ID NO: 4698441 - DNA, 20 bp, Homo sapiens
ctgagtcccaggctgagcct

SEQ ID NO: 4698442 - DNA, 19 bp, Homo sapiens
ctgagtctggcaaacatgt

SEQ ID NO: 4698443 - DNA, 19 bp, Homo sapiens
ctgagtgcctggccaaagg

SEQ ID NO: 4698444 - DNA, 16 bp, Homo sapiens
ctgataacaacctgga

SEQ ID NO: 4698445 - DNA, 14 bp, Homo sapiens
ctgataatgtattg

SEQ ID NO: 4698446 - DNA, 20 bp, Homo sapiens
ctgatcatttggctcttttt

SEQ ID NO: 4698447 - DNA, 20 bp, Homo sapiens
ctgatcctgtgaagtaagga

SEQ ID NO: 4698448 - DNA, 12 bp, Homo sapiens
ctgatgaaaata

SEQ ID NO: 4698449 - DNA, 14 bp, Homo sapiens
ctgatgaaaataaa

SEQ ID NO: 4698450 - DNA, 16 bp, Homo sapiens
ctgatgaaaataaaga

SEQ ID NO: 4698451 - DNA, 14 bp, Homo sapiens
ctgatgacctggga

SEQ ID NO: 4698452 - DNA, 14 bp, Homo sapiens
ctgatgctgggctg

SEQ ID NO: 4698453 - DNA, 19 bp, Homo sapiens
ctgatgctgggctgggtgc

SEQ ID NO: 4698454 - DNA, 18 bp, Homo sapiens
ctgatgcttcttcagaga

SEQ ID NO: 4698455 - DNA, 16 bp, Homo sapiens
ctgatggagagtgaga

SEQ ID NO: 4698456 - DNA, 22 bp, Homo sapiens
ctgatggcaggatggcctggcc

SEQ ID NO: 4698457 - DNA, 23 bp, Homo sapiens
ctgatgggcaacccccagcctgc

SEQ ID NO: 4698458 - DNA, 24 bp, Homo sapiens
ctgatgggcaacccccagcctgct

SEQ ID NO: 4698459 - DNA, 17 bp, Homo sapiens
ctgatggggcaaactca

SEQ ID NO: 4698460 - DNA, 14 bp, Homo sapiens
ctgatgtttataaa

SEQ ID NO: 4698461 - DNA, 23 bp, Homo sapiens
ctgattagataatcttttacatt

SEQ ID NO: 4698462 - DNA, 15 bp, Homo sapiens
ctgattcccaagctc

SEQ ID NO: 4698463 - DNA, 17 bp, Homo sapiens
ctgattcccaagctctg

SEQ ID NO: 4698464 - DNA, 15 bp, Homo sapiens
ctgattctcagggtc

SEQ ID NO: 4698465 - DNA, 20 bp, Homo sapiens
ctgattctcagggtctctgc

SEQ ID NO: 4698466 - DNA, 21 bp, Homo sapiens
ctgattctcagggtctctgct

SEQ ID NO: 4698467 - DNA, 23 bp, Homo sapiens
ctgattggtgttttatctcctgt

SEQ ID NO: 4698468 - DNA, 21 bp, Homo sapiens
ctgattgtgtctcttggtcct

SEQ ID NO: 4698469 - DNA, 11 bp, Homo sapiens
ctgatttgctg

SEQ ID NO: 4698470 - DNA, 14 bp, Homo sapiens
ctgatttgtattaa

SEQ ID NO: 4698471 - DNA, 17 bp, Homo sapiens
ctgcaaagcccagcttg

SEQ ID NO: 4698472 - DNA, 18 bp, Homo sapiens
ctgcaaagcccagcttga

SEQ ID NO: 4698473 - DNA, 11 bp, Homo sapiens
ctgcaacatgg

SEQ ID NO: 4698474 - DNA, 22 bp, Homo sapiens
ctgcaacctgattgtgtctctt

SEQ ID NO: 4698475 - DNA, 17 bp, Homo sapiens
ctgcaaccttcgccacc

SEQ ID NO: 4698476 - DNA, 19 bp, Homo sapiens
ctgcaaccttcgccacctg

SEQ ID NO: 4698477 - DNA, 20 bp, Homo sapiens
ctgcaaccttcgccacctgg

SEQ ID NO: 4698478 - DNA, 22 bp, Homo sapiens
ctgcaaccttcgccacctgggt

SEQ ID NO: 4698479 - DNA, 15 bp, Homo sapiens
ctgcaacttgtgaac

SEQ ID NO: 4698480 - DNA, 14 bp, Homo sapiens
ctgcacaataaaac

SEQ ID NO: 4698481 - DNA, 14 bp, Homo sapiens
ctgcacacagcacg

SEQ ID NO: 4698482 - DNA, 18 bp, Homo sapiens
ctgcacactcagttctgc

SEQ ID NO: 4698483 - DNA, 22 bp, Homo sapiens
ctgcacactcagttctgctcta

SEQ ID NO: 4698484 - DNA, 17 bp, Homo sapiens
ctgcaccaacccagccg

SEQ ID NO: 4698485 - DNA, 21 bp, Homo sapiens
ctgcacccagccccaaggggt

SEQ ID NO: 4698486 - DNA, 17 bp, Homo sapiens
ctgcaccggctggcctg

SEQ ID NO: 4698487 - DNA, 22 bp, Homo sapiens
ctgcaccggctggcctggcccc

SEQ ID NO: 4698488 - DNA, 12 bp, Homo sapiens
ctgcaccgggcc

SEQ ID NO: 4698489 - DNA, 18 bp, Homo sapiens
ctgcactatagcctaggt

SEQ ID NO: 4698490 - DNA, 13 bp, Homo sapiens
ctgcactcccctg

SEQ ID NO: 4698491 - DNA, 14 bp, Homo sapiens
ctgcactcccctgc

SEQ ID NO: 4698492 - DNA, 17 bp, Homo sapiens
ctgcactctgtgcccat

SEQ ID NO: 4698493 - DNA, 11 bp, Homo sapiens
ctgcactgtcc

SEQ ID NO: 4698494 - DNA, 15 bp, Homo sapiens
ctgcactgtcctgct

SEQ ID NO: 4698495 - DNA, 22 bp, Homo sapiens
ctgcacttgcggttccggcatg

SEQ ID NO: 4698496 - DNA, 22 bp, Homo sapiens
ctgcagaggggcaggccctgca

SEQ ID NO: 4698497 - DNA, 23 bp, Homo sapiens
ctgcagaggggcaggccctgcac

SEQ ID NO: 4698498 - DNA, 17 bp, Homo sapiens
ctgcagatttgggctgg

SEQ ID NO: 4698499 - DNA, 18 bp, Homo sapiens
ctgcagatttgggctgga

SEQ ID NO: 4698500 - DNA, 23 bp, Homo sapiens
ctgcagatttgggctggaacaga

SEQ ID NO: 4698501 - DNA, 21 bp, Homo sapiens
ctgcagcagggcaggaagggg

SEQ ID NO: 4698502 - DNA, 23 bp, Homo sapiens
ctgcagcctcaacctcctgggct

SEQ ID NO: 4698503 - DNA, 14 bp, Homo sapiens
ctgcagcctcagag

SEQ ID NO: 4698504 - DNA, 14 bp, Homo sapiens
ctgcaggaaggagc

SEQ ID NO: 4698505 - DNA, 21 bp, Homo sapiens
ctgcaggaaggagctgcctgg

SEQ ID NO: 4698506 - DNA, 13 bp, Homo sapiens
ctgcaggcagcca

SEQ ID NO: 4698507 - DNA, 16 bp, Homo sapiens
ctgcaggcagccaggc

SEQ ID NO: 4698508 - DNA, 12 bp, Homo sapiens
ctgcagggaaaa

SEQ ID NO: 4698509 - DNA, 22 bp, Homo sapiens
ctgcagggaaaattatttgcat

SEQ ID NO: 4698510 - DNA, 22 bp, Homo sapiens
ctgcagggagtccgaaagggac

SEQ ID NO: 4698511 - DNA, 15 bp, Homo sapiens
ctgcaggttgggcca

SEQ ID NO: 4698512 - DNA, 20 bp, Homo sapiens
ctgcaggttgggccatactg

SEQ ID NO: 4698513 - DNA, 22 bp, Homo sapiens
ctgcagtcacttcgtgggatct

SEQ ID NO: 4698514 - DNA, 21 bp, Homo sapiens
ctgcagttgccagtcaccccg

SEQ ID NO: 4698515 - DNA, 22 bp, Homo sapiens
ctgcataatgtttctggatttc

SEQ ID NO: 4698516 - DNA, 21 bp, Homo sapiens
ctgcatatctctagtccctgt

SEQ ID NO: 4698517 - DNA, 20 bp, Homo sapiens
ctgcatcctccgcctcccgg

SEQ ID NO: 4698518 - DNA, 23 bp, Homo sapiens
ctgcatgcgagtgctcatttcag

SEQ ID NO: 4698519 - DNA, 23 bp, Homo sapiens
ctgctgacagacacaggcccggc

SEQ ID NO: 4698520 - DNA, 12 bp, Homo sapiens
ctgctgacagtg

SEQ ID NO: 4698521 - DNA, 13 bp, Homo sapiens
ctgctgacagtgt

SEQ ID NO: 4698522 - DNA, 18 bp, Homo sapiens
ctgctgcaccaacccagc

SEQ ID NO: 4698523 - DNA, 23 bp, Homo sapiens
ctgctgcaccaacccagccgctg

SEQ ID NO: 4698524 - DNA, 17 bp, Homo sapiens
ctgctgcagaggggcag

SEQ ID NO: 4698525 - DNA, 13 bp, Homo sapiens
ctgctgcccctcc

SEQ ID NO: 4698526 - DNA, 16 bp, Homo sapiens
ctgctgcccctccctg

SEQ ID NO: 4698527 - DNA, 13 bp, Homo sapiens
ctgctgcctgcct

SEQ ID NO: 4698528 - DNA, 14 bp, Homo sapiens
ctgctgctgcctgc

SEQ ID NO: 4698529 - DNA, 13 bp, Homo sapiens
ctgctgggctggg

SEQ ID NO: 4698530 - DNA, 17 bp, Homo sapiens
ctgctgggctggggcct

SEQ ID NO: 4698531 - DNA, 19 bp, Homo sapiens
ctgctgggctggggcctga

SEQ ID NO: 4698532 - DNA, 18 bp, Homo sapiens
ctgctgggtggcccatcc

SEQ ID NO: 4698533 - DNA, 14 bp, Homo sapiens
ctgctgggtgtggc

SEQ ID NO: 4698534 - DNA, 13 bp, Homo sapiens
ctgctgtcccctc

SEQ ID NO: 4698535 - DNA, 19 bp, Homo sapiens
ctgctgtcccctcttgccc

SEQ ID NO: 4698536 - DNA, 23 bp, Homo sapiens
ctgctgtcccctcttgccccaac

SEQ ID NO: 4698537 - DNA, 14 bp, Homo sapiens
ctgcttccagtgag

SEQ ID NO: 4698538 - DNA, 23 bp, Homo sapiens
ctgcttccagtgaggctctgccc

SEQ ID NO: 4698539 - DNA, 14 bp, Homo sapiens
ctgcttgaggaaaa

SEQ ID NO: 4698540 - DNA, 16 bp, Homo sapiens
ctgcttgaggaaaaca

SEQ ID NO: 4698541 - DNA, 13 bp, Homo sapiens
ctgctttggaaat

SEQ ID NO: 4698542 - DNA, 17 bp, Homo sapiens
ctgcttttggtctgtgt

SEQ ID NO: 4698543 - DNA, 19 bp, Homo sapiens
ctgcttttgtctatgggac

SEQ ID NO: 4698544 - DNA, 20 bp, Homo sapiens
ctgcttttgtctatgggact

SEQ ID NO: 4698545 - DNA, 21 bp, Homo sapiens
ctgcttttgtctatgggactc

SEQ ID NO: 4698546 - DNA, 17 bp, Homo sapiens
ctggaaagcaaacagga

SEQ ID NO: 4698547 - DNA, 21 bp, Homo sapiens
ctggaacagattcacactgtc

SEQ ID NO: 4698548 - DNA, 21 bp, Homo sapiens
ctggaaccaggcttgcctggg

SEQ ID NO: 4698549 - DNA, 15 bp, Homo sapiens
ctggaagcacagctt

SEQ ID NO: 4698550 - DNA, 22 bp, Homo sapiens
ctggaagggctagaacctgtag

SEQ ID NO: 4698551 - DNA, 20 bp, Homo sapiens
ctggaatctggagagctaga

SEQ ID NO: 4698552 - DNA, 17 bp, Homo sapiens
ctggacacttgctcatg

SEQ ID NO: 4698553 - DNA, 23 bp, Homo sapiens
ctggacccctgcattggaactgg

SEQ ID NO: 4698554 - DNA, 16 bp, Homo sapiens
ctggacctctcttgtg

SEQ ID NO: 4698555 - DNA, 12 bp, Homo sapiens
ctggactcagga

SEQ ID NO: 4698556 - DNA, 14 bp, Homo sapiens
ctggactctcagtc

SEQ ID NO: 4698557 - DNA, 15 bp, Homo sapiens
ctggactgaggcctg

SEQ ID NO: 4698558 - DNA, 16 bp, Homo sapiens
ctggactgaggcctga

SEQ ID NO: 4698559 - DNA, 18 bp, Homo sapiens
ctggactgaggcctgagc

SEQ ID NO: 4698560 - DNA, 13 bp, Homo sapiens
ctggagaactaga

SEQ ID NO: 4698561 - DNA, 20 bp, Homo sapiens
ctggagactcctaggcagga

SEQ ID NO: 4698562 - DNA, 16 bp, Homo sapiens
ctggagccactaacta

SEQ ID NO: 4698563 - DNA, 20 bp, Homo sapiens
ctggaggactagaacctgga

SEQ ID NO: 4698564 - DNA, 22 bp, Homo sapiens
ctggaggactagaacctggagg

SEQ ID NO: 4698565 - DNA, 16 bp, Homo sapiens
ctggaggagcccaggc

SEQ ID NO: 4698566 - DNA, 21 bp, Homo sapiens
ctggaggagcccaggccagga

SEQ ID NO: 4698567 - DNA, 20 bp, Homo sapiens
ctggagggctagaacctgga

SEQ ID NO: 4698568 - DNA, 20 bp, Homo sapiens
ctggagggctagaatctgga

SEQ ID NO: 4698569 - DNA, 19 bp, Homo sapiens
ctggagggctggaatctgg

SEQ ID NO: 4698570 - DNA, 20 bp, Homo sapiens
ctggagggctggaatctgga

SEQ ID NO: 4698571 - DNA, 21 bp, Homo sapiens
ctggaggggtcatccttgccc

SEQ ID NO: 4698572 - DNA, 22 bp, Homo sapiens
ctggaggggtcatccttgccca

SEQ ID NO: 4698573 - DNA, 15 bp, Homo sapiens
ctggagtgcagtgag

SEQ ID NO: 4698574 - DNA, 17 bp, Homo sapiens
ctggatgggggctctgc

SEQ ID NO: 4698575 - DNA, 18 bp, Homo sapiens
ctggcaaacatgtgcaac

SEQ ID NO: 4698576 - DNA, 19 bp, Homo sapiens
ctggcaagctagaacctgg

SEQ ID NO: 4698577 - DNA, 22 bp, Homo sapiens
ctggcaagctagaacctggagg

SEQ ID NO: 4698578 - DNA, 22 bp, Homo sapiens
ctggcacccggcccctgctggt

SEQ ID NO: 4698579 - DNA, 18 bp, Homo sapiens
ctggcacctgaaattaat

SEQ ID NO: 4698580 - DNA, 14 bp, Homo sapiens
ctggcactgctggg

SEQ ID NO: 4698581 - DNA, 13 bp, Homo sapiens
ctggcactgcttc

SEQ ID NO: 4698582 - DNA, 19 bp, Homo sapiens
ctggcactgcttccagtga

SEQ ID NO: 4698583 - DNA, 15 bp, Homo sapiens
ctggcagctcagaga

SEQ ID NO: 4698584 - DNA, 16 bp, Homo sapiens
ctggccagatgcacca

SEQ ID NO: 4698585 - DNA, 18 bp, Homo sapiens
ctggccagatgcaccagc

SEQ ID NO: 4698586 - DNA, 23 bp, Homo sapiens
ctggccagatgtcgctgggtcct

SEQ ID NO: 4698587 - DNA, 13 bp, Homo sapiens
ctggccagcccca

SEQ ID NO: 4698588 - DNA, 23 bp, Homo sapiens
ctggccagggcctggaagacaga

SEQ ID NO: 4698589 - DNA, 12 bp, Homo sapiens
ctggcccagctc

SEQ ID NO: 4698590 - DNA, 23 bp, Homo sapiens
ctggccctcaaggcctcccacag

SEQ ID NO: 4698591 - DNA, 18 bp, Homo sapiens
ctggccgcgccaaataat

SEQ ID NO: 4698592 - DNA, 22 bp, Homo sapiens
ctggccgttgatgttggctggg

SEQ ID NO: 4698593 - DNA, 23 bp, Homo sapiens
ctggccgttgatgttggctggga

SEQ ID NO: 4698594 - DNA, 12 bp, Homo sapiens
ctggcctagtcc

SEQ ID NO: 4698595 - DNA, 16 bp, Homo sapiens
ctggcctcgcctggcc

SEQ ID NO: 4698596 - DNA, 13 bp, Homo sapiens
ctggcctctgcac

SEQ ID NO: 4698597 - DNA, 16 bp, Homo sapiens
ctggcctctgcactcc

SEQ ID NO: 4698598 - DNA, 24 bp, Homo sapiens
ctggcctggcccctcagggtccct

SEQ ID NO: 4698599 - DNA, 18 bp, Homo sapiens
ctggcgtcatgcaaagtc

SEQ ID NO: 4698600 - DNA, 19 bp, Homo sapiens
ctggcgtcatgcaaagtca

SEQ ID NO: 4698601 - DNA, 23 bp, Homo sapiens
ctggcgtcctctccctcctggcc

SEQ ID NO: 4698602 - DNA, 14 bp, Homo sapiens
ctggcgtgcagtgg

SEQ ID NO: 4698603 - DNA, 15 bp, Homo sapiens
ctggcgtgcagtggt

SEQ ID NO: 4698604 - DNA, 14 bp, Homo sapiens
ctggctccagctgg

SEQ ID NO: 4698605 - DNA, 18 bp, Homo sapiens
ctggctccagctggccgg

SEQ ID NO: 4698606 - DNA, 20 bp, Homo sapiens
ctggctccagctggccggga

SEQ ID NO: 4698607 - DNA, 14 bp, Homo sapiens
ctggctcttccagg

SEQ ID NO: 4698608 - DNA, 19 bp, Homo sapiens
ctggctcttccaggctggg

SEQ ID NO: 4698609 - DNA, 12 bp, Homo sapiens
ctggctgaagga

SEQ ID NO: 4698610 - DNA, 15 bp, Homo sapiens
ctggctgaaggactg

SEQ ID NO: 4698611 - DNA, 18 bp, Homo sapiens
ctggctgcctccactccc

SEQ ID NO: 4698612 - DNA, 22 bp, Homo sapiens
ctggctgcctccactcccactt

SEQ ID NO: 4698613 - DNA, 14 bp, Homo sapiens
ctggctgtgacaat

SEQ ID NO: 4698614 - DNA, 16 bp, Homo sapiens
ctggctgttggctggg

SEQ ID NO: 4698615 - DNA, 17 bp, Homo sapiens
ctggctgttggctgggg

SEQ ID NO: 4698616 - DNA, 14 bp, Homo sapiens
ctggcttcacagat

SEQ ID NO: 4698617 - DNA, 16 bp, Homo sapiens
ctggcttcgcaaaatg

SEQ ID NO: 4698618 - DNA, 13 bp, Homo sapiens
ctgggacacagtt

SEQ ID NO: 4698619 - DNA, 14 bp, Homo sapiens
ctgggacatgggaa

SEQ ID NO: 4698620 - DNA, 18 bp, Homo sapiens
ctgggacatgggaaaggg

SEQ ID NO: 4698621 - DNA, 13 bp, Homo sapiens
ctgggactacagg

SEQ ID NO: 4698622 - DNA, 23 bp, Homo sapiens
ctgggagaaagaccatgcattta

SEQ ID NO: 4698623 - DNA, 17 bp, Homo sapiens
ctgggagagccttccag

SEQ ID NO: 4698624 - DNA, 18 bp, Homo sapiens
ctgggagagccttccagg

SEQ ID NO: 4698625 - DNA, 13 bp, Homo sapiens
ctgggagggcagc

SEQ ID NO: 4698626 - DNA, 15 bp, Homo sapiens
ctgggagggcagcag

SEQ ID NO: 4698627 - DNA, 22 bp, Homo sapiens
ctgggagggcagcagggctacc

SEQ ID NO: 4698628 - DNA, 21 bp, Homo sapiens
ctgggattacaggcgtgagcc

SEQ ID NO: 4698629 - DNA, 18 bp, Homo sapiens
cttacctaccacatgcca

SEQ ID NO: 4698630 - DNA, 18 bp, Homo sapiens
cttactaaaaagtataaa

SEQ ID NO: 4698631 - DNA, 14 bp, Homo sapiens
cttactccaggaga

SEQ ID NO: 4698632 - DNA, 22 bp, Homo sapiens
cttactgaagaaatctttccag

SEQ ID NO: 4698633 - DNA, 18 bp, Homo sapiens
cttactgtggaggaagga

SEQ ID NO: 4698634 - DNA, 15 bp, Homo sapiens
cttactttgtgcaaa

SEQ ID NO: 4698635 - DNA, 14 bp, Homo sapiens
cttagacagtccct

SEQ ID NO: 4698636 - DNA, 17 bp, Homo sapiens
cttagacagtccctgcc

SEQ ID NO: 4698637 - DNA, 18 bp, Homo sapiens
cttagacagtccctgcca

SEQ ID NO: 4698638 - DNA, 11 bp, Homo sapiens
cttagagcagt

SEQ ID NO: 4698639 - DNA, 15 bp, Homo sapiens
cttagattgtgttcc

SEQ ID NO: 4698640 - DNA, 13 bp, Homo sapiens
cttagattttctg

SEQ ID NO: 4698641 - DNA, 14 bp, Homo sapiens
cttagcagatgctg

SEQ ID NO: 4698642 - DNA, 17 bp, Homo sapiens
cttagcccccacccact

SEQ ID NO: 4698643 - DNA, 20 bp, Homo sapiens
cttagcccccacccacttcc

SEQ ID NO: 4698644 - DNA, 17 bp, Homo sapiens
cttagctcccctccaac

SEQ ID NO: 4698645 - DNA, 17 bp, Homo sapiens
cttagctttttaattgt

SEQ ID NO: 4698646 - DNA, 15 bp, Homo sapiens
cttaggaagaatttt

SEQ ID NO: 4698647 - DNA, 18 bp, Homo sapiens
cttagttcttaccttttg

SEQ ID NO: 4698648 - DNA, 17 bp, Homo sapiens
cttataaaccaatctta

SEQ ID NO: 4698649 - DNA, 18 bp, Homo sapiens
cttataaaccaatcttaa

SEQ ID NO: 4698650 - DNA, 20 bp, Homo sapiens
cttataaagtggaagtatgt

SEQ ID NO: 4698651 - DNA, 24 bp, Homo sapiens
cttataaagtggaagtatgtatat

SEQ ID NO: 4698652 - DNA, 13 bp, Homo sapiens
cttataatttaaa

SEQ ID NO: 4698653 - DNA, 13 bp, Homo sapiens
cttataggtggcc

SEQ ID NO: 4698654 - DNA, 22 bp, Homo sapiens
cttatctcagtcatgcataaat

SEQ ID NO: 4698655 - DNA, 12 bp, Homo sapiens
cttatgcttcca

SEQ ID NO: 4698656 - DNA, 21 bp, Homo sapiens
cttatgggctgggttctaccc

SEQ ID NO: 4698657 - DNA, 21 bp, Homo sapiens
cttattagagtgtctttccac

SEQ ID NO: 4698658 - DNA, 21 bp, Homo sapiens
cttattctatactttcttgta

SEQ ID NO: 4698659 - DNA, 13 bp, Homo sapiens
cttattgaatata

SEQ ID NO: 4698660 - DNA, 18 bp, Homo sapiens
cttatttatattcatcaa

SEQ ID NO: 4698661 - DNA, 23 bp, Homo sapiens
cttatttgctgccacacctgagc

SEQ ID NO: 4698662 - DNA, 16 bp, Homo sapiens
cttcaaaaactaaaat

SEQ ID NO: 4698663 - DNA, 20 bp, Homo sapiens
cttcaaaatgttctatttaa

SEQ ID NO: 4698664 - DNA, 23 bp, Homo sapiens
cttcaaactagggccaagcccag

SEQ ID NO: 4698665 - DNA, 16 bp, Homo sapiens
cttcaactccctgccc

SEQ ID NO: 4698666 - DNA, 20 bp, Homo sapiens
cttcaagtgagtggcatgtg

SEQ ID NO: 4698667 - DNA, 20 bp, Homo sapiens
cttcaatgatcaaattttga

SEQ ID NO: 4698668 - DNA, 14 bp, Homo sapiens
cttcacctttgtcc

SEQ ID NO: 4698669 - DNA, 13 bp, Homo sapiens
cttcactgtataa

SEQ ID NO: 4698670 - DNA, 16 bp, Homo sapiens
cttcactgtataaata

SEQ ID NO: 4698671 - DNA, 19 bp, Homo sapiens
cttcagagactcctgcagg

SEQ ID NO: 4698672 - DNA, 20 bp, Homo sapiens
cttcagagctgacacaggat

SEQ ID NO: 4698673 - DNA, 19 bp, Homo sapiens
cttcagccctcacccctgg

SEQ ID NO: 4698674 - DNA, 14 bp, Homo sapiens
cttcagcctcccga

SEQ ID NO: 4698675 - DNA, 19 bp, Homo sapiens
cttcagctggtggatggtg

SEQ ID NO: 4698676 - DNA, 18 bp, Homo sapiens
cttcaggggctgcccgct

SEQ ID NO: 4698677 - DNA, 19 bp, Homo sapiens
cttcaggggctgcccgctc

SEQ ID NO: 4698678 - DNA, 21 bp, Homo sapiens
cttcaggttatcgaaataaca

SEQ ID NO: 4698679 - DNA, 15 bp, Homo sapiens
cttcagtactcaaat

SEQ ID NO: 4698680 - DNA, 15 bp, Homo sapiens
cttcagtggcagctg

SEQ ID NO: 4698681 - DNA, 17 bp, Homo sapiens
cttcagtggcagctgct

SEQ ID NO: 4698682 - DNA, 16 bp, Homo sapiens
cttcatagaatactca

SEQ ID NO: 4698683 - DNA, 16 bp, Homo sapiens
cttcatgacagcctcc

SEQ ID NO: 4698684 - DNA, 15 bp, Homo sapiens
cttcatggcagaagg

SEQ ID NO: 4698685 - DNA, 15 bp, Homo sapiens
cttcattagagcagg

SEQ ID NO: 4698686 - DNA, 16 bp, Homo sapiens
cttcattagagcaggc

SEQ ID NO: 4698687 - DNA, 18 bp, Homo sapiens
cttcatttcctgtgtctt

SEQ ID NO: 4698688 - DNA, 14 bp, Homo sapiens
cttcattttttaaa

SEQ ID NO: 4698689 - DNA, 16 bp, Homo sapiens
cttcattttttaaaaa

SEQ ID NO: 4698690 - DNA, 13 bp, Homo sapiens
cttccaaacaaaa

SEQ ID NO: 4698691 - DNA, 16 bp, Homo sapiens
cttccaaatcccctaa

SEQ ID NO: 4698692 - DNA, 23 bp, Homo sapiens
cttccacacccccaccccttgct

SEQ ID NO: 4698693 - DNA, 17 bp, Homo sapiens
cttccagagctctgacc

SEQ ID NO: 4698694 - DNA, 19 bp, Homo sapiens
cttccagagctctgaccca

SEQ ID NO: 4698695 - DNA, 12 bp, Homo sapiens
cttccaggctgg

SEQ ID NO: 4698696 - DNA, 14 bp, Homo sapiens
cttccaggctggga

SEQ ID NO: 4698697 - DNA, 14 bp, Homo sapiens
cttccaggggtggg

SEQ ID NO: 4698698 - DNA, 22 bp, Homo sapiens
cttccaggggtgggacaccctg

SEQ ID NO: 4698699 - DNA, 15 bp, Homo sapiens
cttccagtgaggctc

SEQ ID NO: 4698700 - DNA, 20 bp, Homo sapiens
cttccagtgaggctctgccc

SEQ ID NO: 4698701 - DNA, 21 bp, Homo sapiens
cttccagtgaggctctgccct

SEQ ID NO: 4698702 - DNA, 22 bp, Homo sapiens
cttccagtgaggctctgccctt

SEQ ID NO: 4698703 - DNA, 23 bp, Homo sapiens
cttccagtgaggctctgcccttg

SEQ ID NO: 4698704 - DNA, 13 bp, Homo sapiens
cttccatttgcaa

SEQ ID NO: 4698705 - DNA, 22 bp, Homo sapiens
cttcccagaggggcctgccacc

SEQ ID NO: 4698706 - DNA, 19 bp, Homo sapiens
cttcccagtataagatttt

SEQ ID NO: 4698707 - DNA, 22 bp, Homo sapiens
cttcccagtataagatttttga

SEQ ID NO: 4698708 - DNA, 14 bp, Homo sapiens
cttcccagtggctg

SEQ ID NO: 4698709 - DNA, 17 bp, Homo sapiens
cttcccagtggctgctg

SEQ ID NO: 4698710 - DNA, 18 bp, Homo sapiens
cttcccagtggctgctgc

SEQ ID NO: 4698711 - DNA, 20 bp, Homo sapiens
cttcccataccacccaatgc

SEQ ID NO: 4698712 - DNA, 17 bp, Homo sapiens
cttcccatgacccaggc

SEQ ID NO: 4698713 - DNA, 21 bp, Homo sapiens
cttcccatgacccaggctggg

SEQ ID NO: 4698714 - DNA, 23 bp, Homo sapiens
cttcccatgacccaggctgggca

SEQ ID NO: 4698715 - DNA, 11 bp, Homo sapiens
cttccccatac

SEQ ID NO: 4698716 - DNA, 22 bp, Homo sapiens
cttccccgagggatgatgccac

SEQ ID NO: 4698717 - DNA, 23 bp, Homo sapiens
cttcccctcctacccctcccagc

SEQ ID NO: 4698718 - DNA, 17 bp, Homo sapiens
cttccctatctttgcca

SEQ ID NO: 4698719 - DNA, 20 bp, Homo sapiens
cttccctgactcattctgaa

SEQ ID NO: 4698720 - DNA, 18 bp, Homo sapiens
cttcctaattccacagct

SEQ ID NO: 4698721 - DNA, 12 bp, Homo sapiens
cttcctcccctc

SEQ ID NO: 4698722 - DNA, 14 bp, Homo sapiens
cttcctcccctcgc

SEQ ID NO: 4698723 - DNA, 12 bp, Homo sapiens
cttcctcctggg

SEQ ID NO: 4698724 - DNA, 14 bp, Homo sapiens
cttcctggagactg

SEQ ID NO: 4698725 - DNA, 22 bp, Homo sapiens
cttcctggagcccagaggaggg

SEQ ID NO: 4698726 - DNA, 15 bp, Homo sapiens
cttcgccacctgggt

SEQ ID NO: 4698727 - DNA, 21 bp, Homo sapiens
cttcgtgggatctgcccctcc

SEQ ID NO: 4698728 - DNA, 15 bp, Homo sapiens
cttctatcctgttaa

SEQ ID NO: 4698729 - DNA, 16 bp, Homo sapiens
cttctatttatttatt

SEQ ID NO: 4698730 - DNA, 18 bp, Homo sapiens
cttctcatcactcccctc

SEQ ID NO: 4698731 - DNA, 15 bp, Homo sapiens
cttctcatttcaccc

SEQ ID NO: 4698732 - DNA, 17 bp, Homo sapiens
cttctcatttcacccct

SEQ ID NO: 4698733 - DNA, 12 bp, Homo sapiens
cttctccccaga

SEQ ID NO: 4698734 - DNA, 22 bp, Homo sapiens
cttctcccccccggggctgggt

SEQ ID NO: 4698735 - DNA, 22 bp, Homo sapiens
cttctccctcatttcaggagca

SEQ ID NO: 4698736 - DNA, 12 bp, Homo sapiens
cttctctccagc

SEQ ID NO: 4698737 - DNA, 13 bp, Homo sapiens
cttctctctgtgg

SEQ ID NO: 4698738 - DNA, 16 bp, Homo sapiens
cttctctctgtgggat

SEQ ID NO: 4698739 - DNA, 13 bp, Homo sapiens
gaaaagctgctga

SEQ ID NO: 4698740 - DNA, 17 bp, Homo sapiens
gaaaaggtaaggtgaag

SEQ ID NO: 4698741 - DNA, 20 bp, Homo sapiens
gaaaagtatattgataacct

SEQ ID NO: 4698742 - DNA, 19 bp, Homo sapiens
gaaaagttttgtaaatttc

SEQ ID NO: 4698743 - DNA, 16 bp, Homo sapiens
gaaaataaagaatgga

SEQ ID NO: 4698744 - DNA, 19 bp, Homo sapiens
gaaaataacgataaaagac

SEQ ID NO: 4698745 - DNA, 18 bp, Homo sapiens
gaaaatagggtccttgaa

SEQ ID NO: 4698746 - DNA, 21 bp, Homo sapiens
gaaaatagggtccttgaaaca

SEQ ID NO: 4698747 - DNA, 19 bp, Homo sapiens
gaaaatcttataatttaaa

SEQ ID NO: 4698748 - DNA, 18 bp, Homo sapiens
gaaaatgcaacaacatgt

SEQ ID NO: 4698749 - DNA, 12 bp, Homo sapiens
gaaaatgcctgt

SEQ ID NO: 4698750 - DNA, 10 bp, Homo sapiens
gaaaatgtgt

SEQ ID NO: 4698751 - DNA, 12 bp, Homo sapiens
gaaaatgtgtct

SEQ ID NO: 4698752 - DNA, 13 bp, Homo sapiens
gaaaatgtgtctg

SEQ ID NO: 4698753 - DNA, 13 bp, Homo sapiens
gaaaattaacact

SEQ ID NO: 4698754 - DNA, 15 bp, Homo sapiens
gaaaattaacactgc

SEQ ID NO: 4698755 - DNA, 16 bp, Homo sapiens
gaaaattttttttcaa

SEQ ID NO: 4698756 - DNA, 20 bp, Homo sapiens
gaaacaactctttgagaaac

SEQ ID NO: 4698757 - DNA, 18 bp, Homo sapiens
gaaacagctaatgggaca

SEQ ID NO: 4698758 - DNA, 20 bp, Homo sapiens
gaaaccacagctgctggaga

SEQ ID NO: 4698759 - DNA, 21 bp, Homo sapiens
gaaaccattatgaagaagaga

SEQ ID NO: 4698760 - DNA, 23 bp, Homo sapiens
gaaacccagctctggtccataga

SEQ ID NO: 4698761 - DNA, 14 bp, Homo sapiens
gaaaccctccaaat

SEQ ID NO: 4698762 - DNA, 14 bp, Homo sapiens
gaaacctgggagag

SEQ ID NO: 4698763 - DNA, 17 bp, Homo sapiens
gaaaccttttttaagat

SEQ ID NO: 4698764 - DNA, 18 bp, Homo sapiens
gaaaccttttttaagatt

SEQ ID NO: 4698765 - DNA, 13 bp, Homo sapiens
gaaacgtggcagg

SEQ ID NO: 4698766 - DNA, 15 bp, Homo sapiens
gaaactcttatctca

SEQ ID NO: 4698767 - DNA, 16 bp, Homo sapiens
gaaactcttatctcag

SEQ ID NO: 4698768 - DNA, 21 bp, Homo sapiens
gaaactcttatctcagtcatg

SEQ ID NO: 4698769 - DNA, 23 bp, Homo sapiens
gaaactcttatctcagtcatgca

SEQ ID NO: 4698770 - DNA, 18 bp, Homo sapiens
gaaactgtgaatgcttct

SEQ ID NO: 4698771 - DNA, 20 bp, Homo sapiens
gaaactgtgaatgcttctga

SEQ ID NO: 4698772 - DNA, 22 bp, Homo sapiens
gaaagaaagttgcacggctgct

SEQ ID NO: 4698773 - DNA, 23 bp, Homo sapiens
gaaagaaagttgcacggctgctg

SEQ ID NO: 4698774 - DNA, 14 bp, Homo sapiens
gaaagacagagctg

SEQ ID NO: 4698775 - DNA, 22 bp, Homo sapiens
gaaagaccatgcatttaaagta

SEQ ID NO: 4698776 - DNA, 15 bp, Homo sapiens
gaaagagtaggaaga

SEQ ID NO: 4698777 - DNA, 16 bp, Homo sapiens
gaaagagtaggaagac

SEQ ID NO: 4698778 - DNA, 11 bp, Homo sapiens
gaaagatatct

SEQ ID NO: 4698779 - DNA, 15 bp, Homo sapiens
gaaagatatctatga

SEQ ID NO: 4698780 - DNA, 15 bp, Homo sapiens
gaaagcacaggtggg

SEQ ID NO: 4698781 - DNA, 16 bp, Homo sapiens
gaaagcttcagtgctg

SEQ ID NO: 4698782 - DNA, 21 bp, Homo sapiens
gaaaggctccaggagcagcca

SEQ ID NO: 4698783 - DNA, 22 bp, Homo sapiens
gaaaggctccaggagcagccac

SEQ ID NO: 4698784 - DNA, 14 bp, Homo sapiens
gaaaggttgcgttt

SEQ ID NO: 4698785 - DNA, 17 bp, Homo sapiens
gaaagttttgttctgta

SEQ ID NO: 4698786 - DNA, 13 bp, Homo sapiens
gaaatattaaaat

SEQ ID NO: 4698787 - DNA, 15 bp, Homo sapiens
gaaatattccctaga

SEQ ID NO: 4698788 - DNA, 21 bp, Homo sapiens
gaaatcatcaaaaagaaaaat

SEQ ID NO: 4698789 - DNA, 19 bp, Homo sapiens
gaaatcttacagctgggtg

SEQ ID NO: 4698790 - DNA, 17 bp, Homo sapiens
gaaatggcttttcccaa

SEQ ID NO: 4698791 - DNA, 18 bp, Homo sapiens
gaaatgtagatgatatgt

SEQ ID NO: 4698792 - DNA, 16 bp, Homo sapiens
gaaattaatttgtgaa

SEQ ID NO: 4698793 - DNA, 20 bp, Homo sapiens
gaaattaatttgtgaatttg

SEQ ID NO: 4698794 - DNA, 21 bp, Homo sapiens
gaaattaatttgtgaatttgc

SEQ ID NO: 4698795 - DNA, 16 bp, Homo sapiens
gaaattacctgtggat

SEQ ID NO: 4698796 - DNA, 17 bp, Homo sapiens
gaaattacctgtggata

SEQ ID NO: 4698797 - DNA, 14 bp, Homo sapiens
gaaattcttcatga

SEQ ID NO: 4698798 - DNA, 16 bp, Homo sapiens
gaaattggaagagcac

SEQ ID NO: 4698799 - DNA, 18 bp, Homo sapiens
gaaatttagagtcaattt

SEQ ID NO: 4698800 - DNA, 12 bp, Homo sapiens
gaaatttcattt

SEQ ID NO: 4698801 - DNA, 13 bp, Homo sapiens
gaaatttcatttt

SEQ ID NO: 4698802 - DNA, 19 bp, Homo sapiens
gaaatttccactcaggtct

SEQ ID NO: 4698803 - DNA, 20 bp, Homo sapiens
gaaatttccactcaggtctg

SEQ ID NO: 4698804 - DNA, 23 bp, Homo sapiens
gaaatttgggagagccatacata

SEQ ID NO: 4698805 - DNA, 15 bp, Homo sapiens
gaacaaagtgagaca

SEQ ID NO: 4698806 - DNA, 23 bp, Homo sapiens
gaacaatcacaaaagctgtgtct

SEQ ID NO: 4698807 - DNA, 15 bp, Homo sapiens
gaacactccttcaca

SEQ ID NO: 4698808 - DNA, 15 bp, Homo sapiens
gaacagactggaagc

SEQ ID NO: 4698809 - DNA, 16 bp, Homo sapiens
gaacagactggaagca

SEQ ID NO: 4698810 - DNA, 20 bp, Homo sapiens
gaacagactggaagcacagc

SEQ ID NO: 4698811 - DNA, 18 bp, Homo sapiens
gaacagataatccctgta

SEQ ID NO: 4698812 - DNA, 17 bp, Homo sapiens
gaacagattcacactgt

SEQ ID NO: 4698813 - DNA, 14 bp, Homo sapiens
gaacatatcatttg

SEQ ID NO: 4698814 - DNA, 17 bp, Homo sapiens
gaacatatcatttgtga

SEQ ID NO: 4698815 - DNA, 21 bp, Homo sapiens
gaacatcatcaaggcactgcc

SEQ ID NO: 4698816 - DNA, 22 bp, Homo sapiens
gaacatcatcaaggcactgcct

SEQ ID NO: 4698817 - DNA, 20 bp, Homo sapiens
gaacatggtgtgtgtctctg

SEQ ID NO: 4698818 - DNA, 21 bp, Homo sapiens
gaacatggtgtgtgtctctga

SEQ ID NO: 4698819 - DNA, 17 bp, Homo sapiens
gaacatgtggcttgaat

SEQ ID NO: 4698820 - DNA, 17 bp, Homo sapiens
gaacatttaataatgta

SEQ ID NO: 4698821 - DNA, 21 bp, Homo sapiens
gaacatttaataatgtatgta

SEQ ID NO: 4698822 - DNA, 20 bp, Homo sapiens
gaaccacatcttgctctgct

SEQ ID NO: 4698823 - DNA, 19 bp, Homo sapiens
gaaccacattgaagaatgt

SEQ ID NO: 4698824 - DNA, 21 bp, Homo sapiens
gaaccaccacacccagcccac

SEQ ID NO: 4698825 - DNA, 15 bp, Homo sapiens
gaaccacctttgtct

SEQ ID NO: 4698826 - DNA, 19 bp, Homo sapiens
gaaccaggcttgcctggga

SEQ ID NO: 4698827 - DNA, 21 bp, Homo sapiens
gaacccaaagagacagctctt

SEQ ID NO: 4698828 - DNA, 21 bp, Homo sapiens
gaaccgaacatatcatttgtg

SEQ ID NO: 4698829 - DNA, 21 bp, Homo sapiens
gaacctacagttttaactgtg

SEQ ID NO: 4698830 - DNA, 23 bp, Homo sapiens
gaacctacagttttaactgtgga

SEQ ID NO: 4698831 - DNA, 17 bp, Homo sapiens
gaacctagaagggctag

SEQ ID NO: 4698832 - DNA, 13 bp, Homo sapiens
gaacctcctttct

SEQ ID NO: 4698833 - DNA, 17 bp, Homo sapiens
gaacctggaggggctag

SEQ ID NO: 4698834 - DNA, 21 bp, Homo sapiens
gaactatggacggtgctccag

SEQ ID NO: 4698835 - DNA, 18 bp, Homo sapiens
gaactcatccctaatgct

SEQ ID NO: 4698836 - DNA, 16 bp, Homo sapiens
gaactcctaaatcaag

SEQ ID NO: 4698837 - DNA, 14 bp, Homo sapiens
gaactcctggcctc

SEQ ID NO: 4698838 - DNA, 22 bp, Homo sapiens
gaactctgaaccacctttgtct

SEQ ID NO: 4698839 - DNA, 16 bp, Homo sapiens
gaactctgcaactgaa

SEQ ID NO: 4698840 - DNA, 22 bp, Homo sapiens
gaactgctagtcaagtgcgtcc

SEQ ID NO: 4698841 - DNA, 11 bp, Homo sapiens
gaactggaggc

SEQ ID NO: 4698842 - DNA, 11 bp, Homo sapiens
gaactggctgc

SEQ ID NO: 4698843 - DNA, 12 bp, Homo sapiens
gaactggctgca

SEQ ID NO: 4698844 - DNA, 18 bp, Homo sapiens
gaactgtggtgccacatg

SEQ ID NO: 4698845 - DNA, 17 bp, Homo sapiens
gaacttaagtctcgaat

SEQ ID NO: 4698846 - DNA, 19 bp, Homo sapiens
gaacttgagcctgtcaaga

SEQ ID NO: 4698847 - DNA, 15 bp, Homo sapiens
gaacttggaggcacc

SEQ ID NO: 4698848 - DNA, 17 bp, Homo sapiens
gaacttggaggcaccat

SEQ ID NO: 4698849 - DNA, 17 bp, Homo sapiens
gaattggtcttaatgtt

SEQ ID NO: 4698850 - DNA, 20 bp, Homo sapiens
gaattggtcttaatgttgaa

SEQ ID NO: 4698851 - DNA, 22 bp, Homo sapiens
gaattgttgacaaatgtaaaca

SEQ ID NO: 4698852 - DNA, 16 bp, Homo sapiens
gaatttaataatctgt

SEQ ID NO: 4698853 - DNA, 13 bp, Homo sapiens
gaatttataacaa

SEQ ID NO: 4698854 - DNA, 13 bp, Homo sapiens
gaatttataaccc

SEQ ID NO: 4698855 - DNA, 16 bp, Homo sapiens
gaatttgcaacagtaa

SEQ ID NO: 4698856 - DNA, 19 bp, Homo sapiens
gaatttgtccattgtaaat

SEQ ID NO: 4698857 - DNA, 16 bp, Homo sapiens
gacaaatgtaaacatt

SEQ ID NO: 4698858 - DNA, 22 bp, Homo sapiens
gacaacactcattgacctgagg

SEQ ID NO: 4698859 - DNA, 19 bp, Homo sapiens
gacaagaccctctcaggct

SEQ ID NO: 4698860 - DNA, 17 bp, Homo sapiens
gacaagcctgtccattg

SEQ ID NO: 4698861 - DNA, 22 bp, Homo sapiens
gacaaggattgctactgtccta

SEQ ID NO: 4698862 - DNA, 18 bp, Homo sapiens
gacacaatgttgcactga

SEQ ID NO: 4698863 - DNA, 17 bp, Homo sapiens
gacacacagctctgtcc

SEQ ID NO: 4698864 - DNA, 19 bp, Homo sapiens
gacacacagctctgtcctg

SEQ ID NO: 4698865 - DNA, 22 bp, Homo sapiens
gacacaccccaacatgcctgca

SEQ ID NO: 4698866 - DNA, 16 bp, Homo sapiens
gacacagctcttctcc

SEQ ID NO: 4698867 - DNA, 23 bp, Homo sapiens
gacacagctcttctccaggctgt

SEQ ID NO: 4698868 - DNA, 17 bp, Homo sapiens
gacacaggatgaaggca

SEQ ID NO: 4698869 - DNA, 18 bp, Homo sapiens
gacacaggcccggctcca

SEQ ID NO: 4698870 - DNA, 19 bp, Homo sapiens
gacacaggcccggctccag

SEQ ID NO: 4698871 - DNA, 21 bp, Homo sapiens
gacacaggcccggctccaggc

SEQ ID NO: 4698872 - DNA, 20 bp, Homo sapiens
gacacatgtccaagaagccc

SEQ ID NO: 4698873 - DNA, 23 bp, Homo sapiens
gacacatgtccaagaagcccagg

SEQ ID NO: 4698874 - DNA, 16 bp, Homo sapiens
gacacatgtggagaag

SEQ ID NO: 4698875 - DNA, 19 bp, Homo sapiens
gacacattgccccatgaga

SEQ ID NO: 4698876 - DNA, 17 bp, Homo sapiens
gacaccccccttctgaa

SEQ ID NO: 4698877 - DNA, 21 bp, Homo sapiens
gacaccccccttctgaatgaa

SEQ ID NO: 4698878 - DNA, 20 bp, Homo sapiens
gacaccttgacagggcacac

SEQ ID NO: 4698879 - DNA, 15 bp, Homo sapiens
gacactaaccacgct

SEQ ID NO: 4698880 - DNA, 16 bp, Homo sapiens
gacactaaccacgctg

SEQ ID NO: 4698881 - DNA, 13 bp, Homo sapiens
gacacttctcagg

SEQ ID NO: 4698882 - DNA, 16 bp, Homo sapiens
gacacttctcaggaaa

SEQ ID NO: 4698883 - DNA, 15 bp, Homo sapiens
gacagaagcagctct

SEQ ID NO: 4698884 - DNA, 20 bp, Homo sapiens
gacagaatggctatcaaaag

SEQ ID NO: 4698885 - DNA, 15 bp, Homo sapiens
gacagagacctcctg

SEQ ID NO: 4698886 - DNA, 16 bp, Homo sapiens
gacagagacctcctgc

SEQ ID NO: 4698887 - DNA, 12 bp, Homo sapiens
gacagaggcagc

SEQ ID NO: 4698888 - DNA, 14 bp, Homo sapiens
gacagaggcagccc

SEQ ID NO: 4698889 - DNA, 13 bp, Homo sapiens
gacagagggggtg

SEQ ID NO: 4698890 - DNA, 15 bp, Homo sapiens
gacagagggggtggc

SEQ ID NO: 4698891 - DNA, 20 bp, Homo sapiens
gacagagtgagactctgtct

SEQ ID NO: 4698892 - DNA, 18 bp, Homo sapiens
gacagatatatttaagcc

SEQ ID NO: 4698893 - DNA, 19 bp, Homo sapiens
gacagcactcctcggcagg

SEQ ID NO: 4698894 - DNA, 13 bp, Homo sapiens
gacagcatttaaa

SEQ ID NO: 4698895 - DNA, 13 bp, Homo sapiens
gacagccacggcc

SEQ ID NO: 4698896 - DNA, 15 bp, Homo sapiens
gacagccccctgccc

SEQ ID NO: 4698897 - DNA, 17 bp, Homo sapiens
gacagcccgggctctgc

SEQ ID NO: 4698898 - DNA, 19 bp, Homo sapiens
gacagcccgggctctgcct

SEQ ID NO: 4698899 - DNA, 14 bp, Homo sapiens
gacagctccttctg

SEQ ID NO: 4698900 - DNA, 18 bp, Homo sapiens
gacagctccttctgtcct

SEQ ID NO: 4698901 - DNA, 12 bp, Homo sapiens
gacagctgcctg

SEQ ID NO: 4698902 - DNA, 13 bp, Homo sapiens
gacagctgcctgg

SEQ ID NO: 4698903 - DNA, 14 bp, Homo sapiens
gacagctgcctggg

SEQ ID NO: 4698904 - DNA, 17 bp, Homo sapiens
gacaggcaagcacctcc

SEQ ID NO: 4698905 - DNA, 20 bp, Homo sapiens
gacaggcaagcacctcctgc

SEQ ID NO: 4698906 - DNA, 18 bp, Homo sapiens
gacaggcaatgctggctg

SEQ ID NO: 4698907 - DNA, 24 bp, Homo sapiens
gacaggcaatgctggctgttggct

SEQ ID NO: 4698908 - DNA, 22 bp, Homo sapiens
gacagggttttgccatgttggc

SEQ ID NO: 4698909 - DNA, 16 bp, Homo sapiens
gacagtccagcctgga

SEQ ID NO: 4698910 - DNA, 20 bp, Homo sapiens
gacagtccctgccaatggac

SEQ ID NO: 4698911 - DNA, 19 bp, Homo sapiens
gacagtctttgatcatcat

SEQ ID NO: 4698912 - DNA, 14 bp, Homo sapiens
gacagtttcttagc

SEQ ID NO: 4698913 - DNA, 20 bp, Homo sapiens
gacagtttcttagcttttta

SEQ ID NO: 4698914 - DNA, 15 bp, Homo sapiens
gacataaatgttcac

SEQ ID NO: 4698915 - DNA, 16 bp, Homo sapiens
gacataaatgttcact

SEQ ID NO: 4698916 - DNA, 16 bp, Homo sapiens
gacatattatgcctga

SEQ ID NO: 4698917 - DNA, 13 bp, Homo sapiens
gacatcgatatga

SEQ ID NO: 4698918 - DNA, 17 bp, Homo sapiens
gacatgtcttttcttgc

SEQ ID NO: 4698919 - DNA, 23 bp, Homo sapiens
gacatgtgaaaccttttttaaga

SEQ ID NO: 4698920 - DNA, 13 bp, Homo sapiens
gacattcatgcct

SEQ ID NO: 4698921 - DNA, 16 bp, Homo sapiens
gacattcatgcctggc

SEQ ID NO: 4698922 - DNA, 18 bp, Homo sapiens
gacattcatgcctggctt

SEQ ID NO: 4698923 - DNA, 23 bp, Homo sapiens
gacattccgtcctgatgattttt

SEQ ID NO: 4698924 - DNA, 18 bp, Homo sapiens
gacattctgtctttcaaa

SEQ ID NO: 4698925 - DNA, 16 bp, Homo sapiens
gacattgaaactacac

SEQ ID NO: 4698926 - DNA, 16 bp, Homo sapiens
gacattttatgtcttt

SEQ ID NO: 4698927 - DNA, 20 bp, Homo sapiens
gacattttatgtctttcttg

SEQ ID NO: 4698928 - DNA, 17 bp, Homo sapiens
gaccaaaatccccttct

SEQ ID NO: 4698929 - DNA, 13 bp, Homo sapiens
gaccaaacctagc

SEQ ID NO: 4698930 - DNA, 15 bp, Homo sapiens
gaccaagggcagagg

SEQ ID NO: 4698931 - DNA, 18 bp, Homo sapiens
gaccaaggttccagctca

SEQ ID NO: 4698932 - DNA, 18 bp, Homo sapiens
gaccaatattgtacagtt

SEQ ID NO: 4698933 - DNA, 22 bp, Homo sapiens
gaccacctttgtttctccccca

SEQ ID NO: 4698934 - DNA, 18 bp, Homo sapiens
gaccagaaacctgggaga

SEQ ID NO: 4698935 - DNA, 15 bp, Homo sapiens
gaccagcctggccca

SEQ ID NO: 4698936 - DNA, 11 bp, Homo sapiens
gaccaggaaag

SEQ ID NO: 4698937 - DNA, 18 bp, Homo sapiens
gaccagggatttccatga

SEQ ID NO: 4698938 - DNA, 17 bp, Homo sapiens
gaccagtcaacctgggc

SEQ ID NO: 4698939 - DNA, 12 bp, Homo sapiens
gaccatccctga

SEQ ID NO: 4698940 - DNA, 13 bp, Homo sapiens
gaccatccctgaa

SEQ ID NO: 4698941 - DNA, 17 bp, Homo sapiens
gaccatccctgaaggcc

SEQ ID NO: 4698942 - DNA, 14 bp, Homo sapiens
gaccatgtgattat

SEQ ID NO: 4698943 - DNA, 16 bp, Homo sapiens
gaccattctccacctg

SEQ ID NO: 4698944 - DNA, 17 bp, Homo sapiens
gaccattctccacctgc

SEQ ID NO: 4698945 - DNA, 19 bp, Homo sapiens
gacccactggactcacctc

SEQ ID NO: 4698946 - DNA, 13 bp, Homo sapiens
gacccaggctggg

SEQ ID NO: 4698947 - DNA, 15 bp, Homo sapiens
gacccattccttccc

SEQ ID NO: 4698948 - DNA, 13 bp, Homo sapiens
gaccccctccccc

SEQ ID NO: 4698949 - DNA, 11 bp, Homo sapiens
gacccctcctc

SEQ ID NO: 4698950 - DNA, 20 bp, Homo sapiens
gaccccttttcagcttctgc

SEQ ID NO: 4698951 - DNA, 21 bp, Homo sapiens
gaccctagttattttctgaaa

SEQ ID NO: 4698952 - DNA, 16 bp, Homo sapiens
gaccctctcaggctgt

SEQ ID NO: 4698953 - DNA, 10 bp, Homo sapiens
gaccctgagg

SEQ ID NO: 4698954 - DNA, 16 bp, Homo sapiens
gaccctgaggcccaga

SEQ ID NO: 4698955 - DNA, 22 bp, Homo sapiens
gaccctgaggcccagagggcct

SEQ ID NO: 4698956 - DNA, 12 bp, Homo sapiens
gaccctgccctg

SEQ ID NO: 4698957 - DNA, 15 bp, Homo sapiens
gaccctgccctgtgg

SEQ ID NO: 4698958 - DNA, 13 bp, Homo sapiens
gaccctgctcaca

SEQ ID NO: 4698959 - DNA, 14 bp, Homo sapiens
gaccctgggtggga

SEQ ID NO: 4698960 - DNA, 16 bp, Homo sapiens
gagctgaggcagcagt

SEQ ID NO: 4698961 - DNA, 15 bp, Homo sapiens
gagctgcctggaccc

SEQ ID NO: 4698962 - DNA, 16 bp, Homo sapiens
gagctgcctgttcagc

SEQ ID NO: 4698963 - DNA, 20 bp, Homo sapiens
gagctgcctgttcagctcca

SEQ ID NO: 4698964 - DNA, 21 bp, Homo sapiens
gagctgcctgttcagctccag

SEQ ID NO: 4698965 - DNA, 14 bp, Homo sapiens
gagctggagcctgg

SEQ ID NO: 4698966 - DNA, 18 bp, Homo sapiens
gagctgtgcaggtgggga

SEQ ID NO: 4698967 - DNA, 16 bp, Homo sapiens
gagcttcatggcagaa

SEQ ID NO: 4698968 - DNA, 17 bp, Homo sapiens
gagcttccctgactcat

SEQ ID NO: 4698969 - DNA, 18 bp, Homo sapiens
gagcttctgttgctgcct

SEQ ID NO: 4698970 - DNA, 18 bp, Homo sapiens
gagcttgtaataaatact

SEQ ID NO: 4698971 - DNA, 13 bp, Homo sapiens
gaggaagccgctg

SEQ ID NO: 4698972 - DNA, 14 bp, Homo sapiens
gaggaagccgctgg

SEQ ID NO: 4698973 - DNA, 21 bp, Homo sapiens
gaggaaggaaacccagctctg

SEQ ID NO: 4698974 - DNA, 14 bp, Homo sapiens
gaggaaggattgta

SEQ ID NO: 4698975 - DNA, 14 bp, Homo sapiens
gaggacaaaataaa

SEQ ID NO: 4698976 - DNA, 15 bp, Homo sapiens
gaggacaaaataaag

SEQ ID NO: 4698977 - DNA, 19 bp, Homo sapiens
gaggacccgccggatgaca

SEQ ID NO: 4698978 - DNA, 20 bp, Homo sapiens
gaggagagagcagcttctgc

SEQ ID NO: 4698979 - DNA, 21 bp, Homo sapiens
gaggagagagcagcttctgcc

SEQ ID NO: 4698980 - DNA, 17 bp, Homo sapiens
gaggagcagtgcaggca

SEQ ID NO: 4698981 - DNA, 21 bp, Homo sapiens
gaggagcccaggccaggactc

SEQ ID NO: 4698982 - DNA, 21 bp, Homo sapiens
gaggagcctgggggctcctca

SEQ ID NO: 4698983 - DNA, 21 bp, Homo sapiens
gaggaggcctgggggcaggga

SEQ ID NO: 4698984 - DNA, 18 bp, Homo sapiens
gaggatcacagtgctgag

SEQ ID NO: 4698985 - DNA, 16 bp, Homo sapiens
gaggatgagagcccag

SEQ ID NO: 4698986 - DNA, 17 bp, Homo sapiens
gaggcacttcctcccct

SEQ ID NO: 4698987 - DNA, 22 bp, Homo sapiens
gaggcacttcctcccctcgccc

SEQ ID NO: 4698988 - DNA, 20 bp, Homo sapiens
gaggcagaggttgcagtgag

SEQ ID NO: 4698989 - DNA, 20 bp, Homo sapiens
gaggcagcagtgtgaggcca

SEQ ID NO: 4698990 - DNA, 22 bp, Homo sapiens
gaggcagcagtgtgaggccagg

SEQ ID NO: 4698991 - DNA, 13 bp, Homo sapiens
gaggcagccccat

SEQ ID NO: 4698992 - DNA, 20 bp, Homo sapiens
gaggcagggtctcactctgt

SEQ ID NO: 4698993 - DNA, 13 bp, Homo sapiens
gaggccagggata

SEQ ID NO: 4698994 - DNA, 19 bp, Homo sapiens
gaggccagggcagagtgag

SEQ ID NO: 4698995 - DNA, 17 bp, Homo sapiens
gaggccatgggcctcct

SEQ ID NO: 4698996 - DNA, 15 bp, Homo sapiens
gaggcccagagggcc

SEQ ID NO: 4698997 - DNA, 16 bp, Homo sapiens
gaggcccagagggcct

SEQ ID NO: 4698998 - DNA, 19 bp, Homo sapiens
gaggccccttctaggtggc

SEQ ID NO: 4698999 - DNA, 15 bp, Homo sapiens
gaggcccttctctcc

SEQ ID NO: 4699000 - DNA, 21 bp, Homo sapiens
gaggcccttctctccagcccc

SEQ ID NO: 4699001 - DNA, 17 bp, Homo sapiens
gaggccgagtctgtcct

SEQ ID NO: 4699002 - DNA, 18 bp, Homo sapiens
gaggccgagtctgtcctg

SEQ ID NO: 4699003 - DNA, 19 bp, Homo sapiens
gaggcggatctttggacag

SEQ ID NO: 4699004 - DNA, 20 bp, Homo sapiens
gaggcggccccggccggggt

SEQ ID NO: 4699005 - DNA, 22 bp, Homo sapiens
gaggctagtgtggtgtttcctg

SEQ ID NO: 4699006 - DNA, 14 bp, Homo sapiens
gaggctctgccctt

SEQ ID NO: 4699007 - DNA, 14 bp, Homo sapiens
gaggctgggctccc

SEQ ID NO: 4699008 - DNA, 20 bp, Homo sapiens
gaggctgggctcccttccca

SEQ ID NO: 4699009 - DNA, 17 bp, Homo sapiens
gagggaaactgtgaatg

SEQ ID NO: 4699010 - DNA, 19 bp, Homo sapiens
gagggaagccaggattggg

SEQ ID NO: 4699011 - DNA, 16 bp, Homo sapiens
gagggaatgaacctgg

SEQ ID NO: 4699012 - DNA, 15 bp, Homo sapiens
gagggacgcctgggg

SEQ ID NO: 4699013 - DNA, 14 bp, Homo sapiens
gagggagtgacaga

SEQ ID NO: 4699014 - DNA, 16 bp, Homo sapiens
gagggatctaggtctt

SEQ ID NO: 4699015 - DNA, 12 bp, Homo sapiens
gagggcacacac

SEQ ID NO: 4699016 - DNA, 15 bp, Homo sapiens
gagggcacacactgt

SEQ ID NO: 4699017 - DNA, 17 bp, Homo sapiens
gagggctagaacctaga

SEQ ID NO: 4699018 - DNA, 20 bp, Homo sapiens
gagggctagaacctggcagg

SEQ ID NO: 4699019 - DNA, 18 bp, Homo sapiens
gagggctagaactggaga

SEQ ID NO: 4699020 - DNA, 19 bp, Homo sapiens
gagggctagaatctggaga

SEQ ID NO: 4699021 - DNA, 20 bp, Homo sapiens
gagggctagaatctggagag

SEQ ID NO: 4699022 - DNA, 21 bp, Homo sapiens
gagggctagaatctggagagc

SEQ ID NO: 4699023 - DNA, 15 bp, Homo sapiens
gagggctggaatctg

SEQ ID NO: 4699024 - DNA, 19 bp, Homo sapiens
gagggctggaatctggaga

SEQ ID NO: 4699025 - DNA, 21 bp, Homo sapiens
gagggctggaatctggagagc

SEQ ID NO: 4699026 - DNA, 12 bp, Homo sapiens
gaggggaacaga

SEQ ID NO: 4699027 - DNA, 22 bp, Homo sapiens
gaggggacgcaggcccctctcc

SEQ ID NO: 4699028 - DNA, 12 bp, Homo sapiens
gaggggcctctt

SEQ ID NO: 4699029 - DNA, 19 bp, Homo sapiens
gaggggcctgccacctgga

SEQ ID NO: 4699030 - DNA, 20 bp, Homo sapiens
gaggggcctgccacctggac

SEQ ID NO: 4699031 - DNA, 13 bp, Homo sapiens
gaggggtgttgta

SEQ ID NO: 4699032 - DNA, 14 bp, Homo sapiens
gagggtctgaggaa

SEQ ID NO: 4699033 - DNA, 14 bp, Homo sapiens
gagggttgggctgg

SEQ ID NO: 4699034 - DNA, 15 bp, Homo sapiens
gagggttgggctggt

SEQ ID NO: 4699035 - DNA, 16 bp, Homo sapiens
gaggtaaaggatgagg

SEQ ID NO: 4699036 - DNA, 13 bp, Homo sapiens
gaggtaacagaac

SEQ ID NO: 4699037 - DNA, 17 bp, Homo sapiens
gaggtaacagaacagct

SEQ ID NO: 4699038 - DNA, 18 bp, Homo sapiens
gaggtatggaaagaacca

SEQ ID NO: 4699039 - DNA, 12 bp, Homo sapiens
gaggtcagagcc

SEQ ID NO: 4699040 - DNA, 22 bp, Homo sapiens
gaggtccagccctggctgaagg

SEQ ID NO: 4699041 - DNA, 18 bp, Homo sapiens
gaggtgggatcctccagg

SEQ ID NO: 4699042 - DNA, 20 bp, Homo sapiens
gaggtttctcaaagaaattt

SEQ ID NO: 4699043 - DNA, 15 bp, Homo sapiens
gagtaagaaacttca

SEQ ID NO: 4699044 - DNA, 19 bp, Homo sapiens
gagtactacagtcctccca

SEQ ID NO: 4699045 - DNA, 20 bp, Homo sapiens
gagtactacagtcctcccat

SEQ ID NO: 4699046 - DNA, 19 bp, Homo sapiens
gagtagaaactgcagggaa

SEQ ID NO: 4699047 - DNA, 14 bp, Homo sapiens
gagtagctgggact

SEQ ID NO: 4699048 - DNA, 12 bp, Homo sapiens
gagtaggaagac

SEQ ID NO: 4699049 - DNA, 12 bp, Homo sapiens
gagtcaatttgc

SEQ ID NO: 4699050 - DNA, 15 bp, Homo sapiens
gagtcaatttgctga

SEQ ID NO: 4699051 - DNA, 14 bp, Homo sapiens
gagtcaccaagccc

SEQ ID NO: 4699052 - DNA, 15 bp, Homo sapiens
gagtcaccaagccca

SEQ ID NO: 4699053 - DNA, 18 bp, Homo sapiens
gagtcagctgaccccctc

SEQ ID NO: 4699054 - DNA, 22 bp, Homo sapiens
gagtcagctgaccccctccccc

SEQ ID NO: 4699055 - DNA, 12 bp, Homo sapiens
gagtcatgccaa

SEQ ID NO: 4699056 - DNA, 13 bp, Homo sapiens
gagtcccaccttg

SEQ ID NO: 4699057 - DNA, 19 bp, Homo sapiens
gagtcccaggctgagcctc

SEQ ID NO: 4699058 - DNA, 12 bp, Homo sapiens
gagtcccctgtt

SEQ ID NO: 4699059 - DNA, 15 bp, Homo sapiens
gagtcgaggacaggg

SEQ ID NO: 4699060 - DNA, 16 bp, Homo sapiens
gagtcgaggacaggga

SEQ ID NO: 4699061 - DNA, 22 bp, Homo sapiens
gagtctcccactgcaacttgtg

SEQ ID NO: 4699062 - DNA, 16 bp, Homo sapiens
gagtctctgaacatcc

SEQ ID NO: 4699063 - DNA, 13 bp, Homo sapiens
gagtctgaaggct

SEQ ID NO: 4699064 - DNA, 14 bp, Homo sapiens
gagtctgaaggctg

SEQ ID NO: 4699065 - DNA, 21 bp, Homo sapiens
gagtctgaaggctgggttctg

SEQ ID NO: 4699066 - DNA, 12 bp, Homo sapiens
gagtctgatgat

SEQ ID NO: 4699067 - DNA, 17 bp, Homo sapiens
gagtctggcaaacatgt

SEQ ID NO: 4699068 - DNA, 22 bp, Homo sapiens
gagtctggcaaacatgtgcaac

SEQ ID NO: 4699069 - DNA, 16 bp, Homo sapiens
gagtgactacacacag

SEQ ID NO: 4699070 - DNA, 20 bp, Homo sapiens
gcacaccgggcactcagaag

SEQ ID NO: 4699071 - DNA, 15 bp, Homo sapiens
gcacacctctggctg

SEQ ID NO: 4699072 - DNA, 16 bp, Homo sapiens
gcacacctctggctgt

SEQ ID NO: 4699073 - DNA, 16 bp, Homo sapiens
gcacacctttattcag

SEQ ID NO: 4699074 - DNA, 19 bp, Homo sapiens
gcacacgcacgcacacaca

SEQ ID NO: 4699075 - DNA, 20 bp, Homo sapiens
gcacacgcacgcacacacac

SEQ ID NO: 4699076 - DNA, 19 bp, Homo sapiens
gcacactcagttctgctct

SEQ ID NO: 4699077 - DNA, 20 bp, Homo sapiens
gcacacttggcccaagtggc

SEQ ID NO: 4699078 - DNA, 22 bp, Homo sapiens
gcacactttgccatattttcac

SEQ ID NO: 4699079 - DNA, 16 bp, Homo sapiens
gcacagaccctgccct

SEQ ID NO: 4699080 - DNA, 17 bp, Homo sapiens
gcacagaccctgccctg

SEQ ID NO: 4699081 - DNA, 18 bp, Homo sapiens
gcacagaccctgccctgt

SEQ ID NO: 4699082 - DNA, 19 bp, Homo sapiens
gcacagaccctgccctgtg

SEQ ID NO: 4699083 - DNA, 22 bp, Homo sapiens
gcacagaccctgccctgtgggc

SEQ ID NO: 4699084 - DNA, 14 bp, Homo sapiens
gcacagcaaggagg

SEQ ID NO: 4699085 - DNA, 11 bp, Homo sapiens
gcacagccctc

SEQ ID NO: 4699086 - DNA, 13 bp, Homo sapiens
gcacagccctccc

SEQ ID NO: 4699087 - DNA, 21 bp, Homo sapiens
gcacagccctcccgccccttc

SEQ ID NO: 4699088 - DNA, 16 bp, Homo sapiens
gcacagcttcatttcc

SEQ ID NO: 4699089 - DNA, 21 bp, Homo sapiens
gcacagcttcatttcctgtgt

SEQ ID NO: 4699090 - DNA, 23 bp, Homo sapiens
gcacagcttcatttcctgtgtct

SEQ ID NO: 4699091 - DNA, 18 bp, Homo sapiens
gcacagtgtctgggctga

SEQ ID NO: 4699092 - DNA, 18 bp, Homo sapiens
gcacatctgtgtcttgtt

SEQ ID NO: 4699093 - DNA, 15 bp, Homo sapiens
gcacatgttcatata

SEQ ID NO: 4699094 - DNA, 18 bp, Homo sapiens
gcacattttgacacaatg

SEQ ID NO: 4699095 - DNA, 16 bp, Homo sapiens
gcaccaacccagccgc

SEQ ID NO: 4699096 - DNA, 22 bp, Homo sapiens
gcaccaacccagccgctgcccg

SEQ ID NO: 4699097 - DNA, 15 bp, Homo sapiens
gcaccaagcaggaaa

SEQ ID NO: 4699098 - DNA, 23 bp, Homo sapiens
gcaccagggttgaccccagagga

SEQ ID NO: 4699099 - DNA, 14 bp, Homo sapiens
gcacccagagaaaa

SEQ ID NO: 4699100 - DNA, 16 bp, Homo sapiens
gcaccccctcctgctg

SEQ ID NO: 4699101 - DNA, 19 bp, Homo sapiens
gcaccccctcctgctgcag

SEQ ID NO: 4699102 - DNA, 14 bp, Homo sapiens
gcacccggcccctg

SEQ ID NO: 4699103 - DNA, 17 bp, Homo sapiens
gcacccggcccctgctg

SEQ ID NO: 4699104 - DNA, 19 bp, Homo sapiens
gcacccggcccctgctggt

SEQ ID NO: 4699105 - DNA, 17 bp, Homo sapiens
gcacccgggctcaggga

SEQ ID NO: 4699106 - DNA, 17 bp, Homo sapiens
gcaccctcatacacaga

SEQ ID NO: 4699107 - DNA, 20 bp, Homo sapiens
gcaccgcttctcagccacaa

SEQ ID NO: 4699108 - DNA, 16 bp, Homo sapiens
gcaccggaccagcctg

SEQ ID NO: 4699109 - DNA, 19 bp, Homo sapiens
gcaccggaccagcctggcc

SEQ ID NO: 4699110 - DNA, 16 bp, Homo sapiens
gcaccggctggcctgg

SEQ ID NO: 4699111 - DNA, 17 bp, Homo sapiens
gcacctaccaccacgcc

SEQ ID NO: 4699112 - DNA, 14 bp, Homo sapiens
gcacctcctgcctc

SEQ ID NO: 4699113 - DNA, 23 bp, Homo sapiens
gcacctgaaattaatttgtgaat

SEQ ID NO: 4699114 - DNA, 22 bp, Homo sapiens
gcacctgcagcgcgcacacgca

SEQ ID NO: 4699115 - DNA, 21 bp, Homo sapiens
gcacctgcaggttgggccata

SEQ ID NO: 4699116 - DNA, 19 bp, Homo sapiens
gcaccttagacagtccctg

SEQ ID NO: 4699117 - DNA, 21 bp, Homo sapiens
gcaccttagacagtccctgcc

SEQ ID NO: 4699118 - DNA, 22 bp, Homo sapiens
gcaccttctgacgcagcctgag

SEQ ID NO: 4699119 - DNA, 16 bp, Homo sapiens
gcacgcacacacacat

SEQ ID NO: 4699120 - DNA, 20 bp, Homo sapiens
gcacgcacacacacatacag

SEQ ID NO: 4699121 - DNA, 12 bp, Homo sapiens
gcacgcagtggc

SEQ ID NO: 4699122 - DNA, 12 bp, Homo sapiens
gcacggctgctg

SEQ ID NO: 4699123 - DNA, 15 bp, Homo sapiens
gcacgtattttaata

SEQ ID NO: 4699124 - DNA, 17 bp, Homo sapiens
gcactaaggtgtgctct

SEQ ID NO: 4699125 - DNA, 21 bp, Homo sapiens
gcactaattctgcatctgggc

SEQ ID NO: 4699126 - DNA, 21 bp, Homo sapiens
gcactaccatagctacatcag

SEQ ID NO: 4699127 - DNA, 13 bp, Homo sapiens
gcactatttttat

SEQ ID NO: 4699128 - DNA, 14 bp, Homo sapiens
gcactccagcctgg

SEQ ID NO: 4699129 - DNA, 17 bp, Homo sapiens
gcactcccctgctgggt

SEQ ID NO: 4699130 - DNA, 22 bp, Homo sapiens
gcactcccctgctgggtgtggc

SEQ ID NO: 4699131 - DNA, 11 bp, Homo sapiens
gcactctgtgc

SEQ ID NO: 4699132 - DNA, 12 bp, Homo sapiens
gcactctgtgcc

SEQ ID NO: 4699133 - DNA, 14 bp, Homo sapiens
gcactctgtgccca

SEQ ID NO: 4699134 - DNA, 20 bp, Homo sapiens
gcactctgtgcccatgggca

SEQ ID NO: 4699135 - DNA, 21 bp, Homo sapiens
gcactctgtgcccatgggcac

SEQ ID NO: 4699136 - DNA, 14 bp, Homo sapiens
gcactgcacactca

SEQ ID NO: 4699137 - DNA, 19 bp, Homo sapiens
gcactgctgggtggcccat

SEQ ID NO: 4699138 - DNA, 16 bp, Homo sapiens
gcactgcttgaggaaa

SEQ ID NO: 4699139 - DNA, 17 bp, Homo sapiens
gcactgctttctccttc

SEQ ID NO: 4699140 - DNA, 16 bp, Homo sapiens
gcactgtcctgctcca

SEQ ID NO: 4699141 - DNA, 17 bp, Homo sapiens
gcactgtcctgctccac

SEQ ID NO: 4699142 - DNA, 21 bp, Homo sapiens
gcactgtcctgctccacagtg

SEQ ID NO: 4699143 - DNA, 13 bp, Homo sapiens
gcactgtgctcag

SEQ ID NO: 4699144 - DNA, 15 bp, Homo sapiens
gcactgttccccctg

SEQ ID NO: 4699145 - DNA, 19 bp, Homo sapiens
gcactgttccccctgtgca

SEQ ID NO: 4699146 - DNA, 20 bp, Homo sapiens
gcacttattgaatatatgat

SEQ ID NO: 4699147 - DNA, 22 bp, Homo sapiens
gcacttgcggttccggcatgga

SEQ ID NO: 4699148 - DNA, 16 bp, Homo sapiens
gcactttgttctggct

SEQ ID NO: 4699149 - DNA, 19 bp, Homo sapiens
gcactttgttctggctctt

SEQ ID NO: 4699150 - DNA, 22 bp, Homo sapiens
gcactttgttctggctcttcca

SEQ ID NO: 4699151 - DNA, 21 bp, Homo sapiens
gcagaagacaccagagcagat

SEQ ID NO: 4699152 - DNA, 14 bp, Homo sapiens
gcagaagggggtgg

SEQ ID NO: 4699153 - DNA, 19 bp, Homo sapiens
gcagacatgtgcacttgaa

SEQ ID NO: 4699154 - DNA, 22 bp, Homo sapiens
gcagacattatgtaaaagaaag

SEQ ID NO: 4699155 - DNA, 18 bp, Homo sapiens
gcagactctacagaggcc

SEQ ID NO: 4699156 - DNA, 21 bp, Homo sapiens
gcagagaatgaaagggcccag

SEQ ID NO: 4699157 - DNA, 22 bp, Homo sapiens
gcagagaatgaaagggcccaga

SEQ ID NO: 4699158 - DNA, 14 bp, Homo sapiens
gcagagaccatccc

SEQ ID NO: 4699159 - DNA, 15 bp, Homo sapiens
gcagagaccatccct

SEQ ID NO: 4699160 - DNA, 22 bp, Homo sapiens
gcagagaccatccctgaaggcc

SEQ ID NO: 4699161 - DNA, 12 bp, Homo sapiens
gcagagacttgg

SEQ ID NO: 4699162 - DNA, 19 bp, Homo sapiens
gcagagcaccttagacagt

SEQ ID NO: 4699163 - DNA, 15 bp, Homo sapiens
gcagagcagagacca

SEQ ID NO: 4699164 - DNA, 15 bp, Homo sapiens
gcagaggaggagaaa

SEQ ID NO: 4699165 - DNA, 19 bp, Homo sapiens
gcagaggggcaggccctgc

SEQ ID NO: 4699166 - DNA, 13 bp, Homo sapiens
gcagagtcacacg

SEQ ID NO: 4699167 - DNA, 19 bp, Homo sapiens
gcagagttctttgcaagct

SEQ ID NO: 4699168 - DNA, 22 bp, Homo sapiens
gcagatacaggaaaagctgctg

SEQ ID NO: 4699169 - DNA, 14 bp, Homo sapiens
gcagatgaggttgc

SEQ ID NO: 4699170 - DNA, 17 bp, Homo sapiens
gcagatttgatatttgc

SEQ ID NO: 4699171 - DNA, 22 bp, Homo sapiens
gcagcacagcaaggaggctggc

SEQ ID NO: 4699172 - DNA, 12 bp, Homo sapiens
gcagcagaaggg

SEQ ID NO: 4699173 - DNA, 21 bp, Homo sapiens
gcagcagggcaggaaggggaa

SEQ ID NO: 4699174 - DNA, 17 bp, Homo sapiens
gcagcagggctaccctg

SEQ ID NO: 4699175 - DNA, 13 bp, Homo sapiens
gcagcaggtgctg

SEQ ID NO: 4699176 - DNA, 16 bp, Homo sapiens
gcagcaggtgctgcta

SEQ ID NO: 4699177 - DNA, 17 bp, Homo sapiens
gcagcaggtgctgctac

SEQ ID NO: 4699178 - DNA, 18 bp, Homo sapiens
gcagcaggtgctgctacc

SEQ ID NO: 4699179 - DNA, 11 bp, Homo sapiens
gcattcatgtt

SEQ ID NO: 4699180 - DNA, 12 bp, Homo sapiens
gcattcatgttt

SEQ ID NO: 4699181 - DNA, 15 bp, Homo sapiens
gcattccccaggagg

SEQ ID NO: 4699182 - DNA, 19 bp, Homo sapiens
gcattccccaggaggccag

SEQ ID NO: 4699183 - DNA, 14 bp, Homo sapiens
gcattccttctttg

SEQ ID NO: 4699184 - DNA, 15 bp, Homo sapiens
gcattctcagccaca

SEQ ID NO: 4699185 - DNA, 16 bp, Homo sapiens
gcattggaactggagg

SEQ ID NO: 4699186 - DNA, 19 bp, Homo sapiens
gcattggaactggaggcag

SEQ ID NO: 4699187 - DNA, 23 bp, Homo sapiens
gcattgttgatgctcacatatga

SEQ ID NO: 4699188 - DNA, 21 bp, Homo sapiens
gcatttaaagttgtataaaaa

SEQ ID NO: 4699189 - DNA, 16 bp, Homo sapiens
gcatttaatgtagcca

SEQ ID NO: 4699190 - DNA, 20 bp, Homo sapiens
gcatttgggtggtttttatt

SEQ ID NO: 4699191 - DNA, 23 bp, Homo sapiens
gcattttgaatgtgatcatcttt

SEQ ID NO: 4699192 - DNA, 21 bp, Homo sapiens
gcatttttaaaggacaaacag

SEQ ID NO: 4699193 - DNA, 21 bp, Homo sapiens
gccaaatttaaaactgttgga

SEQ ID NO: 4699194 - DNA, 16 bp, Homo sapiens
gccaacactcaagaag

SEQ ID NO: 4699195 - DNA, 23 bp, Homo sapiens
gccaacagtgttaggcctggcac

SEQ ID NO: 4699196 - DNA, 22 bp, Homo sapiens
gccaacatggtgaaactccatc

SEQ ID NO: 4699197 - DNA, 12 bp, Homo sapiens
gccaagaaatcg

SEQ ID NO: 4699198 - DNA, 23 bp, Homo sapiens
gccaagaaatcgccttatgagaa

SEQ ID NO: 4699199 - DNA, 13 bp, Homo sapiens
gccaagcccaata

SEQ ID NO: 4699200 - DNA, 20 bp, Homo sapiens
gccaagctcaggaccaggca

SEQ ID NO: 4699201 - DNA, 12 bp, Homo sapiens
gccaagttctta

SEQ ID NO: 4699202 - DNA, 20 bp, Homo sapiens
gccaataataatacctccct

SEQ ID NO: 4699203 - DNA, 16 bp, Homo sapiens
gccaatctattctcaa

SEQ ID NO: 4699204 - DNA, 23 bp, Homo sapiens
gccaatctattctcaaagttaaa

SEQ ID NO: 4699205 - DNA, 13 bp, Homo sapiens
gccaattcctata

SEQ ID NO: 4699206 - DNA, 22 bp, Homo sapiens
gccaattttgtcacagctcttg

SEQ ID NO: 4699207 - DNA, 22 bp, Homo sapiens
gccacaagacccttgtggtccc

SEQ ID NO: 4699208 - DNA, 13 bp, Homo sapiens
gccacaccaagct

SEQ ID NO: 4699209 - DNA, 14 bp, Homo sapiens
gccacaccaagctg

SEQ ID NO: 4699210 - DNA, 17 bp, Homo sapiens
gccacaccaagctgtgc

SEQ ID NO: 4699211 - DNA, 20 bp, Homo sapiens
gccacaccaagctgtgccac

SEQ ID NO: 4699212 - DNA, 14 bp, Homo sapiens
gccacagagaaagt

SEQ ID NO: 4699213 - DNA, 20 bp, Homo sapiens
gccacaggcctgagatttca

SEQ ID NO: 4699214 - DNA, 16 bp, Homo sapiens
gccacattcctgatgc

SEQ ID NO: 4699215 - DNA, 16 bp, Homo sapiens
gccacatttagtcctg

SEQ ID NO: 4699216 - DNA, 22 bp, Homo sapiens
gccacatttagtcctgtactgt

SEQ ID NO: 4699217 - DNA, 19 bp, Homo sapiens
gccaccaacatactcccat

SEQ ID NO: 4699218 - DNA, 22 bp, Homo sapiens
gccaccaacatactcccatctg

SEQ ID NO: 4699219 - DNA, 13 bp, Homo sapiens
gccaccctcaccg

SEQ ID NO: 4699220 - DNA, 13 bp, Homo sapiens
gccaccctcatgc

SEQ ID NO: 4699221 - DNA, 16 bp, Homo sapiens
gccaccctcatgctgt

SEQ ID NO: 4699222 - DNA, 13 bp, Homo sapiens
gccaccctgggct

SEQ ID NO: 4699223 - DNA, 17 bp, Homo sapiens
gccaccctgggctctgt

SEQ ID NO: 4699224 - DNA, 20 bp, Homo sapiens
gccacctgcggtgctatctc

SEQ ID NO: 4699225 - DNA, 12 bp, Homo sapiens
gccacctggacc

SEQ ID NO: 4699226 - DNA, 16 bp, Homo sapiens
gccacctggacccctg

SEQ ID NO: 4699227 - DNA, 11 bp, Homo sapiens
gccacctgggt

SEQ ID NO: 4699228 - DNA, 17 bp, Homo sapiens
gccacggccaggccaga

SEQ ID NO: 4699229 - DNA, 18 bp, Homo sapiens
gccacggccaggccagag

SEQ ID NO: 4699230 - DNA, 14 bp, Homo sapiens
gccactatgagctt

SEQ ID NO: 4699231 - DNA, 17 bp, Homo sapiens
gccactcctctgactca

SEQ ID NO: 4699232 - DNA, 19 bp, Homo sapiens
gccactgcaccgggccaca

SEQ ID NO: 4699233 - DNA, 23 bp, Homo sapiens
gccactgcaccgggccacagaga

SEQ ID NO: 4699234 - DNA, 13 bp, Homo sapiens
gccacttcccagg

SEQ ID NO: 4699235 - DNA, 23 bp, Homo sapiens
gccacttctgggtggggcagtgg

SEQ ID NO: 4699236 - DNA, 22 bp, Homo sapiens
gccagagggagtgacagaggca

SEQ ID NO: 4699237 - DNA, 23 bp, Homo sapiens
gccagagggagtgacagaggcag

SEQ ID NO: 4699238 - DNA, 14 bp, Homo sapiens
gccagatgcaccag

SEQ ID NO: 4699239 - DNA, 15 bp, Homo sapiens
gccagatgcaccagc

SEQ ID NO: 4699240 - DNA, 16 bp, Homo sapiens
gccagatgcaccagcc

SEQ ID NO: 4699241 - DNA, 17 bp, Homo sapiens
gccagatgcaccagccc

SEQ ID NO: 4699242 - DNA, 17 bp, Homo sapiens
gccagattctttcctga

SEQ ID NO: 4699243 - DNA, 19 bp, Homo sapiens
gccagattctttcctgagg

SEQ ID NO: 4699244 - DNA, 20 bp, Homo sapiens
gccagcaccggaccagcctg

SEQ ID NO: 4699245 - DNA, 21 bp, Homo sapiens
gccagcaccggaccagcctgg

SEQ ID NO: 4699246 - DNA, 16 bp, Homo sapiens
gccagccccacagccc

SEQ ID NO: 4699247 - DNA, 18 bp, Homo sapiens
gccagccccacagcccac

SEQ ID NO: 4699248 - DNA, 19 bp, Homo sapiens
gccagccccacagcccacg

SEQ ID NO: 4699249 - DNA, 15 bp, Homo sapiens
gccagcccctgctgg

SEQ ID NO: 4699250 - DNA, 14 bp, Homo sapiens
gccagccttgacca

SEQ ID NO: 4699251 - DNA, 20 bp, Homo sapiens
gccagccttgaccattctcc

SEQ ID NO: 4699252 - DNA, 18 bp, Homo sapiens
gccaggaccaagggcaga

SEQ ID NO: 4699253 - DNA, 20 bp, Homo sapiens
gccaggaccaagggcagagg

SEQ ID NO: 4699254 - DNA, 22 bp, Homo sapiens
gccaggaccagtcaacctgggc

SEQ ID NO: 4699255 - DNA, 13 bp, Homo sapiens
gccaggactctgc

SEQ ID NO: 4699256 - DNA, 15 bp, Homo sapiens
gccaggactctgcag

SEQ ID NO: 4699257 - DNA, 19 bp, Homo sapiens
gccaggactctgcagcctc

SEQ ID NO: 4699258 - DNA, 24 bp, Homo sapiens
gccaggattggggacctgatggag

SEQ ID NO: 4699259 - DNA, 15 bp, Homo sapiens
gccaggccagaggga

SEQ ID NO: 4699260 - DNA, 16 bp, Homo sapiens
gccaggccctctgccc

SEQ ID NO: 4699261 - DNA, 20 bp, Homo sapiens
gccaggccctctgcccactc

SEQ ID NO: 4699262 - DNA, 14 bp, Homo sapiens
gccaggctgctctt

SEQ ID NO: 4699263 - DNA, 16 bp, Homo sapiens
gccagggacagagggg

SEQ ID NO: 4699264 - DNA, 23 bp, Homo sapiens
gccagggacagagggggtggcct

SEQ ID NO: 4699265 - DNA, 17 bp, Homo sapiens
gccagggagagcccagg

SEQ ID NO: 4699266 - DNA, 19 bp, Homo sapiens
gccagggagagcccaggag

SEQ ID NO: 4699267 - DNA, 21 bp, Homo sapiens
gccagggagagcccaggagct

SEQ ID NO: 4699268 - DNA, 15 bp, Homo sapiens
gccagggcctggaag

SEQ ID NO: 4699269 - DNA, 16 bp, Homo sapiens
gccagggcctggaaga

SEQ ID NO: 4699270 - DNA, 11 bp, Homo sapiens
gccagggctgc

SEQ ID NO: 4699271 - DNA, 21 bp, Homo sapiens
gccagtcaccccggccacctg

SEQ ID NO: 4699272 - DNA, 18 bp, Homo sapiens
gccagtcgcgctgcctgt

SEQ ID NO: 4699273 - DNA, 20 bp, Homo sapiens
gccagtcgcgctgcctgtgt

SEQ ID NO: 4699274 - DNA, 20 bp, Homo sapiens
gccagtgatgctaaaggttg

SEQ ID NO: 4699275 - DNA, 20 bp, Homo sapiens
gccagttggtcccccttcca

SEQ ID NO: 4699276 - DNA, 22 bp, Homo sapiens
gccagttggtcccccttccatg

SEQ ID NO: 4699277 - DNA, 15 bp, Homo sapiens
gccatactggcctcg

SEQ ID NO: 4699278 - DNA, 17 bp, Homo sapiens
gccatactggcctcgcc

SEQ ID NO: 4699279 - DNA, 19 bp, Homo sapiens
gccatactggcctcgcctg

SEQ ID NO: 4699280 - DNA, 12 bp, Homo sapiens
gccatagctcct

SEQ ID NO: 4699281 - DNA, 20 bp, Homo sapiens
gccatattctgttggccagt

SEQ ID NO: 4699282 - DNA, 14 bp, Homo sapiens
gccatccaggttca

SEQ ID NO: 4699283 - DNA, 20 bp, Homo sapiens
gccatccaggttcagcttgt

SEQ ID NO: 4699284 - DNA, 16 bp, Homo sapiens
gccatcccagccccaa

SEQ ID NO: 4699285 - DNA, 20 bp, Homo sapiens
gccatcctcaaacactgcag

SEQ ID NO: 4699286 - DNA, 21 bp, Homo sapiens
gccatcctcaaacactgcagg

SEQ ID NO: 4699287 - DNA, 18 bp, Homo sapiens
gccatggacagaagaagg

SEQ ID NO: 4699288 - DNA, 16 bp, Homo sapiens
gcctcccaaagtgctg

SEQ ID NO: 4699289 - DNA, 18 bp, Homo sapiens
gcctcccaaagtgctggg

SEQ ID NO: 4699290 - DNA, 16 bp, Homo sapiens
gcctcccaactcaccc

SEQ ID NO: 4699291 - DNA, 21 bp, Homo sapiens
gcctcccaactcaccccagcc

SEQ ID NO: 4699292 - DNA, 16 bp, Homo sapiens
gcctcccacagtgact

SEQ ID NO: 4699293 - DNA, 16 bp, Homo sapiens
gcctcccatcacccgc

SEQ ID NO: 4699294 - DNA, 15 bp, Homo sapiens
gcctcccctgccagg

SEQ ID NO: 4699295 - DNA, 17 bp, Homo sapiens
gcctcccctgccagggc

SEQ ID NO: 4699296 - DNA, 20 bp, Homo sapiens
gcctcccgaatagctgggac

SEQ ID NO: 4699297 - DNA, 23 bp, Homo sapiens
gcctcccgagtagctgggactac

SEQ ID NO: 4699298 - DNA, 18 bp, Homo sapiens
gcctcccttcatgcatgg

SEQ ID NO: 4699299 - DNA, 13 bp, Homo sapiens
gcctcctgtgtgt

SEQ ID NO: 4699300 - DNA, 22 bp, Homo sapiens
gcctccttatatttggcccaaa

SEQ ID NO: 4699301 - DNA, 13 bp, Homo sapiens
gcctcgaactggc

SEQ ID NO: 4699302 - DNA, 16 bp, Homo sapiens
gcctcgaactggctgc

SEQ ID NO: 4699303 - DNA, 17 bp, Homo sapiens
gcctcgaactggctgca

SEQ ID NO: 4699304 - DNA, 20 bp, Homo sapiens
gcctcgatgtcctcctctgt

SEQ ID NO: 4699305 - DNA, 20 bp, Homo sapiens
gcctcggacttagctgggag

SEQ ID NO: 4699306 - DNA, 17 bp, Homo sapiens
gcctcggctcctgctgc

SEQ ID NO: 4699307 - DNA, 23 bp, Homo sapiens
gcctctacctgacactcccttgg

SEQ ID NO: 4699308 - DNA, 13 bp, Homo sapiens
gcctctagggacc

SEQ ID NO: 4699309 - DNA, 17 bp, Homo sapiens
gcctctagggacccctc

SEQ ID NO: 4699310 - DNA, 20 bp, Homo sapiens
gcctctagggacccctcctc

SEQ ID NO: 4699311 - DNA, 21 bp, Homo sapiens
gcctctccttgtggcctgggc

SEQ ID NO: 4699312 - DNA, 22 bp, Homo sapiens
gcctctccttgtggcctgggcc

SEQ ID NO: 4699313 - DNA, 14 bp, Homo sapiens
gcctctgcactccc

SEQ ID NO: 4699314 - DNA, 18 bp, Homo sapiens
gcctctgcctctgacaca

SEQ ID NO: 4699315 - DNA, 15 bp, Homo sapiens
gcctctgtccccttc

SEQ ID NO: 4699316 - DNA, 19 bp, Homo sapiens
gcctctgtccccttctctc

SEQ ID NO: 4699317 - DNA, 16 bp, Homo sapiens
gcctctgtgtcactgg

SEQ ID NO: 4699318 - DNA, 17 bp, Homo sapiens
gcctctgtttgacaaac

SEQ ID NO: 4699319 - DNA, 17 bp, Homo sapiens
gcctcttatgggctggg

SEQ ID NO: 4699320 - DNA, 18 bp, Homo sapiens
gcctcttatgggctgggt

SEQ ID NO: 4699321 - DNA, 18 bp, Homo sapiens
gcctcttctgggagggca

SEQ ID NO: 4699322 - DNA, 14 bp, Homo sapiens
gcctcttgggttca

SEQ ID NO: 4699323 - DNA, 23 bp, Homo sapiens
gcctcttttcacattttttttct

SEQ ID NO: 4699324 - DNA, 16 bp, Homo sapiens
gcctgaagaccccaga

SEQ ID NO: 4699325 - DNA, 17 bp, Homo sapiens
gcctgaagtcacacagt

SEQ ID NO: 4699326 - DNA, 16 bp, Homo sapiens
gcctgacaacagcctg

SEQ ID NO: 4699327 - DNA, 13 bp, Homo sapiens
gcctgagaatgac

SEQ ID NO: 4699328 - DNA, 12 bp, Homo sapiens
gcctgagcccct

SEQ ID NO: 4699329 - DNA, 13 bp, Homo sapiens
gcctgagcccctc

SEQ ID NO: 4699330 - DNA, 16 bp, Homo sapiens
gcctgagcccctcaga

SEQ ID NO: 4699331 - DNA, 12 bp, Homo sapiens
gcctgagctggg

SEQ ID NO: 4699332 - DNA, 10 bp, Homo sapiens
gcctgaggga

SEQ ID NO: 4699333 - DNA, 13 bp, Homo sapiens
gcctgatggacct

SEQ ID NO: 4699334 - DNA, 17 bp, Homo sapiens
gcctgatggggagggtc

SEQ ID NO: 4699335 - DNA, 19 bp, Homo sapiens
gcctgattgccaagctcag

SEQ ID NO: 4699336 - DNA, 20 bp, Homo sapiens
gcctgattgccaagctcagg

SEQ ID NO: 4699337 - DNA, 21 bp, Homo sapiens
gcctgattgccaagctcagga

SEQ ID NO: 4699338 - DNA, 12 bp, Homo sapiens
gcctgccacctg

SEQ ID NO: 4699339 - DNA, 14 bp, Homo sapiens
gcctgccacctgga

SEQ ID NO: 4699340 - DNA, 16 bp, Homo sapiens
gcctgccacctggacc

SEQ ID NO: 4699341 - DNA, 14 bp, Homo sapiens
gcctgcccaggccc

SEQ ID NO: 4699342 - DNA, 17 bp, Homo sapiens
gcctgcccaggcccctg

SEQ ID NO: 4699343 - DNA, 19 bp, Homo sapiens
gcctgcccagttgcactca

SEQ ID NO: 4699344 - DNA, 11 bp, Homo sapiens
gcctgcctcca

SEQ ID NO: 4699345 - DNA, 17 bp, Homo sapiens
gcctgccttctcaggga

SEQ ID NO: 4699346 - DNA, 23 bp, Homo sapiens
gcctgctaattccccagattgca

SEQ ID NO: 4699347 - DNA, 23 bp, Homo sapiens
gcctggacccgttcatgggggag

SEQ ID NO: 4699348 - DNA, 20 bp, Homo sapiens
gcctggatggggctgcaccg

SEQ ID NO: 4699349 - DNA, 21 bp, Homo sapiens
gcctggcacagtgtctgggct

SEQ ID NO: 4699350 - DNA, 15 bp, Homo sapiens
gcctggccaaaggga

SEQ ID NO: 4699351 - DNA, 20 bp, Homo sapiens
gcctggccaacatggcgaaa

SEQ ID NO: 4699352 - DNA, 21 bp, Homo sapiens
gcctggccagatgcaccagcc

SEQ ID NO: 4699353 - DNA, 17 bp, Homo sapiens
gcctggccagggcctgg

SEQ ID NO: 4699354 - DNA, 18 bp, Homo sapiens
gcctggcccaccccaccc

SEQ ID NO: 4699355 - DNA, 16 bp, Homo sapiens
gcctggccccatggtc

SEQ ID NO: 4699356 - DNA, 16 bp, Homo sapiens
gcctggcccctcaggg

SEQ ID NO: 4699357 - DNA, 22 bp, Homo sapiens
gcctggcccctcagggtccctg

SEQ ID NO: 4699358 - DNA, 14 bp, Homo sapiens
gcctggcctgagct

SEQ ID NO: 4699359 - DNA, 13 bp, Homo sapiens
gcctgggagccag

SEQ ID NO: 4699360 - DNA, 21 bp, Homo sapiens
gcctgggcctcctcacaacat

SEQ ID NO: 4699361 - DNA, 14 bp, Homo sapiens
gcctgggggctcct

SEQ ID NO: 4699362 - DNA, 13 bp, Homo sapiens
gcctggtggcagc

SEQ ID NO: 4699363 - DNA, 18 bp, Homo sapiens
gcctggtggcagctgcgg

SEQ ID NO: 4699364 - DNA, 13 bp, Homo sapiens
gcctgtaacatat

SEQ ID NO: 4699365 - DNA, 20 bp, Homo sapiens
gcctgttcagctccagctca

SEQ ID NO: 4699366 - DNA, 17 bp, Homo sapiens
gccttagaagtcacaca

SEQ ID NO: 4699367 - DNA, 16 bp, Homo sapiens
gccttataaaccaatc

SEQ ID NO: 4699368 - DNA, 16 bp, Homo sapiens
gccttatgagaacatg

SEQ ID NO: 4699369 - DNA, 13 bp, Homo sapiens
gccttcatctccc

SEQ ID NO: 4699370 - DNA, 22 bp, Homo sapiens
gccttccacttggctacacagg

SEQ ID NO: 4699371 - DNA, 14 bp, Homo sapiens
gccttcctcctggg

SEQ ID NO: 4699372 - DNA, 16 bp, Homo sapiens
gccttcctcctgggcc

SEQ ID NO: 4699373 - DNA, 20 bp, Homo sapiens
gccttctcagggacttctgc

SEQ ID NO: 4699374 - DNA, 23 bp, Homo sapiens
gccttctcccccccggggctggg

SEQ ID NO: 4699375 - DNA, 16 bp, Homo sapiens
gccttgaccattctcc

SEQ ID NO: 4699376 - DNA, 23 bp, Homo sapiens
gccttgaccattctccacctgcc

SEQ ID NO: 4699377 - DNA, 19 bp, Homo sapiens
gccttggaagttgcatggc

SEQ ID NO: 4699378 - DNA, 22 bp, Homo sapiens
gcctttaccctcctctatttct

SEQ ID NO: 4699379 - DNA, 23 bp, Homo sapiens
gcctttaccctcctctatttctt

SEQ ID NO: 4699380 - DNA, 21 bp, Homo sapiens
gcctttagtgatcacagcagc

SEQ ID NO: 4699381 - DNA, 22 bp, Homo sapiens
gcctttagtgatcacagcagct

SEQ ID NO: 4699382 - DNA, 16 bp, Homo sapiens
gcctttgacctgcctc

SEQ ID NO: 4699383 - DNA, 21 bp, Homo sapiens
gcctttgagacagtttcttag

SEQ ID NO: 4699384 - DNA, 15 bp, Homo sapiens
gcctttggcaggtgc

SEQ ID NO: 4699385 - DNA, 19 bp, Homo sapiens
gcgagagatcaaagatgaa

SEQ ID NO: 4699386 - DNA, 12 bp, Homo sapiens
gcgagagatgtg

SEQ ID NO: 4699387 - DNA, 14 bp, Homo sapiens
gcgagagatgtgtg

SEQ ID NO: 4699388 - DNA, 15 bp, Homo sapiens
gcgagagatgtgtgt

SEQ ID NO: 4699389 - DNA, 15 bp, Homo sapiens
gcgagcacatgttca

SEQ ID NO: 4699390 - DNA, 17 bp, Homo sapiens
gcgagccctggtggcag

SEQ ID NO: 4699391 - DNA, 20 bp, Homo sapiens
gcgaggagatgctccttggg

SEQ ID NO: 4699392 - DNA, 16 bp, Homo sapiens
gcgaggaggctccaga

SEQ ID NO: 4699393 - DNA, 14 bp, Homo sapiens
gcgattcttctgct

SEQ ID NO: 4699394 - DNA, 16 bp, Homo sapiens
gcgcacccagagaaaa

SEQ ID NO: 4699395 - DNA, 16 bp, Homo sapiens
gcgcaccctcccctcc

SEQ ID NO: 4699396 - DNA, 14 bp, Homo sapiens
gcgcaggctggccc

SEQ ID NO: 4699397 - DNA, 15 bp, Homo sapiens
gcgcaggctggccct

SEQ ID NO: 4699398 - DNA, 24 bp, Homo sapiens
gctgcccctccctgcctccaccca

SEQ ID NO: 4699399 - DNA, 14 bp, Homo sapiens
gctgcccgctccca

SEQ ID NO: 4699400 - DNA, 19 bp, Homo sapiens
gctgcccgctcccagtgtc

SEQ ID NO: 4699401 - DNA, 19 bp, Homo sapiens
gctgcccggcgccctctgt

SEQ ID NO: 4699402 - DNA, 23 bp, Homo sapiens
gctgcccggcgccctctgtcctg

SEQ ID NO: 4699403 - DNA, 14 bp, Homo sapiens
gctgccctgcccac

SEQ ID NO: 4699404 - DNA, 18 bp, Homo sapiens
gctgccctgcccacctgg

SEQ ID NO: 4699405 - DNA, 20 bp, Homo sapiens
gctgccctgcccacctggcc

SEQ ID NO: 4699406 - DNA, 23 bp, Homo sapiens
gctgccctgcccacctggcctct

SEQ ID NO: 4699407 - DNA, 24 bp, Homo sapiens
gctgccctgcccacctggcctctg

SEQ ID NO: 4699408 - DNA, 11 bp, Homo sapiens
gctgccctgtg

SEQ ID NO: 4699409 - DNA, 14 bp, Homo sapiens
gctgccctgtgagt

SEQ ID NO: 4699410 - DNA, 13 bp, Homo sapiens
gctgcctcatgct

SEQ ID NO: 4699411 - DNA, 14 bp, Homo sapiens
gctgcctccactcc

SEQ ID NO: 4699412 - DNA, 15 bp, Homo sapiens
gctgcctccactccc

SEQ ID NO: 4699413 - DNA, 13 bp, Homo sapiens
gctgcctggaccc

SEQ ID NO: 4699414 - DNA, 19 bp, Homo sapiens
gctgcctgggatccctcat

SEQ ID NO: 4699415 - DNA, 18 bp, Homo sapiens
gctgcctgttcagctcca

SEQ ID NO: 4699416 - DNA, 18 bp, Homo sapiens
gctgcggtccacccagga

SEQ ID NO: 4699417 - DNA, 21 bp, Homo sapiens
gctgcggtccacccaggagcc

SEQ ID NO: 4699418 - DNA, 14 bp, Homo sapiens
gctgctaccctccc

SEQ ID NO: 4699419 - DNA, 13 bp, Homo sapiens
gctgctgaaggct

SEQ ID NO: 4699420 - DNA, 14 bp, Homo sapiens
gctgctgaaggctc

SEQ ID NO: 4699421 - DNA, 18 bp, Homo sapiens
gctgctgaaggctcgagc

SEQ ID NO: 4699422 - DNA, 16 bp, Homo sapiens
gctgctgcctgcctgg

SEQ ID NO: 4699423 - DNA, 13 bp, Homo sapiens
gctgctggctggt

SEQ ID NO: 4699424 - DNA, 23 bp, Homo sapiens
gctggaaagcaaacaggaagatt

SEQ ID NO: 4699425 - DNA, 16 bp, Homo sapiens
gctggaacagattcac

SEQ ID NO: 4699426 - DNA, 21 bp, Homo sapiens
gctggaacagattcacactgt

SEQ ID NO: 4699427 - DNA, 17 bp, Homo sapiens
gctggaagtggctctgg

SEQ ID NO: 4699428 - DNA, 19 bp, Homo sapiens
gctggaatctggagagcta

SEQ ID NO: 4699429 - DNA, 22 bp, Homo sapiens
gctggaccttgaactgggtact

SEQ ID NO: 4699430 - DNA, 22 bp, Homo sapiens
gctggactctcagtctctgagc

SEQ ID NO: 4699431 - DNA, 17 bp, Homo sapiens
gctggactgaggcctga

SEQ ID NO: 4699432 - DNA, 15 bp, Homo sapiens
gctggagccactaac

SEQ ID NO: 4699433 - DNA, 16 bp, Homo sapiens
gctggaggagcccagg

SEQ ID NO: 4699434 - DNA, 22 bp, Homo sapiens
gctggaggagcccaggccagga

SEQ ID NO: 4699435 - DNA, 14 bp, Homo sapiens
gctggagtgcagtg

SEQ ID NO: 4699436 - DNA, 18 bp, Homo sapiens
gctggagtgcagtgagcc

SEQ ID NO: 4699437 - DNA, 22 bp, Homo sapiens
gctggattgggttatgaatatt

SEQ ID NO: 4699438 - DNA, 11 bp, Homo sapiens
gctggcagaga

SEQ ID NO: 4699439 - DNA, 12 bp, Homo sapiens
gctggccctgcc

SEQ ID NO: 4699440 - DNA, 16 bp, Homo sapiens
gctggccctgccctgg

SEQ ID NO: 4699441 - DNA, 13 bp, Homo sapiens
gctggcctggccc

SEQ ID NO: 4699442 - DNA, 17 bp, Homo sapiens
gctggcctggcccctca

SEQ ID NO: 4699443 - DNA, 15 bp, Homo sapiens
gctggcgtgcagtgg

SEQ ID NO: 4699444 - DNA, 13 bp, Homo sapiens
gctggctgtgaaa

SEQ ID NO: 4699445 - DNA, 16 bp, Homo sapiens
gctggctgtgacaatg

SEQ ID NO: 4699446 - DNA, 15 bp, Homo sapiens
gctggctgttggctg

SEQ ID NO: 4699447 - DNA, 16 bp, Homo sapiens
gctggctgttggctgg

SEQ ID NO: 4699448 - DNA, 19 bp, Homo sapiens
gctggctgttggctggggg

SEQ ID NO: 4699449 - DNA, 23 bp, Homo sapiens
gctggctgttggctgggggcctc

SEQ ID NO: 4699450 - DNA, 16 bp, Homo sapiens
gctgggaactcacctg

SEQ ID NO: 4699451 - DNA, 21 bp, Homo sapiens
gctgggaactcacctggggct

SEQ ID NO: 4699452 - DNA, 13 bp, Homo sapiens
gctgggactacag

SEQ ID NO: 4699453 - DNA, 20 bp, Homo sapiens
gctgggactacaggcaccca

SEQ ID NO: 4699454 - DNA, 19 bp, Homo sapiens
gctgggactacaggtgtga

SEQ ID NO: 4699455 - DNA, 17 bp, Homo sapiens
gctgggagagccttcca

SEQ ID NO: 4699456 - DNA, 16 bp, Homo sapiens
gctgggagcaggactg

SEQ ID NO: 4699457 - DNA, 17 bp, Homo sapiens
gctgggattacaggcgt

SEQ ID NO: 4699458 - DNA, 21 bp, Homo sapiens
gctgggattacaggctcctgc

SEQ ID NO: 4699459 - DNA, 19 bp, Homo sapiens
gctgggcagtttttctgta

SEQ ID NO: 4699460 - DNA, 12 bp, Homo sapiens
gctgggctccct

SEQ ID NO: 4699461 - DNA, 16 bp, Homo sapiens
gctgggctcccttccc

SEQ ID NO: 4699462 - DNA, 20 bp, Homo sapiens
gctgggctcccttcccacct

SEQ ID NO: 4699463 - DNA, 17 bp, Homo sapiens
gctgggctggggcctga

SEQ ID NO: 4699464 - DNA, 14 bp, Homo sapiens
gctgggctgggtgc

SEQ ID NO: 4699465 - DNA, 15 bp, Homo sapiens
gctgggctgggtgcg

SEQ ID NO: 4699466 - DNA, 19 bp, Homo sapiens
gctgggcttcagtggcagc

SEQ ID NO: 4699467 - DNA, 21 bp, Homo sapiens
gctggggcctatcagtgtgcc

SEQ ID NO: 4699468 - DNA, 14 bp, Homo sapiens
gctgggggcctcag

SEQ ID NO: 4699469 - DNA, 19 bp, Homo sapiens
gctgggggcctcagtgcca

SEQ ID NO: 4699470 - DNA, 14 bp, Homo sapiens
gctgggtggcccat

SEQ ID NO: 4699471 - DNA, 21 bp, Homo sapiens
gctgggtggcccatcccccct

SEQ ID NO: 4699472 - DNA, 15 bp, Homo sapiens
gctgggtgtggcgca

SEQ ID NO: 4699473 - DNA, 18 bp, Homo sapiens
gctgggttctacccaggt

SEQ ID NO: 4699474 - DNA, 21 bp, Homo sapiens
gctgggttctacccaggtgct

SEQ ID NO: 4699475 - DNA, 17 bp, Homo sapiens
gctgggttggcgcaccc

SEQ ID NO: 4699476 - DNA, 19 bp, Homo sapiens
gctggtcccactcagtcca

SEQ ID NO: 4699477 - DNA, 20 bp, Homo sapiens
gctggtcccactcagtccat

SEQ ID NO: 4699478 - DNA, 22 bp, Homo sapiens
gctggtctcgaactcctgacct

SEQ ID NO: 4699479 - DNA, 15 bp, Homo sapiens
gctggtgcctgaaga

SEQ ID NO: 4699480 - DNA, 13 bp, Homo sapiens
gctggtgcctgag

SEQ ID NO: 4699481 - DNA, 16 bp, Homo sapiens
gctggtggatggtgac

SEQ ID NO: 4699482 - DNA, 15 bp, Homo sapiens
gctggttcagggttg

SEQ ID NO: 4699483 - DNA, 21 bp, Homo sapiens
gctggttcggatttggggtgg

SEQ ID NO: 4699484 - DNA, 16 bp, Homo sapiens
gctggttggagagcta

SEQ ID NO: 4699485 - DNA, 17 bp, Homo sapiens
gctgtatcccatgagcc

SEQ ID NO: 4699486 - DNA, 20 bp, Homo sapiens
gctgtatcccatgagcctca

SEQ ID NO: 4699487 - DNA, 23 bp, Homo sapiens
gctgtatcccatgagcctcagca

SEQ ID NO: 4699488 - DNA, 22 bp, Homo sapiens
gctgtcaggattgcgagagatg

SEQ ID NO: 4699489 - DNA, 23 bp, Homo sapiens
gctgtcaggattgcgagagatgt

SEQ ID NO: 4699490 - DNA, 24 bp, Homo sapiens
gctgtcaggattgcgagagatgtg

SEQ ID NO: 4699491 - DNA, 14 bp, Homo sapiens
gctgtccagtgccc

SEQ ID NO: 4699492 - DNA, 15 bp, Homo sapiens
gctgtccagtgccca

SEQ ID NO: 4699493 - DNA, 21 bp, Homo sapiens
gctgtcccaagctcccaagag

SEQ ID NO: 4699494 - DNA, 16 bp, Homo sapiens
gctgtcccctcttgcc

SEQ ID NO: 4699495 - DNA, 18 bp, Homo sapiens
gctgtcccctcttgcccc

SEQ ID NO: 4699496 - DNA, 21 bp, Homo sapiens
gctgtgacaccccccttctga

SEQ ID NO: 4699497 - DNA, 13 bp, Homo sapiens
gctgtgacatcta

SEQ ID NO: 4699498 - DNA, 12 bp, Homo sapiens
gctgtgccaccc

SEQ ID NO: 4699499 - DNA, 19 bp, Homo sapiens
gctgtgccaccctgggctc

SEQ ID NO: 4699500 - DNA, 21 bp, Homo sapiens
gctgtgccaccctgggctctg

SEQ ID NO: 4699501 - DNA, 16 bp, Homo sapiens
gctgtgctctggacag

SEQ ID NO: 4699502 - DNA, 21 bp, Homo sapiens
gctgtgctctggacaggcatg

SEQ ID NO: 4699503 - DNA, 14 bp, Homo sapiens
gctgtgctgccctg

SEQ ID NO: 4699504 - DNA, 19 bp, Homo sapiens
gctgtgctgccctgcccac

SEQ ID NO: 4699505 - DNA, 22 bp, Homo sapiens
gctgtggaaaggattctaaaca

SEQ ID NO: 4699506 - DNA, 22 bp, Homo sapiens
gctgtgggcgtgagacctgccc

SEQ ID NO: 4699507 - DNA, 16 bp, Homo sapiens
gctgttgtacatttat

SEQ ID NO: 4699508 - DNA, 15 bp, Homo sapiens
ggaggtaaaggatga

SEQ ID NO: 4699509 - DNA, 22 bp, Homo sapiens
ggaggtaaggaatacctgtccc

SEQ ID NO: 4699510 - DNA, 14 bp, Homo sapiens
ggaggtgaccccag

SEQ ID NO: 4699511 - DNA, 17 bp, Homo sapiens
ggagtacaggtgaagca

SEQ ID NO: 4699512 - DNA, 22 bp, Homo sapiens
ggagtcccaccttggctgcagg

SEQ ID NO: 4699513 - DNA, 14 bp, Homo sapiens
ggagtcccagagct

SEQ ID NO: 4699514 - DNA, 22 bp, Homo sapiens
ggagtctcccactgcaacttgt

SEQ ID NO: 4699515 - DNA, 19 bp, Homo sapiens
ggagtgacagaggcagccc

SEQ ID NO: 4699516 - DNA, 12 bp, Homo sapiens
ggagtgcagtga

SEQ ID NO: 4699517 - DNA, 14 bp, Homo sapiens
ggagtgcagtgagc

SEQ ID NO: 4699518 - DNA, 22 bp, Homo sapiens
ggagtgggcccaatgcactttg

SEQ ID NO: 4699519 - DNA, 20 bp, Homo sapiens
ggagtggttgggctgtgcct

SEQ ID NO: 4699520 - DNA, 21 bp, Homo sapiens
ggagtgtttgacgaagaaaca

SEQ ID NO: 4699521 - DNA, 20 bp, Homo sapiens
ggagttgatcgcctttccca

SEQ ID NO: 4699522 - DNA, 23 bp, Homo sapiens
ggagttgatcgcctttcccaggt

SEQ ID NO: 4699523 - DNA, 15 bp, Homo sapiens
ggataaaaagatgtt

SEQ ID NO: 4699524 - DNA, 20 bp, Homo sapiens
ggataggcaggaacatacag

SEQ ID NO: 4699525 - DNA, 17 bp, Homo sapiens
ggatccaaactgatcca

SEQ ID NO: 4699526 - DNA, 22 bp, Homo sapiens
ggatccctcatcctcataccca

SEQ ID NO: 4699527 - DNA, 18 bp, Homo sapiens
ggatccctcatctgtccc

SEQ ID NO: 4699528 - DNA, 13 bp, Homo sapiens
ggatcctccaggt

SEQ ID NO: 4699529 - DNA, 20 bp, Homo sapiens
ggatctgcccctccctgctt

SEQ ID NO: 4699530 - DNA, 21 bp, Homo sapiens
ggatctttggacagaagcagc

SEQ ID NO: 4699531 - DNA, 22 bp, Homo sapiens
ggatctttggacagaagcagct

SEQ ID NO: 4699532 - DNA, 15 bp, Homo sapiens
ggatgagagcccaga

SEQ ID NO: 4699533 - DNA, 16 bp, Homo sapiens
ggatgagagcccagag

SEQ ID NO: 4699534 - DNA, 19 bp, Homo sapiens
ggatgagagcccagaggta

SEQ ID NO: 4699535 - DNA, 17 bp, Homo sapiens
ggatgagcatggagctg

SEQ ID NO: 4699536 - DNA, 20 bp, Homo sapiens
ggatgagcatggagctggcc

SEQ ID NO: 4699537 - DNA, 18 bp, Homo sapiens
ggatgatctaggaagact

SEQ ID NO: 4699538 - DNA, 22 bp, Homo sapiens
ggatgatctaggaagactttgg

SEQ ID NO: 4699539 - DNA, 17 bp, Homo sapiens
ggatgcagcctcacagt

SEQ ID NO: 4699540 - DNA, 19 bp, Homo sapiens
ggatgcagcctcacagtcc

SEQ ID NO: 4699541 - DNA, 19 bp, Homo sapiens
ggatgcctggtggcagctg

SEQ ID NO: 4699542 - DNA, 20 bp, Homo sapiens
ggatgcctggtggcagctgc

SEQ ID NO: 4699543 - DNA, 20 bp, Homo sapiens
ggatgggggaaatggtgcct

SEQ ID NO: 4699544 - DNA, 15 bp, Homo sapiens
ggatgggggctctgc

SEQ ID NO: 4699545 - DNA, 23 bp, Homo sapiens
ggatggtgacttttgaagaacaa

SEQ ID NO: 4699546 - DNA, 13 bp, Homo sapiens
ggatggtgccctg

SEQ ID NO: 4699547 - DNA, 15 bp, Homo sapiens
ggatgttctgggaca

SEQ ID NO: 4699548 - DNA, 23 bp, Homo sapiens
ggattacaagcgtgagccactgc

SEQ ID NO: 4699549 - DNA, 19 bp, Homo sapiens
ggattacaggctcctgcca

SEQ ID NO: 4699550 - DNA, 16 bp, Homo sapiens
ggattgcgagagatgt

SEQ ID NO: 4699551 - DNA, 19 bp, Homo sapiens
ggattgcgagagatgtgtg

SEQ ID NO: 4699552 - DNA, 17 bp, Homo sapiens
ggattgctactgtccta

SEQ ID NO: 4699553 - DNA, 16 bp, Homo sapiens
ggattgtccccgaccc

SEQ ID NO: 4699554 - DNA, 17 bp, Homo sapiens
ggatttaaaagcctgct

SEQ ID NO: 4699555 - DNA, 19 bp, Homo sapiens
ggatttaaaagcctgctca

SEQ ID NO: 4699556 - DNA, 21 bp, Homo sapiens
ggattttgatccaagctggtc

SEQ ID NO: 4699557 - DNA, 16 bp, Homo sapiens
ggattttgtcaagcag

SEQ ID NO: 4699558 - DNA, 10 bp, Homo sapiens
ggatttttag

SEQ ID NO: 4699559 - DNA, 14 bp, Homo sapiens
ggcaaacatgtgca

SEQ ID NO: 4699560 - DNA, 13 bp, Homo sapiens
ggcaaacccatca

SEQ ID NO: 4699561 - DNA, 16 bp, Homo sapiens
ggcaaatgcccaaggg

SEQ ID NO: 4699562 - DNA, 13 bp, Homo sapiens
ggcaaattaaaca

SEQ ID NO: 4699563 - DNA, 18 bp, Homo sapiens
ggcaacccccagcctgct

SEQ ID NO: 4699564 - DNA, 16 bp, Homo sapiens
ggcaacgcacaaaaca

SEQ ID NO: 4699565 - DNA, 18 bp, Homo sapiens
ggcaacttgggaactaga

SEQ ID NO: 4699566 - DNA, 22 bp, Homo sapiens
ggcaactttccttgttccccat

SEQ ID NO: 4699567 - DNA, 20 bp, Homo sapiens
ggcaagctagaacctggagg

SEQ ID NO: 4699568 - DNA, 14 bp, Homo sapiens
ggcaaggacacaga

SEQ ID NO: 4699569 - DNA, 14 bp, Homo sapiens
ggcaaggctgtgct

SEQ ID NO: 4699570 - DNA, 19 bp, Homo sapiens
ggcacagtgtctgggctga

SEQ ID NO: 4699571 - DNA, 18 bp, Homo sapiens
ggcacatttaagagacag

SEQ ID NO: 4699572 - DNA, 20 bp, Homo sapiens
ggcacctgcaggttgggcca

SEQ ID NO: 4699573 - DNA, 15 bp, Homo sapiens
ggcactatttttatt

SEQ ID NO: 4699574 - DNA, 18 bp, Homo sapiens
ggcactcagaagacactg

SEQ ID NO: 4699575 - DNA, 20 bp, Homo sapiens
ggcactgcatgttcctggac

SEQ ID NO: 4699576 - DNA, 12 bp, Homo sapiens
ggcactgcctga

SEQ ID NO: 4699577 - DNA, 14 bp, Homo sapiens
ggcactgctgggtg

SEQ ID NO: 4699578 - DNA, 19 bp, Homo sapiens
ggcactgctgggtggccca

SEQ ID NO: 4699579 - DNA, 20 bp, Homo sapiens
ggcactgctgggtggcccat

SEQ ID NO: 4699580 - DNA, 16 bp, Homo sapiens
ggcactgcttccagtg

SEQ ID NO: 4699581 - DNA, 20 bp, Homo sapiens
ggcactgcttccagtgaggc

SEQ ID NO: 4699582 - DNA, 12 bp, Homo sapiens
ggcagaagacac

SEQ ID NO: 4699583 - DNA, 16 bp, Homo sapiens
ggcagaagacaccaga

SEQ ID NO: 4699584 - DNA, 17 bp, Homo sapiens
ggcagaagtgtttttta

SEQ ID NO: 4699585 - DNA, 19 bp, Homo sapiens
ggcagaccctgagcagaat

SEQ ID NO: 4699586 - DNA, 20 bp, Homo sapiens
ggcagagcagagaccatccc

SEQ ID NO: 4699587 - DNA, 16 bp, Homo sapiens
ggcagagcccaaggga

SEQ ID NO: 4699588 - DNA, 23 bp, Homo sapiens
ggcagatacaggaaaagctgctg

SEQ ID NO: 4699589 - DNA, 15 bp, Homo sapiens
ggcagcaggtgctgc

SEQ ID NO: 4699590 - DNA, 20 bp, Homo sapiens
ggcagcagtgtgaggccagg

SEQ ID NO: 4699591 - DNA, 12 bp, Homo sapiens
ggcagccaggga

SEQ ID NO: 4699592 - DNA, 19 bp, Homo sapiens
ggcagccagggagagccca

SEQ ID NO: 4699593 - DNA, 21 bp, Homo sapiens
ggcagccagggagagcccagg

SEQ ID NO: 4699594 - DNA, 16 bp, Homo sapiens
ggcagccccattctgc

SEQ ID NO: 4699595 - DNA, 21 bp, Homo sapiens
ggcagccccattctgcctgcc

SEQ ID NO: 4699596 - DNA, 11 bp, Homo sapiens
ggcagccctcc

SEQ ID NO: 4699597 - DNA, 16 bp, Homo sapiens
ggcagccctccttacc

SEQ ID NO: 4699598 - DNA, 14 bp, Homo sapiens
ggcagctcacctct

SEQ ID NO: 4699599 - DNA, 19 bp, Homo sapiens
ggcagctgcggtccaccca

SEQ ID NO: 4699600 - DNA, 22 bp, Homo sapiens
ggcagctgcttttgtctatggg

SEQ ID NO: 4699601 - DNA, 18 bp, Homo sapiens
ggcaggcacagcacaggg

SEQ ID NO: 4699602 - DNA, 13 bp, Homo sapiens
ggcaggccctgca

SEQ ID NO: 4699603 - DNA, 14 bp, Homo sapiens
ggcaggccctgcac

SEQ ID NO: 4699604 - DNA, 22 bp, Homo sapiens
ggcaggccctgcactgtcctgc

SEQ ID NO: 4699605 - DNA, 22 bp, Homo sapiens
ggcaggctaaggcgtggagctg

SEQ ID NO: 4699606 - DNA, 18 bp, Homo sapiens
ggcagggaacatggggag

SEQ ID NO: 4699607 - DNA, 17 bp, Homo sapiens
ggcagggagggcctggg

SEQ ID NO: 4699608 - DNA, 17 bp, Homo sapiens
ggcagggtctcactctg

SEQ ID NO: 4699609 - DNA, 20 bp, Homo sapiens
ggcagggtctcactctgtcg

SEQ ID NO: 4699610 - DNA, 14 bp, Homo sapiens
ggcagtgccagggc

SEQ ID NO: 4699611 - DNA, 16 bp, Homo sapiens
ggcagtgggagctgcc

SEQ ID NO: 4699612 - DNA, 23 bp, Homo sapiens
ggcagtgggtcccacttcccctc

SEQ ID NO: 4699613 - DNA, 12 bp, Homo sapiens
ggcagtttttct

SEQ ID NO: 4699614 - DNA, 19 bp, Homo sapiens
ggcatagatgcaggtgagc

SEQ ID NO: 4699615 - DNA, 22 bp, Homo sapiens
ggcatccctttttcataaatta

SEQ ID NO: 4699616 - DNA, 19 bp, Homo sapiens
ggcatgacccagtgaagat

SEQ ID NO: 4699617 - DNA, 22 bp, Homo sapiens
ggctgtatcccatgagcctcag

SEQ ID NO: 4699618 - DNA, 15 bp, Homo sapiens
ggctgtccagtgccc

SEQ ID NO: 4699619 - DNA, 19 bp, Homo sapiens
ggctgtccagtgcccattc

SEQ ID NO: 4699620 - DNA, 19 bp, Homo sapiens
ggctgtcccaagctcccaa

SEQ ID NO: 4699621 - DNA, 15 bp, Homo sapiens
ggctgttggctgggg

SEQ ID NO: 4699622 - DNA, 15 bp, Homo sapiens
ggcttaaaacaacac

SEQ ID NO: 4699623 - DNA, 15 bp, Homo sapiens
ggcttagtcactgag

SEQ ID NO: 4699624 - DNA, 12 bp, Homo sapiens
ggcttcacagat

SEQ ID NO: 4699625 - DNA, 15 bp, Homo sapiens
ggcttcactgtataa

SEQ ID NO: 4699626 - DNA, 21 bp, Homo sapiens
ggcttcactgtataaatagga

SEQ ID NO: 4699627 - DNA, 20 bp, Homo sapiens
ggcttcagtggcagctgctt

SEQ ID NO: 4699628 - DNA, 22 bp, Homo sapiens
ggcttccaaggtggtctgctcg

SEQ ID NO: 4699629 - DNA, 14 bp, Homo sapiens
ggcttctctctgtg

SEQ ID NO: 4699630 - DNA, 18 bp, Homo sapiens
ggcttttaccattagcat

SEQ ID NO: 4699631 - DNA, 22 bp, Homo sapiens
gggaaactgtgaatgcttctga

SEQ ID NO: 4699632 - DNA, 22 bp, Homo sapiens
gggaacagactggaagcacagc

SEQ ID NO: 4699633 - DNA, 12 bp, Homo sapiens
gggaacatgggg

SEQ ID NO: 4699634 - DNA, 13 bp, Homo sapiens
gggaacctgaccc

SEQ ID NO: 4699635 - DNA, 14 bp, Homo sapiens
gggaagagcacagc

SEQ ID NO: 4699636 - DNA, 22 bp, Homo sapiens
gggaagatgaaaccgtccctga

SEQ ID NO: 4699637 - DNA, 16 bp, Homo sapiens
gggaagggggctggga

SEQ ID NO: 4699638 - DNA, 17 bp, Homo sapiens
gggaagggggctgggac

SEQ ID NO: 4699639 - DNA, 22 bp, Homo sapiens
gggaatggcacagcccaaagaa

SEQ ID NO: 4699640 - DNA, 13 bp, Homo sapiens
gggacagagcaga

SEQ ID NO: 4699641 - DNA, 13 bp, Homo sapiens
gggacagaggggg

SEQ ID NO: 4699642 - DNA, 15 bp, Homo sapiens
gggacagctccttct

SEQ ID NO: 4699643 - DNA, 16 bp, Homo sapiens
gggacagctccttctg

SEQ ID NO: 4699644 - DNA, 15 bp, Homo sapiens
gggaccccacccctc

SEQ ID NO: 4699645 - DNA, 18 bp, Homo sapiens
gggaccccacccctcatc

SEQ ID NO: 4699646 - DNA, 16 bp, Homo sapiens
gggaccccgagcctgg

SEQ ID NO: 4699647 - DNA, 14 bp, Homo sapiens
gggacgcaggcccc

SEQ ID NO: 4699648 - DNA, 22 bp, Homo sapiens
gggacgcctgggggtgccagga

SEQ ID NO: 4699649 - DNA, 17 bp, Homo sapiens
gggactacaggcaccca

SEQ ID NO: 4699650 - DNA, 23 bp, Homo sapiens
gggactcaatgcactgacattgt

SEQ ID NO: 4699651 - DNA, 17 bp, Homo sapiens
gggacttggaagctccg

SEQ ID NO: 4699652 - DNA, 18 bp, Homo sapiens
gggacttggaagctccgc

SEQ ID NO: 4699653 - DNA, 19 bp, Homo sapiens
gggagactgggctgaggga

SEQ ID NO: 4699654 - DNA, 17 bp, Homo sapiens
gggagagaactgagcat

SEQ ID NO: 4699655 - DNA, 17 bp, Homo sapiens
gggagagcccaggagct

SEQ ID NO: 4699656 - DNA, 14 bp, Homo sapiens
gggagaggggacgc

SEQ ID NO: 4699657 - DNA, 12 bp, Homo sapiens
gggagccagggt

SEQ ID NO: 4699658 - DNA, 14 bp, Homo sapiens
gggaggagcctggg

SEQ ID NO: 4699659 - DNA, 19 bp, Homo sapiens
gggaggcacttcctcccct

SEQ ID NO: 4699660 - DNA, 20 bp, Homo sapiens
gggaggcagaggttgcagtg

SEQ ID NO: 4699661 - DNA, 15 bp, Homo sapiens
gggagggctccagac

SEQ ID NO: 4699662 - DNA, 14 bp, Homo sapiens
gggagggggcagaa

SEQ ID NO: 4699663 - DNA, 16 bp, Homo sapiens
gggaggtgaccccagg

SEQ ID NO: 4699664 - DNA, 11 bp, Homo sapiens
gggagtgagct

SEQ ID NO: 4699665 - DNA, 13 bp, Homo sapiens
gggatacatgctc

SEQ ID NO: 4699666 - DNA, 15 bp, Homo sapiens
gggatctgcccctcc

SEQ ID NO: 4699667 - DNA, 13 bp, Homo sapiens
gggatgagaaagg

SEQ ID NO: 4699668 - DNA, 12 bp, Homo sapiens
gggatggtgccc

SEQ ID NO: 4699669 - DNA, 22 bp, Homo sapiens
gggatgtacaaggcgatcccat

SEQ ID NO: 4699670 - DNA, 20 bp, Homo sapiens
gggatttccagccagggctg

SEQ ID NO: 4699671 - DNA, 16 bp, Homo sapiens
gggcactcagaagaca

SEQ ID NO: 4699672 - DNA, 13 bp, Homo sapiens
gggcactgctggg

SEQ ID NO: 4699673 - DNA, 20 bp, Homo sapiens
gggcactgctgggtggccca

SEQ ID NO: 4699674 - DNA, 21 bp, Homo sapiens
gggcactgctgggtggcccat

SEQ ID NO: 4699675 - DNA, 16 bp, Homo sapiens
gggcagagcagagacc

SEQ ID NO: 4699676 - DNA, 14 bp, Homo sapiens
gggcagagcccaag

SEQ ID NO: 4699677 - DNA, 12 bp, Homo sapiens
gggcagcacagc

SEQ ID NO: 4699678 - DNA, 20 bp, Homo sapiens
gggcagcagaagggggtggt

SEQ ID NO: 4699679 - DNA, 18 bp, Homo sapiens
gggcagccagggagagcc

SEQ ID NO: 4699680 - DNA, 20 bp, Homo sapiens
gggcagccagggagagccca

SEQ ID NO: 4699681 - DNA, 12 bp, Homo sapiens
gggcaggcacag

SEQ ID NO: 4699682 - DNA, 13 bp, Homo sapiens
gggcaggcacagc

SEQ ID NO: 4699683 - DNA, 14 bp, Homo sapiens
gggcaggcacagca

SEQ ID NO: 4699684 - DNA, 13 bp, Homo sapiens
gggcaggccctgc

SEQ ID NO: 4699685 - DNA, 17 bp, Homo sapiens
gggcagtcattatccag

SEQ ID NO: 4699686 - DNA, 17 bp, Homo sapiens
gggcatgggtcgggaga

SEQ ID NO: 4699687 - DNA, 12 bp, Homo sapiens
gggccagaggct

SEQ ID NO: 4699688 - DNA, 14 bp, Homo sapiens
gggccatactggcc

SEQ ID NO: 4699689 - DNA, 16 bp, Homo sapiens
gggccatactggcctc

SEQ ID NO: 4699690 - DNA, 15 bp, Homo sapiens
gggccatgctgagag

SEQ ID NO: 4699691 - DNA, 18 bp, Homo sapiens
gggccatgctgagagctg

SEQ ID NO: 4699692 - DNA, 22 bp, Homo sapiens
gggcccatggaggagacaggaa

SEQ ID NO: 4699693 - DNA, 21 bp, Homo sapiens
gggcccgcttgcctcggctcc

SEQ ID NO: 4699694 - DNA, 11 bp, Homo sapiens
gggcccggacg

SEQ ID NO: 4699695 - DNA, 15 bp, Homo sapiens
gggcctatcagtgtg

SEQ ID NO: 4699696 - DNA, 18 bp, Homo sapiens
gggcctatcagtgtgccc

SEQ ID NO: 4699697 - DNA, 20 bp, Homo sapiens
gggcctatcagtgtgccccc

SEQ ID NO: 4699698 - DNA, 23 bp, Homo sapiens
gggcctatcagtgtgccccccat

SEQ ID NO: 4699699 - DNA, 13 bp, Homo sapiens
gggcctcctgtgt

SEQ ID NO: 4699700 - DNA, 19 bp, Homo sapiens
gggcctgccacctggaccc

SEQ ID NO: 4699701 - DNA, 23 bp, Homo sapiens
gggcctgccacctggacccctgc

SEQ ID NO: 4699702 - DNA, 12 bp, Homo sapiens
gggcctggctca

SEQ ID NO: 4699703 - DNA, 17 bp, Homo sapiens
gggcctggctcaggtgg

SEQ ID NO: 4699704 - DNA, 11 bp, Homo sapiens
gggcctgggcc

SEQ ID NO: 4699705 - DNA, 21 bp, Homo sapiens
gggcggtgagaggggaacaga

SEQ ID NO: 4699706 - DNA, 20 bp, Homo sapiens
gggctaacatttaggagaag

SEQ ID NO: 4699707 - DNA, 16 bp, Homo sapiens
gggctaccctgagctg

SEQ ID NO: 4699708 - DNA, 19 bp, Homo sapiens
gggctaccctgagctgagg

SEQ ID NO: 4699709 - DNA, 21 bp, Homo sapiens
gggctaccctgagctgaggca

SEQ ID NO: 4699710 - DNA, 14 bp, Homo sapiens
gggctagaacctgg

SEQ ID NO: 4699711 - DNA, 15 bp, Homo sapiens
gggctagaacctgga

SEQ ID NO: 4699712 - DNA, 17 bp, Homo sapiens
gggctagaacctggagg

SEQ ID NO: 4699713 - DNA, 13 bp, Homo sapiens
gggctcagagagg

SEQ ID NO: 4699714 - DNA, 14 bp, Homo sapiens
gggctcagagagga

SEQ ID NO: 4699715 - DNA, 17 bp, Homo sapiens
gggctcagcggggacag

SEQ ID NO: 4699716 - DNA, 19 bp, Homo sapiens
gggctcagcggggacagct

SEQ ID NO: 4699717 - DNA, 18 bp, Homo sapiens
gggctccctgactgggag

SEQ ID NO: 4699718 - DNA, 17 bp, Homo sapiens
gggctcccttcccacct

SEQ ID NO: 4699719 - DNA, 18 bp, Homo sapiens
gggctcccttcccacctc

SEQ ID NO: 4699720 - DNA, 14 bp, Homo sapiens
gggctcctgtgccc

SEQ ID NO: 4699721 - DNA, 15 bp, Homo sapiens
gggctcctgtgccct

SEQ ID NO: 4699722 - DNA, 13 bp, Homo sapiens
gggctctgcctcc

SEQ ID NO: 4699723 - DNA, 15 bp, Homo sapiens
gggctctgcctccca

SEQ ID NO: 4699724 - DNA, 20 bp, Homo sapiens
gggctctgcctcccatcacc

SEQ ID NO: 4699725 - DNA, 14 bp, Homo sapiens
gggctctgtgggct

SEQ ID NO: 4699726 - DNA, 19 bp, Homo sapiens
gggctgcaccggctggcct

SEQ ID NO: 4699727 - DNA, 22 bp, Homo sapiens
gggctgcccgctcccagtgtct

SEQ ID NO: 4699728 - DNA, 20 bp, Homo sapiens
gtaagtataacaaactatgt

SEQ ID NO: 4699729 - DNA, 16 bp, Homo sapiens
gtaataatagactgta

SEQ ID NO: 4699730 - DNA, 18 bp, Homo sapiens
gtaatattctctgatgtt

SEQ ID NO: 4699731 - DNA, 19 bp, Homo sapiens
gtaatattgtaaatactgg

SEQ ID NO: 4699732 - DNA, 14 bp, Homo sapiens
gtaatatttcttca

SEQ ID NO: 4699733 - DNA, 15 bp, Homo sapiens
gtaatcgacctgcct

SEQ ID NO: 4699734 - DNA, 20 bp, Homo sapiens
gtaatctgtaaatgaacaca

SEQ ID NO: 4699735 - DNA, 19 bp, Homo sapiens
gtaatgaaccgctgaatat

SEQ ID NO: 4699736 - DNA, 18 bp, Homo sapiens
gtaatggactatgcacac

SEQ ID NO: 4699737 - DNA, 13 bp, Homo sapiens
gtaattaaaagac

SEQ ID NO: 4699738 - DNA, 19 bp, Homo sapiens
gtaattaaaagactccaca

SEQ ID NO: 4699739 - DNA, 21 bp, Homo sapiens
gtaattgtgtggattctttaa

SEQ ID NO: 4699740 - DNA, 12 bp, Homo sapiens
gtaatttaactt

SEQ ID NO: 4699741 - DNA, 17 bp, Homo sapiens
gtacaaggcgatcccat

SEQ ID NO: 4699742 - DNA, 16 bp, Homo sapiens
gtacaattaagttaca

SEQ ID NO: 4699743 - DNA, 22 bp, Homo sapiens
gtacagagcccacgcccccact

SEQ ID NO: 4699744 - DNA, 16 bp, Homo sapiens
gtacagtctcaatttt

SEQ ID NO: 4699745 - DNA, 19 bp, Homo sapiens
gtacagtcttgcagcagga

SEQ ID NO: 4699746 - DNA, 14 bp, Homo sapiens
gtacagtcttgtat

SEQ ID NO: 4699747 - DNA, 15 bp, Homo sapiens
gtacataaaattttc

SEQ ID NO: 4699748 - DNA, 20 bp, Homo sapiens
gtacattgaaaccctccaaa

SEQ ID NO: 4699749 - DNA, 14 bp, Homo sapiens
gtacatttatgatt

SEQ ID NO: 4699750 - DNA, 16 bp, Homo sapiens
gtacatttatgattta

SEQ ID NO: 4699751 - DNA, 21 bp, Homo sapiens
gtacatttatgatttaataaa

SEQ ID NO: 4699752 - DNA, 19 bp, Homo sapiens
gtaccaggtctcctccacc

SEQ ID NO: 4699753 - DNA, 22 bp, Homo sapiens
gtaccaggtctcctccaccgcc

SEQ ID NO: 4699754 - DNA, 14 bp, Homo sapiens
gtacccactgctct

SEQ ID NO: 4699755 - DNA, 18 bp, Homo sapiens
gtacccccgcccaggctg

SEQ ID NO: 4699756 - DNA, 12 bp, Homo sapiens
gtactacaattt

SEQ ID NO: 4699757 - DNA, 15 bp, Homo sapiens
gtactacaatttaaa

SEQ ID NO: 4699758 - DNA, 19 bp, Homo sapiens
gtactacagtcctcccatc

SEQ ID NO: 4699759 - DNA, 15 bp, Homo sapiens
gtactcaaatgtagc

SEQ ID NO: 4699760 - DNA, 18 bp, Homo sapiens
gtactcaaattcaatgat

SEQ ID NO: 4699761 - DNA, 24 bp, Homo sapiens
gtactccagcccggcactccagcc

SEQ ID NO: 4699762 - DNA, 13 bp, Homo sapiens
gtactctgtgtgt

SEQ ID NO: 4699763 - DNA, 20 bp, Homo sapiens
gtactctgtgtgtgtatgag

SEQ ID NO: 4699764 - DNA, 23 bp, Homo sapiens
gtactgtatggaaacactgattt

SEQ ID NO: 4699765 - DNA, 14 bp, Homo sapiens
gtacttctccaccc

SEQ ID NO: 4699766 - DNA, 17 bp, Homo sapiens
gtacttctccaccctgc

SEQ ID NO: 4699767 - DNA, 20 bp, Homo sapiens
gtacttgtggacacagctct

SEQ ID NO: 4699768 - DNA, 20 bp, Homo sapiens
gtagaaaagggaactgaaca

SEQ ID NO: 4699769 - DNA, 18 bp, Homo sapiens
gtagaaagacagagctgg

SEQ ID NO: 4699770 - DNA, 14 bp, Homo sapiens
gtagaatgttttca

SEQ ID NO: 4699771 - DNA, 18 bp, Homo sapiens
gtagagccagggtctcac

SEQ ID NO: 4699772 - DNA, 17 bp, Homo sapiens
gtagagttaagaagctg

SEQ ID NO: 4699773 - DNA, 18 bp, Homo sapiens
gtagagttaagaagctgt

SEQ ID NO: 4699774 - DNA, 21 bp, Homo sapiens
gtagatatcctctgcttaaaa

SEQ ID NO: 4699775 - DNA, 19 bp, Homo sapiens
gtagctgggactacaggca

SEQ ID NO: 4699776 - DNA, 19 bp, Homo sapiens
gtaggagactgtttggaaa

SEQ ID NO: 4699777 - DNA, 16 bp, Homo sapiens
gtagggcgggaggatg

SEQ ID NO: 4699778 - DNA, 22 bp, Homo sapiens
gtaggggagccacatttacata

SEQ ID NO: 4699779 - DNA, 21 bp, Homo sapiens
gtagggggctggaggagccca

SEQ ID NO: 4699780 - DNA, 14 bp, Homo sapiens
gtagggtgggcctt

SEQ ID NO: 4699781 - DNA, 16 bp, Homo sapiens
gtagtcacctctgggc

SEQ ID NO: 4699782 - DNA, 18 bp, Homo sapiens
gtataaaaacatgagtta

SEQ ID NO: 4699783 - DNA, 12 bp, Homo sapiens
gtataaattaat

SEQ ID NO: 4699784 - DNA, 15 bp, Homo sapiens
gtataacaaactatg

SEQ ID NO: 4699785 - DNA, 12 bp, Homo sapiens
gtataatatttt

SEQ ID NO: 4699786 - DNA, 13 bp, Homo sapiens
gtatacatttgtt

SEQ ID NO: 4699787 - DNA, 14 bp, Homo sapiens
gtatagaaatgctg

SEQ ID NO: 4699788 - DNA, 15 bp, Homo sapiens
gtatagaaatgctgg

SEQ ID NO: 4699789 - DNA, 16 bp, Homo sapiens
gtatatggtatttatt

SEQ ID NO: 4699790 - DNA, 12 bp, Homo sapiens
gtatatgtttta

SEQ ID NO: 4699791 - DNA, 13 bp, Homo sapiens
gtatatgttttat

SEQ ID NO: 4699792 - DNA, 19 bp, Homo sapiens
gtatattaaaaaagagaca

SEQ ID NO: 4699793 - DNA, 18 bp, Homo sapiens
gtatcaggacccagagga

SEQ ID NO: 4699794 - DNA, 22 bp, Homo sapiens
gtatcaggacccagaggaaggg

SEQ ID NO: 4699795 - DNA, 21 bp, Homo sapiens
gtatcccatgagcctcagcat

SEQ ID NO: 4699796 - DNA, 19 bp, Homo sapiens
gtatctgcatgtaaaatct

SEQ ID NO: 4699797 - DNA, 21 bp, Homo sapiens
gtatctgcatgtaaaatcttc

SEQ ID NO: 4699798 - DNA, 17 bp, Homo sapiens
gtatctggtatctgcat

SEQ ID NO: 4699799 - DNA, 12 bp, Homo sapiens
gtatctggtgac

SEQ ID NO: 4699800 - DNA, 20 bp, Homo sapiens
gtatgatcacggctcactgc

SEQ ID NO: 4699801 - DNA, 21 bp, Homo sapiens
gtatgatcacggctcactgca

SEQ ID NO: 4699802 - DNA, 22 bp, Homo sapiens
gtatgatcacggctcactgcag

SEQ ID NO: 4699803 - DNA, 20 bp, Homo sapiens
gtatgcaagtgggagatgaa

SEQ ID NO: 4699804 - DNA, 16 bp, Homo sapiens
gtatggaatgcttctt

SEQ ID NO: 4699805 - DNA, 13 bp, Homo sapiens
gtatggagctcag

SEQ ID NO: 4699806 - DNA, 21 bp, Homo sapiens
gtatgtgtggtttcagttctg

SEQ ID NO: 4699807 - DNA, 20 bp, Homo sapiens
gtattaaatcagttctcaat

SEQ ID NO: 4699808 - DNA, 22 bp, Homo sapiens
gtattaactttatacacttgga

SEQ ID NO: 4699809 - DNA, 22 bp, Homo sapiens
gtattaagttgttaataaaagt

SEQ ID NO: 4699810 - DNA, 14 bp, Homo sapiens
gtattacttctgct

SEQ ID NO: 4699811 - DNA, 21 bp, Homo sapiens
gtattcccaaaaattactttg

SEQ ID NO: 4699812 - DNA, 11 bp, Homo sapiens
gtattctctga

SEQ ID NO: 4699813 - DNA, 12 bp, Homo sapiens
gtattctctgag

SEQ ID NO: 4699814 - DNA, 13 bp, Homo sapiens
gtattctctgagc

SEQ ID NO: 4699815 - DNA, 15 bp, Homo sapiens
gtattgctccatttt

SEQ ID NO: 4699816 - DNA, 23 bp, Homo sapiens
gtatttaatgatttttgtgtatc

SEQ ID NO: 4699817 - DNA, 13 bp, Homo sapiens
gtatttattaatt

SEQ ID NO: 4699818 - DNA, 16 bp, Homo sapiens
gtatttattaatttga

SEQ ID NO: 4699819 - DNA, 17 bp, Homo sapiens
gtatttattaatttgaa

SEQ ID NO: 4699820 - DNA, 18 bp, Homo sapiens
gtatttattaatttgaaa

SEQ ID NO: 4699821 - DNA, 13 bp, Homo sapiens
gtatttcaaattg

SEQ ID NO: 4699822 - DNA, 14 bp, Homo sapiens
gtattttaatcctg

SEQ ID NO: 4699823 - DNA, 19 bp, Homo sapiens
gtcaagagggtctgaggaa

SEQ ID NO: 4699824 - DNA, 15 bp, Homo sapiens
gtcaatttgctgaaa

SEQ ID NO: 4699825 - DNA, 21 bp, Homo sapiens
gtcaatttgctgaaaacatta

SEQ ID NO: 4699826 - DNA, 22 bp, Homo sapiens
gtcacacagtattacttctgct

SEQ ID NO: 4699827 - DNA, 17 bp, Homo sapiens
gtcacactaaaatttaa

SEQ ID NO: 4699828 - DNA, 13 bp, Homo sapiens
gtcacaggcaggt

SEQ ID NO: 4699829 - DNA, 16 bp, Homo sapiens
gtcacaggcaggtcca

SEQ ID NO: 4699830 - DNA, 13 bp, Homo sapiens
gtcacatgaaaca

SEQ ID NO: 4699831 - DNA, 20 bp, Homo sapiens
gtcacctgaagactcattct

SEQ ID NO: 4699832 - DNA, 13 bp, Homo sapiens
gtcacctgtgctt

SEQ ID NO: 4699833 - DNA, 14 bp, Homo sapiens
gtcactctggcagc

SEQ ID NO: 4699834 - DNA, 22 bp, Homo sapiens
gtcactctggcagctcagagag

SEQ ID NO: 4699835 - DNA, 23 bp, Homo sapiens
gtcactgagacagcccgggctct

SEQ ID NO: 4699836 - DNA, 16 bp, Homo sapiens
gtcactggctgcctcc

SEQ ID NO: 4699837 - DNA, 21 bp, Homo sapiens
gtcactggctgcctccactcc

SEQ ID NO: 4699838 - DNA, 21 bp, Homo sapiens
gtgcacacaccagagcccacc

SEQ ID NO: 4699839 - DNA, 15 bp, Homo sapiens
gtgcacatgcttcag

SEQ ID NO: 4699840 - DNA, 18 bp, Homo sapiens
gtgcacgcagtggccttc

SEQ ID NO: 4699841 - DNA, 18 bp, Homo sapiens
gtgcacgtacacacacat

SEQ ID NO: 4699842 - DNA, 20 bp, Homo sapiens
gtgcagtggtgcgatctggg

SEQ ID NO: 4699843 - DNA, 13 bp, Homo sapiens
gtgccaacactca

SEQ ID NO: 4699844 - DNA, 21 bp, Homo sapiens
gtgccaacagtgttaggcctg

SEQ ID NO: 4699845 - DNA, 22 bp, Homo sapiens
gtgccaatggaacctcctttct

SEQ ID NO: 4699846 - DNA, 14 bp, Homo sapiens
gtgccaccctgggc

SEQ ID NO: 4699847 - DNA, 15 bp, Homo sapiens
gtgccaccctgggct

SEQ ID NO: 4699848 - DNA, 16 bp, Homo sapiens
gtgccaccctgggctc

SEQ ID NO: 4699849 - DNA, 21 bp, Homo sapiens
gtgccaccctgggctctgtgg

SEQ ID NO: 4699850 - DNA, 18 bp, Homo sapiens
gtgccagcccctgctggc

SEQ ID NO: 4699851 - DNA, 21 bp, Homo sapiens
gtgccagcccctgctggctgg

SEQ ID NO: 4699852 - DNA, 13 bp, Homo sapiens
gtgccaggaccag

SEQ ID NO: 4699853 - DNA, 16 bp, Homo sapiens
gtgccagtcgcgctgc

SEQ ID NO: 4699854 - DNA, 18 bp, Homo sapiens
gtgccagtcgcgctgcct

SEQ ID NO: 4699855 - DNA, 22 bp, Homo sapiens
gtgccagtcgcgctgcctgtgt

SEQ ID NO: 4699856 - DNA, 21 bp, Homo sapiens
gtgcccaagtgggtccaagtg

SEQ ID NO: 4699857 - DNA, 17 bp, Homo sapiens
gtgccccccatcctggc

SEQ ID NO: 4699858 - DNA, 20 bp, Homo sapiens
gtgccccccatcctggccca

SEQ ID NO: 4699859 - DNA, 13 bp, Homo sapiens
gtgcccctagctt

SEQ ID NO: 4699860 - DNA, 15 bp, Homo sapiens
gtgccgacagaagga

SEQ ID NO: 4699861 - DNA, 23 bp, Homo sapiens
gtgccgccgcctcgcccaccgca

SEQ ID NO: 4699862 - DNA, 18 bp, Homo sapiens
gtgcctgattcggctgtc

SEQ ID NO: 4699863 - DNA, 18 bp, Homo sapiens
gtgcgaccccatctgccc

SEQ ID NO: 4699864 - DNA, 12 bp, Homo sapiens
gtgcgtgctcag

SEQ ID NO: 4699865 - DNA, 15 bp, Homo sapiens
gtgcgtgtgtagagt

SEQ ID NO: 4699866 - DNA, 20 bp, Homo sapiens
gtgctacgtacatgtgaggc

SEQ ID NO: 4699867 - DNA, 16 bp, Homo sapiens
gtgctcatttcaggat

SEQ ID NO: 4699868 - DNA, 14 bp, Homo sapiens
gtgctccaaatgat

SEQ ID NO: 4699869 - DNA, 23 bp, Homo sapiens
gtgctgagttggtgttgacatgt

SEQ ID NO: 4699870 - DNA, 18 bp, Homo sapiens
gtgctgccatccaggttc

SEQ ID NO: 4699871 - DNA, 20 bp, Homo sapiens
gtgctgccctgcccacctgg

SEQ ID NO: 4699872 - DNA, 19 bp, Homo sapiens
gtgctgcctctacctgaca

SEQ ID NO: 4699873 - DNA, 19 bp, Homo sapiens
gtgctgctaccctccctgc

SEQ ID NO: 4699874 - DNA, 12 bp, Homo sapiens
gtgctggagcca

SEQ ID NO: 4699875 - DNA, 18 bp, Homo sapiens
gtgctggagccactaact

SEQ ID NO: 4699876 - DNA, 21 bp, Homo sapiens
gtgctgggattacaagcgtga

SEQ ID NO: 4699877 - DNA, 20 bp, Homo sapiens
gtgctgggattacaggtgtg

SEQ ID NO: 4699878 - DNA, 12 bp, Homo sapiens
gtgctgtgacac

SEQ ID NO: 4699879 - DNA, 14 bp, Homo sapiens
gtgcttcgggccct

SEQ ID NO: 4699880 - DNA, 21 bp, Homo sapiens
gtgcttcttgtaatatttctt

SEQ ID NO: 4699881 - DNA, 16 bp, Homo sapiens
gtgcttgccacagagc

SEQ ID NO: 4699882 - DNA, 12 bp, Homo sapiens
gtgcttggagga

SEQ ID NO: 4699883 - DNA, 19 bp, Homo sapiens
gtggaaaggattctaaaca

SEQ ID NO: 4699884 - DNA, 13 bp, Homo sapiens
gtggaagcttcta

SEQ ID NO: 4699885 - DNA, 14 bp, Homo sapiens
gtggaagcttgggg

SEQ ID NO: 4699886 - DNA, 19 bp, Homo sapiens
gtggaagtagtggagcccc

SEQ ID NO: 4699887 - DNA, 23 bp, Homo sapiens
gtggacacagctcttctccaggc

SEQ ID NO: 4699888 - DNA, 20 bp, Homo sapiens
gtggagaagccacaggcctg

SEQ ID NO: 4699889 - DNA, 14 bp, Homo sapiens
gtggaggaaggatt

SEQ ID NO: 4699890 - DNA, 16 bp, Homo sapiens
gtggaggaaggattgt

SEQ ID NO: 4699891 - DNA, 13 bp, Homo sapiens
gtggagtcccaga

SEQ ID NO: 4699892 - DNA, 19 bp, Homo sapiens
gtggatccaaactgatcca

SEQ ID NO: 4699893 - DNA, 16 bp, Homo sapiens
gtggatgcctggtggc

SEQ ID NO: 4699894 - DNA, 18 bp, Homo sapiens
gtggatggtgacttttga

SEQ ID NO: 4699895 - DNA, 22 bp, Homo sapiens
gtggatggtgacttttgaagaa

SEQ ID NO: 4699896 - DNA, 21 bp, Homo sapiens
gtggattcagcttctgttgga

SEQ ID NO: 4699897 - DNA, 13 bp, Homo sapiens
gtggcaaggctgt

SEQ ID NO: 4699898 - DNA, 12 bp, Homo sapiens
gtggcactgcca

SEQ ID NO: 4699899 - DNA, 15 bp, Homo sapiens
gtggcagagcttgga

SEQ ID NO: 4699900 - DNA, 19 bp, Homo sapiens
gtggcagagcttggactgg

SEQ ID NO: 4699901 - DNA, 16 bp, Homo sapiens
gtggcagctcacctct

SEQ ID NO: 4699902 - DNA, 23 bp, Homo sapiens
gtggcagctgcggtccacccagg

SEQ ID NO: 4699903 - DNA, 12 bp, Homo sapiens
gtggcagctgct

SEQ ID NO: 4699904 - DNA, 19 bp, Homo sapiens
gtggcagtgggagctgcct

SEQ ID NO: 4699905 - DNA, 23 bp, Homo sapiens
gtggcatgtgggttgtgatattg

SEQ ID NO: 4699906 - DNA, 22 bp, Homo sapiens
gtggcattggcagcaggtgctg

SEQ ID NO: 4699907 - DNA, 17 bp, Homo sapiens
gtggcccatcccccctc

SEQ ID NO: 4699908 - DNA, 13 bp, Homo sapiens
gtggccccagcct

SEQ ID NO: 4699909 - DNA, 14 bp, Homo sapiens
gtggccccagcctg

SEQ ID NO: 4699910 - DNA, 17 bp, Homo sapiens
gtggccctctcccctgc

SEQ ID NO: 4699911 - DNA, 19 bp, Homo sapiens
gtggccctctcccctgccc

SEQ ID NO: 4699912 - DNA, 16 bp, Homo sapiens
gtggccgtcctgaggg

SEQ ID NO: 4699913 - DNA, 19 bp, Homo sapiens
gtggcctaccttgtgaggg

SEQ ID NO: 4699914 - DNA, 20 bp, Homo sapiens
gtggcctaccttgtgaggga

SEQ ID NO: 4699915 - DNA, 13 bp, Homo sapiens
gtggcctcccaac

SEQ ID NO: 4699916 - DNA, 22 bp, Homo sapiens
gtggcctctccttgtggcctgg

SEQ ID NO: 4699917 - DNA, 23 bp, Homo sapiens
gtggcctctccttgtggcctggg

SEQ ID NO: 4699918 - DNA, 22 bp, Homo sapiens
gtggcgcagcatattcaggaag

SEQ ID NO: 4699919 - DNA, 23 bp, Homo sapiens
gtggcgcagcatattcaggaagc

SEQ ID NO: 4699920 - DNA, 12 bp, Homo sapiens
gtggctccctgg

SEQ ID NO: 4699921 - DNA, 14 bp, Homo sapiens
gtggctctggggtc

SEQ ID NO: 4699922 - DNA, 19 bp, Homo sapiens
gtggctgggttggagggtg

SEQ ID NO: 4699923 - DNA, 15 bp, Homo sapiens
gtggctgtccagtgc

SEQ ID NO: 4699924 - DNA, 18 bp, Homo sapiens
gtggctgtccagtgccca

SEQ ID NO: 4699925 - DNA, 19 bp, Homo sapiens
gtggctgtccagtgcccat

SEQ ID NO: 4699926 - DNA, 14 bp, Homo sapiens
gtggcttcttaatc

SEQ ID NO: 4699927 - DNA, 23 bp, Homo sapiens
gtggcttgctttcttctcctgtg

SEQ ID NO: 4699928 - DNA, 23 bp, Homo sapiens
gtgggaacgactgggcactgcca

SEQ ID NO: 4699929 - DNA, 14 bp, Homo sapiens
gtgggagtgggccc

SEQ ID NO: 4699930 - DNA, 13 bp, Homo sapiens
gtgggatcctcca

SEQ ID NO: 4699931 - DNA, 18 bp, Homo sapiens
gtgggatctgcccctccc

SEQ ID NO: 4699932 - DNA, 16 bp, Homo sapiens
gtgggcttcccagtgg

SEQ ID NO: 4699933 - DNA, 23 bp, Homo sapiens
gtgggcttcccagtggctgctgc

SEQ ID NO: 4699934 - DNA, 13 bp, Homo sapiens
gtggggaggggct

SEQ ID NO: 4699935 - DNA, 17 bp, Homo sapiens
gtggggcagcttgaggg

SEQ ID NO: 4699936 - DNA, 16 bp, Homo sapiens
gtgggggggagaagaa

SEQ ID NO: 4699937 - DNA, 19 bp, Homo sapiens
gtggggggtcccaaagagt

SEQ ID NO: 4699938 - DNA, 17 bp, Homo sapiens
gtggggtcactctggca

SEQ ID NO: 4699939 - DNA, 20 bp, Homo sapiens
gtggggtcactctggcagct

SEQ ID NO: 4699940 - DNA, 20 bp, Homo sapiens
gtgggtccatgggcagagcc

SEQ ID NO: 4699941 - DNA, 17 bp, Homo sapiens
gtgggttgtgatattga

SEQ ID NO: 4699942 - DNA, 14 bp, Homo sapiens
gtggtcccacccca

SEQ ID NO: 4699943 - DNA, 15 bp, Homo sapiens
gtggtctttgtaaga

SEQ ID NO: 4699944 - DNA, 19 bp, Homo sapiens
gtggtctttgtaagagtgt

SEQ ID NO: 4699945 - DNA, 18 bp, Homo sapiens
gtggtggctcatgcctgt

SEQ ID NO: 4699946 - DNA, 14 bp, Homo sapiens
gtggtgtggagaag

SEQ ID NO: 4699947 - DNA, 15 bp, Homo sapiens
gtggtgtttcctggc

SEQ ID NO: 4699948 - DNA, 20 bp, Homo sapiens
gtttgtcttggatatatagg

SEQ ID NO: 4699949 - DNA, 17 bp, Homo sapiens
gtttgttatttacactg

SEQ ID NO: 4699950 - DNA, 18 bp, Homo sapiens
gtttgtttctgaaaggga

SEQ ID NO: 4699951 - DNA, 22 bp, Homo sapiens
gttttaactgtggatattgtta

SEQ ID NO: 4699952 - DNA, 14 bp, Homo sapiens
gttttaagaggcag

SEQ ID NO: 4699953 - DNA, 20 bp, Homo sapiens
gttttccatgagtcccctgt

SEQ ID NO: 4699954 - DNA, 14 bp, Homo sapiens
gttttctctgtgtg

SEQ ID NO: 4699955 - DNA, 21 bp, Homo sapiens
gttttgaaaagctattagcca

SEQ ID NO: 4699956 - DNA, 21 bp, Homo sapiens
gttttgccatgttggccaggc

SEQ ID NO: 4699957 - DNA, 12 bp, Homo sapiens
gttttgtacatg

SEQ ID NO: 4699958 - DNA, 19 bp, Homo sapiens
gttttgtggaggagctcag

SEQ ID NO: 4699959 - DNA, 17 bp, Homo sapiens
gttttgttcccctcctc

SEQ ID NO: 4699960 - DNA, 17 bp, Homo sapiens
gtttttaaaatatcttt

SEQ ID NO: 4699961 - DNA, 21 bp, Homo sapiens
gtttttatggttccaatgaaa

SEQ ID NO: 4699962 - DNA, 15 bp, Homo sapiens
gtttttctattaaaa

SEQ ID NO: 4699963 - DNA, 16 bp, Homo sapiens
gtttttctattaaaag

SEQ ID NO: 4699964 - DNA, 17 bp, Homo sapiens
gtttttctattaaaaga

SEQ ID NO: 4699965 - DNA, 21 bp, Homo sapiens
gtttttctattaaaagactca

SEQ ID NO: 4699966 - DNA, 16 bp, Homo sapiens
gtttttgagttttctt

SEQ ID NO: 4699967 - DNA, 14 bp, Homo sapiens
gtttttgtaaatta

SEQ ID NO: 4699968 - DNA, 20 bp, Homo sapiens
gtttttgttgagtctctgaa

SEQ ID NO: 4699969 - DNA, 22 bp, Homo sapiens
gtttttgttgagtctctgaaca

SEQ ID NO: 4699970 - DNA, 23 bp, Homo sapiens
gtttttgttgagtctctgaacat

SEQ ID NO: 4699971 - DNA, 15 bp, Homo sapiens
taaaaaaaaatgcct

SEQ ID NO: 4699972 - DNA, 17 bp, Homo sapiens
taaaaaaaaatgccttt

SEQ ID NO: 4699973 - DNA, 15 bp, Homo sapiens
taaaaaaaagatgaa

SEQ ID NO: 4699974 - DNA, 15 bp, Homo sapiens
taaaaaaatttaagt

SEQ ID NO: 4699975 - DNA, 13 bp, Homo sapiens
taaaaaagagaca

SEQ ID NO: 4699976 - DNA, 19 bp, Homo sapiens
taaaaaatttattatgtcc

SEQ ID NO: 4699977 - DNA, 15 bp, Homo sapiens
taaaaataacatcat

SEQ ID NO: 4699978 - DNA, 13 bp, Homo sapiens
taaaaatacacta

SEQ ID NO: 4699979 - DNA, 19 bp, Homo sapiens
taaaaatgtagaaattctt

SEQ ID NO: 4699980 - DNA, 18 bp, Homo sapiens
taaaaatgttagtatttt

SEQ ID NO: 4699981 - DNA, 16 bp, Homo sapiens
taaaaattagatggaa

SEQ ID NO: 4699982 - DNA, 19 bp, Homo sapiens
taaaaatttttacaaaact

SEQ ID NO: 4699983 - DNA, 16 bp, Homo sapiens
taaaacaaaagctcat

SEQ ID NO: 4699984 - DNA, 22 bp, Homo sapiens
taaaacaagcactaaacaaaga

SEQ ID NO: 4699985 - DNA, 14 bp, Homo sapiens
taaaacacacaggt

SEQ ID NO: 4699986 - DNA, 13 bp, Homo sapiens
taaaaccaagcct

SEQ ID NO: 4699987 - DNA, 14 bp, Homo sapiens
taaaagaaaatttt

SEQ ID NO: 4699988 - DNA, 14 bp, Homo sapiens
taaaagacaaacac

SEQ ID NO: 4699989 - DNA, 21 bp, Homo sapiens
taaaagataaatttgttgaat

SEQ ID NO: 4699990 - DNA, 18 bp, Homo sapiens
taaaagcaaaaagatgta

SEQ ID NO: 4699991 - DNA, 14 bp, Homo sapiens
taaaagcctgctca

SEQ ID NO: 4699992 - DNA, 18 bp, Homo sapiens
taaaagtttgtcctttaa

SEQ ID NO: 4699993 - DNA, 15 bp, Homo sapiens
taaaagttttgttct

SEQ ID NO: 4699994 - DNA, 18 bp, Homo sapiens
taaaatatcttttgacct

SEQ ID NO: 4699995 - DNA, 13 bp, Homo sapiens
taaaatctgtcac

SEQ ID NO: 4699996 - DNA, 14 bp, Homo sapiens
taaaatctgtcacg

SEQ ID NO: 4699997 - DNA, 13 bp, Homo sapiens
taaaattatttca

SEQ ID NO: 4699998 - DNA, 15 bp, Homo sapiens
taaaattttctagaa

SEQ ID NO: 4699999 - DNA, 19 bp, Homo sapiens
taaaattttggattaattt

SEQ ID NO: 4700000 - DNA, 15 bp, Homo sapiens
taaacaagaaccatt

SEQ ID NO: 4700001 - DNA, 16 bp, Homo sapiens
taaacaagaaccattt

SEQ ID NO: 4700002 - DNA, 20 bp, Homo sapiens
taaacaagaaccatttgcaa

SEQ ID NO: 4700003 - DNA, 17 bp, Homo sapiens
taaacagatgtccctga

SEQ ID NO: 4700004 - DNA, 13 bp, Homo sapiens
taaacagttcttg

SEQ ID NO: 4700005 - DNA, 18 bp, Homo sapiens
taaacctctaatttattt

SEQ ID NO: 4700006 - DNA, 16 bp, Homo sapiens
taaaccttgtttcttt

SEQ ID NO: 4700007 - DNA, 17 bp, Homo sapiens
taaaccttgtttctttc

SEQ ID NO: 4700008 - DNA, 17 bp, Homo sapiens
taaactatgataaatta

SEQ ID NO: 4700009 - DNA, 23 bp, Homo sapiens
taaactcctactgcttcctctga

SEQ ID NO: 4700010 - DNA, 21 bp, Homo sapiens
taaactgccccctctgccctg

SEQ ID NO: 4700011 - DNA, 23 bp, Homo sapiens
taaacttcttttctcttctacat

SEQ ID NO: 4700012 - DNA, 22 bp, Homo sapiens
taaactttcaaattgaaatgac

SEQ ID NO: 4700013 - DNA, 16 bp, Homo sapiens
taaactttcaatatct

SEQ ID NO: 4700014 - DNA, 13 bp, Homo sapiens
taaagaaaatgtg

SEQ ID NO: 4700015 - DNA, 17 bp, Homo sapiens
taaagaaaatgtgtctg

SEQ ID NO: 4700016 - DNA, 20 bp, Homo sapiens
taaagaattggtcttaatgt

SEQ ID NO: 4700017 - DNA, 16 bp, Homo sapiens
taaagagagtttgcca

SEQ ID NO: 4700018 - DNA, 16 bp, Homo sapiens
taaagcagcttatgtt

SEQ ID NO: 4700019 - DNA, 23 bp, Homo sapiens
taaagccaaaaccatcttctgtg

SEQ ID NO: 4700020 - DNA, 18 bp, Homo sapiens
taaagccttgttttctct

SEQ ID NO: 4700021 - DNA, 15 bp, Homo sapiens
taaagctagaaatga

SEQ ID NO: 4700022 - DNA, 14 bp, Homo sapiens
taaaggaatttaaa

SEQ ID NO: 4700023 - DNA, 14 bp, Homo sapiens
taaaggacaaacag

SEQ ID NO: 4700024 - DNA, 21 bp, Homo sapiens
taaaggcaatggtttgtgtca

SEQ ID NO: 4700025 - DNA, 22 bp, Homo sapiens
taaaggcctgcgtgtgtctgtg

SEQ ID NO: 4700026 - DNA, 20 bp, Homo sapiens
taaagggcgcaaagggcatg

SEQ ID NO: 4700027 - DNA, 13 bp, Homo sapiens
taaagtaaataca

SEQ ID NO: 4700028 - DNA, 16 bp, Homo sapiens
taaagtaatttctaaa

SEQ ID NO: 4700029 - DNA, 14 bp, Homo sapiens
taaagtattctcca

SEQ ID NO: 4700030 - DNA, 19 bp, Homo sapiens
taaagtattctccatcctc

SEQ ID NO: 4700031 - DNA, 20 bp, Homo sapiens
taaagtgagctctatgggca

SEQ ID NO: 4700032 - DNA, 13 bp, Homo sapiens
taaagtgtgtgtg

SEQ ID NO: 4700033 - DNA, 20 bp, Homo sapiens
taaatacatgcatataatga

SEQ ID NO: 4700034 - DNA, 21 bp, Homo sapiens
taaatacatgcatataatgaa

SEQ ID NO: 4700035 - DNA, 20 bp, Homo sapiens
taaatactaactgctgattt

SEQ ID NO: 4700036 - DNA, 21 bp, Homo sapiens
taaatactaactgctgatttt

SEQ ID NO: 4700037 - DNA, 13 bp, Homo sapiens
taaatactggact

SEQ ID NO: 4700038 - DNA, 19 bp, Homo sapiens
taaatagtaaaaataaaat

SEQ ID NO: 4700039 - DNA, 16 bp, Homo sapiens
taaatatagttgtctt

SEQ ID NO: 4700040 - DNA, 22 bp, Homo sapiens
taaatatcccttggacatttta

SEQ ID NO: 4700041 - DNA, 13 bp, Homo sapiens
taaatatgcagtg

SEQ ID NO: 4700042 - DNA, 17 bp, Homo sapiens
taaatatgcagtgatat

SEQ ID NO: 4700043 - DNA, 15 bp, Homo sapiens
taaatatgtgaagaa

SEQ ID NO: 4700044 - DNA, 16 bp, Homo sapiens
taaatatgtgaagaaa

SEQ ID NO: 4700045 - DNA, 21 bp, Homo sapiens
taaatattggtttgttattct

SEQ ID NO: 4700046 - DNA, 13 bp, Homo sapiens
taaatcacacatt

SEQ ID NO: 4700047 - DNA, 16 bp, Homo sapiens
taaatcacacattcag

SEQ ID NO: 4700048 - DNA, 22 bp, Homo sapiens
taaatctgaagaaagttattct

SEQ ID NO: 4700049 - DNA, 19 bp, Homo sapiens
taaatgaacacatggcaga

SEQ ID NO: 4700050 - DNA, 14 bp, Homo sapiens
taaatgcccagccc

SEQ ID NO: 4700051 - DNA, 17 bp, Homo sapiens
taaatgcccagcccctt

SEQ ID NO: 4700052 - DNA, 14 bp, Homo sapiens
taaatgtagttgtc

SEQ ID NO: 4700053 - DNA, 22 bp, Homo sapiens
taaatgtgcaatagaaggtgat

SEQ ID NO: 4700054 - DNA, 16 bp, Homo sapiens
taaattaatacagagt

SEQ ID NO: 4700055 - DNA, 21 bp, Homo sapiens
taaattgttataacttcataa

SEQ ID NO: 4700056 - DNA, 11 bp, Homo sapiens
taaatttcagt

SEQ ID NO: 4700057 - DNA, 20 bp, Homo sapiens
taaatttcagtcaattctga

SEQ ID NO: 4700058 - DNA, 15 bp, Homo sapiens
taccaatgaaaaaat

SEQ ID NO: 4700059 - DNA, 15 bp, Homo sapiens
taccaccacgcccgg

SEQ ID NO: 4700060 - DNA, 15 bp, Homo sapiens
taccacccccacacc

SEQ ID NO: 4700061 - DNA, 13 bp, Homo sapiens
taccagcagagca

SEQ ID NO: 4700062 - DNA, 22 bp, Homo sapiens
taccagcagagcaccttagaca

SEQ ID NO: 4700063 - DNA, 11 bp, Homo sapiens
taccagccact

SEQ ID NO: 4700064 - DNA, 14 bp, Homo sapiens
taccagtgggcatg

SEQ ID NO: 4700065 - DNA, 17 bp, Homo sapiens
taccataagtgacacca

SEQ ID NO: 4700066 - DNA, 15 bp, Homo sapiens
taccatgatgcatgg

SEQ ID NO: 4700067 - DNA, 18 bp, Homo sapiens
taccatgcttcacaatgt

SEQ ID NO: 4700068 - DNA, 23 bp, Homo sapiens
taccatggttgtgcacatgcttc

SEQ ID NO: 4700069 - DNA, 20 bp, Homo sapiens
taccattagcataattttgt

SEQ ID NO: 4700070 - DNA, 15 bp, Homo sapiens
taccattatttaatt

SEQ ID NO: 4700071 - DNA, 14 bp, Homo sapiens
tacccaaactgctt

SEQ ID NO: 4700072 - DNA, 17 bp, Homo sapiens
tacccacccccacccaa

SEQ ID NO: 4700073 - DNA, 12 bp, Homo sapiens
tacccactgctc

SEQ ID NO: 4700074 - DNA, 13 bp, Homo sapiens
tacccactgctct

SEQ ID NO: 4700075 - DNA, 22 bp, Homo sapiens
tacccaggtgctaggaacactc

SEQ ID NO: 4700076 - DNA, 16 bp, Homo sapiens
tacccccgcccaggct

SEQ ID NO: 4700077 - DNA, 22 bp, Homo sapiens
tacccccgcccaggctggccag

SEQ ID NO: 4700078 - DNA, 19 bp, Homo sapiens
taccccctgcaaagcccag

SEQ ID NO: 4700079 - DNA, 14 bp, Homo sapiens
taccctccctgctg

SEQ ID NO: 4700080 - DNA, 22 bp, Homo sapiens
taccctccctgctgtcccctct

SEQ ID NO: 4700081 - DNA, 18 bp, Homo sapiens
taccctcctctatttctt

SEQ ID NO: 4700082 - DNA, 21 bp, Homo sapiens
tacccttgacttaacttttta

SEQ ID NO: 4700083 - DNA, 13 bp, Homo sapiens
tacctgaaaacac

SEQ ID NO: 4700084 - DNA, 20 bp, Homo sapiens
tacctgaaaacactgtgcac

SEQ ID NO: 4700085 - DNA, 14 bp, Homo sapiens
tacctgggaagggg

SEQ ID NO: 4700086 - DNA, 16 bp, Homo sapiens
tacctgtccccctgac

SEQ ID NO: 4700087 - DNA, 22 bp, Homo sapiens
taccttactgtggaggaaggat

SEQ ID NO: 4700088 - DNA, 15 bp, Homo sapiens
taccttattggatat

SEQ ID NO: 4700089 - DNA, 18 bp, Homo sapiens
taccttttaagacatttt

SEQ ID NO: 4700090 - DNA, 19 bp, Homo sapiens
taccttttaagacattttc

SEQ ID NO: 4700091 - DNA, 22 bp, Homo sapiens
tacgaacctacagttttaactg

SEQ ID NO: 4700092 - DNA, 12 bp, Homo sapiens
tacggtgggggt

SEQ ID NO: 4700093 - DNA, 17 bp, Homo sapiens
tacgtaaagccttgttt

SEQ ID NO: 4700094 - DNA, 16 bp, Homo sapiens
tacgtagtaaaagtca

SEQ ID NO: 4700095 - DNA, 23 bp, Homo sapiens
tacgttaaaagcaaaaagatgta

SEQ ID NO: 4700096 - DNA, 14 bp, Homo sapiens
tacgttaccaggca

SEQ ID NO: 4700097 - DNA, 18 bp, Homo sapiens
tactaaaaagtataaaat

SEQ ID NO: 4700098 - DNA, 19 bp, Homo sapiens
tactaaaaagtataaaata

SEQ ID NO: 4700099 - DNA, 16 bp, Homo sapiens
tactaaggacgttgtt

SEQ ID NO: 4700100 - DNA, 13 bp, Homo sapiens
tactaaggagaat

SEQ ID NO: 4700101 - DNA, 19 bp, Homo sapiens
tactaaggagaattaaact

SEQ ID NO: 4700102 - DNA, 17 bp, Homo sapiens
tactaatgatgctttta

SEQ ID NO: 4700103 - DNA, 22 bp, Homo sapiens
tactacagtcctcccatctcac

SEQ ID NO: 4700104 - DNA, 11 bp, Homo sapiens
tactacatctg

SEQ ID NO: 4700105 - DNA, 18 bp, Homo sapiens
tactacctcactactaca

SEQ ID NO: 4700106 - DNA, 18 bp, Homo sapiens
tactatccaaataaaaat

SEQ ID NO: 4700107 - DNA, 14 bp, Homo sapiens
tactattcatgttt

SEQ ID NO: 4700108 - DNA, 18 bp, Homo sapiens
tactcattccccggggcg

SEQ ID NO: 4700109 - DNA, 14 bp, Homo sapiens
tactcccatctgtg

SEQ ID NO: 4700110 - DNA, 21 bp, Homo sapiens
tactctcaaagccatgtgtgg

SEQ ID NO: 4700111 - DNA, 21 bp, Homo sapiens
tactctgtgtcaggtggggca

SEQ ID NO: 4700112 - DNA, 18 bp, Homo sapiens
tactgaaaaaggtgatta

SEQ ID NO: 4700113 - DNA, 16 bp, Homo sapiens
tactgcaaaaagaaaa

SEQ ID NO: 4700114 - DNA, 22 bp, Homo sapiens
tactggaccaaaaaaataaagc

SEQ ID NO: 4700115 - DNA, 19 bp, Homo sapiens
tactggcctcgcctggcct

SEQ ID NO: 4700116 - DNA, 22 bp, Homo sapiens
tactgtatggaaacactgattt

SEQ ID NO: 4700117 - DNA, 16 bp, Homo sapiens
tactgtcctacccacc

SEQ ID NO: 4700118 - DNA, 13 bp, Homo sapiens
tactgtctgtagt

SEQ ID NO: 4700119 - DNA, 14 bp, Homo sapiens
tactgtggaggaag

SEQ ID NO: 4700120 - DNA, 15 bp, Homo sapiens
tactgtggcttctta

SEQ ID NO: 4700121 - DNA, 16 bp, Homo sapiens
tactgtgttccctcat

SEQ ID NO: 4700122 - DNA, 14 bp, Homo sapiens
tactgttgcacgtg

SEQ ID NO: 4700123 - DNA, 15 bp, Homo sapiens
tactgttgcacgtgt

SEQ ID NO: 4700124 - DNA, 16 bp, Homo sapiens
tactgttgcacgtgtg

SEQ ID NO: 4700125 - DNA, 15 bp, Homo sapiens
tacttaaacatcatt

SEQ ID NO: 4700126 - DNA, 18 bp, Homo sapiens
tacttacatatctgactt

SEQ ID NO: 4700127 - DNA, 15 bp, Homo sapiens
tacttatacacctta

SEQ ID NO: 4700128 - DNA, 18 bp, Homo sapiens
tacttattttaggaaatt

SEQ ID NO: 4700129 - DNA, 18 bp, Homo sapiens
tacttctccaccctgctc

SEQ ID NO: 4700130 - DNA, 20 bp, Homo sapiens
tacttctctgagtcagctga

SEQ ID NO: 4700131 - DNA, 16 bp, Homo sapiens
tacttctgtaattgtg

SEQ ID NO: 4700132 - DNA, 16 bp, Homo sapiens
tacttctttgctttgc

SEQ ID NO: 4700133 - DNA, 15 bp, Homo sapiens
tacttgcagtacatc

SEQ ID NO: 4700134 - DNA, 15 bp, Homo sapiens
tactttaccaccccc

SEQ ID NO: 4700135 - DNA, 22 bp, Homo sapiens
tactttccacttgattttgcaa

SEQ ID NO: 4700136 - DNA, 18 bp, Homo sapiens
tactttcgaaatttcatt

SEQ ID NO: 4700137 - DNA, 14 bp, Homo sapiens
tactttgaagtcat

SEQ ID NO: 4700138 - DNA, 18 bp, Homo sapiens
tactttgaagtcatacca

SEQ ID NO: 4700139 - DNA, 15 bp, Homo sapiens
tactttgacagtgtt

SEQ ID NO: 4700140 - DNA, 22 bp, Homo sapiens
tactttgtttattgtaaaacag

SEQ ID NO: 4700141 - DNA, 20 bp, Homo sapiens
tacttttgcttttttattta

SEQ ID NO: 4700142 - DNA, 15 bp, Homo sapiens
tagaaaacaatggaa

SEQ ID NO: 4700143 - DNA, 22 bp, Homo sapiens
tagaaaatttgttattttgcaa

SEQ ID NO: 4700144 - DNA, 23 bp, Homo sapiens
tagaaaatttgttattttgcaac

SEQ ID NO: 4700145 - DNA, 15 bp, Homo sapiens
tagaaacattgaaga

SEQ ID NO: 4700146 - DNA, 17 bp, Homo sapiens
tagaaagagatacagag

SEQ ID NO: 4700147 - DNA, 12 bp, Homo sapiens
tagaaatcattt

SEQ ID NO: 4700148 - DNA, 16 bp, Homo sapiens
tagaaattacctgtgg

SEQ ID NO: 4700149 - DNA, 18 bp, Homo sapiens
tagaaattataattttag

SEQ ID NO: 4700150 - DNA, 21 bp, Homo sapiens
tagaaattcttcatgaacata

SEQ ID NO: 4700151 - DNA, 22 bp, Homo sapiens
tagaacatggagagctagaacc

SEQ ID NO: 4700152 - DNA, 16 bp, Homo sapiens
tagaaccaagaagggc

SEQ ID NO: 4700153 - DNA, 22 bp, Homo sapiens
tagaacccggcaggctagaacc

SEQ ID NO: 4700154 - DNA, 21 bp, Homo sapiens
tagaacctcgaggtttctcaa

SEQ ID NO: 4700155 - DNA, 16 bp, Homo sapiens
tagaacctggaagggc

SEQ ID NO: 4700156 - DNA, 13 bp, Homo sapiens
tagaacctggaga

SEQ ID NO: 4700157 - DNA, 22 bp, Homo sapiens
tagaactggagaggctagaacc

SEQ ID NO: 4700158 - DNA, 22 bp, Homo sapiens
tagaagcattccttctttgata

SEQ ID NO: 4700159 - DNA, 12 bp, Homo sapiens
tagaagcctgca

SEQ ID NO: 4700160 - DNA, 19 bp, Homo sapiens
tagaatgttttcaaatgtt

SEQ ID NO: 4700161 - DNA, 19 bp, Homo sapiens
tagaattggctgaactcat

SEQ ID NO: 4700162 - DNA, 21 bp, Homo sapiens
tagacagtccctgccaatgga

SEQ ID NO: 4700163 - DNA, 13 bp, Homo sapiens
tagacatgtcatg

SEQ ID NO: 4700164 - DNA, 20 bp, Homo sapiens
tagacccactggactcacct

SEQ ID NO: 4700165 - DNA, 18 bp, Homo sapiens
tagacttaatagaaacat

SEQ ID NO: 4700166 - DNA, 23 bp, Homo sapiens
tagagaagtaagcagagttcttt

SEQ ID NO: 4700167 - DNA, 19 bp, Homo sapiens
tagagatatttaaaagaca

SEQ ID NO: 4700168 - DNA, 19 bp, Homo sapiens
tatgtagtatctatatgac

SEQ ID NO: 4700169 - DNA, 22 bp, Homo sapiens
tatgtatcttgatgttcagaca

SEQ ID NO: 4700170 - DNA, 18 bp, Homo sapiens
tatgtgaagaaaaagacc

SEQ ID NO: 4700171 - DNA, 23 bp, Homo sapiens
tatgtgaagaaaaagacctgcat

SEQ ID NO: 4700172 - DNA, 17 bp, Homo sapiens
tatgtgcactaccatag

SEQ ID NO: 4700173 - DNA, 23 bp, Homo sapiens
tatgtgtggtttcagttctgtgt

SEQ ID NO: 4700174 - DNA, 18 bp, Homo sapiens
tatgtgttgcataaacaa

SEQ ID NO: 4700175 - DNA, 16 bp, Homo sapiens
tatgttacttaaacat

SEQ ID NO: 4700176 - DNA, 19 bp, Homo sapiens
tatgttacttaaacatcat

SEQ ID NO: 4700177 - DNA, 19 bp, Homo sapiens
tatgttatcaccttccaaa

SEQ ID NO: 4700178 - DNA, 19 bp, Homo sapiens
tatgttgcccaggcaggtc

SEQ ID NO: 4700179 - DNA, 20 bp, Homo sapiens
tatgttgcccaggcaggtct

SEQ ID NO: 4700180 - DNA, 18 bp, Homo sapiens
tatgttgtttataataaa

SEQ ID NO: 4700181 - DNA, 20 bp, Homo sapiens
tatgttgtttataataaaaa

SEQ ID NO: 4700182 - DNA, 18 bp, Homo sapiens
tatgtttttgtgtatttg

SEQ ID NO: 4700183 - DNA, 13 bp, Homo sapiens
tattaaaaccagt

SEQ ID NO: 4700184 - DNA, 13 bp, Homo sapiens
tattaaaagactc

SEQ ID NO: 4700185 - DNA, 16 bp, Homo sapiens
tattaaaatatttcag

SEQ ID NO: 4700186 - DNA, 17 bp, Homo sapiens
tattaaaatatttcagg

SEQ ID NO: 4700187 - DNA, 13 bp, Homo sapiens
tattaaatcagtt

SEQ ID NO: 4700188 - DNA, 19 bp, Homo sapiens
tattaaatcagttctcaat

SEQ ID NO: 4700189 - DNA, 19 bp, Homo sapiens
tattaaatgcccagcccct

SEQ ID NO: 4700190 - DNA, 19 bp, Homo sapiens
tattaaattaaattttgtg

SEQ ID NO: 4700191 - DNA, 20 bp, Homo sapiens
tattaagaaacaatttaaat

SEQ ID NO: 4700192 - DNA, 14 bp, Homo sapiens
tattaatcagaata

SEQ ID NO: 4700193 - DNA, 12 bp, Homo sapiens
tattaatttgaa

SEQ ID NO: 4700194 - DNA, 16 bp, Homo sapiens
tattaatttgaaacca

SEQ ID NO: 4700195 - DNA, 21 bp, Homo sapiens
tattactgtttgtcttctccc

SEQ ID NO: 4700196 - DNA, 13 bp, Homo sapiens
tattagccaggat

SEQ ID NO: 4700197 - DNA, 19 bp, Homo sapiens
tattagccaggatcatggt

SEQ ID NO: 4700198 - DNA, 23 bp, Homo sapiens
tattagccaggatcatggtgtaa

SEQ ID NO: 4700199 - DNA, 22 bp, Homo sapiens
tattagcccttctccatggccc

SEQ ID NO: 4700200 - DNA, 21 bp, Homo sapiens
tattagtcttggggcaggatg

SEQ ID NO: 4700201 - DNA, 16 bp, Homo sapiens
tattagtgatgtcatc

SEQ ID NO: 4700202 - DNA, 16 bp, Homo sapiens
tattataaaggataaa

SEQ ID NO: 4700203 - DNA, 17 bp, Homo sapiens
tattatattcattcttt

SEQ ID NO: 4700204 - DNA, 16 bp, Homo sapiens
tattcaagaaagatat

SEQ ID NO: 4700205 - DNA, 20 bp, Homo sapiens
tattcaagaaagatatctat

SEQ ID NO: 4700206 - DNA, 21 bp, Homo sapiens
tattcaagaaagatatctatg

SEQ ID NO: 4700207 - DNA, 15 bp, Homo sapiens
tattcacatgttcta

SEQ ID NO: 4700208 - DNA, 22 bp, Homo sapiens
tattcactttcatttttgacag

SEQ ID NO: 4700209 - DNA, 16 bp, Homo sapiens
tattcagtgaatttgt

SEQ ID NO: 4700210 - DNA, 15 bp, Homo sapiens
tattcagttcttaca

SEQ ID NO: 4700211 - DNA, 23 bp, Homo sapiens
tattcataaagagaaaatgatga

SEQ ID NO: 4700212 - DNA, 20 bp, Homo sapiens
tattcatgaagcggtcacag

SEQ ID NO: 4700213 - DNA, 12 bp, Homo sapiens
tattcatgtttt

SEQ ID NO: 4700214 - DNA, 23 bp, Homo sapiens
tattcattctttttgaaatgtca

SEQ ID NO: 4700215 - DNA, 15 bp, Homo sapiens
tattccactatttgc

SEQ ID NO: 4700216 - DNA, 21 bp, Homo sapiens
tattccactatttgcagaggc

SEQ ID NO: 4700217 - DNA, 14 bp, Homo sapiens
tattcctacttgca

SEQ ID NO: 4700218 - DNA, 22 bp, Homo sapiens
tattcctacttgcagtacatca

SEQ ID NO: 4700219 - DNA, 15 bp, Homo sapiens
tattcgaaatgagct

SEQ ID NO: 4700220 - DNA, 18 bp, Homo sapiens
tattctgataatgtattg

SEQ ID NO: 4700221 - DNA, 15 bp, Homo sapiens
tattgaccatgtgat

SEQ ID NO: 4700222 - DNA, 14 bp, Homo sapiens
tattgataacagca

SEQ ID NO: 4700223 - DNA, 16 bp, Homo sapiens
tattgatgaaatcatt

SEQ ID NO: 4700224 - DNA, 22 bp, Homo sapiens
tattgcagcgattaataacagg

SEQ ID NO: 4700225 - DNA, 13 bp, Homo sapiens
tattgcccacgct

SEQ ID NO: 4700226 - DNA, 15 bp, Homo sapiens
tattgcccacgctgg

SEQ ID NO: 4700227 - DNA, 21 bp, Homo sapiens
tattgcttgcacaaaccaatt

SEQ ID NO: 4700228 - DNA, 16 bp, Homo sapiens
tattggatatttgata

SEQ ID NO: 4700229 - DNA, 18 bp, Homo sapiens
tattggatctgcttgctg

SEQ ID NO: 4700230 - DNA, 23 bp, Homo sapiens
tattggctaaattgaaacctgga

SEQ ID NO: 4700231 - DNA, 16 bp, Homo sapiens
tattgtaaatactgga

SEQ ID NO: 4700232 - DNA, 18 bp, Homo sapiens
tattgtaaatactggact

SEQ ID NO: 4700233 - DNA, 22 bp, Homo sapiens
tattgtgatttcccgtggcccc

SEQ ID NO: 4700234 - DNA, 16 bp, Homo sapiens
tattgttctatttttg

SEQ ID NO: 4700235 - DNA, 12 bp, Homo sapiens
tatttaaaactt

SEQ ID NO: 4700236 - DNA, 18 bp, Homo sapiens
tatttaacaactgggtca

SEQ ID NO: 4700237 - DNA, 23 bp, Homo sapiens
tatttaacttaacccagatttta

SEQ ID NO: 4700238 - DNA, 12 bp, Homo sapiens
tatttaactttt

SEQ ID NO: 4700239 - DNA, 21 bp, Homo sapiens
tatttaagccttataaaccaa

SEQ ID NO: 4700240 - DNA, 17 bp, Homo sapiens
tatttaatgatttttgt

SEQ ID NO: 4700241 - DNA, 18 bp, Homo sapiens
tatttaatgatttttgtg

SEQ ID NO: 4700242 - DNA, 13 bp, Homo sapiens
tatttaatttgaa

SEQ ID NO: 4700243 - DNA, 16 bp, Homo sapiens
tatttaatttgaaggt

SEQ ID NO: 4700244 - DNA, 21 bp, Homo sapiens
tatttaatttgtatgctaaat

SEQ ID NO: 4700245 - DNA, 15 bp, Homo sapiens
tatttacactggtct

SEQ ID NO: 4700246 - DNA, 17 bp, Homo sapiens
tatttacactggtctaa

SEQ ID NO: 4700247 - DNA, 22 bp, Homo sapiens
tatttaccttttaagacatttt

SEQ ID NO: 4700248 - DNA, 13 bp, Homo sapiens
tatttatatcttt

SEQ ID NO: 4700249 - DNA, 18 bp, Homo sapiens
tatttatattcatcaaat

SEQ ID NO: 4700250 - DNA, 19 bp, Homo sapiens
tatttatattcatcaaata

SEQ ID NO: 4700251 - DNA, 14 bp, Homo sapiens
tatttattaatttg

SEQ ID NO: 4700252 - DNA, 14 bp, Homo sapiens
tatttatttattta

SEQ ID NO: 4700253 - DNA, 18 bp, Homo sapiens
tatttcaaattggagctt

SEQ ID NO: 4700254 - DNA, 14 bp, Homo sapiens
tatttctacagaga

SEQ ID NO: 4700255 - DNA, 15 bp, Homo sapiens
tatttctacagagaa

SEQ ID NO: 4700256 - DNA, 16 bp, Homo sapiens
tatttctacagagaaa

SEQ ID NO: 4700257 - DNA, 23 bp, Homo sapiens
tatttctgaggagcctgcaacat

SEQ ID NO: 4700258 - DNA, 22 bp, Homo sapiens
tatttctggcagctgtggtaca

SEQ ID NO: 4700259 - DNA, 17 bp, Homo sapiens
tatttcttcaagtgagt

SEQ ID NO: 4700260 - DNA, 14 bp, Homo sapiens
tatttgcattgagg

SEQ ID NO: 4700261 - DNA, 17 bp, Homo sapiens
tatttgccatgggcttc

SEQ ID NO: 4700262 - DNA, 20 bp, Homo sapiens
tatttgttaatggtttgaat

SEQ ID NO: 4700263 - DNA, 14 bp, Homo sapiens
tattttaatcctgt

SEQ ID NO: 4700264 - DNA, 23 bp, Homo sapiens
tattttaatcctgtaccaaatct

SEQ ID NO: 4700265 - DNA, 20 bp, Homo sapiens
tattttacatctgaacaaaa

SEQ ID NO: 4700266 - DNA, 13 bp, Homo sapiens
tattttagacttt

SEQ ID NO: 4700267 - DNA, 16 bp, Homo sapiens
tattttagatgttatt

SEQ ID NO: 4700268 - DNA, 14 bp, Homo sapiens
tattttaggaaatt

SEQ ID NO: 4700269 - DNA, 13 bp, Homo sapiens
tattttcaccatt

SEQ ID NO: 4700270 - DNA, 16 bp, Homo sapiens
tattttccatgaaaat

SEQ ID NO: 4700271 - DNA, 13 bp, Homo sapiens
tattttgccactg

SEQ ID NO: 4700272 - DNA, 15 bp, Homo sapiens
tattttggtttagtg

SEQ ID NO: 4700273 - DNA, 14 bp, Homo sapiens
tattttgtaattat

SEQ ID NO: 4700274 - DNA, 13 bp, Homo sapiens
tattttgtgaaga

SEQ ID NO: 4700275 - DNA, 15 bp, Homo sapiens
tattttgttactgtc

SEQ ID NO: 4700276 - DNA, 21 bp, Homo sapiens
tattttgttttgtgcagagat

SEQ ID NO: 4700277 - DNA, 18 bp, Homo sapiens
tatttttaactctggatt

SEQ ID NO: 4700278 - DNA, 16 bp, Homo sapiens
tcaggtgacatgtgaa

SEQ ID NO: 4700279 - DNA, 17 bp, Homo sapiens
tcaggtgacatgtgaaa

SEQ ID NO: 4700280 - DNA, 21 bp, Homo sapiens
tcaggtgacatgtgaaacctt

SEQ ID NO: 4700281 - DNA, 18 bp, Homo sapiens
tcaggtggggcagcttga

SEQ ID NO: 4700282 - DNA, 19 bp, Homo sapiens
tcaggtggggcagcttgag

SEQ ID NO: 4700283 - DNA, 23 bp, Homo sapiens
tcaggtggggtcactctggcagc

SEQ ID NO: 4700284 - DNA, 22 bp, Homo sapiens
tcaggtgtccctgcacttgcag

SEQ ID NO: 4700285 - DNA, 20 bp, Homo sapiens
tcaggttatcgaaataacaa

SEQ ID NO: 4700286 - DNA, 14 bp, Homo sapiens
tcagtaagttatct

SEQ ID NO: 4700287 - DNA, 16 bp, Homo sapiens
tcagtactcaaattca

SEQ ID NO: 4700288 - DNA, 17 bp, Homo sapiens
tcagtactcaaattcaa

SEQ ID NO: 4700289 - DNA, 14 bp, Homo sapiens
tcagtatatttggt

SEQ ID NO: 4700290 - DNA, 16 bp, Homo sapiens
tcagtcatgcataaat

SEQ ID NO: 4700291 - DNA, 17 bp, Homo sapiens
tcagtcatgcataaata

SEQ ID NO: 4700292 - DNA, 20 bp, Homo sapiens
tcagtcatgcataaatatgc

SEQ ID NO: 4700293 - DNA, 16 bp, Homo sapiens
tcagtctccctccctt

SEQ ID NO: 4700294 - DNA, 19 bp, Homo sapiens
tcagtctgattcccaagct

SEQ ID NO: 4700295 - DNA, 24 bp, Homo sapiens
tcagtctgattcccaagctctgct

SEQ ID NO: 4700296 - DNA, 16 bp, Homo sapiens
tcagtgagtaaataga

SEQ ID NO: 4700297 - DNA, 12 bp, Homo sapiens
tcagtgccacta

SEQ ID NO: 4700298 - DNA, 15 bp, Homo sapiens
tcagtgccagcccct

SEQ ID NO: 4700299 - DNA, 22 bp, Homo sapiens
tcagtgccagcccctgctggct

SEQ ID NO: 4700300 - DNA, 23 bp, Homo sapiens
tcagtgccgccgcctcgcccacc

SEQ ID NO: 4700301 - DNA, 12 bp, Homo sapiens
tcagtggcagct

SEQ ID NO: 4700302 - DNA, 16 bp, Homo sapiens
tcagtggcagctgctt

SEQ ID NO: 4700303 - DNA, 14 bp, Homo sapiens
tcagtggggcagtc

SEQ ID NO: 4700304 - DNA, 20 bp, Homo sapiens
tcagtgtgccccccatcctg

SEQ ID NO: 4700305 - DNA, 15 bp, Homo sapiens
tcagtgtgttgactt

SEQ ID NO: 4700306 - DNA, 21 bp, Homo sapiens
tcagtgttaaatgtgatgaat

SEQ ID NO: 4700307 - DNA, 22 bp, Homo sapiens
tcagttagagctgacacaaacc

SEQ ID NO: 4700308 - DNA, 16 bp, Homo sapiens
tcagttatattttgct

SEQ ID NO: 4700309 - DNA, 15 bp, Homo sapiens
tcagttctgtgtaca

SEQ ID NO: 4700310 - DNA, 19 bp, Homo sapiens
tcagttctgtgtacatttt

SEQ ID NO: 4700311 - DNA, 20 bp, Homo sapiens
tcagttgttatttattgaaa

SEQ ID NO: 4700312 - DNA, 15 bp, Homo sapiens
tcagtttttttttat

SEQ ID NO: 4700313 - DNA, 22 bp, Homo sapiens
tcataaattatttgattattta

SEQ ID NO: 4700314 - DNA, 23 bp, Homo sapiens
tcataaatttgttgtcatgtgta

SEQ ID NO: 4700315 - DNA, 14 bp, Homo sapiens
tcataacctagcct

SEQ ID NO: 4700316 - DNA, 15 bp, Homo sapiens
tcataagtatttcaa

SEQ ID NO: 4700317 - DNA, 14 bp, Homo sapiens
tcatacaaatacta

SEQ ID NO: 4700318 - DNA, 21 bp, Homo sapiens
tcatacaaatactatccaaat

SEQ ID NO: 4700319 - DNA, 23 bp, Homo sapiens
tcatacagatcaggcagtgttta

SEQ ID NO: 4700320 - DNA, 15 bp, Homo sapiens
tcataccaatgaaaa

SEQ ID NO: 4700321 - DNA, 14 bp, Homo sapiens
tcatacccaccccc

SEQ ID NO: 4700322 - DNA, 20 bp, Homo sapiens
tcatacccacccccacccaa

SEQ ID NO: 4700323 - DNA, 17 bp, Homo sapiens
tcatacgtaaaattttg

SEQ ID NO: 4700324 - DNA, 14 bp, Homo sapiens
tcatactgattttt

SEQ ID NO: 4700325 - DNA, 17 bp, Homo sapiens
tcatactgatttttaag

SEQ ID NO: 4700326 - DNA, 21 bp, Homo sapiens
tcatactgatttttaagtcaa

SEQ ID NO: 4700327 - DNA, 18 bp, Homo sapiens
tcatactgtgctggagcc

SEQ ID NO: 4700328 - DNA, 18 bp, Homo sapiens
tcatagtatggtggctgg

SEQ ID NO: 4700329 - DNA, 19 bp, Homo sapiens
tcatagtatggtggctggg

SEQ ID NO: 4700330 - DNA, 20 bp, Homo sapiens
tcatagtttgctttgtttaa

SEQ ID NO: 4700331 - DNA, 14 bp, Homo sapiens
tcatataaacattt

SEQ ID NO: 4700332 - DNA, 15 bp, Homo sapiens
tcatataaacatttt

SEQ ID NO: 4700333 - DNA, 21 bp, Homo sapiens
tcatataaacattttatttat

SEQ ID NO: 4700334 - DNA, 19 bp, Homo sapiens
tcatatagtcaatgtaaaa

SEQ ID NO: 4700335 - DNA, 20 bp, Homo sapiens
tcatatatattttaaaaaca

SEQ ID NO: 4700336 - DNA, 21 bp, Homo sapiens
tcatattttgccactgccttt

SEQ ID NO: 4700337 - DNA, 14 bp, Homo sapiens
tcatcaaaaagaaa

SEQ ID NO: 4700338 - DNA, 15 bp, Homo sapiens
tcatcaaaaagaaaa

SEQ ID NO: 4700339 - DNA, 23 bp, Homo sapiens
tcatcaaatggaagacacattga

SEQ ID NO: 4700340 - DNA, 17 bp, Homo sapiens
tcatcaaggcactgcct

SEQ ID NO: 4700341 - DNA, 19 bp, Homo sapiens
tcatcaccaacgtctgtgc

SEQ ID NO: 4700342 - DNA, 15 bp, Homo sapiens
tcatcactcccctcc

SEQ ID NO: 4700343 - DNA, 14 bp, Homo sapiens
tcatcagaactgaa

SEQ ID NO: 4700344 - DNA, 20 bp, Homo sapiens
tcatcagtaagtataacaaa

SEQ ID NO: 4700345 - DNA, 22 bp, Homo sapiens
tcatcattctctgtctcatcca

SEQ ID NO: 4700346 - DNA, 19 bp, Homo sapiens
tcatccactgtgccatgtg

SEQ ID NO: 4700347 - DNA, 21 bp, Homo sapiens
tcatccagggctctgaccagt

SEQ ID NO: 4700348 - DNA, 23 bp, Homo sapiens
tcatcccgagcacctccacatcc

SEQ ID NO: 4700349 - DNA, 15 bp, Homo sapiens
tcatccctccctgcc

SEQ ID NO: 4700350 - DNA, 22 bp, Homo sapiens
tcatccctccctgcctaaggaa

SEQ ID NO: 4700351 - DNA, 21 bp, Homo sapiens
tcatcctggaggggtgttgta

SEQ ID NO: 4700352 - DNA, 22 bp, Homo sapiens
tcatcctggaggggtgttgtat

SEQ ID NO: 4700353 - DNA, 13 bp, Homo sapiens
tcatctatgtcat

SEQ ID NO: 4700354 - DNA, 15 bp, Homo sapiens
tcatctcctgccttc

SEQ ID NO: 4700355 - DNA, 14 bp, Homo sapiens
tcatctctgtccca

SEQ ID NO: 4700356 - DNA, 14 bp, Homo sapiens
tcatctgcagcctc

SEQ ID NO: 4700357 - DNA, 15 bp, Homo sapiens
tcatctgctctcctt

SEQ ID NO: 4700358 - DNA, 17 bp, Homo sapiens
tcatctgtccctccggg

SEQ ID NO: 4700359 - DNA, 16 bp, Homo sapiens
tcatcttcttcaccat

SEQ ID NO: 4700360 - DNA, 11 bp, Homo sapiens
tcatctttgct

SEQ ID NO: 4700361 - DNA, 23 bp, Homo sapiens
tcatgattagaaattacctgtgg

SEQ ID NO: 4700362 - DNA, 14 bp, Homo sapiens
tcatgcataaatat

SEQ ID NO: 4700363 - DNA, 21 bp, Homo sapiens
tcatgccaagcatttaatgta

SEQ ID NO: 4700364 - DNA, 21 bp, Homo sapiens
tcatgctctcatatatatttt

SEQ ID NO: 4700365 - DNA, 17 bp, Homo sapiens
tcatggtccgcctgcct

SEQ ID NO: 4700366 - DNA, 14 bp, Homo sapiens
tcatggtgtaataa

SEQ ID NO: 4700367 - DNA, 22 bp, Homo sapiens
tcatgtaaacataccaacatgt

SEQ ID NO: 4700368 - DNA, 16 bp, Homo sapiens
tcatgtaaactgtgca

SEQ ID NO: 4700369 - DNA, 13 bp, Homo sapiens
tcatgtctggcta

SEQ ID NO: 4700370 - DNA, 13 bp, Homo sapiens
tcatgtgtatgag

SEQ ID NO: 4700371 - DNA, 19 bp, Homo sapiens
tcatgtgtatgagaagtac

SEQ ID NO: 4700372 - DNA, 17 bp, Homo sapiens
tcatgtgtttgaacttc

SEQ ID NO: 4700373 - DNA, 14 bp, Homo sapiens
tcatgtttaacgtt

SEQ ID NO: 4700374 - DNA, 22 bp, Homo sapiens
tcatgtttaacgtttctcatta

SEQ ID NO: 4700375 - DNA, 21 bp, Homo sapiens
tcatgttttaaagcttgctca

SEQ ID NO: 4700376 - DNA, 13 bp, Homo sapiens
tcattagagcagg

SEQ ID NO: 4700377 - DNA, 14 bp, Homo sapiens
tcattagttttgaa

SEQ ID NO: 4700378 - DNA, 16 bp, Homo sapiens
tcattatgttaatatt

SEQ ID NO: 4700379 - DNA, 16 bp, Homo sapiens
tcattatttgataaca

SEQ ID NO: 4700380 - DNA, 14 bp, Homo sapiens
tcattccattctgg

SEQ ID NO: 4700381 - DNA, 23 bp, Homo sapiens
tcattctcacctaaaccctctgt

SEQ ID NO: 4700382 - DNA, 14 bp, Homo sapiens
tcattctctgtctc

SEQ ID NO: 4700383 - DNA, 15 bp, Homo sapiens
tcattctctgtctca

SEQ ID NO: 4700384 - DNA, 13 bp, Homo sapiens
tcattctgtgacc

SEQ ID NO: 4700385 - DNA, 20 bp, Homo sapiens
tcattgccctcaggaaagtt

SEQ ID NO: 4700386 - DNA, 17 bp, Homo sapiens
tcattgctgttttaatt

SEQ ID NO: 4700387 - DNA, 14 bp, Homo sapiens
tccctgtaacctct

SEQ ID NO: 4700388 - DNA, 19 bp, Homo sapiens
tccctgtaacctcttcaga

SEQ ID NO: 4700389 - DNA, 23 bp, Homo sapiens
tccctgtaacctcttcagaggcc

SEQ ID NO: 4700390 - DNA, 15 bp, Homo sapiens
tcccttaaacaaaaa

SEQ ID NO: 4700391 - DNA, 13 bp, Homo sapiens
tcccttacctcaa

SEQ ID NO: 4700392 - DNA, 13 bp, Homo sapiens
tcccttcccacct

SEQ ID NO: 4700393 - DNA, 22 bp, Homo sapiens
tcccttcccatgacccaggctg

SEQ ID NO: 4700394 - DNA, 14 bp, Homo sapiens
tcccttgcccccct

SEQ ID NO: 4700395 - DNA, 18 bp, Homo sapiens
tcccttgcccccctggcc

SEQ ID NO: 4700396 - DNA, 16 bp, Homo sapiens
tcccttggacatttta

SEQ ID NO: 4700397 - DNA, 21 bp, Homo sapiens
tcccttggacattttatgtct

SEQ ID NO: 4700398 - DNA, 12 bp, Homo sapiens
tcccttggagct

SEQ ID NO: 4700399 - DNA, 13 bp, Homo sapiens
tccctttaaagag

SEQ ID NO: 4700400 - DNA, 14 bp, Homo sapiens
tccctttaaagaga

SEQ ID NO: 4700401 - DNA, 16 bp, Homo sapiens
tccctttatttcacat

SEQ ID NO: 4700402 - DNA, 17 bp, Homo sapiens
tccctttatttcacata

SEQ ID NO: 4700403 - DNA, 14 bp, Homo sapiens
tccctttctcccct

SEQ ID NO: 4700404 - DNA, 15 bp, Homo sapiens
tccctttctcccctg

SEQ ID NO: 4700405 - DNA, 19 bp, Homo sapiens
tccctttgacgccatccca

SEQ ID NO: 4700406 - DNA, 21 bp, Homo sapiens
tccctttgacgccatcccagc

SEQ ID NO: 4700407 - DNA, 21 bp, Homo sapiens
tccctttttccttgtccccac

SEQ ID NO: 4700408 - DNA, 23 bp, Homo sapiens
tcccttttttggctgctgaaggc

SEQ ID NO: 4700409 - DNA, 21 bp, Homo sapiens
tccgaaagggacttggaagct

SEQ ID NO: 4700410 - DNA, 22 bp, Homo sapiens
tccgaaagggacttggaagctc

SEQ ID NO: 4700411 - DNA, 21 bp, Homo sapiens
tccgacttgaattttcccact

SEQ ID NO: 4700412 - DNA, 13 bp, Homo sapiens
tccggcatggaca

SEQ ID NO: 4700413 - DNA, 21 bp, Homo sapiens
tccgggacctggtgctgcctc

SEQ ID NO: 4700414 - DNA, 19 bp, Homo sapiens
tccgtcctgatgattttta

SEQ ID NO: 4700415 - DNA, 22 bp, Homo sapiens
tcctaaaacaaaagctcatcca

SEQ ID NO: 4700416 - DNA, 17 bp, Homo sapiens
tcctaaaataagggcag

SEQ ID NO: 4700417 - DNA, 16 bp, Homo sapiens
tcctaattccacagct

SEQ ID NO: 4700418 - DNA, 17 bp, Homo sapiens
tcctaattccacagctg

SEQ ID NO: 4700419 - DNA, 17 bp, Homo sapiens
tcctacaaccaggtctt

SEQ ID NO: 4700420 - DNA, 16 bp, Homo sapiens
tcctaccccaattcct

SEQ ID NO: 4700421 - DNA, 18 bp, Homo sapiens
tcctaccccaattccttg

SEQ ID NO: 4700422 - DNA, 19 bp, Homo sapiens
tcctaccccaattccttgt

SEQ ID NO: 4700423 - DNA, 13 bp, Homo sapiens
tcctacccctccc

SEQ ID NO: 4700424 - DNA, 17 bp, Homo sapiens
tcctacccctcccagct

SEQ ID NO: 4700425 - DNA, 12 bp, Homo sapiens
tcctactctgtg

SEQ ID NO: 4700426 - DNA, 15 bp, Homo sapiens
tcctactctgtgtca

SEQ ID NO: 4700427 - DNA, 13 bp, Homo sapiens
tcctacttctctg

SEQ ID NO: 4700428 - DNA, 18 bp, Homo sapiens
tcctacttctctgagtca

SEQ ID NO: 4700429 - DNA, 23 bp, Homo sapiens
tcctagcactttgggaggccaag

SEQ ID NO: 4700430 - DNA, 17 bp, Homo sapiens
tcctagctgtgtgaata

SEQ ID NO: 4700431 - DNA, 12 bp, Homo sapiens
tcctagttccac

SEQ ID NO: 4700432 - DNA, 21 bp, Homo sapiens
tcctagttccaccatcaagcc

SEQ ID NO: 4700433 - DNA, 19 bp, Homo sapiens
tcctatacgcagcgtgctt

SEQ ID NO: 4700434 - DNA, 18 bp, Homo sapiens
tcctatgtttttgttcaa

SEQ ID NO: 4700435 - DNA, 19 bp, Homo sapiens
tcctatttctggaatggaa

SEQ ID NO: 4700436 - DNA, 18 bp, Homo sapiens
tcctatttgccatgggct

SEQ ID NO: 4700437 - DNA, 15 bp, Homo sapiens
tcctcaaggggccat

SEQ ID NO: 4700438 - DNA, 22 bp, Homo sapiens
tcctcaccttttcccggggagg

SEQ ID NO: 4700439 - DNA, 18 bp, Homo sapiens
tcctcatccagggctctg

SEQ ID NO: 4700440 - DNA, 20 bp, Homo sapiens
tcctcatggtgcatataaat

SEQ ID NO: 4700441 - DNA, 12 bp, Homo sapiens
tcctcattttga

SEQ ID NO: 4700442 - DNA, 22 bp, Homo sapiens
tcctcattttgaattatgtgca

SEQ ID NO: 4700443 - DNA, 22 bp, Homo sapiens
tcctccaccgccatggcttcca

SEQ ID NO: 4700444 - DNA, 19 bp, Homo sapiens
tcctccacgttctgctcat

SEQ ID NO: 4700445 - DNA, 23 bp, Homo sapiens
tcctccacgttctgctcatcatt

SEQ ID NO: 4700446 - DNA, 19 bp, Homo sapiens
tcctccactctcccccacc

SEQ ID NO: 4700447 - DNA, 14 bp, Homo sapiens
tcctccaggtgcac

SEQ ID NO: 4700448 - DNA, 21 bp, Homo sapiens
tcctccatgggggctcagcca

SEQ ID NO: 4700449 - DNA, 12 bp, Homo sapiens
tcctcccacctc

SEQ ID NO: 4700450 - DNA, 16 bp, Homo sapiens
tcctcccacctcagcc

SEQ ID NO: 4700451 - DNA, 18 bp, Homo sapiens
tcctcccacctcagcctc

SEQ ID NO: 4700452 - DNA, 19 bp, Homo sapiens
tcctccccaaggagacaca

SEQ ID NO: 4700453 - DNA, 15 bp, Homo sapiens
tcctcccctcgccca

SEQ ID NO: 4700454 - DNA, 14 bp, Homo sapiens
tcctcctccaggga

SEQ ID NO: 4700455 - DNA, 17 bp, Homo sapiens
tcctcctccagggacag

SEQ ID NO: 4700456 - DNA, 12 bp, Homo sapiens
tcctcctctgtg

SEQ ID NO: 4700457 - DNA, 15 bp, Homo sapiens
tcctcctgggccctc

SEQ ID NO: 4700458 - DNA, 16 bp, Homo sapiens
tcctcctgggccctct

SEQ ID NO: 4700459 - DNA, 14 bp, Homo sapiens
tcctctcagcccct

SEQ ID NO: 4700460 - DNA, 12 bp, Homo sapiens
tcctctctgccc

SEQ ID NO: 4700461 - DNA, 15 bp, Homo sapiens
tcctctgaatattaa

SEQ ID NO: 4700462 - DNA, 12 bp, Homo sapiens
tcctctgagcct

SEQ ID NO: 4700463 - DNA, 13 bp, Homo sapiens
tcctctgagcctt

SEQ ID NO: 4700464 - DNA, 18 bp, Homo sapiens
tcctctgagctgttatct

SEQ ID NO: 4700465 - DNA, 17 bp, Homo sapiens
tcctctgcagtgtggca

SEQ ID NO: 4700466 - DNA, 15 bp, Homo sapiens
tcctctggcctgtgt

SEQ ID NO: 4700467 - DNA, 15 bp, Homo sapiens
tcctctgtacagagc

SEQ ID NO: 4700468 - DNA, 18 bp, Homo sapiens
tcctctgtacagagccca

SEQ ID NO: 4700469 - DNA, 12 bp, Homo sapiens
tcctctgtgaaa

SEQ ID NO: 4700470 - DNA, 16 bp, Homo sapiens
tcctgacttcaggggc

SEQ ID NO: 4700471 - DNA, 19 bp, Homo sapiens
tcctgagaaaaaaggttcc

SEQ ID NO: 4700472 - DNA, 24 bp, Homo sapiens
tcctgagaaaaaaggttccgcttg

SEQ ID NO: 4700473 - DNA, 12 bp, Homo sapiens
tcctgaggctgg

SEQ ID NO: 4700474 - DNA, 15 bp, Homo sapiens
tcctgatcagagccg

SEQ ID NO: 4700475 - DNA, 12 bp, Homo sapiens
tcctgcaggcag

SEQ ID NO: 4700476 - DNA, 19 bp, Homo sapiens
tcctgcaggcagccaggcc

SEQ ID NO: 4700477 - DNA, 20 bp, Homo sapiens
tcctgcaggcagccaggcca

SEQ ID NO: 4700478 - DNA, 11 bp, Homo sapiens
tcctgccacca

SEQ ID NO: 4700479 - DNA, 16 bp, Homo sapiens
tcctgccaccacgccc

SEQ ID NO: 4700480 - DNA, 20 bp, Homo sapiens
tcctgcccttgctccagcct

SEQ ID NO: 4700481 - DNA, 21 bp, Homo sapiens
tcctgcccttgctccagcctg

SEQ ID NO: 4700482 - DNA, 13 bp, Homo sapiens
tcctgccgcagag

SEQ ID NO: 4700483 - DNA, 15 bp, Homo sapiens
tcctgccgcagagct

SEQ ID NO: 4700484 - DNA, 16 bp, Homo sapiens
tcctgccgcagagctg

SEQ ID NO: 4700485 - DNA, 18 bp, Homo sapiens
tcctgccgcagagctggc

SEQ ID NO: 4700486 - DNA, 19 bp, Homo sapiens
tcctgcctcagcctcccaa

SEQ ID NO: 4700487 - DNA, 20 bp, Homo sapiens
tcctgcctcgaactggctgc

SEQ ID NO: 4700488 - DNA, 21 bp, Homo sapiens
tcctgcctcgaactggctgca

SEQ ID NO: 4700489 - DNA, 14 bp, Homo sapiens
tcctgccttcctcc

SEQ ID NO: 4700490 - DNA, 18 bp, Homo sapiens
tcctgctccacagccatc

SEQ ID NO: 4700491 - DNA, 14 bp, Homo sapiens
tcctgctccacagt

SEQ ID NO: 4700492 - DNA, 16 bp, Homo sapiens
tcctgctccacagtgt

SEQ ID NO: 4700493 - DNA, 12 bp, Homo sapiens
tcctgctgcacc

SEQ ID NO: 4700494 - DNA, 13 bp, Homo sapiens
tcctgctgcacca

SEQ ID NO: 4700495 - DNA, 19 bp, Homo sapiens
tcctgctgcaccaacccag

SEQ ID NO: 4700496 - DNA, 20 bp, Homo sapiens
tcctgctgcaccaacccagc

SEQ ID NO: 4700497 - DNA, 22 bp, Homo sapiens
tcctgctgcaccaacccagccg

SEQ ID NO: 4700498 - DNA, 13 bp, Homo sapiens
tctatgggactca

SEQ ID NO: 4700499 - DNA, 18 bp, Homo sapiens
tctattaaaagactcatc

SEQ ID NO: 4700500 - DNA, 17 bp, Homo sapiens
tctattaaaattgccat

SEQ ID NO: 4700501 - DNA, 13 bp, Homo sapiens
tctatttatttat

SEQ ID NO: 4700502 - DNA, 14 bp, Homo sapiens
tctatttatttatt

SEQ ID NO: 4700503 - DNA, 14 bp, Homo sapiens
tctatttctcctcc

SEQ ID NO: 4700504 - DNA, 12 bp, Homo sapiens
tctatttcttta

SEQ ID NO: 4700505 - DNA, 12 bp, Homo sapiens
tctatttgtaga

SEQ ID NO: 4700506 - DNA, 11 bp, Homo sapiens
tctatttttgt

SEQ ID NO: 4700507 - DNA, 23 bp, Homo sapiens
tctatttttgtttacaaacatgg

SEQ ID NO: 4700508 - DNA, 21 bp, Homo sapiens
tctcaaactcttgacctcagg

SEQ ID NO: 4700509 - DNA, 19 bp, Homo sapiens
tctcaaagaaatttccact

SEQ ID NO: 4700510 - DNA, 22 bp, Homo sapiens
tctcaaagaaatttccactcag

SEQ ID NO: 4700511 - DNA, 18 bp, Homo sapiens
tctcaaagttaaaagtaa

SEQ ID NO: 4700512 - DNA, 16 bp, Homo sapiens
tctcaaagttttgaaa

SEQ ID NO: 4700513 - DNA, 17 bp, Homo sapiens
tctcaacccaggagcat

SEQ ID NO: 4700514 - DNA, 12 bp, Homo sapiens
tctcaattctgt

SEQ ID NO: 4700515 - DNA, 13 bp, Homo sapiens
tctcaattctgtc

SEQ ID NO: 4700516 - DNA, 13 bp, Homo sapiens
tctcaattttgta

SEQ ID NO: 4700517 - DNA, 16 bp, Homo sapiens
tctcaattttgtattt

SEQ ID NO: 4700518 - DNA, 19 bp, Homo sapiens
tctcacctaaaccctctgt

SEQ ID NO: 4700519 - DNA, 20 bp, Homo sapiens
tctcactatgttgcccaggc

SEQ ID NO: 4700520 - DNA, 21 bp, Homo sapiens
tctcactatgttgcccaggca

SEQ ID NO: 4700521 - DNA, 22 bp, Homo sapiens
tctcactatgttgcccaggcag

SEQ ID NO: 4700522 - DNA, 14 bp, Homo sapiens
tctcactcacattt

SEQ ID NO: 4700523 - DNA, 12 bp, Homo sapiens
tctcactctgtc

SEQ ID NO: 4700524 - DNA, 18 bp, Homo sapiens
tctcactctgtcgcccag

SEQ ID NO: 4700525 - DNA, 22 bp, Homo sapiens
tctcactctgtcgcccagtctg

SEQ ID NO: 4700526 - DNA, 23 bp, Homo sapiens
tctcactctgtcgcccagtctgg

SEQ ID NO: 4700527 - DNA, 19 bp, Homo sapiens
tctcactgttgcccaggct

SEQ ID NO: 4700528 - DNA, 20 bp, Homo sapiens
tctcactgttgcccaggctg

SEQ ID NO: 4700529 - DNA, 13 bp, Homo sapiens
tctcacttgtgcc

SEQ ID NO: 4700530 - DNA, 16 bp, Homo sapiens
tctcagtcatgcataa

SEQ ID NO: 4700531 - DNA, 20 bp, Homo sapiens
tctcagtcatgcataaatat

SEQ ID NO: 4700532 - DNA, 13 bp, Homo sapiens
tctcagtctctga

SEQ ID NO: 4700533 - DNA, 17 bp, Homo sapiens
tctcatatatattttaa

SEQ ID NO: 4700534 - DNA, 20 bp, Homo sapiens
tctcatatatattttaaaaa

SEQ ID NO: 4700535 - DNA, 15 bp, Homo sapiens
tctcatatctaactt

SEQ ID NO: 4700536 - DNA, 20 bp, Homo sapiens
tctcatctcttagctcccct

SEQ ID NO: 4700537 - DNA, 22 bp, Homo sapiens
tctcatctttcttgatcaacat

SEQ ID NO: 4700538 - DNA, 12 bp, Homo sapiens
tctcattaaaat

SEQ ID NO: 4700539 - DNA, 20 bp, Homo sapiens
tctcattggacccttccatg

SEQ ID NO: 4700540 - DNA, 17 bp, Homo sapiens
tctcatttcacccctcc

SEQ ID NO: 4700541 - DNA, 23 bp, Homo sapiens
tctccaaccccccagcactgagg

SEQ ID NO: 4700542 - DNA, 15 bp, Homo sapiens
tctccaagcaggaca

SEQ ID NO: 4700543 - DNA, 16 bp, Homo sapiens
tctccaagcaggacat

SEQ ID NO: 4700544 - DNA, 19 bp, Homo sapiens
tctccaagcaggacatgga

SEQ ID NO: 4700545 - DNA, 13 bp, Homo sapiens
tctccaccctgct

SEQ ID NO: 4700546 - DNA, 15 bp, Homo sapiens
tctccacctagtggc

SEQ ID NO: 4700547 - DNA, 21 bp, Homo sapiens
tctccacctagtggctgtcca

SEQ ID NO: 4700548 - DNA, 14 bp, Homo sapiens
tctccacctgccag

SEQ ID NO: 4700549 - DNA, 12 bp, Homo sapiens
tctccagcccct

SEQ ID NO: 4700550 - DNA, 22 bp, Homo sapiens
tctccagctataacagtaggga

SEQ ID NO: 4700551 - DNA, 19 bp, Homo sapiens
tctccatccacatgggagc

SEQ ID NO: 4700552 - DNA, 16 bp, Homo sapiens
tctccatggccctgcc

SEQ ID NO: 4700553 - DNA, 12 bp, Homo sapiens
tctcccccaccc

SEQ ID NO: 4700554 - DNA, 15 bp, Homo sapiens
tctcccccaccccct

SEQ ID NO: 4700555 - DNA, 19 bp, Homo sapiens
tctcccccaccccctcccc

SEQ ID NO: 4700556 - DNA, 13 bp, Homo sapiens
tctcccccagccc

SEQ ID NO: 4700557 - DNA, 14 bp, Homo sapiens
tctcccccagcccc

SEQ ID NO: 4700558 - DNA, 15 bp, Homo sapiens
tctcccccagcccca

SEQ ID NO: 4700559 - DNA, 22 bp, Homo sapiens
tctcccccagccccatcctctg

SEQ ID NO: 4700560 - DNA, 15 bp, Homo sapiens
tctcccctgccccca

SEQ ID NO: 4700561 - DNA, 19 bp, Homo sapiens
tctcccctgccccctgcag

SEQ ID NO: 4700562 - DNA, 21 bp, Homo sapiens
tctcccctgccccctgcagga

SEQ ID NO: 4700563 - DNA, 15 bp, Homo sapiens
tctccctcctggcca

SEQ ID NO: 4700564 - DNA, 16 bp, Homo sapiens
tctccctcctggccag

SEQ ID NO: 4700565 - DNA, 14 bp, Homo sapiens
tctccctggccctc

SEQ ID NO: 4700566 - DNA, 11 bp, Homo sapiens
tctcccttgga

SEQ ID NO: 4700567 - DNA, 23 bp, Homo sapiens
tctccgcacacctctggctgtct

SEQ ID NO: 4700568 - DNA, 14 bp, Homo sapiens
tctcctccaccgcc

SEQ ID NO: 4700569 - DNA, 20 bp, Homo sapiens
tctcctccatgggagaaaat

SEQ ID NO: 4700570 - DNA, 12 bp, Homo sapiens
tctcctccccaa

SEQ ID NO: 4700571 - DNA, 13 bp, Homo sapiens
tctcctccgtggc

SEQ ID NO: 4700572 - DNA, 12 bp, Homo sapiens
tctcctctgctg

SEQ ID NO: 4700573 - DNA, 18 bp, Homo sapiens
tctcctgccttcctcctg

SEQ ID NO: 4700574 - DNA, 20 bp, Homo sapiens
tctccttcacctttgtcccc

SEQ ID NO: 4700575 - DNA, 21 bp, Homo sapiens
tctccttcatgacagcctcca

SEQ ID NO: 4700576 - DNA, 20 bp, Homo sapiens
tctcgctgatgctgggctgg

SEQ ID NO: 4700577 - DNA, 22 bp, Homo sapiens
tctcgctgatgctgggctgggt

SEQ ID NO: 4700578 - DNA, 14 bp, Homo sapiens
tctcggtggtacca

SEQ ID NO: 4700579 - DNA, 19 bp, Homo sapiens
tctcgtggtaggactgtag

SEQ ID NO: 4700580 - DNA, 16 bp, Homo sapiens
tctctaattttggata

SEQ ID NO: 4700581 - DNA, 19 bp, Homo sapiens
tctctaattttggataata

SEQ ID NO: 4700582 - DNA, 21 bp, Homo sapiens
tctctactgtctcagtttaca

SEQ ID NO: 4700583 - DNA, 20 bp, Homo sapiens
tctctagtccctgtgttctg

SEQ ID NO: 4700584 - DNA, 13 bp, Homo sapiens
tctctccagcccc

SEQ ID NO: 4700585 - DNA, 15 bp, Homo sapiens
tctctccagcccctg

SEQ ID NO: 4700586 - DNA, 19 bp, Homo sapiens
tctctccagcccctggatg

SEQ ID NO: 4700587 - DNA, 14 bp, Homo sapiens
tctctcctgcggga

SEQ ID NO: 4700588 - DNA, 20 bp, Homo sapiens
tctctctcactcacattttc

SEQ ID NO: 4700589 - DNA, 16 bp, Homo sapiens
tctctgactaaaaata

SEQ ID NO: 4700590 - DNA, 16 bp, Homo sapiens
tctctggacactgcca

SEQ ID NO: 4700591 - DNA, 14 bp, Homo sapiens
tctctggatgcctg

SEQ ID NO: 4700592 - DNA, 15 bp, Homo sapiens
tctctggatgcctga

SEQ ID NO: 4700593 - DNA, 21 bp, Homo sapiens
tctctgggtttacaacaaaca

SEQ ID NO: 4700594 - DNA, 22 bp, Homo sapiens
tctctgggtttacaacaaacac

SEQ ID NO: 4700595 - DNA, 16 bp, Homo sapiens
tctctgtctcatccat

SEQ ID NO: 4700596 - DNA, 21 bp, Homo sapiens
tctctgtctcatccatcatca

SEQ ID NO: 4700597 - DNA, 21 bp, Homo sapiens
tctctgttccattgaatctgt

SEQ ID NO: 4700598 - DNA, 15 bp, Homo sapiens
tctcttcagtgtgtt

SEQ ID NO: 4700599 - DNA, 19 bp, Homo sapiens
tctcttcagtgtgttgact

SEQ ID NO: 4700600 - DNA, 14 bp, Homo sapiens
tctcttcccctctc

SEQ ID NO: 4700601 - DNA, 15 bp, Homo sapiens
tctcttcccctctca

SEQ ID NO: 4700602 - DNA, 13 bp, Homo sapiens
tctcttctctgtt

SEQ ID NO: 4700603 - DNA, 18 bp, Homo sapiens
tctcttctgggttccttc

SEQ ID NO: 4700604 - DNA, 14 bp, Homo sapiens
tctcttgaccctgt

SEQ ID NO: 4700605 - DNA, 14 bp, Homo sapiens
tctctttaaaatgc

SEQ ID NO: 4700606 - DNA, 22 bp, Homo sapiens
tctctttaatgtcacaggcagg

SEQ ID NO: 4700607 - DNA, 18 bp, Homo sapiens
tctctttacttcccagta

SEQ ID NO: 4700608 - DNA, 23 bp, Homo sapiens
tctttgtaccacagtttcttctg

SEQ ID NO: 4700609 - DNA, 15 bp, Homo sapiens
tcttttacatacagt

SEQ ID NO: 4700610 - DNA, 13 bp, Homo sapiens
tcttttcacaaat

SEQ ID NO: 4700611 - DNA, 14 bp, Homo sapiens
tcttttcacaaata

SEQ ID NO: 4700612 - DNA, 15 bp, Homo sapiens
tcttttcacaaataa

SEQ ID NO: 4700613 - DNA, 12 bp, Homo sapiens
tcttttcacatt

SEQ ID NO: 4700614 - DNA, 14 bp, Homo sapiens
tcttttccagaaag

SEQ ID NO: 4700615 - DNA, 15 bp, Homo sapiens
tcttttccagaaaga

SEQ ID NO: 4700616 - DNA, 15 bp, Homo sapiens
tctttttattcattg

SEQ ID NO: 4700617 - DNA, 16 bp, Homo sapiens
tctttttttccttcca

SEQ ID NO: 4700618 - DNA, 20 bp, Homo sapiens
tcttttttttttctgttgaa

SEQ ID NO: 4700619 - DNA, 21 bp, Homo sapiens
tcttttttttttctgttgaag

SEQ ID NO: 4700620 - DNA, 22 bp, Homo sapiens
tgaaaaaatagagcctgaggga

SEQ ID NO: 4700621 - DNA, 18 bp, Homo sapiens
tgaaaaaatgtatatgca

SEQ ID NO: 4700622 - DNA, 13 bp, Homo sapiens
tgaaaaacagaaa

SEQ ID NO: 4700623 - DNA, 16 bp, Homo sapiens
tgaaaacactgtgcac

SEQ ID NO: 4700624 - DNA, 20 bp, Homo sapiens
tgaaaacactgttctctgcc

SEQ ID NO: 4700625 - DNA, 23 bp, Homo sapiens
tgaaaacactgttctctgccctc

SEQ ID NO: 4700626 - DNA, 15 bp, Homo sapiens
tgaaaacattgatga

SEQ ID NO: 4700627 - DNA, 17 bp, Homo sapiens
tgaaaagctattagcca

SEQ ID NO: 4700628 - DNA, 20 bp, Homo sapiens
tgaaaagctattagccagga

SEQ ID NO: 4700629 - DNA, 14 bp, Homo sapiens
tgaaaataaagaat

SEQ ID NO: 4700630 - DNA, 14 bp, Homo sapiens
tgaaaatgtcttgt

SEQ ID NO: 4700631 - DNA, 14 bp, Homo sapiens
tgaaaattaacact

SEQ ID NO: 4700632 - DNA, 18 bp, Homo sapiens
tgaaaatttgtttgacaa

SEQ ID NO: 4700633 - DNA, 16 bp, Homo sapiens
tgaaaccttttttaag

SEQ ID NO: 4700634 - DNA, 20 bp, Homo sapiens
tgaaaccttttttaagattt

SEQ ID NO: 4700635 - DNA, 18 bp, Homo sapiens
tgaaactgtcataatggt

SEQ ID NO: 4700636 - DNA, 11 bp, Homo sapiens
tgaaagaactt

SEQ ID NO: 4700637 - DNA, 20 bp, Homo sapiens
tgaaagaatagaacacagtt

SEQ ID NO: 4700638 - DNA, 15 bp, Homo sapiens
tgaaagctactcata

SEQ ID NO: 4700639 - DNA, 12 bp, Homo sapiens
tgaaataaaata

SEQ ID NO: 4700640 - DNA, 15 bp, Homo sapiens
tgaaatacctgtttc

SEQ ID NO: 4700641 - DNA, 14 bp, Homo sapiens
tgaaatattaaaat

SEQ ID NO: 4700642 - DNA, 19 bp, Homo sapiens
tgaaatcttacagctgggt

SEQ ID NO: 4700643 - DNA, 16 bp, Homo sapiens
tgaaatgagcatgcat

SEQ ID NO: 4700644 - DNA, 20 bp, Homo sapiens
tgaaatgagcatgcattttc

SEQ ID NO: 4700645 - DNA, 21 bp, Homo sapiens
tgaaatgagcatgcattttct

SEQ ID NO: 4700646 - DNA, 19 bp, Homo sapiens
tgaaatggacttttgtaca

SEQ ID NO: 4700647 - DNA, 14 bp, Homo sapiens
tgaaattaacctct

SEQ ID NO: 4700648 - DNA, 17 bp, Homo sapiens
tgaaattaatttgtgaa

SEQ ID NO: 4700649 - DNA, 20 bp, Homo sapiens
tgaaattaatttgtgaattt

SEQ ID NO: 4700650 - DNA, 15 bp, Homo sapiens
tgaaattattttctc

SEQ ID NO: 4700651 - DNA, 13 bp, Homo sapiens
tgaaatttctcat

SEQ ID NO: 4700652 - DNA, 21 bp, Homo sapiens
tgaacagtttggatgtcctca

SEQ ID NO: 4700653 - DNA, 15 bp, Homo sapiens
tgaacattgcaatag

SEQ ID NO: 4700654 - DNA, 19 bp, Homo sapiens
tgaaccacatcttgctctg

SEQ ID NO: 4700655 - DNA, 21 bp, Homo sapiens
tgaaccacatcttgctctgct

SEQ ID NO: 4700656 - DNA, 22 bp, Homo sapiens
tgaaccaccacacccagcccac

SEQ ID NO: 4700657 - DNA, 12 bp, Homo sapiens
tgaacctgccct

SEQ ID NO: 4700658 - DNA, 13 bp, Homo sapiens
tgaacctttactc

SEQ ID NO: 4700659 - DNA, 21 bp, Homo sapiens
tgaactatggacggtgctcca

SEQ ID NO: 4700660 - DNA, 14 bp, Homo sapiens
tgaactcctggcct

SEQ ID NO: 4700661 - DNA, 16 bp, Homo sapiens
tgaactcctggcctca

SEQ ID NO: 4700662 - DNA, 21 bp, Homo sapiens
tgaactttcattggatttttg

SEQ ID NO: 4700663 - DNA, 15 bp, Homo sapiens
tgaactttgtaggac

SEQ ID NO: 4700664 - DNA, 13 bp, Homo sapiens
tgaagaaaacaaa

SEQ ID NO: 4700665 - DNA, 13 bp, Homo sapiens
tgaagaagctggg

SEQ ID NO: 4700666 - DNA, 23 bp, Homo sapiens
tgaagaaggctagaaaaaaagaa

SEQ ID NO: 4700667 - DNA, 23 bp, Homo sapiens
tgaagaatgttagagtaatgaaa

SEQ ID NO: 4700668 - DNA, 22 bp, Homo sapiens
tgaagaattattcagtgaattt

SEQ ID NO: 4700669 - DNA, 20 bp, Homo sapiens
tgaagactcattcttctgta

SEQ ID NO: 4700670 - DNA, 15 bp, Homo sapiens
tgaagagggaagcca

SEQ ID NO: 4700671 - DNA, 23 bp, Homo sapiens
tgaagagtaagtcaacctgcctg

SEQ ID NO: 4700672 - DNA, 22 bp, Homo sapiens
tgaagatcccaacatggtccta

SEQ ID NO: 4700673 - DNA, 12 bp, Homo sapiens
tgaagatgaaca

SEQ ID NO: 4700674 - DNA, 19 bp, Homo sapiens
tgaagattaacactaatta

SEQ ID NO: 4700675 - DNA, 21 bp, Homo sapiens
tgaagattctttcccaattca

SEQ ID NO: 4700676 - DNA, 17 bp, Homo sapiens
tgaagccttctgacctg

SEQ ID NO: 4700677 - DNA, 16 bp, Homo sapiens
tgaaggccccgcccag

SEQ ID NO: 4700678 - DNA, 18 bp, Homo sapiens
tgaaggccccgcccaggc

SEQ ID NO: 4700679 - DNA, 13 bp, Homo sapiens
tgaaggcttctct

SEQ ID NO: 4700680 - DNA, 15 bp, Homo sapiens
tgaaggcttctctct

SEQ ID NO: 4700681 - DNA, 21 bp, Homo sapiens
tgaagtcgtcttaactcacca

SEQ ID NO: 4700682 - DNA, 18 bp, Homo sapiens
tgaagtcttgcattgaat

SEQ ID NO: 4700683 - DNA, 21 bp, Homo sapiens
tgaataaagggaacatgcagc

SEQ ID NO: 4700684 - DNA, 16 bp, Homo sapiens
tgaatactgtattttg

SEQ ID NO: 4700685 - DNA, 21 bp, Homo sapiens
tgaatagatatgaaagctgat

SEQ ID NO: 4700686 - DNA, 15 bp, Homo sapiens
tgaatataaacacta

SEQ ID NO: 4700687 - DNA, 23 bp, Homo sapiens
tgaatatgtagtatctatatgac

SEQ ID NO: 4700688 - DNA, 19 bp, Homo sapiens
tgaatattaagaaacaatt

SEQ ID NO: 4700689 - DNA, 23 bp, Homo sapiens
tgaatattggtaattaaaagact

SEQ ID NO: 4700690 - DNA, 17 bp, Homo sapiens
tgaatattgtggctccc

SEQ ID NO: 4700691 - DNA, 20 bp, Homo sapiens
tgaatattgtggctccctgg

SEQ ID NO: 4700692 - DNA, 15 bp, Homo sapiens
tgaatctccttgttg

SEQ ID NO: 4700693 - DNA, 16 bp, Homo sapiens
tgaatcttggtgtcta

SEQ ID NO: 4700694 - DNA, 22 bp, Homo sapiens
tgaatgaagccttctgacctgg

SEQ ID NO: 4700695 - DNA, 19 bp, Homo sapiens
tgaatgactccaggaagaa

SEQ ID NO: 4700696 - DNA, 20 bp, Homo sapiens
tgaatgactccaggaagaag

SEQ ID NO: 4700697 - DNA, 16 bp, Homo sapiens
tgaatgattcagtgtt

SEQ ID NO: 4700698 - DNA, 19 bp, Homo sapiens
tgaatgcaaaagaaattta

SEQ ID NO: 4700699 - DNA, 14 bp, Homo sapiens
tgaatgcataaaat

SEQ ID NO: 4700700 - DNA, 16 bp, Homo sapiens
tgaatgcataaaatgt

SEQ ID NO: 4700701 - DNA, 15 bp, Homo sapiens
tgaatggattggatt

SEQ ID NO: 4700702 - DNA, 21 bp, Homo sapiens
tgaatggattggattatttaa

SEQ ID NO: 4700703 - DNA, 22 bp, Homo sapiens
tgaatggttccactcaaatgtc

SEQ ID NO: 4700704 - DNA, 15 bp, Homo sapiens
tgaatgtcagttgtt

SEQ ID NO: 4700705 - DNA, 18 bp, Homo sapiens
tgaatgtcattatttgat

SEQ ID NO: 4700706 - DNA, 19 bp, Homo sapiens
tgaatgtcattatttgata

SEQ ID NO: 4700707 - DNA, 20 bp, Homo sapiens
tgaatgtgcaaaaaaagaaa

SEQ ID NO: 4700708 - DNA, 14 bp, Homo sapiens
tgaattagctcact

SEQ ID NO: 4700709 - DNA, 21 bp, Homo sapiens
tgaattagggtgggctctaaa

SEQ ID NO: 4700710 - DNA, 13 bp, Homo sapiens
tgaattatgtgca

SEQ ID NO: 4700711 - DNA, 14 bp, Homo sapiens
tgaattatgtgcac

SEQ ID NO: 4700712 - DNA, 19 bp, Homo sapiens
tgaattgtaactgttcttg

SEQ ID NO: 4700713 - DNA, 22 bp, Homo sapiens
tgaattgtgtcccccataaaag

SEQ ID NO: 4700714 - DNA, 14 bp, Homo sapiens
tgaattttcccact

SEQ ID NO: 4700715 - DNA, 16 bp, Homo sapiens
tgaattttcccactgc

SEQ ID NO: 4700716 - DNA, 14 bp, Homo sapiens
tgacaaatgtgtat

SEQ ID NO: 4700717 - DNA, 16 bp, Homo sapiens
tgacaaatgtgtatgt

SEQ ID NO: 4700718 - DNA, 19 bp, Homo sapiens
tgatctaggaagactttgg

SEQ ID NO: 4700719 - DNA, 16 bp, Homo sapiens
tgatctatttgtagat

SEQ ID NO: 4700720 - DNA, 22 bp, Homo sapiens
tgatctatttgtagattaggat

SEQ ID NO: 4700721 - DNA, 21 bp, Homo sapiens
tgatctgatgcaagcaagaaa

SEQ ID NO: 4700722 - DNA, 15 bp, Homo sapiens
tgatctgtgggcaca

SEQ ID NO: 4700723 - DNA, 19 bp, Homo sapiens
tgatgaaactgtcataatg

SEQ ID NO: 4700724 - DNA, 22 bp, Homo sapiens
tgatgaaatgaggtcagagcct

SEQ ID NO: 4700725 - DNA, 20 bp, Homo sapiens
tgatgaatgaggaacaatca

SEQ ID NO: 4700726 - DNA, 14 bp, Homo sapiens
tgatgagattttta

SEQ ID NO: 4700727 - DNA, 15 bp, Homo sapiens
tgatgaggccctcca

SEQ ID NO: 4700728 - DNA, 23 bp, Homo sapiens
tgatgaggccctccacacctgcg

SEQ ID NO: 4700729 - DNA, 17 bp, Homo sapiens
tgatgaggctgatcatt

SEQ ID NO: 4700730 - DNA, 18 bp, Homo sapiens
tgatgagtttttatggtt

SEQ ID NO: 4700731 - DNA, 23 bp, Homo sapiens
tgatgatctttgcagacaggcaa

SEQ ID NO: 4700732 - DNA, 18 bp, Homo sapiens
tgatgccacaccaagctg

SEQ ID NO: 4700733 - DNA, 23 bp, Homo sapiens
tgatgccacaccaagctgtgcca

SEQ ID NO: 4700734 - DNA, 12 bp, Homo sapiens
tgatgctgggat

SEQ ID NO: 4700735 - DNA, 14 bp, Homo sapiens
tgatgctgggctgg

SEQ ID NO: 4700736 - DNA, 16 bp, Homo sapiens
tgatgctgggctgggt

SEQ ID NO: 4700737 - DNA, 20 bp, Homo sapiens
tgatgctgggctgggtgcga

SEQ ID NO: 4700738 - DNA, 16 bp, Homo sapiens
tgatgcttcttcagag

SEQ ID NO: 4700739 - DNA, 20 bp, Homo sapiens
tgatggcaggatggcctggc

SEQ ID NO: 4700740 - DNA, 22 bp, Homo sapiens
tgatgggcaacccccagcctgc

SEQ ID NO: 4700741 - DNA, 14 bp, Homo sapiens
tgatggggccctgc

SEQ ID NO: 4700742 - DNA, 16 bp, Homo sapiens
tgatggggccctgcct

SEQ ID NO: 4700743 - DNA, 19 bp, Homo sapiens
tgatgggttagtggatgga

SEQ ID NO: 4700744 - DNA, 23 bp, Homo sapiens
tgatgggttagtggatggaaggg

SEQ ID NO: 4700745 - DNA, 15 bp, Homo sapiens
tgatggtgatgaaat

SEQ ID NO: 4700746 - DNA, 14 bp, Homo sapiens
tgatgttactgaga

SEQ ID NO: 4700747 - DNA, 15 bp, Homo sapiens
tgatgttactgagat

SEQ ID NO: 4700748 - DNA, 19 bp, Homo sapiens
tgatgtttataaactgaga

SEQ ID NO: 4700749 - DNA, 23 bp, Homo sapiens
tgattagaaattacctgtggata

SEQ ID NO: 4700750 - DNA, 16 bp, Homo sapiens
tgattagataatcttt

SEQ ID NO: 4700751 - DNA, 13 bp, Homo sapiens
tgattatatgtca

SEQ ID NO: 4700752 - DNA, 14 bp, Homo sapiens
tgattattcagtgt

SEQ ID NO: 4700753 - DNA, 22 bp, Homo sapiens
tgattatttaagactaaaagtt

SEQ ID NO: 4700754 - DNA, 12 bp, Homo sapiens
tgattcacagtg

SEQ ID NO: 4700755 - DNA, 14 bp, Homo sapiens
tgattcagacagct

SEQ ID NO: 4700756 - DNA, 15 bp, Homo sapiens
tgattcagacagctg

SEQ ID NO: 4700757 - DNA, 15 bp, Homo sapiens
tgattccatcaaaga

SEQ ID NO: 4700758 - DNA, 21 bp, Homo sapiens
tgattcccaagctctgctcct

SEQ ID NO: 4700759 - DNA, 12 bp, Homo sapiens
tgattctcaggg

SEQ ID NO: 4700760 - DNA, 21 bp, Homo sapiens
tgattctcagggtctctgctg

SEQ ID NO: 4700761 - DNA, 15 bp, Homo sapiens
tgattctcctgcctc

SEQ ID NO: 4700762 - DNA, 20 bp, Homo sapiens
tgattctcctgcctcagcct

SEQ ID NO: 4700763 - DNA, 13 bp, Homo sapiens
tgattctccttca

SEQ ID NO: 4700764 - DNA, 14 bp, Homo sapiens
tgattctccttcag

SEQ ID NO: 4700765 - DNA, 21 bp, Homo sapiens
tgattctccttcagccctcac

SEQ ID NO: 4700766 - DNA, 13 bp, Homo sapiens
tgattggaggggg

SEQ ID NO: 4700767 - DNA, 21 bp, Homo sapiens
tgattggaggggggaggtggg

SEQ ID NO: 4700768 - DNA, 20 bp, Homo sapiens
tgattggcaggagttggaag

SEQ ID NO: 4700769 - DNA, 20 bp, Homo sapiens
tgatttaataaaataattct

SEQ ID NO: 4700770 - DNA, 22 bp, Homo sapiens
tgatttaataaaataattctaa

SEQ ID NO: 4700771 - DNA, 21 bp, Homo sapiens
tgatttagcaatgctgtgaat

SEQ ID NO: 4700772 - DNA, 22 bp, Homo sapiens
tgatttagcaatgctgtgaata

SEQ ID NO: 4700773 - DNA, 23 bp, Homo sapiens
tgatttagcaatgctgtgaataa

SEQ ID NO: 4700774 - DNA, 21 bp, Homo sapiens
tgatttaggtagccttgtgtt

SEQ ID NO: 4700775 - DNA, 16 bp, Homo sapiens
tgattttgctgtagaa

SEQ ID NO: 4700776 - DNA, 17 bp, Homo sapiens
tgattttgctgtagaag

SEQ ID NO: 4700777 - DNA, 13 bp, Homo sapiens
tgatttttgtgta

SEQ ID NO: 4700778 - DNA, 13 bp, Homo sapiens
tgcaaaaaaagaa

SEQ ID NO: 4700779 - DNA, 14 bp, Homo sapiens
tgcaaaaagggtca

SEQ ID NO: 4700780 - DNA, 23 bp, Homo sapiens
tgcaaaatgcgtatttgcatttg

SEQ ID NO: 4700781 - DNA, 17 bp, Homo sapiens
tgcaaagcccagcttga

SEQ ID NO: 4700782 - DNA, 20 bp, Homo sapiens
tgcaaagtcatgcaaaggct

SEQ ID NO: 4700783 - DNA, 23 bp, Homo sapiens
tgcaaatactgtatattcaggac

SEQ ID NO: 4700784 - DNA, 16 bp, Homo sapiens
tgcaacagacttgaat

SEQ ID NO: 4700785 - DNA, 13 bp, Homo sapiens
tgcaacaggctgg

SEQ ID NO: 4700786 - DNA, 14 bp, Homo sapiens
tgcaacaggctggg

SEQ ID NO: 4700787 - DNA, 16 bp, Homo sapiens
tgcaacaggctgggct

SEQ ID NO: 4700788 - DNA, 17 bp, Homo sapiens
tgcaacaggctgggctt

SEQ ID NO: 4700789 - DNA, 17 bp, Homo sapiens
tgcaacagtaatcagag

SEQ ID NO: 4700790 - DNA, 13 bp, Homo sapiens
tgcaacctccgcc

SEQ ID NO: 4700791 - DNA, 14 bp, Homo sapiens
tgcaacctccgcct

SEQ ID NO: 4700792 - DNA, 18 bp, Homo sapiens
tgcaacctccgcctcttg

SEQ ID NO: 4700793 - DNA, 20 bp, Homo sapiens
tgcaacctccgcctcttggg

SEQ ID NO: 4700794 - DNA, 14 bp, Homo sapiens
tgcaacctcgctgg

SEQ ID NO: 4700795 - DNA, 22 bp, Homo sapiens
tgcaacctcgctggactctcag

SEQ ID NO: 4700796 - DNA, 19 bp, Homo sapiens
tgcaacctgattgtgtctc

SEQ ID NO: 4700797 - DNA, 18 bp, Homo sapiens
tgcaaccttcgccacctg

SEQ ID NO: 4700798 - DNA, 21 bp, Homo sapiens
tgcaactcgccctgtttggca

SEQ ID NO: 4700799 - DNA, 18 bp, Homo sapiens
tgcaacttgtaaatgtgg

SEQ ID NO: 4700800 - DNA, 18 bp, Homo sapiens
tgcaagcaacaagctatt

SEQ ID NO: 4700801 - DNA, 19 bp, Homo sapiens
tgcaagcaacaagctattt

SEQ ID NO: 4700802 - DNA, 11 bp, Homo sapiens
tgcaagggaaa

SEQ ID NO: 4700803 - DNA, 19 bp, Homo sapiens
tgcaagtgggagatgaaaa

SEQ ID NO: 4700804 - DNA, 16 bp, Homo sapiens
tgcaatagaaggtgat

SEQ ID NO: 4700805 - DNA, 20 bp, Homo sapiens
tgcaatatggatttcttaga

SEQ ID NO: 4700806 - DNA, 15 bp, Homo sapiens
tgcaatggcagcctt

SEQ ID NO: 4700807 - DNA, 17 bp, Homo sapiens
tgcaatgtttttgtgta

SEQ ID NO: 4700808 - DNA, 18 bp, Homo sapiens
tgcaatgtttttgtgtag

SEQ ID NO: 4700809 - DNA, 19 bp, Homo sapiens
tgcaatgtttttgtgtaga

SEQ ID NO: 4700810 - DNA, 14 bp, Homo sapiens
tgcacaacattaca

SEQ ID NO: 4700811 - DNA, 22 bp, Homo sapiens
tgcacaagctccaagctcccag

SEQ ID NO: 4700812 - DNA, 23 bp, Homo sapiens
tgcacaagctccaagctcccagg

SEQ ID NO: 4700813 - DNA, 12 bp, Homo sapiens
tgcacaataaaa

SEQ ID NO: 4700814 - DNA, 22 bp, Homo sapiens
tgcacacaccagagcccacctt

SEQ ID NO: 4700815 - DNA, 18 bp, Homo sapiens
tgcacactcagttctgct

SEQ ID NO: 4700816 - DNA, 22 bp, Homo sapiens
tgcacactttgccatattttca

SEQ ID NO: 4700817 - DNA, 12 bp, Homo sapiens
tgcacatccctg

SEQ ID NO: 4700818 - DNA, 15 bp, Homo sapiens
tgcacatctgtgtct

SEQ ID NO: 4700819 - DNA, 17 bp, Homo sapiens
tgcacatctgttttgta

SEQ ID NO: 4700820 - DNA, 19 bp, Homo sapiens
tgcaccaacccagccgctg

SEQ ID NO: 4700821 - DNA, 22 bp, Homo sapiens
tgcaccaacccagccgctgccc

SEQ ID NO: 4700822 - DNA, 21 bp, Homo sapiens
tgcacccagccccaaggggtg

SEQ ID NO: 4700823 - DNA, 22 bp, Homo sapiens
tgcacccagccccaaggggtgg

SEQ ID NO: 4700824 - DNA, 12 bp, Homo sapiens
tgcaccccctcc

SEQ ID NO: 4700825 - DNA, 14 bp, Homo sapiens
tgcaccccctcctg

SEQ ID NO: 4700826 - DNA, 15 bp, Homo sapiens
tgcaccccctcctgc

SEQ ID NO: 4700827 - DNA, 13 bp, Homo sapiens
tgcgcaggctggc

SEQ ID NO: 4700828 - DNA, 21 bp, Homo sapiens
tgcgcaggctggccctgccct

SEQ ID NO: 4700829 - DNA, 20 bp, Homo sapiens
tgcgccactacactccagcc

SEQ ID NO: 4700830 - DNA, 13 bp, Homo sapiens
tgcgcctacagga

SEQ ID NO: 4700831 - DNA, 16 bp, Homo sapiens
tgcgcctacaggagtg

SEQ ID NO: 4700832 - DNA, 22 bp, Homo sapiens
tgcgcctacaggagtgagcact

SEQ ID NO: 4700833 - DNA, 23 bp, Homo sapiens
tgcggacagccacggccaggcca

SEQ ID NO: 4700834 - DNA, 17 bp, Homo sapiens
tgcggcattaaagccat

SEQ ID NO: 4700835 - DNA, 21 bp, Homo sapiens
tgcggggcctgaggcaagcca

SEQ ID NO: 4700836 - DNA, 16 bp, Homo sapiens
tgcgggtcacaggagg

SEQ ID NO: 4700837 - DNA, 18 bp, Homo sapiens
tgcggtccacccaggagc

SEQ ID NO: 4700838 - DNA, 18 bp, Homo sapiens
tgcggttccggcatggac

SEQ ID NO: 4700839 - DNA, 15 bp, Homo sapiens
tgcgtgacaataaaa

SEQ ID NO: 4700840 - DNA, 12 bp, Homo sapiens
tgcgtgtgtaga

SEQ ID NO: 4700841 - DNA, 14 bp, Homo sapiens
tgcgtgtgtagagt

SEQ ID NO: 4700842 - DNA, 19 bp, Homo sapiens
tgcgtgtgtagagttaaga

SEQ ID NO: 4700843 - DNA, 24 bp, Homo sapiens
tgcgtgtgtagagttaagaagctg

SEQ ID NO: 4700844 - DNA, 17 bp, Homo sapiens
tgctaaccttgtagcat

SEQ ID NO: 4700845 - DNA, 22 bp, Homo sapiens
tgctaactagcttggaaactgg

SEQ ID NO: 4700846 - DNA, 22 bp, Homo sapiens
tgctaagactcagtggggaggg

SEQ ID NO: 4700847 - DNA, 14 bp, Homo sapiens
tgctaccctccctg

SEQ ID NO: 4700848 - DNA, 17 bp, Homo sapiens
tgctaccctccctgctg

SEQ ID NO: 4700849 - DNA, 18 bp, Homo sapiens
tgctaccctccctgctgt

SEQ ID NO: 4700850 - DNA, 19 bp, Homo sapiens
tgctaccctccctgctgtc

SEQ ID NO: 4700851 - DNA, 16 bp, Homo sapiens
tgctaggaacactcct

SEQ ID NO: 4700852 - DNA, 21 bp, Homo sapiens
tgctataactatgttgataaa

SEQ ID NO: 4700853 - DNA, 13 bp, Homo sapiens
tgctatcaagaaa

SEQ ID NO: 4700854 - DNA, 21 bp, Homo sapiens
tgctatctagcagtaaaagat

SEQ ID NO: 4700855 - DNA, 17 bp, Homo sapiens
tgctcacgtcaaatgca

SEQ ID NO: 4700856 - DNA, 15 bp, Homo sapiens
tgctcatcattctct

SEQ ID NO: 4700857 - DNA, 19 bp, Homo sapiens
tgctcatcattctctgtct

SEQ ID NO: 4700858 - DNA, 14 bp, Homo sapiens
tgctccaaatttaa

SEQ ID NO: 4700859 - DNA, 12 bp, Homo sapiens
tgctccacagtg

SEQ ID NO: 4700860 - DNA, 17 bp, Homo sapiens
tgctccagcctgacaac

SEQ ID NO: 4700861 - DNA, 21 bp, Homo sapiens
tgctccagcctgacaacagcc

SEQ ID NO: 4700862 - DNA, 12 bp, Homo sapiens
tgctccaggcag

SEQ ID NO: 4700863 - DNA, 14 bp, Homo sapiens
tgctccaggcaggc

SEQ ID NO: 4700864 - DNA, 22 bp, Homo sapiens
tgctccaggcaggctaaggcgt

SEQ ID NO: 4700865 - DNA, 15 bp, Homo sapiens
tgctccctcacatgt

SEQ ID NO: 4700866 - DNA, 19 bp, Homo sapiens
tgctccttgggccctttga

SEQ ID NO: 4700867 - DNA, 21 bp, Homo sapiens
tgctccttgggccctttgagt

SEQ ID NO: 4700868 - DNA, 14 bp, Homo sapiens
tgctcgggcccagg

SEQ ID NO: 4700869 - DNA, 15 bp, Homo sapiens
tgctcgggcccaggc

SEQ ID NO: 4700870 - DNA, 21 bp, Homo sapiens
tgctctaagaagctgcaataa

SEQ ID NO: 4700871 - DNA, 21 bp, Homo sapiens
tgctctcatatatattttaaa

SEQ ID NO: 4700872 - DNA, 18 bp, Homo sapiens
tgctctccttcctggagc

SEQ ID NO: 4700873 - DNA, 13 bp, Homo sapiens
tgctctgatccct

SEQ ID NO: 4700874 - DNA, 21 bp, Homo sapiens
tgctctgctgacagacacagg

SEQ ID NO: 4700875 - DNA, 14 bp, Homo sapiens
tgctctggacaggc

SEQ ID NO: 4700876 - DNA, 20 bp, Homo sapiens
tgctcttgaactcctgacct

SEQ ID NO: 4700877 - DNA, 21 bp, Homo sapiens
tgctgaaggctcgagcatgcc

SEQ ID NO: 4700878 - DNA, 20 bp, Homo sapiens
tgctgaatgtaaaagaaaat

SEQ ID NO: 4700879 - DNA, 13 bp, Homo sapiens
tgctgaatgtcat

SEQ ID NO: 4700880 - DNA, 18 bp, Homo sapiens
tgctgagtctgaaggctg

SEQ ID NO: 4700881 - DNA, 21 bp, Homo sapiens
tgctgagtctgaaggctgggt

SEQ ID NO: 4700882 - DNA, 22 bp, Homo sapiens
tgctgatagctaagtgagtttt

SEQ ID NO: 4700883 - DNA, 17 bp, Homo sapiens
tgctgatgtcctcacca

SEQ ID NO: 4700884 - DNA, 16 bp, Homo sapiens
tgctgatgtttataaa

SEQ ID NO: 4700885 - DNA, 22 bp, Homo sapiens
tgctgcagaggggcaggccctg

SEQ ID NO: 4700886 - DNA, 23 bp, Homo sapiens
tgctgcagaggggcaggccctgc

SEQ ID NO: 4700887 - DNA, 16 bp, Homo sapiens
tgctgcagttgccagt

SEQ ID NO: 4700888 - DNA, 13 bp, Homo sapiens
tgctgccatccag

SEQ ID NO: 4700889 - DNA, 19 bp, Homo sapiens
tgctgccccatcagtgctc

SEQ ID NO: 4700890 - DNA, 12 bp, Homo sapiens
tgctgccctgcc

SEQ ID NO: 4700891 - DNA, 13 bp, Homo sapiens
tgctgccctgccc

SEQ ID NO: 4700892 - DNA, 16 bp, Homo sapiens
tgctgccctgcccacc

SEQ ID NO: 4700893 - DNA, 17 bp, Homo sapiens
tgctgccctgcccacct

SEQ ID NO: 4700894 - DNA, 19 bp, Homo sapiens
tgctgccctgcccacctgg

SEQ ID NO: 4700895 - DNA, 21 bp, Homo sapiens
tgctgccctgcccacctggcc

SEQ ID NO: 4700896 - DNA, 12 bp, Homo sapiens
tgctgccctgtg

SEQ ID NO: 4700897 - DNA, 21 bp, Homo sapiens
tgctgccgccccacccagatg

SEQ ID NO: 4700898 - DNA, 18 bp, Homo sapiens
tgctgctaccctccctgc

SEQ ID NO: 4700899 - DNA, 21 bp, Homo sapiens
tgctgctaccctccctgctgt

SEQ ID NO: 4700900 - DNA, 22 bp, Homo sapiens
tgctgctaccctccctgctgtc

SEQ ID NO: 4700901 - DNA, 21 bp, Homo sapiens
tgctgctgaatttataaaaat

SEQ ID NO: 4700902 - DNA, 13 bp, Homo sapiens
tgctgctggctgg

SEQ ID NO: 4700903 - DNA, 19 bp, Homo sapiens
tgctggagccactaactag

SEQ ID NO: 4700904 - DNA, 21 bp, Homo sapiens
tgctggcctctctgacatatg

SEQ ID NO: 4700905 - DNA, 14 bp, Homo sapiens
tgctggctgtgaaa

SEQ ID NO: 4700906 - DNA, 15 bp, Homo sapiens
tgctggctgtgacaa

SEQ ID NO: 4700907 - DNA, 21 bp, Homo sapiens
tgctggctgttggctgggggc

SEQ ID NO: 4700908 - DNA, 16 bp, Homo sapiens
tgctgggagcaggact

SEQ ID NO: 4700909 - DNA, 14 bp, Homo sapiens
tgctgggctggggc

SEQ ID NO: 4700910 - DNA, 17 bp, Homo sapiens
tgctgggctggggcctg

SEQ ID NO: 4700911 - DNA, 14 bp, Homo sapiens
tgctgggctgggtg

SEQ ID NO: 4700912 - DNA, 13 bp, Homo sapiens
tgctgggtggccc

SEQ ID NO: 4700913 - DNA, 14 bp, Homo sapiens
tgctgggtggccca

SEQ ID NO: 4700914 - DNA, 16 bp, Homo sapiens
tgctgggtggcccatc

SEQ ID NO: 4700915 - DNA, 22 bp, Homo sapiens
tgctgggtggcccatcccccct

SEQ ID NO: 4700916 - DNA, 12 bp, Homo sapiens
tgctggtttttc

SEQ ID NO: 4700917 - DNA, 18 bp, Homo sapiens
tgctggtttttcagtttt

SEQ ID NO: 4700918 - DNA, 15 bp, Homo sapiens
tgctgtcccctcttg

SEQ ID NO: 4700919 - DNA, 13 bp, Homo sapiens
tgctgtcttaaac

SEQ ID NO: 4700920 - DNA, 21 bp, Homo sapiens
tgctgtcttaaactaaatgtg

SEQ ID NO: 4700921 - DNA, 22 bp, Homo sapiens
tgctgtgacaccccccttctga

SEQ ID NO: 4700922 - DNA, 17 bp, Homo sapiens
tgctgtggtgtgtcccc

SEQ ID NO: 4700923 - DNA, 23 bp, Homo sapiens
tgctgtggtgtgtccccctctgt

SEQ ID NO: 4700924 - DNA, 13 bp, Homo sapiens
tgctgtttatgat

SEQ ID NO: 4700925 - DNA, 22 bp, Homo sapiens
tgcttaaaaggtataattaaac

SEQ ID NO: 4700926 - DNA, 16 bp, Homo sapiens
tgcttatgtgttgcat

SEQ ID NO: 4700927 - DNA, 22 bp, Homo sapiens
tgcttatgtgttgcataaacaa

SEQ ID NO: 4700928 - DNA, 16 bp, Homo sapiens
tgcttattttgtttca

SEQ ID NO: 4700929 - DNA, 17 bp, Homo sapiens
tgcttattttgtttcaa

SEQ ID NO: 4700930 - DNA, 13 bp, Homo sapiens
tgcttcagcctcc

SEQ ID NO: 4700931 - DNA, 21 bp, Homo sapiens
tgcttccaggtaaaaacagat

SEQ ID NO: 4700932 - DNA, 16 bp, Homo sapiens
tgcttccagtgaggct

SEQ ID NO: 4700933 - DNA, 20 bp, Homo sapiens
tgcttccagtgaggctctgc

SEQ ID NO: 4700934 - DNA, 19 bp, Homo sapiens
tgcttccattaacaaatgc

SEQ ID NO: 4700935 - DNA, 22 bp, Homo sapiens
tgcttccattaacaaatgctct

SEQ ID NO: 4700936 - DNA, 11 bp, Homo sapiens
tggatatttgt

SEQ ID NO: 4700937 - DNA, 20 bp, Homo sapiens
tggatgcatgttttccagct

SEQ ID NO: 4700938 - DNA, 19 bp, Homo sapiens
tggatgcctggtggcagct

SEQ ID NO: 4700939 - DNA, 18 bp, Homo sapiens
tggatggtgacttttgaa

SEQ ID NO: 4700940 - DNA, 20 bp, Homo sapiens
tggatggtgacttttgaaga

SEQ ID NO: 4700941 - DNA, 14 bp, Homo sapiens
tggattatttaata

SEQ ID NO: 4700942 - DNA, 20 bp, Homo sapiens
tggattccaaagcattttca

SEQ ID NO: 4700943 - DNA, 21 bp, Homo sapiens
tggattggagatagggaaaga

SEQ ID NO: 4700944 - DNA, 16 bp, Homo sapiens
tggattggattattta

SEQ ID NO: 4700945 - DNA, 21 bp, Homo sapiens
tggattggattatttaataac

SEQ ID NO: 4700946 - DNA, 13 bp, Homo sapiens
tggattggatttg

SEQ ID NO: 4700947 - DNA, 13 bp, Homo sapiens
tggattgtccccg

SEQ ID NO: 4700948 - DNA, 21 bp, Homo sapiens
tggattgtccccgacccttgc

SEQ ID NO: 4700949 - DNA, 19 bp, Homo sapiens
tggattgtgcctaatgtgt

SEQ ID NO: 4700950 - DNA, 20 bp, Homo sapiens
tggattgtgcctaatgtgtt

SEQ ID NO: 4700951 - DNA, 23 bp, Homo sapiens
tggattgtgcctaatgtgtttga

SEQ ID NO: 4700952 - DNA, 18 bp, Homo sapiens
tggatttaaaagcctgct

SEQ ID NO: 4700953 - DNA, 17 bp, Homo sapiens
tggatttttgtcttgtg

SEQ ID NO: 4700954 - DNA, 18 bp, Homo sapiens
tggcaagcaagagctctt

SEQ ID NO: 4700955 - DNA, 12 bp, Homo sapiens
tggcaaggctgt

SEQ ID NO: 4700956 - DNA, 20 bp, Homo sapiens
tggcaaggctgtgctccctg

SEQ ID NO: 4700957 - DNA, 20 bp, Homo sapiens
tggcacagcccaaagaagga

SEQ ID NO: 4700958 - DNA, 16 bp, Homo sapiens
tggcacagtgtctggg

SEQ ID NO: 4700959 - DNA, 18 bp, Homo sapiens
tggcacagtgtctgggct

SEQ ID NO: 4700960 - DNA, 19 bp, Homo sapiens
tggcacctgaaattaattt

SEQ ID NO: 4700961 - DNA, 14 bp, Homo sapiens
tggcactattttta

SEQ ID NO: 4700962 - DNA, 16 bp, Homo sapiens
tggcactatttttatt

SEQ ID NO: 4700963 - DNA, 23 bp, Homo sapiens
tggcagaagacaccagagcagat

SEQ ID NO: 4700964 - DNA, 17 bp, Homo sapiens
tggcagcaggtgctgct

SEQ ID NO: 4700965 - DNA, 17 bp, Homo sapiens
tggcagccttggcaaac

SEQ ID NO: 4700966 - DNA, 13 bp, Homo sapiens
tggcagctcagag

SEQ ID NO: 4700967 - DNA, 15 bp, Homo sapiens
tggcagctcagagag

SEQ ID NO: 4700968 - DNA, 16 bp, Homo sapiens
tggcagctcagagagg

SEQ ID NO: 4700969 - DNA, 21 bp, Homo sapiens
tggcagctgcggtccacccag

SEQ ID NO: 4700970 - DNA, 23 bp, Homo sapiens
tggcagctgcggtccacccagga

SEQ ID NO: 4700971 - DNA, 23 bp, Homo sapiens
tggcaggaagatgtatgctttga

SEQ ID NO: 4700972 - DNA, 17 bp, Homo sapiens
tggcaggagggcagtgg

SEQ ID NO: 4700973 - DNA, 19 bp, Homo sapiens
tggcaggatggcctggcca

SEQ ID NO: 4700974 - DNA, 15 bp, Homo sapiens
tggcaggtgcagccc

SEQ ID NO: 4700975 - DNA, 23 bp, Homo sapiens
tggcagtgggaaaaatgtaggag

SEQ ID NO: 4700976 - DNA, 13 bp, Homo sapiens
tggcagtgggagc

SEQ ID NO: 4700977 - DNA, 19 bp, Homo sapiens
tggcagtgggagctgcctg

SEQ ID NO: 4700978 - DNA, 20 bp, Homo sapiens
tggcattggcagcaggtgct

SEQ ID NO: 4700979 - DNA, 21 bp, Homo sapiens
tggccaaagccaaagctaggc

SEQ ID NO: 4700980 - DNA, 23 bp, Homo sapiens
tggccaaagccaaagctaggcct

SEQ ID NO: 4700981 - DNA, 18 bp, Homo sapiens
tggccaccaccccccact

SEQ ID NO: 4700982 - DNA, 19 bp, Homo sapiens
tggccagatgcaccagccc

SEQ ID NO: 4700983 - DNA, 21 bp, Homo sapiens
tggccagatgtcgctgggtcc

SEQ ID NO: 4700984 - DNA, 13 bp, Homo sapiens
tggccagccccac

SEQ ID NO: 4700985 - DNA, 18 bp, Homo sapiens
tggccagccccacagccc

SEQ ID NO: 4700986 - DNA, 23 bp, Homo sapiens
tggccagccccacagcccacgtc

SEQ ID NO: 4700987 - DNA, 16 bp, Homo sapiens
tggccaggctgctctt

SEQ ID NO: 4700988 - DNA, 23 bp, Homo sapiens
tggccagtgtgacaaggattgct

SEQ ID NO: 4700989 - DNA, 17 bp, Homo sapiens
tggccatctctggatgc

SEQ ID NO: 4700990 - DNA, 13 bp, Homo sapiens
tggcccagctccc

SEQ ID NO: 4700991 - DNA, 19 bp, Homo sapiens
tggcccatcccccctcacc

SEQ ID NO: 4700992 - DNA, 20 bp, Homo sapiens
tggcccatcccccctcacca

SEQ ID NO: 4700993 - DNA, 20 bp, Homo sapiens
tggccccagcctggcccagc

SEQ ID NO: 4700994 - DNA, 15 bp, Homo sapiens
tggcccctgcccggc

SEQ ID NO: 4700995 - DNA, 16 bp, Homo sapiens
tggcccctgcccggct

SEQ ID NO: 4700996 - DNA, 21 bp, Homo sapiens
tggcccctgcccggctgcgga

SEQ ID NO: 4700997 - DNA, 16 bp, Homo sapiens
tggccctctcccctgc

SEQ ID NO: 4700998 - DNA, 15 bp, Homo sapiens
tggccctgcaaaagg

SEQ ID NO: 4700999 - DNA, 17 bp, Homo sapiens
tggccctgctgcccctc

SEQ ID NO: 4701000 - DNA, 22 bp, Homo sapiens
tggccctgctgcccctccctgc

SEQ ID NO: 4701001 - DNA, 22 bp, Homo sapiens
tggccgcgccaaataatgtctc

SEQ ID NO: 4701002 - DNA, 23 bp, Homo sapiens
tggccgggaccccgagcctggct

SEQ ID NO: 4701003 - DNA, 15 bp, Homo sapiens
tggccgggagcctga

SEQ ID NO: 4701004 - DNA, 14 bp, Homo sapiens
tggccgtgggcctg

SEQ ID NO: 4701005 - DNA, 21 bp, Homo sapiens
tggccgttgatgttggctggg

SEQ ID NO: 4701006 - DNA, 18 bp, Homo sapiens
tggcctcaagtgattctc

SEQ ID NO: 4701007 - DNA, 23 bp, Homo sapiens
tggcctcaagtgattctcctgcc

SEQ ID NO: 4701008 - DNA, 23 bp, Homo sapiens
tggcctcccaactcaccccagcc

SEQ ID NO: 4701009 - DNA, 21 bp, Homo sapiens
tggcctctccttgtggcctgg

SEQ ID NO: 4701010 - DNA, 13 bp, Homo sapiens
tggcctctgcact

SEQ ID NO: 4701011 - DNA, 17 bp, Homo sapiens
tggcctctgcactcccc

SEQ ID NO: 4701012 - DNA, 19 bp, Homo sapiens
tggcctctgcactcccctg

SEQ ID NO: 4701013 - DNA, 14 bp, Homo sapiens
tggcctgggcctcc

SEQ ID NO: 4701014 - DNA, 17 bp, Homo sapiens
tggcctgggcctcctca

SEQ ID NO: 4701015 - DNA, 17 bp, Homo sapiens
tggcctttacagaaaat

SEQ ID NO: 4701016 - DNA, 14 bp, Homo sapiens
tggcgcaccctccc

SEQ ID NO: 4701017 - DNA, 18 bp, Homo sapiens
tggcgcaccctcccctcc

SEQ ID NO: 4701018 - DNA, 12 bp, Homo sapiens
tggcgtcctctc

SEQ ID NO: 4701019 - DNA, 22 bp, Homo sapiens
tggcgtcctctccctcctggcc

SEQ ID NO: 4701020 - DNA, 16 bp, Homo sapiens
tggcgtcctgcccttg

SEQ ID NO: 4701021 - DNA, 20 bp, Homo sapiens
tggctagaatatcctacttc

SEQ ID NO: 4701022 - DNA, 12 bp, Homo sapiens
tggctcacactg

SEQ ID NO: 4701023 - DNA, 20 bp, Homo sapiens
tggctcaggtggggtcactc

SEQ ID NO: 4701024 - DNA, 18 bp, Homo sapiens
tggctccaaaccctcgag

SEQ ID NO: 4701025 - DNA, 17 bp, Homo sapiens
tggctccagctggccgg

SEQ ID NO: 4701026 - DNA, 12 bp, Homo sapiens
tggctccctggg

SEQ ID NO: 4701027 - DNA, 15 bp, Homo sapiens
tggctccctgggggc

SEQ ID NO: 4701028 - DNA, 16 bp, Homo sapiens
tggctctctaattcca

SEQ ID NO: 4701029 - DNA, 19 bp, Homo sapiens
tggctcttccaggctggga

SEQ ID NO: 4701030 - DNA, 21 bp, Homo sapiens
tggctcttccaggctgggaga

SEQ ID NO: 4701031 - DNA, 17 bp, Homo sapiens
tggctctttttttcctt

SEQ ID NO: 4701032 - DNA, 20 bp, Homo sapiens
tggctgacttacatcatgtg

SEQ ID NO: 4701033 - DNA, 20 bp, Homo sapiens
tggctgagagagtggcattg

SEQ ID NO: 4701034 - DNA, 14 bp, Homo sapiens
tggctgcagggagt

SEQ ID NO: 4701035 - DNA, 15 bp, Homo sapiens
tggctgcagggagtc

SEQ ID NO: 4701036 - DNA, 14 bp, Homo sapiens
tggctgcctccact

SEQ ID NO: 4701037 - DNA, 16 bp, Homo sapiens
tggctgcctccactcc

SEQ ID NO: 4701038 - DNA, 12 bp, Homo sapiens
tggctgctgccc

SEQ ID NO: 4701039 - DNA, 23 bp, Homo sapiens
tggctgggaactcacctggggct

SEQ ID NO: 4701040 - DNA, 21 bp, Homo sapiens
tggctggggcctatcagtgtg

SEQ ID NO: 4701041 - DNA, 22 bp, Homo sapiens
tggctggggcctatcagtgtgc

SEQ ID NO: 4701042 - DNA, 15 bp, Homo sapiens
tggctgtccagtgcc

SEQ ID NO: 4701043 - DNA, 17 bp, Homo sapiens
tggctgtccagtgccca

SEQ ID NO: 4701044 - DNA, 23 bp, Homo sapiens
tggctgtccagtgcccattcctc

SEQ ID NO: 4701045 - DNA, 17 bp, Homo sapiens
tgtacataaaattttct

SEQ ID NO: 4701046 - DNA, 20 bp, Homo sapiens
tgtacatttatgatttaata

SEQ ID NO: 4701047 - DNA, 23 bp, Homo sapiens
tgtacattttaaaggataatggt

SEQ ID NO: 4701048 - DNA, 17 bp, Homo sapiens
tgtaccaaatctgacat

SEQ ID NO: 4701049 - DNA, 18 bp, Homo sapiens
tgtaccatggttgtgcac

SEQ ID NO: 4701050 - DNA, 22 bp, Homo sapiens
tgtacccccgcccaggctggcc

SEQ ID NO: 4701051 - DNA, 18 bp, Homo sapiens
tgtacctggtgacccctt

SEQ ID NO: 4701052 - DNA, 16 bp, Homo sapiens
tgtactaactagcatt

SEQ ID NO: 4701053 - DNA, 12 bp, Homo sapiens
tgtactacaatt

SEQ ID NO: 4701054 - DNA, 13 bp, Homo sapiens
tgtactctgtgtg

SEQ ID NO: 4701055 - DNA, 18 bp, Homo sapiens
tgtactggagagtggcaa

SEQ ID NO: 4701056 - DNA, 21 bp, Homo sapiens
tgtagaaaagggaactgaaca

SEQ ID NO: 4701057 - DNA, 16 bp, Homo sapiens
tgtagaagcattcctt

SEQ ID NO: 4701058 - DNA, 12 bp, Homo sapiens
tgtagagccagg

SEQ ID NO: 4701059 - DNA, 18 bp, Homo sapiens
tgtagagccagggtctca

SEQ ID NO: 4701060 - DNA, 20 bp, Homo sapiens
tgtagagtggcgattgaatg

SEQ ID NO: 4701061 - DNA, 14 bp, Homo sapiens
tgtagagttaagaa

SEQ ID NO: 4701062 - DNA, 16 bp, Homo sapiens
tgtagagttaagaagc

SEQ ID NO: 4701063 - DNA, 17 bp, Homo sapiens
tgtaggcataaagtcag

SEQ ID NO: 4701064 - DNA, 22 bp, Homo sapiens
tgtagggaaaaaaatgcttctt

SEQ ID NO: 4701065 - DNA, 22 bp, Homo sapiens
tgtagttgtcacactaaaattt

SEQ ID NO: 4701066 - DNA, 18 bp, Homo sapiens
tgtataaaagtgtgaaat

SEQ ID NO: 4701067 - DNA, 18 bp, Homo sapiens
tgtataaataggagagga

SEQ ID NO: 4701068 - DNA, 18 bp, Homo sapiens
tgtataaattaatacaga

SEQ ID NO: 4701069 - DNA, 20 bp, Homo sapiens
tgtataaattaatacagagt

SEQ ID NO: 4701070 - DNA, 22 bp, Homo sapiens
tgtataccatgatgcatggagt

SEQ ID NO: 4701071 - DNA, 13 bp, Homo sapiens
tgtatagcatgaa

SEQ ID NO: 4701072 - DNA, 19 bp, Homo sapiens
tgtatagcatgaaataaaa

SEQ ID NO: 4701073 - DNA, 21 bp, Homo sapiens
tgtatatagctctacacaaca

SEQ ID NO: 4701074 - DNA, 15 bp, Homo sapiens
tgtatatgaaaacaa

SEQ ID NO: 4701075 - DNA, 23 bp, Homo sapiens
tgtatatgaaaacaagttccaaa

SEQ ID NO: 4701076 - DNA, 13 bp, Homo sapiens
tgtatatgtataa

SEQ ID NO: 4701077 - DNA, 14 bp, Homo sapiens
tgtatatgtataaa

SEQ ID NO: 4701078 - DNA, 19 bp, Homo sapiens
tgtatatgtataaattaat

SEQ ID NO: 4701079 - DNA, 13 bp, Homo sapiens
tgtatatttaagg

SEQ ID NO: 4701080 - DNA, 15 bp, Homo sapiens
tgtatatttaaggta

SEQ ID NO: 4701081 - DNA, 22 bp, Homo sapiens
tgtatatttttatattgttttt

SEQ ID NO: 4701082 - DNA, 22 bp, Homo sapiens
tgtatccattctacctgtcctc

SEQ ID NO: 4701083 - DNA, 19 bp, Homo sapiens
tgtatcccatgagcctcag

SEQ ID NO: 4701084 - DNA, 12 bp, Homo sapiens
tgtatctaattc

SEQ ID NO: 4701085 - DNA, 14 bp, Homo sapiens
tgtatgctttgaat

SEQ ID NO: 4701086 - DNA, 14 bp, Homo sapiens
tgtatggaaacact

SEQ ID NO: 4701087 - DNA, 15 bp, Homo sapiens
tgtatggaaacactg

SEQ ID NO: 4701088 - DNA, 16 bp, Homo sapiens
tgtatggaaacactga

SEQ ID NO: 4701089 - DNA, 16 bp, Homo sapiens
tgtatggatatgtgta

SEQ ID NO: 4701090 - DNA, 17 bp, Homo sapiens
tgtatggatatgtgtaa

SEQ ID NO: 4701091 - DNA, 18 bp, Homo sapiens
tgtatggatatgtgtaaa

SEQ ID NO: 4701092 - DNA, 19 bp, Homo sapiens
tgtatgtggatacagtcat

SEQ ID NO: 4701093 - DNA, 20 bp, Homo sapiens
tgtatgtggatacagtcatt

SEQ ID NO: 4701094 - DNA, 14 bp, Homo sapiens
tgtattagccagtc

SEQ ID NO: 4701095 - DNA, 19 bp, Homo sapiens
tgtattctctgagctgtgc

SEQ ID NO: 4701096 - DNA, 20 bp, Homo sapiens
tgtattctctgagctgtgca

SEQ ID NO: 4701097 - DNA, 19 bp, Homo sapiens
tgtattgcatatatacata

SEQ ID NO: 4701098 - DNA, 17 bp, Homo sapiens
tgtattgtacataaaat

SEQ ID NO: 4701099 - DNA, 17 bp, Homo sapiens
tgtcaaaaagcaactga

SEQ ID NO: 4701100 - DNA, 13 bp, Homo sapiens
tgtcaaaactggt

SEQ ID NO: 4701101 - DNA, 13 bp, Homo sapiens
tgtcaaaattaat

SEQ ID NO: 4701102 - DNA, 19 bp, Homo sapiens
tgtcaagctggtgtcttca

SEQ ID NO: 4701103 - DNA, 17 bp, Homo sapiens
tgtcaatactgagccat

SEQ ID NO: 4701104 - DNA, 13 bp, Homo sapiens
tgtcacacacttt

SEQ ID NO: 4701105 - DNA, 14 bp, Homo sapiens
tgtcacctgtgctt

SEQ ID NO: 4701106 - DNA, 13 bp, Homo sapiens
tgtcactggctgc

SEQ ID NO: 4701107 - DNA, 22 bp, Homo sapiens
tgtcacttgctggctgtgaaac

SEQ ID NO: 4701108 - DNA, 22 bp, Homo sapiens
tgtcaggattgcgagagatgtg

SEQ ID NO: 4701109 - DNA, 16 bp, Homo sapiens
tgtcatttctcatgga

SEQ ID NO: 4701110 - DNA, 20 bp, Homo sapiens
tgtcatttgagcagggctca

SEQ ID NO: 4701111 - DNA, 17 bp, Homo sapiens
tgtccaaagcagggtct

SEQ ID NO: 4701112 - DNA, 18 bp, Homo sapiens
tgtccaaagcagggtctg

SEQ ID NO: 4701113 - DNA, 22 bp, Homo sapiens
tgtccaagaagcccaggaaagg

SEQ ID NO: 4701114 - DNA, 13 bp, Homo sapiens
tgtccagtgccca

SEQ ID NO: 4701115 - DNA, 14 bp, Homo sapiens
tgtccagtgcccat

SEQ ID NO: 4701116 - DNA, 15 bp, Homo sapiens
tgtccagtgcccatt

SEQ ID NO: 4701117 - DNA, 17 bp, Homo sapiens
tgtccagtgcccattcc

SEQ ID NO: 4701118 - DNA, 23 bp, Homo sapiens
tgtccagtgcccattcctcacct

SEQ ID NO: 4701119 - DNA, 19 bp, Homo sapiens
tgtccattattcaagaaag

SEQ ID NO: 4701120 - DNA, 13 bp, Homo sapiens
tgtccattgtaaa

SEQ ID NO: 4701121 - DNA, 19 bp, Homo sapiens
tgtccattgtaaatctgaa

SEQ ID NO: 4701122 - DNA, 16 bp, Homo sapiens
tgtcccaagctcccaa

SEQ ID NO: 4701123 - DNA, 20 bp, Homo sapiens
tgtcccagtttcccactctg

SEQ ID NO: 4701124 - DNA, 14 bp, Homo sapiens
tgtccccacactcc

SEQ ID NO: 4701125 - DNA, 19 bp, Homo sapiens
tgtccccaccgcagacagg

SEQ ID NO: 4701126 - DNA, 18 bp, Homo sapiens
tgtccccctctgtccagg

SEQ ID NO: 4701127 - DNA, 15 bp, Homo sapiens
tgtcccctcttgccc

SEQ ID NO: 4701128 - DNA, 17 bp, Homo sapiens
tgtcccctcttgcccca

SEQ ID NO: 4701129 - DNA, 12 bp, Homo sapiens
tgtccctccggg

SEQ ID NO: 4701130 - DNA, 22 bp, Homo sapiens
tgtccctgcacttgcagactct

SEQ ID NO: 4701131 - DNA, 21 bp, Homo sapiens
tgtcccttgcccccctggcct

SEQ ID NO: 4701132 - DNA, 14 bp, Homo sapiens
tgtcctataattct

SEQ ID NO: 4701133 - DNA, 22 bp, Homo sapiens
tgtcctatgggagtcaagtgtg

SEQ ID NO: 4701134 - DNA, 15 bp, Homo sapiens
tgtcctattatattc

SEQ ID NO: 4701135 - DNA, 18 bp, Homo sapiens
tgtcctcctctgtgaaac

SEQ ID NO: 4701136 - DNA, 14 bp, Homo sapiens
tgtcctgctccaca

SEQ ID NO: 4701137 - DNA, 16 bp, Homo sapiens
tgtcctgctccacagt

SEQ ID NO: 4701138 - DNA, 16 bp, Homo sapiens
tgtcgctgggtcctct

SEQ ID NO: 4701139 - DNA, 18 bp, Homo sapiens
tgtcgctgggtcctctgc

SEQ ID NO: 4701140 - DNA, 21 bp, Homo sapiens
tgtctagtagaacaatgtaca

SEQ ID NO: 4701141 - DNA, 14 bp, Homo sapiens
tgtctatgggactc

SEQ ID NO: 4701142 - DNA, 15 bp, Homo sapiens
tgtctatgggactca

SEQ ID NO: 4701143 - DNA, 16 bp, Homo sapiens
tgtctatgggactcaa

SEQ ID NO: 4701144 - DNA, 11 bp, Homo sapiens
tgtctcatcca

SEQ ID NO: 4701145 - DNA, 21 bp, Homo sapiens
tgtctcatccatcatcatgtg

SEQ ID NO: 4701146 - DNA, 11 bp, Homo sapiens
tgtctccaacc

SEQ ID NO: 4701147 - DNA, 19 bp, Homo sapiens
tgtctccaaccccccagca

SEQ ID NO: 4701148 - DNA, 22 bp, Homo sapiens
tgtctccaaccccccagcactg

SEQ ID NO: 4701149 - DNA, 16 bp, Homo sapiens
tgtctccctggccctc

SEQ ID NO: 4701150 - DNA, 18 bp, Homo sapiens
tgtctcttggtcctgctg

SEQ ID NO: 4701151 - DNA, 13 bp, Homo sapiens
tgtctgcaacatg

SEQ ID NO: 4701152 - DNA, 14 bp, Homo sapiens
tgtctgcaacatgg

SEQ ID NO: 4701153 - DNA, 19 bp, Homo sapiens
tgtcttcaatgatcaaatt

SEQ ID NO: 4701154 - DNA, 15 bp, Homo sapiens
tgtcttgcaatggca

SEQ ID NO: 4701155 - DNA, 14 bp, Homo sapiens
tgttttcaaatgtt

SEQ ID NO: 4701156 - DNA, 21 bp, Homo sapiens
tgttttgagggctattagaag

SEQ ID NO: 4701157 - DNA, 19 bp, Homo sapiens
tgttttgtctcctaaattg

SEQ ID NO: 4701158 - DNA, 12 bp, Homo sapiens
tgtttttaactc

SEQ ID NO: 4701159 - DNA, 21 bp, Homo sapiens
tgtttttctattaaaagactc

SEQ ID NO: 4701160 - DNA, 22 bp, Homo sapiens
tgtttttctattaaaagactca

SEQ ID NO: 4701161 - DNA, 17 bp, Homo sapiens
tgtttttctctaatgct

SEQ ID NO: 4701162 - DNA, 13 bp, Homo sapiens
tgtttttgtattt

SEQ ID NO: 4701163 - DNA, 23 bp, Homo sapiens
ttaaaaatgtagaaattcttcat

SEQ ID NO: 4701164 - DNA, 17 bp, Homo sapiens
ttaaaacaacactcaca

SEQ ID NO: 4701165 - DNA, 19 bp, Homo sapiens
ttaaaacctggaccttttc

SEQ ID NO: 4701166 - DNA, 12 bp, Homo sapiens
ttaaaagactca

SEQ ID NO: 4701167 - DNA, 13 bp, Homo sapiens
ttaaaagcctgct

SEQ ID NO: 4701168 - DNA, 13 bp, Homo sapiens
ttaaaagtaaaat

SEQ ID NO: 4701169 - DNA, 18 bp, Homo sapiens
ttaaaagttttgttcttt

SEQ ID NO: 4701170 - DNA, 23 bp, Homo sapiens
ttaaaatggatttaatccatttt

SEQ ID NO: 4701171 - DNA, 13 bp, Homo sapiens
ttaaaatttctta

SEQ ID NO: 4701172 - DNA, 15 bp, Homo sapiens
ttaaaccaattataa

SEQ ID NO: 4701173 - DNA, 18 bp, Homo sapiens
ttaaactccctttcatgt

SEQ ID NO: 4701174 - DNA, 13 bp, Homo sapiens
ttaaactggtatt

SEQ ID NO: 4701175 - DNA, 19 bp, Homo sapiens
ttaaactggtattttatct

SEQ ID NO: 4701176 - DNA, 22 bp, Homo sapiens
ttaaactgtattttatgttatt

SEQ ID NO: 4701177 - DNA, 18 bp, Homo sapiens
ttaaagaaaagttttgta

SEQ ID NO: 4701178 - DNA, 17 bp, Homo sapiens
ttaaagaaaatgtgtct

SEQ ID NO: 4701179 - DNA, 17 bp, Homo sapiens
ttaaagaatttctttat

SEQ ID NO: 4701180 - DNA, 21 bp, Homo sapiens
ttaaagcacatgccagggaaa

SEQ ID NO: 4701181 - DNA, 16 bp, Homo sapiens
ttaaaggacaaacagt

SEQ ID NO: 4701182 - DNA, 20 bp, Homo sapiens
ttaaaggacaaacagtgaat

SEQ ID NO: 4701183 - DNA, 20 bp, Homo sapiens
ttaaataaataaataagaat

SEQ ID NO: 4701184 - DNA, 18 bp, Homo sapiens
ttaaatgcccagcccctt

SEQ ID NO: 4701185 - DNA, 21 bp, Homo sapiens
ttaaatgtatcacattgaaga

SEQ ID NO: 4701186 - DNA, 23 bp, Homo sapiens
ttaaattctctctaacataacaa

SEQ ID NO: 4701187 - DNA, 17 bp, Homo sapiens
ttaaattgttataactt

SEQ ID NO: 4701188 - DNA, 15 bp, Homo sapiens
ttaaatttgtaagtt

SEQ ID NO: 4701189 - DNA, 19 bp, Homo sapiens
ttaacactgcttgtgtttt

SEQ ID NO: 4701190 - DNA, 18 bp, Homo sapiens
ttaacactgtaatatctt

SEQ ID NO: 4701191 - DNA, 18 bp, Homo sapiens
ttaacattcttttgttta

SEQ ID NO: 4701192 - DNA, 14 bp, Homo sapiens
ttaaccataaatca

SEQ ID NO: 4701193 - DNA, 16 bp, Homo sapiens
ttaaccctcactggga

SEQ ID NO: 4701194 - DNA, 13 bp, Homo sapiens
ttaacctgatgca

SEQ ID NO: 4701195 - DNA, 16 bp, Homo sapiens
ttaactatgacagata

SEQ ID NO: 4701196 - DNA, 20 bp, Homo sapiens
ttaactatgacagatatatt

SEQ ID NO: 4701197 - DNA, 21 bp, Homo sapiens
ttaactatgacagatatattt

SEQ ID NO: 4701198 - DNA, 14 bp, Homo sapiens
ttaactctggattt

SEQ ID NO: 4701199 - DNA, 18 bp, Homo sapiens
ttaactgaagatattcca

SEQ ID NO: 4701200 - DNA, 19 bp, Homo sapiens
ttaactgaagatattccaa

SEQ ID NO: 4701201 - DNA, 14 bp, Homo sapiens
ttaactttttaacc

SEQ ID NO: 4701202 - DNA, 19 bp, Homo sapiens
ttaagaactaaaatgttct

SEQ ID NO: 4701203 - DNA, 14 bp, Homo sapiens
ttaagaagctgttg

SEQ ID NO: 4701204 - DNA, 22 bp, Homo sapiens
ttaagaagctgttgtacattta

SEQ ID NO: 4701205 - DNA, 13 bp, Homo sapiens
ttaagactagata

SEQ ID NO: 4701206 - DNA, 14 bp, Homo sapiens
ttaagatttttctc

SEQ ID NO: 4701207 - DNA, 22 bp, Homo sapiens
ttaagatttttctcaaagtttt

SEQ ID NO: 4701208 - DNA, 18 bp, Homo sapiens
ttaagccacaaagtttgt

SEQ ID NO: 4701209 - DNA, 19 bp, Homo sapiens
ttaagcctcaaatttgaac

SEQ ID NO: 4701210 - DNA, 20 bp, Homo sapiens
ttaaggaaactcttatctca

SEQ ID NO: 4701211 - DNA, 13 bp, Homo sapiens
ttaagggtatgat

SEQ ID NO: 4701212 - DNA, 20 bp, Homo sapiens
ttaaggtatctttttattca

SEQ ID NO: 4701213 - DNA, 18 bp, Homo sapiens
ttaagtgcgtgtgtagag

SEQ ID NO: 4701214 - DNA, 19 bp, Homo sapiens
ttaagtgcgtgtgtagagt

SEQ ID NO: 4701215 - DNA, 20 bp, Homo sapiens
ttaagttacaattacatctc

SEQ ID NO: 4701216 - DNA, 18 bp, Homo sapiens
ttaagttagggaatggca

SEQ ID NO: 4701217 - DNA, 18 bp, Homo sapiens
ttaagttttatttaactt

SEQ ID NO: 4701218 - DNA, 16 bp, Homo sapiens
ttaataacattacctt

SEQ ID NO: 4701219 - DNA, 17 bp, Homo sapiens
ttaataacattacctta

SEQ ID NO: 4701220 - DNA, 20 bp, Homo sapiens
ttaatagcgtcataactaga

SEQ ID NO: 4701221 - DNA, 13 bp, Homo sapiens
ttaataggatttt

SEQ ID NO: 4701222 - DNA, 16 bp, Homo sapiens
ttaatagtatatctaa

SEQ ID NO: 4701223 - DNA, 18 bp, Homo sapiens
ttaatcacagtcatcttt

SEQ ID NO: 4701224 - DNA, 18 bp, Homo sapiens
ttaatcctgtaccaaatc

SEQ ID NO: 4701225 - DNA, 16 bp, Homo sapiens
ttaatcttttcacaaa

SEQ ID NO: 4701226 - DNA, 19 bp, Homo sapiens
ttaatcttttcacaaataa

SEQ ID NO: 4701227 - DNA, 18 bp, Homo sapiens
ttaatgatttttgtgtat

SEQ ID NO: 4701228 - DNA, 16 bp, Homo sapiens
ttaatgtggttgaaga

SEQ ID NO: 4701229 - DNA, 13 bp, Homo sapiens
ttaattgttgttt

SEQ ID NO: 4701230 - DNA, 20 bp, Homo sapiens
ttaattgttgtttctttcta

SEQ ID NO: 4701231 - DNA, 22 bp, Homo sapiens
ttaatttacaaaaatataaaat

SEQ ID NO: 4701232 - DNA, 13 bp, Homo sapiens
ttaatttgtgaat

SEQ ID NO: 4701233 - DNA, 19 bp, Homo sapiens
ttaatttttttgagacaga

SEQ ID NO: 4701234 - DNA, 18 bp, Homo sapiens
ttacaaaaatataaaata

SEQ ID NO: 4701235 - DNA, 15 bp, Homo sapiens
ttacaaacatgtggt

SEQ ID NO: 4701236 - DNA, 20 bp, Homo sapiens
ttacaagggcataaagtaaa

SEQ ID NO: 4701237 - DNA, 17 bp, Homo sapiens
ttacaatcagtgtgaat

SEQ ID NO: 4701238 - DNA, 18 bp, Homo sapiens
ttacaatcagtgtgaatg

SEQ ID NO: 4701239 - DNA, 23 bp, Homo sapiens
ttacaatgtaaaccacatgaact

SEQ ID NO: 4701240 - DNA, 23 bp, Homo sapiens
ttacacagtcaaatttacattta

SEQ ID NO: 4701241 - DNA, 20 bp, Homo sapiens
ttacactggtctaatgtttg

SEQ ID NO: 4701242 - DNA, 14 bp, Homo sapiens
ttacacttactgtt

SEQ ID NO: 4701243 - DNA, 15 bp, Homo sapiens
ttacacttactgttg

SEQ ID NO: 4701244 - DNA, 18 bp, Homo sapiens
ttacaggctcctgccacc

SEQ ID NO: 4701245 - DNA, 14 bp, Homo sapiens
ttacaggtgtgaac

SEQ ID NO: 4701246 - DNA, 15 bp, Homo sapiens
ttacatacagtgata

SEQ ID NO: 4701247 - DNA, 14 bp, Homo sapiens
ttacatatctgact

SEQ ID NO: 4701248 - DNA, 13 bp, Homo sapiens
ttaccaaaacagg

SEQ ID NO: 4701249 - DNA, 14 bp, Homo sapiens
ttaccattagcata

SEQ ID NO: 4701250 - DNA, 16 bp, Homo sapiens
ttacccagagttttta

SEQ ID NO: 4701251 - DNA, 11 bp, Homo sapiens
ttacctcctga

SEQ ID NO: 4701252 - DNA, 13 bp, Homo sapiens
ttacctgtggata

SEQ ID NO: 4701253 - DNA, 17 bp, Homo sapiens
ttaccttattggatatt

SEQ ID NO: 4701254 - DNA, 15 bp, Homo sapiens
ttactaaaaagtata

SEQ ID NO: 4701255 - DNA, 12 bp, Homo sapiens
ttactcactgct

SEQ ID NO: 4701256 - DNA, 18 bp, Homo sapiens
ttactccaaggtttataa

SEQ ID NO: 4701257 - DNA, 24 bp, Homo sapiens
ttactccaaggtttataaagcaga

SEQ ID NO: 4701258 - DNA, 21 bp, Homo sapiens
ttactcctgaagtgagtttta

SEQ ID NO: 4701259 - DNA, 12 bp, Homo sapiens
ttactgaaaaag

SEQ ID NO: 4701260 - DNA, 18 bp, Homo sapiens
ttactgaaaaaggtgatt

SEQ ID NO: 4701261 - DNA, 21 bp, Homo sapiens
ttactgaagaaatctttccag

SEQ ID NO: 4701262 - DNA, 13 bp, Homo sapiens
ttactgcttttca

SEQ ID NO: 4701263 - DNA, 14 bp, Homo sapiens
ttactgcttttcat

SEQ ID NO: 4701264 - DNA, 15 bp, Homo sapiens
ttactgcttttcatt

SEQ ID NO: 4701265 - DNA, 17 bp, Homo sapiens
ttcaattgcatctccca

SEQ ID NO: 4701266 - DNA, 19 bp, Homo sapiens
ttcaattgcatctcccaga

SEQ ID NO: 4701267 - DNA, 17 bp, Homo sapiens
ttcaatttccaagagct

SEQ ID NO: 4701268 - DNA, 13 bp, Homo sapiens
ttcacaatgttaa

SEQ ID NO: 4701269 - DNA, 13 bp, Homo sapiens
ttcacactgtctg

SEQ ID NO: 4701270 - DNA, 20 bp, Homo sapiens
ttcacagtgcccaagagtgg

SEQ ID NO: 4701271 - DNA, 18 bp, Homo sapiens
ttcacagtttcttccatt

SEQ ID NO: 4701272 - DNA, 18 bp, Homo sapiens
ttcacatctaacctcatc

SEQ ID NO: 4701273 - DNA, 19 bp, Homo sapiens
ttcacatctaacctcatct

SEQ ID NO: 4701274 - DNA, 17 bp, Homo sapiens
ttcacattttttttctt

SEQ ID NO: 4701275 - DNA, 22 bp, Homo sapiens
ttcacccctccctttctcccct

SEQ ID NO: 4701276 - DNA, 14 bp, Homo sapiens
ttcaccgaggacat

SEQ ID NO: 4701277 - DNA, 22 bp, Homo sapiens
ttcacctttgtccccaccgcag

SEQ ID NO: 4701278 - DNA, 13 bp, Homo sapiens
ttcactctaattg

SEQ ID NO: 4701279 - DNA, 19 bp, Homo sapiens
ttcactgtataaataggag

SEQ ID NO: 4701280 - DNA, 17 bp, Homo sapiens
ttcagaagtcacacatt

SEQ ID NO: 4701281 - DNA, 22 bp, Homo sapiens
ttcagaagtcacacattacaaa

SEQ ID NO: 4701282 - DNA, 14 bp, Homo sapiens
ttcagaatatctta

SEQ ID NO: 4701283 - DNA, 15 bp, Homo sapiens
ttcagaatcacttct

SEQ ID NO: 4701284 - DNA, 14 bp, Homo sapiens
ttcagacagctgcc

SEQ ID NO: 4701285 - DNA, 21 bp, Homo sapiens
ttcagacagctgcctgggatc

SEQ ID NO: 4701286 - DNA, 19 bp, Homo sapiens
ttcagagactcctgcaggc

SEQ ID NO: 4701287 - DNA, 14 bp, Homo sapiens
ttcagatataaaag

SEQ ID NO: 4701288 - DNA, 19 bp, Homo sapiens
ttcagatataaaagactga

SEQ ID NO: 4701289 - DNA, 22 bp, Homo sapiens
ttcagatataaaagactgacca

SEQ ID NO: 4701290 - DNA, 22 bp, Homo sapiens
ttcagcacctacagtgtacagt

SEQ ID NO: 4701291 - DNA, 12 bp, Homo sapiens
ttcagccctcac

SEQ ID NO: 4701292 - DNA, 16 bp, Homo sapiens
ttcagccctcacccct

SEQ ID NO: 4701293 - DNA, 13 bp, Homo sapiens
ttcagctcactgt

SEQ ID NO: 4701294 - DNA, 12 bp, Homo sapiens
ttcagctccagc

SEQ ID NO: 4701295 - DNA, 15 bp, Homo sapiens
ttcagctccagctca

SEQ ID NO: 4701296 - DNA, 23 bp, Homo sapiens
ttcagctccagctcaccagcccc

SEQ ID NO: 4701297 - DNA, 11 bp, Homo sapiens
ttcagctggtg

SEQ ID NO: 4701298 - DNA, 19 bp, Homo sapiens
ttcagctggtggatggtga

SEQ ID NO: 4701299 - DNA, 21 bp, Homo sapiens
ttcagctggtggatggtgact

SEQ ID NO: 4701300 - DNA, 15 bp, Homo sapiens
ttcagcttctgctgg

SEQ ID NO: 4701301 - DNA, 16 bp, Homo sapiens
ttcagcttctgctggg

SEQ ID NO: 4701302 - DNA, 17 bp, Homo sapiens
ttcagcttctgctgggc

SEQ ID NO: 4701303 - DNA, 18 bp, Homo sapiens
ttcagcttctgctgggct

SEQ ID NO: 4701304 - DNA, 22 bp, Homo sapiens
ttcagcttgtaaatagctcagg

SEQ ID NO: 4701305 - DNA, 19 bp, Homo sapiens
ttcaggaaaagcctctgtg

SEQ ID NO: 4701306 - DNA, 20 bp, Homo sapiens
ttcaggaaaagcctctgtgt

SEQ ID NO: 4701307 - DNA, 13 bp, Homo sapiens
ttcaggaagctca

SEQ ID NO: 4701308 - DNA, 17 bp, Homo sapiens
ttcaggaagctcagggc

SEQ ID NO: 4701309 - DNA, 22 bp, Homo sapiens
ttcaggagcagcctcagaacaa

SEQ ID NO: 4701310 - DNA, 14 bp, Homo sapiens
ttcagggttggccc

SEQ ID NO: 4701311 - DNA, 19 bp, Homo sapiens
ttcagggttggcccctgcc

SEQ ID NO: 4701312 - DNA, 18 bp, Homo sapiens
ttcaggtgacatgtgaaa

SEQ ID NO: 4701313 - DNA, 19 bp, Homo sapiens
ttcaggttatcgaaataac

SEQ ID NO: 4701314 - DNA, 22 bp, Homo sapiens
ttcaggttatcgaaataacaat

SEQ ID NO: 4701315 - DNA, 16 bp, Homo sapiens
ttcaggttttagtttt

SEQ ID NO: 4701316 - DNA, 22 bp, Homo sapiens
ttcagtactcaaattcaatgat

SEQ ID NO: 4701317 - DNA, 22 bp, Homo sapiens
ttcagtgttaaatgtgatgaat

SEQ ID NO: 4701318 - DNA, 17 bp, Homo sapiens
ttcataagtatttcaaa

SEQ ID NO: 4701319 - DNA, 16 bp, Homo sapiens
ttcatacctgtgaata

SEQ ID NO: 4701320 - DNA, 15 bp, Homo sapiens
ttcatattgcatcat

SEQ ID NO: 4701321 - DNA, 17 bp, Homo sapiens
ttcatattgcatcatag

SEQ ID NO: 4701322 - DNA, 14 bp, Homo sapiens
ttcatcaaataaac

SEQ ID NO: 4701323 - DNA, 19 bp, Homo sapiens
ttcatcaaatggaagacac

SEQ ID NO: 4701324 - DNA, 18 bp, Homo sapiens
ttcatcagggaggaaagt

SEQ ID NO: 4701325 - DNA, 19 bp, Homo sapiens
ttcatcatccctccctgcc

SEQ ID NO: 4701326 - DNA, 13 bp, Homo sapiens
ttcatctgctctc

SEQ ID NO: 4701327 - DNA, 13 bp, Homo sapiens
ttcatcttttcat

SEQ ID NO: 4701328 - DNA, 17 bp, Homo sapiens
ttcatggcagaaggcaa

SEQ ID NO: 4701329 - DNA, 20 bp, Homo sapiens
ttcattagcagttgctcaca

SEQ ID NO: 4701330 - DNA, 19 bp, Homo sapiens
ttcattctttttgaaatgt

SEQ ID NO: 4701331 - DNA, 21 bp, Homo sapiens
ttcattggatttttgttaatt

SEQ ID NO: 4701332 - DNA, 14 bp, Homo sapiens
ttcattggttaaaa

SEQ ID NO: 4701333 - DNA, 15 bp, Homo sapiens
ttcatttcctgtgtc

SEQ ID NO: 4701334 - DNA, 16 bp, Homo sapiens
ttcatttcctgtgtct

SEQ ID NO: 4701335 - DNA, 18 bp, Homo sapiens
ttcattttttatgtattg

SEQ ID NO: 4701336 - DNA, 17 bp, Homo sapiens
ttcatttttttccaggc

SEQ ID NO: 4701337 - DNA, 20 bp, Homo sapiens
ttccaaagcattttcagcat

SEQ ID NO: 4701338 - DNA, 23 bp, Homo sapiens
ttccaaaggccatggagagctgg

SEQ ID NO: 4701339 - DNA, 16 bp, Homo sapiens
ttccaaatgtgtataa

SEQ ID NO: 4701340 - DNA, 13 bp, Homo sapiens
ttccaagagctga

SEQ ID NO: 4701341 - DNA, 15 bp, Homo sapiens
ttccaatcacagtgt

SEQ ID NO: 4701342 - DNA, 12 bp, Homo sapiens
ttccaatgaaat

SEQ ID NO: 4701343 - DNA, 16 bp, Homo sapiens
ttccaatgaaatatgt

SEQ ID NO: 4701344 - DNA, 16 bp, Homo sapiens
ttccacacccccaccc

SEQ ID NO: 4701345 - DNA, 22 bp, Homo sapiens
ttccacacccccaccccttgct

SEQ ID NO: 4701346 - DNA, 18 bp, Homo sapiens
ttccaccatcaagccacc

SEQ ID NO: 4701347 - DNA, 19 bp, Homo sapiens
ttccaccatcaagccacca

SEQ ID NO: 4701348 - DNA, 19 bp, Homo sapiens
ttccactatttgcagaggc

SEQ ID NO: 4701349 - DNA, 16 bp, Homo sapiens
ttccactgagggcagt

SEQ ID NO: 4701350 - DNA, 18 bp, Homo sapiens
ttccacttgattttgcaa

SEQ ID NO: 4701351 - DNA, 15 bp, Homo sapiens
ttccagagctgcttc

SEQ ID NO: 4701352 - DNA, 20 bp, Homo sapiens
ttccagcaattctcctgcct

SEQ ID NO: 4701353 - DNA, 22 bp, Homo sapiens
ttccagcaattctcctgcctca

SEQ ID NO: 4701354 - DNA, 12 bp, Homo sapiens
ttccagccaggg

SEQ ID NO: 4701355 - DNA, 15 bp, Homo sapiens
ttccagccagggctg

SEQ ID NO: 4701356 - DNA, 16 bp, Homo sapiens
ttccagcttccagaac

SEQ ID NO: 4701357 - DNA, 17 bp, Homo sapiens
ttccaggggtgggacac

SEQ ID NO: 4701358 - DNA, 15 bp, Homo sapiens
ttccaggtggggtga

SEQ ID NO: 4701359 - DNA, 15 bp, Homo sapiens
ttccagtgaggctct

SEQ ID NO: 4701360 - DNA, 21 bp, Homo sapiens
ttccagtgaggctctgccctt

SEQ ID NO: 4701361 - DNA, 17 bp, Homo sapiens
ttccagtgcagagatcc

SEQ ID NO: 4701362 - DNA, 14 bp, Homo sapiens
ttccataagctatt

SEQ ID NO: 4701363 - DNA, 16 bp, Homo sapiens
ttccataagctatttt

SEQ ID NO: 4701364 - DNA, 15 bp, Homo sapiens
ttccatgaaaatgca

SEQ ID NO: 4701365 - DNA, 13 bp, Homo sapiens
ttccatgatgctg

SEQ ID NO: 4701366 - DNA, 18 bp, Homo sapiens
ttccatgatgctgggatt

SEQ ID NO: 4701367 - DNA, 15 bp, Homo sapiens
ttccatggactttgt

SEQ ID NO: 4701368 - DNA, 20 bp, Homo sapiens
ttccattctggattttgtca

SEQ ID NO: 4701369 - DNA, 24 bp, Homo sapiens
ttccattgcctcttttcacatttt

SEQ ID NO: 4701370 - DNA, 16 bp, Homo sapiens
ttccattggatctcat

SEQ ID NO: 4701371 - DNA, 17 bp, Homo sapiens
ttccattggatctcatt

SEQ ID NO: 4701372 - DNA, 17 bp, Homo sapiens
ttccatttgcaagggaa

SEQ ID NO: 4701373 - DNA, 11 bp, Homo sapiens
ttcccaaaagc

SEQ ID NO: 4701374 - DNA, 21 bp, Homo sapiens
ttcccaaaagcccattcattc

SEQ ID NO: 4701375 - DNA, 12 bp, Homo sapiens
ttgcccaggctg

SEQ ID NO: 4701376 - DNA, 23 bp, Homo sapiens
ttgcccaggctggcgtgcagtgg

SEQ ID NO: 4701377 - DNA, 14 bp, Homo sapiens
ttgccccaaccccc

SEQ ID NO: 4701378 - DNA, 14 bp, Homo sapiens
ttgcccccctggcc

SEQ ID NO: 4701379 - DNA, 15 bp, Homo sapiens
ttgcccccctggcct

SEQ ID NO: 4701380 - DNA, 16 bp, Homo sapiens
ttgcccccctggcctc

SEQ ID NO: 4701381 - DNA, 15 bp, Homo sapiens
ttgccctcccatccc

SEQ ID NO: 4701382 - DNA, 18 bp, Homo sapiens
ttgccctttccatattta

SEQ ID NO: 4701383 - DNA, 13 bp, Homo sapiens
ttgccgtctacct

SEQ ID NO: 4701384 - DNA, 14 bp, Homo sapiens
ttgcctaccatttc

SEQ ID NO: 4701385 - DNA, 18 bp, Homo sapiens
ttgcctcggctcctgctg

SEQ ID NO: 4701386 - DNA, 20 bp, Homo sapiens
ttgcctcggctcctgctgca

SEQ ID NO: 4701387 - DNA, 18 bp, Homo sapiens
ttgcctctgcctctgaca

SEQ ID NO: 4701388 - DNA, 19 bp, Homo sapiens
ttgcctctgtccccttctc

SEQ ID NO: 4701389 - DNA, 20 bp, Homo sapiens
ttgcctctgtccccttctct

SEQ ID NO: 4701390 - DNA, 14 bp, Homo sapiens
ttgccttcaactaa

SEQ ID NO: 4701391 - DNA, 14 bp, Homo sapiens
ttgcgagagatgtg

SEQ ID NO: 4701392 - DNA, 20 bp, Homo sapiens
ttgctactacttacctacca

SEQ ID NO: 4701393 - DNA, 16 bp, Homo sapiens
ttgctcatgccctgcc

SEQ ID NO: 4701394 - DNA, 15 bp, Homo sapiens
ttgctccagcctgac

SEQ ID NO: 4701395 - DNA, 17 bp, Homo sapiens
ttgctccagcctgacaa

SEQ ID NO: 4701396 - DNA, 16 bp, Homo sapiens
ttgctccattttcttg

SEQ ID NO: 4701397 - DNA, 18 bp, Homo sapiens
ttgctgaatgtcattatt

SEQ ID NO: 4701398 - DNA, 21 bp, Homo sapiens
ttgctgaatgtcattatttga

SEQ ID NO: 4701399 - DNA, 19 bp, Homo sapiens
ttgctgccccatcagtgct

SEQ ID NO: 4701400 - DNA, 20 bp, Homo sapiens
ttgctgccccatcagtgctc

SEQ ID NO: 4701401 - DNA, 14 bp, Homo sapiens
ttgctggctgtgaa

SEQ ID NO: 4701402 - DNA, 22 bp, Homo sapiens
ttgctttgaccatggaaagaaa

SEQ ID NO: 4701403 - DNA, 13 bp, Homo sapiens
ttggaaaagaaat

SEQ ID NO: 4701404 - DNA, 19 bp, Homo sapiens
ttggaaaagaaatcaattt

SEQ ID NO: 4701405 - DNA, 15 bp, Homo sapiens
ttggaaaataaatca

SEQ ID NO: 4701406 - DNA, 19 bp, Homo sapiens
ttggaagctccgctttcta

SEQ ID NO: 4701407 - DNA, 19 bp, Homo sapiens
ttggaatcttcacctcaga

SEQ ID NO: 4701408 - DNA, 17 bp, Homo sapiens
ttggacattttatgtct

SEQ ID NO: 4701409 - DNA, 15 bp, Homo sapiens
ttggaccctgaggcc

SEQ ID NO: 4701410 - DNA, 19 bp, Homo sapiens
ttggaccctgaggcccaga

SEQ ID NO: 4701411 - DNA, 13 bp, Homo sapiens
ttggacccttcca

SEQ ID NO: 4701412 - DNA, 15 bp, Homo sapiens
ttggactggatgcat

SEQ ID NO: 4701413 - DNA, 15 bp, Homo sapiens
ttggagaatatcaaa

SEQ ID NO: 4701414 - DNA, 22 bp, Homo sapiens
ttggagagctagaacctggaga

SEQ ID NO: 4701415 - DNA, 23 bp, Homo sapiens
ttggagatacgtaaagccttgtt

SEQ ID NO: 4701416 - DNA, 15 bp, Homo sapiens
ttggataatattcat

SEQ ID NO: 4701417 - DNA, 20 bp, Homo sapiens
ttggatatttgatatttggt

SEQ ID NO: 4701418 - DNA, 19 bp, Homo sapiens
ttggatattttttacttta

SEQ ID NO: 4701419 - DNA, 14 bp, Homo sapiens
ttggattgtccccg

SEQ ID NO: 4701420 - DNA, 15 bp, Homo sapiens
ttggattgtccccga

SEQ ID NO: 4701421 - DNA, 21 bp, Homo sapiens
ttggatttaaaagcctgctca

SEQ ID NO: 4701422 - DNA, 12 bp, Homo sapiens
ttggcagcaggt

SEQ ID NO: 4701423 - DNA, 18 bp, Homo sapiens
ttggcagcaggtgctgct

SEQ ID NO: 4701424 - DNA, 18 bp, Homo sapiens
ttggcccctgcccggctg

SEQ ID NO: 4701425 - DNA, 17 bp, Homo sapiens
ttggcgcaccctcccct

SEQ ID NO: 4701426 - DNA, 16 bp, Homo sapiens
ttggctatttaaaact

SEQ ID NO: 4701427 - DNA, 22 bp, Homo sapiens
ttggctgcaggcagcaaaaaca

SEQ ID NO: 4701428 - DNA, 14 bp, Homo sapiens
ttggctgcagggag

SEQ ID NO: 4701429 - DNA, 11 bp, Homo sapiens
ttggctgctga

SEQ ID NO: 4701430 - DNA, 15 bp, Homo sapiens
ttggctgctgaaggc

SEQ ID NO: 4701431 - DNA, 22 bp, Homo sapiens
ttggctgggggcctcagtgcca

SEQ ID NO: 4701432 - DNA, 19 bp, Homo sapiens
ttgggctggaacagattca

SEQ ID NO: 4701433 - DNA, 13 bp, Homo sapiens
ttgggctgtgcct

SEQ ID NO: 4701434 - DNA, 18 bp, Homo sapiens
ttggggaagggcctgccc

SEQ ID NO: 4701435 - DNA, 18 bp, Homo sapiens
ttgggggttaccaaaaat

SEQ ID NO: 4701436 - DNA, 17 bp, Homo sapiens
ttgggtcatttttaact

SEQ ID NO: 4701437 - DNA, 14 bp, Homo sapiens
ttggtaattaaaag

SEQ ID NO: 4701438 - DNA, 22 bp, Homo sapiens
ttggtcattcctaatgcattag

SEQ ID NO: 4701439 - DNA, 22 bp, Homo sapiens
ttggtcccccttccatggactt

SEQ ID NO: 4701440 - DNA, 13 bp, Homo sapiens
ttggtccctgggg

SEQ ID NO: 4701441 - DNA, 12 bp, Homo sapiens
ttggtcctgctg

SEQ ID NO: 4701442 - DNA, 13 bp, Homo sapiens
ttggtcctgctgc

SEQ ID NO: 4701443 - DNA, 18 bp, Homo sapiens
ttggtcttactttgtgca

SEQ ID NO: 4701444 - DNA, 20 bp, Homo sapiens
ttggtgcaattaactctgga

SEQ ID NO: 4701445 - DNA, 21 bp, Homo sapiens
ttggtgttttatctcctgtga

SEQ ID NO: 4701446 - DNA, 22 bp, Homo sapiens
ttggttaacaataaagtgacaa

SEQ ID NO: 4701447 - DNA, 14 bp, Homo sapiens
ttggttagaagtaa

SEQ ID NO: 4701448 - DNA, 16 bp, Homo sapiens
ttggtttcctatttcc

SEQ ID NO: 4701449 - DNA, 20 bp, Homo sapiens
ttggtttgttaattcttatt

SEQ ID NO: 4701450 - DNA, 15 bp, Homo sapiens
ttgtaaaaaaaaatg

SEQ ID NO: 4701451 - DNA, 16 bp, Homo sapiens
ttgtaaaaaaaaatgc

SEQ ID NO: 4701452 - DNA, 17 bp, Homo sapiens
ttgtaaaaaaaaatgcc

SEQ ID NO: 4701453 - DNA, 19 bp, Homo sapiens
ttgtaaaaaaaaatgcctt

SEQ ID NO: 4701454 - DNA, 23 bp, Homo sapiens
ttgtaaaaaaaaatgcctttgag

SEQ ID NO: 4701455 - DNA, 17 bp, Homo sapiens
ttgtaaaattatttcat

SEQ ID NO: 4701456 - DNA, 14 bp, Homo sapiens
ttgtaaatactgga

SEQ ID NO: 4701457 - DNA, 17 bp, Homo sapiens
ttgtaaatctgaagaaa

SEQ ID NO: 4701458 - DNA, 16 bp, Homo sapiens
ttgtaaattaatcttt

SEQ ID NO: 4701459 - DNA, 14 bp, Homo sapiens
ttgtaaatttctct

SEQ ID NO: 4701460 - DNA, 18 bp, Homo sapiens
ttgtaagtttcaggtgac

SEQ ID NO: 4701461 - DNA, 15 bp, Homo sapiens
ttgtaatatttcttc

SEQ ID NO: 4701462 - DNA, 18 bp, Homo sapiens
ttgtaatcctagcacttt

SEQ ID NO: 4701463 - DNA, 18 bp, Homo sapiens
ttgtaattattgtgattt

SEQ ID NO: 4701464 - DNA, 16 bp, Homo sapiens
ttgtacagtttttatt

SEQ ID NO: 4701465 - DNA, 17 bp, Homo sapiens
ttgtaccacagtttctt

SEQ ID NO: 4701466 - DNA, 21 bp, Homo sapiens
ttgtaccacagtttcttctgt

SEQ ID NO: 4701467 - DNA, 20 bp, Homo sapiens
ttgtaccatggttgtgcaca

SEQ ID NO: 4701468 - DNA, 14 bp, Homo sapiens
ttgtagcctctctt

SEQ ID NO: 4701469 - DNA, 19 bp, Homo sapiens
ttgtagtgccactgttgtt

SEQ ID NO: 4701470 - DNA, 20 bp, Homo sapiens
ttgtatagcatgaaataaaa

SEQ ID NO: 4701471 - DNA, 19 bp, Homo sapiens
ttgtatgttagaataattt

SEQ ID NO: 4701472 - DNA, 16 bp, Homo sapiens
ttgtattctctgagct

SEQ ID NO: 4701473 - DNA, 22 bp, Homo sapiens
ttgtattctctgagctgtgcag

SEQ ID NO: 4701474 - DNA, 19 bp, Homo sapiens
ttgtcaaaattaatatgat

SEQ ID NO: 4701475 - DNA, 11 bp, Homo sapiens
ttgtcaatact

SEQ ID NO: 4701476 - DNA, 18 bp, Homo sapiens
ttgtcaatggaagaaacc

SEQ ID NO: 4701477 - DNA, 14 bp, Homo sapiens
ttgtcacagctctt

SEQ ID NO: 4701478 - DNA, 22 bp, Homo sapiens
ttgtcacatgaaacatttgcaa

SEQ ID NO: 4701479 - DNA, 12 bp, Homo sapiens
ttgtcatgtgta

SEQ ID NO: 4701480 - DNA, 20 bp, Homo sapiens
ttgtccattgtaaatctgaa

SEQ ID NO: 4701481 - DNA, 17 bp, Homo sapiens
ttgtccccacactccta

SEQ ID NO: 4701482 - DNA, 18 bp, Homo sapiens
ttgtccccaccgcagaca

SEQ ID NO: 4701483 - DNA, 15 bp, Homo sapiens
ttgtccccgaccctt

SEQ ID NO: 4701484 - DNA, 17 bp, Homo sapiens
ttgtcctttaactatca

SEQ ID NO: 4701485 - DNA, 20 bp, Homo sapiens
tttcttcaagtgagtggcat

SEQ ID NO: 4701486 - DNA, 23 bp, Homo sapiens
tttcttcaagtgagtggcatgtg

SEQ ID NO: 4701487 - DNA, 17 bp, Homo sapiens
tttcttgttattaccaa

SEQ ID NO: 4701488 - DNA, 12 bp, Homo sapiens
tttctttctagt

SEQ ID NO: 4701489 - DNA, 11 bp, Homo sapiens
tttctttgaaa

SEQ ID NO: 4701490 - DNA, 13 bp, Homo sapiens
tttctttgctgct

SEQ ID NO: 4701491 - DNA, 14 bp, Homo sapiens
tttcttttgctgat

SEQ ID NO: 4701492 - DNA, 17 bp, Homo sapiens
tttcttttggtccaggg

SEQ ID NO: 4701493 - DNA, 13 bp, Homo sapiens
tttgaaaagctat

SEQ ID NO: 4701494 - DNA, 14 bp, Homo sapiens
tttgaaaagctatt

SEQ ID NO: 4701495 - DNA, 15 bp, Homo sapiens
tttgaaaagctatta

SEQ ID NO: 4701496 - DNA, 18 bp, Homo sapiens
tttgaaaagctattagcc

SEQ ID NO: 4701497 - DNA, 18 bp, Homo sapiens
tttgaaaatagttattca

SEQ ID NO: 4701498 - DNA, 19 bp, Homo sapiens
tttgaagaacaaaaggctt

SEQ ID NO: 4701499 - DNA, 16 bp, Homo sapiens
tttgaagattctatgt

SEQ ID NO: 4701500 - DNA, 12 bp, Homo sapiens
tttgaagtatta

SEQ ID NO: 4701501 - DNA, 22 bp, Homo sapiens
tttgaagtcataccaatgaaaa

SEQ ID NO: 4701502 - DNA, 18 bp, Homo sapiens
tttgaatataaacactat

SEQ ID NO: 4701503 - DNA, 19 bp, Homo sapiens
tttgaatataaacactata

SEQ ID NO: 4701504 - DNA, 16 bp, Homo sapiens
tttgaccaggaaagca

SEQ ID NO: 4701505 - DNA, 16 bp, Homo sapiens
tttgacgaagaaacaa

SEQ ID NO: 4701506 - DNA, 19 bp, Homo sapiens
tttgacgaagaaacaaaaa

SEQ ID NO: 4701507 - DNA, 13 bp, Homo sapiens
tttgacgccatcc

SEQ ID NO: 4701508 - DNA, 19 bp, Homo sapiens
tttgacgccatcccagccc

SEQ ID NO: 4701509 - DNA, 21 bp, Homo sapiens
tttgagaaacaacaatttcta

SEQ ID NO: 4701510 - DNA, 15 bp, Homo sapiens
tttgagacagtttct

SEQ ID NO: 4701511 - DNA, 20 bp, Homo sapiens
tttgagacagtttcttagct

SEQ ID NO: 4701512 - DNA, 22 bp, Homo sapiens
tttgagcaaagaaacttgtgct

SEQ ID NO: 4701513 - DNA, 14 bp, Homo sapiens
tttgagctcagccc

SEQ ID NO: 4701514 - DNA, 14 bp, Homo sapiens
tttgagtgctctga

SEQ ID NO: 4701515 - DNA, 12 bp, Homo sapiens
tttgataacatt

SEQ ID NO: 4701516 - DNA, 12 bp, Homo sapiens
tttgataatgtt

SEQ ID NO: 4701517 - DNA, 14 bp, Homo sapiens
tttgataatgttaa

SEQ ID NO: 4701518 - DNA, 18 bp, Homo sapiens
tttgatagtattgtgcat

SEQ ID NO: 4701519 - DNA, 13 bp, Homo sapiens
tttgatatttgca

SEQ ID NO: 4701520 - DNA, 14 bp, Homo sapiens
tttgatccaagctg

SEQ ID NO: 4701521 - DNA, 18 bp, Homo sapiens
tttgatgaggccctccac

SEQ ID NO: 4701522 - DNA, 17 bp, Homo sapiens
tttgattatttaagact

SEQ ID NO: 4701523 - DNA, 21 bp, Homo sapiens
tttgattcagacagctgcctg

SEQ ID NO: 4701524 - DNA, 22 bp, Homo sapiens
tttgattcagacagctgcctgg

SEQ ID NO: 4701525 - DNA, 14 bp, Homo sapiens
tttgcaacctcgct

SEQ ID NO: 4701526 - DNA, 18 bp, Homo sapiens
tttgcactgaggatattc

SEQ ID NO: 4701527 - DNA, 14 bp, Homo sapiens
tttgcagacaggca

SEQ ID NO: 4701528 - DNA, 16 bp, Homo sapiens
tttgcataacaattcc

SEQ ID NO: 4701529 - DNA, 18 bp, Homo sapiens
tttgcataacaattcctc

SEQ ID NO: 4701530 - DNA, 21 bp, Homo sapiens
tttgcatatatgttcttcata

SEQ ID NO: 4701531 - DNA, 18 bp, Homo sapiens
tttgcattaatctaagaa

SEQ ID NO: 4701532 - DNA, 18 bp, Homo sapiens
tttgccaccctcatgctg

SEQ ID NO: 4701533 - DNA, 19 bp, Homo sapiens
tttgccaccctcatgctgt

SEQ ID NO: 4701534 - DNA, 15 bp, Homo sapiens
tttgccagtgggaac

SEQ ID NO: 4701535 - DNA, 16 bp, Homo sapiens
tttgccagtgggaact

SEQ ID NO: 4701536 - DNA, 20 bp, Homo sapiens
tttgccatgggcttcactgt

SEQ ID NO: 4701537 - DNA, 22 bp, Homo sapiens
tttgccatgttggccaggctgg

SEQ ID NO: 4701538 - DNA, 15 bp, Homo sapiens
tttgcgcaaacttta

SEQ ID NO: 4701539 - DNA, 21 bp, Homo sapiens
tttgctgaatgtcattatttg

SEQ ID NO: 4701540 - DNA, 13 bp, Homo sapiens
tttgctgatcttt

SEQ ID NO: 4701541 - DNA, 17 bp, Homo sapiens
tttgctgatctttgtct

SEQ ID NO: 4701542 - DNA, 20 bp, Homo sapiens
tttggagatgtctctgtgtg

SEQ ID NO: 4701543 - DNA, 20 bp, Homo sapiens
tttggagtcagacagatgtg

SEQ ID NO: 4701544 - DNA, 18 bp, Homo sapiens
tttggcctcattacttta

SEQ ID NO: 4701545 - DNA, 13 bp, Homo sapiens
tttggctgctgaa

SEQ ID NO: 4701546 - DNA, 12 bp, Homo sapiens
tttgggaagggg

SEQ ID NO: 4701547 - DNA, 18 bp, Homo sapiens
tttgggtcatttttaact

SEQ ID NO: 4701548 - DNA, 22 bp, Homo sapiens
tttgggttaatatggctcttca

SEQ ID NO: 4701549 - DNA, 18 bp, Homo sapiens
tttggtttatattcttat

SEQ ID NO: 4701550 - DNA, 14 bp, Homo sapiens
tttggttttgttcc

SEQ ID NO: 4701551 - DNA, 23 bp, Homo sapiens
tttgtaactgtttagatgaatgt

SEQ ID NO: 4701552 - DNA, 12 bp, Homo sapiens
tttgtaagagtg

SEQ ID NO: 4701553 - DNA, 23 bp, Homo sapiens
tttgtaagagtgtagaagcattc

SEQ ID NO: 4701554 - DNA, 14 bp, Homo sapiens
tttgtaagtttcag

SEQ ID NO: 4701555 - DNA, 14 bp, Homo sapiens
tttgtataaaagtg

SEQ ID NO: 4701556 - DNA, 16 bp, Homo sapiens
tttgtatgctaaatga

SEQ ID NO: 4701557 - DNA, 16 bp, Homo sapiens
tttgtattctctgagc

SEQ ID NO: 4701558 - DNA, 13 bp, Homo sapiens
tttgtccccaccg

SEQ ID NO: 4701559 - DNA, 21 bp, Homo sapiens
tttgtccccaccgcagacagg

SEQ ID NO: 4701560 - DNA, 16 bp, Homo sapiens
tttgtcgaatttttat

SEQ ID NO: 4701561 - DNA, 19 bp, Homo sapiens
tttgtctttggtgaacatt

SEQ ID NO: 4701562 - DNA, 12 bp, Homo sapiens
tttgtgaagaat

SEQ ID NO: 4701563 - DNA, 19 bp, Homo sapiens
tttgtgaatggattggatt

SEQ ID NO: 4701564 - DNA, 12 bp, Homo sapiens
tttgtgaatttg

SEQ ID NO: 4701565 - DNA, 13 bp, Homo sapiens
tttgtgaatttgc

SEQ ID NO: 4701566 - DNA, 19 bp, Homo sapiens
tttgtgaggaagccgctgg

SEQ ID NO: 4701567 - DNA, 22 bp, Homo sapiens
tttgtgatgaataaaataatta

SEQ ID NO: 4701568 - DNA, 22 bp, Homo sapiens
tttgttactgtctgtagtgttt

SEQ ID NO: 4701569 - DNA, 16 bp, Homo sapiens
tttgttattttgcaac

SEQ ID NO: 4701570 - DNA, 16 bp, Homo sapiens
tttgttcccctcctcc

SEQ ID NO: 4701571 - DNA, 21 bp, Homo sapiens
tttgttctggctcttccaggc

SEQ ID NO: 4701572 - DNA, 14 bp, Homo sapiens
tttgttgtcatgtg

SEQ ID NO: 4701573 - DNA, 15 bp, Homo sapiens
tttgttgtcatgtgt

SEQ ID NO: 4701574 - DNA, 13 bp, Homo sapiens
tttgtttatgtta

SEQ ID NO: 4701575 - DNA, 21 bp, Homo sapiens
tttgtttatgttacttaaaca

SEQ ID NO: 4701576 - DNA, 22 bp, Homo sapiens
tttgtttcaatctctgactaaa

SEQ ID NO: 4701577 - DNA, 14 bp, Homo sapiens
tttgtttctgaaag

SEQ ID NO: 4701578 - DNA, 14 bp, Homo sapiens
tttgtttgtttgca

SEQ ID NO: 4701579 - DNA, 12 bp, Homo sapiens
tttgttttgcac

SEQ ID NO: 4701580 - DNA, 22 bp, Homo sapiens
ttttaaaaaatctgttgttcca

SEQ ID NO: 4701581 - DNA, 15 bp, Homo sapiens
ttttaaagaaaagtt

SEQ ID NO: 4701582 - DNA, 20 bp, Homo sapiens
ttttaaagagtgaaaaatga

SEQ ID NO: 4701583 - DNA, 16 bp, Homo sapiens
ttttaaaggacaaaca

SEQ ID NO: 4701584 - DNA, 12 bp, Homo sapiens
ttttaaagtaat

SEQ ID NO: 4701585 - DNA, 13 bp, Homo sapiens
ttttaaatttcag

SEQ ID NO: 4701586 - DNA, 15 bp, Homo sapiens
ttttaagaggcaggg

SEQ ID NO: 4701587 - DNA, 21 bp, Homo sapiens
ttttaagttacacatttttca

SEQ ID NO: 4701588 - DNA, 15 bp, Homo sapiens
ttttaagttcacttt

SEQ ID NO: 4701589 - DNA, 19 bp, Homo sapiens
ttttaataggatttttaga

SEQ ID NO: 4701590 - DNA, 23 bp, Homo sapiens
ttttaatcctgtaccaaatctga

SEQ ID NO: 4701591 - DNA, 14 bp, Homo sapiens
ttttaccattagca

SEQ ID NO: 4701592 - DNA, 18 bp, Homo sapiens
ttttagactcaaagaata

SEQ ID NO: 4701593 - DNA, 12 bp, Homo sapiens
ttttagatgtta

SEQ ID NO: 4701594 - DNA, 18 bp, Homo sapiens
ttttaggtctcttcccct

SEQ ID NO: 4701595 - DNA, 19 bp, Homo sapiens
ttttataaacctctaattt

SEQ ID NO: 4701596 - DNA, 15 bp, Homo sapiens
cacgtgtgtttttct

SEQ ID NO: 4701597 - DNA, 20 bp, Homo sapiens
cacgtgtgtttttctattaa

SEQ ID NO: 4701598 - DNA, 19 bp, Homo sapiens
cactaaaacacacaggtgc

SEQ ID NO: 4701599 - DNA, 14 bp, Homo sapiens
cactaacagagtgg

SEQ ID NO: 4701600 - DNA, 18 bp, Homo sapiens
cactaaccacgctggacc

SEQ ID NO: 4701601 - DNA, 20 bp, Homo sapiens
cactaactagagcagccctg

SEQ ID NO: 4701602 - DNA, 17 bp, Homo sapiens
cactaaggtgtgctctg

SEQ ID NO: 4701603 - DNA, 18 bp, Homo sapiens
cactaaggtgtgctctga

SEQ ID NO: 4701604 - DNA, 15 bp, Homo sapiens
cactaatacaccagg

SEQ ID NO: 4701605 - DNA, 18 bp, Homo sapiens
cactactacatctgtgat

SEQ ID NO: 4701606 - DNA, 16 bp, Homo sapiens
cactagaggccaggga

SEQ ID NO: 4701607 - DNA, 13 bp, Homo sapiens
cactatggtgcca

SEQ ID NO: 4701608 - DNA, 19 bp, Homo sapiens
cactatgttgcccaggcag

SEQ ID NO: 4701609 - DNA, 17 bp, Homo sapiens
cactcaagaagcaggct

SEQ ID NO: 4701610 - DNA, 15 bp, Homo sapiens
cactcagccgtgggc

SEQ ID NO: 4701611 - DNA, 22 bp, Homo sapiens
cactcattgacctgaggccctt

SEQ ID NO: 4701612 - DNA, 14 bp, Homo sapiens
cactcatttccaat

SEQ ID NO: 4701613 - DNA, 15 bp, Homo sapiens
cactccagcctgggt

SEQ ID NO: 4701614 - DNA, 13 bp, Homo sapiens
cactcccacttcc

SEQ ID NO: 4701615 - DNA, 15 bp, Homo sapiens
cactcccacttccct

SEQ ID NO: 4701616 - DNA, 14 bp, Homo sapiens
cactcccaggcagc

SEQ ID NO: 4701617 - DNA, 13 bp, Homo sapiens
cactccctgcaac

SEQ ID NO: 4701618 - DNA, 13 bp, Homo sapiens
cactcccttgggc

SEQ ID NO: 4701619 - DNA, 21 bp, Homo sapiens
cactcctctgactcagggctc

SEQ ID NO: 4701620 - DNA, 23 bp, Homo sapiens
cactcctctgactcagggctcct

SEQ ID NO: 4701621 - DNA, 16 bp, Homo sapiens
cactctcccccacccc

SEQ ID NO: 4701622 - DNA, 18 bp, Homo sapiens
cactctcccccaccccct

SEQ ID NO: 4701623 - DNA, 16 bp, Homo sapiens
cactctgcttgttatt

SEQ ID NO: 4701624 - DNA, 16 bp, Homo sapiens
cactctggcagctcag

SEQ ID NO: 4701625 - DNA, 23 bp, Homo sapiens
cactctggcagctcagagagggt

SEQ ID NO: 4701626 - DNA, 20 bp, Homo sapiens
cactctgtcgcccagtctgg

SEQ ID NO: 4701627 - DNA, 19 bp, Homo sapiens
cactcttattgcccacgct

SEQ ID NO: 4701628 - DNA, 20 bp, Homo sapiens
cactgaactttgctgagcct

SEQ ID NO: 4701629 - DNA, 23 bp, Homo sapiens
cactgacattgttggccaaagcc

SEQ ID NO: 4701630 - DNA, 18 bp, Homo sapiens
cactgagaatgtaagaac

SEQ ID NO: 4701631 - DNA, 23 bp, Homo sapiens
cactgagacagcccgggctctgc

SEQ ID NO: 4701632 - DNA, 18 bp, Homo sapiens
cactgagataccagcgag

SEQ ID NO: 4701633 - DNA, 21 bp, Homo sapiens
cactgagccatcatttcctgg

SEQ ID NO: 4701634 - DNA, 17 bp, Homo sapiens
cactgaggaagaacggg

SEQ ID NO: 4701635 - DNA, 14 bp, Homo sapiens
cactgagggcagtc

SEQ ID NO: 4701636 - DNA, 15 bp, Homo sapiens
cactgattttgtaaa

SEQ ID NO: 4701637 - DNA, 16 bp, Homo sapiens
cactgattttgtaaag

SEQ ID NO: 4701638 - DNA, 14 bp, Homo sapiens
cactgcaacctccg

SEQ ID NO: 4701639 - DNA, 17 bp, Homo sapiens
cactgcaacttgtgaac

SEQ ID NO: 4701640 - DNA, 21 bp, Homo sapiens
cactgcaacttgtgaactcca

SEQ ID NO: 4701641 - DNA, 14 bp, Homo sapiens
cactgcaccccctc

SEQ ID NO: 4701642 - DNA, 18 bp, Homo sapiens
cactgcactatagcctag

SEQ ID NO: 4701643 - DNA, 14 bp, Homo sapiens
cactgcagcctcaa

SEQ ID NO: 4701644 - DNA, 22 bp, Homo sapiens
cactgcagcctcaacctcctgg

SEQ ID NO: 4701645 - DNA, 20 bp, Homo sapiens
cactgcaggcatcacagcta

SEQ ID NO: 4701646 - DNA, 14 bp, Homo sapiens
cactgcatcctccg

SEQ ID NO: 4701647 - DNA, 18 bp, Homo sapiens
cactgcatcctccgcctc

SEQ ID NO: 4701648 - DNA, 20 bp, Homo sapiens
cactgcatgttcctggacac

SEQ ID NO: 4701649 - DNA, 12 bp, Homo sapiens
cactgcctttga

SEQ ID NO: 4701650 - DNA, 13 bp, Homo sapiens
cactgctgggtgg

SEQ ID NO: 4701651 - DNA, 14 bp, Homo sapiens
cactgcttccagtg

SEQ ID NO: 4701652 - DNA, 15 bp, Homo sapiens
cactgcttccagtga

SEQ ID NO: 4701653 - DNA, 19 bp, Homo sapiens
cactgcttccagtgaggct

SEQ ID NO: 4701654 - DNA, 22 bp, Homo sapiens
cactgcttccagtgaggctctg

SEQ ID NO: 4701655 - DNA, 17 bp, Homo sapiens
cacaggacatttctcta

SEQ ID NO: 4701656 - DNA, 15 bp, Homo sapiens
cacaggatcagtctg

SEQ ID NO: 4701657 - DNA, 16 bp, Homo sapiens
cacaggatgaaggcaa

SEQ ID NO: 4701658 - DNA, 15 bp, Homo sapiens
cacaggcaggtccag

SEQ ID NO: 4701659 - DNA, 16 bp, Homo sapiens
cacaggcccggctcca

SEQ ID NO: 4701660 - DNA, 18 bp, Homo sapiens
cacaggcccggctccagg

SEQ ID NO: 4701661 - DNA, 22 bp, Homo sapiens
cacagggtttggcccaagtttc

SEQ ID NO: 4701662 - DNA, 19 bp, Homo sapiens
cacaggtgcaacagacttg

SEQ ID NO: 4701663 - DNA, 19 bp, Homo sapiens
cacagtaatgcaagcaaag

SEQ ID NO: 4701664 - DNA, 19 bp, Homo sapiens
cacagtcaaatttacattt

SEQ ID NO: 4701665 - DNA, 18 bp, Homo sapiens
cacagtgactcgggctcc

SEQ ID NO: 4701666 - DNA, 21 bp, Homo sapiens
cacagtgagtcgaggacaggg

SEQ ID NO: 4701667 - DNA, 13 bp, Homo sapiens
cacagtggaacca

SEQ ID NO: 4701668 - DNA, 13 bp, Homo sapiens
cacagtgtctggg

SEQ ID NO: 4701669 - DNA, 17 bp, Homo sapiens
cacagtgttatgctctg

SEQ ID NO: 4701670 - DNA, 17 bp, Homo sapiens
cacagttccttgcatgt

SEQ ID NO: 4701671 - DNA, 19 bp, Homo sapiens
cacagtttcttccattccc

SEQ ID NO: 4701672 - DNA, 14 bp, Homo sapiens
cacagtttcttctg

SEQ ID NO: 4701673 - DNA, 13 bp, Homo sapiens
cacatacacacac

SEQ ID NO: 4701674 - DNA, 17 bp, Homo sapiens
cacatacacacacacgc

SEQ ID NO: 4701675 - DNA, 22 bp, Homo sapiens
cacatagttctgcccaaattat

SEQ ID NO: 4701676 - DNA, 23 bp, Homo sapiens
cacatattaagaatagtctctgg

SEQ ID NO: 4701677 - DNA, 17 bp, Homo sapiens
cacatctaacctcatct

SEQ ID NO: 4701678 - DNA, 18 bp, Homo sapiens
cacatctgaatctccttg

SEQ ID NO: 4701679 - DNA, 19 bp, Homo sapiens
cacatctgaatctccttgt

SEQ ID NO: 4701680 - DNA, 22 bp, Homo sapiens
cacatctgaatctccttgttgt

SEQ ID NO: 4701681 - DNA, 18 bp, Homo sapiens
cacatctgtgtcttgttt

SEQ ID NO: 4701682 - DNA, 13 bp, Homo sapiens
cacatctttactc

SEQ ID NO: 4701683 - DNA, 19 bp, Homo sapiens
cacatgagcatcaggccag

SEQ ID NO: 4701684 - DNA, 15 bp, Homo sapiens
cacatgccactatga

SEQ ID NO: 4701685 - DNA, 18 bp, Homo sapiens
cacatgcttttcttccta

SEQ ID NO: 4701686 - DNA, 11 bp, Homo sapiens
cacatggcaga

SEQ ID NO: 4701687 - DNA, 14 bp, Homo sapiens
cacatggcgtcctg

SEQ ID NO: 4701688 - DNA, 22 bp, Homo sapiens
cacatgtccaagaagcccagga

SEQ ID NO: 4701689 - DNA, 19 bp, Homo sapiens
cacattccttgcctgcaca

SEQ ID NO: 4701690 - DNA, 14 bp, Homo sapiens
cacattgccccatg

SEQ ID NO: 4701691 - DNA, 19 bp, Homo sapiens
cacatttaagagacagtca

SEQ ID NO: 4701692 - DNA, 15 bp, Homo sapiens
cacatttacactaga

SEQ ID NO: 4701693 - DNA, 14 bp, Homo sapiens
cacattttgacaca

SEQ ID NO: 4701694 - DNA, 20 bp, Homo sapiens
cacattttgacacaatgttg

SEQ ID NO: 4701695 - DNA, 22 bp, Homo sapiens
cacattttgacacaatgttgca

SEQ ID NO: 4701696 - DNA, 14 bp, Homo sapiens
caccaaaatgaacc

SEQ ID NO: 4701697 - DNA, 21 bp, Homo sapiens
caccaacatactcccatctgt

SEQ ID NO: 4701698 - DNA, 14 bp, Homo sapiens
caccaacccagccg

SEQ ID NO: 4701699 - DNA, 20 bp, Homo sapiens
caccaacccagccgctgccc

SEQ ID NO: 4701700 - DNA, 21 bp, Homo sapiens
caccaagcaggaaatgaaaat

SEQ ID NO: 4701701 - DNA, 15 bp, Homo sapiens
caccaagcccagtta

SEQ ID NO: 4701702 - DNA, 15 bp, Homo sapiens
caccaataaatgttt

SEQ ID NO: 4701703 - DNA, 15 bp, Homo sapiens
tcttctcatttcacc

SEQ ID NO: 4701704 - DNA, 18 bp, Homo sapiens
tcttctcatttcacccct

SEQ ID NO: 4701705 - DNA, 22 bp, Homo sapiens
tcttctcatttcacccctccct

SEQ ID NO: 4701706 - DNA, 12 bp, Homo sapiens
tcttctccaggc

SEQ ID NO: 4701707 - DNA, 13 bp, Homo sapiens
tcttctccaggct

SEQ ID NO: 4701708 - DNA, 14 bp, Homo sapiens
tcttctccaggctg

SEQ ID NO: 4701709 - DNA, 12 bp, Homo sapiens
tcttctcctgtg

SEQ ID NO: 4701710 - DNA, 15 bp, Homo sapiens
tcttctcttttccca

SEQ ID NO: 4701711 - DNA, 14 bp, Homo sapiens
tcttcttcaccatt

SEQ ID NO: 4701712 - DNA, 21 bp, Homo sapiens
tcttgaatttaataatctgta

SEQ ID NO: 4701713 - DNA, 20 bp, Homo sapiens
tcttgacctgaactctgcaa

SEQ ID NO: 4701714 - DNA, 16 bp, Homo sapiens
tcttgactacagtcag

SEQ ID NO: 4701715 - DNA, 14 bp, Homo sapiens
tcttgataagacca

SEQ ID NO: 4701716 - DNA, 20 bp, Homo sapiens
tcttgatcaacatcttttct

SEQ ID NO: 4701717 - DNA, 16 bp, Homo sapiens
tcttgcaagcaacaag

SEQ ID NO: 4701718 - DNA, 17 bp, Homo sapiens
tcttgcaatggcagcct

SEQ ID NO: 4701719 - DNA, 19 bp, Homo sapiens
tcttgcaatggcagccttg

SEQ ID NO: 4701720 - DNA, 15 bp, Homo sapiens
tcttgcatgaggcta

SEQ ID NO: 4701721 - DNA, 19 bp, Homo sapiens
tcttgccaaatataaataa

SEQ ID NO: 4701722 - DNA, 21 bp, Homo sapiens
tcttgcctctgtccccttctc

SEQ ID NO: 4701723 - DNA, 22 bp, Homo sapiens
tcttgcctctgtccccttctct

SEQ ID NO: 4701724 - DNA, 11 bp, Homo sapiens
tcttgctctgc

SEQ ID NO: 4701725 - DNA, 12 bp, Homo sapiens
tcttgctctgct

SEQ ID NO: 4701726 - DNA, 22 bp, Homo sapiens
tcttggatggtgacattgaaac

SEQ ID NO: 4701727 - DNA, 19 bp, Homo sapiens
tcttggtactgttgctttg

SEQ ID NO: 4701728 - DNA, 14 bp, Homo sapiens
tcttggtcctgctg

SEQ ID NO: 4701729 - DNA, 19 bp, Homo sapiens
tcttggtcctgctgcagtt

SEQ ID NO: 4701730 - DNA, 15 bp, Homo sapiens
tcttggttgaggaaa

SEQ ID NO: 4701731 - DNA, 18 bp, Homo sapiens
tcttgtattaagttgtta

SEQ ID NO: 4701732 - DNA, 15 bp, Homo sapiens
tcttgtgtatggata

SEQ ID NO: 4701733 - DNA, 20 bp, Homo sapiens
tcttgttattaccaaaacag

SEQ ID NO: 4701734 - DNA, 22 bp, Homo sapiens
tcttgtttggagggatcatttt

SEQ ID NO: 4701735 - DNA, 17 bp, Homo sapiens
tctttaaatgatgtaca

SEQ ID NO: 4701736 - DNA, 15 bp, Homo sapiens
tctttaaccctcact

SEQ ID NO: 4701737 - DNA, 21 bp, Homo sapiens
tctttaagttttatttaactt

SEQ ID NO: 4701738 - DNA, 13 bp, Homo sapiens
tctttaatctgtt

SEQ ID NO: 4701739 - DNA, 15 bp, Homo sapiens
tctttaatctgttgt

SEQ ID NO: 4701740 - DNA, 17 bp, Homo sapiens
tctttaatgattcctat

SEQ ID NO: 4701741 - DNA, 20 bp, Homo sapiens
tctttaatgattcctataaa

SEQ ID NO: 4701742 - DNA, 15 bp, Homo sapiens
tctttaatgtcacag

SEQ ID NO: 4701743 - DNA, 19 bp, Homo sapiens
tctttaatgtcacaggcag

SEQ ID NO: 4701744 - DNA, 20 bp, Homo sapiens
tctttaatgtcacaggcagg

SEQ ID NO: 4701745 - DNA, 16 bp, Homo sapiens
tctttatgatttttaa

SEQ ID NO: 4701746 - DNA, 21 bp, Homo sapiens
tctttattcaccttttcttca

SEQ ID NO: 4701747 - DNA, 20 bp, Homo sapiens
tctttcaaaaccttttgaaa

SEQ ID NO: 4701748 - DNA, 21 bp, Homo sapiens
tctttcaaaaccttttgaaat

SEQ ID NO: 4701749 - DNA, 23 bp, Homo sapiens
tctttcaaaaccttttgaaatta

SEQ ID NO: 4701750 - DNA, 19 bp, Homo sapiens
tctttccacggagccactc

SEQ ID NO: 4701751 - DNA, 23 bp, Homo sapiens
tctttccacggagccactcctct

SEQ ID NO: 4701752 - DNA, 20 bp, Homo sapiens
tctttccattggatctcatt

SEQ ID NO: 4701753 - DNA, 12 bp, Homo sapiens
tctttcctgagg

SEQ ID NO: 4701754 - DNA, 13 bp, Homo sapiens
tctttcctgaggc

SEQ ID NO: 4701755 - DNA, 16 bp, Homo sapiens
tctttcctgaggctgg

SEQ ID NO: 4701756 - DNA, 14 bp, Homo sapiens
tctttctacagtat

SEQ ID NO: 4701757 - DNA, 16 bp, Homo sapiens
tctttctagtggtctt

SEQ ID NO: 4701758 - DNA, 17 bp, Homo sapiens
tctttctattttcacaa

SEQ ID NO: 4701759 - DNA, 20 bp, Homo sapiens
tctttcttacaaggaaggtg

SEQ ID NO: 4701760 - DNA, 15 bp, Homo sapiens
tctttctttgctgct

SEQ ID NO: 4701761 - DNA, 17 bp, Homo sapiens
tctttgataatgttaaa

SEQ ID NO: 4701762 - DNA, 15 bp, Homo sapiens
tctttgattctcctt

SEQ ID NO: 4701763 - DNA, 16 bp, Homo sapiens
tctttgattctccttc

SEQ ID NO: 4701764 - DNA, 17 bp, Homo sapiens
tctttgcagacaggcaa

SEQ ID NO: 4701765 - DNA, 21 bp, Homo sapiens
tctttggacagaagcagctct

SEQ ID NO: 4701766 - DNA, 21 bp, Homo sapiens
tctttgggtgggggggagaag

SEQ ID NO: 4701767 - DNA, 14 bp, Homo sapiens
tctttggtctacac

SEQ ID NO: 4701768 - DNA, 21 bp, Homo sapiens
tctttggtctacactgtgctg

SEQ ID NO: 4701769 - DNA, 20 bp, Homo sapiens
tcttttacatacagtgatat

SEQ ID NO: 4701770 - DNA, 12 bp, Homo sapiens
tcttttcacaaa

SEQ ID NO: 4701771 - DNA, 13 bp, Homo sapiens
tcttttctcttct

SEQ ID NO: 4701772 - DNA, 20 bp, Homo sapiens
tcttttcttgcctctgtccc

SEQ ID NO: 4701773 - DNA, 11 bp, Homo sapiens
tcttttgacct

SEQ ID NO: 4701774 - DNA, 16 bp, Homo sapiens
tcttttgttcttgata

SEQ ID NO: 4701775 - DNA, 20 bp, Homo sapiens
tctttttaaaaattgttatt

SEQ ID NO: 4701776 - DNA, 19 bp, Homo sapiens
tcttttttttttctgttga

SEQ ID NO: 4701777 - DNA, 16 bp, Homo sapiens
tgaaaaaaattattca

SEQ ID NO: 4701778 - DNA, 18 bp, Homo sapiens
tgaaaaaaattattcatg

SEQ ID NO: 4701779 - DNA, 23 bp, Homo sapiens
tgaaaaaaattattcatgctctc

SEQ ID NO: 4701780 - DNA, 21 bp, Homo sapiens
tgaaaaaagaagtttgggcta

SEQ ID NO: 4701781 - DNA, 16 bp, Homo sapiens
tgaaaacattgatgaa

SEQ ID NO: 4701782 - DNA, 17 bp, Homo sapiens
tgaaaacattgatgaat

SEQ ID NO: 4701783 - DNA, 20 bp, Homo sapiens
tgaaaacattgatgaatgag

SEQ ID NO: 4701784 - DNA, 20 bp, Homo sapiens
tgaaaagctccatttttagt

SEQ ID NO: 4701785 - DNA, 20 bp, Homo sapiens
tgaaaagggtgttgggaggg

SEQ ID NO: 4701786 - DNA, 21 bp, Homo sapiens
tgaaaagtatattgataacct

SEQ ID NO: 4701787 - DNA, 15 bp, Homo sapiens
tgaaaataaagaatg

SEQ ID NO: 4701788 - DNA, 16 bp, Homo sapiens
tgaaaataaagaatgg

SEQ ID NO: 4701789 - DNA, 14 bp, Homo sapiens
tgaaaatacatttc

SEQ ID NO: 4701790 - DNA, 16 bp, Homo sapiens
tgaaaatataaccagc

SEQ ID NO: 4701791 - DNA, 15 bp, Homo sapiens
tgaaaatatctcttg

SEQ ID NO: 4701792 - DNA, 17 bp, Homo sapiens
tgaaaatcctgaataaa

SEQ ID NO: 4701793 - DNA, 16 bp, Homo sapiens
tctccaccctgctctc

SEQ ID NO: 4701794 - DNA, 23 bp, Homo sapiens
tctccacctagtggctgtccagt

SEQ ID NO: 4701795 - DNA, 15 bp, Homo sapiens
tctccacctgccagg

SEQ ID NO: 4701796 - DNA, 22 bp, Homo sapiens
tctccacctgccagggacagag

SEQ ID NO: 4701797 - DNA, 13 bp, Homo sapiens
tctccagcccctg

SEQ ID NO: 4701798 - DNA, 14 bp, Homo sapiens
tctccagcccctgg

SEQ ID NO: 4701799 - DNA, 15 bp, Homo sapiens
tctccagcccctgga

SEQ ID NO: 4701800 - DNA, 22 bp, Homo sapiens
tctccagcccctggatgcagcc

SEQ ID NO: 4701801 - DNA, 18 bp, Homo sapiens
tctccagcctcagctctc

SEQ ID NO: 4701802 - DNA, 13 bp, Homo sapiens
tctccatccacat

SEQ ID NO: 4701803 - DNA, 12 bp, Homo sapiens
tctccatctcta

SEQ ID NO: 4701804 - DNA, 24 bp, Homo sapiens
tctccatggccctgccatgctctc

SEQ ID NO: 4701805 - DNA, 21 bp, Homo sapiens
tctcccactgcaacttgtgaa

SEQ ID NO: 4701806 - DNA, 22 bp, Homo sapiens
tctcccactgcaacttgtgaac

SEQ ID NO: 4701807 - DNA, 18 bp, Homo sapiens
tctcccagataatgtgaa

SEQ ID NO: 4701808 - DNA, 23 bp, Homo sapiens
tctcccagataatgtgaaaatgg

SEQ ID NO: 4701809 - DNA, 12 bp, Homo sapiens
tctccccagagt

SEQ ID NO: 4701810 - DNA, 21 bp, Homo sapiens
tctcccccccggggctgggtt

SEQ ID NO: 4701811 - DNA, 14 bp, Homo sapiens
tctcccctgccccc

SEQ ID NO: 4701812 - DNA, 21 bp, Homo sapiens
tctcccctgcccccaggactg

SEQ ID NO: 4701813 - DNA, 22 bp, Homo sapiens
tctcccctgcccccaggactgg

SEQ ID NO: 4701814 - DNA, 18 bp, Homo sapiens
tctcccctgccccctgca

SEQ ID NO: 4701815 - DNA, 14 bp, Homo sapiens
tctccctcccttgg

SEQ ID NO: 4701816 - DNA, 14 bp, Homo sapiens
tctccctcctggcc

SEQ ID NO: 4701817 - DNA, 17 bp, Homo sapiens
tctccgaccagacacct

SEQ ID NO: 4701818 - DNA, 23 bp, Homo sapiens
tctccgaccagacaccttgacag

SEQ ID NO: 4701819 - DNA, 19 bp, Homo sapiens
tctccgcacacctctggct

SEQ ID NO: 4701820 - DNA, 21 bp, Homo sapiens
tctccgcacacctctggctgt

SEQ ID NO: 4701821 - DNA, 14 bp, Homo sapiens
tctcctaattgtat

SEQ ID NO: 4701822 - DNA, 17 bp, Homo sapiens
tctcctccgtggcacat

SEQ ID NO: 4701823 - DNA, 16 bp, Homo sapiens
tctcctctcagcccct

SEQ ID NO: 4701824 - DNA, 13 bp, Homo sapiens
tctcctctgctgc

SEQ ID NO: 4701825 - DNA, 14 bp, Homo sapiens
tctcctctgctgct

SEQ ID NO: 4701826 - DNA, 15 bp, Homo sapiens
tctcctctgctgctg

SEQ ID NO: 4701827 - DNA, 12 bp, Homo sapiens
tctcctgcctca

SEQ ID NO: 4701828 - DNA, 15 bp, Homo sapiens
tctcctgcctcagcc

SEQ ID NO: 4701829 - DNA, 16 bp, Homo sapiens
tctcctgccttcctcc

SEQ ID NO: 4701830 - DNA, 19 bp, Homo sapiens
tctcctgtgatgtcccagt

SEQ ID NO: 4701831 - DNA, 21 bp, Homo sapiens
tctccttagaagtggaagtag

SEQ ID NO: 4701832 - DNA, 14 bp, Homo sapiens
tctccttcaccttt

SEQ ID NO: 4701833 - DNA, 20 bp, Homo sapiens
tctccttcagccctcacccc

SEQ ID NO: 4701834 - DNA, 19 bp, Homo sapiens
tctccttgtggcctgggcc

SEQ ID NO: 4701835 - DNA, 20 bp, Homo sapiens
tctccttgtggcctgggcct

SEQ ID NO: 4701836 - DNA, 17 bp, Homo sapiens
tctcgaactcctgacct

SEQ ID NO: 4701837 - DNA, 18 bp, Homo sapiens
tctcgctgatgctgggct

SEQ ID NO: 4701838 - DNA, 17 bp, Homo sapiens
tctctaagtgtaaaagt

SEQ ID NO: 4701839 - DNA, 17 bp, Homo sapiens
tctctaatgcttgattt

SEQ ID NO: 4701840 - DNA, 15 bp, Homo sapiens
tctctaattttggat

SEQ ID NO: 4701841 - DNA, 15 bp, Homo sapiens
tctctaggctgggga

SEQ ID NO: 4701842 - DNA, 13 bp, Homo sapiens
tctctcactcctt

SEQ ID NO: 4701843 - DNA, 14 bp, Homo sapiens
tctctcatctctta

SEQ ID NO: 4701844 - DNA, 19 bp, Homo sapiens
tctctcatctcttagctcc

SEQ ID NO: 4701845 - DNA, 14 bp, Homo sapiens
tctctccagcccct

SEQ ID NO: 4701846 - DNA, 16 bp, Homo sapiens
tctctccagcccctgg

SEQ ID NO: 4701847 - DNA, 17 bp, Homo sapiens
tctctctaacataacaa

SEQ ID NO: 4701848 - DNA, 23 bp, Homo sapiens
tctctctcactcacattttctca

SEQ ID NO: 4701849 - DNA, 11 bp, Homo sapiens
tctctctgtgg

SEQ ID NO: 4701850 - DNA, 14 bp, Homo sapiens
tctctgagggtgat

SEQ ID NO: 4701851 - DNA, 18 bp, Homo sapiens
tctctgagtcagctgacc

SEQ ID NO: 4701852 - DNA, 11 bp, Homo sapiens
tctctgcccta

SEQ ID NO: 4701853 - DNA, 15 bp, Homo sapiens
tctctgccctccaag

SEQ ID NO: 4701854 - DNA, 16 bp, Homo sapiens
tctctgccctccaaga

SEQ ID NO: 4701855 - DNA, 18 bp, Homo sapiens
tctctgctctgcgtgtca

SEQ ID NO: 4701856 - DNA, 23 bp, Homo sapiens
tctctgctctgcgtgtcacctgt

SEQ ID NO: 4701857 - DNA, 12 bp, Homo sapiens
tctctgctgccg

SEQ ID NO: 4701858 - DNA, 13 bp, Homo sapiens
tctctggaagaag

SEQ ID NO: 4701859 - DNA, 12 bp, Homo sapiens
tctctgtctcat

SEQ ID NO: 4701860 - DNA, 14 bp, Homo sapiens
tctctgtctcatcc

SEQ ID NO: 4701861 - DNA, 15 bp, Homo sapiens
tctctgtctcatcca

SEQ ID NO: 4701862 - DNA, 18 bp, Homo sapiens
tctcttagctcccctcca

SEQ ID NO: 4701863 - DNA, 13 bp, Homo sapiens
tctcttcagtgtg

SEQ ID NO: 4701864 - DNA, 17 bp, Homo sapiens
tctcttcagtgtgttga

SEQ ID NO: 4701865 - DNA, 13 bp, Homo sapiens
tctcttcccctct

SEQ ID NO: 4701866 - DNA, 17 bp, Homo sapiens
tctcttcccctctcaga

SEQ ID NO: 4701867 - DNA, 20 bp, Homo sapiens
tctcttctgggttccttcct

SEQ ID NO: 4701868 - DNA, 16 bp, Homo sapiens
tctcttggtcctgctg

SEQ ID NO: 4701869 - DNA, 20 bp, Homo sapiens
tctctttaatgtcacaggca

SEQ ID NO: 4701870 - DNA, 18 bp, Homo sapiens
tctctttttgctttcgaa

SEQ ID NO: 4701871 - DNA, 14 bp, Homo sapiens
tctgaaaatataac

SEQ ID NO: 4701872 - DNA, 17 bp, Homo sapiens
tctgaaaatatctcttg

SEQ ID NO: 4701873 - DNA, 17 bp, Homo sapiens
tctgaaaattaacactg

SEQ ID NO: 4701874 - DNA, 15 bp, Homo sapiens
tctgaaaccagtgtt

SEQ ID NO: 4701875 - DNA, 20 bp, Homo sapiens
tctgaaaccagtgttaggga

SEQ ID NO: 4701876 - DNA, 21 bp, Homo sapiens
tctgaaggacattgcggacag

SEQ ID NO: 4701877 - DNA, 20 bp, Homo sapiens
tctgaaggagccccattcct

SEQ ID NO: 4701878 - DNA, 18 bp, Homo sapiens
tctgaaggctgggttctg

SEQ ID NO: 4701879 - DNA, 19 bp, Homo sapiens
tctgacaatgcgtggcaca

SEQ ID NO: 4701880 - DNA, 18 bp, Homo sapiens
tctgacacacagctctgt

SEQ ID NO: 4701881 - DNA, 13 bp, Homo sapiens
tctgacccacagc

SEQ ID NO: 4701882 - DNA, 19 bp, Homo sapiens
tctgacccatgctgccctg

SEQ ID NO: 4701883 - DNA, 23 bp, Homo sapiens
tctgacccatgctgccctgtgag

SEQ ID NO: 4701884 - DNA, 15 bp, Homo sapiens
tctgactcagggctc

SEQ ID NO: 4701885 - DNA, 19 bp, Homo sapiens
tctgagctgtcaacgagac

SEQ ID NO: 4701886 - DNA, 15 bp, Homo sapiens
tctgagctgttatct

SEQ ID NO: 4701887 - DNA, 16 bp, Homo sapiens
tctgaggaatccagac

SEQ ID NO: 4701888 - DNA, 13 bp, Homo sapiens
tctgagtcagaga

SEQ ID NO: 4701889 - DNA, 20 bp, Homo sapiens
tctgataatgtattgcagtg

SEQ ID NO: 4701890 - DNA, 21 bp, Homo sapiens
tctgatcatccactgtgccat

SEQ ID NO: 4701891 - DNA, 16 bp, Homo sapiens
tctgatgatgtgcctg

SEQ ID NO: 4701892 - DNA, 23 bp, Homo sapiens
tctgatgcaagcaagaaacactg

SEQ ID NO: 4701893 - DNA, 18 bp, Homo sapiens
tctgatggcttctccagg

SEQ ID NO: 4701894 - DNA, 19 bp, Homo sapiens
tctgattcccaagctctgc

SEQ ID NO: 4701895 - DNA, 14 bp, Homo sapiens
tctgatttagcaat

SEQ ID NO: 4701896 - DNA, 13 bp, Homo sapiens
tctgatttttaat

SEQ ID NO: 4701897 - DNA, 12 bp, Homo sapiens
tctgcaacatgg

SEQ ID NO: 4701898 - DNA, 15 bp, Homo sapiens
tctgcaacatggatt

SEQ ID NO: 4701899 - DNA, 13 bp, Homo sapiens
tctgcaactgaat

SEQ ID NO: 4701900 - DNA, 13 bp, Homo sapiens
tctgcaagacaaa

SEQ ID NO: 4701901 - DNA, 14 bp, Homo sapiens
tctgcaagacaaag

SEQ ID NO: 4701902 - DNA, 21 bp, Homo sapiens
tctgcaatgtttttgtgtaga

SEQ ID NO: 4701903 - DNA, 14 bp, Homo sapiens
tctgcacacagcac

SEQ ID NO: 4701904 - DNA, 19 bp, Homo sapiens
tctgcactcccctgctggg

SEQ ID NO: 4701905 - DNA, 20 bp, Homo sapiens
tctgcactcccctgctgggt

SEQ ID NO: 4701906 - DNA, 11 bp, Homo sapiens
tctgcagcctc

SEQ ID NO: 4701907 - DNA, 20 bp, Homo sapiens
tctgcatgtaaaatcttcag

SEQ ID NO: 4701908 - DNA, 16 bp, Homo sapiens
tctgccatgtccatag

SEQ ID NO: 4701909 - DNA, 19 bp, Homo sapiens
tctgcccaaattatgtgaa

SEQ ID NO: 4701910 - DNA, 17 bp, Homo sapiens
tctgcccaactttcatt

SEQ ID NO: 4701911 - DNA, 14 bp, Homo sapiens
tctgcccactccct

SEQ ID NO: 4701912 - DNA, 12 bp, Homo sapiens
tctgcccctccc

SEQ ID NO: 4701913 - DNA, 14 bp, Homo sapiens
tctgccctccaaga

SEQ ID NO: 4701914 - DNA, 18 bp, Homo sapiens
tctgccctccaagacctt

SEQ ID NO: 4701915 - DNA, 19 bp, Homo sapiens
tctgccctccaagaccttc

SEQ ID NO: 4701916 - DNA, 10 bp, Homo sapiens
tctgccctgc

SEQ ID NO: 4701917 - DNA, 12 bp, Homo sapiens
tctgcctcccat

SEQ ID NO: 4701918 - DNA, 15 bp, Homo sapiens
tctgcctctgacaca

SEQ ID NO: 4701919 - DNA, 22 bp, Homo sapiens
tctgctcatcattctctgtctc

SEQ ID NO: 4701920 - DNA, 18 bp, Homo sapiens
tctgctcctctccccagc

SEQ ID NO: 4701921 - DNA, 16 bp, Homo sapiens
tctgctcgggcccagg

SEQ ID NO: 4701922 - DNA, 20 bp, Homo sapiens
tctgctctaagaagctgcaa

SEQ ID NO: 4701923 - DNA, 22 bp, Homo sapiens
tctgctctaagaagctgcaata

SEQ ID NO: 4701924 - DNA, 20 bp, Homo sapiens
tctgctgacagacacaggcc

SEQ ID NO: 4701925 - DNA, 21 bp, Homo sapiens
tctgctgccttgggtttctgt

SEQ ID NO: 4701926 - DNA, 24 bp, Homo sapiens
tctgctgggctggggcctgatggg

SEQ ID NO: 4701927 - DNA, 13 bp, Homo sapiens
tctgcttcagcct

SEQ ID NO: 4701928 - DNA, 19 bp, Homo sapiens
tctggaagggcagcatata

SEQ ID NO: 4701929 - DNA, 22 bp, Homo sapiens
tctggaagtgactttggctgca

SEQ ID NO: 4701930 - DNA, 14 bp, Homo sapiens
tctggacacttgct

SEQ ID NO: 4701931 - DNA, 21 bp, Homo sapiens
tctggagagctagaacctgga

SEQ ID NO: 4701932 - DNA, 16 bp, Homo sapiens
tctggattcatattta

SEQ ID NO: 4701933 - DNA, 19 bp, Homo sapiens
tctggcaaacatgtgcaac

SEQ ID NO: 4701934 - DNA, 16 bp, Homo sapiens
tctggcagctcagaga

SEQ ID NO: 4701935 - DNA, 21 bp, Homo sapiens
tctggcagctcagagagggtg

SEQ ID NO: 4701936 - DNA, 15 bp, Homo sapiens
tctggctccagctgg

SEQ ID NO: 4701937 - DNA, 23 bp, Homo sapiens
tctggctcttccaggctgggaga

SEQ ID NO: 4701938 - DNA, 14 bp, Homo sapiens
tctgggacacagtt

SEQ ID NO: 4701939 - DNA, 13 bp, Homo sapiens
tctgggagggcag

SEQ ID NO: 4701940 - DNA, 14 bp, Homo sapiens
tctgggcaggactc

SEQ ID NO: 4701941 - DNA, 20 bp, Homo sapiens
tctgggcaggactcagctcc

SEQ ID NO: 4701942 - DNA, 21 bp, Homo sapiens
tctgggcaggactcagctccc

SEQ ID NO: 4701943 - DNA, 15 bp, Homo sapiens
tctgggtgatttcta

SEQ ID NO: 4701944 - DNA, 19 bp, Homo sapiens
tctgggtgatttctagaat

SEQ ID NO: 4701945 - DNA, 16 bp, Homo sapiens
tctgggttcactgcaa

SEQ ID NO: 4701946 - DNA, 23 bp, Homo sapiens
tctgggttccttcctctgagcct

SEQ ID NO: 4701947 - DNA, 18 bp, Homo sapiens
tctgggtttacaacaaac

SEQ ID NO: 4701948 - DNA, 14 bp, Homo sapiens
tctggtatctgcat

SEQ ID NO: 4701949 - DNA, 18 bp, Homo sapiens
tctggtccatagagagca

SEQ ID NO: 4701950 - DNA, 16 bp, Homo sapiens
tctggtctctaggctg

SEQ ID NO: 4701951 - DNA, 18 bp, Homo sapiens
tctggtctctaggctggg

SEQ ID NO: 4701952 - DNA, 21 bp, Homo sapiens
tctggtctctaggctggggaa

SEQ ID NO: 4701953 - DNA, 16 bp, Homo sapiens
tctgtaaatgaacaca

SEQ ID NO: 4701954 - DNA, 13 bp, Homo sapiens
tctgtaactcttt

SEQ ID NO: 4701955 - DNA, 23 bp, Homo sapiens
tctgtaactctttctgaggagct

SEQ ID NO: 4701956 - DNA, 15 bp, Homo sapiens
tctgtaataatagac

SEQ ID NO: 4701957 - DNA, 18 bp, Homo sapiens
tctgtacgtctgacaggc

SEQ ID NO: 4701958 - DNA, 16 bp, Homo sapiens
tctgtatatagctcta

SEQ ID NO: 4701959 - DNA, 15 bp, Homo sapiens
tctgtcatttgagca

SEQ ID NO: 4701960 - DNA, 20 bp, Homo sapiens
tctgtcatttgagcagggct

SEQ ID NO: 4701961 - DNA, 19 bp, Homo sapiens
tctgtcctactctgtgtca

SEQ ID NO: 4701962 - DNA, 14 bp, Homo sapiens
tctgtctttcaaaa

SEQ ID NO: 4701963 - DNA, 22 bp, Homo sapiens
tctgtgaaaggaaagagggagg

SEQ ID NO: 4701964 - DNA, 21 bp, Homo sapiens
tctgtgagactcgagaacttt

SEQ ID NO: 4701965 - DNA, 21 bp, Homo sapiens
tctgtgcacgcagtggccttc

SEQ ID NO: 4701966 - DNA, 21 bp, Homo sapiens
tctgtgcccatgggcactgct

SEQ ID NO: 4701967 - DNA, 15 bp, Homo sapiens
tctgtgggctgcact

SEQ ID NO: 4701968 - DNA, 19 bp, Homo sapiens
tctgtgggctgcactctgt

SEQ ID NO: 4701969 - DNA, 20 bp, Homo sapiens
tctgtgggctgcactctgtg

SEQ ID NO: 4701970 - DNA, 23 bp, Homo sapiens
tctgtgggctgcactctgtgccc

SEQ ID NO: 4701971 - DNA, 14 bp, Homo sapiens
tctgtgtcactggc

SEQ ID NO: 4701972 - DNA, 22 bp, Homo sapiens
tctgtgtcaggtggggcagctt

SEQ ID NO: 4701973 - DNA, 14 bp, Homo sapiens
tctgtgtgtgcctg

SEQ ID NO: 4701974 - DNA, 12 bp, Homo sapiens
tctgtgtttagc

SEQ ID NO: 4701975 - DNA, 23 bp, Homo sapiens
tctgtgtttatggccaatctatt

SEQ ID NO: 4701976 - DNA, 14 bp, Homo sapiens
tctgttctacttga

SEQ ID NO: 4701977 - DNA, 17 bp, Homo sapiens
tctgttctacttgatat

SEQ ID NO: 4701978 - DNA, 22 bp, Homo sapiens
tctgttctacttgatatttcct

SEQ ID NO: 4701979 - DNA, 15 bp, Homo sapiens
tctgttgctgcctca

SEQ ID NO: 4701980 - DNA, 12 bp, Homo sapiens
tctgttggccag

SEQ ID NO: 4701981 - DNA, 17 bp, Homo sapiens
tctgttggccagtgtga

SEQ ID NO: 4701982 - DNA, 20 bp, Homo sapiens
tctgttggccagtgtgacaa

SEQ ID NO: 4701983 - DNA, 15 bp, Homo sapiens
tctgttgttccaaat

SEQ ID NO: 4701984 - DNA, 13 bp, Homo sapiens
tctgttgtttgaa

SEQ ID NO: 4701985 - DNA, 14 bp, Homo sapiens
tctgtttgacaaac

SEQ ID NO: 4701986 - DNA, 17 bp, Homo sapiens
tcttaaacataataaat

SEQ ID NO: 4701987 - DNA, 12 bp, Homo sapiens
tcttaaactaaa

SEQ ID NO: 4701988 - DNA, 19 bp, Homo sapiens
tcttaatcttttcacaaat

SEQ ID NO: 4701989 - DNA, 13 bp, Homo sapiens
tcttactttgtgc

SEQ ID NO: 4701990 - DNA, 14 bp, Homo sapiens
tcttagctcccctc

SEQ ID NO: 4701991 - DNA, 17 bp, Homo sapiens
tcttagctttttaattg

SEQ ID NO: 4701992 - DNA, 22 bp, Homo sapiens
tcttagtggaagacaatactcc

SEQ ID NO: 4701993 - DNA, 19 bp, Homo sapiens
tcttataagaagaagagag

SEQ ID NO: 4701994 - DNA, 13 bp, Homo sapiens
tcttataatttaa

SEQ ID NO: 4701995 - DNA, 12 bp, Homo sapiens
tcttatctcagt

SEQ ID NO: 4701996 - DNA, 22 bp, Homo sapiens
tcttatctcagtcatgcataaa

SEQ ID NO: 4701997 - DNA, 16 bp, Homo sapiens
tcttatctgccatgtc

SEQ ID NO: 4701998 - DNA, 19 bp, Homo sapiens
tcttatctgccatgtccat

SEQ ID NO: 4701999 - DNA, 21 bp, Homo sapiens
tcttatgcttccattaacaaa

SEQ ID NO: 4702000 - DNA, 23 bp, Homo sapiens
tcttatgcttccattaacaaatg

SEQ ID NO: 4702001 - DNA, 16 bp, Homo sapiens
tcttatgggctgggtt

SEQ ID NO: 4702002 - DNA, 18 bp, Homo sapiens
tcttatgggctgggttct

SEQ ID NO: 4702003 - DNA, 12 bp, Homo sapiens
tcttattcatca

SEQ ID NO: 4702004 - DNA, 13 bp, Homo sapiens
tcttcagagctga

SEQ ID NO: 4702005 - DNA, 11 bp, Homo sapiens
tcttcagctgg

SEQ ID NO: 4702006 - DNA, 12 bp, Homo sapiens
tcttcagctggt

SEQ ID NO: 4702007 - DNA, 15 bp, Homo sapiens
tcttcataattctaa

SEQ ID NO: 4702008 - DNA, 14 bp, Homo sapiens
tcttccaggctggg

SEQ ID NO: 4702009 - DNA, 15 bp, Homo sapiens
tcttccaggctggga

SEQ ID NO: 4702010 - DNA, 19 bp, Homo sapiens
tcttccaggtggggtgagg

SEQ ID NO: 4702011 - DNA, 13 bp, Homo sapiens
tcttccatttgca

SEQ ID NO: 4702012 - DNA, 18 bp, Homo sapiens
tcttcctatttctggaat

SEQ ID NO: 4702013 - DNA, 12 bp, Homo sapiens
tcttcctgtggg

SEQ ID NO: 4702014 - DNA, 13 bp, Homo sapiens
tcttcctgtgggg

SEQ ID NO: 4702015 - DNA, 19 bp, Homo sapiens
tcttcctgtgggggaagag

SEQ ID NO: 4702016 - DNA, 14 bp, Homo sapiens
tcttcctttcagaa

SEQ ID NO: 4702017 - DNA, 21 bp, Homo sapiens
agtgaggctctgcccttggtt

SEQ ID NO: 4702018 - DNA, 15 bp, Homo sapiens
agtgagtcgaggaca

SEQ ID NO: 4702019 - DNA, 16 bp, Homo sapiens
agtgagtgatcactgg

SEQ ID NO: 4702020 - DNA, 18 bp, Homo sapiens
agtgagttgttgccctgg

SEQ ID NO: 4702021 - DNA, 19 bp, Homo sapiens
agtgagttgttgccctggg

SEQ ID NO: 4702022 - DNA, 20 bp, Homo sapiens
agtgagttgttgccctgggt

SEQ ID NO: 4702023 - DNA, 17 bp, Homo sapiens
agtgatatggcagaaga

SEQ ID NO: 4702024 - DNA, 24 bp, Homo sapiens
agtgatatggcagaagacaccaga

SEQ ID NO: 4702025 - DNA, 13 bp, Homo sapiens
agtgatcctccca

SEQ ID NO: 4702026 - DNA, 19 bp, Homo sapiens
agtgatcctcccacctcag

SEQ ID NO: 4702027 - DNA, 23 bp, Homo sapiens
agtgatcctcccacctcagcctc

SEQ ID NO: 4702028 - DNA, 19 bp, Homo sapiens
agtgatccttccacctcag

SEQ ID NO: 4702029 - DNA, 20 bp, Homo sapiens
agtgatccttccacctcagt

SEQ ID NO: 4702030 - DNA, 23 bp, Homo sapiens
agtgatccttccacctcagtctc

SEQ ID NO: 4702031 - DNA, 14 bp, Homo sapiens
agtgattctcctgc

SEQ ID NO: 4702032 - DNA, 17 bp, Homo sapiens
agtgattctcctgcctc

SEQ ID NO: 4702033 - DNA, 22 bp, Homo sapiens
agtgattctcctgcctcagcct

SEQ ID NO: 4702034 - DNA, 19 bp, Homo sapiens
agtgatttagttgtggaaa

SEQ ID NO: 4702035 - DNA, 21 bp, Homo sapiens
agtgcacacctttattcagaa

SEQ ID NO: 4702036 - DNA, 23 bp, Homo sapiens
agtgcacacctttattcagaact

SEQ ID NO: 4702037 - DNA, 16 bp, Homo sapiens
agtgcagtcctgatca

SEQ ID NO: 4702038 - DNA, 17 bp, Homo sapiens
agtgcagtgagccgaga

SEQ ID NO: 4702039 - DNA, 17 bp, Homo sapiens
agtgccgccgcctcgcc

SEQ ID NO: 4702040 - DNA, 19 bp, Homo sapiens
agtgccgccgcctcgccca

SEQ ID NO: 4702041 - DNA, 23 bp, Homo sapiens
agtgccgccgcctcgcccaccgc

SEQ ID NO: 4702042 - DNA, 14 bp, Homo sapiens
agtgcctattgata

SEQ ID NO: 4702043 - DNA, 16 bp, Homo sapiens
agtgcgtgtgtagagt

SEQ ID NO: 4702044 - DNA, 20 bp, Homo sapiens
agtgctgggattacaggcgt

SEQ ID NO: 4702045 - DNA, 20 bp, Homo sapiens
agtgctgggattacaggtgt

SEQ ID NO: 4702046 - DNA, 23 bp, Homo sapiens
agtgctgtcttaaactaaatgtg

SEQ ID NO: 4702047 - DNA, 22 bp, Homo sapiens
agtgcttcttgtaatatttctt

SEQ ID NO: 4702048 - DNA, 19 bp, Homo sapiens
agtgcttgccacagagcgg

SEQ ID NO: 4702049 - DNA, 16 bp, Homo sapiens
agtggaaccagcccag

SEQ ID NO: 4702050 - DNA, 16 bp, Homo sapiens
agtggaacgaaaatga

SEQ ID NO: 4702051 - DNA, 14 bp, Homo sapiens
agtggcagctgctt

SEQ ID NO: 4702052 - DNA, 19 bp, Homo sapiens
agtggctgctgcccaggcc

SEQ ID NO: 4702053 - DNA, 22 bp, Homo sapiens
agtggctgctgcccaggcccag

SEQ ID NO: 4702054 - DNA, 12 bp, Homo sapiens
agtggctgtcca

SEQ ID NO: 4702055 - DNA, 17 bp, Homo sapiens
agtggctgtccagtgcc

SEQ ID NO: 4702056 - DNA, 23 bp, Homo sapiens
agtggcttaaaacaacactcaca

SEQ ID NO: 4702057 - DNA, 17 bp, Homo sapiens
agtgggaaaaatgtagg

SEQ ID NO: 4702058 - DNA, 18 bp, Homo sapiens
agtgggaaaaatgtagga

SEQ ID NO: 4702059 - DNA, 19 bp, Homo sapiens
agtgggaaaaatgtaggag

SEQ ID NO: 4702060 - DNA, 15 bp, Homo sapiens
agtggggacagagca

SEQ ID NO: 4702061 - DNA, 20 bp, Homo sapiens
agtggggaccccacccctca

SEQ ID NO: 4702062 - DNA, 22 bp, Homo sapiens
agtgggtcccacttcccctcct

SEQ ID NO: 4702063 - DNA, 15 bp, Homo sapiens
agtggtatagaaatg

SEQ ID NO: 4702064 - DNA, 16 bp, Homo sapiens
agtggtatagaaatgc

SEQ ID NO: 4702065 - DNA, 14 bp, Homo sapiens
agtggtctttgtaa

SEQ ID NO: 4702066 - DNA, 20 bp, Homo sapiens
agtggtctttgtaagagtgt

SEQ ID NO: 4702067 - DNA, 17 bp, Homo sapiens
agtggtgcgatctgggt

SEQ ID NO: 4702068 - DNA, 20 bp, Homo sapiens
agtggttgggctgtgcctgg

SEQ ID NO: 4702069 - DNA, 19 bp, Homo sapiens
agtgtacccccgcccaggc

SEQ ID NO: 4702070 - DNA, 15 bp, Homo sapiens
agtgtagaagcattc

SEQ ID NO: 4702071 - DNA, 22 bp, Homo sapiens
agtgtctgtgttttgaaagaat

SEQ ID NO: 4702072 - DNA, 16 bp, Homo sapiens
agtgtcttcctgtggg

SEQ ID NO: 4702073 - DNA, 20 bp, Homo sapiens
agtgtgccccccatcctggc

SEQ ID NO: 4702074 - DNA, 22 bp, Homo sapiens
agtgtgccccccatcctggccc

SEQ ID NO: 4702075 - DNA, 23 bp, Homo sapiens
agtgtgccccccatcctggccca

SEQ ID NO: 4702076 - DNA, 19 bp, Homo sapiens
agtgtggtgtttcctggca

SEQ ID NO: 4702077 - DNA, 21 bp, Homo sapiens
agtgtgtaaggtatatgtttt

SEQ ID NO: 4702078 - DNA, 15 bp, Homo sapiens
agtgttaaatgtgat

SEQ ID NO: 4702079 - DNA, 17 bp, Homo sapiens
agtgttaggcctggcac

SEQ ID NO: 4702080 - DNA, 20 bp, Homo sapiens
agtgttaggcctggcacagt

SEQ ID NO: 4702081 - DNA, 19 bp, Homo sapiens
agtgttagggaagggcctg

SEQ ID NO: 4702082 - DNA, 19 bp, Homo sapiens
agtgttatgcggtctaggg

SEQ ID NO: 4702083 - DNA, 15 bp, Homo sapiens
agtgttcacaacctg

SEQ ID NO: 4702084 - DNA, 21 bp, Homo sapiens
agtgttccccttccactgagg

SEQ ID NO: 4702085 - DNA, 16 bp, Homo sapiens
agtgttttatgcatgt

SEQ ID NO: 4702086 - DNA, 18 bp, Homo sapiens
agttaaaagtaaaattgt

SEQ ID NO: 4702087 - DNA, 20 bp, Homo sapiens
agttaaaattgttatcaaaa

SEQ ID NO: 4702088 - DNA, 21 bp, Homo sapiens
agttaagaagctgttgtacat

SEQ ID NO: 4702089 - DNA, 22 bp, Homo sapiens
agttaagaagctgttgtacatt

SEQ ID NO: 4702090 - DNA, 19 bp, Homo sapiens
agttaattgtatttatgta

SEQ ID NO: 4702091 - DNA, 13 bp, Homo sapiens
agttaatttttgt

SEQ ID NO: 4702092 - DNA, 22 bp, Homo sapiens
agttaatttttgtataaggtga

SEQ ID NO: 4702093 - DNA, 19 bp, Homo sapiens
agttacaattacatctcta

SEQ ID NO: 4702094 - DNA, 20 bp, Homo sapiens
agttacaattacatctctaa

SEQ ID NO: 4702095 - DNA, 19 bp, Homo sapiens
agttacacatttttcagat

SEQ ID NO: 4702096 - DNA, 18 bp, Homo sapiens
agttaccattatttaatt

SEQ ID NO: 4702097 - DNA, 20 bp, Homo sapiens
agttagaaggaggttctaat

SEQ ID NO: 4702098 - DNA, 12 bp, Homo sapiens
agttagagctga

SEQ ID NO: 4702099 - DNA, 14 bp, Homo sapiens
agttattcataaag

SEQ ID NO: 4702100 - DNA, 15 bp, Homo sapiens
agttattcataaaga

SEQ ID NO: 4702101 - DNA, 20 bp, Homo sapiens
agttattcttggtactgttg

SEQ ID NO: 4702102 - DNA, 24 bp, Homo sapiens
agttcaatctggattcatatttaa

SEQ ID NO: 4702103 - DNA, 16 bp, Homo sapiens
agttcaattctcattt

SEQ ID NO: 4702104 - DNA, 17 bp, Homo sapiens
agttcagcctttaagat

SEQ ID NO: 4702105 - DNA, 21 bp, Homo sapiens
agttcataaatttgttgtcat

SEQ ID NO: 4702106 - DNA, 18 bp, Homo sapiens
agttccaccatcaagcca

SEQ ID NO: 4702107 - DNA, 21 bp, Homo sapiens
agttccaccatcaagccacca

SEQ ID NO: 4702108 - DNA, 18 bp, Homo sapiens
agttccagttttgttttg

SEQ ID NO: 4702109 - DNA, 21 bp, Homo sapiens
agttcctttagaaagcagtta

SEQ ID NO: 4702110 - DNA, 19 bp, Homo sapiens
agttcggtgagctacaaat

SEQ ID NO: 4702111 - DNA, 17 bp, Homo sapiens
agttctcaatttcattt

SEQ ID NO: 4702112 - DNA, 23 bp, Homo sapiens
agttctgctctaagaagctgcaa

SEQ ID NO: 4702113 - DNA, 20 bp, Homo sapiens
agttcttagttgctgtatgt

SEQ ID NO: 4702114 - DNA, 20 bp, Homo sapiens
agttgaaaaaagaagtttgg

SEQ ID NO: 4702115 - DNA, 22 bp, Homo sapiens
agttgaaaatcttataatttaa

SEQ ID NO: 4702116 - DNA, 22 bp, Homo sapiens
agttgacttgacagaacactgt

SEQ ID NO: 4702117 - DNA, 21 bp, Homo sapiens
agttgatagcacagaccctgc

SEQ ID NO: 4702118 - DNA, 22 bp, Homo sapiens
agttgatagcacagaccctgcc

SEQ ID NO: 4702119 - DNA, 17 bp, Homo sapiens
agttgatatagaacagt

SEQ ID NO: 4702120 - DNA, 17 bp, Homo sapiens
agttgcaatagaacaga

SEQ ID NO: 4702121 - DNA, 15 bp, Homo sapiens
agttgcacggctgct

SEQ ID NO: 4702122 - DNA, 20 bp, Homo sapiens
agttgcacggctgctgaggc

SEQ ID NO: 4702123 - DNA, 20 bp, Homo sapiens
agttgcatggcatcacctcc

SEQ ID NO: 4702124 - DNA, 23 bp, Homo sapiens
agttgcattttaaccctatttta

SEQ ID NO: 4702125 - DNA, 12 bp, Homo sapiens
atatattttaaa

SEQ ID NO: 4702126 - DNA, 13 bp, Homo sapiens
atatattttaatt

SEQ ID NO: 4702127 - DNA, 16 bp, Homo sapiens
atatattttgtttaca

SEQ ID NO: 4702128 - DNA, 19 bp, Homo sapiens
atatcagaatatgattcac

SEQ ID NO: 4702129 - DNA, 14 bp, Homo sapiens
atatcatataaaca

SEQ ID NO: 4702130 - DNA, 20 bp, Homo sapiens
atatcatgcttggttttctt

SEQ ID NO: 4702131 - DNA, 15 bp, Homo sapiens
atatcatttgtgaag

SEQ ID NO: 4702132 - DNA, 16 bp, Homo sapiens
atatcatttgtgaaga

SEQ ID NO: 4702133 - DNA, 18 bp, Homo sapiens
atatcatttgtgaagaat

SEQ ID NO: 4702134 - DNA, 20 bp, Homo sapiens
atatcatttgtgaagaatta

SEQ ID NO: 4702135 - DNA, 19 bp, Homo sapiens
atatcccttggacatttta

SEQ ID NO: 4702136 - DNA, 16 bp, Homo sapiens
atatcctacttctcca

SEQ ID NO: 4702137 - DNA, 20 bp, Homo sapiens
atatcctctgcttaaaaact

SEQ ID NO: 4702138 - DNA, 21 bp, Homo sapiens
atatctatgactgtgtttaat

SEQ ID NO: 4702139 - DNA, 15 bp, Homo sapiens
atatctctagtccct

SEQ ID NO: 4702140 - DNA, 22 bp, Homo sapiens
atatctctagtccctgtgttct

SEQ ID NO: 4702141 - DNA, 15 bp, Homo sapiens
atatcttgtatggtt

SEQ ID NO: 4702142 - DNA, 14 bp, Homo sapiens
atatctttattcac

SEQ ID NO: 4702143 - DNA, 16 bp, Homo sapiens
atatgaagacataaac

SEQ ID NO: 4702144 - DNA, 16 bp, Homo sapiens
atatgaggagacattc

SEQ ID NO: 4702145 - DNA, 21 bp, Homo sapiens
atatgaggagacattctgtct

SEQ ID NO: 4702146 - DNA, 14 bp, Homo sapiens
atatgcacttataa

SEQ ID NO: 4702147 - DNA, 14 bp, Homo sapiens
atatgtgtaaatgt

SEQ ID NO: 4702148 - DNA, 17 bp, Homo sapiens
atatgtttatcaccttt

SEQ ID NO: 4702149 - DNA, 18 bp, Homo sapiens
atatgttttaagaggcag

SEQ ID NO: 4702150 - DNA, 20 bp, Homo sapiens
atatgttttaagaggcaggg

SEQ ID NO: 4702151 - DNA, 15 bp, Homo sapiens
atatgttttataatt

SEQ ID NO: 4702152 - DNA, 13 bp, Homo sapiens
atattaagaaaca

SEQ ID NO: 4702153 - DNA, 16 bp, Homo sapiens
atattaagaaacaatt

SEQ ID NO: 4702154 - DNA, 19 bp, Homo sapiens
atattataaaggataaaga

SEQ ID NO: 4702155 - DNA, 20 bp, Homo sapiens
atattataaaggataaagaa

SEQ ID NO: 4702156 - DNA, 23 bp, Homo sapiens
atattataaaggataaagaagga

SEQ ID NO: 4702157 - DNA, 19 bp, Homo sapiens
atattatgcctgaatgact

SEQ ID NO: 4702158 - DNA, 22 bp, Homo sapiens
atattattccgtattacatttt

SEQ ID NO: 4702159 - DNA, 16 bp, Homo sapiens
atattcacatgttcta

SEQ ID NO: 4702160 - DNA, 18 bp, Homo sapiens
atattcacatgttctaat

SEQ ID NO: 4702161 - DNA, 16 bp, Homo sapiens
atattccaactcaaaa

SEQ ID NO: 4702162 - DNA, 17 bp, Homo sapiens
atattccactatttgca

SEQ ID NO: 4702163 - DNA, 19 bp, Homo sapiens
atattccactatttgcaga

SEQ ID NO: 4702164 - DNA, 17 bp, Homo sapiens
atattctgataatgtat

SEQ ID NO: 4702165 - DNA, 16 bp, Homo sapiens
atattctgttggccag

SEQ ID NO: 4702166 - DNA, 16 bp, Homo sapiens
atattgaaaaaataga

SEQ ID NO: 4702167 - DNA, 15 bp, Homo sapiens
atattgaccatgtga

SEQ ID NO: 4702168 - DNA, 17 bp, Homo sapiens
atattgaccatgtgatt

SEQ ID NO: 4702169 - DNA, 22 bp, Homo sapiens
atattgaccatgtgattatgga

SEQ ID NO: 4702170 - DNA, 21 bp, Homo sapiens
atattggtaattaaaagactc

SEQ ID NO: 4702171 - DNA, 13 bp, Homo sapiens
atattgtacagtt

SEQ ID NO: 4702172 - DNA, 16 bp, Homo sapiens
atattgtggctccctg

SEQ ID NO: 4702173 - DNA, 16 bp, Homo sapiens
atattgtttttgtatt

SEQ ID NO: 4702174 - DNA, 19 bp, Homo sapiens
atattgtttttgtatttat

SEQ ID NO: 4702175 - DNA, 18 bp, Homo sapiens
atatttaacctatttcca

SEQ ID NO: 4702176 - DNA, 22 bp, Homo sapiens
atatttattgaattattttgtt

SEQ ID NO: 4702177 - DNA, 20 bp, Homo sapiens
atatttcaggttcttcagaa

SEQ ID NO: 4702178 - DNA, 14 bp, Homo sapiens
atatttcagttctt

SEQ ID NO: 4702179 - DNA, 23 bp, Homo sapiens
atatttctgaggagcctgcaaca

SEQ ID NO: 4702180 - DNA, 16 bp, Homo sapiens
atatttgatatttggt

SEQ ID NO: 4702181 - DNA, 20 bp, Homo sapiens
atatttgcaaagtgtattag

SEQ ID NO: 4702182 - DNA, 21 bp, Homo sapiens
atatttggcccaaactcatct

SEQ ID NO: 4702183 - DNA, 17 bp, Homo sapiens
atatttggttatttaat

SEQ ID NO: 4702184 - DNA, 20 bp, Homo sapiens
atatttgtatttaaatgaaa

SEQ ID NO: 4702185 - DNA, 13 bp, Homo sapiens
atattttgttacc

SEQ ID NO: 4702186 - DNA, 15 bp, Homo sapiens
atatttttaattaaa

SEQ ID NO: 4702187 - DNA, 14 bp, Homo sapiens
atatttttctaaag

SEQ ID NO: 4702188 - DNA, 23 bp, Homo sapiens
atatttttttttaagctctgagc

SEQ ID NO: 4702189 - DNA, 13 bp, Homo sapiens
atcaaacatgaaa

SEQ ID NO: 4702190 - DNA, 14 bp, Homo sapiens
atcaaacatgaaaa

SEQ ID NO: 4702191 - DNA, 16 bp, Homo sapiens
atcaaacatgaaaaca

SEQ ID NO: 4702192 - DNA, 12 bp, Homo sapiens
atcaaagatgaa

SEQ ID NO: 4702193 - DNA, 21 bp, Homo sapiens
atcaaattttgagcaaagaaa

SEQ ID NO: 4702194 - DNA, 20 bp, Homo sapiens
atcaaccccttcgctcctgt

SEQ ID NO: 4702195 - DNA, 14 bp, Homo sapiens
atcaagcagccaag

SEQ ID NO: 4702196 - DNA, 13 bp, Homo sapiens
atcaaggcactgc

SEQ ID NO: 4702197 - DNA, 15 bp, Homo sapiens
atcaaggcactgcct

SEQ ID NO: 4702198 - DNA, 16 bp, Homo sapiens
atcaaggcactgcctg

SEQ ID NO: 4702199 - DNA, 19 bp, Homo sapiens
atcaattttttaaaccact

SEQ ID NO: 4702200 - DNA, 23 bp, Homo sapiens
atcacaaaagctgtgtctctgta

SEQ ID NO: 4702201 - DNA, 12 bp, Homo sapiens
atcacaatcagt

SEQ ID NO: 4702202 - DNA, 19 bp, Homo sapiens
atcaccaacgtctgtgcca

SEQ ID NO: 4702203 - DNA, 13 bp, Homo sapiens
atcacctgccctg

SEQ ID NO: 4702204 - DNA, 13 bp, Homo sapiens
atcacgccactgc

SEQ ID NO: 4702205 - DNA, 20 bp, Homo sapiens
atcacgtctgacaaatgtgt

SEQ ID NO: 4702206 - DNA, 20 bp, Homo sapiens
atcactgagccatcatttcc

SEQ ID NO: 4702207 - DNA, 20 bp, Homo sapiens
atcactgtcaatatttttat

SEQ ID NO: 4702208 - DNA, 20 bp, Homo sapiens
atcagaaacaccctcacact

SEQ ID NO: 4702209 - DNA, 20 bp, Homo sapiens
atcagaatatgattcactat

SEQ ID NO: 4702210 - DNA, 14 bp, Homo sapiens
atcagctatatact

SEQ ID NO: 4702211 - DNA, 20 bp, Homo sapiens
atcaggacccagaggaaggg

SEQ ID NO: 4702212 - DNA, 13 bp, Homo sapiens
atcaggagaaaaa

SEQ ID NO: 4702213 - DNA, 15 bp, Homo sapiens
atcaggagttccagt

SEQ ID NO: 4702214 - DNA, 23 bp, Homo sapiens
atcaggccaggccctctgcccac

SEQ ID NO: 4702215 - DNA, 22 bp, Homo sapiens
atcagtatatttggtttctaga

SEQ ID NO: 4702216 - DNA, 12 bp, Homo sapiens
atcagtgccagc

SEQ ID NO: 4702217 - DNA, 15 bp, Homo sapiens
atcagtgctccctca

SEQ ID NO: 4702218 - DNA, 22 bp, Homo sapiens
atcagtgtgccccccatcctgg

SEQ ID NO: 4702219 - DNA, 15 bp, Homo sapiens
atcagttactggtat

SEQ ID NO: 4702220 - DNA, 16 bp, Homo sapiens
atcatactgattttta

SEQ ID NO: 4702221 - DNA, 19 bp, Homo sapiens
atcatcaaggcactgcctg

SEQ ID NO: 4702222 - DNA, 23 bp, Homo sapiens
atcatccactgtgccatgtgcca

SEQ ID NO: 4702223 - DNA, 13 bp, Homo sapiens
atcatccctccct

SEQ ID NO: 4702224 - DNA, 14 bp, Homo sapiens
atcatccctccctg

SEQ ID NO: 4702225 - DNA, 22 bp, Homo sapiens
atcatcctggaggggtgttgta

SEQ ID NO: 4702226 - DNA, 13 bp, Homo sapiens
atcatctttgctg

SEQ ID NO: 4702227 - DNA, 17 bp, Homo sapiens
atcatggtgtaataaga

SEQ ID NO: 4702228 - DNA, 23 bp, Homo sapiens
atcatggtgtaataagacataac

SEQ ID NO: 4702229 - DNA, 16 bp, Homo sapiens
atcattctctgtctca

SEQ ID NO: 4702230 - DNA, 24 bp, Homo sapiens
atcattctctgtctcatccatcat

SEQ ID NO: 4702231 - DNA, 13 bp, Homo sapiens
atcattctgtaaa

SEQ ID NO: 4702232 - DNA, 14 bp, Homo sapiens
atcattcttactaa

SEQ ID NO: 4702233 - DNA, 17 bp, Homo sapiens
atcattggataaatttg

SEQ ID NO: 4702234 - DNA, 17 bp, Homo sapiens
atccaaatgcattcatg

SEQ ID NO: 4702235 - DNA, 19 bp, Homo sapiens
atgtacaaggtatgtacag

SEQ ID NO: 4702236 - DNA, 23 bp, Homo sapiens
atgtacagttcataaatttgttg

SEQ ID NO: 4702237 - DNA, 21 bp, Homo sapiens
atgtacctaatccaaatatca

SEQ ID NO: 4702238 - DNA, 15 bp, Homo sapiens
atgtactggagagtg

SEQ ID NO: 4702239 - DNA, 14 bp, Homo sapiens
atgtagaaaatttg

SEQ ID NO: 4702240 - DNA, 21 bp, Homo sapiens
atgtagcaaaatacatgacat

SEQ ID NO: 4702241 - DNA, 16 bp, Homo sapiens
atgtagcttgacaatt

SEQ ID NO: 4702242 - DNA, 14 bp, Homo sapiens
atgtagtatctata

SEQ ID NO: 4702243 - DNA, 19 bp, Homo sapiens
atgtagtatctatatgact

SEQ ID NO: 4702244 - DNA, 19 bp, Homo sapiens
atgtagtattgttctattt

SEQ ID NO: 4702245 - DNA, 14 bp, Homo sapiens
atgtatattaaaaa

SEQ ID NO: 4702246 - DNA, 16 bp, Homo sapiens
atgtatattaaaaaag

SEQ ID NO: 4702247 - DNA, 14 bp, Homo sapiens
atgtatgattacat

SEQ ID NO: 4702248 - DNA, 16 bp, Homo sapiens
atgtatgtaaatagat

SEQ ID NO: 4702249 - DNA, 17 bp, Homo sapiens
atgtatgtgccaatttt

SEQ ID NO: 4702250 - DNA, 19 bp, Homo sapiens
atgtatgtgccaattttgt

SEQ ID NO: 4702251 - DNA, 17 bp, Homo sapiens
atgtatgtggatacagt

SEQ ID NO: 4702252 - DNA, 16 bp, Homo sapiens
atgtcagcaaatgtaa

SEQ ID NO: 4702253 - DNA, 17 bp, Homo sapiens
atgtcagtaccttcaaa

SEQ ID NO: 4702254 - DNA, 15 bp, Homo sapiens
atgtcagttgttatt

SEQ ID NO: 4702255 - DNA, 16 bp, Homo sapiens
atgtcatattttgcca

SEQ ID NO: 4702256 - DNA, 18 bp, Homo sapiens
atgtccaagaagcccagg

SEQ ID NO: 4702257 - DNA, 19 bp, Homo sapiens
atgtccaagaagcccagga

SEQ ID NO: 4702258 - DNA, 23 bp, Homo sapiens
atgtccaagaagcccaggaaagg

SEQ ID NO: 4702259 - DNA, 20 bp, Homo sapiens
atgtccatagccataattcc

SEQ ID NO: 4702260 - DNA, 20 bp, Homo sapiens
atgtcccagtttcccactct

SEQ ID NO: 4702261 - DNA, 15 bp, Homo sapiens
atgtcctcaccacat

SEQ ID NO: 4702262 - DNA, 17 bp, Homo sapiens
atgtcctcctctgtgaa

SEQ ID NO: 4702263 - DNA, 19 bp, Homo sapiens
atgtcgctgggtcctctgc

SEQ ID NO: 4702264 - DNA, 16 bp, Homo sapiens
atgtctagaaagtaag

SEQ ID NO: 4702265 - DNA, 16 bp, Homo sapiens
atgtctatgctccctc

SEQ ID NO: 4702266 - DNA, 16 bp, Homo sapiens
atgtctcgtggtagga

SEQ ID NO: 4702267 - DNA, 17 bp, Homo sapiens
atgtctctgagcattag

SEQ ID NO: 4702268 - DNA, 23 bp, Homo sapiens
atgtctctttaatgtcacaggca

SEQ ID NO: 4702269 - DNA, 19 bp, Homo sapiens
atgtctgacctgcaaaaat

SEQ ID NO: 4702270 - DNA, 23 bp, Homo sapiens
atgtcttgatgcatgcactgttc

SEQ ID NO: 4702271 - DNA, 14 bp, Homo sapiens
atgtcttttcttgc

SEQ ID NO: 4702272 - DNA, 17 bp, Homo sapiens
atgtgaaaaaaattatt

SEQ ID NO: 4702273 - DNA, 21 bp, Homo sapiens
atgtgaaaatggtccaggaga

SEQ ID NO: 4702274 - DNA, 15 bp, Homo sapiens
atgtgaaaccttttt

SEQ ID NO: 4702275 - DNA, 23 bp, Homo sapiens
atgtgaaaccttttttaagattt

SEQ ID NO: 4702276 - DNA, 19 bp, Homo sapiens
atgtgaaatgcttatgctt

SEQ ID NO: 4702277 - DNA, 14 bp, Homo sapiens
atgtgaagaaaaag

SEQ ID NO: 4702278 - DNA, 20 bp, Homo sapiens
atgtgagggcaccaccaaga

SEQ ID NO: 4702279 - DNA, 17 bp, Homo sapiens
atgtgatgaatactgta

SEQ ID NO: 4702280 - DNA, 19 bp, Homo sapiens
atgtgatgaatactgtatt

SEQ ID NO: 4702281 - DNA, 15 bp, Homo sapiens
atgtgcaactcttgt

SEQ ID NO: 4702282 - DNA, 17 bp, Homo sapiens
atgtgcaactcttgtat

SEQ ID NO: 4702283 - DNA, 16 bp, Homo sapiens
atgtgccaattttgtc

SEQ ID NO: 4702284 - DNA, 21 bp, Homo sapiens
atgtgccaggtttttggtctg

SEQ ID NO: 4702285 - DNA, 19 bp, Homo sapiens
atgtggaaaacatcctgac

SEQ ID NO: 4702286 - DNA, 16 bp, Homo sapiens
atgtggcctttgaatt

SEQ ID NO: 4702287 - DNA, 13 bp, Homo sapiens
atgtggctgtatc

SEQ ID NO: 4702288 - DNA, 20 bp, Homo sapiens
atgtgggtccctctcttgac

SEQ ID NO: 4702289 - DNA, 14 bp, Homo sapiens
atgtgggttgtgat

SEQ ID NO: 4702290 - DNA, 15 bp, Homo sapiens
atgtgtaaatgttat

SEQ ID NO: 4702291 - DNA, 19 bp, Homo sapiens
atgtgtaaatgttatgact

SEQ ID NO: 4702292 - DNA, 23 bp, Homo sapiens
atgtgtataattttaaagtaatt

SEQ ID NO: 4702293 - DNA, 23 bp, Homo sapiens
atgtgtgtccacgactgtctcca

SEQ ID NO: 4702294 - DNA, 16 bp, Homo sapiens
atgtgtgttgatactg

SEQ ID NO: 4702295 - DNA, 20 bp, Homo sapiens
atgtgtgttgatactgttgc

SEQ ID NO: 4702296 - DNA, 21 bp, Homo sapiens
atgtgtgttgatactgttgca

SEQ ID NO: 4702297 - DNA, 15 bp, Homo sapiens
atgtgtttgaacttc

SEQ ID NO: 4702298 - DNA, 21 bp, Homo sapiens
atgttaaacttacttagtgtt

SEQ ID NO: 4702299 - DNA, 14 bp, Homo sapiens
atgttaaatttgta

SEQ ID NO: 4702300 - DNA, 16 bp, Homo sapiens
atgttaaatttgtaag

SEQ ID NO: 4702301 - DNA, 18 bp, Homo sapiens
atgttaaatttgtaagtt

SEQ ID NO: 4702302 - DNA, 20 bp, Homo sapiens
atgttaaatttgtaagtttc

SEQ ID NO: 4702303 - DNA, 17 bp, Homo sapiens
atgttaaggaaactctt

SEQ ID NO: 4702304 - DNA, 19 bp, Homo sapiens
atgttaaggaaactcttat

SEQ ID NO: 4702305 - DNA, 23 bp, Homo sapiens
atgttaaggaaactcttatctca

SEQ ID NO: 4702306 - DNA, 14 bp, Homo sapiens
atgttaagttatat

SEQ ID NO: 4702307 - DNA, 22 bp, Homo sapiens
atgttaatattttaggtgtaaa

SEQ ID NO: 4702308 - DNA, 15 bp, Homo sapiens
atgttactgagatgt

SEQ ID NO: 4702309 - DNA, 19 bp, Homo sapiens
atgttactgagatgtttta

SEQ ID NO: 4702310 - DNA, 17 bp, Homo sapiens
atgttagtattttaatc

SEQ ID NO: 4702311 - DNA, 18 bp, Homo sapiens
atgttagtattttaatcc

SEQ ID NO: 4702312 - DNA, 13 bp, Homo sapiens
atgttattatgct

SEQ ID NO: 4702313 - DNA, 22 bp, Homo sapiens
atgttcctggacaccacccaga

SEQ ID NO: 4702314 - DNA, 19 bp, Homo sapiens
atgttctaagtctttccat

SEQ ID NO: 4702315 - DNA, 19 bp, Homo sapiens
atgttctaatactttgttt

SEQ ID NO: 4702316 - DNA, 20 bp, Homo sapiens
atgttctatttaacaactgg

SEQ ID NO: 4702317 - DNA, 11 bp, Homo sapiens
atgttctggga

SEQ ID NO: 4702318 - DNA, 12 bp, Homo sapiens
atgttctgggac

SEQ ID NO: 4702319 - DNA, 13 bp, Homo sapiens
atgttctgggaca

SEQ ID NO: 4702320 - DNA, 14 bp, Homo sapiens
atgttctgggacac

SEQ ID NO: 4702321 - DNA, 15 bp, Homo sapiens
atgttctgggacaca

SEQ ID NO: 4702322 - DNA, 23 bp, Homo sapiens
atgttctgtcccttgcccccctg

SEQ ID NO: 4702323 - DNA, 22 bp, Homo sapiens
atgttgccatcctaccgtcttt

SEQ ID NO: 4702324 - DNA, 13 bp, Homo sapiens
atgttgcccaggc

SEQ ID NO: 4702325 - DNA, 14 bp, Homo sapiens
atgttgcccaggca

SEQ ID NO: 4702326 - DNA, 17 bp, Homo sapiens
atgttggccaggctggt

SEQ ID NO: 4702327 - DNA, 21 bp, Homo sapiens
atgttggtgcaattaactctg

SEQ ID NO: 4702328 - DNA, 18 bp, Homo sapiens
atgttgtaaacaggaagc

SEQ ID NO: 4702329 - DNA, 22 bp, Homo sapiens
atgttgtcaggtcgttcttatc

SEQ ID NO: 4702330 - DNA, 18 bp, Homo sapiens
atgttgtttataataaaa

SEQ ID NO: 4702331 - DNA, 14 bp, Homo sapiens
atgtttaaacattt

SEQ ID NO: 4702332 - DNA, 11 bp, Homo sapiens
atgtttataaa

SEQ ID NO: 4702333 - DNA, 18 bp, Homo sapiens
atgtttataaactgagag

SEQ ID NO: 4702334 - DNA, 14 bp, Homo sapiens
atgtttgcctctgc

SEQ ID NO: 4702335 - DNA, 18 bp, Homo sapiens
atgtttgcctctgcctct

SEQ ID NO: 4702336 - DNA, 19 bp, Homo sapiens
atgtttgcctctgcctctg

SEQ ID NO: 4702337 - DNA, 22 bp, Homo sapiens
atgtttgcctctgcctctgaca

SEQ ID NO: 4702338 - DNA, 24 bp, Homo sapiens
atgtttgtgagaagcttctaatta

SEQ ID NO: 4702339 - DNA, 12 bp, Homo sapiens
atgttttaccat

SEQ ID NO: 4702340 - DNA, 18 bp, Homo sapiens
atgttttcaaatgttctc

SEQ ID NO: 4702341 - DNA, 17 bp, Homo sapiens
atgtttttgtgtagagt

SEQ ID NO: 4702342 - DNA, 22 bp, Homo sapiens
attaaaaaagagacatccaaat

SEQ ID NO: 4702343 - DNA, 23 bp, Homo sapiens
attaaaaccagtctcagatatca

SEQ ID NO: 4702344 - DNA, 17 bp, Homo sapiens
tcttactaaaaagtata

SEQ ID NO: 4702345 - DNA, 23 bp, Homo sapiens
tcttactttgtgcaaaagcaggc

SEQ ID NO: 4702346 - DNA, 24 bp, Homo sapiens
tcttagagattaaaccaattataa

SEQ ID NO: 4702347 - DNA, 18 bp, Homo sapiens
tcttagctttttaattgt

SEQ ID NO: 4702348 - DNA, 22 bp, Homo sapiens
tcttagctttttaattgttgtt

SEQ ID NO: 4702349 - DNA, 21 bp, Homo sapiens
tcttataaagtggaagtatgt

SEQ ID NO: 4702350 - DNA, 13 bp, Homo sapiens
tcttatgggctgg

SEQ ID NO: 4702351 - DNA, 14 bp, Homo sapiens
tcttatgggctggg

SEQ ID NO: 4702352 - DNA, 22 bp, Homo sapiens
tcttatgttatcaccttccaaa

SEQ ID NO: 4702353 - DNA, 23 bp, Homo sapiens
tcttatgttatcaccttccaaac

SEQ ID NO: 4702354 - DNA, 13 bp, Homo sapiens
tcttattcacttt

SEQ ID NO: 4702355 - DNA, 22 bp, Homo sapiens
tcttattgcccacgctggagtg

SEQ ID NO: 4702356 - DNA, 13 bp, Homo sapiens
tcttattttagaa

SEQ ID NO: 4702357 - DNA, 13 bp, Homo sapiens
tcttcaacattaa

SEQ ID NO: 4702358 - DNA, 13 bp, Homo sapiens
tcttcaatgatca

SEQ ID NO: 4702359 - DNA, 12 bp, Homo sapiens
tcttcagagact

SEQ ID NO: 4702360 - DNA, 12 bp, Homo sapiens
tcttcagagctg

SEQ ID NO: 4702361 - DNA, 14 bp, Homo sapiens
tcttcagaggccct

SEQ ID NO: 4702362 - DNA, 22 bp, Homo sapiens
tcttcagtgtgttgacttctat

SEQ ID NO: 4702363 - DNA, 17 bp, Homo sapiens
tcttccaggctgggaga

SEQ ID NO: 4702364 - DNA, 20 bp, Homo sapiens
tcttctaatcataacatagt

SEQ ID NO: 4702365 - DNA, 24 bp, Homo sapiens
tcttctaatcataacatagttgaa

SEQ ID NO: 4702366 - DNA, 12 bp, Homo sapiens
tcttctatttat

SEQ ID NO: 4702367 - DNA, 22 bp, Homo sapiens
tcttctatttatttatttattc

SEQ ID NO: 4702368 - DNA, 19 bp, Homo sapiens
tcttctcatttcacccctc

SEQ ID NO: 4702369 - DNA, 20 bp, Homo sapiens
tcttctcatttcacccctcc

SEQ ID NO: 4702370 - DNA, 19 bp, Homo sapiens
tcttctgcttcagcctccc

SEQ ID NO: 4702371 - DNA, 22 bp, Homo sapiens
tcttctgcttcagcctcccgag

SEQ ID NO: 4702372 - DNA, 20 bp, Homo sapiens
tcttctgggagggcagcagg

SEQ ID NO: 4702373 - DNA, 22 bp, Homo sapiens
tcttctgggagggcagcagggc

SEQ ID NO: 4702374 - DNA, 23 bp, Homo sapiens
tcttctgggagggcagcagggct

SEQ ID NO: 4702375 - DNA, 18 bp, Homo sapiens
tcttctgggttccttcct

SEQ ID NO: 4702376 - DNA, 23 bp, Homo sapiens
tcttctgtgattcggtggagact

SEQ ID NO: 4702377 - DNA, 15 bp, Homo sapiens
tcttctgtgtttatg

SEQ ID NO: 4702378 - DNA, 17 bp, Homo sapiens
tcttgaactcctgacct

SEQ ID NO: 4702379 - DNA, 15 bp, Homo sapiens
tcttgaactcctggc

SEQ ID NO: 4702380 - DNA, 13 bp, Homo sapiens
tcttgaatttaat

SEQ ID NO: 4702381 - DNA, 16 bp, Homo sapiens
tcttgaccctgtcact

SEQ ID NO: 4702382 - DNA, 17 bp, Homo sapiens
tcttgatcaacatcttt

SEQ ID NO: 4702383 - DNA, 19 bp, Homo sapiens
tcttgatcaacatcttttc

SEQ ID NO: 4702384 - DNA, 23 bp, Homo sapiens
tcttgatcaacatcttttcttgc

SEQ ID NO: 4702385 - DNA, 13 bp, Homo sapiens
tcttgatgcatgc

SEQ ID NO: 4702386 - DNA, 13 bp, Homo sapiens
tcttgcaatggca

SEQ ID NO: 4702387 - DNA, 22 bp, Homo sapiens
tcttgcaatggcagccttggca

SEQ ID NO: 4702388 - DNA, 22 bp, Homo sapiens
tcttgcattgaatttagtcatt

SEQ ID NO: 4702389 - DNA, 14 bp, Homo sapiens
tcttgccagccaca

SEQ ID NO: 4702390 - DNA, 18 bp, Homo sapiens
tcttgccccaacccccag

SEQ ID NO: 4702391 - DNA, 21 bp, Homo sapiens
tcttgccccaacccccagcac

SEQ ID NO: 4702392 - DNA, 16 bp, Homo sapiens
tcttgcctctgtcccc

SEQ ID NO: 4702393 - DNA, 14 bp, Homo sapiens
tcttgctctgctga

SEQ ID NO: 4702394 - DNA, 23 bp, Homo sapiens
tcttgctctgctgacagacacag

SEQ ID NO: 4702395 - DNA, 20 bp, Homo sapiens
tcttgcttggggaacttgtg

SEQ ID NO: 4702396 - DNA, 15 bp, Homo sapiens
tcttggtcctgctgc

SEQ ID NO: 4702397 - DNA, 17 bp, Homo sapiens
tcttggtcctgctgcag

SEQ ID NO: 4702398 - DNA, 18 bp, Homo sapiens
tcttggttagagaagtaa

SEQ ID NO: 4702399 - DNA, 13 bp, Homo sapiens
tcttggttgagga

SEQ ID NO: 4702400 - DNA, 17 bp, Homo sapiens
tcttggttggctggcct

SEQ ID NO: 4702401 - DNA, 22 bp, Homo sapiens
tcttgtattaagttgttaataa

SEQ ID NO: 4702402 - DNA, 16 bp, Homo sapiens
tcttgtattgctccat

SEQ ID NO: 4702403 - DNA, 20 bp, Homo sapiens
tcttgtgaatattgtggctc

SEQ ID NO: 4702404 - DNA, 21 bp, Homo sapiens
tcttgtgtggtttggcccttc

SEQ ID NO: 4702405 - DNA, 20 bp, Homo sapiens
tcttgtttatacctttgcct

SEQ ID NO: 4702406 - DNA, 21 bp, Homo sapiens
tctttaaccctcactgggact

SEQ ID NO: 4702407 - DNA, 21 bp, Homo sapiens
tctttaactgccgtaatttaa

SEQ ID NO: 4702408 - DNA, 18 bp, Homo sapiens
tctttaatgattcctata

SEQ ID NO: 4702409 - DNA, 18 bp, Homo sapiens
tctttaatgtcacaggca

SEQ ID NO: 4702410 - DNA, 15 bp, Homo sapiens
tctttagtttttgtg

SEQ ID NO: 4702411 - DNA, 11 bp, Homo sapiens
tctttcaaaac

SEQ ID NO: 4702412 - DNA, 17 bp, Homo sapiens
tctttcacatttaaata

SEQ ID NO: 4702413 - DNA, 15 bp, Homo sapiens
tctttcctgaggctg

SEQ ID NO: 4702414 - DNA, 17 bp, Homo sapiens
tctttctagtggtcttt

SEQ ID NO: 4702415 - DNA, 14 bp, Homo sapiens
tctttctattttca

SEQ ID NO: 4702416 - DNA, 15 bp, Homo sapiens
tctttctattttcac

SEQ ID NO: 4702417 - DNA, 18 bp, Homo sapiens
tctttcttggtgcattcg

SEQ ID NO: 4702418 - DNA, 14 bp, Homo sapiens
tctttctttgctgc

SEQ ID NO: 4702419 - DNA, 16 bp, Homo sapiens
tctttctttgctgctg

SEQ ID NO: 4702420 - DNA, 16 bp, Homo sapiens
tctttgataatgttaa

SEQ ID NO: 4702421 - DNA, 20 bp, Homo sapiens
tctttgattctccttcagcc

SEQ ID NO: 4702422 - DNA, 23 bp, Homo sapiens
tctttgattctccttcagccctc

SEQ ID NO: 4702423 - DNA, 18 bp, Homo sapiens
tctttgccaacatggtga

SEQ ID NO: 4702424 - DNA, 22 bp, Homo sapiens
tctttgccaccctcatgctgtg

SEQ ID NO: 4702425 - DNA, 23 bp, Homo sapiens
tctttgctgctgtggaaaggatt

SEQ ID NO: 4702426 - DNA, 13 bp, Homo sapiens
tctttgctttgcc

SEQ ID NO: 4702427 - DNA, 17 bp, Homo sapiens
tctttgctttgcccagc

SEQ ID NO: 4702428 - DNA, 15 bp, Homo sapiens
tctttggaccctgag

SEQ ID NO: 4702429 - DNA, 21 bp, Homo sapiens
tctttggaccctgaggcccag

SEQ ID NO: 4702430 - DNA, 22 bp, Homo sapiens
tctttggtctacactgtgctga

SEQ ID NO: 4702431 - DNA, 22 bp, Homo sapiens
tctttggtgaacattgcaatag

SEQ ID NO: 4702432 - DNA, 14 bp, Homo sapiens
tctttgtaagagtg

SEQ ID NO: 4702433 - DNA, 18 bp, Homo sapiens
tctttgtaagagtgtaga

SEQ ID NO: 4702434 - DNA, 21 bp, Homo sapiens
tctttgtaagagtgtagaagc

SEQ ID NO: 4702435 - DNA, 22 bp, Homo sapiens
tctttgtaccacagtttcttct

SEQ ID NO: 4702436 - DNA, 14 bp, Homo sapiens
tctttgtggcttcc

SEQ ID NO: 4702437 - DNA, 16 bp, Homo sapiens
tcttttcacaaataaa

SEQ ID NO: 4702438 - DNA, 22 bp, Homo sapiens
tcttttcccagagaccttctga

SEQ ID NO: 4702439 - DNA, 16 bp, Homo sapiens
tcttttcttgcctctg

SEQ ID NO: 4702440 - DNA, 12 bp, Homo sapiens
tcttttctttac

SEQ ID NO: 4702441 - DNA, 12 bp, Homo sapiens
tctttttattca

SEQ ID NO: 4702442 - DNA, 15 bp, Homo sapiens
tcttttttcttttgg

SEQ ID NO: 4702443 - DNA, 23 bp, Homo sapiens
tctttttttttttttttaaagaa

SEQ ID NO: 4702444 - DNA, 13 bp, Homo sapiens
tgaaaaaaattat

SEQ ID NO: 4702445 - DNA, 13 bp, Homo sapiens
tgaaaaataaata

SEQ ID NO: 4702446 - DNA, 16 bp, Homo sapiens
tgaaaaattatcagtt

SEQ ID NO: 4702447 - DNA, 18 bp, Homo sapiens
tgaaaacactgtgcacat

SEQ ID NO: 4702448 - DNA, 21 bp, Homo sapiens
tgaaaacactgttctctgccc

SEQ ID NO: 4702449 - DNA, 13 bp, Homo sapiens
tgaaaacctgcat

SEQ ID NO: 4702450 - DNA, 13 bp, Homo sapiens
tgaaaagctatta

SEQ ID NO: 4702451 - DNA, 19 bp, Homo sapiens
tgaaaagctattagccagg

SEQ ID NO: 4702452 - DNA, 23 bp, Homo sapiens
tgaaaagctattagccaggatca

SEQ ID NO: 4702453 - DNA, 14 bp, Homo sapiens
tgacaataaaacat

SEQ ID NO: 4702454 - DNA, 22 bp, Homo sapiens
tgacaatgcgtggcacatctaa

SEQ ID NO: 4702455 - DNA, 19 bp, Homo sapiens
tgacacaaacctgcctggg

SEQ ID NO: 4702456 - DNA, 19 bp, Homo sapiens
tgacacacagaaatgtgtc

SEQ ID NO: 4702457 - DNA, 14 bp, Homo sapiens
tgacacacagctct

SEQ ID NO: 4702458 - DNA, 16 bp, Homo sapiens
tgacacacagctctgt

SEQ ID NO: 4702459 - DNA, 18 bp, Homo sapiens
tgacacacagctctgtcc

SEQ ID NO: 4702460 - DNA, 20 bp, Homo sapiens
tgacacacagctctgtcctg

SEQ ID NO: 4702461 - DNA, 16 bp, Homo sapiens
tgacacaggatgaagg

SEQ ID NO: 4702462 - DNA, 15 bp, Homo sapiens
tgacaccaaaatgaa

SEQ ID NO: 4702463 - DNA, 14 bp, Homo sapiens
tgacactcccttgg

SEQ ID NO: 4702464 - DNA, 15 bp, Homo sapiens
tgacagaacactgtc

SEQ ID NO: 4702465 - DNA, 21 bp, Homo sapiens
tgacagaacactgtcttgaag

SEQ ID NO: 4702466 - DNA, 17 bp, Homo sapiens
tgacagacacaggcccg

SEQ ID NO: 4702467 - DNA, 14 bp, Homo sapiens
tgacagagtgagac

SEQ ID NO: 4702468 - DNA, 22 bp, Homo sapiens
tgacagagtgagactctgtctc

SEQ ID NO: 4702469 - DNA, 13 bp, Homo sapiens
tgacagatatatt

SEQ ID NO: 4702470 - DNA, 21 bp, Homo sapiens
tgacagatatatttaagcctt

SEQ ID NO: 4702471 - DNA, 22 bp, Homo sapiens
tgacagatatatttaagcctta

SEQ ID NO: 4702472 - DNA, 22 bp, Homo sapiens
tgacagatcctccatttttgtt

SEQ ID NO: 4702473 - DNA, 19 bp, Homo sapiens
tgacaggaaagattcatgt

SEQ ID NO: 4702474 - DNA, 20 bp, Homo sapiens
tgacaggattccctccacaa

SEQ ID NO: 4702475 - DNA, 15 bp, Homo sapiens
tgacaggcagcagag

SEQ ID NO: 4702476 - DNA, 16 bp, Homo sapiens
tgacaggcagcagaga

SEQ ID NO: 4702477 - DNA, 20 bp, Homo sapiens
tgacagggcacaccgggcac

SEQ ID NO: 4702478 - DNA, 15 bp, Homo sapiens
tgacagtcctctcca

SEQ ID NO: 4702479 - DNA, 13 bp, Homo sapiens
tgacatgtctttt

SEQ ID NO: 4702480 - DNA, 15 bp, Homo sapiens
tgacatgtgaaacct

SEQ ID NO: 4702481 - DNA, 17 bp, Homo sapiens
tgacatgtgaaaccttt

SEQ ID NO: 4702482 - DNA, 15 bp, Homo sapiens
tgacattcatgcctg

SEQ ID NO: 4702483 - DNA, 21 bp, Homo sapiens
tgacattgttggccaaagcca

SEQ ID NO: 4702484 - DNA, 21 bp, Homo sapiens
tgacatttggagtgttcccct

SEQ ID NO: 4702485 - DNA, 19 bp, Homo sapiens
tgaccaatattgtacagtt

SEQ ID NO: 4702486 - DNA, 15 bp, Homo sapiens
tgaccaatgtcttga

SEQ ID NO: 4702487 - DNA, 12 bp, Homo sapiens
tgaccacataga

SEQ ID NO: 4702488 - DNA, 12 bp, Homo sapiens
tgaccaggcctg

SEQ ID NO: 4702489 - DNA, 20 bp, Homo sapiens
tgaccagtttaacctgatgc

SEQ ID NO: 4702490 - DNA, 21 bp, Homo sapiens
tgaccagtttaacctgatgca

SEQ ID NO: 4702491 - DNA, 12 bp, Homo sapiens
tgaccatgtgat

SEQ ID NO: 4702492 - DNA, 17 bp, Homo sapiens
tgaccattctccacctg

SEQ ID NO: 4702493 - DNA, 20 bp, Homo sapiens
tgaccattctccacctgcca

SEQ ID NO: 4702494 - DNA, 22 bp, Homo sapiens
tgaccattctccacctgccagg

SEQ ID NO: 4702495 - DNA, 23 bp, Homo sapiens
tgaccattctccacctgccaggg

SEQ ID NO: 4702496 - DNA, 12 bp, Homo sapiens
tgacccaggctg

SEQ ID NO: 4702497 - DNA, 14 bp, Homo sapiens
tgacccaggctggg

SEQ ID NO: 4702498 - DNA, 15 bp, Homo sapiens
tgacccaggctgggc

SEQ ID NO: 4702499 - DNA, 18 bp, Homo sapiens
tgacccatgctgccctgt

SEQ ID NO: 4702500 - DNA, 20 bp, Homo sapiens
tgacccatgctgccctgtga

SEQ ID NO: 4702501 - DNA, 19 bp, Homo sapiens
tgacccctcatagccctca

SEQ ID NO: 4702502 - DNA, 22 bp, Homo sapiens
tgaccccttttcagcttctgct

SEQ ID NO: 4702503 - DNA, 22 bp, Homo sapiens
tgacctcaggtgatccacccac

SEQ ID NO: 4702504 - DNA, 15 bp, Homo sapiens
tgacctgaactctgc

SEQ ID NO: 4702505 - DNA, 17 bp, Homo sapiens
tgacctgcaaaaatgct

SEQ ID NO: 4702506 - DNA, 19 bp, Homo sapiens
tgacctgccaggcacactg

SEQ ID NO: 4702507 - DNA, 21 bp, Homo sapiens
tgacctgcctcccttcatgca

SEQ ID NO: 4702508 - DNA, 17 bp, Homo sapiens
tgaccttctaggaagct

SEQ ID NO: 4702509 - DNA, 22 bp, Homo sapiens
tgaccttgaggagtcttgtgtg

SEQ ID NO: 4702510 - DNA, 13 bp, Homo sapiens
tgacgcagcctga

SEQ ID NO: 4702511 - DNA, 15 bp, Homo sapiens
tgacgcagcctgaga

SEQ ID NO: 4702512 - DNA, 16 bp, Homo sapiens
tgacgcagcctgagaa

SEQ ID NO: 4702513 - DNA, 19 bp, Homo sapiens
tgacgcagcctgagaatga

SEQ ID NO: 4702514 - DNA, 18 bp, Homo sapiens
tgacgccatcccagcccc

SEQ ID NO: 4702515 - DNA, 22 bp, Homo sapiens
tgacgccgcgcactcagccgtg

SEQ ID NO: 4702516 - DNA, 18 bp, Homo sapiens
tgacgtaagctctatctg

SEQ ID NO: 4702517 - DNA, 17 bp, Homo sapiens
tgactaacaggccaaag

SEQ ID NO: 4702518 - DNA, 16 bp, Homo sapiens
tgactacagtcaggaa

SEQ ID NO: 4702519 - DNA, 13 bp, Homo sapiens
tgactcagggctc

SEQ ID NO: 4702520 - DNA, 14 bp, Homo sapiens
tgactcagggctcc

SEQ ID NO: 4702521 - DNA, 15 bp, Homo sapiens
tgactcagggctcct

SEQ ID NO: 4702522 - DNA, 19 bp, Homo sapiens
tgactcagggctcctgggt

SEQ ID NO: 4702523 - DNA, 13 bp, Homo sapiens
tgactccaggaag

SEQ ID NO: 4702524 - DNA, 15 bp, Homo sapiens
tgactccaggaagaa

SEQ ID NO: 4702525 - DNA, 15 bp, Homo sapiens
tgactccttctgcca

SEQ ID NO: 4702526 - DNA, 17 bp, Homo sapiens
tgactcgggctcctgtg

SEQ ID NO: 4702527 - DNA, 19 bp, Homo sapiens
tgactcgggctcctgtgcc

SEQ ID NO: 4702528 - DNA, 11 bp, Homo sapiens
tgactgagctt

SEQ ID NO: 4702529 - DNA, 12 bp, Homo sapiens
tgactgttgtac

SEQ ID NO: 4702530 - DNA, 15 bp, Homo sapiens
tgactgttgttctta

SEQ ID NO: 4702531 - DNA, 20 bp, Homo sapiens
tgacttatttatataaattt

SEQ ID NO: 4702532 - DNA, 16 bp, Homo sapiens
tgacttctatcctgtt

SEQ ID NO: 4702533 - DNA, 19 bp, Homo sapiens
tgacttgacagaacactgt

SEQ ID NO: 4702534 - DNA, 14 bp, Homo sapiens
tgacttttctgacc

SEQ ID NO: 4702535 - DNA, 14 bp, Homo sapiens
tgacttttgaagaa

SEQ ID NO: 4702536 - DNA, 21 bp, Homo sapiens
tgagaacatggtgtgtgtctc

SEQ ID NO: 4702537 - DNA, 24 bp, Homo sapiens
tgagaacatggtgtgtgtctctga

SEQ ID NO: 4702538 - DNA, 12 bp, Homo sapiens
tgagaagggctc

SEQ ID NO: 4702539 - DNA, 21 bp, Homo sapiens
tgagaagggctcagagaggac

SEQ ID NO: 4702540 - DNA, 20 bp, Homo sapiens
tgagaagtactttgtgctga

SEQ ID NO: 4702541 - DNA, 21 bp, Homo sapiens
tgagaagtactttgtgctgat

SEQ ID NO: 4702542 - DNA, 22 bp, Homo sapiens
tgagaatgacctgccctggccc

SEQ ID NO: 4702543 - DNA, 20 bp, Homo sapiens
tgagaatttgagtgctctga

SEQ ID NO: 4702544 - DNA, 11 bp, Homo sapiens
tgagacagagt

SEQ ID NO: 4702545 - DNA, 13 bp, Homo sapiens
tgagacagcccgg

SEQ ID NO: 4702546 - DNA, 16 bp, Homo sapiens
tgagacagtttcttag

SEQ ID NO: 4702547 - DNA, 20 bp, Homo sapiens
tgagacagtttcttagcttt

SEQ ID NO: 4702548 - DNA, 21 bp, Homo sapiens
tgagacagtttcttagctttt

SEQ ID NO: 4702549 - DNA, 13 bp, Homo sapiens
tgagaccagcctg

SEQ ID NO: 4702550 - DNA, 20 bp, Homo sapiens
tgagacccagccctcatccc

SEQ ID NO: 4702551 - DNA, 16 bp, Homo sapiens
tgagactccacctcaa

SEQ ID NO: 4702552 - DNA, 16 bp, Homo sapiens
tgagactcgagaactt

SEQ ID NO: 4702553 - DNA, 14 bp, Homo sapiens
tgagactctgtctc

SEQ ID NO: 4702554 - DNA, 13 bp, Homo sapiens
tgagagcataatt

SEQ ID NO: 4702555 - DNA, 19 bp, Homo sapiens
tgagagcccagaggtaaca

SEQ ID NO: 4702556 - DNA, 14 bp, Homo sapiens
tgagagctgggtgt

SEQ ID NO: 4702557 - DNA, 16 bp, Homo sapiens
tgagagggccctgcct

SEQ ID NO: 4702558 - DNA, 22 bp, Homo sapiens
tgagagttcgtgaagagggaag

SEQ ID NO: 4702559 - DNA, 20 bp, Homo sapiens
tgagataccagcgaggaggc

SEQ ID NO: 4702560 - DNA, 13 bp, Homo sapiens
tgagatttcatct

SEQ ID NO: 4702561 - DNA, 13 bp, Homo sapiens
tgagcagggctca

SEQ ID NO: 4702562 - DNA, 19 bp, Homo sapiens
tgagcagggctcagcgggg

SEQ ID NO: 4702563 - DNA, 17 bp, Homo sapiens
tgatgaaaataaagaat

SEQ ID NO: 4702564 - DNA, 19 bp, Homo sapiens
tgatgaaaataaagaatgg

SEQ ID NO: 4702565 - DNA, 23 bp, Homo sapiens
tgatgaaatgaggtcagagcctg

SEQ ID NO: 4702566 - DNA, 16 bp, Homo sapiens
tgatgactggttgttc

SEQ ID NO: 4702567 - DNA, 19 bp, Homo sapiens
tgatgactggttgttcaaa

SEQ ID NO: 4702568 - DNA, 14 bp, Homo sapiens
tgatgaggccctcc

SEQ ID NO: 4702569 - DNA, 16 bp, Homo sapiens
tgatgatgtgcctggg

SEQ ID NO: 4702570 - DNA, 18 bp, Homo sapiens
tgatgcatgcactgttcc

SEQ ID NO: 4702571 - DNA, 15 bp, Homo sapiens
tgatgccacaccaag

SEQ ID NO: 4702572 - DNA, 17 bp, Homo sapiens
tgatgtcatctgtcact

SEQ ID NO: 4702573 - DNA, 18 bp, Homo sapiens
tgatgtgggtcaaggaat

SEQ ID NO: 4702574 - DNA, 15 bp, Homo sapiens
tgatgttggctggga

SEQ ID NO: 4702575 - DNA, 16 bp, Homo sapiens
tgatgttggctgggaa

SEQ ID NO: 4702576 - DNA, 17 bp, Homo sapiens
tgatgtttataaactga

SEQ ID NO: 4702577 - DNA, 22 bp, Homo sapiens
tgattagataatcttttacatt

SEQ ID NO: 4702578 - DNA, 13 bp, Homo sapiens
tgattcagacagc

SEQ ID NO: 4702579 - DNA, 16 bp, Homo sapiens
tgattcagacagctgc

SEQ ID NO: 4702580 - DNA, 21 bp, Homo sapiens
tgattcagacagctgcctggg

SEQ ID NO: 4702581 - DNA, 19 bp, Homo sapiens
tgattcccaagctctgctc

SEQ ID NO: 4702582 - DNA, 22 bp, Homo sapiens
tgattcccaagctctgctcctc

SEQ ID NO: 4702583 - DNA, 14 bp, Homo sapiens
tgattcccttttct

SEQ ID NO: 4702584 - DNA, 19 bp, Homo sapiens
tgattctcagggtctctgc

SEQ ID NO: 4702585 - DNA, 14 bp, Homo sapiens
tgattctcatgcct

SEQ ID NO: 4702586 - DNA, 16 bp, Homo sapiens
tgattctccttcagcc

SEQ ID NO: 4702587 - DNA, 18 bp, Homo sapiens
tgattctccttcagccct

SEQ ID NO: 4702588 - DNA, 19 bp, Homo sapiens
tgattctccttcagccctc

SEQ ID NO: 4702589 - DNA, 13 bp, Homo sapiens
tgatttaataaaa

SEQ ID NO: 4702590 - DNA, 14 bp, Homo sapiens
tgatttacatgctg

SEQ ID NO: 4702591 - DNA, 17 bp, Homo sapiens
tgatttagcaatgctgt

SEQ ID NO: 4702592 - DNA, 21 bp, Homo sapiens
tgatttcagcacctacagtgt

SEQ ID NO: 4702593 - DNA, 18 bp, Homo sapiens
tgatttcccgtggcccca

SEQ ID NO: 4702594 - DNA, 22 bp, Homo sapiens
tgatttcccgtggccccagcct

SEQ ID NO: 4702595 - DNA, 15 bp, Homo sapiens
tgatttcgatgtaca

SEQ ID NO: 4702596 - DNA, 22 bp, Homo sapiens
tgatttcgatgtacagtctcaa

SEQ ID NO: 4702597 - DNA, 19 bp, Homo sapiens
tgattttgctgtagaagat

SEQ ID NO: 4702598 - DNA, 13 bp, Homo sapiens
tgattttgtatat

SEQ ID NO: 4702599 - DNA, 18 bp, Homo sapiens
tgattttgtatatgaaaa

SEQ ID NO: 4702600 - DNA, 23 bp, Homo sapiens
tgatttttaatttttttaaattt

SEQ ID NO: 4702601 - DNA, 14 bp, Homo sapiens
tgatttttgtgtat

SEQ ID NO: 4702602 - DNA, 20 bp, Homo sapiens
tgatttttgtgtatccagta

SEQ ID NO: 4702603 - DNA, 17 bp, Homo sapiens
tgattttttttaattac

SEQ ID NO: 4702604 - DNA, 15 bp, Homo sapiens
tgcaaaagcaggctt

SEQ ID NO: 4702605 - DNA, 23 bp, Homo sapiens
tgcaaagtcatgcaaaggctggg

SEQ ID NO: 4702606 - DNA, 15 bp, Homo sapiens
tgcaacagtaatcag

SEQ ID NO: 4702607 - DNA, 23 bp, Homo sapiens
tgcaacatggattccaaagcatt

SEQ ID NO: 4702608 - DNA, 21 bp, Homo sapiens
tgcaacctccgcctcttgggt

SEQ ID NO: 4702609 - DNA, 19 bp, Homo sapiens
tgcaacctcgctggactct

SEQ ID NO: 4702610 - DNA, 13 bp, Homo sapiens
tgcaactcttgta

SEQ ID NO: 4702611 - DNA, 16 bp, Homo sapiens
tgcaactgaatacttg

SEQ ID NO: 4702612 - DNA, 16 bp, Homo sapiens
tgcaacttgtaaatgt

SEQ ID NO: 4702613 - DNA, 18 bp, Homo sapiens
tgcaacttgtgaactcca

SEQ ID NO: 4702614 - DNA, 17 bp, Homo sapiens
tgcaagtgggagatgaa

SEQ ID NO: 4702615 - DNA, 20 bp, Homo sapiens
tgcaatagaacagagaaaga

SEQ ID NO: 4702616 - DNA, 16 bp, Homo sapiens
tgcaatggcagccttg

SEQ ID NO: 4702617 - DNA, 19 bp, Homo sapiens
tgcaatgggggagggaggg

SEQ ID NO: 4702618 - DNA, 12 bp, Homo sapiens
tgcaatgttttt

SEQ ID NO: 4702619 - DNA, 15 bp, Homo sapiens
tgcacaaactcacca

SEQ ID NO: 4702620 - DNA, 21 bp, Homo sapiens
tgcacaaccatctgtccctgc

SEQ ID NO: 4702621 - DNA, 18 bp, Homo sapiens
tgcacaagctccaagctc

SEQ ID NO: 4702622 - DNA, 20 bp, Homo sapiens
tgcacaataaaaccaagcct

SEQ ID NO: 4702623 - DNA, 15 bp, Homo sapiens
tgcacacaccagagc

SEQ ID NO: 4702624 - DNA, 17 bp, Homo sapiens
tgcacacaccagagccc

SEQ ID NO: 4702625 - DNA, 24 bp, Homo sapiens
tgcacacagcacgggggccaagga

SEQ ID NO: 4702626 - DNA, 17 bp, Homo sapiens
tgcacacctttattcag

SEQ ID NO: 4702627 - DNA, 16 bp, Homo sapiens
tgcacactcagttctg

SEQ ID NO: 4702628 - DNA, 18 bp, Homo sapiens
tgcacagttgccacattt

SEQ ID NO: 4702629 - DNA, 23 bp, Homo sapiens
tgcacatagttctgcccaaatta

SEQ ID NO: 4702630 - DNA, 16 bp, Homo sapiens
tgcacatctgtgtctt

SEQ ID NO: 4702631 - DNA, 19 bp, Homo sapiens
tgcacatctgtgtcttgtt

SEQ ID NO: 4702632 - DNA, 13 bp, Homo sapiens
tgcacatctgttt

SEQ ID NO: 4702633 - DNA, 23 bp, Homo sapiens
tgcaccagggttgaccccagagg

SEQ ID NO: 4702634 - DNA, 16 bp, Homo sapiens
tgcaccattctttctt

SEQ ID NO: 4702635 - DNA, 16 bp, Homo sapiens
tgcaccccctcctgct

SEQ ID NO: 4702636 - DNA, 17 bp, Homo sapiens
tgcaccccctcctgctg

SEQ ID NO: 4702637 - DNA, 19 bp, Homo sapiens
tgcaccccctcctgctgca

SEQ ID NO: 4702638 - DNA, 16 bp, Homo sapiens
tgcaccggctggcctg

SEQ ID NO: 4702639 - DNA, 19 bp, Homo sapiens
tgcaccggctggcctggcc

SEQ ID NO: 4702640 - DNA, 15 bp, Homo sapiens
tgcaccgggccacag

SEQ ID NO: 4702641 - DNA, 15 bp, Homo sapiens
tgcacctgcagcgcg

SEQ ID NO: 4702642 - DNA, 13 bp, Homo sapiens
tgcaccttctgac

SEQ ID NO: 4702643 - DNA, 21 bp, Homo sapiens
tgcaccttctgacgcagcctg

SEQ ID NO: 4702644 - DNA, 19 bp, Homo sapiens
tgcacgtacacacacatac

SEQ ID NO: 4702645 - DNA, 12 bp, Homo sapiens
tgcacgtgtgtt

SEQ ID NO: 4702646 - DNA, 19 bp, Homo sapiens
tgcacgtgtgtttttctat

SEQ ID NO: 4702647 - DNA, 23 bp, Homo sapiens
tgcactatagcctaggtgacaga

SEQ ID NO: 4702648 - DNA, 14 bp, Homo sapiens
tgcactccagcctg

SEQ ID NO: 4702649 - DNA, 21 bp, Homo sapiens
tgcactctgtgcccatgggca

SEQ ID NO: 4702650 - DNA, 13 bp, Homo sapiens
tgcactgaaaacc

SEQ ID NO: 4702651 - DNA, 18 bp, Homo sapiens
tgcactgacattgttggc

SEQ ID NO: 4702652 - DNA, 16 bp, Homo sapiens
tgcactgtcctgctcc

SEQ ID NO: 4702653 - DNA, 20 bp, Homo sapiens
tgcactgttccccctgtgca

SEQ ID NO: 4702654 - DNA, 22 bp, Homo sapiens
tgcacttgcggttccggcatgg

SEQ ID NO: 4702655 - DNA, 15 bp, Homo sapiens
tgcactttgttctgg

SEQ ID NO: 4702656 - DNA, 20 bp, Homo sapiens
tgcagactctacagaggcca

SEQ ID NO: 4702657 - DNA, 15 bp, Homo sapiens
tgcagagagccattt

SEQ ID NO: 4702658 - DNA, 17 bp, Homo sapiens
tgcagagagccattttg

SEQ ID NO: 4702659 - DNA, 22 bp, Homo sapiens
tgcagaggggcaggccctgcac

SEQ ID NO: 4702660 - DNA, 19 bp, Homo sapiens
tgcagaggtccacaacaca

SEQ ID NO: 4702661 - DNA, 20 bp, Homo sapiens
tgcagatttctgccttgaaa

SEQ ID NO: 4702662 - DNA, 16 bp, Homo sapiens
tgcagatttgggctgg

SEQ ID NO: 4702663 - DNA, 14 bp, Homo sapiens
tgcagcaatattct

SEQ ID NO: 4702664 - DNA, 21 bp, Homo sapiens
tgcagcaggatctagaggggg

SEQ ID NO: 4702665 - DNA, 14 bp, Homo sapiens
tgcagccctgctgc

SEQ ID NO: 4702666 - DNA, 14 bp, Homo sapiens
tgcagccgctgagc

SEQ ID NO: 4702667 - DNA, 23 bp, Homo sapiens
tgcagcctcaacctcctgggcta

SEQ ID NO: 4702668 - DNA, 17 bp, Homo sapiens
tgcagcctcacagtcct

SEQ ID NO: 4702669 - DNA, 12 bp, Homo sapiens
tgcagcctcaga

SEQ ID NO: 4702670 - DNA, 20 bp, Homo sapiens
tgcagctctgcagcaatatt

SEQ ID NO: 4702671 - DNA, 14 bp, Homo sapiens
tgcaggaaggagct

SEQ ID NO: 4702672 - DNA, 18 bp, Homo sapiens
tgcaggaaggagctgcct

SEQ ID NO: 4702673 - DNA, 18 bp, Homo sapiens
tgccccctgcaggaagga

SEQ ID NO: 4702674 - DNA, 21 bp, Homo sapiens
tgccccctgcaggaaggagct

SEQ ID NO: 4702675 - DNA, 21 bp, Homo sapiens
tgccccgcaggcctgccttct

SEQ ID NO: 4702676 - DNA, 16 bp, Homo sapiens
tgcccctagcttagag

SEQ ID NO: 4702677 - DNA, 23 bp, Homo sapiens
tgcccctagcttagagcctccct

SEQ ID NO: 4702678 - DNA, 18 bp, Homo sapiens
tgcccctccctgcctcca

SEQ ID NO: 4702679 - DNA, 19 bp, Homo sapiens
tgcccctcctctctgccct

SEQ ID NO: 4702680 - DNA, 20 bp, Homo sapiens
tgcccctcctctctgcccta

SEQ ID NO: 4702681 - DNA, 17 bp, Homo sapiens
tgcccgctcccagtgtc

SEQ ID NO: 4702682 - DNA, 15 bp, Homo sapiens
tgcccggcgccctct

SEQ ID NO: 4702683 - DNA, 22 bp, Homo sapiens
tgcccggcgccctctgtcctga

SEQ ID NO: 4702684 - DNA, 23 bp, Homo sapiens
tgccctaatgcgcaggctggccc

SEQ ID NO: 4702685 - DNA, 15 bp, Homo sapiens
tgccctcccatcccg

SEQ ID NO: 4702686 - DNA, 15 bp, Homo sapiens
tgccctgcccacctg

SEQ ID NO: 4702687 - DNA, 21 bp, Homo sapiens
tgccctgcccacctggcctct

SEQ ID NO: 4702688 - DNA, 22 bp, Homo sapiens
tgccctgcccacctggcctctg

SEQ ID NO: 4702689 - DNA, 17 bp, Homo sapiens
tgccctgggaggcagtg

SEQ ID NO: 4702690 - DNA, 18 bp, Homo sapiens
tgccctggtttcctgccc

SEQ ID NO: 4702691 - DNA, 23 bp, Homo sapiens
tgccctgtgagtactacagtcct

SEQ ID NO: 4702692 - DNA, 18 bp, Homo sapiens
tgcccttacacttactgt

SEQ ID NO: 4702693 - DNA, 14 bp, Homo sapiens
tgccgccccaccca

SEQ ID NO: 4702694 - DNA, 17 bp, Homo sapiens
tgccgccgcctcgccca

SEQ ID NO: 4702695 - DNA, 18 bp, Homo sapiens
tgccgccgcctcgcccac

SEQ ID NO: 4702696 - DNA, 14 bp, Homo sapiens
tgccgtaatttaac

SEQ ID NO: 4702697 - DNA, 14 bp, Homo sapiens
tgcctaccatttca

SEQ ID NO: 4702698 - DNA, 15 bp, Homo sapiens
tgcctaccttgtgag

SEQ ID NO: 4702699 - DNA, 17 bp, Homo sapiens
tgcctacgtgacaacac

SEQ ID NO: 4702700 - DNA, 12 bp, Homo sapiens
tgcctcagcctc

SEQ ID NO: 4702701 - DNA, 13 bp, Homo sapiens
tgcctcagcctcc

SEQ ID NO: 4702702 - DNA, 15 bp, Homo sapiens
tgcctcagcctcctg

SEQ ID NO: 4702703 - DNA, 21 bp, Homo sapiens
tgcctcattttagaaccacca

SEQ ID NO: 4702704 - DNA, 21 bp, Homo sapiens
tgcctccacccacagtggaga

SEQ ID NO: 4702705 - DNA, 13 bp, Homo sapiens
tgcctccactccc

SEQ ID NO: 4702706 - DNA, 17 bp, Homo sapiens
tgcctccactcccactt

SEQ ID NO: 4702707 - DNA, 20 bp, Homo sapiens
tgcctccactcccacttccc

SEQ ID NO: 4702708 - DNA, 14 bp, Homo sapiens
tgcctccagggctg

SEQ ID NO: 4702709 - DNA, 20 bp, Homo sapiens
tgcctccagggctggactga

SEQ ID NO: 4702710 - DNA, 21 bp, Homo sapiens
tgcctccagggctggactgag

SEQ ID NO: 4702711 - DNA, 17 bp, Homo sapiens
tgcctcctttgtgagga

SEQ ID NO: 4702712 - DNA, 18 bp, Homo sapiens
tgcctcctttgtgaggaa

SEQ ID NO: 4702713 - DNA, 19 bp, Homo sapiens
tgcctcgaactggctgcaa

SEQ ID NO: 4702714 - DNA, 20 bp, Homo sapiens
tgcctcgaactggctgcaaa

SEQ ID NO: 4702715 - DNA, 14 bp, Homo sapiens
tgcctcggctcctg

SEQ ID NO: 4702716 - DNA, 16 bp, Homo sapiens
tgcctcggctcctgct

SEQ ID NO: 4702717 - DNA, 20 bp, Homo sapiens
tgcctcggctcctgctgcac

SEQ ID NO: 4702718 - DNA, 23 bp, Homo sapiens
tgcctctacctgacactcccttg

SEQ ID NO: 4702719 - DNA, 16 bp, Homo sapiens
tgcctctgacacacag

SEQ ID NO: 4702720 - DNA, 12 bp, Homo sapiens
tgcctctgcctc

SEQ ID NO: 4702721 - DNA, 13 bp, Homo sapiens
tgcctctgcctct

SEQ ID NO: 4702722 - DNA, 17 bp, Homo sapiens
tgcctctgcctctgaca

SEQ ID NO: 4702723 - DNA, 18 bp, Homo sapiens
tgcctctgcctctgacac

SEQ ID NO: 4702724 - DNA, 20 bp, Homo sapiens
tgcctcttctgggagggcag

SEQ ID NO: 4702725 - DNA, 21 bp, Homo sapiens
tgcctcttctgggagggcagc

SEQ ID NO: 4702726 - DNA, 14 bp, Homo sapiens
tgcctcttttcaca

SEQ ID NO: 4702727 - DNA, 19 bp, Homo sapiens
tgcctcttttcacattttt

SEQ ID NO: 4702728 - DNA, 15 bp, Homo sapiens
tgcctgaagacccca

SEQ ID NO: 4702729 - DNA, 18 bp, Homo sapiens
tgcctgacatttggagtg

SEQ ID NO: 4702730 - DNA, 14 bp, Homo sapiens
tgcctgagcccctc

SEQ ID NO: 4702731 - DNA, 15 bp, Homo sapiens
tgcctgattgccaag

SEQ ID NO: 4702732 - DNA, 20 bp, Homo sapiens
tgcctgattgccaagctcag

SEQ ID NO: 4702733 - DNA, 17 bp, Homo sapiens
tgcctgcacaaactcac

SEQ ID NO: 4702734 - DNA, 19 bp, Homo sapiens
tgcctgcacaaactcacca

SEQ ID NO: 4702735 - DNA, 15 bp, Homo sapiens
tgcctgcccaggccc

SEQ ID NO: 4702736 - DNA, 16 bp, Homo sapiens
tgcctgcccaggcccc

SEQ ID NO: 4702737 - DNA, 18 bp, Homo sapiens
tgcctgcccaggcccctg

SEQ ID NO: 4702738 - DNA, 19 bp, Homo sapiens
tgcctgcccaggcccctgc

SEQ ID NO: 4702739 - DNA, 15 bp, Homo sapiens
tgcctggatggggct

SEQ ID NO: 4702740 - DNA, 20 bp, Homo sapiens
tgcctggatggggctgcacc

SEQ ID NO: 4702741 - DNA, 21 bp, Homo sapiens
tgcctggatggggctgcaccg

SEQ ID NO: 4702742 - DNA, 17 bp, Homo sapiens
tgcctgttcagctccag

SEQ ID NO: 4702743 - DNA, 21 bp, Homo sapiens
tgccttattagagtgtctttc

SEQ ID NO: 4702744 - DNA, 15 bp, Homo sapiens
tgccttcctcctggg

SEQ ID NO: 4702745 - DNA, 19 bp, Homo sapiens
tgccttcctcctgggccct

SEQ ID NO: 4702746 - DNA, 12 bp, Homo sapiens
tgccttccttgc

SEQ ID NO: 4702747 - DNA, 16 bp, Homo sapiens
tgcctttatttgctgt

SEQ ID NO: 4702748 - DNA, 13 bp, Homo sapiens
tgcctttgagaca

SEQ ID NO: 4702749 - DNA, 19 bp, Homo sapiens
tgcctttgagacagtttct

SEQ ID NO: 4702750 - DNA, 19 bp, Homo sapiens
tgcgaccccatctgcccag

SEQ ID NO: 4702751 - DNA, 12 bp, Homo sapiens
tgcgagagatgt

SEQ ID NO: 4702752 - DNA, 13 bp, Homo sapiens
tgcgagagatgtg

SEQ ID NO: 4702753 - DNA, 15 bp, Homo sapiens
tgcgagagatgtgtg

SEQ ID NO: 4702754 - DNA, 19 bp, Homo sapiens
tgcgatctgggttcactgc

SEQ ID NO: 4702755 - DNA, 19 bp, Homo sapiens
tgcgattatctacccacgt

SEQ ID NO: 4702756 - DNA, 23 bp, Homo sapiens
tgcgcaggctggccctgccctgg

SEQ ID NO: 4702757 - DNA, 17 bp, Homo sapiens
tgcgcgcacaatagtaa

SEQ ID NO: 4702758 - DNA, 17 bp, Homo sapiens
tgcggacagccacggcc

SEQ ID NO: 4702759 - DNA, 21 bp, Homo sapiens
tgcgggcattttgaatgtgat

SEQ ID NO: 4702760 - DNA, 14 bp, Homo sapiens
tgcggtctagggaa

SEQ ID NO: 4702761 - DNA, 19 bp, Homo sapiens
tgcgtccacgagctgttta

SEQ ID NO: 4702762 - DNA, 23 bp, Homo sapiens
tgcgtctgtgtgtgcctgtgtgc

SEQ ID NO: 4702763 - DNA, 14 bp, Homo sapiens
tgcgtgacaataaa

SEQ ID NO: 4702764 - DNA, 21 bp, Homo sapiens
tgctaaaatattttagatgtt

SEQ ID NO: 4702765 - DNA, 22 bp, Homo sapiens
tgctaaaatattttagatgtta

SEQ ID NO: 4702766 - DNA, 19 bp, Homo sapiens
tgctacgtacatgtgaggc

SEQ ID NO: 4702767 - DNA, 20 bp, Homo sapiens
tgctaggaacactccttcac

SEQ ID NO: 4702768 - DNA, 21 bp, Homo sapiens
tgctaggaacactccttcaca

SEQ ID NO: 4702769 - DNA, 23 bp, Homo sapiens
tgctagtgctgtaatattgtaaa

SEQ ID NO: 4702770 - DNA, 16 bp, Homo sapiens
tgctatcaagaaatgc

SEQ ID NO: 4702771 - DNA, 17 bp, Homo sapiens
tgctatctcccccagcc

SEQ ID NO: 4702772 - DNA, 20 bp, Homo sapiens
tgctatctcccccagcccca

SEQ ID NO: 4702773 - DNA, 16 bp, Homo sapiens
tgctcacatatctgtc

SEQ ID NO: 4702774 - DNA, 17 bp, Homo sapiens
tgctcacatatctgtca

SEQ ID NO: 4702775 - DNA, 14 bp, Homo sapiens
tgctcacatgtctt

SEQ ID NO: 4702776 - DNA, 15 bp, Homo sapiens
tgctcacatgtcttt

SEQ ID NO: 4702777 - DNA, 18 bp, Homo sapiens
tgctcagttcagaatcac

SEQ ID NO: 4702778 - DNA, 18 bp, Homo sapiens
tgctcatctgcagcctcc

SEQ ID NO: 4702779 - DNA, 19 bp, Homo sapiens
tgctcatgggctgtgtgat

SEQ ID NO: 4702780 - DNA, 12 bp, Homo sapiens
tgctccagcctg

SEQ ID NO: 4702781 - DNA, 14 bp, Homo sapiens
tgctccagcctgac

SEQ ID NO: 4702782 - DNA, 12 bp, Homo sapiens
aaatcaattttt

SEQ ID NO: 4702783 - DNA, 14 bp, Homo sapiens
aaatccaatattgt

SEQ ID NO: 4702784 - DNA, 15 bp, Homo sapiens
aaatcctgaagagca

SEQ ID NO: 4702785 - DNA, 13 bp, Homo sapiens
aaatctgacatat

SEQ ID NO: 4702786 - DNA, 15 bp, Homo sapiens
aaatctgacatatta

SEQ ID NO: 4702787 - DNA, 15 bp, Homo sapiens
aaatctgttgttcca

SEQ ID NO: 4702788 - DNA, 16 bp, Homo sapiens
aaatctgttgttccaa

SEQ ID NO: 4702789 - DNA, 12 bp, Homo sapiens
aaatcttcagct

SEQ ID NO: 4702790 - DNA, 14 bp, Homo sapiens
aaatgaaagtgaga

SEQ ID NO: 4702791 - DNA, 15 bp, Homo sapiens
aaatgaaatgcatat

SEQ ID NO: 4702792 - DNA, 17 bp, Homo sapiens
aaatgaacacatggcag

SEQ ID NO: 4702793 - DNA, 13 bp, Homo sapiens
aaatgaatggttc

SEQ ID NO: 4702794 - DNA, 19 bp, Homo sapiens
aaatgagctacttcttatt

SEQ ID NO: 4702795 - DNA, 21 bp, Homo sapiens
aaatgagctcaaattgatttt

SEQ ID NO: 4702796 - DNA, 20 bp, Homo sapiens
aaatgaggaggtacattgaa

SEQ ID NO: 4702797 - DNA, 17 bp, Homo sapiens
aaatgaggtcagagcct

SEQ ID NO: 4702798 - DNA, 23 bp, Homo sapiens
aaatgatccccagctgtttatgc

SEQ ID NO: 4702799 - DNA, 21 bp, Homo sapiens
aaatgatctggtggttattta

SEQ ID NO: 4702800 - DNA, 13 bp, Homo sapiens
aaatgcccagccc

SEQ ID NO: 4702801 - DNA, 14 bp, Homo sapiens
aaatgcccagcccc

SEQ ID NO: 4702802 - DNA, 14 bp, Homo sapiens
aaatgcctttgaga

SEQ ID NO: 4702803 - DNA, 20 bp, Homo sapiens
aaatgcctttgagacagttt

SEQ ID NO: 4702804 - DNA, 18 bp, Homo sapiens
aaatgcctttttgtttac

SEQ ID NO: 4702805 - DNA, 14 bp, Homo sapiens
aaatgctctgatta

SEQ ID NO: 4702806 - DNA, 17 bp, Homo sapiens
aaatgctggagaaaaat

SEQ ID NO: 4702807 - DNA, 22 bp, Homo sapiens
aaatgctggtttttcagttttc

SEQ ID NO: 4702808 - DNA, 24 bp, Homo sapiens
aaatgcttatgcttgtgtatatgt

SEQ ID NO: 4702809 - DNA, 17 bp, Homo sapiens
aaatgcttctttctact

SEQ ID NO: 4702810 - DNA, 16 bp, Homo sapiens
aaatggaaatgggcag

SEQ ID NO: 4702811 - DNA, 20 bp, Homo sapiens
aaatggaggatctctaaaga

SEQ ID NO: 4702812 - DNA, 20 bp, Homo sapiens
aaatgggcagagcagagacc

SEQ ID NO: 4702813 - DNA, 19 bp, Homo sapiens
aaatggtagttagcaacta

SEQ ID NO: 4702814 - DNA, 16 bp, Homo sapiens
aaatgtacttatatta

SEQ ID NO: 4702815 - DNA, 22 bp, Homo sapiens
aaatgtacttatattaagaaaa

SEQ ID NO: 4702816 - DNA, 15 bp, Homo sapiens
aaatgtatatgcact

SEQ ID NO: 4702817 - DNA, 21 bp, Homo sapiens
aaatgtcctgcaatttaggat

SEQ ID NO: 4702818 - DNA, 21 bp, Homo sapiens
aaatgtgaaaaaaattattca

SEQ ID NO: 4702819 - DNA, 22 bp, Homo sapiens
aaatgtgaaaaaaattattcat

SEQ ID NO: 4702820 - DNA, 16 bp, Homo sapiens
aaatgtggctgtatcc

SEQ ID NO: 4702821 - DNA, 15 bp, Homo sapiens
aaatgtggtcctatt

SEQ ID NO: 4702822 - DNA, 17 bp, Homo sapiens
aaatgtgtataatttta

SEQ ID NO: 4702823 - DNA, 13 bp, Homo sapiens
aaatgtgtatgtg

SEQ ID NO: 4702824 - DNA, 15 bp, Homo sapiens
aaatgtgtcaatgta

SEQ ID NO: 4702825 - DNA, 16 bp, Homo sapiens
aaatgttagtatttta

SEQ ID NO: 4702826 - DNA, 15 bp, Homo sapiens
aaatgttatgactcc

SEQ ID NO: 4702827 - DNA, 13 bp, Homo sapiens
aaatgttcacttt

SEQ ID NO: 4702828 - DNA, 21 bp, Homo sapiens
aaatgttctatttaacaactg

SEQ ID NO: 4702829 - DNA, 13 bp, Homo sapiens
aaatgttggtgca

SEQ ID NO: 4702830 - DNA, 19 bp, Homo sapiens
aaatgtttgttatttacac

SEQ ID NO: 4702831 - DNA, 22 bp, Homo sapiens
aaatgtttgttatttacactgg

SEQ ID NO: 4702832 - DNA, 21 bp, Homo sapiens
aaattaaattctctctaacat

SEQ ID NO: 4702833 - DNA, 12 bp, Homo sapiens
aaattaacactg

SEQ ID NO: 4702834 - DNA, 22 bp, Homo sapiens
aaattaactgctccaaatttaa

SEQ ID NO: 4702835 - DNA, 12 bp, Homo sapiens
aaattaatttgt

SEQ ID NO: 4702836 - DNA, 13 bp, Homo sapiens
aaattaatttgtg

SEQ ID NO: 4702837 - DNA, 17 bp, Homo sapiens
aaattataattttagtt

SEQ ID NO: 4702838 - DNA, 16 bp, Homo sapiens
aaattatcagttatat

SEQ ID NO: 4702839 - DNA, 18 bp, Homo sapiens
aaattatgtgaaatgctt

SEQ ID NO: 4702840 - DNA, 23 bp, Homo sapiens
aaattattttctccaaataaaaa

SEQ ID NO: 4702841 - DNA, 21 bp, Homo sapiens
aaattcatcaaatggaagaca

SEQ ID NO: 4702842 - DNA, 16 bp, Homo sapiens
aaattcccttcatctg

SEQ ID NO: 4702843 - DNA, 19 bp, Homo sapiens
aaattgatcattcataatt

SEQ ID NO: 4702844 - DNA, 14 bp, Homo sapiens
aaattgattttgaa

SEQ ID NO: 4702845 - DNA, 15 bp, Homo sapiens
aaattgattttgaac

SEQ ID NO: 4702846 - DNA, 15 bp, Homo sapiens
aaattgccattttat

SEQ ID NO: 4702847 - DNA, 17 bp, Homo sapiens
aaattgtattacaaatc

SEQ ID NO: 4702848 - DNA, 16 bp, Homo sapiens
aaatttaagtgcgtgt

SEQ ID NO: 4702849 - DNA, 21 bp, Homo sapiens
aaatttaagtgcgtgtgtaga

SEQ ID NO: 4702850 - DNA, 13 bp, Homo sapiens
aaatttacattta

SEQ ID NO: 4702851 - DNA, 16 bp, Homo sapiens
aaatttacatttatct

SEQ ID NO: 4702852 - DNA, 23 bp, Homo sapiens
aaatttagagtcaatttgctgaa

SEQ ID NO: 4702853 - DNA, 17 bp, Homo sapiens
aaatttcagcagctgca

SEQ ID NO: 4702854 - DNA, 13 bp, Homo sapiens
aaatttgtaagtt

SEQ ID NO: 4702855 - DNA, 15 bp, Homo sapiens
aaatttgtaagtttc

SEQ ID NO: 4702856 - DNA, 22 bp, Homo sapiens
aaatttgtaagtttcaggtgac

SEQ ID NO: 4702857 - DNA, 21 bp, Homo sapiens
aaatttgttgtcatgtgtatg

SEQ ID NO: 4702858 - DNA, 15 bp, Homo sapiens
aaattttctagaaat

SEQ ID NO: 4702859 - DNA, 22 bp, Homo sapiens
aaatttttaactgcctttttgt

SEQ ID NO: 4702860 - DNA, 17 bp, Homo sapiens
aaattttttttgtttca

SEQ ID NO: 4702861 - DNA, 13 bp, Homo sapiens
aacaaaaattgtc

SEQ ID NO: 4702862 - DNA, 13 bp, Homo sapiens
aacaaaatgcctt

SEQ ID NO: 4702863 - DNA, 13 bp, Homo sapiens
aacaaaatttcta

SEQ ID NO: 4702864 - DNA, 11 bp, Homo sapiens
aacaaagaaac

SEQ ID NO: 4702865 - DNA, 13 bp, Homo sapiens
aacaacatgtata

SEQ ID NO: 4702866 - DNA, 12 bp, Homo sapiens
aacaataaaaga

SEQ ID NO: 4702867 - DNA, 16 bp, Homo sapiens
aacaataaagtgacaa

SEQ ID NO: 4702868 - DNA, 11 bp, Homo sapiens
aacaatcacaa

SEQ ID NO: 4702869 - DNA, 23 bp, Homo sapiens
aacaatccaaatgcattcatgtt

SEQ ID NO: 4702870 - DNA, 18 bp, Homo sapiens
aacacagcaattcctcag

SEQ ID NO: 4702871 - DNA, 15 bp, Homo sapiens
aacacatttttgtat

SEQ ID NO: 4702872 - DNA, 21 bp, Homo sapiens
aacaccctcacactgggactt

SEQ ID NO: 4702873 - DNA, 14 bp, Homo sapiens
aacactatatggca

SEQ ID NO: 4702874 - DNA, 15 bp, Homo sapiens
aacactgtaatatct

SEQ ID NO: 4702875 - DNA, 12 bp, Homo sapiens
aacactgtgaaa

SEQ ID NO: 4702876 - DNA, 16 bp, Homo sapiens
aacactgttctctgcc

SEQ ID NO: 4702877 - DNA, 18 bp, Homo sapiens
aacactgttctctgccct

SEQ ID NO: 4702878 - DNA, 21 bp, Homo sapiens
aacactgttctctgccctcca

SEQ ID NO: 4702879 - DNA, 15 bp, Homo sapiens
aacagaaatgctctg

SEQ ID NO: 4702880 - DNA, 16 bp, Homo sapiens
aacagaaatgctctga

SEQ ID NO: 4702881 - DNA, 20 bp, Homo sapiens
aacagactggaagcacagct

SEQ ID NO: 4702882 - DNA, 16 bp, Homo sapiens
aacagattcacactgt

SEQ ID NO: 4702883 - DNA, 13 bp, Homo sapiens
aacagcctgagaa

SEQ ID NO: 4702884 - DNA, 22 bp, Homo sapiens
aacagctctcttcaatgacata

SEQ ID NO: 4702885 - DNA, 18 bp, Homo sapiens
aacagctggacttattta

SEQ ID NO: 4702886 - DNA, 16 bp, Homo sapiens
aacaggcactgccctg

SEQ ID NO: 4702887 - DNA, 21 bp, Homo sapiens
aacaggttttcttctaatcat

SEQ ID NO: 4702888 - DNA, 22 bp, Homo sapiens
aacagtgttaggcctggcacag

SEQ ID NO: 4702889 - DNA, 18 bp, Homo sapiens
aacagtgttctcagtttt

SEQ ID NO: 4702890 - DNA, 17 bp, Homo sapiens
aacagtgtttatgacga

SEQ ID NO: 4702891 - DNA, 15 bp, Homo sapiens
aacatactcccatct

SEQ ID NO: 4702892 - DNA, 13 bp, Homo sapiens
aacatatcatttg

SEQ ID NO: 4702893 - DNA, 15 bp, Homo sapiens
aagctcagccagccc

SEQ ID NO: 4702894 - DNA, 17 bp, Homo sapiens
aagctcaggaccaggca

SEQ ID NO: 4702895 - DNA, 21 bp, Homo sapiens
aagctcccaagggatggtgcc

SEQ ID NO: 4702896 - DNA, 12 bp, Homo sapiens
aagctcccaggc

SEQ ID NO: 4702897 - DNA, 22 bp, Homo sapiens
aagctcccaggcattccccagg

SEQ ID NO: 4702898 - DNA, 12 bp, Homo sapiens
aagctctgagct

SEQ ID NO: 4702899 - DNA, 16 bp, Homo sapiens
aagctgggactcattc

SEQ ID NO: 4702900 - DNA, 18 bp, Homo sapiens
aagctggtcccactcagt

SEQ ID NO: 4702901 - DNA, 14 bp, Homo sapiens
aagctgtgccaccc

SEQ ID NO: 4702902 - DNA, 16 bp, Homo sapiens
aagctgtgccaccctg

SEQ ID NO: 4702903 - DNA, 14 bp, Homo sapiens
aagctgttgtacat

SEQ ID NO: 4702904 - DNA, 16 bp, Homo sapiens
aagcttggttctgtga

SEQ ID NO: 4702905 - DNA, 16 bp, Homo sapiens
aaggaaaaaataacaa

SEQ ID NO: 4702906 - DNA, 20 bp, Homo sapiens
aaggaaaaaattatgttttt

SEQ ID NO: 4702907 - DNA, 17 bp, Homo sapiens
aaggaaaaataaatatt

SEQ ID NO: 4702908 - DNA, 16 bp, Homo sapiens
aaggaaaccacagctg

SEQ ID NO: 4702909 - DNA, 17 bp, Homo sapiens
aaggaaaccacagctgc

SEQ ID NO: 4702910 - DNA, 20 bp, Homo sapiens
aaggaaaccacagctgctgg

SEQ ID NO: 4702911 - DNA, 22 bp, Homo sapiens
aaggaaacccagctctggtcca

SEQ ID NO: 4702912 - DNA, 13 bp, Homo sapiens
aaggaaactctta

SEQ ID NO: 4702913 - DNA, 13 bp, Homo sapiens
aaggaaaggcaaa

SEQ ID NO: 4702914 - DNA, 18 bp, Homo sapiens
aaggaatacctgtccccc

SEQ ID NO: 4702915 - DNA, 21 bp, Homo sapiens
aaggaatccactcccaggcag

SEQ ID NO: 4702916 - DNA, 22 bp, Homo sapiens
aaggaatccccagatatttatg

SEQ ID NO: 4702917 - DNA, 18 bp, Homo sapiens
aaggactagggtcctggg

SEQ ID NO: 4702918 - DNA, 19 bp, Homo sapiens
aaggagccccattcctggg

SEQ ID NO: 4702919 - DNA, 18 bp, Homo sapiens
aaggagctgcctggaccc

SEQ ID NO: 4702920 - DNA, 19 bp, Homo sapiens
aaggaggacaagaccctct

SEQ ID NO: 4702921 - DNA, 13 bp, Homo sapiens
aaggaggctggct

SEQ ID NO: 4702922 - DNA, 14 bp, Homo sapiens
aaggaggttctaat

SEQ ID NO: 4702923 - DNA, 12 bp, Homo sapiens
aaggataaagaa

SEQ ID NO: 4702924 - DNA, 13 bp, Homo sapiens
aaggataaagaag

SEQ ID NO: 4702925 - DNA, 16 bp, Homo sapiens
aaggatccggaaagaa

SEQ ID NO: 4702926 - DNA, 23 bp, Homo sapiens
aaggatgatctaggaagactttg

SEQ ID NO: 4702927 - DNA, 19 bp, Homo sapiens
aaggatgatgtctttttat

SEQ ID NO: 4702928 - DNA, 16 bp, Homo sapiens
aaggatgtgggggaag

SEQ ID NO: 4702929 - DNA, 13 bp, Homo sapiens
aaggattataaac

SEQ ID NO: 4702930 - DNA, 23 bp, Homo sapiens
aaggattgtaaaaaaaaatgcct

SEQ ID NO: 4702931 - DNA, 20 bp, Homo sapiens
aaggcaaacccatcaacaaa

SEQ ID NO: 4702932 - DNA, 13 bp, Homo sapiens
aaggcactgcctg

SEQ ID NO: 4702933 - DNA, 14 bp, Homo sapiens
aaggcactgcctga

SEQ ID NO: 4702934 - DNA, 18 bp, Homo sapiens
aaggcaggggaatgtatg

SEQ ID NO: 4702935 - DNA, 21 bp, Homo sapiens
aaggccaattcctatacgcag

SEQ ID NO: 4702936 - DNA, 14 bp, Homo sapiens
aaggccccgcccag

SEQ ID NO: 4702937 - DNA, 16 bp, Homo sapiens
aaggccccgcccaggc

SEQ ID NO: 4702938 - DNA, 13 bp, Homo sapiens
aaggcctcccaca

SEQ ID NO: 4702939 - DNA, 14 bp, Homo sapiens
aaggcctcccacag

SEQ ID NO: 4702940 - DNA, 23 bp, Homo sapiens
aaggcgatcccatcttgataaga

SEQ ID NO: 4702941 - DNA, 22 bp, Homo sapiens
aaggctccaggagcagccacat

SEQ ID NO: 4702942 - DNA, 20 bp, Homo sapiens
aaggctcgagcatgcctgga

SEQ ID NO: 4702943 - DNA, 19 bp, Homo sapiens
aaggctgagaggagagaga

SEQ ID NO: 4702944 - DNA, 20 bp, Homo sapiens
aaggctggtctcccccagcc

SEQ ID NO: 4702945 - DNA, 17 bp, Homo sapiens
aaggctttggcaacaga

SEQ ID NO: 4702946 - DNA, 21 bp, Homo sapiens
aagggaagttcaggctctgag

SEQ ID NO: 4702947 - DNA, 18 bp, Homo sapiens
aagggacgctacccggga

SEQ ID NO: 4702948 - DNA, 22 bp, Homo sapiens
aagggaggcacttcctcccctc

SEQ ID NO: 4702949 - DNA, 18 bp, Homo sapiens
aagggcatgggtcgggag

SEQ ID NO: 4702950 - DNA, 21 bp, Homo sapiens
aagggcatgggtcgggagagg

SEQ ID NO: 4702951 - DNA, 22 bp, Homo sapiens
aagggcatgggtcgggagaggg

SEQ ID NO: 4702952 - DNA, 19 bp, Homo sapiens
aagggcctggcctgagctg

SEQ ID NO: 4702953 - DNA, 15 bp, Homo sapiens
aagggcgcaaagggc

SEQ ID NO: 4702954 - DNA, 21 bp, Homo sapiens
aagggcgcaaagggcatgggt

SEQ ID NO: 4702955 - DNA, 16 bp, Homo sapiens
aagggctatgtaaata

SEQ ID NO: 4702956 - DNA, 19 bp, Homo sapiens
aagggctcagagaggacaa

SEQ ID NO: 4702957 - DNA, 18 bp, Homo sapiens
aagggctttgttttgcac

SEQ ID NO: 4702958 - DNA, 15 bp, Homo sapiens
aaggggcatttcaca

SEQ ID NO: 4702959 - DNA, 13 bp, Homo sapiens
aaggggccatcct

SEQ ID NO: 4702960 - DNA, 17 bp, Homo sapiens
aagggggtggtgtctcc

SEQ ID NO: 4702961 - DNA, 14 bp, Homo sapiens
aaggtagaatgttt

SEQ ID NO: 4702962 - DNA, 14 bp, Homo sapiens
aaggtatcttttta

SEQ ID NO: 4702963 - DNA, 16 bp, Homo sapiens
aaggtggggacaggga

SEQ ID NO: 4702964 - DNA, 13 bp, Homo sapiens
aaggtggggtgga

SEQ ID NO: 4702965 - DNA, 15 bp, Homo sapiens
aaggtgtgaaatcat

SEQ ID NO: 4702966 - DNA, 21 bp, Homo sapiens
aaggttctctcctccccaagg

SEQ ID NO: 4702967 - DNA, 16 bp, Homo sapiens
aaggtttataaagcag

SEQ ID NO: 4702968 - DNA, 13 bp, Homo sapiens
aagtaagcaaaga

SEQ ID NO: 4702969 - DNA, 20 bp, Homo sapiens
aagtacttctccaccctgct

SEQ ID NO: 4702970 - DNA, 18 bp, Homo sapiens
aagtagcaaccctgtgat

SEQ ID NO: 4702971 - DNA, 15 bp, Homo sapiens
aagtagtaaattttg

SEQ ID NO: 4702972 - DNA, 15 bp, Homo sapiens
aagtagtggagcccc

SEQ ID NO: 4702973 - DNA, 12 bp, Homo sapiens
aagtataacaaa

SEQ ID NO: 4702974 - DNA, 20 bp, Homo sapiens
aagtatcaaagaaaaacaat

SEQ ID NO: 4702975 - DNA, 14 bp, Homo sapiens
aagtatcttcatgt

SEQ ID NO: 4702976 - DNA, 15 bp, Homo sapiens
aagtatggaattttc

SEQ ID NO: 4702977 - DNA, 21 bp, Homo sapiens
aagtatgtatattaaaaaaga

SEQ ID NO: 4702978 - DNA, 16 bp, Homo sapiens
aagtattgtttacatt

SEQ ID NO: 4702979 - DNA, 22 bp, Homo sapiens
aagtattgtttacattaaactc

SEQ ID NO: 4702980 - DNA, 13 bp, Homo sapiens
aagtatttcaaat

SEQ ID NO: 4702981 - DNA, 22 bp, Homo sapiens
aagtatttcaaattggagcttc

SEQ ID NO: 4702982 - DNA, 22 bp, Homo sapiens
aagtattttcataagtatttca

SEQ ID NO: 4702983 - DNA, 20 bp, Homo sapiens
aagtcaacactatatatttt

SEQ ID NO: 4702984 - DNA, 13 bp, Homo sapiens
aagtcacacagtg

SEQ ID NO: 4702985 - DNA, 17 bp, Homo sapiens
aagtcatgcaaaggctg

SEQ ID NO: 4702986 - DNA, 15 bp, Homo sapiens
aagtcattaaagaca

SEQ ID NO: 4702987 - DNA, 24 bp, Homo sapiens
aagtcattgtttcccatcactgta

SEQ ID NO: 4702988 - DNA, 19 bp, Homo sapiens
aagtcctacttttaaagaa

SEQ ID NO: 4702989 - DNA, 18 bp, Homo sapiens
aagtcctcttttctgaga

SEQ ID NO: 4702990 - DNA, 22 bp, Homo sapiens
aagtcctcttttctgagaggac

SEQ ID NO: 4702991 - DNA, 22 bp, Homo sapiens
aagtctcgaatgtaattggaat

SEQ ID NO: 4702992 - DNA, 22 bp, Homo sapiens
aagtctgaggcacctgcatatc

SEQ ID NO: 4702993 - DNA, 16 bp, Homo sapiens
aagtcttatcaagcag

SEQ ID NO: 4702994 - DNA, 13 bp, Homo sapiens
aagtcttctattt

SEQ ID NO: 4702995 - DNA, 17 bp, Homo sapiens
aagtcttctatttattt

SEQ ID NO: 4702996 - DNA, 16 bp, Homo sapiens
aagtctttcacattta

SEQ ID NO: 4702997 - DNA, 13 bp, Homo sapiens
aagtgacaccaat

SEQ ID NO: 4702998 - DNA, 19 bp, Homo sapiens
aagtgactgttcaagagca

SEQ ID NO: 4702999 - DNA, 14 bp, Homo sapiens
aagtgactgttgta

SEQ ID NO: 4703000 - DNA, 15 bp, Homo sapiens
aagtgactgttgtac

SEQ ID NO: 4703001 - DNA, 20 bp, Homo sapiens
aagtgagacagtccagcctg

SEQ ID NO: 4703002 - DNA, 17 bp, Homo sapiens
aagtgagtggcatgtgg

SEQ ID NO: 4703003 - DNA, 22 bp, Homo sapiens
aatgtcagttgttatttattga

SEQ ID NO: 4703004 - DNA, 15 bp, Homo sapiens
aatgtcattatttga

SEQ ID NO: 4703005 - DNA, 23 bp, Homo sapiens
aatgtcgctgtaaattttatggc

SEQ ID NO: 4703006 - DNA, 20 bp, Homo sapiens
aatgtctctttaatgtcaca

SEQ ID NO: 4703007 - DNA, 19 bp, Homo sapiens
aatgtctgtaataatagac

SEQ ID NO: 4703008 - DNA, 16 bp, Homo sapiens
aatgtgaaaaaaatta

SEQ ID NO: 4703009 - DNA, 19 bp, Homo sapiens
aatgtgaaaaaaattattc

SEQ ID NO: 4703010 - DNA, 22 bp, Homo sapiens
aatgtgaaaatggtccaggaga

SEQ ID NO: 4703011 - DNA, 18 bp, Homo sapiens
aatgtgatcatctttgct

SEQ ID NO: 4703012 - DNA, 16 bp, Homo sapiens
aatgtgatgaatactg

SEQ ID NO: 4703013 - DNA, 17 bp, Homo sapiens
aatgtgtctgcaacatg

SEQ ID NO: 4703014 - DNA, 18 bp, Homo sapiens
aatgtgtctgcaacatgg

SEQ ID NO: 4703015 - DNA, 18 bp, Homo sapiens
aatgttaaggaaactctt

SEQ ID NO: 4703016 - DNA, 20 bp, Homo sapiens
aatgttagagtaatgaaatg

SEQ ID NO: 4703017 - DNA, 13 bp, Homo sapiens
aatgttagtattt

SEQ ID NO: 4703018 - DNA, 18 bp, Homo sapiens
aatgttagtattttaatc

SEQ ID NO: 4703019 - DNA, 15 bp, Homo sapiens
aatgttgaatgtatt

SEQ ID NO: 4703020 - DNA, 17 bp, Homo sapiens
aattaaacgtaaatgtt

SEQ ID NO: 4703021 - DNA, 14 bp, Homo sapiens
aattaactctggac

SEQ ID NO: 4703022 - DNA, 22 bp, Homo sapiens
aattaagttacaattacatctc

SEQ ID NO: 4703023 - DNA, 18 bp, Homo sapiens
aattaagtttgtgaatgt

SEQ ID NO: 4703024 - DNA, 12 bp, Homo sapiens
aattaatacaga

SEQ ID NO: 4703025 - DNA, 14 bp, Homo sapiens
aattaatacagagt

SEQ ID NO: 4703026 - DNA, 15 bp, Homo sapiens
aattaatacagagta

SEQ ID NO: 4703027 - DNA, 19 bp, Homo sapiens
aattaatgaagttgattca

SEQ ID NO: 4703028 - DNA, 13 bp, Homo sapiens
aattaatttgtga

SEQ ID NO: 4703029 - DNA, 14 bp, Homo sapiens
aattaatttgtgaa

SEQ ID NO: 4703030 - DNA, 15 bp, Homo sapiens
aattaatttgtgaat

SEQ ID NO: 4703031 - DNA, 14 bp, Homo sapiens
aattacctgtggat

SEQ ID NO: 4703032 - DNA, 13 bp, Homo sapiens
aattacttatttt

SEQ ID NO: 4703033 - DNA, 13 bp, Homo sapiens
aattagaaatcaa

SEQ ID NO: 4703034 - DNA, 16 bp, Homo sapiens
aattagattatttctg

SEQ ID NO: 4703035 - DNA, 16 bp, Homo sapiens
aattagcatattaata

SEQ ID NO: 4703036 - DNA, 15 bp, Homo sapiens
aattatgcatctgct

SEQ ID NO: 4703037 - DNA, 16 bp, Homo sapiens
aattatgtgaaatgct

SEQ ID NO: 4703038 - DNA, 13 bp, Homo sapiens
aattattcatgct

SEQ ID NO: 4703039 - DNA, 12 bp, Homo sapiens
aattatttgcat

SEQ ID NO: 4703040 - DNA, 11 bp, Homo sapiens
aattcaatgaa

SEQ ID NO: 4703041 - DNA, 15 bp, Homo sapiens
aattcaatgaaatgg

SEQ ID NO: 4703042 - DNA, 16 bp, Homo sapiens
aattcaatgaaatgga

SEQ ID NO: 4703043 - DNA, 17 bp, Homo sapiens
aattcaatgaaatggat

SEQ ID NO: 4703044 - DNA, 22 bp, Homo sapiens
aattcctatacgcagcgtgctt

SEQ ID NO: 4703045 - DNA, 17 bp, Homo sapiens
aattcttacaaacatgt

SEQ ID NO: 4703046 - DNA, 21 bp, Homo sapiens
aattcttccctatctttgcca

SEQ ID NO: 4703047 - DNA, 21 bp, Homo sapiens
aattcttgccaaatataaata

SEQ ID NO: 4703048 - DNA, 19 bp, Homo sapiens
aattcttggttgaggaaac

SEQ ID NO: 4703049 - DNA, 17 bp, Homo sapiens
aattctttctattttca

SEQ ID NO: 4703050 - DNA, 19 bp, Homo sapiens
aattctttctattttcaca

SEQ ID NO: 4703051 - DNA, 14 bp, Homo sapiens
aattgaaagaactt

SEQ ID NO: 4703052 - DNA, 21 bp, Homo sapiens
aattgacttatttatataaat

SEQ ID NO: 4703053 - DNA, 17 bp, Homo sapiens
aattgagcttgcttctt

SEQ ID NO: 4703054 - DNA, 17 bp, Homo sapiens
aattgagttttcagtgg

SEQ ID NO: 4703055 - DNA, 14 bp, Homo sapiens
aattgatcattcat

SEQ ID NO: 4703056 - DNA, 13 bp, Homo sapiens
aattgcagactgt

SEQ ID NO: 4703057 - DNA, 18 bp, Homo sapiens
aattgcccctgcaccttt

SEQ ID NO: 4703058 - DNA, 20 bp, Homo sapiens
aattggaatcttcacctcag

SEQ ID NO: 4703059 - DNA, 16 bp, Homo sapiens
aattggatattgatga

SEQ ID NO: 4703060 - DNA, 14 bp, Homo sapiens
aattggtcattcct

SEQ ID NO: 4703061 - DNA, 14 bp, Homo sapiens
aattgtaactgttc

SEQ ID NO: 4703062 - DNA, 23 bp, Homo sapiens
aattgtatttatgtatgtaaata

SEQ ID NO: 4703063 - DNA, 16 bp, Homo sapiens
aattgtcccttaaaca

SEQ ID NO: 4703064 - DNA, 17 bp, Homo sapiens
aattgtgggtctatttc

SEQ ID NO: 4703065 - DNA, 19 bp, Homo sapiens
aattgtgtggattctttaa

SEQ ID NO: 4703066 - DNA, 12 bp, Homo sapiens
aattgttgtttc

SEQ ID NO: 4703067 - DNA, 13 bp, Homo sapiens
aattgttgtttct

SEQ ID NO: 4703068 - DNA, 19 bp, Homo sapiens
aattgttgtttctttctag

SEQ ID NO: 4703069 - DNA, 23 bp, Homo sapiens
aattgttgtttctttctagtggt

SEQ ID NO: 4703070 - DNA, 17 bp, Homo sapiens
aatttaaaaatatattt

SEQ ID NO: 4703071 - DNA, 14 bp, Homo sapiens
aatttaaattgtta

SEQ ID NO: 4703072 - DNA, 14 bp, Homo sapiens
aatttacatttatc

SEQ ID NO: 4703073 - DNA, 22 bp, Homo sapiens
aatttactttttaaacagtgtt

SEQ ID NO: 4703074 - DNA, 23 bp, Homo sapiens
aatttactttttaaacagtgttt

SEQ ID NO: 4703075 - DNA, 13 bp, Homo sapiens
aatttagtcatta

SEQ ID NO: 4703076 - DNA, 22 bp, Homo sapiens
aatttagtcccttaaaaattaa

SEQ ID NO: 4703077 - DNA, 15 bp, Homo sapiens
aatttataaaaatta

SEQ ID NO: 4703078 - DNA, 15 bp, Homo sapiens
aatttataacaaata

SEQ ID NO: 4703079 - DNA, 12 bp, Homo sapiens
aatttattttgt

SEQ ID NO: 4703080 - DNA, 17 bp, Homo sapiens
aatttcacagatgctgt

SEQ ID NO: 4703081 - DNA, 18 bp, Homo sapiens
aatttcattttccttcag

SEQ ID NO: 4703082 - DNA, 17 bp, Homo sapiens
aatttctactttgaagt

SEQ ID NO: 4703083 - DNA, 14 bp, Homo sapiens
aatttctatgaagg

SEQ ID NO: 4703084 - DNA, 18 bp, Homo sapiens
aatttgaaaccaggacat

SEQ ID NO: 4703085 - DNA, 13 bp, Homo sapiens
aatttgagtgctc

SEQ ID NO: 4703086 - DNA, 23 bp, Homo sapiens
aatttggatttaaaagcctgctc

SEQ ID NO: 4703087 - DNA, 17 bp, Homo sapiens
aatttggtttgttaatt

SEQ ID NO: 4703088 - DNA, 14 bp, Homo sapiens
aatttgtgaatttg

SEQ ID NO: 4703089 - DNA, 12 bp, Homo sapiens
aatttgtttgac

SEQ ID NO: 4703090 - DNA, 15 bp, Homo sapiens
aatttgtttgacaat

SEQ ID NO: 4703091 - DNA, 12 bp, Homo sapiens
aattttaaagta

SEQ ID NO: 4703092 - DNA, 18 bp, Homo sapiens
aattttcacttttggcaa

SEQ ID NO: 4703093 - DNA, 16 bp, Homo sapiens
aattttccataagcta

SEQ ID NO: 4703094 - DNA, 13 bp, Homo sapiens
aattttcctgtga

SEQ ID NO: 4703095 - DNA, 17 bp, Homo sapiens
aattttgtcacagctct

SEQ ID NO: 4703096 - DNA, 23 bp, Homo sapiens
aattttgtgatgaataaaataat

SEQ ID NO: 4703097 - DNA, 21 bp, Homo sapiens
aatttttattatttgttttcc

SEQ ID NO: 4703098 - DNA, 19 bp, Homo sapiens
aatttttttaatttacaaa

SEQ ID NO: 4703099 - DNA, 17 bp, Homo sapiens
aatttttttgagacaga

SEQ ID NO: 4703100 - DNA, 13 bp, Homo sapiens
acaaaagagcagt

SEQ ID NO: 4703101 - DNA, 19 bp, Homo sapiens
acaaacgtatggaatgctt

SEQ ID NO: 4703102 - DNA, 20 bp, Homo sapiens
acaaactcaccatctgtgca

SEQ ID NO: 4703103 - DNA, 20 bp, Homo sapiens
acaaagaaacaaagatgtta

SEQ ID NO: 4703104 - DNA, 18 bp, Homo sapiens
acaaagcggctttctaat

SEQ ID NO: 4703105 - DNA, 23 bp, Homo sapiens
acaaaggaggacaagaccctctc

SEQ ID NO: 4703106 - DNA, 20 bp, Homo sapiens
acaaatatggctagttttca

SEQ ID NO: 4703107 - DNA, 15 bp, Homo sapiens
acaaatgctctgtct

SEQ ID NO: 4703108 - DNA, 14 bp, Homo sapiens
acaaatgtaaacat

SEQ ID NO: 4703109 - DNA, 18 bp, Homo sapiens
acaaatgtaaacattttc

SEQ ID NO: 4703110 - DNA, 18 bp, Homo sapiens
acaaatgtgataatatat

SEQ ID NO: 4703111 - DNA, 14 bp, Homo sapiens
acaaatgtgtatgt

SEQ ID NO: 4703112 - DNA, 18 bp, Homo sapiens
acaaatgtgtcccagtga

SEQ ID NO: 4703113 - DNA, 14 bp, Homo sapiens
acaacagcctgaga

SEQ ID NO: 4703114 - DNA, 17 bp, Homo sapiens
acagtattacttctgct

SEQ ID NO: 4703115 - DNA, 19 bp, Homo sapiens
acagtattacttctgctac

SEQ ID NO: 4703116 - DNA, 16 bp, Homo sapiens
acagtcaaatttacat

SEQ ID NO: 4703117 - DNA, 20 bp, Homo sapiens
acagtcaaatttacatttat

SEQ ID NO: 4703118 - DNA, 22 bp, Homo sapiens
acagtcaaatttacatttatct

SEQ ID NO: 4703119 - DNA, 13 bp, Homo sapiens
acagtccctgcca

SEQ ID NO: 4703120 - DNA, 14 bp, Homo sapiens
acagtcctcccatc

SEQ ID NO: 4703121 - DNA, 23 bp, Homo sapiens
acagtcctctccacctagtggct

SEQ ID NO: 4703122 - DNA, 20 bp, Homo sapiens
acagtccttaccagcagagc

SEQ ID NO: 4703123 - DNA, 17 bp, Homo sapiens
acagtctcaattttgta

SEQ ID NO: 4703124 - DNA, 14 bp, Homo sapiens
acagtcttccattt

SEQ ID NO: 4703125 - DNA, 14 bp, Homo sapiens
acagtcttgtatta

SEQ ID NO: 4703126 - DNA, 13 bp, Homo sapiens
acagtgcccaaga

SEQ ID NO: 4703127 - DNA, 18 bp, Homo sapiens
acagtgcccaagagtggg

SEQ ID NO: 4703128 - DNA, 21 bp, Homo sapiens
acagtgcttgccacagagcgg

SEQ ID NO: 4703129 - DNA, 16 bp, Homo sapiens
acagtggagagggcta

SEQ ID NO: 4703130 - DNA, 13 bp, Homo sapiens
acagtgtacagtc

SEQ ID NO: 4703131 - DNA, 18 bp, Homo sapiens
acagtgtacagtcttgta

SEQ ID NO: 4703132 - DNA, 21 bp, Homo sapiens
acagtgtctgggctgactggg

SEQ ID NO: 4703133 - DNA, 19 bp, Homo sapiens
acagtgttaggcctggcac

SEQ ID NO: 4703134 - DNA, 19 bp, Homo sapiens
acagttcggtgagctacaa

SEQ ID NO: 4703135 - DNA, 22 bp, Homo sapiens
acagttcggtgagctacaaatg

SEQ ID NO: 4703136 - DNA, 13 bp, Homo sapiens
acagtttcttctg

SEQ ID NO: 4703137 - DNA, 14 bp, Homo sapiens
acagtttgtcacat

SEQ ID NO: 4703138 - DNA, 13 bp, Homo sapiens
acagttttaactg

SEQ ID NO: 4703139 - DNA, 21 bp, Homo sapiens
acagttttaactgtggatatt

SEQ ID NO: 4703140 - DNA, 14 bp, Homo sapiens
acataaaagaaata

SEQ ID NO: 4703141 - DNA, 17 bp, Homo sapiens
acataaaagaaataaac

SEQ ID NO: 4703142 - DNA, 21 bp, Homo sapiens
acataaaatccaatattgtaa

SEQ ID NO: 4703143 - DNA, 13 bp, Homo sapiens
acataaaattttc

SEQ ID NO: 4703144 - DNA, 17 bp, Homo sapiens
acataaatgttcacttt

SEQ ID NO: 4703145 - DNA, 15 bp, Homo sapiens
acataacgtttttcc

SEQ ID NO: 4703146 - DNA, 22 bp, Homo sapiens
acataacgtttttcctttaaaa

SEQ ID NO: 4703147 - DNA, 14 bp, Homo sapiens
acataataaatcac

SEQ ID NO: 4703148 - DNA, 15 bp, Homo sapiens
acataataaatcaca

SEQ ID NO: 4703149 - DNA, 20 bp, Homo sapiens
acatatcatttgtgaagaat

SEQ ID NO: 4703150 - DNA, 14 bp, Homo sapiens
acatcacaagacta

SEQ ID NO: 4703151 - DNA, 12 bp, Homo sapiens
acatcagccctt

SEQ ID NO: 4703152 - DNA, 13 bp, Homo sapiens
acatcagtttgat

SEQ ID NO: 4703153 - DNA, 12 bp, Homo sapiens
acatctaaattg

SEQ ID NO: 4703154 - DNA, 20 bp, Homo sapiens
acatctaaattgatcattca

SEQ ID NO: 4703155 - DNA, 16 bp, Homo sapiens
acatctaacctcatct

SEQ ID NO: 4703156 - DNA, 13 bp, Homo sapiens
acatcttgctctg

SEQ ID NO: 4703157 - DNA, 17 bp, Homo sapiens
acatgaaaacattgatg

SEQ ID NO: 4703158 - DNA, 15 bp, Homo sapiens
acatgaagattcttt

SEQ ID NO: 4703159 - DNA, 19 bp, Homo sapiens
acatgaccctaaatcttga

SEQ ID NO: 4703160 - DNA, 13 bp, Homo sapiens
acatgagcatcag

SEQ ID NO: 4703161 - DNA, 18 bp, Homo sapiens
acatgagcatcaggccag

SEQ ID NO: 4703162 - DNA, 13 bp, Homo sapiens
acatgcacgtgtg

SEQ ID NO: 4703163 - DNA, 23 bp, Homo sapiens
acatgcagctctgcagcaatatt

SEQ ID NO: 4703164 - DNA, 13 bp, Homo sapiens
acatgcatataat

SEQ ID NO: 4703165 - DNA, 18 bp, Homo sapiens
acatgccaagcactgtgc

SEQ ID NO: 4703166 - DNA, 17 bp, Homo sapiens
acatggatacatatttc

SEQ ID NO: 4703167 - DNA, 15 bp, Homo sapiens
acatggattccaaag

SEQ ID NO: 4703168 - DNA, 19 bp, Homo sapiens
acatggattccaaagcatt

SEQ ID NO: 4703169 - DNA, 23 bp, Homo sapiens
acatgggagccgggtctgcctct

SEQ ID NO: 4703170 - DNA, 15 bp, Homo sapiens
acatggggaggagga

SEQ ID NO: 4703171 - DNA, 22 bp, Homo sapiens
acatggtagccagttgaattta

SEQ ID NO: 4703172 - DNA, 15 bp, Homo sapiens
acatggtctgtcctg

SEQ ID NO: 4703173 - DNA, 18 bp, Homo sapiens
acatggtgggtccatggg

SEQ ID NO: 4703174 - DNA, 23 bp, Homo sapiens
acatggtgtctggattcccagga

SEQ ID NO: 4703175 - DNA, 17 bp, Homo sapiens
acatgtaggaagtagga

SEQ ID NO: 4703176 - DNA, 14 bp, Homo sapiens
acatgtataatatt

SEQ ID NO: 4703177 - DNA, 20 bp, Homo sapiens
acatgtataatatttttaat

SEQ ID NO: 4703178 - DNA, 19 bp, Homo sapiens
acatgtcagtaccttcaaa

SEQ ID NO: 4703179 - DNA, 15 bp, Homo sapiens
acatgtgcaactctt

SEQ ID NO: 4703180 - DNA, 19 bp, Homo sapiens
acatgtgcaactcttgtat

SEQ ID NO: 4703181 - DNA, 18 bp, Homo sapiens
acatgtgcacatgcacgt

SEQ ID NO: 4703182 - DNA, 20 bp, Homo sapiens
acatgtgtcccagccacagt

SEQ ID NO: 4703183 - DNA, 17 bp, Homo sapiens
acatgttaaacttactt

SEQ ID NO: 4703184 - DNA, 15 bp, Homo sapiens
acattaccttactgt

SEQ ID NO: 4703185 - DNA, 19 bp, Homo sapiens
acattatctcacttgtgcc

SEQ ID NO: 4703186 - DNA, 16 bp, Homo sapiens
acattcatgcctggct

SEQ ID NO: 4703187 - DNA, 13 bp, Homo sapiens
acattccatcctt

SEQ ID NO: 4703188 - DNA, 18 bp, Homo sapiens
acattccttgcctgcaca

SEQ ID NO: 4703189 - DNA, 24 bp, Homo sapiens
acattgacacacagaaatgtgtca

SEQ ID NO: 4703190 - DNA, 22 bp, Homo sapiens
acattgtctctaaattgtgggt

SEQ ID NO: 4703191 - DNA, 18 bp, Homo sapiens
acatttaataatgtatgt

SEQ ID NO: 4703192 - DNA, 19 bp, Homo sapiens
acatttaataatgtatgta

SEQ ID NO: 4703193 - DNA, 20 bp, Homo sapiens
acatttaataatgtatgtac

SEQ ID NO: 4703194 - DNA, 17 bp, Homo sapiens
acatttagcccctctct

SEQ ID NO: 4703195 - DNA, 20 bp, Homo sapiens
acatttatgatttaataaaa

SEQ ID NO: 4703196 - DNA, 15 bp, Homo sapiens
acatttatgtgttga

SEQ ID NO: 4703197 - DNA, 14 bp, Homo sapiens
acatttattctgct

SEQ ID NO: 4703198 - DNA, 15 bp, Homo sapiens
acatttattctgctc

SEQ ID NO: 4703199 - DNA, 15 bp, Homo sapiens
acatttggagtgttc

SEQ ID NO: 4703200 - DNA, 20 bp, Homo sapiens
acatttggagtgttcccctt

SEQ ID NO: 4703201 - DNA, 21 bp, Homo sapiens
acattttcttttgttcttgat

SEQ ID NO: 4703202 - DNA, 11 bp, Homo sapiens
accaaaacagg

SEQ ID NO: 4703203 - DNA, 16 bp, Homo sapiens
accaaaacagttaatc

SEQ ID NO: 4703204 - DNA, 14 bp, Homo sapiens
accaaacctagccc

SEQ ID NO: 4703205 - DNA, 17 bp, Homo sapiens
accaaacttcatttttt

SEQ ID NO: 4703206 - DNA, 20 bp, Homo sapiens
accaaacttcattttttaaa

SEQ ID NO: 4703207 - DNA, 12 bp, Homo sapiens
accaaattttga

SEQ ID NO: 4703208 - DNA, 19 bp, Homo sapiens
accaacccagccgctgccc

SEQ ID NO: 4703209 - DNA, 14 bp, Homo sapiens
accaacccatgtat

SEQ ID NO: 4703210 - DNA, 14 bp, Homo sapiens
accaacgtctgtgc

SEQ ID NO: 4703211 - DNA, 21 bp, Homo sapiens
accaacgtctgtgccattttg

SEQ ID NO: 4703212 - DNA, 13 bp, Homo sapiens
accaagcaggaaa

SEQ ID NO: 4703213 - DNA, 12 bp, Homo sapiens
accaagcccagt

SEQ ID NO: 4703214 - DNA, 12 bp, Homo sapiens
accaagctgtgc

SEQ ID NO: 4703215 - DNA, 14 bp, Homo sapiens
accaagctgtgcca

SEQ ID NO: 4703216 - DNA, 23 bp, Homo sapiens
accaagggcagaggggtgctcat

SEQ ID NO: 4703217 - DNA, 18 bp, Homo sapiens
accaagttgtttattcca

SEQ ID NO: 4703218 - DNA, 14 bp, Homo sapiens
accaatattgtaca

SEQ ID NO: 4703219 - DNA, 12 bp, Homo sapiens
accaatgtcttg

SEQ ID NO: 4703220 - DNA, 22 bp, Homo sapiens
accaattataacttattagcag

SEQ ID NO: 4703221 - DNA, 15 bp, Homo sapiens
accacacccagccca

SEQ ID NO: 4703222 - DNA, 21 bp, Homo sapiens
accacacccagcccacttctg

SEQ ID NO: 4703223 - DNA, 21 bp, Homo sapiens
accacagcaaggcacctgcag

SEQ ID NO: 4703224 - DNA, 16 bp, Homo sapiens
acgcagcctgagaatg

SEQ ID NO: 4703225 - DNA, 19 bp, Homo sapiens
acgcaggcccctctcctcc

SEQ ID NO: 4703226 - DNA, 19 bp, Homo sapiens
acgccagattctttcctga

SEQ ID NO: 4703227 - DNA, 22 bp, Homo sapiens
acgccagattctttcctgaggc

SEQ ID NO: 4703228 - DNA, 15 bp, Homo sapiens
acgccatcccagccc

SEQ ID NO: 4703229 - DNA, 16 bp, Homo sapiens
acgccgcgcactcagc

SEQ ID NO: 4703230 - DNA, 16 bp, Homo sapiens
acgcgcgcacacacac

SEQ ID NO: 4703231 - DNA, 13 bp, Homo sapiens
acgctacccggga

SEQ ID NO: 4703232 - DNA, 13 bp, Homo sapiens
acgctctgcacct

SEQ ID NO: 4703233 - DNA, 13 bp, Homo sapiens
acgctggaccttg

SEQ ID NO: 4703234 - DNA, 19 bp, Homo sapiens
acgctggagtgcagtgagc

SEQ ID NO: 4703235 - DNA, 12 bp, Homo sapiens
acgctgtgctgc

SEQ ID NO: 4703236 - DNA, 14 bp, Homo sapiens
acgctgtgctgccc

SEQ ID NO: 4703237 - DNA, 16 bp, Homo sapiens
acgctgtgctgccctg

SEQ ID NO: 4703238 - DNA, 19 bp, Homo sapiens
acggagccactcctctgac

SEQ ID NO: 4703239 - DNA, 21 bp, Homo sapiens
acggagtcccaccttggctgc

SEQ ID NO: 4703240 - DNA, 13 bp, Homo sapiens
acggccaggccag

SEQ ID NO: 4703241 - DNA, 14 bp, Homo sapiens
acggctcactgcag

SEQ ID NO: 4703242 - DNA, 15 bp, Homo sapiens
acggctcactgcagc

SEQ ID NO: 4703243 - DNA, 15 bp, Homo sapiens
acggggctcttctca

SEQ ID NO: 4703244 - DNA, 11 bp, Homo sapiens
acgtaaatgtt

SEQ ID NO: 4703245 - DNA, 20 bp, Homo sapiens
acgtccatcacgttagctgt

SEQ ID NO: 4703246 - DNA, 21 bp, Homo sapiens
acgtcctgtcagtgccgccgc

SEQ ID NO: 4703247 - DNA, 13 bp, Homo sapiens
acgtctgtgccat

SEQ ID NO: 4703248 - DNA, 19 bp, Homo sapiens
acgtgattttgctgtagaa

SEQ ID NO: 4703249 - DNA, 17 bp, Homo sapiens
acgtttctcattaaaat

SEQ ID NO: 4703250 - DNA, 22 bp, Homo sapiens
acgtttttgtaaattaatcttt

SEQ ID NO: 4703251 - DNA, 15 bp, Homo sapiens
actaaaaaaaagatg

SEQ ID NO: 4703252 - DNA, 18 bp, Homo sapiens
actaaaatcattgtcaaa

SEQ ID NO: 4703253 - DNA, 14 bp, Homo sapiens
actaaatcccctca

SEQ ID NO: 4703254 - DNA, 17 bp, Homo sapiens
actaaatgtagttgtca

SEQ ID NO: 4703255 - DNA, 18 bp, Homo sapiens
actaacaggccaaagagt

SEQ ID NO: 4703256 - DNA, 22 bp, Homo sapiens
actaacgaaatatcaaagtcat

SEQ ID NO: 4703257 - DNA, 18 bp, Homo sapiens
actaagccagcaccggac

SEQ ID NO: 4703258 - DNA, 21 bp, Homo sapiens
actaatgcttgccaagaaatc

SEQ ID NO: 4703259 - DNA, 18 bp, Homo sapiens
actaatggggcggtgaga

SEQ ID NO: 4703260 - DNA, 18 bp, Homo sapiens
actacaaacaaaatttct

SEQ ID NO: 4703261 - DNA, 20 bp, Homo sapiens
actacaaacaaaatttctat

SEQ ID NO: 4703262 - DNA, 15 bp, Homo sapiens
actacaggcacccac

SEQ ID NO: 4703263 - DNA, 23 bp, Homo sapiens
actacaggtgtgagtcaccaagc

SEQ ID NO: 4703264 - DNA, 15 bp, Homo sapiens
actacagtcaggaaa

SEQ ID NO: 4703265 - DNA, 15 bp, Homo sapiens
actacagtcctccca

SEQ ID NO: 4703266 - DNA, 16 bp, Homo sapiens
actacagtcctcccat

SEQ ID NO: 4703267 - DNA, 14 bp, Homo sapiens
actaccgtggacca

SEQ ID NO: 4703268 - DNA, 13 bp, Homo sapiens
actactacatctg

SEQ ID NO: 4703269 - DNA, 21 bp, Homo sapiens
actactcagttattactgttt

SEQ ID NO: 4703270 - DNA, 17 bp, Homo sapiens
actacttgggagcaccg

SEQ ID NO: 4703271 - DNA, 23 bp, Homo sapiens
actagaacctggagggctagaac

SEQ ID NO: 4703272 - DNA, 19 bp, Homo sapiens
actagaactgaattttgtc

SEQ ID NO: 4703273 - DNA, 15 bp, Homo sapiens
actagacatgtcatg

SEQ ID NO: 4703274 - DNA, 15 bp, Homo sapiens
actagaggccaggga

SEQ ID NO: 4703275 - DNA, 18 bp, Homo sapiens
actagggatccctcatct

SEQ ID NO: 4703276 - DNA, 19 bp, Homo sapiens
actagggatccctcatctg

SEQ ID NO: 4703277 - DNA, 15 bp, Homo sapiens
actagggtcctgggg

SEQ ID NO: 4703278 - DNA, 18 bp, Homo sapiens
actatagcctaggtgaca

SEQ ID NO: 4703279 - DNA, 16 bp, Homo sapiens
actatcccggctgccc

SEQ ID NO: 4703280 - DNA, 18 bp, Homo sapiens
actatcccggctgccctt

SEQ ID NO: 4703281 - DNA, 16 bp, Homo sapiens
actatgatttggaaaa

SEQ ID NO: 4703282 - DNA, 23 bp, Homo sapiens
actatgcgtggctggaaccacat

SEQ ID NO: 4703283 - DNA, 18 bp, Homo sapiens
actatgcgtttttataaa

SEQ ID NO: 4703284 - DNA, 21 bp, Homo sapiens
actatggtgccaatggaacct

SEQ ID NO: 4703285 - DNA, 14 bp, Homo sapiens
actatgtaacatgt

SEQ ID NO: 4703286 - DNA, 13 bp, Homo sapiens
actatgttgataa

SEQ ID NO: 4703287 - DNA, 18 bp, Homo sapiens
actatgttgcccaggcag

SEQ ID NO: 4703288 - DNA, 20 bp, Homo sapiens
actatgttgcccaggcaggt

SEQ ID NO: 4703289 - DNA, 23 bp, Homo sapiens
actatgttgcccaggcaggtctt

SEQ ID NO: 4703290 - DNA, 21 bp, Homo sapiens
actattaccaccacctgctca

SEQ ID NO: 4703291 - DNA, 13 bp, Homo sapiens
actcaagaagcag

SEQ ID NO: 4703292 - DNA, 15 bp, Homo sapiens
actcaagaagcaggc

SEQ ID NO: 4703293 - DNA, 16 bp, Homo sapiens
actcaagaagcaggct

SEQ ID NO: 4703294 - DNA, 19 bp, Homo sapiens
actcaagaagcaggctaca

SEQ ID NO: 4703295 - DNA, 17 bp, Homo sapiens
actcaagacttccagag

SEQ ID NO: 4703296 - DNA, 19 bp, Homo sapiens
actcaagcaggtttcttgc

SEQ ID NO: 4703297 - DNA, 13 bp, Homo sapiens
actcaccatctgt

SEQ ID NO: 4703298 - DNA, 12 bp, Homo sapiens
actcaccccagc

SEQ ID NO: 4703299 - DNA, 14 bp, Homo sapiens
actcaccccagccc

SEQ ID NO: 4703300 - DNA, 12 bp, Homo sapiens
actcacctgggg

SEQ ID NO: 4703301 - DNA, 18 bp, Homo sapiens
actcacctggggctgctg

SEQ ID NO: 4703302 - DNA, 20 bp, Homo sapiens
actcacctggggctgctggc

SEQ ID NO: 4703303 - DNA, 19 bp, Homo sapiens
actcagctccccagagtcc

SEQ ID NO: 4703304 - DNA, 12 bp, Homo sapiens
actcaggaactt

SEQ ID NO: 4703305 - DNA, 16 bp, Homo sapiens
actcagggctcctggg

SEQ ID NO: 4703306 - DNA, 19 bp, Homo sapiens
actcagtccatagcagaga

SEQ ID NO: 4703307 - DNA, 14 bp, Homo sapiens
actcagtggggagg

SEQ ID NO: 4703308 - DNA, 14 bp, Homo sapiens
actcatacatctgg

SEQ ID NO: 4703309 - DNA, 18 bp, Homo sapiens
actcatagatgttatgca

SEQ ID NO: 4703310 - DNA, 14 bp, Homo sapiens
actcatgagaagtt

SEQ ID NO: 4703311 - DNA, 17 bp, Homo sapiens
actcattaattcaatga

SEQ ID NO: 4703312 - DNA, 22 bp, Homo sapiens
actcattaattcaatgaaatgg

SEQ ID NO: 4703313 - DNA, 17 bp, Homo sapiens
actcattcacatttcaa

SEQ ID NO: 4703314 - DNA, 19 bp, Homo sapiens
actcattctgaaggagccc

SEQ ID NO: 4703315 - DNA, 15 bp, Homo sapiens
actcattcttctgta

SEQ ID NO: 4703316 - DNA, 15 bp, Homo sapiens
actcattgacctgag

SEQ ID NO: 4703317 - DNA, 22 bp, Homo sapiens
actcattgacctgaggcccttc

SEQ ID NO: 4703318 - DNA, 17 bp, Homo sapiens
actccaggatttataaa

SEQ ID NO: 4703319 - DNA, 18 bp, Homo sapiens
actccagttaaaaaaaat

SEQ ID NO: 4703320 - DNA, 22 bp, Homo sapiens
actccctcagatcccagttcct

SEQ ID NO: 4703321 - DNA, 17 bp, Homo sapiens
actccctttaaagagag

SEQ ID NO: 4703322 - DNA, 14 bp, Homo sapiens
actccctttcatgt

SEQ ID NO: 4703323 - DNA, 18 bp, Homo sapiens
actcctaggcaggacatg

SEQ ID NO: 4703324 - DNA, 14 bp, Homo sapiens
actcctctgactca

SEQ ID NO: 4703325 - DNA, 15 bp, Homo sapiens
actcctgggtcagga

SEQ ID NO: 4703326 - DNA, 23 bp, Homo sapiens
actccttgaaaacactgttctct

SEQ ID NO: 4703327 - DNA, 13 bp, Homo sapiens
actcgagaacttt

SEQ ID NO: 4703328 - DNA, 17 bp, Homo sapiens
actcgagaactttcatt

SEQ ID NO: 4703329 - DNA, 15 bp, Homo sapiens
actcgggctcctgtg

SEQ ID NO: 4703330 - DNA, 18 bp, Homo sapiens
actcgggctcctgtgccc

SEQ ID NO: 4703331 - DNA, 19 bp, Homo sapiens
actcgggctcctgtgccct

SEQ ID NO: 4703332 - DNA, 21 bp, Homo sapiens
actctaaaattataaatgaca

SEQ ID NO: 4703333 - DNA, 15 bp, Homo sapiens
actctacagaggcca

SEQ ID NO: 4703334 - DNA, 19 bp, Homo sapiens
agaagatggcacttataac

SEQ ID NO: 4703335 - DNA, 14 bp, Homo sapiens
agaagcattccttc

SEQ ID NO: 4703336 - DNA, 22 bp, Homo sapiens
agaagcattccttctttgataa

SEQ ID NO: 4703337 - DNA, 24 bp, Homo sapiens
agaagcattccttctttgataatg

SEQ ID NO: 4703338 - DNA, 21 bp, Homo sapiens
agaagccacaggcctgagatt

SEQ ID NO: 4703339 - DNA, 16 bp, Homo sapiens
agaagccagaatcaca

SEQ ID NO: 4703340 - DNA, 21 bp, Homo sapiens
agaagcccaggaaaggctcca

SEQ ID NO: 4703341 - DNA, 19 bp, Homo sapiens
agaagcctttgggaagggg

SEQ ID NO: 4703342 - DNA, 19 bp, Homo sapiens
agaagctgttgtacattta

SEQ ID NO: 4703343 - DNA, 13 bp, Homo sapiens
agaagggctagaa

SEQ ID NO: 4703344 - DNA, 23 bp, Homo sapiens
agaagggctagaacctggagagc

SEQ ID NO: 4703345 - DNA, 13 bp, Homo sapiens
agaagggggtggt

SEQ ID NO: 4703346 - DNA, 22 bp, Homo sapiens
agaaggtgggttttcatcaaga

SEQ ID NO: 4703347 - DNA, 18 bp, Homo sapiens
agaaggtttcagaaagaa

SEQ ID NO: 4703348 - DNA, 14 bp, Homo sapiens
agaagtactttgtg

SEQ ID NO: 4703349 - DNA, 14 bp, Homo sapiens
agaagtatggaatt

SEQ ID NO: 4703350 - DNA, 18 bp, Homo sapiens
agaagtattgtttacatt

SEQ ID NO: 4703351 - DNA, 18 bp, Homo sapiens
agaagtcttctatttatt

SEQ ID NO: 4703352 - DNA, 19 bp, Homo sapiens
agaagtggggaccccaccc

SEQ ID NO: 4703353 - DNA, 21 bp, Homo sapiens
agaagttggtcttactttgtg

SEQ ID NO: 4703354 - DNA, 15 bp, Homo sapiens
agaatacattgtact

SEQ ID NO: 4703355 - DNA, 17 bp, Homo sapiens
agaatactggtctcagg

SEQ ID NO: 4703356 - DNA, 17 bp, Homo sapiens
agaatagaacacagttt

SEQ ID NO: 4703357 - DNA, 14 bp, Homo sapiens
agaatagtctctgg

SEQ ID NO: 4703358 - DNA, 18 bp, Homo sapiens
agaatattcctacttgca

SEQ ID NO: 4703359 - DNA, 22 bp, Homo sapiens
agaatcacttctgagaactcat

SEQ ID NO: 4703360 - DNA, 20 bp, Homo sapiens
agaatccagcaccggcccca

SEQ ID NO: 4703361 - DNA, 16 bp, Homo sapiens
agaatgaaagggccca

SEQ ID NO: 4703362 - DNA, 16 bp, Homo sapiens
agaatgacctgccctg

SEQ ID NO: 4703363 - DNA, 23 bp, Homo sapiens
agaatgcacagtgggtggagcca

SEQ ID NO: 4703364 - DNA, 17 bp, Homo sapiens
agaatggtgttccattg

SEQ ID NO: 4703365 - DNA, 15 bp, Homo sapiens
agaatgtaagaacta

SEQ ID NO: 4703366 - DNA, 15 bp, Homo sapiens
agaatgttttcaaat

SEQ ID NO: 4703367 - DNA, 21 bp, Homo sapiens
agaattattcagtgaatttgt

SEQ ID NO: 4703368 - DNA, 16 bp, Homo sapiens
agaattctaattgtca

SEQ ID NO: 4703369 - DNA, 18 bp, Homo sapiens
agaattggctgaactcat

SEQ ID NO: 4703370 - DNA, 22 bp, Homo sapiens
agaattggctgaactcatgaga

SEQ ID NO: 4703371 - DNA, 19 bp, Homo sapiens
agaattgttgcatccctca

SEQ ID NO: 4703372 - DNA, 13 bp, Homo sapiens
agaatttctttat

SEQ ID NO: 4703373 - DNA, 17 bp, Homo sapiens
agaatttgagtgctctg

SEQ ID NO: 4703374 - DNA, 15 bp, Homo sapiens
agacaaaagagcagt

SEQ ID NO: 4703375 - DNA, 19 bp, Homo sapiens
agacaaagcggctttctaa

SEQ ID NO: 4703376 - DNA, 15 bp, Homo sapiens
agacacaacaactcc

SEQ ID NO: 4703377 - DNA, 12 bp, Homo sapiens
agacacaggccc

SEQ ID NO: 4703378 - DNA, 17 bp, Homo sapiens
agacacaggcccggctc

SEQ ID NO: 4703379 - DNA, 13 bp, Homo sapiens
agacaccagagca

SEQ ID NO: 4703380 - DNA, 20 bp, Homo sapiens
agacaccagagcagatgcag

SEQ ID NO: 4703381 - DNA, 19 bp, Homo sapiens
agacaccttgacagggcac

SEQ ID NO: 4703382 - DNA, 22 bp, Homo sapiens
agacaccttgacagggcacacc

SEQ ID NO: 4703383 - DNA, 19 bp, Homo sapiens
agacactgttgataaaaac

SEQ ID NO: 4703384 - DNA, 22 bp, Homo sapiens
agacagaatctcgctctgtcgc

SEQ ID NO: 4703385 - DNA, 16 bp, Homo sapiens
agacagagacctcctg

SEQ ID NO: 4703386 - DNA, 15 bp, Homo sapiens
agacagaggcagaga

SEQ ID NO: 4703387 - DNA, 11 bp, Homo sapiens
agacagagtct

SEQ ID NO: 4703388 - DNA, 22 bp, Homo sapiens
agacagcccgggctctgcctcc

SEQ ID NO: 4703389 - DNA, 12 bp, Homo sapiens
agacagctgcct

SEQ ID NO: 4703390 - DNA, 15 bp, Homo sapiens
agacagctgcctggg

SEQ ID NO: 4703391 - DNA, 16 bp, Homo sapiens
agacagctgcctggga

SEQ ID NO: 4703392 - DNA, 21 bp, Homo sapiens
agacagggttttgccatgttg

SEQ ID NO: 4703393 - DNA, 17 bp, Homo sapiens
agacagtccagcctgga

SEQ ID NO: 4703394 - DNA, 14 bp, Homo sapiens
agacagtccctgcc

SEQ ID NO: 4703395 - DNA, 17 bp, Homo sapiens
agacagtccctgccaat

SEQ ID NO: 4703396 - DNA, 19 bp, Homo sapiens
agacagtccctgccaatgg

SEQ ID NO: 4703397 - DNA, 14 bp, Homo sapiens
agacataacgtttt

SEQ ID NO: 4703398 - DNA, 14 bp, Homo sapiens
agacatcagccctt

SEQ ID NO: 4703399 - DNA, 22 bp, Homo sapiens
agacatccaaatttttttttaa

SEQ ID NO: 4703400 - DNA, 16 bp, Homo sapiens
agacatgaaataaaag

SEQ ID NO: 4703401 - DNA, 18 bp, Homo sapiens
agacattctgtctttcaa

SEQ ID NO: 4703402 - DNA, 17 bp, Homo sapiens
agacccagccctcatcc

SEQ ID NO: 4703403 - DNA, 18 bp, Homo sapiens
agacccagccctcatccc

SEQ ID NO: 4703404 - DNA, 15 bp, Homo sapiens
agacccattccttcc

SEQ ID NO: 4703405 - DNA, 22 bp, Homo sapiens
agacccattccttcccagaggg

SEQ ID NO: 4703406 - DNA, 13 bp, Homo sapiens
agaccctctcagg

SEQ ID NO: 4703407 - DNA, 20 bp, Homo sapiens
agaccctctcaggctgtccc

SEQ ID NO: 4703408 - DNA, 14 bp, Homo sapiens
agaccctgccctgt

SEQ ID NO: 4703409 - DNA, 19 bp, Homo sapiens
agacccttgtggtcccacc

SEQ ID NO: 4703410 - DNA, 16 bp, Homo sapiens
agacctgcatttggca

SEQ ID NO: 4703411 - DNA, 13 bp, Homo sapiens
agacctgcccctc

SEQ ID NO: 4703412 - DNA, 14 bp, Homo sapiens
agacctgctctgga

SEQ ID NO: 4703413 - DNA, 18 bp, Homo sapiens
agaccttctaggacgcca

SEQ ID NO: 4703414 - DNA, 11 bp, Homo sapiens
agaccttctcc

SEQ ID NO: 4703415 - DNA, 18 bp, Homo sapiens
agaccttctccttcacct

SEQ ID NO: 4703416 - DNA, 19 bp, Homo sapiens
agacgctgtgctgccctgc

SEQ ID NO: 4703417 - DNA, 22 bp, Homo sapiens
agacgctgtgctgccctgccca

SEQ ID NO: 4703418 - DNA, 21 bp, Homo sapiens
agacggaggcctactcttcca

SEQ ID NO: 4703419 - DNA, 19 bp, Homo sapiens
agacggagtcccaccttgg

SEQ ID NO: 4703420 - DNA, 11 bp, Homo sapiens
agactcctagg

SEQ ID NO: 4703421 - DNA, 13 bp, Homo sapiens
agactcctgcagg

SEQ ID NO: 4703422 - DNA, 20 bp, Homo sapiens
agactccttgagagaccagg

SEQ ID NO: 4703423 - DNA, 15 bp, Homo sapiens
agactcgagaacttt

SEQ ID NO: 4703424 - DNA, 19 bp, Homo sapiens
agactcgagaactttcatt

SEQ ID NO: 4703425 - DNA, 17 bp, Homo sapiens
agactctacagaggcca

SEQ ID NO: 4703426 - DNA, 19 bp, Homo sapiens
agactctacagaggccatg

SEQ ID NO: 4703427 - DNA, 23 bp, Homo sapiens
agactctttttgtacctggtgac

SEQ ID NO: 4703428 - DNA, 12 bp, Homo sapiens
agactgaccaat

SEQ ID NO: 4703429 - DNA, 21 bp, Homo sapiens
agactgaccaatattgtacag

SEQ ID NO: 4703430 - DNA, 22 bp, Homo sapiens
agactgaccaatattgtacagt

SEQ ID NO: 4703431 - DNA, 17 bp, Homo sapiens
agactggaagcacagct

SEQ ID NO: 4703432 - DNA, 15 bp, Homo sapiens
agactgggctgaggg

SEQ ID NO: 4703433 - DNA, 16 bp, Homo sapiens
agactgggctgaggga

SEQ ID NO: 4703434 - DNA, 17 bp, Homo sapiens
agacttaatagaaacat

SEQ ID NO: 4703435 - DNA, 21 bp, Homo sapiens
agacttgtatagcatgaaata

SEQ ID NO: 4703436 - DNA, 20 bp, Homo sapiens
agactttcaagggaattaaa

SEQ ID NO: 4703437 - DNA, 12 bp, Homo sapiens
agactttggaaa

SEQ ID NO: 4703438 - DNA, 14 bp, Homo sapiens
agactttggaaaga

SEQ ID NO: 4703439 - DNA, 19 bp, Homo sapiens
agactttggaaagagtagg

SEQ ID NO: 4703440 - DNA, 15 bp, Homo sapiens
agagaaaaacaaatt

SEQ ID NO: 4703441 - DNA, 16 bp, Homo sapiens
agagaaaatgaatttg

SEQ ID NO: 4703442 - DNA, 18 bp, Homo sapiens
agagaaaatgatgagttt

SEQ ID NO: 4703443 - DNA, 16 bp, Homo sapiens
agagaactgagcatct

SEQ ID NO: 4703444 - DNA, 15 bp, Homo sapiens
agcaggaaatgaaaa

SEQ ID NO: 4703445 - DNA, 13 bp, Homo sapiens
agcaggacatgga

SEQ ID NO: 4703446 - DNA, 20 bp, Homo sapiens
agcagggaaaatatatatct

SEQ ID NO: 4703447 - DNA, 14 bp, Homo sapiens
agcagggaaacagc

SEQ ID NO: 4703448 - DNA, 13 bp, Homo sapiens
agcagggctcagc

SEQ ID NO: 4703449 - DNA, 14 bp, Homo sapiens
agcagggctcagcg

SEQ ID NO: 4703450 - DNA, 22 bp, Homo sapiens
agcagggctcagcggggacagc

SEQ ID NO: 4703451 - DNA, 16 bp, Homo sapiens
agcagggctgctgtga

SEQ ID NO: 4703452 - DNA, 15 bp, Homo sapiens
agcaggtgctgctac

SEQ ID NO: 4703453 - DNA, 20 bp, Homo sapiens
agcaggtgctgctaccctcc

SEQ ID NO: 4703454 - DNA, 19 bp, Homo sapiens
agcagtaaaagataaattt

SEQ ID NO: 4703455 - DNA, 23 bp, Homo sapiens
agcagtaaaagataaatttgttg

SEQ ID NO: 4703456 - DNA, 13 bp, Homo sapiens
agcagtgcaggca

SEQ ID NO: 4703457 - DNA, 19 bp, Homo sapiens
agcagtttctgtcctgctg

SEQ ID NO: 4703458 - DNA, 20 bp, Homo sapiens
agcataatttaaaaatatat

SEQ ID NO: 4703459 - DNA, 17 bp, Homo sapiens
agcatataaaaacatca

SEQ ID NO: 4703460 - DNA, 17 bp, Homo sapiens
agcatattcaggaagct

SEQ ID NO: 4703461 - DNA, 21 bp, Homo sapiens
agcatattcaggaagctcagg

SEQ ID NO: 4703462 - DNA, 22 bp, Homo sapiens
agcatattcaggaagctcaggg

SEQ ID NO: 4703463 - DNA, 14 bp, Homo sapiens
agcatcaaacatga

SEQ ID NO: 4703464 - DNA, 19 bp, Homo sapiens
agcatcaaacatgaaaaca

SEQ ID NO: 4703465 - DNA, 17 bp, Homo sapiens
agcatcacttgggatta

SEQ ID NO: 4703466 - DNA, 12 bp, Homo sapiens
agcatcaggcca

SEQ ID NO: 4703467 - DNA, 14 bp, Homo sapiens
agcatcaggccagg

SEQ ID NO: 4703468 - DNA, 18 bp, Homo sapiens
agcatcaggccaggccct

SEQ ID NO: 4703469 - DNA, 19 bp, Homo sapiens
agcatcaggccaggccctc

SEQ ID NO: 4703470 - DNA, 22 bp, Homo sapiens
agcatcccttgaccaggcctgg

SEQ ID NO: 4703471 - DNA, 14 bp, Homo sapiens
agcatcctggcacc

SEQ ID NO: 4703472 - DNA, 19 bp, Homo sapiens
agcatgaaataaaatatat

SEQ ID NO: 4703473 - DNA, 15 bp, Homo sapiens
agcatgagtggcctt

SEQ ID NO: 4703474 - DNA, 13 bp, Homo sapiens
agcatgcattttc

SEQ ID NO: 4703475 - DNA, 12 bp, Homo sapiens
agcatgcctgga

SEQ ID NO: 4703476 - DNA, 20 bp, Homo sapiens
agcatgcctggatggggctg

SEQ ID NO: 4703477 - DNA, 23 bp, Homo sapiens
agcatgcctggatggggctgcac

SEQ ID NO: 4703478 - DNA, 16 bp, Homo sapiens
agcatggagctggccg

SEQ ID NO: 4703479 - DNA, 21 bp, Homo sapiens
agcatggccctgctgcccctc

SEQ ID NO: 4703480 - DNA, 17 bp, Homo sapiens
agcatggctgtgaggat

SEQ ID NO: 4703481 - DNA, 23 bp, Homo sapiens
agcattccttctttgataatgtt

SEQ ID NO: 4703482 - DNA, 24 bp, Homo sapiens
agcattccttctttgataatgtta

SEQ ID NO: 4703483 - DNA, 17 bp, Homo sapiens
agcatttaatgtagcca

SEQ ID NO: 4703484 - DNA, 20 bp, Homo sapiens
agcatttaatgtagccatgg

SEQ ID NO: 4703485 - DNA, 18 bp, Homo sapiens
agccaaaaccatcttctg

SEQ ID NO: 4703486 - DNA, 20 bp, Homo sapiens
agccaaagctaggcctggcc

SEQ ID NO: 4703487 - DNA, 12 bp, Homo sapiens
agccaaatttaa

SEQ ID NO: 4703488 - DNA, 13 bp, Homo sapiens
agccaaatttaaa

SEQ ID NO: 4703489 - DNA, 16 bp, Homo sapiens
agccacaggcctgaga

SEQ ID NO: 4703490 - DNA, 17 bp, Homo sapiens
agccacaggcctgagat

SEQ ID NO: 4703491 - DNA, 21 bp, Homo sapiens
agccacaggcctgagatttca

SEQ ID NO: 4703492 - DNA, 23 bp, Homo sapiens
agccacaggcctgagatttcatc

SEQ ID NO: 4703493 - DNA, 20 bp, Homo sapiens
agccaccaacatactcccat

SEQ ID NO: 4703494 - DNA, 23 bp, Homo sapiens
agccaccaacatactcccatctg

SEQ ID NO: 4703495 - DNA, 23 bp, Homo sapiens
agccaccctcaccgcggctggat

SEQ ID NO: 4703496 - DNA, 14 bp, Homo sapiens
agccacggccaggc

SEQ ID NO: 4703497 - DNA, 13 bp, Homo sapiens
agccactaactag

SEQ ID NO: 4703498 - DNA, 14 bp, Homo sapiens
agccactaactaga

SEQ ID NO: 4703499 - DNA, 21 bp, Homo sapiens
agccactcctctgactcaggg

SEQ ID NO: 4703500 - DNA, 22 bp, Homo sapiens
agccactcctctgactcagggc

SEQ ID NO: 4703501 - DNA, 13 bp, Homo sapiens
agccactgcaccg

SEQ ID NO: 4703502 - DNA, 16 bp, Homo sapiens
agccactgcaccgggc

SEQ ID NO: 4703503 - DNA, 20 bp, Homo sapiens
agccactgcaccgggccaca

SEQ ID NO: 4703504 - DNA, 12 bp, Homo sapiens
agccactggagg

SEQ ID NO: 4703505 - DNA, 17 bp, Homo sapiens
agccacttaaaatgttc

SEQ ID NO: 4703506 - DNA, 20 bp, Homo sapiens
agccagcaccggaccagcct

SEQ ID NO: 4703507 - DNA, 24 bp, Homo sapiens
agccagcaccggaccagcctggcc

SEQ ID NO: 4703508 - DNA, 18 bp, Homo sapiens
agccagcgtcctcctctg

SEQ ID NO: 4703509 - DNA, 23 bp, Homo sapiens
agccagcgtcctcctctgtgacc

SEQ ID NO: 4703510 - DNA, 15 bp, Homo sapiens
agccaggatcatggt

SEQ ID NO: 4703511 - DNA, 14 bp, Homo sapiens
agccaggccacaag

SEQ ID NO: 4703512 - DNA, 18 bp, Homo sapiens
agccagggagagcccagg

SEQ ID NO: 4703513 - DNA, 19 bp, Homo sapiens
agccagggagagcccagga

SEQ ID NO: 4703514 - DNA, 21 bp, Homo sapiens
agccagggctgctagacggag

SEQ ID NO: 4703515 - DNA, 20 bp, Homo sapiens
agccagggtgagagtctggg

SEQ ID NO: 4703516 - DNA, 18 bp, Homo sapiens
agccagtaaacagaggag

SEQ ID NO: 4703517 - DNA, 15 bp, Homo sapiens
agccatgggaccaaa

SEQ ID NO: 4703518 - DNA, 22 bp, Homo sapiens
agccatgtagaagctgcatctt

SEQ ID NO: 4703519 - DNA, 14 bp, Homo sapiens
agccattttgtgaa

SEQ ID NO: 4703520 - DNA, 13 bp, Homo sapiens
agcccaaagaagg

SEQ ID NO: 4703521 - DNA, 20 bp, Homo sapiens
agcccaaagtggtatagaaa

SEQ ID NO: 4703522 - DNA, 14 bp, Homo sapiens
agcccaccttggct

SEQ ID NO: 4703523 - DNA, 16 bp, Homo sapiens
agcccaccttggctca

SEQ ID NO: 4703524 - DNA, 15 bp, Homo sapiens
agcccacgcccccac

SEQ ID NO: 4703525 - DNA, 17 bp, Homo sapiens
agcccacgcccccactg

SEQ ID NO: 4703526 - DNA, 18 bp, Homo sapiens
agcccacgcccccactgg

SEQ ID NO: 4703527 - DNA, 19 bp, Homo sapiens
agcccacgtcctgtcagtg

SEQ ID NO: 4703528 - DNA, 21 bp, Homo sapiens
agcccacgtcctgtcagtgcc

SEQ ID NO: 4703529 - DNA, 14 bp, Homo sapiens
agcccagaggaggg

SEQ ID NO: 4703530 - DNA, 21 bp, Homo sapiens
agcccagcactgcttgaggaa

SEQ ID NO: 4703531 - DNA, 20 bp, Homo sapiens
agcccaggaaaggctccagg

SEQ ID NO: 4703532 - DNA, 21 bp, Homo sapiens
agcccaggaaaggctccagga

SEQ ID NO: 4703533 - DNA, 14 bp, Homo sapiens
agcccaggagctcc

SEQ ID NO: 4703534 - DNA, 13 bp, Homo sapiens
agcccaggccagg

SEQ ID NO: 4703535 - DNA, 15 bp, Homo sapiens
agcccaggccaggac

SEQ ID NO: 4703536 - DNA, 19 bp, Homo sapiens
agcccaggccaggactctg

SEQ ID NO: 4703537 - DNA, 14 bp, Homo sapiens
agcccattcattcc

SEQ ID NO: 4703538 - DNA, 17 bp, Homo sapiens
agcccattcattccatt

SEQ ID NO: 4703539 - DNA, 23 bp, Homo sapiens
agcccattcattccattctggaa

SEQ ID NO: 4703540 - DNA, 17 bp, Homo sapiens
agccccaaaactctcct

SEQ ID NO: 4703541 - DNA, 15 bp, Homo sapiens
agccccacagcccac

SEQ ID NO: 4703542 - DNA, 17 bp, Homo sapiens
agccccacagcccacgt

SEQ ID NO: 4703543 - DNA, 18 bp, Homo sapiens
agccccaccccagggcag

SEQ ID NO: 4703544 - DNA, 22 bp, Homo sapiens
agccccaccccagggcagccag

SEQ ID NO: 4703545 - DNA, 16 bp, Homo sapiens
agccccagtgcccaca

SEQ ID NO: 4703546 - DNA, 15 bp, Homo sapiens
agccccatcctctgt

SEQ ID NO: 4703547 - DNA, 13 bp, Homo sapiens
agccccattctgc

SEQ ID NO: 4703548 - DNA, 16 bp, Homo sapiens
agccccattctgcctg

SEQ ID NO: 4703549 - DNA, 21 bp, Homo sapiens
agccccattctgcctgcccag

SEQ ID NO: 4703550 - DNA, 23 bp, Homo sapiens
agccccattctgcctgcccaggc

SEQ ID NO: 4703551 - DNA, 19 bp, Homo sapiens
agcccccacccacttccct

SEQ ID NO: 4703552 - DNA, 12 bp, Homo sapiens
agcccctctctt

SEQ ID NO: 4703553 - DNA, 19 bp, Homo sapiens
aggccacaagacccttgtg

SEQ ID NO: 4703554 - DNA, 20 bp, Homo sapiens
aggccagagggagtgacaga

SEQ ID NO: 4703555 - DNA, 17 bp, Homo sapiens
aggccaggactctgcag

SEQ ID NO: 4703556 - DNA, 15 bp, Homo sapiens
aggccaggccctctg

SEQ ID NO: 4703557 - DNA, 16 bp, Homo sapiens
aggccaggccctctgc

SEQ ID NO: 4703558 - DNA, 19 bp, Homo sapiens
aggccaggccctctgccca

SEQ ID NO: 4703559 - DNA, 21 bp, Homo sapiens
aggccatcatcagtggagcca

SEQ ID NO: 4703560 - DNA, 18 bp, Homo sapiens
aggccatggagagctgga

SEQ ID NO: 4703561 - DNA, 18 bp, Homo sapiens
aggccatgggcctcctgt

SEQ ID NO: 4703562 - DNA, 13 bp, Homo sapiens
aggccattattgt

SEQ ID NO: 4703563 - DNA, 19 bp, Homo sapiens
aggcccagagggcctgcaa

SEQ ID NO: 4703564 - DNA, 17 bp, Homo sapiens
aggccccgcccaggctt

SEQ ID NO: 4703565 - DNA, 13 bp, Homo sapiens
aggcccctgccac

SEQ ID NO: 4703566 - DNA, 13 bp, Homo sapiens
aggcccggctcca

SEQ ID NO: 4703567 - DNA, 17 bp, Homo sapiens
aggcccggctccaggct

SEQ ID NO: 4703568 - DNA, 20 bp, Homo sapiens
aggccctccacacctgcggc

SEQ ID NO: 4703569 - DNA, 15 bp, Homo sapiens
aggccctctgcccac

SEQ ID NO: 4703570 - DNA, 20 bp, Homo sapiens
aggccctctgcccactccct

SEQ ID NO: 4703571 - DNA, 13 bp, Homo sapiens
aggccctgcactg

SEQ ID NO: 4703572 - DNA, 15 bp, Homo sapiens
aggccctgcactgtc

SEQ ID NO: 4703573 - DNA, 21 bp, Homo sapiens
aggccctgcactgtcctgctc

SEQ ID NO: 4703574 - DNA, 16 bp, Homo sapiens
aggccgagtctgtcct

SEQ ID NO: 4703575 - DNA, 20 bp, Homo sapiens
aggccgagtctgtcctggaa

SEQ ID NO: 4703576 - DNA, 14 bp, Homo sapiens
aggcctcccacagt

SEQ ID NO: 4703577 - DNA, 18 bp, Homo sapiens
aggcctcccacagtgact

SEQ ID NO: 4703578 - DNA, 21 bp, Homo sapiens
aggcctgagatttcatctgct

SEQ ID NO: 4703579 - DNA, 23 bp, Homo sapiens
aggcctgagatttcatctgctct

SEQ ID NO: 4703580 - DNA, 14 bp, Homo sapiens
aggcctgagcgctc

SEQ ID NO: 4703581 - DNA, 18 bp, Homo sapiens
aggcctgagcgctcctgc

SEQ ID NO: 4703582 - DNA, 21 bp, Homo sapiens
aggcctgcctccagggctgga

SEQ ID NO: 4703583 - DNA, 17 bp, Homo sapiens
aggcctgccttctcagg

SEQ ID NO: 4703584 - DNA, 19 bp, Homo sapiens
aggcctgcgtgtgtctgtg

SEQ ID NO: 4703585 - DNA, 13 bp, Homo sapiens
aggcctggcacag

SEQ ID NO: 4703586 - DNA, 17 bp, Homo sapiens
aggcctggccagatgca

SEQ ID NO: 4703587 - DNA, 22 bp, Homo sapiens
aggcctggccagatgcaccagc

SEQ ID NO: 4703588 - DNA, 17 bp, Homo sapiens
aggccttctctgaagga

SEQ ID NO: 4703589 - DNA, 16 bp, Homo sapiens
aggcgtggagctgcct

SEQ ID NO: 4703590 - DNA, 15 bp, Homo sapiens
aggctaaggcgtgga

SEQ ID NO: 4703591 - DNA, 19 bp, Homo sapiens
aggctacactgacactggt

SEQ ID NO: 4703592 - DNA, 19 bp, Homo sapiens
aggctagaacctggcaagc

SEQ ID NO: 4703593 - DNA, 19 bp, Homo sapiens
aggctattttctaaagact

SEQ ID NO: 4703594 - DNA, 15 bp, Homo sapiens
aggctcaactaggga

SEQ ID NO: 4703595 - DNA, 21 bp, Homo sapiens
aggctcacccccttctccatc

SEQ ID NO: 4703596 - DNA, 23 bp, Homo sapiens
aggctcacccccttctccatcca

SEQ ID NO: 4703597 - DNA, 13 bp, Homo sapiens
aggctccagaggg

SEQ ID NO: 4703598 - DNA, 14 bp, Homo sapiens
aggctccagagggc

SEQ ID NO: 4703599 - DNA, 16 bp, Homo sapiens
aggctccaggagcagc

SEQ ID NO: 4703600 - DNA, 17 bp, Homo sapiens
aggctccaggagcagcc

SEQ ID NO: 4703601 - DNA, 13 bp, Homo sapiens
aggctcctgccac

SEQ ID NO: 4703602 - DNA, 14 bp, Homo sapiens
aggctcctgccacc

SEQ ID NO: 4703603 - DNA, 22 bp, Homo sapiens
aggctcctgttttgcacagcca

SEQ ID NO: 4703604 - DNA, 19 bp, Homo sapiens
aggctcgagcatgcctgga

SEQ ID NO: 4703605 - DNA, 14 bp, Homo sapiens
aggctctgagacac

SEQ ID NO: 4703606 - DNA, 15 bp, Homo sapiens
aggctctgcccttgg

SEQ ID NO: 4703607 - DNA, 18 bp, Homo sapiens
aggctcttctccccagag

SEQ ID NO: 4703608 - DNA, 19 bp, Homo sapiens
aggctcttctccccagagt

SEQ ID NO: 4703609 - DNA, 16 bp, Homo sapiens
aggctgagaacactgt

SEQ ID NO: 4703610 - DNA, 16 bp, Homo sapiens
aggctggccagcccca

SEQ ID NO: 4703611 - DNA, 18 bp, Homo sapiens
aggctggccagccccaca

SEQ ID NO: 4703612 - DNA, 12 bp, Homo sapiens
aggctggccctg

SEQ ID NO: 4703613 - DNA, 15 bp, Homo sapiens
aggctggccctgccc

SEQ ID NO: 4703614 - DNA, 19 bp, Homo sapiens
aggctggccctgccctggt

SEQ ID NO: 4703615 - DNA, 13 bp, Homo sapiens
aggctggcgtgca

SEQ ID NO: 4703616 - DNA, 18 bp, Homo sapiens
aggctggcgtgcagtggt

SEQ ID NO: 4703617 - DNA, 20 bp, Homo sapiens
aggctggcgtgcagtggtgc

SEQ ID NO: 4703618 - DNA, 12 bp, Homo sapiens
aggctggctggg

SEQ ID NO: 4703619 - DNA, 19 bp, Homo sapiens
aggctgggagagccttcca

SEQ ID NO: 4703620 - DNA, 14 bp, Homo sapiens
aggctgggctccct

SEQ ID NO: 4703621 - DNA, 23 bp, Homo sapiens
aggctgggctcccttcccacctc

SEQ ID NO: 4703622 - DNA, 14 bp, Homo sapiens
aggctgggcttcag

SEQ ID NO: 4703623 - DNA, 19 bp, Homo sapiens
aggctgggcttcagtggca

SEQ ID NO: 4703624 - DNA, 16 bp, Homo sapiens
aggctggggaagtcct

SEQ ID NO: 4703625 - DNA, 12 bp, Homo sapiens
aggctgtcccaa

SEQ ID NO: 4703626 - DNA, 20 bp, Homo sapiens
aggcttagctttgctctgcc

SEQ ID NO: 4703627 - DNA, 16 bp, Homo sapiens
aggcttctctctgtgg

SEQ ID NO: 4703628 - DNA, 22 bp, Homo sapiens
aggctttggcaacagaaaacaa

SEQ ID NO: 4703629 - DNA, 15 bp, Homo sapiens
agggaaactgtgaat

SEQ ID NO: 4703630 - DNA, 16 bp, Homo sapiens
agggaaactgtgaatg

SEQ ID NO: 4703631 - DNA, 12 bp, Homo sapiens
agggaaagaaaa

SEQ ID NO: 4703632 - DNA, 16 bp, Homo sapiens
agggaaatgatcagtt

SEQ ID NO: 4703633 - DNA, 16 bp, Homo sapiens
agggaacatgcagctc

SEQ ID NO: 4703634 - DNA, 14 bp, Homo sapiens
agggaagaactatt

SEQ ID NO: 4703635 - DNA, 18 bp, Homo sapiens
agggaagggcctgccaca

SEQ ID NO: 4703636 - DNA, 18 bp, Homo sapiens
agggaatgaacctggagg

SEQ ID NO: 4703637 - DNA, 23 bp, Homo sapiens
agggaatgagacaggacctagga

SEQ ID NO: 4703638 - DNA, 14 bp, Homo sapiens
agggaatgcctgag

SEQ ID NO: 4703639 - DNA, 18 bp, Homo sapiens
agggaatgcctgagtgcc

SEQ ID NO: 4703640 - DNA, 21 bp, Homo sapiens
agggaatttcttcaactccct

SEQ ID NO: 4703641 - DNA, 12 bp, Homo sapiens
agggacagaggg

SEQ ID NO: 4703642 - DNA, 13 bp, Homo sapiens
agggaccacagca

SEQ ID NO: 4703643 - DNA, 13 bp, Homo sapiens
agggacgcctggg

SEQ ID NO: 4703644 - DNA, 22 bp, Homo sapiens
agggacgcctgggggtgccagg

SEQ ID NO: 4703645 - DNA, 17 bp, Homo sapiens
agggacgctacccggga

SEQ ID NO: 4703646 - DNA, 20 bp, Homo sapiens
agggactcaatttctcccca

SEQ ID NO: 4703647 - DNA, 22 bp, Homo sapiens
agggacttctgcggggcctgag

SEQ ID NO: 4703648 - DNA, 18 bp, Homo sapiens
agggacttggaagctccg

SEQ ID NO: 4703649 - DNA, 21 bp, Homo sapiens
agggagaagactatattgtac

SEQ ID NO: 4703650 - DNA, 14 bp, Homo sapiens
agggagagcccagg

SEQ ID NO: 4703651 - DNA, 19 bp, Homo sapiens
agggagagcccaggagctc

SEQ ID NO: 4703652 - DNA, 21 bp, Homo sapiens
agggagagcccaggagctccc

SEQ ID NO: 4703653 - DNA, 14 bp, Homo sapiens
agggagcatggctg

SEQ ID NO: 4703654 - DNA, 23 bp, Homo sapiens
agggaggcctttagcttaagagg

SEQ ID NO: 4703655 - DNA, 15 bp, Homo sapiens
agggagggcctgggc

SEQ ID NO: 4703656 - DNA, 12 bp, Homo sapiens
agggagggctcc

SEQ ID NO: 4703657 - DNA, 14 bp, Homo sapiens
agggcacacactgt

SEQ ID NO: 4703658 - DNA, 12 bp, Homo sapiens
agggcagagtga

SEQ ID NO: 4703659 - DNA, 15 bp, Homo sapiens
agggcagcagaaggg

SEQ ID NO: 4703660 - DNA, 21 bp, Homo sapiens
agggcagcagaagggggtggt

SEQ ID NO: 4703661 - DNA, 15 bp, Homo sapiens
agggcagcagggcta

SEQ ID NO: 4703662 - DNA, 12 bp, Homo sapiens
agggcagccctc

SEQ ID NO: 4703663 - DNA, 13 bp, Homo sapiens
attaaaatatttc

SEQ ID NO: 4703664 - DNA, 14 bp, Homo sapiens
attaaaatatttca

SEQ ID NO: 4703665 - DNA, 14 bp, Homo sapiens
attaaaatcctcaa

SEQ ID NO: 4703666 - DNA, 14 bp, Homo sapiens
attaaaatggattt

SEQ ID NO: 4703667 - DNA, 23 bp, Homo sapiens
attaaaatggatttaatccattt

SEQ ID NO: 4703668 - DNA, 16 bp, Homo sapiens
attaaaattgccattt

SEQ ID NO: 4703669 - DNA, 12 bp, Homo sapiens
attaaacatttt

SEQ ID NO: 4703670 - DNA, 18 bp, Homo sapiens
attaaacattttcatgca

SEQ ID NO: 4703671 - DNA, 15 bp, Homo sapiens
attaaaccaattata

SEQ ID NO: 4703672 - DNA, 16 bp, Homo sapiens
attaaacgtaaatgtt

SEQ ID NO: 4703673 - DNA, 22 bp, Homo sapiens
attaaatcagttctcaatttca

SEQ ID NO: 4703674 - DNA, 14 bp, Homo sapiens
attaaatgcccagc

SEQ ID NO: 4703675 - DNA, 15 bp, Homo sapiens
attaaatgcccagcc

SEQ ID NO: 4703676 - DNA, 16 bp, Homo sapiens
attaaatgcccagccc

SEQ ID NO: 4703677 - DNA, 21 bp, Homo sapiens
attaaattctctctaacataa

SEQ ID NO: 4703678 - DNA, 13 bp, Homo sapiens
attaacaaatgct

SEQ ID NO: 4703679 - DNA, 22 bp, Homo sapiens
attaacactaattatcacgtct

SEQ ID NO: 4703680 - DNA, 24 bp, Homo sapiens
attaacactaattatcacgtctga

SEQ ID NO: 4703681 - DNA, 14 bp, Homo sapiens
attaagaaacaatt

SEQ ID NO: 4703682 - DNA, 20 bp, Homo sapiens
attaagccacttaaaatgtt

SEQ ID NO: 4703683 - DNA, 21 bp, Homo sapiens
attaagtcctacttttaaaga

SEQ ID NO: 4703684 - DNA, 21 bp, Homo sapiens
attaagttacaattacatctc

SEQ ID NO: 4703685 - DNA, 22 bp, Homo sapiens
attaagttacaattacatctct

SEQ ID NO: 4703686 - DNA, 13 bp, Homo sapiens
attaagttgttaa

SEQ ID NO: 4703687 - DNA, 20 bp, Homo sapiens
attaatatggggatgcagca

SEQ ID NO: 4703688 - DNA, 16 bp, Homo sapiens
attaattatatttcta

SEQ ID NO: 4703689 - DNA, 19 bp, Homo sapiens
attaattcaatgaaatgga

SEQ ID NO: 4703690 - DNA, 15 bp, Homo sapiens
attaatttgaaacca

SEQ ID NO: 4703691 - DNA, 22 bp, Homo sapiens
attaatttgaaaccaggacatt

SEQ ID NO: 4703692 - DNA, 23 bp, Homo sapiens
attacaaagttaaaattgttatc

SEQ ID NO: 4703693 - DNA, 20 bp, Homo sapiens
attacacagtcaaatttaca

SEQ ID NO: 4703694 - DNA, 19 bp, Homo sapiens
attacagttgcatttttat

SEQ ID NO: 4703695 - DNA, 14 bp, Homo sapiens
attacatctctaat

SEQ ID NO: 4703696 - DNA, 19 bp, Homo sapiens
attacatctctaattttgg

SEQ ID NO: 4703697 - DNA, 23 bp, Homo sapiens
attacatctctaattttggataa

SEQ ID NO: 4703698 - DNA, 12 bp, Homo sapiens
attaccttctcc

SEQ ID NO: 4703699 - DNA, 16 bp, Homo sapiens
attactgtttgttctc

SEQ ID NO: 4703700 - DNA, 12 bp, Homo sapiens
attacttctgct

SEQ ID NO: 4703701 - DNA, 23 bp, Homo sapiens
attactttaccacccccacacct

SEQ ID NO: 4703702 - DNA, 21 bp, Homo sapiens
attactttggggctaatttaa

SEQ ID NO: 4703703 - DNA, 13 bp, Homo sapiens
attagaacattta

SEQ ID NO: 4703704 - DNA, 14 bp, Homo sapiens
attagaacatttaa

SEQ ID NO: 4703705 - DNA, 17 bp, Homo sapiens
attagaacatttaataa

SEQ ID NO: 4703706 - DNA, 21 bp, Homo sapiens
attagaagatattagtcttgg

SEQ ID NO: 4703707 - DNA, 18 bp, Homo sapiens
attagataatcttttaca

SEQ ID NO: 4703708 - DNA, 13 bp, Homo sapiens
attagccaggatc

SEQ ID NO: 4703709 - DNA, 19 bp, Homo sapiens
attagctcacttggtgata

SEQ ID NO: 4703710 - DNA, 18 bp, Homo sapiens
attataaaggataaagaa

SEQ ID NO: 4703711 - DNA, 14 bp, Homo sapiens
attatagaattgca

SEQ ID NO: 4703712 - DNA, 20 bp, Homo sapiens
attatatacttgttgtttaa

SEQ ID NO: 4703713 - DNA, 17 bp, Homo sapiens
attatatttacaaatgg

SEQ ID NO: 4703714 - DNA, 15 bp, Homo sapiens
attatcagttatatt

SEQ ID NO: 4703715 - DNA, 20 bp, Homo sapiens
attatcagttatattttgct

SEQ ID NO: 4703716 - DNA, 22 bp, Homo sapiens
attatcagttatattttgctgt

SEQ ID NO: 4703717 - DNA, 17 bp, Homo sapiens
attatgcctgaatgact

SEQ ID NO: 4703718 - DNA, 22 bp, Homo sapiens
attatggcatatattaaaagca

SEQ ID NO: 4703719 - DNA, 21 bp, Homo sapiens
attatggcctttttaagtatt

SEQ ID NO: 4703720 - DNA, 14 bp, Homo sapiens
attatgttaatatt

SEQ ID NO: 4703721 - DNA, 13 bp, Homo sapiens
attattactgttt

SEQ ID NO: 4703722 - DNA, 15 bp, Homo sapiens
attattcagtgtcac

SEQ ID NO: 4703723 - DNA, 15 bp, Homo sapiens
attattccagatctg

SEQ ID NO: 4703724 - DNA, 17 bp, Homo sapiens
attattgatgttttcat

SEQ ID NO: 4703725 - DNA, 15 bp, Homo sapiens
attatttaaatgtac

SEQ ID NO: 4703726 - DNA, 22 bp, Homo sapiens
attatttaaatgtacttatatt

SEQ ID NO: 4703727 - DNA, 12 bp, Homo sapiens
attatttaataa

SEQ ID NO: 4703728 - DNA, 13 bp, Homo sapiens
attatttaataac

SEQ ID NO: 4703729 - DNA, 14 bp, Homo sapiens
attatttaataaca

SEQ ID NO: 4703730 - DNA, 15 bp, Homo sapiens
attatttaataacat

SEQ ID NO: 4703731 - DNA, 22 bp, Homo sapiens
attatttaataacattacctta

SEQ ID NO: 4703732 - DNA, 11 bp, Homo sapiens
attatttctgt

SEQ ID NO: 4703733 - DNA, 18 bp, Homo sapiens
attatttgataacatttt

SEQ ID NO: 4703734 - DNA, 14 bp, Homo sapiens
attatttgttttcc

SEQ ID NO: 4703735 - DNA, 14 bp, Homo sapiens
attattttctccaa

SEQ ID NO: 4703736 - DNA, 18 bp, Homo sapiens
attattttgttactgtct

SEQ ID NO: 4703737 - DNA, 17 bp, Homo sapiens
attcaagaaagatatct

SEQ ID NO: 4703738 - DNA, 20 bp, Homo sapiens
attcaagaaagatatctatg

SEQ ID NO: 4703739 - DNA, 14 bp, Homo sapiens
attcaatgaaatgg

SEQ ID NO: 4703740 - DNA, 17 bp, Homo sapiens
attcacatctaacctca

SEQ ID NO: 4703741 - DNA, 20 bp, Homo sapiens
attcacatctaacctcatct

SEQ ID NO: 4703742 - DNA, 18 bp, Homo sapiens
attcaccttttcttcaaa

SEQ ID NO: 4703743 - DNA, 13 bp, Homo sapiens
attcagaacttta

SEQ ID NO: 4703744 - DNA, 13 bp, Homo sapiens
attcagacagctg

SEQ ID NO: 4703745 - DNA, 15 bp, Homo sapiens
attcagacagctgcc

SEQ ID NO: 4703746 - DNA, 19 bp, Homo sapiens
attcagacagctgcctggg

SEQ ID NO: 4703747 - DNA, 22 bp, Homo sapiens
attcagctagaactttgaagga

SEQ ID NO: 4703748 - DNA, 16 bp, Homo sapiens
attcaggaagataaaa

SEQ ID NO: 4703749 - DNA, 20 bp, Homo sapiens
attcaggaagctcagggcct

SEQ ID NO: 4703750 - DNA, 15 bp, Homo sapiens
attcagtgaatttgt

SEQ ID NO: 4703751 - DNA, 16 bp, Homo sapiens
attcagtgaatttgtc

SEQ ID NO: 4703752 - DNA, 18 bp, Homo sapiens
attcagttcttacacatt

SEQ ID NO: 4703753 - DNA, 14 bp, Homo sapiens
attcataaagagaa

SEQ ID NO: 4703754 - DNA, 12 bp, Homo sapiens
attcataaccat

SEQ ID NO: 4703755 - DNA, 18 bp, Homo sapiens
attcatcaaataaacctt

SEQ ID NO: 4703756 - DNA, 21 bp, Homo sapiens
attcatccaggactgagatgc

SEQ ID NO: 4703757 - DNA, 22 bp, Homo sapiens
attcatctctctttaatataaa

SEQ ID NO: 4703758 - DNA, 17 bp, Homo sapiens
attcatgttttaaaagt

SEQ ID NO: 4703759 - DNA, 21 bp, Homo sapiens
attcatgttttaaaagtttgt

SEQ ID NO: 4703760 - DNA, 15 bp, Homo sapiens
attcattagttttga

SEQ ID NO: 4703761 - DNA, 12 bp, Homo sapiens
attcattccatt

SEQ ID NO: 4703762 - DNA, 18 bp, Homo sapiens
attcattccattctggaa

SEQ ID NO: 4703763 - DNA, 19 bp, Homo sapiens
attcattccattctggaag

SEQ ID NO: 4703764 - DNA, 20 bp, Homo sapiens
attcattggttaacaataaa

SEQ ID NO: 4703765 - DNA, 12 bp, Homo sapiens
attccacagctg

SEQ ID NO: 4703766 - DNA, 13 bp, Homo sapiens
attccacagctgc

SEQ ID NO: 4703767 - DNA, 21 bp, Homo sapiens
attccattctggaagtgactt

SEQ ID NO: 4703768 - DNA, 19 bp, Homo sapiens
attcccaagctctgctcct

SEQ ID NO: 4703769 - DNA, 19 bp, Homo sapiens
attccccaggaggccagcc

SEQ ID NO: 4703770 - DNA, 20 bp, Homo sapiens
attccccaggaggccagcct

SEQ ID NO: 4703771 - DNA, 22 bp, Homo sapiens
attccccaggaggccagccttg

SEQ ID NO: 4703772 - DNA, 23 bp, Homo sapiens
attccccctggccaccacccccc

SEQ ID NO: 4703773 - DNA, 13 bp, Homo sapiens
caaataatgtctc

SEQ ID NO: 4703774 - DNA, 23 bp, Homo sapiens
caaataatgtctctgtgagactc

SEQ ID NO: 4703775 - DNA, 17 bp, Homo sapiens
caaatattccagagact

SEQ ID NO: 4703776 - DNA, 14 bp, Homo sapiens
caaatcactgaact

SEQ ID NO: 4703777 - DNA, 21 bp, Homo sapiens
caaatctgacatattatgcct

SEQ ID NO: 4703778 - DNA, 22 bp, Homo sapiens
caaatgagaaaatgtctttatt

SEQ ID NO: 4703779 - DNA, 17 bp, Homo sapiens
caaatgcattcatgttt

SEQ ID NO: 4703780 - DNA, 22 bp, Homo sapiens
caaatgctctgtcttcaatgat

SEQ ID NO: 4703781 - DNA, 15 bp, Homo sapiens
caaatgctgtgcaaa

SEQ ID NO: 4703782 - DNA, 15 bp, Homo sapiens
caaatggaagacaca

SEQ ID NO: 4703783 - DNA, 19 bp, Homo sapiens
caaatggaagacacattga

SEQ ID NO: 4703784 - DNA, 14 bp, Homo sapiens
caaatgtaaacatt

SEQ ID NO: 4703785 - DNA, 21 bp, Homo sapiens
caaatgtggctgtatccactt

SEQ ID NO: 4703786 - DNA, 14 bp, Homo sapiens
caaatgtgtcccag

SEQ ID NO: 4703787 - DNA, 16 bp, Homo sapiens
caaatgtttaaacatt

SEQ ID NO: 4703788 - DNA, 15 bp, Homo sapiens
caaattatgtgaaat

SEQ ID NO: 4703789 - DNA, 20 bp, Homo sapiens
caaatttaaccataaatcaa

SEQ ID NO: 4703790 - DNA, 13 bp, Homo sapiens
caacaaacactgt

SEQ ID NO: 4703791 - DNA, 13 bp, Homo sapiens
caacaatttctac

SEQ ID NO: 4703792 - DNA, 20 bp, Homo sapiens
caacaatttctactttgaag

SEQ ID NO: 4703793 - DNA, 22 bp, Homo sapiens
caacacacagatttgagctcag

SEQ ID NO: 4703794 - DNA, 12 bp, Homo sapiens
caacacattttt

SEQ ID NO: 4703795 - DNA, 13 bp, Homo sapiens
caacagaaacatt

SEQ ID NO: 4703796 - DNA, 15 bp, Homo sapiens
caacagcaaacaggt

SEQ ID NO: 4703797 - DNA, 14 bp, Homo sapiens
caacaggctgggct

SEQ ID NO: 4703798 - DNA, 20 bp, Homo sapiens
caacaggctgggcttcagtg

SEQ ID NO: 4703799 - DNA, 15 bp, Homo sapiens
caacagtaatcagag

SEQ ID NO: 4703800 - DNA, 23 bp, Homo sapiens
caacatgccagccactgtgatag

SEQ ID NO: 4703801 - DNA, 15 bp, Homo sapiens
caacatggtgtctgg

SEQ ID NO: 4703802 - DNA, 17 bp, Homo sapiens
caacatgtataatattt

SEQ ID NO: 4703803 - DNA, 23 bp, Homo sapiens
caacatgtataatatttttaatt

SEQ ID NO: 4703804 - DNA, 15 bp, Homo sapiens
caacatgtatgtgga

SEQ ID NO: 4703805 - DNA, 22 bp, Homo sapiens
caaccagcatcccttgaccagg

SEQ ID NO: 4703806 - DNA, 13 bp, Homo sapiens
caacccccagcac

SEQ ID NO: 4703807 - DNA, 17 bp, Homo sapiens
caacccccagcctgcta

SEQ ID NO: 4703808 - DNA, 14 bp, Homo sapiens
caaccccttcgctc

SEQ ID NO: 4703809 - DNA, 17 bp, Homo sapiens
caaccccttcgctcctg

SEQ ID NO: 4703810 - DNA, 19 bp, Homo sapiens
caaccccttcgctcctgtg

SEQ ID NO: 4703811 - DNA, 21 bp, Homo sapiens
caaccccttcgctcctgtgtc

SEQ ID NO: 4703812 - DNA, 15 bp, Homo sapiens
caaccctcatcacca

SEQ ID NO: 4703813 - DNA, 15 bp, Homo sapiens
caacctcctgggcta

SEQ ID NO: 4703814 - DNA, 21 bp, Homo sapiens
caacctgattgtgtctcttgg

SEQ ID NO: 4703815 - DNA, 19 bp, Homo sapiens
caacctgtggcgctgcagc

SEQ ID NO: 4703816 - DNA, 19 bp, Homo sapiens
caaccttcgccacctgggt

SEQ ID NO: 4703817 - DNA, 20 bp, Homo sapiens
caacggaaagtgctgtctta

SEQ ID NO: 4703818 - DNA, 17 bp, Homo sapiens
caactatgatttggaaa

SEQ ID NO: 4703819 - DNA, 13 bp, Homo sapiens
caactcaccccag

SEQ ID NO: 4703820 - DNA, 15 bp, Homo sapiens
caactcaccccagcc

SEQ ID NO: 4703821 - DNA, 16 bp, Homo sapiens
caactcaccccagccc

SEQ ID NO: 4703822 - DNA, 19 bp, Homo sapiens
caactccctgccccccagc

SEQ ID NO: 4703823 - DNA, 20 bp, Homo sapiens
caactccctgccccccagcc

SEQ ID NO: 4703824 - DNA, 22 bp, Homo sapiens
caactcttgtattgctccattt

SEQ ID NO: 4703825 - DNA, 14 bp, Homo sapiens
caactctttgagaa

SEQ ID NO: 4703826 - DNA, 14 bp, Homo sapiens
caacttcttcagag

SEQ ID NO: 4703827 - DNA, 23 bp, Homo sapiens
caactttcatttgaaagtgggtt

SEQ ID NO: 4703828 - DNA, 20 bp, Homo sapiens
caagaaaacaggcactgccc

SEQ ID NO: 4703829 - DNA, 22 bp, Homo sapiens
caagaaaacaggcactgccctg

SEQ ID NO: 4703830 - DNA, 21 bp, Homo sapiens
caagaaatcgccttatgagaa

SEQ ID NO: 4703831 - DNA, 16 bp, Homo sapiens
caagaaccatttgcaa

SEQ ID NO: 4703832 - DNA, 18 bp, Homo sapiens
caagaagcccaggaaagg

SEQ ID NO: 4703833 - DNA, 13 bp, Homo sapiens
caagacacagtga

SEQ ID NO: 4703834 - DNA, 16 bp, Homo sapiens
caagaccctctcaggc

SEQ ID NO: 4703835 - DNA, 22 bp, Homo sapiens
caagaccctctcaggctgtccc

SEQ ID NO: 4703836 - DNA, 22 bp, Homo sapiens
caagacccttgtggtcccaccc

SEQ ID NO: 4703837 - DNA, 13 bp, Homo sapiens
caagaccttctcc

SEQ ID NO: 4703838 - DNA, 16 bp, Homo sapiens
caagaccttctccttc

SEQ ID NO: 4703839 - DNA, 17 bp, Homo sapiens
caagacgctgtgctgcc

SEQ ID NO: 4703840 - DNA, 18 bp, Homo sapiens
caagacgctgtgctgccc

SEQ ID NO: 4703841 - DNA, 22 bp, Homo sapiens
caagacgctgtgctgccctgcc

SEQ ID NO: 4703842 - DNA, 22 bp, Homo sapiens
caagactggaaggtggggacag

SEQ ID NO: 4703843 - DNA, 23 bp, Homo sapiens
caagagagagagagaatgagaga

SEQ ID NO: 4703844 - DNA, 14 bp, Homo sapiens
caagagctcttgtg

SEQ ID NO: 4703845 - DNA, 19 bp, Homo sapiens
caagagcttccagagctct

SEQ ID NO: 4703846 - DNA, 17 bp, Homo sapiens
caagagggacgcctggg

SEQ ID NO: 4703847 - DNA, 16 bp, Homo sapiens
caagagggtctgagga

SEQ ID NO: 4703848 - DNA, 20 bp, Homo sapiens
caagatccaaatgctgtgca

SEQ ID NO: 4703849 - DNA, 22 bp, Homo sapiens
caagatccaaatgctgtgcaaa

SEQ ID NO: 4703850 - DNA, 17 bp, Homo sapiens
caagcaacaagctattt

SEQ ID NO: 4703851 - DNA, 12 bp, Homo sapiens
caagcactgtgc

SEQ ID NO: 4703852 - DNA, 14 bp, Homo sapiens
caagcaggacatgg

SEQ ID NO: 4703853 - DNA, 18 bp, Homo sapiens
caagcaggacatggacaa

SEQ ID NO: 4703854 - DNA, 23 bp, Homo sapiens
caagccatggagtgagacccagg

SEQ ID NO: 4703855 - DNA, 14 bp, Homo sapiens
caagcctggcaagg

SEQ ID NO: 4703856 - DNA, 18 bp, Homo sapiens
caagcgattcttctgctt

SEQ ID NO: 4703857 - DNA, 20 bp, Homo sapiens
caagcgattcttctgcttca

SEQ ID NO: 4703858 - DNA, 18 bp, Homo sapiens
caagctagaacctggagg

SEQ ID NO: 4703859 - DNA, 16 bp, Homo sapiens
caagctatcctggctc

SEQ ID NO: 4703860 - DNA, 16 bp, Homo sapiens
caagctcaggaccagg

SEQ ID NO: 4703861 - DNA, 18 bp, Homo sapiens
caagctcaggaccaggca

SEQ ID NO: 4703862 - DNA, 12 bp, Homo sapiens
caagctccaagc

SEQ ID NO: 4703863 - DNA, 19 bp, Homo sapiens
caagctccaagctcccagg

SEQ ID NO: 4703864 - DNA, 16 bp, Homo sapiens
caagctcccaagagct

SEQ ID NO: 4703865 - DNA, 18 bp, Homo sapiens
caagctcccaagagcttc

SEQ ID NO: 4703866 - DNA, 14 bp, Homo sapiens
caagctctgctcct

SEQ ID NO: 4703867 - DNA, 16 bp, Homo sapiens
caagctctgctcctct

SEQ ID NO: 4703868 - DNA, 23 bp, Homo sapiens
caagctggtcccactcagtccat

SEQ ID NO: 4703869 - DNA, 21 bp, Homo sapiens
caagctgtgccaccctgggct

SEQ ID NO: 4703870 - DNA, 23 bp, Homo sapiens
caagcttatttagcacattttga

SEQ ID NO: 4703871 - DNA, 14 bp, Homo sapiens
caaggaaaccacag

SEQ ID NO: 4703872 - DNA, 22 bp, Homo sapiens
caaggaaaccacagctgctgga

SEQ ID NO: 4703873 - DNA, 15 bp, Homo sapiens
caaggaaaggcaaat

SEQ ID NO: 4703874 - DNA, 19 bp, Homo sapiens
caaggaagtctgtgtctac

SEQ ID NO: 4703875 - DNA, 19 bp, Homo sapiens
caaggactagggtcctggg

SEQ ID NO: 4703876 - DNA, 20 bp, Homo sapiens
caaggactagggtcctgggg

SEQ ID NO: 4703877 - DNA, 20 bp, Homo sapiens
caaggagacacaacaactcc

SEQ ID NO: 4703878 - DNA, 13 bp, Homo sapiens
caaggagaggagg

SEQ ID NO: 4703879 - DNA, 14 bp, Homo sapiens
caaggagaggaggc

SEQ ID NO: 4703880 - DNA, 14 bp, Homo sapiens
caaggagccaaaca

SEQ ID NO: 4703881 - DNA, 14 bp, Homo sapiens
caaggaggctggct

SEQ ID NO: 4703882 - DNA, 16 bp, Homo sapiens
caaggaggctggctgg

SEQ ID NO: 4703883 - DNA, 20 bp, Homo sapiens
cacccaggagccccgaggcc

SEQ ID NO: 4703884 - DNA, 24 bp, Homo sapiens
cacccaggagccccgaggccttct

SEQ ID NO: 4703885 - DNA, 12 bp, Homo sapiens
cacccccacacc

SEQ ID NO: 4703886 - DNA, 16 bp, Homo sapiens
caccccggccacctgc

SEQ ID NO: 4703887 - DNA, 18 bp, Homo sapiens
cacccctggttctcatct

SEQ ID NO: 4703888 - DNA, 16 bp, Homo sapiens
cacccgccttttataa

SEQ ID NO: 4703889 - DNA, 12 bp, Homo sapiens
cacccggcccct

SEQ ID NO: 4703890 - DNA, 18 bp, Homo sapiens
cacccggcccctgctggt

SEQ ID NO: 4703891 - DNA, 13 bp, Homo sapiens
caccctcatgctg

SEQ ID NO: 4703892 - DNA, 16 bp, Homo sapiens
caccctcatgctgtgt

SEQ ID NO: 4703893 - DNA, 21 bp, Homo sapiens
caccctcatgctgtgtgactc

SEQ ID NO: 4703894 - DNA, 14 bp, Homo sapiens
caccctcccctccc

SEQ ID NO: 4703895 - DNA, 15 bp, Homo sapiens
caccctgggctctgt

SEQ ID NO: 4703896 - DNA, 16 bp, Homo sapiens
caccctgggctctgtg

SEQ ID NO: 4703897 - DNA, 17 bp, Homo sapiens
caccctgggctctgtgg

SEQ ID NO: 4703898 - DNA, 15 bp, Homo sapiens
caccctgtgatgggg

SEQ ID NO: 4703899 - DNA, 21 bp, Homo sapiens
caccctgtgatggggccctgc

SEQ ID NO: 4703900 - DNA, 17 bp, Homo sapiens
cacccttttccagctgg

SEQ ID NO: 4703901 - DNA, 23 bp, Homo sapiens
caccgcggctggatgggggctct

SEQ ID NO: 4703902 - DNA, 17 bp, Homo sapiens
caccggaccagcctggc

SEQ ID NO: 4703903 - DNA, 19 bp, Homo sapiens
caccggaccagcctggccc

SEQ ID NO: 4703904 - DNA, 18 bp, Homo sapiens
caccggctggcctggccc

SEQ ID NO: 4703905 - DNA, 14 bp, Homo sapiens
caccgggcactcag

SEQ ID NO: 4703906 - DNA, 18 bp, Homo sapiens
caccgggccacagagaaa

SEQ ID NO: 4703907 - DNA, 19 bp, Homo sapiens
caccgtagggcctgactcc

SEQ ID NO: 4703908 - DNA, 20 bp, Homo sapiens
caccgtgcctggccacgccc

SEQ ID NO: 4703909 - DNA, 16 bp, Homo sapiens
cacctacagtgtacag

SEQ ID NO: 4703910 - DNA, 23 bp, Homo sapiens
cacctacagtgtacagtcttgta

SEQ ID NO: 4703911 - DNA, 20 bp, Homo sapiens
cacctaccaccacgcccggc

SEQ ID NO: 4703912 - DNA, 14 bp, Homo sapiens
cacctagtggctgt

SEQ ID NO: 4703913 - DNA, 16 bp, Homo sapiens
cacctagtggctgtcc

SEQ ID NO: 4703914 - DNA, 13 bp, Homo sapiens
cacctcaccctct

SEQ ID NO: 4703915 - DNA, 14 bp, Homo sapiens
cacctcaccctctc

SEQ ID NO: 4703916 - DNA, 20 bp, Homo sapiens
cacctcagagtggagttgaa

SEQ ID NO: 4703917 - DNA, 12 bp, Homo sapiens
cacctcagcctc

SEQ ID NO: 4703918 - DNA, 16 bp, Homo sapiens
cacctccacatcctcc

SEQ ID NO: 4703919 - DNA, 14 bp, Homo sapiens
cacctcccccatct

SEQ ID NO: 4703920 - DNA, 13 bp, Homo sapiens
cacctcctgcctc

SEQ ID NO: 4703921 - DNA, 17 bp, Homo sapiens
cacctccttccagcact

SEQ ID NO: 4703922 - DNA, 18 bp, Homo sapiens
cacctctctcactccttg

SEQ ID NO: 4703923 - DNA, 23 bp, Homo sapiens
cacctgaagactcattcttctgt

SEQ ID NO: 4703924 - DNA, 15 bp, Homo sapiens
cacctgcactaacag

SEQ ID NO: 4703925 - DNA, 22 bp, Homo sapiens
cacctgcaggttgggccatact

SEQ ID NO: 4703926 - DNA, 16 bp, Homo sapiens
cacctgcggtgctatc

SEQ ID NO: 4703927 - DNA, 19 bp, Homo sapiens
cacctgcggtgctatctcc

SEQ ID NO: 4703928 - DNA, 20 bp, Homo sapiens
cacctgcggtgctatctccc

SEQ ID NO: 4703929 - DNA, 13 bp, Homo sapiens
cacctgctcactg

SEQ ID NO: 4703930 - DNA, 15 bp, Homo sapiens
cacctggacccctgc

SEQ ID NO: 4703931 - DNA, 12 bp, Homo sapiens
cacctggcctct

SEQ ID NO: 4703932 - DNA, 13 bp, Homo sapiens
cacctggcctctg

SEQ ID NO: 4703933 - DNA, 17 bp, Homo sapiens
cacctggcctctgcact

SEQ ID NO: 4703934 - DNA, 23 bp, Homo sapiens
cacctggcctctgcactcccctg

SEQ ID NO: 4703935 - DNA, 15 bp, Homo sapiens
cacctggggctgctg

SEQ ID NO: 4703936 - DNA, 19 bp, Homo sapiens
cacctgtgcttcgggccct

SEQ ID NO: 4703937 - DNA, 20 bp, Homo sapiens
caccttactttcccattgta

SEQ ID NO: 4703938 - DNA, 21 bp, Homo sapiens
caccttactttcccattgtaa

SEQ ID NO: 4703939 - DNA, 16 bp, Homo sapiens
caccttagacagtccc

SEQ ID NO: 4703940 - DNA, 19 bp, Homo sapiens
caccttagacagtccctgc

SEQ ID NO: 4703941 - DNA, 21 bp, Homo sapiens
caccttagacagtccctgcca

SEQ ID NO: 4703942 - DNA, 15 bp, Homo sapiens
caccttcaaaatgtt

SEQ ID NO: 4703943 - DNA, 16 bp, Homo sapiens
caccttcaaaatgttc

SEQ ID NO: 4703944 - DNA, 18 bp, Homo sapiens
caccttctgacgcagcct

SEQ ID NO: 4703945 - DNA, 19 bp, Homo sapiens
caccttctgacgcagcctg

SEQ ID NO: 4703946 - DNA, 20 bp, Homo sapiens
caccttctgacgcagcctga

SEQ ID NO: 4703947 - DNA, 13 bp, Homo sapiens
caccttgacaggg

SEQ ID NO: 4703948 - DNA, 16 bp, Homo sapiens
caccttgacagggcac

SEQ ID NO: 4703949 - DNA, 19 bp, Homo sapiens
caccttgacagggcacacc

SEQ ID NO: 4703950 - DNA, 14 bp, Homo sapiens
caccttgcggggat

SEQ ID NO: 4703951 - DNA, 17 bp, Homo sapiens
cacctttgtccccaccg

SEQ ID NO: 4703952 - DNA, 16 bp, Homo sapiens
cacgactgtctccatg

SEQ ID NO: 4703953 - DNA, 14 bp, Homo sapiens
cacgaggtgcagta

SEQ ID NO: 4703954 - DNA, 16 bp, Homo sapiens
cacgcacgcacacaca

SEQ ID NO: 4703955 - DNA, 13 bp, Homo sapiens
cacgccactgcac

SEQ ID NO: 4703956 - DNA, 15 bp, Homo sapiens
cacgccactgcacta

SEQ ID NO: 4703957 - DNA, 19 bp, Homo sapiens
cacgccagattctttcctg

SEQ ID NO: 4703958 - DNA, 22 bp, Homo sapiens
cacgccagattctttcctgagg

SEQ ID NO: 4703959 - DNA, 13 bp, Homo sapiens
cacgcccccactg

SEQ ID NO: 4703960 - DNA, 16 bp, Homo sapiens
cacgctggagtgcagt

SEQ ID NO: 4703961 - DNA, 16 bp, Homo sapiens
cacggagccactcctc

SEQ ID NO: 4703962 - DNA, 19 bp, Homo sapiens
cacggagccactcctctga

SEQ ID NO: 4703963 - DNA, 12 bp, Homo sapiens
cacggccaggcc

SEQ ID NO: 4703964 - DNA, 19 bp, Homo sapiens
cacggctcactgcagcctc

SEQ ID NO: 4703965 - DNA, 20 bp, Homo sapiens
cacggctcactgcagcctca

SEQ ID NO: 4703966 - DNA, 22 bp, Homo sapiens
cacgggggcagctgatacaaat

SEQ ID NO: 4703967 - DNA, 17 bp, Homo sapiens
cacggtttgaagcctgg

SEQ ID NO: 4703968 - DNA, 18 bp, Homo sapiens
cacggtttgaagcctgga

SEQ ID NO: 4703969 - DNA, 19 bp, Homo sapiens
cacgtacacacacatacac

SEQ ID NO: 4703970 - DNA, 18 bp, Homo sapiens
cacgtggaggagcagtgc

SEQ ID NO: 4703971 - DNA, 14 bp, Homo sapiens
cacgtgtatgcaag

SEQ ID NO: 4703972 - DNA, 19 bp, Homo sapiens
cacgtgtgtttttctatta

SEQ ID NO: 4703973 - DNA, 14 bp, Homo sapiens
cactaaccacgctg

SEQ ID NO: 4703974 - DNA, 15 bp, Homo sapiens
cactaaccacgctgg

SEQ ID NO: 4703975 - DNA, 16 bp, Homo sapiens
cactaacgaaatatca

SEQ ID NO: 4703976 - DNA, 19 bp, Homo sapiens
cactaatgagtatttggta

SEQ ID NO: 4703977 - DNA, 20 bp, Homo sapiens
cactaccgtggaccacctag

SEQ ID NO: 4703978 - DNA, 18 bp, Homo sapiens
cactatcccggctgccct

SEQ ID NO: 4703979 - DNA, 17 bp, Homo sapiens
cactatgttgcccaggc

SEQ ID NO: 4703980 - DNA, 20 bp, Homo sapiens
cactatgttgcccaggcagg

SEQ ID NO: 4703981 - DNA, 12 bp, Homo sapiens
cactatttttat

SEQ ID NO: 4703982 - DNA, 15 bp, Homo sapiens
cactcaagaagcagg

SEQ ID NO: 4703983 - DNA, 23 bp, Homo sapiens
cactcaagaagcaggctacactg

SEQ ID NO: 4703984 - DNA, 13 bp, Homo sapiens
cactcacattttc

SEQ ID NO: 4703985 - DNA, 16 bp, Homo sapiens
cactcacattttctca

SEQ ID NO: 4703986 - DNA, 18 bp, Homo sapiens
cactcagaagacactgat

SEQ ID NO: 4703987 - DNA, 16 bp, Homo sapiens
cactcagccgtgggcc

SEQ ID NO: 4703988 - DNA, 15 bp, Homo sapiens
cactcattgacctga

SEQ ID NO: 4703989 - DNA, 20 bp, Homo sapiens
cactcattgacctgaggccc

SEQ ID NO: 4703990 - DNA, 13 bp, Homo sapiens
cactcccaggcag

SEQ ID NO: 4703991 - DNA, 17 bp, Homo sapiens
cactcccctaaactcca

SEQ ID NO: 4703992 - DNA, 12 bp, Homo sapiens
cactcccctgct

SEQ ID NO: 4703993 - DNA, 17 bp, Homo sapiens
cagcaattctcctgcct

SEQ ID NO: 4703994 - DNA, 19 bp, Homo sapiens
cagcacagcaaggaggctg

SEQ ID NO: 4703995 - DNA, 21 bp, Homo sapiens
cagcacagcaaggaggctggc

SEQ ID NO: 4703996 - DNA, 15 bp, Homo sapiens
cagcaccggaccagc

SEQ ID NO: 4703997 - DNA, 21 bp, Homo sapiens
cagcaccggaccagcctggcc

SEQ ID NO: 4703998 - DNA, 12 bp, Homo sapiens
cagcactgagga

SEQ ID NO: 4703999 - DNA, 19 bp, Homo sapiens
cagcacttggagaggctga

SEQ ID NO: 4704000 - DNA, 11 bp, Homo sapiens
cagcagagcac

SEQ ID NO: 4704001 - DNA, 13 bp, Homo sapiens
cagcagagcacct

SEQ ID NO: 4704002 - DNA, 14 bp, Homo sapiens
cagcaggtgctgct

SEQ ID NO: 4704003 - DNA, 17 bp, Homo sapiens
cagcaggtgctgctacc

SEQ ID NO: 4704004 - DNA, 22 bp, Homo sapiens
cagcagtgtgaggccagggcag

SEQ ID NO: 4704005 - DNA, 22 bp, Homo sapiens
cagcatattcaggaagctcagg

SEQ ID NO: 4704006 - DNA, 14 bp, Homo sapiens
cagcatcctggcac

SEQ ID NO: 4704007 - DNA, 19 bp, Homo sapiens
cagcatcctggcacccggc

SEQ ID NO: 4704008 - DNA, 21 bp, Homo sapiens
cagcatcctggcacccggccc

SEQ ID NO: 4704009 - DNA, 21 bp, Homo sapiens
cagcatcgtgatcactgagcc

SEQ ID NO: 4704010 - DNA, 16 bp, Homo sapiens
cagcattgtatatgtg

SEQ ID NO: 4704011 - DNA, 20 bp, Homo sapiens
cagccaagggatgaaagaga

SEQ ID NO: 4704012 - DNA, 15 bp, Homo sapiens
cagccacattcctga

SEQ ID NO: 4704013 - DNA, 19 bp, Homo sapiens
cagccacattcctgatgct

SEQ ID NO: 4704014 - DNA, 12 bp, Homo sapiens
cagccaccctca

SEQ ID NO: 4704015 - DNA, 22 bp, Homo sapiens
cagccacggccaggccagaggg

SEQ ID NO: 4704016 - DNA, 18 bp, Homo sapiens
cagccagggagagcccag

SEQ ID NO: 4704017 - DNA, 13 bp, Homo sapiens
cagccagggctgc

SEQ ID NO: 4704018 - DNA, 16 bp, Homo sapiens
cagccagggctgctag

SEQ ID NO: 4704019 - DNA, 19 bp, Homo sapiens
cagccaggtgctgtgacac

SEQ ID NO: 4704020 - DNA, 17 bp, Homo sapiens
cagcccaaagaaggaaa

SEQ ID NO: 4704021 - DNA, 16 bp, Homo sapiens
cagcccacgtcctgtc

SEQ ID NO: 4704022 - DNA, 19 bp, Homo sapiens
cagcccacgtcctgtcagt

SEQ ID NO: 4704023 - DNA, 20 bp, Homo sapiens
cagccccaaaactctcctct

SEQ ID NO: 4704024 - DNA, 12 bp, Homo sapiens
cagccccacagc

SEQ ID NO: 4704025 - DNA, 14 bp, Homo sapiens
cagccccacagccc

SEQ ID NO: 4704026 - DNA, 20 bp, Homo sapiens
cagccccacagcccacgtcc

SEQ ID NO: 4704027 - DNA, 23 bp, Homo sapiens
cagccccaccccagggcagccag

SEQ ID NO: 4704028 - DNA, 13 bp, Homo sapiens
cagccccagtgcc

SEQ ID NO: 4704029 - DNA, 15 bp, Homo sapiens
cagccccagtgccca

SEQ ID NO: 4704030 - DNA, 16 bp, Homo sapiens
cagccccagtgcccac

SEQ ID NO: 4704031 - DNA, 13 bp, Homo sapiens
cagccccattctg

SEQ ID NO: 4704032 - DNA, 16 bp, Homo sapiens
cagccccattctgcct

SEQ ID NO: 4704033 - DNA, 12 bp, Homo sapiens
cagcccccaccc

SEQ ID NO: 4704034 - DNA, 13 bp, Homo sapiens
cagcccctgctgg

SEQ ID NO: 4704035 - DNA, 22 bp, Homo sapiens
cagcccctggatgcagcctcac

SEQ ID NO: 4704036 - DNA, 21 bp, Homo sapiens
cagccccttctgacccatgct

SEQ ID NO: 4704037 - DNA, 22 bp, Homo sapiens
cagccccttctgacccatgctg

SEQ ID NO: 4704038 - DNA, 24 bp, Homo sapiens
cagccccttctgacccatgctgcc

SEQ ID NO: 4704039 - DNA, 15 bp, Homo sapiens
cagcccgggctctgc

SEQ ID NO: 4704040 - DNA, 17 bp, Homo sapiens
cagcccgggctctgcct

SEQ ID NO: 4704041 - DNA, 20 bp, Homo sapiens
cagcccgggctctgcctccc

SEQ ID NO: 4704042 - DNA, 21 bp, Homo sapiens
cagcccgggctctgcctccca

SEQ ID NO: 4704043 - DNA, 22 bp, Homo sapiens
cagcccgggctctgcctcccat

SEQ ID NO: 4704044 - DNA, 18 bp, Homo sapiens
cagccctcacccctggtt

SEQ ID NO: 4704045 - DNA, 14 bp, Homo sapiens
cagccctcccagca

SEQ ID NO: 4704046 - DNA, 20 bp, Homo sapiens
cagccctggagtcatgccaa

SEQ ID NO: 4704047 - DNA, 17 bp, Homo sapiens
cagccctggctgaagga

SEQ ID NO: 4704048 - DNA, 23 bp, Homo sapiens
cagcccttgggggtcctcctcca

SEQ ID NO: 4704049 - DNA, 19 bp, Homo sapiens
cagccgctgagcgaggaga

SEQ ID NO: 4704050 - DNA, 17 bp, Homo sapiens
cagcctcaacctcctgg

SEQ ID NO: 4704051 - DNA, 18 bp, Homo sapiens
cagcctcaataagccttg

SEQ ID NO: 4704052 - DNA, 21 bp, Homo sapiens
cagcctcaataagccttgtcg

SEQ ID NO: 4704053 - DNA, 23 bp, Homo sapiens
cagcctcccaaagtgctgggatt

SEQ ID NO: 4704054 - DNA, 18 bp, Homo sapiens
cagcctcccctgccaggg

SEQ ID NO: 4704055 - DNA, 20 bp, Homo sapiens
cagcctcccgaatagctggg

SEQ ID NO: 4704056 - DNA, 22 bp, Homo sapiens
cagcctcccgagtagctgggac

SEQ ID NO: 4704057 - DNA, 23 bp, Homo sapiens
cagcctcccgagtagctgggact

SEQ ID NO: 4704058 - DNA, 15 bp, Homo sapiens
cagcctcctgagtag

SEQ ID NO: 4704059 - DNA, 15 bp, Homo sapiens
cagcctctagggacc

SEQ ID NO: 4704060 - DNA, 20 bp, Homo sapiens
cagcctctgcaagattttaa

SEQ ID NO: 4704061 - DNA, 19 bp, Homo sapiens
cagcctgacaacagcctga

SEQ ID NO: 4704062 - DNA, 22 bp, Homo sapiens
cagcctgacaacagcctgagaa

SEQ ID NO: 4704063 - DNA, 13 bp, Homo sapiens
cagcctgagaaat

SEQ ID NO: 4704064 - DNA, 12 bp, Homo sapiens
cagcctgagaat

SEQ ID NO: 4704065 - DNA, 23 bp, Homo sapiens
cagcctgagaatgacctgccctg

SEQ ID NO: 4704066 - DNA, 20 bp, Homo sapiens
cagcctgctccttcccagga

SEQ ID NO: 4704067 - DNA, 11 bp, Homo sapiens
cagcctggccc

SEQ ID NO: 4704068 - DNA, 14 bp, Homo sapiens
cagcctggcccagc

SEQ ID NO: 4704069 - DNA, 17 bp, Homo sapiens
cagcctggcccagctcc

SEQ ID NO: 4704070 - DNA, 20 bp, Homo sapiens
cagcctggcccagctccccc

SEQ ID NO: 4704071 - DNA, 22 bp, Homo sapiens
cagccttgaccattctccacct

SEQ ID NO: 4704072 - DNA, 13 bp, Homo sapiens
cagcctttaagat

SEQ ID NO: 4704073 - DNA, 13 bp, Homo sapiens
cagcgagccctgg

SEQ ID NO: 4704074 - DNA, 20 bp, Homo sapiens
cagcgctggccgggaccccg

SEQ ID NO: 4704075 - DNA, 21 bp, Homo sapiens
cagcgctgtcaggattgcgag

SEQ ID NO: 4704076 - DNA, 18 bp, Homo sapiens
cagcggggacagctcctt

SEQ ID NO: 4704077 - DNA, 18 bp, Homo sapiens
cagcgtcctcctctgtga

SEQ ID NO: 4704078 - DNA, 19 bp, Homo sapiens
cagcgtgctttaaaaaata

SEQ ID NO: 4704079 - DNA, 15 bp, Homo sapiens
cagctaaatttggag

SEQ ID NO: 4704080 - DNA, 18 bp, Homo sapiens
cagctaacacacagctcc

SEQ ID NO: 4704081 - DNA, 21 bp, Homo sapiens
cagctatatactatttatata

SEQ ID NO: 4704082 - DNA, 14 bp, Homo sapiens
cagctcaccagccc

SEQ ID NO: 4704083 - DNA, 16 bp, Homo sapiens
cagctcaccagcccca

SEQ ID NO: 4704084 - DNA, 17 bp, Homo sapiens
cagctcaccagccccag

SEQ ID NO: 4704085 - DNA, 21 bp, Homo sapiens
cagctcaccagccccagtgcc

SEQ ID NO: 4704086 - DNA, 22 bp, Homo sapiens
cagctcaccagccccagtgccc

SEQ ID NO: 4704087 - DNA, 13 bp, Homo sapiens
cagctcacctctc

SEQ ID NO: 4704088 - DNA, 16 bp, Homo sapiens
cagctcacctctccct

SEQ ID NO: 4704089 - DNA, 20 bp, Homo sapiens
cagctcagagagggtgggag

SEQ ID NO: 4704090 - DNA, 15 bp, Homo sapiens
cagctcatctctgtc

SEQ ID NO: 4704091 - DNA, 16 bp, Homo sapiens
cagctccagctcacca

SEQ ID NO: 4704092 - DNA, 22 bp, Homo sapiens
cagctccagctcaccagcccca

SEQ ID NO: 4704093 - DNA, 13 bp, Homo sapiens
cagctccccagag

SEQ ID NO: 4704094 - DNA, 19 bp, Homo sapiens
cagctcctcatccagggct

SEQ ID NO: 4704095 - DNA, 16 bp, Homo sapiens
cagctccttctgtcct

SEQ ID NO: 4704096 - DNA, 21 bp, Homo sapiens
cagctccttctgtcctactct

SEQ ID NO: 4704097 - DNA, 23 bp, Homo sapiens
cagctccttctgtcctactctgt

SEQ ID NO: 4704098 - DNA, 18 bp, Homo sapiens
cagctctcagttgcagcc

SEQ ID NO: 4704099 - DNA, 16 bp, Homo sapiens
cagctctggtccatag

SEQ ID NO: 4704100 - DNA, 18 bp, Homo sapiens
cagctcttctccaggctg

SEQ ID NO: 4704101 - DNA, 19 bp, Homo sapiens
cagctcttctccaggctgt

SEQ ID NO: 4704102 - DNA, 12 bp, Homo sapiens
cagtagacaagc

SEQ ID NO: 4704103 - DNA, 21 bp, Homo sapiens
cagtagattcaagttgtgtct

SEQ ID NO: 4704104 - DNA, 15 bp, Homo sapiens
cagtaggagcccagc

SEQ ID NO: 4704105 - DNA, 17 bp, Homo sapiens
cagtagtcacctctggg

SEQ ID NO: 4704106 - DNA, 23 bp, Homo sapiens
cagtataattgagttttcagtgg

SEQ ID NO: 4704107 - DNA, 16 bp, Homo sapiens
cagtatgtcccatagg

SEQ ID NO: 4704108 - DNA, 16 bp, Homo sapiens
cagtattacttctgct

SEQ ID NO: 4704109 - DNA, 12 bp, Homo sapiens
cagtattgaaaa

SEQ ID NO: 4704110 - DNA, 19 bp, Homo sapiens
cagtcaaatttacatttat

SEQ ID NO: 4704111 - DNA, 14 bp, Homo sapiens
cagtcaccccggcc

SEQ ID NO: 4704112 - DNA, 17 bp, Homo sapiens
cagtcaccccggccacc

SEQ ID NO: 4704113 - DNA, 20 bp, Homo sapiens
cagtcaccccggccacctgc

SEQ ID NO: 4704114 - DNA, 22 bp, Homo sapiens
cagtcaccccggccacctgcgg

SEQ ID NO: 4704115 - DNA, 13 bp, Homo sapiens
cagtcatgcataa

SEQ ID NO: 4704116 - DNA, 19 bp, Homo sapiens
cagtcatgcataaatatgc

SEQ ID NO: 4704117 - DNA, 18 bp, Homo sapiens
cagtcattatttaaagca

SEQ ID NO: 4704118 - DNA, 22 bp, Homo sapiens
cagtccaaggaaaccacagctg

SEQ ID NO: 4704119 - DNA, 13 bp, Homo sapiens
cagtccctgccaa

SEQ ID NO: 4704120 - DNA, 14 bp, Homo sapiens
cagtccctgccaat

SEQ ID NO: 4704121 - DNA, 12 bp, Homo sapiens
cagtcctcccat

SEQ ID NO: 4704122 - DNA, 14 bp, Homo sapiens
cagtcctcccatct

SEQ ID NO: 4704123 - DNA, 15 bp, Homo sapiens
cagtcctcccatctc

SEQ ID NO: 4704124 - DNA, 17 bp, Homo sapiens
cagtcctcccatctcac

SEQ ID NO: 4704125 - DNA, 15 bp, Homo sapiens
cagtccttaccagca

SEQ ID NO: 4704126 - DNA, 19 bp, Homo sapiens
cagtccttaccagcagagc

SEQ ID NO: 4704127 - DNA, 15 bp, Homo sapiens
cagtcgatagagctg

SEQ ID NO: 4704128 - DNA, 21 bp, Homo sapiens
cagtcgcgagcacatgttcat

SEQ ID NO: 4704129 - DNA, 16 bp, Homo sapiens
cagtcgcgctgcctgt

SEQ ID NO: 4704130 - DNA, 22 bp, Homo sapiens
cagtctaggaatggagtctccc

SEQ ID NO: 4704131 - DNA, 15 bp, Homo sapiens
cagtctcaattttgt

SEQ ID NO: 4704132 - DNA, 20 bp, Homo sapiens
cagtctcaattttgtattta

SEQ ID NO: 4704133 - DNA, 14 bp, Homo sapiens
cagtctccctccct

SEQ ID NO: 4704134 - DNA, 20 bp, Homo sapiens
cagtctgattcccaagctct

SEQ ID NO: 4704135 - DNA, 19 bp, Homo sapiens
cagtctggaatgcagtggt

SEQ ID NO: 4704136 - DNA, 21 bp, Homo sapiens
cagtcttccatttgcaaggga

SEQ ID NO: 4704137 - DNA, 16 bp, Homo sapiens
cagtgaaagaaaataa

SEQ ID NO: 4704138 - DNA, 13 bp, Homo sapiens
cagtgaaagcatc

SEQ ID NO: 4704139 - DNA, 16 bp, Homo sapiens
cagtgaacagtttgga

SEQ ID NO: 4704140 - DNA, 15 bp, Homo sapiens
cagtgaagatgcagg

SEQ ID NO: 4704141 - DNA, 18 bp, Homo sapiens
cagtgaatttaagcatga

SEQ ID NO: 4704142 - DNA, 14 bp, Homo sapiens
cagtgaatttgtcc

SEQ ID NO: 4704143 - DNA, 16 bp, Homo sapiens
cagtgactcgggctcc

SEQ ID NO: 4704144 - DNA, 18 bp, Homo sapiens
cagtgactcgggctcctg

SEQ ID NO: 4704145 - DNA, 17 bp, Homo sapiens
cagtgaggctctgccct

SEQ ID NO: 4704146 - DNA, 21 bp, Homo sapiens
cagtgaggctctgcccttggt

SEQ ID NO: 4704147 - DNA, 13 bp, Homo sapiens
cagtgatttacat

SEQ ID NO: 4704148 - DNA, 17 bp, Homo sapiens
cagtgatttacatgctg

SEQ ID NO: 4704149 - DNA, 14 bp, Homo sapiens
cagtgcaggcacag

SEQ ID NO: 4704150 - DNA, 22 bp, Homo sapiens
cagtgccaataaaatttaggaa

SEQ ID NO: 4704151 - DNA, 22 bp, Homo sapiens
cagtgccagcccctgctggctg

SEQ ID NO: 4704152 - DNA, 17 bp, Homo sapiens
cagtgcccaagagtggg

SEQ ID NO: 4704153 - DNA, 17 bp, Homo sapiens
cagtgcccacaggatca

SEQ ID NO: 4704154 - DNA, 18 bp, Homo sapiens
cagtgcccacaggatcag

SEQ ID NO: 4704155 - DNA, 21 bp, Homo sapiens
cagtgcccacaggatcagtct

SEQ ID NO: 4704156 - DNA, 22 bp, Homo sapiens
cagtgctgctgaactaatttct

SEQ ID NO: 4704157 - DNA, 13 bp, Homo sapiens
cagtggagagggc

SEQ ID NO: 4704158 - DNA, 12 bp, Homo sapiens
cagtggcagctg

SEQ ID NO: 4704159 - DNA, 15 bp, Homo sapiens
cagtggctgctgccc

SEQ ID NO: 4704160 - DNA, 11 bp, Homo sapiens
cagtgggaact

SEQ ID NO: 4704161 - DNA, 15 bp, Homo sapiens
cagtgggagctgcct

SEQ ID NO: 4704162 - DNA, 20 bp, Homo sapiens
cagtgggagctgcctgttca

SEQ ID NO: 4704163 - DNA, 23 bp, Homo sapiens
cagtgggagctgcctgttcagct

SEQ ID NO: 4704164 - DNA, 20 bp, Homo sapiens
cagtggggaggggctgtggg

SEQ ID NO: 4704165 - DNA, 15 bp, Homo sapiens
cagtggggcagtcat

SEQ ID NO: 4704166 - DNA, 15 bp, Homo sapiens
cagtgggtcccactt

SEQ ID NO: 4704167 - DNA, 20 bp, Homo sapiens
cagtgggtcccacttcccct

SEQ ID NO: 4704168 - DNA, 14 bp, Homo sapiens
cagtgggttaattt

SEQ ID NO: 4704169 - DNA, 19 bp, Homo sapiens
cagtggtgcgatctgggtt

SEQ ID NO: 4704170 - DNA, 21 bp, Homo sapiens
cagtggtgcgatctgggttca

SEQ ID NO: 4704171 - DNA, 19 bp, Homo sapiens
cagtggtggagctggacct

SEQ ID NO: 4704172 - DNA, 12 bp, Homo sapiens
cagtgtacagtc

SEQ ID NO: 4704173 - DNA, 16 bp, Homo sapiens
cagtgtacccccgccc

SEQ ID NO: 4704174 - DNA, 18 bp, Homo sapiens
cagtgtacccccgcccag

SEQ ID NO: 4704175 - DNA, 22 bp, Homo sapiens
cagtgtacccccgcccaggctg

SEQ ID NO: 4704176 - DNA, 23 bp, Homo sapiens
cagtgtacccccgcccaggctgg

SEQ ID NO: 4704177 - DNA, 13 bp, Homo sapiens
cagtgtctgggct

SEQ ID NO: 4704178 - DNA, 18 bp, Homo sapiens
cagtgtgaggccagggca

SEQ ID NO: 4704179 - DNA, 14 bp, Homo sapiens
cagtgttaaatgtg

SEQ ID NO: 4704180 - DNA, 23 bp, Homo sapiens
cagtgttacaatcagtgtgaatg

SEQ ID NO: 4704181 - DNA, 17 bp, Homo sapiens
cagtgttaggcctggca

SEQ ID NO: 4704182 - DNA, 18 bp, Homo sapiens
cagtgttaggcctggcac

SEQ ID NO: 4704183 - DNA, 16 bp, Homo sapiens
cagttaaaaaaaattt

SEQ ID NO: 4704184 - DNA, 19 bp, Homo sapiens
cagttaaaaaaaattttaa

SEQ ID NO: 4704185 - DNA, 20 bp, Homo sapiens
cagttacgtgagaagaggtc

SEQ ID NO: 4704186 - DNA, 21 bp, Homo sapiens
cagttagaaggaggttctaat

SEQ ID NO: 4704187 - DNA, 17 bp, Homo sapiens
cagttattatatttaca

SEQ ID NO: 4704188 - DNA, 23 bp, Homo sapiens
cagttcagaatcacttctgagaa

SEQ ID NO: 4704189 - DNA, 23 bp, Homo sapiens
cagttcataaatttgttgtcatg

SEQ ID NO: 4704190 - DNA, 14 bp, Homo sapiens
cagttccctttatt

SEQ ID NO: 4704191 - DNA, 19 bp, Homo sapiens
cagttcctttagaaagcag

SEQ ID NO: 4704192 - DNA, 15 bp, Homo sapiens
cagttcctttcaatg

SEQ ID NO: 4704193 - DNA, 22 bp, Homo sapiens
cagttcggtgagctacaaatgc

SEQ ID NO: 4704194 - DNA, 12 bp, Homo sapiens
cagttctgtgta

SEQ ID NO: 4704195 - DNA, 18 bp, Homo sapiens
cagttcttacacattcca

SEQ ID NO: 4704196 - DNA, 12 bp, Homo sapiens
cagttcttcccc

SEQ ID NO: 4704197 - DNA, 15 bp, Homo sapiens
cagttcttgtgtggt

SEQ ID NO: 4704198 - DNA, 11 bp, Homo sapiens
cagttgcagcc

SEQ ID NO: 4704199 - DNA, 22 bp, Homo sapiens
cagttgcatttttatggagttc

SEQ ID NO: 4704200 - DNA, 22 bp, Homo sapiens
cagttggtcccccttccatgga

SEQ ID NO: 4704201 - DNA, 14 bp, Homo sapiens
cagttgttatttat

SEQ ID NO: 4704202 - DNA, 21 bp, Homo sapiens
cagttgttatttattgaaatg

SEQ ID NO: 4704203 - DNA, 15 bp, Homo sapiens
cagtttcttagcttt

SEQ ID NO: 4704204 - DNA, 16 bp, Homo sapiens
cagtttcttctgtaaa

SEQ ID NO: 4704205 - DNA, 18 bp, Homo sapiens
cagtttgtagtgccactg

SEQ ID NO: 4704206 - DNA, 16 bp, Homo sapiens
cagtttgtcttggata

SEQ ID NO: 4704207 - DNA, 18 bp, Homo sapiens
cagttttaactgtggata

SEQ ID NO: 4704208 - DNA, 23 bp, Homo sapiens
cagttttaactgtggatattgtt

SEQ ID NO: 4704209 - DNA, 13 bp, Homo sapiens
cagttttagaata

SEQ ID NO: 4704210 - DNA, 15 bp, Homo sapiens
cagtttttattgctt

SEQ ID NO: 4704211 - DNA, 16 bp, Homo sapiens
cataaaagaaataaac

SEQ ID NO: 4704212 - DNA, 13 bp, Homo sapiens
catgttggccagg

SEQ ID NO: 4704213 - DNA, 14 bp, Homo sapiens
catgttggccaggc

SEQ ID NO: 4704214 - DNA, 12 bp, Homo sapiens
catgtttctgcc

SEQ ID NO: 4704215 - DNA, 18 bp, Homo sapiens
catgttttccagctcctc

SEQ ID NO: 4704216 - DNA, 18 bp, Homo sapiens
catgtttttaaagggcta

SEQ ID NO: 4704217 - DNA, 19 bp, Homo sapiens
cattaaaaatgttagtatt

SEQ ID NO: 4704218 - DNA, 22 bp, Homo sapiens
cattaaaggaaacgtggcagga

SEQ ID NO: 4704219 - DNA, 22 bp, Homo sapiens
cattaattaccctactttcatt

SEQ ID NO: 4704220 - DNA, 24 bp, Homo sapiens
cattacagggaatgcctgagtgcc

SEQ ID NO: 4704221 - DNA, 17 bp, Homo sapiens
cattaccttactgtgga

SEQ ID NO: 4704222 - DNA, 20 bp, Homo sapiens
cattaccttactgtggagga

SEQ ID NO: 4704223 - DNA, 23 bp, Homo sapiens
cattactttaccacccccacacc

SEQ ID NO: 4704224 - DNA, 16 bp, Homo sapiens
cattacttttaaaaat

SEQ ID NO: 4704225 - DNA, 19 bp, Homo sapiens
cattacttttaaaaatgta

SEQ ID NO: 4704226 - DNA, 22 bp, Homo sapiens
cattagaagatattagtcttgg

SEQ ID NO: 4704227 - DNA, 11 bp, Homo sapiens
cattagagcag

SEQ ID NO: 4704228 - DNA, 16 bp, Homo sapiens
cattagttttgaagat

SEQ ID NO: 4704229 - DNA, 23 bp, Homo sapiens
cattattcaagaaagatatctat

SEQ ID NO: 4704230 - DNA, 16 bp, Homo sapiens
cattatttaatttgta

SEQ ID NO: 4704231 - DNA, 18 bp, Homo sapiens
cattatttaatttgtatg

SEQ ID NO: 4704232 - DNA, 23 bp, Homo sapiens
cattatttaatttgtatgctaaa

SEQ ID NO: 4704233 - DNA, 18 bp, Homo sapiens
cattcaacagagactgaa

SEQ ID NO: 4704234 - DNA, 12 bp, Homo sapiens
cattcacatttc

SEQ ID NO: 4704235 - DNA, 15 bp, Homo sapiens
cattcacatttcaag

SEQ ID NO: 4704236 - DNA, 13 bp, Homo sapiens
cattcaggaattc

SEQ ID NO: 4704237 - DNA, 19 bp, Homo sapiens
cattcaggaattcttggag

SEQ ID NO: 4704238 - DNA, 19 bp, Homo sapiens
cattcatccaggactgaga

SEQ ID NO: 4704239 - DNA, 22 bp, Homo sapiens
cattcatgttttaaaagtttgt

SEQ ID NO: 4704240 - DNA, 17 bp, Homo sapiens
cattcattccattctgg

SEQ ID NO: 4704241 - DNA, 14 bp, Homo sapiens
cattccatccttga

SEQ ID NO: 4704242 - DNA, 14 bp, Homo sapiens
cattccatcttaca

SEQ ID NO: 4704243 - DNA, 15 bp, Homo sapiens
cattccattctggaa

SEQ ID NO: 4704244 - DNA, 13 bp, Homo sapiens
cattccccaggag

SEQ ID NO: 4704245 - DNA, 15 bp, Homo sapiens
cattccccaggaggc

SEQ ID NO: 4704246 - DNA, 17 bp, Homo sapiens
cattccccaggaggcca

SEQ ID NO: 4704247 - DNA, 13 bp, Homo sapiens
cattcctcacctt

SEQ ID NO: 4704248 - DNA, 22 bp, Homo sapiens
cattcctgatgcttcttcagag

SEQ ID NO: 4704249 - DNA, 23 bp, Homo sapiens
cattcctgatgcttcttcagaga

SEQ ID NO: 4704250 - DNA, 21 bp, Homo sapiens
cattcctgggaaatattccct

SEQ ID NO: 4704251 - DNA, 19 bp, Homo sapiens
cattccttctttgataatg

SEQ ID NO: 4704252 - DNA, 14 bp, Homo sapiens
cattctcagccaca

SEQ ID NO: 4704253 - DNA, 13 bp, Homo sapiens
cattctccacctg

SEQ ID NO: 4704254 - DNA, 18 bp, Homo sapiens
cattctccacctgccagg

SEQ ID NO: 4704255 - DNA, 14 bp, Homo sapiens
cattctctgtctca

SEQ ID NO: 4704256 - DNA, 23 bp, Homo sapiens
cattctctgtctcatccatcatc

SEQ ID NO: 4704257 - DNA, 18 bp, Homo sapiens
cattctgacccagggcct

SEQ ID NO: 4704258 - DNA, 16 bp, Homo sapiens
cattctgcctgcccag

SEQ ID NO: 4704259 - DNA, 19 bp, Homo sapiens
cattctgcctgcccaggcc

SEQ ID NO: 4704260 - DNA, 16 bp, Homo sapiens
cattctggaagtgact

SEQ ID NO: 4704261 - DNA, 13 bp, Homo sapiens
cattctggaataa

SEQ ID NO: 4704262 - DNA, 14 bp, Homo sapiens
cattcttcccttat

SEQ ID NO: 4704263 - DNA, 14 bp, Homo sapiens
cattcttgttcaaa

SEQ ID NO: 4704264 - DNA, 16 bp, Homo sapiens
cattctttttgaaatg

SEQ ID NO: 4704265 - DNA, 22 bp, Homo sapiens
cattgaagaatgttagagtaat

SEQ ID NO: 4704266 - DNA, 23 bp, Homo sapiens
cattgaattcttggttgaggaaa

SEQ ID NO: 4704267 - DNA, 22 bp, Homo sapiens
cattgacctgaggcccttctct

SEQ ID NO: 4704268 - DNA, 13 bp, Homo sapiens
cattgatgaatga

SEQ ID NO: 4704269 - DNA, 22 bp, Homo sapiens
cattgatgaatgaggaacaatc

SEQ ID NO: 4704270 - DNA, 15 bp, Homo sapiens
cattgcaatagaaat

SEQ ID NO: 4704271 - DNA, 15 bp, Homo sapiens
cattgccaagggctt

SEQ ID NO: 4704272 - DNA, 23 bp, Homo sapiens
cattgcctcttttcacatttttt

SEQ ID NO: 4704273 - DNA, 18 bp, Homo sapiens
cattgctgttttaatttg

SEQ ID NO: 4704274 - DNA, 19 bp, Homo sapiens
cattggaactggaggcagg

SEQ ID NO: 4704275 - DNA, 17 bp, Homo sapiens
cattggacccttccatg

SEQ ID NO: 4704276 - DNA, 16 bp, Homo sapiens
cattggcagcaggtgc

SEQ ID NO: 4704277 - DNA, 23 bp, Homo sapiens
cattggcagcaggtgctgctacc

SEQ ID NO: 4704278 - DNA, 18 bp, Homo sapiens
cattggctatttaaaact

SEQ ID NO: 4704279 - DNA, 19 bp, Homo sapiens
cattggctatttaaaactt

SEQ ID NO: 4704280 - DNA, 16 bp, Homo sapiens
cattgtaaatctgaag

SEQ ID NO: 4704281 - DNA, 18 bp, Homo sapiens
cattgtaaatctgaagaa

SEQ ID NO: 4704282 - DNA, 19 bp, Homo sapiens
cattgtccaatcctatgtt

SEQ ID NO: 4704283 - DNA, 13 bp, Homo sapiens
cattgtgtcctgc

SEQ ID NO: 4704284 - DNA, 15 bp, Homo sapiens
cattgttcattcttg

SEQ ID NO: 4704285 - DNA, 16 bp, Homo sapiens
cattgttcattcttgt

SEQ ID NO: 4704286 - DNA, 23 bp, Homo sapiens
cattgttgatgctcacatatgat

SEQ ID NO: 4704287 - DNA, 12 bp, Homo sapiens
catttaaaaaaa

SEQ ID NO: 4704288 - DNA, 15 bp, Homo sapiens
catttaaagttgtat

SEQ ID NO: 4704289 - DNA, 19 bp, Homo sapiens
catttaagagacagtcacc

SEQ ID NO: 4704290 - DNA, 22 bp, Homo sapiens
catttaatgtagccatgggacc

SEQ ID NO: 4704291 - DNA, 20 bp, Homo sapiens
catttacataggaaccaaat

SEQ ID NO: 4704292 - DNA, 14 bp, Homo sapiens
catttactgtggct

SEQ ID NO: 4704293 - DNA, 15 bp, Homo sapiens
catttactgtggctt

SEQ ID NO: 4704294 - DNA, 21 bp, Homo sapiens
catttactttgtgttcacctt

SEQ ID NO: 4704295 - DNA, 15 bp, Homo sapiens
catttagtcctgtac

SEQ ID NO: 4704296 - DNA, 17 bp, Homo sapiens
catttagtttgattatt

SEQ ID NO: 4704297 - DNA, 23 bp, Homo sapiens
catttagtttgattattcagtgt

SEQ ID NO: 4704298 - DNA, 16 bp, Homo sapiens
catttatctattaaaa

SEQ ID NO: 4704299 - DNA, 16 bp, Homo sapiens
catttatgatttaata

SEQ ID NO: 4704300 - DNA, 17 bp, Homo sapiens
catttatgatttaataa

SEQ ID NO: 4704301 - DNA, 18 bp, Homo sapiens
catttatgatttaataaa

SEQ ID NO: 4704302 - DNA, 20 bp, Homo sapiens
catttatgatttaataaaat

SEQ ID NO: 4704303 - DNA, 23 bp, Homo sapiens
catttatgatttaataaaataat

SEQ ID NO: 4704304 - DNA, 20 bp, Homo sapiens
catttcacaaaacagccttt

SEQ ID NO: 4704305 - DNA, 18 bp, Homo sapiens
catttcacccctcccttt

SEQ ID NO: 4704306 - DNA, 22 bp, Homo sapiens
catttcacccctccctttctcc

SEQ ID NO: 4704307 - DNA, 22 bp, Homo sapiens
catttcaggagcagcctcagaa

SEQ ID NO: 4704308 - DNA, 15 bp, Homo sapiens
catttcctgggagaa

SEQ ID NO: 4704309 - DNA, 18 bp, Homo sapiens
catttcctgggagaaaga

SEQ ID NO: 4704310 - DNA, 12 bp, Homo sapiens
catttcctgtgt

SEQ ID NO: 4704311 - DNA, 13 bp, Homo sapiens
catttcctgtgtc

SEQ ID NO: 4704312 - DNA, 17 bp, Homo sapiens
catttctcatgttgaaa

SEQ ID NO: 4704313 - DNA, 21 bp, Homo sapiens
catttgaaagtgggtttcaat

SEQ ID NO: 4704314 - DNA, 18 bp, Homo sapiens
catttggcaggaagatgt

SEQ ID NO: 4704315 - DNA, 18 bp, Homo sapiens
catttggtattacacagt

SEQ ID NO: 4704316 - DNA, 19 bp, Homo sapiens
cattttattaaacattttc

SEQ ID NO: 4704317 - DNA, 21 bp, Homo sapiens
cattttattaaacattttcat

SEQ ID NO: 4704318 - DNA, 16 bp, Homo sapiens
cattttcatgcttcca

SEQ ID NO: 4704319 - DNA, 14 bp, Homo sapiens
cattttcttgtcaa

SEQ ID NO: 4704320 - DNA, 15 bp, Homo sapiens
cattttgccaaaatt

SEQ ID NO: 4704321 - DNA, 13 bp, Homo sapiens
ccagccccacagc

SEQ ID NO: 4704322 - DNA, 18 bp, Homo sapiens
ccagccccatcctctgta

SEQ ID NO: 4704323 - DNA, 11 bp, Homo sapiens
ccagcccctgg

SEQ ID NO: 4704324 - DNA, 14 bp, Homo sapiens
ccagcccctggatg

SEQ ID NO: 4704325 - DNA, 10 bp, Homo sapiens
ccagcccctt

SEQ ID NO: 4704326 - DNA, 15 bp, Homo sapiens
ccagccccttctgac

SEQ ID NO: 4704327 - DNA, 17 bp, Homo sapiens
ccagccctactctgtgt

SEQ ID NO: 4704328 - DNA, 18 bp, Homo sapiens
ccagccctactctgtgta

SEQ ID NO: 4704329 - DNA, 16 bp, Homo sapiens
ccagcccttagcaggg

SEQ ID NO: 4704330 - DNA, 14 bp, Homo sapiens
ccagccgctgcccg

SEQ ID NO: 4704331 - DNA, 20 bp, Homo sapiens
ccagcctctagggacccctc

SEQ ID NO: 4704332 - DNA, 20 bp, Homo sapiens
ccagcctggagatgaaatct

SEQ ID NO: 4704333 - DNA, 13 bp, Homo sapiens
ccagcctggccca

SEQ ID NO: 4704334 - DNA, 16 bp, Homo sapiens
ccagcctggcccagct

SEQ ID NO: 4704335 - DNA, 17 bp, Homo sapiens
ccagcctggcccagctc

SEQ ID NO: 4704336 - DNA, 20 bp, Homo sapiens
ccagccttgaccattctcca

SEQ ID NO: 4704337 - DNA, 22 bp, Homo sapiens
ccagccttgaccattctccacc

SEQ ID NO: 4704338 - DNA, 14 bp, Homo sapiens
ccagcgagccctgg

SEQ ID NO: 4704339 - DNA, 15 bp, Homo sapiens
ccagcgagccctggt

SEQ ID NO: 4704340 - DNA, 13 bp, Homo sapiens
ccagcgtcctcct

SEQ ID NO: 4704341 - DNA, 21 bp, Homo sapiens
ccagcgtgagtggtggaggag

SEQ ID NO: 4704342 - DNA, 14 bp, Homo sapiens
ccagctaattgaga

SEQ ID NO: 4704343 - DNA, 17 bp, Homo sapiens
ccagctcccccgggagg

SEQ ID NO: 4704344 - DNA, 21 bp, Homo sapiens
ccagctcccccgggaggggcc

SEQ ID NO: 4704345 - DNA, 18 bp, Homo sapiens
ccagctctgtatcaggac

SEQ ID NO: 4704346 - DNA, 20 bp, Homo sapiens
ccagctggccgggagcctga

SEQ ID NO: 4704347 - DNA, 21 bp, Homo sapiens
ccagctggtgagtgatgcggc

SEQ ID NO: 4704348 - DNA, 23 bp, Homo sapiens
ccagcttttcccaaaagcccatt

SEQ ID NO: 4704349 - DNA, 22 bp, Homo sapiens
ccaggaaaggctccaggagcag

SEQ ID NO: 4704350 - DNA, 22 bp, Homo sapiens
ccaggaaccgaacatatcattt

SEQ ID NO: 4704351 - DNA, 19 bp, Homo sapiens
ccaggaagaaggtgtgtcc

SEQ ID NO: 4704352 - DNA, 17 bp, Homo sapiens
ccaggaccaagggcaga

SEQ ID NO: 4704353 - DNA, 19 bp, Homo sapiens
ccaggactctgcagcctca

SEQ ID NO: 4704354 - DNA, 20 bp, Homo sapiens
ccaggactctgcagcctcag

SEQ ID NO: 4704355 - DNA, 22 bp, Homo sapiens
ccaggactctgcagcctcagag

SEQ ID NO: 4704356 - DNA, 16 bp, Homo sapiens
ccaggagcagccacat

SEQ ID NO: 4704357 - DNA, 14 bp, Homo sapiens
ccaggagctcccct

SEQ ID NO: 4704358 - DNA, 20 bp, Homo sapiens
ccaggagctcccctccccaa

SEQ ID NO: 4704359 - DNA, 13 bp, Homo sapiens
ccaggaggccagc

SEQ ID NO: 4704360 - DNA, 15 bp, Homo sapiens
ccaggaggccagcct

SEQ ID NO: 4704361 - DNA, 17 bp, Homo sapiens
ccaggatcatggtgtaa

SEQ ID NO: 4704362 - DNA, 20 bp, Homo sapiens
ccaggatcatggtgtaataa

SEQ ID NO: 4704363 - DNA, 23 bp, Homo sapiens
ccaggatcatggtgtaataagac

SEQ ID NO: 4704364 - DNA, 17 bp, Homo sapiens
ccaggcaacttgggaac

SEQ ID NO: 4704365 - DNA, 21 bp, Homo sapiens
ccaggcaggctaaggcgtgga

SEQ ID NO: 4704366 - DNA, 12 bp, Homo sapiens
ccaggcaggtct

SEQ ID NO: 4704367 - DNA, 14 bp, Homo sapiens
ccaggcaggtcttg

SEQ ID NO: 4704368 - DNA, 19 bp, Homo sapiens
ccaggcattccccaggagg

SEQ ID NO: 4704369 - DNA, 21 bp, Homo sapiens
ccaggcattccccaggaggcc

SEQ ID NO: 4704370 - DNA, 12 bp, Homo sapiens
ccaggccagagg

SEQ ID NO: 4704371 - DNA, 21 bp, Homo sapiens
ccaggccagagggagtgacag

SEQ ID NO: 4704372 - DNA, 21 bp, Homo sapiens
ccaggccaggaccaagggcag

SEQ ID NO: 4704373 - DNA, 19 bp, Homo sapiens
ccaggccaggactctgcag

SEQ ID NO: 4704374 - DNA, 21 bp, Homo sapiens
ccaggcccctgccaccctggg

SEQ ID NO: 4704375 - DNA, 14 bp, Homo sapiens
ccaggccctctgcc

SEQ ID NO: 4704376 - DNA, 23 bp, Homo sapiens
ccaggccctctgcccactccctg

SEQ ID NO: 4704377 - DNA, 17 bp, Homo sapiens
ccaggcctggccatgtg

SEQ ID NO: 4704378 - DNA, 17 bp, Homo sapiens
ccaggctgagcctcagt

SEQ ID NO: 4704379 - DNA, 14 bp, Homo sapiens
ccaggctggccagc

SEQ ID NO: 4704380 - DNA, 16 bp, Homo sapiens
ccaggctggccagccc

SEQ ID NO: 4704381 - DNA, 17 bp, Homo sapiens
ccaggctggccagcccc

SEQ ID NO: 4704382 - DNA, 21 bp, Homo sapiens
ccaggctggccagccccacag

SEQ ID NO: 4704383 - DNA, 18 bp, Homo sapiens
ccaggctgggcaaggagg

SEQ ID NO: 4704384 - DNA, 17 bp, Homo sapiens
ccaggcttagtcactga

SEQ ID NO: 4704385 - DNA, 17 bp, Homo sapiens
ccaggcttgcctgggac

SEQ ID NO: 4704386 - DNA, 21 bp, Homo sapiens
ccagggacagagggggtggcc

SEQ ID NO: 4704387 - DNA, 22 bp, Homo sapiens
ccagggacagagggggtggcct

SEQ ID NO: 4704388 - DNA, 14 bp, Homo sapiens
ccagggagagccca

SEQ ID NO: 4704389 - DNA, 18 bp, Homo sapiens
ccagggagagcccaggag

SEQ ID NO: 4704390 - DNA, 19 bp, Homo sapiens
ccagggcctggaagacaga

SEQ ID NO: 4704391 - DNA, 17 bp, Homo sapiens
ccagggctggactgagg

SEQ ID NO: 4704392 - DNA, 22 bp, Homo sapiens
ccagggctggactgaggcctga

SEQ ID NO: 4704393 - DNA, 19 bp, Homo sapiens
ccaggggcaggcacagcac

SEQ ID NO: 4704394 - DNA, 13 bp, Homo sapiens
ccaggggtgggac

SEQ ID NO: 4704395 - DNA, 21 bp, Homo sapiens
ccaggggtgggacaccctgtg

SEQ ID NO: 4704396 - DNA, 21 bp, Homo sapiens
ccagggttgaccccagaggat

SEQ ID NO: 4704397 - DNA, 21 bp, Homo sapiens
ccaggtaatgtgggtctacca

SEQ ID NO: 4704398 - DNA, 14 bp, Homo sapiens
ccaggtagaacaca

SEQ ID NO: 4704399 - DNA, 21 bp, Homo sapiens
ccaggtcttgacctgaactct

SEQ ID NO: 4704400 - DNA, 24 bp, Homo sapiens
ccaggtgcacaagctccaagctcc

SEQ ID NO: 4704401 - DNA, 19 bp, Homo sapiens
ccaggtgctaggaacactc

SEQ ID NO: 4704402 - DNA, 15 bp, Homo sapiens
ccaggtgctgtgaca

SEQ ID NO: 4704403 - DNA, 23 bp, Homo sapiens
ccaggttggaaaagaaatcaatt

SEQ ID NO: 4704404 - DNA, 12 bp, Homo sapiens
ccagtaaacaga

SEQ ID NO: 4704405 - DNA, 20 bp, Homo sapiens
ccagtacctcctgtctctgg

SEQ ID NO: 4704406 - DNA, 23 bp, Homo sapiens
ccagtatcctgctggttcactct

SEQ ID NO: 4704407 - DNA, 16 bp, Homo sapiens
ccagtcaccccggcca

SEQ ID NO: 4704408 - DNA, 17 bp, Homo sapiens
ccagtcaccccggccac

SEQ ID NO: 4704409 - DNA, 18 bp, Homo sapiens
ccagtcaccccggccacc

SEQ ID NO: 4704410 - DNA, 16 bp, Homo sapiens
ccagtcgcgctgcctg

SEQ ID NO: 4704411 - DNA, 19 bp, Homo sapiens
ccagtcgcgctgcctgtgt

SEQ ID NO: 4704412 - DNA, 20 bp, Homo sapiens
ccagtcgcgctgcctgtgtg

SEQ ID NO: 4704413 - DNA, 16 bp, Homo sapiens
ccagtgaggctctgcc

SEQ ID NO: 4704414 - DNA, 17 bp, Homo sapiens
ccagtgaggctctgccc

SEQ ID NO: 4704415 - DNA, 20 bp, Homo sapiens
ccagtgaggctctgcccttg

SEQ ID NO: 4704416 - DNA, 23 bp, Homo sapiens
ccagtgcccacaggatcagtctg

SEQ ID NO: 4704417 - DNA, 13 bp, Homo sapiens
ccagtgcccattc

SEQ ID NO: 4704418 - DNA, 13 bp, Homo sapiens
ccagtggctgctg

SEQ ID NO: 4704419 - DNA, 21 bp, Homo sapiens
ccagtggctgctgcccaggcc

SEQ ID NO: 4704420 - DNA, 22 bp, Homo sapiens
ccagtgttacaatcagtgtgaa

SEQ ID NO: 4704421 - DNA, 17 bp, Homo sapiens
ccagtgttagggaaggg

SEQ ID NO: 4704422 - DNA, 23 bp, Homo sapiens
ccagttcctttcaatggtttgca

SEQ ID NO: 4704423 - DNA, 17 bp, Homo sapiens
ccagttgggtggatgcc

SEQ ID NO: 4704424 - DNA, 20 bp, Homo sapiens
ccagttggtcccccttccat

SEQ ID NO: 4704425 - DNA, 17 bp, Homo sapiens
ccataagtgacaccaat

SEQ ID NO: 4704426 - DNA, 18 bp, Homo sapiens
ccataagtgacaccaata

SEQ ID NO: 4704427 - DNA, 22 bp, Homo sapiens
ccataagtgacaccaataaatg

SEQ ID NO: 4704428 - DNA, 14 bp, Homo sapiens
ccataatccctgtc

SEQ ID NO: 4704429 - DNA, 13 bp, Homo sapiens
ccatactaattat

SEQ ID NO: 4704430 - DNA, 20 bp, Homo sapiens
ccccagcaagtgagagctgg

SEQ ID NO: 4704431 - DNA, 22 bp, Homo sapiens
ccccagcaagtgagagctgggt

SEQ ID NO: 4704432 - DNA, 14 bp, Homo sapiens
ccccagccccatcc

SEQ ID NO: 4704433 - DNA, 16 bp, Homo sapiens
ccccagcccctccatg

SEQ ID NO: 4704434 - DNA, 19 bp, Homo sapiens
ccccagccctccttatcaa

SEQ ID NO: 4704435 - DNA, 19 bp, Homo sapiens
ccccagcctggcccagctc

SEQ ID NO: 4704436 - DNA, 16 bp, Homo sapiens
ccccaggactgggcca

SEQ ID NO: 4704437 - DNA, 16 bp, Homo sapiens
ccccagtgcccacagg

SEQ ID NO: 4704438 - DNA, 20 bp, Homo sapiens
ccccatcagtgctccctcac

SEQ ID NO: 4704439 - DNA, 19 bp, Homo sapiens
ccccatcctctgtacagag

SEQ ID NO: 4704440 - DNA, 21 bp, Homo sapiens
ccccatcctctgtacagagcc

SEQ ID NO: 4704441 - DNA, 17 bp, Homo sapiens
ccccatcctggcccatc

SEQ ID NO: 4704442 - DNA, 13 bp, Homo sapiens
ccccatctgccca

SEQ ID NO: 4704443 - DNA, 15 bp, Homo sapiens
ccccatgttctgtcc

SEQ ID NO: 4704444 - DNA, 21 bp, Homo sapiens
ccccattctgcctgcccaggc

SEQ ID NO: 4704445 - DNA, 13 bp, Homo sapiens
ccccatttgattt

SEQ ID NO: 4704446 - DNA, 15 bp, Homo sapiens
cccccatcctggccc

SEQ ID NO: 4704447 - DNA, 14 bp, Homo sapiens
ccccccagcactga

SEQ ID NO: 4704448 - DNA, 15 bp, Homo sapiens
cccccgggaggggcc

SEQ ID NO: 4704449 - DNA, 15 bp, Homo sapiens
cccccggggctgggt

SEQ ID NO: 4704450 - DNA, 16 bp, Homo sapiens
cccccggggctgggtt

SEQ ID NO: 4704451 - DNA, 16 bp, Homo sapiens
ccccctcctgctgcag

SEQ ID NO: 4704452 - DNA, 13 bp, Homo sapiens
ccccctcgtgcca

SEQ ID NO: 4704453 - DNA, 13 bp, Homo sapiens
ccccctctgccct

SEQ ID NO: 4704454 - DNA, 12 bp, Homo sapiens
ccccctctggct

SEQ ID NO: 4704455 - DNA, 12 bp, Homo sapiens
ccccctgcagga

SEQ ID NO: 4704456 - DNA, 14 bp, Homo sapiens
cccccttccatgga

SEQ ID NO: 4704457 - DNA, 21 bp, Homo sapiens
ccccgagggatgatgccacac

SEQ ID NO: 4704458 - DNA, 22 bp, Homo sapiens
ccccgagggatgatgccacacc

SEQ ID NO: 4704459 - DNA, 14 bp, Homo sapiens
ccccgcaggcctgc

SEQ ID NO: 4704460 - DNA, 12 bp, Homo sapiens
ccccgcccaggc

SEQ ID NO: 4704461 - DNA, 16 bp, Homo sapiens
ccccgcccaggctggc

SEQ ID NO: 4704462 - DNA, 14 bp, Homo sapiens
ccccggccacctgc

SEQ ID NO: 4704463 - DNA, 23 bp, Homo sapiens
ccccgggaggggcccgcttgcct

SEQ ID NO: 4704464 - DNA, 20 bp, Homo sapiens
ccccgtccccctctggctcc

SEQ ID NO: 4704465 - DNA, 17 bp, Homo sapiens
cccctcaccaggggcag

SEQ ID NO: 4704466 - DNA, 17 bp, Homo sapiens
cccctcagacagccccc

SEQ ID NO: 4704467 - DNA, 16 bp, Homo sapiens
cccctcagggtccctg

SEQ ID NO: 4704468 - DNA, 14 bp, Homo sapiens
cccctcccagctga

SEQ ID NO: 4704469 - DNA, 23 bp, Homo sapiens
cccctcctacccctcccagctga

SEQ ID NO: 4704470 - DNA, 12 bp, Homo sapiens
cccctcctccac

SEQ ID NO: 4704471 - DNA, 12 bp, Homo sapiens
cccctctgccct

SEQ ID NO: 4704472 - DNA, 23 bp, Homo sapiens
cccctctgccctgcgggtcacag

SEQ ID NO: 4704473 - DNA, 12 bp, Homo sapiens
cccctcttgccc

SEQ ID NO: 4704474 - DNA, 20 bp, Homo sapiens
cccctgcaaagcccagcttg

SEQ ID NO: 4704475 - DNA, 14 bp, Homo sapiens
cccctgcaggaagg

SEQ ID NO: 4704476 - DNA, 17 bp, Homo sapiens
cccctgccacctcctgc

SEQ ID NO: 4704477 - DNA, 14 bp, Homo sapiens
cccctgccagggca

SEQ ID NO: 4704478 - DNA, 19 bp, Homo sapiens
cccctgccagggcagggcc

SEQ ID NO: 4704479 - DNA, 11 bp, Homo sapiens
cccctgccccc

SEQ ID NO: 4704480 - DNA, 17 bp, Homo sapiens
cccctgcccccaggact

SEQ ID NO: 4704481 - DNA, 19 bp, Homo sapiens
cccctgcccccaggactgg

SEQ ID NO: 4704482 - DNA, 16 bp, Homo sapiens
cccctgccccctgcag

SEQ ID NO: 4704483 - DNA, 17 bp, Homo sapiens
cccctgcccggctgcgg

SEQ ID NO: 4704484 - DNA, 19 bp, Homo sapiens
cccctgctggctggtgcct

SEQ ID NO: 4704485 - DNA, 13 bp, Homo sapiens
cccctgctggttc

SEQ ID NO: 4704486 - DNA, 15 bp, Homo sapiens
cccctgctggttcag

SEQ ID NO: 4704487 - DNA, 20 bp, Homo sapiens
cccctgtgcagccgctgagc

SEQ ID NO: 4704488 - DNA, 13 bp, Homo sapiens
ccccttccatgga

SEQ ID NO: 4704489 - DNA, 20 bp, Homo sapiens
ccccttcctaattccacagc

SEQ ID NO: 4704490 - DNA, 21 bp, Homo sapiens
ccccttcctaattccacagct

SEQ ID NO: 4704491 - DNA, 13 bp, Homo sapiens
ccccttctctcat

SEQ ID NO: 4704492 - DNA, 22 bp, Homo sapiens
ccccttttcagcttctgctggg

SEQ ID NO: 4704493 - DNA, 14 bp, Homo sapiens
cccgaatacaaaca

SEQ ID NO: 4704494 - DNA, 17 bp, Homo sapiens
cccgaatagctgggact

SEQ ID NO: 4704495 - DNA, 15 bp, Homo sapiens
cccgaggccttctct

SEQ ID NO: 4704496 - DNA, 13 bp, Homo sapiens
cccgagtagctgg

SEQ ID NO: 4704497 - DNA, 15 bp, Homo sapiens
cccgagtagctggga

SEQ ID NO: 4704498 - DNA, 17 bp, Homo sapiens
cccgagtagctgggact

SEQ ID NO: 4704499 - DNA, 12 bp, Homo sapiens
cccgcccaggct

SEQ ID NO: 4704500 - DNA, 17 bp, Homo sapiens
cccgcccaggctggcca

SEQ ID NO: 4704501 - DNA, 20 bp, Homo sapiens
cccgcccaggctggccagcc

SEQ ID NO: 4704502 - DNA, 20 bp, Homo sapiens
cccgccccttccccgaggga

SEQ ID NO: 4704503 - DNA, 23 bp, Homo sapiens
cccgctcccagtgtcttcctgtg

SEQ ID NO: 4704504 - DNA, 21 bp, Homo sapiens
cccggagggaaactgtgaatg

SEQ ID NO: 4704505 - DNA, 17 bp, Homo sapiens
cccggccacctgcggtg

SEQ ID NO: 4704506 - DNA, 16 bp, Homo sapiens
cccggcccctgctggt

SEQ ID NO: 4704507 - DNA, 19 bp, Homo sapiens
cccggcgccctctgtcctg

SEQ ID NO: 4704508 - DNA, 11 bp, Homo sapiens
cccggctccag

SEQ ID NO: 4704509 - DNA, 12 bp, Homo sapiens
cccggctccagg

SEQ ID NO: 4704510 - DNA, 15 bp, Homo sapiens
cccggctccaggctc

SEQ ID NO: 4704511 - DNA, 22 bp, Homo sapiens
cccgggaggggcccgcttgcct

SEQ ID NO: 4704512 - DNA, 18 bp, Homo sapiens
cccgggccctgggcccgg

SEQ ID NO: 4704513 - DNA, 15 bp, Homo sapiens
cccgggctctgcctc

SEQ ID NO: 4704514 - DNA, 16 bp, Homo sapiens
cccgggctctgcctcc

SEQ ID NO: 4704515 - DNA, 14 bp, Homo sapiens
cccgtggccccagc

SEQ ID NO: 4704516 - DNA, 15 bp, Homo sapiens
cccgtggccccagcc

SEQ ID NO: 4704517 - DNA, 17 bp, Homo sapiens
cccgtggccccagcctg

SEQ ID NO: 4704518 - DNA, 19 bp, Homo sapiens
cccgttgtctccctggccc

SEQ ID NO: 4704519 - DNA, 22 bp, Homo sapiens
ccctaatgcgcaggctggccct

SEQ ID NO: 4704520 - DNA, 23 bp, Homo sapiens
ccctaatgcgcaggctggccctg

SEQ ID NO: 4704521 - DNA, 22 bp, Homo sapiens
ccctatcccattctccctctca

SEQ ID NO: 4704522 - DNA, 14 bp, Homo sapiens
ccctatctgtattc

SEQ ID NO: 4704523 - DNA, 22 bp, Homo sapiens
ccctcaaggcctcccacagtga

SEQ ID NO: 4704524 - DNA, 12 bp, Homo sapiens
ccctcacactgg

SEQ ID NO: 4704525 - DNA, 15 bp, Homo sapiens
ccctcaccctggggc

SEQ ID NO: 4704526 - DNA, 17 bp, Homo sapiens
ccctcaccgcggctgga

SEQ ID NO: 4704527 - DNA, 19 bp, Homo sapiens
ccctcaccgcggctggatg

SEQ ID NO: 4704528 - DNA, 17 bp, Homo sapiens
ccctcagacagccccct

SEQ ID NO: 4704529 - DNA, 19 bp, Homo sapiens
ccctcagacagccccctgc

SEQ ID NO: 4704530 - DNA, 16 bp, Homo sapiens
ccctcagggtccctgg

SEQ ID NO: 4704531 - DNA, 21 bp, Homo sapiens
ccctcagggtccctggtggca

SEQ ID NO: 4704532 - DNA, 17 bp, Homo sapiens
ccctcatcctcataccc

SEQ ID NO: 4704533 - DNA, 20 bp, Homo sapiens
ccctcatcctcatacccacc

SEQ ID NO: 4704534 - DNA, 13 bp, Homo sapiens
ccctcatctgtcc

SEQ ID NO: 4704535 - DNA, 14 bp, Homo sapiens
ccctcccagcagtg

SEQ ID NO: 4704536 - DNA, 16 bp, Homo sapiens
ccctccccgccctttt

SEQ ID NO: 4704537 - DNA, 17 bp, Homo sapiens
ccctccccgcccttttt

SEQ ID NO: 4704538 - DNA, 11 bp, Homo sapiens
ccctccctgcc

SEQ ID NO: 4704539 - DNA, 13 bp, Homo sapiens
ccctccctgcctc

SEQ ID NO: 4704540 - DNA, 14 bp, Homo sapiens
ccctccctgctgtc

SEQ ID NO: 4704541 - DNA, 14 bp, Homo sapiens
cctcagatgtgttg

SEQ ID NO: 4704542 - DNA, 15 bp, Homo sapiens
cctcagatgtgttga

SEQ ID NO: 4704543 - DNA, 14 bp, Homo sapiens
cctcagcatcctgg

SEQ ID NO: 4704544 - DNA, 18 bp, Homo sapiens
cctcagcctcctgagtag

SEQ ID NO: 4704545 - DNA, 20 bp, Homo sapiens
cctcagggtccctggtggca

SEQ ID NO: 4704546 - DNA, 22 bp, Homo sapiens
cctcaggtaatcgacctgcctc

SEQ ID NO: 4704547 - DNA, 19 bp, Homo sapiens
cctcaggtgatccacccac

SEQ ID NO: 4704548 - DNA, 22 bp, Homo sapiens
cctcaggtgatccacccacctc

SEQ ID NO: 4704549 - DNA, 15 bp, Homo sapiens
cctcagtaagacgac

SEQ ID NO: 4704550 - DNA, 12 bp, Homo sapiens
cctcatacccac

SEQ ID NO: 4704551 - DNA, 14 bp, Homo sapiens
cctcatccagggct

SEQ ID NO: 4704552 - DNA, 21 bp, Homo sapiens
cctccaatgctgcctgggagc

SEQ ID NO: 4704553 - DNA, 16 bp, Homo sapiens
cctccacacctgcggc

SEQ ID NO: 4704554 - DNA, 17 bp, Homo sapiens
cctccaccgccatggct

SEQ ID NO: 4704555 - DNA, 12 bp, Homo sapiens
cctccactccca

SEQ ID NO: 4704556 - DNA, 13 bp, Homo sapiens
cctccactcccac

SEQ ID NO: 4704557 - DNA, 18 bp, Homo sapiens
cctccactcccacttccc

SEQ ID NO: 4704558 - DNA, 20 bp, Homo sapiens
cctccactcccacttccctg

SEQ ID NO: 4704559 - DNA, 16 bp, Homo sapiens
cctccagggctggact

SEQ ID NO: 4704560 - DNA, 18 bp, Homo sapiens
cctccagggctggactga

SEQ ID NO: 4704561 - DNA, 21 bp, Homo sapiens
cctccagggctggactgaggc

SEQ ID NO: 4704562 - DNA, 11 bp, Homo sapiens
cctccaggtgc

SEQ ID NO: 4704563 - DNA, 22 bp, Homo sapiens
cctccaggtgcacaagctccaa

SEQ ID NO: 4704564 - DNA, 23 bp, Homo sapiens
cctccagtccaaggaaaccacag

SEQ ID NO: 4704565 - DNA, 12 bp, Homo sapiens
cctccagtgaag

SEQ ID NO: 4704566 - DNA, 19 bp, Homo sapiens
cctccatattttctttaaa

SEQ ID NO: 4704567 - DNA, 11 bp, Homo sapiens
cctccatggga

SEQ ID NO: 4704568 - DNA, 15 bp, Homo sapiens
cctccatgtgggcta

SEQ ID NO: 4704569 - DNA, 15 bp, Homo sapiens
cctccatttttgttg

SEQ ID NO: 4704570 - DNA, 15 bp, Homo sapiens
cctcccaaagtgctg

SEQ ID NO: 4704571 - DNA, 16 bp, Homo sapiens
cctcccaaagtgctgg

SEQ ID NO: 4704572 - DNA, 17 bp, Homo sapiens
cctcccaaagtgctggg

SEQ ID NO: 4704573 - DNA, 14 bp, Homo sapiens
cctcccaactcacc

SEQ ID NO: 4704574 - DNA, 17 bp, Homo sapiens
cctcccaactcacccca

SEQ ID NO: 4704575 - DNA, 12 bp, Homo sapiens
cctcccacagtg

SEQ ID NO: 4704576 - DNA, 20 bp, Homo sapiens
cctcccagcagtggcttgct

SEQ ID NO: 4704577 - DNA, 13 bp, Homo sapiens
cctcccccacttt

SEQ ID NO: 4704578 - DNA, 15 bp, Homo sapiens
cctcccctcccgtct

SEQ ID NO: 4704579 - DNA, 14 bp, Homo sapiens
cctcccctcgccca

SEQ ID NO: 4704580 - DNA, 12 bp, Homo sapiens
cctcccctgcca

SEQ ID NO: 4704581 - DNA, 16 bp, Homo sapiens
cctcccctgccagggc

SEQ ID NO: 4704582 - DNA, 17 bp, Homo sapiens
cctcccgaatagctggg

SEQ ID NO: 4704583 - DNA, 18 bp, Homo sapiens
cctcccgaatagctggga

SEQ ID NO: 4704584 - DNA, 20 bp, Homo sapiens
cctcccgaatagctgggact

SEQ ID NO: 4704585 - DNA, 18 bp, Homo sapiens
cctcccgagtagctggga

SEQ ID NO: 4704586 - DNA, 11 bp, Homo sapiens
cctcccgcccc

SEQ ID NO: 4704587 - DNA, 14 bp, Homo sapiens
cctccctgctgtcc

SEQ ID NO: 4704588 - DNA, 21 bp, Homo sapiens
cctccctgctgtcccctcttg

SEQ ID NO: 4704589 - DNA, 22 bp, Homo sapiens
cctccctgctgtcccctcttgc

SEQ ID NO: 4704590 - DNA, 14 bp, Homo sapiens
cctccgtggcacat

SEQ ID NO: 4704591 - DNA, 18 bp, Homo sapiens
cctcctacccctcccagc

SEQ ID NO: 4704592 - DNA, 12 bp, Homo sapiens
cctcctccaggg

SEQ ID NO: 4704593 - DNA, 14 bp, Homo sapiens
cctcctccagggac

SEQ ID NO: 4704594 - DNA, 15 bp, Homo sapiens
cctcctctctgccct

SEQ ID NO: 4704595 - DNA, 13 bp, Homo sapiens
cctcctctgtgaa

SEQ ID NO: 4704596 - DNA, 12 bp, Homo sapiens
cctcctgagaaa

SEQ ID NO: 4704597 - DNA, 20 bp, Homo sapiens
cctcctgctgcagaggggca

SEQ ID NO: 4704598 - DNA, 21 bp, Homo sapiens
cctcctgctgcagaggggcag

SEQ ID NO: 4704599 - DNA, 13 bp, Homo sapiens
cctcctggccaga

SEQ ID NO: 4704600 - DNA, 13 bp, Homo sapiens
cctcctgggctaa

SEQ ID NO: 4704601 - DNA, 15 bp, Homo sapiens
cctcctgtctctggc

SEQ ID NO: 4704602 - DNA, 20 bp, Homo sapiens
cctccttatcaaaggacacc

SEQ ID NO: 4704603 - DNA, 14 bp, Homo sapiens
cctccttctctgtc

SEQ ID NO: 4704604 - DNA, 23 bp, Homo sapiens
cctcctttgtgaggaagccgctg

SEQ ID NO: 4704605 - DNA, 12 bp, Homo sapiens
cctcgcccaccg

SEQ ID NO: 4704606 - DNA, 13 bp, Homo sapiens
cctcgcctggcct

SEQ ID NO: 4704607 - DNA, 13 bp, Homo sapiens
cctcgctgccagc

SEQ ID NO: 4704608 - DNA, 20 bp, Homo sapiens
cctcgctgccagctctgtat

SEQ ID NO: 4704609 - DNA, 19 bp, Homo sapiens
cctcggctcctgctgcacc

SEQ ID NO: 4704610 - DNA, 21 bp, Homo sapiens
cctctacagagcttccctgac

SEQ ID NO: 4704611 - DNA, 19 bp, Homo sapiens
cctctagggacccctcctc

SEQ ID NO: 4704612 - DNA, 19 bp, Homo sapiens
cctctatgaactatggacg

SEQ ID NO: 4704613 - DNA, 21 bp, Homo sapiens
cctctcagagctacttgggcc

SEQ ID NO: 4704614 - DNA, 23 bp, Homo sapiens
cctctcagagctacttgggccat

SEQ ID NO: 4704615 - DNA, 17 bp, Homo sapiens
cctctccacctagtggc

SEQ ID NO: 4704616 - DNA, 23 bp, Homo sapiens
cctctccacctagtggctgtcca

SEQ ID NO: 4704617 - DNA, 23 bp, Homo sapiens
cctctcccctgccccctgcagga

SEQ ID NO: 4704618 - DNA, 15 bp, Homo sapiens
cctctccctcctggc

SEQ ID NO: 4704619 - DNA, 18 bp, Homo sapiens
cctctccgcacacctctg

SEQ ID NO: 4704620 - DNA, 23 bp, Homo sapiens
cctctccttcatgacagcctcca

SEQ ID NO: 4704621 - DNA, 12 bp, Homo sapiens
cctctctgccct

SEQ ID NO: 4704622 - DNA, 13 bp, Homo sapiens
cctctctgcccta

SEQ ID NO: 4704623 - DNA, 15 bp, Homo sapiens
cctctctgctctgcg

SEQ ID NO: 4704624 - DNA, 13 bp, Homo sapiens
cctctgacacaca

SEQ ID NO: 4704625 - DNA, 15 bp, Homo sapiens
cctctgacacacagc

SEQ ID NO: 4704626 - DNA, 16 bp, Homo sapiens
cctctgacacacagct

SEQ ID NO: 4704627 - DNA, 19 bp, Homo sapiens
cctctgacacacagctctg

SEQ ID NO: 4704628 - DNA, 20 bp, Homo sapiens
cctctgacacacagctctgt

SEQ ID NO: 4704629 - DNA, 21 bp, Homo sapiens
cctctgacacacagctctgtc

SEQ ID NO: 4704630 - DNA, 16 bp, Homo sapiens
cctctgactcagggct

SEQ ID NO: 4704631 - DNA, 18 bp, Homo sapiens
cctctgcactcccctgct

SEQ ID NO: 4704632 - DNA, 18 bp, Homo sapiens
cctctgcagtgtggcaag

SEQ ID NO: 4704633 - DNA, 23 bp, Homo sapiens
cctctgcagtgtggcaagcaaga

SEQ ID NO: 4704634 - DNA, 16 bp, Homo sapiens
cctctgcccactccct

SEQ ID NO: 4704635 - DNA, 11 bp, Homo sapiens
cctctgcctca

SEQ ID NO: 4704636 - DNA, 20 bp, Homo sapiens
cctctgcctctgacacacag

SEQ ID NO: 4704637 - DNA, 15 bp, Homo sapiens
cctctgctgctggct

SEQ ID NO: 4704638 - DNA, 16 bp, Homo sapiens
cctctgctgctggctg

SEQ ID NO: 4704639 - DNA, 16 bp, Homo sapiens
cctctgggccaggttg

SEQ ID NO: 4704640 - DNA, 16 bp, Homo sapiens
cctctgtacagagccc

SEQ ID NO: 4704641 - DNA, 19 bp, Homo sapiens
cctctgtccaggcactgag

SEQ ID NO: 4704642 - DNA, 22 bp, Homo sapiens
cctctgtccccttctctcatct

SEQ ID NO: 4704643 - DNA, 14 bp, Homo sapiens
cctctgtcctgact

SEQ ID NO: 4704644 - DNA, 22 bp, Homo sapiens
cctctgtcctgacttcaggggc

SEQ ID NO: 4704645 - DNA, 18 bp, Homo sapiens
cctctgtgaccaatgtct

SEQ ID NO: 4704646 - DNA, 16 bp, Homo sapiens
cctctgtgtcactggc

SEQ ID NO: 4704647 - DNA, 15 bp, Homo sapiens
cctcttatgggctgg

SEQ ID NO: 4704648 - DNA, 16 bp, Homo sapiens
cctcttatgggctggg

SEQ ID NO: 4704649 - DNA, 17 bp, Homo sapiens
cctcttctgggagggca

SEQ ID NO: 4704650 - DNA, 12 bp, Homo sapiens
cctcttgccctt

SEQ ID NO: 4704651 - DNA, 22 bp, Homo sapiens
cctctttggtctacactgtgct

SEQ ID NO: 4704652 - DNA, 17 bp, Homo sapiens
cctgaaaacactgtgca

SEQ ID NO: 4704653 - DNA, 21 bp, Homo sapiens
cctgaagactcattcttctgt

SEQ ID NO: 4704654 - DNA, 21 bp, Homo sapiens
cctgaaggccccgcccaggct

SEQ ID NO: 4704655 - DNA, 22 bp, Homo sapiens
cctgaaggccccgcccaggctt

SEQ ID NO: 4704656 - DNA, 19 bp, Homo sapiens
cctgaagtaagcaaagact

SEQ ID NO: 4704657 - DNA, 16 bp, Homo sapiens
cctgaagtcacacagt

SEQ ID NO: 4704658 - DNA, 16 bp, Homo sapiens
cctgacaacagcctga

SEQ ID NO: 4704659 - DNA, 17 bp, Homo sapiens
cctgacaacagcctgag

SEQ ID NO: 4704660 - DNA, 22 bp, Homo sapiens
cctgaccttgaggagtcttgtg

SEQ ID NO: 4704661 - DNA, 13 bp, Homo sapiens
cctgactccttct

SEQ ID NO: 4704662 - DNA, 23 bp, Homo sapiens
cctgacttcaggggctgcccgct

SEQ ID NO: 4704663 - DNA, 11 bp, Homo sapiens
cctgagatttc

SEQ ID NO: 4704664 - DNA, 16 bp, Homo sapiens
cctgagatttcatctg

SEQ ID NO: 4704665 - DNA, 23 bp, Homo sapiens
cctgagatttcatctgctctcct

SEQ ID NO: 4704666 - DNA, 18 bp, Homo sapiens
cctgagcagaatactggt

SEQ ID NO: 4704667 - DNA, 23 bp, Homo sapiens
cctgagcagaatactggtctcag

SEQ ID NO: 4704668 - DNA, 13 bp, Homo sapiens
cctgagcccctca

SEQ ID NO: 4704669 - DNA, 14 bp, Homo sapiens
cctgagcccctcag

SEQ ID NO: 4704670 - DNA, 15 bp, Homo sapiens
cctgagctgaggcag

SEQ ID NO: 4704671 - DNA, 18 bp, Homo sapiens
cctgagctgaggcagcag

SEQ ID NO: 4704672 - DNA, 23 bp, Homo sapiens
cctgaggactgatttcagagtga

SEQ ID NO: 4704673 - DNA, 15 bp, Homo sapiens
cctgaggcccagagg

SEQ ID NO: 4704674 - DNA, 21 bp, Homo sapiens
cctgaggcccagagggcctgc

SEQ ID NO: 4704675 - DNA, 11 bp, Homo sapiens
cctgaggccct

SEQ ID NO: 4704676 - DNA, 14 bp, Homo sapiens
cctgaggcccttct

SEQ ID NO: 4704677 - DNA, 17 bp, Homo sapiens
cctgaggcccttctctc

SEQ ID NO: 4704678 - DNA, 19 bp, Homo sapiens
cctgaggcccttctctcca

SEQ ID NO: 4704679 - DNA, 13 bp, Homo sapiens
cctgaggctgggc

SEQ ID NO: 4704680 - DNA, 15 bp, Homo sapiens
cctgaggctgggctc

SEQ ID NO: 4704681 - DNA, 16 bp, Homo sapiens
cctgaggctgggctcc

SEQ ID NO: 4704682 - DNA, 18 bp, Homo sapiens
cctgataacaacctggag

SEQ ID NO: 4704683 - DNA, 19 bp, Homo sapiens
cctgataacaacctggaga

SEQ ID NO: 4704684 - DNA, 21 bp, Homo sapiens
cctgatatttccctcccctgg

SEQ ID NO: 4704685 - DNA, 19 bp, Homo sapiens
cctgatgaaaataaagaat

SEQ ID NO: 4704686 - DNA, 15 bp, Homo sapiens
cctgatgacctggga

SEQ ID NO: 4704687 - DNA, 15 bp, Homo sapiens
cctgatgcagtcacg

SEQ ID NO: 4704688 - DNA, 17 bp, Homo sapiens
cctgatgcttcttcaga

SEQ ID NO: 4704689 - DNA, 18 bp, Homo sapiens
cctgatgcttcttcagag

SEQ ID NO: 4704690 - DNA, 20 bp, Homo sapiens
cctgatgcttcttcagagac

SEQ ID NO: 4704691 - DNA, 21 bp, Homo sapiens
cctgatgcttcttcagagact

SEQ ID NO: 4704692 - DNA, 22 bp, Homo sapiens
cctgatgcttcttcagagactc

SEQ ID NO: 4704693 - DNA, 18 bp, Homo sapiens
cctgatggagagtgagag

SEQ ID NO: 4704694 - DNA, 19 bp, Homo sapiens
cctgatggagagtgagagc

SEQ ID NO: 4704695 - DNA, 20 bp, Homo sapiens
cctgatggcaggatggcctg

SEQ ID NO: 4704696 - DNA, 16 bp, Homo sapiens
cctgcaacctgattgt

SEQ ID NO: 4704697 - DNA, 22 bp, Homo sapiens
cctgcaacctgattgtgtctct

SEQ ID NO: 4704698 - DNA, 14 bp, Homo sapiens
cctgcactgtcctg

SEQ ID NO: 4704699 - DNA, 19 bp, Homo sapiens
cctgcactgtcctgctcca

SEQ ID NO: 4704700 - DNA, 20 bp, Homo sapiens
cctgcactgtcctgctccac

SEQ ID NO: 4704701 - DNA, 16 bp, Homo sapiens
cctgcacttgcagact

SEQ ID NO: 4704702 - DNA, 19 bp, Homo sapiens
cctgcacttgcagactcta

SEQ ID NO: 4704703 - DNA, 20 bp, Homo sapiens
cctgcaggaaggagctgcct

SEQ ID NO: 4704704 - DNA, 22 bp, Homo sapiens
cctgcaggaaggagctgcctgg

SEQ ID NO: 4704705 - DNA, 15 bp, Homo sapiens
cctgcaggcagccag

SEQ ID NO: 4704706 - DNA, 16 bp, Homo sapiens
cctgcaggcagccagg

SEQ ID NO: 4704707 - DNA, 21 bp, Homo sapiens
cctgcaggttgggccatactg

SEQ ID NO: 4704708 - DNA, 22 bp, Homo sapiens
cctgcataatgtttctggattt

SEQ ID NO: 4704709 - DNA, 19 bp, Homo sapiens
cctgcattggaactggagg

SEQ ID NO: 4704710 - DNA, 21 bp, Homo sapiens
cctgcattggaactggaggca

SEQ ID NO: 4704711 - DNA, 22 bp, Homo sapiens
cctgcattggaactggaggcag

SEQ ID NO: 4704712 - DNA, 19 bp, Homo sapiens
cctgcatttttaaaggaca

SEQ ID NO: 4704713 - DNA, 12 bp, Homo sapiens
cctgccacagcc

SEQ ID NO: 4704714 - DNA, 14 bp, Homo sapiens
cctgccaccctggg

SEQ ID NO: 4704715 - DNA, 14 bp, Homo sapiens
cctgccacctcctg

SEQ ID NO: 4704716 - DNA, 11 bp, Homo sapiens
cctgccaggga

SEQ ID NO: 4704717 - DNA, 12 bp, Homo sapiens
cctgccagggac

SEQ ID NO: 4704718 - DNA, 14 bp, Homo sapiens
cctgccagggacag

SEQ ID NO: 4704719 - DNA, 19 bp, Homo sapiens
cctgccagggcagggcccc

SEQ ID NO: 4704720 - DNA, 12 bp, Homo sapiens
cctgcccacctg

SEQ ID NO: 4704721 - DNA, 15 bp, Homo sapiens
cctgcccacctggcc

SEQ ID NO: 4704722 - DNA, 17 bp, Homo sapiens
cctgcccacctggcctc

SEQ ID NO: 4704723 - DNA, 18 bp, Homo sapiens
cctgcccacctggcctct

SEQ ID NO: 4704724 - DNA, 19 bp, Homo sapiens
cctgcccacctggcctctg

SEQ ID NO: 4704725 - DNA, 16 bp, Homo sapiens
cctgcccaggcccctg

SEQ ID NO: 4704726 - DNA, 21 bp, Homo sapiens
cctgcccaggcccctgccacc

SEQ ID NO: 4704727 - DNA, 22 bp, Homo sapiens
cctgcccaggcccctgccaccc

SEQ ID NO: 4704728 - DNA, 15 bp, Homo sapiens
cctgcccccaatcca

SEQ ID NO: 4704729 - DNA, 14 bp, Homo sapiens
cctgcccccaggac

SEQ ID NO: 4704730 - DNA, 15 bp, Homo sapiens
cctgcccccaggact

SEQ ID NO: 4704731 - DNA, 14 bp, Homo sapiens
cctgccccccagcc

SEQ ID NO: 4704732 - DNA, 14 bp, Homo sapiens
cctgccccctgcag

SEQ ID NO: 4704733 - DNA, 15 bp, Homo sapiens
cctgccccctgcagg

SEQ ID NO: 4704734 - DNA, 10 bp, Homo sapiens
cctgccctgg

SEQ ID NO: 4704735 - DNA, 15 bp, Homo sapiens
cctgccctgggaggc

SEQ ID NO: 4704736 - DNA, 20 bp, Homo sapiens
cctgccctgggaggcagtga

SEQ ID NO: 4704737 - DNA, 19 bp, Homo sapiens
cctgccctggtttcctgcc

SEQ ID NO: 4704738 - DNA, 22 bp, Homo sapiens
cctgcccttgctccagcctgac

SEQ ID NO: 4704739 - DNA, 13 bp, Homo sapiens
cctgccgcagagc

SEQ ID NO: 4704740 - DNA, 17 bp, Homo sapiens
cctgccgcagagctggc

SEQ ID NO: 4704741 - DNA, 12 bp, Homo sapiens
cctgcctcagcc

SEQ ID NO: 4704742 - DNA, 14 bp, Homo sapiens
cctgcctcagcctc

SEQ ID NO: 4704743 - DNA, 21 bp, Homo sapiens
cctgcctccacccacagtgga

SEQ ID NO: 4704744 - DNA, 16 bp, Homo sapiens
cctgcctccagggctg

SEQ ID NO: 4704745 - DNA, 20 bp, Homo sapiens
cctgcctcctttgtgaggaa

SEQ ID NO: 4704746 - DNA, 21 bp, Homo sapiens
cctgcctcgaactggctgcaa

SEQ ID NO: 4704747 - DNA, 16 bp, Homo sapiens
cctgccttcctcctgg

SEQ ID NO: 4704748 - DNA, 20 bp, Homo sapiens
cctgcggcccaatccaaggt

SEQ ID NO: 4704749 - DNA, 22 bp, Homo sapiens
cctgcgggtcacaggagggagg

SEQ ID NO: 4704750 - DNA, 17 bp, Homo sapiens
cctgcggtgctatctcc

SEQ ID NO: 4704751 - DNA, 19 bp, Homo sapiens
cctgctcaatccctgagga

SEQ ID NO: 4704752 - DNA, 12 bp, Homo sapiens
cctgctccacag

SEQ ID NO: 4704753 - DNA, 19 bp, Homo sapiens
cctgctccacagccatccc

SEQ ID NO: 4704754 - DNA, 22 bp, Homo sapiens
cctgctctccgaccagacacct

SEQ ID NO: 4704755 - DNA, 15 bp, Homo sapiens
cctgctgagtcccag

SEQ ID NO: 4704756 - DNA, 18 bp, Homo sapiens
cctgctgagtcccaggct

SEQ ID NO: 4704757 - DNA, 19 bp, Homo sapiens
cctgctgagtcccaggctg

SEQ ID NO: 4704758 - DNA, 17 bp, Homo sapiens
cctgctgcaccaaccca

SEQ ID NO: 4704759 - DNA, 21 bp, Homo sapiens
cctgctgcaccaacccagccg

SEQ ID NO: 4704760 - DNA, 23 bp, Homo sapiens
cctgctgcaccaacccagccgct

SEQ ID NO: 4704761 - DNA, 23 bp, Homo sapiens
cctgctgcagaggggcaggccct

SEQ ID NO: 4704762 - DNA, 21 bp, Homo sapiens
cgcccctcccacagcgctggc

SEQ ID NO: 4704763 - DNA, 13 bp, Homo sapiens
cgcctcgcccacc

SEQ ID NO: 4704764 - DNA, 13 bp, Homo sapiens
cgccttctccccc

SEQ ID NO: 4704765 - DNA, 15 bp, Homo sapiens
cgcggctggatgggg

SEQ ID NO: 4704766 - DNA, 19 bp, Homo sapiens
cgcgtgcacacaccagagc

SEQ ID NO: 4704767 - DNA, 16 bp, Homo sapiens
cgctaagagggaggga

SEQ ID NO: 4704768 - DNA, 21 bp, Homo sapiens
cgctacccgggaagggggctg

SEQ ID NO: 4704769 - DNA, 24 bp, Homo sapiens
cgctacccgggaagggggctggga

SEQ ID NO: 4704770 - DNA, 17 bp, Homo sapiens
cgctattgtcaccaggg

SEQ ID NO: 4704771 - DNA, 22 bp, Homo sapiens
cgctcccagtgtcttcctgtgg

SEQ ID NO: 4704772 - DNA, 19 bp, Homo sapiens
cgctcctgccgcagagctg

SEQ ID NO: 4704773 - DNA, 16 bp, Homo sapiens
cgctgatgctgggctg

SEQ ID NO: 4704774 - DNA, 18 bp, Homo sapiens
cgctgcagcagggcagga

SEQ ID NO: 4704775 - DNA, 19 bp, Homo sapiens
cgctgcccggcgccctctg

SEQ ID NO: 4704776 - DNA, 13 bp, Homo sapiens
cgctgcctgtgtg

SEQ ID NO: 4704777 - DNA, 18 bp, Homo sapiens
cgctggagtgcagtgagc

SEQ ID NO: 4704778 - DNA, 13 bp, Homo sapiens
cgctgggtcctct

SEQ ID NO: 4704779 - DNA, 19 bp, Homo sapiens
cgctgggtcctctgcagtg

SEQ ID NO: 4704780 - DNA, 20 bp, Homo sapiens
cgctgtcaggattgcgagag

SEQ ID NO: 4704781 - DNA, 14 bp, Homo sapiens
cgctgtgctgccct

SEQ ID NO: 4704782 - DNA, 16 bp, Homo sapiens
cgctgtgctgccctgc

SEQ ID NO: 4704783 - DNA, 17 bp, Homo sapiens
cgctgtgctgccctgcc

SEQ ID NO: 4704784 - DNA, 21 bp, Homo sapiens
cgctgtgctgccctgcccacc

SEQ ID NO: 4704785 - DNA, 11 bp, Homo sapiens
cgcttgcctcg

SEQ ID NO: 4704786 - DNA, 16 bp, Homo sapiens
cgctttctacccagcg

SEQ ID NO: 4704787 - DNA, 18 bp, Homo sapiens
cggaaagaagagcgagag

SEQ ID NO: 4704788 - DNA, 16 bp, Homo sapiens
cggaatagttggctag

SEQ ID NO: 4704789 - DNA, 16 bp, Homo sapiens
cggacagccacggcca

SEQ ID NO: 4704790 - DNA, 20 bp, Homo sapiens
cggacagccacggccaggcc

SEQ ID NO: 4704791 - DNA, 20 bp, Homo sapiens
cggagacggagtcccacctt

SEQ ID NO: 4704792 - DNA, 14 bp, Homo sapiens
cggagagtgggggt

SEQ ID NO: 4704793 - DNA, 18 bp, Homo sapiens
cggagggaaactgtgaat

SEQ ID NO: 4704794 - DNA, 18 bp, Homo sapiens
cggagtcccaccttggct

SEQ ID NO: 4704795 - DNA, 23 bp, Homo sapiens
cggataggcaggaacatacagac

SEQ ID NO: 4704796 - DNA, 12 bp, Homo sapiens
cggcactgcatg

SEQ ID NO: 4704797 - DNA, 15 bp, Homo sapiens
cggccacctgcggtg

SEQ ID NO: 4704798 - DNA, 14 bp, Homo sapiens
cggccagccctccc

SEQ ID NO: 4704799 - DNA, 18 bp, Homo sapiens
cggccagccctcccagca

SEQ ID NO: 4704800 - DNA, 11 bp, Homo sapiens
cggccaggcca

SEQ ID NO: 4704801 - DNA, 24 bp, Homo sapiens
cggccaggccagagggagtgacag

SEQ ID NO: 4704802 - DNA, 19 bp, Homo sapiens
cggcccctgctggttcagg

SEQ ID NO: 4704803 - DNA, 14 bp, Homo sapiens
cggcctgtaacata

SEQ ID NO: 4704804 - DNA, 18 bp, Homo sapiens
cggcgccctctgtcctga

SEQ ID NO: 4704805 - DNA, 17 bp, Homo sapiens
cggctcactgcagcctc

SEQ ID NO: 4704806 - DNA, 15 bp, Homo sapiens
cggctccaggctcct

SEQ ID NO: 4704807 - DNA, 14 bp, Homo sapiens
cggctcctgctgca

SEQ ID NO: 4704808 - DNA, 17 bp, Homo sapiens
cggctcctgctgcacca

SEQ ID NO: 4704809 - DNA, 23 bp, Homo sapiens
cggctcctgctgcaccaacccag

SEQ ID NO: 4704810 - DNA, 17 bp, Homo sapiens
cggctctggcctccaag

SEQ ID NO: 4704811 - DNA, 13 bp, Homo sapiens
cggctgagctggg

SEQ ID NO: 4704812 - DNA, 11 bp, Homo sapiens
cggctgccctt

SEQ ID NO: 4704813 - DNA, 13 bp, Homo sapiens
cggctggcctggc

SEQ ID NO: 4704814 - DNA, 14 bp, Homo sapiens
cggctggcctggcc

SEQ ID NO: 4704815 - DNA, 18 bp, Homo sapiens
cggctggcctggcccctc

SEQ ID NO: 4704816 - DNA, 19 bp, Homo sapiens
cggctggcctggcccctca

SEQ ID NO: 4704817 - DNA, 16 bp, Homo sapiens
cggctgtctcagactc

SEQ ID NO: 4704818 - DNA, 16 bp, Homo sapiens
cgggaagggggctggg

SEQ ID NO: 4704819 - DNA, 20 bp, Homo sapiens
cgggaccctgctcacaggca

SEQ ID NO: 4704820 - DNA, 13 bp, Homo sapiens
cgggacctggtgc

SEQ ID NO: 4704821 - DNA, 22 bp, Homo sapiens
cgggagaggggacgcaggcccc

SEQ ID NO: 4704822 - DNA, 14 bp, Homo sapiens
cgggaggggcccgc

SEQ ID NO: 4704823 - DNA, 17 bp, Homo sapiens
cgggattagtacacact

SEQ ID NO: 4704824 - DNA, 12 bp, Homo sapiens
cgggcagcacag

SEQ ID NO: 4704825 - DNA, 14 bp, Homo sapiens
cgggcagcacagca

SEQ ID NO: 4704826 - DNA, 17 bp, Homo sapiens
cgggccacagagaaagt

SEQ ID NO: 4704827 - DNA, 15 bp, Homo sapiens
cgggcccaggccatc

SEQ ID NO: 4704828 - DNA, 14 bp, Homo sapiens
cgggccctgggccc

SEQ ID NO: 4704829 - DNA, 18 bp, Homo sapiens
cgggctcagggaccacag

SEQ ID NO: 4704830 - DNA, 15 bp, Homo sapiens
cgggctcctgtgccc

SEQ ID NO: 4704831 - DNA, 12 bp, Homo sapiens
cgggctctgcct

SEQ ID NO: 4704832 - DNA, 17 bp, Homo sapiens
cgggctctgcctcccat

SEQ ID NO: 4704833 - DNA, 15 bp, Homo sapiens
cggggacagctcctt

SEQ ID NO: 4704834 - DNA, 14 bp, Homo sapiens
cggggcgtttcttt

SEQ ID NO: 4704835 - DNA, 21 bp, Homo sapiens
cggggctgggttggcgcaccc

SEQ ID NO: 4704836 - DNA, 19 bp, Homo sapiens
cgggtcacaggagggaggg

SEQ ID NO: 4704837 - DNA, 20 bp, Homo sapiens
cggtccacccaggagccccg

SEQ ID NO: 4704838 - DNA, 21 bp, Homo sapiens
cggtctaaagtgagctctatg

SEQ ID NO: 4704839 - DNA, 21 bp, Homo sapiens
cggtgagaggggaacagactg

SEQ ID NO: 4704840 - DNA, 20 bp, Homo sapiens
cggtgctatctcccccagcc

SEQ ID NO: 4704841 - DNA, 21 bp, Homo sapiens
cggtggtaccaggtctcctcc

SEQ ID NO: 4704842 - DNA, 15 bp, Homo sapiens
cggtggttcttcctg

SEQ ID NO: 4704843 - DNA, 17 bp, Homo sapiens
cgtaaagctagaaatga

SEQ ID NO: 4704844 - DNA, 15 bp, Homo sapiens
cgtaagctctatctg

SEQ ID NO: 4704845 - DNA, 14 bp, Homo sapiens
cgtatacatttgtt

SEQ ID NO: 4704846 - DNA, 16 bp, Homo sapiens
cgtatggctccacacc

SEQ ID NO: 4704847 - DNA, 14 bp, Homo sapiens
cgtcataactagaa

SEQ ID NO: 4704848 - DNA, 20 bp, Homo sapiens
cgtccatcactggctctcta

SEQ ID NO: 4704849 - DNA, 21 bp, Homo sapiens
cgtccccctctggctccagct

SEQ ID NO: 4704850 - DNA, 15 bp, Homo sapiens
cgtcctgagggggaa

SEQ ID NO: 4704851 - DNA, 16 bp, Homo sapiens
cgtctacctgaggggc

SEQ ID NO: 4704852 - DNA, 21 bp, Homo sapiens
cgtctactcattccccggggc

SEQ ID NO: 4704853 - DNA, 18 bp, Homo sapiens
cgtctgacaaatgtgtat

SEQ ID NO: 4704854 - DNA, 13 bp, Homo sapiens
cgtctgacaggca

SEQ ID NO: 4704855 - DNA, 21 bp, Homo sapiens
cgtctgacaggcaatgctggc

SEQ ID NO: 4704856 - DNA, 22 bp, Homo sapiens
cgtctgacaggcaatgctggct

SEQ ID NO: 4704857 - DNA, 12 bp, Homo sapiens
cgtgacaacact

SEQ ID NO: 4704858 - DNA, 21 bp, Homo sapiens
cgtgacctctgcaagacaaag

SEQ ID NO: 4704859 - DNA, 13 bp, Homo sapiens
cgtgagacctgcc

SEQ ID NO: 4704860 - DNA, 16 bp, Homo sapiens
cgtgagacctgcccct

SEQ ID NO: 4704861 - DNA, 23 bp, Homo sapiens
cgtgagccaccgtgcctggccac

SEQ ID NO: 4704862 - DNA, 22 bp, Homo sapiens
cgtgagccactgcaccgggcca

SEQ ID NO: 4704863 - DNA, 19 bp, Homo sapiens
cgtgagtgtctcttgtcta

SEQ ID NO: 4704864 - DNA, 15 bp, Homo sapiens
cgtggaacgtttttc

SEQ ID NO: 4704865 - DNA, 18 bp, Homo sapiens
cgtggaccacctagtctg

SEQ ID NO: 4704866 - DNA, 16 bp, Homo sapiens
cgtggaggagcagtgc

SEQ ID NO: 4704867 - DNA, 22 bp, Homo sapiens
cgtggaggagcagtgcaggcac

SEQ ID NO: 4704868 - DNA, 14 bp, Homo sapiens
cgtggccccagcct

SEQ ID NO: 4704869 - DNA, 19 bp, Homo sapiens
cgtggccccagcctggccc

SEQ ID NO: 4704870 - DNA, 20 bp, Homo sapiens
cgtggccccagcctggccca

SEQ ID NO: 4704871 - DNA, 23 bp, Homo sapiens
cgtggccccagcctggcccagct

SEQ ID NO: 4704872 - DNA, 21 bp, Homo sapiens
ctcacccctggttctcatctt

SEQ ID NO: 4704873 - DNA, 15 bp, Homo sapiens
ctcaccgcggctgga

SEQ ID NO: 4704874 - DNA, 22 bp, Homo sapiens
ctcacctaaaccctctgtgaaa

SEQ ID NO: 4704875 - DNA, 17 bp, Homo sapiens
ctcacctggggctgctg

SEQ ID NO: 4704876 - DNA, 20 bp, Homo sapiens
ctcacctggggctgctggcc

SEQ ID NO: 4704877 - DNA, 21 bp, Homo sapiens
ctcactatcccggctgccctt

SEQ ID NO: 4704878 - DNA, 23 bp, Homo sapiens
ctcactatggtgccaatggaacc

SEQ ID NO: 4704879 - DNA, 16 bp, Homo sapiens
ctcactatgttgccca

SEQ ID NO: 4704880 - DNA, 17 bp, Homo sapiens
ctcactatgttgcccag

SEQ ID NO: 4704881 - DNA, 21 bp, Homo sapiens
ctcactatgttgcccaggcag

SEQ ID NO: 4704882 - DNA, 15 bp, Homo sapiens
ctcactcacattttc

SEQ ID NO: 4704883 - DNA, 12 bp, Homo sapiens
ctcactctgtcg

SEQ ID NO: 4704884 - DNA, 13 bp, Homo sapiens
ctcactctgtcgc

SEQ ID NO: 4704885 - DNA, 21 bp, Homo sapiens
ctcactctgtcgcccagtctg

SEQ ID NO: 4704886 - DNA, 20 bp, Homo sapiens
ctcactgcatcctccgcctc

SEQ ID NO: 4704887 - DNA, 15 bp, Homo sapiens
ctcactgttgcccag

SEQ ID NO: 4704888 - DNA, 20 bp, Homo sapiens
ctcactgttgcccaggctgg

SEQ ID NO: 4704889 - DNA, 21 bp, Homo sapiens
ctcagaagacacatgtggaga

SEQ ID NO: 4704890 - DNA, 23 bp, Homo sapiens
ctcagaagacactgatgggcaac

SEQ ID NO: 4704891 - DNA, 15 bp, Homo sapiens
ctcagacagccccct

SEQ ID NO: 4704892 - DNA, 22 bp, Homo sapiens
ctcagacagccccctgccccgc

SEQ ID NO: 4704893 - DNA, 20 bp, Homo sapiens
ctcagagaggacaaaataaa

SEQ ID NO: 4704894 - DNA, 19 bp, Homo sapiens
ctcagagagggtgggagtg

SEQ ID NO: 4704895 - DNA, 18 bp, Homo sapiens
ctcagagtatggagctca

SEQ ID NO: 4704896 - DNA, 16 bp, Homo sapiens
ctcagagtggagttga

SEQ ID NO: 4704897 - DNA, 13 bp, Homo sapiens
ctcagcatcctgg

SEQ ID NO: 4704898 - DNA, 15 bp, Homo sapiens
ctcagcatcctggca

SEQ ID NO: 4704899 - DNA, 21 bp, Homo sapiens
ctcagcatcctggcacccggc

SEQ ID NO: 4704900 - DNA, 23 bp, Homo sapiens
ctcagcccctgatcctgtgaagt

SEQ ID NO: 4704901 - DNA, 16 bp, Homo sapiens
ctcagcctcccaaagt

SEQ ID NO: 4704902 - DNA, 22 bp, Homo sapiens
ctcagcctcccaaagtgctggg

SEQ ID NO: 4704903 - DNA, 14 bp, Homo sapiens
ctcagcggggacag

SEQ ID NO: 4704904 - DNA, 15 bp, Homo sapiens
ctcagcggggacagc

SEQ ID NO: 4704905 - DNA, 23 bp, Homo sapiens
ctcagcggggacagctccttctg

SEQ ID NO: 4704906 - DNA, 14 bp, Homo sapiens
ctcagctccccaga

SEQ ID NO: 4704907 - DNA, 16 bp, Homo sapiens
ctcagctccccagagt

SEQ ID NO: 4704908 - DNA, 17 bp, Homo sapiens
ctcagggaccacagcaa

SEQ ID NO: 4704909 - DNA, 15 bp, Homo sapiens
ctcagggcctggctc

SEQ ID NO: 4704910 - DNA, 19 bp, Homo sapiens
ctcagggcctggctcaggt

SEQ ID NO: 4704911 - DNA, 20 bp, Homo sapiens
ctcagggcctggctcaggtg

SEQ ID NO: 4704912 - DNA, 13 bp, Homo sapiens
ctcagggctcctg

SEQ ID NO: 4704913 - DNA, 14 bp, Homo sapiens
ctcagggctcctgg

SEQ ID NO: 4704914 - DNA, 12 bp, Homo sapiens
ctcagggtccct

SEQ ID NO: 4704915 - DNA, 18 bp, Homo sapiens
ctcagggtccctggtggc

SEQ ID NO: 4704916 - DNA, 13 bp, Homo sapiens
ctcagggtctctg

SEQ ID NO: 4704917 - DNA, 17 bp, Homo sapiens
ctcagggtctctgctgc

SEQ ID NO: 4704918 - DNA, 22 bp, Homo sapiens
ctcaggtaatcgacctgcctcg

SEQ ID NO: 4704919 - DNA, 20 bp, Homo sapiens
ctcaggtgatccacccacct

SEQ ID NO: 4704920 - DNA, 20 bp, Homo sapiens
ctcaggtggggtcactctgg

SEQ ID NO: 4704921 - DNA, 22 bp, Homo sapiens
ctcaggtggggtcactctggca

SEQ ID NO: 4704922 - DNA, 16 bp, Homo sapiens
ctcaggtgtccctgca

SEQ ID NO: 4704923 - DNA, 21 bp, Homo sapiens
ctcagtaagtatctggaggaa

SEQ ID NO: 4704924 - DNA, 23 bp, Homo sapiens
ctcagtcatgcataaatatgcag

SEQ ID NO: 4704925 - DNA, 15 bp, Homo sapiens
ctcagttcagaatca

SEQ ID NO: 4704926 - DNA, 13 bp, Homo sapiens
ctcagttctgctc

SEQ ID NO: 4704927 - DNA, 23 bp, Homo sapiens
ctcagttctgctctaagaagctg

SEQ ID NO: 4704928 - DNA, 13 bp, Homo sapiens
ctcagttgcagcc

SEQ ID NO: 4704929 - DNA, 12 bp, Homo sapiens
ctcagtttcata

SEQ ID NO: 4704930 - DNA, 15 bp, Homo sapiens
ctcagtttcttgctt

SEQ ID NO: 4704931 - DNA, 18 bp, Homo sapiens
ctcatacccacccccacc

SEQ ID NO: 4704932 - DNA, 21 bp, Homo sapiens
ctcatacccacccccacccaa

SEQ ID NO: 4704933 - DNA, 21 bp, Homo sapiens
ctcatagtatggtggctgggt

SEQ ID NO: 4704934 - DNA, 13 bp, Homo sapiens
ctcatataagaca

SEQ ID NO: 4704935 - DNA, 19 bp, Homo sapiens
ctcatatatattttaaaaa

SEQ ID NO: 4704936 - DNA, 19 bp, Homo sapiens
ctcatcaggagttccagtg

SEQ ID NO: 4704937 - DNA, 13 bp, Homo sapiens
ctcatcattctct

SEQ ID NO: 4704938 - DNA, 14 bp, Homo sapiens
ctcatcattctctg

SEQ ID NO: 4704939 - DNA, 17 bp, Homo sapiens
ctcatcattctctgtct

SEQ ID NO: 4704940 - DNA, 18 bp, Homo sapiens
ctcatcattctctgtctc

SEQ ID NO: 4704941 - DNA, 19 bp, Homo sapiens
ctcatcattctctgtctca

SEQ ID NO: 4704942 - DNA, 16 bp, Homo sapiens
ctcatccatcatcatg

SEQ ID NO: 4704943 - DNA, 21 bp, Homo sapiens
ctcatccctaatgctgcagat

SEQ ID NO: 4704944 - DNA, 14 bp, Homo sapiens
ctcatctatgtcat

SEQ ID NO: 4704945 - DNA, 19 bp, Homo sapiens
ctcatctcttagctcccct

SEQ ID NO: 4704946 - DNA, 18 bp, Homo sapiens
ctcatctgtccctccggg

SEQ ID NO: 4704947 - DNA, 13 bp, Homo sapiens
ctcatctttcttg

SEQ ID NO: 4704948 - DNA, 21 bp, Homo sapiens
ctcatgtcatttctcatggat

SEQ ID NO: 4704949 - DNA, 17 bp, Homo sapiens
ctcatgtccctatttat

SEQ ID NO: 4704950 - DNA, 18 bp, Homo sapiens
ctcatgtgtgctcttctt

SEQ ID NO: 4704951 - DNA, 17 bp, Homo sapiens
ctcattaattcaatgaa

SEQ ID NO: 4704952 - DNA, 18 bp, Homo sapiens
ctcattaattcaatgaaa

SEQ ID NO: 4704953 - DNA, 13 bp, Homo sapiens
ctcattccccggg

SEQ ID NO: 4704954 - DNA, 23 bp, Homo sapiens
ctcattccccggggcgtttcttt

SEQ ID NO: 4704955 - DNA, 19 bp, Homo sapiens
ctcattctgaaggagcccc

SEQ ID NO: 4704956 - DNA, 21 bp, Homo sapiens
ctcattgacctgaggcccttc

SEQ ID NO: 4704957 - DNA, 21 bp, Homo sapiens
ctcatttgtcacacactttgg

SEQ ID NO: 4704958 - DNA, 20 bp, Homo sapiens
ctcattttgaattatgtgca

SEQ ID NO: 4704959 - DNA, 23 bp, Homo sapiens
ctccaaagaggtgactgggccct

SEQ ID NO: 4704960 - DNA, 21 bp, Homo sapiens
ctccaaccccccagcactgag

SEQ ID NO: 4704961 - DNA, 15 bp, Homo sapiens
ctccaagaccttctc

SEQ ID NO: 4704962 - DNA, 18 bp, Homo sapiens
ctccaagaccttctcctt

SEQ ID NO: 4704963 - DNA, 15 bp, Homo sapiens
ctccaagctcccagg

SEQ ID NO: 4704964 - DNA, 17 bp, Homo sapiens
ctccaagctcccaggca

SEQ ID NO: 4704965 - DNA, 23 bp, Homo sapiens
ctccaagtccacagtggaaccag

SEQ ID NO: 4704966 - DNA, 13 bp, Homo sapiens
ctccacacctgcg

SEQ ID NO: 4704967 - DNA, 17 bp, Homo sapiens
ctccacatcctccacgt

SEQ ID NO: 4704968 - DNA, 11 bp, Homo sapiens
ctccaccctgc

SEQ ID NO: 4704969 - DNA, 15 bp, Homo sapiens
ctccaccctgctctc

SEQ ID NO: 4704970 - DNA, 15 bp, Homo sapiens
ctccacctagtggct

SEQ ID NO: 4704971 - DNA, 21 bp, Homo sapiens
ctccacctagtggctgtccag

SEQ ID NO: 4704972 - DNA, 23 bp, Homo sapiens
ctccacctagtggctgtccagtg

SEQ ID NO: 4704973 - DNA, 17 bp, Homo sapiens
ctccacgcagctggcag

SEQ ID NO: 4704974 - DNA, 20 bp, Homo sapiens
ctccacgcagctggcagaga

SEQ ID NO: 4704975 - DNA, 20 bp, Homo sapiens
ctccacgttctgctcatcat

SEQ ID NO: 4704976 - DNA, 14 bp, Homo sapiens
ctccactcccactt

SEQ ID NO: 4704977 - DNA, 13 bp, Homo sapiens
ctccactctcccc

SEQ ID NO: 4704978 - DNA, 16 bp, Homo sapiens
ctccagacacatgtcc

SEQ ID NO: 4704979 - DNA, 19 bp, Homo sapiens
ctccagacacatgtccaag

SEQ ID NO: 4704980 - DNA, 13 bp, Homo sapiens
ctccagagggcac

SEQ ID NO: 4704981 - DNA, 13 bp, Homo sapiens
ctcctgctgcacc

SEQ ID NO: 4704982 - DNA, 21 bp, Homo sapiens
ctcctgctgcaccaacccagc

SEQ ID NO: 4704983 - DNA, 22 bp, Homo sapiens
ctcctgctgcaccaacccagcc

SEQ ID NO: 4704984 - DNA, 11 bp, Homo sapiens
ctcctggccag

SEQ ID NO: 4704985 - DNA, 19 bp, Homo sapiens
ctcctgggccctctctgct

SEQ ID NO: 4704986 - DNA, 11 bp, Homo sapiens
ctcctgtgtgt

SEQ ID NO: 4704987 - DNA, 16 bp, Homo sapiens
ctcctgtgtgtgcgcc

SEQ ID NO: 4704988 - DNA, 24 bp, Homo sapiens
ctcctgtgtgtgcgcctacaggag

SEQ ID NO: 4704989 - DNA, 12 bp, Homo sapiens
ctcctgtttatg

SEQ ID NO: 4704990 - DNA, 19 bp, Homo sapiens
ctcctgttttgcacagcca

SEQ ID NO: 4704991 - DNA, 13 bp, Homo sapiens
ctccttagaagtg

SEQ ID NO: 4704992 - DNA, 20 bp, Homo sapiens
ctccttagaagtggaagtag

SEQ ID NO: 4704993 - DNA, 19 bp, Homo sapiens
ctccttcacctttgtcccc

SEQ ID NO: 4704994 - DNA, 14 bp, Homo sapiens
ctccttcagccctc

SEQ ID NO: 4704995 - DNA, 13 bp, Homo sapiens
ctccttcctggag

SEQ ID NO: 4704996 - DNA, 20 bp, Homo sapiens
ctccttctctgtctcatgtg

SEQ ID NO: 4704997 - DNA, 12 bp, Homo sapiens
ctccttgggccc

SEQ ID NO: 4704998 - DNA, 16 bp, Homo sapiens
ctccttgggccctttg

SEQ ID NO: 4704999 - DNA, 18 bp, Homo sapiens
ctccttgtggcctgggcc

SEQ ID NO: 4705000 - DNA, 23 bp, Homo sapiens
ctccttgttgttctttaaccctc

SEQ ID NO: 4705001 - DNA, 23 bp, Homo sapiens
ctcctttgtgaggaagccgctgg

SEQ ID NO: 4705002 - DNA, 16 bp, Homo sapiens
ctcgaactcctgacct

SEQ ID NO: 4705003 - DNA, 17 bp, Homo sapiens
ctcgaactcctgacctt

SEQ ID NO: 4705004 - DNA, 13 bp, Homo sapiens
ctcgaactggctg

SEQ ID NO: 4705005 - DNA, 14 bp, Homo sapiens
ctcgaactggctgc

SEQ ID NO: 4705006 - DNA, 14 bp, Homo sapiens
ctcgaagaaaataa

SEQ ID NO: 4705007 - DNA, 15 bp, Homo sapiens
ctcgagcatgcctgg

SEQ ID NO: 4705008 - DNA, 22 bp, Homo sapiens
ctcgagcatgcctggatggggc

SEQ ID NO: 4705009 - DNA, 22 bp, Homo sapiens
ctcgcccaccgcatgccccctc

SEQ ID NO: 4705010 - DNA, 23 bp, Homo sapiens
ctcgcccaccgcatgccccctcg

SEQ ID NO: 4705011 - DNA, 21 bp, Homo sapiens
ctcgcccatcagtgccagccc

SEQ ID NO: 4705012 - DNA, 22 bp, Homo sapiens
ctcgctgatgctgggctgggtg

SEQ ID NO: 4705013 - DNA, 23 bp, Homo sapiens
ctcgctgatgctgggctgggtgc

SEQ ID NO: 4705014 - DNA, 23 bp, Homo sapiens
ctcggcctcccaaagtgctggga

SEQ ID NO: 4705015 - DNA, 17 bp, Homo sapiens
ctcggctcactgcatcc

SEQ ID NO: 4705016 - DNA, 15 bp, Homo sapiens
ctcgggctcctgtgc

SEQ ID NO: 4705017 - DNA, 19 bp, Homo sapiens
ctcggtggtaccaggtctc

SEQ ID NO: 4705018 - DNA, 15 bp, Homo sapiens
ctcgtggtaggactg

SEQ ID NO: 4705019 - DNA, 16 bp, Homo sapiens
ctcgtggtaggactgt

SEQ ID NO: 4705020 - DNA, 23 bp, Homo sapiens
ctcgttgactggctgtgtgttgg

SEQ ID NO: 4705021 - DNA, 12 bp, Homo sapiens
ctcgtttgatag

SEQ ID NO: 4705022 - DNA, 17 bp, Homo sapiens
ctcgtttgatagtgctt

SEQ ID NO: 4705023 - DNA, 17 bp, Homo sapiens
ctctaattttggataat

SEQ ID NO: 4705024 - DNA, 16 bp, Homo sapiens
ctctacacaacatgta

SEQ ID NO: 4705025 - DNA, 18 bp, Homo sapiens
ctctacagagcttccctg

SEQ ID NO: 4705026 - DNA, 20 bp, Homo sapiens
ctctacagagcttccctgac

SEQ ID NO: 4705027 - DNA, 19 bp, Homo sapiens
ctctacagaggccatgggc

SEQ ID NO: 4705028 - DNA, 23 bp, Homo sapiens
ctctaggtacgatgacagtgttc

SEQ ID NO: 4705029 - DNA, 21 bp, Homo sapiens
ctctagtccctgtgttctgca

SEQ ID NO: 4705030 - DNA, 11 bp, Homo sapiens
ctctatttctt

SEQ ID NO: 4705031 - DNA, 17 bp, Homo sapiens
ctctcactcacattttc

SEQ ID NO: 4705032 - DNA, 12 bp, Homo sapiens
ctctcactcctt

SEQ ID NO: 4705033 - DNA, 21 bp, Homo sapiens
ctctcagcccctgatcctgtg

SEQ ID NO: 4705034 - DNA, 17 bp, Homo sapiens
ctctcaggaccaaagct

SEQ ID NO: 4705035 - DNA, 13 bp, Homo sapiens
ctctcagtctctg

SEQ ID NO: 4705036 - DNA, 19 bp, Homo sapiens
ctctcagttgcagccctgc

SEQ ID NO: 4705037 - DNA, 20 bp, Homo sapiens
ctctccacctagtggctgtc

SEQ ID NO: 4705038 - DNA, 13 bp, Homo sapiens
ctctccagctata

SEQ ID NO: 4705039 - DNA, 24 bp, Homo sapiens
ctctccccagcaagtgagagctgg

SEQ ID NO: 4705040 - DNA, 15 bp, Homo sapiens
ctctcccctgccccc

SEQ ID NO: 4705041 - DNA, 21 bp, Homo sapiens
ctctcccctgccccctgcagg

SEQ ID NO: 4705042 - DNA, 22 bp, Homo sapiens
ctctcccctgccccctgcagga

SEQ ID NO: 4705043 - DNA, 18 bp, Homo sapiens
ctctccctcctggccaga

SEQ ID NO: 4705044 - DNA, 13 bp, Homo sapiens
ctctcccttggat

SEQ ID NO: 4705045 - DNA, 19 bp, Homo sapiens
ctctccgcacacctctggc

SEQ ID NO: 4705046 - DNA, 15 bp, Homo sapiens
ctctcctctgcctca

SEQ ID NO: 4705047 - DNA, 13 bp, Homo sapiens
ctctcctctgctg

SEQ ID NO: 4705048 - DNA, 21 bp, Homo sapiens
ctctcttgtgagccatagaga

SEQ ID NO: 4705049 - DNA, 12 bp, Homo sapiens
ctctgaaaccag

SEQ ID NO: 4705050 - DNA, 17 bp, Homo sapiens
ctctgaaaccagtgtta

SEQ ID NO: 4705051 - DNA, 18 bp, Homo sapiens
ctctgacccacagcctcc

SEQ ID NO: 4705052 - DNA, 21 bp, Homo sapiens
ctctgacccacagcctccaag

SEQ ID NO: 4705053 - DNA, 20 bp, Homo sapiens
ctctgactcagggctcctgg

SEQ ID NO: 4705054 - DNA, 21 bp, Homo sapiens
ctctgactcagggctcctggg

SEQ ID NO: 4705055 - DNA, 15 bp, Homo sapiens
ctctgagacacaccc

SEQ ID NO: 4705056 - DNA, 15 bp, Homo sapiens
ctctgagctgtgcag

SEQ ID NO: 4705057 - DNA, 12 bp, Homo sapiens
ctctgagctgtt

SEQ ID NO: 4705058 - DNA, 19 bp, Homo sapiens
ctctgagctgttatcttgt

SEQ ID NO: 4705059 - DNA, 12 bp, Homo sapiens
ctctgatccctc

SEQ ID NO: 4705060 - DNA, 14 bp, Homo sapiens
ctctgcaccttctg

SEQ ID NO: 4705061 - DNA, 15 bp, Homo sapiens
ctctgcaccttctga

SEQ ID NO: 4705062 - DNA, 23 bp, Homo sapiens
ctctgcaccttctgacgcagcct

SEQ ID NO: 4705063 - DNA, 15 bp, Homo sapiens
ctctgcactcccctg

SEQ ID NO: 4705064 - DNA, 18 bp, Homo sapiens
ctctgcactcccctgctg

SEQ ID NO: 4705065 - DNA, 21 bp, Homo sapiens
ctctgcactcccctgctgggt

SEQ ID NO: 4705066 - DNA, 13 bp, Homo sapiens
ctctgcagcctca

SEQ ID NO: 4705067 - DNA, 15 bp, Homo sapiens
ctctgcagcctcaga

SEQ ID NO: 4705068 - DNA, 17 bp, Homo sapiens
ctctgcagtgtggcaag

SEQ ID NO: 4705069 - DNA, 23 bp, Homo sapiens
ctctgcagtgtggcaagcaagag

SEQ ID NO: 4705070 - DNA, 20 bp, Homo sapiens
ctctgcccactccctgcaac

SEQ ID NO: 4705071 - DNA, 23 bp, Homo sapiens
ctctgccctccaagaccttctcc

SEQ ID NO: 4705072 - DNA, 11 bp, Homo sapiens
ctctgccctgc

SEQ ID NO: 4705073 - DNA, 12 bp, Homo sapiens
ctctgccctgcg

SEQ ID NO: 4705074 - DNA, 10 bp, Homo sapiens
ctctgcctga

SEQ ID NO: 4705075 - DNA, 22 bp, Homo sapiens
ctctgcctgaagtcacacagtg

SEQ ID NO: 4705076 - DNA, 13 bp, Homo sapiens
ctctgctctgcgt

SEQ ID NO: 4705077 - DNA, 20 bp, Homo sapiens
ctctgctgacagacacaggc

SEQ ID NO: 4705078 - DNA, 21 bp, Homo sapiens
ctctgctgacagacacaggcc

SEQ ID NO: 4705079 - DNA, 16 bp, Homo sapiens
ctctgctgctggctgg

SEQ ID NO: 4705080 - DNA, 13 bp, Homo sapiens
ctctggaagaaga

SEQ ID NO: 4705081 - DNA, 16 bp, Homo sapiens
ctctggacaggcatgt

SEQ ID NO: 4705082 - DNA, 15 bp, Homo sapiens
ctctggatgcctgat

SEQ ID NO: 4705083 - DNA, 16 bp, Homo sapiens
ctctggcagctcagag

SEQ ID NO: 4705084 - DNA, 17 bp, Homo sapiens
ctctggcagctcagaga

SEQ ID NO: 4705085 - DNA, 18 bp, Homo sapiens
ctctggcagctcagagag

SEQ ID NO: 4705086 - DNA, 19 bp, Homo sapiens
ctctggcagctcagagagg

SEQ ID NO: 4705087 - DNA, 15 bp, Homo sapiens
ctctggctccagctg

SEQ ID NO: 4705088 - DNA, 22 bp, Homo sapiens
ctctggctccagctggccggga

SEQ ID NO: 4705089 - DNA, 19 bp, Homo sapiens
ctctggtatctaattcttt

SEQ ID NO: 4705090 - DNA, 16 bp, Homo sapiens
ctctggtccatagaga

SEQ ID NO: 4705091 - DNA, 18 bp, Homo sapiens
ctgcatgttcctggacac

SEQ ID NO: 4705092 - DNA, 15 bp, Homo sapiens
ctgcatttaaaaaaa

SEQ ID NO: 4705093 - DNA, 23 bp, Homo sapiens
ctgcattttgtagcctctctttg

SEQ ID NO: 4705094 - DNA, 19 bp, Homo sapiens
ctgcatttttaaaggacaa

SEQ ID NO: 4705095 - DNA, 23 bp, Homo sapiens
ctgcatttttaaaggacaaacag

SEQ ID NO: 4705096 - DNA, 22 bp, Homo sapiens
ctgccacagcctcccctgccag

SEQ ID NO: 4705097 - DNA, 16 bp, Homo sapiens
ctgccaccctggggag

SEQ ID NO: 4705098 - DNA, 20 bp, Homo sapiens
ctgccaccctggggagaaag

SEQ ID NO: 4705099 - DNA, 21 bp, Homo sapiens
ctgccaccctggggagaaagt

SEQ ID NO: 4705100 - DNA, 15 bp, Homo sapiens
ctgccagggacagag

SEQ ID NO: 4705101 - DNA, 20 bp, Homo sapiens
ctgccagggacagagggggt

SEQ ID NO: 4705102 - DNA, 16 bp, Homo sapiens
ctgccagggcagggcc

SEQ ID NO: 4705103 - DNA, 23 bp, Homo sapiens
ctgccatattctgttggccagtg

SEQ ID NO: 4705104 - DNA, 22 bp, Homo sapiens
ctgccatggccttggcaggctg

SEQ ID NO: 4705105 - DNA, 13 bp, Homo sapiens
ctgccatgtccat

SEQ ID NO: 4705106 - DNA, 15 bp, Homo sapiens
ctgcccacctccttc

SEQ ID NO: 4705107 - DNA, 13 bp, Homo sapiens
ctgcccacctggc

SEQ ID NO: 4705108 - DNA, 14 bp, Homo sapiens
ctgcccactccctg

SEQ ID NO: 4705109 - DNA, 16 bp, Homo sapiens
ctgcccactccctgca

SEQ ID NO: 4705110 - DNA, 18 bp, Homo sapiens
ctgcccactccctgcaac

SEQ ID NO: 4705111 - DNA, 13 bp, Homo sapiens
ctgcccaggcccc

SEQ ID NO: 4705112 - DNA, 18 bp, Homo sapiens
ctgcccaggcccctgcca

SEQ ID NO: 4705113 - DNA, 20 bp, Homo sapiens
ctgcccaggcccctgccacc

SEQ ID NO: 4705114 - DNA, 14 bp, Homo sapiens
ctgccccctctgcc

SEQ ID NO: 4705115 - DNA, 18 bp, Homo sapiens
ctgccccctctgccctgc

SEQ ID NO: 4705116 - DNA, 19 bp, Homo sapiens
ctgccccctctgccctgcg

SEQ ID NO: 4705117 - DNA, 12 bp, Homo sapiens
ctgccccctgca

SEQ ID NO: 4705118 - DNA, 13 bp, Homo sapiens
ctgccccctgcag

SEQ ID NO: 4705119 - DNA, 15 bp, Homo sapiens
ctgccccctgcagga

SEQ ID NO: 4705120 - DNA, 19 bp, Homo sapiens
ctgcccctcctctctgccc

SEQ ID NO: 4705121 - DNA, 20 bp, Homo sapiens
ctgcccctcctctctgccct

SEQ ID NO: 4705122 - DNA, 16 bp, Homo sapiens
ctgcccgctcccagtg

SEQ ID NO: 4705123 - DNA, 20 bp, Homo sapiens
ctgcccggcgccctctgtcc

SEQ ID NO: 4705124 - DNA, 21 bp, Homo sapiens
ctgcccggcgccctctgtcct

SEQ ID NO: 4705125 - DNA, 23 bp, Homo sapiens
ctgcccggcgccctctgtcctga

SEQ ID NO: 4705126 - DNA, 11 bp, Homo sapiens
ctgcccggctg

SEQ ID NO: 4705127 - DNA, 15 bp, Homo sapiens
ctgcccggctgcgga

SEQ ID NO: 4705128 - DNA, 22 bp, Homo sapiens
ctgccctaatgcgcaggctggc

SEQ ID NO: 4705129 - DNA, 14 bp, Homo sapiens
ctgccctgcccacc

SEQ ID NO: 4705130 - DNA, 15 bp, Homo sapiens
ctgccctgcccacct

SEQ ID NO: 4705131 - DNA, 13 bp, Homo sapiens
ctgccctgggagg

SEQ ID NO: 4705132 - DNA, 22 bp, Homo sapiens
ctgccctgggaggcagtgatgg

SEQ ID NO: 4705133 - DNA, 19 bp, Homo sapiens
ctgccctggtttcctgccc

SEQ ID NO: 4705134 - DNA, 20 bp, Homo sapiens
ctgccctggtttcctgccct

SEQ ID NO: 4705135 - DNA, 23 bp, Homo sapiens
ctgccctggtttcctgccctggg

SEQ ID NO: 4705136 - DNA, 12 bp, Homo sapiens
ctgccctgtggg

SEQ ID NO: 4705137 - DNA, 16 bp, Homo sapiens
ctgccctgtgggcccc

SEQ ID NO: 4705138 - DNA, 18 bp, Homo sapiens
ctgccctgtgggccccca

SEQ ID NO: 4705139 - DNA, 18 bp, Homo sapiens
ctgcccttgctccagcct

SEQ ID NO: 4705140 - DNA, 15 bp, Homo sapiens
ctgcctcagcctccc

SEQ ID NO: 4705141 - DNA, 19 bp, Homo sapiens
ctgcctcagcctcccaaag

SEQ ID NO: 4705142 - DNA, 18 bp, Homo sapiens
ctgcctccactcccactt

SEQ ID NO: 4705143 - DNA, 14 bp, Homo sapiens
ctgcctccagggct

SEQ ID NO: 4705144 - DNA, 16 bp, Homo sapiens
ctgcctccagggctgg

SEQ ID NO: 4705145 - DNA, 17 bp, Homo sapiens
ctgcctccagggctgga

SEQ ID NO: 4705146 - DNA, 19 bp, Homo sapiens
ctgcctccagggctggact

SEQ ID NO: 4705147 - DNA, 20 bp, Homo sapiens
ctgcctccagggctggactg

SEQ ID NO: 4705148 - DNA, 12 bp, Homo sapiens
ctgcctcccatc

SEQ ID NO: 4705149 - DNA, 19 bp, Homo sapiens
ctgcctcccatcacccgct

SEQ ID NO: 4705150 - DNA, 17 bp, Homo sapiens
ctgcctcccttcatgca

SEQ ID NO: 4705151 - DNA, 21 bp, Homo sapiens
ctgcctcctttgtgaggaagc

SEQ ID NO: 4705152 - DNA, 15 bp, Homo sapiens
ctgcctcgaactggc

SEQ ID NO: 4705153 - DNA, 18 bp, Homo sapiens
ctgcctcgaactggctgc

SEQ ID NO: 4705154 - DNA, 20 bp, Homo sapiens
ctgcctcgaactggctgcaa

SEQ ID NO: 4705155 - DNA, 17 bp, Homo sapiens
ctgcctctgacacacag

SEQ ID NO: 4705156 - DNA, 23 bp, Homo sapiens
ctgcctctgacacacagctctgt

SEQ ID NO: 4705157 - DNA, 16 bp, Homo sapiens
ctgcctcttctgggag

SEQ ID NO: 4705158 - DNA, 17 bp, Homo sapiens
ctgcctcttctgggagg

SEQ ID NO: 4705159 - DNA, 18 bp, Homo sapiens
ctgcctgaagtcacacag

SEQ ID NO: 4705160 - DNA, 23 bp, Homo sapiens
ctgcctgaagtcacacagtgagt

SEQ ID NO: 4705161 - DNA, 14 bp, Homo sapiens
ctgcctgcccaggc

SEQ ID NO: 4705162 - DNA, 17 bp, Homo sapiens
ctgcctgcccaggcccc

SEQ ID NO: 4705163 - DNA, 23 bp, Homo sapiens
ctgcctggacttggcccctgcca

SEQ ID NO: 4705164 - DNA, 16 bp, Homo sapiens
ctgcctgggagccagg

SEQ ID NO: 4705165 - DNA, 22 bp, Homo sapiens
ctgcctgggatccctcatcctc

SEQ ID NO: 4705166 - DNA, 17 bp, Homo sapiens
ctgcctgttcagctcca

SEQ ID NO: 4705167 - DNA, 13 bp, Homo sapiens
ctgccttcctcct

SEQ ID NO: 4705168 - DNA, 21 bp, Homo sapiens
ctgccttcctcctgggccctc

SEQ ID NO: 4705169 - DNA, 12 bp, Homo sapiens
ctgccttccttg

SEQ ID NO: 4705170 - DNA, 13 bp, Homo sapiens
ctgccttccttgc

SEQ ID NO: 4705171 - DNA, 14 bp, Homo sapiens
ctgccttccttgct

SEQ ID NO: 4705172 - DNA, 15 bp, Homo sapiens
ctgccttccttgcta

SEQ ID NO: 4705173 - DNA, 12 bp, Homo sapiens
ctgccttgatta

SEQ ID NO: 4705174 - DNA, 14 bp, Homo sapiens
ctgcctttttgtcg

SEQ ID NO: 4705175 - DNA, 23 bp, Homo sapiens
ctgcggattgctttttcattttc

SEQ ID NO: 4705176 - DNA, 21 bp, Homo sapiens
ctgcgggtcacaggagggagg

SEQ ID NO: 4705177 - DNA, 16 bp, Homo sapiens
ctgcggtccacccagg

SEQ ID NO: 4705178 - DNA, 23 bp, Homo sapiens
ctgcggtgctatctcccccagcc

SEQ ID NO: 4705179 - DNA, 19 bp, Homo sapiens
ctgcgtgacaataaaacat

SEQ ID NO: 4705180 - DNA, 17 bp, Homo sapiens
ctgcgtgtgtctgtgtt

SEQ ID NO: 4705181 - DNA, 16 bp, Homo sapiens
ctgctaattccccaga

SEQ ID NO: 4705182 - DNA, 18 bp, Homo sapiens
ctgctaccctccctgctg

SEQ ID NO: 4705183 - DNA, 21 bp, Homo sapiens
ctgctagtgctgtaatattgt

SEQ ID NO: 4705184 - DNA, 18 bp, Homo sapiens
ctgctcacaggcaggctt

SEQ ID NO: 4705185 - DNA, 16 bp, Homo sapiens
ctgctcacatatctgt

SEQ ID NO: 4705186 - DNA, 18 bp, Homo sapiens
ctgctcacgtcaaatgca

SEQ ID NO: 4705187 - DNA, 17 bp, Homo sapiens
ctgctcatcattctctg

SEQ ID NO: 4705188 - DNA, 13 bp, Homo sapiens
ctgctccacagtg

SEQ ID NO: 4705189 - DNA, 14 bp, Homo sapiens
ctgctccacagtgt

SEQ ID NO: 4705190 - DNA, 16 bp, Homo sapiens
ctgctcctctccccag

SEQ ID NO: 4705191 - DNA, 17 bp, Homo sapiens
ctgctcctctccccagc

SEQ ID NO: 4705192 - DNA, 17 bp, Homo sapiens
ctgctctaagaagctgc

SEQ ID NO: 4705193 - DNA, 21 bp, Homo sapiens
ctgctctaagaagctgcaata

SEQ ID NO: 4705194 - DNA, 15 bp, Homo sapiens
ctgctctccttcctg

SEQ ID NO: 4705195 - DNA, 17 bp, Homo sapiens
ctgctctccttcctgga

SEQ ID NO: 4705196 - DNA, 12 bp, Homo sapiens
ctgctctggtta

SEQ ID NO: 4705197 - DNA, 24 bp, Homo sapiens
ctgctgaaggctcgagcatgcctg

SEQ ID NO: 4705198 - DNA, 15 bp, Homo sapiens
ctgctgaatgtaaaa

SEQ ID NO: 4705199 - DNA, 18 bp, Homo sapiens
ctgctgacagacacaggc

SEQ ID NO: 4705200 - DNA, 20 bp, Homo sapiens
ctgctgacagacacaggccc

SEQ ID NO: 4705201 - DNA, 22 bp, Homo sapiens
ctgtcccttggagctgtaaacc

SEQ ID NO: 4705202 - DNA, 16 bp, Homo sapiens
ctgtcctactctgtgt

SEQ ID NO: 4705203 - DNA, 17 bp, Homo sapiens
ctgtcctactctgtgtc

SEQ ID NO: 4705204 - DNA, 21 bp, Homo sapiens
ctgtcctactctgtgtcaggt

SEQ ID NO: 4705205 - DNA, 14 bp, Homo sapiens
ctgtcctgctccac

SEQ ID NO: 4705206 - DNA, 18 bp, Homo sapiens
ctgtcctgctccacagtg

SEQ ID NO: 4705207 - DNA, 16 bp, Homo sapiens
ctgtctcatccatcat

SEQ ID NO: 4705208 - DNA, 17 bp, Homo sapiens
ctgtctcatccatcatc

SEQ ID NO: 4705209 - DNA, 13 bp, Homo sapiens
ctgtctctggcct

SEQ ID NO: 4705210 - DNA, 13 bp, Homo sapiens
ctgtctgtagtgt

SEQ ID NO: 4705211 - DNA, 20 bp, Homo sapiens
ctgtgaacaagcttcagtaa

SEQ ID NO: 4705212 - DNA, 16 bp, Homo sapiens
ctgtgaataaaaagaa

SEQ ID NO: 4705213 - DNA, 21 bp, Homo sapiens
ctgtgaataaaaagaaagatt

SEQ ID NO: 4705214 - DNA, 16 bp, Homo sapiens
ctgtgaatgcttctga

SEQ ID NO: 4705215 - DNA, 15 bp, Homo sapiens
ctgtgacaggcagca

SEQ ID NO: 4705216 - DNA, 20 bp, Homo sapiens
ctgtgagactcgagaacttt

SEQ ID NO: 4705217 - DNA, 23 bp, Homo sapiens
ctgtgagtactacagtcctccca

SEQ ID NO: 4705218 - DNA, 15 bp, Homo sapiens
ctgtgatggggccct

SEQ ID NO: 4705219 - DNA, 19 bp, Homo sapiens
ctgtgatggggccctgcct

SEQ ID NO: 4705220 - DNA, 18 bp, Homo sapiens
ctgtgcaaacagtgtaag

SEQ ID NO: 4705221 - DNA, 18 bp, Homo sapiens
ctgtgcagataaacagaa

SEQ ID NO: 4705222 - DNA, 16 bp, Homo sapiens
ctgtgcagccgctgag

SEQ ID NO: 4705223 - DNA, 13 bp, Homo sapiens
ctgtgccaccctg

SEQ ID NO: 4705224 - DNA, 18 bp, Homo sapiens
ctgtgccaccctgggctc

SEQ ID NO: 4705225 - DNA, 18 bp, Homo sapiens
ctgtgccatgtgccaggt

SEQ ID NO: 4705226 - DNA, 14 bp, Homo sapiens
ctgtgccattttgt

SEQ ID NO: 4705227 - DNA, 14 bp, Homo sapiens
ctgtgctccctggt

SEQ ID NO: 4705228 - DNA, 14 bp, Homo sapiens
ctgtgctctggaca

SEQ ID NO: 4705229 - DNA, 12 bp, Homo sapiens
ctgtgctgccct

SEQ ID NO: 4705230 - DNA, 18 bp, Homo sapiens
ctgtgctgccctgcccac

SEQ ID NO: 4705231 - DNA, 19 bp, Homo sapiens
ctgtgctgccctgcccacc

SEQ ID NO: 4705232 - DNA, 15 bp, Homo sapiens
ctgtggaggaaggat

SEQ ID NO: 4705233 - DNA, 17 bp, Homo sapiens
ctgtggaggaaggattg

SEQ ID NO: 4705234 - DNA, 19 bp, Homo sapiens
ctgtggaggaaggattgta

SEQ ID NO: 4705235 - DNA, 20 bp, Homo sapiens
ctgtggaggccgagtctgtc

SEQ ID NO: 4705236 - DNA, 20 bp, Homo sapiens
ctgtggattcagcttctgtt

SEQ ID NO: 4705237 - DNA, 19 bp, Homo sapiens
ctgtggcgctgcagcaggg

SEQ ID NO: 4705238 - DNA, 24 bp, Homo sapiens
ctgtggcgctgcagcagggcagga

SEQ ID NO: 4705239 - DNA, 20 bp, Homo sapiens
ctgtgggattctgatttgta

SEQ ID NO: 4705240 - DNA, 14 bp, Homo sapiens
ctgtgggctgcact

SEQ ID NO: 4705241 - DNA, 18 bp, Homo sapiens
ctgtgggctgcactctgt

SEQ ID NO: 4705242 - DNA, 20 bp, Homo sapiens
ctgtgggctgcactctgtgc

SEQ ID NO: 4705243 - DNA, 19 bp, Homo sapiens
ctgtggtacaaatgtgata

SEQ ID NO: 4705244 - DNA, 23 bp, Homo sapiens
ctgtgtaatagaataaaggcctg

SEQ ID NO: 4705245 - DNA, 13 bp, Homo sapiens
ctgtgtacatttt

SEQ ID NO: 4705246 - DNA, 14 bp, Homo sapiens
ctgtgtacatttta

SEQ ID NO: 4705247 - DNA, 19 bp, Homo sapiens
ctgtgtcactggctgcctc

SEQ ID NO: 4705248 - DNA, 20 bp, Homo sapiens
ctgtgtcactggctgcctcc

SEQ ID NO: 4705249 - DNA, 21 bp, Homo sapiens
ctgtgtcactggctgcctcca

SEQ ID NO: 4705250 - DNA, 16 bp, Homo sapiens
ctgtgtctaaatttct

SEQ ID NO: 4705251 - DNA, 18 bp, Homo sapiens
ctgtgtctctgtatatag

SEQ ID NO: 4705252 - DNA, 23 bp, Homo sapiens
ctgtgtctctgtatatagctcta

SEQ ID NO: 4705253 - DNA, 14 bp, Homo sapiens
ctgtgtcttgcaat

SEQ ID NO: 4705254 - DNA, 22 bp, Homo sapiens
ctgtgtcttgcaatggcagcct

SEQ ID NO: 4705255 - DNA, 15 bp, Homo sapiens
ctgtgtgaatttttc

SEQ ID NO: 4705256 - DNA, 20 bp, Homo sapiens
ctgtgtgtgcgcctacagga

SEQ ID NO: 4705257 - DNA, 22 bp, Homo sapiens
ctgtgtgtttgtgtgtatctgt

SEQ ID NO: 4705258 - DNA, 22 bp, Homo sapiens
ctgtgttactaaaaaaaagatg

SEQ ID NO: 4705259 - DNA, 23 bp, Homo sapiens
ctgtgttactaaaaaaaagatga

SEQ ID NO: 4705260 - DNA, 17 bp, Homo sapiens
ctgtgttctcttaagca

SEQ ID NO: 4705261 - DNA, 18 bp, Homo sapiens
ctgtgttttgaaagaata

SEQ ID NO: 4705262 - DNA, 21 bp, Homo sapiens
ctgttaacactgtaatatctt

SEQ ID NO: 4705263 - DNA, 12 bp, Homo sapiens
ctgttagccagg

SEQ ID NO: 4705264 - DNA, 21 bp, Homo sapiens
ctgttcaagagcacacttggc

SEQ ID NO: 4705265 - DNA, 23 bp, Homo sapiens
ctgttcaagagcacacttggccc

SEQ ID NO: 4705266 - DNA, 13 bp, Homo sapiens
ctgttcagctcca

SEQ ID NO: 4705267 - DNA, 16 bp, Homo sapiens
ctgttccccctgtgca

SEQ ID NO: 4705268 - DNA, 14 bp, Homo sapiens
ctgttctacttgat

SEQ ID NO: 4705269 - DNA, 13 bp, Homo sapiens
ctgttctctgccc

SEQ ID NO: 4705270 - DNA, 15 bp, Homo sapiens
ctgttctctgccctc

SEQ ID NO: 4705271 - DNA, 18 bp, Homo sapiens
ctgttctctgccctccaa

SEQ ID NO: 4705272 - DNA, 19 bp, Homo sapiens
ctgttctgtcccttggagc

SEQ ID NO: 4705273 - DNA, 15 bp, Homo sapiens
ctgttgcacgtgtgt

SEQ ID NO: 4705274 - DNA, 23 bp, Homo sapiens
ctgttgcacgtgtgtttttctat

SEQ ID NO: 4705275 - DNA, 15 bp, Homo sapiens
ctgttgcccaggctg

SEQ ID NO: 4705276 - DNA, 17 bp, Homo sapiens
ctgttgctgcctcatgc

SEQ ID NO: 4705277 - DNA, 12 bp, Homo sapiens
ctgttggccagt

SEQ ID NO: 4705278 - DNA, 12 bp, Homo sapiens
ctgttgggtggg

SEQ ID NO: 4705279 - DNA, 21 bp, Homo sapiens
ctgttggttatttgtgttatt

SEQ ID NO: 4705280 - DNA, 13 bp, Homo sapiens
ctgttgtacattt

SEQ ID NO: 4705281 - DNA, 14 bp, Homo sapiens
ctgttgtacattta

SEQ ID NO: 4705282 - DNA, 18 bp, Homo sapiens
ctgttgtacatttatgat

SEQ ID NO: 4705283 - DNA, 13 bp, Homo sapiens
ctgtttactgctt

SEQ ID NO: 4705284 - DNA, 19 bp, Homo sapiens
ctgtttatgatctatttgt

SEQ ID NO: 4705285 - DNA, 20 bp, Homo sapiens
ctgtttatgatctatttgta

SEQ ID NO: 4705286 - DNA, 12 bp, Homo sapiens
ctgtttcccagc

SEQ ID NO: 4705287 - DNA, 16 bp, Homo sapiens
ctgtttcctagctgtg

SEQ ID NO: 4705288 - DNA, 12 bp, Homo sapiens
ctgtttgacaaa

SEQ ID NO: 4705289 - DNA, 15 bp, Homo sapiens
ctgtttgacaaacct

SEQ ID NO: 4705290 - DNA, 22 bp, Homo sapiens
ctgtttgcatttgatacatttt

SEQ ID NO: 4705291 - DNA, 23 bp, Homo sapiens
ctgtttggaggagcaaaggctga

SEQ ID NO: 4705292 - DNA, 16 bp, Homo sapiens
ctgtttgtcttctccc

SEQ ID NO: 4705293 - DNA, 17 bp, Homo sapiens
ctgtttgtcttctcccc

SEQ ID NO: 4705294 - DNA, 18 bp, Homo sapiens
ctgttttaatttgtattt

SEQ ID NO: 4705295 - DNA, 20 bp, Homo sapiens
ctgttttctacccttggaaa

SEQ ID NO: 4705296 - DNA, 14 bp, Homo sapiens
cttaaaacaacact

SEQ ID NO: 4705297 - DNA, 24 bp, Homo sapiens
cttaaaatgttcacttttgacaaa

SEQ ID NO: 4705298 - DNA, 13 bp, Homo sapiens
cttaaacaaaaat

SEQ ID NO: 4705299 - DNA, 19 bp, Homo sapiens
cttaaacaaaaattaaaat

SEQ ID NO: 4705300 - DNA, 15 bp, Homo sapiens
cttaaactaaatgtg

SEQ ID NO: 4705301 - DNA, 13 bp, Homo sapiens
cttaaatttggtt

SEQ ID NO: 4705302 - DNA, 12 bp, Homo sapiens
cttaacagtttt

SEQ ID NO: 4705303 - DNA, 21 bp, Homo sapiens
cttaagaggcctgtgattatt

SEQ ID NO: 4705304 - DNA, 16 bp, Homo sapiens
cttaagtctcgaatgt

SEQ ID NO: 4705305 - DNA, 19 bp, Homo sapiens
cttaagtctcgaatgtaat

SEQ ID NO: 4705306 - DNA, 18 bp, Homo sapiens
cttaatcttttcacaaat

SEQ ID NO: 4705307 - DNA, 21 bp, Homo sapiens
cttaatcttttcacaaataaa

SEQ ID NO: 4705308 - DNA, 15 bp, Homo sapiens
cttaatgttgaatgt

SEQ ID NO: 4705309 - DNA, 16 bp, Homo sapiens
cttaattattgatgtt

SEQ ID NO: 4705310 - DNA, 23 bp, Homo sapiens
cttacagtgagggctatacatgg

SEQ ID NO: 4705311 - DNA, 12 bp, Homo sapiens
cttctctgagtc

SEQ ID NO: 4705312 - DNA, 19 bp, Homo sapiens
cttctcttatctgccatgt

SEQ ID NO: 4705313 - DNA, 20 bp, Homo sapiens
cttctgaatgaagccttctg

SEQ ID NO: 4705314 - DNA, 17 bp, Homo sapiens
cttctgacccatgctgc

SEQ ID NO: 4705315 - DNA, 18 bp, Homo sapiens
cttctgacccatgctgcc

SEQ ID NO: 4705316 - DNA, 22 bp, Homo sapiens
cttctgacccatgctgccctgt

SEQ ID NO: 4705317 - DNA, 11 bp, Homo sapiens
cttctgccact

SEQ ID NO: 4705318 - DNA, 14 bp, Homo sapiens
cttctgctgggctg

SEQ ID NO: 4705319 - DNA, 15 bp, Homo sapiens
cttctgctgggctgg

SEQ ID NO: 4705320 - DNA, 18 bp, Homo sapiens
cttctgcttcagcctccc

SEQ ID NO: 4705321 - DNA, 15 bp, Homo sapiens
cttctgggagggcag

SEQ ID NO: 4705322 - DNA, 16 bp, Homo sapiens
cttctgggttccttcc

SEQ ID NO: 4705323 - DNA, 15 bp, Homo sapiens
cttctgtaattgtgt

SEQ ID NO: 4705324 - DNA, 15 bp, Homo sapiens
cttctgtacgtctga

SEQ ID NO: 4705325 - DNA, 20 bp, Homo sapiens
cttctgtacgtctgacaggc

SEQ ID NO: 4705326 - DNA, 21 bp, Homo sapiens
cttctgtacgtctgacaggca

SEQ ID NO: 4705327 - DNA, 17 bp, Homo sapiens
cttctgtcctactctgt

SEQ ID NO: 4705328 - DNA, 17 bp, Homo sapiens
cttctgttgctgcctca

SEQ ID NO: 4705329 - DNA, 16 bp, Homo sapiens
cttcttaatcttttca

SEQ ID NO: 4705330 - DNA, 13 bp, Homo sapiens
cttcttcagagac

SEQ ID NO: 4705331 - DNA, 12 bp, Homo sapiens
cttcttgtaata

SEQ ID NO: 4705332 - DNA, 13 bp, Homo sapiens
cttcttgtaatat

SEQ ID NO: 4705333 - DNA, 18 bp, Homo sapiens
cttcttgtaatatttctt

SEQ ID NO: 4705334 - DNA, 17 bp, Homo sapiens
cttctttgataatgtta

SEQ ID NO: 4705335 - DNA, 14 bp, Homo sapiens
cttgaaaaaaaaca

SEQ ID NO: 4705336 - DNA, 20 bp, Homo sapiens
cttgaaaacatgttagtcaa

SEQ ID NO: 4705337 - DNA, 13 bp, Homo sapiens
cttgaactcctga

SEQ ID NO: 4705338 - DNA, 15 bp, Homo sapiens
cttgaactcctggcc

SEQ ID NO: 4705339 - DNA, 17 bp, Homo sapiens
cttgaactcctggcctc

SEQ ID NO: 4705340 - DNA, 20 bp, Homo sapiens
cttgaactgggtacttgtgg

SEQ ID NO: 4705341 - DNA, 17 bp, Homo sapiens
cttgaagtaggaagtag

SEQ ID NO: 4705342 - DNA, 17 bp, Homo sapiens
cttgaagtgactgttgt

SEQ ID NO: 4705343 - DNA, 19 bp, Homo sapiens
cttgaagtgactgttgtac

SEQ ID NO: 4705344 - DNA, 20 bp, Homo sapiens
cttgaattgtaactgttctt

SEQ ID NO: 4705345 - DNA, 17 bp, Homo sapiens
cttgaattttcccactg

SEQ ID NO: 4705346 - DNA, 22 bp, Homo sapiens
cttgaattttcccactgcaccc

SEQ ID NO: 4705347 - DNA, 19 bp, Homo sapiens
cttgacaccttactttccc

SEQ ID NO: 4705348 - DNA, 15 bp, Homo sapiens
cttgaccaggcctgg

SEQ ID NO: 4705349 - DNA, 20 bp, Homo sapiens
cttgaccattctccacctgc

SEQ ID NO: 4705350 - DNA, 14 bp, Homo sapiens
cttgagagaccagg

SEQ ID NO: 4705351 - DNA, 13 bp, Homo sapiens
cttgaggagaagt

SEQ ID NO: 4705352 - DNA, 22 bp, Homo sapiens
cttgatacgatagttacataat

SEQ ID NO: 4705353 - DNA, 19 bp, Homo sapiens
cttgatgccagtaggctca

SEQ ID NO: 4705354 - DNA, 20 bp, Homo sapiens
cttgcaagcaacaagctatt

SEQ ID NO: 4705355 - DNA, 21 bp, Homo sapiens
cttgcaagcaacaagctattt

SEQ ID NO: 4705356 - DNA, 15 bp, Homo sapiens
cttgcaatggcagcc

SEQ ID NO: 4705357 - DNA, 12 bp, Homo sapiens
cttgcagcagga

SEQ ID NO: 4705358 - DNA, 12 bp, Homo sapiens
cttgcagtacat

SEQ ID NO: 4705359 - DNA, 20 bp, Homo sapiens
cttgcagtacatcaaaggaa

SEQ ID NO: 4705360 - DNA, 22 bp, Homo sapiens
cttgcagtacatcaaaggaatg

SEQ ID NO: 4705361 - DNA, 14 bp, Homo sapiens
cttgcatgaggcta

SEQ ID NO: 4705362 - DNA, 14 bp, Homo sapiens
cttgccaagaaatc

SEQ ID NO: 4705363 - DNA, 13 bp, Homo sapiens
cttgccccaaccc

SEQ ID NO: 4705364 - DNA, 16 bp, Homo sapiens
cttgcccttgggtgct

SEQ ID NO: 4705365 - DNA, 16 bp, Homo sapiens
cttgccctttccatat

SEQ ID NO: 4705366 - DNA, 18 bp, Homo sapiens
cttgccgtctacctgagg

SEQ ID NO: 4705367 - DNA, 19 bp, Homo sapiens
cttgccgtctacctgaggg

SEQ ID NO: 4705368 - DNA, 17 bp, Homo sapiens
cttgcctcggctcctgc

SEQ ID NO: 4705369 - DNA, 18 bp, Homo sapiens
cttgcctcggctcctgct

SEQ ID NO: 4705370 - DNA, 20 bp, Homo sapiens
cttgcctcggctcctgctgc

SEQ ID NO: 4705371 - DNA, 18 bp, Homo sapiens
cttgccttattagagtgt

SEQ ID NO: 4705372 - DNA, 14 bp, Homo sapiens
cttgctatcaagaa

SEQ ID NO: 4705373 - DNA, 14 bp, Homo sapiens
cttgctctgctgac

SEQ ID NO: 4705374 - DNA, 16 bp, Homo sapiens
cttgctggctgtgaaa

SEQ ID NO: 4705375 - DNA, 18 bp, Homo sapiens
cttgcttggggaacttgt

SEQ ID NO: 4705376 - DNA, 22 bp, Homo sapiens
cttgctttacaaaccaaccatt

SEQ ID NO: 4705377 - DNA, 19 bp, Homo sapiens
cttgctttcttctcctgtg

SEQ ID NO: 4705378 - DNA, 13 bp, Homo sapiens
cttggaagctccg

SEQ ID NO: 4705379 - DNA, 17 bp, Homo sapiens
cttggacattttatgtc

SEQ ID NO: 4705380 - DNA, 13 bp, Homo sapiens
cttggaggaagga

SEQ ID NO: 4705381 - DNA, 11 bp, Homo sapiens
cttggatgagg

SEQ ID NO: 4705382 - DNA, 20 bp, Homo sapiens
cttggattctctgagaaatg

SEQ ID NO: 4705383 - DNA, 14 bp, Homo sapiens
cttggattgtcccc

SEQ ID NO: 4705384 - DNA, 15 bp, Homo sapiens
cttggattgtccccg

SEQ ID NO: 4705385 - DNA, 18 bp, Homo sapiens
cttggattgtccccgacc

SEQ ID NO: 4705386 - DNA, 22 bp, Homo sapiens
cttggattgtccccgacccttg

SEQ ID NO: 4705387 - DNA, 24 bp, Homo sapiens
cttggattgtccccgacccttgcc

SEQ ID NO: 4705388 - DNA, 18 bp, Homo sapiens
cttggcacttattgaata

SEQ ID NO: 4705389 - DNA, 16 bp, Homo sapiens
cttggcatcagctggc

SEQ ID NO: 4705390 - DNA, 16 bp, Homo sapiens
cttggctggtgcacct

SEQ ID NO: 4705391 - DNA, 16 bp, Homo sapiens
cttggggccactgcct

SEQ ID NO: 4705392 - DNA, 14 bp, Homo sapiens
cttggttggctggc

SEQ ID NO: 4705393 - DNA, 16 bp, Homo sapiens
cttggttggctggcct

SEQ ID NO: 4705394 - DNA, 13 bp, Homo sapiens
cttgtaataaata

SEQ ID NO: 4705395 - DNA, 21 bp, Homo sapiens
cttgtatagcatgaaataaaa

SEQ ID NO: 4705396 - DNA, 13 bp, Homo sapiens
cttgtattaagtt

SEQ ID NO: 4705397 - DNA, 17 bp, Homo sapiens
cttgtattaagttgtta

SEQ ID NO: 4705398 - DNA, 14 bp, Homo sapiens
cttgtattgctcca

SEQ ID NO: 4705399 - DNA, 14 bp, Homo sapiens
cttgtattttgtga

SEQ ID NO: 4705400 - DNA, 20 bp, Homo sapiens
cttgtcaatggaagaaaccc

SEQ ID NO: 4705401 - DNA, 12 bp, Homo sapiens
cttgtccccaca

SEQ ID NO: 4705402 - DNA, 13 bp, Homo sapiens
cttgtccccacac

SEQ ID NO: 4705403 - DNA, 14 bp, Homo sapiens
cttgtccccacact

SEQ ID NO: 4705404 - DNA, 16 bp, Homo sapiens
cttgtccccacactcc

SEQ ID NO: 4705405 - DNA, 18 bp, Homo sapiens
cttgtccccacactccta

SEQ ID NO: 4705406 - DNA, 22 bp, Homo sapiens
cttgtgaactccatcattcatc

SEQ ID NO: 4705407 - DNA, 22 bp, Homo sapiens
cttgtgaatattgtggctccct

SEQ ID NO: 4705408 - DNA, 14 bp, Homo sapiens
cttgtgagggagag

SEQ ID NO: 4705409 - DNA, 13 bp, Homo sapiens
cttgtggacacag

SEQ ID NO: 4705410 - DNA, 16 bp, Homo sapiens
cttgtggacacagctc

SEQ ID NO: 4705411 - DNA, 21 bp, Homo sapiens
cttgtgtttctttagtttttg

SEQ ID NO: 4705412 - DNA, 21 bp, Homo sapiens
cttgttattaccaaaacagga

SEQ ID NO: 4705413 - DNA, 14 bp, Homo sapiens
cttgttcattctgt

SEQ ID NO: 4705414 - DNA, 17 bp, Homo sapiens
cttgttcattctgtgac

SEQ ID NO: 4705415 - DNA, 16 bp, Homo sapiens
cttgtttaatggtagt

SEQ ID NO: 4705416 - DNA, 14 bp, Homo sapiens
cttgttttctctgt

SEQ ID NO: 4705417 - DNA, 18 bp, Homo sapiens
ctttaaaaaaatttaagt

SEQ ID NO: 4705418 - DNA, 19 bp, Homo sapiens
ctttaaaaaaatttaagtg

SEQ ID NO: 4705419 - DNA, 20 bp, Homo sapiens
ctttaaaagacaaatcaaag

SEQ ID NO: 4705420 - DNA, 18 bp, Homo sapiens
ctttaaaaggattaatct

SEQ ID NO: 4705421 - DNA, 19 bp, Homo sapiens
ctttaaaaggattaatctg

SEQ ID NO: 4705422 - DNA, 21 bp, Homo sapiens
gaacttgtaaaggaatttaaa

SEQ ID NO: 4705423 - DNA, 12 bp, Homo sapiens
gaactttcattt

SEQ ID NO: 4705424 - DNA, 18 bp, Homo sapiens
gaagaaaataattctcta

SEQ ID NO: 4705425 - DNA, 12 bp, Homo sapiens
gaagaaacaaaa

SEQ ID NO: 4705426 - DNA, 21 bp, Homo sapiens
gaagaaacccttccacgtgta

SEQ ID NO: 4705427 - DNA, 16 bp, Homo sapiens
gaagaaccgcattttg

SEQ ID NO: 4705428 - DNA, 13 bp, Homo sapiens
gaagaacggggct

SEQ ID NO: 4705429 - DNA, 22 bp, Homo sapiens
gaagaacggggctcttctcatt

SEQ ID NO: 4705430 - DNA, 23 bp, Homo sapiens
gaagaagaattggccatcttaaa

SEQ ID NO: 4705431 - DNA, 19 bp, Homo sapiens
gaagaatgttagagtaatg

SEQ ID NO: 4705432 - DNA, 22 bp, Homo sapiens
gaagaattattcagtgaatttg

SEQ ID NO: 4705433 - DNA, 23 bp, Homo sapiens
gaagaattattcagtgaatttgt

SEQ ID NO: 4705434 - DNA, 23 bp, Homo sapiens
gaagacaatactccctttaaaga

SEQ ID NO: 4705435 - DNA, 16 bp, Homo sapiens
gaagacaccagagcag

SEQ ID NO: 4705436 - DNA, 21 bp, Homo sapiens
gaagacaccagagcagatgca

SEQ ID NO: 4705437 - DNA, 22 bp, Homo sapiens
gaagacaccagagcagatgcag

SEQ ID NO: 4705438 - DNA, 18 bp, Homo sapiens
gaagacagagacctcctg

SEQ ID NO: 4705439 - DNA, 22 bp, Homo sapiens
gaagacccattccttcccagag

SEQ ID NO: 4705440 - DNA, 21 bp, Homo sapiens
gaagaccccagatgtgagggc

SEQ ID NO: 4705441 - DNA, 17 bp, Homo sapiens
gaagactcattcttctg

SEQ ID NO: 4705442 - DNA, 14 bp, Homo sapiens
gaagactttggaaa

SEQ ID NO: 4705443 - DNA, 22 bp, Homo sapiens
gaagagcgagagatcaaagatg

SEQ ID NO: 4705444 - DNA, 18 bp, Homo sapiens
gaagagttgcatcaacaa

SEQ ID NO: 4705445 - DNA, 21 bp, Homo sapiens
gaagatataactattgcccag

SEQ ID NO: 4705446 - DNA, 19 bp, Homo sapiens
gaagatgaaaccgtccctg

SEQ ID NO: 4705447 - DNA, 20 bp, Homo sapiens
gaagatgaaaccgtccctga

SEQ ID NO: 4705448 - DNA, 14 bp, Homo sapiens
gaagattctttccc

SEQ ID NO: 4705449 - DNA, 13 bp, Homo sapiens
gaagcagctcaag

SEQ ID NO: 4705450 - DNA, 23 bp, Homo sapiens
gaagcaggctacactgacactgg

SEQ ID NO: 4705451 - DNA, 16 bp, Homo sapiens
gaagcccaggaaaggc

SEQ ID NO: 4705452 - DNA, 23 bp, Homo sapiens
gaagcccaggaaaggctccagga

SEQ ID NO: 4705453 - DNA, 14 bp, Homo sapiens
gaagccgctggggc

SEQ ID NO: 4705454 - DNA, 13 bp, Homo sapiens
gaagcctggaaca

SEQ ID NO: 4705455 - DNA, 18 bp, Homo sapiens
gaagcctttgggaagggg

SEQ ID NO: 4705456 - DNA, 16 bp, Homo sapiens
gaagctagctcccctc

SEQ ID NO: 4705457 - DNA, 17 bp, Homo sapiens
gaagctcagggcctggc

SEQ ID NO: 4705458 - DNA, 19 bp, Homo sapiens
gaagctcagggcctggctc

SEQ ID NO: 4705459 - DNA, 23 bp, Homo sapiens
gaagctcagggcctggctcaggt

SEQ ID NO: 4705460 - DNA, 19 bp, Homo sapiens
gaagctccgctttctaccc

SEQ ID NO: 4705461 - DNA, 14 bp, Homo sapiens
gaagctgcaataaa

SEQ ID NO: 4705462 - DNA, 18 bp, Homo sapiens
gaaggaaaaggcagggag

SEQ ID NO: 4705463 - DNA, 17 bp, Homo sapiens
gaaggaaacccagctct

SEQ ID NO: 4705464 - DNA, 18 bp, Homo sapiens
gaaggaaacccagctctg

SEQ ID NO: 4705465 - DNA, 19 bp, Homo sapiens
gaaggacattgcggacagc

SEQ ID NO: 4705466 - DNA, 21 bp, Homo sapiens
gaaggacattgcggacagcca

SEQ ID NO: 4705467 - DNA, 18 bp, Homo sapiens
gaaggactgtgacaggca

SEQ ID NO: 4705468 - DNA, 14 bp, Homo sapiens
gaaggagctgcctg

SEQ ID NO: 4705469 - DNA, 15 bp, Homo sapiens
gaaggagctgcctgg

SEQ ID NO: 4705470 - DNA, 17 bp, Homo sapiens
gaaggagctgcctggac

SEQ ID NO: 4705471 - DNA, 19 bp, Homo sapiens
gaaggagctgcctggaccc

SEQ ID NO: 4705472 - DNA, 14 bp, Homo sapiens
gaaggcagggaggg

SEQ ID NO: 4705473 - DNA, 14 bp, Homo sapiens
gaaggccccgccca

SEQ ID NO: 4705474 - DNA, 17 bp, Homo sapiens
gaaggccccgcccaggc

SEQ ID NO: 4705475 - DNA, 23 bp, Homo sapiens
gaaggctcttctccccagagttc

SEQ ID NO: 4705476 - DNA, 19 bp, Homo sapiens
gaaggctgggttctgatcc

SEQ ID NO: 4705477 - DNA, 19 bp, Homo sapiens
gaagggctagaacctggag

SEQ ID NO: 4705478 - DNA, 16 bp, Homo sapiens
gaaggggccagaggct

SEQ ID NO: 4705479 - DNA, 17 bp, Homo sapiens
gaaggggccagaggctc

SEQ ID NO: 4705480 - DNA, 19 bp, Homo sapiens
gaagggggtggtgtctcca

SEQ ID NO: 4705481 - DNA, 15 bp, Homo sapiens
gaagggtcatttctc

SEQ ID NO: 4705482 - DNA, 14 bp, Homo sapiens
gaaggtaattaaag

SEQ ID NO: 4705483 - DNA, 20 bp, Homo sapiens
gaaggtactgtcatgggcta

SEQ ID NO: 4705484 - DNA, 15 bp, Homo sapiens
gaaggtagaatgttt

SEQ ID NO: 4705485 - DNA, 15 bp, Homo sapiens
gaagtactttgtgct

SEQ ID NO: 4705486 - DNA, 13 bp, Homo sapiens
gaagtaggaagta

SEQ ID NO: 4705487 - DNA, 23 bp, Homo sapiens
gaagtagtggagcccctgctctg

SEQ ID NO: 4705488 - DNA, 19 bp, Homo sapiens
gaagtattagacttctaaa

SEQ ID NO: 4705489 - DNA, 13 bp, Homo sapiens
gaagtcacacagt

SEQ ID NO: 4705490 - DNA, 12 bp, Homo sapiens
gaagtctgtgtc

SEQ ID NO: 4705491 - DNA, 16 bp, Homo sapiens
gaagtgaaaaacagaa

SEQ ID NO: 4705492 - DNA, 23 bp, Homo sapiens
gaagtgatttagttgtggaaaga

SEQ ID NO: 4705493 - DNA, 12 bp, Homo sapiens
gaagttatttat

SEQ ID NO: 4705494 - DNA, 18 bp, Homo sapiens
gaagttgatatagaacag

SEQ ID NO: 4705495 - DNA, 17 bp, Homo sapiens
gaagttgattcatattg

SEQ ID NO: 4705496 - DNA, 19 bp, Homo sapiens
gaagtttgggctaacattt

SEQ ID NO: 4705497 - DNA, 20 bp, Homo sapiens
gaataatcctaaacatatga

SEQ ID NO: 4705498 - DNA, 13 bp, Homo sapiens
gaataattttatt

SEQ ID NO: 4705499 - DNA, 14 bp, Homo sapiens
gaatagctgggact

SEQ ID NO: 4705500 - DNA, 21 bp, Homo sapiens
gaatataaacactatatggca

SEQ ID NO: 4705501 - DNA, 21 bp, Homo sapiens
gaatatgattcactatttaaa

SEQ ID NO: 4705502 - DNA, 19 bp, Homo sapiens
gaatatgtagtatctatat

SEQ ID NO: 4705503 - DNA, 19 bp, Homo sapiens
gaatattggtaattaaaag

SEQ ID NO: 4705504 - DNA, 13 bp, Homo sapiens
gaatattgtccat

SEQ ID NO: 4705505 - DNA, 16 bp, Homo sapiens
gaatattgtggctccc

SEQ ID NO: 4705506 - DNA, 19 bp, Homo sapiens
gaatcacctcctgtgttgt

SEQ ID NO: 4705507 - DNA, 22 bp, Homo sapiens
gaatcatttctatttctcctcc

SEQ ID NO: 4705508 - DNA, 20 bp, Homo sapiens
gaatccaatactgcccaagg

SEQ ID NO: 4705509 - DNA, 18 bp, Homo sapiens
gaatccagacccggctgc

SEQ ID NO: 4705510 - DNA, 19 bp, Homo sapiens
gaatgaaagggcccagaga

SEQ ID NO: 4705511 - DNA, 21 bp, Homo sapiens
gaatgaaagggcccagagagg

SEQ ID NO: 4705512 - DNA, 19 bp, Homo sapiens
gaatggattggattattta

SEQ ID NO: 4705513 - DNA, 20 bp, Homo sapiens
gaatggattggattatttaa

SEQ ID NO: 4705514 - DNA, 13 bp, Homo sapiens
gaatggcaatggt

SEQ ID NO: 4705515 - DNA, 17 bp, Homo sapiens
gaatggcacagcccaaa

SEQ ID NO: 4705516 - DNA, 19 bp, Homo sapiens
gaatgggaagcagctcaag

SEQ ID NO: 4705517 - DNA, 13 bp, Homo sapiens
gaatgtaaaagaa

SEQ ID NO: 4705518 - DNA, 15 bp, Homo sapiens
gaatgtaattggaat

SEQ ID NO: 4705519 - DNA, 17 bp, Homo sapiens
gaatgtcagttgttatt

SEQ ID NO: 4705520 - DNA, 21 bp, Homo sapiens
gaatgtcagttgttatttatt

SEQ ID NO: 4705521 - DNA, 14 bp, Homo sapiens
gaatgtgattttaa

SEQ ID NO: 4705522 - DNA, 23 bp, Homo sapiens
gaatgtggaaaacatcctgactt

SEQ ID NO: 4705523 - DNA, 17 bp, Homo sapiens
gaatgtttgcctctgcc

SEQ ID NO: 4705524 - DNA, 17 bp, Homo sapiens
gaatgttttcaaatgtt

SEQ ID NO: 4705525 - DNA, 14 bp, Homo sapiens
gaattacatatgaa

SEQ ID NO: 4705526 - DNA, 19 bp, Homo sapiens
gaattattcagtgaatttg

SEQ ID NO: 4705527 - DNA, 16 bp, Homo sapiens
gaattattttgttact

SEQ ID NO: 4705528 - DNA, 19 bp, Homo sapiens
gaattctaattgtcagtga

SEQ ID NO: 4705529 - DNA, 20 bp, Homo sapiens
gaattcttggttgaggaaac

SEQ ID NO: 4705530 - DNA, 16 bp, Homo sapiens
gaattggccatcttaa

SEQ ID NO: 4705531 - DNA, 14 bp, Homo sapiens
gagactcctgcagg

SEQ ID NO: 4705532 - DNA, 15 bp, Homo sapiens
gagactcctgcaggc

SEQ ID NO: 4705533 - DNA, 16 bp, Homo sapiens
gagactcctgcaggca

SEQ ID NO: 4705534 - DNA, 17 bp, Homo sapiens
gagactcgagaactttc

SEQ ID NO: 4705535 - DNA, 18 bp, Homo sapiens
gagactctgtttgcttgt

SEQ ID NO: 4705536 - DNA, 13 bp, Homo sapiens
gagactgggctga

SEQ ID NO: 4705537 - DNA, 15 bp, Homo sapiens
gagactgggctgagg

SEQ ID NO: 4705538 - DNA, 17 bp, Homo sapiens
gagactgggctgaggga

SEQ ID NO: 4705539 - DNA, 14 bp, Homo sapiens
gagactgtttggaa

SEQ ID NO: 4705540 - DNA, 16 bp, Homo sapiens
gagactgtttggaaat

SEQ ID NO: 4705541 - DNA, 15 bp, Homo sapiens
gagacttggatgagg

SEQ ID NO: 4705542 - DNA, 14 bp, Homo sapiens
gagagatcaaagat

SEQ ID NO: 4705543 - DNA, 22 bp, Homo sapiens
gagagatgtgtgttgatactgt

SEQ ID NO: 4705544 - DNA, 18 bp, Homo sapiens
gagagcagcttctgccac

SEQ ID NO: 4705545 - DNA, 15 bp, Homo sapiens
gagagcatgtgaggg

SEQ ID NO: 4705546 - DNA, 14 bp, Homo sapiens
gagagccattttgt

SEQ ID NO: 4705547 - DNA, 17 bp, Homo sapiens
gagagccattttgtgaa

SEQ ID NO: 4705548 - DNA, 16 bp, Homo sapiens
gagagccttccagggg

SEQ ID NO: 4705549 - DNA, 18 bp, Homo sapiens
gagagctagaacctggag

SEQ ID NO: 4705550 - DNA, 19 bp, Homo sapiens
gagagctagaacctggagg

SEQ ID NO: 4705551 - DNA, 13 bp, Homo sapiens
gagagctgggctt

SEQ ID NO: 4705552 - DNA, 22 bp, Homo sapiens
gagagcttctgttgctgcctca

SEQ ID NO: 4705553 - DNA, 18 bp, Homo sapiens
gagaggagggatgcaact

SEQ ID NO: 4705554 - DNA, 16 bp, Homo sapiens
gagaggatgagagccc

SEQ ID NO: 4705555 - DNA, 20 bp, Homo sapiens
gagaggatgagagcccagag

SEQ ID NO: 4705556 - DNA, 16 bp, Homo sapiens
gagagggcaggcatga

SEQ ID NO: 4705557 - DNA, 12 bp, Homo sapiens
gagaggggacgc

SEQ ID NO: 4705558 - DNA, 16 bp, Homo sapiens
gagaggggacgcaggc

SEQ ID NO: 4705559 - DNA, 19 bp, Homo sapiens
gagaggggacgcaggcccc

SEQ ID NO: 4705560 - DNA, 20 bp, Homo sapiens
gagaggggacgcaggcccct

SEQ ID NO: 4705561 - DNA, 21 bp, Homo sapiens
gagaggggacgcaggcccctc

SEQ ID NO: 4705562 - DNA, 21 bp, Homo sapiens
gagagggtgggagtgggccca

SEQ ID NO: 4705563 - DNA, 15 bp, Homo sapiens
gagagtgggggtggg

SEQ ID NO: 4705564 - DNA, 15 bp, Homo sapiens
gagataccagcgagg

SEQ ID NO: 4705565 - DNA, 22 bp, Homo sapiens
gagatatttaaaagacaaacac

SEQ ID NO: 4705566 - DNA, 15 bp, Homo sapiens
gagatcaaagatgaa

SEQ ID NO: 4705567 - DNA, 20 bp, Homo sapiens
gagatcaaagatgaaaagta

SEQ ID NO: 4705568 - DNA, 18 bp, Homo sapiens
gagatcacgccactgcac

SEQ ID NO: 4705569 - DNA, 21 bp, Homo sapiens
gagatgaaatcttacagctgg

SEQ ID NO: 4705570 - DNA, 16 bp, Homo sapiens
gagatgtctctgtgtg

SEQ ID NO: 4705571 - DNA, 20 bp, Homo sapiens
gagatttcatctgctctcct

SEQ ID NO: 4705572 - DNA, 21 bp, Homo sapiens
gagatttcatctgctctcctt

SEQ ID NO: 4705573 - DNA, 22 bp, Homo sapiens
gagatttcatctgctctccttc

SEQ ID NO: 4705574 - DNA, 23 bp, Homo sapiens
gagatttcatctgctctccttcc

SEQ ID NO: 4705575 - DNA, 22 bp, Homo sapiens
gagcaaagaaacttgtgcttta

SEQ ID NO: 4705576 - DNA, 22 bp, Homo sapiens
gagcaagacgctgtgctgccct

SEQ ID NO: 4705577 - DNA, 23 bp, Homo sapiens
gagcaagacgctgtgctgccctg

SEQ ID NO: 4705578 - DNA, 18 bp, Homo sapiens
gagcacacttggcccaag

SEQ ID NO: 4705579 - DNA, 14 bp, Homo sapiens
gagcacatgttcat

SEQ ID NO: 4705580 - DNA, 15 bp, Homo sapiens
gagcacatgttcata

SEQ ID NO: 4705581 - DNA, 14 bp, Homo sapiens
gagcacctccacat

SEQ ID NO: 4705582 - DNA, 19 bp, Homo sapiens
gagcaccttagacagtccc

SEQ ID NO: 4705583 - DNA, 15 bp, Homo sapiens
gagcactaaggtgtg

SEQ ID NO: 4705584 - DNA, 18 bp, Homo sapiens
gagcagaatactggtctc

SEQ ID NO: 4705585 - DNA, 12 bp, Homo sapiens
gagcagagacca

SEQ ID NO: 4705586 - DNA, 19 bp, Homo sapiens
gagcagagaccatccctga

SEQ ID NO: 4705587 - DNA, 21 bp, Homo sapiens
gagcagggctcagcggggaca

SEQ ID NO: 4705588 - DNA, 16 bp, Homo sapiens
gagcagtgcaggcaca

SEQ ID NO: 4705589 - DNA, 17 bp, Homo sapiens
gagcagtttctgtcctg

SEQ ID NO: 4705590 - DNA, 16 bp, Homo sapiens
gagcatcaggccaggc

SEQ ID NO: 4705591 - DNA, 14 bp, Homo sapiens
gagcatccacctcc

SEQ ID NO: 4705592 - DNA, 23 bp, Homo sapiens
gagcatctccagcattctcagcc

SEQ ID NO: 4705593 - DNA, 22 bp, Homo sapiens
gagcatgcattttcttgtatga

SEQ ID NO: 4705594 - DNA, 15 bp, Homo sapiens
gagcatggagctggc

SEQ ID NO: 4705595 - DNA, 16 bp, Homo sapiens
gagcatggctgtgagg

SEQ ID NO: 4705596 - DNA, 14 bp, Homo sapiens
gagcatgtgagggg

SEQ ID NO: 4705597 - DNA, 20 bp, Homo sapiens
gagccaatccactccttcct

SEQ ID NO: 4705598 - DNA, 15 bp, Homo sapiens
gagccactcctctga

SEQ ID NO: 4705599 - DNA, 13 bp, Homo sapiens
gagccactgcacc

SEQ ID NO: 4705600 - DNA, 18 bp, Homo sapiens
gagccactgcaccgggcc

SEQ ID NO: 4705601 - DNA, 19 bp, Homo sapiens
gagccagggtctcactatg

SEQ ID NO: 4705602 - DNA, 20 bp, Homo sapiens
gagccatttatacctttgaa

SEQ ID NO: 4705603 - DNA, 14 bp, Homo sapiens
gagcccaagggaat

SEQ ID NO: 4705604 - DNA, 21 bp, Homo sapiens
gagcccagaggtaacagaaca

SEQ ID NO: 4705605 - DNA, 22 bp, Homo sapiens
gagcccagaggtaacagaacag

SEQ ID NO: 4705606 - DNA, 23 bp, Homo sapiens
gagcccagaggtaacagaacagc

SEQ ID NO: 4705607 - DNA, 13 bp, Homo sapiens
gagcccaggagct

SEQ ID NO: 4705608 - DNA, 17 bp, Homo sapiens
gagcccaggagctcccc

SEQ ID NO: 4705609 - DNA, 24 bp, Homo sapiens
gagcccaggccaggactctgcagc

SEQ ID NO: 4705610 - DNA, 17 bp, Homo sapiens
gagccccattcctggga

SEQ ID NO: 4705611 - DNA, 13 bp, Homo sapiens
gagccccgaggcc

SEQ ID NO: 4705612 - DNA, 14 bp, Homo sapiens
gagccccgaggcct

SEQ ID NO: 4705613 - DNA, 14 bp, Homo sapiens
gagccctggtggca

SEQ ID NO: 4705614 - DNA, 16 bp, Homo sapiens
gagccctggtggcagt

SEQ ID NO: 4705615 - DNA, 18 bp, Homo sapiens
gagccctggtggcagtgg

SEQ ID NO: 4705616 - DNA, 19 bp, Homo sapiens
gagccgagatcacgccact

SEQ ID NO: 4705617 - DNA, 20 bp, Homo sapiens
gagccgagatcacgccactg

SEQ ID NO: 4705618 - DNA, 16 bp, Homo sapiens
gagccggcactgcatg

SEQ ID NO: 4705619 - DNA, 22 bp, Homo sapiens
gagccgggtctgcctcttctgg

SEQ ID NO: 4705620 - DNA, 17 bp, Homo sapiens
gagccgtggtcctttgg

SEQ ID NO: 4705621 - DNA, 19 bp, Homo sapiens
gagcctcagtctccctccc

SEQ ID NO: 4705622 - DNA, 21 bp, Homo sapiens
gagcctccctcaattccccct

SEQ ID NO: 4705623 - DNA, 14 bp, Homo sapiens
gagcctggtgccct

SEQ ID NO: 4705624 - DNA, 14 bp, Homo sapiens
gagccttccagggg

SEQ ID NO: 4705625 - DNA, 15 bp, Homo sapiens
gagccttccaggggt

SEQ ID NO: 4705626 - DNA, 23 bp, Homo sapiens
gagccttccaggggtgggacacc

SEQ ID NO: 4705627 - DNA, 17 bp, Homo sapiens
gagcgagagatcaaaga

SEQ ID NO: 4705628 - DNA, 20 bp, Homo sapiens
gagcgagagatcaaagatga

SEQ ID NO: 4705629 - DNA, 22 bp, Homo sapiens
gagcgctcctgccgcagagctg

SEQ ID NO: 4705630 - DNA, 21 bp, Homo sapiens
gagcgggctcgaagaaaataa

SEQ ID NO: 4705631 - DNA, 22 bp, Homo sapiens
gagcgggctcgaagaaaataat

SEQ ID NO: 4705632 - DNA, 14 bp, Homo sapiens
gagcgtgattctgt

SEQ ID NO: 4705633 - DNA, 17 bp, Homo sapiens
gagcgtgcgtctgtgtg

SEQ ID NO: 4705634 - DNA, 12 bp, Homo sapiens
gagctacaaatg

SEQ ID NO: 4705635 - DNA, 15 bp, Homo sapiens
gagctacttcttatt

SEQ ID NO: 4705636 - DNA, 17 bp, Homo sapiens
gagctagaacctggagg

SEQ ID NO: 4705637 - DNA, 18 bp, Homo sapiens
gagctagaagctggagga

SEQ ID NO: 4705638 - DNA, 19 bp, Homo sapiens
gagctctatgggcagatct

SEQ ID NO: 4705639 - DNA, 23 bp, Homo sapiens
gagctgacacaaacctgcctggg

SEQ ID NO: 4705640 - DNA, 22 bp, Homo sapiens
gagtgagacccagccctcatcc

SEQ ID NO: 4705641 - DNA, 18 bp, Homo sapiens
gagtgagacccaggagcc

SEQ ID NO: 4705642 - DNA, 17 bp, Homo sapiens
gagtgcaggcctgctca

SEQ ID NO: 4705643 - DNA, 12 bp, Homo sapiens
gagtgcagtgag

SEQ ID NO: 4705644 - DNA, 13 bp, Homo sapiens
gagtgcagtgagc

SEQ ID NO: 4705645 - DNA, 15 bp, Homo sapiens
gagtgcgtggtgcga

SEQ ID NO: 4705646 - DNA, 12 bp, Homo sapiens
gagtgggcccaa

SEQ ID NO: 4705647 - DNA, 13 bp, Homo sapiens
gagtgggggtggg

SEQ ID NO: 4705648 - DNA, 19 bp, Homo sapiens
gagtggtggaggaggacac

SEQ ID NO: 4705649 - DNA, 11 bp, Homo sapiens
gagtgtagaag

SEQ ID NO: 4705650 - DNA, 14 bp, Homo sapiens
gagtgtagaagcat

SEQ ID NO: 4705651 - DNA, 15 bp, Homo sapiens
gagtgtctttccacg

SEQ ID NO: 4705652 - DNA, 21 bp, Homo sapiens
gagtgtctttccacggagcca

SEQ ID NO: 4705653 - DNA, 14 bp, Homo sapiens
gagttaagaagctg

SEQ ID NO: 4705654 - DNA, 12 bp, Homo sapiens
gagttctttgca

SEQ ID NO: 4705655 - DNA, 21 bp, Homo sapiens
gagttgaaaatcttataattt

SEQ ID NO: 4705656 - DNA, 23 bp, Homo sapiens
gagttgacttgacagaacactgt

SEQ ID NO: 4705657 - DNA, 21 bp, Homo sapiens
gagttgatagcacagaccctg

SEQ ID NO: 4705658 - DNA, 19 bp, Homo sapiens
gagttgcaccattctttct

SEQ ID NO: 4705659 - DNA, 15 bp, Homo sapiens
gagtttggtccctgg

SEQ ID NO: 4705660 - DNA, 16 bp, Homo sapiens
gataaataactttttt

SEQ ID NO: 4705661 - DNA, 15 bp, Homo sapiens
gataaatttgttgaa

SEQ ID NO: 4705662 - DNA, 18 bp, Homo sapiens
gataatacagatttgtaa

SEQ ID NO: 4705663 - DNA, 22 bp, Homo sapiens
gataatacagatttgtaacatt

SEQ ID NO: 4705664 - DNA, 18 bp, Homo sapiens
gataatattgtggtgcca

SEQ ID NO: 4705665 - DNA, 16 bp, Homo sapiens
gataatcttttacatt

SEQ ID NO: 4705666 - DNA, 13 bp, Homo sapiens
gataatgttaaat

SEQ ID NO: 4705667 - DNA, 11 bp, Homo sapiens
gataatttttt

SEQ ID NO: 4705668 - DNA, 14 bp, Homo sapiens
gatacaagagtcag

SEQ ID NO: 4705669 - DNA, 18 bp, Homo sapiens
gatacagtcaacaagcct

SEQ ID NO: 4705670 - DNA, 13 bp, Homo sapiens
gatacgtgtatga

SEQ ID NO: 4705671 - DNA, 12 bp, Homo sapiens
gatactgttgca

SEQ ID NO: 4705672 - DNA, 14 bp, Homo sapiens
gatactgttgcacg

SEQ ID NO: 4705673 - DNA, 16 bp, Homo sapiens
gatactgttgcacgtg

SEQ ID NO: 4705674 - DNA, 19 bp, Homo sapiens
gatactgttgcacgtgtgt

SEQ ID NO: 4705675 - DNA, 21 bp, Homo sapiens
gatagacagtaacggtgttta

SEQ ID NO: 4705676 - DNA, 19 bp, Homo sapiens
gatagcacagaccctgccc

SEQ ID NO: 4705677 - DNA, 16 bp, Homo sapiens
gatagtattgtgcata

SEQ ID NO: 4705678 - DNA, 22 bp, Homo sapiens
gatatcatgcttggttttcttt

SEQ ID NO: 4705679 - DNA, 15 bp, Homo sapiens
gatatgaaaaataaa

SEQ ID NO: 4705680 - DNA, 14 bp, Homo sapiens
gatatggcagaaga

SEQ ID NO: 4705681 - DNA, 16 bp, Homo sapiens
gatatttatgtatctt

SEQ ID NO: 4705682 - DNA, 14 bp, Homo sapiens
gatatttgcattga

SEQ ID NO: 4705683 - DNA, 15 bp, Homo sapiens
gatcaaagatgaaaa

SEQ ID NO: 4705684 - DNA, 13 bp, Homo sapiens
gatcacaaaaaca

SEQ ID NO: 4705685 - DNA, 16 bp, Homo sapiens
gatcacgccactgcac

SEQ ID NO: 4705686 - DNA, 18 bp, Homo sapiens
gatcacgccactgcacta

SEQ ID NO: 4705687 - DNA, 16 bp, Homo sapiens
gatcagagccgtggtc

SEQ ID NO: 4705688 - DNA, 23 bp, Homo sapiens
gatcagagccgtggtcctttggg

SEQ ID NO: 4705689 - DNA, 16 bp, Homo sapiens
gatcaggcagtgttta

SEQ ID NO: 4705690 - DNA, 19 bp, Homo sapiens
gatcatccactgtgccatg

SEQ ID NO: 4705691 - DNA, 21 bp, Homo sapiens
gatcatccactgtgccatgtg

SEQ ID NO: 4705692 - DNA, 14 bp, Homo sapiens
gatcatggtgtaat

SEQ ID NO: 4705693 - DNA, 20 bp, Homo sapiens
gatcatggtgtaataagaca

SEQ ID NO: 4705694 - DNA, 16 bp, Homo sapiens
gatccaagctggtccc

SEQ ID NO: 4705695 - DNA, 19 bp, Homo sapiens
gatccaagctggtcccact

SEQ ID NO: 4705696 - DNA, 21 bp, Homo sapiens
gatccaataattttcctgtga

SEQ ID NO: 4705697 - DNA, 19 bp, Homo sapiens
gatccacccacctcagcct

SEQ ID NO: 4705698 - DNA, 20 bp, Homo sapiens
gatccacccacctcagcctc

SEQ ID NO: 4705699 - DNA, 17 bp, Homo sapiens
gatcccaacatggtcct

SEQ ID NO: 4705700 - DNA, 14 bp, Homo sapiens
gatccctcatctgt

SEQ ID NO: 4705701 - DNA, 14 bp, Homo sapiens
gatccctctctgga

SEQ ID NO: 4705702 - DNA, 14 bp, Homo sapiens
gatcctccaggtgc

SEQ ID NO: 4705703 - DNA, 16 bp, Homo sapiens
gatcctcccacctcag

SEQ ID NO: 4705704 - DNA, 16 bp, Homo sapiens
gatccttccacctcag

SEQ ID NO: 4705705 - DNA, 15 bp, Homo sapiens
gatccttttggagtc

SEQ ID NO: 4705706 - DNA, 17 bp, Homo sapiens
gatccttttggagtcag

SEQ ID NO: 4705707 - DNA, 22 bp, Homo sapiens
gatcggccatcaagggaagaac

SEQ ID NO: 4705708 - DNA, 14 bp, Homo sapiens
gatctaggaagact

SEQ ID NO: 4705709 - DNA, 18 bp, Homo sapiens
gatctctattatatcttg

SEQ ID NO: 4705710 - DNA, 18 bp, Homo sapiens
gatctgctagtgctgtaa

SEQ ID NO: 4705711 - DNA, 21 bp, Homo sapiens
gatctgttgcaaactcagcct

SEQ ID NO: 4705712 - DNA, 13 bp, Homo sapiens
gatctttggacag

SEQ ID NO: 4705713 - DNA, 21 bp, Homo sapiens
gatgaaaagtatattgataac

SEQ ID NO: 4705714 - DNA, 19 bp, Homo sapiens
gatgaaaataaagaatgga

SEQ ID NO: 4705715 - DNA, 21 bp, Homo sapiens
gatgaaatgaggtcagagcct

SEQ ID NO: 4705716 - DNA, 13 bp, Homo sapiens
gatgaataaaata

SEQ ID NO: 4705717 - DNA, 20 bp, Homo sapiens
gatgacaactggaatagttt

SEQ ID NO: 4705718 - DNA, 18 bp, Homo sapiens
gatgactggttgttcaaa

SEQ ID NO: 4705719 - DNA, 11 bp, Homo sapiens
gatgagaaagg

SEQ ID NO: 4705720 - DNA, 17 bp, Homo sapiens
gatgagcatcccaggat

SEQ ID NO: 4705721 - DNA, 16 bp, Homo sapiens
gatgagcatggagctg

SEQ ID NO: 4705722 - DNA, 17 bp, Homo sapiens
gatgagcatggagctgg

SEQ ID NO: 4705723 - DNA, 13 bp, Homo sapiens
gatgaggcagagg

SEQ ID NO: 4705724 - DNA, 19 bp, Homo sapiens
gatgaggccctccacacct

SEQ ID NO: 4705725 - DNA, 13 bp, Homo sapiens
gatgcaccagccc

SEQ ID NO: 4705726 - DNA, 23 bp, Homo sapiens
gatgcaccagcccttagcaggga

SEQ ID NO: 4705727 - DNA, 23 bp, Homo sapiens
gatgcagagagccattttgtgaa

SEQ ID NO: 4705728 - DNA, 16 bp, Homo sapiens
gatgcagcattatgat

SEQ ID NO: 4705729 - DNA, 20 bp, Homo sapiens
gatgcatgttttccagctcc

SEQ ID NO: 4705730 - DNA, 21 bp, Homo sapiens
gatgcatgttttccagctcct

SEQ ID NO: 4705731 - DNA, 15 bp, Homo sapiens
gatgccacaccaagc

SEQ ID NO: 4705732 - DNA, 22 bp, Homo sapiens
gatgcctgattgccaagctcag

SEQ ID NO: 4705733 - DNA, 17 bp, Homo sapiens
gatgcctggtggcagct

SEQ ID NO: 4705734 - DNA, 18 bp, Homo sapiens
gatgcctggtggcagctg

SEQ ID NO: 4705735 - DNA, 20 bp, Homo sapiens
gatgcctggtggcagctgcg

SEQ ID NO: 4705736 - DNA, 13 bp, Homo sapiens
gatgctccttggg

SEQ ID NO: 4705737 - DNA, 14 bp, Homo sapiens
gatgctccttgggc

SEQ ID NO: 4705738 - DNA, 16 bp, Homo sapiens
gatgctccttgggccc

SEQ ID NO: 4705739 - DNA, 11 bp, Homo sapiens
gatgctgggat

SEQ ID NO: 4705740 - DNA, 13 bp, Homo sapiens
gatgctgggctgg

SEQ ID NO: 4705741 - DNA, 20 bp, Homo sapiens
gatggcctggccagggcctg

SEQ ID NO: 4705742 - DNA, 21 bp, Homo sapiens
gatgggcaacccccagcctgc

SEQ ID NO: 4705743 - DNA, 22 bp, Homo sapiens
gatgggcaacccccagcctgct

SEQ ID NO: 4705744 - DNA, 13 bp, Homo sapiens
gatggggccctgc

SEQ ID NO: 4705745 - DNA, 24 bp, Homo sapiens
gatggggccctgcctcctttgtga

SEQ ID NO: 4705746 - DNA, 16 bp, Homo sapiens
gatggggctgagcagg

SEQ ID NO: 4705747 - DNA, 19 bp, Homo sapiens
gatggggctgcaccggctg

SEQ ID NO: 4705748 - DNA, 21 bp, Homo sapiens
gatgggggaaagcacaggtgg

SEQ ID NO: 4705749 - DNA, 15 bp, Homo sapiens
gatgggggctctgca

SEQ ID NO: 4705750 - DNA, 17 bp, Homo sapiens
gcagcatattcaggaag

SEQ ID NO: 4705751 - DNA, 12 bp, Homo sapiens
gcagccaggcca

SEQ ID NO: 4705752 - DNA, 16 bp, Homo sapiens
gcagccaggccacaag

SEQ ID NO: 4705753 - DNA, 12 bp, Homo sapiens
gcagccagggag

SEQ ID NO: 4705754 - DNA, 15 bp, Homo sapiens
gcagccagggagagc

SEQ ID NO: 4705755 - DNA, 19 bp, Homo sapiens
gcagccagggagagcccag

SEQ ID NO: 4705756 - DNA, 21 bp, Homo sapiens
gcagccccattctgcctgccc

SEQ ID NO: 4705757 - DNA, 10 bp, Homo sapiens
gcagccctcc

SEQ ID NO: 4705758 - DNA, 13 bp, Homo sapiens
gcagccctcctta

SEQ ID NO: 4705759 - DNA, 21 bp, Homo sapiens
gcagccctgctgctgcctgcc

SEQ ID NO: 4705760 - DNA, 21 bp, Homo sapiens
gcagcctcaacctcctgggct

SEQ ID NO: 4705761 - DNA, 22 bp, Homo sapiens
gcagcctcaacctcctgggcta

SEQ ID NO: 4705762 - DNA, 14 bp, Homo sapiens
gcagcctgagaatg

SEQ ID NO: 4705763 - DNA, 17 bp, Homo sapiens
gcagcgctagtggaggg

SEQ ID NO: 4705764 - DNA, 20 bp, Homo sapiens
gcagctcacctctcccttgg

SEQ ID NO: 4705765 - DNA, 19 bp, Homo sapiens
gcagctcatctctgtccca

SEQ ID NO: 4705766 - DNA, 18 bp, Homo sapiens
gcagctggactgctgctg

SEQ ID NO: 4705767 - DNA, 12 bp, Homo sapiens
gcagctggcaga

SEQ ID NO: 4705768 - DNA, 21 bp, Homo sapiens
gcagctgtggtacaaatgtga

SEQ ID NO: 4705769 - DNA, 14 bp, Homo sapiens
gcagcttctgccac

SEQ ID NO: 4705770 - DNA, 15 bp, Homo sapiens
gcagcttctgccact

SEQ ID NO: 4705771 - DNA, 18 bp, Homo sapiens
gcagcttctgccacttcc

SEQ ID NO: 4705772 - DNA, 19 bp, Homo sapiens
gcagcttgagggttgggct

SEQ ID NO: 4705773 - DNA, 22 bp, Homo sapiens
gcaggaagatgtatgctttgaa

SEQ ID NO: 4705774 - DNA, 15 bp, Homo sapiens
gcaggaaggagctgc

SEQ ID NO: 4705775 - DNA, 23 bp, Homo sapiens
gcaggaaggagctgcctggaccc

SEQ ID NO: 4705776 - DNA, 18 bp, Homo sapiens
gcaggaggggggctgggt

SEQ ID NO: 4705777 - DNA, 16 bp, Homo sapiens
gcaggatggcctggcc

SEQ ID NO: 4705778 - DNA, 13 bp, Homo sapiens
gcaggcacagcac

SEQ ID NO: 4705779 - DNA, 15 bp, Homo sapiens
gcaggcacagcacag

SEQ ID NO: 4705780 - DNA, 17 bp, Homo sapiens
gcaggcagccaggccac

SEQ ID NO: 4705781 - DNA, 18 bp, Homo sapiens
gcaggcatggctggtgcc

SEQ ID NO: 4705782 - DNA, 14 bp, Homo sapiens
gcaggcccctctcc

SEQ ID NO: 4705783 - DNA, 17 bp, Homo sapiens
gcaggcccctctcctcc

SEQ ID NO: 4705784 - DNA, 18 bp, Homo sapiens
gcaggcccctctcctccg

SEQ ID NO: 4705785 - DNA, 23 bp, Homo sapiens
gcaggcccctctcctccgtggca

SEQ ID NO: 4705786 - DNA, 14 bp, Homo sapiens
gcaggccctgcact

SEQ ID NO: 4705787 - DNA, 18 bp, Homo sapiens
gcaggccctgcactgtcc

SEQ ID NO: 4705788 - DNA, 21 bp, Homo sapiens
gcaggcctgccttctcaggga

SEQ ID NO: 4705789 - DNA, 20 bp, Homo sapiens
gcaggctaaggcgtggagct

SEQ ID NO: 4705790 - DNA, 17 bp, Homo sapiens
gcaggctggccctgccc

SEQ ID NO: 4705791 - DNA, 19 bp, Homo sapiens
gcaggctggccctgccctg

SEQ ID NO: 4705792 - DNA, 20 bp, Homo sapiens
gcaggctggccctgccctgg

SEQ ID NO: 4705793 - DNA, 22 bp, Homo sapiens
gcagggaaacagctaatgggac

SEQ ID NO: 4705794 - DNA, 13 bp, Homo sapiens
gcagggagggcct

SEQ ID NO: 4705795 - DNA, 17 bp, Homo sapiens
gcagggagggcctgggc

SEQ ID NO: 4705796 - DNA, 21 bp, Homo sapiens
gcagggccccaggcattgcca

SEQ ID NO: 4705797 - DNA, 17 bp, Homo sapiens
gcagggctaccctgagc

SEQ ID NO: 4705798 - DNA, 14 bp, Homo sapiens
gcagggctcagcgg

SEQ ID NO: 4705799 - DNA, 20 bp, Homo sapiens
gcagggtctgggcaggactc

SEQ ID NO: 4705800 - DNA, 19 bp, Homo sapiens
gcaggtcttgaactcctgg

SEQ ID NO: 4705801 - DNA, 20 bp, Homo sapiens
gcaggtcttgaactcctggc

SEQ ID NO: 4705802 - DNA, 22 bp, Homo sapiens
gcaggtgctgctaccctccctg

SEQ ID NO: 4705803 - DNA, 23 bp, Homo sapiens
gcaggtgctgctaccctccctgc

SEQ ID NO: 4705804 - DNA, 17 bp, Homo sapiens
gcaggtggggagactgg

SEQ ID NO: 4705805 - DNA, 21 bp, Homo sapiens
gcaggtggggagactgggctg

SEQ ID NO: 4705806 - DNA, 16 bp, Homo sapiens
gcaggttagaacctag

SEQ ID NO: 4705807 - DNA, 23 bp, Homo sapiens
gcaggttgggccatactggcctc

SEQ ID NO: 4705808 - DNA, 12 bp, Homo sapiens
gcagtacatcaa

SEQ ID NO: 4705809 - DNA, 20 bp, Homo sapiens
gcagtgaatgattcagtgtt

SEQ ID NO: 4705810 - DNA, 16 bp, Homo sapiens
gcagtgatatggcaga

SEQ ID NO: 4705811 - DNA, 19 bp, Homo sapiens
gcagtgatatggcagaaga

SEQ ID NO: 4705812 - DNA, 21 bp, Homo sapiens
gcagtgatatggcagaagaca

SEQ ID NO: 4705813 - DNA, 14 bp, Homo sapiens
gcagtgggaaaaat

SEQ ID NO: 4705814 - DNA, 12 bp, Homo sapiens
gcagtgggagct

SEQ ID NO: 4705815 - DNA, 11 bp, Homo sapiens
gcagtgggtcc

SEQ ID NO: 4705816 - DNA, 18 bp, Homo sapiens
gcagtgggtcccacttcc

SEQ ID NO: 4705817 - DNA, 22 bp, Homo sapiens
gcagtgggtcccacttcccctc

SEQ ID NO: 4705818 - DNA, 23 bp, Homo sapiens
gcagtgggtcccacttcccctcc

SEQ ID NO: 4705819 - DNA, 18 bp, Homo sapiens
gcagtggtgtggagaagc

SEQ ID NO: 4705820 - DNA, 21 bp, Homo sapiens
gcagtgtgaggccagggcaga

SEQ ID NO: 4705821 - DNA, 16 bp, Homo sapiens
gcagtttctgtcctgc

SEQ ID NO: 4705822 - DNA, 16 bp, Homo sapiens
gcataaagtaaataca

SEQ ID NO: 4705823 - DNA, 13 bp, Homo sapiens
gcataaatatgca

SEQ ID NO: 4705824 - DNA, 15 bp, Homo sapiens
gcataaatatgcagt

SEQ ID NO: 4705825 - DNA, 16 bp, Homo sapiens
gcataacaattcctct

SEQ ID NO: 4705826 - DNA, 20 bp, Homo sapiens
gcataatttaaaaatatatt

SEQ ID NO: 4705827 - DNA, 20 bp, Homo sapiens
gcatacaagtttcattctcc

SEQ ID NO: 4705828 - DNA, 17 bp, Homo sapiens
gcataggaggggtctgg

SEQ ID NO: 4705829 - DNA, 16 bp, Homo sapiens
gcatattataaaggat

SEQ ID NO: 4705830 - DNA, 15 bp, Homo sapiens
gcatattcaggaagc

SEQ ID NO: 4705831 - DNA, 18 bp, Homo sapiens
gcatattcaggaagctca

SEQ ID NO: 4705832 - DNA, 20 bp, Homo sapiens
gcatattcaggaagctcagg

SEQ ID NO: 4705833 - DNA, 19 bp, Homo sapiens
gcatatttgcaaagtgtat

SEQ ID NO: 4705834 - DNA, 12 bp, Homo sapiens
gcatcaaacatg

SEQ ID NO: 4705835 - DNA, 22 bp, Homo sapiens
gcatcaaacatgaaaacattga

SEQ ID NO: 4705836 - DNA, 15 bp, Homo sapiens
gcatcaggccaggcc

SEQ ID NO: 4705837 - DNA, 17 bp, Homo sapiens
gcatcaggccaggccct

SEQ ID NO: 4705838 - DNA, 15 bp, Homo sapiens
gcatccacctccttc

SEQ ID NO: 4705839 - DNA, 22 bp, Homo sapiens
gcatccctttttcataaattat

SEQ ID NO: 4705840 - DNA, 17 bp, Homo sapiens
gcatcctggcacccggc

SEQ ID NO: 4705841 - DNA, 18 bp, Homo sapiens
gcatcgtgatcactgagc

SEQ ID NO: 4705842 - DNA, 20 bp, Homo sapiens
gcatctaattcttattttta

SEQ ID NO: 4705843 - DNA, 18 bp, Homo sapiens
gcatctggtgtaggaagt

SEQ ID NO: 4705844 - DNA, 19 bp, Homo sapiens
gcatctggtgtaggaagtt

SEQ ID NO: 4705845 - DNA, 18 bp, Homo sapiens
gcatgaaataaaatatat

SEQ ID NO: 4705846 - DNA, 12 bp, Homo sapiens
gcatgacccagt

SEQ ID NO: 4705847 - DNA, 15 bp, Homo sapiens
gcatgccccctcgtg

SEQ ID NO: 4705848 - DNA, 18 bp, Homo sapiens
gcatgccccctcgtgcca

SEQ ID NO: 4705849 - DNA, 17 bp, Homo sapiens
gcatgcccttcctttct

SEQ ID NO: 4705850 - DNA, 14 bp, Homo sapiens
gcatgcctggatgg

SEQ ID NO: 4705851 - DNA, 19 bp, Homo sapiens
gcatgcgattatctaccca

SEQ ID NO: 4705852 - DNA, 23 bp, Homo sapiens
gcatggaaattcccttcatctgg

SEQ ID NO: 4705853 - DNA, 18 bp, Homo sapiens
gcatggcatcacctccac

SEQ ID NO: 4705854 - DNA, 22 bp, Homo sapiens
gcatggccctgctgcccctccc

SEQ ID NO: 4705855 - DNA, 22 bp, Homo sapiens
gcatgtaaaatcttcagctggt

SEQ ID NO: 4705856 - DNA, 23 bp, Homo sapiens
gcatgtaaaatcttcagctggtg

SEQ ID NO: 4705857 - DNA, 14 bp, Homo sapiens
gcatgttctctgag

SEQ ID NO: 4705858 - DNA, 22 bp, Homo sapiens
gcatgttctctgaggacactaa

SEQ ID NO: 4705859 - DNA, 24 bp, Homo sapiens
gccccctgcaggaaggagctgcct

SEQ ID NO: 4705860 - DNA, 22 bp, Homo sapiens
gccccgaggccttctctgaagg

SEQ ID NO: 4705861 - DNA, 23 bp, Homo sapiens
gccccgaggccttctctgaagga

SEQ ID NO: 4705862 - DNA, 17 bp, Homo sapiens
gccccgtccccctctgg

SEQ ID NO: 4705863 - DNA, 21 bp, Homo sapiens
gcccctcagggtccctggtgg

SEQ ID NO: 4705864 - DNA, 15 bp, Homo sapiens
gcccctccctgcctc

SEQ ID NO: 4705865 - DNA, 22 bp, Homo sapiens
gcccctctcctccgtggcacat

SEQ ID NO: 4705866 - DNA, 23 bp, Homo sapiens
gcccctgccacctcctgcctcag

SEQ ID NO: 4705867 - DNA, 15 bp, Homo sapiens
gcccctgctggttca

SEQ ID NO: 4705868 - DNA, 15 bp, Homo sapiens
gcccctggatgcagc

SEQ ID NO: 4705869 - DNA, 16 bp, Homo sapiens
gccccttccccgaggg

SEQ ID NO: 4705870 - DNA, 19 bp, Homo sapiens
gccccttctgacccatgct

SEQ ID NO: 4705871 - DNA, 13 bp, Homo sapiens
gcccgaatacaaa

SEQ ID NO: 4705872 - DNA, 12 bp, Homo sapiens
gcccgctcccag

SEQ ID NO: 4705873 - DNA, 12 bp, Homo sapiens
gcccgcttgcct

SEQ ID NO: 4705874 - DNA, 14 bp, Homo sapiens
gcccggcgccctct

SEQ ID NO: 4705875 - DNA, 17 bp, Homo sapiens
gcccggcgccctctgtc

SEQ ID NO: 4705876 - DNA, 20 bp, Homo sapiens
gcccggcgccctctgtcctg

SEQ ID NO: 4705877 - DNA, 12 bp, Homo sapiens
gcccggctccag

SEQ ID NO: 4705878 - DNA, 17 bp, Homo sapiens
gcccggctccaggctcc

SEQ ID NO: 4705879 - DNA, 21 bp, Homo sapiens
gcccgggctctgcctcccatc

SEQ ID NO: 4705880 - DNA, 18 bp, Homo sapiens
gcccgttgtctccctggc

SEQ ID NO: 4705881 - DNA, 20 bp, Homo sapiens
gcccgttgtctccctggccc

SEQ ID NO: 4705882 - DNA, 21 bp, Homo sapiens
gccctaacctctgagtcacca

SEQ ID NO: 4705883 - DNA, 20 bp, Homo sapiens
gccctaatgcgcaggctggc

SEQ ID NO: 4705884 - DNA, 15 bp, Homo sapiens
gccctcaaggcctcc

SEQ ID NO: 4705885 - DNA, 20 bp, Homo sapiens
gccctcaaggcctcccacag

SEQ ID NO: 4705886 - DNA, 21 bp, Homo sapiens
gccctcaaggcctcccacagt

SEQ ID NO: 4705887 - DNA, 18 bp, Homo sapiens
gccctcacccctggttct

SEQ ID NO: 4705888 - DNA, 22 bp, Homo sapiens
gccctcacccctggttctcatc

SEQ ID NO: 4705889 - DNA, 12 bp, Homo sapiens
gccctcatcccg

SEQ ID NO: 4705890 - DNA, 21 bp, Homo sapiens
gccctccaagaccttctcctt

SEQ ID NO: 4705891 - DNA, 23 bp, Homo sapiens
gccctccaagaccttctccttca

SEQ ID NO: 4705892 - DNA, 14 bp, Homo sapiens
gccctccacacctg

SEQ ID NO: 4705893 - DNA, 20 bp, Homo sapiens
gccctccatctaaactgccc

SEQ ID NO: 4705894 - DNA, 14 bp, Homo sapiens
gccctcccatcccg

SEQ ID NO: 4705895 - DNA, 13 bp, Homo sapiens
gccctcccgcccc

SEQ ID NO: 4705896 - DNA, 15 bp, Homo sapiens
gccctcccgcccctt

SEQ ID NO: 4705897 - DNA, 14 bp, Homo sapiens
gccctctcccctgc

SEQ ID NO: 4705898 - DNA, 17 bp, Homo sapiens
gccctctcccctgcccc

SEQ ID NO: 4705899 - DNA, 18 bp, Homo sapiens
gccctctcccctgccccc

SEQ ID NO: 4705900 - DNA, 22 bp, Homo sapiens
gccctctcccctgccccctgca

SEQ ID NO: 4705901 - DNA, 13 bp, Homo sapiens
gccctctgcccac

SEQ ID NO: 4705902 - DNA, 22 bp, Homo sapiens
gccctctgcccactccctgcaa

SEQ ID NO: 4705903 - DNA, 12 bp, Homo sapiens
gccctctgtcct

SEQ ID NO: 4705904 - DNA, 14 bp, Homo sapiens
gccctctgtcctga

SEQ ID NO: 4705905 - DNA, 15 bp, Homo sapiens
gccctctgtcctgac

SEQ ID NO: 4705906 - DNA, 14 bp, Homo sapiens
gccctgcaaaagga

SEQ ID NO: 4705907 - DNA, 14 bp, Homo sapiens
gccctgcactgtcc

SEQ ID NO: 4705908 - DNA, 18 bp, Homo sapiens
gccctgcactgtcctgct

SEQ ID NO: 4705909 - DNA, 19 bp, Homo sapiens
gccctgcactgtcctgctc

SEQ ID NO: 4705910 - DNA, 23 bp, Homo sapiens
gccctgcactgtcctgctccaca

SEQ ID NO: 4705911 - DNA, 21 bp, Homo sapiens
gccctgcccacctggcctctg

SEQ ID NO: 4705912 - DNA, 16 bp, Homo sapiens
gccctgccctggtttc

SEQ ID NO: 4705913 - DNA, 14 bp, Homo sapiens
gccctgcctccttt

SEQ ID NO: 4705914 - DNA, 15 bp, Homo sapiens
gccctgcctctgttt

SEQ ID NO: 4705915 - DNA, 20 bp, Homo sapiens
gccctgcgggtcacaggagg

SEQ ID NO: 4705916 - DNA, 20 bp, Homo sapiens
gccctgctgcccctccctgc

SEQ ID NO: 4705917 - DNA, 15 bp, Homo sapiens
gccctggagtcatgc

SEQ ID NO: 4705918 - DNA, 20 bp, Homo sapiens
gccctggagtcatgccaagc

SEQ ID NO: 4705919 - DNA, 14 bp, Homo sapiens
gccctggctgaagg

SEQ ID NO: 4705920 - DNA, 17 bp, Homo sapiens
gccctggctgaaggact

SEQ ID NO: 4705921 - DNA, 19 bp, Homo sapiens
gccctggctgaaggactgt

SEQ ID NO: 4705922 - DNA, 11 bp, Homo sapiens
gccctgggagg

SEQ ID NO: 4705923 - DNA, 16 bp, Homo sapiens
gccctgggaggcagtg

SEQ ID NO: 4705924 - DNA, 22 bp, Homo sapiens
gccctggtggcagtgggagctg

SEQ ID NO: 4705925 - DNA, 14 bp, Homo sapiens
gccctggtttcctg

SEQ ID NO: 4705926 - DNA, 18 bp, Homo sapiens
gccctggtttcctgccct

SEQ ID NO: 4705927 - DNA, 14 bp, Homo sapiens
gccctggtttgttt

SEQ ID NO: 4705928 - DNA, 19 bp, Homo sapiens
gcccttagcagggaaacag

SEQ ID NO: 4705929 - DNA, 17 bp, Homo sapiens
gcccttctctccagccc

SEQ ID NO: 4705930 - DNA, 21 bp, Homo sapiens
gcccttctctccagcccctgg

SEQ ID NO: 4705931 - DNA, 18 bp, Homo sapiens
gcccttgctccagcctga

SEQ ID NO: 4705932 - DNA, 21 bp, Homo sapiens
gcccttgggggtcctcctcca

SEQ ID NO: 4705933 - DNA, 19 bp, Homo sapiens
gccgagatcacgccactgc

SEQ ID NO: 4705934 - DNA, 15 bp, Homo sapiens
gccgagtctgtcctg

SEQ ID NO: 4705935 - DNA, 12 bp, Homo sapiens
gccgcagagctg

SEQ ID NO: 4705936 - DNA, 13 bp, Homo sapiens
gccgccgcctcgc

SEQ ID NO: 4705937 - DNA, 16 bp, Homo sapiens
gccgcgcactcagccg

SEQ ID NO: 4705938 - DNA, 20 bp, Homo sapiens
gccggacacttctcaggaaa

SEQ ID NO: 4705939 - DNA, 12 bp, Homo sapiens
gccggcactgca

SEQ ID NO: 4705940 - DNA, 18 bp, Homo sapiens
gccgggaccccgagcctg

SEQ ID NO: 4705941 - DNA, 21 bp, Homo sapiens
gccgggtctgcctcttctggg

SEQ ID NO: 4705942 - DNA, 22 bp, Homo sapiens
gccgtctacctgaggggcctct

SEQ ID NO: 4705943 - DNA, 20 bp, Homo sapiens
gcctaacccccagcccctcc

SEQ ID NO: 4705944 - DNA, 17 bp, Homo sapiens
gcctaccatttcacaga

SEQ ID NO: 4705945 - DNA, 13 bp, Homo sapiens
gcctaccttgtga

SEQ ID NO: 4705946 - DNA, 14 bp, Homo sapiens
gcctaggtgacaga

SEQ ID NO: 4705947 - DNA, 14 bp, Homo sapiens
gcctagtcccttcc

SEQ ID NO: 4705948 - DNA, 23 bp, Homo sapiens
gcctatcagtgtgccccccatcc

SEQ ID NO: 4705949 - DNA, 22 bp, Homo sapiens
gcctatgtgcatgcagcatcta

SEQ ID NO: 4705950 - DNA, 16 bp, Homo sapiens
gcctcaacctcctggg

SEQ ID NO: 4705951 - DNA, 18 bp, Homo sapiens
gcctcaacctcctgggct

SEQ ID NO: 4705952 - DNA, 19 bp, Homo sapiens
gcctcaacctcctgggcta

SEQ ID NO: 4705953 - DNA, 21 bp, Homo sapiens
gcctcaagtgattctcctgcc

SEQ ID NO: 4705954 - DNA, 20 bp, Homo sapiens
gcctcaagttccagtgcaga

SEQ ID NO: 4705955 - DNA, 13 bp, Homo sapiens
gcctcacagtcct

SEQ ID NO: 4705956 - DNA, 15 bp, Homo sapiens
gcctcagcatcctgg

SEQ ID NO: 4705957 - DNA, 14 bp, Homo sapiens
gcctcagcctccca

SEQ ID NO: 4705958 - DNA, 18 bp, Homo sapiens
gcctcagtctccctccct

SEQ ID NO: 4705959 - DNA, 21 bp, Homo sapiens
gcctcattactttaccacccc

SEQ ID NO: 4705960 - DNA, 14 bp, Homo sapiens
gcctccactcccac

SEQ ID NO: 4705961 - DNA, 16 bp, Homo sapiens
gcctccactcccactt

SEQ ID NO: 4705962 - DNA, 22 bp, Homo sapiens
gcctccactcccacttccctga

SEQ ID NO: 4705963 - DNA, 12 bp, Homo sapiens
gcctccagggct

SEQ ID NO: 4705964 - DNA, 16 bp, Homo sapiens
gcctccagggctggac

SEQ ID NO: 4705965 - DNA, 18 bp, Homo sapiens
gcctccagggctggactg

SEQ ID NO: 4705966 - DNA, 19 bp, Homo sapiens
gcctccagggctggactga

SEQ ID NO: 4705967 - DNA, 22 bp, Homo sapiens
gcctccagggctggactgaggc

SEQ ID NO: 4705968 - DNA, 24 bp, Homo sapiens
gcctccagggctggactgaggcct

SEQ ID NO: 4705969 - DNA, 15 bp, Homo sapiens
gctgtttactaggga

SEQ ID NO: 4705970 - DNA, 23 bp, Homo sapiens
gcttacactgattggtgttttat

SEQ ID NO: 4705971 - DNA, 22 bp, Homo sapiens
gcttactgaagaaatctttcca

SEQ ID NO: 4705972 - DNA, 16 bp, Homo sapiens
gcttagagcctccctc

SEQ ID NO: 4705973 - DNA, 17 bp, Homo sapiens
gcttagtcactgagaca

SEQ ID NO: 4705974 - DNA, 20 bp, Homo sapiens
gcttagtttttttttaatct

SEQ ID NO: 4705975 - DNA, 17 bp, Homo sapiens
gcttataggtggcctct

SEQ ID NO: 4705976 - DNA, 15 bp, Homo sapiens
gcttcactgtataaa

SEQ ID NO: 4705977 - DNA, 17 bp, Homo sapiens
gcttcactgtataaata

SEQ ID NO: 4705978 - DNA, 19 bp, Homo sapiens
gcttcaggttatcgaaata

SEQ ID NO: 4705979 - DNA, 23 bp, Homo sapiens
gcttcaggttatcgaaataacaa

SEQ ID NO: 4705980 - DNA, 22 bp, Homo sapiens
gcttcatttcctctgagctgtt

SEQ ID NO: 4705981 - DNA, 15 bp, Homo sapiens
gcttccaaggtggtc

SEQ ID NO: 4705982 - DNA, 16 bp, Homo sapiens
gcttccaaggtggtct

SEQ ID NO: 4705983 - DNA, 20 bp, Homo sapiens
gcttccagagctctgaccca

SEQ ID NO: 4705984 - DNA, 18 bp, Homo sapiens
gcttccagtgaggctctg

SEQ ID NO: 4705985 - DNA, 19 bp, Homo sapiens
gcttccagtgaggctctgc

SEQ ID NO: 4705986 - DNA, 22 bp, Homo sapiens
gcttcccagtggctgctgccca

SEQ ID NO: 4705987 - DNA, 14 bp, Homo sapiens
gcttccctgactca

SEQ ID NO: 4705988 - DNA, 18 bp, Homo sapiens
gcttccctgactcattct

SEQ ID NO: 4705989 - DNA, 22 bp, Homo sapiens
gcttcctcatagtatggtggct

SEQ ID NO: 4705990 - DNA, 21 bp, Homo sapiens
gcttcctctgaatattaagaa

SEQ ID NO: 4705991 - DNA, 19 bp, Homo sapiens
gcttctaaatggtgctgca

SEQ ID NO: 4705992 - DNA, 14 bp, Homo sapiens
gcttctgctgggct

SEQ ID NO: 4705993 - DNA, 17 bp, Homo sapiens
gcttctgctgggctggg

SEQ ID NO: 4705994 - DNA, 21 bp, Homo sapiens
gcttcttcctatttgccatgg

SEQ ID NO: 4705995 - DNA, 16 bp, Homo sapiens
gcttgagggttgggct

SEQ ID NO: 4705996 - DNA, 20 bp, Homo sapiens
gcttgagggttgggctggtg

SEQ ID NO: 4705997 - DNA, 19 bp, Homo sapiens
gcttgatatttattatatt

SEQ ID NO: 4705998 - DNA, 15 bp, Homo sapiens
gcttgcctcggctcc

SEQ ID NO: 4705999 - DNA, 16 bp, Homo sapiens
gcttgcctcggctcct

SEQ ID NO: 4706000 - DNA, 18 bp, Homo sapiens
gcttgcctcggctcctgc

SEQ ID NO: 4706001 - DNA, 12 bp, Homo sapiens
gcttgcctggga

SEQ ID NO: 4706002 - DNA, 18 bp, Homo sapiens
gcttggagcagaggggct

SEQ ID NO: 4706003 - DNA, 13 bp, Homo sapiens
gcttggaggaagg

SEQ ID NO: 4706004 - DNA, 15 bp, Homo sapiens
gcttggttctgtgaa

SEQ ID NO: 4706005 - DNA, 19 bp, Homo sapiens
gcttgtaaatagctcaggt

SEQ ID NO: 4706006 - DNA, 14 bp, Homo sapiens
gcttgttggatttt

SEQ ID NO: 4706007 - DNA, 20 bp, Homo sapiens
gctttacaaaccaaccattt

SEQ ID NO: 4706008 - DNA, 16 bp, Homo sapiens
gctttcagactccagc

SEQ ID NO: 4706009 - DNA, 12 bp, Homo sapiens
gctttcagtatt

SEQ ID NO: 4706010 - DNA, 21 bp, Homo sapiens
gctttcatgtaaactgtgcac

SEQ ID NO: 4706011 - DNA, 13 bp, Homo sapiens
gctttctacccag

SEQ ID NO: 4706012 - DNA, 19 bp, Homo sapiens
gctttctacccagcgagcc

SEQ ID NO: 4706013 - DNA, 19 bp, Homo sapiens
gcttttaccattagcataa

SEQ ID NO: 4706014 - DNA, 22 bp, Homo sapiens
gcttttacgtagtaaaagtcat

SEQ ID NO: 4706015 - DNA, 13 bp, Homo sapiens
gctttttaattgt

SEQ ID NO: 4706016 - DNA, 18 bp, Homo sapiens
gcttttttgattttgctg

SEQ ID NO: 4706017 - DNA, 23 bp, Homo sapiens
gctttttttgcctaccatttcac

SEQ ID NO: 4706018 - DNA, 20 bp, Homo sapiens
ggaaaaaataacaatgaaag

SEQ ID NO: 4706019 - DNA, 22 bp, Homo sapiens
ggaaaaaattgaaagaacttaa

SEQ ID NO: 4706020 - DNA, 14 bp, Homo sapiens
ggaaaagcctctgt

SEQ ID NO: 4706021 - DNA, 18 bp, Homo sapiens
ggaaaccacagctgctgg

SEQ ID NO: 4706022 - DNA, 15 bp, Homo sapiens
ggaaacgtggcagga

SEQ ID NO: 4706023 - DNA, 13 bp, Homo sapiens
ggaaactgtgaat

SEQ ID NO: 4706024 - DNA, 14 bp, Homo sapiens
ggaaagataataaa

SEQ ID NO: 4706025 - DNA, 17 bp, Homo sapiens
ggaaagcacaggtgggc

SEQ ID NO: 4706026 - DNA, 14 bp, Homo sapiens
ggaaaggctccagg

SEQ ID NO: 4706027 - DNA, 17 bp, Homo sapiens
ggaaatattgctggggt

SEQ ID NO: 4706028 - DNA, 13 bp, Homo sapiens
ggaaatcttaaac

SEQ ID NO: 4706029 - DNA, 19 bp, Homo sapiens
ggaaattcccttcatctgg

SEQ ID NO: 4706030 - DNA, 17 bp, Homo sapiens
ggaaattggaagagcac

SEQ ID NO: 4706031 - DNA, 16 bp, Homo sapiens
ggaacaatcacaaaag

SEQ ID NO: 4706032 - DNA, 23 bp, Homo sapiens
ggaacagaagaggaaagagagac

SEQ ID NO: 4706033 - DNA, 17 bp, Homo sapiens
ggaacagactggaagca

SEQ ID NO: 4706034 - DNA, 16 bp, Homo sapiens
ggaacatacagacaca

SEQ ID NO: 4706035 - DNA, 15 bp, Homo sapiens
ggaacatcatcaagg

SEQ ID NO: 4706036 - DNA, 13 bp, Homo sapiens
ggaacatggggag

SEQ ID NO: 4706037 - DNA, 23 bp, Homo sapiens
ggaaccgaacatatcatttgtga

SEQ ID NO: 4706038 - DNA, 13 bp, Homo sapiens
ggaacctgacccc

SEQ ID NO: 4706039 - DNA, 14 bp, Homo sapiens
ggaacgactgggca

SEQ ID NO: 4706040 - DNA, 23 bp, Homo sapiens
ggaactagactcccaagctggac

SEQ ID NO: 4706041 - DNA, 15 bp, Homo sapiens
ggaactggaggcagg

SEQ ID NO: 4706042 - DNA, 19 bp, Homo sapiens
ggaagaaagagaaggagcc

SEQ ID NO: 4706043 - DNA, 17 bp, Homo sapiens
ggaagacagcatttaaa

SEQ ID NO: 4706044 - DNA, 17 bp, Homo sapiens
ggaagactttggaaaga

SEQ ID NO: 4706045 - DNA, 18 bp, Homo sapiens
ggaagccgctggggccag

SEQ ID NO: 4706046 - DNA, 16 bp, Homo sapiens
ggaagctagctcccct

SEQ ID NO: 4706047 - DNA, 17 bp, Homo sapiens
ggaagctagctcccctc

SEQ ID NO: 4706048 - DNA, 21 bp, Homo sapiens
ggaagctagctcccctcctct

SEQ ID NO: 4706049 - DNA, 22 bp, Homo sapiens
ggaagctagctcccctcctctc

SEQ ID NO: 4706050 - DNA, 22 bp, Homo sapiens
ggaagctcagggcctggctcag

SEQ ID NO: 4706051 - DNA, 14 bp, Homo sapiens
ggaagcttggggaa

SEQ ID NO: 4706052 - DNA, 12 bp, Homo sapiens
ggaaggagctgc

SEQ ID NO: 4706053 - DNA, 17 bp, Homo sapiens
ggaaggagctgcctgga

SEQ ID NO: 4706054 - DNA, 20 bp, Homo sapiens
ggaaggagctgcctggaccc

SEQ ID NO: 4706055 - DNA, 13 bp, Homo sapiens
ggaaggattgtaa

SEQ ID NO: 4706056 - DNA, 16 bp, Homo sapiens
ggaaggattgtaaaaa

SEQ ID NO: 4706057 - DNA, 17 bp, Homo sapiens
ggaaggctgagaggaga

SEQ ID NO: 4706058 - DNA, 18 bp, Homo sapiens
ggaagtatgtatattaaa

SEQ ID NO: 4706059 - DNA, 14 bp, Homo sapiens
ggaagtcacttcac

SEQ ID NO: 4706060 - DNA, 15 bp, Homo sapiens
ggaagtccctcagag

SEQ ID NO: 4706061 - DNA, 13 bp, Homo sapiens
ggaagtcctctgg

SEQ ID NO: 4706062 - DNA, 19 bp, Homo sapiens
ggaagtctgtgtctaccag

SEQ ID NO: 4706063 - DNA, 17 bp, Homo sapiens
ggaagtgagaagggctc

SEQ ID NO: 4706064 - DNA, 21 bp, Homo sapiens
ggaagttttgtggaggagctc

SEQ ID NO: 4706065 - DNA, 22 bp, Homo sapiens
ggaataatgggcttagagcagt

SEQ ID NO: 4706066 - DNA, 15 bp, Homo sapiens
ggaatacctgtcccc

SEQ ID NO: 4706067 - DNA, 16 bp, Homo sapiens
ggaatcagcaagaaga

SEQ ID NO: 4706068 - DNA, 20 bp, Homo sapiens
ggaatccactcccaggcagc

SEQ ID NO: 4706069 - DNA, 13 bp, Homo sapiens
ggaatctggagag

SEQ ID NO: 4706070 - DNA, 16 bp, Homo sapiens
ggaatcttcacctcag

SEQ ID NO: 4706071 - DNA, 12 bp, Homo sapiens
ggaatgcagtgg

SEQ ID NO: 4706072 - DNA, 21 bp, Homo sapiens
ggaatgcatcccaccttgcca

SEQ ID NO: 4706073 - DNA, 22 bp, Homo sapiens
ggaatgcatcccaccttgccaa

SEQ ID NO: 4706074 - DNA, 18 bp, Homo sapiens
ggaatgcctgagtgcctg

SEQ ID NO: 4706075 - DNA, 22 bp, Homo sapiens
ggaatggatttttctttaactg

SEQ ID NO: 4706076 - DNA, 15 bp, Homo sapiens
ggaatggcacagccc

SEQ ID NO: 4706077 - DNA, 19 bp, Homo sapiens
ggaatgtttgcctctgcct

SEQ ID NO: 4706078 - DNA, 17 bp, Homo sapiens
ggacaaaacatagctgg

SEQ ID NO: 4706079 - DNA, 21 bp, Homo sapiens
ggcatgggtcgggagagggga

SEQ ID NO: 4706080 - DNA, 13 bp, Homo sapiens
ggcatttcacaaa

SEQ ID NO: 4706081 - DNA, 17 bp, Homo sapiens
ggcattttgaatgtgat

SEQ ID NO: 4706082 - DNA, 20 bp, Homo sapiens
ggcattttgaatgtgatcat

SEQ ID NO: 4706083 - DNA, 16 bp, Homo sapiens
ggccaaagagtctcca

SEQ ID NO: 4706084 - DNA, 12 bp, Homo sapiens
ggccaagttctt

SEQ ID NO: 4706085 - DNA, 14 bp, Homo sapiens
ggccaccacccccc

SEQ ID NO: 4706086 - DNA, 17 bp, Homo sapiens
ggccaccaccccccact

SEQ ID NO: 4706087 - DNA, 18 bp, Homo sapiens
ggccaccaccccccactc

SEQ ID NO: 4706088 - DNA, 21 bp, Homo sapiens
ggccaccgtagggcctgactc

SEQ ID NO: 4706089 - DNA, 11 bp, Homo sapiens
ggccagaggct

SEQ ID NO: 4706090 - DNA, 17 bp, Homo sapiens
ggccagagggagtgaca

SEQ ID NO: 4706091 - DNA, 23 bp, Homo sapiens
ggccagagggagtgacagaggca

SEQ ID NO: 4706092 - DNA, 21 bp, Homo sapiens
ggccagatgcacatccctgga

SEQ ID NO: 4706093 - DNA, 15 bp, Homo sapiens
ggccagatgcaccag

SEQ ID NO: 4706094 - DNA, 14 bp, Homo sapiens
ggccagccccacag

SEQ ID NO: 4706095 - DNA, 18 bp, Homo sapiens
ggccagccccacagccca

SEQ ID NO: 4706096 - DNA, 18 bp, Homo sapiens
ggccaggactctgcagcc

SEQ ID NO: 4706097 - DNA, 14 bp, Homo sapiens
ggccaggccagagg

SEQ ID NO: 4706098 - DNA, 15 bp, Homo sapiens
ggccaggccctctgc

SEQ ID NO: 4706099 - DNA, 17 bp, Homo sapiens
ggccaggccctctgccc

SEQ ID NO: 4706100 - DNA, 16 bp, Homo sapiens
ggccaggctgctcttg

SEQ ID NO: 4706101 - DNA, 16 bp, Homo sapiens
ggccaggctggtctca

SEQ ID NO: 4706102 - DNA, 19 bp, Homo sapiens
ggccagggcctggaagaca

SEQ ID NO: 4706103 - DNA, 21 bp, Homo sapiens
ggccaggttggaaaagaaatc

SEQ ID NO: 4706104 - DNA, 22 bp, Homo sapiens
ggccaggttggaaaagaaatca

SEQ ID NO: 4706105 - DNA, 20 bp, Homo sapiens
ggccagtgtgacaaggattg

SEQ ID NO: 4706106 - DNA, 22 bp, Homo sapiens
ggccatactggcctcgcctggc

SEQ ID NO: 4706107 - DNA, 23 bp, Homo sapiens
ggccatactggcctcgcctggcc

SEQ ID NO: 4706108 - DNA, 17 bp, Homo sapiens
ggccatagctcctgctc

SEQ ID NO: 4706109 - DNA, 22 bp, Homo sapiens
ggccatcttccaggtggggtga

SEQ ID NO: 4706110 - DNA, 19 bp, Homo sapiens
ggccatgctgagagctggg

SEQ ID NO: 4706111 - DNA, 22 bp, Homo sapiens
ggccatggagagctggagcctg

SEQ ID NO: 4706112 - DNA, 13 bp, Homo sapiens
ggccatgggcctc

SEQ ID NO: 4706113 - DNA, 16 bp, Homo sapiens
ggccatgggcctcctg

SEQ ID NO: 4706114 - DNA, 22 bp, Homo sapiens
ggcccaccccacccacttctgc

SEQ ID NO: 4706115 - DNA, 19 bp, Homo sapiens
ggcccagagggcctgcaag

SEQ ID NO: 4706116 - DNA, 15 bp, Homo sapiens
ggcccagctcccccg

SEQ ID NO: 4706117 - DNA, 17 bp, Homo sapiens
ggcccagtatgagccct

SEQ ID NO: 4706118 - DNA, 16 bp, Homo sapiens
ggcccatcagtgtacc

SEQ ID NO: 4706119 - DNA, 16 bp, Homo sapiens
ggcccatggaggagac

SEQ ID NO: 4706120 - DNA, 18 bp, Homo sapiens
ggcccatggaggagacag

SEQ ID NO: 4706121 - DNA, 13 bp, Homo sapiens
ggccccagcctgg

SEQ ID NO: 4706122 - DNA, 13 bp, Homo sapiens
ggcccctctcctc

SEQ ID NO: 4706123 - DNA, 20 bp, Homo sapiens
ggcccctgccacctcctgcc

SEQ ID NO: 4706124 - DNA, 16 bp, Homo sapiens
ggcccctgcccggctg

SEQ ID NO: 4706125 - DNA, 17 bp, Homo sapiens
ggcccctgcccggctgc

SEQ ID NO: 4706126 - DNA, 13 bp, Homo sapiens
ggcccctgctggt

SEQ ID NO: 4706127 - DNA, 14 bp, Homo sapiens
ggcccctgctggtt

SEQ ID NO: 4706128 - DNA, 21 bp, Homo sapiens
ggcccgcttgcctcggctcct

SEQ ID NO: 4706129 - DNA, 23 bp, Homo sapiens
ggcccgttgtctccctggccctc

SEQ ID NO: 4706130 - DNA, 24 bp, Homo sapiens
ggcccgttgtctccctggccctca

SEQ ID NO: 4706131 - DNA, 15 bp, Homo sapiens
ggccctccacacctg

SEQ ID NO: 4706132 - DNA, 16 bp, Homo sapiens
ggccctccacacctgc

SEQ ID NO: 4706133 - DNA, 21 bp, Homo sapiens
ggccctccacacctgcggccc

SEQ ID NO: 4706134 - DNA, 14 bp, Homo sapiens
ggccctcccagtac

SEQ ID NO: 4706135 - DNA, 21 bp, Homo sapiens
ggccctcgctgccagctctgt

SEQ ID NO: 4706136 - DNA, 23 bp, Homo sapiens
ggccctctcccctgccccctgca

SEQ ID NO: 4706137 - DNA, 14 bp, Homo sapiens
ggccctctctgctc

SEQ ID NO: 4706138 - DNA, 21 bp, Homo sapiens
ggccctctctgctctgcgtgt

SEQ ID NO: 4706139 - DNA, 19 bp, Homo sapiens
ggccctctgcccactccct

SEQ ID NO: 4706140 - DNA, 22 bp, Homo sapiens
ggccctgcaaaaggactctcag

SEQ ID NO: 4706141 - DNA, 20 bp, Homo sapiens
ggccctgcactgtcctgctc

SEQ ID NO: 4706142 - DNA, 22 bp, Homo sapiens
ggccctgcactgtcctgctcca

SEQ ID NO: 4706143 - DNA, 12 bp, Homo sapiens
ggccctgccctg

SEQ ID NO: 4706144 - DNA, 20 bp, Homo sapiens
ggccctgccctggtttcctg

SEQ ID NO: 4706145 - DNA, 22 bp, Homo sapiens
ggccctgccctggtttcctgcc

SEQ ID NO: 4706146 - DNA, 18 bp, Homo sapiens
ggccctgccgggaccctg

SEQ ID NO: 4706147 - DNA, 11 bp, Homo sapiens
ggccctgctgc

SEQ ID NO: 4706148 - DNA, 22 bp, Homo sapiens
ggccctgctgcccctccctgcc

SEQ ID NO: 4706149 - DNA, 18 bp, Homo sapiens
ggcccttctctccagccc

SEQ ID NO: 4706150 - DNA, 15 bp, Homo sapiens
ggccgagtctgtcct

SEQ ID NO: 4706151 - DNA, 15 bp, Homo sapiens
ggccggccaggtggg

SEQ ID NO: 4706152 - DNA, 15 bp, Homo sapiens
ggccgggagcctgat

SEQ ID NO: 4706153 - DNA, 13 bp, Homo sapiens
ggccgtcctgagg

SEQ ID NO: 4706154 - DNA, 14 bp, Homo sapiens
ggccgtcctgaggg

SEQ ID NO: 4706155 - DNA, 17 bp, Homo sapiens
ggcctatcagtgtgccc

SEQ ID NO: 4706156 - DNA, 18 bp, Homo sapiens
ggcctatcagtgtgcccc

SEQ ID NO: 4706157 - DNA, 23 bp, Homo sapiens
ggcctcaagtgattctcctgcct

SEQ ID NO: 4706158 - DNA, 23 bp, Homo sapiens
ggcctccaagtccacagtggaac

SEQ ID NO: 4706159 - DNA, 14 bp, Homo sapiens
ggcctcccaactca

SEQ ID NO: 4706160 - DNA, 18 bp, Homo sapiens
ggcctcccaactcacccc

SEQ ID NO: 4706161 - DNA, 11 bp, Homo sapiens
ggcctcccaca

SEQ ID NO: 4706162 - DNA, 14 bp, Homo sapiens
ggcctcccacagtg

SEQ ID NO: 4706163 - DNA, 13 bp, Homo sapiens
ggcctcccccact

SEQ ID NO: 4706164 - DNA, 14 bp, Homo sapiens
ggcctcccccactt

SEQ ID NO: 4706165 - DNA, 16 bp, Homo sapiens
ggcctcgcctggcctg

SEQ ID NO: 4706166 - DNA, 17 bp, Homo sapiens
ggcctcggacttagctg

SEQ ID NO: 4706167 - DNA, 22 bp, Homo sapiens
ggcctcggacttagctgggaga

SEQ ID NO: 4706168 - DNA, 14 bp, Homo sapiens
ggcctctgcactcc

SEQ ID NO: 4706169 - DNA, 22 bp, Homo sapiens
ggcctctgcactcccctgctgg

SEQ ID NO: 4706170 - DNA, 22 bp, Homo sapiens
ggcctgaatgcttataggtggc

SEQ ID NO: 4706171 - DNA, 23 bp, Homo sapiens
ggcctgaatgcttataggtggcc

SEQ ID NO: 4706172 - DNA, 12 bp, Homo sapiens
ggcctgagctgg

SEQ ID NO: 4706173 - DNA, 14 bp, Homo sapiens
ggcctgccacctgg

SEQ ID NO: 4706174 - DNA, 18 bp, Homo sapiens
ggcctgccacctggaccc

SEQ ID NO: 4706175 - DNA, 23 bp, Homo sapiens
ggcctgccacctggacccctgca

SEQ ID NO: 4706176 - DNA, 18 bp, Homo sapiens
ggcctgcctccagggctg

SEQ ID NO: 4706177 - DNA, 20 bp, Homo sapiens
ggcctgcctccagggctgga

SEQ ID NO: 4706178 - DNA, 16 bp, Homo sapiens
ggcctgccttctcagg

SEQ ID NO: 4706179 - DNA, 17 bp, Homo sapiens
ggcctgcgtgtgtctgt

SEQ ID NO: 4706180 - DNA, 16 bp, Homo sapiens
ggcctggccagatgca

SEQ ID NO: 4706181 - DNA, 21 bp, Homo sapiens
ggcctggccagatgcaccagc

SEQ ID NO: 4706182 - DNA, 14 bp, Homo sapiens
ggcctggcccctca

SEQ ID NO: 4706183 - DNA, 15 bp, Homo sapiens
ggcctggcccctcag

SEQ ID NO: 4706184 - DNA, 13 bp, Homo sapiens
ggcctggcctgag

SEQ ID NO: 4706185 - DNA, 14 bp, Homo sapiens
ggccttaataaata

SEQ ID NO: 4706186 - DNA, 16 bp, Homo sapiens
ggccttctctgaagga

SEQ ID NO: 4706187 - DNA, 15 bp, Homo sapiens
ggcgagaggaggggc

SEQ ID NO: 4706188 - DNA, 16 bp, Homo sapiens
ggcgcaccctcccctc

SEQ ID NO: 4706189 - DNA, 23 bp, Homo sapiens
gggctggaacagattcacactgt

SEQ ID NO: 4706190 - DNA, 13 bp, Homo sapiens
gggctggaggagc

SEQ ID NO: 4706191 - DNA, 20 bp, Homo sapiens
gggctgggttctacccaggt

SEQ ID NO: 4706192 - DNA, 21 bp, Homo sapiens
gggctgggttggcgcaccctc

SEQ ID NO: 4706193 - DNA, 22 bp, Homo sapiens
gggctgggttggcgcaccctcc

SEQ ID NO: 4706194 - DNA, 16 bp, Homo sapiens
gggcttcagtggcagc

SEQ ID NO: 4706195 - DNA, 19 bp, Homo sapiens
gggcttcagtggcagctgc

SEQ ID NO: 4706196 - DNA, 21 bp, Homo sapiens
gggcttcccagtggctgctgc

SEQ ID NO: 4706197 - DNA, 23 bp, Homo sapiens
gggcttcccagtggctgctgccc

SEQ ID NO: 4706198 - DNA, 18 bp, Homo sapiens
gggctttcctctgtgacc

SEQ ID NO: 4706199 - DNA, 13 bp, Homo sapiens
ggggaaagcacag

SEQ ID NO: 4706200 - DNA, 14 bp, Homo sapiens
ggggaagagcacag

SEQ ID NO: 4706201 - DNA, 12 bp, Homo sapiens
ggggaagatgaa

SEQ ID NO: 4706202 - DNA, 16 bp, Homo sapiens
ggggaagtcctctggg

SEQ ID NO: 4706203 - DNA, 12 bp, Homo sapiens
ggggacagctcc

SEQ ID NO: 4706204 - DNA, 14 bp, Homo sapiens
ggggacagctcctt

SEQ ID NO: 4706205 - DNA, 13 bp, Homo sapiens
ggggacagggatg

SEQ ID NO: 4706206 - DNA, 17 bp, Homo sapiens
ggggacctgatggagag

SEQ ID NO: 4706207 - DNA, 15 bp, Homo sapiens
ggggacgcaggcccc

SEQ ID NO: 4706208 - DNA, 17 bp, Homo sapiens
ggggacgcaggcccctc

SEQ ID NO: 4706209 - DNA, 21 bp, Homo sapiens
ggggcaatagggttaaatggt

SEQ ID NO: 4706210 - DNA, 13 bp, Homo sapiens
ggggcaggccctg

SEQ ID NO: 4706211 - DNA, 21 bp, Homo sapiens
ggggcaggccctgcactgtcc

SEQ ID NO: 4706212 - DNA, 22 bp, Homo sapiens
ggggcaggccctgcactgtcct

SEQ ID NO: 4706213 - DNA, 14 bp, Homo sapiens
ggggcatgacccag

SEQ ID NO: 4706214 - DNA, 19 bp, Homo sapiens
ggggccagttggtccccct

SEQ ID NO: 4706215 - DNA, 21 bp, Homo sapiens
ggggcccgttgtctccctggc

SEQ ID NO: 4706216 - DNA, 22 bp, Homo sapiens
ggggcccgttgtctccctggcc

SEQ ID NO: 4706217 - DNA, 15 bp, Homo sapiens
ggggccctgcctcct

SEQ ID NO: 4706218 - DNA, 23 bp, Homo sapiens
ggggcctatcagtgtgcccccca

SEQ ID NO: 4706219 - DNA, 16 bp, Homo sapiens
ggggcctgaggcaagc

SEQ ID NO: 4706220 - DNA, 19 bp, Homo sapiens
ggggcctgccacctggacc

SEQ ID NO: 4706221 - DNA, 22 bp, Homo sapiens
ggggcctgccacctggacccct

SEQ ID NO: 4706222 - DNA, 18 bp, Homo sapiens
ggggcggccagccctccc

SEQ ID NO: 4706223 - DNA, 13 bp, Homo sapiens
ggggctctgcacc

SEQ ID NO: 4706224 - DNA, 14 bp, Homo sapiens
ggggctctgcaccc

SEQ ID NO: 4706225 - DNA, 12 bp, Homo sapiens
ggggctgcaccg

SEQ ID NO: 4706226 - DNA, 13 bp, Homo sapiens
ggggctgcccgct

SEQ ID NO: 4706227 - DNA, 15 bp, Homo sapiens
ggggctgctggcctg

SEQ ID NO: 4706228 - DNA, 21 bp, Homo sapiens
ggggctggaggagcccaggcc

SEQ ID NO: 4706229 - DNA, 23 bp, Homo sapiens
ggggctgggttggcgcaccctcc

SEQ ID NO: 4706230 - DNA, 12 bp, Homo sapiens
gggggaaagcac

SEQ ID NO: 4706231 - DNA, 18 bp, Homo sapiens
gggggtcctcctccaggg

SEQ ID NO: 4706232 - DNA, 20 bp, Homo sapiens
gggggtcctcctccagggac

SEQ ID NO: 4706233 - DNA, 22 bp, Homo sapiens
ggggtaaagggcgcaaagggca

SEQ ID NO: 4706234 - DNA, 21 bp, Homo sapiens
ggggtaccagccactggaggg

SEQ ID NO: 4706235 - DNA, 12 bp, Homo sapiens
ggggtggccgtc

SEQ ID NO: 4706236 - DNA, 15 bp, Homo sapiens
ggggtggccgtcctg

SEQ ID NO: 4706237 - DNA, 24 bp, Homo sapiens
gggtaggggaagaagagctatcag

SEQ ID NO: 4706238 - DNA, 18 bp, Homo sapiens
gggtagggggctggagga

SEQ ID NO: 4706239 - DNA, 20 bp, Homo sapiens
gggtatcaggtgctgccatc

SEQ ID NO: 4706240 - DNA, 14 bp, Homo sapiens
gggtcactctggca

SEQ ID NO: 4706241 - DNA, 20 bp, Homo sapiens
gggtcactctggcagctcag

SEQ ID NO: 4706242 - DNA, 19 bp, Homo sapiens
gggtcagacgcctgaggaa

SEQ ID NO: 4706243 - DNA, 20 bp, Homo sapiens
gggtcctcctccagggacag

SEQ ID NO: 4706244 - DNA, 22 bp, Homo sapiens
gggtctcactatgttgcccagg

SEQ ID NO: 4706245 - DNA, 23 bp, Homo sapiens
gggtctcactatgttgcccaggc

SEQ ID NO: 4706246 - DNA, 14 bp, Homo sapiens
gggtctctgctgcc

SEQ ID NO: 4706247 - DNA, 15 bp, Homo sapiens
gggtctctgctgccg

SEQ ID NO: 4706248 - DNA, 23 bp, Homo sapiens
gggtgaggacccgccggatgaca

SEQ ID NO: 4706249 - DNA, 21 bp, Homo sapiens
gggtgcgaccccatctgccca

SEQ ID NO: 4706250 - DNA, 18 bp, Homo sapiens
gggtggccgtcctgaggg

SEQ ID NO: 4706251 - DNA, 18 bp, Homo sapiens
gggtgggacaccctgtga

SEQ ID NO: 4706252 - DNA, 11 bp, Homo sapiens
gggtgggccct

SEQ ID NO: 4706253 - DNA, 12 bp, Homo sapiens
gggtggtgacct

SEQ ID NO: 4706254 - DNA, 19 bp, Homo sapiens
gggtggtttttatttttat

SEQ ID NO: 4706255 - DNA, 22 bp, Homo sapiens
gggttccagcaattctcctgcc

SEQ ID NO: 4706256 - DNA, 12 bp, Homo sapiens
gggttctaccca

SEQ ID NO: 4706257 - DNA, 12 bp, Homo sapiens
gggttgaagaaa

SEQ ID NO: 4706258 - DNA, 22 bp, Homo sapiens
gggttggcgcaccctcccctcc

SEQ ID NO: 4706259 - DNA, 15 bp, Homo sapiens
gggtttcccttgccc

SEQ ID NO: 4706260 - DNA, 23 bp, Homo sapiens
gggttttgccatgttggccaggc

SEQ ID NO: 4706261 - DNA, 15 bp, Homo sapiens
ggtaaaggatgaggg

SEQ ID NO: 4706262 - DNA, 15 bp, Homo sapiens
ggtaacagaacagct

SEQ ID NO: 4706263 - DNA, 16 bp, Homo sapiens
ggtaacagaacagctt

SEQ ID NO: 4706264 - DNA, 21 bp, Homo sapiens
ggtaacagaacagcttcaggt

SEQ ID NO: 4706265 - DNA, 13 bp, Homo sapiens
ggtaacaggcaga

SEQ ID NO: 4706266 - DNA, 14 bp, Homo sapiens
ggtaacaggcagat

SEQ ID NO: 4706267 - DNA, 20 bp, Homo sapiens
ggtaagcacttaatgaatga

SEQ ID NO: 4706268 - DNA, 14 bp, Homo sapiens
ggtaatcgacctgc

SEQ ID NO: 4706269 - DNA, 12 bp, Homo sapiens
ggtacaaatgtg

SEQ ID NO: 4706270 - DNA, 13 bp, Homo sapiens
ggtacaaatgtga

SEQ ID NO: 4706271 - DNA, 15 bp, Homo sapiens
ggtactaaggagaat

SEQ ID NO: 4706272 - DNA, 17 bp, Homo sapiens
ggtactgttgctttggg

SEQ ID NO: 4706273 - DNA, 18 bp, Homo sapiens
ggtagccttgtgttctga

SEQ ID NO: 4706274 - DNA, 23 bp, Homo sapiens
ggtagggggctggaggagcccag

SEQ ID NO: 4706275 - DNA, 23 bp, Homo sapiens
ggtagggtgggccttcagggagt

SEQ ID NO: 4706276 - DNA, 19 bp, Homo sapiens
ggtagtgggatggtggggt

SEQ ID NO: 4706277 - DNA, 13 bp, Homo sapiens
ggtatagaaatgc

SEQ ID NO: 4706278 - DNA, 14 bp, Homo sapiens
ggtatcaggtgctg

SEQ ID NO: 4706279 - DNA, 17 bp, Homo sapiens
ggtatctaattctttaa

SEQ ID NO: 4706280 - DNA, 20 bp, Homo sapiens
ggtatctaattctttaatga

SEQ ID NO: 4706281 - DNA, 23 bp, Homo sapiens
ggtatctgcatgtaaaatcttca

SEQ ID NO: 4706282 - DNA, 13 bp, Homo sapiens
ggtcactggaact

SEQ ID NO: 4706283 - DNA, 11 bp, Homo sapiens
ggtcagagcct

SEQ ID NO: 4706284 - DNA, 12 bp, Homo sapiens
ggtcagagcctg

SEQ ID NO: 4706285 - DNA, 14 bp, Homo sapiens
ggtcagtgcaaata

SEQ ID NO: 4706286 - DNA, 12 bp, Homo sapiens
ggtcatccttgc

SEQ ID NO: 4706287 - DNA, 20 bp, Homo sapiens
ggtcattcctaatgcattag

SEQ ID NO: 4706288 - DNA, 15 bp, Homo sapiens
ggtccacccaggagc

SEQ ID NO: 4706289 - DNA, 17 bp, Homo sapiens
ggtccagccctggctga

SEQ ID NO: 4706290 - DNA, 19 bp, Homo sapiens
ggtccagccctggctgaag

SEQ ID NO: 4706291 - DNA, 23 bp, Homo sapiens
ggtccagccctggctgaaggact

SEQ ID NO: 4706292 - DNA, 17 bp, Homo sapiens
ggtccatgggcagagcc

SEQ ID NO: 4706293 - DNA, 18 bp, Homo sapiens
ggtccatgggcagagccc

SEQ ID NO: 4706294 - DNA, 22 bp, Homo sapiens
ggtcccaccccacacacgccag

SEQ ID NO: 4706295 - DNA, 12 bp, Homo sapiens
ggtcccactcag

SEQ ID NO: 4706296 - DNA, 22 bp, Homo sapiens
ggtcccactcagtccatagcag

SEQ ID NO: 4706297 - DNA, 20 bp, Homo sapiens
ggtccctgataacaacctgg

SEQ ID NO: 4706298 - DNA, 23 bp, Homo sapiens
ggtccctgataacaacctggaga

SEQ ID NO: 4706299 - DNA, 16 bp, Homo sapiens
gtcagacgcctgagga

SEQ ID NO: 4706300 - DNA, 13 bp, Homo sapiens
gtcagattcacac

SEQ ID NO: 4706301 - DNA, 22 bp, Homo sapiens
gtcagccctagggtggagagcc

SEQ ID NO: 4706302 - DNA, 18 bp, Homo sapiens
gtcagctgaccccctccc

SEQ ID NO: 4706303 - DNA, 19 bp, Homo sapiens
gtcaggattgcgagagatg

SEQ ID NO: 4706304 - DNA, 21 bp, Homo sapiens
gtcaggattgcgagagatgtg

SEQ ID NO: 4706305 - DNA, 16 bp, Homo sapiens
gtcaggtggggcagct

SEQ ID NO: 4706306 - DNA, 16 bp, Homo sapiens
gtcagtaccttcaaac

SEQ ID NO: 4706307 - DNA, 22 bp, Homo sapiens
gtcagtgccgccgcctcgccca

SEQ ID NO: 4706308 - DNA, 23 bp, Homo sapiens
gtcagtgccgccgcctcgcccac

SEQ ID NO: 4706309 - DNA, 20 bp, Homo sapiens
gtcagtgtccaaagcagggt

SEQ ID NO: 4706310 - DNA, 17 bp, Homo sapiens
gtcagttgttatttatt

SEQ ID NO: 4706311 - DNA, 22 bp, Homo sapiens
gtcataactagaactgaatttt

SEQ ID NO: 4706312 - DNA, 17 bp, Homo sapiens
gtcatacaatccattct

SEQ ID NO: 4706313 - DNA, 14 bp, Homo sapiens
gtcatacagtaaac

SEQ ID NO: 4706314 - DNA, 15 bp, Homo sapiens
gtcatcagtaagtat

SEQ ID NO: 4706315 - DNA, 16 bp, Homo sapiens
gtcatgcaaaggctgg

SEQ ID NO: 4706316 - DNA, 19 bp, Homo sapiens
gtcatgcataaatatgcag

SEQ ID NO: 4706317 - DNA, 17 bp, Homo sapiens
gtcatgtgcatctggtg

SEQ ID NO: 4706318 - DNA, 19 bp, Homo sapiens
gtcattatttgataacatt

SEQ ID NO: 4706319 - DNA, 21 bp, Homo sapiens
gtcattatttgataacatttt

SEQ ID NO: 4706320 - DNA, 21 bp, Homo sapiens
gtcattgtaacctcgtgtcta

SEQ ID NO: 4706321 - DNA, 15 bp, Homo sapiens
gtcatttctcttttt

SEQ ID NO: 4706322 - DNA, 14 bp, Homo sapiens
gtcatttttaacta

SEQ ID NO: 4706323 - DNA, 17 bp, Homo sapiens
gtccaaggaaaccacag

SEQ ID NO: 4706324 - DNA, 13 bp, Homo sapiens
gtccacaggaagt

SEQ ID NO: 4706325 - DNA, 12 bp, Homo sapiens
gtccacccagga

SEQ ID NO: 4706326 - DNA, 14 bp, Homo sapiens
gtccacccaggagc

SEQ ID NO: 4706327 - DNA, 14 bp, Homo sapiens
gtccagccctggct

SEQ ID NO: 4706328 - DNA, 17 bp, Homo sapiens
gtccagccctggctgaa

SEQ ID NO: 4706329 - DNA, 18 bp, Homo sapiens
gtccagccctggctgaag

SEQ ID NO: 4706330 - DNA, 20 bp, Homo sapiens
gtccagccctggctgaagga

SEQ ID NO: 4706331 - DNA, 14 bp, Homo sapiens
gtccatgggcagag

SEQ ID NO: 4706332 - DNA, 18 bp, Homo sapiens
gtccatgggcagagccca

SEQ ID NO: 4706333 - DNA, 16 bp, Homo sapiens
gtcccaagctcccaag

SEQ ID NO: 4706334 - DNA, 17 bp, Homo sapiens
gtcccaagctcccaaga

SEQ ID NO: 4706335 - DNA, 15 bp, Homo sapiens
gtcccaccccacaca

SEQ ID NO: 4706336 - DNA, 20 bp, Homo sapiens
gtcccaccccacacacgcca

SEQ ID NO: 4706337 - DNA, 15 bp, Homo sapiens
gtcccaccttggctg

SEQ ID NO: 4706338 - DNA, 16 bp, Homo sapiens
gtcccaccttggctgc

SEQ ID NO: 4706339 - DNA, 18 bp, Homo sapiens
gtcccaccttggctgcag

SEQ ID NO: 4706340 - DNA, 16 bp, Homo sapiens
gtcccacttcccctcc

SEQ ID NO: 4706341 - DNA, 17 bp, Homo sapiens
gtcccaggttatctggg

SEQ ID NO: 4706342 - DNA, 15 bp, Homo sapiens
gtcccagtttcccac

SEQ ID NO: 4706343 - DNA, 17 bp, Homo sapiens
gtcccagtttcccactc

SEQ ID NO: 4706344 - DNA, 18 bp, Homo sapiens
gtcccagtttcccactct

SEQ ID NO: 4706345 - DNA, 19 bp, Homo sapiens
gtcccagtttcccactctg

SEQ ID NO: 4706346 - DNA, 12 bp, Homo sapiens
gtccccacactc

SEQ ID NO: 4706347 - DNA, 13 bp, Homo sapiens
gtcccctcttgcc

SEQ ID NO: 4706348 - DNA, 16 bp, Homo sapiens
gtcccctcttgcccca

SEQ ID NO: 4706349 - DNA, 18 bp, Homo sapiens
gtcccctgtttgtttctg

SEQ ID NO: 4706350 - DNA, 22 bp, Homo sapiens
gtcccctgtttgtttctgaaag

SEQ ID NO: 4706351 - DNA, 23 bp, Homo sapiens
gtcccctgtttgtttctgaaagg

SEQ ID NO: 4706352 - DNA, 17 bp, Homo sapiens
gtccccttctctcatct

SEQ ID NO: 4706353 - DNA, 18 bp, Homo sapiens
gtccccttctctcatctc

SEQ ID NO: 4706354 - DNA, 18 bp, Homo sapiens
gtccctcctccccggagc

SEQ ID NO: 4706355 - DNA, 19 bp, Homo sapiens
gtccctcctccccggagcc

SEQ ID NO: 4706356 - DNA, 18 bp, Homo sapiens
gtccctggtggcagctca

SEQ ID NO: 4706357 - DNA, 19 bp, Homo sapiens
gtcccttgcccccctggcc

SEQ ID NO: 4706358 - DNA, 20 bp, Homo sapiens
gtcccttgcccccctggcct

SEQ ID NO: 4706359 - DNA, 13 bp, Homo sapiens
gtcctacccaccc

SEQ ID NO: 4706360 - DNA, 19 bp, Homo sapiens
gtcctattatattcattct

SEQ ID NO: 4706361 - DNA, 20 bp, Homo sapiens
gtcctcaaagaagtggttct

SEQ ID NO: 4706362 - DNA, 19 bp, Homo sapiens
gtcctcaaggggccatcct

SEQ ID NO: 4706363 - DNA, 23 bp, Homo sapiens
gtcctcccatctcacacatgagc

SEQ ID NO: 4706364 - DNA, 13 bp, Homo sapiens
gtcctcctccagg

SEQ ID NO: 4706365 - DNA, 18 bp, Homo sapiens
gtcctcctccagggacag

SEQ ID NO: 4706366 - DNA, 16 bp, Homo sapiens
gtcctcctctgtgaaa

SEQ ID NO: 4706367 - DNA, 22 bp, Homo sapiens
gtcctcctctgtgaaactggga

SEQ ID NO: 4706368 - DNA, 14 bp, Homo sapiens
gtcctctccaccta

SEQ ID NO: 4706369 - DNA, 20 bp, Homo sapiens
gtcctctccacctagtggct

SEQ ID NO: 4706370 - DNA, 19 bp, Homo sapiens
gtcctctccctcctggcca

SEQ ID NO: 4706371 - DNA, 20 bp, Homo sapiens
gtcctctccctcctggccag

SEQ ID NO: 4706372 - DNA, 17 bp, Homo sapiens
gtcctgacttcaggggc

SEQ ID NO: 4706373 - DNA, 23 bp, Homo sapiens
gtcctgcccttgctccagcctga

SEQ ID NO: 4706374 - DNA, 17 bp, Homo sapiens
gtcctgctgcagttgcc

SEQ ID NO: 4706375 - DNA, 17 bp, Homo sapiens
gtcctgggagtgagctg

SEQ ID NO: 4706376 - DNA, 19 bp, Homo sapiens
gtcctgggagtgagctggt

SEQ ID NO: 4706377 - DNA, 20 bp, Homo sapiens
gtcctggggaacctgacccc

SEQ ID NO: 4706378 - DNA, 15 bp, Homo sapiens
gtcctgtcagtgccg

SEQ ID NO: 4706379 - DNA, 13 bp, Homo sapiens
gtccttcaaaggc

SEQ ID NO: 4706380 - DNA, 12 bp, Homo sapiens
gtccttgaaaca

SEQ ID NO: 4706381 - DNA, 15 bp, Homo sapiens
gtcgcccaggctgga

SEQ ID NO: 4706382 - DNA, 23 bp, Homo sapiens
gtcgcccagtctggaatgcagtg

SEQ ID NO: 4706383 - DNA, 19 bp, Homo sapiens
gtcgcgagcacatgttcat

SEQ ID NO: 4706384 - DNA, 12 bp, Homo sapiens
gtcgcgctgcct

SEQ ID NO: 4706385 - DNA, 16 bp, Homo sapiens
gtcgctgggtcctctg

SEQ ID NO: 4706386 - DNA, 15 bp, Homo sapiens
gtcgggagaggggac

SEQ ID NO: 4706387 - DNA, 20 bp, Homo sapiens
gtcgggagaggggacgcagg

SEQ ID NO: 4706388 - DNA, 14 bp, Homo sapiens
gtcggtgccttcaa

SEQ ID NO: 4706389 - DNA, 16 bp, Homo sapiens
gtctaccagaagccag

SEQ ID NO: 4706390 - DNA, 20 bp, Homo sapiens
gtctactcattccccggggc

SEQ ID NO: 4706391 - DNA, 22 bp, Homo sapiens
gtctcaaactcttgacctcagg

SEQ ID NO: 4706392 - DNA, 16 bp, Homo sapiens
gtctcaattttgtatt

SEQ ID NO: 4706393 - DNA, 17 bp, Homo sapiens
gtctcaattttgtattt

SEQ ID NO: 4706394 - DNA, 23 bp, Homo sapiens
gtctcactatgttgcccaggcag

SEQ ID NO: 4706395 - DNA, 11 bp, Homo sapiens
gtctcactctg

SEQ ID NO: 4706396 - DNA, 16 bp, Homo sapiens
gtctcactctgtcgcc

SEQ ID NO: 4706397 - DNA, 13 bp, Homo sapiens
gtctcactgttgc

SEQ ID NO: 4706398 - DNA, 16 bp, Homo sapiens
gtctcactgttgccca

SEQ ID NO: 4706399 - DNA, 17 bp, Homo sapiens
gtctcactgttgcccag

SEQ ID NO: 4706400 - DNA, 18 bp, Homo sapiens
gtctcactgttgcccagg

SEQ ID NO: 4706401 - DNA, 22 bp, Homo sapiens
gtctcactgttgcccaggctgg

SEQ ID NO: 4706402 - DNA, 14 bp, Homo sapiens
gtctcagtttcttg

SEQ ID NO: 4706403 - DNA, 16 bp, Homo sapiens
gtctcatccatcatca

SEQ ID NO: 4706404 - DNA, 11 bp, Homo sapiens
gtctcatgtgt

SEQ ID NO: 4706405 - DNA, 21 bp, Homo sapiens
gtctccaaccccccagcactg

SEQ ID NO: 4706406 - DNA, 16 bp, Homo sapiens
gtctccctcccttggg

SEQ ID NO: 4706407 - DNA, 15 bp, Homo sapiens
gtctccctggccctc

SEQ ID NO: 4706408 - DNA, 18 bp, Homo sapiens
gtctccctggccctcaag

SEQ ID NO: 4706409 - DNA, 16 bp, Homo sapiens
gtggtgtttcctggca

SEQ ID NO: 4706410 - DNA, 14 bp, Homo sapiens
gtggttgaagagca

SEQ ID NO: 4706411 - DNA, 17 bp, Homo sapiens
gtggttgggctgtgcct

SEQ ID NO: 4706412 - DNA, 12 bp, Homo sapiens
gtggtttttatt

SEQ ID NO: 4706413 - DNA, 13 bp, Homo sapiens
gtgtaatattctc

SEQ ID NO: 4706414 - DNA, 16 bp, Homo sapiens
gtgtacagtcttgtat

SEQ ID NO: 4706415 - DNA, 22 bp, Homo sapiens
gtgtacagtcttgtattaagtt

SEQ ID NO: 4706416 - DNA, 17 bp, Homo sapiens
gtgtacccccgcccagg

SEQ ID NO: 4706417 - DNA, 19 bp, Homo sapiens
gtgtagaagcattccttct

SEQ ID NO: 4706418 - DNA, 21 bp, Homo sapiens
gtgtagtgttaaagtgaatct

SEQ ID NO: 4706419 - DNA, 15 bp, Homo sapiens
gtgtatatgtataaa

SEQ ID NO: 4706420 - DNA, 22 bp, Homo sapiens
gtgtcaactttcatttgaaagt

SEQ ID NO: 4706421 - DNA, 14 bp, Homo sapiens
gtgtcacctgtgct

SEQ ID NO: 4706422 - DNA, 13 bp, Homo sapiens
gtgtcactggctg

SEQ ID NO: 4706423 - DNA, 23 bp, Homo sapiens
gtgtcactggctgcctccactcc

SEQ ID NO: 4706424 - DNA, 19 bp, Homo sapiens
gtgtcaggtggggcagctt

SEQ ID NO: 4706425 - DNA, 21 bp, Homo sapiens
gtgtcatgattcacccccaaa

SEQ ID NO: 4706426 - DNA, 19 bp, Homo sapiens
gtgtctaggcaggacctgt

SEQ ID NO: 4706427 - DNA, 18 bp, Homo sapiens
gtgtctccaaccccccag

SEQ ID NO: 4706428 - DNA, 19 bp, Homo sapiens
gtgtctccaaccccccagc

SEQ ID NO: 4706429 - DNA, 22 bp, Homo sapiens
gtgtctcttggtcctgctgcag

SEQ ID NO: 4706430 - DNA, 21 bp, Homo sapiens
gtgtcttgcaatggcagcctt

SEQ ID NO: 4706431 - DNA, 21 bp, Homo sapiens
gtgtcttttctgtagagcata

SEQ ID NO: 4706432 - DNA, 18 bp, Homo sapiens
gtgtgccccccatcctgg

SEQ ID NO: 4706433 - DNA, 19 bp, Homo sapiens
gtgtgccccccatcctggc

SEQ ID NO: 4706434 - DNA, 21 bp, Homo sapiens
gtgtgccccccatcctggccc

SEQ ID NO: 4706435 - DNA, 22 bp, Homo sapiens
gtgtgccccccatcctggccca

SEQ ID NO: 4706436 - DNA, 23 bp, Homo sapiens
gtgtgccccccatcctggcccat

SEQ ID NO: 4706437 - DNA, 15 bp, Homo sapiens
gtgtgctctgatcat

SEQ ID NO: 4706438 - DNA, 22 bp, Homo sapiens
gtgtgctctgatcatccactgt

SEQ ID NO: 4706439 - DNA, 21 bp, Homo sapiens
gtgtgtagagttaagaagctg

SEQ ID NO: 4706440 - DNA, 18 bp, Homo sapiens
gtgtgtatgcgtgtgtgt

SEQ ID NO: 4706441 - DNA, 19 bp, Homo sapiens
gtgtgtccacgactgtctc

SEQ ID NO: 4706442 - DNA, 20 bp, Homo sapiens
gtgtgtccacgactgtctcc

SEQ ID NO: 4706443 - DNA, 16 bp, Homo sapiens
gtgtgtccccctctgt

SEQ ID NO: 4706444 - DNA, 18 bp, Homo sapiens
gtgtgtccccctctgtcc

SEQ ID NO: 4706445 - DNA, 23 bp, Homo sapiens
gtgtgtggtcaacatttctcatg

SEQ ID NO: 4706446 - DNA, 11 bp, Homo sapiens
gtgtgtgtact

SEQ ID NO: 4706447 - DNA, 19 bp, Homo sapiens
gtgtgtgtatgcgtgtgtg

SEQ ID NO: 4706448 - DNA, 14 bp, Homo sapiens
gtgtgtgtgtgaaa

SEQ ID NO: 4706449 - DNA, 14 bp, Homo sapiens
gtgtgttgatactg

SEQ ID NO: 4706450 - DNA, 23 bp, Homo sapiens
gtgtgttgatactgttgcacgtg

SEQ ID NO: 4706451 - DNA, 16 bp, Homo sapiens
gtgtgtttttctatta

SEQ ID NO: 4706452 - DNA, 20 bp, Homo sapiens
gtgttactaaaaaaaagatg

SEQ ID NO: 4706453 - DNA, 21 bp, Homo sapiens
gtgttactaaaaaaaagatga

SEQ ID NO: 4706454 - DNA, 19 bp, Homo sapiens
gtgttaggcctggcacagt

SEQ ID NO: 4706455 - DNA, 16 bp, Homo sapiens
gtgttagggaagggcc

SEQ ID NO: 4706456 - DNA, 22 bp, Homo sapiens
gtgttagggaagggcctgccac

SEQ ID NO: 4706457 - DNA, 14 bp, Homo sapiens
gtgttcattgtttc

SEQ ID NO: 4706458 - DNA, 18 bp, Homo sapiens
gtgttccccttccactga

SEQ ID NO: 4706459 - DNA, 22 bp, Homo sapiens
gtgttccccttccactgagggc

SEQ ID NO: 4706460 - DNA, 16 bp, Homo sapiens
gtgttgatactgttgc

SEQ ID NO: 4706461 - DNA, 18 bp, Homo sapiens
gtgttgatactgttgcac

SEQ ID NO: 4706462 - DNA, 20 bp, Homo sapiens
gtgttgatactgttgcacgt

SEQ ID NO: 4706463 - DNA, 23 bp, Homo sapiens
gtgttgatactgttgcacgtgtg

SEQ ID NO: 4706464 - DNA, 23 bp, Homo sapiens
gtgtttcctggcactgcttccag

SEQ ID NO: 4706465 - DNA, 14 bp, Homo sapiens
gtgttttaattgta

SEQ ID NO: 4706466 - DNA, 16 bp, Homo sapiens
gtgttttaattgtaaa

SEQ ID NO: 4706467 - DNA, 15 bp, Homo sapiens
gtgtttttctattaa

SEQ ID NO: 4706468 - DNA, 23 bp, Homo sapiens
gtgtttttctattaaaagactca

SEQ ID NO: 4706469 - DNA, 15 bp, Homo sapiens
gttaaatttgtaagt

SEQ ID NO: 4706470 - DNA, 19 bp, Homo sapiens
gttaaatttgtaagtttca

SEQ ID NO: 4706471 - DNA, 21 bp, Homo sapiens
gttaacactgtaatatcttta

SEQ ID NO: 4706472 - DNA, 13 bp, Homo sapiens
gttaagaagctgt

SEQ ID NO: 4706473 - DNA, 20 bp, Homo sapiens
gttaagaagctgttgtacat

SEQ ID NO: 4706474 - DNA, 21 bp, Homo sapiens
gttaagaagctgttgtacatt

SEQ ID NO: 4706475 - DNA, 19 bp, Homo sapiens
gttaaggaaactcttatct

SEQ ID NO: 4706476 - DNA, 23 bp, Homo sapiens
gttaatccacatctttactcagg

SEQ ID NO: 4706477 - DNA, 18 bp, Homo sapiens
gttaatgatagctactgt

SEQ ID NO: 4706478 - DNA, 20 bp, Homo sapiens
gttaatgtaatctgatggct

SEQ ID NO: 4706479 - DNA, 11 bp, Homo sapiens
gttaattttgg

SEQ ID NO: 4706480 - DNA, 23 bp, Homo sapiens
gttacataatcagtatatttggt

SEQ ID NO: 4706481 - DNA, 21 bp, Homo sapiens
gttaccattatttaatttgta

SEQ ID NO: 4706482 - DNA, 22 bp, Homo sapiens
gttacctgaaaacactgtgcac

SEQ ID NO: 4706483 - DNA, 21 bp, Homo sapiens
gttagattttgtattcagggg

SEQ ID NO: 4706484 - DNA, 15 bp, Homo sapiens
gttagggaaaacatt

SEQ ID NO: 4706485 - DNA, 20 bp, Homo sapiens
gttagggaaaacattccatc

SEQ ID NO: 4706486 - DNA, 24 bp, Homo sapiens
gttagttcaatctggattcatatt

SEQ ID NO: 4706487 - DNA, 16 bp, Homo sapiens
gttagtttctccaagc

SEQ ID NO: 4706488 - DNA, 14 bp, Homo sapiens
gttatattttgctg

SEQ ID NO: 4706489 - DNA, 16 bp, Homo sapiens
gttatcaccttccaaa

SEQ ID NO: 4706490 - DNA, 13 bp, Homo sapiens
gttatccagaagt

SEQ ID NO: 4706491 - DNA, 23 bp, Homo sapiens
gttatccagaagtattgtttaca

SEQ ID NO: 4706492 - DNA, 15 bp, Homo sapiens
gttatcgaaataaca

SEQ ID NO: 4706493 - DNA, 11 bp, Homo sapiens
gttatgactcc

SEQ ID NO: 4706494 - DNA, 17 bp, Homo sapiens
gttatgatggaaaggaa

SEQ ID NO: 4706495 - DNA, 17 bp, Homo sapiens
gttattatatttacaaa

SEQ ID NO: 4706496 - DNA, 19 bp, Homo sapiens
gttattatatttacaaatg

SEQ ID NO: 4706497 - DNA, 18 bp, Homo sapiens
gttattcataaagagaaa

SEQ ID NO: 4706498 - DNA, 23 bp, Homo sapiens
gttattcataaagagaaaatgat

SEQ ID NO: 4706499 - DNA, 13 bp, Homo sapiens
gttcaaagccagc

SEQ ID NO: 4706500 - DNA, 13 bp, Homo sapiens
gttcaacaaagaa

SEQ ID NO: 4706501 - DNA, 22 bp, Homo sapiens
gttcaacaaagaaacaaagatg

SEQ ID NO: 4706502 - DNA, 23 bp, Homo sapiens
gttcaacaaagaaacaaagatgt

SEQ ID NO: 4706503 - DNA, 20 bp, Homo sapiens
gttcaagcgattcttctgct

SEQ ID NO: 4706504 - DNA, 23 bp, Homo sapiens
gttcaagtgattctcatgcctca

SEQ ID NO: 4706505 - DNA, 23 bp, Homo sapiens
gttcaattctcatttgtcacaca

SEQ ID NO: 4706506 - DNA, 22 bp, Homo sapiens
gttcaccttcaaaatgttctat

SEQ ID NO: 4706507 - DNA, 16 bp, Homo sapiens
gttcacttttgacaaa

SEQ ID NO: 4706508 - DNA, 19 bp, Homo sapiens
gttcagctactttccattt

SEQ ID NO: 4706509 - DNA, 23 bp, Homo sapiens
gttcagcttgtaaatagctcagg

SEQ ID NO: 4706510 - DNA, 15 bp, Homo sapiens
gttcaggctctgaga

SEQ ID NO: 4706511 - DNA, 20 bp, Homo sapiens
gttcagggttggcccctgcc

SEQ ID NO: 4706512 - DNA, 21 bp, Homo sapiens
gttcagggttggcccctgccc

SEQ ID NO: 4706513 - DNA, 13 bp, Homo sapiens
gttcattcttgtt

SEQ ID NO: 4706514 - DNA, 20 bp, Homo sapiens
gttccaccatcaagccacca

SEQ ID NO: 4706515 - DNA, 23 bp, Homo sapiens
gttccagcaattctcctgcctca

SEQ ID NO: 4706516 - DNA, 13 bp, Homo sapiens
gttccccttccac

SEQ ID NO: 4706517 - DNA, 16 bp, Homo sapiens
taaatttgaactccat

SEQ ID NO: 4706518 - DNA, 21 bp, Homo sapiens
taaatttgaactccatgggat

SEQ ID NO: 4706519 - DNA, 13 bp, Homo sapiens
taaatttggagat

SEQ ID NO: 4706520 - DNA, 22 bp, Homo sapiens
taaatttgttgtcatgtgtatg

SEQ ID NO: 4706521 - DNA, 23 bp, Homo sapiens
taaatttgttgtcatgtgtatga

SEQ ID NO: 4706522 - DNA, 22 bp, Homo sapiens
taaattttgtgatgaataaaat

SEQ ID NO: 4706523 - DNA, 23 bp, Homo sapiens
taaattttgtgatgaataaaata

SEQ ID NO: 4706524 - DNA, 22 bp, Homo sapiens
taacaacctttcccatttcgtg

SEQ ID NO: 4706525 - DNA, 16 bp, Homo sapiens
taacaactatgatttg

SEQ ID NO: 4706526 - DNA, 19 bp, Homo sapiens
taacaagaactttaaattg

SEQ ID NO: 4706527 - DNA, 12 bp, Homo sapiens
taacaatgttaa

SEQ ID NO: 4706528 - DNA, 14 bp, Homo sapiens
taacaatgttaagg

SEQ ID NO: 4706529 - DNA, 19 bp, Homo sapiens
taacaatgttaaggaaact

SEQ ID NO: 4706530 - DNA, 23 bp, Homo sapiens
taacaatgttaaggaaactctta

SEQ ID NO: 4706531 - DNA, 14 bp, Homo sapiens
taacaattcctcta

SEQ ID NO: 4706532 - DNA, 21 bp, Homo sapiens
taacacagcattgtatatgtg

SEQ ID NO: 4706533 - DNA, 16 bp, Homo sapiens
taacactgtaatatct

SEQ ID NO: 4706534 - DNA, 16 bp, Homo sapiens
taacagaacagcttca

SEQ ID NO: 4706535 - DNA, 20 bp, Homo sapiens
taacagaacagcttcaggtt

SEQ ID NO: 4706536 - DNA, 20 bp, Homo sapiens
taacagttttagaatacatt

SEQ ID NO: 4706537 - DNA, 15 bp, Homo sapiens
taacatgtaggaagt

SEQ ID NO: 4706538 - DNA, 12 bp, Homo sapiens
taacattacctt

SEQ ID NO: 4706539 - DNA, 13 bp, Homo sapiens
taacattacctta

SEQ ID NO: 4706540 - DNA, 17 bp, Homo sapiens
taacattaccttactgt

SEQ ID NO: 4706541 - DNA, 19 bp, Homo sapiens
taacattcttttgtttata

SEQ ID NO: 4706542 - DNA, 15 bp, Homo sapiens
taacatttaggagaa

SEQ ID NO: 4706543 - DNA, 16 bp, Homo sapiens
taacatttaggagaag

SEQ ID NO: 4706544 - DNA, 16 bp, Homo sapiens
taaccaagttgtttat

SEQ ID NO: 4706545 - DNA, 15 bp, Homo sapiens
taaccataaatcaat

SEQ ID NO: 4706546 - DNA, 14 bp, Homo sapiens
taacccagatttta

SEQ ID NO: 4706547 - DNA, 21 bp, Homo sapiens
taacgattgacaccaaaatga

SEQ ID NO: 4706548 - DNA, 13 bp, Homo sapiens
taactactgtatt

SEQ ID NO: 4706549 - DNA, 12 bp, Homo sapiens
taactagaactg

SEQ ID NO: 4706550 - DNA, 20 bp, Homo sapiens
taactagaactgaattttgt

SEQ ID NO: 4706551 - DNA, 15 bp, Homo sapiens
taactagcttggaaa

SEQ ID NO: 4706552 - DNA, 23 bp, Homo sapiens
taactatgacagatatatttaag

SEQ ID NO: 4706553 - DNA, 17 bp, Homo sapiens
taactattgcccaggtt

SEQ ID NO: 4706554 - DNA, 14 bp, Homo sapiens
taactcaatatttt

SEQ ID NO: 4706555 - DNA, 16 bp, Homo sapiens
taactcacctaactca

SEQ ID NO: 4706556 - DNA, 17 bp, Homo sapiens
taactgcattttgtagc

SEQ ID NO: 4706557 - DNA, 17 bp, Homo sapiens
taacttacccttaggga

SEQ ID NO: 4706558 - DNA, 18 bp, Homo sapiens
taacttacccttagggag

SEQ ID NO: 4706559 - DNA, 13 bp, Homo sapiens
taacttcataaaa

SEQ ID NO: 4706560 - DNA, 16 bp, Homo sapiens
taagaaaaatattaat

SEQ ID NO: 4706561 - DNA, 16 bp, Homo sapiens
taagaaacaatttaaa

SEQ ID NO: 4706562 - DNA, 17 bp, Homo sapiens
taagaaacaatttaaat

SEQ ID NO: 4706563 - DNA, 13 bp, Homo sapiens
taagaaatagaat

SEQ ID NO: 4706564 - DNA, 17 bp, Homo sapiens
taagaagaagagaggca

SEQ ID NO: 4706565 - DNA, 18 bp, Homo sapiens
taagaagctgttgtacat

SEQ ID NO: 4706566 - DNA, 18 bp, Homo sapiens
taagaatagtagatgtgg

SEQ ID NO: 4706567 - DNA, 20 bp, Homo sapiens
taagaatagtctctgggttt

SEQ ID NO: 4706568 - DNA, 17 bp, Homo sapiens
taagaccaccacctcag

SEQ ID NO: 4706569 - DNA, 14 bp, Homo sapiens
taagacgacaagga

SEQ ID NO: 4706570 - DNA, 21 bp, Homo sapiens
taagagacagtcaccccagga

SEQ ID NO: 4706571 - DNA, 12 bp, Homo sapiens
taagaggcaggg

SEQ ID NO: 4706572 - DNA, 15 bp, Homo sapiens
taagaggcagggtct

SEQ ID NO: 4706573 - DNA, 22 bp, Homo sapiens
taagaggcagggtctcactctg

SEQ ID NO: 4706574 - DNA, 22 bp, Homo sapiens
taagagggagggagggctccag

SEQ ID NO: 4706575 - DNA, 17 bp, Homo sapiens
taagagggcacacactg

SEQ ID NO: 4706576 - DNA, 18 bp, Homo sapiens
taagagggcacacactgt

SEQ ID NO: 4706577 - DNA, 13 bp, Homo sapiens
taagagtgtagaa

SEQ ID NO: 4706578 - DNA, 18 bp, Homo sapiens
taagagtgtagaagcatt

SEQ ID NO: 4706579 - DNA, 19 bp, Homo sapiens
taagagtgtagaagcattc

SEQ ID NO: 4706580 - DNA, 23 bp, Homo sapiens
taagagtgtagaagcattccttc

SEQ ID NO: 4706581 - DNA, 16 bp, Homo sapiens
taagatttttctcaaa

SEQ ID NO: 4706582 - DNA, 18 bp, Homo sapiens
taagatttttctcaaagt

SEQ ID NO: 4706583 - DNA, 20 bp, Homo sapiens
taagatttttctcaaagttt

SEQ ID NO: 4706584 - DNA, 21 bp, Homo sapiens
taagcagagttctttgcaagc

SEQ ID NO: 4706585 - DNA, 18 bp, Homo sapiens
taagcaggaggaggtgcc

SEQ ID NO: 4706586 - DNA, 14 bp, Homo sapiens
taagcatgagtggc

SEQ ID NO: 4706587 - DNA, 17 bp, Homo sapiens
taagccacttaaaatgt

SEQ ID NO: 4706588 - DNA, 23 bp, Homo sapiens
taagccagcaccggaccagcctg

SEQ ID NO: 4706589 - DNA, 17 bp, Homo sapiens
taagccttataaaccaa

SEQ ID NO: 4706590 - DNA, 12 bp, Homo sapiens
taagccttgtcg

SEQ ID NO: 4706591 - DNA, 12 bp, Homo sapiens
taagctctgagc

SEQ ID NO: 4706592 - DNA, 20 bp, Homo sapiens
taaggaaacacttctattta

SEQ ID NO: 4706593 - DNA, 17 bp, Homo sapiens
taaggaaactcttatct

SEQ ID NO: 4706594 - DNA, 19 bp, Homo sapiens
taaggaaactcttatctca

SEQ ID NO: 4706595 - DNA, 20 bp, Homo sapiens
taaggaaactcttatctcag

SEQ ID NO: 4706596 - DNA, 15 bp, Homo sapiens
taaggaacatgtact

SEQ ID NO: 4706597 - DNA, 18 bp, Homo sapiens
taaggaaccctggaaact

SEQ ID NO: 4706598 - DNA, 13 bp, Homo sapiens
taaggactttttc

SEQ ID NO: 4706599 - DNA, 19 bp, Homo sapiens
taaggccattattgtactt

SEQ ID NO: 4706600 - DNA, 17 bp, Homo sapiens
taaggcgtggagctgcc

SEQ ID NO: 4706601 - DNA, 21 bp, Homo sapiens
taaggtatctggtatctgcat

SEQ ID NO: 4706602 - DNA, 15 bp, Homo sapiens
taaggtgtgctctga

SEQ ID NO: 4706603 - DNA, 19 bp, Homo sapiens
taagtataacaaactatgt

SEQ ID NO: 4706604 - DNA, 15 bp, Homo sapiens
taagtcctactttta

SEQ ID NO: 4706605 - DNA, 21 bp, Homo sapiens
taagtctcctttactgaatgt

SEQ ID NO: 4706606 - DNA, 16 bp, Homo sapiens
taagtctcgaatgtaa

SEQ ID NO: 4706607 - DNA, 17 bp, Homo sapiens
taagtgcgtgtgtagag

SEQ ID NO: 4706608 - DNA, 23 bp, Homo sapiens
taagtgcgtgtgtagagttaaga

SEQ ID NO: 4706609 - DNA, 14 bp, Homo sapiens
taagtgtaaaagta

SEQ ID NO: 4706610 - DNA, 17 bp, Homo sapiens
taagttacaattacatc

SEQ ID NO: 4706611 - DNA, 21 bp, Homo sapiens
taagttacacatttttcagat

SEQ ID NO: 4706612 - DNA, 18 bp, Homo sapiens
taagtttcaggtgacatg

SEQ ID NO: 4706613 - DNA, 20 bp, Homo sapiens
taagtttcaggtgacatgtg

SEQ ID NO: 4706614 - DNA, 22 bp, Homo sapiens
taagtttcaggtgacatgtgaa

SEQ ID NO: 4706615 - DNA, 18 bp, Homo sapiens
taagtttgtgaatgtgac

SEQ ID NO: 4706616 - DNA, 14 bp, Homo sapiens
taagttttatttaa

SEQ ID NO: 4706617 - DNA, 14 bp, Homo sapiens
taataaatcacaca

SEQ ID NO: 4706618 - DNA, 20 bp, Homo sapiens
taataacattaccttactgt

SEQ ID NO: 4706619 - DNA, 12 bp, Homo sapiens
taataagacata

SEQ ID NO: 4706620 - DNA, 20 bp, Homo sapiens
taataagacataacgttttt

SEQ ID NO: 4706621 - DNA, 22 bp, Homo sapiens
taataagacataacgtttttcc

SEQ ID NO: 4706622 - DNA, 13 bp, Homo sapiens
taatacctccctt

SEQ ID NO: 4706623 - DNA, 18 bp, Homo sapiens
taatagagagattagtaa

SEQ ID NO: 4706624 - DNA, 19 bp, Homo sapiens
taatagcgtcataactaga

SEQ ID NO: 4706625 - DNA, 22 bp, Homo sapiens
taatataagaagctttcagtat

SEQ ID NO: 4706626 - DNA, 20 bp, Homo sapiens
taatatctattccatttgta

SEQ ID NO: 4706627 - DNA, 17 bp, Homo sapiens
tagagattacctcctga

SEQ ID NO: 4706628 - DNA, 21 bp, Homo sapiens
tagagattacctcctgagaaa

SEQ ID NO: 4706629 - DNA, 19 bp, Homo sapiens
tagagcagccctggagtca

SEQ ID NO: 4706630 - DNA, 11 bp, Homo sapiens
tagagcaggcg

SEQ ID NO: 4706631 - DNA, 17 bp, Homo sapiens
tagagtcaatttgctga

SEQ ID NO: 4706632 - DNA, 21 bp, Homo sapiens
tagagtcaatttgctgaaaac

SEQ ID NO: 4706633 - DNA, 12 bp, Homo sapiens
tagagttaagaa

SEQ ID NO: 4706634 - DNA, 16 bp, Homo sapiens
tagatcactgtgctta

SEQ ID NO: 4706635 - DNA, 13 bp, Homo sapiens
tagatgatatgtt

SEQ ID NO: 4706636 - DNA, 13 bp, Homo sapiens
tagatggaaaaat

SEQ ID NO: 4706637 - DNA, 15 bp, Homo sapiens
tagatggaaaaatgt

SEQ ID NO: 4706638 - DNA, 13 bp, Homo sapiens
tagatttgaccta

SEQ ID NO: 4706639 - DNA, 18 bp, Homo sapiens
tagcacagaccctgccct

SEQ ID NO: 4706640 - DNA, 20 bp, Homo sapiens
tagcacagaccctgccctgt

SEQ ID NO: 4706641 - DNA, 22 bp, Homo sapiens
tagcacagaccctgccctgtgg

SEQ ID NO: 4706642 - DNA, 24 bp, Homo sapiens
tagcacagaccctgccctgtgggc

SEQ ID NO: 4706643 - DNA, 13 bp, Homo sapiens
tagcaccagggaa

SEQ ID NO: 4706644 - DNA, 20 bp, Homo sapiens
tagcactagacatgtcatgg

SEQ ID NO: 4706645 - DNA, 19 bp, Homo sapiens
tagcagagaatgaaagggc

SEQ ID NO: 4706646 - DNA, 11 bp, Homo sapiens
tagcagggaaa

SEQ ID NO: 4706647 - DNA, 14 bp, Homo sapiens
tagcagggaaaata

SEQ ID NO: 4706648 - DNA, 20 bp, Homo sapiens
tagcagtaaaagataaattt

SEQ ID NO: 4706649 - DNA, 14 bp, Homo sapiens
tagcagttgctcac

SEQ ID NO: 4706650 - DNA, 15 bp, Homo sapiens
tagcatgaaataaaa

SEQ ID NO: 4706651 - DNA, 15 bp, Homo sapiens
tagccaggatcatgg

SEQ ID NO: 4706652 - DNA, 18 bp, Homo sapiens
tagccaggatcatggtgt

SEQ ID NO: 4706653 - DNA, 16 bp, Homo sapiens
tagccagttgaattta

SEQ ID NO: 4706654 - DNA, 13 bp, Homo sapiens
tagccatgggacc

SEQ ID NO: 4706655 - DNA, 14 bp, Homo sapiens
tagcccctctctta

SEQ ID NO: 4706656 - DNA, 15 bp, Homo sapiens
tagcctcgatgtcct

SEQ ID NO: 4706657 - DNA, 22 bp, Homo sapiens
tagcctcgatgtcctcctctgt

SEQ ID NO: 4706658 - DNA, 15 bp, Homo sapiens
tagcctctctttgtt

SEQ ID NO: 4706659 - DNA, 15 bp, Homo sapiens
tagctaaaagacaaa

SEQ ID NO: 4706660 - DNA, 13 bp, Homo sapiens
tagctaattattt

SEQ ID NO: 4706661 - DNA, 12 bp, Homo sapiens
tagctacatcag

SEQ ID NO: 4706662 - DNA, 12 bp, Homo sapiens
tagctatttaat

SEQ ID NO: 4706663 - DNA, 22 bp, Homo sapiens
tagctatttaatactaattttc

SEQ ID NO: 4706664 - DNA, 21 bp, Homo sapiens
tagctcaggtgtccctgcact

SEQ ID NO: 4706665 - DNA, 17 bp, Homo sapiens
tagctctacacaacatg

SEQ ID NO: 4706666 - DNA, 12 bp, Homo sapiens
tagctgggacta

SEQ ID NO: 4706667 - DNA, 18 bp, Homo sapiens
tagctgggactacaggtg

SEQ ID NO: 4706668 - DNA, 19 bp, Homo sapiens
tagctgtaggttttctgtg

SEQ ID NO: 4706669 - DNA, 15 bp, Homo sapiens
tagctgttgtaaaga

SEQ ID NO: 4706670 - DNA, 23 bp, Homo sapiens
tagcttaagaggcctgtgattat

SEQ ID NO: 4706671 - DNA, 13 bp, Homo sapiens
tagcttagagcct

SEQ ID NO: 4706672 - DNA, 17 bp, Homo sapiens
tagcttagagcctccct

SEQ ID NO: 4706673 - DNA, 20 bp, Homo sapiens
tagcttggaaactggatgag

SEQ ID NO: 4706674 - DNA, 16 bp, Homo sapiens
taggaaaaaattgaaa

SEQ ID NO: 4706675 - DNA, 16 bp, Homo sapiens
taggaaatccagggtg

SEQ ID NO: 4706676 - DNA, 17 bp, Homo sapiens
taggaacactccttcac

SEQ ID NO: 4706677 - DNA, 13 bp, Homo sapiens
taggaagactttg

SEQ ID NO: 4706678 - DNA, 17 bp, Homo sapiens
taggaagactttggaaa

SEQ ID NO: 4706679 - DNA, 16 bp, Homo sapiens
taggacgccacccagc

SEQ ID NO: 4706680 - DNA, 22 bp, Homo sapiens
taggagaggatgagagcccaga

SEQ ID NO: 4706681 - DNA, 17 bp, Homo sapiens
taggcaggaacatacag

SEQ ID NO: 4706682 - DNA, 16 bp, Homo sapiens
taggcaggacatgctg

SEQ ID NO: 4706683 - DNA, 22 bp, Homo sapiens
taggcaggacatgctgaagcca

SEQ ID NO: 4706684 - DNA, 15 bp, Homo sapiens
taggcaggacctgtg

SEQ ID NO: 4706685 - DNA, 17 bp, Homo sapiens
taggcctggcacagtgt

SEQ ID NO: 4706686 - DNA, 18 bp, Homo sapiens
taggcctggccagatgca

SEQ ID NO: 4706687 - DNA, 19 bp, Homo sapiens
taggcttttaccattagca

SEQ ID NO: 4706688 - DNA, 20 bp, Homo sapiens
tagggaaaaaaatgcttctt

SEQ ID NO: 4706689 - DNA, 13 bp, Homo sapiens
tagggaaaacatt

SEQ ID NO: 4706690 - DNA, 21 bp, Homo sapiens
tagggaatggcacagcccaaa

SEQ ID NO: 4706691 - DNA, 15 bp, Homo sapiens
tagggacccctcctc

SEQ ID NO: 4706692 - DNA, 20 bp, Homo sapiens
tagggactcaatttctcccc

SEQ ID NO: 4706693 - DNA, 21 bp, Homo sapiens
tagggaggcctttagcttaag

SEQ ID NO: 4706694 - DNA, 23 bp, Homo sapiens
tagggccaagcccagcactgctt

SEQ ID NO: 4706695 - DNA, 13 bp, Homo sapiens
tagggtccttgaa

SEQ ID NO: 4706696 - DNA, 14 bp, Homo sapiens
tagggttaaatggt

SEQ ID NO: 4706697 - DNA, 15 bp, Homo sapiens
taggtggcaaggctg

SEQ ID NO: 4706698 - DNA, 19 bp, Homo sapiens
taggttttctgtgtttagc

SEQ ID NO: 4706699 - DNA, 13 bp, Homo sapiens
tagtaaaaataaa

SEQ ID NO: 4706700 - DNA, 16 bp, Homo sapiens
tagtaaaaataaaatt

SEQ ID NO: 4706701 - DNA, 21 bp, Homo sapiens
tagtaaaagtcataaatgcat

SEQ ID NO: 4706702 - DNA, 13 bp, Homo sapiens
tagtaaatatgtg

SEQ ID NO: 4706703 - DNA, 13 bp, Homo sapiens
tagtaaattttgt

SEQ ID NO: 4706704 - DNA, 16 bp, Homo sapiens
tagtagaactggatcc

SEQ ID NO: 4706705 - DNA, 20 bp, Homo sapiens
tagtagaactggatcccaac

SEQ ID NO: 4706706 - DNA, 14 bp, Homo sapiens
tagtagagacaggg

SEQ ID NO: 4706707 - DNA, 15 bp, Homo sapiens
tagtagagacagggt

SEQ ID NO: 4706708 - DNA, 21 bp, Homo sapiens
tagtagccaaagttaaatgta

SEQ ID NO: 4706709 - DNA, 15 bp, Homo sapiens
tagtatctatatgac

SEQ ID NO: 4706710 - DNA, 17 bp, Homo sapiens
tagtattttaatcctgt

SEQ ID NO: 4706711 - DNA, 22 bp, Homo sapiens
tagtcaatgtaaaaatacacta

SEQ ID NO: 4706712 - DNA, 14 bp, Homo sapiens
tagtcactgagaca

SEQ ID NO: 4706713 - DNA, 14 bp, Homo sapiens
tagtccctgtgttc

SEQ ID NO: 4706714 - DNA, 12 bp, Homo sapiens
tagtcccttcca

SEQ ID NO: 4706715 - DNA, 22 bp, Homo sapiens
tagtgcttcttgtaatatttct

SEQ ID NO: 4706716 - DNA, 20 bp, Homo sapiens
tagtggcttcattagagcag

SEQ ID NO: 4706717 - DNA, 19 bp, Homo sapiens
tagtggtctttgtaagagt

SEQ ID NO: 4706718 - DNA, 23 bp, Homo sapiens
tagtggtctttgtaagagtgtag

SEQ ID NO: 4706719 - DNA, 13 bp, Homo sapiens
tagttaaaagcct

SEQ ID NO: 4706720 - DNA, 14 bp, Homo sapiens
tagttaaaagcctt

SEQ ID NO: 4706721 - DNA, 15 bp, Homo sapiens
tagttaaaatgctga

SEQ ID NO: 4706722 - DNA, 19 bp, Homo sapiens
tagttatacttatttgtat

SEQ ID NO: 4706723 - DNA, 18 bp, Homo sapiens
tagttcaggtaacaggca

SEQ ID NO: 4706724 - DNA, 16 bp, Homo sapiens
tagttccagagggttg

SEQ ID NO: 4706725 - DNA, 19 bp, Homo sapiens
tagttctcagctcttctga

SEQ ID NO: 4706726 - DNA, 14 bp, Homo sapiens
tagttgtctttctt

SEQ ID NO: 4706727 - DNA, 16 bp, Homo sapiens
tagttgtggaaagata

SEQ ID NO: 4706728 - DNA, 20 bp, Homo sapiens
tagttgtttgattcagacag

SEQ ID NO: 4706729 - DNA, 13 bp, Homo sapiens
tagtttctccaag

SEQ ID NO: 4706730 - DNA, 19 bp, Homo sapiens
tataaaaaatggtgcctga

SEQ ID NO: 4706731 - DNA, 21 bp, Homo sapiens
tataaaaacatgagttattca

SEQ ID NO: 4706732 - DNA, 14 bp, Homo sapiens
tataaaagactgac

SEQ ID NO: 4706733 - DNA, 23 bp, Homo sapiens
tataaaatatgaagacataaacc

SEQ ID NO: 4706734 - DNA, 22 bp, Homo sapiens
tataaacctctaatttattttg

SEQ ID NO: 4706735 - DNA, 23 bp, Homo sapiens
tataaactgagaggtcacaaaga

SEQ ID NO: 4706736 - DNA, 15 bp, Homo sapiens
tataaagattaacac

SEQ ID NO: 4706737 - DNA, 17 bp, Homo sapiens
tatttttaattaaataa

SEQ ID NO: 4706738 - DNA, 19 bp, Homo sapiens
tattttttcttttctttac

SEQ ID NO: 4706739 - DNA, 17 bp, Homo sapiens
tcaaaaactaaaatcat

SEQ ID NO: 4706740 - DNA, 11 bp, Homo sapiens
tcaaaaagaaa

SEQ ID NO: 4706741 - DNA, 12 bp, Homo sapiens
tcaaaaagaaaa

SEQ ID NO: 4706742 - DNA, 17 bp, Homo sapiens
tcaaaagaaatagaaaa

SEQ ID NO: 4706743 - DNA, 21 bp, Homo sapiens
tcaaaagaaatagaaaaggaa

SEQ ID NO: 4706744 - DNA, 19 bp, Homo sapiens
tcaaaattaatatgattat

SEQ ID NO: 4706745 - DNA, 16 bp, Homo sapiens
tcaaacatgaaaacat

SEQ ID NO: 4706746 - DNA, 20 bp, Homo sapiens
tcaaaccaaatcactgaact

SEQ ID NO: 4706747 - DNA, 19 bp, Homo sapiens
tcaaaccttgaggagaagt

SEQ ID NO: 4706748 - DNA, 21 bp, Homo sapiens
tcaaactgtgggattctgatt

SEQ ID NO: 4706749 - DNA, 16 bp, Homo sapiens
tcaaagaaaaacaatg

SEQ ID NO: 4706750 - DNA, 12 bp, Homo sapiens
tcaaagaaattt

SEQ ID NO: 4706751 - DNA, 13 bp, Homo sapiens
tcaaagaaatttc

SEQ ID NO: 4706752 - DNA, 10 bp, Homo sapiens
tcaaagcaga

SEQ ID NO: 4706753 - DNA, 12 bp, Homo sapiens
tcaaagccagcg

SEQ ID NO: 4706754 - DNA, 14 bp, Homo sapiens
tcaaagctgaaatg

SEQ ID NO: 4706755 - DNA, 13 bp, Homo sapiens
tcaaagtcattaa

SEQ ID NO: 4706756 - DNA, 17 bp, Homo sapiens
tcaaagtcattaaagac

SEQ ID NO: 4706757 - DNA, 18 bp, Homo sapiens
tcaaagtcattaaagaca

SEQ ID NO: 4706758 - DNA, 21 bp, Homo sapiens
tcaaagtctgctctcatataa

SEQ ID NO: 4706759 - DNA, 17 bp, Homo sapiens
tcaaagttaaaagtaaa

SEQ ID NO: 4706760 - DNA, 18 bp, Homo sapiens
tcaaagttttgaaaagct

SEQ ID NO: 4706761 - DNA, 17 bp, Homo sapiens
tcaaatggaagacacat

SEQ ID NO: 4706762 - DNA, 18 bp, Homo sapiens
tcaaattcaatgattctt

SEQ ID NO: 4706763 - DNA, 20 bp, Homo sapiens
tcaaattcaatgattcttcc

SEQ ID NO: 4706764 - DNA, 14 bp, Homo sapiens
tcaaatttacattt

SEQ ID NO: 4706765 - DNA, 20 bp, Homo sapiens
tcaaattttgagcaaagaaa

SEQ ID NO: 4706766 - DNA, 20 bp, Homo sapiens
tcaacaaagaaacaaagatg

SEQ ID NO: 4706767 - DNA, 17 bp, Homo sapiens
tcaacactatatatttt

SEQ ID NO: 4706768 - DNA, 12 bp, Homo sapiens
tcaacatctttt

SEQ ID NO: 4706769 - DNA, 16 bp, Homo sapiens
tcaacattaaggcagt

SEQ ID NO: 4706770 - DNA, 17 bp, Homo sapiens
tcaacatttctcatgtt

SEQ ID NO: 4706771 - DNA, 15 bp, Homo sapiens
tcaacccaggagcat

SEQ ID NO: 4706772 - DNA, 20 bp, Homo sapiens
tcaaccccttcgctcctgtg

SEQ ID NO: 4706773 - DNA, 23 bp, Homo sapiens
tcaaccccttcgctcctgtgtct

SEQ ID NO: 4706774 - DNA, 15 bp, Homo sapiens
tcaacctcctgggct

SEQ ID NO: 4706775 - DNA, 15 bp, Homo sapiens
tcaactccctgcccc

SEQ ID NO: 4706776 - DNA, 21 bp, Homo sapiens
tcaactccctgccccccagcc

SEQ ID NO: 4706777 - DNA, 19 bp, Homo sapiens
tcaactggttgtatatttt

SEQ ID NO: 4706778 - DNA, 18 bp, Homo sapiens
tcaacttcagtactcaaa

SEQ ID NO: 4706779 - DNA, 14 bp, Homo sapiens
tcaactttcatttg

SEQ ID NO: 4706780 - DNA, 17 bp, Homo sapiens
tcaactttcatttgaaa

SEQ ID NO: 4706781 - DNA, 21 bp, Homo sapiens
tcaagaaagatatctatgact

SEQ ID NO: 4706782 - DNA, 19 bp, Homo sapiens
tcaagactggaaggtgggg

SEQ ID NO: 4706783 - DNA, 22 bp, Homo sapiens
tcaagcaggtttcttgcttctg

SEQ ID NO: 4706784 - DNA, 18 bp, Homo sapiens
tcaagcgattcttctgct

SEQ ID NO: 4706785 - DNA, 20 bp, Homo sapiens
tcaaggactggtaaaataca

SEQ ID NO: 4706786 - DNA, 21 bp, Homo sapiens
tcaaggactggtaaaatacat

SEQ ID NO: 4706787 - DNA, 16 bp, Homo sapiens
tcaaggcctcccacag

SEQ ID NO: 4706788 - DNA, 19 bp, Homo sapiens
tcaaggcctcccacagtga

SEQ ID NO: 4706789 - DNA, 21 bp, Homo sapiens
tcaagggaattaaataaataa

SEQ ID NO: 4706790 - DNA, 17 bp, Homo sapiens
tcaagggaccctgggtg

SEQ ID NO: 4706791 - DNA, 19 bp, Homo sapiens
tcaagggaccctgggtggg

SEQ ID NO: 4706792 - DNA, 20 bp, Homo sapiens
tcaagggaccctgggtggga

SEQ ID NO: 4706793 - DNA, 16 bp, Homo sapiens
tcaagtgagtggcatg

SEQ ID NO: 4706794 - DNA, 21 bp, Homo sapiens
tcaagtgattctcctgcctca

SEQ ID NO: 4706795 - DNA, 14 bp, Homo sapiens
tcaagttccagtgc

SEQ ID NO: 4706796 - DNA, 14 bp, Homo sapiens
tcaataagccttgt

SEQ ID NO: 4706797 - DNA, 22 bp, Homo sapiens
tcaatatttttatttttaactc

SEQ ID NO: 4706798 - DNA, 19 bp, Homo sapiens
tcaatgagagcataattta

SEQ ID NO: 4706799 - DNA, 17 bp, Homo sapiens
tcaatgctataactatg

SEQ ID NO: 4706800 - DNA, 18 bp, Homo sapiens
tcaatggtttgcaaggaa

SEQ ID NO: 4706801 - DNA, 17 bp, Homo sapiens
tcaattcaacactccct

SEQ ID NO: 4706802 - DNA, 19 bp, Homo sapiens
tcaattcttccctatcttt

SEQ ID NO: 4706803 - DNA, 16 bp, Homo sapiens
tcaattcttgccaaat

SEQ ID NO: 4706804 - DNA, 14 bp, Homo sapiens
tcaatttctcccca

SEQ ID NO: 4706805 - DNA, 14 bp, Homo sapiens
tcaatttgctgaaa

SEQ ID NO: 4706806 - DNA, 13 bp, Homo sapiens
tcaattttgtatt

SEQ ID NO: 4706807 - DNA, 14 bp, Homo sapiens
tcaattttgtattt

SEQ ID NO: 4706808 - DNA, 17 bp, Homo sapiens
tcaattttgtatttaat

SEQ ID NO: 4706809 - DNA, 23 bp, Homo sapiens
tcaatttttttgtgtgtgtttct

SEQ ID NO: 4706810 - DNA, 18 bp, Homo sapiens
tcacaaaagctgtgtctc

SEQ ID NO: 4706811 - DNA, 12 bp, Homo sapiens
tcacaattatta

SEQ ID NO: 4706812 - DNA, 18 bp, Homo sapiens
tcacacatgccactatga

SEQ ID NO: 4706813 - DNA, 15 bp, Homo sapiens
tcacacctagcgtca

SEQ ID NO: 4706814 - DNA, 22 bp, Homo sapiens
tcacacgtctggcttcacagat

SEQ ID NO: 4706815 - DNA, 15 bp, Homo sapiens
tcacactaaaattta

SEQ ID NO: 4706816 - DNA, 23 bp, Homo sapiens
tcacactgagaatgtaagaacta

SEQ ID NO: 4706817 - DNA, 14 bp, Homo sapiens
tcacagatgggtgc

SEQ ID NO: 4706818 - DNA, 23 bp, Homo sapiens
tcacagatgtgtgattcacagtg

SEQ ID NO: 4706819 - DNA, 17 bp, Homo sapiens
tcacagcttgtattttg

SEQ ID NO: 4706820 - DNA, 12 bp, Homo sapiens
tcacaggcaggt

SEQ ID NO: 4706821 - DNA, 19 bp, Homo sapiens
tcacagtccttaccagcag

SEQ ID NO: 4706822 - DNA, 15 bp, Homo sapiens
tcacatatctgtcat

SEQ ID NO: 4706823 - DNA, 18 bp, Homo sapiens
tcacatctgaatctcctt

SEQ ID NO: 4706824 - DNA, 14 bp, Homo sapiens
tcacatgttctaat

SEQ ID NO: 4706825 - DNA, 14 bp, Homo sapiens
tcacatttattctg

SEQ ID NO: 4706826 - DNA, 19 bp, Homo sapiens
tcacatttattctgctcac

SEQ ID NO: 4706827 - DNA, 19 bp, Homo sapiens
tcacattttctcagtgtgc

SEQ ID NO: 4706828 - DNA, 20 bp, Homo sapiens
tcaccacatgcggagaacaa

SEQ ID NO: 4706829 - DNA, 16 bp, Homo sapiens
tcaccacatgtgcaca

SEQ ID NO: 4706830 - DNA, 16 bp, Homo sapiens
tcaccacgtggggcca

SEQ ID NO: 4706831 - DNA, 13 bp, Homo sapiens
tcaccagccccag

SEQ ID NO: 4706832 - DNA, 17 bp, Homo sapiens
tcaccagccccagtgcc

SEQ ID NO: 4706833 - DNA, 15 bp, Homo sapiens
tcaccatccttagac

SEQ ID NO: 4706834 - DNA, 14 bp, Homo sapiens
tcaccatctgtgca

SEQ ID NO: 4706835 - DNA, 22 bp, Homo sapiens
tcaccatgttggccaggctggt

SEQ ID NO: 4706836 - DNA, 17 bp, Homo sapiens
tcaccatttgattatgt

SEQ ID NO: 4706837 - DNA, 13 bp, Homo sapiens
tcaccccagcccc

SEQ ID NO: 4706838 - DNA, 16 bp, Homo sapiens
tcacccccttctccat

SEQ ID NO: 4706839 - DNA, 14 bp, Homo sapiens
tcacccctcccttt

SEQ ID NO: 4706840 - DNA, 18 bp, Homo sapiens
tcacccctccctttctcc

SEQ ID NO: 4706841 - DNA, 18 bp, Homo sapiens
tcacccctggttctcatc

SEQ ID NO: 4706842 - DNA, 21 bp, Homo sapiens
tcacccctggttctcatcttt

SEQ ID NO: 4706843 - DNA, 22 bp, Homo sapiens
tcacccctggttctcatctttc

SEQ ID NO: 4706844 - DNA, 13 bp, Homo sapiens
tcaccgtgggctc

SEQ ID NO: 4706845 - DNA, 17 bp, Homo sapiens
tcacctaaaccctctgt

SEQ ID NO: 4706846 - DNA, 17 bp, Homo sapiens
tcacctggggctgctgg

SEQ ID NO: 4706847 - DNA, 18 bp, Homo sapiens
tcattggataaatttgaa

SEQ ID NO: 4706848 - DNA, 23 bp, Homo sapiens
tcattggttaaaatattactgat

SEQ ID NO: 4706849 - DNA, 13 bp, Homo sapiens
tcatttactgtgg

SEQ ID NO: 4706850 - DNA, 15 bp, Homo sapiens
tcatttactgtggct

SEQ ID NO: 4706851 - DNA, 13 bp, Homo sapiens
tcatttagagttt

SEQ ID NO: 4706852 - DNA, 14 bp, Homo sapiens
tcatttcacccctc

SEQ ID NO: 4706853 - DNA, 16 bp, Homo sapiens
tcatttcaggagcagc

SEQ ID NO: 4706854 - DNA, 19 bp, Homo sapiens
tcatttcctctgagctgtt

SEQ ID NO: 4706855 - DNA, 21 bp, Homo sapiens
tcatttcctctgagctgttat

SEQ ID NO: 4706856 - DNA, 18 bp, Homo sapiens
tcatttcctgggagaaag

SEQ ID NO: 4706857 - DNA, 18 bp, Homo sapiens
tcatttctcatggatttg

SEQ ID NO: 4706858 - DNA, 20 bp, Homo sapiens
tcattttttatgtattgttt

SEQ ID NO: 4706859 - DNA, 13 bp, Homo sapiens
tcatttttttcca

SEQ ID NO: 4706860 - DNA, 18 bp, Homo sapiens
tcatttttttccaggctg

SEQ ID NO: 4706861 - DNA, 18 bp, Homo sapiens
tccaaagagtgtggaatt

SEQ ID NO: 4706862 - DNA, 13 bp, Homo sapiens
tccaaagcagggt

SEQ ID NO: 4706863 - DNA, 22 bp, Homo sapiens
tccaaaggccatggagagctgg

SEQ ID NO: 4706864 - DNA, 18 bp, Homo sapiens
tccaaataaaaattagat

SEQ ID NO: 4706865 - DNA, 13 bp, Homo sapiens
tccaaatgcattc

SEQ ID NO: 4706866 - DNA, 19 bp, Homo sapiens
tccaaatgcattcatgttt

SEQ ID NO: 4706867 - DNA, 19 bp, Homo sapiens
tccaaatgtgtataatttt

SEQ ID NO: 4706868 - DNA, 18 bp, Homo sapiens
tccaaccccccagcactg

SEQ ID NO: 4706869 - DNA, 19 bp, Homo sapiens
tccaaccccccagcactga

SEQ ID NO: 4706870 - DNA, 20 bp, Homo sapiens
tccaaccccccagcactgag

SEQ ID NO: 4706871 - DNA, 21 bp, Homo sapiens
tccaaccccccagcactgagg

SEQ ID NO: 4706872 - DNA, 22 bp, Homo sapiens
tccaaccccccagcactgagga

SEQ ID NO: 4706873 - DNA, 17 bp, Homo sapiens
tccaaccctcatcacca

SEQ ID NO: 4706874 - DNA, 16 bp, Homo sapiens
tccaagaagcccagga

SEQ ID NO: 4706875 - DNA, 17 bp, Homo sapiens
tccaagagtctgatgat

SEQ ID NO: 4706876 - DNA, 14 bp, Homo sapiens
tccaagctcccagg

SEQ ID NO: 4706877 - DNA, 11 bp, Homo sapiens
tccaagctggt

SEQ ID NO: 4706878 - DNA, 16 bp, Homo sapiens
tccaaggtggggtgga

SEQ ID NO: 4706879 - DNA, 15 bp, Homo sapiens
tccaaggtttataaa

SEQ ID NO: 4706880 - DNA, 21 bp, Homo sapiens
tccaaggtttataaagcagat

SEQ ID NO: 4706881 - DNA, 14 bp, Homo sapiens
tccaagtggctgtg

SEQ ID NO: 4706882 - DNA, 21 bp, Homo sapiens
tccaagtttactcaaccctct

SEQ ID NO: 4706883 - DNA, 14 bp, Homo sapiens
tccaatcatacaaa

SEQ ID NO: 4706884 - DNA, 22 bp, Homo sapiens
tccaattaatgaagttgattca

SEQ ID NO: 4706885 - DNA, 14 bp, Homo sapiens
tccacacctgcggc

SEQ ID NO: 4706886 - DNA, 18 bp, Homo sapiens
tccacacctgcggcccaa

SEQ ID NO: 4706887 - DNA, 13 bp, Homo sapiens
tccacaggaagtg

SEQ ID NO: 4706888 - DNA, 20 bp, Homo sapiens
tccacagtggaaccagccca

SEQ ID NO: 4706889 - DNA, 13 bp, Homo sapiens
tccacatcctcca

SEQ ID NO: 4706890 - DNA, 15 bp, Homo sapiens
tccaccatcaagcca

SEQ ID NO: 4706891 - DNA, 18 bp, Homo sapiens
tccacccacctcagcctc

SEQ ID NO: 4706892 - DNA, 12 bp, Homo sapiens
tccacccaggag

SEQ ID NO: 4706893 - DNA, 20 bp, Homo sapiens
tccacccaggagccccgagg

SEQ ID NO: 4706894 - DNA, 20 bp, Homo sapiens
tccacctagtggctgtccag

SEQ ID NO: 4706895 - DNA, 21 bp, Homo sapiens
tccacctagtggctgtccagt

SEQ ID NO: 4706896 - DNA, 12 bp, Homo sapiens
tccacctccttc

SEQ ID NO: 4706897 - DNA, 18 bp, Homo sapiens
tccacctgccagggacag

SEQ ID NO: 4706898 - DNA, 15 bp, Homo sapiens
tccacgactgtctcc

SEQ ID NO: 4706899 - DNA, 15 bp, Homo sapiens
tccacggagccactc

SEQ ID NO: 4706900 - DNA, 14 bp, Homo sapiens
tccacgtgtatgca

SEQ ID NO: 4706901 - DNA, 18 bp, Homo sapiens
tccactatttgcagaggc

SEQ ID NO: 4706902 - DNA, 13 bp, Homo sapiens
tccactcccactt

SEQ ID NO: 4706903 - DNA, 19 bp, Homo sapiens
tccactcccaggcagccct

SEQ ID NO: 4706904 - DNA, 12 bp, Homo sapiens
tccactctcccc

SEQ ID NO: 4706905 - DNA, 13 bp, Homo sapiens
tccactctccccc

SEQ ID NO: 4706906 - DNA, 14 bp, Homo sapiens
tccactctccccca

SEQ ID NO: 4706907 - DNA, 21 bp, Homo sapiens
tccactgtgccatgtgccagg

SEQ ID NO: 4706908 - DNA, 22 bp, Homo sapiens
tccactgtgccatgtgccaggt

SEQ ID NO: 4706909 - DNA, 17 bp, Homo sapiens
tccacttgttcattctg

SEQ ID NO: 4706910 - DNA, 21 bp, Homo sapiens
tccagaaagaaaatgaatttg

SEQ ID NO: 4706911 - DNA, 21 bp, Homo sapiens
tccagaagtattgtttacatt

SEQ ID NO: 4706912 - DNA, 14 bp, Homo sapiens
tccagacccggctg

SEQ ID NO: 4706913 - DNA, 23 bp, Homo sapiens
tccagagctctgacccacagcct

SEQ ID NO: 4706914 - DNA, 20 bp, Homo sapiens
tccagagctgcttctgtctg

SEQ ID NO: 4706915 - DNA, 22 bp, Homo sapiens
tccagatagtgtagctgaggag

SEQ ID NO: 4706916 - DNA, 19 bp, Homo sapiens
tccagcaattctcctgcct

SEQ ID NO: 4706917 - DNA, 22 bp, Homo sapiens
tccagcaattctcctgcctcag

SEQ ID NO: 4706918 - DNA, 17 bp, Homo sapiens
tccagcattctcagcca

SEQ ID NO: 4706919 - DNA, 13 bp, Homo sapiens
tccagcccctgga

SEQ ID NO: 4706920 - DNA, 19 bp, Homo sapiens
tccagccctggctgaagga

SEQ ID NO: 4706921 - DNA, 21 bp, Homo sapiens
tccagccctggctgaaggact

SEQ ID NO: 4706922 - DNA, 14 bp, Homo sapiens
tccagcctgacaac

SEQ ID NO: 4706923 - DNA, 16 bp, Homo sapiens
tccagctcaccagccc

SEQ ID NO: 4706924 - DNA, 18 bp, Homo sapiens
tccagctcctcatccagg

SEQ ID NO: 4706925 - DNA, 21 bp, Homo sapiens
tccagctggccgggagcctga

SEQ ID NO: 4706926 - DNA, 13 bp, Homo sapiens
tccaggaagatcc

SEQ ID NO: 4706927 - DNA, 20 bp, Homo sapiens
tccaggagaaggccaattcc

SEQ ID NO: 4706928 - DNA, 18 bp, Homo sapiens
tccaggatttataaagca

SEQ ID NO: 4706929 - DNA, 13 bp, Homo sapiens
tccagggacagca

SEQ ID NO: 4706930 - DNA, 14 bp, Homo sapiens
tccagggacagcaa

SEQ ID NO: 4706931 - DNA, 14 bp, Homo sapiens
tccagggctggact

SEQ ID NO: 4706932 - DNA, 17 bp, Homo sapiens
tccagggctggactgag

SEQ ID NO: 4706933 - DNA, 23 bp, Homo sapiens
tccaggggtgggacaccctgtga

SEQ ID NO: 4706934 - DNA, 15 bp, Homo sapiens
tccaggtaaatggta

SEQ ID NO: 4706935 - DNA, 21 bp, Homo sapiens
tccaggtgcacaagctccaag

SEQ ID NO: 4706936 - DNA, 22 bp, Homo sapiens
tccaggtgcacaagctccaagc

SEQ ID NO: 4706937 - DNA, 15 bp, Homo sapiens
tccagtcattatgtt

SEQ ID NO: 4706938 - DNA, 23 bp, Homo sapiens
tccagtcattatgttaatatttc

SEQ ID NO: 4706939 - DNA, 23 bp, Homo sapiens
tccagtccaaggaaaccacagct

SEQ ID NO: 4706940 - DNA, 15 bp, Homo sapiens
tccagtgaggctctg

SEQ ID NO: 4706941 - DNA, 20 bp, Homo sapiens
tccagtgcccattcctcacc

SEQ ID NO: 4706942 - DNA, 21 bp, Homo sapiens
tccagttagaaggaggttcta

SEQ ID NO: 4706943 - DNA, 14 bp, Homo sapiens
tccataagctattt

SEQ ID NO: 4706944 - DNA, 14 bp, Homo sapiens
tccatagagagcaa

SEQ ID NO: 4706945 - DNA, 20 bp, Homo sapiens
tccatagagagcaagacgct

SEQ ID NO: 4706946 - DNA, 14 bp, Homo sapiens
tccatcaaagagaa

SEQ ID NO: 4706947 - DNA, 20 bp, Homo sapiens
tccatccttgagtcaaaaaa

SEQ ID NO: 4706948 - DNA, 18 bp, Homo sapiens
tccatctaaactgccccc

SEQ ID NO: 4706949 - DNA, 16 bp, Homo sapiens
tccatgagtcccctgt

SEQ ID NO: 4706950 - DNA, 20 bp, Homo sapiens
tccatggccctgcaaaagga

SEQ ID NO: 4706951 - DNA, 15 bp, Homo sapiens
tccatgggcagagcc

SEQ ID NO: 4706952 - DNA, 17 bp, Homo sapiens
tccatgggcagagccca

SEQ ID NO: 4706953 - DNA, 18 bp, Homo sapiens
tccatgggcagagcccaa

SEQ ID NO: 4706954 - DNA, 19 bp, Homo sapiens
tccatgggggctcagccag

SEQ ID NO: 4706955 - DNA, 20 bp, Homo sapiens
tccatgtgggctagttgggc

SEQ ID NO: 4706956 - DNA, 19 bp, Homo sapiens
tccattaactgctttccac

SEQ ID NO: 4706957 - DNA, 16 bp, Homo sapiens
tcctgctgcagagggg

SEQ ID NO: 4706958 - DNA, 21 bp, Homo sapiens
tcctgctgcagaggggcaggc

SEQ ID NO: 4706959 - DNA, 22 bp, Homo sapiens
tcctggaggggtgttgtatggc

SEQ ID NO: 4706960 - DNA, 21 bp, Homo sapiens
tcctggcacccggcccctgct

SEQ ID NO: 4706961 - DNA, 13 bp, Homo sapiens
tcctggcactgct

SEQ ID NO: 4706962 - DNA, 18 bp, Homo sapiens
tcctggcactgcttccag

SEQ ID NO: 4706963 - DNA, 22 bp, Homo sapiens
tcctggcactgcttccagtgag

SEQ ID NO: 4706964 - DNA, 18 bp, Homo sapiens
tcctggcccatcagtgta

SEQ ID NO: 4706965 - DNA, 14 bp, Homo sapiens
tcctgggaaatatt

SEQ ID NO: 4706966 - DNA, 16 bp, Homo sapiens
tcctgggaaatattcc

SEQ ID NO: 4706967 - DNA, 20 bp, Homo sapiens
tcctgggaaatattccctag

SEQ ID NO: 4706968 - DNA, 12 bp, Homo sapiens
tcctgggagtga

SEQ ID NO: 4706969 - DNA, 16 bp, Homo sapiens
tcctgggccctctctg

SEQ ID NO: 4706970 - DNA, 22 bp, Homo sapiens
tcctgggttttgtattctctga

SEQ ID NO: 4706971 - DNA, 23 bp, Homo sapiens
tcctgtaccaaatctgacatatt

SEQ ID NO: 4706972 - DNA, 14 bp, Homo sapiens
tcctgtcagtgccg

SEQ ID NO: 4706973 - DNA, 17 bp, Homo sapiens
tcctgtgatgtcccagt

SEQ ID NO: 4706974 - DNA, 22 bp, Homo sapiens
tcctgtgggggaagagcacagc

SEQ ID NO: 4706975 - DNA, 24 bp, Homo sapiens
tcctgtgtcttgcaatggcagcct

SEQ ID NO: 4706976 - DNA, 18 bp, Homo sapiens
tcctgtgtgtgcgcctac

SEQ ID NO: 4706977 - DNA, 17 bp, Homo sapiens
tcctgttttgcacagcc

SEQ ID NO: 4706978 - DNA, 14 bp, Homo sapiens
tccttaccagcaga

SEQ ID NO: 4706979 - DNA, 17 bp, Homo sapiens
tccttaccagcagagca

SEQ ID NO: 4706980 - DNA, 18 bp, Homo sapiens
tccttaccagcagagcac

SEQ ID NO: 4706981 - DNA, 20 bp, Homo sapiens
tccttaccagcagagcacct

SEQ ID NO: 4706982 - DNA, 14 bp, Homo sapiens
tccttatcaaagga

SEQ ID NO: 4706983 - DNA, 15 bp, Homo sapiens
tccttatcaaaggac

SEQ ID NO: 4706984 - DNA, 23 bp, Homo sapiens
tccttcccagaggggcctgccac

SEQ ID NO: 4706985 - DNA, 20 bp, Homo sapiens
tccttcccaggagtggagga

SEQ ID NO: 4706986 - DNA, 15 bp, Homo sapiens
tccttctctgtctca

SEQ ID NO: 4706987 - DNA, 12 bp, Homo sapiens
tccttctgtcct

SEQ ID NO: 4706988 - DNA, 16 bp, Homo sapiens
tccttctttgataatg

SEQ ID NO: 4706989 - DNA, 23 bp, Homo sapiens
tccttgaaaacactgttctctgc

SEQ ID NO: 4706990 - DNA, 12 bp, Homo sapiens
tccttgaaacag

SEQ ID NO: 4706991 - DNA, 16 bp, Homo sapiens
tccttgagagaccagg

SEQ ID NO: 4706992 - DNA, 13 bp, Homo sapiens
tccttgggccctt

SEQ ID NO: 4706993 - DNA, 19 bp, Homo sapiens
tccttgtcaatactgagcc

SEQ ID NO: 4706994 - DNA, 14 bp, Homo sapiens
tccttgtccccaca

SEQ ID NO: 4706995 - DNA, 22 bp, Homo sapiens
tccttgtccccacactcctaca

SEQ ID NO: 4706996 - DNA, 16 bp, Homo sapiens
tcctttaaaaaaattt

SEQ ID NO: 4706997 - DNA, 17 bp, Homo sapiens
tcctttactgaatgtaa

SEQ ID NO: 4706998 - DNA, 14 bp, Homo sapiens
tcgaaataacaatg

SEQ ID NO: 4706999 - DNA, 15 bp, Homo sapiens
tcgaactggctgcaa

SEQ ID NO: 4707000 - DNA, 16 bp, Homo sapiens
tcgaatgtaattggaa

SEQ ID NO: 4707001 - DNA, 16 bp, Homo sapiens
tcgagaactttcattt

SEQ ID NO: 4707002 - DNA, 14 bp, Homo sapiens
tcgagcagggtgct

SEQ ID NO: 4707003 - DNA, 13 bp, Homo sapiens
tcgaggacaggga

SEQ ID NO: 4707004 - DNA, 14 bp, Homo sapiens
tcgaggacagggag

SEQ ID NO: 4707005 - DNA, 17 bp, Homo sapiens
tcgaggacagggaggtg

SEQ ID NO: 4707006 - DNA, 22 bp, Homo sapiens
tcgaggtttctcaaagaaattt

SEQ ID NO: 4707007 - DNA, 13 bp, Homo sapiens
tcgatatgaaaaa

SEQ ID NO: 4707008 - DNA, 15 bp, Homo sapiens
tcgcacacacagtga

SEQ ID NO: 4707009 - DNA, 22 bp, Homo sapiens
tcgcccaccgcatgccccctcg

SEQ ID NO: 4707010 - DNA, 20 bp, Homo sapiens
tcgcccatcagtgccagccc

SEQ ID NO: 4707011 - DNA, 19 bp, Homo sapiens
tcgcgagcacatgttcata

SEQ ID NO: 4707012 - DNA, 15 bp, Homo sapiens
tcgcgctgcctgtgt

SEQ ID NO: 4707013 - DNA, 18 bp, Homo sapiens
tcgctattgtcaccaggg

SEQ ID NO: 4707014 - DNA, 12 bp, Homo sapiens
tcgctcctgtgt

SEQ ID NO: 4707015 - DNA, 20 bp, Homo sapiens
tcgctggactctcagtctct

SEQ ID NO: 4707016 - DNA, 16 bp, Homo sapiens
tcggatttggggtgga

SEQ ID NO: 4707017 - DNA, 21 bp, Homo sapiens
tcggcaggcatggctggtgcc

SEQ ID NO: 4707018 - DNA, 18 bp, Homo sapiens
tcggctcactgcatcctc

SEQ ID NO: 4707019 - DNA, 14 bp, Homo sapiens
tcggctcctgctgc

SEQ ID NO: 4707020 - DNA, 15 bp, Homo sapiens
tcggctcctgctgca

SEQ ID NO: 4707021 - DNA, 22 bp, Homo sapiens
tcgggagaggggacgcaggccc

SEQ ID NO: 4707022 - DNA, 23 bp, Homo sapiens
tcgggagaggggacgcaggcccc

SEQ ID NO: 4707023 - DNA, 17 bp, Homo sapiens
tcgggcccaggccatct

SEQ ID NO: 4707024 - DNA, 15 bp, Homo sapiens
tcgggctcctgtgcc

SEQ ID NO: 4707025 - DNA, 17 bp, Homo sapiens
tcgggctcctgtgccct

SEQ ID NO: 4707026 - DNA, 16 bp, Homo sapiens
tcgtgatcactgagcc

SEQ ID NO: 4707027 - DNA, 19 bp, Homo sapiens
tcgtgccagtcgcgctgcc

SEQ ID NO: 4707028 - DNA, 16 bp, Homo sapiens
tcgtgtcccctatcct

SEQ ID NO: 4707029 - DNA, 17 bp, Homo sapiens
tcgtttgaatcacagta

SEQ ID NO: 4707030 - DNA, 18 bp, Homo sapiens
tctaaaattataaatgac

SEQ ID NO: 4707031 - DNA, 21 bp, Homo sapiens
tctaaacaagaaccatttgca

SEQ ID NO: 4707032 - DNA, 19 bp, Homo sapiens
tctaaacagatgtccctga

SEQ ID NO: 4707033 - DNA, 19 bp, Homo sapiens
tctaaaccatggcacttga

SEQ ID NO: 4707034 - DNA, 13 bp, Homo sapiens
tctaaagagcatc

SEQ ID NO: 4707035 - DNA, 14 bp, Homo sapiens
tctaaagagcatct

SEQ ID NO: 4707036 - DNA, 20 bp, Homo sapiens
tctaaagcagtttattataa

SEQ ID NO: 4707037 - DNA, 20 bp, Homo sapiens
tctaaagccattgtagtcct

SEQ ID NO: 4707038 - DNA, 20 bp, Homo sapiens
tctaacctcatcttcttcac

SEQ ID NO: 4707039 - DNA, 20 bp, Homo sapiens
tctaagagaacaatgtgcta

SEQ ID NO: 4707040 - DNA, 16 bp, Homo sapiens
tctaaggactttttct

SEQ ID NO: 4707041 - DNA, 17 bp, Homo sapiens
tctaaggactttttctt

SEQ ID NO: 4707042 - DNA, 14 bp, Homo sapiens
tctaagtctttcca

SEQ ID NO: 4707043 - DNA, 14 bp, Homo sapiens
tctaagtgtaaaag

SEQ ID NO: 4707044 - DNA, 22 bp, Homo sapiens
tctaagtgtaaaagtagtaaat

SEQ ID NO: 4707045 - DNA, 17 bp, Homo sapiens
tctaatactttgtttat

SEQ ID NO: 4707046 - DNA, 18 bp, Homo sapiens
tctaattgtcagtgattt

SEQ ID NO: 4707047 - DNA, 22 bp, Homo sapiens
tctaattttggataatattcat

SEQ ID NO: 4707048 - DNA, 17 bp, Homo sapiens
tctacacatatcttgtt

SEQ ID NO: 4707049 - DNA, 15 bp, Homo sapiens
tctacactgtgctga

SEQ ID NO: 4707050 - DNA, 15 bp, Homo sapiens
tctacagaggccatg

SEQ ID NO: 4707051 - DNA, 16 bp, Homo sapiens
tctacagaggccatgg

SEQ ID NO: 4707052 - DNA, 12 bp, Homo sapiens
tctacatctttt

SEQ ID NO: 4707053 - DNA, 20 bp, Homo sapiens
tctaccaagctatcctggct

SEQ ID NO: 4707054 - DNA, 17 bp, Homo sapiens
tctacccttggaaagaa

SEQ ID NO: 4707055 - DNA, 14 bp, Homo sapiens
tctacctgtcctcc

SEQ ID NO: 4707056 - DNA, 19 bp, Homo sapiens
tctacggtgtatggttctg

SEQ ID NO: 4707057 - DNA, 18 bp, Homo sapiens
tctacttgatatttcctt

SEQ ID NO: 4707058 - DNA, 20 bp, Homo sapiens
tctaggtggcaaggctgtgc

SEQ ID NO: 4707059 - DNA, 15 bp, Homo sapiens
tctagtggtctttgt

SEQ ID NO: 4707060 - DNA, 17 bp, Homo sapiens
tctagtggtctttgtaa

SEQ ID NO: 4707061 - DNA, 23 bp, Homo sapiens
tctagttgtttgattcagacagc

SEQ ID NO: 4707062 - DNA, 14 bp, Homo sapiens
tctataaactataa

SEQ ID NO: 4707063 - DNA, 13 bp, Homo sapiens
tctataatttaaa

SEQ ID NO: 4707064 - DNA, 13 bp, Homo sapiens
tctatatccttga

SEQ ID NO: 4707065 - DNA, 22 bp, Homo sapiens
tctatatccttgacaccttact

SEQ ID NO: 4707066 - DNA, 23 bp, Homo sapiens
tctatcactaaaaatttttacaa

SEQ ID NO: 4707067 - DNA, 16 bp, Homo sapiens
tctgtcgcccagtctg

SEQ ID NO: 4707068 - DNA, 13 bp, Homo sapiens
tctgtctcatcca

SEQ ID NO: 4707069 - DNA, 21 bp, Homo sapiens
tctgtctcatccatcatcatg

SEQ ID NO: 4707070 - DNA, 16 bp, Homo sapiens
tctgtgaaatttgtaa

SEQ ID NO: 4707071 - DNA, 17 bp, Homo sapiens
tctgtgaaatttgtaat

SEQ ID NO: 4707072 - DNA, 16 bp, Homo sapiens
tctgtgaccaatgtct

SEQ ID NO: 4707073 - DNA, 17 bp, Homo sapiens
tctgtgagactcgagaa

SEQ ID NO: 4707074 - DNA, 22 bp, Homo sapiens
tctgtgcccatgggcactgctg

SEQ ID NO: 4707075 - DNA, 20 bp, Homo sapiens
tctgtggattcagcttctgt

SEQ ID NO: 4707076 - DNA, 12 bp, Homo sapiens
tctgtgggctgc

SEQ ID NO: 4707077 - DNA, 18 bp, Homo sapiens
tctgtgggtctccatcct

SEQ ID NO: 4707078 - DNA, 18 bp, Homo sapiens
tctgtgtaagaaaacaaa

SEQ ID NO: 4707079 - DNA, 15 bp, Homo sapiens
tctgtgtcactggct

SEQ ID NO: 4707080 - DNA, 17 bp, Homo sapiens
tctgtgtcactggctgc

SEQ ID NO: 4707081 - DNA, 22 bp, Homo sapiens
tctgtgtcactggctgcctcca

SEQ ID NO: 4707082 - DNA, 17 bp, Homo sapiens
tctgtgtcaggtggggc

SEQ ID NO: 4707083 - DNA, 17 bp, Homo sapiens
tctgtgtggcaaattaa

SEQ ID NO: 4707084 - DNA, 17 bp, Homo sapiens
tctgttctgcacacagc

SEQ ID NO: 4707085 - DNA, 15 bp, Homo sapiens
tcttaaaatgtccta

SEQ ID NO: 4707086 - DNA, 17 bp, Homo sapiens
tcttaaacaaatgtatg

SEQ ID NO: 4707087 - DNA, 20 bp, Homo sapiens
tcttaatcttttcacaaata

SEQ ID NO: 4707088 - DNA, 22 bp, Homo sapiens
tcttaatcttttcacaaataaa

SEQ ID NO: 4707089 - DNA, 14 bp, Homo sapiens
tcttacaaacatgt

SEQ ID NO: 4707090 - DNA, 22 bp, Homo sapiens
tcttacacattccatcttacat

SEQ ID NO: 4707091 - DNA, 16 bp, Homo sapiens
tcttactaaaaagtat

SEQ ID NO: 4707092 - DNA, 14 bp, Homo sapiens
tcttagctttttaa

SEQ ID NO: 4707093 - DNA, 16 bp, Homo sapiens
tcttagctttttaatt

SEQ ID NO: 4707094 - DNA, 21 bp, Homo sapiens
tcttagctttttaattgttgt

SEQ ID NO: 4707095 - DNA, 14 bp, Homo sapiens
tcttaggagcagag

SEQ ID NO: 4707096 - DNA, 16 bp, Homo sapiens
tcttagtggaagacaa

SEQ ID NO: 4707097 - DNA, 13 bp, Homo sapiens
tcttatcaagcag

SEQ ID NO: 4707098 - DNA, 16 bp, Homo sapiens
tcttatcaagcagcca

SEQ ID NO: 4707099 - DNA, 14 bp, Homo sapiens
tcttatctcagtca

SEQ ID NO: 4707100 - DNA, 20 bp, Homo sapiens
tcttatctcagtcatgcata

SEQ ID NO: 4707101 - DNA, 13 bp, Homo sapiens
tcttatgcttcca

SEQ ID NO: 4707102 - DNA, 18 bp, Homo sapiens
tcttattgcccacgctgg

SEQ ID NO: 4707103 - DNA, 15 bp, Homo sapiens
tcttcaactccctgc

SEQ ID NO: 4707104 - DNA, 15 bp, Homo sapiens
tcttcaatgatcaaa

SEQ ID NO: 4707105 - DNA, 16 bp, Homo sapiens
tcttcaatgatcaaat

SEQ ID NO: 4707106 - DNA, 17 bp, Homo sapiens
tcttcaccatttggcaa

SEQ ID NO: 4707107 - DNA, 13 bp, Homo sapiens
tcttcacctcaga

SEQ ID NO: 4707108 - DNA, 17 bp, Homo sapiens
tcttcacctcagagtgg

SEQ ID NO: 4707109 - DNA, 13 bp, Homo sapiens
tcttcactcacag

SEQ ID NO: 4707110 - DNA, 17 bp, Homo sapiens
tcttcagagactcctgc

SEQ ID NO: 4707111 - DNA, 20 bp, Homo sapiens
tcttcagagactcctgcagg

SEQ ID NO: 4707112 - DNA, 21 bp, Homo sapiens
tcttccaggctgggagagcct

SEQ ID NO: 4707113 - DNA, 22 bp, Homo sapiens
tcttccaggctgggagagcctt

SEQ ID NO: 4707114 - DNA, 14 bp, Homo sapiens
tcttccatttgcaa

SEQ ID NO: 4707115 - DNA, 21 bp, Homo sapiens
tcttcctatttgccatgggct

SEQ ID NO: 4707116 - DNA, 17 bp, Homo sapiens
tcttcctgttctgtgac

SEQ ID NO: 4707117 - DNA, 19 bp, Homo sapiens
tcttcctgttctgtgactg

SEQ ID NO: 4707118 - DNA, 10 bp, Homo sapiens
tcttctcatt

SEQ ID NO: 4707119 - DNA, 16 bp, Homo sapiens
tcttctcgtccctcct

SEQ ID NO: 4707120 - DNA, 15 bp, Homo sapiens
tcttctgtacgtctg

SEQ ID NO: 4707121 - DNA, 21 bp, Homo sapiens
tcttctgtacgtctgacaggc

SEQ ID NO: 4707122 - DNA, 22 bp, Homo sapiens
tcttctgtacgtctgacaggca

SEQ ID NO: 4707123 - DNA, 23 bp, Homo sapiens
tcttctgtacgtctgacaggcaa

SEQ ID NO: 4707124 - DNA, 12 bp, Homo sapiens
tcttgaactcct

SEQ ID NO: 4707125 - DNA, 19 bp, Homo sapiens
tcttgaactcctgacctca

SEQ ID NO: 4707126 - DNA, 16 bp, Homo sapiens
tcttgaactcctggcc

SEQ ID NO: 4707127 - DNA, 17 bp, Homo sapiens
tcttgaactcctggcct

SEQ ID NO: 4707128 - DNA, 18 bp, Homo sapiens
tcttgaactcctggcctc

SEQ ID NO: 4707129 - DNA, 23 bp, Homo sapiens
tcttgaatttaataatctgtagg

SEQ ID NO: 4707130 - DNA, 21 bp, Homo sapiens
tcttgacaccagctgttctgt

SEQ ID NO: 4707131 - DNA, 22 bp, Homo sapiens
tcttgacaccagctgttctgtc

SEQ ID NO: 4707132 - DNA, 18 bp, Homo sapiens
tcttgatcaacatctttt

SEQ ID NO: 4707133 - DNA, 21 bp, Homo sapiens
tcttgcaagcaacaagctatt

SEQ ID NO: 4707134 - DNA, 18 bp, Homo sapiens
tcttgcaatggcagcctt

SEQ ID NO: 4707135 - DNA, 22 bp, Homo sapiens
tcttgccccaacccccagcacc

SEQ ID NO: 4707136 - DNA, 15 bp, Homo sapiens
tcttgctctgctgac

SEQ ID NO: 4707137 - DNA, 22 bp, Homo sapiens
tcttggcacatttaagagacag

SEQ ID NO: 4707138 - DNA, 15 bp, Homo sapiens
tcttgtatggtttgc

SEQ ID NO: 4707139 - DNA, 15 bp, Homo sapiens
tcttgtggcaagagc

SEQ ID NO: 4707140 - DNA, 14 bp, Homo sapiens
tcttgttcaaaaag

SEQ ID NO: 4707141 - DNA, 18 bp, Homo sapiens
tcttgttgctgtacaaaa

SEQ ID NO: 4707142 - DNA, 17 bp, Homo sapiens
tctttaaccctcactgg

SEQ ID NO: 4707143 - DNA, 20 bp, Homo sapiens
tctttaactgccgtaattta

SEQ ID NO: 4707144 - DNA, 22 bp, Homo sapiens
tctttaactgccgtaatttaac

SEQ ID NO: 4707145 - DNA, 22 bp, Homo sapiens
tctttaatgtcacaggcaggtc

SEQ ID NO: 4707146 - DNA, 17 bp, Homo sapiens
tctttattaaatgtaga

SEQ ID NO: 4707147 - DNA, 18 bp, Homo sapiens
tctttcactcacatcttt

SEQ ID NO: 4707148 - DNA, 22 bp, Homo sapiens
tctttccacggagccactcctc

SEQ ID NO: 4707149 - DNA, 14 bp, Homo sapiens
tctttcctgaggct

SEQ ID NO: 4707150 - DNA, 17 bp, Homo sapiens
tctttcctgaggctggg

SEQ ID NO: 4707151 - DNA, 15 bp, Homo sapiens
tctttctagtggtct

SEQ ID NO: 4707152 - DNA, 20 bp, Homo sapiens
tctttctagtggtctttgta

SEQ ID NO: 4707153 - DNA, 21 bp, Homo sapiens
tctttctagtggtctttgtaa

SEQ ID NO: 4707154 - DNA, 17 bp, Homo sapiens
tctttcttggtgcattc

SEQ ID NO: 4707155 - DNA, 12 bp, Homo sapiens
tctttctttgct

SEQ ID NO: 4707156 - DNA, 13 bp, Homo sapiens
tctttctttgctg

SEQ ID NO: 4707157 - DNA, 20 bp, Homo sapiens
tctttctttgctgctgtgga

SEQ ID NO: 4707158 - DNA, 20 bp, Homo sapiens
tctttgaaaatagttattca

SEQ ID NO: 4707159 - DNA, 16 bp, Homo sapiens
tctttgaatatgtagt

SEQ ID NO: 4707160 - DNA, 14 bp, Homo sapiens
tctttgataatgtt

SEQ ID NO: 4707161 - DNA, 21 bp, Homo sapiens
tctttgataatgttaaatttg

SEQ ID NO: 4707162 - DNA, 12 bp, Homo sapiens
tctttgccaagt

SEQ ID NO: 4707163 - DNA, 14 bp, Homo sapiens
tctttgccaccctc

SEQ ID NO: 4707164 - DNA, 17 bp, Homo sapiens
tctttgccaccctcatg

SEQ ID NO: 4707165 - DNA, 18 bp, Homo sapiens
tctttgccaccctcatgc

SEQ ID NO: 4707166 - DNA, 21 bp, Homo sapiens
tctttgctgaatgtcattatt

SEQ ID NO: 4707167 - DNA, 19 bp, Homo sapiens
tctttggacagaagcagct

SEQ ID NO: 4707168 - DNA, 13 bp, Homo sapiens
tctttggaccctg

SEQ ID NO: 4707169 - DNA, 14 bp, Homo sapiens
tctttggaccctga

SEQ ID NO: 4707170 - DNA, 16 bp, Homo sapiens
tctttggaccctgagg

SEQ ID NO: 4707171 - DNA, 17 bp, Homo sapiens
tctttggagaggatttg

SEQ ID NO: 4707172 - DNA, 16 bp, Homo sapiens
tctttggtgaacattg

SEQ ID NO: 4707173 - DNA, 13 bp, Homo sapiens
tctttgtaagagt

SEQ ID NO: 4707174 - DNA, 19 bp, Homo sapiens
tctttgtaagagtgtagaa

SEQ ID NO: 4707175 - DNA, 22 bp, Homo sapiens
tctttgtaagagtgtagaagca

SEQ ID NO: 4707176 - DNA, 23 bp, Homo sapiens
tctttgtaagagtgtagaagcat

SEQ ID NO: 4707177 - DNA, 19 bp, Homo sapiens
tgagccaccgtgcctggcc

SEQ ID NO: 4707178 - DNA, 21 bp, Homo sapiens
tgagccactgcaccgggccac

SEQ ID NO: 4707179 - DNA, 19 bp, Homo sapiens
tgagccatcatttcctggg

SEQ ID NO: 4707180 - DNA, 17 bp, Homo sapiens
tgagcccatggccctcc

SEQ ID NO: 4707181 - DNA, 13 bp, Homo sapiens
tgagcctcagcat

SEQ ID NO: 4707182 - DNA, 14 bp, Homo sapiens
tgagcctcagtctc

SEQ ID NO: 4707183 - DNA, 22 bp, Homo sapiens
tgagcgaggagatgctccttgg

SEQ ID NO: 4707184 - DNA, 23 bp, Homo sapiens
tgagcgaggagatgctccttggg

SEQ ID NO: 4707185 - DNA, 13 bp, Homo sapiens
tgagcgtgattct

SEQ ID NO: 4707186 - DNA, 18 bp, Homo sapiens
tgagcgtgcgtctgtgtg

SEQ ID NO: 4707187 - DNA, 23 bp, Homo sapiens
tgagcgtgcgtctgtgtgtgcct

SEQ ID NO: 4707188 - DNA, 21 bp, Homo sapiens
tgagctacttcttattcactt

SEQ ID NO: 4707189 - DNA, 22 bp, Homo sapiens
tgagctagaagctggaggacta

SEQ ID NO: 4707190 - DNA, 17 bp, Homo sapiens
tgaggaagaacggggct

SEQ ID NO: 4707191 - DNA, 19 bp, Homo sapiens
tgaggaagaacggggctct

SEQ ID NO: 4707192 - DNA, 24 bp, Homo sapiens
tgaggaagaacggggctcttctca

SEQ ID NO: 4707193 - DNA, 21 bp, Homo sapiens
tgaggaagccgctggggccag

SEQ ID NO: 4707194 - DNA, 21 bp, Homo sapiens
tgaggaatccagacccggctg

SEQ ID NO: 4707195 - DNA, 13 bp, Homo sapiens
tgaggacaaagaa

SEQ ID NO: 4707196 - DNA, 16 bp, Homo sapiens
tgaggacacattgccc

SEQ ID NO: 4707197 - DNA, 16 bp, Homo sapiens
tgaggacccgccggat

SEQ ID NO: 4707198 - DNA, 17 bp, Homo sapiens
tgaggagacattctgtc

SEQ ID NO: 4707199 - DNA, 18 bp, Homo sapiens
tgaggatattcagatgta

SEQ ID NO: 4707200 - DNA, 21 bp, Homo sapiens
tgaggcaagccatggagtgag

SEQ ID NO: 4707201 - DNA, 21 bp, Homo sapiens
tgaggcagcagtgtgaggcca

SEQ ID NO: 4707202 - DNA, 13 bp, Homo sapiens
tgaggccagggca

SEQ ID NO: 4707203 - DNA, 14 bp, Homo sapiens
tgaggccagggcag

SEQ ID NO: 4707204 - DNA, 16 bp, Homo sapiens
tgaggccagggcagag

SEQ ID NO: 4707205 - DNA, 12 bp, Homo sapiens
tgaggcccagag

SEQ ID NO: 4707206 - DNA, 18 bp, Homo sapiens
tgaggcccagagggcctg

SEQ ID NO: 4707207 - DNA, 13 bp, Homo sapiens
tgaggccctccac

SEQ ID NO: 4707208 - DNA, 19 bp, Homo sapiens
tgaggccctccacacctgc

SEQ ID NO: 4707209 - DNA, 21 bp, Homo sapiens
tgaggccctccacacctgcgg

SEQ ID NO: 4707210 - DNA, 19 bp, Homo sapiens
tgaggcccttctctccagc

SEQ ID NO: 4707211 - DNA, 15 bp, Homo sapiens
tgaggctctgccctt

SEQ ID NO: 4707212 - DNA, 16 bp, Homo sapiens
tgaggctctgcccttg

SEQ ID NO: 4707213 - DNA, 18 bp, Homo sapiens
tgaggctctgcccttggt

SEQ ID NO: 4707214 - DNA, 18 bp, Homo sapiens
tgagggtatcaaataaaa

SEQ ID NO: 4707215 - DNA, 19 bp, Homo sapiens
tgaggtcagagcctgcagt

SEQ ID NO: 4707216 - DNA, 18 bp, Homo sapiens
tgaggtcatagcagtgct

SEQ ID NO: 4707217 - DNA, 18 bp, Homo sapiens
tgaggtctcgctgatgct

SEQ ID NO: 4707218 - DNA, 23 bp, Homo sapiens
tgaggtctcgctgatgctgggct

SEQ ID NO: 4707219 - DNA, 18 bp, Homo sapiens
tgaggtcttttacataca

SEQ ID NO: 4707220 - DNA, 22 bp, Homo sapiens
tgagtaactgatttgtaacaag

SEQ ID NO: 4707221 - DNA, 21 bp, Homo sapiens
tgagtactacagtcctcccat

SEQ ID NO: 4707222 - DNA, 13 bp, Homo sapiens
tgagtagctggga

SEQ ID NO: 4707223 - DNA, 14 bp, Homo sapiens
tgagtcaccaagcc

SEQ ID NO: 4707224 - DNA, 22 bp, Homo sapiens
tgagtcagagatttggagatgt

SEQ ID NO: 4707225 - DNA, 21 bp, Homo sapiens
tgagtcccaggctgagcctca

SEQ ID NO: 4707226 - DNA, 19 bp, Homo sapiens
tgagtcgaggacagggagg

SEQ ID NO: 4707227 - DNA, 13 bp, Homo sapiens
tgagtctgaaggc

SEQ ID NO: 4707228 - DNA, 18 bp, Homo sapiens
tgagtctgaaggctgggt

SEQ ID NO: 4707229 - DNA, 21 bp, Homo sapiens
tgagtctggcaaacatgtgca

SEQ ID NO: 4707230 - DNA, 14 bp, Homo sapiens
tgagtgatcactgg

SEQ ID NO: 4707231 - DNA, 18 bp, Homo sapiens
tgagtgatcactggtatt

SEQ ID NO: 4707232 - DNA, 12 bp, Homo sapiens
tgagtgctctga

SEQ ID NO: 4707233 - DNA, 22 bp, Homo sapiens
tgagtggcatgtgggttgtgat

SEQ ID NO: 4707234 - DNA, 21 bp, Homo sapiens
tgagttattcataaagagaaa

SEQ ID NO: 4707235 - DNA, 18 bp, Homo sapiens
tgagttcataccctgtta

SEQ ID NO: 4707236 - DNA, 20 bp, Homo sapiens
tgagttgatagcacagaccc

SEQ ID NO: 4707237 - DNA, 23 bp, Homo sapiens
tgagttgatagcacagaccctgc

SEQ ID NO: 4707238 - DNA, 23 bp, Homo sapiens
tgagttttcttatatatatattg

SEQ ID NO: 4707239 - DNA, 20 bp, Homo sapiens
tgataaaaaatttattatgt

SEQ ID NO: 4707240 - DNA, 22 bp, Homo sapiens
tgataaaaaatttattatgtcc

SEQ ID NO: 4707241 - DNA, 13 bp, Homo sapiens
tgataaaaactca

SEQ ID NO: 4707242 - DNA, 16 bp, Homo sapiens
tgataaaaccatgtag

SEQ ID NO: 4707243 - DNA, 17 bp, Homo sapiens
tgataacaacctggaga

SEQ ID NO: 4707244 - DNA, 15 bp, Homo sapiens
tgataacattttgtt

SEQ ID NO: 4707245 - DNA, 21 bp, Homo sapiens
tgataagagggcacacactgt

SEQ ID NO: 4707246 - DNA, 18 bp, Homo sapiens
tgataatatattgctaaa

SEQ ID NO: 4707247 - DNA, 20 bp, Homo sapiens
tgatacaaattgcagactgt

SEQ ID NO: 4707248 - DNA, 20 bp, Homo sapiens
tgatacaagagtcagcatca

SEQ ID NO: 4707249 - DNA, 13 bp, Homo sapiens
tgatactgttgca

SEQ ID NO: 4707250 - DNA, 16 bp, Homo sapiens
tgatactgttgcacgt

SEQ ID NO: 4707251 - DNA, 18 bp, Homo sapiens
tgatactgttgcacgtgt

SEQ ID NO: 4707252 - DNA, 18 bp, Homo sapiens
tgataggtataagtggtg

SEQ ID NO: 4707253 - DNA, 22 bp, Homo sapiens
tgatagtgactagcactagaca

SEQ ID NO: 4707254 - DNA, 14 bp, Homo sapiens
tgatagtgcttctt

SEQ ID NO: 4707255 - DNA, 19 bp, Homo sapiens
tgatagtgcttcttgtaat

SEQ ID NO: 4707256 - DNA, 19 bp, Homo sapiens
tgatatggcagaagacacc

SEQ ID NO: 4707257 - DNA, 19 bp, Homo sapiens
tgatatgttggtagattct

SEQ ID NO: 4707258 - DNA, 22 bp, Homo sapiens
tgatatttattatatttttccc

SEQ ID NO: 4707259 - DNA, 14 bp, Homo sapiens
tgatatttccttca

SEQ ID NO: 4707260 - DNA, 15 bp, Homo sapiens
tgatatttccttcac

SEQ ID NO: 4707261 - DNA, 12 bp, Homo sapiens
tgatatttgcat

SEQ ID NO: 4707262 - DNA, 14 bp, Homo sapiens
tgatatttgcattg

SEQ ID NO: 4707263 - DNA, 17 bp, Homo sapiens
tgatatttgcattgagg

SEQ ID NO: 4707264 - DNA, 21 bp, Homo sapiens
tgatatttgcattgaggaaat

SEQ ID NO: 4707265 - DNA, 11 bp, Homo sapiens
tgatatttggt

SEQ ID NO: 4707266 - DNA, 12 bp, Homo sapiens
tgatatttggtt

SEQ ID NO: 4707267 - DNA, 16 bp, Homo sapiens
tgatatttggttattt

SEQ ID NO: 4707268 - DNA, 21 bp, Homo sapiens
tgatcaacatcttttcttgcc

SEQ ID NO: 4707269 - DNA, 23 bp, Homo sapiens
tgatcaacatcttttcttgcctc

SEQ ID NO: 4707270 - DNA, 15 bp, Homo sapiens
tgatcacggctcact

SEQ ID NO: 4707271 - DNA, 18 bp, Homo sapiens
tgatcacggctcactgca

SEQ ID NO: 4707272 - DNA, 23 bp, Homo sapiens
tgatcagagccgtggtcctttgg

SEQ ID NO: 4707273 - DNA, 15 bp, Homo sapiens
tgatcatcatgtaga

SEQ ID NO: 4707274 - DNA, 17 bp, Homo sapiens
tgatcatcatgtagaat

SEQ ID NO: 4707275 - DNA, 16 bp, Homo sapiens
tgatcatctttgctga

SEQ ID NO: 4707276 - DNA, 13 bp, Homo sapiens
tgatccaagctgg

SEQ ID NO: 4707277 - DNA, 21 bp, Homo sapiens
tgatccaagctggtcccactc

SEQ ID NO: 4707278 - DNA, 15 bp, Homo sapiens
tgatccacccacctc

SEQ ID NO: 4707279 - DNA, 18 bp, Homo sapiens
tgatccactcgccttcat

SEQ ID NO: 4707280 - DNA, 17 bp, Homo sapiens
tgatcccttgagatatg

SEQ ID NO: 4707281 - DNA, 19 bp, Homo sapiens
tgatcctcccacctcagcc

SEQ ID NO: 4707282 - DNA, 13 bp, Homo sapiens
tgatcctgtgaag

SEQ ID NO: 4707283 - DNA, 15 bp, Homo sapiens
tgatcgccttattta

SEQ ID NO: 4707284 - DNA, 22 bp, Homo sapiens
tgatcgccttatttatattcat

SEQ ID NO: 4707285 - DNA, 18 bp, Homo sapiens
tgatctacttctgtaatt

SEQ ID NO: 4707286 - DNA, 14 bp, Homo sapiens
tgcaccttctgacg

SEQ ID NO: 4707287 - DNA, 15 bp, Homo sapiens
tgcacggctgctgag

SEQ ID NO: 4707288 - DNA, 15 bp, Homo sapiens
tgcactcccctgctg

SEQ ID NO: 4707289 - DNA, 17 bp, Homo sapiens
tgcactcccctgctggg

SEQ ID NO: 4707290 - DNA, 14 bp, Homo sapiens
tgcactgtcctgct

SEQ ID NO: 4707291 - DNA, 15 bp, Homo sapiens
tgcactgtcctgctc

SEQ ID NO: 4707292 - DNA, 18 bp, Homo sapiens
tgcactgtcctgctccac

SEQ ID NO: 4707293 - DNA, 22 bp, Homo sapiens
tgcactgtcctgctccacagtg

SEQ ID NO: 4707294 - DNA, 23 bp, Homo sapiens
tgcactgtcctgctccacagtgt

SEQ ID NO: 4707295 - DNA, 13 bp, Homo sapiens
tgcactgttcccc

SEQ ID NO: 4707296 - DNA, 19 bp, Homo sapiens
tgcactgttccccctgtgc

SEQ ID NO: 4707297 - DNA, 21 bp, Homo sapiens
tgcactgttccccctgtgcag

SEQ ID NO: 4707298 - DNA, 22 bp, Homo sapiens
tgcacttatttatgaacctgcc

SEQ ID NO: 4707299 - DNA, 12 bp, Homo sapiens
tgcactttgttc

SEQ ID NO: 4707300 - DNA, 12 bp, Homo sapiens
tgcagacaggca

SEQ ID NO: 4707301 - DNA, 22 bp, Homo sapiens
tgcagacaggcaagcacctcct

SEQ ID NO: 4707302 - DNA, 15 bp, Homo sapiens
tgcagacatgagtgc

SEQ ID NO: 4707303 - DNA, 16 bp, Homo sapiens
tgcagactctacagag

SEQ ID NO: 4707304 - DNA, 18 bp, Homo sapiens
tgcagactctacagaggc

SEQ ID NO: 4707305 - DNA, 10 bp, Homo sapiens
tgcagaggct

SEQ ID NO: 4707306 - DNA, 21 bp, Homo sapiens
tgcagaggcttattcagttct

SEQ ID NO: 4707307 - DNA, 15 bp, Homo sapiens
tgcagaggggcaggc

SEQ ID NO: 4707308 - DNA, 18 bp, Homo sapiens
tgcagaggggcaggccct

SEQ ID NO: 4707309 - DNA, 20 bp, Homo sapiens
tgcagaggggcaggccctgc

SEQ ID NO: 4707310 - DNA, 21 bp, Homo sapiens
tgcagaggggcaggccctgca

SEQ ID NO: 4707311 - DNA, 14 bp, Homo sapiens
tgcagatttgatat

SEQ ID NO: 4707312 - DNA, 20 bp, Homo sapiens
tgcagcagggcaggaagggg

SEQ ID NO: 4707313 - DNA, 17 bp, Homo sapiens
tgcagcccccactgcct

SEQ ID NO: 4707314 - DNA, 22 bp, Homo sapiens
tgcagcctcaacctcctgggct

SEQ ID NO: 4707315 - DNA, 16 bp, Homo sapiens
tgcagcctcacagtcc

SEQ ID NO: 4707316 - DNA, 20 bp, Homo sapiens
tgcagcctcagagacatcag

SEQ ID NO: 4707317 - DNA, 13 bp, Homo sapiens
tgcagctctgcag

SEQ ID NO: 4707318 - DNA, 13 bp, Homo sapiens
tgcaggcagccag

SEQ ID NO: 4707319 - DNA, 18 bp, Homo sapiens
tgcaggcagccaggccac

SEQ ID NO: 4707320 - DNA, 15 bp, Homo sapiens
tgcagggaaaattat

SEQ ID NO: 4707321 - DNA, 20 bp, Homo sapiens
tgcagggaaaattatttgca

SEQ ID NO: 4707322 - DNA, 23 bp, Homo sapiens
tgcagggagcatggctgtgagga

SEQ ID NO: 4707323 - DNA, 19 bp, Homo sapiens
tgcaggtctccatgaagaa

SEQ ID NO: 4707324 - DNA, 23 bp, Homo sapiens
tgcaggttgggccatactggcct

SEQ ID NO: 4707325 - DNA, 18 bp, Homo sapiens
tgcaggtttgaccaggaa

SEQ ID NO: 4707326 - DNA, 17 bp, Homo sapiens
tgcagtattgagcactg

SEQ ID NO: 4707327 - DNA, 23 bp, Homo sapiens
tgcagtgatatggcagaagacac

SEQ ID NO: 4707328 - DNA, 15 bp, Homo sapiens
tgcagttgccagtca

SEQ ID NO: 4707329 - DNA, 16 bp, Homo sapiens
tgcagttgccagtcac

SEQ ID NO: 4707330 - DNA, 19 bp, Homo sapiens
tgcataaacaatccaaatg

SEQ ID NO: 4707331 - DNA, 17 bp, Homo sapiens
tgcataatgtttctgga

SEQ ID NO: 4707332 - DNA, 17 bp, Homo sapiens
tgcatataatgaataaa

SEQ ID NO: 4707333 - DNA, 17 bp, Homo sapiens
tgcatatatacatatat

SEQ ID NO: 4707334 - DNA, 15 bp, Homo sapiens
tgcatatatgttctt

SEQ ID NO: 4707335 - DNA, 20 bp, Homo sapiens
tgcatatctctagtccctgt

SEQ ID NO: 4707336 - DNA, 19 bp, Homo sapiens
tgcatatttgcaaagtgta

SEQ ID NO: 4707337 - DNA, 14 bp, Homo sapiens
tgcatcctccgcct

SEQ ID NO: 4707338 - DNA, 21 bp, Homo sapiens
tgcatcctccgcctcccgggt

SEQ ID NO: 4707339 - DNA, 12 bp, Homo sapiens
tgcatctggtgt

SEQ ID NO: 4707340 - DNA, 13 bp, Homo sapiens
tgcatctggtgta

SEQ ID NO: 4707341 - DNA, 21 bp, Homo sapiens
tgcatgaggctagtgtggtgt

SEQ ID NO: 4707342 - DNA, 19 bp, Homo sapiens
tgcatgcccttcctttcta

SEQ ID NO: 4707343 - DNA, 19 bp, Homo sapiens
tgcatggaaattcccttca

SEQ ID NO: 4707344 - DNA, 23 bp, Homo sapiens
tgcatggaaattcccttcatctg

SEQ ID NO: 4707345 - DNA, 14 bp, Homo sapiens
tgcatggagtgttt

SEQ ID NO: 4707346 - DNA, 19 bp, Homo sapiens
tgcatgtaaaatcttcagc

SEQ ID NO: 4707347 - DNA, 21 bp, Homo sapiens
tgcatgtaaaatcttcagctg

SEQ ID NO: 4707348 - DNA, 12 bp, Homo sapiens
tgcatgttcctg

SEQ ID NO: 4707349 - DNA, 15 bp, Homo sapiens
tgcattcttattcat

SEQ ID NO: 4707350 - DNA, 19 bp, Homo sapiens
tgcattgaatttagtcatt

SEQ ID NO: 4707351 - DNA, 17 bp, Homo sapiens
tgcattgaggaaatatt

SEQ ID NO: 4707352 - DNA, 18 bp, Homo sapiens
tgcattggaactggaggc

SEQ ID NO: 4707353 - DNA, 21 bp, Homo sapiens
tgcattggaactggaggcagg

SEQ ID NO: 4707354 - DNA, 14 bp, Homo sapiens
tgcatttaaagtat

SEQ ID NO: 4707355 - DNA, 16 bp, Homo sapiens
tgcatttaaatacagt

SEQ ID NO: 4707356 - DNA, 20 bp, Homo sapiens
tgcattttgtagcctctctt

SEQ ID NO: 4707357 - DNA, 17 bp, Homo sapiens
tgcatttttaaaggaca

SEQ ID NO: 4707358 - DNA, 19 bp, Homo sapiens
tgccaaatataaataaaaa

SEQ ID NO: 4707359 - DNA, 22 bp, Homo sapiens
tgccaaatataaataaaaataa

SEQ ID NO: 4707360 - DNA, 20 bp, Homo sapiens
tgccaacactcaagaagcag

SEQ ID NO: 4707361 - DNA, 15 bp, Homo sapiens
tgccaagcactgtgc

SEQ ID NO: 4707362 - DNA, 22 bp, Homo sapiens
tgccaagcatttaatgtagcca

SEQ ID NO: 4707363 - DNA, 22 bp, Homo sapiens
tgccaataataatacctccctt

SEQ ID NO: 4707364 - DNA, 18 bp, Homo sapiens
tgccaatggaacctcctt

SEQ ID NO: 4707365 - DNA, 21 bp, Homo sapiens
tgccacaccaagctgtgccac

SEQ ID NO: 4707366 - DNA, 21 bp, Homo sapiens
tgccacagcctcccctgccag

SEQ ID NO: 4707367 - DNA, 20 bp, Homo sapiens
tgccaccctggggagaaagt

SEQ ID NO: 4707368 - DNA, 14 bp, Homo sapiens
tgccacctcctgcc

SEQ ID NO: 4707369 - DNA, 19 bp, Homo sapiens
tgccacctggacccctgca

SEQ ID NO: 4707370 - DNA, 20 bp, Homo sapiens
tgccacctggacccctgcat

SEQ ID NO: 4707371 - DNA, 22 bp, Homo sapiens
tgccactacggaatagttggct

SEQ ID NO: 4707372 - DNA, 16 bp, Homo sapiens
tgccacttcccaggta

SEQ ID NO: 4707373 - DNA, 17 bp, Homo sapiens
tgccagcccctgctggc

SEQ ID NO: 4707374 - DNA, 23 bp, Homo sapiens
tgccagcccctgctggctggtgc

SEQ ID NO: 4707375 - DNA, 23 bp, Homo sapiens
tgccagctctgtatcaggaccca

SEQ ID NO: 4707376 - DNA, 21 bp, Homo sapiens
tgccagggaaaaagaccaaat

SEQ ID NO: 4707377 - DNA, 11 bp, Homo sapiens
tgccagggaca

SEQ ID NO: 4707378 - DNA, 22 bp, Homo sapiens
tgccagggacagagggggtggc

SEQ ID NO: 4707379 - DNA, 11 bp, Homo sapiens
tgccagggcag

SEQ ID NO: 4707380 - DNA, 15 bp, Homo sapiens
tgccagtcaccccgg

SEQ ID NO: 4707381 - DNA, 17 bp, Homo sapiens
tgccagtcgcgctgcct

SEQ ID NO: 4707382 - DNA, 20 bp, Homo sapiens
tgccatacttgttctgtatt

SEQ ID NO: 4707383 - DNA, 16 bp, Homo sapiens
tgccatattctgttgg

SEQ ID NO: 4707384 - DNA, 20 bp, Homo sapiens
tgccatattctgttggccag

SEQ ID NO: 4707385 - DNA, 13 bp, Homo sapiens
tgccatcatctcc

SEQ ID NO: 4707386 - DNA, 12 bp, Homo sapiens
tgccatccaggt

SEQ ID NO: 4707387 - DNA, 21 bp, Homo sapiens
tgccatccaggttcagcttgt

SEQ ID NO: 4707388 - DNA, 23 bp, Homo sapiens
tgccatcctcaaacactgcaggc

SEQ ID NO: 4707389 - DNA, 16 bp, Homo sapiens
tgccatgcagggcctc

SEQ ID NO: 4707390 - DNA, 20 bp, Homo sapiens
tgccatgggcttcactgtat

SEQ ID NO: 4707391 - DNA, 15 bp, Homo sapiens
tgccatgttggccag

SEQ ID NO: 4707392 - DNA, 19 bp, Homo sapiens
tgccatgttggccaggctg

SEQ ID NO: 4707393 - DNA, 20 bp, Homo sapiens
tgccatgttggccaggctgg

SEQ ID NO: 4707394 - DNA, 19 bp, Homo sapiens
tgccattggggtagttgtg

SEQ ID NO: 4707395 - DNA, 15 bp, Homo sapiens
tgcttcgggcccttc

SEQ ID NO: 4707396 - DNA, 22 bp, Homo sapiens
tgcttctgatttagcaatgctg

SEQ ID NO: 4707397 - DNA, 23 bp, Homo sapiens
tgcttctggctttgttcttgtca

SEQ ID NO: 4707398 - DNA, 15 bp, Homo sapiens
tgcttcttgtaatat

SEQ ID NO: 4707399 - DNA, 19 bp, Homo sapiens
tgcttcttgtaatatttct

SEQ ID NO: 4707400 - DNA, 21 bp, Homo sapiens
tgcttcttgtaatatttcttc

SEQ ID NO: 4707401 - DNA, 15 bp, Homo sapiens
tgcttggaggaagga

SEQ ID NO: 4707402 - DNA, 16 bp, Homo sapiens
tgcttggaggaaggaa

SEQ ID NO: 4707403 - DNA, 15 bp, Homo sapiens
tgcttgtgtttgttt

SEQ ID NO: 4707404 - DNA, 13 bp, Homo sapiens
tgctttgaatgca

SEQ ID NO: 4707405 - DNA, 18 bp, Homo sapiens
tgcttttcattagcagtt

SEQ ID NO: 4707406 - DNA, 20 bp, Homo sapiens
tgcttttgtctatgggactc

SEQ ID NO: 4707407 - DNA, 14 bp, Homo sapiens
tgctttttccaact

SEQ ID NO: 4707408 - DNA, 19 bp, Homo sapiens
tgcttttttgattttgctg

SEQ ID NO: 4707409 - DNA, 13 bp, Homo sapiens
tggaaaagaaatc

SEQ ID NO: 4707410 - DNA, 11 bp, Homo sapiens
tggaaaataaa

SEQ ID NO: 4707411 - DNA, 15 bp, Homo sapiens
tggaaaataaatcaa

SEQ ID NO: 4707412 - DNA, 19 bp, Homo sapiens
tggaaactaccagtgggca

SEQ ID NO: 4707413 - DNA, 21 bp, Homo sapiens
tggaaactggatgaggtcata

SEQ ID NO: 4707414 - DNA, 20 bp, Homo sapiens
tggaaaggaagaatgcagag

SEQ ID NO: 4707415 - DNA, 20 bp, Homo sapiens
tggaaaggattctaaacaga

SEQ ID NO: 4707416 - DNA, 14 bp, Homo sapiens
tggaaatacacagt

SEQ ID NO: 4707417 - DNA, 23 bp, Homo sapiens
tggaaatgggcagagcagagacc

SEQ ID NO: 4707418 - DNA, 22 bp, Homo sapiens
tggaaattcccttcatctggaa

SEQ ID NO: 4707419 - DNA, 17 bp, Homo sapiens
tggaaattggaagagca

SEQ ID NO: 4707420 - DNA, 19 bp, Homo sapiens
tggaacagattcacactgt

SEQ ID NO: 4707421 - DNA, 23 bp, Homo sapiens
tggaacagattcacactgtctgg

SEQ ID NO: 4707422 - DNA, 20 bp, Homo sapiens
tggaaccaggcttgcctggg

SEQ ID NO: 4707423 - DNA, 15 bp, Homo sapiens
tggaacctcctttct

SEQ ID NO: 4707424 - DNA, 21 bp, Homo sapiens
tggaacgtttttcctgttctt

SEQ ID NO: 4707425 - DNA, 23 bp, Homo sapiens
tggaagacagagacctcctgcct

SEQ ID NO: 4707426 - DNA, 14 bp, Homo sapiens
tggaagctagctcc

SEQ ID NO: 4707427 - DNA, 18 bp, Homo sapiens
tggaagctagctcccctc

SEQ ID NO: 4707428 - DNA, 13 bp, Homo sapiens
tggaagctccgct

SEQ ID NO: 4707429 - DNA, 17 bp, Homo sapiens
tggaagtagtggagccc

SEQ ID NO: 4707430 - DNA, 17 bp, Homo sapiens
tggaagtccctcagagg

SEQ ID NO: 4707431 - DNA, 23 bp, Homo sapiens
tggaagtgactttggctgcatgc

SEQ ID NO: 4707432 - DNA, 12 bp, Homo sapiens
tggaagttattt

SEQ ID NO: 4707433 - DNA, 16 bp, Homo sapiens
tggaagttgcatggca

SEQ ID NO: 4707434 - DNA, 18 bp, Homo sapiens
tggaagttgcatggcatc

SEQ ID NO: 4707435 - DNA, 21 bp, Homo sapiens
tggaatcagattttaacagct

SEQ ID NO: 4707436 - DNA, 15 bp, Homo sapiens
tggaatctggagagc

SEQ ID NO: 4707437 - DNA, 20 bp, Homo sapiens
tggaatcttcacctcagagt

SEQ ID NO: 4707438 - DNA, 21 bp, Homo sapiens
tggaatcttcacctcagagtg

SEQ ID NO: 4707439 - DNA, 17 bp, Homo sapiens
tggaatgggcagctcat

SEQ ID NO: 4707440 - DNA, 21 bp, Homo sapiens
tggaattatgctggcttctga

SEQ ID NO: 4707441 - DNA, 14 bp, Homo sapiens
tggaattggacata

SEQ ID NO: 4707442 - DNA, 21 bp, Homo sapiens
tggacacagctcttctccagg

SEQ ID NO: 4707443 - DNA, 23 bp, Homo sapiens
tggacacagctcttctccaggct

SEQ ID NO: 4707444 - DNA, 12 bp, Homo sapiens
tggacaccaccc

SEQ ID NO: 4707445 - DNA, 23 bp, Homo sapiens
tggacaccacccagagcaccctc

SEQ ID NO: 4707446 - DNA, 16 bp, Homo sapiens
tggacaggcatgttct

SEQ ID NO: 4707447 - DNA, 17 bp, Homo sapiens
tggacaggcatgttctc

SEQ ID NO: 4707448 - DNA, 22 bp, Homo sapiens
tggacaggcatgttctctgagg

SEQ ID NO: 4707449 - DNA, 23 bp, Homo sapiens
tggacatagcccaagaacagaaa

SEQ ID NO: 4707450 - DNA, 15 bp, Homo sapiens
tggacatcgatatga

SEQ ID NO: 4707451 - DNA, 12 bp, Homo sapiens
tggacatggccc

SEQ ID NO: 4707452 - DNA, 17 bp, Homo sapiens
tggacatggcccctgtg

SEQ ID NO: 4707453 - DNA, 13 bp, Homo sapiens
tggacattttatg

SEQ ID NO: 4707454 - DNA, 22 bp, Homo sapiens
tggaccaaaaaaataaagcatt

SEQ ID NO: 4707455 - DNA, 16 bp, Homo sapiens
tggacccctgcattgg

SEQ ID NO: 4707456 - DNA, 12 bp, Homo sapiens
tggaccctgagg

SEQ ID NO: 4707457 - DNA, 13 bp, Homo sapiens
tggaccctgaggc

SEQ ID NO: 4707458 - DNA, 18 bp, Homo sapiens
tggaccggagagtggggg

SEQ ID NO: 4707459 - DNA, 20 bp, Homo sapiens
tggaccttgaactgggtact

SEQ ID NO: 4707460 - DNA, 17 bp, Homo sapiens
tggactatgcacacttt

SEQ ID NO: 4707461 - DNA, 18 bp, Homo sapiens
tggactcacctcccccat

SEQ ID NO: 4707462 - DNA, 16 bp, Homo sapiens
tggactcaggaacttt

SEQ ID NO: 4707463 - DNA, 14 bp, Homo sapiens
tggacttggggcct

SEQ ID NO: 4707464 - DNA, 15 bp, Homo sapiens
tggacttggggcctc

SEQ ID NO: 4707465 - DNA, 19 bp, Homo sapiens
tggacttgtccaattaatg

SEQ ID NO: 4707466 - DNA, 19 bp, Homo sapiens
tggagaactagaacctgga

SEQ ID NO: 4707467 - DNA, 18 bp, Homo sapiens
tggagaagccacaggcct

SEQ ID NO: 4707468 - DNA, 15 bp, Homo sapiens
tggagaatggtgttc

SEQ ID NO: 4707469 - DNA, 19 bp, Homo sapiens
tggagagccagaacctgga

SEQ ID NO: 4707470 - DNA, 21 bp, Homo sapiens
tggagagctagaacctggaga

SEQ ID NO: 4707471 - DNA, 23 bp, Homo sapiens
tggagagctagaacctggagagc

SEQ ID NO: 4707472 - DNA, 20 bp, Homo sapiens
tggagagctggagcctggtg

SEQ ID NO: 4707473 - DNA, 19 bp, Homo sapiens
tggagagtgagagcatgtg

SEQ ID NO: 4707474 - DNA, 16 bp, Homo sapiens
tggagcagaggggctg

SEQ ID NO: 4707475 - DNA, 20 bp, Homo sapiens
tggagcccagaggagggcag

SEQ ID NO: 4707476 - DNA, 14 bp, Homo sapiens
tggagcctggtgcc

SEQ ID NO: 4707477 - DNA, 22 bp, Homo sapiens
tggagcggctcatcagaactga

SEQ ID NO: 4707478 - DNA, 15 bp, Homo sapiens
tggagctgcctgata

SEQ ID NO: 4707479 - DNA, 18 bp, Homo sapiens
tggaggaaggaaacccag

SEQ ID NO: 4707480 - DNA, 23 bp, Homo sapiens
tggaggaaggaaacccagctctg

SEQ ID NO: 4707481 - DNA, 18 bp, Homo sapiens
tggaggaaggattgtaaa

SEQ ID NO: 4707482 - DNA, 20 bp, Homo sapiens
tggaggactagaacctggag

SEQ ID NO: 4707483 - DNA, 21 bp, Homo sapiens
tggaggactagaacctggagg

SEQ ID NO: 4707484 - DNA, 15 bp, Homo sapiens
tggaggagacaggaa

SEQ ID NO: 4707485 - DNA, 17 bp, Homo sapiens
tggaggagacaggaagc

SEQ ID NO: 4707486 - DNA, 11 bp, Homo sapiens
tggaggagcaa

SEQ ID NO: 4707487 - DNA, 16 bp, Homo sapiens
tggaggagcaaaggct

SEQ ID NO: 4707488 - DNA, 13 bp, Homo sapiens
tggaggagcagtg

SEQ ID NO: 4707489 - DNA, 14 bp, Homo sapiens
tggaggagcccagg

SEQ ID NO: 4707490 - DNA, 20 bp, Homo sapiens
tggaggagctcaggacacta

SEQ ID NO: 4707491 - DNA, 15 bp, Homo sapiens
tggaggatttggtca

SEQ ID NO: 4707492 - DNA, 20 bp, Homo sapiens
tggagggaatgaacctggag

SEQ ID NO: 4707493 - DNA, 18 bp, Homo sapiens
tggagggatcattttctg

SEQ ID NO: 4707494 - DNA, 21 bp, Homo sapiens
tggagggctagaacctggaga

SEQ ID NO: 4707495 - DNA, 23 bp, Homo sapiens
tggagggctagaatctggagagc

SEQ ID NO: 4707496 - DNA, 21 bp, Homo sapiens
tggaggggtcatccttgccca

SEQ ID NO: 4707497 - DNA, 19 bp, Homo sapiens
tggaggtttcacttgcaca

SEQ ID NO: 4707498 - DNA, 14 bp, Homo sapiens
tggagtcccagagc

SEQ ID NO: 4707499 - DNA, 22 bp, Homo sapiens
tggagtcccagagctgcacagg

SEQ ID NO: 4707500 - DNA, 22 bp, Homo sapiens
tggagtgtttgacgaagaaaca

SEQ ID NO: 4707501 - DNA, 14 bp, Homo sapiens
tggagttgaaaatc

SEQ ID NO: 4707502 - DNA, 17 bp, Homo sapiens
tggataatattcattgg

SEQ ID NO: 4707503 - DNA, 18 bp, Homo sapiens
tggatatgtgtaaatgtt

SEQ ID NO: 4707504 - DNA, 21 bp, Homo sapiens
tgggttttgtattctctgagc

SEQ ID NO: 4707505 - DNA, 18 bp, Homo sapiens
tggtaagatgtcttgaaa

SEQ ID NO: 4707506 - DNA, 15 bp, Homo sapiens
tggtatctaattctt

SEQ ID NO: 4707507 - DNA, 21 bp, Homo sapiens
tggtatctaattctttaatga

SEQ ID NO: 4707508 - DNA, 24 bp, Homo sapiens
tggtattaactttatacacttgga

SEQ ID NO: 4707509 - DNA, 14 bp, Homo sapiens
tggtattacacagt

SEQ ID NO: 4707510 - DNA, 19 bp, Homo sapiens
tggtcagccctagggtgga

SEQ ID NO: 4707511 - DNA, 19 bp, Homo sapiens
tggtcattcctaatgcatt

SEQ ID NO: 4707512 - DNA, 14 bp, Homo sapiens
tggtcccccttcca

SEQ ID NO: 4707513 - DNA, 18 bp, Homo sapiens
tggtcccccttccatgga

SEQ ID NO: 4707514 - DNA, 23 bp, Homo sapiens
tggtcccccttccatggactttg

SEQ ID NO: 4707515 - DNA, 12 bp, Homo sapiens
tggtccctgggg

SEQ ID NO: 4707516 - DNA, 13 bp, Homo sapiens
tggtcctgctgca

SEQ ID NO: 4707517 - DNA, 12 bp, Homo sapiens
tggtcctttggg

SEQ ID NO: 4707518 - DNA, 19 bp, Homo sapiens
tggtctatctttgagcgcc

SEQ ID NO: 4707519 - DNA, 15 bp, Homo sapiens
tggtctcccccagcc

SEQ ID NO: 4707520 - DNA, 16 bp, Homo sapiens
tggtctctaggctggg

SEQ ID NO: 4707521 - DNA, 17 bp, Homo sapiens
tggtctctaggctgggg

SEQ ID NO: 4707522 - DNA, 17 bp, Homo sapiens
tggtctgacccactgct

SEQ ID NO: 4707523 - DNA, 17 bp, Homo sapiens
tggtctgctcgggccca

SEQ ID NO: 4707524 - DNA, 21 bp, Homo sapiens
tggtctgctcgggcccaggcc

SEQ ID NO: 4707525 - DNA, 20 bp, Homo sapiens
tggtcttaatgttgaatgta

SEQ ID NO: 4707526 - DNA, 20 bp, Homo sapiens
tggtcttactttgtgcaaaa

SEQ ID NO: 4707527 - DNA, 20 bp, Homo sapiens
tggtctttcttacaaggaag

SEQ ID NO: 4707528 - DNA, 22 bp, Homo sapiens
tggtctttgtaagagtgtagaa

SEQ ID NO: 4707529 - DNA, 17 bp, Homo sapiens
tggtgcaattaactctg

SEQ ID NO: 4707530 - DNA, 20 bp, Homo sapiens
tggtgccaatggaacctcct

SEQ ID NO: 4707531 - DNA, 22 bp, Homo sapiens
tggtgccaatggaacctccttt

SEQ ID NO: 4707532 - DNA, 20 bp, Homo sapiens
tggtgccacaaataaaatgg

SEQ ID NO: 4707533 - DNA, 20 bp, Homo sapiens
tggtgccctgttctctacca

SEQ ID NO: 4707534 - DNA, 10 bp, Homo sapiens
tggtgcctga

SEQ ID NO: 4707535 - DNA, 21 bp, Homo sapiens
tggtgcctgattcggctgtct

SEQ ID NO: 4707536 - DNA, 17 bp, Homo sapiens
tggtgcgatctgggttc

SEQ ID NO: 4707537 - DNA, 12 bp, Homo sapiens
tggtggcagctc

SEQ ID NO: 4707538 - DNA, 19 bp, Homo sapiens
tggtggcagctcacctctc

SEQ ID NO: 4707539 - DNA, 12 bp, Homo sapiens
tggtggcagctg

SEQ ID NO: 4707540 - DNA, 13 bp, Homo sapiens
tggtggcagctgc

SEQ ID NO: 4707541 - DNA, 13 bp, Homo sapiens
tggtggcagtggg

SEQ ID NO: 4707542 - DNA, 18 bp, Homo sapiens
tggtggcagtgggagctg

SEQ ID NO: 4707543 - DNA, 14 bp, Homo sapiens
tggtggccctctcc

SEQ ID NO: 4707544 - DNA, 19 bp, Homo sapiens
tggtggccctctcccctgc

SEQ ID NO: 4707545 - DNA, 21 bp, Homo sapiens
tggtggccctctcccctgccc

SEQ ID NO: 4707546 - DNA, 22 bp, Homo sapiens
tggtggccctctcccctgcccc

SEQ ID NO: 4707547 - DNA, 23 bp, Homo sapiens
tggtggccctctcccctgccccc

SEQ ID NO: 4707548 - DNA, 13 bp, Homo sapiens
tggtggctgggtt

SEQ ID NO: 4707549 - DNA, 21 bp, Homo sapiens
tggtggggcccatggaggaga

SEQ ID NO: 4707550 - DNA, 20 bp, Homo sapiens
tggtggggctgccaggggag

SEQ ID NO: 4707551 - DNA, 17 bp, Homo sapiens
tggtgggtccatgggca

SEQ ID NO: 4707552 - DNA, 18 bp, Homo sapiens
tggtgggtccatgggcag

SEQ ID NO: 4707553 - DNA, 19 bp, Homo sapiens
tggtgtctccaacccccca

SEQ ID NO: 4707554 - DNA, 19 bp, Homo sapiens
tggtgtctggattcccagg

SEQ ID NO: 4707555 - DNA, 15 bp, Homo sapiens
tggtgtgtgtatgcg

SEQ ID NO: 4707556 - DNA, 18 bp, Homo sapiens
tggtgtgtgtctctgaca

SEQ ID NO: 4707557 - DNA, 21 bp, Homo sapiens
tggttaacaataaagtgacaa

SEQ ID NO: 4707558 - DNA, 13 bp, Homo sapiens
tggttaatgccat

SEQ ID NO: 4707559 - DNA, 16 bp, Homo sapiens
tggttactagtacagg

SEQ ID NO: 4707560 - DNA, 19 bp, Homo sapiens
tggttagagaagtaagcag

SEQ ID NO: 4707561 - DNA, 13 bp, Homo sapiens
tggttatttaatc

SEQ ID NO: 4707562 - DNA, 18 bp, Homo sapiens
tggttcagctactttcca

SEQ ID NO: 4707563 - DNA, 20 bp, Homo sapiens
tggttcagctactttccatt

SEQ ID NO: 4707564 - DNA, 23 bp, Homo sapiens
tggttcagggttggcccctgccc

SEQ ID NO: 4707565 - DNA, 21 bp, Homo sapiens
tggttccgcccactcattcct

SEQ ID NO: 4707566 - DNA, 11 bp, Homo sapiens
tggttctcatc

SEQ ID NO: 4707567 - DNA, 13 bp, Homo sapiens
tggttctcatctt

SEQ ID NO: 4707568 - DNA, 13 bp, Homo sapiens
tggttgcatccta

SEQ ID NO: 4707569 - DNA, 16 bp, Homo sapiens
tggttggagagctaga

SEQ ID NO: 4707570 - DNA, 20 bp, Homo sapiens
tggttgtatatttttatatt

SEQ ID NO: 4707571 - DNA, 19 bp, Homo sapiens
tggtttggccatctctgga

SEQ ID NO: 4707572 - DNA, 21 bp, Homo sapiens
tggtttggcccttctcctttt

SEQ ID NO: 4707573 - DNA, 17 bp, Homo sapiens
tggttttgttcccctcc

SEQ ID NO: 4707574 - DNA, 18 bp, Homo sapiens
tgtaaaaaaaaatgcctt

SEQ ID NO: 4707575 - DNA, 11 bp, Homo sapiens
tgtaaagatgt

SEQ ID NO: 4707576 - DNA, 19 bp, Homo sapiens
tgtaaaggtatattgtgaa

SEQ ID NO: 4707577 - DNA, 21 bp, Homo sapiens
tgtaaatactgtttttaacaa

SEQ ID NO: 4707578 - DNA, 11 bp, Homo sapiens
tgtaacatgta

SEQ ID NO: 4707579 - DNA, 14 bp, Homo sapiens
tgtaacgattgaca

SEQ ID NO: 4707580 - DNA, 21 bp, Homo sapiens
tgtaacgattgacaccaaaat

SEQ ID NO: 4707581 - DNA, 17 bp, Homo sapiens
tgtaacttccaaataaa

SEQ ID NO: 4707582 - DNA, 21 bp, Homo sapiens
tgtaagaaaacaaactaaatg

SEQ ID NO: 4707583 - DNA, 18 bp, Homo sapiens
tgtaagaactacaaacaa

SEQ ID NO: 4707584 - DNA, 19 bp, Homo sapiens
tgtaagaactacaaacaaa

SEQ ID NO: 4707585 - DNA, 18 bp, Homo sapiens
tgtaagagtgtagaagca

SEQ ID NO: 4707586 - DNA, 14 bp, Homo sapiens
tgtaagtttcaggt

SEQ ID NO: 4707587 - DNA, 16 bp, Homo sapiens
tgtaagtttcaggtga

SEQ ID NO: 4707588 - DNA, 18 bp, Homo sapiens
tgtaagtttcaggtgaca

SEQ ID NO: 4707589 - DNA, 23 bp, Homo sapiens
tgtaagtttcaggtgacatgtga

SEQ ID NO: 4707590 - DNA, 15 bp, Homo sapiens
tgtaataaatactgc

SEQ ID NO: 4707591 - DNA, 15 bp, Homo sapiens
tgtaataagacataa

SEQ ID NO: 4707592 - DNA, 18 bp, Homo sapiens
tgtaataagacataacgt

SEQ ID NO: 4707593 - DNA, 14 bp, Homo sapiens
tgtaataatagact

SEQ ID NO: 4707594 - DNA, 14 bp, Homo sapiens
tgtaatatctttaa

SEQ ID NO: 4707595 - DNA, 21 bp, Homo sapiens
tgtaatatctttaaatgatgt

SEQ ID NO: 4707596 - DNA, 23 bp, Homo sapiens
tgtaatatctttaaatgatgtac

SEQ ID NO: 4707597 - DNA, 20 bp, Homo sapiens
tgtaatattctctgatgttt

SEQ ID NO: 4707598 - DNA, 14 bp, Homo sapiens
tgtaatattgtaaa

SEQ ID NO: 4707599 - DNA, 20 bp, Homo sapiens
tgtaatatttcttcaagtga

SEQ ID NO: 4707600 - DNA, 21 bp, Homo sapiens
tgtaatatttcttcaagtgag

SEQ ID NO: 4707601 - DNA, 17 bp, Homo sapiens
tgtaatggactatgcac

SEQ ID NO: 4707602 - DNA, 16 bp, Homo sapiens
tgtaattataagctga

SEQ ID NO: 4707603 - DNA, 11 bp, Homo sapiens
tgtaattattg

SEQ ID NO: 4707604 - DNA, 15 bp, Homo sapiens
tgtaattggaatctt

SEQ ID NO: 4707605 - DNA, 21 bp, Homo sapiens
tgtaattggaatcttcacctc

SEQ ID NO: 4707606 - DNA, 20 bp, Homo sapiens
tgtaattgtgtggattcttt

SEQ ID NO: 4707607 - DNA, 21 bp, Homo sapiens
tgtaattgtgtggattcttta

SEQ ID NO: 4707608 - DNA, 13 bp, Homo sapiens
tgtacaaaagcaa

SEQ ID NO: 4707609 - DNA, 15 bp, Homo sapiens
tgtacaaaagcaatg

SEQ ID NO: 4707610 - DNA, 13 bp, Homo sapiens
tgtacaaggtatg

SEQ ID NO: 4707611 - DNA, 18 bp, Homo sapiens
tgtacaaggtatgtacag

SEQ ID NO: 4707612 - DNA, 12 bp, Homo sapiens
tgtacagtcttg

SEQ ID NO: 4707613 - DNA, 17 bp, Homo sapiens
tgtacagtcttgtatta

SEQ ID NO: 4707614 - DNA, 15 bp, Homo sapiens
tgtctttctttgctg

SEQ ID NO: 4707615 - DNA, 19 bp, Homo sapiens
tgtctttctttgctgctgt

SEQ ID NO: 4707616 - DNA, 22 bp, Homo sapiens
tgtctttggaccctgaggccca

SEQ ID NO: 4707617 - DNA, 16 bp, Homo sapiens
tgtcttttcttgcatg

SEQ ID NO: 4707618 - DNA, 22 bp, Homo sapiens
tgtgaaaccttttttaagattt

SEQ ID NO: 4707619 - DNA, 13 bp, Homo sapiens
tgtgaaaggaaag

SEQ ID NO: 4707620 - DNA, 15 bp, Homo sapiens
tgtgaaaggaaagag

SEQ ID NO: 4707621 - DNA, 19 bp, Homo sapiens
tgtgaaatcatcaaaaaga

SEQ ID NO: 4707622 - DNA, 21 bp, Homo sapiens
tgtgaaccaccacacccagcc

SEQ ID NO: 4707623 - DNA, 22 bp, Homo sapiens
tgtgaaccaccacacccagccc

SEQ ID NO: 4707624 - DNA, 17 bp, Homo sapiens
tgtgaactccatcattc

SEQ ID NO: 4707625 - DNA, 23 bp, Homo sapiens
tgtgaaggcaggggaatgtatgt

SEQ ID NO: 4707626 - DNA, 16 bp, Homo sapiens
tgtgaatagattttag

SEQ ID NO: 4707627 - DNA, 21 bp, Homo sapiens
tgtgaatattgtggctccctg

SEQ ID NO: 4707628 - DNA, 14 bp, Homo sapiens
tgtgaatgcttctg

SEQ ID NO: 4707629 - DNA, 18 bp, Homo sapiens
tgtgaatgcttctgattt

SEQ ID NO: 4707630 - DNA, 13 bp, Homo sapiens
tgtgaatggattg

SEQ ID NO: 4707631 - DNA, 22 bp, Homo sapiens
tgtgaatggattggattattta

SEQ ID NO: 4707632 - DNA, 17 bp, Homo sapiens
tgtgacaggcagcagag

SEQ ID NO: 4707633 - DNA, 16 bp, Homo sapiens
tgtgaccaatgtcttg

SEQ ID NO: 4707634 - DNA, 12 bp, Homo sapiens
tgtgaggaagcc

SEQ ID NO: 4707635 - DNA, 15 bp, Homo sapiens
tgtgaggccagggca

SEQ ID NO: 4707636 - DNA, 22 bp, Homo sapiens
tgtgaggccagggcagagtgag

SEQ ID NO: 4707637 - DNA, 13 bp, Homo sapiens
tgtgagggagaga

SEQ ID NO: 4707638 - DNA, 17 bp, Homo sapiens
tgtgagggagagaactg

SEQ ID NO: 4707639 - DNA, 15 bp, Homo sapiens
tgtgagtcaccaagc

SEQ ID NO: 4707640 - DNA, 19 bp, Homo sapiens
tgtgagtcaccaagcccag

SEQ ID NO: 4707641 - DNA, 17 bp, Homo sapiens
tgtgatcatctttgctg

SEQ ID NO: 4707642 - DNA, 13 bp, Homo sapiens
tgtgatcgtctga

SEQ ID NO: 4707643 - DNA, 18 bp, Homo sapiens
tgtgatgacaactggaat

SEQ ID NO: 4707644 - DNA, 19 bp, Homo sapiens
tgtgatgactggttgttca

SEQ ID NO: 4707645 - DNA, 16 bp, Homo sapiens
tgtgatgaggcagagg

SEQ ID NO: 4707646 - DNA, 13 bp, Homo sapiens
tgtgatgtcccag

SEQ ID NO: 4707647 - DNA, 15 bp, Homo sapiens
tgtgatttcccgtgg

SEQ ID NO: 4707648 - DNA, 24 bp, Homo sapiens
tgtgatttcccgtggccccagcct

SEQ ID NO: 4707649 - DNA, 13 bp, Homo sapiens
tgtgcaatagaag

SEQ ID NO: 4707650 - DNA, 16 bp, Homo sapiens
tgtgcaatagaaggtg

SEQ ID NO: 4707651 - DNA, 20 bp, Homo sapiens
tgtgcacatctgtgtcttgt

SEQ ID NO: 4707652 - DNA, 21 bp, Homo sapiens
tgtgcacatctgtgtcttgtt

SEQ ID NO: 4707653 - DNA, 16 bp, Homo sapiens
tgtgcacatgcacgtg

SEQ ID NO: 4707654 - DNA, 22 bp, Homo sapiens
tgtgcagataaacagaaatgct

SEQ ID NO: 4707655 - DNA, 22 bp, Homo sapiens
tgtgcagctgacttttctgacc

SEQ ID NO: 4707656 - DNA, 12 bp, Homo sapiens
tgtgccaccctg

SEQ ID NO: 4707657 - DNA, 20 bp, Homo sapiens
tgtgccatacttgttctgta

SEQ ID NO: 4707658 - DNA, 20 bp, Homo sapiens
tgtgcccatgggcactgctg

SEQ ID NO: 4707659 - DNA, 16 bp, Homo sapiens
tgtgccccccatcctg

SEQ ID NO: 4707660 - DNA, 18 bp, Homo sapiens
tgtgccccccatcctggc

SEQ ID NO: 4707661 - DNA, 21 bp, Homo sapiens
tgtgccccccatcctggccca

SEQ ID NO: 4707662 - DNA, 15 bp, Homo sapiens
tgtgcctaatgtgtt

SEQ ID NO: 4707663 - DNA, 18 bp, Homo sapiens
tgtgcctaatgtgtttga

SEQ ID NO: 4707664 - DNA, 20 bp, Homo sapiens
tgtgcctgggtggacatggc

SEQ ID NO: 4707665 - DNA, 13 bp, Homo sapiens
tgtgcgagtctga

SEQ ID NO: 4707666 - DNA, 14 bp, Homo sapiens
tgtgctatttaatt

SEQ ID NO: 4707667 - DNA, 12 bp, Homo sapiens
tgtgctctgatc

SEQ ID NO: 4707668 - DNA, 15 bp, Homo sapiens
tgtgctctggacagg

SEQ ID NO: 4707669 - DNA, 19 bp, Homo sapiens
tgtgctctggacaggcatg

SEQ ID NO: 4707670 - DNA, 12 bp, Homo sapiens
tgtgctgccctg

SEQ ID NO: 4707671 - DNA, 22 bp, Homo sapiens
tgtgcttatgtatgaggtacaa

SEQ ID NO: 4707672 - DNA, 21 bp, Homo sapiens
tgtggaaaggattctaaacag

SEQ ID NO: 4707673 - DNA, 14 bp, Homo sapiens
tgtggacacagctc

SEQ ID NO: 4707674 - DNA, 19 bp, Homo sapiens
tgtggacacagctcttctc

SEQ ID NO: 4707675 - DNA, 12 bp, Homo sapiens
tgtggaggaagg

SEQ ID NO: 4707676 - DNA, 21 bp, Homo sapiens
tgtggaggaaggattgtaaaa

SEQ ID NO: 4707677 - DNA, 19 bp, Homo sapiens
tgtggagggcacattcctt

SEQ ID NO: 4707678 - DNA, 19 bp, Homo sapiens
tgtggcacagatgcccacg

SEQ ID NO: 4707679 - DNA, 17 bp, Homo sapiens
tgtggcaggagggcagt

SEQ ID NO: 4707680 - DNA, 15 bp, Homo sapiens
tgtggcctgggcctc

SEQ ID NO: 4707681 - DNA, 21 bp, Homo sapiens
tgtgggcgtgagacctgcccc

SEQ ID NO: 4707682 - DNA, 23 bp, Homo sapiens
tgtgggggaagagcacagccctc

SEQ ID NO: 4707683 - DNA, 15 bp, Homo sapiens
tgtgggtcaaggaat

SEQ ID NO: 4707684 - DNA, 18 bp, Homo sapiens
tgtgggttgtgatattga

SEQ ID NO: 4707685 - DNA, 22 bp, Homo sapiens
tgtggtcaacatttctcatgtt

SEQ ID NO: 4707686 - DNA, 16 bp, Homo sapiens
tgtggtcccaccccac

SEQ ID NO: 4707687 - DNA, 15 bp, Homo sapiens
tgtggttaatgccat

SEQ ID NO: 4707688 - DNA, 20 bp, Homo sapiens
tgtggttaatgccatggaca

SEQ ID NO: 4707689 - DNA, 21 bp, Homo sapiens
tgtggttcagctactttccat

SEQ ID NO: 4707690 - DNA, 13 bp, Homo sapiens
tgtgtaacagaac

SEQ ID NO: 4707691 - DNA, 22 bp, Homo sapiens
tgtgtaaggtatatgttttata

SEQ ID NO: 4707692 - DNA, 13 bp, Homo sapiens
tgtgtagagttaa

SEQ ID NO: 4707693 - DNA, 16 bp, Homo sapiens
tgtgtagagttaagaa

SEQ ID NO: 4707694 - DNA, 18 bp, Homo sapiens
tgtgtagagttaagaagc

SEQ ID NO: 4707695 - DNA, 19 bp, Homo sapiens
tgtgtagagttaagaagct

SEQ ID NO: 4707696 - DNA, 20 bp, Homo sapiens
tgtgtatccagtatgcacgt

SEQ ID NO: 4707697 - DNA, 14 bp, Homo sapiens
tgtgtcaatgtaaa

SEQ ID NO: 4707698 - DNA, 18 bp, Homo sapiens
tgtgtcaatgtaaagcca

SEQ ID NO: 4707699 - DNA, 17 bp, Homo sapiens
tgtgtccacgactgtct

SEQ ID NO: 4707700 - DNA, 18 bp, Homo sapiens
tgtgtccacgactgtctc

SEQ ID NO: 4707701 - DNA, 21 bp, Homo sapiens
tgtgtccccctctgtccaggc

SEQ ID NO: 4707702 - DNA, 19 bp, Homo sapiens
tgtgtctaggcaggacctg

SEQ ID NO: 4707703 - DNA, 15 bp, Homo sapiens
tgtgtctctgtatat

SEQ ID NO: 4707704 - DNA, 13 bp, Homo sapiens
tgtgtctcttggt

SEQ ID NO: 4707705 - DNA, 21 bp, Homo sapiens
tgtgtctcttggtcctgctgc

SEQ ID NO: 4707706 - DNA, 20 bp, Homo sapiens
tgtgtcttgcaatggcagcc

SEQ ID NO: 4707707 - DNA, 19 bp, Homo sapiens
tgtgtgaatttttctaaac

SEQ ID NO: 4707708 - DNA, 21 bp, Homo sapiens
tgtgtggcaaattaaacaata

SEQ ID NO: 4707709 - DNA, 21 bp, Homo sapiens
tgtgtggtttcagttctgtgt

SEQ ID NO: 4707710 - DNA, 12 bp, Homo sapiens
tgtgtgtctctg

SEQ ID NO: 4707711 - DNA, 19 bp, Homo sapiens
tgtgtgtgcttatgtatga

SEQ ID NO: 4707712 - DNA, 11 bp, Homo sapiens
tgtgtgtgtgc

SEQ ID NO: 4707713 - DNA, 14 bp, Homo sapiens
tgtgtgttcacctt

SEQ ID NO: 4707714 - DNA, 16 bp, Homo sapiens
tgtgtgttgatactgt

SEQ ID NO: 4707715 - DNA, 17 bp, Homo sapiens
tgtgtgttgatactgtt

SEQ ID NO: 4707716 - DNA, 21 bp, Homo sapiens
tgtgttcaccttcaaaatgtt

SEQ ID NO: 4707717 - DNA, 22 bp, Homo sapiens
tgtgttcaccttcaaaatgttc

SEQ ID NO: 4707718 - DNA, 15 bp, Homo sapiens
tgtgttgatactgtt

SEQ ID NO: 4707719 - DNA, 18 bp, Homo sapiens
tgtgttgatactgttgca

SEQ ID NO: 4707720 - DNA, 23 bp, Homo sapiens
tgtgttgatactgttgcacgtgt

SEQ ID NO: 4707721 - DNA, 23 bp, Homo sapiens
tgtgttgcataaacaatccaaat

SEQ ID NO: 4707722 - DNA, 23 bp, Homo sapiens
tgtgtttgtttgtttgcagtctc

SEQ ID NO: 4707723 - DNA, 14 bp, Homo sapiens
ttactgtctgtagt

SEQ ID NO: 4707724 - DNA, 14 bp, Homo sapiens
ttactgtggaggaa

SEQ ID NO: 4707725 - DNA, 17 bp, Homo sapiens
ttactgtggaggaagga

SEQ ID NO: 4707726 - DNA, 18 bp, Homo sapiens
ttactgtggaggaaggat

SEQ ID NO: 4707727 - DNA, 22 bp, Homo sapiens
ttactgtttgtcttctccccag

SEQ ID NO: 4707728 - DNA, 16 bp, Homo sapiens
ttacttaaacatcatt

SEQ ID NO: 4707729 - DNA, 21 bp, Homo sapiens
ttacttcccagtataagattt

SEQ ID NO: 4707730 - DNA, 20 bp, Homo sapiens
ttactttaccacccccacac

SEQ ID NO: 4707731 - DNA, 21 bp, Homo sapiens
ttactttggggctaatttaac

SEQ ID NO: 4707732 - DNA, 23 bp, Homo sapiens
ttagaagcctgcataatgtttct

SEQ ID NO: 4707733 - DNA, 16 bp, Homo sapiens
ttagaagtcacacagt

SEQ ID NO: 4707734 - DNA, 14 bp, Homo sapiens
ttagaatcagtgtg

SEQ ID NO: 4707735 - DNA, 14 bp, Homo sapiens
ttagacagtccctg

SEQ ID NO: 4707736 - DNA, 17 bp, Homo sapiens
ttagacagtccctgcca

SEQ ID NO: 4707737 - DNA, 15 bp, Homo sapiens
ttagactcaaagaat

SEQ ID NO: 4707738 - DNA, 22 bp, Homo sapiens
ttagactttaaaatgagctact

SEQ ID NO: 4707739 - DNA, 14 bp, Homo sapiens
ttagattgtgttcc

SEQ ID NO: 4707740 - DNA, 15 bp, Homo sapiens
ttagattttctgtaa

SEQ ID NO: 4707741 - DNA, 18 bp, Homo sapiens
ttagcaatgctgtgaata

SEQ ID NO: 4707742 - DNA, 15 bp, Homo sapiens
ttagcataattttgt

SEQ ID NO: 4707743 - DNA, 21 bp, Homo sapiens
ttagcatgatgaaactgtcat

SEQ ID NO: 4707744 - DNA, 15 bp, Homo sapiens
ttagccagtcattgt

SEQ ID NO: 4707745 - DNA, 12 bp, Homo sapiens
ttagcccccacc

SEQ ID NO: 4707746 - DNA, 11 bp, Homo sapiens
ttagctattta

SEQ ID NO: 4707747 - DNA, 19 bp, Homo sapiens
ttagctatttaatactaat

SEQ ID NO: 4707748 - DNA, 12 bp, Homo sapiens
ttagctgggaga

SEQ ID NO: 4707749 - DNA, 17 bp, Homo sapiens
ttaggattgcagatttc

SEQ ID NO: 4707750 - DNA, 14 bp, Homo sapiens
ttaggcctggcaca

SEQ ID NO: 4707751 - DNA, 18 bp, Homo sapiens
ttaggcctggcacagtgt

SEQ ID NO: 4707752 - DNA, 16 bp, Homo sapiens
ttagtaaatatgtgaa

SEQ ID NO: 4707753 - DNA, 12 bp, Homo sapiens
ttagtaacatgt

SEQ ID NO: 4707754 - DNA, 17 bp, Homo sapiens
ttagtagagacagggtt

SEQ ID NO: 4707755 - DNA, 18 bp, Homo sapiens
ttagtattttaatcctgt

SEQ ID NO: 4707756 - DNA, 13 bp, Homo sapiens
ttagtcattatta

SEQ ID NO: 4707757 - DNA, 14 bp, Homo sapiens
ttagtcctgtactg

SEQ ID NO: 4707758 - DNA, 18 bp, Homo sapiens
ttagtgatgtcatctgtc

SEQ ID NO: 4707759 - DNA, 12 bp, Homo sapiens
ttagtggcttca

SEQ ID NO: 4707760 - DNA, 13 bp, Homo sapiens
ttagttgctgtat

SEQ ID NO: 4707761 - DNA, 20 bp, Homo sapiens
ttagtttttaaaatatcttt

SEQ ID NO: 4707762 - DNA, 19 bp, Homo sapiens
ttataaaaaatggtgcctg

SEQ ID NO: 4707763 - DNA, 23 bp, Homo sapiens
ttataaaatattgttaatgccta

SEQ ID NO: 4707764 - DNA, 14 bp, Homo sapiens
ttataaaccaatct

SEQ ID NO: 4707765 - DNA, 18 bp, Homo sapiens
ttataaaccaatcttaaa

SEQ ID NO: 4707766 - DNA, 17 bp, Homo sapiens
ttataaacctctaattt

SEQ ID NO: 4707767 - DNA, 19 bp, Homo sapiens
ttataaatatcctgctcac

SEQ ID NO: 4707768 - DNA, 14 bp, Homo sapiens
ttataattttccta

SEQ ID NO: 4707769 - DNA, 16 bp, Homo sapiens
ttataattttcctaat

SEQ ID NO: 4707770 - DNA, 16 bp, Homo sapiens
ttataccccatttgat

SEQ ID NO: 4707771 - DNA, 18 bp, Homo sapiens
ttataccccctgcaaagc

SEQ ID NO: 4707772 - DNA, 18 bp, Homo sapiens
ttatatacttgttgttta

SEQ ID NO: 4707773 - DNA, 23 bp, Homo sapiens
ttatattacttgcctatctgact

SEQ ID NO: 4707774 - DNA, 10 bp, Homo sapiens
ttatattctt

SEQ ID NO: 4707775 - DNA, 20 bp, Homo sapiens
ttatattgtttttgtattta

SEQ ID NO: 4707776 - DNA, 16 bp, Homo sapiens
ttatatttacaaatgg

SEQ ID NO: 4707777 - DNA, 18 bp, Homo sapiens
ttatatttggcccaaact

SEQ ID NO: 4707778 - DNA, 17 bp, Homo sapiens
ttatattttgctgttta

SEQ ID NO: 4707779 - DNA, 19 bp, Homo sapiens
ttatcagttatattttgct

SEQ ID NO: 4707780 - DNA, 14 bp, Homo sapiens
ttatccagaagtat

SEQ ID NO: 4707781 - DNA, 17 bp, Homo sapiens
ttatctaatttgtgcct

SEQ ID NO: 4707782 - DNA, 22 bp, Homo sapiens
ttatctattaaaattgccattt

SEQ ID NO: 4707783 - DNA, 16 bp, Homo sapiens
ttatctcacttgtgcc

SEQ ID NO: 4707784 - DNA, 17 bp, Homo sapiens
ttatctcagtcatgcat

SEQ ID NO: 4707785 - DNA, 21 bp, Homo sapiens
ttatctcagtcatgcataaat

SEQ ID NO: 4707786 - DNA, 22 bp, Homo sapiens
ttatctcagtcatgcataaata

SEQ ID NO: 4707787 - DNA, 13 bp, Homo sapiens
ttatctcctgtga

SEQ ID NO: 4707788 - DNA, 12 bp, Homo sapiens
ttatctgtccca

SEQ ID NO: 4707789 - DNA, 15 bp, Homo sapiens
ttatctttctaaaac

SEQ ID NO: 4707790 - DNA, 19 bp, Homo sapiens
ttatgaatatttacgtttt

SEQ ID NO: 4707791 - DNA, 17 bp, Homo sapiens
ttatgaggagctgcaga

SEQ ID NO: 4707792 - DNA, 14 bp, Homo sapiens
ttatgcatagataa

SEQ ID NO: 4707793 - DNA, 11 bp, Homo sapiens
ttatggacatc

SEQ ID NO: 4707794 - DNA, 19 bp, Homo sapiens
ttatggacatcgatatgaa

SEQ ID NO: 4707795 - DNA, 20 bp, Homo sapiens
ttatggcctttttaagtatt

SEQ ID NO: 4707796 - DNA, 13 bp, Homo sapiens
ttatgggctgggt

SEQ ID NO: 4707797 - DNA, 13 bp, Homo sapiens
ttatgtaaaagaa

SEQ ID NO: 4707798 - DNA, 17 bp, Homo sapiens
ttatgtatgtaaataga

SEQ ID NO: 4707799 - DNA, 17 bp, Homo sapiens
ttatgtctagaaagtaa

SEQ ID NO: 4707800 - DNA, 13 bp, Homo sapiens
ttatgttaatatt

SEQ ID NO: 4707801 - DNA, 13 bp, Homo sapiens
ttatgttatttat

SEQ ID NO: 4707802 - DNA, 13 bp, Homo sapiens
ttatgtttgtaat

SEQ ID NO: 4707803 - DNA, 19 bp, Homo sapiens
ttattaaatgcccagcccc

SEQ ID NO: 4707804 - DNA, 13 bp, Homo sapiens
ttattaatgatca

SEQ ID NO: 4707805 - DNA, 14 bp, Homo sapiens
ttattatatttaca

SEQ ID NO: 4707806 - DNA, 19 bp, Homo sapiens
ttattcaagaaagatatct

SEQ ID NO: 4707807 - DNA, 23 bp, Homo sapiens
ttattcaagaaagatatctatga

SEQ ID NO: 4707808 - DNA, 14 bp, Homo sapiens
ttattcacttttgt

SEQ ID NO: 4707809 - DNA, 23 bp, Homo sapiens
ttattcaggaaaagcctctgtgt

SEQ ID NO: 4707810 - DNA, 13 bp, Homo sapiens
ttattcagtgtca

SEQ ID NO: 4707811 - DNA, 12 bp, Homo sapiens
ttattcataaag

SEQ ID NO: 4707812 - DNA, 15 bp, Homo sapiens
ttattcataaagaga

SEQ ID NO: 4707813 - DNA, 15 bp, Homo sapiens
ttattgcccacgctg

SEQ ID NO: 4707814 - DNA, 22 bp, Homo sapiens
ttattggatatttgatatttgg

SEQ ID NO: 4707815 - DNA, 15 bp, Homo sapiens
ttatttaacttttct

SEQ ID NO: 4707816 - DNA, 21 bp, Homo sapiens
ttatttaatcacagtcatctt

SEQ ID NO: 4707817 - DNA, 16 bp, Homo sapiens
ttatttaggctttgta

SEQ ID NO: 4707818 - DNA, 15 bp, Homo sapiens
ttatttagtatttat

SEQ ID NO: 4707819 - DNA, 11 bp, Homo sapiens
ttatttattga

SEQ ID NO: 4707820 - DNA, 19 bp, Homo sapiens
ttatttcttaaacaaatgt

SEQ ID NO: 4707821 - DNA, 14 bp, Homo sapiens
ttattttagacttt

SEQ ID NO: 4707822 - DNA, 18 bp, Homo sapiens
ttattttgcatatatgtt

SEQ ID NO: 4707823 - DNA, 18 bp, Homo sapiens
ttcaaaaactaaaatcat

SEQ ID NO: 4707824 - DNA, 17 bp, Homo sapiens
ttcaaaatgttctattt

SEQ ID NO: 4707825 - DNA, 20 bp, Homo sapiens
ttcaaaatgttctatttaac

SEQ ID NO: 4707826 - DNA, 23 bp, Homo sapiens
ttcaaagccagcgtcctcctctg

SEQ ID NO: 4707827 - DNA, 17 bp, Homo sapiens
ttcaaagcttaaaaaga

SEQ ID NO: 4707828 - DNA, 17 bp, Homo sapiens
ttcaagaaagatatcta

SEQ ID NO: 4707829 - DNA, 20 bp, Homo sapiens
ttcaagaaagatatctatga

SEQ ID NO: 4707830 - DNA, 23 bp, Homo sapiens
ttcaatctggattcatatttaat

SEQ ID NO: 4707831 - DNA, 14 bp, Homo sapiens
ttcaatctgtgtaa

SEQ ID NO: 4707832 - DNA, 17 bp, Homo sapiens
ttcaattcaacactccc

SEQ ID NO: 4707833 - DNA, 15 bp, Homo sapiens
ttcaattgcatctcc

SEQ ID NO: 4707834 - DNA, 10 bp, Homo sapiens
ttctgggaca

SEQ ID NO: 4707835 - DNA, 13 bp, Homo sapiens
ttctgggtgattt

SEQ ID NO: 4707836 - DNA, 20 bp, Homo sapiens
ttctgggttctcaattctgt

SEQ ID NO: 4707837 - DNA, 19 bp, Homo sapiens
ttctgtcctactctgtgtc

SEQ ID NO: 4707838 - DNA, 20 bp, Homo sapiens
ttctgtctggtttatttagg

SEQ ID NO: 4707839 - DNA, 21 bp, Homo sapiens
ttctgtgcagataaacagaaa

SEQ ID NO: 4707840 - DNA, 13 bp, Homo sapiens
ttctgtgtttagc

SEQ ID NO: 4707841 - DNA, 20 bp, Homo sapiens
ttctgtgtttagctatttaa

SEQ ID NO: 4707842 - DNA, 15 bp, Homo sapiens
ttctgttgctgcctc

SEQ ID NO: 4707843 - DNA, 14 bp, Homo sapiens
ttctgtttaatttt

SEQ ID NO: 4707844 - DNA, 17 bp, Homo sapiens
ttcttaaacaaatgtat

SEQ ID NO: 4707845 - DNA, 19 bp, Homo sapiens
ttcttaatcttttcacaaa

SEQ ID NO: 4707846 - DNA, 21 bp, Homo sapiens
ttcttaatcttttcacaaata

SEQ ID NO: 4707847 - DNA, 23 bp, Homo sapiens
ttcttaatcttttcacaaataaa

SEQ ID NO: 4707848 - DNA, 15 bp, Homo sapiens
ttcttagctttttaa

SEQ ID NO: 4707849 - DNA, 15 bp, Homo sapiens
ttcttagttgctgta

SEQ ID NO: 4707850 - DNA, 17 bp, Homo sapiens
ttcttatgttgcccagt

SEQ ID NO: 4707851 - DNA, 14 bp, Homo sapiens
ttcttattcacttt

SEQ ID NO: 4707852 - DNA, 14 bp, Homo sapiens
ttcttcaactccct

SEQ ID NO: 4707853 - DNA, 20 bp, Homo sapiens
ttcttccagcagaacagaga

SEQ ID NO: 4707854 - DNA, 13 bp, Homo sapiens
ttcttcctgttct

SEQ ID NO: 4707855 - DNA, 13 bp, Homo sapiens
ttcttctgcttca

SEQ ID NO: 4707856 - DNA, 20 bp, Homo sapiens
ttcttgcctctgtccccttc

SEQ ID NO: 4707857 - DNA, 16 bp, Homo sapiens
ttcttggttgaggaaa

SEQ ID NO: 4707858 - DNA, 16 bp, Homo sapiens
ttcttggttggctggc

SEQ ID NO: 4707859 - DNA, 20 bp, Homo sapiens
ttcttggttggctggccttc

SEQ ID NO: 4707860 - DNA, 22 bp, Homo sapiens
ttcttgtcatcagtaagtataa

SEQ ID NO: 4707861 - DNA, 21 bp, Homo sapiens
ttctttcctgaggctgggctc

SEQ ID NO: 4707862 - DNA, 18 bp, Homo sapiens
ttctttctagtggtcttt

SEQ ID NO: 4707863 - DNA, 13 bp, Homo sapiens
ttctttcttggtg

SEQ ID NO: 4707864 - DNA, 22 bp, Homo sapiens
ttctttgaaaatagttattcag

SEQ ID NO: 4707865 - DNA, 23 bp, Homo sapiens
ttctttgaaaatagttattcagt

SEQ ID NO: 4707866 - DNA, 18 bp, Homo sapiens
ttctttgataatgttaaa

SEQ ID NO: 4707867 - DNA, 22 bp, Homo sapiens
ttgaaaaaatagagcctgaggg

SEQ ID NO: 4707868 - DNA, 19 bp, Homo sapiens
ttgaaaacactgttctctg

SEQ ID NO: 4707869 - DNA, 21 bp, Homo sapiens
ttgaaaacactgttctctgcc

SEQ ID NO: 4707870 - DNA, 23 bp, Homo sapiens
ttgaaaacactgttctctgccct

SEQ ID NO: 4707871 - DNA, 23 bp, Homo sapiens
ttgaaaacatgttagtcaaggac

SEQ ID NO: 4707872 - DNA, 13 bp, Homo sapiens
ttgaaaagctatt

SEQ ID NO: 4707873 - DNA, 13 bp, Homo sapiens
ttgaaacagaaaa

SEQ ID NO: 4707874 - DNA, 14 bp, Homo sapiens
ttgaaactttaaga

SEQ ID NO: 4707875 - DNA, 18 bp, Homo sapiens
ttgaaagaacttaagtct

SEQ ID NO: 4707876 - DNA, 18 bp, Homo sapiens
ttgaaagtttttaatatt

SEQ ID NO: 4707877 - DNA, 14 bp, Homo sapiens
ttgaaatgatttca

SEQ ID NO: 4707878 - DNA, 19 bp, Homo sapiens
ttgaacctgatgaaaataa

SEQ ID NO: 4707879 - DNA, 20 bp, Homo sapiens
ttgaacctgatgaaaataaa

SEQ ID NO: 4707880 - DNA, 19 bp, Homo sapiens
ttgaagaacaaaaggcttt

SEQ ID NO: 4707881 - DNA, 23 bp, Homo sapiens
ttgaagattctatgttaatattt

SEQ ID NO: 4707882 - DNA, 17 bp, Homo sapiens
ttgaagggaaatttcag

SEQ ID NO: 4707883 - DNA, 15 bp, Homo sapiens
ttgaatataaacact

SEQ ID NO: 4707884 - DNA, 18 bp, Homo sapiens
ttgaattgtaactgttct

SEQ ID NO: 4707885 - DNA, 18 bp, Homo sapiens
ttgaattttcccactgca

SEQ ID NO: 4707886 - DNA, 20 bp, Homo sapiens
ttgacaaacttctttcactc

SEQ ID NO: 4707887 - DNA, 15 bp, Homo sapiens
ttgacagaacactgt

SEQ ID NO: 4707888 - DNA, 17 bp, Homo sapiens
ttgacagaacactgtct

SEQ ID NO: 4707889 - DNA, 10 bp, Homo sapiens
ttgacagggc

SEQ ID NO: 4707890 - DNA, 12 bp, Homo sapiens
ttgacagggcac

SEQ ID NO: 4707891 - DNA, 13 bp, Homo sapiens
ttgaccaggaaag

SEQ ID NO: 4707892 - DNA, 18 bp, Homo sapiens
ttgaccattctccacctg

SEQ ID NO: 4707893 - DNA, 16 bp, Homo sapiens
ttgacctgaactctgc

SEQ ID NO: 4707894 - DNA, 21 bp, Homo sapiens
ttgacctgcctcccttcatgc

SEQ ID NO: 4707895 - DNA, 19 bp, Homo sapiens
ttgacgccatcccagcccc

SEQ ID NO: 4707896 - DNA, 20 bp, Homo sapiens
ttgacgccatcccagcccca

SEQ ID NO: 4707897 - DNA, 22 bp, Homo sapiens
ttgacgccatcccagccccaat

SEQ ID NO: 4707898 - DNA, 18 bp, Homo sapiens
ttgactgtgctagctaaa

SEQ ID NO: 4707899 - DNA, 19 bp, Homo sapiens
ttgagacataaatgttcac

SEQ ID NO: 4707900 - DNA, 16 bp, Homo sapiens
ttgagagaccaggcaa

SEQ ID NO: 4707901 - DNA, 13 bp, Homo sapiens
ttgagctcagccc

SEQ ID NO: 4707902 - DNA, 18 bp, Homo sapiens
ttgagggtgtaaccagta

SEQ ID NO: 4707903 - DNA, 13 bp, Homo sapiens
ttgagggttgggc

SEQ ID NO: 4707904 - DNA, 16 bp, Homo sapiens
ttgagggttgggctgg

SEQ ID NO: 4707905 - DNA, 14 bp, Homo sapiens
ttgataacagcact

SEQ ID NO: 4707906 - DNA, 18 bp, Homo sapiens
ttgataatgttaaatttg

SEQ ID NO: 4707907 - DNA, 19 bp, Homo sapiens
ttgataatgttaaatttgt

SEQ ID NO: 4707908 - DNA, 14 bp, Homo sapiens
ttgatactgttgca

SEQ ID NO: 4707909 - DNA, 20 bp, Homo sapiens
ttgatagcacagaccctgcc

SEQ ID NO: 4707910 - DNA, 23 bp, Homo sapiens
ttgatagcacagaccctgccctg

SEQ ID NO: 4707911 - DNA, 19 bp, Homo sapiens
ttgatagtgcttcttgtaa

SEQ ID NO: 4707912 - DNA, 17 bp, Homo sapiens
ttgatatagaacagtgc

SEQ ID NO: 4707913 - DNA, 14 bp, Homo sapiens
ttgatatttccttc

SEQ ID NO: 4707914 - DNA, 13 bp, Homo sapiens
ttgatatttggtt

SEQ ID NO: 4707915 - DNA, 17 bp, Homo sapiens
ttgatcaacatcttttc

SEQ ID NO: 4707916 - DNA, 13 bp, Homo sapiens
ttgatcatcatgt

SEQ ID NO: 4707917 - DNA, 13 bp, Homo sapiens
ttgatcattcata

SEQ ID NO: 4707918 - DNA, 17 bp, Homo sapiens
ttgattcagacagctgc

SEQ ID NO: 4707919 - DNA, 23 bp, Homo sapiens
ttgattcagacagctgcctggga

SEQ ID NO: 4707920 - DNA, 17 bp, Homo sapiens
ttgattctccttcagcc

SEQ ID NO: 4707921 - DNA, 13 bp, Homo sapiens
ttgcaaagtgtat

SEQ ID NO: 4707922 - DNA, 14 bp, Homo sapiens
ttgcaacaggctgg

SEQ ID NO: 4707923 - DNA, 20 bp, Homo sapiens
ttgcaagcaacaagctattt

SEQ ID NO: 4707924 - DNA, 13 bp, Homo sapiens
ttgcaaggaagcc

SEQ ID NO: 4707925 - DNA, 22 bp, Homo sapiens
ttgcaatagaaatccaattgga

SEQ ID NO: 4707926 - DNA, 17 bp, Homo sapiens
ttgcaatggcagccttg

SEQ ID NO: 4707927 - DNA, 19 bp, Homo sapiens
ttgcaatggcagccttggc

SEQ ID NO: 4707928 - DNA, 16 bp, Homo sapiens
ttgcaccattctttct

SEQ ID NO: 4707929 - DNA, 18 bp, Homo sapiens
ttgcaccattctttcttg

SEQ ID NO: 4707930 - DNA, 14 bp, Homo sapiens
ttgcacgtgtgttt

SEQ ID NO: 4707931 - DNA, 16 bp, Homo sapiens
ttgcactccagcctgg

SEQ ID NO: 4707932 - DNA, 23 bp, Homo sapiens
ttgcagacaggcaagcacctcct

SEQ ID NO: 4707933 - DNA, 11 bp, Homo sapiens
ttgcagaggct

SEQ ID NO: 4707934 - DNA, 19 bp, Homo sapiens
ttgcagatttctgccttga

SEQ ID NO: 4707935 - DNA, 19 bp, Homo sapiens
ttgcagcgattaataacag

SEQ ID NO: 4707936 - DNA, 18 bp, Homo sapiens
ttgcagggagcatggctg

SEQ ID NO: 4707937 - DNA, 19 bp, Homo sapiens
ttgcataaacaatccaaat

SEQ ID NO: 4707938 - DNA, 13 bp, Homo sapiens
ttgccagtcaccc

SEQ ID NO: 4707939 - DNA, 23 bp, Homo sapiens
ttgccatctgcgtgacaataaaa

SEQ ID NO: 4707940 - DNA, 22 bp, Homo sapiens
ttgccatgggcttcactgtata

SEQ ID NO: 4707941 - DNA, 21 bp, Homo sapiens
ttgccattttattaaacattt

SEQ ID NO: 4707942 - DNA, 22 bp, Homo sapiens
ttgcccagcattttactgattc

SEQ ID NO: 4707943 - DNA, 11 bp, Homo sapiens
ttgcccaggct

SEQ ID NO: 4707944 - DNA, 17 bp, Homo sapiens
tttataaaaaatggtgc

SEQ ID NO: 4707945 - DNA, 17 bp, Homo sapiens
tttataaacctctaatt

SEQ ID NO: 4707946 - DNA, 14 bp, Homo sapiens
tttataaactgaga

SEQ ID NO: 4707947 - DNA, 21 bp, Homo sapiens
tttataaagcaaattactcca

SEQ ID NO: 4707948 - DNA, 12 bp, Homo sapiens
tttataaagcag

SEQ ID NO: 4707949 - DNA, 19 bp, Homo sapiens
tttataaagcagattacct

SEQ ID NO: 4707950 - DNA, 16 bp, Homo sapiens
tttataataaaaatat

SEQ ID NO: 4707951 - DNA, 22 bp, Homo sapiens
tttatacccttgacttaacttt

SEQ ID NO: 4707952 - DNA, 16 bp, Homo sapiens
tttatactatatttgt

SEQ ID NO: 4707953 - DNA, 16 bp, Homo sapiens
tttatattcatcaaat

SEQ ID NO: 4707954 - DNA, 23 bp, Homo sapiens
tttatattcatcaaataaacctt

SEQ ID NO: 4707955 - DNA, 13 bp, Homo sapiens
tttatctcctgtg

SEQ ID NO: 4707956 - DNA, 17 bp, Homo sapiens
tttatgatctatttgta

SEQ ID NO: 4707957 - DNA, 12 bp, Homo sapiens
tttatgatttaa

SEQ ID NO: 4707958 - DNA, 14 bp, Homo sapiens
tttatgatttaata

SEQ ID NO: 4707959 - DNA, 17 bp, Homo sapiens
tttatggaatctaccaa

SEQ ID NO: 4707960 - DNA, 23 bp, Homo sapiens
tttatggccaatctattctcaaa

SEQ ID NO: 4707961 - DNA, 22 bp, Homo sapiens
tttatgggtcagagttccgact

SEQ ID NO: 4707962 - DNA, 17 bp, Homo sapiens
tttatgggtttcttcca

SEQ ID NO: 4707963 - DNA, 18 bp, Homo sapiens
tttatgtagcttgacaat

SEQ ID NO: 4707964 - DNA, 12 bp, Homo sapiens
tttatgtatctt

SEQ ID NO: 4707965 - DNA, 14 bp, Homo sapiens
tttatgtatcttga

SEQ ID NO: 4707966 - DNA, 22 bp, Homo sapiens
tttatgttacttaaacatcatt

SEQ ID NO: 4707967 - DNA, 14 bp, Homo sapiens
tttatgttatttat

SEQ ID NO: 4707968 - DNA, 14 bp, Homo sapiens
tttattaaaatatt

SEQ ID NO: 4707969 - DNA, 16 bp, Homo sapiens
tttattattactgttt

SEQ ID NO: 4707970 - DNA, 16 bp, Homo sapiens
tttattcagaacttta

SEQ ID NO: 4707971 - DNA, 21 bp, Homo sapiens
tttattcatacgtaaaatttt

SEQ ID NO: 4707972 - DNA, 13 bp, Homo sapiens
tttattgcttgtt

SEQ ID NO: 4707973 - DNA, 12 bp, Homo sapiens
tttatttaactt

SEQ ID NO: 4707974 - DNA, 16 bp, Homo sapiens
tttatttatttattca

SEQ ID NO: 4707975 - DNA, 13 bp, Homo sapiens
tttatttcttaaa

SEQ ID NO: 4707976 - DNA, 18 bp, Homo sapiens
tttattttgtaattattg

SEQ ID NO: 4707977 - DNA, 12 bp, Homo sapiens
tttatttttcat

SEQ ID NO: 4707978 - DNA, 12 bp, Homo sapiens
tttcaaaaatgc

SEQ ID NO: 4707979 - DNA, 18 bp, Homo sapiens
tttcaaaaccttttgaaa

SEQ ID NO: 4707980 - DNA, 19 bp, Homo sapiens
tttcaacttcagtactcaa

SEQ ID NO: 4707981 - DNA, 18 bp, Homo sapiens
tttcaagggaattaaata

SEQ ID NO: 4707982 - DNA, 18 bp, Homo sapiens
tttcaatttactttttaa

SEQ ID NO: 4707983 - DNA, 13 bp, Homo sapiens
tttcacccctccc

SEQ ID NO: 4707984 - DNA, 14 bp, Homo sapiens
tttcacccctccct

SEQ ID NO: 4707985 - DNA, 15 bp, Homo sapiens
tttcacccctccctt

SEQ ID NO: 4707986 - DNA, 21 bp, Homo sapiens
tttcagaaagaagtggggaca

SEQ ID NO: 4707987 - DNA, 14 bp, Homo sapiens
tttcagaagtgatt

SEQ ID NO: 4707988 - DNA, 18 bp, Homo sapiens
tttcagatataaaagact

SEQ ID NO: 4707989 - DNA, 19 bp, Homo sapiens
tttcagcatcaaacatgaa

SEQ ID NO: 4707990 - DNA, 22 bp, Homo sapiens
tttcaggtgacatgtgaaacct

SEQ ID NO: 4707991 - DNA, 20 bp, Homo sapiens
tttcagtattagtgatgtca

SEQ ID NO: 4707992 - DNA, 17 bp, Homo sapiens
tttcagtgaaagcatca

SEQ ID NO: 4707993 - DNA, 21 bp, Homo sapiens
tttcagtggggcagtcattat

SEQ ID NO: 4707994 - DNA, 14 bp, Homo sapiens
tttcataagtattt

SEQ ID NO: 4707995 - DNA, 19 bp, Homo sapiens
tttcataagtatttcaaat

SEQ ID NO: 4707996 - DNA, 15 bp, Homo sapiens
tttcatctgctctcc

SEQ ID NO: 4707997 - DNA, 16 bp, Homo sapiens
tttcatctgctctcct

SEQ ID NO: 4707998 - DNA, 19 bp, Homo sapiens
tttcatgtaaactgtgcac

SEQ ID NO: 4707999 - DNA, 12 bp, Homo sapiens
tttcatgttaat

SEQ ID NO: 4708000 - DNA, 18 bp, Homo sapiens
tttcattagcagttgctc

SEQ ID NO: 4708001 - DNA, 14 bp, Homo sapiens
tttcatttactgtg

SEQ ID NO: 4708002 - DNA, 17 bp, Homo sapiens
tttcatttactgtggct

SEQ ID NO: 4708003 - DNA, 16 bp, Homo sapiens
tttccaagagctgagg

SEQ ID NO: 4708004 - DNA, 18 bp, Homo sapiens
tttccaatcacagtgtta

SEQ ID NO: 4708005 - DNA, 14 bp, Homo sapiens
tttccataagctat

SEQ ID NO: 4708006 - DNA, 16 bp, Homo sapiens
tttccataagctattt

SEQ ID NO: 4708007 - DNA, 21 bp, Homo sapiens
tttccatcccctagaaatcct

SEQ ID NO: 4708008 - DNA, 17 bp, Homo sapiens
tttccatgaaaatgcaa

SEQ ID NO: 4708009 - DNA, 17 bp, Homo sapiens
tttccatgagtcccctg

SEQ ID NO: 4708010 - DNA, 18 bp, Homo sapiens
tttccatttggtattaca

SEQ ID NO: 4708011 - DNA, 15 bp, Homo sapiens
tttcccactgcaccc

SEQ ID NO: 4708012 - DNA, 22 bp, Homo sapiens
tttcccactgcaccccctcctg

SEQ ID NO: 4708013 - DNA, 15 bp, Homo sapiens
tttcccgtggcccca

SEQ ID NO: 4708014 - DNA, 21 bp, Homo sapiens
tttcccgtggccccagcctgg

SEQ ID NO: 4708015 - DNA, 20 bp, Homo sapiens
tttcccttgccctttccata

SEQ ID NO: 4708016 - DNA, 21 bp, Homo sapiens
tttcctaataaagttctgtac

SEQ ID NO: 4708017 - DNA, 24 bp, Homo sapiens
tttcctaataaagttctgtactca

SEQ ID NO: 4708018 - DNA, 19 bp, Homo sapiens
tttcctcattttgaattat

SEQ ID NO: 4708019 - DNA, 15 bp, Homo sapiens
tttcctctgagctgt

SEQ ID NO: 4708020 - DNA, 20 bp, Homo sapiens
tttcctctgagctgttatct

SEQ ID NO: 4708021 - DNA, 22 bp, Homo sapiens
tttcctctgagctgttatcttg

SEQ ID NO: 4708022 - DNA, 12 bp, Homo sapiens
tttcctgccctg

SEQ ID NO: 4708023 - DNA, 23 bp, Homo sapiens
tttcctggcactgcttccagtga

SEQ ID NO: 4708024 - DNA, 16 bp, Homo sapiens
tttccttggctggtgc

SEQ ID NO: 4708025 - DNA, 19 bp, Homo sapiens
tttccttgtccccacactc

SEQ ID NO: 4708026 - DNA, 23 bp, Homo sapiens
tttcctttaaaaaaatttaagtg

SEQ ID NO: 4708027 - DNA, 18 bp, Homo sapiens
tttctacagtattatgta

SEQ ID NO: 4708028 - DNA, 15 bp, Homo sapiens
tttctacccagcgag

SEQ ID NO: 4708029 - DNA, 23 bp, Homo sapiens
tttctacccttggaaagaaatgt

SEQ ID NO: 4708030 - DNA, 17 bp, Homo sapiens
tttctactttgtttatt

SEQ ID NO: 4708031 - DNA, 20 bp, Homo sapiens
tttctagcccgaatacaaac

SEQ ID NO: 4708032 - DNA, 18 bp, Homo sapiens
tttctagtggtctttgta

SEQ ID NO: 4708033 - DNA, 19 bp, Homo sapiens
tttctagtggtctttgtaa

SEQ ID NO: 4708034 - DNA, 21 bp, Homo sapiens
tttctagtggtctttgtaaga

SEQ ID NO: 4708035 - DNA, 15 bp, Homo sapiens
tttctattaaaagac

SEQ ID NO: 4708036 - DNA, 13 bp, Homo sapiens
tttctcaaagttt

SEQ ID NO: 4708037 - DNA, 15 bp, Homo sapiens
tttctcaaagttttg

SEQ ID NO: 4708038 - DNA, 23 bp, Homo sapiens
tttctcagtgtgcccttctctta

SEQ ID NO: 4708039 - DNA, 15 bp, Homo sapiens
tttctcatcacatca

SEQ ID NO: 4708040 - DNA, 15 bp, Homo sapiens
tttctcatgttgaaa

SEQ ID NO: 4708041 - DNA, 22 bp, Homo sapiens
tttctcatttgccaataataat

SEQ ID NO: 4708042 - DNA, 20 bp, Homo sapiens
tttctcccctgcccccagga

SEQ ID NO: 4708043 - DNA, 23 bp, Homo sapiens
tttctcccctgcccccaggactg

SEQ ID NO: 4708044 - DNA, 16 bp, Homo sapiens
tttctccttcacagct

SEQ ID NO: 4708045 - DNA, 14 bp, Homo sapiens
tttctgactctaaa

SEQ ID NO: 4708046 - DNA, 19 bp, Homo sapiens
tttctgcccaactttcatt

SEQ ID NO: 4708047 - DNA, 18 bp, Homo sapiens
tttctggaatggaattgg

SEQ ID NO: 4708048 - DNA, 15 bp, Homo sapiens
tttctgtaaatgaag

SEQ ID NO: 4708049 - DNA, 16 bp, Homo sapiens
tttcttagagattaaa

SEQ ID NO: 4708050 - DNA, 19 bp, Homo sapiens
tttcttagctttttaattg

SEQ ID NO: 4708051 - DNA, 21 bp, Homo sapiens
tttcttagctttttaattgtt

SEQ ID NO: 4708052 - DNA, 21 bp, Homo sapiens
tttcttcaaaatcgatatggt

SEQ ID NO: 4708053 - DNA, 19 bp, Homo sapiens
tttcttcaagtgagtggca

SEQ ID NO: 4708054 - DNA, 13 bp, Homo sapiens
aagtattgtttac

SEQ ID NO: 4708055 - DNA, 15 bp, Homo sapiens
aagtattgtttacat

SEQ ID NO: 4708056 - DNA, 20 bp, Homo sapiens
aagtcaaagcaaggaaacta

SEQ ID NO: 4708057 - DNA, 19 bp, Homo sapiens
aagtcaagggtagggtggg

SEQ ID NO: 4708058 - DNA, 19 bp, Homo sapiens
aagtcatgcaaaggctggg

SEQ ID NO: 4708059 - DNA, 19 bp, Homo sapiens
aagtccacagtggaaccag

SEQ ID NO: 4708060 - DNA, 20 bp, Homo sapiens
aagtcctacttttaaagaat

SEQ ID NO: 4708061 - DNA, 15 bp, Homo sapiens
aagtcgttgtgaggg

SEQ ID NO: 4708062 - DNA, 20 bp, Homo sapiens
aagtgacaccaataaatgtt

SEQ ID NO: 4708063 - DNA, 19 bp, Homo sapiens
aagtgacttagcagatgct

SEQ ID NO: 4708064 - DNA, 15 bp, Homo sapiens
aagtgagtggcatgt

SEQ ID NO: 4708065 - DNA, 14 bp, Homo sapiens
aagtgagttttaca

SEQ ID NO: 4708066 - DNA, 16 bp, Homo sapiens
aagtgagttttacacg

SEQ ID NO: 4708067 - DNA, 13 bp, Homo sapiens
aagtgatcctccc

SEQ ID NO: 4708068 - DNA, 18 bp, Homo sapiens
aagtgatccttccacctc

SEQ ID NO: 4708069 - DNA, 16 bp, Homo sapiens
aagtgattctcatgcc

SEQ ID NO: 4708070 - DNA, 15 bp, Homo sapiens
aagtgattctcctgc

SEQ ID NO: 4708071 - DNA, 16 bp, Homo sapiens
aagtgattctcctgcc

SEQ ID NO: 4708072 - DNA, 18 bp, Homo sapiens
aagtgattctcctgcctc

SEQ ID NO: 4708073 - DNA, 20 bp, Homo sapiens
aagtgattctcctgcctcag

SEQ ID NO: 4708074 - DNA, 19 bp, Homo sapiens
aagtgatttagttgtggaa

SEQ ID NO: 4708075 - DNA, 19 bp, Homo sapiens
aagtgcacacctttattca

SEQ ID NO: 4708076 - DNA, 22 bp, Homo sapiens
aagtgcggggtaggggaagaag

SEQ ID NO: 4708077 - DNA, 22 bp, Homo sapiens
aagtgcgtccacgagctgttta

SEQ ID NO: 4708078 - DNA, 16 bp, Homo sapiens
aagtgcgtgtgtagag

SEQ ID NO: 4708079 - DNA, 19 bp, Homo sapiens
aagtgcgtgtgtagagtta

SEQ ID NO: 4708080 - DNA, 22 bp, Homo sapiens
aagtgcgtgtgtagagttaaga

SEQ ID NO: 4708081 - DNA, 22 bp, Homo sapiens
aagtgctgggattacaggtgtg

SEQ ID NO: 4708082 - DNA, 15 bp, Homo sapiens
aagtggggacagagc

SEQ ID NO: 4708083 - DNA, 17 bp, Homo sapiens
aagtggggaccccaccc

SEQ ID NO: 4708084 - DNA, 23 bp, Homo sapiens
aagtggggaccccacccctcatc

SEQ ID NO: 4708085 - DNA, 19 bp, Homo sapiens
aagtgtttatgttgtttat

SEQ ID NO: 4708086 - DNA, 18 bp, Homo sapiens
aagttaaaagtaaaattg

SEQ ID NO: 4708087 - DNA, 23 bp, Homo sapiens
aagttaaaagtaaaattgtttca

SEQ ID NO: 4708088 - DNA, 18 bp, Homo sapiens
aagttaattgtatttatg

SEQ ID NO: 4708089 - DNA, 14 bp, Homo sapiens
aagttacacatttt

SEQ ID NO: 4708090 - DNA, 17 bp, Homo sapiens
aagttacacatttttca

SEQ ID NO: 4708091 - DNA, 16 bp, Homo sapiens
aagttgagcaaacatt

SEQ ID NO: 4708092 - DNA, 18 bp, Homo sapiens
aagttgcacggctgctga

SEQ ID NO: 4708093 - DNA, 15 bp, Homo sapiens
aagttggtcttactt

SEQ ID NO: 4708094 - DNA, 15 bp, Homo sapiens
aagttgtataaaaac

SEQ ID NO: 4708095 - DNA, 14 bp, Homo sapiens
aagtttaattgact

SEQ ID NO: 4708096 - DNA, 12 bp, Homo sapiens
aagtttcaggtg

SEQ ID NO: 4708097 - DNA, 19 bp, Homo sapiens
aagtttcaggtgacatgtg

SEQ ID NO: 4708098 - DNA, 17 bp, Homo sapiens
aagtttccttggctggt

SEQ ID NO: 4708099 - DNA, 19 bp, Homo sapiens
aagtttgggctaacattta

SEQ ID NO: 4708100 - DNA, 13 bp, Homo sapiens
aagttttgaaaag

SEQ ID NO: 4708101 - DNA, 18 bp, Homo sapiens
aataaaaagggcagccct

SEQ ID NO: 4708102 - DNA, 14 bp, Homo sapiens
aataaaaatatatt

SEQ ID NO: 4708103 - DNA, 20 bp, Homo sapiens
aataaaaatatattttcaac

SEQ ID NO: 4708104 - DNA, 17 bp, Homo sapiens
aataaaaccaagcctct

SEQ ID NO: 4708105 - DNA, 15 bp, Homo sapiens
aataaaatatatctt

SEQ ID NO: 4708106 - DNA, 14 bp, Homo sapiens
aataaaccttgttt

SEQ ID NO: 4708107 - DNA, 17 bp, Homo sapiens
aataaaccttgtttctt

SEQ ID NO: 4708108 - DNA, 22 bp, Homo sapiens
aataaaccttgtttctttctga

SEQ ID NO: 4708109 - DNA, 18 bp, Homo sapiens
aataaactttcaaattga

SEQ ID NO: 4708110 - DNA, 21 bp, Homo sapiens
aataaatcattcttactaaaa

SEQ ID NO: 4708111 - DNA, 15 bp, Homo sapiens
aataaatgtttgtta

SEQ ID NO: 4708112 - DNA, 21 bp, Homo sapiens
aataaatgtttgttatttaca

SEQ ID NO: 4708113 - DNA, 21 bp, Homo sapiens
aataacaatgaaagttgataa

SEQ ID NO: 4708114 - DNA, 15 bp, Homo sapiens
aataacaatgttaag

SEQ ID NO: 4708115 - DNA, 24 bp, Homo sapiens
aataacaatgttaaggaaactctt

SEQ ID NO: 4708116 - DNA, 17 bp, Homo sapiens
aataagacataacgttt

SEQ ID NO: 4708117 - DNA, 13 bp, Homo sapiens
aataatagactgt

SEQ ID NO: 4708118 - DNA, 20 bp, Homo sapiens
aataatgcctaccttgtgag

SEQ ID NO: 4708119 - DNA, 22 bp, Homo sapiens
aataattttattagaataattt

SEQ ID NO: 4708120 - DNA, 18 bp, Homo sapiens
aataattttcctgtgaca

SEQ ID NO: 4708121 - DNA, 17 bp, Homo sapiens
aatacaaaaattagctg

SEQ ID NO: 4708122 - DNA, 19 bp, Homo sapiens
aatacagtttgtcacatga

SEQ ID NO: 4708123 - DNA, 14 bp, Homo sapiens
aatacatataaaga

SEQ ID NO: 4708124 - DNA, 23 bp, Homo sapiens
aatacatgacatttatttttcat

SEQ ID NO: 4708125 - DNA, 18 bp, Homo sapiens
aatactaattttccataa

SEQ ID NO: 4708126 - DNA, 23 bp, Homo sapiens
aatactacctcactactacatct

SEQ ID NO: 4708127 - DNA, 14 bp, Homo sapiens
aatactatccaaat

SEQ ID NO: 4708128 - DNA, 23 bp, Homo sapiens
aatactcagggaaagcatttaaa

SEQ ID NO: 4708129 - DNA, 17 bp, Homo sapiens
aatactccctttaaaga

SEQ ID NO: 4708130 - DNA, 15 bp, Homo sapiens
aatactggactcagg

SEQ ID NO: 4708131 - DNA, 21 bp, Homo sapiens
aatactggactcaggaacttt

SEQ ID NO: 4708132 - DNA, 16 bp, Homo sapiens
aatactggtctcaggc

SEQ ID NO: 4708133 - DNA, 14 bp, Homo sapiens
aatacttccagaag

SEQ ID NO: 4708134 - DNA, 11 bp, Homo sapiens
aatacttttgc

SEQ ID NO: 4708135 - DNA, 16 bp, Homo sapiens
aatagaaatccaattg

SEQ ID NO: 4708136 - DNA, 18 bp, Homo sapiens
aatgcatatttgcaaagt

SEQ ID NO: 4708137 - DNA, 23 bp, Homo sapiens
aatgcatatttgcaaagtgtatt

SEQ ID NO: 4708138 - DNA, 21 bp, Homo sapiens
aatgccatggacagaagaagg

SEQ ID NO: 4708139 - DNA, 11 bp, Homo sapiens
aatgcccagcc

SEQ ID NO: 4708140 - DNA, 13 bp, Homo sapiens
aatgcccagcccc

SEQ ID NO: 4708141 - DNA, 22 bp, Homo sapiens
aatgcctataactttttttcaa

SEQ ID NO: 4708142 - DNA, 16 bp, Homo sapiens
aatgcctgagtgcctg

SEQ ID NO: 4708143 - DNA, 13 bp, Homo sapiens
aatgcctttgaga

SEQ ID NO: 4708144 - DNA, 20 bp, Homo sapiens
aatgcctttgagacagtttc

SEQ ID NO: 4708145 - DNA, 18 bp, Homo sapiens
aatgcgcaggctggccct

SEQ ID NO: 4708146 - DNA, 20 bp, Homo sapiens
aatgcgcaggctggccctgc

SEQ ID NO: 4708147 - DNA, 22 bp, Homo sapiens
aatgcgcaggctggccctgccc

SEQ ID NO: 4708148 - DNA, 12 bp, Homo sapiens
aatgctgcagat

SEQ ID NO: 4708149 - DNA, 19 bp, Homo sapiens
aatgcttatgcttgtgtat

SEQ ID NO: 4708150 - DNA, 20 bp, Homo sapiens
aatgcttatgtgttgcataa

SEQ ID NO: 4708151 - DNA, 13 bp, Homo sapiens
aatgcttctgatt

SEQ ID NO: 4708152 - DNA, 15 bp, Homo sapiens
aatgcttctgattta

SEQ ID NO: 4708153 - DNA, 20 bp, Homo sapiens
aatggaaatgggcagagcag

SEQ ID NO: 4708154 - DNA, 22 bp, Homo sapiens
aatggaacctcctttctcttct

SEQ ID NO: 4708155 - DNA, 13 bp, Homo sapiens
aatggaatgagaa

SEQ ID NO: 4708156 - DNA, 19 bp, Homo sapiens
aatggacttttgtacatag

SEQ ID NO: 4708157 - DNA, 20 bp, Homo sapiens
aatggagtctcccactgcaa

SEQ ID NO: 4708158 - DNA, 21 bp, Homo sapiens
aatggagtctcccactgcaac

SEQ ID NO: 4708159 - DNA, 18 bp, Homo sapiens
aatggattggattattta

SEQ ID NO: 4708160 - DNA, 15 bp, Homo sapiens
acaccttatatttac

SEQ ID NO: 4708161 - DNA, 14 bp, Homo sapiens
acaccttgacaggg

SEQ ID NO: 4708162 - DNA, 24 bp, Homo sapiens
acacctttattcagaactttagta

SEQ ID NO: 4708163 - DNA, 17 bp, Homo sapiens
acacgcacgcacacaca

SEQ ID NO: 4708164 - DNA, 17 bp, Homo sapiens
acacgcgtgcacacacc

SEQ ID NO: 4708165 - DNA, 17 bp, Homo sapiens
acactaacgaaatatca

SEQ ID NO: 4708166 - DNA, 19 bp, Homo sapiens
acactaatgagtatttggt

SEQ ID NO: 4708167 - DNA, 18 bp, Homo sapiens
acactagaggccagggat

SEQ ID NO: 4708168 - DNA, 15 bp, Homo sapiens
acactcaagaagcag

SEQ ID NO: 4708169 - DNA, 16 bp, Homo sapiens
acactcaagaagcagg

SEQ ID NO: 4708170 - DNA, 16 bp, Homo sapiens
acactcagttctgctc

SEQ ID NO: 4708171 - DNA, 19 bp, Homo sapiens
acactcattgacctgaggc

SEQ ID NO: 4708172 - DNA, 21 bp, Homo sapiens
acactcattgacctgaggccc

SEQ ID NO: 4708173 - DNA, 14 bp, Homo sapiens
acactgagctgtca

SEQ ID NO: 4708174 - DNA, 11 bp, Homo sapiens
acactgcacag

SEQ ID NO: 4708175 - DNA, 17 bp, Homo sapiens
acactggtctaatgttt

SEQ ID NO: 4708176 - DNA, 15 bp, Homo sapiens
acactgtaatatctt

SEQ ID NO: 4708177 - DNA, 16 bp, Homo sapiens
acactgtaatatcttt

SEQ ID NO: 4708178 - DNA, 22 bp, Homo sapiens
acactgtctggtttcaccgagg

SEQ ID NO: 4708179 - DNA, 21 bp, Homo sapiens
acactgtgcacatctgtgtct

SEQ ID NO: 4708180 - DNA, 22 bp, Homo sapiens
acactgtgctgagtctgaaggc

SEQ ID NO: 4708181 - DNA, 20 bp, Homo sapiens
acactgttctctgccctcca

SEQ ID NO: 4708182 - DNA, 13 bp, Homo sapiens
acacttctattta

SEQ ID NO: 4708183 - DNA, 12 bp, Homo sapiens
acacttctcagg

SEQ ID NO: 4708184 - DNA, 18 bp, Homo sapiens
acacttgctcatgccctg

SEQ ID NO: 4708185 - DNA, 22 bp, Homo sapiens
acacttggcccaagtggcagag

SEQ ID NO: 4708186 - DNA, 14 bp, Homo sapiens
acagaaatgtgtca

SEQ ID NO: 4708187 - DNA, 19 bp, Homo sapiens
acagaaatgtgtcaatgta

SEQ ID NO: 4708188 - DNA, 14 bp, Homo sapiens
acagaacagcttca

SEQ ID NO: 4708189 - DNA, 15 bp, Homo sapiens
acagaacagcttcag

SEQ ID NO: 4708190 - DNA, 14 bp, Homo sapiens
acagaagacagcag

SEQ ID NO: 4708191 - DNA, 11 bp, Homo sapiens
acagacacagg

SEQ ID NO: 4708192 - DNA, 23 bp, Homo sapiens
acagacacaggcccggctccagg

SEQ ID NO: 4708193 - DNA, 13 bp, Homo sapiens
acagacagccctc

SEQ ID NO: 4708194 - DNA, 18 bp, Homo sapiens
acagaccctgccctgtgg

SEQ ID NO: 4708195 - DNA, 17 bp, Homo sapiens
acagactggaagcacag

SEQ ID NO: 4708196 - DNA, 21 bp, Homo sapiens
acagactggaagcacagcttc

SEQ ID NO: 4708197 - DNA, 18 bp, Homo sapiens
acagagaaaatgaatttg

SEQ ID NO: 4708198 - DNA, 18 bp, Homo sapiens
acagagaaagtacttctc

SEQ ID NO: 4708199 - DNA, 15 bp, Homo sapiens
acagagcccacgccc

SEQ ID NO: 4708200 - DNA, 14 bp, Homo sapiens
acagagctgggatg

SEQ ID NO: 4708201 - DNA, 18 bp, Homo sapiens
acagagctgggatgtttc

SEQ ID NO: 4708202 - DNA, 16 bp, Homo sapiens
acagagcttccctgac

SEQ ID NO: 4708203 - DNA, 13 bp, Homo sapiens
acagaggcagccc

SEQ ID NO: 4708204 - DNA, 14 bp, Homo sapiens
acagagggggtggc

SEQ ID NO: 4708205 - DNA, 17 bp, Homo sapiens
acagagggggtggcctc

SEQ ID NO: 4708206 - DNA, 18 bp, Homo sapiens
acagagggggtggcctcc

SEQ ID NO: 4708207 - DNA, 22 bp, Homo sapiens
acagagggggtggcctcccaac

SEQ ID NO: 4708208 - DNA, 12 bp, Homo sapiens
acagagtctcac

SEQ ID NO: 4708209 - DNA, 23 bp, Homo sapiens
acagagtctcactgttgcccagg

SEQ ID NO: 4708210 - DNA, 18 bp, Homo sapiens
acagatccccaagcctgg

SEQ ID NO: 4708211 - DNA, 15 bp, Homo sapiens
acagatcctccattt

SEQ ID NO: 4708212 - DNA, 20 bp, Homo sapiens
acagatgtaaaagacttttt

SEQ ID NO: 4708213 - DNA, 16 bp, Homo sapiens
acagattcacactgtc

SEQ ID NO: 4708214 - DNA, 15 bp, Homo sapiens
acagatttgagctca

SEQ ID NO: 4708215 - DNA, 22 bp, Homo sapiens
acagatttgagctcagccctgg

SEQ ID NO: 4708216 - DNA, 15 bp, Homo sapiens
acagcaaacaggtgc

SEQ ID NO: 4708217 - DNA, 18 bp, Homo sapiens
acagcaaggaggctggct

SEQ ID NO: 4708218 - DNA, 19 bp, Homo sapiens
acagcaaggaggctggctg

SEQ ID NO: 4708219 - DNA, 15 bp, Homo sapiens
acagcaattcctcag

SEQ ID NO: 4708220 - DNA, 17 bp, Homo sapiens
acagcaattcctcaggc

SEQ ID NO: 4708221 - DNA, 19 bp, Homo sapiens
acagcacgggggccaagga

SEQ ID NO: 4708222 - DNA, 15 bp, Homo sapiens
acagcactcctcggc

SEQ ID NO: 4708223 - DNA, 15 bp, Homo sapiens
acagccaaatttaaa

SEQ ID NO: 4708224 - DNA, 18 bp, Homo sapiens
acagccacggccaggcca

SEQ ID NO: 4708225 - DNA, 19 bp, Homo sapiens
acagccacggccaggccag

SEQ ID NO: 4708226 - DNA, 15 bp, Homo sapiens
acagccatcccagcc

SEQ ID NO: 4708227 - DNA, 19 bp, Homo sapiens
acagccatcccagccttgg

SEQ ID NO: 4708228 - DNA, 19 bp, Homo sapiens
acagcccaaagaaggaaaa

SEQ ID NO: 4708229 - DNA, 15 bp, Homo sapiens
acagcccacgtcctg

SEQ ID NO: 4708230 - DNA, 15 bp, Homo sapiens
acagccccctgcccc

SEQ ID NO: 4708231 - DNA, 23 bp, Homo sapiens
acagcccgggctctgcctcccat

SEQ ID NO: 4708232 - DNA, 15 bp, Homo sapiens
acagccctcccgccc

SEQ ID NO: 4708233 - DNA, 18 bp, Homo sapiens
acagcctcccctgccagg

SEQ ID NO: 4708234 - DNA, 21 bp, Homo sapiens
acagcctcccctgccagggca

SEQ ID NO: 4708235 - DNA, 12 bp, Homo sapiens
acagcctgagaa

SEQ ID NO: 4708236 - DNA, 13 bp, Homo sapiens
acagcctgagaaa

SEQ ID NO: 4708237 - DNA, 18 bp, Homo sapiens
acagctaaatttggagat

SEQ ID NO: 4708238 - DNA, 13 bp, Homo sapiens
acagctccttctg

SEQ ID NO: 4708239 - DNA, 15 bp, Homo sapiens
acagctccttctgtc

SEQ ID NO: 4708240 - DNA, 23 bp, Homo sapiens
acagctccttctgtcctactctg

SEQ ID NO: 4708241 - DNA, 16 bp, Homo sapiens
acagctcttctccagg

SEQ ID NO: 4708242 - DNA, 17 bp, Homo sapiens
acagctcttctccaggc

SEQ ID NO: 4708243 - DNA, 19 bp, Homo sapiens
acagctcttctccaggctg

SEQ ID NO: 4708244 - DNA, 20 bp, Homo sapiens
acagctcttctccaggctgt

SEQ ID NO: 4708245 - DNA, 13 bp, Homo sapiens
acagctgcctggg

SEQ ID NO: 4708246 - DNA, 11 bp, Homo sapiens
acagctgctgg

SEQ ID NO: 4708247 - DNA, 16 bp, Homo sapiens
acagctgggtggcact

SEQ ID NO: 4708248 - DNA, 20 bp, Homo sapiens
acagcttcaggttatcgaaa

SEQ ID NO: 4708249 - DNA, 20 bp, Homo sapiens
acagctttgggtcattttta

SEQ ID NO: 4708250 - DNA, 14 bp, Homo sapiens
acaggatcagtctg

SEQ ID NO: 4708251 - DNA, 15 bp, Homo sapiens
acaggatcagtctga

SEQ ID NO: 4708252 - DNA, 15 bp, Homo sapiens
acaggcaagcacctc

SEQ ID NO: 4708253 - DNA, 20 bp, Homo sapiens
acaggcaagcacctcctgcc

SEQ ID NO: 4708254 - DNA, 23 bp, Homo sapiens
acaggcaagcacctcctgcctcg

SEQ ID NO: 4708255 - DNA, 14 bp, Homo sapiens
acaggcaatgctgg

SEQ ID NO: 4708256 - DNA, 15 bp, Homo sapiens
acaggcaatgctggc

SEQ ID NO: 4708257 - DNA, 14 bp, Homo sapiens
acaggcacccacca

SEQ ID NO: 4708258 - DNA, 18 bp, Homo sapiens
acaggcactgccctggtg

SEQ ID NO: 4708259 - DNA, 23 bp, Homo sapiens
acaggcactgccctggtggccct

SEQ ID NO: 4708260 - DNA, 15 bp, Homo sapiens
acaggcatgttctct

SEQ ID NO: 4708261 - DNA, 19 bp, Homo sapiens
acaggcatgttctctgagg

SEQ ID NO: 4708262 - DNA, 20 bp, Homo sapiens
acaggcccggctccaggctc

SEQ ID NO: 4708263 - DNA, 15 bp, Homo sapiens
acaggcctgagattt

SEQ ID NO: 4708264 - DNA, 22 bp, Homo sapiens
acaggctcctgccaccacgccc

SEQ ID NO: 4708265 - DNA, 21 bp, Homo sapiens
acaggctgggcttcagtggca

SEQ ID NO: 4708266 - DNA, 23 bp, Homo sapiens
acaggctgggcttcagtggcagc

SEQ ID NO: 4708267 - DNA, 22 bp, Homo sapiens
acagggaatgcctgagtgcctg

SEQ ID NO: 4708268 - DNA, 14 bp, Homo sapiens
acagggatgagcat

SEQ ID NO: 4708269 - DNA, 18 bp, Homo sapiens
acagggtttggcccaagt

SEQ ID NO: 4708270 - DNA, 18 bp, Homo sapiens
acaggtgctaatttgttt

SEQ ID NO: 4708271 - DNA, 18 bp, Homo sapiens
acccgttcatgggggagg

SEQ ID NO: 4708272 - DNA, 16 bp, Homo sapiens
accctaaatcttgact

SEQ ID NO: 4708273 - DNA, 18 bp, Homo sapiens
accctagttattttctga

SEQ ID NO: 4708274 - DNA, 21 bp, Homo sapiens
accctcaccgcggctggatgg

SEQ ID NO: 4708275 - DNA, 23 bp, Homo sapiens
accctcatcaccaacgtctgtgc

SEQ ID NO: 4708276 - DNA, 12 bp, Homo sapiens
accctcccctcc

SEQ ID NO: 4708277 - DNA, 12 bp, Homo sapiens
accctccctgct

SEQ ID NO: 4708278 - DNA, 14 bp, Homo sapiens
accctcgaggcgga

SEQ ID NO: 4708279 - DNA, 19 bp, Homo sapiens
accctctcaggctgtccca

SEQ ID NO: 4708280 - DNA, 21 bp, Homo sapiens
accctctccgcacacctctgg

SEQ ID NO: 4708281 - DNA, 22 bp, Homo sapiens
accctctccgcacacctctggc

SEQ ID NO: 4708282 - DNA, 12 bp, Homo sapiens
accctctgtgaa

SEQ ID NO: 4708283 - DNA, 13 bp, Homo sapiens
accctctgtgaaa

SEQ ID NO: 4708284 - DNA, 13 bp, Homo sapiens
accctgaggccca

SEQ ID NO: 4708285 - DNA, 16 bp, Homo sapiens
accctgaggcccagag

SEQ ID NO: 4708286 - DNA, 21 bp, Homo sapiens
accctgaggcccagagggcct

SEQ ID NO: 4708287 - DNA, 12 bp, Homo sapiens
accctgccctgt

SEQ ID NO: 4708288 - DNA, 17 bp, Homo sapiens
accctgccctgtgggcc

SEQ ID NO: 4708289 - DNA, 22 bp, Homo sapiens
accctgccctgtgggcccccaa

SEQ ID NO: 4708290 - DNA, 18 bp, Homo sapiens
accctgggctctgtgggc

SEQ ID NO: 4708291 - DNA, 19 bp, Homo sapiens
accctgggctctgtgggct

SEQ ID NO: 4708292 - DNA, 23 bp, Homo sapiens
accctgtaaaatggaggtggaaa

SEQ ID NO: 4708293 - DNA, 17 bp, Homo sapiens
accctgtcacttgctgg

SEQ ID NO: 4708294 - DNA, 17 bp, Homo sapiens
accctgttaccattttg

SEQ ID NO: 4708295 - DNA, 17 bp, Homo sapiens
acccttaagccaatcat

SEQ ID NO: 4708296 - DNA, 20 bp, Homo sapiens
acccttgtggtcccacccca

SEQ ID NO: 4708297 - DNA, 20 bp, Homo sapiens
accgaacatatcatttgtga

SEQ ID NO: 4708298 - DNA, 21 bp, Homo sapiens
accgccacacacacaggagca

SEQ ID NO: 4708299 - DNA, 17 bp, Homo sapiens
accgctgattctcaggg

SEQ ID NO: 4708300 - DNA, 15 bp, Homo sapiens
accggaccagcctgg

SEQ ID NO: 4708301 - DNA, 12 bp, Homo sapiens
accgggcactca

SEQ ID NO: 4708302 - DNA, 20 bp, Homo sapiens
accgggccacagagaaagta

SEQ ID NO: 4708303 - DNA, 17 bp, Homo sapiens
accgtagggcctgactc

SEQ ID NO: 4708304 - DNA, 11 bp, Homo sapiens
accgtccctga

SEQ ID NO: 4708305 - DNA, 22 bp, Homo sapiens
acctaaaatttgccctcccatc

SEQ ID NO: 4708306 - DNA, 20 bp, Homo sapiens
acctaaaccctctgtgaaat

SEQ ID NO: 4708307 - DNA, 21 bp, Homo sapiens
acctaactcacctaactcata

SEQ ID NO: 4708308 - DNA, 15 bp, Homo sapiens
acctacagtgtacag

SEQ ID NO: 4708309 - DNA, 17 bp, Homo sapiens
acctacagttttaactg

SEQ ID NO: 4708310 - DNA, 18 bp, Homo sapiens
acctacagttttaactgt

SEQ ID NO: 4708311 - DNA, 16 bp, Homo sapiens
acctactcctgggtca

SEQ ID NO: 4708312 - DNA, 15 bp, Homo sapiens
acctagggtctattt

SEQ ID NO: 4708313 - DNA, 23 bp, Homo sapiens
acctcagagtggagttgaaactg

SEQ ID NO: 4708314 - DNA, 12 bp, Homo sapiens
acctcagcctcc

SEQ ID NO: 4708315 - DNA, 15 bp, Homo sapiens
acctcatgtcatttc

SEQ ID NO: 4708316 - DNA, 17 bp, Homo sapiens
acctccaatgctgcctg

SEQ ID NO: 4708317 - DNA, 11 bp, Homo sapiens
acctcctgcct

SEQ ID NO: 4708318 - DNA, 13 bp, Homo sapiens
acctcctgcctcg

SEQ ID NO: 4708319 - DNA, 15 bp, Homo sapiens
acctcctgtctctgg

SEQ ID NO: 4708320 - DNA, 23 bp, Homo sapiens
acctccttctctgtctcatgtgt

SEQ ID NO: 4708321 - DNA, 20 bp, Homo sapiens
acctcctttctcttctctgt

SEQ ID NO: 4708322 - DNA, 16 bp, Homo sapiens
acctcgctggactctc

SEQ ID NO: 4708323 - DNA, 18 bp, Homo sapiens
acctcgctggactctcag

SEQ ID NO: 4708324 - DNA, 23 bp, Homo sapiens
acctcgtgtctagtagaacaatg

SEQ ID NO: 4708325 - DNA, 18 bp, Homo sapiens
acctctaatttattttgt

SEQ ID NO: 4708326 - DNA, 22 bp, Homo sapiens
acctctccagcctcagctctca

SEQ ID NO: 4708327 - DNA, 13 bp, Homo sapiens
acctctcccttgg

SEQ ID NO: 4708328 - DNA, 14 bp, Homo sapiens
acctctcccttgga

SEQ ID NO: 4708329 - DNA, 12 bp, Homo sapiens
acctctgcctga

SEQ ID NO: 4708330 - DNA, 11 bp, Homo sapiens
acctgaaaaca

SEQ ID NO: 4708331 - DNA, 16 bp, Homo sapiens
acctgacactcccttg

SEQ ID NO: 4708332 - DNA, 17 bp, Homo sapiens
acctgacccctgacccc

SEQ ID NO: 4708333 - DNA, 14 bp, Homo sapiens
acctgaggcccttc

SEQ ID NO: 4708334 - DNA, 22 bp, Homo sapiens
acctgaggcccttctctccagc

SEQ ID NO: 4708335 - DNA, 18 bp, Homo sapiens
acctgatgaaaataaaga

SEQ ID NO: 4708336 - DNA, 17 bp, Homo sapiens
acctgattgtgtctctt

SEQ ID NO: 4708337 - DNA, 18 bp, Homo sapiens
acctgcactaacagagtg

SEQ ID NO: 4708338 - DNA, 21 bp, Homo sapiens
acctgcagcgcgcacacgcac

SEQ ID NO: 4708339 - DNA, 23 bp, Homo sapiens
acctgcatatctctagtccctgt

SEQ ID NO: 4708340 - DNA, 17 bp, Homo sapiens
acctgcctcggcctccc

SEQ ID NO: 4708341 - DNA, 13 bp, Homo sapiens
acctgcctgggtt

SEQ ID NO: 4708342 - DNA, 19 bp, Homo sapiens
acctgcggtgctatctccc

SEQ ID NO: 4708343 - DNA, 20 bp, Homo sapiens
acctgctcacgtcaaatgca

SEQ ID NO: 4708344 - DNA, 18 bp, Homo sapiens
acctggaccttttctgga

SEQ ID NO: 4708345 - DNA, 22 bp, Homo sapiens
acctggagagccagaacctgga

SEQ ID NO: 4708346 - DNA, 22 bp, Homo sapiens
acctggagagctagaacctgga

SEQ ID NO: 4708347 - DNA, 13 bp, Homo sapiens
acctggagggcta

SEQ ID NO: 4708348 - DNA, 21 bp, Homo sapiens
acctggagggctagaacctag

SEQ ID NO: 4708349 - DNA, 22 bp, Homo sapiens
acctggagggctagaacctgga

SEQ ID NO: 4708350 - DNA, 23 bp, Homo sapiens
acctggagggctagaacctggag

SEQ ID NO: 4708351 - DNA, 23 bp, Homo sapiens
acctggcaagctagaacctggag

SEQ ID NO: 4708352 - DNA, 16 bp, Homo sapiens
acctggcctctgcact

SEQ ID NO: 4708353 - DNA, 17 bp, Homo sapiens
acctggcctctgcactc

SEQ ID NO: 4708354 - DNA, 18 bp, Homo sapiens
acctggcctctgcactcc

SEQ ID NO: 4708355 - DNA, 23 bp, Homo sapiens
acctgggagagacttggatgagg

SEQ ID NO: 4708356 - DNA, 14 bp, Homo sapiens
acctggggctgctg

SEQ ID NO: 4708357 - DNA, 16 bp, Homo sapiens
acctggtgctgcctct

SEQ ID NO: 4708358 - DNA, 15 bp, Homo sapiens
acctgtccccctgac

SEQ ID NO: 4708359 - DNA, 16 bp, Homo sapiens
acctgtccccctgaca

SEQ ID NO: 4708360 - DNA, 22 bp, Homo sapiens
acctgtgcttcgggcccttccc

SEQ ID NO: 4708361 - DNA, 19 bp, Homo sapiens
acctgtggccaagttctta

SEQ ID NO: 4708362 - DNA, 18 bp, Homo sapiens
accttagacagtccctgc

SEQ ID NO: 4708363 - DNA, 19 bp, Homo sapiens
accttattggatatttgat

SEQ ID NO: 4708364 - DNA, 15 bp, Homo sapiens
accttcaaaatgttc

SEQ ID NO: 4708365 - DNA, 12 bp, Homo sapiens
accttctccttc

SEQ ID NO: 4708366 - DNA, 19 bp, Homo sapiens
accttctgacgcagcctga

SEQ ID NO: 4708367 - DNA, 21 bp, Homo sapiens
accttctgacgcagcctgaga

SEQ ID NO: 4708368 - DNA, 23 bp, Homo sapiens
accttctgacgcagcctgagaat

SEQ ID NO: 4708369 - DNA, 16 bp, Homo sapiens
accttgaaaaaaaaca

SEQ ID NO: 4708370 - DNA, 21 bp, Homo sapiens
accttgaagtgactgttgtac

SEQ ID NO: 4708371 - DNA, 14 bp, Homo sapiens
accttgaggagaag

SEQ ID NO: 4708372 - DNA, 17 bp, Homo sapiens
actttttgttccagagc

SEQ ID NO: 4708373 - DNA, 21 bp, Homo sapiens
agacagagtctcactgttgcc

SEQ ID NO: 4708374 - DNA, 15 bp, Homo sapiens
acctttgtccccacc

SEQ ID NO: 4708375 - DNA, 16 bp, Homo sapiens
acctttgtccccaccg

SEQ ID NO: 4708376 - DNA, 17 bp, Homo sapiens
acctttgtccccaccgc

SEQ ID NO: 4708377 - DNA, 20 bp, Homo sapiens
acctttgtttccttattcag

SEQ ID NO: 4708378 - DNA, 14 bp, Homo sapiens
accttttacagaat

SEQ ID NO: 4708379 - DNA, 16 bp, Homo sapiens
accttttttaagattt

SEQ ID NO: 4708380 - DNA, 14 bp, Homo sapiens
acgacaaggaaagg

SEQ ID NO: 4708381 - DNA, 14 bp, Homo sapiens
acgatgacagtgtt

SEQ ID NO: 4708382 - DNA, 20 bp, Homo sapiens
acgattgacaccaaaatgaa

SEQ ID NO: 4708383 - DNA, 16 bp, Homo sapiens
acgcacacacacatac

SEQ ID NO: 4708384 - DNA, 17 bp, Homo sapiens
acgcacagccaaggact

SEQ ID NO: 4708385 - DNA, 15 bp, Homo sapiens
acgcacgcacacaca

SEQ ID NO: 4708386 - DNA, 19 bp, Homo sapiens
acgcagcaacgtttttaat

SEQ ID NO: 4708387 - DNA, 21 bp, Homo sapiens
acgcagcctgagaatgacctg

SEQ ID NO: 4708388 - DNA, 16 bp, Homo sapiens
acgcagctggcagaga

SEQ ID NO: 4708389 - DNA, 11 bp, Homo sapiens
acgcaggcccc

SEQ ID NO: 4708390 - DNA, 16 bp, Homo sapiens
acgcaggcccctctcc

SEQ ID NO: 4708391 - DNA, 17 bp, Homo sapiens
acgcaggcccctctcct

SEQ ID NO: 4708392 - DNA, 18 bp, Homo sapiens
acgcaggcccctctcctc

SEQ ID NO: 4708393 - DNA, 14 bp, Homo sapiens
acgcagtggccttc

SEQ ID NO: 4708394 - DNA, 12 bp, Homo sapiens
acgccacccagc

SEQ ID NO: 4708395 - DNA, 18 bp, Homo sapiens
acgccactgcactatagc

SEQ ID NO: 4708396 - DNA, 17 bp, Homo sapiens
acgccatcccagcccca

SEQ ID NO: 4708397 - DNA, 18 bp, Homo sapiens
acgccatcccagccccaa

SEQ ID NO: 4708398 - DNA, 15 bp, Homo sapiens
acgcccaggacccca

SEQ ID NO: 4708399 - DNA, 14 bp, Homo sapiens
acgcggccacctca

SEQ ID NO: 4708400 - DNA, 23 bp, Homo sapiens
acgcgtgcacacaccagagccca

SEQ ID NO: 4708401 - DNA, 17 bp, Homo sapiens
acgctacccgggaaggg

SEQ ID NO: 4708402 - DNA, 21 bp, Homo sapiens
acgctacccgggaagggggct

SEQ ID NO: 4708403 - DNA, 18 bp, Homo sapiens
acgctctgcaccttctga

SEQ ID NO: 4708404 - DNA, 20 bp, Homo sapiens
acgctggaccttgaactggg

SEQ ID NO: 4708405 - DNA, 23 bp, Homo sapiens
acgctggaccttgaactgggtac

SEQ ID NO: 4708406 - DNA, 16 bp, Homo sapiens
acgctggagtgcagtg

SEQ ID NO: 4708407 - DNA, 15 bp, Homo sapiens
acgctgtgctgccct

SEQ ID NO: 4708408 - DNA, 17 bp, Homo sapiens
acgctgtgctgccctgc

SEQ ID NO: 4708409 - DNA, 18 bp, Homo sapiens
acgctgtgctgccctgcc

SEQ ID NO: 4708410 - DNA, 22 bp, Homo sapiens
acgctgtgctgccctgcccacc

SEQ ID NO: 4708411 - DNA, 23 bp, Homo sapiens
acgcttgtgtctttagtgctcca

SEQ ID NO: 4708412 - DNA, 15 bp, Homo sapiens
acggaatagttggct

SEQ ID NO: 4708413 - DNA, 21 bp, Homo sapiens
acggagccactcctctgactc

SEQ ID NO: 4708414 - DNA, 23 bp, Homo sapiens
acggcagctgctggctgtgacaa

SEQ ID NO: 4708415 - DNA, 17 bp, Homo sapiens
acgggacgcggcaggct

SEQ ID NO: 4708416 - DNA, 18 bp, Homo sapiens
acggggccggccaggtgg

SEQ ID NO: 4708417 - DNA, 18 bp, Homo sapiens
acggtgctccaggcaggc

SEQ ID NO: 4708418 - DNA, 22 bp, Homo sapiens
acggtgctccaggcaggctaag

SEQ ID NO: 4708419 - DNA, 15 bp, Homo sapiens
acgtagtaaaagtca

SEQ ID NO: 4708420 - DNA, 16 bp, Homo sapiens
acgtagtaaaagtcat

SEQ ID NO: 4708421 - DNA, 18 bp, Homo sapiens
acgtccacgcggccacct

SEQ ID NO: 4708422 - DNA, 21 bp, Homo sapiens
acgtccacgcggccacctcac

SEQ ID NO: 4708423 - DNA, 18 bp, Homo sapiens
acgtcctgtcagtgccgc

SEQ ID NO: 4708424 - DNA, 14 bp, Homo sapiens
acgtctgacaggca

SEQ ID NO: 4708425 - DNA, 18 bp, Homo sapiens
acgtgatggtctgagact

SEQ ID NO: 4708426 - DNA, 22 bp, Homo sapiens
acgtgtgtttttctattaaaag

SEQ ID NO: 4708427 - DNA, 16 bp, Homo sapiens
acgtgtttgtgctgtg

SEQ ID NO: 4708428 - DNA, 19 bp, Homo sapiens
acgttaaaagcaaaaagat

SEQ ID NO: 4708429 - DNA, 15 bp, Homo sapiens
acgttaccaggcagg

SEQ ID NO: 4708430 - DNA, 22 bp, Homo sapiens
acgttcactggtctctaagtgt

SEQ ID NO: 4708431 - DNA, 22 bp, Homo sapiens
acgtttctcattaaaatccagt

SEQ ID NO: 4708432 - DNA, 13 bp, Homo sapiens
acgtttttccttt

SEQ ID NO: 4708433 - DNA, 19 bp, Homo sapiens
actaactgctgattttgac

SEQ ID NO: 4708434 - DNA, 21 bp, Homo sapiens
actaattttttaagaggaatt

SEQ ID NO: 4708435 - DNA, 17 bp, Homo sapiens
actacaatttaaagcaa

SEQ ID NO: 4708436 - DNA, 13 bp, Homo sapiens
actacacacagta

SEQ ID NO: 4708437 - DNA, 16 bp, Homo sapiens
actacatttagcccct

SEQ ID NO: 4708438 - DNA, 19 bp, Homo sapiens
actaccgtggaccacctag

SEQ ID NO: 4708439 - DNA, 18 bp, Homo sapiens
actactacatctgtgatg

SEQ ID NO: 4708440 - DNA, 15 bp, Homo sapiens
actactcagttatta

SEQ ID NO: 4708441 - DNA, 23 bp, Homo sapiens
actacttttgcttttttatttac

SEQ ID NO: 4708442 - DNA, 15 bp, Homo sapiens
actagaacctggagg

SEQ ID NO: 4708443 - DNA, 13 bp, Homo sapiens
actagacatgtca

SEQ ID NO: 4708444 - DNA, 16 bp, Homo sapiens
actagagcagccctgg

SEQ ID NO: 4708445 - DNA, 19 bp, Homo sapiens
actagagcagccctggagt

SEQ ID NO: 4708446 - DNA, 15 bp, Homo sapiens
actatattgtacaca

SEQ ID NO: 4708447 - DNA, 20 bp, Homo sapiens
actatctacaaaatttctga

SEQ ID NO: 4708448 - DNA, 19 bp, Homo sapiens
actatctgaaaatacattt

SEQ ID NO: 4708449 - DNA, 18 bp, Homo sapiens
actatgacagatatattt

SEQ ID NO: 4708450 - DNA, 16 bp, Homo sapiens
actatgcaaaagtaca

SEQ ID NO: 4708451 - DNA, 17 bp, Homo sapiens
actatgtaaaaataacc

SEQ ID NO: 4708452 - DNA, 17 bp, Homo sapiens
actatgtaatgcttatg

SEQ ID NO: 4708453 - DNA, 14 bp, Homo sapiens
actatgttgcccag

SEQ ID NO: 4708454 - DNA, 19 bp, Homo sapiens
actatgttgcccaggcagg

SEQ ID NO: 4708455 - DNA, 13 bp, Homo sapiens
actattgcccagg

SEQ ID NO: 4708456 - DNA, 10 bp, Homo sapiens
actatttaac

SEQ ID NO: 4708457 - DNA, 14 bp, Homo sapiens
actatttttcagaa

SEQ ID NO: 4708458 - DNA, 18 bp, Homo sapiens
actatttttcagaatctc

SEQ ID NO: 4708459 - DNA, 20 bp, Homo sapiens
actcaaaacccatctgggct

SEQ ID NO: 4708460 - DNA, 20 bp, Homo sapiens
actcaaaccaaatcactgaa

SEQ ID NO: 4708461 - DNA, 15 bp, Homo sapiens
actcaaccctctcag

SEQ ID NO: 4708462 - DNA, 20 bp, Homo sapiens
actcaagacttccagagcct

SEQ ID NO: 4708463 - DNA, 18 bp, Homo sapiens
actcaatattttccatga

SEQ ID NO: 4708464 - DNA, 14 bp, Homo sapiens
actcaatgcactga

SEQ ID NO: 4708465 - DNA, 16 bp, Homo sapiens
actcaatgcactgaca

SEQ ID NO: 4708466 - DNA, 17 bp, Homo sapiens
actcaatttctccccag

SEQ ID NO: 4708467 - DNA, 19 bp, Homo sapiens
actcacatggctatgtttt

SEQ ID NO: 4708468 - DNA, 20 bp, Homo sapiens
actcacatggctatgtttta

SEQ ID NO: 4708469 - DNA, 15 bp, Homo sapiens
actcaccatctgtgc

SEQ ID NO: 4708470 - DNA, 16 bp, Homo sapiens
actcaccccagcccca

SEQ ID NO: 4708471 - DNA, 14 bp, Homo sapiens
actcacctggggct

SEQ ID NO: 4708472 - DNA, 23 bp, Homo sapiens
actcacctggggctgctggcctg

SEQ ID NO: 4708473 - DNA, 18 bp, Homo sapiens
actcagaagacactgatg

SEQ ID NO: 4708474 - DNA, 22 bp, Homo sapiens
actcagcctcaataagccttgt

SEQ ID NO: 4708475 - DNA, 15 bp, Homo sapiens
actcagctccccaga

SEQ ID NO: 4708476 - DNA, 13 bp, Homo sapiens
actcaggaacttt

SEQ ID NO: 4708477 - DNA, 14 bp, Homo sapiens
actcagtttcatat

SEQ ID NO: 4708478 - DNA, 17 bp, Homo sapiens
actcataaatactaact

SEQ ID NO: 4708479 - DNA, 17 bp, Homo sapiens
actcatactgtgctgga

SEQ ID NO: 4708480 - DNA, 21 bp, Homo sapiens
actcatactgtgctggagcca

SEQ ID NO: 4708481 - DNA, 17 bp, Homo sapiens
actccaaggtttataaa

SEQ ID NO: 4708482 - DNA, 13 bp, Homo sapiens
actccactgtttt

SEQ ID NO: 4708483 - DNA, 20 bp, Homo sapiens
actccagcctgggtgacaga

SEQ ID NO: 4708484 - DNA, 23 bp, Homo sapiens
actgggtacttgtggacacagct

SEQ ID NO: 4708485 - DNA, 18 bp, Homo sapiens
actggtattcctgcctcc

SEQ ID NO: 4708486 - DNA, 14 bp, Homo sapiens
actggtattttatc

SEQ ID NO: 4708487 - DNA, 21 bp, Homo sapiens
actggtgttatcaccgtgggc

SEQ ID NO: 4708488 - DNA, 20 bp, Homo sapiens
actgtaacttccaaataaat

SEQ ID NO: 4708489 - DNA, 22 bp, Homo sapiens
actgtaatgaaccgctgaatat

SEQ ID NO: 4708490 - DNA, 23 bp, Homo sapiens
actgtagaaaagggaactgaaca

SEQ ID NO: 4708491 - DNA, 21 bp, Homo sapiens
actgtagggaaaaaaatgctt

SEQ ID NO: 4708492 - DNA, 17 bp, Homo sapiens
actgtataaataggaga

SEQ ID NO: 4708493 - DNA, 22 bp, Homo sapiens
actgtataaataggagaggatg

SEQ ID NO: 4708494 - DNA, 19 bp, Homo sapiens
actgtatggaaacactgat

SEQ ID NO: 4708495 - DNA, 23 bp, Homo sapiens
actgtatggaaacactgattttg

SEQ ID NO: 4708496 - DNA, 14 bp, Homo sapiens
actgtattttatgt

SEQ ID NO: 4708497 - DNA, 21 bp, Homo sapiens
actgtattttgtattgtttca

SEQ ID NO: 4708498 - DNA, 15 bp, Homo sapiens
actgtcctattatat

SEQ ID NO: 4708499 - DNA, 13 bp, Homo sapiens
actgtcctgctcc

SEQ ID NO: 4708500 - DNA, 21 bp, Homo sapiens
actgtctaagattaatagcat

SEQ ID NO: 4708501 - DNA, 22 bp, Homo sapiens
actgtctccatggccctgcaaa

SEQ ID NO: 4708502 - DNA, 19 bp, Homo sapiens
actgtctgtagtgttttgt

SEQ ID NO: 4708503 - DNA, 16 bp, Homo sapiens
actgtcttcttcaggg

SEQ ID NO: 4708504 - DNA, 20 bp, Homo sapiens
actgtgaatgcttctgattt

SEQ ID NO: 4708505 - DNA, 17 bp, Homo sapiens
actgtgacaggcagcag

SEQ ID NO: 4708506 - DNA, 21 bp, Homo sapiens
actgtgcacatctgtgtcttg

SEQ ID NO: 4708507 - DNA, 16 bp, Homo sapiens
actgtgccatgtgcca

SEQ ID NO: 4708508 - DNA, 20 bp, Homo sapiens
actgtgctgagtctgaaggc

SEQ ID NO: 4708509 - DNA, 18 bp, Homo sapiens
actgtgctggagccacta

SEQ ID NO: 4708510 - DNA, 15 bp, Homo sapiens
actgtggaggaagga

SEQ ID NO: 4708511 - DNA, 16 bp, Homo sapiens
actgtggaggaaggat

SEQ ID NO: 4708512 - DNA, 23 bp, Homo sapiens
actgtgtacagtaaatggcttat

SEQ ID NO: 4708513 - DNA, 23 bp, Homo sapiens
actgtgtttaatagtatatctaa

SEQ ID NO: 4708514 - DNA, 16 bp, Homo sapiens
actgttaactatgaca

SEQ ID NO: 4708515 - DNA, 21 bp, Homo sapiens
actgttaatagttcaggtaac

SEQ ID NO: 4708516 - DNA, 15 bp, Homo sapiens
actgttcaagagcac

SEQ ID NO: 4708517 - DNA, 16 bp, Homo sapiens
actgttcaagagcaca

SEQ ID NO: 4708518 - DNA, 15 bp, Homo sapiens
actgttccccctgtg

SEQ ID NO: 4708519 - DNA, 16 bp, Homo sapiens
actgttccccctgtgc

SEQ ID NO: 4708520 - DNA, 18 bp, Homo sapiens
actgttccccctgtgcag

SEQ ID NO: 4708521 - DNA, 14 bp, Homo sapiens
actgttctctgccc

SEQ ID NO: 4708522 - DNA, 19 bp, Homo sapiens
actgttctctgccctccaa

SEQ ID NO: 4708523 - DNA, 13 bp, Homo sapiens
actgttcttgaat

SEQ ID NO: 4708524 - DNA, 18 bp, Homo sapiens
actgttgcccaggctggc

SEQ ID NO: 4708525 - DNA, 22 bp, Homo sapiens
actgttgggtgggtgggccctg

SEQ ID NO: 4708526 - DNA, 19 bp, Homo sapiens
actgtttgtcttctcccca

SEQ ID NO: 4708527 - DNA, 16 bp, Homo sapiens
acttaaacatttttgt

SEQ ID NO: 4708528 - DNA, 20 bp, Homo sapiens
acttaaatttggtttgttaa

SEQ ID NO: 4708529 - DNA, 17 bp, Homo sapiens
acttaagtctcgaatgt

SEQ ID NO: 4708530 - DNA, 15 bp, Homo sapiens
acttaatagaaacat

SEQ ID NO: 4708531 - DNA, 13 bp, Homo sapiens
acttaatgaatga

SEQ ID NO: 4708532 - DNA, 16 bp, Homo sapiens
acttacaccagtttga

SEQ ID NO: 4708533 - DNA, 14 bp, Homo sapiens
acttacatatctga

SEQ ID NO: 4708534 - DNA, 15 bp, Homo sapiens
acttattgaatatat

SEQ ID NO: 4708535 - DNA, 21 bp, Homo sapiens
acttcaaaaactaaaatcatt

SEQ ID NO: 4708536 - DNA, 19 bp, Homo sapiens
acttcagtactcaaattca

SEQ ID NO: 4708537 - DNA, 15 bp, Homo sapiens
acttcattttttaaa

SEQ ID NO: 4708538 - DNA, 19 bp, Homo sapiens
acttccaaatcccctaagc

SEQ ID NO: 4708539 - DNA, 17 bp, Homo sapiens
acttcccctcctacccc

SEQ ID NO: 4708540 - DNA, 14 bp, Homo sapiens
acttccctgggcaa

SEQ ID NO: 4708541 - DNA, 12 bp, Homo sapiens
acttcctcccct

SEQ ID NO: 4708542 - DNA, 13 bp, Homo sapiens
acttctaggattt

SEQ ID NO: 4708543 - DNA, 20 bp, Homo sapiens
acttctaggatttattgtta

SEQ ID NO: 4708544 - DNA, 19 bp, Homo sapiens
acttctctgagtcagctga

SEQ ID NO: 4708545 - DNA, 18 bp, Homo sapiens
acttctgccatattctgt

SEQ ID NO: 4708546 - DNA, 20 bp, Homo sapiens
acttctgccatattctgttg

SEQ ID NO: 4708547 - DNA, 13 bp, Homo sapiens
acttcttcagagc

SEQ ID NO: 4708548 - DNA, 16 bp, Homo sapiens
acttcttcagagctga

SEQ ID NO: 4708549 - DNA, 21 bp, Homo sapiens
acttcttcagagctgacacag

SEQ ID NO: 4708550 - DNA, 22 bp, Homo sapiens
acttcttccatccaaagaatta

SEQ ID NO: 4708551 - DNA, 21 bp, Homo sapiens
acttctttgctttgcccagca

SEQ ID NO: 4708552 - DNA, 18 bp, Homo sapiens
acttgaattttcccactg

SEQ ID NO: 4708553 - DNA, 20 bp, Homo sapiens
acttgaattttcccactgca

SEQ ID NO: 4708554 - DNA, 18 bp, Homo sapiens
acttgacagaacactgtc

SEQ ID NO: 4708555 - DNA, 20 bp, Homo sapiens
acttgacagaacactgtctt

SEQ ID NO: 4708556 - DNA, 20 bp, Homo sapiens
acttgcggttccggcatgga

SEQ ID NO: 4708557 - DNA, 14 bp, Homo sapiens
acttggaagctccg

SEQ ID NO: 4708558 - DNA, 18 bp, Homo sapiens
acttggatgaggagtggt

SEQ ID NO: 4708559 - DNA, 14 bp, Homo sapiens
acttggggcctctg

SEQ ID NO: 4708560 - DNA, 16 bp, Homo sapiens
acttggtttcctattt

SEQ ID NO: 4708561 - DNA, 19 bp, Homo sapiens
acttgtaaaggaatttaaa

SEQ ID NO: 4708562 - DNA, 18 bp, Homo sapiens
acttgtaatttttttaat

SEQ ID NO: 4708563 - DNA, 21 bp, Homo sapiens
acttgtgaactccatcattca

SEQ ID NO: 4708564 - DNA, 14 bp, Homo sapiens
acttgtggacacag

SEQ ID NO: 4708565 - DNA, 19 bp, Homo sapiens
acttgtggacacagctctt

SEQ ID NO: 4708566 - DNA, 18 bp, Homo sapiens
acttgttcattctgtgac

SEQ ID NO: 4708567 - DNA, 13 bp, Homo sapiens
acttgttgtttaa

SEQ ID NO: 4708568 - DNA, 16 bp, Homo sapiens
acttgttgtttaatgt

SEQ ID NO: 4708569 - DNA, 16 bp, Homo sapiens
actttaaaaggagcca

SEQ ID NO: 4708570 - DNA, 13 bp, Homo sapiens
actttaaattgtg

SEQ ID NO: 4708571 - DNA, 16 bp, Homo sapiens
actttagaagcctgca

SEQ ID NO: 4708572 - DNA, 15 bp, Homo sapiens
actttagtattaaat

SEQ ID NO: 4708573 - DNA, 17 bp, Homo sapiens
actttagtattaaatca

SEQ ID NO: 4708574 - DNA, 22 bp, Homo sapiens
actttcaggccacatggctaaa

SEQ ID NO: 4708575 - DNA, 18 bp, Homo sapiens
actttcattacttttaaa

SEQ ID NO: 4708576 - DNA, 22 bp, Homo sapiens
actttcattggatttttgttaa

SEQ ID NO: 4708577 - DNA, 20 bp, Homo sapiens
actttcatttttttccaggc

SEQ ID NO: 4708578 - DNA, 21 bp, Homo sapiens
actttcatttttttccaggct

SEQ ID NO: 4708579 - DNA, 23 bp, Homo sapiens
actttcatttttttccaggctgg

SEQ ID NO: 4708580 - DNA, 21 bp, Homo sapiens
actttcctcttagtcgagcca

SEQ ID NO: 4708581 - DNA, 21 bp, Homo sapiens
actttcctctttggtctacac

SEQ ID NO: 4708582 - DNA, 20 bp, Homo sapiens
actttgacctaaattattta

SEQ ID NO: 4708583 - DNA, 14 bp, Homo sapiens
actttggaaagact

SEQ ID NO: 4708584 - DNA, 17 bp, Homo sapiens
actttggctgcatgcga

SEQ ID NO: 4708585 - DNA, 21 bp, Homo sapiens
actttggggttcggcctgtgt

SEQ ID NO: 4708586 - DNA, 12 bp, Homo sapiens
actttgtgcaaa

SEQ ID NO: 4708587 - DNA, 17 bp, Homo sapiens
actttgtgcaaaagcag

SEQ ID NO: 4708588 - DNA, 18 bp, Homo sapiens
actttgtgttcaccttgt

SEQ ID NO: 4708589 - DNA, 12 bp, Homo sapiens
actttgtttatt

SEQ ID NO: 4708590 - DNA, 14 bp, Homo sapiens
acttttctttgtgg

SEQ ID NO: 4708591 - DNA, 22 bp, Homo sapiens
acttttgttaggaaaaaattga

SEQ ID NO: 4708592 - DNA, 15 bp, Homo sapiens
actttttgcagcttt

SEQ ID NO: 4708593 - DNA, 16 bp, Homo sapiens
actttttgttccagag

SEQ ID NO: 4708594 - DNA, 14 bp, Homo sapiens
agcacagaccctgc

SEQ ID NO: 4708595 - DNA, 22 bp, Homo sapiens
agcacagcaaggaggctggctg

SEQ ID NO: 4708596 - DNA, 12 bp, Homo sapiens
agcacagccctc

SEQ ID NO: 4708597 - DNA, 21 bp, Homo sapiens
agcacagccctcccgcccctt

SEQ ID NO: 4708598 - DNA, 16 bp, Homo sapiens
agcacagcttcatttc

SEQ ID NO: 4708599 - DNA, 15 bp, Homo sapiens
agcacaggtgggctt

SEQ ID NO: 4708600 - DNA, 19 bp, Homo sapiens
agcacaggtgggcttccca

SEQ ID NO: 4708601 - DNA, 21 bp, Homo sapiens
agcacaggtgggcttcccagt

SEQ ID NO: 4708602 - DNA, 12 bp, Homo sapiens
agcacagttcct

SEQ ID NO: 4708603 - DNA, 21 bp, Homo sapiens
agcacatgttaccatgtctga

SEQ ID NO: 4708604 - DNA, 22 bp, Homo sapiens
agcacattttgacacaatgttg

SEQ ID NO: 4708605 - DNA, 18 bp, Homo sapiens
agcaccaagctcaaagcg

SEQ ID NO: 4708606 - DNA, 12 bp, Homo sapiens
agcaccagggaa

SEQ ID NO: 4708607 - DNA, 15 bp, Homo sapiens
agcacccgggctcag

SEQ ID NO: 4708608 - DNA, 16 bp, Homo sapiens
agcaccggaccagcct

SEQ ID NO: 4708609 - DNA, 17 bp, Homo sapiens
agcaccggaccagcctg

SEQ ID NO: 4708610 - DNA, 23 bp, Homo sapiens
agcaccggaccagcctggcccac

SEQ ID NO: 4708611 - DNA, 15 bp, Homo sapiens
agcacctacagtgta

SEQ ID NO: 4708612 - DNA, 22 bp, Homo sapiens
agcacctacagtgtacagtctt

SEQ ID NO: 4708613 - DNA, 13 bp, Homo sapiens
agcacctcctgcc

SEQ ID NO: 4708614 - DNA, 19 bp, Homo sapiens
agcaccttagacagtccct

SEQ ID NO: 4708615 - DNA, 11 bp, Homo sapiens
agcactgagga

SEQ ID NO: 4708616 - DNA, 17 bp, Homo sapiens
agcactgcttgaggaaa

SEQ ID NO: 4708617 - DNA, 18 bp, Homo sapiens
agcacttacaccagtttg

SEQ ID NO: 4708618 - DNA, 12 bp, Homo sapiens
agcagaaggggg

SEQ ID NO: 4708619 - DNA, 17 bp, Homo sapiens
agcagaatactggtctc

SEQ ID NO: 4708620 - DNA, 15 bp, Homo sapiens
agcagagaccatccc

SEQ ID NO: 4708621 - DNA, 16 bp, Homo sapiens
agcagagttctttgca

SEQ ID NO: 4708622 - DNA, 23 bp, Homo sapiens
agcagagttctttgcaagcttat

SEQ ID NO: 4708623 - DNA, 16 bp, Homo sapiens
agcagatgcagagagc

SEQ ID NO: 4708624 - DNA, 13 bp, Homo sapiens
agcagatgctggt

SEQ ID NO: 4708625 - DNA, 15 bp, Homo sapiens
agcagcaagtgtgct

SEQ ID NO: 4708626 - DNA, 17 bp, Homo sapiens
agcagccctggagtcat

SEQ ID NO: 4708627 - DNA, 14 bp, Homo sapiens
agcagcctccttat

SEQ ID NO: 4708628 - DNA, 18 bp, Homo sapiens
agcagcttagactaaggc

SEQ ID NO: 4708629 - DNA, 17 bp, Homo sapiens
agcagcttctgccactt

SEQ ID NO: 4708630 - DNA, 13 bp, Homo sapiens
agcagggaaacag

SEQ ID NO: 4708631 - DNA, 15 bp, Homo sapiens
agcagggctcagcgg

SEQ ID NO: 4708632 - DNA, 17 bp, Homo sapiens
agcagggtctgggcagg

SEQ ID NO: 4708633 - DNA, 17 bp, Homo sapiens
agcaggtgctgctaccc

SEQ ID NO: 4708634 - DNA, 18 bp, Homo sapiens
agcaggtgctgctaccct

SEQ ID NO: 4708635 - DNA, 20 bp, Homo sapiens
agcagtgaatgattcagtgt

SEQ ID NO: 4708636 - DNA, 12 bp, Homo sapiens
agcagtgtctct

SEQ ID NO: 4708637 - DNA, 15 bp, Homo sapiens
agcagtgtgaggcca

SEQ ID NO: 4708638 - DNA, 15 bp, Homo sapiens
agcagttgctcacat

SEQ ID NO: 4708639 - DNA, 15 bp, Homo sapiens
agcagtttattataa

SEQ ID NO: 4708640 - DNA, 22 bp, Homo sapiens
agcataatttaaaaatatattt

SEQ ID NO: 4708641 - DNA, 20 bp, Homo sapiens
agcataattttgtgttgtac

SEQ ID NO: 4708642 - DNA, 16 bp, Homo sapiens
agcatcaaacatgaaa

SEQ ID NO: 4708643 - DNA, 16 bp, Homo sapiens
agcatcaggccaggcc

SEQ ID NO: 4708644 - DNA, 17 bp, Homo sapiens
agcatcaggccaggccc

SEQ ID NO: 4708645 - DNA, 13 bp, Homo sapiens
agcatcctggcac

SEQ ID NO: 4708646 - DNA, 23 bp, Homo sapiens
agcatcctggcacccggcccctg

SEQ ID NO: 4708647 - DNA, 19 bp, Homo sapiens
agcatcgcttaggagaagt

SEQ ID NO: 4708648 - DNA, 22 bp, Homo sapiens
agcatgagactatgtaaaaata

SEQ ID NO: 4708649 - DNA, 21 bp, Homo sapiens
agcatgcattttcttgtatga

SEQ ID NO: 4708650 - DNA, 13 bp, Homo sapiens
agcatggccctgc

SEQ ID NO: 4708651 - DNA, 16 bp, Homo sapiens
agcatggctgtgagga

SEQ ID NO: 4708652 - DNA, 19 bp, Homo sapiens
agcatggttccaatttttt

SEQ ID NO: 4708653 - DNA, 23 bp, Homo sapiens
agcatggttccaattttttttaa

SEQ ID NO: 4708654 - DNA, 20 bp, Homo sapiens
agcatgtgaggggtagtggg

SEQ ID NO: 4708655 - DNA, 17 bp, Homo sapiens
agcattagatttctcat

SEQ ID NO: 4708656 - DNA, 19 bp, Homo sapiens
agcattatgatgtgggtca

SEQ ID NO: 4708657 - DNA, 15 bp, Homo sapiens
agcattccttctttg

SEQ ID NO: 4708658 - DNA, 17 bp, Homo sapiens
agcattccttctttgat

SEQ ID NO: 4708659 - DNA, 16 bp, Homo sapiens
agcatttgtcaacaaa

SEQ ID NO: 4708660 - DNA, 21 bp, Homo sapiens
agcattttcagcatcaaacat

SEQ ID NO: 4708661 - DNA, 16 bp, Homo sapiens
agccaaagctaggcct

SEQ ID NO: 4708662 - DNA, 19 bp, Homo sapiens
agccaaagctaggcctggc

SEQ ID NO: 4708663 - DNA, 23 bp, Homo sapiens
agccaaagctaggcctggccaga

SEQ ID NO: 4708664 - DNA, 17 bp, Homo sapiens
agccaaagttaaatgta

SEQ ID NO: 4708665 - DNA, 19 bp, Homo sapiens
agccaaatttaaaactgtt

SEQ ID NO: 4708666 - DNA, 14 bp, Homo sapiens
agccacattcctga

SEQ ID NO: 4708667 - DNA, 22 bp, Homo sapiens
agccaccctcaccgcggctgga

SEQ ID NO: 4708668 - DNA, 14 bp, Homo sapiens
agccactcctctga

SEQ ID NO: 4708669 - DNA, 18 bp, Homo sapiens
agccactgcaccgggcca

SEQ ID NO: 4708670 - DNA, 21 bp, Homo sapiens
agccactgcaccgggccacag

SEQ ID NO: 4708671 - DNA, 13 bp, Homo sapiens
agccactggaggg

SEQ ID NO: 4708672 - DNA, 21 bp, Homo sapiens
agccagcgtcctcctctgtga

SEQ ID NO: 4708673 - DNA, 22 bp, Homo sapiens
agccaggatcatggtgtaataa

SEQ ID NO: 4708674 - DNA, 12 bp, Homo sapiens
agccaggccaca

SEQ ID NO: 4708675 - DNA, 22 bp, Homo sapiens
agccaggccacaagacccttgt

SEQ ID NO: 4708676 - DNA, 15 bp, Homo sapiens
agccagggagagccc

SEQ ID NO: 4708677 - DNA, 21 bp, Homo sapiens
agccagggagagcccaggagc

SEQ ID NO: 4708678 - DNA, 12 bp, Homo sapiens
agccagggtctc

SEQ ID NO: 4708679 - DNA, 16 bp, Homo sapiens
agccagtaaacagagg

SEQ ID NO: 4708680 - DNA, 23 bp, Homo sapiens
agccagtcattgtaacctcgtgt

SEQ ID NO: 4708681 - DNA, 21 bp, Homo sapiens
agccataattccaccatcata

SEQ ID NO: 4708682 - DNA, 16 bp, Homo sapiens
agccatacataaaaga

SEQ ID NO: 4708683 - DNA, 18 bp, Homo sapiens
agccatacataaaagaaa

SEQ ID NO: 4708684 - DNA, 21 bp, Homo sapiens
agccatacataaaagaaataa

SEQ ID NO: 4708685 - DNA, 22 bp, Homo sapiens
agccatacataaaagaaataaa

SEQ ID NO: 4708686 - DNA, 23 bp, Homo sapiens
agccatacataaaagaaataaac

SEQ ID NO: 4708687 - DNA, 20 bp, Homo sapiens
agccatagagatatttaaaa

SEQ ID NO: 4708688 - DNA, 14 bp, Homo sapiens
agccatcccagcct

SEQ ID NO: 4708689 - DNA, 17 bp, Homo sapiens
agccatcccagccttgg

SEQ ID NO: 4708690 - DNA, 18 bp, Homo sapiens
agccatcccagccttggc

SEQ ID NO: 4708691 - DNA, 21 bp, Homo sapiens
agccattggctatttaaaact

SEQ ID NO: 4708692 - DNA, 23 bp, Homo sapiens
agcccaaagtggtatagaaatgc

SEQ ID NO: 4708693 - DNA, 20 bp, Homo sapiens
agcccacgcccccactggtg

SEQ ID NO: 4708694 - DNA, 23 bp, Homo sapiens
agcccacgcccccactggtgaca

SEQ ID NO: 4708695 - DNA, 15 bp, Homo sapiens
agcccacgtcctgtc

SEQ ID NO: 4708696 - DNA, 17 bp, Homo sapiens
agcccacgtcctgtcag

SEQ ID NO: 4708697 - DNA, 14 bp, Homo sapiens
agcccacttctgcc

SEQ ID NO: 4708698 - DNA, 23 bp, Homo sapiens
agctagctcccctcctctcccct

SEQ ID NO: 4708699 - DNA, 20 bp, Homo sapiens
agctatgttatattgaaaaa

SEQ ID NO: 4708700 - DNA, 14 bp, Homo sapiens
agctattagccagg

SEQ ID NO: 4708701 - DNA, 18 bp, Homo sapiens
agctattagccaggatca

SEQ ID NO: 4708702 - DNA, 15 bp, Homo sapiens
agctatttctatgta

SEQ ID NO: 4708703 - DNA, 17 bp, Homo sapiens
agctattttggtttagt

SEQ ID NO: 4708704 - DNA, 23 bp, Homo sapiens
agctattttttaaaaaaaactat

SEQ ID NO: 4708705 - DNA, 15 bp, Homo sapiens
agctcaccagcccca

SEQ ID NO: 4708706 - DNA, 22 bp, Homo sapiens
agctcaccagccccagtgccca

SEQ ID NO: 4708707 - DNA, 15 bp, Homo sapiens
agctcacctctccct

SEQ ID NO: 4708708 - DNA, 14 bp, Homo sapiens
agctcagagagggc

SEQ ID NO: 4708709 - DNA, 17 bp, Homo sapiens
agctcagagagggcagg

SEQ ID NO: 4708710 - DNA, 14 bp, Homo sapiens
agctcagagagggt

SEQ ID NO: 4708711 - DNA, 18 bp, Homo sapiens
agctcagagagggtggga

SEQ ID NO: 4708712 - DNA, 14 bp, Homo sapiens
agctcaggaccagg

SEQ ID NO: 4708713 - DNA, 18 bp, Homo sapiens
agctcaggaccaggcaat

SEQ ID NO: 4708714 - DNA, 17 bp, Homo sapiens
agctcagggcctggctc

SEQ ID NO: 4708715 - DNA, 20 bp, Homo sapiens
agctcagggcctggctcagg

SEQ ID NO: 4708716 - DNA, 22 bp, Homo sapiens
agctcaggtgtccctgcacttg

SEQ ID NO: 4708717 - DNA, 15 bp, Homo sapiens
agctccaagctccca

SEQ ID NO: 4708718 - DNA, 13 bp, Homo sapiens
agctccagctcac

SEQ ID NO: 4708719 - DNA, 17 bp, Homo sapiens
agctccagctcaccagc

SEQ ID NO: 4708720 - DNA, 23 bp, Homo sapiens
agctcccaagagcttccagagct

SEQ ID NO: 4708721 - DNA, 22 bp, Homo sapiens
agctcccaagggatggtgccct

SEQ ID NO: 4708722 - DNA, 23 bp, Homo sapiens
agctcccaagggatggtgccctg

SEQ ID NO: 4708723 - DNA, 14 bp, Homo sapiens
agctcccctcccca

SEQ ID NO: 4708724 - DNA, 19 bp, Homo sapiens
agctcccctcctctcccct

SEQ ID NO: 4708725 - DNA, 23 bp, Homo sapiens
agctccgctttctacccagcgag

SEQ ID NO: 4708726 - DNA, 15 bp, Homo sapiens
agctccgtggagcag

SEQ ID NO: 4708727 - DNA, 15 bp, Homo sapiens
agctccttctgtcct

SEQ ID NO: 4708728 - DNA, 22 bp, Homo sapiens
agctccttctgtcctactctgt

SEQ ID NO: 4708729 - DNA, 17 bp, Homo sapiens
agctctatcaccaagga

SEQ ID NO: 4708730 - DNA, 13 bp, Homo sapiens
agctctatctgca

SEQ ID NO: 4708731 - DNA, 17 bp, Homo sapiens
agctctatctgcaatgt

SEQ ID NO: 4708732 - DNA, 21 bp, Homo sapiens
agctctcagttgcagccctgc

SEQ ID NO: 4708733 - DNA, 15 bp, Homo sapiens
agctctgagctgtca

SEQ ID NO: 4708734 - DNA, 15 bp, Homo sapiens
agctctgcagcaata

SEQ ID NO: 4708735 - DNA, 21 bp, Homo sapiens
agctctgcagcaatattctga

SEQ ID NO: 4708736 - DNA, 17 bp, Homo sapiens
agctctggtccatagag

SEQ ID NO: 4708737 - DNA, 14 bp, Homo sapiens
agctctgtcctggg

SEQ ID NO: 4708738 - DNA, 20 bp, Homo sapiens
agctgacacaaacctgcctg

SEQ ID NO: 4708739 - DNA, 14 bp, Homo sapiens
agctgacagtcctc

SEQ ID NO: 4708740 - DNA, 16 bp, Homo sapiens
agctgacagtcctctc

SEQ ID NO: 4708741 - DNA, 14 bp, Homo sapiens
agctgaccccctcc

SEQ ID NO: 4708742 - DNA, 19 bp, Homo sapiens
agctgaccccctcccccca

SEQ ID NO: 4708743 - DNA, 23 bp, Homo sapiens
agctgagattataggcacctacc

SEQ ID NO: 4708744 - DNA, 14 bp, Homo sapiens
agctgcctggaccc

SEQ ID NO: 4708745 - DNA, 13 bp, Homo sapiens
agctgcctgttca

SEQ ID NO: 4708746 - DNA, 18 bp, Homo sapiens
agctgcggtccacccagg

SEQ ID NO: 4708747 - DNA, 19 bp, Homo sapiens
agctgcggtccacccagga

SEQ ID NO: 4708748 - DNA, 20 bp, Homo sapiens
agctgcggtccacccaggag

SEQ ID NO: 4708749 - DNA, 12 bp, Homo sapiens
agctgctgacag

SEQ ID NO: 4708750 - DNA, 22 bp, Homo sapiens
agctgcttttgtctatgggact

SEQ ID NO: 4708751 - DNA, 21 bp, Homo sapiens
agctggaagtggctctggggt

SEQ ID NO: 4708752 - DNA, 14 bp, Homo sapiens
agctggagcctggt

SEQ ID NO: 4708753 - DNA, 20 bp, Homo sapiens
agctggaggactagaacctg

SEQ ID NO: 4708754 - DNA, 22 bp, Homo sapiens
agctggaggactagaacctgga

SEQ ID NO: 4708755 - DNA, 23 bp, Homo sapiens
agctggattgggttatgaatatt

SEQ ID NO: 4708756 - DNA, 18 bp, Homo sapiens
agctgggactacaggcac

SEQ ID NO: 4708757 - DNA, 19 bp, Homo sapiens
agctgggactacaggtgtg

SEQ ID NO: 4708758 - DNA, 21 bp, Homo sapiens
agctgggattacaggctcctg

SEQ ID NO: 4708759 - DNA, 14 bp, Homo sapiens
agctgggttggaaa

SEQ ID NO: 4708760 - DNA, 16 bp, Homo sapiens
agctggtcccactcag

SEQ ID NO: 4708761 - DNA, 17 bp, Homo sapiens
agctggtggatggtgac

SEQ ID NO: 4708762 - DNA, 15 bp, Homo sapiens
agctggttggagagc

SEQ ID NO: 4708763 - DNA, 21 bp, Homo sapiens
agctgtgccaccctgggctct

SEQ ID NO: 4708764 - DNA, 22 bp, Homo sapiens
agctgtgccaccctgggctctg

SEQ ID NO: 4708765 - DNA, 17 bp, Homo sapiens
agctgtgctctggacag

SEQ ID NO: 4708766 - DNA, 13 bp, Homo sapiens
agctgtgtctctg

SEQ ID NO: 4708767 - DNA, 16 bp, Homo sapiens
agctgtgtctctgtat

SEQ ID NO: 4708768 - DNA, 22 bp, Homo sapiens
agctgttctgtcccttggagct

SEQ ID NO: 4708769 - DNA, 16 bp, Homo sapiens
agctgttgtaaagaat

SEQ ID NO: 4708770 - DNA, 22 bp, Homo sapiens
agctgttgtacatttatgattt

SEQ ID NO: 4708771 - DNA, 23 bp, Homo sapiens
agctgttgtacatttatgattta

SEQ ID NO: 4708772 - DNA, 22 bp, Homo sapiens
agcttagattttctgtaaatga

SEQ ID NO: 4708773 - DNA, 16 bp, Homo sapiens
agcttatggcatctca

SEQ ID NO: 4708774 - DNA, 18 bp, Homo sapiens
agcttatttagcacattt

SEQ ID NO: 4708775 - DNA, 18 bp, Homo sapiens
agcttcacagtacccaaa

SEQ ID NO: 4708776 - DNA, 11 bp, Homo sapiens
agcttcaggtt

SEQ ID NO: 4708777 - DNA, 20 bp, Homo sapiens
agcttccagagctctgaccc

SEQ ID NO: 4708778 - DNA, 13 bp, Homo sapiens
agcttctgctggg

SEQ ID NO: 4708779 - DNA, 23 bp, Homo sapiens
agcttctgttgctgcctcatgct

SEQ ID NO: 4708780 - DNA, 22 bp, Homo sapiens
agcttgagggttgggctggtgt

SEQ ID NO: 4708781 - DNA, 14 bp, Homo sapiens
agcttggggaagac

SEQ ID NO: 4708782 - DNA, 21 bp, Homo sapiens
agcttgtaaatagctcaggtg

SEQ ID NO: 4708783 - DNA, 22 bp, Homo sapiens
agctttcatgtaaactgtgcac

SEQ ID NO: 4708784 - DNA, 22 bp, Homo sapiens
agctttgggtcatttttaacta

SEQ ID NO: 4708785 - DNA, 14 bp, Homo sapiens
agctttttaattgt

SEQ ID NO: 4708786 - DNA, 15 bp, Homo sapiens
agctttttaattgtt

SEQ ID NO: 4708787 - DNA, 21 bp, Homo sapiens
agctttttaattgttgtttct

SEQ ID NO: 4708788 - DNA, 19 bp, Homo sapiens
aggaaaagcctctgtgtca

SEQ ID NO: 4708789 - DNA, 16 bp, Homo sapiens
aggaaaagctgctgac

SEQ ID NO: 4708790 - DNA, 15 bp, Homo sapiens
aggaaacccagctct

SEQ ID NO: 4708791 - DNA, 17 bp, Homo sapiens
aggaaacccagctctgg

SEQ ID NO: 4708792 - DNA, 21 bp, Homo sapiens
aggaaacccagctctggtcca

SEQ ID NO: 4708793 - DNA, 12 bp, Homo sapiens
aggaaactctta

SEQ ID NO: 4708794 - DNA, 17 bp, Homo sapiens
aggaaactcttatctca

SEQ ID NO: 4708795 - DNA, 18 bp, Homo sapiens
aggaaactcttatctcag

SEQ ID NO: 4708796 - DNA, 23 bp, Homo sapiens
agcccaggaaaggctccaggagc

SEQ ID NO: 4708797 - DNA, 18 bp, Homo sapiens
agcccaggagctcccctc

SEQ ID NO: 4708798 - DNA, 19 bp, Homo sapiens
agcccaggagctcccctcc

SEQ ID NO: 4708799 - DNA, 21 bp, Homo sapiens
agcccaggccaggactctgca

SEQ ID NO: 4708800 - DNA, 22 bp, Homo sapiens
agcccaggccaggactctgcag

SEQ ID NO: 4708801 - DNA, 23 bp, Homo sapiens
agcccaggccaggactctgcagc

SEQ ID NO: 4708802 - DNA, 22 bp, Homo sapiens
agcccattcattccattctgga

SEQ ID NO: 4708803 - DNA, 18 bp, Homo sapiens
agccccaaaactctcctc

SEQ ID NO: 4708804 - DNA, 21 bp, Homo sapiens
agccccaaaactctcctctgc

SEQ ID NO: 4708805 - DNA, 22 bp, Homo sapiens
agccccaaaactctcctctgct

SEQ ID NO: 4708806 - DNA, 24 bp, Homo sapiens
agccccaaaactctcctctgctgc

SEQ ID NO: 4708807 - DNA, 16 bp, Homo sapiens
agccccaaggggtggc

SEQ ID NO: 4708808 - DNA, 11 bp, Homo sapiens
agccccacagc

SEQ ID NO: 4708809 - DNA, 16 bp, Homo sapiens
agccccacagcccacg

SEQ ID NO: 4708810 - DNA, 20 bp, Homo sapiens
agccccacagcccacgtcct

SEQ ID NO: 4708811 - DNA, 23 bp, Homo sapiens
agccccaccccagggcagccagg

SEQ ID NO: 4708812 - DNA, 13 bp, Homo sapiens
agccccagtgccc

SEQ ID NO: 4708813 - DNA, 15 bp, Homo sapiens
agccccagtgcccac

SEQ ID NO: 4708814 - DNA, 11 bp, Homo sapiens
agccccatcct

SEQ ID NO: 4708815 - DNA, 23 bp, Homo sapiens
agccccatcctctgtacagagcc

SEQ ID NO: 4708816 - DNA, 17 bp, Homo sapiens
agccccattctgcctgc

SEQ ID NO: 4708817 - DNA, 11 bp, Homo sapiens
agcccccaccc

SEQ ID NO: 4708818 - DNA, 14 bp, Homo sapiens
agccccgaggcctt

SEQ ID NO: 4708819 - DNA, 17 bp, Homo sapiens
agccccgaggccttctc

SEQ ID NO: 4708820 - DNA, 19 bp, Homo sapiens
agccccgccacgcttgtgt

SEQ ID NO: 4708821 - DNA, 14 bp, Homo sapiens
agcccctctcttat

SEQ ID NO: 4708822 - DNA, 20 bp, Homo sapiens
agcccctgatcctgtgaagt

SEQ ID NO: 4708823 - DNA, 18 bp, Homo sapiens
agcccctggatgcagcct

SEQ ID NO: 4708824 - DNA, 14 bp, Homo sapiens
agccccttctgacc

SEQ ID NO: 4708825 - DNA, 14 bp, Homo sapiens
agcccgaatacaaa

SEQ ID NO: 4708826 - DNA, 13 bp, Homo sapiens
agcccgggctctg

SEQ ID NO: 4708827 - DNA, 14 bp, Homo sapiens
agcccgggctctgc

SEQ ID NO: 4708828 - DNA, 16 bp, Homo sapiens
agcccgggctctgcct

SEQ ID NO: 4708829 - DNA, 16 bp, Homo sapiens
agccctactctgtgta

SEQ ID NO: 4708830 - DNA, 17 bp, Homo sapiens
agccctagggtggagag

SEQ ID NO: 4708831 - DNA, 17 bp, Homo sapiens
agccctcaccctggggc

SEQ ID NO: 4708832 - DNA, 17 bp, Homo sapiens
agccctccttaccactg

SEQ ID NO: 4708833 - DNA, 15 bp, Homo sapiens
agccctggctgaagg

SEQ ID NO: 4708834 - DNA, 16 bp, Homo sapiens
agccctggctgaagga

SEQ ID NO: 4708835 - DNA, 21 bp, Homo sapiens
agccctggtggcagtgggagc

SEQ ID NO: 4708836 - DNA, 23 bp, Homo sapiens
agccctggtggcagtgggagctg

SEQ ID NO: 4708837 - DNA, 21 bp, Homo sapiens
agcccttctccatggccctgc

SEQ ID NO: 4708838 - DNA, 17 bp, Homo sapiens
agccgagatcacgccac

SEQ ID NO: 4708839 - DNA, 14 bp, Homo sapiens
agccgctggggcca

SEQ ID NO: 4708840 - DNA, 16 bp, Homo sapiens
agccgggtctgcctct

SEQ ID NO: 4708841 - DNA, 18 bp, Homo sapiens
agcctaaggctcctgttt

SEQ ID NO: 4708842 - DNA, 19 bp, Homo sapiens
agcctaaggctcctgtttt

SEQ ID NO: 4708843 - DNA, 17 bp, Homo sapiens
agcctcaacctcctggg

SEQ ID NO: 4708844 - DNA, 18 bp, Homo sapiens
agcctcaacctcctgggc

SEQ ID NO: 4708845 - DNA, 19 bp, Homo sapiens
agcctcaacctcctgggct

SEQ ID NO: 4708846 - DNA, 18 bp, Homo sapiens
agcctcaataagccttgt

SEQ ID NO: 4708847 - DNA, 20 bp, Homo sapiens
agcctcaataagccttgtcg

SEQ ID NO: 4708848 - DNA, 17 bp, Homo sapiens
agcctcacagtccttac

SEQ ID NO: 4708849 - DNA, 13 bp, Homo sapiens
agcctcagcatcc

SEQ ID NO: 4708850 - DNA, 14 bp, Homo sapiens
agcctcagcatcct

SEQ ID NO: 4708851 - DNA, 19 bp, Homo sapiens
agcctcagcatcctggcac

SEQ ID NO: 4708852 - DNA, 22 bp, Homo sapiens
agcctcagcatcctggcacccg

SEQ ID NO: 4708853 - DNA, 22 bp, Homo sapiens
agcctcagtctccctcccttgg

SEQ ID NO: 4708854 - DNA, 18 bp, Homo sapiens
agcctcccaaagtgctgg

SEQ ID NO: 4708855 - DNA, 19 bp, Homo sapiens
agcctcccaaagtgctggg

SEQ ID NO: 4708856 - DNA, 19 bp, Homo sapiens
agcctcccctgccagggca

SEQ ID NO: 4708857 - DNA, 19 bp, Homo sapiens
agcctcccgaatagctggg

SEQ ID NO: 4708858 - DNA, 17 bp, Homo sapiens
agcctcccgagtagctg

SEQ ID NO: 4708859 - DNA, 20 bp, Homo sapiens
agcctcccgagtagctggga

SEQ ID NO: 4708860 - DNA, 21 bp, Homo sapiens
agcctctagggacccctcctc

SEQ ID NO: 4708861 - DNA, 13 bp, Homo sapiens
agcctctctttgt

SEQ ID NO: 4708862 - DNA, 14 bp, Homo sapiens
agcctctctttgtt

SEQ ID NO: 4708863 - DNA, 15 bp, Homo sapiens
agcctctgtgtcact

SEQ ID NO: 4708864 - DNA, 18 bp, Homo sapiens
agcctctgtgtcactggc

SEQ ID NO: 4708865 - DNA, 21 bp, Homo sapiens
agcctctgtgtcactggctgc

SEQ ID NO: 4708866 - DNA, 18 bp, Homo sapiens
agcctgacaacagcctga

SEQ ID NO: 4708867 - DNA, 14 bp, Homo sapiens
agcctgagaatgac

SEQ ID NO: 4708868 - DNA, 17 bp, Homo sapiens
agcctgagaatgacctg

SEQ ID NO: 4708869 - DNA, 23 bp, Homo sapiens
agcctgcagttattaacactaac

SEQ ID NO: 4708870 - DNA, 21 bp, Homo sapiens
agcctggaacatcatcaaggc

SEQ ID NO: 4708871 - DNA, 16 bp, Homo sapiens
agcctggcccagctcc

SEQ ID NO: 4708872 - DNA, 20 bp, Homo sapiens
agcctggctccaaaccctcg

SEQ ID NO: 4708873 - DNA, 19 bp, Homo sapiens
agcctgggtgacaaagcga

SEQ ID NO: 4708874 - DNA, 11 bp, Homo sapiens
agcctggtgcc

SEQ ID NO: 4708875 - DNA, 22 bp, Homo sapiens
agccttagaagtcacacagtat

SEQ ID NO: 4708876 - DNA, 20 bp, Homo sapiens
agccttataaaccaatctta

SEQ ID NO: 4708877 - DNA, 17 bp, Homo sapiens
agccttccaggggtggg

SEQ ID NO: 4708878 - DNA, 22 bp, Homo sapiens
agccttgaccattctccacctg

SEQ ID NO: 4708879 - DNA, 16 bp, Homo sapiens
agccttgggacccctg

SEQ ID NO: 4708880 - DNA, 22 bp, Homo sapiens
agcctttaccctcctctatttc

SEQ ID NO: 4708881 - DNA, 23 bp, Homo sapiens
agcctttaccctcctctatttct

SEQ ID NO: 4708882 - DNA, 13 bp, Homo sapiens
agcgagccctggt

SEQ ID NO: 4708883 - DNA, 19 bp, Homo sapiens
agcgaggaggctccagagg

SEQ ID NO: 4708884 - DNA, 15 bp, Homo sapiens
agcgattcttctgct

SEQ ID NO: 4708885 - DNA, 20 bp, Homo sapiens
agcgcccactagacccactg

SEQ ID NO: 4708886 - DNA, 22 bp, Homo sapiens
agcgcccagttgggtggatgcc

SEQ ID NO: 4708887 - DNA, 15 bp, Homo sapiens
agcgctagtggaggg

SEQ ID NO: 4708888 - DNA, 21 bp, Homo sapiens
agcgcttctttctgactctaa

SEQ ID NO: 4708889 - DNA, 22 bp, Homo sapiens
agcgcttctttctgactctaaa

SEQ ID NO: 4708890 - DNA, 16 bp, Homo sapiens
agcggggacagctcct

SEQ ID NO: 4708891 - DNA, 20 bp, Homo sapiens
agcggggacagctccttctg

SEQ ID NO: 4708892 - DNA, 18 bp, Homo sapiens
agcgggggcctaaaaaaa

SEQ ID NO: 4708893 - DNA, 16 bp, Homo sapiens
agcgtcctcctctgtg

SEQ ID NO: 4708894 - DNA, 17 bp, Homo sapiens
agcgtgctttaaaaaat

SEQ ID NO: 4708895 - DNA, 13 bp, Homo sapiens
agctaaaagacaa

SEQ ID NO: 4708896 - DNA, 22 bp, Homo sapiens
atgacagccaccctcaccgcgg

SEQ ID NO: 4708897 - DNA, 16 bp, Homo sapiens
atgacattcatgcctg

SEQ ID NO: 4708898 - DNA, 17 bp, Homo sapiens
atgacattcatgcctgg

SEQ ID NO: 4708899 - DNA, 17 bp, Homo sapiens
atgacattttgccaaaa

SEQ ID NO: 4708900 - DNA, 16 bp, Homo sapiens
atgacccaggctgggc

SEQ ID NO: 4708901 - DNA, 13 bp, Homo sapiens
atgacctgccctg

SEQ ID NO: 4708902 - DNA, 14 bp, Homo sapiens
atgacctgccctgg

SEQ ID NO: 4708903 - DNA, 23 bp, Homo sapiens
atgacgagacctcagatgtgttg

SEQ ID NO: 4708904 - DNA, 22 bp, Homo sapiens
atgactccactgtttttctcta

SEQ ID NO: 4708905 - DNA, 14 bp, Homo sapiens
atgactccaggaag

SEQ ID NO: 4708906 - DNA, 17 bp, Homo sapiens
atgactgtagaatttgt

SEQ ID NO: 4708907 - DNA, 18 bp, Homo sapiens
atgactgttgttcttata

SEQ ID NO: 4708908 - DNA, 21 bp, Homo sapiens
atgactgttgttcttataaga

SEQ ID NO: 4708909 - DNA, 15 bp, Homo sapiens
atgagaagtactttg

SEQ ID NO: 4708910 - DNA, 16 bp, Homo sapiens
atgagaagtactttgt

SEQ ID NO: 4708911 - DNA, 22 bp, Homo sapiens
atgagactatgtaaaaataacc

SEQ ID NO: 4708912 - DNA, 20 bp, Homo sapiens
atgagagcataatttaaaaa

SEQ ID NO: 4708913 - DNA, 18 bp, Homo sapiens
atgagagcccagaggtaa

SEQ ID NO: 4708914 - DNA, 22 bp, Homo sapiens
atgagcatcaggccaggccctc

SEQ ID NO: 4708915 - DNA, 18 bp, Homo sapiens
atgagcatgcattttctt

SEQ ID NO: 4708916 - DNA, 15 bp, Homo sapiens
atgagcatggagctg

SEQ ID NO: 4708917 - DNA, 18 bp, Homo sapiens
atgagcatggagctggcc

SEQ ID NO: 4708918 - DNA, 21 bp, Homo sapiens
atgagcctcagcatcctggca

SEQ ID NO: 4708919 - DNA, 13 bp, Homo sapiens
atgaggcagagga

SEQ ID NO: 4708920 - DNA, 14 bp, Homo sapiens
atgaggcatttggc

SEQ ID NO: 4708921 - DNA, 15 bp, Homo sapiens
atgaggccctccaca

SEQ ID NO: 4708922 - DNA, 15 bp, Homo sapiens
atgagggttcatcat

SEQ ID NO: 4708923 - DNA, 22 bp, Homo sapiens
atgagggttcatcatccctccc

SEQ ID NO: 4708924 - DNA, 21 bp, Homo sapiens
atgaggtacaacctgttctgc

SEQ ID NO: 4708925 - DNA, 13 bp, Homo sapiens
atgagtatttggt

SEQ ID NO: 4708926 - DNA, 15 bp, Homo sapiens
atgataaaaaagtgt

SEQ ID NO: 4708927 - DNA, 12 bp, Homo sapiens
atgataaattat

SEQ ID NO: 4708928 - DNA, 19 bp, Homo sapiens
atgatcacggctcactgca

SEQ ID NO: 4708929 - DNA, 15 bp, Homo sapiens
atgatcagttttttt

SEQ ID NO: 4708930 - DNA, 15 bp, Homo sapiens
atgatcctaatgaat

SEQ ID NO: 4708931 - DNA, 12 bp, Homo sapiens
atgatgccacac

SEQ ID NO: 4708932 - DNA, 16 bp, Homo sapiens
atgatgtgcctgggtg

SEQ ID NO: 4708933 - DNA, 24 bp, Homo sapiens
atgatgttttccatgagtcccctg

SEQ ID NO: 4708934 - DNA, 23 bp, Homo sapiens
atgattagaaattacctgtggat

SEQ ID NO: 4708935 - DNA, 16 bp, Homo sapiens
atgattcagtgttaaa

SEQ ID NO: 4708936 - DNA, 13 bp, Homo sapiens
atgatttaataaa

SEQ ID NO: 4708937 - DNA, 14 bp, Homo sapiens
atgatttaataaaa

SEQ ID NO: 4708938 - DNA, 19 bp, Homo sapiens
atgatttaataaaataatt

SEQ ID NO: 4708939 - DNA, 18 bp, Homo sapiens
atgattttgatgcacaac

SEQ ID NO: 4708940 - DNA, 14 bp, Homo sapiens
atgatttttgtgta

SEQ ID NO: 4708941 - DNA, 23 bp, Homo sapiens
atgcaaaagtacaagggctgaga

SEQ ID NO: 4708942 - DNA, 14 bp, Homo sapiens
atgcaaaggctggg

SEQ ID NO: 4708943 - DNA, 20 bp, Homo sapiens
atgcaactcgccctgtttgg

SEQ ID NO: 4708944 - DNA, 23 bp, Homo sapiens
atgcaactcgccctgtttggcat

SEQ ID NO: 4708945 - DNA, 17 bp, Homo sapiens
atgcaagattgttttca

SEQ ID NO: 4708946 - DNA, 20 bp, Homo sapiens
atgcaagtgggagatgaaaa

SEQ ID NO: 4708947 - DNA, 21 bp, Homo sapiens
atgcaagtgggagatgaaaac

SEQ ID NO: 4708948 - DNA, 23 bp, Homo sapiens
atgcacacttttaattttgtcag

SEQ ID NO: 4708949 - DNA, 14 bp, Homo sapiens
atgcaccagccctt

SEQ ID NO: 4708950 - DNA, 16 bp, Homo sapiens
atgcacgaccttggga

SEQ ID NO: 4708951 - DNA, 19 bp, Homo sapiens
atgcacttataattttcct

SEQ ID NO: 4708952 - DNA, 17 bp, Homo sapiens
atgcactttgttctggc

SEQ ID NO: 4708953 - DNA, 20 bp, Homo sapiens
atgcactttgttctggctct

SEQ ID NO: 4708954 - DNA, 14 bp, Homo sapiens
atgcagagagccat

SEQ ID NO: 4708955 - DNA, 16 bp, Homo sapiens
atgcagagagccattt

SEQ ID NO: 4708956 - DNA, 23 bp, Homo sapiens
atgcagagagccattttgtgaat

SEQ ID NO: 4708957 - DNA, 13 bp, Homo sapiens
atgcagcctcaca

SEQ ID NO: 4708958 - DNA, 15 bp, Homo sapiens
atgcagcctcacagt

SEQ ID NO: 4708959 - DNA, 17 bp, Homo sapiens
atgcagcctcacagtcc

SEQ ID NO: 4708960 - DNA, 19 bp, Homo sapiens
atgcagggcctcacacggt

SEQ ID NO: 4708961 - DNA, 21 bp, Homo sapiens
atgcaggtctccatgaagaag

SEQ ID NO: 4708962 - DNA, 23 bp, Homo sapiens
atgcaggtttgaccaggaaagca

SEQ ID NO: 4708963 - DNA, 17 bp, Homo sapiens
atgcagtagcactttgg

SEQ ID NO: 4708964 - DNA, 23 bp, Homo sapiens
atgcagtgatatggcagaagaca

SEQ ID NO: 4708965 - DNA, 16 bp, Homo sapiens
atgcataaatatgcag

SEQ ID NO: 4708966 - DNA, 17 bp, Homo sapiens
atgcatgcactgttccc

SEQ ID NO: 4708967 - DNA, 12 bp, Homo sapiens
atgcatggaaat

SEQ ID NO: 4708968 - DNA, 13 bp, Homo sapiens
atgcattcatgtt

SEQ ID NO: 4708969 - DNA, 19 bp, Homo sapiens
atgccaagcactgtgctca

SEQ ID NO: 4708970 - DNA, 16 bp, Homo sapiens
atgccactatgagctt

SEQ ID NO: 4708971 - DNA, 14 bp, Homo sapiens
atgccatcatctcc

SEQ ID NO: 4708972 - DNA, 12 bp, Homo sapiens
atgccatcctca

SEQ ID NO: 4708973 - DNA, 15 bp, Homo sapiens
atatttactatttca

SEQ ID NO: 4708974 - DNA, 18 bp, Homo sapiens
atatttatgtatcttgat

SEQ ID NO: 4708975 - DNA, 23 bp, Homo sapiens
atatttatgtatcttgatgttca

SEQ ID NO: 4708976 - DNA, 12 bp, Homo sapiens
atatttattgaa

SEQ ID NO: 4708977 - DNA, 23 bp, Homo sapiens
atatttccttcaccacctcatgt

SEQ ID NO: 4708978 - DNA, 21 bp, Homo sapiens
atatttctacagagaaaatga

SEQ ID NO: 4708979 - DNA, 18 bp, Homo sapiens
atatttgcatatttttct

SEQ ID NO: 4708980 - DNA, 21 bp, Homo sapiens
atatttggtttctagatcact

SEQ ID NO: 4708981 - DNA, 12 bp, Homo sapiens
atattttacatc

SEQ ID NO: 4708982 - DNA, 15 bp, Homo sapiens
atattttacatctga

SEQ ID NO: 4708983 - DNA, 21 bp, Homo sapiens
atattttctttaaaagacaaa

SEQ ID NO: 4708984 - DNA, 18 bp, Homo sapiens
atatttttctaaagaaat

SEQ ID NO: 4708985 - DNA, 16 bp, Homo sapiens
atcaaaagaaatagaa

SEQ ID NO: 4708986 - DNA, 14 bp, Homo sapiens
atcaaaatagtcta

SEQ ID NO: 4708987 - DNA, 17 bp, Homo sapiens
atcaaacatgaaaacat

SEQ ID NO: 4708988 - DNA, 12 bp, Homo sapiens
atcaaaggacac

SEQ ID NO: 4708989 - DNA, 13 bp, Homo sapiens
atcaacatctttt

SEQ ID NO: 4708990 - DNA, 15 bp, Homo sapiens
atcaacatcttttct

SEQ ID NO: 4708991 - DNA, 22 bp, Homo sapiens
atcaaccccttcgctcctgtgt

SEQ ID NO: 4708992 - DNA, 14 bp, Homo sapiens
atcaaggcactgcc

SEQ ID NO: 4708993 - DNA, 18 bp, Homo sapiens
atcaagggaagaactatt

SEQ ID NO: 4708994 - DNA, 20 bp, Homo sapiens
atcaatcacagcttgtattt

SEQ ID NO: 4708995 - DNA, 23 bp, Homo sapiens
atcaatggaaaaaaataaacttt

SEQ ID NO: 4708996 - DNA, 15 bp, Homo sapiens
atcacaaaagctgtg

SEQ ID NO: 4708997 - DNA, 24 bp, Homo sapiens
atcacaaagtggaacgaaaatgaa

SEQ ID NO: 4708998 - DNA, 20 bp, Homo sapiens
atcaccaacgtctgtgccat

SEQ ID NO: 4708999 - DNA, 19 bp, Homo sapiens
atcaccgtgggctccctga

SEQ ID NO: 4709000 - DNA, 19 bp, Homo sapiens
atcaccttccaaacaaaag

SEQ ID NO: 4709001 - DNA, 14 bp, Homo sapiens
atcacgtaaagcta

SEQ ID NO: 4709002 - DNA, 21 bp, Homo sapiens
atcacgtaaagctagaaatga

SEQ ID NO: 4709003 - DNA, 13 bp, Homo sapiens
atcactcccctcc

SEQ ID NO: 4709004 - DNA, 14 bp, Homo sapiens
atcactgaactttg

SEQ ID NO: 4709005 - DNA, 16 bp, Homo sapiens
atcactgagccatcat

SEQ ID NO: 4709006 - DNA, 18 bp, Homo sapiens
atcactgagccatcattt

SEQ ID NO: 4709007 - DNA, 12 bp, Homo sapiens
atcactgtatcc

SEQ ID NO: 4709008 - DNA, 19 bp, Homo sapiens
atcagaatatcagaatatg

SEQ ID NO: 4709009 - DNA, 19 bp, Homo sapiens
atcagactaagccagcacc

SEQ ID NO: 4709010 - DNA, 23 bp, Homo sapiens
atcagcaacaaccagcatccctt

SEQ ID NO: 4709011 - DNA, 16 bp, Homo sapiens
atcagcccttgggggt

SEQ ID NO: 4709012 - DNA, 18 bp, Homo sapiens
atcaggagttccagtgct

SEQ ID NO: 4709013 - DNA, 16 bp, Homo sapiens
atcaggccaggccctc

SEQ ID NO: 4709014 - DNA, 21 bp, Homo sapiens
atcaggccaggccctctgccc

SEQ ID NO: 4709015 - DNA, 17 bp, Homo sapiens
atcagtgccagcccctg

SEQ ID NO: 4709016 - DNA, 14 bp, Homo sapiens
atcagtgtgccccc

SEQ ID NO: 4709017 - DNA, 14 bp, Homo sapiens
atcagtgtgttact

SEQ ID NO: 4709018 - DNA, 19 bp, Homo sapiens
atcagtgtgttactatcta

SEQ ID NO: 4709019 - DNA, 13 bp, Homo sapiens
atcagttctcaat

SEQ ID NO: 4709020 - DNA, 18 bp, Homo sapiens
atcataacatagttgaaa

SEQ ID NO: 4709021 - DNA, 20 bp, Homo sapiens
atcataacatagttgaaaaa

SEQ ID NO: 4709022 - DNA, 23 bp, Homo sapiens
atcatagtggcttaaaacaacac

SEQ ID NO: 4709023 - DNA, 21 bp, Homo sapiens
atcatagtttgctttgtttaa

SEQ ID NO: 4709024 - DNA, 14 bp, Homo sapiens
atcatcaaaaagaa

SEQ ID NO: 4709025 - DNA, 15 bp, Homo sapiens
atcatcaaaaagaaa

SEQ ID NO: 4709026 - DNA, 22 bp, Homo sapiens
atcatccctccctgcctaagga

SEQ ID NO: 4709027 - DNA, 16 bp, Homo sapiens
atcatggtgtaataag

SEQ ID NO: 4709028 - DNA, 13 bp, Homo sapiens
atcattaaaggaa

SEQ ID NO: 4709029 - DNA, 21 bp, Homo sapiens
atcattcatccaggactgaga

SEQ ID NO: 4709030 - DNA, 12 bp, Homo sapiens
atcattctctgt

SEQ ID NO: 4709031 - DNA, 21 bp, Homo sapiens
atcattctctgtctcatccat

SEQ ID NO: 4709032 - DNA, 17 bp, Homo sapiens
atcattgtattaacgca

SEQ ID NO: 4709033 - DNA, 21 bp, Homo sapiens
atcattgtattaacgcaaata

SEQ ID NO: 4709034 - DNA, 15 bp, Homo sapiens
atcatttctatttct

SEQ ID NO: 4709035 - DNA, 12 bp, Homo sapiens
atcatttgtgaa

SEQ ID NO: 4709036 - DNA, 13 bp, Homo sapiens
atcatttgtgaag

SEQ ID NO: 4709037 - DNA, 14 bp, Homo sapiens
atcatttgtgaaga

SEQ ID NO: 4709038 - DNA, 21 bp, Homo sapiens
atccaaatatcatataaacat

SEQ ID NO: 4709039 - DNA, 22 bp, Homo sapiens
atccaaatgctgtgcaaacagt

SEQ ID NO: 4709040 - DNA, 19 bp, Homo sapiens
atccaagatattttaaaat

SEQ ID NO: 4709041 - DNA, 21 bp, Homo sapiens
atccaagctggtcccactcag

SEQ ID NO: 4709042 - DNA, 19 bp, Homo sapiens
atccaataattttcctgtg

SEQ ID NO: 4709043 - DNA, 20 bp, Homo sapiens
atccaataattttcctgtga

SEQ ID NO: 4709044 - DNA, 20 bp, Homo sapiens
atccacagaactagccttat

SEQ ID NO: 4709045 - DNA, 18 bp, Homo sapiens
atccacccacctcagcct

SEQ ID NO: 4709046 - DNA, 15 bp, Homo sapiens
atccagacccggctg

SEQ ID NO: 4709047 - DNA, 19 bp, Homo sapiens
atccagacccggctgcgtg

SEQ ID NO: 4709048 - DNA, 15 bp, Homo sapiens
atccaggactgagat

SEQ ID NO: 4709049 - DNA, 19 bp, Homo sapiens
atccagggctctgaccagt

SEQ ID NO: 4709050 - DNA, 16 bp, Homo sapiens
atccaggttcagcttg

SEQ ID NO: 4709051 - DNA, 14 bp, Homo sapiens
atccatcatcatgt

SEQ ID NO: 4709052 - DNA, 18 bp, Homo sapiens
atccatcatcatgtgtgt

SEQ ID NO: 4709053 - DNA, 23 bp, Homo sapiens
atccattatgactgttgttctta

SEQ ID NO: 4709054 - DNA, 23 bp, Homo sapiens
atccatttgcgttccatgatgct

SEQ ID NO: 4709055 - DNA, 17 bp, Homo sapiens
atcttgactacagtcag

SEQ ID NO: 4709056 - DNA, 19 bp, Homo sapiens
atcttggatggtgacattg

SEQ ID NO: 4709057 - DNA, 23 bp, Homo sapiens
atcttggcacatttaagagacag

SEQ ID NO: 4709058 - DNA, 15 bp, Homo sapiens
atctttataaatgta

SEQ ID NO: 4709059 - DNA, 13 bp, Homo sapiens
atctttcttgatc

SEQ ID NO: 4709060 - DNA, 16 bp, Homo sapiens
atctttgattctcctt

SEQ ID NO: 4709061 - DNA, 18 bp, Homo sapiens
atctttgattctccttca

SEQ ID NO: 4709062 - DNA, 17 bp, Homo sapiens
atctttgccaacatggt

SEQ ID NO: 4709063 - DNA, 14 bp, Homo sapiens
atctttgccaccct

SEQ ID NO: 4709064 - DNA, 15 bp, Homo sapiens
atctttgccaccctc

SEQ ID NO: 4709065 - DNA, 23 bp, Homo sapiens
atctttggacagaagcagctctt

SEQ ID NO: 4709066 - DNA, 17 bp, Homo sapiens
atcttttcacaaataaa

SEQ ID NO: 4709067 - DNA, 13 bp, Homo sapiens
atgaaaacattga

SEQ ID NO: 4709068 - DNA, 14 bp, Homo sapiens
atgaaaacattgat

SEQ ID NO: 4709069 - DNA, 14 bp, Homo sapiens
atgaaaataaagaa

SEQ ID NO: 4709070 - DNA, 17 bp, Homo sapiens
atgaaaataaagaatgg

SEQ ID NO: 4709071 - DNA, 18 bp, Homo sapiens
atgaaaatttgtttgaca

SEQ ID NO: 4709072 - DNA, 22 bp, Homo sapiens
atgaaactgtcataatggtgaa

SEQ ID NO: 4709073 - DNA, 19 bp, Homo sapiens
atgaaagggcccagagagg

SEQ ID NO: 4709074 - DNA, 14 bp, Homo sapiens
atgaaatgaggtca

SEQ ID NO: 4709075 - DNA, 20 bp, Homo sapiens
atgaacattagaaaaatagc

SEQ ID NO: 4709076 - DNA, 22 bp, Homo sapiens
atgaaccacatcttgctctgct

SEQ ID NO: 4709077 - DNA, 23 bp, Homo sapiens
atgaaccacatcttgctctgctg

SEQ ID NO: 4709078 - DNA, 13 bp, Homo sapiens
atgaaccttgcta

SEQ ID NO: 4709079 - DNA, 15 bp, Homo sapiens
atgaagacagaggca

SEQ ID NO: 4709080 - DNA, 15 bp, Homo sapiens
atgaagccttctgac

SEQ ID NO: 4709081 - DNA, 17 bp, Homo sapiens
atgaaggtttctgaaaa

SEQ ID NO: 4709082 - DNA, 18 bp, Homo sapiens
atgaagtcgttgtgaggg

SEQ ID NO: 4709083 - DNA, 15 bp, Homo sapiens
atgaataaaataatt

SEQ ID NO: 4709084 - DNA, 14 bp, Homo sapiens
atgaatttgactgg

SEQ ID NO: 4709085 - DNA, 15 bp, Homo sapiens
atgacagatatattt

SEQ ID NO: 4709086 - DNA, 21 bp, Homo sapiens
atgacagatatatttaagcct

SEQ ID NO: 4709087 - DNA, 18 bp, Homo sapiens
agttgctcacatgtcttt

SEQ ID NO: 4709088 - DNA, 13 bp, Homo sapiens
agttggtccccct

SEQ ID NO: 4709089 - DNA, 21 bp, Homo sapiens
agttggtcttactttgtgcaa

SEQ ID NO: 4709090 - DNA, 16 bp, Homo sapiens
agttgtataaaaacat

SEQ ID NO: 4709091 - DNA, 13 bp, Homo sapiens
agttgtctttctt

SEQ ID NO: 4709092 - DNA, 14 bp, Homo sapiens
agttgtgtttcaac

SEQ ID NO: 4709093 - DNA, 23 bp, Homo sapiens
agttgttaataaaagtacatgtt

SEQ ID NO: 4709094 - DNA, 15 bp, Homo sapiens
agtttactgatgaaa

SEQ ID NO: 4709095 - DNA, 16 bp, Homo sapiens
agtttattataatggt

SEQ ID NO: 4709096 - DNA, 20 bp, Homo sapiens
agtttcacagactcttacca

SEQ ID NO: 4709097 - DNA, 14 bp, Homo sapiens
agtttcaggtgaca

SEQ ID NO: 4709098 - DNA, 15 bp, Homo sapiens
agtttcaggtgacat

SEQ ID NO: 4709099 - DNA, 18 bp, Homo sapiens
agtttcaggtgacatgtg

SEQ ID NO: 4709100 - DNA, 17 bp, Homo sapiens
agtttccttggctggtg

SEQ ID NO: 4709101 - DNA, 18 bp, Homo sapiens
agtttccttggctggtgc

SEQ ID NO: 4709102 - DNA, 14 bp, Homo sapiens
agtttcttagcttt

SEQ ID NO: 4709103 - DNA, 15 bp, Homo sapiens
agtttcttctgtaaa

SEQ ID NO: 4709104 - DNA, 20 bp, Homo sapiens
agtttgatacagtattgaaa

SEQ ID NO: 4709105 - DNA, 17 bp, Homo sapiens
agtttgatgaggccctc

SEQ ID NO: 4709106 - DNA, 13 bp, Homo sapiens
agttttaactgtg

SEQ ID NO: 4709107 - DNA, 15 bp, Homo sapiens
agttttatttaactt

SEQ ID NO: 4709108 - DNA, 20 bp, Homo sapiens
agttttcttatatatatatt

SEQ ID NO: 4709109 - DNA, 17 bp, Homo sapiens
agttttgaaaagctatt

SEQ ID NO: 4709110 - DNA, 12 bp, Homo sapiens
agttttgtaaat

SEQ ID NO: 4709111 - DNA, 13 bp, Homo sapiens
agttttgttctgt

SEQ ID NO: 4709112 - DNA, 19 bp, Homo sapiens
agttttgttcttttataga

SEQ ID NO: 4709113 - DNA, 17 bp, Homo sapiens
agtttttaaaatatctt

SEQ ID NO: 4709114 - DNA, 23 bp, Homo sapiens
agtttttatggttccaatgaaat

SEQ ID NO: 4709115 - DNA, 23 bp, Homo sapiens
agtttttttttatacactgtaat

SEQ ID NO: 4709116 - DNA, 13 bp, Homo sapiens
ataaaacattaat

SEQ ID NO: 4709117 - DNA, 15 bp, Homo sapiens
ataaaagacagtgaa

SEQ ID NO: 4709118 - DNA, 15 bp, Homo sapiens
ataaaagtacatgtt

SEQ ID NO: 4709119 - DNA, 17 bp, Homo sapiens
ataaaatatatcttata

SEQ ID NO: 4709120 - DNA, 16 bp, Homo sapiens
ataaaattaaagctga

SEQ ID NO: 4709121 - DNA, 17 bp, Homo sapiens
ataaacagaaatgctct

SEQ ID NO: 4709122 - DNA, 15 bp, Homo sapiens
ataaacattttattt

SEQ ID NO: 4709123 - DNA, 12 bp, Homo sapiens
ataaaccaatct

SEQ ID NO: 4709124 - DNA, 21 bp, Homo sapiens
ataaacccagttgccatctgc

SEQ ID NO: 4709125 - DNA, 18 bp, Homo sapiens
ataaacctctaatttatt

SEQ ID NO: 4709126 - DNA, 20 bp, Homo sapiens
ataaacctctaatttatttt

SEQ ID NO: 4709127 - DNA, 22 bp, Homo sapiens
ataaacctctaatttattttgt

SEQ ID NO: 4709128 - DNA, 14 bp, Homo sapiens
ataaactttcaaat

SEQ ID NO: 4709129 - DNA, 15 bp, Homo sapiens
ataaagagaaaatga

SEQ ID NO: 4709130 - DNA, 21 bp, Homo sapiens
ataaagagagaaaaacaaatt

SEQ ID NO: 4709131 - DNA, 13 bp, Homo sapiens
ataaagattaaca

SEQ ID NO: 4709132 - DNA, 14 bp, Homo sapiens
ataaaggataaaga

SEQ ID NO: 4709133 - DNA, 18 bp, Homo sapiens
ataaaggattaatgtcaa

SEQ ID NO: 4709134 - DNA, 12 bp, Homo sapiens
ataaaggcctgc

SEQ ID NO: 4709135 - DNA, 20 bp, Homo sapiens
ataaagggaacatgcagctc

SEQ ID NO: 4709136 - DNA, 16 bp, Homo sapiens
ataaagtaaatacatg

SEQ ID NO: 4709137 - DNA, 15 bp, Homo sapiens
ataaagttctgtact

SEQ ID NO: 4709138 - DNA, 13 bp, Homo sapiens
ataaatatgcagt

SEQ ID NO: 4709139 - DNA, 20 bp, Homo sapiens
ataaatcaattcatgtttaa

SEQ ID NO: 4709140 - DNA, 21 bp, Homo sapiens
ataaatcattcttactaaaaa

SEQ ID NO: 4709141 - DNA, 13 bp, Homo sapiens
ataaattaataca

SEQ ID NO: 4709142 - DNA, 13 bp, Homo sapiens
ataacaatgttaa

SEQ ID NO: 4709143 - DNA, 16 bp, Homo sapiens
ataacaatgttaagga

SEQ ID NO: 4709144 - DNA, 15 bp, Homo sapiens
ataacaattcctcta

SEQ ID NO: 4709145 - DNA, 12 bp, Homo sapiens
ataacagcactg

SEQ ID NO: 4709146 - DNA, 12 bp, Homo sapiens
ataacatagttg

SEQ ID NO: 4709147 - DNA, 17 bp, Homo sapiens
ataacattttgtttatg

SEQ ID NO: 4709148 - DNA, 22 bp, Homo sapiens
ataacgataaaagacagtgaaa

SEQ ID NO: 4709149 - DNA, 13 bp, Homo sapiens
ataacgtttttcc

SEQ ID NO: 4709150 - DNA, 18 bp, Homo sapiens
ataacgtttttcctttaa

SEQ ID NO: 4709151 - DNA, 14 bp, Homo sapiens
ataacttattagca

SEQ ID NO: 4709152 - DNA, 21 bp, Homo sapiens
ataactttttttcaatttttt

SEQ ID NO: 4709153 - DNA, 17 bp, Homo sapiens
ataagagggcacacact

SEQ ID NO: 4709154 - DNA, 15 bp, Homo sapiens
ataagatttttgaaa

SEQ ID NO: 4709155 - DNA, 12 bp, Homo sapiens
ataagctatttt

SEQ ID NO: 4709156 - DNA, 13 bp, Homo sapiens
ataagggcagagt

SEQ ID NO: 4709157 - DNA, 16 bp, Homo sapiens
ataagtatttcaaatt

SEQ ID NO: 4709158 - DNA, 11 bp, Homo sapiens
ataataaaaat

SEQ ID NO: 4709159 - DNA, 19 bp, Homo sapiens
ataataaaaatatattttc

SEQ ID NO: 4709160 - DNA, 18 bp, Homo sapiens
ataataaatcacacattc

SEQ ID NO: 4709161 - DNA, 19 bp, Homo sapiens
ataataaatcacacattca

SEQ ID NO: 4709162 - DNA, 13 bp, Homo sapiens
ataatagactgta

SEQ ID NO: 4709163 - DNA, 18 bp, Homo sapiens
ataatcctaaacatatga

SEQ ID NO: 4709164 - DNA, 15 bp, Homo sapiens
ataatcttttacatt

SEQ ID NO: 4709165 - DNA, 18 bp, Homo sapiens
ataatgggcttagagcag

SEQ ID NO: 4709166 - DNA, 15 bp, Homo sapiens
ataatgtaaataaag

SEQ ID NO: 4709167 - DNA, 11 bp, Homo sapiens
ataatgtctct

SEQ ID NO: 4709168 - DNA, 16 bp, Homo sapiens
ataatgttaaatttgt

SEQ ID NO: 4709169 - DNA, 22 bp, Homo sapiens
ataatgttaaatttgtaagttt

SEQ ID NO: 4709170 - DNA, 21 bp, Homo sapiens
ataattaaacttcttttctct

SEQ ID NO: 4709171 - DNA, 21 bp, Homo sapiens
ataattcttagtggaagacaa

SEQ ID NO: 4709172 - DNA, 19 bp, Homo sapiens
ataattgagttttcagtgg

SEQ ID NO: 4709173 - DNA, 12 bp, Homo sapiens
ataatttcacag

SEQ ID NO: 4709174 - DNA, 21 bp, Homo sapiens
ataatttcatactgaaattat

SEQ ID NO: 4709175 - DNA, 16 bp, Homo sapiens
ataattttaaagtaat

SEQ ID NO: 4709176 - DNA, 22 bp, Homo sapiens
ataattttagtttatattaatt

SEQ ID NO: 4709177 - DNA, 13 bp, Homo sapiens
ataattttattag

SEQ ID NO: 4709178 - DNA, 19 bp, Homo sapiens
ataattttattagaataat

SEQ ID NO: 4709179 - DNA, 18 bp, Homo sapiens
ataattttgtgttgtaca

SEQ ID NO: 4709180 - DNA, 12 bp, Homo sapiens
atacactaatga

SEQ ID NO: 4709181 - DNA, 19 bp, Homo sapiens
atacacttggagtttgcat

SEQ ID NO: 4709182 - DNA, 21 bp, Homo sapiens
atacacttggagtttgcattc

SEQ ID NO: 4709183 - DNA, 18 bp, Homo sapiens
atacagagctctctgagg

SEQ ID NO: 4709184 - DNA, 14 bp, Homo sapiens
atacagatttgtaa

SEQ ID NO: 4709185 - DNA, 19 bp, Homo sapiens
atacagatttgtaacatta

SEQ ID NO: 4709186 - DNA, 19 bp, Homo sapiens
atacaggaaaagctgctga

SEQ ID NO: 4709187 - DNA, 17 bp, Homo sapiens
atacaggattattttga

SEQ ID NO: 4709188 - DNA, 16 bp, Homo sapiens
atacagtattgaaaaa

SEQ ID NO: 4709189 - DNA, 15 bp, Homo sapiens
atacagtcaacaagc

SEQ ID NO: 4709190 - DNA, 20 bp, Homo sapiens
atacagtcttccatttgcaa

SEQ ID NO: 4709191 - DNA, 14 bp, Homo sapiens
atacataaaagaaa

SEQ ID NO: 4709192 - DNA, 19 bp, Homo sapiens
atacatataaagattaaca

SEQ ID NO: 4709193 - DNA, 21 bp, Homo sapiens
atacatgcatataatgaataa

SEQ ID NO: 4709194 - DNA, 22 bp, Homo sapiens
atacatggtagccagttgaatt

SEQ ID NO: 4709195 - DNA, 16 bp, Homo sapiens
atacattgtctctaaa

SEQ ID NO: 4709196 - DNA, 16 bp, Homo sapiens
atacccacccccaccc

SEQ ID NO: 4709197 - DNA, 12 bp, Homo sapiens
atacctgtcccc

SEQ ID NO: 4709198 - DNA, 13 bp, Homo sapiens
atacctgtccccc

SEQ ID NO: 4709199 - DNA, 14 bp, Homo sapiens
agtgacagaggcag

SEQ ID NO: 4709200 - DNA, 19 bp, Homo sapiens
agtgacagaggcagcccca

SEQ ID NO: 4709201 - DNA, 17 bp, Homo sapiens
agtgactgttcaagagc

SEQ ID NO: 4709202 - DNA, 20 bp, Homo sapiens
agtgactgttcaagagcaca

SEQ ID NO: 4709203 - DNA, 18 bp, Homo sapiens
agtgactttggctgcatg

SEQ ID NO: 4709204 - DNA, 18 bp, Homo sapiens
agtgagaagggctcagag

SEQ ID NO: 4709205 - DNA, 21 bp, Homo sapiens
agtgagacccagccctcatcc

SEQ ID NO: 4709206 - DNA, 18 bp, Homo sapiens
agtgagactccacctcaa

SEQ ID NO: 4709207 - DNA, 14 bp, Homo sapiens
agtgagcactaagg

SEQ ID NO: 4709208 - DNA, 16 bp, Homo sapiens
agtgaggctctgccct

SEQ ID NO: 4709209 - DNA, 12 bp, Homo sapiens
agtgagtggcat

SEQ ID NO: 4709210 - DNA, 14 bp, Homo sapiens
agtgagtggcatgt

SEQ ID NO: 4709211 - DNA, 17 bp, Homo sapiens
agtgagtggtgttggca

SEQ ID NO: 4709212 - DNA, 23 bp, Homo sapiens
agtgagttgatagcacagaccct

SEQ ID NO: 4709213 - DNA, 22 bp, Homo sapiens
agtgatatggcagaagacacca

SEQ ID NO: 4709214 - DNA, 14 bp, Homo sapiens
agtgatcacagcag

SEQ ID NO: 4709215 - DNA, 14 bp, Homo sapiens
agtgatcctcccac

SEQ ID NO: 4709216 - DNA, 18 bp, Homo sapiens
agtgatcctcccacctca

SEQ ID NO: 4709217 - DNA, 20 bp, Homo sapiens
agtgatcctcccacctcagc

SEQ ID NO: 4709218 - DNA, 18 bp, Homo sapiens
agtgatccttccacctca

SEQ ID NO: 4709219 - DNA, 20 bp, Homo sapiens
agtgatctattttgagttaa

SEQ ID NO: 4709220 - DNA, 19 bp, Homo sapiens
agtgattccatcaaagaga

SEQ ID NO: 4709221 - DNA, 19 bp, Homo sapiens
agtgattctcatgcctcag

SEQ ID NO: 4709222 - DNA, 18 bp, Homo sapiens
agtgattctcctgcctca

SEQ ID NO: 4709223 - DNA, 20 bp, Homo sapiens
agtgattctcctgcctcagc

SEQ ID NO: 4709224 - DNA, 16 bp, Homo sapiens
agtgatttacatgctg

SEQ ID NO: 4709225 - DNA, 18 bp, Homo sapiens
agtgcacacctttattca

SEQ ID NO: 4709226 - DNA, 20 bp, Homo sapiens
agtgcacacctttattcaga

SEQ ID NO: 4709227 - DNA, 22 bp, Homo sapiens
agtgcacacctttattcagaac

SEQ ID NO: 4709228 - DNA, 20 bp, Homo sapiens
agtgcagagatcctacttct

SEQ ID NO: 4709229 - DNA, 22 bp, Homo sapiens
agtgcagtcctgatcagagccg

SEQ ID NO: 4709230 - DNA, 23 bp, Homo sapiens
agtgcagtcctgatcagagccgt

SEQ ID NO: 4709231 - DNA, 13 bp, Homo sapiens
agtgccaagcagg

SEQ ID NO: 4709232 - DNA, 14 bp, Homo sapiens
agtgccagcccctg

SEQ ID NO: 4709233 - DNA, 17 bp, Homo sapiens
agtgcccattcctcacc

SEQ ID NO: 4709234 - DNA, 20 bp, Homo sapiens
agtgccgccgcctcgcccac

SEQ ID NO: 4709235 - DNA, 14 bp, Homo sapiens
agtgcgtgctcagt

SEQ ID NO: 4709236 - DNA, 17 bp, Homo sapiens
agtgctcatttcaggat

SEQ ID NO: 4709237 - DNA, 11 bp, Homo sapiens
agtgctccctc

SEQ ID NO: 4709238 - DNA, 11 bp, Homo sapiens
agtgctctgat

SEQ ID NO: 4709239 - DNA, 12 bp, Homo sapiens
agtgctgagacc

SEQ ID NO: 4709240 - DNA, 20 bp, Homo sapiens
agtgctgggattacaagcgt

SEQ ID NO: 4709241 - DNA, 21 bp, Homo sapiens
agtgctgggattacaggtgtg

SEQ ID NO: 4709242 - DNA, 13 bp, Homo sapiens
agtgctgtaatat

SEQ ID NO: 4709243 - DNA, 16 bp, Homo sapiens
agtgcttgccacagag

SEQ ID NO: 4709244 - DNA, 24 bp, Homo sapiens
agtggaacgaaaatgaaagctact

SEQ ID NO: 4709245 - DNA, 17 bp, Homo sapiens
agtggaagtagtggagc

SEQ ID NO: 4709246 - DNA, 20 bp, Homo sapiens
agtggcagctgcttttgtct

SEQ ID NO: 4709247 - DNA, 16 bp, Homo sapiens
agtggcattggcagca

SEQ ID NO: 4709248 - DNA, 18 bp, Homo sapiens
agtggcattggcagcagg

SEQ ID NO: 4709249 - DNA, 12 bp, Homo sapiens
agtggctgctgc

SEQ ID NO: 4709250 - DNA, 16 bp, Homo sapiens
agtggctgctgcccag

SEQ ID NO: 4709251 - DNA, 21 bp, Homo sapiens
agtggcttcattagagcaggc

SEQ ID NO: 4709252 - DNA, 22 bp, Homo sapiens
agtggcttcattagagcaggcg

SEQ ID NO: 4709253 - DNA, 16 bp, Homo sapiens
agtgggagatgaaaac

SEQ ID NO: 4709254 - DNA, 16 bp, Homo sapiens
agtgggagctgcctgt

SEQ ID NO: 4709255 - DNA, 22 bp, Homo sapiens
agtgggcccaatgcactttgtt

SEQ ID NO: 4709256 - DNA, 14 bp, Homo sapiens
agtggggaggggct

SEQ ID NO: 4709257 - DNA, 17 bp, Homo sapiens
agtgggtcccacttccc

SEQ ID NO: 4709258 - DNA, 18 bp, Homo sapiens
agtggtatagaaatgctg

SEQ ID NO: 4709259 - DNA, 15 bp, Homo sapiens
agtggtctttgtaag

SEQ ID NO: 4709260 - DNA, 24 bp, Homo sapiens
agtggtctttgtaagagtgtagaa

SEQ ID NO: 4709261 - DNA, 16 bp, Homo sapiens
agtggtgcgatctggg

SEQ ID NO: 4709262 - DNA, 17 bp, Homo sapiens
agtggttgggctgtgcc

SEQ ID NO: 4709263 - DNA, 16 bp, Homo sapiens
agtgtacagtcttgta

SEQ ID NO: 4709264 - DNA, 14 bp, Homo sapiens
agtgtagaagcatt

SEQ ID NO: 4709265 - DNA, 17 bp, Homo sapiens
agtgtagaagcattcct

SEQ ID NO: 4709266 - DNA, 17 bp, Homo sapiens
agtgtccaaagcagggt

SEQ ID NO: 4709267 - DNA, 20 bp, Homo sapiens
agtgtccaaagcagggtctg

SEQ ID NO: 4709268 - DNA, 19 bp, Homo sapiens
agtgtctgggctgactggg

SEQ ID NO: 4709269 - DNA, 13 bp, Homo sapiens
agtgtctttccac

SEQ ID NO: 4709270 - DNA, 18 bp, Homo sapiens
agtgtgaggccagggcag

SEQ ID NO: 4709271 - DNA, 12 bp, Homo sapiens
agtgtgcaaaat

SEQ ID NO: 4709272 - DNA, 14 bp, Homo sapiens
agtgtgcaaaatat

SEQ ID NO: 4709273 - DNA, 13 bp, Homo sapiens
agtgtgcccccca

SEQ ID NO: 4709274 - DNA, 16 bp, Homo sapiens
agtgtggtgtttcctg

SEQ ID NO: 4709275 - DNA, 11 bp, Homo sapiens
agtgtgtgtgc

SEQ ID NO: 4709276 - DNA, 12 bp, Homo sapiens
agtgtgttgact

SEQ ID NO: 4709277 - DNA, 22 bp, Homo sapiens
agtgttacaatcagtgtgaatg

SEQ ID NO: 4709278 - DNA, 15 bp, Homo sapiens
agtgttaggcctggc

SEQ ID NO: 4709279 - DNA, 19 bp, Homo sapiens
agtgttaggcctggcacag

SEQ ID NO: 4709280 - DNA, 23 bp, Homo sapiens
agtgttagggaagggcctgccac

SEQ ID NO: 4709281 - DNA, 18 bp, Homo sapiens
agtgtttatgttgtttat

SEQ ID NO: 4709282 - DNA, 22 bp, Homo sapiens
agtgtttgatttttattttata

SEQ ID NO: 4709283 - DNA, 22 bp, Homo sapiens
agttaaaattgttatcaaaata

SEQ ID NO: 4709284 - DNA, 20 bp, Homo sapiens
agttaaactgtattttatgt

SEQ ID NO: 4709285 - DNA, 12 bp, Homo sapiens
agttaaatgtat

SEQ ID NO: 4709286 - DNA, 14 bp, Homo sapiens
agttaaatgtatca

SEQ ID NO: 4709287 - DNA, 18 bp, Homo sapiens
agttaagaagctgttgta

SEQ ID NO: 4709288 - DNA, 20 bp, Homo sapiens
agttaagaagctgttgtaca

SEQ ID NO: 4709289 - DNA, 17 bp, Homo sapiens
agttacaattacatctc

SEQ ID NO: 4709290 - DNA, 15 bp, Homo sapiens
agttatattttgctg

SEQ ID NO: 4709291 - DNA, 17 bp, Homo sapiens
agttatattttgctgtt

SEQ ID NO: 4709292 - DNA, 23 bp, Homo sapiens
agttatattttgctgtttatgat

SEQ ID NO: 4709293 - DNA, 21 bp, Homo sapiens
agttcaggctctgagacacac

SEQ ID NO: 4709294 - DNA, 20 bp, Homo sapiens
agttcaggtaacaggcagat

SEQ ID NO: 4709295 - DNA, 14 bp, Homo sapiens
agttccccatgcag

SEQ ID NO: 4709296 - DNA, 19 bp, Homo sapiens
agttcctttagaaagcagt

SEQ ID NO: 4709297 - DNA, 23 bp, Homo sapiens
agttctgtactcaaatgtagcca

SEQ ID NO: 4709298 - DNA, 11 bp, Homo sapiens
agttctgtgta

SEQ ID NO: 4709299 - DNA, 13 bp, Homo sapiens
agttctgtgtaca

SEQ ID NO: 4709300 - DNA, 14 bp, Homo sapiens
agttctgtgtacat

SEQ ID NO: 4709301 - DNA, 16 bp, Homo sapiens
agttcttagttgctgt

SEQ ID NO: 4709302 - DNA, 15 bp, Homo sapiens
agttgaaactgctat

SEQ ID NO: 4709303 - DNA, 23 bp, Homo sapiens
agttgaaactgctatagcctaag

SEQ ID NO: 4709304 - DNA, 20 bp, Homo sapiens
agttgatagcacagaccctg

SEQ ID NO: 4709305 - DNA, 21 bp, Homo sapiens
agttgatcgcctttcccaggt

SEQ ID NO: 4709306 - DNA, 16 bp, Homo sapiens
agttgcacggctgctg

SEQ ID NO: 4709307 - DNA, 17 bp, Homo sapiens
agttgcatgaccacata

SEQ ID NO: 4709308 - DNA, 14 bp, Homo sapiens
agttgcctttattt

SEQ ID NO: 4709309 - DNA, 19 bp, Homo sapiens
agttgcctttatttgctgt

SEQ ID NO: 4709310 - DNA, 14 bp, Homo sapiens
cagctctgtcctgg

SEQ ID NO: 4709311 - DNA, 14 bp, Homo sapiens
cagctcttctccag

SEQ ID NO: 4709312 - DNA, 15 bp, Homo sapiens
cagctcttctccagg

SEQ ID NO: 4709313 - DNA, 15 bp, Homo sapiens
cagctcttgtttgga

SEQ ID NO: 4709314 - DNA, 20 bp, Homo sapiens
cagctgacttttctgaccca

SEQ ID NO: 4709315 - DNA, 15 bp, Homo sapiens
cagctgatacaaatt

SEQ ID NO: 4709316 - DNA, 12 bp, Homo sapiens
cagctgcctggg

SEQ ID NO: 4709317 - DNA, 14 bp, Homo sapiens
cagctgcctgggat

SEQ ID NO: 4709318 - DNA, 21 bp, Homo sapiens
cagctgcggtccacccaggag

SEQ ID NO: 4709319 - DNA, 17 bp, Homo sapiens
cagctggaattatgctg

SEQ ID NO: 4709320 - DNA, 15 bp, Homo sapiens
cagctggacttattt

SEQ ID NO: 4709321 - DNA, 23 bp, Homo sapiens
cagctggatgagaatttgagtgc

SEQ ID NO: 4709322 - DNA, 11 bp, Homo sapiens
cagctggtgga

SEQ ID NO: 4709323 - DNA, 22 bp, Homo sapiens
cagctggtggatggtgactttt

SEQ ID NO: 4709324 - DNA, 18 bp, Homo sapiens
cagctgtgctctggacag

SEQ ID NO: 4709325 - DNA, 20 bp, Homo sapiens
cagctgtgctctggacaggc

SEQ ID NO: 4709326 - DNA, 24 bp, Homo sapiens
cagctgtgctctggacaggcatgt

SEQ ID NO: 4709327 - DNA, 19 bp, Homo sapiens
cagctgtggtacaaatgtg

SEQ ID NO: 4709328 - DNA, 22 bp, Homo sapiens
cagctgtggtacaaatgtgata

SEQ ID NO: 4709329 - DNA, 14 bp, Homo sapiens
cagctgtttcctca

SEQ ID NO: 4709330 - DNA, 20 bp, Homo sapiens
cagcttcatttcctgtgtct

SEQ ID NO: 4709331 - DNA, 12 bp, Homo sapiens
cagcttctgcca

SEQ ID NO: 4709332 - DNA, 14 bp, Homo sapiens
cagcttctgccact

SEQ ID NO: 4709333 - DNA, 17 bp, Homo sapiens
cagcttctgccacttcc

SEQ ID NO: 4709334 - DNA, 15 bp, Homo sapiens
cagcttctgctgggc

SEQ ID NO: 4709335 - DNA, 18 bp, Homo sapiens
cagcttctgctgggctgg

SEQ ID NO: 4709336 - DNA, 14 bp, Homo sapiens
cagcttctgttgga

SEQ ID NO: 4709337 - DNA, 15 bp, Homo sapiens
cagcttgagggttgg

SEQ ID NO: 4709338 - DNA, 18 bp, Homo sapiens
cagcttgagggttgggct

SEQ ID NO: 4709339 - DNA, 19 bp, Homo sapiens
cagcttgagggttgggctg

SEQ ID NO: 4709340 - DNA, 20 bp, Homo sapiens
cagcttgagggttgggctgg

SEQ ID NO: 4709341 - DNA, 19 bp, Homo sapiens
cagcttgtaaatagctcag

SEQ ID NO: 4709342 - DNA, 23 bp, Homo sapiens
cagcttttacgtagtaaaagtca

SEQ ID NO: 4709343 - DNA, 18 bp, Homo sapiens
cagcttttcccaaaagcc

SEQ ID NO: 4709344 - DNA, 17 bp, Homo sapiens
caggaaaagcctctgtg

SEQ ID NO: 4709345 - DNA, 19 bp, Homo sapiens
caggaaaagcctctgtgtc

SEQ ID NO: 4709346 - DNA, 18 bp, Homo sapiens
caggaaaagctgctgaca

SEQ ID NO: 4709347 - DNA, 19 bp, Homo sapiens
caggaaaagctgctgacag

SEQ ID NO: 4709348 - DNA, 20 bp, Homo sapiens
caggaaaagctgctgacagt

SEQ ID NO: 4709349 - DNA, 21 bp, Homo sapiens
caggaaaggctccaggagcag

SEQ ID NO: 4709350 - DNA, 20 bp, Homo sapiens
caggaacatacagacacatt

SEQ ID NO: 4709351 - DNA, 14 bp, Homo sapiens
caggaagctcaggg

SEQ ID NO: 4709352 - DNA, 18 bp, Homo sapiens
caggaaggagctgcctgg

SEQ ID NO: 4709353 - DNA, 22 bp, Homo sapiens
caggaaggagctgcctggaccc

SEQ ID NO: 4709354 - DNA, 16 bp, Homo sapiens
caggacaagctactta

SEQ ID NO: 4709355 - DNA, 13 bp, Homo sapiens
caggacatgctga

SEQ ID NO: 4709356 - DNA, 12 bp, Homo sapiens
caggacatttct

SEQ ID NO: 4709357 - DNA, 14 bp, Homo sapiens
caggacatttctct

SEQ ID NO: 4709358 - DNA, 18 bp, Homo sapiens
caggacatttctctaaga

SEQ ID NO: 4709359 - DNA, 18 bp, Homo sapiens
caggaccaagggcagagg

SEQ ID NO: 4709360 - DNA, 13 bp, Homo sapiens
caggacccagagg

SEQ ID NO: 4709361 - DNA, 16 bp, Homo sapiens
caggacccagaggaag

SEQ ID NO: 4709362 - DNA, 22 bp, Homo sapiens
caggacctaggatatcttctcc

SEQ ID NO: 4709363 - DNA, 20 bp, Homo sapiens
caggacggggccggccaggt

SEQ ID NO: 4709364 - DNA, 22 bp, Homo sapiens
caggacggggccggccaggtgg

SEQ ID NO: 4709365 - DNA, 14 bp, Homo sapiens
caggactcagctcc

SEQ ID NO: 4709366 - DNA, 19 bp, Homo sapiens
caggactcagctccccaga

SEQ ID NO: 4709367 - DNA, 13 bp, Homo sapiens
caggactctgcag

SEQ ID NO: 4709368 - DNA, 14 bp, Homo sapiens
caggactctgcagc

SEQ ID NO: 4709369 - DNA, 18 bp, Homo sapiens
caggactctgcagcctca

SEQ ID NO: 4709370 - DNA, 15 bp, Homo sapiens
atgtggcaggagggc

SEQ ID NO: 4709371 - DNA, 21 bp, Homo sapiens
atgtggccctccagtgtatga

SEQ ID NO: 4709372 - DNA, 16 bp, Homo sapiens
atgtgggtccctctct

SEQ ID NO: 4709373 - DNA, 15 bp, Homo sapiens
atgtgggttgtgata

SEQ ID NO: 4709374 - DNA, 19 bp, Homo sapiens
atgtggtcctatttaagcc

SEQ ID NO: 4709375 - DNA, 16 bp, Homo sapiens
atgtggttgaagagca

SEQ ID NO: 4709376 - DNA, 16 bp, Homo sapiens
atgtgtaaatgttatg

SEQ ID NO: 4709377 - DNA, 13 bp, Homo sapiens
atgtgtatgagaa

SEQ ID NO: 4709378 - DNA, 18 bp, Homo sapiens
atgtgtatgtgtggtttc

SEQ ID NO: 4709379 - DNA, 21 bp, Homo sapiens
atgtgtcccagtgaacagttt

SEQ ID NO: 4709380 - DNA, 18 bp, Homo sapiens
atgtgtctgcaacatgga

SEQ ID NO: 4709381 - DNA, 21 bp, Homo sapiens
atgtgtggtttcagttctgtg

SEQ ID NO: 4709382 - DNA, 21 bp, Homo sapiens
atgtgtgtccacgactgtctc

SEQ ID NO: 4709383 - DNA, 12 bp, Homo sapiens
atgtgtgtgtgc

SEQ ID NO: 4709384 - DNA, 23 bp, Homo sapiens
atgtgtgttgatactgttgcacg

SEQ ID NO: 4709385 - DNA, 20 bp, Homo sapiens
atgtgttgataattttttaa

SEQ ID NO: 4709386 - DNA, 19 bp, Homo sapiens
atgtgttgcataaacaatc

SEQ ID NO: 4709387 - DNA, 22 bp, Homo sapiens
atgtgttggggaagggcctgcc

SEQ ID NO: 4709388 - DNA, 22 bp, Homo sapiens
atgttaaatttgtaagtttcag

SEQ ID NO: 4709389 - DNA, 23 bp, Homo sapiens
atgttaaatttgtaagtttcagg

SEQ ID NO: 4709390 - DNA, 14 bp, Homo sapiens
atgttaatcaaaca

SEQ ID NO: 4709391 - DNA, 12 bp, Homo sapiens
atgttactgaga

SEQ ID NO: 4709392 - DNA, 14 bp, Homo sapiens
atgttagaataatt

SEQ ID NO: 4709393 - DNA, 14 bp, Homo sapiens
atgttagagtaatg

SEQ ID NO: 4709394 - DNA, 12 bp, Homo sapiens
atgttcacttta

SEQ ID NO: 4709395 - DNA, 17 bp, Homo sapiens
atgttcactttaaagca

SEQ ID NO: 4709396 - DNA, 14 bp, Homo sapiens
atgttcacttttga

SEQ ID NO: 4709397 - DNA, 22 bp, Homo sapiens
atgttcacttttgacaaaggca

SEQ ID NO: 4709398 - DNA, 16 bp, Homo sapiens
atgttctaatactttg

SEQ ID NO: 4709399 - DNA, 20 bp, Homo sapiens
atgttctccagtcattatgt

SEQ ID NO: 4709400 - DNA, 13 bp, Homo sapiens
atgttctctgagg

SEQ ID NO: 4709401 - DNA, 20 bp, Homo sapiens
atgttctgtcccttgccccc

SEQ ID NO: 4709402 - DNA, 15 bp, Homo sapiens
atgttcttcataagc

SEQ ID NO: 4709403 - DNA, 16 bp, Homo sapiens
atgttggccaggctgc

SEQ ID NO: 4709404 - DNA, 13 bp, Homo sapiens
atgttggctggga

SEQ ID NO: 4709405 - DNA, 16 bp, Homo sapiens
atgttgtttataataa

SEQ ID NO: 4709406 - DNA, 20 bp, Homo sapiens
atgttgtttataataaaaat

SEQ ID NO: 4709407 - DNA, 17 bp, Homo sapiens
atgtttgcctctgcctc

SEQ ID NO: 4709408 - DNA, 20 bp, Homo sapiens
atgtttgttatttacactgg

SEQ ID NO: 4709409 - DNA, 22 bp, Homo sapiens
atgtttgttatttacactggtc

SEQ ID NO: 4709410 - DNA, 23 bp, Homo sapiens
atgtttgttatttacactggtct

SEQ ID NO: 4709411 - DNA, 16 bp, Homo sapiens
atgttttaagaggcag

SEQ ID NO: 4709412 - DNA, 18 bp, Homo sapiens
atgttttaagaggcaggg

SEQ ID NO: 4709413 - DNA, 12 bp, Homo sapiens
atgttttcaaat

SEQ ID NO: 4709414 - DNA, 13 bp, Homo sapiens
atgtttttgtgta

SEQ ID NO: 4709415 - DNA, 19 bp, Homo sapiens
atgtttttgttcaaagcca

SEQ ID NO: 4709416 - DNA, 13 bp, Homo sapiens
attaaaagactca

SEQ ID NO: 4709417 - DNA, 14 bp, Homo sapiens
attaaaagactcat

SEQ ID NO: 4709418 - DNA, 15 bp, Homo sapiens
attaaaagactcatc

SEQ ID NO: 4709419 - DNA, 16 bp, Homo sapiens
attaaaatcctcaatc

SEQ ID NO: 4709420 - DNA, 20 bp, Homo sapiens
attaaaatggatttaatcca

SEQ ID NO: 4709421 - DNA, 22 bp, Homo sapiens
attaaaatggatttaatccatt

SEQ ID NO: 4709422 - DNA, 13 bp, Homo sapiens
attaaacattttc

SEQ ID NO: 4709423 - DNA, 17 bp, Homo sapiens
attaaacgtaaatgttt

SEQ ID NO: 4709424 - DNA, 16 bp, Homo sapiens
attaaacttcttttct

SEQ ID NO: 4709425 - DNA, 24 bp, Homo sapiens
attaaacttcttttctcttctaca

SEQ ID NO: 4709426 - DNA, 18 bp, Homo sapiens
attaaatcagttctcaat

SEQ ID NO: 4709427 - DNA, 17 bp, Homo sapiens
attaaattctctctaac

SEQ ID NO: 4709428 - DNA, 12 bp, Homo sapiens
attaaattgtgt

SEQ ID NO: 4709429 - DNA, 22 bp, Homo sapiens
attaacaaatgctctgtcttca

SEQ ID NO: 4709430 - DNA, 18 bp, Homo sapiens
attaacactaattatcac

SEQ ID NO: 4709431 - DNA, 14 bp, Homo sapiens
attaacactcattt

SEQ ID NO: 4709432 - DNA, 11 bp, Homo sapiens
attaacactgc

SEQ ID NO: 4709433 - DNA, 19 bp, Homo sapiens
attaactgctccaaattta

SEQ ID NO: 4709434 - DNA, 23 bp, Homo sapiens
attaactgctccaaatttaacca

SEQ ID NO: 4709435 - DNA, 17 bp, Homo sapiens
attaagaaacaatttaa

SEQ ID NO: 4709436 - DNA, 16 bp, Homo sapiens
attaaggcagtatgat

SEQ ID NO: 4709437 - DNA, 12 bp, Homo sapiens
attaagttacaa

SEQ ID NO: 4709438 - DNA, 19 bp, Homo sapiens
attaagttgttaataaaag

SEQ ID NO: 4709439 - DNA, 20 bp, Homo sapiens
attaagttgttaataaaagt

SEQ ID NO: 4709440 - DNA, 13 bp, Homo sapiens
attaatacagagt

SEQ ID NO: 4709441 - DNA, 18 bp, Homo sapiens
attaatagcattcgaaga

SEQ ID NO: 4709442 - DNA, 14 bp, Homo sapiens
attaattcaatgaa

SEQ ID NO: 4709443 - DNA, 12 bp, Homo sapiens
attaatttgaaa

SEQ ID NO: 4709444 - DNA, 21 bp, Homo sapiens
attaatttgaaaccaggacat

SEQ ID NO: 4709445 - DNA, 12 bp, Homo sapiens
attataactgta

SEQ ID NO: 4709446 - DNA, 13 bp, Homo sapiens
attataacttatt

SEQ ID NO: 4709447 - DNA, 23 bp, Homo sapiens
attatagtgatgtaatcttgaat

SEQ ID NO: 4709448 - DNA, 20 bp, Homo sapiens
attatatggcttgagtttaa

SEQ ID NO: 4709449 - DNA, 15 bp, Homo sapiens
attatatttacaaat

SEQ ID NO: 4709450 - DNA, 16 bp, Homo sapiens
attatatttacaaatg

SEQ ID NO: 4709451 - DNA, 15 bp, Homo sapiens
attatcactttgggg

SEQ ID NO: 4709452 - DNA, 17 bp, Homo sapiens
attatccaggtaatcca

SEQ ID NO: 4709453 - DNA, 17 bp, Homo sapiens
attatggcatatattaa

SEQ ID NO: 4709454 - DNA, 16 bp, Homo sapiens
attatggcctttttaa

SEQ ID NO: 4709455 - DNA, 12 bp, Homo sapiens
attatgtgaaat

SEQ ID NO: 4709456 - DNA, 13 bp, Homo sapiens
attatgttaatat

SEQ ID NO: 4709457 - DNA, 17 bp, Homo sapiens
attatgttaatatttct

SEQ ID NO: 4709458 - DNA, 18 bp, Homo sapiens
attattaaattgtgtaca

SEQ ID NO: 4709459 - DNA, 14 bp, Homo sapiens
attattacttttta

SEQ ID NO: 4709460 - DNA, 21 bp, Homo sapiens
attattcaagaaagatatcta

SEQ ID NO: 4709461 - DNA, 18 bp, Homo sapiens
attattcagtgaatttgt

SEQ ID NO: 4709462 - DNA, 14 bp, Homo sapiens
attattcagtgtca

SEQ ID NO: 4709463 - DNA, 18 bp, Homo sapiens
attattccgtattacatt

SEQ ID NO: 4709464 - DNA, 13 bp, Homo sapiens
attatttaaagca

SEQ ID NO: 4709465 - DNA, 14 bp, Homo sapiens
attatttaaatgta

SEQ ID NO: 4709466 - DNA, 17 bp, Homo sapiens
attatttaaatgtactt

SEQ ID NO: 4709467 - DNA, 18 bp, Homo sapiens
attatttaataacattac

SEQ ID NO: 4709468 - DNA, 15 bp, Homo sapiens
attatttaattgtcc

SEQ ID NO: 4709469 - DNA, 15 bp, Homo sapiens
attatttaatttgta

SEQ ID NO: 4709470 - DNA, 23 bp, Homo sapiens
attatttattaaatgcccagccc

SEQ ID NO: 4709471 - DNA, 15 bp, Homo sapiens
attatttgattattt

SEQ ID NO: 4709472 - DNA, 22 bp, Homo sapiens
attatttgattatttaagacta

SEQ ID NO: 4709473 - DNA, 12 bp, Homo sapiens
attattttctcc

SEQ ID NO: 4709474 - DNA, 19 bp, Homo sapiens
attattttctccaaataaa

SEQ ID NO: 4709475 - DNA, 13 bp, Homo sapiens
attattttgatta

SEQ ID NO: 4709476 - DNA, 13 bp, Homo sapiens
attcaagaaagat

SEQ ID NO: 4709477 - DNA, 16 bp, Homo sapiens
attcaatgaaatggat

SEQ ID NO: 4709478 - DNA, 11 bp, Homo sapiens
attcacactgt

SEQ ID NO: 4709479 - DNA, 20 bp, Homo sapiens
attcagaactttagtattaa

SEQ ID NO: 4709480 - DNA, 11 bp, Homo sapiens
attcagacagc

SEQ ID NO: 4709481 - DNA, 12 bp, Homo sapiens
attcagacagct

SEQ ID NO: 4709482 - DNA, 14 bp, Homo sapiens
attcagacagctgc

SEQ ID NO: 4709483 - DNA, 14 bp, Homo sapiens
attcagatgtatgt

SEQ ID NO: 4709484 - DNA, 13 bp, Homo sapiens
attcaggaagctc

SEQ ID NO: 4709485 - DNA, 19 bp, Homo sapiens
attcaggaagctcagggcc

SEQ ID NO: 4709486 - DNA, 19 bp, Homo sapiens
attcaggacttgaaagaaa

SEQ ID NO: 4709487 - DNA, 15 bp, Homo sapiens
attcataaagagaaa

SEQ ID NO: 4709488 - DNA, 19 bp, Homo sapiens
attcatcaaataaaccttg

SEQ ID NO: 4709489 - DNA, 19 bp, Homo sapiens
attcatccaggactgagat

SEQ ID NO: 4709490 - DNA, 17 bp, Homo sapiens
attcatctctctttaat

SEQ ID NO: 4709491 - DNA, 13 bp, Homo sapiens
attcatgcctggc

SEQ ID NO: 4709492 - DNA, 14 bp, Homo sapiens
attcattagttttg

SEQ ID NO: 4709493 - DNA, 17 bp, Homo sapiens
attcattccattctgga

SEQ ID NO: 4709494 - DNA, 21 bp, Homo sapiens
attcattctttttgaaatgtc

SEQ ID NO: 4709495 - DNA, 20 bp, Homo sapiens
attccatcaaagagaaggaa

SEQ ID NO: 4709496 - DNA, 14 bp, Homo sapiens
attcccaagctctg

SEQ ID NO: 4709497 - DNA, 17 bp, Homo sapiens
attcccaagctctgctc

SEQ ID NO: 4709498 - DNA, 16 bp, Homo sapiens
attccccaggaggcca

SEQ ID NO: 4709499 - DNA, 12 bp, Homo sapiens
attccctccagt

SEQ ID NO: 4709500 - DNA, 19 bp, Homo sapiens
attcccttcatctggaacc

SEQ ID NO: 4709501 - DNA, 21 bp, Homo sapiens
attcctatacgcagcgtgctt

SEQ ID NO: 4709502 - DNA, 16 bp, Homo sapiens
attccttcccagaggg

SEQ ID NO: 4709503 - DNA, 14 bp, Homo sapiens
attccttctttgat

SEQ ID NO: 4709504 - DNA, 16 bp, Homo sapiens
attccttctttgataa

SEQ ID NO: 4709505 - DNA, 23 bp, Homo sapiens
attccttctttgataatgttaaa

SEQ ID NO: 4709506 - DNA, 14 bp, Homo sapiens
attcctttgcatat

SEQ ID NO: 4709507 - DNA, 23 bp, Homo sapiens
attcgttgttcccactgaaatgg

SEQ ID NO: 4709508 - DNA, 12 bp, Homo sapiens
attctaaacaga

SEQ ID NO: 4709509 - DNA, 21 bp, Homo sapiens
attctaaacagatgtccctga

SEQ ID NO: 4709510 - DNA, 13 bp, Homo sapiens
attctaattgtca

SEQ ID NO: 4709511 - DNA, 17 bp, Homo sapiens
attctaattgtcagtga

SEQ ID NO: 4709512 - DNA, 16 bp, Homo sapiens
attctacgtatctgct

SEQ ID NO: 4709513 - DNA, 17 bp, Homo sapiens
attctatactttcttgt

SEQ ID NO: 4709514 - DNA, 16 bp, Homo sapiens
attctcagggtctctg

SEQ ID NO: 4709515 - DNA, 17 bp, Homo sapiens
attctcagggtctctgc

SEQ ID NO: 4709516 - DNA, 19 bp, Homo sapiens
attctcagggtctctgctg

SEQ ID NO: 4709517 - DNA, 22 bp, Homo sapiens
attctcagggtctctgctgccg

SEQ ID NO: 4709518 - DNA, 21 bp, Homo sapiens
attctcatgcctcagcctcct

SEQ ID NO: 4709519 - DNA, 22 bp, Homo sapiens
cagagagggtgggagtgggccc

SEQ ID NO: 4709520 - DNA, 23 bp, Homo sapiens
cagagagggtgggagtgggccca

SEQ ID NO: 4709521 - DNA, 20 bp, Homo sapiens
cagagagggtggtgacctct

SEQ ID NO: 4709522 - DNA, 16 bp, Homo sapiens
cagagcaccttagaca

SEQ ID NO: 4709523 - DNA, 18 bp, Homo sapiens
cagagcaccttagacagt

SEQ ID NO: 4709524 - DNA, 19 bp, Homo sapiens
cagagcaccttagacagtc

SEQ ID NO: 4709525 - DNA, 14 bp, Homo sapiens
cagagcagagacca

SEQ ID NO: 4709526 - DNA, 18 bp, Homo sapiens
cagagcagagaccatccc

SEQ ID NO: 4709527 - DNA, 19 bp, Homo sapiens
cagagcagagaccatccct

SEQ ID NO: 4709528 - DNA, 21 bp, Homo sapiens
cagagcagagaccatccctga

SEQ ID NO: 4709529 - DNA, 16 bp, Homo sapiens
cagagcagatgcagag

SEQ ID NO: 4709530 - DNA, 15 bp, Homo sapiens
cagagcccaccttgg

SEQ ID NO: 4709531 - DNA, 17 bp, Homo sapiens
cagagcccaccttggct

SEQ ID NO: 4709532 - DNA, 19 bp, Homo sapiens
cagagcccaccttggctca

SEQ ID NO: 4709533 - DNA, 16 bp, Homo sapiens
cagagcccacgccccc

SEQ ID NO: 4709534 - DNA, 20 bp, Homo sapiens
cagagcccacgcccccactg

SEQ ID NO: 4709535 - DNA, 12 bp, Homo sapiens
cagagcctgcag

SEQ ID NO: 4709536 - DNA, 13 bp, Homo sapiens
cagagcctgcagt

SEQ ID NO: 4709537 - DNA, 14 bp, Homo sapiens
cagagcctgcagtt

SEQ ID NO: 4709538 - DNA, 20 bp, Homo sapiens
cagagcgggctcgaagaaaa

SEQ ID NO: 4709539 - DNA, 17 bp, Homo sapiens
cagagctacttgggcca

SEQ ID NO: 4709540 - DNA, 22 bp, Homo sapiens
cagagctctgacccacagcctc

SEQ ID NO: 4709541 - DNA, 14 bp, Homo sapiens
cagagctgacacag

SEQ ID NO: 4709542 - DNA, 15 bp, Homo sapiens
cagagctgacacagg

SEQ ID NO: 4709543 - DNA, 19 bp, Homo sapiens
cagagctgcttctgtctgg

SEQ ID NO: 4709544 - DNA, 9 bp, Homo sapiens
cagagctgg

SEQ ID NO: 4709545 - DNA, 13 bp, Homo sapiens
cagagcttccctg

SEQ ID NO: 4709546 - DNA, 16 bp, Homo sapiens
cagaggaaggggccag

SEQ ID NO: 4709547 - DNA, 21 bp, Homo sapiens
cagaggaaggggccagaggct

SEQ ID NO: 4709548 - DNA, 18 bp, Homo sapiens
cagaggagggcagcagaa

SEQ ID NO: 4709549 - DNA, 11 bp, Homo sapiens
cagaggcagcc

SEQ ID NO: 4709550 - DNA, 13 bp, Homo sapiens
cagaggcagcccc

SEQ ID NO: 4709551 - DNA, 20 bp, Homo sapiens
cagaggcagccccattctgc

SEQ ID NO: 4709552 - DNA, 16 bp, Homo sapiens
cagaggccatgggcct

SEQ ID NO: 4709553 - DNA, 19 bp, Homo sapiens
cagaggccctcgctgccag

SEQ ID NO: 4709554 - DNA, 20 bp, Homo sapiens
cagagggagtgacagaggca

SEQ ID NO: 4709555 - DNA, 21 bp, Homo sapiens
cagagggagtgacagaggcag

SEQ ID NO: 4709556 - DNA, 23 bp, Homo sapiens
cagagggagtgacagaggcagcc

SEQ ID NO: 4709557 - DNA, 22 bp, Homo sapiens
cagagggcctgcaagggagtga

SEQ ID NO: 4709558 - DNA, 20 bp, Homo sapiens
cagaggggcaggccctgcac

SEQ ID NO: 4709559 - DNA, 22 bp, Homo sapiens
cagaggggcctgccacctggac

SEQ ID NO: 4709560 - DNA, 14 bp, Homo sapiens
cagagggggtggcc

SEQ ID NO: 4709561 - DNA, 18 bp, Homo sapiens
cagagggggtggcctccc

SEQ ID NO: 4709562 - DNA, 19 bp, Homo sapiens
cagagggggtggcctccca

SEQ ID NO: 4709563 - DNA, 15 bp, Homo sapiens
cagaggtccacaaca

SEQ ID NO: 4709564 - DNA, 18 bp, Homo sapiens
cagaggttatctgtccca

SEQ ID NO: 4709565 - DNA, 19 bp, Homo sapiens
cagaggttatctgtcccag

SEQ ID NO: 4709566 - DNA, 17 bp, Homo sapiens
cagagtctcactgttgc

SEQ ID NO: 4709567 - DNA, 21 bp, Homo sapiens
cagagtctcactgttgcccag

SEQ ID NO: 4709568 - DNA, 19 bp, Homo sapiens
cagagtgagactctgtctc

SEQ ID NO: 4709569 - DNA, 20 bp, Homo sapiens
cagagtgagactctgtctca

SEQ ID NO: 4709570 - DNA, 19 bp, Homo sapiens
cagagtggagttgaaactg

SEQ ID NO: 4709571 - DNA, 18 bp, Homo sapiens
cagagttccccatgcaga

SEQ ID NO: 4709572 - DNA, 13 bp, Homo sapiens
cagagttctttgc

SEQ ID NO: 4709573 - DNA, 20 bp, Homo sapiens
cagatacaggaaaagctgct

SEQ ID NO: 4709574 - DNA, 22 bp, Homo sapiens
cagatacaggaaaagctgctga

SEQ ID NO: 4709575 - DNA, 20 bp, Homo sapiens
catcatcaaggcactgcctg

SEQ ID NO: 4709576 - DNA, 21 bp, Homo sapiens
catcatcaaggcactgcctga

SEQ ID NO: 4709577 - DNA, 17 bp, Homo sapiens
catcatccctccctgcc

SEQ ID NO: 4709578 - DNA, 13 bp, Homo sapiens
catcatctcctgc

SEQ ID NO: 4709579 - DNA, 15 bp, Homo sapiens
catcatgtagaatat

SEQ ID NO: 4709580 - DNA, 13 bp, Homo sapiens
catcatgtctggc

SEQ ID NO: 4709581 - DNA, 15 bp, Homo sapiens
catcatgtctggcta

SEQ ID NO: 4709582 - DNA, 22 bp, Homo sapiens
catcattcatccaggactgaga

SEQ ID NO: 4709583 - DNA, 17 bp, Homo sapiens
catcattctctgtctca

SEQ ID NO: 4709584 - DNA, 12 bp, Homo sapiens
catcattggata

SEQ ID NO: 4709585 - DNA, 12 bp, Homo sapiens
catccacctcct

SEQ ID NO: 4709586 - DNA, 16 bp, Homo sapiens
catccacctccttctc

SEQ ID NO: 4709587 - DNA, 14 bp, Homo sapiens
catccactgtgcca

SEQ ID NO: 4709588 - DNA, 15 bp, Homo sapiens
catccaggactgaga

SEQ ID NO: 4709589 - DNA, 13 bp, Homo sapiens
catccatcatcat

SEQ ID NO: 4709590 - DNA, 16 bp, Homo sapiens
catcccagccccaatg

SEQ ID NO: 4709591 - DNA, 17 bp, Homo sapiens
catcccagccccaatga

SEQ ID NO: 4709592 - DNA, 23 bp, Homo sapiens
catccctcagtttcttaaaatgt

SEQ ID NO: 4709593 - DNA, 15 bp, Homo sapiens
catccctccctgcct

SEQ ID NO: 4709594 - DNA, 18 bp, Homo sapiens
catccctccctgcctaag

SEQ ID NO: 4709595 - DNA, 20 bp, Homo sapiens
catcccttgaccaggcctgg

SEQ ID NO: 4709596 - DNA, 14 bp, Homo sapiens
catcctaactccat

SEQ ID NO: 4709597 - DNA, 18 bp, Homo sapiens
catcctacaagacacagt

SEQ ID NO: 4709598 - DNA, 15 bp, Homo sapiens
catcctaccgtcttt

SEQ ID NO: 4709599 - DNA, 17 bp, Homo sapiens
catcctcatacccaccc

SEQ ID NO: 4709600 - DNA, 22 bp, Homo sapiens
catcctcatacccacccccacc

SEQ ID NO: 4709601 - DNA, 20 bp, Homo sapiens
catcctccacgttctgctca

SEQ ID NO: 4709602 - DNA, 19 bp, Homo sapiens
catcctctgtacagagccc

SEQ ID NO: 4709603 - DNA, 22 bp, Homo sapiens
catcctctgtacagagcccacg

SEQ ID NO: 4709604 - DNA, 15 bp, Homo sapiens
catcctggcacccgg

SEQ ID NO: 4709605 - DNA, 12 bp, Homo sapiens
catcctggccca

SEQ ID NO: 4709606 - DNA, 13 bp, Homo sapiens
catcctggcccat

SEQ ID NO: 4709607 - DNA, 18 bp, Homo sapiens
catcctgtcccaccatgc

SEQ ID NO: 4709608 - DNA, 12 bp, Homo sapiens
catcgcaatgta

SEQ ID NO: 4709609 - DNA, 19 bp, Homo sapiens
catcgtgatcactgagcca

SEQ ID NO: 4709610 - DNA, 20 bp, Homo sapiens
catctaattcttatttttaa

SEQ ID NO: 4709611 - DNA, 22 bp, Homo sapiens
catctcaaggaataatgggctt

SEQ ID NO: 4709612 - DNA, 12 bp, Homo sapiens
caggagcagcca

SEQ ID NO: 4709613 - DNA, 14 bp, Homo sapiens
caggagcagccaca

SEQ ID NO: 4709614 - DNA, 23 bp, Homo sapiens
caggagccccgaggccttctctg

SEQ ID NO: 4709615 - DNA, 22 bp, Homo sapiens
caggagccggacacttctcagg

SEQ ID NO: 4709616 - DNA, 13 bp, Homo sapiens
caggagctcccct

SEQ ID NO: 4709617 - DNA, 14 bp, Homo sapiens
caggagctcccctc

SEQ ID NO: 4709618 - DNA, 16 bp, Homo sapiens
caggagctcccctccc

SEQ ID NO: 4709619 - DNA, 18 bp, Homo sapiens
caggaggccagccttgac

SEQ ID NO: 4709620 - DNA, 23 bp, Homo sapiens
caggagggagggggaaggcaggg

SEQ ID NO: 4709621 - DNA, 16 bp, Homo sapiens
caggagttggaagtgt

SEQ ID NO: 4709622 - DNA, 16 bp, Homo sapiens
caggatcatggtgtaa

SEQ ID NO: 4709623 - DNA, 19 bp, Homo sapiens
caggatcatggtgtaataa

SEQ ID NO: 4709624 - DNA, 23 bp, Homo sapiens
caggatcatggtgtaataagaca

SEQ ID NO: 4709625 - DNA, 16 bp, Homo sapiens
caggattgcgagagat

SEQ ID NO: 4709626 - DNA, 15 bp, Homo sapiens
caggatttataaagc

SEQ ID NO: 4709627 - DNA, 14 bp, Homo sapiens
caggcaagcacctc

SEQ ID NO: 4709628 - DNA, 15 bp, Homo sapiens
caggcaagcacctcc

SEQ ID NO: 4709629 - DNA, 16 bp, Homo sapiens
caggcaatgctggctg

SEQ ID NO: 4709630 - DNA, 19 bp, Homo sapiens
caggcaatgctggctgttg

SEQ ID NO: 4709631 - DNA, 18 bp, Homo sapiens
caggcacccaccatcatg

SEQ ID NO: 4709632 - DNA, 22 bp, Homo sapiens
caggcacccaccatcatgtctg

SEQ ID NO: 4709633 - DNA, 22 bp, Homo sapiens
caggcactgccctggtggccct

SEQ ID NO: 4709634 - DNA, 11 bp, Homo sapiens
caggcagcaga

SEQ ID NO: 4709635 - DNA, 23 bp, Homo sapiens
caggcagcagagacttgggacat

SEQ ID NO: 4709636 - DNA, 16 bp, Homo sapiens
caggcagccaggccac

SEQ ID NO: 4709637 - DNA, 17 bp, Homo sapiens
caggcagccaggccaca

SEQ ID NO: 4709638 - DNA, 20 bp, Homo sapiens
caggcaggctaaggcgtgga

SEQ ID NO: 4709639 - DNA, 13 bp, Homo sapiens
caggcaggtccag

SEQ ID NO: 4709640 - DNA, 15 bp, Homo sapiens
caggcaggtccaggg

SEQ ID NO: 4709641 - DNA, 23 bp, Homo sapiens
caggcaggtcttgaactcctggc

SEQ ID NO: 4709642 - DNA, 14 bp, Homo sapiens
caggcatcacagct

SEQ ID NO: 4709643 - DNA, 15 bp, Homo sapiens
caggcatcacagcta

SEQ ID NO: 4709644 - DNA, 17 bp, Homo sapiens
caggcatggctggtgcc

SEQ ID NO: 4709645 - DNA, 18 bp, Homo sapiens
caggcatggctggtgcct

SEQ ID NO: 4709646 - DNA, 17 bp, Homo sapiens
caggcattccccaggag

SEQ ID NO: 4709647 - DNA, 19 bp, Homo sapiens
caggcattccccaggaggc

SEQ ID NO: 4709648 - DNA, 24 bp, Homo sapiens
caggcattccccaggaggccagcc

SEQ ID NO: 4709649 - DNA, 18 bp, Homo sapiens
caggccaagcccaataca

SEQ ID NO: 4709650 - DNA, 21 bp, Homo sapiens
caggccaagcccaatacagcc

SEQ ID NO: 4709651 - DNA, 13 bp, Homo sapiens
caggccacaagac

SEQ ID NO: 4709652 - DNA, 17 bp, Homo sapiens
caggccacaagaccctt

SEQ ID NO: 4709653 - DNA, 20 bp, Homo sapiens
caggccacaagacccttgtg

SEQ ID NO: 4709654 - DNA, 13 bp, Homo sapiens
caggccagaggga

SEQ ID NO: 4709655 - DNA, 16 bp, Homo sapiens
caggccagagggagtg

SEQ ID NO: 4709656 - DNA, 19 bp, Homo sapiens
caggccagagggagtgaca

SEQ ID NO: 4709657 - DNA, 23 bp, Homo sapiens
caggtgggcttcccagtggctgc

SEQ ID NO: 4709658 - DNA, 23 bp, Homo sapiens
caggtggggagactgggctgagg

SEQ ID NO: 4709659 - DNA, 20 bp, Homo sapiens
caggtggggtcactctggca

SEQ ID NO: 4709660 - DNA, 21 bp, Homo sapiens
caggtggggtggagtcccaga

SEQ ID NO: 4709661 - DNA, 22 bp, Homo sapiens
caggtggggtggagtcccagag

SEQ ID NO: 4709662 - DNA, 11 bp, Homo sapiens
caggtgtccct

SEQ ID NO: 4709663 - DNA, 12 bp, Homo sapiens
caggtgtgaacc

SEQ ID NO: 4709664 - DNA, 19 bp, Homo sapiens
caggtgtgaaccaccacac

SEQ ID NO: 4709665 - DNA, 23 bp, Homo sapiens
caggtgtgaaccaccacacccag

SEQ ID NO: 4709666 - DNA, 19 bp, Homo sapiens
caggtgtgccgacagaagg

SEQ ID NO: 4709667 - DNA, 20 bp, Homo sapiens
caggttatcgaaataacaat

SEQ ID NO: 4709668 - DNA, 12 bp, Homo sapiens
caggttcagctt

SEQ ID NO: 4709669 - DNA, 22 bp, Homo sapiens
caggttggaaaagaaatcaatt

SEQ ID NO: 4709670 - DNA, 21 bp, Homo sapiens
caggttgggccatactggcct

SEQ ID NO: 4709671 - DNA, 20 bp, Homo sapiens
caggtttctggtctctaggc

SEQ ID NO: 4709672 - DNA, 14 bp, Homo sapiens
caggtttgaccagg

SEQ ID NO: 4709673 - DNA, 18 bp, Homo sapiens
caggtttgaccaggaaag

SEQ ID NO: 4709674 - DNA, 20 bp, Homo sapiens
cagtaaaagataaatttgtt

SEQ ID NO: 4709675 - DNA, 18 bp, Homo sapiens
cagtaacgcaggggaaac

SEQ ID NO: 4709676 - DNA, 21 bp, Homo sapiens
cagtaagtagcaaccctgtga

SEQ ID NO: 4709677 - DNA, 19 bp, Homo sapiens
cagtaagtataacaaacta

SEQ ID NO: 4709678 - DNA, 20 bp, Homo sapiens
cagtaagttatctttgaata

SEQ ID NO: 4709679 - DNA, 21 bp, Homo sapiens
cagtaatcagagttaccatta

SEQ ID NO: 4709680 - DNA, 12 bp, Homo sapiens
cagtacctcctg

SEQ ID NO: 4709681 - DNA, 14 bp, Homo sapiens
cagtagattcaagt

SEQ ID NO: 4709682 - DNA, 14 bp, Homo sapiens
cagtaggagcccag

SEQ ID NO: 4709683 - DNA, 22 bp, Homo sapiens
cagtaggagcccagctctgaaa

SEQ ID NO: 4709684 - DNA, 18 bp, Homo sapiens
cagtaggctcaactaggg

SEQ ID NO: 4709685 - DNA, 19 bp, Homo sapiens
cagtaggcttttaccatta

SEQ ID NO: 4709686 - DNA, 23 bp, Homo sapiens
cagtaggcttttaccattagcat

SEQ ID NO: 4709687 - DNA, 23 bp, Homo sapiens
cagtatcctgctggttcactcta

SEQ ID NO: 4709688 - DNA, 21 bp, Homo sapiens
cagtatgggttagggaaaaca

SEQ ID NO: 4709689 - DNA, 17 bp, Homo sapiens
cagtcaattctgatgtt

SEQ ID NO: 4709690 - DNA, 18 bp, Homo sapiens
cagtcaccccggccacct

SEQ ID NO: 4709691 - DNA, 18 bp, Homo sapiens
cagtcacgtggaggagca

SEQ ID NO: 4709692 - DNA, 18 bp, Homo sapiens
cagtcatgcataaatatg

SEQ ID NO: 4709693 - DNA, 20 bp, Homo sapiens
cagtcatgcataaatatgca

SEQ ID NO: 4709694 - DNA, 23 bp, Homo sapiens
cagtcatgcataaatatgcagtg

SEQ ID NO: 4709695 - DNA, 21 bp, Homo sapiens
cagtcattatttaaagcacat

SEQ ID NO: 4709696 - DNA, 22 bp, Homo sapiens
cagtcattgtaacctcgtgtct

SEQ ID NO: 4709697 - DNA, 23 bp, Homo sapiens
cagtcatttttgtttctacctcc

SEQ ID NO: 4709698 - DNA, 23 bp, Homo sapiens
cagtccaaggaaaccacagctgc

SEQ ID NO: 4709699 - DNA, 13 bp, Homo sapiens
cagtccacaaaat

SEQ ID NO: 4709700 - DNA, 14 bp, Homo sapiens
cagtccagcctgga

SEQ ID NO: 4709701 - DNA, 17 bp, Homo sapiens
cagtccagcctggagat

SEQ ID NO: 4709702 - DNA, 16 bp, Homo sapiens
cagtccatagcagaga

SEQ ID NO: 4709703 - DNA, 12 bp, Homo sapiens
cagtccctgcca

SEQ ID NO: 4709704 - DNA, 13 bp, Homo sapiens
cagtcctctccac

SEQ ID NO: 4709705 - DNA, 15 bp, Homo sapiens
cagtcgcgctgcctg

SEQ ID NO: 4709706 - DNA, 20 bp, Homo sapiens
cagtcgcgctgcctgtgtgg

SEQ ID NO: 4709707 - DNA, 14 bp, Homo sapiens
cagtctcaattttg

SEQ ID NO: 4709708 - DNA, 14 bp, Homo sapiens
cagtctctgagcag

SEQ ID NO: 4709709 - DNA, 15 bp, Homo sapiens
cagtctctggaagaa

SEQ ID NO: 4709710 - DNA, 19 bp, Homo sapiens
cagtctgattcccaagctc

SEQ ID NO: 4709711 - DNA, 23 bp, Homo sapiens
cagtctgattcccaagctctgct

SEQ ID NO: 4709712 - DNA, 17 bp, Homo sapiens
cagtctggaatgcagtg

SEQ ID NO: 4709713 - DNA, 18 bp, Homo sapiens
cagtctggaatgcagtgg

SEQ ID NO: 4709714 - DNA, 15 bp, Homo sapiens
cagtcttccatttgc

SEQ ID NO: 4709715 - DNA, 14 bp, Homo sapiens
cagtgaaagcatca

SEQ ID NO: 4709716 - DNA, 17 bp, Homo sapiens
cagtgaatgattcagtg

SEQ ID NO: 4709717 - DNA, 22 bp, Homo sapiens
cagtgaatttgtccattgtaaa

SEQ ID NO: 4709718 - DNA, 19 bp, Homo sapiens
cagtgactcgggctcctgt

SEQ ID NO: 4709719 - DNA, 12 bp, Homo sapiens
cagtgaggctct

SEQ ID NO: 4709720 - DNA, 13 bp, Homo sapiens
cagtgaggctctg

SEQ ID NO: 4709721 - DNA, 15 bp, Homo sapiens
cagtgaggctctgcc

SEQ ID NO: 4709722 - DNA, 19 bp, Homo sapiens
cagtgaggctctgcccttg

SEQ ID NO: 4709723 - DNA, 17 bp, Homo sapiens
cagtgagtcgaggacag

SEQ ID NO: 4709724 - DNA, 19 bp, Homo sapiens
cagtgagtcgaggacaggg

SEQ ID NO: 4709725 - DNA, 15 bp, Homo sapiens
cagtgatatggcaga

SEQ ID NO: 4709726 - DNA, 21 bp, Homo sapiens
ccctaatgcgcaggctggccc

SEQ ID NO: 4709727 - DNA, 20 bp, Homo sapiens
ccctaccactgtcttcttca

SEQ ID NO: 4709728 - DNA, 17 bp, Homo sapiens
ccctagttattttctga

SEQ ID NO: 4709729 - DNA, 21 bp, Homo sapiens
ccctcaaggcctcccacagtg

SEQ ID NO: 4709730 - DNA, 10 bp, Homo sapiens
ccctcacact

SEQ ID NO: 4709731 - DNA, 14 bp, Homo sapiens
ccctcaccaggggc

SEQ ID NO: 4709732 - DNA, 16 bp, Homo sapiens
ccctcagacagccccc

SEQ ID NO: 4709733 - DNA, 15 bp, Homo sapiens
ccctcagggtccctg

SEQ ID NO: 4709734 - DNA, 18 bp, Homo sapiens
ccctcagggtccctggtg

SEQ ID NO: 4709735 - DNA, 19 bp, Homo sapiens
ccctcagggtccctggtgg

SEQ ID NO: 4709736 - DNA, 12 bp, Homo sapiens
ccctcatgctgt

SEQ ID NO: 4709737 - DNA, 17 bp, Homo sapiens
ccctccatgtgggctag

SEQ ID NO: 4709738 - DNA, 12 bp, Homo sapiens
ccctcccacagc

SEQ ID NO: 4709739 - DNA, 14 bp, Homo sapiens
ccctcccacagcgc

SEQ ID NO: 4709740 - DNA, 17 bp, Homo sapiens
ccctcccagctgacagt

SEQ ID NO: 4709741 - DNA, 20 bp, Homo sapiens
ccctcccagctgacagtcct

SEQ ID NO: 4709742 - DNA, 21 bp, Homo sapiens
ccctccccaactgaccacctt

SEQ ID NO: 4709743 - DNA, 15 bp, Homo sapiens
ccctcccctggggac

SEQ ID NO: 4709744 - DNA, 22 bp, Homo sapiens
ccctcccgtctactcattcccc

SEQ ID NO: 4709745 - DNA, 13 bp, Homo sapiens
ccctccctgctgt

SEQ ID NO: 4709746 - DNA, 17 bp, Homo sapiens
ccctccctgctgtcccc

SEQ ID NO: 4709747 - DNA, 15 bp, Homo sapiens
ccctcctacccctcc

SEQ ID NO: 4709748 - DNA, 22 bp, Homo sapiens
ccctcctacccctcccagctga

SEQ ID NO: 4709749 - DNA, 15 bp, Homo sapiens
ccctcctctctgccc

SEQ ID NO: 4709750 - DNA, 16 bp, Homo sapiens
ccctcctctctgccct

SEQ ID NO: 4709751 - DNA, 13 bp, Homo sapiens
ccctcctggccag

SEQ ID NO: 4709752 - DNA, 14 bp, Homo sapiens
ccctcgctgccagc

SEQ ID NO: 4709753 - DNA, 16 bp, Homo sapiens
ccctcgtgccagtcgc

SEQ ID NO: 4709754 - DNA, 22 bp, Homo sapiens
ccctcgtgccagtcgcgctgcc

SEQ ID NO: 4709755 - DNA, 21 bp, Homo sapiens
ccctctcagagctacttgggc

SEQ ID NO: 4709756 - DNA, 21 bp, Homo sapiens
ccctctcaggtgaccaaaatc

SEQ ID NO: 4709757 - DNA, 21 bp, Homo sapiens
ccctctccgcacacctctggc

SEQ ID NO: 4709758 - DNA, 12 bp, Homo sapiens
ccctctcctccg

SEQ ID NO: 4709759 - DNA, 19 bp, Homo sapiens
ccctctcctccgtggcaca

SEQ ID NO: 4709760 - DNA, 16 bp, Homo sapiens
ccctctctgctctgcg

SEQ ID NO: 4709761 - DNA, 11 bp, Homo sapiens
ccctctctgga

SEQ ID NO: 4709762 - DNA, 18 bp, Homo sapiens
ccctctgcccactccctg

SEQ ID NO: 4709763 - DNA, 12 bp, Homo sapiens
ccctctgccctg

SEQ ID NO: 4709764 - DNA, 13 bp, Homo sapiens
ccctctgccctgc

SEQ ID NO: 4709765 - DNA, 22 bp, Homo sapiens
ccctctggctccagctggccgg

SEQ ID NO: 4709766 - DNA, 14 bp, Homo sapiens
ccctctgtcctgac

SEQ ID NO: 4709767 - DNA, 12 bp, Homo sapiens
ccctcttgcccc

SEQ ID NO: 4709768 - DNA, 19 bp, Homo sapiens
ccctcttgccccaaccccc

SEQ ID NO: 4709769 - DNA, 22 bp, Homo sapiens
ccctcttgccccaacccccagc

SEQ ID NO: 4709770 - DNA, 20 bp, Homo sapiens
ccctgacactgcggggcttg

SEQ ID NO: 4709771 - DNA, 15 bp, Homo sapiens
ccctgactcattctg

SEQ ID NO: 4709772 - DNA, 23 bp, Homo sapiens
ccctgagcagaatactggtctca

SEQ ID NO: 4709773 - DNA, 16 bp, Homo sapiens
ccctgagctgaggcag

SEQ ID NO: 4709774 - DNA, 17 bp, Homo sapiens
ccctgagctgaggcagc

SEQ ID NO: 4709775 - DNA, 16 bp, Homo sapiens
ccctgaggcccagagg

SEQ ID NO: 4709776 - DNA, 18 bp, Homo sapiens
ccctgaggcccagagggc

SEQ ID NO: 4709777 - DNA, 20 bp, Homo sapiens
ccctgaggcccagagggcct

SEQ ID NO: 4709778 - DNA, 18 bp, Homo sapiens
ccctgataacaacctgga

SEQ ID NO: 4709779 - DNA, 15 bp, Homo sapiens
ccctgatcctgtgaa

SEQ ID NO: 4709780 - DNA, 17 bp, Homo sapiens
ccctgcaaagcccagct

SEQ ID NO: 4709781 - DNA, 20 bp, Homo sapiens
ccctgcaaagcccagcttga

SEQ ID NO: 4709782 - DNA, 16 bp, Homo sapiens
ccctgcaacctgattg

SEQ ID NO: 4709783 - DNA, 17 bp, Homo sapiens
ccctgcactgtcctgct

SEQ ID NO: 4709784 - DNA, 19 bp, Homo sapiens
ccctgcactgtcctgctcc

SEQ ID NO: 4709785 - DNA, 22 bp, Homo sapiens
ccctgcactgtcctgctccaca

SEQ ID NO: 4709786 - DNA, 18 bp, Homo sapiens
ccctgcaggaaggagctg

SEQ ID NO: 4709787 - DNA, 17 bp, Homo sapiens
ccctgccaccctgggga

SEQ ID NO: 4709788 - DNA, 14 bp, Homo sapiens
ccctgccacctcct

SEQ ID NO: 4709789 - DNA, 17 bp, Homo sapiens
ccctgcccacctggcct

SEQ ID NO: 4709790 - DNA, 14 bp, Homo sapiens
ccctgcccccagga

SEQ ID NO: 4709791 - DNA, 16 bp, Homo sapiens
ccctgcccccaggact

SEQ ID NO: 4709792 - DNA, 17 bp, Homo sapiens
ccctgcccccaggactg

SEQ ID NO: 4709793 - DNA, 15 bp, Homo sapiens
ccctgccccctgcag

SEQ ID NO: 4709794 - DNA, 15 bp, Homo sapiens
ccctgccctgtgggc

SEQ ID NO: 4709795 - DNA, 13 bp, Homo sapiens
ccctgcctctgtt

SEQ ID NO: 4709796 - DNA, 23 bp, Homo sapiens
ccctgctgagtcccaggctgagc

SEQ ID NO: 4709797 - DNA, 15 bp, Homo sapiens
ccctgctgcccctcc

SEQ ID NO: 4709798 - DNA, 13 bp, Homo sapiens
ccctgctgctgcc

SEQ ID NO: 4709799 - DNA, 17 bp, Homo sapiens
ccctgctgctgcctgcc

SEQ ID NO: 4709800 - DNA, 21 bp, Homo sapiens
ccctgctgggtgtggcgcagc

SEQ ID NO: 4709801 - DNA, 22 bp, Homo sapiens
ccctgctgggtgtggcgcagca

SEQ ID NO: 4709802 - DNA, 18 bp, Homo sapiens
ccctgctgtcccctcttg

SEQ ID NO: 4709803 - DNA, 18 bp, Homo sapiens
ccctggagtcatgccaag

SEQ ID NO: 4709804 - DNA, 20 bp, Homo sapiens
ccctggccaccaccccccac

SEQ ID NO: 4709805 - DNA, 23 bp, Homo sapiens
ccctggccaccaccccccactct

SEQ ID NO: 4709806 - DNA, 17 bp, Homo sapiens
ccctggccccagcccta

SEQ ID NO: 4709807 - DNA, 21 bp, Homo sapiens
ccctggcgtcctctccctcct

SEQ ID NO: 4709808 - DNA, 22 bp, Homo sapiens
ccctggcgtcctctccctcctg

SEQ ID NO: 4709809 - DNA, 14 bp, Homo sapiens
ccctggctgaagga

SEQ ID NO: 4709810 - DNA, 15 bp, Homo sapiens
ccctggctgaaggac

SEQ ID NO: 4709811 - DNA, 18 bp, Homo sapiens
ccctgggaggcagtgatg

SEQ ID NO: 4709812 - DNA, 17 bp, Homo sapiens
ccctgggctctgtgggc

SEQ ID NO: 4709813 - DNA, 20 bp, Homo sapiens
ccctgggctctgtgggctgc

SEQ ID NO: 4709814 - DNA, 19 bp, Homo sapiens
ccctggggacagcaagggc

SEQ ID NO: 4709815 - DNA, 14 bp, Homo sapiens
ccctgggtgggagc

SEQ ID NO: 4709816 - DNA, 13 bp, Homo sapiens
ccctggtggcagt

SEQ ID NO: 4709817 - DNA, 16 bp, Homo sapiens
ccctggtggcagtggg

SEQ ID NO: 4709818 - DNA, 22 bp, Homo sapiens
ccctggtggcagtgggagctgc

SEQ ID NO: 4709819 - DNA, 21 bp, Homo sapiens
ccctggtggccctctcccctg

SEQ ID NO: 4709820 - DNA, 22 bp, Homo sapiens
ccctggtggccctctcccctgc

SEQ ID NO: 4709821 - DNA, 17 bp, Homo sapiens
ccctggttctcatcttt

SEQ ID NO: 4709822 - DNA, 14 bp, Homo sapiens
cccacttcccctcc

SEQ ID NO: 4709823 - DNA, 20 bp, Homo sapiens
cccacttccctgacactgcg

SEQ ID NO: 4709824 - DNA, 23 bp, Homo sapiens
cccagaggaaggggccagaggct

SEQ ID NO: 4709825 - DNA, 15 bp, Homo sapiens
cccagaggagggcag

SEQ ID NO: 4709826 - DNA, 15 bp, Homo sapiens
cccagagggcctgca

SEQ ID NO: 4709827 - DNA, 14 bp, Homo sapiens
cccagaggggcctg

SEQ ID NO: 4709828 - DNA, 20 bp, Homo sapiens
cccagaggggcctgccacct

SEQ ID NO: 4709829 - DNA, 18 bp, Homo sapiens
cccagaggtaacagaaca

SEQ ID NO: 4709830 - DNA, 21 bp, Homo sapiens
cccagatgggggaaagcacag

SEQ ID NO: 4709831 - DNA, 21 bp, Homo sapiens
cccagattgcaacaggctggg

SEQ ID NO: 4709832 - DNA, 22 bp, Homo sapiens
cccagattgcaacaggctgggc

SEQ ID NO: 4709833 - DNA, 19 bp, Homo sapiens
cccagattggctcacactg

SEQ ID NO: 4709834 - DNA, 19 bp, Homo sapiens
cccagcaagtgagagctgg

SEQ ID NO: 4709835 - DNA, 20 bp, Homo sapiens
cccagcaagtgagagctggg

SEQ ID NO: 4709836 - DNA, 22 bp, Homo sapiens
cccagcaagtgagagctgggtg

SEQ ID NO: 4709837 - DNA, 23 bp, Homo sapiens
cccagcaagtgagagctgggtgt

SEQ ID NO: 4709838 - DNA, 21 bp, Homo sapiens
cccagcacccgggctcaggga

SEQ ID NO: 4709839 - DNA, 21 bp, Homo sapiens
cccagcactgcttgaggaaaa

SEQ ID NO: 4709840 - DNA, 16 bp, Homo sapiens
cccagcacttggagag

SEQ ID NO: 4709841 - DNA, 16 bp, Homo sapiens
cccagcagtggcttgc

SEQ ID NO: 4709842 - DNA, 14 bp, Homo sapiens
cccagcccacttct

SEQ ID NO: 4709843 - DNA, 16 bp, Homo sapiens
cccagccccaaggggt

SEQ ID NO: 4709844 - DNA, 13 bp, Homo sapiens
cccagccccaatg

SEQ ID NO: 4709845 - DNA, 17 bp, Homo sapiens
cccagccccaatgaaca

SEQ ID NO: 4709846 - DNA, 11 bp, Homo sapiens
cccagccccat

SEQ ID NO: 4709847 - DNA, 12 bp, Homo sapiens
cccagccccatc

SEQ ID NO: 4709848 - DNA, 18 bp, Homo sapiens
cccagccccatcctctgt

SEQ ID NO: 4709849 - DNA, 13 bp, Homo sapiens
cccagcccccacc

SEQ ID NO: 4709850 - DNA, 18 bp, Homo sapiens
cccagccccttctgaccc

SEQ ID NO: 4709851 - DNA, 14 bp, Homo sapiens
cccagccctcatcc

SEQ ID NO: 4709852 - DNA, 12 bp, Homo sapiens
cccagcctgcta

SEQ ID NO: 4709853 - DNA, 12 bp, Homo sapiens
cccagcctggcc

SEQ ID NO: 4709854 - DNA, 20 bp, Homo sapiens
cccagcctggcccagctccc

SEQ ID NO: 4709855 - DNA, 18 bp, Homo sapiens
cccagcgagccctggtgg

SEQ ID NO: 4709856 - DNA, 14 bp, Homo sapiens
cccagctctgaaac

SEQ ID NO: 4709857 - DNA, 14 bp, Homo sapiens
cccagctctgaggc

SEQ ID NO: 4709858 - DNA, 16 bp, Homo sapiens
cccagctctggtccat

SEQ ID NO: 4709859 - DNA, 18 bp, Homo sapiens
cccagctctggtccatag

SEQ ID NO: 4709860 - DNA, 23 bp, Homo sapiens
cccagctctggtccatagagagc

SEQ ID NO: 4709861 - DNA, 22 bp, Homo sapiens
cccagctgacagtcctctccac

SEQ ID NO: 4709862 - DNA, 15 bp, Homo sapiens
cccagcttgaaacct

SEQ ID NO: 4709863 - DNA, 19 bp, Homo sapiens
cccaggaaaggctccagga

SEQ ID NO: 4709864 - DNA, 20 bp, Homo sapiens
cccaggaccccatggcagtg

SEQ ID NO: 4709865 - DNA, 23 bp, Homo sapiens
cccaggacggggccggccaggtg

SEQ ID NO: 4709866 - DNA, 13 bp, Homo sapiens
cccaggactgggc

SEQ ID NO: 4709867 - DNA, 13 bp, Homo sapiens
cccaggaggccag

SEQ ID NO: 4709868 - DNA, 16 bp, Homo sapiens
cccaggaggccagcct

SEQ ID NO: 4709869 - DNA, 23 bp, Homo sapiens
cccaggcaggtcttgaactcctg

SEQ ID NO: 4709870 - DNA, 17 bp, Homo sapiens
cccaggccaggactctg

SEQ ID NO: 4709871 - DNA, 18 bp, Homo sapiens
cccaggccaggactctgc

SEQ ID NO: 4709872 - DNA, 17 bp, Homo sapiens
cccaggctggccagccc

SEQ ID NO: 4709873 - DNA, 12 bp, Homo sapiens
cccaggctgggc

SEQ ID NO: 4709874 - DNA, 15 bp, Homo sapiens
cccagggaagttttg

SEQ ID NO: 4709875 - DNA, 22 bp, Homo sapiens
cccaggtgctaggaacactcct

SEQ ID NO: 4709876 - DNA, 23 bp, Homo sapiens
cccaggtgctaggaacactcctt

SEQ ID NO: 4709877 - DNA, 14 bp, Homo sapiens
cccagtacctcctg

SEQ ID NO: 4709878 - DNA, 20 bp, Homo sapiens
cccagtacctcctgtctctg

SEQ ID NO: 4709879 - DNA, 18 bp, Homo sapiens
cccagtctggaatgcagt

SEQ ID NO: 4709880 - DNA, 15 bp, Homo sapiens
cccagtgaagatgca

SEQ ID NO: 4709881 - DNA, 20 bp, Homo sapiens
cccagtgcccacaggatcag

SEQ ID NO: 4709882 - DNA, 21 bp, Homo sapiens
cccagtgcccacaggatcagt

SEQ ID NO: 4709883 - DNA, 16 bp, Homo sapiens
cccagtggctgctgcc

SEQ ID NO: 4709884 - DNA, 21 bp, Homo sapiens
cccagtggctgctgcccaggc

SEQ ID NO: 4709885 - DNA, 15 bp, Homo sapiens
cccagttcctttaga

SEQ ID NO: 4709886 - DNA, 14 bp, Homo sapiens
cccagttgggtgga

SEQ ID NO: 4709887 - DNA, 15 bp, Homo sapiens
cccagtttcccactc

SEQ ID NO: 4709888 - DNA, 16 bp, Homo sapiens
cccatacaaataagca

SEQ ID NO: 4709889 - DNA, 17 bp, Homo sapiens
cccatcaggactcttgt

SEQ ID NO: 4709890 - DNA, 19 bp, Homo sapiens
cccatcaggactcttgtga

SEQ ID NO: 4709891 - DNA, 23 bp, Homo sapiens
cccatcagtgtacccccgcccag

SEQ ID NO: 4709892 - DNA, 12 bp, Homo sapiens
cccatcccccct

SEQ ID NO: 4709893 - DNA, 16 bp, Homo sapiens
cccatcccccctcacc

SEQ ID NO: 4709894 - DNA, 20 bp, Homo sapiens
cccatcccccctcaccaggg

SEQ ID NO: 4709895 - DNA, 15 bp, Homo sapiens
cccatcctctgtaca

SEQ ID NO: 4709896 - DNA, 20 bp, Homo sapiens
cccatcctctgtacagagcc

SEQ ID NO: 4709897 - DNA, 21 bp, Homo sapiens
cccatcctctgtacagagccc

SEQ ID NO: 4709898 - DNA, 16 bp, Homo sapiens
cccatcctggcccatc

SEQ ID NO: 4709899 - DNA, 17 bp, Homo sapiens
cccatcctggcccatca

SEQ ID NO: 4709900 - DNA, 16 bp, Homo sapiens
cccatctgcccaggac

SEQ ID NO: 4709901 - DNA, 18 bp, Homo sapiens
cccatgagacagtcccag

SEQ ID NO: 4709902 - DNA, 16 bp, Homo sapiens
cccatgagcctcagca

SEQ ID NO: 4709903 - DNA, 20 bp, Homo sapiens
cccatgagcctcagcatcct

SEQ ID NO: 4709904 - DNA, 22 bp, Homo sapiens
cccatgagcctcagcatcctgg

SEQ ID NO: 4709905 - DNA, 15 bp, Homo sapiens
cccatgctgccctgt

SEQ ID NO: 4709906 - DNA, 16 bp, Homo sapiens
cccatgctgccctgtg

SEQ ID NO: 4709907 - DNA, 16 bp, Homo sapiens
cccatggaggagacag

SEQ ID NO: 4709908 - DNA, 16 bp, Homo sapiens
cccatgggcactgctg

SEQ ID NO: 4709909 - DNA, 18 bp, Homo sapiens
cccatgggcactgctggg

SEQ ID NO: 4709910 - DNA, 19 bp, Homo sapiens
cccattctgcctgcccagg

SEQ ID NO: 4709911 - DNA, 18 bp, Homo sapiens
ccccaaaactctcctctg

SEQ ID NO: 4709912 - DNA, 21 bp, Homo sapiens
ccccaaatggaaatgggcaga

SEQ ID NO: 4709913 - DNA, 23 bp, Homo sapiens
cctgcctcgaactggctgcaaag

SEQ ID NO: 4709914 - DNA, 14 bp, Homo sapiens
cctgcctctgtttg

SEQ ID NO: 4709915 - DNA, 15 bp, Homo sapiens
cctgcctctgtttga

SEQ ID NO: 4709916 - DNA, 14 bp, Homo sapiens
cctgccttctcagg

SEQ ID NO: 4709917 - DNA, 15 bp, Homo sapiens
cctgccttctcaggg

SEQ ID NO: 4709918 - DNA, 22 bp, Homo sapiens
cctgcggtgctatctcccccag

SEQ ID NO: 4709919 - DNA, 17 bp, Homo sapiens
cctgcgtgtgtctgtgt

SEQ ID NO: 4709920 - DNA, 19 bp, Homo sapiens
cctgctcacgtcaaatgca

SEQ ID NO: 4709921 - DNA, 20 bp, Homo sapiens
cctgctccacagccatccca

SEQ ID NO: 4709922 - DNA, 18 bp, Homo sapiens
cctgctccttcccaggag

SEQ ID NO: 4709923 - DNA, 21 bp, Homo sapiens
cctgctctccgaccagacacc

SEQ ID NO: 4709924 - DNA, 22 bp, Homo sapiens
cctgctgcagaggggcaggccc

SEQ ID NO: 4709925 - DNA, 17 bp, Homo sapiens
cctgctgcagttgccag

SEQ ID NO: 4709926 - DNA, 19 bp, Homo sapiens
cctgctgcagttgccagtc

SEQ ID NO: 4709927 - DNA, 22 bp, Homo sapiens
cctgctgcagttgccagtcacc

SEQ ID NO: 4709928 - DNA, 23 bp, Homo sapiens
cctgctgcccctccctgcctcca

SEQ ID NO: 4709929 - DNA, 17 bp, Homo sapiens
cctgctgctgcctgcct

SEQ ID NO: 4709930 - DNA, 18 bp, Homo sapiens
cctgctgctgcctgcctg

SEQ ID NO: 4709931 - DNA, 21 bp, Homo sapiens
cctgctgggtgtggcgcagca

SEQ ID NO: 4709932 - DNA, 17 bp, Homo sapiens
cctgctggttcactcta

SEQ ID NO: 4709933 - DNA, 15 bp, Homo sapiens
cctgctgtcccctct

SEQ ID NO: 4709934 - DNA, 22 bp, Homo sapiens
cctggaaggacatccatgttcc

SEQ ID NO: 4709935 - DNA, 14 bp, Homo sapiens
cctggacccctgca

SEQ ID NO: 4709936 - DNA, 22 bp, Homo sapiens
cctggacccgttcatgggggag

SEQ ID NO: 4709937 - DNA, 21 bp, Homo sapiens
cctggagagccagaacctgga

SEQ ID NO: 4709938 - DNA, 22 bp, Homo sapiens
cctggagagccagaacctggag

SEQ ID NO: 4709939 - DNA, 23 bp, Homo sapiens
cctggagagccagaacctggagg

SEQ ID NO: 4709940 - DNA, 21 bp, Homo sapiens
cctggagagctagaacctaga

SEQ ID NO: 4709941 - DNA, 18 bp, Homo sapiens
cctggagtcatgccaagc

SEQ ID NO: 4709942 - DNA, 13 bp, Homo sapiens
cctggatgcagcc

SEQ ID NO: 4709943 - DNA, 14 bp, Homo sapiens
cctggatgcagcct

SEQ ID NO: 4709944 - DNA, 19 bp, Homo sapiens
cctggatgcagcctcacag

SEQ ID NO: 4709945 - DNA, 18 bp, Homo sapiens
cctggcacccggcccctg

SEQ ID NO: 4709946 - DNA, 19 bp, Homo sapiens
cctggcacccggcccctgc

SEQ ID NO: 4709947 - DNA, 12 bp, Homo sapiens
cctggcactgct

SEQ ID NO: 4709948 - DNA, 13 bp, Homo sapiens
cctggcactgctt

SEQ ID NO: 4709949 - DNA, 20 bp, Homo sapiens
cctggcaggttagaacctag

SEQ ID NO: 4709950 - DNA, 21 bp, Homo sapiens
cctggcaggttagaacctaga

SEQ ID NO: 4709951 - DNA, 13 bp, Homo sapiens
cctggcatttcac

SEQ ID NO: 4709952 - DNA, 17 bp, Homo sapiens
cctggccaccacccccc

SEQ ID NO: 4709953 - DNA, 21 bp, Homo sapiens
cctggccaccaccccccactc

SEQ ID NO: 4709954 - DNA, 20 bp, Homo sapiens
cctggccagatgcaccagcc

SEQ ID NO: 4709955 - DNA, 12 bp, Homo sapiens
cctggcccagct

SEQ ID NO: 4709956 - DNA, 18 bp, Homo sapiens
cctggccccatggtcagc

SEQ ID NO: 4709957 - DNA, 14 bp, Homo sapiens
cctggcccctcagg

SEQ ID NO: 4709958 - DNA, 18 bp, Homo sapiens
cctggcccctcagggtcc

SEQ ID NO: 4709959 - DNA, 14 bp, Homo sapiens
cctggcctccccca

SEQ ID NO: 4709960 - DNA, 18 bp, Homo sapiens
cctggcctcccccacttt

SEQ ID NO: 4709961 - DNA, 15 bp, Homo sapiens
cctggcctctgcact

SEQ ID NO: 4709962 - DNA, 20 bp, Homo sapiens
cctggcctctgcactcccct

SEQ ID NO: 4709963 - DNA, 21 bp, Homo sapiens
cctggcctctgcactcccctg

SEQ ID NO: 4709964 - DNA, 14 bp, Homo sapiens
cctggcctgagctg

SEQ ID NO: 4709965 - DNA, 16 bp, Homo sapiens
cctggcctgaggtctc

SEQ ID NO: 4709966 - DNA, 18 bp, Homo sapiens
cctggcgacaagagtgag

SEQ ID NO: 4709967 - DNA, 20 bp, Homo sapiens
cctggcgtcctctccctcct

SEQ ID NO: 4709968 - DNA, 23 bp, Homo sapiens
cctggcgtcctctccctcctggc

SEQ ID NO: 4709969 - DNA, 20 bp, Homo sapiens
cctggctccaaaccctcgag

SEQ ID NO: 4709970 - DNA, 14 bp, Homo sapiens
cctggctgaaggac

SEQ ID NO: 4709971 - DNA, 16 bp, Homo sapiens
cctggctgaaggactg

SEQ ID NO: 4709972 - DNA, 18 bp, Homo sapiens
cctgggaaatattcccta

SEQ ID NO: 4709973 - DNA, 12 bp, Homo sapiens
cctgggaagggg

SEQ ID NO: 4709974 - DNA, 16 bp, Homo sapiens
cctgggacggctgagc

SEQ ID NO: 4709975 - DNA, 14 bp, Homo sapiens
cctgggagccaggg

SEQ ID NO: 4709976 - DNA, 13 bp, Homo sapiens
cctgggaggcagt

SEQ ID NO: 4709977 - DNA, 16 bp, Homo sapiens
cctgggagtgagctgg

SEQ ID NO: 4709978 - DNA, 18 bp, Homo sapiens
cctgggagtgagctggtt

SEQ ID NO: 4709979 - DNA, 20 bp, Homo sapiens
cctgggatccctcatcctca

SEQ ID NO: 4709980 - DNA, 21 bp, Homo sapiens
cctgggcaaatgaatggctca

SEQ ID NO: 4709981 - DNA, 13 bp, Homo sapiens
cctgggctctgtg

SEQ ID NO: 4709982 - DNA, 16 bp, Homo sapiens
cctgggggctcctcac

SEQ ID NO: 4709983 - DNA, 12 bp, Homo sapiens
cctggggggcag

SEQ ID NO: 4709984 - DNA, 16 bp, Homo sapiens
cctgggggtgccagga

SEQ ID NO: 4709985 - DNA, 16 bp, Homo sapiens
cctggtggcagctcac

SEQ ID NO: 4709986 - DNA, 17 bp, Homo sapiens
cctggtggcagctgcgg

SEQ ID NO: 4709987 - DNA, 18 bp, Homo sapiens
cctggtggcagtgggagc

SEQ ID NO: 4709988 - DNA, 21 bp, Homo sapiens
cctggtggccctctcccctgc

SEQ ID NO: 4709989 - DNA, 23 bp, Homo sapiens
cctggtggccctctcccctgccc

SEQ ID NO: 4709990 - DNA, 13 bp, Homo sapiens
cctggttctcatc

SEQ ID NO: 4709991 - DNA, 15 bp, Homo sapiens
cctggttctcatctt

SEQ ID NO: 4709992 - DNA, 18 bp, Homo sapiens
cctggtttcctgccctgg

SEQ ID NO: 4709993 - DNA, 16 bp, Homo sapiens
cctgtaaaccaaagtt

SEQ ID NO: 4709994 - DNA, 16 bp, Homo sapiens
cctgtaccaaatctga

SEQ ID NO: 4709995 - DNA, 23 bp, Homo sapiens
cctgtactgtatggaaacactga

SEQ ID NO: 4709996 - DNA, 14 bp, Homo sapiens
cctgtagagctaga

SEQ ID NO: 4709997 - DNA, 15 bp, Homo sapiens
cctgtcacttgctgg

SEQ ID NO: 4709998 - DNA, 22 bp, Homo sapiens
cctgtcattcccaccaccctga

SEQ ID NO: 4709999 - DNA, 15 bp, Homo sapiens
cctgtccccctgaca

SEQ ID NO: 4710000 - DNA, 13 bp, Homo sapiens
cctgtcctgtgct

SEQ ID NO: 4710001 - DNA, 22 bp, Homo sapiens
cctgtgaaagactcaatgagct

SEQ ID NO: 4710002 - DNA, 15 bp, Homo sapiens
cctgtgatgtcccag

SEQ ID NO: 4710003 - DNA, 12 bp, Homo sapiens
cctgtggatatt

SEQ ID NO: 4710004 - DNA, 20 bp, Homo sapiens
cctgtggccaagttcttagt

SEQ ID NO: 4710005 - DNA, 20 bp, Homo sapiens
cctgtgggcccccaaatgga

SEQ ID NO: 4710006 - DNA, 19 bp, Homo sapiens
cctgtgtcttgcaatggca

SEQ ID NO: 4710007 - DNA, 21 bp, Homo sapiens
cctgtgtgcgagtctgagtca

SEQ ID NO: 4710008 - DNA, 21 bp, Homo sapiens
cctgtgtgtgcgcctacagga

SEQ ID NO: 4710009 - DNA, 13 bp, Homo sapiens
cctgttagccagg

SEQ ID NO: 4710010 - DNA, 14 bp, Homo sapiens
cctgttcagctcca

SEQ ID NO: 4710011 - DNA, 18 bp, Homo sapiens
cctgtttgtttctgaaag

SEQ ID NO: 4710012 - DNA, 20 bp, Homo sapiens
ccttaaacaaaaattaaaat

SEQ ID NO: 4710013 - DNA, 12 bp, Homo sapiens
ccttaataaata

SEQ ID NO: 4710014 - DNA, 23 bp, Homo sapiens
ccttaataaatatagttgtcttt

SEQ ID NO: 4710015 - DNA, 15 bp, Homo sapiens
ccttacacttactgt

SEQ ID NO: 4710016 - DNA, 18 bp, Homo sapiens
cctataaatctaatgaca

SEQ ID NO: 4710017 - DNA, 16 bp, Homo sapiens
cctatcagtgtgcccc

SEQ ID NO: 4710018 - DNA, 20 bp, Homo sapiens
cctatctttgccaccctcat

SEQ ID NO: 4710019 - DNA, 21 bp, Homo sapiens
cctatgcatggtgtagatgcc

SEQ ID NO: 4710020 - DNA, 18 bp, Homo sapiens
cctatgggagtcaagtgt

SEQ ID NO: 4710021 - DNA, 21 bp, Homo sapiens
cctcaaacactgcaggcatca

SEQ ID NO: 4710022 - DNA, 14 bp, Homo sapiens
cctcaaatgagaaa

SEQ ID NO: 4710023 - DNA, 16 bp, Homo sapiens
cctcaacctcctgggc

SEQ ID NO: 4710024 - DNA, 17 bp, Homo sapiens
cctcaaggcctcccaca

SEQ ID NO: 4710025 - DNA, 18 bp, Homo sapiens
cctcaaggcctcccacag

SEQ ID NO: 4710026 - DNA, 20 bp, Homo sapiens
cctcaaggcctcccacagtg

SEQ ID NO: 4710027 - DNA, 21 bp, Homo sapiens
cctcaaggcctcccacagtga

SEQ ID NO: 4710028 - DNA, 20 bp, Homo sapiens
cctcaagtgattctcctgcc

SEQ ID NO: 4710029 - DNA, 23 bp, Homo sapiens
cctcaagtgattctcctgcctca

SEQ ID NO: 4710030 - DNA, 13 bp, Homo sapiens
cctcaatccagct

SEQ ID NO: 4710031 - DNA, 17 bp, Homo sapiens
cctcacatggcgtcctg

SEQ ID NO: 4710032 - DNA, 20 bp, Homo sapiens
cctcaccaggggcaggcaca

SEQ ID NO: 4710033 - DNA, 22 bp, Homo sapiens
cctcaccaggggcaggcacagc

SEQ ID NO: 4710034 - DNA, 21 bp, Homo sapiens
cctcacccctggttctcatct

SEQ ID NO: 4710035 - DNA, 16 bp, Homo sapiens
cctcaccgcggctgga

SEQ ID NO: 4710036 - DNA, 16 bp, Homo sapiens
cctcagcatcctggca

SEQ ID NO: 4710037 - DNA, 23 bp, Homo sapiens
cctcagcctcccaaagtgctggg

SEQ ID NO: 4710038 - DNA, 17 bp, Homo sapiens
cctcagggtccctggtg

SEQ ID NO: 4710039 - DNA, 11 bp, Homo sapiens
cctcagtgcca

SEQ ID NO: 4710040 - DNA, 13 bp, Homo sapiens
cctcatacccacc

SEQ ID NO: 4710041 - DNA, 17 bp, Homo sapiens
cctcatagccctcaccc

SEQ ID NO: 4710042 - DNA, 18 bp, Homo sapiens
cctcatagccctcaccct

SEQ ID NO: 4710043 - DNA, 21 bp, Homo sapiens
cctcatagtatggtggctggg

SEQ ID NO: 4710044 - DNA, 13 bp, Homo sapiens
cctcatcaggagt

SEQ ID NO: 4710045 - DNA, 22 bp, Homo sapiens
cctcatcaggagttccagtgct

SEQ ID NO: 4710046 - DNA, 20 bp, Homo sapiens
cctcatcccgagcacctcca

SEQ ID NO: 4710047 - DNA, 18 bp, Homo sapiens
cctcatcttcttcaccat

SEQ ID NO: 4710048 - DNA, 17 bp, Homo sapiens
cctcatgtcatttctca

SEQ ID NO: 4710049 - DNA, 22 bp, Homo sapiens
cctcattactttaccaccccca

SEQ ID NO: 4710050 - DNA, 10 bp, Homo sapiens
cctcattttg

SEQ ID NO: 4710051 - DNA, 12 bp, Homo sapiens
cctcattttgaa

SEQ ID NO: 4710052 - DNA, 16 bp, Homo sapiens
cctccaagaccttctc

SEQ ID NO: 4710053 - DNA, 20 bp, Homo sapiens
cctccaagaccttctccttc

SEQ ID NO: 4710054 - DNA, 21 bp, Homo sapiens
cctccaagtccacagtggaac

SEQ ID NO: 4710055 - DNA, 21 bp, Homo sapiens
cctccacaactcagtttcata

SEQ ID NO: 4710056 - DNA, 15 bp, Homo sapiens
cctccacacctgcgg

SEQ ID NO: 4710057 - DNA, 20 bp, Homo sapiens
cctccacatcctccacgttc

SEQ ID NO: 4710058 - DNA, 19 bp, Homo sapiens
cctccactctcccccaccc

SEQ ID NO: 4710059 - DNA, 22 bp, Homo sapiens
cctccactctcccccaccccct

SEQ ID NO: 4710060 - DNA, 13 bp, Homo sapiens
cctccagggacag

SEQ ID NO: 4710061 - DNA, 12 bp, Homo sapiens
cctccagggctg

SEQ ID NO: 4710062 - DNA, 13 bp, Homo sapiens
cctccagggctgg

SEQ ID NO: 4710063 - DNA, 17 bp, Homo sapiens
cctccaggtgcacaagc

SEQ ID NO: 4710064 - DNA, 21 bp, Homo sapiens
cctccaggtgcacaagctcca

SEQ ID NO: 4710065 - DNA, 18 bp, Homo sapiens
cctccatctaaactgccc

SEQ ID NO: 4710066 - DNA, 21 bp, Homo sapiens
cctcccaactcaccccagccc

SEQ ID NO: 4710067 - DNA, 15 bp, Homo sapiens
cctcccacctcagcc

SEQ ID NO: 4710068 - DNA, 21 bp, Homo sapiens
cctcccagcagtggcttgctt

SEQ ID NO: 4710069 - DNA, 17 bp, Homo sapiens
cctcccagtacctcctg

SEQ ID NO: 4710070 - DNA, 12 bp, Homo sapiens
cctcccatcacc

SEQ ID NO: 4710071 - DNA, 13 bp, Homo sapiens
cctcccctgccag

SEQ ID NO: 4710072 - DNA, 21 bp, Homo sapiens
cctcccgagtagctgggacta

SEQ ID NO: 4710073 - DNA, 18 bp, Homo sapiens
cctccctcaaagaaatcc

SEQ ID NO: 4710074 - DNA, 12 bp, Homo sapiens
cctccctgctgt

SEQ ID NO: 4710075 - DNA, 19 bp, Homo sapiens
cctccctgctgtcccctct

SEQ ID NO: 4710076 - DNA, 20 bp, Homo sapiens
cctccctgctgtcccctctt

SEQ ID NO: 4710077 - DNA, 13 bp, Homo sapiens
cctccctttctcc

SEQ ID NO: 4710078 - DNA, 14 bp, Homo sapiens
cctccctttctccc

SEQ ID NO: 4710079 - DNA, 17 bp, Homo sapiens
cctccctttttccttgt

SEQ ID NO: 4710080 - DNA, 18 bp, Homo sapiens
cctccctttttccttgtc

SEQ ID NO: 4710081 - DNA, 13 bp, Homo sapiens
cctccgcctcttg

SEQ ID NO: 4710082 - DNA, 13 bp, Homo sapiens
cctccgtggcaca

SEQ ID NO: 4710083 - DNA, 16 bp, Homo sapiens
cctcctacccctccca

SEQ ID NO: 4710084 - DNA, 19 bp, Homo sapiens
cctcctacccctcccagct

SEQ ID NO: 4710085 - DNA, 20 bp, Homo sapiens
cctcctacccctcccagctg

SEQ ID NO: 4710086 - DNA, 15 bp, Homo sapiens
cctcctccagggaca

SEQ ID NO: 4710087 - DNA, 14 bp, Homo sapiens
cctcctcccttttt

SEQ ID NO: 4710088 - DNA, 12 bp, Homo sapiens
cctcctctgtga

SEQ ID NO: 4710089 - DNA, 14 bp, Homo sapiens
cctcctctgtgaaa

SEQ ID NO: 4710090 - DNA, 15 bp, Homo sapiens
cctcctctgtgaaac

SEQ ID NO: 4710091 - DNA, 13 bp, Homo sapiens
cctcctgcctcga

SEQ ID NO: 4710092 - DNA, 23 bp, Homo sapiens
cctcctgcctcgaactggctgca

SEQ ID NO: 4710093 - DNA, 12 bp, Homo sapiens
cctcctgctgca

SEQ ID NO: 4710094 - DNA, 22 bp, Homo sapiens
cctcctgggttcacaccattct

SEQ ID NO: 4710095 - DNA, 13 bp, Homo sapiens
cctcctgtgtgtg

SEQ ID NO: 4710096 - DNA, 22 bp, Homo sapiens
cctcctgtgtgtgcgcctacag

SEQ ID NO: 4710097 - DNA, 20 bp, Homo sapiens
cctcctgtgttgtgctggga

SEQ ID NO: 4710098 - DNA, 18 bp, Homo sapiens
cctccttatcaaaggaca

SEQ ID NO: 4710099 - DNA, 22 bp, Homo sapiens
cctccttctctgtctcatgtgt

SEQ ID NO: 4710100 - DNA, 10 bp, Homo sapiens
cctcctttcc

SEQ ID NO: 4710101 - DNA, 16 bp, Homo sapiens
cctcctttctcttctc

SEQ ID NO: 4710102 - DNA, 21 bp, Homo sapiens
cctcgaggtttctcaaagaaa

SEQ ID NO: 4710103 - DNA, 19 bp, Homo sapiens
cctcgatgtcctcctctgt

SEQ ID NO: 4710104 - DNA, 20 bp, Homo sapiens
cctcgatgtcctcctctgtg

SEQ ID NO: 4710105 - DNA, 22 bp, Homo sapiens
cctcgatgtcctcctctgtgaa

SEQ ID NO: 4710106 - DNA, 19 bp, Homo sapiens
cctcgcccaccgcatgccc

SEQ ID NO: 4710107 - DNA, 16 bp, Homo sapiens
cctcgcctggcctgag

SEQ ID NO: 4710108 - DNA, 14 bp, Homo sapiens
cctcgctgccagct

SEQ ID NO: 4710109 - DNA, 17 bp, Homo sapiens
cctcgctggactctcag

SEQ ID NO: 4710110 - DNA, 18 bp, Homo sapiens
cctcgctggactctcagt

SEQ ID NO: 4710111 - DNA, 22 bp, Homo sapiens
cctcggctcctgctgcaccaac

SEQ ID NO: 4710112 - DNA, 13 bp, Homo sapiens
cctcgggcctgct

SEQ ID NO: 4710113 - DNA, 12 bp, Homo sapiens
cctcgtgccagt

SEQ ID NO: 4710114 - DNA, 15 bp, Homo sapiens
cctcgtttgatagtg

SEQ ID NO: 4710115 - DNA, 20 bp, Homo sapiens
cctcgtttgatagtgcttct

SEQ ID NO: 4710116 - DNA, 12 bp, Homo sapiens
ctaccatttcac

SEQ ID NO: 4710117 - DNA, 17 bp, Homo sapiens
ctacccaccctcctttc

SEQ ID NO: 4710118 - DNA, 16 bp, Homo sapiens
ctaccccaattccttg

SEQ ID NO: 4710119 - DNA, 15 bp, Homo sapiens
ctacccgggaagggg

SEQ ID NO: 4710120 - DNA, 20 bp, Homo sapiens
ctacccgggaagggggctgg

SEQ ID NO: 4710121 - DNA, 15 bp, Homo sapiens
ctaccctccctgctg

SEQ ID NO: 4710122 - DNA, 20 bp, Homo sapiens
ctaccctccctgctgtcccc

SEQ ID NO: 4710123 - DNA, 17 bp, Homo sapiens
ctacccttggaaagaaa

SEQ ID NO: 4710124 - DNA, 16 bp, Homo sapiens
ctaccgtcttttcctg

SEQ ID NO: 4710125 - DNA, 19 bp, Homo sapiens
ctaccttgtgagggagaga

SEQ ID NO: 4710126 - DNA, 16 bp, Homo sapiens
ctactaattttttaag

SEQ ID NO: 4710127 - DNA, 22 bp, Homo sapiens
ctactacatctgtgatgactgg

SEQ ID NO: 4710128 - DNA, 16 bp, Homo sapiens
ctactcattccccggg

SEQ ID NO: 4710129 - DNA, 14 bp, Homo sapiens
ctactcctgggtca

SEQ ID NO: 4710130 - DNA, 13 bp, Homo sapiens
ctactctgtgtca

SEQ ID NO: 4710131 - DNA, 16 bp, Homo sapiens
ctactctgtgtcaggt

SEQ ID NO: 4710132 - DNA, 17 bp, Homo sapiens
ctactgcttcctctgaa

SEQ ID NO: 4710133 - DNA, 19 bp, Homo sapiens
ctactgtattcccacaagg

SEQ ID NO: 4710134 - DNA, 20 bp, Homo sapiens
ctacttccccttcctaattc

SEQ ID NO: 4710135 - DNA, 19 bp, Homo sapiens
ctacttctctgagtcagct

SEQ ID NO: 4710136 - DNA, 20 bp, Homo sapiens
ctacttctctgagtcagctg

SEQ ID NO: 4710137 - DNA, 18 bp, Homo sapiens
ctacttctgtaattgtgt

SEQ ID NO: 4710138 - DNA, 22 bp, Homo sapiens
ctacttctttgctttgcccagc

SEQ ID NO: 4710139 - DNA, 11 bp, Homo sapiens
ctactttccat

SEQ ID NO: 4710140 - DNA, 16 bp, Homo sapiens
ctagaaagtaagaaaa

SEQ ID NO: 4710141 - DNA, 18 bp, Homo sapiens
ctagaacctagaagggct

SEQ ID NO: 4710142 - DNA, 14 bp, Homo sapiens
ctagaacctggaga

SEQ ID NO: 4710143 - DNA, 16 bp, Homo sapiens
ctagaacctggagggc

SEQ ID NO: 4710144 - DNA, 18 bp, Homo sapiens
ctagaacctggagggctg

SEQ ID NO: 4710145 - DNA, 21 bp, Homo sapiens
ctagacccactggactcacct

SEQ ID NO: 4710146 - DNA, 15 bp, Homo sapiens
ctagagcagccctgg

SEQ ID NO: 4710147 - DNA, 14 bp, Homo sapiens
ctagaggccaggga

SEQ ID NO: 4710148 - DNA, 22 bp, Homo sapiens
ctagaggggggatttccagcca

SEQ ID NO: 4710149 - DNA, 15 bp, Homo sapiens
ctagatcactgtgct

SEQ ID NO: 4710150 - DNA, 17 bp, Homo sapiens
ctagatcactgtgctta

SEQ ID NO: 4710151 - DNA, 20 bp, Homo sapiens
ctagcactgcacactcagtt

SEQ ID NO: 4710152 - DNA, 22 bp, Homo sapiens
ctagcattgtaaaattatttca

SEQ ID NO: 4710153 - DNA, 23 bp, Homo sapiens
ctagcattgtaaaattatttcat

SEQ ID NO: 4710154 - DNA, 15 bp, Homo sapiens
ctagctaattattta

SEQ ID NO: 4710155 - DNA, 16 bp, Homo sapiens
ctagctaattatttaa

SEQ ID NO: 4710156 - DNA, 14 bp, Homo sapiens
ctagctcccctcct

SEQ ID NO: 4710157 - DNA, 17 bp, Homo sapiens
ctaggaaatccagggtg

SEQ ID NO: 4710158 - DNA, 15 bp, Homo sapiens
ctaggaacactcctt

SEQ ID NO: 4710159 - DNA, 22 bp, Homo sapiens
ctaggacccctccatgtgggct

SEQ ID NO: 4710160 - DNA, 15 bp, Homo sapiens
ctaggcctggccaga

SEQ ID NO: 4710161 - DNA, 19 bp, Homo sapiens
ctaggcctggccagatgca

SEQ ID NO: 4710162 - DNA, 20 bp, Homo sapiens
ctagggaaatgatcagtttt

SEQ ID NO: 4710163 - DNA, 16 bp, Homo sapiens
ctagggacccctcctc

SEQ ID NO: 4710164 - DNA, 17 bp, Homo sapiens
ctagggacccctcctcc

SEQ ID NO: 4710165 - DNA, 17 bp, Homo sapiens
ctagggatccctcatct

SEQ ID NO: 4710166 - DNA, 16 bp, Homo sapiens
ctagggccaagcccag

SEQ ID NO: 4710167 - DNA, 15 bp, Homo sapiens
ctagggccactgaag

SEQ ID NO: 4710168 - DNA, 20 bp, Homo sapiens
ctaggtacgatgacagtgtt

SEQ ID NO: 4710169 - DNA, 14 bp, Homo sapiens
ctaggtgacagagt

SEQ ID NO: 4710170 - DNA, 17 bp, Homo sapiens
ctaggtggcaaggctgt

SEQ ID NO: 4710171 - DNA, 16 bp, Homo sapiens
ctagtagaacaatgta

SEQ ID NO: 4710172 - DNA, 12 bp, Homo sapiens
ctagtgctgtaa

SEQ ID NO: 4710173 - DNA, 20 bp, Homo sapiens
ctagtgctgtaatattgtaa

SEQ ID NO: 4710174 - DNA, 22 bp, Homo sapiens
ctagtgctgtaatattgtaaat

SEQ ID NO: 4710175 - DNA, 23 bp, Homo sapiens
ctagtgctgtaatattgtaaata

SEQ ID NO: 4710176 - DNA, 19 bp, Homo sapiens
ctagtggctgtccagtgcc

SEQ ID NO: 4710177 - DNA, 16 bp, Homo sapiens
ctagtggtctttgtaa

SEQ ID NO: 4710178 - DNA, 17 bp, Homo sapiens
ctagtggtctttgtaag

SEQ ID NO: 4710179 - DNA, 18 bp, Homo sapiens
ctagtggtctttgtaaga

SEQ ID NO: 4710180 - DNA, 15 bp, Homo sapiens
ctagttaaaagcctt

SEQ ID NO: 4710181 - DNA, 15 bp, Homo sapiens
ctagttattttctga

SEQ ID NO: 4710182 - DNA, 14 bp, Homo sapiens
ctagttccaccatc

SEQ ID NO: 4710183 - DNA, 20 bp, Homo sapiens
ctagttccaccatcaagcca

SEQ ID NO: 4710184 - DNA, 22 bp, Homo sapiens
ctagttccaccatcaagccacc

SEQ ID NO: 4710185 - DNA, 22 bp, Homo sapiens
ctagttgtttgattcagacagc

SEQ ID NO: 4710186 - DNA, 23 bp, Homo sapiens
ctagttgtttgattcagacagct

SEQ ID NO: 4710187 - DNA, 13 bp, Homo sapiens
ctataatttaaat

SEQ ID NO: 4710188 - DNA, 17 bp, Homo sapiens
ctatagcctaggtgaca

SEQ ID NO: 4710189 - DNA, 16 bp, Homo sapiens
ctatatattttatgat

SEQ ID NO: 4710190 - DNA, 14 bp, Homo sapiens
ctatattgtacaca

SEQ ID NO: 4710191 - DNA, 15 bp, Homo sapiens
ctatattgtacacac

SEQ ID NO: 4710192 - DNA, 20 bp, Homo sapiens
ctatatttgtgctatttaat

SEQ ID NO: 4710193 - DNA, 21 bp, Homo sapiens
ctatatttgtgctatttaatt

SEQ ID NO: 4710194 - DNA, 14 bp, Homo sapiens
ctatcaaaagaaat

SEQ ID NO: 4710195 - DNA, 18 bp, Homo sapiens
ctatcagactaagccagc

SEQ ID NO: 4710196 - DNA, 12 bp, Homo sapiens
ctatcagtgtgc

SEQ ID NO: 4710197 - DNA, 16 bp, Homo sapiens
ctatcagtgtgccccc

SEQ ID NO: 4710198 - DNA, 14 bp, Homo sapiens
ctatccaaataaaa

SEQ ID NO: 4710199 - DNA, 16 bp, Homo sapiens
ctatcccggctgccct

SEQ ID NO: 4710200 - DNA, 17 bp, Homo sapiens
ctatctgacttcataca

SEQ ID NO: 4710201 - DNA, 15 bp, Homo sapiens
ctatctgcaatgttt

SEQ ID NO: 4710202 - DNA, 22 bp, Homo sapiens
ctatctgcaatgtttttgtgta

SEQ ID NO: 4710203 - DNA, 12 bp, Homo sapiens
ctatctttgcca

SEQ ID NO: 4710204 - DNA, 14 bp, Homo sapiens
ctatctttgccacc

SEQ ID NO: 4710205 - DNA, 15 bp, Homo sapiens
ctatctttgccaccc

SEQ ID NO: 4710206 - DNA, 21 bp, Homo sapiens
ctatgacctcgccctccacaa

SEQ ID NO: 4710207 - DNA, 15 bp, Homo sapiens
ctatgactgtgttta

SEQ ID NO: 4710208 - DNA, 16 bp, Homo sapiens
ctatgataaattatga

SEQ ID NO: 4710209 - DNA, 21 bp, Homo sapiens
ctatgataaattatgataata

SEQ ID NO: 4710210 - DNA, 15 bp, Homo sapiens
ctatgatttggaaaa

SEQ ID NO: 4710211 - DNA, 19 bp, Homo sapiens
ctatgatttggaaaataaa

SEQ ID NO: 4710212 - DNA, 19 bp, Homo sapiens
ctatggacggtgctccagg

SEQ ID NO: 4710213 - DNA, 23 bp, Homo sapiens
ctatggacggtgctccaggcagg

SEQ ID NO: 4710214 - DNA, 18 bp, Homo sapiens
ctatgggactcaatgcac

SEQ ID NO: 4710215 - DNA, 21 bp, Homo sapiens
ctatggtgccaatggaacctc

SEQ ID NO: 4710216 - DNA, 22 bp, Homo sapiens
ctatgtaacatgtaggaagtag

SEQ ID NO: 4710217 - DNA, 19 bp, Homo sapiens
ctatgtaatgcttatgtgt

SEQ ID NO: 4710218 - DNA, 18 bp, Homo sapiens
ctatgtatatcttctaca

SEQ ID NO: 4710219 - DNA, 22 bp, Homo sapiens
ctatgtgtagggcgggaggatg

SEQ ID NO: 4710220 - DNA, 17 bp, Homo sapiens
ctatgttaatattttag

SEQ ID NO: 4710221 - DNA, 20 bp, Homo sapiens
ctatgtttttgttcaaagcc

SEQ ID NO: 4710222 - DNA, 11 bp, Homo sapiens
ctattaaaaga

SEQ ID NO: 4710223 - DNA, 19 bp, Homo sapiens
ctattaaaagactcatccg

SEQ ID NO: 4710224 - DNA, 12 bp, Homo sapiens
ctgcccacctgg

SEQ ID NO: 4710225 - DNA, 15 bp, Homo sapiens
ctgcccacctggcct

SEQ ID NO: 4710226 - DNA, 18 bp, Homo sapiens
ctgcccacctggcctctg

SEQ ID NO: 4710227 - DNA, 20 bp, Homo sapiens
ctgcccacctggcctctgca

SEQ ID NO: 4710228 - DNA, 17 bp, Homo sapiens
ctgcccagctctgaggc

SEQ ID NO: 4710229 - DNA, 15 bp, Homo sapiens
ctgcccaggcccctg

SEQ ID NO: 4710230 - DNA, 19 bp, Homo sapiens
ctgcccaggcccctgccac

SEQ ID NO: 4710231 - DNA, 22 bp, Homo sapiens
ctgcccagggtcagtgtatcta

SEQ ID NO: 4710232 - DNA, 14 bp, Homo sapiens
ctgcccccaggact

SEQ ID NO: 4710233 - DNA, 17 bp, Homo sapiens
ctgcccccaggactggg

SEQ ID NO: 4710234 - DNA, 14 bp, Homo sapiens
ctgccccctgcagg

SEQ ID NO: 4710235 - DNA, 22 bp, Homo sapiens
ctgccccctgcaggaaggagct

SEQ ID NO: 4710236 - DNA, 23 bp, Homo sapiens
ctgccccctgcaggaaggagctg

SEQ ID NO: 4710237 - DNA, 17 bp, Homo sapiens
ctgccccgcaggcctgc

SEQ ID NO: 4710238 - DNA, 19 bp, Homo sapiens
ctgcccctccctgcctcca

SEQ ID NO: 4710239 - DNA, 17 bp, Homo sapiens
ctgcccctcctctctgc

SEQ ID NO: 4710240 - DNA, 18 bp, Homo sapiens
ctgcccctcctctctgcc

SEQ ID NO: 4710241 - DNA, 13 bp, Homo sapiens
ctgcccgctccca

SEQ ID NO: 4710242 - DNA, 12 bp, Homo sapiens
ctgccctccaag

SEQ ID NO: 4710243 - DNA, 17 bp, Homo sapiens
ctgccctgcccacctgg

SEQ ID NO: 4710244 - DNA, 17 bp, Homo sapiens
ctgccctggccccagcc

SEQ ID NO: 4710245 - DNA, 12 bp, Homo sapiens
ctgccctgggag

SEQ ID NO: 4710246 - DNA, 18 bp, Homo sapiens
ctgccctggtggccctct

SEQ ID NO: 4710247 - DNA, 18 bp, Homo sapiens
ctgccctggtttcctgcc

SEQ ID NO: 4710248 - DNA, 21 bp, Homo sapiens
ctgccctggtttcctgccctg

SEQ ID NO: 4710249 - DNA, 19 bp, Homo sapiens
ctgccctgtgggcccccaa

SEQ ID NO: 4710250 - DNA, 20 bp, Homo sapiens
ctgcccttgctccagcctga

SEQ ID NO: 4710251 - DNA, 13 bp, Homo sapiens
ctgccgcagagct

SEQ ID NO: 4710252 - DNA, 18 bp, Homo sapiens
ctgccgcagagctggccg

SEQ ID NO: 4710253 - DNA, 23 bp, Homo sapiens
ctgccggttcttaaatccatcct

SEQ ID NO: 4710254 - DNA, 15 bp, Homo sapiens
ctgcctaaggaagct

SEQ ID NO: 4710255 - DNA, 14 bp, Homo sapiens
ctgcctcagcctcc

SEQ ID NO: 4710256 - DNA, 15 bp, Homo sapiens
ctgcctccacccaca

SEQ ID NO: 4710257 - DNA, 17 bp, Homo sapiens
ctgcctccacccacagt

SEQ ID NO: 4710258 - DNA, 13 bp, Homo sapiens
ctgcctccactcc

SEQ ID NO: 4710259 - DNA, 19 bp, Homo sapiens
ctgcctccactcccacttc

SEQ ID NO: 4710260 - DNA, 15 bp, Homo sapiens
ctgcctccagggctg

SEQ ID NO: 4710261 - DNA, 18 bp, Homo sapiens
ctgcctccagggctggac

SEQ ID NO: 4710262 - DNA, 23 bp, Homo sapiens
ctgcctccagggctggactgagg

SEQ ID NO: 4710263 - DNA, 11 bp, Homo sapiens
ctgcctcccat

SEQ ID NO: 4710264 - DNA, 14 bp, Homo sapiens
ctgcctcccttcat

SEQ ID NO: 4710265 - DNA, 19 bp, Homo sapiens
ctgcctcccttcatgcatg

SEQ ID NO: 4710266 - DNA, 17 bp, Homo sapiens
ctgcctcctttgtgagg

SEQ ID NO: 4710267 - DNA, 17 bp, Homo sapiens
ctgcctcgaactggctg

SEQ ID NO: 4710268 - DNA, 15 bp, Homo sapiens
ctgcctctgacacac

SEQ ID NO: 4710269 - DNA, 18 bp, Homo sapiens
ctgcctctgacacacagc

SEQ ID NO: 4710270 - DNA, 21 bp, Homo sapiens
ctgcctctgacacacagctct

SEQ ID NO: 4710271 - DNA, 20 bp, Homo sapiens
ctgcctctgtttgacaaacc

SEQ ID NO: 4710272 - DNA, 20 bp, Homo sapiens
ctgcctgacatttggagtgt

SEQ ID NO: 4710273 - DNA, 23 bp, Homo sapiens
ctgcctgacatttggagtgttcc

SEQ ID NO: 4710274 - DNA, 20 bp, Homo sapiens
ctgcctgcccaggcccctgc

SEQ ID NO: 4710275 - DNA, 21 bp, Homo sapiens
ctgcctgcccaggcccctgcc

SEQ ID NO: 4710276 - DNA, 22 bp, Homo sapiens
ctgcctgcccaggcccctgcca

SEQ ID NO: 4710277 - DNA, 13 bp, Homo sapiens
ctgcctggacccg

SEQ ID NO: 4710278 - DNA, 12 bp, Homo sapiens
ctgcctgggagc

SEQ ID NO: 4710279 - DNA, 19 bp, Homo sapiens
ctgcctgttcagctccagc

SEQ ID NO: 4710280 - DNA, 20 bp, Homo sapiens
ctgcctgttcagctccagct

SEQ ID NO: 4710281 - DNA, 23 bp, Homo sapiens
ctgcctgttcagctccagctcac

SEQ ID NO: 4710282 - DNA, 14 bp, Homo sapiens
ctgccttcctcctg

SEQ ID NO: 4710283 - DNA, 15 bp, Homo sapiens
ctgccttcctcctgg

SEQ ID NO: 4710284 - DNA, 21 bp, Homo sapiens
ctgcggaatgaaccacatctt

SEQ ID NO: 4710285 - DNA, 18 bp, Homo sapiens
ctgcggcccaatccaagg

SEQ ID NO: 4710286 - DNA, 17 bp, Homo sapiens
ctgcggtccacccagga

SEQ ID NO: 4710287 - DNA, 18 bp, Homo sapiens
ctgcggtccacccaggag

SEQ ID NO: 4710288 - DNA, 20 bp, Homo sapiens
ctgcggtccacccaggagcc

SEQ ID NO: 4710289 - DNA, 23 bp, Homo sapiens
ctgcggtccacccaggagccccg

SEQ ID NO: 4710290 - DNA, 19 bp, Homo sapiens
ctgcggtgctatctccccc

SEQ ID NO: 4710291 - DNA, 20 bp, Homo sapiens
ctgcggtgctatctccccca

SEQ ID NO: 4710292 - DNA, 19 bp, Homo sapiens
ctgcgtgtcacctgtgctt

SEQ ID NO: 4710293 - DNA, 13 bp, Homo sapiens
ctgctaccctccc

SEQ ID NO: 4710294 - DNA, 17 bp, Homo sapiens
ctgctaccctccctgct

SEQ ID NO: 4710295 - DNA, 20 bp, Homo sapiens
ctgctaccctccctgctgtc

SEQ ID NO: 4710296 - DNA, 14 bp, Homo sapiens
ctgctcacaggcag

SEQ ID NO: 4710297 - DNA, 14 bp, Homo sapiens
ctgctcacatatct

SEQ ID NO: 4710298 - DNA, 16 bp, Homo sapiens
ctgctcatcattctct

SEQ ID NO: 4710299 - DNA, 22 bp, Homo sapiens
ctgctcatcattctctgtctca

SEQ ID NO: 4710300 - DNA, 21 bp, Homo sapiens
ctgctccacagtgttggcgag

SEQ ID NO: 4710301 - DNA, 18 bp, Homo sapiens
ctgctcctctccccagca

SEQ ID NO: 4710302 - DNA, 19 bp, Homo sapiens
ctgctcctctccccagcaa

SEQ ID NO: 4710303 - DNA, 15 bp, Homo sapiens
ctgctcgggcccagg

SEQ ID NO: 4710304 - DNA, 16 bp, Homo sapiens
ctgctcgggcccaggc

SEQ ID NO: 4710305 - DNA, 17 bp, Homo sapiens
ctgctcgggcccaggcc

SEQ ID NO: 4710306 - DNA, 22 bp, Homo sapiens
ctgctcgggcccaggccatctt

SEQ ID NO: 4710307 - DNA, 18 bp, Homo sapiens
ctgctctaagaagctgca

SEQ ID NO: 4710308 - DNA, 15 bp, Homo sapiens
ctgctctccgaccag

SEQ ID NO: 4710309 - DNA, 12 bp, Homo sapiens
ctgctctccttc

SEQ ID NO: 4710310 - DNA, 16 bp, Homo sapiens
ctgctctccttcctgg

SEQ ID NO: 4710311 - DNA, 12 bp, Homo sapiens
ctgctctggaca

SEQ ID NO: 4710312 - DNA, 11 bp, Homo sapiens
ctgctgaaggc

SEQ ID NO: 4710313 - DNA, 13 bp, Homo sapiens
ctgctgaaggctc

SEQ ID NO: 4710314 - DNA, 15 bp, Homo sapiens
ctgctgaaggctcga

SEQ ID NO: 4710315 - DNA, 23 bp, Homo sapiens
ctgctgaaggctcgagcatgcct

SEQ ID NO: 4710316 - DNA, 11 bp, Homo sapiens
ctgctgacagt

SEQ ID NO: 4710317 - DNA, 23 bp, Homo sapiens
ctgctgagtcccaggctgagcct

SEQ ID NO: 4710318 - DNA, 17 bp, Homo sapiens
ctgctgcaccaacccag

SEQ ID NO: 4710319 - DNA, 19 bp, Homo sapiens
ctgctgcaccaacccagcc

SEQ ID NO: 4710320 - DNA, 12 bp, Homo sapiens
ctctaggctggg

SEQ ID NO: 4710321 - DNA, 13 bp, Homo sapiens
ctctaggctgggg

SEQ ID NO: 4710322 - DNA, 14 bp, Homo sapiens
ctctaggctgggga

SEQ ID NO: 4710323 - DNA, 14 bp, Homo sapiens
ctctagggacccct

SEQ ID NO: 4710324 - DNA, 18 bp, Homo sapiens
ctctagggacccctcctc

SEQ ID NO: 4710325 - DNA, 20 bp, Homo sapiens
ctctagggacccctcctccc

SEQ ID NO: 4710326 - DNA, 21 bp, Homo sapiens
ctctcaaagccatgtgtggag

SEQ ID NO: 4710327 - DNA, 17 bp, Homo sapiens
ctctcaacccaggagca

SEQ ID NO: 4710328 - DNA, 14 bp, Homo sapiens
ctctcactccttga

SEQ ID NO: 4710329 - DNA, 22 bp, Homo sapiens
ctctcagagctacttgggccat

SEQ ID NO: 4710330 - DNA, 18 bp, Homo sapiens
ctctcaggctgtcccaag

SEQ ID NO: 4710331 - DNA, 21 bp, Homo sapiens
ctctcaggctgtcccaagctc

SEQ ID NO: 4710332 - DNA, 15 bp, Homo sapiens
ctctcaggtgaccaa

SEQ ID NO: 4710333 - DNA, 18 bp, Homo sapiens
ctctcagtctctgagcag

SEQ ID NO: 4710334 - DNA, 15 bp, Homo sapiens
ctctcagttgcagcc

SEQ ID NO: 4710335 - DNA, 16 bp, Homo sapiens
ctctcatatatatttt

SEQ ID NO: 4710336 - DNA, 14 bp, Homo sapiens
ctctccacctagtg

SEQ ID NO: 4710337 - DNA, 13 bp, Homo sapiens
ctctccagcccct

SEQ ID NO: 4710338 - DNA, 21 bp, Homo sapiens
ctctccattcccgtggaacgt

SEQ ID NO: 4710339 - DNA, 22 bp, Homo sapiens
ctctccccagcaagtgagagct

SEQ ID NO: 4710340 - DNA, 16 bp, Homo sapiens
ctctcccccaccccct

SEQ ID NO: 4710341 - DNA, 12 bp, Homo sapiens
ctctcccctgcc

SEQ ID NO: 4710342 - DNA, 20 bp, Homo sapiens
ctctcccctgccccctgcag

SEQ ID NO: 4710343 - DNA, 17 bp, Homo sapiens
ctctccctcctggccag

SEQ ID NO: 4710344 - DNA, 21 bp, Homo sapiens
ctctccgaccagacaccttga

SEQ ID NO: 4710345 - DNA, 17 bp, Homo sapiens
ctctctcactcacattt

SEQ ID NO: 4710346 - DNA, 14 bp, Homo sapiens
ctctctcactcctt

SEQ ID NO: 4710347 - DNA, 15 bp, Homo sapiens
ctctctcactccttg

SEQ ID NO: 4710348 - DNA, 15 bp, Homo sapiens
ctctctgacatatgc

SEQ ID NO: 4710349 - DNA, 23 bp, Homo sapiens
ctctctgccatggccttggcagg

SEQ ID NO: 4710350 - DNA, 12 bp, Homo sapiens
ctctctgcccta

SEQ ID NO: 4710351 - DNA, 12 bp, Homo sapiens
ctctctgctctg

SEQ ID NO: 4710352 - DNA, 22 bp, Homo sapiens
ctctctgctctgcgtgtcacct

SEQ ID NO: 4710353 - DNA, 14 bp, Homo sapiens
ctctcttgaccctg

SEQ ID NO: 4710354 - DNA, 21 bp, Homo sapiens
ctctcttgaccctgtcacttg

SEQ ID NO: 4710355 - DNA, 16 bp, Homo sapiens
ctctctttgtttttct

SEQ ID NO: 4710356 - DNA, 19 bp, Homo sapiens
ctctgaatattaagaaaca

SEQ ID NO: 4710357 - DNA, 16 bp, Homo sapiens
ctctgacacacagctc

SEQ ID NO: 4710358 - DNA, 17 bp, Homo sapiens
ctctgacacacagctct

SEQ ID NO: 4710359 - DNA, 18 bp, Homo sapiens
ctctgacacacagctctg

SEQ ID NO: 4710360 - DNA, 19 bp, Homo sapiens
ctctgacacacagctctgt

SEQ ID NO: 4710361 - DNA, 14 bp, Homo sapiens
ctctgacccacagc

SEQ ID NO: 4710362 - DNA, 14 bp, Homo sapiens
ctctgactcagggc

SEQ ID NO: 4710363 - DNA, 15 bp, Homo sapiens
ctctgactcagggct

SEQ ID NO: 4710364 - DNA, 16 bp, Homo sapiens
ctctgactcagggctc

SEQ ID NO: 4710365 - DNA, 17 bp, Homo sapiens
ctctgactcagggctcc

SEQ ID NO: 4710366 - DNA, 13 bp, Homo sapiens
ctctgagacacac

SEQ ID NO: 4710367 - DNA, 15 bp, Homo sapiens
ctctgagccttggga

SEQ ID NO: 4710368 - DNA, 15 bp, Homo sapiens
ctctgagctgtcaac

SEQ ID NO: 4710369 - DNA, 15 bp, Homo sapiens
ctctgagctgttatc

SEQ ID NO: 4710370 - DNA, 16 bp, Homo sapiens
ctctgagctgttatct

SEQ ID NO: 4710371 - DNA, 14 bp, Homo sapiens
ctctgaggacacta

SEQ ID NO: 4710372 - DNA, 21 bp, Homo sapiens
ctctgatccctctacagagct

SEQ ID NO: 4710373 - DNA, 14 bp, Homo sapiens
ctctgatgtttggg

SEQ ID NO: 4710374 - DNA, 13 bp, Homo sapiens
ctctgcaactgaa

SEQ ID NO: 4710375 - DNA, 21 bp, Homo sapiens
ctctgcaactgaatacttgaa

SEQ ID NO: 4710376 - DNA, 14 bp, Homo sapiens
ctctgcactcccct

SEQ ID NO: 4710377 - DNA, 17 bp, Homo sapiens
ctctgcatttaaaaaaa

SEQ ID NO: 4710378 - DNA, 19 bp, Homo sapiens
ctctgccaacttcttcaga

SEQ ID NO: 4710379 - DNA, 23 bp, Homo sapiens
ctctgccaacttcttcagagctg

SEQ ID NO: 4710380 - DNA, 22 bp, Homo sapiens
ctctgccatggccttggcaggc

SEQ ID NO: 4710381 - DNA, 13 bp, Homo sapiens
ctctgcccactcc

SEQ ID NO: 4710382 - DNA, 15 bp, Homo sapiens
ctctgcccactccct

SEQ ID NO: 4710383 - DNA, 17 bp, Homo sapiens
ctctgcccactccctgc

SEQ ID NO: 4710384 - DNA, 18 bp, Homo sapiens
ctctgcccactccctgca

SEQ ID NO: 4710385 - DNA, 20 bp, Homo sapiens
ctctgccctaatgcgcaggc

SEQ ID NO: 4710386 - DNA, 22 bp, Homo sapiens
ctctgccctaatgcgcaggctg

SEQ ID NO: 4710387 - DNA, 12 bp, Homo sapiens
ctctgcccttgg

SEQ ID NO: 4710388 - DNA, 16 bp, Homo sapiens
ctctgcctcccatcac

SEQ ID NO: 4710389 - DNA, 16 bp, Homo sapiens
ctctgcctctgacaca

SEQ ID NO: 4710390 - DNA, 19 bp, Homo sapiens
ctctgcctctgacacacag

SEQ ID NO: 4710391 - DNA, 21 bp, Homo sapiens
ctctgcctgaagtcacacagt

SEQ ID NO: 4710392 - DNA, 18 bp, Homo sapiens
ctctgctcctctccccag

SEQ ID NO: 4710393 - DNA, 17 bp, Homo sapiens
ctctgctgacagacaca

SEQ ID NO: 4710394 - DNA, 23 bp, Homo sapiens
ctctgctgacagacacaggcccg

SEQ ID NO: 4710395 - DNA, 13 bp, Homo sapiens
ctctgctgccgcc

SEQ ID NO: 4710396 - DNA, 21 bp, Homo sapiens
ctctgctgccgccccacccag

SEQ ID NO: 4710397 - DNA, 15 bp, Homo sapiens
ctctgctgctggctg

SEQ ID NO: 4710398 - DNA, 15 bp, Homo sapiens
ctctgctttggaaat

SEQ ID NO: 4710399 - DNA, 12 bp, Homo sapiens
ctctggaagaag

SEQ ID NO: 4710400 - DNA, 17 bp, Homo sapiens
ctctggacacttgctca

SEQ ID NO: 4710401 - DNA, 19 bp, Homo sapiens
ctctggatgcctgattgcc

SEQ ID NO: 4710402 - DNA, 23 bp, Homo sapiens
ctctggatgcctgattgccaagc

SEQ ID NO: 4710403 - DNA, 22 bp, Homo sapiens
ctctggattggagatagggaaa

SEQ ID NO: 4710404 - DNA, 14 bp, Homo sapiens
ctctggattttgaa

SEQ ID NO: 4710405 - DNA, 12 bp, Homo sapiens
ctctggcagctc

SEQ ID NO: 4710406 - DNA, 14 bp, Homo sapiens
ctctggcagctcag

SEQ ID NO: 4710407 - DNA, 14 bp, Homo sapiens
ctctggtccataga

SEQ ID NO: 4710408 - DNA, 15 bp, Homo sapiens
ctctggtccatagag

SEQ ID NO: 4710409 - DNA, 18 bp, Homo sapiens
ctctggtccatagagagc

SEQ ID NO: 4710410 - DNA, 19 bp, Homo sapiens
ctctggtccatagagagca

SEQ ID NO: 4710411 - DNA, 15 bp, Homo sapiens
ctctggttatctaat

SEQ ID NO: 4710412 - DNA, 13 bp, Homo sapiens
ctctgtacagagc

SEQ ID NO: 4710413 - DNA, 15 bp, Homo sapiens
ctctgtacagagccc

SEQ ID NO: 4710414 - DNA, 16 bp, Homo sapiens
ctctgtacagagccca

SEQ ID NO: 4710415 - DNA, 21 bp, Homo sapiens
ctctgtacagagcccacgccc

SEQ ID NO: 4710416 - DNA, 23 bp, Homo sapiens
ctctgtccccttctctcatctct

SEQ ID NO: 4710417 - DNA, 13 bp, Homo sapiens
ctctgtcctggga

SEQ ID NO: 4710418 - DNA, 15 bp, Homo sapiens
ctctgtcctgggagt

SEQ ID NO: 4710419 - DNA, 17 bp, Homo sapiens
ctctgtcgcccagtctg

SEQ ID NO: 4710420 - DNA, 18 bp, Homo sapiens
ctctgtcgcccagtctgg

SEQ ID NO: 4710421 - DNA, 23 bp, Homo sapiens
ctattctcaaagttaaaagtaaa

SEQ ID NO: 4710422 - DNA, 11 bp, Homo sapiens
ctattggtaaa

SEQ ID NO: 4710423 - DNA, 16 bp, Homo sapiens
ctatttaaaacttgta

SEQ ID NO: 4710424 - DNA, 12 bp, Homo sapiens
ctatttatatac

SEQ ID NO: 4710425 - DNA, 14 bp, Homo sapiens
ctatttcctttgcg

SEQ ID NO: 4710426 - DNA, 18 bp, Homo sapiens
ctatttcctttgcgcaaa

SEQ ID NO: 4710427 - DNA, 17 bp, Homo sapiens
ctatttctatgtatgtg

SEQ ID NO: 4710428 - DNA, 15 bp, Homo sapiens
ctatttctcctccat

SEQ ID NO: 4710429 - DNA, 16 bp, Homo sapiens
ctatttctcctccatg

SEQ ID NO: 4710430 - DNA, 23 bp, Homo sapiens
ctatttgccatgggcttcactgt

SEQ ID NO: 4710431 - DNA, 16 bp, Homo sapiens
ctattttctgaagtga

SEQ ID NO: 4710432 - DNA, 19 bp, Homo sapiens
ctcaaaaagctgcctggga

SEQ ID NO: 4710433 - DNA, 19 bp, Homo sapiens
ctcaaaacccatctgggct

SEQ ID NO: 4710434 - DNA, 22 bp, Homo sapiens
ctcaaaacccatctgggctcct

SEQ ID NO: 4710435 - DNA, 18 bp, Homo sapiens
ctcaaaccaaatcactga

SEQ ID NO: 4710436 - DNA, 14 bp, Homo sapiens
ctcaaagttttgaa

SEQ ID NO: 4710437 - DNA, 17 bp, Homo sapiens
ctcaaagttttgaaaag

SEQ ID NO: 4710438 - DNA, 18 bp, Homo sapiens
ctcaaagttttgaaaagc

SEQ ID NO: 4710439 - DNA, 23 bp, Homo sapiens
ctcaaagttttgaaaagctatta

SEQ ID NO: 4710440 - DNA, 13 bp, Homo sapiens
ctcaaccctctca

SEQ ID NO: 4710441 - DNA, 17 bp, Homo sapiens
ctcaacctcctgggcta

SEQ ID NO: 4710442 - DNA, 13 bp, Homo sapiens
ctcaagaagcagg

SEQ ID NO: 4710443 - DNA, 14 bp, Homo sapiens
ctcaagacttccag

SEQ ID NO: 4710444 - DNA, 17 bp, Homo sapiens
ctcaaggcctcccacag

SEQ ID NO: 4710445 - DNA, 18 bp, Homo sapiens
ctcaaggcctcccacagt

SEQ ID NO: 4710446 - DNA, 20 bp, Homo sapiens
ctcaaggcctcccacagtga

SEQ ID NO: 4710447 - DNA, 22 bp, Homo sapiens
ctcaaggggccatcctgtccca

SEQ ID NO: 4710448 - DNA, 14 bp, Homo sapiens
ctcaagtcctcttt

SEQ ID NO: 4710449 - DNA, 17 bp, Homo sapiens
ctcaagtgattctcctg

SEQ ID NO: 4710450 - DNA, 16 bp, Homo sapiens
ctcaagttccagtgca

SEQ ID NO: 4710451 - DNA, 14 bp, Homo sapiens
ctcaataagccttg

SEQ ID NO: 4710452 - DNA, 18 bp, Homo sapiens
ctcaattccccctggcca

SEQ ID NO: 4710453 - DNA, 12 bp, Homo sapiens
ctcaatttcatt

SEQ ID NO: 4710454 - DNA, 13 bp, Homo sapiens
ctcaatttctccc

SEQ ID NO: 4710455 - DNA, 13 bp, Homo sapiens
ctcacactgagaa

SEQ ID NO: 4710456 - DNA, 16 bp, Homo sapiens
ctcacagagaaaaagt

SEQ ID NO: 4710457 - DNA, 19 bp, Homo sapiens
ctcacatttattctgctca

SEQ ID NO: 4710458 - DNA, 20 bp, Homo sapiens
ctcacattttctcagtgtgc

SEQ ID NO: 4710459 - DNA, 19 bp, Homo sapiens
ctcaccagccccagtgccc

SEQ ID NO: 4710460 - DNA, 15 bp, Homo sapiens
ctcaccaggggcagg

SEQ ID NO: 4710461 - DNA, 22 bp, Homo sapiens
ctcaccaggggcaggcacagca

SEQ ID NO: 4710462 - DNA, 19 bp, Homo sapiens
ctcacccccttctccatcc

SEQ ID NO: 4710463 - DNA, 21 bp, Homo sapiens
ctcacccccttctccatccac

SEQ ID NO: 4710464 - DNA, 14 bp, Homo sapiens
ctcacccctggttc

SEQ ID NO: 4710465 - DNA, 19 bp, Homo sapiens
ctcacccctggttctcatc

SEQ ID NO: 4710466 - DNA, 20 bp, Homo sapiens
ctcacccctggttctcatct

SEQ ID NO: 4710467 - DNA, 18 bp, Homo sapiens
ctcaccgcggctggatgg

SEQ ID NO: 4710468 - DNA, 17 bp, Homo sapiens
ctcacctaaaccctctg

SEQ ID NO: 4710469 - DNA, 19 bp, Homo sapiens
ctcacctaaaccctctgtg

SEQ ID NO: 4710470 - DNA, 17 bp, Homo sapiens
ctcacctaactcatact

SEQ ID NO: 4710471 - DNA, 14 bp, Homo sapiens
ctcacctctccctt

SEQ ID NO: 4710472 - DNA, 16 bp, Homo sapiens
ctcacctctcccttgg

SEQ ID NO: 4710473 - DNA, 17 bp, Homo sapiens
ctcacctgcactaacag

SEQ ID NO: 4710474 - DNA, 18 bp, Homo sapiens
ctcactatgttgcccagg

SEQ ID NO: 4710475 - DNA, 20 bp, Homo sapiens
ctcactatgttgcccaggca

SEQ ID NO: 4710476 - DNA, 22 bp, Homo sapiens
ctcactatgttgcccaggcagg

SEQ ID NO: 4710477 - DNA, 13 bp, Homo sapiens
ctcactccttgaa

SEQ ID NO: 4710478 - DNA, 13 bp, Homo sapiens
ctcactgcagcct

SEQ ID NO: 4710479 - DNA, 16 bp, Homo sapiens
ctcactgcagcctcaa

SEQ ID NO: 4710480 - DNA, 17 bp, Homo sapiens
ctcactgggactttgta

SEQ ID NO: 4710481 - DNA, 17 bp, Homo sapiens
ctcactgttgcccaggc

SEQ ID NO: 4710482 - DNA, 17 bp, Homo sapiens
ctcacttcttccatcca

SEQ ID NO: 4710483 - DNA, 21 bp, Homo sapiens
ctcacttggtgatatgtccta

SEQ ID NO: 4710484 - DNA, 13 bp, Homo sapiens
ctcagaagacact

SEQ ID NO: 4710485 - DNA, 17 bp, Homo sapiens
ctcagaagacactgatg

SEQ ID NO: 4710486 - DNA, 20 bp, Homo sapiens
ctcagaagacactgatgggc

SEQ ID NO: 4710487 - DNA, 22 bp, Homo sapiens
ctcagaagacactgatgggcaa

SEQ ID NO: 4710488 - DNA, 19 bp, Homo sapiens
ctcagaatatattcacttt

SEQ ID NO: 4710489 - DNA, 19 bp, Homo sapiens
ctcagacagccccctgccc

SEQ ID NO: 4710490 - DNA, 11 bp, Homo sapiens
ctcagagagga

SEQ ID NO: 4710491 - DNA, 13 bp, Homo sapiens
ctcagagaggaca

SEQ ID NO: 4710492 - DNA, 22 bp, Homo sapiens
ctcagagaggacaaaataaagt

SEQ ID NO: 4710493 - DNA, 23 bp, Homo sapiens
ctcagagaggacaaaataaagtg

SEQ ID NO: 4710494 - DNA, 13 bp, Homo sapiens
ctcagagagggca

SEQ ID NO: 4710495 - DNA, 14 bp, Homo sapiens
ctcagaggccttgg

SEQ ID NO: 4710496 - DNA, 16 bp, Homo sapiens
ctcagcatcctggcac

SEQ ID NO: 4710497 - DNA, 17 bp, Homo sapiens
ctcagcatcctggcacc

SEQ ID NO: 4710498 - DNA, 22 bp, Homo sapiens
ctcagcatcctggcacccggcc

SEQ ID NO: 4710499 - DNA, 20 bp, Homo sapiens
ctcagccacaaaccctgcct

SEQ ID NO: 4710500 - DNA, 16 bp, Homo sapiens
ctcagccagccccatc

SEQ ID NO: 4710501 - DNA, 13 bp, Homo sapiens
ctcagcctcccga

SEQ ID NO: 4710502 - DNA, 19 bp, Homo sapiens
ctcagcctcccgaatagct

SEQ ID NO: 4710503 - DNA, 23 bp, Homo sapiens
ctcagcctcccgaatagctggga

SEQ ID NO: 4710504 - DNA, 13 bp, Homo sapiens
ctcagcggggaca

SEQ ID NO: 4710505 - DNA, 19 bp, Homo sapiens
ctcagcggggacagctcct

SEQ ID NO: 4710506 - DNA, 16 bp, Homo sapiens
ctcagctcttctgact

SEQ ID NO: 4710507 - DNA, 18 bp, Homo sapiens
ctcaggaaatggcttttc

SEQ ID NO: 4710508 - DNA, 13 bp, Homo sapiens
ctcaggaactttt

SEQ ID NO: 4710509 - DNA, 12 bp, Homo sapiens
ctcaggaccagg

SEQ ID NO: 4710510 - DNA, 14 bp, Homo sapiens
ctcaggaccaggca

SEQ ID NO: 4710511 - DNA, 14 bp, Homo sapiens
ctcaggctgtccca

SEQ ID NO: 4710512 - DNA, 18 bp, Homo sapiens
ctcaggctgtcccaagct

SEQ ID NO: 4710513 - DNA, 19 bp, Homo sapiens
ctcaggctgtcccaagctc

SEQ ID NO: 4710514 - DNA, 22 bp, Homo sapiens
ctcaggctgtcccaagctccca

SEQ ID NO: 4710515 - DNA, 16 bp, Homo sapiens
ctcagggcctggctca

SEQ ID NO: 4710516 - DNA, 17 bp, Homo sapiens
ctcagggctcctgggtt

SEQ ID NO: 4710517 - DNA, 17 bp, Homo sapiens
ctcagggtccctggtgg

SEQ ID NO: 4710518 - DNA, 24 bp, Homo sapiens
ctcagggtccctggtggcagctca

SEQ ID NO: 4710519 - DNA, 19 bp, Homo sapiens
ctcaggtggggtcactctg

SEQ ID NO: 4710520 - DNA, 17 bp, Homo sapiens
ctcaggtgtccctgcac

SEQ ID NO: 4710521 - DNA, 18 bp, Homo sapiens
ctcaggtgtccctgcact

SEQ ID NO: 4710522 - DNA, 21 bp, Homo sapiens
ctcagtaagacgacaaggaaa

SEQ ID NO: 4710523 - DNA, 20 bp, Homo sapiens
ctcagtaagtatctggagga

SEQ ID NO: 4710524 - DNA, 23 bp, Homo sapiens
ctcagtctcccagctaattgaga

SEQ ID NO: 4710525 - DNA, 13 bp, Homo sapiens
ctcagtctccctc

SEQ ID NO: 4710526 - DNA, 13 bp, Homo sapiens
ctcagtgccacta

SEQ ID NO: 4710527 - DNA, 13 bp, Homo sapiens
ctcatagccctca

SEQ ID NO: 4710528 - DNA, 13 bp, Homo sapiens
ccttaccactgtg

SEQ ID NO: 4710529 - DNA, 15 bp, Homo sapiens
ccttaccagcagagc

SEQ ID NO: 4710530 - DNA, 18 bp, Homo sapiens
ccttagaagtcacacagt

SEQ ID NO: 4710531 - DNA, 17 bp, Homo sapiens
ccttagacagtccctgc

SEQ ID NO: 4710532 - DNA, 20 bp, Homo sapiens
ccttaggtgatccactcgcc

SEQ ID NO: 4710533 - DNA, 22 bp, Homo sapiens
cttctgacgcagcctgagaatg

SEQ ID NO: 4710534 - DNA, 18 bp, Homo sapiens
cttctgacttaagtgtgc

SEQ ID NO: 4710535 - DNA, 16 bp, Homo sapiens
cttctgccacttccca

SEQ ID NO: 4710536 - DNA, 15 bp, Homo sapiens
cttctgccatattct

SEQ ID NO: 4710537 - DNA, 11 bp, Homo sapiens
cttctgctggg

SEQ ID NO: 4710538 - DNA, 19 bp, Homo sapiens
cttctgggagggcagcagg

SEQ ID NO: 4710539 - DNA, 20 bp, Homo sapiens
cttctgtaattgtgtggatt

SEQ ID NO: 4710540 - DNA, 19 bp, Homo sapiens
cttctgtcctactctgtgt

SEQ ID NO: 4710541 - DNA, 21 bp, Homo sapiens
cttctgtcctactctgtgtca

SEQ ID NO: 4710542 - DNA, 19 bp, Homo sapiens
cttctgttgctgcctcatg

SEQ ID NO: 4710543 - DNA, 20 bp, Homo sapiens
cttctgttgctgcctcatgc

SEQ ID NO: 4710544 - DNA, 23 bp, Homo sapiens
cttcttaaaggggaactgtcaag

SEQ ID NO: 4710545 - DNA, 13 bp, Homo sapiens
cttcttcaccatt

SEQ ID NO: 4710546 - DNA, 15 bp, Homo sapiens
cttcttctttctaca

SEQ ID NO: 4710547 - DNA, 17 bp, Homo sapiens
cttctttctgactctaa

SEQ ID NO: 4710548 - DNA, 18 bp, Homo sapiens
cttgaaaaaaaacagtgg

SEQ ID NO: 4710549 - DNA, 15 bp, Homo sapiens
cttgaaaagggtgtt

SEQ ID NO: 4710550 - DNA, 16 bp, Homo sapiens
cttgaactcctgacct

SEQ ID NO: 4710551 - DNA, 13 bp, Homo sapiens
cttgaactcctgg

SEQ ID NO: 4710552 - DNA, 18 bp, Homo sapiens
cttgaactcctggcctca

SEQ ID NO: 4710553 - DNA, 18 bp, Homo sapiens
cttgaagtgactgttgta

SEQ ID NO: 4710554 - DNA, 22 bp, Homo sapiens
cttgaattgtaactgttcttga

SEQ ID NO: 4710555 - DNA, 18 bp, Homo sapiens
cttgacaaacttctttca

SEQ ID NO: 4710556 - DNA, 16 bp, Homo sapiens
cttgacagaacactgt

SEQ ID NO: 4710557 - DNA, 12 bp, Homo sapiens
cttgacagggca

SEQ ID NO: 4710558 - DNA, 20 bp, Homo sapiens
cttgacagggcacaccgggc

SEQ ID NO: 4710559 - DNA, 21 bp, Homo sapiens
cttgaccattctccacctgcc

SEQ ID NO: 4710560 - DNA, 17 bp, Homo sapiens
cttgacctgaactctgc

SEQ ID NO: 4710561 - DNA, 19 bp, Homo sapiens
cttgacctgaactctgcaa

SEQ ID NO: 4710562 - DNA, 24 bp, Homo sapiens
cttgaggcttagctttgctctgcc

SEQ ID NO: 4710563 - DNA, 20 bp, Homo sapiens
cttgagggttgggctggtgt

SEQ ID NO: 4710564 - DNA, 21 bp, Homo sapiens
cttgagggttgggctggtgtc

SEQ ID NO: 4710565 - DNA, 19 bp, Homo sapiens
cttgagtttaaattgtaat

SEQ ID NO: 4710566 - DNA, 19 bp, Homo sapiens
cttgcacgtattttaatag

SEQ ID NO: 4710567 - DNA, 18 bp, Homo sapiens
cttgcagactctacagag

SEQ ID NO: 4710568 - DNA, 20 bp, Homo sapiens
cttgcagactctacagaggc

SEQ ID NO: 4710569 - DNA, 21 bp, Homo sapiens
cttgcagactctacagaggcc

SEQ ID NO: 4710570 - DNA, 19 bp, Homo sapiens
cttgccccaacccccagca

SEQ ID NO: 4710571 - DNA, 20 bp, Homo sapiens
cttgccccaacccccagcac

SEQ ID NO: 4710572 - DNA, 16 bp, Homo sapiens
cttgcccccctggcct

SEQ ID NO: 4710573 - DNA, 22 bp, Homo sapiens
cttgcccccctggcctccccca

SEQ ID NO: 4710574 - DNA, 14 bp, Homo sapiens
cttgccctttccat

SEQ ID NO: 4710575 - DNA, 20 bp, Homo sapiens
cttgccgtctacctgagggg

SEQ ID NO: 4710576 - DNA, 19 bp, Homo sapiens
cttgcctcggctcctgctg

SEQ ID NO: 4710577 - DNA, 23 bp, Homo sapiens
cttgcctcggctcctgctgcacc

SEQ ID NO: 4710578 - DNA, 17 bp, Homo sapiens
cttgcctctgtcccctt

SEQ ID NO: 4710579 - DNA, 19 bp, Homo sapiens
cttgcctctgtccccttct

SEQ ID NO: 4710580 - DNA, 16 bp, Homo sapiens
cttgcctgcacaaact

SEQ ID NO: 4710581 - DNA, 13 bp, Homo sapiens
cttgctccagcct

SEQ ID NO: 4710582 - DNA, 16 bp, Homo sapiens
cttgctccagcctgac

SEQ ID NO: 4710583 - DNA, 17 bp, Homo sapiens
cttgctccagcctgaca

SEQ ID NO: 4710584 - DNA, 19 bp, Homo sapiens
cttgctccagcctgacaac

SEQ ID NO: 4710585 - DNA, 13 bp, Homo sapiens
cttgctctgctga

SEQ ID NO: 4710586 - DNA, 22 bp, Homo sapiens
cttgctctgctgacagacacag

SEQ ID NO: 4710587 - DNA, 17 bp, Homo sapiens
cttgctggctgtgaaac

SEQ ID NO: 4710588 - DNA, 16 bp, Homo sapiens
cttgctgtatatgcag

SEQ ID NO: 4710589 - DNA, 22 bp, Homo sapiens
cttgcttctggctttgttcttg

SEQ ID NO: 4710590 - DNA, 21 bp, Homo sapiens
cttggaaactggatgaggtca

SEQ ID NO: 4710591 - DNA, 12 bp, Homo sapiens
cttggaaagaaa

SEQ ID NO: 4710592 - DNA, 14 bp, Homo sapiens
cttggaagctccgc

SEQ ID NO: 4710593 - DNA, 18 bp, Homo sapiens
cttggaagttgcatggca

SEQ ID NO: 4710594 - DNA, 22 bp, Homo sapiens
cttggattctctgagaaatgat

SEQ ID NO: 4710595 - DNA, 20 bp, Homo sapiens
cttggattgtccccgaccct

SEQ ID NO: 4710596 - DNA, 23 bp, Homo sapiens
cttggcacatttaagagacagtc

SEQ ID NO: 4710597 - DNA, 23 bp, Homo sapiens
cttggctcaagtcctcttttctg

SEQ ID NO: 4710598 - DNA, 12 bp, Homo sapiens
cttggctgcagg

SEQ ID NO: 4710599 - DNA, 13 bp, Homo sapiens
cttggctgcaggg

SEQ ID NO: 4710600 - DNA, 16 bp, Homo sapiens
cttgggccatagctcc

SEQ ID NO: 4710601 - DNA, 10 bp, Homo sapiens
cttggggcct

SEQ ID NO: 4710602 - DNA, 20 bp, Homo sapiens
cttgggggtcctcctccagg

SEQ ID NO: 4710603 - DNA, 23 bp, Homo sapiens
cttgggggtcctcctccagggac

SEQ ID NO: 4710604 - DNA, 14 bp, Homo sapiens
cttggtcctgctgc

SEQ ID NO: 4710605 - DNA, 16 bp, Homo sapiens
cttggtcctgctgcag

SEQ ID NO: 4710606 - DNA, 16 bp, Homo sapiens
cttggttcccccactg

SEQ ID NO: 4710607 - DNA, 19 bp, Homo sapiens
cttggttcccccactgatc

SEQ ID NO: 4710608 - DNA, 14 bp, Homo sapiens
cttggttgaggaaa

SEQ ID NO: 4710609 - DNA, 15 bp, Homo sapiens
cttggttgaggaaac

SEQ ID NO: 4710610 - DNA, 16 bp, Homo sapiens
cttggttgaggaaaca

SEQ ID NO: 4710611 - DNA, 18 bp, Homo sapiens
cttgtaaaggaatttaaa

SEQ ID NO: 4710612 - DNA, 20 bp, Homo sapiens
cttttcataacctagcctta

SEQ ID NO: 4710613 - DNA, 16 bp, Homo sapiens
cttttccagaaagaaa

SEQ ID NO: 4710614 - DNA, 21 bp, Homo sapiens
cttttcccagagaccttctga

SEQ ID NO: 4710615 - DNA, 13 bp, Homo sapiens
cttttcctgtgtt

SEQ ID NO: 4710616 - DNA, 22 bp, Homo sapiens
cttttctcaatattaagtcatt

SEQ ID NO: 4710617 - DNA, 23 bp, Homo sapiens
cttttctttaagttttatttaac

SEQ ID NO: 4710618 - DNA, 21 bp, Homo sapiens
cttttgaagaacaaaaggctt

SEQ ID NO: 4710619 - DNA, 17 bp, Homo sapiens
cttttgacaaaggcaag

SEQ ID NO: 4710620 - DNA, 10 bp, Homo sapiens
cttttgacct

SEQ ID NO: 4710621 - DNA, 15 bp, Homo sapiens
cttttggtctgtgtg

SEQ ID NO: 4710622 - DNA, 18 bp, Homo sapiens
ctttttaaaaattgttat

SEQ ID NO: 4710623 - DNA, 14 bp, Homo sapiens
ctttttaaccaagt

SEQ ID NO: 4710624 - DNA, 22 bp, Homo sapiens
ctttttaaccaagttgtttatt

SEQ ID NO: 4710625 - DNA, 14 bp, Homo sapiens
ctttttaattgttg

SEQ ID NO: 4710626 - DNA, 16 bp, Homo sapiens
ctttttattaaaatat

SEQ ID NO: 4710627 - DNA, 13 bp, Homo sapiens
ctttttgctttcg

SEQ ID NO: 4710628 - DNA, 16 bp, Homo sapiens
ctttttgtacctggtg

SEQ ID NO: 4710629 - DNA, 14 bp, Homo sapiens
cttttttatttacc

SEQ ID NO: 4710630 - DNA, 17 bp, Homo sapiens
cttttttggctgctgaa

SEQ ID NO: 4710631 - DNA, 20 bp, Homo sapiens
cttttttggctgctgaaggc

SEQ ID NO: 4710632 - DNA, 23 bp, Homo sapiens
cttttttggctgctgaaggctcg

SEQ ID NO: 4710633 - DNA, 16 bp, Homo sapiens
ctttttttaaaattat

SEQ ID NO: 4710634 - DNA, 22 bp, Homo sapiens
ctttttttcaatttttttgtgt

SEQ ID NO: 4710635 - DNA, 22 bp, Homo sapiens
ctttttttgcctaccatttcac

SEQ ID NO: 4710636 - DNA, 17 bp, Homo sapiens
cttttttttttctgttg

SEQ ID NO: 4710637 - DNA, 16 bp, Homo sapiens
gaaaaaaaacagtgga

SEQ ID NO: 4710638 - DNA, 14 bp, Homo sapiens
gaaaaaagaagttt

SEQ ID NO: 4710639 - DNA, 19 bp, Homo sapiens
gaaaaacaaattcatcaaa

SEQ ID NO: 4710640 - DNA, 13 bp, Homo sapiens
gaaaaacagaaaa

SEQ ID NO: 4710641 - DNA, 12 bp, Homo sapiens
gaaaaataaata

SEQ ID NO: 4710642 - DNA, 17 bp, Homo sapiens
gaaaaatagcaacttgt

SEQ ID NO: 4710643 - DNA, 11 bp, Homo sapiens
gaaaaatatta

SEQ ID NO: 4710644 - DNA, 22 bp, Homo sapiens
gaaaaattgcattcattgactt

SEQ ID NO: 4710645 - DNA, 17 bp, Homo sapiens
gaaaacaagttccaaat

SEQ ID NO: 4710646 - DNA, 17 bp, Homo sapiens
ctgttgcccaggctggc

SEQ ID NO: 4710647 - DNA, 23 bp, Homo sapiens
ctgttggaatggatttttcttta

SEQ ID NO: 4710648 - DNA, 15 bp, Homo sapiens
ctgttggccagtgtg

SEQ ID NO: 4710649 - DNA, 14 bp, Homo sapiens
ctgttggctggggg

SEQ ID NO: 4710650 - DNA, 22 bp, Homo sapiens
ctgttggctgggggcctcagtg

SEQ ID NO: 4710651 - DNA, 17 bp, Homo sapiens
ctgttgtacatttatga

SEQ ID NO: 4710652 - DNA, 16 bp, Homo sapiens
ctgttgtcctatggga

SEQ ID NO: 4710653 - DNA, 22 bp, Homo sapiens
ctgttgttcttataagaagaag

SEQ ID NO: 4710654 - DNA, 14 bp, Homo sapiens
ctgttgtttgaaga

SEQ ID NO: 4710655 - DNA, 22 bp, Homo sapiens
ctgtttactgcttttcattagc

SEQ ID NO: 4710656 - DNA, 21 bp, Homo sapiens
ctgtttcccagcagtggactc

SEQ ID NO: 4710657 - DNA, 11 bp, Homo sapiens
ctgtttcctca

SEQ ID NO: 4710658 - DNA, 18 bp, Homo sapiens
ctgtttgcatttgataca

SEQ ID NO: 4710659 - DNA, 23 bp, Homo sapiens
ctgtttggaaattgattttgaac

SEQ ID NO: 4710660 - DNA, 18 bp, Homo sapiens
ctgtttgtcttctcccca

SEQ ID NO: 4710661 - DNA, 23 bp, Homo sapiens
ctgtttttctctaatgcttgatt

SEQ ID NO: 4710662 - DNA, 14 bp, Homo sapiens
cttaaactaaatgt

SEQ ID NO: 4710663 - DNA, 21 bp, Homo sapiens
cttaaatttggtttgttaatt

SEQ ID NO: 4710664 - DNA, 13 bp, Homo sapiens
cttaactttttaa

SEQ ID NO: 4710665 - DNA, 16 bp, Homo sapiens
cttaactttttaacca

SEQ ID NO: 4710666 - DNA, 13 bp, Homo sapiens
cttacacattcca

SEQ ID NO: 4710667 - DNA, 14 bp, Homo sapiens
cttacagctgggtg

SEQ ID NO: 4710668 - DNA, 23 bp, Homo sapiens
cttacagctgggtggcactgcca

SEQ ID NO: 4710669 - DNA, 23 bp, Homo sapiens
cttacagtaggagcccagctctg

SEQ ID NO: 4710670 - DNA, 23 bp, Homo sapiens
cttaccagggtctttgcagatgt

SEQ ID NO: 4710671 - DNA, 15 bp, Homo sapiens
cttacccttagggag

SEQ ID NO: 4710672 - DNA, 13 bp, Homo sapiens
cttactaaaaagt

SEQ ID NO: 4710673 - DNA, 17 bp, Homo sapiens
cttactaaaaagtataa

SEQ ID NO: 4710674 - DNA, 17 bp, Homo sapiens
gaactatggacggtgct

SEQ ID NO: 4710675 - DNA, 20 bp, Homo sapiens
gaactattgtgctcagagac

SEQ ID NO: 4710676 - DNA, 16 bp, Homo sapiens
gaactcacctggggct

SEQ ID NO: 4710677 - DNA, 22 bp, Homo sapiens
gaactcacctggggctgctggc

SEQ ID NO: 4710678 - DNA, 13 bp, Homo sapiens
gaactcctggcct

SEQ ID NO: 4710679 - DNA, 15 bp, Homo sapiens
gaactcctggcctca

SEQ ID NO: 4710680 - DNA, 20 bp, Homo sapiens
gaacttgtgtccctaatgtg

SEQ ID NO: 4710681 - DNA, 14 bp, Homo sapiens
gaactttcattttt

SEQ ID NO: 4710682 - DNA, 14 bp, Homo sapiens
gaactttgaaggac

SEQ ID NO: 4710683 - DNA, 21 bp, Homo sapiens
gaagaaaaagacctgcatttg

SEQ ID NO: 4710684 - DNA, 20 bp, Homo sapiens
gaagaacggggctcttctca

SEQ ID NO: 4710685 - DNA, 13 bp, Homo sapiens
gaagaagagaggc

SEQ ID NO: 4710686 - DNA, 18 bp, Homo sapiens
gaagaaggggacaatggc

SEQ ID NO: 4710687 - DNA, 14 bp, Homo sapiens
gaagacaccagagc

SEQ ID NO: 4710688 - DNA, 21 bp, Homo sapiens
gaagacactgatgggcaaccc

SEQ ID NO: 4710689 - DNA, 17 bp, Homo sapiens
gaagacagcatttaaag

SEQ ID NO: 4710690 - DNA, 16 bp, Homo sapiens
gaagactcattcttct

SEQ ID NO: 4710691 - DNA, 13 bp, Homo sapiens
gaagactttggaa

SEQ ID NO: 4710692 - DNA, 17 bp, Homo sapiens
gaagactttggaaagag

SEQ ID NO: 4710693 - DNA, 15 bp, Homo sapiens
gaagagcacagccct

SEQ ID NO: 4710694 - DNA, 23 bp, Homo sapiens
gaagagtaagtcaacctgcctga

SEQ ID NO: 4710695 - DNA, 22 bp, Homo sapiens
gaagatataactattgcccagg

SEQ ID NO: 4710696 - DNA, 17 bp, Homo sapiens
gaagatcctaaaacaaa

SEQ ID NO: 4710697 - DNA, 18 bp, Homo sapiens
gaagatgtatgctttgaa

SEQ ID NO: 4710698 - DNA, 13 bp, Homo sapiens
gaagcacagcttc

SEQ ID NO: 4710699 - DNA, 14 bp, Homo sapiens
gaagcacagcttca

SEQ ID NO: 4710700 - DNA, 21 bp, Homo sapiens
gaagcagcctccttatatttg

SEQ ID NO: 4710701 - DNA, 18 bp, Homo sapiens
gaagcaggctacactgac

SEQ ID NO: 4710702 - DNA, 15 bp, Homo sapiens
gaagcattccttctt

SEQ ID NO: 4710703 - DNA, 18 bp, Homo sapiens
gaagcattccttctttga

SEQ ID NO: 4710704 - DNA, 17 bp, Homo sapiens
gaagcatttactttgtg

SEQ ID NO: 4710705 - DNA, 18 bp, Homo sapiens
gaagcatttactttgtgt

SEQ ID NO: 4710706 - DNA, 15 bp, Homo sapiens
gaagccacaggcctg

SEQ ID NO: 4710707 - DNA, 17 bp, Homo sapiens
gaagccacaggcctgag

SEQ ID NO: 4710708 - DNA, 22 bp, Homo sapiens
gaagcccaggaaaggctccagg

SEQ ID NO: 4710709 - DNA, 18 bp, Homo sapiens
gaagccgctggggccagt

SEQ ID NO: 4710710 - DNA, 20 bp, Homo sapiens
gaagccgctggggccagttg

SEQ ID NO: 4710711 - DNA, 21 bp, Homo sapiens
gaagccgctggggccagttgg

SEQ ID NO: 4710712 - DNA, 15 bp, Homo sapiens
gaagccttctgacct

SEQ ID NO: 4710713 - DNA, 12 bp, Homo sapiens
gaagctagctcc

SEQ ID NO: 4710714 - DNA, 14 bp, Homo sapiens
gaagctagctcccc

SEQ ID NO: 4710715 - DNA, 17 bp, Homo sapiens
gaagctagctcccctcc

SEQ ID NO: 4710716 - DNA, 16 bp, Homo sapiens
gaagctcagggcctgg

SEQ ID NO: 4710717 - DNA, 22 bp, Homo sapiens
gaagctgggactcattcacatt

SEQ ID NO: 4710718 - DNA, 13 bp, Homo sapiens
gaagctgttgtac

SEQ ID NO: 4710719 - DNA, 19 bp, Homo sapiens
gaagctgttgtacatttat

SEQ ID NO: 4710720 - DNA, 22 bp, Homo sapiens
gaagctgttgtacatttatgat

SEQ ID NO: 4710721 - DNA, 14 bp, Homo sapiens
gaagctttcagtat

SEQ ID NO: 4710722 - DNA, 14 bp, Homo sapiens
gaagctttctgtct

SEQ ID NO: 4710723 - DNA, 21 bp, Homo sapiens
gaaggaaaaaattatgttttt

SEQ ID NO: 4710724 - DNA, 23 bp, Homo sapiens
gaaggaaaaaattatgtttttca

SEQ ID NO: 4710725 - DNA, 20 bp, Homo sapiens
gaaggacattgcggacagcc

SEQ ID NO: 4710726 - DNA, 22 bp, Homo sapiens
gaaggactgtgacaggcagcag

SEQ ID NO: 4710727 - DNA, 19 bp, Homo sapiens
gaaggaggtaaaggatgag

SEQ ID NO: 4710728 - DNA, 20 bp, Homo sapiens
gaaggaggtaaaggatgagg

SEQ ID NO: 4710729 - DNA, 23 bp, Homo sapiens
gaaggatccatctttgtatattt

SEQ ID NO: 4710730 - DNA, 17 bp, Homo sapiens
gaaggcagcaggtggca

SEQ ID NO: 4710731 - DNA, 13 bp, Homo sapiens
gaaggcagggagg

SEQ ID NO: 4710732 - DNA, 22 bp, Homo sapiens
gaaggcagggagggcctgggcc

SEQ ID NO: 4710733 - DNA, 19 bp, Homo sapiens
gaaggccccgcccaggctt

SEQ ID NO: 4710734 - DNA, 19 bp, Homo sapiens
gaaggctcgagcatgcctg

SEQ ID NO: 4710735 - DNA, 22 bp, Homo sapiens
gaaggctgggttctgatcctag

SEQ ID NO: 4710736 - DNA, 22 bp, Homo sapiens
gaagggcctgcccagttgcact

SEQ ID NO: 4710737 - DNA, 22 bp, Homo sapiens
gaaggggagataagggtatctg

SEQ ID NO: 4710738 - DNA, 14 bp, Homo sapiens
gaaggggccagagg

SEQ ID NO: 4710739 - DNA, 15 bp, Homo sapiens
gaagggggctgggac

SEQ ID NO: 4710740 - DNA, 22 bp, Homo sapiens
gaagtaagcagagttctttgca

SEQ ID NO: 4710741 - DNA, 13 bp, Homo sapiens
gaagtcttctatt

SEQ ID NO: 4710742 - DNA, 17 bp, Homo sapiens
gaagtcttctatttatt

SEQ ID NO: 4710743 - DNA, 15 bp, Homo sapiens
gaagtcttgcattga

SEQ ID NO: 4710744 - DNA, 18 bp, Homo sapiens
gaagtgactgtaccactt

SEQ ID NO: 4710745 - DNA, 21 bp, Homo sapiens
gaagtgagaagggctcagaga

SEQ ID NO: 4710746 - DNA, 16 bp, Homo sapiens
gcttcatttcctgtgt

SEQ ID NO: 4710747 - DNA, 17 bp, Homo sapiens
gcttcatttcctgtgtc

SEQ ID NO: 4710748 - DNA, 18 bp, Homo sapiens
gcttcatttcctgtgtct

SEQ ID NO: 4710749 - DNA, 21 bp, Homo sapiens
gcttccaggtaaaaacagata

SEQ ID NO: 4710750 - DNA, 17 bp, Homo sapiens
gcttccattaacaaatg

SEQ ID NO: 4710751 - DNA, 18 bp, Homo sapiens
gcttcccagtggctgctg

SEQ ID NO: 4710752 - DNA, 19 bp, Homo sapiens
gcttcccagtggctgctgc

SEQ ID NO: 4710753 - DNA, 20 bp, Homo sapiens
gcttcccagtggctgctgcc

SEQ ID NO: 4710754 - DNA, 13 bp, Homo sapiens
gcttctgccactt

SEQ ID NO: 4710755 - DNA, 16 bp, Homo sapiens
gcttctgccacttccc

SEQ ID NO: 4710756 - DNA, 18 bp, Homo sapiens
gcttctgccacttcccag

SEQ ID NO: 4710757 - DNA, 12 bp, Homo sapiens
gcttctgctggg

SEQ ID NO: 4710758 - DNA, 15 bp, Homo sapiens
gcttctgctgggctg

SEQ ID NO: 4710759 - DNA, 19 bp, Homo sapiens
gcttcttaatcttttcaca

SEQ ID NO: 4710760 - DNA, 19 bp, Homo sapiens
gcttcttcagagactcctg

SEQ ID NO: 4710761 - DNA, 14 bp, Homo sapiens
gcttgccacagagc

SEQ ID NO: 4710762 - DNA, 16 bp, Homo sapiens
gcttgccacagagcgg

SEQ ID NO: 4710763 - DNA, 23 bp, Homo sapiens
gcttgcctcggctcctgctgcac

SEQ ID NO: 4710764 - DNA, 11 bp, Homo sapiens
gcttgcttctt

SEQ ID NO: 4710765 - DNA, 19 bp, Homo sapiens
gcttgctttcttctcctgt

SEQ ID NO: 4710766 - DNA, 12 bp, Homo sapiens
gcttggactgga

SEQ ID NO: 4710767 - DNA, 17 bp, Homo sapiens
gcttgtaaatagctcag

SEQ ID NO: 4710768 - DNA, 21 bp, Homo sapiens
gctttagaattctaattgtca

SEQ ID NO: 4710769 - DNA, 17 bp, Homo sapiens
gctttataccccatttg

SEQ ID NO: 4710770 - DNA, 23 bp, Homo sapiens
gctttctacccagcgagccctgg

SEQ ID NO: 4710771 - DNA, 20 bp, Homo sapiens
gctttctctggacactgcca

SEQ ID NO: 4710772 - DNA, 14 bp, Homo sapiens
gctttgttcttgtc

SEQ ID NO: 4710773 - DNA, 21 bp, Homo sapiens
gctttgtttaagcatcacatt

SEQ ID NO: 4710774 - DNA, 17 bp, Homo sapiens
gcttttacgtagtaaaa

SEQ ID NO: 4710775 - DNA, 19 bp, Homo sapiens
gcttttcccaacccccagc

SEQ ID NO: 4710776 - DNA, 22 bp, Homo sapiens
gctttttaattgttgtttcttt

SEQ ID NO: 4710777 - DNA, 22 bp, Homo sapiens
gctttttttgcctaccatttca

SEQ ID NO: 4710778 - DNA, 13 bp, Homo sapiens
ggaaaaaattaac

SEQ ID NO: 4710779 - DNA, 14 bp, Homo sapiens
ggaaaaatgtgaaa

SEQ ID NO: 4710780 - DNA, 12 bp, Homo sapiens
ggaaaaccagac

SEQ ID NO: 4710781 - DNA, 22 bp, Homo sapiens
ggaaaaccagactacttgggag

SEQ ID NO: 4710782 - DNA, 12 bp, Homo sapiens
ggaaaattattt

SEQ ID NO: 4710783 - DNA, 20 bp, Homo sapiens
ggaaacagctaatgggacac

SEQ ID NO: 4710784 - DNA, 19 bp, Homo sapiens
ggaaaccacagctgctgga

SEQ ID NO: 4710785 - DNA, 16 bp, Homo sapiens
ggaaagagtaggaaga

SEQ ID NO: 4710786 - DNA, 17 bp, Homo sapiens
ggaaagagtaggaagac

SEQ ID NO: 4710787 - DNA, 14 bp, Homo sapiens
ggaaagcatttaaa

SEQ ID NO: 4710788 - DNA, 18 bp, Homo sapiens
ggaaaggcaaatgcccaa

SEQ ID NO: 4710789 - DNA, 12 bp, Homo sapiens
ggaaaggctcca

SEQ ID NO: 4710790 - DNA, 17 bp, Homo sapiens
ggaaaggctccaggagc

SEQ ID NO: 4710791 - DNA, 21 bp, Homo sapiens
ggaaaggctccaggagcagcc

SEQ ID NO: 4710792 - DNA, 19 bp, Homo sapiens
ggaaagtgctgtcttaaac

SEQ ID NO: 4710793 - DNA, 17 bp, Homo sapiens
ggaaagttttgttctgt

SEQ ID NO: 4710794 - DNA, 16 bp, Homo sapiens
ggaaatccagggtggt

SEQ ID NO: 4710795 - DNA, 18 bp, Homo sapiens
ggaaatgatcagtttttt

SEQ ID NO: 4710796 - DNA, 16 bp, Homo sapiens
ggaaatgggcagagca

SEQ ID NO: 4710797 - DNA, 18 bp, Homo sapiens
ggaaatgggcagagcaga

SEQ ID NO: 4710798 - DNA, 22 bp, Homo sapiens
ggaaatgggcagagcagagacc

SEQ ID NO: 4710799 - DNA, 13 bp, Homo sapiens
ggaaatggtgcct

SEQ ID NO: 4710800 - DNA, 20 bp, Homo sapiens
ggaaattcccttcatctgga

SEQ ID NO: 4710801 - DNA, 22 bp, Homo sapiens
ggaaattcccttcatctggaac

SEQ ID NO: 4710802 - DNA, 19 bp, Homo sapiens
ggaacagactggaagcaca

SEQ ID NO: 4710803 - DNA, 17 bp, Homo sapiens
ggaacatggggaggagg

SEQ ID NO: 4710804 - DNA, 24 bp, Homo sapiens
ggaacccttacagtaggagcccag

SEQ ID NO: 4710805 - DNA, 14 bp, Homo sapiens
ggaagacctggcaa

SEQ ID NO: 4710806 - DNA, 12 bp, Homo sapiens
ggaagactttgg

SEQ ID NO: 4710807 - DNA, 19 bp, Homo sapiens
ggaagctagctcccctcct

SEQ ID NO: 4710808 - DNA, 16 bp, Homo sapiens
ggaagctcagggcctg

SEQ ID NO: 4710809 - DNA, 23 bp, Homo sapiens
ggaagctcagggcctggctcagg

SEQ ID NO: 4710810 - DNA, 16 bp, Homo sapiens
ggaaggaaacccagct

SEQ ID NO: 4710811 - DNA, 19 bp, Homo sapiens
ggaaggaaacccagctctg

SEQ ID NO: 4710812 - DNA, 20 bp, Homo sapiens
ggaaggaaacccagctctgg

SEQ ID NO: 4710813 - DNA, 13 bp, Homo sapiens
ggaaggagctgcc

SEQ ID NO: 4710814 - DNA, 14 bp, Homo sapiens
ggaaggagctgcct

SEQ ID NO: 4710815 - DNA, 22 bp, Homo sapiens
ggaaggagctgcctggacccgt

SEQ ID NO: 4710816 - DNA, 23 bp, Homo sapiens
ggaaggggagataagggtatctg

SEQ ID NO: 4710817 - DNA, 16 bp, Homo sapiens
ggaagtaggaagtaaa

SEQ ID NO: 4710818 - DNA, 14 bp, Homo sapiens
ggcaggagggcagt

SEQ ID NO: 4710819 - DNA, 15 bp, Homo sapiens
ggcaggatgacttta

SEQ ID NO: 4710820 - DNA, 22 bp, Homo sapiens
ggcaggcatggctggtgcctga

SEQ ID NO: 4710821 - DNA, 16 bp, Homo sapiens
ggcaggccctgcactg

SEQ ID NO: 4710822 - DNA, 19 bp, Homo sapiens
ggcaggccctgcactgtcc

SEQ ID NO: 4710823 - DNA, 18 bp, Homo sapiens
ggcaggctagaacctggc

SEQ ID NO: 4710824 - DNA, 19 bp, Homo sapiens
ggcagggagggcctgggcc

SEQ ID NO: 4710825 - DNA, 23 bp, Homo sapiens
ggcagtcattcagcaccagagca

SEQ ID NO: 4710826 - DNA, 14 bp, Homo sapiens
ggcagtgggagctg

SEQ ID NO: 4710827 - DNA, 18 bp, Homo sapiens
ggcagtgggagctgcctg

SEQ ID NO: 4710828 - DNA, 15 bp, Homo sapiens
ggcagtgtttgtata

SEQ ID NO: 4710829 - DNA, 19 bp, Homo sapiens
ggcagtttttctgtatttt

SEQ ID NO: 4710830 - DNA, 13 bp, Homo sapiens
ggcatcagctggc

SEQ ID NO: 4710831 - DNA, 22 bp, Homo sapiens
ggcatctaattcttatttttaa

SEQ ID NO: 4710832 - DNA, 23 bp, Homo sapiens
ggcatgacccagtgaagatgcag

SEQ ID NO: 4710833 - DNA, 14 bp, Homo sapiens
ggcatgggtcggga

SEQ ID NO: 4710834 - DNA, 18 bp, Homo sapiens
ggcattccccaggaggcc

SEQ ID NO: 4710835 - DNA, 19 bp, Homo sapiens
ggcattggcagcaggtgct

SEQ ID NO: 4710836 - DNA, 21 bp, Homo sapiens
ggccaaggatgccccgtcccc

SEQ ID NO: 4710837 - DNA, 17 bp, Homo sapiens
ggccacaagacccttgt

SEQ ID NO: 4710838 - DNA, 14 bp, Homo sapiens
ggccacctcaccct

SEQ ID NO: 4710839 - DNA, 16 bp, Homo sapiens
ggccacctcaccctct

SEQ ID NO: 4710840 - DNA, 22 bp, Homo sapiens
ggccacctgcggtgctatctcc

SEQ ID NO: 4710841 - DNA, 20 bp, Homo sapiens
ggccagatgcacatccctgg

SEQ ID NO: 4710842 - DNA, 22 bp, Homo sapiens
ggccagatgtcgctgggtcctc

SEQ ID NO: 4710843 - DNA, 19 bp, Homo sapiens
ggccagccctcccagcagt

SEQ ID NO: 4710844 - DNA, 11 bp, Homo sapiens
ggccaggctgg

SEQ ID NO: 4710845 - DNA, 14 bp, Homo sapiens
ggccaggctggtct

SEQ ID NO: 4710846 - DNA, 18 bp, Homo sapiens
ggccaggctggtctcaaa

SEQ ID NO: 4710847 - DNA, 17 bp, Homo sapiens
ggccagggcctggaaga

SEQ ID NO: 4710848 - DNA, 14 bp, Homo sapiens
ggccagttggtccc

SEQ ID NO: 4710849 - DNA, 16 bp, Homo sapiens
ggccatactggcctcg

SEQ ID NO: 4710850 - DNA, 15 bp, Homo sapiens
ggccatcctgtccca

SEQ ID NO: 4710851 - DNA, 11 bp, Homo sapiens
ggaggatttgg

SEQ ID NO: 4710852 - DNA, 12 bp, Homo sapiens
ggaggccagcct

SEQ ID NO: 4710853 - DNA, 21 bp, Homo sapiens
ggaggctcacccccttctcca

SEQ ID NO: 4710854 - DNA, 15 bp, Homo sapiens
ggaggctccagaggg

SEQ ID NO: 4710855 - DNA, 16 bp, Homo sapiens
ggagggagggctccag

SEQ ID NO: 4710856 - DNA, 17 bp, Homo sapiens
ggagggagggctccaga

SEQ ID NO: 4710857 - DNA, 21 bp, Homo sapiens
ggagggcacattccttgcctg

SEQ ID NO: 4710858 - DNA, 15 bp, Homo sapiens
ggagggcagcagggc

SEQ ID NO: 4710859 - DNA, 20 bp, Homo sapiens
ggagggctagaacctagaag

SEQ ID NO: 4710860 - DNA, 21 bp, Homo sapiens
ggagggctagaacctggaagg

SEQ ID NO: 4710861 - DNA, 20 bp, Homo sapiens
ggagggctagaacctggaga

SEQ ID NO: 4710862 - DNA, 22 bp, Homo sapiens
ggagggctagaacctggagagc

SEQ ID NO: 4710863 - DNA, 20 bp, Homo sapiens
ggagggctagaacctggcag

SEQ ID NO: 4710864 - DNA, 23 bp, Homo sapiens
ggagggctagaacctggcaggtt

SEQ ID NO: 4710865 - DNA, 19 bp, Homo sapiens
ggagggctagaactggaga

SEQ ID NO: 4710866 - DNA, 14 bp, Homo sapiens
ggagggctccagac

SEQ ID NO: 4710867 - DNA, 16 bp, Homo sapiens
ggagggctggaatctg

SEQ ID NO: 4710868 - DNA, 13 bp, Homo sapiens
ggaggggcccgct

SEQ ID NO: 4710869 - DNA, 18 bp, Homo sapiens
ggaggggcccgcttgcct

SEQ ID NO: 4710870 - DNA, 14 bp, Homo sapiens
ggaggggggaggtg

SEQ ID NO: 4710871 - DNA, 16 bp, Homo sapiens
ggaggggggaggtggg

SEQ ID NO: 4710872 - DNA, 22 bp, Homo sapiens
ggaggtgggatcctccaggtgc

SEQ ID NO: 4710873 - DNA, 15 bp, Homo sapiens
ggagtcaatttgcct

SEQ ID NO: 4710874 - DNA, 20 bp, Homo sapiens
ggagtcccaccttggctgca

SEQ ID NO: 4710875 - DNA, 11 bp, Homo sapiens
ggagtgacaga

SEQ ID NO: 4710876 - DNA, 16 bp, Homo sapiens
ggagtgacagaggcag

SEQ ID NO: 4710877 - DNA, 14 bp, Homo sapiens
ggagtgagacccag

SEQ ID NO: 4710878 - DNA, 12 bp, Homo sapiens
ggagtgagctgg

SEQ ID NO: 4710879 - DNA, 17 bp, Homo sapiens
ggagttccagcaaacaa

SEQ ID NO: 4710880 - DNA, 13 bp, Homo sapiens
ggatactaaagta

SEQ ID NO: 4710881 - DNA, 19 bp, Homo sapiens
ggatatataggctattttc

SEQ ID NO: 4710882 - DNA, 18 bp, Homo sapiens
ggatatttgatatttggt

SEQ ID NO: 4710883 - DNA, 21 bp, Homo sapiens
ggatcagtctgattcccaagc

SEQ ID NO: 4710884 - DNA, 16 bp, Homo sapiens
ggatcatggtgtaata

SEQ ID NO: 4710885 - DNA, 19 bp, Homo sapiens
ggcgcagcgcagagcgggc

SEQ ID NO: 4710886 - DNA, 16 bp, Homo sapiens
ggcgtcctctccctcc

SEQ ID NO: 4710887 - DNA, 18 bp, Homo sapiens
ggcgtcctctccctcctg

SEQ ID NO: 4710888 - DNA, 11 bp, Homo sapiens
ggcgtttcttt

SEQ ID NO: 4710889 - DNA, 18 bp, Homo sapiens
ggctaacatttaggagaa

SEQ ID NO: 4710890 - DNA, 20 bp, Homo sapiens
ggctaagcttcactgtaaaa

SEQ ID NO: 4710891 - DNA, 19 bp, Homo sapiens
ggctaaggcgtggagctgc

SEQ ID NO: 4710892 - DNA, 22 bp, Homo sapiens
ggctaaggcgtggagctgcctg

SEQ ID NO: 4710893 - DNA, 13 bp, Homo sapiens
ggctaatttaaca

SEQ ID NO: 4710894 - DNA, 12 bp, Homo sapiens
ggctacacaggg

SEQ ID NO: 4710895 - DNA, 15 bp, Homo sapiens
ggctacacagggatg

SEQ ID NO: 4710896 - DNA, 21 bp, Homo sapiens
ggctagaaccaagaagggcta

SEQ ID NO: 4710897 - DNA, 22 bp, Homo sapiens
ggctagaacctggagagctaga

SEQ ID NO: 4710898 - DNA, 18 bp, Homo sapiens
ggctagaacctggagggc

SEQ ID NO: 4710899 - DNA, 22 bp, Homo sapiens
ggctagaacctgtagagctaga

SEQ ID NO: 4710900 - DNA, 16 bp, Homo sapiens
ggctagaatctggaga

SEQ ID NO: 4710901 - DNA, 15 bp, Homo sapiens
ggctagttgggcttc

SEQ ID NO: 4710902 - DNA, 21 bp, Homo sapiens
ggctatggatctgatttttaa

SEQ ID NO: 4710903 - DNA, 17 bp, Homo sapiens
ggctcacactgagaatg

SEQ ID NO: 4710904 - DNA, 12 bp, Homo sapiens
ggctcagagagg

SEQ ID NO: 4710905 - DNA, 18 bp, Homo sapiens
ggctcagagaggacaaaa

SEQ ID NO: 4710906 - DNA, 23 bp, Homo sapiens
ggctcagccccaccccagggcag

SEQ ID NO: 4710907 - DNA, 18 bp, Homo sapiens
ggctcagcggggacagct

SEQ ID NO: 4710908 - DNA, 23 bp, Homo sapiens
ggctcagcggggacagctccttc

SEQ ID NO: 4710909 - DNA, 17 bp, Homo sapiens
ggctcagggaccacagc

SEQ ID NO: 4710910 - DNA, 10 bp, Homo sapiens
ggctccagac

SEQ ID NO: 4710911 - DNA, 13 bp, Homo sapiens
ggctccaggagca

SEQ ID NO: 4710912 - DNA, 16 bp, Homo sapiens
ggctccaggagcagcc

SEQ ID NO: 4710913 - DNA, 17 bp, Homo sapiens
ggctccaggagcagcca

SEQ ID NO: 4710914 - DNA, 20 bp, Homo sapiens
ggctccctgggggcggccag

SEQ ID NO: 4710915 - DNA, 17 bp, Homo sapiens
ggctcccttcccacctc

SEQ ID NO: 4710916 - DNA, 21 bp, Homo sapiens
ggggcccatggaggagacagg

SEQ ID NO: 4710917 - DNA, 15 bp, Homo sapiens
ggggcccgcttgcct

SEQ ID NO: 4710918 - DNA, 23 bp, Homo sapiens
ggggcccgcttgcctcggctcct

SEQ ID NO: 4710919 - DNA, 23 bp, Homo sapiens
ggggcccggacgcccaggacccc

SEQ ID NO: 4710920 - DNA, 20 bp, Homo sapiens
ggggcccgttgtctccctgg

SEQ ID NO: 4710921 - DNA, 23 bp, Homo sapiens
ggggcccgttgtctccctggccc

SEQ ID NO: 4710922 - DNA, 19 bp, Homo sapiens
ggggccctgcctcctttgt

SEQ ID NO: 4710923 - DNA, 23 bp, Homo sapiens
ggggccctgcctcctttgtgagg

SEQ ID NO: 4710924 - DNA, 21 bp, Homo sapiens
ggggcggccagccctcccagc

SEQ ID NO: 4710925 - DNA, 14 bp, Homo sapiens
ggggctagaaccta

SEQ ID NO: 4710926 - DNA, 21 bp, Homo sapiens
ggggctagaacctagagaagc

SEQ ID NO: 4710927 - DNA, 22 bp, Homo sapiens
ggggctgcaccggctggcctgg

SEQ ID NO: 4710928 - DNA, 14 bp, Homo sapiens
ggggctgccagggg

SEQ ID NO: 4710929 - DNA, 16 bp, Homo sapiens
ggggctggaggagccc

SEQ ID NO: 4710930 - DNA, 12 bp, Homo sapiens
gggggagggagg

SEQ ID NO: 4710931 - DNA, 17 bp, Homo sapiens
gggggcctcagtgccac

SEQ ID NO: 4710932 - DNA, 19 bp, Homo sapiens
gggggtcctcctccaggga

SEQ ID NO: 4710933 - DNA, 15 bp, Homo sapiens
ggggtaccagccact

SEQ ID NO: 4710934 - DNA, 22 bp, Homo sapiens
ggggtcctcacatggcgtcctg

SEQ ID NO: 4710935 - DNA, 12 bp, Homo sapiens
ggggtggcctcc

SEQ ID NO: 4710936 - DNA, 23 bp, Homo sapiens
ggggttcccttttttggctgctg

SEQ ID NO: 4710937 - DNA, 19 bp, Homo sapiens
ggggttcggcctgtgtccc

SEQ ID NO: 4710938 - DNA, 22 bp, Homo sapiens
gggtacttgtggacacagctct

SEQ ID NO: 4710939 - DNA, 12 bp, Homo sapiens
gggtcaaggaat

SEQ ID NO: 4710940 - DNA, 22 bp, Homo sapiens
gggtcactctggcagctcagag

SEQ ID NO: 4710941 - DNA, 15 bp, Homo sapiens
gggtcatccttgccc

SEQ ID NO: 4710942 - DNA, 22 bp, Homo sapiens
gttgaatattggtaattaaaag

SEQ ID NO: 4710943 - DNA, 22 bp, Homo sapiens
gttgatagcacagaccctgccc

SEQ ID NO: 4710944 - DNA, 16 bp, Homo sapiens
gttgatgttggctggg

SEQ ID NO: 4710945 - DNA, 23 bp, Homo sapiens
gttgatttcagcacctacagtgt

SEQ ID NO: 4710946 - DNA, 15 bp, Homo sapiens
gttgcaaactcagcc

SEQ ID NO: 4710947 - DNA, 15 bp, Homo sapiens
gttgcactgaaaacc

SEQ ID NO: 4710948 - DNA, 20 bp, Homo sapiens
gttgcagtgagccgagatca

SEQ ID NO: 4710949 - DNA, 16 bp, Homo sapiens
gttgcataaacaatcc

SEQ ID NO: 4710950 - DNA, 23 bp, Homo sapiens
gttgccatcctaccgtcttttcc

SEQ ID NO: 4710951 - DNA, 15 bp, Homo sapiens
gttgcccaggcaggt

SEQ ID NO: 4710952 - DNA, 13 bp, Homo sapiens
gttgcccaggctg

SEQ ID NO: 4710953 - DNA, 15 bp, Homo sapiens
taaaacaacactcac

SEQ ID NO: 4710954 - DNA, 22 bp, Homo sapiens
taaaacagagaaggtcaatcta

SEQ ID NO: 4710955 - DNA, 20 bp, Homo sapiens
taaaacagctaaatttggag

SEQ ID NO: 4710956 - DNA, 21 bp, Homo sapiens
taaaacaggttataacagtgt

SEQ ID NO: 4710957 - DNA, 21 bp, Homo sapiens
taaaaccatgtagaaaatttg

SEQ ID NO: 4710958 - DNA, 19 bp, Homo sapiens
taaaacttcaaaaactaaa

SEQ ID NO: 4710959 - DNA, 22 bp, Homo sapiens
taaaagacaaatcaaagcagat

SEQ ID NO: 4710960 - DNA, 20 bp, Homo sapiens
taaaagacagtgaaagaaaa

SEQ ID NO: 4710961 - DNA, 13 bp, Homo sapiens
taaaagactcatc

SEQ ID NO: 4710962 - DNA, 16 bp, Homo sapiens
taaaagactcatccgt

SEQ ID NO: 4710963 - DNA, 22 bp, Homo sapiens
taaaagataaatttgttgaata

SEQ ID NO: 4710964 - DNA, 21 bp, Homo sapiens
taaaagcaggcttctatgaaa

SEQ ID NO: 4710965 - DNA, 12 bp, Homo sapiens
taaaagcctgct

SEQ ID NO: 4710966 - DNA, 12 bp, Homo sapiens
taaaaggagcca

SEQ ID NO: 4710967 - DNA, 20 bp, Homo sapiens
taaaagtacatgttaaactt

SEQ ID NO: 4710968 - DNA, 13 bp, Homo sapiens
taaaagtagtaaa

SEQ ID NO: 4710969 - DNA, 17 bp, Homo sapiens
taaaagtagtaaatttt

SEQ ID NO: 4710970 - DNA, 15 bp, Homo sapiens
taaaagtcataaatg

SEQ ID NO: 4710971 - DNA, 15 bp, Homo sapiens
taaaagtttgtcctt

SEQ ID NO: 4710972 - DNA, 20 bp, Homo sapiens
taaaatatgaagacataaac

SEQ ID NO: 4710973 - DNA, 15 bp, Homo sapiens
taaaatatggaaaat

SEQ ID NO: 4710974 - DNA, 18 bp, Homo sapiens
taaaatccaatattgtaa

SEQ ID NO: 4710975 - DNA, 19 bp, Homo sapiens
taaaatccaatattgtaat

SEQ ID NO: 4710976 - DNA, 14 bp, Homo sapiens
taaaatcttcagct

SEQ ID NO: 4710977 - DNA, 17 bp, Homo sapiens
taaaatcttcagctggt

SEQ ID NO: 4710978 - DNA, 20 bp, Homo sapiens
taaaatcttcagctggtgga

SEQ ID NO: 4710979 - DNA, 16 bp, Homo sapiens
taaaatggatttaatc

SEQ ID NO: 4710980 - DNA, 19 bp, Homo sapiens
taaaattaaagctgaaaac

SEQ ID NO: 4710981 - DNA, 15 bp, Homo sapiens
taaaattatttcatg

SEQ ID NO: 4710982 - DNA, 12 bp, Homo sapiens
taaaattgttat

SEQ ID NO: 4710983 - DNA, 16 bp, Homo sapiens
taaaatttgccctccc

SEQ ID NO: 4710984 - DNA, 15 bp, Homo sapiens
taaaattttggatta

SEQ ID NO: 4710985 - DNA, 18 bp, Homo sapiens
taaacaagaaccatttgc

SEQ ID NO: 4710986 - DNA, 19 bp, Homo sapiens
taaacagaaatgctctgat

SEQ ID NO: 4710987 - DNA, 18 bp, Homo sapiens
taaacagatgtccctgaa

SEQ ID NO: 4710988 - DNA, 15 bp, Homo sapiens
taaacagtgtttatg

SEQ ID NO: 4710989 - DNA, 16 bp, Homo sapiens
taaacagtgtttatga

SEQ ID NO: 4710990 - DNA, 15 bp, Homo sapiens
taaacattttcatgc

SEQ ID NO: 4710991 - DNA, 13 bp, Homo sapiens
taaaccctctgtg

SEQ ID NO: 4710992 - DNA, 16 bp, Homo sapiens
taaaccctctgtgaaa

SEQ ID NO: 4710993 - DNA, 19 bp, Homo sapiens
taaaccttgtttctttctg

SEQ ID NO: 4710994 - DNA, 21 bp, Homo sapiens
taaaccttgtttctttctgaa

SEQ ID NO: 4710995 - DNA, 14 bp, Homo sapiens
taaacgtaaatgtt

SEQ ID NO: 4710996 - DNA, 15 bp, Homo sapiens
taaactccaggattt

SEQ ID NO: 4710997 - DNA, 20 bp, Homo sapiens
taaactccaggatttataaa

SEQ ID NO: 4710998 - DNA, 24 bp, Homo sapiens
taaactcctactgcttcctctgaa

SEQ ID NO: 4710999 - DNA, 12 bp, Homo sapiens
taaactgccccc

SEQ ID NO: 4711000 - DNA, 20 bp, Homo sapiens
taaactgccccctctgccct

SEQ ID NO: 4711001 - DNA, 22 bp, Homo sapiens
taaacttcttttctcttctaca

SEQ ID NO: 4711002 - DNA, 16 bp, Homo sapiens
taaagaaaagttttgt

SEQ ID NO: 4711003 - DNA, 23 bp, Homo sapiens
taaagaaaatgtgtctgcaacat

SEQ ID NO: 4711004 - DNA, 16 bp, Homo sapiens
taaagaaagcaacttt

SEQ ID NO: 4711005 - DNA, 16 bp, Homo sapiens
taaagaaggatgatgt

SEQ ID NO: 4711006 - DNA, 16 bp, Homo sapiens
taaagaatttctttat

SEQ ID NO: 4711007 - DNA, 18 bp, Homo sapiens
taaagagttagtttgagt

SEQ ID NO: 4711008 - DNA, 12 bp, Homo sapiens
taaagattaaca

SEQ ID NO: 4711009 - DNA, 22 bp, Homo sapiens
taaagattaacactcatttcca

SEQ ID NO: 4711010 - DNA, 15 bp, Homo sapiens
taaagcaatatgcat

SEQ ID NO: 4711011 - DNA, 17 bp, Homo sapiens
taaagcagattacctct

SEQ ID NO: 4711012 - DNA, 18 bp, Homo sapiens
taaagcagattacctctt

SEQ ID NO: 4711013 - DNA, 14 bp, Homo sapiens
taaagctagaaatg

SEQ ID NO: 4711014 - DNA, 14 bp, Homo sapiens
taaagctgaaaact

SEQ ID NO: 4711015 - DNA, 16 bp, Homo sapiens
taaaggacaaacagtg

SEQ ID NO: 4711016 - DNA, 17 bp, Homo sapiens
taaaggacaaacagtga

SEQ ID NO: 4711017 - DNA, 21 bp, Homo sapiens
taaaggacaaacagtgaattt

SEQ ID NO: 4711018 - DNA, 22 bp, Homo sapiens
taaaggacaaacagtgaattta

SEQ ID NO: 4711019 - DNA, 13 bp, Homo sapiens
taaaggatgaggg

SEQ ID NO: 4711020 - DNA, 13 bp, Homo sapiens
taaagtcaggggt

SEQ ID NO: 4711021 - DNA, 22 bp, Homo sapiens
taaagtgaattgttgacaaatg

SEQ ID NO: 4711022 - DNA, 19 bp, Homo sapiens
taaagtgacaaaagctcat

SEQ ID NO: 4711023 - DNA, 18 bp, Homo sapiens
taaagtgcacacctttat

SEQ ID NO: 4711024 - DNA, 15 bp, Homo sapiens
taaagtgtgtgtgca

SEQ ID NO: 4711025 - DNA, 19 bp, Homo sapiens
taaagttgtataaaaacat

SEQ ID NO: 4711026 - DNA, 22 bp, Homo sapiens
taaataagaaacaactctttga

SEQ ID NO: 4711027 - DNA, 14 bp, Homo sapiens
taaatactggactc

SEQ ID NO: 4711028 - DNA, 15 bp, Homo sapiens
taaatactggactca

SEQ ID NO: 4711029 - DNA, 21 bp, Homo sapiens
taaataggagaggatgagagc

SEQ ID NO: 4711030 - DNA, 20 bp, Homo sapiens
taaatatagttgtctttctt

SEQ ID NO: 4711031 - DNA, 18 bp, Homo sapiens
taaatatatataaattga

SEQ ID NO: 4711032 - DNA, 14 bp, Homo sapiens
taaatatgcagtga

SEQ ID NO: 4711033 - DNA, 13 bp, Homo sapiens
taaatatgtgaag

SEQ ID NO: 4711034 - DNA, 21 bp, Homo sapiens
taaatatgtgaagaaaaagac

SEQ ID NO: 4711035 - DNA, 19 bp, Homo sapiens
taaatcaagttggcttcta

SEQ ID NO: 4711036 - DNA, 17 bp, Homo sapiens
taaatcattcttactaa

SEQ ID NO: 4711037 - DNA, 16 bp, Homo sapiens
taaatcctgaagagca

SEQ ID NO: 4711038 - DNA, 15 bp, Homo sapiens
taaatctgaagaaag

SEQ ID NO: 4711039 - DNA, 18 bp, Homo sapiens
taaatgaaaatcgtgaca

SEQ ID NO: 4711040 - DNA, 20 bp, Homo sapiens
taaatgaacacatggcagaa

SEQ ID NO: 4711041 - DNA, 20 bp, Homo sapiens
taaatgaagggtcatttctc

SEQ ID NO: 4711042 - DNA, 21 bp, Homo sapiens
taaatgaagggtcatttctct

SEQ ID NO: 4711043 - DNA, 16 bp, Homo sapiens
taaatgtacttatatt

SEQ ID NO: 4711044 - DNA, 13 bp, Homo sapiens
taaatgtggtaaa

SEQ ID NO: 4711045 - DNA, 11 bp, Homo sapiens
taaatgttcac

SEQ ID NO: 4711046 - DNA, 19 bp, Homo sapiens
taaatgtttgttatttaca

SEQ ID NO: 4711047 - DNA, 19 bp, Homo sapiens
taaattaccataaaatgtc

SEQ ID NO: 4711048 - DNA, 20 bp, Homo sapiens
taaattaccataaaatgtca

SEQ ID NO: 4711049 - DNA, 20 bp, Homo sapiens
taaattatttgattatttaa

SEQ ID NO: 4711050 - DNA, 19 bp, Homo sapiens
taaattcgctgtgagtgag

SEQ ID NO: 4711051 - DNA, 19 bp, Homo sapiens
taaattctctctaacataa

SEQ ID NO: 4711052 - DNA, 18 bp, Homo sapiens
taaattgttgtaattgca

SEQ ID NO: 4711053 - DNA, 18 bp, Homo sapiens
taaatttgtaagtttcag

SEQ ID NO: 4711054 - DNA, 11 bp, Homo sapiens
taaatttgttg

SEQ ID NO: 4711055 - DNA, 16 bp, Homo sapiens
ggtgctcatagcgggc

SEQ ID NO: 4711056 - DNA, 17 bp, Homo sapiens
ggtgctgcagatttgat

SEQ ID NO: 4711057 - DNA, 15 bp, Homo sapiens
ggtgctgccatccag

SEQ ID NO: 4711058 - DNA, 17 bp, Homo sapiens
ggtgctgcctctacctg

SEQ ID NO: 4711059 - DNA, 22 bp, Homo sapiens
ggtgctgctaccctccctgctg

SEQ ID NO: 4711060 - DNA, 19 bp, Homo sapiens
ggtggaagcttggggaaga

SEQ ID NO: 4711061 - DNA, 19 bp, Homo sapiens
ggtggagccaatccactcc

SEQ ID NO: 4711062 - DNA, 21 bp, Homo sapiens
ggtggatgcctggtggcagct

SEQ ID NO: 4711063 - DNA, 20 bp, Homo sapiens
ggtggcaaggctgtgctccc

SEQ ID NO: 4711064 - DNA, 13 bp, Homo sapiens
ggtggcactgcca

SEQ ID NO: 4711065 - DNA, 16 bp, Homo sapiens
ggtggcagtgggagct

SEQ ID NO: 4711066 - DNA, 20 bp, Homo sapiens
ggtggccctctcccctgccc

SEQ ID NO: 4711067 - DNA, 17 bp, Homo sapiens
ggtggccgtcctgaggg

SEQ ID NO: 4711068 - DNA, 20 bp, Homo sapiens
ggtggccgtcctgaggggga

SEQ ID NO: 4711069 - DNA, 23 bp, Homo sapiens
ggtggccgtcctgagggggaagt

SEQ ID NO: 4711070 - DNA, 17 bp, Homo sapiens
ggtggctcatgcctgta

SEQ ID NO: 4711071 - DNA, 12 bp, Homo sapiens
ggtggctgggtt

SEQ ID NO: 4711072 - DNA, 18 bp, Homo sapiens
ggtggctgggttggaggg

SEQ ID NO: 4711073 - DNA, 23 bp, Homo sapiens
ggtggggtcactctggcagctca

SEQ ID NO: 4711074 - DNA, 10 bp, Homo sapiens
ggtgggtcca

SEQ ID NO: 4711075 - DNA, 16 bp, Homo sapiens
ggtggtaccaggtctc

SEQ ID NO: 4711076 - DNA, 14 bp, Homo sapiens
ggtggtctgctcgg

SEQ ID NO: 4711077 - DNA, 20 bp, Homo sapiens
ggtggtctgctcgggcccag

SEQ ID NO: 4711078 - DNA, 16 bp, Homo sapiens
ggtggtgacctctgcc

SEQ ID NO: 4711079 - DNA, 16 bp, Homo sapiens
gtgaatcacgtaaagc

SEQ ID NO: 4711080 - DNA, 15 bp, Homo sapiens
gtgaatggattggat

SEQ ID NO: 4711081 - DNA, 12 bp, Homo sapiens
gtgacaataaaa

SEQ ID NO: 4711082 - DNA, 19 bp, Homo sapiens
gtgacaccaataaatgttt

SEQ ID NO: 4711083 - DNA, 18 bp, Homo sapiens
gtgacaccccccttctga

SEQ ID NO: 4711084 - DNA, 18 bp, Homo sapiens
gtgacagaggcagcccca

SEQ ID NO: 4711085 - DNA, 23 bp, Homo sapiens
gtgacagaggcagccccattctg

SEQ ID NO: 4711086 - DNA, 22 bp, Homo sapiens
gtgacagagtgagactctgtct

SEQ ID NO: 4711087 - DNA, 17 bp, Homo sapiens
gtgacatgtgaaacctt

SEQ ID NO: 4711088 - DNA, 16 bp, Homo sapiens
gtgaccaaaatcccct

SEQ ID NO: 4711089 - DNA, 16 bp, Homo sapiens
gtgaccaatgtcttga

SEQ ID NO: 4711090 - DNA, 15 bp, Homo sapiens
gtgacctctgcctga

SEQ ID NO: 4711091 - DNA, 13 bp, Homo sapiens
gtgactgttgtac

SEQ ID NO: 4711092 - DNA, 21 bp, Homo sapiens
gtgacttagcagatgctggtc

SEQ ID NO: 4711093 - DNA, 15 bp, Homo sapiens
gtgagaagggctcag

SEQ ID NO: 4711094 - DNA, 20 bp, Homo sapiens
gtgagacccagccctcatcc

SEQ ID NO: 4711095 - DNA, 13 bp, Homo sapiens
gtgagacccagga

SEQ ID NO: 4711096 - DNA, 14 bp, Homo sapiens
gtgagacctgcccc

SEQ ID NO: 4711097 - DNA, 15 bp, Homo sapiens
gtgagacctgcccct

SEQ ID NO: 4711098 - DNA, 21 bp, Homo sapiens
gtgagagaataatttctgttg

SEQ ID NO: 4711099 - DNA, 21 bp, Homo sapiens
gtgagcactaaggtgtgctct

SEQ ID NO: 4711100 - DNA, 17 bp, Homo sapiens
gtgagccaccgtgcctg

SEQ ID NO: 4711101 - DNA, 22 bp, Homo sapiens
gtgagccaccgtgcctggccac

SEQ ID NO: 4711102 - DNA, 14 bp, Homo sapiens
gtgagctacaaatg

SEQ ID NO: 4711103 - DNA, 19 bp, Homo sapiens
gtgaggaagccgctggggc

SEQ ID NO: 4711104 - DNA, 13 bp, Homo sapiens
gtgaggacccgcc

SEQ ID NO: 4711105 - DNA, 13 bp, Homo sapiens
gtgaggcagtggg

SEQ ID NO: 4711106 - DNA, 23 bp, Homo sapiens
gtgaggcagtgggtcccacttcc

SEQ ID NO: 4711107 - DNA, 17 bp, Homo sapiens
gtgaggccagggcagag

SEQ ID NO: 4711108 - DNA, 12 bp, Homo sapiens
gtgaggctctgc

SEQ ID NO: 4711109 - DNA, 15 bp, Homo sapiens
gtgaggctctgccct

SEQ ID NO: 4711110 - DNA, 17 bp, Homo sapiens
gtgaggctctgcccttg

SEQ ID NO: 4711111 - DNA, 12 bp, Homo sapiens
gtgagggagaga

SEQ ID NO: 4711112 - DNA, 13 bp, Homo sapiens
gtgagggagagaa

SEQ ID NO: 4711113 - DNA, 17 bp, Homo sapiens
gtgagtactacagtcct

SEQ ID NO: 4711114 - DNA, 19 bp, Homo sapiens
gtgagtcaccaagcccagt

SEQ ID NO: 4711115 - DNA, 15 bp, Homo sapiens
gtgagtcgaggacag

SEQ ID NO: 4711116 - DNA, 16 bp, Homo sapiens
gtgatatggcagaaga

SEQ ID NO: 4711117 - DNA, 17 bp, Homo sapiens
gtgatcacagcagcttc

SEQ ID NO: 4711118 - DNA, 18 bp, Homo sapiens
gtgatccacccacctcag

SEQ ID NO: 4711119 - DNA, 18 bp, Homo sapiens
gtgatccttccacctcag

SEQ ID NO: 4711120 - DNA, 19 bp, Homo sapiens
gtgatccttccacctcagt

SEQ ID NO: 4711121 - DNA, 20 bp, Homo sapiens
gtgatgaataaaataattat

SEQ ID NO: 4711122 - DNA, 14 bp, Homo sapiens
gtgatgaatactgt

SEQ ID NO: 4711123 - DNA, 22 bp, Homo sapiens
gtgatgacaactggaatagttt

SEQ ID NO: 4711124 - DNA, 22 bp, Homo sapiens
gtgatgctaaaggttgtattgc

SEQ ID NO: 4711125 - DNA, 17 bp, Homo sapiens
gtgatggggccctgcct

SEQ ID NO: 4711126 - DNA, 19 bp, Homo sapiens
gtgatggggccctgcctcc

SEQ ID NO: 4711127 - DNA, 12 bp, Homo sapiens
gtgatgtcccag

SEQ ID NO: 4711128 - DNA, 18 bp, Homo sapiens
gtgatgttgggaagctat

SEQ ID NO: 4711129 - DNA, 14 bp, Homo sapiens
gtgattctcctgcc

SEQ ID NO: 4711130 - DNA, 18 bp, Homo sapiens
gtgattctcctgcctcag

SEQ ID NO: 4711131 - DNA, 19 bp, Homo sapiens
gtgattctcctgcctcagc

SEQ ID NO: 4711132 - DNA, 17 bp, Homo sapiens
gtgatttagttgtggaa

SEQ ID NO: 4711133 - DNA, 20 bp, Homo sapiens
gtgatttcccgtggccccag

SEQ ID NO: 4711134 - DNA, 21 bp, Homo sapiens
gtgatttcccgtggccccagc

SEQ ID NO: 4711135 - DNA, 23 bp, Homo sapiens
gtgatttcccgtggccccagcct

SEQ ID NO: 4711136 - DNA, 20 bp, Homo sapiens
gtgcaaacagtgtaagctta

SEQ ID NO: 4711137 - DNA, 12 bp, Homo sapiens
gtgcaatagaag

SEQ ID NO: 4711138 - DNA, 14 bp, Homo sapiens
gtgcacacaccaga

SEQ ID NO: 4711139 - DNA, 17 bp, Homo sapiens
gtgcacatctgttttgt

SEQ ID NO: 4711140 - DNA, 18 bp, Homo sapiens
gtgcaggcctgctcaggg

SEQ ID NO: 4711141 - DNA, 13 bp, Homo sapiens
gtgcatctggtgt

SEQ ID NO: 4711142 - DNA, 22 bp, Homo sapiens
gtgcatgaaggtttctgaaaat

SEQ ID NO: 4711143 - DNA, 18 bp, Homo sapiens
gtgccaacactcaagaag

SEQ ID NO: 4711144 - DNA, 23 bp, Homo sapiens
gtgccaacactcaagaagcaggc

SEQ ID NO: 4711145 - DNA, 12 bp, Homo sapiens
gtgccaattttg

SEQ ID NO: 4711146 - DNA, 12 bp, Homo sapiens
gtgccaccctgg

SEQ ID NO: 4711147 - DNA, 20 bp, Homo sapiens
gtgccaccctgggctctgtg

SEQ ID NO: 4711148 - DNA, 22 bp, Homo sapiens
gtgccaccctgggctctgtggg

SEQ ID NO: 4711149 - DNA, 16 bp, Homo sapiens
gtgccagggcagcact

SEQ ID NO: 4711150 - DNA, 14 bp, Homo sapiens
gtgccatgtgccag

SEQ ID NO: 4711151 - DNA, 20 bp, Homo sapiens
gtgcccacaggatcagtctg

SEQ ID NO: 4711152 - DNA, 16 bp, Homo sapiens
gtgcccatgggcactg

SEQ ID NO: 4711153 - DNA, 17 bp, Homo sapiens
gtgccgccgcctcgccc

SEQ ID NO: 4711154 - DNA, 15 bp, Homo sapiens
gtgcctgagcccctc

SEQ ID NO: 4711155 - DNA, 16 bp, Homo sapiens
gtgcctgagcccctca

SEQ ID NO: 4711156 - DNA, 18 bp, Homo sapiens
gtgcctgagcccctcaga

SEQ ID NO: 4711157 - DNA, 19 bp, Homo sapiens
gtgcctgattcggctgtct

SEQ ID NO: 4711158 - DNA, 21 bp, Homo sapiens
gtgcctgtgtgcgagtctgag

SEQ ID NO: 4711159 - DNA, 16 bp, Homo sapiens
gtgcgaccccatctgc

SEQ ID NO: 4711160 - DNA, 13 bp, Homo sapiens
gtgcgtgaatatt

SEQ ID NO: 4711161 - DNA, 13 bp, Homo sapiens
gtgcgtgtgtaga

SEQ ID NO: 4711162 - DNA, 17 bp, Homo sapiens
gtgctaggaacactcct

SEQ ID NO: 4711163 - DNA, 18 bp, Homo sapiens
gtgctaggaacactcctt

SEQ ID NO: 4711164 - DNA, 13 bp, Homo sapiens
gtgctccaggcag

SEQ ID NO: 4711165 - DNA, 17 bp, Homo sapiens
gtgctctggacaggcat

SEQ ID NO: 4711166 - DNA, 18 bp, Homo sapiens
gtgctctggacaggcatg

SEQ ID NO: 4711167 - DNA, 17 bp, Homo sapiens
gtgctcttcttctttct

SEQ ID NO: 4711168 - DNA, 12 bp, Homo sapiens
gtgctgagtctg

SEQ ID NO: 4711169 - DNA, 19 bp, Homo sapiens
gtgctgagtctgaaggctg

SEQ ID NO: 4711170 - DNA, 22 bp, Homo sapiens
gtgctgccatccaggttcagct

SEQ ID NO: 4711171 - DNA, 14 bp, Homo sapiens
gtgctgccctgccc

SEQ ID NO: 4711172 - DNA, 19 bp, Homo sapiens
gtgctgccctgcccacctg

SEQ ID NO: 4711173 - DNA, 18 bp, Homo sapiens
taatgatttttgtgtatc

SEQ ID NO: 4711174 - DNA, 17 bp, Homo sapiens
taatgcaagcaaagtat

SEQ ID NO: 4711175 - DNA, 19 bp, Homo sapiens
taatgcctataactttttt

SEQ ID NO: 4711176 - DNA, 23 bp, Homo sapiens
taatgcgcaggctggccctgccc

SEQ ID NO: 4711177 - DNA, 18 bp, Homo sapiens
taatggtgaacattttaa

SEQ ID NO: 4711178 - DNA, 16 bp, Homo sapiens
tagcacagaccctgcc

SEQ ID NO: 4711179 - DNA, 22 bp, Homo sapiens
tagcacagtggacagtctttga

SEQ ID NO: 4711180 - DNA, 16 bp, Homo sapiens
tagcatgaaataaaat

SEQ ID NO: 4711181 - DNA, 21 bp, Homo sapiens
tagcatgatgaaactgtcata

SEQ ID NO: 4711182 - DNA, 24 bp, Homo sapiens
tagcattgtaaaattatttcatga

SEQ ID NO: 4711183 - DNA, 23 bp, Homo sapiens
tagccaggatcatggtgtaataa

SEQ ID NO: 4711184 - DNA, 15 bp, Homo sapiens
tagccagtcattgta

SEQ ID NO: 4711185 - DNA, 18 bp, Homo sapiens
tagccccttagcccccac

SEQ ID NO: 4711186 - DNA, 16 bp, Homo sapiens
tagcccgaatacaaac

SEQ ID NO: 4711187 - DNA, 24 bp, Homo sapiens
tagcctcgatgtcctcctctgtga

SEQ ID NO: 4711188 - DNA, 14 bp, Homo sapiens
tagcctctctttgt

SEQ ID NO: 4711189 - DNA, 21 bp, Homo sapiens
tagccttagaagtcacacagt

SEQ ID NO: 4711190 - DNA, 18 bp, Homo sapiens
tagcgcacccagagaaaa

SEQ ID NO: 4711191 - DNA, 17 bp, Homo sapiens
tagcgcccagttgggtg

SEQ ID NO: 4711192 - DNA, 16 bp, Homo sapiens
tagctactaattttaa

SEQ ID NO: 4711193 - DNA, 13 bp, Homo sapiens
tagctatttaata

SEQ ID NO: 4711194 - DNA, 16 bp, Homo sapiens
tagctcaggtgtccct

SEQ ID NO: 4711195 - DNA, 14 bp, Homo sapiens
tagctcccctccaa

SEQ ID NO: 4711196 - DNA, 15 bp, Homo sapiens
tagctcccctcctct

SEQ ID NO: 4711197 - DNA, 17 bp, Homo sapiens
tagctgggactacaggc

SEQ ID NO: 4711198 - DNA, 22 bp, Homo sapiens
tagctgtgtgaatacctgctca

SEQ ID NO: 4711199 - DNA, 14 bp, Homo sapiens
tagcttattataga

SEQ ID NO: 4711200 - DNA, 14 bp, Homo sapiens
tagctttgctctgc

SEQ ID NO: 4711201 - DNA, 15 bp, Homo sapiens
tagctttttaattgt

SEQ ID NO: 4711202 - DNA, 16 bp, Homo sapiens
tagctttttaattgtt

SEQ ID NO: 4711203 - DNA, 22 bp, Homo sapiens
taggaaaaaattgaaagaactt

SEQ ID NO: 4711204 - DNA, 16 bp, Homo sapiens
taggaaatttaagact

SEQ ID NO: 4711205 - DNA, 13 bp, Homo sapiens
taggaacactcct

SEQ ID NO: 4711206 - DNA, 16 bp, Homo sapiens
taggaagtaaattata

SEQ ID NO: 4711207 - DNA, 17 bp, Homo sapiens
taggaagttttttctac

SEQ ID NO: 4711208 - DNA, 14 bp, Homo sapiens
taggaatcagcaag

SEQ ID NO: 4711209 - DNA, 15 bp, Homo sapiens
taggaatcagcaaga

SEQ ID NO: 4711210 - DNA, 18 bp, Homo sapiens
taggaatcattctgtaaa

SEQ ID NO: 4711211 - DNA, 15 bp, Homo sapiens
taggacgccacccag

SEQ ID NO: 4711212 - DNA, 13 bp, Homo sapiens
taggactgtagaa

SEQ ID NO: 4711213 - DNA, 14 bp, Homo sapiens
taggagaggatgag

SEQ ID NO: 4711214 - DNA, 21 bp, Homo sapiens
taggagagtttactgatgaaa

SEQ ID NO: 4711215 - DNA, 14 bp, Homo sapiens
taggagcagagctc

SEQ ID NO: 4711216 - DNA, 20 bp, Homo sapiens
taggcaaatgtttaaacatt

SEQ ID NO: 4711217 - DNA, 14 bp, Homo sapiens
taggcaggacctgt

SEQ ID NO: 4711218 - DNA, 14 bp, Homo sapiens
taggcattgtggga

SEQ ID NO: 4711219 - DNA, 13 bp, Homo sapiens
taggcctggccag

SEQ ID NO: 4711220 - DNA, 20 bp, Homo sapiens
taggctattttctaaagact

SEQ ID NO: 4711221 - DNA, 14 bp, Homo sapiens
taggcttttaccat

SEQ ID NO: 4711222 - DNA, 16 bp, Homo sapiens
tagggaaaacattcca

SEQ ID NO: 4711223 - DNA, 19 bp, Homo sapiens
tagggaaaatagggtcctt

SEQ ID NO: 4711224 - DNA, 13 bp, Homo sapiens
tagggaaagaaag

SEQ ID NO: 4711225 - DNA, 14 bp, Homo sapiens
tagggaagggcctg

SEQ ID NO: 4711226 - DNA, 21 bp, Homo sapiens
tagggaagggtggtggagcca

SEQ ID NO: 4711227 - DNA, 17 bp, Homo sapiens
tagggacccctcctccc

SEQ ID NO: 4711228 - DNA, 14 bp, Homo sapiens
tagggatgagtacc

SEQ ID NO: 4711229 - DNA, 16 bp, Homo sapiens
tagggccaagcccagc

SEQ ID NO: 4711230 - DNA, 16 bp, Homo sapiens
tagggggctggaggag

SEQ ID NO: 4711231 - DNA, 20 bp, Homo sapiens
tagggggctggaggagccca

SEQ ID NO: 4711232 - DNA, 15 bp, Homo sapiens
taggggttgaagaaa

SEQ ID NO: 4711233 - DNA, 16 bp, Homo sapiens
tagggtggagagccac

SEQ ID NO: 4711234 - DNA, 15 bp, Homo sapiens
tagggtgggccttca

SEQ ID NO: 4711235 - DNA, 21 bp, Homo sapiens
tagggtgtgtgttcaccttca

SEQ ID NO: 4711236 - DNA, 16 bp, Homo sapiens
taggtgacagagtgag

SEQ ID NO: 4711237 - DNA, 24 bp, Homo sapiens
taggttggaagctagctcccctcc

SEQ ID NO: 4711238 - DNA, 18 bp, Homo sapiens
tagtaaatatgtgaagaa

SEQ ID NO: 4711239 - DNA, 13 bp, Homo sapiens
tagtagagacagg

SEQ ID NO: 4711240 - DNA, 22 bp, Homo sapiens
tagtagagacagggttttgcca

SEQ ID NO: 4711241 - DNA, 18 bp, Homo sapiens
tagtaggggttgaagaaa

SEQ ID NO: 4711242 - DNA, 19 bp, Homo sapiens
tagtatacattgtctctaa

SEQ ID NO: 4711243 - DNA, 16 bp, Homo sapiens
tagtatctatatgact

SEQ ID NO: 4711244 - DNA, 17 bp, Homo sapiens
tagtcactgagacagcc

SEQ ID NO: 4711245 - DNA, 17 bp, Homo sapiens
tagtcccttccacaccc

SEQ ID NO: 4711246 - DNA, 19 bp, Homo sapiens
tagtgaaggcttctctctg

SEQ ID NO: 4711247 - DNA, 15 bp, Homo sapiens
tagtgcaagctgaag

SEQ ID NO: 4711248 - DNA, 14 bp, Homo sapiens
tagtgccaccacag

SEQ ID NO: 4711249 - DNA, 16 bp, Homo sapiens
tagtgctgtaatattg

SEQ ID NO: 4711250 - DNA, 17 bp, Homo sapiens
tagtgcttatctaattt

SEQ ID NO: 4711251 - DNA, 14 bp, Homo sapiens
tagtgcttcttgta

SEQ ID NO: 4711252 - DNA, 13 bp, Homo sapiens
tagtggctgtcca

SEQ ID NO: 4711253 - DNA, 20 bp, Homo sapiens
tagtggcttaaaacaacact

SEQ ID NO: 4711254 - DNA, 18 bp, Homo sapiens
tagtggtctttgtaagag

SEQ ID NO: 4711255 - DNA, 20 bp, Homo sapiens
tagttaataatctatgatga

SEQ ID NO: 4711256 - DNA, 23 bp, Homo sapiens
tagttcaatctggattcatattt

SEQ ID NO: 4711257 - DNA, 20 bp, Homo sapiens
tagttccaccatcaagccac

SEQ ID NO: 4711258 - DNA, 13 bp, Homo sapiens
tagttgtctttct

SEQ ID NO: 4711259 - DNA, 20 bp, Homo sapiens
tagttgtggaaagataataa

SEQ ID NO: 4711260 - DNA, 15 bp, Homo sapiens
tagttgtgtttcaac

SEQ ID NO: 4711261 - DNA, 16 bp, Homo sapiens
tagttttatactatat

SEQ ID NO: 4711262 - DNA, 13 bp, Homo sapiens
tagttttcaactt

SEQ ID NO: 4711263 - DNA, 21 bp, Homo sapiens
tagtttttaaaatatcttttg

SEQ ID NO: 4711264 - DNA, 22 bp, Homo sapiens
tagtttttaaaatatcttttga

SEQ ID NO: 4711265 - DNA, 18 bp, Homo sapiens
tagtttttttttaatcta

SEQ ID NO: 4711266 - DNA, 13 bp, Homo sapiens
tataaaaaatggt

SEQ ID NO: 4711267 - DNA, 17 bp, Homo sapiens
tataaaaaatggtgcct

SEQ ID NO: 4711268 - DNA, 17 bp, Homo sapiens
tataaaaacatgagtta

SEQ ID NO: 4711269 - DNA, 15 bp, Homo sapiens
tataaaatttactgt

SEQ ID NO: 4711270 - DNA, 11 bp, Homo sapiens
tataaactgag

SEQ ID NO: 4711271 - DNA, 17 bp, Homo sapiens
tataaagcaaattactc

SEQ ID NO: 4711272 - DNA, 16 bp, Homo sapiens
tataaaggataaagaa

SEQ ID NO: 4711273 - DNA, 17 bp, Homo sapiens
tataaataggagaggat

SEQ ID NO: 4711274 - DNA, 19 bp, Homo sapiens
tataaataggagaggatga

SEQ ID NO: 4711275 - DNA, 17 bp, Homo sapiens
tataacaaactatgtaa

SEQ ID NO: 4711276 - DNA, 17 bp, Homo sapiens
tataacttattagcagt

SEQ ID NO: 4711277 - DNA, 13 bp, Homo sapiens
tataagaaggaaa

SEQ ID NO: 4711278 - DNA, 16 bp, Homo sapiens
tataagaaggaaaaat

SEQ ID NO: 4711279 - DNA, 22 bp, Homo sapiens
tataatatttttaattaaataa

SEQ ID NO: 4711280 - DNA, 13 bp, Homo sapiens
tataatgaataaa

SEQ ID NO: 4711281 - DNA, 16 bp, Homo sapiens
tataatgaataaatca

SEQ ID NO: 4711282 - DNA, 14 bp, Homo sapiens
tataattctattga

SEQ ID NO: 4711283 - DNA, 19 bp, Homo sapiens
tataattttaaagtaattt

SEQ ID NO: 4711284 - DNA, 21 bp, Homo sapiens
tatacaccttattaatgatca

SEQ ID NO: 4711285 - DNA, 10 bp, Homo sapiens
tatacatttg

SEQ ID NO: 4711286 - DNA, 19 bp, Homo sapiens
tataccagtataattgagt

SEQ ID NO: 4711287 - DNA, 16 bp, Homo sapiens
tatacctttgccttgg

SEQ ID NO: 4711288 - DNA, 14 bp, Homo sapiens
gtggacacagctct

SEQ ID NO: 4711289 - DNA, 18 bp, Homo sapiens
gtggacacagctcttctc

SEQ ID NO: 4711290 - DNA, 22 bp, Homo sapiens
gtggacacagctcttctccagg

SEQ ID NO: 4711291 - DNA, 17 bp, Homo sapiens
gtggagaagccacaggc

SEQ ID NO: 4711292 - DNA, 13 bp, Homo sapiens
gtggagctgcctg

SEQ ID NO: 4711293 - DNA, 15 bp, Homo sapiens
gtggaggagcagtgc

SEQ ID NO: 4711294 - DNA, 17 bp, Homo sapiens
gtggaggagcagtgcag

SEQ ID NO: 4711295 - DNA, 16 bp, Homo sapiens
gtggaggagctcagga

SEQ ID NO: 4711296 - DNA, 23 bp, Homo sapiens
gtggaggagctcaggacactaat

SEQ ID NO: 4711297 - DNA, 20 bp, Homo sapiens
gtggaggccgagtctgtcct

SEQ ID NO: 4711298 - DNA, 17 bp, Homo sapiens
gtggatggtgacttttg

SEQ ID NO: 4711299 - DNA, 21 bp, Homo sapiens
gtggattttggttttgttccc

SEQ ID NO: 4711300 - DNA, 14 bp, Homo sapiens
gtggcaaattaaac

SEQ ID NO: 4711301 - DNA, 18 bp, Homo sapiens
gtggcaaattaaacaata

SEQ ID NO: 4711302 - DNA, 14 bp, Homo sapiens
gtggcagctcacct

SEQ ID NO: 4711303 - DNA, 22 bp, Homo sapiens
gtggcagctcacctctcccttg

SEQ ID NO: 4711304 - DNA, 14 bp, Homo sapiens
gtggcagctgcggt

SEQ ID NO: 4711305 - DNA, 17 bp, Homo sapiens
gtggcagctgcggtcca

SEQ ID NO: 4711306 - DNA, 22 bp, Homo sapiens
gtggcagctgcggtccacccag

SEQ ID NO: 4711307 - DNA, 13 bp, Homo sapiens
gtggcagctgctt

SEQ ID NO: 4711308 - DNA, 16 bp, Homo sapiens
gtggcaggagggcagt

SEQ ID NO: 4711309 - DNA, 16 bp, Homo sapiens
gtggcagtgggagctg

SEQ ID NO: 4711310 - DNA, 17 bp, Homo sapiens
gtggccccagcctggcc

SEQ ID NO: 4711311 - DNA, 19 bp, Homo sapiens
gtggccccagcctggccca

SEQ ID NO: 4711312 - DNA, 20 bp, Homo sapiens
gtggccccagcctggcccag

SEQ ID NO: 4711313 - DNA, 21 bp, Homo sapiens
gtggccccagcctggcccagc

SEQ ID NO: 4711314 - DNA, 14 bp, Homo sapiens
gtggccctctcccc

SEQ ID NO: 4711315 - DNA, 15 bp, Homo sapiens
gtggccgtcctgagg

SEQ ID NO: 4711316 - DNA, 14 bp, Homo sapiens
gtggcctcccaact

SEQ ID NO: 4711317 - DNA, 22 bp, Homo sapiens
gtggcctcccaactcaccccag

SEQ ID NO: 4711318 - DNA, 12 bp, Homo sapiens
gtggcctgggcc

SEQ ID NO: 4711319 - DNA, 14 bp, Homo sapiens
gtggctcatgcctg

SEQ ID NO: 4711320 - DNA, 19 bp, Homo sapiens
gtggctcatgcctgtaatc

SEQ ID NO: 4711321 - DNA, 11 bp, Homo sapiens
gtggctccctg

SEQ ID NO: 4711322 - DNA, 13 bp, Homo sapiens
gtggctctggggt

SEQ ID NO: 4711323 - DNA, 12 bp, Homo sapiens
gtggctgctgcc

SEQ ID NO: 4711324 - DNA, 13 bp, Homo sapiens
gtggctgctgccc

SEQ ID NO: 4711325 - DNA, 24 bp, Homo sapiens
gtggctggaaccacattgaagaat

SEQ ID NO: 4711326 - DNA, 14 bp, Homo sapiens
gtggctggctcacc

SEQ ID NO: 4711327 - DNA, 17 bp, Homo sapiens
gtggctgtccagtgccc

SEQ ID NO: 4711328 - DNA, 20 bp, Homo sapiens
gtggcttcattagagcaggc

SEQ ID NO: 4711329 - DNA, 13 bp, Homo sapiens
gtgggacaccctg

SEQ ID NO: 4711330 - DNA, 18 bp, Homo sapiens
gtgggatcctccaggtgc

SEQ ID NO: 4711331 - DNA, 21 bp, Homo sapiens
gtgggcgtgagacctgcccct

SEQ ID NO: 4711332 - DNA, 22 bp, Homo sapiens
gtgggcgtgagacctgcccctc

SEQ ID NO: 4711333 - DNA, 15 bp, Homo sapiens
gtgggctccctgact

SEQ ID NO: 4711334 - DNA, 20 bp, Homo sapiens
gtgggctgcactctgtgccc

SEQ ID NO: 4711335 - DNA, 21 bp, Homo sapiens
gtgggctgcactctgtgccca

SEQ ID NO: 4711336 - DNA, 22 bp, Homo sapiens
gtgggcttcccagtggctgctg

SEQ ID NO: 4711337 - DNA, 15 bp, Homo sapiens
gtggggaccccaccc

SEQ ID NO: 4711338 - DNA, 13 bp, Homo sapiens
gtggggcagcttg

SEQ ID NO: 4711339 - DNA, 17 bp, Homo sapiens
gtgggggaagacctggc

SEQ ID NO: 4711340 - DNA, 23 bp, Homo sapiens
gtgggggtgcagatgaggttgct

SEQ ID NO: 4711341 - DNA, 22 bp, Homo sapiens
gtggggtcactctggcagctca

SEQ ID NO: 4711342 - DNA, 22 bp, Homo sapiens
gtgggtccatgggcagagccca

SEQ ID NO: 4711343 - DNA, 18 bp, Homo sapiens
gtgggtcttatgcttcca

SEQ ID NO: 4711344 - DNA, 15 bp, Homo sapiens
gtggtcccaccccac

SEQ ID NO: 4711345 - DNA, 16 bp, Homo sapiens
gtggtcccaccccaca

SEQ ID NO: 4711346 - DNA, 19 bp, Homo sapiens
gtggtctgctcgggcccag

SEQ ID NO: 4711347 - DNA, 22 bp, Homo sapiens
gtggtctgctcgggcccaggcc

SEQ ID NO: 4711348 - DNA, 23 bp, Homo sapiens
gtggttaatgccatggacagaag

SEQ ID NO: 4711349 - DNA, 17 bp, Homo sapiens
gtggtttttatttttat

SEQ ID NO: 4711350 - DNA, 13 bp, Homo sapiens
gtgtaataagaca

SEQ ID NO: 4711351 - DNA, 13 bp, Homo sapiens
gtgtacagtcttg

SEQ ID NO: 4711352 - DNA, 19 bp, Homo sapiens
gtgtacccccgcccaggct

SEQ ID NO: 4711353 - DNA, 22 bp, Homo sapiens
gtgtactctgtgtgtgtatgag

SEQ ID NO: 4711354 - DNA, 15 bp, Homo sapiens
gtgtagagttaagaa

SEQ ID NO: 4711355 - DNA, 18 bp, Homo sapiens
gtgtagagttaagaagct

SEQ ID NO: 4711356 - DNA, 18 bp, Homo sapiens
gtgtatgagagagagaaa

SEQ ID NO: 4711357 - DNA, 22 bp, Homo sapiens
gtgtatgcaagtgggagatgaa

SEQ ID NO: 4711358 - DNA, 17 bp, Homo sapiens
gtgtcaaaactggttta

SEQ ID NO: 4711359 - DNA, 15 bp, Homo sapiens
gtgtcaactttcatt

SEQ ID NO: 4711360 - DNA, 14 bp, Homo sapiens
gtgtcacctgaaga

SEQ ID NO: 4711361 - DNA, 22 bp, Homo sapiens
gtgtcacctgaagactcattct

SEQ ID NO: 4711362 - DNA, 16 bp, Homo sapiens
gtgtcactggctgcct

SEQ ID NO: 4711363 - DNA, 18 bp, Homo sapiens
gtgtcactggctgcctcc

SEQ ID NO: 4711364 - DNA, 23 bp, Homo sapiens
gtgtcaggaaacatatttaagaa

SEQ ID NO: 4711365 - DNA, 18 bp, Homo sapiens
gtgtcaggtggggcagct

SEQ ID NO: 4711366 - DNA, 13 bp, Homo sapiens
gtgtccaaagcag

SEQ ID NO: 4711367 - DNA, 23 bp, Homo sapiens
gtgtccctgcacttgcagactct

SEQ ID NO: 4711368 - DNA, 19 bp, Homo sapiens
gtgtctagtagaacaatgt

SEQ ID NO: 4711369 - DNA, 17 bp, Homo sapiens
gtgtctccaacccccca

SEQ ID NO: 4711370 - DNA, 21 bp, Homo sapiens
gtgtctccaaccccccagcac

SEQ ID NO: 4711371 - DNA, 14 bp, Homo sapiens
gtgtctcttggtcc

SEQ ID NO: 4711372 - DNA, 18 bp, Homo sapiens
gtgtctcttggtcctgct

SEQ ID NO: 4711373 - DNA, 19 bp, Homo sapiens
gtgtctcttggtcctgctg

SEQ ID NO: 4711374 - DNA, 20 bp, Homo sapiens
gtgtctcttggtcctgctgc

SEQ ID NO: 4711375 - DNA, 21 bp, Homo sapiens
gtgtctcttggtcctgctgca

SEQ ID NO: 4711376 - DNA, 17 bp, Homo sapiens
gtgtctggattcccagg

SEQ ID NO: 4711377 - DNA, 21 bp, Homo sapiens
gtgtctggattcccaggatga

SEQ ID NO: 4711378 - DNA, 12 bp, Homo sapiens
gtgtctgggctg

SEQ ID NO: 4711379 - DNA, 13 bp, Homo sapiens
gtgtctgggctga

SEQ ID NO: 4711380 - DNA, 13 bp, Homo sapiens
gtgtcttcctgtg

SEQ ID NO: 4711381 - DNA, 14 bp, Homo sapiens
gtgtcttcctgtgg

SEQ ID NO: 4711382 - DNA, 21 bp, Homo sapiens
gtgtctttagtgctccaagtc

SEQ ID NO: 4711383 - DNA, 14 bp, Homo sapiens
gtgtgaaacatact

SEQ ID NO: 4711384 - DNA, 18 bp, Homo sapiens
tatacgataaataacttt

SEQ ID NO: 4711385 - DNA, 19 bp, Homo sapiens
tatactatttatatacaag

SEQ ID NO: 4711386 - DNA, 16 bp, Homo sapiens
tatacttttctcaata

SEQ ID NO: 4711387 - DNA, 11 bp, Homo sapiens
tatagaaatgc

SEQ ID NO: 4711388 - DNA, 19 bp, Homo sapiens
tatagatgggcaactggct

SEQ ID NO: 4711389 - DNA, 14 bp, Homo sapiens
tatagatttgacct

SEQ ID NO: 4711390 - DNA, 20 bp, Homo sapiens
tatagcatgaaataaaatat

SEQ ID NO: 4711391 - DNA, 18 bp, Homo sapiens
tatagcctaggtgacaga

SEQ ID NO: 4711392 - DNA, 20 bp, Homo sapiens
tatagcctaggtgacagagt

SEQ ID NO: 4711393 - DNA, 13 bp, Homo sapiens
tataggctatttt

SEQ ID NO: 4711394 - DNA, 20 bp, Homo sapiens
tatagttgtctttctttgct

SEQ ID NO: 4711395 - DNA, 21 bp, Homo sapiens
tatagttgtctttctttgctg

SEQ ID NO: 4711396 - DNA, 22 bp, Homo sapiens
tatagttgtctttctttgctgc

SEQ ID NO: 4711397 - DNA, 18 bp, Homo sapiens
tatataggctattttcta

SEQ ID NO: 4711398 - DNA, 17 bp, Homo sapiens
tatatagtatttaattg

SEQ ID NO: 4711399 - DNA, 21 bp, Homo sapiens
tatatagtatttaattgtttc

SEQ ID NO: 4711400 - DNA, 13 bp, Homo sapiens
tatatcttctaca

SEQ ID NO: 4711401 - DNA, 14 bp, Homo sapiens
tatatctttattca

SEQ ID NO: 4711402 - DNA, 22 bp, Homo sapiens
tatatgaaaacaagttccaaat

SEQ ID NO: 4711403 - DNA, 17 bp, Homo sapiens
tatattatcatatctct

SEQ ID NO: 4711404 - DNA, 23 bp, Homo sapiens
tatattcatcaaataaaccttgt

SEQ ID NO: 4711405 - DNA, 12 bp, Homo sapiens
tatattgataac

SEQ ID NO: 4711406 - DNA, 23 bp, Homo sapiens
tatattgataacagcactgacta

SEQ ID NO: 4711407 - DNA, 21 bp, Homo sapiens
tatatttaacttaacccagat

SEQ ID NO: 4711408 - DNA, 14 bp, Homo sapiens
tatatttacaaatg

SEQ ID NO: 4711409 - DNA, 15 bp, Homo sapiens
tatatttacaaatgg

SEQ ID NO: 4711410 - DNA, 15 bp, Homo sapiens
tatatttataaggaa

SEQ ID NO: 4711411 - DNA, 22 bp, Homo sapiens
tatatttctacagagaaaatga

SEQ ID NO: 4711412 - DNA, 23 bp, Homo sapiens
tatatttctacagagaaaatgaa

SEQ ID NO: 4711413 - DNA, 18 bp, Homo sapiens
tatatttggtttctagat

SEQ ID NO: 4711414 - DNA, 15 bp, Homo sapiens
tatattttaaaaaca

SEQ ID NO: 4711415 - DNA, 13 bp, Homo sapiens
tatattttgctgt

SEQ ID NO: 4711416 - DNA, 23 bp, Homo sapiens
tatattttgctgtttatgatcta

SEQ ID NO: 4711417 - DNA, 17 bp, Homo sapiens
tatattttgtttacaaa

SEQ ID NO: 4711418 - DNA, 21 bp, Homo sapiens
tatatttttttttaagctctg

SEQ ID NO: 4711419 - DNA, 13 bp, Homo sapiens
tatcaaaagaaat

SEQ ID NO: 4711420 - DNA, 23 bp, Homo sapiens
tatcaaaagaaatagaaaaggaa

SEQ ID NO: 4711421 - DNA, 14 bp, Homo sapiens
tatcaagaaatgct

SEQ ID NO: 4711422 - DNA, 23 bp, Homo sapiens
tatcaccgtgggctccctgactg

SEQ ID NO: 4711423 - DNA, 17 bp, Homo sapiens
tatcaggtgctgccatc

SEQ ID NO: 4711424 - DNA, 15 bp, Homo sapiens
tatcagtgaagcagt

SEQ ID NO: 4711425 - DNA, 18 bp, Homo sapiens
tatcatataaacatttta

SEQ ID NO: 4711426 - DNA, 11 bp, Homo sapiens
tatcatgcttg

SEQ ID NO: 4711427 - DNA, 21 bp, Homo sapiens
tatcatgtcaaacgtgaaaat

SEQ ID NO: 4711428 - DNA, 14 bp, Homo sapiens
tatcatttgtgaag

SEQ ID NO: 4711429 - DNA, 23 bp, Homo sapiens
tatccagaagtattgtttacatt

SEQ ID NO: 4711430 - DNA, 18 bp, Homo sapiens
tatccaggtaatccaaga

SEQ ID NO: 4711431 - DNA, 19 bp, Homo sapiens
tatcccttggacattttat

SEQ ID NO: 4711432 - DNA, 14 bp, Homo sapiens
tatcctacttcccc

SEQ ID NO: 4711433 - DNA, 12 bp, Homo sapiens
tatcctacttct

SEQ ID NO: 4711434 - DNA, 20 bp, Homo sapiens
tatcctgttaacactgtaat

SEQ ID NO: 4711435 - DNA, 14 bp, Homo sapiens
tatcgaaataacaa

SEQ ID NO: 4711436 - DNA, 20 bp, Homo sapiens
tatcgaaataacaatgttaa

SEQ ID NO: 4711437 - DNA, 21 bp, Homo sapiens
tatcgaaataacaatgttaag

SEQ ID NO: 4711438 - DNA, 14 bp, Homo sapiens
tatcgttactggca

SEQ ID NO: 4711439 - DNA, 15 bp, Homo sapiens
tatctaattctttaa

SEQ ID NO: 4711440 - DNA, 17 bp, Homo sapiens
tatctcccccagcccca

SEQ ID NO: 4711441 - DNA, 16 bp, Homo sapiens
tatctctagtccctgt

SEQ ID NO: 4711442 - DNA, 19 bp, Homo sapiens
tatctctagtccctgtgtt

SEQ ID NO: 4711443 - DNA, 16 bp, Homo sapiens
tatctcttgtgctttt

SEQ ID NO: 4711444 - DNA, 12 bp, Homo sapiens
tatctgcatgta

SEQ ID NO: 4711445 - DNA, 19 bp, Homo sapiens
tatctggtatctgcatgta

SEQ ID NO: 4711446 - DNA, 23 bp, Homo sapiens
tatcttataaagtggaagtatgt

SEQ ID NO: 4711447 - DNA, 18 bp, Homo sapiens
tatctttgattctccttc

SEQ ID NO: 4711448 - DNA, 19 bp, Homo sapiens
tatctttgattctccttca

SEQ ID NO: 4711449 - DNA, 19 bp, Homo sapiens
tatgaagacagaggcagag

SEQ ID NO: 4711450 - DNA, 14 bp, Homo sapiens
tatgaagacataaa

SEQ ID NO: 4711451 - DNA, 12 bp, Homo sapiens
tatgaataacat

SEQ ID NO: 4711452 - DNA, 15 bp, Homo sapiens
tatgacagatatatt

SEQ ID NO: 4711453 - DNA, 18 bp, Homo sapiens
tatgaccttctaggaagc

SEQ ID NO: 4711454 - DNA, 14 bp, Homo sapiens
tatgagaacatggt

SEQ ID NO: 4711455 - DNA, 18 bp, Homo sapiens
tatgagaagtactttgtg

SEQ ID NO: 4711456 - DNA, 12 bp, Homo sapiens
tatgagactttc

SEQ ID NO: 4711457 - DNA, 21 bp, Homo sapiens
tatgagagggccctgcctgct

SEQ ID NO: 4711458 - DNA, 15 bp, Homo sapiens
tatgaggagacattc

SEQ ID NO: 4711459 - DNA, 18 bp, Homo sapiens
tatgatgtgggtcaagga

SEQ ID NO: 4711460 - DNA, 15 bp, Homo sapiens
tatgattattaatca

SEQ ID NO: 4711461 - DNA, 14 bp, Homo sapiens
tatgatttaataaa

SEQ ID NO: 4711462 - DNA, 15 bp, Homo sapiens
tatgatttggaaaat

SEQ ID NO: 4711463 - DNA, 18 bp, Homo sapiens
tatgattttgatgcacaa

SEQ ID NO: 4711464 - DNA, 15 bp, Homo sapiens
tatgcaagtgggaga

SEQ ID NO: 4711465 - DNA, 22 bp, Homo sapiens
tatgcacttataattttcctaa

SEQ ID NO: 4711466 - DNA, 21 bp, Homo sapiens
tatgcatttaaatacagtctt

SEQ ID NO: 4711467 - DNA, 22 bp, Homo sapiens
tatgcatttaaatacagtcttc

SEQ ID NO: 4711468 - DNA, 18 bp, Homo sapiens
tatgcttccattaacaaa

SEQ ID NO: 4711469 - DNA, 14 bp, Homo sapiens
tatgcttgtgtata

SEQ ID NO: 4711470 - DNA, 16 bp, Homo sapiens
tatggaaacactgatt

SEQ ID NO: 4711471 - DNA, 16 bp, Homo sapiens
tatggacggtgctcca

SEQ ID NO: 4711472 - DNA, 12 bp, Homo sapiens
tatggcagaaga

SEQ ID NO: 4711473 - DNA, 16 bp, Homo sapiens
tatggcagaagacacc

SEQ ID NO: 4711474 - DNA, 23 bp, Homo sapiens
tatggcagaagacaccagagcag

SEQ ID NO: 4711475 - DNA, 17 bp, Homo sapiens
tatggctagaatatcct

SEQ ID NO: 4711476 - DNA, 22 bp, Homo sapiens
tatggctagaatatcctacttc

SEQ ID NO: 4711477 - DNA, 23 bp, Homo sapiens
tatgtaaaaataaccttgcagaa

SEQ ID NO: 4711478 - DNA, 19 bp, Homo sapiens
tatgtacagttcataaatt

SEQ ID NO: 4711479 - DNA, 17 bp, Homo sapiens
tatgtataaattaatac

SEQ ID NO: 4711480 - DNA, 23 bp, Homo sapiens
tatgtgcactaccatagctacat

SEQ ID NO: 4711481 - DNA, 19 bp, Homo sapiens
tatgtgccaattttgtcac

SEQ ID NO: 4711482 - DNA, 18 bp, Homo sapiens
tatgtggatacagtcatt

SEQ ID NO: 4711483 - DNA, 17 bp, Homo sapiens
tatgtgtggtttcagtt

SEQ ID NO: 4711484 - DNA, 15 bp, Homo sapiens
tatgttacttaaaca

SEQ ID NO: 4711485 - DNA, 16 bp, Homo sapiens
tatgttatttatagct

SEQ ID NO: 4711486 - DNA, 13 bp, Homo sapiens
tatgttgcccagg

SEQ ID NO: 4711487 - DNA, 14 bp, Homo sapiens
tatgtttttgtgta

SEQ ID NO: 4711488 - DNA, 22 bp, Homo sapiens
tattaaaacagaaattaatctt

SEQ ID NO: 4711489 - DNA, 18 bp, Homo sapiens
tattaaaagactcatccg

SEQ ID NO: 4711490 - DNA, 16 bp, Homo sapiens
tattaaaattgccatt

SEQ ID NO: 4711491 - DNA, 19 bp, Homo sapiens
tattaagaatagtctctgg

SEQ ID NO: 4711492 - DNA, 13 bp, Homo sapiens
tattaatttgaaa

SEQ ID NO: 4711493 - DNA, 14 bp, Homo sapiens
tctctccattcccg

SEQ ID NO: 4711494 - DNA, 14 bp, Homo sapiens
tctctgagcagtga

SEQ ID NO: 4711495 - DNA, 15 bp, Homo sapiens
tctctgagctgtgca

SEQ ID NO: 4711496 - DNA, 16 bp, Homo sapiens
tctctgagctgtgcag

SEQ ID NO: 4711497 - DNA, 13 bp, Homo sapiens
tctctgaggacac

SEQ ID NO: 4711498 - DNA, 17 bp, Homo sapiens
tctctgaggacactaac

SEQ ID NO: 4711499 - DNA, 20 bp, Homo sapiens
tctctgcatttaaaaaaatc

SEQ ID NO: 4711500 - DNA, 22 bp, Homo sapiens
tctctgccctaatgcgcaggct

SEQ ID NO: 4711501 - DNA, 11 bp, Homo sapiens
tctctgccctc

SEQ ID NO: 4711502 - DNA, 21 bp, Homo sapiens
tctctgctctgcgtgtcacct

SEQ ID NO: 4711503 - DNA, 22 bp, Homo sapiens
tctctgctctgcgtgtcacctg

SEQ ID NO: 4711504 - DNA, 23 bp, Homo sapiens
tctctgtctcatccatcatcatg

SEQ ID NO: 4711505 - DNA, 16 bp, Homo sapiens
tctctgtctcatgtgt

SEQ ID NO: 4711506 - DNA, 14 bp, Homo sapiens
tctctgtgagactc

SEQ ID NO: 4711507 - DNA, 19 bp, Homo sapiens
tctctgtgagactcgagaa

SEQ ID NO: 4711508 - DNA, 16 bp, Homo sapiens
tctcttagctcccctc

SEQ ID NO: 4711509 - DNA, 17 bp, Homo sapiens
tctcttagctcccctcc

SEQ ID NO: 4711510 - DNA, 18 bp, Homo sapiens
tctcttgaccctgtcact

SEQ ID NO: 4711511 - DNA, 18 bp, Homo sapiens
tctcttggtcctgctgca

SEQ ID NO: 4711512 - DNA, 22 bp, Homo sapiens
tctctttgtaccacagtttctt

SEQ ID NO: 4711513 - DNA, 18 bp, Homo sapiens
tctgaaaattaacactgc

SEQ ID NO: 4711514 - DNA, 18 bp, Homo sapiens
tctgaagaaagttattct

SEQ ID NO: 4711515 - DNA, 17 bp, Homo sapiens
tctgaatattaagaaac

SEQ ID NO: 4711516 - DNA, 16 bp, Homo sapiens
tctgaatgaagccttc

SEQ ID NO: 4711517 - DNA, 22 bp, Homo sapiens
tctgaatgaagccttctgacct

SEQ ID NO: 4711518 - DNA, 14 bp, Homo sapiens
tctgacacacagct

SEQ ID NO: 4711519 - DNA, 12 bp, Homo sapiens
tctgacaggcaa

SEQ ID NO: 4711520 - DNA, 21 bp, Homo sapiens
tctgacaggcaatgctggctg

SEQ ID NO: 4711521 - DNA, 21 bp, Homo sapiens
tctgacatattatgcctgaat

SEQ ID NO: 4711522 - DNA, 23 bp, Homo sapiens
tctgaccagtttaacctgatgca

SEQ ID NO: 4711523 - DNA, 16 bp, Homo sapiens
tctgacccacagcctc

SEQ ID NO: 4711524 - DNA, 22 bp, Homo sapiens
tctgacccacagcctccaagtc

SEQ ID NO: 4711525 - DNA, 21 bp, Homo sapiens
tctgacccagggcctaggacg

SEQ ID NO: 4711526 - DNA, 14 bp, Homo sapiens
tctgacccatgctg

SEQ ID NO: 4711527 - DNA, 16 bp, Homo sapiens
tctgacccatgctgcc

SEQ ID NO: 4711528 - DNA, 17 bp, Homo sapiens
tctgacccatgctgccc

SEQ ID NO: 4711529 - DNA, 22 bp, Homo sapiens
tctgacccatgctgccctgtga

SEQ ID NO: 4711530 - DNA, 15 bp, Homo sapiens
tctgacgcagcctga

SEQ ID NO: 4711531 - DNA, 16 bp, Homo sapiens
tctgacgcagcctgag

SEQ ID NO: 4711532 - DNA, 17 bp, Homo sapiens
tctgacgcagcctgaga

SEQ ID NO: 4711533 - DNA, 12 bp, Homo sapiens
tctgactctaaa

SEQ ID NO: 4711534 - DNA, 16 bp, Homo sapiens
tctgactctaaaatat

SEQ ID NO: 4711535 - DNA, 15 bp, Homo sapiens
tctgagacacacccc

SEQ ID NO: 4711536 - DNA, 19 bp, Homo sapiens
tctgagcagtgaatgattc

SEQ ID NO: 4711537 - DNA, 10 bp, Homo sapiens
tctgagctgt

SEQ ID NO: 4711538 - DNA, 19 bp, Homo sapiens
tctgagctgttatcttgtg

SEQ ID NO: 4711539 - DNA, 21 bp, Homo sapiens
tctgaggaatccagacccggc

SEQ ID NO: 4711540 - DNA, 23 bp, Homo sapiens
tctgaggaatccagacccggctg

SEQ ID NO: 4711541 - DNA, 15 bp, Homo sapiens
tctgataatgtattg

SEQ ID NO: 4711542 - DNA, 17 bp, Homo sapiens
tctgataatgtattgca

SEQ ID NO: 4711543 - DNA, 21 bp, Homo sapiens
tctgatccctctacagagctt

SEQ ID NO: 4711544 - DNA, 21 bp, Homo sapiens
tctgattcccaagctctgctc

SEQ ID NO: 4711545 - DNA, 23 bp, Homo sapiens
tctgattcccaagctctgctcct

SEQ ID NO: 4711546 - DNA, 20 bp, Homo sapiens
tctgatttgtattaaaattg

SEQ ID NO: 4711547 - DNA, 14 bp, Homo sapiens
tctgatttttaatt

SEQ ID NO: 4711548 - DNA, 23 bp, Homo sapiens
tctgcacccagccccaaggggtg

SEQ ID NO: 4711549 - DNA, 15 bp, Homo sapiens
tctgcaccttctgac

SEQ ID NO: 4711550 - DNA, 22 bp, Homo sapiens
tctgcaccttctgacgcagcct

SEQ ID NO: 4711551 - DNA, 16 bp, Homo sapiens
tctgcactcccctgct

SEQ ID NO: 4711552 - DNA, 18 bp, Homo sapiens
tctgcactcccctgctgg

SEQ ID NO: 4711553 - DNA, 22 bp, Homo sapiens
tctgcactcccctgctgggtgt

SEQ ID NO: 4711554 - DNA, 13 bp, Homo sapiens
tctgcagcctcag

SEQ ID NO: 4711555 - DNA, 14 bp, Homo sapiens
tctgcagcctcaga

SEQ ID NO: 4711556 - DNA, 20 bp, Homo sapiens
tctgcagtcacttcgtggga

SEQ ID NO: 4711557 - DNA, 17 bp, Homo sapiens
tctgcatgtaaaatctt

SEQ ID NO: 4711558 - DNA, 21 bp, Homo sapiens
tctgcatgtaaaatcttcagc

SEQ ID NO: 4711559 - DNA, 23 bp, Homo sapiens
tctgcatgtaaaatcttcagctg

SEQ ID NO: 4711560 - DNA, 15 bp, Homo sapiens
tctgccacttcccag

SEQ ID NO: 4711561 - DNA, 17 bp, Homo sapiens
tctgccacttcccaggt

SEQ ID NO: 4711562 - DNA, 18 bp, Homo sapiens
tctgccatattctgttgg

SEQ ID NO: 4711563 - DNA, 23 bp, Homo sapiens
tctgccatattctgttggccagt

SEQ ID NO: 4711564 - DNA, 21 bp, Homo sapiens
tctgccatggccttggcaggc

SEQ ID NO: 4711565 - DNA, 15 bp, Homo sapiens
tctgcccaaattatg

SEQ ID NO: 4711566 - DNA, 15 bp, Homo sapiens
tctgcccaactttca

SEQ ID NO: 4711567 - DNA, 20 bp, Homo sapiens
tctgcccaactttcattggt

SEQ ID NO: 4711568 - DNA, 12 bp, Homo sapiens
tctgcccactcc

SEQ ID NO: 4711569 - DNA, 17 bp, Homo sapiens
tctgcccactccctgca

SEQ ID NO: 4711570 - DNA, 23 bp, Homo sapiens
tctgcccaggacggggccggcca

SEQ ID NO: 4711571 - DNA, 11 bp, Homo sapiens
tctgccctgcg

SEQ ID NO: 4711572 - DNA, 12 bp, Homo sapiens
tctgccctgcgg

SEQ ID NO: 4711573 - DNA, 12 bp, Homo sapiens
tctgcccttggt

SEQ ID NO: 4711574 - DNA, 23 bp, Homo sapiens
tctgcccttggttaggcattgtg

SEQ ID NO: 4711575 - DNA, 13 bp, Homo sapiens
tctgcctcccatc

SEQ ID NO: 4711576 - DNA, 16 bp, Homo sapiens
tctgcctcccatcacc

SEQ ID NO: 4711577 - DNA, 23 bp, Homo sapiens
tctgcctctgacacacagctctg

SEQ ID NO: 4711578 - DNA, 19 bp, Homo sapiens
tctgcctgaagtcacacag

SEQ ID NO: 4711579 - DNA, 13 bp, Homo sapiens
tctgcctgcccag

SEQ ID NO: 4711580 - DNA, 14 bp, Homo sapiens
tctgcctgcccagg

SEQ ID NO: 4711581 - DNA, 15 bp, Homo sapiens
tctgcctgcccaggc

SEQ ID NO: 4711582 - DNA, 17 bp, Homo sapiens
tctgcctgcccaggccc

SEQ ID NO: 4711583 - DNA, 21 bp, Homo sapiens
tctgcctgcccaggcccctgc

SEQ ID NO: 4711584 - DNA, 22 bp, Homo sapiens
tctgcctgcccaggcccctgcc

SEQ ID NO: 4711585 - DNA, 13 bp, Homo sapiens
tctgccttccttg

SEQ ID NO: 4711586 - DNA, 16 bp, Homo sapiens
tctgccttccttgcta

SEQ ID NO: 4711587 - DNA, 22 bp, Homo sapiens
tctgccttgaaatacctgtttc

SEQ ID NO: 4711588 - DNA, 17 bp, Homo sapiens
tctgctcacatatctgt

SEQ ID NO: 4711589 - DNA, 12 bp, Homo sapiens
tctgctcatcat

SEQ ID NO: 4711590 - DNA, 14 bp, Homo sapiens
tctgctcatcattc

SEQ ID NO: 4711591 - DNA, 23 bp, Homo sapiens
tctgctcatcattctctgtctca

SEQ ID NO: 4711592 - DNA, 18 bp, Homo sapiens
tctgctcgggcccaggcc

SEQ ID NO: 4711593 - DNA, 14 bp, Homo sapiens
tctgctctccttcc

SEQ ID NO: 4711594 - DNA, 16 bp, Homo sapiens
tctgctctgcgtgtca

SEQ ID NO: 4711595 - DNA, 16 bp, Homo sapiens
tctgctgaatgtaaaa

SEQ ID NO: 4711596 - DNA, 20 bp, Homo sapiens
tctgctgaatgtaaaagaaa

SEQ ID NO: 4711597 - DNA, 19 bp, Homo sapiens
tctgctgacagacacaggc

SEQ ID NO: 4711598 - DNA, 17 bp, Homo sapiens
tctgctgctggctggtt

SEQ ID NO: 4711599 - DNA, 12 bp, Homo sapiens
tctgctgggctg

SEQ ID NO: 4711600 - DNA, 22 bp, Homo sapiens
tctgctgggctggggcctgatg

SEQ ID NO: 4711601 - DNA, 12 bp, Homo sapiens
tctgcttaaaaa

SEQ ID NO: 4711602 - DNA, 14 bp, Homo sapiens
tctgcttcagcctc

SEQ ID NO: 4711603 - DNA, 15 bp, Homo sapiens
tctgcttcagcctcc

SEQ ID NO: 4711604 - DNA, 19 bp, Homo sapiens
tctacctgaggggcctctt

SEQ ID NO: 4711605 - DNA, 22 bp, Homo sapiens
tctacgtatggctccacacctc

SEQ ID NO: 4711606 - DNA, 14 bp, Homo sapiens
tctactacccccac

SEQ ID NO: 4711607 - DNA, 17 bp, Homo sapiens
tctactagattgtgatc

SEQ ID NO: 4711608 - DNA, 14 bp, Homo sapiens
tctactatttatgt

SEQ ID NO: 4711609 - DNA, 20 bp, Homo sapiens
tctactttgaagtcatacca

SEQ ID NO: 4711610 - DNA, 12 bp, Homo sapiens
tctagaatggtt

SEQ ID NO: 4711611 - DNA, 19 bp, Homo sapiens
tctaggaagactttggaaa

SEQ ID NO: 4711612 - DNA, 12 bp, Homo sapiens
tctaggctgggg

SEQ ID NO: 4711613 - DNA, 15 bp, Homo sapiens
tctaggtcttggtta

SEQ ID NO: 4711614 - DNA, 18 bp, Homo sapiens
tctaggtggcaaggctgt

SEQ ID NO: 4711615 - DNA, 17 bp, Homo sapiens
tctagtagaacaatgta

SEQ ID NO: 4711616 - DNA, 19 bp, Homo sapiens
tctagtccctgtgttctgc

SEQ ID NO: 4711617 - DNA, 16 bp, Homo sapiens
tctagtggtctttgta

SEQ ID NO: 4711618 - DNA, 19 bp, Homo sapiens
tctatcctgttaacactgt

SEQ ID NO: 4711619 - DNA, 23 bp, Homo sapiens
tctatcctgttaacactgtaata

SEQ ID NO: 4711620 - DNA, 22 bp, Homo sapiens
tctatctttgagcgcccactag

SEQ ID NO: 4711621 - DNA, 23 bp, Homo sapiens
tctatgggactcaatgcactgac

SEQ ID NO: 4711622 - DNA, 22 bp, Homo sapiens
tctatgtatgtgccaattttgt

SEQ ID NO: 4711623 - DNA, 12 bp, Homo sapiens
tctattaaaaga

SEQ ID NO: 4711624 - DNA, 13 bp, Homo sapiens
tctattaaaagac

SEQ ID NO: 4711625 - DNA, 14 bp, Homo sapiens
tctattaaaagact

SEQ ID NO: 4711626 - DNA, 15 bp, Homo sapiens
tctattaaaagactc

SEQ ID NO: 4711627 - DNA, 19 bp, Homo sapiens
tctattaaaagactcatcc

SEQ ID NO: 4711628 - DNA, 20 bp, Homo sapiens
tctattaaaagactcatccg

SEQ ID NO: 4711629 - DNA, 21 bp, Homo sapiens
tctattaaaagactcatccgt

SEQ ID NO: 4711630 - DNA, 21 bp, Homo sapiens
tctattaaaattgccatttta

SEQ ID NO: 4711631 - DNA, 11 bp, Homo sapiens
tctatttctag

SEQ ID NO: 4711632 - DNA, 15 bp, Homo sapiens
tctatttctcctcca

SEQ ID NO: 4711633 - DNA, 13 bp, Homo sapiens
tctattttcacaa

SEQ ID NO: 4711634 - DNA, 17 bp, Homo sapiens
tctcaaagaaatttcca

SEQ ID NO: 4711635 - DNA, 18 bp, Homo sapiens
tctcaaagttttgaaaag

SEQ ID NO: 4711636 - DNA, 20 bp, Homo sapiens
tctcaaagttttgaaaagct

SEQ ID NO: 4711637 - DNA, 15 bp, Homo sapiens
tctcaattttgtatt

SEQ ID NO: 4711638 - DNA, 23 bp, Homo sapiens
tctcacacatgagcatcaggcca

SEQ ID NO: 4711639 - DNA, 16 bp, Homo sapiens
tctcactatgttgccc

SEQ ID NO: 4711640 - DNA, 17 bp, Homo sapiens
tctcactatgttgccca

SEQ ID NO: 4711641 - DNA, 19 bp, Homo sapiens
tctcactatgttgcccagg

SEQ ID NO: 4711642 - DNA, 11 bp, Homo sapiens
tctcactcctt

SEQ ID NO: 4711643 - DNA, 21 bp, Homo sapiens
tctcactgttgcccaggctgg

SEQ ID NO: 4711644 - DNA, 19 bp, Homo sapiens
tctcagctcttctgactta

SEQ ID NO: 4711645 - DNA, 23 bp, Homo sapiens
tctcaggaccaaagctttcatgt

SEQ ID NO: 4711646 - DNA, 19 bp, Homo sapiens
tctcaggctgtcccaagct

SEQ ID NO: 4711647 - DNA, 16 bp, Homo sapiens
tctcagggtctctgct

SEQ ID NO: 4711648 - DNA, 17 bp, Homo sapiens
tctcagggtctctgctg

SEQ ID NO: 4711649 - DNA, 19 bp, Homo sapiens
tctcagggtctctgctgcc

SEQ ID NO: 4711650 - DNA, 21 bp, Homo sapiens
tctcagtcatgcataaatatg

SEQ ID NO: 4711651 - DNA, 11 bp, Homo sapiens
tctcagtctct

SEQ ID NO: 4711652 - DNA, 17 bp, Homo sapiens
tctcagtctctgagcag

SEQ ID NO: 4711653 - DNA, 21 bp, Homo sapiens
tctcagtgtgcccttctctta

SEQ ID NO: 4711654 - DNA, 22 bp, Homo sapiens
tctcagtgtgcccttctcttat

SEQ ID NO: 4711655 - DNA, 21 bp, Homo sapiens
tctcagttgcagccctgctgc

SEQ ID NO: 4711656 - DNA, 16 bp, Homo sapiens
tctcatcactcccctc

SEQ ID NO: 4711657 - DNA, 19 bp, Homo sapiens
tctcatcactcccctccaa

SEQ ID NO: 4711658 - DNA, 13 bp, Homo sapiens
tctcatccatcat

SEQ ID NO: 4711659 - DNA, 14 bp, Homo sapiens
tctcatgaatctgc

SEQ ID NO: 4711660 - DNA, 13 bp, Homo sapiens
tctcatgcctcag

SEQ ID NO: 4711661 - DNA, 16 bp, Homo sapiens
tctcatgcctcagcct

SEQ ID NO: 4711662 - DNA, 17 bp, Homo sapiens
tctcattaaaatccagt

SEQ ID NO: 4711663 - DNA, 22 bp, Homo sapiens
tctcattgctgttttaatttgt

SEQ ID NO: 4711664 - DNA, 22 bp, Homo sapiens
tctcatttcacccctccctttc

SEQ ID NO: 4711665 - DNA, 19 bp, Homo sapiens
tctcatttgccaataataa

SEQ ID NO: 4711666 - DNA, 16 bp, Homo sapiens
tctccaaataaaaatt

SEQ ID NO: 4711667 - DNA, 17 bp, Homo sapiens
tctccaaccccccagca

SEQ ID NO: 4711668 - DNA, 18 bp, Homo sapiens
tctccaaccccccagcac

SEQ ID NO: 4711669 - DNA, 19 bp, Homo sapiens
tctccaaccccccagcact

SEQ ID NO: 4711670 - DNA, 20 bp, Homo sapiens
tctccaaccccccagcactg

SEQ ID NO: 4711671 - DNA, 21 bp, Homo sapiens
tctccaaccccccagcactga

SEQ ID NO: 4711672 - DNA, 14 bp, Homo sapiens
tctccacctagtgg

SEQ ID NO: 4711673 - DNA, 16 bp, Homo sapiens
tctccacctagtggct

SEQ ID NO: 4711674 - DNA, 16 bp, Homo sapiens
tctccacctgccaggg

SEQ ID NO: 4711675 - DNA, 17 bp, Homo sapiens
tctccacctgccaggga

SEQ ID NO: 4711676 - DNA, 19 bp, Homo sapiens
tctccacctgccagggaca

SEQ ID NO: 4711677 - DNA, 18 bp, Homo sapiens
tctccagcattctcagcc

SEQ ID NO: 4711678 - DNA, 16 bp, Homo sapiens
tctccagcccctggat

SEQ ID NO: 4711679 - DNA, 16 bp, Homo sapiens
tctccaggctgtatcc

SEQ ID NO: 4711680 - DNA, 17 bp, Homo sapiens
tctccagtatcctgctg

SEQ ID NO: 4711681 - DNA, 18 bp, Homo sapiens
tctccatggccctgcaaa

SEQ ID NO: 4711682 - DNA, 20 bp, Homo sapiens
tctccatggccctgccatgc

SEQ ID NO: 4711683 - DNA, 16 bp, Homo sapiens
tctcccagataatgtg

SEQ ID NO: 4711684 - DNA, 21 bp, Homo sapiens
tctcccagataatgtgaaaat

SEQ ID NO: 4711685 - DNA, 23 bp, Homo sapiens
tctccccagcaagtgagagctgg

SEQ ID NO: 4711686 - DNA, 20 bp, Homo sapiens
tctcccccaccccctccccg

SEQ ID NO: 4711687 - DNA, 17 bp, Homo sapiens
tctcccccagccccatc

SEQ ID NO: 4711688 - DNA, 13 bp, Homo sapiens
tctcccccccggg

SEQ ID NO: 4711689 - DNA, 12 bp, Homo sapiens
tctcccctgccc

SEQ ID NO: 4711690 - DNA, 23 bp, Homo sapiens
tctcccctgcccccaggactggg

SEQ ID NO: 4711691 - DNA, 13 bp, Homo sapiens
tctccctggccct

SEQ ID NO: 4711692 - DNA, 18 bp, Homo sapiens
tctcccttggattgtccc

SEQ ID NO: 4711693 - DNA, 19 bp, Homo sapiens
tctcccttggattgtcccc

SEQ ID NO: 4711694 - DNA, 21 bp, Homo sapiens
tctcccttggattgtccccga

SEQ ID NO: 4711695 - DNA, 21 bp, Homo sapiens
tcttctcctgtgatgtcccag

SEQ ID NO: 4711696 - DNA, 21 bp, Homo sapiens
tcttctgacttaagtgtgcaa

SEQ ID NO: 4711697 - DNA, 12 bp, Homo sapiens
tcttctgcttca

SEQ ID NO: 4711698 - DNA, 17 bp, Homo sapiens
tcttctgggagggcagc

SEQ ID NO: 4711699 - DNA, 20 bp, Homo sapiens
tcttctgtacgtctgacagg

SEQ ID NO: 4711700 - DNA, 13 bp, Homo sapiens
tcttcttcaccat

SEQ ID NO: 4711701 - DNA, 15 bp, Homo sapiens
tcttcttcaccattt

SEQ ID NO: 4711702 - DNA, 20 bp, Homo sapiens
tcttgacaccagctgttctg

SEQ ID NO: 4711703 - DNA, 21 bp, Homo sapiens
tcttgaccctgtcacttgctg

SEQ ID NO: 4711704 - DNA, 18 bp, Homo sapiens
tcttgacctgaactctgc

SEQ ID NO: 4711705 - DNA, 21 bp, Homo sapiens
tcttgatgcatgcactgttcc

SEQ ID NO: 4711706 - DNA, 16 bp, Homo sapiens
tcttgcaatggcagcc

SEQ ID NO: 4711707 - DNA, 23 bp, Homo sapiens
tcttgcaatggcagccttggcaa

SEQ ID NO: 4711708 - DNA, 16 bp, Homo sapiens
tcttgcattgaattta

SEQ ID NO: 4711709 - DNA, 20 bp, Homo sapiens
tcttgccccaacccccagca

SEQ ID NO: 4711710 - DNA, 23 bp, Homo sapiens
tcttgccccaacccccagcaccc

SEQ ID NO: 4711711 - DNA, 13 bp, Homo sapiens
tcttgctctgctg

SEQ ID NO: 4711712 - DNA, 12 bp, Homo sapiens
tcttgcttctgg

SEQ ID NO: 4711713 - DNA, 21 bp, Homo sapiens
tcttggcacatttaagagaca

SEQ ID NO: 4711714 - DNA, 19 bp, Homo sapiens
tcttgtaatccgaatctct

SEQ ID NO: 4711715 - DNA, 16 bp, Homo sapiens
tcttgtattaagttgt

SEQ ID NO: 4711716 - DNA, 16 bp, Homo sapiens
tcttgtcatcagtaag

SEQ ID NO: 4711717 - DNA, 22 bp, Homo sapiens
tcttgtgaatattgtggctccc

SEQ ID NO: 4711718 - DNA, 17 bp, Homo sapiens
tcttgtgcttttttgat

SEQ ID NO: 4711719 - DNA, 12 bp, Homo sapiens
tcttgtgtttct

SEQ ID NO: 4711720 - DNA, 18 bp, Homo sapiens
tcttgttagatttttaac

SEQ ID NO: 4711721 - DNA, 21 bp, Homo sapiens
tcttgtttggagggatcattt

SEQ ID NO: 4711722 - DNA, 19 bp, Homo sapiens
tctttaacagcttacactg

SEQ ID NO: 4711723 - DNA, 11 bp, Homo sapiens
tctttaactgc

SEQ ID NO: 4711724 - DNA, 15 bp, Homo sapiens
tctttaagttttatt

SEQ ID NO: 4711725 - DNA, 21 bp, Homo sapiens
tctttattaaatgtagaaagt

SEQ ID NO: 4711726 - DNA, 22 bp, Homo sapiens
tctttctagtggtctttgtaag

SEQ ID NO: 4711727 - DNA, 15 bp, Homo sapiens
tctttcttgctttga

SEQ ID NO: 4711728 - DNA, 15 bp, Homo sapiens
tctttcttggtgcat

SEQ ID NO: 4711729 - DNA, 19 bp, Homo sapiens
tctttctttgctgctgtgg

SEQ ID NO: 4711730 - DNA, 13 bp, Homo sapiens
tctttgataatgt

SEQ ID NO: 4711731 - DNA, 19 bp, Homo sapiens
tctttgattctccttcagc

SEQ ID NO: 4711732 - DNA, 13 bp, Homo sapiens
tctttgcagacag

SEQ ID NO: 4711733 - DNA, 14 bp, Homo sapiens
tctttgcagacagg

SEQ ID NO: 4711734 - DNA, 16 bp, Homo sapiens
tctttgccaccctcat

SEQ ID NO: 4711735 - DNA, 20 bp, Homo sapiens
tctttgccaccctcatgctg

SEQ ID NO: 4711736 - DNA, 21 bp, Homo sapiens
tctttgccaccctcatgctgt

SEQ ID NO: 4711737 - DNA, 17 bp, Homo sapiens
tctttgctgctgtggaa

SEQ ID NO: 4711738 - DNA, 22 bp, Homo sapiens
tctttggacagaagcagctctt

SEQ ID NO: 4711739 - DNA, 17 bp, Homo sapiens
tctttggaccctgaggc

SEQ ID NO: 4711740 - DNA, 24 bp, Homo sapiens
tctttgtaagagtgtagaagcatt

SEQ ID NO: 4711741 - DNA, 18 bp, Homo sapiens
tcttttacatacagtgat

SEQ ID NO: 4711742 - DNA, 14 bp, Homo sapiens
tcttttcacatttt

SEQ ID NO: 4711743 - DNA, 17 bp, Homo sapiens
tcttttctcttctacat

SEQ ID NO: 4711744 - DNA, 14 bp, Homo sapiens
tctttttgaaatgt

SEQ ID NO: 4711745 - DNA, 16 bp, Homo sapiens
tgaaaaaaaacagtgg

SEQ ID NO: 4711746 - DNA, 22 bp, Homo sapiens
tgaaaaagcaacgggaaatgtg

SEQ ID NO: 4711747 - DNA, 15 bp, Homo sapiens
tgaaaaaggtgatta

SEQ ID NO: 4711748 - DNA, 17 bp, Homo sapiens
tgaaaaattatcagtta

SEQ ID NO: 4711749 - DNA, 19 bp, Homo sapiens
tgaaaaattgcattcattg

SEQ ID NO: 4711750 - DNA, 18 bp, Homo sapiens
tgaaaacaagttccaaat

SEQ ID NO: 4711751 - DNA, 17 bp, Homo sapiens
tgaaaacactgttctct

SEQ ID NO: 4711752 - DNA, 22 bp, Homo sapiens
tgaaaacactgttctctgccct

SEQ ID NO: 4711753 - DNA, 17 bp, Homo sapiens
tgaaaataaagaatgga

SEQ ID NO: 4711754 - DNA, 20 bp, Homo sapiens
tgaaaatatctcttgtgctt

SEQ ID NO: 4711755 - DNA, 16 bp, Homo sapiens
tgaaaatcctgaataa

SEQ ID NO: 4711756 - DNA, 21 bp, Homo sapiens
tgaaaatgcaacaacatgtat

SEQ ID NO: 4711757 - DNA, 20 bp, Homo sapiens
tgaaacacaaacaatagtaa

SEQ ID NO: 4711758 - DNA, 22 bp, Homo sapiens
tgaaacagcctctgcaagattt

SEQ ID NO: 4711759 - DNA, 20 bp, Homo sapiens
tgaaaccagtgttagggaag

SEQ ID NO: 4711760 - DNA, 21 bp, Homo sapiens
tgaaaccttttttaagatttt

SEQ ID NO: 4711761 - DNA, 13 bp, Homo sapiens
tgaaactccacct

SEQ ID NO: 4711762 - DNA, 13 bp, Homo sapiens
tgaaagaaaataa

SEQ ID NO: 4711763 - DNA, 15 bp, Homo sapiens
tgaaagggcccagag

SEQ ID NO: 4711764 - DNA, 23 bp, Homo sapiens
tgaaagtttttaatatttattga

SEQ ID NO: 4711765 - DNA, 21 bp, Homo sapiens
tgaaataccaacctgaagaca

SEQ ID NO: 4711766 - DNA, 18 bp, Homo sapiens
tgaaatcatcaaaaagaa

SEQ ID NO: 4711767 - DNA, 19 bp, Homo sapiens
tgaaatgaggtcagagcct

SEQ ID NO: 4711768 - DNA, 23 bp, Homo sapiens
tgaaatgaggtcagagcctgcag

SEQ ID NO: 4711769 - DNA, 13 bp, Homo sapiens
tgaaatgtcaacc

SEQ ID NO: 4711770 - DNA, 17 bp, Homo sapiens
tgaaattaacctctcac

SEQ ID NO: 4711771 - DNA, 14 bp, Homo sapiens
tgaaattaatttgt

SEQ ID NO: 4711772 - DNA, 16 bp, Homo sapiens
tgaaattaatttgtga

SEQ ID NO: 4711773 - DNA, 19 bp, Homo sapiens
tgaaattattttctccaaa

SEQ ID NO: 4711774 - DNA, 15 bp, Homo sapiens
tgaaattgtattaca

SEQ ID NO: 4711775 - DNA, 22 bp, Homo sapiens
tgaacagtttggatgtcctcaa

SEQ ID NO: 4711776 - DNA, 13 bp, Homo sapiens
tgaacattccaga

SEQ ID NO: 4711777 - DNA, 17 bp, Homo sapiens
tgaacattgcaatagaa

SEQ ID NO: 4711778 - DNA, 15 bp, Homo sapiens
tgacatatttttgct

SEQ ID NO: 4711779 - DNA, 18 bp, Homo sapiens
tgacatttatttttcatt

SEQ ID NO: 4711780 - DNA, 22 bp, Homo sapiens
tgacatttatttttctcatgaa

SEQ ID NO: 4711781 - DNA, 14 bp, Homo sapiens
tgaccaatgtcttg

SEQ ID NO: 4711782 - DNA, 12 bp, Homo sapiens
tgaccaggaaag

SEQ ID NO: 4711783 - DNA, 21 bp, Homo sapiens
tgaccattctccacctgccag

SEQ ID NO: 4711784 - DNA, 13 bp, Homo sapiens
tgaccattctttt

SEQ ID NO: 4711785 - DNA, 14 bp, Homo sapiens
tgacccacagcctc

SEQ ID NO: 4711786 - DNA, 17 bp, Homo sapiens
tgacccacagcctccaa

SEQ ID NO: 4711787 - DNA, 18 bp, Homo sapiens
tgacccacagcctccaag

SEQ ID NO: 4711788 - DNA, 13 bp, Homo sapiens
tgacccactgctt

SEQ ID NO: 4711789 - DNA, 13 bp, Homo sapiens
tgacccaggctgg

SEQ ID NO: 4711790 - DNA, 19 bp, Homo sapiens
tgacccaggctgggcaagg

SEQ ID NO: 4711791 - DNA, 14 bp, Homo sapiens
tgacccatgctgcc

SEQ ID NO: 4711792 - DNA, 21 bp, Homo sapiens
tgacccatgctgccctgtgag

SEQ ID NO: 4711793 - DNA, 16 bp, Homo sapiens
tgaccccctcccccca

SEQ ID NO: 4711794 - DNA, 23 bp, Homo sapiens
tgacccctcatagccctcaccct

SEQ ID NO: 4711795 - DNA, 19 bp, Homo sapiens
tgaccctgtcacttgctgg

SEQ ID NO: 4711796 - DNA, 17 bp, Homo sapiens
tgacctaaattatttac

SEQ ID NO: 4711797 - DNA, 20 bp, Homo sapiens
tgacctcaggtgatccaccc

SEQ ID NO: 4711798 - DNA, 21 bp, Homo sapiens
tgacctcaggtgatccaccca

SEQ ID NO: 4711799 - DNA, 18 bp, Homo sapiens
tgacctctgcaagacaaa

SEQ ID NO: 4711800 - DNA, 15 bp, Homo sapiens
tgacctgaggccctt

SEQ ID NO: 4711801 - DNA, 19 bp, Homo sapiens
tgacctgaggcccttctct

SEQ ID NO: 4711802 - DNA, 19 bp, Homo sapiens
tgacctgcaaaaatgctgg

SEQ ID NO: 4711803 - DNA, 16 bp, Homo sapiens
tgacctgccaggcaca

SEQ ID NO: 4711804 - DNA, 21 bp, Homo sapiens
tgacctgccctggccccagcc

SEQ ID NO: 4711805 - DNA, 16 bp, Homo sapiens
tgacctgcctcccttc

SEQ ID NO: 4711806 - DNA, 19 bp, Homo sapiens
tgacctgcctcccttcatg

SEQ ID NO: 4711807 - DNA, 20 bp, Homo sapiens
tgaccttgaggagtcttgtg

SEQ ID NO: 4711808 - DNA, 21 bp, Homo sapiens
tgaccttgaggagtcttgtgt

SEQ ID NO: 4711809 - DNA, 14 bp, Homo sapiens
tgacgcagcctgag

SEQ ID NO: 4711810 - DNA, 17 bp, Homo sapiens
tgacgcagcctgagaat

SEQ ID NO: 4711811 - DNA, 13 bp, Homo sapiens
tgacgccatccca

SEQ ID NO: 4711812 - DNA, 15 bp, Homo sapiens
tgacgccatcccagc

SEQ ID NO: 4711813 - DNA, 16 bp, Homo sapiens
tgacgccatcccagcc

SEQ ID NO: 4711814 - DNA, 20 bp, Homo sapiens
tgacgtaagctctatctgca

SEQ ID NO: 4711815 - DNA, 21 bp, Homo sapiens
tgactaacaggccaaagagtc

SEQ ID NO: 4711816 - DNA, 17 bp, Homo sapiens
tgactacagtcaggaaa

SEQ ID NO: 4711817 - DNA, 18 bp, Homo sapiens
tgactacagtcaggaaag

SEQ ID NO: 4711818 - DNA, 20 bp, Homo sapiens
tgactacatttagcccctct

SEQ ID NO: 4711819 - DNA, 22 bp, Homo sapiens
tgactagcactagacatgtcat

SEQ ID NO: 4711820 - DNA, 17 bp, Homo sapiens
tgactagggaaatgatc

SEQ ID NO: 4711821 - DNA, 19 bp, Homo sapiens
tgactatttttcagaatct

SEQ ID NO: 4711822 - DNA, 17 bp, Homo sapiens
tgactcagggctcctgg

SEQ ID NO: 4711823 - DNA, 20 bp, Homo sapiens
tgactcattctgaaggagcc

SEQ ID NO: 4711824 - DNA, 16 bp, Homo sapiens
tgactccttctgccag

SEQ ID NO: 4711825 - DNA, 15 bp, Homo sapiens
tgactcgggctcctg

SEQ ID NO: 4711826 - DNA, 20 bp, Homo sapiens
tgactcgggctcctgtgccc

SEQ ID NO: 4711827 - DNA, 19 bp, Homo sapiens
tgactcttggcacagcatg

SEQ ID NO: 4711828 - DNA, 21 bp, Homo sapiens
tgactgggccctgcctctgtt

SEQ ID NO: 4711829 - DNA, 23 bp, Homo sapiens
tgactggtgttatcaccgtgggc

SEQ ID NO: 4711830 - DNA, 21 bp, Homo sapiens
tgacttatttatataaatttt

SEQ ID NO: 4711831 - DNA, 18 bp, Homo sapiens
tgacttcaggggctgccc

SEQ ID NO: 4711832 - DNA, 22 bp, Homo sapiens
tgacttcaggggctgcccgctc

SEQ ID NO: 4711833 - DNA, 16 bp, Homo sapiens
tgactttcctctttgg

SEQ ID NO: 4711834 - DNA, 12 bp, Homo sapiens
tgagaacactgt

SEQ ID NO: 4711835 - DNA, 22 bp, Homo sapiens
tgagaagggctcagagaggaca

SEQ ID NO: 4711836 - DNA, 23 bp, Homo sapiens
tgagaagggctcagagaggacaa

SEQ ID NO: 4711837 - DNA, 19 bp, Homo sapiens
tgagaagtactttgtgctg

SEQ ID NO: 4711838 - DNA, 20 bp, Homo sapiens
tgagacagaatctcgctctg

SEQ ID NO: 4711839 - DNA, 20 bp, Homo sapiens
tgagacagcccgggctctgc

SEQ ID NO: 4711840 - DNA, 22 bp, Homo sapiens
tgagacagcccgggctctgcct

SEQ ID NO: 4711841 - DNA, 16 bp, Homo sapiens
tgagacagtccagcct

SEQ ID NO: 4711842 - DNA, 14 bp, Homo sapiens
tgagacagtttctt

SEQ ID NO: 4711843 - DNA, 19 bp, Homo sapiens
tgagacagtttcttagctt

SEQ ID NO: 4711844 - DNA, 23 bp, Homo sapiens
tgagacagtttcttagcttttta

SEQ ID NO: 4711845 - DNA, 21 bp, Homo sapiens
tgagacataaatgttcacttt

SEQ ID NO: 4711846 - DNA, 18 bp, Homo sapiens
tgagactatgcgttttta

SEQ ID NO: 4711847 - DNA, 20 bp, Homo sapiens
tgagactctgtctcaaaaaa

SEQ ID NO: 4711848 - DNA, 15 bp, Homo sapiens
tgagagagagactgt

SEQ ID NO: 4711849 - DNA, 18 bp, Homo sapiens
tgagagagagactgtgtg

SEQ ID NO: 4711850 - DNA, 20 bp, Homo sapiens
tgagagcatgtgaggggtag

SEQ ID NO: 4711851 - DNA, 20 bp, Homo sapiens
tgagagcccagaggtaacag

SEQ ID NO: 4711852 - DNA, 19 bp, Homo sapiens
tgagaggggaacagactgg

SEQ ID NO: 4711853 - DNA, 19 bp, Homo sapiens
tgagaggtgtaggttgaaa

SEQ ID NO: 4711854 - DNA, 21 bp, Homo sapiens
tgagataccagcgaggaggct

SEQ ID NO: 4711855 - DNA, 15 bp, Homo sapiens
tgagatgttttacca

SEQ ID NO: 4711856 - DNA, 22 bp, Homo sapiens
tgagcactaaggtgtgctctga

SEQ ID NO: 4711857 - DNA, 23 bp, Homo sapiens
tgagcactaaggtgtgctctgat

SEQ ID NO: 4711858 - DNA, 13 bp, Homo sapiens
tgagcactgtagg

SEQ ID NO: 4711859 - DNA, 19 bp, Homo sapiens
tgagcagaatactggtctc

SEQ ID NO: 4711860 - DNA, 12 bp, Homo sapiens
tgagcagggctc

SEQ ID NO: 4711861 - DNA, 20 bp, Homo sapiens
tgagcagggctcagcgggga

SEQ ID NO: 4711862 - DNA, 24 bp, Homo sapiens
tgagcatcaggccaggccctctgc

SEQ ID NO: 4711863 - DNA, 17 bp, Homo sapiens
tgagcatgcattttctt

SEQ ID NO: 4711864 - DNA, 16 bp, Homo sapiens
tgagcattagatttct

SEQ ID NO: 4711865 - DNA, 17 bp, Homo sapiens
tgagccatcatttcctg

SEQ ID NO: 4711866 - DNA, 21 bp, Homo sapiens
tgagcctcagcatcctggcac

SEQ ID NO: 4711867 - DNA, 23 bp, Homo sapiens
tgagcgcacgcgcgcacacacac

SEQ ID NO: 4711868 - DNA, 16 bp, Homo sapiens
tgagctacttcttatt

SEQ ID NO: 4711869 - DNA, 11 bp, Homo sapiens
tgagctcagcc

SEQ ID NO: 4711870 - DNA, 19 bp, Homo sapiens
tgagctgggcagctggaag

SEQ ID NO: 4711871 - DNA, 23 bp, Homo sapiens
tgagcttaagaattttgagcagg

SEQ ID NO: 4711872 - DNA, 23 bp, Homo sapiens
tgaggaagaacggggctcttctc

SEQ ID NO: 4711873 - DNA, 17 bp, Homo sapiens
tgaggaagccgctgggg

SEQ ID NO: 4711874 - DNA, 22 bp, Homo sapiens
tgaggaatccagacccggctgc

SEQ ID NO: 4711875 - DNA, 21 bp, Homo sapiens
tgaggacactaaccacgctgg

SEQ ID NO: 4711876 - DNA, 14 bp, Homo sapiens
tgaggacccgccgg

SEQ ID NO: 4711877 - DNA, 17 bp, Homo sapiens
tgaggactgatttcaga

SEQ ID NO: 4711878 - DNA, 15 bp, Homo sapiens
tgaggagaagtgggg

SEQ ID NO: 4711879 - DNA, 15 bp, Homo sapiens
tgaggagtcttgtgt

SEQ ID NO: 4711880 - DNA, 23 bp, Homo sapiens
tgaggagtggttgggctgtgcct

SEQ ID NO: 4711881 - DNA, 17 bp, Homo sapiens
tgaggcaagccatggag

SEQ ID NO: 4711882 - DNA, 18 bp, Homo sapiens
tgaggcacctgcatatct

SEQ ID NO: 4711883 - DNA, 21 bp, Homo sapiens
tgaggcagtgggtcccacttc

SEQ ID NO: 4711884 - DNA, 22 bp, Homo sapiens
tgaggcagtgggtcccacttcc

SEQ ID NO: 4711885 - DNA, 23 bp, Homo sapiens
tgaggcatcgcaatgtaagactc

SEQ ID NO: 4711886 - DNA, 15 bp, Homo sapiens
tgattctcagggtct

SEQ ID NO: 4711887 - DNA, 22 bp, Homo sapiens
tgattctcagggtctctgctgc

SEQ ID NO: 4711888 - DNA, 13 bp, Homo sapiens
tgattctcatgcc

SEQ ID NO: 4711889 - DNA, 15 bp, Homo sapiens
tgattctcatgcctc

SEQ ID NO: 4711890 - DNA, 16 bp, Homo sapiens
tgattctcatgcctca

SEQ ID NO: 4711891 - DNA, 13 bp, Homo sapiens
tgattctcctgcc

SEQ ID NO: 4711892 - DNA, 19 bp, Homo sapiens
tgattctcctgcctcagcc

SEQ ID NO: 4711893 - DNA, 12 bp, Homo sapiens
tgattctccttc

SEQ ID NO: 4711894 - DNA, 13 bp, Homo sapiens
tgattctgttcta

SEQ ID NO: 4711895 - DNA, 19 bp, Homo sapiens
tgattctgttctacttgat

SEQ ID NO: 4711896 - DNA, 18 bp, Homo sapiens
tgattgccaagctcagga

SEQ ID NO: 4711897 - DNA, 17 bp, Homo sapiens
tgatttaataaaataat

SEQ ID NO: 4711898 - DNA, 19 bp, Homo sapiens
tgatttaataaaataattc

SEQ ID NO: 4711899 - DNA, 21 bp, Homo sapiens
tgatttaataaaataattcta

SEQ ID NO: 4711900 - DNA, 16 bp, Homo sapiens
tgatttcacagtgtgt

SEQ ID NO: 4711901 - DNA, 17 bp, Homo sapiens
tgatttcagctcactgc

SEQ ID NO: 4711902 - DNA, 21 bp, Homo sapiens
tgatttcagtgctgctgaact

SEQ ID NO: 4711903 - DNA, 17 bp, Homo sapiens
tgatttcccgtggcccc

SEQ ID NO: 4711904 - DNA, 19 bp, Homo sapiens
tgatttcccgtggccccag

SEQ ID NO: 4711905 - DNA, 20 bp, Homo sapiens
tgatttcccgtggccccagc

SEQ ID NO: 4711906 - DNA, 21 bp, Homo sapiens
tgatttcccgtggccccagcc

SEQ ID NO: 4711907 - DNA, 23 bp, Homo sapiens
tgatttcccgtggccccagcctg

SEQ ID NO: 4711908 - DNA, 13 bp, Homo sapiens
tgatttctagaat

SEQ ID NO: 4711909 - DNA, 18 bp, Homo sapiens
tgatttctagaatggttt

SEQ ID NO: 4711910 - DNA, 11 bp, Homo sapiens
tgattttgaac

SEQ ID NO: 4711911 - DNA, 23 bp, Homo sapiens
tgattttgaacctgatgaaaata

SEQ ID NO: 4711912 - DNA, 19 bp, Homo sapiens
tgatttttaaagaaaagtt

SEQ ID NO: 4711913 - DNA, 15 bp, Homo sapiens
tgatttttgtgtatc

SEQ ID NO: 4711914 - DNA, 21 bp, Homo sapiens
tgatttttgtgtatccagtat

SEQ ID NO: 4711915 - DNA, 19 bp, Homo sapiens
tgcaaaaggactctcagga

SEQ ID NO: 4711916 - DNA, 22 bp, Homo sapiens
tgcaaaaggactctcaggacca

SEQ ID NO: 4711917 - DNA, 15 bp, Homo sapiens
tgcaaagcccagctt

SEQ ID NO: 4711918 - DNA, 13 bp, Homo sapiens
tgcaaaggctggg

SEQ ID NO: 4711919 - DNA, 21 bp, Homo sapiens
tgcaaagggtatcaggtgctg

SEQ ID NO: 4711920 - DNA, 21 bp, Homo sapiens
tgcaaagtcatgcaaaggctg

SEQ ID NO: 4711921 - DNA, 22 bp, Homo sapiens
tgcaaagtcatgcaaaggctgg

SEQ ID NO: 4711922 - DNA, 13 bp, Homo sapiens
tgcaacaacatgt

SEQ ID NO: 4711923 - DNA, 15 bp, Homo sapiens
tgcaacaacatgtat

SEQ ID NO: 4711924 - DNA, 21 bp, Homo sapiens
tgcaacatggattccaaagca

SEQ ID NO: 4711925 - DNA, 20 bp, Homo sapiens
tgcaacctgattgtgtctct

SEQ ID NO: 4711926 - DNA, 21 bp, Homo sapiens
tgcaaccttcgccacctgggt

SEQ ID NO: 4711927 - DNA, 14 bp, Homo sapiens
tgcaactcttgtat

SEQ ID NO: 4711928 - DNA, 18 bp, Homo sapiens
tgcaactcttgtattgct

SEQ ID NO: 4711929 - DNA, 14 bp, Homo sapiens
tgcaacttgtgaac

SEQ ID NO: 4711930 - DNA, 23 bp, Homo sapiens
tgcaagattttaaaagttttgtt

SEQ ID NO: 4711931 - DNA, 20 bp, Homo sapiens
tgcaaggaagccacagctgg

SEQ ID NO: 4711932 - DNA, 13 bp, Homo sapiens
tgcaatggcagcc

SEQ ID NO: 4711933 - DNA, 18 bp, Homo sapiens
tgcaatgggggagggagg

SEQ ID NO: 4711934 - DNA, 15 bp, Homo sapiens
tgcaattaactctgg

SEQ ID NO: 4711935 - DNA, 17 bp, Homo sapiens
tgcaattaactctggac

SEQ ID NO: 4711936 - DNA, 22 bp, Homo sapiens
tgcacaactagttaaaagcctt

SEQ ID NO: 4711937 - DNA, 21 bp, Homo sapiens
tgcacacaccagagcccacct

SEQ ID NO: 4711938 - DNA, 12 bp, Homo sapiens
tgcacacagcac

SEQ ID NO: 4711939 - DNA, 19 bp, Homo sapiens
tgcacacctttattcagaa

SEQ ID NO: 4711940 - DNA, 14 bp, Homo sapiens
tgcacactgtccta

SEQ ID NO: 4711941 - DNA, 19 bp, Homo sapiens
tgcacagttgccacattta

SEQ ID NO: 4711942 - DNA, 16 bp, Homo sapiens
tgcaccaacccagccg

SEQ ID NO: 4711943 - DNA, 23 bp, Homo sapiens
tgcaccaacccagccgctgcccg

SEQ ID NO: 4711944 - DNA, 13 bp, Homo sapiens
tgcaccagccctt

SEQ ID NO: 4711945 - DNA, 23 bp, Homo sapiens
tgcacccagccccaaggggtggc

SEQ ID NO: 4711946 - DNA, 18 bp, Homo sapiens
tgcaccccctcctgctgc

SEQ ID NO: 4711947 - DNA, 14 bp, Homo sapiens
tgcaccggctggcc

SEQ ID NO: 4711948 - DNA, 15 bp, Homo sapiens
tgcaccggctggcct

SEQ ID NO: 4711949 - DNA, 18 bp, Homo sapiens
tgcaccggctggcctggc

SEQ ID NO: 4711950 - DNA, 20 bp, Homo sapiens
tgcaccggctggcctggccc

SEQ ID NO: 4711951 - DNA, 17 bp, Homo sapiens
tgcaccgggccacagag

SEQ ID NO: 4711952 - DNA, 22 bp, Homo sapiens
tgcaccttctgacgcagcctga

SEQ ID NO: 4711953 - DNA, 23 bp, Homo sapiens
tgcaccttctgacgcagcctgag

SEQ ID NO: 4711954 - DNA, 16 bp, Homo sapiens
tgcacgtacacacaca

SEQ ID NO: 4711955 - DNA, 18 bp, Homo sapiens
tgcacgtgtgtttttcta

SEQ ID NO: 4711956 - DNA, 22 bp, Homo sapiens
tgcacgtgtgtttttctattaa

SEQ ID NO: 4711957 - DNA, 16 bp, Homo sapiens
tgcacgttaacagcgt

SEQ ID NO: 4711958 - DNA, 22 bp, Homo sapiens
tgcactaccatagctacatcag

SEQ ID NO: 4711959 - DNA, 19 bp, Homo sapiens
tgcactcccctgctgggtg

SEQ ID NO: 4711960 - DNA, 12 bp, Homo sapiens
tgcactctgtgc

SEQ ID NO: 4711961 - DNA, 12 bp, Homo sapiens
tgcactgtcctg

SEQ ID NO: 4711962 - DNA, 17 bp, Homo sapiens
tgcactgtcctgctcca

SEQ ID NO: 4711963 - DNA, 21 bp, Homo sapiens
tgcactgtcctgctccacagt

SEQ ID NO: 4711964 - DNA, 14 bp, Homo sapiens
tgcactgttccccc

SEQ ID NO: 4711965 - DNA, 23 bp, Homo sapiens
tgcactgttccccctgtgcagcc

SEQ ID NO: 4711966 - DNA, 16 bp, Homo sapiens
tgcacttgcagactct

SEQ ID NO: 4711967 - DNA, 21 bp, Homo sapiens
tgcacttgcagactctacaga

SEQ ID NO: 4711968 - DNA, 14 bp, Homo sapiens
tgcactttgttctg

SEQ ID NO: 4711969 - DNA, 18 bp, Homo sapiens
tgcactttgttctggctc

SEQ ID NO: 4711970 - DNA, 19 bp, Homo sapiens
tgcactttgttctggctct

SEQ ID NO: 4711971 - DNA, 19 bp, Homo sapiens
tgcagactctacagaggcc

SEQ ID NO: 4711972 - DNA, 18 bp, Homo sapiens
tgcagagagccattttgt

SEQ ID NO: 4711973 - DNA, 21 bp, Homo sapiens
tgcagagagccattttgtgaa

SEQ ID NO: 4711974 - DNA, 22 bp, Homo sapiens
tgcagagagccattttgtgaat

SEQ ID NO: 4711975 - DNA, 23 bp, Homo sapiens
tgcagagagccattttgtgaatg

SEQ ID NO: 4711976 - DNA, 21 bp, Homo sapiens
tgcagaggaggagaaaagtga

SEQ ID NO: 4711977 - DNA, 13 bp, Homo sapiens
tgcagaggggcag

SEQ ID NO: 4711978 - DNA, 15 bp, Homo sapiens
tgcagataaacagaa

SEQ ID NO: 4711979 - DNA, 22 bp, Homo sapiens
tgcagcagggcaggaaggggaa

SEQ ID NO: 4711980 - DNA, 23 bp, Homo sapiens
tgcagcccccactgcctttgacc

SEQ ID NO: 4711981 - DNA, 18 bp, Homo sapiens
tgcagcctcaacctcctg

SEQ ID NO: 4711982 - DNA, 20 bp, Homo sapiens
tgcagcctcaacctcctggg

SEQ ID NO: 4711983 - DNA, 13 bp, Homo sapiens
tgcagcctcacag

SEQ ID NO: 4711984 - DNA, 15 bp, Homo sapiens
tgcagcctcacagtc

SEQ ID NO: 4711985 - DNA, 18 bp, Homo sapiens
tgcagcctcacagtcctt

SEQ ID NO: 4711986 - DNA, 20 bp, Homo sapiens
tgcagctgacttttctgacc

SEQ ID NO: 4711987 - DNA, 16 bp, Homo sapiens
tgcaggaaggagctgc

SEQ ID NO: 4711988 - DNA, 17 bp, Homo sapiens
tgcaggaaggagctgcc

SEQ ID NO: 4711989 - DNA, 19 bp, Homo sapiens
tgcaggaaggagctgcctg

SEQ ID NO: 4711990 - DNA, 20 bp, Homo sapiens
tgcaggaaggagctgcctgg

SEQ ID NO: 4711991 - DNA, 21 bp, Homo sapiens
tgcaggaaggagctgcctgga

SEQ ID NO: 4711992 - DNA, 15 bp, Homo sapiens
tgcaggcagccaggc

SEQ ID NO: 4711993 - DNA, 17 bp, Homo sapiens
tgcaggcagccaggcca

SEQ ID NO: 4711994 - DNA, 16 bp, Homo sapiens
tgcaggcatcacagct

SEQ ID NO: 4711995 - DNA, 13 bp, Homo sapiens
tcaaattcaatga

SEQ ID NO: 4711996 - DNA, 17 bp, Homo sapiens
tcaaattcaatgattct

SEQ ID NO: 4711997 - DNA, 15 bp, Homo sapiens
tcaaattgaaatgac

SEQ ID NO: 4711998 - DNA, 15 bp, Homo sapiens
tcaaatttacattta

SEQ ID NO: 4711999 - DNA, 15 bp, Homo sapiens
tcaacaaaaattgtc

SEQ ID NO: 4712000 - DNA, 18 bp, Homo sapiens
tcaacaaaaattgtccct

SEQ ID NO: 4712001 - DNA, 18 bp, Homo sapiens
tcaacactatatatttta

SEQ ID NO: 4712002 - DNA, 19 bp, Homo sapiens
tcaacactatatattttat

SEQ ID NO: 4712003 - DNA, 18 bp, Homo sapiens
tcaacactcccttcccat

SEQ ID NO: 4712004 - DNA, 13 bp, Homo sapiens
tcaacctaaccac

SEQ ID NO: 4712005 - DNA, 15 bp, Homo sapiens
tcaactttcatttga

SEQ ID NO: 4712006 - DNA, 15 bp, Homo sapiens
tcaagaaaacaggca

SEQ ID NO: 4712007 - DNA, 19 bp, Homo sapiens
tcaagaaaacaggcactgc

SEQ ID NO: 4712008 - DNA, 20 bp, Homo sapiens
tcaagactggaaggtgggga

SEQ ID NO: 4712009 - DNA, 15 bp, Homo sapiens
tcaagacttccagag

SEQ ID NO: 4712010 - DNA, 23 bp, Homo sapiens
tcaagatccaaatgctgtgcaaa

SEQ ID NO: 4712011 - DNA, 12 bp, Homo sapiens
tcaagcagccaa

SEQ ID NO: 4712012 - DNA, 21 bp, Homo sapiens
tcaagcgattcttctgcttca

SEQ ID NO: 4712013 - DNA, 18 bp, Homo sapiens
tcaaggaataatgggctt

SEQ ID NO: 4712014 - DNA, 15 bp, Homo sapiens
tcaaggactggtaaa

SEQ ID NO: 4712015 - DNA, 13 bp, Homo sapiens
tcaaggcactgcc

SEQ ID NO: 4712016 - DNA, 14 bp, Homo sapiens
tcaaggcctcccac

SEQ ID NO: 4712017 - DNA, 17 bp, Homo sapiens
tcaaggcctcccacagt

SEQ ID NO: 4712018 - DNA, 16 bp, Homo sapiens
tcaagtactacatttt

SEQ ID NO: 4712019 - DNA, 19 bp, Homo sapiens
tcaagtactacattttctt

SEQ ID NO: 4712020 - DNA, 22 bp, Homo sapiens
tcaagtcctcttttctgagagg

SEQ ID NO: 4712021 - DNA, 13 bp, Homo sapiens
tcaagtgagtggc

SEQ ID NO: 4712022 - DNA, 17 bp, Homo sapiens
tcaagtgattctcatgc

SEQ ID NO: 4712023 - DNA, 17 bp, Homo sapiens
tcaagtgattctcctgc

SEQ ID NO: 4712024 - DNA, 18 bp, Homo sapiens
tcaagtgattctcctgcc

SEQ ID NO: 4712025 - DNA, 20 bp, Homo sapiens
tcaagtgattctcctgcctc

SEQ ID NO: 4712026 - DNA, 17 bp, Homo sapiens
tcaagttgtgtctgaaa

SEQ ID NO: 4712027 - DNA, 13 bp, Homo sapiens
tcaatactgagcc

SEQ ID NO: 4712028 - DNA, 20 bp, Homo sapiens
tcaatactgagccatttata

SEQ ID NO: 4712029 - DNA, 15 bp, Homo sapiens
tcaatattttccatg

SEQ ID NO: 4712030 - DNA, 18 bp, Homo sapiens
tcaatattttccatgaaa

SEQ ID NO: 4712031 - DNA, 20 bp, Homo sapiens
tcaatatttttatttttaac

SEQ ID NO: 4712032 - DNA, 23 bp, Homo sapiens
tcaatatttttatttttaactct

SEQ ID NO: 4712033 - DNA, 15 bp, Homo sapiens
tcaatccagctatgt

SEQ ID NO: 4712034 - DNA, 14 bp, Homo sapiens
tcaatctgtgtaag

SEQ ID NO: 4712035 - DNA, 18 bp, Homo sapiens
tcaatgaaatggattggt

SEQ ID NO: 4712036 - DNA, 13 bp, Homo sapiens
tcaatgagagcat

SEQ ID NO: 4712037 - DNA, 14 bp, Homo sapiens
tcaatgagagcata

SEQ ID NO: 4712038 - DNA, 14 bp, Homo sapiens
tcaatgcactgaca

SEQ ID NO: 4712039 - DNA, 17 bp, Homo sapiens
tcaatggtttgcaagga

SEQ ID NO: 4712040 - DNA, 19 bp, Homo sapiens
tcaatggtttgcaaggaag

SEQ ID NO: 4712041 - DNA, 14 bp, Homo sapiens
tcaatgtaaaaata

SEQ ID NO: 4712042 - DNA, 13 bp, Homo sapiens
tcaattcaacact

SEQ ID NO: 4712043 - DNA, 15 bp, Homo sapiens
tcaattcttgccaaa

SEQ ID NO: 4712044 - DNA, 17 bp, Homo sapiens
tcaattgcaaaatgcgt

SEQ ID NO: 4712045 - DNA, 16 bp, Homo sapiens
tcaattgcatctccca

SEQ ID NO: 4712046 - DNA, 17 bp, Homo sapiens
tcaatttactttttaaa

SEQ ID NO: 4712047 - DNA, 13 bp, Homo sapiens
tcaatttccaaga

SEQ ID NO: 4712048 - DNA, 18 bp, Homo sapiens
tcaatttccaagagctga

SEQ ID NO: 4712049 - DNA, 15 bp, Homo sapiens
tcaatttctccccag

SEQ ID NO: 4712050 - DNA, 13 bp, Homo sapiens
tcaatttgctgaa

SEQ ID NO: 4712051 - DNA, 15 bp, Homo sapiens
tcaattttgtattta

SEQ ID NO: 4712052 - DNA, 15 bp, Homo sapiens
tcaattttttaaacc

SEQ ID NO: 4712053 - DNA, 21 bp, Homo sapiens
tcaattttttaaaccactaat

SEQ ID NO: 4712054 - DNA, 22 bp, Homo sapiens
tcacaaaacagcctttgggaaa

SEQ ID NO: 4712055 - DNA, 20 bp, Homo sapiens
tcacaaaacatattttacat

SEQ ID NO: 4712056 - DNA, 19 bp, Homo sapiens
tcacaaaagctgtgtctct

SEQ ID NO: 4712057 - DNA, 21 bp, Homo sapiens
tcacaaaagctgtgtctctgt

SEQ ID NO: 4712058 - DNA, 15 bp, Homo sapiens
tcacaattattaaat

SEQ ID NO: 4712059 - DNA, 14 bp, Homo sapiens
tcacacagacacta

SEQ ID NO: 4712060 - DNA, 21 bp, Homo sapiens
tcacacagtattacttctgct

SEQ ID NO: 4712061 - DNA, 22 bp, Homo sapiens
tcacacatgagcatcaggccag

SEQ ID NO: 4712062 - DNA, 18 bp, Homo sapiens
tcacacgggggcagctga

SEQ ID NO: 4712063 - DNA, 11 bp, Homo sapiens
tcacactgaga

SEQ ID NO: 4712064 - DNA, 12 bp, Homo sapiens
tcacactgagaa

SEQ ID NO: 4712065 - DNA, 11 bp, Homo sapiens
tcacactggga

SEQ ID NO: 4712066 - DNA, 13 bp, Homo sapiens
tcacagagaaaaa

SEQ ID NO: 4712067 - DNA, 20 bp, Homo sapiens
tcacagatgggtgcttggag

SEQ ID NO: 4712068 - DNA, 16 bp, Homo sapiens
tcacagctcttgtttg

SEQ ID NO: 4712069 - DNA, 19 bp, Homo sapiens
tcacaggagggagggggaa

SEQ ID NO: 4712070 - DNA, 11 bp, Homo sapiens
tcacaggcagg

SEQ ID NO: 4712071 - DNA, 15 bp, Homo sapiens
tcacaggcaggtcca

SEQ ID NO: 4712072 - DNA, 18 bp, Homo sapiens
tcacaggcaggtccaggg

SEQ ID NO: 4712073 - DNA, 13 bp, Homo sapiens
tcacagtgctgag

SEQ ID NO: 4712074 - DNA, 22 bp, Homo sapiens
tcacagttccctttatttcaca

SEQ ID NO: 4712075 - DNA, 12 bp, Homo sapiens
tcacatatctgt

SEQ ID NO: 4712076 - DNA, 22 bp, Homo sapiens
tcacatcatgctgttttatcct

SEQ ID NO: 4712077 - DNA, 17 bp, Homo sapiens
tcacatctgaatctcct

SEQ ID NO: 4712078 - DNA, 15 bp, Homo sapiens
tcacattttctcagt

SEQ ID NO: 4712079 - DNA, 16 bp, Homo sapiens
tcaccagccccagtgc

SEQ ID NO: 4712080 - DNA, 23 bp, Homo sapiens
tcaccatttggcaatgccatcat

SEQ ID NO: 4712081 - DNA, 14 bp, Homo sapiens
tcaccccagcccca

SEQ ID NO: 4712082 - DNA, 20 bp, Homo sapiens
tcacccctccctttctcccc

SEQ ID NO: 4712083 - DNA, 18 bp, Homo sapiens
tcacccgctaagagggag

SEQ ID NO: 4712084 - DNA, 19 bp, Homo sapiens
tcacccgctaagagggagg

SEQ ID NO: 4712085 - DNA, 20 bp, Homo sapiens
tcaccctggggctaggaaat

SEQ ID NO: 4712086 - DNA, 18 bp, Homo sapiens
tcaccgcggctggatggg

SEQ ID NO: 4712087 - DNA, 15 bp, Homo sapiens
tcaccgtgggctccc

SEQ ID NO: 4712088 - DNA, 17 bp, Homo sapiens
tcaccgtgggctccctg

SEQ ID NO: 4712089 - DNA, 18 bp, Homo sapiens
tcaccgtgggctccctga

SEQ ID NO: 4712090 - DNA, 14 bp, Homo sapiens
tcacctaactcata

SEQ ID NO: 4712091 - DNA, 17 bp, Homo sapiens
tcacctaggggaggagg

SEQ ID NO: 4712092 - DNA, 13 bp, Homo sapiens
tcacctcccccat

SEQ ID NO: 4712093 - DNA, 16 bp, Homo sapiens
tcacctctctcactga

SEQ ID NO: 4712094 - DNA, 23 bp, Homo sapiens
tcacctgaagactcattcttctg

SEQ ID NO: 4712095 - DNA, 13 bp, Homo sapiens
tcacctgcactaa

SEQ ID NO: 4712096 - DNA, 18 bp, Homo sapiens
tcacctggggctgctggc

SEQ ID NO: 4712097 - DNA, 21 bp, Homo sapiens
tcaccttcaaaatgttctatt

SEQ ID NO: 4712098 - DNA, 17 bp, Homo sapiens
tcaccttccaaacaaaa

SEQ ID NO: 4712099 - DNA, 14 bp, Homo sapiens
tcacctttgtcccc

SEQ ID NO: 4712100 - DNA, 21 bp, Homo sapiens
tcacgattgtcatcaggagaa

SEQ ID NO: 4712101 - DNA, 13 bp, Homo sapiens
tcaggtgctgcca

SEQ ID NO: 4712102 - DNA, 18 bp, Homo sapiens
tcaggtgctgccatccag

SEQ ID NO: 4712103 - DNA, 14 bp, Homo sapiens
tcaggtggggcagc

SEQ ID NO: 4712104 - DNA, 22 bp, Homo sapiens
tcaggtggggtcactctggcag

SEQ ID NO: 4712105 - DNA, 15 bp, Homo sapiens
tcaggtgtccctgca

SEQ ID NO: 4712106 - DNA, 18 bp, Homo sapiens
tcaggtgtccctgcactt

SEQ ID NO: 4712107 - DNA, 18 bp, Homo sapiens
tcaggttatcgaaataac

SEQ ID NO: 4712108 - DNA, 12 bp, Homo sapiens
tctgctttcctc

SEQ ID NO: 4712109 - DNA, 19 bp, Homo sapiens
tctggaagtgactttggct

SEQ ID NO: 4712110 - DNA, 14 bp, Homo sapiens
tctggacaggcatg

SEQ ID NO: 4712111 - DNA, 21 bp, Homo sapiens
tctggacaggcatgttctctg

SEQ ID NO: 4712112 - DNA, 16 bp, Homo sapiens
tctggacctctcttgt

SEQ ID NO: 4712113 - DNA, 17 bp, Homo sapiens
tctggacctctcttgtg

SEQ ID NO: 4712114 - DNA, 20 bp, Homo sapiens
tctggagagctagaacctgg

SEQ ID NO: 4712115 - DNA, 23 bp, Homo sapiens
tctggagagctagaacctggagg

SEQ ID NO: 4712116 - DNA, 17 bp, Homo sapiens
tctggattcccaggatg

SEQ ID NO: 4712117 - DNA, 14 bp, Homo sapiens
tctggattttgaat

SEQ ID NO: 4712118 - DNA, 14 bp, Homo sapiens
tctggcagctcaga

SEQ ID NO: 4712119 - DNA, 15 bp, Homo sapiens
tctggcagctcagag

SEQ ID NO: 4712120 - DNA, 18 bp, Homo sapiens
tctggcagctcagagagg

SEQ ID NO: 4712121 - DNA, 13 bp, Homo sapiens
tctggcctagtcc

SEQ ID NO: 4712122 - DNA, 20 bp, Homo sapiens
tctggcctagtcccttccac

SEQ ID NO: 4712123 - DNA, 13 bp, Homo sapiens
tctggctctgtct

SEQ ID NO: 4712124 - DNA, 15 bp, Homo sapiens
tctggctcttccagg

SEQ ID NO: 4712125 - DNA, 18 bp, Homo sapiens
tctggctcttccaggctg

SEQ ID NO: 4712126 - DNA, 19 bp, Homo sapiens
tctggctttgttcttgtca

SEQ ID NO: 4712127 - DNA, 18 bp, Homo sapiens
tctgggtccaggcctggc

SEQ ID NO: 4712128 - DNA, 14 bp, Homo sapiens
tctgggttcactgc

SEQ ID NO: 4712129 - DNA, 22 bp, Homo sapiens
tctgggttccttcctctgagcc

SEQ ID NO: 4712130 - DNA, 16 bp, Homo sapiens
tctgggtttacaacaa

SEQ ID NO: 4712131 - DNA, 23 bp, Homo sapiens
tctgggtttacaacaaacactgt

SEQ ID NO: 4712132 - DNA, 21 bp, Homo sapiens
tctggtatctaattctttaat

SEQ ID NO: 4712133 - DNA, 17 bp, Homo sapiens
tctggtctctaggctgg

SEQ ID NO: 4712134 - DNA, 19 bp, Homo sapiens
tctggtctctaggctgggg

SEQ ID NO: 4712135 - DNA, 14 bp, Homo sapiens
tctggtggttattt

SEQ ID NO: 4712136 - DNA, 16 bp, Homo sapiens
tctggtgtaggaagtt

SEQ ID NO: 4712137 - DNA, 15 bp, Homo sapiens
tctggtttcaccgag

SEQ ID NO: 4712138 - DNA, 14 bp, Homo sapiens
tctgtaagaaactg

SEQ ID NO: 4712139 - DNA, 15 bp, Homo sapiens
tctgtaagaaactgc

SEQ ID NO: 4712140 - DNA, 13 bp, Homo sapiens
tctgtaattgtgt

SEQ ID NO: 4712141 - DNA, 23 bp, Homo sapiens
tctgtacagagcccacgccccca

SEQ ID NO: 4712142 - DNA, 20 bp, Homo sapiens
tctgtatcaggacccagagg

SEQ ID NO: 4712143 - DNA, 17 bp, Homo sapiens
tctgtcccacttggcat

SEQ ID NO: 4712144 - DNA, 21 bp, Homo sapiens
tctgtcccacttggcatcagc

SEQ ID NO: 4712145 - DNA, 13 bp, Homo sapiens
tctgtcccaggtt

SEQ ID NO: 4712146 - DNA, 15 bp, Homo sapiens
tctgtccccttctct

SEQ ID NO: 4712147 - DNA, 22 bp, Homo sapiens
tctgtcccttgcccccctggcc

SEQ ID NO: 4712148 - DNA, 15 bp, Homo sapiens
tctgtcccttggagc

SEQ ID NO: 4712149 - DNA, 15 bp, Homo sapiens
tctgtcctactctgt

SEQ ID NO: 4712150 - DNA, 12 bp, Homo sapiens
tctgtcctggga

SEQ ID NO: 4712151 - DNA, 17 bp, Homo sapiens
tctgtcgcccagtctgg

SEQ ID NO: 4712152 - DNA, 17 bp, Homo sapiens
tctgtctcatccatcat

SEQ ID NO: 4712153 - DNA, 14 bp, Homo sapiens
tctgtctccttaac

SEQ ID NO: 4712154 - DNA, 19 bp, Homo sapiens
tctgtctccttaacactga

SEQ ID NO: 4712155 - DNA, 22 bp, Homo sapiens
tctgtctccttaacactgagct

SEQ ID NO: 4712156 - DNA, 15 bp, Homo sapiens
tctgtgaaaggaaag

SEQ ID NO: 4712157 - DNA, 21 bp, Homo sapiens
tctgtgaaaggaaagagggag

SEQ ID NO: 4712158 - DNA, 19 bp, Homo sapiens
tctgtgaacaagcttcagt

SEQ ID NO: 4712159 - DNA, 18 bp, Homo sapiens
tctgtgaccaatgtcttg

SEQ ID NO: 4712160 - DNA, 19 bp, Homo sapiens
tctgtgcacgcagtggcct

SEQ ID NO: 4712161 - DNA, 16 bp, Homo sapiens
tctgtgcccatgggca

SEQ ID NO: 4712162 - DNA, 19 bp, Homo sapiens
tctgtgcccatgggcactg

SEQ ID NO: 4712163 - DNA, 20 bp, Homo sapiens
tctgtgcccatgggcactgc

SEQ ID NO: 4712164 - DNA, 21 bp, Homo sapiens
tctgtggattcagcttctgtt

SEQ ID NO: 4712165 - DNA, 21 bp, Homo sapiens
tctgtgggctgcactctgtgc

SEQ ID NO: 4712166 - DNA, 13 bp, Homo sapiens
tctgtgtacattt

SEQ ID NO: 4712167 - DNA, 20 bp, Homo sapiens
tctgtgtcaggtggggcagc

SEQ ID NO: 4712168 - DNA, 12 bp, Homo sapiens
tctgtgtcttgt

SEQ ID NO: 4712169 - DNA, 17 bp, Homo sapiens
tctgtgtggttcagcta

SEQ ID NO: 4712170 - DNA, 17 bp, Homo sapiens
tctgtgtgtgcctgtgt

SEQ ID NO: 4712171 - DNA, 18 bp, Homo sapiens
tctgtgtgtgcctgtgtg

SEQ ID NO: 4712172 - DNA, 15 bp, Homo sapiens
tctgtgtgtttgtgt

SEQ ID NO: 4712173 - DNA, 17 bp, Homo sapiens
tctgtgtttagctattt

SEQ ID NO: 4712174 - DNA, 18 bp, Homo sapiens
tctgtgttttgaaagaat

SEQ ID NO: 4712175 - DNA, 19 bp, Homo sapiens
tctgttctgcacacagcac

SEQ ID NO: 4712176 - DNA, 18 bp, Homo sapiens
tctgttggccagtgtgac

SEQ ID NO: 4712177 - DNA, 14 bp, Homo sapiens
tctgttgttccaaa

SEQ ID NO: 4712178 - DNA, 18 bp, Homo sapiens
tctgtttaattttcactt

SEQ ID NO: 4712179 - DNA, 21 bp, Homo sapiens
tcttaaacataataaatcaca

SEQ ID NO: 4712180 - DNA, 15 bp, Homo sapiens
tcttaagagtgctaa

SEQ ID NO: 4712181 - DNA, 18 bp, Homo sapiens
tcttaatcttttcacaaa

SEQ ID NO: 4712182 - DNA, 16 bp, Homo sapiens
tcttaattagacctag

SEQ ID NO: 4712183 - DNA, 14 bp, Homo sapiens
tcttacacattcca

SEQ ID NO: 4712184 - DNA, 14 bp, Homo sapiens
tcttacctttatga

SEQ ID NO: 4712185 - DNA, 12 bp, Homo sapiens
tcttactttgtg

SEQ ID NO: 4712186 - DNA, 19 bp, Homo sapiens
tcttactttgtgcaaaagc

SEQ ID NO: 4712187 - DNA, 13 bp, Homo sapiens
tcttagagattaa

SEQ ID NO: 4712188 - DNA, 13 bp, Homo sapiens
tcttagctcccct

SEQ ID NO: 4712189 - DNA, 16 bp, Homo sapiens
tcttagctcccctcca

SEQ ID NO: 4712190 - DNA, 17 bp, Homo sapiens
tcttagctcccctccaa

SEQ ID NO: 4712191 - DNA, 19 bp, Homo sapiens
tcttaggagcagagctctg

SEQ ID NO: 4712192 - DNA, 17 bp, Homo sapiens
tcttagtggaagacaat

SEQ ID NO: 4712193 - DNA, 14 bp, Homo sapiens
tcttataatttaaa

SEQ ID NO: 4712194 - DNA, 22 bp, Homo sapiens
tcttatatatatattgattatt

SEQ ID NO: 4712195 - DNA, 15 bp, Homo sapiens
tcttatgggctgggt

SEQ ID NO: 4712196 - DNA, 14 bp, Homo sapiens
tcttattgcccacg

SEQ ID NO: 4712197 - DNA, 18 bp, Homo sapiens
tcttatttttaatttttc

SEQ ID NO: 4712198 - DNA, 16 bp, Homo sapiens
tcttcaagtgagtggc

SEQ ID NO: 4712199 - DNA, 17 bp, Homo sapiens
tcttcaatgatcaaatt

SEQ ID NO: 4712200 - DNA, 12 bp, Homo sapiens
tcttcacctcag

SEQ ID NO: 4712201 - DNA, 15 bp, Homo sapiens
tcttcacctcagagt

SEQ ID NO: 4712202 - DNA, 18 bp, Homo sapiens
tcttcagagactcctgca

SEQ ID NO: 4712203 - DNA, 21 bp, Homo sapiens
tcttcagagactcctgcaggc

SEQ ID NO: 4712204 - DNA, 15 bp, Homo sapiens
tcttcagaggccctc

SEQ ID NO: 4712205 - DNA, 14 bp, Homo sapiens
tcttcagctggtgg

SEQ ID NO: 4712206 - DNA, 20 bp, Homo sapiens
tcttcagctggtggatggtg

SEQ ID NO: 4712207 - DNA, 21 bp, Homo sapiens
tcttcagggtcctgagattta

SEQ ID NO: 4712208 - DNA, 20 bp, Homo sapiens
tcttcagtgtgttgacttct

SEQ ID NO: 4712209 - DNA, 14 bp, Homo sapiens
tcttcatgaacata

SEQ ID NO: 4712210 - DNA, 20 bp, Homo sapiens
tcttccaggctgggagagcc

SEQ ID NO: 4712211 - DNA, 13 bp, Homo sapiens
tcttccaggtggg

SEQ ID NO: 4712212 - DNA, 14 bp, Homo sapiens
tcttcccctctcag

SEQ ID NO: 4712213 - DNA, 16 bp, Homo sapiens
tcttcctatttctgga

SEQ ID NO: 4712214 - DNA, 18 bp, Homo sapiens
tcttcctgttctgtgact

SEQ ID NO: 4712215 - DNA, 15 bp, Homo sapiens
tcttctaatcataac

SEQ ID NO: 4712216 - DNA, 23 bp, Homo sapiens
tcttctcatttcacccctccctt

SEQ ID NO: 4712217 - DNA, 14 bp, Homo sapiens
tcttctccaggatg

SEQ ID NO: 4712218 - DNA, 15 bp, Homo sapiens
tcttctccaggctgt

SEQ ID NO: 4712219 - DNA, 12 bp, Homo sapiens
tcttctccccag

SEQ ID NO: 4712220 - DNA, 21 bp, Homo sapiens
tggctgggggcctcagtgcca

SEQ ID NO: 4712221 - DNA, 18 bp, Homo sapiens
tggctgtccagtgcccat

SEQ ID NO: 4712222 - DNA, 12 bp, Homo sapiens
tggctgtgagga

SEQ ID NO: 4712223 - DNA, 18 bp, Homo sapiens
tggcttcattagagcagg

SEQ ID NO: 4712224 - DNA, 20 bp, Homo sapiens
tggcttcattagagcaggcg

SEQ ID NO: 4712225 - DNA, 22 bp, Homo sapiens
tggcttcctaaaattcagtgga

SEQ ID NO: 4712226 - DNA, 14 bp, Homo sapiens
tggcttctccaggg

SEQ ID NO: 4712227 - DNA, 18 bp, Homo sapiens
tggcttgaattaagaaga

SEQ ID NO: 4712228 - DNA, 16 bp, Homo sapiens
tgggaaaaatgtagga

SEQ ID NO: 4712229 - DNA, 15 bp, Homo sapiens
tgggaactcacctgg

SEQ ID NO: 4712230 - DNA, 18 bp, Homo sapiens
tgggaactcacctggggc

SEQ ID NO: 4712231 - DNA, 20 bp, Homo sapiens
tgggaagtgacttagcagat

SEQ ID NO: 4712232 - DNA, 17 bp, Homo sapiens
tgggaccaaacctagcc

SEQ ID NO: 4712233 - DNA, 19 bp, Homo sapiens
tgggacctgatgacctggg

SEQ ID NO: 4712234 - DNA, 16 bp, Homo sapiens
tgggactacaggcacc

SEQ ID NO: 4712235 - DNA, 14 bp, Homo sapiens
tgggagatgaaaac

SEQ ID NO: 4712236 - DNA, 12 bp, Homo sapiens
tgggagctgcct

SEQ ID NO: 4712237 - DNA, 14 bp, Homo sapiens
tgggagctgcctgt

SEQ ID NO: 4712238 - DNA, 17 bp, Homo sapiens
tgggagctgcctgttca

SEQ ID NO: 4712239 - DNA, 20 bp, Homo sapiens
tgggaggctcacccccttct

SEQ ID NO: 4712240 - DNA, 17 bp, Homo sapiens
tgggagggcagcagggc

SEQ ID NO: 4712241 - DNA, 18 bp, Homo sapiens
tgggatcctccaggtgca

SEQ ID NO: 4712242 - DNA, 23 bp, Homo sapiens
tgggatctgcccctccctgcttc

SEQ ID NO: 4712243 - DNA, 16 bp, Homo sapiens
tgggatggtggagggc

SEQ ID NO: 4712244 - DNA, 22 bp, Homo sapiens
tgggattacaagcgtgagccac

SEQ ID NO: 4712245 - DNA, 17 bp, Homo sapiens
tgggattacaggcgtga

SEQ ID NO: 4712246 - DNA, 18 bp, Homo sapiens
tgggattacaggctcctg

SEQ ID NO: 4712247 - DNA, 19 bp, Homo sapiens
tgggattttatctgtggat

SEQ ID NO: 4712248 - DNA, 15 bp, Homo sapiens
tgggcaaagcctagt

SEQ ID NO: 4712249 - DNA, 20 bp, Homo sapiens
tgggcaacccccagcctgct

SEQ ID NO: 4712250 - DNA, 21 bp, Homo sapiens
tgggcaacccccagcctgcta

SEQ ID NO: 4712251 - DNA, 14 bp, Homo sapiens
tgggcaaggaggcc

SEQ ID NO: 4712252 - DNA, 12 bp, Homo sapiens
tgggcagagcag

SEQ ID NO: 4712253 - DNA, 14 bp, Homo sapiens
tgggcagagcagag

SEQ ID NO: 4712254 - DNA, 18 bp, Homo sapiens
tgggcagagcagagacca

SEQ ID NO: 4712255 - DNA, 22 bp, Homo sapiens
tgggcagagcagagaccatccc

SEQ ID NO: 4712256 - DNA, 16 bp, Homo sapiens
tgggcagatctacccc

SEQ ID NO: 4712257 - DNA, 21 bp, Homo sapiens
tgggcaggactcagctcccca

SEQ ID NO: 4712258 - DNA, 22 bp, Homo sapiens
tgggcagtttttctgtatttta

SEQ ID NO: 4712259 - DNA, 24 bp, Homo sapiens
tgggccatactggcctcgcctggc

SEQ ID NO: 4712260 - DNA, 16 bp, Homo sapiens
tgggcccccaaatgga

SEQ ID NO: 4712261 - DNA, 18 bp, Homo sapiens
tgggccctgcctctgttt

SEQ ID NO: 4712262 - DNA, 13 bp, Homo sapiens
tgggccctttgag

SEQ ID NO: 4712263 - DNA, 17 bp, Homo sapiens
tgggcgtgagacctgcc

SEQ ID NO: 4712264 - DNA, 15 bp, Homo sapiens
tgggctccctgactg

SEQ ID NO: 4712265 - DNA, 15 bp, Homo sapiens
tgggctcccttccca

SEQ ID NO: 4712266 - DNA, 11 bp, Homo sapiens
tgggctgaggg

SEQ ID NO: 4712267 - DNA, 12 bp, Homo sapiens
tgggctgaggga

SEQ ID NO: 4712268 - DNA, 19 bp, Homo sapiens
tgggctgcactctgtgccc

SEQ ID NO: 4712269 - DNA, 22 bp, Homo sapiens
tgggctgcactctgtgcccatg

SEQ ID NO: 4712270 - DNA, 18 bp, Homo sapiens
tgggctggggcctgatgg

SEQ ID NO: 4712271 - DNA, 18 bp, Homo sapiens
tgggctgggttctaccca

SEQ ID NO: 4712272 - DNA, 23 bp, Homo sapiens
tgggctgggttctacccaggtgc

SEQ ID NO: 4712273 - DNA, 16 bp, Homo sapiens
tgggcttcactgtata

SEQ ID NO: 4712274 - DNA, 18 bp, Homo sapiens
tgggcttcagtggcagct

SEQ ID NO: 4712275 - DNA, 19 bp, Homo sapiens
tgggcttcagtggcagctg

SEQ ID NO: 4712276 - DNA, 22 bp, Homo sapiens
tgggcttcagtggcagctgctt

SEQ ID NO: 4712277 - DNA, 17 bp, Homo sapiens
tggggacagagcagaac

SEQ ID NO: 4712278 - DNA, 12 bp, Homo sapiens
tggggagaaagt

SEQ ID NO: 4712279 - DNA, 13 bp, Homo sapiens
tggggaggaggag

SEQ ID NO: 4712280 - DNA, 13 bp, Homo sapiens
tggggcagcttga

SEQ ID NO: 4712281 - DNA, 20 bp, Homo sapiens
tgtaacttccaaataaataa

SEQ ID NO: 4712282 - DNA, 19 bp, Homo sapiens
tgtaagagtgtagaagcat

SEQ ID NO: 4712283 - DNA, 19 bp, Homo sapiens
tgtaaggatccggaaagaa

SEQ ID NO: 4712284 - DNA, 21 bp, Homo sapiens
tgtaaggatccggaaagaaga

SEQ ID NO: 4712285 - DNA, 19 bp, Homo sapiens
tgtaagtttcaggtgacat

SEQ ID NO: 4712286 - DNA, 21 bp, Homo sapiens
tgtaagtttcaggtgacatgt

SEQ ID NO: 4712287 - DNA, 12 bp, Homo sapiens
tgtaagtttgtg

SEQ ID NO: 4712288 - DNA, 14 bp, Homo sapiens
tgtaataagacata

SEQ ID NO: 4712289 - DNA, 21 bp, Homo sapiens
tgtaatattgtaaatactgga

SEQ ID NO: 4712290 - DNA, 19 bp, Homo sapiens
tgtaatatttcttcaagtg

SEQ ID NO: 4712291 - DNA, 16 bp, Homo sapiens
tgtaatccgaatctct

SEQ ID NO: 4712292 - DNA, 15 bp, Homo sapiens
tgtaatcttgaattg

SEQ ID NO: 4712293 - DNA, 12 bp, Homo sapiens
tgtaattattgt

SEQ ID NO: 4712294 - DNA, 14 bp, Homo sapiens
tgtaattattgtga

SEQ ID NO: 4712295 - DNA, 14 bp, Homo sapiens
tgtaattggaatct

SEQ ID NO: 4712296 - DNA, 16 bp, Homo sapiens
tgtaattgtgtggatt

SEQ ID NO: 4712297 - DNA, 23 bp, Homo sapiens
tgtaatttgaataagatccaatt

SEQ ID NO: 4712298 - DNA, 13 bp, Homo sapiens
tgtacagagccca

SEQ ID NO: 4712299 - DNA, 16 bp, Homo sapiens
tgtacagctggtgctt

SEQ ID NO: 4712300 - DNA, 17 bp, Homo sapiens
tgtacagtctcaatttt

SEQ ID NO: 4712301 - DNA, 16 bp, Homo sapiens
tgtaccaaatctgaca

SEQ ID NO: 4712302 - DNA, 21 bp, Homo sapiens
tgtaccaaatctgacatatta

SEQ ID NO: 4712303 - DNA, 15 bp, Homo sapiens
tgtacccccgcccag

SEQ ID NO: 4712304 - DNA, 16 bp, Homo sapiens
tgtacccccgcccagg

SEQ ID NO: 4712305 - DNA, 19 bp, Homo sapiens
tgtacccccgcccaggctg

SEQ ID NO: 4712306 - DNA, 17 bp, Homo sapiens
tgtacctggtgacccct

SEQ ID NO: 4712307 - DNA, 17 bp, Homo sapiens
tgtacgtctgacaggca

SEQ ID NO: 4712308 - DNA, 18 bp, Homo sapiens
tgtactttttgttccaga

SEQ ID NO: 4712309 - DNA, 18 bp, Homo sapiens
tgtagaaaagggaactga

SEQ ID NO: 4712310 - DNA, 23 bp, Homo sapiens
tgtagaaaatttgttattttgca

SEQ ID NO: 4712311 - DNA, 15 bp, Homo sapiens
tgtagaagcattcct

SEQ ID NO: 4712312 - DNA, 17 bp, Homo sapiens
tgtagaagcattccttc

SEQ ID NO: 4712313 - DNA, 15 bp, Homo sapiens
tgtagagccagggtc

SEQ ID NO: 4712314 - DNA, 17 bp, Homo sapiens
tgtagagttaagaagct

SEQ ID NO: 4712315 - DNA, 19 bp, Homo sapiens
tgtagagttaagaagctgt

SEQ ID NO: 4712316 - DNA, 21 bp, Homo sapiens
tgtagagttaagaagctgttg

SEQ ID NO: 4712317 - DNA, 13 bp, Homo sapiens
tgtagattaggat

SEQ ID NO: 4712318 - DNA, 19 bp, Homo sapiens
tgtagattaggattaaaat

SEQ ID NO: 4712319 - DNA, 22 bp, Homo sapiens
tgtagcatgtgaagaatgtctg

SEQ ID NO: 4712320 - DNA, 14 bp, Homo sapiens
tgtagcctctcttt

SEQ ID NO: 4712321 - DNA, 15 bp, Homo sapiens
tgtagctgaggaggc

SEQ ID NO: 4712322 - DNA, 20 bp, Homo sapiens
tgtaggcataaagtcagggg

SEQ ID NO: 4712323 - DNA, 20 bp, Homo sapiens
tgtagggaaaaaaatgcttc

SEQ ID NO: 4712324 - DNA, 15 bp, Homo sapiens
tgtagttgtcacact

SEQ ID NO: 4712325 - DNA, 15 bp, Homo sapiens
tgtataaaaacatga

SEQ ID NO: 4712326 - DNA, 14 bp, Homo sapiens
tgtataaataggag

SEQ ID NO: 4712327 - DNA, 19 bp, Homo sapiens
tgtataaattaatacagag

SEQ ID NO: 4712328 - DNA, 12 bp, Homo sapiens
tgtatatcttct

SEQ ID NO: 4712329 - DNA, 18 bp, Homo sapiens
tgtatatgtataaattaa

SEQ ID NO: 4712330 - DNA, 14 bp, Homo sapiens
tgtatatttgcata

SEQ ID NO: 4712331 - DNA, 15 bp, Homo sapiens
tgtatcccatgagcc

SEQ ID NO: 4712332 - DNA, 16 bp, Homo sapiens
tgtatcccatgagcct

SEQ ID NO: 4712333 - DNA, 14 bp, Homo sapiens
tgtatgctaaatga

SEQ ID NO: 4712334 - DNA, 21 bp, Homo sapiens
tgctgtgaatttgtgtaagga

SEQ ID NO: 4712335 - DNA, 23 bp, Homo sapiens
tgctgtgacaccccccttctgaa

SEQ ID NO: 4712336 - DNA, 16 bp, Homo sapiens
tgctgtggtgtgtccc

SEQ ID NO: 4712337 - DNA, 17 bp, Homo sapiens
tgctgttaatgtatact

SEQ ID NO: 4712338 - DNA, 19 bp, Homo sapiens
tgcttaaaaggtataatta

SEQ ID NO: 4712339 - DNA, 14 bp, Homo sapiens
tgcttcagcctccc

SEQ ID NO: 4712340 - DNA, 18 bp, Homo sapiens
tgcttccaggtaaaaaca

SEQ ID NO: 4712341 - DNA, 19 bp, Homo sapiens
tgcttccagtgaggctctg

SEQ ID NO: 4712342 - DNA, 22 bp, Homo sapiens
tgcttccagtgaggctctgccc

SEQ ID NO: 4712343 - DNA, 13 bp, Homo sapiens
tgcttcctctgaa

SEQ ID NO: 4712344 - DNA, 13 bp, Homo sapiens
tgcttcgggccct

SEQ ID NO: 4712345 - DNA, 16 bp, Homo sapiens
tgcttctggctttgtt

SEQ ID NO: 4712346 - DNA, 15 bp, Homo sapiens
tgcttctgtctggtt

SEQ ID NO: 4712347 - DNA, 13 bp, Homo sapiens
tgcttcttcagag

SEQ ID NO: 4712348 - DNA, 16 bp, Homo sapiens
tgcttcttgtaatatt

SEQ ID NO: 4712349 - DNA, 22 bp, Homo sapiens
tgcttctttctactttgtttat

SEQ ID NO: 4712350 - DNA, 12 bp, Homo sapiens
tgcttgaggaaa

SEQ ID NO: 4712351 - DNA, 16 bp, Homo sapiens
tgcttgaggaaaacaa

SEQ ID NO: 4712352 - DNA, 14 bp, Homo sapiens
tgcttgttggattt

SEQ ID NO: 4712353 - DNA, 14 bp, Homo sapiens
tgctttgcccagca

SEQ ID NO: 4712354 - DNA, 13 bp, Homo sapiens
tgctttggaaatc

SEQ ID NO: 4712355 - DNA, 22 bp, Homo sapiens
tgctttgggagacagtctagga

SEQ ID NO: 4712356 - DNA, 14 bp, Homo sapiens
tgcttttggtctgt

SEQ ID NO: 4712357 - DNA, 17 bp, Homo sapiens
tggaaaacaaggaagtc

SEQ ID NO: 4712358 - DNA, 19 bp, Homo sapiens
tggaaaacatcctgacttc

SEQ ID NO: 4712359 - DNA, 14 bp, Homo sapiens
tggaaaagaaatca

SEQ ID NO: 4712360 - DNA, 19 bp, Homo sapiens
tggaaaagaaatcaatttt

SEQ ID NO: 4712361 - DNA, 16 bp, Homo sapiens
tggaaacactgatttt

SEQ ID NO: 4712362 - DNA, 21 bp, Homo sapiens
tggaaagacttttccaaccct

SEQ ID NO: 4712363 - DNA, 17 bp, Homo sapiens
tggaaagcaaacaggaa

SEQ ID NO: 4712364 - DNA, 19 bp, Homo sapiens
tggaaccacattgaagaat

SEQ ID NO: 4712365 - DNA, 13 bp, Homo sapiens
tggaacctccttt

SEQ ID NO: 4712366 - DNA, 21 bp, Homo sapiens
tggaacctcctttctcttctc

SEQ ID NO: 4712367 - DNA, 13 bp, Homo sapiens
tggaactggaggc

SEQ ID NO: 4712368 - DNA, 16 bp, Homo sapiens
tggaactggaggcagg

SEQ ID NO: 4712369 - DNA, 11 bp, Homo sapiens
tggaagacaca

SEQ ID NO: 4712370 - DNA, 15 bp, Homo sapiens
tggaagacacattga

SEQ ID NO: 4712371 - DNA, 16 bp, Homo sapiens
tggaagcttggggaag

SEQ ID NO: 4712372 - DNA, 17 bp, Homo sapiens
tggaagggaagttcagg

SEQ ID NO: 4712373 - DNA, 14 bp, Homo sapiens
tggaagtagtggag

SEQ ID NO: 4712374 - DNA, 14 bp, Homo sapiens
tggaagtccctcag

SEQ ID NO: 4712375 - DNA, 17 bp, Homo sapiens
tggaagtgactttggct

SEQ ID NO: 4712376 - DNA, 22 bp, Homo sapiens
tggaataatcctaaacatatga

SEQ ID NO: 4712377 - DNA, 17 bp, Homo sapiens
tggaatcttcacctcag

SEQ ID NO: 4712378 - DNA, 23 bp, Homo sapiens
tggaatcttcacctcagagtgga

SEQ ID NO: 4712379 - DNA, 15 bp, Homo sapiens
tggaatgagaattta

SEQ ID NO: 4712380 - DNA, 17 bp, Homo sapiens
tggaatggaattggaca

SEQ ID NO: 4712381 - DNA, 15 bp, Homo sapiens
tggaatggatttttc

SEQ ID NO: 4712382 - DNA, 12 bp, Homo sapiens
tggaattttctg

SEQ ID NO: 4712383 - DNA, 16 bp, Homo sapiens
tggacaaggaggtctg

SEQ ID NO: 4712384 - DNA, 12 bp, Homo sapiens
tggacaggcatg

SEQ ID NO: 4712385 - DNA, 22 bp, Homo sapiens
tggacagtctttgatcatcatg

SEQ ID NO: 4712386 - DNA, 19 bp, Homo sapiens
tggacatcgatatgaaaaa

SEQ ID NO: 4712387 - DNA, 12 bp, Homo sapiens
tggacccctgca

SEQ ID NO: 4712388 - DNA, 20 bp, Homo sapiens
tggacccgttcatgggggag

SEQ ID NO: 4712389 - DNA, 21 bp, Homo sapiens
tggacccgttcatgggggagg

SEQ ID NO: 4712390 - DNA, 14 bp, Homo sapiens
tggaccctgaggcc

SEQ ID NO: 4712391 - DNA, 15 bp, Homo sapiens
tggaccctgaggccc

SEQ ID NO: 4712392 - DNA, 16 bp, Homo sapiens
tggaccctgaggccca

SEQ ID NO: 4712393 - DNA, 19 bp, Homo sapiens
tggaccctgaggcccagag

SEQ ID NO: 4712394 - DNA, 21 bp, Homo sapiens
tggaccctgaggcccagaggg

SEQ ID NO: 4712395 - DNA, 15 bp, Homo sapiens
tggacctctcttgtg

SEQ ID NO: 4712396 - DNA, 14 bp, Homo sapiens
tggacggtgctcca

SEQ ID NO: 4712397 - DNA, 16 bp, Homo sapiens
tggacggtgctccagg

SEQ ID NO: 4712398 - DNA, 19 bp, Homo sapiens
tggacggtgctccaggcag

SEQ ID NO: 4712399 - DNA, 19 bp, Homo sapiens
tggactaacttgtctttgg

SEQ ID NO: 4712400 - DNA, 20 bp, Homo sapiens
tggactaacttgtctttgga

SEQ ID NO: 4712401 - DNA, 20 bp, Homo sapiens
tggactctcagtctctgagc

SEQ ID NO: 4712402 - DNA, 20 bp, Homo sapiens
tttgtccattgtaaatctga

SEQ ID NO: 4712403 - DNA, 15 bp, Homo sapiens
tttgtgaatttgcaa

SEQ ID NO: 4712404 - DNA, 18 bp, Homo sapiens
tttgtgaggaagccgctg

SEQ ID NO: 4712405 - DNA, 23 bp, Homo sapiens
tttgtgatgaataaaataattat

SEQ ID NO: 4712406 - DNA, 14 bp, Homo sapiens
tttgtggagtactg

SEQ ID NO: 4712407 - DNA, 14 bp, Homo sapiens
tttgtgttgtacaa

SEQ ID NO: 4712408 - DNA, 15 bp, Homo sapiens
tttgttatttacact

SEQ ID NO: 4712409 - DNA, 17 bp, Homo sapiens
tttgttatttacactgg

SEQ ID NO: 4712410 - DNA, 15 bp, Homo sapiens
tttgttattttgcaa

SEQ ID NO: 4712411 - DNA, 15 bp, Homo sapiens
tttgttcccctcctc

SEQ ID NO: 4712412 - DNA, 16 bp, Homo sapiens
tttgttgtcatgtgta

SEQ ID NO: 4712413 - DNA, 16 bp, Homo sapiens
tttgtttctgaaaggg

SEQ ID NO: 4712414 - DNA, 13 bp, Homo sapiens
tttgtttgtgcat

SEQ ID NO: 4712415 - DNA, 23 bp, Homo sapiens
ttttaaaaacactacttttgctt

SEQ ID NO: 4712416 - DNA, 19 bp, Homo sapiens
ttttaaaaattgttattta

SEQ ID NO: 4712417 - DNA, 13 bp, Homo sapiens
ttttaaaacccag

SEQ ID NO: 4712418 - DNA, 19 bp, Homo sapiens
ttttaaaatgttggtgcaa

SEQ ID NO: 4712419 - DNA, 17 bp, Homo sapiens
ttttaaaggacaaacag

SEQ ID NO: 4712420 - DNA, 19 bp, Homo sapiens
ttttaaaggacaaacagtg

SEQ ID NO: 4712421 - DNA, 22 bp, Homo sapiens
ttttaaaggacaaacagtgaat

SEQ ID NO: 4712422 - DNA, 16 bp, Homo sapiens
ttttaactctggattt

SEQ ID NO: 4712423 - DNA, 19 bp, Homo sapiens
ttttaactctggattttga

SEQ ID NO: 4712424 - DNA, 23 bp, Homo sapiens
ttttaagaggaatttataacaaa

SEQ ID NO: 4712425 - DNA, 17 bp, Homo sapiens
ttttaagatttttctca

SEQ ID NO: 4712426 - DNA, 18 bp, Homo sapiens
ttttaagatttttctcaa

SEQ ID NO: 4712427 - DNA, 15 bp, Homo sapiens
ttttaagctctgagc

SEQ ID NO: 4712428 - DNA, 18 bp, Homo sapiens
ttttaaggctgtgtgaat

SEQ ID NO: 4712429 - DNA, 20 bp, Homo sapiens
ttttaattatttaaatgtac

SEQ ID NO: 4712430 - DNA, 22 bp, Homo sapiens
ttttaattgttcattgctagta

SEQ ID NO: 4712431 - DNA, 17 bp, Homo sapiens
ttttaatttacaaaaat

SEQ ID NO: 4712432 - DNA, 13 bp, Homo sapiens
ttttaatttgtat

SEQ ID NO: 4712433 - DNA, 22 bp, Homo sapiens
ttttaattttgtcagattcaca

SEQ ID NO: 4712434 - DNA, 17 bp, Homo sapiens
ttttaccatatgtttat

SEQ ID NO: 4712435 - DNA, 15 bp, Homo sapiens
ttttaccattagcat

SEQ ID NO: 4712436 - DNA, 17 bp, Homo sapiens
ttttacgtagtaaaagt

SEQ ID NO: 4712437 - DNA, 12 bp, Homo sapiens
ttttagaataca

SEQ ID NO: 4712438 - DNA, 16 bp, Homo sapiens
ttttataaaaaatggt

SEQ ID NO: 4712439 - DNA, 22 bp, Homo sapiens
ttttatagatgggcaactggct

SEQ ID NO: 4712440 - DNA, 21 bp, Homo sapiens
ttttatggttccaatgaaata

SEQ ID NO: 4712441 - DNA, 18 bp, Homo sapiens
ttttattaaacattttca

SEQ ID NO: 4712442 - DNA, 14 bp, Homo sapiens
ttttatttatatct

SEQ ID NO: 4712443 - DNA, 15 bp, Homo sapiens
ttttatttatatctt

SEQ ID NO: 4712444 - DNA, 16 bp, Homo sapiens
ttttattttgtaatta

SEQ ID NO: 4712445 - DNA, 14 bp, Homo sapiens
ttttcacaaataaa

SEQ ID NO: 4712446 - DNA, 12 bp, Homo sapiens
ttttcacatttt

SEQ ID NO: 4712447 - DNA, 21 bp, Homo sapiens
ttttcagatataaaagactga

SEQ ID NO: 4712448 - DNA, 12 bp, Homo sapiens
ttttcagcttct

SEQ ID NO: 4712449 - DNA, 20 bp, Homo sapiens
ttttcagcttctgctgggct

SEQ ID NO: 4712450 - DNA, 14 bp, Homo sapiens
ttttcagtttaatt

SEQ ID NO: 4712451 - DNA, 14 bp, Homo sapiens
ttttcagttttcag

SEQ ID NO: 4712452 - DNA, 14 bp, Homo sapiens
ttttccaatcacag

SEQ ID NO: 4712453 - DNA, 19 bp, Homo sapiens
ttttccaatcacagtgtta

SEQ ID NO: 4712454 - DNA, 20 bp, Homo sapiens
ttttccagctggatgagaat

SEQ ID NO: 4712455 - DNA, 16 bp, Homo sapiens
ttttccataagctatt

SEQ ID NO: 4712456 - DNA, 13 bp, Homo sapiens
ttttcccactgca

SEQ ID NO: 4712457 - DNA, 22 bp, Homo sapiens
ttttcccactgcaccccctcct

SEQ ID NO: 4712458 - DNA, 15 bp, Homo sapiens
ttttcctcattttga

SEQ ID NO: 4712459 - DNA, 20 bp, Homo sapiens
ttttcctcattttgaattat

SEQ ID NO: 4712460 - DNA, 13 bp, Homo sapiens
ttttcctgtgaca

SEQ ID NO: 4712461 - DNA, 14 bp, Homo sapiens
ttttctaaagactt

SEQ ID NO: 4712462 - DNA, 18 bp, Homo sapiens
ttttctattaaaagactc

SEQ ID NO: 4712463 - DNA, 19 bp, Homo sapiens
ttttctattaaaagactca

SEQ ID NO: 4712464 - DNA, 20 bp, Homo sapiens
ttttctattaaaagactcat

SEQ ID NO: 4712465 - DNA, 18 bp, Homo sapiens
ttttctcagtgtgccctt

SEQ ID NO: 4712466 - DNA, 14 bp, Homo sapiens
ttttctctgtgtgg

SEQ ID NO: 4712467 - DNA, 20 bp, Homo sapiens
ttttctctgtgtggttcagc

SEQ ID NO: 4712468 - DNA, 22 bp, Homo sapiens
ttttctgcccaactttcattgg

SEQ ID NO: 4712469 - DNA, 18 bp, Homo sapiens
ttttctggaatggaattg

SEQ ID NO: 4712470 - DNA, 20 bp, Homo sapiens
ttttctggaatggaattgga

SEQ ID NO: 4712471 - DNA, 13 bp, Homo sapiens
ttttctgtgttta

SEQ ID NO: 4712472 - DNA, 23 bp, Homo sapiens
ttttctgtgtttagctatttaat

SEQ ID NO: 4712473 - DNA, 13 bp, Homo sapiens
ttttcttaggttt

SEQ ID NO: 4712474 - DNA, 18 bp, Homo sapiens
ttttcttgcctctgtccc

SEQ ID NO: 4712475 - DNA, 14 bp, Homo sapiens
ttttcttgtatgat

SEQ ID NO: 4712476 - DNA, 14 bp, Homo sapiens
ttttgaagaacaaa

SEQ ID NO: 4712477 - DNA, 21 bp, Homo sapiens
ttttgaattagattatttctg

SEQ ID NO: 4712478 - DNA, 17 bp, Homo sapiens
ttttgagttttcttata

SEQ ID NO: 4712479 - DNA, 17 bp, Homo sapiens
ttttgatccaagctggt

SEQ ID NO: 4712480 - DNA, 15 bp, Homo sapiens
ttttgattttgctga

SEQ ID NO: 4712481 - DNA, 21 bp, Homo sapiens
ttttgcaacctcgctggactc

SEQ ID NO: 4712482 - DNA, 21 bp, Homo sapiens
ttttgcactgaggatattcag

SEQ ID NO: 4712483 - DNA, 12 bp, Homo sapiens
ttttgcagcttt

SEQ ID NO: 4712484 - DNA, 20 bp, Homo sapiens
ttttgccactgcctttcaga

SEQ ID NO: 4712485 - DNA, 23 bp, Homo sapiens
ttttgccatgttggccaggctgg

SEQ ID NO: 4712486 - DNA, 23 bp, Homo sapiens
ttttggcaatgactcaaagtctg

SEQ ID NO: 4712487 - DNA, 16 bp, Homo sapiens
ttttggttttgttccc

SEQ ID NO: 4712488 - DNA, 17 bp, Homo sapiens
ttttgtattctctgagc

SEQ ID NO: 4712489 - DNA, 22 bp, Homo sapiens
ttttgtcacctcaatatttact

SEQ ID NO: 4712490 - DNA, 13 bp, Homo sapiens
ttttgtcttgtgt

SEQ ID NO: 4712491 - DNA, 14 bp, Homo sapiens
ttttgtgaagactg

SEQ ID NO: 4712492 - DNA, 14 bp, Homo sapiens
ttttgttcccctcc

SEQ ID NO: 4712493 - DNA, 12 bp, Homo sapiens
ttttgttctgta

SEQ ID NO: 4712494 - DNA, 19 bp, Homo sapiens
ttttgtttcatattgatgt

SEQ ID NO: 4712495 - DNA, 17 bp, Homo sapiens
tttttaaaatatctttt

SEQ ID NO: 4712496 - DNA, 12 bp, Homo sapiens
tttttaaagaaa

SEQ ID NO: 4712497 - DNA, 14 bp, Homo sapiens
tttttaagctctga

SEQ ID NO: 4712498 - DNA, 18 bp, Homo sapiens
tttttaagttacacattt

SEQ ID NO: 4712499 - DNA, 15 bp, Homo sapiens
tttttaattatttaa

SEQ ID NO: 4712500 - DNA, 18 bp, Homo sapiens
tttttaattgttgtttct

SEQ ID NO: 4712501 - DNA, 21 bp, Homo sapiens
tttttagtggaagcttctaaa

SEQ ID NO: 4712502 - DNA, 19 bp, Homo sapiens
tttttatttgtttgtgcat

SEQ ID NO: 4712503 - DNA, 23 bp, Homo sapiens
tttttcagcacatgttaccatgt

SEQ ID NO: 4712504 - DNA, 15 bp, Homo sapiens
tttttcagttttcag

SEQ ID NO: 4712505 - DNA, 22 bp, Homo sapiens
tttttccttgtccccacactcc

SEQ ID NO: 4712506 - DNA, 21 bp, Homo sapiens
tttttctaccataagtgacac

SEQ ID NO: 4712507 - DNA, 16 bp, Homo sapiens
tttttctcaaagtttt

SEQ ID NO: 4712508 - DNA, 19 bp, Homo sapiens
tttttctcatgaatctgca

SEQ ID NO: 4712509 - DNA, 14 bp, Homo sapiens
tttttcttaggttt

SEQ ID NO: 4712510 - DNA, 18 bp, Homo sapiens
tttttgaactttgtagga

SEQ ID NO: 4712511 - DNA, 22 bp, Homo sapiens
tttttggaggggtttatgctca

SEQ ID NO: 4712512 - DNA, 11 bp, Homo sapiens
tttttgtactt

SEQ ID NO: 4712513 - DNA, 13 bp, Homo sapiens
ttgtgtggattct

SEQ ID NO: 4712514 - DNA, 15 bp, Homo sapiens
ttgtgtgtgtttcta

SEQ ID NO: 4712515 - DNA, 13 bp, Homo sapiens
ttgtgttcacctt

SEQ ID NO: 4712516 - DNA, 15 bp, Homo sapiens
ttgttaaaaatgtca

SEQ ID NO: 4712517 - DNA, 21 bp, Homo sapiens
ttgttaataaaagtacatgtt

SEQ ID NO: 4712518 - DNA, 16 bp, Homo sapiens
ttgttaattttcctca

SEQ ID NO: 4712519 - DNA, 19 bp, Homo sapiens
ttgttaccttttacagaat

SEQ ID NO: 4712520 - DNA, 19 bp, Homo sapiens
ttgttaggaaaaaattgaa

SEQ ID NO: 4712521 - DNA, 18 bp, Homo sapiens
ttgttatattacttgcct

SEQ ID NO: 4712522 - DNA, 16 bp, Homo sapiens
ttgttatgtctagaaa

SEQ ID NO: 4712523 - DNA, 23 bp, Homo sapiens
ttgttatgtctagaaagtaagaa

SEQ ID NO: 4712524 - DNA, 17 bp, Homo sapiens
ttgttattcttttccag

SEQ ID NO: 4712525 - DNA, 17 bp, Homo sapiens
ttgttatttacactggt

SEQ ID NO: 4712526 - DNA, 15 bp, Homo sapiens
ttgttatttattgaa

SEQ ID NO: 4712527 - DNA, 15 bp, Homo sapiens
ttgttccaaatgtgt

SEQ ID NO: 4712528 - DNA, 20 bp, Homo sapiens
ttgttcccctcctccactct

SEQ ID NO: 4712529 - DNA, 23 bp, Homo sapiens
ttgttcccctcctccactctccc

SEQ ID NO: 4712530 - DNA, 19 bp, Homo sapiens
ttgttctggctcttccagg

SEQ ID NO: 4712531 - DNA, 12 bp, Homo sapiens
ttgttctgtatt

SEQ ID NO: 4712532 - DNA, 23 bp, Homo sapiens
ttgttctgtattcgaaatgagct

SEQ ID NO: 4712533 - DNA, 12 bp, Homo sapiens
ttgtttaatggt

SEQ ID NO: 4712534 - DNA, 23 bp, Homo sapiens
ttgtttaatggtagttttacagt

SEQ ID NO: 4712535 - DNA, 16 bp, Homo sapiens
ttgtttataataaaaa

SEQ ID NO: 4712536 - DNA, 12 bp, Homo sapiens
ttgtttattcca

SEQ ID NO: 4712537 - DNA, 11 bp, Homo sapiens
ttgttttctct

SEQ ID NO: 4712538 - DNA, 22 bp, Homo sapiens
ttgttttctctgtgtggttcag

SEQ ID NO: 4712539 - DNA, 19 bp, Homo sapiens
ttgttttggcgataggtct

SEQ ID NO: 4712540 - DNA, 18 bp, Homo sapiens
ttgtttttgagttttctt

SEQ ID NO: 4712541 - DNA, 19 bp, Homo sapiens
tttaaaaaaaactatttaa

SEQ ID NO: 4712542 - DNA, 12 bp, Homo sapiens
tttaaaagacaa

SEQ ID NO: 4712543 - DNA, 17 bp, Homo sapiens
tttaaaagttttgttct

SEQ ID NO: 4712544 - DNA, 17 bp, Homo sapiens
tttaaaatgttggtgca

SEQ ID NO: 4712545 - DNA, 13 bp, Homo sapiens
tttaaagaaaagt

SEQ ID NO: 4712546 - DNA, 15 bp, Homo sapiens
tttaaagaatttctt

SEQ ID NO: 4712547 - DNA, 18 bp, Homo sapiens
tttaaagcaattgcataa

SEQ ID NO: 4712548 - DNA, 17 bp, Homo sapiens
tttaaaggacaaacagt

SEQ ID NO: 4712549 - DNA, 19 bp, Homo sapiens
tttaaaggacaaacagtga

SEQ ID NO: 4712550 - DNA, 21 bp, Homo sapiens
tttaaaggacaaacagtgaat

SEQ ID NO: 4712551 - DNA, 20 bp, Homo sapiens
tttaaatacagtcttccatt

SEQ ID NO: 4712552 - DNA, 11 bp, Homo sapiens
tttaaattgtg

SEQ ID NO: 4712553 - DNA, 12 bp, Homo sapiens
tttaaattgtgt

SEQ ID NO: 4712554 - DNA, 23 bp, Homo sapiens
tttaacattcttttgtttatatt

SEQ ID NO: 4712555 - DNA, 22 bp, Homo sapiens
tttaaccaagttgtttattcca

SEQ ID NO: 4712556 - DNA, 20 bp, Homo sapiens
tttaaccataaatcaattca

SEQ ID NO: 4712557 - DNA, 18 bp, Homo sapiens
tttaactctgtaagaaac

SEQ ID NO: 4712558 - DNA, 12 bp, Homo sapiens
tttaactgccgt

SEQ ID NO: 4712559 - DNA, 21 bp, Homo sapiens
tttaactgccgtaatttaact

SEQ ID NO: 4712560 - DNA, 17 bp, Homo sapiens
tttaactgcctttttgt

SEQ ID NO: 4712561 - DNA, 13 bp, Homo sapiens
tttaactgtggat

SEQ ID NO: 4712562 - DNA, 17 bp, Homo sapiens
tttaactgtggatattg

SEQ ID NO: 4712563 - DNA, 14 bp, Homo sapiens
tttaagaaatagaa

SEQ ID NO: 4712564 - DNA, 18 bp, Homo sapiens
tttaagaggaatttataa

SEQ ID NO: 4712565 - DNA, 14 bp, Homo sapiens
tttaagaggcaggg

SEQ ID NO: 4712566 - DNA, 12 bp, Homo sapiens
tttaagattttt

SEQ ID NO: 4712567 - DNA, 21 bp, Homo sapiens
tttaagcatcacattaaagtt

SEQ ID NO: 4712568 - DNA, 22 bp, Homo sapiens
tttaagccttataaaccaatct

SEQ ID NO: 4712569 - DNA, 20 bp, Homo sapiens
tttaaggctgtgtgaatttt

SEQ ID NO: 4712570 - DNA, 23 bp, Homo sapiens
tttaagttcactttttttgttct

SEQ ID NO: 4712571 - DNA, 12 bp, Homo sapiens
tttaataacatt

SEQ ID NO: 4712572 - DNA, 22 bp, Homo sapiens
tttaatagcgtcataactagaa

SEQ ID NO: 4712573 - DNA, 17 bp, Homo sapiens
tttaatatttattgaat

SEQ ID NO: 4712574 - DNA, 13 bp, Homo sapiens
tttaatccatttt

SEQ ID NO: 4712575 - DNA, 15 bp, Homo sapiens
tttaatccattttta

SEQ ID NO: 4712576 - DNA, 18 bp, Homo sapiens
tttaatcctgtaccaaat

SEQ ID NO: 4712577 - DNA, 22 bp, Homo sapiens
tttaatcctgtaccaaatctga

SEQ ID NO: 4712578 - DNA, 13 bp, Homo sapiens
tttaattaaataa

SEQ ID NO: 4712579 - DNA, 13 bp, Homo sapiens
tttaattatttaa

SEQ ID NO: 4712580 - DNA, 14 bp, Homo sapiens
tttaattatttaaa

SEQ ID NO: 4712581 - DNA, 22 bp, Homo sapiens
tttaattatttaaatgtactta

SEQ ID NO: 4712582 - DNA, 18 bp, Homo sapiens
tttaattctttctatttt

SEQ ID NO: 4712583 - DNA, 24 bp, Homo sapiens
tttaattgttgtttctttctagtg

SEQ ID NO: 4712584 - DNA, 17 bp, Homo sapiens
tttaattttttaaataa

SEQ ID NO: 4712585 - DNA, 16 bp, Homo sapiens
tttacaaaaatataaa

SEQ ID NO: 4712586 - DNA, 14 bp, Homo sapiens
tttacactggtcta

SEQ ID NO: 4712587 - DNA, 17 bp, Homo sapiens
tttacagtgtttctggc

SEQ ID NO: 4712588 - DNA, 21 bp, Homo sapiens
tttactcaaccctctcaggtg

SEQ ID NO: 4712589 - DNA, 13 bp, Homo sapiens
tttactgcttttc

SEQ ID NO: 4712590 - DNA, 15 bp, Homo sapiens
tttactttgtgttca

SEQ ID NO: 4712591 - DNA, 14 bp, Homo sapiens
tttagaagcctgca

SEQ ID NO: 4712592 - DNA, 13 bp, Homo sapiens
tttagactttaaa

SEQ ID NO: 4712593 - DNA, 18 bp, Homo sapiens
tttagatgaatgtcagtt

SEQ ID NO: 4712594 - DNA, 15 bp, Homo sapiens
tttagcaatgctgtg

SEQ ID NO: 4712595 - DNA, 11 bp, Homo sapiens
tttaggagaag

SEQ ID NO: 4712596 - DNA, 15 bp, Homo sapiens
tttagtcctgtactg

SEQ ID NO: 4712597 - DNA, 22 bp, Homo sapiens
tttagtgcaaagtataaaatta

SEQ ID NO: 4712598 - DNA, 13 bp, Homo sapiens
tttagtggcttca

SEQ ID NO: 4712599 - DNA, 18 bp, Homo sapiens
tttagttgctcaaagagc

SEQ ID NO: 4712600 - DNA, 17 bp, Homo sapiens
tttataaactgagaggt

SEQ ID NO: 4712601 - DNA, 14 bp, Homo sapiens
tttataataaaaat

SEQ ID NO: 4712602 - DNA, 21 bp, Homo sapiens
tttatacacttggatttcatt

SEQ ID NO: 4712603 - DNA, 17 bp, Homo sapiens
tttatagttaataatct

SEQ ID NO: 4712604 - DNA, 14 bp, Homo sapiens
tttatccttccttt

SEQ ID NO: 4712605 - DNA, 18 bp, Homo sapiens
tttatctttgattctcct

SEQ ID NO: 4712606 - DNA, 18 bp, Homo sapiens
tttatgatttaataaaat

SEQ ID NO: 4712607 - DNA, 15 bp, Homo sapiens
tttatgatttcaaca

SEQ ID NO: 4712608 - DNA, 16 bp, Homo sapiens
tttatgatttcaacat

SEQ ID NO: 4712609 - DNA, 16 bp, Homo sapiens
tttatgctcaatccat

SEQ ID NO: 4712610 - DNA, 18 bp, Homo sapiens
tttattaaaatatttcag

SEQ ID NO: 4712611 - DNA, 17 bp, Homo sapiens
tttattaaacattttca

SEQ ID NO: 4712612 - DNA, 19 bp, Homo sapiens
tttattaaatgcccagccc

SEQ ID NO: 4712613 - DNA, 15 bp, Homo sapiens
tttattaatttgaaa

SEQ ID NO: 4712614 - DNA, 14 bp, Homo sapiens
tttattcagaactt

SEQ ID NO: 4712615 - DNA, 15 bp, Homo sapiens
tttattcagaacttt

SEQ ID NO: 4712616 - DNA, 17 bp, Homo sapiens
tttattttataaattta

SEQ ID NO: 4712617 - DNA, 23 bp, Homo sapiens
tttcaaaaatgctgttaatgtat

SEQ ID NO: 4712618 - DNA, 17 bp, Homo sapiens
tttcaaaaggtaatggt

SEQ ID NO: 4712619 - DNA, 16 bp, Homo sapiens
tttcaacatggataca

SEQ ID NO: 4712620 - DNA, 15 bp, Homo sapiens
tttcaagatccaaat

SEQ ID NO: 4712621 - DNA, 21 bp, Homo sapiens
tttcaatggtttgcaaggaag

SEQ ID NO: 4712622 - DNA, 14 bp, Homo sapiens
tttcaatttccaag

SEQ ID NO: 4712623 - DNA, 12 bp, Homo sapiens
tttcacaaataa

SEQ ID NO: 4712624 - DNA, 16 bp, Homo sapiens
tttcacagatgctgtg

SEQ ID NO: 4712625 - DNA, 16 bp, Homo sapiens
ttgccccaacccccag

SEQ ID NO: 4712626 - DNA, 17 bp, Homo sapiens
ttgccccaacccccagc

SEQ ID NO: 4712627 - DNA, 12 bp, Homo sapiens
ttgccctcccat

SEQ ID NO: 4712628 - DNA, 13 bp, Homo sapiens
ttgccctttccat

SEQ ID NO: 4712629 - DNA, 13 bp, Homo sapiens
ttgcctaccattt

SEQ ID NO: 4712630 - DNA, 17 bp, Homo sapiens
ttgcctatctgacttca

SEQ ID NO: 4712631 - DNA, 14 bp, Homo sapiens
ttgcctcggctcct

SEQ ID NO: 4712632 - DNA, 15 bp, Homo sapiens
ttgcctcggctcctg

SEQ ID NO: 4712633 - DNA, 16 bp, Homo sapiens
ttgcctcggctcctgc

SEQ ID NO: 4712634 - DNA, 14 bp, Homo sapiens
ttgcctctgcctct

SEQ ID NO: 4712635 - DNA, 17 bp, Homo sapiens
ttgcctctgtccccttc

SEQ ID NO: 4712636 - DNA, 18 bp, Homo sapiens
ttgctaaaatattttaga

SEQ ID NO: 4712637 - DNA, 22 bp, Homo sapiens
ttgctaaaatattttagatgtt

SEQ ID NO: 4712638 - DNA, 12 bp, Homo sapiens
ttgctccagcct

SEQ ID NO: 4712639 - DNA, 14 bp, Homo sapiens
ttgctccagcctga

SEQ ID NO: 4712640 - DNA, 14 bp, Homo sapiens
ttgctgactttaaa

SEQ ID NO: 4712641 - DNA, 11 bp, Homo sapiens
ttgctgagcct

SEQ ID NO: 4712642 - DNA, 12 bp, Homo sapiens
ttgctgcctcat

SEQ ID NO: 4712643 - DNA, 15 bp, Homo sapiens
ttgctgcctcatgct

SEQ ID NO: 4712644 - DNA, 15 bp, Homo sapiens
ttgctggctgtgaaa

SEQ ID NO: 4712645 - DNA, 13 bp, Homo sapiens
ttgctgtacaaaa

SEQ ID NO: 4712646 - DNA, 20 bp, Homo sapiens
ttgctgtgaattagctcact

SEQ ID NO: 4712647 - DNA, 23 bp, Homo sapiens
ttgcttctggctttgttcttgtc

SEQ ID NO: 4712648 - DNA, 13 bp, Homo sapiens
ttggaactggagg

SEQ ID NO: 4712649 - DNA, 14 bp, Homo sapiens
ttggaactggaggc

SEQ ID NO: 4712650 - DNA, 22 bp, Homo sapiens
ttggaagctagctcccctcctc

SEQ ID NO: 4712651 - DNA, 23 bp, Homo sapiens
ttggaatattgtccattgtccaa

SEQ ID NO: 4712652 - DNA, 16 bp, Homo sapiens
ttggacattttatgtc

SEQ ID NO: 4712653 - DNA, 18 bp, Homo sapiens
ttggacattttatgtctt

SEQ ID NO: 4712654 - DNA, 14 bp, Homo sapiens
ttggacccttccat

SEQ ID NO: 4712655 - DNA, 11 bp, Homo sapiens
ttggagacaga

SEQ ID NO: 4712656 - DNA, 14 bp, Homo sapiens
ttggagatcaagga

SEQ ID NO: 4712657 - DNA, 19 bp, Homo sapiens
ttggaggggtttatgctca

SEQ ID NO: 4712658 - DNA, 19 bp, Homo sapiens
ttggagtttgcattcttat

SEQ ID NO: 4712659 - DNA, 23 bp, Homo sapiens
ttggataatattcattggttaac

SEQ ID NO: 4712660 - DNA, 17 bp, Homo sapiens
ttggatctgcttgctgt

SEQ ID NO: 4712661 - DNA, 14 bp, Homo sapiens
ttggattatttaat

SEQ ID NO: 4712662 - DNA, 20 bp, Homo sapiens
ttggattatttaataacatt

SEQ ID NO: 4712663 - DNA, 21 bp, Homo sapiens
ttggcaatgactcaaagtctg

SEQ ID NO: 4712664 - DNA, 15 bp, Homo sapiens
ttggcatcagctggc

SEQ ID NO: 4712665 - DNA, 16 bp, Homo sapiens
ttggccatctctggat

SEQ ID NO: 4712666 - DNA, 16 bp, Homo sapiens
ttggctgctgaaggct

SEQ ID NO: 4712667 - DNA, 18 bp, Homo sapiens
ttggctgggggcctcagt

SEQ ID NO: 4712668 - DNA, 19 bp, Homo sapiens
ttgggaagctatttccttt

SEQ ID NO: 4712669 - DNA, 13 bp, Homo sapiens
ttgggattaatat

SEQ ID NO: 4712670 - DNA, 18 bp, Homo sapiens
ttgggccatactggcctc

SEQ ID NO: 4712671 - DNA, 23 bp, Homo sapiens
ttgggccatactggcctcgcctg

SEQ ID NO: 4712672 - DNA, 14 bp, Homo sapiens
ttgggctgtgcctg

SEQ ID NO: 4712673 - DNA, 14 bp, Homo sapiens
ttggggaagaccca

SEQ ID NO: 4712674 - DNA, 20 bp, Homo sapiens
ttggggacctgatggagagt

SEQ ID NO: 4712675 - DNA, 16 bp, Homo sapiens
ttgggtggtttttatt

SEQ ID NO: 4712676 - DNA, 22 bp, Homo sapiens
ttgggttcaagcgattcttctg

SEQ ID NO: 4712677 - DNA, 16 bp, Homo sapiens
ttggtcagaatgcagt

SEQ ID NO: 4712678 - DNA, 20 bp, Homo sapiens
ttggtctgacccactgcttt

SEQ ID NO: 4712679 - DNA, 13 bp, Homo sapiens
ttggtctgtgtga

SEQ ID NO: 4712680 - DNA, 21 bp, Homo sapiens
ttggttatgatggaaaggaag

SEQ ID NO: 4712681 - DNA, 14 bp, Homo sapiens
ttggttctgtgaac

SEQ ID NO: 4712682 - DNA, 16 bp, Homo sapiens
ttggttcttctctttt

SEQ ID NO: 4712683 - DNA, 15 bp, Homo sapiens
ttggttggctggcct

SEQ ID NO: 4712684 - DNA, 20 bp, Homo sapiens
ttgtaaaaaaaaatgccttt

SEQ ID NO: 4712685 - DNA, 21 bp, Homo sapiens
ttgtaaaaaaaaatgcctttg

SEQ ID NO: 4712686 - DNA, 15 bp, Homo sapiens
ttgtaaattaatctt

SEQ ID NO: 4712687 - DNA, 22 bp, Homo sapiens
ttgtaactgtttagatgaatgt

SEQ ID NO: 4712688 - DNA, 15 bp, Homo sapiens
ttgtaagagtgtaga

SEQ ID NO: 4712689 - DNA, 17 bp, Homo sapiens
ttgtaagagtgtagaag

SEQ ID NO: 4712690 - DNA, 22 bp, Homo sapiens
ttgtaagagtgtagaagcattc

SEQ ID NO: 4712691 - DNA, 18 bp, Homo sapiens
ttgtaagctcctcactgg

SEQ ID NO: 4712692 - DNA, 16 bp, Homo sapiens
ttgtaagtttcaggtg

SEQ ID NO: 4712693 - DNA, 17 bp, Homo sapiens
ttgtaagtttcaggtga

SEQ ID NO: 4712694 - DNA, 14 bp, Homo sapiens
ttgtaattattgtg

SEQ ID NO: 4712695 - DNA, 19 bp, Homo sapiens
ttgtacacaccttatattt

SEQ ID NO: 4712696 - DNA, 20 bp, Homo sapiens
ttgtacatttatgatttaat

SEQ ID NO: 4712697 - DNA, 13 bp, Homo sapiens
ttgtacctggtga

SEQ ID NO: 4712698 - DNA, 14 bp, Homo sapiens
ttgtagagccaggg

SEQ ID NO: 4712699 - DNA, 22 bp, Homo sapiens
ttgtatagcatgaaataaaata

SEQ ID NO: 4712700 - DNA, 14 bp, Homo sapiens
ttgtatatgaaaac

SEQ ID NO: 4712701 - DNA, 18 bp, Homo sapiens
ttgtatgctaaatgagga

SEQ ID NO: 4712702 - DNA, 20 bp, Homo sapiens
ttgtattctctgagctgtgc

SEQ ID NO: 4712703 - DNA, 23 bp, Homo sapiens
ttgtatttaaatgaaagtgagac

SEQ ID NO: 4712704 - DNA, 14 bp, Homo sapiens
ttgtatttatgtat

SEQ ID NO: 4712705 - DNA, 18 bp, Homo sapiens
ttgtatttattaatttga

SEQ ID NO: 4712706 - DNA, 17 bp, Homo sapiens
ttgtcaaaaagcaactg

SEQ ID NO: 4712707 - DNA, 17 bp, Homo sapiens
ttgtcaatggaagaaac

SEQ ID NO: 4712708 - DNA, 18 bp, Homo sapiens
ttgtcacacactttggct

SEQ ID NO: 4712709 - DNA, 13 bp, Homo sapiens
ttgtccattgtcc

SEQ ID NO: 4712710 - DNA, 11 bp, Homo sapiens
ttgtccccaca

SEQ ID NO: 4712711 - DNA, 16 bp, Homo sapiens
ttgtccccgacccttg

SEQ ID NO: 4712712 - DNA, 20 bp, Homo sapiens
ttgtctatgggactcaatgc

SEQ ID NO: 4712713 - DNA, 12 bp, Homo sapiens
ttgtctccctgg

SEQ ID NO: 4712714 - DNA, 14 bp, Homo sapiens
ttgtctccctggcc

SEQ ID NO: 4712715 - DNA, 16 bp, Homo sapiens
ttgtctccctggccct

SEQ ID NO: 4712716 - DNA, 17 bp, Homo sapiens
ttgtctccctggccctc

SEQ ID NO: 4712717 - DNA, 22 bp, Homo sapiens
ttgtctcctaaattgttgtaat

SEQ ID NO: 4712718 - DNA, 16 bp, Homo sapiens
ttgtcttctccccagg

SEQ ID NO: 4712719 - DNA, 15 bp, Homo sapiens
ttgtctttctttgct

SEQ ID NO: 4712720 - DNA, 20 bp, Homo sapiens
ttgtctttggaccctgaggc

SEQ ID NO: 4712721 - DNA, 24 bp, Homo sapiens
ttgtctttggaccctgaggcccag

SEQ ID NO: 4712722 - DNA, 11 bp, Homo sapiens
ttgtgaagaat

SEQ ID NO: 4712723 - DNA, 18 bp, Homo sapiens
ttgtgaagactgggaagt

SEQ ID NO: 4712724 - DNA, 15 bp, Homo sapiens
ttgtgaatggattgg

SEQ ID NO: 4712725 - DNA, 13 bp, Homo sapiens
ttgtgaggaagcc

SEQ ID NO: 4712726 - DNA, 17 bp, Homo sapiens
ttgtgaggaagccgctg

SEQ ID NO: 4712727 - DNA, 21 bp, Homo sapiens
ttgtgaggaagccgctggggc

SEQ ID NO: 4712728 - DNA, 20 bp, Homo sapiens
ttgtgatattgaccatgtga

SEQ ID NO: 4712729 - DNA, 18 bp, Homo sapiens
ttgtgcaaaagcaggctt

SEQ ID NO: 4712730 - DNA, 23 bp, Homo sapiens
ttgtgcagctgacttttctgacc

SEQ ID NO: 4712731 - DNA, 18 bp, Homo sapiens
ttgtgcctaatgtgtttg

SEQ ID NO: 4712732 - DNA, 20 bp, Homo sapiens
ttgtgctgggagcaggactg

SEQ ID NO: 4712733 - DNA, 16 bp, Homo sapiens
ttgtggacacagctct

SEQ ID NO: 4712734 - DNA, 19 bp, Homo sapiens
ttgtggcacagatgcccac

SEQ ID NO: 4712735 - DNA, 21 bp, Homo sapiens
ttgtgtacactttcattactt

SEQ ID NO: 4712736 - DNA, 22 bp, Homo sapiens
ttgtgtatggatatgtgtaaat

SEQ ID NO: 4712737 - DNA, 20 bp, Homo sapiens
ttcttctgcttcagcctccc

SEQ ID NO: 4712738 - DNA, 14 bp, Homo sapiens
ttcttgcttctggc

SEQ ID NO: 4712739 - DNA, 15 bp, Homo sapiens
ttcttggtgcattcg

SEQ ID NO: 4712740 - DNA, 22 bp, Homo sapiens
ttcttggttgaggaaacaaaca

SEQ ID NO: 4712741 - DNA, 17 bp, Homo sapiens
ttcttttccagaaagaa

SEQ ID NO: 4712742 - DNA, 18 bp, Homo sapiens
ttgaaaaattatcagtta

SEQ ID NO: 4712743 - DNA, 22 bp, Homo sapiens
ttgaaaacactgttctctgccc

SEQ ID NO: 4712744 - DNA, 12 bp, Homo sapiens
ttgaaaagctat

SEQ ID NO: 4712745 - DNA, 22 bp, Homo sapiens
ttgaaaagctattagccaggat

SEQ ID NO: 4712746 - DNA, 15 bp, Homo sapiens
ttgaaaccaggacat

SEQ ID NO: 4712747 - DNA, 16 bp, Homo sapiens
ttgaaaccaggacatt

SEQ ID NO: 4712748 - DNA, 15 bp, Homo sapiens
ttgaaatattaaaat

SEQ ID NO: 4712749 - DNA, 18 bp, Homo sapiens
ttgaaattaacctctcac

SEQ ID NO: 4712750 - DNA, 15 bp, Homo sapiens
ttgaacatgtggctt

SEQ ID NO: 4712751 - DNA, 22 bp, Homo sapiens
ttgaactccatgggattttatc

SEQ ID NO: 4712752 - DNA, 17 bp, Homo sapiens
ttgaactcctgacctca

SEQ ID NO: 4712753 - DNA, 13 bp, Homo sapiens
ttgaactttgtag

SEQ ID NO: 4712754 - DNA, 15 bp, Homo sapiens
ttgaactttgtagga

SEQ ID NO: 4712755 - DNA, 18 bp, Homo sapiens
ttgaagaacaaaaggctt

SEQ ID NO: 4712756 - DNA, 22 bp, Homo sapiens
ttgaagattctatgttaatatt

SEQ ID NO: 4712757 - DNA, 15 bp, Homo sapiens
ttgaaggtagaatgt

SEQ ID NO: 4712758 - DNA, 16 bp, Homo sapiens
ttgaaggtagaatgtt

SEQ ID NO: 4712759 - DNA, 13 bp, Homo sapiens
ttgaagttctaac

SEQ ID NO: 4712760 - DNA, 22 bp, Homo sapiens
ttgaatattggtaattaaaaga

SEQ ID NO: 4712761 - DNA, 16 bp, Homo sapiens
ttgaatgtgatcatct

SEQ ID NO: 4712762 - DNA, 23 bp, Homo sapiens
ttgaattagattatttctgtatt

SEQ ID NO: 4712763 - DNA, 14 bp, Homo sapiens
ttgaattatgtgca

SEQ ID NO: 4712764 - DNA, 18 bp, Homo sapiens
ttgaattattttgttact

SEQ ID NO: 4712765 - DNA, 17 bp, Homo sapiens
ttgaattttcccactgc

SEQ ID NO: 4712766 - DNA, 18 bp, Homo sapiens
ttgacaaaggcaagcact

SEQ ID NO: 4712767 - DNA, 16 bp, Homo sapiens
ttgacacacagaaatg

SEQ ID NO: 4712768 - DNA, 19 bp, Homo sapiens
ttgacacacagaaatgtgt

SEQ ID NO: 4712769 - DNA, 24 bp, Homo sapiens
ttgaccattctccacctgccaggg

SEQ ID NO: 4712770 - DNA, 15 bp, Homo sapiens
ttgacctcaggtgat

SEQ ID NO: 4712771 - DNA, 21 bp, Homo sapiens
ttgacctcaggtgatccaccc

SEQ ID NO: 4712772 - DNA, 12 bp, Homo sapiens
ttgacctgaggc

SEQ ID NO: 4712773 - DNA, 19 bp, Homo sapiens
ttgacctgaggcccttctc

SEQ ID NO: 4712774 - DNA, 22 bp, Homo sapiens
ttgacctgaggcccttctctcc

SEQ ID NO: 4712775 - DNA, 14 bp, Homo sapiens
ttgacgccatccca

SEQ ID NO: 4712776 - DNA, 15 bp, Homo sapiens
ttgacgccatcccag

SEQ ID NO: 4712777 - DNA, 21 bp, Homo sapiens
ttgacttgacagaacactgtc

SEQ ID NO: 4712778 - DNA, 12 bp, Homo sapiens
ttgagacagttt

SEQ ID NO: 4712779 - DNA, 17 bp, Homo sapiens
ttgagacagtttcttag

SEQ ID NO: 4712780 - DNA, 12 bp, Homo sapiens
ttgagacataaa

SEQ ID NO: 4712781 - DNA, 23 bp, Homo sapiens
ttgagagttcgtgaagagggaag

SEQ ID NO: 4712782 - DNA, 13 bp, Homo sapiens
ttgaggaaaacaa

SEQ ID NO: 4712783 - DNA, 23 bp, Homo sapiens
ttgaggaaaacaagcattcacaa

SEQ ID NO: 4712784 - DNA, 13 bp, Homo sapiens
ttgaggaaatatt

SEQ ID NO: 4712785 - DNA, 15 bp, Homo sapiens
ttgaggaaatattaa

SEQ ID NO: 4712786 - DNA, 16 bp, Homo sapiens
ttgaggaaatattaat

SEQ ID NO: 4712787 - DNA, 15 bp, Homo sapiens
ttgaggctttcaggt

SEQ ID NO: 4712788 - DNA, 18 bp, Homo sapiens
ttgaggtcttttacatac

SEQ ID NO: 4712789 - DNA, 16 bp, Homo sapiens
ttgagtcaaaaaatct

SEQ ID NO: 4712790 - DNA, 12 bp, Homo sapiens
ttgagtctctga

SEQ ID NO: 4712791 - DNA, 14 bp, Homo sapiens
ttgagtctgtgcca

SEQ ID NO: 4712792 - DNA, 13 bp, Homo sapiens
ttgagttaatttt

SEQ ID NO: 4712793 - DNA, 14 bp, Homo sapiens
ttgataatgttaaa

SEQ ID NO: 4712794 - DNA, 22 bp, Homo sapiens
ttgataattttttaattattta

SEQ ID NO: 4712795 - DNA, 13 bp, Homo sapiens
ttgatactgttgc

SEQ ID NO: 4712796 - DNA, 15 bp, Homo sapiens
ttgatactgttgcac

SEQ ID NO: 4712797 - DNA, 16 bp, Homo sapiens
ttgatactgttgcacg

SEQ ID NO: 4712798 - DNA, 17 bp, Homo sapiens
ttgatactgttgcacgt

SEQ ID NO: 4712799 - DNA, 19 bp, Homo sapiens
ttgatagcacagaccctgc

SEQ ID NO: 4712800 - DNA, 23 bp, Homo sapiens
ttgatatttgcattgaggaaata

SEQ ID NO: 4712801 - DNA, 14 bp, Homo sapiens
ttgatgaaatcatt

SEQ ID NO: 4712802 - DNA, 16 bp, Homo sapiens
ttgatgatctttgcag

SEQ ID NO: 4712803 - DNA, 16 bp, Homo sapiens
ttgatgtgtgtctagg

SEQ ID NO: 4712804 - DNA, 23 bp, Homo sapiens
ttgatgttcagacatttatgtgt

SEQ ID NO: 4712805 - DNA, 16 bp, Homo sapiens
ttgatgttggctggga

SEQ ID NO: 4712806 - DNA, 15 bp, Homo sapiens
ttgattattcagtgt

SEQ ID NO: 4712807 - DNA, 14 bp, Homo sapiens
ttgattcagacagc

SEQ ID NO: 4712808 - DNA, 15 bp, Homo sapiens
ttgattcagacagct

SEQ ID NO: 4712809 - DNA, 16 bp, Homo sapiens
ttgattcagacagctg

SEQ ID NO: 4712810 - DNA, 21 bp, Homo sapiens
ttgattcagacagctgcctgg

SEQ ID NO: 4712811 - DNA, 20 bp, Homo sapiens
ttgattcatattgcatcata

SEQ ID NO: 4712812 - DNA, 20 bp, Homo sapiens
ttgattctccttcagccctc

SEQ ID NO: 4712813 - DNA, 17 bp, Homo sapiens
ttgatttcgatgtacag

SEQ ID NO: 4712814 - DNA, 17 bp, Homo sapiens
ttgcaacaggctgggct

SEQ ID NO: 4712815 - DNA, 14 bp, Homo sapiens
ttgcaacctcgctg

SEQ ID NO: 4712816 - DNA, 19 bp, Homo sapiens
ttgcaagcaacaagctatt

SEQ ID NO: 4712817 - DNA, 12 bp, Homo sapiens
ttgcaaggaagc

SEQ ID NO: 4712818 - DNA, 19 bp, Homo sapiens
ttgcaagggaaaagtctct

SEQ ID NO: 4712819 - DNA, 15 bp, Homo sapiens
ttgcaatagaaatcc

SEQ ID NO: 4712820 - DNA, 16 bp, Homo sapiens
ttgcaatggcagcctt

SEQ ID NO: 4712821 - DNA, 19 bp, Homo sapiens
ttgcacagccaaatttaaa

SEQ ID NO: 4712822 - DNA, 14 bp, Homo sapiens
ttgcacggctgctg

SEQ ID NO: 4712823 - DNA, 15 bp, Homo sapiens
ttgcacggctgctga

SEQ ID NO: 4712824 - DNA, 19 bp, Homo sapiens
ttgcacgtattttaatagc

SEQ ID NO: 4712825 - DNA, 20 bp, Homo sapiens
ttgcacgtgtgtttttctat

SEQ ID NO: 4712826 - DNA, 23 bp, Homo sapiens
ttgcacgtgtgtttttctattaa

SEQ ID NO: 4712827 - DNA, 14 bp, Homo sapiens
ttgcactgaaaacc

SEQ ID NO: 4712828 - DNA, 22 bp, Homo sapiens
ttgcagacaggcaagcacctcc

SEQ ID NO: 4712829 - DNA, 19 bp, Homo sapiens
ttgcagtacatcaaaggaa

SEQ ID NO: 4712830 - DNA, 18 bp, Homo sapiens
ttgcagtctaaaacttca

SEQ ID NO: 4712831 - DNA, 14 bp, Homo sapiens
ttgcatatatacat

SEQ ID NO: 4712832 - DNA, 19 bp, Homo sapiens
ttgcatattataaaggata

SEQ ID NO: 4712833 - DNA, 20 bp, Homo sapiens
ttgcatatttttctaaagaa

SEQ ID NO: 4712834 - DNA, 20 bp, Homo sapiens
ttgcatctcccagataatgt

SEQ ID NO: 4712835 - DNA, 19 bp, Homo sapiens
ttgcatggcatcacctcca

SEQ ID NO: 4712836 - DNA, 15 bp, Homo sapiens
ttgcattgaggaaat

SEQ ID NO: 4712837 - DNA, 22 bp, Homo sapiens
ttgcattgaggaaatattaatt

SEQ ID NO: 4712838 - DNA, 14 bp, Homo sapiens
ttgccaaagcactt

SEQ ID NO: 4712839 - DNA, 15 bp, Homo sapiens
ttgccaagctcagga

SEQ ID NO: 4712840 - DNA, 16 bp, Homo sapiens
ttgccaccctcatgct

SEQ ID NO: 4712841 - DNA, 18 bp, Homo sapiens
ttgccactcccctaaact

SEQ ID NO: 4712842 - DNA, 21 bp, Homo sapiens
ttgccactcccctaaactcca

SEQ ID NO: 4712843 - DNA, 19 bp, Homo sapiens
ttgccatattttcaccatt

SEQ ID NO: 4712844 - DNA, 21 bp, Homo sapiens
ttgccatgggcttcactgtat

SEQ ID NO: 4712845 - DNA, 17 bp, Homo sapiens
ttgccatgttggccagg

SEQ ID NO: 4712846 - DNA, 18 bp, Homo sapiens
ttgccatgttggccaggc

SEQ ID NO: 4712847 - DNA, 20 bp, Homo sapiens
ttgccatgttggccaggctg

SEQ ID NO: 4712848 - DNA, 23 bp, Homo sapiens
tggatgcggaacccaaattacgt

SEQ ID NO: 4712849 - DNA, 19 bp, Homo sapiens
tggatgggggctctgcacc

SEQ ID NO: 4712850 - DNA, 23 bp, Homo sapiens
tggatgtcctcaaagaagtggtt

SEQ ID NO: 4712851 - DNA, 13 bp, Homo sapiens
tggattatttaat

SEQ ID NO: 4712852 - DNA, 17 bp, Homo sapiens
tggattatttaataaca

SEQ ID NO: 4712853 - DNA, 18 bp, Homo sapiens
tggattatttaataacat

SEQ ID NO: 4712854 - DNA, 23 bp, Homo sapiens
tggattatttaataacattacct

SEQ ID NO: 4712855 - DNA, 17 bp, Homo sapiens
tggattcatatttaatt

SEQ ID NO: 4712856 - DNA, 23 bp, Homo sapiens
tggattggagaagtaatcctagg

SEQ ID NO: 4712857 - DNA, 15 bp, Homo sapiens
tggattggattattt

SEQ ID NO: 4712858 - DNA, 23 bp, Homo sapiens
tggattggattatttaataacat

SEQ ID NO: 4712859 - DNA, 16 bp, Homo sapiens
tggatttaaaagcctg

SEQ ID NO: 4712860 - DNA, 15 bp, Homo sapiens
tggattttgaattag

SEQ ID NO: 4712861 - DNA, 15 bp, Homo sapiens
tggatttttctttaa

SEQ ID NO: 4712862 - DNA, 18 bp, Homo sapiens
tggatttttctttaactg

SEQ ID NO: 4712863 - DNA, 17 bp, Homo sapiens
tggcaaaataaaacatg

SEQ ID NO: 4712864 - DNA, 21 bp, Homo sapiens
tggcaagctagaacctggagg

SEQ ID NO: 4712865 - DNA, 19 bp, Homo sapiens
tggcaaggacacagatgaa

SEQ ID NO: 4712866 - DNA, 14 bp, Homo sapiens
tggcaaggctgtgc

SEQ ID NO: 4712867 - DNA, 20 bp, Homo sapiens
tggcacccggcccctgctgg

SEQ ID NO: 4712868 - DNA, 16 bp, Homo sapiens
tggcacctgaaattaa

SEQ ID NO: 4712869 - DNA, 14 bp, Homo sapiens
tggcactgcttcca

SEQ ID NO: 4712870 - DNA, 13 bp, Homo sapiens
tggcagaagacac

SEQ ID NO: 4712871 - DNA, 20 bp, Homo sapiens
tggcagaagacaccagagca

SEQ ID NO: 4712872 - DNA, 22 bp, Homo sapiens
tggcagaagacaccagagcaga

SEQ ID NO: 4712873 - DNA, 18 bp, Homo sapiens
tggcagagagcacagtga

SEQ ID NO: 4712874 - DNA, 19 bp, Homo sapiens
tggcagagagcacagtgat

SEQ ID NO: 4712875 - DNA, 22 bp, Homo sapiens
tggcagagcttggactggatgc

SEQ ID NO: 4712876 - DNA, 16 bp, Homo sapiens
tggcagcaggtgctgc

SEQ ID NO: 4712877 - DNA, 13 bp, Homo sapiens
tggcagccttggc

SEQ ID NO: 4712878 - DNA, 18 bp, Homo sapiens
tggcagctcagagagggt

SEQ ID NO: 4712879 - DNA, 19 bp, Homo sapiens
tggcagctgcggtccaccc

SEQ ID NO: 4712880 - DNA, 13 bp, Homo sapiens
tggcagctgcttt

SEQ ID NO: 4712881 - DNA, 15 bp, Homo sapiens
tggcaggaagatgta

SEQ ID NO: 4712882 - DNA, 19 bp, Homo sapiens
tggcaggagttggaagtgt

SEQ ID NO: 4712883 - DNA, 13 bp, Homo sapiens
tggcagtgtttgt

SEQ ID NO: 4712884 - DNA, 14 bp, Homo sapiens
tggcagtgtttgta

SEQ ID NO: 4712885 - DNA, 15 bp, Homo sapiens
tggcatcagctggcg

SEQ ID NO: 4712886 - DNA, 22 bp, Homo sapiens
tggcatctaattcttattttta

SEQ ID NO: 4712887 - DNA, 19 bp, Homo sapiens
tggcatgtgggttgtgata

SEQ ID NO: 4712888 - DNA, 20 bp, Homo sapiens
tggcatgtgggttgtgatat

SEQ ID NO: 4712889 - DNA, 23 bp, Homo sapiens
tggcatgtgggttgtgatattga

SEQ ID NO: 4712890 - DNA, 19 bp, Homo sapiens
tggcattggcagcaggtgc

SEQ ID NO: 4712891 - DNA, 16 bp, Homo sapiens
tggccaagttcttagt

SEQ ID NO: 4712892 - DNA, 15 bp, Homo sapiens
tggccaccacccccc

SEQ ID NO: 4712893 - DNA, 23 bp, Homo sapiens
tggccaccaccccccactctgtg

SEQ ID NO: 4712894 - DNA, 18 bp, Homo sapiens
tggccagatgcaccagcc

SEQ ID NO: 4712895 - DNA, 20 bp, Homo sapiens
tggccagatgcaccagccct

SEQ ID NO: 4712896 - DNA, 15 bp, Homo sapiens
tggccagccccacag

SEQ ID NO: 4712897 - DNA, 16 bp, Homo sapiens
tggccagccccacagc

SEQ ID NO: 4712898 - DNA, 20 bp, Homo sapiens
tggccagccccacagcccac

SEQ ID NO: 4712899 - DNA, 13 bp, Homo sapiens
tggccaggctggt

SEQ ID NO: 4712900 - DNA, 20 bp, Homo sapiens
tggccaggctggtctcgaac

SEQ ID NO: 4712901 - DNA, 23 bp, Homo sapiens
tggccagggcctggaagacagag

SEQ ID NO: 4712902 - DNA, 21 bp, Homo sapiens
tggcccaagtggcagagcttg

SEQ ID NO: 4712903 - DNA, 22 bp, Homo sapiens
tggcccaagtttctaagggagg

SEQ ID NO: 4712904 - DNA, 22 bp, Homo sapiens
tggcccaccccacccacttctg

SEQ ID NO: 4712905 - DNA, 23 bp, Homo sapiens
tggcccaccccacccacttctgc

SEQ ID NO: 4712906 - DNA, 12 bp, Homo sapiens
tggcccagctcc

SEQ ID NO: 4712907 - DNA, 14 bp, Homo sapiens
tggcccagctcccc

SEQ ID NO: 4712908 - DNA, 22 bp, Homo sapiens
tggcccagctcccccgggaggg

SEQ ID NO: 4712909 - DNA, 15 bp, Homo sapiens
tggcccatcccccct

SEQ ID NO: 4712910 - DNA, 16 bp, Homo sapiens
tggcccatcccccctc

SEQ ID NO: 4712911 - DNA, 21 bp, Homo sapiens
tggcccatcccccctcaccag

SEQ ID NO: 4712912 - DNA, 22 bp, Homo sapiens
aaatgctaaccttgtagcatgt

SEQ ID NO: 4712913 - DNA, 12 bp, Homo sapiens
aaatggaaattt

SEQ ID NO: 4712914 - DNA, 22 bp, Homo sapiens
aaatggaggatctctaaagagc

SEQ ID NO: 4712915 - DNA, 15 bp, Homo sapiens
aaatgggcagagcag

SEQ ID NO: 4712916 - DNA, 11 bp, Homo sapiens
aaatggtgcct

SEQ ID NO: 4712917 - DNA, 15 bp, Homo sapiens
aaatgtaaacatttt

SEQ ID NO: 4712918 - DNA, 20 bp, Homo sapiens
aaatgtaattataagctgag

SEQ ID NO: 4712919 - DNA, 18 bp, Homo sapiens
aaatgtagaaattcttca

SEQ ID NO: 4712920 - DNA, 14 bp, Homo sapiens
aaatgtcacagtaa

SEQ ID NO: 4712921 - DNA, 18 bp, Homo sapiens
aaatgtctgtaataatag

SEQ ID NO: 4712922 - DNA, 13 bp, Homo sapiens
aaatgtcttgtgt

SEQ ID NO: 4712923 - DNA, 13 bp, Homo sapiens
aaatgtgatgaat

SEQ ID NO: 4712924 - DNA, 21 bp, Homo sapiens
aaatgtgatgaatactgtatt

SEQ ID NO: 4712925 - DNA, 17 bp, Homo sapiens
aaatgtggtcctattta

SEQ ID NO: 4712926 - DNA, 21 bp, Homo sapiens
aaatgtggtcctatttaagcc

SEQ ID NO: 4712927 - DNA, 23 bp, Homo sapiens
aaatgtgtcccagtgaacagttt

SEQ ID NO: 4712928 - DNA, 12 bp, Homo sapiens
aaatgtgtgtgt

SEQ ID NO: 4712929 - DNA, 23 bp, Homo sapiens
aaatgttagtattttaatcctgt

SEQ ID NO: 4712930 - DNA, 14 bp, Homo sapiens
aaatgttatgactc

SEQ ID NO: 4712931 - DNA, 17 bp, Homo sapiens
aaatgttctatttaaca

SEQ ID NO: 4712932 - DNA, 22 bp, Homo sapiens
aaatgttctatttaacaactgg

SEQ ID NO: 4712933 - DNA, 14 bp, Homo sapiens
aaattaaacaatat

SEQ ID NO: 4712934 - DNA, 18 bp, Homo sapiens
aaattaaacgtaaatgtt

SEQ ID NO: 4712935 - DNA, 20 bp, Homo sapiens
aaattaaacgtaaatgtttt

SEQ ID NO: 4712936 - DNA, 18 bp, Homo sapiens
aaattaactgctccaaat

SEQ ID NO: 4712937 - DNA, 21 bp, Homo sapiens
aaattaactgctccaaattta

SEQ ID NO: 4712938 - DNA, 14 bp, Homo sapiens
aaattaatttgtga

SEQ ID NO: 4712939 - DNA, 20 bp, Homo sapiens
aaattaatttgtgaatttgc

SEQ ID NO: 4712940 - DNA, 15 bp, Homo sapiens
aaattacctgtggat

SEQ ID NO: 4712941 - DNA, 21 bp, Homo sapiens
aaattactccaaggtttataa

SEQ ID NO: 4712942 - DNA, 17 bp, Homo sapiens
aaattatgataatatat

SEQ ID NO: 4712943 - DNA, 14 bp, Homo sapiens
aaattgaaagaact

SEQ ID NO: 4712944 - DNA, 15 bp, Homo sapiens
aaattgaaagaactt

SEQ ID NO: 4712945 - DNA, 18 bp, Homo sapiens
aaattgacctagttcaga

SEQ ID NO: 4712946 - DNA, 13 bp, Homo sapiens
aaattgatttgtt

SEQ ID NO: 4712947 - DNA, 17 bp, Homo sapiens
aaattgatttgttatgg

SEQ ID NO: 4712948 - DNA, 21 bp, Homo sapiens
aaattgcattcattgacttca

SEQ ID NO: 4712949 - DNA, 19 bp, Homo sapiens
aaattgttatcaaaatagt

SEQ ID NO: 4712950 - DNA, 21 bp, Homo sapiens
aaatttactgtctaagattaa

SEQ ID NO: 4712951 - DNA, 14 bp, Homo sapiens
aaatttattatgtc

SEQ ID NO: 4712952 - DNA, 18 bp, Homo sapiens
aaatttcagcagctgcag

SEQ ID NO: 4712953 - DNA, 20 bp, Homo sapiens
aaatttcagtcaattctgat

SEQ ID NO: 4712954 - DNA, 22 bp, Homo sapiens
aaatttccactcaggtctgttt

SEQ ID NO: 4712955 - DNA, 17 bp, Homo sapiens
aaatttctctactgtct

SEQ ID NO: 4712956 - DNA, 16 bp, Homo sapiens
aaatttgtaagtttca

SEQ ID NO: 4712957 - DNA, 20 bp, Homo sapiens
aaatttgtaagtttcaggtg

SEQ ID NO: 4712958 - DNA, 19 bp, Homo sapiens
aaatttgttattttgcaac

SEQ ID NO: 4712959 - DNA, 21 bp, Homo sapiens
aaattttacaagggcataaag

SEQ ID NO: 4712960 - DNA, 19 bp, Homo sapiens
aaatttttttttaaagcag

SEQ ID NO: 4712961 - DNA, 15 bp, Homo sapiens
aactatgttgataaa

SEQ ID NO: 4712962 - DNA, 12 bp, Homo sapiens
aactatttaaca

SEQ ID NO: 4712963 - DNA, 14 bp, Homo sapiens
aactcaatattttc

SEQ ID NO: 4712964 - DNA, 20 bp, Homo sapiens
aactcaatattttccatgaa

SEQ ID NO: 4712965 - DNA, 14 bp, Homo sapiens
aactcacctaactc

SEQ ID NO: 4712966 - DNA, 20 bp, Homo sapiens
aactcacctggggctgctgg

SEQ ID NO: 4712967 - DNA, 21 bp, Homo sapiens
aactcagaatatattcacttt

SEQ ID NO: 4712968 - DNA, 14 bp, Homo sapiens
aactcaggcaaaga

SEQ ID NO: 4712969 - DNA, 19 bp, Homo sapiens
aactccaggatttataaag

SEQ ID NO: 4712970 - DNA, 22 bp, Homo sapiens
aactccaggatttataaagcaa

SEQ ID NO: 4712971 - DNA, 13 bp, Homo sapiens
aactccatcattc

SEQ ID NO: 4712972 - DNA, 14 bp, Homo sapiens
aactcctgacctca

SEQ ID NO: 4712973 - DNA, 16 bp, Homo sapiens
aactctcctctgctgc

SEQ ID NO: 4712974 - DNA, 17 bp, Homo sapiens
aactctcctctgctgct

SEQ ID NO: 4712975 - DNA, 19 bp, Homo sapiens
aactctgaattttaaagca

SEQ ID NO: 4712976 - DNA, 23 bp, Homo sapiens
aactctgcaactgaatacttgaa

SEQ ID NO: 4712977 - DNA, 12 bp, Homo sapiens
aactctgtaaga

SEQ ID NO: 4712978 - DNA, 14 bp, Homo sapiens
aactctgtaagaaa

SEQ ID NO: 4712979 - DNA, 15 bp, Homo sapiens
aactcttatctcagt

SEQ ID NO: 4712980 - DNA, 13 bp, Homo sapiens
aactcttgtattg

SEQ ID NO: 4712981 - DNA, 14 bp, Homo sapiens
aactcttgtattgc

SEQ ID NO: 4712982 - DNA, 13 bp, Homo sapiens
aactctttcaaaa

SEQ ID NO: 4712983 - DNA, 14 bp, Homo sapiens
aactctttgagaaa

SEQ ID NO: 4712984 - DNA, 15 bp, Homo sapiens
aactgaacattccag

SEQ ID NO: 4712985 - DNA, 14 bp, Homo sapiens
aactgcagggaaaa

SEQ ID NO: 4712986 - DNA, 18 bp, Homo sapiens
aactgcattttgtagcct

SEQ ID NO: 4712987 - DNA, 23 bp, Homo sapiens
aactgcattttgtagcctctctt

SEQ ID NO: 4712988 - DNA, 20 bp, Homo sapiens
aactgccaaaaatataattc

SEQ ID NO: 4712989 - DNA, 17 bp, Homo sapiens
aactgccgtaatttaac

SEQ ID NO: 4712990 - DNA, 11 bp, Homo sapiens
aactggctgca

SEQ ID NO: 4712991 - DNA, 16 bp, Homo sapiens
aactgggtacttgtgg

SEQ ID NO: 4712992 - DNA, 13 bp, Homo sapiens
aactggtatttta

SEQ ID NO: 4712993 - DNA, 22 bp, Homo sapiens
aactggtattttatctttgatt

SEQ ID NO: 4712994 - DNA, 11 bp, Homo sapiens
aactgtgaatg

SEQ ID NO: 4712995 - DNA, 17 bp, Homo sapiens
aactgtgaatgcttctg

SEQ ID NO: 4712996 - DNA, 11 bp, Homo sapiens
aactgtggata

SEQ ID NO: 4712997 - DNA, 13 bp, Homo sapiens
aactgtggatatt

SEQ ID NO: 4712998 - DNA, 19 bp, Homo sapiens
aactgttggaatggatttt

SEQ ID NO: 4712999 - DNA, 22 bp, Homo sapiens
aactgtttagggccctgatttg

SEQ ID NO: 4713000 - DNA, 17 bp, Homo sapiens
aacttcaaaaactaaaa

SEQ ID NO: 4713001 - DNA, 18 bp, Homo sapiens
aacttcagtactcaaatt

SEQ ID NO: 4713002 - DNA, 16 bp, Homo sapiens
aacttccaaataaata

SEQ ID NO: 4713003 - DNA, 11 bp, Homo sapiens
aacttcttcag

SEQ ID NO: 4713004 - DNA, 18 bp, Homo sapiens
aacttcttttctcttcta

SEQ ID NO: 4713005 - DNA, 11 bp, Homo sapiens
aacttgtgaac

SEQ ID NO: 4713006 - DNA, 11 bp, Homo sapiens
aactttcattt

SEQ ID NO: 4713007 - DNA, 23 bp, Homo sapiens
aactttttaaccaagttgtttat

SEQ ID NO: 4713008 - DNA, 14 bp, Homo sapiens
aacttttttcttta

SEQ ID NO: 4713009 - DNA, 14 bp, Homo sapiens
aacttttttttaag

SEQ ID NO: 4713010 - DNA, 11 bp, Homo sapiens
aagaaaacaaa

SEQ ID NO: 4713011 - DNA, 17 bp, Homo sapiens
aagaaaaggggagagaa

SEQ ID NO: 4713012 - DNA, 20 bp, Homo sapiens
aagaaaatatacatttgttg

SEQ ID NO: 4713013 - DNA, 16 bp, Homo sapiens
aagaaaatgaaatgca

SEQ ID NO: 4713014 - DNA, 12 bp, Homo sapiens
aagaaaattttt

SEQ ID NO: 4713015 - DNA, 15 bp, Homo sapiens
aagaaacaaagatgt

SEQ ID NO: 4713016 - DNA, 17 bp, Homo sapiens
aagaaacttgtgcttta

SEQ ID NO: 4713017 - DNA, 20 bp, Homo sapiens
aagaaagttgcacggctgct

SEQ ID NO: 4713018 - DNA, 22 bp, Homo sapiens
aagaaagttgcacggctgctga

SEQ ID NO: 4713019 - DNA, 12 bp, Homo sapiens
aagaaatagaat

SEQ ID NO: 4713020 - DNA, 15 bp, Homo sapiens
aagaaatatattatt

SEQ ID NO: 4713021 - DNA, 17 bp, Homo sapiens
aagaaatcgccttatga

SEQ ID NO: 4713022 - DNA, 19 bp, Homo sapiens
aagaaatcgccttatgaga

SEQ ID NO: 4713023 - DNA, 21 bp, Homo sapiens
aagaaatcgccttatgagaac

SEQ ID NO: 4713024 - DNA, 18 bp, Homo sapiens
aagaacggggctcttctc

SEQ ID NO: 4713025 - DNA, 16 bp, Homo sapiens
aagagggcacacactg

SEQ ID NO: 4713026 - DNA, 13 bp, Homo sapiens
aagagtagaaact

SEQ ID NO: 4713027 - DNA, 12 bp, Homo sapiens
aagagtaggaag

SEQ ID NO: 4713028 - DNA, 13 bp, Homo sapiens
aagagtaggaaga

SEQ ID NO: 4713029 - DNA, 18 bp, Homo sapiens
aagagtaggaagactttg

SEQ ID NO: 4713030 - DNA, 20 bp, Homo sapiens
aagagtaggaagactttgga

SEQ ID NO: 4713031 - DNA, 20 bp, Homo sapiens
aagatacagaactctttcaa

SEQ ID NO: 4713032 - DNA, 16 bp, Homo sapiens
aagatcccaacatggt

SEQ ID NO: 4713033 - DNA, 22 bp, Homo sapiens
aagatcctaaaacaaaagctca

SEQ ID NO: 4713034 - DNA, 18 bp, Homo sapiens
aagatgtatgctttgaat

SEQ ID NO: 4713035 - DNA, 20 bp, Homo sapiens
aagatgttatggtgtttaga

SEQ ID NO: 4713036 - DNA, 19 bp, Homo sapiens
aagattaacactcatttcc

SEQ ID NO: 4713037 - DNA, 21 bp, Homo sapiens
aagattaacactcatttccaa

SEQ ID NO: 4713038 - DNA, 19 bp, Homo sapiens
aagattctatgttaatatt

SEQ ID NO: 4713039 - DNA, 23 bp, Homo sapiens
aagattttaaaagttttgttctt

SEQ ID NO: 4713040 - DNA, 21 bp, Homo sapiens
aagcaaactctaaaattataa

SEQ ID NO: 4713041 - DNA, 22 bp, Homo sapiens
aagcaaagactttcctcttagt

SEQ ID NO: 4713042 - DNA, 16 bp, Homo sapiens
aagcacatgccaggga

SEQ ID NO: 4713043 - DNA, 17 bp, Homo sapiens
aagcacctcctgcctcg

SEQ ID NO: 4713044 - DNA, 23 bp, Homo sapiens
aagcactctcgcacacacagtga

SEQ ID NO: 4713045 - DNA, 20 bp, Homo sapiens
aagcagaaaatacagctgga

SEQ ID NO: 4713046 - DNA, 19 bp, Homo sapiens
aagcagcgctagtggaggg

SEQ ID NO: 4713047 - DNA, 22 bp, Homo sapiens
aagcaggaaatgaaaatgtctt

SEQ ID NO: 4713048 - DNA, 21 bp, Homo sapiens
aagcaggaggaggtgccaaca

SEQ ID NO: 4713049 - DNA, 15 bp, Homo sapiens
aagcatgagtggcct

SEQ ID NO: 4713050 - DNA, 14 bp, Homo sapiens
aagcatggccctgc

SEQ ID NO: 4713051 - DNA, 18 bp, Homo sapiens
aagcatggccctgctgcc

SEQ ID NO: 4713052 - DNA, 12 bp, Homo sapiens
aagcattcacaa

SEQ ID NO: 4713053 - DNA, 14 bp, Homo sapiens
aagcattccttctt

SEQ ID NO: 4713054 - DNA, 18 bp, Homo sapiens
aagcattccttctttgat

SEQ ID NO: 4713055 - DNA, 21 bp, Homo sapiens
aagcattccttctttgataat

SEQ ID NO: 4713056 - DNA, 22 bp, Homo sapiens
aagcattccttctttgataatg

SEQ ID NO: 4713057 - DNA, 23 bp, Homo sapiens
aagcattccttctttgataatgt

SEQ ID NO: 4713058 - DNA, 13 bp, Homo sapiens
aagcatttaaagg

SEQ ID NO: 4713059 - DNA, 15 bp, Homo sapiens
aagcattttcagcat

SEQ ID NO: 4713060 - DNA, 17 bp, Homo sapiens
aagcattttcagcatca

SEQ ID NO: 4713061 - DNA, 18 bp, Homo sapiens
aagccaaagctaggcctg

SEQ ID NO: 4713062 - DNA, 22 bp, Homo sapiens
aagccacaggcctgagatttca

SEQ ID NO: 4713063 - DNA, 18 bp, Homo sapiens
aagccacttaaaatgttc

SEQ ID NO: 4713064 - DNA, 19 bp, Homo sapiens
aagccagcgtcctcctctg

SEQ ID NO: 4713065 - DNA, 21 bp, Homo sapiens
aagccatggagtgagacccag

SEQ ID NO: 4713066 - DNA, 22 bp, Homo sapiens
aagccatggagtgagacccagg

SEQ ID NO: 4713067 - DNA, 17 bp, Homo sapiens
aagcccaggaaaggctc

SEQ ID NO: 4713068 - DNA, 19 bp, Homo sapiens
aagcccaggaaaggctcca

SEQ ID NO: 4713069 - DNA, 22 bp, Homo sapiens
aagcccaggaaaggctccagga

SEQ ID NO: 4713070 - DNA, 21 bp, Homo sapiens
aagcccattcattccattctg

SEQ ID NO: 4713071 - DNA, 23 bp, Homo sapiens
aagcccattcattccattctgga

SEQ ID NO: 4713072 - DNA, 21 bp, Homo sapiens
aagcctcaaatttgaacatgt

SEQ ID NO: 4713073 - DNA, 13 bp, Homo sapiens
aagcctctgtgtc

SEQ ID NO: 4713074 - DNA, 22 bp, Homo sapiens
aagcctctgtgtcactggctgc

SEQ ID NO: 4713075 - DNA, 20 bp, Homo sapiens
aagccttataaaccaatctt

SEQ ID NO: 4713076 - DNA, 15 bp, Homo sapiens
aagccttgttttctc

SEQ ID NO: 4713077 - DNA, 22 bp, Homo sapiens
aagcctttcataccagtcagta

SEQ ID NO: 4713078 - DNA, 17 bp, Homo sapiens
aagcgattcttctgctt

SEQ ID NO: 4713079 - DNA, 13 bp, Homo sapiens
aagctagaaatga

SEQ ID NO: 4713080 - DNA, 17 bp, Homo sapiens
aagctagaacctggagg

SEQ ID NO: 4713081 - DNA, 16 bp, Homo sapiens
aagctcagggcctggc

SEQ ID NO: 4713082 - DNA, 19 bp, Homo sapiens
aagctcagggcctggctca

SEQ ID NO: 4713083 - DNA, 20 bp, Homo sapiens
aagctcagggcctggctcag

SEQ ID NO: 4713084 - DNA, 17 bp, Homo sapiens
aagctccaagctcccag

SEQ ID NO: 4713085 - DNA, 17 bp, Homo sapiens
aagctcccaagggatgg

SEQ ID NO: 4713086 - DNA, 9 bp, Homo sapiens
aagctctga

SEQ ID NO: 4713087 - DNA, 13 bp, Homo sapiens
aagctctgctcct

SEQ ID NO: 4713088 - DNA, 13 bp, Homo sapiens
aagctgcaataaa

SEQ ID NO: 4713089 - DNA, 23 bp, Homo sapiens
aagctggaggactagaacctgga

SEQ ID NO: 4713090 - DNA, 22 bp, Homo sapiens
aagctgggactcattcacattt

SEQ ID NO: 4713091 - DNA, 20 bp, Homo sapiens
aagctgtgccaccctgggct

SEQ ID NO: 4713092 - DNA, 14 bp, Homo sapiens
aagctgtgtctctg

SEQ ID NO: 4713093 - DNA, 18 bp, Homo sapiens
aagctgttgtacatttat

SEQ ID NO: 4713094 - DNA, 21 bp, Homo sapiens
aagctgttgtacatttatgat

SEQ ID NO: 4713095 - DNA, 13 bp, Homo sapiens
aagcttactaaag

SEQ ID NO: 4713096 - DNA, 14 bp, Homo sapiens
aagcttgctcacat

SEQ ID NO: 4713097 - DNA, 12 bp, Homo sapiens
aagcttggggaa

SEQ ID NO: 4713098 - DNA, 21 bp, Homo sapiens
aagcttggttctgtgaacaag

SEQ ID NO: 4713099 - DNA, 20 bp, Homo sapiens
aaggaaacacttctatttaa

SEQ ID NO: 4713100 - DNA, 15 bp, Homo sapiens
aaggaaacccagctc

SEQ ID NO: 4713101 - DNA, 17 bp, Homo sapiens
aaggaaacccagctctg

SEQ ID NO: 4713102 - DNA, 19 bp, Homo sapiens
aaggaaactcttatctcag

SEQ ID NO: 4713103 - DNA, 21 bp, Homo sapiens
aaggaaggctcttctccccag

SEQ ID NO: 4713104 - DNA, 17 bp, Homo sapiens
aaggaatacctgtcccc

SEQ ID NO: 4713105 - DNA, 13 bp, Homo sapiens
aaggactagggtc

SEQ ID NO: 4713106 - DNA, 20 bp, Homo sapiens
aaggactagggtcctgggga

SEQ ID NO: 4713107 - DNA, 11 bp, Homo sapiens
aaggagctgcc

SEQ ID NO: 4713108 - DNA, 19 bp, Homo sapiens
aaggagctgcctggacccg

SEQ ID NO: 4713109 - DNA, 12 bp, Homo sapiens
aaggaggacaag

SEQ ID NO: 4713110 - DNA, 17 bp, Homo sapiens
aaggaggacaagaccct

SEQ ID NO: 4713111 - DNA, 20 bp, Homo sapiens
aaggaggacaagaccctctc

SEQ ID NO: 4713112 - DNA, 20 bp, Homo sapiens
aaggaggggatagagagaga

SEQ ID NO: 4713113 - DNA, 17 bp, Homo sapiens
aaggatccggaaagaag

SEQ ID NO: 4713114 - DNA, 13 bp, Homo sapiens
aaggatgagggtt

SEQ ID NO: 4713115 - DNA, 19 bp, Homo sapiens
aaggatgccccgtccccct

SEQ ID NO: 4713116 - DNA, 15 bp, Homo sapiens
aaggattgctactgt

SEQ ID NO: 4713117 - DNA, 12 bp, Homo sapiens
aaggattgtaaa

SEQ ID NO: 4713118 - DNA, 13 bp, Homo sapiens
aaggattgtaaaa

SEQ ID NO: 4713119 - DNA, 12 bp, Homo sapiens
aaggcagggagg

SEQ ID NO: 4713120 - DNA, 15 bp, Homo sapiens
aaggcatgtgtgaaa

SEQ ID NO: 4713121 - DNA, 19 bp, Homo sapiens
aaggcctcccacagtgact

SEQ ID NO: 4713122 - DNA, 16 bp, Homo sapiens
aaggctccaggagcag

SEQ ID NO: 4713123 - DNA, 18 bp, Homo sapiens
aaggctccaggagcagcc

SEQ ID NO: 4713124 - DNA, 16 bp, Homo sapiens
aaggctcgagcatgcc

SEQ ID NO: 4713125 - DNA, 17 bp, Homo sapiens
aaggctcttctccccag

SEQ ID NO: 4713126 - DNA, 21 bp, Homo sapiens
aagggcataaagtaaatacat

SEQ ID NO: 4713127 - DNA, 17 bp, Homo sapiens
aagggcctggcctgagc

SEQ ID NO: 4713128 - DNA, 19 bp, Homo sapiens
aagggctagaacctggaga

SEQ ID NO: 4713129 - DNA, 17 bp, Homo sapiens
aagggctcagagaggac

SEQ ID NO: 4713130 - DNA, 22 bp, Homo sapiens
aaggggaatgtttgcctctgcc

SEQ ID NO: 4713131 - DNA, 12 bp, Homo sapiens
aagggggctggg

SEQ ID NO: 4713132 - DNA, 23 bp, Homo sapiens
aagggggctgggacatgggaaag

SEQ ID NO: 4713133 - DNA, 16 bp, Homo sapiens
aaggggtctgaaattt

SEQ ID NO: 4713134 - DNA, 20 bp, Homo sapiens
aaggggtggccgtcctgagg

SEQ ID NO: 4713135 - DNA, 21 bp, Homo sapiens
aaggggtggccgtcctgaggg

SEQ ID NO: 4713136 - DNA, 16 bp, Homo sapiens
aagggtatcaggtgct

SEQ ID NO: 4713137 - DNA, 21 bp, Homo sapiens
aagggtgttgggagggtggtt

SEQ ID NO: 4713138 - DNA, 21 bp, Homo sapiens
aaggtataattaaacttcttt

SEQ ID NO: 4713139 - DNA, 20 bp, Homo sapiens
aaggtatatgttttataatt

SEQ ID NO: 4713140 - DNA, 13 bp, Homo sapiens
aaggtatctggta

SEQ ID NO: 4713141 - DNA, 14 bp, Homo sapiens
aaggtatctggtat

SEQ ID NO: 4713142 - DNA, 23 bp, Homo sapiens
aaggtgagaggtgtaggttgaaa

SEQ ID NO: 4713143 - DNA, 16 bp, Homo sapiens
aaggttaagccctgag

SEQ ID NO: 4713144 - DNA, 13 bp, Homo sapiens
aaggttgtattgc

SEQ ID NO: 4713145 - DNA, 14 bp, Homo sapiens
aaggtttataaagc

SEQ ID NO: 4713146 - DNA, 16 bp, Homo sapiens
aaggtttctgaaaatt

SEQ ID NO: 4713147 - DNA, 14 bp, Homo sapiens
aagtaaaattgttt

SEQ ID NO: 4713148 - DNA, 16 bp, Homo sapiens
aagtaatcctagggaa

SEQ ID NO: 4713149 - DNA, 18 bp, Homo sapiens
aagtacttctccaccctg

SEQ ID NO: 4713150 - DNA, 21 bp, Homo sapiens
aagtacttctccaccctgctc

SEQ ID NO: 4713151 - DNA, 23 bp, Homo sapiens
aagtacttctccaccctgctctc

SEQ ID NO: 4713152 - DNA, 20 bp, Homo sapiens
aagtagattatggccttttt

SEQ ID NO: 4713153 - DNA, 14 bp, Homo sapiens
aagtagtaaatttt

SEQ ID NO: 4713154 - DNA, 20 bp, Homo sapiens
aagtataaaatagtatgaaa

SEQ ID NO: 4713155 - DNA, 22 bp, Homo sapiens
aagtataaaatagtatgaaaat

SEQ ID NO: 4713156 - DNA, 20 bp, Homo sapiens
aagtattagacttctaaata

SEQ ID NO: 4713157 - DNA, 22 bp, Homo sapiens
aagtattgcagtctaaaacttc

SEQ ID NO: 4713158 - DNA, 17 bp, Homo sapiens
aagtattgtttacatta

SEQ ID NO: 4713159 - DNA, 24 bp, Homo sapiens
aagtcacacagtattacttctgct

SEQ ID NO: 4713160 - DNA, 17 bp, Homo sapiens
aagtctcgaatgtaatt

SEQ ID NO: 4713161 - DNA, 17 bp, Homo sapiens
aagtcttatcaagcagc

SEQ ID NO: 4713162 - DNA, 14 bp, Homo sapiens
aagtgacaaaagct

SEQ ID NO: 4713163 - DNA, 22 bp, Homo sapiens
aagtgacagatcctccattttt

SEQ ID NO: 4713164 - DNA, 21 bp, Homo sapiens
aagtgacttagcagatgctgg

SEQ ID NO: 4713165 - DNA, 15 bp, Homo sapiens
aagtgagacagtcca

SEQ ID NO: 4713166 - DNA, 14 bp, Homo sapiens
aagtgagagctggg

SEQ ID NO: 4713167 - DNA, 13 bp, Homo sapiens
aagtgattctcat

SEQ ID NO: 4713168 - DNA, 19 bp, Homo sapiens
aagtgattctcatgcctca

SEQ ID NO: 4713169 - DNA, 18 bp, Homo sapiens
aagtgattgggacagagg

SEQ ID NO: 4713170 - DNA, 21 bp, Homo sapiens
aagtgcacacctttattcaga

SEQ ID NO: 4713171 - DNA, 15 bp, Homo sapiens
aagtgcgtgtgtaga

SEQ ID NO: 4713172 - DNA, 20 bp, Homo sapiens
aagtggaacgaaaatgaaag

SEQ ID NO: 4713173 - DNA, 16 bp, Homo sapiens
aagtggaagtatgtat

SEQ ID NO: 4713174 - DNA, 13 bp, Homo sapiens
aagtggtatagaa

SEQ ID NO: 4713175 - DNA, 13 bp, Homo sapiens
aagtgtgtgtgca

SEQ ID NO: 4713176 - DNA, 15 bp, Homo sapiens
aagtgtttatgttgt

SEQ ID NO: 4713177 - DNA, 19 bp, Homo sapiens
aagttaaaagtaaaattgt

SEQ ID NO: 4713178 - DNA, 14 bp, Homo sapiens
aagttaaatgtatc

SEQ ID NO: 4713179 - DNA, 15 bp, Homo sapiens
aagttaaatgtatca

SEQ ID NO: 4713180 - DNA, 14 bp, Homo sapiens
aagttaaattttat

SEQ ID NO: 4713181 - DNA, 17 bp, Homo sapiens
aagttacaattacatct

SEQ ID NO: 4713182 - DNA, 14 bp, Homo sapiens
aagttatctttgaa

SEQ ID NO: 4713183 - DNA, 15 bp, Homo sapiens
aagttatctttgaat

SEQ ID NO: 4713184 - DNA, 14 bp, Homo sapiens
aagttcaggctctg

SEQ ID NO: 4713185 - DNA, 23 bp, Homo sapiens
aagttcaggctctgagacacacc

SEQ ID NO: 4713186 - DNA, 19 bp, Homo sapiens
aagttctgtactcaaatgt

SEQ ID NO: 4713187 - DNA, 22 bp, Homo sapiens
aagttcttagttgctgtatgtc

SEQ ID NO: 4713188 - DNA, 21 bp, Homo sapiens
aagttgatatagaacagtgct

SEQ ID NO: 4713189 - DNA, 18 bp, Homo sapiens
aagttgatggtgatgaaa

SEQ ID NO: 4713190 - DNA, 15 bp, Homo sapiens
aagttgcacggctgc

SEQ ID NO: 4713191 - DNA, 21 bp, Homo sapiens
aagttgtataaaaacatgagt

SEQ ID NO: 4713192 - DNA, 19 bp, Homo sapiens
aagtttactcaaccctctc

SEQ ID NO: 4713193 - DNA, 17 bp, Homo sapiens
aagtttcaggtgacatg

SEQ ID NO: 4713194 - DNA, 20 bp, Homo sapiens
aagtttccttggctggtgca

SEQ ID NO: 4713195 - DNA, 17 bp, Homo sapiens
aagtttgggctaacatt

SEQ ID NO: 4713196 - DNA, 16 bp, Homo sapiens
aagtttttaatattta

SEQ ID NO: 4713197 - DNA, 22 bp, Homo sapiens
aataaaaagggcagccctcctt

SEQ ID NO: 4713198 - DNA, 21 bp, Homo sapiens
aataaaaccaagcctctggaa

SEQ ID NO: 4713199 - DNA, 16 bp, Homo sapiens
aataaaataattatct

SEQ ID NO: 4713200 - DNA, 23 bp, Homo sapiens
aataaaattaaagctgaaaactg

SEQ ID NO: 4713201 - DNA, 16 bp, Homo sapiens
agtccttaccagcaga

SEQ ID NO: 4713202 - DNA, 19 bp, Homo sapiens
agtccttaccagcagagca

SEQ ID NO: 4713203 - DNA, 16 bp, Homo sapiens
agtcgaggacagggag

SEQ ID NO: 4713204 - DNA, 17 bp, Homo sapiens
agtcgcgagcacatgtt

SEQ ID NO: 4713205 - DNA, 20 bp, Homo sapiens
agtcgcgagcacatgttcat

SEQ ID NO: 4713206 - DNA, 13 bp, Homo sapiens
agtcgcgctgcct

SEQ ID NO: 4713207 - DNA, 20 bp, Homo sapiens
agtctaggaatggagtctcc

SEQ ID NO: 4713208 - DNA, 13 bp, Homo sapiens
agtctcaattttg

SEQ ID NO: 4713209 - DNA, 14 bp, Homo sapiens
agtctcaattttgt

SEQ ID NO: 4713210 - DNA, 18 bp, Homo sapiens
agtctcactgttgcccag

SEQ ID NO: 4713211 - DNA, 19 bp, Homo sapiens
agtctcactgttgcccagg

SEQ ID NO: 4713212 - DNA, 21 bp, Homo sapiens
agtctcactgttgcccaggct

SEQ ID NO: 4713213 - DNA, 23 bp, Homo sapiens
agtctcactgttgcccaggctgg

SEQ ID NO: 4713214 - DNA, 18 bp, Homo sapiens
agtctcccactgcaactt

SEQ ID NO: 4713215 - DNA, 23 bp, Homo sapiens
agtctcccactgcaacttgtgaa

SEQ ID NO: 4713216 - DNA, 14 bp, Homo sapiens
agtctccctccctt

SEQ ID NO: 4713217 - DNA, 18 bp, Homo sapiens
agtctccctcccttgggg

SEQ ID NO: 4713218 - DNA, 13 bp, Homo sapiens
agtctctgagcag

SEQ ID NO: 4713219 - DNA, 16 bp, Homo sapiens
agtctctgagcagtga

SEQ ID NO: 4713220 - DNA, 12 bp, Homo sapiens
agtctgaaggct

SEQ ID NO: 4713221 - DNA, 19 bp, Homo sapiens
agtctgaggcacctgcata

SEQ ID NO: 4713222 - DNA, 20 bp, Homo sapiens
agtctgattcccaagctctg

SEQ ID NO: 4713223 - DNA, 21 bp, Homo sapiens
agtctgattcccaagctctgc

SEQ ID NO: 4713224 - DNA, 17 bp, Homo sapiens
agtctggcaaacatgtg

SEQ ID NO: 4713225 - DNA, 20 bp, Homo sapiens
agtctggcaaacatgtgcaa

SEQ ID NO: 4713226 - DNA, 17 bp, Homo sapiens
agtctgggtccaggcct

SEQ ID NO: 4713227 - DNA, 16 bp, Homo sapiens
agtcttacgaatactt

SEQ ID NO: 4713228 - DNA, 15 bp, Homo sapiens
agtcttatcaagcag

SEQ ID NO: 4713229 - DNA, 16 bp, Homo sapiens
agtcttatcaagcagc

SEQ ID NO: 4713230 - DNA, 15 bp, Homo sapiens
agtcttccatttgca

SEQ ID NO: 4713231 - DNA, 17 bp, Homo sapiens
agtcttccatttgcaag

SEQ ID NO: 4713232 - DNA, 22 bp, Homo sapiens
agtcttgtattaagttgttaat

SEQ ID NO: 4713233 - DNA, 16 bp, Homo sapiens
agtctttcacatttaa

SEQ ID NO: 4713234 - DNA, 21 bp, Homo sapiens
agtgaaggcttctctctgtgg

SEQ ID NO: 4713235 - DNA, 13 bp, Homo sapiens
agtgaatgattca

SEQ ID NO: 4713236 - DNA, 15 bp, Homo sapiens
agtgaatttgtccat

SEQ ID NO: 4713237 - DNA, 20 bp, Homo sapiens
agtgaatttgtccattgtaa

SEQ ID NO: 4713238 - DNA, 22 bp, Homo sapiens
agtgaatttgtccattgtaaat

SEQ ID NO: 4713239 - DNA, 17 bp, Homo sapiens
agtgacaccaataaatg

SEQ ID NO: 4713240 - DNA, 16 bp, Homo sapiens
agtgacagaggcagcc

SEQ ID NO: 4713241 - DNA, 18 bp, Homo sapiens
agtgaccatactaattat

SEQ ID NO: 4713242 - DNA, 17 bp, Homo sapiens
agtgactcgggctcctg

SEQ ID NO: 4713243 - DNA, 20 bp, Homo sapiens
agtgactcgggctcctgtgc

SEQ ID NO: 4713244 - DNA, 21 bp, Homo sapiens
agtgactcgggctcctgtgcc

SEQ ID NO: 4713245 - DNA, 13 bp, Homo sapiens
agtgactgttgta

SEQ ID NO: 4713246 - DNA, 16 bp, Homo sapiens
agtgacttaatatcta

SEQ ID NO: 4713247 - DNA, 21 bp, Homo sapiens
agtgacttagcagatgctggt

SEQ ID NO: 4713248 - DNA, 17 bp, Homo sapiens
agtgagactccacctca

SEQ ID NO: 4713249 - DNA, 13 bp, Homo sapiens
agtgagactctgt

SEQ ID NO: 4713250 - DNA, 19 bp, Homo sapiens
agtgagagcatgtgagggg

SEQ ID NO: 4713251 - DNA, 12 bp, Homo sapiens
agtgagatgcat

SEQ ID NO: 4713252 - DNA, 23 bp, Homo sapiens
agtgagctggtttttagcggaga

SEQ ID NO: 4713253 - DNA, 12 bp, Homo sapiens
agtgaggctctg

SEQ ID NO: 4713254 - DNA, 15 bp, Homo sapiens
agtgaggctctgccc

SEQ ID NO: 4713255 - DNA, 17 bp, Homo sapiens
agtgaggctctgccctt

SEQ ID NO: 4713256 - DNA, 23 bp, Homo sapiens
agtgagtgcaaaaagctgagtat

SEQ ID NO: 4713257 - DNA, 16 bp, Homo sapiens
agtgagtggcatgtgg

SEQ ID NO: 4713258 - DNA, 18 bp, Homo sapiens
agtgagtggcatgtgggt

SEQ ID NO: 4713259 - DNA, 21 bp, Homo sapiens
agtgagttcagcctttaagat

SEQ ID NO: 4713260 - DNA, 22 bp, Homo sapiens
agtgagttcagcctttaagata

SEQ ID NO: 4713261 - DNA, 21 bp, Homo sapiens
agtgagttgatagcacagacc

SEQ ID NO: 4713262 - DNA, 23 bp, Homo sapiens
agtgatatggtactaaggagaat

SEQ ID NO: 4713263 - DNA, 15 bp, Homo sapiens
agtgatcacagcagc

SEQ ID NO: 4713264 - DNA, 16 bp, Homo sapiens
agtgatcacagcagct

SEQ ID NO: 4713265 - DNA, 12 bp, Homo sapiens
agtgatcactgg

SEQ ID NO: 4713266 - DNA, 15 bp, Homo sapiens
agtgatcctcccacc

SEQ ID NO: 4713267 - DNA, 24 bp, Homo sapiens
agtgatcctcccacctcagcctcc

SEQ ID NO: 4713268 - DNA, 20 bp, Homo sapiens
agtgatgggttagtggatgg

SEQ ID NO: 4713269 - DNA, 21 bp, Homo sapiens
agtgattctcatgcctcagcc

SEQ ID NO: 4713270 - DNA, 19 bp, Homo sapiens
agtgattctcctgcctcag

SEQ ID NO: 4713271 - DNA, 17 bp, Homo sapiens
agtgattgggacagagg

SEQ ID NO: 4713272 - DNA, 18 bp, Homo sapiens
agtgatttagttgtggaa

SEQ ID NO: 4713273 - DNA, 17 bp, Homo sapiens
agtgcaaagtataaaat

SEQ ID NO: 4713274 - DNA, 14 bp, Homo sapiens
agtgcaagctgaag

SEQ ID NO: 4713275 - DNA, 19 bp, Homo sapiens
agtgcacacctttattcag

SEQ ID NO: 4713276 - DNA, 12 bp, Homo sapiens
agtgccaccaca

SEQ ID NO: 4713277 - DNA, 17 bp, Homo sapiens
agtgccactgttgtttt

SEQ ID NO: 4713278 - DNA, 17 bp, Homo sapiens
agtgccagcccctgctg

SEQ ID NO: 4713279 - DNA, 22 bp, Homo sapiens
agtgccgccgcctcgcccaccg

SEQ ID NO: 4713280 - DNA, 13 bp, Homo sapiens
agtgcgtgtgtag

SEQ ID NO: 4713281 - DNA, 18 bp, Homo sapiens
agtgcgtgtgtagagtta

SEQ ID NO: 4713282 - DNA, 22 bp, Homo sapiens
agtgcgtgtgtagagttaagaa

SEQ ID NO: 4713283 - DNA, 17 bp, Homo sapiens
agtgctccctcacatgt

SEQ ID NO: 4713284 - DNA, 21 bp, Homo sapiens
agtgctctgatccctctacag

SEQ ID NO: 4713285 - DNA, 16 bp, Homo sapiens
agtgctgtaatattgt

SEQ ID NO: 4713286 - DNA, 18 bp, Homo sapiens
agtgctgtaatattgtaa

SEQ ID NO: 4713287 - DNA, 20 bp, Homo sapiens
agtgctgtaatattgtaaat

SEQ ID NO: 4713288 - DNA, 14 bp, Homo sapiens
agtgcttcttgtaa

SEQ ID NO: 4713289 - DNA, 20 bp, Homo sapiens
agtttttatggttccaatga

SEQ ID NO: 4713290 - DNA, 15 bp, Homo sapiens
agtttttattgcttg

SEQ ID NO: 4713291 - DNA, 16 bp, Homo sapiens
agtttttctgtatttt

SEQ ID NO: 4713292 - DNA, 18 bp, Homo sapiens
ataaaaaagtgtcctata

SEQ ID NO: 4713293 - DNA, 12 bp, Homo sapiens
ataaaaaatggt

SEQ ID NO: 4713294 - DNA, 18 bp, Homo sapiens
ataaaaaatggtgcctga

SEQ ID NO: 4713295 - DNA, 18 bp, Homo sapiens
ataaaaaatttattatgt

SEQ ID NO: 4713296 - DNA, 21 bp, Homo sapiens
ataaaaactcaggcaaagaaa

SEQ ID NO: 4713297 - DNA, 12 bp, Homo sapiens
ataaaaatatat

SEQ ID NO: 4713298 - DNA, 20 bp, Homo sapiens
ataaaaccaagcctctggaa

SEQ ID NO: 4713299 - DNA, 14 bp, Homo sapiens
ataaaagatatgtt

SEQ ID NO: 4713300 - DNA, 15 bp, Homo sapiens
ataaaataattctaa

SEQ ID NO: 4713301 - DNA, 17 bp, Homo sapiens
ataaaataattctaaag

SEQ ID NO: 4713302 - DNA, 18 bp, Homo sapiens
ataaaatagtatgaaaat

SEQ ID NO: 4713303 - DNA, 14 bp, Homo sapiens
ataaacaatccaaa

SEQ ID NO: 4713304 - DNA, 19 bp, Homo sapiens
ataaacctctaatttattt

SEQ ID NO: 4713305 - DNA, 20 bp, Homo sapiens
ataaaccttgtttctttctg

SEQ ID NO: 4713306 - DNA, 21 bp, Homo sapiens
ataaaccttgtttctttctga

SEQ ID NO: 4713307 - DNA, 17 bp, Homo sapiens
ataaagcagattacctc

SEQ ID NO: 4713308 - DNA, 13 bp, Homo sapiens
ataaagggaacat

SEQ ID NO: 4713309 - DNA, 16 bp, Homo sapiens
ataaagggaacatgca

SEQ ID NO: 4713310 - DNA, 14 bp, Homo sapiens
ataaagtgtgtgtg

SEQ ID NO: 4713311 - DNA, 15 bp, Homo sapiens
ataaagtgtgtgtgc

SEQ ID NO: 4713312 - DNA, 14 bp, Homo sapiens
ataaataacttttt

SEQ ID NO: 4713313 - DNA, 12 bp, Homo sapiens
ataaataatttt

SEQ ID NO: 4713314 - DNA, 15 bp, Homo sapiens
ataaatcacacattc

SEQ ID NO: 4713315 - DNA, 16 bp, Homo sapiens
ataaattaatacagag

SEQ ID NO: 4713316 - DNA, 23 bp, Homo sapiens
aggtctcctccaccgccatggct

SEQ ID NO: 4713317 - DNA, 17 bp, Homo sapiens
aggtctcgctgatgctg

SEQ ID NO: 4713318 - DNA, 22 bp, Homo sapiens
aggtctcgctgatgctgggctg

SEQ ID NO: 4713319 - DNA, 16 bp, Homo sapiens
aggtcttgaactcctg

SEQ ID NO: 4713320 - DNA, 17 bp, Homo sapiens
aggtcttgaactcctgg

SEQ ID NO: 4713321 - DNA, 20 bp, Homo sapiens
aggtcttgaactcctggcct

SEQ ID NO: 4713322 - DNA, 21 bp, Homo sapiens
aggtcttgaactcctggcctc

SEQ ID NO: 4713323 - DNA, 20 bp, Homo sapiens
aggtcttggttagagaagta

SEQ ID NO: 4713324 - DNA, 13 bp, Homo sapiens
aggtgaccccagg

SEQ ID NO: 4713325 - DNA, 20 bp, Homo sapiens
aggtgactgggccctgcctc

SEQ ID NO: 4713326 - DNA, 22 bp, Homo sapiens
aggtgactgggccctgcctctg

SEQ ID NO: 4713327 - DNA, 23 bp, Homo sapiens
aggtgatccacccacctcagcct

SEQ ID NO: 4713328 - DNA, 20 bp, Homo sapiens
aggtgcacaagctccaagct

SEQ ID NO: 4713329 - DNA, 23 bp, Homo sapiens
aggtgctaatttgttttggatat

SEQ ID NO: 4713330 - DNA, 20 bp, Homo sapiens
aggtgctacacccttttcca

SEQ ID NO: 4713331 - DNA, 21 bp, Homo sapiens
aggtgctacacccttttccag

SEQ ID NO: 4713332 - DNA, 21 bp, Homo sapiens
aggtgctgctaccctccctgc

SEQ ID NO: 4713333 - DNA, 22 bp, Homo sapiens
aggtgctgctaccctccctgct

SEQ ID NO: 4713334 - DNA, 14 bp, Homo sapiens
aggtgctgtgacac

SEQ ID NO: 4713335 - DNA, 14 bp, Homo sapiens
aggtgcttgttatg

SEQ ID NO: 4713336 - DNA, 15 bp, Homo sapiens
aggtggcaaggctgt

SEQ ID NO: 4713337 - DNA, 19 bp, Homo sapiens
aggtgggcgggcagcacag

SEQ ID NO: 4713338 - DNA, 23 bp, Homo sapiens
aggtggggcagcttgagggttgg

SEQ ID NO: 4713339 - DNA, 20 bp, Homo sapiens
aggtggggtggagtcccaga

SEQ ID NO: 4713340 - DNA, 20 bp, Homo sapiens
aggtgtccctgcacttgcag

SEQ ID NO: 4713341 - DNA, 21 bp, Homo sapiens
aggtgtgagtcaccaagccca

SEQ ID NO: 4713342 - DNA, 12 bp, Homo sapiens
aggtgtgctctg

SEQ ID NO: 4713343 - DNA, 15 bp, Homo sapiens
aggtgtgctctgatc

SEQ ID NO: 4713344 - DNA, 20 bp, Homo sapiens
aggtgtgctctgatcatcca

SEQ ID NO: 4713345 - DNA, 15 bp, Homo sapiens
aggtgttggtgacaa

SEQ ID NO: 4713346 - DNA, 18 bp, Homo sapiens
aggtgttggtgacaattg

SEQ ID NO: 4713347 - DNA, 20 bp, Homo sapiens
aggttaattctctagggcta

SEQ ID NO: 4713348 - DNA, 20 bp, Homo sapiens
aggttagaacctagaagggc

SEQ ID NO: 4713349 - DNA, 17 bp, Homo sapiens
aggttatcgaaataaca

SEQ ID NO: 4713350 - DNA, 20 bp, Homo sapiens
aggttatcgaaataacaatg

SEQ ID NO: 4713351 - DNA, 17 bp, Homo sapiens
aggttatctgtcccagg

SEQ ID NO: 4713352 - DNA, 13 bp, Homo sapiens
aggttcagcttgt

SEQ ID NO: 4713353 - DNA, 18 bp, Homo sapiens
aggttccgcttggagcag

SEQ ID NO: 4713354 - DNA, 22 bp, Homo sapiens
aggttctctcctccccaaggag

SEQ ID NO: 4713355 - DNA, 18 bp, Homo sapiens
aggttggaagctagctcc

SEQ ID NO: 4713356 - DNA, 19 bp, Homo sapiens
aggttggaagctagctccc

SEQ ID NO: 4713357 - DNA, 15 bp, Homo sapiens
aggtttataaagcag

SEQ ID NO: 4713358 - DNA, 16 bp, Homo sapiens
aggtttataaagcaga

SEQ ID NO: 4713359 - DNA, 19 bp, Homo sapiens
aggtttctcaaagaaattt

SEQ ID NO: 4713360 - DNA, 15 bp, Homo sapiens
aggtttctgaaaatt

SEQ ID NO: 4713361 - DNA, 23 bp, Homo sapiens
aggtttctgaaaattaacactgc

SEQ ID NO: 4713362 - DNA, 22 bp, Homo sapiens
aggtttctggtctctaggctgg

SEQ ID NO: 4713363 - DNA, 14 bp, Homo sapiens
aggtttcttgcttc

SEQ ID NO: 4713364 - DNA, 14 bp, Homo sapiens
aggttttattttgt

SEQ ID NO: 4713365 - DNA, 15 bp, Homo sapiens
aggttttctgtgttt

SEQ ID NO: 4713366 - DNA, 23 bp, Homo sapiens
aggttttctgtgtttagctattt

SEQ ID NO: 4713367 - DNA, 12 bp, Homo sapiens
agtaaaaataaa

SEQ ID NO: 4713368 - DNA, 15 bp, Homo sapiens
agtaaaaataaaatt

SEQ ID NO: 4713369 - DNA, 12 bp, Homo sapiens
agtaaaagtcat

SEQ ID NO: 4713370 - DNA, 15 bp, Homo sapiens
agtaaaagtcataaa

SEQ ID NO: 4713371 - DNA, 16 bp, Homo sapiens
agtaaaggcaaactta

SEQ ID NO: 4713372 - DNA, 22 bp, Homo sapiens
agtaaattttgtgatgaataaa

SEQ ID NO: 4713373 - DNA, 19 bp, Homo sapiens
agtaagtagcaaccctgtg

SEQ ID NO: 4713374 - DNA, 16 bp, Homo sapiens
agtaagttatctttga

SEQ ID NO: 4713375 - DNA, 18 bp, Homo sapiens
agtaatacaggattattt

SEQ ID NO: 4713376 - DNA, 16 bp, Homo sapiens
agtaatttctaaagca

SEQ ID NO: 4713377 - DNA, 18 bp, Homo sapiens
agtacaggttttgccctg

SEQ ID NO: 4713378 - DNA, 15 bp, Homo sapiens
agtacagtcttatca

SEQ ID NO: 4713379 - DNA, 14 bp, Homo sapiens
agtacatgttaaac

SEQ ID NO: 4713380 - DNA, 22 bp, Homo sapiens
agtacccaaaagctcagccagc

SEQ ID NO: 4713381 - DNA, 12 bp, Homo sapiens
agtacctcctgt

SEQ ID NO: 4713382 - DNA, 16 bp, Homo sapiens
agtacgaacctacagt

SEQ ID NO: 4713383 - DNA, 18 bp, Homo sapiens
agtacgaacctacagttt

SEQ ID NO: 4713384 - DNA, 19 bp, Homo sapiens
agtactacagtcctcccat

SEQ ID NO: 4713385 - DNA, 15 bp, Homo sapiens
agtactcaaattcaa

SEQ ID NO: 4713386 - DNA, 22 bp, Homo sapiens
agtacttctccaccctgctctc

SEQ ID NO: 4713387 - DNA, 21 bp, Homo sapiens
agtagaaagacagagctggga

SEQ ID NO: 4713388 - DNA, 18 bp, Homo sapiens
agtagagcttgtaataaa

SEQ ID NO: 4713389 - DNA, 13 bp, Homo sapiens
agtagctgggact

SEQ ID NO: 4713390 - DNA, 14 bp, Homo sapiens
agtagctgggacta

SEQ ID NO: 4713391 - DNA, 19 bp, Homo sapiens
agtagctgggactacaggc

SEQ ID NO: 4713392 - DNA, 22 bp, Homo sapiens
agtagctgggactacaggcacc

SEQ ID NO: 4713393 - DNA, 16 bp, Homo sapiens
agtaggaagactttgg

SEQ ID NO: 4713394 - DNA, 13 bp, Homo sapiens
agtaggagcccag

SEQ ID NO: 4713395 - DNA, 22 bp, Homo sapiens
agtaggcttttaccattagcat

SEQ ID NO: 4713396 - DNA, 22 bp, Homo sapiens
agtagggaaaatagggtccttg

SEQ ID NO: 4713397 - DNA, 20 bp, Homo sapiens
agtaggttggaagctagctc

SEQ ID NO: 4713398 - DNA, 22 bp, Homo sapiens
agtataaaatagtatgaaaatg

SEQ ID NO: 4713399 - DNA, 19 bp, Homo sapiens
agtataaattcgctgtgag

SEQ ID NO: 4713400 - DNA, 13 bp, Homo sapiens
agtataacaaact

SEQ ID NO: 4713401 - DNA, 16 bp, Homo sapiens
agtataagatttttga

SEQ ID NO: 4713402 - DNA, 18 bp, Homo sapiens
agtatatctaatggctgt

SEQ ID NO: 4713403 - DNA, 13 bp, Homo sapiens
agtatatttggtt

SEQ ID NO: 4713404 - DNA, 14 bp, Homo sapiens
agtatcttcatgta

SEQ ID NO: 4713405 - DNA, 19 bp, Homo sapiens
agtatgaaaatggaaattt

SEQ ID NO: 4713406 - DNA, 18 bp, Homo sapiens
agtatgggttagggaaaa

SEQ ID NO: 4713407 - DNA, 15 bp, Homo sapiens
agtatggtggctggg

SEQ ID NO: 4713408 - DNA, 16 bp, Homo sapiens
agtatggtggctgggt

SEQ ID NO: 4713409 - DNA, 15 bp, Homo sapiens
agtattagacttcta

SEQ ID NO: 4713410 - DNA, 16 bp, Homo sapiens
agtattctccatcctc

SEQ ID NO: 4713411 - DNA, 21 bp, Homo sapiens
agtattgaaaaattatcagtt

SEQ ID NO: 4713412 - DNA, 22 bp, Homo sapiens
agtattgcagtctaaaacttca

SEQ ID NO: 4713413 - DNA, 19 bp, Homo sapiens
agtattgttctatttttgt

SEQ ID NO: 4713414 - DNA, 16 bp, Homo sapiens
agtattgtttacatta

SEQ ID NO: 4713415 - DNA, 20 bp, Homo sapiens
agtatttcaaattggagctt

SEQ ID NO: 4713416 - DNA, 15 bp, Homo sapiens
agtcaacctgggcaa

SEQ ID NO: 4713417 - DNA, 18 bp, Homo sapiens
agtcaagggtagggtggg

SEQ ID NO: 4713418 - DNA, 20 bp, Homo sapiens
agtcaagtgcgtccacgagc

SEQ ID NO: 4713419 - DNA, 12 bp, Homo sapiens
agtcaatttgct

SEQ ID NO: 4713420 - DNA, 14 bp, Homo sapiens
agtcaatttgctga

SEQ ID NO: 4713421 - DNA, 15 bp, Homo sapiens
agtcaatttgctgaa

SEQ ID NO: 4713422 - DNA, 22 bp, Homo sapiens
agtcacacagtattacttctgc

SEQ ID NO: 4713423 - DNA, 15 bp, Homo sapiens
agtcacacagtgagt

SEQ ID NO: 4713424 - DNA, 22 bp, Homo sapiens
agtcacagagataattctagct

SEQ ID NO: 4713425 - DNA, 16 bp, Homo sapiens
agccccgaggccttct

SEQ ID NO: 4713426 - DNA, 16 bp, Homo sapiens
agcccctgctggctgg

SEQ ID NO: 4713427 - DNA, 22 bp, Homo sapiens
agcccctggatgcagcctcaca

SEQ ID NO: 4713428 - DNA, 15 bp, Homo sapiens
agccccttctgaccc

SEQ ID NO: 4713429 - DNA, 24 bp, Homo sapiens
agccccttctgacccatgctgccc

SEQ ID NO: 4713430 - DNA, 15 bp, Homo sapiens
agcccgggctctgcc

SEQ ID NO: 4713431 - DNA, 20 bp, Homo sapiens
agccctagggtggagagcca

SEQ ID NO: 4713432 - DNA, 22 bp, Homo sapiens
agccctcacccctggttctcat

SEQ ID NO: 4713433 - DNA, 21 bp, Homo sapiens
agccctccatctaaactgccc

SEQ ID NO: 4713434 - DNA, 18 bp, Homo sapiens
agccctgctgctgcctgc

SEQ ID NO: 4713435 - DNA, 13 bp, Homo sapiens
agccctggctgaa

SEQ ID NO: 4713436 - DNA, 21 bp, Homo sapiens
agccctggctgaaggactgtg

SEQ ID NO: 4713437 - DNA, 16 bp, Homo sapiens
agcccttagcagggaa

SEQ ID NO: 4713438 - DNA, 23 bp, Homo sapiens
agcccttgggggtcctcctccag

SEQ ID NO: 4713439 - DNA, 18 bp, Homo sapiens
agccgagatcacgccact

SEQ ID NO: 4713440 - DNA, 20 bp, Homo sapiens
agccgagatcacgccactgc

SEQ ID NO: 4713441 - DNA, 15 bp, Homo sapiens
agccgctgagcgagg

SEQ ID NO: 4713442 - DNA, 19 bp, Homo sapiens
agccgctgagcgaggagat

SEQ ID NO: 4713443 - DNA, 12 bp, Homo sapiens
agccgctgcccg

SEQ ID NO: 4713444 - DNA, 17 bp, Homo sapiens
agccgctgcccggcgcc

SEQ ID NO: 4713445 - DNA, 13 bp, Homo sapiens
agccgctggggcc

SEQ ID NO: 4713446 - DNA, 16 bp, Homo sapiens
agccggacacttctca

SEQ ID NO: 4713447 - DNA, 19 bp, Homo sapiens
agccggacacttctcagga

SEQ ID NO: 4713448 - DNA, 20 bp, Homo sapiens
agccgggtctgcctcttctg

SEQ ID NO: 4713449 - DNA, 20 bp, Homo sapiens
agcctaacccccagcccctc

SEQ ID NO: 4713450 - DNA, 17 bp, Homo sapiens
agcctaggtgacagagt

SEQ ID NO: 4713451 - DNA, 14 bp, Homo sapiens
agcctagtgaaggc

SEQ ID NO: 4713452 - DNA, 15 bp, Homo sapiens
agcctcaacctcctg

SEQ ID NO: 4713453 - DNA, 19 bp, Homo sapiens
agcctcaataagccttgtc

SEQ ID NO: 4713454 - DNA, 20 bp, Homo sapiens
agcctcagagacatcagccc

SEQ ID NO: 4713455 - DNA, 23 bp, Homo sapiens
agcctcagagacatcagcccttg

SEQ ID NO: 4713456 - DNA, 17 bp, Homo sapiens
agcctcagcatcctggc

SEQ ID NO: 4713457 - DNA, 13 bp, Homo sapiens
agcctcagtctcc

SEQ ID NO: 4713458 - DNA, 14 bp, Homo sapiens
agcctcatgctctg

SEQ ID NO: 4713459 - DNA, 17 bp, Homo sapiens
agcctcatgctctgatt

SEQ ID NO: 4713460 - DNA, 22 bp, Homo sapiens
agcctccaccccacaacccaaa

SEQ ID NO: 4713461 - DNA, 17 bp, Homo sapiens
agcctcccaaagtgctg

SEQ ID NO: 4713462 - DNA, 14 bp, Homo sapiens
agcctcccctgcca

SEQ ID NO: 4713463 - DNA, 16 bp, Homo sapiens
agcctcccctgccagg

SEQ ID NO: 4713464 - DNA, 18 bp, Homo sapiens
agcctcccctgccagggc

SEQ ID NO: 4713465 - DNA, 18 bp, Homo sapiens
agcctcccgagtagctgg

SEQ ID NO: 4713466 - DNA, 16 bp, Homo sapiens
agcctcgatgtcctcc

SEQ ID NO: 4713467 - DNA, 20 bp, Homo sapiens
agcctcgatgtcctcctctg

SEQ ID NO: 4713468 - DNA, 22 bp, Homo sapiens
agcctcgatgtcctcctctgtg

SEQ ID NO: 4713469 - DNA, 22 bp, Homo sapiens
agcctctagggacccctcctcc

SEQ ID NO: 4713470 - DNA, 12 bp, Homo sapiens
agcctctctttg

SEQ ID NO: 4713471 - DNA, 13 bp, Homo sapiens
agcctctgtgtca

SEQ ID NO: 4713472 - DNA, 14 bp, Homo sapiens
agcctctgtgtcac

SEQ ID NO: 4713473 - DNA, 19 bp, Homo sapiens
agcctgatcacctgccctg

SEQ ID NO: 4713474 - DNA, 10 bp, Homo sapiens
agcctgctca

SEQ ID NO: 4713475 - DNA, 13 bp, Homo sapiens
agcctggcccagc

SEQ ID NO: 4713476 - DNA, 17 bp, Homo sapiens
agcctggccccatggtc

SEQ ID NO: 4713477 - DNA, 22 bp, Homo sapiens
agcctggctccaaaccctcgag

SEQ ID NO: 4713478 - DNA, 16 bp, Homo sapiens
agcctgggggctcctc

SEQ ID NO: 4713479 - DNA, 20 bp, Homo sapiens
agccttagaagtcacacagt

SEQ ID NO: 4713480 - DNA, 11 bp, Homo sapiens
agccttccagg

SEQ ID NO: 4713481 - DNA, 18 bp, Homo sapiens
agccttccaggggtggga

SEQ ID NO: 4713482 - DNA, 19 bp, Homo sapiens
agccttgaccattctccac

SEQ ID NO: 4713483 - DNA, 18 bp, Homo sapiens
agcgcacccagagaaaat

SEQ ID NO: 4713484 - DNA, 18 bp, Homo sapiens
agcgcacgcgcgcacaca

SEQ ID NO: 4713485 - DNA, 19 bp, Homo sapiens
agcgcacgcgcgcacacac

SEQ ID NO: 4713486 - DNA, 15 bp, Homo sapiens
agcgcagagcgggct

SEQ ID NO: 4713487 - DNA, 16 bp, Homo sapiens
agcgcagagcgggctc

SEQ ID NO: 4713488 - DNA, 14 bp, Homo sapiens
agcgcccagttggg

SEQ ID NO: 4713489 - DNA, 22 bp, Homo sapiens
agcgctcctgccgcagagctgg

SEQ ID NO: 4713490 - DNA, 22 bp, Homo sapiens
agcgctggccgggaccccgagc

SEQ ID NO: 4713491 - DNA, 22 bp, Homo sapiens
agcggaaaaggttttattttgt

SEQ ID NO: 4713492 - DNA, 18 bp, Homo sapiens
agcggagacggagtccca

SEQ ID NO: 4713493 - DNA, 18 bp, Homo sapiens
agcggctgtttactgctt

SEQ ID NO: 4713494 - DNA, 21 bp, Homo sapiens
agcgggctcgaagaaaataat

SEQ ID NO: 4713495 - DNA, 15 bp, Homo sapiens
agcggggacagctcc

SEQ ID NO: 4713496 - DNA, 17 bp, Homo sapiens
agcggggacagctcctt

SEQ ID NO: 4713497 - DNA, 22 bp, Homo sapiens
agcggggacagctccttctgtc

SEQ ID NO: 4713498 - DNA, 17 bp, Homo sapiens
agcgtcctcctctgtga

SEQ ID NO: 4713499 - DNA, 13 bp, Homo sapiens
agcgtgagccact

SEQ ID NO: 4713500 - DNA, 16 bp, Homo sapiens
agcgtgcgtctgtgtg

SEQ ID NO: 4713501 - DNA, 15 bp, Homo sapiens
agcgtggacaggtgt

SEQ ID NO: 4713502 - DNA, 20 bp, Homo sapiens
agctaaaagcatggccctgc

SEQ ID NO: 4713503 - DNA, 22 bp, Homo sapiens
agctaaaagcatggccctgctg

SEQ ID NO: 4713504 - DNA, 16 bp, Homo sapiens
agctaacacacagctc

SEQ ID NO: 4713505 - DNA, 18 bp, Homo sapiens
agctaacacacagctccc

SEQ ID NO: 4713506 - DNA, 12 bp, Homo sapiens
agctaattattt

SEQ ID NO: 4713507 - DNA, 13 bp, Homo sapiens
agctacaaatgca

SEQ ID NO: 4713508 - DNA, 13 bp, Homo sapiens
agctacttgggcc

SEQ ID NO: 4713509 - DNA, 15 bp, Homo sapiens
agctacttgggccat

SEQ ID NO: 4713510 - DNA, 15 bp, Homo sapiens
agctactttccattt

SEQ ID NO: 4713511 - DNA, 21 bp, Homo sapiens
agctactttccatttggtatt

SEQ ID NO: 4713512 - DNA, 11 bp, Homo sapiens
agctagaaatg

SEQ ID NO: 4713513 - DNA, 17 bp, Homo sapiens
agctagctcccctcctc

SEQ ID NO: 4713514 - DNA, 12 bp, Homo sapiens
agctaggcctgg

SEQ ID NO: 4713515 - DNA, 15 bp, Homo sapiens
agctaggcctggcca

SEQ ID NO: 4713516 - DNA, 15 bp, Homo sapiens
agctatcctggctct

SEQ ID NO: 4713517 - DNA, 16 bp, Homo sapiens
agctatcctggctctt

SEQ ID NO: 4713518 - DNA, 19 bp, Homo sapiens
agctatggtgtcataggct

SEQ ID NO: 4713519 - DNA, 18 bp, Homo sapiens
agctatgttatattgaaa

SEQ ID NO: 4713520 - DNA, 22 bp, Homo sapiens
agctatgttatattgaaaaaat

SEQ ID NO: 4713521 - DNA, 11 bp, Homo sapiens
agctatttaat

SEQ ID NO: 4713522 - DNA, 16 bp, Homo sapiens
agctatttctatgtat

SEQ ID NO: 4713523 - DNA, 22 bp, Homo sapiens
agctcaaagcgtggacaggtgt

SEQ ID NO: 4713524 - DNA, 14 bp, Homo sapiens
agctcaccagcccc

SEQ ID NO: 4713525 - DNA, 21 bp, Homo sapiens
agctcaccagccccagtgccc

SEQ ID NO: 4713526 - DNA, 23 bp, Homo sapiens
agctcaccagccccagtgcccac

SEQ ID NO: 4713527 - DNA, 12 bp, Homo sapiens
agctcagagagg

SEQ ID NO: 4713528 - DNA, 21 bp, Homo sapiens
agctcagagagggcaggcatg

SEQ ID NO: 4713529 - DNA, 13 bp, Homo sapiens
agctcagggcctg

SEQ ID NO: 4713530 - DNA, 17 bp, Homo sapiens
agctcaggtgtccctgc

SEQ ID NO: 4713531 - DNA, 18 bp, Homo sapiens
agctcaggtgtccctgca

SEQ ID NO: 4713532 - DNA, 16 bp, Homo sapiens
aggaatcattctgtaa

SEQ ID NO: 4713533 - DNA, 16 bp, Homo sapiens
aggaatccactcccag

SEQ ID NO: 4713534 - DNA, 23 bp, Homo sapiens
aggaattaagttagggaatggca

SEQ ID NO: 4713535 - DNA, 14 bp, Homo sapiens
aggaatttataaca

SEQ ID NO: 4713536 - DNA, 18 bp, Homo sapiens
aggacaaaataaagtgtg

SEQ ID NO: 4713537 - DNA, 13 bp, Homo sapiens
agaggggcctgcc

SEQ ID NO: 4713538 - DNA, 20 bp, Homo sapiens
agaggggcctgccacctgga

SEQ ID NO: 4713539 - DNA, 21 bp, Homo sapiens
agaggggctgaatagcagaag

SEQ ID NO: 4713540 - DNA, 17 bp, Homo sapiens
agagggggtggcctccc

SEQ ID NO: 4713541 - DNA, 19 bp, Homo sapiens
agagggggtggcctcccaa

SEQ ID NO: 4713542 - DNA, 20 bp, Homo sapiens
agagggtctgaggaatccag

SEQ ID NO: 4713543 - DNA, 19 bp, Homo sapiens
agagggtggtgacctctgc

SEQ ID NO: 4713544 - DNA, 23 bp, Homo sapiens
agagggtggtgacctctgcctga

SEQ ID NO: 4713545 - DNA, 17 bp, Homo sapiens
agaggttatctgtccca

SEQ ID NO: 4713546 - DNA, 20 bp, Homo sapiens
agaggttatctgtcccaggt

SEQ ID NO: 4713547 - DNA, 21 bp, Homo sapiens
agagtatggagctcagagagg

SEQ ID NO: 4713548 - DNA, 13 bp, Homo sapiens
agagtatttctgg

SEQ ID NO: 4713549 - DNA, 17 bp, Homo sapiens
agagtcaatttgctgaa

SEQ ID NO: 4713550 - DNA, 14 bp, Homo sapiens
agagtgtagaagca

SEQ ID NO: 4713551 - DNA, 15 bp, Homo sapiens
agagtgtagaagcat

SEQ ID NO: 4713552 - DNA, 17 bp, Homo sapiens
agagtgtagaagcattc

SEQ ID NO: 4713553 - DNA, 18 bp, Homo sapiens
agagtgtagaagcattcc

SEQ ID NO: 4713554 - DNA, 14 bp, Homo sapiens
agagttaagaagct

SEQ ID NO: 4713555 - DNA, 15 bp, Homo sapiens
agagttaagaagctg

SEQ ID NO: 4713556 - DNA, 16 bp, Homo sapiens
agagttcgtgaagagg

SEQ ID NO: 4713557 - DNA, 18 bp, Homo sapiens
agagttcgtgaagaggga

SEQ ID NO: 4713558 - DNA, 19 bp, Homo sapiens
agagttcgtgaagagggaa

SEQ ID NO: 4713559 - DNA, 16 bp, Homo sapiens
agagtttactgatgaa

SEQ ID NO: 4713560 - DNA, 13 bp, Homo sapiens
agataaaaatcag

SEQ ID NO: 4713561 - DNA, 17 bp, Homo sapiens
agataagggtatctggt

SEQ ID NO: 4713562 - DNA, 19 bp, Homo sapiens
agataagggtatctggtga

SEQ ID NO: 4713563 - DNA, 14 bp, Homo sapiens
agataataaattga

SEQ ID NO: 4713564 - DNA, 12 bp, Homo sapiens
agataatgtgaa

SEQ ID NO: 4713565 - DNA, 18 bp, Homo sapiens
agataattctagctttga

SEQ ID NO: 4713566 - DNA, 15 bp, Homo sapiens
agatataaaagactg

SEQ ID NO: 4713567 - DNA, 17 bp, Homo sapiens
agatatatttaagcctt

SEQ ID NO: 4713568 - DNA, 21 bp, Homo sapiens
agatatcatactgatttttaa

SEQ ID NO: 4713569 - DNA, 23 bp, Homo sapiens
agatatcatactgatttttaagt

SEQ ID NO: 4713570 - DNA, 17 bp, Homo sapiens
agatatcctctgcttaa

SEQ ID NO: 4713571 - DNA, 13 bp, Homo sapiens
agatatctatgac

SEQ ID NO: 4713572 - DNA, 23 bp, Homo sapiens
agatatctatgactgtgtttaat

SEQ ID NO: 4713573 - DNA, 12 bp, Homo sapiens
agatcaaagatg

SEQ ID NO: 4713574 - DNA, 19 bp, Homo sapiens
agatcaaccccttcgctcc

SEQ ID NO: 4713575 - DNA, 16 bp, Homo sapiens
agatcaaggagaggag

SEQ ID NO: 4713576 - DNA, 19 bp, Homo sapiens
agatcacaccactgtactc

SEQ ID NO: 4713577 - DNA, 15 bp, Homo sapiens
agatcacgccactgc

SEQ ID NO: 4713578 - DNA, 18 bp, Homo sapiens
agatcaggcagtgtttaa

SEQ ID NO: 4713579 - DNA, 22 bp, Homo sapiens
agatcctaaaacaaaagctcat

SEQ ID NO: 4713580 - DNA, 11 bp, Homo sapiens
agatgaaaacc

SEQ ID NO: 4713581 - DNA, 18 bp, Homo sapiens
agatgaaaccgtccctga

SEQ ID NO: 4713582 - DNA, 23 bp, Homo sapiens
agatgaaatcttacagctgggtg

SEQ ID NO: 4713583 - DNA, 19 bp, Homo sapiens
agatgcagagagccatttt

SEQ ID NO: 4713584 - DNA, 20 bp, Homo sapiens
agatgctccttgggcccttt

SEQ ID NO: 4713585 - DNA, 23 bp, Homo sapiens
agatggacttggggcctctgacg

SEQ ID NO: 4713586 - DNA, 15 bp, Homo sapiens
agatgtatatttgca

SEQ ID NO: 4713587 - DNA, 20 bp, Homo sapiens
agatgtatgctttgaatgca

SEQ ID NO: 4713588 - DNA, 15 bp, Homo sapiens
agatgtccctgaagt

SEQ ID NO: 4713589 - DNA, 22 bp, Homo sapiens
agatgtcgctgggtcctctgca

SEQ ID NO: 4713590 - DNA, 15 bp, Homo sapiens
agatgtctctgtgtg

SEQ ID NO: 4713591 - DNA, 15 bp, Homo sapiens
agatgtgtgttgata

SEQ ID NO: 4713592 - DNA, 17 bp, Homo sapiens
agatgttcagtcatttt

SEQ ID NO: 4713593 - DNA, 15 bp, Homo sapiens
agatgtttatttcag

SEQ ID NO: 4713594 - DNA, 18 bp, Homo sapiens
agattaatagcattcgaa

SEQ ID NO: 4713595 - DNA, 11 bp, Homo sapiens
agattaggatt

SEQ ID NO: 4713596 - DNA, 13 bp, Homo sapiens
agattaggattaa

SEQ ID NO: 4713597 - DNA, 20 bp, Homo sapiens
agattataggcacctaccac

SEQ ID NO: 4713598 - DNA, 12 bp, Homo sapiens
agattatttctg

SEQ ID NO: 4713599 - DNA, 13 bp, Homo sapiens
agattatttctgt

SEQ ID NO: 4713600 - DNA, 17 bp, Homo sapiens
agattgcaacaggctgg

SEQ ID NO: 4713601 - DNA, 20 bp, Homo sapiens
agattgcaacaggctgggct

SEQ ID NO: 4713602 - DNA, 21 bp, Homo sapiens
agattgcaacaggctgggctt

SEQ ID NO: 4713603 - DNA, 20 bp, Homo sapiens
agattgtgatcccttgagat

SEQ ID NO: 4713604 - DNA, 13 bp, Homo sapiens
agattgttttcag

SEQ ID NO: 4713605 - DNA, 15 bp, Homo sapiens
agatttcatctgctc

SEQ ID NO: 4713606 - DNA, 18 bp, Homo sapiens
agatttcatctgctctcc

SEQ ID NO: 4713607 - DNA, 20 bp, Homo sapiens
agatttcatctgctctcctt

SEQ ID NO: 4713608 - DNA, 12 bp, Homo sapiens
agatttgaccta

SEQ ID NO: 4713609 - DNA, 19 bp, Homo sapiens
agattttatacccttgact

SEQ ID NO: 4713610 - DNA, 20 bp, Homo sapiens
agcaaaatcaagcaagcctc

SEQ ID NO: 4713611 - DNA, 23 bp, Homo sapiens
agcaaaggagtagaaagacagag

SEQ ID NO: 4713612 - DNA, 19 bp, Homo sapiens
agcaaaggctgagaacact

SEQ ID NO: 4713613 - DNA, 16 bp, Homo sapiens
agcaaagtatcaaaga

SEQ ID NO: 4713614 - DNA, 23 bp, Homo sapiens
agcaagacgctgtgctgccctgc

SEQ ID NO: 4713615 - DNA, 20 bp, Homo sapiens
agcaagctcccaagggatgg

SEQ ID NO: 4713616 - DNA, 22 bp, Homo sapiens
agcaagtgtgctggcctctctg

SEQ ID NO: 4713617 - DNA, 16 bp, Homo sapiens
agcaatgctgtgaata

SEQ ID NO: 4713618 - DNA, 15 bp, Homo sapiens
agcaattctcctgcc

SEQ ID NO: 4713619 - DNA, 18 bp, Homo sapiens
agcaattctcctgcctca

SEQ ID NO: 4713620 - DNA, 12 bp, Homo sapiens
agcacagaccct

SEQ ID NO: 4713621 - DNA, 20 bp, Homo sapiens
agcacagaccctgccctgtg

SEQ ID NO: 4713622 - DNA, 10 bp, Homo sapiens
agcacagccc

SEQ ID NO: 4713623 - DNA, 13 bp, Homo sapiens
agcacagccctcc

SEQ ID NO: 4713624 - DNA, 14 bp, Homo sapiens
agcacagccctccc

SEQ ID NO: 4713625 - DNA, 15 bp, Homo sapiens
agcacagccctcccg

SEQ ID NO: 4713626 - DNA, 18 bp, Homo sapiens
agcacagttccttgcatg

SEQ ID NO: 4713627 - DNA, 20 bp, Homo sapiens
agcacatgccagggaaaaag

SEQ ID NO: 4713628 - DNA, 10 bp, Homo sapiens
agcaccaggg

SEQ ID NO: 4713629 - DNA, 19 bp, Homo sapiens
agcaccggaccagcctggc

SEQ ID NO: 4713630 - DNA, 21 bp, Homo sapiens
agcacctacagtgtacagtct

SEQ ID NO: 4713631 - DNA, 14 bp, Homo sapiens
agcacctcctgcct

SEQ ID NO: 4713632 - DNA, 19 bp, Homo sapiens
agcactaaggtgtgctctg

SEQ ID NO: 4713633 - DNA, 18 bp, Homo sapiens
agcactagacatgtcatg

SEQ ID NO: 4713634 - DNA, 23 bp, Homo sapiens
agcactgactagggaaatgatca

SEQ ID NO: 4713635 - DNA, 21 bp, Homo sapiens
agcactgaggaagaacggggc

SEQ ID NO: 4713636 - DNA, 20 bp, Homo sapiens
agcactgcacactcagttct

SEQ ID NO: 4713637 - DNA, 19 bp, Homo sapiens
agcactgtgctcagggcta

SEQ ID NO: 4713638 - DNA, 15 bp, Homo sapiens
agcactttgcaagga

SEQ ID NO: 4713639 - DNA, 19 bp, Homo sapiens
agcactttgcaaggaatgt

SEQ ID NO: 4713640 - DNA, 13 bp, Homo sapiens
agcagaaaataca

SEQ ID NO: 4713641 - DNA, 19 bp, Homo sapiens
agcagaaaatacagctgga

SEQ ID NO: 4713642 - DNA, 23 bp, Homo sapiens
agcagaagggggtggtgtctcca

SEQ ID NO: 4713643 - DNA, 16 bp, Homo sapiens
actgctatagcctaag

SEQ ID NO: 4713644 - DNA, 12 bp, Homo sapiens
actgctccaaat

SEQ ID NO: 4713645 - DNA, 18 bp, Homo sapiens
actgcttccagtgaggct

SEQ ID NO: 4713646 - DNA, 22 bp, Homo sapiens
actgcttccagtgaggctctgc

SEQ ID NO: 4713647 - DNA, 23 bp, Homo sapiens
actgcttccagtgaggctctgcc

SEQ ID NO: 4713648 - DNA, 15 bp, Homo sapiens
actgcttgaggaaaa

SEQ ID NO: 4713649 - DNA, 18 bp, Homo sapiens
actgcttgaggaaaacaa

SEQ ID NO: 4713650 - DNA, 14 bp, Homo sapiens
actgcttttcatta

SEQ ID NO: 4713651 - DNA, 20 bp, Homo sapiens
actgcttttggtctgtgtga

SEQ ID NO: 4713652 - DNA, 18 bp, Homo sapiens
actggaaggtggggacag

SEQ ID NO: 4713653 - DNA, 18 bp, Homo sapiens
actggactcaggaacttt

SEQ ID NO: 4713654 - DNA, 17 bp, Homo sapiens
actggagaggctagaac

SEQ ID NO: 4713655 - DNA, 20 bp, Homo sapiens
agaaaaatattaataagaca

SEQ ID NO: 4713656 - DNA, 20 bp, Homo sapiens
agaaaagggaactgaacatt

SEQ ID NO: 4713657 - DNA, 18 bp, Homo sapiens
agaaaataattctctatt

SEQ ID NO: 4713658 - DNA, 13 bp, Homo sapiens
agaaaatgaattt

SEQ ID NO: 4713659 - DNA, 15 bp, Homo sapiens
agaaaatgaatttgg

SEQ ID NO: 4713660 - DNA, 24 bp, Homo sapiens
agaaaatgtgtctgcaacatggat

SEQ ID NO: 4713661 - DNA, 20 bp, Homo sapiens
agaaaattaattatatttct

SEQ ID NO: 4713662 - DNA, 20 bp, Homo sapiens
agaaaattttttttcaaaaa

SEQ ID NO: 4713663 - DNA, 17 bp, Homo sapiens
agaaacaactctttgag

SEQ ID NO: 4713664 - DNA, 18 bp, Homo sapiens
agaccccagatgtgaggg

SEQ ID NO: 4713665 - DNA, 15 bp, Homo sapiens
agaccctctcaggct

SEQ ID NO: 4713666 - DNA, 17 bp, Homo sapiens
agaccctctcaggctgt

SEQ ID NO: 4713667 - DNA, 12 bp, Homo sapiens
agaccctgccct

SEQ ID NO: 4713668 - DNA, 13 bp, Homo sapiens
agacccttgtggt

SEQ ID NO: 4713669 - DNA, 22 bp, Homo sapiens
agacccttgtggtcccacccca

SEQ ID NO: 4713670 - DNA, 23 bp, Homo sapiens
agacccttgtggtcccaccccac

SEQ ID NO: 4713671 - DNA, 19 bp, Homo sapiens
agacctaacgagaaataga

SEQ ID NO: 4713672 - DNA, 17 bp, Homo sapiens
agacctcagatgtgttg

SEQ ID NO: 4713673 - DNA, 17 bp, Homo sapiens
agacctgctctggacac

SEQ ID NO: 4713674 - DNA, 16 bp, Homo sapiens
agaccttctgatctcc

SEQ ID NO: 4713675 - DNA, 21 bp, Homo sapiens
agacgacaaggaaaggcaaat

SEQ ID NO: 4713676 - DNA, 17 bp, Homo sapiens
agacgctgtgctgccct

SEQ ID NO: 4713677 - DNA, 16 bp, Homo sapiens
agactaaaagttgcat

SEQ ID NO: 4713678 - DNA, 19 bp, Homo sapiens
agactaattcctgccctgc

SEQ ID NO: 4713679 - DNA, 14 bp, Homo sapiens
agactcaaagaata

SEQ ID NO: 4713680 - DNA, 15 bp, Homo sapiens
agactcattcttctg

SEQ ID NO: 4713681 - DNA, 21 bp, Homo sapiens
agactccagctgggttggaaa

SEQ ID NO: 4713682 - DNA, 22 bp, Homo sapiens
agactcctaggcaggacatgct

SEQ ID NO: 4713683 - DNA, 14 bp, Homo sapiens
agactcctgcaggc

SEQ ID NO: 4713684 - DNA, 17 bp, Homo sapiens
agactcctgcaggcagc

SEQ ID NO: 4713685 - DNA, 19 bp, Homo sapiens
agactcctgcaggcagcca

SEQ ID NO: 4713686 - DNA, 23 bp, Homo sapiens
agactcctgcaggcagccaggcc

SEQ ID NO: 4713687 - DNA, 14 bp, Homo sapiens
agactcgagaactt

SEQ ID NO: 4713688 - DNA, 18 bp, Homo sapiens
agactcgagaactttcat

SEQ ID NO: 4713689 - DNA, 19 bp, Homo sapiens
agactggaagcacagcttc

SEQ ID NO: 4713690 - DNA, 11 bp, Homo sapiens
agactggaagg

SEQ ID NO: 4713691 - DNA, 12 bp, Homo sapiens
agactgggctga

SEQ ID NO: 4713692 - DNA, 14 bp, Homo sapiens
agactgggctgagg

SEQ ID NO: 4713693 - DNA, 20 bp, Homo sapiens
agactgggctgagggagcct

SEQ ID NO: 4713694 - DNA, 21 bp, Homo sapiens
agactgtaacttccaaataaa

SEQ ID NO: 4713695 - DNA, 23 bp, Homo sapiens
agacttaatagaaacattgaaga

SEQ ID NO: 4713696 - DNA, 15 bp, Homo sapiens
agacttgggacattg

SEQ ID NO: 4713697 - DNA, 17 bp, Homo sapiens
agactttggaaagactt

SEQ ID NO: 4713698 - DNA, 15 bp, Homo sapiens
agacttttccaaccc

SEQ ID NO: 4713699 - DNA, 19 bp, Homo sapiens
agactttttttaaatagta

SEQ ID NO: 4713700 - DNA, 13 bp, Homo sapiens
agagaaaaacaaa

SEQ ID NO: 4713701 - DNA, 13 bp, Homo sapiens
agagaaaatgaat

SEQ ID NO: 4713702 - DNA, 18 bp, Homo sapiens
agagaaagtacttctcca

SEQ ID NO: 4713703 - DNA, 12 bp, Homo sapiens
agagaaggagcc

SEQ ID NO: 4713704 - DNA, 13 bp, Homo sapiens
agagaaggagcca

SEQ ID NO: 4713705 - DNA, 15 bp, Homo sapiens
agagaagtaagcaga

SEQ ID NO: 4713706 - DNA, 19 bp, Homo sapiens
agagaccatccctgaaggc

SEQ ID NO: 4713707 - DNA, 21 bp, Homo sapiens
agagaccatccctgaaggccc

SEQ ID NO: 4713708 - DNA, 22 bp, Homo sapiens
agagaccatccctgaaggcccc

SEQ ID NO: 4713709 - DNA, 23 bp, Homo sapiens
agagaccatccctgaaggccccg

SEQ ID NO: 4713710 - DNA, 12 bp, Homo sapiens
agagactcctgc

SEQ ID NO: 4713711 - DNA, 17 bp, Homo sapiens
agagactcctgcaggca

SEQ ID NO: 4713712 - DNA, 18 bp, Homo sapiens
agagactcctgcaggcag

SEQ ID NO: 4713713 - DNA, 22 bp, Homo sapiens
agagactcctgcaggcagccag

SEQ ID NO: 4713714 - DNA, 23 bp, Homo sapiens
agagactcctgcaggcagccagg

SEQ ID NO: 4713715 - DNA, 22 bp, Homo sapiens
agagactccttgagagaccagg

SEQ ID NO: 4713716 - DNA, 20 bp, Homo sapiens
agagacttgggacattgcct

SEQ ID NO: 4713717 - DNA, 17 bp, Homo sapiens
agagagcagcttctgcc

SEQ ID NO: 4713718 - DNA, 15 bp, Homo sapiens
agagagccattttgt

SEQ ID NO: 4713719 - DNA, 23 bp, Homo sapiens
agagagcttctgttgctgcctca

SEQ ID NO: 4713720 - DNA, 19 bp, Homo sapiens
agagaggacaaaataaagt

SEQ ID NO: 4713721 - DNA, 14 bp, Homo sapiens
agagagggcaggca

SEQ ID NO: 4713722 - DNA, 12 bp, Homo sapiens
agagatgtgtgt

SEQ ID NO: 4713723 - DNA, 14 bp, Homo sapiens
agagatgtgtgttg

SEQ ID NO: 4713724 - DNA, 18 bp, Homo sapiens
agagatgtgtgttgatac

SEQ ID NO: 4713725 - DNA, 22 bp, Homo sapiens
agagatgtgtgttgatactgtt

SEQ ID NO: 4713726 - DNA, 20 bp, Homo sapiens
agagattacctcctgagaaa

SEQ ID NO: 4713727 - DNA, 12 bp, Homo sapiens
agagattagaac

SEQ ID NO: 4713728 - DNA, 23 bp, Homo sapiens
agagcaagacgctgtgctgccct

SEQ ID NO: 4713729 - DNA, 20 bp, Homo sapiens
agagcacacttggcccaagt

SEQ ID NO: 4713730 - DNA, 11 bp, Homo sapiens
agagcacagcc

SEQ ID NO: 4713731 - DNA, 14 bp, Homo sapiens
agagcacagccctc

SEQ ID NO: 4713732 - DNA, 23 bp, Homo sapiens
agagcaccttagacagtccctgc

SEQ ID NO: 4713733 - DNA, 18 bp, Homo sapiens
agagcagagaccatccct

SEQ ID NO: 4713734 - DNA, 14 bp, Homo sapiens
agagcagatgcaga

SEQ ID NO: 4713735 - DNA, 17 bp, Homo sapiens
agagcagtggtaagaat

SEQ ID NO: 4713736 - DNA, 23 bp, Homo sapiens
agagcataatttaaaaatatatt

SEQ ID NO: 4713737 - DNA, 23 bp, Homo sapiens
agagcatgtgaggggtagtggga

SEQ ID NO: 4713738 - DNA, 13 bp, Homo sapiens
agagccatacata

SEQ ID NO: 4713739 - DNA, 16 bp, Homo sapiens
agagccatacataaaa

SEQ ID NO: 4713740 - DNA, 13 bp, Homo sapiens
agagcccacgccc

SEQ ID NO: 4713741 - DNA, 24 bp, Homo sapiens
agagcccagaggtaacagaacagc

SEQ ID NO: 4713742 - DNA, 22 bp, Homo sapiens
agagcctccctcaattccccct

SEQ ID NO: 4713743 - DNA, 14 bp, Homo sapiens
agagcctgagggat

SEQ ID NO: 4713744 - DNA, 19 bp, Homo sapiens
agagcgagagatcaaagat

SEQ ID NO: 4713745 - DNA, 23 bp, Homo sapiens
agagctagaacccggcaggctag

SEQ ID NO: 4713746 - DNA, 18 bp, Homo sapiens
agagctagaacctggaga

SEQ ID NO: 4713747 - DNA, 17 bp, Homo sapiens
agagctatcaggagaaa

SEQ ID NO: 4713748 - DNA, 22 bp, Homo sapiens
agagctgacacaaacctgcctg

SEQ ID NO: 4713749 - DNA, 12 bp, Homo sapiens
agagctggagcc

SEQ ID NO: 4713750 - DNA, 21 bp, Homo sapiens
agagcttaatgataatattgt

SEQ ID NO: 4713751 - DNA, 17 bp, Homo sapiens
agagcttccagagctct

SEQ ID NO: 4713752 - DNA, 17 bp, Homo sapiens
agagcttccctgactca

SEQ ID NO: 4713753 - DNA, 19 bp, Homo sapiens
agagcttctgttgctgcct

SEQ ID NO: 4713754 - DNA, 20 bp, Homo sapiens
agagcttctgttgctgcctc

SEQ ID NO: 4713755 - DNA, 21 bp, Homo sapiens
agaggacttttctttgtggct

SEQ ID NO: 4713756 - DNA, 23 bp, Homo sapiens
agaggacttttctttgtggcttc

SEQ ID NO: 4713757 - DNA, 13 bp, Homo sapiens
agaggaggagaaa

SEQ ID NO: 4713758 - DNA, 22 bp, Homo sapiens
agaggatgagagcccagaggta

SEQ ID NO: 4713759 - DNA, 19 bp, Homo sapiens
agaggcagccccattctgc

SEQ ID NO: 4713760 - DNA, 10 bp, Homo sapiens
agaggcaggg

SEQ ID NO: 4713761 - DNA, 13 bp, Homo sapiens
agaggcagggtct

SEQ ID NO: 4713762 - DNA, 21 bp, Homo sapiens
agaggcagggtctcactctgt

SEQ ID NO: 4713763 - DNA, 14 bp, Homo sapiens
agaggccctcgctg

SEQ ID NO: 4713764 - DNA, 20 bp, Homo sapiens
agaggcctgcctccagggct

SEQ ID NO: 4713765 - DNA, 21 bp, Homo sapiens
agaggcctgcctccagggctg

SEQ ID NO: 4713766 - DNA, 16 bp, Homo sapiens
agagggagggagggct

SEQ ID NO: 4713767 - DNA, 21 bp, Homo sapiens
accttcaaaatgttctattta

SEQ ID NO: 4713768 - DNA, 19 bp, Homo sapiens
accttcaaactagggccaa

SEQ ID NO: 4713769 - DNA, 22 bp, Homo sapiens
accttctaggacgccacccagc

SEQ ID NO: 4713770 - DNA, 23 bp, Homo sapiens
accttctccctcatttcaggagc

SEQ ID NO: 4713771 - DNA, 13 bp, Homo sapiens
accttctccttca

SEQ ID NO: 4713772 - DNA, 20 bp, Homo sapiens
accttctgacgcagcctgag

SEQ ID NO: 4713773 - DNA, 20 bp, Homo sapiens
accttgaagtgactgttgta

SEQ ID NO: 4713774 - DNA, 16 bp, Homo sapiens
accttgctatcaagaa

SEQ ID NO: 4713775 - DNA, 15 bp, Homo sapiens
acctttattcagaac

SEQ ID NO: 4713776 - DNA, 18 bp, Homo sapiens
acctttattcagaacttt

SEQ ID NO: 4713777 - DNA, 22 bp, Homo sapiens
acctttgaaatattaaaatcac

SEQ ID NO: 4713778 - DNA, 14 bp, Homo sapiens
acctttgtccccac

SEQ ID NO: 4713779 - DNA, 18 bp, Homo sapiens
acctttgtccccaccgca

SEQ ID NO: 4713780 - DNA, 15 bp, Homo sapiens
accttttacagaata

SEQ ID NO: 4713781 - DNA, 15 bp, Homo sapiens
accttttcttcaaaa

SEQ ID NO: 4713782 - DNA, 14 bp, Homo sapiens
acgaatacttttgc

SEQ ID NO: 4713783 - DNA, 12 bp, Homo sapiens
acgactgtctcc

SEQ ID NO: 4713784 - DNA, 16 bp, Homo sapiens
acgagacgtttcctac

SEQ ID NO: 4713785 - DNA, 19 bp, Homo sapiens
acgattgacaccaaaatga

SEQ ID NO: 4713786 - DNA, 19 bp, Homo sapiens
acgcacacacacatacaga

SEQ ID NO: 4713787 - DNA, 16 bp, Homo sapiens
acgcacgcacacacac

SEQ ID NO: 4713788 - DNA, 15 bp, Homo sapiens
acgcagcctgagaat

SEQ ID NO: 4713789 - DNA, 20 bp, Homo sapiens
acgcaggcccctctcctccg

SEQ ID NO: 4713790 - DNA, 23 bp, Homo sapiens
acgcaggcccctctcctccgtgg

SEQ ID NO: 4713791 - DNA, 17 bp, Homo sapiens
acgccagattctttcct

SEQ ID NO: 4713792 - DNA, 23 bp, Homo sapiens
acgccagattctttcctgaggct

SEQ ID NO: 4713793 - DNA, 11 bp, Homo sapiens
acgccatccca

SEQ ID NO: 4713794 - DNA, 21 bp, Homo sapiens
acgcctgaggaacccttacag

SEQ ID NO: 4713795 - DNA, 20 bp, Homo sapiens
acgcgtgcacacaccagagc

SEQ ID NO: 4713796 - DNA, 19 bp, Homo sapiens
acgctctgcaccttctgac

SEQ ID NO: 4713797 - DNA, 17 bp, Homo sapiens
acgctggagtgcagtga

SEQ ID NO: 4713798 - DNA, 18 bp, Homo sapiens
acgctggagtgcagtgag

SEQ ID NO: 4713799 - DNA, 11 bp, Homo sapiens
acgctgtgctg

SEQ ID NO: 4713800 - DNA, 19 bp, Homo sapiens
acggaatagttggctagga

SEQ ID NO: 4713801 - DNA, 18 bp, Homo sapiens
acggagccactcctctga

SEQ ID NO: 4713802 - DNA, 23 bp, Homo sapiens
acggagtcccaccttggctgcag

SEQ ID NO: 4713803 - DNA, 22 bp, Homo sapiens
acggataggcaggaacatacag

SEQ ID NO: 4713804 - DNA, 12 bp, Homo sapiens
acggccaggcca

SEQ ID NO: 4713805 - DNA, 18 bp, Homo sapiens
acggctcactgcagcctc

SEQ ID NO: 4713806 - DNA, 15 bp, Homo sapiens
acggggccggccagg

SEQ ID NO: 4713807 - DNA, 15 bp, Homo sapiens
acggtgctccaggca

SEQ ID NO: 4713808 - DNA, 21 bp, Homo sapiens
acggtgggggtagggggctgg

SEQ ID NO: 4713809 - DNA, 17 bp, Homo sapiens
acggtttgaagcctgga

SEQ ID NO: 4713810 - DNA, 16 bp, Homo sapiens
acgtatggaatgcttc

SEQ ID NO: 4713811 - DNA, 14 bp, Homo sapiens
acgtgacaacacaa

SEQ ID NO: 4713812 - DNA, 16 bp, Homo sapiens
acgtgagatcattcac

SEQ ID NO: 4713813 - DNA, 17 bp, Homo sapiens
acgtggaggagcagtgc

SEQ ID NO: 4713814 - DNA, 21 bp, Homo sapiens
acgtggcaggacttccatctg

SEQ ID NO: 4713815 - DNA, 18 bp, Homo sapiens
acgtgtgtttttctatta

SEQ ID NO: 4713816 - DNA, 23 bp, Homo sapiens
acgtgtgtttttctattaaaaga

SEQ ID NO: 4713817 - DNA, 21 bp, Homo sapiens
acgttaaaagcaaaaagatgt

SEQ ID NO: 4713818 - DNA, 23 bp, Homo sapiens
acgttaaaagcaaaaagatgtat

SEQ ID NO: 4713819 - DNA, 16 bp, Homo sapiens
actaaaaaaaagatga

SEQ ID NO: 4713820 - DNA, 17 bp, Homo sapiens
actaaaaaaaagatgaa

SEQ ID NO: 4713821 - DNA, 20 bp, Homo sapiens
actaaaaagtataaaatagt

SEQ ID NO: 4713822 - DNA, 21 bp, Homo sapiens
actaaaaagtataaaatagta

SEQ ID NO: 4713823 - DNA, 14 bp, Homo sapiens
actaaaaattttta

SEQ ID NO: 4713824 - DNA, 14 bp, Homo sapiens
actaaaatgttcta

SEQ ID NO: 4713825 - DNA, 22 bp, Homo sapiens
actaaatgtagttgtcacacta

SEQ ID NO: 4713826 - DNA, 13 bp, Homo sapiens
actaaccacgctg

SEQ ID NO: 4713827 - DNA, 12 bp, Homo sapiens
actaactagagc

SEQ ID NO: 4713828 - DNA, 13 bp, Homo sapiens
actaactagagca

SEQ ID NO: 4713829 - DNA, 12 bp, Homo sapiens
actaaggagaat

SEQ ID NO: 4713830 - DNA, 17 bp, Homo sapiens
actaatgttatttttta

SEQ ID NO: 4713831 - DNA, 20 bp, Homo sapiens
actaattttccataagctat

SEQ ID NO: 4713832 - DNA, 14 bp, Homo sapiens
actaattttttaag

SEQ ID NO: 4713833 - DNA, 15 bp, Homo sapiens
actaattttttaaga

SEQ ID NO: 4713834 - DNA, 22 bp, Homo sapiens
actacaatttaaagcaaaggag

SEQ ID NO: 4713835 - DNA, 17 bp, Homo sapiens
actacagtcctcccatc

SEQ ID NO: 4713836 - DNA, 18 bp, Homo sapiens
actaccagtgggcatgta

SEQ ID NO: 4713837 - DNA, 19 bp, Homo sapiens
actaccagtgggcatgtat

SEQ ID NO: 4713838 - DNA, 16 bp, Homo sapiens
actagaactgaatttt

SEQ ID NO: 4713839 - DNA, 15 bp, Homo sapiens
actagaattgttgca

SEQ ID NO: 4713840 - DNA, 14 bp, Homo sapiens
actagaggccaggg

SEQ ID NO: 4713841 - DNA, 19 bp, Homo sapiens
actagatactcgtgtgtgg

SEQ ID NO: 4713842 - DNA, 15 bp, Homo sapiens
actagattgtgatcc

SEQ ID NO: 4713843 - DNA, 16 bp, Homo sapiens
actagggatccctcat

SEQ ID NO: 4713844 - DNA, 20 bp, Homo sapiens
actagggatccctcatctgt

SEQ ID NO: 4713845 - DNA, 16 bp, Homo sapiens
actagggccaagccca

SEQ ID NO: 4713846 - DNA, 22 bp, Homo sapiens
actatcatgtcaaacgtgaaaa

SEQ ID NO: 4713847 - DNA, 13 bp, Homo sapiens
actatccaaataa

SEQ ID NO: 4713848 - DNA, 20 bp, Homo sapiens
actatgagctttcagactcc

SEQ ID NO: 4713849 - DNA, 16 bp, Homo sapiens
actatgataaattatg

SEQ ID NO: 4713850 - DNA, 14 bp, Homo sapiens
actatggtgccaat

SEQ ID NO: 4713851 - DNA, 20 bp, Homo sapiens
actatggtgccaatggaacc

SEQ ID NO: 4713852 - DNA, 23 bp, Homo sapiens
actatgtaatgcttatgtgttgc

SEQ ID NO: 4713853 - DNA, 16 bp, Homo sapiens
actatgttgcccaggc

SEQ ID NO: 4713854 - DNA, 17 bp, Homo sapiens
actatgttgcccaggca

SEQ ID NO: 4713855 - DNA, 13 bp, Homo sapiens
actattcatgttt

SEQ ID NO: 4713856 - DNA, 14 bp, Homo sapiens
actatttatataca

SEQ ID NO: 4713857 - DNA, 15 bp, Homo sapiens
actatttgcagaggc

SEQ ID NO: 4713858 - DNA, 13 bp, Homo sapiens
actcaaaaagctg

SEQ ID NO: 4713859 - DNA, 19 bp, Homo sapiens
actcaaaccaaatcactga

SEQ ID NO: 4713860 - DNA, 13 bp, Homo sapiens
actcaaccctctc

SEQ ID NO: 4713861 - DNA, 14 bp, Homo sapiens
actcaagaagcagg

SEQ ID NO: 4713862 - DNA, 12 bp, Homo sapiens
actcaatatttt

SEQ ID NO: 4713863 - DNA, 15 bp, Homo sapiens
actcaatattttcca

SEQ ID NO: 4713864 - DNA, 14 bp, Homo sapiens
actcaatttctccc

SEQ ID NO: 4713865 - DNA, 14 bp, Homo sapiens
actcacatcttttt

SEQ ID NO: 4713866 - DNA, 19 bp, Homo sapiens
actcacatttattctgctc

SEQ ID NO: 4713867 - DNA, 13 bp, Homo sapiens
actcaccccagcc

SEQ ID NO: 4713868 - DNA, 15 bp, Homo sapiens
actcaccccagcccc

SEQ ID NO: 4713869 - DNA, 17 bp, Homo sapiens
actcaccccagccccaa

SEQ ID NO: 4713870 - DNA, 19 bp, Homo sapiens
actcacctcccccatctct

SEQ ID NO: 4713871 - DNA, 22 bp, Homo sapiens
actcacctgcactaacagagtg

SEQ ID NO: 4713872 - DNA, 14 bp, Homo sapiens
actcagaagacact

SEQ ID NO: 4713873 - DNA, 15 bp, Homo sapiens
actcagaagacactg

SEQ ID NO: 4713874 - DNA, 16 bp, Homo sapiens
actcagaagacactga

SEQ ID NO: 4713875 - DNA, 17 bp, Homo sapiens
actcagaagacactgat

SEQ ID NO: 4713876 - DNA, 14 bp, Homo sapiens
actcagttctgctc

SEQ ID NO: 4713877 - DNA, 15 bp, Homo sapiens
acccatgctgccctg

SEQ ID NO: 4713878 - DNA, 18 bp, Homo sapiens
acccatgctgccctgtga

SEQ ID NO: 4713879 - DNA, 23 bp, Homo sapiens
acccattccttcccagaggggcc

SEQ ID NO: 4713880 - DNA, 17 bp, Homo sapiens
accccacacacgccaga

SEQ ID NO: 4713881 - DNA, 16 bp, Homo sapiens
accccatctgcccagg

SEQ ID NO: 4713882 - DNA, 22 bp, Homo sapiens
accccatggcagtgggaaaaat

SEQ ID NO: 4713883 - DNA, 22 bp, Homo sapiens
acccccacagacctgctctgga

SEQ ID NO: 4713884 - DNA, 17 bp, Homo sapiens
acccccaccccttgctc

SEQ ID NO: 4713885 - DNA, 14 bp, Homo sapiens
acccccagcctgct

SEQ ID NO: 4713886 - DNA, 15 bp, Homo sapiens
acccccagcctgcta

SEQ ID NO: 4713887 - DNA, 15 bp, Homo sapiens
accccccagcactga

SEQ ID NO: 4713888 - DNA, 13 bp, Homo sapiens
accccccttctga

SEQ ID NO: 4713889 - DNA, 13 bp, Homo sapiens
acccccgcccagg

SEQ ID NO: 4713890 - DNA, 15 bp, Homo sapiens
acccccgcccaggct

SEQ ID NO: 4713891 - DNA, 21 bp, Homo sapiens
acccccgcccaggctggccag

SEQ ID NO: 4713892 - DNA, 18 bp, Homo sapiens
accccctgtcctgtgctg

SEQ ID NO: 4713893 - DNA, 18 bp, Homo sapiens
acccccttctccatccac

SEQ ID NO: 4713894 - DNA, 19 bp, Homo sapiens
acccccttctccatccaca

SEQ ID NO: 4713895 - DNA, 19 bp, Homo sapiens
acccctccatgtgggctag

SEQ ID NO: 4713896 - DNA, 16 bp, Homo sapiens
acccctcccagctgac

SEQ ID NO: 4713897 - DNA, 22 bp, Homo sapiens
acccctcccagctgacagtcct

SEQ ID NO: 4713898 - DNA, 14 bp, Homo sapiens
acccctccctttct

SEQ ID NO: 4713899 - DNA, 19 bp, Homo sapiens
acccctccctttctcccct

SEQ ID NO: 4713900 - DNA, 19 bp, Homo sapiens
acagtaacgcaggggaaac

SEQ ID NO: 4713901 - DNA, 15 bp, Homo sapiens
acagtacccaaactg

SEQ ID NO: 4713902 - DNA, 17 bp, Homo sapiens
acagtatgtcccatagg

SEQ ID NO: 4713903 - DNA, 17 bp, Homo sapiens
acagtcaaatttacatt

SEQ ID NO: 4713904 - DNA, 14 bp, Homo sapiens
acagtcattattta

SEQ ID NO: 4713905 - DNA, 17 bp, Homo sapiens
acagtcctcccatctca

SEQ ID NO: 4713906 - DNA, 21 bp, Homo sapiens
acagtccttaccagcagagca

SEQ ID NO: 4713907 - DNA, 13 bp, Homo sapiens
acagtctcaattt

SEQ ID NO: 4713908 - DNA, 18 bp, Homo sapiens
acagtcttatcaactggt

SEQ ID NO: 4713909 - DNA, 19 bp, Homo sapiens
acagtcttccatttgcaag

SEQ ID NO: 4713910 - DNA, 15 bp, Homo sapiens
acagtcttgcagcag

SEQ ID NO: 4713911 - DNA, 15 bp, Homo sapiens
acagtcttgtattaa

SEQ ID NO: 4713912 - DNA, 17 bp, Homo sapiens
acagtgaatttaagcat

SEQ ID NO: 4713913 - DNA, 23 bp, Homo sapiens
acagtgactcgggctcctgtgcc

SEQ ID NO: 4713914 - DNA, 23 bp, Homo sapiens
acagtgagtcgaggacagggagg

SEQ ID NO: 4713915 - DNA, 21 bp, Homo sapiens
acagtggacagtctttgatca

SEQ ID NO: 4713916 - DNA, 23 bp, Homo sapiens
acagtggagagggctacaaagga

SEQ ID NO: 4713917 - DNA, 18 bp, Homo sapiens
acagtggatcacaaagtg

SEQ ID NO: 4713918 - DNA, 12 bp, Homo sapiens
acagtgtacagt

SEQ ID NO: 4713919 - DNA, 16 bp, Homo sapiens
acagtgtctgggctga

SEQ ID NO: 4713920 - DNA, 17 bp, Homo sapiens
acagtgttaggcctggc

SEQ ID NO: 4713921 - DNA, 14 bp, Homo sapiens
acagtgtttatgac

SEQ ID NO: 4713922 - DNA, 12 bp, Homo sapiens
acagtgtttgat

SEQ ID NO: 4713923 - DNA, 20 bp, Homo sapiens
acagttcaattctcatttgt

SEQ ID NO: 4713924 - DNA, 23 bp, Homo sapiens
acagttcataaatttgttgtcat

SEQ ID NO: 4713925 - DNA, 23 bp, Homo sapiens
acagttcggtgagctacaaatgc

SEQ ID NO: 4713926 - DNA, 23 bp, Homo sapiens
acagttcttgtgtggtttggccc

SEQ ID NO: 4713927 - DNA, 14 bp, Homo sapiens
acagtttcttagct

SEQ ID NO: 4713928 - DNA, 16 bp, Homo sapiens
acagtttcttagcttt

SEQ ID NO: 4713929 - DNA, 22 bp, Homo sapiens
acagtttcttagctttttaatt

SEQ ID NO: 4713930 - DNA, 17 bp, Homo sapiens
acagttttaactgtgga

SEQ ID NO: 4713931 - DNA, 16 bp, Homo sapiens
acataaaattttctag

SEQ ID NO: 4713932 - DNA, 16 bp, Homo sapiens
acataacgtttttcct

SEQ ID NO: 4713933 - DNA, 21 bp, Homo sapiens
acataacgtttttcctttaaa

SEQ ID NO: 4713934 - DNA, 18 bp, Homo sapiens
acataataaatcacacat

SEQ ID NO: 4713935 - DNA, 21 bp, Homo sapiens
acataataaatcacacattca

SEQ ID NO: 4713936 - DNA, 13 bp, Homo sapiens
acatactcccatc

SEQ ID NO: 4713937 - DNA, 17 bp, Homo sapiens
acatagaaagttcatgg

SEQ ID NO: 4713938 - DNA, 15 bp, Homo sapiens
acatagaacatgtgt

SEQ ID NO: 4713939 - DNA, 12 bp, Homo sapiens
acatatcatttg

SEQ ID NO: 4713940 - DNA, 13 bp, Homo sapiens
acatatcatttgt

SEQ ID NO: 4713941 - DNA, 15 bp, Homo sapiens
acatatcatttgtga

SEQ ID NO: 4713942 - DNA, 12 bp, Homo sapiens
acatatgaaaaa

SEQ ID NO: 4713943 - DNA, 21 bp, Homo sapiens
acatattatgcctgaatgact

SEQ ID NO: 4713944 - DNA, 17 bp, Homo sapiens
acatattttacatctga

SEQ ID NO: 4713945 - DNA, 19 bp, Homo sapiens
acatcattgtattaacgca

SEQ ID NO: 4713946 - DNA, 18 bp, Homo sapiens
acatccctcagtttctta

SEQ ID NO: 4713947 - DNA, 16 bp, Homo sapiens
acatcgatatgaaaaa

SEQ ID NO: 4713948 - DNA, 19 bp, Homo sapiens
acatcttgctctgctgaca

SEQ ID NO: 4713949 - DNA, 22 bp, Homo sapiens
acatcttgctctgctgacagac

SEQ ID NO: 4713950 - DNA, 15 bp, Homo sapiens
acatctttttcactg

SEQ ID NO: 4713951 - DNA, 14 bp, Homo sapiens
acatgaaaacattg

SEQ ID NO: 4713952 - DNA, 17 bp, Homo sapiens
acatgaaataaaagctt

SEQ ID NO: 4713953 - DNA, 17 bp, Homo sapiens
acatgagcatcaggcca

SEQ ID NO: 4713954 - DNA, 18 bp, Homo sapiens
acatgcatataatgaata

SEQ ID NO: 4713955 - DNA, 23 bp, Homo sapiens
acatgcggagaacaaatgtgaag

SEQ ID NO: 4713956 - DNA, 14 bp, Homo sapiens
acatgctgaagcca

SEQ ID NO: 4713957 - DNA, 22 bp, Homo sapiens
acatggaaaacagagtatttct

SEQ ID NO: 4713958 - DNA, 23 bp, Homo sapiens
acatggaaaacagagtatttctg

SEQ ID NO: 4713959 - DNA, 18 bp, Homo sapiens
acatggattccaaagcat

SEQ ID NO: 4713960 - DNA, 19 bp, Homo sapiens
acatggtgggtccatgggc

SEQ ID NO: 4713961 - DNA, 16 bp, Homo sapiens
acatggtgtgtgtctc

SEQ ID NO: 4713962 - DNA, 18 bp, Homo sapiens
acatgtatgtggatacag

SEQ ID NO: 4713963 - DNA, 21 bp, Homo sapiens
acatgtcagtaccttcaaact

SEQ ID NO: 4713964 - DNA, 21 bp, Homo sapiens
acatgtcttttcttgcatgag

SEQ ID NO: 4713965 - DNA, 12 bp, Homo sapiens
acatgtgaaacc

SEQ ID NO: 4713966 - DNA, 17 bp, Homo sapiens
acatgtgaaaccttttt

SEQ ID NO: 4713967 - DNA, 18 bp, Homo sapiens
acatgtgcaactcttgta

SEQ ID NO: 4713968 - DNA, 18 bp, Homo sapiens
acatgtggcttgaattaa

SEQ ID NO: 4713969 - DNA, 21 bp, Homo sapiens
acatgtggttactagtacagg

SEQ ID NO: 4713970 - DNA, 20 bp, Homo sapiens
acatgtgttaagtattttca

SEQ ID NO: 4713971 - DNA, 19 bp, Homo sapiens
acatgttagtcaaggactg

SEQ ID NO: 4713972 - DNA, 21 bp, Homo sapiens
acattaaactccctttcatgt

SEQ ID NO: 4713973 - DNA, 15 bp, Homo sapiens
acattagtgattcca

SEQ ID NO: 4713974 - DNA, 14 bp, Homo sapiens
acattcctgatgct

SEQ ID NO: 4713975 - DNA, 19 bp, Homo sapiens
acattgaaaccctccaaat

SEQ ID NO: 4713976 - DNA, 12 bp, Homo sapiens
acattgaagaat

SEQ ID NO: 4713977 - DNA, 15 bp, Homo sapiens
acattgcaatagaaa

SEQ ID NO: 4713978 - DNA, 22 bp, Homo sapiens
acattgccttttctagcccgaa

SEQ ID NO: 4713979 - DNA, 22 bp, Homo sapiens
acattgcggacagccacggcca

SEQ ID NO: 4713980 - DNA, 18 bp, Homo sapiens
acattgttcattcttgtt

SEQ ID NO: 4713981 - DNA, 20 bp, Homo sapiens
acatttaagagacagtcacc

SEQ ID NO: 4713982 - DNA, 23 bp, Homo sapiens
acatttaataatgtatgtacagc

SEQ ID NO: 4713983 - DNA, 15 bp, Homo sapiens
acatttagcccctct

SEQ ID NO: 4713984 - DNA, 16 bp, Homo sapiens
acatttaggagaagtt

SEQ ID NO: 4713985 - DNA, 14 bp, Homo sapiens
acatttatgattta

SEQ ID NO: 4713986 - DNA, 17 bp, Homo sapiens
acatttatgatttaata

SEQ ID NO: 4713987 - DNA, 19 bp, Homo sapiens
acatttcaagatccaaatg

SEQ ID NO: 4713988 - DNA, 23 bp, Homo sapiens
acatttctctaagagaacaatgt

SEQ ID NO: 4713989 - DNA, 15 bp, Homo sapiens
acattttaaaggata

SEQ ID NO: 4713990 - DNA, 22 bp, Homo sapiens
acattttcagaaatattcatga

SEQ ID NO: 4713991 - DNA, 21 bp, Homo sapiens
acatttttgcagctaaattac

SEQ ID NO: 4713992 - DNA, 17 bp, Homo sapiens
acatttttgtttttaat

SEQ ID NO: 4713993 - DNA, 11 bp, Homo sapiens
accaaaaatat

SEQ ID NO: 4713994 - DNA, 14 bp, Homo sapiens
accaaaatcccctt

SEQ ID NO: 4713995 - DNA, 17 bp, Homo sapiens
accaaaatccccttctc

SEQ ID NO: 4713996 - DNA, 13 bp, Homo sapiens
accaaatctgaca

SEQ ID NO: 4713997 - DNA, 18 bp, Homo sapiens
accaaatctgacatatta

SEQ ID NO: 4713998 - DNA, 19 bp, Homo sapiens
accaaattttgaggtcttt

SEQ ID NO: 4713999 - DNA, 22 bp, Homo sapiens
accaaattttgaggtcttttac

SEQ ID NO: 4714000 - DNA, 17 bp, Homo sapiens
accaacatactcccatc

SEQ ID NO: 4714001 - DNA, 21 bp, Homo sapiens
accaacatactcccatctgtg

SEQ ID NO: 4714002 - DNA, 14 bp, Homo sapiens
accaaccatttcta

SEQ ID NO: 4714003 - DNA, 14 bp, Homo sapiens
accaacccagccgc

SEQ ID NO: 4714004 - DNA, 16 bp, Homo sapiens
accaacccagccgctg

SEQ ID NO: 4714005 - DNA, 20 bp, Homo sapiens
accaacccagccgctgcccg

SEQ ID NO: 4714006 - DNA, 13 bp, Homo sapiens
accaagcctctgg

SEQ ID NO: 4714007 - DNA, 14 bp, Homo sapiens
agggagggctccag

SEQ ID NO: 4714008 - DNA, 16 bp, Homo sapiens
agggagggctccagac

SEQ ID NO: 4714009 - DNA, 20 bp, Homo sapiens
agggagtccgaaagggactt

SEQ ID NO: 4714010 - DNA, 23 bp, Homo sapiens
agggagtccgaaagggacttgga

SEQ ID NO: 4714011 - DNA, 17 bp, Homo sapiens
agggagtgacagaggca

SEQ ID NO: 4714012 - DNA, 15 bp, Homo sapiens
agggatccctcatct

SEQ ID NO: 4714013 - DNA, 18 bp, Homo sapiens
agggatgatgccacacca

SEQ ID NO: 4714014 - DNA, 22 bp, Homo sapiens
agggatgggacctgatgacctg

SEQ ID NO: 4714015 - DNA, 17 bp, Homo sapiens
agggcacaccgggcact

SEQ ID NO: 4714016 - DNA, 17 bp, Homo sapiens
agggcagagtcacacgg

SEQ ID NO: 4714017 - DNA, 15 bp, Homo sapiens
agggcagccagggag

SEQ ID NO: 4714018 - DNA, 15 bp, Homo sapiens
agggcagccctcctt

SEQ ID NO: 4714019 - DNA, 17 bp, Homo sapiens
ttctcttatctgccatg

SEQ ID NO: 4714020 - DNA, 16 bp, Homo sapiens
ttctcttcagtgtgtt

SEQ ID NO: 4714021 - DNA, 20 bp, Homo sapiens
ttctcttcagtgtgttgact

SEQ ID NO: 4714022 - DNA, 22 bp, Homo sapiens
ttctgaatgaagccttctgacc

SEQ ID NO: 4714023 - DNA, 21 bp, Homo sapiens
ttctgacccatgctgccctgt

SEQ ID NO: 4714024 - DNA, 23 bp, Homo sapiens
ttctgacccatgctgccctgtga

SEQ ID NO: 4714025 - DNA, 17 bp, Homo sapiens
ttctgacgcagcctgag

SEQ ID NO: 4714026 - DNA, 20 bp, Homo sapiens
ttctgacgcagcctgagaat

SEQ ID NO: 4714027 - DNA, 16 bp, Homo sapiens
ttctgcctgcccaggc

SEQ ID NO: 4714028 - DNA, 17 bp, Homo sapiens
ttctgcctgcccaggcc

SEQ ID NO: 4714029 - DNA, 19 bp, Homo sapiens
ttctgctcacatatctgtc

SEQ ID NO: 4714030 - DNA, 14 bp, Homo sapiens
ttctgctcatcatt

SEQ ID NO: 4714031 - DNA, 19 bp, Homo sapiens
ttctgctcatcattctctg

SEQ ID NO: 4714032 - DNA, 20 bp, Homo sapiens
ttctgctcatcattctctgt

SEQ ID NO: 4714033 - DNA, 13 bp, Homo sapiens
ttctgctgggctg

SEQ ID NO: 4714034 - DNA, 15 bp, Homo sapiens
ttctgctgggctggg

SEQ ID NO: 4714035 - DNA, 14 bp, Homo sapiens
ttctgcttcagcct

SEQ ID NO: 4714036 - DNA, 16 bp, Homo sapiens
ttctggaatggaattg

SEQ ID NO: 4714037 - DNA, 14 bp, Homo sapiens
ttctggctttgttc

SEQ ID NO: 4714038 - DNA, 11 bp, Homo sapiens
ttctgggacac

SEQ ID NO: 4714039 - DNA, 14 bp, Homo sapiens
ttctgggagggcag

SEQ ID NO: 4714040 - DNA, 15 bp, Homo sapiens
ttctgggtgatttct

SEQ ID NO: 4714041 - DNA, 18 bp, Homo sapiens
ttctgtactcaaatgtag

SEQ ID NO: 4714042 - DNA, 15 bp, Homo sapiens
ttctgtctttcaaaa

SEQ ID NO: 4714043 - DNA, 19 bp, Homo sapiens
ttctgtgcagataaacaga

SEQ ID NO: 4714044 - DNA, 17 bp, Homo sapiens
ttctgtgtttagctatt

SEQ ID NO: 4714045 - DNA, 21 bp, Homo sapiens
ttctgttggccagtgtgacaa

SEQ ID NO: 4714046 - DNA, 21 bp, Homo sapiens
ttcttaagacgtgattttgct

SEQ ID NO: 4714047 - DNA, 23 bp, Homo sapiens
ttcttaagacgtgattttgctgt

SEQ ID NO: 4714048 - DNA, 20 bp, Homo sapiens
ttcttaatcttttcacaaat

SEQ ID NO: 4714049 - DNA, 15 bp, Homo sapiens
ttcttacaaacatgt

SEQ ID NO: 4714050 - DNA, 17 bp, Homo sapiens
ttcttaccttttgtggt

SEQ ID NO: 4714051 - DNA, 20 bp, Homo sapiens
ttcttagctttttaattgtt

SEQ ID NO: 4714052 - DNA, 23 bp, Homo sapiens
ttcttagttgctgtatgtctcgt

SEQ ID NO: 4714053 - DNA, 20 bp, Homo sapiens
ttcttcaaaatcgatatggt

SEQ ID NO: 4714054 - DNA, 21 bp, Homo sapiens
ttcttccattcccatttcctg

SEQ ID NO: 4714055 - DNA, 15 bp, Homo sapiens
ttcttctcctgtgat

SEQ ID NO: 4714056 - DNA, 22 bp, Homo sapiens
ttcttctcctgtgatgtcccag

SEQ ID NO: 4714057 - DNA, 21 bp, Homo sapiens
ttcttgcaagcaacaagctat

SEQ ID NO: 4714058 - DNA, 23 bp, Homo sapiens
ttcttgcaagcaacaagctattt

SEQ ID NO: 4714059 - DNA, 18 bp, Homo sapiens
ttcttgtcaatggaagaa

SEQ ID NO: 4714060 - DNA, 12 bp, Homo sapiens
ttctttaactgc

SEQ ID NO: 4714061 - DNA, 21 bp, Homo sapiens
ttctttctagtggtctttgta

SEQ ID NO: 4714062 - DNA, 12 bp, Homo sapiens
ttctttcttggt

SEQ ID NO: 4714063 - DNA, 14 bp, Homo sapiens
ttctttcttggtgc

SEQ ID NO: 4714064 - DNA, 11 bp, Homo sapiens
ttctttgaaaa

SEQ ID NO: 4714065 - DNA, 16 bp, Homo sapiens
ttctttgataatgtta

SEQ ID NO: 4714066 - DNA, 14 bp, Homo sapiens
ttctttttgaaatg

SEQ ID NO: 4714067 - DNA, 15 bp, Homo sapiens
ttctttttgaaatgt

SEQ ID NO: 4714068 - DNA, 18 bp, Homo sapiens
ttcttttttttttctgtt

SEQ ID NO: 4714069 - DNA, 20 bp, Homo sapiens
ttcttttttttttctgttga

SEQ ID NO: 4714070 - DNA, 12 bp, Homo sapiens
ttgaaaaaagaa

SEQ ID NO: 4714071 - DNA, 16 bp, Homo sapiens
ttgaaaaaagaagttt

SEQ ID NO: 4714072 - DNA, 22 bp, Homo sapiens
ttgaaaaattatcagttatatt

SEQ ID NO: 4714073 - DNA, 14 bp, Homo sapiens
ttgaaactgctata

SEQ ID NO: 4714074 - DNA, 14 bp, Homo sapiens
ttgaaagaatagaa

SEQ ID NO: 4714075 - DNA, 15 bp, Homo sapiens
ttgaactcctggcct

SEQ ID NO: 4714076 - DNA, 18 bp, Homo sapiens
ttgaacttcctgcaggta

SEQ ID NO: 4714077 - DNA, 19 bp, Homo sapiens
ttgaaggtagaatgttttc

SEQ ID NO: 4714078 - DNA, 23 bp, Homo sapiens
ttgaatgcaaaagaaatttagag

SEQ ID NO: 4714079 - DNA, 14 bp, Homo sapiens
ttgaatgtattttg

SEQ ID NO: 4714080 - DNA, 15 bp, Homo sapiens
ttgaatgtattttgg

SEQ ID NO: 4714081 - DNA, 12 bp, Homo sapiens
ttgaatgtgatc

SEQ ID NO: 4714082 - DNA, 15 bp, Homo sapiens
ttgaattagattatt

SEQ ID NO: 4714083 - DNA, 15 bp, Homo sapiens
ttgaattgtaactgt

SEQ ID NO: 4714084 - DNA, 17 bp, Homo sapiens
ttgacacacagaaatgt

SEQ ID NO: 4714085 - DNA, 16 bp, Homo sapiens
ttgacaccaaaatgaa

SEQ ID NO: 4714086 - DNA, 14 bp, Homo sapiens
ttgacagaacactg

SEQ ID NO: 4714087 - DNA, 19 bp, Homo sapiens
ttgacagggcacaccgggc

SEQ ID NO: 4714088 - DNA, 11 bp, Homo sapiens
ttgaccaggcc

SEQ ID NO: 4714089 - DNA, 15 bp, Homo sapiens
ttgaccatgtgatta

SEQ ID NO: 4714090 - DNA, 21 bp, Homo sapiens
ttgacgaagaaacaaaaaaca

SEQ ID NO: 4714091 - DNA, 18 bp, Homo sapiens
ttgacgccatcccagccc

SEQ ID NO: 4714092 - DNA, 15 bp, Homo sapiens
ttgactgtgctagct

SEQ ID NO: 4714093 - DNA, 16 bp, Homo sapiens
ttgacttctatcctgt

SEQ ID NO: 4714094 - DNA, 11 bp, Homo sapiens
ttgagacagag

SEQ ID NO: 4714095 - DNA, 12 bp, Homo sapiens
ttgagacagagt

SEQ ID NO: 4714096 - DNA, 19 bp, Homo sapiens
ttgagacagtttcttagct

SEQ ID NO: 4714097 - DNA, 19 bp, Homo sapiens
ttgagagttcgtgaagagg

SEQ ID NO: 4714098 - DNA, 16 bp, Homo sapiens
ttgagcagggctcagc

SEQ ID NO: 4714099 - DNA, 15 bp, Homo sapiens
ttgagcctgtcaaga

SEQ ID NO: 4714100 - DNA, 15 bp, Homo sapiens
ttgagcgtgattctg

SEQ ID NO: 4714101 - DNA, 19 bp, Homo sapiens
ttgaggacaaagaaaactg

SEQ ID NO: 4714102 - DNA, 21 bp, Homo sapiens
ttgaggtccagccctggctga

SEQ ID NO: 4714103 - DNA, 14 bp, Homo sapiens
ttgagtgctctgat

SEQ ID NO: 4714104 - DNA, 14 bp, Homo sapiens
ttgagttttcagtg

SEQ ID NO: 4714105 - DNA, 19 bp, Homo sapiens
ttgataacagcactgacta

SEQ ID NO: 4714106 - DNA, 15 bp, Homo sapiens
ttgataacattttgt

SEQ ID NO: 4714107 - DNA, 18 bp, Homo sapiens
ttgataaccttgaaaaaa

SEQ ID NO: 4714108 - DNA, 22 bp, Homo sapiens
ttgataagagggcacacactgt

SEQ ID NO: 4714109 - DNA, 15 bp, Homo sapiens
ttgataatgttaaat

SEQ ID NO: 4714110 - DNA, 20 bp, Homo sapiens
ttgataatgttaaatttgta

SEQ ID NO: 4714111 - DNA, 22 bp, Homo sapiens
ttgataatgttaaatttgtaag

SEQ ID NO: 4714112 - DNA, 20 bp, Homo sapiens
ttgatactgttgcacgtgtg

SEQ ID NO: 4714113 - DNA, 17 bp, Homo sapiens
ttgatagtgcttcttgt

SEQ ID NO: 4714114 - DNA, 16 bp, Homo sapiens
ttgatatttgcattga

SEQ ID NO: 4714115 - DNA, 18 bp, Homo sapiens
ttgatcaacatcttttct

SEQ ID NO: 4714116 - DNA, 19 bp, Homo sapiens
ttgatcgcctttcccaggt

SEQ ID NO: 4714117 - DNA, 23 bp, Homo sapiens
ttgatggtgatgaaatgtaaata

SEQ ID NO: 4714118 - DNA, 13 bp, Homo sapiens
ttgatgttggctg

SEQ ID NO: 4714119 - DNA, 19 bp, Homo sapiens
ttgattagtgtagtgttaa

SEQ ID NO: 4714120 - DNA, 13 bp, Homo sapiens
ttgattatgcata

SEQ ID NO: 4714121 - DNA, 17 bp, Homo sapiens
ttgattattcagtgtca

SEQ ID NO: 4714122 - DNA, 13 bp, Homo sapiens
ttgattctccttc

SEQ ID NO: 4714123 - DNA, 23 bp, Homo sapiens
ttgcaaatgcccttacacttact

SEQ ID NO: 4714124 - DNA, 17 bp, Homo sapiens
ttgcaagcaacaagcta

SEQ ID NO: 4714125 - DNA, 21 bp, Homo sapiens
ttgcaagcaacaagctatttt

SEQ ID NO: 4714126 - DNA, 18 bp, Homo sapiens
ttgcacagccaaatttaa

SEQ ID NO: 4714127 - DNA, 17 bp, Homo sapiens
ttgcaccattctttctt

SEQ ID NO: 4714128 - DNA, 23 bp, Homo sapiens
ttgcaccattctttcttggtgca

SEQ ID NO: 4714129 - DNA, 20 bp, Homo sapiens
tttaatgggattgtgttaaa

SEQ ID NO: 4714130 - DNA, 14 bp, Homo sapiens
tttaatgtagccat

SEQ ID NO: 4714131 - DNA, 18 bp, Homo sapiens
tttaattgttgtttcttt

SEQ ID NO: 4714132 - DNA, 22 bp, Homo sapiens
tttaattgttgtttctttctag

SEQ ID NO: 4714133 - DNA, 23 bp, Homo sapiens
tttacaaaactgccaaaaatata

SEQ ID NO: 4714134 - DNA, 21 bp, Homo sapiens
tttacaaacatggaaaacaga

SEQ ID NO: 4714135 - DNA, 22 bp, Homo sapiens
tttacaaacatggaaaacagag

SEQ ID NO: 4714136 - DNA, 14 bp, Homo sapiens
tttacaacaaacac

SEQ ID NO: 4714137 - DNA, 15 bp, Homo sapiens
tttacaacaaacact

SEQ ID NO: 4714138 - DNA, 19 bp, Homo sapiens
tttacagtgtttctggctt

SEQ ID NO: 4714139 - DNA, 21 bp, Homo sapiens
tttacatacagtgatatggta

SEQ ID NO: 4714140 - DNA, 13 bp, Homo sapiens
tttaccaccccca

SEQ ID NO: 4714141 - DNA, 15 bp, Homo sapiens
tttaccacccccaca

SEQ ID NO: 4714142 - DNA, 20 bp, Homo sapiens
tttacccttcttttctgact

SEQ ID NO: 4714143 - DNA, 12 bp, Homo sapiens
tttaccttttaa

SEQ ID NO: 4714144 - DNA, 17 bp, Homo sapiens
tttaccttttaagacat

SEQ ID NO: 4714145 - DNA, 22 bp, Homo sapiens
tttactatttcaatacttacat

SEQ ID NO: 4714146 - DNA, 19 bp, Homo sapiens
tttactgcttttcattagc

SEQ ID NO: 4714147 - DNA, 18 bp, Homo sapiens
tttactttagaagcctgc

SEQ ID NO: 4714148 - DNA, 15 bp, Homo sapiens
tttactttttaaaca

SEQ ID NO: 4714149 - DNA, 13 bp, Homo sapiens
tttagaattctaa

SEQ ID NO: 4714150 - DNA, 19 bp, Homo sapiens
tttagaattctaattgtca

SEQ ID NO: 4714151 - DNA, 22 bp, Homo sapiens
tttagatgaatgtcagttgtta

SEQ ID NO: 4714152 - DNA, 19 bp, Homo sapiens
tttagcaatgctgtgaata

SEQ ID NO: 4714153 - DNA, 14 bp, Homo sapiens
tttagctatttaat

SEQ ID NO: 4714154 - DNA, 21 bp, Homo sapiens
tttagctatttaatactaatt

SEQ ID NO: 4714155 - DNA, 14 bp, Homo sapiens
tttaggagaagttg

SEQ ID NO: 4714156 - DNA, 15 bp, Homo sapiens
tttagtagagacagg

SEQ ID NO: 4714157 - DNA, 19 bp, Homo sapiens
tttagtggaagcttctaaa

SEQ ID NO: 4714158 - DNA, 16 bp, Homo sapiens
tttataaacctctaat

SEQ ID NO: 4714159 - DNA, 14 bp, Homo sapiens
tttataacaaatat

SEQ ID NO: 4714160 - DNA, 19 bp, Homo sapiens
tttataataaaaatatatt

SEQ ID NO: 4714161 - DNA, 16 bp, Homo sapiens
tttataccccatttga

SEQ ID NO: 4714162 - DNA, 18 bp, Homo sapiens
tttgagacagtttcttag

SEQ ID NO: 4714163 - DNA, 22 bp, Homo sapiens
tttgagacagtttcttagcttt

SEQ ID NO: 4714164 - DNA, 20 bp, Homo sapiens
tttgagacataaatgttcac

SEQ ID NO: 4714165 - DNA, 15 bp, Homo sapiens
tttgagcagggctca

SEQ ID NO: 4714166 - DNA, 13 bp, Homo sapiens
tttgagtgctctg

SEQ ID NO: 4714167 - DNA, 17 bp, Homo sapiens
tttgataatgttaaatt

SEQ ID NO: 4714168 - DNA, 14 bp, Homo sapiens
tttgatacattttt

SEQ ID NO: 4714169 - DNA, 16 bp, Homo sapiens
tttgatagtgcttctt

SEQ ID NO: 4714170 - DNA, 15 bp, Homo sapiens
tttgatccaagctgg

SEQ ID NO: 4714171 - DNA, 12 bp, Homo sapiens
tttgattctcct

SEQ ID NO: 4714172 - DNA, 14 bp, Homo sapiens
tttgattctccttc

SEQ ID NO: 4714173 - DNA, 21 bp, Homo sapiens
tttgattctccttcagccctc

SEQ ID NO: 4714174 - DNA, 13 bp, Homo sapiens
tttgattttgctg

SEQ ID NO: 4714175 - DNA, 18 bp, Homo sapiens
tttgcaaagtgtattagg

SEQ ID NO: 4714176 - DNA, 22 bp, Homo sapiens
tttgcaacagtaatcagagtta

SEQ ID NO: 4714177 - DNA, 21 bp, Homo sapiens
tttgcaaggaagccacagctg

SEQ ID NO: 4714178 - DNA, 20 bp, Homo sapiens
tttgcaagggaaaagtctct

SEQ ID NO: 4714179 - DNA, 21 bp, Homo sapiens
tttgcaagggaaaagtctctt

SEQ ID NO: 4714180 - DNA, 12 bp, Homo sapiens
tttgcagaggct

SEQ ID NO: 4714181 - DNA, 22 bp, Homo sapiens
tttgcagatgtaattagttaag

SEQ ID NO: 4714182 - DNA, 11 bp, Homo sapiens
tttgcagcttt

SEQ ID NO: 4714183 - DNA, 17 bp, Homo sapiens
tttgcataacaattcct

SEQ ID NO: 4714184 - DNA, 22 bp, Homo sapiens
tttgcataacaattcctctact

SEQ ID NO: 4714185 - DNA, 23 bp, Homo sapiens
tttgcattgaggaaatattaatt

SEQ ID NO: 4714186 - DNA, 18 bp, Homo sapiens
tttgccatgttggccagg

SEQ ID NO: 4714187 - DNA, 15 bp, Homo sapiens
tttgctgctgtggaa

SEQ ID NO: 4714188 - DNA, 21 bp, Homo sapiens
tttgctgctgtggaaaggatt

SEQ ID NO: 4714189 - DNA, 19 bp, Homo sapiens
tttgctgggcagtttttct

SEQ ID NO: 4714190 - DNA, 13 bp, Homo sapiens
tttggaagttatt

SEQ ID NO: 4714191 - DNA, 13 bp, Homo sapiens
tttggaccctgag

SEQ ID NO: 4714192 - DNA, 15 bp, Homo sapiens
tttggaccctgaggc

SEQ ID NO: 4714193 - DNA, 19 bp, Homo sapiens
tttggaccctgaggcccag

SEQ ID NO: 4714194 - DNA, 16 bp, Homo sapiens
tttggagggatcattt

SEQ ID NO: 4714195 - DNA, 22 bp, Homo sapiens
tttggatgtcctcaaagaagtg

SEQ ID NO: 4714196 - DNA, 16 bp, Homo sapiens
tttggctagtccttgt

SEQ ID NO: 4714197 - DNA, 12 bp, Homo sapiens
tttggctgctga

SEQ ID NO: 4714198 - DNA, 16 bp, Homo sapiens
tttgggctaacattta

SEQ ID NO: 4714199 - DNA, 21 bp, Homo sapiens
tttggggtacccactgctctg

SEQ ID NO: 4714200 - DNA, 22 bp, Homo sapiens
tttggggtacccactgctctgg

SEQ ID NO: 4714201 - DNA, 21 bp, Homo sapiens
tttggggttcggcctgtgtcc

SEQ ID NO: 4714202 - DNA, 18 bp, Homo sapiens
tttgggtcttttatacat

SEQ ID NO: 4714203 - DNA, 23 bp, Homo sapiens
tttggtgaacattgcaatagaaa

SEQ ID NO: 4714204 - DNA, 21 bp, Homo sapiens
tttggttagaagtaaggatta

SEQ ID NO: 4714205 - DNA, 15 bp, Homo sapiens
tttggttttgttccc

SEQ ID NO: 4714206 - DNA, 16 bp, Homo sapiens
tttggttttgttcccc

SEQ ID NO: 4714207 - DNA, 19 bp, Homo sapiens
tttggttttgttcccctcc

SEQ ID NO: 4714208 - DNA, 21 bp, Homo sapiens
tttggttttgttcccctcctc

SEQ ID NO: 4714209 - DNA, 22 bp, Homo sapiens
tttgtaactgtttagatgaatg

SEQ ID NO: 4714210 - DNA, 16 bp, Homo sapiens
tttgtaagagtgtaga

SEQ ID NO: 4714211 - DNA, 17 bp, Homo sapiens
tttgtaagagtgtagaa

SEQ ID NO: 4714212 - DNA, 19 bp, Homo sapiens
tttgtaagagtgtagaagc

SEQ ID NO: 4714213 - DNA, 13 bp, Homo sapiens
tttgtagagccag

SEQ ID NO: 4714214 - DNA, 19 bp, Homo sapiens
tttgtagcctctctttgtt

SEQ ID NO: 4714215 - DNA, 20 bp, Homo sapiens
tttgtataaaagtgtgaaat

SEQ ID NO: 4714216 - DNA, 21 bp, Homo sapiens
tttgtattgtttcaattgcat

SEQ ID NO: 4714217 - DNA, 14 bp, Homo sapiens
tttgtatttaatga

SEQ ID NO: 4714218 - DNA, 23 bp, Homo sapiens
tttgtatttaatgatttttgtgt

SEQ ID NO: 4714219 - DNA, 16 bp, Homo sapiens
tttgtatttattaatt

SEQ ID NO: 4714220 - DNA, 18 bp, Homo sapiens
tttgtatttattaatttg

SEQ ID NO: 4714221 - DNA, 14 bp, Homo sapiens
tttgtatttttagt

SEQ ID NO: 4714222 - DNA, 19 bp, Homo sapiens
tttgtcacagctcttgttt

SEQ ID NO: 4714223 - DNA, 17 bp, Homo sapiens
tttgtcagattcacaca

SEQ ID NO: 4714224 - DNA, 20 bp, Homo sapiens
tttgtcgaatttttattatt

SEQ ID NO: 4714225 - DNA, 21 bp, Homo sapiens
tttgtcttgtgtttctttagt

SEQ ID NO: 4714226 - DNA, 23 bp, Homo sapiens
tttgtgaatggattggattattt

SEQ ID NO: 4714227 - DNA, 15 bp, Homo sapiens
tttgtgatgaataaa

SEQ ID NO: 4714228 - DNA, 16 bp, Homo sapiens
tttgttaattcttatt

SEQ ID NO: 4714229 - DNA, 16 bp, Homo sapiens
tttgttaccttttaca

SEQ ID NO: 4714230 - DNA, 12 bp, Homo sapiens
tttgttcccctc

SEQ ID NO: 4714231 - DNA, 19 bp, Homo sapiens
tttgttcccctcctccact

SEQ ID NO: 4714232 - DNA, 12 bp, Homo sapiens
tttgttctgtat

SEQ ID NO: 4714233 - DNA, 13 bp, Homo sapiens
tttgttctgtata

SEQ ID NO: 4714234 - DNA, 16 bp, Homo sapiens
tttgttgagtctctga

SEQ ID NO: 4714235 - DNA, 17 bp, Homo sapiens
tttgttgagtctctgaa

SEQ ID NO: 4714236 - DNA, 15 bp, Homo sapiens
tttgtttctacctcc

SEQ ID NO: 4714237 - DNA, 21 bp, Homo sapiens
tttgttttgggatttttgtgt

SEQ ID NO: 4714238 - DNA, 20 bp, Homo sapiens
ttttaaaaaaaactatttaa

SEQ ID NO: 4714239 - DNA, 17 bp, Homo sapiens
ttttaaaaatgtagaaa

SEQ ID NO: 4714240 - DNA, 14 bp, Homo sapiens
ttttaaaatatctt

SEQ ID NO: 4714241 - DNA, 20 bp, Homo sapiens
ttttaaaatatcttttgacc

SEQ ID NO: 4714242 - DNA, 13 bp, Homo sapiens
ttttaaacagtgt

SEQ ID NO: 4714243 - DNA, 20 bp, Homo sapiens
ttttaaagaaaatgtgtctg

SEQ ID NO: 4714244 - DNA, 23 bp, Homo sapiens
ttttaaatttcagtcaattctga

SEQ ID NO: 4714245 - DNA, 13 bp, Homo sapiens
ttttaactcaata

SEQ ID NO: 4714246 - DNA, 14 bp, Homo sapiens
ttttaactgtggat

SEQ ID NO: 4714247 - DNA, 16 bp, Homo sapiens
ttttaagaggcagggt

SEQ ID NO: 4714248 - DNA, 13 bp, Homo sapiens
ttttaagattgta

SEQ ID NO: 4714249 - DNA, 12 bp, Homo sapiens
ttttaagatttt

SEQ ID NO: 4714250 - DNA, 21 bp, Homo sapiens
ttttaagatttttctcaaagt

SEQ ID NO: 4714251 - DNA, 13 bp, Homo sapiens
ttttaattaaata

SEQ ID NO: 4714252 - DNA, 13 bp, Homo sapiens
ttttaatttgata

SEQ ID NO: 4714253 - DNA, 23 bp, Homo sapiens
ttttacagaataaaagaattaca

SEQ ID NO: 4714254 - DNA, 14 bp, Homo sapiens
ttttacatacagtg

SEQ ID NO: 4714255 - DNA, 19 bp, Homo sapiens
ttttaccattagcataatt

SEQ ID NO: 4714256 - DNA, 20 bp, Homo sapiens
ttttagaatacattgtactt

SEQ ID NO: 4714257 - DNA, 15 bp, Homo sapiens
ttttagtagagacag

SEQ ID NO: 4714258 - DNA, 13 bp, Homo sapiens
ttttatctgtgga

SEQ ID NO: 4714259 - DNA, 20 bp, Homo sapiens
ttttatggttccaatgaaat

SEQ ID NO: 4714260 - DNA, 19 bp, Homo sapiens
ttttattaaaatatttcag

SEQ ID NO: 4714261 - DNA, 13 bp, Homo sapiens
ttttattttatgt

SEQ ID NO: 4714262 - DNA, 20 bp, Homo sapiens
ttttattttgtaattattgt

SEQ ID NO: 4714263 - DNA, 18 bp, Homo sapiens
ttttatttttagacagag

SEQ ID NO: 4714264 - DNA, 15 bp, Homo sapiens
ttttcaaatgttctc

SEQ ID NO: 4714265 - DNA, 13 bp, Homo sapiens
ttttcacaaataa

SEQ ID NO: 4714266 - DNA, 15 bp, Homo sapiens
ttttcagatataaaa

SEQ ID NO: 4714267 - DNA, 17 bp, Homo sapiens
ttttcagatataaaaga

SEQ ID NO: 4714268 - DNA, 19 bp, Homo sapiens
ttttcagatataaaagact

SEQ ID NO: 4714269 - DNA, 17 bp, Homo sapiens
ttttcagcttctgctgg

SEQ ID NO: 4714270 - DNA, 12 bp, Homo sapiens
ttttcagttttc

SEQ ID NO: 4714271 - DNA, 14 bp, Homo sapiens
ttttcatgcacagt

SEQ ID NO: 4714272 - DNA, 14 bp, Homo sapiens
ttttcatgcttcca

SEQ ID NO: 4714273 - DNA, 16 bp, Homo sapiens
ttttcattagcagttg

SEQ ID NO: 4714274 - DNA, 17 bp, Homo sapiens
ttttccagaaagaaaat

SEQ ID NO: 4714275 - DNA, 13 bp, Homo sapiens
ttttccaggctgg

SEQ ID NO: 4714276 - DNA, 19 bp, Homo sapiens
ttttccatgagtcccctgt

SEQ ID NO: 4714277 - DNA, 20 bp, Homo sapiens
ttttcccactgcaccccctc

SEQ ID NO: 4714278 - DNA, 16 bp, Homo sapiens
ttttccttgtccccac

SEQ ID NO: 4714279 - DNA, 18 bp, Homo sapiens
ttttctagcccgaataca

SEQ ID NO: 4714280 - DNA, 15 bp, Homo sapiens
ttttctattaaaaga

SEQ ID NO: 4714281 - DNA, 16 bp, Homo sapiens
ttttctattaaaagac

SEQ ID NO: 4714282 - DNA, 20 bp, Homo sapiens
ttttctctaatgcttgattt

SEQ ID NO: 4714283 - DNA, 19 bp, Homo sapiens
ttttcttgcctctgtcccc

SEQ ID NO: 4714284 - DNA, 18 bp, Homo sapiens
ttttctttaactgccgta

SEQ ID NO: 4714285 - DNA, 20 bp, Homo sapiens
ttttcttttttcttttggtc

SEQ ID NO: 4714286 - DNA, 17 bp, Homo sapiens
ttttgaaattaacctct

SEQ ID NO: 4714287 - DNA, 18 bp, Homo sapiens
ttttgacctgtggtgcaa

SEQ ID NO: 4714288 - DNA, 23 bp, Homo sapiens
ttttgagaaacagctacagcttt

SEQ ID NO: 4714289 - DNA, 23 bp, Homo sapiens
ttttgctgtttatgatctatttg

SEQ ID NO: 4714290 - DNA, 21 bp, Homo sapiens
ttttgctttcgaactgctagt

SEQ ID NO: 4714291 - DNA, 22 bp, Homo sapiens
ttttggcaatgactcaaagtct

SEQ ID NO: 4714292 - DNA, 20 bp, Homo sapiens
ttttggttttgttcccctcc

SEQ ID NO: 4714293 - DNA, 15 bp, Homo sapiens
ttttgtaattattgt

SEQ ID NO: 4714294 - DNA, 17 bp, Homo sapiens
ttttgtaattattgtga

SEQ ID NO: 4714295 - DNA, 18 bp, Homo sapiens
ttttgtagcctctctttg

SEQ ID NO: 4714296 - DNA, 15 bp, Homo sapiens
ttttgtatttaatga

SEQ ID NO: 4714297 - DNA, 19 bp, Homo sapiens
ttttgtcacagctcttgtt

SEQ ID NO: 4714298 - DNA, 18 bp, Homo sapiens
ttttgtgatgaataaaat

SEQ ID NO: 4714299 - DNA, 16 bp, Homo sapiens
ttttgttcaaagccag

SEQ ID NO: 4714300 - DNA, 15 bp, Homo sapiens
ttttgttcccctcct

SEQ ID NO: 4714301 - DNA, 11 bp, Homo sapiens
ttttgttctgt

SEQ ID NO: 4714302 - DNA, 18 bp, Homo sapiens
ttttgttgagtctctgaa

SEQ ID NO: 4714303 - DNA, 22 bp, Homo sapiens
ttttgttggcttgcttgcttta

SEQ ID NO: 4714304 - DNA, 20 bp, Homo sapiens
tttttaaagaaaagttttgt

SEQ ID NO: 4714305 - DNA, 21 bp, Homo sapiens
tttttaaagaaaatgtgtctg

SEQ ID NO: 4714306 - DNA, 15 bp, Homo sapiens
tttttaaatttcagt

SEQ ID NO: 4714307 - DNA, 22 bp, Homo sapiens
tttttaactcaatattttccat

SEQ ID NO: 4714308 - DNA, 17 bp, Homo sapiens
tttttaatatttattga

SEQ ID NO: 4714309 - DNA, 16 bp, Homo sapiens
tttttatgtattgttt

SEQ ID NO: 4714310 - DNA, 14 bp, Homo sapiens
tttttattaaaata

SEQ ID NO: 4714311 - DNA, 23 bp, Homo sapiens
tttttattaaaatatttcaggtt

SEQ ID NO: 4714312 - DNA, 12 bp, Homo sapiens
tttttccaggct

SEQ ID NO: 4714313 - DNA, 22 bp, Homo sapiens
tttttctaaacaagaaccattt

SEQ ID NO: 4714314 - DNA, 19 bp, Homo sapiens
tttttctattaaaagactc

SEQ ID NO: 4714315 - DNA, 18 bp, Homo sapiens
tttttctcaaagttttga

SEQ ID NO: 4714316 - DNA, 16 bp, Homo sapiens
tttttctctaatgctt

SEQ ID NO: 4714317 - DNA, 20 bp, Homo sapiens
tttttcttttttttttctgt

SEQ ID NO: 4714318 - DNA, 15 bp, Homo sapiens
tttttgaagctgtat

SEQ ID NO: 4714319 - DNA, 16 bp, Homo sapiens
tttttgcctaccattt

SEQ ID NO: 4714320 - DNA, 22 bp, Homo sapiens
tttttgggaaaagaaaagtcaa

SEQ ID NO: 4714321 - DNA, 16 bp, Homo sapiens
tttttgtacctggtga

SEQ ID NO: 4714322 - DNA, 11 bp, Homo sapiens
ttttttaagat

SEQ ID NO: 4714323 - DNA, 15 bp, Homo sapiens
ttttttatatatgtg

SEQ ID NO: 4714324 - DNA, 13 bp, Homo sapiens
ttttttatgtatt

SEQ ID NO: 4714325 - DNA, 13 bp, Homo sapiens
ttttttgtttcat

SEQ ID NO: 4714326 - DNA, 17 bp, Homo sapiens
ttaatcttttcacaaat

SEQ ID NO: 4714327 - DNA, 20 bp, Homo sapiens
ttaatcttttcacaaataaa

SEQ ID NO: 4714328 - DNA, 17 bp, Homo sapiens
ttaatgatttttgtgta

SEQ ID NO: 4714329 - DNA, 19 bp, Homo sapiens
ttaatgcttccagggattt

SEQ ID NO: 4714330 - DNA, 14 bp, Homo sapiens
ttaatggaaatgtt

SEQ ID NO: 4714331 - DNA, 17 bp, Homo sapiens
ttaatgtcacaggcagg

SEQ ID NO: 4714332 - DNA, 13 bp, Homo sapiens
ttaattatttaaa

SEQ ID NO: 4714333 - DNA, 16 bp, Homo sapiens
ttaattatttaaatgt

SEQ ID NO: 4714334 - DNA, 13 bp, Homo sapiens
ttaattcaatgaa

SEQ ID NO: 4714335 - DNA, 17 bp, Homo sapiens
ttaattcttattttaga

SEQ ID NO: 4714336 - DNA, 13 bp, Homo sapiens
ttaattctttcta

SEQ ID NO: 4714337 - DNA, 12 bp, Homo sapiens
ttaattgtattt

SEQ ID NO: 4714338 - DNA, 16 bp, Homo sapiens
ttaattgttgtttctt

SEQ ID NO: 4714339 - DNA, 18 bp, Homo sapiens
ttaatttcggttatagct

SEQ ID NO: 4714340 - DNA, 20 bp, Homo sapiens
ttaatttgaaaccaggacat

SEQ ID NO: 4714341 - DNA, 12 bp, Homo sapiens
ttaatttgtatg

SEQ ID NO: 4714342 - DNA, 16 bp, Homo sapiens
ttaatttgtgaatttg

SEQ ID NO: 4714343 - DNA, 20 bp, Homo sapiens
ttaatttttttaaatttcag

SEQ ID NO: 4714344 - DNA, 20 bp, Homo sapiens
ttacaaacatggaaaacaga

SEQ ID NO: 4714345 - DNA, 13 bp, Homo sapiens
ttacaacaaacac

SEQ ID NO: 4714346 - DNA, 15 bp, Homo sapiens
ttacaattacatctc

SEQ ID NO: 4714347 - DNA, 16 bp, Homo sapiens
ttacacagtcaaattt

SEQ ID NO: 4714348 - DNA, 15 bp, Homo sapiens
ttacacatttttcag

SEQ ID NO: 4714349 - DNA, 17 bp, Homo sapiens
ttacacatttttcagat

SEQ ID NO: 4714350 - DNA, 23 bp, Homo sapiens
ttacacatttttcagatataaaa

SEQ ID NO: 4714351 - DNA, 17 bp, Homo sapiens
ttacactgattggtgtt

SEQ ID NO: 4714352 - DNA, 12 bp, Homo sapiens
ttacactggtct

SEQ ID NO: 4714353 - DNA, 14 bp, Homo sapiens
ttacagaataaaag

SEQ ID NO: 4714354 - DNA, 19 bp, Homo sapiens
ttacagaataaaagaatta

SEQ ID NO: 4714355 - DNA, 15 bp, Homo sapiens
ttacagcacaaaatg

SEQ ID NO: 4714356 - DNA, 20 bp, Homo sapiens
ttacagctgggtggcactgc

SEQ ID NO: 4714357 - DNA, 21 bp, Homo sapiens
ttacagctgggtggcactgcc

SEQ ID NO: 4714358 - DNA, 19 bp, Homo sapiens
ttacagtaggagcccagct

SEQ ID NO: 4714359 - DNA, 23 bp, Homo sapiens
ttacatatctgacttctaggatt

SEQ ID NO: 4714360 - DNA, 20 bp, Homo sapiens
ttacatctctaattttggat

SEQ ID NO: 4714361 - DNA, 22 bp, Homo sapiens
ttacatctgaacaaaatgcctt

SEQ ID NO: 4714362 - DNA, 19 bp, Homo sapiens
ttacattgtgtcctgctta

SEQ ID NO: 4714363 - DNA, 12 bp, Homo sapiens
ttaccaagcgct

SEQ ID NO: 4714364 - DNA, 23 bp, Homo sapiens
ttaccactgtggaagtccctcag

SEQ ID NO: 4714365 - DNA, 19 bp, Homo sapiens
ttaccagcagagcacctta

SEQ ID NO: 4714366 - DNA, 20 bp, Homo sapiens
ttaccagcatatatagtatt

SEQ ID NO: 4714367 - DNA, 13 bp, Homo sapiens
ttaccattagcat

SEQ ID NO: 4714368 - DNA, 23 bp, Homo sapiens
ttaccattttggggtacccactg

SEQ ID NO: 4714369 - DNA, 18 bp, Homo sapiens
ttacctgaaaacactgtg

SEQ ID NO: 4714370 - DNA, 20 bp, Homo sapiens
ttacctgtggatatttgtat

SEQ ID NO: 4714371 - DNA, 22 bp, Homo sapiens
ttactcattaattcaatgaaat

SEQ ID NO: 4714372 - DNA, 14 bp, Homo sapiens
ttactcctttttat

SEQ ID NO: 4714373 - DNA, 23 bp, Homo sapiens
ttcccaacccccagcccccaccc

SEQ ID NO: 4714374 - DNA, 16 bp, Homo sapiens
ttcccaagctctgctc

SEQ ID NO: 4714375 - DNA, 18 bp, Homo sapiens
ttcccaagctctgctcct

SEQ ID NO: 4714376 - DNA, 14 bp, Homo sapiens
ttcccaattcacat

SEQ ID NO: 4714377 - DNA, 22 bp, Homo sapiens
ttcccacctctctcactccttg

SEQ ID NO: 4714378 - DNA, 23 bp, Homo sapiens
ttcccagtataagatttttgaaa

SEQ ID NO: 4714379 - DNA, 15 bp, Homo sapiens
ttcccagtggctgct

SEQ ID NO: 4714380 - DNA, 16 bp, Homo sapiens
ttcccagtggctgctg

SEQ ID NO: 4714381 - DNA, 17 bp, Homo sapiens
ttcccagtggctgctgc

SEQ ID NO: 4714382 - DNA, 19 bp, Homo sapiens
ttcccagtggctgctgccc

SEQ ID NO: 4714383 - DNA, 21 bp, Homo sapiens
ttcccataccacccaatgctg

SEQ ID NO: 4714384 - DNA, 17 bp, Homo sapiens
ttccccaggaggccagc

SEQ ID NO: 4714385 - DNA, 19 bp, Homo sapiens
ttccccaggaggccagcct

SEQ ID NO: 4714386 - DNA, 20 bp, Homo sapiens
ttccccaggaggccagcctt

SEQ ID NO: 4714387 - DNA, 14 bp, Homo sapiens
ttccccatacaaat

SEQ ID NO: 4714388 - DNA, 16 bp, Homo sapiens
ttccccgagggatgat

SEQ ID NO: 4714389 - DNA, 19 bp, Homo sapiens
ttcccctcctacccctccc

SEQ ID NO: 4714390 - DNA, 22 bp, Homo sapiens
ttcccctcctacccctcccagc

SEQ ID NO: 4714391 - DNA, 21 bp, Homo sapiens
ttccccttccactgagggcag

SEQ ID NO: 4714392 - DNA, 22 bp, Homo sapiens
ttcccggagggaaactgtgaat

SEQ ID NO: 4714393 - DNA, 22 bp, Homo sapiens
ttccctccctcaaagaaatcct

SEQ ID NO: 4714394 - DNA, 17 bp, Homo sapiens
ttccctccctctcttcc

SEQ ID NO: 4714395 - DNA, 14 bp, Homo sapiens
ttcccttcatctgg

SEQ ID NO: 4714396 - DNA, 21 bp, Homo sapiens
ttccctttgacgccatcccag

SEQ ID NO: 4714397 - DNA, 13 bp, Homo sapiens
ttccgcttggagc

SEQ ID NO: 4714398 - DNA, 19 bp, Homo sapiens
ttccgtaggttattttcag

SEQ ID NO: 4714399 - DNA, 22 bp, Homo sapiens
ttcctaataaagttctgtactc

SEQ ID NO: 4714400 - DNA, 12 bp, Homo sapiens
ttcctatttccc

SEQ ID NO: 4714401 - DNA, 18 bp, Homo sapiens
ttcctatttgccatgggc

SEQ ID NO: 4714402 - DNA, 20 bp, Homo sapiens
ttcctatttgccatgggctt

SEQ ID NO: 4714403 - DNA, 23 bp, Homo sapiens
ttcctcatagtatggtggctggg

SEQ ID NO: 4714404 - DNA, 14 bp, Homo sapiens
ttcctcctgggccc

SEQ ID NO: 4714405 - DNA, 15 bp, Homo sapiens
ttcctcctgggccct

SEQ ID NO: 4714406 - DNA, 21 bp, Homo sapiens
ttcctcctgggccctctctgc

SEQ ID NO: 4714407 - DNA, 19 bp, Homo sapiens
ttcctctgagctgttatct

SEQ ID NO: 4714408 - DNA, 19 bp, Homo sapiens
ttcctgatgcttcttcaga

SEQ ID NO: 4714409 - DNA, 21 bp, Homo sapiens
ttcctgccccagatggctttg

SEQ ID NO: 4714410 - DNA, 19 bp, Homo sapiens
ttcctggcactgcttccag

SEQ ID NO: 4714411 - DNA, 22 bp, Homo sapiens
ttcctggcactgcttccagtga

SEQ ID NO: 4714412 - DNA, 17 bp, Homo sapiens
ttcctgggaaatattcc

SEQ ID NO: 4714413 - DNA, 18 bp, Homo sapiens
ttcctgggagaaagacca

SEQ ID NO: 4714414 - DNA, 11 bp, Homo sapiens
ttcctgtgaca

SEQ ID NO: 4714415 - DNA, 12 bp, Homo sapiens
ttcctgtgacac

SEQ ID NO: 4714416 - DNA, 19 bp, Homo sapiens
ttccttcagaatatcttaa

SEQ ID NO: 4714417 - DNA, 15 bp, Homo sapiens
ttccttccagaagag

SEQ ID NO: 4714418 - DNA, 19 bp, Homo sapiens
ttccttgcctgcacaaact

SEQ ID NO: 4714419 - DNA, 13 bp, Homo sapiens
ttccttgctaatg

SEQ ID NO: 4714420 - DNA, 16 bp, Homo sapiens
ttccttgtccccacac

SEQ ID NO: 4714421 - DNA, 20 bp, Homo sapiens
ttccttgtccccacactcct

SEQ ID NO: 4714422 - DNA, 20 bp, Homo sapiens
ttcgatgggcccaattctta

SEQ ID NO: 4714423 - DNA, 16 bp, Homo sapiens
ttcgatgtacagtctc

SEQ ID NO: 4714424 - DNA, 13 bp, Homo sapiens
ttcggcctgtgtc

SEQ ID NO: 4714425 - DNA, 13 bp, Homo sapiens
ttcggtgtgcacc

SEQ ID NO: 4714426 - DNA, 20 bp, Homo sapiens
ttctaaacagatgtccctga

SEQ ID NO: 4714427 - DNA, 22 bp, Homo sapiens
ttctaaatatcccttggacatt

SEQ ID NO: 4714428 - DNA, 17 bp, Homo sapiens
ttctaagtctttccatt

SEQ ID NO: 4714429 - DNA, 14 bp, Homo sapiens
ttctaatagagaga

SEQ ID NO: 4714430 - DNA, 15 bp, Homo sapiens
ttctaatcataacat

SEQ ID NO: 4714431 - DNA, 17 bp, Homo sapiens
ttctacagagaaaatga

SEQ ID NO: 4714432 - DNA, 22 bp, Homo sapiens
ttctacagagaaaatgaatttg

SEQ ID NO: 4714433 - DNA, 13 bp, Homo sapiens
ttctacctcccag

SEQ ID NO: 4714434 - DNA, 19 bp, Homo sapiens
ttctagatcactgtgctta

SEQ ID NO: 4714435 - DNA, 21 bp, Homo sapiens
ttctagcccgaatacaaacac

SEQ ID NO: 4714436 - DNA, 18 bp, Homo sapiens
ttctagtggtctttgtaa

SEQ ID NO: 4714437 - DNA, 19 bp, Homo sapiens
ttctagtggtctttgtaag

SEQ ID NO: 4714438 - DNA, 20 bp, Homo sapiens
ttctagtggtctttgtaaga

SEQ ID NO: 4714439 - DNA, 17 bp, Homo sapiens
tgcgcaggctggccctg

SEQ ID NO: 4714440 - DNA, 14 bp, Homo sapiens
tgcgcctacaggag

SEQ ID NO: 4714441 - DNA, 13 bp, Homo sapiens
tgcggagaacaaa

SEQ ID NO: 4714442 - DNA, 23 bp, Homo sapiens
tgcgggcattttgaatgtgatca

SEQ ID NO: 4714443 - DNA, 14 bp, Homo sapiens
tgcggtccacccag

SEQ ID NO: 4714444 - DNA, 11 bp, Homo sapiens
tgcgtctgtgt

SEQ ID NO: 4714445 - DNA, 22 bp, Homo sapiens
tgcgtgacaataaaacattaat

SEQ ID NO: 4714446 - DNA, 17 bp, Homo sapiens
tgcgtggcacatctaaa

SEQ ID NO: 4714447 - DNA, 21 bp, Homo sapiens
tgcgtgtgtagagttaagaag

SEQ ID NO: 4714448 - DNA, 17 bp, Homo sapiens
tgcgttccatgatgctg

SEQ ID NO: 4714449 - DNA, 20 bp, Homo sapiens
tgctaactagcttggaaact

SEQ ID NO: 4714450 - DNA, 13 bp, Homo sapiens
tgctaatttgttt

SEQ ID NO: 4714451 - DNA, 15 bp, Homo sapiens
tgctaccctccctgc

SEQ ID NO: 4714452 - DNA, 20 bp, Homo sapiens
tgctaccctccctgctgtcc

SEQ ID NO: 4714453 - DNA, 23 bp, Homo sapiens
tgctaccctccctgctgtcccct

SEQ ID NO: 4714454 - DNA, 19 bp, Homo sapiens
tgctaggaacactccttca

SEQ ID NO: 4714455 - DNA, 21 bp, Homo sapiens
tgctaggggttttaggtctct

SEQ ID NO: 4714456 - DNA, 16 bp, Homo sapiens
tgctagtgctgtaata

SEQ ID NO: 4714457 - DNA, 21 bp, Homo sapiens
tgctatagcctaagcggctgt

SEQ ID NO: 4714458 - DNA, 19 bp, Homo sapiens
tgctatccagctattttta

SEQ ID NO: 4714459 - DNA, 13 bp, Homo sapiens
tgctatctccccc

SEQ ID NO: 4714460 - DNA, 18 bp, Homo sapiens
tgctatctcccccagccc

SEQ ID NO: 4714461 - DNA, 16 bp, Homo sapiens
tgctatttaattcttt

SEQ ID NO: 4714462 - DNA, 23 bp, Homo sapiens
tgctcacatctgaatctccttgt

SEQ ID NO: 4714463 - DNA, 14 bp, Homo sapiens
tgctcactcaacaa

SEQ ID NO: 4714464 - DNA, 17 bp, Homo sapiens
tgctcagttcagaatca

SEQ ID NO: 4714465 - DNA, 20 bp, Homo sapiens
tgctcatcattctctgtctc

SEQ ID NO: 4714466 - DNA, 21 bp, Homo sapiens
tgctcatcattctctgtctca

SEQ ID NO: 4714467 - DNA, 15 bp, Homo sapiens
tgctcatgccctgcc

SEQ ID NO: 4714468 - DNA, 14 bp, Homo sapiens
tgctcatttcagga

SEQ ID NO: 4714469 - DNA, 17 bp, Homo sapiens
tgctcctctccccagca

SEQ ID NO: 4714470 - DNA, 18 bp, Homo sapiens
tgctcctctccccagcaa

SEQ ID NO: 4714471 - DNA, 12 bp, Homo sapiens
tgctccttgggc

SEQ ID NO: 4714472 - DNA, 16 bp, Homo sapiens
tgctcgggcccaggcc

SEQ ID NO: 4714473 - DNA, 20 bp, Homo sapiens
tgctctaagaagctgcaata

SEQ ID NO: 4714474 - DNA, 15 bp, Homo sapiens
tgctctcatatatat

SEQ ID NO: 4714475 - DNA, 12 bp, Homo sapiens
tgctctccttcc

SEQ ID NO: 4714476 - DNA, 14 bp, Homo sapiens
tgctctgatccctc

SEQ ID NO: 4714477 - DNA, 19 bp, Homo sapiens
tgctctgatccctctacag

SEQ ID NO: 4714478 - DNA, 14 bp, Homo sapiens
tgctctgctgacag

SEQ ID NO: 4714479 - DNA, 15 bp, Homo sapiens
tgctcttgaactcct

SEQ ID NO: 4714480 - DNA, 22 bp, Homo sapiens
tgctcttgaactcctgacctca

SEQ ID NO: 4714481 - DNA, 14 bp, Homo sapiens
tgctgaaaacatta

SEQ ID NO: 4714482 - DNA, 20 bp, Homo sapiens
tgctgaaaacattacatgct

SEQ ID NO: 4714483 - DNA, 20 bp, Homo sapiens
tgctgaatgtcattatttga

SEQ ID NO: 4714484 - DNA, 23 bp, Homo sapiens
tgctgaatgtcattatttgataa

SEQ ID NO: 4714485 - DNA, 22 bp, Homo sapiens
tgctgacagacacaggcccggc

SEQ ID NO: 4714486 - DNA, 23 bp, Homo sapiens
tgctgagcctgtaaaataaaagg

SEQ ID NO: 4714487 - DNA, 18 bp, Homo sapiens
tgctgagtcccaggctga

SEQ ID NO: 4714488 - DNA, 14 bp, Homo sapiens
tgctgagtctgaag

SEQ ID NO: 4714489 - DNA, 16 bp, Homo sapiens
tgctgagtctgaaggc

SEQ ID NO: 4714490 - DNA, 17 bp, Homo sapiens
tgctgagtctgaaggct

SEQ ID NO: 4714491 - DNA, 22 bp, Homo sapiens
tgctgagtctgaaggctgggtt

SEQ ID NO: 4714492 - DNA, 15 bp, Homo sapiens
tgctgagttggtgtt

SEQ ID NO: 4714493 - DNA, 19 bp, Homo sapiens
tgctgatagctaagtgagt

SEQ ID NO: 4714494 - DNA, 15 bp, Homo sapiens
tgctgatcgccttat

SEQ ID NO: 4714495 - DNA, 17 bp, Homo sapiens
tgctgcaccaacccagc

SEQ ID NO: 4714496 - DNA, 19 bp, Homo sapiens
tgctgcaccaacccagccg

SEQ ID NO: 4714497 - DNA, 18 bp, Homo sapiens
tgctgcagttgccagtca

SEQ ID NO: 4714498 - DNA, 23 bp, Homo sapiens
tgctgcagttgccagtcaccccg

SEQ ID NO: 4714499 - DNA, 11 bp, Homo sapiens
tgctgccatcc

SEQ ID NO: 4714500 - DNA, 12 bp, Homo sapiens
tgctgccatcca

SEQ ID NO: 4714501 - DNA, 22 bp, Homo sapiens
tgctgccatccaggttcagctt

SEQ ID NO: 4714502 - DNA, 16 bp, Homo sapiens
tgctgcccaggcccag

SEQ ID NO: 4714503 - DNA, 16 bp, Homo sapiens
tgctgcccctccctgc

SEQ ID NO: 4714504 - DNA, 11 bp, Homo sapiens
tgctgccctgt

SEQ ID NO: 4714505 - DNA, 13 bp, Homo sapiens
tgctgccctgtga

SEQ ID NO: 4714506 - DNA, 15 bp, Homo sapiens
tgctgccctgtgagt

SEQ ID NO: 4714507 - DNA, 14 bp, Homo sapiens
tgctgctaccctcc

SEQ ID NO: 4714508 - DNA, 19 bp, Homo sapiens
tgctgctaccctccctgct

SEQ ID NO: 4714509 - DNA, 20 bp, Homo sapiens
tgctgctgaactaatttctg

SEQ ID NO: 4714510 - DNA, 13 bp, Homo sapiens
tgctgctgcctgc

SEQ ID NO: 4714511 - DNA, 14 bp, Homo sapiens
tgctgctgcctgcc

SEQ ID NO: 4714512 - DNA, 14 bp, Homo sapiens
tgctgctgtggaaa

SEQ ID NO: 4714513 - DNA, 13 bp, Homo sapiens
tgctggagactcc

SEQ ID NO: 4714514 - DNA, 19 bp, Homo sapiens
tgctggctgcctctctgct

SEQ ID NO: 4714515 - DNA, 19 bp, Homo sapiens
tgctgggattacaagcgtg

SEQ ID NO: 4714516 - DNA, 17 bp, Homo sapiens
tgctgggattacaggtg

SEQ ID NO: 4714517 - DNA, 20 bp, Homo sapiens
tgctgggattacaggtgtga

SEQ ID NO: 4714518 - DNA, 15 bp, Homo sapiens
tgctgggtggcccat

SEQ ID NO: 4714519 - DNA, 20 bp, Homo sapiens
tgctgggtggcccatccccc

SEQ ID NO: 4714520 - DNA, 13 bp, Homo sapiens
tgctgggtgtggc

SEQ ID NO: 4714521 - DNA, 15 bp, Homo sapiens
tgctggtttttcagt

SEQ ID NO: 4714522 - DNA, 20 bp, Homo sapiens
tgctgtccaaaccagcaaac

SEQ ID NO: 4714523 - DNA, 10 bp, Homo sapiens
tgctgtcccc

SEQ ID NO: 4714524 - DNA, 17 bp, Homo sapiens
tgctgtcccctcttgcc

SEQ ID NO: 4714525 - DNA, 14 bp, Homo sapiens
tgctgtcttaaact

SEQ ID NO: 4714526 - DNA, 17 bp, Homo sapiens
tgctgtgcaaacagtgt

SEQ ID NO: 4714527 - DNA, 18 bp, Homo sapiens
tgctgtgcaaacagtgta

SEQ ID NO: 4714528 - DNA, 21 bp, Homo sapiens
tgctgtgggtgatatggacag

SEQ ID NO: 4714529 - DNA, 23 bp, Homo sapiens
tgctgttaactgttaactatgac

SEQ ID NO: 4714530 - DNA, 22 bp, Homo sapiens
tgcttaacagttttagaataca

SEQ ID NO: 4714531 - DNA, 22 bp, Homo sapiens
tgcttagaggggtgaaaattat

SEQ ID NO: 4714532 - DNA, 14 bp, Homo sapiens
tgcttcacaatgtt

SEQ ID NO: 4714533 - DNA, 18 bp, Homo sapiens
tgcttccagtgaggctct

SEQ ID NO: 4714534 - DNA, 23 bp, Homo sapiens
tgcttccagtgaggctctgccct

SEQ ID NO: 4714535 - DNA, 21 bp, Homo sapiens
tgcttccattaacaaatgctc

SEQ ID NO: 4714536 - DNA, 18 bp, Homo sapiens
tgcttcctctgaatatta

SEQ ID NO: 4714537 - DNA, 16 bp, Homo sapiens
tgcttctgatttagca

SEQ ID NO: 4714538 - DNA, 22 bp, Homo sapiens
tgcttctggctttgttcttgtc

SEQ ID NO: 4714539 - DNA, 16 bp, Homo sapiens
tgcttcttcagagact

SEQ ID NO: 4714540 - DNA, 11 bp, Homo sapiens
tgcttcttgta

SEQ ID NO: 4714541 - DNA, 12 bp, Homo sapiens
tgcttcttgtaa

SEQ ID NO: 4714542 - DNA, 13 bp, Homo sapiens
tgcttgaggaaaa

SEQ ID NO: 4714543 - DNA, 14 bp, Homo sapiens
tgcttggaggaagg

SEQ ID NO: 4714544 - DNA, 21 bp, Homo sapiens
tgcttggaggaaggaaaccca

SEQ ID NO: 4714545 - DNA, 22 bp, Homo sapiens
tgctttataccccatttgattt

SEQ ID NO: 4714546 - DNA, 18 bp, Homo sapiens
tgctttcgaactgctagt

SEQ ID NO: 4714547 - DNA, 18 bp, Homo sapiens
tgctttcttctcctgtga

SEQ ID NO: 4714548 - DNA, 13 bp, Homo sapiens
tgctttgcccagc

SEQ ID NO: 4714549 - DNA, 16 bp, Homo sapiens
tggattatttaataac

SEQ ID NO: 4714550 - DNA, 20 bp, Homo sapiens
tggattatttaataacatta

SEQ ID NO: 4714551 - DNA, 14 bp, Homo sapiens
tggattcatattta

SEQ ID NO: 4714552 - DNA, 20 bp, Homo sapiens
tggattggattatttaataa

SEQ ID NO: 4714553 - DNA, 18 bp, Homo sapiens
tggattgggttatgaata

SEQ ID NO: 4714554 - DNA, 16 bp, Homo sapiens
tggatttcatttgtaa

SEQ ID NO: 4714555 - DNA, 22 bp, Homo sapiens
tggattttggttttgttcccct

SEQ ID NO: 4714556 - DNA, 12 bp, Homo sapiens
tggcaaaataaa

SEQ ID NO: 4714557 - DNA, 14 bp, Homo sapiens
tggcaaacatgtgc

SEQ ID NO: 4714558 - DNA, 22 bp, Homo sapiens
tggcaaacatgtgcaactcttg

SEQ ID NO: 4714559 - DNA, 15 bp, Homo sapiens
tggcaaggctgtgct

SEQ ID NO: 4714560 - DNA, 18 bp, Homo sapiens
tggcacagcccaaagaag

SEQ ID NO: 4714561 - DNA, 19 bp, Homo sapiens
tggcacagtgtctgggctg

SEQ ID NO: 4714562 - DNA, 20 bp, Homo sapiens
tggcacagtgtctgggctga

SEQ ID NO: 4714563 - DNA, 18 bp, Homo sapiens
tggcacatttaagagaca

SEQ ID NO: 4714564 - DNA, 16 bp, Homo sapiens
tggcacccggcccctg

SEQ ID NO: 4714565 - DNA, 15 bp, Homo sapiens
tggcactatttttat

SEQ ID NO: 4714566 - DNA, 12 bp, Homo sapiens
tggcactgctgg

SEQ ID NO: 4714567 - DNA, 19 bp, Homo sapiens
tggcactgcttccagtgag

SEQ ID NO: 4714568 - DNA, 18 bp, Homo sapiens
tggcagaagacaccagag

SEQ ID NO: 4714569 - DNA, 21 bp, Homo sapiens
tggcagaagacaccagagcag

SEQ ID NO: 4714570 - DNA, 22 bp, Homo sapiens
tggcagaatggggtgcatgaag

SEQ ID NO: 4714571 - DNA, 13 bp, Homo sapiens
tggcagcaggtgc

SEQ ID NO: 4714572 - DNA, 15 bp, Homo sapiens
tggcagcaggtgctg

SEQ ID NO: 4714573 - DNA, 21 bp, Homo sapiens
tggcagcaggtgctgctaccc

SEQ ID NO: 4714574 - DNA, 21 bp, Homo sapiens
tggcagctcacctctcccttg

SEQ ID NO: 4714575 - DNA, 23 bp, Homo sapiens
tggcagctcacctctcccttgga

SEQ ID NO: 4714576 - DNA, 14 bp, Homo sapiens
tggcagctcagaga

SEQ ID NO: 4714577 - DNA, 20 bp, Homo sapiens
tggcaggatggcctggccag

SEQ ID NO: 4714578 - DNA, 22 bp, Homo sapiens
tggcagtgggaaaaatgtagga

SEQ ID NO: 4714579 - DNA, 14 bp, Homo sapiens
tggcagtgggagct

SEQ ID NO: 4714580 - DNA, 15 bp, Homo sapiens
tggcagtgggagctg

SEQ ID NO: 4714581 - DNA, 16 bp, Homo sapiens
tggcagtgggagctgc

SEQ ID NO: 4714582 - DNA, 20 bp, Homo sapiens
tggcagtgggagctgcctgt

SEQ ID NO: 4714583 - DNA, 14 bp, Homo sapiens
tggcatcagctggc

SEQ ID NO: 4714584 - DNA, 18 bp, Homo sapiens
tggcatcagctggcgtca

SEQ ID NO: 4714585 - DNA, 21 bp, Homo sapiens
tggcatctaattcttattttt

SEQ ID NO: 4714586 - DNA, 13 bp, Homo sapiens
tggcattggcagc

SEQ ID NO: 4714587 - DNA, 14 bp, Homo sapiens
tggcattggcagca

SEQ ID NO: 4714588 - DNA, 13 bp, Homo sapiens
tggcattgttgat

SEQ ID NO: 4714589 - DNA, 13 bp, Homo sapiens
tggccaccacccc

SEQ ID NO: 4714590 - DNA, 12 bp, Homo sapiens
tggccagcccca

SEQ ID NO: 4714591 - DNA, 17 bp, Homo sapiens
tggccagccccacagcc

SEQ ID NO: 4714592 - DNA, 13 bp, Homo sapiens
tgtcccctatcct

SEQ ID NO: 4714593 - DNA, 11 bp, Homo sapiens
tgtcccctctt

SEQ ID NO: 4714594 - DNA, 21 bp, Homo sapiens
tgtcccctcttgccccaaccc

SEQ ID NO: 4714595 - DNA, 14 bp, Homo sapiens
tgtccccttctctc

SEQ ID NO: 4714596 - DNA, 20 bp, Homo sapiens
tgtccctgaagtcttgcatt

SEQ ID NO: 4714597 - DNA, 16 bp, Homo sapiens
tgtcccttaaacaaaa

SEQ ID NO: 4714598 - DNA, 18 bp, Homo sapiens
tgtcccttgcccccctgg

SEQ ID NO: 4714599 - DNA, 14 bp, Homo sapiens
tgtcccttggagct

SEQ ID NO: 4714600 - DNA, 17 bp, Homo sapiens
tgtcctactctgtgtca

SEQ ID NO: 4714601 - DNA, 13 bp, Homo sapiens
tgtcctcaaagaa

SEQ ID NO: 4714602 - DNA, 14 bp, Homo sapiens
tgtcctcaccacat

SEQ ID NO: 4714603 - DNA, 16 bp, Homo sapiens
tgtcctcctctgtgaa

SEQ ID NO: 4714604 - DNA, 17 bp, Homo sapiens
tgtcctgacagcactcc

SEQ ID NO: 4714605 - DNA, 19 bp, Homo sapiens
tgtcctgacagcactcctc

SEQ ID NO: 4714606 - DNA, 21 bp, Homo sapiens
tgtcctgacttcaggggctgc

SEQ ID NO: 4714607 - DNA, 22 bp, Homo sapiens
tgtcctgacttcaggggctgcc

SEQ ID NO: 4714608 - DNA, 12 bp, Homo sapiens
tgtcctgctggt

SEQ ID NO: 4714609 - DNA, 19 bp, Homo sapiens
tgtcctgcttatacttttc

SEQ ID NO: 4714610 - DNA, 22 bp, Homo sapiens
tgtcctgcttatacttttctca

SEQ ID NO: 4714611 - DNA, 12 bp, Homo sapiens
tgtcctgggagt

SEQ ID NO: 4714612 - DNA, 20 bp, Homo sapiens
tgtcctgggagtgagctggt

SEQ ID NO: 4714613 - DNA, 15 bp, Homo sapiens
tgtcgcccaggctgg

SEQ ID NO: 4714614 - DNA, 16 bp, Homo sapiens
tgtcgcccaggctgga

SEQ ID NO: 4714615 - DNA, 14 bp, Homo sapiens
tgtcgcgccttctc

SEQ ID NO: 4714616 - DNA, 20 bp, Homo sapiens
tgtcgcgccttctccccccc

SEQ ID NO: 4714617 - DNA, 21 bp, Homo sapiens
tgtcgctgggtcctctgcagt

SEQ ID NO: 4714618 - DNA, 22 bp, Homo sapiens
tgtcgttgactttagggactca

SEQ ID NO: 4714619 - DNA, 21 bp, Homo sapiens
tgtctaagattaatagcattc

SEQ ID NO: 4714620 - DNA, 22 bp, Homo sapiens
tgtctagaaagtaagaaaacaa

SEQ ID NO: 4714621 - DNA, 19 bp, Homo sapiens
tgtctagtagaacaatgta

SEQ ID NO: 4714622 - DNA, 15 bp, Homo sapiens
tgtctagttgtttga

SEQ ID NO: 4714623 - DNA, 16 bp, Homo sapiens
tgtctatgctccctct

SEQ ID NO: 4714624 - DNA, 17 bp, Homo sapiens
tgtctcatccatcatca

SEQ ID NO: 4714625 - DNA, 21 bp, Homo sapiens
tgtctccaaccccccagcact

SEQ ID NO: 4714626 - DNA, 15 bp, Homo sapiens
tgtctccatggccct

SEQ ID NO: 4714627 - DNA, 18 bp, Homo sapiens
tgtctcgtggtaggactg

SEQ ID NO: 4714628 - DNA, 21 bp, Homo sapiens
tgtctcgtggtaggactgtag

SEQ ID NO: 4714629 - DNA, 12 bp, Homo sapiens
tgtctctgtgtg

SEQ ID NO: 4714630 - DNA, 21 bp, Homo sapiens
tgtctcttggtcctgctgcag

SEQ ID NO: 4714631 - DNA, 21 bp, Homo sapiens
tgtctctttaatgtcacaggc

SEQ ID NO: 4714632 - DNA, 16 bp, Homo sapiens
tgtctgcaacatggat

SEQ ID NO: 4714633 - DNA, 20 bp, Homo sapiens
tgtcttaaactaaatgtgca

SEQ ID NO: 4714634 - DNA, 13 bp, Homo sapiens
tgtcttcaatgat

SEQ ID NO: 4714635 - DNA, 14 bp, Homo sapiens
tgtcttcctgtggg

SEQ ID NO: 4714636 - DNA, 14 bp, Homo sapiens
tgtcttctccccag

SEQ ID NO: 4714637 - DNA, 20 bp, Homo sapiens
tgtcttgcaatggcagcctt

SEQ ID NO: 4714638 - DNA, 15 bp, Homo sapiens
tgtcttgtgtttctt

SEQ ID NO: 4714639 - DNA, 18 bp, Homo sapiens
tgtcttgtgtttctttag

SEQ ID NO: 4714640 - DNA, 16 bp, Homo sapiens
tgtctttggaccctga

SEQ ID NO: 4714641 - DNA, 18 bp, Homo sapiens
tgtctttggaccctgagg

SEQ ID NO: 4714642 - DNA, 21 bp, Homo sapiens
tgtcttttcttgcatgaggct

SEQ ID NO: 4714643 - DNA, 23 bp, Homo sapiens
tgtcttttcttgcatgaggctag

SEQ ID NO: 4714644 - DNA, 20 bp, Homo sapiens
tgtgaaaccttttttaagat

SEQ ID NO: 4714645 - DNA, 21 bp, Homo sapiens
tgtgaaaggaaagagggaggt

SEQ ID NO: 4714646 - DNA, 16 bp, Homo sapiens
tgtgaaccaccacacc

SEQ ID NO: 4714647 - DNA, 14 bp, Homo sapiens
tgttacttaaacat

SEQ ID NO: 4714648 - DNA, 20 bp, Homo sapiens
tgttaggcctggcacagtgt

SEQ ID NO: 4714649 - DNA, 14 bp, Homo sapiens
tgttagtcaaggac

SEQ ID NO: 4714650 - DNA, 17 bp, Homo sapiens
tgttatcaccttccaaa

SEQ ID NO: 4714651 - DNA, 23 bp, Homo sapiens
tgttattagagattacctcctga

SEQ ID NO: 4714652 - DNA, 18 bp, Homo sapiens
tgttattcttttccagaa

SEQ ID NO: 4714653 - DNA, 13 bp, Homo sapiens
tgttatttattga

SEQ ID NO: 4714654 - DNA, 21 bp, Homo sapiens
tgttcaaagccagcgtcctcc

SEQ ID NO: 4714655 - DNA, 22 bp, Homo sapiens
tgttcaaagccagcgtcctcct

SEQ ID NO: 4714656 - DNA, 14 bp, Homo sapiens
tgttcaatctgtgt

SEQ ID NO: 4714657 - DNA, 14 bp, Homo sapiens
tgttcacaacctgg

SEQ ID NO: 4714658 - DNA, 22 bp, Homo sapiens
tgttcacacctagcgtcagtat

SEQ ID NO: 4714659 - DNA, 18 bp, Homo sapiens
tgttcaccttcaaaatgt

SEQ ID NO: 4714660 - DNA, 22 bp, Homo sapiens
tgttcagctccagctcaccagc

SEQ ID NO: 4714661 - DNA, 14 bp, Homo sapiens
tgttccaaatgtgt

SEQ ID NO: 4714662 - DNA, 14 bp, Homo sapiens
tgttccattgcctc

SEQ ID NO: 4714663 - DNA, 16 bp, Homo sapiens
tgttccccctgtgcag

SEQ ID NO: 4714664 - DNA, 12 bp, Homo sapiens
tgttcccctcct

SEQ ID NO: 4714665 - DNA, 15 bp, Homo sapiens
tgttcccctcctcca

SEQ ID NO: 4714666 - DNA, 19 bp, Homo sapiens
tgttcccctcctccactct

SEQ ID NO: 4714667 - DNA, 17 bp, Homo sapiens
tgttccccttccactga

SEQ ID NO: 4714668 - DNA, 16 bp, Homo sapiens
tgttctattcatctca

SEQ ID NO: 4714669 - DNA, 19 bp, Homo sapiens
tgttctatttaacaactgg

SEQ ID NO: 4714670 - DNA, 15 bp, Homo sapiens
tgttctctgccctcc

SEQ ID NO: 4714671 - DNA, 12 bp, Homo sapiens
tgttctggctct

SEQ ID NO: 4714672 - DNA, 13 bp, Homo sapiens
tgttctggctctt

SEQ ID NO: 4714673 - DNA, 16 bp, Homo sapiens
tgttctggctcttcca

SEQ ID NO: 4714674 - DNA, 20 bp, Homo sapiens
tgttctggctcttccaggct

SEQ ID NO: 4714675 - DNA, 16 bp, Homo sapiens
tgttcttataagaaga

SEQ ID NO: 4714676 - DNA, 17 bp, Homo sapiens
tgttcttataagaagaa

SEQ ID NO: 4714677 - DNA, 18 bp, Homo sapiens
tgttgagtctctgaacat

SEQ ID NO: 4714678 - DNA, 19 bp, Homo sapiens
tgttgatactgttgcacgt

SEQ ID NO: 4714679 - DNA, 13 bp, Homo sapiens
tgttgcccaggca

SEQ ID NO: 4714680 - DNA, 16 bp, Homo sapiens
tgttgcccaggcaggt

SEQ ID NO: 4714681 - DNA, 20 bp, Homo sapiens
tgttgcccaggctggcgtgc

SEQ ID NO: 4714682 - DNA, 18 bp, Homo sapiens
tgttggccaggctgctct

SEQ ID NO: 4714683 - DNA, 15 bp, Homo sapiens
tgttggcgagaggag

SEQ ID NO: 4714684 - DNA, 19 bp, Homo sapiens
tgttggctgggggcctcag

SEQ ID NO: 4714685 - DNA, 20 bp, Homo sapiens
tgttgggtgggtgggccctg

SEQ ID NO: 4714686 - DNA, 14 bp, Homo sapiens
tgttggtgcaatta

SEQ ID NO: 4714687 - DNA, 21 bp, Homo sapiens
tgttggtgcaattaactctgg

SEQ ID NO: 4714688 - DNA, 23 bp, Homo sapiens
tgttgtacaattaagttacaatt

SEQ ID NO: 4714689 - DNA, 13 bp, Homo sapiens
tgttgtacattta

SEQ ID NO: 4714690 - DNA, 16 bp, Homo sapiens
tgttgtacatttatga

SEQ ID NO: 4714691 - DNA, 17 bp, Homo sapiens
tgttgtacatttatgat

SEQ ID NO: 4714692 - DNA, 22 bp, Homo sapiens
tgttgtacatttatgatttaat

SEQ ID NO: 4714693 - DNA, 22 bp, Homo sapiens
tgttgtgctgggagcaggactg

SEQ ID NO: 4714694 - DNA, 22 bp, Homo sapiens
tgttgttccaaatgtgtataat

SEQ ID NO: 4714695 - DNA, 14 bp, Homo sapiens
tgttgttcttataa

SEQ ID NO: 4714696 - DNA, 13 bp, Homo sapiens
tgttgtttaatgt

SEQ ID NO: 4714697 - DNA, 15 bp, Homo sapiens
tgttgtttataataa

SEQ ID NO: 4714698 - DNA, 12 bp, Homo sapiens
tgttgtttcttt

SEQ ID NO: 4714699 - DNA, 14 bp, Homo sapiens
tgttgtttctttct

SEQ ID NO: 4714700 - DNA, 15 bp, Homo sapiens
tgttgtttgaagaac

SEQ ID NO: 4714701 - DNA, 14 bp, Homo sapiens
tgtttaatagtata

SEQ ID NO: 4714702 - DNA, 15 bp, Homo sapiens
tgtttaatggtagtt

SEQ ID NO: 4714703 - DNA, 15 bp, Homo sapiens
tgtttacaaacatgg

SEQ ID NO: 4714704 - DNA, 16 bp, Homo sapiens
tgtttataataaaaat

SEQ ID NO: 4714705 - DNA, 20 bp, Homo sapiens
tgtttatcacctttattgaa

SEQ ID NO: 4714706 - DNA, 14 bp, Homo sapiens
tgtttattgtaaaa

SEQ ID NO: 4714707 - DNA, 13 bp, Homo sapiens
tgtttattttaga

SEQ ID NO: 4714708 - DNA, 20 bp, Homo sapiens
tgtttcatattgatgtgtgt

SEQ ID NO: 4714709 - DNA, 15 bp, Homo sapiens
tgtttcctggcactg

SEQ ID NO: 4714710 - DNA, 21 bp, Homo sapiens
tgtttctcccccatgttctgt

SEQ ID NO: 4714711 - DNA, 17 bp, Homo sapiens
tgtttgattcagacagc

SEQ ID NO: 4714712 - DNA, 12 bp, Homo sapiens
tgtttgattttt

SEQ ID NO: 4714713 - DNA, 16 bp, Homo sapiens
tgtttgcctctgcctc

SEQ ID NO: 4714714 - DNA, 18 bp, Homo sapiens
tgtttggaatattgtcca

SEQ ID NO: 4714715 - DNA, 20 bp, Homo sapiens
tgtttgtataccatgatgca

SEQ ID NO: 4714716 - DNA, 13 bp, Homo sapiens
tgtttgtgctgtg

SEQ ID NO: 4714717 - DNA, 15 bp, Homo sapiens
tgtttgttctcttat

SEQ ID NO: 4714718 - DNA, 20 bp, Homo sapiens
tgttttaaaagtttgtcctt

SEQ ID NO: 4714719 - DNA, 20 bp, Homo sapiens
tgttttaagaggcagggtct

SEQ ID NO: 4714720 - DNA, 17 bp, Homo sapiens
tgttttaagccacaaag

SEQ ID NO: 4714721 - DNA, 16 bp, Homo sapiens
tgttttaataacttat

SEQ ID NO: 4714722 - DNA, 13 bp, Homo sapiens
tgttttgagacat

SEQ ID NO: 4714723 - DNA, 16 bp, Homo sapiens
tgtttttctattaaaa

SEQ ID NO: 4714724 - DNA, 18 bp, Homo sapiens
tgtttttctattaaaaga

SEQ ID NO: 4714725 - DNA, 19 bp, Homo sapiens
tgtttttctattaaaagac

SEQ ID NO: 4714726 - DNA, 22 bp, Homo sapiens
tgtttttgtatttattaatttg

SEQ ID NO: 4714727 - DNA, 21 bp, Homo sapiens
tgttttttttttttttgctta

SEQ ID NO: 4714728 - DNA, 19 bp, Homo sapiens
ttaaaaaaaactatttaac

SEQ ID NO: 4714729 - DNA, 13 bp, Homo sapiens
ttaaaaaagagac

SEQ ID NO: 4714730 - DNA, 13 bp, Homo sapiens
ttaaaaaatctgt

SEQ ID NO: 4714731 - DNA, 19 bp, Homo sapiens
ttaaaaatgtagaaattct

SEQ ID NO: 4714732 - DNA, 14 bp, Homo sapiens
ttaaaaattgttat

SEQ ID NO: 4714733 - DNA, 14 bp, Homo sapiens
ttaaaagacaaaca

SEQ ID NO: 4714734 - DNA, 16 bp, Homo sapiens
ttaaaagacaaacacc

SEQ ID NO: 4714735 - DNA, 15 bp, Homo sapiens
ttaaaagcaaaaaga

SEQ ID NO: 4714736 - DNA, 19 bp, Homo sapiens
ttaaaagcaaaaagatgta

SEQ ID NO: 4714737 - DNA, 23 bp, Homo sapiens
ttaaaaggtataattaaacttct

SEQ ID NO: 4714738 - DNA, 16 bp, Homo sapiens
ttaaaagtaaaattgt

SEQ ID NO: 4714739 - DNA, 16 bp, Homo sapiens
ttaaaagtttgtcctt

SEQ ID NO: 4714740 - DNA, 19 bp, Homo sapiens
ttaaaatatcttttgacct

SEQ ID NO: 4714741 - DNA, 14 bp, Homo sapiens
ttaaaatccagtat

SEQ ID NO: 4714742 - DNA, 15 bp, Homo sapiens
ttaaaatccagtatt

SEQ ID NO: 4714743 - DNA, 20 bp, Homo sapiens
ttaaaatggatttaatccat

SEQ ID NO: 4714744 - DNA, 15 bp, Homo sapiens
ttaaaattgccattt

SEQ ID NO: 4714745 - DNA, 22 bp, Homo sapiens
ttaaacaaatgtatgattacat

SEQ ID NO: 4714746 - DNA, 19 bp, Homo sapiens
ttaaacataataaatcaca

SEQ ID NO: 4714747 - DNA, 21 bp, Homo sapiens
ttaaacatcattggataaatt

SEQ ID NO: 4714748 - DNA, 13 bp, Homo sapiens
ttaaacattttca

SEQ ID NO: 4714749 - DNA, 23 bp, Homo sapiens
ttaaacgctctaggtacgatgac

SEQ ID NO: 4714750 - DNA, 13 bp, Homo sapiens
ttaaactgtattt

SEQ ID NO: 4714751 - DNA, 12 bp, Homo sapiens
ttaaacttcttt

SEQ ID NO: 4714752 - DNA, 20 bp, Homo sapiens
ttaaactttcaatatcttta

SEQ ID NO: 4714753 - DNA, 19 bp, Homo sapiens
ttaaaggacaaacagtgaa

SEQ ID NO: 4714754 - DNA, 13 bp, Homo sapiens
ttaaaggataatg

SEQ ID NO: 4714755 - DNA, 18 bp, Homo sapiens
ttaaatagtaaaaataaa

SEQ ID NO: 4714756 - DNA, 17 bp, Homo sapiens
ttaaatgcccagcccct

SEQ ID NO: 4714757 - DNA, 15 bp, Homo sapiens
ttaaatgtagaaagt

SEQ ID NO: 4714758 - DNA, 17 bp, Homo sapiens
ttaaattctctctaaca

SEQ ID NO: 4714759 - DNA, 18 bp, Homo sapiens
ttaaattctctctaacat

SEQ ID NO: 4714760 - DNA, 16 bp, Homo sapiens
ttaaattgtgtacact

SEQ ID NO: 4714761 - DNA, 15 bp, Homo sapiens
ttaaattgtgtttta

SEQ ID NO: 4714762 - DNA, 13 bp, Homo sapiens
ttaaatttgtaag

SEQ ID NO: 4714763 - DNA, 14 bp, Homo sapiens
ttaaatttgtaagt

SEQ ID NO: 4714764 - DNA, 21 bp, Homo sapiens
ttaaatttgtaagtttcaggt

SEQ ID NO: 4714765 - DNA, 14 bp, Homo sapiens
ttaaattttgtgtc

SEQ ID NO: 4714766 - DNA, 16 bp, Homo sapiens
ttaaattttgtgtctc

SEQ ID NO: 4714767 - DNA, 22 bp, Homo sapiens
ttaacaaatgctctgtcttcaa

SEQ ID NO: 4714768 - DNA, 13 bp, Homo sapiens
ttaacactgagct

SEQ ID NO: 4714769 - DNA, 20 bp, Homo sapiens
ttaacactgtaatatcttta

SEQ ID NO: 4714770 - DNA, 19 bp, Homo sapiens
ttaacagcgtgtcaacttt

SEQ ID NO: 4714771 - DNA, 22 bp, Homo sapiens
ttaacaggttttcttctaatca

SEQ ID NO: 4714772 - DNA, 21 bp, Homo sapiens
ttaaccaagttgtttattcca

SEQ ID NO: 4714773 - DNA, 14 bp, Homo sapiens
ttaacctatttcca

SEQ ID NO: 4714774 - DNA, 14 bp, Homo sapiens
ttaacgtttctcat

SEQ ID NO: 4714775 - DNA, 20 bp, Homo sapiens
ttaacgtttctcattaaaat

SEQ ID NO: 4714776 - DNA, 18 bp, Homo sapiens
ttaactctggattttgaa

SEQ ID NO: 4714777 - DNA, 13 bp, Homo sapiens
ttaactgtggata

SEQ ID NO: 4714778 - DNA, 15 bp, Homo sapiens
ttaactgtggatatt

SEQ ID NO: 4714779 - DNA, 15 bp, Homo sapiens
ttaagaaatagaatt

SEQ ID NO: 4714780 - DNA, 20 bp, Homo sapiens
ttaagaactaaaatgttcta

SEQ ID NO: 4714781 - DNA, 13 bp, Homo sapiens
ttaagaagaaaat

SEQ ID NO: 4714782 - DNA, 21 bp, Homo sapiens
ttaagaagctgttgtacattt

SEQ ID NO: 4714783 - DNA, 19 bp, Homo sapiens
ttaagaatagtctctgggt

SEQ ID NO: 4714784 - DNA, 16 bp, Homo sapiens
ttaagaggcagggtct

SEQ ID NO: 4714785 - DNA, 16 bp, Homo sapiens
ttaagatttttctcaa

SEQ ID NO: 4714786 - DNA, 15 bp, Homo sapiens
ttaagcatcacatta

SEQ ID NO: 4714787 - DNA, 13 bp, Homo sapiens
ttaagccctgagg

SEQ ID NO: 4714788 - DNA, 21 bp, Homo sapiens
ttaagccttataaaccaatct

SEQ ID NO: 4714789 - DNA, 14 bp, Homo sapiens
ttaagctctgagct

SEQ ID NO: 4714790 - DNA, 15 bp, Homo sapiens
ttaagctctgagctg

SEQ ID NO: 4714791 - DNA, 16 bp, Homo sapiens
ttaagctctgagctgt

SEQ ID NO: 4714792 - DNA, 16 bp, Homo sapiens
ttaaggaaactcttat

SEQ ID NO: 4714793 - DNA, 20 bp, Homo sapiens
ttaaggctgtgtgaattttt

SEQ ID NO: 4714794 - DNA, 20 bp, Homo sapiens
ttaagtcctacttttaaaga

SEQ ID NO: 4714795 - DNA, 21 bp, Homo sapiens
ttaagtgcgtgtgtagagtta

SEQ ID NO: 4714796 - DNA, 21 bp, Homo sapiens
ttaagttacaattacatctct

SEQ ID NO: 4714797 - DNA, 22 bp, Homo sapiens
ttaagttacacatttttcagat

SEQ ID NO: 4714798 - DNA, 16 bp, Homo sapiens
ttaataaaagtacatg

SEQ ID NO: 4714799 - DNA, 13 bp, Homo sapiens
ttaataacattac

SEQ ID NO: 4714800 - DNA, 15 bp, Homo sapiens
ttaataacattacct

SEQ ID NO: 4714801 - DNA, 21 bp, Homo sapiens
ttaataacattaccttactgt

SEQ ID NO: 4714802 - DNA, 15 bp, Homo sapiens
ttaatactaattttc

SEQ ID NO: 4714803 - DNA, 20 bp, Homo sapiens
ttaatactaattttccataa

SEQ ID NO: 4714804 - DNA, 14 bp, Homo sapiens
ttaatagtatatct

SEQ ID NO: 4714805 - DNA, 21 bp, Homo sapiens
ttaatatctattccatttgta

SEQ ID NO: 4714806 - DNA, 13 bp, Homo sapiens
ttaatatggctct

SEQ ID NO: 4714807 - DNA, 16 bp, Homo sapiens
ttaatatggggatgca

SEQ ID NO: 4714808 - DNA, 14 bp, Homo sapiens
ttaatatttattga

SEQ ID NO: 4714809 - DNA, 16 bp, Homo sapiens
ttaatatttattgaat

SEQ ID NO: 4714810 - DNA, 22 bp, Homo sapiens
ttaatcacagtcatctttaaca

SEQ ID NO: 4714811 - DNA, 22 bp, Homo sapiens
ttaatcagaatatcagaatatg

SEQ ID NO: 4714812 - DNA, 13 bp, Homo sapiens
ttaatcctgtacc

SEQ ID NO: 4714813 - DNA, 17 bp, Homo sapiens
ttaatcctgtaccaaat

SEQ ID NO: 4714814 - DNA, 22 bp, Homo sapiens
ttaatcctgtaccaaatctgac

SEQ ID NO: 4714815 - DNA, 20 bp, Homo sapiens
ttaatctgggcagacattat

SEQ ID NO: 4714816 - DNA, 15 bp, Homo sapiens
ttaatctgttgtttg

SEQ ID NO: 4714817 - DNA, 22 bp, Homo sapiens
tgggagctgcctgttcagctcc

SEQ ID NO: 4714818 - DNA, 23 bp, Homo sapiens
tgggagctgcctgttcagctcca

SEQ ID NO: 4714819 - DNA, 24 bp, Homo sapiens
tgggagctgcctgttcagctccag

SEQ ID NO: 4714820 - DNA, 15 bp, Homo sapiens
tgggagtcaagtgtg

SEQ ID NO: 4714821 - DNA, 16 bp, Homo sapiens
tgggagtgggcccaat

SEQ ID NO: 4714822 - DNA, 12 bp, Homo sapiens
tgggatcctcca

SEQ ID NO: 4714823 - DNA, 13 bp, Homo sapiens
tgggatcctccag

SEQ ID NO: 4714824 - DNA, 16 bp, Homo sapiens
tgggatctgcccctcc

SEQ ID NO: 4714825 - DNA, 18 bp, Homo sapiens
tgggatggtggagggcca

SEQ ID NO: 4714826 - DNA, 21 bp, Homo sapiens
tgggcacccagcctctaggga

SEQ ID NO: 4714827 - DNA, 11 bp, Homo sapiens
tgggcagagca

SEQ ID NO: 4714828 - DNA, 13 bp, Homo sapiens
tgggcagagcaga

SEQ ID NO: 4714829 - DNA, 15 bp, Homo sapiens
tgggcagagcagaga

SEQ ID NO: 4714830 - DNA, 14 bp, Homo sapiens
tgggcagagcccaa

SEQ ID NO: 4714831 - DNA, 19 bp, Homo sapiens
tgggcagctcatctctgtc

SEQ ID NO: 4714832 - DNA, 18 bp, Homo sapiens
tgggcagtttttctgtat

SEQ ID NO: 4714833 - DNA, 16 bp, Homo sapiens
tgggcatagatgcagg

SEQ ID NO: 4714834 - DNA, 20 bp, Homo sapiens
tgggccaggttggaaaagaa

SEQ ID NO: 4714835 - DNA, 17 bp, Homo sapiens
tgggccatactggcctc

SEQ ID NO: 4714836 - DNA, 18 bp, Homo sapiens
tgggccatactggcctcg

SEQ ID NO: 4714837 - DNA, 20 bp, Homo sapiens
tgggccatactggcctcgcc

SEQ ID NO: 4714838 - DNA, 13 bp, Homo sapiens
tgggcccaagtga

SEQ ID NO: 4714839 - DNA, 22 bp, Homo sapiens
tgggccccagttgtatttattt

SEQ ID NO: 4714840 - DNA, 13 bp, Homo sapiens
tgggccctctctg

SEQ ID NO: 4714841 - DNA, 13 bp, Homo sapiens
tgggccctgcctc

SEQ ID NO: 4714842 - DNA, 20 bp, Homo sapiens
tgggcctcctcacaacatgg

SEQ ID NO: 4714843 - DNA, 11 bp, Homo sapiens
tgggccttcag

SEQ ID NO: 4714844 - DNA, 12 bp, Homo sapiens
tgggccttcagg

SEQ ID NO: 4714845 - DNA, 15 bp, Homo sapiens
tgggccttcagggag

SEQ ID NO: 4714846 - DNA, 18 bp, Homo sapiens
tgggcgggcagcacagca

SEQ ID NO: 4714847 - DNA, 22 bp, Homo sapiens
tgggcgtggtagtgcaagctga

SEQ ID NO: 4714848 - DNA, 11 bp, Homo sapiens
tgggctccctg

SEQ ID NO: 4714849 - DNA, 19 bp, Homo sapiens
tgggctccctgactgggag

SEQ ID NO: 4714850 - DNA, 19 bp, Homo sapiens
tgggctcccttcccacctc

SEQ ID NO: 4714851 - DNA, 20 bp, Homo sapiens
tgggctcccttcccacctct

SEQ ID NO: 4714852 - DNA, 21 bp, Homo sapiens
tgggctctgtgggctgcactc

SEQ ID NO: 4714853 - DNA, 18 bp, Homo sapiens
tgggctggaacagattca

SEQ ID NO: 4714854 - DNA, 14 bp, Homo sapiens
tgggctgtgcctgg

SEQ ID NO: 4714855 - DNA, 14 bp, Homo sapiens
tgggcttagagcag

SEQ ID NO: 4714856 - DNA, 23 bp, Homo sapiens
tgggcttcactgtataaatagga

SEQ ID NO: 4714857 - DNA, 15 bp, Homo sapiens
tgggcttcagtggca

SEQ ID NO: 4714858 - DNA, 17 bp, Homo sapiens
tgggcttcagtggcagc

SEQ ID NO: 4714859 - DNA, 12 bp, Homo sapiens
tgggcttcccag

SEQ ID NO: 4714860 - DNA, 19 bp, Homo sapiens
tgggcttcccagtggctgc

SEQ ID NO: 4714861 - DNA, 21 bp, Homo sapiens
tgggcttcccagtggctgctg

SEQ ID NO: 4714862 - DNA, 16 bp, Homo sapiens
tggggaagggcctgcc

SEQ ID NO: 4714863 - DNA, 14 bp, Homo sapiens
tggggaccccaccc

SEQ ID NO: 4714864 - DNA, 19 bp, Homo sapiens
tggggaccccacccctcat

SEQ ID NO: 4714865 - DNA, 19 bp, Homo sapiens
tggggacctgatggagagt

SEQ ID NO: 4714866 - DNA, 17 bp, Homo sapiens
tggggagactgggctga

SEQ ID NO: 4714867 - DNA, 23 bp, Homo sapiens
tggggatgagaaaggttgaagca

SEQ ID NO: 4714868 - DNA, 22 bp, Homo sapiens
tggggcatgacccagtgaagat

SEQ ID NO: 4714869 - DNA, 20 bp, Homo sapiens
tggggcccatggaggagaca

SEQ ID NO: 4714870 - DNA, 21 bp, Homo sapiens
tggggcccatggaggagacag

SEQ ID NO: 4714871 - DNA, 12 bp, Homo sapiens
tggggccctgcc

SEQ ID NO: 4714872 - DNA, 15 bp, Homo sapiens
tggggccctgcctcc

SEQ ID NO: 4714873 - DNA, 16 bp, Homo sapiens
tggggccctgcctcct

SEQ ID NO: 4714874 - DNA, 19 bp, Homo sapiens
tggggcctatcagtgtgcc

SEQ ID NO: 4714875 - DNA, 19 bp, Homo sapiens
tggggcctgatggggaggg

SEQ ID NO: 4714876 - DNA, 18 bp, Homo sapiens
tggggcggtgagagggga

SEQ ID NO: 4714877 - DNA, 12 bp, Homo sapiens
tggggctgctgg

SEQ ID NO: 4714878 - DNA, 17 bp, Homo sapiens
tgggggaagacctggca

SEQ ID NO: 4714879 - DNA, 23 bp, Homo sapiens
tgggggaagagcacagccctccc

SEQ ID NO: 4714880 - DNA, 16 bp, Homo sapiens
tgggggcctcagtgcc

SEQ ID NO: 4714881 - DNA, 14 bp, Homo sapiens
tggggtaccagcca

SEQ ID NO: 4714882 - DNA, 18 bp, Homo sapiens
tggggtacccactgctct

SEQ ID NO: 4714883 - DNA, 20 bp, Homo sapiens
tggggtacccactgctctgg

SEQ ID NO: 4714884 - DNA, 14 bp, Homo sapiens
tggggtcactctgg

SEQ ID NO: 4714885 - DNA, 17 bp, Homo sapiens
tggggtcactctggcag

SEQ ID NO: 4714886 - DNA, 18 bp, Homo sapiens
tggggttcggcctgtgtc

SEQ ID NO: 4714887 - DNA, 23 bp, Homo sapiens
tgggtacttgtggacacagctct

SEQ ID NO: 4714888 - DNA, 13 bp, Homo sapiens
tgggtcattttta

SEQ ID NO: 4714889 - DNA, 17 bp, Homo sapiens
tgggtccatgggcagag

SEQ ID NO: 4714890 - DNA, 17 bp, Homo sapiens
tgggtcccacttcccct

SEQ ID NO: 4714891 - DNA, 14 bp, Homo sapiens
tgggtcgggagagg

SEQ ID NO: 4714892 - DNA, 21 bp, Homo sapiens
tgggtgcgaccccatctgccc

SEQ ID NO: 4714893 - DNA, 14 bp, Homo sapiens
tgggtggatgcctg

SEQ ID NO: 4714894 - DNA, 16 bp, Homo sapiens
tgggtgggtgggccct

SEQ ID NO: 4714895 - DNA, 15 bp, Homo sapiens
tgggtggtttttatt

SEQ ID NO: 4714896 - DNA, 19 bp, Homo sapiens
tgggtggtttttattttta

SEQ ID NO: 4714897 - DNA, 23 bp, Homo sapiens
tgggtgtcaagagggtctgagga

SEQ ID NO: 4714898 - DNA, 21 bp, Homo sapiens
tgggttagggaaaacattcca

SEQ ID NO: 4714899 - DNA, 14 bp, Homo sapiens
tgggttagtggatg

SEQ ID NO: 4714900 - DNA, 16 bp, Homo sapiens
tgggttcactgcaacc

SEQ ID NO: 4714901 - DNA, 22 bp, Homo sapiens
tgggttctacccaggtgctagg

SEQ ID NO: 4714902 - DNA, 14 bp, Homo sapiens
tgggtttcaattta

SEQ ID NO: 4714903 - DNA, 19 bp, Homo sapiens
tgggttttgtattctctga

SEQ ID NO: 4714904 - DNA, 19 bp, Homo sapiens
tggtaagagttaaagagta

SEQ ID NO: 4714905 - DNA, 15 bp, Homo sapiens
tggtacaaatgtgat

SEQ ID NO: 4714906 - DNA, 15 bp, Homo sapiens
tggtaccaggtctcc

SEQ ID NO: 4714907 - DNA, 15 bp, Homo sapiens
tggtactaaggagaa

SEQ ID NO: 4714908 - DNA, 23 bp, Homo sapiens
tggtagcctcgatgtcctcctct

SEQ ID NO: 4714909 - DNA, 16 bp, Homo sapiens
tggtaggtagcacagt

SEQ ID NO: 4714910 - DNA, 18 bp, Homo sapiens
tggtaggtagcacagtgg

SEQ ID NO: 4714911 - DNA, 22 bp, Homo sapiens
tggtcagccctagggtggagag

SEQ ID NO: 4714912 - DNA, 16 bp, Homo sapiens
tggtccaggagaaggc

SEQ ID NO: 4714913 - DNA, 15 bp, Homo sapiens
tggtccatagagagc

SEQ ID NO: 4714914 - DNA, 15 bp, Homo sapiens
tggtcccaccccaca

SEQ ID NO: 4714915 - DNA, 18 bp, Homo sapiens
tggtctacactgtgctga

SEQ ID NO: 4714916 - DNA, 16 bp, Homo sapiens
tggtctcaaactcttg

SEQ ID NO: 4714917 - DNA, 17 bp, Homo sapiens
tggtctcaaactcttga

SEQ ID NO: 4714918 - DNA, 15 bp, Homo sapiens
tggtctcgaactcct

SEQ ID NO: 4714919 - DNA, 16 bp, Homo sapiens
tggtctgacccactgc

SEQ ID NO: 4714920 - DNA, 18 bp, Homo sapiens
tggtctgacccactgctt

SEQ ID NO: 4714921 - DNA, 22 bp, Homo sapiens
tggtctgaggggcaactgagtc

SEQ ID NO: 4714922 - DNA, 19 bp, Homo sapiens
tggtctgctcgggcccagg

SEQ ID NO: 4714923 - DNA, 21 bp, Homo sapiens
tggtctttgtaagagtgtaga

SEQ ID NO: 4714924 - DNA, 15 bp, Homo sapiens
tggtgaacattgcaa

SEQ ID NO: 4714925 - DNA, 20 bp, Homo sapiens
tggtgaacattgcaatagaa

SEQ ID NO: 4714926 - DNA, 14 bp, Homo sapiens
tggtgaacatttta

SEQ ID NO: 4714927 - DNA, 14 bp, Homo sapiens
tggtgaagtgaaaa

SEQ ID NO: 4714928 - DNA, 13 bp, Homo sapiens
tggtgacctctgc

SEQ ID NO: 4714929 - DNA, 15 bp, Homo sapiens
tggtgacctctgcct

SEQ ID NO: 4714930 - DNA, 16 bp, Homo sapiens
tggtgacctctgcctg

SEQ ID NO: 4714931 - DNA, 19 bp, Homo sapiens
tggtgactttcctctttgg

SEQ ID NO: 4714932 - DNA, 22 bp, Homo sapiens
tggtgcatataaatatatttaa

SEQ ID NO: 4714933 - DNA, 11 bp, Homo sapiens
tggtgccttca

SEQ ID NO: 4714934 - DNA, 15 bp, Homo sapiens
tggtgctgcagattt

SEQ ID NO: 4714935 - DNA, 21 bp, Homo sapiens
tggtggaccctactattcatg

SEQ ID NO: 4714936 - DNA, 14 bp, Homo sapiens
tggtggatggtgac

SEQ ID NO: 4714937 - DNA, 15 bp, Homo sapiens
tggtggcagctgcgg

SEQ ID NO: 4714938 - DNA, 20 bp, Homo sapiens
tggtggcagtgggagctgcc

SEQ ID NO: 4714939 - DNA, 16 bp, Homo sapiens
tggtgggtccatgggc

SEQ ID NO: 4714940 - DNA, 14 bp, Homo sapiens
tggtgtaataagac

SEQ ID NO: 4714941 - DNA, 16 bp, Homo sapiens
tggtgtaataagacat

SEQ ID NO: 4714942 - DNA, 21 bp, Homo sapiens
tggtgtcgcgccttctccccc

SEQ ID NO: 4714943 - DNA, 11 bp, Homo sapiens
tggtgtctcca

SEQ ID NO: 4714944 - DNA, 19 bp, Homo sapiens
tggtgtgtccccctctgtc

SEQ ID NO: 4714945 - DNA, 14 bp, Homo sapiens
tggtgtgtgtctct

SEQ ID NO: 4714946 - DNA, 16 bp, Homo sapiens
tggtgtgtgtctctga

SEQ ID NO: 4714947 - DNA, 13 bp, Homo sapiens
tggtgttccattg

SEQ ID NO: 4714948 - DNA, 17 bp, Homo sapiens
tggtgtttcctggcact

SEQ ID NO: 4714949 - DNA, 21 bp, Homo sapiens
tggttagagaagtaagcagag

SEQ ID NO: 4714950 - DNA, 18 bp, Homo sapiens
tggttaggcattgtggga

SEQ ID NO: 4714951 - DNA, 13 bp, Homo sapiens
tggttatttaacg

SEQ ID NO: 4714952 - DNA, 18 bp, Homo sapiens
tggttatttaatcacagt

SEQ ID NO: 4714953 - DNA, 19 bp, Homo sapiens
tggttcagctactttccat

SEQ ID NO: 4714954 - DNA, 20 bp, Homo sapiens
tggttctgatgatgtgcctg

SEQ ID NO: 4714955 - DNA, 22 bp, Homo sapiens
tggttcttcctgttctgtgact

SEQ ID NO: 4714956 - DNA, 15 bp, Homo sapiens
tggttcttctctttt

SEQ ID NO: 4714957 - DNA, 17 bp, Homo sapiens
tggttcttctcttttcc

SEQ ID NO: 4714958 - DNA, 12 bp, Homo sapiens
tggttgaggaaa

SEQ ID NO: 4714959 - DNA, 18 bp, Homo sapiens
tggttgatgatctttgca

SEQ ID NO: 4714960 - DNA, 16 bp, Homo sapiens
tggttgtgggcttgga

SEQ ID NO: 4714961 - DNA, 12 bp, Homo sapiens
tggtttcagttc

SEQ ID NO: 4714962 - DNA, 14 bp, Homo sapiens
tggtttcctgccct

SEQ ID NO: 4714963 - DNA, 20 bp, Homo sapiens
tggtttcctgccctgggagg

SEQ ID NO: 4714964 - DNA, 18 bp, Homo sapiens
tggtttctagatcactgt

SEQ ID NO: 4714965 - DNA, 15 bp, Homo sapiens
tggtttgcaaggaag

SEQ ID NO: 4714966 - DNA, 22 bp, Homo sapiens
tggtttggcccttctccttttg

SEQ ID NO: 4714967 - DNA, 20 bp, Homo sapiens
tggttttgttcccctcctcc

SEQ ID NO: 4714968 - DNA, 19 bp, Homo sapiens
tgtaaaaaaaaatgccttt

SEQ ID NO: 4714969 - DNA, 21 bp, Homo sapiens
tgtaaaagaaaggttgcgttt

SEQ ID NO: 4714970 - DNA, 17 bp, Homo sapiens
tgtaaaagtagtaaatt

SEQ ID NO: 4714971 - DNA, 19 bp, Homo sapiens
tgtaaaatcttcagctggt

SEQ ID NO: 4714972 - DNA, 16 bp, Homo sapiens
tgtaaaccacatgaac

SEQ ID NO: 4714973 - DNA, 14 bp, Homo sapiens
tgtaaactgtgcac

SEQ ID NO: 4714974 - DNA, 12 bp, Homo sapiens
tgtaaagaattg

SEQ ID NO: 4714975 - DNA, 16 bp, Homo sapiens
tgtaaaggaatttaaa

SEQ ID NO: 4714976 - DNA, 19 bp, Homo sapiens
tgtaaagttgcctttattt

SEQ ID NO: 4714977 - DNA, 24 bp, Homo sapiens
tgtaaatactggactcaggaactt

SEQ ID NO: 4714978 - DNA, 15 bp, Homo sapiens
tgtaaatagctcagg

SEQ ID NO: 4714979 - DNA, 21 bp, Homo sapiens
tgtaaatgaacacatggcaga

SEQ ID NO: 4714980 - DNA, 22 bp, Homo sapiens
tgtaaatgaagggtcatttctc

SEQ ID NO: 4714981 - DNA, 15 bp, Homo sapiens
tgtaacatatctgta

SEQ ID NO: 4714982 - DNA, 15 bp, Homo sapiens
tgtaacttccaaata

SEQ ID NO: 4714983 - DNA, 21 bp, Homo sapiens
tgtaacttccaaataaataat

SEQ ID NO: 4714984 - DNA, 15 bp, Homo sapiens
tgtaagagtgtagaa

SEQ ID NO: 4714985 - DNA, 21 bp, Homo sapiens
tgtaagagtgtagaagcattc

SEQ ID NO: 4714986 - DNA, 19 bp, Homo sapiens
tgtaagcttagattttctg

SEQ ID NO: 4714987 - DNA, 12 bp, Homo sapiens
tgtaaggtatat

SEQ ID NO: 4714988 - DNA, 13 bp, Homo sapiens
tgtaagtttcagg

SEQ ID NO: 4714989 - DNA, 15 bp, Homo sapiens
tgtaagtttcaggtg

SEQ ID NO: 4714990 - DNA, 20 bp, Homo sapiens
tgtaagtttcaggtgacatg

SEQ ID NO: 4714991 - DNA, 12 bp, Homo sapiens
tgtaataagaca

SEQ ID NO: 4714992 - DNA, 13 bp, Homo sapiens
tgtaataagacat

SEQ ID NO: 4714993 - DNA, 15 bp, Homo sapiens
tgtaatatttcttca

SEQ ID NO: 4714994 - DNA, 23 bp, Homo sapiens
tgtaattggaatcttcacctcag

SEQ ID NO: 4714995 - DNA, 16 bp, Homo sapiens
tgtacagagcccacgc

SEQ ID NO: 4714996 - DNA, 18 bp, Homo sapiens
tgtacagagcccacgccc

SEQ ID NO: 4714997 - DNA, 18 bp, Homo sapiens
tgtacagtctcaattttg

SEQ ID NO: 4714998 - DNA, 14 bp, Homo sapiens
tgtacagtcttgta

SEQ ID NO: 4714999 - DNA, 12 bp, Homo sapiens
tgtacagttttt

SEQ ID NO: 4715000 - DNA, 21 bp, Homo sapiens
tgtacatttatgatttaataa

SEQ ID NO: 4715001 - DNA, 20 bp, Homo sapiens
tgtaccaaatctgacatatt

SEQ ID NO: 4715002 - DNA, 23 bp, Homo sapiens
tgtaccatgtacctaatccaaat

SEQ ID NO: 4715003 - DNA, 18 bp, Homo sapiens
tgtactctgtgtgtgtat

SEQ ID NO: 4715004 - DNA, 19 bp, Homo sapiens
tgtactggagagtggcaaa

SEQ ID NO: 4715005 - DNA, 19 bp, Homo sapiens
tgtactgtatggaaacact

SEQ ID NO: 4715006 - DNA, 24 bp, Homo sapiens
tgtactgtatggaaacactgattt

SEQ ID NO: 4715007 - DNA, 13 bp, Homo sapiens
tgtactttgcttc

SEQ ID NO: 4715008 - DNA, 16 bp, Homo sapiens
tgtactttttgttcca

SEQ ID NO: 4715009 - DNA, 20 bp, Homo sapiens
tgtagaaaagggaactgaac

SEQ ID NO: 4715010 - DNA, 23 bp, Homo sapiens
tgtagaaaagggaactgaacatt

SEQ ID NO: 4715011 - DNA, 13 bp, Homo sapiens
tgtagaagcattc

SEQ ID NO: 4715012 - DNA, 12 bp, Homo sapiens
tgtagagttaag

SEQ ID NO: 4715013 - DNA, 13 bp, Homo sapiens
tgtagagttaaga

SEQ ID NO: 4715014 - DNA, 15 bp, Homo sapiens
tgtagagttaagaag

SEQ ID NO: 4715015 - DNA, 18 bp, Homo sapiens
tgtagagttaagaagctg

SEQ ID NO: 4715016 - DNA, 17 bp, Homo sapiens
tgtagataatacagttc

SEQ ID NO: 4715017 - DNA, 11 bp, Homo sapiens
tgtagccatgg

SEQ ID NO: 4715018 - DNA, 15 bp, Homo sapiens
tgtagccatgggacc

SEQ ID NO: 4715019 - DNA, 16 bp, Homo sapiens
tgtagccatgggacca

SEQ ID NO: 4715020 - DNA, 21 bp, Homo sapiens
tgtagggaaaaaaatgcttct

SEQ ID NO: 4715021 - DNA, 22 bp, Homo sapiens
tgtaggggagccacatttacat

SEQ ID NO: 4715022 - DNA, 13 bp, Homo sapiens
tgtataaaagtgt

SEQ ID NO: 4715023 - DNA, 21 bp, Homo sapiens
tgtataaaagtgtgaaataaa

SEQ ID NO: 4715024 - DNA, 13 bp, Homo sapiens
tgtataaattaat

SEQ ID NO: 4715025 - DNA, 15 bp, Homo sapiens
tgtataatattttta

SEQ ID NO: 4715026 - DNA, 21 bp, Homo sapiens
tgtataccatgatgcatggag

SEQ ID NO: 4715027 - DNA, 22 bp, Homo sapiens
tgtatatagctctacacaacat

SEQ ID NO: 4715028 - DNA, 13 bp, Homo sapiens
tgtatatgaaaac

SEQ ID NO: 4715029 - DNA, 14 bp, Homo sapiens
tgtatatgaaaaca

SEQ ID NO: 4715030 - DNA, 17 bp, Homo sapiens
tgtatatgtataaatta

SEQ ID NO: 4715031 - DNA, 13 bp, Homo sapiens
tgtatatttacat

SEQ ID NO: 4715032 - DNA, 13 bp, Homo sapiens
tgtatatttgcat

SEQ ID NO: 4715033 - DNA, 17 bp, Homo sapiens
tgtatattttgttacct

SEQ ID NO: 4715034 - DNA, 19 bp, Homo sapiens
tgtatatttttatattgtt

SEQ ID NO: 4715035 - DNA, 16 bp, Homo sapiens
tgtatgagaagtactt

SEQ ID NO: 4715036 - DNA, 17 bp, Homo sapiens
tgtatgagaagtacttt

SEQ ID NO: 4715037 - DNA, 13 bp, Homo sapiens
tgtatgcgtgtgt

SEQ ID NO: 4715038 - DNA, 14 bp, Homo sapiens
tgagtactacagtc

SEQ ID NO: 4715039 - DNA, 23 bp, Homo sapiens
tgagtactacagtcctcccatct

SEQ ID NO: 4715040 - DNA, 16 bp, Homo sapiens
tgagtcaccaagccca

SEQ ID NO: 4715041 - DNA, 17 bp, Homo sapiens
tgagtcaccaagcccag

SEQ ID NO: 4715042 - DNA, 19 bp, Homo sapiens
tgagtcccctgtttgtttc

SEQ ID NO: 4715043 - DNA, 21 bp, Homo sapiens
tgagtcccctgtttgtttctg

SEQ ID NO: 4715044 - DNA, 14 bp, Homo sapiens
tgagtcgaggacag

SEQ ID NO: 4715045 - DNA, 11 bp, Homo sapiens
tgagtctctga

SEQ ID NO: 4715046 - DNA, 12 bp, Homo sapiens
tgagtctctgaa

SEQ ID NO: 4715047 - DNA, 15 bp, Homo sapiens
tgagtctgaaggctg

SEQ ID NO: 4715048 - DNA, 14 bp, Homo sapiens
tgagtctggcaaac

SEQ ID NO: 4715049 - DNA, 12 bp, Homo sapiens
tgagtgcctggc

SEQ ID NO: 4715050 - DNA, 13 bp, Homo sapiens
tgagtgctctgat

SEQ ID NO: 4715051 - DNA, 21 bp, Homo sapiens
tgagtggtgttggcagtgttt

SEQ ID NO: 4715052 - DNA, 23 bp, Homo sapiens
tgagttgcaccattctttcttgg

SEQ ID NO: 4715053 - DNA, 20 bp, Homo sapiens
tgagttggtgttgacatgtg

SEQ ID NO: 4715054 - DNA, 18 bp, Homo sapiens
tgagttttcttctgtgat

SEQ ID NO: 4715055 - DNA, 19 bp, Homo sapiens
tgataagagggcacacact

SEQ ID NO: 4715056 - DNA, 22 bp, Homo sapiens
tgataatacagatttgtaacat

SEQ ID NO: 4715057 - DNA, 19 bp, Homo sapiens
tgataatattgtggtgcca

SEQ ID NO: 4715058 - DNA, 15 bp, Homo sapiens
tgataatgttaaatt

SEQ ID NO: 4715059 - DNA, 16 bp, Homo sapiens
tgataatgttaaattt

SEQ ID NO: 4715060 - DNA, 18 bp, Homo sapiens
tgataatgttaaatttgt

SEQ ID NO: 4715061 - DNA, 20 bp, Homo sapiens
tgataattttttaattattt

SEQ ID NO: 4715062 - DNA, 17 bp, Homo sapiens
tgatacgatagttacat

SEQ ID NO: 4715063 - DNA, 20 bp, Homo sapiens
tgatactgttgcacgtgtgt

SEQ ID NO: 4715064 - DNA, 15 bp, Homo sapiens
tgatagcacagaccc

SEQ ID NO: 4715065 - DNA, 16 bp, Homo sapiens
tgatagcacagaccct

SEQ ID NO: 4715066 - DNA, 20 bp, Homo sapiens
tgatagcacagaccctgccc

SEQ ID NO: 4715067 - DNA, 17 bp, Homo sapiens
tgatagggatacatgct

SEQ ID NO: 4715068 - DNA, 16 bp, Homo sapiens
tgatagtgcttcttgt

SEQ ID NO: 4715069 - DNA, 20 bp, Homo sapiens
tgatagtgcttcttgtaata

SEQ ID NO: 4715070 - DNA, 17 bp, Homo sapiens
tgatatggcagaagaca

SEQ ID NO: 4715071 - DNA, 20 bp, Homo sapiens
tgatatggcagaagacacca

SEQ ID NO: 4715072 - DNA, 16 bp, Homo sapiens
tgatatttgcattgag

SEQ ID NO: 4715073 - DNA, 17 bp, Homo sapiens
tgatcaacatcttttct

SEQ ID NO: 4715074 - DNA, 14 bp, Homo sapiens
tgatcacctgccct

SEQ ID NO: 4715075 - DNA, 14 bp, Homo sapiens
tgatcacggctcac

SEQ ID NO: 4715076 - DNA, 19 bp, Homo sapiens
tgatcacggctcactgcag

SEQ ID NO: 4715077 - DNA, 20 bp, Homo sapiens
tgatcacggctcactgcagc

SEQ ID NO: 4715078 - DNA, 14 bp, Homo sapiens
tgatcactgagcca

SEQ ID NO: 4715079 - DNA, 22 bp, Homo sapiens
tgatcagagccgtggtcctttg

SEQ ID NO: 4715080 - DNA, 14 bp, Homo sapiens
tgatcatatttgtg

SEQ ID NO: 4715081 - DNA, 13 bp, Homo sapiens
tgatcatctttgc

SEQ ID NO: 4715082 - DNA, 22 bp, Homo sapiens
tgatcattcataattttatcta

SEQ ID NO: 4715083 - DNA, 18 bp, Homo sapiens
tgatccacccacctcagc

SEQ ID NO: 4715084 - DNA, 20 bp, Homo sapiens
tgatccacccacctcagcct

SEQ ID NO: 4715085 - DNA, 21 bp, Homo sapiens
tgatccacccacctcagcctc

SEQ ID NO: 4715086 - DNA, 14 bp, Homo sapiens
tgatccactcgcct

SEQ ID NO: 4715087 - DNA, 16 bp, Homo sapiens
tgatcctagttccacc

SEQ ID NO: 4715088 - DNA, 18 bp, Homo sapiens
tgatcctcccacctcagc

SEQ ID NO: 4715089 - DNA, 21 bp, Homo sapiens
tgatcctcccacctcagcctc

SEQ ID NO: 4715090 - DNA, 18 bp, Homo sapiens
tgatccttccacctcagt

SEQ ID NO: 4715091 - DNA, 15 bp, Homo sapiens
tgatcgcctttccca

SEQ ID NO: 4715092 - DNA, 15 bp, Homo sapiens
tgatctaggaagact

SEQ ID NO: 4715093 - DNA, 21 bp, Homo sapiens
tgatctaggaagactttggaa

SEQ ID NO: 4715094 - DNA, 20 bp, Homo sapiens
tgatctgatgcaagcaagaa

SEQ ID NO: 4715095 - DNA, 17 bp, Homo sapiens
tgatcttacctttatga

SEQ ID NO: 4715096 - DNA, 19 bp, Homo sapiens
tgatctttgcagacaggca

SEQ ID NO: 4715097 - DNA, 20 bp, Homo sapiens
tgatctttgcagacaggcaa

SEQ ID NO: 4715098 - DNA, 21 bp, Homo sapiens
tgatctttgcagacaggcaag

SEQ ID NO: 4715099 - DNA, 18 bp, Homo sapiens
tgatgaaatgtaaatact

SEQ ID NO: 4715100 - DNA, 14 bp, Homo sapiens
tgatgaatactgta

SEQ ID NO: 4715101 - DNA, 21 bp, Homo sapiens
tgatgacaactggaatagttt

SEQ ID NO: 4715102 - DNA, 16 bp, Homo sapiens
tgatgaggccctccac

SEQ ID NO: 4715103 - DNA, 17 bp, Homo sapiens
tgatgaggccctccaca

SEQ ID NO: 4715104 - DNA, 21 bp, Homo sapiens
tgatgaggccctccacacctg

SEQ ID NO: 4715105 - DNA, 19 bp, Homo sapiens
tgatgatctttgcagacag

SEQ ID NO: 4715106 - DNA, 20 bp, Homo sapiens
tgatgatctttgcagacagg

SEQ ID NO: 4715107 - DNA, 21 bp, Homo sapiens
tgatgatctttgcagacaggc

SEQ ID NO: 4715108 - DNA, 17 bp, Homo sapiens
tgatgcatgcactgttc

SEQ ID NO: 4715109 - DNA, 23 bp, Homo sapiens
tgatgcatgcactgttccccctg

SEQ ID NO: 4715110 - DNA, 17 bp, Homo sapiens
tgatgccacaccaagct

SEQ ID NO: 4715111 - DNA, 20 bp, Homo sapiens
tgatgccacaccaagctgtg

SEQ ID NO: 4715112 - DNA, 22 bp, Homo sapiens
tgatgccacaccaagctgtgcc

SEQ ID NO: 4715113 - DNA, 23 bp, Homo sapiens
tgatgctacaggatttgaaattg

SEQ ID NO: 4715114 - DNA, 13 bp, Homo sapiens
tgatgctgggctg

SEQ ID NO: 4715115 - DNA, 15 bp, Homo sapiens
tgatgctgggctggg

SEQ ID NO: 4715116 - DNA, 18 bp, Homo sapiens
tgatgctgggctgggtgc

SEQ ID NO: 4715117 - DNA, 17 bp, Homo sapiens
tgatgcttcttcagaga

SEQ ID NO: 4715118 - DNA, 19 bp, Homo sapiens
tgatgcttcttcagagact

SEQ ID NO: 4715119 - DNA, 13 bp, Homo sapiens
tgatggcttctcc

SEQ ID NO: 4715120 - DNA, 13 bp, Homo sapiens
tgatggggccctg

SEQ ID NO: 4715121 - DNA, 16 bp, Homo sapiens
tgatggtgatgaaatg

SEQ ID NO: 4715122 - DNA, 22 bp, Homo sapiens
tgatgtaatcttgaattgtaac

SEQ ID NO: 4715123 - DNA, 18 bp, Homo sapiens
tgatgttactgagatgtt

SEQ ID NO: 4715124 - DNA, 22 bp, Homo sapiens
tgatgttgggaagctatttcct

SEQ ID NO: 4715125 - DNA, 17 bp, Homo sapiens
tgatgttttccatgagt

SEQ ID NO: 4715126 - DNA, 19 bp, Homo sapiens
tgatgttttccatgagtcc

SEQ ID NO: 4715127 - DNA, 23 bp, Homo sapiens
tgatgttttccatgagtcccctg

SEQ ID NO: 4715128 - DNA, 17 bp, Homo sapiens
tgattaatggaaatgtt

SEQ ID NO: 4715129 - DNA, 19 bp, Homo sapiens
tgattagaaaggaaatgaa

SEQ ID NO: 4715130 - DNA, 15 bp, Homo sapiens
tgattagttaaaaaa

SEQ ID NO: 4715131 - DNA, 16 bp, Homo sapiens
tgattattcagtgtca

SEQ ID NO: 4715132 - DNA, 15 bp, Homo sapiens
tgattcactatttaa

SEQ ID NO: 4715133 - DNA, 16 bp, Homo sapiens
tgattcactatttaaa

SEQ ID NO: 4715134 - DNA, 19 bp, Homo sapiens
tgattcagacagctgcctg

SEQ ID NO: 4715135 - DNA, 12 bp, Homo sapiens
tgattcagtgtt

SEQ ID NO: 4715136 - DNA, 21 bp, Homo sapiens
tgattcagtgttaaatgtgat

SEQ ID NO: 4715137 - DNA, 14 bp, Homo sapiens
tgattcatattgca

SEQ ID NO: 4715138 - DNA, 15 bp, Homo sapiens
tgattcccaagctct

SEQ ID NO: 4715139 - DNA, 16 bp, Homo sapiens
tgattcccaagctctg

SEQ ID NO: 4715140 - DNA, 23 bp, Homo sapiens
tgattcccaagctctgctcctct

SEQ ID NO: 4715141 - DNA, 20 bp, Homo sapiens
tgattctcagggtctctgct

SEQ ID NO: 4715142 - DNA, 23 bp, Homo sapiens
tgattctcagggtctctgctgcc

SEQ ID NO: 4715143 - DNA, 21 bp, Homo sapiens
tgattctcctgcctcagcctc

SEQ ID NO: 4715144 - DNA, 23 bp, Homo sapiens
tgattctccttcagccctcaccc

SEQ ID NO: 4715145 - DNA, 15 bp, Homo sapiens
tgattgggacagagg

SEQ ID NO: 4715146 - DNA, 17 bp, Homo sapiens
tgattgggacagaggtt

SEQ ID NO: 4715147 - DNA, 16 bp, Homo sapiens
tgattgtgtctcttgg

SEQ ID NO: 4715148 - DNA, 14 bp, Homo sapiens
tgatttaataaaat

SEQ ID NO: 4715149 - DNA, 15 bp, Homo sapiens
tgatttaataaaata

SEQ ID NO: 4715150 - DNA, 23 bp, Homo sapiens
tgatttaataaaataattctaaa

SEQ ID NO: 4715151 - DNA, 15 bp, Homo sapiens
tgatttacatgctga

SEQ ID NO: 4715152 - DNA, 16 bp, Homo sapiens
tgatttacatgctgat

SEQ ID NO: 4715153 - DNA, 22 bp, Homo sapiens
tgatttaggtagccttgtgttc

SEQ ID NO: 4715154 - DNA, 14 bp, Homo sapiens
tgatttcacagtgt

SEQ ID NO: 4715155 - DNA, 20 bp, Homo sapiens
tgatttcagcacctacagtg

SEQ ID NO: 4715156 - DNA, 19 bp, Homo sapiens
tgatttcgatgtacagtct

SEQ ID NO: 4715157 - DNA, 17 bp, Homo sapiens
tgatttctgccttcctt

SEQ ID NO: 4715158 - DNA, 12 bp, Homo sapiens
tgatttggaaaa

SEQ ID NO: 4715159 - DNA, 12 bp, Homo sapiens
tgattttgacac

SEQ ID NO: 4715160 - DNA, 13 bp, Homo sapiens
tgattttgcaaat

SEQ ID NO: 4715161 - DNA, 14 bp, Homo sapiens
tgattttgctgtag

SEQ ID NO: 4715162 - DNA, 16 bp, Homo sapiens
tgattttgtaaagttg

SEQ ID NO: 4715163 - DNA, 14 bp, Homo sapiens
tgattttgtatatg

SEQ ID NO: 4715164 - DNA, 12 bp, Homo sapiens
tgatttttgtgt

SEQ ID NO: 4715165 - DNA, 20 bp, Homo sapiens
tgcaaaatgcgtatttgcat

SEQ ID NO: 4715166 - DNA, 12 bp, Homo sapiens
tgcaaacagtgt

SEQ ID NO: 4715167 - DNA, 14 bp, Homo sapiens
tgcaaagcccagct

SEQ ID NO: 4715168 - DNA, 12 bp, Homo sapiens
tgcaaaggctgg

SEQ ID NO: 4715169 - DNA, 14 bp, Homo sapiens
tgcaaaggctggga

SEQ ID NO: 4715170 - DNA, 15 bp, Homo sapiens
tgcaacaggctgggc

SEQ ID NO: 4715171 - DNA, 19 bp, Homo sapiens
tgcaacaggctgggcttca

SEQ ID NO: 4715172 - DNA, 20 bp, Homo sapiens
tgcaacaggctgggcttcag

SEQ ID NO: 4715173 - DNA, 16 bp, Homo sapiens
tgcaacagtaatcaga

SEQ ID NO: 4715174 - DNA, 22 bp, Homo sapiens
tgcaacatggattccaaagcat

SEQ ID NO: 4715175 - DNA, 20 bp, Homo sapiens
tgcaacctcgctggactctc

SEQ ID NO: 4715176 - DNA, 22 bp, Homo sapiens
tgcaacctgattgtgtctcttg

SEQ ID NO: 4715177 - DNA, 15 bp, Homo sapiens
tgcaactcttgtatt

SEQ ID NO: 4715178 - DNA, 13 bp, Homo sapiens
tgcaacttgtgaa

SEQ ID NO: 4715179 - DNA, 14 bp, Homo sapiens
tgcaagcttattta

SEQ ID NO: 4715180 - DNA, 19 bp, Homo sapiens
tgcaaggaagccacagctg

SEQ ID NO: 4715181 - DNA, 20 bp, Homo sapiens
tgcaagtgggagatgaaaac

SEQ ID NO: 4715182 - DNA, 21 bp, Homo sapiens
tgcaagtgggagatgaaaacc

SEQ ID NO: 4715183 - DNA, 13 bp, Homo sapiens
tgcaatatggatt

SEQ ID NO: 4715184 - DNA, 14 bp, Homo sapiens
tgcaatggcagcct

SEQ ID NO: 4715185 - DNA, 15 bp, Homo sapiens
tgcacaagctccaag

SEQ ID NO: 4715186 - DNA, 16 bp, Homo sapiens
tgcacaagctccaagc

SEQ ID NO: 4715187 - DNA, 20 bp, Homo sapiens
tgcacaagctccaagctccc

SEQ ID NO: 4715188 - DNA, 23 bp, Homo sapiens
tgcacaataaaaccaagcctctg

SEQ ID NO: 4715189 - DNA, 18 bp, Homo sapiens
tgcacacaccagagccca

SEQ ID NO: 4715190 - DNA, 20 bp, Homo sapiens
tgcacactcagttctgctct

SEQ ID NO: 4715191 - DNA, 21 bp, Homo sapiens
tgcacactgtcctattatatt

SEQ ID NO: 4715192 - DNA, 14 bp, Homo sapiens
tgcacactttgcca

SEQ ID NO: 4715193 - DNA, 21 bp, Homo sapiens
tgcacagggtttggcccaagt

SEQ ID NO: 4715194 - DNA, 18 bp, Homo sapiens
tgcacatctgtgtcttgt

SEQ ID NO: 4715195 - DNA, 15 bp, Homo sapiens
tgcaccaacccagcc

SEQ ID NO: 4715196 - DNA, 20 bp, Homo sapiens
tgcaccaacccagccgctgc

SEQ ID NO: 4715197 - DNA, 14 bp, Homo sapiens
tgcaccaagcagga

SEQ ID NO: 4715198 - DNA, 22 bp, Homo sapiens
tgcaccaagcaggaaatgaaaa

SEQ ID NO: 4715199 - DNA, 23 bp, Homo sapiens
tgcaccattctttcttggtgcat

SEQ ID NO: 4715200 - DNA, 21 bp, Homo sapiens
tgcaccggctggcctggcccc

SEQ ID NO: 4715201 - DNA, 23 bp, Homo sapiens
tgcaccggctggcctggcccctc

SEQ ID NO: 4715202 - DNA, 14 bp, Homo sapiens
tgcaccgggccaca

SEQ ID NO: 4715203 - DNA, 22 bp, Homo sapiens
tgcaccgggccacagagaaagt

SEQ ID NO: 4715204 - DNA, 15 bp, Homo sapiens
tgcacgaccttggga

SEQ ID NO: 4715205 - DNA, 13 bp, Homo sapiens
tgcacggctgctg

SEQ ID NO: 4715206 - DNA, 14 bp, Homo sapiens
tgcacggctgctga

SEQ ID NO: 4715207 - DNA, 17 bp, Homo sapiens
tgcacgtattttaatag

SEQ ID NO: 4715208 - DNA, 11 bp, Homo sapiens
tgcacgtgtgt

SEQ ID NO: 4715209 - DNA, 14 bp, Homo sapiens
tgcacgtgtgtgca

SEQ ID NO: 4715210 - DNA, 15 bp, Homo sapiens
tgcacgtgtgtgcac

SEQ ID NO: 4715211 - DNA, 13 bp, Homo sapiens
tgcacgtgtgttt

SEQ ID NO: 4715212 - DNA, 15 bp, Homo sapiens
tgcacgtgtgttttt

SEQ ID NO: 4715213 - DNA, 21 bp, Homo sapiens
tgcacgttaacagcgtgtcaa

SEQ ID NO: 4715214 - DNA, 17 bp, Homo sapiens
tgcactaacagagtggc

SEQ ID NO: 4715215 - DNA, 22 bp, Homo sapiens
tgcactatagcctaggtgacag

SEQ ID NO: 4715216 - DNA, 15 bp, Homo sapiens
tgcactccagcctgg

SEQ ID NO: 4715217 - DNA, 12 bp, Homo sapiens
tgcactcccctg

SEQ ID NO: 4715218 - DNA, 13 bp, Homo sapiens
tgcactcccctgc

SEQ ID NO: 4715219 - DNA, 16 bp, Homo sapiens
tgcactcccctgctgg

SEQ ID NO: 4715220 - DNA, 13 bp, Homo sapiens
tgcactctgtgcc

SEQ ID NO: 4715221 - DNA, 15 bp, Homo sapiens
tgcactctgtgccca

SEQ ID NO: 4715222 - DNA, 16 bp, Homo sapiens
tgcactctgtgcccat

SEQ ID NO: 4715223 - DNA, 21 bp, Homo sapiens
tgcactgacattgttggccaa

SEQ ID NO: 4715224 - DNA, 13 bp, Homo sapiens
tgcactgtcctgc

SEQ ID NO: 4715225 - DNA, 20 bp, Homo sapiens
tgcactgtcctgctccacag

SEQ ID NO: 4715226 - DNA, 20 bp, Homo sapiens
tgcactttgttctggctctt

SEQ ID NO: 4715227 - DNA, 13 bp, Homo sapiens
tgcagacaggcaa

SEQ ID NO: 4715228 - DNA, 21 bp, Homo sapiens
tgcagacaggcaagcacctcc

SEQ ID NO: 4715229 - DNA, 17 bp, Homo sapiens
tgcagactctacagagg

SEQ ID NO: 4715230 - DNA, 22 bp, Homo sapiens
tgcagactctacagaggccatg

SEQ ID NO: 4715231 - DNA, 16 bp, Homo sapiens
tgcagagagccatttt

SEQ ID NO: 4715232 - DNA, 12 bp, Homo sapiens
tgcagagatcct

SEQ ID NO: 4715233 - DNA, 16 bp, Homo sapiens
tgcagaggaggagaaa

SEQ ID NO: 4715234 - DNA, 17 bp, Homo sapiens
tgcagaggggcaggccc

SEQ ID NO: 4715235 - DNA, 22 bp, Homo sapiens
tgcagataaacagaaatgctct

SEQ ID NO: 4715236 - DNA, 16 bp, Homo sapiens
tgcagatttgatattt

SEQ ID NO: 4715237 - DNA, 20 bp, Homo sapiens
tgcagatttgatatttgcat

SEQ ID NO: 4715238 - DNA, 17 bp, Homo sapiens
tgcagatttgggctgga

SEQ ID NO: 4715239 - DNA, 22 bp, Homo sapiens
tgcagccctgctgctgcctgcc

SEQ ID NO: 4715240 - DNA, 19 bp, Homo sapiens
tgcagcctcaacctcctgg

SEQ ID NO: 4715241 - DNA, 21 bp, Homo sapiens
tgcagcctcaacctcctgggc

SEQ ID NO: 4715242 - DNA, 21 bp, Homo sapiens
tgcagcctcacagtccttacc

SEQ ID NO: 4715243 - DNA, 14 bp, Homo sapiens
tgcagcctcagaga

SEQ ID NO: 4715244 - DNA, 14 bp, Homo sapiens
tgcagcttgagttt

SEQ ID NO: 4715245 - DNA, 12 bp, Homo sapiens
tgcaggaaggag

SEQ ID NO: 4715246 - DNA, 15 bp, Homo sapiens
tgcaggaaggagctg

SEQ ID NO: 4715247 - DNA, 14 bp, Homo sapiens
tgcaggcagcaaaa

SEQ ID NO: 4715248 - DNA, 16 bp, Homo sapiens
tgcaggcagccaggcc

SEQ ID NO: 4715249 - DNA, 16 bp, Homo sapiens
tgcaggcctgctcagg

SEQ ID NO: 4715250 - DNA, 21 bp, Homo sapiens
tgcaggcctgctcagggactg

SEQ ID NO: 4715251 - DNA, 22 bp, Homo sapiens
tgcagggaaaattatttgcata

SEQ ID NO: 4715252 - DNA, 13 bp, Homo sapiens
tgcaggtggggag

SEQ ID NO: 4715253 - DNA, 16 bp, Homo sapiens
tgcagtacagtcttat

SEQ ID NO: 4715254 - DNA, 13 bp, Homo sapiens
tgcagtacatcaa

SEQ ID NO: 4715255 - DNA, 19 bp, Homo sapiens
tgcagtcacgtggaggagc

SEQ ID NO: 4715256 - DNA, 18 bp, Homo sapiens
tgcataaacaatccaaat

SEQ ID NO: 4715257 - DNA, 23 bp, Homo sapiens
tgcataaacaatccaaatgcatt

SEQ ID NO: 4715258 - DNA, 15 bp, Homo sapiens
tgcataaatatgcag

SEQ ID NO: 4715259 - DNA, 19 bp, Homo sapiens
tgcataaatatgcagtgat

SEQ ID NO: 4715260 - DNA, 18 bp, Homo sapiens
tgcataatgtttctggat

SEQ ID NO: 4715261 - DNA, 16 bp, Homo sapiens
tgcatataatgaataa

SEQ ID NO: 4715262 - DNA, 20 bp, Homo sapiens
tgcatataatgaataaatca

SEQ ID NO: 4715263 - DNA, 16 bp, Homo sapiens
tgcatatatgttcttc

SEQ ID NO: 4715264 - DNA, 20 bp, Homo sapiens
tgcatatatgttcttcataa

SEQ ID NO: 4715265 - DNA, 18 bp, Homo sapiens
tgcatatctctagtccct

SEQ ID NO: 4715266 - DNA, 22 bp, Homo sapiens
tgcatatctctagtccctgtgt

SEQ ID NO: 4715267 - DNA, 16 bp, Homo sapiens
tgcatattataaagga

SEQ ID NO: 4715268 - DNA, 18 bp, Homo sapiens
tgcatctcccagataatg

SEQ ID NO: 4715269 - DNA, 20 bp, Homo sapiens
tgcatctggtgtaggaagtt

SEQ ID NO: 4715270 - DNA, 18 bp, Homo sapiens
tgcatgaaggtttctgaa

SEQ ID NO: 4715271 - DNA, 21 bp, Homo sapiens
tgcatgaaggtttctgaaaat

SEQ ID NO: 4715272 - DNA, 24 bp, Homo sapiens
tgcatgaccacatagaacatgtgt

SEQ ID NO: 4715273 - DNA, 19 bp, Homo sapiens
tgcatgcactgttccccct

SEQ ID NO: 4715274 - DNA, 17 bp, Homo sapiens
tgcatggagtgtttgac

SEQ ID NO: 4715275 - DNA, 17 bp, Homo sapiens
tgcatgtaaaatcttca

SEQ ID NO: 4715276 - DNA, 18 bp, Homo sapiens
tgcatgtaaaatcttcag

SEQ ID NO: 4715277 - DNA, 22 bp, Homo sapiens
tgcatgtaaaatcttcagctgg

SEQ ID NO: 4715278 - DNA, 21 bp, Homo sapiens
tgcatgttttccagctcctca

SEQ ID NO: 4715279 - DNA, 22 bp, Homo sapiens
tgcattcatgttttaaaagttt

SEQ ID NO: 4715280 - DNA, 17 bp, Homo sapiens
tgcattcttattcatca

SEQ ID NO: 4715281 - DNA, 17 bp, Homo sapiens
tgcatttaaagtattct

SEQ ID NO: 4715282 - DNA, 22 bp, Homo sapiens
tgcatttaaatacagtcttcca

SEQ ID NO: 4715283 - DNA, 21 bp, Homo sapiens
tgcatttggcaggaagatgta

SEQ ID NO: 4715284 - DNA, 22 bp, Homo sapiens
tgcatttttaaaggacaaacag

SEQ ID NO: 4715285 - DNA, 18 bp, Homo sapiens
tgccaaatataaataaaa

SEQ ID NO: 4715286 - DNA, 21 bp, Homo sapiens
tgccaacagtgttaggcctgg

SEQ ID NO: 4715287 - DNA, 21 bp, Homo sapiens
tgccaacttcttcagagctga

SEQ ID NO: 4715288 - DNA, 14 bp, Homo sapiens
tgccaagcagcaga

SEQ ID NO: 4715289 - DNA, 14 bp, Homo sapiens
tgccaagcaggcct

SEQ ID NO: 4715290 - DNA, 14 bp, Homo sapiens
tgccaagctcagga

SEQ ID NO: 4715291 - DNA, 15 bp, Homo sapiens
tgccaagctcaggac

SEQ ID NO: 4715292 - DNA, 21 bp, Homo sapiens
tgccaataataatacctccct

SEQ ID NO: 4715293 - DNA, 14 bp, Homo sapiens
tgccacagagcggg

SEQ ID NO: 4715294 - DNA, 16 bp, Homo sapiens
tgccacagagcgggga

SEQ ID NO: 4715295 - DNA, 23 bp, Homo sapiens
tgccaccacagcttatggcatct

SEQ ID NO: 4715296 - DNA, 15 bp, Homo sapiens
tgccaccacgcccgg

SEQ ID NO: 4715297 - DNA, 17 bp, Homo sapiens
tgccaccctcatgctgt

SEQ ID NO: 4715298 - DNA, 13 bp, Homo sapiens
tgccaccctgggc

SEQ ID NO: 4715299 - DNA, 14 bp, Homo sapiens
tgccaccctgggct

SEQ ID NO: 4715300 - DNA, 18 bp, Homo sapiens
tgccaccctgggctctgt

SEQ ID NO: 4715301 - DNA, 22 bp, Homo sapiens
tgccaccctgggctctgtgggc

SEQ ID NO: 4715302 - DNA, 18 bp, Homo sapiens
tgccacctggacccctgc

SEQ ID NO: 4715303 - DNA, 20 bp, Homo sapiens
tgccactcccctaaactcca

SEQ ID NO: 4715304 - DNA, 20 bp, Homo sapiens
tgccagccccgccacgcttg

SEQ ID NO: 4715305 - DNA, 20 bp, Homo sapiens
tgccaggaccagtcaacctg

SEQ ID NO: 4715306 - DNA, 17 bp, Homo sapiens
tgccagggaaaaagacc

SEQ ID NO: 4715307 - DNA, 16 bp, Homo sapiens
tgccagggcagggccc

SEQ ID NO: 4715308 - DNA, 16 bp, Homo sapiens
tgccagtcaccccggc

SEQ ID NO: 4715309 - DNA, 18 bp, Homo sapiens
tgccagtcaccccggcca

SEQ ID NO: 4715310 - DNA, 22 bp, Homo sapiens
tgccagtcaccccggccacctg

SEQ ID NO: 4715311 - DNA, 16 bp, Homo sapiens
tgccagtcgcgctgcc

SEQ ID NO: 4715312 - DNA, 18 bp, Homo sapiens
tgccagtcgcgctgcctg

SEQ ID NO: 4715313 - DNA, 19 bp, Homo sapiens
tgccagtcgcgctgcctgt

SEQ ID NO: 4715314 - DNA, 20 bp, Homo sapiens
tgccagtcgcgctgcctgtg

SEQ ID NO: 4715315 - DNA, 17 bp, Homo sapiens
tgccatacttgttctgt

SEQ ID NO: 4715316 - DNA, 15 bp, Homo sapiens
tgccatattctgttg

SEQ ID NO: 4715317 - DNA, 17 bp, Homo sapiens
tgccatattttcaccat

SEQ ID NO: 4715318 - DNA, 15 bp, Homo sapiens
tgccatcatctcctg

SEQ ID NO: 4715319 - DNA, 23 bp, Homo sapiens
tgccatcatctcctgccttcctc

SEQ ID NO: 4715320 - DNA, 15 bp, Homo sapiens
tgccatccaggttca

SEQ ID NO: 4715321 - DNA, 18 bp, Homo sapiens
tgccatggacagaagaag

SEQ ID NO: 4715322 - DNA, 20 bp, Homo sapiens
tgccatggacagaagaaggc

SEQ ID NO: 4715323 - DNA, 23 bp, Homo sapiens
tgccatggacagaagaaggcagc

SEQ ID NO: 4715324 - DNA, 15 bp, Homo sapiens
tgccatgtccatagc

SEQ ID NO: 4715325 - DNA, 16 bp, Homo sapiens
tgccatgttggccagg

SEQ ID NO: 4715326 - DNA, 21 bp, Homo sapiens
tgccatgttggccaggctggt

SEQ ID NO: 4715327 - DNA, 16 bp, Homo sapiens
tgcccacaggatcagt

SEQ ID NO: 4715328 - DNA, 13 bp, Homo sapiens
tgcccacctggcc

SEQ ID NO: 4715329 - DNA, 17 bp, Homo sapiens
tgcccacctggcctctg

SEQ ID NO: 4715330 - DNA, 20 bp, Homo sapiens
tgcccacctggcctctgcac

SEQ ID NO: 4715331 - DNA, 13 bp, Homo sapiens
tgcccagcccctt

SEQ ID NO: 4715332 - DNA, 22 bp, Homo sapiens
tgcccaggacggggccggccag

SEQ ID NO: 4715333 - DNA, 13 bp, Homo sapiens
tgcccaggcaggt

SEQ ID NO: 4715334 - DNA, 16 bp, Homo sapiens
tgcccaggcaggtctt

SEQ ID NO: 4715335 - DNA, 11 bp, Homo sapiens
tgcccaggccc

SEQ ID NO: 4715336 - DNA, 14 bp, Homo sapiens
tgcccaggcccaga

SEQ ID NO: 4715337 - DNA, 15 bp, Homo sapiens
tgcccaggcccagac

SEQ ID NO: 4715338 - DNA, 12 bp, Homo sapiens
tgcccaggcccc

SEQ ID NO: 4715339 - DNA, 20 bp, Homo sapiens
tgcccaggctggcgtgcagt

SEQ ID NO: 4715340 - DNA, 20 bp, Homo sapiens
tgcccaggtttctggtctct

SEQ ID NO: 4715341 - DNA, 15 bp, Homo sapiens
tgcccatgggcactg

SEQ ID NO: 4715342 - DNA, 18 bp, Homo sapiens
tgcccatgggcactgctg

SEQ ID NO: 4715343 - DNA, 20 bp, Homo sapiens
tgcccatgggcactgctggg

SEQ ID NO: 4715344 - DNA, 23 bp, Homo sapiens
tgcccatgggcactgctgggtgg

SEQ ID NO: 4715345 - DNA, 13 bp, Homo sapiens
tgccccatgagac

SEQ ID NO: 4715346 - DNA, 11 bp, Homo sapiens
tgcccccagga

SEQ ID NO: 4715347 - DNA, 13 bp, Homo sapiens
tgcccccaggact

SEQ ID NO: 4715348 - DNA, 15 bp, Homo sapiens
tgcccccaggactgg

SEQ ID NO: 4715349 - DNA, 16 bp, Homo sapiens
tgcccccaggactggg

SEQ ID NO: 4715350 - DNA, 17 bp, Homo sapiens
tgccccccatcctggcc

SEQ ID NO: 4715351 - DNA, 20 bp, Homo sapiens
tgccccccatcctggcccat

SEQ ID NO: 4715352 - DNA, 17 bp, Homo sapiens
tgccccctcgtgccagt

SEQ ID NO: 4715353 - DNA, 16 bp, Homo sapiens
tgccccctctgccctg

SEQ ID NO: 4715354 - DNA, 17 bp, Homo sapiens
tgccccctctgccctgc

SEQ ID NO: 4715355 - DNA, 18 bp, Homo sapiens
tgccccctctgccctgcg

SEQ ID NO: 4715356 - DNA, 14 bp, Homo sapiens
tgccccctgcagga

SEQ ID NO: 4715357 - DNA, 16 bp, Homo sapiens
tgccccctgcaggaag

SEQ ID NO: 4715358 - DNA, 17 bp, Homo sapiens
tgccccctgcaggaagg

SEQ ID NO: 4715359 - DNA, 22 bp, Homo sapiens
tgccccctgcaggaaggagctg

SEQ ID NO: 4715360 - DNA, 22 bp, Homo sapiens
tgccccgcaggcctgccttctc

SEQ ID NO: 4715361 - DNA, 16 bp, Homo sapiens
tgccccgtccccctct

SEQ ID NO: 4715362 - DNA, 17 bp, Homo sapiens
tgcccctcctctctgcc

SEQ ID NO: 4715363 - DNA, 18 bp, Homo sapiens
tgcccctcctctctgccc

SEQ ID NO: 4715364 - DNA, 16 bp, Homo sapiens
tgcccggcgccctctg

SEQ ID NO: 4715365 - DNA, 21 bp, Homo sapiens
tgcccggcgccctctgtcctg

SEQ ID NO: 4715366 - DNA, 22 bp, Homo sapiens
tgccctaacctctgagtcacca

SEQ ID NO: 4715367 - DNA, 20 bp, Homo sapiens
tgccctccaagaccttctcc

SEQ ID NO: 4715368 - DNA, 12 bp, Homo sapiens
tgccctcccatc

SEQ ID NO: 4715369 - DNA, 16 bp, Homo sapiens
tgccctgcccacctgg

SEQ ID NO: 4715370 - DNA, 20 bp, Homo sapiens
tgccctgcccacctggcctc

SEQ ID NO: 4715371 - DNA, 23 bp, Homo sapiens
tgaaatgcttatgcttgtgtata

SEQ ID NO: 4715372 - DNA, 17 bp, Homo sapiens
tgaaattattttctcca

SEQ ID NO: 4715373 - DNA, 13 bp, Homo sapiens
tgaacacatggca

SEQ ID NO: 4715374 - DNA, 18 bp, Homo sapiens
tgaacattgcaatagaaa

SEQ ID NO: 4715375 - DNA, 11 bp, Homo sapiens
tgaacatttta

SEQ ID NO: 4715376 - DNA, 19 bp, Homo sapiens
tgaacattttaatgggttt

SEQ ID NO: 4715377 - DNA, 22 bp, Homo sapiens
tgaaccacatcttgctctgctg

SEQ ID NO: 4715378 - DNA, 21 bp, Homo sapiens
tgaaccacctttgtctctgca

SEQ ID NO: 4715379 - DNA, 18 bp, Homo sapiens
tgaaccttgctatcaaga

SEQ ID NO: 4715380 - DNA, 20 bp, Homo sapiens
tgaactaccttggttccccc

SEQ ID NO: 4715381 - DNA, 17 bp, Homo sapiens
tgaactcctggcctcaa

SEQ ID NO: 4715382 - DNA, 19 bp, Homo sapiens
tgaactgggtacttgtgga

SEQ ID NO: 4715383 - DNA, 22 bp, Homo sapiens
tgaacttcctgcaggtaaacag

SEQ ID NO: 4715384 - DNA, 18 bp, Homo sapiens
tgaagaaccgcattttga

SEQ ID NO: 4715385 - DNA, 21 bp, Homo sapiens
tgaagaatctgtttcccagca

SEQ ID NO: 4715386 - DNA, 14 bp, Homo sapiens
tgaagaatgtctgt

SEQ ID NO: 4715387 - DNA, 19 bp, Homo sapiens
tgaagacagaggcagagat

SEQ ID NO: 4715388 - DNA, 12 bp, Homo sapiens
tgaagacataaa

SEQ ID NO: 4715389 - DNA, 21 bp, Homo sapiens
tgaagaccccagatgtgaggg

SEQ ID NO: 4715390 - DNA, 19 bp, Homo sapiens
tgaagactcattcttctgt

SEQ ID NO: 4715391 - DNA, 16 bp, Homo sapiens
tgaagagactctgttt

SEQ ID NO: 4715392 - DNA, 11 bp, Homo sapiens
tgaagatattt

SEQ ID NO: 4715393 - DNA, 16 bp, Homo sapiens
tgaagattctttccca

SEQ ID NO: 4715394 - DNA, 16 bp, Homo sapiens
tgaagccttctgacct

SEQ ID NO: 4715395 - DNA, 19 bp, Homo sapiens
tgaagccttctgacctggg

SEQ ID NO: 4715396 - DNA, 20 bp, Homo sapiens
tgaaggacattgcggacagc

SEQ ID NO: 4715397 - DNA, 23 bp, Homo sapiens
tgaaggactgtgacaggcagcag

SEQ ID NO: 4715398 - DNA, 20 bp, Homo sapiens
tgaaggctcgagcatgcctg

SEQ ID NO: 4715399 - DNA, 19 bp, Homo sapiens
tgaaggtagaatgttttca

SEQ ID NO: 4715400 - DNA, 13 bp, Homo sapiens
tgaaggtttctga

SEQ ID NO: 4715401 - DNA, 16 bp, Homo sapiens
tgaaggtttctgaaaa

SEQ ID NO: 4715402 - DNA, 15 bp, Homo sapiens
tgaagtaagcaaaga

SEQ ID NO: 4715403 - DNA, 13 bp, Homo sapiens
tgaagtcacacag

SEQ ID NO: 4715404 - DNA, 17 bp, Homo sapiens
tgaagtcgttgtgaggg

SEQ ID NO: 4715405 - DNA, 16 bp, Homo sapiens
tgaagtgactgttgta

SEQ ID NO: 4715406 - DNA, 20 bp, Homo sapiens
tgaagtgactgttgtaccat

SEQ ID NO: 4715407 - DNA, 18 bp, Homo sapiens
tgaagttgattcatattg

SEQ ID NO: 4715408 - DNA, 19 bp, Homo sapiens
tgaagtttccttggctggt

SEQ ID NO: 4715409 - DNA, 22 bp, Homo sapiens
tgaataaagggaacatgcagct

SEQ ID NO: 4715410 - DNA, 14 bp, Homo sapiens
tgaatacctgctca

SEQ ID NO: 4715411 - DNA, 18 bp, Homo sapiens
tgaatagatatgaaagct

SEQ ID NO: 4715412 - DNA, 12 bp, Homo sapiens
tgaatatatgat

SEQ ID NO: 4715413 - DNA, 19 bp, Homo sapiens
tgaatattggtaattaaaa

SEQ ID NO: 4715414 - DNA, 21 bp, Homo sapiens
tgaatattggtaattaaaaga

SEQ ID NO: 4715415 - DNA, 22 bp, Homo sapiens
tgaatattggtaattaaaagac

SEQ ID NO: 4715416 - DNA, 17 bp, Homo sapiens
tgaatatttacgttttt

SEQ ID NO: 4715417 - DNA, 17 bp, Homo sapiens
tgaatcacgtaaagcta

SEQ ID NO: 4715418 - DNA, 19 bp, Homo sapiens
tgaatgactccactgtttt

SEQ ID NO: 4715419 - DNA, 16 bp, Homo sapiens
tgaatgcttctgattt

SEQ ID NO: 4715420 - DNA, 19 bp, Homo sapiens
tgaatgtattttggttgct

SEQ ID NO: 4715421 - DNA, 22 bp, Homo sapiens
tgaatgtattttggttgctgat

SEQ ID NO: 4715422 - DNA, 23 bp, Homo sapiens
tgaatgtgatcatctttgctgaa

SEQ ID NO: 4715423 - DNA, 17 bp, Homo sapiens
tgaattagattatttct

SEQ ID NO: 4715424 - DNA, 20 bp, Homo sapiens
tgaattcttggttgaggaaa

SEQ ID NO: 4715425 - DNA, 18 bp, Homo sapiens
tgaattgtaactgttctt

SEQ ID NO: 4715426 - DNA, 13 bp, Homo sapiens
tgaatttaagcat

SEQ ID NO: 4715427 - DNA, 14 bp, Homo sapiens
tgaatttaagcatg

SEQ ID NO: 4715428 - DNA, 19 bp, Homo sapiens
tgaatttaagcatgagtgg

SEQ ID NO: 4715429 - DNA, 19 bp, Homo sapiens
tgaatttaataatctgtag

SEQ ID NO: 4715430 - DNA, 16 bp, Homo sapiens
tgaatttgcaacagta

SEQ ID NO: 4715431 - DNA, 20 bp, Homo sapiens
tgaatttgggatactaaagt

SEQ ID NO: 4715432 - DNA, 15 bp, Homo sapiens
tgaattttcccactg

SEQ ID NO: 4715433 - DNA, 17 bp, Homo sapiens
tgacaaacctctaaccc

SEQ ID NO: 4715434 - DNA, 22 bp, Homo sapiens
tgacaaacttctttcactcaca

SEQ ID NO: 4715435 - DNA, 16 bp, Homo sapiens
tgacaacagcctgaga

SEQ ID NO: 4715436 - DNA, 23 bp, Homo sapiens
tgacaaggattgctactgtccta

SEQ ID NO: 4715437 - DNA, 12 bp, Homo sapiens
tgacaataaaac

SEQ ID NO: 4715438 - DNA, 17 bp, Homo sapiens
tgacaataaaacattaa

SEQ ID NO: 4715439 - DNA, 13 bp, Homo sapiens
tgacaattgtcac

SEQ ID NO: 4715440 - DNA, 18 bp, Homo sapiens
tgacacaaacctgcctgg

SEQ ID NO: 4715441 - DNA, 13 bp, Homo sapiens
tgacacacagaaa

SEQ ID NO: 4715442 - DNA, 17 bp, Homo sapiens
tgacaccaataaatgtt

SEQ ID NO: 4715443 - DNA, 19 bp, Homo sapiens
tgacaccaataaatgtttg

SEQ ID NO: 4715444 - DNA, 20 bp, Homo sapiens
tgacactgcggggcttggct

SEQ ID NO: 4715445 - DNA, 23 bp, Homo sapiens
tgacactgcggggcttggctgag

SEQ ID NO: 4715446 - DNA, 19 bp, Homo sapiens
tgacactggtattcctgcc

SEQ ID NO: 4715447 - DNA, 13 bp, Homo sapiens
tgacagaacactg

SEQ ID NO: 4715448 - DNA, 17 bp, Homo sapiens
tgacagaacactgtctt

SEQ ID NO: 4715449 - DNA, 13 bp, Homo sapiens
tgacagacacagg

SEQ ID NO: 4715450 - DNA, 20 bp, Homo sapiens
tgacagacacaggcccggct

SEQ ID NO: 4715451 - DNA, 15 bp, Homo sapiens
tgacagaggcagccc

SEQ ID NO: 4715452 - DNA, 17 bp, Homo sapiens
tgacagagtgagactct

SEQ ID NO: 4715453 - DNA, 19 bp, Homo sapiens
tgacagagtgagactctgt

SEQ ID NO: 4715454 - DNA, 20 bp, Homo sapiens
tgacagatatatttaagcct

SEQ ID NO: 4715455 - DNA, 19 bp, Homo sapiens
tgacaggcaatgctggctg

SEQ ID NO: 4715456 - DNA, 13 bp, Homo sapiens
tgacaggcagcag

SEQ ID NO: 4715457 - DNA, 19 bp, Homo sapiens
tgacaggcagcagagactt

SEQ ID NO: 4715458 - DNA, 16 bp, Homo sapiens
tgacagtcctctccac

SEQ ID NO: 4715459 - DNA, 17 bp, Homo sapiens
tgacagtcctctccacc

SEQ ID NO: 4715460 - DNA, 14 bp, Homo sapiens
tgacagtgttttta

SEQ ID NO: 4715461 - DNA, 12 bp, Homo sapiens
tgacagtttaac

SEQ ID NO: 4715462 - DNA, 12 bp, Homo sapiens
tgacatattatg

SEQ ID NO: 4715463 - DNA, 15 bp, Homo sapiens
tgacatgtcttttct

SEQ ID NO: 4715464 - DNA, 16 bp, Homo sapiens
tgacatgtgaaacctt

SEQ ID NO: 4715465 - DNA, 19 bp, Homo sapiens
tgacatgtgaaaccttttt

SEQ ID NO: 4715466 - DNA, 21 bp, Homo sapiens
tgacatttatttttcatttag

SEQ ID NO: 4715467 - DNA, 21 bp, Homo sapiens
tgacatttatttttctcatga

SEQ ID NO: 4715468 - DNA, 18 bp, Homo sapiens
tgaccaaaatccccttct

SEQ ID NO: 4715469 - DNA, 13 bp, Homo sapiens
tgaccaatgtctt

SEQ ID NO: 4715470 - DNA, 15 bp, Homo sapiens
tgaccaggcctgggc

SEQ ID NO: 4715471 - DNA, 17 bp, Homo sapiens
tgaccatgtgattatgg

SEQ ID NO: 4715472 - DNA, 14 bp, Homo sapiens
tgaccattctccac

SEQ ID NO: 4715473 - DNA, 18 bp, Homo sapiens
tgaccattctccacctgc

SEQ ID NO: 4715474 - DNA, 19 bp, Homo sapiens
tgaccattctccacctgcc

SEQ ID NO: 4715475 - DNA, 19 bp, Homo sapiens
tgacccacagcctccaagt

SEQ ID NO: 4715476 - DNA, 12 bp, Homo sapiens
tgacccactgct

SEQ ID NO: 4715477 - DNA, 12 bp, Homo sapiens
tgacccatgctg

SEQ ID NO: 4715478 - DNA, 15 bp, Homo sapiens
tgacccatgctgccc

SEQ ID NO: 4715479 - DNA, 16 bp, Homo sapiens
tgacccatgctgccct

SEQ ID NO: 4715480 - DNA, 19 bp, Homo sapiens
tgacccatgctgccctgtg

SEQ ID NO: 4715481 - DNA, 13 bp, Homo sapiens
tgaccccagagga

SEQ ID NO: 4715482 - DNA, 17 bp, Homo sapiens
tgacccctcatagccct

SEQ ID NO: 4715483 - DNA, 20 bp, Homo sapiens
tgacccctcatagccctcac

SEQ ID NO: 4715484 - DNA, 21 bp, Homo sapiens
tgaccccttttcagcttctgc

SEQ ID NO: 4715485 - DNA, 16 bp, Homo sapiens
tgacctacaaatcaat

SEQ ID NO: 4715486 - DNA, 19 bp, Homo sapiens
tgacctacagtgctgtgta

SEQ ID NO: 4715487 - DNA, 13 bp, Homo sapiens
tgacctctgcctg

SEQ ID NO: 4715488 - DNA, 14 bp, Homo sapiens
tgacctctgcctga

SEQ ID NO: 4715489 - DNA, 16 bp, Homo sapiens
tgacctgaactctgca

SEQ ID NO: 4715490 - DNA, 12 bp, Homo sapiens
tgacctgaggcc

SEQ ID NO: 4715491 - DNA, 18 bp, Homo sapiens
tgacctgaggcccttctc

SEQ ID NO: 4715492 - DNA, 23 bp, Homo sapiens
tgacctgcctcccttcatgcatg

SEQ ID NO: 4715493 - DNA, 14 bp, Homo sapiens
tgacgccatcccag

SEQ ID NO: 4715494 - DNA, 17 bp, Homo sapiens
tgacgccatcccagccc

SEQ ID NO: 4715495 - DNA, 19 bp, Homo sapiens
tgacgccatcccagcccca

SEQ ID NO: 4715496 - DNA, 20 bp, Homo sapiens
tgacgccatcccagccccaa

SEQ ID NO: 4715497 - DNA, 13 bp, Homo sapiens
tgacgtaagctct

SEQ ID NO: 4715498 - DNA, 22 bp, Homo sapiens
tgactaaaaatacttaaatttg

SEQ ID NO: 4715499 - DNA, 20 bp, Homo sapiens
tgactatgcgtggctggaac

SEQ ID NO: 4715500 - DNA, 22 bp, Homo sapiens
tgactattacagttgcattttt

SEQ ID NO: 4715501 - DNA, 14 bp, Homo sapiens
tgactcaaagtctg

SEQ ID NO: 4715502 - DNA, 19 bp, Homo sapiens
tgactcccctttctcttct

SEQ ID NO: 4715503 - DNA, 16 bp, Homo sapiens
tgactcgggctcctgt

SEQ ID NO: 4715504 - DNA, 14 bp, Homo sapiens
tgactcttggcaca

SEQ ID NO: 4715505 - DNA, 15 bp, Homo sapiens
tgactgagcttccct

SEQ ID NO: 4715506 - DNA, 20 bp, Homo sapiens
tgactgagtctggcaaacat

SEQ ID NO: 4715507 - DNA, 21 bp, Homo sapiens
tgactgagtctggcaaacatg

SEQ ID NO: 4715508 - DNA, 18 bp, Homo sapiens
tgactgttcaagagcaca

SEQ ID NO: 4715509 - DNA, 17 bp, Homo sapiens
tgacttatttatataaa

SEQ ID NO: 4715510 - DNA, 13 bp, Homo sapiens
tgacttcaggggc

SEQ ID NO: 4715511 - DNA, 17 bp, Homo sapiens
tgacttcaggggctgcc

SEQ ID NO: 4715512 - DNA, 20 bp, Homo sapiens
tgacttctatcctgttaaca

SEQ ID NO: 4715513 - DNA, 17 bp, Homo sapiens
tgacttgacagaacact

SEQ ID NO: 4715514 - DNA, 16 bp, Homo sapiens
tgactttggctgcatg

SEQ ID NO: 4715515 - DNA, 13 bp, Homo sapiens
tgacttttgaaga

SEQ ID NO: 4715516 - DNA, 17 bp, Homo sapiens
tgacttttgaagaacaa

SEQ ID NO: 4715517 - DNA, 14 bp, Homo sapiens
tgagaacactgtga

SEQ ID NO: 4715518 - DNA, 16 bp, Homo sapiens
tgagaacactgtgaaa

SEQ ID NO: 4715519 - DNA, 21 bp, Homo sapiens
tgagacagagttttcactctt

SEQ ID NO: 4715520 - DNA, 17 bp, Homo sapiens
tgagacagcccgggctc

SEQ ID NO: 4715521 - DNA, 18 bp, Homo sapiens
tgagacagtccagcctgg

SEQ ID NO: 4715522 - DNA, 15 bp, Homo sapiens
tgagacagtttctta

SEQ ID NO: 4715523 - DNA, 18 bp, Homo sapiens
tgagacagtttcttagct

SEQ ID NO: 4715524 - DNA, 14 bp, Homo sapiens
tgagaccagcctgg

SEQ ID NO: 4715525 - DNA, 12 bp, Homo sapiens
tgagacctgccc

SEQ ID NO: 4715526 - DNA, 13 bp, Homo sapiens
tgagacctgcccc

SEQ ID NO: 4715527 - DNA, 14 bp, Homo sapiens
tgagacctgcccct

SEQ ID NO: 4715528 - DNA, 22 bp, Homo sapiens
tgagacctgcccctcctctctg

SEQ ID NO: 4715529 - DNA, 21 bp, Homo sapiens
tgagactatgcaaaagtacaa

SEQ ID NO: 4715530 - DNA, 17 bp, Homo sapiens
tgagactcgagaacttt

SEQ ID NO: 4715531 - DNA, 19 bp, Homo sapiens
tgagactctcttaggagca

SEQ ID NO: 4715532 - DNA, 12 bp, Homo sapiens
tgagagctgggc

SEQ ID NO: 4715533 - DNA, 18 bp, Homo sapiens
tgagatttcatctgctct

SEQ ID NO: 4715534 - DNA, 21 bp, Homo sapiens
tgagatttcatctgctctcct

SEQ ID NO: 4715535 - DNA, 20 bp, Homo sapiens
tgagcactaaggtgtgctct

SEQ ID NO: 4715536 - DNA, 21 bp, Homo sapiens
tgagcactaaggtgtgctctg

SEQ ID NO: 4715537 - DNA, 18 bp, Homo sapiens
tgagcagaatactggtct

SEQ ID NO: 4715538 - DNA, 17 bp, Homo sapiens
tgagcagggctcagcgg

SEQ ID NO: 4715539 - DNA, 14 bp, Homo sapiens
tgagcatcaggcca

SEQ ID NO: 4715540 - DNA, 18 bp, Homo sapiens
tgagcatcaggccaggcc

SEQ ID NO: 4715541 - DNA, 19 bp, Homo sapiens
tgagcatcaggccaggccc

SEQ ID NO: 4715542 - DNA, 21 bp, Homo sapiens
tgagcatcaggccaggccctc

SEQ ID NO: 4715543 - DNA, 22 bp, Homo sapiens
tgagcatcaggccaggccctct

SEQ ID NO: 4715544 - DNA, 14 bp, Homo sapiens
tgagcatggagctg

SEQ ID NO: 4715545 - DNA, 16 bp, Homo sapiens
tgagcatggagctggc

SEQ ID NO: 4715546 - DNA, 14 bp, Homo sapiens
tgagccaccgtgcc

SEQ ID NO: 4715547 - DNA, 18 bp, Homo sapiens
tgagccaccgtgcctggc

SEQ ID NO: 4715548 - DNA, 20 bp, Homo sapiens
tgagccaccgtgcctggcca

SEQ ID NO: 4715549 - DNA, 21 bp, Homo sapiens
tgagccaccgtgcctggccac

SEQ ID NO: 4715550 - DNA, 12 bp, Homo sapiens
tgagccactgca

SEQ ID NO: 4715551 - DNA, 13 bp, Homo sapiens
tgagccactgcac

SEQ ID NO: 4715552 - DNA, 14 bp, Homo sapiens
tgagccactgcacc

SEQ ID NO: 4715553 - DNA, 23 bp, Homo sapiens
tgagccactgcaccgggccacag

SEQ ID NO: 4715554 - DNA, 22 bp, Homo sapiens
tgagcccctcagacagccccct

SEQ ID NO: 4715555 - DNA, 19 bp, Homo sapiens
tgagccgagatcacgccac

SEQ ID NO: 4715556 - DNA, 23 bp, Homo sapiens
tgagccgagatcacgccactgca

SEQ ID NO: 4715557 - DNA, 15 bp, Homo sapiens
tgagcctcagcatcc

SEQ ID NO: 4715558 - DNA, 18 bp, Homo sapiens
tgagcctcagcatcctgg

SEQ ID NO: 4715559 - DNA, 22 bp, Homo sapiens
tgagcctcagcatcctggcacc

SEQ ID NO: 4715560 - DNA, 18 bp, Homo sapiens
tgagcgcacgcgcgcaca

SEQ ID NO: 4715561 - DNA, 22 bp, Homo sapiens
tgagcgcacgcgcgcacacaca

SEQ ID NO: 4715562 - DNA, 14 bp, Homo sapiens
tgagcgctcctgcc

SEQ ID NO: 4715563 - DNA, 22 bp, Homo sapiens
tgagcgctcctgccgcagagct

SEQ ID NO: 4715564 - DNA, 13 bp, Homo sapiens
tgagctacaaatg

SEQ ID NO: 4715565 - DNA, 14 bp, Homo sapiens
tgagctacaaatgc

SEQ ID NO: 4715566 - DNA, 19 bp, Homo sapiens
tgagctagaagctggagga

SEQ ID NO: 4715567 - DNA, 12 bp, Homo sapiens
tgagctcagccc

SEQ ID NO: 4715568 - DNA, 20 bp, Homo sapiens
tgagctcagccctggtgggc

SEQ ID NO: 4715569 - DNA, 14 bp, Homo sapiens
tgagctgaggcagc

SEQ ID NO: 4715570 - DNA, 18 bp, Homo sapiens
tgagcttgcttctttctt

SEQ ID NO: 4715571 - DNA, 16 bp, Homo sapiens
tgaggaaatattaatt

SEQ ID NO: 4715572 - DNA, 19 bp, Homo sapiens
tgaggacccgccggatgac

SEQ ID NO: 4715573 - DNA, 11 bp, Homo sapiens
tgaggagaagt

SEQ ID NO: 4715574 - DNA, 16 bp, Homo sapiens
tgaggagtcttgtgtg

SEQ ID NO: 4715575 - DNA, 12 bp, Homo sapiens
tgaggagtggtt

SEQ ID NO: 4715576 - DNA, 22 bp, Homo sapiens
tgaggagtggttgggctgtgcc

SEQ ID NO: 4715577 - DNA, 20 bp, Homo sapiens
tgaggcacctgcatatctct

SEQ ID NO: 4715578 - DNA, 23 bp, Homo sapiens
tgaggcagtgggtcccacttccc

SEQ ID NO: 4715579 - DNA, 22 bp, Homo sapiens
tgaggccctccacacctgcggc

SEQ ID NO: 4715580 - DNA, 23 bp, Homo sapiens
tgaggccctccacacctgcggcc

SEQ ID NO: 4715581 - DNA, 23 bp, Homo sapiens
tgaggcccttctctccagcccct

SEQ ID NO: 4715582 - DNA, 23 bp, Homo sapiens
tgaggctagtgtggtgtttcctg

SEQ ID NO: 4715583 - DNA, 23 bp, Homo sapiens
tgaggcttagctttgctctgcca

SEQ ID NO: 4715584 - DNA, 18 bp, Homo sapiens
tgaggctttcaggtttta

SEQ ID NO: 4715585 - DNA, 14 bp, Homo sapiens
tgagggagcctggc

SEQ ID NO: 4715586 - DNA, 11 bp, Homo sapiens
tgagggcagtc

SEQ ID NO: 4715587 - DNA, 13 bp, Homo sapiens
tgaggggcctctt

SEQ ID NO: 4715588 - DNA, 14 bp, Homo sapiens
tgaggggtccctga

SEQ ID NO: 4715589 - DNA, 22 bp, Homo sapiens
tgagggttcatcatccctccct

SEQ ID NO: 4715590 - DNA, 20 bp, Homo sapiens
tgagggttgggctggtgtca

SEQ ID NO: 4715591 - DNA, 20 bp, Homo sapiens
tgaggtccagccctggctga

SEQ ID NO: 4715592 - DNA, 16 bp, Homo sapiens
tgaggttgctagagaa

SEQ ID NO: 4715593 - DNA, 16 bp, Homo sapiens
tgaaaatcgtgacaac

SEQ ID NO: 4715594 - DNA, 19 bp, Homo sapiens
tgaaaatcgtgacaacact

SEQ ID NO: 4715595 - DNA, 20 bp, Homo sapiens
tgaaaatcttataatttaaa

SEQ ID NO: 4715596 - DNA, 18 bp, Homo sapiens
tgaaaatgcaacaacatg

SEQ ID NO: 4715597 - DNA, 15 bp, Homo sapiens
tgaaaattaacactg

SEQ ID NO: 4715598 - DNA, 16 bp, Homo sapiens
tgaaaattaacactgc

SEQ ID NO: 4715599 - DNA, 18 bp, Homo sapiens
tgaaaattaacactgctt

SEQ ID NO: 4715600 - DNA, 17 bp, Homo sapiens
tgaaacagcctctgcaa

SEQ ID NO: 4715601 - DNA, 16 bp, Homo sapiens
tgaaaccctccaaatc

SEQ ID NO: 4715602 - DNA, 15 bp, Homo sapiens
tgaaaccgtccctga

SEQ ID NO: 4715603 - DNA, 23 bp, Homo sapiens
tgaaaccttttttaagatttttc

SEQ ID NO: 4715604 - DNA, 12 bp, Homo sapiens
tgaaacgatttc

SEQ ID NO: 4715605 - DNA, 17 bp, Homo sapiens
tgaaagggcccagagag

SEQ ID NO: 4715606 - DNA, 18 bp, Homo sapiens
tgaaagggcccagagagg

SEQ ID NO: 4715607 - DNA, 16 bp, Homo sapiens
tgaaatattaaaatca

SEQ ID NO: 4715608 - DNA, 17 bp, Homo sapiens
tgaaatattaaaatcac

SEQ ID NO: 4715609 - DNA, 19 bp, Homo sapiens
tgaaatattaaaatcactg

SEQ ID NO: 4715610 - DNA, 15 bp, Homo sapiens
tgaaatcatcaaaaa

SEQ ID NO: 4715611 - DNA, 20 bp, Homo sapiens
tgaaatgaggtcagagcctg

SEQ ID NO: 4715612 - DNA, 13 bp, Homo sapiens
tgaaatgcatatt

SEQ ID NO: 4715613 - DNA, 22 bp, Homo sapiens
tgaaatgcttatgcttgtgtat

SEQ ID NO: 4715614 - DNA, 20 bp, Homo sapiens
tcagagccgtggtcctttgg

SEQ ID NO: 4715615 - DNA, 21 bp, Homo sapiens
tcagaggccctcgctgccagc

SEQ ID NO: 4715616 - DNA, 23 bp, Homo sapiens
tcagagttaccattatttaattt

SEQ ID NO: 4715617 - DNA, 19 bp, Homo sapiens
tcagatacagggtgctcct

SEQ ID NO: 4715618 - DNA, 14 bp, Homo sapiens
tcagatataaaaga

SEQ ID NO: 4715619 - DNA, 18 bp, Homo sapiens
tcagatataaaagactga

SEQ ID NO: 4715620 - DNA, 20 bp, Homo sapiens
tcagatataaaagactgacc

SEQ ID NO: 4715621 - DNA, 16 bp, Homo sapiens
tcagcatcaaacatga

SEQ ID NO: 4715622 - DNA, 15 bp, Homo sapiens
tcagcatcctggcac

SEQ ID NO: 4715623 - DNA, 18 bp, Homo sapiens
tcagccccaccccagggc

SEQ ID NO: 4715624 - DNA, 19 bp, Homo sapiens
tcagccccaccccagggca

SEQ ID NO: 4715625 - DNA, 14 bp, Homo sapiens
tcagcccctgatcc

SEQ ID NO: 4715626 - DNA, 22 bp, Homo sapiens
tcagcccctgatcctgtgaagt

SEQ ID NO: 4715627 - DNA, 14 bp, Homo sapiens
tcagcctcccaaag

SEQ ID NO: 4715628 - DNA, 21 bp, Homo sapiens
tcagcctcccgagtagctggg

SEQ ID NO: 4715629 - DNA, 20 bp, Homo sapiens
tcagcctcctgagtagctgg

SEQ ID NO: 4715630 - DNA, 18 bp, Homo sapiens
tcagcggggacagctcct

SEQ ID NO: 4715631 - DNA, 20 bp, Homo sapiens
tcagcggggacagctccttc

SEQ ID NO: 4715632 - DNA, 15 bp, Homo sapiens
tcagctactttccat

SEQ ID NO: 4715633 - DNA, 13 bp, Homo sapiens
tcagctcactgca

SEQ ID NO: 4715634 - DNA, 18 bp, Homo sapiens
tcagctccactttcagtg

SEQ ID NO: 4715635 - DNA, 14 bp, Homo sapiens
tcagctccagctca

SEQ ID NO: 4715636 - DNA, 18 bp, Homo sapiens
tcagctccagctcaccag

SEQ ID NO: 4715637 - DNA, 15 bp, Homo sapiens
tcagctccttcctgg

SEQ ID NO: 4715638 - DNA, 16 bp, Homo sapiens
tcagctccttcctgga

SEQ ID NO: 4715639 - DNA, 17 bp, Homo sapiens
tcagctccttcctggag

SEQ ID NO: 4715640 - DNA, 17 bp, Homo sapiens
tcagctgaccccctccc

SEQ ID NO: 4715641 - DNA, 19 bp, Homo sapiens
tcagctgaccccctccccc

SEQ ID NO: 4715642 - DNA, 16 bp, Homo sapiens
tcagcttctgctgggc

SEQ ID NO: 4715643 - DNA, 16 bp, Homo sapiens
tcaggaaaagcctctg

SEQ ID NO: 4715644 - DNA, 17 bp, Homo sapiens
tcaggaaaagcctctgt

SEQ ID NO: 4715645 - DNA, 18 bp, Homo sapiens
tcaggaaaagcctctgtg

SEQ ID NO: 4715646 - DNA, 19 bp, Homo sapiens
tcaggaaaagcctctgtgt

SEQ ID NO: 4715647 - DNA, 15 bp, Homo sapiens
tcaggaaaggaatca

SEQ ID NO: 4715648 - DNA, 16 bp, Homo sapiens
tcaggaagctcagggc

SEQ ID NO: 4715649 - DNA, 13 bp, Homo sapiens
tcaggacactaat

SEQ ID NO: 4715650 - DNA, 14 bp, Homo sapiens
tcaggaccaggcaa

SEQ ID NO: 4715651 - DNA, 16 bp, Homo sapiens
tcaggacccagaggaa

SEQ ID NO: 4715652 - DNA, 17 bp, Homo sapiens
tcaggacttgaaagaaa

SEQ ID NO: 4715653 - DNA, 12 bp, Homo sapiens
tcaggagaaaaa

SEQ ID NO: 4715654 - DNA, 15 bp, Homo sapiens
tcaggagttccagtg

SEQ ID NO: 4715655 - DNA, 18 bp, Homo sapiens
tcaggagttccagtgctg

SEQ ID NO: 4715656 - DNA, 22 bp, Homo sapiens
tcaggagttccagtgctgcatg

SEQ ID NO: 4715657 - DNA, 16 bp, Homo sapiens
tcaggcagtgtttaaa

SEQ ID NO: 4715658 - DNA, 11 bp, Homo sapiens
tcaggccaggc

SEQ ID NO: 4715659 - DNA, 15 bp, Homo sapiens
tcaggccaggccctc

SEQ ID NO: 4715660 - DNA, 17 bp, Homo sapiens
tcaggccaggccctctg

SEQ ID NO: 4715661 - DNA, 20 bp, Homo sapiens
tcaggccaggccctctgccc

SEQ ID NO: 4715662 - DNA, 22 bp, Homo sapiens
tcaggccaggccctctgcccac

SEQ ID NO: 4715663 - DNA, 23 bp, Homo sapiens
tcaggccaggccctctgcccact

SEQ ID NO: 4715664 - DNA, 23 bp, Homo sapiens
tcaggccatcatcagtggagcca

SEQ ID NO: 4715665 - DNA, 13 bp, Homo sapiens
tcaggctctgaga

SEQ ID NO: 4715666 - DNA, 13 bp, Homo sapiens
tcagggaaagcat

SEQ ID NO: 4715667 - DNA, 22 bp, Homo sapiens
tcagggaaagcatttaaagggt

SEQ ID NO: 4715668 - DNA, 21 bp, Homo sapiens
tcagggaacatatttaaggaa

SEQ ID NO: 4715669 - DNA, 21 bp, Homo sapiens
tcagggagtgggctaagcacg

SEQ ID NO: 4715670 - DNA, 23 bp, Homo sapiens
tcagggctaaacgggcattgcct

SEQ ID NO: 4715671 - DNA, 16 bp, Homo sapiens
tcaggggctgcccgct

SEQ ID NO: 4715672 - DNA, 13 bp, Homo sapiens
tcagggtccctgg

SEQ ID NO: 4715673 - DNA, 18 bp, Homo sapiens
tcagggtccctggtggca

SEQ ID NO: 4715674 - DNA, 19 bp, Homo sapiens
tcagggtccctggtggcag

SEQ ID NO: 4715675 - DNA, 16 bp, Homo sapiens
tcagggtctctgctgc

SEQ ID NO: 4715676 - DNA, 16 bp, Homo sapiens
tcagggttggcccctg

SEQ ID NO: 4715677 - DNA, 18 bp, Homo sapiens
tcagggttggcccctgcc

SEQ ID NO: 4715678 - DNA, 21 bp, Homo sapiens
tcaggtaacaggcagatacag

SEQ ID NO: 4715679 - DNA, 22 bp, Homo sapiens
tcaggtaacaggcagatacagg

SEQ ID NO: 4715680 - DNA, 19 bp, Homo sapiens
tcaggtaatcgacctgcct

SEQ ID NO: 4715681 - DNA, 21 bp, Homo sapiens
tcaggtaatcgacctgcctcg

SEQ ID NO: 4715682 - DNA, 23 bp, Homo sapiens
tcaggtgatccacccacctcagc

SEQ ID NO: 4715683 - DNA, 14 bp, Homo sapiens
tcaggtgctgccat

SEQ ID NO: 4715684 - DNA, 15 bp, Homo sapiens
tcaggtgctgccatc

SEQ ID NO: 4715685 - DNA, 16 bp, Homo sapiens
tcaggtggggcagctt

SEQ ID NO: 4715686 - DNA, 17 bp, Homo sapiens
tcaggtggggcagcttg

SEQ ID NO: 4715687 - DNA, 20 bp, Homo sapiens
tcaggtggggtcactctggc

SEQ ID NO: 4715688 - DNA, 17 bp, Homo sapiens
tcaggtgtccctgcact

SEQ ID NO: 4715689 - DNA, 19 bp, Homo sapiens
tcaggttatcgaaataaca

SEQ ID NO: 4715690 - DNA, 13 bp, Homo sapiens
tcagtaagacgac

SEQ ID NO: 4715691 - DNA, 21 bp, Homo sapiens
tcagtaagacgacaaggaaag

SEQ ID NO: 4715692 - DNA, 15 bp, Homo sapiens
tcagtatatttggtt

SEQ ID NO: 4715693 - DNA, 20 bp, Homo sapiens
tcagtattcccagccttgag

SEQ ID NO: 4715694 - DNA, 16 bp, Homo sapiens
tcagtattttccctgc

SEQ ID NO: 4715695 - DNA, 15 bp, Homo sapiens
tcagtcatgcataaa

SEQ ID NO: 4715696 - DNA, 17 bp, Homo sapiens
tcagtctctgagcagtg

SEQ ID NO: 4715697 - DNA, 21 bp, Homo sapiens
tcagtctgattcccaagctct

SEQ ID NO: 4715698 - DNA, 18 bp, Homo sapiens
tcagtgaatttgtccatt

SEQ ID NO: 4715699 - DNA, 22 bp, Homo sapiens
tcagtgattttgtatatgaaaa

SEQ ID NO: 4715700 - DNA, 14 bp, Homo sapiens
tcagtgccgccgcc

SEQ ID NO: 4715701 - DNA, 21 bp, Homo sapiens
tcagtgccgccgcctcgccca

SEQ ID NO: 4715702 - DNA, 12 bp, Homo sapiens
tcagtgctccct

SEQ ID NO: 4715703 - DNA, 13 bp, Homo sapiens
tcagtgctccctc

SEQ ID NO: 4715704 - DNA, 19 bp, Homo sapiens
tcagtgctccctcacatgt

SEQ ID NO: 4715705 - DNA, 15 bp, Homo sapiens
tcagtggcagctgct

SEQ ID NO: 4715706 - DNA, 16 bp, Homo sapiens
tcagtggggaggggct

SEQ ID NO: 4715707 - DNA, 13 bp, Homo sapiens
tcagtgtgccccc

SEQ ID NO: 4715708 - DNA, 14 bp, Homo sapiens
tcagtgtgcccttc

SEQ ID NO: 4715709 - DNA, 17 bp, Homo sapiens
tcagtgttaaatgtgat

SEQ ID NO: 4715710 - DNA, 14 bp, Homo sapiens
tcagttactggtat

SEQ ID NO: 4715711 - DNA, 18 bp, Homo sapiens
tcagttagagctgacaca

SEQ ID NO: 4715712 - DNA, 12 bp, Homo sapiens
tcagttctcaat

SEQ ID NO: 4715713 - DNA, 17 bp, Homo sapiens
tcagttctgtgtacatt

SEQ ID NO: 4715714 - DNA, 18 bp, Homo sapiens
tcagttctgtgtacattt

SEQ ID NO: 4715715 - DNA, 16 bp, Homo sapiens
tcagtttcatatatta

SEQ ID NO: 4715716 - DNA, 22 bp, Homo sapiens
tcagtttgatacagtattgaaa

SEQ ID NO: 4715717 - DNA, 17 bp, Homo sapiens
tcagtttttgtgaaaag

SEQ ID NO: 4715718 - DNA, 22 bp, Homo sapiens
tcagtttttttttatacactgt

SEQ ID NO: 4715719 - DNA, 11 bp, Homo sapiens
tcataaattat

SEQ ID NO: 4715720 - DNA, 13 bp, Homo sapiens
tcataaattattt

SEQ ID NO: 4715721 - DNA, 20 bp, Homo sapiens
tcataagtatttcaaattgg

SEQ ID NO: 4715722 - DNA, 22 bp, Homo sapiens
tcatacatccctcagtttctta

SEQ ID NO: 4715723 - DNA, 14 bp, Homo sapiens
tcataccagtcagt

SEQ ID NO: 4715724 - DNA, 15 bp, Homo sapiens
tcatacccaccccca

SEQ ID NO: 4715725 - DNA, 17 bp, Homo sapiens
tcatactgtgctggagc

SEQ ID NO: 4715726 - DNA, 21 bp, Homo sapiens
tcatagccctcaccctggggc

SEQ ID NO: 4715727 - DNA, 13 bp, Homo sapiens
tcatattttgcca

SEQ ID NO: 4715728 - DNA, 20 bp, Homo sapiens
tcatcaaaaagaaaaatcaa

SEQ ID NO: 4715729 - DNA, 21 bp, Homo sapiens
tcatcaaaaagaaaaatcaaa

SEQ ID NO: 4715730 - DNA, 19 bp, Homo sapiens
tcatcaaatggaagacaca

SEQ ID NO: 4715731 - DNA, 21 bp, Homo sapiens
tcatcaaggcactgcctgatg

SEQ ID NO: 4715732 - DNA, 20 bp, Homo sapiens
tcatcaccaacgtctgtgcc

SEQ ID NO: 4715733 - DNA, 21 bp, Homo sapiens
tcatcaccaacgtctgtgcca

SEQ ID NO: 4715734 - DNA, 18 bp, Homo sapiens
tcatcaggagttccagtg

SEQ ID NO: 4715735 - DNA, 16 bp, Homo sapiens
tcatcatccctccctg

SEQ ID NO: 4715736 - DNA, 14 bp, Homo sapiens
tcatcatgtagaat

SEQ ID NO: 4715737 - DNA, 13 bp, Homo sapiens
tcatcattctctg

SEQ ID NO: 4715738 - DNA, 20 bp, Homo sapiens
tcatcattctctgtctcatc

SEQ ID NO: 4715739 - DNA, 18 bp, Homo sapiens
tcatccactgtgccatgt

SEQ ID NO: 4715740 - DNA, 14 bp, Homo sapiens
tcatccatcatcat

SEQ ID NO: 4715741 - DNA, 21 bp, Homo sapiens
tcatcccgagcacctccacat

SEQ ID NO: 4715742 - DNA, 17 bp, Homo sapiens
tcatccctaatgctgca

SEQ ID NO: 4715743 - DNA, 14 bp, Homo sapiens
tcatccctccctgc

SEQ ID NO: 4715744 - DNA, 15 bp, Homo sapiens
tcatccttgcccatc

SEQ ID NO: 4715745 - DNA, 18 bp, Homo sapiens
tcatctcctgccttcctc

SEQ ID NO: 4715746 - DNA, 22 bp, Homo sapiens
tcatctcctgccttcctcctgg

SEQ ID NO: 4715747 - DNA, 14 bp, Homo sapiens
tcatctcttagctc

SEQ ID NO: 4715748 - DNA, 20 bp, Homo sapiens
tcatctcttagctcccctcc

SEQ ID NO: 4715749 - DNA, 14 bp, Homo sapiens
tcatctgctctcct

SEQ ID NO: 4715750 - DNA, 16 bp, Homo sapiens
tcatctgctctccttc

SEQ ID NO: 4715751 - DNA, 17 bp, Homo sapiens
tcatctgctctccttcc

SEQ ID NO: 4715752 - DNA, 21 bp, Homo sapiens
tcatctgctctccttcctgga

SEQ ID NO: 4715753 - DNA, 12 bp, Homo sapiens
tcatctggaacc

SEQ ID NO: 4715754 - DNA, 13 bp, Homo sapiens
tcatctggaacca

SEQ ID NO: 4715755 - DNA, 12 bp, Homo sapiens
tcatctgtccct

SEQ ID NO: 4715756 - DNA, 22 bp, Homo sapiens
tcatctttcttgatcaacatct

SEQ ID NO: 4715757 - DNA, 15 bp, Homo sapiens
tcatgcataaatatg

SEQ ID NO: 4715758 - DNA, 20 bp, Homo sapiens
tcatgcataaatatgcagtg

SEQ ID NO: 4715759 - DNA, 14 bp, Homo sapiens
tcatgcatggaaat

SEQ ID NO: 4715760 - DNA, 15 bp, Homo sapiens
tcatgcctggcttcg

SEQ ID NO: 4715761 - DNA, 17 bp, Homo sapiens
tcatgcctggcttcgca

SEQ ID NO: 4715762 - DNA, 18 bp, Homo sapiens
tcatgcctggcttcgcaa

SEQ ID NO: 4715763 - DNA, 15 bp, Homo sapiens
tcatgcctgtaatcc

SEQ ID NO: 4715764 - DNA, 21 bp, Homo sapiens
tcatgcttccaggtaaaaaca

SEQ ID NO: 4715765 - DNA, 21 bp, Homo sapiens
tcatggagggtttagtgctta

SEQ ID NO: 4715766 - DNA, 17 bp, Homo sapiens
tcatggtgcatataaat

SEQ ID NO: 4715767 - DNA, 19 bp, Homo sapiens
tcatggtgtaataagacat

SEQ ID NO: 4715768 - DNA, 20 bp, Homo sapiens
tcatggtgtaataagacata

SEQ ID NO: 4715769 - DNA, 21 bp, Homo sapiens
tcatggtgtaataagacataa

SEQ ID NO: 4715770 - DNA, 14 bp, Homo sapiens
tcatgtaaacatac

SEQ ID NO: 4715771 - DNA, 17 bp, Homo sapiens
tcatgtaaactgtgcac

SEQ ID NO: 4715772 - DNA, 13 bp, Homo sapiens
tcatgtcatttct

SEQ ID NO: 4715773 - DNA, 14 bp, Homo sapiens
tcatgtcatttctc

SEQ ID NO: 4715774 - DNA, 16 bp, Homo sapiens
tcatgtcatttctcat

SEQ ID NO: 4715775 - DNA, 22 bp, Homo sapiens
tcatgttttaaaagtttgtcct

SEQ ID NO: 4715776 - DNA, 23 bp, Homo sapiens
tcatgttttaaaagtttgtcctt

SEQ ID NO: 4715777 - DNA, 17 bp, Homo sapiens
tcattaattcaatgaaa

SEQ ID NO: 4715778 - DNA, 21 bp, Homo sapiens
tcattaattcaatgaaatgga

SEQ ID NO: 4715779 - DNA, 15 bp, Homo sapiens
tcattagagcaggcg

SEQ ID NO: 4715780 - DNA, 14 bp, Homo sapiens
tcattcacatttca

SEQ ID NO: 4715781 - DNA, 14 bp, Homo sapiens
tcattcatccagga

SEQ ID NO: 4715782 - DNA, 15 bp, Homo sapiens
tcattccattctgga

SEQ ID NO: 4715783 - DNA, 15 bp, Homo sapiens
tcattcccctgccca

SEQ ID NO: 4715784 - DNA, 16 bp, Homo sapiens
tcattctctgtctcat

SEQ ID NO: 4715785 - DNA, 18 bp, Homo sapiens
tcattctctgtctcatcc

SEQ ID NO: 4715786 - DNA, 18 bp, Homo sapiens
tcattctgaaggagcccc

SEQ ID NO: 4715787 - DNA, 15 bp, Homo sapiens
tcattcttactaaaa

SEQ ID NO: 4715788 - DNA, 22 bp, Homo sapiens
tcattgacctgaggcccttctc

SEQ ID NO: 4715789 - DNA, 17 bp, Homo sapiens
tcattggatttttgtta

SEQ ID NO: 4715790 - DNA, 19 bp, Homo sapiens
tcatttagtttgattattc

SEQ ID NO: 4715791 - DNA, 20 bp, Homo sapiens
tcatttcctctgagctgtta

SEQ ID NO: 4715792 - DNA, 15 bp, Homo sapiens
tcatttctctttttt

SEQ ID NO: 4715793 - DNA, 21 bp, Homo sapiens
tcatttgagcagggctcagcg

SEQ ID NO: 4715794 - DNA, 20 bp, Homo sapiens
tcatttgctaactagcttgg

SEQ ID NO: 4715795 - DNA, 14 bp, Homo sapiens
tcatttgtcacaca

SEQ ID NO: 4715796 - DNA, 16 bp, Homo sapiens
tcatttgtcacacact

SEQ ID NO: 4715797 - DNA, 19 bp, Homo sapiens
tcatttttaactactgtat

SEQ ID NO: 4715798 - DNA, 14 bp, Homo sapiens
tcatttttgaatac

SEQ ID NO: 4715799 - DNA, 20 bp, Homo sapiens
tcatttttgtttctacctcc

SEQ ID NO: 4715800 - DNA, 15 bp, Homo sapiens
tcattttttaaaaaa

SEQ ID NO: 4715801 - DNA, 16 bp, Homo sapiens
tcattttttatgtatt

SEQ ID NO: 4715802 - DNA, 19 bp, Homo sapiens
tccaaactaccttccagtt

SEQ ID NO: 4715803 - DNA, 22 bp, Homo sapiens
tccaaataaaaataacatcatt

SEQ ID NO: 4715804 - DNA, 14 bp, Homo sapiens
tccaaatgcattca

SEQ ID NO: 4715805 - DNA, 14 bp, Homo sapiens
tccaaccccccagc

SEQ ID NO: 4715806 - DNA, 23 bp, Homo sapiens
tccaaccccccagcactgaggaa

SEQ ID NO: 4715807 - DNA, 14 bp, Homo sapiens
tccaaccctcatca

SEQ ID NO: 4715808 - DNA, 16 bp, Homo sapiens
tccaaccctcatcacc

SEQ ID NO: 4715809 - DNA, 21 bp, Homo sapiens
tccaacctggggggcagtggt

SEQ ID NO: 4715810 - DNA, 12 bp, Homo sapiens
tccaagaagccc

SEQ ID NO: 4715811 - DNA, 14 bp, Homo sapiens
tccaagaagcccag

SEQ ID NO: 4715812 - DNA, 20 bp, Homo sapiens
tccaagaccttctccttcac

SEQ ID NO: 4715813 - DNA, 16 bp, Homo sapiens
tccaagagtctgatga

SEQ ID NO: 4715814 - DNA, 14 bp, Homo sapiens
tccaagcaggacat

SEQ ID NO: 4715815 - DNA, 16 bp, Homo sapiens
tccaagctcccaggca

SEQ ID NO: 4715816 - DNA, 19 bp, Homo sapiens
tccaaggaaaccacagctg

SEQ ID NO: 4715817 - DNA, 20 bp, Homo sapiens
tccaaggaaaccacagctgc

SEQ ID NO: 4715818 - DNA, 23 bp, Homo sapiens
tccaaggaaaccacagctgctgg

SEQ ID NO: 4715819 - DNA, 14 bp, Homo sapiens
tccaaggtgtttct

SEQ ID NO: 4715820 - DNA, 18 bp, Homo sapiens
tccaaggtttataaagca

SEQ ID NO: 4715821 - DNA, 19 bp, Homo sapiens
tccaagtccacagtggaac

SEQ ID NO: 4715822 - DNA, 15 bp, Homo sapiens
tccaagtggctgtga

SEQ ID NO: 4715823 - DNA, 16 bp, Homo sapiens
tccaatcctatgtttt

SEQ ID NO: 4715824 - DNA, 18 bp, Homo sapiens
tccaattttttttaagtt

SEQ ID NO: 4715825 - DNA, 20 bp, Homo sapiens
tccacaaaataaccaatcct

SEQ ID NO: 4715826 - DNA, 14 bp, Homo sapiens
tccacaacacacag

SEQ ID NO: 4715827 - DNA, 13 bp, Homo sapiens
tccacacccccac

SEQ ID NO: 4715828 - DNA, 18 bp, Homo sapiens
tccacacctccaatgctg

SEQ ID NO: 4715829 - DNA, 15 bp, Homo sapiens
tccacacctgcggcc

SEQ ID NO: 4715830 - DNA, 15 bp, Homo sapiens
tccacagccatccca

SEQ ID NO: 4715831 - DNA, 18 bp, Homo sapiens
tccaccatcaagccacca

SEQ ID NO: 4715832 - DNA, 17 bp, Homo sapiens
tccacccacctcagcct

SEQ ID NO: 4715833 - DNA, 14 bp, Homo sapiens
tccaccctgctctc

SEQ ID NO: 4715834 - DNA, 12 bp, Homo sapiens
tccacctgccag

SEQ ID NO: 4715835 - DNA, 14 bp, Homo sapiens
tccacgactgtctc

SEQ ID NO: 4715836 - DNA, 16 bp, Homo sapiens
tccacgactgtctcca

SEQ ID NO: 4715837 - DNA, 19 bp, Homo sapiens
tccacgactgtctccatgg

SEQ ID NO: 4715838 - DNA, 14 bp, Homo sapiens
tccacgcggccacc

SEQ ID NO: 4715839 - DNA, 21 bp, Homo sapiens
tccacgcggccacctcaccct

SEQ ID NO: 4715840 - DNA, 14 bp, Homo sapiens
tccacggagccact

SEQ ID NO: 4715841 - DNA, 20 bp, Homo sapiens
tccacggagccactcctctg

SEQ ID NO: 4715842 - DNA, 21 bp, Homo sapiens
tccacggagccactcctctga

SEQ ID NO: 4715843 - DNA, 13 bp, Homo sapiens
tccacgtgtatgc

SEQ ID NO: 4715844 - DNA, 20 bp, Homo sapiens
tccacgttctgctcatcatt

SEQ ID NO: 4715845 - DNA, 19 bp, Homo sapiens
tccactatttgcagaggct

SEQ ID NO: 4715846 - DNA, 12 bp, Homo sapiens
tccactcccact

SEQ ID NO: 4715847 - DNA, 18 bp, Homo sapiens
tccactctcccccacccc

SEQ ID NO: 4715848 - DNA, 22 bp, Homo sapiens
tccactctcccccaccccctcc

SEQ ID NO: 4715849 - DNA, 20 bp, Homo sapiens
tccacttgttcattctgtga

SEQ ID NO: 4715850 - DNA, 18 bp, Homo sapiens
tccactttcagtgaaagc

SEQ ID NO: 4715851 - DNA, 15 bp, Homo sapiens
tccagacccggctgc

SEQ ID NO: 4715852 - DNA, 18 bp, Homo sapiens
tccagacccggctgcgtg

SEQ ID NO: 4715853 - DNA, 17 bp, Homo sapiens
tccagagctctgaccca

SEQ ID NO: 4715854 - DNA, 19 bp, Homo sapiens
tccagagctgcttctgtct

SEQ ID NO: 4715855 - DNA, 18 bp, Homo sapiens
tccagcaattctcctgcc

SEQ ID NO: 4715856 - DNA, 20 bp, Homo sapiens
tccagcaattctcctgcctc

SEQ ID NO: 4715857 - DNA, 13 bp, Homo sapiens
tccagccagggct

SEQ ID NO: 4715858 - DNA, 14 bp, Homo sapiens
tccagccagggctg

SEQ ID NO: 4715859 - DNA, 19 bp, Homo sapiens
tccagcccctggatgcagc

SEQ ID NO: 4715860 - DNA, 21 bp, Homo sapiens
tccagcccctggatgcagcct

SEQ ID NO: 4715861 - DNA, 15 bp, Homo sapiens
tccagccctggctga

SEQ ID NO: 4715862 - DNA, 14 bp, Homo sapiens
tccagcctggagat

SEQ ID NO: 4715863 - DNA, 21 bp, Homo sapiens
tccagctatttttatttgttt

SEQ ID NO: 4715864 - DNA, 14 bp, Homo sapiens
tccagctcaccagc

SEQ ID NO: 4715865 - DNA, 18 bp, Homo sapiens
tccagctcaccagcccca

SEQ ID NO: 4715866 - DNA, 23 bp, Homo sapiens
tccagctcaccagccccagtgcc

SEQ ID NO: 4715867 - DNA, 15 bp, Homo sapiens
tccagctggccggga

SEQ ID NO: 4715868 - DNA, 23 bp, Homo sapiens
tccaggagaaggccaattcctat

SEQ ID NO: 4715869 - DNA, 15 bp, Homo sapiens
tccaggagcagccac

SEQ ID NO: 4715870 - DNA, 18 bp, Homo sapiens
tccaggagcagccacatt

SEQ ID NO: 4715871 - DNA, 22 bp, Homo sapiens
tccaggagcagccacattcctg

SEQ ID NO: 4715872 - DNA, 15 bp, Homo sapiens
tccaggatttataaa

SEQ ID NO: 4715873 - DNA, 14 bp, Homo sapiens
tccaggctgggaga

SEQ ID NO: 4715874 - DNA, 21 bp, Homo sapiens
tccaggctgggagagccttcc

SEQ ID NO: 4715875 - DNA, 23 bp, Homo sapiens
tccaggctgggagagccttccag

SEQ ID NO: 4715876 - DNA, 11 bp, Homo sapiens
tccaggctggt

SEQ ID NO: 4715877 - DNA, 14 bp, Homo sapiens
tccaggctgtatcc

SEQ ID NO: 4715878 - DNA, 12 bp, Homo sapiens
tccagggacagc

SEQ ID NO: 4715879 - DNA, 21 bp, Homo sapiens
tccagggctggactgaggcct

SEQ ID NO: 4715880 - DNA, 23 bp, Homo sapiens
tccagggctggactgaggcctga

SEQ ID NO: 4715881 - DNA, 19 bp, Homo sapiens
tccaggggtgggacaccct

SEQ ID NO: 4715882 - DNA, 22 bp, Homo sapiens
tccaggggtgggacaccctgtg

SEQ ID NO: 4715883 - DNA, 20 bp, Homo sapiens
tccaggtgcacaagctccaa

SEQ ID NO: 4715884 - DNA, 16 bp, Homo sapiens
tccaggtggggtgagg

SEQ ID NO: 4715885 - DNA, 15 bp, Homo sapiens
tccaggttcagcttg

SEQ ID NO: 4715886 - DNA, 15 bp, Homo sapiens
tccagtatcctgctg

SEQ ID NO: 4715887 - DNA, 14 bp, Homo sapiens
tccagtcattatgt

SEQ ID NO: 4715888 - DNA, 16 bp, Homo sapiens
tccagtccaaggaaac

SEQ ID NO: 4715889 - DNA, 16 bp, Homo sapiens
tccagtgaggctctgc

SEQ ID NO: 4715890 - DNA, 23 bp, Homo sapiens
tccagtgaggctctgcccttggt

SEQ ID NO: 4715891 - DNA, 15 bp, Homo sapiens
tccagtgctgcatgc

SEQ ID NO: 4715892 - DNA, 19 bp, Homo sapiens
tccagttaaaaaaaatttt

SEQ ID NO: 4715893 - DNA, 13 bp, Homo sapiens
tccagttcttccc

SEQ ID NO: 4715894 - DNA, 12 bp, Homo sapiens
tccagttttgtt

SEQ ID NO: 4715895 - DNA, 19 bp, Homo sapiens
tccatcacgttagctgtcc

SEQ ID NO: 4715896 - DNA, 18 bp, Homo sapiens
tccatcagttagagctga

SEQ ID NO: 4715897 - DNA, 21 bp, Homo sapiens
tccatccctgaaatttctcat

SEQ ID NO: 4715898 - DNA, 16 bp, Homo sapiens
tccatcctcccaggaa

SEQ ID NO: 4715899 - DNA, 18 bp, Homo sapiens
tccatctttcctgatggc

SEQ ID NO: 4715900 - DNA, 16 bp, Homo sapiens
tccatgaaaatgcaac

SEQ ID NO: 4715901 - DNA, 15 bp, Homo sapiens
tccatgagtcccctg

SEQ ID NO: 4715902 - DNA, 15 bp, Homo sapiens
tccatgatgctggga

SEQ ID NO: 4715903 - DNA, 13 bp, Homo sapiens
tccatggactttg

SEQ ID NO: 4715904 - DNA, 18 bp, Homo sapiens
tccatgggagaaaataga

SEQ ID NO: 4715905 - DNA, 20 bp, Homo sapiens
tccatgggccatatgaaaag

SEQ ID NO: 4715906 - DNA, 18 bp, Homo sapiens
tccatgggggctcagcca

SEQ ID NO: 4715907 - DNA, 19 bp, Homo sapiens
tccatgtctatgctccctc

SEQ ID NO: 4715908 - DNA, 19 bp, Homo sapiens
tccattctacctgtcctcc

SEQ ID NO: 4715909 - DNA, 14 bp, Homo sapiens
tccattctggaagt

SEQ ID NO: 4715910 - DNA, 17 bp, Homo sapiens
tccattgtaaatctgaa

SEQ ID NO: 4715911 - DNA, 21 bp, Homo sapiens
tccattgtaaatctgaagaaa

SEQ ID NO: 4715912 - DNA, 21 bp, Homo sapiens
tccatttttaaggctgtgtga

SEQ ID NO: 4715913 - DNA, 20 bp, Homo sapiens
tcccaaaagcccattcattc

SEQ ID NO: 4715914 - DNA, 21 bp, Homo sapiens
tcccaaagtgctgggattaca

SEQ ID NO: 4715915 - DNA, 19 bp, Homo sapiens
tcccaacatggtcctagca

SEQ ID NO: 4715916 - DNA, 14 bp, Homo sapiens
tcccaactcacccc

SEQ ID NO: 4715917 - DNA, 15 bp, Homo sapiens
tcccaactcacccca

SEQ ID NO: 4715918 - DNA, 17 bp, Homo sapiens
tcccaactcaccccagc

SEQ ID NO: 4715919 - DNA, 18 bp, Homo sapiens
tcccaactcaccccagcc

SEQ ID NO: 4715920 - DNA, 21 bp, Homo sapiens
tcccaactcaccccagcccca

SEQ ID NO: 4715921 - DNA, 14 bp, Homo sapiens
tcccaagctctgct

SEQ ID NO: 4715922 - DNA, 21 bp, Homo sapiens
tcccaagggatggtgccctgt

SEQ ID NO: 4715923 - DNA, 15 bp, Homo sapiens
tcccaattcacatct

SEQ ID NO: 4715924 - DNA, 13 bp, Homo sapiens
tcccacagcgctg

SEQ ID NO: 4715925 - DNA, 21 bp, Homo sapiens
tcccacaggacatttctctaa

SEQ ID NO: 4715926 - DNA, 15 bp, Homo sapiens
tcccaccaccctgag

SEQ ID NO: 4715927 - DNA, 13 bp, Homo sapiens
tcccacctcagcc

SEQ ID NO: 4715928 - DNA, 18 bp, Homo sapiens
tcccaccttggctgcagg

SEQ ID NO: 4715929 - DNA, 20 bp, Homo sapiens
tcccactgcaacttgtgaac

SEQ ID NO: 4715930 - DNA, 16 bp, Homo sapiens
tcccactgcaccccct

SEQ ID NO: 4715931 - DNA, 21 bp, Homo sapiens
tcccactgcaccccctcctgc

SEQ ID NO: 4715932 - DNA, 19 bp, Homo sapiens
tcccagaggggcctgccac

SEQ ID NO: 4715933 - DNA, 20 bp, Homo sapiens
tcccagctgtgctctggaca

SEQ ID NO: 4715934 - DNA, 21 bp, Homo sapiens
tcccagctgtgctctggacag

SEQ ID NO: 4715935 - DNA, 18 bp, Homo sapiens
tcccaggcattccccagg

SEQ ID NO: 4715936 - DNA, 21 bp, Homo sapiens
tcccaggcattccccaggagg

SEQ ID NO: 4715937 - DNA, 22 bp, Homo sapiens
tcccaggcattccccaggaggc

SEQ ID NO: 4715938 - DNA, 15 bp, Homo sapiens
tcccaggctgagcct

SEQ ID NO: 4715939 - DNA, 23 bp, Homo sapiens
tcccagtggctgctgcccaggcc

SEQ ID NO: 4715940 - DNA, 14 bp, Homo sapiens
tcccataccaccca

SEQ ID NO: 4715941 - DNA, 15 bp, Homo sapiens
tcccatcacccgcta

SEQ ID NO: 4715942 - DNA, 14 bp, Homo sapiens
tcccatctcacaca

SEQ ID NO: 4715943 - DNA, 19 bp, Homo sapiens
tcccatctcacacatgagc

SEQ ID NO: 4715944 - DNA, 21 bp, Homo sapiens
tcccatctgtgaaaggaaaga

SEQ ID NO: 4715945 - DNA, 19 bp, Homo sapiens
tcccatgacccaggctggg

SEQ ID NO: 4715946 - DNA, 19 bp, Homo sapiens
tccccaactgaccaccttt

SEQ ID NO: 4715947 - DNA, 16 bp, Homo sapiens
tccccaccgcagacag

SEQ ID NO: 4715948 - DNA, 19 bp, Homo sapiens
tattctctgagctgtgcag

SEQ ID NO: 4715949 - DNA, 16 bp, Homo sapiens
tattctgttggccagt

SEQ ID NO: 4715950 - DNA, 17 bp, Homo sapiens
tattgaaaaattatcag

SEQ ID NO: 4715951 - DNA, 20 bp, Homo sapiens
tattgaattattttgttact

SEQ ID NO: 4715952 - DNA, 13 bp, Homo sapiens
tattgatgttttc

SEQ ID NO: 4715953 - DNA, 13 bp, Homo sapiens
tattgcccaggtt

SEQ ID NO: 4715954 - DNA, 19 bp, Homo sapiens
tattgctaaaatattttag

SEQ ID NO: 4715955 - DNA, 18 bp, Homo sapiens
tattgctccattttcttg

SEQ ID NO: 4715956 - DNA, 15 bp, Homo sapiens
tattgcttgcacaaa

SEQ ID NO: 4715957 - DNA, 14 bp, Homo sapiens
tattgtacagtttt

SEQ ID NO: 4715958 - DNA, 15 bp, Homo sapiens
tattgtccattgtcc

SEQ ID NO: 4715959 - DNA, 17 bp, Homo sapiens
tattgtccattgtccaa

SEQ ID NO: 4715960 - DNA, 13 bp, Homo sapiens
tattgtggctccc

SEQ ID NO: 4715961 - DNA, 22 bp, Homo sapiens
tattgttacgtagcctaaggct

SEQ ID NO: 4715962 - DNA, 18 bp, Homo sapiens
tattgttatattacttgc

SEQ ID NO: 4715963 - DNA, 12 bp, Homo sapiens
tattgtttacat

SEQ ID NO: 4715964 - DNA, 12 bp, Homo sapiens
tattgtttcaat

SEQ ID NO: 4715965 - DNA, 18 bp, Homo sapiens
tattgtttcaattgcatc

SEQ ID NO: 4715966 - DNA, 19 bp, Homo sapiens
tattgttttactccttttt

SEQ ID NO: 4715967 - DNA, 16 bp, Homo sapiens
tattgtttttgtattt

SEQ ID NO: 4715968 - DNA, 14 bp, Homo sapiens
tatttaaaagacaa

SEQ ID NO: 4715969 - DNA, 18 bp, Homo sapiens
tatttaaaagacaaacac

SEQ ID NO: 4715970 - DNA, 13 bp, Homo sapiens
tatttaaatgtac

SEQ ID NO: 4715971 - DNA, 11 bp, Homo sapiens
tatttaataac

SEQ ID NO: 4715972 - DNA, 13 bp, Homo sapiens
tatttaataacat

SEQ ID NO: 4715973 - DNA, 15 bp, Homo sapiens
tatttaataacatta

SEQ ID NO: 4715974 - DNA, 20 bp, Homo sapiens
tatttaatgatttttgtgta

SEQ ID NO: 4715975 - DNA, 22 bp, Homo sapiens
tatttaattctttctattttca

SEQ ID NO: 4715976 - DNA, 18 bp, Homo sapiens
tatttaattgtttcaaaa

SEQ ID NO: 4715977 - DNA, 14 bp, Homo sapiens
tatttaatttgtat

SEQ ID NO: 4715978 - DNA, 18 bp, Homo sapiens
tatttaccttttaagaca

SEQ ID NO: 4715979 - DNA, 14 bp, Homo sapiens
tatttactatttca

SEQ ID NO: 4715980 - DNA, 13 bp, Homo sapiens
tatttatataaat

SEQ ID NO: 4715981 - DNA, 16 bp, Homo sapiens
tatttattaatttgaa

SEQ ID NO: 4715982 - DNA, 19 bp, Homo sapiens
tatttattgaattattttg

SEQ ID NO: 4715983 - DNA, 14 bp, Homo sapiens
tatttatttagtat

SEQ ID NO: 4715984 - DNA, 14 bp, Homo sapiens
tatttcaaattgga

SEQ ID NO: 4715985 - DNA, 22 bp, Homo sapiens
tatttcaatttccaagagctga

SEQ ID NO: 4715986 - DNA, 15 bp, Homo sapiens
tatttccctcccctg

SEQ ID NO: 4715987 - DNA, 12 bp, Homo sapiens
tatttgaaactt

SEQ ID NO: 4715988 - DNA, 18 bp, Homo sapiens
tatttgataacattttgt

SEQ ID NO: 4715989 - DNA, 19 bp, Homo sapiens
tatttgataacattttgtt

SEQ ID NO: 4715990 - DNA, 16 bp, Homo sapiens
tatttgatatttggtt

SEQ ID NO: 4715991 - DNA, 22 bp, Homo sapiens
tatttgcataacaattcctcta

SEQ ID NO: 4715992 - DNA, 20 bp, Homo sapiens
tatttgcatatttttctaaa

SEQ ID NO: 4715993 - DNA, 21 bp, Homo sapiens
tatttggtgggagttatatca

SEQ ID NO: 4715994 - DNA, 22 bp, Homo sapiens
tatttggtgggagttatatcag

SEQ ID NO: 4715995 - DNA, 13 bp, Homo sapiens
tatttggtttcta

SEQ ID NO: 4715996 - DNA, 16 bp, Homo sapiens
tatttgtgctatttaa

SEQ ID NO: 4715997 - DNA, 12 bp, Homo sapiens
tattttaatcct

SEQ ID NO: 4715998 - DNA, 11 bp, Homo sapiens
tattttacatc

SEQ ID NO: 4715999 - DNA, 20 bp, Homo sapiens
tattttagaaattataattt

SEQ ID NO: 4716000 - DNA, 20 bp, Homo sapiens
tattttccatgaaaatgcaa

SEQ ID NO: 4716001 - DNA, 15 bp, Homo sapiens
tattttctaaagact

SEQ ID NO: 4716002 - DNA, 18 bp, Homo sapiens
tattttgcatatatgttc

SEQ ID NO: 4716003 - DNA, 19 bp, Homo sapiens
tattttgcatatatgttct

SEQ ID NO: 4716004 - DNA, 19 bp, Homo sapiens
tattttggaaattgagtct

SEQ ID NO: 4716005 - DNA, 11 bp, Homo sapiens
tatttttaatt

SEQ ID NO: 4716006 - DNA, 17 bp, Homo sapiens
tatttttatttgtttgt

SEQ ID NO: 4716007 - DNA, 15 bp, Homo sapiens
tatttttctaaagaa

SEQ ID NO: 4716008 - DNA, 19 bp, Homo sapiens
tatttttctaaagaaatat

SEQ ID NO: 4716009 - DNA, 18 bp, Homo sapiens
tattttttgaactttgta

SEQ ID NO: 4716010 - DNA, 17 bp, Homo sapiens
tcaaaaagaaaaatcaa

SEQ ID NO: 4716011 - DNA, 12 bp, Homo sapiens
tcaaaaatgctg

SEQ ID NO: 4716012 - DNA, 18 bp, Homo sapiens
tcaaaaatgctgttaatg

SEQ ID NO: 4716013 - DNA, 22 bp, Homo sapiens
tcaaacacaatggagtgtgtaa

SEQ ID NO: 4716014 - DNA, 15 bp, Homo sapiens
tcaaacatgaaaaca

SEQ ID NO: 4716015 - DNA, 15 bp, Homo sapiens
tcaaacgtgaaaatg

SEQ ID NO: 4716016 - DNA, 16 bp, Homo sapiens
tcaaacgtgaaaatgc

SEQ ID NO: 4716017 - DNA, 23 bp, Homo sapiens
tcaaagaaaaacaatgaaattga

SEQ ID NO: 4716018 - DNA, 15 bp, Homo sapiens
tcaaagcaaggaaac

SEQ ID NO: 4716019 - DNA, 22 bp, Homo sapiens
tcaaagccagcgtcctcctctg

SEQ ID NO: 4716020 - DNA, 23 bp, Homo sapiens
tcaaagccagcgtcctcctctgt

SEQ ID NO: 4716021 - DNA, 13 bp, Homo sapiens
tcaaagcttaaaa

SEQ ID NO: 4716022 - DNA, 16 bp, Homo sapiens
tcaaagttaaaagtaa

SEQ ID NO: 4716023 - DNA, 15 bp, Homo sapiens
tcaaagttttgaaaa

SEQ ID NO: 4716024 - DNA, 17 bp, Homo sapiens
tcaaagttttgaaaagc

SEQ ID NO: 4716025 - DNA, 20 bp, Homo sapiens
tcaaagttttgaaaagctat

SEQ ID NO: 4716026 - DNA, 13 bp, Homo sapiens
tcaaataaacctt

SEQ ID NO: 4716027 - DNA, 15 bp, Homo sapiens
tcaaatgagaaaatg

SEQ ID NO: 4716028 - DNA, 20 bp, Homo sapiens
tcaaatggaagacacattga

SEQ ID NO: 4716029 - DNA, 19 bp, Homo sapiens
tcaaattaggcaaatcttt

SEQ ID NO: 4716030 - DNA, 15 bp, Homo sapiens
tcaaattcaatgatt

SEQ ID NO: 4716031 - DNA, 14 bp, Homo sapiens
tcaacaaagaaaca

SEQ ID NO: 4716032 - DNA, 21 bp, Homo sapiens
tcaacaaagaaacaaagatgt

SEQ ID NO: 4716033 - DNA, 16 bp, Homo sapiens
tcaacagagactgaat

SEQ ID NO: 4716034 - DNA, 18 bp, Homo sapiens
tcaaccccttcgctcctg

SEQ ID NO: 4716035 - DNA, 13 bp, Homo sapiens
tcaacctcctggg

SEQ ID NO: 4716036 - DNA, 16 bp, Homo sapiens
tcaacctcctgggcta

SEQ ID NO: 4716037 - DNA, 17 bp, Homo sapiens
tcaacctgggcaaagcc

SEQ ID NO: 4716038 - DNA, 21 bp, Homo sapiens
tcaacggaaagtgctgtctta

SEQ ID NO: 4716039 - DNA, 14 bp, Homo sapiens
tcaactccctgccc

SEQ ID NO: 4716040 - DNA, 19 bp, Homo sapiens
tcaacttcagtactcaaat

SEQ ID NO: 4716041 - DNA, 23 bp, Homo sapiens
tcaagaaaacaggcactgccctg

SEQ ID NO: 4716042 - DNA, 17 bp, Homo sapiens
tcaagaaagatatctat

SEQ ID NO: 4716043 - DNA, 23 bp, Homo sapiens
tcaagaagcaggctacactgaca

SEQ ID NO: 4716044 - DNA, 15 bp, Homo sapiens
tcaagagcacacttg

SEQ ID NO: 4716045 - DNA, 22 bp, Homo sapiens
tcaagatccaaatgctgtgcaa

SEQ ID NO: 4716046 - DNA, 17 bp, Homo sapiens
tcaagcaagatttcaga

SEQ ID NO: 4716047 - DNA, 19 bp, Homo sapiens
tcaagcaggtttcttgctt

SEQ ID NO: 4716048 - DNA, 20 bp, Homo sapiens
tcaagccaccaacatactcc

SEQ ID NO: 4716049 - DNA, 19 bp, Homo sapiens
tcaagcgattcttctgctt

SEQ ID NO: 4716050 - DNA, 16 bp, Homo sapiens
tcaaggcactgcctga

SEQ ID NO: 4716051 - DNA, 20 bp, Homo sapiens
tcaagtgattctcatgcctc

SEQ ID NO: 4716052 - DNA, 21 bp, Homo sapiens
tcaagtgattctcatgcctca

SEQ ID NO: 4716053 - DNA, 22 bp, Homo sapiens
tcaagtgattctcctgcctcag

SEQ ID NO: 4716054 - DNA, 18 bp, Homo sapiens
tcaatatttactatttca

SEQ ID NO: 4716055 - DNA, 16 bp, Homo sapiens
tcaatattttccatga

SEQ ID NO: 4716056 - DNA, 17 bp, Homo sapiens
tcaatattttccatgaa

SEQ ID NO: 4716057 - DNA, 12 bp, Homo sapiens
tcaatcacagct

SEQ ID NO: 4716058 - DNA, 20 bp, Homo sapiens
tcaatcacagcttgtatttt

SEQ ID NO: 4716059 - DNA, 18 bp, Homo sapiens
tcaatctgtgtaagaaaa

SEQ ID NO: 4716060 - DNA, 21 bp, Homo sapiens
tcaatctgtgtaagaaaacaa

SEQ ID NO: 4716061 - DNA, 18 bp, Homo sapiens
tcaatgcactgacattgt

SEQ ID NO: 4716062 - DNA, 22 bp, Homo sapiens
tcaattacttattttaggaaat

SEQ ID NO: 4716063 - DNA, 18 bp, Homo sapiens
tcaattgcatctcccaga

SEQ ID NO: 4716064 - DNA, 20 bp, Homo sapiens
tcaatttccaagagctgagg

SEQ ID NO: 4716065 - DNA, 14 bp, Homo sapiens
tcacaaaagctgtg

SEQ ID NO: 4716066 - DNA, 20 bp, Homo sapiens
tcacaaaatatattttgttt

SEQ ID NO: 4716067 - DNA, 15 bp, Homo sapiens
tcacacactttggct

SEQ ID NO: 4716068 - DNA, 22 bp, Homo sapiens
tcacacagtattacttctgcta

SEQ ID NO: 4716069 - DNA, 22 bp, Homo sapiens
tcacacagtgagtcgaggacag

SEQ ID NO: 4716070 - DNA, 21 bp, Homo sapiens
tcacacatgagcatcaggcca

SEQ ID NO: 4716071 - DNA, 11 bp, Homo sapiens
tcacacattca

SEQ ID NO: 4716072 - DNA, 14 bp, Homo sapiens
tcacacatttgcct

SEQ ID NO: 4716073 - DNA, 20 bp, Homo sapiens
tcacacctagcgtcagtatt

SEQ ID NO: 4716074 - DNA, 17 bp, Homo sapiens
tcacacgggggcagctg

SEQ ID NO: 4716075 - DNA, 18 bp, Homo sapiens
tcacactaaaatttaatt

SEQ ID NO: 4716076 - DNA, 21 bp, Homo sapiens
tcacactgagaatgtaagaac

SEQ ID NO: 4716077 - DNA, 15 bp, Homo sapiens
tcacagatgggtgct

SEQ ID NO: 4716078 - DNA, 14 bp, Homo sapiens
tcacagctcttgtt

SEQ ID NO: 4716079 - DNA, 17 bp, Homo sapiens
tcacaggcaggtccagg

SEQ ID NO: 4716080 - DNA, 23 bp, Homo sapiens
tcacagttccctttatttcacat

SEQ ID NO: 4716081 - DNA, 12 bp, Homo sapiens
tcacatatgata

SEQ ID NO: 4716082 - DNA, 16 bp, Homo sapiens
tcacatcccatgtaga

SEQ ID NO: 4716083 - DNA, 22 bp, Homo sapiens
tcacatctgaatctccttgttg

SEQ ID NO: 4716084 - DNA, 15 bp, Homo sapiens
tcacatcttggcaca

SEQ ID NO: 4716085 - DNA, 16 bp, Homo sapiens
tcacatctttttcact

SEQ ID NO: 4716086 - DNA, 23 bp, Homo sapiens
tcacatggcgtcctgcccttgct

SEQ ID NO: 4716087 - DNA, 12 bp, Homo sapiens
tcacatttaaat

SEQ ID NO: 4716088 - DNA, 17 bp, Homo sapiens
tcacatttattctgctc

SEQ ID NO: 4716089 - DNA, 13 bp, Homo sapiens
tcacattttctca

SEQ ID NO: 4716090 - DNA, 18 bp, Homo sapiens
tcaccaacgtctgtgcca

SEQ ID NO: 4716091 - DNA, 18 bp, Homo sapiens
tcaccacgtggggccatg

SEQ ID NO: 4716092 - DNA, 19 bp, Homo sapiens
tcaccacgtggggccatgc

SEQ ID NO: 4716093 - DNA, 22 bp, Homo sapiens
tcaccagccccagtgcccacag

SEQ ID NO: 4716094 - DNA, 18 bp, Homo sapiens
tcaccaggggcaggcaca

SEQ ID NO: 4716095 - DNA, 21 bp, Homo sapiens
tcaccaggggcaggcacagca

SEQ ID NO: 4716096 - DNA, 22 bp, Homo sapiens
tcaccaggggcaggcacagcac

SEQ ID NO: 4716097 - DNA, 22 bp, Homo sapiens
tcaccatttgattatgtagcaa

SEQ ID NO: 4716098 - DNA, 20 bp, Homo sapiens
tcaccccagccccaaaactc

SEQ ID NO: 4716099 - DNA, 22 bp, Homo sapiens
tcacccccttctccatccacat

SEQ ID NO: 4716100 - DNA, 15 bp, Homo sapiens
tcaccccggccacct

SEQ ID NO: 4716101 - DNA, 17 bp, Homo sapiens
tcaccccggccacctgc

SEQ ID NO: 4716102 - DNA, 22 bp, Homo sapiens
tcaccccggccacctgcggtgc

SEQ ID NO: 4716103 - DNA, 19 bp, Homo sapiens
tcacccctggttctcatct

SEQ ID NO: 4716104 - DNA, 19 bp, Homo sapiens
tcaccgcggctggatgggg

SEQ ID NO: 4716105 - DNA, 16 bp, Homo sapiens
tcaccgtgggctccct

SEQ ID NO: 4716106 - DNA, 19 bp, Homo sapiens
tcaccgtgggctccctgac

SEQ ID NO: 4716107 - DNA, 16 bp, Homo sapiens
tcacctaaaccctctg

SEQ ID NO: 4716108 - DNA, 18 bp, Homo sapiens
tcacctaaaccctctgtg

SEQ ID NO: 4716109 - DNA, 19 bp, Homo sapiens
tcacctaaaccctctgtga

SEQ ID NO: 4716110 - DNA, 22 bp, Homo sapiens
tcacctaactcatactgtgctg

SEQ ID NO: 4716111 - DNA, 16 bp, Homo sapiens
tcacctcagagtggag

SEQ ID NO: 4716112 - DNA, 22 bp, Homo sapiens
tcacctcagagtggagttgaaa

SEQ ID NO: 4716113 - DNA, 15 bp, Homo sapiens
tcacctctcccttgg

SEQ ID NO: 4716114 - DNA, 16 bp, Homo sapiens
tcacctgaagactcat

SEQ ID NO: 4716115 - DNA, 19 bp, Homo sapiens
tcacctgaagactcattct

SEQ ID NO: 4716116 - DNA, 20 bp, Homo sapiens
tcacctggggctgctggcct

SEQ ID NO: 4716117 - DNA, 21 bp, Homo sapiens
tcacctgtgcttcgggccctt

SEQ ID NO: 4716118 - DNA, 16 bp, Homo sapiens
tcaccttcaaaatgtt

SEQ ID NO: 4716119 - DNA, 19 bp, Homo sapiens
tcaccttcaaaatgttcta

SEQ ID NO: 4716120 - DNA, 15 bp, Homo sapiens
tcacctttgtcccca

SEQ ID NO: 4716121 - DNA, 18 bp, Homo sapiens
tcacctttgtccccaccg

SEQ ID NO: 4716122 - DNA, 14 bp, Homo sapiens
tcaccttttcttca

SEQ ID NO: 4716123 - DNA, 18 bp, Homo sapiens
tcacgattgtcatcagga

SEQ ID NO: 4716124 - DNA, 13 bp, Homo sapiens
tcacgccactgca

SEQ ID NO: 4716125 - DNA, 16 bp, Homo sapiens
tcacgccactgcacta

SEQ ID NO: 4716126 - DNA, 20 bp, Homo sapiens
tcacggctcactgcagcctc

SEQ ID NO: 4716127 - DNA, 16 bp, Homo sapiens
tcacgtggaggagcag

SEQ ID NO: 4716128 - DNA, 19 bp, Homo sapiens
tcactatcccggctgccct

SEQ ID NO: 4716129 - DNA, 23 bp, Homo sapiens
tcactatggtgccaatggaacct

SEQ ID NO: 4716130 - DNA, 19 bp, Homo sapiens
tcactatgttgcccaggca

SEQ ID NO: 4716131 - DNA, 20 bp, Homo sapiens
tcactatgttgcccaggcag

SEQ ID NO: 4716132 - DNA, 22 bp, Homo sapiens
tcactatttaaactatgataaa

SEQ ID NO: 4716133 - DNA, 14 bp, Homo sapiens
tcactcacattttc

SEQ ID NO: 4716134 - DNA, 13 bp, Homo sapiens
tcactcccctcca

SEQ ID NO: 4716135 - DNA, 13 bp, Homo sapiens
tcactccttgaaa

SEQ ID NO: 4716136 - DNA, 21 bp, Homo sapiens
tcactctaattggtcattcct

SEQ ID NO: 4716137 - DNA, 13 bp, Homo sapiens
tcactctggcagc

SEQ ID NO: 4716138 - DNA, 16 bp, Homo sapiens
tcactctggcagctca

SEQ ID NO: 4716139 - DNA, 17 bp, Homo sapiens
tcactcttattgcccac

SEQ ID NO: 4716140 - DNA, 23 bp, Homo sapiens
tcactcttattgcccacgctgga

SEQ ID NO: 4716141 - DNA, 23 bp, Homo sapiens
tcactgagacagcccgggctctg

SEQ ID NO: 4716142 - DNA, 17 bp, Homo sapiens
tcactgagccatcattt

SEQ ID NO: 4716143 - DNA, 18 bp, Homo sapiens
tcactgcaacctccgcct

SEQ ID NO: 4716144 - DNA, 15 bp, Homo sapiens
tcactgcagcctcaa

SEQ ID NO: 4716145 - DNA, 14 bp, Homo sapiens
tcactggctgcctc

SEQ ID NO: 4716146 - DNA, 17 bp, Homo sapiens
tcactggggagtctgct

SEQ ID NO: 4716147 - DNA, 23 bp, Homo sapiens
tcactgtataaataggagaggat

SEQ ID NO: 4716148 - DNA, 24 bp, Homo sapiens
tcactgtataaataggagaggatg

SEQ ID NO: 4716149 - DNA, 15 bp, Homo sapiens
tcactgttgcccagg

SEQ ID NO: 4716150 - DNA, 19 bp, Homo sapiens
tcactgttgcccaggctgg

SEQ ID NO: 4716151 - DNA, 17 bp, Homo sapiens
tcacttctgagaactca

SEQ ID NO: 4716152 - DNA, 13 bp, Homo sapiens
tcacttgcacatc

SEQ ID NO: 4716153 - DNA, 19 bp, Homo sapiens
tcacttgctggctgtgaaa

SEQ ID NO: 4716154 - DNA, 22 bp, Homo sapiens
tcactttaaagcaattgcataa

SEQ ID NO: 4716155 - DNA, 12 bp, Homo sapiens
tcacttttattt

SEQ ID NO: 4716156 - DNA, 18 bp, Homo sapiens
tcacttttgacaaaggca

SEQ ID NO: 4716157 - DNA, 19 bp, Homo sapiens
tcagaaacaccctcacact

SEQ ID NO: 4716158 - DNA, 21 bp, Homo sapiens
tcagaaacaccctcacactgg

SEQ ID NO: 4716159 - DNA, 21 bp, Homo sapiens
tcagaactttagtattaaatc

SEQ ID NO: 4716160 - DNA, 13 bp, Homo sapiens
tcagaatatattc

SEQ ID NO: 4716161 - DNA, 22 bp, Homo sapiens
tcagaatatattcactttcatt

SEQ ID NO: 4716162 - DNA, 17 bp, Homo sapiens
tcagaatctctcttctt

SEQ ID NO: 4716163 - DNA, 13 bp, Homo sapiens
tcagacagctgcc

SEQ ID NO: 4716164 - DNA, 17 bp, Homo sapiens
tcagacagctgcctggg

SEQ ID NO: 4716165 - DNA, 19 bp, Homo sapiens
tcagacagctgcctgggat

SEQ ID NO: 4716166 - DNA, 15 bp, Homo sapiens
tcagacatttatgtg

SEQ ID NO: 4716167 - DNA, 17 bp, Homo sapiens
tcagacgcctgaggaac

SEQ ID NO: 4716168 - DNA, 12 bp, Homo sapiens
tcagagacactg

SEQ ID NO: 4716169 - DNA, 23 bp, Homo sapiens
tcagagagggtgggagtgggccc

SEQ ID NO: 4716170 - DNA, 15 bp, Homo sapiens
tagcccgaatacaaa

SEQ ID NO: 4716171 - DNA, 20 bp, Homo sapiens
tagcctaaggctcctgtttt

SEQ ID NO: 4716172 - DNA, 16 bp, Homo sapiens
tagcctaggtgacaga

SEQ ID NO: 4716173 - DNA, 21 bp, Homo sapiens
tagcctcgatgtcctcctctg

SEQ ID NO: 4716174 - DNA, 20 bp, Homo sapiens
tagccttagaagtcacacag

SEQ ID NO: 4716175 - DNA, 17 bp, Homo sapiens
tagcgcacccagagaaa

SEQ ID NO: 4716176 - DNA, 14 bp, Homo sapiens
tagcgcccagttgg

SEQ ID NO: 4716177 - DNA, 15 bp, Homo sapiens
tagctacatcagttt

SEQ ID NO: 4716178 - DNA, 15 bp, Homo sapiens
tagctagctatttct

SEQ ID NO: 4716179 - DNA, 18 bp, Homo sapiens
tagctagctatttctatg

SEQ ID NO: 4716180 - DNA, 20 bp, Homo sapiens
tagctatttaatactaattt

SEQ ID NO: 4716181 - DNA, 16 bp, Homo sapiens
tagctatttctatgta

SEQ ID NO: 4716182 - DNA, 13 bp, Homo sapiens
tagctcccctcct

SEQ ID NO: 4716183 - DNA, 14 bp, Homo sapiens
tagctcccctcctc

SEQ ID NO: 4716184 - DNA, 19 bp, Homo sapiens
tagctgggactacaggcac

SEQ ID NO: 4716185 - DNA, 20 bp, Homo sapiens
tagctgggactacaggcacc

SEQ ID NO: 4716186 - DNA, 22 bp, Homo sapiens
tagctgggagaaagagagagct

SEQ ID NO: 4716187 - DNA, 22 bp, Homo sapiens
tagctggttaaccttgaagtga

SEQ ID NO: 4716188 - DNA, 20 bp, Homo sapiens
tagctggttggagagctaga

SEQ ID NO: 4716189 - DNA, 19 bp, Homo sapiens
tagcttagagcctccctca

SEQ ID NO: 4716190 - DNA, 14 bp, Homo sapiens
tagctttttaattg

SEQ ID NO: 4716191 - DNA, 14 bp, Homo sapiens
taggaacactcctt

SEQ ID NO: 4716192 - DNA, 16 bp, Homo sapiens
taggaagactttggaa

SEQ ID NO: 4716193 - DNA, 14 bp, Homo sapiens
taggactgtagaaa

SEQ ID NO: 4716194 - DNA, 12 bp, Homo sapiens
taggatttattg

SEQ ID NO: 4716195 - DNA, 18 bp, Homo sapiens
taggcaggaacatacaga

SEQ ID NO: 4716196 - DNA, 14 bp, Homo sapiens
taggcctggcacag

SEQ ID NO: 4716197 - DNA, 14 bp, Homo sapiens
taggcctggccaga

SEQ ID NO: 4716198 - DNA, 15 bp, Homo sapiens
taggcctggccagat

SEQ ID NO: 4716199 - DNA, 18 bp, Homo sapiens
tagggaaaacattccatc

SEQ ID NO: 4716200 - DNA, 20 bp, Homo sapiens
tagggaagggtggtggagcc

SEQ ID NO: 4716201 - DNA, 14 bp, Homo sapiens
tagggacccctcct

SEQ ID NO: 4716202 - DNA, 16 bp, Homo sapiens
tagggacccctcctcc

SEQ ID NO: 4716203 - DNA, 17 bp, Homo sapiens
tagggatccctcatctg

SEQ ID NO: 4716204 - DNA, 19 bp, Homo sapiens
tagggatggggctgtgggg

SEQ ID NO: 4716205 - DNA, 13 bp, Homo sapiens
tagggcctgactc

SEQ ID NO: 4716206 - DNA, 15 bp, Homo sapiens
tagggggctggagga

SEQ ID NO: 4716207 - DNA, 18 bp, Homo sapiens
tagggggctggaggagcc

SEQ ID NO: 4716208 - DNA, 18 bp, Homo sapiens
taggggttgaagaaaaca

SEQ ID NO: 4716209 - DNA, 16 bp, Homo sapiens
tagggtccttgaaaca

SEQ ID NO: 4716210 - DNA, 15 bp, Homo sapiens
tagggtgtgtgttca

SEQ ID NO: 4716211 - DNA, 16 bp, Homo sapiens
taggtcagtgcaaata

SEQ ID NO: 4716212 - DNA, 14 bp, Homo sapiens
taggtctcttcccc

SEQ ID NO: 4716213 - DNA, 11 bp, Homo sapiens
taggtgacaga

SEQ ID NO: 4716214 - DNA, 21 bp, Homo sapiens
taggtgatccactcgccttca

SEQ ID NO: 4716215 - DNA, 16 bp, Homo sapiens
taggtggcaaggctgt

SEQ ID NO: 4716216 - DNA, 19 bp, Homo sapiens
tagtaaatatgtgaagaaa

SEQ ID NO: 4716217 - DNA, 14 bp, Homo sapiens
tagtaattctcagg

SEQ ID NO: 4716218 - DNA, 15 bp, Homo sapiens
tagtaattctcaggc

SEQ ID NO: 4716219 - DNA, 13 bp, Homo sapiens
tagtagagacggg

SEQ ID NO: 4716220 - DNA, 21 bp, Homo sapiens
tagtaggggttgaagaaaaca

SEQ ID NO: 4716221 - DNA, 14 bp, Homo sapiens
tagtatttaattgt

SEQ ID NO: 4716222 - DNA, 20 bp, Homo sapiens
tagtcactgagacagcccgg

SEQ ID NO: 4716223 - DNA, 12 bp, Homo sapiens
tagtcctgtact

SEQ ID NO: 4716224 - DNA, 21 bp, Homo sapiens
tagtgaaggcttctctctgtg

SEQ ID NO: 4716225 - DNA, 21 bp, Homo sapiens
tagtgaatcacgtaaagctag

SEQ ID NO: 4716226 - DNA, 14 bp, Homo sapiens
tagtgatcacagca

SEQ ID NO: 4716227 - DNA, 21 bp, Homo sapiens
tagtgattccatcaaagagaa

SEQ ID NO: 4716228 - DNA, 21 bp, Homo sapiens
tagtggagggttggagaagga

SEQ ID NO: 4716229 - DNA, 15 bp, Homo sapiens
tagtggtctttgtaa

SEQ ID NO: 4716230 - DNA, 16 bp, Homo sapiens
tagtggtctttgtaag

SEQ ID NO: 4716231 - DNA, 21 bp, Homo sapiens
tagtggtctttgtaagagtgt

SEQ ID NO: 4716232 - DNA, 14 bp, Homo sapiens
tagttacataatca

SEQ ID NO: 4716233 - DNA, 16 bp, Homo sapiens
tagttgaaaaaagaag

SEQ ID NO: 4716234 - DNA, 21 bp, Homo sapiens
tagttgtttgattcagacagc

SEQ ID NO: 4716235 - DNA, 14 bp, Homo sapiens
tataaacactatat

SEQ ID NO: 4716236 - DNA, 15 bp, Homo sapiens
tataaatatatttaa

SEQ ID NO: 4716237 - DNA, 16 bp, Homo sapiens
tataaattaatacaga

SEQ ID NO: 4716238 - DNA, 17 bp, Homo sapiens
tataaattttttttgtt

SEQ ID NO: 4716239 - DNA, 14 bp, Homo sapiens
tataagatttttga

SEQ ID NO: 4716240 - DNA, 12 bp, Homo sapiens
tataataaaaat

SEQ ID NO: 4716241 - DNA, 13 bp, Homo sapiens
tataataaaaata

SEQ ID NO: 4716242 - DNA, 21 bp, Homo sapiens
tataatttagtcccttaaaaa

SEQ ID NO: 4716243 - DNA, 16 bp, Homo sapiens
tataattttaaagtaa

SEQ ID NO: 4716244 - DNA, 12 bp, Homo sapiens
tatacatttgtt

SEQ ID NO: 4716245 - DNA, 13 bp, Homo sapiens
tatacatttgttg

SEQ ID NO: 4716246 - DNA, 20 bp, Homo sapiens
tatacgtttatataaatata

SEQ ID NO: 4716247 - DNA, 16 bp, Homo sapiens
tatagaattgcacata

SEQ ID NO: 4716248 - DNA, 16 bp, Homo sapiens
tatagcatgaaataaa

SEQ ID NO: 4716249 - DNA, 13 bp, Homo sapiens
tatagctagctat

SEQ ID NO: 4716250 - DNA, 22 bp, Homo sapiens
tatagctagctatttctatgta

SEQ ID NO: 4716251 - DNA, 19 bp, Homo sapiens
tatagctctacacaacatg

SEQ ID NO: 4716252 - DNA, 21 bp, Homo sapiens
tatagctctacacaacatgta

SEQ ID NO: 4716253 - DNA, 19 bp, Homo sapiens
tatagtaggggttgaagaa

SEQ ID NO: 4716254 - DNA, 20 bp, Homo sapiens
tatagtaggggttgaagaaa

SEQ ID NO: 4716255 - DNA, 18 bp, Homo sapiens
tatagtgatgtaatcttg

SEQ ID NO: 4716256 - DNA, 16 bp, Homo sapiens
tatagttgtctttctt

SEQ ID NO: 4716257 - DNA, 23 bp, Homo sapiens
tatataaattgagcttgcttctt

SEQ ID NO: 4716258 - DNA, 23 bp, Homo sapiens
tatataaattttttttgtttcat

SEQ ID NO: 4716259 - DNA, 15 bp, Homo sapiens
tatatacatatatat

SEQ ID NO: 4716260 - DNA, 14 bp, Homo sapiens
tatataggctattt

SEQ ID NO: 4716261 - DNA, 23 bp, Homo sapiens
tatataggctattttctaaagac

SEQ ID NO: 4716262 - DNA, 15 bp, Homo sapiens
tatatattttatgat

SEQ ID NO: 4716263 - DNA, 22 bp, Homo sapiens
tatatgggcttttacctgtgca

SEQ ID NO: 4716264 - DNA, 14 bp, Homo sapiens
tatatgttcttcat

SEQ ID NO: 4716265 - DNA, 15 bp, Homo sapiens
tatatgttcttcata

SEQ ID NO: 4716266 - DNA, 21 bp, Homo sapiens
tatattaatttcggttatagc

SEQ ID NO: 4716267 - DNA, 20 bp, Homo sapiens
tatattattccgtattacat

SEQ ID NO: 4716268 - DNA, 22 bp, Homo sapiens
tatatttggcccaaactcatct

SEQ ID NO: 4716269 - DNA, 13 bp, Homo sapiens
tatattttaaaaa

SEQ ID NO: 4716270 - DNA, 16 bp, Homo sapiens
tatattttttgaactt

SEQ ID NO: 4716271 - DNA, 14 bp, Homo sapiens
tatcaaaatagtct

SEQ ID NO: 4716272 - DNA, 12 bp, Homo sapiens
tatcaaagtcat

SEQ ID NO: 4716273 - DNA, 18 bp, Homo sapiens
tatcaaagtcattaaaga

SEQ ID NO: 4716274 - DNA, 15 bp, Homo sapiens
tatcaagtactacat

SEQ ID NO: 4716275 - DNA, 22 bp, Homo sapiens
tatcaccttccaaacaaaagca

SEQ ID NO: 4716276 - DNA, 20 bp, Homo sapiens
tatcagatgctcattgcttt

SEQ ID NO: 4716277 - DNA, 21 bp, Homo sapiens
tatcaggacccagaggaaggg

SEQ ID NO: 4716278 - DNA, 13 bp, Homo sapiens
tatcagtgtgccc

SEQ ID NO: 4716279 - DNA, 17 bp, Homo sapiens
tatcagtgtgcccccca

SEQ ID NO: 4716280 - DNA, 14 bp, Homo sapiens
tatcatactgattt

SEQ ID NO: 4716281 - DNA, 16 bp, Homo sapiens
tatcatttgtgaagaa

SEQ ID NO: 4716282 - DNA, 21 bp, Homo sapiens
tatccaggtaatccaagatat

SEQ ID NO: 4716283 - DNA, 16 bp, Homo sapiens
tatcccggctgccctt

SEQ ID NO: 4716284 - DNA, 18 bp, Homo sapiens
tatcccttggacatttta

SEQ ID NO: 4716285 - DNA, 13 bp, Homo sapiens
tatcctgttaaca

SEQ ID NO: 4716286 - DNA, 19 bp, Homo sapiens
tatcgaaataacaatgtta

SEQ ID NO: 4716287 - DNA, 20 bp, Homo sapiens
tatctattaaaattgccatt

SEQ ID NO: 4716288 - DNA, 16 bp, Homo sapiens
tatctcacttgtgcca

SEQ ID NO: 4716289 - DNA, 18 bp, Homo sapiens
tatctcagtcatgcataa

SEQ ID NO: 4716290 - DNA, 20 bp, Homo sapiens
tatctcctgtgatcctttga

SEQ ID NO: 4716291 - DNA, 16 bp, Homo sapiens
tatctgaaaatacatt

SEQ ID NO: 4716292 - DNA, 23 bp, Homo sapiens
tatctgcaatgtttttgtgtaga

SEQ ID NO: 4716293 - DNA, 17 bp, Homo sapiens
tatctgccatgtccata

SEQ ID NO: 4716294 - DNA, 16 bp, Homo sapiens
tatctggtatctgcat

SEQ ID NO: 4716295 - DNA, 23 bp, Homo sapiens
tatcttgatgttcagacatttat

SEQ ID NO: 4716296 - DNA, 16 bp, Homo sapiens
tatctttctaaaactg

SEQ ID NO: 4716297 - DNA, 15 bp, Homo sapiens
tatctttgaatatgt

SEQ ID NO: 4716298 - DNA, 17 bp, Homo sapiens
tatctttgattctcctt

SEQ ID NO: 4716299 - DNA, 19 bp, Homo sapiens
tatcttttgacctgtggtg

SEQ ID NO: 4716300 - DNA, 13 bp, Homo sapiens
tatctttttattc

SEQ ID NO: 4716301 - DNA, 20 bp, Homo sapiens
tatgaaaacaagttccaaat

SEQ ID NO: 4716302 - DNA, 14 bp, Homo sapiens
tatgaaaatggaaa

SEQ ID NO: 4716303 - DNA, 16 bp, Homo sapiens
tatgaagacagaggca

SEQ ID NO: 4716304 - DNA, 20 bp, Homo sapiens
tatgaaggatccatctttgt

SEQ ID NO: 4716305 - DNA, 16 bp, Homo sapiens
tatgacagatatattt

SEQ ID NO: 4716306 - DNA, 14 bp, Homo sapiens
tatgacattcatgc

SEQ ID NO: 4716307 - DNA, 20 bp, Homo sapiens
tatgacattcatgcctggct

SEQ ID NO: 4716308 - DNA, 16 bp, Homo sapiens
tatgaccttctaggaa

SEQ ID NO: 4716309 - DNA, 20 bp, Homo sapiens
tatgacttggacctcatttt

SEQ ID NO: 4716310 - DNA, 22 bp, Homo sapiens
tatgattcactatttaaactat

SEQ ID NO: 4716311 - DNA, 18 bp, Homo sapiens
tatgatttaataaaataa

SEQ ID NO: 4716312 - DNA, 14 bp, Homo sapiens
tatgatttcaacat

SEQ ID NO: 4716313 - DNA, 17 bp, Homo sapiens
tatgatttggaaaataa

SEQ ID NO: 4716314 - DNA, 13 bp, Homo sapiens
tatgcaagtggga

SEQ ID NO: 4716315 - DNA, 12 bp, Homo sapiens
tatgcacacttt

SEQ ID NO: 4716316 - DNA, 17 bp, Homo sapiens
tatgcacgaccttggga

SEQ ID NO: 4716317 - DNA, 19 bp, Homo sapiens
tatgcacttataattttcc

SEQ ID NO: 4716318 - DNA, 20 bp, Homo sapiens
tatgcacttataattttcct

SEQ ID NO: 4716319 - DNA, 18 bp, Homo sapiens
tatgcagaggtccacaac

SEQ ID NO: 4716320 - DNA, 18 bp, Homo sapiens
tatgcatgcccttccttt

SEQ ID NO: 4716321 - DNA, 13 bp, Homo sapiens
tatgcctgaatga

SEQ ID NO: 4716322 - DNA, 13 bp, Homo sapiens
tatgctttgaatg

SEQ ID NO: 4716323 - DNA, 23 bp, Homo sapiens
tatggaaacactgattttgtaaa

SEQ ID NO: 4716324 - DNA, 14 bp, Homo sapiens
tatggaatgcttct

SEQ ID NO: 4716325 - DNA, 21 bp, Homo sapiens
tatggacatcgatatgaaaaa

SEQ ID NO: 4716326 - DNA, 17 bp, Homo sapiens
tatggagctcagagagg

SEQ ID NO: 4716327 - DNA, 23 bp, Homo sapiens
tatggatatgtgtaaatgttatg

SEQ ID NO: 4716328 - DNA, 13 bp, Homo sapiens
tatggcagaagac

SEQ ID NO: 4716329 - DNA, 15 bp, Homo sapiens
tatggcagaagacac

SEQ ID NO: 4716330 - DNA, 22 bp, Homo sapiens
tatggcagaagacaccagagca

SEQ ID NO: 4716331 - DNA, 16 bp, Homo sapiens
tatggcagtgtctttc

SEQ ID NO: 4716332 - DNA, 12 bp, Homo sapiens
tatggcatctca

SEQ ID NO: 4716333 - DNA, 21 bp, Homo sapiens
tatggccaatctattctcaaa

SEQ ID NO: 4716334 - DNA, 23 bp, Homo sapiens
tatgggactcaatgcactgacat

SEQ ID NO: 4716335 - DNA, 15 bp, Homo sapiens
tatgtaaatagattt

SEQ ID NO: 4716336 - DNA, 12 bp, Homo sapiens
tatgtaacatgt

SEQ ID NO: 4716337 - DNA, 14 bp, Homo sapiens
tatgtatatcttct

SEQ ID NO: 4716338 - DNA, 17 bp, Homo sapiens
tatgtatatcttctaca

SEQ ID NO: 4716339 - DNA, 14 bp, Homo sapiens
tatgtatcttgatg

SEQ ID NO: 4716340 - DNA, 19 bp, Homo sapiens
tatgtatgtgccaattttg

SEQ ID NO: 4716341 - DNA, 20 bp, Homo sapiens
tatgtatgtgccaattttgt

SEQ ID NO: 4716342 - DNA, 16 bp, Homo sapiens
tatgtctagaaagtaa

SEQ ID NO: 4716343 - DNA, 21 bp, Homo sapiens
tatgtctcgtggtaggactgt

SEQ ID NO: 4716344 - DNA, 12 bp, Homo sapiens
tatgtgaagaaa

SEQ ID NO: 4716345 - DNA, 17 bp, Homo sapiens
tatgtgccaattttgtc

SEQ ID NO: 4716346 - DNA, 17 bp, Homo sapiens
tatgtggatacagtcat

SEQ ID NO: 4716347 - DNA, 22 bp, Homo sapiens
tatgtgttgataattttttaat

SEQ ID NO: 4716348 - DNA, 13 bp, Homo sapiens
tatgttaatattt

SEQ ID NO: 4716349 - DNA, 16 bp, Homo sapiens
tatgttaatatttctg

SEQ ID NO: 4716350 - DNA, 16 bp, Homo sapiens
tatgttgcccaggcag

SEQ ID NO: 4716351 - DNA, 21 bp, Homo sapiens
tatgttgcccaggcaggtctt

SEQ ID NO: 4716352 - DNA, 18 bp, Homo sapiens
tatgttggtagattctaa

SEQ ID NO: 4716353 - DNA, 19 bp, Homo sapiens
tatgtttggaatattccac

SEQ ID NO: 4716354 - DNA, 17 bp, Homo sapiens
tatgttttaagaggcag

SEQ ID NO: 4716355 - DNA, 19 bp, Homo sapiens
tatgttttaagaggcaggg

SEQ ID NO: 4716356 - DNA, 15 bp, Homo sapiens
tatgttttataattc

SEQ ID NO: 4716357 - DNA, 17 bp, Homo sapiens
tattaaaaaagagacat

SEQ ID NO: 4716358 - DNA, 23 bp, Homo sapiens
tattaaaaaagagacatccaaat

SEQ ID NO: 4716359 - DNA, 14 bp, Homo sapiens
tattaaaagactca

SEQ ID NO: 4716360 - DNA, 16 bp, Homo sapiens
tattaaaagactcatc

SEQ ID NO: 4716361 - DNA, 19 bp, Homo sapiens
tattaaaattgccatttta

SEQ ID NO: 4716362 - DNA, 16 bp, Homo sapiens
tattaaacattttcat

SEQ ID NO: 4716363 - DNA, 15 bp, Homo sapiens
tattaaatcagttct

SEQ ID NO: 4716364 - DNA, 15 bp, Homo sapiens
tattaaatgcccagc

SEQ ID NO: 4716365 - DNA, 21 bp, Homo sapiens
tattaaattaaattttgtgtc

SEQ ID NO: 4716366 - DNA, 16 bp, Homo sapiens
tattaaattgtgtaca

SEQ ID NO: 4716367 - DNA, 22 bp, Homo sapiens
tattaaattgtgtacactttca

SEQ ID NO: 4716368 - DNA, 18 bp, Homo sapiens
tattaagaatagtctctg

SEQ ID NO: 4716369 - DNA, 21 bp, Homo sapiens
tattaagaatagtctctgggt

SEQ ID NO: 4716370 - DNA, 15 bp, Homo sapiens
tattaagttgttaat

SEQ ID NO: 4716371 - DNA, 17 bp, Homo sapiens
tattaatagctgcctta

SEQ ID NO: 4716372 - DNA, 20 bp, Homo sapiens
tattaattttccaatgcaca

SEQ ID NO: 4716373 - DNA, 18 bp, Homo sapiens
tattagagtgtctttcca

SEQ ID NO: 4716374 - DNA, 19 bp, Homo sapiens
tattagccagtcattgtaa

SEQ ID NO: 4716375 - DNA, 14 bp, Homo sapiens
tattatatcttgta

SEQ ID NO: 4716376 - DNA, 17 bp, Homo sapiens
tattatatttacaaatg

SEQ ID NO: 4716377 - DNA, 17 bp, Homo sapiens
tattattcatcttttca

SEQ ID NO: 4716378 - DNA, 17 bp, Homo sapiens
tattcaccttttcttca

SEQ ID NO: 4716379 - DNA, 19 bp, Homo sapiens
tattcaccttttcttcaaa

SEQ ID NO: 4716380 - DNA, 13 bp, Homo sapiens
tattcagaacttt

SEQ ID NO: 4716381 - DNA, 17 bp, Homo sapiens
tattcaggaaaagcctc

SEQ ID NO: 4716382 - DNA, 23 bp, Homo sapiens
tattcaggaagataaaaatcagt

SEQ ID NO: 4716383 - DNA, 18 bp, Homo sapiens
tattcaggaagctcaggg

SEQ ID NO: 4716384 - DNA, 22 bp, Homo sapiens
tattcaggaagctcagggcctg

SEQ ID NO: 4716385 - DNA, 15 bp, Homo sapiens
tattcataaagagaa

SEQ ID NO: 4716386 - DNA, 19 bp, Homo sapiens
tattcatacgtaaaatttt

SEQ ID NO: 4716387 - DNA, 15 bp, Homo sapiens
tattcatctcaagga

SEQ ID NO: 4716388 - DNA, 13 bp, Homo sapiens
tattcatgttttg

SEQ ID NO: 4716389 - DNA, 14 bp, Homo sapiens
tattccatttgtat

SEQ ID NO: 4716390 - DNA, 21 bp, Homo sapiens
tattccctagaaacttccaaa

SEQ ID NO: 4716391 - DNA, 17 bp, Homo sapiens
tattcgaaatgagctca

SEQ ID NO: 4716392 - DNA, 18 bp, Homo sapiens
tattctctgagctgtgca

SEQ ID NO: 4716393 - DNA, 21 bp, Homo sapiens
taccttttaagacattttcat

SEQ ID NO: 4716394 - DNA, 14 bp, Homo sapiens
tacgaatacttttg

SEQ ID NO: 4716395 - DNA, 14 bp, Homo sapiens
tacgacaacttgca

SEQ ID NO: 4716396 - DNA, 15 bp, Homo sapiens
tacgacaacttgcac

SEQ ID NO: 4716397 - DNA, 15 bp, Homo sapiens
tacgttaaaagcaaa

SEQ ID NO: 4716398 - DNA, 18 bp, Homo sapiens
tactaaaaaaaagatgaa

SEQ ID NO: 4716399 - DNA, 21 bp, Homo sapiens
tactaaaaagtataaaatagt

SEQ ID NO: 4716400 - DNA, 23 bp, Homo sapiens
tactaacaatcagctccttcctg

SEQ ID NO: 4716401 - DNA, 22 bp, Homo sapiens
tactaattttccataagctatt

SEQ ID NO: 4716402 - DNA, 17 bp, Homo sapiens
tactacagtcctcccat

SEQ ID NO: 4716403 - DNA, 12 bp, Homo sapiens
tactacatctgt

SEQ ID NO: 4716404 - DNA, 14 bp, Homo sapiens
tactcaaccctctc

SEQ ID NO: 4716405 - DNA, 22 bp, Homo sapiens
tactccaaggtttataaagcag

SEQ ID NO: 4716406 - DNA, 16 bp, Homo sapiens
tactcccatctgtgaa

SEQ ID NO: 4716407 - DNA, 17 bp, Homo sapiens
tactcccatctgtgaaa

SEQ ID NO: 4716408 - DNA, 13 bp, Homo sapiens
tactctactgata

SEQ ID NO: 4716409 - DNA, 11 bp, Homo sapiens
tactctgtgta

SEQ ID NO: 4716410 - DNA, 17 bp, Homo sapiens
tactgaaaaaggtgatt

SEQ ID NO: 4716411 - DNA, 12 bp, Homo sapiens
tactgcccaagg

SEQ ID NO: 4716412 - DNA, 17 bp, Homo sapiens
tactgcttttcattagc

SEQ ID NO: 4716413 - DNA, 23 bp, Homo sapiens
tactgtattttgtattgtttcaa

SEQ ID NO: 4716414 - DNA, 14 bp, Homo sapiens
tactgtctgtagtg

SEQ ID NO: 4716415 - DNA, 15 bp, Homo sapiens
tactgtgctggagcc

SEQ ID NO: 4716416 - DNA, 16 bp, Homo sapiens
tactgtggaggaagga

SEQ ID NO: 4716417 - DNA, 22 bp, Homo sapiens
tactgtggaggaaggattgtaa

SEQ ID NO: 4716418 - DNA, 23 bp, Homo sapiens
tactgtggaggaaggattgtaaa

SEQ ID NO: 4716419 - DNA, 16 bp, Homo sapiens
tactgttgctttggga

SEQ ID NO: 4716420 - DNA, 21 bp, Homo sapiens
tacttaaatttggtttgttaa

SEQ ID NO: 4716421 - DNA, 17 bp, Homo sapiens
tacttacatatctgact

SEQ ID NO: 4716422 - DNA, 18 bp, Homo sapiens
tacttccccttcctaatt

SEQ ID NO: 4716423 - DNA, 13 bp, Homo sapiens
tacttctccaccc

SEQ ID NO: 4716424 - DNA, 20 bp, Homo sapiens
tacttctccaccctgctctc

SEQ ID NO: 4716425 - DNA, 17 bp, Homo sapiens
tacttctgtaattgtgt

SEQ ID NO: 4716426 - DNA, 18 bp, Homo sapiens
tacttcttattcactttt

SEQ ID NO: 4716427 - DNA, 14 bp, Homo sapiens
tacttgcagtacat

SEQ ID NO: 4716428 - DNA, 17 bp, Homo sapiens
tacttgcctatctgact

SEQ ID NO: 4716429 - DNA, 19 bp, Homo sapiens
tacttgggccatagctcct

SEQ ID NO: 4716430 - DNA, 15 bp, Homo sapiens
tacttgtggacacag

SEQ ID NO: 4716431 - DNA, 19 bp, Homo sapiens
tacttgtggacacagctct

SEQ ID NO: 4716432 - DNA, 17 bp, Homo sapiens
tacttgttgtttaatgt

SEQ ID NO: 4716433 - DNA, 19 bp, Homo sapiens
tactttaccacccccacac

SEQ ID NO: 4716434 - DNA, 16 bp, Homo sapiens
tactttccatttggta

SEQ ID NO: 4716435 - DNA, 21 bp, Homo sapiens
tactttcgaaatttcattttc

SEQ ID NO: 4716436 - DNA, 17 bp, Homo sapiens
tactttggaattcttag

SEQ ID NO: 4716437 - DNA, 20 bp, Homo sapiens
tactttggggctaatttaac

SEQ ID NO: 4716438 - DNA, 13 bp, Homo sapiens
tactttgtgcaaa

SEQ ID NO: 4716439 - DNA, 13 bp, Homo sapiens
tactttgtttatt

SEQ ID NO: 4716440 - DNA, 21 bp, Homo sapiens
tactttttaaacagtgtttat

SEQ ID NO: 4716441 - DNA, 15 bp, Homo sapiens
tagaaatacactttt

SEQ ID NO: 4716442 - DNA, 23 bp, Homo sapiens
tagaaatacacttttttccaaag

SEQ ID NO: 4716443 - DNA, 21 bp, Homo sapiens
tagaaatagctccgtggagca

SEQ ID NO: 4716444 - DNA, 22 bp, Homo sapiens
tagaaatagctccgtggagcag

SEQ ID NO: 4716445 - DNA, 13 bp, Homo sapiens
tagaaatcaactt

SEQ ID NO: 4716446 - DNA, 23 bp, Homo sapiens
tagaacaatgtacaaggtatgta

SEQ ID NO: 4716447 - DNA, 17 bp, Homo sapiens
tagaaccaagaagggct

SEQ ID NO: 4716448 - DNA, 23 bp, Homo sapiens
tagaaccaagaagggctagaacc

SEQ ID NO: 4716449 - DNA, 12 bp, Homo sapiens
tagaaccaggca

SEQ ID NO: 4716450 - DNA, 23 bp, Homo sapiens
tagaaccaggcaacttgggaact

SEQ ID NO: 4716451 - DNA, 14 bp, Homo sapiens
tagaacctagaagg

SEQ ID NO: 4716452 - DNA, 23 bp, Homo sapiens
tagaacctagagaagctaaaacc

SEQ ID NO: 4716453 - DNA, 17 bp, Homo sapiens
tagaacctggaagggct

SEQ ID NO: 4716454 - DNA, 18 bp, Homo sapiens
tagaagatggcacttata

SEQ ID NO: 4716455 - DNA, 21 bp, Homo sapiens
tagaagcattccttctttgat

SEQ ID NO: 4716456 - DNA, 14 bp, Homo sapiens
tagaagctggagga

SEQ ID NO: 4716457 - DNA, 20 bp, Homo sapiens
tagaaggaggttctaatatt

SEQ ID NO: 4716458 - DNA, 22 bp, Homo sapiens
tagaagggctagaacctggaga

SEQ ID NO: 4716459 - DNA, 15 bp, Homo sapiens
tagaagtcacacagt

SEQ ID NO: 4716460 - DNA, 15 bp, Homo sapiens
tagaatatatttcct

SEQ ID NO: 4716461 - DNA, 12 bp, Homo sapiens
tagaatctggag

SEQ ID NO: 4716462 - DNA, 12 bp, Homo sapiens
tagacagtccct

SEQ ID NO: 4716463 - DNA, 14 bp, Homo sapiens
tagacagtccctgc

SEQ ID NO: 4716464 - DNA, 16 bp, Homo sapiens
tagagagagaccactt

SEQ ID NO: 4716465 - DNA, 20 bp, Homo sapiens
tagagatatttaaaagacaa

SEQ ID NO: 4716466 - DNA, 22 bp, Homo sapiens
tagagatatttaaaagacaaac

SEQ ID NO: 4716467 - DNA, 14 bp, Homo sapiens
tagagccagggtct

SEQ ID NO: 4716468 - DNA, 13 bp, Homo sapiens
tagaggccaggga

SEQ ID NO: 4716469 - DNA, 12 bp, Homo sapiens
tagagtaatgaa

SEQ ID NO: 4716470 - DNA, 16 bp, Homo sapiens
tagagtcaatttgctg

SEQ ID NO: 4716471 - DNA, 18 bp, Homo sapiens
tagagtcaatttgctgaa

SEQ ID NO: 4716472 - DNA, 19 bp, Homo sapiens
tagagtggcgattgaatgc

SEQ ID NO: 4716473 - DNA, 16 bp, Homo sapiens
tagagttaagaagctg

SEQ ID NO: 4716474 - DNA, 18 bp, Homo sapiens
tagataatcttttacatt

SEQ ID NO: 4716475 - DNA, 22 bp, Homo sapiens
tagataggtcagtgcaaatact

SEQ ID NO: 4716476 - DNA, 15 bp, Homo sapiens
tagatatgaaagctg

SEQ ID NO: 4716477 - DNA, 14 bp, Homo sapiens
tagatcactgtgct

SEQ ID NO: 4716478 - DNA, 17 bp, Homo sapiens
tagatggaaaaatgtga

SEQ ID NO: 4716479 - DNA, 17 bp, Homo sapiens
tagattaggattaaaat

SEQ ID NO: 4716480 - DNA, 13 bp, Homo sapiens
tagattatttctg

SEQ ID NO: 4716481 - DNA, 17 bp, Homo sapiens
tagattatttctgtatt

SEQ ID NO: 4716482 - DNA, 18 bp, Homo sapiens
tagattcaagttgtgtct

SEQ ID NO: 4716483 - DNA, 15 bp, Homo sapiens
tagattttctgtaaa

SEQ ID NO: 4716484 - DNA, 17 bp, Homo sapiens
tagcaaccctgtgatac

SEQ ID NO: 4716485 - DNA, 14 bp, Homo sapiens
tagcaatgctgtga

SEQ ID NO: 4716486 - DNA, 17 bp, Homo sapiens
tagcaatgctgtgaata

SEQ ID NO: 4716487 - DNA, 15 bp, Homo sapiens
tagcacagaccctgc

SEQ ID NO: 4716488 - DNA, 17 bp, Homo sapiens
tagcacagaccctgccc

SEQ ID NO: 4716489 - DNA, 21 bp, Homo sapiens
tagcacagaccctgccctgtg

SEQ ID NO: 4716490 - DNA, 16 bp, Homo sapiens
tagcaccagggaaggg

SEQ ID NO: 4716491 - DNA, 21 bp, Homo sapiens
tagcactgcacactcagttct

SEQ ID NO: 4716492 - DNA, 23 bp, Homo sapiens
tagcagaaggttgcacctccccc

SEQ ID NO: 4716493 - DNA, 23 bp, Homo sapiens
tagcagagaatgaaagggcccag

SEQ ID NO: 4716494 - DNA, 18 bp, Homo sapiens
tagcagtcgcgagcacat

SEQ ID NO: 4716495 - DNA, 23 bp, Homo sapiens
tagcagtcgcgagcacatgttca

SEQ ID NO: 4716496 - DNA, 13 bp, Homo sapiens
tagcagtgattca

SEQ ID NO: 4716497 - DNA, 20 bp, Homo sapiens
tagcagttgctcacatgtct

SEQ ID NO: 4716498 - DNA, 21 bp, Homo sapiens
tagcagttgctcacatgtctt

SEQ ID NO: 4716499 - DNA, 21 bp, Homo sapiens
tagcataattttgtgttgtac

SEQ ID NO: 4716500 - DNA, 18 bp, Homo sapiens
tagcatgtcgtcaaagct

SEQ ID NO: 4716501 - DNA, 17 bp, Homo sapiens
tagccagtcattgtaac

SEQ ID NO: 4716502 - DNA, 12 bp, Homo sapiens
tagccataattc

SEQ ID NO: 4716503 - DNA, 14 bp, Homo sapiens
tagccatgggacca

SEQ ID NO: 4716504 - DNA, 17 bp, Homo sapiens
ggggctggaggagccca

SEQ ID NO: 4716505 - DNA, 23 bp, Homo sapiens
ggggctggaggagcccaggccag

SEQ ID NO: 4716506 - DNA, 13 bp, Homo sapiens
ggggctgggacat

SEQ ID NO: 4716507 - DNA, 10 bp, Homo sapiens
ggggctgggt

SEQ ID NO: 4716508 - DNA, 13 bp, Homo sapiens
ggggctgggttgg

SEQ ID NO: 4716509 - DNA, 19 bp, Homo sapiens
ggggctgggttggcgcacc

SEQ ID NO: 4716510 - DNA, 22 bp, Homo sapiens
gggggaggtgggatcctccagg

SEQ ID NO: 4716511 - DNA, 12 bp, Homo sapiens
gggggcagaagt

SEQ ID NO: 4716512 - DNA, 12 bp, Homo sapiens
gggggcctcagt

SEQ ID NO: 4716513 - DNA, 15 bp, Homo sapiens
gggggcctcagtgcc

SEQ ID NO: 4716514 - DNA, 18 bp, Homo sapiens
gggggcctcagtgccact

SEQ ID NO: 4716515 - DNA, 12 bp, Homo sapiens
gggggctctgca

SEQ ID NO: 4716516 - DNA, 11 bp, Homo sapiens
gggggctggga

SEQ ID NO: 4716517 - DNA, 13 bp, Homo sapiens
gggggtggcctcc

SEQ ID NO: 4716518 - DNA, 22 bp, Homo sapiens
ggggtcactctggcagctcaga

SEQ ID NO: 4716519 - DNA, 15 bp, Homo sapiens
ggggtcatccttgcc

SEQ ID NO: 4716520 - DNA, 23 bp, Homo sapiens
ggggtcctcctccagggacagca

SEQ ID NO: 4716521 - DNA, 13 bp, Homo sapiens
ggggtggccgtcc

SEQ ID NO: 4716522 - DNA, 15 bp, Homo sapiens
gggtacccactgctc

SEQ ID NO: 4716523 - DNA, 17 bp, Homo sapiens
gggtcccacttcccctc

SEQ ID NO: 4716524 - DNA, 16 bp, Homo sapiens
gggtcctcctccaggg

SEQ ID NO: 4716525 - DNA, 18 bp, Homo sapiens
gggtcctcctccagggac

SEQ ID NO: 4716526 - DNA, 18 bp, Homo sapiens
gggtcgggagaggggacg

SEQ ID NO: 4716527 - DNA, 12 bp, Homo sapiens
gggtctcactct

SEQ ID NO: 4716528 - DNA, 12 bp, Homo sapiens
gggtctgaggaa

SEQ ID NO: 4716529 - DNA, 19 bp, Homo sapiens
gggtgcgaccccatctgcc

SEQ ID NO: 4716530 - DNA, 22 bp, Homo sapiens
gggtgcgaccccatctgcccag

SEQ ID NO: 4716531 - DNA, 13 bp, Homo sapiens
gggtggagtccca

SEQ ID NO: 4716532 - DNA, 13 bp, Homo sapiens
gggtggatgcctg

SEQ ID NO: 4716533 - DNA, 14 bp, Homo sapiens
gggtggcactgcca

SEQ ID NO: 4716534 - DNA, 11 bp, Homo sapiens
gggtggcccat

SEQ ID NO: 4716535 - DNA, 13 bp, Homo sapiens
gggtggcccatcc

SEQ ID NO: 4716536 - DNA, 18 bp, Homo sapiens
gggtggcccatcccccct

SEQ ID NO: 4716537 - DNA, 15 bp, Homo sapiens
gggtgggacaccctg

SEQ ID NO: 4716538 - DNA, 13 bp, Homo sapiens
gggtggtttttat

SEQ ID NO: 4716539 - DNA, 14 bp, Homo sapiens
gggttatgaatatt

SEQ ID NO: 4716540 - DNA, 17 bp, Homo sapiens
gggttctacccaggtgc

SEQ ID NO: 4716541 - DNA, 16 bp, Homo sapiens
gggttctcaattctgt

SEQ ID NO: 4716542 - DNA, 17 bp, Homo sapiens
gggttggagaaggaggt

SEQ ID NO: 4716543 - DNA, 19 bp, Homo sapiens
gggttggcccctgcccggc

SEQ ID NO: 4716544 - DNA, 14 bp, Homo sapiens
ggtaaaggatgagg

SEQ ID NO: 4716545 - DNA, 14 bp, Homo sapiens
ggtaacagaacagc

SEQ ID NO: 4716546 - DNA, 18 bp, Homo sapiens
ggtaacagaacagcttca

SEQ ID NO: 4716547 - DNA, 20 bp, Homo sapiens
ggtaaggaatacctgtcccc

SEQ ID NO: 4716548 - DNA, 20 bp, Homo sapiens
ggtaatacttccagaagtgc

SEQ ID NO: 4716549 - DNA, 17 bp, Homo sapiens
ggtaatcgacctgcctc

SEQ ID NO: 4716550 - DNA, 23 bp, Homo sapiens
ggtacaacctgttctgctttcct

SEQ ID NO: 4716551 - DNA, 24 bp, Homo sapiens
ggtacaacctgttctgctttcctc

SEQ ID NO: 4716552 - DNA, 11 bp, Homo sapiens
ggtacccactg

SEQ ID NO: 4716553 - DNA, 13 bp, Homo sapiens
ggtacccactgct

SEQ ID NO: 4716554 - DNA, 16 bp, Homo sapiens
ggtacccactgctctg

SEQ ID NO: 4716555 - DNA, 17 bp, Homo sapiens
ggtacccactgctctgg

SEQ ID NO: 4716556 - DNA, 19 bp, Homo sapiens
ggtactggggtgggatctt

SEQ ID NO: 4716557 - DNA, 14 bp, Homo sapiens
ggtactgttgcttt

SEQ ID NO: 4716558 - DNA, 21 bp, Homo sapiens
ggtacttgtggacacagctct

SEQ ID NO: 4716559 - DNA, 22 bp, Homo sapiens
ggtacttgtggacacagctctt

SEQ ID NO: 4716560 - DNA, 18 bp, Homo sapiens
ggtataagtggtgtgtgt

SEQ ID NO: 4716561 - DNA, 21 bp, Homo sapiens
ggtatctgcatgtaaaatctt

SEQ ID NO: 4716562 - DNA, 21 bp, Homo sapiens
ggtatgaccttctaggaagct

SEQ ID NO: 4716563 - DNA, 11 bp, Homo sapiens
ggtatgtacag

SEQ ID NO: 4716564 - DNA, 14 bp, Homo sapiens
ggtattcctgcctc

SEQ ID NO: 4716565 - DNA, 12 bp, Homo sapiens
ggtcactctggc

SEQ ID NO: 4716566 - DNA, 24 bp, Homo sapiens
ggtcagtgtccaaagcagggtctg

SEQ ID NO: 4716567 - DNA, 20 bp, Homo sapiens
ggtccacaggaagtgaagaa

SEQ ID NO: 4716568 - DNA, 16 bp, Homo sapiens
ggtccacccaggagcc

SEQ ID NO: 4716569 - DNA, 22 bp, Homo sapiens
ggtccacccaggagccccgagg

SEQ ID NO: 4716570 - DNA, 15 bp, Homo sapiens
ggtccatagagagca

SEQ ID NO: 4716571 - DNA, 13 bp, Homo sapiens
ggtccatgggcag

SEQ ID NO: 4716572 - DNA, 15 bp, Homo sapiens
ggtcccaccccacac

SEQ ID NO: 4716573 - DNA, 12 bp, Homo sapiens
ggtcccacttcc

SEQ ID NO: 4716574 - DNA, 13 bp, Homo sapiens
ggtcccccttcca

SEQ ID NO: 4716575 - DNA, 22 bp, Homo sapiens
ggtccctgataacaacctggag

SEQ ID NO: 4716576 - DNA, 22 bp, Homo sapiens
ggtcctagcactgcacactcag

SEQ ID NO: 4716577 - DNA, 18 bp, Homo sapiens
ggtcctcctccagggaca

SEQ ID NO: 4716578 - DNA, 11 bp, Homo sapiens
ggtcctgctgc

SEQ ID NO: 4716579 - DNA, 12 bp, Homo sapiens
ggtcctgctgca

SEQ ID NO: 4716580 - DNA, 17 bp, Homo sapiens
ggtctacactgtgctga

SEQ ID NO: 4716581 - DNA, 22 bp, Homo sapiens
ggtctcactctgtcgcccagtc

SEQ ID NO: 4716582 - DNA, 23 bp, Homo sapiens
ggtctcactctgtcgcccagtct

SEQ ID NO: 4716583 - DNA, 14 bp, Homo sapiens
ggtctcctccaccg

SEQ ID NO: 4716584 - DNA, 22 bp, Homo sapiens
ggtctcctccaccgccatggct

SEQ ID NO: 4716585 - DNA, 20 bp, Homo sapiens
ggtctcgaactcctgacctt

SEQ ID NO: 4716586 - DNA, 19 bp, Homo sapiens
ggtctcgctgatgctgggc

SEQ ID NO: 4716587 - DNA, 22 bp, Homo sapiens
ggtctcgctgatgctgggctgg

SEQ ID NO: 4716588 - DNA, 15 bp, Homo sapiens
ggtctctaggctggg

SEQ ID NO: 4716589 - DNA, 16 bp, Homo sapiens
ggtctctaggctgggg

SEQ ID NO: 4716590 - DNA, 18 bp, Homo sapiens
ggtctctaggctggggaa

SEQ ID NO: 4716591 - DNA, 13 bp, Homo sapiens
ggtctctgctgcc

SEQ ID NO: 4716592 - DNA, 14 bp, Homo sapiens
ggtctctgctgccg

SEQ ID NO: 4716593 - DNA, 14 bp, Homo sapiens
ggtctgacccactg

SEQ ID NO: 4716594 - DNA, 13 bp, Homo sapiens
ggtctgtttaaat

SEQ ID NO: 4716595 - DNA, 12 bp, Homo sapiens
ggtctgtttgca

SEQ ID NO: 4716596 - DNA, 22 bp, Homo sapiens
ggtcttgaactcctggcctcaa

SEQ ID NO: 4716597 - DNA, 12 bp, Homo sapiens
ggtctttgtaag

SEQ ID NO: 4716598 - DNA, 15 bp, Homo sapiens
ggtctttgtaagagt

SEQ ID NO: 4716599 - DNA, 20 bp, Homo sapiens
ggtctttgtaagagtgtaga

SEQ ID NO: 4716600 - DNA, 22 bp, Homo sapiens
ggtcttttacatacagtgatat

SEQ ID NO: 4716601 - DNA, 23 bp, Homo sapiens
ggtgaagtgaaaaacagaaaaat

SEQ ID NO: 4716602 - DNA, 14 bp, Homo sapiens
ggtgacatgtgaaa

SEQ ID NO: 4716603 - DNA, 21 bp, Homo sapiens
ggtgaccccttttcagcttct

SEQ ID NO: 4716604 - DNA, 14 bp, Homo sapiens
ggtgacctctgcct

SEQ ID NO: 4716605 - DNA, 19 bp, Homo sapiens
ggtgcaattaactctggac

SEQ ID NO: 4716606 - DNA, 16 bp, Homo sapiens
ggtgcctgagcccctc

SEQ ID NO: 4716607 - DNA, 17 bp, Homo sapiens
ggtgcctgagcccctca

SEQ ID NO: 4716608 - DNA, 18 bp, Homo sapiens
ggtgcgagtgcgtgaata

SEQ ID NO: 4716609 - DNA, 15 bp, Homo sapiens
ggtgcgatctgggtt

SEQ ID NO: 4716610 - DNA, 17 bp, Homo sapiens
ggtgctatctcccccag

SEQ ID NO: 4716611 - DNA, 15 bp, Homo sapiens
ggtggaacaagcaca

SEQ ID NO: 4716612 - DNA, 21 bp, Homo sapiens
ggtggagccagtaaacagagg

SEQ ID NO: 4716613 - DNA, 16 bp, Homo sapiens
ggtggatcacaaggtc

SEQ ID NO: 4716614 - DNA, 13 bp, Homo sapiens
ggtggatgcctgg

SEQ ID NO: 4716615 - DNA, 13 bp, Homo sapiens
ggtggatggtgac

SEQ ID NO: 4716616 - DNA, 22 bp, Homo sapiens
ggtggatggtgacttttgaaga

SEQ ID NO: 4716617 - DNA, 21 bp, Homo sapiens
taaaatttgccctcccatccc

SEQ ID NO: 4716618 - DNA, 19 bp, Homo sapiens
taaacaaatgtatgattac

SEQ ID NO: 4716619 - DNA, 18 bp, Homo sapiens
taaacaatataagaagga

SEQ ID NO: 4716620 - DNA, 20 bp, Homo sapiens
taaacaatataagaaggaaa

SEQ ID NO: 4716621 - DNA, 21 bp, Homo sapiens
taaacaatataagaaggaaaa

SEQ ID NO: 4716622 - DNA, 21 bp, Homo sapiens
taaacagaaatgctctgatta

SEQ ID NO: 4716623 - DNA, 15 bp, Homo sapiens
taaacataataaatc

SEQ ID NO: 4716624 - DNA, 16 bp, Homo sapiens
taaacataataaatca

SEQ ID NO: 4716625 - DNA, 23 bp, Homo sapiens
taaactccaggatttataaagca

SEQ ID NO: 4716626 - DNA, 22 bp, Homo sapiens
taaactgccccctctgccctgc

SEQ ID NO: 4716627 - DNA, 23 bp, Homo sapiens
taaactgccccctctgccctgcg

SEQ ID NO: 4716628 - DNA, 14 bp, Homo sapiens
taaactgtgcacca

SEQ ID NO: 4716629 - DNA, 12 bp, Homo sapiens
taaagaaaactg

SEQ ID NO: 4716630 - DNA, 16 bp, Homo sapiens
taaagaaaatgtgtct

SEQ ID NO: 4716631 - DNA, 15 bp, Homo sapiens
taaagacaggagaca

SEQ ID NO: 4716632 - DNA, 23 bp, Homo sapiens
taaagacaggagacaaaagagca

SEQ ID NO: 4716633 - DNA, 22 bp, Homo sapiens
taaagacttgtatagcatgaaa

SEQ ID NO: 4716634 - DNA, 13 bp, Homo sapiens
taaagagaaaatg

SEQ ID NO: 4716635 - DNA, 14 bp, Homo sapiens
taaagcaaattact

SEQ ID NO: 4716636 - DNA, 17 bp, Homo sapiens
taaagcaatatgcattt

SEQ ID NO: 4716637 - DNA, 14 bp, Homo sapiens
taaagcaattgcat

SEQ ID NO: 4716638 - DNA, 20 bp, Homo sapiens
taaagcaattgcataataga

SEQ ID NO: 4716639 - DNA, 17 bp, Homo sapiens
taaagcagtttattata

SEQ ID NO: 4716640 - DNA, 22 bp, Homo sapiens
taaagcagtttattataatggt

SEQ ID NO: 4716641 - DNA, 14 bp, Homo sapiens
taaaggataaagaa

SEQ ID NO: 4716642 - DNA, 12 bp, Homo sapiens
taaaggatgagg

SEQ ID NO: 4716643 - DNA, 14 bp, Homo sapiens
taaaggatgagggt

SEQ ID NO: 4716644 - DNA, 18 bp, Homo sapiens
taaagtaatttctaaagc

SEQ ID NO: 4716645 - DNA, 21 bp, Homo sapiens
taaagtaatttctaaagcagt

SEQ ID NO: 4716646 - DNA, 14 bp, Homo sapiens
taaagtctagcaca

SEQ ID NO: 4716647 - DNA, 14 bp, Homo sapiens
taaagtgtttgaaa

SEQ ID NO: 4716648 - DNA, 22 bp, Homo sapiens
taaagttgcctttatttgctgt

SEQ ID NO: 4716649 - DNA, 21 bp, Homo sapiens
taaataagaaacaactctttg

SEQ ID NO: 4716650 - DNA, 13 bp, Homo sapiens
taaatacagtctt

SEQ ID NO: 4716651 - DNA, 20 bp, Homo sapiens
taaatacagtcttccatttg

SEQ ID NO: 4716652 - DNA, 22 bp, Homo sapiens
taaatacagtcttccatttgca

SEQ ID NO: 4716653 - DNA, 16 bp, Homo sapiens
taaatacatgcatata

SEQ ID NO: 4716654 - DNA, 18 bp, Homo sapiens
taaatactaactgctgat

SEQ ID NO: 4716655 - DNA, 23 bp, Homo sapiens
taaatactggactcaggaacttt

SEQ ID NO: 4716656 - DNA, 20 bp, Homo sapiens
taaatagtaaaaataaaatt

SEQ ID NO: 4716657 - DNA, 16 bp, Homo sapiens
taaatatgcagtgata

SEQ ID NO: 4716658 - DNA, 20 bp, Homo sapiens
taaatatgtgaagaaaaaga

SEQ ID NO: 4716659 - DNA, 22 bp, Homo sapiens
taaatattggtttgttattctt

SEQ ID NO: 4716660 - DNA, 14 bp, Homo sapiens
taaatcacacattc

SEQ ID NO: 4716661 - DNA, 17 bp, Homo sapiens
taaatcacacattcagt

SEQ ID NO: 4716662 - DNA, 16 bp, Homo sapiens
taaatccattatgact

SEQ ID NO: 4716663 - DNA, 14 bp, Homo sapiens
taaatcctgaagag

SEQ ID NO: 4716664 - DNA, 18 bp, Homo sapiens
taaatcctgaagagcatt

SEQ ID NO: 4716665 - DNA, 19 bp, Homo sapiens
taaatctagtatacattgt

SEQ ID NO: 4716666 - DNA, 13 bp, Homo sapiens
taaatctgaagaa

SEQ ID NO: 4716667 - DNA, 14 bp, Homo sapiens
taaatctgaagaaa

SEQ ID NO: 4716668 - DNA, 20 bp, Homo sapiens
taaatctgaagaaagttatt

SEQ ID NO: 4716669 - DNA, 18 bp, Homo sapiens
taaatgaacacatggcag

SEQ ID NO: 4716670 - DNA, 13 bp, Homo sapiens
taaatgcccagcc

SEQ ID NO: 4716671 - DNA, 15 bp, Homo sapiens
taaatgcccagcccc

SEQ ID NO: 4716672 - DNA, 16 bp, Homo sapiens
taaatgcccagcccct

SEQ ID NO: 4716673 - DNA, 15 bp, Homo sapiens
taaatgtacttatat

SEQ ID NO: 4716674 - DNA, 15 bp, Homo sapiens
taaatgtagaaagtg

SEQ ID NO: 4716675 - DNA, 22 bp, Homo sapiens
taaatgtctctttaatgtcaca

SEQ ID NO: 4716676 - DNA, 19 bp, Homo sapiens
taaatgtgatgaatactgt

SEQ ID NO: 4716677 - DNA, 13 bp, Homo sapiens
taaatgtttgtta

SEQ ID NO: 4716678 - DNA, 13 bp, Homo sapiens
taaattaatcttt

SEQ ID NO: 4716679 - DNA, 10 bp, Homo sapiens
taaattattt

SEQ ID NO: 4716680 - DNA, 22 bp, Homo sapiens
taaattatttgattatttaaga

SEQ ID NO: 4716681 - DNA, 23 bp, Homo sapiens
taaattcgctgtgagtgagtggt

SEQ ID NO: 4716682 - DNA, 17 bp, Homo sapiens
taaattctctctaacat

SEQ ID NO: 4716683 - DNA, 13 bp, Homo sapiens
taaattgatttgt

SEQ ID NO: 4716684 - DNA, 15 bp, Homo sapiens
taaattgatttgtta

SEQ ID NO: 4716685 - DNA, 18 bp, Homo sapiens
taaattgttataacttca

SEQ ID NO: 4716686 - DNA, 19 bp, Homo sapiens
taaattgttataacttcat

SEQ ID NO: 4716687 - DNA, 13 bp, Homo sapiens
taaatttgtaagt

SEQ ID NO: 4716688 - DNA, 17 bp, Homo sapiens
taaatttgtaagtttca

SEQ ID NO: 4716689 - DNA, 19 bp, Homo sapiens
taaatttgtaagtttcagg

SEQ ID NO: 4716690 - DNA, 20 bp, Homo sapiens
taaatttgtaagtttcaggt

SEQ ID NO: 4716691 - DNA, 14 bp, Homo sapiens
taacaacctggaga

SEQ ID NO: 4716692 - DNA, 21 bp, Homo sapiens
taacaactatgatttggaaaa

SEQ ID NO: 4716693 - DNA, 22 bp, Homo sapiens
taacaactatgatttggaaaat

SEQ ID NO: 4716694 - DNA, 18 bp, Homo sapiens
taacaataaagtgacaaa

SEQ ID NO: 4716695 - DNA, 14 bp, Homo sapiens
taacaatcagctcc

SEQ ID NO: 4716696 - DNA, 13 bp, Homo sapiens
taacaatgttaag

SEQ ID NO: 4716697 - DNA, 22 bp, Homo sapiens
taacaatgttaaggaaactctt

SEQ ID NO: 4716698 - DNA, 13 bp, Homo sapiens
taacaattcctct

SEQ ID NO: 4716699 - DNA, 15 bp, Homo sapiens
taacaattgtgaagt

SEQ ID NO: 4716700 - DNA, 12 bp, Homo sapiens
taacacacagct

SEQ ID NO: 4716701 - DNA, 14 bp, Homo sapiens
taacacacagctcc

SEQ ID NO: 4716702 - DNA, 17 bp, Homo sapiens
taacacacagctcccat

SEQ ID NO: 4716703 - DNA, 15 bp, Homo sapiens
taacaccaaacttca

SEQ ID NO: 4716704 - DNA, 15 bp, Homo sapiens
taacactcatttcca

SEQ ID NO: 4716705 - DNA, 12 bp, Homo sapiens
taacagaacagc

SEQ ID NO: 4716706 - DNA, 18 bp, Homo sapiens
taacagaacagcttcagg

SEQ ID NO: 4716707 - DNA, 19 bp, Homo sapiens
taacagaacagcttcaggt

SEQ ID NO: 4716708 - DNA, 22 bp, Homo sapiens
taacagaacagcttcaggttat

SEQ ID NO: 4716709 - DNA, 23 bp, Homo sapiens
taacagcgtgtcaactttcattt

SEQ ID NO: 4716710 - DNA, 15 bp, Homo sapiens
taacaggccaaagag

SEQ ID NO: 4716711 - DNA, 15 bp, Homo sapiens
taacaggttttcttc

SEQ ID NO: 4716712 - DNA, 15 bp, Homo sapiens
taacataacaacctt

SEQ ID NO: 4716713 - DNA, 13 bp, Homo sapiens
taacatatctgta

SEQ ID NO: 4716714 - DNA, 18 bp, Homo sapiens
taacatatctgtaaatag

SEQ ID NO: 4716715 - DNA, 22 bp, Homo sapiens
taacatgtgttaagtattttca

SEQ ID NO: 4716716 - DNA, 19 bp, Homo sapiens
taacattaccttactgtgg

SEQ ID NO: 4716717 - DNA, 21 bp, Homo sapiens
taacattcaggaattcttgga

SEQ ID NO: 4716718 - DNA, 15 bp, Homo sapiens
taacattcttttgtt

SEQ ID NO: 4716719 - DNA, 21 bp, Homo sapiens
taaccacctaccttacagtga

SEQ ID NO: 4716720 - DNA, 15 bp, Homo sapiens
taacccagattttat

SEQ ID NO: 4716721 - DNA, 16 bp, Homo sapiens
taaccctcactgggac

SEQ ID NO: 4716722 - DNA, 20 bp, Homo sapiens
taaccctcctgggcccaagt

SEQ ID NO: 4716723 - DNA, 16 bp, Homo sapiens
taacctatttccacat

SEQ ID NO: 4716724 - DNA, 18 bp, Homo sapiens
taacctcatcttcttcac

SEQ ID NO: 4716725 - DNA, 15 bp, Homo sapiens
taacctcgtgtctag

SEQ ID NO: 4716726 - DNA, 20 bp, Homo sapiens
taacgataaaagacagtgaa

SEQ ID NO: 4716727 - DNA, 22 bp, Homo sapiens
taacgattgacaccaaaatgaa

SEQ ID NO: 4716728 - DNA, 19 bp, Homo sapiens
taacgtttttcctttaaaa

SEQ ID NO: 4716729 - DNA, 14 bp, Homo sapiens
taactaatgttatt

SEQ ID NO: 4716730 - DNA, 18 bp, Homo sapiens
taactagagcagccctgg

SEQ ID NO: 4716731 - DNA, 21 bp, Homo sapiens
taactagagcagccctggagt

SEQ ID NO: 4716732 - DNA, 22 bp, Homo sapiens
taactagagcagccctggagtc

SEQ ID NO: 4716733 - DNA, 18 bp, Homo sapiens
taactattttattttttg

SEQ ID NO: 4716734 - DNA, 17 bp, Homo sapiens
taactctgctgaatgta

SEQ ID NO: 4716735 - DNA, 19 bp, Homo sapiens
taactctggattttgaatt

SEQ ID NO: 4716736 - DNA, 15 bp, Homo sapiens
taactctgtaagaaa

SEQ ID NO: 4716737 - DNA, 17 bp, Homo sapiens
taactgccgtaatttaa

SEQ ID NO: 4716738 - DNA, 15 bp, Homo sapiens
taactgctccaaatt

SEQ ID NO: 4716739 - DNA, 15 bp, Homo sapiens
taactgctgattttg

SEQ ID NO: 4716740 - DNA, 13 bp, Homo sapiens
taacttattagca

SEQ ID NO: 4716741 - DNA, 20 bp, Homo sapiens
taacttgtctttggaccctg

SEQ ID NO: 4716742 - DNA, 18 bp, Homo sapiens
taagaaaacaaactaaat

SEQ ID NO: 4716743 - DNA, 21 bp, Homo sapiens
taagaaataggaaagactttc

SEQ ID NO: 4716744 - DNA, 15 bp, Homo sapiens
taagaacacctgcat

SEQ ID NO: 4716745 - DNA, 16 bp, Homo sapiens
taagaactaaaatgtt

SEQ ID NO: 4716746 - DNA, 13 bp, Homo sapiens
taagaagctgttg

SEQ ID NO: 4716747 - DNA, 22 bp, Homo sapiens
taagaagctgttgtacatttat

SEQ ID NO: 4716748 - DNA, 21 bp, Homo sapiens
taagaatagtctctgggttta

SEQ ID NO: 4716749 - DNA, 19 bp, Homo sapiens
taagacaaatattcctttg

SEQ ID NO: 4716750 - DNA, 21 bp, Homo sapiens
taagacataacgtttttcctt

SEQ ID NO: 4716751 - DNA, 18 bp, Homo sapiens
taagaccaccacctcaga

SEQ ID NO: 4716752 - DNA, 16 bp, Homo sapiens
taagagtgtagaagca

SEQ ID NO: 4716753 - DNA, 18 bp, Homo sapiens
taagatactcaagcaggt

SEQ ID NO: 4716754 - DNA, 18 bp, Homo sapiens
taagattgtaaaaataat

SEQ ID NO: 4716755 - DNA, 20 bp, Homo sapiens
taagcagaccactgataaaa

SEQ ID NO: 4716756 - DNA, 17 bp, Homo sapiens
taagcagagttctttgc

SEQ ID NO: 4716757 - DNA, 15 bp, Homo sapiens
taagccatgggagac

SEQ ID NO: 4716758 - DNA, 16 bp, Homo sapiens
taagccttataaacca

SEQ ID NO: 4716759 - DNA, 10 bp, Homo sapiens
taagctattt

SEQ ID NO: 4716760 - DNA, 19 bp, Homo sapiens
taagctctatctgcaatgt

SEQ ID NO: 4716761 - DNA, 10 bp, Homo sapiens
taaggaaact

SEQ ID NO: 4716762 - DNA, 15 bp, Homo sapiens
taaggaaactcttat

SEQ ID NO: 4716763 - DNA, 18 bp, Homo sapiens
taaggaatacctgtcccc

SEQ ID NO: 4716764 - DNA, 12 bp, Homo sapiens
taaggacttttt

SEQ ID NO: 4716765 - DNA, 17 bp, Homo sapiens
taaggatccggaaagaa

SEQ ID NO: 4716766 - DNA, 18 bp, Homo sapiens
taaggatccggaaagaag

SEQ ID NO: 4716767 - DNA, 13 bp, Homo sapiens
taagggcagagtc

SEQ ID NO: 4716768 - DNA, 16 bp, Homo sapiens
taaggtatatgtttta

SEQ ID NO: 4716769 - DNA, 18 bp, Homo sapiens
taagtagcaaccctgtga

SEQ ID NO: 4716770 - DNA, 21 bp, Homo sapiens
taagtagcaaccctgtgatac

SEQ ID NO: 4716771 - DNA, 15 bp, Homo sapiens
taagtataacaaact

SEQ ID NO: 4716772 - DNA, 18 bp, Homo sapiens
taagtataacaaactatg

SEQ ID NO: 4716773 - DNA, 15 bp, Homo sapiens
taagtccattaactg

SEQ ID NO: 4716774 - DNA, 22 bp, Homo sapiens
taagtctcctttactgaatgta

SEQ ID NO: 4716775 - DNA, 20 bp, Homo sapiens
taagtgacaccaataaatgt

SEQ ID NO: 4716776 - DNA, 20 bp, Homo sapiens
taagtgacagtttaactttt

SEQ ID NO: 4716777 - DNA, 21 bp, Homo sapiens
taagtgcgtgtgtagagttaa

SEQ ID NO: 4716778 - DNA, 21 bp, Homo sapiens
taagttttatttaacttttct

SEQ ID NO: 4716779 - DNA, 19 bp, Homo sapiens
taataaaataattctaaag

SEQ ID NO: 4716780 - DNA, 15 bp, Homo sapiens
taataaatcacacat

SEQ ID NO: 4716781 - DNA, 13 bp, Homo sapiens
taataaattgatt

SEQ ID NO: 4716782 - DNA, 15 bp, Homo sapiens
taataacattacctt

SEQ ID NO: 4716783 - DNA, 19 bp, Homo sapiens
taataatgcctaccttgtg

SEQ ID NO: 4716784 - DNA, 12 bp, Homo sapiens
taatacagattt

SEQ ID NO: 4716785 - DNA, 19 bp, Homo sapiens
taatacagatttgtaacat

SEQ ID NO: 4716786 - DNA, 23 bp, Homo sapiens
taatactaattttccataagcta

SEQ ID NO: 4716787 - DNA, 17 bp, Homo sapiens
taatagaataaaggcct

SEQ ID NO: 4716788 - DNA, 22 bp, Homo sapiens
taatagactgtaacttccaaat

SEQ ID NO: 4716789 - DNA, 14 bp, Homo sapiens
taatagtatatcta

SEQ ID NO: 4716790 - DNA, 19 bp, Homo sapiens
taatagtgccaagcaggcc

SEQ ID NO: 4716791 - DNA, 14 bp, Homo sapiens
taatataaagttgg

SEQ ID NO: 4716792 - DNA, 19 bp, Homo sapiens
taatataaagttggatgcg

SEQ ID NO: 4716793 - DNA, 23 bp, Homo sapiens
taatatggctcttcataattcta

SEQ ID NO: 4716794 - DNA, 17 bp, Homo sapiens
taatattctctgatgtt

SEQ ID NO: 4716795 - DNA, 12 bp, Homo sapiens
taatatttcttc

SEQ ID NO: 4716796 - DNA, 18 bp, Homo sapiens
taatatttcttcaagtga

SEQ ID NO: 4716797 - DNA, 22 bp, Homo sapiens
taatatttcttcaagtgagtgg

SEQ ID NO: 4716798 - DNA, 20 bp, Homo sapiens
taatcagagttaccattatt

SEQ ID NO: 4716799 - DNA, 13 bp, Homo sapiens
taatccctgtctt

SEQ ID NO: 4716800 - DNA, 18 bp, Homo sapiens
taatcctgtaccaaatct

SEQ ID NO: 4716801 - DNA, 21 bp, Homo sapiens
taatcctgtaccaaatctgac

SEQ ID NO: 4716802 - DNA, 23 bp, Homo sapiens
taatcctgtaccaaatctgacat

SEQ ID NO: 4716803 - DNA, 13 bp, Homo sapiens
taatcgacctgcc

SEQ ID NO: 4716804 - DNA, 17 bp, Homo sapiens
taatctcacaaaacata

SEQ ID NO: 4716805 - DNA, 22 bp, Homo sapiens
taatctcacaaaacatatttta

SEQ ID NO: 4716806 - DNA, 20 bp, Homo sapiens
taatctgatggcttctccag

SEQ ID NO: 4716807 - DNA, 12 bp, Homo sapiens
taatctgttgtt

SEQ ID NO: 4716808 - DNA, 14 bp, Homo sapiens
taatctgttgtttg

SEQ ID NO: 4716809 - DNA, 16 bp, Homo sapiens
taatctgttgtttgaa

SEQ ID NO: 4716810 - DNA, 22 bp, Homo sapiens
taatcttgaattgtaactgttc

SEQ ID NO: 4716811 - DNA, 15 bp, Homo sapiens
taatcttttacattg

SEQ ID NO: 4716812 - DNA, 22 bp, Homo sapiens
taatgaagaaagtggaaaacaa

SEQ ID NO: 4716813 - DNA, 14 bp, Homo sapiens
taatgacattcaat

SEQ ID NO: 4716814 - DNA, 17 bp, Homo sapiens
taatgacattcaataaa

SEQ ID NO: 4716815 - DNA, 19 bp, Homo sapiens
taatgacattcaataaagt

SEQ ID NO: 4716816 - DNA, 23 bp, Homo sapiens
taatgatgtcgtttgaatcacag

SEQ ID NO: 4716817 - DNA, 18 bp, Homo sapiens
taatgattcctataaatc

SEQ ID NO: 4716818 - DNA, 23 bp, Homo sapiens
taatgcaagcaaagtatcaaaga

SEQ ID NO: 4716819 - DNA, 17 bp, Homo sapiens
taatgcctaccttgtga

SEQ ID NO: 4716820 - DNA, 18 bp, Homo sapiens
taatgcctataacttttt

SEQ ID NO: 4716821 - DNA, 20 bp, Homo sapiens
taatgcttatgtgttgcata

SEQ ID NO: 4716822 - DNA, 15 bp, Homo sapiens
taatggtgaacattt

SEQ ID NO: 4716823 - DNA, 16 bp, Homo sapiens
taatggtgaacatttt

SEQ ID NO: 4716824 - DNA, 21 bp, Homo sapiens
taatgtgaaaatggtccagga

SEQ ID NO: 4716825 - DNA, 20 bp, Homo sapiens
taatgttaaatttgtaagtt

SEQ ID NO: 4716826 - DNA, 22 bp, Homo sapiens
taatgttaaatttgtaagtttc

SEQ ID NO: 4716827 - DNA, 22 bp, Homo sapiens
taatgtttctggatttcatact

SEQ ID NO: 4716828 - DNA, 14 bp, Homo sapiens
taattaaacttctt

SEQ ID NO: 4716829 - DNA, 15 bp, Homo sapiens
taattaaacttcttt

SEQ ID NO: 4716830 - DNA, 14 bp, Homo sapiens
taattagaaatcaa

SEQ ID NO: 4716831 - DNA, 19 bp, Homo sapiens
taattagaaatcaacttgt

SEQ ID NO: 4716832 - DNA, 20 bp, Homo sapiens
taattataccccctgcaaag

SEQ ID NO: 4716833 - DNA, 14 bp, Homo sapiens
taattccacagctg

SEQ ID NO: 4716834 - DNA, 12 bp, Homo sapiens
taattctaaagg

SEQ ID NO: 4716835 - DNA, 22 bp, Homo sapiens
taattctattgaaagtttttaa

SEQ ID NO: 4716836 - DNA, 12 bp, Homo sapiens
taattctcaggc

SEQ ID NO: 4716837 - DNA, 19 bp, Homo sapiens
taattctttctattttcac

SEQ ID NO: 4716838 - DNA, 14 bp, Homo sapiens
taattgtgtggatt

SEQ ID NO: 4716839 - DNA, 20 bp, Homo sapiens
taattgtgtggattctttaa

SEQ ID NO: 4716840 - DNA, 14 bp, Homo sapiens
taattgttgtttct

SEQ ID NO: 4716841 - DNA, 11 bp, Homo sapiens
taattgtttca

SEQ ID NO: 4716842 - DNA, 22 bp, Homo sapiens
taatttaaaaatatatttataa

SEQ ID NO: 4716843 - DNA, 11 bp, Homo sapiens
taatttaactt

SEQ ID NO: 4716844 - DNA, 19 bp, Homo sapiens
taatttacaaaaatataaa

SEQ ID NO: 4716845 - DNA, 14 bp, Homo sapiens
taatttctaaagca

SEQ ID NO: 4716846 - DNA, 22 bp, Homo sapiens
taatttctaaagcagtttatta

SEQ ID NO: 4716847 - DNA, 22 bp, Homo sapiens
taatttgatagtattgtgcata

SEQ ID NO: 4716848 - DNA, 20 bp, Homo sapiens
taatttgtgaaaatgtaatt

SEQ ID NO: 4716849 - DNA, 12 bp, Homo sapiens
taatttgtgcct

SEQ ID NO: 4716850 - DNA, 17 bp, Homo sapiens
taatttgttttggatat

SEQ ID NO: 4716851 - DNA, 23 bp, Homo sapiens
taattttaaagtaatttctaaag

SEQ ID NO: 4716852 - DNA, 22 bp, Homo sapiens
taattttattagaataatttca

SEQ ID NO: 4716853 - DNA, 12 bp, Homo sapiens
taattttgtcag

SEQ ID NO: 4716854 - DNA, 15 bp, Homo sapiens
taattttgtgttgta

SEQ ID NO: 4716855 - DNA, 15 bp, Homo sapiens
taatttttgtatttt

SEQ ID NO: 4716856 - DNA, 14 bp, Homo sapiens
taatttttttaatt

SEQ ID NO: 4716857 - DNA, 18 bp, Homo sapiens
taatttttttgagacaga

SEQ ID NO: 4716858 - DNA, 17 bp, Homo sapiens
tacaaaaatataaaata

SEQ ID NO: 4716859 - DNA, 20 bp, Homo sapiens
tacaaaaatataaaatatga

SEQ ID NO: 4716860 - DNA, 20 bp, Homo sapiens
tacaaacgtatggaatgctt

SEQ ID NO: 4716861 - DNA, 22 bp, Homo sapiens
tacaaacgtatggaatgcttct

SEQ ID NO: 4716862 - DNA, 18 bp, Homo sapiens
tacaaagttaaaattgtt

SEQ ID NO: 4716863 - DNA, 18 bp, Homo sapiens
tacaaatactatccaaat

SEQ ID NO: 4716864 - DNA, 21 bp, Homo sapiens
tacaaatactatccaaataaa

SEQ ID NO: 4716865 - DNA, 15 bp, Homo sapiens
tacaagacacagtga

SEQ ID NO: 4716866 - DNA, 21 bp, Homo sapiens
tacaagcgtgagccactgcac

SEQ ID NO: 4716867 - DNA, 17 bp, Homo sapiens
tacaaggaaggtggtgg

SEQ ID NO: 4716868 - DNA, 19 bp, Homo sapiens
tacaagggcataaagtaaa

SEQ ID NO: 4716869 - DNA, 13 bp, Homo sapiens
tacaaggtatgta

SEQ ID NO: 4716870 - DNA, 14 bp, Homo sapiens
tacaatcagtgtga

SEQ ID NO: 4716871 - DNA, 17 bp, Homo sapiens
tacaatcagtgtgaatg

SEQ ID NO: 4716872 - DNA, 17 bp, Homo sapiens
tacacaacatgtatgtg

SEQ ID NO: 4716873 - DNA, 21 bp, Homo sapiens
tacacaacatgtatgtggata

SEQ ID NO: 4716874 - DNA, 9 bp, Homo sapiens
tacacacac

SEQ ID NO: 4716875 - DNA, 10 bp, Homo sapiens
tacacacacg

SEQ ID NO: 4716876 - DNA, 15 bp, Homo sapiens
tacacatttttcaga

SEQ ID NO: 4716877 - DNA, 19 bp, Homo sapiens
tacacatttttcagatata

SEQ ID NO: 4716878 - DNA, 13 bp, Homo sapiens
tacaccagtttga

SEQ ID NO: 4716879 - DNA, 16 bp, Homo sapiens
tacacccttttccagc

SEQ ID NO: 4716880 - DNA, 22 bp, Homo sapiens
tacacctaactcacctaactca

SEQ ID NO: 4716881 - DNA, 16 bp, Homo sapiens
tacactgtgctgagtc

SEQ ID NO: 4716882 - DNA, 14 bp, Homo sapiens
tacacttactgttg

SEQ ID NO: 4716883 - DNA, 17 bp, Homo sapiens
tacagaactctttcaaa

SEQ ID NO: 4716884 - DNA, 19 bp, Homo sapiens
tacagaactctttcaaaac

SEQ ID NO: 4716885 - DNA, 18 bp, Homo sapiens
tacagatcaggcagtgtt

SEQ ID NO: 4716886 - DNA, 18 bp, Homo sapiens
tacagatttgtaacatta

SEQ ID NO: 4716887 - DNA, 15 bp, Homo sapiens
tacaggagtgagcac

SEQ ID NO: 4716888 - DNA, 22 bp, Homo sapiens
tacaggcgtgagccaccgtgcc

SEQ ID NO: 4716889 - DNA, 15 bp, Homo sapiens
tacaggctcctgcca

SEQ ID NO: 4716890 - DNA, 20 bp, Homo sapiens
tacagggaatgcctgagtgc

SEQ ID NO: 4716891 - DNA, 15 bp, Homo sapiens
tacagtaggagccca

SEQ ID NO: 4716892 - DNA, 23 bp, Homo sapiens
tacagtattgaaaaattatcagt

SEQ ID NO: 4716893 - DNA, 14 bp, Homo sapiens
tacagtctcaattt

SEQ ID NO: 4716894 - DNA, 20 bp, Homo sapiens
tacagtctcaattttgtatt

SEQ ID NO: 4716895 - DNA, 22 bp, Homo sapiens
tacagtctcaattttgtattta

SEQ ID NO: 4716896 - DNA, 19 bp, Homo sapiens
tacagtcttccatttgcaa

SEQ ID NO: 4716897 - DNA, 13 bp, Homo sapiens
tacagtgatatgg

SEQ ID NO: 4716898 - DNA, 16 bp, Homo sapiens
tacagtgtacagtctt

SEQ ID NO: 4716899 - DNA, 15 bp, Homo sapiens
tacagttcataaatt

SEQ ID NO: 4716900 - DNA, 17 bp, Homo sapiens
tacagtttgtcacatga

SEQ ID NO: 4716901 - DNA, 15 bp, Homo sapiens
tacagttttaactgt

SEQ ID NO: 4716902 - DNA, 20 bp, Homo sapiens
tacagttttaactgtggata

SEQ ID NO: 4716903 - DNA, 13 bp, Homo sapiens
tacataaaagaaa

SEQ ID NO: 4716904 - DNA, 15 bp, Homo sapiens
tacatacagtgatat

SEQ ID NO: 4716905 - DNA, 13 bp, Homo sapiens
tacatataaagat

SEQ ID NO: 4716906 - DNA, 19 bp, Homo sapiens
tacatataaagattaacac

SEQ ID NO: 4716907 - DNA, 21 bp, Homo sapiens
tacatccctcagtttcttaaa

SEQ ID NO: 4716908 - DNA, 18 bp, Homo sapiens
tacatctctaattttgga

SEQ ID NO: 4716909 - DNA, 20 bp, Homo sapiens
tacatctgaacaaaatgcct

SEQ ID NO: 4716910 - DNA, 19 bp, Homo sapiens
tacatgaaaatttgtttga

SEQ ID NO: 4716911 - DNA, 17 bp, Homo sapiens
tacattgacacacagaa

SEQ ID NO: 4716912 - DNA, 15 bp, Homo sapiens
tacattgtgtcctgc

SEQ ID NO: 4716913 - DNA, 21 bp, Homo sapiens
tacatttatctattaaaattg

SEQ ID NO: 4716914 - DNA, 14 bp, Homo sapiens
tacatttatgattt

SEQ ID NO: 4716915 - DNA, 18 bp, Homo sapiens
tacatttatgatttaata

SEQ ID NO: 4716916 - DNA, 12 bp, Homo sapiens
taccaaatctga

SEQ ID NO: 4716917 - DNA, 14 bp, Homo sapiens
taccaaatctgaca

SEQ ID NO: 4716918 - DNA, 19 bp, Homo sapiens
taccaaatctgacatatta

SEQ ID NO: 4716919 - DNA, 20 bp, Homo sapiens
taccaactgtttagggccct

SEQ ID NO: 4716920 - DNA, 20 bp, Homo sapiens
taccaagcgcttctttctga

SEQ ID NO: 4716921 - DNA, 13 bp, Homo sapiens
taccacagtttct

SEQ ID NO: 4716922 - DNA, 16 bp, Homo sapiens
taccaggtctcctcca

SEQ ID NO: 4716923 - DNA, 18 bp, Homo sapiens
taccaggtctcctccacc

SEQ ID NO: 4716924 - DNA, 20 bp, Homo sapiens
taccaggtctcctccaccgc

SEQ ID NO: 4716925 - DNA, 20 bp, Homo sapiens
taccatagctacatcagttt

SEQ ID NO: 4716926 - DNA, 21 bp, Homo sapiens
taccatcccggtgcatgcagg

SEQ ID NO: 4716927 - DNA, 17 bp, Homo sapiens
tacccaaatcctctcca

SEQ ID NO: 4716928 - DNA, 15 bp, Homo sapiens
tacccacccccaccc

SEQ ID NO: 4716929 - DNA, 19 bp, Homo sapiens
tacccacccccacccaagg

SEQ ID NO: 4716930 - DNA, 18 bp, Homo sapiens
tacccagcgagccctggt

SEQ ID NO: 4716931 - DNA, 14 bp, Homo sapiens
tacccagtcatgta

SEQ ID NO: 4716932 - DNA, 20 bp, Homo sapiens
tacccccacagacctgctct

SEQ ID NO: 4716933 - DNA, 23 bp, Homo sapiens
taccccctgcaaagcccagcttg

SEQ ID NO: 4716934 - DNA, 14 bp, Homo sapiens
tacccctcccagct

SEQ ID NO: 4716935 - DNA, 19 bp, Homo sapiens
tacccctcccagctgacag

SEQ ID NO: 4716936 - DNA, 11 bp, Homo sapiens
taccctccctg

SEQ ID NO: 4716937 - DNA, 17 bp, Homo sapiens
taccctccctgctgtcc

SEQ ID NO: 4716938 - DNA, 19 bp, Homo sapiens
tacccttgacttaactttt

SEQ ID NO: 4716939 - DNA, 20 bp, Homo sapiens
taccgtagcgtatacatttg

SEQ ID NO: 4716940 - DNA, 13 bp, Homo sapiens
tacctcctgagaa

SEQ ID NO: 4716941 - DNA, 14 bp, Homo sapiens
tacctcctgagaaa

SEQ ID NO: 4716942 - DNA, 15 bp, Homo sapiens
tacctcctgtctctg

SEQ ID NO: 4716943 - DNA, 20 bp, Homo sapiens
tacctgacactcccttgggc

SEQ ID NO: 4716944 - DNA, 14 bp, Homo sapiens
tacctgtccccctg

SEQ ID NO: 4716945 - DNA, 17 bp, Homo sapiens
tacctgtccccctgaca

SEQ ID NO: 4716946 - DNA, 20 bp, Homo sapiens
taccttacagtgagggctat

SEQ ID NO: 4716947 - DNA, 21 bp, Homo sapiens
taccttattgagcgtgattct

SEQ ID NO: 4716948 - DNA, 18 bp, Homo sapiens
taccttgtgagggagaga

SEQ ID NO: 4716949 - DNA, 14 bp, Homo sapiens
taccttttaagaca

SEQ ID NO: 4716950 - DNA, 23 bp, Homo sapiens
gtggagggcacattccttgcctg

SEQ ID NO: 4716951 - DNA, 12 bp, Homo sapiens
gtggagggccac

SEQ ID NO: 4716952 - DNA, 14 bp, Homo sapiens
gtggatacagtcat

SEQ ID NO: 4716953 - DNA, 16 bp, Homo sapiens
gtggatatttgtataa

SEQ ID NO: 4716954 - DNA, 18 bp, Homo sapiens
gtggatcacaaggtcaag

SEQ ID NO: 4716955 - DNA, 21 bp, Homo sapiens
gtggatgcctggtggcagctg

SEQ ID NO: 4716956 - DNA, 16 bp, Homo sapiens
gtggatggtgactttt

SEQ ID NO: 4716957 - DNA, 13 bp, Homo sapiens
gtggattctttaa

SEQ ID NO: 4716958 - DNA, 22 bp, Homo sapiens
gtggcaagcaagagctcttgtg

SEQ ID NO: 4716959 - DNA, 15 bp, Homo sapiens
gtggcaaggctgtgc

SEQ ID NO: 4716960 - DNA, 16 bp, Homo sapiens
gtggcaaggctgtgct

SEQ ID NO: 4716961 - DNA, 17 bp, Homo sapiens
gtggcacagatgcccac

SEQ ID NO: 4716962 - DNA, 23 bp, Homo sapiens
gtggcagagcttggactggatgc

SEQ ID NO: 4716963 - DNA, 19 bp, Homo sapiens
gtggcagctgcggtccacc

SEQ ID NO: 4716964 - DNA, 21 bp, Homo sapiens
gtggcagctgcggtccaccca

SEQ ID NO: 4716965 - DNA, 19 bp, Homo sapiens
gtggcagctgcttttgtct

SEQ ID NO: 4716966 - DNA, 15 bp, Homo sapiens
gtggcagtgggagct

SEQ ID NO: 4716967 - DNA, 13 bp, Homo sapiens
gtggcatggccac

SEQ ID NO: 4716968 - DNA, 21 bp, Homo sapiens
gtggcccatcccccctcacca

SEQ ID NO: 4716969 - DNA, 15 bp, Homo sapiens
gtggccccagcctgg

SEQ ID NO: 4716970 - DNA, 16 bp, Homo sapiens
gtggccccagcctggc

SEQ ID NO: 4716971 - DNA, 18 bp, Homo sapiens
gtggccccagcctggccc

SEQ ID NO: 4716972 - DNA, 22 bp, Homo sapiens
gtggccccagcctggcccagct

SEQ ID NO: 4716973 - DNA, 20 bp, Homo sapiens
gtggccgtcctgagggggaa

SEQ ID NO: 4716974 - DNA, 22 bp, Homo sapiens
gtggccgtcctgagggggaagt

SEQ ID NO: 4716975 - DNA, 15 bp, Homo sapiens
gtggcctcccaactc

SEQ ID NO: 4716976 - DNA, 21 bp, Homo sapiens
gtggcctcccaactcacccca

SEQ ID NO: 4716977 - DNA, 21 bp, Homo sapiens
gtggcctctccttgtggcctg

SEQ ID NO: 4716978 - DNA, 15 bp, Homo sapiens
gtggcctgggcctcc

SEQ ID NO: 4716979 - DNA, 22 bp, Homo sapiens
gtggctccctgggggcggccag

SEQ ID NO: 4716980 - DNA, 15 bp, Homo sapiens
gtggctgcaaaacta

SEQ ID NO: 4716981 - DNA, 15 bp, Homo sapiens
gtggctgctgcccag

SEQ ID NO: 4716982 - DNA, 22 bp, Homo sapiens
gtggcttaaaacaacactcaca

SEQ ID NO: 4716983 - DNA, 19 bp, Homo sapiens
gtggcttcattagagcagg

SEQ ID NO: 4716984 - DNA, 23 bp, Homo sapiens
gtggcttttctggaatggaattg

SEQ ID NO: 4716985 - DNA, 17 bp, Homo sapiens
gtgggaacgactgggca

SEQ ID NO: 4716986 - DNA, 12 bp, Homo sapiens
gtgggagatgaa

SEQ ID NO: 4716987 - DNA, 15 bp, Homo sapiens
gtgggagatgaaaac

SEQ ID NO: 4716988 - DNA, 23 bp, Homo sapiens
gtgggagcataggaggggtctgg

SEQ ID NO: 4716989 - DNA, 19 bp, Homo sapiens
gtgggatctgcccctccct

SEQ ID NO: 4716990 - DNA, 19 bp, Homo sapiens
gtgggccttcagggagtga

SEQ ID NO: 4716991 - DNA, 19 bp, Homo sapiens
gtgggcgggcagcacagca

SEQ ID NO: 4716992 - DNA, 18 bp, Homo sapiens
gtgggcgtgagacctgcc

SEQ ID NO: 4716993 - DNA, 12 bp, Homo sapiens
gtgggctaagca

SEQ ID NO: 4716994 - DNA, 13 bp, Homo sapiens
gtgggctccctga

SEQ ID NO: 4716995 - DNA, 14 bp, Homo sapiens
gtgggctccctgac

SEQ ID NO: 4716996 - DNA, 17 bp, Homo sapiens
gtggggagactgggctg

SEQ ID NO: 4716997 - DNA, 22 bp, Homo sapiens
gtggggccatgctgagagctgg

SEQ ID NO: 4716998 - DNA, 18 bp, Homo sapiens
gtggggcccatggaggag

SEQ ID NO: 4716999 - DNA, 19 bp, Homo sapiens
gtgggggaagagcacagcc

SEQ ID NO: 4717000 - DNA, 21 bp, Homo sapiens
gtgggggaagagcacagccct

SEQ ID NO: 4717001 - DNA, 22 bp, Homo sapiens
gtgggggaagagcacagccctc

SEQ ID NO: 4717002 - DNA, 19 bp, Homo sapiens
gtgggggtagggggctgga

SEQ ID NO: 4717003 - DNA, 22 bp, Homo sapiens
gtgggggtagggggctggagga

SEQ ID NO: 4717004 - DNA, 15 bp, Homo sapiens
gtggggtcactctgg

SEQ ID NO: 4717005 - DNA, 14 bp, Homo sapiens
gtgggtcaaggaat

SEQ ID NO: 4717006 - DNA, 13 bp, Homo sapiens
gtgggtgggccct

SEQ ID NO: 4717007 - DNA, 17 bp, Homo sapiens
gtggtacaaatgtgata

SEQ ID NO: 4717008 - DNA, 17 bp, Homo sapiens
gtggtgcgagtgcgtga

SEQ ID NO: 4717009 - DNA, 19 bp, Homo sapiens
gtggtgcgatctgggttca

SEQ ID NO: 4717010 - DNA, 22 bp, Homo sapiens
gtggtggagccagtaaacagag

SEQ ID NO: 4717011 - DNA, 20 bp, Homo sapiens
gtggttcagctactttccat

SEQ ID NO: 4717012 - DNA, 14 bp, Homo sapiens
gtgtaagaaaacaa

SEQ ID NO: 4717013 - DNA, 20 bp, Homo sapiens
gtgtaagaaaacaaactaaa

SEQ ID NO: 4717014 - DNA, 15 bp, Homo sapiens
gtgtaataagacata

SEQ ID NO: 4717015 - DNA, 12 bp, Homo sapiens
gtgtacatttta

SEQ ID NO: 4717016 - DNA, 22 bp, Homo sapiens
gtgtaccctggggcaatagggt

SEQ ID NO: 4717017 - DNA, 13 bp, Homo sapiens
gtgtagaagcatt

SEQ ID NO: 4717018 - DNA, 14 bp, Homo sapiens
gtgtagaagcattc

SEQ ID NO: 4717019 - DNA, 17 bp, Homo sapiens
gtgtagaagcattcctt

SEQ ID NO: 4717020 - DNA, 17 bp, Homo sapiens
gtgtagagttaagaagc

SEQ ID NO: 4717021 - DNA, 20 bp, Homo sapiens
gtgtaggggagccacattta

SEQ ID NO: 4717022 - DNA, 15 bp, Homo sapiens
gtgtatctaattccc

SEQ ID NO: 4717023 - DNA, 20 bp, Homo sapiens
gtgtatgattttgatgcaca

SEQ ID NO: 4717024 - DNA, 14 bp, Homo sapiens
gtgtatttaactct

SEQ ID NO: 4717025 - DNA, 16 bp, Homo sapiens
gtgtcaactttcattt

SEQ ID NO: 4717026 - DNA, 18 bp, Homo sapiens
gtgtcaactttcatttga

SEQ ID NO: 4717027 - DNA, 20 bp, Homo sapiens
gtgtcaagagggtctgagga

SEQ ID NO: 4717028 - DNA, 14 bp, Homo sapiens
gtgtcactggctgc

SEQ ID NO: 4717029 - DNA, 15 bp, Homo sapiens
gtgtcactggctgcc

SEQ ID NO: 4717030 - DNA, 19 bp, Homo sapiens
gtgtcactggctgcctcca

SEQ ID NO: 4717031 - DNA, 14 bp, Homo sapiens
gtgtcaggtggggc

SEQ ID NO: 4717032 - DNA, 20 bp, Homo sapiens
gtgtcaggtggggcagcttg

SEQ ID NO: 4717033 - DNA, 18 bp, Homo sapiens
gtgtccacgactgtctcc

SEQ ID NO: 4717034 - DNA, 20 bp, Homo sapiens
gtgtcccaaaaagaaaggag

SEQ ID NO: 4717035 - DNA, 22 bp, Homo sapiens
gtgtcccccataaaagatatgt

SEQ ID NO: 4717036 - DNA, 16 bp, Homo sapiens
gtgtccctgcacttgc

SEQ ID NO: 4717037 - DNA, 18 bp, Homo sapiens
gtgtccctgcacttgcag

SEQ ID NO: 4717038 - DNA, 17 bp, Homo sapiens
gtgtcttgcaatggcag

SEQ ID NO: 4717039 - DNA, 19 bp, Homo sapiens
gtgtcttgcaatggcagcc

SEQ ID NO: 4717040 - DNA, 17 bp, Homo sapiens
gtgtgaaaatgtgtgtg

SEQ ID NO: 4717041 - DNA, 14 bp, Homo sapiens
gtgtgaggccaggg

SEQ ID NO: 4717042 - DNA, 17 bp, Homo sapiens
gtgtgaggccagggcag

SEQ ID NO: 4717043 - DNA, 13 bp, Homo sapiens
gtgtgagtcacca

SEQ ID NO: 4717044 - DNA, 14 bp, Homo sapiens
gtgtgatcgtctga

SEQ ID NO: 4717045 - DNA, 13 bp, Homo sapiens
gtgtgctcttctt

SEQ ID NO: 4717046 - DNA, 15 bp, Homo sapiens
gtgtggtgtttcctg

SEQ ID NO: 4717047 - DNA, 16 bp, Homo sapiens
gtgtgtagagttaaga

SEQ ID NO: 4717048 - DNA, 13 bp, Homo sapiens
gtgtgtctgtgtt

SEQ ID NO: 4717049 - DNA, 23 bp, Homo sapiens
gtgtgttcaccttcaaaatgttc

SEQ ID NO: 4717050 - DNA, 17 bp, Homo sapiens
gtgtgttgatactgttg

SEQ ID NO: 4717051 - DNA, 19 bp, Homo sapiens
gtgtgttgatactgttgca

SEQ ID NO: 4717052 - DNA, 22 bp, Homo sapiens
gtgtgttgatactgttgcacgt

SEQ ID NO: 4717053 - DNA, 21 bp, Homo sapiens
gtgtgtttttctattaaaaga

SEQ ID NO: 4717054 - DNA, 21 bp, Homo sapiens
gtgttcaccttcaaaatgttc

SEQ ID NO: 4717055 - DNA, 13 bp, Homo sapiens
gtgttgatactgt

SEQ ID NO: 4717056 - DNA, 15 bp, Homo sapiens
gtgttgatactgttg

SEQ ID NO: 4717057 - DNA, 17 bp, Homo sapiens
gtgttgatactgttgca

SEQ ID NO: 4717058 - DNA, 21 bp, Homo sapiens
gtgttgatactgttgcacgtg

SEQ ID NO: 4717059 - DNA, 12 bp, Homo sapiens
gtgttgtacaat

SEQ ID NO: 4717060 - DNA, 22 bp, Homo sapiens
gtgtttatggccaatctattct

SEQ ID NO: 4717061 - DNA, 13 bp, Homo sapiens
gtgtttctttagt

SEQ ID NO: 4717062 - DNA, 21 bp, Homo sapiens
gtgtttttctattaaaagact

SEQ ID NO: 4717063 - DNA, 22 bp, Homo sapiens
gtgtttttctattaaaagactc

SEQ ID NO: 4717064 - DNA, 14 bp, Homo sapiens
gttaaaagtaaaat

SEQ ID NO: 4717065 - DNA, 23 bp, Homo sapiens
gttaaatttgtaagtttcaggtg

SEQ ID NO: 4717066 - DNA, 17 bp, Homo sapiens
gttaacaataaagtgac

SEQ ID NO: 4717067 - DNA, 15 bp, Homo sapiens
gttaacactgtaata

SEQ ID NO: 4717068 - DNA, 17 bp, Homo sapiens
gttaacactgtaatatc

SEQ ID NO: 4717069 - DNA, 17 bp, Homo sapiens
gttaactatgacagata

SEQ ID NO: 4717070 - DNA, 18 bp, Homo sapiens
gttaactgttaactatga

SEQ ID NO: 4717071 - DNA, 19 bp, Homo sapiens
gttaactgttaactatgac

SEQ ID NO: 4717072 - DNA, 14 bp, Homo sapiens
gttaaggaaactct

SEQ ID NO: 4717073 - DNA, 13 bp, Homo sapiens
gttaataatctat

SEQ ID NO: 4717074 - DNA, 16 bp, Homo sapiens
gttaataatctatgat

SEQ ID NO: 4717075 - DNA, 18 bp, Homo sapiens
gttaattttcctcatttt

SEQ ID NO: 4717076 - DNA, 23 bp, Homo sapiens
gttaattttcctcattttgaatt

SEQ ID NO: 4717077 - DNA, 16 bp, Homo sapiens
gttacacatttttcag

SEQ ID NO: 4717078 - DNA, 17 bp, Homo sapiens
gttaccaaaaatatccc

SEQ ID NO: 4717079 - DNA, 18 bp, Homo sapiens
gttaccattatttaattt

SEQ ID NO: 4717080 - DNA, 23 bp, Homo sapiens
gttaccattttggggtacccact

SEQ ID NO: 4717081 - DNA, 17 bp, Homo sapiens
gttaccttttacagaat

SEQ ID NO: 4717082 - DNA, 23 bp, Homo sapiens
gttaccttttacagaataaaaga

SEQ ID NO: 4717083 - DNA, 18 bp, Homo sapiens
gttacgtagcctaaggct

SEQ ID NO: 4717084 - DNA, 15 bp, Homo sapiens
gttactgagatgttt

SEQ ID NO: 4717085 - DNA, 22 bp, Homo sapiens
gttactggcacctgaaattaat

SEQ ID NO: 4717086 - DNA, 17 bp, Homo sapiens
gttactgtctgtagtgt

SEQ ID NO: 4717087 - DNA, 19 bp, Homo sapiens
gttactgtctgtagtgttt

SEQ ID NO: 4717088 - DNA, 12 bp, Homo sapiens
gttacttaaaca

SEQ ID NO: 4717089 - DNA, 20 bp, Homo sapiens
gttacttaaacatcattgga

SEQ ID NO: 4717090 - DNA, 19 bp, Homo sapiens
gttaggcattgtgggaagg

SEQ ID NO: 4717091 - DNA, 17 bp, Homo sapiens
gttagggtgtgtgttca

SEQ ID NO: 4717092 - DNA, 19 bp, Homo sapiens
gttagtttctccaagcagg

SEQ ID NO: 4717093 - DNA, 22 bp, Homo sapiens
gttatattacttgcctatctga

SEQ ID NO: 4717094 - DNA, 19 bp, Homo sapiens
gttatattgaaaaaataga

SEQ ID NO: 4717095 - DNA, 17 bp, Homo sapiens
gttatattttgctgttt

SEQ ID NO: 4717096 - DNA, 18 bp, Homo sapiens
gttatattttgctgttta

SEQ ID NO: 4717097 - DNA, 14 bp, Homo sapiens
gttatcgaaataac

SEQ ID NO: 4717098 - DNA, 18 bp, Homo sapiens
gttatcgaaataacaatg

SEQ ID NO: 4717099 - DNA, 16 bp, Homo sapiens
gttatcttgtgtatgg

SEQ ID NO: 4717100 - DNA, 12 bp, Homo sapiens
gttatgaatatt

SEQ ID NO: 4717101 - DNA, 21 bp, Homo sapiens
gttattacccagagtttttat

SEQ ID NO: 4717102 - DNA, 22 bp, Homo sapiens
gttattagagattacctcctga

SEQ ID NO: 4717103 - DNA, 17 bp, Homo sapiens
gttattatgctaatata

SEQ ID NO: 4717104 - DNA, 17 bp, Homo sapiens
gttattcttggtactgt

SEQ ID NO: 4717105 - DNA, 22 bp, Homo sapiens
gttatttaatcacagtcatctt

SEQ ID NO: 4717106 - DNA, 18 bp, Homo sapiens
gttatttacactggtcta

SEQ ID NO: 4717107 - DNA, 19 bp, Homo sapiens
gttatttacactggtctaa

SEQ ID NO: 4717108 - DNA, 22 bp, Homo sapiens
gttatttacactggtctaatgt

SEQ ID NO: 4717109 - DNA, 13 bp, Homo sapiens
gttattttgcaac

SEQ ID NO: 4717110 - DNA, 18 bp, Homo sapiens
gttcaagcgattcttctg

SEQ ID NO: 4717111 - DNA, 19 bp, Homo sapiens
gttcaccttcaaaatgttc

SEQ ID NO: 4717112 - DNA, 19 bp, Homo sapiens
gttcactgcaacctccgcc

SEQ ID NO: 4717113 - DNA, 11 bp, Homo sapiens
gttcacttttt

SEQ ID NO: 4717114 - DNA, 15 bp, Homo sapiens
gttcagctccagctc

SEQ ID NO: 4717115 - DNA, 16 bp, Homo sapiens
gttcagctccagctca

SEQ ID NO: 4717116 - DNA, 17 bp, Homo sapiens
gttcagctccagctcac

SEQ ID NO: 4717117 - DNA, 17 bp, Homo sapiens
gttcagggttggcccct

SEQ ID NO: 4717118 - DNA, 22 bp, Homo sapiens
gttcagggttggcccctgcccg

SEQ ID NO: 4717119 - DNA, 17 bp, Homo sapiens
gttcaggtaacaggcag

SEQ ID NO: 4717120 - DNA, 18 bp, Homo sapiens
gttcaggtaacaggcaga

SEQ ID NO: 4717121 - DNA, 19 bp, Homo sapiens
gttcatcatccctccctgc

SEQ ID NO: 4717122 - DNA, 14 bp, Homo sapiens
gttcattctgtgac

SEQ ID NO: 4717123 - DNA, 15 bp, Homo sapiens
gttcattctgtgacc

SEQ ID NO: 4717124 - DNA, 23 bp, Homo sapiens
gttccaaatgtgtataattttaa

SEQ ID NO: 4717125 - DNA, 17 bp, Homo sapiens
gttccaccatcaagcca

SEQ ID NO: 4717126 - DNA, 19 bp, Homo sapiens
gttccactcaaatgtcctg

SEQ ID NO: 4717127 - DNA, 19 bp, Homo sapiens
gttccagagctgcttctgt

SEQ ID NO: 4717128 - DNA, 16 bp, Homo sapiens
gttccatgatgctggg

SEQ ID NO: 4717129 - DNA, 21 bp, Homo sapiens
gttccattgcctcttttcaca

SEQ ID NO: 4717130 - DNA, 14 bp, Homo sapiens
gttccccatgcaga

SEQ ID NO: 4717131 - DNA, 21 bp, Homo sapiens
gttcccttttttggctgctga

SEQ ID NO: 4717132 - DNA, 15 bp, Homo sapiens
gttccggcatggaca

SEQ ID NO: 4717133 - DNA, 17 bp, Homo sapiens
gttctaagtctttccat

SEQ ID NO: 4717134 - DNA, 17 bp, Homo sapiens
gttctaggggaaatgaa

SEQ ID NO: 4717135 - DNA, 18 bp, Homo sapiens
gttctatttttgtttaca

SEQ ID NO: 4717136 - DNA, 11 bp, Homo sapiens
gttctcatctt

SEQ ID NO: 4717137 - DNA, 16 bp, Homo sapiens
gttctctcctccccaa

SEQ ID NO: 4717138 - DNA, 11 bp, Homo sapiens
gttctctgccc

SEQ ID NO: 4717139 - DNA, 15 bp, Homo sapiens
gttctctgccctcca

SEQ ID NO: 4717140 - DNA, 19 bp, Homo sapiens
gttctgatcctagttccac

SEQ ID NO: 4717141 - DNA, 21 bp, Homo sapiens
gttctgcccaaattatgtgaa

SEQ ID NO: 4717142 - DNA, 23 bp, Homo sapiens
gttctgctcatcattctctgtct

SEQ ID NO: 4717143 - DNA, 22 bp, Homo sapiens
gttctgctctaagaagctgcaa

SEQ ID NO: 4717144 - DNA, 14 bp, Homo sapiens
gttctgggacacag

SEQ ID NO: 4717145 - DNA, 16 bp, Homo sapiens
gttctgtcccttgccc

SEQ ID NO: 4717146 - DNA, 17 bp, Homo sapiens
gttctgtgtacatttta

SEQ ID NO: 4717147 - DNA, 19 bp, Homo sapiens
gttcttagttgctgtatgt

SEQ ID NO: 4717148 - DNA, 12 bp, Homo sapiens
gttcttgtcatc

SEQ ID NO: 4717149 - DNA, 16 bp, Homo sapiens
gttctttgcaagctta

SEQ ID NO: 4717150 - DNA, 17 bp, Homo sapiens
gttgaaaaaagaagttt

SEQ ID NO: 4717151 - DNA, 20 bp, Homo sapiens
gttgaatattggtaattaaa

SEQ ID NO: 4717152 - DNA, 15 bp, Homo sapiens
gttgaccccagagga

SEQ ID NO: 4717153 - DNA, 15 bp, Homo sapiens
gttgactttagggac

SEQ ID NO: 4717154 - DNA, 14 bp, Homo sapiens
gttgatagcacaga

SEQ ID NO: 4717155 - DNA, 19 bp, Homo sapiens
gttgatagcacagaccctg

SEQ ID NO: 4717156 - DNA, 17 bp, Homo sapiens
gttgcacgtgtgttttt

SEQ ID NO: 4717157 - DNA, 23 bp, Homo sapiens
gttgcagccctgctgctgcctgc

SEQ ID NO: 4717158 - DNA, 21 bp, Homo sapiens
gttgcataaacaatccaaatg

SEQ ID NO: 4717159 - DNA, 23 bp, Homo sapiens
gttgcattttaaccctattttac

SEQ ID NO: 4717160 - DNA, 21 bp, Homo sapiens
gttgccacatttagtcctgta

SEQ ID NO: 4717161 - DNA, 12 bp, Homo sapiens
gttgcccaggct

SEQ ID NO: 4717162 - DNA, 16 bp, Homo sapiens
gttgctgatgtttata

SEQ ID NO: 4717163 - DNA, 19 bp, Homo sapiens
gttggaggtttcacttgca

SEQ ID NO: 4717164 - DNA, 23 bp, Homo sapiens
gttggccaaagccaaagctaggc

SEQ ID NO: 4717165 - DNA, 14 bp, Homo sapiens
gttggccagtgtga

SEQ ID NO: 4717166 - DNA, 19 bp, Homo sapiens
gttggcgcaccctcccctc

SEQ ID NO: 4717167 - DNA, 21 bp, Homo sapiens
gttggcgcaccctcccctccc

SEQ ID NO: 4717168 - DNA, 17 bp, Homo sapiens
gttggctgggaactcac

SEQ ID NO: 4717169 - DNA, 12 bp, Homo sapiens
gttggctggggg

SEQ ID NO: 4717170 - DNA, 17 bp, Homo sapiens
gttgggaattttgtttt

SEQ ID NO: 4717171 - DNA, 15 bp, Homo sapiens
gttgggtgggtgggc

SEQ ID NO: 4717172 - DNA, 12 bp, Homo sapiens
gttggtttttat

SEQ ID NO: 4717173 - DNA, 14 bp, Homo sapiens
gttgtaatttgaat

SEQ ID NO: 4717174 - DNA, 16 bp, Homo sapiens
gttgtacatttatgat

SEQ ID NO: 4717175 - DNA, 20 bp, Homo sapiens
gttgtacatttatgatttaa

SEQ ID NO: 4717176 - DNA, 18 bp, Homo sapiens
gttgtactttggaattct

SEQ ID NO: 4717177 - DNA, 15 bp, Homo sapiens
gttgtataaaaacat

SEQ ID NO: 4717178 - DNA, 13 bp, Homo sapiens
gttgtctccctgg

SEQ ID NO: 4717179 - DNA, 15 bp, Homo sapiens
gttgtctccctggcc

SEQ ID NO: 4717180 - DNA, 12 bp, Homo sapiens
gttgtctttctt

SEQ ID NO: 4717181 - DNA, 20 bp, Homo sapiens
gttgttaaaggcaatggttt

SEQ ID NO: 4717182 - DNA, 18 bp, Homo sapiens
gttgtttataataaaaat

SEQ ID NO: 4717183 - DNA, 13 bp, Homo sapiens
gttgtttctttct

SEQ ID NO: 4717184 - DNA, 20 bp, Homo sapiens
gttgtttgattcagacagct

SEQ ID NO: 4717185 - DNA, 23 bp, Homo sapiens
gttgtttgattcagacagctgcc

SEQ ID NO: 4717186 - DNA, 22 bp, Homo sapiens
gtttaacgtttctcattaaaat

SEQ ID NO: 4717187 - DNA, 15 bp, Homo sapiens
gtttacaacaaacac

SEQ ID NO: 4717188 - DNA, 16 bp, Homo sapiens
gtttacaacaaacact

SEQ ID NO: 4717189 - DNA, 21 bp, Homo sapiens
gtttacaacaaacactgtgat

SEQ ID NO: 4717190 - DNA, 20 bp, Homo sapiens
gtttagatttatggttgtta

SEQ ID NO: 4717191 - DNA, 14 bp, Homo sapiens
gtttataataaaaa

SEQ ID NO: 4717192 - DNA, 17 bp, Homo sapiens
gtttatgatctatttgt

SEQ ID NO: 4717193 - DNA, 18 bp, Homo sapiens
gtttatgatctatttgta

SEQ ID NO: 4717194 - DNA, 18 bp, Homo sapiens
gtttcaccatccttagac

SEQ ID NO: 4717195 - DNA, 22 bp, Homo sapiens
gtttcaccatccttagaccaag

SEQ ID NO: 4717196 - DNA, 14 bp, Homo sapiens
gtttcaggtgacat

SEQ ID NO: 4717197 - DNA, 19 bp, Homo sapiens
gtttcccatcactgtatcc

SEQ ID NO: 4717198 - DNA, 20 bp, Homo sapiens
gtttcccttgccctttccat

SEQ ID NO: 4717199 - DNA, 13 bp, Homo sapiens
gtttcctgccctg

SEQ ID NO: 4717200 - DNA, 22 bp, Homo sapiens
gtttcctgccctgggaggcagt

SEQ ID NO: 4717201 - DNA, 21 bp, Homo sapiens
gtttcctggcactgcttccag

SEQ ID NO: 4717202 - DNA, 22 bp, Homo sapiens
gtttcctggcactgcttccagt

SEQ ID NO: 4717203 - DNA, 17 bp, Homo sapiens
gtttcctttcatttact

SEQ ID NO: 4717204 - DNA, 20 bp, Homo sapiens
gtttcctttcatttactgtg

SEQ ID NO: 4717205 - DNA, 18 bp, Homo sapiens
gtttctcaaagaaatttc

SEQ ID NO: 4717206 - DNA, 21 bp, Homo sapiens
gtttctgaaaattaacactgc

SEQ ID NO: 4717207 - DNA, 14 bp, Homo sapiens
gtttctggatttca

SEQ ID NO: 4717208 - DNA, 13 bp, Homo sapiens
gtttgactgtgct

SEQ ID NO: 4717209 - DNA, 12 bp, Homo sapiens
gtttgatagtgc

SEQ ID NO: 4717210 - DNA, 20 bp, Homo sapiens
gtttgattcagacagctgcc

SEQ ID NO: 4717211 - DNA, 17 bp, Homo sapiens
gtttgcaaggaagccac

SEQ ID NO: 4717212 - DNA, 14 bp, Homo sapiens
gtttgtaatctgta

SEQ ID NO: 4717213 - DNA, 17 bp, Homo sapiens
gtttgtcctttaactat

SEQ ID NO: 4717214 - DNA, 21 bp, Homo sapiens
gtttgtgtcaaaactggttta

SEQ ID NO: 4717215 - DNA, 13 bp, Homo sapiens
gtttgttatttac

SEQ ID NO: 4717216 - DNA, 16 bp, Homo sapiens
gtttgttgtgaggatt

SEQ ID NO: 4717217 - DNA, 16 bp, Homo sapiens
gttttaactgtggata

SEQ ID NO: 4717218 - DNA, 16 bp, Homo sapiens
gttttagaaggttctc

SEQ ID NO: 4717219 - DNA, 12 bp, Homo sapiens
gttttatttaac

SEQ ID NO: 4717220 - DNA, 11 bp, Homo sapiens
gttttcactct

SEQ ID NO: 4717221 - DNA, 12 bp, Homo sapiens
gttttcactctt

SEQ ID NO: 4717222 - DNA, 14 bp, Homo sapiens
gttttcatcaagac

SEQ ID NO: 4717223 - DNA, 14 bp, Homo sapiens
gttttgaaaagcta

SEQ ID NO: 4717224 - DNA, 16 bp, Homo sapiens
gttttgaagattctat

SEQ ID NO: 4717225 - DNA, 20 bp, Homo sapiens
gttttgaagattctatgtta

SEQ ID NO: 4717226 - DNA, 15 bp, Homo sapiens
gttttgcacagccaa

SEQ ID NO: 4717227 - DNA, 22 bp, Homo sapiens
gttttgccatgttggccaggct

SEQ ID NO: 4717228 - DNA, 12 bp, Homo sapiens
gttttgtattct

SEQ ID NO: 4717229 - DNA, 15 bp, Homo sapiens
gttttgtattctctg

SEQ ID NO: 4717230 - DNA, 14 bp, Homo sapiens
gttttgttcccctc

SEQ ID NO: 4717231 - DNA, 15 bp, Homo sapiens
gttttgttcccctcc

SEQ ID NO: 4717232 - DNA, 21 bp, Homo sapiens
gttttgttcccctcctccact

SEQ ID NO: 4717233 - DNA, 12 bp, Homo sapiens
gttttgttcttt

SEQ ID NO: 4717234 - DNA, 16 bp, Homo sapiens
gtttttcagtttaatt

SEQ ID NO: 4717235 - DNA, 14 bp, Homo sapiens
gtttttcagttttc

SEQ ID NO: 4717236 - DNA, 21 bp, Homo sapiens
gtttttgtaaattaatctttt

SEQ ID NO: 4717237 - DNA, 13 bp, Homo sapiens
gtttttgtattta

SEQ ID NO: 4717238 - DNA, 22 bp, Homo sapiens
gtttttgtatttattaatttga

SEQ ID NO: 4717239 - DNA, 20 bp, Homo sapiens
gtttttttaagattgtaaaa

SEQ ID NO: 4717240 - DNA, 16 bp, Homo sapiens
taaaaaaatttaagtg

SEQ ID NO: 4717241 - DNA, 17 bp, Homo sapiens
taaaaaatggtgcctga

SEQ ID NO: 4717242 - DNA, 15 bp, Homo sapiens
taaaaacactacttt

SEQ ID NO: 4717243 - DNA, 13 bp, Homo sapiens
taaaaacatgagt

SEQ ID NO: 4717244 - DNA, 23 bp, Homo sapiens
taaaaagggaaagttttgttctg

SEQ ID NO: 4717245 - DNA, 20 bp, Homo sapiens
taaaaagggcagccctcctt

SEQ ID NO: 4717246 - DNA, 13 bp, Homo sapiens
taaaaagtataaa

SEQ ID NO: 4717247 - DNA, 19 bp, Homo sapiens
taaaaagtataaaatagta

SEQ ID NO: 4717248 - DNA, 11 bp, Homo sapiens
taaaaataacc

SEQ ID NO: 4717249 - DNA, 21 bp, Homo sapiens
taaaaatgtagaaattcttca

SEQ ID NO: 4717250 - DNA, 18 bp, Homo sapiens
taaaacctgagctagaag

SEQ ID NO: 4717251 - DNA, 13 bp, Homo sapiens
taaaagaaaattt

SEQ ID NO: 4717252 - DNA, 22 bp, Homo sapiens
taaaagaaaggttgcgtttaat

SEQ ID NO: 4717253 - DNA, 14 bp, Homo sapiens
taaaagaaataaac

SEQ ID NO: 4717254 - DNA, 16 bp, Homo sapiens
taaaagaaataaacca

SEQ ID NO: 4717255 - DNA, 11 bp, Homo sapiens
taaaagacaaa

SEQ ID NO: 4717256 - DNA, 12 bp, Homo sapiens
taaaagacaaat

SEQ ID NO: 4717257 - DNA, 20 bp, Homo sapiens
taaaagacaaatcaaagcag

SEQ ID NO: 4717258 - DNA, 12 bp, Homo sapiens
taaaagactcat

SEQ ID NO: 4717259 - DNA, 14 bp, Homo sapiens
taaaagactcatcc

SEQ ID NO: 4717260 - DNA, 13 bp, Homo sapiens
taaaagacttttt

SEQ ID NO: 4717261 - DNA, 11 bp, Homo sapiens
taaaagatatg

SEQ ID NO: 4717262 - DNA, 13 bp, Homo sapiens
taaaagatatgtt

SEQ ID NO: 4717263 - DNA, 17 bp, Homo sapiens
taaaagcaaaaagatgt

SEQ ID NO: 4717264 - DNA, 20 bp, Homo sapiens
taaaagcatggccctgctgc

SEQ ID NO: 4717265 - DNA, 14 bp, Homo sapiens
taaaagtcataaat

SEQ ID NO: 4717266 - DNA, 13 bp, Homo sapiens
taaaagtcttgtg

SEQ ID NO: 4717267 - DNA, 17 bp, Homo sapiens
taaaagttttgttcttt

SEQ ID NO: 4717268 - DNA, 14 bp, Homo sapiens
taaaatacatataa

SEQ ID NO: 4717269 - DNA, 15 bp, Homo sapiens
taaaatacatataaa

SEQ ID NO: 4717270 - DNA, 16 bp, Homo sapiens
taaaatagtatgaaaa

SEQ ID NO: 4717271 - DNA, 19 bp, Homo sapiens
taaaatatgaagacataaa

SEQ ID NO: 4717272 - DNA, 21 bp, Homo sapiens
taaaatattttagatgttatt

SEQ ID NO: 4717273 - DNA, 15 bp, Homo sapiens
taaaatcctcaatcc

SEQ ID NO: 4717274 - DNA, 15 bp, Homo sapiens
taaaatcttcagctg

SEQ ID NO: 4717275 - DNA, 18 bp, Homo sapiens
taaaatcttcagctggtg

SEQ ID NO: 4717276 - DNA, 21 bp, Homo sapiens
taaaatggatttaatccattt

SEQ ID NO: 4717277 - DNA, 17 bp, Homo sapiens
taaaatgttcacttttg

SEQ ID NO: 4717278 - DNA, 22 bp, Homo sapiens
taaaatgttcacttttgacaaa

SEQ ID NO: 4717279 - DNA, 19 bp, Homo sapiens
taaaatgttggtgcaatta

SEQ ID NO: 4717280 - DNA, 16 bp, Homo sapiens
taaaattaaagctgaa

SEQ ID NO: 4717281 - DNA, 18 bp, Homo sapiens
taaaattaaagctgaaaa

SEQ ID NO: 4717282 - DNA, 13 bp, Homo sapiens
taaaattatattt

SEQ ID NO: 4717283 - DNA, 16 bp, Homo sapiens
taaaattgccatttta

SEQ ID NO: 4717284 - DNA, 15 bp, Homo sapiens
taaaattgttatcaa

SEQ ID NO: 4717285 - DNA, 15 bp, Homo sapiens
gtccacgactgtctc

SEQ ID NO: 4717286 - DNA, 18 bp, Homo sapiens
gtccacgactgtctccat

SEQ ID NO: 4717287 - DNA, 18 bp, Homo sapiens
gtccacgcggccacctca

SEQ ID NO: 4717288 - DNA, 19 bp, Homo sapiens
gtccagccctggctgaagg

SEQ ID NO: 4717289 - DNA, 23 bp, Homo sapiens
gtccagccctggctgaaggactg

SEQ ID NO: 4717290 - DNA, 13 bp, Homo sapiens
gtccagtgcccat

SEQ ID NO: 4717291 - DNA, 13 bp, Homo sapiens
gtccatgggcaga

SEQ ID NO: 4717292 - DNA, 20 bp, Homo sapiens
gtcccaccatgcagtgcccc

SEQ ID NO: 4717293 - DNA, 19 bp, Homo sapiens
gtcccaccttggctgcagg

SEQ ID NO: 4717294 - DNA, 14 bp, Homo sapiens
gtcccactcagtcc

SEQ ID NO: 4717295 - DNA, 17 bp, Homo sapiens
gtcccacttcccctcct

SEQ ID NO: 4717296 - DNA, 19 bp, Homo sapiens
gtcccacttggcatcagct

SEQ ID NO: 4717297 - DNA, 12 bp, Homo sapiens
gtcccagagctg

SEQ ID NO: 4717298 - DNA, 17 bp, Homo sapiens
gtcccagagctgcacag

SEQ ID NO: 4717299 - DNA, 21 bp, Homo sapiens
gtcccagattggctcacactg

SEQ ID NO: 4717300 - DNA, 22 bp, Homo sapiens
gtcccagattggctcacactga

SEQ ID NO: 4717301 - DNA, 15 bp, Homo sapiens
gtcccaggctgagcc

SEQ ID NO: 4717302 - DNA, 16 bp, Homo sapiens
gtcccaggctgagcct

SEQ ID NO: 4717303 - DNA, 12 bp, Homo sapiens
gtcccagtgaac

SEQ ID NO: 4717304 - DNA, 16 bp, Homo sapiens
gtcccataggcccagt

SEQ ID NO: 4717305 - DNA, 17 bp, Homo sapiens
gtccccaccgcagacag

SEQ ID NO: 4717306 - DNA, 15 bp, Homo sapiens
gtcccctcttgcccc

SEQ ID NO: 4717307 - DNA, 12 bp, Homo sapiens
gtccccttctct

SEQ ID NO: 4717308 - DNA, 20 bp, Homo sapiens
gtccccttctctcatctctt

SEQ ID NO: 4717309 - DNA, 12 bp, Homo sapiens
gtccctctcttg

SEQ ID NO: 4717310 - DNA, 13 bp, Homo sapiens
gtccctgaagtct

SEQ ID NO: 4717311 - DNA, 11 bp, Homo sapiens
gtccctgccaa

SEQ ID NO: 4717312 - DNA, 15 bp, Homo sapiens
gtccctgccaatgga

SEQ ID NO: 4717313 - DNA, 18 bp, Homo sapiens
gtccctgccccagcaaga

SEQ ID NO: 4717314 - DNA, 16 bp, Homo sapiens
gtccctggtggcagct

SEQ ID NO: 4717315 - DNA, 14 bp, Homo sapiens
gtccctgtgttctg

SEQ ID NO: 4717316 - DNA, 22 bp, Homo sapiens
gtcccttccacacccccacccc

SEQ ID NO: 4717317 - DNA, 13 bp, Homo sapiens
gtcccttgccccc

SEQ ID NO: 4717318 - DNA, 15 bp, Homo sapiens
gtcccttgcccccct

SEQ ID NO: 4717319 - DNA, 21 bp, Homo sapiens
gtcctatgtatatcttctaca

SEQ ID NO: 4717320 - DNA, 20 bp, Homo sapiens
gtcctcaaggggccatcctg

SEQ ID NO: 4717321 - DNA, 17 bp, Homo sapiens
gtcctcctccagggaca

SEQ ID NO: 4717322 - DNA, 13 bp, Homo sapiens
gtcctctccacct

SEQ ID NO: 4717323 - DNA, 18 bp, Homo sapiens
gtcctctccacctagtgg

SEQ ID NO: 4717324 - DNA, 18 bp, Homo sapiens
gtcctctccctcctggcc

SEQ ID NO: 4717325 - DNA, 20 bp, Homo sapiens
gtcctgacttcaggggctgc

SEQ ID NO: 4717326 - DNA, 18 bp, Homo sapiens
gtcctgggagtgagctgg

SEQ ID NO: 4717327 - DNA, 13 bp, Homo sapiens
gtcctgtcagtgc

SEQ ID NO: 4717328 - DNA, 14 bp, Homo sapiens
gtcctgtcagtgcc

SEQ ID NO: 4717329 - DNA, 16 bp, Homo sapiens
gtcctgtcagtgccgc

SEQ ID NO: 4717330 - DNA, 22 bp, Homo sapiens
gtcctgtcagtgccgccgcctc

SEQ ID NO: 4717331 - DNA, 15 bp, Homo sapiens
gtccttaccagcaga

SEQ ID NO: 4717332 - DNA, 16 bp, Homo sapiens
gtccttaccagcagag

SEQ ID NO: 4717333 - DNA, 16 bp, Homo sapiens
gtcgaggacagggagg

SEQ ID NO: 4717334 - DNA, 20 bp, Homo sapiens
gtcgcccaggctggagtgca

SEQ ID NO: 4717335 - DNA, 16 bp, Homo sapiens
gtcgcgctgcctgtgt

SEQ ID NO: 4717336 - DNA, 18 bp, Homo sapiens
gtcgctgggtcctctgca

SEQ ID NO: 4717337 - DNA, 18 bp, Homo sapiens
gtcgctgtaaattttatg

SEQ ID NO: 4717338 - DNA, 11 bp, Homo sapiens
gtcgggagagg

SEQ ID NO: 4717339 - DNA, 22 bp, Homo sapiens
gtcgggagaggggacgcaggcc

SEQ ID NO: 4717340 - DNA, 13 bp, Homo sapiens
gtcgttgtgaggg

SEQ ID NO: 4717341 - DNA, 13 bp, Homo sapiens
gtctaaatttctt

SEQ ID NO: 4717342 - DNA, 20 bp, Homo sapiens
gtctacctgaggggcctctt

SEQ ID NO: 4717343 - DNA, 23 bp, Homo sapiens
gtctaggcaggacctgtggccaa

SEQ ID NO: 4717344 - DNA, 12 bp, Homo sapiens
gtctagtagaac

SEQ ID NO: 4717345 - DNA, 14 bp, Homo sapiens
gtctatgggactca

SEQ ID NO: 4717346 - DNA, 15 bp, Homo sapiens
gtctatgggactcaa

SEQ ID NO: 4717347 - DNA, 14 bp, Homo sapiens
gtctcaaaaaaaca

SEQ ID NO: 4717348 - DNA, 19 bp, Homo sapiens
gtctcactatgttgcccag

SEQ ID NO: 4717349 - DNA, 20 bp, Homo sapiens
gtctcactatgttgcccagg

SEQ ID NO: 4717350 - DNA, 21 bp, Homo sapiens
gtctcactatgttgcccaggc

SEQ ID NO: 4717351 - DNA, 18 bp, Homo sapiens
gtctcactctgtcgccca

SEQ ID NO: 4717352 - DNA, 22 bp, Homo sapiens
gtctcactctgtcgcccagtct

SEQ ID NO: 4717353 - DNA, 19 bp, Homo sapiens
gtctcactgttgcccaggc

SEQ ID NO: 4717354 - DNA, 21 bp, Homo sapiens
gtctcactgttgcccaggctg

SEQ ID NO: 4717355 - DNA, 20 bp, Homo sapiens
gtctccaaccccccagcact

SEQ ID NO: 4717356 - DNA, 22 bp, Homo sapiens
gtctccaaccccccagcactga

SEQ ID NO: 4717357 - DNA, 22 bp, Homo sapiens
gtctcccactgcaacttgtgaa

SEQ ID NO: 4717358 - DNA, 14 bp, Homo sapiens
gtctccctggccct

SEQ ID NO: 4717359 - DNA, 14 bp, Homo sapiens
gtctcctccaccgc

SEQ ID NO: 4717360 - DNA, 18 bp, Homo sapiens
gtctcgaatgtaattgga

SEQ ID NO: 4717361 - DNA, 17 bp, Homo sapiens
gtctcgctgatgctggg

SEQ ID NO: 4717362 - DNA, 16 bp, Homo sapiens
gtctcggtggtaccag

SEQ ID NO: 4717363 - DNA, 19 bp, Homo sapiens
gtctcgtggtaggactgta

SEQ ID NO: 4717364 - DNA, 19 bp, Homo sapiens
gtctctaagtgtaaaagta

SEQ ID NO: 4717365 - DNA, 17 bp, Homo sapiens
gtctctaggctggggaa

SEQ ID NO: 4717366 - DNA, 11 bp, Homo sapiens
gtctctgtgtg

SEQ ID NO: 4717367 - DNA, 19 bp, Homo sapiens
gtctctttaatgtcacagg

SEQ ID NO: 4717368 - DNA, 23 bp, Homo sapiens
gtctctttaatgtcacaggcagg

SEQ ID NO: 4717369 - DNA, 14 bp, Homo sapiens
gtctgaaggctggg

SEQ ID NO: 4717370 - DNA, 19 bp, Homo sapiens
gtctgaaggctgggttctg

SEQ ID NO: 4717371 - DNA, 14 bp, Homo sapiens
gtctgacaggcaat

SEQ ID NO: 4717372 - DNA, 18 bp, Homo sapiens
gtctgacaggcaatgctg

SEQ ID NO: 4717373 - DNA, 22 bp, Homo sapiens
gtctgacaggcaatgctggctg

SEQ ID NO: 4717374 - DNA, 14 bp, Homo sapiens
gtctgacccactgc

SEQ ID NO: 4717375 - DNA, 18 bp, Homo sapiens
gtctgaggaatccagacc

SEQ ID NO: 4717376 - DNA, 21 bp, Homo sapiens
gtctgaggaatccagacccgg

SEQ ID NO: 4717377 - DNA, 14 bp, Homo sapiens
gtctgagtaagaaa

SEQ ID NO: 4717378 - DNA, 20 bp, Homo sapiens
gtctgattcccaagctctgc

SEQ ID NO: 4717379 - DNA, 21 bp, Homo sapiens
gtctgattcccaagctctgct

SEQ ID NO: 4717380 - DNA, 16 bp, Homo sapiens
gtctgatttgtgatga

SEQ ID NO: 4717381 - DNA, 11 bp, Homo sapiens
gtctgggctga

SEQ ID NO: 4717382 - DNA, 13 bp, Homo sapiens
gtctgtcctggaa

SEQ ID NO: 4717383 - DNA, 18 bp, Homo sapiens
gtctgtgccattttgtat

SEQ ID NO: 4717384 - DNA, 15 bp, Homo sapiens
gtctgtgtgtgcctg

SEQ ID NO: 4717385 - DNA, 22 bp, Homo sapiens
gtcttaaactaaatgtgcaata

SEQ ID NO: 4717386 - DNA, 14 bp, Homo sapiens
gtcttaatgttgaa

SEQ ID NO: 4717387 - DNA, 19 bp, Homo sapiens
gtcttatatattgtagata

SEQ ID NO: 4717388 - DNA, 16 bp, Homo sapiens
gtcttatcaactggtt

SEQ ID NO: 4717389 - DNA, 13 bp, Homo sapiens
gtcttctccccag

SEQ ID NO: 4717390 - DNA, 20 bp, Homo sapiens
gtcttgcaatggcagccttg

SEQ ID NO: 4717391 - DNA, 21 bp, Homo sapiens
gtcttgcaatggcagccttgg

SEQ ID NO: 4717392 - DNA, 23 bp, Homo sapiens
gtcttgcaatggcagccttggca

SEQ ID NO: 4717393 - DNA, 21 bp, Homo sapiens
gtctttactccatgaagggtc

SEQ ID NO: 4717394 - DNA, 17 bp, Homo sapiens
gtctttggaccctgagg

SEQ ID NO: 4717395 - DNA, 15 bp, Homo sapiens
gtctttgtaagagtg

SEQ ID NO: 4717396 - DNA, 14 bp, Homo sapiens
gtcttttcttgcat

SEQ ID NO: 4717397 - DNA, 18 bp, Homo sapiens
gtgaaaatgtaattataa

SEQ ID NO: 4717398 - DNA, 16 bp, Homo sapiens
gtgaaaatgtgtgtgt

SEQ ID NO: 4717399 - DNA, 14 bp, Homo sapiens
gtgaaacctttttt

SEQ ID NO: 4717400 - DNA, 20 bp, Homo sapiens
gtgaaagcatcacttgggat

SEQ ID NO: 4717401 - DNA, 21 bp, Homo sapiens
gtgaaccaccacacccagccc

SEQ ID NO: 4717402 - DNA, 19 bp, Homo sapiens
gtgaatattgtggctccct

SEQ ID NO: 4717403 - DNA, 20 bp, Homo sapiens
gtgaatattgtggctccctg

SEQ ID NO: 4717404 - DNA, 18 bp, Homo sapiens
gtgaatcacgtaaagcta

SEQ ID NO: 4717405 - DNA, 14 bp, Homo sapiens
gtgacagaggcagc

SEQ ID NO: 4717406 - DNA, 15 bp, Homo sapiens
gtgacagaggcagcc

SEQ ID NO: 4717407 - DNA, 20 bp, Homo sapiens
gtgacagagtgagactctgt

SEQ ID NO: 4717408 - DNA, 19 bp, Homo sapiens
gtgacatgtcttttcttgc

SEQ ID NO: 4717409 - DNA, 15 bp, Homo sapiens
gtgacatgtgaaacc

SEQ ID NO: 4717410 - DNA, 20 bp, Homo sapiens
gtgacatgtgaaaccttttt

SEQ ID NO: 4717411 - DNA, 15 bp, Homo sapiens
gtgaccaatgtcttg

SEQ ID NO: 4717412 - DNA, 13 bp, Homo sapiens
gtgacctctgcct

SEQ ID NO: 4717413 - DNA, 14 bp, Homo sapiens
gtgacctctgcctg

SEQ ID NO: 4717414 - DNA, 18 bp, Homo sapiens
gtgactcgggctcctgtg

SEQ ID NO: 4717415 - DNA, 16 bp, Homo sapiens
gtgagacctgcccctc

SEQ ID NO: 4717416 - DNA, 23 bp, Homo sapiens
gtgagacctgcccctcctctctg

SEQ ID NO: 4717417 - DNA, 20 bp, Homo sapiens
gtgagactcgagaactttca

SEQ ID NO: 4717418 - DNA, 18 bp, Homo sapiens
gtgagactctgtctcaaa

SEQ ID NO: 4717419 - DNA, 18 bp, Homo sapiens
gtgagagcatgtgagggg

SEQ ID NO: 4717420 - DNA, 13 bp, Homo sapiens
gtgagagctgggt

SEQ ID NO: 4717421 - DNA, 15 bp, Homo sapiens
gtgagccaccgtgcc

SEQ ID NO: 4717422 - DNA, 15 bp, Homo sapiens
gtgagccactgcacc

SEQ ID NO: 4717423 - DNA, 14 bp, Homo sapiens
gtgaggccagggca

SEQ ID NO: 4717424 - DNA, 19 bp, Homo sapiens
gtgagtactacagtcctcc

SEQ ID NO: 4717425 - DNA, 23 bp, Homo sapiens
gtgagtactacagtcctcccatc

SEQ ID NO: 4717426 - DNA, 17 bp, Homo sapiens
gtgagtcaccaagccca

SEQ ID NO: 4717427 - DNA, 22 bp, Homo sapiens
gtgagtcgaggacagggaggtg

SEQ ID NO: 4717428 - DNA, 14 bp, Homo sapiens
gtgagtgatcactg

SEQ ID NO: 4717429 - DNA, 17 bp, Homo sapiens
gtgagtgatcactggta

SEQ ID NO: 4717430 - DNA, 18 bp, Homo sapiens
gtgagtgatcactggtat

SEQ ID NO: 4717431 - DNA, 14 bp, Homo sapiens
gtgagtggcatgtg

SEQ ID NO: 4717432 - DNA, 16 bp, Homo sapiens
gtgagtggcatgtggg

SEQ ID NO: 4717433 - DNA, 17 bp, Homo sapiens
gtgagttgatagcacag

SEQ ID NO: 4717434 - DNA, 23 bp, Homo sapiens
gtgataatacagatttgtaacat

SEQ ID NO: 4717435 - DNA, 19 bp, Homo sapiens
gtgatatggcagaagacac

SEQ ID NO: 4717436 - DNA, 19 bp, Homo sapiens
gtgatattgaccatgtgat

SEQ ID NO: 4717437 - DNA, 15 bp, Homo sapiens
gtgatcatctttgct

SEQ ID NO: 4717438 - DNA, 15 bp, Homo sapiens
gtgatccacccacct

SEQ ID NO: 4717439 - DNA, 23 bp, Homo sapiens
gtgatccacccacctcagcctcc

SEQ ID NO: 4717440 - DNA, 14 bp, Homo sapiens
gtgatccactcgcc

SEQ ID NO: 4717441 - DNA, 22 bp, Homo sapiens
gtgattatggacatcgatatga

SEQ ID NO: 4717442 - DNA, 20 bp, Homo sapiens
gtgattctcatgcctcagcc

SEQ ID NO: 4717443 - DNA, 16 bp, Homo sapiens
gtgattctcctgcctc

SEQ ID NO: 4717444 - DNA, 17 bp, Homo sapiens
gtgattctcctgcctca

SEQ ID NO: 4717445 - DNA, 23 bp, Homo sapiens
gtgattctcctgcctcagcctcc

SEQ ID NO: 4717446 - DNA, 12 bp, Homo sapiens
gtgatttacatg

SEQ ID NO: 4717447 - DNA, 22 bp, Homo sapiens
gtgatttcccgtggccccagcc

SEQ ID NO: 4717448 - DNA, 15 bp, Homo sapiens
gtgcaactcttgtat

SEQ ID NO: 4717449 - DNA, 17 bp, Homo sapiens
gtgcaattaactctgga

SEQ ID NO: 4717450 - DNA, 12 bp, Homo sapiens
gtgcacacacca

SEQ ID NO: 4717451 - DNA, 17 bp, Homo sapiens
gtgcacacaccagagcc

SEQ ID NO: 4717452 - DNA, 18 bp, Homo sapiens
gtgcacatctgtgtcttg

SEQ ID NO: 4717453 - DNA, 21 bp, Homo sapiens
gtgcacatgcacgtgtgtgca

SEQ ID NO: 4717454 - DNA, 17 bp, Homo sapiens
gtgcagatgaggttgct

SEQ ID NO: 4717455 - DNA, 18 bp, Homo sapiens
gtgcatgcagcatctaag

SEQ ID NO: 4717456 - DNA, 15 bp, Homo sapiens
gtgcatgcaggtctc

SEQ ID NO: 4717457 - DNA, 12 bp, Homo sapiens
gtgccagcccct

SEQ ID NO: 4717458 - DNA, 17 bp, Homo sapiens
gtgccagcccctgctgg

SEQ ID NO: 4717459 - DNA, 16 bp, Homo sapiens
gtgccaggaccagtca

SEQ ID NO: 4717460 - DNA, 22 bp, Homo sapiens
gtgccaggtttttggtctgacc

SEQ ID NO: 4717461 - DNA, 17 bp, Homo sapiens
gtgccagtcgcgctgcc

SEQ ID NO: 4717462 - DNA, 16 bp, Homo sapiens
gtgccatgtgccaggt

SEQ ID NO: 4717463 - DNA, 15 bp, Homo sapiens
gtgcccaagagtggg

SEQ ID NO: 4717464 - DNA, 19 bp, Homo sapiens
gtgcccatgggcactgctg

SEQ ID NO: 4717465 - DNA, 20 bp, Homo sapiens
gtgcccatgggcactgctgg

SEQ ID NO: 4717466 - DNA, 16 bp, Homo sapiens
gtgcccattcctcacc

SEQ ID NO: 4717467 - DNA, 17 bp, Homo sapiens
gtgcccattcctcacct

SEQ ID NO: 4717468 - DNA, 19 bp, Homo sapiens
gtgccccccatcctggccc

SEQ ID NO: 4717469 - DNA, 14 bp, Homo sapiens
gtgccgacagaagg

SEQ ID NO: 4717470 - DNA, 22 bp, Homo sapiens
gtgccgccgcctcgcccaccgc

SEQ ID NO: 4717471 - DNA, 15 bp, Homo sapiens
gtgcctgaagacccc

SEQ ID NO: 4717472 - DNA, 18 bp, Homo sapiens
gtgcctgaagaccccaga

SEQ ID NO: 4717473 - DNA, 12 bp, Homo sapiens
gtgcctgagccc

SEQ ID NO: 4717474 - DNA, 14 bp, Homo sapiens
gtgcctgagcccct

SEQ ID NO: 4717475 - DNA, 22 bp, Homo sapiens
gtgcctgggtggacatggcccc

SEQ ID NO: 4717476 - DNA, 21 bp, Homo sapiens
gtgcgatctgggttcactgca

SEQ ID NO: 4717477 - DNA, 15 bp, Homo sapiens
gtgcgtccacgagct

SEQ ID NO: 4717478 - DNA, 21 bp, Homo sapiens
gtgctacacccttttccagct

SEQ ID NO: 4717479 - DNA, 22 bp, Homo sapiens
gtgctaggaacactccttcaca

SEQ ID NO: 4717480 - DNA, 21 bp, Homo sapiens
gtgctatctcccccagcccca

SEQ ID NO: 4717481 - DNA, 22 bp, Homo sapiens
gtgctatctcccccagccccat

SEQ ID NO: 4717482 - DNA, 13 bp, Homo sapiens
gtgctctggacag

SEQ ID NO: 4717483 - DNA, 14 bp, Homo sapiens
gtgctctggacagg

SEQ ID NO: 4717484 - DNA, 15 bp, Homo sapiens
gtgctctggacaggc

SEQ ID NO: 4717485 - DNA, 17 bp, Homo sapiens
gtgctgagtctgaaggc

SEQ ID NO: 4717486 - DNA, 18 bp, Homo sapiens
gtgctgagtctgaaggct

SEQ ID NO: 4717487 - DNA, 12 bp, Homo sapiens
gtgctgccctgc

SEQ ID NO: 4717488 - DNA, 18 bp, Homo sapiens
gtgctgccctgcccacct

SEQ ID NO: 4717489 - DNA, 21 bp, Homo sapiens
gtgctgccctgcccacctggc

SEQ ID NO: 4717490 - DNA, 11 bp, Homo sapiens
gtgctgcctct

SEQ ID NO: 4717491 - DNA, 18 bp, Homo sapiens
gtgctgctaccctccctg

SEQ ID NO: 4717492 - DNA, 21 bp, Homo sapiens
gtgctgctaccctccctgctg

SEQ ID NO: 4717493 - DNA, 22 bp, Homo sapiens
gtgctgggattacaagcgtgag

SEQ ID NO: 4717494 - DNA, 20 bp, Homo sapiens
gtgctgggattacaggcgtg

SEQ ID NO: 4717495 - DNA, 18 bp, Homo sapiens
gtgctgtaatattgtaaa

SEQ ID NO: 4717496 - DNA, 23 bp, Homo sapiens
gtgctgttttctacccttggaaa

SEQ ID NO: 4717497 - DNA, 17 bp, Homo sapiens
gtgcttcgggcccttcc

SEQ ID NO: 4717498 - DNA, 15 bp, Homo sapiens
gtgcttggaggaagg

SEQ ID NO: 4717499 - DNA, 22 bp, Homo sapiens
gtggaaagataataaattgatt

SEQ ID NO: 4717500 - DNA, 16 bp, Homo sapiens
gtggaacgaaaatgaa

SEQ ID NO: 4717501 - DNA, 19 bp, Homo sapiens
gtggaagcttggggaagac

SEQ ID NO: 4717502 - DNA, 24 bp, Homo sapiens
gtggacacagctcttctccaggct

SEQ ID NO: 4717503 - DNA, 13 bp, Homo sapiens
gtggaggaaggat

SEQ ID NO: 4717504 - DNA, 19 bp, Homo sapiens
gtggaggaaggattgtaaa

SEQ ID NO: 4717505 - DNA, 20 bp, Homo sapiens
gtggaggaaggattgtaaaa

SEQ ID NO: 4717506 - DNA, 15 bp, Homo sapiens
gtggaggaggacact

SEQ ID NO: 4717507 - DNA, 14 bp, Homo sapiens
gtggaggaggcctg

SEQ ID NO: 4717508 - DNA, 17 bp, Homo sapiens
ggtggcaaggctgtgct

SEQ ID NO: 4717509 - DNA, 13 bp, Homo sapiens
ggtggcagctcac

SEQ ID NO: 4717510 - DNA, 15 bp, Homo sapiens
ggtggcagctgcggt

SEQ ID NO: 4717511 - DNA, 22 bp, Homo sapiens
ggtggcagtgggagctgcctgt

SEQ ID NO: 4717512 - DNA, 15 bp, Homo sapiens
ggtggccctctcccc

SEQ ID NO: 4717513 - DNA, 17 bp, Homo sapiens
ggtggcctcccaactca

SEQ ID NO: 4717514 - DNA, 23 bp, Homo sapiens
ggtggcctctccttgtggcctgg

SEQ ID NO: 4717515 - DNA, 19 bp, Homo sapiens
ggtggcgggtgcctgtaat

SEQ ID NO: 4717516 - DNA, 15 bp, Homo sapiens
ggtgggatcctccag

SEQ ID NO: 4717517 - DNA, 14 bp, Homo sapiens
ggtgggcttcccag

SEQ ID NO: 4717518 - DNA, 20 bp, Homo sapiens
ggtgggcttcccagtggctg

SEQ ID NO: 4717519 - DNA, 17 bp, Homo sapiens
ggtggggcagcttgagg

SEQ ID NO: 4717520 - DNA, 22 bp, Homo sapiens
ggtggggcccatggaggagaca

SEQ ID NO: 4717521 - DNA, 20 bp, Homo sapiens
ggtgggggtagggggctgga

SEQ ID NO: 4717522 - DNA, 14 bp, Homo sapiens
ggtgggtccatggg

SEQ ID NO: 4717523 - DNA, 22 bp, Homo sapiens
ggtggtaccaggtctcctccac

SEQ ID NO: 4717524 - DNA, 19 bp, Homo sapiens
ggtggtcactggaactcag

SEQ ID NO: 4717525 - DNA, 13 bp, Homo sapiens
ggtggtggagcca

SEQ ID NO: 4717526 - DNA, 21 bp, Homo sapiens
ggtggtgtctccaacccccca

SEQ ID NO: 4717527 - DNA, 16 bp, Homo sapiens
ggtgtaataagacata

SEQ ID NO: 4717528 - DNA, 17 bp, Homo sapiens
ggtgtcaagagggtctg

SEQ ID NO: 4717529 - DNA, 20 bp, Homo sapiens
ggtgtcgcgccttctccccc

SEQ ID NO: 4717530 - DNA, 19 bp, Homo sapiens
ggtgtctccaaccccccag

SEQ ID NO: 4717531 - DNA, 18 bp, Homo sapiens
ggtgtgatcgtctgactg

SEQ ID NO: 4717532 - DNA, 13 bp, Homo sapiens
ggtgtgctctgat

SEQ ID NO: 4717533 - DNA, 21 bp, Homo sapiens
ggtgttatcaccgtgggctcc

SEQ ID NO: 4717534 - DNA, 16 bp, Homo sapiens
ggttaagccctgaggg

SEQ ID NO: 4717535 - DNA, 17 bp, Homo sapiens
ggttaggcattgtggga

SEQ ID NO: 4717536 - DNA, 22 bp, Homo sapiens
ggttagtggatggaaggggctg

SEQ ID NO: 4717537 - DNA, 11 bp, Homo sapiens
ggttatttaac

SEQ ID NO: 4717538 - DNA, 19 bp, Homo sapiens
ggttcagctactttccatt

SEQ ID NO: 4717539 - DNA, 18 bp, Homo sapiens
ggttcagggttggcccct

SEQ ID NO: 4717540 - DNA, 16 bp, Homo sapiens
ggttcatcatccctcc

SEQ ID NO: 4717541 - DNA, 17 bp, Homo sapiens
ggttcatcatccctccc

SEQ ID NO: 4717542 - DNA, 20 bp, Homo sapiens
ggttcatcatccctccctgc

SEQ ID NO: 4717543 - DNA, 23 bp, Homo sapiens
ggttccagcaattctcctgcctc

SEQ ID NO: 4717544 - DNA, 24 bp, Homo sapiens
ggttccagcaattctcctgcctca

SEQ ID NO: 4717545 - DNA, 21 bp, Homo sapiens
ggttccctttgacgccatccc

SEQ ID NO: 4717546 - DNA, 23 bp, Homo sapiens
ggttccctttgacgccatcccag

SEQ ID NO: 4717547 - DNA, 15 bp, Homo sapiens
ggttccgcttggagc

SEQ ID NO: 4717548 - DNA, 19 bp, Homo sapiens
ggttccttcctctgagcct

SEQ ID NO: 4717549 - DNA, 20 bp, Homo sapiens
ggttccttcctctgagcctt

SEQ ID NO: 4717550 - DNA, 17 bp, Homo sapiens
ggttctaatattcacat

SEQ ID NO: 4717551 - DNA, 15 bp, Homo sapiens
ggttctcaattctgt

SEQ ID NO: 4717552 - DNA, 12 bp, Homo sapiens
ggttctcatctt

SEQ ID NO: 4717553 - DNA, 21 bp, Homo sapiens
ggttgaggtccagccctggct

SEQ ID NO: 4717554 - DNA, 23 bp, Homo sapiens
ggttgaggtccagccctggctga

SEQ ID NO: 4717555 - DNA, 22 bp, Homo sapiens
ggttggaaaagaaatcaatttt

SEQ ID NO: 4717556 - DNA, 14 bp, Homo sapiens
ggttggagaaggag

SEQ ID NO: 4717557 - DNA, 18 bp, Homo sapiens
ggttggagaaggaggtaa

SEQ ID NO: 4717558 - DNA, 20 bp, Homo sapiens
ggttggcgcaccctcccctc

SEQ ID NO: 4717559 - DNA, 15 bp, Homo sapiens
ggtttacaacaaaca

SEQ ID NO: 4717560 - DNA, 18 bp, Homo sapiens
ggtttactcactgctgca

SEQ ID NO: 4717561 - DNA, 16 bp, Homo sapiens
ggtttcccttgccctt

SEQ ID NO: 4717562 - DNA, 15 bp, Homo sapiens
ggtttcctgccctgg

SEQ ID NO: 4717563 - DNA, 13 bp, Homo sapiens
ggtttctgaaaat

SEQ ID NO: 4717564 - DNA, 18 bp, Homo sapiens
ggtttgaatataaacact

SEQ ID NO: 4717565 - DNA, 19 bp, Homo sapiens
ggtttgaccaggaaagcag

SEQ ID NO: 4717566 - DNA, 20 bp, Homo sapiens
ggtttgtcagcctttctcct

SEQ ID NO: 4717567 - DNA, 18 bp, Homo sapiens
ggttttgtattctctgag

SEQ ID NO: 4717568 - DNA, 20 bp, Homo sapiens
ggttttttgtgtactttttg

SEQ ID NO: 4717569 - DNA, 20 bp, Homo sapiens
gtaaaaaaaaatgcctttga

SEQ ID NO: 4717570 - DNA, 13 bp, Homo sapiens
gtaaaaataaaat

SEQ ID NO: 4717571 - DNA, 18 bp, Homo sapiens
gtaaaaataaccttgcag

SEQ ID NO: 4717572 - DNA, 14 bp, Homo sapiens
gtaaaaatacacta

SEQ ID NO: 4717573 - DNA, 23 bp, Homo sapiens
gtaaaagaaaattttttttcaaa

SEQ ID NO: 4717574 - DNA, 22 bp, Homo sapiens
gtaaaagataaatttgttgaat

SEQ ID NO: 4717575 - DNA, 19 bp, Homo sapiens
gtaaaatcttcagctggtg

SEQ ID NO: 4717576 - DNA, 15 bp, Homo sapiens
gtaaaatggaggtgg

SEQ ID NO: 4717577 - DNA, 19 bp, Homo sapiens
gtaaacataccaacatgtt

SEQ ID NO: 4717578 - DNA, 24 bp, Homo sapiens
gtaaactgtgcaccaagcaggaaa

SEQ ID NO: 4717579 - DNA, 16 bp, Homo sapiens
gtaaagctagaaatga

SEQ ID NO: 4717580 - DNA, 20 bp, Homo sapiens
gtaaagggcgcaaagggcat

SEQ ID NO: 4717581 - DNA, 17 bp, Homo sapiens
gtaaatacatgcatata

SEQ ID NO: 4717582 - DNA, 18 bp, Homo sapiens
gtaaatactggactcagg

SEQ ID NO: 4717583 - DNA, 19 bp, Homo sapiens
gtaaatactggactcagga

SEQ ID NO: 4717584 - DNA, 22 bp, Homo sapiens
gtaaatactggactcaggaact

SEQ ID NO: 4717585 - DNA, 22 bp, Homo sapiens
gtaaatagacagcctttctgct

SEQ ID NO: 4717586 - DNA, 15 bp, Homo sapiens
gtaaatctgaagaaa

SEQ ID NO: 4717587 - DNA, 23 bp, Homo sapiens
gtaaatgaagggtcatttctctt

SEQ ID NO: 4717588 - DNA, 13 bp, Homo sapiens
gtaaatgttatga

SEQ ID NO: 4717589 - DNA, 14 bp, Homo sapiens
gtaacagaacagct

SEQ ID NO: 4717590 - DNA, 23 bp, Homo sapiens
gtaacctaccccatgaagatatt

SEQ ID NO: 4717591 - DNA, 20 bp, Homo sapiens
gtaacctcttcagaggccct

SEQ ID NO: 4717592 - DNA, 19 bp, Homo sapiens
gtaacttccaaataaataa

SEQ ID NO: 4717593 - DNA, 14 bp, Homo sapiens
gtaagagtgtagaa

SEQ ID NO: 4717594 - DNA, 17 bp, Homo sapiens
gtaagagtgtagaagca

SEQ ID NO: 4717595 - DNA, 23 bp, Homo sapiens
gtaaggaatacctgtccccctga

SEQ ID NO: 4717596 - DNA, 18 bp, Homo sapiens
gtaaggatccggaaagaa

SEQ ID NO: 4717597 - DNA, 13 bp, Homo sapiens
gtaagtttcaggt

SEQ ID NO: 4717598 - DNA, 14 bp, Homo sapiens
gtaagtttcaggtg

SEQ ID NO: 4717599 - DNA, 16 bp, Homo sapiens
gtaagtttcaggtgac

SEQ ID NO: 4717600 - DNA, 22 bp, Homo sapiens
gtaagtttcaggtgacatgtga

SEQ ID NO: 4717601 - DNA, 12 bp, Homo sapiens
gtaataaatact

SEQ ID NO: 4717602 - DNA, 13 bp, Homo sapiens
gtaataaatactg

SEQ ID NO: 4717603 - DNA, 19 bp, Homo sapiens
gtaataagacataacgttt

SEQ ID NO: 4717604 - DNA, 23 bp, Homo sapiens
gtaataagacataacgtttttcc

SEQ ID NO: 4717605 - DNA, 13 bp, Homo sapiens
gtaatatctttaa

SEQ ID NO: 4717606 - DNA, 19 bp, Homo sapiens
gtaatattctctgatgttt

SEQ ID NO: 4717607 - DNA, 20 bp, Homo sapiens
gtaatattgtaaatactgga

SEQ ID NO: 4717608 - DNA, 12 bp, Homo sapiens
gtaattattgtg

SEQ ID NO: 4717609 - DNA, 23 bp, Homo sapiens
gtaattggaatcttcacctcaga

SEQ ID NO: 4717610 - DNA, 15 bp, Homo sapiens
gtaattgtgtggatt

SEQ ID NO: 4717611 - DNA, 21 bp, Homo sapiens
gtaatttttttaatttacaaa

SEQ ID NO: 4717612 - DNA, 19 bp, Homo sapiens
gtacaaatgtgataatata

SEQ ID NO: 4717613 - DNA, 13 bp, Homo sapiens
gtacagtcttgta

SEQ ID NO: 4717614 - DNA, 13 bp, Homo sapiens
gtacataaaattt

SEQ ID NO: 4717615 - DNA, 20 bp, Homo sapiens
gtaccaaatctgacatatta

SEQ ID NO: 4717616 - DNA, 18 bp, Homo sapiens
gtaccaggtctcctccac

SEQ ID NO: 4717617 - DNA, 17 bp, Homo sapiens
gtacccccgcccaggct

SEQ ID NO: 4717618 - DNA, 19 bp, Homo sapiens
gtacccccgcccaggctgg

SEQ ID NO: 4717619 - DNA, 23 bp, Homo sapiens
gtaccgccttgcacactcagaag

SEQ ID NO: 4717620 - DNA, 17 bp, Homo sapiens
gtacgtctgacaggcaa

SEQ ID NO: 4717621 - DNA, 18 bp, Homo sapiens
gtactacagtcctcccat

SEQ ID NO: 4717622 - DNA, 15 bp, Homo sapiens
gtacttctccaccct

SEQ ID NO: 4717623 - DNA, 20 bp, Homo sapiens
gtacttctccaccctgctct

SEQ ID NO: 4717624 - DNA, 23 bp, Homo sapiens
gtactttattttctataatttaa

SEQ ID NO: 4717625 - DNA, 15 bp, Homo sapiens
gtagaaaaataaaga

SEQ ID NO: 4717626 - DNA, 15 bp, Homo sapiens
gtagaaactgcaggg

SEQ ID NO: 4717627 - DNA, 19 bp, Homo sapiens
gtagaaactgcagggaaaa

SEQ ID NO: 4717628 - DNA, 21 bp, Homo sapiens
gtagaaagacagagctgggat

SEQ ID NO: 4717629 - DNA, 22 bp, Homo sapiens
gtagaacacaaggtcatttgct

SEQ ID NO: 4717630 - DNA, 18 bp, Homo sapiens
gtagaagcattccttctt

SEQ ID NO: 4717631 - DNA, 22 bp, Homo sapiens
gtagacaagcaattagacaaga

SEQ ID NO: 4717632 - DNA, 11 bp, Homo sapiens
gtagagacagg

SEQ ID NO: 4717633 - DNA, 13 bp, Homo sapiens
gtagagacagggt

SEQ ID NO: 4717634 - DNA, 15 bp, Homo sapiens
gtagagccagggtct

SEQ ID NO: 4717635 - DNA, 21 bp, Homo sapiens
gtagagctagaacatggagag

SEQ ID NO: 4717636 - DNA, 12 bp, Homo sapiens
gtagagttaaga

SEQ ID NO: 4717637 - DNA, 16 bp, Homo sapiens
gtagagttaagaagct

SEQ ID NO: 4717638 - DNA, 20 bp, Homo sapiens
gtagattatggcctttttaa

SEQ ID NO: 4717639 - DNA, 17 bp, Homo sapiens
gtagcaaccctgtgata

SEQ ID NO: 4717640 - DNA, 15 bp, Homo sapiens
gtagccatgggacca

SEQ ID NO: 4717641 - DNA, 15 bp, Homo sapiens
gtagcctctctttgt

SEQ ID NO: 4717642 - DNA, 18 bp, Homo sapiens
gtagctgggactacaggc

SEQ ID NO: 4717643 - DNA, 21 bp, Homo sapiens
gtagctgggactacaggcacc

SEQ ID NO: 4717644 - DNA, 15 bp, Homo sapiens
gtaggaagtaggaag

SEQ ID NO: 4717645 - DNA, 15 bp, Homo sapiens
gtaggactgtagaaa

SEQ ID NO: 4717646 - DNA, 19 bp, Homo sapiens
gtaggctcaactagggagt

SEQ ID NO: 4717647 - DNA, 23 bp, Homo sapiens
gtagggcgggaggatgttctggg

SEQ ID NO: 4717648 - DNA, 16 bp, Homo sapiens
gtaggggttgaagaaa

SEQ ID NO: 4717649 - DNA, 17 bp, Homo sapiens
gtagggtgggccttcag

SEQ ID NO: 4717650 - DNA, 18 bp, Homo sapiens
gtagttgcaatagaacag

SEQ ID NO: 4717651 - DNA, 17 bp, Homo sapiens
gtataagatttttgaaa

SEQ ID NO: 4717652 - DNA, 15 bp, Homo sapiens
gtataatatttttaa

SEQ ID NO: 4717653 - DNA, 13 bp, Homo sapiens
gtataattttaaa

SEQ ID NO: 4717654 - DNA, 23 bp, Homo sapiens
gtatagaaatgctggtttttcag

SEQ ID NO: 4717655 - DNA, 23 bp, Homo sapiens
gtatatgggcttttacctgtgca

SEQ ID NO: 4717656 - DNA, 13 bp, Homo sapiens
gtatattaaaaaa

SEQ ID NO: 4717657 - DNA, 15 bp, Homo sapiens
gtatatttctgggtt

SEQ ID NO: 4717658 - DNA, 21 bp, Homo sapiens
gtatcaggacccagaggaagg

SEQ ID NO: 4717659 - DNA, 18 bp, Homo sapiens
gtatcaggtgctgccatc

SEQ ID NO: 4717660 - DNA, 19 bp, Homo sapiens
gtatcccatgagcctcagc

SEQ ID NO: 4717661 - DNA, 17 bp, Homo sapiens
gtatgaagacagaggca

SEQ ID NO: 4717662 - DNA, 18 bp, Homo sapiens
gtatggagctcagagagg

SEQ ID NO: 4717663 - DNA, 21 bp, Homo sapiens
gtatggatatgtgtaaatgtt

SEQ ID NO: 4717664 - DNA, 14 bp, Homo sapiens
gtatggtggctggg

SEQ ID NO: 4717665 - DNA, 22 bp, Homo sapiens
gtatgtacagttcataaatttg

SEQ ID NO: 4717666 - DNA, 23 bp, Homo sapiens
gtatgtatattaaaaaagagaca

SEQ ID NO: 4717667 - DNA, 15 bp, Homo sapiens
gtattacttctgcta

SEQ ID NO: 4717668 - DNA, 20 bp, Homo sapiens
gtattagccagtcattgtaa

SEQ ID NO: 4717669 - DNA, 21 bp, Homo sapiens
gtattatgtactctactgata

SEQ ID NO: 4717670 - DNA, 19 bp, Homo sapiens
gtattctctgagctgtgca

SEQ ID NO: 4717671 - DNA, 14 bp, Homo sapiens
gtattgtttacatt

SEQ ID NO: 4717672 - DNA, 19 bp, Homo sapiens
gtatttatttagtatttat

SEQ ID NO: 4717673 - DNA, 22 bp, Homo sapiens
gtatttggctatggatctgatt

SEQ ID NO: 4717674 - DNA, 15 bp, Homo sapiens
gtattttaatcctgt

SEQ ID NO: 4717675 - DNA, 14 bp, Homo sapiens
gtattttactaata

SEQ ID NO: 4717676 - DNA, 18 bp, Homo sapiens
gtattttgtattgtttca

SEQ ID NO: 4717677 - DNA, 12 bp, Homo sapiens
gtcaaaattaat

SEQ ID NO: 4717678 - DNA, 17 bp, Homo sapiens
gtcaaacgtgaaaatgc

SEQ ID NO: 4717679 - DNA, 22 bp, Homo sapiens
gtcaaatgcatacaagtttcat

SEQ ID NO: 4717680 - DNA, 14 bp, Homo sapiens
gtcaaatttacatt

SEQ ID NO: 4717681 - DNA, 17 bp, Homo sapiens
gtcaaatttacatttat

SEQ ID NO: 4717682 - DNA, 13 bp, Homo sapiens
gtcaacatttctc

SEQ ID NO: 4717683 - DNA, 15 bp, Homo sapiens
gtcaactttcatttg

SEQ ID NO: 4717684 - DNA, 16 bp, Homo sapiens
gtcaactttcatttga

SEQ ID NO: 4717685 - DNA, 18 bp, Homo sapiens
gtcaactttcatttgaaa

SEQ ID NO: 4717686 - DNA, 22 bp, Homo sapiens
gtcaatccaagagtctgatgat

SEQ ID NO: 4717687 - DNA, 17 bp, Homo sapiens
gtcaatctagttccaga

SEQ ID NO: 4717688 - DNA, 21 bp, Homo sapiens
gtcaatctagttccagagggt

SEQ ID NO: 4717689 - DNA, 23 bp, Homo sapiens
gtcaattctgatgttactgagat

SEQ ID NO: 4717690 - DNA, 16 bp, Homo sapiens
gtcacacactttggct

SEQ ID NO: 4717691 - DNA, 14 bp, Homo sapiens
gtcacacagggcag

SEQ ID NO: 4717692 - DNA, 19 bp, Homo sapiens
gtcacacattacaaagtta

SEQ ID NO: 4717693 - DNA, 16 bp, Homo sapiens
gtcacagctcttgttt

SEQ ID NO: 4717694 - DNA, 16 bp, Homo sapiens
gtcacaggagggaggg

SEQ ID NO: 4717695 - DNA, 12 bp, Homo sapiens
gtcaccaagccc

SEQ ID NO: 4717696 - DNA, 15 bp, Homo sapiens
gtcaccaagcccagt

SEQ ID NO: 4717697 - DNA, 18 bp, Homo sapiens
gtcaccccggccacctgc

SEQ ID NO: 4717698 - DNA, 21 bp, Homo sapiens
gtcactccaaggatcagaagt

SEQ ID NO: 4717699 - DNA, 12 bp, Homo sapiens
gtcactctggca

SEQ ID NO: 4717700 - DNA, 16 bp, Homo sapiens
gtcactgagacagccc

SEQ ID NO: 4717701 - DNA, 20 bp, Homo sapiens
gtcactggctgcctccactc

SEQ ID NO: 4717702 - DNA, 14 bp, Homo sapiens
gtcagagcctgcag

SEQ ID NO: 4717703 - DNA, 16 bp, Homo sapiens
gtcagctgaccccctc

SEQ ID NO: 4717704 - DNA, 19 bp, Homo sapiens
gtcagctgaccccctcccc

SEQ ID NO: 4717705 - DNA, 20 bp, Homo sapiens
gtcagctgaccccctccccc

SEQ ID NO: 4717706 - DNA, 22 bp, Homo sapiens
gtcagctgaccccctcccccca

SEQ ID NO: 4717707 - DNA, 23 bp, Homo sapiens
gtcaggattgcgagagatgtgtg

SEQ ID NO: 4717708 - DNA, 18 bp, Homo sapiens
gtcaggtggggcagcttg

SEQ ID NO: 4717709 - DNA, 22 bp, Homo sapiens
gtcaggtggggcagcttgaggg

SEQ ID NO: 4717710 - DNA, 16 bp, Homo sapiens
gtcagttgttatttat

SEQ ID NO: 4717711 - DNA, 17 bp, Homo sapiens
gtcataactagaactga

SEQ ID NO: 4717712 - DNA, 15 bp, Homo sapiens
gtcataccaatgaaa

SEQ ID NO: 4717713 - DNA, 16 bp, Homo sapiens
gtcatctcagctggat

SEQ ID NO: 4717714 - DNA, 17 bp, Homo sapiens
gtcatgcaaaggctggg

SEQ ID NO: 4717715 - DNA, 18 bp, Homo sapiens
gtcatgcaaaggctggga

SEQ ID NO: 4717716 - DNA, 14 bp, Homo sapiens
gtcatgcataaata

SEQ ID NO: 4717717 - DNA, 16 bp, Homo sapiens
gtcatgtgcatctggt

SEQ ID NO: 4717718 - DNA, 14 bp, Homo sapiens
gtcattatttaaag

SEQ ID NO: 4717719 - DNA, 20 bp, Homo sapiens
gtcatttagagtttcacaga

SEQ ID NO: 4717720 - DNA, 19 bp, Homo sapiens
gtcatttgagcagggctca

SEQ ID NO: 4717721 - DNA, 13 bp, Homo sapiens
gtccaagaagccc

SEQ ID NO: 4717722 - DNA, 16 bp, Homo sapiens
gtccaagaagcccagg

SEQ ID NO: 4717723 - DNA, 18 bp, Homo sapiens
gtccaagaagcccaggaa

SEQ ID NO: 4717724 - DNA, 22 bp, Homo sapiens
gtccaaggaaaccacagctgct

SEQ ID NO: 4717725 - DNA, 21 bp, Homo sapiens
gtccaattaatgaagttgatt

SEQ ID NO: 4717726 - DNA, 15 bp, Homo sapiens
gtccacaacacacag

SEQ ID NO: 4717727 - DNA, 16 bp, Homo sapiens
gtccacagtggaacca

SEQ ID NO: 4717728 - DNA, 16 bp, Homo sapiens
gtccacccaggagccc

SEQ ID NO: 4717729 - DNA, 18 bp, Homo sapiens
ggctaatttttgttttgt

SEQ ID NO: 4717730 - DNA, 16 bp, Homo sapiens
ggctacaaaggaggac

SEQ ID NO: 4717731 - DNA, 17 bp, Homo sapiens
ggctacaaaggaggaca

SEQ ID NO: 4717732 - DNA, 16 bp, Homo sapiens
ggctagaacctggagg

SEQ ID NO: 4717733 - DNA, 18 bp, Homo sapiens
ggctagaatatcctactt

SEQ ID NO: 4717734 - DNA, 21 bp, Homo sapiens
ggctatcaaaagaaatagaaa

SEQ ID NO: 4717735 - DNA, 20 bp, Homo sapiens
ggctattttctaaagacttg

SEQ ID NO: 4717736 - DNA, 15 bp, Homo sapiens
ggctcaagtcctctt

SEQ ID NO: 4717737 - DNA, 14 bp, Homo sapiens
ggctcacactgaga

SEQ ID NO: 4717738 - DNA, 15 bp, Homo sapiens
ggctcacactgagaa

SEQ ID NO: 4717739 - DNA, 14 bp, Homo sapiens
ggctcagagaggac

SEQ ID NO: 4717740 - DNA, 17 bp, Homo sapiens
ggctcagagaggacaaa

SEQ ID NO: 4717741 - DNA, 23 bp, Homo sapiens
ggctcagagaggacaaaataaag

SEQ ID NO: 4717742 - DNA, 12 bp, Homo sapiens
ggctcagccagg

SEQ ID NO: 4717743 - DNA, 22 bp, Homo sapiens
ggctcagcggggacagctcctt

SEQ ID NO: 4717744 - DNA, 13 bp, Homo sapiens
ggctccagagggc

SEQ ID NO: 4717745 - DNA, 18 bp, Homo sapiens
ggctccaggagcagccac

SEQ ID NO: 4717746 - DNA, 19 bp, Homo sapiens
ggctccaggagcagccaca

SEQ ID NO: 4717747 - DNA, 12 bp, Homo sapiens
ggctccaggctc

SEQ ID NO: 4717748 - DNA, 13 bp, Homo sapiens
ggctccaggctcc

SEQ ID NO: 4717749 - DNA, 15 bp, Homo sapiens
ggctccaggctcctt

SEQ ID NO: 4717750 - DNA, 11 bp, Homo sapiens
ggctcctgctg

SEQ ID NO: 4717751 - DNA, 13 bp, Homo sapiens
ggctcctgctgca

SEQ ID NO: 4717752 - DNA, 14 bp, Homo sapiens
ggctcctgctgcac

SEQ ID NO: 4717753 - DNA, 16 bp, Homo sapiens
ggctcctgctgcacca

SEQ ID NO: 4717754 - DNA, 18 bp, Homo sapiens
ggctcgagcatgcctgga

SEQ ID NO: 4717755 - DNA, 18 bp, Homo sapiens
ggctcgttgactggctgt

SEQ ID NO: 4717756 - DNA, 16 bp, Homo sapiens
ggctctgagacacacc

SEQ ID NO: 4717757 - DNA, 12 bp, Homo sapiens
ggctctgccctt

SEQ ID NO: 4717758 - DNA, 17 bp, Homo sapiens
ggctcttccaggctggg

SEQ ID NO: 4717759 - DNA, 18 bp, Homo sapiens
ggctcttccaggctggga

SEQ ID NO: 4717760 - DNA, 22 bp, Homo sapiens
ggctcttctcatttcacccctc

SEQ ID NO: 4717761 - DNA, 16 bp, Homo sapiens
ggctgaatagcagaag

SEQ ID NO: 4717762 - DNA, 17 bp, Homo sapiens
ggctgaggcaggagaat

SEQ ID NO: 4717763 - DNA, 16 bp, Homo sapiens
ggctgagggagcctgg

SEQ ID NO: 4717764 - DNA, 22 bp, Homo sapiens
ggctgcaaagggtatcaggtgc

SEQ ID NO: 4717765 - DNA, 24 bp, Homo sapiens
ggctgcaaagggtatcaggtgctg

SEQ ID NO: 4717766 - DNA, 18 bp, Homo sapiens
ggctgcaccggctggcct

SEQ ID NO: 4717767 - DNA, 15 bp, Homo sapiens
ggctgcactctgtgc

SEQ ID NO: 4717768 - DNA, 13 bp, Homo sapiens
ggctgcagggagt

SEQ ID NO: 4717769 - DNA, 18 bp, Homo sapiens
ggctgcccgctcccagtg

SEQ ID NO: 4717770 - DNA, 14 bp, Homo sapiens
ggctgctgaaggct

SEQ ID NO: 4717771 - DNA, 17 bp, Homo sapiens
ggctgctgaaggctcga

SEQ ID NO: 4717772 - DNA, 18 bp, Homo sapiens
ggctgctgaaggctcgag

SEQ ID NO: 4717773 - DNA, 23 bp, Homo sapiens
ggctggaacagattcacactgtc

SEQ ID NO: 4717774 - DNA, 18 bp, Homo sapiens
ggctggaatctggagagc

SEQ ID NO: 4717775 - DNA, 19 bp, Homo sapiens
ggctggaatctggagagct

SEQ ID NO: 4717776 - DNA, 17 bp, Homo sapiens
ggctggactgaggcctg

SEQ ID NO: 4717777 - DNA, 15 bp, Homo sapiens
ggctggaggagccca

SEQ ID NO: 4717778 - DNA, 14 bp, Homo sapiens
ggctggatgggggc

SEQ ID NO: 4717779 - DNA, 20 bp, Homo sapiens
ggctggatgggggctctgca

SEQ ID NO: 4717780 - DNA, 21 bp, Homo sapiens
ggctggatgggggctctgcac

SEQ ID NO: 4717781 - DNA, 22 bp, Homo sapiens
ggctggatgggggctctgcacc

SEQ ID NO: 4717782 - DNA, 11 bp, Homo sapiens
ggctggccagc

SEQ ID NO: 4717783 - DNA, 13 bp, Homo sapiens
ggctggccctgcc

SEQ ID NO: 4717784 - DNA, 14 bp, Homo sapiens
ggctggccctgccc

SEQ ID NO: 4717785 - DNA, 15 bp, Homo sapiens
ggctggccctgccct

SEQ ID NO: 4717786 - DNA, 15 bp, Homo sapiens
ggctggcctggcccc

SEQ ID NO: 4717787 - DNA, 17 bp, Homo sapiens
ggctggcctggcccctc

SEQ ID NO: 4717788 - DNA, 22 bp, Homo sapiens
ggctggcctggcccctcagggt

SEQ ID NO: 4717789 - DNA, 16 bp, Homo sapiens
ggctggcgtgcagtgg

SEQ ID NO: 4717790 - DNA, 14 bp, Homo sapiens
ggctgggagtggtg

SEQ ID NO: 4717791 - DNA, 17 bp, Homo sapiens
ggctgggcaaggaggcc

SEQ ID NO: 4717792 - DNA, 17 bp, Homo sapiens
ggctgggctcccttccc

SEQ ID NO: 4717793 - DNA, 20 bp, Homo sapiens
ggctgggctcccttcccacc

SEQ ID NO: 4717794 - DNA, 11 bp, Homo sapiens
ggctgggcttc

SEQ ID NO: 4717795 - DNA, 13 bp, Homo sapiens
ggctgggcttcag

SEQ ID NO: 4717796 - DNA, 22 bp, Homo sapiens
ggctgggcttcagtggcagctg

SEQ ID NO: 4717797 - DNA, 18 bp, Homo sapiens
ggctggggaagtcctctg

SEQ ID NO: 4717798 - DNA, 21 bp, Homo sapiens
ggctggggcctatcagtgtgc

SEQ ID NO: 4717799 - DNA, 14 bp, Homo sapiens
ggctgggtgcgacc

SEQ ID NO: 4717800 - DNA, 21 bp, Homo sapiens
ggctgggttctacccaggtgc

SEQ ID NO: 4717801 - DNA, 22 bp, Homo sapiens
ggctgggttctacccaggtgct

SEQ ID NO: 4717802 - DNA, 14 bp, Homo sapiens
ggctggtgcctgag

SEQ ID NO: 4717803 - DNA, 17 bp, Homo sapiens
ggctggtgcctgagccc

SEQ ID NO: 4717804 - DNA, 20 bp, Homo sapiens
ggctgtatcccatgagcctc

SEQ ID NO: 4717805 - DNA, 11 bp, Homo sapiens
ggctgtccagt

SEQ ID NO: 4717806 - DNA, 14 bp, Homo sapiens
ggctgtcccaagct

SEQ ID NO: 4717807 - DNA, 10 bp, Homo sapiens
ggctgtgaaa

SEQ ID NO: 4717808 - DNA, 20 bp, Homo sapiens
ggctgtgctccctggttctg

SEQ ID NO: 4717809 - DNA, 14 bp, Homo sapiens
ggctgttggctggg

SEQ ID NO: 4717810 - DNA, 18 bp, Homo sapiens
ggcttagctttgctctgc

SEQ ID NO: 4717811 - DNA, 18 bp, Homo sapiens
ggcttcactgtataaata

SEQ ID NO: 4717812 - DNA, 15 bp, Homo sapiens
ggcttcagtggcagc

SEQ ID NO: 4717813 - DNA, 16 bp, Homo sapiens
ggcttcagtggcagct

SEQ ID NO: 4717814 - DNA, 17 bp, Homo sapiens
ggcttcagtggcagctg

SEQ ID NO: 4717815 - DNA, 14 bp, Homo sapiens
ggcttccaaggtgg

SEQ ID NO: 4717816 - DNA, 19 bp, Homo sapiens
ggcttccaaggtggtctgc

SEQ ID NO: 4717817 - DNA, 17 bp, Homo sapiens
ggcttcccagtggctgc

SEQ ID NO: 4717818 - DNA, 19 bp, Homo sapiens
ggcttcccagtggctgctg

SEQ ID NO: 4717819 - DNA, 12 bp, Homo sapiens
ggcttgcctggg

SEQ ID NO: 4717820 - DNA, 15 bp, Homo sapiens
ggctttgttcttgtc

SEQ ID NO: 4717821 - DNA, 24 bp, Homo sapiens
ggctttgttcttgtcatcagtaag

SEQ ID NO: 4717822 - DNA, 14 bp, Homo sapiens
gggaaatggtgcct

SEQ ID NO: 4717823 - DNA, 18 bp, Homo sapiens
gggaacatatttaaggaa

SEQ ID NO: 4717824 - DNA, 16 bp, Homo sapiens
gggaagaaagagaagg

SEQ ID NO: 4717825 - DNA, 18 bp, Homo sapiens
gggaagagcacagccctc

SEQ ID NO: 4717826 - DNA, 20 bp, Homo sapiens
gggaagagcacagccctccc

SEQ ID NO: 4717827 - DNA, 22 bp, Homo sapiens
gggaaggcagggagggcctggg

SEQ ID NO: 4717828 - DNA, 15 bp, Homo sapiens
gggaagttcagcaag

SEQ ID NO: 4717829 - DNA, 16 bp, Homo sapiens
gggaatgaacctggag

SEQ ID NO: 4717830 - DNA, 22 bp, Homo sapiens
gggacagagggggtggcctccc

SEQ ID NO: 4717831 - DNA, 23 bp, Homo sapiens
gggacagagggggtggcctccca

SEQ ID NO: 4717832 - DNA, 12 bp, Homo sapiens
gggacagctcct

SEQ ID NO: 4717833 - DNA, 19 bp, Homo sapiens
gggaccacagcaaggcacc

SEQ ID NO: 4717834 - DNA, 22 bp, Homo sapiens
gggaccacagcaaggcacctgc

SEQ ID NO: 4717835 - DNA, 14 bp, Homo sapiens
gggaccctgggtgg

SEQ ID NO: 4717836 - DNA, 12 bp, Homo sapiens
gggacgcaggcc

SEQ ID NO: 4717837 - DNA, 21 bp, Homo sapiens
gggacgcaggcccctctcctc

SEQ ID NO: 4717838 - DNA, 19 bp, Homo sapiens
gggacgcggcaggcttctc

SEQ ID NO: 4717839 - DNA, 16 bp, Homo sapiens
gggactcaatgcactg

SEQ ID NO: 4717840 - DNA, 17 bp, Homo sapiens
gggactcaatgcactga

SEQ ID NO: 4717841 - DNA, 20 bp, Homo sapiens
gggactcaatttctccccag

SEQ ID NO: 4717842 - DNA, 23 bp, Homo sapiens
gggacttggaagctccgctttct

SEQ ID NO: 4717843 - DNA, 14 bp, Homo sapiens
gggagaagaagaat

SEQ ID NO: 4717844 - DNA, 13 bp, Homo sapiens
gggagagcccagg

SEQ ID NO: 4717845 - DNA, 16 bp, Homo sapiens
gggagagcccaggagc

SEQ ID NO: 4717846 - DNA, 17 bp, Homo sapiens
gggagagtgcaggcctg

SEQ ID NO: 4717847 - DNA, 21 bp, Homo sapiens
gggagctgcctgttcagctcc

SEQ ID NO: 4717848 - DNA, 18 bp, Homo sapiens
gggaggcacttcctcccc

SEQ ID NO: 4717849 - DNA, 11 bp, Homo sapiens
gggagggcagc

SEQ ID NO: 4717850 - DNA, 11 bp, Homo sapiens
gggagggctcc

SEQ ID NO: 4717851 - DNA, 14 bp, Homo sapiens
gggagggctccaga

SEQ ID NO: 4717852 - DNA, 17 bp, Homo sapiens
gggagggctccagacac

SEQ ID NO: 4717853 - DNA, 13 bp, Homo sapiens
gggagggggcaga

SEQ ID NO: 4717854 - DNA, 15 bp, Homo sapiens
gggagggggcagaag

SEQ ID NO: 4717855 - DNA, 20 bp, Homo sapiens
gggaggtgggatcctccagg

SEQ ID NO: 4717856 - DNA, 17 bp, Homo sapiens
gggagtgacagaggcag

SEQ ID NO: 4717857 - DNA, 21 bp, Homo sapiens
gggagtgagttgatagcacag

SEQ ID NO: 4717858 - DNA, 13 bp, Homo sapiens
gggatagagagag

SEQ ID NO: 4717859 - DNA, 22 bp, Homo sapiens
gggatgatgccacaccaagctg

SEQ ID NO: 4717860 - DNA, 14 bp, Homo sapiens
gggattacaggcgt

SEQ ID NO: 4717861 - DNA, 14 bp, Homo sapiens
gggcaaagcctagt

SEQ ID NO: 4717862 - DNA, 20 bp, Homo sapiens
gggcaacccccagcctgcta

SEQ ID NO: 4717863 - DNA, 22 bp, Homo sapiens
gggcactgctgggtggcccatc

SEQ ID NO: 4717864 - DNA, 17 bp, Homo sapiens
gggcagagcagagacca

SEQ ID NO: 4717865 - DNA, 22 bp, Homo sapiens
gggcagagcagagaccatccct

SEQ ID NO: 4717866 - DNA, 23 bp, Homo sapiens
gggcagagcagagaccatccctg

SEQ ID NO: 4717867 - DNA, 12 bp, Homo sapiens
gggcagagccca

SEQ ID NO: 4717868 - DNA, 12 bp, Homo sapiens
gggcagagtcac

SEQ ID NO: 4717869 - DNA, 17 bp, Homo sapiens
gggcagagtgagaccca

SEQ ID NO: 4717870 - DNA, 13 bp, Homo sapiens
gggcagcacagca

SEQ ID NO: 4717871 - DNA, 14 bp, Homo sapiens
gggcagcacagcaa

SEQ ID NO: 4717872 - DNA, 23 bp, Homo sapiens
gggcaggactcagctccccagag

SEQ ID NO: 4717873 - DNA, 17 bp, Homo sapiens
gggcaggcacagcacag

SEQ ID NO: 4717874 - DNA, 15 bp, Homo sapiens
gggcaggcatgaagt

SEQ ID NO: 4717875 - DNA, 22 bp, Homo sapiens
gggcaggccctgcactgtcctg

SEQ ID NO: 4717876 - DNA, 23 bp, Homo sapiens
gggcaggccctgcactgtcctgc

SEQ ID NO: 4717877 - DNA, 20 bp, Homo sapiens
gggcagtggtgtggagaagc

SEQ ID NO: 4717878 - DNA, 22 bp, Homo sapiens
gggcatagatgcaggtgagccc

SEQ ID NO: 4717879 - DNA, 20 bp, Homo sapiens
gggcatgacccagtgaagat

SEQ ID NO: 4717880 - DNA, 21 bp, Homo sapiens
gggcatgacccagtgaagatg

SEQ ID NO: 4717881 - DNA, 22 bp, Homo sapiens
gggcatgggtcgggagagggga

SEQ ID NO: 4717882 - DNA, 13 bp, Homo sapiens
gggccaagcccag

SEQ ID NO: 4717883 - DNA, 23 bp, Homo sapiens
gggccacagagaaagtacttctc

SEQ ID NO: 4717884 - DNA, 22 bp, Homo sapiens
gggccacttctgggtggggcag

SEQ ID NO: 4717885 - DNA, 17 bp, Homo sapiens
gggccatactggcctcg

SEQ ID NO: 4717886 - DNA, 20 bp, Homo sapiens
gggcccaggccatcttccag

SEQ ID NO: 4717887 - DNA, 12 bp, Homo sapiens
gggcccggacgc

SEQ ID NO: 4717888 - DNA, 19 bp, Homo sapiens
gggcccgggcgcggggagg

SEQ ID NO: 4717889 - DNA, 21 bp, Homo sapiens
gggcccgttgtctccctggcc

SEQ ID NO: 4717890 - DNA, 13 bp, Homo sapiens
gggccctgcctcc

SEQ ID NO: 4717891 - DNA, 21 bp, Homo sapiens
gggccggccaggtgggcgggc

SEQ ID NO: 4717892 - DNA, 13 bp, Homo sapiens
gggcctcagtgcc

SEQ ID NO: 4717893 - DNA, 15 bp, Homo sapiens
gggcctcctgtgtgt

SEQ ID NO: 4717894 - DNA, 18 bp, Homo sapiens
gggcctcttatgggctgg

SEQ ID NO: 4717895 - DNA, 20 bp, Homo sapiens
gggcctcttatgggctgggt

SEQ ID NO: 4717896 - DNA, 16 bp, Homo sapiens
gggcctgatggggagg

SEQ ID NO: 4717897 - DNA, 13 bp, Homo sapiens
gggcctgccacct

SEQ ID NO: 4717898 - DNA, 18 bp, Homo sapiens
gggcctgccacctggacc

SEQ ID NO: 4717899 - DNA, 18 bp, Homo sapiens
gggcctggcctgagctgg

SEQ ID NO: 4717900 - DNA, 16 bp, Homo sapiens
gggcctggctcaggtg

SEQ ID NO: 4717901 - DNA, 16 bp, Homo sapiens
gggcctttggcaggtg

SEQ ID NO: 4717902 - DNA, 21 bp, Homo sapiens
gggcggccagccctcccagca

SEQ ID NO: 4717903 - DNA, 15 bp, Homo sapiens
gggcgggcagcacag

SEQ ID NO: 4717904 - DNA, 20 bp, Homo sapiens
gggcgggcagcacagcaagg

SEQ ID NO: 4717905 - DNA, 18 bp, Homo sapiens
gggcgtgagacctgcccc

SEQ ID NO: 4717906 - DNA, 20 bp, Homo sapiens
gggctacaaaggaggacaag

SEQ ID NO: 4717907 - DNA, 21 bp, Homo sapiens
gggctacaaaggaggacaaga

SEQ ID NO: 4717908 - DNA, 20 bp, Homo sapiens
gggctaggaaatccagggtg

SEQ ID NO: 4717909 - DNA, 22 bp, Homo sapiens
gggctagtcttcccttacctca

SEQ ID NO: 4717910 - DNA, 15 bp, Homo sapiens
gggctagttgggctt

SEQ ID NO: 4717911 - DNA, 20 bp, Homo sapiens
gggctcagggaccacagcaa

SEQ ID NO: 4717912 - DNA, 13 bp, Homo sapiens
gggctccagacac

SEQ ID NO: 4717913 - DNA, 23 bp, Homo sapiens
gggctcccttcccacctctctca

SEQ ID NO: 4717914 - DNA, 12 bp, Homo sapiens
gggctcttctca

SEQ ID NO: 4717915 - DNA, 15 bp, Homo sapiens
gggctcttctcattt

SEQ ID NO: 4717916 - DNA, 14 bp, Homo sapiens
gggctgactgggac

SEQ ID NO: 4717917 - DNA, 13 bp, Homo sapiens
gggctgagggagc

SEQ ID NO: 4717918 - DNA, 20 bp, Homo sapiens
gggctgcaccggctggcctg

SEQ ID NO: 4717919 - DNA, 21 bp, Homo sapiens
gggctgcaccggctggcctgg

SEQ ID NO: 4717920 - DNA, 22 bp, Homo sapiens
gggctgcaccggctggcctggc

SEQ ID NO: 4717921 - DNA, 18 bp, Homo sapiens
gggctgcactctgtgccc

SEQ ID NO: 4717922 - DNA, 11 bp, Homo sapiens
gggctggaaca

SEQ ID NO: 4717923 - DNA, 18 bp, Homo sapiens
gggctggaatctggagag

SEQ ID NO: 4717924 - DNA, 19 bp, Homo sapiens
gggctggactgaggcctga

SEQ ID NO: 4717925 - DNA, 15 bp, Homo sapiens
gggctggaggagccc

SEQ ID NO: 4717926 - DNA, 16 bp, Homo sapiens
gggctggaggagccca

SEQ ID NO: 4717927 - DNA, 22 bp, Homo sapiens
gggctgggtgcgaccccatctg

SEQ ID NO: 4717928 - DNA, 16 bp, Homo sapiens
gggctgggttggcgca

SEQ ID NO: 4717929 - DNA, 23 bp, Homo sapiens
gggctgggttggcgcaccctccc

SEQ ID NO: 4717930 - DNA, 13 bp, Homo sapiens
gggctgtgcctgg

SEQ ID NO: 4717931 - DNA, 17 bp, Homo sapiens
gggcttcagtggcagct

SEQ ID NO: 4717932 - DNA, 15 bp, Homo sapiens
ggggaaaaaattaac

SEQ ID NO: 4717933 - DNA, 16 bp, Homo sapiens
ggggaagtgagaaggg

SEQ ID NO: 4717934 - DNA, 13 bp, Homo sapiens
ggggaccccaccc

SEQ ID NO: 4717935 - DNA, 15 bp, Homo sapiens
ggggaccccacccct

SEQ ID NO: 4717936 - DNA, 11 bp, Homo sapiens
ggggagaaagt

SEQ ID NO: 4717937 - DNA, 15 bp, Homo sapiens
ggggcaggcacagca

SEQ ID NO: 4717938 - DNA, 23 bp, Homo sapiens
ggggcaggccctgcactgtcctg

SEQ ID NO: 4717939 - DNA, 12 bp, Homo sapiens
ggggccagaggc

SEQ ID NO: 4717940 - DNA, 17 bp, Homo sapiens
ggggccagttggtcccc

SEQ ID NO: 4717941 - DNA, 19 bp, Homo sapiens
ggggcccgttgtctccctg

SEQ ID NO: 4717942 - DNA, 16 bp, Homo sapiens
ggggccctgcctcctt

SEQ ID NO: 4717943 - DNA, 15 bp, Homo sapiens
ggggcctcagtgcca

SEQ ID NO: 4717944 - DNA, 20 bp, Homo sapiens
ggggcctctgacgccgcgca

SEQ ID NO: 4717945 - DNA, 12 bp, Homo sapiens
ggggcctgccac

SEQ ID NO: 4717946 - DNA, 18 bp, Homo sapiens
ggggcctgccacctggac

SEQ ID NO: 4717947 - DNA, 20 bp, Homo sapiens
ggggcctgccacctggaccc

SEQ ID NO: 4717948 - DNA, 14 bp, Homo sapiens
ggggctcttctcat

SEQ ID NO: 4717949 - DNA, 23 bp, Homo sapiens
ggggctgcaccggctggcctggc

SEQ ID NO: 4717950 - DNA, 16 bp, Homo sapiens
ggggctgcccgctccc

SEQ ID NO: 4717951 - DNA, 23 bp, Homo sapiens
ggggctgcccgctcccagtgtct

SEQ ID NO: 4717952 - DNA, 21 bp, Homo sapiens
tccccaccgcagacaggacca

SEQ ID NO: 4717953 - DNA, 13 bp, Homo sapiens
tccccagattgca

SEQ ID NO: 4717954 - DNA, 18 bp, Homo sapiens
tccccagattgcaacagg

SEQ ID NO: 4717955 - DNA, 20 bp, Homo sapiens
tccccagattgcaacaggct

SEQ ID NO: 4717956 - DNA, 15 bp, Homo sapiens
tccccaggaggccag

SEQ ID NO: 4717957 - DNA, 18 bp, Homo sapiens
tccccaggaggccagcct

SEQ ID NO: 4717958 - DNA, 23 bp, Homo sapiens
tccccaggaggccagccttgacc

SEQ ID NO: 4717959 - DNA, 19 bp, Homo sapiens
tcccccaccccctccccgc

SEQ ID NO: 4717960 - DNA, 13 bp, Homo sapiens
tcccccagcccca

SEQ ID NO: 4717961 - DNA, 16 bp, Homo sapiens
tcccccagccccatcc

SEQ ID NO: 4717962 - DNA, 21 bp, Homo sapiens
tcccccgaacgctctgcacct

SEQ ID NO: 4717963 - DNA, 12 bp, Homo sapiens
tccccctctgtc

SEQ ID NO: 4717964 - DNA, 15 bp, Homo sapiens
tccccctctgtccag

SEQ ID NO: 4717965 - DNA, 23 bp, Homo sapiens
tccccctggccaccaccccccac

SEQ ID NO: 4717966 - DNA, 15 bp, Homo sapiens
tcccccttccatgga

SEQ ID NO: 4717967 - DNA, 22 bp, Homo sapiens
tcccctccaacctggggggcag

SEQ ID NO: 4717968 - DNA, 22 bp, Homo sapiens
tcccctcctacccctcccagct

SEQ ID NO: 4717969 - DNA, 19 bp, Homo sapiens
tcccctcgcccatcagtgc

SEQ ID NO: 4717970 - DNA, 12 bp, Homo sapiens
tcccctgccccc

SEQ ID NO: 4717971 - DNA, 13 bp, Homo sapiens
tcccctgccccca

SEQ ID NO: 4717972 - DNA, 18 bp, Homo sapiens
tcccctgccccctgcagg

SEQ ID NO: 4717973 - DNA, 14 bp, Homo sapiens
tcccctgctgggtg

SEQ ID NO: 4717974 - DNA, 24 bp, Homo sapiens
tcccctgctgggtgtggcgcagca

SEQ ID NO: 4717975 - DNA, 19 bp, Homo sapiens
tcccctggggacagcaagg

SEQ ID NO: 4717976 - DNA, 19 bp, Homo sapiens
tccccttctcatcactccc

SEQ ID NO: 4717977 - DNA, 15 bp, Homo sapiens
tccccttctctcatc

SEQ ID NO: 4717978 - DNA, 15 bp, Homo sapiens
tcccgaatagctggg

SEQ ID NO: 4717979 - DNA, 20 bp, Homo sapiens
tcccgaatagctgggactac

SEQ ID NO: 4717980 - DNA, 17 bp, Homo sapiens
tcccgagtagctgggac

SEQ ID NO: 4717981 - DNA, 18 bp, Homo sapiens
tcccgagtagctgggact

SEQ ID NO: 4717982 - DNA, 15 bp, Homo sapiens
tcccgccccttcccc

SEQ ID NO: 4717983 - DNA, 23 bp, Homo sapiens
tcccgtggaacgtttttcctgtt

SEQ ID NO: 4717984 - DNA, 22 bp, Homo sapiens
tcccgtggccccagcctggccc

SEQ ID NO: 4717985 - DNA, 23 bp, Homo sapiens
tcccgtggccccagcctggccca

SEQ ID NO: 4717986 - DNA, 14 bp, Homo sapiens
tccctaatgctgca

SEQ ID NO: 4717987 - DNA, 18 bp, Homo sapiens
tccctagaaacttccaaa

SEQ ID NO: 4717988 - DNA, 19 bp, Homo sapiens
tccctagaaacttccaaat

SEQ ID NO: 4717989 - DNA, 17 bp, Homo sapiens
tccctaggagagtttac

SEQ ID NO: 4717990 - DNA, 20 bp, Homo sapiens
tccctaggagagtttactga

SEQ ID NO: 4717991 - DNA, 16 bp, Homo sapiens
tccctcaattccccct

SEQ ID NO: 4717992 - DNA, 22 bp, Homo sapiens
tccctcccctggggacagcaag

SEQ ID NO: 4717993 - DNA, 14 bp, Homo sapiens
tccctcccttgggg

SEQ ID NO: 4717994 - DNA, 14 bp, Homo sapiens
tccctccgggacct

SEQ ID NO: 4717995 - DNA, 24 bp, Homo sapiens
tccctcctggccagatgtcgctgg

SEQ ID NO: 4717996 - DNA, 19 bp, Homo sapiens
tccctctcttgaccctgtc

SEQ ID NO: 4717997 - DNA, 18 bp, Homo sapiens
tccctgaaatttctcatt

SEQ ID NO: 4717998 - DNA, 11 bp, Homo sapiens
tccctgaaggc

SEQ ID NO: 4717999 - DNA, 18 bp, Homo sapiens
tccctgaaggccccgccc

SEQ ID NO: 4718000 - DNA, 23 bp, Homo sapiens
tccctgaaggccccgcccaggct

SEQ ID NO: 4718001 - DNA, 16 bp, Homo sapiens
tccctgacactgcggg

SEQ ID NO: 4718002 - DNA, 22 bp, Homo sapiens
tccctgacactgcggggcttgg

SEQ ID NO: 4718003 - DNA, 23 bp, Homo sapiens
tccctgacactgcggggcttggc

SEQ ID NO: 4718004 - DNA, 16 bp, Homo sapiens
tccctgactcattctg

SEQ ID NO: 4718005 - DNA, 19 bp, Homo sapiens
tccctgactcattctgaag

SEQ ID NO: 4718006 - DNA, 14 bp, Homo sapiens
tccctgactgggag

SEQ ID NO: 4718007 - DNA, 16 bp, Homo sapiens
tccctgccaatggact

SEQ ID NO: 4718008 - DNA, 16 bp, Homo sapiens
tccctgccccccagcc

SEQ ID NO: 4718009 - DNA, 17 bp, Homo sapiens
tccctgcctccacccac

SEQ ID NO: 4718010 - DNA, 18 bp, Homo sapiens
tccctggaaggacatcca

SEQ ID NO: 4718011 - DNA, 19 bp, Homo sapiens
tccctggcgtcctctccct

SEQ ID NO: 4718012 - DNA, 23 bp, Homo sapiens
tccctgggggcggccagccctcc

SEQ ID NO: 4718013 - DNA, 21 bp, Homo sapiens
tccctggtggcagctcacctc

SEQ ID NO: 4718014 - DNA, 23 bp, Homo sapiens
tccctggtggcagctcacctctc

SEQ ID NO: 4718015 - DNA, 12 bp, Homo sapiens
tccctggttctg

SEQ ID NO: 4718016 - DNA, 17 bp, Homo sapiens
tccctggttctgatgat

SEQ ID NO: 4718017 - DNA, 15 bp, Homo sapiens
tcccttatccctgct

SEQ ID NO: 4718018 - DNA, 17 bp, Homo sapiens
tcccttcatgcatggaa

SEQ ID NO: 4718019 - DNA, 16 bp, Homo sapiens
tcccttccacaccccc

SEQ ID NO: 4718020 - DNA, 14 bp, Homo sapiens
tcccttcccacctc

SEQ ID NO: 4718021 - DNA, 15 bp, Homo sapiens
tcccttggacatttt

SEQ ID NO: 4718022 - DNA, 18 bp, Homo sapiens
tcccttggacattttatg

SEQ ID NO: 4718023 - DNA, 19 bp, Homo sapiens
tcccttggacattttatgt

SEQ ID NO: 4718024 - DNA, 19 bp, Homo sapiens
tcccttggattgtccccga

SEQ ID NO: 4718025 - DNA, 12 bp, Homo sapiens
tcccttgggctc

SEQ ID NO: 4718026 - DNA, 14 bp, Homo sapiens
tcccttgggctccc

SEQ ID NO: 4718027 - DNA, 23 bp, Homo sapiens
tccctttaaagagagtttgccac

SEQ ID NO: 4718028 - DNA, 13 bp, Homo sapiens
tccctttcatgtt

SEQ ID NO: 4718029 - DNA, 16 bp, Homo sapiens
tccctttctcccctgc

SEQ ID NO: 4718030 - DNA, 17 bp, Homo sapiens
tccctttctcccctgcc

SEQ ID NO: 4718031 - DNA, 18 bp, Homo sapiens
tccctttctcccctgccc

SEQ ID NO: 4718032 - DNA, 18 bp, Homo sapiens
tccctttgacgccatccc

SEQ ID NO: 4718033 - DNA, 15 bp, Homo sapiens
tccctttttccttgt

SEQ ID NO: 4718034 - DNA, 16 bp, Homo sapiens
tccctttttccttgtc

SEQ ID NO: 4718035 - DNA, 17 bp, Homo sapiens
tccctttttccttgtcc

SEQ ID NO: 4718036 - DNA, 17 bp, Homo sapiens
tcccttttttggctgct

SEQ ID NO: 4718037 - DNA, 13 bp, Homo sapiens
tccctttttttct

SEQ ID NO: 4718038 - DNA, 14 bp, Homo sapiens
tccgagacagccgg

SEQ ID NO: 4718039 - DNA, 21 bp, Homo sapiens
tccgcacacctctggctgtct

SEQ ID NO: 4718040 - DNA, 15 bp, Homo sapiens
tccgctatccaccaa

SEQ ID NO: 4718041 - DNA, 12 bp, Homo sapiens
tccggaaagaag

SEQ ID NO: 4718042 - DNA, 12 bp, Homo sapiens
tccgtggcacat

SEQ ID NO: 4718043 - DNA, 22 bp, Homo sapiens
tcctaaaataagggcagagtca

SEQ ID NO: 4718044 - DNA, 22 bp, Homo sapiens
tcctaatgaatgcataaaatgt

SEQ ID NO: 4718045 - DNA, 13 bp, Homo sapiens
tcctaatgcatta

SEQ ID NO: 4718046 - DNA, 15 bp, Homo sapiens
tcctaattccacagc

SEQ ID NO: 4718047 - DNA, 15 bp, Homo sapiens
tcctacaagacacag

SEQ ID NO: 4718048 - DNA, 15 bp, Homo sapiens
tcctacacctaactc

SEQ ID NO: 4718049 - DNA, 18 bp, Homo sapiens
tcctacccaccctccttt

SEQ ID NO: 4718050 - DNA, 15 bp, Homo sapiens
tcctacccctcccag

SEQ ID NO: 4718051 - DNA, 18 bp, Homo sapiens
tcctacccctcccagctg

SEQ ID NO: 4718052 - DNA, 14 bp, Homo sapiens
tcctacttcccctt

SEQ ID NO: 4718053 - DNA, 17 bp, Homo sapiens
tcctacttgcagtacat

SEQ ID NO: 4718054 - DNA, 16 bp, Homo sapiens
tcctacttttaaagaa

SEQ ID NO: 4718055 - DNA, 19 bp, Homo sapiens
tcctaggcaggacatgctg

SEQ ID NO: 4718056 - DNA, 19 bp, Homo sapiens
tcctagggaagggtggtgg

SEQ ID NO: 4718057 - DNA, 14 bp, Homo sapiens
tcctagttccacca

SEQ ID NO: 4718058 - DNA, 19 bp, Homo sapiens
tcctatgtttttgttcaaa

SEQ ID NO: 4718059 - DNA, 12 bp, Homo sapiens
tcctattatatt

SEQ ID NO: 4718060 - DNA, 14 bp, Homo sapiens
tcctcaaacactgc

SEQ ID NO: 4718061 - DNA, 15 bp, Homo sapiens
tcctcaaacactgca

SEQ ID NO: 4718062 - DNA, 18 bp, Homo sapiens
tcctcaaggggccatcct

SEQ ID NO: 4718063 - DNA, 12 bp, Homo sapiens
tcctcaatccag

SEQ ID NO: 4718064 - DNA, 14 bp, Homo sapiens
tcctcaccacatgc

SEQ ID NO: 4718065 - DNA, 15 bp, Homo sapiens
tcctcaccttttccc

SEQ ID NO: 4718066 - DNA, 19 bp, Homo sapiens
tcctcaccttttcccgggg

SEQ ID NO: 4718067 - DNA, 14 bp, Homo sapiens
tcctcatacccacc

SEQ ID NO: 4718068 - DNA, 23 bp, Homo sapiens
tcctcatacccacccccacccaa

SEQ ID NO: 4718069 - DNA, 16 bp, Homo sapiens
tcctcatccagggctc

SEQ ID NO: 4718070 - DNA, 21 bp, Homo sapiens
tcctccaccgccatggcttcc

SEQ ID NO: 4718071 - DNA, 16 bp, Homo sapiens
tcctccactctccccc

SEQ ID NO: 4718072 - DNA, 14 bp, Homo sapiens
tcctccagggacag

SEQ ID NO: 4718073 - DNA, 10 bp, Homo sapiens
tcctccaggt

SEQ ID NO: 4718074 - DNA, 23 bp, Homo sapiens
tcctccatgggggctcagccagg

SEQ ID NO: 4718075 - DNA, 15 bp, Homo sapiens
tcctccatttttgtt

SEQ ID NO: 4718076 - DNA, 15 bp, Homo sapiens
tcctcccacctcagc

SEQ ID NO: 4718077 - DNA, 21 bp, Homo sapiens
tcctcccacctcagcctcccg

SEQ ID NO: 4718078 - DNA, 13 bp, Homo sapiens
tcctccccggagc

SEQ ID NO: 4718079 - DNA, 16 bp, Homo sapiens
tcctcccgtcactcca

SEQ ID NO: 4718080 - DNA, 15 bp, Homo sapiens
tcctccgtggcacat

SEQ ID NO: 4718081 - DNA, 15 bp, Homo sapiens
tcctcctccagggac

SEQ ID NO: 4718082 - DNA, 14 bp, Homo sapiens
tcctcctctgtgaa

SEQ ID NO: 4718083 - DNA, 22 bp, Homo sapiens
tcctcctgggccctctctgctc

SEQ ID NO: 4718084 - DNA, 19 bp, Homo sapiens
tcctctactaacaatcagc

SEQ ID NO: 4718085 - DNA, 15 bp, Homo sapiens
tcctctatttcttta

SEQ ID NO: 4718086 - DNA, 19 bp, Homo sapiens
tcctctccacctagtggct

SEQ ID NO: 4718087 - DNA, 12 bp, Homo sapiens
tcctctccccag

SEQ ID NO: 4718088 - DNA, 15 bp, Homo sapiens
tcctctccccagcaa

SEQ ID NO: 4718089 - DNA, 16 bp, Homo sapiens
tcctctgctgctggct

SEQ ID NO: 4718090 - DNA, 13 bp, Homo sapiens
tcctctgtacaga

SEQ ID NO: 4718091 - DNA, 16 bp, Homo sapiens
tcctctgtacagagcc

SEQ ID NO: 4718092 - DNA, 17 bp, Homo sapiens
tcctctgtacagagccc

SEQ ID NO: 4718093 - DNA, 19 bp, Homo sapiens
tcctctgtgaccaatgtct

SEQ ID NO: 4718094 - DNA, 20 bp, Homo sapiens
tcctctgtgaccaatgtctt

SEQ ID NO: 4718095 - DNA, 21 bp, Homo sapiens
tcctctgtgaccaatgtcttg

SEQ ID NO: 4718096 - DNA, 19 bp, Homo sapiens
tcctctttggtctacactg

SEQ ID NO: 4718097 - DNA, 22 bp, Homo sapiens
tcctctttggtctacactgtgc

SEQ ID NO: 4718098 - DNA, 13 bp, Homo sapiens
tcctgaagtgagt

SEQ ID NO: 4718099 - DNA, 19 bp, Homo sapiens
tcctgacttcaggggctgc

SEQ ID NO: 4718100 - DNA, 21 bp, Homo sapiens
tcctgatgcttcttcagagac

SEQ ID NO: 4718101 - DNA, 13 bp, Homo sapiens
tcctgcaggcagc

SEQ ID NO: 4718102 - DNA, 22 bp, Homo sapiens
tcctgccccagatggctttgtg

SEQ ID NO: 4718103 - DNA, 12 bp, Homo sapiens
tcctgccctggg

SEQ ID NO: 4718104 - DNA, 14 bp, Homo sapiens
tcctgccctgggag

SEQ ID NO: 4718105 - DNA, 14 bp, Homo sapiens
tcctgcccttgctc

SEQ ID NO: 4718106 - DNA, 22 bp, Homo sapiens
tcctgcccttgctccagcctga

SEQ ID NO: 4718107 - DNA, 17 bp, Homo sapiens
tcctgccgcagagctgg

SEQ ID NO: 4718108 - DNA, 15 bp, Homo sapiens
tcctgcctcagcctc

SEQ ID NO: 4718109 - DNA, 16 bp, Homo sapiens
tcctgcctcagcctcc

SEQ ID NO: 4718110 - DNA, 17 bp, Homo sapiens
tcctgcctcagcctccc

SEQ ID NO: 4718111 - DNA, 22 bp, Homo sapiens
tcctgccttcctcctgggccct

SEQ ID NO: 4718112 - DNA, 18 bp, Homo sapiens
tcctgctccacagtgttg

SEQ ID NO: 4718113 - DNA, 13 bp, Homo sapiens
tcctgctgcagtt

SEQ ID NO: 4718114 - DNA, 21 bp, Homo sapiens
tcctgctgcagttgccagtca

SEQ ID NO: 4718115 - DNA, 21 bp, Homo sapiens
tcctggaaccaggcttgcctg

SEQ ID NO: 4718116 - DNA, 21 bp, Homo sapiens
tcctggacatgaagattcttt

SEQ ID NO: 4718117 - DNA, 18 bp, Homo sapiens
tcctggagcccagaggag

SEQ ID NO: 4718118 - DNA, 14 bp, Homo sapiens
tcctggcacccggc

SEQ ID NO: 4718119 - DNA, 20 bp, Homo sapiens
tcctggcacccggcccctgc

SEQ ID NO: 4718120 - DNA, 22 bp, Homo sapiens
tcctggcacccggcccctgctg

SEQ ID NO: 4718121 - DNA, 23 bp, Homo sapiens
tcctggcacccggcccctgctgg

SEQ ID NO: 4718122 - DNA, 17 bp, Homo sapiens
tcctggcactgcttcca

SEQ ID NO: 4718123 - DNA, 18 bp, Homo sapiens
tcctgggagtgagctggt

SEQ ID NO: 4718124 - DNA, 17 bp, Homo sapiens
tcctgggccctctctgc

SEQ ID NO: 4718125 - DNA, 18 bp, Homo sapiens
tcctggggaacctgaccc

SEQ ID NO: 4718126 - DNA, 19 bp, Homo sapiens
tcctggggaacctgacccc

SEQ ID NO: 4718127 - DNA, 15 bp, Homo sapiens
tcctgtctctggcct

SEQ ID NO: 4718128 - DNA, 23 bp, Homo sapiens
tcctgtgtcttgcaatggcagcc

SEQ ID NO: 4718129 - DNA, 13 bp, Homo sapiens
tcctgtgtgtgcg

SEQ ID NO: 4718130 - DNA, 20 bp, Homo sapiens
tcctgtgttgtgctgggagc

SEQ ID NO: 4718131 - DNA, 18 bp, Homo sapiens
tcctgttaacactgtaat

SEQ ID NO: 4718132 - DNA, 20 bp, Homo sapiens
tcctgttaacactgtaatat

SEQ ID NO: 4718133 - DNA, 15 bp, Homo sapiens
tccttaaaacagaga

SEQ ID NO: 4718134 - DNA, 21 bp, Homo sapiens
tccttaccagcagagcacctt

SEQ ID NO: 4718135 - DNA, 17 bp, Homo sapiens
tccttatcaaaggacac

SEQ ID NO: 4718136 - DNA, 18 bp, Homo sapiens
tccttcacagatgggtgc

SEQ ID NO: 4718137 - DNA, 18 bp, Homo sapiens
tccttcacctttgtcccc

SEQ ID NO: 4718138 - DNA, 20 bp, Homo sapiens
tccttcacctttgtccccac

SEQ ID NO: 4718139 - DNA, 13 bp, Homo sapiens
tccttcagccctc

SEQ ID NO: 4718140 - DNA, 15 bp, Homo sapiens
tccttcagccctcac

SEQ ID NO: 4718141 - DNA, 15 bp, Homo sapiens
tccttccaccaagtt

SEQ ID NO: 4718142 - DNA, 12 bp, Homo sapiens
tccttctctgtc

SEQ ID NO: 4718143 - DNA, 21 bp, Homo sapiens
tccttctgccagttccctccc

SEQ ID NO: 4718144 - DNA, 19 bp, Homo sapiens
tccttctgtcctactctgt

SEQ ID NO: 4718145 - DNA, 20 bp, Homo sapiens
tccttctttgataatgttaa

SEQ ID NO: 4718146 - DNA, 22 bp, Homo sapiens
tccttctttgataatgttaaat

SEQ ID NO: 4718147 - DNA, 20 bp, Homo sapiens
tccttgagagaccaggcaaa

SEQ ID NO: 4718148 - DNA, 23 bp, Homo sapiens
tccttgataaaaaatttattatg

SEQ ID NO: 4718149 - DNA, 16 bp, Homo sapiens
tccttgggccctttga

SEQ ID NO: 4718150 - DNA, 20 bp, Homo sapiens
tccttgtccccacactccta

SEQ ID NO: 4718151 - DNA, 17 bp, Homo sapiens
tcctttaactatcagag

SEQ ID NO: 4718152 - DNA, 23 bp, Homo sapiens
tcctttaactatcagagggatct

SEQ ID NO: 4718153 - DNA, 19 bp, Homo sapiens
tcctttagcgcccagttgg

SEQ ID NO: 4718154 - DNA, 23 bp, Homo sapiens
tcctttagcgcccagttgggtgg

SEQ ID NO: 4718155 - DNA, 20 bp, Homo sapiens
tcctttcatttactgtggct

SEQ ID NO: 4718156 - DNA, 18 bp, Homo sapiens
tcctttgtgaggaagccg

SEQ ID NO: 4718157 - DNA, 15 bp, Homo sapiens
tccttttattaaaac

SEQ ID NO: 4718158 - DNA, 12 bp, Homo sapiens
tcgaaataacaa

SEQ ID NO: 4718159 - DNA, 20 bp, Homo sapiens
tcgaaataacaatgttaagg

SEQ ID NO: 4718160 - DNA, 22 bp, Homo sapiens
tcgaacccgggaggcagaggtt

SEQ ID NO: 4718161 - DNA, 13 bp, Homo sapiens
tcgaactggctgc

SEQ ID NO: 4718162 - DNA, 14 bp, Homo sapiens
tcgaactggctgca

SEQ ID NO: 4718163 - DNA, 13 bp, Homo sapiens
tcgaagaaaataa

SEQ ID NO: 4718164 - DNA, 19 bp, Homo sapiens
tcgaatgtaattggaatct

SEQ ID NO: 4718165 - DNA, 13 bp, Homo sapiens
tcgacctgcctcg

SEQ ID NO: 4718166 - DNA, 22 bp, Homo sapiens
tcgaggcggatctttggacaga

SEQ ID NO: 4718167 - DNA, 16 bp, Homo sapiens
tcgaggtttctcaaag

SEQ ID NO: 4718168 - DNA, 21 bp, Homo sapiens
tcgatgtcctcctctgtgaaa

SEQ ID NO: 4718169 - DNA, 14 bp, Homo sapiens
tcgcccaccgcatg

SEQ ID NO: 4718170 - DNA, 21 bp, Homo sapiens
tcgcccaccgcatgccccctc

SEQ ID NO: 4718171 - DNA, 12 bp, Homo sapiens
tcgcccaggctg

SEQ ID NO: 4718172 - DNA, 14 bp, Homo sapiens
tcgcccaggctgga

SEQ ID NO: 4718173 - DNA, 19 bp, Homo sapiens
tcgcccaggctggagtgca

SEQ ID NO: 4718174 - DNA, 14 bp, Homo sapiens
tcgcctggcctgag

SEQ ID NO: 4718175 - DNA, 14 bp, Homo sapiens
tcgctgatgctggg

SEQ ID NO: 4718176 - DNA, 19 bp, Homo sapiens
tcgctgatgctgggctggg

SEQ ID NO: 4718177 - DNA, 20 bp, Homo sapiens
tcgctgatgctgggctgggt

SEQ ID NO: 4718178 - DNA, 22 bp, Homo sapiens
tcgctgatgctgggctgggtgc

SEQ ID NO: 4718179 - DNA, 20 bp, Homo sapiens
tcgctgccagctctgtatca

SEQ ID NO: 4718180 - DNA, 12 bp, Homo sapiens
tcgctgggtcct

SEQ ID NO: 4718181 - DNA, 17 bp, Homo sapiens
tcgctgggtcctctgca

SEQ ID NO: 4718182 - DNA, 18 bp, Homo sapiens
tcggacttagctgggaga

SEQ ID NO: 4718183 - DNA, 12 bp, Homo sapiens
tcggctcctgct

SEQ ID NO: 4718184 - DNA, 16 bp, Homo sapiens
tcggctcctgctgcac

SEQ ID NO: 4718185 - DNA, 17 bp, Homo sapiens
tcgggaccagaaacctg

SEQ ID NO: 4718186 - DNA, 13 bp, Homo sapiens
tcgggcccttccc

SEQ ID NO: 4718187 - DNA, 16 bp, Homo sapiens
tcgggctcctgtgccc

SEQ ID NO: 4718188 - DNA, 22 bp, Homo sapiens
tcggtggagactatcagcccaa

SEQ ID NO: 4718189 - DNA, 13 bp, Homo sapiens
tcgtgacaacact

SEQ ID NO: 4718190 - DNA, 21 bp, Homo sapiens
tcgtgccagtcgcgctgcctg

SEQ ID NO: 4718191 - DNA, 12 bp, Homo sapiens
tcgttactggca

SEQ ID NO: 4718192 - DNA, 22 bp, Homo sapiens
tcgttgttcccactgaaatgga

SEQ ID NO: 4718193 - DNA, 20 bp, Homo sapiens
tctaaacaagaaccatttgc

SEQ ID NO: 4718194 - DNA, 22 bp, Homo sapiens
tctaaacagatgtccctgaagt

SEQ ID NO: 4718195 - DNA, 20 bp, Homo sapiens
tctaaatggtgctgcagatt

SEQ ID NO: 4718196 - DNA, 19 bp, Homo sapiens
tctaaattgatcattcata

SEQ ID NO: 4718197 - DNA, 18 bp, Homo sapiens
tctaaatttaattacctt

SEQ ID NO: 4718198 - DNA, 21 bp, Homo sapiens
tctaaatttcttcctatttct

SEQ ID NO: 4718199 - DNA, 13 bp, Homo sapiens
tctaacctcatct

SEQ ID NO: 4718200 - DNA, 22 bp, Homo sapiens
tctaagggaggcacttcctccc

SEQ ID NO: 4718201 - DNA, 22 bp, Homo sapiens
tctaatactttgtttattgtaa

SEQ ID NO: 4718202 - DNA, 19 bp, Homo sapiens
tctaatattcacatgttct

SEQ ID NO: 4718203 - DNA, 11 bp, Homo sapiens
tctaatgtttg

SEQ ID NO: 4718204 - DNA, 12 bp, Homo sapiens
tctaatgtttgt

SEQ ID NO: 4718205 - DNA, 16 bp, Homo sapiens
tctaatgtttgtgaga

SEQ ID NO: 4718206 - DNA, 13 bp, Homo sapiens
tctaattctttaa

SEQ ID NO: 4718207 - DNA, 19 bp, Homo sapiens
tctaattttggataatatt

SEQ ID NO: 4718208 - DNA, 14 bp, Homo sapiens
tctacacaacatgt

SEQ ID NO: 4718209 - DNA, 12 bp, Homo sapiens
tctacactgtgc

SEQ ID NO: 4718210 - DNA, 14 bp, Homo sapiens
tctacactgtgctg

SEQ ID NO: 4718211 - DNA, 13 bp, Homo sapiens
tctacagagaaaa

SEQ ID NO: 4718212 - DNA, 21 bp, Homo sapiens
tctacagagaaaatgaatttg

SEQ ID NO: 4718213 - DNA, 22 bp, Homo sapiens
tctacagagaaaatgaatttgg

SEQ ID NO: 4718214 - DNA, 19 bp, Homo sapiens
tctacagagcttccctgac

SEQ ID NO: 4718215 - DNA, 21 bp, Homo sapiens
tctacagaggccatgggcctc

SEQ ID NO: 4718216 - DNA, 20 bp, Homo sapiens
tctacccagcgagccctggt

SEQ ID NO: 4718217 - DNA, 18 bp, Homo sapiens
tctacccttggaaagaaa

SEQ ID NO: 4718218 - DNA, 12 bp, Homo sapiens
tctacctgaggg

SEQ ID NO: 4718219 - DNA, 18 bp, Homo sapiens
tctactcattccccgggg

SEQ ID NO: 4718220 - DNA, 16 bp, Homo sapiens
tctactgtacacaatc

SEQ ID NO: 4718221 - DNA, 14 bp, Homo sapiens
tctactttgtttat

SEQ ID NO: 4718222 - DNA, 16 bp, Homo sapiens
tctactttgtttattt

SEQ ID NO: 4718223 - DNA, 20 bp, Homo sapiens
tctagaaagtaagaaaacaa

SEQ ID NO: 4718224 - DNA, 22 bp, Homo sapiens
tctagaaatacacttttttcca

SEQ ID NO: 4718225 - DNA, 16 bp, Homo sapiens
tctagatcactgtgct

SEQ ID NO: 4718226 - DNA, 20 bp, Homo sapiens
tctagatcactgtgcttatt

SEQ ID NO: 4718227 - DNA, 22 bp, Homo sapiens
tctagatcactgtgcttatttt

SEQ ID NO: 4718228 - DNA, 23 bp, Homo sapiens
tctagcagtaaaagataaatttg

SEQ ID NO: 4718229 - DNA, 12 bp, Homo sapiens
tctaggaagact

SEQ ID NO: 4718230 - DNA, 21 bp, Homo sapiens
tctaggaagactttggaaaga

SEQ ID NO: 4718231 - DNA, 18 bp, Homo sapiens
tctaggacgccacccagc

SEQ ID NO: 4718232 - DNA, 16 bp, Homo sapiens
tctagggacccctcct

SEQ ID NO: 4718233 - DNA, 17 bp, Homo sapiens
tctagggacccctcctc

SEQ ID NO: 4718234 - DNA, 20 bp, Homo sapiens
tctagggacccctcctccct

SEQ ID NO: 4718235 - DNA, 11 bp, Homo sapiens
tctaggtcttg

SEQ ID NO: 4718236 - DNA, 13 bp, Homo sapiens
tctagtagaacaa

SEQ ID NO: 4718237 - DNA, 19 bp, Homo sapiens
tctagtggtctttgtaaga

SEQ ID NO: 4718238 - DNA, 21 bp, Homo sapiens
tctagtggtctttgtaagagt

SEQ ID NO: 4718239 - DNA, 22 bp, Homo sapiens
tctagttgtttgattcagacag

SEQ ID NO: 4718240 - DNA, 21 bp, Homo sapiens
tctataaactataacctctcc

SEQ ID NO: 4718241 - DNA, 14 bp, Homo sapiens
tctatcaccaagga

SEQ ID NO: 4718242 - DNA, 20 bp, Homo sapiens
tctatcattcccctgcccac

SEQ ID NO: 4718243 - DNA, 14 bp, Homo sapiens
tctatcttccaaac

SEQ ID NO: 4718244 - DNA, 14 bp, Homo sapiens
tctatgctccctct

SEQ ID NO: 4718245 - DNA, 12 bp, Homo sapiens
tctatgggactc

SEQ ID NO: 4718246 - DNA, 19 bp, Homo sapiens
tctatgggactcaatgcac

SEQ ID NO: 4718247 - DNA, 11 bp, Homo sapiens
tctattaaaag

SEQ ID NO: 4718248 - DNA, 16 bp, Homo sapiens
tctattaaaagactca

SEQ ID NO: 4718249 - DNA, 22 bp, Homo sapiens
tctattaaaagactcatccgtc

SEQ ID NO: 4718250 - DNA, 16 bp, Homo sapiens
tctattaaaattgcca

SEQ ID NO: 4718251 - DNA, 18 bp, Homo sapiens
tctattccatttgtattg

SEQ ID NO: 4718252 - DNA, 15 bp, Homo sapiens
tctatttgtagatta

SEQ ID NO: 4718253 - DNA, 22 bp, Homo sapiens
tctcaaactcttgacctcaggt

SEQ ID NO: 4718254 - DNA, 22 bp, Homo sapiens
tctcaaagttaaaagtaaaatt

SEQ ID NO: 4718255 - DNA, 17 bp, Homo sapiens
tctcaaagttttgaaaa

SEQ ID NO: 4718256 - DNA, 23 bp, Homo sapiens
tctcaaagttttgaaaagctatt

SEQ ID NO: 4718257 - DNA, 12 bp, Homo sapiens
tctcaattttgt

SEQ ID NO: 4718258 - DNA, 22 bp, Homo sapiens
tctcacaaaacatattttacat

SEQ ID NO: 4718259 - DNA, 23 bp, Homo sapiens
tctcacaaaacatattttacatc

SEQ ID NO: 4718260 - DNA, 16 bp, Homo sapiens
tctcacacatgagcat

SEQ ID NO: 4718261 - DNA, 18 bp, Homo sapiens
tctcacctaaaccctctg

SEQ ID NO: 4718262 - DNA, 20 bp, Homo sapiens
tctcacctaaaccctctgtg

SEQ ID NO: 4718263 - DNA, 21 bp, Homo sapiens
tctcacctaaaccctctgtga

SEQ ID NO: 4718264 - DNA, 23 bp, Homo sapiens
tctcacctaaaccctctgtgaaa

SEQ ID NO: 4718265 - DNA, 16 bp, Homo sapiens
tctcactataccagta

SEQ ID NO: 4718266 - DNA, 23 bp, Homo sapiens
tctcactatgttgcccaggcagg

SEQ ID NO: 4718267 - DNA, 17 bp, Homo sapiens
tctcactctgtcgccca

SEQ ID NO: 4718268 - DNA, 17 bp, Homo sapiens
tctcactgttgcccagg

SEQ ID NO: 4718269 - DNA, 18 bp, Homo sapiens
tctcactgttgcccaggc

SEQ ID NO: 4718270 - DNA, 19 bp, Homo sapiens
tctcagagctacttgggcc

SEQ ID NO: 4718271 - DNA, 11 bp, Homo sapiens
tctcaggaaat

SEQ ID NO: 4718272 - DNA, 20 bp, Homo sapiens
tctcagggtctctgctgccg

SEQ ID NO: 4718273 - DNA, 22 bp, Homo sapiens
tctcatatatattttaaaaaca

SEQ ID NO: 4718274 - DNA, 17 bp, Homo sapiens
tctcatctcttagctcc

SEQ ID NO: 4718275 - DNA, 12 bp, Homo sapiens
tctcatctttct

SEQ ID NO: 4718276 - DNA, 21 bp, Homo sapiens
tctcatgcctcagcctcctga

SEQ ID NO: 4718277 - DNA, 23 bp, Homo sapiens
tctcattgaggacaaagaaaact

SEQ ID NO: 4718278 - DNA, 19 bp, Homo sapiens
tctcatttcacccctccct

SEQ ID NO: 4718279 - DNA, 14 bp, Homo sapiens
tctcatttgtcaca

SEQ ID NO: 4718280 - DNA, 16 bp, Homo sapiens
tctcatttgtcacaca

SEQ ID NO: 4718281 - DNA, 15 bp, Homo sapiens
tctccaaataaaaat

SEQ ID NO: 4718282 - DNA, 22 bp, Homo sapiens
tctccaaccccccagcactgag

SEQ ID NO: 4718283 - DNA, 18 bp, Homo sapiens
tctccaagcaggacatgg

SEQ ID NO: 4718284 - DNA, 12 bp, Homo sapiens
tctccaccctgc

SEQ ID NO: 4718285 - DNA, 21 bp, Homo sapiens
caagtcctcttttctgagagg

SEQ ID NO: 4718286 - DNA, 21 bp, Homo sapiens
caagtgattctcatgcctcag

SEQ ID NO: 4718287 - DNA, 19 bp, Homo sapiens
caagtgattgggacagagg

SEQ ID NO: 4718288 - DNA, 18 bp, Homo sapiens
caagtggcagagcttgga

SEQ ID NO: 4718289 - DNA, 16 bp, Homo sapiens
caagtgttcacaacct

SEQ ID NO: 4718290 - DNA, 12 bp, Homo sapiens
caagttgtttat

SEQ ID NO: 4718291 - DNA, 20 bp, Homo sapiens
caagttgtttattccaaaga

SEQ ID NO: 4718292 - DNA, 20 bp, Homo sapiens
caagtttactcaaccctctc

SEQ ID NO: 4718293 - DNA, 14 bp, Homo sapiens
caataaaacattaa

SEQ ID NO: 4718294 - DNA, 17 bp, Homo sapiens
caataaaaccaagcctc

SEQ ID NO: 4718295 - DNA, 21 bp, Homo sapiens
caataaaaccaagcctctgga

SEQ ID NO: 4718296 - DNA, 15 bp, Homo sapiens
caataacacacagct

SEQ ID NO: 4718297 - DNA, 15 bp, Homo sapiens
caatactacctcact

SEQ ID NO: 4718298 - DNA, 13 bp, Homo sapiens
caatactgagcca

SEQ ID NO: 4718299 - DNA, 14 bp, Homo sapiens
caatactgagccat

SEQ ID NO: 4718300 - DNA, 21 bp, Homo sapiens
caatacttacatatctgactt

SEQ ID NO: 4718301 - DNA, 14 bp, Homo sapiens
caatattgtacagt

SEQ ID NO: 4718302 - DNA, 15 bp, Homo sapiens
caatattgtacagtt

SEQ ID NO: 4718303 - DNA, 16 bp, Homo sapiens
caatattgtacagttt

SEQ ID NO: 4718304 - DNA, 21 bp, Homo sapiens
caatatttactatttcaatac

SEQ ID NO: 4718305 - DNA, 20 bp, Homo sapiens
caatattttccatgaaaatg

SEQ ID NO: 4718306 - DNA, 15 bp, Homo sapiens
caatccctcaaacct

SEQ ID NO: 4718307 - DNA, 14 bp, Homo sapiens
caatcctatgtttt

SEQ ID NO: 4718308 - DNA, 20 bp, Homo sapiens
caatctgtgtaagaaaacaa

SEQ ID NO: 4718309 - DNA, 19 bp, Homo sapiens
caatgagatcattgtgaag

SEQ ID NO: 4718310 - DNA, 14 bp, Homo sapiens
caatgcactgacat

SEQ ID NO: 4718311 - DNA, 17 bp, Homo sapiens
caatgcactttgttctg

SEQ ID NO: 4718312 - DNA, 21 bp, Homo sapiens
caatgcactttgttctggctc

SEQ ID NO: 4718313 - DNA, 14 bp, Homo sapiens
caatgccatcatct

SEQ ID NO: 4718314 - DNA, 22 bp, Homo sapiens
caatgcgtggcacatctaaatt

SEQ ID NO: 4718315 - DNA, 20 bp, Homo sapiens
caatgctgatgtcctcacca

SEQ ID NO: 4718316 - DNA, 23 bp, Homo sapiens
caatgctggctgttggctggggg

SEQ ID NO: 4718317 - DNA, 22 bp, Homo sapiens
caatggaccggagagtgggggt

SEQ ID NO: 4718318 - DNA, 14 bp, Homo sapiens
caatggcagccttg

SEQ ID NO: 4718319 - DNA, 18 bp, Homo sapiens
caatggcttactccagga

SEQ ID NO: 4718320 - DNA, 20 bp, Homo sapiens
caatggtttgcaaggaagcc

SEQ ID NO: 4718321 - DNA, 21 bp, Homo sapiens
caatgtaaaaatacactaatg

SEQ ID NO: 4718322 - DNA, 21 bp, Homo sapiens
caatgtacaaggtatgtacag

SEQ ID NO: 4718323 - DNA, 16 bp, Homo sapiens
caatgttaaggaaact

SEQ ID NO: 4718324 - DNA, 13 bp, Homo sapiens
caattaactctgg

SEQ ID NO: 4718325 - DNA, 22 bp, Homo sapiens
caattaagttacaattacatct

SEQ ID NO: 4718326 - DNA, 21 bp, Homo sapiens
caattacttattttaggaaat

SEQ ID NO: 4718327 - DNA, 20 bp, Homo sapiens
caattcacatctaacctcat

SEQ ID NO: 4718328 - DNA, 19 bp, Homo sapiens
caattcagtgacttaatat

SEQ ID NO: 4718329 - DNA, 22 bp, Homo sapiens
caattctgtctcattgattgat

SEQ ID NO: 4718330 - DNA, 17 bp, Homo sapiens
caattcttacaaacatg

SEQ ID NO: 4718331 - DNA, 19 bp, Homo sapiens
caattcttacaaacatgtg

SEQ ID NO: 4718332 - DNA, 17 bp, Homo sapiens
caattgcatctcccaga

SEQ ID NO: 4718333 - DNA, 20 bp, Homo sapiens
caattggatacgacaacttg

SEQ ID NO: 4718334 - DNA, 13 bp, Homo sapiens
caatttaaagcaa

SEQ ID NO: 4718335 - DNA, 17 bp, Homo sapiens
caatttccaagagctga

SEQ ID NO: 4718336 - DNA, 14 bp, Homo sapiens
caatttctccccag

SEQ ID NO: 4718337 - DNA, 16 bp, Homo sapiens
caatttgctgaaaaca

SEQ ID NO: 4718338 - DNA, 16 bp, Homo sapiens
caattttgtatttaat

SEQ ID NO: 4718339 - DNA, 15 bp, Homo sapiens
caattttttaaacca

SEQ ID NO: 4718340 - DNA, 18 bp, Homo sapiens
cacaaaagctgtgtctct

SEQ ID NO: 4718341 - DNA, 22 bp, Homo sapiens
cacaaaataaccaatcctggac

SEQ ID NO: 4718342 - DNA, 17 bp, Homo sapiens
cacaaacctgcctgggt

SEQ ID NO: 4718343 - DNA, 13 bp, Homo sapiens
cacaaactcacca

SEQ ID NO: 4718344 - DNA, 12 bp, Homo sapiens
cacaacttgttt

SEQ ID NO: 4718345 - DNA, 16 bp, Homo sapiens
cacaagacccttgtgg

SEQ ID NO: 4718346 - DNA, 21 bp, Homo sapiens
cacaagccaaggaagtctgtg

SEQ ID NO: 4718347 - DNA, 13 bp, Homo sapiens
cacaagctccaag

SEQ ID NO: 4718348 - DNA, 19 bp, Homo sapiens
cacaatctcggctcactgc

SEQ ID NO: 4718349 - DNA, 20 bp, Homo sapiens
cacaatctcggctcactgca

SEQ ID NO: 4718350 - DNA, 22 bp, Homo sapiens
cacaatctcggctcactgcatc

SEQ ID NO: 4718351 - DNA, 24 bp, Homo sapiens
cacaatctcggctcactgcatcct

SEQ ID NO: 4718352 - DNA, 15 bp, Homo sapiens
cacaattattaaatt

SEQ ID NO: 4718353 - DNA, 14 bp, Homo sapiens
cacacacacataca

SEQ ID NO: 4718354 - DNA, 13 bp, Homo sapiens
cacacacatacag

SEQ ID NO: 4718355 - DNA, 16 bp, Homo sapiens
cacacaccagagccca

SEQ ID NO: 4718356 - DNA, 20 bp, Homo sapiens
cacacaccagagcccacctt

SEQ ID NO: 4718357 - DNA, 12 bp, Homo sapiens
cacacagctctg

SEQ ID NO: 4718358 - DNA, 14 bp, Homo sapiens
cacacagctctgtc

SEQ ID NO: 4718359 - DNA, 21 bp, Homo sapiens
cacacatgagcatcaggccag

SEQ ID NO: 4718360 - DNA, 19 bp, Homo sapiens
cacaccactgtactccagc

SEQ ID NO: 4718361 - DNA, 13 bp, Homo sapiens
cacacccagccca

SEQ ID NO: 4718362 - DNA, 23 bp, Homo sapiens
cacacccccaccccttgctctca

SEQ ID NO: 4718363 - DNA, 12 bp, Homo sapiens
cacacctctggc

SEQ ID NO: 4718364 - DNA, 11 bp, Homo sapiens
cacacctgagc

SEQ ID NO: 4718365 - DNA, 14 bp, Homo sapiens
cacacctttattca

SEQ ID NO: 4718366 - DNA, 20 bp, Homo sapiens
cacacggtttgaagcctgga

SEQ ID NO: 4718367 - DNA, 16 bp, Homo sapiens
cacactcagttctgct

SEQ ID NO: 4718368 - DNA, 19 bp, Homo sapiens
cacactcagttctgctcta

SEQ ID NO: 4718369 - DNA, 22 bp, Homo sapiens
cacagaccctgccctgtgggcc

SEQ ID NO: 4718370 - DNA, 21 bp, Homo sapiens
cacagagaaaaagttgtaatt

SEQ ID NO: 4718371 - DNA, 21 bp, Homo sapiens
cacagagaaagtacttctcca

SEQ ID NO: 4718372 - DNA, 14 bp, Homo sapiens
cacagagcggggac

SEQ ID NO: 4718373 - DNA, 18 bp, Homo sapiens
cacagatgggtgcttgga

SEQ ID NO: 4718374 - DNA, 22 bp, Homo sapiens
cacagatttgagctcagccctg

SEQ ID NO: 4718375 - DNA, 22 bp, Homo sapiens
cacagccatcccagccttggca

SEQ ID NO: 4718376 - DNA, 14 bp, Homo sapiens
cacagcccacgtcc

SEQ ID NO: 4718377 - DNA, 20 bp, Homo sapiens
cacagcccacgtcctgtcag

SEQ ID NO: 4718378 - DNA, 14 bp, Homo sapiens
cacagccctcccgc

SEQ ID NO: 4718379 - DNA, 16 bp, Homo sapiens
cacagcctccaagtca

SEQ ID NO: 4718380 - DNA, 20 bp, Homo sapiens
cacagcctcccctgccaggg

SEQ ID NO: 4718381 - DNA, 22 bp, Homo sapiens
cacagcgctggccgggaccccg

SEQ ID NO: 4718382 - DNA, 20 bp, Homo sapiens
cacagctaacaattgtgaag

SEQ ID NO: 4718383 - DNA, 20 bp, Homo sapiens
cacagctaacacacagctcc

SEQ ID NO: 4718384 - DNA, 11 bp, Homo sapiens
cacagctctgt

SEQ ID NO: 4718385 - DNA, 15 bp, Homo sapiens
cacagctctgtcctg

SEQ ID NO: 4718386 - DNA, 19 bp, Homo sapiens
cacagctctgtcctgggag

SEQ ID NO: 4718387 - DNA, 10 bp, Homo sapiens
cacagctctt

SEQ ID NO: 4718388 - DNA, 18 bp, Homo sapiens
cacagctcttctccaggc

SEQ ID NO: 4718389 - DNA, 19 bp, Homo sapiens
cacagctcttctccaggct

SEQ ID NO: 4718390 - DNA, 21 bp, Homo sapiens
cacagctcttctccaggctgt

SEQ ID NO: 4718391 - DNA, 16 bp, Homo sapiens
cacagctcttgtttgg

SEQ ID NO: 4718392 - DNA, 12 bp, Homo sapiens
cacagctgctca

SEQ ID NO: 4718393 - DNA, 14 bp, Homo sapiens
cacagctgctggag

SEQ ID NO: 4718394 - DNA, 19 bp, Homo sapiens
cacagctgtttcctcacgt

SEQ ID NO: 4718395 - DNA, 20 bp, Homo sapiens
cactgcttgaggaaaacaag

SEQ ID NO: 4718396 - DNA, 13 bp, Homo sapiens
cactggaactcag

SEQ ID NO: 4718397 - DNA, 13 bp, Homo sapiens
cactggctgcctc

SEQ ID NO: 4718398 - DNA, 20 bp, Homo sapiens
cactggctgcctccactccc

SEQ ID NO: 4718399 - DNA, 15 bp, Homo sapiens
cactgggactttgta

SEQ ID NO: 4718400 - DNA, 16 bp, Homo sapiens
cactggtattcctgcc

SEQ ID NO: 4718401 - DNA, 19 bp, Homo sapiens
cactggtattcctgcctcc

SEQ ID NO: 4718402 - DNA, 20 bp, Homo sapiens
cactggtattcctgcctcca

SEQ ID NO: 4718403 - DNA, 17 bp, Homo sapiens
cactggtctaatgtttg

SEQ ID NO: 4718404 - DNA, 20 bp, Homo sapiens
cactggtctgtttgcatttg

SEQ ID NO: 4718405 - DNA, 17 bp, Homo sapiens
cactggtgacatgtctt

SEQ ID NO: 4718406 - DNA, 17 bp, Homo sapiens
cactgtataaataggag

SEQ ID NO: 4718407 - DNA, 23 bp, Homo sapiens
cactgtataaataggagaggatg

SEQ ID NO: 4718408 - DNA, 20 bp, Homo sapiens
cactgtcctgctccacagtg

SEQ ID NO: 4718409 - DNA, 14 bp, Homo sapiens
cactgtcttgaaga

SEQ ID NO: 4718410 - DNA, 20 bp, Homo sapiens
cactgtgcacatctgtgtct

SEQ ID NO: 4718411 - DNA, 22 bp, Homo sapiens
cactgtgcacatctgtgtcttg

SEQ ID NO: 4718412 - DNA, 16 bp, Homo sapiens
cactgtgccatgtgcc

SEQ ID NO: 4718413 - DNA, 17 bp, Homo sapiens
cactgtgctgagtctga

SEQ ID NO: 4718414 - DNA, 19 bp, Homo sapiens
cactgtgcttattttgttt

SEQ ID NO: 4718415 - DNA, 17 bp, Homo sapiens
cactgtggaagtccctc

SEQ ID NO: 4718416 - DNA, 19 bp, Homo sapiens
cactgtggaagtccctcag

SEQ ID NO: 4718417 - DNA, 22 bp, Homo sapiens
cactgtggaagtccctcagagg

SEQ ID NO: 4718418 - DNA, 14 bp, Homo sapiens
cactgttctctgcc

SEQ ID NO: 4718419 - DNA, 15 bp, Homo sapiens
cactgttctctgccc

SEQ ID NO: 4718420 - DNA, 17 bp, Homo sapiens
cactgttctctgccctc

SEQ ID NO: 4718421 - DNA, 16 bp, Homo sapiens
cactgttgataaaaac

SEQ ID NO: 4718422 - DNA, 16 bp, Homo sapiens
cactgttgcccaggct

SEQ ID NO: 4718423 - DNA, 17 bp, Homo sapiens
cactgttgcccaggctg

SEQ ID NO: 4718424 - DNA, 18 bp, Homo sapiens
cactgttgcccaggctgg

SEQ ID NO: 4718425 - DNA, 23 bp, Homo sapiens
cactgttgcccaggctggcgtgc

SEQ ID NO: 4718426 - DNA, 20 bp, Homo sapiens
cacttataaatatcctgctc

SEQ ID NO: 4718427 - DNA, 20 bp, Homo sapiens
cacttatttatgaacctgcc

SEQ ID NO: 4718428 - DNA, 13 bp, Homo sapiens
cacttcctcccct

SEQ ID NO: 4718429 - DNA, 15 bp, Homo sapiens
cacttcctcccctcg

SEQ ID NO: 4718430 - DNA, 23 bp, Homo sapiens
cacttcgtgggatctgcccctcc

SEQ ID NO: 4718431 - DNA, 16 bp, Homo sapiens
cacttctatttaatgc

SEQ ID NO: 4718432 - DNA, 12 bp, Homo sapiens
cacttctcagga

SEQ ID NO: 4718433 - DNA, 19 bp, Homo sapiens
cacttgcagactctacaga

SEQ ID NO: 4718434 - DNA, 24 bp, Homo sapiens
cacttgcagactctacagaggcca

SEQ ID NO: 4718435 - DNA, 19 bp, Homo sapiens
cacttggcccaagtggcag

SEQ ID NO: 4718436 - DNA, 20 bp, Homo sapiens
cacttggtgatatgtcctat

SEQ ID NO: 4718437 - DNA, 18 bp, Homo sapiens
cacttgtgttatgaagca

SEQ ID NO: 4718438 - DNA, 22 bp, Homo sapiens
cactttaaagcaattgcataat

SEQ ID NO: 4718439 - DNA, 15 bp, Homo sapiens
cactttttgcagctt

SEQ ID NO: 4718440 - DNA, 18 bp, Homo sapiens
cagaaaacaattgttctg

SEQ ID NO: 4718441 - DNA, 19 bp, Homo sapiens
cagaaagaaaatgaatttg

SEQ ID NO: 4718442 - DNA, 20 bp, Homo sapiens
cagaaatattctacacatat

SEQ ID NO: 4718443 - DNA, 15 bp, Homo sapiens
cagaacagcttcagg

SEQ ID NO: 4718444 - DNA, 16 bp, Homo sapiens
cagaacagcttcaggt

SEQ ID NO: 4718445 - DNA, 20 bp, Homo sapiens
cagaacaggtgttggtgaca

SEQ ID NO: 4718446 - DNA, 17 bp, Homo sapiens
cagaacagtgtttgatt

SEQ ID NO: 4718447 - DNA, 17 bp, Homo sapiens
caccacacccagcccac

SEQ ID NO: 4718448 - DNA, 15 bp, Homo sapiens
caccaccccccactc

SEQ ID NO: 4718449 - DNA, 16 bp, Homo sapiens
caccaccccccactct

SEQ ID NO: 4718450 - DNA, 22 bp, Homo sapiens
caccaccccccactctgtgcct

SEQ ID NO: 4718451 - DNA, 15 bp, Homo sapiens
caccacgcccggcta

SEQ ID NO: 4718452 - DNA, 15 bp, Homo sapiens
caccagagcccacct

SEQ ID NO: 4718453 - DNA, 22 bp, Homo sapiens
caccagccccagtgcccacagg

SEQ ID NO: 4718454 - DNA, 22 bp, Homo sapiens
caccagctgttctgtcccttgg

SEQ ID NO: 4718455 - DNA, 13 bp, Homo sapiens
caccagggaaggg

SEQ ID NO: 4718456 - DNA, 18 bp, Homo sapiens
caccagggaaggggacaa

SEQ ID NO: 4718457 - DNA, 16 bp, Homo sapiens
caccaggggcaggcac

SEQ ID NO: 4718458 - DNA, 19 bp, Homo sapiens
caccagggttgaccccaga

SEQ ID NO: 4718459 - DNA, 22 bp, Homo sapiens
caccagtgtgacaggaaagatt

SEQ ID NO: 4718460 - DNA, 19 bp, Homo sapiens
caccatcaagccaccaaca

SEQ ID NO: 4718461 - DNA, 22 bp, Homo sapiens
caccatgcagtgcccctagctt

SEQ ID NO: 4718462 - DNA, 19 bp, Homo sapiens
caccatgttggccaggctg

SEQ ID NO: 4718463 - DNA, 20 bp, Homo sapiens
caccatgttggccaggctgg

SEQ ID NO: 4718464 - DNA, 14 bp, Homo sapiens
caccattctttctt

SEQ ID NO: 4718465 - DNA, 16 bp, Homo sapiens
cacccaagggcctggc

SEQ ID NO: 4718466 - DNA, 18 bp, Homo sapiens
cacccaagggcctggcct

SEQ ID NO: 4718467 - DNA, 20 bp, Homo sapiens
cacccaagggcctggcctga

SEQ ID NO: 4718468 - DNA, 21 bp, Homo sapiens
cacccaagggcctggcctgag

SEQ ID NO: 4718469 - DNA, 19 bp, Homo sapiens
cacccacagtggagagggc

SEQ ID NO: 4718470 - DNA, 20 bp, Homo sapiens
cacccaccatcatgtctggc

SEQ ID NO: 4718471 - DNA, 13 bp, Homo sapiens
cacccacctcagc

SEQ ID NO: 4718472 - DNA, 14 bp, Homo sapiens
cacccacttctgca

SEQ ID NO: 4718473 - DNA, 16 bp, Homo sapiens
cacccagcccacttct

SEQ ID NO: 4718474 - DNA, 19 bp, Homo sapiens
cacccagcttcaaagctta

SEQ ID NO: 4718475 - DNA, 18 bp, Homo sapiens
caccccaacatgcctgca

SEQ ID NO: 4718476 - DNA, 13 bp, Homo sapiens
caccccagcccca

SEQ ID NO: 4718477 - DNA, 16 bp, Homo sapiens
caccccagggcagcca

SEQ ID NO: 4718478 - DNA, 16 bp, Homo sapiens
caccccctcctgctgc

SEQ ID NO: 4718479 - DNA, 18 bp, Homo sapiens
cacccccttctccatcca

SEQ ID NO: 4718480 - DNA, 14 bp, Homo sapiens
caccccggccacct

SEQ ID NO: 4718481 - DNA, 15 bp, Homo sapiens
caccccggccacctg

SEQ ID NO: 4718482 - DNA, 19 bp, Homo sapiens
caccccttgctctcaaccc

SEQ ID NO: 4718483 - DNA, 19 bp, Homo sapiens
cacccgctaagagggaggg

SEQ ID NO: 4718484 - DNA, 13 bp, Homo sapiens
cacccggcccctg

SEQ ID NO: 4718485 - DNA, 14 bp, Homo sapiens
cacccggcccctgc

SEQ ID NO: 4718486 - DNA, 16 bp, Homo sapiens
cacccggcccctgctg

SEQ ID NO: 4718487 - DNA, 21 bp, Homo sapiens
cacccggcccctgctggttca

SEQ ID NO: 4718488 - DNA, 22 bp, Homo sapiens
caccctcaccgcggctggatgg

SEQ ID NO: 4718489 - DNA, 16 bp, Homo sapiens
caccctggggagaaag

SEQ ID NO: 4718490 - DNA, 17 bp, Homo sapiens
caccctggggagaaagt

SEQ ID NO: 4718491 - DNA, 22 bp, Homo sapiens
caccctgtgatggggccctgcc

SEQ ID NO: 4718492 - DNA, 23 bp, Homo sapiens
caccctgtgatggggccctgcct

SEQ ID NO: 4718493 - DNA, 15 bp, Homo sapiens
cacccttttccagct

SEQ ID NO: 4718494 - DNA, 13 bp, Homo sapiens
caccgcagacagg

SEQ ID NO: 4718495 - DNA, 21 bp, Homo sapiens
caccgcagacaggaccaggga

SEQ ID NO: 4718496 - DNA, 22 bp, Homo sapiens
caccgcatgccccctcgtgcca

SEQ ID NO: 4718497 - DNA, 22 bp, Homo sapiens
caccggccccatttacccaact

SEQ ID NO: 4718498 - DNA, 16 bp, Homo sapiens
caccggctggcctggc

SEQ ID NO: 4718499 - DNA, 15 bp, Homo sapiens
caccgggccacagag

SEQ ID NO: 4718500 - DNA, 15 bp, Homo sapiens
caccggggcctcgga

SEQ ID NO: 4718501 - DNA, 17 bp, Homo sapiens
caccgtgggctccctga

SEQ ID NO: 4718502 - DNA, 16 bp, Homo sapiens
cacctaaaccctctgt

SEQ ID NO: 4718503 - DNA, 17 bp, Homo sapiens
cacctaaaccctctgtg

SEQ ID NO: 4718504 - DNA, 17 bp, Homo sapiens
cacctacagtgtacagt

SEQ ID NO: 4718505 - DNA, 20 bp, Homo sapiens
cacctacagtgtacagtctt

SEQ ID NO: 4718506 - DNA, 16 bp, Homo sapiens
cacctagaattggctg

SEQ ID NO: 4718507 - DNA, 17 bp, Homo sapiens
cacctagtggctgtcca

SEQ ID NO: 4718508 - DNA, 18 bp, Homo sapiens
cacctagtggctgtccag

SEQ ID NO: 4718509 - DNA, 19 bp, Homo sapiens
cacctagtggctgtccagt

SEQ ID NO: 4718510 - DNA, 15 bp, Homo sapiens
cacctcaccctctcc

SEQ ID NO: 4718511 - DNA, 22 bp, Homo sapiens
cacctcagagtatggagctcag

SEQ ID NO: 4718512 - DNA, 18 bp, Homo sapiens
cacctccaatgctgcctg

SEQ ID NO: 4718513 - DNA, 12 bp, Homo sapiens
cacctccttctc

SEQ ID NO: 4718514 - DNA, 14 bp, Homo sapiens
cacctctcccttgg

SEQ ID NO: 4718515 - DNA, 17 bp, Homo sapiens
cacctctcccttggatt

SEQ ID NO: 4718516 - DNA, 13 bp, Homo sapiens
cacctctggctgt

SEQ ID NO: 4718517 - DNA, 18 bp, Homo sapiens
cacctgaaattaatttgt

SEQ ID NO: 4718518 - DNA, 19 bp, Homo sapiens
cacctgaaattaatttgtg

SEQ ID NO: 4718519 - DNA, 21 bp, Homo sapiens
cacctgaaattaatttgtgaa

SEQ ID NO: 4718520 - DNA, 22 bp, Homo sapiens
cacctgaaattaatttgtgaat

SEQ ID NO: 4718521 - DNA, 15 bp, Homo sapiens
cacctgaagactcat

SEQ ID NO: 4718522 - DNA, 16 bp, Homo sapiens
cacctgcactaacaga

SEQ ID NO: 4718523 - DNA, 21 bp, Homo sapiens
cacctgcactaacagagtggc

SEQ ID NO: 4718524 - DNA, 18 bp, Homo sapiens
cacctgcaggttgggcca

SEQ ID NO: 4718525 - DNA, 15 bp, Homo sapiens
cacctgcattcttcc

SEQ ID NO: 4718526 - DNA, 14 bp, Homo sapiens
cacctgccagggac

SEQ ID NO: 4718527 - DNA, 12 bp, Homo sapiens
cacctggacccc

SEQ ID NO: 4718528 - DNA, 16 bp, Homo sapiens
cacctggacccctgca

SEQ ID NO: 4718529 - DNA, 14 bp, Homo sapiens
cacctggggctgct

SEQ ID NO: 4718530 - DNA, 15 bp, Homo sapiens
caccttactttccca

SEQ ID NO: 4718531 - DNA, 14 bp, Homo sapiens
caccttagacagtc

SEQ ID NO: 4718532 - DNA, 18 bp, Homo sapiens
caccttagacagtccctg

SEQ ID NO: 4718533 - DNA, 23 bp, Homo sapiens
caccttagacagtccctgccaat

SEQ ID NO: 4718534 - DNA, 15 bp, Homo sapiens
caccttccaaacaaa

SEQ ID NO: 4718535 - DNA, 14 bp, Homo sapiens
caccttggctcaag

SEQ ID NO: 4718536 - DNA, 14 bp, Homo sapiens
caccttggctgcag

SEQ ID NO: 4718537 - DNA, 14 bp, Homo sapiens
cacctttgtcccca

SEQ ID NO: 4718538 - DNA, 15 bp, Homo sapiens
cacctttgtccccac

SEQ ID NO: 4718539 - DNA, 20 bp, Homo sapiens
cacgagctgtttactaggga

SEQ ID NO: 4718540 - DNA, 15 bp, Homo sapiens
cacgcacacacacat

SEQ ID NO: 4718541 - DNA, 16 bp, Homo sapiens
cacgccagattctttc

SEQ ID NO: 4718542 - DNA, 20 bp, Homo sapiens
cacgccagattctttcctga

SEQ ID NO: 4718543 - DNA, 15 bp, Homo sapiens
cacgcccccactggt

SEQ ID NO: 4718544 - DNA, 17 bp, Homo sapiens
cacgcccccactggtga

SEQ ID NO: 4718545 - DNA, 18 bp, Homo sapiens
cacgcccccactggtgac

SEQ ID NO: 4718546 - DNA, 15 bp, Homo sapiens
cacgctggagtgcag

SEQ ID NO: 4718547 - DNA, 18 bp, Homo sapiens
cacgctggagtgcagtga

SEQ ID NO: 4718548 - DNA, 15 bp, Homo sapiens
cacggagccactcct

SEQ ID NO: 4718549 - DNA, 17 bp, Homo sapiens
cacggagccactcctct

SEQ ID NO: 4718550 - DNA, 16 bp, Homo sapiens
cacggccaggccagag

SEQ ID NO: 4718551 - DNA, 17 bp, Homo sapiens
cacggccaggccagagg

SEQ ID NO: 4718552 - DNA, 14 bp, Homo sapiens
cacggctcactgca

SEQ ID NO: 4718553 - DNA, 16 bp, Homo sapiens
cacggctcactgcagc

SEQ ID NO: 4718554 - DNA, 19 bp, Homo sapiens
cacggtttgaagcctggaa

SEQ ID NO: 4718555 - DNA, 20 bp, Homo sapiens
cacggtttgaagcctggaac

SEQ ID NO: 4718556 - DNA, 20 bp, Homo sapiens
cacgtcaaatgcatacaagt

SEQ ID NO: 4718557 - DNA, 21 bp, Homo sapiens
cacgtggaggagcagtgcagg

SEQ ID NO: 4718558 - DNA, 19 bp, Homo sapiens
ataatgtctctgtgagact

SEQ ID NO: 4718559 - DNA, 13 bp, Homo sapiens
ataatgtgaaaat

SEQ ID NO: 4718560 - DNA, 11 bp, Homo sapiens
ataatgttaaa

SEQ ID NO: 4718561 - DNA, 19 bp, Homo sapiens
ataatgttaaatttgtaag

SEQ ID NO: 4718562 - DNA, 14 bp, Homo sapiens
ataattacatcttt

SEQ ID NO: 4718563 - DNA, 21 bp, Homo sapiens
ataattccaggtagataactg

SEQ ID NO: 4718564 - DNA, 12 bp, Homo sapiens
ataattctaaag

SEQ ID NO: 4718565 - DNA, 21 bp, Homo sapiens
ataattctattgaaagttttt

SEQ ID NO: 4718566 - DNA, 17 bp, Homo sapiens
ataatttaaaaatatat

SEQ ID NO: 4718567 - DNA, 19 bp, Homo sapiens
ataatttaaaaatatattt

SEQ ID NO: 4718568 - DNA, 17 bp, Homo sapiens
ataattttgtgttgtac

SEQ ID NO: 4718569 - DNA, 20 bp, Homo sapiens
ataattttgtgttgtacaat

SEQ ID NO: 4718570 - DNA, 21 bp, Homo sapiens
ataattttgtgttgtacaatt

SEQ ID NO: 4718571 - DNA, 17 bp, Homo sapiens
atacaacatgattttat

SEQ ID NO: 4718572 - DNA, 10 bp, Homo sapiens
atacacacac

SEQ ID NO: 4718573 - DNA, 15 bp, Homo sapiens
atacacttttttcca

SEQ ID NO: 4718574 - DNA, 17 bp, Homo sapiens
atacacttttttccaaa

SEQ ID NO: 4718575 - DNA, 14 bp, Homo sapiens
atacagaactcttt

SEQ ID NO: 4718576 - DNA, 18 bp, Homo sapiens
atacagaactctttcaaa

SEQ ID NO: 4718577 - DNA, 23 bp, Homo sapiens
atacagaactctttcaaaacctt

SEQ ID NO: 4718578 - DNA, 12 bp, Homo sapiens
atacagacacat

SEQ ID NO: 4718579 - DNA, 14 bp, Homo sapiens
atacagagctctct

SEQ ID NO: 4718580 - DNA, 19 bp, Homo sapiens
atacagatcaggcagtgtt

SEQ ID NO: 4718581 - DNA, 20 bp, Homo sapiens
atacaggaaaagctgctgac

SEQ ID NO: 4718582 - DNA, 23 bp, Homo sapiens
atacaggaaaagctgctgacagt

SEQ ID NO: 4718583 - DNA, 22 bp, Homo sapiens
atacagtttgtcacatgaaaca

SEQ ID NO: 4718584 - DNA, 17 bp, Homo sapiens
atacatccctcagtttc

SEQ ID NO: 4718585 - DNA, 15 bp, Homo sapiens
atacatgctcttaga

SEQ ID NO: 4718586 - DNA, 22 bp, Homo sapiens
ataccagcgaggaggctccaga

SEQ ID NO: 4718587 - DNA, 18 bp, Homo sapiens
atacccaaatcctctcca

SEQ ID NO: 4718588 - DNA, 17 bp, Homo sapiens
atacccacccccaccca

SEQ ID NO: 4718589 - DNA, 15 bp, Homo sapiens
ataccccatttgatt

SEQ ID NO: 4718590 - DNA, 17 bp, Homo sapiens
ataccccctgcaaagcc

SEQ ID NO: 4718591 - DNA, 22 bp, Homo sapiens
ataccccctgcaaagcccagct

SEQ ID NO: 4718592 - DNA, 15 bp, Homo sapiens
atacctgtccccctg

SEQ ID NO: 4718593 - DNA, 15 bp, Homo sapiens
atacctttgccttgg

SEQ ID NO: 4718594 - DNA, 13 bp, Homo sapiens
atacggtgggggt

SEQ ID NO: 4718595 - DNA, 17 bp, Homo sapiens
atactaactgctgattt

SEQ ID NO: 4718596 - DNA, 14 bp, Homo sapiens
atactattaccacc

SEQ ID NO: 4718597 - DNA, 11 bp, Homo sapiens
atactcccatc

SEQ ID NO: 4718598 - DNA, 22 bp, Homo sapiens
atactccctttaaagagagttt

SEQ ID NO: 4718599 - DNA, 14 bp, Homo sapiens
atactgaaattatt

SEQ ID NO: 4718600 - DNA, 18 bp, Homo sapiens
atactgaaattattttct

SEQ ID NO: 4718601 - DNA, 20 bp, Homo sapiens
atactgaaattattttctcc

SEQ ID NO: 4718602 - DNA, 22 bp, Homo sapiens
atactgaaattattttctccaa

SEQ ID NO: 4718603 - DNA, 18 bp, Homo sapiens
atactgagccatttatac

SEQ ID NO: 4718604 - DNA, 12 bp, Homo sapiens
atactgattttt

SEQ ID NO: 4718605 - DNA, 14 bp, Homo sapiens
atactgatttttaa

SEQ ID NO: 4718606 - DNA, 14 bp, Homo sapiens
atactggactcagg

SEQ ID NO: 4718607 - DNA, 19 bp, Homo sapiens
atactggactcaggaactt

SEQ ID NO: 4718608 - DNA, 22 bp, Homo sapiens
atactggcctcgcctggcctga

SEQ ID NO: 4718609 - DNA, 14 bp, Homo sapiens
atactggtctcagg

SEQ ID NO: 4718610 - DNA, 19 bp, Homo sapiens
atactgtattttgtattgt

SEQ ID NO: 4718611 - DNA, 12 bp, Homo sapiens
atactgttgcac

SEQ ID NO: 4718612 - DNA, 16 bp, Homo sapiens
atacttaaatttggtt

SEQ ID NO: 4718613 - DNA, 16 bp, Homo sapiens
atacttacatatctga

SEQ ID NO: 4718614 - DNA, 20 bp, Homo sapiens
atacttacatatctgacttc

SEQ ID NO: 4718615 - DNA, 18 bp, Homo sapiens
atacttatttgtatatgg

SEQ ID NO: 4718616 - DNA, 18 bp, Homo sapiens
atactttgtttattgtaa

SEQ ID NO: 4718617 - DNA, 22 bp, Homo sapiens
atagaaaaggaagacagcattt

SEQ ID NO: 4718618 - DNA, 13 bp, Homo sapiens
atagaaatgctgg

SEQ ID NO: 4718619 - DNA, 17 bp, Homo sapiens
atagaacagagaaagag

SEQ ID NO: 4718620 - DNA, 13 bp, Homo sapiens
atagaacagtgct

SEQ ID NO: 4718621 - DNA, 18 bp, Homo sapiens
atagataggtcagtgcaa

SEQ ID NO: 4718622 - DNA, 18 bp, Homo sapiens
atagatagtaaaaagctt

SEQ ID NO: 4718623 - DNA, 15 bp, Homo sapiens
atagcctaggtgaca

SEQ ID NO: 4718624 - DNA, 22 bp, Homo sapiens
atagctacatcagtttgataca

SEQ ID NO: 4718625 - DNA, 17 bp, Homo sapiens
atagctactaattttaa

SEQ ID NO: 4718626 - DNA, 18 bp, Homo sapiens
atagctactaattttaaa

SEQ ID NO: 4718627 - DNA, 19 bp, Homo sapiens
atagctagctatttctatg

SEQ ID NO: 4718628 - DNA, 22 bp, Homo sapiens
atagctagctatttctatgtat

SEQ ID NO: 4718629 - DNA, 20 bp, Homo sapiens
atagctcaggtgtccctgca

SEQ ID NO: 4718630 - DNA, 20 bp, Homo sapiens
atagctgtgtgaacgtgtat

SEQ ID NO: 4718631 - DNA, 20 bp, Homo sapiens
ataggagaggatgagagccc

SEQ ID NO: 4718632 - DNA, 21 bp, Homo sapiens
ataggagaggatgagagccca

SEQ ID NO: 4718633 - DNA, 23 bp, Homo sapiens
ataggagaggatgagagcccaga

SEQ ID NO: 4718634 - DNA, 24 bp, Homo sapiens
ataggagaggatgagagcccagag

SEQ ID NO: 4718635 - DNA, 23 bp, Homo sapiens
ataggaggggtctggacatgtgg

SEQ ID NO: 4718636 - DNA, 18 bp, Homo sapiens
ataggcaggaacatacag

SEQ ID NO: 4718637 - DNA, 19 bp, Homo sapiens
ataggcaggaacatacaga

SEQ ID NO: 4718638 - DNA, 23 bp, Homo sapiens
ataggcaggaacatacagacaca

SEQ ID NO: 4718639 - DNA, 20 bp, Homo sapiens
ataggctattttctaaagac

SEQ ID NO: 4718640 - DNA, 20 bp, Homo sapiens
atagggtccttgaaacagaa

SEQ ID NO: 4718641 - DNA, 21 bp, Homo sapiens
ataggtataagtggtgtgtgt

SEQ ID NO: 4718642 - DNA, 13 bp, Homo sapiens
atagtaaaaataa

SEQ ID NO: 4718643 - DNA, 14 bp, Homo sapiens
atagtaattctcag

SEQ ID NO: 4718644 - DNA, 22 bp, Homo sapiens
atagtagatgtggcctttgaat

SEQ ID NO: 4718645 - DNA, 21 bp, Homo sapiens
atagtagccaaagttaaatgt

SEQ ID NO: 4718646 - DNA, 20 bp, Homo sapiens
atagtaggggttgaagaaaa

SEQ ID NO: 4718647 - DNA, 12 bp, Homo sapiens
atagtatatcta

SEQ ID NO: 4718648 - DNA, 17 bp, Homo sapiens
atagtatggtggctggg

SEQ ID NO: 4718649 - DNA, 18 bp, Homo sapiens
atagtatggtggctgggt

SEQ ID NO: 4718650 - DNA, 17 bp, Homo sapiens
atagtgcttcttgtaat

SEQ ID NO: 4718651 - DNA, 15 bp, Homo sapiens
atagttaaaatgctg

SEQ ID NO: 4718652 - DNA, 13 bp, Homo sapiens
atagttacataat

SEQ ID NO: 4718653 - DNA, 16 bp, Homo sapiens
atataaaagactgacc

SEQ ID NO: 4718654 - DNA, 13 bp, Homo sapiens
atataaacactat

SEQ ID NO: 4718655 - DNA, 22 bp, Homo sapiens
atataaattttttttgtttcat

SEQ ID NO: 4718656 - DNA, 18 bp, Homo sapiens
atataagaaggaaaaatt

SEQ ID NO: 4718657 - DNA, 18 bp, Homo sapiens
atatacatttgttggtaa

SEQ ID NO: 4718658 - DNA, 19 bp, Homo sapiens
atatagtaggggttgaaga

SEQ ID NO: 4718659 - DNA, 21 bp, Homo sapiens
atatagttgtctttctttgct

SEQ ID NO: 4718660 - DNA, 14 bp, Homo sapiens
atatatacatatat

SEQ ID NO: 4718661 - DNA, 15 bp, Homo sapiens
atatatagtatttaa

SEQ ID NO: 4718662 - DNA, 22 bp, Homo sapiens
atatatagtatttaattgtttc

SEQ ID NO: 4718663 - DNA, 15 bp, Homo sapiens
atatatataaattga

SEQ ID NO: 4718664 - DNA, 13 bp, Homo sapiens
atatatattttaa

SEQ ID NO: 4718665 - DNA, 19 bp, Homo sapiens
atatatcttataaagtgga

SEQ ID NO: 4718666 - DNA, 16 bp, Homo sapiens
atatattattcatctt

SEQ ID NO: 4718667 - DNA, 14 bp, Homo sapiens
atatatttaagcct

SEQ ID NO: 4718668 - DNA, 14 bp, Homo sapiens
atctgttgttccaa

SEQ ID NO: 4718669 - DNA, 15 bp, Homo sapiens
atctgttgttccaaa

SEQ ID NO: 4718670 - DNA, 13 bp, Homo sapiens
atctgttgtttga

SEQ ID NO: 4718671 - DNA, 20 bp, Homo sapiens
atcttaaacataataaatca

SEQ ID NO: 4718672 - DNA, 15 bp, Homo sapiens
atcttacctttatga

SEQ ID NO: 4718673 - DNA, 13 bp, Homo sapiens
atcttcagctggt

SEQ ID NO: 4718674 - DNA, 14 bp, Homo sapiens
atcttcagctggtg

SEQ ID NO: 4718675 - DNA, 20 bp, Homo sapiens
atcttcagctggtggatggt

SEQ ID NO: 4718676 - DNA, 15 bp, Homo sapiens
atcttctccaggatg

SEQ ID NO: 4718677 - DNA, 14 bp, Homo sapiens
atcttcttcaccat

SEQ ID NO: 4718678 - DNA, 16 bp, Homo sapiens
atcttgctctgctgac

SEQ ID NO: 4718679 - DNA, 16 bp, Homo sapiens
atctttaaatgatgta

SEQ ID NO: 4718680 - DNA, 19 bp, Homo sapiens
atctttaaatgatgtacag

SEQ ID NO: 4718681 - DNA, 15 bp, Homo sapiens
atctttgaatatgta

SEQ ID NO: 4718682 - DNA, 19 bp, Homo sapiens
atctttgattctccttcag

SEQ ID NO: 4718683 - DNA, 18 bp, Homo sapiens
atctttgtgttgctttca

SEQ ID NO: 4718684 - DNA, 19 bp, Homo sapiens
atcttttgacctgtggtgc

SEQ ID NO: 4718685 - DNA, 15 bp, Homo sapiens
atgaaaacattgatg

SEQ ID NO: 4718686 - DNA, 14 bp, Homo sapiens
atgaaaacctgcat

SEQ ID NO: 4718687 - DNA, 15 bp, Homo sapiens
atgaaaataaagaat

SEQ ID NO: 4718688 - DNA, 20 bp, Homo sapiens
atgaaaatgcaacaacatgt

SEQ ID NO: 4718689 - DNA, 15 bp, Homo sapiens
atgaaaatgtcttgt

SEQ ID NO: 4718690 - DNA, 18 bp, Homo sapiens
atgaaagggcccagagag

SEQ ID NO: 4718691 - DNA, 16 bp, Homo sapiens
atgaaagtgagacttt

SEQ ID NO: 4718692 - DNA, 11 bp, Homo sapiens
atgaaatggat

SEQ ID NO: 4718693 - DNA, 17 bp, Homo sapiens
atgaacctggagggcta

SEQ ID NO: 4718694 - DNA, 14 bp, Homo sapiens
atgaagaaagtgga

SEQ ID NO: 4718695 - DNA, 14 bp, Homo sapiens
atgaagccttctga

SEQ ID NO: 4718696 - DNA, 17 bp, Homo sapiens
atgaagggtcatttctc

SEQ ID NO: 4718697 - DNA, 19 bp, Homo sapiens
atgaaggtttctgaaaatt

SEQ ID NO: 4718698 - DNA, 16 bp, Homo sapiens
atgaagttgattcata

SEQ ID NO: 4718699 - DNA, 19 bp, Homo sapiens
atgaagtttccttggctgg

SEQ ID NO: 4718700 - DNA, 22 bp, Homo sapiens
atgaatgaggaacaatcacaaa

SEQ ID NO: 4718701 - DNA, 23 bp, Homo sapiens
atgaatggctcactatggtgcca

SEQ ID NO: 4718702 - DNA, 15 bp, Homo sapiens
atgaatttgactggt

SEQ ID NO: 4718703 - DNA, 18 bp, Homo sapiens
atgaatttgggatactaa

SEQ ID NO: 4718704 - DNA, 18 bp, Homo sapiens
atgacaactggaatagtt

SEQ ID NO: 4718705 - DNA, 20 bp, Homo sapiens
atgacagatatatttaagcc

SEQ ID NO: 4718706 - DNA, 20 bp, Homo sapiens
atgacctacagtgctgtgta

SEQ ID NO: 4718707 - DNA, 20 bp, Homo sapiens
atgactacatttagcccctc

SEQ ID NO: 4718708 - DNA, 22 bp, Homo sapiens
atgactatgcgtggctggaacc

SEQ ID NO: 4718709 - DNA, 14 bp, Homo sapiens
atgactcaaagtct

SEQ ID NO: 4718710 - DNA, 17 bp, Homo sapiens
atgagaaaatgtcttta

SEQ ID NO: 4718711 - DNA, 21 bp, Homo sapiens
atgagaaaggttgaagcacca

SEQ ID NO: 4718712 - DNA, 18 bp, Homo sapiens
atgagacaggacctagga

SEQ ID NO: 4718713 - DNA, 20 bp, Homo sapiens
atgagacaggacctaggata

SEQ ID NO: 4718714 - DNA, 16 bp, Homo sapiens
atgagagcataattta

SEQ ID NO: 4718715 - DNA, 13 bp, Homo sapiens
atgagagcccaga

SEQ ID NO: 4718716 - DNA, 15 bp, Homo sapiens
atgagcatcaggcca

SEQ ID NO: 4718717 - DNA, 14 bp, Homo sapiens
atgagcatcccagg

SEQ ID NO: 4718718 - DNA, 16 bp, Homo sapiens
atgagcctcagcatcc

SEQ ID NO: 4718719 - DNA, 17 bp, Homo sapiens
atgagcctcagcatcct

SEQ ID NO: 4718720 - DNA, 22 bp, Homo sapiens
atgagctacttcttattcactt

SEQ ID NO: 4718721 - DNA, 20 bp, Homo sapiens
atgagggtatcaaataaaat

SEQ ID NO: 4718722 - DNA, 18 bp, Homo sapiens
atgaggtcagagcctgca

SEQ ID NO: 4718723 - DNA, 14 bp, Homo sapiens
atgagtatttggta

SEQ ID NO: 4718724 - DNA, 13 bp, Homo sapiens
atgagtcccctgt

SEQ ID NO: 4718725 - DNA, 23 bp, Homo sapiens
atgagtcccctgtttgtttctga

SEQ ID NO: 4718726 - DNA, 16 bp, Homo sapiens
atgagttattcataaa

SEQ ID NO: 4718727 - DNA, 21 bp, Homo sapiens
atgagtttttatggttccaat

SEQ ID NO: 4718728 - DNA, 22 bp, Homo sapiens
atgataaaaaagtgtcctataa

SEQ ID NO: 4718729 - DNA, 23 bp, Homo sapiens
atgatcacggctcactgcagcct

SEQ ID NO: 4718730 - DNA, 17 bp, Homo sapiens
atgatctaggaagactt

SEQ ID NO: 4718731 - DNA, 20 bp, Homo sapiens
atgatctaggaagactttgg

SEQ ID NO: 4718732 - DNA, 13 bp, Homo sapiens
atgatctatttgt

SEQ ID NO: 4718733 - DNA, 14 bp, Homo sapiens
atgatctatttgta

SEQ ID NO: 4718734 - DNA, 15 bp, Homo sapiens
atgatctatttgtag

SEQ ID NO: 4718735 - DNA, 18 bp, Homo sapiens
atgatctttgcagacagg

SEQ ID NO: 4718736 - DNA, 21 bp, Homo sapiens
atgatctttgcagacaggcaa

SEQ ID NO: 4718737 - DNA, 15 bp, Homo sapiens
atgatgaaactgtca

SEQ ID NO: 4718738 - DNA, 21 bp, Homo sapiens
atgatgcatggagtgtttgac

SEQ ID NO: 4718739 - DNA, 17 bp, Homo sapiens
atgatgtacaggcagat

SEQ ID NO: 4718740 - DNA, 19 bp, Homo sapiens
atgatgtctttttattaaa

SEQ ID NO: 4718741 - DNA, 22 bp, Homo sapiens
atgattagaaattacctgtgga

SEQ ID NO: 4718742 - DNA, 21 bp, Homo sapiens
atgattagttaaaaaaagaaa

SEQ ID NO: 4718743 - DNA, 18 bp, Homo sapiens
atgattcccttttcttta

SEQ ID NO: 4718744 - DNA, 18 bp, Homo sapiens
atgattcttccagataat

SEQ ID NO: 4718745 - DNA, 20 bp, Homo sapiens
atgattcttccttttattaa

SEQ ID NO: 4718746 - DNA, 18 bp, Homo sapiens
atgatttaataaaataat

SEQ ID NO: 4718747 - DNA, 16 bp, Homo sapiens
atgatttttaaagaaa

SEQ ID NO: 4718748 - DNA, 22 bp, Homo sapiens
atgcacaactagttaaaagcct

SEQ ID NO: 4718749 - DNA, 13 bp, Homo sapiens
atgcaccagccct

SEQ ID NO: 4718750 - DNA, 14 bp, Homo sapiens
atgcacgaccttgg

SEQ ID NO: 4718751 - DNA, 12 bp, Homo sapiens
atgcactttgtt

SEQ ID NO: 4718752 - DNA, 15 bp, Homo sapiens
atgcactttgttctg

SEQ ID NO: 4718753 - DNA, 16 bp, Homo sapiens
atgcactttgttctgg

SEQ ID NO: 4718754 - DNA, 22 bp, Homo sapiens
atgcagacatgagtgcgtgctc

SEQ ID NO: 4718755 - DNA, 13 bp, Homo sapiens
atgcagagagcca

SEQ ID NO: 4718756 - DNA, 22 bp, Homo sapiens
atgcagagagccattttgtgaa

SEQ ID NO: 4718757 - DNA, 18 bp, Homo sapiens
atgcagaggtccacaaca

SEQ ID NO: 4718758 - DNA, 18 bp, Homo sapiens
atgcaggtttgaccagga

SEQ ID NO: 4718759 - DNA, 21 bp, Homo sapiens
atgcaggtttgaccaggaaag

SEQ ID NO: 4718760 - DNA, 19 bp, Homo sapiens
atgcagtgatatggcagaa

SEQ ID NO: 4718761 - DNA, 21 bp, Homo sapiens
atgcataaatatgcagtgata

SEQ ID NO: 4718762 - DNA, 14 bp, Homo sapiens
atgcatacaagttt

SEQ ID NO: 4718763 - DNA, 21 bp, Homo sapiens
atgcatataatgaataaatca

SEQ ID NO: 4718764 - DNA, 22 bp, Homo sapiens
atgcatggagtgtttgacgaag

SEQ ID NO: 4718765 - DNA, 19 bp, Homo sapiens
atgcattagattatcaaaa

SEQ ID NO: 4718766 - DNA, 21 bp, Homo sapiens
atgcattcttggttggctggc

SEQ ID NO: 4718767 - DNA, 18 bp, Homo sapiens
atgccaagcactgtgctc

SEQ ID NO: 4718768 - DNA, 15 bp, Homo sapiens
atgccacaccaagct

SEQ ID NO: 4718769 - DNA, 20 bp, Homo sapiens
atgccacaccaagctgtgcc

SEQ ID NO: 4718770 - DNA, 21 bp, Homo sapiens
atgccacaccaagctgtgcca

SEQ ID NO: 4718771 - DNA, 17 bp, Homo sapiens
atgccatggacagaaga

SEQ ID NO: 4718772 - DNA, 18 bp, Homo sapiens
atgccatggacagaagaa

SEQ ID NO: 4718773 - DNA, 12 bp, Homo sapiens
atgcccaaggga

SEQ ID NO: 4718774 - DNA, 15 bp, Homo sapiens
atgcccaagggaaag

SEQ ID NO: 4718775 - DNA, 14 bp, Homo sapiens
atgcccagcccctt

SEQ ID NO: 4718776 - DNA, 21 bp, Homo sapiens
atgccccgtccccctctggct

SEQ ID NO: 4718777 - DNA, 21 bp, Homo sapiens
atgcctggatggggctgcacc

SEQ ID NO: 4718778 - DNA, 12 bp, Homo sapiens
aaaccctctgtg

SEQ ID NO: 4718779 - DNA, 15 bp, Homo sapiens
aaaccctctgtgaaa

SEQ ID NO: 4718780 - DNA, 18 bp, Homo sapiens
aaacctctaatttatttt

SEQ ID NO: 4718781 - DNA, 23 bp, Homo sapiens
aaacctgaactttcattggattt

SEQ ID NO: 4718782 - DNA, 16 bp, Homo sapiens
aaacctgcctgggttt

SEQ ID NO: 4718783 - DNA, 18 bp, Homo sapiens
aaaccttgtttctttctg

SEQ ID NO: 4718784 - DNA, 15 bp, Homo sapiens
aaaccttttttaaga

SEQ ID NO: 4718785 - DNA, 12 bp, Homo sapiens
aaacgtgaaaat

SEQ ID NO: 4718786 - DNA, 23 bp, Homo sapiens
aaactaccagtgggcatgtatta

SEQ ID NO: 4718787 - DNA, 23 bp, Homo sapiens
aaactcagcctcaataagccttg

SEQ ID NO: 4718788 - DNA, 15 bp, Homo sapiens
aaactcctactgctt

SEQ ID NO: 4718789 - DNA, 22 bp, Homo sapiens
aaactcttatctcagtcatgca

SEQ ID NO: 4718790 - DNA, 11 bp, Homo sapiens
aaactgccccc

SEQ ID NO: 4718791 - DNA, 22 bp, Homo sapiens
aaactggtattttatctttgat

SEQ ID NO: 4718792 - DNA, 17 bp, Homo sapiens
aaactgtgaatgcttct

SEQ ID NO: 4718793 - DNA, 21 bp, Homo sapiens
aaagaaaaacaatgaaattga

SEQ ID NO: 4718794 - DNA, 14 bp, Homo sapiens
aaagaaagcaactt

SEQ ID NO: 4718795 - DNA, 17 bp, Homo sapiens
aaagaaaggttgcgttt

SEQ ID NO: 4718796 - DNA, 23 bp, Homo sapiens
aaagaaagttgcacggctgctga

SEQ ID NO: 4718797 - DNA, 13 bp, Homo sapiens
aaagaaatatatt

SEQ ID NO: 4718798 - DNA, 19 bp, Homo sapiens
aaagaaatatattattcat

SEQ ID NO: 4718799 - DNA, 14 bp, Homo sapiens
aaagaaatcaattt

SEQ ID NO: 4718800 - DNA, 18 bp, Homo sapiens
aaagaagtggggacagag

SEQ ID NO: 4718801 - DNA, 20 bp, Homo sapiens
aaagaagtttgggctaacat

SEQ ID NO: 4718802 - DNA, 17 bp, Homo sapiens
aaagaatggaaggtgga

SEQ ID NO: 4718803 - DNA, 22 bp, Homo sapiens
aaagaattggtcttaatgttga

SEQ ID NO: 4718804 - DNA, 19 bp, Homo sapiens
aaagacaaatcaaagcaga

SEQ ID NO: 4718805 - DNA, 13 bp, Homo sapiens
aaagacagtgaaa

SEQ ID NO: 4718806 - DNA, 17 bp, Homo sapiens
aaagaccaaattttgag

SEQ ID NO: 4718807 - DNA, 18 bp, Homo sapiens
aaagataaatttgttgaa

SEQ ID NO: 4718808 - DNA, 18 bp, Homo sapiens
aaagataataaattgatt

SEQ ID NO: 4718809 - DNA, 23 bp, Homo sapiens
aaagcaaattactccaaggttta

SEQ ID NO: 4718810 - DNA, 14 bp, Homo sapiens
aaagcaatatgcat

SEQ ID NO: 4718811 - DNA, 21 bp, Homo sapiens
aaagcacttacaccagtttga

SEQ ID NO: 4718812 - DNA, 17 bp, Homo sapiens
aaagcacttactttttt

SEQ ID NO: 4718813 - DNA, 21 bp, Homo sapiens
aaagcagattacctcttgccc

SEQ ID NO: 4718814 - DNA, 15 bp, Homo sapiens
aaagccaaagctagg

SEQ ID NO: 4718815 - DNA, 15 bp, Homo sapiens
aaagcccaaagtggt

SEQ ID NO: 4718816 - DNA, 18 bp, Homo sapiens
aaagcccaaagtggtata

SEQ ID NO: 4718817 - DNA, 16 bp, Homo sapiens
aaagcccattcattcc

SEQ ID NO: 4718818 - DNA, 21 bp, Homo sapiens
aaagcctctgtgtcactggct

SEQ ID NO: 4718819 - DNA, 17 bp, Homo sapiens
aaagctaggcctggcca

SEQ ID NO: 4718820 - DNA, 22 bp, Homo sapiens
aaagctattagccaggatcatg

SEQ ID NO: 4718821 - DNA, 23 bp, Homo sapiens
aaagctattagccaggatcatgg

SEQ ID NO: 4718822 - DNA, 12 bp, Homo sapiens
aaagctgaaaac

SEQ ID NO: 4718823 - DNA, 13 bp, Homo sapiens
aaagctgctgaca

SEQ ID NO: 4718824 - DNA, 17 bp, Homo sapiens
aaagctgtgtctctgta

SEQ ID NO: 4718825 - DNA, 16 bp, Homo sapiens
aaaggaaaatgtctgt

SEQ ID NO: 4718826 - DNA, 17 bp, Homo sapiens
aaaggaatcatttctat

SEQ ID NO: 4718827 - DNA, 13 bp, Homo sapiens
aaaggacaaacag

SEQ ID NO: 4718828 - DNA, 14 bp, Homo sapiens
aaaggagataaatc

SEQ ID NO: 4718829 - DNA, 15 bp, Homo sapiens
aaaggagataaatct

SEQ ID NO: 4718830 - DNA, 14 bp, Homo sapiens
aaaggattaatctg

SEQ ID NO: 4718831 - DNA, 15 bp, Homo sapiens
aaaggctccaggagc

SEQ ID NO: 4718832 - DNA, 16 bp, Homo sapiens
aaaggctccaggagca

SEQ ID NO: 4718833 - DNA, 19 bp, Homo sapiens
aaagggaaagttttgttct

SEQ ID NO: 4718834 - DNA, 21 bp, Homo sapiens
aaagggcatgggtcgggagag

SEQ ID NO: 4718835 - DNA, 20 bp, Homo sapiens
aaagggcccagagagggtgg

SEQ ID NO: 4718836 - DNA, 20 bp, Homo sapiens
aaaggtttaagaaatagaat

SEQ ID NO: 4718837 - DNA, 18 bp, Homo sapiens
aaaggttttattttgtaa

SEQ ID NO: 4718838 - DNA, 18 bp, Homo sapiens
aaagtaatttctaaagca

SEQ ID NO: 4718839 - DNA, 19 bp, Homo sapiens
aaagtacttctccaccctg

SEQ ID NO: 4718840 - DNA, 20 bp, Homo sapiens
aaagtacttctccaccctgc

SEQ ID NO: 4718841 - DNA, 19 bp, Homo sapiens
aaagtataaaattatattt

SEQ ID NO: 4718842 - DNA, 23 bp, Homo sapiens
aaagtctgctctcatataagaca

SEQ ID NO: 4718843 - DNA, 23 bp, Homo sapiens
aaagtgagactttgagggtgtat

SEQ ID NO: 4718844 - DNA, 20 bp, Homo sapiens
aaagtggaacgaaaatgaaa

SEQ ID NO: 4718845 - DNA, 15 bp, Homo sapiens
aaagtggaagtatgt

SEQ ID NO: 4718846 - DNA, 20 bp, Homo sapiens
aaagtggtatagaaatgctg

SEQ ID NO: 4718847 - DNA, 13 bp, Homo sapiens
aaagtgtgtgtgc

SEQ ID NO: 4718848 - DNA, 14 bp, Homo sapiens
aaagtgtgtgtgca

SEQ ID NO: 4718849 - DNA, 12 bp, Homo sapiens
aaagttaaatgt

SEQ ID NO: 4718850 - DNA, 13 bp, Homo sapiens
aaagtttctttga

SEQ ID NO: 4718851 - DNA, 14 bp, Homo sapiens
aaagtttgtccttt

SEQ ID NO: 4718852 - DNA, 12 bp, Homo sapiens
aaagttttgaaa

SEQ ID NO: 4718853 - DNA, 14 bp, Homo sapiens
aaagttttgaaaag

SEQ ID NO: 4718854 - DNA, 15 bp, Homo sapiens
aaagttttgttctgt

SEQ ID NO: 4718855 - DNA, 19 bp, Homo sapiens
aaataaaactaaggaaccc

SEQ ID NO: 4718856 - DNA, 22 bp, Homo sapiens
aaataaaccaaaggaaaatgtc

SEQ ID NO: 4718857 - DNA, 11 bp, Homo sapiens
aaataaataat

SEQ ID NO: 4718858 - DNA, 12 bp, Homo sapiens
aaataacaatga

SEQ ID NO: 4718859 - DNA, 12 bp, Homo sapiens
aaataatgtctc

SEQ ID NO: 4718860 - DNA, 21 bp, Homo sapiens
aaatacaagttaaggtatctg

SEQ ID NO: 4718861 - DNA, 17 bp, Homo sapiens
aaatacagctggattgg

SEQ ID NO: 4718862 - DNA, 13 bp, Homo sapiens
aaatacatgacat

SEQ ID NO: 4718863 - DNA, 15 bp, Homo sapiens
aaatacggtgggggt

SEQ ID NO: 4718864 - DNA, 18 bp, Homo sapiens
aaatactaactgctgatt

SEQ ID NO: 4718865 - DNA, 15 bp, Homo sapiens
aaatactggactcag

SEQ ID NO: 4718866 - DNA, 18 bp, Homo sapiens
aaatacttaaatttggtt

SEQ ID NO: 4718867 - DNA, 20 bp, Homo sapiens
aaatagacagcctttctgct

SEQ ID NO: 4718868 - DNA, 18 bp, Homo sapiens
aaatagcttattatagaa

SEQ ID NO: 4718869 - DNA, 16 bp, Homo sapiens
aaataggaaagacttt

SEQ ID NO: 4718870 - DNA, 16 bp, Homo sapiens
aaataggagaggatga

SEQ ID NO: 4718871 - DNA, 16 bp, Homo sapiens
aaatagggtccttgaa

SEQ ID NO: 4718872 - DNA, 19 bp, Homo sapiens
aaatagtatgaaaatggaa

SEQ ID NO: 4718873 - DNA, 17 bp, Homo sapiens
aaatatatcttataaag

SEQ ID NO: 4718874 - DNA, 18 bp, Homo sapiens
aaatatatgctaagtctt

SEQ ID NO: 4718875 - DNA, 21 bp, Homo sapiens
aaatatcaaagtcattaaaga

SEQ ID NO: 4718876 - DNA, 22 bp, Homo sapiens
aaatatcaaagtcattaaagac

SEQ ID NO: 4718877 - DNA, 16 bp, Homo sapiens
aaatatcatataaaca

SEQ ID NO: 4718878 - DNA, 23 bp, Homo sapiens
aaatatcccttggacattttatg

SEQ ID NO: 4718879 - DNA, 20 bp, Homo sapiens
aaatatgaagacataaaccc

SEQ ID NO: 4718880 - DNA, 14 bp, Homo sapiens
aaatatgcagtgat

SEQ ID NO: 4718881 - DNA, 12 bp, Homo sapiens
aaatattaaaat

SEQ ID NO: 4718882 - DNA, 15 bp, Homo sapiens
aaatattaaaatcac

SEQ ID NO: 4718883 - DNA, 16 bp, Homo sapiens
aaatattttagatgtt

SEQ ID NO: 4718884 - DNA, 17 bp, Homo sapiens
aaatattttagatgtta

SEQ ID NO: 4718885 - DNA, 20 bp, Homo sapiens
aaatcaaactgtagttgttt

SEQ ID NO: 4718886 - DNA, 22 bp, Homo sapiens
aaatcaaatgtggctgtatcca

SEQ ID NO: 4718887 - DNA, 19 bp, Homo sapiens
aaatcaatgctataactat

SEQ ID NO: 4718888 - DNA, 21 bp, Homo sapiens
aagaaaagttttgtaaatttc

SEQ ID NO: 4718889 - DNA, 17 bp, Homo sapiens
aagaaaatatacatttg

SEQ ID NO: 4718890 - DNA, 15 bp, Homo sapiens
aagaaaatctttata

SEQ ID NO: 4718891 - DNA, 12 bp, Homo sapiens
aagaaaatgaat

SEQ ID NO: 4718892 - DNA, 17 bp, Homo sapiens
aagaaagagaaggagcc

SEQ ID NO: 4718893 - DNA, 17 bp, Homo sapiens
aagaaagatatctatga

SEQ ID NO: 4718894 - DNA, 22 bp, Homo sapiens
aagaaagattttatacccttga

SEQ ID NO: 4718895 - DNA, 14 bp, Homo sapiens
aagaaatcaatttt

SEQ ID NO: 4718896 - DNA, 13 bp, Homo sapiens
aagaaatggtgaa

SEQ ID NO: 4718897 - DNA, 21 bp, Homo sapiens
aagaaatttccactcaggtct

SEQ ID NO: 4718898 - DNA, 22 bp, Homo sapiens
aagaacggggctcttctcattt

SEQ ID NO: 4718899 - DNA, 23 bp, Homo sapiens
aagaacggggctcttctcatttc

SEQ ID NO: 4718900 - DNA, 17 bp, Homo sapiens
aagaactgttggttatt

SEQ ID NO: 4718901 - DNA, 14 bp, Homo sapiens
aagaagcaggctac

SEQ ID NO: 4718902 - DNA, 16 bp, Homo sapiens
aagaagctgttgtaca

SEQ ID NO: 4718903 - DNA, 17 bp, Homo sapiens
aagaagctgttgtacat

SEQ ID NO: 4718904 - DNA, 22 bp, Homo sapiens
aagaagctgttgtacatttatg

SEQ ID NO: 4718905 - DNA, 17 bp, Homo sapiens
aagaaggaaaaatttga

SEQ ID NO: 4718906 - DNA, 14 bp, Homo sapiens
aagaaggatgatgt

SEQ ID NO: 4718907 - DNA, 17 bp, Homo sapiens
aagaaggatgatgtctt

SEQ ID NO: 4718908 - DNA, 19 bp, Homo sapiens
aagaaggcagcaggtggca

SEQ ID NO: 4718909 - DNA, 17 bp, Homo sapiens
aagaaggtatttttcca

SEQ ID NO: 4718910 - DNA, 18 bp, Homo sapiens
aagaaggtatttttccaa

SEQ ID NO: 4718911 - DNA, 23 bp, Homo sapiens
aagaaggtttcagaaagaagtgg

SEQ ID NO: 4718912 - DNA, 19 bp, Homo sapiens
aagaatgtctgtaccttga

SEQ ID NO: 4718913 - DNA, 20 bp, Homo sapiens
aagaatgttagagtaatgaa

SEQ ID NO: 4718914 - DNA, 19 bp, Homo sapiens
aagaattattcagtgaatt

SEQ ID NO: 4718915 - DNA, 21 bp, Homo sapiens
aagaattggccatcttaaaaa

SEQ ID NO: 4718916 - DNA, 19 bp, Homo sapiens
aagaatttctttataaaat

SEQ ID NO: 4718917 - DNA, 13 bp, Homo sapiens
aagacaaatattc

SEQ ID NO: 4718918 - DNA, 13 bp, Homo sapiens
aagacaccagagc

SEQ ID NO: 4718919 - DNA, 16 bp, Homo sapiens
aagacaccagagcaga

SEQ ID NO: 4718920 - DNA, 21 bp, Homo sapiens
aagacaccagagcagatgcag

SEQ ID NO: 4718921 - DNA, 22 bp, Homo sapiens
aagacaccagagcagatgcaga

SEQ ID NO: 4718922 - DNA, 14 bp, Homo sapiens
aagacaggagacaa

SEQ ID NO: 4718923 - DNA, 20 bp, Homo sapiens
aagacataacgtttttcctt

SEQ ID NO: 4718924 - DNA, 22 bp, Homo sapiens
aagacccttgtggtcccacccc

SEQ ID NO: 4718925 - DNA, 19 bp, Homo sapiens
aagaccttctccttcacct

SEQ ID NO: 4718926 - DNA, 16 bp, Homo sapiens
aagacgtgattttgct

SEQ ID NO: 4718927 - DNA, 23 bp, Homo sapiens
aagacgtgattttgctgtagaag

SEQ ID NO: 4718928 - DNA, 12 bp, Homo sapiens
aagactaaaagt

SEQ ID NO: 4718929 - DNA, 18 bp, Homo sapiens
aagacttccagagcctca

SEQ ID NO: 4718930 - DNA, 16 bp, Homo sapiens
aagactttggaaagac

SEQ ID NO: 4718931 - DNA, 20 bp, Homo sapiens
aagagacagtcaccccagga

SEQ ID NO: 4718932 - DNA, 15 bp, Homo sapiens
aagagacatccaaat

SEQ ID NO: 4718933 - DNA, 15 bp, Homo sapiens
aagagcacagccctc

SEQ ID NO: 4718934 - DNA, 19 bp, Homo sapiens
aagagcacagccctcccgc

SEQ ID NO: 4718935 - DNA, 18 bp, Homo sapiens
aagagcagtggtaagaat

SEQ ID NO: 4718936 - DNA, 21 bp, Homo sapiens
aagagccatgtagaagctgca

SEQ ID NO: 4718937 - DNA, 21 bp, Homo sapiens
aagagcgagagatcaaagatg

SEQ ID NO: 4718938 - DNA, 16 bp, Homo sapiens
aagagcttaacagtgt

SEQ ID NO: 4718939 - DNA, 15 bp, Homo sapiens
aagaggagatgacta

SEQ ID NO: 4718940 - DNA, 17 bp, Homo sapiens
aagagggacgcctgggg

SEQ ID NO: 4718941 - DNA, 21 bp, Homo sapiens
aagagggagggagggctccag

SEQ ID NO: 4718942 - DNA, 17 bp, Homo sapiens
aagagggcacacactgt

SEQ ID NO: 4718943 - DNA, 22 bp, Homo sapiens
aagagggtctgaggaatccaga

SEQ ID NO: 4718944 - DNA, 14 bp, Homo sapiens
aagagtgtagaagc

SEQ ID NO: 4718945 - DNA, 18 bp, Homo sapiens
aagagtgtagaagcattc

SEQ ID NO: 4718946 - DNA, 15 bp, Homo sapiens
aagataaaaatcagt

SEQ ID NO: 4718947 - DNA, 22 bp, Homo sapiens
aagatacagaactctttcaaaa

SEQ ID NO: 4718948 - DNA, 17 bp, Homo sapiens
aagatactcaagcaggt

SEQ ID NO: 4718949 - DNA, 19 bp, Homo sapiens
aagatattttaaaatctgt

SEQ ID NO: 4718950 - DNA, 20 bp, Homo sapiens
aagatccaaatgctgtgcaa

SEQ ID NO: 4718951 - DNA, 21 bp, Homo sapiens
aagatccaaatgctgtgcaaa

SEQ ID NO: 4718952 - DNA, 19 bp, Homo sapiens
aagatgaaaccgtccctga

SEQ ID NO: 4718953 - DNA, 16 bp, Homo sapiens
aagatgttatggtgtt

SEQ ID NO: 4718954 - DNA, 22 bp, Homo sapiens
aagattaacactcatttccaat

SEQ ID NO: 4718955 - DNA, 11 bp, Homo sapiens
aagattctatg

SEQ ID NO: 4718956 - DNA, 22 bp, Homo sapiens
aagattctatgttaatatttta

SEQ ID NO: 4718957 - DNA, 13 bp, Homo sapiens
aagattctttccc

SEQ ID NO: 4718958 - DNA, 13 bp, Homo sapiens
aagatttttctca

SEQ ID NO: 4718959 - DNA, 14 bp, Homo sapiens
aagatttttctcaa

SEQ ID NO: 4718960 - DNA, 20 bp, Homo sapiens
aagatttttctcaaagtttt

SEQ ID NO: 4718961 - DNA, 16 bp, Homo sapiens
aagcaaattactccaa

SEQ ID NO: 4718962 - DNA, 15 bp, Homo sapiens
aagcactgtgctcag

SEQ ID NO: 4718963 - DNA, 21 bp, Homo sapiens
aagcagaccactgataaaacc

SEQ ID NO: 4718964 - DNA, 11 bp, Homo sapiens
aagcagctctt

SEQ ID NO: 4718965 - DNA, 18 bp, Homo sapiens
aagcaggcttctatgaaa

SEQ ID NO: 4718966 - DNA, 16 bp, Homo sapiens
aagcaggcttgtgctt

SEQ ID NO: 4718967 - DNA, 19 bp, Homo sapiens
aagcatgagtggccttaat

SEQ ID NO: 4718968 - DNA, 16 bp, Homo sapiens
aagcatggccctgctg

SEQ ID NO: 4718969 - DNA, 17 bp, Homo sapiens
aagcatggccctgctgc

SEQ ID NO: 4718970 - DNA, 20 bp, Homo sapiens
aagcattccttctttgataa

SEQ ID NO: 4718971 - DNA, 23 bp, Homo sapiens
aagcatttaatgtagccatggga

SEQ ID NO: 4718972 - DNA, 16 bp, Homo sapiens
aagcattttcagcatc

SEQ ID NO: 4718973 - DNA, 17 bp, Homo sapiens
aagccaaagctaggcct

SEQ ID NO: 4718974 - DNA, 22 bp, Homo sapiens
aagccaaagctaggcctggcca

SEQ ID NO: 4718975 - DNA, 17 bp, Homo sapiens
aagccaataacacacag

SEQ ID NO: 4718976 - DNA, 17 bp, Homo sapiens
aagccacaggcctgaga

SEQ ID NO: 4718977 - DNA, 17 bp, Homo sapiens
aagccagcaccggacca

SEQ ID NO: 4718978 - DNA, 22 bp, Homo sapiens
aagccagcaccggaccagcctg

SEQ ID NO: 4718979 - DNA, 20 bp, Homo sapiens
aagcccagcactgcttgagg

SEQ ID NO: 4718980 - DNA, 23 bp, Homo sapiens
aagcccagcactgcttgaggaaa

SEQ ID NO: 4718981 - DNA, 13 bp, Homo sapiens
aagcccagcttga

SEQ ID NO: 4718982 - DNA, 16 bp, Homo sapiens
aagcccattcattcca

SEQ ID NO: 4718983 - DNA, 23 bp, Homo sapiens
aagcctcaagttccagtgcagag

SEQ ID NO: 4718984 - DNA, 20 bp, Homo sapiens
aagcctctgtgtcactggct

SEQ ID NO: 4718985 - DNA, 19 bp, Homo sapiens
aagcctttcataccagtca

SEQ ID NO: 4718986 - DNA, 14 bp, Homo sapiens
aagcgattcttctg

SEQ ID NO: 4718987 - DNA, 23 bp, Homo sapiens
aagcgcttctttctgactctaaa

SEQ ID NO: 4718988 - DNA, 23 bp, Homo sapiens
aagcggaaaaggttttattttgt

SEQ ID NO: 4718989 - DNA, 15 bp, Homo sapiens
aagcgtgagccactg

SEQ ID NO: 4718990 - DNA, 17 bp, Homo sapiens
aagctaagatgggtgga

SEQ ID NO: 4718991 - DNA, 13 bp, Homo sapiens
aagctagctcccc

SEQ ID NO: 4718992 - DNA, 18 bp, Homo sapiens
aagctagctcccctcctc

SEQ ID NO: 4718993 - DNA, 19 bp, Homo sapiens
aagctagctcccctcctct

SEQ ID NO: 4718994 - DNA, 12 bp, Homo sapiens
aagctaggcctg

SEQ ID NO: 4718995 - DNA, 18 bp, Homo sapiens
aagctaggcctggccaga

SEQ ID NO: 4718996 - DNA, 22 bp, Homo sapiens
aagctaggcctggccagatgca

SEQ ID NO: 4718997 - DNA, 16 bp, Homo sapiens
aatcacagtgttatgt

SEQ ID NO: 4718998 - DNA, 19 bp, Homo sapiens
aatcacattcgagtgtttc

SEQ ID NO: 4718999 - DNA, 14 bp, Homo sapiens
aatcacctcccacc

SEQ ID NO: 4719000 - DNA, 17 bp, Homo sapiens
aatcacctcctgtgttg

SEQ ID NO: 4719001 - DNA, 21 bp, Homo sapiens
aatcagtatatttggtttcta

SEQ ID NO: 4719002 - DNA, 14 bp, Homo sapiens
aatcagtgtgttac

SEQ ID NO: 4719003 - DNA, 16 bp, Homo sapiens
aatcagtgtgttacta

SEQ ID NO: 4719004 - DNA, 14 bp, Homo sapiens
aatcagttctcaat

SEQ ID NO: 4719005 - DNA, 21 bp, Homo sapiens
aatcatacaaatactatccaa

SEQ ID NO: 4719006 - DNA, 15 bp, Homo sapiens
aatcatcaaaaagaa

SEQ ID NO: 4719007 - DNA, 15 bp, Homo sapiens
aatcattctgtaaag

SEQ ID NO: 4719008 - DNA, 23 bp, Homo sapiens
aatcattggcctggcaaaataaa

SEQ ID NO: 4719009 - DNA, 22 bp, Homo sapiens
aatcatttgggttaatatggct

SEQ ID NO: 4719010 - DNA, 18 bp, Homo sapiens
aatccaatactgcccaag

SEQ ID NO: 4719011 - DNA, 15 bp, Homo sapiens
aatccaatattgtaa

SEQ ID NO: 4719012 - DNA, 15 bp, Homo sapiens
aatccacatctttac

SEQ ID NO: 4719013 - DNA, 15 bp, Homo sapiens
aatccactcccaggc

SEQ ID NO: 4719014 - DNA, 18 bp, Homo sapiens
aatccactcccaggcagc

SEQ ID NO: 4719015 - DNA, 15 bp, Homo sapiens
aatccagtagggaaa

SEQ ID NO: 4719016 - DNA, 24 bp, Homo sapiens
aatccagtattatattatcatatc

SEQ ID NO: 4719017 - DNA, 20 bp, Homo sapiens
aatccccagatatttatgta

SEQ ID NO: 4719018 - DNA, 18 bp, Homo sapiens
aatccccttctcatcact

SEQ ID NO: 4719019 - DNA, 14 bp, Homo sapiens
aatcctggggaaca

SEQ ID NO: 4719020 - DNA, 16 bp, Homo sapiens
aatcgccttatgagaa

SEQ ID NO: 4719021 - DNA, 18 bp, Homo sapiens
aatcgccttatgagaaca

SEQ ID NO: 4719022 - DNA, 20 bp, Homo sapiens
aatctaagaaaaggggagag

SEQ ID NO: 4719023 - DNA, 18 bp, Homo sapiens
aatctaatgacattcaat

SEQ ID NO: 4719024 - DNA, 22 bp, Homo sapiens
aatctattaatagctgccttaa

SEQ ID NO: 4719025 - DNA, 18 bp, Homo sapiens
aatctcggctcactgcat

SEQ ID NO: 4719026 - DNA, 16 bp, Homo sapiens
aatctctccattcccg

SEQ ID NO: 4719027 - DNA, 12 bp, Homo sapiens
aatctgaagaaa

SEQ ID NO: 4719028 - DNA, 12 bp, Homo sapiens
aatctgacatat

SEQ ID NO: 4719029 - DNA, 16 bp, Homo sapiens
aatctggattcatatt

SEQ ID NO: 4719030 - DNA, 19 bp, Homo sapiens
aatctgggcagacattatg

SEQ ID NO: 4719031 - DNA, 22 bp, Homo sapiens
aatctgtcacgtagaacttgga

SEQ ID NO: 4719032 - DNA, 13 bp, Homo sapiens
aatcttacaaaag

SEQ ID NO: 4719033 - DNA, 14 bp, Homo sapiens
aatcttacagctgg

SEQ ID NO: 4719034 - DNA, 14 bp, Homo sapiens
aatcttttcacaaa

SEQ ID NO: 4719035 - DNA, 16 bp, Homo sapiens
aatcttttcacaaata

SEQ ID NO: 4719036 - DNA, 17 bp, Homo sapiens
aatcttttcacaaataa

SEQ ID NO: 4719037 - DNA, 15 bp, Homo sapiens
aatgaaaatgtcttg

SEQ ID NO: 4719038 - DNA, 18 bp, Homo sapiens
aatgaaagctactcatag

SEQ ID NO: 4719039 - DNA, 14 bp, Homo sapiens
aatgaaattgacct

SEQ ID NO: 4719040 - DNA, 17 bp, Homo sapiens
aatgaaccacatcttgc

SEQ ID NO: 4719041 - DNA, 18 bp, Homo sapiens
aatgaagggtcatttctc

SEQ ID NO: 4719042 - DNA, 16 bp, Homo sapiens
aatgaatttgactggt

SEQ ID NO: 4719043 - DNA, 17 bp, Homo sapiens
aatgaatttgactggtt

SEQ ID NO: 4719044 - DNA, 11 bp, Homo sapiens
aatgaatttgg

SEQ ID NO: 4719045 - DNA, 16 bp, Homo sapiens
aatgactcaaagtctg

SEQ ID NO: 4719046 - DNA, 15 bp, Homo sapiens
aatgagaatttaagc

SEQ ID NO: 4719047 - DNA, 20 bp, Homo sapiens
aatgagctacttcttattca

SEQ ID NO: 4719048 - DNA, 21 bp, Homo sapiens
aatgagctcaaattgattttt

SEQ ID NO: 4719049 - DNA, 16 bp, Homo sapiens
aatgagtatttggtaa

SEQ ID NO: 4719050 - DNA, 13 bp, Homo sapiens
aatgatactgtgt

SEQ ID NO: 4719051 - DNA, 17 bp, Homo sapiens
aatgatcagctatatac

SEQ ID NO: 4719052 - DNA, 20 bp, Homo sapiens
aatgatccccagctgtttat

SEQ ID NO: 4719053 - DNA, 22 bp, Homo sapiens
aatgatccccagctgtttatgc

SEQ ID NO: 4719054 - DNA, 21 bp, Homo sapiens
aatgattcagtgttaaatgtg

SEQ ID NO: 4719055 - DNA, 22 bp, Homo sapiens
aatgattcttccttttattaaa

SEQ ID NO: 4719056 - DNA, 15 bp, Homo sapiens
aatgatttttgtgta

SEQ ID NO: 4719057 - DNA, 15 bp, Homo sapiens
aatgcaagcaaagta

SEQ ID NO: 4719058 - DNA, 13 bp, Homo sapiens
aatgcactttgtt

SEQ ID NO: 4719059 - DNA, 21 bp, Homo sapiens
aatgcactttgttctggctct

SEQ ID NO: 4719060 - DNA, 18 bp, Homo sapiens
aatgcagaggaggagaaa

SEQ ID NO: 4719061 - DNA, 17 bp, Homo sapiens
aatgcagttgttgtaca

SEQ ID NO: 4719062 - DNA, 12 bp, Homo sapiens
aatgcattcatg

SEQ ID NO: 4719063 - DNA, 18 bp, Homo sapiens
aatgcccttacacttact

SEQ ID NO: 4719064 - DNA, 22 bp, Homo sapiens
aatgcccttacacttactgttg

SEQ ID NO: 4719065 - DNA, 17 bp, Homo sapiens
aatgcctgagtgcctgg

SEQ ID NO: 4719066 - DNA, 12 bp, Homo sapiens
aatgcctttgag

SEQ ID NO: 4719067 - DNA, 14 bp, Homo sapiens
aatgcctttgagac

SEQ ID NO: 4719068 - DNA, 16 bp, Homo sapiens
aatgcctttgagacag

SEQ ID NO: 4719069 - DNA, 17 bp, Homo sapiens
aatgcctttgagacagt

SEQ ID NO: 4719070 - DNA, 19 bp, Homo sapiens
aatgcctttgagacagttt

SEQ ID NO: 4719071 - DNA, 14 bp, Homo sapiens
aatgcgcaggctgg

SEQ ID NO: 4719072 - DNA, 21 bp, Homo sapiens
aatgcgcaggctggccctgcc

SEQ ID NO: 4719073 - DNA, 21 bp, Homo sapiens
aatgctgcccagggtcagtgt

SEQ ID NO: 4719074 - DNA, 22 bp, Homo sapiens
aatgctggctgttggctggggg

SEQ ID NO: 4719075 - DNA, 22 bp, Homo sapiens
aatgctgtattagtcacagaga

SEQ ID NO: 4719076 - DNA, 13 bp, Homo sapiens
aatgctgtgaata

SEQ ID NO: 4719077 - DNA, 22 bp, Homo sapiens
aatgctgtgcaaacagtgtaag

SEQ ID NO: 4719078 - DNA, 14 bp, Homo sapiens
aatgcttctgattt

SEQ ID NO: 4719079 - DNA, 19 bp, Homo sapiens
aatgcttctgatttagcaa

SEQ ID NO: 4719080 - DNA, 18 bp, Homo sapiens
aatgcttgccaagaaatc

SEQ ID NO: 4719081 - DNA, 21 bp, Homo sapiens
aatggaaatgggcagagcaga

SEQ ID NO: 4719082 - DNA, 16 bp, Homo sapiens
aatggaacctcctttc

SEQ ID NO: 4719083 - DNA, 14 bp, Homo sapiens
aatggaagacacat

SEQ ID NO: 4719084 - DNA, 21 bp, Homo sapiens
aatggattggattatttaata

SEQ ID NO: 4719085 - DNA, 23 bp, Homo sapiens
aatggattggattatttaataac

SEQ ID NO: 4719086 - DNA, 19 bp, Homo sapiens
aatggatttaatccatttt

SEQ ID NO: 4719087 - DNA, 17 bp, Homo sapiens
aatggatttttctttaa

SEQ ID NO: 4719088 - DNA, 18 bp, Homo sapiens
aatggatttttctttaac

SEQ ID NO: 4719089 - DNA, 20 bp, Homo sapiens
aatggcacagcccaaagaag

SEQ ID NO: 4719090 - DNA, 12 bp, Homo sapiens
aatggcagcctt

SEQ ID NO: 4719091 - DNA, 22 bp, Homo sapiens
aatggcttatccagctggtgag

SEQ ID NO: 4719092 - DNA, 13 bp, Homo sapiens
aatgggacactaa

SEQ ID NO: 4719093 - DNA, 15 bp, Homo sapiens
aatgggattgtgtta

SEQ ID NO: 4719094 - DNA, 13 bp, Homo sapiens
aatgggcagagca

SEQ ID NO: 4719095 - DNA, 15 bp, Homo sapiens
aatggtgttccattg

SEQ ID NO: 4719096 - DNA, 23 bp, Homo sapiens
aatggtttgaatataaacactat

SEQ ID NO: 4719097 - DNA, 23 bp, Homo sapiens
aatgtaaaaatttaatttctgaa

SEQ ID NO: 4719098 - DNA, 18 bp, Homo sapiens
aatgtaaaagaaaatttt

SEQ ID NO: 4719099 - DNA, 13 bp, Homo sapiens
aatgtaaacattt

SEQ ID NO: 4719100 - DNA, 16 bp, Homo sapiens
aatgtaaatggtactt

SEQ ID NO: 4719101 - DNA, 12 bp, Homo sapiens
aatgtaattgga

SEQ ID NO: 4719102 - DNA, 19 bp, Homo sapiens
aatgtaattggaatcttca

SEQ ID NO: 4719103 - DNA, 15 bp, Homo sapiens
aatgtagaaattctt

SEQ ID NO: 4719104 - DNA, 15 bp, Homo sapiens
aatgtagttgtcaca

SEQ ID NO: 4719105 - DNA, 23 bp, Homo sapiens
aatgtattttggttgctgatgtt

SEQ ID NO: 4719106 - DNA, 15 bp, Homo sapiens
aatgtcacaggcagg

SEQ ID NO: 4719107 - DNA, 15 bp, Homo sapiens
acactgttctctgcc

SEQ ID NO: 4719108 - DNA, 18 bp, Homo sapiens
acactgttctctgccctc

SEQ ID NO: 4719109 - DNA, 22 bp, Homo sapiens
acactgttctctgccctccaag

SEQ ID NO: 4719110 - DNA, 17 bp, Homo sapiens
acactgttgataaaaac

SEQ ID NO: 4719111 - DNA, 23 bp, Homo sapiens
acacttactgttgtcctatggga

SEQ ID NO: 4719112 - DNA, 13 bp, Homo sapiens
acacttctcagga

SEQ ID NO: 4719113 - DNA, 14 bp, Homo sapiens
acacttggattttt

SEQ ID NO: 4719114 - DNA, 23 bp, Homo sapiens
acacttgttgattaatggaaatg

SEQ ID NO: 4719115 - DNA, 20 bp, Homo sapiens
acactttcattacttttaaa

SEQ ID NO: 4719116 - DNA, 19 bp, Homo sapiens
acactttgccatattttca

SEQ ID NO: 4719117 - DNA, 15 bp, Homo sapiens
acagaaatgctctga

SEQ ID NO: 4719118 - DNA, 16 bp, Homo sapiens
acagaacagcttcagg

SEQ ID NO: 4719119 - DNA, 17 bp, Homo sapiens
acagaacagcttcaggt

SEQ ID NO: 4719120 - DNA, 20 bp, Homo sapiens
acagaactctttcaaaacct

SEQ ID NO: 4719121 - DNA, 20 bp, Homo sapiens
acagaagaaggcagcaggtg

SEQ ID NO: 4719122 - DNA, 12 bp, Homo sapiens
acagaagcagct

SEQ ID NO: 4719123 - DNA, 13 bp, Homo sapiens
acagaataaaaga

SEQ ID NO: 4719124 - DNA, 18 bp, Homo sapiens
acagacacaggcccggct

SEQ ID NO: 4719125 - DNA, 22 bp, Homo sapiens
acagacacaggcccggctccag

SEQ ID NO: 4719126 - DNA, 15 bp, Homo sapiens
acagacagccctcca

SEQ ID NO: 4719127 - DNA, 14 bp, Homo sapiens
acagaccctgccct

SEQ ID NO: 4719128 - DNA, 16 bp, Homo sapiens
acagaccctgccctgt

SEQ ID NO: 4719129 - DNA, 16 bp, Homo sapiens
acagacctgctctgga

SEQ ID NO: 4719130 - DNA, 16 bp, Homo sapiens
acagagaaaatgaatt

SEQ ID NO: 4719131 - DNA, 19 bp, Homo sapiens
acagagaaagaggaagctt

SEQ ID NO: 4719132 - DNA, 14 bp, Homo sapiens
acagagacctcctg

SEQ ID NO: 4719133 - DNA, 20 bp, Homo sapiens
acagagactgaatagatatg

SEQ ID NO: 4719134 - DNA, 14 bp, Homo sapiens
acagagcccacgcc

SEQ ID NO: 4719135 - DNA, 18 bp, Homo sapiens
acagagcccacgccccca

SEQ ID NO: 4719136 - DNA, 19 bp, Homo sapiens
acagagcccacgcccccac

SEQ ID NO: 4719137 - DNA, 10 bp, Homo sapiens
acagagctgg

SEQ ID NO: 4719138 - DNA, 14 bp, Homo sapiens
acagaggcagcccc

SEQ ID NO: 4719139 - DNA, 23 bp, Homo sapiens
acagaggccatgggcctcctgtg

SEQ ID NO: 4719140 - DNA, 21 bp, Homo sapiens
acagagggggtggcctcccaa

SEQ ID NO: 4719141 - DNA, 17 bp, Homo sapiens
acagagtctcactgttg

SEQ ID NO: 4719142 - DNA, 19 bp, Homo sapiens
acagagtgagactctgtct

SEQ ID NO: 4719143 - DNA, 14 bp, Homo sapiens
acagagtggccgtc

SEQ ID NO: 4719144 - DNA, 20 bp, Homo sapiens
acagagttttcactcttatt

SEQ ID NO: 4719145 - DNA, 22 bp, Homo sapiens
acagatctctgctttggaaatc

SEQ ID NO: 4719146 - DNA, 13 bp, Homo sapiens
acagatgcccacg

SEQ ID NO: 4719147 - DNA, 14 bp, Homo sapiens
acagatgcccacgt

SEQ ID NO: 4719148 - DNA, 23 bp, Homo sapiens
acagatgggtgcttggaggaagg

SEQ ID NO: 4719149 - DNA, 15 bp, Homo sapiens
acagattcacactgt

SEQ ID NO: 4719150 - DNA, 19 bp, Homo sapiens
acagattcacactgtctgg

SEQ ID NO: 4719151 - DNA, 14 bp, Homo sapiens
acagatttgagctc

SEQ ID NO: 4719152 - DNA, 16 bp, Homo sapiens
acagcaaggaggctgg

SEQ ID NO: 4719153 - DNA, 18 bp, Homo sapiens
acagcaaggcacctgcag

SEQ ID NO: 4719154 - DNA, 19 bp, Homo sapiens
acagcaattcctcaggcta

SEQ ID NO: 4719155 - DNA, 19 bp, Homo sapiens
acagcacaatgttattacc

SEQ ID NO: 4719156 - DNA, 17 bp, Homo sapiens
acagcactcctcggcag

SEQ ID NO: 4719157 - DNA, 19 bp, Homo sapiens
acagcatcgtgatcactga

SEQ ID NO: 4719158 - DNA, 16 bp, Homo sapiens
acagccacggccaggc

SEQ ID NO: 4719159 - DNA, 16 bp, Homo sapiens
acagccatcccagcct

SEQ ID NO: 4719160 - DNA, 18 bp, Homo sapiens
acagccatcccagccttg

SEQ ID NO: 4719161 - DNA, 17 bp, Homo sapiens
acagcccacgtcctgtc

SEQ ID NO: 4719162 - DNA, 18 bp, Homo sapiens
acagcccgggctctgcct

SEQ ID NO: 4719163 - DNA, 21 bp, Homo sapiens
acagccctcccgccccttccc

SEQ ID NO: 4719164 - DNA, 22 bp, Homo sapiens
acagccctcccgccccttcccc

SEQ ID NO: 4719165 - DNA, 12 bp, Homo sapiens
acagcctccaag

SEQ ID NO: 4719166 - DNA, 14 bp, Homo sapiens
acagcctccaagtc

SEQ ID NO: 4719167 - DNA, 15 bp, Homo sapiens
acagcctccaagtca

SEQ ID NO: 4719168 - DNA, 15 bp, Homo sapiens
acagcctcccctgcc

SEQ ID NO: 4719169 - DNA, 17 bp, Homo sapiens
acagcctcccctgccag

SEQ ID NO: 4719170 - DNA, 19 bp, Homo sapiens
acagctaacaattgtgaag

SEQ ID NO: 4719171 - DNA, 15 bp, Homo sapiens
acagctaacacacag

SEQ ID NO: 4719172 - DNA, 16 bp, Homo sapiens
acagctaatgggacac

SEQ ID NO: 4719173 - DNA, 19 bp, Homo sapiens
acagctaatgggacactaa

SEQ ID NO: 4719174 - DNA, 20 bp, Homo sapiens
acagctacagctttgggtca

SEQ ID NO: 4719175 - DNA, 12 bp, Homo sapiens
acagctccttct

SEQ ID NO: 4719176 - DNA, 18 bp, Homo sapiens
acagctccttctgtccta

SEQ ID NO: 4719177 - DNA, 16 bp, Homo sapiens
acagctctgtcctggg

SEQ ID NO: 4719178 - DNA, 17 bp, Homo sapiens
acagctctgtcctggga

SEQ ID NO: 4719179 - DNA, 23 bp, Homo sapiens
acagctgcctgggatccctcatc

SEQ ID NO: 4719180 - DNA, 21 bp, Homo sapiens
acagctgctcaataaagtaca

SEQ ID NO: 4719181 - DNA, 18 bp, Homo sapiens
acagctgggtggcactgc

SEQ ID NO: 4719182 - DNA, 22 bp, Homo sapiens
acagcttacactgattggtgtt

SEQ ID NO: 4719183 - DNA, 16 bp, Homo sapiens
acagcttatggcatct

SEQ ID NO: 4719184 - DNA, 19 bp, Homo sapiens
acagcttcatttcctgtgt

SEQ ID NO: 4719185 - DNA, 15 bp, Homo sapiens
acagcttgtattttg

SEQ ID NO: 4719186 - DNA, 22 bp, Homo sapiens
acagctttgggtcatttttaac

SEQ ID NO: 4719187 - DNA, 16 bp, Homo sapiens
acaggaaaagctgctg

SEQ ID NO: 4719188 - DNA, 17 bp, Homo sapiens
acaggaaaagctgctga

SEQ ID NO: 4719189 - DNA, 18 bp, Homo sapiens
acaggaaaagctgctgac

SEQ ID NO: 4719190 - DNA, 21 bp, Homo sapiens
acaggaaaagctgctgacagt

SEQ ID NO: 4719191 - DNA, 12 bp, Homo sapiens
acaggaagcctc

SEQ ID NO: 4719192 - DNA, 15 bp, Homo sapiens
acaggaagcctcaag

SEQ ID NO: 4719193 - DNA, 18 bp, Homo sapiens
acaggagacaaaagagca

SEQ ID NO: 4719194 - DNA, 16 bp, Homo sapiens
acaggagtgagcacta

SEQ ID NO: 4719195 - DNA, 14 bp, Homo sapiens
acaggattattttg

SEQ ID NO: 4719196 - DNA, 12 bp, Homo sapiens
acaggcaagcac

SEQ ID NO: 4719197 - DNA, 16 bp, Homo sapiens
acaggcaagcacctcc

SEQ ID NO: 4719198 - DNA, 19 bp, Homo sapiens
acaggcaagcacctcctgc

SEQ ID NO: 4719199 - DNA, 16 bp, Homo sapiens
acaggcaatgctggct

SEQ ID NO: 4719200 - DNA, 17 bp, Homo sapiens
acaggcaatgctggctg

SEQ ID NO: 4719201 - DNA, 12 bp, Homo sapiens
acaggcagcaga

SEQ ID NO: 4719202 - DNA, 13 bp, Homo sapiens
acaggcaggtcca

SEQ ID NO: 4719203 - DNA, 16 bp, Homo sapiens
acaggcaggtccaggg

SEQ ID NO: 4719204 - DNA, 22 bp, Homo sapiens
acaggcatgttctctgaggaca

SEQ ID NO: 4719205 - DNA, 18 bp, Homo sapiens
acaggcccggctccaggc

SEQ ID NO: 4719206 - DNA, 12 bp, Homo sapiens
acaggctcctgc

SEQ ID NO: 4719207 - DNA, 21 bp, Homo sapiens
acaggctcctgccaccacgcc

SEQ ID NO: 4719208 - DNA, 14 bp, Homo sapiens
acaggctgggcttc

SEQ ID NO: 4719209 - DNA, 22 bp, Homo sapiens
acaggctgggcttcagtggcag

SEQ ID NO: 4719210 - DNA, 12 bp, Homo sapiens
acagggcacacc

SEQ ID NO: 4719211 - DNA, 20 bp, Homo sapiens
acagggtgctccttgtcaat

SEQ ID NO: 4719212 - DNA, 19 bp, Homo sapiens
acaggtgtgaaccaccaca

SEQ ID NO: 4719213 - DNA, 23 bp, Homo sapiens
acaggtgtgaaccaccacaccca

SEQ ID NO: 4719214 - DNA, 22 bp, Homo sapiens
acaggtgtgagccaccacgccc

SEQ ID NO: 4719215 - DNA, 14 bp, Homo sapiens
acagtaggagccca

SEQ ID NO: 4719216 - DNA, 15 bp, Homo sapiens
acagtattacttctg

SEQ ID NO: 4719217 - DNA, 13 bp, Homo sapiens
acccttacagtag

SEQ ID NO: 4719218 - DNA, 12 bp, Homo sapiens
acccttcttttc

SEQ ID NO: 4719219 - DNA, 20 bp, Homo sapiens
acccttgccgtctacctgag

SEQ ID NO: 4719220 - DNA, 15 bp, Homo sapiens
acccttgtggtccca

SEQ ID NO: 4719221 - DNA, 23 bp, Homo sapiens
acccttgtggtcccaccccacac

SEQ ID NO: 4719222 - DNA, 16 bp, Homo sapiens
accgcagacaggacca

SEQ ID NO: 4719223 - DNA, 17 bp, Homo sapiens
accgcagacaggaccag

SEQ ID NO: 4719224 - DNA, 14 bp, Homo sapiens
accgcatgccccct

SEQ ID NO: 4719225 - DNA, 19 bp, Homo sapiens
accggagagtgggggtggg

SEQ ID NO: 4719226 - DNA, 14 bp, Homo sapiens
accggctggcctgg

SEQ ID NO: 4719227 - DNA, 15 bp, Homo sapiens
accggctggcctggc

SEQ ID NO: 4719228 - DNA, 17 bp, Homo sapiens
accggctggcctggccc

SEQ ID NO: 4719229 - DNA, 18 bp, Homo sapiens
accggctggcctggcccc

SEQ ID NO: 4719230 - DNA, 19 bp, Homo sapiens
accggctggcctggcccct

SEQ ID NO: 4719231 - DNA, 19 bp, Homo sapiens
accgtagcgtatacatttg

SEQ ID NO: 4719232 - DNA, 19 bp, Homo sapiens
acctaaaatttgccctccc

SEQ ID NO: 4719233 - DNA, 14 bp, Homo sapiens
acctaaaccctctg

SEQ ID NO: 4719234 - DNA, 17 bp, Homo sapiens
acctaaaccctctgtga

SEQ ID NO: 4719235 - DNA, 17 bp, Homo sapiens
acctacagtgtacagtc

SEQ ID NO: 4719236 - DNA, 18 bp, Homo sapiens
acctacagtgtacagtct

SEQ ID NO: 4719237 - DNA, 16 bp, Homo sapiens
acctaccaccacgccc

SEQ ID NO: 4719238 - DNA, 20 bp, Homo sapiens
acctaccccatgaagatatt

SEQ ID NO: 4719239 - DNA, 14 bp, Homo sapiens
acctagaagggcta

SEQ ID NO: 4719240 - DNA, 17 bp, Homo sapiens
acctagctgttgtaaag

SEQ ID NO: 4719241 - DNA, 21 bp, Homo sapiens
acctagctgttgtaaagaatt

SEQ ID NO: 4719242 - DNA, 16 bp, Homo sapiens
acctagtggctgtcca

SEQ ID NO: 4719243 - DNA, 22 bp, Homo sapiens
acctcaggtaatcgacctgcct

SEQ ID NO: 4719244 - DNA, 16 bp, Homo sapiens
acctccacatcctcca

SEQ ID NO: 4719245 - DNA, 20 bp, Homo sapiens
acctccgcctcttgggttca

SEQ ID NO: 4719246 - DNA, 13 bp, Homo sapiens
acctcctgagaaa

SEQ ID NO: 4719247 - DNA, 12 bp, Homo sapiens
acctcctgcctc

SEQ ID NO: 4719248 - DNA, 16 bp, Homo sapiens
acctcctgtctctggc

SEQ ID NO: 4719249 - DNA, 17 bp, Homo sapiens
acctcctgtctctggcc

SEQ ID NO: 4719250 - DNA, 22 bp, Homo sapiens
acctcctgtgttgtgctgggag

SEQ ID NO: 4719251 - DNA, 12 bp, Homo sapiens
acctccttctct

SEQ ID NO: 4719252 - DNA, 16 bp, Homo sapiens
acctcctttctcttct

SEQ ID NO: 4719253 - DNA, 15 bp, Homo sapiens
acctcgggcctgctg

SEQ ID NO: 4719254 - DNA, 16 bp, Homo sapiens
acctctccagcctcag

SEQ ID NO: 4719255 - DNA, 14 bp, Homo sapiens
acctctctcactcc

SEQ ID NO: 4719256 - DNA, 12 bp, Homo sapiens
acctctcttgtg

SEQ ID NO: 4719257 - DNA, 21 bp, Homo sapiens
acctgaaaacactgtgcacat

SEQ ID NO: 4719258 - DNA, 19 bp, Homo sapiens
acctgaaattaatttgtga

SEQ ID NO: 4719259 - DNA, 18 bp, Homo sapiens
acctgaagactcattctt

SEQ ID NO: 4719260 - DNA, 17 bp, Homo sapiens
acctgacactcccttgg

SEQ ID NO: 4719261 - DNA, 19 bp, Homo sapiens
acctgacactcccttgggc

SEQ ID NO: 4719262 - DNA, 19 bp, Homo sapiens
acctgagctagaagctgga

SEQ ID NO: 4719263 - DNA, 20 bp, Homo sapiens
acctgaggcccttctctcca

SEQ ID NO: 4719264 - DNA, 14 bp, Homo sapiens
acctgaggggcctc

SEQ ID NO: 4719265 - DNA, 15 bp, Homo sapiens
acctgattgtgtctc

SEQ ID NO: 4719266 - DNA, 22 bp, Homo sapiens
acctgcaggttgggccatactg

SEQ ID NO: 4719267 - DNA, 17 bp, Homo sapiens
acctgcatatctctagt

SEQ ID NO: 4719268 - DNA, 13 bp, Homo sapiens
acctgccagggac

SEQ ID NO: 4719269 - DNA, 16 bp, Homo sapiens
acctgccagggacaga

SEQ ID NO: 4719270 - DNA, 18 bp, Homo sapiens
acctgccagggacagagg

SEQ ID NO: 4719271 - DNA, 16 bp, Homo sapiens
acctgcccccaatcca

SEQ ID NO: 4719272 - DNA, 18 bp, Homo sapiens
acctgcccctcctctctg

SEQ ID NO: 4719273 - DNA, 20 bp, Homo sapiens
acctgcccctcctctctgcc

SEQ ID NO: 4719274 - DNA, 23 bp, Homo sapiens
acctgccctggccccagccctac

SEQ ID NO: 4719275 - DNA, 22 bp, Homo sapiens
acctgcctcccttcatgcatgg

SEQ ID NO: 4719276 - DNA, 21 bp, Homo sapiens
acctgcctgacatttggagtg

SEQ ID NO: 4719277 - DNA, 16 bp, Homo sapiens
acctgcggcccaatcc

SEQ ID NO: 4719278 - DNA, 21 bp, Homo sapiens
acctggaagggctagaacctg

SEQ ID NO: 4719279 - DNA, 19 bp, Homo sapiens
acctggaattgtggggcaa

SEQ ID NO: 4719280 - DNA, 15 bp, Homo sapiens
acctggacccctgca

SEQ ID NO: 4719281 - DNA, 21 bp, Homo sapiens
acctggacccctgcattggaa

SEQ ID NO: 4719282 - DNA, 23 bp, Homo sapiens
acctggagaactagaacctggag

SEQ ID NO: 4719283 - DNA, 20 bp, Homo sapiens
acctggagagctagaacctg

SEQ ID NO: 4719284 - DNA, 20 bp, Homo sapiens
acctggagggctagaacctg

SEQ ID NO: 4719285 - DNA, 22 bp, Homo sapiens
acctggagggctagaacctggc

SEQ ID NO: 4719286 - DNA, 14 bp, Homo sapiens
acctggaggggcta

SEQ ID NO: 4719287 - DNA, 22 bp, Homo sapiens
acctggcaagctagaacctgga

SEQ ID NO: 4719288 - DNA, 18 bp, Homo sapiens
acctggggctgctggcct

SEQ ID NO: 4719289 - DNA, 20 bp, Homo sapiens
acctggggctgctggcctga

SEQ ID NO: 4719290 - DNA, 18 bp, Homo sapiens
acctgggttagggtgtgt

SEQ ID NO: 4719291 - DNA, 23 bp, Homo sapiens
acctgggttagggtgtgtgttca

SEQ ID NO: 4719292 - DNA, 23 bp, Homo sapiens
acctgtcacgattgtcatcagga

SEQ ID NO: 4719293 - DNA, 12 bp, Homo sapiens
acctgtccccct

SEQ ID NO: 4719294 - DNA, 14 bp, Homo sapiens
acctgtggatattt

SEQ ID NO: 4719295 - DNA, 17 bp, Homo sapiens
acctgtggccaagttct

SEQ ID NO: 4719296 - DNA, 21 bp, Homo sapiens
accttactgtggaggaaggat

SEQ ID NO: 4719297 - DNA, 22 bp, Homo sapiens
accttattgagcgtgattctgt

SEQ ID NO: 4719298 - DNA, 14 bp, Homo sapiens
accttctccttcac

SEQ ID NO: 4719299 - DNA, 22 bp, Homo sapiens
accttctgacgcagcctgagaa

SEQ ID NO: 4719300 - DNA, 18 bp, Homo sapiens
accttgaaaaaaaacagt

SEQ ID NO: 4719301 - DNA, 14 bp, Homo sapiens
accttgacagggca

SEQ ID NO: 4719302 - DNA, 16 bp, Homo sapiens
accttgacagggcaca

SEQ ID NO: 4719303 - DNA, 13 bp, Homo sapiens
accttgaggagaa

SEQ ID NO: 4719304 - DNA, 12 bp, Homo sapiens
accttggctgca

SEQ ID NO: 4719305 - DNA, 14 bp, Homo sapiens
accttgtagcatgt

SEQ ID NO: 4719306 - DNA, 13 bp, Homo sapiens
accttgtgaggga

SEQ ID NO: 4719307 - DNA, 13 bp, Homo sapiens
acctttatgaggt

SEQ ID NO: 4719308 - DNA, 22 bp, Homo sapiens
acctttattcagaactttagta

SEQ ID NO: 4719309 - DNA, 22 bp, Homo sapiens
acctttattgaagggtctgttt

SEQ ID NO: 4719310 - DNA, 14 bp, Homo sapiens
acctttcccatttc

SEQ ID NO: 4719311 - DNA, 15 bp, Homo sapiens
acctttgtcaaaaag

SEQ ID NO: 4719312 - DNA, 13 bp, Homo sapiens
acctttgtcccca

SEQ ID NO: 4719313 - DNA, 13 bp, Homo sapiens
acctttgtttcct

SEQ ID NO: 4719314 - DNA, 18 bp, Homo sapiens
accttttaagacattttc

SEQ ID NO: 4719315 - DNA, 20 bp, Homo sapiens
accttttttaagatttttct

SEQ ID NO: 4719316 - DNA, 22 bp, Homo sapiens
accttttttaagatttttctca

SEQ ID NO: 4719317 - DNA, 19 bp, Homo sapiens
acgaacctacagttttaac

SEQ ID NO: 4719318 - DNA, 19 bp, Homo sapiens
acgagctgtttactaggga

SEQ ID NO: 4719319 - DNA, 17 bp, Homo sapiens
acgatagttacataatc

SEQ ID NO: 4719320 - DNA, 15 bp, Homo sapiens
acgcacacacacata

SEQ ID NO: 4719321 - DNA, 18 bp, Homo sapiens
acgcacacacacatacag

SEQ ID NO: 4719322 - DNA, 15 bp, Homo sapiens
acgcacagccaagga

SEQ ID NO: 4719323 - DNA, 11 bp, Homo sapiens
acgcagcctga

SEQ ID NO: 4719324 - DNA, 12 bp, Homo sapiens
acgcagcctgag

SEQ ID NO: 4719325 - DNA, 13 bp, Homo sapiens
acgcagcctgaga

SEQ ID NO: 4719326 - DNA, 14 bp, Homo sapiens
acgcagcctgagaa

SEQ ID NO: 4719327 - DNA, 17 bp, Homo sapiens
acttataattttcctaa

SEQ ID NO: 4719328 - DNA, 13 bp, Homo sapiens
acttatcagatgc

SEQ ID NO: 4719329 - DNA, 17 bp, Homo sapiens
acttattgaatatatga

SEQ ID NO: 4719330 - DNA, 18 bp, Homo sapiens
acttattgaatatatgat

SEQ ID NO: 4719331 - DNA, 17 bp, Homo sapiens
acttatttatgaacctg

SEQ ID NO: 4719332 - DNA, 16 bp, Homo sapiens
acttcaaaaactaaaa

SEQ ID NO: 4719333 - DNA, 20 bp, Homo sapiens
acttcaaaaactaaaatcat

SEQ ID NO: 4719334 - DNA, 16 bp, Homo sapiens
acttcaggggctgccc

SEQ ID NO: 4719335 - DNA, 17 bp, Homo sapiens
acttcaggggctgcccg

SEQ ID NO: 4719336 - DNA, 12 bp, Homo sapiens
acttcccctcct

SEQ ID NO: 4719337 - DNA, 16 bp, Homo sapiens
acttcccctcctaccc

SEQ ID NO: 4719338 - DNA, 19 bp, Homo sapiens
acttccccttcctaattcc

SEQ ID NO: 4719339 - DNA, 23 bp, Homo sapiens
acttcgtgggatctgcccctccc

SEQ ID NO: 4719340 - DNA, 21 bp, Homo sapiens
acttctaaataaggtgtgaaa

SEQ ID NO: 4719341 - DNA, 13 bp, Homo sapiens
acttctatcctgt

SEQ ID NO: 4719342 - DNA, 20 bp, Homo sapiens
acttctcaggaaatggcttt

SEQ ID NO: 4719343 - DNA, 14 bp, Homo sapiens
acttctccaccctg

SEQ ID NO: 4719344 - DNA, 15 bp, Homo sapiens
acttctccaccctgc

SEQ ID NO: 4719345 - DNA, 16 bp, Homo sapiens
acttctccaccctgct

SEQ ID NO: 4719346 - DNA, 13 bp, Homo sapiens
acttctccagcct

SEQ ID NO: 4719347 - DNA, 15 bp, Homo sapiens
acttctccagcctag

SEQ ID NO: 4719348 - DNA, 20 bp, Homo sapiens
acttctttgctttgcccagc

SEQ ID NO: 4719349 - DNA, 24 bp, Homo sapiens
acttgaatgctagttatacttatt

SEQ ID NO: 4719350 - DNA, 19 bp, Homo sapiens
acttgaattttcccactgc

SEQ ID NO: 4719351 - DNA, 17 bp, Homo sapiens
acttgacagaacactgt

SEQ ID NO: 4719352 - DNA, 23 bp, Homo sapiens
acttgatgtgatgtggcaggagg

SEQ ID NO: 4719353 - DNA, 16 bp, Homo sapiens
acttgcctatctgact

SEQ ID NO: 4719354 - DNA, 15 bp, Homo sapiens
acttgctggctgtga

SEQ ID NO: 4719355 - DNA, 13 bp, Homo sapiens
acttgggacattg

SEQ ID NO: 4719356 - DNA, 23 bp, Homo sapiens
acttggtttcctatttcccctta

SEQ ID NO: 4719357 - DNA, 18 bp, Homo sapiens
acttgtaaatgtggtaaa

SEQ ID NO: 4719358 - DNA, 20 bp, Homo sapiens
acttgtaaatgtggtaaaga

SEQ ID NO: 4719359 - DNA, 14 bp, Homo sapiens
acttgtctttggac

SEQ ID NO: 4719360 - DNA, 20 bp, Homo sapiens
acttgtctttggaccctgag

SEQ ID NO: 4719361 - DNA, 13 bp, Homo sapiens
acttgtgccaaca

SEQ ID NO: 4719362 - DNA, 18 bp, Homo sapiens
acttgtgccaacactcaa

SEQ ID NO: 4719363 - DNA, 17 bp, Homo sapiens
acttgtggacacagctc

SEQ ID NO: 4719364 - DNA, 18 bp, Homo sapiens
acttgtggacacagctct

SEQ ID NO: 4719365 - DNA, 22 bp, Homo sapiens
acttgtggacacagctcttctc

SEQ ID NO: 4719366 - DNA, 19 bp, Homo sapiens
acttgttcattctgtgacc

SEQ ID NO: 4719367 - DNA, 13 bp, Homo sapiens
acttgttctgtat

SEQ ID NO: 4719368 - DNA, 18 bp, Homo sapiens
actttaaagcaattgcat

SEQ ID NO: 4719369 - DNA, 15 bp, Homo sapiens
actttagaagcctgc

SEQ ID NO: 4719370 - DNA, 16 bp, Homo sapiens
actttatacacttgga

SEQ ID NO: 4719371 - DNA, 22 bp, Homo sapiens
actttgacctaaattatttact

SEQ ID NO: 4719372 - DNA, 23 bp, Homo sapiens
actttgagggtgtatattttctg

SEQ ID NO: 4719373 - DNA, 23 bp, Homo sapiens
actttggaaagacttttccaacc

SEQ ID NO: 4719374 - DNA, 13 bp, Homo sapiens
actttggaaagag

SEQ ID NO: 4719375 - DNA, 17 bp, Homo sapiens
actttggggctaattta

SEQ ID NO: 4719376 - DNA, 23 bp, Homo sapiens
actttggggttcggcctgtgtcc

SEQ ID NO: 4719377 - DNA, 14 bp, Homo sapiens
actttgtaggacaa

SEQ ID NO: 4719378 - DNA, 20 bp, Homo sapiens
actttgttagtttctccaag

SEQ ID NO: 4719379 - DNA, 23 bp, Homo sapiens
actttgttctggctcttccaggc

SEQ ID NO: 4719380 - DNA, 20 bp, Homo sapiens
acttttcataacctagcctt

SEQ ID NO: 4719381 - DNA, 23 bp, Homo sapiens
acttttgaagaacaaaaggcttt

SEQ ID NO: 4719382 - DNA, 18 bp, Homo sapiens
actttttaaaatgttggt

SEQ ID NO: 4719383 - DNA, 16 bp, Homo sapiens
actttttaaacagtgt

SEQ ID NO: 4719384 - DNA, 23 bp, Homo sapiens
acttttttgctatccagctattt

SEQ ID NO: 4719385 - DNA, 13 bp, Homo sapiens
agaaaaataaaga

SEQ ID NO: 4719386 - DNA, 13 bp, Homo sapiens
agaaaaatcaaag

SEQ ID NO: 4719387 - DNA, 19 bp, Homo sapiens
agaaaaatttacatggcaa

SEQ ID NO: 4719388 - DNA, 14 bp, Homo sapiens
agaaaactgcacaa

SEQ ID NO: 4719389 - DNA, 11 bp, Homo sapiens
agaaaaggaag

SEQ ID NO: 4719390 - DNA, 15 bp, Homo sapiens
agaaaatctttataa

SEQ ID NO: 4719391 - DNA, 21 bp, Homo sapiens
agaaaatgaaatgcatatttg

SEQ ID NO: 4719392 - DNA, 21 bp, Homo sapiens
agaaaatgaatttgactggtt

SEQ ID NO: 4719393 - DNA, 16 bp, Homo sapiens
agaaaatgatgagttt

SEQ ID NO: 4719394 - DNA, 18 bp, Homo sapiens
agaaaatgatgagttttt

SEQ ID NO: 4719395 - DNA, 16 bp, Homo sapiens
agaaacctgggagaga

SEQ ID NO: 4719396 - DNA, 14 bp, Homo sapiens
agaaacttccaaat

SEQ ID NO: 4719397 - DNA, 14 bp, Homo sapiens
agaaagaaaatgaa

SEQ ID NO: 4719398 - DNA, 15 bp, Homo sapiens
agaaagaagatgaat

SEQ ID NO: 4719399 - DNA, 20 bp, Homo sapiens
agaaagtggaaaacaaggaa

SEQ ID NO: 4719400 - DNA, 17 bp, Homo sapiens
agaaagttattcttggt

SEQ ID NO: 4719401 - DNA, 13 bp, Homo sapiens
agaaatagaaaag

SEQ ID NO: 4719402 - DNA, 15 bp, Homo sapiens
agaaatcaacttgtg

SEQ ID NO: 4719403 - DNA, 21 bp, Homo sapiens
agaaatcaattttttaaacca

SEQ ID NO: 4719404 - DNA, 14 bp, Homo sapiens
agaaatctttccag

SEQ ID NO: 4719405 - DNA, 15 bp, Homo sapiens
agaaatctttccagt

SEQ ID NO: 4719406 - DNA, 16 bp, Homo sapiens
agaaatctttccagtt

SEQ ID NO: 4719407 - DNA, 21 bp, Homo sapiens
agaaatgctggtttttcagtt

SEQ ID NO: 4719408 - DNA, 18 bp, Homo sapiens
agaaatttagagtcaatt

SEQ ID NO: 4719409 - DNA, 22 bp, Homo sapiens
agaaatttccactcaggtctgt

SEQ ID NO: 4719410 - DNA, 16 bp, Homo sapiens
agaacacaaggtcatt

SEQ ID NO: 4719411 - DNA, 17 bp, Homo sapiens
agaacactgtgaaaaca

SEQ ID NO: 4719412 - DNA, 14 bp, Homo sapiens
agaacagcttcagg

SEQ ID NO: 4719413 - DNA, 16 bp, Homo sapiens
agaacagcttcaggtt

SEQ ID NO: 4719414 - DNA, 23 bp, Homo sapiens
agaacaggtgttggtgacaattg

SEQ ID NO: 4719415 - DNA, 16 bp, Homo sapiens
agaacagtgtttgatt

SEQ ID NO: 4719416 - DNA, 17 bp, Homo sapiens
agaacagtgtttgattt

SEQ ID NO: 4719417 - DNA, 20 bp, Homo sapiens
agaacatggtgtgtgtctct

SEQ ID NO: 4719418 - DNA, 15 bp, Homo sapiens
agaaccgcattttga

SEQ ID NO: 4719419 - DNA, 23 bp, Homo sapiens
agaacctggagggctagaactgg

SEQ ID NO: 4719420 - DNA, 17 bp, Homo sapiens
agaacctgtagagctag

SEQ ID NO: 4719421 - DNA, 22 bp, Homo sapiens
agaactacaaacaaaatttcta

SEQ ID NO: 4719422 - DNA, 18 bp, Homo sapiens
agaactagccttatttct

SEQ ID NO: 4719423 - DNA, 23 bp, Homo sapiens
agaactcatccctaatgctgcag

SEQ ID NO: 4719424 - DNA, 21 bp, Homo sapiens
agaactgaattttgtctttat

SEQ ID NO: 4719425 - DNA, 20 bp, Homo sapiens
agaacttccccatacaaata

SEQ ID NO: 4719426 - DNA, 15 bp, Homo sapiens
agaactttcattttt

SEQ ID NO: 4719427 - DNA, 16 bp, Homo sapiens
agaactttgaaggaca

SEQ ID NO: 4719428 - DNA, 14 bp, Homo sapiens
agaagaagagaggc

SEQ ID NO: 4719429 - DNA, 14 bp, Homo sapiens
agaagaaggcagca

SEQ ID NO: 4719430 - DNA, 14 bp, Homo sapiens
agaagacaccagag

SEQ ID NO: 4719431 - DNA, 16 bp, Homo sapiens
agaagacaccagagca

SEQ ID NO: 4719432 - DNA, 19 bp, Homo sapiens
agaagacaccagagcagat

SEQ ID NO: 4719433 - DNA, 22 bp, Homo sapiens
agaagagagtccatatttcaat

SEQ ID NO: 4719434 - DNA, 22 bp, Homo sapiens
agaagatattagtcttggggca

SEQ ID NO: 4719435 - DNA, 18 bp, Homo sapiens
agaagatcctaaaacaaa

SEQ ID NO: 4719436 - DNA, 18 bp, Homo sapiens
agatatcctctgcttaaa

SEQ ID NO: 4719437 - DNA, 15 bp, Homo sapiens
agatatctatgactg

SEQ ID NO: 4719438 - DNA, 16 bp, Homo sapiens
agatatctatgactgt

SEQ ID NO: 4719439 - DNA, 16 bp, Homo sapiens
agatatttatgtatct

SEQ ID NO: 4719440 - DNA, 14 bp, Homo sapiens
agatcaaccccttc

SEQ ID NO: 4719441 - DNA, 17 bp, Homo sapiens
agatcacgccactgcac

SEQ ID NO: 4719442 - DNA, 19 bp, Homo sapiens
agatcactgtgcttatttt

SEQ ID NO: 4719443 - DNA, 20 bp, Homo sapiens
agatccaaatgctgtgcaaa

SEQ ID NO: 4719444 - DNA, 16 bp, Homo sapiens
agatcctaaaacaaaa

SEQ ID NO: 4719445 - DNA, 22 bp, Homo sapiens
agatcctaccccaattccttgt

SEQ ID NO: 4719446 - DNA, 21 bp, Homo sapiens
agatcctacttctctgagtca

SEQ ID NO: 4719447 - DNA, 18 bp, Homo sapiens
agatctctgctttggaaa

SEQ ID NO: 4719448 - DNA, 14 bp, Homo sapiens
agatgaaacacaaa

SEQ ID NO: 4719449 - DNA, 15 bp, Homo sapiens
agatgaatgtcagtt

SEQ ID NO: 4719450 - DNA, 21 bp, Homo sapiens
agatgacctacagtgctgtgt

SEQ ID NO: 4719451 - DNA, 15 bp, Homo sapiens
agatgcaccagccct

SEQ ID NO: 4719452 - DNA, 13 bp, Homo sapiens
agatgcagagagc

SEQ ID NO: 4719453 - DNA, 18 bp, Homo sapiens
agatgcagagagccattt

SEQ ID NO: 4719454 - DNA, 20 bp, Homo sapiens
agatgcagagagccattttg

SEQ ID NO: 4719455 - DNA, 19 bp, Homo sapiens
agatgcaggtttgaccagg

SEQ ID NO: 4719456 - DNA, 23 bp, Homo sapiens
agatgcaggtttgaccaggaaag

SEQ ID NO: 4719457 - DNA, 22 bp, Homo sapiens
agatgcattcttggttggctgg

SEQ ID NO: 4719458 - DNA, 11 bp, Homo sapiens
agatgccctga

SEQ ID NO: 4719459 - DNA, 18 bp, Homo sapiens
agatgctgtgtaacagaa

SEQ ID NO: 4719460 - DNA, 15 bp, Homo sapiens
agatgggggaaagca

SEQ ID NO: 4719461 - DNA, 22 bp, Homo sapiens
agatgtatgctttgaatgcaaa

SEQ ID NO: 4719462 - DNA, 18 bp, Homo sapiens
agatgtccctgaagtctt

SEQ ID NO: 4719463 - DNA, 17 bp, Homo sapiens
agatgtcgctgggtcct

SEQ ID NO: 4719464 - DNA, 13 bp, Homo sapiens
agatgtgtgttga

SEQ ID NO: 4719465 - DNA, 23 bp, Homo sapiens
agatgtgtgttgatactgttgca

SEQ ID NO: 4719466 - DNA, 18 bp, Homo sapiens
agatgttattatgctaat

SEQ ID NO: 4719467 - DNA, 17 bp, Homo sapiens
agatgttctaagtcttt

SEQ ID NO: 4719468 - DNA, 20 bp, Homo sapiens
agatgttctaagtctttcca

SEQ ID NO: 4719469 - DNA, 19 bp, Homo sapiens
agatgttttaccatcctta

SEQ ID NO: 4719470 - DNA, 19 bp, Homo sapiens
agattaacactcatttcca

SEQ ID NO: 4719471 - DNA, 19 bp, Homo sapiens
agattacctcttgcccttg

SEQ ID NO: 4719472 - DNA, 20 bp, Homo sapiens
agattacctcttgcccttgg

SEQ ID NO: 4719473 - DNA, 15 bp, Homo sapiens
agattagaacattta

SEQ ID NO: 4719474 - DNA, 16 bp, Homo sapiens
agattagaacatttaa

SEQ ID NO: 4719475 - DNA, 23 bp, Homo sapiens
agattagtaaatatgtgaagaaa

SEQ ID NO: 4719476 - DNA, 18 bp, Homo sapiens
agattatttctgtatttg

SEQ ID NO: 4719477 - DNA, 14 bp, Homo sapiens
agattcaagttgtg

SEQ ID NO: 4719478 - DNA, 13 bp, Homo sapiens
agattcacacatg

SEQ ID NO: 4719479 - DNA, 13 bp, Homo sapiens
agattcacactgt

SEQ ID NO: 4719480 - DNA, 17 bp, Homo sapiens
agattcacactgtctgg

SEQ ID NO: 4719481 - DNA, 18 bp, Homo sapiens
agattctatgttaatatt

SEQ ID NO: 4719482 - DNA, 21 bp, Homo sapiens
agattctatgttaatatttta

SEQ ID NO: 4719483 - DNA, 15 bp, Homo sapiens
agattctttcctgag

SEQ ID NO: 4719484 - DNA, 16 bp, Homo sapiens
agattctttcctgagg

SEQ ID NO: 4719485 - DNA, 19 bp, Homo sapiens
agattctttcctgaggctg

SEQ ID NO: 4719486 - DNA, 16 bp, Homo sapiens
agattgcaacaggctg

SEQ ID NO: 4719487 - DNA, 23 bp, Homo sapiens
agattgcaacaggctgggcttca

SEQ ID NO: 4719488 - DNA, 23 bp, Homo sapiens
agattggctcacactgagaatgt

SEQ ID NO: 4719489 - DNA, 16 bp, Homo sapiens
agatttgatatttgca

SEQ ID NO: 4719490 - DNA, 14 bp, Homo sapiens
agatttgtaacatt

SEQ ID NO: 4719491 - DNA, 15 bp, Homo sapiens
agatttgtaacatta

SEQ ID NO: 4719492 - DNA, 20 bp, Homo sapiens
agattttatttatatcttta

SEQ ID NO: 4719493 - DNA, 22 bp, Homo sapiens
agatttttctcaaagttttgaa

SEQ ID NO: 4719494 - DNA, 14 bp, Homo sapiens
agcaaaaagatgta

SEQ ID NO: 4719495 - DNA, 12 bp, Homo sapiens
agcaaagaaact

SEQ ID NO: 4719496 - DNA, 15 bp, Homo sapiens
agcaaccctgtgata

SEQ ID NO: 4719497 - DNA, 18 bp, Homo sapiens
agcaactgatcatatttg

SEQ ID NO: 4719498 - DNA, 16 bp, Homo sapiens
agcaagacgctgtgct

SEQ ID NO: 4719499 - DNA, 22 bp, Homo sapiens
agcaagagagagagagaatgag

SEQ ID NO: 4719500 - DNA, 15 bp, Homo sapiens
agcaagctcccaagg

SEQ ID NO: 4719501 - DNA, 22 bp, Homo sapiens
agcaaggaggctggctggggcc

SEQ ID NO: 4719502 - DNA, 13 bp, Homo sapiens
agcaagtgagagc

SEQ ID NO: 4719503 - DNA, 18 bp, Homo sapiens
agcaagtgagagctgggt

SEQ ID NO: 4719504 - DNA, 21 bp, Homo sapiens
agcaagtgattgggacagagg

SEQ ID NO: 4719505 - DNA, 12 bp, Homo sapiens
agcaatatgcat

SEQ ID NO: 4719506 - DNA, 17 bp, Homo sapiens
agcaattctcctgcctc

SEQ ID NO: 4719507 - DNA, 15 bp, Homo sapiens
agcacagaccctgcc

SEQ ID NO: 4719508 - DNA, 17 bp, Homo sapiens
agcacagaccctgccct

SEQ ID NO: 4719509 - DNA, 18 bp, Homo sapiens
agcacagaccctgccctg

SEQ ID NO: 4719510 - DNA, 19 bp, Homo sapiens
agcacagcaaggaggctgg

SEQ ID NO: 4719511 - DNA, 23 bp, Homo sapiens
agcacagcaaggaggctggctgg

SEQ ID NO: 4719512 - DNA, 17 bp, Homo sapiens
agcacaggttagggcat

SEQ ID NO: 4719513 - DNA, 17 bp, Homo sapiens
agcacatgccagggaaa

SEQ ID NO: 4719514 - DNA, 14 bp, Homo sapiens
agcacatgttcata

SEQ ID NO: 4719515 - DNA, 22 bp, Homo sapiens
agcaccaaaagcttaccaaggg

SEQ ID NO: 4719516 - DNA, 17 bp, Homo sapiens
agcacccgggctcaggg

SEQ ID NO: 4719517 - DNA, 18 bp, Homo sapiens
agcaccggaccagcctgg

SEQ ID NO: 4719518 - DNA, 14 bp, Homo sapiens
agcacctacagtgt

SEQ ID NO: 4719519 - DNA, 19 bp, Homo sapiens
agcacctacagtgtacagt

SEQ ID NO: 4719520 - DNA, 16 bp, Homo sapiens
agcacctcctgcctcg

SEQ ID NO: 4719521 - DNA, 21 bp, Homo sapiens
agcaccttagacagtccctgc

SEQ ID NO: 4719522 - DNA, 22 bp, Homo sapiens
agcaccttagacagtccctgcc

SEQ ID NO: 4719523 - DNA, 23 bp, Homo sapiens
agcaccttagacagtccctgcca

SEQ ID NO: 4719524 - DNA, 20 bp, Homo sapiens
agcactaaggtgtgctctga

SEQ ID NO: 4719525 - DNA, 14 bp, Homo sapiens
agcactcctcggca

SEQ ID NO: 4719526 - DNA, 10 bp, Homo sapiens
agcactgagg

SEQ ID NO: 4719527 - DNA, 14 bp, Homo sapiens
agcactgaggaaga

SEQ ID NO: 4719528 - DNA, 18 bp, Homo sapiens
agcactgtgctcagggct

SEQ ID NO: 4719529 - DNA, 13 bp, Homo sapiens
agcacttgctgta

SEQ ID NO: 4719530 - DNA, 21 bp, Homo sapiens
agcacttgtgggtttttgttt

SEQ ID NO: 4719531 - DNA, 16 bp, Homo sapiens
agcagaagggggtggt

SEQ ID NO: 4719532 - DNA, 22 bp, Homo sapiens
agcagaagggggtggtgtctcc

SEQ ID NO: 4719533 - DNA, 14 bp, Homo sapiens
agcagaatactggt

SEQ ID NO: 4719534 - DNA, 18 bp, Homo sapiens
agcagaatactggtctca

SEQ ID NO: 4719535 - DNA, 16 bp, Homo sapiens
agcagagaccatccct

SEQ ID NO: 4719536 - DNA, 18 bp, Homo sapiens
agcagagaccatccctga

SEQ ID NO: 4719537 - DNA, 20 bp, Homo sapiens
agcagagaccatccctgaag

SEQ ID NO: 4719538 - DNA, 20 bp, Homo sapiens
agcagagcaccttagacagt

SEQ ID NO: 4719539 - DNA, 15 bp, Homo sapiens
agcagagctctgccg

SEQ ID NO: 4719540 - DNA, 14 bp, Homo sapiens
agcagaggggctga

SEQ ID NO: 4719541 - DNA, 14 bp, Homo sapiens
agcagatgctggtc

SEQ ID NO: 4719542 - DNA, 20 bp, Homo sapiens
agcagccaagggatgaaaga

SEQ ID NO: 4719543 - DNA, 11 bp, Homo sapiens
agcagccacat

SEQ ID NO: 4719544 - DNA, 15 bp, Homo sapiens
agcagccctggagtc

SEQ ID NO: 4719545 - DNA, 18 bp, Homo sapiens
agcagcgctagtggaggg

SEQ ID NO: 4719546 - DNA, 23 bp, Homo sapiens
agctctgtatcaggacccagagg

SEQ ID NO: 4719547 - DNA, 16 bp, Homo sapiens
agctctgtcctgggag

SEQ ID NO: 4719548 - DNA, 21 bp, Homo sapiens
agctctgtcctgggagtgagc

SEQ ID NO: 4719549 - DNA, 23 bp, Homo sapiens
agctctgtcctgggagtgagctg

SEQ ID NO: 4719550 - DNA, 16 bp, Homo sapiens
agctcttctccaggct

SEQ ID NO: 4719551 - DNA, 23 bp, Homo sapiens
agctcttgtgaatattgtggctc

SEQ ID NO: 4719552 - DNA, 12 bp, Homo sapiens
agctcttgtttg

SEQ ID NO: 4719553 - DNA, 15 bp, Homo sapiens
agctgaaggctgagg

SEQ ID NO: 4719554 - DNA, 14 bp, Homo sapiens
agctgacacaaacc

SEQ ID NO: 4719555 - DNA, 17 bp, Homo sapiens
agctgaggcaattctaa

SEQ ID NO: 4719556 - DNA, 11 bp, Homo sapiens
agctgcaataa

SEQ ID NO: 4719557 - DNA, 13 bp, Homo sapiens
agctgcctgggat

SEQ ID NO: 4719558 - DNA, 19 bp, Homo sapiens
agctgcctgggatccctca

SEQ ID NO: 4719559 - DNA, 10 bp, Homo sapiens
agctgcctgt

SEQ ID NO: 4719560 - DNA, 16 bp, Homo sapiens
agctgcctgttcagct

SEQ ID NO: 4719561 - DNA, 18 bp, Homo sapiens
agctgcctgttcagctcc

SEQ ID NO: 4719562 - DNA, 19 bp, Homo sapiens
agctgcctgttcagctcca

SEQ ID NO: 4719563 - DNA, 20 bp, Homo sapiens
agctgcctgttcagctccag

SEQ ID NO: 4719564 - DNA, 21 bp, Homo sapiens
agctgcctgttcagctccagc

SEQ ID NO: 4719565 - DNA, 13 bp, Homo sapiens
agctgcggtccac

SEQ ID NO: 4719566 - DNA, 17 bp, Homo sapiens
agctgcggtccacccag

SEQ ID NO: 4719567 - DNA, 14 bp, Homo sapiens
agctgctgacagtg

SEQ ID NO: 4719568 - DNA, 24 bp, Homo sapiens
agctgcttttgtctatgggactca

SEQ ID NO: 4719569 - DNA, 22 bp, Homo sapiens
agctggaagtggctctggggtc

SEQ ID NO: 4719570 - DNA, 13 bp, Homo sapiens
agctggaggacta

SEQ ID NO: 4719571 - DNA, 22 bp, Homo sapiens
agctggatctccattctctcag

SEQ ID NO: 4719572 - DNA, 12 bp, Homo sapiens
agctggcagaga

SEQ ID NO: 4719573 - DNA, 14 bp, Homo sapiens
agctggcagagagc

SEQ ID NO: 4719574 - DNA, 17 bp, Homo sapiens
agctggcagagagcaca

SEQ ID NO: 4719575 - DNA, 18 bp, Homo sapiens
agctggccgggagcctga

SEQ ID NO: 4719576 - DNA, 19 bp, Homo sapiens
agctggccgtgggcctggg

SEQ ID NO: 4719577 - DNA, 21 bp, Homo sapiens
agctggcgtcatgcaaagtca

SEQ ID NO: 4719578 - DNA, 19 bp, Homo sapiens
agctgggactacaggcacc

SEQ ID NO: 4719579 - DNA, 23 bp, Homo sapiens
agctgggactacaggcacccacc

SEQ ID NO: 4719580 - DNA, 19 bp, Homo sapiens
agctgggtggcactgccat

SEQ ID NO: 4719581 - DNA, 20 bp, Homo sapiens
agctgggttggaaaacagta

SEQ ID NO: 4719582 - DNA, 17 bp, Homo sapiens
agctggtcccactcagt

SEQ ID NO: 4719583 - DNA, 18 bp, Homo sapiens
agctggtcccactcagtc

SEQ ID NO: 4719584 - DNA, 21 bp, Homo sapiens
agctggtcccactcagtccat

SEQ ID NO: 4719585 - DNA, 20 bp, Homo sapiens
agctggtggatggtgacttt

SEQ ID NO: 4719586 - DNA, 10 bp, Homo sapiens
agctgtgcag

SEQ ID NO: 4719587 - DNA, 12 bp, Homo sapiens
agctgtgccacc

SEQ ID NO: 4719588 - DNA, 19 bp, Homo sapiens
agctgtgccaccctgggct

SEQ ID NO: 4719589 - DNA, 18 bp, Homo sapiens
agctgtgctctggacagg

SEQ ID NO: 4719590 - DNA, 19 bp, Homo sapiens
agctgtgctctggacaggc

SEQ ID NO: 4719591 - DNA, 11 bp, Homo sapiens
agctgtgtctc

SEQ ID NO: 4719592 - DNA, 14 bp, Homo sapiens
agctgtgtctctgt

SEQ ID NO: 4719593 - DNA, 23 bp, Homo sapiens
agctgttattttgcatatatgtt

SEQ ID NO: 4719594 - DNA, 16 bp, Homo sapiens
agctgtttactaggga

SEQ ID NO: 4719595 - DNA, 13 bp, Homo sapiens
agcttaacagtgt

SEQ ID NO: 4719596 - DNA, 15 bp, Homo sapiens
agcttagactaaggc

SEQ ID NO: 4719597 - DNA, 16 bp, Homo sapiens
agcttagattttctgt

SEQ ID NO: 4719598 - DNA, 18 bp, Homo sapiens
agcttagattttctgtaa

SEQ ID NO: 4719599 - DNA, 23 bp, Homo sapiens
agcttcaggttatcgaaataaca

SEQ ID NO: 4719600 - DNA, 21 bp, Homo sapiens
agcttcagtaagttatctttg

SEQ ID NO: 4719601 - DNA, 18 bp, Homo sapiens
agcttcatttcctgtgtc

SEQ ID NO: 4719602 - DNA, 19 bp, Homo sapiens
agcttcatttcctgtgtct

SEQ ID NO: 4719603 - DNA, 12 bp, Homo sapiens
agcttccagagc

SEQ ID NO: 4719604 - DNA, 13 bp, Homo sapiens
agcttccagagct

SEQ ID NO: 4719605 - DNA, 19 bp, Homo sapiens
agcttccagagctctgacc

SEQ ID NO: 4719606 - DNA, 20 bp, Homo sapiens
agcttctaaatggtgctgca

SEQ ID NO: 4719607 - DNA, 18 bp, Homo sapiens
agcttctgctgggctggg

SEQ ID NO: 4719608 - DNA, 17 bp, Homo sapiens
agcttgctcacatcttg

SEQ ID NO: 4719609 - DNA, 12 bp, Homo sapiens
agcttgcttctt

SEQ ID NO: 4719610 - DNA, 23 bp, Homo sapiens
agcttggaaactggatgaggtca

SEQ ID NO: 4719611 - DNA, 18 bp, Homo sapiens
agcttggttctgtgaaca

SEQ ID NO: 4719612 - DNA, 22 bp, Homo sapiens
agctttttaattgttgtttctt

SEQ ID NO: 4719613 - DNA, 12 bp, Homo sapiens
aggaaaaagaac

SEQ ID NO: 4719614 - DNA, 14 bp, Homo sapiens
aggaaaagcctctg

SEQ ID NO: 4719615 - DNA, 14 bp, Homo sapiens
aggaaaagctgctg

SEQ ID NO: 4719616 - DNA, 20 bp, Homo sapiens
aggaaaatgtctgtaataat

SEQ ID NO: 4719617 - DNA, 17 bp, Homo sapiens
aggaaaccacagctgct

SEQ ID NO: 4719618 - DNA, 16 bp, Homo sapiens
aggaaacccagctctg

SEQ ID NO: 4719619 - DNA, 20 bp, Homo sapiens
aggaaacccagctctggtcc

SEQ ID NO: 4719620 - DNA, 22 bp, Homo sapiens
aggaaaggctccaggagcagcc

SEQ ID NO: 4719621 - DNA, 20 bp, Homo sapiens
aggaaagtttctttgaaaat

SEQ ID NO: 4719622 - DNA, 19 bp, Homo sapiens
aggaacccttacagtagga

SEQ ID NO: 4719623 - DNA, 18 bp, Homo sapiens
aggaagaacggggctctt

SEQ ID NO: 4719624 - DNA, 12 bp, Homo sapiens
aggaagaaggtg

SEQ ID NO: 4719625 - DNA, 14 bp, Homo sapiens
aggaagactttgga

SEQ ID NO: 4719626 - DNA, 14 bp, Homo sapiens
aggaagataaaaat

SEQ ID NO: 4719627 - DNA, 16 bp, Homo sapiens
aggaagccacagctgg

SEQ ID NO: 4719628 - DNA, 18 bp, Homo sapiens
aggaagccacagctggtg

SEQ ID NO: 4719629 - DNA, 20 bp, Homo sapiens
aggaagcctcaagttccagt

SEQ ID NO: 4719630 - DNA, 12 bp, Homo sapiens
aggaagctcagg

SEQ ID NO: 4719631 - DNA, 18 bp, Homo sapiens
aggaaggagctgcctgga

SEQ ID NO: 4719632 - DNA, 20 bp, Homo sapiens
aggaaggagctgcctggacc

SEQ ID NO: 4719633 - DNA, 22 bp, Homo sapiens
aggaaggagctgcctggacccg

SEQ ID NO: 4719634 - DNA, 15 bp, Homo sapiens
aggaaggattgtaaa

SEQ ID NO: 4719635 - DNA, 15 bp, Homo sapiens
aggaaggctgagagg

SEQ ID NO: 4719636 - DNA, 14 bp, Homo sapiens
aggaagtaggaagt

SEQ ID NO: 4719637 - DNA, 14 bp, Homo sapiens
aggaagtgaagaat

SEQ ID NO: 4719638 - DNA, 16 bp, Homo sapiens
aggaagttttttctac

SEQ ID NO: 4719639 - DNA, 18 bp, Homo sapiens
aggaatacctgtccccct

SEQ ID NO: 4719640 - DNA, 22 bp, Homo sapiens
aggaatcagcaagaagatccta

SEQ ID NO: 4719641 - DNA, 17 bp, Homo sapiens
aggaatccactcccagg

SEQ ID NO: 4719642 - DNA, 23 bp, Homo sapiens
aggaatccagacccggctgcgtg

SEQ ID NO: 4719643 - DNA, 11 bp, Homo sapiens
aggacaaacag

SEQ ID NO: 4719644 - DNA, 18 bp, Homo sapiens
aggacaaacagtgaattt

SEQ ID NO: 4719645 - DNA, 15 bp, Homo sapiens
aggacaagaccctct

SEQ ID NO: 4719646 - DNA, 23 bp, Homo sapiens
aggacacagatgaaacacaaaca

SEQ ID NO: 4719647 - DNA, 22 bp, Homo sapiens
aggacacattgccccatgagac

SEQ ID NO: 4719648 - DNA, 23 bp, Homo sapiens
aggacactaaccacgctggacct

SEQ ID NO: 4719649 - DNA, 15 bp, Homo sapiens
aggacaggctggtgc

SEQ ID NO: 4719650 - DNA, 17 bp, Homo sapiens
aggacaggctggtgcta

SEQ ID NO: 4719651 - DNA, 16 bp, Homo sapiens
aggaccaagggcagag

SEQ ID NO: 4719652 - DNA, 15 bp, Homo sapiens
aggacccagaggaag

SEQ ID NO: 4719653 - DNA, 15 bp, Homo sapiens
aggacgccacccagc

SEQ ID NO: 4719654 - DNA, 19 bp, Homo sapiens
aggacggggccggccaggt

SEQ ID NO: 4719655 - DNA, 20 bp, Homo sapiens
aggacggggccggccaggtg

SEQ ID NO: 4719656 - DNA, 22 bp, Homo sapiens
aggacggggccggccaggtggg

SEQ ID NO: 4719657 - DNA, 15 bp, Homo sapiens
aggactagggtcctg

SEQ ID NO: 4719658 - DNA, 16 bp, Homo sapiens
aggactagggtcctgg

SEQ ID NO: 4719659 - DNA, 14 bp, Homo sapiens
aggactcagctccc

SEQ ID NO: 4719660 - DNA, 18 bp, Homo sapiens
aggactcagctccccaga

SEQ ID NO: 4719661 - DNA, 15 bp, Homo sapiens
aggactctgcagcct

SEQ ID NO: 4719662 - DNA, 16 bp, Homo sapiens
aggactctgcagcctc

SEQ ID NO: 4719663 - DNA, 19 bp, Homo sapiens
aggactctgcagcctcaga

SEQ ID NO: 4719664 - DNA, 22 bp, Homo sapiens
aggactgattgaattacggaaa

SEQ ID NO: 4719665 - DNA, 18 bp, Homo sapiens
aggactgatttcagagtg

SEQ ID NO: 4719666 - DNA, 17 bp, Homo sapiens
aggactgtgacaggcag

SEQ ID NO: 4719667 - DNA, 18 bp, Homo sapiens
aggactgtgacaggcagc

SEQ ID NO: 4719668 - DNA, 22 bp, Homo sapiens
aggacttttctttgtggcttcc

SEQ ID NO: 4719669 - DNA, 13 bp, Homo sapiens
aggagaagttggt

SEQ ID NO: 4719670 - DNA, 13 bp, Homo sapiens
aggagacaaaaga

SEQ ID NO: 4719671 - DNA, 15 bp, Homo sapiens
aggagacaggaagcc

SEQ ID NO: 4719672 - DNA, 14 bp, Homo sapiens
aggagacccacagg

SEQ ID NO: 4719673 - DNA, 15 bp, Homo sapiens
aggagaggatgagag

SEQ ID NO: 4719674 - DNA, 18 bp, Homo sapiens
aggagaggatgagagccc

SEQ ID NO: 4719675 - DNA, 19 bp, Homo sapiens
aggagaggatgagagccca

SEQ ID NO: 4719676 - DNA, 21 bp, Homo sapiens
aggagaggatgagagcccaga

SEQ ID NO: 4719677 - DNA, 23 bp, Homo sapiens
aggagaggatgagagcccagagg

SEQ ID NO: 4719678 - DNA, 21 bp, Homo sapiens
aggagataaatctagtataca

SEQ ID NO: 4719679 - DNA, 22 bp, Homo sapiens
aggagatccagggcaaggccat

SEQ ID NO: 4719680 - DNA, 18 bp, Homo sapiens
aggagatgctccttgggc

SEQ ID NO: 4719681 - DNA, 16 bp, Homo sapiens
aggagcaaaggctgag

SEQ ID NO: 4719682 - DNA, 12 bp, Homo sapiens
aggagcagccac

SEQ ID NO: 4719683 - DNA, 13 bp, Homo sapiens
aggagcccaggcc

SEQ ID NO: 4719684 - DNA, 16 bp, Homo sapiens
aggagcccaggccagg

SEQ ID NO: 4719685 - DNA, 19 bp, Homo sapiens
aggagccccattcctggga

SEQ ID NO: 4719686 - DNA, 21 bp, Homo sapiens
aggagccccattcctgggaaa

SEQ ID NO: 4719687 - DNA, 17 bp, Homo sapiens
aggagccccgaggcctt

SEQ ID NO: 4719688 - DNA, 15 bp, Homo sapiens
aggagctcccctccc

SEQ ID NO: 4719689 - DNA, 17 bp, Homo sapiens
aggagctcccctcccca

SEQ ID NO: 4719690 - DNA, 20 bp, Homo sapiens
aggagctcccctccccaact

SEQ ID NO: 4719691 - DNA, 15 bp, Homo sapiens
aggagctgcctggac

SEQ ID NO: 4719692 - DNA, 17 bp, Homo sapiens
aggagctgcctggaccc

SEQ ID NO: 4719693 - DNA, 19 bp, Homo sapiens
aggaggccacgtgatgtgg

SEQ ID NO: 4719694 - DNA, 13 bp, Homo sapiens
aggaggctccaga

SEQ ID NO: 4719695 - DNA, 17 bp, Homo sapiens
aggaggctccagagggc

SEQ ID NO: 4719696 - DNA, 13 bp, Homo sapiens
aggaggctggctg

SEQ ID NO: 4719697 - DNA, 14 bp, Homo sapiens
aggaggctggctgg

SEQ ID NO: 4719698 - DNA, 14 bp, Homo sapiens
aggagggaggggga

SEQ ID NO: 4719699 - DNA, 15 bp, Homo sapiens
aggaggggaaaaaat

SEQ ID NO: 4719700 - DNA, 16 bp, Homo sapiens
aggagggtcggtgcct

SEQ ID NO: 4719701 - DNA, 15 bp, Homo sapiens
aggatatcttctcca

SEQ ID NO: 4719702 - DNA, 21 bp, Homo sapiens
aggatatgttcacacctagcg

SEQ ID NO: 4719703 - DNA, 12 bp, Homo sapiens
aggatcagtctg

SEQ ID NO: 4719704 - DNA, 17 bp, Homo sapiens
aggatcatggtgtaata

SEQ ID NO: 4719705 - DNA, 18 bp, Homo sapiens
aggatcatggtgtaataa

SEQ ID NO: 4719706 - DNA, 22 bp, Homo sapiens
aggatcatggtgtaataagaca

SEQ ID NO: 4719707 - DNA, 19 bp, Homo sapiens
aggatccctctctggattg

SEQ ID NO: 4719708 - DNA, 14 bp, Homo sapiens
aggatccggaaaga

SEQ ID NO: 4719709 - DNA, 16 bp, Homo sapiens
aggatccggaaagaag

SEQ ID NO: 4719710 - DNA, 14 bp, Homo sapiens
aggatgagagccca

SEQ ID NO: 4719711 - DNA, 16 bp, Homo sapiens
aggatgagagcccaga

SEQ ID NO: 4719712 - DNA, 17 bp, Homo sapiens
aggatgagagcccagag

SEQ ID NO: 4719713 - DNA, 23 bp, Homo sapiens
aggatgagagcccagaggtaaca

SEQ ID NO: 4719714 - DNA, 11 bp, Homo sapiens
aggatgagggt

SEQ ID NO: 4719715 - DNA, 20 bp, Homo sapiens
aggatgatctaggaagactt

SEQ ID NO: 4719716 - DNA, 16 bp, Homo sapiens
aggatgattttggcct

SEQ ID NO: 4719717 - DNA, 15 bp, Homo sapiens
aggatgttctgggac

SEQ ID NO: 4719718 - DNA, 22 bp, Homo sapiens
aggattacttagattgtgttcc

SEQ ID NO: 4719719 - DNA, 17 bp, Homo sapiens
aggattctaaacagatg

SEQ ID NO: 4719720 - DNA, 15 bp, Homo sapiens
aggattgcgagagat

SEQ ID NO: 4719721 - DNA, 23 bp, Homo sapiens
aggattgcgagagatgtgtgttg

SEQ ID NO: 4719722 - DNA, 22 bp, Homo sapiens
aggattgctactgtcctaccca

SEQ ID NO: 4719723 - DNA, 15 bp, Homo sapiens
aggatttataaagca

SEQ ID NO: 4719724 - DNA, 14 bp, Homo sapiens
aggatttgatttct

SEQ ID NO: 4719725 - DNA, 14 bp, Homo sapiens
aggcaaatgcccaa

SEQ ID NO: 4719726 - DNA, 19 bp, Homo sapiens
aggcaaatgtttaaacatt

SEQ ID NO: 4719727 - DNA, 14 bp, Homo sapiens
aggcaagcacctcc

SEQ ID NO: 4719728 - DNA, 18 bp, Homo sapiens
aggcaagcacctcctgcc

SEQ ID NO: 4719729 - DNA, 14 bp, Homo sapiens
aggcaatgctggct

SEQ ID NO: 4719730 - DNA, 15 bp, Homo sapiens
aggcaatgctggctg

SEQ ID NO: 4719731 - DNA, 16 bp, Homo sapiens
aggcaatgctggctgt

SEQ ID NO: 4719732 - DNA, 15 bp, Homo sapiens
aggcacccaccatca

SEQ ID NO: 4719733 - DNA, 21 bp, Homo sapiens
aggcacctgcaggttgggcca

SEQ ID NO: 4719734 - DNA, 23 bp, Homo sapiens
aggcactgagataccagcgagga

SEQ ID NO: 4719735 - DNA, 22 bp, Homo sapiens
aggcactgccctggtggccctc

SEQ ID NO: 4719736 - DNA, 15 bp, Homo sapiens
aggcacttcctcccc

SEQ ID NO: 4719737 - DNA, 16 bp, Homo sapiens
aggcacttcctcccct

SEQ ID NO: 4719738 - DNA, 17 bp, Homo sapiens
aggcacttcctcccctc

SEQ ID NO: 4719739 - DNA, 13 bp, Homo sapiens
aggcagatacagg

SEQ ID NO: 4719740 - DNA, 19 bp, Homo sapiens
aggcagcagtgtgaggcca

SEQ ID NO: 4719741 - DNA, 20 bp, Homo sapiens
aggcagcagtgtgaggccag

SEQ ID NO: 4719742 - DNA, 23 bp, Homo sapiens
aggcagcagtgtgaggccagggc

SEQ ID NO: 4719743 - DNA, 14 bp, Homo sapiens
aggcagccaggcca

SEQ ID NO: 4719744 - DNA, 16 bp, Homo sapiens
aggcaggaacatacag

SEQ ID NO: 4719745 - DNA, 21 bp, Homo sapiens
aggcaggacatgctgaagcca

SEQ ID NO: 4719746 - DNA, 21 bp, Homo sapiens
aggcaggagaatcactcgaac

SEQ ID NO: 4719747 - DNA, 22 bp, Homo sapiens
aggcaggctaaggcgtggagct

SEQ ID NO: 4719748 - DNA, 21 bp, Homo sapiens
aggcagggaacatggggagga

SEQ ID NO: 4719749 - DNA, 14 bp, Homo sapiens
aggcaggggaatgt

SEQ ID NO: 4719750 - DNA, 19 bp, Homo sapiens
aggcagggtctcactctgt

SEQ ID NO: 4719751 - DNA, 21 bp, Homo sapiens
aggcagggtctcactctgtcg

SEQ ID NO: 4719752 - DNA, 22 bp, Homo sapiens
aggcaggtcttgaactcctggc

SEQ ID NO: 4719753 - DNA, 17 bp, Homo sapiens
aggcatcgcaatgtaag

SEQ ID NO: 4719754 - DNA, 12 bp, Homo sapiens
aggcatggtggc

SEQ ID NO: 4719755 - DNA, 18 bp, Homo sapiens
aggcatgtgtgaaacata

SEQ ID NO: 4719756 - DNA, 19 bp, Homo sapiens
aggcatgttctctgaggac

SEQ ID NO: 4719757 - DNA, 20 bp, Homo sapiens
aggcatgttctctgaggaca

SEQ ID NO: 4719758 - DNA, 21 bp, Homo sapiens
aggcattccccaggaggccag

SEQ ID NO: 4719759 - DNA, 23 bp, Homo sapiens
aggcattccccaggaggccagcc

SEQ ID NO: 4719760 - DNA, 16 bp, Homo sapiens
aggcattgccaagggc

SEQ ID NO: 4719761 - DNA, 21 bp, Homo sapiens
aggccaaagagtctccagttt

SEQ ID NO: 4719762 - DNA, 22 bp, Homo sapiens
aggccaacccaaaataagcagg

SEQ ID NO: 4719763 - DNA, 16 bp, Homo sapiens
aggccaaggcgggtgg

SEQ ID NO: 4719764 - DNA, 16 bp, Homo sapiens
aggccacaagaccctt

SEQ ID NO: 4719765 - DNA, 17 bp, Homo sapiens
aggccacaagacccttg

SEQ ID NO: 4719766 - DNA, 22 bp, Homo sapiens
aggttagattttgtattcaggg

SEQ ID NO: 4719767 - DNA, 18 bp, Homo sapiens
aggttatcgaaataacaa

SEQ ID NO: 4719768 - DNA, 21 bp, Homo sapiens
aggttccgcttggagcagagg

SEQ ID NO: 4719769 - DNA, 14 bp, Homo sapiens
aggttctctcctcc

SEQ ID NO: 4719770 - DNA, 14 bp, Homo sapiens
aggttgaagcacca

SEQ ID NO: 4719771 - DNA, 23 bp, Homo sapiens
aggttggaaaagaaatcaatttt

SEQ ID NO: 4719772 - DNA, 18 bp, Homo sapiens
aggtttctggtctctagg

SEQ ID NO: 4719773 - DNA, 23 bp, Homo sapiens
aggtttctggtctctaggctggg

SEQ ID NO: 4719774 - DNA, 15 bp, Homo sapiens
aggtttgaccaggaa

SEQ ID NO: 4719775 - DNA, 16 bp, Homo sapiens
agtaaaagtcataaat

SEQ ID NO: 4719776 - DNA, 19 bp, Homo sapiens
agtaaaagtcataaatgca

SEQ ID NO: 4719777 - DNA, 14 bp, Homo sapiens
agtaagaaaacaat

SEQ ID NO: 4719778 - DNA, 20 bp, Homo sapiens
agtaagcagagttctttgca

SEQ ID NO: 4719779 - DNA, 22 bp, Homo sapiens
agtaagcagagttctttgcaag

SEQ ID NO: 4719780 - DNA, 21 bp, Homo sapiens
agtaagtagcaaccctgtgat

SEQ ID NO: 4719781 - DNA, 20 bp, Homo sapiens
agtaagttatctttgaatat

SEQ ID NO: 4719782 - DNA, 15 bp, Homo sapiens
agtaatgaaatggag

SEQ ID NO: 4719783 - DNA, 14 bp, Homo sapiens
agtaattctcaggc

SEQ ID NO: 4719784 - DNA, 22 bp, Homo sapiens
agtacctcctgtctctggcctg

SEQ ID NO: 4719785 - DNA, 22 bp, Homo sapiens
agtactacagtcctcccatctc

SEQ ID NO: 4719786 - DNA, 12 bp, Homo sapiens
agtactcaaatt

SEQ ID NO: 4719787 - DNA, 17 bp, Homo sapiens
agtacttctccaccctg

SEQ ID NO: 4719788 - DNA, 20 bp, Homo sapiens
agtagaaagacagagctggg

SEQ ID NO: 4719789 - DNA, 21 bp, Homo sapiens
agtagatgtggcctttgaatt

SEQ ID NO: 4719790 - DNA, 16 bp, Homo sapiens
agtaggggttgaagaa

SEQ ID NO: 4719791 - DNA, 23 bp, Homo sapiens
agtaggttggaagctagctcccc

SEQ ID NO: 4719792 - DNA, 15 bp, Homo sapiens
agtataaaattatat

SEQ ID NO: 4719793 - DNA, 13 bp, Homo sapiens
agtataagatttt

SEQ ID NO: 4719794 - DNA, 15 bp, Homo sapiens
agtataagatttttg

SEQ ID NO: 4719795 - DNA, 21 bp, Homo sapiens
agtatattgataaccttgaaa

SEQ ID NO: 4719796 - DNA, 12 bp, Homo sapiens
agtatatttggt

SEQ ID NO: 4719797 - DNA, 17 bp, Homo sapiens
agtatggtggctgggtt

SEQ ID NO: 4719798 - DNA, 15 bp, Homo sapiens
agtatgtatattaaa

SEQ ID NO: 4719799 - DNA, 23 bp, Homo sapiens
agtatgtatattaaaaaagagac

SEQ ID NO: 4719800 - DNA, 18 bp, Homo sapiens
agtattacttctgctaca

SEQ ID NO: 4719801 - DNA, 15 bp, Homo sapiens
agtattctccatcct

SEQ ID NO: 4719802 - DNA, 17 bp, Homo sapiens
agtatttaattgtttca

SEQ ID NO: 4719803 - DNA, 12 bp, Homo sapiens
agtattttaatc

SEQ ID NO: 4719804 - DNA, 19 bp, Homo sapiens
agtattttccctgctaggg

SEQ ID NO: 4719805 - DNA, 17 bp, Homo sapiens
agtcaaatttacattta

SEQ ID NO: 4719806 - DNA, 14 bp, Homo sapiens
agtcaacaagcctg

SEQ ID NO: 4719807 - DNA, 22 bp, Homo sapiens
agtcaacactatatattttatg

SEQ ID NO: 4719808 - DNA, 20 bp, Homo sapiens
agtcaaggactggtaaaata

SEQ ID NO: 4719809 - DNA, 21 bp, Homo sapiens
agtcaattctgatgttactga

SEQ ID NO: 4719810 - DNA, 16 bp, Homo sapiens
agtcaatttgcctctg

SEQ ID NO: 4719811 - DNA, 16 bp, Homo sapiens
agtcaatttgctgaaa

SEQ ID NO: 4719812 - DNA, 16 bp, Homo sapiens
agtcacacgggggcag

SEQ ID NO: 4719813 - DNA, 19 bp, Homo sapiens
agtcacacgggggcagctg

SEQ ID NO: 4719814 - DNA, 14 bp, Homo sapiens
agtcaccaagccca

SEQ ID NO: 4719815 - DNA, 18 bp, Homo sapiens
agtcactgagacagcccg

SEQ ID NO: 4719816 - DNA, 19 bp, Homo sapiens
agtcactgagacagcccgg

SEQ ID NO: 4719817 - DNA, 18 bp, Homo sapiens
agtcagctgaccccctcc

SEQ ID NO: 4719818 - DNA, 22 bp, Homo sapiens
agtcagctgaccccctcccccc

SEQ ID NO: 4719819 - DNA, 12 bp, Homo sapiens
agtcaggaaagg

SEQ ID NO: 4719820 - DNA, 17 bp, Homo sapiens
agtcataccaatgaaaa

SEQ ID NO: 4719821 - DNA, 19 bp, Homo sapiens
agtcatgcaaaggctggga

SEQ ID NO: 4719822 - DNA, 20 bp, Homo sapiens
agtcatgcaaaggctgggac

SEQ ID NO: 4719823 - DNA, 16 bp, Homo sapiens
agtcatgcataaatat

SEQ ID NO: 4719824 - DNA, 22 bp, Homo sapiens
agtcatgcataaatatgcagtg

SEQ ID NO: 4719825 - DNA, 23 bp, Homo sapiens
agtcatgtactggagagtggcaa

SEQ ID NO: 4719826 - DNA, 12 bp, Homo sapiens
agtcattatgtt

SEQ ID NO: 4719827 - DNA, 23 bp, Homo sapiens
agtcattattattactttttaaa

SEQ ID NO: 4719828 - DNA, 15 bp, Homo sapiens
agtcattgtttccca

SEQ ID NO: 4719829 - DNA, 21 bp, Homo sapiens
agtccaaggaaaccacagctg

SEQ ID NO: 4719830 - DNA, 14 bp, Homo sapiens
agtccacaaaataa

SEQ ID NO: 4719831 - DNA, 15 bp, Homo sapiens
agtccagcctggaga

SEQ ID NO: 4719832 - DNA, 21 bp, Homo sapiens
agtccatatttcaatttccaa

SEQ ID NO: 4719833 - DNA, 18 bp, Homo sapiens
agtcccaccttggctgca

SEQ ID NO: 4719834 - DNA, 16 bp, Homo sapiens
agtcccagagctgcac

SEQ ID NO: 4719835 - DNA, 19 bp, Homo sapiens
agtcccaggctgagcctca

SEQ ID NO: 4719836 - DNA, 12 bp, Homo sapiens
agtccctgccaa

SEQ ID NO: 4719837 - DNA, 14 bp, Homo sapiens
agtccctgccaatg

SEQ ID NO: 4719838 - DNA, 15 bp, Homo sapiens
agtcccttccacacc

SEQ ID NO: 4719839 - DNA, 21 bp, Homo sapiens
agtcctctccacctagtggct

SEQ ID NO: 4719840 - DNA, 20 bp, Homo sapiens
agtcctctgggtaggaatca

SEQ ID NO: 4719841 - DNA, 14 bp, Homo sapiens
agtcctgtactgta

SEQ ID NO: 4719842 - DNA, 14 bp, Homo sapiens
agtcgcgctgcctg

SEQ ID NO: 4719843 - DNA, 18 bp, Homo sapiens
agtctaaggccatggcat

SEQ ID NO: 4719844 - DNA, 23 bp, Homo sapiens
agtctatggccaggtatgcatgg

SEQ ID NO: 4719845 - DNA, 17 bp, Homo sapiens
agtctcactgttgccca

SEQ ID NO: 4719846 - DNA, 17 bp, Homo sapiens
agtctcgaatgtaattg

SEQ ID NO: 4719847 - DNA, 11 bp, Homo sapiens
agtctctgagc

SEQ ID NO: 4719848 - DNA, 15 bp, Homo sapiens
agtctctggaagaag

SEQ ID NO: 4719849 - DNA, 18 bp, Homo sapiens
agtctgattcccaagctc

SEQ ID NO: 4719850 - DNA, 22 bp, Homo sapiens
agtctgattcccaagctctgct

SEQ ID NO: 4719851 - DNA, 23 bp, Homo sapiens
agtctgtaactctttctgaggag

SEQ ID NO: 4719852 - DNA, 20 bp, Homo sapiens
agtctgtgtggcaaattaaa

SEQ ID NO: 4719853 - DNA, 16 bp, Homo sapiens
agtcttccatttgcaa

SEQ ID NO: 4719854 - DNA, 15 bp, Homo sapiens
agtcttgcattgaat

SEQ ID NO: 4719855 - DNA, 17 bp, Homo sapiens
agtcttggggcaggatg

SEQ ID NO: 4719856 - DNA, 16 bp, Homo sapiens
agtcttgtattaagtt

SEQ ID NO: 4719857 - DNA, 18 bp, Homo sapiens
agtcttgtattaagttgt

SEQ ID NO: 4719858 - DNA, 14 bp, Homo sapiens
agtgaaaaacagaa

SEQ ID NO: 4719859 - DNA, 19 bp, Homo sapiens
agtgaatgattcagtgtta

SEQ ID NO: 4719860 - DNA, 12 bp, Homo sapiens
agtgaatttgtc

SEQ ID NO: 4719861 - DNA, 22 bp, Homo sapiens
agtgacaccaataaatgtttgt

SEQ ID NO: 4719862 - DNA, 20 bp, Homo sapiens
agtgacagatcctccatttt

SEQ ID NO: 4719863 - DNA, 19 bp, Homo sapiens
agtgactgttcaagagcac

SEQ ID NO: 4719864 - DNA, 14 bp, Homo sapiens
agtgactgttgtac

SEQ ID NO: 4719865 - DNA, 16 bp, Homo sapiens
agtgagaagggctcag

SEQ ID NO: 4719866 - DNA, 13 bp, Homo sapiens
agtgagacccagg

SEQ ID NO: 4719867 - DNA, 14 bp, Homo sapiens
agtgagacccagga

SEQ ID NO: 4719868 - DNA, 16 bp, Homo sapiens
agtgagactctgtctc

SEQ ID NO: 4719869 - DNA, 22 bp, Homo sapiens
agtgagactctgtctcaaaaaa

SEQ ID NO: 4719870 - DNA, 14 bp, Homo sapiens
agtgagagctgggt

SEQ ID NO: 4719871 - DNA, 16 bp, Homo sapiens
agtgagatgcattctt

SEQ ID NO: 4719872 - DNA, 22 bp, Homo sapiens
agtgagcactaaggtgtgctct

SEQ ID NO: 4719873 - DNA, 13 bp, Homo sapiens
agtgaggctctgc

SEQ ID NO: 4719874 - DNA, 14 bp, Homo sapiens
agtgaggctctgcc

SEQ ID NO: 4719875 - DNA, 20 bp, Homo sapiens
agtgaggctctgcccttggt

SEQ ID NO: 4719876 - DNA, 13 bp, Homo sapiens
attgtttcaattg

SEQ ID NO: 4719877 - DNA, 22 bp, Homo sapiens
attgtttcaattgcatctccca

SEQ ID NO: 4719878 - DNA, 13 bp, Homo sapiens
attgttttactcc

SEQ ID NO: 4719879 - DNA, 16 bp, Homo sapiens
attgtttttgtattta

SEQ ID NO: 4719880 - DNA, 13 bp, Homo sapiens
atttaaaagacaa

SEQ ID NO: 4719881 - DNA, 15 bp, Homo sapiens
atttaaaagacaaac

SEQ ID NO: 4719882 - DNA, 17 bp, Homo sapiens
atttaaactatgataaa

SEQ ID NO: 4719883 - DNA, 12 bp, Homo sapiens
atttaaagcaca

SEQ ID NO: 4719884 - DNA, 19 bp, Homo sapiens
atttaaagttgtataaaaa

SEQ ID NO: 4719885 - DNA, 17 bp, Homo sapiens
atttaaccataaatcaa

SEQ ID NO: 4719886 - DNA, 23 bp, Homo sapiens
atttaacctatttccacattctc

SEQ ID NO: 4719887 - DNA, 17 bp, Homo sapiens
atttaagcatgagtggc

SEQ ID NO: 4719888 - DNA, 19 bp, Homo sapiens
atttaagcatgagtggcct

SEQ ID NO: 4719889 - DNA, 23 bp, Homo sapiens
atttaagccttataaaccaatct

SEQ ID NO: 4719890 - DNA, 20 bp, Homo sapiens
atttaagtgcgtgtgtagag

SEQ ID NO: 4719891 - DNA, 19 bp, Homo sapiens
atttaataaaataattcta

SEQ ID NO: 4719892 - DNA, 22 bp, Homo sapiens
atttaataaaataattctaaag

SEQ ID NO: 4719893 - DNA, 15 bp, Homo sapiens
atttaataacattac

SEQ ID NO: 4719894 - DNA, 21 bp, Homo sapiens
atttaatcacagtcatcttta

SEQ ID NO: 4719895 - DNA, 24 bp, Homo sapiens
atttaatgatttttgtgtatccag

SEQ ID NO: 4719896 - DNA, 14 bp, Homo sapiens
atttaatgtagcca

SEQ ID NO: 4719897 - DNA, 22 bp, Homo sapiens
atttaattaccttattggatat

SEQ ID NO: 4719898 - DNA, 22 bp, Homo sapiens
atttaattctttctattttcac

SEQ ID NO: 4719899 - DNA, 23 bp, Homo sapiens
atttaattctttctattttcaca

SEQ ID NO: 4719900 - DNA, 12 bp, Homo sapiens
atttaatttgta

SEQ ID NO: 4719901 - DNA, 23 bp, Homo sapiens
atttaatttttttgagacagagt

SEQ ID NO: 4719902 - DNA, 15 bp, Homo sapiens
atttacactggtcta

SEQ ID NO: 4719903 - DNA, 19 bp, Homo sapiens
atttacccaactctgtaca

SEQ ID NO: 4719904 - DNA, 19 bp, Homo sapiens
atttaccttttaagacatt

SEQ ID NO: 4719905 - DNA, 13 bp, Homo sapiens
atttactatttca

SEQ ID NO: 4719906 - DNA, 19 bp, Homo sapiens
atttactttttaaacagtg

SEQ ID NO: 4719907 - DNA, 20 bp, Homo sapiens
atttagagtcaatttgctga

SEQ ID NO: 4719908 - DNA, 21 bp, Homo sapiens
atttagagtcaatttgctgaa

SEQ ID NO: 4719909 - DNA, 21 bp, Homo sapiens
atttagcaatgctgtgaataa

SEQ ID NO: 4719910 - DNA, 14 bp, Homo sapiens
atttagcccctctc

SEQ ID NO: 4719911 - DNA, 16 bp, Homo sapiens
atttagcccctctctt

SEQ ID NO: 4719912 - DNA, 21 bp, Homo sapiens
atttagcgcacccagagaaaa

SEQ ID NO: 4719913 - DNA, 17 bp, Homo sapiens
atttaggagaagttggt

SEQ ID NO: 4719914 - DNA, 17 bp, Homo sapiens
atttataaagcaaatta

SEQ ID NO: 4719915 - DNA, 23 bp, Homo sapiens
atttatagctgtaggttttctgt

SEQ ID NO: 4719916 - DNA, 15 bp, Homo sapiens
atttatataaatttt

SEQ ID NO: 4719917 - DNA, 13 bp, Homo sapiens
atttatgatttaa

SEQ ID NO: 4719918 - DNA, 20 bp, Homo sapiens
atttattaaatgcccagccc

SEQ ID NO: 4719919 - DNA, 22 bp, Homo sapiens
atttattaaatgcccagcccct

SEQ ID NO: 4719920 - DNA, 17 bp, Homo sapiens
atttattaatttgaaac

SEQ ID NO: 4719921 - DNA, 15 bp, Homo sapiens
atttattgaattatt

SEQ ID NO: 4719922 - DNA, 19 bp, Homo sapiens
atttattgaattattttgt

SEQ ID NO: 4719923 - DNA, 16 bp, Homo sapiens
atttatttatttattc

SEQ ID NO: 4719924 - DNA, 17 bp, Homo sapiens
atttcaaattggagctt

SEQ ID NO: 4719925 - DNA, 14 bp, Homo sapiens
atttcaagatccaa

SEQ ID NO: 4719926 - DNA, 17 bp, Homo sapiens
atttcacagtgtgtggt

SEQ ID NO: 4719927 - DNA, 21 bp, Homo sapiens
atttcaggtcaactctgaaga

SEQ ID NO: 4719928 - DNA, 14 bp, Homo sapiens
atttcatctgctct

SEQ ID NO: 4719929 - DNA, 15 bp, Homo sapiens
atttcatgattagaa

SEQ ID NO: 4719930 - DNA, 16 bp, Homo sapiens
atttccaagagctgag

SEQ ID NO: 4719931 - DNA, 16 bp, Homo sapiens
atttccactcaggtct

SEQ ID NO: 4719932 - DNA, 18 bp, Homo sapiens
atttccagccagggctgc

SEQ ID NO: 4719933 - DNA, 18 bp, Homo sapiens
atttcccgtggccccagc

SEQ ID NO: 4719934 - DNA, 17 bp, Homo sapiens
atttcctctgagctgtt

SEQ ID NO: 4719935 - DNA, 13 bp, Homo sapiens
atttctacagaga

SEQ ID NO: 4719936 - DNA, 20 bp, Homo sapiens
atttctatgtatgtgccaat

SEQ ID NO: 4719937 - DNA, 18 bp, Homo sapiens
atttctatttctcctcca

SEQ ID NO: 4719938 - DNA, 20 bp, Homo sapiens
atttctatttctcctccatg

SEQ ID NO: 4719939 - DNA, 15 bp, Homo sapiens
atttctcttcagtgt

SEQ ID NO: 4719940 - DNA, 15 bp, Homo sapiens
atttctgccttcctt

SEQ ID NO: 4719941 - DNA, 13 bp, Homo sapiens
atttctgtgtcta

SEQ ID NO: 4719942 - DNA, 21 bp, Homo sapiens
atttcttaaacaaatgtatga

SEQ ID NO: 4719943 - DNA, 19 bp, Homo sapiens
atttcttagagattaaacc

SEQ ID NO: 4719944 - DNA, 11 bp, Homo sapiens
atttctttaat

SEQ ID NO: 4719945 - DNA, 18 bp, Homo sapiens
atttgaaaccaggacatt

SEQ ID NO: 4719946 - DNA, 23 bp, Homo sapiens
atttgaaagtgggtttcaattta

SEQ ID NO: 4719947 - DNA, 22 bp, Homo sapiens
atttgaacatgtggcttgaatt

SEQ ID NO: 4719948 - DNA, 18 bp, Homo sapiens
atttgaaggtagaatgtt

SEQ ID NO: 4719949 - DNA, 15 bp, Homo sapiens
atttgatatttgcat

SEQ ID NO: 4719950 - DNA, 15 bp, Homo sapiens
atttgatatttggtt

SEQ ID NO: 4719951 - DNA, 18 bp, Homo sapiens
atttgatatttggttatt

SEQ ID NO: 4719952 - DNA, 16 bp, Homo sapiens
atttgattatttaaga

SEQ ID NO: 4719953 - DNA, 16 bp, Homo sapiens
atttgatttcgatgta

SEQ ID NO: 4719954 - DNA, 22 bp, Homo sapiens
atttgatttcgatgtacagtct

SEQ ID NO: 4719955 - DNA, 21 bp, Homo sapiens
atttgcaacagtaatcagagt

SEQ ID NO: 4719956 - DNA, 21 bp, Homo sapiens
atttgcataacaattcctcta

SEQ ID NO: 4719957 - DNA, 15 bp, Homo sapiens
atttgccatgggctt

SEQ ID NO: 4719958 - DNA, 14 bp, Homo sapiens
atttgccctcccat

SEQ ID NO: 4719959 - DNA, 15 bp, Homo sapiens
atttgctgaaaacat

SEQ ID NO: 4719960 - DNA, 20 bp, Homo sapiens
atttggatttaaaagcctgc

SEQ ID NO: 4719961 - DNA, 23 bp, Homo sapiens
atttggatttaaaagcctgctca

SEQ ID NO: 4719962 - DNA, 19 bp, Homo sapiens
atttggcatttatttgtga

SEQ ID NO: 4719963 - DNA, 19 bp, Homo sapiens
atttgggggggaataagat

SEQ ID NO: 4719964 - DNA, 12 bp, Homo sapiens
atttggggtgga

SEQ ID NO: 4719965 - DNA, 22 bp, Homo sapiens
atttggtgggagttatatcagt

SEQ ID NO: 4719966 - DNA, 20 bp, Homo sapiens
atttggtttgttaattctta

SEQ ID NO: 4719967 - DNA, 14 bp, Homo sapiens
atttgtaagtttca

SEQ ID NO: 4719968 - DNA, 14 bp, Homo sapiens
atttgtattaaaat

SEQ ID NO: 4719969 - DNA, 13 bp, Homo sapiens
atttgtcaacaaa

SEQ ID NO: 4719970 - DNA, 17 bp, Homo sapiens
atttgtccattgtaaat

SEQ ID NO: 4719971 - DNA, 19 bp, Homo sapiens
atttgtcggggaagatgaa

SEQ ID NO: 4719972 - DNA, 13 bp, Homo sapiens
atttgtgaagaat

SEQ ID NO: 4719973 - DNA, 14 bp, Homo sapiens
atttgtgaagaatt

SEQ ID NO: 4719974 - DNA, 10 bp, Homo sapiens
atttgtgaat

SEQ ID NO: 4719975 - DNA, 17 bp, Homo sapiens
atttgtgaatttgcaac

SEQ ID NO: 4719976 - DNA, 14 bp, Homo sapiens
atttgttatggtta

SEQ ID NO: 4719977 - DNA, 16 bp, Homo sapiens
atttgttatggttaca

SEQ ID NO: 4719978 - DNA, 21 bp, Homo sapiens
atttgttggtaactaatgtta

SEQ ID NO: 4719979 - DNA, 14 bp, Homo sapiens
atttgttgtcatgt

SEQ ID NO: 4719980 - DNA, 18 bp, Homo sapiens
atttgttgtcatgtgtat

SEQ ID NO: 4719981 - DNA, 15 bp, Homo sapiens
atttgttttggatat

SEQ ID NO: 4719982 - DNA, 19 bp, Homo sapiens
attttaaaagttttgttct

SEQ ID NO: 4719983 - DNA, 20 bp, Homo sapiens
attttaaaagttttgttctt

SEQ ID NO: 4719984 - DNA, 14 bp, Homo sapiens
attttaatcctgta

SEQ ID NO: 4719985 - DNA, 19 bp, Homo sapiens
attttacctagctaattat

SEQ ID NO: 4719986 - DNA, 19 bp, Homo sapiens
caaggaggctggctggggc

SEQ ID NO: 4719987 - DNA, 22 bp, Homo sapiens
caaggaggctggctggggccta

SEQ ID NO: 4719988 - DNA, 17 bp, Homo sapiens
caaggaggtctgtgcca

SEQ ID NO: 4719989 - DNA, 13 bp, Homo sapiens
caaggcacctgca

SEQ ID NO: 4719990 - DNA, 12 bp, Homo sapiens
caaggcactgcc

SEQ ID NO: 4719991 - DNA, 16 bp, Homo sapiens
caaggcactgcctgat

SEQ ID NO: 4719992 - DNA, 18 bp, Homo sapiens
caaggcactgcctgatgg

SEQ ID NO: 4719993 - DNA, 16 bp, Homo sapiens
caaggcctcccacagt

SEQ ID NO: 4719994 - DNA, 17 bp, Homo sapiens
caaggcctcccacagtg

SEQ ID NO: 4719995 - DNA, 18 bp, Homo sapiens
caaggctgtgctccctgg

SEQ ID NO: 4719996 - DNA, 16 bp, Homo sapiens
caagggcataaagtaa

SEQ ID NO: 4719997 - DNA, 13 bp, Homo sapiens
caagggcctggcc

SEQ ID NO: 4719998 - DNA, 14 bp, Homo sapiens
caagggcctggcct

SEQ ID NO: 4719999 - DNA, 14 bp, Homo sapiens
caaggtttataaag

SEQ ID NO: 4720000 - DNA, 15 bp, Homo sapiens
caagtactacatttt

SEQ ID NO: 4720001 - DNA, 18 bp, Homo sapiens
caagtgagagctgggtgt

SEQ ID NO: 4720002 - DNA, 12 bp, Homo sapiens
caagtgagtggc

SEQ ID NO: 4720003 - DNA, 22 bp, Homo sapiens
caagtgatccttccacctcagt

SEQ ID NO: 4720004 - DNA, 20 bp, Homo sapiens
caagtgattctcatgcctca

SEQ ID NO: 4720005 - DNA, 16 bp, Homo sapiens
caagtgattctcctgc

SEQ ID NO: 4720006 - DNA, 22 bp, Homo sapiens
caagtgattctcctgcctcagc

SEQ ID NO: 4720007 - DNA, 23 bp, Homo sapiens
caagtggcagagcttggactgga

SEQ ID NO: 4720008 - DNA, 19 bp, Homo sapiens
caagtgggagatgaaaacc

SEQ ID NO: 4720009 - DNA, 22 bp, Homo sapiens
caagtgggagatgaaaacctgc

SEQ ID NO: 4720010 - DNA, 16 bp, Homo sapiens
caagttagttcaatct

SEQ ID NO: 4720011 - DNA, 14 bp, Homo sapiens
caagttccagtgca

SEQ ID NO: 4720012 - DNA, 15 bp, Homo sapiens
caataaaacattaat

SEQ ID NO: 4720013 - DNA, 14 bp, Homo sapiens
caataaaaccaagc

SEQ ID NO: 4720014 - DNA, 19 bp, Homo sapiens
caataaagttgagcaaaca

SEQ ID NO: 4720015 - DNA, 16 bp, Homo sapiens
caataaatgtttgtta

SEQ ID NO: 4720016 - DNA, 13 bp, Homo sapiens
caataagccttgt

SEQ ID NO: 4720017 - DNA, 20 bp, Homo sapiens
caatacccaaatcctctcca

SEQ ID NO: 4720018 - DNA, 20 bp, Homo sapiens
caatactccctttaaagaga

SEQ ID NO: 4720019 - DNA, 18 bp, Homo sapiens
caatagtaattctcaggc

SEQ ID NO: 4720020 - DNA, 23 bp, Homo sapiens
caatattgtaatcctagcacttt

SEQ ID NO: 4720021 - DNA, 11 bp, Homo sapiens
caatattttcc

SEQ ID NO: 4720022 - DNA, 19 bp, Homo sapiens
caatattttccatgaaaat

SEQ ID NO: 4720023 - DNA, 22 bp, Homo sapiens
caatattttccatgaaaatgca

SEQ ID NO: 4720024 - DNA, 16 bp, Homo sapiens
caatcacaaaagctgt

SEQ ID NO: 4720025 - DNA, 23 bp, Homo sapiens
caatcacaaaagctgtgtctctg

SEQ ID NO: 4720026 - DNA, 23 bp, Homo sapiens
caatcataaagtgcacaccttta

SEQ ID NO: 4720027 - DNA, 15 bp, Homo sapiens
caatccaagagtctg

SEQ ID NO: 4720028 - DNA, 20 bp, Homo sapiens
caatctattaatagctgcct

SEQ ID NO: 4720029 - DNA, 13 bp, Homo sapiens
caatctattctca

SEQ ID NO: 4720030 - DNA, 18 bp, Homo sapiens
caatctcggctcactgca

SEQ ID NO: 4720031 - DNA, 20 bp, Homo sapiens
caatctggattcatatttaa

SEQ ID NO: 4720032 - DNA, 17 bp, Homo sapiens
caatctgtgtaagaaaa

SEQ ID NO: 4720033 - DNA, 16 bp, Homo sapiens
caatcttaaacataat

SEQ ID NO: 4720034 - DNA, 20 bp, Homo sapiens
caatcttaaacataataaat

SEQ ID NO: 4720035 - DNA, 15 bp, Homo sapiens
caatgatcaaatttt

SEQ ID NO: 4720036 - DNA, 21 bp, Homo sapiens
caatgattaggaatcattctg

SEQ ID NO: 4720037 - DNA, 13 bp, Homo sapiens
caatgcactttgt

SEQ ID NO: 4720038 - DNA, 20 bp, Homo sapiens
caatgcactttgttctggct

SEQ ID NO: 4720039 - DNA, 23 bp, Homo sapiens
caatgcactttgttctggctctt

SEQ ID NO: 4720040 - DNA, 20 bp, Homo sapiens
caatgccatcctcaaacact

SEQ ID NO: 4720041 - DNA, 12 bp, Homo sapiens
caatgctggctg

SEQ ID NO: 4720042 - DNA, 20 bp, Homo sapiens
caatgctggctgttggctgg

SEQ ID NO: 4720043 - DNA, 16 bp, Homo sapiens
caatgctgtgaataaa

SEQ ID NO: 4720044 - DNA, 16 bp, Homo sapiens
caatggaacctccttt

SEQ ID NO: 4720045 - DNA, 11 bp, Homo sapiens
caatggcagcc

SEQ ID NO: 4720046 - DNA, 12 bp, Homo sapiens
caatggcagcct

SEQ ID NO: 4720047 - DNA, 13 bp, Homo sapiens
caatggcagcctt

SEQ ID NO: 4720048 - DNA, 16 bp, Homo sapiens
caatggcagccttggc

SEQ ID NO: 4720049 - DNA, 20 bp, Homo sapiens
caatggtgttatttgaaact

SEQ ID NO: 4720050 - DNA, 21 bp, Homo sapiens
caatggtgttatttgaaactt

SEQ ID NO: 4720051 - DNA, 13 bp, Homo sapiens
caatggtttgcaa

SEQ ID NO: 4720052 - DNA, 16 bp, Homo sapiens
caatggtttgcaagga

SEQ ID NO: 4720053 - DNA, 17 bp, Homo sapiens
caatggtttgcaaggaa

SEQ ID NO: 4720054 - DNA, 20 bp, Homo sapiens
caatgtaaaaatacactaat

SEQ ID NO: 4720055 - DNA, 20 bp, Homo sapiens
caatgtattgataagagggc

SEQ ID NO: 4720056 - DNA, 19 bp, Homo sapiens
caatgtgtggctgaagact

SEQ ID NO: 4720057 - DNA, 14 bp, Homo sapiens
caatgttaaggaaa

SEQ ID NO: 4720058 - DNA, 20 bp, Homo sapiens
caatgttaaggaaactctta

SEQ ID NO: 4720059 - DNA, 13 bp, Homo sapiens
caattacatctct

SEQ ID NO: 4720060 - DNA, 16 bp, Homo sapiens
caattacatctctaat

SEQ ID NO: 4720061 - DNA, 16 bp, Homo sapiens
caattacttattttag

SEQ ID NO: 4720062 - DNA, 22 bp, Homo sapiens
caattattaaattgtgtacact

SEQ ID NO: 4720063 - DNA, 23 bp, Homo sapiens
caattctcatttgtcacacactt

SEQ ID NO: 4720064 - DNA, 13 bp, Homo sapiens
caattctcctgcc

SEQ ID NO: 4720065 - DNA, 14 bp, Homo sapiens
caattctcctgcct

SEQ ID NO: 4720066 - DNA, 16 bp, Homo sapiens
caattctcctgcctca

SEQ ID NO: 4720067 - DNA, 19 bp, Homo sapiens
caattgttctgggtgattt

SEQ ID NO: 4720068 - DNA, 12 bp, Homo sapiens
caatttaaagca

SEQ ID NO: 4720069 - DNA, 17 bp, Homo sapiens
caatttaaattgttata

SEQ ID NO: 4720070 - DNA, 21 bp, Homo sapiens
caatttactttttaaacagtg

SEQ ID NO: 4720071 - DNA, 16 bp, Homo sapiens
caatttctactttgaa

SEQ ID NO: 4720072 - DNA, 12 bp, Homo sapiens
caatttctcccc

SEQ ID NO: 4720073 - DNA, 13 bp, Homo sapiens
caatttgcctctg

SEQ ID NO: 4720074 - DNA, 14 bp, Homo sapiens
caattttgtcacag

SEQ ID NO: 4720075 - DNA, 20 bp, Homo sapiens
cacaaaagctgtgtctctgt

SEQ ID NO: 4720076 - DNA, 18 bp, Homo sapiens
cacaaaagtttctctttt

SEQ ID NO: 4720077 - DNA, 16 bp, Homo sapiens
cacaaaccctgcctct

SEQ ID NO: 4720078 - DNA, 15 bp, Homo sapiens
cacaaacctgcctgg

SEQ ID NO: 4720079 - DNA, 18 bp, Homo sapiens
cacaaagtttgtggtaat

SEQ ID NO: 4720080 - DNA, 10 bp, Homo sapiens
cacaaataaa

SEQ ID NO: 4720081 - DNA, 14 bp, Homo sapiens
cacaaatgtgtccc

SEQ ID NO: 4720082 - DNA, 22 bp, Homo sapiens
cacaacacacagatttgagctc

SEQ ID NO: 4720083 - DNA, 22 bp, Homo sapiens
cacaagccaaggaagtctgtgt

SEQ ID NO: 4720084 - DNA, 18 bp, Homo sapiens
cacaagctccaagctccc

SEQ ID NO: 4720085 - DNA, 21 bp, Homo sapiens
cacaagctccaagctcccagg

SEQ ID NO: 4720086 - DNA, 23 bp, Homo sapiens
cacaagctccaagctcccaggca

SEQ ID NO: 4720087 - DNA, 13 bp, Homo sapiens
cacacagctccca

SEQ ID NO: 4720088 - DNA, 17 bp, Homo sapiens
cacacagctctgtcctg

SEQ ID NO: 4720089 - DNA, 23 bp, Homo sapiens
cacacagtattacttctgctaca

SEQ ID NO: 4720090 - DNA, 18 bp, Homo sapiens
cacacagtgagtcgagga

SEQ ID NO: 4720091 - DNA, 21 bp, Homo sapiens
cacacagtgagtcgaggacag

SEQ ID NO: 4720092 - DNA, 12 bp, Homo sapiens
cacacatacaga

SEQ ID NO: 4720093 - DNA, 19 bp, Homo sapiens
cacacatgcttttcttcct

SEQ ID NO: 4720094 - DNA, 20 bp, Homo sapiens
cacaccaagctgtgccaccc

SEQ ID NO: 4720095 - DNA, 22 bp, Homo sapiens
cacaccaagctgtgccaccctg

SEQ ID NO: 4720096 - DNA, 17 bp, Homo sapiens
cactccctgcaacctga

SEQ ID NO: 4720097 - DNA, 13 bp, Homo sapiens
cactcctctgact

SEQ ID NO: 4720098 - DNA, 20 bp, Homo sapiens
cactctcgcacacacagtga

SEQ ID NO: 4720099 - DNA, 13 bp, Homo sapiens
cactctggcagct

SEQ ID NO: 4720100 - DNA, 17 bp, Homo sapiens
cactctggcagctcaga

SEQ ID NO: 4720101 - DNA, 15 bp, Homo sapiens
cactctgtcgcccag

SEQ ID NO: 4720102 - DNA, 19 bp, Homo sapiens
cactctgtcgcccagtctg

SEQ ID NO: 4720103 - DNA, 18 bp, Homo sapiens
cactcttattgcccacgc

SEQ ID NO: 4720104 - DNA, 20 bp, Homo sapiens
cactcttattgcccacgctg

SEQ ID NO: 4720105 - DNA, 20 bp, Homo sapiens
cactgacactggtattcctg

SEQ ID NO: 4720106 - DNA, 23 bp, Homo sapiens
cactgacactggtattcctgcct

SEQ ID NO: 4720107 - DNA, 14 bp, Homo sapiens
cactgactggaagg

SEQ ID NO: 4720108 - DNA, 15 bp, Homo sapiens
cactgagccatcatt

SEQ ID NO: 4720109 - DNA, 13 bp, Homo sapiens
cactgaggaagaa

SEQ ID NO: 4720110 - DNA, 14 bp, Homo sapiens
cactgaggaagaac

SEQ ID NO: 4720111 - DNA, 15 bp, Homo sapiens
cactgaggaagaacg

SEQ ID NO: 4720112 - DNA, 19 bp, Homo sapiens
cactgatggacaaggaggt

SEQ ID NO: 4720113 - DNA, 18 bp, Homo sapiens
cactgatgggcaaccccc

SEQ ID NO: 4720114 - DNA, 24 bp, Homo sapiens
cactgatgggcaacccccagcctg

SEQ ID NO: 4720115 - DNA, 13 bp, Homo sapiens
cactgcaacctcc

SEQ ID NO: 4720116 - DNA, 15 bp, Homo sapiens
cactgcaacttgtga

SEQ ID NO: 4720117 - DNA, 18 bp, Homo sapiens
cactgcaccccctcctgc

SEQ ID NO: 4720118 - DNA, 21 bp, Homo sapiens
cactgcaccccctcctgctgc

SEQ ID NO: 4720119 - DNA, 16 bp, Homo sapiens
cactgcaccgggccac

SEQ ID NO: 4720120 - DNA, 18 bp, Homo sapiens
cactgcaccgggccacag

SEQ ID NO: 4720121 - DNA, 21 bp, Homo sapiens
cactgcagcctcaacctcctg

SEQ ID NO: 4720122 - DNA, 11 bp, Homo sapiens
cactgcatgtt

SEQ ID NO: 4720123 - DNA, 19 bp, Homo sapiens
cactgccctggtggccctc

SEQ ID NO: 4720124 - DNA, 19 bp, Homo sapiens
cactgcctcctacaaccag

SEQ ID NO: 4720125 - DNA, 22 bp, Homo sapiens
cactgcctgatggacctgtcac

SEQ ID NO: 4720126 - DNA, 20 bp, Homo sapiens
cactgcggggcttggctgag

SEQ ID NO: 4720127 - DNA, 12 bp, Homo sapiens
cactgctctggt

SEQ ID NO: 4720128 - DNA, 19 bp, Homo sapiens
cactgctgggtggcccatc

SEQ ID NO: 4720129 - DNA, 16 bp, Homo sapiens
cactgcttccagtgag

SEQ ID NO: 4720130 - DNA, 21 bp, Homo sapiens
cactgcttccagtgaggctct

SEQ ID NO: 4720131 - DNA, 20 bp, Homo sapiens
cactgcttttggtctgtgtg

SEQ ID NO: 4720132 - DNA, 19 bp, Homo sapiens
cactggaactcagtgtgac

SEQ ID NO: 4720133 - DNA, 17 bp, Homo sapiens
cactggattggtcattt

SEQ ID NO: 4720134 - DNA, 14 bp, Homo sapiens
cactggctgcctcc

SEQ ID NO: 4720135 - DNA, 19 bp, Homo sapiens
cactggctgcctccactcc

SEQ ID NO: 4720136 - DNA, 16 bp, Homo sapiens
cactgggactttgtaa

SEQ ID NO: 4720137 - DNA, 18 bp, Homo sapiens
cactggtctaatgtttgt

SEQ ID NO: 4720138 - DNA, 20 bp, Homo sapiens
cactggtctctaagtgtaaa

SEQ ID NO: 4720139 - DNA, 14 bp, Homo sapiens
cactgtaatatctt

SEQ ID NO: 4720140 - DNA, 22 bp, Homo sapiens
cactgtaatatctttaaatgat

SEQ ID NO: 4720141 - DNA, 14 bp, Homo sapiens
cactgtataaatag

SEQ ID NO: 4720142 - DNA, 11 bp, Homo sapiens
cactgtcctgc

SEQ ID NO: 4720143 - DNA, 13 bp, Homo sapiens
cactgtcctgctc

SEQ ID NO: 4720144 - DNA, 23 bp, Homo sapiens
cactgttctattcatctcaagga

SEQ ID NO: 4720145 - DNA, 13 bp, Homo sapiens
cactgttgataaa

SEQ ID NO: 4720146 - DNA, 14 bp, Homo sapiens
cactgttgataaaa

SEQ ID NO: 4720147 - DNA, 14 bp, Homo sapiens
cactgttgcccagg

SEQ ID NO: 4720148 - DNA, 23 bp, Homo sapiens
cactgttgggtgggtgggccctg

SEQ ID NO: 4720149 - DNA, 17 bp, Homo sapiens
cacttacaccagtttga

SEQ ID NO: 4720150 - DNA, 16 bp, Homo sapiens
cacttattgaatatat

SEQ ID NO: 4720151 - DNA, 15 bp, Homo sapiens
cacttcccctcctac

SEQ ID NO: 4720152 - DNA, 21 bp, Homo sapiens
cacttcccctcctacccctcc

SEQ ID NO: 4720153 - DNA, 15 bp, Homo sapiens
cacttccctgacact

SEQ ID NO: 4720154 - DNA, 11 bp, Homo sapiens
cacttctattt

SEQ ID NO: 4720155 - DNA, 22 bp, Homo sapiens
cacttctgccatattctgttgg

SEQ ID NO: 4720156 - DNA, 19 bp, Homo sapiens
cacttctgggtggggcagt

SEQ ID NO: 4720157 - DNA, 20 bp, Homo sapiens
cacttgatgtgatgtggcag

SEQ ID NO: 4720158 - DNA, 21 bp, Homo sapiens
cacttgatgtgatgtggcagg

SEQ ID NO: 4720159 - DNA, 14 bp, Homo sapiens
cacttgcagactct

SEQ ID NO: 4720160 - DNA, 18 bp, Homo sapiens
cacttgcagactctacag

SEQ ID NO: 4720161 - DNA, 22 bp, Homo sapiens
cacttgtgggtttttgttttgt

SEQ ID NO: 4720162 - DNA, 18 bp, Homo sapiens
cacttgttcattctgtga

SEQ ID NO: 4720163 - DNA, 19 bp, Homo sapiens
cacttgttcattctgtgac

SEQ ID NO: 4720164 - DNA, 19 bp, Homo sapiens
cacttgttgattaatggaa

SEQ ID NO: 4720165 - DNA, 13 bp, Homo sapiens
cactttcattttt

SEQ ID NO: 4720166 - DNA, 14 bp, Homo sapiens
cactttcatttttg

SEQ ID NO: 4720167 - DNA, 13 bp, Homo sapiens
cactttgttctgg

SEQ ID NO: 4720168 - DNA, 14 bp, Homo sapiens
cactttgttctggc

SEQ ID NO: 4720169 - DNA, 18 bp, Homo sapiens
cacttttatttagcacca

SEQ ID NO: 4720170 - DNA, 14 bp, Homo sapiens
cactttttgcagct

SEQ ID NO: 4720171 - DNA, 18 bp, Homo sapiens
cactttttgcagctttct

SEQ ID NO: 4720172 - DNA, 18 bp, Homo sapiens
cagaaacaccctcacact

SEQ ID NO: 4720173 - DNA, 23 bp, Homo sapiens
cagaaacaccctcacactgggac

SEQ ID NO: 4720174 - DNA, 16 bp, Homo sapiens
cagaaagaaaatgaat

SEQ ID NO: 4720175 - DNA, 14 bp, Homo sapiens
cagaaatgctctga

SEQ ID NO: 4720176 - DNA, 11 bp, Homo sapiens
cagaacactgt

SEQ ID NO: 4720177 - DNA, 12 bp, Homo sapiens
cagaacagcttc

SEQ ID NO: 4720178 - DNA, 13 bp, Homo sapiens
cagaacagcttca

SEQ ID NO: 4720179 - DNA, 19 bp, Homo sapiens
cagaacagtctctggaaga

SEQ ID NO: 4720180 - DNA, 22 bp, Homo sapiens
cagaacagtgtttgatttttat

SEQ ID NO: 4720181 - DNA, 21 bp, Homo sapiens
cagaacctggagggctagaac

SEQ ID NO: 4720182 - DNA, 15 bp, Homo sapiens
cagaactttagtatt

SEQ ID NO: 4720183 - DNA, 14 bp, Homo sapiens
cagaagaaggcagc

SEQ ID NO: 4720184 - DNA, 15 bp, Homo sapiens
cagaagacaccagag

SEQ ID NO: 4720185 - DNA, 14 bp, Homo sapiens
cagaagggggtggt

SEQ ID NO: 4720186 - DNA, 20 bp, Homo sapiens
cagaagggggtggtgtctcc

SEQ ID NO: 4720187 - DNA, 19 bp, Homo sapiens
cagaagtattgtttacatt

SEQ ID NO: 4720188 - DNA, 24 bp, Homo sapiens
cagaagtgatttagttgtggaaag

SEQ ID NO: 4720189 - DNA, 12 bp, Homo sapiens
cagaatactggt

SEQ ID NO: 4720190 - DNA, 23 bp, Homo sapiens
cagaatatgattcactatttaaa

SEQ ID NO: 4720191 - DNA, 13 bp, Homo sapiens
cagacacaggccc

SEQ ID NO: 4720192 - DNA, 17 bp, Homo sapiens
cagacacatgtccaaga

SEQ ID NO: 4720193 - DNA, 15 bp, Homo sapiens
cagacagccccctgc

SEQ ID NO: 4720194 - DNA, 13 bp, Homo sapiens
cagacagctgcct

SEQ ID NO: 4720195 - DNA, 15 bp, Homo sapiens
cagacaggaccaggg

SEQ ID NO: 4720196 - DNA, 24 bp, Homo sapiens
cagacaggaccagggatttccatg

SEQ ID NO: 4720197 - DNA, 13 bp, Homo sapiens
cagacaggcaagc

SEQ ID NO: 4720198 - DNA, 18 bp, Homo sapiens
cagacaggcaagcacctc

SEQ ID NO: 4720199 - DNA, 20 bp, Homo sapiens
cagacaggcaagcacctcct

SEQ ID NO: 4720200 - DNA, 23 bp, Homo sapiens
cagacaggcaagcacctcctgcc

SEQ ID NO: 4720201 - DNA, 16 bp, Homo sapiens
cagacccggctgcgtg

SEQ ID NO: 4720202 - DNA, 16 bp, Homo sapiens
cagaccctgccctgtg

SEQ ID NO: 4720203 - DNA, 22 bp, Homo sapiens
cagaccctgccctgtgggcccc

SEQ ID NO: 4720204 - DNA, 22 bp, Homo sapiens
cagacctgctctggacacttgc

SEQ ID NO: 4720205 - DNA, 21 bp, Homo sapiens
cagaccttctaggacgccacc

SEQ ID NO: 4720206 - DNA, 13 bp, Homo sapiens
cagctcttgtttg

SEQ ID NO: 4720207 - DNA, 14 bp, Homo sapiens
cagctgacagtcct

SEQ ID NO: 4720208 - DNA, 18 bp, Homo sapiens
cagctgacagtcctctcc

SEQ ID NO: 4720209 - DNA, 15 bp, Homo sapiens
cagctgcctgggatc

SEQ ID NO: 4720210 - DNA, 18 bp, Homo sapiens
cagctgcggtccacccag

SEQ ID NO: 4720211 - DNA, 20 bp, Homo sapiens
cagctgcggtccacccagga

SEQ ID NO: 4720212 - DNA, 14 bp, Homo sapiens
cagctgctggagac

SEQ ID NO: 4720213 - DNA, 15 bp, Homo sapiens
cagctgctggagact

SEQ ID NO: 4720214 - DNA, 18 bp, Homo sapiens
cagctgctggctgtgaca

SEQ ID NO: 4720215 - DNA, 19 bp, Homo sapiens
cagctgctggctgtgacaa

SEQ ID NO: 4720216 - DNA, 23 bp, Homo sapiens
cagctgcttttgtctatgggact

SEQ ID NO: 4720217 - DNA, 17 bp, Homo sapiens
cagctggactgctgctg

SEQ ID NO: 4720218 - DNA, 19 bp, Homo sapiens
cagctggattgggttatga

SEQ ID NO: 4720219 - DNA, 13 bp, Homo sapiens
cagctggcagaga

SEQ ID NO: 4720220 - DNA, 16 bp, Homo sapiens
cagctgggtggcactg

SEQ ID NO: 4720221 - DNA, 19 bp, Homo sapiens
cagctgggtggcactgcca

SEQ ID NO: 4720222 - DNA, 19 bp, Homo sapiens
cagctggtggatggtgact

SEQ ID NO: 4720223 - DNA, 15 bp, Homo sapiens
cagcttcatttcctg

SEQ ID NO: 4720224 - DNA, 17 bp, Homo sapiens
cagcttctgctgggctg

SEQ ID NO: 4720225 - DNA, 14 bp, Homo sapiens
cagcttgagggttg

SEQ ID NO: 4720226 - DNA, 13 bp, Homo sapiens
cagcttgtatttt

SEQ ID NO: 4720227 - DNA, 20 bp, Homo sapiens
cagctttgggtcatttttaa

SEQ ID NO: 4720228 - DNA, 18 bp, Homo sapiens
caggaaaagcctctgtgt

SEQ ID NO: 4720229 - DNA, 16 bp, Homo sapiens
caggaaaagctgctga

SEQ ID NO: 4720230 - DNA, 19 bp, Homo sapiens
caggaaagagattagaaca

SEQ ID NO: 4720231 - DNA, 19 bp, Homo sapiens
caggaaaggaatcatttct

SEQ ID NO: 4720232 - DNA, 15 bp, Homo sapiens
caggaaaggctccag

SEQ ID NO: 4720233 - DNA, 23 bp, Homo sapiens
caggaaaggctccaggagcagcc

SEQ ID NO: 4720234 - DNA, 13 bp, Homo sapiens
caggaaatgaaaa

SEQ ID NO: 4720235 - DNA, 20 bp, Homo sapiens
caggaaatgaaaatgtcttg

SEQ ID NO: 4720236 - DNA, 13 bp, Homo sapiens
caggaacatacag

SEQ ID NO: 4720237 - DNA, 15 bp, Homo sapiens
caggaacatacagac

SEQ ID NO: 4720238 - DNA, 16 bp, Homo sapiens
caggaagataaaaatc

SEQ ID NO: 4720239 - DNA, 20 bp, Homo sapiens
caggaagatgtatgctttga

SEQ ID NO: 4720240 - DNA, 13 bp, Homo sapiens
caggaagctcagg

SEQ ID NO: 4720241 - DNA, 15 bp, Homo sapiens
caggaagctcagggc

SEQ ID NO: 4720242 - DNA, 22 bp, Homo sapiens
caggaagctcagggcctggctc

SEQ ID NO: 4720243 - DNA, 23 bp, Homo sapiens
caggaagctcagggcctggctca

SEQ ID NO: 4720244 - DNA, 15 bp, Homo sapiens
caggaaggagctgcc

SEQ ID NO: 4720245 - DNA, 17 bp, Homo sapiens
caggaaggagctgcctg

SEQ ID NO: 4720246 - DNA, 21 bp, Homo sapiens
caggaattcttggagaaaatg

SEQ ID NO: 4720247 - DNA, 16 bp, Homo sapiens
caggacatgctgaagc

SEQ ID NO: 4720248 - DNA, 16 bp, Homo sapiens
caggacattaaaaatg

SEQ ID NO: 4720249 - DNA, 18 bp, Homo sapiens
caggaccaggcaatgtga

SEQ ID NO: 4720250 - DNA, 21 bp, Homo sapiens
caggaccagtcaacctgggca

SEQ ID NO: 4720251 - DNA, 23 bp, Homo sapiens
caggacctagctgttgtaaagaa

SEQ ID NO: 4720252 - DNA, 17 bp, Homo sapiens
caggacctgtggccaag

SEQ ID NO: 4720253 - DNA, 19 bp, Homo sapiens
caggacggggccggccagg

SEQ ID NO: 4720254 - DNA, 24 bp, Homo sapiens
caggacggggccggccaggtgggc

SEQ ID NO: 4720255 - DNA, 11 bp, Homo sapiens
caggactctgc

SEQ ID NO: 4720256 - DNA, 16 bp, Homo sapiens
caggactgggccactt

SEQ ID NO: 4720257 - DNA, 20 bp, Homo sapiens
caggactgggccacttctgg

SEQ ID NO: 4720258 - DNA, 15 bp, Homo sapiens
caggacttccatctg

SEQ ID NO: 4720259 - DNA, 19 bp, Homo sapiens
caggagaaggccaattcct

SEQ ID NO: 4720260 - DNA, 22 bp, Homo sapiens
caggagaaggccaattcctata

SEQ ID NO: 4720261 - DNA, 13 bp, Homo sapiens
caggagcagccac

SEQ ID NO: 4720262 - DNA, 15 bp, Homo sapiens
caggagccccgaggc

SEQ ID NO: 4720263 - DNA, 20 bp, Homo sapiens
caggagccggacacttctca

SEQ ID NO: 4720264 - DNA, 21 bp, Homo sapiens
caggagctcccctccccaact

SEQ ID NO: 4720265 - DNA, 22 bp, Homo sapiens
caggagctcccctccccaactg

SEQ ID NO: 4720266 - DNA, 19 bp, Homo sapiens
caggaggaggtgccaacag

SEQ ID NO: 4720267 - DNA, 15 bp, Homo sapiens
caggaggccagcctt

SEQ ID NO: 4720268 - DNA, 22 bp, Homo sapiens
caggaggccagccttgaccatt

SEQ ID NO: 4720269 - DNA, 13 bp, Homo sapiens
caggagggcagtg

SEQ ID NO: 4720270 - DNA, 21 bp, Homo sapiens
caggagggcagtggtggagct

SEQ ID NO: 4720271 - DNA, 19 bp, Homo sapiens
caggagggctaattagaaa

SEQ ID NO: 4720272 - DNA, 23 bp, Homo sapiens
caggagggctaattagaaatcaa

SEQ ID NO: 4720273 - DNA, 17 bp, Homo sapiens
caggagtgggttgattt

SEQ ID NO: 4720274 - DNA, 21 bp, Homo sapiens
caggagttccagtgctgcatg

SEQ ID NO: 4720275 - DNA, 21 bp, Homo sapiens
caggagtttgagaccagcctg

SEQ ID NO: 4720276 - DNA, 13 bp, Homo sapiens
caggatcagtctg

SEQ ID NO: 4720277 - DNA, 14 bp, Homo sapiens
caggatcagtctga

SEQ ID NO: 4720278 - DNA, 15 bp, Homo sapiens
caggatcatggtgta

SEQ ID NO: 4720279 - DNA, 21 bp, Homo sapiens
caggatcatggtgtaataaga

SEQ ID NO: 4720280 - DNA, 22 bp, Homo sapiens
caggatcatggtgtaataagac

SEQ ID NO: 4720281 - DNA, 23 bp, Homo sapiens
caggatcgcaagagccatgtaga

SEQ ID NO: 4720282 - DNA, 16 bp, Homo sapiens
caggatggcctggcca

SEQ ID NO: 4720283 - DNA, 17 bp, Homo sapiens
caggatggcctggccag

SEQ ID NO: 4720284 - DNA, 24 bp, Homo sapiens
caggatggcctggccagggcctgg

SEQ ID NO: 4720285 - DNA, 18 bp, Homo sapiens
caggattgcgagagatgt

SEQ ID NO: 4720286 - DNA, 23 bp, Homo sapiens
caggattgcgagagatgtgtgtt

SEQ ID NO: 4720287 - DNA, 14 bp, Homo sapiens
caggcacagcacag

SEQ ID NO: 4720288 - DNA, 12 bp, Homo sapiens
caggcagcagag

SEQ ID NO: 4720289 - DNA, 12 bp, Homo sapiens
caggcagcccta

SEQ ID NO: 4720290 - DNA, 19 bp, Homo sapiens
caggcaggtccagggtttg

SEQ ID NO: 4720291 - DNA, 12 bp, Homo sapiens
caggcatgaagt

SEQ ID NO: 4720292 - DNA, 19 bp, Homo sapiens
caggcatgttctctgagga

SEQ ID NO: 4720293 - DNA, 20 bp, Homo sapiens
caggcattccccaggaggcc

SEQ ID NO: 4720294 - DNA, 21 bp, Homo sapiens
caggcattccccaggaggcca

SEQ ID NO: 4720295 - DNA, 22 bp, Homo sapiens
caggcattccccaggaggccag

SEQ ID NO: 4720296 - DNA, 23 bp, Homo sapiens
caggcattccccaggaggccagc

SEQ ID NO: 4720297 - DNA, 19 bp, Homo sapiens
caggcattgccaagggctt

SEQ ID NO: 4720298 - DNA, 22 bp, Homo sapiens
caggccaaagagtctccagttt

SEQ ID NO: 4720299 - DNA, 18 bp, Homo sapiens
caggccacaagacccttg

SEQ ID NO: 4720300 - DNA, 23 bp, Homo sapiens
caggccagagggagtgacagagg

SEQ ID NO: 4720301 - DNA, 17 bp, Homo sapiens
caggccaggactctgca

SEQ ID NO: 4720302 - DNA, 19 bp, Homo sapiens
caggccaggactctgcagc

SEQ ID NO: 4720303 - DNA, 20 bp, Homo sapiens
caggccaggactctgcagcc

SEQ ID NO: 4720304 - DNA, 14 bp, Homo sapiens
caggccatcttcca

SEQ ID NO: 4720305 - DNA, 15 bp, Homo sapiens
caggccatcttccag

SEQ ID NO: 4720306 - DNA, 12 bp, Homo sapiens
caggcccctctc

SEQ ID NO: 4720307 - DNA, 14 bp, Homo sapiens
caggcccctctcct

SEQ ID NO: 4720308 - DNA, 14 bp, Homo sapiens
caggcccggctcca

SEQ ID NO: 4720309 - DNA, 21 bp, Homo sapiens
caggcccggctccaggctcct

SEQ ID NO: 4720310 - DNA, 18 bp, Homo sapiens
caggcctgagatttcatc

SEQ ID NO: 4720311 - DNA, 23 bp, Homo sapiens
caggcctgagatttcatctgctc

SEQ ID NO: 4720312 - DNA, 17 bp, Homo sapiens
caggcctgggccagagt

SEQ ID NO: 4720313 - DNA, 21 bp, Homo sapiens
caggcgtgagccaccgtgcct

SEQ ID NO: 4720314 - DNA, 13 bp, Homo sapiens
caggcgttcagct

SEQ ID NO: 4720315 - DNA, 14 bp, Homo sapiens
cataaaattttcta

SEQ ID NO: 4720316 - DNA, 21 bp, Homo sapiens
cataaacccagttgccatctg

SEQ ID NO: 4720317 - DNA, 12 bp, Homo sapiens
cataaatatgca

SEQ ID NO: 4720318 - DNA, 13 bp, Homo sapiens
cataaatatgcag

SEQ ID NO: 4720319 - DNA, 14 bp, Homo sapiens
cataaatgttcact

SEQ ID NO: 4720320 - DNA, 17 bp, Homo sapiens
cataaattatttgatta

SEQ ID NO: 4720321 - DNA, 22 bp, Homo sapiens
cataaattatttgattatttaa

SEQ ID NO: 4720322 - DNA, 21 bp, Homo sapiens
cataaatttgttgtcatgtgt

SEQ ID NO: 4720323 - DNA, 14 bp, Homo sapiens
cataacaattcctc

SEQ ID NO: 4720324 - DNA, 16 bp, Homo sapiens
cataacaattcctcta

SEQ ID NO: 4720325 - DNA, 22 bp, Homo sapiens
cataacatagttgaaaaaagaa

SEQ ID NO: 4720326 - DNA, 15 bp, Homo sapiens
cataacgtttttcct

SEQ ID NO: 4720327 - DNA, 17 bp, Homo sapiens
cataacgtttttccttt

SEQ ID NO: 4720328 - DNA, 18 bp, Homo sapiens
cataacgtttttccttta

SEQ ID NO: 4720329 - DNA, 21 bp, Homo sapiens
cataacgtttttcctttaaaa

SEQ ID NO: 4720330 - DNA, 17 bp, Homo sapiens
cataagtgacaccaata

SEQ ID NO: 4720331 - DNA, 20 bp, Homo sapiens
cataataaatcacacattca

SEQ ID NO: 4720332 - DNA, 20 bp, Homo sapiens
cataattttgtgttgtacaa

SEQ ID NO: 4720333 - DNA, 14 bp, Homo sapiens
catacaaatactat

SEQ ID NO: 4720334 - DNA, 13 bp, Homo sapiens
catacagacacat

SEQ ID NO: 4720335 - DNA, 19 bp, Homo sapiens
catacagagctctctgagg

SEQ ID NO: 4720336 - DNA, 11 bp, Homo sapiens
catacccaccc

SEQ ID NO: 4720337 - DNA, 14 bp, Homo sapiens
catacccaccccca

SEQ ID NO: 4720338 - DNA, 17 bp, Homo sapiens
catacccacccccaccc

SEQ ID NO: 4720339 - DNA, 18 bp, Homo sapiens
catacccacccccaccca

SEQ ID NO: 4720340 - DNA, 19 bp, Homo sapiens
catacctgtgaatatagat

SEQ ID NO: 4720341 - DNA, 16 bp, Homo sapiens
catactcccatctgtg

SEQ ID NO: 4720342 - DNA, 20 bp, Homo sapiens
catactcccatctgtgaaag

SEQ ID NO: 4720343 - DNA, 13 bp, Homo sapiens
catactggcctcg

SEQ ID NO: 4720344 - DNA, 15 bp, Homo sapiens
catactggcctcgcc

SEQ ID NO: 4720345 - DNA, 17 bp, Homo sapiens
catactggcctcgcctg

SEQ ID NO: 4720346 - DNA, 19 bp, Homo sapiens
catactgtgctggagccac

SEQ ID NO: 4720347 - DNA, 19 bp, Homo sapiens
catagcagagaatgaaagg

SEQ ID NO: 4720348 - DNA, 12 bp, Homo sapiens
catagccctcac

SEQ ID NO: 4720349 - DNA, 15 bp, Homo sapiens
catagctacatcagt

SEQ ID NO: 4720350 - DNA, 18 bp, Homo sapiens
cataggaggggtctggac

SEQ ID NO: 4720351 - DNA, 22 bp, Homo sapiens
cataggaggggtctggacatgt

SEQ ID NO: 4720352 - DNA, 16 bp, Homo sapiens
catagtatggtggctg

SEQ ID NO: 4720353 - DNA, 18 bp, Homo sapiens
catagtatggtggctggg

SEQ ID NO: 4720354 - DNA, 20 bp, Homo sapiens
catagtatggtggctgggtt

SEQ ID NO: 4720355 - DNA, 17 bp, Homo sapiens
catataaaaacatcagt

SEQ ID NO: 4720356 - DNA, 17 bp, Homo sapiens
catataaagattaacac

SEQ ID NO: 4720357 - DNA, 11 bp, Homo sapiens
catataagaca

SEQ ID NO: 4720358 - DNA, 14 bp, Homo sapiens
catataatgaataa

SEQ ID NO: 4720359 - DNA, 15 bp, Homo sapiens
catatagtcaatgta

SEQ ID NO: 4720360 - DNA, 23 bp, Homo sapiens
catatatatgttttaagaggcag

SEQ ID NO: 4720361 - DNA, 13 bp, Homo sapiens
catatcatttgtg

SEQ ID NO: 4720362 - DNA, 18 bp, Homo sapiens
catatcatttgtgaagaa

SEQ ID NO: 4720363 - DNA, 18 bp, Homo sapiens
catatctctagtccctgt

SEQ ID NO: 4720364 - DNA, 19 bp, Homo sapiens
catatgacattcatgcctg

SEQ ID NO: 4720365 - DNA, 22 bp, Homo sapiens
catatgcatgcccttcctttct

SEQ ID NO: 4720366 - DNA, 20 bp, Homo sapiens
catattaagaatagtctctg

SEQ ID NO: 4720367 - DNA, 22 bp, Homo sapiens
catattataaaggataaagaag

SEQ ID NO: 4720368 - DNA, 14 bp, Homo sapiens
catattatgcctga

SEQ ID NO: 4720369 - DNA, 14 bp, Homo sapiens
catattcaggaagc

SEQ ID NO: 4720370 - DNA, 20 bp, Homo sapiens
catattcaggaagctcaggg

SEQ ID NO: 4720371 - DNA, 22 bp, Homo sapiens
catattcaggaagctcagggcc

SEQ ID NO: 4720372 - DNA, 22 bp, Homo sapiens
catattctgttggccagtgtga

SEQ ID NO: 4720373 - DNA, 21 bp, Homo sapiens
catattgagcacttgctgtat

SEQ ID NO: 4720374 - DNA, 12 bp, Homo sapiens
catatttaagaa

SEQ ID NO: 4720375 - DNA, 15 bp, Homo sapiens
catcaaacatgaaaa

SEQ ID NO: 4720376 - DNA, 13 bp, Homo sapiens
catcaacaaaaat

SEQ ID NO: 4720377 - DNA, 15 bp, Homo sapiens
catcaagactggaag

SEQ ID NO: 4720378 - DNA, 22 bp, Homo sapiens
catcaagtctttcacatttaaa

SEQ ID NO: 4720379 - DNA, 13 bp, Homo sapiens
catcacctccacc

SEQ ID NO: 4720380 - DNA, 17 bp, Homo sapiens
catcagaaacaccctca

SEQ ID NO: 4720381 - DNA, 15 bp, Homo sapiens
catcagtgctccctc

SEQ ID NO: 4720382 - DNA, 24 bp, Homo sapiens
catcagtgctccctcacatgtcag

SEQ ID NO: 4720383 - DNA, 14 bp, Homo sapiens
catcagtggagcca

SEQ ID NO: 4720384 - DNA, 21 bp, Homo sapiens
catcagtgtacccccgcccag

SEQ ID NO: 4720385 - DNA, 18 bp, Homo sapiens
catcagttagagctgaca

SEQ ID NO: 4720386 - DNA, 16 bp, Homo sapiens
catcatccctccctgc

SEQ ID NO: 4720387 - DNA, 20 bp, Homo sapiens
catcatctcctgccttcctc

SEQ ID NO: 4720388 - DNA, 21 bp, Homo sapiens
catcatctcctgccttcctcc

SEQ ID NO: 4720389 - DNA, 12 bp, Homo sapiens
catcattctctg

SEQ ID NO: 4720390 - DNA, 16 bp, Homo sapiens
catcattctctgtctc

SEQ ID NO: 4720391 - DNA, 21 bp, Homo sapiens
catcattctctgtctcatcca

SEQ ID NO: 4720392 - DNA, 20 bp, Homo sapiens
catcattggataaatttgaa

SEQ ID NO: 4720393 - DNA, 17 bp, Homo sapiens
catccacatgggagccg

SEQ ID NO: 4720394 - DNA, 13 bp, Homo sapiens
catccacctcctt

SEQ ID NO: 4720395 - DNA, 14 bp, Homo sapiens
catccacctccttc

SEQ ID NO: 4720396 - DNA, 16 bp, Homo sapiens
catccaggactgagat

SEQ ID NO: 4720397 - DNA, 19 bp, Homo sapiens
catccatgttccgagaaga

SEQ ID NO: 4720398 - DNA, 12 bp, Homo sapiens
catcccagcccc

SEQ ID NO: 4720399 - DNA, 17 bp, Homo sapiens
catcccccctcaccagg

SEQ ID NO: 4720400 - DNA, 13 bp, Homo sapiens
catccctccctgc

SEQ ID NO: 4720401 - DNA, 13 bp, Homo sapiens
catccctgaaggc

SEQ ID NO: 4720402 - DNA, 22 bp, Homo sapiens
catccctgaaggccccgcccag

SEQ ID NO: 4720403 - DNA, 14 bp, Homo sapiens
catcctaaatattg

SEQ ID NO: 4720404 - DNA, 17 bp, Homo sapiens
catcctcaaacactgca

SEQ ID NO: 4720405 - DNA, 16 bp, Homo sapiens
catcctcatacccacc

SEQ ID NO: 4720406 - DNA, 18 bp, Homo sapiens
catcctccacgttctgct

SEQ ID NO: 4720407 - DNA, 17 bp, Homo sapiens
catcctccagatagtgt

SEQ ID NO: 4720408 - DNA, 21 bp, Homo sapiens
catcctctgtacagagcccac

SEQ ID NO: 4720409 - DNA, 23 bp, Homo sapiens
catcctggcacccggcccctgct

SEQ ID NO: 4720410 - DNA, 20 bp, Homo sapiens
catcctgtcccaccatgcag

SEQ ID NO: 4720411 - DNA, 16 bp, Homo sapiens
catccttacaatgtaa

SEQ ID NO: 4720412 - DNA, 14 bp, Homo sapiens
catcgatatgaaaa

SEQ ID NO: 4720413 - DNA, 15 bp, Homo sapiens
catctaaactgcccc

SEQ ID NO: 4720414 - DNA, 21 bp, Homo sapiens
catctaaactgccccctctgc

SEQ ID NO: 4720415 - DNA, 16 bp, Homo sapiens
catctaattcttattt

SEQ ID NO: 4720416 - DNA, 20 bp, Homo sapiens
catctcacacatgagcatca

SEQ ID NO: 4720417 - DNA, 23 bp, Homo sapiens
catctccagcattctcagccaca

SEQ ID NO: 4720418 - DNA, 17 bp, Homo sapiens
catctccatcttgaagg

SEQ ID NO: 4720419 - DNA, 22 bp, Homo sapiens
catctcctgccttcctcctggg

SEQ ID NO: 4720420 - DNA, 14 bp, Homo sapiens
catctctggatgcc

SEQ ID NO: 4720421 - DNA, 16 bp, Homo sapiens
catctctggatgcctg

SEQ ID NO: 4720422 - DNA, 13 bp, Homo sapiens
catctctgtccca

SEQ ID NO: 4720423 - DNA, 22 bp, Homo sapiens
catctcttctgggttccttcct

SEQ ID NO: 4720424 - DNA, 19 bp, Homo sapiens
catctgataatttcacaga

SEQ ID NO: 4720425 - DNA, 22 bp, Homo sapiens
cattttggggtacccactgctc

SEQ ID NO: 4720426 - DNA, 17 bp, Homo sapiens
cattttgtagcctctct

SEQ ID NO: 4720427 - DNA, 12 bp, Homo sapiens
cattttgtgaat

SEQ ID NO: 4720428 - DNA, 13 bp, Homo sapiens
cattttgtgaatg

SEQ ID NO: 4720429 - DNA, 16 bp, Homo sapiens
cattttgtgaatggat

SEQ ID NO: 4720430 - DNA, 12 bp, Homo sapiens
catttttaaagg

SEQ ID NO: 4720431 - DNA, 15 bp, Homo sapiens
catttttaaaggaca

SEQ ID NO: 4720432 - DNA, 16 bp, Homo sapiens
catttttaactactgt

SEQ ID NO: 4720433 - DNA, 18 bp, Homo sapiens
catttttaaggctgtgtg

SEQ ID NO: 4720434 - DNA, 20 bp, Homo sapiens
catttttaaggctgtgtgaa

SEQ ID NO: 4720435 - DNA, 12 bp, Homo sapiens
catttttatcta

SEQ ID NO: 4720436 - DNA, 20 bp, Homo sapiens
catttttgtactaactagca

SEQ ID NO: 4720437 - DNA, 22 bp, Homo sapiens
catttttgtttctacctcccag

SEQ ID NO: 4720438 - DNA, 15 bp, Homo sapiens
catttttttccaggc

SEQ ID NO: 4720439 - DNA, 17 bp, Homo sapiens
ccaaaactctcctctgc

SEQ ID NO: 4720440 - DNA, 16 bp, Homo sapiens
ccaaaatccccttctc

SEQ ID NO: 4720441 - DNA, 20 bp, Homo sapiens
ccaaagccaataacacacag

SEQ ID NO: 4720442 - DNA, 21 bp, Homo sapiens
ccaaagccaataacacacagc

SEQ ID NO: 4720443 - DNA, 15 bp, Homo sapiens
ccaaagctaggcctg

SEQ ID NO: 4720444 - DNA, 16 bp, Homo sapiens
ccaaagctaggcctgg

SEQ ID NO: 4720445 - DNA, 19 bp, Homo sapiens
ccaaaggccatggagagct

SEQ ID NO: 4720446 - DNA, 21 bp, Homo sapiens
ccaaaggccatggagagctgg

SEQ ID NO: 4720447 - DNA, 22 bp, Homo sapiens
ccaaagtgctgggattacaggc

SEQ ID NO: 4720448 - DNA, 22 bp, Homo sapiens
ccaaagtgctgggattacaggt

SEQ ID NO: 4720449 - DNA, 22 bp, Homo sapiens
ccaaagtggtatagaaatgctg

SEQ ID NO: 4720450 - DNA, 15 bp, Homo sapiens
ccaaagttaaatgta

SEQ ID NO: 4720451 - DNA, 12 bp, Homo sapiens
ccaaataaataa

SEQ ID NO: 4720452 - DNA, 17 bp, Homo sapiens
ccaaataatgtctctgt

SEQ ID NO: 4720453 - DNA, 13 bp, Homo sapiens
ccaaatcctctcc

SEQ ID NO: 4720454 - DNA, 13 bp, Homo sapiens
ccaaatgcattca

SEQ ID NO: 4720455 - DNA, 18 bp, Homo sapiens
ccaaattatgtgaaatgc

SEQ ID NO: 4720456 - DNA, 23 bp, Homo sapiens
ccaacagtgttaggcctggcaca

SEQ ID NO: 4720457 - DNA, 21 bp, Homo sapiens
ccaacatactcccatctgtga

SEQ ID NO: 4720458 - DNA, 22 bp, Homo sapiens
ccaacatactcccatctgtgaa

SEQ ID NO: 4720459 - DNA, 16 bp, Homo sapiens
ccaacattgttcattc

SEQ ID NO: 4720460 - DNA, 14 bp, Homo sapiens
ccaacccccagcac

SEQ ID NO: 4720461 - DNA, 17 bp, Homo sapiens
ccaacccccagccccca

SEQ ID NO: 4720462 - DNA, 13 bp, Homo sapiens
ccaaccccccagc

SEQ ID NO: 4720463 - DNA, 15 bp, Homo sapiens
ccaaccccccagcac

SEQ ID NO: 4720464 - DNA, 12 bp, Homo sapiens
ccaaccctcatc

SEQ ID NO: 4720465 - DNA, 14 bp, Homo sapiens
ccaacctggggggc

SEQ ID NO: 4720466 - DNA, 19 bp, Homo sapiens
ccaacttcttcagagctga

SEQ ID NO: 4720467 - DNA, 21 bp, Homo sapiens
ccaagcactgtgctcagggct

SEQ ID NO: 4720468 - DNA, 14 bp, Homo sapiens
ccaagcaggacatg

SEQ ID NO: 4720469 - DNA, 23 bp, Homo sapiens
ccaagcatttaatgtagccatgg

SEQ ID NO: 4720470 - DNA, 20 bp, Homo sapiens
ccaagctcaggaccaggcaa

SEQ ID NO: 4720471 - DNA, 12 bp, Homo sapiens
ccaagctcccag

SEQ ID NO: 4720472 - DNA, 13 bp, Homo sapiens
ccaagctcccagg

SEQ ID NO: 4720473 - DNA, 14 bp, Homo sapiens
ccaagctcccaggc

SEQ ID NO: 4720474 - DNA, 15 bp, Homo sapiens
ccaagctcccaggca

SEQ ID NO: 4720475 - DNA, 14 bp, Homo sapiens
ccaagctctgctcc

SEQ ID NO: 4720476 - DNA, 18 bp, Homo sapiens
ccaaggaaaccacagctg

SEQ ID NO: 4720477 - DNA, 19 bp, Homo sapiens
ccaaggaaaccacagctgc

SEQ ID NO: 4720478 - DNA, 14 bp, Homo sapiens
ccaaggaagtctgt

SEQ ID NO: 4720479 - DNA, 14 bp, Homo sapiens
ccaaggagacacaa

SEQ ID NO: 4720480 - DNA, 18 bp, Homo sapiens
ccaaggatgccccgtccc

SEQ ID NO: 4720481 - DNA, 21 bp, Homo sapiens
ccaagggaaagaaaaggaagg

SEQ ID NO: 4720482 - DNA, 13 bp, Homo sapiens
ccaaggtggtctg

SEQ ID NO: 4720483 - DNA, 22 bp, Homo sapiens
ccaagtgatccttccacctcag

SEQ ID NO: 4720484 - DNA, 23 bp, Homo sapiens
ccaagtgatccttccacctcagt

SEQ ID NO: 4720485 - DNA, 13 bp, Homo sapiens
ccaagtggcagag

SEQ ID NO: 4720486 - DNA, 18 bp, Homo sapiens
ccaataattttcctgtga

SEQ ID NO: 4720487 - DNA, 14 bp, Homo sapiens
ccaatcctatgttt

SEQ ID NO: 4720488 - DNA, 15 bp, Homo sapiens
ccaatgaaaaaatgt

SEQ ID NO: 4720489 - DNA, 20 bp, Homo sapiens
ccaatgcactttgttctggc

SEQ ID NO: 4720490 - DNA, 14 bp, Homo sapiens
ccaatgctgatgtc

SEQ ID NO: 4720491 - DNA, 19 bp, Homo sapiens
ccaatggaacctcctttct

SEQ ID NO: 4720492 - DNA, 21 bp, Homo sapiens
ccaatgtattgataagagggc

SEQ ID NO: 4720493 - DNA, 18 bp, Homo sapiens
ccaattaatgaagttgat

SEQ ID NO: 4720494 - DNA, 21 bp, Homo sapiens
ccaattataacttattagcag

SEQ ID NO: 4720495 - DNA, 12 bp, Homo sapiens
ccaattccttgt

SEQ ID NO: 4720496 - DNA, 23 bp, Homo sapiens
ccacaaccaaaaaaaaataaaaa

SEQ ID NO: 4720497 - DNA, 12 bp, Homo sapiens
ccacacccagcc

SEQ ID NO: 4720498 - DNA, 12 bp, Homo sapiens
ccacacctgagc

SEQ ID NO: 4720499 - DNA, 21 bp, Homo sapiens
ccacagacctgctctggacac

SEQ ID NO: 4720500 - DNA, 17 bp, Homo sapiens
ccacagcaaggcacctg

SEQ ID NO: 4720501 - DNA, 13 bp, Homo sapiens
ccacagccatccc

SEQ ID NO: 4720502 - DNA, 18 bp, Homo sapiens
ccacagcccacgtcctgt

SEQ ID NO: 4720503 - DNA, 19 bp, Homo sapiens
ccacagcccacgtcctgtc

SEQ ID NO: 4720504 - DNA, 19 bp, Homo sapiens
ccacagcctcccctgccag

SEQ ID NO: 4720505 - DNA, 23 bp, Homo sapiens
ccacagcgctggccgggaccccg

SEQ ID NO: 4720506 - DNA, 14 bp, Homo sapiens
ccacagctgctgga

SEQ ID NO: 4720507 - DNA, 19 bp, Homo sapiens
ccacagcttatggcatctc

SEQ ID NO: 4720508 - DNA, 16 bp, Homo sapiens
ccacaggatcagtctg

SEQ ID NO: 4720509 - DNA, 11 bp, Homo sapiens
ccacaggcctg

SEQ ID NO: 4720510 - DNA, 12 bp, Homo sapiens
ccacaggcctga

SEQ ID NO: 4720511 - DNA, 19 bp, Homo sapiens
ccacaggcctgagatttca

SEQ ID NO: 4720512 - DNA, 22 bp, Homo sapiens
ccacaggcctgagatttcatct

SEQ ID NO: 4720513 - DNA, 14 bp, Homo sapiens
ccacagtggagagg

SEQ ID NO: 4720514 - DNA, 23 bp, Homo sapiens
ccacagtgttggcgagaggaggg

SEQ ID NO: 4720515 - DNA, 18 bp, Homo sapiens
ccacatcttgctctgctg

SEQ ID NO: 4720516 - DNA, 17 bp, Homo sapiens
ccacatgcggagaacaa

SEQ ID NO: 4720517 - DNA, 16 bp, Homo sapiens
ccacatgggaggctca

SEQ ID NO: 4720518 - DNA, 13 bp, Homo sapiens
ccacatttacata

SEQ ID NO: 4720519 - DNA, 18 bp, Homo sapiens
ccaccaacatactcccat

SEQ ID NO: 4720520 - DNA, 21 bp, Homo sapiens
ccaccaacatactcccatctg

SEQ ID NO: 4720521 - DNA, 14 bp, Homo sapiens
ccaccacacccagc

SEQ ID NO: 4720522 - DNA, 17 bp, Homo sapiens
ccaccacacccagccca

SEQ ID NO: 4720523 - DNA, 16 bp, Homo sapiens
ccaccaccccccactc

SEQ ID NO: 4720524 - DNA, 20 bp, Homo sapiens
ccaccatcaagccaccaaca

SEQ ID NO: 4720525 - DNA, 15 bp, Homo sapiens
ccacccaatgctgat

SEQ ID NO: 4720526 - DNA, 17 bp, Homo sapiens
ccacccacttctgcact

SEQ ID NO: 4720527 - DNA, 14 bp, Homo sapiens
ccacccagagcacc

SEQ ID NO: 4720528 - DNA, 21 bp, Homo sapiens
ccacccaggagccccgaggcc

SEQ ID NO: 4720529 - DNA, 15 bp, Homo sapiens
ccaccccacccactt

SEQ ID NO: 4720530 - DNA, 14 bp, Homo sapiens
ccaccccagggcag

SEQ ID NO: 4720531 - DNA, 20 bp, Homo sapiens
ccaccccagggcagccaggg

SEQ ID NO: 4720532 - DNA, 13 bp, Homo sapiens
ccacccccacacc

SEQ ID NO: 4720533 - DNA, 15 bp, Homo sapiens
ccacccccacccaag

SEQ ID NO: 4720534 - DNA, 17 bp, Homo sapiens
ccacccccacccaaggg

SEQ ID NO: 4720535 - DNA, 14 bp, Homo sapiens
ccatactggcctcg

SEQ ID NO: 4720536 - DNA, 22 bp, Homo sapiens
ccatactggcctcgcctggcct

SEQ ID NO: 4720537 - DNA, 14 bp, Homo sapiens
ccatacttgttctg

SEQ ID NO: 4720538 - DNA, 15 bp, Homo sapiens
ccatacttgttctgt

SEQ ID NO: 4720539 - DNA, 21 bp, Homo sapiens
ccatagagatatttaaaagac

SEQ ID NO: 4720540 - DNA, 18 bp, Homo sapiens
ccatattctgttggccag

SEQ ID NO: 4720541 - DNA, 19 bp, Homo sapiens
ccatattctgttggccagt

SEQ ID NO: 4720542 - DNA, 17 bp, Homo sapiens
ccatcaacaaaaattgt

SEQ ID NO: 4720543 - DNA, 18 bp, Homo sapiens
ccatcaacaaaaattgtc

SEQ ID NO: 4720544 - DNA, 13 bp, Homo sapiens
ccatcaagccacc

SEQ ID NO: 4720545 - DNA, 18 bp, Homo sapiens
ccatcagaaacaccctca

SEQ ID NO: 4720546 - DNA, 17 bp, Homo sapiens
ccatcagtgccagcccc

SEQ ID NO: 4720547 - DNA, 20 bp, Homo sapiens
ccatcagtgccagcccctgc

SEQ ID NO: 4720548 - DNA, 16 bp, Homo sapiens
ccatcagttagagctg

SEQ ID NO: 4720549 - DNA, 16 bp, Homo sapiens
ccatcatcatgtgtgt

SEQ ID NO: 4720550 - DNA, 16 bp, Homo sapiens
ccatcatgtctggcta

SEQ ID NO: 4720551 - DNA, 18 bp, Homo sapiens
ccatccaggttcagcttg

SEQ ID NO: 4720552 - DNA, 19 bp, Homo sapiens
ccatccaggttcagcttgt

SEQ ID NO: 4720553 - DNA, 13 bp, Homo sapiens
ccatcccagcccc

SEQ ID NO: 4720554 - DNA, 14 bp, Homo sapiens
ccatcccagcccca

SEQ ID NO: 4720555 - DNA, 19 bp, Homo sapiens
ccatcccccctcaccaggg

SEQ ID NO: 4720556 - DNA, 21 bp, Homo sapiens
ccatcccccctcaccaggggc

SEQ ID NO: 4720557 - DNA, 18 bp, Homo sapiens
ccatcccggcctgtaaca

SEQ ID NO: 4720558 - DNA, 14 bp, Homo sapiens
ccatcccgtttaga

SEQ ID NO: 4720559 - DNA, 17 bp, Homo sapiens
ccatccctgaaggcccc

SEQ ID NO: 4720560 - DNA, 12 bp, Homo sapiens
ccatcctctgta

SEQ ID NO: 4720561 - DNA, 19 bp, Homo sapiens
ccatcctctgtacagagcc

SEQ ID NO: 4720562 - DNA, 17 bp, Homo sapiens
ccatcctggcccatcag

SEQ ID NO: 4720563 - DNA, 14 bp, Homo sapiens
ccatcctgtcccac

SEQ ID NO: 4720564 - DNA, 14 bp, Homo sapiens
ccatctaaactgcc

SEQ ID NO: 4720565 - DNA, 15 bp, Homo sapiens
ccatctaaactgccc

SEQ ID NO: 4720566 - DNA, 17 bp, Homo sapiens
ccatctcacacatgagc

SEQ ID NO: 4720567 - DNA, 21 bp, Homo sapiens
ccatctcacacatgagcatca

SEQ ID NO: 4720568 - DNA, 15 bp, Homo sapiens
ccatctctggatgcc

SEQ ID NO: 4720569 - DNA, 15 bp, Homo sapiens
ccatctgcccaggac

SEQ ID NO: 4720570 - DNA, 22 bp, Homo sapiens
ccatctgggctcctaaccttcc

SEQ ID NO: 4720571 - DNA, 22 bp, Homo sapiens
ccatctgtgccatacttgttct

SEQ ID NO: 4720572 - DNA, 17 bp, Homo sapiens
ccatctttgtatattta

SEQ ID NO: 4720573 - DNA, 22 bp, Homo sapiens
ccatgaaaatgcaacaacatgt

SEQ ID NO: 4720574 - DNA, 15 bp, Homo sapiens
ccatgacccaggctg

SEQ ID NO: 4720575 - DNA, 13 bp, Homo sapiens
ccatgagcctcag

SEQ ID NO: 4720576 - DNA, 23 bp, Homo sapiens
ccatgagcctcagcatcctggca

SEQ ID NO: 4720577 - DNA, 15 bp, Homo sapiens
ccatgagtcccctgt

SEQ ID NO: 4720578 - DNA, 13 bp, Homo sapiens
ccatgctgagagc

SEQ ID NO: 4720579 - DNA, 17 bp, Homo sapiens
ccatgctgagagctggg

SEQ ID NO: 4720580 - DNA, 11 bp, Homo sapiens
ccatgctgccc

SEQ ID NO: 4720581 - DNA, 13 bp, Homo sapiens
ccatgctgccctg

SEQ ID NO: 4720582 - DNA, 15 bp, Homo sapiens
ccatgctgccctgtg

SEQ ID NO: 4720583 - DNA, 15 bp, Homo sapiens
ccatggagagctgga

SEQ ID NO: 4720584 - DNA, 18 bp, Homo sapiens
ccatggagagctggagcc

SEQ ID NO: 4720585 - DNA, 22 bp, Homo sapiens
ccatggagagctggagcctggt

SEQ ID NO: 4720586 - DNA, 16 bp, Homo sapiens
ccatggaggagacagg

SEQ ID NO: 4720587 - DNA, 19 bp, Homo sapiens
ccatggagtgagacccagg

SEQ ID NO: 4720588 - DNA, 14 bp, Homo sapiens
ccatgggcactgct

SEQ ID NO: 4720589 - DNA, 15 bp, Homo sapiens
ccatgggcactgctg

SEQ ID NO: 4720590 - DNA, 20 bp, Homo sapiens
ccatgggcactgctgggtgg

SEQ ID NO: 4720591 - DNA, 17 bp, Homo sapiens
ccatgggcagagcccaa

SEQ ID NO: 4720592 - DNA, 13 bp, Homo sapiens
ccatgggcctcct

SEQ ID NO: 4720593 - DNA, 17 bp, Homo sapiens
ccatgggcctcctgtgt

SEQ ID NO: 4720594 - DNA, 19 bp, Homo sapiens
ccatgggggctcagccagg

SEQ ID NO: 4720595 - DNA, 19 bp, Homo sapiens
ccatggtgtgatcgtctga

SEQ ID NO: 4720596 - DNA, 15 bp, Homo sapiens
ccatgtagaaaattt

SEQ ID NO: 4720597 - DNA, 16 bp, Homo sapiens
ccatgtagaaaatttg

SEQ ID NO: 4720598 - DNA, 14 bp, Homo sapiens
ccatgtagaagctg

SEQ ID NO: 4720599 - DNA, 15 bp, Homo sapiens
ccatgtagaagctgc

SEQ ID NO: 4720600 - DNA, 18 bp, Homo sapiens
ccatgtagaagctgcatc

SEQ ID NO: 4720601 - DNA, 14 bp, Homo sapiens
ccatgttggccagg

SEQ ID NO: 4720602 - DNA, 17 bp, Homo sapiens
ccatgttggccaggctg

SEQ ID NO: 4720603 - DNA, 19 bp, Homo sapiens
ccatgttggccaggctggt

SEQ ID NO: 4720604 - DNA, 15 bp, Homo sapiens
ccattagcataattt

SEQ ID NO: 4720605 - DNA, 13 bp, Homo sapiens
ccattcattccat

SEQ ID NO: 4720606 - DNA, 16 bp, Homo sapiens
ccattccttcccagag

SEQ ID NO: 4720607 - DNA, 14 bp, Homo sapiens
ccattctccacctg

SEQ ID NO: 4720608 - DNA, 17 bp, Homo sapiens
ccattctccacctgcca

SEQ ID NO: 4720609 - DNA, 12 bp, Homo sapiens
ccattctggaag

SEQ ID NO: 4720610 - DNA, 15 bp, Homo sapiens
ccattctggaagtga

SEQ ID NO: 4720611 - DNA, 21 bp, Homo sapiens
ccattggctatttaaaacttg

SEQ ID NO: 4720612 - DNA, 22 bp, Homo sapiens
ccattttggggtacccactgct

SEQ ID NO: 4720613 - DNA, 21 bp, Homo sapiens
ccattttgtattttactaata

SEQ ID NO: 4720614 - DNA, 13 bp, Homo sapiens
ccattttgtgaat

SEQ ID NO: 4720615 - DNA, 22 bp, Homo sapiens
ccattttgttattgactaacag

SEQ ID NO: 4720616 - DNA, 15 bp, Homo sapiens
cccaaagtgctggga

SEQ ID NO: 4720617 - DNA, 16 bp, Homo sapiens
cccaaagtgctgggat

SEQ ID NO: 4720618 - DNA, 21 bp, Homo sapiens
cccaaagtggtatagaaatgc

SEQ ID NO: 4720619 - DNA, 23 bp, Homo sapiens
cccaaatggaaatgggcagagca

SEQ ID NO: 4720620 - DNA, 15 bp, Homo sapiens
cccaacatggtccta

SEQ ID NO: 4720621 - DNA, 12 bp, Homo sapiens
cccaacccccag

SEQ ID NO: 4720622 - DNA, 13 bp, Homo sapiens
cccaacccccagc

SEQ ID NO: 4720623 - DNA, 20 bp, Homo sapiens
cccaactaatttttgtattt

SEQ ID NO: 4720624 - DNA, 17 bp, Homo sapiens
cccaactcaccccagcc

SEQ ID NO: 4720625 - DNA, 17 bp, Homo sapiens
cccaagggaaagaaaag

SEQ ID NO: 4720626 - DNA, 14 bp, Homo sapiens
cccaagggcctggc

SEQ ID NO: 4720627 - DNA, 16 bp, Homo sapiens
cccaagggcctggcct

SEQ ID NO: 4720628 - DNA, 12 bp, Homo sapiens
cccaatccctca

SEQ ID NO: 4720629 - DNA, 20 bp, Homo sapiens
cccaatgcactttgttctgg

SEQ ID NO: 4720630 - DNA, 23 bp, Homo sapiens
cccacagtgactcgggctcctgt

SEQ ID NO: 4720631 - DNA, 18 bp, Homo sapiens
cccacccaagggcctggc

SEQ ID NO: 4720632 - DNA, 15 bp, Homo sapiens
cccaccccagggcag

SEQ ID NO: 4720633 - DNA, 21 bp, Homo sapiens
cccacccggtggttcttcctg

SEQ ID NO: 4720634 - DNA, 20 bp, Homo sapiens
cccaccgcagacaggaccag

SEQ ID NO: 4720635 - DNA, 17 bp, Homo sapiens
cccacctcagcctcccg

SEQ ID NO: 4720636 - DNA, 12 bp, Homo sapiens
cccacctggcct

SEQ ID NO: 4720637 - DNA, 17 bp, Homo sapiens
cccacctggcctctgca

SEQ ID NO: 4720638 - DNA, 19 bp, Homo sapiens
cccaccttgccaaagcact

SEQ ID NO: 4720639 - DNA, 12 bp, Homo sapiens
cccaccttggct

SEQ ID NO: 4720640 - DNA, 22 bp, Homo sapiens
cccaccttggctcaagtcctct

SEQ ID NO: 4720641 - DNA, 17 bp, Homo sapiens
cccaccttggctgcagg

SEQ ID NO: 4720642 - DNA, 13 bp, Homo sapiens
cccacgcccccac

SEQ ID NO: 4720643 - DNA, 19 bp, Homo sapiens
cccacgcccccactggtga

SEQ ID NO: 4720644 - DNA, 19 bp, Homo sapiens
cccacgctggagtgcagtg

SEQ ID NO: 4720645 - DNA, 20 bp, Homo sapiens
cccacgctggagtgcagtga

SEQ ID NO: 4720646 - DNA, 15 bp, Homo sapiens
ccctccctgctgtcc

SEQ ID NO: 4720647 - DNA, 19 bp, Homo sapiens
ccctccctgctgtcccctc

SEQ ID NO: 4720648 - DNA, 14 bp, Homo sapiens
ccctccctgcttca

SEQ ID NO: 4720649 - DNA, 18 bp, Homo sapiens
ccctcctacccctcccag

SEQ ID NO: 4720650 - DNA, 20 bp, Homo sapiens
ccctcctacccctcccagct

SEQ ID NO: 4720651 - DNA, 21 bp, Homo sapiens
ccctcctacccctcccagctg

SEQ ID NO: 4720652 - DNA, 13 bp, Homo sapiens
ccctcctccactc

SEQ ID NO: 4720653 - DNA, 12 bp, Homo sapiens
ccctcctgctgc

SEQ ID NO: 4720654 - DNA, 14 bp, Homo sapiens
ccctcctggccaga

SEQ ID NO: 4720655 - DNA, 15 bp, Homo sapiens
ccctctacagagctt

SEQ ID NO: 4720656 - DNA, 12 bp, Homo sapiens
ccctctcagagc

SEQ ID NO: 4720657 - DNA, 18 bp, Homo sapiens
ccctctcccctgccccct

SEQ ID NO: 4720658 - DNA, 13 bp, Homo sapiens
ccctctcctccgt

SEQ ID NO: 4720659 - DNA, 20 bp, Homo sapiens
ccctctcctccgtggcacat

SEQ ID NO: 4720660 - DNA, 14 bp, Homo sapiens
ccctctctgctctg

SEQ ID NO: 4720661 - DNA, 15 bp, Homo sapiens
ccctctctgctctgc

SEQ ID NO: 4720662 - DNA, 15 bp, Homo sapiens
ccctctgcccactcc

SEQ ID NO: 4720663 - DNA, 19 bp, Homo sapiens
ccctctgcccactccctgc

SEQ ID NO: 4720664 - DNA, 12 bp, Homo sapiens
ccctctggctcc

SEQ ID NO: 4720665 - DNA, 16 bp, Homo sapiens
ccctctggctccagct

SEQ ID NO: 4720666 - DNA, 13 bp, Homo sapiens
ccctctgtcctga

SEQ ID NO: 4720667 - DNA, 15 bp, Homo sapiens
ccctctgtcctgact

SEQ ID NO: 4720668 - DNA, 12 bp, Homo sapiens
ccctctgtgaaa

SEQ ID NO: 4720669 - DNA, 20 bp, Homo sapiens
ccctctgttctgcacacagc

SEQ ID NO: 4720670 - DNA, 21 bp, Homo sapiens
ccctctgttctgcacacagca

SEQ ID NO: 4720671 - DNA, 13 bp, Homo sapiens
ccctcttgcccca

SEQ ID NO: 4720672 - DNA, 18 bp, Homo sapiens
ccctcttgccccaacccc

SEQ ID NO: 4720673 - DNA, 12 bp, Homo sapiens
ccctgaaggccc

SEQ ID NO: 4720674 - DNA, 16 bp, Homo sapiens
ccctgaaggccccgcc

SEQ ID NO: 4720675 - DNA, 22 bp, Homo sapiens
ccctgaaggccccgcccaggct

SEQ ID NO: 4720676 - DNA, 22 bp, Homo sapiens
ccctgacaacactcattgacct

SEQ ID NO: 4720677 - DNA, 19 bp, Homo sapiens
ccctgactcattctgaagg

SEQ ID NO: 4720678 - DNA, 21 bp, Homo sapiens
ccctgactcattctgaaggag

SEQ ID NO: 4720679 - DNA, 13 bp, Homo sapiens
ccctgactgggag

SEQ ID NO: 4720680 - DNA, 21 bp, Homo sapiens
ccctgagcagaatactggtct

SEQ ID NO: 4720681 - DNA, 14 bp, Homo sapiens
ccctgagctgaggc

SEQ ID NO: 4720682 - DNA, 12 bp, Homo sapiens
ccctgaggccca

SEQ ID NO: 4720683 - DNA, 13 bp, Homo sapiens
ccctgaggcccag

SEQ ID NO: 4720684 - DNA, 23 bp, Homo sapiens
ccctgaggcccagagggcctgca

SEQ ID NO: 4720685 - DNA, 20 bp, Homo sapiens
ccctgcaaaaggactctcag

SEQ ID NO: 4720686 - DNA, 15 bp, Homo sapiens
ccctgcactgtcctg

SEQ ID NO: 4720687 - DNA, 18 bp, Homo sapiens
ccctgcactgtcctgctc

SEQ ID NO: 4720688 - DNA, 12 bp, Homo sapiens
ccctgcacttgc

SEQ ID NO: 4720689 - DNA, 17 bp, Homo sapiens
ccctgcaggaaggagct

SEQ ID NO: 4720690 - DNA, 21 bp, Homo sapiens
ccctgcaggaaggagctgcct

SEQ ID NO: 4720691 - DNA, 21 bp, Homo sapiens
ccctgcattggaactggaggc

SEQ ID NO: 4720692 - DNA, 22 bp, Homo sapiens
ccctgcattggaactggaggca

SEQ ID NO: 4720693 - DNA, 17 bp, Homo sapiens
ccctgccacctcctgcc

SEQ ID NO: 4720694 - DNA, 13 bp, Homo sapiens
ccctgcccacctg

SEQ ID NO: 4720695 - DNA, 22 bp, Homo sapiens
ccctgcccacctggcctctgca

SEQ ID NO: 4720696 - DNA, 16 bp, Homo sapiens
ccctgccccagcaaga

SEQ ID NO: 4720697 - DNA, 20 bp, Homo sapiens
ccctgcccccaggactgggc

SEQ ID NO: 4720698 - DNA, 22 bp, Homo sapiens
ccctgcccccaggactgggcca

SEQ ID NO: 4720699 - DNA, 14 bp, Homo sapiens
ccctgccccctgca

SEQ ID NO: 4720700 - DNA, 17 bp, Homo sapiens
ccctgccccctgcagga

SEQ ID NO: 4720701 - DNA, 19 bp, Homo sapiens
ccctgccccctgcaggaag

SEQ ID NO: 4720702 - DNA, 22 bp, Homo sapiens
ccctgccccgcaggcctgcctt

SEQ ID NO: 4720703 - DNA, 11 bp, Homo sapiens
ccctgccctgg

SEQ ID NO: 4720704 - DNA, 23 bp, Homo sapiens
ccctgccctggtttcctgccctg

SEQ ID NO: 4720705 - DNA, 16 bp, Homo sapiens
ccctgccctgtgggcc

SEQ ID NO: 4720706 - DNA, 21 bp, Homo sapiens
ccctgccctgtgggcccccaa

SEQ ID NO: 4720707 - DNA, 11 bp, Homo sapiens
ccctgcctcct

SEQ ID NO: 4720708 - DNA, 19 bp, Homo sapiens
ccctgcgggtcacaggagg

SEQ ID NO: 4720709 - DNA, 21 bp, Homo sapiens
ccctgcgggtcacaggaggga

SEQ ID NO: 4720710 - DNA, 18 bp, Homo sapiens
ccctgctgcccctccctg

SEQ ID NO: 4720711 - DNA, 19 bp, Homo sapiens
ccctgctgcccctccctgc

SEQ ID NO: 4720712 - DNA, 16 bp, Homo sapiens
ccctgctgggtgtggc

SEQ ID NO: 4720713 - DNA, 13 bp, Homo sapiens
ccctgctgtcccc

SEQ ID NO: 4720714 - DNA, 16 bp, Homo sapiens
ccctgctgtcccctct

SEQ ID NO: 4720715 - DNA, 23 bp, Homo sapiens
ccctgctgtcccctcttgcccca

SEQ ID NO: 4720716 - DNA, 21 bp, Homo sapiens
ccctggaaggacatccatgtt

SEQ ID NO: 4720717 - DNA, 13 bp, Homo sapiens
ccctggatgcagc

SEQ ID NO: 4720718 - DNA, 20 bp, Homo sapiens
ccctggccctcaaggcctcc

SEQ ID NO: 4720719 - DNA, 14 bp, Homo sapiens
ccctgggctctgtg

SEQ ID NO: 4720720 - DNA, 20 bp, Homo sapiens
ccctggggacagcaagggct

SEQ ID NO: 4720721 - DNA, 16 bp, Homo sapiens
ccctgggggcggccag

SEQ ID NO: 4720722 - DNA, 21 bp, Homo sapiens
ccctggtggcagctcacctct

SEQ ID NO: 4720723 - DNA, 15 bp, Homo sapiens
ccctggtggcagtgg

SEQ ID NO: 4720724 - DNA, 16 bp, Homo sapiens
ccctggttctcatctt

SEQ ID NO: 4720725 - DNA, 23 bp, Homo sapiens
ccctggttctgatgatgtgcctg

SEQ ID NO: 4720726 - DNA, 16 bp, Homo sapiens
ccctggtttcctgccc

SEQ ID NO: 4720727 - DNA, 18 bp, Homo sapiens
ccctggtttcctgccctg

SEQ ID NO: 4720728 - DNA, 22 bp, Homo sapiens
ccctggtttcctgccctgggag

SEQ ID NO: 4720729 - DNA, 21 bp, Homo sapiens
ccctgtgagtactacagtcct

SEQ ID NO: 4720730 - DNA, 23 bp, Homo sapiens
ccctgtgagtactacagtcctcc

SEQ ID NO: 4720731 - DNA, 18 bp, Homo sapiens
ccctgtgatggggccctg

SEQ ID NO: 4720732 - DNA, 18 bp, Homo sapiens
ccctgtgggcccccaaat

SEQ ID NO: 4720733 - DNA, 14 bp, Homo sapiens
cccttagcccccac

SEQ ID NO: 4720734 - DNA, 19 bp, Homo sapiens
cccttagcccccacccact

SEQ ID NO: 4720735 - DNA, 14 bp, Homo sapiens
cccttatccctgct

SEQ ID NO: 4720736 - DNA, 16 bp, Homo sapiens
cccttccactgagggc

SEQ ID NO: 4720737 - DNA, 12 bp, Homo sapiens
cccttccatgga

SEQ ID NO: 4720738 - DNA, 18 bp, Homo sapiens
cccttcgctcctgtgtct

SEQ ID NO: 4720739 - DNA, 21 bp, Homo sapiens
cccttctgacccatgctgccc

SEQ ID NO: 4720740 - DNA, 22 bp, Homo sapiens
cccttctgacccatgctgccct

SEQ ID NO: 4720741 - DNA, 15 bp, Homo sapiens
cccttgcccccctgg

SEQ ID NO: 4720742 - DNA, 16 bp, Homo sapiens
cccttgccctttccat

SEQ ID NO: 4720743 - DNA, 17 bp, Homo sapiens
cccttgctccagcctga

SEQ ID NO: 4720744 - DNA, 17 bp, Homo sapiens
cccttggattgtccccg

SEQ ID NO: 4720745 - DNA, 22 bp, Homo sapiens
cccttgggggtcctcctccagg

SEQ ID NO: 4720746 - DNA, 14 bp, Homo sapiens
cccttgtggtccca

SEQ ID NO: 4720747 - DNA, 18 bp, Homo sapiens
cccttgtggtcccacccc

SEQ ID NO: 4720748 - DNA, 20 bp, Homo sapiens
cccttgtggtcccaccccac

SEQ ID NO: 4720749 - DNA, 14 bp, Homo sapiens
ccctttctcccctg

SEQ ID NO: 4720750 - DNA, 20 bp, Homo sapiens
ccctttgacgccatcccagc

SEQ ID NO: 4720751 - DNA, 12 bp, Homo sapiens
ccctttgagtgc

SEQ ID NO: 4720752 - DNA, 14 bp, Homo sapiens
ccctttgagtgcag

SEQ ID NO: 4720753 - DNA, 16 bp, Homo sapiens
cccttttcagcttctg

SEQ ID NO: 4720754 - DNA, 17 bp, Homo sapiens
cccttttttggctgctg

SEQ ID NO: 4720755 - DNA, 18 bp, Homo sapiens
cccttttttggctgctga

SEQ ID NO: 4720756 - DNA, 11 bp, Homo sapiens
cctgctgcagt

SEQ ID NO: 4720757 - DNA, 12 bp, Homo sapiens
cctgctgcagtt

SEQ ID NO: 4720758 - DNA, 21 bp, Homo sapiens
cctgctgcagttgccagtcac

SEQ ID NO: 4720759 - DNA, 14 bp, Homo sapiens
cctgctgcccctcc

SEQ ID NO: 4720760 - DNA, 20 bp, Homo sapiens
cctgctgcccctccctgcct

SEQ ID NO: 4720761 - DNA, 12 bp, Homo sapiens
cctgctggctgg

SEQ ID NO: 4720762 - DNA, 16 bp, Homo sapiens
cctgctggctggtgcc

SEQ ID NO: 4720763 - DNA, 14 bp, Homo sapiens
cctgctgggtgtgg

SEQ ID NO: 4720764 - DNA, 13 bp, Homo sapiens
cctgctggttcag

SEQ ID NO: 4720765 - DNA, 12 bp, Homo sapiens
cctgctgtcccc

SEQ ID NO: 4720766 - DNA, 22 bp, Homo sapiens
cctggaacatcatcaaggcact

SEQ ID NO: 4720767 - DNA, 23 bp, Homo sapiens
cctggacatgaagattctttccc

SEQ ID NO: 4720768 - DNA, 24 bp, Homo sapiens
cctggacatgaagattctttccca

SEQ ID NO: 4720769 - DNA, 23 bp, Homo sapiens
cctggacccgttcatgggggagg

SEQ ID NO: 4720770 - DNA, 14 bp, Homo sapiens
cctggagagctaga

SEQ ID NO: 4720771 - DNA, 12 bp, Homo sapiens
cctggagggcta

SEQ ID NO: 4720772 - DNA, 20 bp, Homo sapiens
cctggagggctagaacctag

SEQ ID NO: 4720773 - DNA, 21 bp, Homo sapiens
cctggagggctagaacctaga

SEQ ID NO: 4720774 - DNA, 23 bp, Homo sapiens
cctggagggctagaacctggaga

SEQ ID NO: 4720775 - DNA, 21 bp, Homo sapiens
cctggaggggctagaacctag

SEQ ID NO: 4720776 - DNA, 17 bp, Homo sapiens
cctggatgcagcctcac

SEQ ID NO: 4720777 - DNA, 18 bp, Homo sapiens
cctggatggggctgcacc

SEQ ID NO: 4720778 - DNA, 21 bp, Homo sapiens
cctggcaagctagaacctgga

SEQ ID NO: 4720779 - DNA, 22 bp, Homo sapiens
cctggcaagctagaacctggag

SEQ ID NO: 4720780 - DNA, 15 bp, Homo sapiens
cctggcacagtgtct

SEQ ID NO: 4720781 - DNA, 22 bp, Homo sapiens
cctggcacagtgtctgggctga

SEQ ID NO: 4720782 - DNA, 20 bp, Homo sapiens
cctggcacccggcccctgct

SEQ ID NO: 4720783 - DNA, 16 bp, Homo sapiens
cctggcactgcttcca

SEQ ID NO: 4720784 - DNA, 17 bp, Homo sapiens
cctggcactgcttccag

SEQ ID NO: 4720785 - DNA, 19 bp, Homo sapiens
cctggcaggttagaaccta

SEQ ID NO: 4720786 - DNA, 14 bp, Homo sapiens
cctggccaacatgg

SEQ ID NO: 4720787 - DNA, 15 bp, Homo sapiens
cctggccaccacccc

SEQ ID NO: 4720788 - DNA, 13 bp, Homo sapiens
cctggccacgccc

SEQ ID NO: 4720789 - DNA, 15 bp, Homo sapiens
cctggccagatgcac

SEQ ID NO: 4720790 - DNA, 18 bp, Homo sapiens
cctggccagatgtcgctg

SEQ ID NO: 4720791 - DNA, 14 bp, Homo sapiens
cctggccagggcct

SEQ ID NO: 4720792 - DNA, 15 bp, Homo sapiens
cctggccagggcctg

SEQ ID NO: 4720793 - DNA, 23 bp, Homo sapiens
cctggccagggcctggaagacag

SEQ ID NO: 4720794 - DNA, 21 bp, Homo sapiens
cctggcccaccccacccactt

SEQ ID NO: 4720795 - DNA, 22 bp, Homo sapiens
cctggcccaccccacccacttc

SEQ ID NO: 4720796 - DNA, 13 bp, Homo sapiens
cctggcccagctc

SEQ ID NO: 4720797 - DNA, 20 bp, Homo sapiens
cctggcccagctcccccggg

SEQ ID NO: 4720798 - DNA, 20 bp, Homo sapiens
cctggcccctcagggtccct

SEQ ID NO: 4720799 - DNA, 13 bp, Homo sapiens
cctggccctcaag

SEQ ID NO: 4720800 - DNA, 12 bp, Homo sapiens
cctggcctctgc

SEQ ID NO: 4720801 - DNA, 13 bp, Homo sapiens
cctggcctgagct

SEQ ID NO: 4720802 - DNA, 22 bp, Homo sapiens
cctggctccaaaccctcgaggc

SEQ ID NO: 4720803 - DNA, 13 bp, Homo sapiens
cctggctgaagga

SEQ ID NO: 4720804 - DNA, 17 bp, Homo sapiens
cctgggaaatattccct

SEQ ID NO: 4720805 - DNA, 11 bp, Homo sapiens
cctgggagaga

SEQ ID NO: 4720806 - DNA, 23 bp, Homo sapiens
cctgggagagacttggatgagga

SEQ ID NO: 4720807 - DNA, 18 bp, Homo sapiens
cctgggagccagggtgag

SEQ ID NO: 4720808 - DNA, 19 bp, Homo sapiens
cctgggctctgtgggctgc

SEQ ID NO: 4720809 - DNA, 15 bp, Homo sapiens
cctggggctgctggc

SEQ ID NO: 4720810 - DNA, 14 bp, Homo sapiens
cctgggggctcctc

SEQ ID NO: 4720811 - DNA, 15 bp, Homo sapiens
cctgggggtgccagg

SEQ ID NO: 4720812 - DNA, 20 bp, Homo sapiens
cctgggtaaatgcagcgtga

SEQ ID NO: 4720813 - DNA, 22 bp, Homo sapiens
cctgggtaaatgcagcgtgaag

SEQ ID NO: 4720814 - DNA, 20 bp, Homo sapiens
cctgggttttgtattctctg

SEQ ID NO: 4720815 - DNA, 21 bp, Homo sapiens
cctgggttttgtattctctga

SEQ ID NO: 4720816 - DNA, 20 bp, Homo sapiens
cctggtacaaacgtatggaa

SEQ ID NO: 4720817 - DNA, 20 bp, Homo sapiens
cctggtgctgcctctacctg

SEQ ID NO: 4720818 - DNA, 14 bp, Homo sapiens
cctggtggcagctg

SEQ ID NO: 4720819 - DNA, 16 bp, Homo sapiens
cctggtggcagctgcg

SEQ ID NO: 4720820 - DNA, 18 bp, Homo sapiens
cctggtggcagctgcggt

SEQ ID NO: 4720821 - DNA, 13 bp, Homo sapiens
cctggtggcagtg

SEQ ID NO: 4720822 - DNA, 15 bp, Homo sapiens
cctggtggcagtggg

SEQ ID NO: 4720823 - DNA, 18 bp, Homo sapiens
cctggtggccctctcccc

SEQ ID NO: 4720824 - DNA, 22 bp, Homo sapiens
cctggtggccctctcccctgcc

SEQ ID NO: 4720825 - DNA, 16 bp, Homo sapiens
cctggttctcatcttt

SEQ ID NO: 4720826 - DNA, 15 bp, Homo sapiens
cctggttctgatgat

SEQ ID NO: 4720827 - DNA, 13 bp, Homo sapiens
cctggtttcctgc

SEQ ID NO: 4720828 - DNA, 14 bp, Homo sapiens
cctggtttcctgcc

SEQ ID NO: 4720829 - DNA, 22 bp, Homo sapiens
cctggtttcctgccctgggagg

SEQ ID NO: 4720830 - DNA, 21 bp, Homo sapiens
cctgtaacctcttcagaggcc

SEQ ID NO: 4720831 - DNA, 20 bp, Homo sapiens
cctgtaatcccagcacttgg

SEQ ID NO: 4720832 - DNA, 18 bp, Homo sapiens
cctgtaccaaatctgaca

SEQ ID NO: 4720833 - DNA, 12 bp, Homo sapiens
cctgtcagtgcc

SEQ ID NO: 4720834 - DNA, 15 bp, Homo sapiens
cctgtcagtgccgcc

SEQ ID NO: 4720835 - DNA, 14 bp, Homo sapiens
cctgtccccctgac

SEQ ID NO: 4720836 - DNA, 17 bp, Homo sapiens
cctgtgatggggccctg

SEQ ID NO: 4720837 - DNA, 18 bp, Homo sapiens
cctgtgatggggccctgc

SEQ ID NO: 4720838 - DNA, 19 bp, Homo sapiens
cctgtggcgctgcagcagg

SEQ ID NO: 4720839 - DNA, 20 bp, Homo sapiens
cctgtgggggaagagcacag

SEQ ID NO: 4720840 - DNA, 22 bp, Homo sapiens
cctgtgggggaagagcacagcc

SEQ ID NO: 4720841 - DNA, 12 bp, Homo sapiens
cctgtgtccccc

SEQ ID NO: 4720842 - DNA, 17 bp, Homo sapiens
cctgtgtgcgagtctga

SEQ ID NO: 4720843 - DNA, 18 bp, Homo sapiens
cctgtgtgcgagtctgag

SEQ ID NO: 4720844 - DNA, 15 bp, Homo sapiens
cctgttagccaggtg

SEQ ID NO: 4720845 - DNA, 15 bp, Homo sapiens
cctgttcagctccag

SEQ ID NO: 4720846 - DNA, 16 bp, Homo sapiens
cctgttcagctccagc

SEQ ID NO: 4720847 - DNA, 19 bp, Homo sapiens
cctgttcagctccagctca

SEQ ID NO: 4720848 - DNA, 20 bp, Homo sapiens
cctgttcagctccagctcac

SEQ ID NO: 4720849 - DNA, 21 bp, Homo sapiens
cctgttcagctccagctcacc

SEQ ID NO: 4720850 - DNA, 23 bp, Homo sapiens
cctgttcagctccagctcaccag

SEQ ID NO: 4720851 - DNA, 16 bp, Homo sapiens
cctgttctgctttcct

SEQ ID NO: 4720852 - DNA, 14 bp, Homo sapiens
cctgtttgtttctg

SEQ ID NO: 4720853 - DNA, 13 bp, Homo sapiens
ccttacacttact

SEQ ID NO: 4720854 - DNA, 17 bp, Homo sapiens
ccttacagtaggagccc

SEQ ID NO: 4720855 - DNA, 12 bp, Homo sapiens
ccttactttccc

SEQ ID NO: 4720856 - DNA, 14 bp, Homo sapiens
ccttagacagtccc

SEQ ID NO: 4720857 - DNA, 15 bp, Homo sapiens
ccttagcccccaccc

SEQ ID NO: 4720858 - DNA, 21 bp, Homo sapiens
ccttagcccccacccacttcc

SEQ ID NO: 4720859 - DNA, 16 bp, Homo sapiens
ccttattagagtgtct

SEQ ID NO: 4720860 - DNA, 17 bp, Homo sapiens
ccttattggatatttga

SEQ ID NO: 4720861 - DNA, 22 bp, Homo sapiens
ccttcaagaccttcaccaaaca

SEQ ID NO: 4720862 - DNA, 14 bp, Homo sapiens
ccttcagccctcac

SEQ ID NO: 4720863 - DNA, 16 bp, Homo sapiens
ccttccaggggtggga

SEQ ID NO: 4720864 - DNA, 21 bp, Homo sapiens
ccttcctggagcccagaggag

SEQ ID NO: 4720865 - DNA, 17 bp, Homo sapiens
ccttcctttctatatcc

SEQ ID NO: 4720866 - DNA, 21 bp, Homo sapiens
ctagaatatcctacttctcca

SEQ ID NO: 4720867 - DNA, 20 bp, Homo sapiens
ctagaatggtttttgttgag

SEQ ID NO: 4720868 - DNA, 18 bp, Homo sapiens
ctagactcccaagctgga

SEQ ID NO: 4720869 - DNA, 17 bp, Homo sapiens
ctagagcagccctggag

SEQ ID NO: 4720870 - DNA, 18 bp, Homo sapiens
ctagcacggacatggtct

SEQ ID NO: 4720871 - DNA, 23 bp, Homo sapiens
ctagcactgcacactcagttctg

SEQ ID NO: 4720872 - DNA, 13 bp, Homo sapiens
ctagctatttcta

SEQ ID NO: 4720873 - DNA, 16 bp, Homo sapiens
ctagctcccctcctct

SEQ ID NO: 4720874 - DNA, 19 bp, Homo sapiens
ctagcttagagcctccctc

SEQ ID NO: 4720875 - DNA, 22 bp, Homo sapiens
ctagcttagagcctccctcaat

SEQ ID NO: 4720876 - DNA, 20 bp, Homo sapiens
ctaggaacactccttcacag

SEQ ID NO: 4720877 - DNA, 18 bp, Homo sapiens
ctaggacgccacccagca

SEQ ID NO: 4720878 - DNA, 22 bp, Homo sapiens
ctaggacgccacccagcaaaag

SEQ ID NO: 4720879 - DNA, 15 bp, Homo sapiens
ctaggatgtcgtctt

SEQ ID NO: 4720880 - DNA, 22 bp, Homo sapiens
ctaggcaggacatgctgaagcc

SEQ ID NO: 4720881 - DNA, 15 bp, Homo sapiens
ctaggcaggacctgt

SEQ ID NO: 4720882 - DNA, 14 bp, Homo sapiens
ctaggcctggccag

SEQ ID NO: 4720883 - DNA, 18 bp, Homo sapiens
ctaggcctggccagatgc

SEQ ID NO: 4720884 - DNA, 22 bp, Homo sapiens
ctaggctggggaagtcctctgg

SEQ ID NO: 4720885 - DNA, 15 bp, Homo sapiens
ctagggacccctcct

SEQ ID NO: 4720886 - DNA, 18 bp, Homo sapiens
ctagggccaagcccagca

SEQ ID NO: 4720887 - DNA, 14 bp, Homo sapiens
ctaggtacgatgac

SEQ ID NO: 4720888 - DNA, 18 bp, Homo sapiens
ctaggtgacagagtgaga

SEQ ID NO: 4720889 - DNA, 14 bp, Homo sapiens
ctagtagaactgga

SEQ ID NO: 4720890 - DNA, 12 bp, Homo sapiens
ctagtccttgtt

SEQ ID NO: 4720891 - DNA, 17 bp, Homo sapiens
ctagtctgtaactcttt

SEQ ID NO: 4720892 - DNA, 20 bp, Homo sapiens
ctagtcttcccttacctcaa

SEQ ID NO: 4720893 - DNA, 21 bp, Homo sapiens
ctagtgaaggcttctctctgt

SEQ ID NO: 4720894 - DNA, 19 bp, Homo sapiens
ctagtgctgtaatattgta

SEQ ID NO: 4720895 - DNA, 22 bp, Homo sapiens
ctagtggctgtccagtgcccat

SEQ ID NO: 4720896 - DNA, 14 bp, Homo sapiens
ctagtggtctttgt

SEQ ID NO: 4720897 - DNA, 15 bp, Homo sapiens
ctagtggtctttgta

SEQ ID NO: 4720898 - DNA, 22 bp, Homo sapiens
ctagtgtggtgtttcctggcac

SEQ ID NO: 4720899 - DNA, 23 bp, Homo sapiens
ctagttcagatacagggtgctcc

SEQ ID NO: 4720900 - DNA, 18 bp, Homo sapiens
ctagttccaccatcaagc

SEQ ID NO: 4720901 - DNA, 19 bp, Homo sapiens
ctatacgcagcgtgcttta

SEQ ID NO: 4720902 - DNA, 19 bp, Homo sapiens
ctatagcctaggtgacaga

SEQ ID NO: 4720903 - DNA, 21 bp, Homo sapiens
ctatagcctaggtgacagagt

SEQ ID NO: 4720904 - DNA, 13 bp, Homo sapiens
ctatattgtacac

SEQ ID NO: 4720905 - DNA, 15 bp, Homo sapiens
ctatcaaaagaaata

SEQ ID NO: 4720906 - DNA, 18 bp, Homo sapiens
ctatcaaaagaaatagaa

SEQ ID NO: 4720907 - DNA, 17 bp, Homo sapiens
ctatcagtgtgcccccc

SEQ ID NO: 4720908 - DNA, 18 bp, Homo sapiens
ctatcagtgtgcccccca

SEQ ID NO: 4720909 - DNA, 17 bp, Homo sapiens
ctatcccggctgccctt

SEQ ID NO: 4720910 - DNA, 19 bp, Homo sapiens
ctatcctggctctttggag

SEQ ID NO: 4720911 - DNA, 20 bp, Homo sapiens
ctatctagcagtaaaagata

SEQ ID NO: 4720912 - DNA, 13 bp, Homo sapiens
ctatctcccccag

SEQ ID NO: 4720913 - DNA, 17 bp, Homo sapiens
ctatctcccccagcccc

SEQ ID NO: 4720914 - DNA, 16 bp, Homo sapiens
ctatctgacttcatac

SEQ ID NO: 4720915 - DNA, 19 bp, Homo sapiens
ctatctttgccaccctcat

SEQ ID NO: 4720916 - DNA, 18 bp, Homo sapiens
ctatgaaggatccatctt

SEQ ID NO: 4720917 - DNA, 20 bp, Homo sapiens
ctatgcagaggtccacaaca

SEQ ID NO: 4720918 - DNA, 13 bp, Homo sapiens
ctatgcgttttta

SEQ ID NO: 4720919 - DNA, 15 bp, Homo sapiens
ctatggtgccaatgg

SEQ ID NO: 4720920 - DNA, 22 bp, Homo sapiens
ctatgtaatgcttatgtgttgc

SEQ ID NO: 4720921 - DNA, 13 bp, Homo sapiens
ctatgttaatatt

SEQ ID NO: 4720922 - DNA, 15 bp, Homo sapiens
ctatgttaatatttt

SEQ ID NO: 4720923 - DNA, 18 bp, Homo sapiens
ctatgttgcccaggcagg

SEQ ID NO: 4720924 - DNA, 19 bp, Homo sapiens
ctatgttgcccaggcaggt

SEQ ID NO: 4720925 - DNA, 21 bp, Homo sapiens
ctatgttgcccaggcaggtct

SEQ ID NO: 4720926 - DNA, 22 bp, Homo sapiens
ctatgttgcccaggcaggtctt

SEQ ID NO: 4720927 - DNA, 22 bp, Homo sapiens
ctatgtttttgttcaaagccag

SEQ ID NO: 4720928 - DNA, 12 bp, Homo sapiens
ctattaaaagac

SEQ ID NO: 4720929 - DNA, 20 bp, Homo sapiens
ctattaaaagactcatccgt

SEQ ID NO: 4720930 - DNA, 19 bp, Homo sapiens
ctattaccaccacctgctc

SEQ ID NO: 4720931 - DNA, 16 bp, Homo sapiens
ctattagccaggatca

SEQ ID NO: 4720932 - DNA, 12 bp, Homo sapiens
ctattcatgttt

SEQ ID NO: 4720933 - DNA, 12 bp, Homo sapiens
ctattgcccagg

SEQ ID NO: 4720934 - DNA, 19 bp, Homo sapiens
ctattgtcaccagggctgg

SEQ ID NO: 4720935 - DNA, 13 bp, Homo sapiens
ctatttaaactat

SEQ ID NO: 4720936 - DNA, 16 bp, Homo sapiens
ctatttcctttgcgca

SEQ ID NO: 4720937 - DNA, 22 bp, Homo sapiens
ctatttcctttgcgcaaacttt

SEQ ID NO: 4720938 - DNA, 21 bp, Homo sapiens
ctatttctatgtatgtgccaa

SEQ ID NO: 4720939 - DNA, 15 bp, Homo sapiens
ctatttctttaatct

SEQ ID NO: 4720940 - DNA, 22 bp, Homo sapiens
ctatttgccatgggcttcactg

SEQ ID NO: 4720941 - DNA, 13 bp, Homo sapiens
ctattttcacaat

SEQ ID NO: 4720942 - DNA, 14 bp, Homo sapiens
ctattttcacaatt

SEQ ID NO: 4720943 - DNA, 15 bp, Homo sapiens
ctattttctaaagac

SEQ ID NO: 4720944 - DNA, 22 bp, Homo sapiens
ctattttgagttaatttttgta

SEQ ID NO: 4720945 - DNA, 14 bp, Homo sapiens
ctatttttcagaat

SEQ ID NO: 4720946 - DNA, 20 bp, Homo sapiens
ctcaaactcttgacctcagg

SEQ ID NO: 4720947 - DNA, 22 bp, Homo sapiens
ctcaaagaaatttccactcagg

SEQ ID NO: 4720948 - DNA, 15 bp, Homo sapiens
ctcaaagttttgaaa

SEQ ID NO: 4720949 - DNA, 15 bp, Homo sapiens
ctcaacctcctgggc

SEQ ID NO: 4720950 - DNA, 16 bp, Homo sapiens
ctcaagacttccagag

SEQ ID NO: 4720951 - DNA, 15 bp, Homo sapiens
ctcaagcaggtttct

SEQ ID NO: 4720952 - DNA, 19 bp, Homo sapiens
ctcaaggcctcccacagtg

SEQ ID NO: 4720953 - DNA, 22 bp, Homo sapiens
ctcaagtgggaacgactgggca

SEQ ID NO: 4720954 - DNA, 15 bp, Homo sapiens
ctcaatccatgttct

SEQ ID NO: 4720955 - DNA, 16 bp, Homo sapiens
ctcaatttctccccag

SEQ ID NO: 4720956 - DNA, 19 bp, Homo sapiens
ctcaattttgtatttaatg

SEQ ID NO: 4720957 - DNA, 22 bp, Homo sapiens
ctcacaaaacatattttacatc

SEQ ID NO: 4720958 - DNA, 14 bp, Homo sapiens
ctcacacatgagca

SEQ ID NO: 4720959 - DNA, 21 bp, Homo sapiens
ctcacacatgagcatcaggcc

SEQ ID NO: 4720960 - DNA, 22 bp, Homo sapiens
ctcacacatgagcatcaggcca

SEQ ID NO: 4720961 - DNA, 17 bp, Homo sapiens
ctcacagtccttaccag

SEQ ID NO: 4720962 - DNA, 21 bp, Homo sapiens
ctcacatctgaatctccttgt

SEQ ID NO: 4720963 - DNA, 23 bp, Homo sapiens
ctcacatggcgtcctgcccttgc

SEQ ID NO: 4720964 - DNA, 14 bp, Homo sapiens
ctcacattttctca

SEQ ID NO: 4720965 - DNA, 16 bp, Homo sapiens
ctcacattttctcagt

SEQ ID NO: 4720966 - DNA, 13 bp, Homo sapiens
ctcaccagcccca

SEQ ID NO: 4720967 - DNA, 14 bp, Homo sapiens
ctcaccagccccag

SEQ ID NO: 4720968 - DNA, 17 bp, Homo sapiens
ctcaccagccccagtgc

SEQ ID NO: 4720969 - DNA, 13 bp, Homo sapiens
ctcaccaggggca

SEQ ID NO: 4720970 - DNA, 23 bp, Homo sapiens
ctcaccaggggcaggcacagcac

SEQ ID NO: 4720971 - DNA, 14 bp, Homo sapiens
ctcaccatctgtgc

SEQ ID NO: 4720972 - DNA, 15 bp, Homo sapiens
ctcacccccttctcc

SEQ ID NO: 4720973 - DNA, 16 bp, Homo sapiens
ctcacccccttctcca

SEQ ID NO: 4720974 - DNA, 20 bp, Homo sapiens
ctcacccccttctccatcca

SEQ ID NO: 4720975 - DNA, 23 bp, Homo sapiens
ctctggttgtgggcttggaccac

SEQ ID NO: 4720976 - DNA, 17 bp, Homo sapiens
ctctgtacagagcccac

SEQ ID NO: 4720977 - DNA, 23 bp, Homo sapiens
ctctgtatatagctctacacaac

SEQ ID NO: 4720978 - DNA, 14 bp, Homo sapiens
ctctgtccccttct

SEQ ID NO: 4720979 - DNA, 15 bp, Homo sapiens
ctctgtccccttctc

SEQ ID NO: 4720980 - DNA, 17 bp, Homo sapiens
ctctgtccccttctctc

SEQ ID NO: 4720981 - DNA, 13 bp, Homo sapiens
ctctgtcctgact

SEQ ID NO: 4720982 - DNA, 22 bp, Homo sapiens
ctctgtcctgggagtgagctgg

SEQ ID NO: 4720983 - DNA, 15 bp, Homo sapiens
ctctgtctcatccat

SEQ ID NO: 4720984 - DNA, 15 bp, Homo sapiens
ctctgtgaccaatgt

SEQ ID NO: 4720985 - DNA, 18 bp, Homo sapiens
ctctgtgaccaatgtctt

SEQ ID NO: 4720986 - DNA, 19 bp, Homo sapiens
ctctgtgaccaatgtcttg

SEQ ID NO: 4720987 - DNA, 12 bp, Homo sapiens
ctctgtgcccat

SEQ ID NO: 4720988 - DNA, 16 bp, Homo sapiens
ctctgtgcccatgggc

SEQ ID NO: 4720989 - DNA, 22 bp, Homo sapiens
ctctgtgcccatgggcactgct

SEQ ID NO: 4720990 - DNA, 14 bp, Homo sapiens
ctctgtgggctgca

SEQ ID NO: 4720991 - DNA, 17 bp, Homo sapiens
ctctgtgggctgcactc

SEQ ID NO: 4720992 - DNA, 13 bp, Homo sapiens
ctctgtgtcactg

SEQ ID NO: 4720993 - DNA, 17 bp, Homo sapiens
ctctgtgtcactggctg

SEQ ID NO: 4720994 - DNA, 22 bp, Homo sapiens
ctctgtgtcaggtggggcagct

SEQ ID NO: 4720995 - DNA, 23 bp, Homo sapiens
ctctgtgtcaggtggggcagctt

SEQ ID NO: 4720996 - DNA, 15 bp, Homo sapiens
ctctgtgtgtgtatg

SEQ ID NO: 4720997 - DNA, 16 bp, Homo sapiens
ctctgtgtgtgtatga

SEQ ID NO: 4720998 - DNA, 15 bp, Homo sapiens
ctcttagctcccctc

SEQ ID NO: 4720999 - DNA, 14 bp, Homo sapiens
ctcttattgcccac

SEQ ID NO: 4721000 - DNA, 20 bp, Homo sapiens
ctcttattgcccacgctgga

SEQ ID NO: 4721001 - DNA, 17 bp, Homo sapiens
ctcttcagaggccctcg

SEQ ID NO: 4721002 - DNA, 18 bp, Homo sapiens
ctcttcagtgtgttgact

SEQ ID NO: 4721003 - DNA, 13 bp, Homo sapiens
ctcttccaggctg

SEQ ID NO: 4721004 - DNA, 15 bp, Homo sapiens
ctcttccaggctggg

SEQ ID NO: 4721005 - DNA, 22 bp, Homo sapiens
ctcttccaggctgggagagcct

SEQ ID NO: 4721006 - DNA, 16 bp, Homo sapiens
ctcttctccaggctgt

SEQ ID NO: 4721007 - DNA, 18 bp, Homo sapiens
ctcttctgggttccttcc

SEQ ID NO: 4721008 - DNA, 18 bp, Homo sapiens
ctcttgaactcctgacct

SEQ ID NO: 4721009 - DNA, 14 bp, Homo sapiens
ctcttgaccctgtc

SEQ ID NO: 4721010 - DNA, 21 bp, Homo sapiens
ctcttgaccctgtcacttgct

SEQ ID NO: 4721011 - DNA, 16 bp, Homo sapiens
ctcttgacctcaggtg

SEQ ID NO: 4721012 - DNA, 14 bp, Homo sapiens
ctcttgccccaacc

SEQ ID NO: 4721013 - DNA, 19 bp, Homo sapiens
ctcttgggttcaagcgatt

SEQ ID NO: 4721014 - DNA, 19 bp, Homo sapiens
ctcttggtcctgctgcagt

SEQ ID NO: 4721015 - DNA, 23 bp, Homo sapiens
ctcttgtattgctccattttctt

SEQ ID NO: 4721016 - DNA, 22 bp, Homo sapiens
ctctttaatgtcacaggcaggt

SEQ ID NO: 4721017 - DNA, 12 bp, Homo sapiens
ctctttcaaaac

SEQ ID NO: 4721018 - DNA, 22 bp, Homo sapiens
ctctttggtctacactgtgctg

SEQ ID NO: 4721019 - DNA, 21 bp, Homo sapiens
ctgaaaatacaaaaattagct

SEQ ID NO: 4721020 - DNA, 15 bp, Homo sapiens
ctgaaaatacatttc

SEQ ID NO: 4721021 - DNA, 15 bp, Homo sapiens
ctgaaaatatctctt

SEQ ID NO: 4721022 - DNA, 14 bp, Homo sapiens
ctgaaaccagtgtt

SEQ ID NO: 4721023 - DNA, 17 bp, Homo sapiens
ctgaaattaatttgtga

SEQ ID NO: 4721024 - DNA, 18 bp, Homo sapiens
ctgaaattaatttgtgaa

SEQ ID NO: 4721025 - DNA, 19 bp, Homo sapiens
ctgaaattaatttgtgaat

SEQ ID NO: 4721026 - DNA, 20 bp, Homo sapiens
ctgaaattaatttgtgaatt

SEQ ID NO: 4721027 - DNA, 21 bp, Homo sapiens
ctgaaattaatttgtgaattt

SEQ ID NO: 4721028 - DNA, 18 bp, Homo sapiens
ctgaacatcctaaatatt

SEQ ID NO: 4721029 - DNA, 20 bp, Homo sapiens
ctgaaccaccaacagagaaa

SEQ ID NO: 4721030 - DNA, 19 bp, Homo sapiens
ctgaaccacctttgtctct

SEQ ID NO: 4721031 - DNA, 18 bp, Homo sapiens
ctgaactctgcaactgaa

SEQ ID NO: 4721032 - DNA, 12 bp, Homo sapiens
ctgaactttgct

SEQ ID NO: 4721033 - DNA, 21 bp, Homo sapiens
ctgaactttgctgagcctgta

SEQ ID NO: 4721034 - DNA, 19 bp, Homo sapiens
ctgaagactcattcttctg

SEQ ID NO: 4721035 - DNA, 12 bp, Homo sapiens
ctgaagatattc

SEQ ID NO: 4721036 - DNA, 19 bp, Homo sapiens
ctgaagatcccaacatggt

SEQ ID NO: 4721037 - DNA, 19 bp, Homo sapiens
ctgaaggacattgcggaca

SEQ ID NO: 4721038 - DNA, 20 bp, Homo sapiens
ctgaaggacattgcggacag

SEQ ID NO: 4721039 - DNA, 23 bp, Homo sapiens
ctgaaggacattgcggacagcca

SEQ ID NO: 4721040 - DNA, 12 bp, Homo sapiens
ctgaaggagccc

SEQ ID NO: 4721041 - DNA, 21 bp, Homo sapiens
ctgaaggagccccattcctgg

SEQ ID NO: 4721042 - DNA, 19 bp, Homo sapiens
ctgaaggccccgcccaggc

SEQ ID NO: 4721043 - DNA, 17 bp, Homo sapiens
ctgaagtcacacagtga

SEQ ID NO: 4721044 - DNA, 18 bp, Homo sapiens
ctgaagtcacacagtgag

SEQ ID NO: 4721045 - DNA, 19 bp, Homo sapiens
ctgaagtcacacagtgagt

SEQ ID NO: 4721046 - DNA, 21 bp, Homo sapiens
ctgaagtcttgcattgaattt

SEQ ID NO: 4721047 - DNA, 14 bp, Homo sapiens
ctgaataaagggaa

SEQ ID NO: 4721048 - DNA, 16 bp, Homo sapiens
ctgaatacttgaagta

SEQ ID NO: 4721049 - DNA, 15 bp, Homo sapiens
ctgaatagcagaagg

SEQ ID NO: 4721050 - DNA, 15 bp, Homo sapiens
ctgaatattaagaaa

SEQ ID NO: 4721051 - DNA, 13 bp, Homo sapiens
ctgaatgaagcct

SEQ ID NO: 4721052 - DNA, 19 bp, Homo sapiens
ctgaatgcttataggtggc

SEQ ID NO: 4721053 - DNA, 17 bp, Homo sapiens
ctgaattatctatttca

SEQ ID NO: 4721054 - DNA, 16 bp, Homo sapiens
ctgaatttataaaaat

SEQ ID NO: 4721055 - DNA, 22 bp, Homo sapiens
ctgacaacactcattgacctga

SEQ ID NO: 4721056 - DNA, 14 bp, Homo sapiens
ctgacaacagcctg

SEQ ID NO: 4721057 - DNA, 14 bp, Homo sapiens
ctgacacaaacctg

SEQ ID NO: 4721058 - DNA, 15 bp, Homo sapiens
ctgacacacagctct

SEQ ID NO: 4721059 - DNA, 21 bp, Homo sapiens
ctgacacacagctctgtcctg

SEQ ID NO: 4721060 - DNA, 18 bp, Homo sapiens
ctgacacaggatgaaggc

SEQ ID NO: 4721061 - DNA, 22 bp, Homo sapiens
ctgacactggtattcctgcctc

SEQ ID NO: 4721062 - DNA, 17 bp, Homo sapiens
ctgacagacacaggccc

SEQ ID NO: 4721063 - DNA, 18 bp, Homo sapiens
ctgacagacacaggcccg

SEQ ID NO: 4721064 - DNA, 19 bp, Homo sapiens
ctgacagacagccctccat

SEQ ID NO: 4721065 - DNA, 17 bp, Homo sapiens
ctgacaggcaatgctgg

SEQ ID NO: 4721066 - DNA, 17 bp, Homo sapiens
ctgacagtcctctccac

SEQ ID NO: 4721067 - DNA, 19 bp, Homo sapiens
ctgacagtcctctccacct

SEQ ID NO: 4721068 - DNA, 20 bp, Homo sapiens
ctgacatattatgcctgaat

SEQ ID NO: 4721069 - DNA, 21 bp, Homo sapiens
ctgacattgttggccaaagcc

SEQ ID NO: 4721070 - DNA, 18 bp, Homo sapiens
ctgaccaatattgtacag

SEQ ID NO: 4721071 - DNA, 22 bp, Homo sapiens
ctgaccacctttgtttctcccc

SEQ ID NO: 4721072 - DNA, 21 bp, Homo sapiens
ctgacccacagcctccaagtc

SEQ ID NO: 4721073 - DNA, 15 bp, Homo sapiens
ctgacccatgctgcc

SEQ ID NO: 4721074 - DNA, 17 bp, Homo sapiens
ctgacccatgctgccct

SEQ ID NO: 4721075 - DNA, 18 bp, Homo sapiens
ctgacccatgctgccctg

SEQ ID NO: 4721076 - DNA, 15 bp, Homo sapiens
ctgaccccctccccc

SEQ ID NO: 4721077 - DNA, 21 bp, Homo sapiens
ctgactcagggctcctgggtt

SEQ ID NO: 4721078 - DNA, 21 bp, Homo sapiens
ctgactctaaaatatggaaaa

SEQ ID NO: 4721079 - DNA, 19 bp, Homo sapiens
ctgactgtaacgattgaca

SEQ ID NO: 4721080 - DNA, 14 bp, Homo sapiens
ctgacttcaggggc

SEQ ID NO: 4721081 - DNA, 20 bp, Homo sapiens
ctgacttcaggggctgcccg

SEQ ID NO: 4721082 - DNA, 11 bp, Homo sapiens
ctgagaacact

SEQ ID NO: 4721083 - DNA, 15 bp, Homo sapiens
ctgagaacactgtga

SEQ ID NO: 4721084 - DNA, 19 bp, Homo sapiens
ctgggattacaggctcctg

SEQ ID NO: 4721085 - DNA, 23 bp, Homo sapiens
ctgggattacaggctcctgccac

SEQ ID NO: 4721086 - DNA, 18 bp, Homo sapiens
ctgggattacaggtgtga

SEQ ID NO: 4721087 - DNA, 15 bp, Homo sapiens
ctgggcagctggaag

SEQ ID NO: 4721088 - DNA, 16 bp, Homo sapiens
ctgggcatagatgcag

SEQ ID NO: 4721089 - DNA, 15 bp, Homo sapiens
ctgggccccagttgt

SEQ ID NO: 4721090 - DNA, 14 bp, Homo sapiens
ctgggccctctctg

SEQ ID NO: 4721091 - DNA, 18 bp, Homo sapiens
ctgggccctctctgctct

SEQ ID NO: 4721092 - DNA, 20 bp, Homo sapiens
ctgggcctcctcacaacatg

SEQ ID NO: 4721093 - DNA, 13 bp, Homo sapiens
ctgggctctgtgg

SEQ ID NO: 4721094 - DNA, 21 bp, Homo sapiens
ctgggctctgtgggctgcact

SEQ ID NO: 4721095 - DNA, 22 bp, Homo sapiens
ctgggctctgtgggctgcactc

SEQ ID NO: 4721096 - DNA, 12 bp, Homo sapiens
ctgggctgactg

SEQ ID NO: 4721097 - DNA, 15 bp, Homo sapiens
ctgggctgactggga

SEQ ID NO: 4721098 - DNA, 12 bp, Homo sapiens
ctgggctgaggg

SEQ ID NO: 4721099 - DNA, 18 bp, Homo sapiens
ctgggctggggcctgatg

SEQ ID NO: 4721100 - DNA, 20 bp, Homo sapiens
ctgggctggggcctgatggg

SEQ ID NO: 4721101 - DNA, 12 bp, Homo sapiens
ctgggctgggtg

SEQ ID NO: 4721102 - DNA, 18 bp, Homo sapiens
ctgggctgggtgcgaccc

SEQ ID NO: 4721103 - DNA, 22 bp, Homo sapiens
ctgggctgggtgcgaccccatc

SEQ ID NO: 4721104 - DNA, 17 bp, Homo sapiens
ctgggcttcagtggcag

SEQ ID NO: 4721105 - DNA, 18 bp, Homo sapiens
ctgggcttcagtggcagc

SEQ ID NO: 4721106 - DNA, 19 bp, Homo sapiens
ctgggcttcagtggcagct

SEQ ID NO: 4721107 - DNA, 20 bp, Homo sapiens
ctgggcttcagtggcagctg

SEQ ID NO: 4721108 - DNA, 23 bp, Homo sapiens
ctgggcttcagtggcagctgctt

SEQ ID NO: 4721109 - DNA, 24 bp, Homo sapiens
ctgggcttcagtggcagctgcttt

SEQ ID NO: 4721110 - DNA, 17 bp, Homo sapiens
ctggggaacctgacccc

SEQ ID NO: 4721111 - DNA, 14 bp, Homo sapiens
ctggggagaaagta

SEQ ID NO: 4721112 - DNA, 15 bp, Homo sapiens
ctggggctgctggcc

SEQ ID NO: 4721113 - DNA, 17 bp, Homo sapiens
ctgggggcctcagtgcc

SEQ ID NO: 4721114 - DNA, 13 bp, Homo sapiens
ctggggggcagtg

SEQ ID NO: 4721115 - DNA, 16 bp, Homo sapiens
ctgggtaaatgcagcg

SEQ ID NO: 4721116 - DNA, 19 bp, Homo sapiens
ctgggtacttgtggacaca

SEQ ID NO: 4721117 - DNA, 20 bp, Homo sapiens
ctgggtacttgtggacacag

SEQ ID NO: 4721118 - DNA, 16 bp, Homo sapiens
ctgggtcctctgcagt

SEQ ID NO: 4721119 - DNA, 18 bp, Homo sapiens
ctgggtcctctgcagtgt

SEQ ID NO: 4721120 - DNA, 13 bp, Homo sapiens
ctgggtgatttct

SEQ ID NO: 4721121 - DNA, 19 bp, Homo sapiens
ctgggtgcgaccccatctg

SEQ ID NO: 4721122 - DNA, 21 bp, Homo sapiens
ctgggtgcgaccccatctgcc

SEQ ID NO: 4721123 - DNA, 22 bp, Homo sapiens
ctgggtgcgaccccatctgccc

SEQ ID NO: 4721124 - DNA, 16 bp, Homo sapiens
ctgggtggcactgcca

SEQ ID NO: 4721125 - DNA, 21 bp, Homo sapiens
ctgggtggcactgccatgcag

SEQ ID NO: 4721126 - DNA, 16 bp, Homo sapiens
ctgggtgtggcgcagc

SEQ ID NO: 4721127 - DNA, 17 bp, Homo sapiens
ctgggtgtggcgcagca

SEQ ID NO: 4721128 - DNA, 20 bp, Homo sapiens
ctgggttagggtgtgtgttc

SEQ ID NO: 4721129 - DNA, 20 bp, Homo sapiens
ctgggttcactgcaacctcc

SEQ ID NO: 4721130 - DNA, 16 bp, Homo sapiens
ctgggttctacccagg

SEQ ID NO: 4721131 - DNA, 13 bp, Homo sapiens
ctgggttggaggg

SEQ ID NO: 4721132 - DNA, 20 bp, Homo sapiens
ctgggttttgtattctctga

SEQ ID NO: 4721133 - DNA, 12 bp, Homo sapiens
ctggtatctgca

SEQ ID NO: 4721134 - DNA, 17 bp, Homo sapiens
ctggtattcctgcctcc

SEQ ID NO: 4721135 - DNA, 21 bp, Homo sapiens
ctggtccatagagagcaagac

SEQ ID NO: 4721136 - DNA, 13 bp, Homo sapiens
ctggtcccactca

SEQ ID NO: 4721137 - DNA, 15 bp, Homo sapiens
ctggtcccactcagt

SEQ ID NO: 4721138 - DNA, 19 bp, Homo sapiens
ctggtctctaagtgtaaaa

SEQ ID NO: 4721139 - DNA, 12 bp, Homo sapiens
ctggtctgaggg

SEQ ID NO: 4721140 - DNA, 22 bp, Homo sapiens
ctggtgacatgtcttttcttgc

SEQ ID NO: 4721141 - DNA, 20 bp, Homo sapiens
ctggtgactttcctctttgg

SEQ ID NO: 4721142 - DNA, 20 bp, Homo sapiens
ctggtgcctgagcccctcag

SEQ ID NO: 4721143 - DNA, 22 bp, Homo sapiens
ctggtggatggtgacttttgaa

SEQ ID NO: 4721144 - DNA, 13 bp, Homo sapiens
ctggtggcagctc

SEQ ID NO: 4721145 - DNA, 18 bp, Homo sapiens
ctggtggcagtgggagct

SEQ ID NO: 4721146 - DNA, 22 bp, Homo sapiens
ctggtggccctctcccctgccc

SEQ ID NO: 4721147 - DNA, 22 bp, Homo sapiens
ctggttcactctaattggtcat

SEQ ID NO: 4721148 - DNA, 21 bp, Homo sapiens
ctggttcggatttggggtgga

SEQ ID NO: 4721149 - DNA, 16 bp, Homo sapiens
ctggttctcatctttc

SEQ ID NO: 4721150 - DNA, 20 bp, Homo sapiens
ctggttctcatctttcttga

SEQ ID NO: 4721151 - DNA, 23 bp, Homo sapiens
ctggttggagagctagaacctgg

SEQ ID NO: 4721152 - DNA, 21 bp, Homo sapiens
ctggtttcctgccctgggagg

SEQ ID NO: 4721153 - DNA, 22 bp, Homo sapiens
ctggtttcctgccctgggaggc

SEQ ID NO: 4721154 - DNA, 15 bp, Homo sapiens
ctggtttttcagttt

SEQ ID NO: 4721155 - DNA, 16 bp, Homo sapiens
ctggtttttcagtttt

SEQ ID NO: 4721156 - DNA, 16 bp, Homo sapiens
ctgtaaagatgtttat

SEQ ID NO: 4721157 - DNA, 22 bp, Homo sapiens
ctgtaaagatgtttatttcagg

SEQ ID NO: 4721158 - DNA, 11 bp, Homo sapiens
ctgtaacatat

SEQ ID NO: 4721159 - DNA, 20 bp, Homo sapiens
ctgtaacctcttcagaggcc

SEQ ID NO: 4721160 - DNA, 22 bp, Homo sapiens
ctgtaacctcttcagaggccct

SEQ ID NO: 4721161 - DNA, 17 bp, Homo sapiens
ctgtaatatctttaaat

SEQ ID NO: 4721162 - DNA, 21 bp, Homo sapiens
ctgtaatattgtaaatactgg

SEQ ID NO: 4721163 - DNA, 16 bp, Homo sapiens
ctgtaatcccagcact

SEQ ID NO: 4721164 - DNA, 15 bp, Homo sapiens
ctgtacaaaagcaat

SEQ ID NO: 4721165 - DNA, 22 bp, Homo sapiens
ctgtacagagcccacgccccca

SEQ ID NO: 4721166 - DNA, 13 bp, Homo sapiens
ctgtaccaaatct

SEQ ID NO: 4721167 - DNA, 15 bp, Homo sapiens
ctgtaccaaatctga

SEQ ID NO: 4721168 - DNA, 14 bp, Homo sapiens
ctgtacgtctgaca

SEQ ID NO: 4721169 - DNA, 20 bp, Homo sapiens
ctgtacgtctgacaggcaat

SEQ ID NO: 4721170 - DNA, 20 bp, Homo sapiens
ctgtaggttttctgtgttta

SEQ ID NO: 4721171 - DNA, 13 bp, Homo sapiens
ctgtataaatagg

SEQ ID NO: 4721172 - DNA, 15 bp, Homo sapiens
ctgtataaataggag

SEQ ID NO: 4721173 - DNA, 16 bp, Homo sapiens
ctgtatcaggacccag

SEQ ID NO: 4721174 - DNA, 19 bp, Homo sapiens
ctgtatcccatgagcctca

SEQ ID NO: 4721175 - DNA, 21 bp, Homo sapiens
ctgtatggaaacactgatttt

SEQ ID NO: 4721176 - DNA, 13 bp, Homo sapiens
ctgtattcccaca

SEQ ID NO: 4721177 - DNA, 22 bp, Homo sapiens
ctgtcaatgagagcataattta

SEQ ID NO: 4721178 - DNA, 22 bp, Homo sapiens
ctgtcacttgctggctgtgaaa

SEQ ID NO: 4721179 - DNA, 15 bp, Homo sapiens
ctgtcaggattgcga

SEQ ID NO: 4721180 - DNA, 17 bp, Homo sapiens
ctgtcaggattgcgaga

SEQ ID NO: 4721181 - DNA, 21 bp, Homo sapiens
ctgtcaggattgcgagagatg

SEQ ID NO: 4721182 - DNA, 13 bp, Homo sapiens
ctgtccagtgccc

SEQ ID NO: 4721183 - DNA, 18 bp, Homo sapiens
ctgtccagtgcccattcc

SEQ ID NO: 4721184 - DNA, 13 bp, Homo sapiens
ctgtcccaagctc

SEQ ID NO: 4721185 - DNA, 22 bp, Homo sapiens
ctgtcccaggttatctgggcat

SEQ ID NO: 4721186 - DNA, 13 bp, Homo sapiens
ctgtccccctgac

SEQ ID NO: 4721187 - DNA, 14 bp, Homo sapiens
ctgtccccctgaca

SEQ ID NO: 4721188 - DNA, 18 bp, Homo sapiens
ctgtcccctcttgcccca

SEQ ID NO: 4721189 - DNA, 22 bp, Homo sapiens
ctgtccccttctctcatctctt

SEQ ID NO: 4721190 - DNA, 14 bp, Homo sapiens
ctgtccctgcctca

SEQ ID NO: 4721191 - DNA, 23 bp, Homo sapiens
ctgtcccttgcccccctggcctc

SEQ ID NO: 4721192 - DNA, 13 bp, Homo sapiens
ctgtcccttggag

SEQ ID NO: 4721193 - DNA, 14 bp, Homo sapiens
ctttaaagagagtt

SEQ ID NO: 4721194 - DNA, 20 bp, Homo sapiens
ctttaaagcaattgcataat

SEQ ID NO: 4721195 - DNA, 18 bp, Homo sapiens
ctttaatgtcacaggcag

SEQ ID NO: 4721196 - DNA, 20 bp, Homo sapiens
ctttaatgtcacaggcaggt

SEQ ID NO: 4721197 - DNA, 22 bp, Homo sapiens
ctttaatgtcacaggcaggtcc

SEQ ID NO: 4721198 - DNA, 23 bp, Homo sapiens
ctttaatgtcacaggcaggtcca

SEQ ID NO: 4721199 - DNA, 15 bp, Homo sapiens
ctttactgaatgtaa

SEQ ID NO: 4721200 - DNA, 15 bp, Homo sapiens
ctttagcgcccagtt

SEQ ID NO: 4721201 - DNA, 23 bp, Homo sapiens
ctttagggactcaatttctcccc

SEQ ID NO: 4721202 - DNA, 16 bp, Homo sapiens
ctttagtattaaatca

SEQ ID NO: 4721203 - DNA, 13 bp, Homo sapiens
ctttataaatgta

SEQ ID NO: 4721204 - DNA, 16 bp, Homo sapiens
ctttattcagaacttt

SEQ ID NO: 4721205 - DNA, 18 bp, Homo sapiens
ctttcaaattgaaatgac

SEQ ID NO: 4721206 - DNA, 11 bp, Homo sapiens
ctttcatacca

SEQ ID NO: 4721207 - DNA, 21 bp, Homo sapiens
ctttcatgtaaactgtgcacc

SEQ ID NO: 4721208 - DNA, 22 bp, Homo sapiens
ctttcatgttaatcaaacaagt

SEQ ID NO: 4721209 - DNA, 19 bp, Homo sapiens
ctttcattacttttaaaaa

SEQ ID NO: 4721210 - DNA, 13 bp, Homo sapiens
ctttcatttgaaa

SEQ ID NO: 4721211 - DNA, 15 bp, Homo sapiens
ctttcatttttttcc

SEQ ID NO: 4721212 - DNA, 16 bp, Homo sapiens
ctttcatttttttcca

SEQ ID NO: 4721213 - DNA, 22 bp, Homo sapiens
ctttccacggagccactcctct

SEQ ID NO: 4721214 - DNA, 18 bp, Homo sapiens
ctttccatatttaaccta

SEQ ID NO: 4721215 - DNA, 14 bp, Homo sapiens
ctttccatttggta

SEQ ID NO: 4721216 - DNA, 12 bp, Homo sapiens
ctttcctgaggc

SEQ ID NO: 4721217 - DNA, 21 bp, Homo sapiens
ctttcctgaggctgggctccc

SEQ ID NO: 4721218 - DNA, 19 bp, Homo sapiens
ctttcctgatggcaggatg

SEQ ID NO: 4721219 - DNA, 13 bp, Homo sapiens
ctttctaaaactg

SEQ ID NO: 4721220 - DNA, 16 bp, Homo sapiens
ctttctaatagagaga

SEQ ID NO: 4721221 - DNA, 22 bp, Homo sapiens
ctttctagtggtctttgtaaga

SEQ ID NO: 4721222 - DNA, 15 bp, Homo sapiens
ctttctattttcaca

SEQ ID NO: 4721223 - DNA, 20 bp, Homo sapiens
ctttctgggcaccggggcct

SEQ ID NO: 4721224 - DNA, 21 bp, Homo sapiens
ctttcttgatcaacatctttt

SEQ ID NO: 4721225 - DNA, 11 bp, Homo sapiens
ctttctttgct

SEQ ID NO: 4721226 - DNA, 21 bp, Homo sapiens
ctttgacctaaattatttact

SEQ ID NO: 4721227 - DNA, 20 bp, Homo sapiens
ctttgacctgcctcccttca

SEQ ID NO: 4721228 - DNA, 17 bp, Homo sapiens
ctttgacgccatcccag

SEQ ID NO: 4721229 - DNA, 13 bp, Homo sapiens
ctttgagacagtt

SEQ ID NO: 4721230 - DNA, 22 bp, Homo sapiens
ctttgataatgttaaatttgta

SEQ ID NO: 4721231 - DNA, 20 bp, Homo sapiens
ctttgattaaagactccagt

SEQ ID NO: 4721232 - DNA, 15 bp, Homo sapiens
ctttgattctccttc

SEQ ID NO: 4721233 - DNA, 22 bp, Homo sapiens
ctttgattctccttcagccctc

SEQ ID NO: 4721234 - DNA, 13 bp, Homo sapiens
ctttgcaagctta

SEQ ID NO: 4721235 - DNA, 20 bp, Homo sapiens
ctttgcagacaggcaagcac

SEQ ID NO: 4721236 - DNA, 13 bp, Homo sapiens
ctttgcagatgta

SEQ ID NO: 4721237 - DNA, 13 bp, Homo sapiens
ctttgcatattat

SEQ ID NO: 4721238 - DNA, 17 bp, Homo sapiens
ctttgccaccctcatgc

SEQ ID NO: 4721239 - DNA, 16 bp, Homo sapiens
ctttgctgaatgtcat

SEQ ID NO: 4721240 - DNA, 18 bp, Homo sapiens
ctttgctgaatgtcatta

SEQ ID NO: 4721241 - DNA, 18 bp, Homo sapiens
ctttgctgagcctgtaaa

SEQ ID NO: 4721242 - DNA, 23 bp, Homo sapiens
ctttggaaagacttttccaaccc

SEQ ID NO: 4721243 - DNA, 21 bp, Homo sapiens
ctttggacagaagcagctctt

SEQ ID NO: 4721244 - DNA, 17 bp, Homo sapiens
ctttggaccctgaggcc

SEQ ID NO: 4721245 - DNA, 17 bp, Homo sapiens
ctttgggagacagtcta

SEQ ID NO: 4721246 - DNA, 20 bp, Homo sapiens
ctttggggttcggcctgtgt

SEQ ID NO: 4721247 - DNA, 17 bp, Homo sapiens
ctttgggtcatttttaa

SEQ ID NO: 4721248 - DNA, 22 bp, Homo sapiens
ctttggtaagagttaaagagta

SEQ ID NO: 4721249 - DNA, 19 bp, Homo sapiens
ctttgtaagagtgtagaag

SEQ ID NO: 4721250 - DNA, 22 bp, Homo sapiens
ctttgtaagagtgtagaagcat

SEQ ID NO: 4721251 - DNA, 14 bp, Homo sapiens
ctttgtccccaccg

SEQ ID NO: 4721252 - DNA, 12 bp, Homo sapiens
ctttgtgcaaaa

SEQ ID NO: 4721253 - DNA, 16 bp, Homo sapiens
ctttgtgcaaaagcag

SEQ ID NO: 4721254 - DNA, 13 bp, Homo sapiens
ctttgtggcttcc

SEQ ID NO: 4721255 - DNA, 21 bp, Homo sapiens
ctttgttctggctcttccagg

SEQ ID NO: 4721256 - DNA, 18 bp, Homo sapiens
ctttgtttccttattcag

SEQ ID NO: 4721257 - DNA, 16 bp, Homo sapiens
ctttgtttctccccca

SEQ ID NO: 4721258 - DNA, 23 bp, Homo sapiens
ctttgttttgcacactttgccat

SEQ ID NO: 4721259 - DNA, 15 bp, Homo sapiens
cttttaagacatttt

SEQ ID NO: 4721260 - DNA, 22 bp, Homo sapiens
cttttaagacattttcatgctt

SEQ ID NO: 4721261 - DNA, 18 bp, Homo sapiens
cttttacagaataaaaga

SEQ ID NO: 4721262 - DNA, 17 bp, Homo sapiens
cttttacgtagtaaaag

SEQ ID NO: 4721263 - DNA, 20 bp, Homo sapiens
cttttacgtagtaaaagtca

SEQ ID NO: 4721264 - DNA, 22 bp, Homo sapiens
cttttacgtagtaaaagtcata

SEQ ID NO: 4721265 - DNA, 16 bp, Homo sapiens
cttttataaacctcta

SEQ ID NO: 4721266 - DNA, 22 bp, Homo sapiens
cttttataaacctctaatttat

SEQ ID NO: 4721267 - DNA, 21 bp, Homo sapiens
cttttatgtttgtaatctgta

SEQ ID NO: 4721268 - DNA, 17 bp, Homo sapiens
cttttcagcttctgctg

SEQ ID NO: 4721269 - DNA, 15 bp, Homo sapiens
cttttcattagcagt

SEQ ID NO: 4721270 - DNA, 18 bp, Homo sapiens
cttttcattagcagttgc

SEQ ID NO: 4721271 - DNA, 15 bp, Homo sapiens
cttttctcttctaca

SEQ ID NO: 4721272 - DNA, 12 bp, Homo sapiens
cttttctgaccc

SEQ ID NO: 4721273 - DNA, 19 bp, Homo sapiens
cttttctggaatggaattg

SEQ ID NO: 4721274 - DNA, 12 bp, Homo sapiens
cttttcttcaaa

SEQ ID NO: 4721275 - DNA, 19 bp, Homo sapiens
cttttgggtagttgttttt

SEQ ID NO: 4721276 - DNA, 20 bp, Homo sapiens
cttttgggtagttgtttttt

SEQ ID NO: 4721277 - DNA, 21 bp, Homo sapiens
ctttttaaaaattgttattta

SEQ ID NO: 4721278 - DNA, 12 bp, Homo sapiens
ctttttaaacag

SEQ ID NO: 4721279 - DNA, 14 bp, Homo sapiens
ctttttaaacagtg

SEQ ID NO: 4721280 - DNA, 15 bp, Homo sapiens
ctttttaaacagtgt

SEQ ID NO: 4721281 - DNA, 18 bp, Homo sapiens
ctttttattaaaatattt

SEQ ID NO: 4721282 - DNA, 22 bp, Homo sapiens
ctttttccaactcagaaattca

SEQ ID NO: 4721283 - DNA, 17 bp, Homo sapiens
ctttttccttgtcccca

SEQ ID NO: 4721284 - DNA, 14 bp, Homo sapiens
ctttttgaaatgtc

SEQ ID NO: 4721285 - DNA, 14 bp, Homo sapiens
ctttttgtacctgg

SEQ ID NO: 4721286 - DNA, 17 bp, Homo sapiens
ctttttgttccagagct

SEQ ID NO: 4721287 - DNA, 20 bp, Homo sapiens
ctttttgttccagagctgct

SEQ ID NO: 4721288 - DNA, 20 bp, Homo sapiens
cttttttaagatttttctca

SEQ ID NO: 4721289 - DNA, 17 bp, Homo sapiens
cttttttctttaaattt

SEQ ID NO: 4721290 - DNA, 11 bp, Homo sapiens
cttttttgatt

SEQ ID NO: 4721291 - DNA, 15 bp, Homo sapiens
cttttttggctgctg

SEQ ID NO: 4721292 - DNA, 21 bp, Homo sapiens
ctttttttggaagttatttat

SEQ ID NO: 4721293 - DNA, 19 bp, Homo sapiens
cttttttttttctgttgaa

SEQ ID NO: 4721294 - DNA, 22 bp, Homo sapiens
gaaaaaaagaatgagtaatgtg

SEQ ID NO: 4721295 - DNA, 16 bp, Homo sapiens
gaaaaatagcaacttg

SEQ ID NO: 4721296 - DNA, 12 bp, Homo sapiens
gaaaaatgtagg

SEQ ID NO: 4721297 - DNA, 17 bp, Homo sapiens
gaaaacagagtatttct

SEQ ID NO: 4721298 - DNA, 12 bp, Homo sapiens
gaaaacaggcac

SEQ ID NO: 4721299 - DNA, 13 bp, Homo sapiens
gaaaacattccat

SEQ ID NO: 4721300 - DNA, 17 bp, Homo sapiens
gaaaacattccatcctt

SEQ ID NO: 4721301 - DNA, 19 bp, Homo sapiens
gaaaactgcaacttgtaaa

SEQ ID NO: 4721302 - DNA, 21 bp, Homo sapiens
gaaaagcctctgtgtcactgg

SEQ ID NO: 4721303 - DNA, 23 bp, Homo sapiens
gacccttgccgtctacctgaggg

SEQ ID NO: 4721304 - DNA, 20 bp, Homo sapiens
gacccttgtggtcccacccc

SEQ ID NO: 4721305 - DNA, 18 bp, Homo sapiens
gaccgcttgtttcttgtt

SEQ ID NO: 4721306 - DNA, 17 bp, Homo sapiens
gaccggagagtgggggt

SEQ ID NO: 4721307 - DNA, 22 bp, Homo sapiens
gacctaaaatttgccctcccat

SEQ ID NO: 4721308 - DNA, 13 bp, Homo sapiens
gacctacaaatca

SEQ ID NO: 4721309 - DNA, 20 bp, Homo sapiens
gacctaggatatcttctcca

SEQ ID NO: 4721310 - DNA, 13 bp, Homo sapiens
gacctcagatgtg

SEQ ID NO: 4721311 - DNA, 23 bp, Homo sapiens
gacctcaggtaatcgacctgcct

SEQ ID NO: 4721312 - DNA, 14 bp, Homo sapiens
gacctcctgcctcc

SEQ ID NO: 4721313 - DNA, 18 bp, Homo sapiens
gacctctgcaagacaaag

SEQ ID NO: 4721314 - DNA, 14 bp, Homo sapiens
gacctgaactctgc

SEQ ID NO: 4721315 - DNA, 13 bp, Homo sapiens
gacctgaggccct

SEQ ID NO: 4721316 - DNA, 13 bp, Homo sapiens
gacctgatggaga

SEQ ID NO: 4721317 - DNA, 17 bp, Homo sapiens
gacctggtgctgcctct

SEQ ID NO: 4721318 - DNA, 14 bp, Homo sapiens
gacctgtggtgcaa

SEQ ID NO: 4721319 - DNA, 14 bp, Homo sapiens
gaccttgaactggg

SEQ ID NO: 4721320 - DNA, 16 bp, Homo sapiens
gacgcagcctgagaat

SEQ ID NO: 4721321 - DNA, 12 bp, Homo sapiens
gacgcaggcccc

SEQ ID NO: 4721322 - DNA, 16 bp, Homo sapiens
gacgcaggcccctctc

SEQ ID NO: 4721323 - DNA, 18 bp, Homo sapiens
gacgcaggcccctctcct

SEQ ID NO: 4721324 - DNA, 20 bp, Homo sapiens
gacgcaggcccctctcctcc

SEQ ID NO: 4721325 - DNA, 12 bp, Homo sapiens
gacgccacccag

SEQ ID NO: 4721326 - DNA, 13 bp, Homo sapiens
gacgccatcccag

SEQ ID NO: 4721327 - DNA, 15 bp, Homo sapiens
gacgccatcccagcc

SEQ ID NO: 4721328 - DNA, 17 bp, Homo sapiens
gacgccatcccagcccc

SEQ ID NO: 4721329 - DNA, 19 bp, Homo sapiens
gacgccatcccagccccaa

SEQ ID NO: 4721330 - DNA, 21 bp, Homo sapiens
gacgccatcccagccccaatg

SEQ ID NO: 4721331 - DNA, 13 bp, Homo sapiens
gacgcctgaggaa

SEQ ID NO: 4721332 - DNA, 12 bp, Homo sapiens
gacgcctggggg

SEQ ID NO: 4721333 - DNA, 17 bp, Homo sapiens
gacgcggcaggcttctc

SEQ ID NO: 4721334 - DNA, 22 bp, Homo sapiens
gacgctacccgggaagggggct

SEQ ID NO: 4721335 - DNA, 12 bp, Homo sapiens
gacgctgtgctg

SEQ ID NO: 4721336 - DNA, 15 bp, Homo sapiens
gacgctgtgctgccc

SEQ ID NO: 4721337 - DNA, 16 bp, Homo sapiens
gacgctgtgctgccct

SEQ ID NO: 4721338 - DNA, 23 bp, Homo sapiens
gacggataggcaggaacatacag

SEQ ID NO: 4721339 - DNA, 17 bp, Homo sapiens
gacggggtttcaccatg

SEQ ID NO: 4721340 - DNA, 16 bp, Homo sapiens
gacgtgattttgctgt

SEQ ID NO: 4721341 - DNA, 16 bp, Homo sapiens
gactaacttgtctttg

SEQ ID NO: 4721342 - DNA, 12 bp, Homo sapiens
gactaagccagc

SEQ ID NO: 4721343 - DNA, 18 bp, Homo sapiens
gactaagccagcaccgga

SEQ ID NO: 4721344 - DNA, 13 bp, Homo sapiens
gactacaggtgtg

SEQ ID NO: 4721345 - DNA, 18 bp, Homo sapiens
gactacaggtgtgagtca

SEQ ID NO: 4721346 - DNA, 22 bp, Homo sapiens
gactacatttagcccctctctt

SEQ ID NO: 4721347 - DNA, 23 bp, Homo sapiens
gactcaaaacccatctgggctcc

SEQ ID NO: 4721348 - DNA, 15 bp, Homo sapiens
gactcacctccccca

SEQ ID NO: 4721349 - DNA, 20 bp, Homo sapiens
gactcagctccccagagtcc

SEQ ID NO: 4721350 - DNA, 13 bp, Homo sapiens
gactcagggctcc

SEQ ID NO: 4721351 - DNA, 14 bp, Homo sapiens
gactcagggctcct

SEQ ID NO: 4721352 - DNA, 17 bp, Homo sapiens
gactcagggctcctggg

SEQ ID NO: 4721353 - DNA, 19 bp, Homo sapiens
gactcagggctcctgggtt

SEQ ID NO: 4721354 - DNA, 15 bp, Homo sapiens
gactcagtggggagg

SEQ ID NO: 4721355 - DNA, 14 bp, Homo sapiens
gactcattcttctg

SEQ ID NO: 4721356 - DNA, 13 bp, Homo sapiens
gactccacctcaa

SEQ ID NO: 4721357 - DNA, 17 bp, Homo sapiens
gactcctaggcaggaca

SEQ ID NO: 4721358 - DNA, 19 bp, Homo sapiens
gactcctaggcaggacatg

SEQ ID NO: 4721359 - DNA, 13 bp, Homo sapiens
gactcctgcaggc

SEQ ID NO: 4721360 - DNA, 18 bp, Homo sapiens
gactcctgcaggcagcca

SEQ ID NO: 4721361 - DNA, 15 bp, Homo sapiens
gactcgggctcctgt

SEQ ID NO: 4721362 - DNA, 17 bp, Homo sapiens
gactcgggctcctgtgc

SEQ ID NO: 4721363 - DNA, 20 bp, Homo sapiens
gactcgggctcctgtgccct

SEQ ID NO: 4721364 - DNA, 16 bp, Homo sapiens
gactctcagtctctga

SEQ ID NO: 4721365 - DNA, 19 bp, Homo sapiens
gactctgtctcaaaaaaac

SEQ ID NO: 4721366 - DNA, 18 bp, Homo sapiens
gactctttttgtacctgg

SEQ ID NO: 4721367 - DNA, 21 bp, Homo sapiens
gactgaccaatattgtacagt

SEQ ID NO: 4721368 - DNA, 14 bp, Homo sapiens
gactgaggcctgag

SEQ ID NO: 4721369 - DNA, 16 bp, Homo sapiens
gactgatttcagagtg

SEQ ID NO: 4721370 - DNA, 14 bp, Homo sapiens
gactgggccctgcc

SEQ ID NO: 4721371 - DNA, 16 bp, Homo sapiens
gactgggctgagggag

SEQ ID NO: 4721372 - DNA, 11 bp, Homo sapiens
gactgtagaaa

SEQ ID NO: 4721373 - DNA, 17 bp, Homo sapiens
gactgtgacaggcagca

SEQ ID NO: 4721374 - DNA, 18 bp, Homo sapiens
gactgtgacaggcagcag

SEQ ID NO: 4721375 - DNA, 20 bp, Homo sapiens
gactgtgacaggcagcagag

SEQ ID NO: 4721376 - DNA, 19 bp, Homo sapiens
gactgtgcccaagtgggtc

SEQ ID NO: 4721377 - DNA, 14 bp, Homo sapiens
gactgttcaagagc

SEQ ID NO: 4721378 - DNA, 19 bp, Homo sapiens
gactgttcaagagcacact

SEQ ID NO: 4721379 - DNA, 23 bp, Homo sapiens
gactgttcaagagcacacttggc

SEQ ID NO: 4721380 - DNA, 15 bp, Homo sapiens
gacttaactttttaa

SEQ ID NO: 4721381 - DNA, 18 bp, Homo sapiens
gacttcaggggctgcccg

SEQ ID NO: 4721382 - DNA, 19 bp, Homo sapiens
gacttgaattttcccactg

SEQ ID NO: 4721383 - DNA, 20 bp, Homo sapiens
gacttgaattttcccactgc

SEQ ID NO: 4721384 - DNA, 21 bp, Homo sapiens
gacttgaattttcccactgca

SEQ ID NO: 4721385 - DNA, 16 bp, Homo sapiens
gacttggaagctccgc

SEQ ID NO: 4721386 - DNA, 15 bp, Homo sapiens
gacttggcccctgcc

SEQ ID NO: 4721387 - DNA, 11 bp, Homo sapiens
gactttcctct

SEQ ID NO: 4721388 - DNA, 22 bp, Homo sapiens
gactttgttagtttctccaagc

SEQ ID NO: 4721389 - DNA, 21 bp, Homo sapiens
gacttttctttgtggcttcct

SEQ ID NO: 4721390 - DNA, 14 bp, Homo sapiens
gacttttgaagaac

SEQ ID NO: 4721391 - DNA, 16 bp, Homo sapiens
gacttttgaagaacaa

SEQ ID NO: 4721392 - DNA, 18 bp, Homo sapiens
gagaaagaccatgcattt

SEQ ID NO: 4721393 - DNA, 18 bp, Homo sapiens
gagaagccacaggcctga

SEQ ID NO: 4721394 - DNA, 21 bp, Homo sapiens
gagaagcttctaattagatca

SEQ ID NO: 4721395 - DNA, 11 bp, Homo sapiens
gagaaggagcc

SEQ ID NO: 4721396 - DNA, 22 bp, Homo sapiens
gagaagggctcagagaggacaa

SEQ ID NO: 4721397 - DNA, 20 bp, Homo sapiens
gagaagtcttctatttattt

SEQ ID NO: 4721398 - DNA, 21 bp, Homo sapiens
gagaagtcttctatttattta

SEQ ID NO: 4721399 - DNA, 15 bp, Homo sapiens
gagaataatttctgt

SEQ ID NO: 4721400 - DNA, 20 bp, Homo sapiens
gagaatattcctacttgcag

SEQ ID NO: 4721401 - DNA, 17 bp, Homo sapiens
gagacagcccgggctct

SEQ ID NO: 4721402 - DNA, 16 bp, Homo sapiens
gagacaggaagcctca

SEQ ID NO: 4721403 - DNA, 17 bp, Homo sapiens
gagacagtccagcctgg

SEQ ID NO: 4721404 - DNA, 21 bp, Homo sapiens
gagacagtcccagaacacggc

SEQ ID NO: 4721405 - DNA, 16 bp, Homo sapiens
gagacagtttcttagc

SEQ ID NO: 4721406 - DNA, 18 bp, Homo sapiens
gagaccatccctgaaggc

SEQ ID NO: 4721407 - DNA, 21 bp, Homo sapiens
gagaccatccctgaaggcccc

SEQ ID NO: 4721408 - DNA, 18 bp, Homo sapiens
gagacctcagatgtgttg

SEQ ID NO: 4721409 - DNA, 14 bp, Homo sapiens
gagacggagtccca

SEQ ID NO: 4721410 - DNA, 15 bp, Homo sapiens
gagacggtcgagcag

SEQ ID NO: 4721411 - DNA, 19 bp, Homo sapiens
gagactatgtaaaaataac

SEQ ID NO: 4721412 - DNA, 16 bp, Homo sapiens
gagactcctaggcagg

SEQ ID NO: 4721413 - DNA, 20 bp, Homo sapiens
gatggtgacttttgaagaac

SEQ ID NO: 4721414 - DNA, 22 bp, Homo sapiens
gatggtggaccctactattcat

SEQ ID NO: 4721415 - DNA, 19 bp, Homo sapiens
gatgtcccagtttcccact

SEQ ID NO: 4721416 - DNA, 18 bp, Homo sapiens
gatgtcctcctctgtgaa

SEQ ID NO: 4721417 - DNA, 19 bp, Homo sapiens
gatgtcctcctctgtgaaa

SEQ ID NO: 4721418 - DNA, 16 bp, Homo sapiens
gatgtctttttattaa

SEQ ID NO: 4721419 - DNA, 13 bp, Homo sapiens
gatgtgcctgggt

SEQ ID NO: 4721420 - DNA, 15 bp, Homo sapiens
gatgtgcctgggtgg

SEQ ID NO: 4721421 - DNA, 12 bp, Homo sapiens
gatgtgtgttga

SEQ ID NO: 4721422 - DNA, 14 bp, Homo sapiens
gatgtgtgttgata

SEQ ID NO: 4721423 - DNA, 19 bp, Homo sapiens
gatgttctaagtctttcca

SEQ ID NO: 4721424 - DNA, 14 bp, Homo sapiens
gatgttggctggga

SEQ ID NO: 4721425 - DNA, 12 bp, Homo sapiens
gatgtttataaa

SEQ ID NO: 4721426 - DNA, 15 bp, Homo sapiens
gatgttttccatgag

SEQ ID NO: 4721427 - DNA, 23 bp, Homo sapiens
gatgttttccatgagtcccctgt

SEQ ID NO: 4721428 - DNA, 17 bp, Homo sapiens
gattaatagcattcgaa

SEQ ID NO: 4721429 - DNA, 18 bp, Homo sapiens
gattaatatggggatgca

SEQ ID NO: 4721430 - DNA, 20 bp, Homo sapiens
gattaatctgggcagacatt

SEQ ID NO: 4721431 - DNA, 13 bp, Homo sapiens
gattacaagcgtg

SEQ ID NO: 4721432 - DNA, 20 bp, Homo sapiens
gattacaggtgtgaaccacc

SEQ ID NO: 4721433 - DNA, 20 bp, Homo sapiens
gattacttagattgtgttcc

SEQ ID NO: 4721434 - DNA, 15 bp, Homo sapiens
gattagaaattacct

SEQ ID NO: 4721435 - DNA, 20 bp, Homo sapiens
gattagaaattacctgtgga

SEQ ID NO: 4721436 - DNA, 16 bp, Homo sapiens
gattaggattaaaatg

SEQ ID NO: 4721437 - DNA, 18 bp, Homo sapiens
gattagtaaatatgtgaa

SEQ ID NO: 4721438 - DNA, 17 bp, Homo sapiens
gattatttaagactaaa

SEQ ID NO: 4721439 - DNA, 13 bp, Homo sapiens
gattatttaataa

SEQ ID NO: 4721440 - DNA, 15 bp, Homo sapiens
gattcactatttaaa

SEQ ID NO: 4721441 - DNA, 13 bp, Homo sapiens
gattcagacagct

SEQ ID NO: 4721442 - DNA, 18 bp, Homo sapiens
gattcatattgcatcata

SEQ ID NO: 4721443 - DNA, 13 bp, Homo sapiens
gattccaaagcat

SEQ ID NO: 4721444 - DNA, 16 bp, Homo sapiens
gattccatcaaagaga

SEQ ID NO: 4721445 - DNA, 17 bp, Homo sapiens
gattctaaacagatgtc

SEQ ID NO: 4721446 - DNA, 17 bp, Homo sapiens
gattctcagggtctctg

SEQ ID NO: 4721447 - DNA, 19 bp, Homo sapiens
gattctcagggtctctgct

SEQ ID NO: 4721448 - DNA, 21 bp, Homo sapiens
gattctcctgcctcagcctcc

SEQ ID NO: 4721449 - DNA, 13 bp, Homo sapiens
gattctccttcag

SEQ ID NO: 4721450 - DNA, 18 bp, Homo sapiens
gattctccttcagccctc

SEQ ID NO: 4721451 - DNA, 21 bp, Homo sapiens
gattcttccttttattaaaac

SEQ ID NO: 4721452 - DNA, 21 bp, Homo sapiens
gattgaattacggaaaatgcc

SEQ ID NO: 4721453 - DNA, 16 bp, Homo sapiens
gattgcaacaggctgg

SEQ ID NO: 4721454 - DNA, 21 bp, Homo sapiens
gattgcgagagatgtgtgttg

SEQ ID NO: 4721455 - DNA, 21 bp, Homo sapiens
gattgctgccccatcagtgct

SEQ ID NO: 4721456 - DNA, 13 bp, Homo sapiens
gattgggacagag

SEQ ID NO: 4721457 - DNA, 22 bp, Homo sapiens
gattgtaaaaaaaaatgccttt

SEQ ID NO: 4721458 - DNA, 19 bp, Homo sapiens
gattgtaaaaataatcagt

SEQ ID NO: 4721459 - DNA, 20 bp, Homo sapiens
gattgtccccgacccttgcc

SEQ ID NO: 4721460 - DNA, 16 bp, Homo sapiens
gatttaaaagcctgct

SEQ ID NO: 4721461 - DNA, 17 bp, Homo sapiens
gatttaataaaataatt

SEQ ID NO: 4721462 - DNA, 19 bp, Homo sapiens
gatttagcaatgctgtgaa

SEQ ID NO: 4721463 - DNA, 13 bp, Homo sapiens
gatttataaagca

SEQ ID NO: 4721464 - DNA, 14 bp, Homo sapiens
gatttataaagcaa

SEQ ID NO: 4721465 - DNA, 17 bp, Homo sapiens
gatttcagctcactgca

SEQ ID NO: 4721466 - DNA, 22 bp, Homo sapiens
gatttcaggtcaactctgaaga

SEQ ID NO: 4721467 - DNA, 22 bp, Homo sapiens
gatttcatctgctctccttcct

SEQ ID NO: 4721468 - DNA, 18 bp, Homo sapiens
gatttcccgtggccccag

SEQ ID NO: 4721469 - DNA, 21 bp, Homo sapiens
gatttcccgtggccccagcct

SEQ ID NO: 4721470 - DNA, 12 bp, Homo sapiens
gatttctagaat

SEQ ID NO: 4721471 - DNA, 17 bp, Homo sapiens
gatttctgccttccttg

SEQ ID NO: 4721472 - DNA, 21 bp, Homo sapiens
gatttgctgggcagtttttct

SEQ ID NO: 4721473 - DNA, 12 bp, Homo sapiens
gatttgggctgg

SEQ ID NO: 4721474 - DNA, 19 bp, Homo sapiens
gatttgttaatgatagcta

SEQ ID NO: 4721475 - DNA, 17 bp, Homo sapiens
gattttcctcctttcct

SEQ ID NO: 4721476 - DNA, 19 bp, Homo sapiens
gattttgatccaagctggt

SEQ ID NO: 4721477 - DNA, 20 bp, Homo sapiens
gattttgtatatgaaaacaa

SEQ ID NO: 4721478 - DNA, 18 bp, Homo sapiens
gatttttctcaaagtttt

SEQ ID NO: 4721479 - DNA, 13 bp, Homo sapiens
gatttttgttaat

SEQ ID NO: 4721480 - DNA, 14 bp, Homo sapiens
gatttttgttaatt

SEQ ID NO: 4721481 - DNA, 13 bp, Homo sapiens
gcaaaaaaagaaa

SEQ ID NO: 4721482 - DNA, 16 bp, Homo sapiens
gcaaactcaagcttct

SEQ ID NO: 4721483 - DNA, 21 bp, Homo sapiens
gcaaagcccagcttgaaacct

SEQ ID NO: 4721484 - DNA, 17 bp, Homo sapiens
gcaaaggagtagaaaga

SEQ ID NO: 4721485 - DNA, 15 bp, Homo sapiens
gcaaagggcatgggt

SEQ ID NO: 4721486 - DNA, 23 bp, Homo sapiens
gcaaagggcatgggtcgggagag

SEQ ID NO: 4721487 - DNA, 23 bp, Homo sapiens
gcaaagtatcaaagaaaaacaat

SEQ ID NO: 4721488 - DNA, 16 bp, Homo sapiens
gcaaatgtcacagtaa

SEQ ID NO: 4721489 - DNA, 16 bp, Homo sapiens
gcaaatgtttaaacat

SEQ ID NO: 4721490 - DNA, 17 bp, Homo sapiens
gcaaatgtttaaacatt

SEQ ID NO: 4721491 - DNA, 19 bp, Homo sapiens
gcaaattaaacaatataag

SEQ ID NO: 4721492 - DNA, 13 bp, Homo sapiens
gcaacaggctggg

SEQ ID NO: 4721493 - DNA, 14 bp, Homo sapiens
gcaacaggctgggc

SEQ ID NO: 4721494 - DNA, 15 bp, Homo sapiens
gcaacatggattcca

SEQ ID NO: 4721495 - DNA, 14 bp, Homo sapiens
gcaacccccagcct

SEQ ID NO: 4721496 - DNA, 18 bp, Homo sapiens
gcaacccccagcctgcta

SEQ ID NO: 4721497 - DNA, 20 bp, Homo sapiens
gcaacctccgcctcttgggt

SEQ ID NO: 4721498 - DNA, 17 bp, Homo sapiens
gcaactgaatacttgaa

SEQ ID NO: 4721499 - DNA, 14 bp, Homo sapiens
gcaacttgtgaact

SEQ ID NO: 4721500 - DNA, 16 bp, Homo sapiens
gcaagcaagagctctt

SEQ ID NO: 4721501 - DNA, 17 bp, Homo sapiens
gcaagcaagagctcttg

SEQ ID NO: 4721502 - DNA, 18 bp, Homo sapiens
gcaagcacctcctgcctc

SEQ ID NO: 4721503 - DNA, 20 bp, Homo sapiens
gcaagcacctcctgcctcga

SEQ ID NO: 4721504 - DNA, 16 bp, Homo sapiens
gcaagcttatttagca

SEQ ID NO: 4721505 - DNA, 13 bp, Homo sapiens
gcaaggaggctgg

SEQ ID NO: 4721506 - DNA, 20 bp, Homo sapiens
gcaaggaggctggctggggc

SEQ ID NO: 4721507 - DNA, 13 bp, Homo sapiens
gcaagtgagagct

SEQ ID NO: 4721508 - DNA, 23 bp, Homo sapiens
gcaatctattaatagctgcctta

SEQ ID NO: 4721509 - DNA, 19 bp, Homo sapiens
gcaatgccatcatctcctg

SEQ ID NO: 4721510 - DNA, 14 bp, Homo sapiens
gcaatgctggctgt

SEQ ID NO: 4721511 - DNA, 23 bp, Homo sapiens
gcaatgctggctgttggctgggg

SEQ ID NO: 4721512 - DNA, 14 bp, Homo sapiens
gcaattctcctgcc

SEQ ID NO: 4721513 - DNA, 18 bp, Homo sapiens
gcacaagctccaagctcc

SEQ ID NO: 4721514 - DNA, 19 bp, Homo sapiens
gcacaataaaaccaagcct

SEQ ID NO: 4721515 - DNA, 21 bp, Homo sapiens
gcacaataaaaccaagcctct

SEQ ID NO: 4721516 - DNA, 20 bp, Homo sapiens
gcacaatagtaacctgggta

SEQ ID NO: 4721517 - DNA, 12 bp, Homo sapiens
gcacacaccaga

SEQ ID NO: 4721518 - DNA, 14 bp, Homo sapiens
gcacacaccagagc

SEQ ID NO: 4721519 - DNA, 15 bp, Homo sapiens
gcacacaccagagcc

SEQ ID NO: 4721520 - DNA, 16 bp, Homo sapiens
gcacacaccagagccc

SEQ ID NO: 4721521 - DNA, 11 bp, Homo sapiens
gcacacactgt

SEQ ID NO: 4721522 - DNA, 14 bp, Homo sapiens
gcacaccgggcact

SEQ ID NO: 4721523 - DNA, 20 bp, Homo sapiens
gccatggagtgagacccagg

SEQ ID NO: 4721524 - DNA, 19 bp, Homo sapiens
gccatggcttccaaggtgg

SEQ ID NO: 4721525 - DNA, 16 bp, Homo sapiens
gccatgggcctcctgt

SEQ ID NO: 4721526 - DNA, 18 bp, Homo sapiens
gccatgtagaagctgcat

SEQ ID NO: 4721527 - DNA, 15 bp, Homo sapiens
gccatgtgttccaag

SEQ ID NO: 4721528 - DNA, 14 bp, Homo sapiens
gccatgttggccag

SEQ ID NO: 4721529 - DNA, 15 bp, Homo sapiens
gccatgttggccagg

SEQ ID NO: 4721530 - DNA, 16 bp, Homo sapiens
gccatgttggccaggc

SEQ ID NO: 4721531 - DNA, 18 bp, Homo sapiens
gccatgttggccaggctg

SEQ ID NO: 4721532 - DNA, 21 bp, Homo sapiens
gccattttattaaacattttc

SEQ ID NO: 4721533 - DNA, 18 bp, Homo sapiens
gccattttgtgaatggat

SEQ ID NO: 4721534 - DNA, 19 bp, Homo sapiens
gccattttgtgaatggatt

SEQ ID NO: 4721535 - DNA, 13 bp, Homo sapiens
gcccaagatgctt

SEQ ID NO: 4721536 - DNA, 20 bp, Homo sapiens
gcccaagtggcagagcttgg

SEQ ID NO: 4721537 - DNA, 13 bp, Homo sapiens
gcccaagtgggtc

SEQ ID NO: 4721538 - DNA, 22 bp, Homo sapiens
gcccaattcttacaaacatgtg

SEQ ID NO: 4721539 - DNA, 18 bp, Homo sapiens
gcccacaggatcagtctg

SEQ ID NO: 4721540 - DNA, 19 bp, Homo sapiens
gcccacaggatcagtctga

SEQ ID NO: 4721541 - DNA, 15 bp, Homo sapiens
gcccacgcccccact

SEQ ID NO: 4721542 - DNA, 17 bp, Homo sapiens
gcccacgcccccactgg

SEQ ID NO: 4721543 - DNA, 16 bp, Homo sapiens
gcccacgctggagtgc

SEQ ID NO: 4721544 - DNA, 19 bp, Homo sapiens
gcccacgctggagtgcagt

SEQ ID NO: 4721545 - DNA, 13 bp, Homo sapiens
gcccacgtcctgt

SEQ ID NO: 4721546 - DNA, 14 bp, Homo sapiens
gcccacgtcctgtc

SEQ ID NO: 4721547 - DNA, 15 bp, Homo sapiens
gcccacgtcctgtca

SEQ ID NO: 4721548 - DNA, 16 bp, Homo sapiens
gcccacgtcctgtcag

SEQ ID NO: 4721549 - DNA, 17 bp, Homo sapiens
gcccactagacccactg

SEQ ID NO: 4721550 - DNA, 14 bp, Homo sapiens
gcccactccctgca

SEQ ID NO: 4721551 - DNA, 15 bp, Homo sapiens
gcccactccctgcaa

SEQ ID NO: 4721552 - DNA, 14 bp, Homo sapiens
gcccacttctgcca

SEQ ID NO: 4721553 - DNA, 23 bp, Homo sapiens
gcccagaggagggcagcagaagg

SEQ ID NO: 4721554 - DNA, 14 bp, Homo sapiens
gcccagagggcctg

SEQ ID NO: 4721555 - DNA, 18 bp, Homo sapiens
gcccagagggcctgcaag

SEQ ID NO: 4721556 - DNA, 19 bp, Homo sapiens
gcccagagggcctgcaagg

SEQ ID NO: 4721557 - DNA, 21 bp, Homo sapiens
gcccagagggcctgcaaggga

SEQ ID NO: 4721558 - DNA, 18 bp, Homo sapiens
gcccagaggtaacagaac

SEQ ID NO: 4721559 - DNA, 20 bp, Homo sapiens
gcccagcactgcttgaggaa

SEQ ID NO: 4721560 - DNA, 17 bp, Homo sapiens
gcccagccccttctgac

SEQ ID NO: 4721561 - DNA, 20 bp, Homo sapiens
gcccagccccttctgaccca

SEQ ID NO: 4721562 - DNA, 24 bp, Homo sapiens
gcccagccccttctgacccatgct

SEQ ID NO: 4721563 - DNA, 19 bp, Homo sapiens
gcccagctcccccgggagg

SEQ ID NO: 4721564 - DNA, 21 bp, Homo sapiens
gcccagcttgaaaccttcact

SEQ ID NO: 4721565 - DNA, 21 bp, Homo sapiens
gcccaggaccccatggcagtg

SEQ ID NO: 4721566 - DNA, 21 bp, Homo sapiens
gcccaggagctcccctcccca

SEQ ID NO: 4721567 - DNA, 11 bp, Homo sapiens
gcccaggcagg

SEQ ID NO: 4721568 - DNA, 11 bp, Homo sapiens
gcccaggccag

SEQ ID NO: 4721569 - DNA, 16 bp, Homo sapiens
gcccaggccaggactc

SEQ ID NO: 4721570 - DNA, 19 bp, Homo sapiens
gcccaggccaggactctgc

SEQ ID NO: 4721571 - DNA, 20 bp, Homo sapiens
gcccaggccaggactctgca

SEQ ID NO: 4721572 - DNA, 21 bp, Homo sapiens
gcccaggccaggactctgcag

SEQ ID NO: 4721573 - DNA, 18 bp, Homo sapiens
gcccaggccatcttccag

SEQ ID NO: 4721574 - DNA, 23 bp, Homo sapiens
gcccaggccatcttccaggtggg

SEQ ID NO: 4721575 - DNA, 11 bp, Homo sapiens
gcccaggcccc

SEQ ID NO: 4721576 - DNA, 12 bp, Homo sapiens
gcccaggcccct

SEQ ID NO: 4721577 - DNA, 13 bp, Homo sapiens
gcccaggcccctg

SEQ ID NO: 4721578 - DNA, 15 bp, Homo sapiens
gcccaggcccctgcc

SEQ ID NO: 4721579 - DNA, 17 bp, Homo sapiens
gcccaggcccctgccac

SEQ ID NO: 4721580 - DNA, 22 bp, Homo sapiens
gcccaggcccctgccaccctgg

SEQ ID NO: 4721581 - DNA, 22 bp, Homo sapiens
gcccaggctggccagccccaca

SEQ ID NO: 4721582 - DNA, 16 bp, Homo sapiens
gcccaggctggcgtgc

SEQ ID NO: 4721583 - DNA, 19 bp, Homo sapiens
gcccaggctggcgtgcagt

SEQ ID NO: 4721584 - DNA, 19 bp, Homo sapiens
gcccaggcttagtcactga

SEQ ID NO: 4721585 - DNA, 23 bp, Homo sapiens
gcccaggtttctggtctctaggc

SEQ ID NO: 4721586 - DNA, 21 bp, Homo sapiens
gcccagttgggtggatgcctg

SEQ ID NO: 4721587 - DNA, 22 bp, Homo sapiens
gcccagttgggtggatgcctgg

SEQ ID NO: 4721588 - DNA, 14 bp, Homo sapiens
gcccatcagtgcca

SEQ ID NO: 4721589 - DNA, 16 bp, Homo sapiens
gcccatcagtgccagc

SEQ ID NO: 4721590 - DNA, 20 bp, Homo sapiens
gcccatcagtgccagcccct

SEQ ID NO: 4721591 - DNA, 20 bp, Homo sapiens
gcccatcagtgtacccccgc

SEQ ID NO: 4721592 - DNA, 22 bp, Homo sapiens
gcccatcagtgtacccccgccc

SEQ ID NO: 4721593 - DNA, 12 bp, Homo sapiens
gcccatcccccc

SEQ ID NO: 4721594 - DNA, 16 bp, Homo sapiens
gcccatcccccctcac

SEQ ID NO: 4721595 - DNA, 18 bp, Homo sapiens
gcccatcccccctcacca

SEQ ID NO: 4721596 - DNA, 20 bp, Homo sapiens
gcccatcccccctcaccagg

SEQ ID NO: 4721597 - DNA, 16 bp, Homo sapiens
gcccatgggcactgct

SEQ ID NO: 4721598 - DNA, 18 bp, Homo sapiens
gcccatgggcactgctgg

SEQ ID NO: 4721599 - DNA, 19 bp, Homo sapiens
gcccatgggcactgctggg

SEQ ID NO: 4721600 - DNA, 22 bp, Homo sapiens
gcccatgggcactgctgggtgg

SEQ ID NO: 4721601 - DNA, 19 bp, Homo sapiens
gcccattcattccattctg

SEQ ID NO: 4721602 - DNA, 23 bp, Homo sapiens
gcccattcattccattctggaag

SEQ ID NO: 4721603 - DNA, 16 bp, Homo sapiens
gcccattcctcacctt

SEQ ID NO: 4721604 - DNA, 19 bp, Homo sapiens
gccccaaaactctcctctg

SEQ ID NO: 4721605 - DNA, 14 bp, Homo sapiens
gccccaacccccag

SEQ ID NO: 4721606 - DNA, 16 bp, Homo sapiens
gccccaacccccagca

SEQ ID NO: 4721607 - DNA, 13 bp, Homo sapiens
gccccaaggggtg

SEQ ID NO: 4721608 - DNA, 17 bp, Homo sapiens
gccccacagcccacgtc

SEQ ID NO: 4721609 - DNA, 22 bp, Homo sapiens
gccccacccagatgggggaaag

SEQ ID NO: 4721610 - DNA, 21 bp, Homo sapiens
gccccaccccagggcagccag

SEQ ID NO: 4721611 - DNA, 19 bp, Homo sapiens
gccccagccctactctgtg

SEQ ID NO: 4721612 - DNA, 14 bp, Homo sapiens
gccccagcctggcc

SEQ ID NO: 4721613 - DNA, 17 bp, Homo sapiens
gccccagcctggcccag

SEQ ID NO: 4721614 - DNA, 12 bp, Homo sapiens
gccccagtgccc

SEQ ID NO: 4721615 - DNA, 14 bp, Homo sapiens
gccccagtgcccac

SEQ ID NO: 4721616 - DNA, 15 bp, Homo sapiens
gccccagtgcccaca

SEQ ID NO: 4721617 - DNA, 22 bp, Homo sapiens
gccccatcctctgtacagagcc

SEQ ID NO: 4721618 - DNA, 23 bp, Homo sapiens
gccccatcctctgtacagagccc

SEQ ID NO: 4721619 - DNA, 15 bp, Homo sapiens
gccccattcctggga

SEQ ID NO: 4721620 - DNA, 14 bp, Homo sapiens
gccccattctgcct

SEQ ID NO: 4721621 - DNA, 15 bp, Homo sapiens
gccccattctgcctg

SEQ ID NO: 4721622 - DNA, 17 bp, Homo sapiens
gccccattctgcctgcc

SEQ ID NO: 4721623 - DNA, 20 bp, Homo sapiens
gccccattctgcctgcccag

SEQ ID NO: 4721624 - DNA, 23 bp, Homo sapiens
gccccattctgcctgcccaggcc

SEQ ID NO: 4721625 - DNA, 22 bp, Homo sapiens
gcccccacgggacgcggcaggc

SEQ ID NO: 4721626 - DNA, 19 bp, Homo sapiens
gcccccactgcctttgacc

SEQ ID NO: 4721627 - DNA, 17 bp, Homo sapiens
gccccccatcctggccc

SEQ ID NO: 4721628 - DNA, 13 bp, Homo sapiens
gcccccctggcct

SEQ ID NO: 4721629 - DNA, 14 bp, Homo sapiens
gccccctctgccct

SEQ ID NO: 4721630 - DNA, 13 bp, Homo sapiens
gccccctgcagga

SEQ ID NO: 4721631 - DNA, 15 bp, Homo sapiens
gccccctgcaggaag

SEQ ID NO: 4721632 - DNA, 16 bp, Homo sapiens
gccccctgcaggaagg

SEQ ID NO: 4721633 - DNA, 21 bp, Homo sapiens
gcgcaggctggccctgccctg

SEQ ID NO: 4721634 - DNA, 18 bp, Homo sapiens
gcgccaaataatgtctct

SEQ ID NO: 4721635 - DNA, 20 bp, Homo sapiens
gcgcctacaggagtgagcac

SEQ ID NO: 4721636 - DNA, 21 bp, Homo sapiens
gcgcctacaggagtgagcact

SEQ ID NO: 4721637 - DNA, 19 bp, Homo sapiens
gcgctcctgccgcagagct

SEQ ID NO: 4721638 - DNA, 19 bp, Homo sapiens
gcggaatgaaccacatctt

SEQ ID NO: 4721639 - DNA, 16 bp, Homo sapiens
gcggacagccacggcc

SEQ ID NO: 4721640 - DNA, 15 bp, Homo sapiens
gcggcaggcttctca

SEQ ID NO: 4721641 - DNA, 12 bp, Homo sapiens
gcggggacagct

SEQ ID NO: 4721642 - DNA, 19 bp, Homo sapiens
gcggggcctgaggcaagcc

SEQ ID NO: 4721643 - DNA, 20 bp, Homo sapiens
gcgggtcacaggagggaggg

SEQ ID NO: 4721644 - DNA, 23 bp, Homo sapiens
gcggtccacccaggagccccgag

SEQ ID NO: 4721645 - DNA, 19 bp, Homo sapiens
gcggtgagaggggaacaga

SEQ ID NO: 4721646 - DNA, 18 bp, Homo sapiens
gcggttccggcatggaca

SEQ ID NO: 4721647 - DNA, 16 bp, Homo sapiens
gcgtcagtattttccc

SEQ ID NO: 4721648 - DNA, 14 bp, Homo sapiens
gcgtcctcctctgt

SEQ ID NO: 4721649 - DNA, 16 bp, Homo sapiens
gcgtcctcctctgtga

SEQ ID NO: 4721650 - DNA, 16 bp, Homo sapiens
gcgtgagccactgcac

SEQ ID NO: 4721651 - DNA, 14 bp, Homo sapiens
gcgtgcacacacca

SEQ ID NO: 4721652 - DNA, 20 bp, Homo sapiens
gcgtgcacacaccagagccc

SEQ ID NO: 4721653 - DNA, 23 bp, Homo sapiens
gcgtgcacacaccagagcccacc

SEQ ID NO: 4721654 - DNA, 21 bp, Homo sapiens
gcgtgctcagttcagaatcac

SEQ ID NO: 4721655 - DNA, 14 bp, Homo sapiens
gcgtggacaggtgt

SEQ ID NO: 4721656 - DNA, 12 bp, Homo sapiens
gcgtggagctgc

SEQ ID NO: 4721657 - DNA, 16 bp, Homo sapiens
gcgtggagctgcctga

SEQ ID NO: 4721658 - DNA, 12 bp, Homo sapiens
gcgtgtgtagag

SEQ ID NO: 4721659 - DNA, 20 bp, Homo sapiens
gcgtgtgtagagttaagaag

SEQ ID NO: 4721660 - DNA, 22 bp, Homo sapiens
gcgtgtgtagagttaagaagct

SEQ ID NO: 4721661 - DNA, 14 bp, Homo sapiens
gctaaaacctgagc

SEQ ID NO: 4721662 - DNA, 16 bp, Homo sapiens
gctaaaacctgagcta

SEQ ID NO: 4721663 - DNA, 12 bp, Homo sapiens
gctaaattttta

SEQ ID NO: 4721664 - DNA, 21 bp, Homo sapiens
gctaactagcttggaaactgg

SEQ ID NO: 4721665 - DNA, 16 bp, Homo sapiens
gctaaggcgtggagct

SEQ ID NO: 4721666 - DNA, 18 bp, Homo sapiens
gctaaggcgtggagctgc

SEQ ID NO: 4721667 - DNA, 20 bp, Homo sapiens
gctaaggcgtggagctgcct

SEQ ID NO: 4721668 - DNA, 18 bp, Homo sapiens
gctaagtgatcctcccac

SEQ ID NO: 4721669 - DNA, 15 bp, Homo sapiens
gctaatgggacacta

SEQ ID NO: 4721670 - DNA, 20 bp, Homo sapiens
gctaatttgttttggatata

SEQ ID NO: 4721671 - DNA, 16 bp, Homo sapiens
gctaatttttcatttt

SEQ ID NO: 4721672 - DNA, 18 bp, Homo sapiens
gctacaaaggaggacaag

SEQ ID NO: 4721673 - DNA, 17 bp, Homo sapiens
gctacacccttttccag

SEQ ID NO: 4721674 - DNA, 13 bp, Homo sapiens
gctacatcagttt

SEQ ID NO: 4721675 - DNA, 15 bp, Homo sapiens
gctacccgggaaggg

SEQ ID NO: 4721676 - DNA, 14 bp, Homo sapiens
gctaccctgagctg

SEQ ID NO: 4721677 - DNA, 19 bp, Homo sapiens
gctactgtcctacccaccc

SEQ ID NO: 4721678 - DNA, 20 bp, Homo sapiens
gctacttcttattcactttt

SEQ ID NO: 4721679 - DNA, 21 bp, Homo sapiens
gctacttcttattcacttttg

SEQ ID NO: 4721680 - DNA, 11 bp, Homo sapiens
gctagaaatga

SEQ ID NO: 4721681 - DNA, 19 bp, Homo sapiens
gctagaaccaagaagggct

SEQ ID NO: 4721682 - DNA, 20 bp, Homo sapiens
gctagaaccaagaagggcta

SEQ ID NO: 4721683 - DNA, 19 bp, Homo sapiens
gctagaacctggaagggct

SEQ ID NO: 4721684 - DNA, 19 bp, Homo sapiens
gctagaacctggagagcta

SEQ ID NO: 4721685 - DNA, 14 bp, Homo sapiens
gctagaagctggag

SEQ ID NO: 4721686 - DNA, 18 bp, Homo sapiens
gctagctatttctatgta

SEQ ID NO: 4721687 - DNA, 22 bp, Homo sapiens
gctagctatttctatgtatgtg

SEQ ID NO: 4721688 - DNA, 16 bp, Homo sapiens
gctagctcccctcctc

SEQ ID NO: 4721689 - DNA, 18 bp, Homo sapiens
gctagctcccctcctctc

SEQ ID NO: 4721690 - DNA, 16 bp, Homo sapiens
gctaggaacactcctt

SEQ ID NO: 4721691 - DNA, 14 bp, Homo sapiens
gctaggcctggcca

SEQ ID NO: 4721692 - DNA, 21 bp, Homo sapiens
gctagtcttcccttacctcaa

SEQ ID NO: 4721693 - DNA, 19 bp, Homo sapiens
gctagtgctgtaatattgt

SEQ ID NO: 4721694 - DNA, 21 bp, Homo sapiens
gctagtgtggtgtttcctggc

SEQ ID NO: 4721695 - DNA, 22 bp, Homo sapiens
gctagttatacttatttgtata

SEQ ID NO: 4721696 - DNA, 21 bp, Homo sapiens
gctagttgggcttcctcatag

SEQ ID NO: 4721697 - DNA, 18 bp, Homo sapiens
gctataacagtagggatg

SEQ ID NO: 4721698 - DNA, 21 bp, Homo sapiens
gctatagcaaaaatagttaaa

SEQ ID NO: 4721699 - DNA, 23 bp, Homo sapiens
gctatcaaaagaaatagaaaagg

SEQ ID NO: 4721700 - DNA, 16 bp, Homo sapiens
gctatcaagaaatgct

SEQ ID NO: 4721701 - DNA, 19 bp, Homo sapiens
gctatccagctatttttat

SEQ ID NO: 4721702 - DNA, 15 bp, Homo sapiens
gctatcctggctctt

SEQ ID NO: 4721703 - DNA, 20 bp, Homo sapiens
gctatctagcagtaaaagat

SEQ ID NO: 4721704 - DNA, 19 bp, Homo sapiens
gctatctcccccagcccca

SEQ ID NO: 4721705 - DNA, 21 bp, Homo sapiens
gctatctcccccagccccatc

SEQ ID NO: 4721706 - DNA, 13 bp, Homo sapiens
gctattagccagg

SEQ ID NO: 4721707 - DNA, 20 bp, Homo sapiens
gctattgtcaccagggctgg

SEQ ID NO: 4721708 - DNA, 16 bp, Homo sapiens
gctatttaatactaat

SEQ ID NO: 4721709 - DNA, 14 bp, Homo sapiens
gctatttctatgta

SEQ ID NO: 4721710 - DNA, 18 bp, Homo sapiens
gctatttctatgtatgtg

SEQ ID NO: 4721711 - DNA, 20 bp, Homo sapiens
gctcaagggaccctgggtgg

SEQ ID NO: 4721712 - DNA, 19 bp, Homo sapiens
gctcaagtcctcttttctg

SEQ ID NO: 4721713 - DNA, 21 bp, Homo sapiens
gctcaagtgttcacaacctgg

SEQ ID NO: 4721714 - DNA, 20 bp, Homo sapiens
gctcaatccatgttctattt

SEQ ID NO: 4721715 - DNA, 20 bp, Homo sapiens
gctcaatccctgaggactga

SEQ ID NO: 4721716 - DNA, 16 bp, Homo sapiens
gctcacatatctgtca

SEQ ID NO: 4721717 - DNA, 14 bp, Homo sapiens
gctcaccagcccca

SEQ ID NO: 4721718 - DNA, 20 bp, Homo sapiens
gctcaccagccccagtgccc

SEQ ID NO: 4721719 - DNA, 23 bp, Homo sapiens
gctcaccagccccagtgcccaca

SEQ ID NO: 4721720 - DNA, 16 bp, Homo sapiens
gctcacctctcccttg

SEQ ID NO: 4721721 - DNA, 17 bp, Homo sapiens
gctcacctctcccttgg

SEQ ID NO: 4721722 - DNA, 14 bp, Homo sapiens
gctcactgcagcct

SEQ ID NO: 4721723 - DNA, 15 bp, Homo sapiens
gctcactgcagcctc

SEQ ID NO: 4721724 - DNA, 16 bp, Homo sapiens
gctcactgcagcctca

SEQ ID NO: 4721725 - DNA, 16 bp, Homo sapiens
gctcagagaggacaaa

SEQ ID NO: 4721726 - DNA, 13 bp, Homo sapiens
gctcagagagggc

SEQ ID NO: 4721727 - DNA, 20 bp, Homo sapiens
gctcagagagggtgggagtg

SEQ ID NO: 4721728 - DNA, 17 bp, Homo sapiens
gctcagccagccccatc

SEQ ID NO: 4721729 - DNA, 22 bp, Homo sapiens
gctcagccccaccccagggcag

SEQ ID NO: 4721730 - DNA, 18 bp, Homo sapiens
gctcagcggggacagctc

SEQ ID NO: 4721731 - DNA, 23 bp, Homo sapiens
gctcagcggggacagctccttct

SEQ ID NO: 4721732 - DNA, 16 bp, Homo sapiens
gctcaggaccaggcaa

SEQ ID NO: 4721733 - DNA, 16 bp, Homo sapiens
gctcagggaccacagc

SEQ ID NO: 4721734 - DNA, 17 bp, Homo sapiens
gctcagggcctggctca

SEQ ID NO: 4721735 - DNA, 14 bp, Homo sapiens
gctcaggtgtccct

SEQ ID NO: 4721736 - DNA, 17 bp, Homo sapiens
gctcaggtgtccctgca

SEQ ID NO: 4721737 - DNA, 16 bp, Homo sapiens
gctcatcattctctgt

SEQ ID NO: 4721738 - DNA, 19 bp, Homo sapiens
gctcatcattctctgtctc

SEQ ID NO: 4721739 - DNA, 13 bp, Homo sapiens
gctccaaaccctc

SEQ ID NO: 4721740 - DNA, 16 bp, Homo sapiens
gctccaaaccctcgag

SEQ ID NO: 4721741 - DNA, 13 bp, Homo sapiens
gctccaagctccc

SEQ ID NO: 4721742 - DNA, 21 bp, Homo sapiens
gctccaagctcccaggcattc

SEQ ID NO: 4721743 - DNA, 12 bp, Homo sapiens
gctccacagtgt

SEQ ID NO: 4721744 - DNA, 21 bp, Homo sapiens
gctccagacacatgtccaaga

SEQ ID NO: 4721745 - DNA, 12 bp, Homo sapiens
gctccagagggc

SEQ ID NO: 4721746 - DNA, 12 bp, Homo sapiens
gctccagcctga

SEQ ID NO: 4721747 - DNA, 17 bp, Homo sapiens
gctccagctggccggga

SEQ ID NO: 4721748 - DNA, 23 bp, Homo sapiens
gctccagctggccgggagcctga

SEQ ID NO: 4721749 - DNA, 11 bp, Homo sapiens
gctccaggagc

SEQ ID NO: 4721750 - DNA, 13 bp, Homo sapiens
gctccaggcaggc

SEQ ID NO: 4721751 - DNA, 12 bp, Homo sapiens
gctccaggctcc

SEQ ID NO: 4721752 - DNA, 13 bp, Homo sapiens
gctccaggctcct

SEQ ID NO: 4721753 - DNA, 16 bp, Homo sapiens
gctccaggctccttta

SEQ ID NO: 4721754 - DNA, 19 bp, Homo sapiens
gctcccaagagcttccaga

SEQ ID NO: 4721755 - DNA, 13 bp, Homo sapiens
gctcccacagaac

SEQ ID NO: 4721756 - DNA, 19 bp, Homo sapiens
gctcccacagaacacagca

SEQ ID NO: 4721757 - DNA, 21 bp, Homo sapiens
gctcccaggcattccccagga

SEQ ID NO: 4721758 - DNA, 22 bp, Homo sapiens
gctcccaggcattccccaggag

SEQ ID NO: 4721759 - DNA, 13 bp, Homo sapiens
gctcccagtgtct

SEQ ID NO: 4721760 - DNA, 14 bp, Homo sapiens
gctcccctccccaa

SEQ ID NO: 4721761 - DNA, 13 bp, Homo sapiens
gctcccctcctct

SEQ ID NO: 4721762 - DNA, 18 bp, Homo sapiens
gctccctgactgggagtt

SEQ ID NO: 4721763 - DNA, 19 bp, Homo sapiens
gctcctctccccagcaagt

SEQ ID NO: 4721764 - DNA, 14 bp, Homo sapiens
gctcctgctccaca

SEQ ID NO: 4721765 - DNA, 11 bp, Homo sapiens
gctcctgctgc

SEQ ID NO: 4721766 - DNA, 12 bp, Homo sapiens
gctcctgctgca

SEQ ID NO: 4721767 - DNA, 14 bp, Homo sapiens
gctcctgctgcacc

SEQ ID NO: 4721768 - DNA, 13 bp, Homo sapiens
gctcctgtgccct

SEQ ID NO: 4721769 - DNA, 23 bp, Homo sapiens
gctccttcccaggagtggaggag

SEQ ID NO: 4721770 - DNA, 23 bp, Homo sapiens
gctccttcctggagactgcccag

SEQ ID NO: 4721771 - DNA, 15 bp, Homo sapiens
gctccttctgtccta

SEQ ID NO: 4721772 - DNA, 14 bp, Homo sapiens
gctccttgggccct

SEQ ID NO: 4721773 - DNA, 17 bp, Homo sapiens
gctccttgggccctttg

SEQ ID NO: 4721774 - DNA, 15 bp, Homo sapiens
gctcgaagaaaataa

SEQ ID NO: 4721775 - DNA, 19 bp, Homo sapiens
gctcgagcatgcctggatg

SEQ ID NO: 4721776 - DNA, 13 bp, Homo sapiens
gctcgggcccagg

SEQ ID NO: 4721777 - DNA, 16 bp, Homo sapiens
gctctaagaagctgca

SEQ ID NO: 4721778 - DNA, 21 bp, Homo sapiens
gctctaagaagctgcaataaa

SEQ ID NO: 4721779 - DNA, 17 bp, Homo sapiens
gctctacacaacatgta

SEQ ID NO: 4721780 - DNA, 16 bp, Homo sapiens
gctctatctgcaatgt

SEQ ID NO: 4721781 - DNA, 16 bp, Homo sapiens
gctctccaaaccactt

SEQ ID NO: 4721782 - DNA, 17 bp, Homo sapiens
gctctccaaaccacttt

SEQ ID NO: 4721783 - DNA, 19 bp, Homo sapiens
gctctccgaccagacacct

SEQ ID NO: 4721784 - DNA, 11 bp, Homo sapiens
gctctccttcc

SEQ ID NO: 4721785 - DNA, 16 bp, Homo sapiens
gctctgaaaccagtgt

SEQ ID NO: 4721786 - DNA, 21 bp, Homo sapiens
gctctgacccacagcctccaa

SEQ ID NO: 4721787 - DNA, 18 bp, Homo sapiens
gctctgaggcccgatctc

SEQ ID NO: 4721788 - DNA, 17 bp, Homo sapiens
gctctgatcatccactg

SEQ ID NO: 4721789 - DNA, 21 bp, Homo sapiens
gctctgatcatccactgtgcc

SEQ ID NO: 4721790 - DNA, 23 bp, Homo sapiens
gctctgatcatccactgtgccat

SEQ ID NO: 4721791 - DNA, 22 bp, Homo sapiens
gctctgatccctctacagagct

SEQ ID NO: 4721792 - DNA, 23 bp, Homo sapiens
gctctgatccctctacagagctt

SEQ ID NO: 4721793 - DNA, 15 bp, Homo sapiens
gctctgcaccttctg

SEQ ID NO: 4721794 - DNA, 22 bp, Homo sapiens
gctctgccaacttcttcagagc

SEQ ID NO: 4721795 - DNA, 23 bp, Homo sapiens
gctctgccaacttcttcagagct

SEQ ID NO: 4721796 - DNA, 14 bp, Homo sapiens
gctctgcccttggt

SEQ ID NO: 4721797 - DNA, 13 bp, Homo sapiens
gctctgctcctct

SEQ ID NO: 4721798 - DNA, 14 bp, Homo sapiens
gctctgctcctctc

SEQ ID NO: 4721799 - DNA, 19 bp, Homo sapiens
gctctgctcctctccccag

SEQ ID NO: 4721800 - DNA, 18 bp, Homo sapiens
gctctgctgacagacaca

SEQ ID NO: 4721801 - DNA, 19 bp, Homo sapiens
gctctgctgacagacacag

SEQ ID NO: 4721802 - DNA, 15 bp, Homo sapiens
gctctggcctccaag

SEQ ID NO: 4721803 - DNA, 17 bp, Homo sapiens
gctctggcctccaagtc

SEQ ID NO: 4721804 - DNA, 16 bp, Homo sapiens
gctctggtccatagag

SEQ ID NO: 4721805 - DNA, 19 bp, Homo sapiens
gctctgtatcaggacccag

SEQ ID NO: 4721806 - DNA, 14 bp, Homo sapiens
gctctgtcctggga

SEQ ID NO: 4721807 - DNA, 15 bp, Homo sapiens
gctctgtcctgggag

SEQ ID NO: 4721808 - DNA, 22 bp, Homo sapiens
gctcttccaggctgggagagcc

SEQ ID NO: 4721809 - DNA, 22 bp, Homo sapiens
gctcttctcatttcacccctcc

SEQ ID NO: 4721810 - DNA, 19 bp, Homo sapiens
gctcttgaactcctgacct

SEQ ID NO: 4721811 - DNA, 14 bp, Homo sapiens
gctctttggagatc

SEQ ID NO: 4721812 - DNA, 15 bp, Homo sapiens
gctgaactcatgaga

SEQ ID NO: 4721813 - DNA, 12 bp, Homo sapiens
gctgaaggactg

SEQ ID NO: 4721814 - DNA, 14 bp, Homo sapiens
gctgaaggactgtg

SEQ ID NO: 4721815 - DNA, 22 bp, Homo sapiens
gctgaaggactgtgacaggcag

SEQ ID NO: 4721816 - DNA, 18 bp, Homo sapiens
gctgaaggctgaggcagg

SEQ ID NO: 4721817 - DNA, 17 bp, Homo sapiens
gctgacacaaacctgcc

SEQ ID NO: 4721818 - DNA, 19 bp, Homo sapiens
gctgacagacacaggcccg

SEQ ID NO: 4721819 - DNA, 21 bp, Homo sapiens
gctgacagacacaggcccggc

SEQ ID NO: 4721820 - DNA, 12 bp, Homo sapiens
gctgacagtcct

SEQ ID NO: 4721821 - DNA, 12 bp, Homo sapiens
gctgagcctcag

SEQ ID NO: 4721822 - DNA, 23 bp, Homo sapiens
gctgagcgaggagatgctccttg

SEQ ID NO: 4721823 - DNA, 17 bp, Homo sapiens
gctgagtcccaggctga

SEQ ID NO: 4721824 - DNA, 22 bp, Homo sapiens
gctgagtcccaggctgagcctc

SEQ ID NO: 4721825 - DNA, 19 bp, Homo sapiens
gctgagtctgaaggctggg

SEQ ID NO: 4721826 - DNA, 20 bp, Homo sapiens
gctgatgtcctcaccacatg

SEQ ID NO: 4721827 - DNA, 22 bp, Homo sapiens
gctgatgtttataaactgagag

SEQ ID NO: 4721828 - DNA, 11 bp, Homo sapiens
gctgatttttt

SEQ ID NO: 4721829 - DNA, 22 bp, Homo sapiens
gctgcaaagggtatcaggtgct

SEQ ID NO: 4721830 - DNA, 17 bp, Homo sapiens
gctgcaccaacccagcc

SEQ ID NO: 4721831 - DNA, 21 bp, Homo sapiens
gctgcaccaacccagccgctg

SEQ ID NO: 4721832 - DNA, 23 bp, Homo sapiens
gctgcaccaacccagccgctgcc

SEQ ID NO: 4721833 - DNA, 13 bp, Homo sapiens
gctgcaccggctg

SEQ ID NO: 4721834 - DNA, 15 bp, Homo sapiens
gctgcactctgtgcc

SEQ ID NO: 4721835 - DNA, 18 bp, Homo sapiens
gctgcactctgtgcccat

SEQ ID NO: 4721836 - DNA, 20 bp, Homo sapiens
gctgcactctgtgcccatgg

SEQ ID NO: 4721837 - DNA, 12 bp, Homo sapiens
gctgcagagggg

SEQ ID NO: 4721838 - DNA, 15 bp, Homo sapiens
gctgcagaggggcag

SEQ ID NO: 4721839 - DNA, 19 bp, Homo sapiens
gctgcagaggggcaggccc

SEQ ID NO: 4721840 - DNA, 21 bp, Homo sapiens
gctgcagaggggcaggccctg

SEQ ID NO: 4721841 - DNA, 23 bp, Homo sapiens
gctgcagaggggcaggccctgca

SEQ ID NO: 4721842 - DNA, 23 bp, Homo sapiens
gctgcagatttgatatttgcatt

SEQ ID NO: 4721843 - DNA, 18 bp, Homo sapiens
gctgcagatttgggctgg

SEQ ID NO: 4721844 - DNA, 16 bp, Homo sapiens
gctgcagcagggcagg

SEQ ID NO: 4721845 - DNA, 22 bp, Homo sapiens
gctgcagtcacgtgtaaacagg

SEQ ID NO: 4721846 - DNA, 14 bp, Homo sapiens
gctgcagttgccag

SEQ ID NO: 4721847 - DNA, 17 bp, Homo sapiens
gctgcagttgccagtca

SEQ ID NO: 4721848 - DNA, 12 bp, Homo sapiens
gctgccatccag

SEQ ID NO: 4721849 - DNA, 21 bp, Homo sapiens
gctgccatccaggttcagctt

SEQ ID NO: 4721850 - DNA, 16 bp, Homo sapiens
gctgcccctccctgcc

SEQ ID NO: 4721851 - DNA, 17 bp, Homo sapiens
gctgcccctccctgcct

SEQ ID NO: 4721852 - DNA, 13 bp, Homo sapiens
ggacaaaataaag

SEQ ID NO: 4721853 - DNA, 14 bp, Homo sapiens
ggacaaaataaagt

SEQ ID NO: 4721854 - DNA, 22 bp, Homo sapiens
ggacaaaataaagtgtgtgtgc

SEQ ID NO: 4721855 - DNA, 16 bp, Homo sapiens
ggacacagatgaaaca

SEQ ID NO: 4721856 - DNA, 12 bp, Homo sapiens
ggacacagctct

SEQ ID NO: 4721857 - DNA, 13 bp, Homo sapiens
ggacacagctctt

SEQ ID NO: 4721858 - DNA, 14 bp, Homo sapiens
ggacacagctcttc

SEQ ID NO: 4721859 - DNA, 15 bp, Homo sapiens
ggacacagctcttct

SEQ ID NO: 4721860 - DNA, 18 bp, Homo sapiens
ggacacagctcttctcca

SEQ ID NO: 4721861 - DNA, 16 bp, Homo sapiens
ggacaccacccagagc

SEQ ID NO: 4721862 - DNA, 22 bp, Homo sapiens
ggacaccacccagagcaccctc

SEQ ID NO: 4721863 - DNA, 23 bp, Homo sapiens
ggacaccacccagagcaccctct

SEQ ID NO: 4721864 - DNA, 12 bp, Homo sapiens
ggacaccctgtg

SEQ ID NO: 4721865 - DNA, 18 bp, Homo sapiens
ggacacttctcaggaaat

SEQ ID NO: 4721866 - DNA, 14 bp, Homo sapiens
ggacagaagcagct

SEQ ID NO: 4721867 - DNA, 21 bp, Homo sapiens
ggacagaggttatctgtccca

SEQ ID NO: 4721868 - DNA, 21 bp, Homo sapiens
ggacagcagaagggggagacc

SEQ ID NO: 4721869 - DNA, 21 bp, Homo sapiens
ggacagccacggccaggccag

SEQ ID NO: 4721870 - DNA, 17 bp, Homo sapiens
ggacagctccttctgtc

SEQ ID NO: 4721871 - DNA, 16 bp, Homo sapiens
ggacatgctgaagcca

SEQ ID NO: 4721872 - DNA, 17 bp, Homo sapiens
ggacatggtctgtcctg

SEQ ID NO: 4721873 - DNA, 19 bp, Homo sapiens
ggaccaagggcagaggggt

SEQ ID NO: 4721874 - DNA, 12 bp, Homo sapiens
ggaccagcctgg

SEQ ID NO: 4721875 - DNA, 17 bp, Homo sapiens
ggaccagcttttcccaa

SEQ ID NO: 4721876 - DNA, 16 bp, Homo sapiens
ggaccccacccctcat

SEQ ID NO: 4721877 - DNA, 23 bp, Homo sapiens
ggacccctgcattggaactggag

SEQ ID NO: 4721878 - DNA, 14 bp, Homo sapiens
ggaccctgaggccc

SEQ ID NO: 4721879 - DNA, 18 bp, Homo sapiens
ggaccctgaggcccagag

SEQ ID NO: 4721880 - DNA, 19 bp, Homo sapiens
ggaccctgaggcccagagg

SEQ ID NO: 4721881 - DNA, 17 bp, Homo sapiens
ggaccggagagtggggg

SEQ ID NO: 4721882 - DNA, 19 bp, Homo sapiens
ggaccggagagtgggggtg

SEQ ID NO: 4721883 - DNA, 15 bp, Homo sapiens
ggacctctcttgtga

SEQ ID NO: 4721884 - DNA, 16 bp, Homo sapiens
ggacctgatggagagt

SEQ ID NO: 4721885 - DNA, 15 bp, Homo sapiens
ggaccttgaactggg

SEQ ID NO: 4721886 - DNA, 16 bp, Homo sapiens
ggacgcaggcccctct

SEQ ID NO: 4721887 - DNA, 19 bp, Homo sapiens
ggacgcaggcccctctcct

SEQ ID NO: 4721888 - DNA, 13 bp, Homo sapiens
ggacgcggcaggc

SEQ ID NO: 4721889 - DNA, 17 bp, Homo sapiens
ggacgctacccgggaag

SEQ ID NO: 4721890 - DNA, 13 bp, Homo sapiens
ggacggggccggc

SEQ ID NO: 4721891 - DNA, 20 bp, Homo sapiens
ggacggtgctccaggcaggc

SEQ ID NO: 4721892 - DNA, 14 bp, Homo sapiens
ggactacaggtgtg

SEQ ID NO: 4721893 - DNA, 14 bp, Homo sapiens
ggactagaacctgg

SEQ ID NO: 4721894 - DNA, 14 bp, Homo sapiens
ggactcaggaactt

SEQ ID NO: 4721895 - DNA, 17 bp, Homo sapiens
ggactctcagtctctga

SEQ ID NO: 4721896 - DNA, 20 bp, Homo sapiens
ggactctcagtctctgagca

SEQ ID NO: 4721897 - DNA, 13 bp, Homo sapiens
ggactctgcagcc

SEQ ID NO: 4721898 - DNA, 14 bp, Homo sapiens
ggactctgcagcct

SEQ ID NO: 4721899 - DNA, 17 bp, Homo sapiens
ggactctgcagcctcag

SEQ ID NO: 4721900 - DNA, 13 bp, Homo sapiens
ggactgaggcctg

SEQ ID NO: 4721901 - DNA, 23 bp, Homo sapiens
ggactgggccacttctgggtggg

SEQ ID NO: 4721902 - DNA, 22 bp, Homo sapiens
ggactggtaaaatacatataaa

SEQ ID NO: 4721903 - DNA, 19 bp, Homo sapiens
ggactgtgacaggcagcag

SEQ ID NO: 4721904 - DNA, 13 bp, Homo sapiens
ggacttatttaaa

SEQ ID NO: 4721905 - DNA, 19 bp, Homo sapiens
ggacttgcaaaaagggtca

SEQ ID NO: 4721906 - DNA, 14 bp, Homo sapiens
ggacttggaagctc

SEQ ID NO: 4721907 - DNA, 24 bp, Homo sapiens
ggagaaagcttggttctgtgaaca

SEQ ID NO: 4721908 - DNA, 13 bp, Homo sapiens
ggagaagaagaat

SEQ ID NO: 4721909 - DNA, 19 bp, Homo sapiens
ggagaatgcacagtgggtg

SEQ ID NO: 4721910 - DNA, 13 bp, Homo sapiens
ggagactgggctg

SEQ ID NO: 4721911 - DNA, 23 bp, Homo sapiens
ggagactgggctgagggagcctg

SEQ ID NO: 4721912 - DNA, 19 bp, Homo sapiens
ggagagaactgagcatctc

SEQ ID NO: 4721913 - DNA, 22 bp, Homo sapiens
ggagagagcagcttctgccact

SEQ ID NO: 4721914 - DNA, 21 bp, Homo sapiens
ggagagccagaacctggaggg

SEQ ID NO: 4721915 - DNA, 20 bp, Homo sapiens
ggagagcccaggagctcccc

SEQ ID NO: 4721916 - DNA, 18 bp, Homo sapiens
ggagagccttccaggggt

SEQ ID NO: 4721917 - DNA, 20 bp, Homo sapiens
ggagagctagaacctggagg

SEQ ID NO: 4721918 - DNA, 13 bp, Homo sapiens
ggagaggatgaga

SEQ ID NO: 4721919 - DNA, 22 bp, Homo sapiens
ggagaggatgagagcccagagg

SEQ ID NO: 4721920 - DNA, 21 bp, Homo sapiens
ggagaggctagaaccaagaag

SEQ ID NO: 4721921 - DNA, 21 bp, Homo sapiens
ggagagggctacaaaggagga

SEQ ID NO: 4721922 - DNA, 13 bp, Homo sapiens
ggagagtgagagc

SEQ ID NO: 4721923 - DNA, 14 bp, Homo sapiens
ggagagtgagagca

SEQ ID NO: 4721924 - DNA, 15 bp, Homo sapiens
ggagatgctccttgg

SEQ ID NO: 4721925 - DNA, 18 bp, Homo sapiens
ggagatgtctctgtgtgt

SEQ ID NO: 4721926 - DNA, 14 bp, Homo sapiens
ggagcaaaggctga

SEQ ID NO: 4721927 - DNA, 12 bp, Homo sapiens
ggagcagagggg

SEQ ID NO: 4721928 - DNA, 13 bp, Homo sapiens
ggagcagccacat

SEQ ID NO: 4721929 - DNA, 15 bp, Homo sapiens
ggagcatggctgtga

SEQ ID NO: 4721930 - DNA, 17 bp, Homo sapiens
ggagcatggctgtgagg

SEQ ID NO: 4721931 - DNA, 16 bp, Homo sapiens
ggagccggtggcggtg

SEQ ID NO: 4721932 - DNA, 12 bp, Homo sapiens
ggagcctggtgc

SEQ ID NO: 4721933 - DNA, 16 bp, Homo sapiens
ggagctcccctcccca

SEQ ID NO: 4721934 - DNA, 17 bp, Homo sapiens
ggagctcccctccccaa

SEQ ID NO: 4721935 - DNA, 21 bp, Homo sapiens
ggagctgcctgttcagctcca

SEQ ID NO: 4721936 - DNA, 21 bp, Homo sapiens
ggagctggccgtgggcctggg

SEQ ID NO: 4721937 - DNA, 18 bp, Homo sapiens
ggagctgtaaaccagaga

SEQ ID NO: 4721938 - DNA, 22 bp, Homo sapiens
ggagctgttactgaatattaaa

SEQ ID NO: 4721939 - DNA, 20 bp, Homo sapiens
ggagctgttctctgtcgtga

SEQ ID NO: 4721940 - DNA, 23 bp, Homo sapiens
ggaggaaggaaacccagctctgg

SEQ ID NO: 4721941 - DNA, 21 bp, Homo sapiens
ggaggacaagaccctctcagg

SEQ ID NO: 4721942 - DNA, 13 bp, Homo sapiens
ggaggagcccagg

SEQ ID NO: 4721943 - DNA, 21 bp, Homo sapiens
ggaggagcctgggggctcctc

SEQ ID NO: 4721944 - DNA, 13 bp, Homo sapiens
ggaggaggagggt

SEQ ID NO: 4721945 - DNA, 12 bp, Homo sapiens
ggaggaggcctg

SEQ ID NO: 4721946 - DNA, 19 bp, Homo sapiens
ggaggagggtcggtgcctt

SEQ ID NO: 4721947 - DNA, 15 bp, Homo sapiens
ggaggatgttctggg

SEQ ID NO: 4721948 - DNA, 20 bp, Homo sapiens
ggaggcagaggttgcagtga

SEQ ID NO: 4721949 - DNA, 11 bp, Homo sapiens
ggaggccagcc

SEQ ID NO: 4721950 - DNA, 13 bp, Homo sapiens
ggaggccagcctt

SEQ ID NO: 4721951 - DNA, 14 bp, Homo sapiens
ggaggcctgggggc

SEQ ID NO: 4721952 - DNA, 18 bp, Homo sapiens
ggaggcctgggggcaggg

SEQ ID NO: 4721953 - DNA, 15 bp, Homo sapiens
ggaggctggctgggg

SEQ ID NO: 4721954 - DNA, 18 bp, Homo sapiens
ggagggaaactgtgaatg

SEQ ID NO: 4721955 - DNA, 19 bp, Homo sapiens
ggagggccacatgggaggc

SEQ ID NO: 4721956 - DNA, 13 bp, Homo sapiens
ggagggcctgggc

SEQ ID NO: 4721957 - DNA, 19 bp, Homo sapiens
ggagggctagaacctggag

SEQ ID NO: 4721958 - DNA, 20 bp, Homo sapiens
ggagggctagaatctggaga

SEQ ID NO: 4721959 - DNA, 12 bp, Homo sapiens
ggagggctccag

SEQ ID NO: 4721960 - DNA, 20 bp, Homo sapiens
ggagggctggaatctggaga

SEQ ID NO: 4721961 - DNA, 23 bp, Homo sapiens
ggaggggcccgcttgcctcggct

SEQ ID NO: 4721962 - DNA, 17 bp, Homo sapiens
ggcgcaccctcccctcc

SEQ ID NO: 4721963 - DNA, 11 bp, Homo sapiens
ggcgccctctg

SEQ ID NO: 4721964 - DNA, 19 bp, Homo sapiens
ggcggccagccctcccagc

SEQ ID NO: 4721965 - DNA, 20 bp, Homo sapiens
ggcggccagccctcccagca

SEQ ID NO: 4721966 - DNA, 15 bp, Homo sapiens
ggcgggcagcacagc

SEQ ID NO: 4721967 - DNA, 20 bp, Homo sapiens
ggcgggtggatcacaaggtc

SEQ ID NO: 4721968 - DNA, 21 bp, Homo sapiens
ggcgtcctctccctcctggcc

SEQ ID NO: 4721969 - DNA, 16 bp, Homo sapiens
ggcgtgagacctgccc

SEQ ID NO: 4721970 - DNA, 14 bp, Homo sapiens
ggcgtgcagtggtg

SEQ ID NO: 4721971 - DNA, 15 bp, Homo sapiens
ggcgtggagctgcct

SEQ ID NO: 4721972 - DNA, 18 bp, Homo sapiens
ggctaattagaaatcaac

SEQ ID NO: 4721973 - DNA, 16 bp, Homo sapiens
ggctagaacctggaga

SEQ ID NO: 4721974 - DNA, 14 bp, Homo sapiens
ggctagaatctgga

SEQ ID NO: 4721975 - DNA, 16 bp, Homo sapiens
ggctaggacccctcca

SEQ ID NO: 4721976 - DNA, 23 bp, Homo sapiens
ggctagtgtggtgtttcctggca

SEQ ID NO: 4721977 - DNA, 16 bp, Homo sapiens
ggctagttgggcttcc

SEQ ID NO: 4721978 - DNA, 16 bp, Homo sapiens
ggctatcaaaagaaat

SEQ ID NO: 4721979 - DNA, 12 bp, Homo sapiens
ggctcacactga

SEQ ID NO: 4721980 - DNA, 18 bp, Homo sapiens
ggctcacactgagaatgt

SEQ ID NO: 4721981 - DNA, 22 bp, Homo sapiens
ggctcacccccttctccatcca

SEQ ID NO: 4721982 - DNA, 13 bp, Homo sapiens
ggctcactgcagc

SEQ ID NO: 4721983 - DNA, 15 bp, Homo sapiens
ggctcactgcagcct

SEQ ID NO: 4721984 - DNA, 17 bp, Homo sapiens
ggctcactgcagcctca

SEQ ID NO: 4721985 - DNA, 16 bp, Homo sapiens
ggctcactgcatcctc

SEQ ID NO: 4721986 - DNA, 19 bp, Homo sapiens
ggctcactgcatcctccgc

SEQ ID NO: 4721987 - DNA, 15 bp, Homo sapiens
ggctcagagaggaca

SEQ ID NO: 4721988 - DNA, 16 bp, Homo sapiens
ggctcagagaggacaa

SEQ ID NO: 4721989 - DNA, 20 bp, Homo sapiens
ggctcagcggggacagctcc

SEQ ID NO: 4721990 - DNA, 21 bp, Homo sapiens
ggctcagcggggacagctcct

SEQ ID NO: 4721991 - DNA, 14 bp, Homo sapiens
ggctcagggaccac

SEQ ID NO: 4721992 - DNA, 16 bp, Homo sapiens
ggctcagggaccacag

SEQ ID NO: 4721993 - DNA, 18 bp, Homo sapiens
ggctcagggaccacagca

SEQ ID NO: 4721994 - DNA, 19 bp, Homo sapiens
ggctcaggtggggtcactc

SEQ ID NO: 4721995 - DNA, 13 bp, Homo sapiens
ggctcatcagaac

SEQ ID NO: 4721996 - DNA, 16 bp, Homo sapiens
ggctcatcagaactga

SEQ ID NO: 4721997 - DNA, 17 bp, Homo sapiens
ggctccaaaccctcgag

SEQ ID NO: 4721998 - DNA, 9 bp, Homo sapiens
ggctccaga

SEQ ID NO: 4721999 - DNA, 16 bp, Homo sapiens
ggctccagagggcact

SEQ ID NO: 4722000 - DNA, 22 bp, Homo sapiens
ggctccagagggcactctgctt

SEQ ID NO: 4722001 - DNA, 12 bp, Homo sapiens
ggctccaggagc

SEQ ID NO: 4722002 - DNA, 14 bp, Homo sapiens
ggctccaggagcag

SEQ ID NO: 4722003 - DNA, 11 bp, Homo sapiens
ggctccaggct

SEQ ID NO: 4722004 - DNA, 16 bp, Homo sapiens
ggctccaggctccttt

SEQ ID NO: 4722005 - DNA, 17 bp, Homo sapiens
ggctccctgactgggag

SEQ ID NO: 4722006 - DNA, 18 bp, Homo sapiens
ggctccctgactgggagt

SEQ ID NO: 4722007 - DNA, 20 bp, Homo sapiens
ggctccctgtaacctcttca

SEQ ID NO: 4722008 - DNA, 21 bp, Homo sapiens
ggctccctgtaacctcttcag

SEQ ID NO: 4722009 - DNA, 16 bp, Homo sapiens
ggctcccttcccacct

SEQ ID NO: 4722010 - DNA, 20 bp, Homo sapiens
ggctcccttcccacctctct

SEQ ID NO: 4722011 - DNA, 23 bp, Homo sapiens
ggctcctgctgcaccaacccagc

SEQ ID NO: 4722012 - DNA, 14 bp, Homo sapiens
ggctcctgtgccct

SEQ ID NO: 4722013 - DNA, 17 bp, Homo sapiens
ggctcctgtgcccttat

SEQ ID NO: 4722014 - DNA, 22 bp, Homo sapiens
ggctcgaagaaaataattctct

SEQ ID NO: 4722015 - DNA, 15 bp, Homo sapiens
ggctctgcacccagc

SEQ ID NO: 4722016 - DNA, 15 bp, Homo sapiens
ggctctgcctcccat

SEQ ID NO: 4722017 - DNA, 16 bp, Homo sapiens
ggctctgcctcccatc

SEQ ID NO: 4722018 - DNA, 17 bp, Homo sapiens
ggctctgcctcccatca

SEQ ID NO: 4722019 - DNA, 14 bp, Homo sapiens
ggctcttccaggct

SEQ ID NO: 4722020 - DNA, 24 bp, Homo sapiens
ggctcttccaggctgggagagcct

SEQ ID NO: 4722021 - DNA, 12 bp, Homo sapiens
ggctcttctcat

SEQ ID NO: 4722022 - DNA, 13 bp, Homo sapiens
ggctgaaagacag

SEQ ID NO: 4722023 - DNA, 18 bp, Homo sapiens
ggctgaaggactgtgaca

SEQ ID NO: 4722024 - DNA, 14 bp, Homo sapiens
ggctgagaacactg

SEQ ID NO: 4722025 - DNA, 17 bp, Homo sapiens
ggctgagagagtggcat

SEQ ID NO: 4722026 - DNA, 22 bp, Homo sapiens
ggctgatcatttggctcttttt

SEQ ID NO: 4722027 - DNA, 19 bp, Homo sapiens
ggctgcaccggctggcctg

SEQ ID NO: 4722028 - DNA, 17 bp, Homo sapiens
ggctgcactctgtgccc

SEQ ID NO: 4722029 - DNA, 20 bp, Homo sapiens
ggctgcactctgtgcccatg

SEQ ID NO: 4722030 - DNA, 12 bp, Homo sapiens
ggctgcagggag

SEQ ID NO: 4722031 - DNA, 17 bp, Homo sapiens
ggctgcagggagtccga

SEQ ID NO: 4722032 - DNA, 13 bp, Homo sapiens
ggctgcccgctcc

SEQ ID NO: 4722033 - DNA, 16 bp, Homo sapiens
ggctgcccgctcccag

SEQ ID NO: 4722034 - DNA, 22 bp, Homo sapiens
ggctgcccgctcccagtgtctt

SEQ ID NO: 4722035 - DNA, 14 bp, Homo sapiens
ggctgccctttctg

SEQ ID NO: 4722036 - DNA, 17 bp, Homo sapiens
ggctgcctccactccca

SEQ ID NO: 4722037 - DNA, 22 bp, Homo sapiens
ggctgcggaatgaaccacatct

SEQ ID NO: 4722038 - DNA, 15 bp, Homo sapiens
ggctgctgaaggctc

SEQ ID NO: 4722039 - DNA, 14 bp, Homo sapiens
ggctgctgcccagg

SEQ ID NO: 4722040 - DNA, 13 bp, Homo sapiens
ggctgctggcctg

SEQ ID NO: 4722041 - DNA, 13 bp, Homo sapiens
ggctggaatctgg

SEQ ID NO: 4722042 - DNA, 16 bp, Homo sapiens
ggctggaatctggaga

SEQ ID NO: 4722043 - DNA, 20 bp, Homo sapiens
ggctggaatctggagagcta

SEQ ID NO: 4722044 - DNA, 13 bp, Homo sapiens
ggctggactgagg

SEQ ID NO: 4722045 - DNA, 16 bp, Homo sapiens
ggctggactgaggcct

SEQ ID NO: 4722046 - DNA, 18 bp, Homo sapiens
ggctggactgaggcctga

SEQ ID NO: 4722047 - DNA, 11 bp, Homo sapiens
ggctggaggag

SEQ ID NO: 4722048 - DNA, 16 bp, Homo sapiens
ggctggaggagcccag

SEQ ID NO: 4722049 - DNA, 17 bp, Homo sapiens
ggctggaggagcccagg

SEQ ID NO: 4722050 - DNA, 15 bp, Homo sapiens
ggctggatgggggct

SEQ ID NO: 4722051 - DNA, 16 bp, Homo sapiens
ggctggcactgctggg

SEQ ID NO: 4722052 - DNA, 12 bp, Homo sapiens
ggctggccagcc

SEQ ID NO: 4722053 - DNA, 13 bp, Homo sapiens
ggctggccagccc

SEQ ID NO: 4722054 - DNA, 17 bp, Homo sapiens
ggctggccagccccaca

SEQ ID NO: 4722055 - DNA, 16 bp, Homo sapiens
ggctggccctgccctg

SEQ ID NO: 4722056 - DNA, 14 bp, Homo sapiens
ggctggcctggccc

SEQ ID NO: 4722057 - DNA, 13 bp, Homo sapiens
ggctggctggggc

SEQ ID NO: 4722058 - DNA, 13 bp, Homo sapiens
ggctgggagagcc

SEQ ID NO: 4722059 - DNA, 18 bp, Homo sapiens
ggctgggagagccttcca

SEQ ID NO: 4722060 - DNA, 20 bp, Homo sapiens
ggctgggagagccttccagg

SEQ ID NO: 4722061 - DNA, 13 bp, Homo sapiens
ggctgggagtggt

SEQ ID NO: 4722062 - DNA, 15 bp, Homo sapiens
ggctgggagtggtgg

SEQ ID NO: 4722063 - DNA, 18 bp, Homo sapiens
ggctgggcttcagtggca

SEQ ID NO: 4722064 - DNA, 20 bp, Homo sapiens
ggctggggcctatcagtgtg

SEQ ID NO: 4722065 - DNA, 14 bp, Homo sapiens
ggctgggggcctca

SEQ ID NO: 4722066 - DNA, 16 bp, Homo sapiens
ggctgggggcctcagt

SEQ ID NO: 4722067 - DNA, 17 bp, Homo sapiens
ggctgggggcctcagtg

SEQ ID NO: 4722068 - DNA, 19 bp, Homo sapiens
ggctgggggcctcagtgcc

SEQ ID NO: 4722069 - DNA, 17 bp, Homo sapiens
ggctggtgcctgaagac

SEQ ID NO: 4722070 - DNA, 16 bp, Homo sapiens
ggctggtgtcacctga

SEQ ID NO: 4722071 - DNA, 22 bp, Homo sapiens
ggctggttcggatttggggtgg

SEQ ID NO: 4722072 - DNA, 18 bp, Homo sapiens
ggctgtatcccatgagcc

SEQ ID NO: 4722073 - DNA, 22 bp, Homo sapiens
ggtccctggtggcagctcacct

SEQ ID NO: 4722074 - DNA, 14 bp, Homo sapiens
ggtcctgctgcagt

SEQ ID NO: 4722075 - DNA, 23 bp, Homo sapiens
ggtcctgctgcagttgccagtca

SEQ ID NO: 4722076 - DNA, 10 bp, Homo sapiens
ggtccttcaa

SEQ ID NO: 4722077 - DNA, 13 bp, Homo sapiens
ggtcggaccagct

SEQ ID NO: 4722078 - DNA, 12 bp, Homo sapiens
ggtcgggagagg

SEQ ID NO: 4722079 - DNA, 14 bp, Homo sapiens
ggtcggtgccttca

SEQ ID NO: 4722080 - DNA, 20 bp, Homo sapiens
ggtctcacgcaacacatttt

SEQ ID NO: 4722081 - DNA, 20 bp, Homo sapiens
ggtctccatgaagaagctgg

SEQ ID NO: 4722082 - DNA, 23 bp, Homo sapiens
ggtctcgctgatgctgggctggg

SEQ ID NO: 4722083 - DNA, 12 bp, Homo sapiens
ggtctctgctgc

SEQ ID NO: 4722084 - DNA, 18 bp, Homo sapiens
ggtctgctcgggcccagg

SEQ ID NO: 4722085 - DNA, 21 bp, Homo sapiens
ggtcttgaactcctggcctca

SEQ ID NO: 4722086 - DNA, 13 bp, Homo sapiens
ggtctttgtaaga

SEQ ID NO: 4722087 - DNA, 14 bp, Homo sapiens
ggtctttgtaagag

SEQ ID NO: 4722088 - DNA, 19 bp, Homo sapiens
ggtctttgtaagagtgtag

SEQ ID NO: 4722089 - DNA, 21 bp, Homo sapiens
ggtgacagagtgagactctgt

SEQ ID NO: 4722090 - DNA, 15 bp, Homo sapiens
ggtgacatgtgaaac

SEQ ID NO: 4722091 - DNA, 21 bp, Homo sapiens
ggtgaccaaaatccccttctc

SEQ ID NO: 4722092 - DNA, 16 bp, Homo sapiens
ggtgacctctgcctga

SEQ ID NO: 4722093 - DNA, 22 bp, Homo sapiens
ggtgagcccatggccctcccag

SEQ ID NO: 4722094 - DNA, 20 bp, Homo sapiens
ggtgaggcagtgggtcccac

SEQ ID NO: 4722095 - DNA, 21 bp, Homo sapiens
ggtgatccactcgccttcatc

SEQ ID NO: 4722096 - DNA, 19 bp, Homo sapiens
ggtgatggggctgagcagg

SEQ ID NO: 4722097 - DNA, 22 bp, Homo sapiens
ggtgcgaccccatctgcccagg

SEQ ID NO: 4722098 - DNA, 21 bp, Homo sapiens
ggtgctatctcccccagcccc

SEQ ID NO: 4722099 - DNA, 21 bp, Homo sapiens
ggtgctgccatccaggttcag

SEQ ID NO: 4722100 - DNA, 23 bp, Homo sapiens
ggtgctgtgacaccccccttctg

SEQ ID NO: 4722101 - DNA, 15 bp, Homo sapiens
ggtggacatggcccc

SEQ ID NO: 4722102 - DNA, 13 bp, Homo sapiens
ggtggagggccac

SEQ ID NO: 4722103 - DNA, 23 bp, Homo sapiens
ggtggagggccacatgggaggct

SEQ ID NO: 4722104 - DNA, 14 bp, Homo sapiens
ggtggatgcctggt

SEQ ID NO: 4722105 - DNA, 14 bp, Homo sapiens
ggtggatggtgact

SEQ ID NO: 4722106 - DNA, 15 bp, Homo sapiens
ggtggatggtgactt

SEQ ID NO: 4722107 - DNA, 19 bp, Homo sapiens
ggtggcagtgggagctgcc

SEQ ID NO: 4722108 - DNA, 13 bp, Homo sapiens
ggtggcccatccc

SEQ ID NO: 4722109 - DNA, 22 bp, Homo sapiens
ggtggcccatcccccctcacca

SEQ ID NO: 4722110 - DNA, 18 bp, Homo sapiens
ggtggccctctcccctgc

SEQ ID NO: 4722111 - DNA, 19 bp, Homo sapiens
ggtggccctctcccctgcc

SEQ ID NO: 4722112 - DNA, 19 bp, Homo sapiens
ggtggctcacacctgtaat

SEQ ID NO: 4722113 - DNA, 13 bp, Homo sapiens
ggtgggacaccct

SEQ ID NO: 4722114 - DNA, 16 bp, Homo sapiens
ggtgggacaccctgtg

SEQ ID NO: 4722115 - DNA, 19 bp, Homo sapiens
ggtgggatcctccaggtgc

SEQ ID NO: 4722116 - DNA, 20 bp, Homo sapiens
ggtgggcgggcagcacagca

SEQ ID NO: 4722117 - DNA, 10 bp, Homo sapiens
ggtgggggta

SEQ ID NO: 4722118 - DNA, 15 bp, Homo sapiens
ggtggggtcactctg

SEQ ID NO: 4722119 - DNA, 17 bp, Homo sapiens
ggtgggtccatgggcag

SEQ ID NO: 4722120 - DNA, 22 bp, Homo sapiens
ggtggtctgctcgggcccaggc

SEQ ID NO: 4722121 - DNA, 15 bp, Homo sapiens
ggtgtcgcgccttct

SEQ ID NO: 4722122 - DNA, 21 bp, Homo sapiens
ggtgtcgcgccttctcccccc

SEQ ID NO: 4722123 - DNA, 18 bp, Homo sapiens
ggtgtgagtcaccaagcc

SEQ ID NO: 4722124 - DNA, 16 bp, Homo sapiens
ggtgtgtgtctctgac

SEQ ID NO: 4722125 - DNA, 18 bp, Homo sapiens
ggtgtgtgttcaccttca

SEQ ID NO: 4722126 - DNA, 17 bp, Homo sapiens
ggtgttgacatgtgctt

SEQ ID NO: 4722127 - DNA, 20 bp, Homo sapiens
ggttaacaataaagtgacaa

SEQ ID NO: 4722128 - DNA, 21 bp, Homo sapiens
ggttagtggatggaaggggct

SEQ ID NO: 4722129 - DNA, 13 bp, Homo sapiens
ggttatgaatatt

SEQ ID NO: 4722130 - DNA, 14 bp, Homo sapiens
ggttatgatggaaa

SEQ ID NO: 4722131 - DNA, 17 bp, Homo sapiens
ggttatttaatcacagt

SEQ ID NO: 4722132 - DNA, 12 bp, Homo sapiens
ggttcagcttgt

SEQ ID NO: 4722133 - DNA, 21 bp, Homo sapiens
ggttccgcttggagcagaggg

SEQ ID NO: 4722134 - DNA, 20 bp, Homo sapiens
ggttcggatttggggtggat

SEQ ID NO: 4722135 - DNA, 14 bp, Homo sapiens
ggttcttctctttt

SEQ ID NO: 4722136 - DNA, 11 bp, Homo sapiens
ggttgaagaaa

SEQ ID NO: 4722137 - DNA, 15 bp, Homo sapiens
ggttgaccccagagg

SEQ ID NO: 4722138 - DNA, 11 bp, Homo sapiens
ggttgaggaaa

SEQ ID NO: 4722139 - DNA, 15 bp, Homo sapiens
ggttggcgcaccctc

SEQ ID NO: 4722140 - DNA, 15 bp, Homo sapiens
ggttgggctgtgcct

SEQ ID NO: 4722141 - DNA, 16 bp, Homo sapiens
ggttgggctgtgcctg

SEQ ID NO: 4722142 - DNA, 17 bp, Homo sapiens
ggtttaagaaatagaat

SEQ ID NO: 4722143 - DNA, 17 bp, Homo sapiens
ggtttacaacaaacact

SEQ ID NO: 4722144 - DNA, 18 bp, Homo sapiens
ggtttacaacaaacactg

SEQ ID NO: 4722145 - DNA, 19 bp, Homo sapiens
ggtttacaacaaacactgt

SEQ ID NO: 4722146 - DNA, 20 bp, Homo sapiens
ggtttcagttctgtgtacat

SEQ ID NO: 4722147 - DNA, 20 bp, Homo sapiens
ggtttcccttgccctttcca

SEQ ID NO: 4722148 - DNA, 16 bp, Homo sapiens
ggtttcctgccctggg

SEQ ID NO: 4722149 - DNA, 19 bp, Homo sapiens
ggtttcctgccctgggagg

SEQ ID NO: 4722150 - DNA, 15 bp, Homo sapiens
ggtttctggtctcta

SEQ ID NO: 4722151 - DNA, 15 bp, Homo sapiens
ggtttgaagcctgga

SEQ ID NO: 4722152 - DNA, 15 bp, Homo sapiens
ggtttgaatataaac

SEQ ID NO: 4722153 - DNA, 16 bp, Homo sapiens
ggtttgaccaggaaag

SEQ ID NO: 4722154 - DNA, 22 bp, Homo sapiens
ggtttgttattcttttccagaa

SEQ ID NO: 4722155 - DNA, 21 bp, Homo sapiens
ggttttaggtctcttcccctc

SEQ ID NO: 4722156 - DNA, 14 bp, Homo sapiens
ggttttgttcccct

SEQ ID NO: 4722157 - DNA, 22 bp, Homo sapiens
ggttttgttcccctcctccact

SEQ ID NO: 4722158 - DNA, 13 bp, Homo sapiens
gtaaaaaaaaatg

SEQ ID NO: 4722159 - DNA, 14 bp, Homo sapiens
gtaaaaataaaatt

SEQ ID NO: 4722160 - DNA, 23 bp, Homo sapiens
gtaaaagataaatttgttgaata

SEQ ID NO: 4722161 - DNA, 16 bp, Homo sapiens
gtaaaataaaaggtcg

SEQ ID NO: 4722162 - DNA, 18 bp, Homo sapiens
gtaaaatcttcagctggt

SEQ ID NO: 4722163 - DNA, 21 bp, Homo sapiens
gtaaaatcttcagctggtgga

SEQ ID NO: 4722164 - DNA, 15 bp, Homo sapiens
gtaaatactggactc

SEQ ID NO: 4722165 - DNA, 14 bp, Homo sapiens
gtaaatagatttta

SEQ ID NO: 4722166 - DNA, 21 bp, Homo sapiens
gtaaatctgaagaaagttatt

SEQ ID NO: 4722167 - DNA, 22 bp, Homo sapiens
gtaaatgaacacatggcagaaa

SEQ ID NO: 4722168 - DNA, 15 bp, Homo sapiens
gtaaatgttatgact

SEQ ID NO: 4722169 - DNA, 17 bp, Homo sapiens
gtaaatgttatgactcc

SEQ ID NO: 4722170 - DNA, 16 bp, Homo sapiens
gtaacaagccacccca

SEQ ID NO: 4722171 - DNA, 18 bp, Homo sapiens
gtaacagaacagcttcag

SEQ ID NO: 4722172 - DNA, 13 bp, Homo sapiens
gtaacatatctgt

SEQ ID NO: 4722173 - DNA, 23 bp, Homo sapiens
gtaacatgtgttaagtattttca

SEQ ID NO: 4722174 - DNA, 14 bp, Homo sapiens
gtaactgtgtcatg

SEQ ID NO: 4722175 - DNA, 18 bp, Homo sapiens
gtaacttccaaataaata

SEQ ID NO: 4722176 - DNA, 13 bp, Homo sapiens
gtaagaaaacaaa

SEQ ID NO: 4722177 - DNA, 13 bp, Homo sapiens
gtaagagcacagg

SEQ ID NO: 4722178 - DNA, 15 bp, Homo sapiens
gtaagagtgtagaag

SEQ ID NO: 4722179 - DNA, 20 bp, Homo sapiens
gtaagcttagattttctgta

SEQ ID NO: 4722180 - DNA, 19 bp, Homo sapiens
gtaaggatccggaaagaag

SEQ ID NO: 4722181 - DNA, 23 bp, Homo sapiens
gtaagggggggatcgaaaagaag

SEQ ID NO: 4722182 - DNA, 22 bp, Homo sapiens
gtaagtagcaaccctgtgatac

SEQ ID NO: 4722183 - DNA, 15 bp, Homo sapiens
gtctcctctcagccc

SEQ ID NO: 4722184 - DNA, 16 bp, Homo sapiens
gtctccttaacactga

SEQ ID NO: 4722185 - DNA, 19 bp, Homo sapiens
gtctcgaactcctgacctt

SEQ ID NO: 4722186 - DNA, 20 bp, Homo sapiens
gtctcgctgatgctgggctg

SEQ ID NO: 4722187 - DNA, 22 bp, Homo sapiens
gtctcggtggtaccaggtctcc

SEQ ID NO: 4722188 - DNA, 13 bp, Homo sapiens
gtctcgtggtagg

SEQ ID NO: 4722189 - DNA, 14 bp, Homo sapiens
gtctctaggctggg

SEQ ID NO: 4722190 - DNA, 15 bp, Homo sapiens
gtctctaggctgggg

SEQ ID NO: 4722191 - DNA, 19 bp, Homo sapiens
gtctctggaagaagagcag

SEQ ID NO: 4722192 - DNA, 12 bp, Homo sapiens
gtctctggcctg

SEQ ID NO: 4722193 - DNA, 13 bp, Homo sapiens
gtctctggcctgt

SEQ ID NO: 4722194 - DNA, 23 bp, Homo sapiens
gtctctgggtttacaacaaacac

SEQ ID NO: 4722195 - DNA, 17 bp, Homo sapiens
gtctcttggtcctgctg

SEQ ID NO: 4722196 - DNA, 19 bp, Homo sapiens
gtctcttggtcctgctgca

SEQ ID NO: 4722197 - DNA, 12 bp, Homo sapiens
gtctgacaggca

SEQ ID NO: 4722198 - DNA, 13 bp, Homo sapiens
gtctgacaggcaa

SEQ ID NO: 4722199 - DNA, 15 bp, Homo sapiens
gtctgacaggcaatg

SEQ ID NO: 4722200 - DNA, 20 bp, Homo sapiens
gtctgacaggcaatgctggc

SEQ ID NO: 4722201 - DNA, 23 bp, Homo sapiens
gtctgacaggcaatgctggctgt

SEQ ID NO: 4722202 - DNA, 13 bp, Homo sapiens
gtctgacccactg

SEQ ID NO: 4722203 - DNA, 18 bp, Homo sapiens
gtctgattcccaagctct

SEQ ID NO: 4722204 - DNA, 18 bp, Homo sapiens
gtctgggtccaggcctgg

SEQ ID NO: 4722205 - DNA, 19 bp, Homo sapiens
gtctgtgtggcaaattaaa

SEQ ID NO: 4722206 - DNA, 21 bp, Homo sapiens
gtctgtgtggcaaattaaaca

SEQ ID NO: 4722207 - DNA, 21 bp, Homo sapiens
gtcttatgcttccattaacaa

SEQ ID NO: 4722208 - DNA, 17 bp, Homo sapiens
gtcttcccttacctcaa

SEQ ID NO: 4722209 - DNA, 12 bp, Homo sapiens
gtcttctattta

SEQ ID NO: 4722210 - DNA, 12 bp, Homo sapiens
gtcttctcccca

SEQ ID NO: 4722211 - DNA, 16 bp, Homo sapiens
gtcttgaactcctggc

SEQ ID NO: 4722212 - DNA, 21 bp, Homo sapiens
gtcttgaactcctggcctcaa

SEQ ID NO: 4722213 - DNA, 16 bp, Homo sapiens
gtcttgcaatggcagc

SEQ ID NO: 4722214 - DNA, 16 bp, Homo sapiens
gtctttcacatttaaa

SEQ ID NO: 4722215 - DNA, 16 bp, Homo sapiens
gtctttctttgctgct

SEQ ID NO: 4722216 - DNA, 15 bp, Homo sapiens
gtctttggaccctga

SEQ ID NO: 4722217 - DNA, 13 bp, Homo sapiens
gtctttgtaagag

SEQ ID NO: 4722218 - DNA, 20 bp, Homo sapiens
gtctttgtaagagtgtagaa

SEQ ID NO: 4722219 - DNA, 16 bp, Homo sapiens
gtcttttttcactaca

SEQ ID NO: 4722220 - DNA, 13 bp, Homo sapiens
gtgaaaccttttt

SEQ ID NO: 4722221 - DNA, 17 bp, Homo sapiens
gtgaaaccttttttaag

SEQ ID NO: 4722222 - DNA, 19 bp, Homo sapiens
gtgaaaccttttttaagat

SEQ ID NO: 4722223 - DNA, 21 bp, Homo sapiens
gtgaaaccttttttaagattt

SEQ ID NO: 4722224 - DNA, 22 bp, Homo sapiens
gtgaaaccttttttaagatttt

SEQ ID NO: 4722225 - DNA, 12 bp, Homo sapiens
gtgaacatttta

SEQ ID NO: 4722226 - DNA, 19 bp, Homo sapiens
gtgaaccaccacacccagc

SEQ ID NO: 4722227 - DNA, 19 bp, Homo sapiens
gtgaagagggaagccagga

SEQ ID NO: 4722228 - DNA, 17 bp, Homo sapiens
gtgaagcaccaagctca

SEQ ID NO: 4722229 - DNA, 22 bp, Homo sapiens
gtgaaggcttctctctgtggga

SEQ ID NO: 4722230 - DNA, 22 bp, Homo sapiens
gtgaatgcttctgatttagcaa

SEQ ID NO: 4722231 - DNA, 14 bp, Homo sapiens
gtgaatggattgga

SEQ ID NO: 4722232 - DNA, 20 bp, Homo sapiens
gtgaatggattggattattt

SEQ ID NO: 4722233 - DNA, 16 bp, Homo sapiens
gtgaatttaagcatga

SEQ ID NO: 4722234 - DNA, 16 bp, Homo sapiens
gtgacaacacttgtgt

SEQ ID NO: 4722235 - DNA, 20 bp, Homo sapiens
gtgacaaggattgctactgt

SEQ ID NO: 4722236 - DNA, 14 bp, Homo sapiens
gtgacaataaaaca

SEQ ID NO: 4722237 - DNA, 20 bp, Homo sapiens
gtgacaccaataaatgtttg

SEQ ID NO: 4722238 - DNA, 23 bp, Homo sapiens
gtgacaccaataaatgtttgtta

SEQ ID NO: 4722239 - DNA, 19 bp, Homo sapiens
gtgacaccccccttctgaa

SEQ ID NO: 4722240 - DNA, 13 bp, Homo sapiens
gtgacagaggcag

SEQ ID NO: 4722241 - DNA, 16 bp, Homo sapiens
gtgacagaggcagccc

SEQ ID NO: 4722242 - DNA, 19 bp, Homo sapiens
gtgacagaggcagccccat

SEQ ID NO: 4722243 - DNA, 15 bp, Homo sapiens
gtgacaggaaagatt

SEQ ID NO: 4722244 - DNA, 16 bp, Homo sapiens
gtgacaggcagcagag

SEQ ID NO: 4722245 - DNA, 14 bp, Homo sapiens
gtgacatgtgaaac

SEQ ID NO: 4722246 - DNA, 16 bp, Homo sapiens
gtgacatgtgaaacct

SEQ ID NO: 4722247 - DNA, 19 bp, Homo sapiens
gtgacatgtgaaacctttt

SEQ ID NO: 4722248 - DNA, 12 bp, Homo sapiens
gtgaccccaggt

SEQ ID NO: 4722249 - DNA, 19 bp, Homo sapiens
gtgaccccttttcagcttc

SEQ ID NO: 4722250 - DNA, 20 bp, Homo sapiens
gtgaccccttttcagcttct

SEQ ID NO: 4722251 - DNA, 23 bp, Homo sapiens
gtgaccccttttcagcttctgct

SEQ ID NO: 4722252 - DNA, 12 bp, Homo sapiens
gtgacctctgcc

SEQ ID NO: 4722253 - DNA, 19 bp, Homo sapiens
gtgactcgggctcctgtgc

SEQ ID NO: 4722254 - DNA, 21 bp, Homo sapiens
gtgactcgggctcctgtgccc

SEQ ID NO: 4722255 - DNA, 18 bp, Homo sapiens
gtgactttggctgcatgc

SEQ ID NO: 4722256 - DNA, 20 bp, Homo sapiens
gtgagaagggctcagagagg

SEQ ID NO: 4722257 - DNA, 22 bp, Homo sapiens
gtgagaagggctcagagaggac

SEQ ID NO: 4722258 - DNA, 23 bp, Homo sapiens
gtgagaagggctcagagaggaca

SEQ ID NO: 4722259 - DNA, 18 bp, Homo sapiens
gtgagacagtccagcctg

SEQ ID NO: 4722260 - DNA, 19 bp, Homo sapiens
gtgagacagtccagcctgg

SEQ ID NO: 4722261 - DNA, 20 bp, Homo sapiens
gtgagacagtccagcctgga

SEQ ID NO: 4722262 - DNA, 15 bp, Homo sapiens
gtgagacccaggagc

SEQ ID NO: 4722263 - DNA, 14 bp, Homo sapiens
gtgagactctgtct

SEQ ID NO: 4722264 - DNA, 20 bp, Homo sapiens
gtgagatggacttggggcct

SEQ ID NO: 4722265 - DNA, 15 bp, Homo sapiens
gtgagccaccacgcc

SEQ ID NO: 4722266 - DNA, 21 bp, Homo sapiens
gtgagccaccgtgcctggcca

SEQ ID NO: 4722267 - DNA, 13 bp, Homo sapiens
gtgagccactgca

SEQ ID NO: 4722268 - DNA, 14 bp, Homo sapiens
gtgagccactgcac

SEQ ID NO: 4722269 - DNA, 20 bp, Homo sapiens
gtgagccactgcaccgggcc

SEQ ID NO: 4722270 - DNA, 23 bp, Homo sapiens
gtgagccatagagatatttaaaa

SEQ ID NO: 4722271 - DNA, 18 bp, Homo sapiens
gtgagcccatggccctcc

SEQ ID NO: 4722272 - DNA, 19 bp, Homo sapiens
gtgagccgagatcacgcca

SEQ ID NO: 4722273 - DNA, 16 bp, Homo sapiens
gtgagctcctaagcca

SEQ ID NO: 4722274 - DNA, 16 bp, Homo sapiens
gtgaggaagccgctgg

SEQ ID NO: 4722275 - DNA, 23 bp, Homo sapiens
gtgaggattaaataatgtaaata

SEQ ID NO: 4722276 - DNA, 15 bp, Homo sapiens
gtgaggccagggcag

SEQ ID NO: 4722277 - DNA, 16 bp, Homo sapiens
gtgaggctctgccctt

SEQ ID NO: 4722278 - DNA, 18 bp, Homo sapiens
gtgaggctctgcccttgg

SEQ ID NO: 4722279 - DNA, 14 bp, Homo sapiens
gtgagggagagaac

SEQ ID NO: 4722280 - DNA, 15 bp, Homo sapiens
gtgagggcaccacca

SEQ ID NO: 4722281 - DNA, 19 bp, Homo sapiens
gtgagggcaccaccaagaa

SEQ ID NO: 4722282 - DNA, 21 bp, Homo sapiens
gtgatatggtactaaggagaa

SEQ ID NO: 4722283 - DNA, 15 bp, Homo sapiens
gtgatcactgagcca

SEQ ID NO: 4722284 - DNA, 22 bp, Homo sapiens
gtgatccacccacctcagcctc

SEQ ID NO: 4722285 - DNA, 15 bp, Homo sapiens
gtgatcctcccacct

SEQ ID NO: 4722286 - DNA, 20 bp, Homo sapiens
gtgattcacagtgtgaatct

SEQ ID NO: 4722287 - DNA, 20 bp, Homo sapiens
gtgattctcctgcctcagcc

SEQ ID NO: 4722288 - DNA, 16 bp, Homo sapiens
gtgattgggacagagg

SEQ ID NO: 4722289 - DNA, 18 bp, Homo sapiens
gtgatttcccgtggcccc

SEQ ID NO: 4722290 - DNA, 19 bp, Homo sapiens
gtgcaatgggggagggagg

SEQ ID NO: 4722291 - DNA, 16 bp, Homo sapiens
gtgcacaagctccaag

SEQ ID NO: 4722292 - DNA, 23 bp, Homo sapiens
gtgcacaagctccaagctcccag

SEQ ID NO: 4722293 - DNA, 15 bp, Homo sapiens
gttccccttccactg

SEQ ID NO: 4722294 - DNA, 22 bp, Homo sapiens
gttcccttttttggctgctgaa

SEQ ID NO: 4722295 - DNA, 23 bp, Homo sapiens
gttccgcccactcattccttctc

SEQ ID NO: 4722296 - DNA, 17 bp, Homo sapiens
gttccttcctctgagcc

SEQ ID NO: 4722297 - DNA, 19 bp, Homo sapiens
gttccttcctctgagcctt

SEQ ID NO: 4722298 - DNA, 23 bp, Homo sapiens
gttcctttagaaagcagttaccc

SEQ ID NO: 4722299 - DNA, 19 bp, Homo sapiens
gttctaagtctttccattg

SEQ ID NO: 4722300 - DNA, 16 bp, Homo sapiens
gttctcatctttcttg

SEQ ID NO: 4722301 - DNA, 14 bp, Homo sapiens
gttctctgaggaca

SEQ ID NO: 4722302 - DNA, 16 bp, Homo sapiens
gttctctgaggacact

SEQ ID NO: 4722303 - DNA, 12 bp, Homo sapiens
gttctctgccct

SEQ ID NO: 4722304 - DNA, 13 bp, Homo sapiens
gttctctgccctc

SEQ ID NO: 4722305 - DNA, 18 bp, Homo sapiens
gttctgatgatgtgcctg

SEQ ID NO: 4722306 - DNA, 15 bp, Homo sapiens
gttctgctcatcatt

SEQ ID NO: 4722307 - DNA, 13 bp, Homo sapiens
gttctgctctaag

SEQ ID NO: 4722308 - DNA, 20 bp, Homo sapiens
gttctggctcttccaggctg

SEQ ID NO: 4722309 - DNA, 16 bp, Homo sapiens
gttctgggacacagtt

SEQ ID NO: 4722310 - DNA, 17 bp, Homo sapiens
gttctgtatattttgtt

SEQ ID NO: 4722311 - DNA, 18 bp, Homo sapiens
gttctgtcccttggagct

SEQ ID NO: 4722312 - DNA, 15 bp, Homo sapiens
gttctgtgtacattt

SEQ ID NO: 4722313 - DNA, 14 bp, Homo sapiens
gttcttaccttttg

SEQ ID NO: 4722314 - DNA, 22 bp, Homo sapiens
gttctttaaccctcactgggac

SEQ ID NO: 4722315 - DNA, 13 bp, Homo sapiens
gttgaagaaaaca

SEQ ID NO: 4722316 - DNA, 21 bp, Homo sapiens
gttgaggtccagccctggctg

SEQ ID NO: 4722317 - DNA, 12 bp, Homo sapiens
gttgataaaaac

SEQ ID NO: 4722318 - DNA, 18 bp, Homo sapiens
gttgataattttttaatt

SEQ ID NO: 4722319 - DNA, 17 bp, Homo sapiens
gttgatactgttgcacg

SEQ ID NO: 4722320 - DNA, 22 bp, Homo sapiens
gttgatgatctttgcagacagg

SEQ ID NO: 4722321 - DNA, 23 bp, Homo sapiens
gttgatgatctttgcagacaggc

SEQ ID NO: 4722322 - DNA, 16 bp, Homo sapiens
gttgattcatattgca

SEQ ID NO: 4722323 - DNA, 20 bp, Homo sapiens
gttgattcatattgcatcat

SEQ ID NO: 4722324 - DNA, 14 bp, Homo sapiens
gttgcaccattctt

SEQ ID NO: 4722325 - DNA, 21 bp, Homo sapiens
gttgcacgtgtgtttttctat

SEQ ID NO: 4722326 - DNA, 22 bp, Homo sapiens
gttgcacgtgtgtttttctatt

SEQ ID NO: 4722327 - DNA, 20 bp, Homo sapiens
gttgcataaacaatccaaat

SEQ ID NO: 4722328 - DNA, 13 bp, Homo sapiens
gttgccagtcacc

SEQ ID NO: 4722329 - DNA, 16 bp, Homo sapiens
gttgccagtcaccccg

SEQ ID NO: 4722330 - DNA, 18 bp, Homo sapiens
gttgccagtcaccccggc

SEQ ID NO: 4722331 - DNA, 23 bp, Homo sapiens
gttgccagtcaccccggccacct

SEQ ID NO: 4722332 - DNA, 14 bp, Homo sapiens
gttgcccaggcagg

SEQ ID NO: 4722333 - DNA, 19 bp, Homo sapiens
gttgcccaggcaggtcttg

SEQ ID NO: 4722334 - DNA, 15 bp, Homo sapiens
gttgcctttatttgc

SEQ ID NO: 4722335 - DNA, 12 bp, Homo sapiens
gttgctgcctca

SEQ ID NO: 4722336 - DNA, 20 bp, Homo sapiens
gttgctggttataagcagca

SEQ ID NO: 4722337 - DNA, 22 bp, Homo sapiens
gttggaagctagctcccctcct

SEQ ID NO: 4722338 - DNA, 22 bp, Homo sapiens
gttggaggtttcacttgcacat

SEQ ID NO: 4722339 - DNA, 20 bp, Homo sapiens
gttggatttttgtcttgtgt

SEQ ID NO: 4722340 - DNA, 18 bp, Homo sapiens
gttggcagtgtttgtata

SEQ ID NO: 4722341 - DNA, 19 bp, Homo sapiens
gttggccaggctgctcttg

SEQ ID NO: 4722342 - DNA, 19 bp, Homo sapiens
gttggccaggctggtctca

SEQ ID NO: 4722343 - DNA, 13 bp, Homo sapiens
gttggcccctgcc

SEQ ID NO: 4722344 - DNA, 18 bp, Homo sapiens
gttggcgagaggaggggc

SEQ ID NO: 4722345 - DNA, 12 bp, Homo sapiens
gttggctggcct

SEQ ID NO: 4722346 - DNA, 19 bp, Homo sapiens
gttggctgggggcctcagt

SEQ ID NO: 4722347 - DNA, 23 bp, Homo sapiens
gttggctgggggcctcagtgcca

SEQ ID NO: 4722348 - DNA, 21 bp, Homo sapiens
gttgggccatactggcctcgc

SEQ ID NO: 4722349 - DNA, 16 bp, Homo sapiens
gttgggctgtgcctgg

SEQ ID NO: 4722350 - DNA, 17 bp, Homo sapiens
gttgggctgtgcctggg

SEQ ID NO: 4722351 - DNA, 18 bp, Homo sapiens
gttggtcccccttccatg

SEQ ID NO: 4722352 - DNA, 18 bp, Homo sapiens
gttggtgcaattaactct

SEQ ID NO: 4722353 - DNA, 19 bp, Homo sapiens
gttgtacaattaagttaca

SEQ ID NO: 4722354 - DNA, 18 bp, Homo sapiens
gttgtacatttatgattt

SEQ ID NO: 4722355 - DNA, 16 bp, Homo sapiens
gttgtataaaaacatg

SEQ ID NO: 4722356 - DNA, 16 bp, Homo sapiens
gttgtctccctggccc

SEQ ID NO: 4722357 - DNA, 21 bp, Homo sapiens
gttgtggaaagataataaatt

SEQ ID NO: 4722358 - DNA, 16 bp, Homo sapiens
gttgttccaaatgtgt

SEQ ID NO: 4722359 - DNA, 12 bp, Homo sapiens
gtttaatggtag

SEQ ID NO: 4722360 - DNA, 17 bp, Homo sapiens
gtttaatggtagtttta

SEQ ID NO: 4722361 - DNA, 20 bp, Homo sapiens
gtttaatggtagttttacag

SEQ ID NO: 4722362 - DNA, 14 bp, Homo sapiens
gtttacaacaaaca

SEQ ID NO: 4722363 - DNA, 19 bp, Homo sapiens
gtttaccgtagcgtataca

SEQ ID NO: 4722364 - DNA, 22 bp, Homo sapiens
gtttactagggatccctcatct

SEQ ID NO: 4722365 - DNA, 17 bp, Homo sapiens
gtttagatgaatgtcag

SEQ ID NO: 4722366 - DNA, 13 bp, Homo sapiens
gtttataaactga

SEQ ID NO: 4722367 - DNA, 12 bp, Homo sapiens
gtttataaagca

SEQ ID NO: 4722368 - DNA, 15 bp, Homo sapiens
gtttataataaaaat

SEQ ID NO: 4722369 - DNA, 15 bp, Homo sapiens
gtttatacctttgcc

SEQ ID NO: 4722370 - DNA, 16 bp, Homo sapiens
gtttatgatctatttg

SEQ ID NO: 4722371 - DNA, 13 bp, Homo sapiens
gtttattgtaaaa

SEQ ID NO: 4722372 - DNA, 18 bp, Homo sapiens
gtttcaacggaaagtgct

SEQ ID NO: 4722373 - DNA, 16 bp, Homo sapiens
gtttcaggtgacatgt

SEQ ID NO: 4722374 - DNA, 18 bp, Homo sapiens
gtttctaaggactttttc

SEQ ID NO: 4722375 - DNA, 16 bp, Homo sapiens
gtttctacctcccaga

SEQ ID NO: 4722376 - DNA, 22 bp, Homo sapiens
gtttctcccccatgttctgtcc

SEQ ID NO: 4722377 - DNA, 16 bp, Homo sapiens
gtttctgccttcttta

SEQ ID NO: 4722378 - DNA, 20 bp, Homo sapiens
gtttctggtctctaggctgg

SEQ ID NO: 4722379 - DNA, 17 bp, Homo sapiens
gtttctgtcctgctggt

SEQ ID NO: 4722380 - DNA, 13 bp, Homo sapiens
gtttcttagcttt

SEQ ID NO: 4722381 - DNA, 16 bp, Homo sapiens
gtttctttagtttttg

SEQ ID NO: 4722382 - DNA, 18 bp, Homo sapiens
gtttctttctagtggtct

SEQ ID NO: 4722383 - DNA, 23 bp, Homo sapiens
gtttctttctagtggtctttgta

SEQ ID NO: 4722384 - DNA, 13 bp, Homo sapiens
gtttgaatataaa

SEQ ID NO: 4722385 - DNA, 17 bp, Homo sapiens
gtttgaatataaacact

SEQ ID NO: 4722386 - DNA, 19 bp, Homo sapiens
gtttgaatataaacactat

SEQ ID NO: 4722387 - DNA, 16 bp, Homo sapiens
gtttgacgaagaaaca

SEQ ID NO: 4722388 - DNA, 20 bp, Homo sapiens
gtttgacgaagaaacaaaaa

SEQ ID NO: 4722389 - DNA, 17 bp, Homo sapiens
gtttgatagtgcttctt

SEQ ID NO: 4722390 - DNA, 21 bp, Homo sapiens
gtttgatagtgcttcttgtaa

SEQ ID NO: 4722391 - DNA, 19 bp, Homo sapiens
gtttgatgaggccctccac

SEQ ID NO: 4722392 - DNA, 20 bp, Homo sapiens
gtttgatgaggccctccaca

SEQ ID NO: 4722393 - DNA, 13 bp, Homo sapiens
gtttgcaaggaag

SEQ ID NO: 4722394 - DNA, 14 bp, Homo sapiens
gtttgcaaggaagc

SEQ ID NO: 4722395 - DNA, 13 bp, Homo sapiens
gtttgcctctgcc

SEQ ID NO: 4722396 - DNA, 21 bp, Homo sapiens
gtttggaaattgattttgaac

SEQ ID NO: 4722397 - DNA, 21 bp, Homo sapiens
gtttggaggagcaaaggctga

SEQ ID NO: 4722398 - DNA, 13 bp, Homo sapiens
gtttggcccaagt

SEQ ID NO: 4722399 - DNA, 22 bp, Homo sapiens
gtttgtataccatgatgcatgg

SEQ ID NO: 4722400 - DNA, 15 bp, Homo sapiens
gtttgtcttctcccc

SEQ ID NO: 4722401 - DNA, 16 bp, Homo sapiens
gtttgtcttctcccca

SEQ ID NO: 4722402 - DNA, 17 bp, Homo sapiens
gtttgtcttctccccag

SEQ ID NO: 4722403 - DNA, 18 bp, Homo sapiens
taatatctttaaatgatg

SEQ ID NO: 4722404 - DNA, 21 bp, Homo sapiens
taatatctttaaatgatgtac

SEQ ID NO: 4722405 - DNA, 22 bp, Homo sapiens
taatatggctcttcataattct

SEQ ID NO: 4722406 - DNA, 12 bp, Homo sapiens
taatattgtaaa

SEQ ID NO: 4722407 - DNA, 14 bp, Homo sapiens
taatatttttaatt

SEQ ID NO: 4722408 - DNA, 17 bp, Homo sapiens
taatcacagtcatcttt

SEQ ID NO: 4722409 - DNA, 18 bp, Homo sapiens
taatcacagtcatcttta

SEQ ID NO: 4722410 - DNA, 13 bp, Homo sapiens
taatccattttta

SEQ ID NO: 4722411 - DNA, 21 bp, Homo sapiens
taatcccagcattttgggaag

SEQ ID NO: 4722412 - DNA, 19 bp, Homo sapiens
taatccgaatctctttttg

SEQ ID NO: 4722413 - DNA, 21 bp, Homo sapiens
taatccgaatctctttttgct

SEQ ID NO: 4722414 - DNA, 21 bp, Homo sapiens
taatcctagcactttgggagg

SEQ ID NO: 4722415 - DNA, 14 bp, Homo sapiens
taatcctgtaccaa

SEQ ID NO: 4722416 - DNA, 14 bp, Homo sapiens
taatcgacctgcct

SEQ ID NO: 4722417 - DNA, 16 bp, Homo sapiens
taatcgtgtcccctat

SEQ ID NO: 4722418 - DNA, 21 bp, Homo sapiens
taatctgatggcttctccagg

SEQ ID NO: 4722419 - DNA, 13 bp, Homo sapiens
taatcttttacat

SEQ ID NO: 4722420 - DNA, 14 bp, Homo sapiens
taatcttttacatt

SEQ ID NO: 4722421 - DNA, 16 bp, Homo sapiens
taatcttttacattga

SEQ ID NO: 4722422 - DNA, 16 bp, Homo sapiens
taatgaagaaagtgga

SEQ ID NO: 4722423 - DNA, 23 bp, Homo sapiens
taatgaagaaagtggaaaacaag

SEQ ID NO: 4722424 - DNA, 17 bp, Homo sapiens
taatgatgtcgtttgaa

SEQ ID NO: 4722425 - DNA, 19 bp, Homo sapiens
taatgcgcaggctggccct

SEQ ID NO: 4722426 - DNA, 15 bp, Homo sapiens
taatgcttatgtgtt

SEQ ID NO: 4722427 - DNA, 18 bp, Homo sapiens
taatggtagttttacagt

SEQ ID NO: 4722428 - DNA, 13 bp, Homo sapiens
taatggtgaacat

SEQ ID NO: 4722429 - DNA, 17 bp, Homo sapiens
taatggtgaacatttta

SEQ ID NO: 4722430 - DNA, 14 bp, Homo sapiens
taatgtagccatgg

SEQ ID NO: 4722431 - DNA, 15 bp, Homo sapiens
taatgtatgtacagc

SEQ ID NO: 4722432 - DNA, 19 bp, Homo sapiens
taatgtctctgtgagactc

SEQ ID NO: 4722433 - DNA, 21 bp, Homo sapiens
taatgttgggtagaaagagat

SEQ ID NO: 4722434 - DNA, 14 bp, Homo sapiens
taatgtttgtgaga

SEQ ID NO: 4722435 - DNA, 10 bp, Homo sapiens
taattaaaag

SEQ ID NO: 4722436 - DNA, 12 bp, Homo sapiens
taattaaagtag

SEQ ID NO: 4722437 - DNA, 15 bp, Homo sapiens
taattaaagtagatt

SEQ ID NO: 4722438 - DNA, 21 bp, Homo sapiens
taattaaataaaaatctgtgg

SEQ ID NO: 4722439 - DNA, 18 bp, Homo sapiens
taattaccttattggata

SEQ ID NO: 4722440 - DNA, 15 bp, Homo sapiens
taattagaaatcaac

SEQ ID NO: 4722441 - DNA, 13 bp, Homo sapiens
taattatatttct

SEQ ID NO: 4722442 - DNA, 21 bp, Homo sapiens
taattatctcctaattgtatg

SEQ ID NO: 4722443 - DNA, 18 bp, Homo sapiens
taattatttcactttaga

SEQ ID NO: 4722444 - DNA, 13 bp, Homo sapiens
taattccacagct

SEQ ID NO: 4722445 - DNA, 11 bp, Homo sapiens
taattctaaag

SEQ ID NO: 4722446 - DNA, 23 bp, Homo sapiens
taattctctattatttttattac

SEQ ID NO: 4722447 - DNA, 14 bp, Homo sapiens
taattctgcatctg

SEQ ID NO: 4722448 - DNA, 16 bp, Homo sapiens
taattctgttaactga

SEQ ID NO: 4722449 - DNA, 15 bp, Homo sapiens
taattcttattttta

SEQ ID NO: 4722450 - DNA, 21 bp, Homo sapiens
taattggaatcttcacctcag

SEQ ID NO: 4722451 - DNA, 19 bp, Homo sapiens
taattgttgtttctttcta

SEQ ID NO: 4722452 - DNA, 14 bp, Homo sapiens
taatttaaaaatat

SEQ ID NO: 4722453 - DNA, 19 bp, Homo sapiens
taatttaactttctgggtt

SEQ ID NO: 4722454 - DNA, 19 bp, Homo sapiens
taatttagtcccttaaaaa

SEQ ID NO: 4722455 - DNA, 18 bp, Homo sapiens
taatttcacagatgctgt

SEQ ID NO: 4722456 - DNA, 17 bp, Homo sapiens
taatttctgttgtttta

SEQ ID NO: 4722457 - DNA, 18 bp, Homo sapiens
taatttgtgaaaatgtaa

SEQ ID NO: 4722458 - DNA, 12 bp, Homo sapiens
taatttgtgaat

SEQ ID NO: 4722459 - DNA, 17 bp, Homo sapiens
taatttgtgaatttgca

SEQ ID NO: 4722460 - DNA, 14 bp, Homo sapiens
taattttaaagtaa

SEQ ID NO: 4722461 - DNA, 16 bp, Homo sapiens
taattttcctgtgaca

SEQ ID NO: 4722462 - DNA, 21 bp, Homo sapiens
taattttggataatattcatt

SEQ ID NO: 4722463 - DNA, 14 bp, Homo sapiens
taattttttaatta

SEQ ID NO: 4722464 - DNA, 18 bp, Homo sapiens
taattttttaattattta

SEQ ID NO: 4722465 - DNA, 13 bp, Homo sapiens
tacaaaactgcca

SEQ ID NO: 4722466 - DNA, 14 bp, Homo sapiens
tacaaacatggaaa

SEQ ID NO: 4722467 - DNA, 17 bp, Homo sapiens
tacaaacatgtggttaa

SEQ ID NO: 4722468 - DNA, 21 bp, Homo sapiens
tacaaacgtatggaatgcttc

SEQ ID NO: 4722469 - DNA, 13 bp, Homo sapiens
tacaaatcaatca

SEQ ID NO: 4722470 - DNA, 16 bp, Homo sapiens
tacaaatgtgataata

SEQ ID NO: 4722471 - DNA, 14 bp, Homo sapiens
tacaacaaacactg

SEQ ID NO: 4722472 - DNA, 15 bp, Homo sapiens
tacaacaaacactgt

SEQ ID NO: 4722473 - DNA, 16 bp, Homo sapiens
tacaacaaacactgtg

SEQ ID NO: 4722474 - DNA, 20 bp, Homo sapiens
tacaacaaacactgtgatgt

SEQ ID NO: 4722475 - DNA, 18 bp, Homo sapiens
tacaagcgtgagccactg

SEQ ID NO: 4722476 - DNA, 20 bp, Homo sapiens
tacaagcgtgagccactgca

SEQ ID NO: 4722477 - DNA, 14 bp, Homo sapiens
tacaatgtaaacca

SEQ ID NO: 4722478 - DNA, 15 bp, Homo sapiens
tacacacacatacac

SEQ ID NO: 4722479 - DNA, 20 bp, Homo sapiens
tacacagggatgtacaaggc

SEQ ID NO: 4722480 - DNA, 17 bp, Homo sapiens
tacacatttttcagata

SEQ ID NO: 4722481 - DNA, 20 bp, Homo sapiens
tacaccagtttgactgtgct

SEQ ID NO: 4722482 - DNA, 12 bp, Homo sapiens
tacacctaactc

SEQ ID NO: 4722483 - DNA, 11 bp, Homo sapiens
tacactggtct

SEQ ID NO: 4722484 - DNA, 21 bp, Homo sapiens
tacactggtctaatgtttgtg

SEQ ID NO: 4722485 - DNA, 22 bp, Homo sapiens
tacactgtgctgagtctgaagg

SEQ ID NO: 4722486 - DNA, 17 bp, Homo sapiens
tacacttggatttcatt

SEQ ID NO: 4722487 - DNA, 17 bp, Homo sapiens
tacagaataaaagaatt

SEQ ID NO: 4722488 - DNA, 22 bp, Homo sapiens
tacagagcccacgcccccactg

SEQ ID NO: 4722489 - DNA, 17 bp, Homo sapiens
tacaggaaaagctgctg

SEQ ID NO: 4722490 - DNA, 18 bp, Homo sapiens
tacaggaaaagctgctga

SEQ ID NO: 4722491 - DNA, 16 bp, Homo sapiens
tacaggcacccaccat

SEQ ID NO: 4722492 - DNA, 15 bp, Homo sapiens
tacaggcatagagtt

SEQ ID NO: 4722493 - DNA, 16 bp, Homo sapiens
tacaggtgtgagtcac

SEQ ID NO: 4722494 - DNA, 13 bp, Homo sapiens
tacagtcattatt

SEQ ID NO: 4722495 - DNA, 12 bp, Homo sapiens
tacagtcctccc

SEQ ID NO: 4722496 - DNA, 18 bp, Homo sapiens
tacagtcctcccatctca

SEQ ID NO: 4722497 - DNA, 18 bp, Homo sapiens
tacagtctcaattttgta

SEQ ID NO: 4722498 - DNA, 21 bp, Homo sapiens
tacagtctcaattttgtattt

SEQ ID NO: 4722499 - DNA, 18 bp, Homo sapiens
tacagtcttccatttgca

SEQ ID NO: 4722500 - DNA, 20 bp, Homo sapiens
tacagtcttccatttgcaag

SEQ ID NO: 4722501 - DNA, 13 bp, Homo sapiens
tacagtgtacagt

SEQ ID NO: 4722502 - DNA, 17 bp, Homo sapiens
tacagttttaactgtgg

SEQ ID NO: 4722503 - DNA, 21 bp, Homo sapiens
tacagttttaactgtggatat

SEQ ID NO: 4722504 - DNA, 17 bp, Homo sapiens
tacataaaagaaataaa

SEQ ID NO: 4722505 - DNA, 16 bp, Homo sapiens
tacataaaattttcta

SEQ ID NO: 4722506 - DNA, 22 bp, Homo sapiens
tacataggaaccaaatcaatga

SEQ ID NO: 4722507 - DNA, 22 bp, Homo sapiens
tacatccctcagtttcttaaaa

SEQ ID NO: 4722508 - DNA, 13 bp, Homo sapiens
tacatctgtgatg

SEQ ID NO: 4722509 - DNA, 16 bp, Homo sapiens
tacatgacatttattt

SEQ ID NO: 4722510 - DNA, 17 bp, Homo sapiens
tacatttagcccctctc

SEQ ID NO: 4722511 - DNA, 23 bp, Homo sapiens
tacatttatgatttaataaaata

SEQ ID NO: 4722512 - DNA, 17 bp, Homo sapiens
taccaaatctgacatat

SEQ ID NO: 4722513 - DNA, 20 bp, Homo sapiens
taccaaatctgacatattat

SEQ ID NO: 4722514 - DNA, 14 bp, Homo sapiens
tataaagcagatta

SEQ ID NO: 4722515 - DNA, 18 bp, Homo sapiens
tataaagcagattacctc

SEQ ID NO: 4722516 - DNA, 18 bp, Homo sapiens
tataaatatatttaactt

SEQ ID NO: 4722517 - DNA, 15 bp, Homo sapiens
tataacttattagca

SEQ ID NO: 4722518 - DNA, 14 bp, Homo sapiens
tataataaaaatat

SEQ ID NO: 4722519 - DNA, 18 bp, Homo sapiens
tataataaaaatatattt

SEQ ID NO: 4722520 - DNA, 15 bp, Homo sapiens
tataatgaataaatc

SEQ ID NO: 4722521 - DNA, 11 bp, Homo sapiens
tataattaaac

SEQ ID NO: 4722522 - DNA, 19 bp, Homo sapiens
tatacacttggatttcatt

SEQ ID NO: 4722523 - DNA, 17 bp, Homo sapiens
tatacatttgttggtaa

SEQ ID NO: 4722524 - DNA, 21 bp, Homo sapiens
tatagctagctatttctatgt

SEQ ID NO: 4722525 - DNA, 15 bp, Homo sapiens
tataggcacctacca

SEQ ID NO: 4722526 - DNA, 17 bp, Homo sapiens
tataggctattttctaa

SEQ ID NO: 4722527 - DNA, 21 bp, Homo sapiens
tataggctattttctaaagac

SEQ ID NO: 4722528 - DNA, 13 bp, Homo sapiens
tatagtgatgtaa

SEQ ID NO: 4722529 - DNA, 19 bp, Homo sapiens
tatagttgtctttctttgc

SEQ ID NO: 4722530 - DNA, 21 bp, Homo sapiens
tatatccttgacaccttactt

SEQ ID NO: 4722531 - DNA, 18 bp, Homo sapiens
tatatgttcttcataagc

SEQ ID NO: 4722532 - DNA, 22 bp, Homo sapiens
tatatgttttataattcataac

SEQ ID NO: 4722533 - DNA, 18 bp, Homo sapiens
tatattaaaaaagagaca

SEQ ID NO: 4722534 - DNA, 22 bp, Homo sapiens
tatattattccgtattacattt

SEQ ID NO: 4722535 - DNA, 22 bp, Homo sapiens
tatattcaggacttgaaagaaa

SEQ ID NO: 4722536 - DNA, 19 bp, Homo sapiens
tatattcattctttttgaa

SEQ ID NO: 4722537 - DNA, 22 bp, Homo sapiens
tatattgataacagcactgact

SEQ ID NO: 4722538 - DNA, 12 bp, Homo sapiens
tatattgtgaac

SEQ ID NO: 4722539 - DNA, 16 bp, Homo sapiens
tatattgtttttgtat

SEQ ID NO: 4722540 - DNA, 20 bp, Homo sapiens
tatattgtttttgtatttat

SEQ ID NO: 4722541 - DNA, 13 bp, Homo sapiens
tatatttaagcct

SEQ ID NO: 4722542 - DNA, 12 bp, Homo sapiens
tatatttacaaa

SEQ ID NO: 4722543 - DNA, 15 bp, Homo sapiens
tatattttgctgttt

SEQ ID NO: 4722544 - DNA, 18 bp, Homo sapiens
tatcaaaaagtataaatt

SEQ ID NO: 4722545 - DNA, 18 bp, Homo sapiens
tatcaaaagaaatagaaa

SEQ ID NO: 4722546 - DNA, 22 bp, Homo sapiens
tatcaaaagaaatagaaaagga

SEQ ID NO: 4722547 - DNA, 16 bp, Homo sapiens
tatcaaagaaaaacaa

SEQ ID NO: 4722548 - DNA, 20 bp, Homo sapiens
tatcaaagtcattaaagaca

SEQ ID NO: 4722549 - DNA, 21 bp, Homo sapiens
tatcaagtactacattttctt

SEQ ID NO: 4722550 - DNA, 19 bp, Homo sapiens
tatcaattgcaaaatgcgt

SEQ ID NO: 4722551 - DNA, 16 bp, Homo sapiens
tatcacgtctgacaaa

SEQ ID NO: 4722552 - DNA, 15 bp, Homo sapiens
tatcagtgtgccccc

SEQ ID NO: 4722553 - DNA, 15 bp, Homo sapiens
tatcatataaacatt

SEQ ID NO: 4722554 - DNA, 17 bp, Homo sapiens
tatcatataaacatttt

SEQ ID NO: 4722555 - DNA, 19 bp, Homo sapiens
tatccaaataaaaataaca

SEQ ID NO: 4722556 - DNA, 22 bp, Homo sapiens
tatccagaagtattgtttacat

SEQ ID NO: 4722557 - DNA, 15 bp, Homo sapiens
tatcccggctgccct

SEQ ID NO: 4722558 - DNA, 17 bp, Homo sapiens
tatcctacttccccttc

SEQ ID NO: 4722559 - DNA, 21 bp, Homo sapiens
tatcctgttaacactgtaata

SEQ ID NO: 4722560 - DNA, 12 bp, Homo sapiens
tatcctttcaca

SEQ ID NO: 4722561 - DNA, 21 bp, Homo sapiens
tatctaatatgtaacaagcca

SEQ ID NO: 4722562 - DNA, 16 bp, Homo sapiens
tatctaattctttaat

SEQ ID NO: 4722563 - DNA, 17 bp, Homo sapiens
tatctagcagtaaaaga

SEQ ID NO: 4722564 - DNA, 19 bp, Homo sapiens
tatctatgactgtgtttaa

SEQ ID NO: 4722565 - DNA, 16 bp, Homo sapiens
tatctcctaattgtat

SEQ ID NO: 4722566 - DNA, 22 bp, Homo sapiens
tatctctagtccctgtgttctg

SEQ ID NO: 4722567 - DNA, 20 bp, Homo sapiens
tatctcttgtgcttttttga

SEQ ID NO: 4722568 - DNA, 21 bp, Homo sapiens
tatctgcaatgtttttgtgta

SEQ ID NO: 4722569 - DNA, 21 bp, Homo sapiens
tatctgcatgtaaaatcttca

SEQ ID NO: 4722570 - DNA, 11 bp, Homo sapiens
tatctggtatc

SEQ ID NO: 4722571 - DNA, 15 bp, Homo sapiens
tatctggtatctgca

SEQ ID NO: 4722572 - DNA, 20 bp, Homo sapiens
tatctgtcatttgagcaggg

SEQ ID NO: 4722573 - DNA, 23 bp, Homo sapiens
tatctgtcatttgagcagggctc

SEQ ID NO: 4722574 - DNA, 23 bp, Homo sapiens
tatctgtggattcagcttctgtt

SEQ ID NO: 4722575 - DNA, 21 bp, Homo sapiens
tatcttgatgttcagacattt

SEQ ID NO: 4722576 - DNA, 16 bp, Homo sapiens
tatcttgtatggtttg

SEQ ID NO: 4722577 - DNA, 19 bp, Homo sapiens
tatcttgtatggtttgcaa

SEQ ID NO: 4722578 - DNA, 14 bp, Homo sapiens
tatcttgtgtatgg

SEQ ID NO: 4722579 - DNA, 19 bp, Homo sapiens
tatctttaaatgatgtaca

SEQ ID NO: 4722580 - DNA, 23 bp, Homo sapiens
tatctttattcaccttttcttca

SEQ ID NO: 4722581 - DNA, 16 bp, Homo sapiens
tatctttgattctcct

SEQ ID NO: 4722582 - DNA, 22 bp, Homo sapiens
tatctttgattctccttcagcc

SEQ ID NO: 4722583 - DNA, 11 bp, Homo sapiens
tatctttgcca

SEQ ID NO: 4722584 - DNA, 16 bp, Homo sapiens
tatctttgccaccctc

SEQ ID NO: 4722585 - DNA, 18 bp, Homo sapiens
tatgaatgggttgttaaa

SEQ ID NO: 4722586 - DNA, 23 bp, Homo sapiens
tatgacagaatggctatcaaaag

SEQ ID NO: 4722587 - DNA, 21 bp, Homo sapiens
tatgacagatatatttaagcc

SEQ ID NO: 4722588 - DNA, 22 bp, Homo sapiens
tatgacagatatatttaagcct

SEQ ID NO: 4722589 - DNA, 19 bp, Homo sapiens
tatgacattcatgcctggc

SEQ ID NO: 4722590 - DNA, 20 bp, Homo sapiens
tatgagaacatggtgtgtgt

SEQ ID NO: 4722591 - DNA, 17 bp, Homo sapiens
tatgagaagtactttgt

SEQ ID NO: 4722592 - DNA, 16 bp, Homo sapiens
tatgagctttcagact

SEQ ID NO: 4722593 - DNA, 18 bp, Homo sapiens
tatgagctttcagactcc

SEQ ID NO: 4722594 - DNA, 16 bp, Homo sapiens
tatgaggcatttggca

SEQ ID NO: 4722595 - DNA, 23 bp, Homo sapiens
tatgataaaaaagtgtcctataa

SEQ ID NO: 4722596 - DNA, 15 bp, Homo sapiens
tatgatatcatgctt

SEQ ID NO: 4722597 - DNA, 21 bp, Homo sapiens
tatgattcactatttaaacta

SEQ ID NO: 4722598 - DNA, 23 bp, Homo sapiens
tatgattcccttttctttaagtt

SEQ ID NO: 4722599 - DNA, 17 bp, Homo sapiens
tatgatttaataaaata

SEQ ID NO: 4722600 - DNA, 18 bp, Homo sapiens
tatgatttggaaaataaa

SEQ ID NO: 4722601 - DNA, 12 bp, Homo sapiens
tatgatttttaa

SEQ ID NO: 4722602 - DNA, 23 bp, Homo sapiens
tatgatttttaaagaaaagtttt

SEQ ID NO: 4722603 - DNA, 23 bp, Homo sapiens
tatgcaaaagtacaagggctgag

SEQ ID NO: 4722604 - DNA, 23 bp, Homo sapiens
tatgcaagtgggagatgaaaacc

SEQ ID NO: 4722605 - DNA, 21 bp, Homo sapiens
tatgcacacttttaattttgt

SEQ ID NO: 4722606 - DNA, 22 bp, Homo sapiens
tatgcacacttttaattttgtc

SEQ ID NO: 4722607 - DNA, 15 bp, Homo sapiens
tatgcacgttaacag

SEQ ID NO: 4722608 - DNA, 23 bp, Homo sapiens
tatgcacgttaacagcgtgtcaa

SEQ ID NO: 4722609 - DNA, 19 bp, Homo sapiens
tatgcagtattgagcactg

SEQ ID NO: 4722610 - DNA, 19 bp, Homo sapiens
tatgcagtgatatggcaga

SEQ ID NO: 4722611 - DNA, 19 bp, Homo sapiens
tatgccattggggtagttg

SEQ ID NO: 4722612 - DNA, 18 bp, Homo sapiens
tatgctttgaatgcaaaa

SEQ ID NO: 4722613 - DNA, 17 bp, Homo sapiens
tatggaatgcttcttaa

SEQ ID NO: 4722614 - DNA, 19 bp, Homo sapiens
tatggacatcgatatgaaa

SEQ ID NO: 4722615 - DNA, 21 bp, Homo sapiens
tatggacggtgctccaggcag

SEQ ID NO: 4722616 - DNA, 18 bp, Homo sapiens
tatggcactatttttatt

SEQ ID NO: 4722617 - DNA, 14 bp, Homo sapiens
tatggcagaagaca

SEQ ID NO: 4722618 - DNA, 16 bp, Homo sapiens
tatgggactcaatgca

SEQ ID NO: 4722619 - DNA, 22 bp, Homo sapiens
tatggttccaatgaaatatgtt

SEQ ID NO: 4722620 - DNA, 23 bp, Homo sapiens
tatgtacagttcataaatttgtt

SEQ ID NO: 4722621 - DNA, 15 bp, Homo sapiens
tatgtagcaaaatac

SEQ ID NO: 4722622 - DNA, 15 bp, Homo sapiens
tcaccttcaaaatgt

SEQ ID NO: 4722623 - DNA, 12 bp, Homo sapiens
tcacctttgtcc

SEQ ID NO: 4722624 - DNA, 22 bp, Homo sapiens
tcacctttgtccccaccgcaga

SEQ ID NO: 4722625 - DNA, 13 bp, Homo sapiens
tcacggctcactg

SEQ ID NO: 4722626 - DNA, 19 bp, Homo sapiens
tcacgtaaagctagaaatg

SEQ ID NO: 4722627 - DNA, 20 bp, Homo sapiens
tcacgtaaagctagaaatga

SEQ ID NO: 4722628 - DNA, 21 bp, Homo sapiens
tcactaccgtggaccacctag

SEQ ID NO: 4722629 - DNA, 20 bp, Homo sapiens
tcactatcccggctgccctt

SEQ ID NO: 4722630 - DNA, 22 bp, Homo sapiens
tcactatgaatgggttgttaaa

SEQ ID NO: 4722631 - DNA, 19 bp, Homo sapiens
tcactatggtgccaatgga

SEQ ID NO: 4722632 - DNA, 23 bp, Homo sapiens
tcactcaacaacatctttgtgtt

SEQ ID NO: 4722633 - DNA, 17 bp, Homo sapiens
tcactcacattttctca

SEQ ID NO: 4722634 - DNA, 12 bp, Homo sapiens
tcactctggcag

SEQ ID NO: 4722635 - DNA, 14 bp, Homo sapiens
tcactctggcagct

SEQ ID NO: 4722636 - DNA, 18 bp, Homo sapiens
tcactctggcagctcaga

SEQ ID NO: 4722637 - DNA, 12 bp, Homo sapiens
tcactctgtcgc

SEQ ID NO: 4722638 - DNA, 16 bp, Homo sapiens
tcactctgtcgcccag

SEQ ID NO: 4722639 - DNA, 21 bp, Homo sapiens
tcactcttattgcccacgctg

SEQ ID NO: 4722640 - DNA, 14 bp, Homo sapiens
tcactgagacagcc

SEQ ID NO: 4722641 - DNA, 15 bp, Homo sapiens
tcactgagacagccc

SEQ ID NO: 4722642 - DNA, 16 bp, Homo sapiens
tcactgagacagcccg

SEQ ID NO: 4722643 - DNA, 16 bp, Homo sapiens
tcactgagccatcatt

SEQ ID NO: 4722644 - DNA, 20 bp, Homo sapiens
tcactgagccatcatttcct

SEQ ID NO: 4722645 - DNA, 13 bp, Homo sapiens
tcactgcagcctc

SEQ ID NO: 4722646 - DNA, 14 bp, Homo sapiens
tcactgcagcctca

SEQ ID NO: 4722647 - DNA, 16 bp, Homo sapiens
tcactggattggtcat

SEQ ID NO: 4722648 - DNA, 14 bp, Homo sapiens
tcactgtataaata

SEQ ID NO: 4722649 - DNA, 15 bp, Homo sapiens
tcactgtataaatag

SEQ ID NO: 4722650 - DNA, 16 bp, Homo sapiens
tcactgtataaatagg

SEQ ID NO: 4722651 - DNA, 17 bp, Homo sapiens
tcactgtataaatagga

SEQ ID NO: 4722652 - DNA, 22 bp, Homo sapiens
tcactgtgcttattttgtttca

SEQ ID NO: 4722653 - DNA, 17 bp, Homo sapiens
tcactgttgcccaggct

SEQ ID NO: 4722654 - DNA, 19 bp, Homo sapiens
tcacttgtgccaacactca

SEQ ID NO: 4722655 - DNA, 20 bp, Homo sapiens
tcactttaaagcaattgcat

SEQ ID NO: 4722656 - DNA, 23 bp, Homo sapiens
tcactttaaagcaattgcataat

SEQ ID NO: 4722657 - DNA, 23 bp, Homo sapiens
tcactttggggttcggcctgtgt

SEQ ID NO: 4722658 - DNA, 22 bp, Homo sapiens
tcacttttatttagcaccaggg

SEQ ID NO: 4722659 - DNA, 20 bp, Homo sapiens
tcacttttggcaatgactca

SEQ ID NO: 4722660 - DNA, 22 bp, Homo sapiens
tcagaaacaccctcacactggg

SEQ ID NO: 4722661 - DNA, 19 bp, Homo sapiens
tcagaagtatggaattttc

SEQ ID NO: 4722662 - DNA, 23 bp, Homo sapiens
tcagaagtatggaattttctgcc

SEQ ID NO: 4722663 - DNA, 16 bp, Homo sapiens
tcagaatatgattcac

SEQ ID NO: 4722664 - DNA, 22 bp, Homo sapiens
tcagaatatgattcactattta

SEQ ID NO: 4722665 - DNA, 22 bp, Homo sapiens
tcagaattagagcatgggaggt

SEQ ID NO: 4722666 - DNA, 13 bp, Homo sapiens
tcagacagccccc

SEQ ID NO: 4722667 - DNA, 15 bp, Homo sapiens
tcagacagctgcctg

SEQ ID NO: 4722668 - DNA, 20 bp, Homo sapiens
tcagacagctgcctgggatc

SEQ ID NO: 4722669 - DNA, 15 bp, Homo sapiens
tcagactaagccagc

SEQ ID NO: 4722670 - DNA, 19 bp, Homo sapiens
tcagagacatcagcccttg

SEQ ID NO: 4722671 - DNA, 16 bp, Homo sapiens
tcagagactcctgcag

SEQ ID NO: 4722672 - DNA, 21 bp, Homo sapiens
tcagagactcctgcaggcagc

SEQ ID NO: 4722673 - DNA, 16 bp, Homo sapiens
tcagagagggtgggag

SEQ ID NO: 4722674 - DNA, 16 bp, Homo sapiens
tcagagccgtggtcct

SEQ ID NO: 4722675 - DNA, 17 bp, Homo sapiens
tcagagctacttgggcc

SEQ ID NO: 4722676 - DNA, 20 bp, Homo sapiens
tcagagtgactacacacagt

SEQ ID NO: 4722677 - DNA, 20 bp, Homo sapiens
tcagcacctacagtgtacag

SEQ ID NO: 4722678 - DNA, 21 bp, Homo sapiens
tcagcacctacagtgtacagt

SEQ ID NO: 4722679 - DNA, 15 bp, Homo sapiens
tcagcatcaaacatg

SEQ ID NO: 4722680 - DNA, 18 bp, Homo sapiens
tcagcatcaaacatgaaa

SEQ ID NO: 4722681 - DNA, 16 bp, Homo sapiens
tcagcatcctggcacc

SEQ ID NO: 4722682 - DNA, 15 bp, Homo sapiens
tcagccagccccatc

SEQ ID NO: 4722683 - DNA, 20 bp, Homo sapiens
tcagccaggtgctgtgacac

SEQ ID NO: 4722684 - DNA, 16 bp, Homo sapiens
tcagcccaagatgctt

SEQ ID NO: 4722685 - DNA, 23 bp, Homo sapiens
tcagccccaccccagggcagcca

SEQ ID NO: 4722686 - DNA, 23 bp, Homo sapiens
tcagccctagggtggagagccac

SEQ ID NO: 4722687 - DNA, 13 bp, Homo sapiens
tcagcctcccaaa

SEQ ID NO: 4722688 - DNA, 21 bp, Homo sapiens
tcagcctcccaaagtgctggg

SEQ ID NO: 4722689 - DNA, 22 bp, Homo sapiens
tcagcctcccgaatagctggga

SEQ ID NO: 4722690 - DNA, 18 bp, Homo sapiens
tcagcctcccgagtagct

SEQ ID NO: 4722691 - DNA, 22 bp, Homo sapiens
tcagcctcccgagtagctggga

SEQ ID NO: 4722692 - DNA, 22 bp, Homo sapiens
tcagcctcctgagtagctggga

SEQ ID NO: 4722693 - DNA, 15 bp, Homo sapiens
tcagcctttaagata

SEQ ID NO: 4722694 - DNA, 21 bp, Homo sapiens
tcagctactttccatttggta

SEQ ID NO: 4722695 - DNA, 15 bp, Homo sapiens
tcagctccagctcac

SEQ ID NO: 4722696 - DNA, 22 bp, Homo sapiens
tcagctccagctcaccagcccc

SEQ ID NO: 4722697 - DNA, 24 bp, Homo sapiens
tcagctccagctcaccagccccag

SEQ ID NO: 4722698 - DNA, 13 bp, Homo sapiens
tcagctccccaga

SEQ ID NO: 4722699 - DNA, 17 bp, Homo sapiens
tcagctccccagagtcc

SEQ ID NO: 4722700 - DNA, 19 bp, Homo sapiens
tcagctctcagttgcagcc

SEQ ID NO: 4722701 - DNA, 21 bp, Homo sapiens
tcagctggtggatggtgactt

SEQ ID NO: 4722702 - DNA, 17 bp, Homo sapiens
tcagcttctgctgggct

SEQ ID NO: 4722703 - DNA, 18 bp, Homo sapiens
tcagcttctgctgggctg

SEQ ID NO: 4722704 - DNA, 21 bp, Homo sapiens
tcagcttctgctgggctgggg

SEQ ID NO: 4722705 - DNA, 22 bp, Homo sapiens
tcagcttctgctgggctggggc

SEQ ID NO: 4722706 - DNA, 17 bp, Homo sapiens
tcaggaaacatatttaa

SEQ ID NO: 4722707 - DNA, 14 bp, Homo sapiens
tcaggaagctcagg

SEQ ID NO: 4722708 - DNA, 15 bp, Homo sapiens
tcaggaagctcaggg

SEQ ID NO: 4722709 - DNA, 19 bp, Homo sapiens
tcaggaagctcagggcctg

SEQ ID NO: 4722710 - DNA, 18 bp, Homo sapiens
tcaggaattcttggagaa

SEQ ID NO: 4722711 - DNA, 12 bp, Homo sapiens
tcaggacactaa

SEQ ID NO: 4722712 - DNA, 20 bp, Homo sapiens
tcaggaccaaagctttcatg

SEQ ID NO: 4722713 - DNA, 15 bp, Homo sapiens
tcaggacccagagga

SEQ ID NO: 4722714 - DNA, 16 bp, Homo sapiens
tcaggacttgaaagaa

SEQ ID NO: 4722715 - DNA, 21 bp, Homo sapiens
tcaggagcagcctcagaacaa

SEQ ID NO: 4722716 - DNA, 13 bp, Homo sapiens
tcaggattgcgag

SEQ ID NO: 4722717 - DNA, 18 bp, Homo sapiens
tcaggattgcgagagatg

SEQ ID NO: 4722718 - DNA, 12 bp, Homo sapiens
tcaggccaggcc

SEQ ID NO: 4722719 - DNA, 19 bp, Homo sapiens
tcaggccaggccctctgcc

SEQ ID NO: 4722720 - DNA, 22 bp, Homo sapiens
tcaggccatcatcagtggagcc

SEQ ID NO: 4722721 - DNA, 21 bp, Homo sapiens
tcaggctgtcccaagctccca

SEQ ID NO: 4722722 - DNA, 17 bp, Homo sapiens
tcagggaacatatttaa

SEQ ID NO: 4722723 - DNA, 13 bp, Homo sapiens
tcagggaccacag

SEQ ID NO: 4722724 - DNA, 14 bp, Homo sapiens
tcagggaccacagc

SEQ ID NO: 4722725 - DNA, 16 bp, Homo sapiens
tcagggcctggctcag

SEQ ID NO: 4722726 - DNA, 13 bp, Homo sapiens
tcaggggctgccc

SEQ ID NO: 4722727 - DNA, 22 bp, Homo sapiens
tcaggggctgcccgctcccagt

SEQ ID NO: 4722728 - DNA, 12 bp, Homo sapiens
tcagggtctctg

SEQ ID NO: 4722729 - DNA, 17 bp, Homo sapiens
tcagggttggcccctgc

SEQ ID NO: 4722730 - DNA, 23 bp, Homo sapiens
tcaggtaacaggcagatacagga

SEQ ID NO: 4722731 - DNA, 14 bp, Homo sapiens
tccattattcaaga

SEQ ID NO: 4722732 - DNA, 21 bp, Homo sapiens
tccattattcaagaaagatat

SEQ ID NO: 4722733 - DNA, 15 bp, Homo sapiens
tccattttcttgtca

SEQ ID NO: 4722734 - DNA, 15 bp, Homo sapiens
tcccaaagtgctggg

SEQ ID NO: 4722735 - DNA, 20 bp, Homo sapiens
tcccaaagtgctgggattac

SEQ ID NO: 4722736 - DNA, 14 bp, Homo sapiens
tcccaacccccagc

SEQ ID NO: 4722737 - DNA, 21 bp, Homo sapiens
tcccaagctcccaagagcttc

SEQ ID NO: 4722738 - DNA, 12 bp, Homo sapiens
tcccaagctctg

SEQ ID NO: 4722739 - DNA, 13 bp, Homo sapiens
tcccaagctctgc

SEQ ID NO: 4722740 - DNA, 18 bp, Homo sapiens
tcccaagggatggtgccc

SEQ ID NO: 4722741 - DNA, 23 bp, Homo sapiens
tcccacagtgactcgggctcctg

SEQ ID NO: 4722742 - DNA, 20 bp, Homo sapiens
tcccaccataatccctgtct

SEQ ID NO: 4722743 - DNA, 23 bp, Homo sapiens
tcccaccataatccctgtcttct

SEQ ID NO: 4722744 - DNA, 20 bp, Homo sapiens
tcccaccccacacacgccag

SEQ ID NO: 4722745 - DNA, 18 bp, Homo sapiens
tcccacctcagcctcccg

SEQ ID NO: 4722746 - DNA, 16 bp, Homo sapiens
tcccaccttggctgca

SEQ ID NO: 4722747 - DNA, 17 bp, Homo sapiens
tcccaccttggctgcag

SEQ ID NO: 4722748 - DNA, 21 bp, Homo sapiens
tcccaccttggctgcagggag

SEQ ID NO: 4722749 - DNA, 14 bp, Homo sapiens
tcccactcagtcca

SEQ ID NO: 4722750 - DNA, 19 bp, Homo sapiens
tcccactgcaacttgtgaa

SEQ ID NO: 4722751 - DNA, 18 bp, Homo sapiens
tcccactgcaccccctcc

SEQ ID NO: 4722752 - DNA, 20 bp, Homo sapiens
tcccacttcccctcctaccc

SEQ ID NO: 4722753 - DNA, 17 bp, Homo sapiens
tcccacttccctgacac

SEQ ID NO: 4722754 - DNA, 21 bp, Homo sapiens
tcccacttggcatcagctggc

SEQ ID NO: 4722755 - DNA, 23 bp, Homo sapiens
tcccacttggcatcagctggcgt

SEQ ID NO: 4722756 - DNA, 22 bp, Homo sapiens
tcccagaacacggcagctgctg

SEQ ID NO: 4722757 - DNA, 16 bp, Homo sapiens
tcccagagaccttctg

SEQ ID NO: 4722758 - DNA, 16 bp, Homo sapiens
tcccagaggggcctgc

SEQ ID NO: 4722759 - DNA, 16 bp, Homo sapiens
tcccagataatgtgaa

SEQ ID NO: 4722760 - DNA, 12 bp, Homo sapiens
tcccagccccaa

SEQ ID NO: 4722761 - DNA, 14 bp, Homo sapiens
tcccagccttggca

SEQ ID NO: 4722762 - DNA, 17 bp, Homo sapiens
tcccagctgacagtcct

SEQ ID NO: 4722763 - DNA, 20 bp, Homo sapiens
tcccagctgacagtcctctc

SEQ ID NO: 4722764 - DNA, 17 bp, Homo sapiens
tcccagctgtgctctgg

SEQ ID NO: 4722765 - DNA, 24 bp, Homo sapiens
tcccaggatgagcatcccaggatc

SEQ ID NO: 4722766 - DNA, 18 bp, Homo sapiens
tcccaggctgagcctcag

SEQ ID NO: 4722767 - DNA, 19 bp, Homo sapiens
tcccaggctgagcctcagt

SEQ ID NO: 4722768 - DNA, 17 bp, Homo sapiens
tcccagtggctgctgcc

SEQ ID NO: 4722769 - DNA, 19 bp, Homo sapiens
tcccagtggctgctgccca

SEQ ID NO: 4722770 - DNA, 15 bp, Homo sapiens
tcccagtgtcttcct

SEQ ID NO: 4722771 - DNA, 17 bp, Homo sapiens
tcccagtgtcttcctgt

SEQ ID NO: 4722772 - DNA, 20 bp, Homo sapiens
tcccagtgtcttcctgtggg

SEQ ID NO: 4722773 - DNA, 23 bp, Homo sapiens
tcccatctcacacatgagcatca

SEQ ID NO: 4722774 - DNA, 14 bp, Homo sapiens
tcccatgacccagg

SEQ ID NO: 4722775 - DNA, 16 bp, Homo sapiens
tcccatgacccaggct

SEQ ID NO: 4722776 - DNA, 22 bp, Homo sapiens
tcccatgagcctcagcatcctg

SEQ ID NO: 4722777 - DNA, 13 bp, Homo sapiens
tcccatttcctgt

SEQ ID NO: 4722778 - DNA, 20 bp, Homo sapiens
tcccatttcctgtcattttt

SEQ ID NO: 4722779 - DNA, 15 bp, Homo sapiens
tccccagatatttat

SEQ ID NO: 4722780 - DNA, 18 bp, Homo sapiens
tccccagatatttatgta

SEQ ID NO: 4722781 - DNA, 23 bp, Homo sapiens
tccccagattgcaacaggctggg

SEQ ID NO: 4722782 - DNA, 20 bp, Homo sapiens
tccccagcaagtgagagctg

SEQ ID NO: 4722783 - DNA, 21 bp, Homo sapiens
tccccagcaagtgagagctgg

SEQ ID NO: 4722784 - DNA, 22 bp, Homo sapiens
tccccagcaagtgagagctggg

SEQ ID NO: 4722785 - DNA, 13 bp, Homo sapiens
tccccaggaggcc

SEQ ID NO: 4722786 - DNA, 16 bp, Homo sapiens
tccccaggaggccagc

SEQ ID NO: 4722787 - DNA, 18 bp, Homo sapiens
tccccatcatctgtggaa

SEQ ID NO: 4722788 - DNA, 12 bp, Homo sapiens
tcccccactttc

SEQ ID NO: 4722789 - DNA, 22 bp, Homo sapiens
tccccgagggatgatgccacac

SEQ ID NO: 4722790 - DNA, 13 bp, Homo sapiens
tccccgccctttt

SEQ ID NO: 4722791 - DNA, 15 bp, Homo sapiens
tccccgccctttttt

SEQ ID NO: 4722792 - DNA, 13 bp, Homo sapiens
tcccctcctaccc

SEQ ID NO: 4722793 - DNA, 14 bp, Homo sapiens
tcccctcctacccc

SEQ ID NO: 4722794 - DNA, 12 bp, Homo sapiens
tcccctgccagg

SEQ ID NO: 4722795 - DNA, 14 bp, Homo sapiens
tcccctgccagggc

SEQ ID NO: 4722796 - DNA, 14 bp, Homo sapiens
tcccctgcccccag

SEQ ID NO: 4722797 - DNA, 18 bp, Homo sapiens
tcccctgcccccaggact

SEQ ID NO: 4722798 - DNA, 22 bp, Homo sapiens
tcccctgcccccaggactgggc

SEQ ID NO: 4722799 - DNA, 16 bp, Homo sapiens
tcccctgccccctgca

SEQ ID NO: 4722800 - DNA, 21 bp, Homo sapiens
tcccctgctgggtgtggcgca

SEQ ID NO: 4722801 - DNA, 18 bp, Homo sapiens
tcccctgtttgtttctga

SEQ ID NO: 4722802 - DNA, 13 bp, Homo sapiens
tccccttccactg

SEQ ID NO: 4722803 - DNA, 16 bp, Homo sapiens
tccccttctctcatct

SEQ ID NO: 4722804 - DNA, 18 bp, Homo sapiens
tcccgaatagctgggact

SEQ ID NO: 4722805 - DNA, 22 bp, Homo sapiens
tcccgagcacctccacatcctc

SEQ ID NO: 4722806 - DNA, 20 bp, Homo sapiens
tcccgagtagctgggactac

SEQ ID NO: 4722807 - DNA, 22 bp, Homo sapiens
tcccggagggaaactgtgaatg

SEQ ID NO: 4722808 - DNA, 13 bp, Homo sapiens
tcccggctgccct

SEQ ID NO: 4722809 - DNA, 19 bp, Homo sapiens
tcccgtggccccagcctgg

SEQ ID NO: 4722810 - DNA, 20 bp, Homo sapiens
tcccgtggccccagcctggc

SEQ ID NO: 4722811 - DNA, 21 bp, Homo sapiens
tcccgtggccccagcctggcc

SEQ ID NO: 4722812 - DNA, 22 bp, Homo sapiens
tccctaaggcatgtgtgaaaca

SEQ ID NO: 4722813 - DNA, 20 bp, Homo sapiens
tccctaatgctgcagatttg

SEQ ID NO: 4722814 - DNA, 19 bp, Homo sapiens
tccctatctttgccaccct

SEQ ID NO: 4722815 - DNA, 21 bp, Homo sapiens
tccctcagatcccagttcctt

SEQ ID NO: 4722816 - DNA, 15 bp, Homo sapiens
tccctcagtttctta

SEQ ID NO: 4722817 - DNA, 16 bp, Homo sapiens
tccctcatctgtccct

SEQ ID NO: 4722818 - DNA, 21 bp, Homo sapiens
tccctcatctgtccctccggg

SEQ ID NO: 4722819 - DNA, 12 bp, Homo sapiens
tccctccctgcc

SEQ ID NO: 4722820 - DNA, 12 bp, Homo sapiens
tccctcctggcc

SEQ ID NO: 4722821 - DNA, 15 bp, Homo sapiens
tccctgaaggccccg

SEQ ID NO: 4722822 - DNA, 17 bp, Homo sapiens
tccctgaagtcttgcat

SEQ ID NO: 4722823 - DNA, 20 bp, Homo sapiens
tccctgaagtcttgcattga

SEQ ID NO: 4722824 - DNA, 14 bp, Homo sapiens
tccctgactcattc

SEQ ID NO: 4722825 - DNA, 22 bp, Homo sapiens
tccctgactcattctgaaggag

SEQ ID NO: 4722826 - DNA, 15 bp, Homo sapiens
tccctgactgggagt

SEQ ID NO: 4722827 - DNA, 15 bp, Homo sapiens
tccctgaggactgat

SEQ ID NO: 4722828 - DNA, 20 bp, Homo sapiens
tccctgaggactgatttcag

SEQ ID NO: 4722829 - DNA, 22 bp, Homo sapiens
tccctgagttgcaccattcttt

SEQ ID NO: 4722830 - DNA, 19 bp, Homo sapiens
tccctgataacaacctgga

SEQ ID NO: 4722831 - DNA, 14 bp, Homo sapiens
tccctgccaatgga

SEQ ID NO: 4722832 - DNA, 18 bp, Homo sapiens
tccctgcctccacccaca

SEQ ID NO: 4722833 - DNA, 13 bp, Homo sapiens
tccctgctgtccc

SEQ ID NO: 4722834 - DNA, 14 bp, Homo sapiens
tccctgctgtcccc

SEQ ID NO: 4722835 - DNA, 21 bp, Homo sapiens
tccctgctgtcccctcttgcc

SEQ ID NO: 4722836 - DNA, 18 bp, Homo sapiens
tccctggtggcagctcac

SEQ ID NO: 4722837 - DNA, 19 bp, Homo sapiens
tccctggtggcagctcacc

SEQ ID NO: 4722838 - DNA, 22 bp, Homo sapiens
tccctggtggcagctcacctct

SEQ ID NO: 4722839 - DNA, 16 bp, Homo sapiens
tccctggttctgatga

SEQ ID NO: 4722840 - DNA, 15 bp, Homo sapiens
tctcttttcaaaaca

SEQ ID NO: 4722841 - DNA, 16 bp, Homo sapiens
tctgaaaatacatttc

SEQ ID NO: 4722842 - DNA, 13 bp, Homo sapiens
tctgaaaatataa

SEQ ID NO: 4722843 - DNA, 19 bp, Homo sapiens
tctgaaaattaacactgct

SEQ ID NO: 4722844 - DNA, 17 bp, Homo sapiens
tctgaacaaaatgcctt

SEQ ID NO: 4722845 - DNA, 17 bp, Homo sapiens
tctgaaccacctttgtc

SEQ ID NO: 4722846 - DNA, 23 bp, Homo sapiens
tctgaagatcccaacatggtcct

SEQ ID NO: 4722847 - DNA, 22 bp, Homo sapiens
tctgaaggacattgcggacagc

SEQ ID NO: 4722848 - DNA, 21 bp, Homo sapiens
tctgaaggagccccattcctg

SEQ ID NO: 4722849 - DNA, 19 bp, Homo sapiens
tctgaatattaagaaacaa

SEQ ID NO: 4722850 - DNA, 17 bp, Homo sapiens
tctgaatgaagccttct

SEQ ID NO: 4722851 - DNA, 12 bp, Homo sapiens
tctgacacacag

SEQ ID NO: 4722852 - DNA, 13 bp, Homo sapiens
tctgacacacagc

SEQ ID NO: 4722853 - DNA, 15 bp, Homo sapiens
tctgacacacagctc

SEQ ID NO: 4722854 - DNA, 19 bp, Homo sapiens
tctgacacacagctctgtc

SEQ ID NO: 4722855 - DNA, 13 bp, Homo sapiens
tctgacatattat

SEQ ID NO: 4722856 - DNA, 17 bp, Homo sapiens
tctgacatattatgcct

SEQ ID NO: 4722857 - DNA, 14 bp, Homo sapiens
tctgacccactgct

SEQ ID NO: 4722858 - DNA, 15 bp, Homo sapiens
tctgacccactgctt

SEQ ID NO: 4722859 - DNA, 15 bp, Homo sapiens
tctgacccatgctgc

SEQ ID NO: 4722860 - DNA, 18 bp, Homo sapiens
tctgacccatgctgccct

SEQ ID NO: 4722861 - DNA, 20 bp, Homo sapiens
tctgacccatgctgccctgt

SEQ ID NO: 4722862 - DNA, 21 bp, Homo sapiens
tctgacctgcaaaaatgctgg

SEQ ID NO: 4722863 - DNA, 22 bp, Homo sapiens
tctgacctgcaaaaatgctgga

SEQ ID NO: 4722864 - DNA, 14 bp, Homo sapiens
tctgacgcagcctg

SEQ ID NO: 4722865 - DNA, 18 bp, Homo sapiens
tctgacgcagcctgagaa

SEQ ID NO: 4722866 - DNA, 19 bp, Homo sapiens
tctgacgcagcctgagaat

SEQ ID NO: 4722867 - DNA, 13 bp, Homo sapiens
tctgactcagggc

SEQ ID NO: 4722868 - DNA, 20 bp, Homo sapiens
tctgactcagggctcctggg

SEQ ID NO: 4722869 - DNA, 13 bp, Homo sapiens
tctgagaactcat

SEQ ID NO: 4722870 - DNA, 18 bp, Homo sapiens
tctgagaggacttttctt

SEQ ID NO: 4722871 - DNA, 20 bp, Homo sapiens
tctgagcattagatttctca

SEQ ID NO: 4722872 - DNA, 17 bp, Homo sapiens
tctgaggaatccagacc

SEQ ID NO: 4722873 - DNA, 18 bp, Homo sapiens
tctgaggaatccagaccc

SEQ ID NO: 4722874 - DNA, 22 bp, Homo sapiens
tctgaggaatccagacccggct

SEQ ID NO: 4722875 - DNA, 23 bp, Homo sapiens
tctgaggacactaaccacgctgg

SEQ ID NO: 4722876 - DNA, 16 bp, Homo sapiens
tctgaggagctgttac

SEQ ID NO: 4722877 - DNA, 19 bp, Homo sapiens
tctgaggggcaactgagtc

SEQ ID NO: 4722878 - DNA, 23 bp, Homo sapiens
tctgagtagagcttgtaataaat

SEQ ID NO: 4722879 - DNA, 15 bp, Homo sapiens
tctgagtcagctgac

SEQ ID NO: 4722880 - DNA, 23 bp, Homo sapiens
tctgagtcagctgaccccctccc

SEQ ID NO: 4722881 - DNA, 17 bp, Homo sapiens
tctgatcatccactgtg

SEQ ID NO: 4722882 - DNA, 13 bp, Homo sapiens
tctgatggcttct

SEQ ID NO: 4722883 - DNA, 17 bp, Homo sapiens
tctgattagaaaggaaa

SEQ ID NO: 4722884 - DNA, 20 bp, Homo sapiens
tctgattcccaagctctgct

SEQ ID NO: 4722885 - DNA, 22 bp, Homo sapiens
tctgcacccagccccaaggggt

SEQ ID NO: 4722886 - DNA, 14 bp, Homo sapiens
tctgcactcccctg

SEQ ID NO: 4722887 - DNA, 18 bp, Homo sapiens
tctgcagtgtggcaagca

SEQ ID NO: 4722888 - DNA, 15 bp, Homo sapiens
tctgcatttaaaaaa

SEQ ID NO: 4722889 - DNA, 22 bp, Homo sapiens
tctgccatattctgttggccag

SEQ ID NO: 4722890 - DNA, 16 bp, Homo sapiens
tctgcccactccctgc

SEQ ID NO: 4722891 - DNA, 12 bp, Homo sapiens
tctgcccaggac

SEQ ID NO: 4722892 - DNA, 13 bp, Homo sapiens
tctgcccctccct

SEQ ID NO: 4722893 - DNA, 15 bp, Homo sapiens
tctgcccctccctgc

SEQ ID NO: 4722894 - DNA, 15 bp, Homo sapiens
tctgcctcccatcac

SEQ ID NO: 4722895 - DNA, 17 bp, Homo sapiens
tctgcctcccatcaccc

SEQ ID NO: 4722896 - DNA, 15 bp, Homo sapiens
tctgcctcttctggg

SEQ ID NO: 4722897 - DNA, 18 bp, Homo sapiens
tctgcctcttctgggagg

SEQ ID NO: 4722898 - DNA, 19 bp, Homo sapiens
tctgcctcttctgggaggg

SEQ ID NO: 4722899 - DNA, 18 bp, Homo sapiens
tctgcctgcccaggcccc

SEQ ID NO: 4722900 - DNA, 20 bp, Homo sapiens
tctgcctgcccaggcccctg

SEQ ID NO: 4722901 - DNA, 14 bp, Homo sapiens
tctgccttccttgc

SEQ ID NO: 4722902 - DNA, 23 bp, Homo sapiens
tctgccttgaaatacctgtttct

SEQ ID NO: 4722903 - DNA, 20 bp, Homo sapiens
tctgcgtgtcacctgtgctt

SEQ ID NO: 4722904 - DNA, 17 bp, Homo sapiens
tctgctagtgctgtaat

SEQ ID NO: 4722905 - DNA, 15 bp, Homo sapiens
tctgctcatcattct

SEQ ID NO: 4722906 - DNA, 21 bp, Homo sapiens
tctgctcctctccccagcaag

SEQ ID NO: 4722907 - DNA, 19 bp, Homo sapiens
tctgctctccttcctggag

SEQ ID NO: 4722908 - DNA, 20 bp, Homo sapiens
tctgctctccttcctggagc

SEQ ID NO: 4722909 - DNA, 21 bp, Homo sapiens
tctgctctgcgtgtcacctgt

SEQ ID NO: 4722910 - DNA, 17 bp, Homo sapiens
tctgctgacagacacag

SEQ ID NO: 4722911 - DNA, 18 bp, Homo sapiens
tctgctgacagacacagg

SEQ ID NO: 4722912 - DNA, 21 bp, Homo sapiens
tctgctgacagacacaggccc

SEQ ID NO: 4722913 - DNA, 22 bp, Homo sapiens
tctgctgacagacacaggcccg

SEQ ID NO: 4722914 - DNA, 11 bp, Homo sapiens
tctgctgctgg

SEQ ID NO: 4722915 - DNA, 13 bp, Homo sapiens
tctgctgctggct

SEQ ID NO: 4722916 - DNA, 14 bp, Homo sapiens
tctgctgggctggg

SEQ ID NO: 4722917 - DNA, 17 bp, Homo sapiens
tctgctgggctggggcc

SEQ ID NO: 4722918 - DNA, 19 bp, Homo sapiens
tctgcttgttattagagat

SEQ ID NO: 4722919 - DNA, 13 bp, Homo sapiens
tctgctttcctct

SEQ ID NO: 4722920 - DNA, 15 bp, Homo sapiens
tctggaatgcagtgg

SEQ ID NO: 4722921 - DNA, 16 bp, Homo sapiens
tctggaatgcagtggt

SEQ ID NO: 4722922 - DNA, 13 bp, Homo sapiens
tctggagagctag

SEQ ID NO: 4722923 - DNA, 14 bp, Homo sapiens
tctggagagctaga

SEQ ID NO: 4722924 - DNA, 22 bp, Homo sapiens
tctggagagctagaacctggag

SEQ ID NO: 4722925 - DNA, 19 bp, Homo sapiens
tctggattcatatttaatt

SEQ ID NO: 4722926 - DNA, 13 bp, Homo sapiens
tctggattcccag

SEQ ID NO: 4722927 - DNA, 21 bp, Homo sapiens
tctggattcccaggatgagca

SEQ ID NO: 4722928 - DNA, 17 bp, Homo sapiens
tctggcaaacatgtgca

SEQ ID NO: 4722929 - DNA, 18 bp, Homo sapiens
tctggcaaacatgtgcaa

SEQ ID NO: 4722930 - DNA, 22 bp, Homo sapiens
tctggcacacagtaggtgctca

SEQ ID NO: 4722931 - DNA, 16 bp, Homo sapiens
tctggctcttccaggc

SEQ ID NO: 4722932 - DNA, 17 bp, Homo sapiens
tctggctcttccaggct

SEQ ID NO: 4722933 - DNA, 13 bp, Homo sapiens
tctgggacacagt

SEQ ID NO: 4722934 - DNA, 19 bp, Homo sapiens
tctgggagggcagcagggc

SEQ ID NO: 4722935 - DNA, 17 bp, Homo sapiens
tctgggtccaggcctgg

SEQ ID NO: 4722936 - DNA, 16 bp, Homo sapiens
tctgggttccttcctc

SEQ ID NO: 4722937 - DNA, 15 bp, Homo sapiens
tctgggttgccttta

SEQ ID NO: 4722938 - DNA, 20 bp, Homo sapiens
tctgggtttacaacaaacac

SEQ ID NO: 4722939 - DNA, 16 bp, Homo sapiens
tctggtggttatttaa

SEQ ID NO: 4722940 - DNA, 13 bp, Homo sapiens
tctgtaataatag

SEQ ID NO: 4722941 - DNA, 16 bp, Homo sapiens
tctgtaataatagact

SEQ ID NO: 4722942 - DNA, 19 bp, Homo sapiens
tctgtaataatagactgta

SEQ ID NO: 4722943 - DNA, 15 bp, Homo sapiens
tctgtacagagccca

SEQ ID NO: 4722944 - DNA, 20 bp, Homo sapiens
tctgtagggtaattagtaac

SEQ ID NO: 4722945 - DNA, 19 bp, Homo sapiens
tctgtccccttctctcatc

SEQ ID NO: 4722946 - DNA, 16 bp, Homo sapiens
tctgtcccttgccccc

SEQ ID NO: 4722947 - DNA, 19 bp, Homo sapiens
tctgtcccttgcccccctg

SEQ ID NO: 4722948 - DNA, 10 bp, Homo sapiens
tctgtcctga

SEQ ID NO: 4722949 - DNA, 21 bp, Homo sapiens
tctgtcctgggagtgagctgg

SEQ ID NO: 4722950 - DNA, 23 bp, Homo sapiens
tgacaaatgtgtatgtgtggttt

SEQ ID NO: 4722951 - DNA, 18 bp, Homo sapiens
tgacaattcagtgactta

SEQ ID NO: 4722952 - DNA, 16 bp, Homo sapiens
tgacacaaacctgcct

SEQ ID NO: 4722953 - DNA, 17 bp, Homo sapiens
tgacacaaacctgcctg

SEQ ID NO: 4722954 - DNA, 15 bp, Homo sapiens
tgacacacagctctg

SEQ ID NO: 4722955 - DNA, 16 bp, Homo sapiens
tgacaccaaaatgaac

SEQ ID NO: 4722956 - DNA, 24 bp, Homo sapiens
tgacaccagctgttctgtcccttg

SEQ ID NO: 4722957 - DNA, 17 bp, Homo sapiens
tgacaccccccttctga

SEQ ID NO: 4722958 - DNA, 18 bp, Homo sapiens
tgacaccccccttctgaa

SEQ ID NO: 4722959 - DNA, 20 bp, Homo sapiens
tgacacctagagtttggact

SEQ ID NO: 4722960 - DNA, 22 bp, Homo sapiens
tgacactcccttgggctccctg

SEQ ID NO: 4722961 - DNA, 21 bp, Homo sapiens
tgacactggtattcctgcctc

SEQ ID NO: 4722962 - DNA, 20 bp, Homo sapiens
tgacacttataaatatcctg

SEQ ID NO: 4722963 - DNA, 23 bp, Homo sapiens
tgacagacacaggcccggctcca

SEQ ID NO: 4722964 - DNA, 16 bp, Homo sapiens
tgacagacagccctcc

SEQ ID NO: 4722965 - DNA, 16 bp, Homo sapiens
tgacagaggcagcccc

SEQ ID NO: 4722966 - DNA, 19 bp, Homo sapiens
tgacagatatatttaagcc

SEQ ID NO: 4722967 - DNA, 21 bp, Homo sapiens
tgacagatcctccatttttgt

SEQ ID NO: 4722968 - DNA, 21 bp, Homo sapiens
tgacagccaccctcaccgcgg

SEQ ID NO: 4722969 - DNA, 20 bp, Homo sapiens
tgacaggcaatgctggctgt

SEQ ID NO: 4722970 - DNA, 16 bp, Homo sapiens
tgacagggcacaccgg

SEQ ID NO: 4722971 - DNA, 15 bp, Homo sapiens
tgacatattatgcct

SEQ ID NO: 4722972 - DNA, 20 bp, Homo sapiens
tgacatattatgcctgaatg

SEQ ID NO: 4722973 - DNA, 12 bp, Homo sapiens
tgacatgtgaaa

SEQ ID NO: 4722974 - DNA, 13 bp, Homo sapiens
tgacatgtgaaac

SEQ ID NO: 4722975 - DNA, 21 bp, Homo sapiens
tgacatgtgaaacctttttta

SEQ ID NO: 4722976 - DNA, 17 bp, Homo sapiens
tgacattcatgcctggc

SEQ ID NO: 4722977 - DNA, 20 bp, Homo sapiens
tgacattgttggccaaagcc

SEQ ID NO: 4722978 - DNA, 14 bp, Homo sapiens
tgacattttgccaa

SEQ ID NO: 4722979 - DNA, 16 bp, Homo sapiens
tgaccaaaatcccctt

SEQ ID NO: 4722980 - DNA, 17 bp, Homo sapiens
tgaccaatattgtacag

SEQ ID NO: 4722981 - DNA, 18 bp, Homo sapiens
tgaccaatattgtacagt

SEQ ID NO: 4722982 - DNA, 21 bp, Homo sapiens
tgaccaatattgtacagtttt

SEQ ID NO: 4722983 - DNA, 13 bp, Homo sapiens
tgaccaggcctgg

SEQ ID NO: 4722984 - DNA, 20 bp, Homo sapiens
tgaccaggcctgggccagag

SEQ ID NO: 4722985 - DNA, 23 bp, Homo sapiens
tgaccagtttaacctgatgcagt

SEQ ID NO: 4722986 - DNA, 13 bp, Homo sapiens
tgaccattctcca

SEQ ID NO: 4722987 - DNA, 16 bp, Homo sapiens
tgaccattctccacct

SEQ ID NO: 4722988 - DNA, 16 bp, Homo sapiens
tgacccacagcctcca

SEQ ID NO: 4722989 - DNA, 17 bp, Homo sapiens
tgacccaggctgggcaa

SEQ ID NO: 4722990 - DNA, 17 bp, Homo sapiens
tgacccatgctgccctg

SEQ ID NO: 4722991 - DNA, 21 bp, Homo sapiens
tgaccccctccccccaatccc

SEQ ID NO: 4722992 - DNA, 15 bp, Homo sapiens
tgacctacagtgctg

SEQ ID NO: 4722993 - DNA, 21 bp, Homo sapiens
tgacctagttcagatacaggg

SEQ ID NO: 4722994 - DNA, 12 bp, Homo sapiens
tgacctctgcct

SEQ ID NO: 4722995 - DNA, 14 bp, Homo sapiens
tgacctgaactctg

SEQ ID NO: 4722996 - DNA, 14 bp, Homo sapiens
tgacctgaggccct

SEQ ID NO: 4722997 - DNA, 17 bp, Homo sapiens
tgacctgaggcccttct

SEQ ID NO: 4722998 - DNA, 15 bp, Homo sapiens
tgacctgcaaaaatg

SEQ ID NO: 4722999 - DNA, 17 bp, Homo sapiens
tgacctgcctcccttca

SEQ ID NO: 4723000 - DNA, 14 bp, Homo sapiens
tgacctgtggtgca

SEQ ID NO: 4723001 - DNA, 18 bp, Homo sapiens
tgactcagggctcctggg

SEQ ID NO: 4723002 - DNA, 18 bp, Homo sapiens
tgactcgggctcctgtgc

SEQ ID NO: 4723003 - DNA, 21 bp, Homo sapiens
tgactcgggctcctgtgccct

SEQ ID NO: 4723004 - DNA, 15 bp, Homo sapiens
tgactctaaaatatg

SEQ ID NO: 4723005 - DNA, 14 bp, Homo sapiens
tgactggttgttca

SEQ ID NO: 4723006 - DNA, 16 bp, Homo sapiens
tgactggttgttcaaa

SEQ ID NO: 4723007 - DNA, 24 bp, Homo sapiens
tgactgttcaagagcacacttggc

SEQ ID NO: 4723008 - DNA, 18 bp, Homo sapiens
tgactgttgttcttataa

SEQ ID NO: 4723009 - DNA, 16 bp, Homo sapiens
tgacttagcagatgct

SEQ ID NO: 4723010 - DNA, 21 bp, Homo sapiens
tgacttcaggggctgcccgct

SEQ ID NO: 4723011 - DNA, 15 bp, Homo sapiens
tgacttctatcctgt

SEQ ID NO: 4723012 - DNA, 21 bp, Homo sapiens
tgagaaaaatttacatggcaa

SEQ ID NO: 4723013 - DNA, 20 bp, Homo sapiens
tgagaaacaacaatttctac

SEQ ID NO: 4723014 - DNA, 22 bp, Homo sapiens
tgagaaacagctacagctttgg

SEQ ID NO: 4723015 - DNA, 23 bp, Homo sapiens
tgagaacatggtgtgtgtctctg

SEQ ID NO: 4723016 - DNA, 19 bp, Homo sapiens
tgagaagggctcagagagg

SEQ ID NO: 4723017 - DNA, 20 bp, Homo sapiens
tgagaagggctcagagagga

SEQ ID NO: 4723018 - DNA, 24 bp, Homo sapiens
tgagaagggctcagagaggacaaa

SEQ ID NO: 4723019 - DNA, 18 bp, Homo sapiens
tgagaatgacctgccctg

SEQ ID NO: 4723020 - DNA, 15 bp, Homo sapiens
tgagaatgtaagaac

SEQ ID NO: 4723021 - DNA, 15 bp, Homo sapiens
tgagacactgcacag

SEQ ID NO: 4723022 - DNA, 19 bp, Homo sapiens
tgagacactgcacagaaga

SEQ ID NO: 4723023 - DNA, 18 bp, Homo sapiens
tgagacagcccgggctct

SEQ ID NO: 4723024 - DNA, 19 bp, Homo sapiens
tgagacagcccgggctctg

SEQ ID NO: 4723025 - DNA, 19 bp, Homo sapiens
tgagacagtccagcctgga

SEQ ID NO: 4723026 - DNA, 18 bp, Homo sapiens
tgagacccagccctcatc

SEQ ID NO: 4723027 - DNA, 16 bp, Homo sapiens
tgagacccaggagccg

SEQ ID NO: 4723028 - DNA, 15 bp, Homo sapiens
tgagacctgcccctc

SEQ ID NO: 4723029 - DNA, 12 bp, Homo sapiens
tgagactcgaga

SEQ ID NO: 4723030 - DNA, 15 bp, Homo sapiens
tgagactcgagaact

SEQ ID NO: 4723031 - DNA, 23 bp, Homo sapiens
tgagactctcttaggagcagagc

SEQ ID NO: 4723032 - DNA, 12 bp, Homo sapiens
tgagactctgtc

SEQ ID NO: 4723033 - DNA, 13 bp, Homo sapiens
tgagactctgtct

SEQ ID NO: 4723034 - DNA, 18 bp, Homo sapiens
tgagagaataatttctgt

SEQ ID NO: 4723035 - DNA, 20 bp, Homo sapiens
tgagagaataatttctgttg

SEQ ID NO: 4723036 - DNA, 14 bp, Homo sapiens
tgagagaccaggca

SEQ ID NO: 4723037 - DNA, 24 bp, Homo sapiens
tgagagaccaggcaaagcaagtga

SEQ ID NO: 4723038 - DNA, 17 bp, Homo sapiens
tgagagagagactgtgt

SEQ ID NO: 4723039 - DNA, 19 bp, Homo sapiens
tgagagagagactgtgtgt

SEQ ID NO: 4723040 - DNA, 15 bp, Homo sapiens
tgagagcataattta

SEQ ID NO: 4723041 - DNA, 15 bp, Homo sapiens
tgagagcccagaggt

SEQ ID NO: 4723042 - DNA, 16 bp, Homo sapiens
tgagagcccagaggta

SEQ ID NO: 4723043 - DNA, 23 bp, Homo sapiens
tgagaggacttttctttgtggct

SEQ ID NO: 4723044 - DNA, 19 bp, Homo sapiens
tgagagggccctgcctgct

SEQ ID NO: 4723045 - DNA, 14 bp, Homo sapiens
tgagaggggaacag

SEQ ID NO: 4723046 - DNA, 18 bp, Homo sapiens
tgagaggggaacagactg

SEQ ID NO: 4723047 - DNA, 18 bp, Homo sapiens
tgagagttcgtgaagagg

SEQ ID NO: 4723048 - DNA, 19 bp, Homo sapiens
tgagatggacttggggcct

SEQ ID NO: 4723049 - DNA, 14 bp, Homo sapiens
tgagatttcatctg

SEQ ID NO: 4723050 - DNA, 19 bp, Homo sapiens
tgagatttcatctgctctc

SEQ ID NO: 4723051 - DNA, 22 bp, Homo sapiens
tgagatttcatctgctctcctt

SEQ ID NO: 4723052 - DNA, 14 bp, Homo sapiens
tgagcagggctcag

SEQ ID NO: 4723053 - DNA, 15 bp, Homo sapiens
tgagcagggctcagc

SEQ ID NO: 4723054 - DNA, 16 bp, Homo sapiens
tgagcagggctcagcg

SEQ ID NO: 4723055 - DNA, 22 bp, Homo sapiens
tgagcagggctcagcggggaca

SEQ ID NO: 4723056 - DNA, 23 bp, Homo sapiens
tgagcagggctcagcggggacag

SEQ ID NO: 4723057 - DNA, 15 bp, Homo sapiens
tgagcatcaggccag

SEQ ID NO: 4723058 - DNA, 18 bp, Homo sapiens
tgagcatggagctggccg

SEQ ID NO: 4723059 - DNA, 22 bp, Homo sapiens
tgccattttattaaacattttc

SEQ ID NO: 4723060 - DNA, 14 bp, Homo sapiens
tgcccacctggcct

SEQ ID NO: 4723061 - DNA, 15 bp, Homo sapiens
tgcccacctggcctc

SEQ ID NO: 4723062 - DNA, 18 bp, Homo sapiens
tgcccacgctggagtgca

SEQ ID NO: 4723063 - DNA, 14 bp, Homo sapiens
tgcccactccctgc

SEQ ID NO: 4723064 - DNA, 21 bp, Homo sapiens
tgcccactccctgcaacctga

SEQ ID NO: 4723065 - DNA, 15 bp, Homo sapiens
tgcccaggcaggtct

SEQ ID NO: 4723066 - DNA, 17 bp, Homo sapiens
tgcccaggcaggtcttg

SEQ ID NO: 4723067 - DNA, 20 bp, Homo sapiens
tgcccaggcaggtcttgaac

SEQ ID NO: 4723068 - DNA, 14 bp, Homo sapiens
tgcccaggcccctg

SEQ ID NO: 4723069 - DNA, 15 bp, Homo sapiens
tgcccaggcccctgc

SEQ ID NO: 4723070 - DNA, 18 bp, Homo sapiens
tgcccaggcccctgccac

SEQ ID NO: 4723071 - DNA, 20 bp, Homo sapiens
tgcccaggcccctgccaccc

SEQ ID NO: 4723072 - DNA, 19 bp, Homo sapiens
tgcccaggctggcgtgcag

SEQ ID NO: 4723073 - DNA, 23 bp, Homo sapiens
tgcccaggctggcgtgcagtggt

SEQ ID NO: 4723074 - DNA, 17 bp, Homo sapiens
tgccccaacccccagca

SEQ ID NO: 4723075 - DNA, 21 bp, Homo sapiens
tgccccatcagtgctccctca

SEQ ID NO: 4723076 - DNA, 14 bp, Homo sapiens
tgcccccaggactg

SEQ ID NO: 4723077 - DNA, 17 bp, Homo sapiens
tgcccccaggactgggc

SEQ ID NO: 4723078 - DNA, 19 bp, Homo sapiens
tgcccccaggactgggcca

SEQ ID NO: 4723079 - DNA, 12 bp, Homo sapiens
tgccccccagcc

SEQ ID NO: 4723080 - DNA, 14 bp, Homo sapiens
tgccccccatcctg

SEQ ID NO: 4723081 - DNA, 16 bp, Homo sapiens
tgccccccatcctggc

SEQ ID NO: 4723082 - DNA, 19 bp, Homo sapiens
tgccccccatcctggccca

SEQ ID NO: 4723083 - DNA, 13 bp, Homo sapiens
tgccccctcgtgc

SEQ ID NO: 4723084 - DNA, 15 bp, Homo sapiens
tgccccctcgtgcca

SEQ ID NO: 4723085 - DNA, 16 bp, Homo sapiens
tgccccctcgtgccag

SEQ ID NO: 4723086 - DNA, 14 bp, Homo sapiens
tgccccctctgccc

SEQ ID NO: 4723087 - DNA, 12 bp, Homo sapiens
tgccccctgcag

SEQ ID NO: 4723088 - DNA, 15 bp, Homo sapiens
tgccccgcaggcctg

SEQ ID NO: 4723089 - DNA, 18 bp, Homo sapiens
tgccccgtccccctctgg

SEQ ID NO: 4723090 - DNA, 14 bp, Homo sapiens
tgcccctccctgcc

SEQ ID NO: 4723091 - DNA, 22 bp, Homo sapiens
tgcccctccctgcctccaccca

SEQ ID NO: 4723092 - DNA, 14 bp, Homo sapiens
tgcccgctcccagt

SEQ ID NO: 4723093 - DNA, 18 bp, Homo sapiens
tgcccggcgccctctgtc

SEQ ID NO: 4723094 - DNA, 22 bp, Homo sapiens
tgccctccaagaccttctcctt

SEQ ID NO: 4723095 - DNA, 23 bp, Homo sapiens
tgccctgcccacctggcctctgc

SEQ ID NO: 4723096 - DNA, 19 bp, Homo sapiens
tgccctgcgggtcacagga

SEQ ID NO: 4723097 - DNA, 18 bp, Homo sapiens
tgccctgctgagtcccag

SEQ ID NO: 4723098 - DNA, 22 bp, Homo sapiens
tgccctgctgagtcccaggctg

SEQ ID NO: 4723099 - DNA, 19 bp, Homo sapiens
tgccctggccccagcccta

SEQ ID NO: 4723100 - DNA, 13 bp, Homo sapiens
tgccctgggaggc

SEQ ID NO: 4723101 - DNA, 20 bp, Homo sapiens
tgccctggtttcctgccctg

SEQ ID NO: 4723102 - DNA, 15 bp, Homo sapiens
tgcccttcctttcta

SEQ ID NO: 4723103 - DNA, 18 bp, Homo sapiens
tgcccttgctccagcctg

SEQ ID NO: 4723104 - DNA, 19 bp, Homo sapiens
tgcccttgctccagcctga

SEQ ID NO: 4723105 - DNA, 15 bp, Homo sapiens
tgccgacagaaggaa

SEQ ID NO: 4723106 - DNA, 14 bp, Homo sapiens
tgccgcagagctgg

SEQ ID NO: 4723107 - DNA, 16 bp, Homo sapiens
tgccgccccacccaga

SEQ ID NO: 4723108 - DNA, 16 bp, Homo sapiens
tgccgccgcctcgccc

SEQ ID NO: 4723109 - DNA, 15 bp, Homo sapiens
tgccgtctacctgag

SEQ ID NO: 4723110 - DNA, 16 bp, Homo sapiens
tgccgtctacctgagg

SEQ ID NO: 4723111 - DNA, 12 bp, Homo sapiens
tgcctaccattt

SEQ ID NO: 4723112 - DNA, 12 bp, Homo sapiens
tgcctaccttgt

SEQ ID NO: 4723113 - DNA, 18 bp, Homo sapiens
tgcctacgtgacaacaca

SEQ ID NO: 4723114 - DNA, 14 bp, Homo sapiens
tgcctatctgactt

SEQ ID NO: 4723115 - DNA, 18 bp, Homo sapiens
tgcctatctgacttcata

SEQ ID NO: 4723116 - DNA, 14 bp, Homo sapiens
tgcctcagcctccc

SEQ ID NO: 4723117 - DNA, 15 bp, Homo sapiens
tgcctcagcctcccg

SEQ ID NO: 4723118 - DNA, 16 bp, Homo sapiens
tgcctccacccacagt

SEQ ID NO: 4723119 - DNA, 16 bp, Homo sapiens
tgcctccactcccact

SEQ ID NO: 4723120 - DNA, 19 bp, Homo sapiens
tgcctccactcccacttcc

SEQ ID NO: 4723121 - DNA, 23 bp, Homo sapiens
tgcctccagggctggactgaggc

SEQ ID NO: 4723122 - DNA, 22 bp, Homo sapiens
tgcctcccatcacccgctaaga

SEQ ID NO: 4723123 - DNA, 21 bp, Homo sapiens
tgcctcctacaaccaggtctt

SEQ ID NO: 4723124 - DNA, 16 bp, Homo sapiens
tgcctcctttgtgagg

SEQ ID NO: 4723125 - DNA, 20 bp, Homo sapiens
tgcctcctttgtgaggaagc

SEQ ID NO: 4723126 - DNA, 21 bp, Homo sapiens
tgcctcctttgtgaggaagcc

SEQ ID NO: 4723127 - DNA, 18 bp, Homo sapiens
tgcctcggctcctgctgc

SEQ ID NO: 4723128 - DNA, 21 bp, Homo sapiens
tgcctcggctcctgctgcacc

SEQ ID NO: 4723129 - DNA, 15 bp, Homo sapiens
tgcctctacctgaca

SEQ ID NO: 4723130 - DNA, 20 bp, Homo sapiens
tgcctctgacacacagctct

SEQ ID NO: 4723131 - DNA, 15 bp, Homo sapiens
tgcctctgcctctga

SEQ ID NO: 4723132 - DNA, 13 bp, Homo sapiens
tgcctctgtcccc

SEQ ID NO: 4723133 - DNA, 16 bp, Homo sapiens
tgcctctgtccccttc

SEQ ID NO: 4723134 - DNA, 17 bp, Homo sapiens
tgcctctgtccccttct

SEQ ID NO: 4723135 - DNA, 23 bp, Homo sapiens
tgcctctgtttgacaaacctcta

SEQ ID NO: 4723136 - DNA, 18 bp, Homo sapiens
tgcctgaagaccccagat

SEQ ID NO: 4723137 - DNA, 17 bp, Homo sapiens
tgcctgaagtcacacag

SEQ ID NO: 4723138 - DNA, 18 bp, Homo sapiens
tgcctgaagtcacacagt

SEQ ID NO: 4723139 - DNA, 22 bp, Homo sapiens
tgcctgaagtcacacagtgagt

SEQ ID NO: 4723140 - DNA, 15 bp, Homo sapiens
tgcctgagcccctca

SEQ ID NO: 4723141 - DNA, 16 bp, Homo sapiens
tgcctgagcccctcag

SEQ ID NO: 4723142 - DNA, 18 bp, Homo sapiens
tgcctgagcccctcagac

SEQ ID NO: 4723143 - DNA, 15 bp, Homo sapiens
tgcctgatggacctg

SEQ ID NO: 4723144 - DNA, 21 bp, Homo sapiens
tgcctgattcggctgtctcag

SEQ ID NO: 4723145 - DNA, 13 bp, Homo sapiens
tgcctgcccaggc

SEQ ID NO: 4723146 - DNA, 17 bp, Homo sapiens
tgcctgcccaggcccct

SEQ ID NO: 4723147 - DNA, 23 bp, Homo sapiens
tgcctgcccaggcccctgccacc

SEQ ID NO: 4723148 - DNA, 17 bp, Homo sapiens
tgcctggatggggctgc

SEQ ID NO: 4723149 - DNA, 18 bp, Homo sapiens
tgcctgggacggctgagc

SEQ ID NO: 4723150 - DNA, 14 bp, Homo sapiens
tgcctgggcctagc

SEQ ID NO: 4723151 - DNA, 21 bp, Homo sapiens
tgcctgggtggacatggcccc

SEQ ID NO: 4723152 - DNA, 22 bp, Homo sapiens
tgcctgggtttaaggggagagg

SEQ ID NO: 4723153 - DNA, 17 bp, Homo sapiens
tgcctggtggcagctgc

SEQ ID NO: 4723154 - DNA, 18 bp, Homo sapiens
tgcctggtggcagctgcg

SEQ ID NO: 4723155 - DNA, 11 bp, Homo sapiens
tgcctgtaatc

SEQ ID NO: 4723156 - DNA, 22 bp, Homo sapiens
tgcctgtgtgcgagtctgagtc

SEQ ID NO: 4723157 - DNA, 20 bp, Homo sapiens
tgcctgttcagctccagctc

SEQ ID NO: 4723158 - DNA, 17 bp, Homo sapiens
tgccttaaagtcagtaa

SEQ ID NO: 4723159 - DNA, 23 bp, Homo sapiens
tgccttattagagtgtctttcca

SEQ ID NO: 4723160 - DNA, 14 bp, Homo sapiens
tgccttcctcctgg

SEQ ID NO: 4723161 - DNA, 16 bp, Homo sapiens
tgccttcctcctgggc

SEQ ID NO: 4723162 - DNA, 20 bp, Homo sapiens
tgcctttcagaagtgattta

SEQ ID NO: 4723163 - DNA, 23 bp, Homo sapiens
tgcctttgacctgcctcccttca

SEQ ID NO: 4723164 - DNA, 18 bp, Homo sapiens
tgcctttgagacagtttc

SEQ ID NO: 4723165 - DNA, 15 bp, Homo sapiens
tgccttttctagccc

SEQ ID NO: 4723166 - DNA, 23 bp, Homo sapiens
tgcgagagatgtgtgttgatact

SEQ ID NO: 4723167 - DNA, 20 bp, Homo sapiens
tgcgagtgctcatttcagga

SEQ ID NO: 4723168 - DNA, 20 bp, Homo sapiens
tgcgatctgggttcactgca

SEQ ID NO: 4723169 - DNA, 11 bp, Homo sapiens
tggctgtgaaa

SEQ ID NO: 4723170 - DNA, 19 bp, Homo sapiens
tggctgtggcattgttgat

SEQ ID NO: 4723171 - DNA, 15 bp, Homo sapiens
tggcttatccagctg

SEQ ID NO: 4723172 - DNA, 21 bp, Homo sapiens
tggcttgagtttaaattgtaa

SEQ ID NO: 4723173 - DNA, 21 bp, Homo sapiens
tggcttgctttcttctcctgt

SEQ ID NO: 4723174 - DNA, 17 bp, Homo sapiens
tggctttgttcttgtca

SEQ ID NO: 4723175 - DNA, 22 bp, Homo sapiens
tggcttttctggaatggaattg

SEQ ID NO: 4723176 - DNA, 13 bp, Homo sapiens
tgggaactagact

SEQ ID NO: 4723177 - DNA, 17 bp, Homo sapiens
tgggaagctatttcctt

SEQ ID NO: 4723178 - DNA, 12 bp, Homo sapiens
tgggacaccctg

SEQ ID NO: 4723179 - DNA, 13 bp, Homo sapiens
tgggacaccctgt

SEQ ID NO: 4723180 - DNA, 15 bp, Homo sapiens
tgggacaccctgtga

SEQ ID NO: 4723181 - DNA, 18 bp, Homo sapiens
tgggactacaggcaccca

SEQ ID NO: 4723182 - DNA, 18 bp, Homo sapiens
tgggagacagtctaggaa

SEQ ID NO: 4723183 - DNA, 16 bp, Homo sapiens
tgggagagccatacat

SEQ ID NO: 4723184 - DNA, 19 bp, Homo sapiens
tgggagggcagcagggcta

SEQ ID NO: 4723185 - DNA, 15 bp, Homo sapiens
tgggagtgagctggt

SEQ ID NO: 4723186 - DNA, 14 bp, Homo sapiens
tgggatcctccagg

SEQ ID NO: 4723187 - DNA, 15 bp, Homo sapiens
tgggatcctccaggt

SEQ ID NO: 4723188 - DNA, 18 bp, Homo sapiens
tgggatgattggaggggg

SEQ ID NO: 4723189 - DNA, 16 bp, Homo sapiens
tgggattgagtctgtg

SEQ ID NO: 4723190 - DNA, 19 bp, Homo sapiens
tgggattgagtctgtgcca

SEQ ID NO: 4723191 - DNA, 21 bp, Homo sapiens
tgggcaaagcctagtgaaggc

SEQ ID NO: 4723192 - DNA, 16 bp, Homo sapiens
tgggcaacccccagcc

SEQ ID NO: 4723193 - DNA, 17 bp, Homo sapiens
tgggcaacccccagcct

SEQ ID NO: 4723194 - DNA, 14 bp, Homo sapiens
tgggcactgctggg

SEQ ID NO: 4723195 - DNA, 16 bp, Homo sapiens
tgggcactgctgggtg

SEQ ID NO: 4723196 - DNA, 17 bp, Homo sapiens
tgggcactgctgggtgg

SEQ ID NO: 4723197 - DNA, 21 bp, Homo sapiens
tgggcactgctgggtggccca

SEQ ID NO: 4723198 - DNA, 22 bp, Homo sapiens
tgggcactgctgggtggcccat

SEQ ID NO: 4723199 - DNA, 17 bp, Homo sapiens
tgggcagagcagagacc

SEQ ID NO: 4723200 - DNA, 13 bp, Homo sapiens
tgggcagagccca

SEQ ID NO: 4723201 - DNA, 22 bp, Homo sapiens
tgggcagatctaccccttactt

SEQ ID NO: 4723202 - DNA, 10 bp, Homo sapiens
tgggcagctc

SEQ ID NO: 4723203 - DNA, 22 bp, Homo sapiens
tgggcaggactcagctccccag

SEQ ID NO: 4723204 - DNA, 22 bp, Homo sapiens
tgggcatagatgcaggtgagcc

SEQ ID NO: 4723205 - DNA, 16 bp, Homo sapiens
tgggccatactggcct

SEQ ID NO: 4723206 - DNA, 18 bp, Homo sapiens
tgggccatagctcctgct

SEQ ID NO: 4723207 - DNA, 18 bp, Homo sapiens
tgggccccagttgtattt

SEQ ID NO: 4723208 - DNA, 16 bp, Homo sapiens
tgggccctctctgctc

SEQ ID NO: 4723209 - DNA, 13 bp, Homo sapiens
tgggcctcctcac

SEQ ID NO: 4723210 - DNA, 13 bp, Homo sapiens
tgggcgggcagca

SEQ ID NO: 4723211 - DNA, 18 bp, Homo sapiens
tgggcgtgagacctgccc

SEQ ID NO: 4723212 - DNA, 19 bp, Homo sapiens
tgggcgtgagacctgcccc

SEQ ID NO: 4723213 - DNA, 20 bp, Homo sapiens
tgggcgtgagacctgcccct

SEQ ID NO: 4723214 - DNA, 12 bp, Homo sapiens
tgggctaacatt

SEQ ID NO: 4723215 - DNA, 21 bp, Homo sapiens
tgggctaacatttaggagaag

SEQ ID NO: 4723216 - DNA, 16 bp, Homo sapiens
tgggctagttgggctt

SEQ ID NO: 4723217 - DNA, 18 bp, Homo sapiens
tgggctcccttcccacct

SEQ ID NO: 4723218 - DNA, 21 bp, Homo sapiens
tgggctcccttcccacctctc

SEQ ID NO: 4723219 - DNA, 17 bp, Homo sapiens
tgggctctgtgggctgc

SEQ ID NO: 4723220 - DNA, 20 bp, Homo sapiens
tgggctgcactctgtgccca

SEQ ID NO: 4723221 - DNA, 20 bp, Homo sapiens
tgggctgggtgcgaccccat

SEQ ID NO: 4723222 - DNA, 19 bp, Homo sapiens
tgggctgggttctacccag

SEQ ID NO: 4723223 - DNA, 17 bp, Homo sapiens
tgggcttcactgtataa

SEQ ID NO: 4723224 - DNA, 18 bp, Homo sapiens
tgggcttcactgtataaa

SEQ ID NO: 4723225 - DNA, 20 bp, Homo sapiens
tgggcttcagtggcagctgc

SEQ ID NO: 4723226 - DNA, 22 bp, Homo sapiens
tgggcttcccagtggctgctgc

SEQ ID NO: 4723227 - DNA, 23 bp, Homo sapiens
tgggcttcccagtggctgctgcc

SEQ ID NO: 4723228 - DNA, 18 bp, Homo sapiens
tggggacctgatggagag

SEQ ID NO: 4723229 - DNA, 21 bp, Homo sapiens
tggggagactgggctgaggga

SEQ ID NO: 4723230 - DNA, 12 bp, Homo sapiens
tggggaggagga

SEQ ID NO: 4723231 - DNA, 20 bp, Homo sapiens
tggggcaatagggttaaatg

SEQ ID NO: 4723232 - DNA, 17 bp, Homo sapiens
tggggcccatggaggag

SEQ ID NO: 4723233 - DNA, 18 bp, Homo sapiens
tggggcccatggaggaga

SEQ ID NO: 4723234 - DNA, 22 bp, Homo sapiens
tggggctgcaccggctggcctg

SEQ ID NO: 4723235 - DNA, 15 bp, Homo sapiens
tgggggaaagcacag

SEQ ID NO: 4723236 - DNA, 17 bp, Homo sapiens
tgggggaaatggtgcct

SEQ ID NO: 4723237 - DNA, 19 bp, Homo sapiens
tgggggaagagcacagccc

SEQ ID NO: 4723238 - DNA, 22 bp, Homo sapiens
tgggggaagagcacagccctcc

SEQ ID NO: 4723239 - DNA, 13 bp, Homo sapiens
tgggggcggccag

SEQ ID NO: 4723240 - DNA, 12 bp, Homo sapiens
tgggggctcctc

SEQ ID NO: 4723241 - DNA, 13 bp, Homo sapiens
tgggggctctgca

SEQ ID NO: 4723242 - DNA, 19 bp, Homo sapiens
tgggggtagggggctggag

SEQ ID NO: 4723243 - DNA, 21 bp, Homo sapiens
tgggggtagggggctggagga

SEQ ID NO: 4723244 - DNA, 21 bp, Homo sapiens
tgggggtcctcctccagggac

SEQ ID NO: 4723245 - DNA, 14 bp, Homo sapiens
tgggggtgccagga

SEQ ID NO: 4723246 - DNA, 16 bp, Homo sapiens
tggggtacccactgct

SEQ ID NO: 4723247 - DNA, 13 bp, Homo sapiens
tggggtcactctg

SEQ ID NO: 4723248 - DNA, 16 bp, Homo sapiens
tggggtcactctggca

SEQ ID NO: 4723249 - DNA, 18 bp, Homo sapiens
tggggtcactctggcagc

SEQ ID NO: 4723250 - DNA, 19 bp, Homo sapiens
tggggtcactctggcagct

SEQ ID NO: 4723251 - DNA, 20 bp, Homo sapiens
tggggtcactctggcagctc

SEQ ID NO: 4723252 - DNA, 22 bp, Homo sapiens
tggggtcactctggcagctcag

SEQ ID NO: 4723253 - DNA, 20 bp, Homo sapiens
tgggtacttgtggacacagc

SEQ ID NO: 4723254 - DNA, 23 bp, Homo sapiens
tgggtcagtgtccaaagcagggt

SEQ ID NO: 4723255 - DNA, 18 bp, Homo sapiens
tgggtccatgggcagagc

SEQ ID NO: 4723256 - DNA, 20 bp, Homo sapiens
tgggtcccacttcccctcct

SEQ ID NO: 4723257 - DNA, 22 bp, Homo sapiens
tgggtcccacttcccctcctac

SEQ ID NO: 4723258 - DNA, 13 bp, Homo sapiens
tgggtcgggagag

SEQ ID NO: 4723259 - DNA, 16 bp, Homo sapiens
tgggtcgggagagggg

SEQ ID NO: 4723260 - DNA, 17 bp, Homo sapiens
tgggtcgggagagggga

SEQ ID NO: 4723261 - DNA, 21 bp, Homo sapiens
tgggtcgggagaggggacgca

SEQ ID NO: 4723262 - DNA, 17 bp, Homo sapiens
tgggtcttatgcttcca

SEQ ID NO: 4723263 - DNA, 13 bp, Homo sapiens
tgggtgcgacccc

SEQ ID NO: 4723264 - DNA, 22 bp, Homo sapiens
tgggtgcgaccccatctgccca

SEQ ID NO: 4723265 - DNA, 19 bp, Homo sapiens
tgggtgcttggaggaagga

SEQ ID NO: 4723266 - DNA, 22 bp, Homo sapiens
tgggtgcttggaggaaggaaac

SEQ ID NO: 4723267 - DNA, 15 bp, Homo sapiens
tgggtggcccatccc

SEQ ID NO: 4723268 - DNA, 21 bp, Homo sapiens
tgggtggcccatcccccctca

SEQ ID NO: 4723269 - DNA, 13 bp, Homo sapiens
tgggtgggtgggc

SEQ ID NO: 4723270 - DNA, 18 bp, Homo sapiens
tgggttagggaaaacatt

SEQ ID NO: 4723271 - DNA, 15 bp, Homo sapiens
tgggttatgaatatt

SEQ ID NO: 4723272 - DNA, 21 bp, Homo sapiens
tgggttccagcaattctcctg

SEQ ID NO: 4723273 - DNA, 21 bp, Homo sapiens
tgggttccttcctctgagcct

SEQ ID NO: 4723274 - DNA, 16 bp, Homo sapiens
tgggttctacccaggt

SEQ ID NO: 4723275 - DNA, 15 bp, Homo sapiens
tgggttggcgcaccc

SEQ ID NO: 4723276 - DNA, 22 bp, Homo sapiens
tgggttggcgcaccctcccctc

SEQ ID NO: 4723277 - DNA, 13 bp, Homo sapiens
tgggtttcaattt

SEQ ID NO: 4723278 - DNA, 16 bp, Homo sapiens
tgtgttttgaaagaat

SEQ ID NO: 4723279 - DNA, 19 bp, Homo sapiens
tgttaaatttgtaagtttc

SEQ ID NO: 4723280 - DNA, 20 bp, Homo sapiens
tgttaacactgtaatatctt

SEQ ID NO: 4723281 - DNA, 17 bp, Homo sapiens
tgttaactatgacagat

SEQ ID NO: 4723282 - DNA, 16 bp, Homo sapiens
tgttaaggaaactctt

SEQ ID NO: 4723283 - DNA, 23 bp, Homo sapiens
tgttaaggaaactcttatctcag

SEQ ID NO: 4723284 - DNA, 13 bp, Homo sapiens
tgttaataaaagt

SEQ ID NO: 4723285 - DNA, 15 bp, Homo sapiens
tgttaattcttattt

SEQ ID NO: 4723286 - DNA, 20 bp, Homo sapiens
tgttacaatcagtgtgaatg

SEQ ID NO: 4723287 - DNA, 19 bp, Homo sapiens
tgttaccttttacagaata

SEQ ID NO: 4723288 - DNA, 16 bp, Homo sapiens
tgttactgagatgttt

SEQ ID NO: 4723289 - DNA, 17 bp, Homo sapiens
tgttactgtctgtagtg

SEQ ID NO: 4723290 - DNA, 13 bp, Homo sapiens
tgttagattttta

SEQ ID NO: 4723291 - DNA, 16 bp, Homo sapiens
tgttaggaaaaaattg

SEQ ID NO: 4723292 - DNA, 16 bp, Homo sapiens
tgttaggcctggcaca

SEQ ID NO: 4723293 - DNA, 21 bp, Homo sapiens
tgttaggcctggcacagtgtc

SEQ ID NO: 4723294 - DNA, 13 bp, Homo sapiens
tgttatcaaaata

SEQ ID NO: 4723295 - DNA, 19 bp, Homo sapiens
tgttatcaccgtgggctcc

SEQ ID NO: 4723296 - DNA, 21 bp, Homo sapiens
tgttatcaccttccaaacaaa

SEQ ID NO: 4723297 - DNA, 19 bp, Homo sapiens
tgttatcttgtgtatggat

SEQ ID NO: 4723298 - DNA, 23 bp, Homo sapiens
tgttatgacagccctaggaaact

SEQ ID NO: 4723299 - DNA, 16 bp, Homo sapiens
tgttattaccaaaaca

SEQ ID NO: 4723300 - DNA, 15 bp, Homo sapiens
tgttatttacactgg

SEQ ID NO: 4723301 - DNA, 17 bp, Homo sapiens
tgttatttattgaaatg

SEQ ID NO: 4723302 - DNA, 14 bp, Homo sapiens
tgttattttgcaac

SEQ ID NO: 4723303 - DNA, 16 bp, Homo sapiens
tgttcaccatcggcag

SEQ ID NO: 4723304 - DNA, 10 bp, Homo sapiens
tgttcacctt

SEQ ID NO: 4723305 - DNA, 19 bp, Homo sapiens
tgttcactttaaagcaatt

SEQ ID NO: 4723306 - DNA, 22 bp, Homo sapiens
tgttcactttaaagcaattgca

SEQ ID NO: 4723307 - DNA, 14 bp, Homo sapiens
tgttcagctccagc

SEQ ID NO: 4723308 - DNA, 16 bp, Homo sapiens
tgttcagctccagctc

SEQ ID NO: 4723309 - DNA, 20 bp, Homo sapiens
tgttcagctccagctcacca

SEQ ID NO: 4723310 - DNA, 15 bp, Homo sapiens
tgttcattctgtgac

SEQ ID NO: 4723311 - DNA, 22 bp, Homo sapiens
tgttccattgcctcttttcaca

SEQ ID NO: 4723312 - DNA, 17 bp, Homo sapiens
tgttcccactgaaatgg

SEQ ID NO: 4723313 - DNA, 23 bp, Homo sapiens
tgttcccctcctccactctcccc

SEQ ID NO: 4723314 - DNA, 14 bp, Homo sapiens
tgttccccttccac

SEQ ID NO: 4723315 - DNA, 21 bp, Homo sapiens
tgttccccttccactgagggc

SEQ ID NO: 4723316 - DNA, 23 bp, Homo sapiens
tgttccccttccactgagggcag

SEQ ID NO: 4723317 - DNA, 22 bp, Homo sapiens
tgttctaaatatcccttggaca

SEQ ID NO: 4723318 - DNA, 19 bp, Homo sapiens
tgttctaatactttgttta

SEQ ID NO: 4723319 - DNA, 16 bp, Homo sapiens
tgttctacttgatatt

SEQ ID NO: 4723320 - DNA, 24 bp, Homo sapiens
tgttctatttaacaactgggtcat

SEQ ID NO: 4723321 - DNA, 21 bp, Homo sapiens
tgttctccagtcattatgtta

SEQ ID NO: 4723322 - DNA, 13 bp, Homo sapiens
tgttctctgagga

SEQ ID NO: 4723323 - DNA, 16 bp, Homo sapiens
tgttctctgaggacac

SEQ ID NO: 4723324 - DNA, 18 bp, Homo sapiens
tgttctctgaggacacta

SEQ ID NO: 4723325 - DNA, 12 bp, Homo sapiens
tgttctctgccc

SEQ ID NO: 4723326 - DNA, 19 bp, Homo sapiens
tgttctctgccctccaaga

SEQ ID NO: 4723327 - DNA, 17 bp, Homo sapiens
tgttctgcacacagcac

SEQ ID NO: 4723328 - DNA, 21 bp, Homo sapiens
tgttctggctcttccaggctg

SEQ ID NO: 4723329 - DNA, 12 bp, Homo sapiens
tgttctgggaca

SEQ ID NO: 4723330 - DNA, 14 bp, Homo sapiens
tgttctgggacaca

SEQ ID NO: 4723331 - DNA, 15 bp, Homo sapiens
tgttctgggacacag

SEQ ID NO: 4723332 - DNA, 18 bp, Homo sapiens
tgttctgtcccttgcccc

SEQ ID NO: 4723333 - DNA, 16 bp, Homo sapiens
tgttcttcataagctg

SEQ ID NO: 4723334 - DNA, 18 bp, Homo sapiens
tgttctttaaccctcact

SEQ ID NO: 4723335 - DNA, 23 bp, Homo sapiens
tgttctttaaccctcactgggac

SEQ ID NO: 4723336 - DNA, 20 bp, Homo sapiens
tgttctttggaaatacacag

SEQ ID NO: 4723337 - DNA, 16 bp, Homo sapiens
tgttgaaactttaaga

SEQ ID NO: 4723338 - DNA, 14 bp, Homo sapiens
tgttgacatgtgct

SEQ ID NO: 4723339 - DNA, 16 bp, Homo sapiens
tgttgatactgttgca

SEQ ID NO: 4723340 - DNA, 17 bp, Homo sapiens
tgttgatactgttgcac

SEQ ID NO: 4723341 - DNA, 23 bp, Homo sapiens
tgttgatactgttgcacgtgtgt

SEQ ID NO: 4723342 - DNA, 14 bp, Homo sapiens
tgttgcacgtgtgt

SEQ ID NO: 4723343 - DNA, 14 bp, Homo sapiens
tgttgcataaacaa

SEQ ID NO: 4723344 - DNA, 12 bp, Homo sapiens
tgttgcccaggc

SEQ ID NO: 4723345 - DNA, 15 bp, Homo sapiens
tgttgcccaggctgg

SEQ ID NO: 4723346 - DNA, 12 bp, Homo sapiens
tgttgccctggg

SEQ ID NO: 4723347 - DNA, 14 bp, Homo sapiens
tgttgctgcctcat

SEQ ID NO: 4723348 - DNA, 20 bp, Homo sapiens
tgttggatttttgtcttgtg

SEQ ID NO: 4723349 - DNA, 18 bp, Homo sapiens
tgttggcagtgtttgtat

SEQ ID NO: 4723350 - DNA, 11 bp, Homo sapiens
tgttggccagg

SEQ ID NO: 4723351 - DNA, 13 bp, Homo sapiens
tgttggccaggct

SEQ ID NO: 4723352 - DNA, 15 bp, Homo sapiens
tgttggccaggctgg

SEQ ID NO: 4723353 - DNA, 20 bp, Homo sapiens
tgttggcgagaggaggggcc

SEQ ID NO: 4723354 - DNA, 19 bp, Homo sapiens
tgttgggaagctatttcct

SEQ ID NO: 4723355 - DNA, 22 bp, Homo sapiens
tgttgggatgcgggcattttga

SEQ ID NO: 4723356 - DNA, 14 bp, Homo sapiens
tgttgtacatttat

SEQ ID NO: 4723357 - DNA, 18 bp, Homo sapiens
tgttgtacatttatgatt

SEQ ID NO: 4723358 - DNA, 15 bp, Homo sapiens
tgttgtcatgtgtat

SEQ ID NO: 4723359 - DNA, 16 bp, Homo sapiens
tgttgtcatgtgtatg

SEQ ID NO: 4723360 - DNA, 20 bp, Homo sapiens
tgttgtttataataaaaata

SEQ ID NO: 4723361 - DNA, 21 bp, Homo sapiens
tgttgtttataataaaaatat

SEQ ID NO: 4723362 - DNA, 13 bp, Homo sapiens
tgttgtttctttc

SEQ ID NO: 4723363 - DNA, 15 bp, Homo sapiens
tgttgtttctttcta

SEQ ID NO: 4723364 - DNA, 21 bp, Homo sapiens
tgtttaaaatttcttagaaaa

SEQ ID NO: 4723365 - DNA, 18 bp, Homo sapiens
tgtttaatagtatatcta

SEQ ID NO: 4723366 - DNA, 21 bp, Homo sapiens
tgtttacaaaaatttctgtaa

SEQ ID NO: 4723367 - DNA, 12 bp, Homo sapiens
tgtttactgctt

SEQ ID NO: 4723368 - DNA, 13 bp, Homo sapiens
tgtttactgcttt

SEQ ID NO: 4723369 - DNA, 20 bp, Homo sapiens
tgtttagatgaatgtcagtt

SEQ ID NO: 4723370 - DNA, 13 bp, Homo sapiens
tgtttagctattt

SEQ ID NO: 4723371 - DNA, 15 bp, Homo sapiens
tgtttagctatttaa

SEQ ID NO: 4723372 - DNA, 19 bp, Homo sapiens
tgtttatcacctttattga

SEQ ID NO: 4723373 - DNA, 21 bp, Homo sapiens
tgtttatgatctatttgtaga

SEQ ID NO: 4723374 - DNA, 18 bp, Homo sapiens
tgtttattccaaagagtg

SEQ ID NO: 4723375 - DNA, 13 bp, Homo sapiens
tgtttatttcagg

SEQ ID NO: 4723376 - DNA, 21 bp, Homo sapiens
tgtttcagtgccatttgttaa

SEQ ID NO: 4723377 - DNA, 21 bp, Homo sapiens
tgtttcctggcactgcttcca

SEQ ID NO: 4723378 - DNA, 22 bp, Homo sapiens
tgtttcctggcactgcttccag

SEQ ID NO: 4723379 - DNA, 18 bp, Homo sapiens
tgtttctggcttagaaca

SEQ ID NO: 4723380 - DNA, 17 bp, Homo sapiens
tgtttctttctgaagtg

SEQ ID NO: 4723381 - DNA, 22 bp, Homo sapiens
tgtttgagcatcgcttaggaga

SEQ ID NO: 4723382 - DNA, 16 bp, Homo sapiens
tgtttggaatattcca

SEQ ID NO: 4723383 - DNA, 21 bp, Homo sapiens
tgtttgggtcttttatacatg

SEQ ID NO: 4723384 - DNA, 21 bp, Homo sapiens
tgtttgtataccatgatgcat

SEQ ID NO: 4723385 - DNA, 20 bp, Homo sapiens
tgtttgttatttacactggt

SEQ ID NO: 4723386 - DNA, 22 bp, Homo sapiens
tgttttaagaggcagggtctca

SEQ ID NO: 4723387 - DNA, 13 bp, Homo sapiens
tgttttcaaatgt

SEQ ID NO: 4723388 - DNA, 14 bp, Homo sapiens
ttcccaagctctgc

SEQ ID NO: 4723389 - DNA, 15 bp, Homo sapiens
ttcccactgaaatgg

SEQ ID NO: 4723390 - DNA, 13 bp, Homo sapiens
ttcccactgcacc

SEQ ID NO: 4723391 - DNA, 19 bp, Homo sapiens
ttcccactgcaccccctcc

SEQ ID NO: 4723392 - DNA, 18 bp, Homo sapiens
ttcccagagaccttctga

SEQ ID NO: 4723393 - DNA, 22 bp, Homo sapiens
ttcccagcagtggactcaaaac

SEQ ID NO: 4723394 - DNA, 20 bp, Homo sapiens
ttcccaggatgagcatccca

SEQ ID NO: 4723395 - DNA, 20 bp, Homo sapiens
ttcccagtggctgctgccca

SEQ ID NO: 4723396 - DNA, 21 bp, Homo sapiens
ttcccagtggctgctgcccag

SEQ ID NO: 4723397 - DNA, 20 bp, Homo sapiens
ttcccatgacccaggctggg

SEQ ID NO: 4723398 - DNA, 15 bp, Homo sapiens
ttccccaggaggcca

SEQ ID NO: 4723399 - DNA, 16 bp, Homo sapiens
ttccccaggaggccag

SEQ ID NO: 4723400 - DNA, 20 bp, Homo sapiens
ttccccctggccaccacccc

SEQ ID NO: 4723401 - DNA, 17 bp, Homo sapiens
ttcccctcctacccctc

SEQ ID NO: 4723402 - DNA, 15 bp, Homo sapiens
ttcccctcctccact

SEQ ID NO: 4723403 - DNA, 14 bp, Homo sapiens
ttccccttccactg

SEQ ID NO: 4723404 - DNA, 23 bp, Homo sapiens
ttcccgtggaacgtttttcctgt

SEQ ID NO: 4723405 - DNA, 17 bp, Homo sapiens
ttcccgtggccccagcc

SEQ ID NO: 4723406 - DNA, 22 bp, Homo sapiens
ttccctagaaacttccaaatcc

SEQ ID NO: 4723407 - DNA, 16 bp, Homo sapiens
ttccctggcgtcctct

SEQ ID NO: 4723408 - DNA, 15 bp, Homo sapiens
ttcccttcatctgga

SEQ ID NO: 4723409 - DNA, 16 bp, Homo sapiens
ttcccttcatctggaa

SEQ ID NO: 4723410 - DNA, 19 bp, Homo sapiens
ttccctttgacgccatccc

SEQ ID NO: 4723411 - DNA, 22 bp, Homo sapiens
ttccctttgacgccatcccagc

SEQ ID NO: 4723412 - DNA, 18 bp, Homo sapiens
ttcccttttttggctgct

SEQ ID NO: 4723413 - DNA, 19 bp, Homo sapiens
ttccgcttggagcagaggg

SEQ ID NO: 4723414 - DNA, 16 bp, Homo sapiens
ttccgtattacatttt

SEQ ID NO: 4723415 - DNA, 19 bp, Homo sapiens
ttcctaataaagttctgta

SEQ ID NO: 4723416 - DNA, 16 bp, Homo sapiens
ttcctaattccacagc

SEQ ID NO: 4723417 - DNA, 18 bp, Homo sapiens
ttcctagctgtgtgaata

SEQ ID NO: 4723418 - DNA, 15 bp, Homo sapiens
ttcctcattttgaat

SEQ ID NO: 4723419 - DNA, 22 bp, Homo sapiens
ttcctcccaccccaagcaaatc

SEQ ID NO: 4723420 - DNA, 14 bp, Homo sapiens
ttcctcccctcgcc

SEQ ID NO: 4723421 - DNA, 14 bp, Homo sapiens
ttcctctgagcctt

SEQ ID NO: 4723422 - DNA, 17 bp, Homo sapiens
ttcctctgagccttggg

SEQ ID NO: 4723423 - DNA, 17 bp, Homo sapiens
ttcctctgagctgttat

SEQ ID NO: 4723424 - DNA, 21 bp, Homo sapiens
ttcctgatggcaggatggcct

SEQ ID NO: 4723425 - DNA, 21 bp, Homo sapiens
ttcctgggaaatattccctag

SEQ ID NO: 4723426 - DNA, 23 bp, Homo sapiens
ttccttcaccacctcatgtcatt

SEQ ID NO: 4723427 - DNA, 17 bp, Homo sapiens
ttccttcctctgagcct

SEQ ID NO: 4723428 - DNA, 19 bp, Homo sapiens
ttccttctttgataatgtt

SEQ ID NO: 4723429 - DNA, 22 bp, Homo sapiens
ttccttctttgataatgttaaa

SEQ ID NO: 4723430 - DNA, 13 bp, Homo sapiens
ttccttggctggt

SEQ ID NO: 4723431 - DNA, 23 bp, Homo sapiens
ttcctttaaaaaaatttaagtgc

SEQ ID NO: 4723432 - DNA, 20 bp, Homo sapiens
ttcctttcatttactgtggc

SEQ ID NO: 4723433 - DNA, 19 bp, Homo sapiens
ttcctttgcatattataaa

SEQ ID NO: 4723434 - DNA, 13 bp, Homo sapiens
ttcgctcctgtgt

SEQ ID NO: 4723435 - DNA, 15 bp, Homo sapiens
ttcgctcctgtgtct

SEQ ID NO: 4723436 - DNA, 19 bp, Homo sapiens
ttcgctcctgtgtcttgca

SEQ ID NO: 4723437 - DNA, 18 bp, Homo sapiens
ttcggtgagctacaaatg

SEQ ID NO: 4723438 - DNA, 18 bp, Homo sapiens
ttcgtgtaatattctctg

SEQ ID NO: 4723439 - DNA, 21 bp, Homo sapiens
ttctaaggactttttcttagg

SEQ ID NO: 4723440 - DNA, 16 bp, Homo sapiens
ttctaatactttgttt

SEQ ID NO: 4723441 - DNA, 19 bp, Homo sapiens
ttctacagagaaaatgaat

SEQ ID NO: 4723442 - DNA, 21 bp, Homo sapiens
ttctacagagaaaatgaattt

SEQ ID NO: 4723443 - DNA, 15 bp, Homo sapiens
ttctacattgacaca

SEQ ID NO: 4723444 - DNA, 12 bp, Homo sapiens
ttctacccagcg

SEQ ID NO: 4723445 - DNA, 14 bp, Homo sapiens
ttctacccaggtgc

SEQ ID NO: 4723446 - DNA, 14 bp, Homo sapiens
ttctacctcccaga

SEQ ID NO: 4723447 - DNA, 13 bp, Homo sapiens
ttctactatttat

SEQ ID NO: 4723448 - DNA, 23 bp, Homo sapiens
ttctagaaatacacttttttcca

SEQ ID NO: 4723449 - DNA, 18 bp, Homo sapiens
ttctaggtggcaaggctg

SEQ ID NO: 4723450 - DNA, 17 bp, Homo sapiens
ttctagtggtctttgta

SEQ ID NO: 4723451 - DNA, 13 bp, Homo sapiens
ttctataatttaa

SEQ ID NO: 4723452 - DNA, 16 bp, Homo sapiens
ttctatgaaagactca

SEQ ID NO: 4723453 - DNA, 16 bp, Homo sapiens
ttctattaaaagactc

SEQ ID NO: 4723454 - DNA, 17 bp, Homo sapiens
ttctatttaacaactgg

SEQ ID NO: 4723455 - DNA, 23 bp, Homo sapiens
ttctattttttgttttgtttcct

SEQ ID NO: 4723456 - DNA, 22 bp, Homo sapiens
ttctcagccacaaaccctgcct

SEQ ID NO: 4723457 - DNA, 17 bp, Homo sapiens
ttctcagggtctctgct

SEQ ID NO: 4723458 - DNA, 21 bp, Homo sapiens
ttctcagggtctctgctgccg

SEQ ID NO: 4723459 - DNA, 15 bp, Homo sapiens
ttctcatcactcccc

SEQ ID NO: 4723460 - DNA, 18 bp, Homo sapiens
ttctcatctttcttgatc

SEQ ID NO: 4723461 - DNA, 22 bp, Homo sapiens
ttctcattaaaatccagtatta

SEQ ID NO: 4723462 - DNA, 13 bp, Homo sapiens
ttctccaaataaa

SEQ ID NO: 4723463 - DNA, 13 bp, Homo sapiens
ttctccaccctgc

SEQ ID NO: 4723464 - DNA, 16 bp, Homo sapiens
ttctccaccctgctct

SEQ ID NO: 4723465 - DNA, 16 bp, Homo sapiens
ttctccacctgccagg

SEQ ID NO: 4723466 - DNA, 11 bp, Homo sapiens
ttctccaggct

SEQ ID NO: 4723467 - DNA, 19 bp, Homo sapiens
ttctccagtcattatgtta

SEQ ID NO: 4723468 - DNA, 20 bp, Homo sapiens
ttctcccccccggggctggg

SEQ ID NO: 4723469 - DNA, 16 bp, Homo sapiens
ttctcccctgccccca

SEQ ID NO: 4723470 - DNA, 23 bp, Homo sapiens
ttctcccctgcccccaggactgg

SEQ ID NO: 4723471 - DNA, 20 bp, Homo sapiens
ttctccctcatttcaggagc

SEQ ID NO: 4723472 - DNA, 13 bp, Homo sapiens
ttctcctgcctca

SEQ ID NO: 4723473 - DNA, 15 bp, Homo sapiens
ttctccttcagccct

SEQ ID NO: 4723474 - DNA, 20 bp, Homo sapiens
ttctccttcagccctcaccc

SEQ ID NO: 4723475 - DNA, 19 bp, Homo sapiens
ttctctaatgcttgattta

SEQ ID NO: 4723476 - DNA, 17 bp, Homo sapiens
ttctctcatctcttagc

SEQ ID NO: 4723477 - DNA, 20 bp, Homo sapiens
ttctctcatctcttagctcc

SEQ ID NO: 4723478 - DNA, 14 bp, Homo sapiens
ttctctccagcccc

SEQ ID NO: 4723479 - DNA, 16 bp, Homo sapiens
ttctctgagctgtgca

SEQ ID NO: 4723480 - DNA, 17 bp, Homo sapiens
ttctctgtctcatgtgt

SEQ ID NO: 4723481 - DNA, 14 bp, Homo sapiens
ttctcttctctgtt

SEQ ID NO: 4723482 - DNA, 16 bp, Homo sapiens
ttctcttttcaaaaca

SEQ ID NO: 4723483 - DNA, 15 bp, Homo sapiens
ttctgaaaatataac

SEQ ID NO: 4723484 - DNA, 14 bp, Homo sapiens
ttctgacccatgct

SEQ ID NO: 4723485 - DNA, 12 bp, Homo sapiens
ttctgacctggg

SEQ ID NO: 4723486 - DNA, 15 bp, Homo sapiens
ttctgacctgggctg

SEQ ID NO: 4723487 - DNA, 16 bp, Homo sapiens
ttctgacgcagcctga

SEQ ID NO: 4723488 - DNA, 22 bp, Homo sapiens
ttctgacgcagcctgagaatga

SEQ ID NO: 4723489 - DNA, 14 bp, Homo sapiens
ttctgagcatttaa

SEQ ID NO: 4723490 - DNA, 19 bp, Homo sapiens
ttctgaggagctgttactg

SEQ ID NO: 4723491 - DNA, 13 bp, Homo sapiens
ttctgatttgtat

SEQ ID NO: 4723492 - DNA, 15 bp, Homo sapiens
ttctgcacacagcac

SEQ ID NO: 4723493 - DNA, 17 bp, Homo sapiens
ttctgccacttcccagg

SEQ ID NO: 4723494 - DNA, 21 bp, Homo sapiens
ttctgcctgcccaggcccctg

SEQ ID NO: 4723495 - DNA, 13 bp, Homo sapiens
ttctgctcatcat

SEQ ID NO: 4723496 - DNA, 22 bp, Homo sapiens
ttctgctctaagaagctgcaat

SEQ ID NO: 4723497 - DNA, 20 bp, Homo sapiens
ttctggattttgtcaagcag

SEQ ID NO: 4723498 - DNA, 18 bp, Homo sapiens
ttgtctccctggccctca

SEQ ID NO: 4723499 - DNA, 16 bp, Homo sapiens
ttgtctcctaaattgt

SEQ ID NO: 4723500 - DNA, 11 bp, Homo sapiens
ttgtctttctt

SEQ ID NO: 4723501 - DNA, 16 bp, Homo sapiens
ttgtctttctttgctg

SEQ ID NO: 4723502 - DNA, 20 bp, Homo sapiens
ttgtgaatattgtggctccc

SEQ ID NO: 4723503 - DNA, 13 bp, Homo sapiens
ttgtgaatggatt

SEQ ID NO: 4723504 - DNA, 14 bp, Homo sapiens
ttgtgaatggattg

SEQ ID NO: 4723505 - DNA, 22 bp, Homo sapiens
ttgtgagggagagaactgagca

SEQ ID NO: 4723506 - DNA, 24 bp, Homo sapiens
ttgtgagggagagaactgagcatc

SEQ ID NO: 4723507 - DNA, 14 bp, Homo sapiens
ttgtgcaaaagcag

SEQ ID NO: 4723508 - DNA, 13 bp, Homo sapiens
ttgtgctatttaa

SEQ ID NO: 4723509 - DNA, 22 bp, Homo sapiens
ttgtgctttataccccatttga

SEQ ID NO: 4723510 - DNA, 18 bp, Homo sapiens
ttgtggaaagataataaa

SEQ ID NO: 4723511 - DNA, 17 bp, Homo sapiens
ttgtggacacagctctt

SEQ ID NO: 4723512 - DNA, 21 bp, Homo sapiens
ttgtggcctgggcctcctcac

SEQ ID NO: 4723513 - DNA, 18 bp, Homo sapiens
ttgtgtatggatatgtgt

SEQ ID NO: 4723514 - DNA, 16 bp, Homo sapiens
ttgtgtccctaatgtg

SEQ ID NO: 4723515 - DNA, 16 bp, Homo sapiens
ttgtgtggattcttta

SEQ ID NO: 4723516 - DNA, 17 bp, Homo sapiens
ttgttaaaggcaatggt

SEQ ID NO: 4723517 - DNA, 19 bp, Homo sapiens
ttgttaataaaagtacatg

SEQ ID NO: 4723518 - DNA, 12 bp, Homo sapiens
ttgttatcaaaa

SEQ ID NO: 4723519 - DNA, 14 bp, Homo sapiens
ttgttatcaaaata

SEQ ID NO: 4723520 - DNA, 16 bp, Homo sapiens
ttgttatcaaaatagt

SEQ ID NO: 4723521 - DNA, 20 bp, Homo sapiens
ttgttatgtctagaaagtaa

SEQ ID NO: 4723522 - DNA, 15 bp, Homo sapiens
ttgttattttgcaac

SEQ ID NO: 4723523 - DNA, 20 bp, Homo sapiens
ttgttctggctcttccaggc

SEQ ID NO: 4723524 - DNA, 13 bp, Homo sapiens
ttgttctgggtga

SEQ ID NO: 4723525 - DNA, 11 bp, Homo sapiens
ttgttctgtat

SEQ ID NO: 4723526 - DNA, 21 bp, Homo sapiens
ttgttcttgatagtagccaaa

SEQ ID NO: 4723527 - DNA, 15 bp, Homo sapiens
ttgttcttttataga

SEQ ID NO: 4723528 - DNA, 16 bp, Homo sapiens
ttgttgagtctctgaa

SEQ ID NO: 4723529 - DNA, 21 bp, Homo sapiens
ttgttgatgctcacatatgat

SEQ ID NO: 4723530 - DNA, 21 bp, Homo sapiens
ttgttgcatccctcaattgaa

SEQ ID NO: 4723531 - DNA, 18 bp, Homo sapiens
ttgttggtaactaatgtt

SEQ ID NO: 4723532 - DNA, 13 bp, Homo sapiens
ttgttgtaattgc

SEQ ID NO: 4723533 - DNA, 12 bp, Homo sapiens
ttgtttacaaac

SEQ ID NO: 4723534 - DNA, 21 bp, Homo sapiens
ttgtttcaatctctgactaaa

SEQ ID NO: 4723535 - DNA, 16 bp, Homo sapiens
ttgtttcaattgcatc

SEQ ID NO: 4723536 - DNA, 14 bp, Homo sapiens
ttgtttctccccca

SEQ ID NO: 4723537 - DNA, 15 bp, Homo sapiens
ttgtttctttctagt

SEQ ID NO: 4723538 - DNA, 18 bp, Homo sapiens
ttgtttggagacagagtc

SEQ ID NO: 4723539 - DNA, 20 bp, Homo sapiens
ttgttttgcacactttgcca

SEQ ID NO: 4723540 - DNA, 19 bp, Homo sapiens
ttgtttttcattcagtctt

SEQ ID NO: 4723541 - DNA, 13 bp, Homo sapiens
ttgtttttttgag

SEQ ID NO: 4723542 - DNA, 18 bp, Homo sapiens
tttaaaaaaattccaagt

SEQ ID NO: 4723543 - DNA, 21 bp, Homo sapiens
tttaaaaacactacttttgct

SEQ ID NO: 4723544 - DNA, 11 bp, Homo sapiens
tttaaaaatat

SEQ ID NO: 4723545 - DNA, 13 bp, Homo sapiens
tttaaaagacaaa

SEQ ID NO: 4723546 - DNA, 14 bp, Homo sapiens
tttaaaccactaat

SEQ ID NO: 4723547 - DNA, 15 bp, Homo sapiens
tttaaagaaaagttt

SEQ ID NO: 4723548 - DNA, 13 bp, Homo sapiens
tttaaagtaattt

SEQ ID NO: 4723549 - DNA, 18 bp, Homo sapiens
tttaaagtctcagtttct

SEQ ID NO: 4723550 - DNA, 20 bp, Homo sapiens
tttaaagttgtataaaaaca

SEQ ID NO: 4723551 - DNA, 18 bp, Homo sapiens
tttaaatgtacttatatt

SEQ ID NO: 4723552 - DNA, 21 bp, Homo sapiens
tttaacaggttttcttctaat

SEQ ID NO: 4723553 - DNA, 24 bp, Homo sapiens
tttaacaggttttcttctaatcat

SEQ ID NO: 4723554 - DNA, 21 bp, Homo sapiens
tttaaccaagttgtttattcc

SEQ ID NO: 4723555 - DNA, 17 bp, Homo sapiens
tttaaccataaatcaat

SEQ ID NO: 4723556 - DNA, 21 bp, Homo sapiens
tttaaccctcctgggcccaag

SEQ ID NO: 4723557 - DNA, 18 bp, Homo sapiens
tttaactgtggatattgt

SEQ ID NO: 4723558 - DNA, 22 bp, Homo sapiens
tttaagaggaatttataacaaa

SEQ ID NO: 4723559 - DNA, 18 bp, Homo sapiens
tttaagattgtaaaaata

SEQ ID NO: 4723560 - DNA, 16 bp, Homo sapiens
tttaagatttttctca

SEQ ID NO: 4723561 - DNA, 22 bp, Homo sapiens
tttaagccacaaagtttgtggt

SEQ ID NO: 4723562 - DNA, 13 bp, Homo sapiens
tttaagctctgag

SEQ ID NO: 4723563 - DNA, 14 bp, Homo sapiens
tttaagctctgagc

SEQ ID NO: 4723564 - DNA, 18 bp, Homo sapiens
tttaagctctgagctgtc

SEQ ID NO: 4723565 - DNA, 19 bp, Homo sapiens
tttaagctctgagctgtca

SEQ ID NO: 4723566 - DNA, 11 bp, Homo sapiens
tttaaggaaaa

SEQ ID NO: 4723567 - DNA, 18 bp, Homo sapiens
tttaagtgcgtgtgtaga

SEQ ID NO: 4723568 - DNA, 20 bp, Homo sapiens
tttaagttttatttaacttt

SEQ ID NO: 4723569 - DNA, 17 bp, Homo sapiens
tttaataaaataattct

SEQ ID NO: 4723570 - DNA, 15 bp, Homo sapiens
tttaataacattacc

SEQ ID NO: 4723571 - DNA, 18 bp, Homo sapiens
tttaataacattacctta

SEQ ID NO: 4723572 - DNA, 22 bp, Homo sapiens
tttaataacattaccttactgt

SEQ ID NO: 4723573 - DNA, 21 bp, Homo sapiens
tttaatagcgtcataactaga

SEQ ID NO: 4723574 - DNA, 22 bp, Homo sapiens
tttaatagtatatctaatggct

SEQ ID NO: 4723575 - DNA, 18 bp, Homo sapiens
tttaatgatttttgtgta

SEQ ID NO: 4723576 - DNA, 22 bp, Homo sapiens
tttaatgatttttgtgtatcca

SEQ ID NO: 4723577 - DNA, 15 bp, Homo sapiens
tttaattatttaaat

SEQ ID NO: 4723578 - DNA, 14 bp, Homo sapiens
tttaattctttcta

SEQ ID NO: 4723579 - DNA, 22 bp, Homo sapiens
tttaattctttctattttcaca

SEQ ID NO: 4723580 - DNA, 16 bp, Homo sapiens
tttaattgttgtttct

SEQ ID NO: 4723581 - DNA, 22 bp, Homo sapiens
tttaatttgaaggtagaatgtt

SEQ ID NO: 4723582 - DNA, 19 bp, Homo sapiens
tttaattttgtcagattca

SEQ ID NO: 4723583 - DNA, 13 bp, Homo sapiens
tttacaaaactgc

SEQ ID NO: 4723584 - DNA, 17 bp, Homo sapiens
tttacaacaaacactgt

SEQ ID NO: 4723585 - DNA, 21 bp, Homo sapiens
tttacaccagttcctttcaat

SEQ ID NO: 4723586 - DNA, 18 bp, Homo sapiens
tttacactggtctaatgt

SEQ ID NO: 4723587 - DNA, 15 bp, Homo sapiens
tttacagaataaaag

SEQ ID NO: 4723588 - DNA, 16 bp, Homo sapiens
tttaccatatgtttat

SEQ ID NO: 4723589 - DNA, 13 bp, Homo sapiens
tttaccattagca

SEQ ID NO: 4723590 - DNA, 15 bp, Homo sapiens
tttaccctcctctat

SEQ ID NO: 4723591 - DNA, 21 bp, Homo sapiens
tttaccctcctctatttcttt

SEQ ID NO: 4723592 - DNA, 13 bp, Homo sapiens
tttacccttcagg

SEQ ID NO: 4723593 - DNA, 19 bp, Homo sapiens
tttacgtagtaaaagtcat

SEQ ID NO: 4723594 - DNA, 23 bp, Homo sapiens
tttactagggatccctcatctgt

SEQ ID NO: 4723595 - DNA, 24 bp, Homo sapiens
tttactatttcaatacttacatat

SEQ ID NO: 4723596 - DNA, 17 bp, Homo sapiens
tttactcaaccctctca

SEQ ID NO: 4723597 - DNA, 20 bp, Homo sapiens
tttactcctttttattcata

SEQ ID NO: 4723598 - DNA, 12 bp, Homo sapiens
tttactgaatgt

SEQ ID NO: 4723599 - DNA, 16 bp, Homo sapiens
tttactgcttttcatt

SEQ ID NO: 4723600 - DNA, 12 bp, Homo sapiens
tttagacagagt

SEQ ID NO: 4723601 - DNA, 20 bp, Homo sapiens
tttagacttaatagaaacat

SEQ ID NO: 4723602 - DNA, 15 bp, Homo sapiens
tttagactttaaaat

SEQ ID NO: 4723603 - DNA, 19 bp, Homo sapiens
tttagagtcaatttgctga

SEQ ID NO: 4723604 - DNA, 13 bp, Homo sapiens
tttagtcattatt

SEQ ID NO: 4723605 - DNA, 19 bp, Homo sapiens
tttagtgatcacagcagct

SEQ ID NO: 4723606 - DNA, 23 bp, Homo sapiens
tttagtgcaaagtataaaattat

SEQ ID NO: 4723607 - DNA, 20 bp, Homo sapiens
tttagtggaagcttctaaat

SEQ ID NO: 4723608 - DNA, 16 bp, Homo sapiens
ttttatagatttgacc

SEQ ID NO: 4723609 - DNA, 22 bp, Homo sapiens
ttttatattgataacagcactg

SEQ ID NO: 4723610 - DNA, 18 bp, Homo sapiens
ttttatggttccaatgaa

SEQ ID NO: 4723611 - DNA, 13 bp, Homo sapiens
ttttatgttattt

SEQ ID NO: 4723612 - DNA, 16 bp, Homo sapiens
ttttatgttatttata

SEQ ID NO: 4723613 - DNA, 22 bp, Homo sapiens
ttttattaaaatatttcaggtt

SEQ ID NO: 4723614 - DNA, 16 bp, Homo sapiens
ttttattattactgtt

SEQ ID NO: 4723615 - DNA, 15 bp, Homo sapiens
ttttattttgtaatt

SEQ ID NO: 4723616 - DNA, 15 bp, Homo sapiens
ttttcaaaaatgctg

SEQ ID NO: 4723617 - DNA, 15 bp, Homo sapiens
ttttcagcttctgct

SEQ ID NO: 4723618 - DNA, 23 bp, Homo sapiens
ttttcataaattatttgattatt

SEQ ID NO: 4723619 - DNA, 22 bp, Homo sapiens
ttttcattagcagttgctcaca

SEQ ID NO: 4723620 - DNA, 12 bp, Homo sapiens
ttttccaggctg

SEQ ID NO: 4723621 - DNA, 20 bp, Homo sapiens
ttttcctaataaagttctgt

SEQ ID NO: 4723622 - DNA, 15 bp, Homo sapiens
ttttctaaagaaata

SEQ ID NO: 4723623 - DNA, 19 bp, Homo sapiens
ttttctagaaatacacttt

SEQ ID NO: 4723624 - DNA, 16 bp, Homo sapiens
ttttctataatttaaa

SEQ ID NO: 4723625 - DNA, 11 bp, Homo sapiens
ttttctattaa

SEQ ID NO: 4723626 - DNA, 12 bp, Homo sapiens
ttttctattaaa

SEQ ID NO: 4723627 - DNA, 14 bp, Homo sapiens
ttttctattaaaag

SEQ ID NO: 4723628 - DNA, 17 bp, Homo sapiens
ttttctattaaaagact

SEQ ID NO: 4723629 - DNA, 21 bp, Homo sapiens
ttttctattaaaagactcatc

SEQ ID NO: 4723630 - DNA, 19 bp, Homo sapiens
ttttctcaaagttttgaaa

SEQ ID NO: 4723631 - DNA, 20 bp, Homo sapiens
ttttctcaaagttttgaaaa

SEQ ID NO: 4723632 - DNA, 23 bp, Homo sapiens
ttttctcaaagttttgaaaagct

SEQ ID NO: 4723633 - DNA, 19 bp, Homo sapiens
ttttctgcccaactttcat

SEQ ID NO: 4723634 - DNA, 17 bp, Homo sapiens
ttttcttgcatgaggct

SEQ ID NO: 4723635 - DNA, 21 bp, Homo sapiens
ttttcttgcctctgtcccctt

SEQ ID NO: 4723636 - DNA, 23 bp, Homo sapiens
ttttgaaaagctattagccagga

SEQ ID NO: 4723637 - DNA, 16 bp, Homo sapiens
ttttgaaaatcctgaa

SEQ ID NO: 4723638 - DNA, 12 bp, Homo sapiens
ttttgaaagaat

SEQ ID NO: 4723639 - DNA, 13 bp, Homo sapiens
ttttgaaatgtca

SEQ ID NO: 4723640 - DNA, 16 bp, Homo sapiens
ttttgaagaacaaaag

SEQ ID NO: 4723641 - DNA, 14 bp, Homo sapiens
ttttgaggctttca

SEQ ID NO: 4723642 - DNA, 13 bp, Homo sapiens
ttttgatgcacaa

SEQ ID NO: 4723643 - DNA, 13 bp, Homo sapiens
ttttgattttgct

SEQ ID NO: 4723644 - DNA, 17 bp, Homo sapiens
ttttgcaacctcgctgg

SEQ ID NO: 4723645 - DNA, 13 bp, Homo sapiens
ttttgccctttga

SEQ ID NO: 4723646 - DNA, 14 bp, Homo sapiens
ttttgctgtagaag

SEQ ID NO: 4723647 - DNA, 23 bp, Homo sapiens
ttttggttgctgatgtttataaa

SEQ ID NO: 4723648 - DNA, 14 bp, Homo sapiens
ttttggttttgttc

SEQ ID NO: 4723649 - DNA, 22 bp, Homo sapiens
ttttgtcgaatttttattattt

SEQ ID NO: 4723650 - DNA, 19 bp, Homo sapiens
ttttgtgaatggattggat

SEQ ID NO: 4723651 - DNA, 23 bp, Homo sapiens
ttttgtgaatggattggattatt

SEQ ID NO: 4723652 - DNA, 20 bp, Homo sapiens
ttttgtgtatccagtatgca

SEQ ID NO: 4723653 - DNA, 13 bp, Homo sapiens
ttttgtgttgtac

SEQ ID NO: 4723654 - DNA, 16 bp, Homo sapiens
ttttgtgttgtacaat

SEQ ID NO: 4723655 - DNA, 12 bp, Homo sapiens
ttttgttactgt

SEQ ID NO: 4723656 - DNA, 19 bp, Homo sapiens
ttttgttcccctcctccac

SEQ ID NO: 4723657 - DNA, 14 bp, Homo sapiens
ttttgttctgtata

SEQ ID NO: 4723658 - DNA, 17 bp, Homo sapiens
ttttgtttttcattcag

SEQ ID NO: 4723659 - DNA, 17 bp, Homo sapiens
tttttaactactgtatt

SEQ ID NO: 4723660 - DNA, 16 bp, Homo sapiens
tttttaagatttttct

SEQ ID NO: 4723661 - DNA, 17 bp, Homo sapiens
tttttaaggctgtgtga

SEQ ID NO: 4723662 - DNA, 14 bp, Homo sapiens
tttttaataggatt

SEQ ID NO: 4723663 - DNA, 20 bp, Homo sapiens
tttttaattgttgtttcttt

SEQ ID NO: 4723664 - DNA, 15 bp, Homo sapiens
tttttatatatgtgt

SEQ ID NO: 4723665 - DNA, 13 bp, Homo sapiens
tttttattatttg

SEQ ID NO: 4723666 - DNA, 14 bp, Homo sapiens
tttttattatttgt

SEQ ID NO: 4723667 - DNA, 15 bp, Homo sapiens
tttttcaaaaatgct

SEQ ID NO: 4723668 - DNA, 20 bp, Homo sapiens
tttttcaaaaatgctgttaa

SEQ ID NO: 4723669 - DNA, 19 bp, Homo sapiens
tttttcagtttaattctgt

SEQ ID NO: 4723670 - DNA, 12 bp, Homo sapiens
tttttcagtttt

SEQ ID NO: 4723671 - DNA, 18 bp, Homo sapiens
tttttctaccataagtga

SEQ ID NO: 4723672 - DNA, 13 bp, Homo sapiens
tttttctattaaa

SEQ ID NO: 4723673 - DNA, 18 bp, Homo sapiens
tttttctattaaaagact

SEQ ID NO: 4723674 - DNA, 21 bp, Homo sapiens
tttttctattaaaagactcat

SEQ ID NO: 4723675 - DNA, 20 bp, Homo sapiens
tttttgagttttcttatata

SEQ ID NO: 4723676 - DNA, 11 bp, Homo sapiens
tttttgtattt

SEQ ID NO: 4723677 - DNA, 23 bp, Homo sapiens
tttttgtcacctcaatatttact

SEQ ID NO: 4723678 - DNA, 15 bp, Homo sapiens
tttttgtgtatttgt

SEQ ID NO: 4723679 - DNA, 14 bp, Homo sapiens
ttttttaaagaaaa

SEQ ID NO: 4723680 - DNA, 23 bp, Homo sapiens
ttttttaaagaaaatgtgtctgc

SEQ ID NO: 4723681 - DNA, 12 bp, Homo sapiens
ttttttaatcta

SEQ ID NO: 4723682 - DNA, 18 bp, Homo sapiens
aggcatttggcatttatt

SEQ ID NO: 4723683 - DNA, 18 bp, Homo sapiens
aggccacaagacccttgt

SEQ ID NO: 4723684 - DNA, 19 bp, Homo sapiens
aggccacgtgatgtggagg

SEQ ID NO: 4723685 - DNA, 14 bp, Homo sapiens
aggccagagggagt

SEQ ID NO: 4723686 - DNA, 13 bp, Homo sapiens
aggccagccttga

SEQ ID NO: 4723687 - DNA, 20 bp, Homo sapiens
aggccaggaccaagggcaga

SEQ ID NO: 4723688 - DNA, 21 bp, Homo sapiens
aggccaggaccaagggcagag

SEQ ID NO: 4723689 - DNA, 22 bp, Homo sapiens
aggccaggactctgcagcctca

SEQ ID NO: 4723690 - DNA, 13 bp, Homo sapiens
aggccaggccctc

SEQ ID NO: 4723691 - DNA, 18 bp, Homo sapiens
aggccagggatagaggat

SEQ ID NO: 4723692 - DNA, 13 bp, Homo sapiens
aggccagggcaga

SEQ ID NO: 4723693 - DNA, 15 bp, Homo sapiens
aggccagggcagagt

SEQ ID NO: 4723694 - DNA, 19 bp, Homo sapiens
aggccatcttccaggtggg

SEQ ID NO: 4723695 - DNA, 14 bp, Homo sapiens
aggccatgggcctc

SEQ ID NO: 4723696 - DNA, 16 bp, Homo sapiens
aggccatgggcctcct

SEQ ID NO: 4723697 - DNA, 11 bp, Homo sapiens
aggcccctctc

SEQ ID NO: 4723698 - DNA, 13 bp, Homo sapiens
aggcccctctcct

SEQ ID NO: 4723699 - DNA, 17 bp, Homo sapiens
aggcccctgccaccctg

SEQ ID NO: 4723700 - DNA, 16 bp, Homo sapiens
aggcccggctccaggc

SEQ ID NO: 4723701 - DNA, 21 bp, Homo sapiens
aggcccggctccaggctcctt

SEQ ID NO: 4723702 - DNA, 14 bp, Homo sapiens
aggccctctgccca

SEQ ID NO: 4723703 - DNA, 17 bp, Homo sapiens
aggccctctgcccactc

SEQ ID NO: 4723704 - DNA, 23 bp, Homo sapiens
aggccctctgcccactccctgca

SEQ ID NO: 4723705 - DNA, 17 bp, Homo sapiens
aggccctgcactgtcct

SEQ ID NO: 4723706 - DNA, 18 bp, Homo sapiens
aggccctgcactgtcctg

SEQ ID NO: 4723707 - DNA, 22 bp, Homo sapiens
aggccctgcactgtcctgctcc

SEQ ID NO: 4723708 - DNA, 19 bp, Homo sapiens
aggcccttctctccagccc

SEQ ID NO: 4723709 - DNA, 20 bp, Homo sapiens
aggcccttctctccagcccc

SEQ ID NO: 4723710 - DNA, 21 bp, Homo sapiens
aggcccttctctccagcccct

SEQ ID NO: 4723711 - DNA, 17 bp, Homo sapiens
aggccgagtctgtcctg

SEQ ID NO: 4723712 - DNA, 12 bp, Homo sapiens
aggcctcccaca

SEQ ID NO: 4723713 - DNA, 15 bp, Homo sapiens
aggcctcccacagtg

SEQ ID NO: 4723714 - DNA, 16 bp, Homo sapiens
aggcctcccacagtga

SEQ ID NO: 4723715 - DNA, 19 bp, Homo sapiens
aggcctgagatttcatctg

SEQ ID NO: 4723716 - DNA, 18 bp, Homo sapiens
aggcctgccttctcaggg

SEQ ID NO: 4723717 - DNA, 21 bp, Homo sapiens
aggcctgcgtgtgtctgtgtt

SEQ ID NO: 4723718 - DNA, 18 bp, Homo sapiens
aggcctgctcagggactg

SEQ ID NO: 4723719 - DNA, 15 bp, Homo sapiens
aggcctggcacagtg

SEQ ID NO: 4723720 - DNA, 18 bp, Homo sapiens
aggcctggcacagtgtct

SEQ ID NO: 4723721 - DNA, 23 bp, Homo sapiens
aggcctggcacagtgtctgggct

SEQ ID NO: 4723722 - DNA, 15 bp, Homo sapiens
aggcctggccagatg

SEQ ID NO: 4723723 - DNA, 16 bp, Homo sapiens
aggcctggccagatgc

SEQ ID NO: 4723724 - DNA, 21 bp, Homo sapiens
aggcctggccagatgcaccag

SEQ ID NO: 4723725 - DNA, 17 bp, Homo sapiens
aggcgtggagctgcctg

SEQ ID NO: 4723726 - DNA, 18 bp, Homo sapiens
aggcgtggagctgcctga

SEQ ID NO: 4723727 - DNA, 14 bp, Homo sapiens
aggctaagctgccg

SEQ ID NO: 4723728 - DNA, 16 bp, Homo sapiens
aggctcacccccttct

SEQ ID NO: 4723729 - DNA, 16 bp, Homo sapiens
aggctccagagggcac

SEQ ID NO: 4723730 - DNA, 23 bp, Homo sapiens
aggctccaggagcagccacattc

SEQ ID NO: 4723731 - DNA, 18 bp, Homo sapiens
aggctcgagcatgcctgg

SEQ ID NO: 4723732 - DNA, 22 bp, Homo sapiens
aggctctcactaccgtggacca

SEQ ID NO: 4723733 - DNA, 11 bp, Homo sapiens
aggctctgccc

SEQ ID NO: 4723734 - DNA, 21 bp, Homo sapiens
aggctggccagccccacagcc

SEQ ID NO: 4723735 - DNA, 22 bp, Homo sapiens
aggctggccagccccacagccc

SEQ ID NO: 4723736 - DNA, 14 bp, Homo sapiens
aggctggccctgcc

SEQ ID NO: 4723737 - DNA, 18 bp, Homo sapiens
aggctggccctgccctgg

SEQ ID NO: 4723738 - DNA, 15 bp, Homo sapiens
aggctggctggggcc

SEQ ID NO: 4723739 - DNA, 17 bp, Homo sapiens
aggctggctggggccta

SEQ ID NO: 4723740 - DNA, 14 bp, Homo sapiens
aggctgggagagcc

SEQ ID NO: 4723741 - DNA, 16 bp, Homo sapiens
aggctgggagagcctt

SEQ ID NO: 4723742 - DNA, 21 bp, Homo sapiens
aggctgggagagccttccagg

SEQ ID NO: 4723743 - DNA, 18 bp, Homo sapiens
aggctggggaagtcctct

SEQ ID NO: 4723744 - DNA, 21 bp, Homo sapiens
aggctggggaagtcctctggg

SEQ ID NO: 4723745 - DNA, 18 bp, Homo sapiens
aggctgggttctgatcct

SEQ ID NO: 4723746 - DNA, 23 bp, Homo sapiens
aggctggtctcgaactcctgacc

SEQ ID NO: 4723747 - DNA, 13 bp, Homo sapiens
aggctgtatccca

SEQ ID NO: 4723748 - DNA, 20 bp, Homo sapiens
aggctgtatcccatgagcct

SEQ ID NO: 4723749 - DNA, 24 bp, Homo sapiens
aggctgtatcccatgagcctcagc

SEQ ID NO: 4723750 - DNA, 22 bp, Homo sapiens
aggctgtcccaagctcccaaga

SEQ ID NO: 4723751 - DNA, 23 bp, Homo sapiens
aggctgtcccaagctcccaagag

SEQ ID NO: 4723752 - DNA, 13 bp, Homo sapiens
aggctgtgctccc

SEQ ID NO: 4723753 - DNA, 22 bp, Homo sapiens
aggcttagtcactgagacagcc

SEQ ID NO: 4723754 - DNA, 23 bp, Homo sapiens
aggcttattcagttcttacacat

SEQ ID NO: 4723755 - DNA, 18 bp, Homo sapiens
aggctttggcaacagaaa

SEQ ID NO: 4723756 - DNA, 16 bp, Homo sapiens
agggaaaacattccat

SEQ ID NO: 4723757 - DNA, 18 bp, Homo sapiens
agggaaaacattccatcc

SEQ ID NO: 4723758 - DNA, 18 bp, Homo sapiens
agggaaaattatttgcat

SEQ ID NO: 4723759 - DNA, 19 bp, Homo sapiens
agggaaagaaaaggaaggc

SEQ ID NO: 4723760 - DNA, 17 bp, Homo sapiens
agggaaagttttgttct

SEQ ID NO: 4723761 - DNA, 21 bp, Homo sapiens
agggaaagttttgttctgtat

SEQ ID NO: 4723762 - DNA, 13 bp, Homo sapiens
agggaacatgcag

SEQ ID NO: 4723763 - DNA, 15 bp, Homo sapiens
agggaagaactattg

SEQ ID NO: 4723764 - DNA, 13 bp, Homo sapiens
agggaaggggaca

SEQ ID NO: 4723765 - DNA, 22 bp, Homo sapiens
agggaaggggacaaggactagg

SEQ ID NO: 4723766 - DNA, 22 bp, Homo sapiens
agggaagtaacagtaacgcagg

SEQ ID NO: 4723767 - DNA, 21 bp, Homo sapiens
agggaagtcacttcaccatca

SEQ ID NO: 4723768 - DNA, 13 bp, Homo sapiens
agggaagttttgt

SEQ ID NO: 4723769 - DNA, 13 bp, Homo sapiens
agggaatgcctga

SEQ ID NO: 4723770 - DNA, 14 bp, Homo sapiens
agggaccacagcaa

SEQ ID NO: 4723771 - DNA, 18 bp, Homo sapiens
agggacgcctgggggtgc

SEQ ID NO: 4723772 - DNA, 23 bp, Homo sapiens
agggacgcctgggggtgccagga

SEQ ID NO: 4723773 - DNA, 20 bp, Homo sapiens
agggacttggaagctccgct

SEQ ID NO: 4723774 - DNA, 18 bp, Homo sapiens
agggagagcccaggagct

SEQ ID NO: 4723775 - DNA, 18 bp, Homo sapiens
aggaagctcagggcctgg

SEQ ID NO: 4723776 - DNA, 22 bp, Homo sapiens
aggaagctcagggcctggctca

SEQ ID NO: 4723777 - DNA, 20 bp, Homo sapiens
aggaaggaaacccagctctg

SEQ ID NO: 4723778 - DNA, 23 bp, Homo sapiens
aggaaggaaacccagctctggtc

SEQ ID NO: 4723779 - DNA, 19 bp, Homo sapiens
aggaaggagctgcctggac

SEQ ID NO: 4723780 - DNA, 16 bp, Homo sapiens
aggaaggattgtaaaa

SEQ ID NO: 4723781 - DNA, 15 bp, Homo sapiens
aggaagtaggaagta

SEQ ID NO: 4723782 - DNA, 23 bp, Homo sapiens
aggaataatgggcttagagcagt

SEQ ID NO: 4723783 - DNA, 17 bp, Homo sapiens
aggaatcattctgtaaa

SEQ ID NO: 4723784 - DNA, 21 bp, Homo sapiens
aggaatccactcccaggcagc

SEQ ID NO: 4723785 - DNA, 13 bp, Homo sapiens
aggacaaaataaa

SEQ ID NO: 4723786 - DNA, 15 bp, Homo sapiens
aggacaaacagtgaa

SEQ ID NO: 4723787 - DNA, 16 bp, Homo sapiens
aggacaaacagtgaat

SEQ ID NO: 4723788 - DNA, 13 bp, Homo sapiens
aggacaagaccct

SEQ ID NO: 4723789 - DNA, 15 bp, Homo sapiens
aggacattgcggaca

SEQ ID NO: 4723790 - DNA, 17 bp, Homo sapiens
aggacattgcggacagc

SEQ ID NO: 4723791 - DNA, 23 bp, Homo sapiens
aggacattgcggacagccacggc

SEQ ID NO: 4723792 - DNA, 19 bp, Homo sapiens
aggaccagtcaacctgggc

SEQ ID NO: 4723793 - DNA, 13 bp, Homo sapiens
aggacccagagga

SEQ ID NO: 4723794 - DNA, 19 bp, Homo sapiens
aggacctagctgttgtaaa

SEQ ID NO: 4723795 - DNA, 16 bp, Homo sapiens
aggacctgtggccaag

SEQ ID NO: 4723796 - DNA, 16 bp, Homo sapiens
aggacggggccggcca

SEQ ID NO: 4723797 - DNA, 22 bp, Homo sapiens
aggactagaacctggagggctg

SEQ ID NO: 4723798 - DNA, 19 bp, Homo sapiens
aggactagggtcctgggga

SEQ ID NO: 4723799 - DNA, 17 bp, Homo sapiens
aggactcagctccccag

SEQ ID NO: 4723800 - DNA, 19 bp, Homo sapiens
aggactcagctccccagag

SEQ ID NO: 4723801 - DNA, 20 bp, Homo sapiens
aggactcagctccccagagt

SEQ ID NO: 4723802 - DNA, 12 bp, Homo sapiens
aggactctcagg

SEQ ID NO: 4723803 - DNA, 12 bp, Homo sapiens
aggactgggcca

SEQ ID NO: 4723804 - DNA, 15 bp, Homo sapiens
aggactgggccactt

SEQ ID NO: 4723805 - DNA, 19 bp, Homo sapiens
aggactgtgacaggcagca

SEQ ID NO: 4723806 - DNA, 21 bp, Homo sapiens
aggactgtgacaggcagcaga

SEQ ID NO: 4723807 - DNA, 16 bp, Homo sapiens
aggacttgaaagaaat

SEQ ID NO: 4723808 - DNA, 11 bp, Homo sapiens
aggagaagttg

SEQ ID NO: 4723809 - DNA, 23 bp, Homo sapiens
aggagaattaagtcctactttta

SEQ ID NO: 4723810 - DNA, 16 bp, Homo sapiens
aggagacaaaagagca

SEQ ID NO: 4723811 - DNA, 12 bp, Homo sapiens
aggagacaggaa

SEQ ID NO: 4723812 - DNA, 13 bp, Homo sapiens
aggagacaggaag

SEQ ID NO: 4723813 - DNA, 20 bp, Homo sapiens
aggagactgtttggaaattg

SEQ ID NO: 4723814 - DNA, 20 bp, Homo sapiens
aggagaggatgagagcccag

SEQ ID NO: 4723815 - DNA, 15 bp, Homo sapiens
aggagcaaaggctga

SEQ ID NO: 4723816 - DNA, 22 bp, Homo sapiens
aggagcaaaggctgagaacact

SEQ ID NO: 4723817 - DNA, 16 bp, Homo sapiens
aggagcagtgcaggca

SEQ ID NO: 4723818 - DNA, 19 bp, Homo sapiens
aggagcagtgcaggcacag

SEQ ID NO: 4723819 - DNA, 18 bp, Homo sapiens
aggagcccaggccaggac

SEQ ID NO: 4723820 - DNA, 19 bp, Homo sapiens
aggagcccaggccaggact

SEQ ID NO: 4723821 - DNA, 15 bp, Homo sapiens
aggagccccattcct

SEQ ID NO: 4723822 - DNA, 19 bp, Homo sapiens
aggagccggacacttctca

SEQ ID NO: 4723823 - DNA, 12 bp, Homo sapiens
aggagctcccct

SEQ ID NO: 4723824 - DNA, 21 bp, Homo sapiens
aggagctcccctccccaactg

SEQ ID NO: 4723825 - DNA, 12 bp, Homo sapiens
aggagctgcctg

SEQ ID NO: 4723826 - DNA, 16 bp, Homo sapiens
aggagctgcctggacc

SEQ ID NO: 4723827 - DNA, 18 bp, Homo sapiens
aggagctgcctggacccg

SEQ ID NO: 4723828 - DNA, 15 bp, Homo sapiens
aggaggacaagaccc

SEQ ID NO: 4723829 - DNA, 11 bp, Homo sapiens
aggaggagaaa

SEQ ID NO: 4723830 - DNA, 18 bp, Homo sapiens
aggaggaggtgccaacag

SEQ ID NO: 4723831 - DNA, 18 bp, Homo sapiens
aggaggcacctacactca

SEQ ID NO: 4723832 - DNA, 16 bp, Homo sapiens
aggaggctccagaggg

SEQ ID NO: 4723833 - DNA, 18 bp, Homo sapiens
aggaggctccagagggca

SEQ ID NO: 4723834 - DNA, 19 bp, Homo sapiens
aggaggctccagagggcac

SEQ ID NO: 4723835 - DNA, 21 bp, Homo sapiens
aggagggtcggtgccttcaag

SEQ ID NO: 4723836 - DNA, 14 bp, Homo sapiens
aggagtgagcacta

SEQ ID NO: 4723837 - DNA, 12 bp, Homo sapiens
aggataatggtg

SEQ ID NO: 4723838 - DNA, 21 bp, Homo sapiens
aggataatggtgaacatttta

SEQ ID NO: 4723839 - DNA, 23 bp, Homo sapiens
aggatatgttcacacctagcgtc

SEQ ID NO: 4723840 - DNA, 18 bp, Homo sapiens
aggatcacagtgctgaga

SEQ ID NO: 4723841 - DNA, 19 bp, Homo sapiens
aggatctctaaagagcatc

SEQ ID NO: 4723842 - DNA, 15 bp, Homo sapiens
aggatgagagcccag

SEQ ID NO: 4723843 - DNA, 18 bp, Homo sapiens
aggatgagagcccagagg

SEQ ID NO: 4723844 - DNA, 22 bp, Homo sapiens
aggatgatctaggaagactttg

SEQ ID NO: 4723845 - DNA, 16 bp, Homo sapiens
aggatggcctggccag

SEQ ID NO: 4723846 - DNA, 23 bp, Homo sapiens
aggatggcctggccagggcctgg

SEQ ID NO: 4723847 - DNA, 18 bp, Homo sapiens
aggatgttctgggacaca

SEQ ID NO: 4723848 - DNA, 15 bp, Homo sapiens
aggattaaaatggat

SEQ ID NO: 4723849 - DNA, 18 bp, Homo sapiens
aggattgcgagagatgtg

SEQ ID NO: 4723850 - DNA, 19 bp, Homo sapiens
aggattgcgagagatgtgt

SEQ ID NO: 4723851 - DNA, 21 bp, Homo sapiens
aggattgcgagagatgtgtgt

SEQ ID NO: 4723852 - DNA, 13 bp, Homo sapiens
aggattgtaaaaa

SEQ ID NO: 4723853 - DNA, 19 bp, Homo sapiens
aggattgtaaaaaaaaatg

SEQ ID NO: 4723854 - DNA, 23 bp, Homo sapiens
aggattgtaaaaaaaaatgcctt

SEQ ID NO: 4723855 - DNA, 16 bp, Homo sapiens
aggatttataaagcaa

SEQ ID NO: 4723856 - DNA, 19 bp, Homo sapiens
aggattttgatccaagctg

SEQ ID NO: 4723857 - DNA, 22 bp, Homo sapiens
aggcaaacccatcaacaaaaat

SEQ ID NO: 4723858 - DNA, 16 bp, Homo sapiens
aggcaacttgggaact

SEQ ID NO: 4723859 - DNA, 20 bp, Homo sapiens
aggcaagcacctcctgcctc

SEQ ID NO: 4723860 - DNA, 17 bp, Homo sapiens
aggcaagccatggagtg

SEQ ID NO: 4723861 - DNA, 12 bp, Homo sapiens
aggcaaggggca

SEQ ID NO: 4723862 - DNA, 23 bp, Homo sapiens
aggcacctacactcacctgcact

SEQ ID NO: 4723863 - DNA, 21 bp, Homo sapiens
aggcactgccctggtggccct

SEQ ID NO: 4723864 - DNA, 14 bp, Homo sapiens
aggcactgcctgat

SEQ ID NO: 4723865 - DNA, 14 bp, Homo sapiens
aggcacttcctccc

SEQ ID NO: 4723866 - DNA, 21 bp, Homo sapiens
aggcagccccattctgcctgc

SEQ ID NO: 4723867 - DNA, 14 bp, Homo sapiens
aggcaggacatgct

SEQ ID NO: 4723868 - DNA, 19 bp, Homo sapiens
aggcaggacatgctgaagc

SEQ ID NO: 4723869 - DNA, 23 bp, Homo sapiens
aggcaggctaaggcgtggagctg

SEQ ID NO: 4723870 - DNA, 16 bp, Homo sapiens
aggcagggagggcctg

SEQ ID NO: 4723871 - DNA, 19 bp, Homo sapiens
aggcaggggaatgtatgtg

SEQ ID NO: 4723872 - DNA, 12 bp, Homo sapiens
aggcagggtctc

SEQ ID NO: 4723873 - DNA, 22 bp, Homo sapiens
aggcagggtctcactctgtcgc

SEQ ID NO: 4723874 - DNA, 14 bp, Homo sapiens
aggcaggtccaggg

SEQ ID NO: 4723875 - DNA, 16 bp, Homo sapiens
aggcagtgggtcccac

SEQ ID NO: 4723876 - DNA, 18 bp, Homo sapiens
aggcatgttctctgagga

SEQ ID NO: 4723877 - DNA, 17 bp, Homo sapiens
aggcattccccaggagg

SEQ ID NO: 4723878 - DNA, 19 bp, Homo sapiens
aggcattccccaggaggcc

SEQ ID NO: 4723879 - DNA, 20 bp, Homo sapiens
aggcattccccaggaggcca

SEQ ID NO: 4723880 - DNA, 22 bp, Homo sapiens
aggcattccccaggaggccagc

SEQ ID NO: 4723881 - DNA, 13 bp, Homo sapiens
aggcattgccaag

SEQ ID NO: 4723882 - DNA, 20 bp, Homo sapiens
aggcattgccaagggctttg

SEQ ID NO: 4723883 - DNA, 13 bp, Homo sapiens
aggcattggatat

SEQ ID NO: 4723884 - DNA, 14 bp, Homo sapiens
aggcattggatatt

SEQ ID NO: 4723885 - DNA, 18 bp, Homo sapiens
aggcattgtgggaagggg

SEQ ID NO: 4723886 - DNA, 14 bp, Homo sapiens
agcaagtgagagct

SEQ ID NO: 4723887 - DNA, 16 bp, Homo sapiens
agcaagtgagagctgg

SEQ ID NO: 4723888 - DNA, 13 bp, Homo sapiens
agcaatgctgtga

SEQ ID NO: 4723889 - DNA, 14 bp, Homo sapiens
agcaatgctgtgaa

SEQ ID NO: 4723890 - DNA, 19 bp, Homo sapiens
agcaattctcctgcctcag

SEQ ID NO: 4723891 - DNA, 14 bp, Homo sapiens
agacagccccctgc

SEQ ID NO: 4723892 - DNA, 17 bp, Homo sapiens
agacagcccgggctctg

SEQ ID NO: 4723893 - DNA, 21 bp, Homo sapiens
agacagcccgggctctgcctc

SEQ ID NO: 4723894 - DNA, 23 bp, Homo sapiens
agacagcccgggctctgcctccc

SEQ ID NO: 4723895 - DNA, 13 bp, Homo sapiens
agacagctgcctg

SEQ ID NO: 4723896 - DNA, 15 bp, Homo sapiens
agacaggagacaaaa

SEQ ID NO: 4723897 - DNA, 15 bp, Homo sapiens
agacagtccagcctg

SEQ ID NO: 4723898 - DNA, 16 bp, Homo sapiens
agacagtccctgccaa

SEQ ID NO: 4723899 - DNA, 14 bp, Homo sapiens
agacagtttcttag

SEQ ID NO: 4723900 - DNA, 21 bp, Homo sapiens
agacagtttcttagcttttta

SEQ ID NO: 4723901 - DNA, 20 bp, Homo sapiens
agacatgagtgcgtgctcag

SEQ ID NO: 4723902 - DNA, 11 bp, Homo sapiens
agacattttca

SEQ ID NO: 4723903 - DNA, 23 bp, Homo sapiens
agaccaaattttgaggtctttta

SEQ ID NO: 4723904 - DNA, 22 bp, Homo sapiens
agaccaagggatgggacctgat

SEQ ID NO: 4723905 - DNA, 22 bp, Homo sapiens
agaccagcctggccaacatggc

SEQ ID NO: 4723906 - DNA, 17 bp, Homo sapiens
agaccaggcaaagcaag

SEQ ID NO: 4723907 - DNA, 13 bp, Homo sapiens
agaccatccctga

SEQ ID NO: 4723908 - DNA, 19 bp, Homo sapiens
agacccagccctcatcccg

SEQ ID NO: 4723909 - DNA, 17 bp, Homo sapiens
agacccattccttccca

SEQ ID NO: 4723910 - DNA, 15 bp, Homo sapiens
agaccccctgtcctg

SEQ ID NO: 4723911 - DNA, 21 bp, Homo sapiens
agaccctctcaggctgtccca

SEQ ID NO: 4723912 - DNA, 13 bp, Homo sapiens
agaccctgccctg

SEQ ID NO: 4723913 - DNA, 15 bp, Homo sapiens
agacccttgtggtcc

SEQ ID NO: 4723914 - DNA, 15 bp, Homo sapiens
agacctcagatgtgt

SEQ ID NO: 4723915 - DNA, 18 bp, Homo sapiens
agacctctgtgcacttat

SEQ ID NO: 4723916 - DNA, 12 bp, Homo sapiens
agacctgcccct

SEQ ID NO: 4723917 - DNA, 16 bp, Homo sapiens
agacctgcccctcctc

SEQ ID NO: 4723918 - DNA, 22 bp, Homo sapiens
agacctgcccctcctctctgcc

SEQ ID NO: 4723919 - DNA, 15 bp, Homo sapiens
agaccttctccttca

SEQ ID NO: 4723920 - DNA, 23 bp, Homo sapiens
agaccttctccttcacctttgtc

SEQ ID NO: 4723921 - DNA, 13 bp, Homo sapiens
agacgcctgagga

SEQ ID NO: 4723922 - DNA, 15 bp, Homo sapiens
agacgcctgaggaac

SEQ ID NO: 4723923 - DNA, 18 bp, Homo sapiens
agacgctgtgctgccctg

SEQ ID NO: 4723924 - DNA, 13 bp, Homo sapiens
agactaagccagc

SEQ ID NO: 4723925 - DNA, 16 bp, Homo sapiens
agactaagccagcacc

SEQ ID NO: 4723926 - DNA, 15 bp, Homo sapiens
agactatcagcccaa

SEQ ID NO: 4723927 - DNA, 18 bp, Homo sapiens
agactatgtaaaaataac

SEQ ID NO: 4723928 - DNA, 21 bp, Homo sapiens
agactcagtggggaggggctg

SEQ ID NO: 4723929 - DNA, 17 bp, Homo sapiens
agactcattcttctgta

SEQ ID NO: 4723930 - DNA, 14 bp, Homo sapiens
agactccacctcaa

SEQ ID NO: 4723931 - DNA, 15 bp, Homo sapiens
agactccagctgtga

SEQ ID NO: 4723932 - DNA, 16 bp, Homo sapiens
agactcccaagctgga

SEQ ID NO: 4723933 - DNA, 14 bp, Homo sapiens
agactcctaggcag

SEQ ID NO: 4723934 - DNA, 15 bp, Homo sapiens
agactcctgcaggca

SEQ ID NO: 4723935 - DNA, 18 bp, Homo sapiens
agactcctgcaggcagcc

SEQ ID NO: 4723936 - DNA, 20 bp, Homo sapiens
agactcctgcaggcagccag

SEQ ID NO: 4723937 - DNA, 24 bp, Homo sapiens
agactgaatagatatgaaagctga

SEQ ID NO: 4723938 - DNA, 16 bp, Homo sapiens
agactggaagcacagc

SEQ ID NO: 4723939 - DNA, 15 bp, Homo sapiens
agacttccagagcct

SEQ ID NO: 4723940 - DNA, 15 bp, Homo sapiens
agacttggatgagga

SEQ ID NO: 4723941 - DNA, 15 bp, Homo sapiens
agactttggaaagac

SEQ ID NO: 4723942 - DNA, 14 bp, Homo sapiens
agagaaaatgaatt

SEQ ID NO: 4723943 - DNA, 13 bp, Homo sapiens
agagaactgagca

SEQ ID NO: 4723944 - DNA, 17 bp, Homo sapiens
agagaactgagcatctc

SEQ ID NO: 4723945 - DNA, 20 bp, Homo sapiens
agagaagctaaaacctgagc

SEQ ID NO: 4723946 - DNA, 16 bp, Homo sapiens
agagaataatttctgt

SEQ ID NO: 4723947 - DNA, 22 bp, Homo sapiens
agagacactgttgataaaaact

SEQ ID NO: 4723948 - DNA, 11 bp, Homo sapiens
agagactcctg

SEQ ID NO: 4723949 - DNA, 15 bp, Homo sapiens
agagactcctgcagg

SEQ ID NO: 4723950 - DNA, 20 bp, Homo sapiens
agagactcctgcaggcagcc

SEQ ID NO: 4723951 - DNA, 21 bp, Homo sapiens
agagactcctgcaggcagcca

SEQ ID NO: 4723952 - DNA, 21 bp, Homo sapiens
agagactccttgagagaccag

SEQ ID NO: 4723953 - DNA, 13 bp, Homo sapiens
agagagaaaaaca

SEQ ID NO: 4723954 - DNA, 14 bp, Homo sapiens
agagagaaaaacaa

SEQ ID NO: 4723955 - DNA, 19 bp, Homo sapiens
agagagcagcttctgccac

SEQ ID NO: 4723956 - DNA, 17 bp, Homo sapiens
agagagccattttgtga

SEQ ID NO: 4723957 - DNA, 18 bp, Homo sapiens
agagagccattttgtgaa

SEQ ID NO: 4723958 - DNA, 19 bp, Homo sapiens
agagagccattttgtgaat

SEQ ID NO: 4723959 - DNA, 16 bp, Homo sapiens
agagagcttctgttgc

SEQ ID NO: 4723960 - DNA, 16 bp, Homo sapiens
agagaggacaaaataa

SEQ ID NO: 4723961 - DNA, 20 bp, Homo sapiens
agagagggtggtgacctctg

SEQ ID NO: 4723962 - DNA, 22 bp, Homo sapiens
agagagggtggtgacctctgcc

SEQ ID NO: 4723963 - DNA, 13 bp, Homo sapiens
agagatatttaaa

SEQ ID NO: 4723964 - DNA, 13 bp, Homo sapiens
agagatgtgtgtt

SEQ ID NO: 4723965 - DNA, 19 bp, Homo sapiens
agagattacctcctgagaa

SEQ ID NO: 4723966 - DNA, 19 bp, Homo sapiens
agagattagaacatttaat

SEQ ID NO: 4723967 - DNA, 20 bp, Homo sapiens
agagattagtaaatatgtga

SEQ ID NO: 4723968 - DNA, 13 bp, Homo sapiens
agagattcactca

SEQ ID NO: 4723969 - DNA, 20 bp, Homo sapiens
agagcagagaccatccctga

SEQ ID NO: 4723970 - DNA, 19 bp, Homo sapiens
agagcagatgcagagagcc

SEQ ID NO: 4723971 - DNA, 23 bp, Homo sapiens
agagcagtttctgtcctgctggt

SEQ ID NO: 4723972 - DNA, 14 bp, Homo sapiens
agagcataatttaa

SEQ ID NO: 4723973 - DNA, 21 bp, Homo sapiens
agagcataatttaaaaatata

SEQ ID NO: 4723974 - DNA, 19 bp, Homo sapiens
agagccaccaagagggacg

SEQ ID NO: 4723975 - DNA, 22 bp, Homo sapiens
agagccagaacctggagggcta

SEQ ID NO: 4723976 - DNA, 18 bp, Homo sapiens
agagccatacataaaaga

SEQ ID NO: 4723977 - DNA, 20 bp, Homo sapiens
agagccatacataaaagaaa

SEQ ID NO: 4723978 - DNA, 21 bp, Homo sapiens
agagccatacataaaagaaat

SEQ ID NO: 4723979 - DNA, 16 bp, Homo sapiens
agagccattttgtgaa

SEQ ID NO: 4723980 - DNA, 13 bp, Homo sapiens
agagcccaccttg

SEQ ID NO: 4723981 - DNA, 19 bp, Homo sapiens
agagcccaccttggctcaa

SEQ ID NO: 4723982 - DNA, 16 bp, Homo sapiens
agagcccacgccccca

SEQ ID NO: 4723983 - DNA, 17 bp, Homo sapiens
agagcccacgcccccac

SEQ ID NO: 4723984 - DNA, 20 bp, Homo sapiens
agagcccagaggtaacagaa

SEQ ID NO: 4723985 - DNA, 15 bp, Homo sapiens
agagcccaggagctc

SEQ ID NO: 4723986 - DNA, 11 bp, Homo sapiens
agagcctgagg

SEQ ID NO: 4723987 - DNA, 13 bp, Homo sapiens
agagcctgaggga

SEQ ID NO: 4723988 - DNA, 17 bp, Homo sapiens
agagccttccaggggtg

SEQ ID NO: 4723989 - DNA, 19 bp, Homo sapiens
agagctagaacatggagag

SEQ ID NO: 4723990 - DNA, 16 bp, Homo sapiens
agagctagaacctgga

SEQ ID NO: 4723991 - DNA, 18 bp, Homo sapiens
agagctgacacaaacctg

SEQ ID NO: 4723992 - DNA, 11 bp, Homo sapiens
agagctgaggc

SEQ ID NO: 4723993 - DNA, 15 bp, Homo sapiens
agagctggagcctgg

SEQ ID NO: 4723994 - DNA, 18 bp, Homo sapiens
agagctggagcctggtgc

SEQ ID NO: 4723995 - DNA, 19 bp, Homo sapiens
agagctgggtgtcaagagg

SEQ ID NO: 4723996 - DNA, 12 bp, Homo sapiens
agagcttccctg

SEQ ID NO: 4723997 - DNA, 16 bp, Homo sapiens
agagcttccctgactc

SEQ ID NO: 4723998 - DNA, 21 bp, Homo sapiens
agagcttctgttgctgcctca

SEQ ID NO: 4723999 - DNA, 22 bp, Homo sapiens
agagcttctgttgctgcctcat

SEQ ID NO: 4724000 - DNA, 16 bp, Homo sapiens
agagcttgtaataaat

SEQ ID NO: 4724001 - DNA, 17 bp, Homo sapiens
agagcttgtaataaata

SEQ ID NO: 4724002 - DNA, 18 bp, Homo sapiens
agagcttgtaataaatac

SEQ ID NO: 4724003 - DNA, 15 bp, Homo sapiens
accttgaggagaagt

SEQ ID NO: 4724004 - DNA, 12 bp, Homo sapiens
accttggctcaa

SEQ ID NO: 4724005 - DNA, 14 bp, Homo sapiens
accttggctcaagt

SEQ ID NO: 4724006 - DNA, 17 bp, Homo sapiens
accttggctgcagggag

SEQ ID NO: 4724007 - DNA, 18 bp, Homo sapiens
accttggctgcagggagt

SEQ ID NO: 4724008 - DNA, 20 bp, Homo sapiens
accttgtagcatgtgaagaa

SEQ ID NO: 4724009 - DNA, 16 bp, Homo sapiens
accttgtttctttctg

SEQ ID NO: 4724010 - DNA, 16 bp, Homo sapiens
acctttcccatttcgt

SEQ ID NO: 4724011 - DNA, 18 bp, Homo sapiens
actttttgttccagagct

SEQ ID NO: 4724012 - DNA, 22 bp, Homo sapiens
acttttttctttaaattttgtt

SEQ ID NO: 4724013 - DNA, 22 bp, Homo sapiens
agaaaacaaactaaatgtagtt

SEQ ID NO: 4724014 - DNA, 20 bp, Homo sapiens
agaaaacaggcactgccctg

SEQ ID NO: 4724015 - DNA, 21 bp, Homo sapiens
agaaaagcaggcctttgcaga

SEQ ID NO: 4724016 - DNA, 14 bp, Homo sapiens
agaaaataacaata

SEQ ID NO: 4724017 - DNA, 17 bp, Homo sapiens
agaaaatgaaatgcata

SEQ ID NO: 4724018 - DNA, 13 bp, Homo sapiens
agaaaatgtgtct

SEQ ID NO: 4724019 - DNA, 23 bp, Homo sapiens
agaaaatgtgtctgcaacatgga

SEQ ID NO: 4724020 - DNA, 17 bp, Homo sapiens
agaaaattttttttcaa

SEQ ID NO: 4724021 - DNA, 17 bp, Homo sapiens
agaaacaaagatgttat

SEQ ID NO: 4724022 - DNA, 14 bp, Homo sapiens
agaaacattgaaga

SEQ ID NO: 4724023 - DNA, 17 bp, Homo sapiens
agaaactactaattttt

SEQ ID NO: 4724024 - DNA, 18 bp, Homo sapiens
agaaactactaatttttt

SEQ ID NO: 4724025 - DNA, 15 bp, Homo sapiens
agaaagacagagctg

SEQ ID NO: 4724026 - DNA, 22 bp, Homo sapiens
agaaagaccatgcatttaaagt

SEQ ID NO: 4724027 - DNA, 18 bp, Homo sapiens
agaaagatatctatgact

SEQ ID NO: 4724028 - DNA, 22 bp, Homo sapiens
agaaagcccttaggaagaattt

SEQ ID NO: 4724029 - DNA, 20 bp, Homo sapiens
agaaaggttgcgtttaatat

SEQ ID NO: 4724030 - DNA, 23 bp, Homo sapiens
agaaagtggaaaacaaggaagtc

SEQ ID NO: 4724031 - DNA, 14 bp, Homo sapiens
agaaataaaccaaa

SEQ ID NO: 4724032 - DNA, 23 bp, Homo sapiens
agaaataaaccaaaggaaaatgt

SEQ ID NO: 4724033 - DNA, 15 bp, Homo sapiens
agaaatactttcgaa

SEQ ID NO: 4724034 - DNA, 23 bp, Homo sapiens
agaaatactttcgaaatttcatt

SEQ ID NO: 4724035 - DNA, 16 bp, Homo sapiens
agaaatagaaaaggaa

SEQ ID NO: 4724036 - DNA, 13 bp, Homo sapiens
agaaatcaatttt

SEQ ID NO: 4724037 - DNA, 13 bp, Homo sapiens
agaaatctttcca

SEQ ID NO: 4724038 - DNA, 12 bp, Homo sapiens
agaaatgctctg

SEQ ID NO: 4724039 - DNA, 19 bp, Homo sapiens
agaaattacctgtggatat

SEQ ID NO: 4724040 - DNA, 20 bp, Homo sapiens
agaaattacctgtggatatt

SEQ ID NO: 4724041 - DNA, 18 bp, Homo sapiens
agaaattataattttagt

SEQ ID NO: 4724042 - DNA, 20 bp, Homo sapiens
agaacaaaggggcttaatta

SEQ ID NO: 4724043 - DNA, 20 bp, Homo sapiens
agaacacagcaattcctcag

SEQ ID NO: 4724044 - DNA, 11 bp, Homo sapiens
agaacacagtt

SEQ ID NO: 4724045 - DNA, 13 bp, Homo sapiens
agaacagcttcag

SEQ ID NO: 4724046 - DNA, 20 bp, Homo sapiens
agaacagtgtttgattttta

SEQ ID NO: 4724047 - DNA, 18 bp, Homo sapiens
agaacatggtgtgtgtct

SEQ ID NO: 4724048 - DNA, 16 bp, Homo sapiens
agaaccaagaagggct

SEQ ID NO: 4724049 - DNA, 15 bp, Homo sapiens
agaacctggaagggc

SEQ ID NO: 4724050 - DNA, 21 bp, Homo sapiens
agaacggggctcttctcattt

SEQ ID NO: 4724051 - DNA, 14 bp, Homo sapiens
agaactctttcaaa

SEQ ID NO: 4724052 - DNA, 14 bp, Homo sapiens
agaactgagcatct

SEQ ID NO: 4724053 - DNA, 15 bp, Homo sapiens
agaactgagcatctc

SEQ ID NO: 4724054 - DNA, 16 bp, Homo sapiens
agaactgagcatctcc

SEQ ID NO: 4724055 - DNA, 20 bp, Homo sapiens
agaactgagcatctccagca

SEQ ID NO: 4724056 - DNA, 22 bp, Homo sapiens
agaactgtcatgtaaacatacc

SEQ ID NO: 4724057 - DNA, 20 bp, Homo sapiens
agaacttaagtctcgaatgt

SEQ ID NO: 4724058 - DNA, 23 bp, Homo sapiens
agaacttggatgtacctgccccc

SEQ ID NO: 4724059 - DNA, 13 bp, Homo sapiens
agaagaaggcagc

SEQ ID NO: 4724060 - DNA, 18 bp, Homo sapiens
agaagacaccagagcaga

SEQ ID NO: 4724061 - DNA, 23 bp, Homo sapiens
agaagacaccagagcagatgcag

SEQ ID NO: 4724062 - DNA, 16 bp, Homo sapiens
agaagatcctacccca

SEQ ID NO: 4724063 - DNA, 13 bp, Homo sapiens
agaagcattcctt

SEQ ID NO: 4724064 - DNA, 15 bp, Homo sapiens
agaagcattccttct

SEQ ID NO: 4724065 - DNA, 19 bp, Homo sapiens
agaagcattccttctttga

SEQ ID NO: 4724066 - DNA, 23 bp, Homo sapiens
agaagcattccttctttgataat

SEQ ID NO: 4724067 - DNA, 16 bp, Homo sapiens
agaagccacaggcctg

SEQ ID NO: 4724068 - DNA, 17 bp, Homo sapiens
agaagccacaggcctga

SEQ ID NO: 4724069 - DNA, 19 bp, Homo sapiens
agaagccacaggcctgaga

SEQ ID NO: 4724070 - DNA, 16 bp, Homo sapiens
agaagcccaggaaagg

SEQ ID NO: 4724071 - DNA, 10 bp, Homo sapiens
agaagcctgc

SEQ ID NO: 4724072 - DNA, 21 bp, Homo sapiens
agaagcctgcataatgtttct

SEQ ID NO: 4724073 - DNA, 23 bp, Homo sapiens
agaagctccctgaagtaagcaaa

SEQ ID NO: 4724074 - DNA, 14 bp, Homo sapiens
agaagctgcaataa

SEQ ID NO: 4724075 - DNA, 16 bp, Homo sapiens
agaagctgttgtacat

SEQ ID NO: 4724076 - DNA, 20 bp, Homo sapiens
agaagctgttgtacatttat

SEQ ID NO: 4724077 - DNA, 22 bp, Homo sapiens
agaagctgttgtacatttatga

SEQ ID NO: 4724078 - DNA, 16 bp, Homo sapiens
agaaggaaaaggcagg

SEQ ID NO: 4724079 - DNA, 13 bp, Homo sapiens
agaaggatgatgt

SEQ ID NO: 4724080 - DNA, 14 bp, Homo sapiens
agaagggctagaac

SEQ ID NO: 4724081 - DNA, 21 bp, Homo sapiens
agaagggctagaacctggaga

SEQ ID NO: 4724082 - DNA, 15 bp, Homo sapiens
agaagggctcagaga

SEQ ID NO: 4724083 - DNA, 18 bp, Homo sapiens
agaagtactttgtgctga

SEQ ID NO: 4724084 - DNA, 15 bp, Homo sapiens
agaagtattgtttac

SEQ ID NO: 4724085 - DNA, 14 bp, Homo sapiens
agaagtcacacagt

SEQ ID NO: 4724086 - DNA, 14 bp, Homo sapiens
agaagtgatttagt

SEQ ID NO: 4724087 - DNA, 21 bp, Homo sapiens
agaagtggggaccccacccct

SEQ ID NO: 4724088 - DNA, 23 bp, Homo sapiens
agaagtggggaccccacccctca

SEQ ID NO: 4724089 - DNA, 18 bp, Homo sapiens
agaagttgatatagaaca

SEQ ID NO: 4724090 - DNA, 19 bp, Homo sapiens
agaagttgatatagaacag

SEQ ID NO: 4724091 - DNA, 19 bp, Homo sapiens
agaagtttgggctaacatt

SEQ ID NO: 4724092 - DNA, 20 bp, Homo sapiens
agaagtttgggctaacattt

SEQ ID NO: 4724093 - DNA, 15 bp, Homo sapiens
agaataaaggcctgc

SEQ ID NO: 4724094 - DNA, 13 bp, Homo sapiens
agaatactggtct

SEQ ID NO: 4724095 - DNA, 15 bp, Homo sapiens
agaatactggtctca

SEQ ID NO: 4724096 - DNA, 16 bp, Homo sapiens
agaatactggtctcag

SEQ ID NO: 4724097 - DNA, 12 bp, Homo sapiens
agaatagtctct

SEQ ID NO: 4724098 - DNA, 13 bp, Homo sapiens
agaatctggagag

SEQ ID NO: 4724099 - DNA, 23 bp, Homo sapiens
agaatgagagagagactgtgtgt

SEQ ID NO: 4724100 - DNA, 23 bp, Homo sapiens
agaatggtttttgttgagtctct

SEQ ID NO: 4724101 - DNA, 16 bp, Homo sapiens
agaatgtaagaactac

SEQ ID NO: 4724102 - DNA, 15 bp, Homo sapiens
agaatgttagagtaa

SEQ ID NO: 4724103 - DNA, 15 bp, Homo sapiens
agaattattcagtga

SEQ ID NO: 4724104 - DNA, 19 bp, Homo sapiens
agaattattcagtgaattt

SEQ ID NO: 4724105 - DNA, 23 bp, Homo sapiens
agaattattcagtgaatttgtcc

SEQ ID NO: 4724106 - DNA, 20 bp, Homo sapiens
agaattggccatcttaaaaa

SEQ ID NO: 4724107 - DNA, 18 bp, Homo sapiens
agaatttgagtgctctga

SEQ ID NO: 4724108 - DNA, 10 bp, Homo sapiens
agacaaacac

SEQ ID NO: 4724109 - DNA, 19 bp, Homo sapiens
agacacaacaactcctagg

SEQ ID NO: 4724110 - DNA, 21 bp, Homo sapiens
agacacaggcccggctccagg

SEQ ID NO: 4724111 - DNA, 19 bp, Homo sapiens
agacaccgttcattcaggc

SEQ ID NO: 4724112 - DNA, 17 bp, Homo sapiens
agacaccttgacagggc

SEQ ID NO: 4724113 - DNA, 18 bp, Homo sapiens
agacaccttgacagggca

SEQ ID NO: 4724114 - DNA, 20 bp, Homo sapiens
agacactaacgaaatatcaa

SEQ ID NO: 4724115 - DNA, 15 bp, Homo sapiens
agacactgcacagaa

SEQ ID NO: 4724116 - DNA, 22 bp, Homo sapiens
agacactgcacagaagacagca

SEQ ID NO: 4724117 - DNA, 18 bp, Homo sapiens
agacagaggcagagattg

SEQ ID NO: 4724118 - DNA, 19 bp, Homo sapiens
agacagagtctcactgttg

SEQ ID NO: 4724119 - DNA, 20 bp, Homo sapiens
agacagagtctcactgttgc

SEQ ID NO: 4724120 - DNA, 20 bp, Homo sapiens
aacagtgaatttaagcatga

SEQ ID NO: 4724121 - DNA, 14 bp, Homo sapiens
aacagtggatcaca

SEQ ID NO: 4724122 - DNA, 19 bp, Homo sapiens
aacagtttggatgtcctca

SEQ ID NO: 4724123 - DNA, 13 bp, Homo sapiens
aacataataaatc

SEQ ID NO: 4724124 - DNA, 20 bp, Homo sapiens
aacataataaatcacacatt

SEQ ID NO: 4724125 - DNA, 15 bp, Homo sapiens
aacataccaacatgt

SEQ ID NO: 4724126 - DNA, 14 bp, Homo sapiens
aacatactcccatc

SEQ ID NO: 4724127 - DNA, 16 bp, Homo sapiens
aacatactcccatctg

SEQ ID NO: 4724128 - DNA, 18 bp, Homo sapiens
aacatactcccatctgtg

SEQ ID NO: 4724129 - DNA, 20 bp, Homo sapiens
aacatactcccatctgtgaa

SEQ ID NO: 4724130 - DNA, 15 bp, Homo sapiens
aacatagttgaaaaa

SEQ ID NO: 4724131 - DNA, 24 bp, Homo sapiens
aacatagttgaaaaaagaagtttg

SEQ ID NO: 4724132 - DNA, 17 bp, Homo sapiens
aacatatttaagaaata

SEQ ID NO: 4724133 - DNA, 14 bp, Homo sapiens
aacatcatcaaggc

SEQ ID NO: 4724134 - DNA, 11 bp, Homo sapiens
aacatcttttc

SEQ ID NO: 4724135 - DNA, 20 bp, Homo sapiens
aacatgaaaacattgatgaa

SEQ ID NO: 4724136 - DNA, 22 bp, Homo sapiens
aacatgtggcttgaattaagaa

SEQ ID NO: 4724137 - DNA, 22 bp, Homo sapiens
aacatgtttctgccttctttat

SEQ ID NO: 4724138 - DNA, 20 bp, Homo sapiens
aacattacagggaatgcctg

SEQ ID NO: 4724139 - DNA, 22 bp, Homo sapiens
aacattacagggaatgcctgag

SEQ ID NO: 4724140 - DNA, 14 bp, Homo sapiens
aacattagttttaa

SEQ ID NO: 4724141 - DNA, 22 bp, Homo sapiens
aacattcttttgtttatattgt

SEQ ID NO: 4724142 - DNA, 15 bp, Homo sapiens
aacatttaggagaag

SEQ ID NO: 4724143 - DNA, 18 bp, Homo sapiens
aacatttaggagaagttg

SEQ ID NO: 4724144 - DNA, 16 bp, Homo sapiens
aaccaaatattccaga

SEQ ID NO: 4724145 - DNA, 13 bp, Homo sapiens
aaccaagttgttt

SEQ ID NO: 4724146 - DNA, 21 bp, Homo sapiens
aaccaatcttaaacataataa

SEQ ID NO: 4724147 - DNA, 18 bp, Homo sapiens
aaccacagctgctggaga

SEQ ID NO: 4724148 - DNA, 18 bp, Homo sapiens
aaccacatcttgctctgc

SEQ ID NO: 4724149 - DNA, 22 bp, Homo sapiens
aaccactaatgcttgccaagaa

SEQ ID NO: 4724150 - DNA, 14 bp, Homo sapiens
aaccactttttgca

SEQ ID NO: 4724151 - DNA, 20 bp, Homo sapiens
aaccatctgtccctgcctca

SEQ ID NO: 4724152 - DNA, 17 bp, Homo sapiens
aaccatgtagaaaattt

SEQ ID NO: 4724153 - DNA, 22 bp, Homo sapiens
aacccaaattacgtgtactaca

SEQ ID NO: 4724154 - DNA, 14 bp, Homo sapiens
aacccagattttat

SEQ ID NO: 4724155 - DNA, 13 bp, Homo sapiens
aacccagctctgg

SEQ ID NO: 4724156 - DNA, 14 bp, Homo sapiens
aacccagctctggt

SEQ ID NO: 4724157 - DNA, 17 bp, Homo sapiens
aacccagctctggtcca

SEQ ID NO: 4724158 - DNA, 13 bp, Homo sapiens
aacccaggagcat

SEQ ID NO: 4724159 - DNA, 20 bp, Homo sapiens
aacccaggagcatccacctc

SEQ ID NO: 4724160 - DNA, 14 bp, Homo sapiens
aacccccagccccc

SEQ ID NO: 4724161 - DNA, 14 bp, Homo sapiens
aacccccagcctgc

SEQ ID NO: 4724162 - DNA, 15 bp, Homo sapiens
aaccctattggtaaa

SEQ ID NO: 4724163 - DNA, 11 bp, Homo sapiens
aaccctctgtg

SEQ ID NO: 4724164 - DNA, 13 bp, Homo sapiens
aaccctctgtgaa

SEQ ID NO: 4724165 - DNA, 23 bp, Homo sapiens
aaccgaacatatcatttgtgaag

SEQ ID NO: 4724166 - DNA, 17 bp, Homo sapiens
aacctcctttctcttct

SEQ ID NO: 4724167 - DNA, 16 bp, Homo sapiens
aacctcgggcctgctg

SEQ ID NO: 4724168 - DNA, 20 bp, Homo sapiens
aacctctaatttattttgtc

SEQ ID NO: 4724169 - DNA, 21 bp, Homo sapiens
aacctctaatttattttgtcg

SEQ ID NO: 4724170 - DNA, 11 bp, Homo sapiens
aacctgacccc

SEQ ID NO: 4724171 - DNA, 17 bp, Homo sapiens
aacctgatgaaaataaa

SEQ ID NO: 4724172 - DNA, 21 bp, Homo sapiens
aacctgatgaaaataaagaat

SEQ ID NO: 4724173 - DNA, 11 bp, Homo sapiens
aacctgcattt

SEQ ID NO: 4724174 - DNA, 15 bp, Homo sapiens
aacctgcatttttaa

SEQ ID NO: 4724175 - DNA, 19 bp, Homo sapiens
aacctggagagctagaacc

SEQ ID NO: 4724176 - DNA, 22 bp, Homo sapiens
aacctggagggctggaatctgg

SEQ ID NO: 4724177 - DNA, 22 bp, Homo sapiens
aacctgggagagacttggatga

SEQ ID NO: 4724178 - DNA, 13 bp, Homo sapiens
aacctgttctgct

SEQ ID NO: 4724179 - DNA, 17 bp, Homo sapiens
aacctgttctgctttcc

SEQ ID NO: 4724180 - DNA, 13 bp, Homo sapiens
aaccttaagatac

SEQ ID NO: 4724181 - DNA, 21 bp, Homo sapiens
aaccttcgccacctgggttcc

SEQ ID NO: 4724182 - DNA, 17 bp, Homo sapiens
aaccttgaaaaaaaaca

SEQ ID NO: 4724183 - DNA, 20 bp, Homo sapiens
aaccttgaaaaaaaacagtg

SEQ ID NO: 4724184 - DNA, 21 bp, Homo sapiens
aaccttgctatcaagaaatgc

SEQ ID NO: 4724185 - DNA, 17 bp, Homo sapiens
aaccttgtttctttctg

SEQ ID NO: 4724186 - DNA, 14 bp, Homo sapiens
aacctttcccattt

SEQ ID NO: 4724187 - DNA, 15 bp, Homo sapiens
aaccttttttaagat

SEQ ID NO: 4724188 - DNA, 18 bp, Homo sapiens
aaccttttttaagatttt

SEQ ID NO: 4724189 - DNA, 18 bp, Homo sapiens
aacggggctcttctcatt

SEQ ID NO: 4724190 - DNA, 19 bp, Homo sapiens
aacgtacctcttaaaattc

SEQ ID NO: 4724191 - DNA, 19 bp, Homo sapiens
aacgtatggaatgcttctt

SEQ ID NO: 4724192 - DNA, 14 bp, Homo sapiens
aacgtttctcatta

SEQ ID NO: 4724193 - DNA, 18 bp, Homo sapiens
aacgtttctcattaaaat

SEQ ID NO: 4724194 - DNA, 23 bp, Homo sapiens
aacgttttctgtttggaggagca

SEQ ID NO: 4724195 - DNA, 22 bp, Homo sapiens
aactaaaatcattgtcaaaatt

SEQ ID NO: 4724196 - DNA, 21 bp, Homo sapiens
aactaaatgtgcaatagaagg

SEQ ID NO: 4724197 - DNA, 16 bp, Homo sapiens
aactaccagtgggcat

SEQ ID NO: 4724198 - DNA, 20 bp, Homo sapiens
aactaccagtgggcatgtat

SEQ ID NO: 4724199 - DNA, 23 bp, Homo sapiens
aactagactcccaagctggacta

SEQ ID NO: 4724200 - DNA, 16 bp, Homo sapiens
aactagagcagccctg

SEQ ID NO: 4724201 - DNA, 22 bp, Homo sapiens
aactagggctagtcttccctta

SEQ ID NO: 4724202 - DNA, 17 bp, Homo sapiens
aactagttaaaagcctt

SEQ ID NO: 4724203 - DNA, 18 bp, Homo sapiens
aactatgacagatatatt

SEQ ID NO: 4724204 - DNA, 16 bp, Homo sapiens
aactatgatttggaaa

SEQ ID NO: 4724205 - DNA, 21 bp, Homo sapiens
aactattgtgctcagagacac

SEQ ID NO: 4724206 - DNA, 22 bp, Homo sapiens
aactattgtgctcagagacact

SEQ ID NO: 4724207 - DNA, 16 bp, Homo sapiens
aactcaccccagcccc

SEQ ID NO: 4724208 - DNA, 17 bp, Homo sapiens
aactcaccccagcccca

SEQ ID NO: 4724209 - DNA, 17 bp, Homo sapiens
aactcaggcaaagaaaa

SEQ ID NO: 4724210 - DNA, 18 bp, Homo sapiens
aactcaggcaaagaaaat

SEQ ID NO: 4724211 - DNA, 21 bp, Homo sapiens
aactcatccctaatgctgcag

SEQ ID NO: 4724212 - DNA, 22 bp, Homo sapiens
aactcatccctaatgctgcaga

SEQ ID NO: 4724213 - DNA, 23 bp, Homo sapiens
aactccatgggattttatctgtg

SEQ ID NO: 4724214 - DNA, 13 bp, Homo sapiens
aactccctgcccc

SEQ ID NO: 4724215 - DNA, 19 bp, Homo sapiens
aactccctgccccccagcc

SEQ ID NO: 4724216 - DNA, 15 bp, Homo sapiens
aactcctactgcttc

SEQ ID NO: 4724217 - DNA, 19 bp, Homo sapiens
aactcgccctgtttggcat

SEQ ID NO: 4724218 - DNA, 21 bp, Homo sapiens
aactctcctctgctgctggct

SEQ ID NO: 4724219 - DNA, 23 bp, Homo sapiens
aactctcctctgctgctggctgg

SEQ ID NO: 4724220 - DNA, 11 bp, Homo sapiens
aactctgaaga

SEQ ID NO: 4724221 - DNA, 16 bp, Homo sapiens
aactctggattttgaa

SEQ ID NO: 4724222 - DNA, 13 bp, Homo sapiens
aactcttatctca

SEQ ID NO: 4724223 - DNA, 12 bp, Homo sapiens
aactctttcaaa

SEQ ID NO: 4724224 - DNA, 16 bp, Homo sapiens
aactgccccctctgcc

SEQ ID NO: 4724225 - DNA, 16 bp, Homo sapiens
aactgccgtaatttaa

SEQ ID NO: 4724226 - DNA, 18 bp, Homo sapiens
aactgccgtaatttaact

SEQ ID NO: 4724227 - DNA, 21 bp, Homo sapiens
aactgctccaaatttaaccat

SEQ ID NO: 4724228 - DNA, 20 bp, Homo sapiens
aactgtgaatgcttctgatt

SEQ ID NO: 4724229 - DNA, 23 bp, Homo sapiens
aaaattttctagaaatacacttt

SEQ ID NO: 4724230 - DNA, 12 bp, Homo sapiens
aaacaaaagcac

SEQ ID NO: 4724231 - DNA, 16 bp, Homo sapiens
aaacaacaatttctac

SEQ ID NO: 4724232 - DNA, 17 bp, Homo sapiens
aaacaagaaccatttgc

SEQ ID NO: 4724233 - DNA, 23 bp, Homo sapiens
aaacaatatgaggagacattctg

SEQ ID NO: 4724234 - DNA, 20 bp, Homo sapiens
aaacaatttaaattgttata

SEQ ID NO: 4724235 - DNA, 19 bp, Homo sapiens
aaacactgttctctgccct

SEQ ID NO: 4724236 - DNA, 22 bp, Homo sapiens
aaacactgttctctgccctcca

SEQ ID NO: 4724237 - DNA, 12 bp, Homo sapiens
aaacagatattg

SEQ ID NO: 4724238 - DNA, 17 bp, Homo sapiens
aaacaggcactgccctg

SEQ ID NO: 4724239 - DNA, 21 bp, Homo sapiens
aaacatcattggataaatttg

SEQ ID NO: 4724240 - DNA, 14 bp, Homo sapiens
aaacatcctgactt

SEQ ID NO: 4724241 - DNA, 20 bp, Homo sapiens
aaacatggaaaacagagtat

SEQ ID NO: 4724242 - DNA, 23 bp, Homo sapiens
aaacatgtgcaactcttgtattg

SEQ ID NO: 4724243 - DNA, 15 bp, Homo sapiens
aaacattgatgaatg

SEQ ID NO: 4724244 - DNA, 16 bp, Homo sapiens
aaacattgatgaatga

SEQ ID NO: 4724245 - DNA, 12 bp, Homo sapiens
aaacattttatt

SEQ ID NO: 4724246 - DNA, 14 bp, Homo sapiens
aaacattttcatgc

SEQ ID NO: 4724247 - DNA, 18 bp, Homo sapiens
aaacattttcatgcacag

SEQ ID NO: 4724248 - DNA, 16 bp, Homo sapiens
aaaccaagcctctgga

SEQ ID NO: 4724249 - DNA, 13 bp, Homo sapiens
aaaccctctgtga

SEQ ID NO: 4724250 - DNA, 19 bp, Homo sapiens
aaacctctaacccaggtct

SEQ ID NO: 4724251 - DNA, 19 bp, Homo sapiens
aaacctctaatttattttg

SEQ ID NO: 4724252 - DNA, 24 bp, Homo sapiens
aaacctctaatttattttgtcgaa

SEQ ID NO: 4724253 - DNA, 17 bp, Homo sapiens
aaaccttcacttaggaa

SEQ ID NO: 4724254 - DNA, 12 bp, Homo sapiens
aaaccttgtttc

SEQ ID NO: 4724255 - DNA, 14 bp, Homo sapiens
aaaccttgtttctt

SEQ ID NO: 4724256 - DNA, 13 bp, Homo sapiens
aaaccttttgaaa

SEQ ID NO: 4724257 - DNA, 20 bp, Homo sapiens
aaaccttttttaagattttt

SEQ ID NO: 4724258 - DNA, 11 bp, Homo sapiens
aaactaaaatc

SEQ ID NO: 4724259 - DNA, 13 bp, Homo sapiens
aaactaaaatcat

SEQ ID NO: 4724260 - DNA, 21 bp, Homo sapiens
aaactaaggaaccctggaaac

SEQ ID NO: 4724261 - DNA, 19 bp, Homo sapiens
aaactaccagtgggcatgt

SEQ ID NO: 4724262 - DNA, 21 bp, Homo sapiens
aaactaccagtgggcatgtat

SEQ ID NO: 4724263 - DNA, 13 bp, Homo sapiens
aaactcagaatat

SEQ ID NO: 4724264 - DNA, 18 bp, Homo sapiens
aaactctcctctgctgct

SEQ ID NO: 4724265 - DNA, 16 bp, Homo sapiens
aaactcttatctcagt

SEQ ID NO: 4724266 - DNA, 17 bp, Homo sapiens
aaactcttgacctcagg

SEQ ID NO: 4724267 - DNA, 13 bp, Homo sapiens
aaactgccccctc

SEQ ID NO: 4724268 - DNA, 19 bp, Homo sapiens
aaactgccccctctgccct

SEQ ID NO: 4724269 - DNA, 16 bp, Homo sapiens
aaactggtattttatc

SEQ ID NO: 4724270 - DNA, 19 bp, Homo sapiens
aaactgttaatagttcagg

SEQ ID NO: 4724271 - DNA, 20 bp, Homo sapiens
aaacttgtaatttttttaat

SEQ ID NO: 4724272 - DNA, 13 bp, Homo sapiens
aaagaaaaatcaa

SEQ ID NO: 4724273 - DNA, 10 bp, Homo sapiens
aaagaaatat

SEQ ID NO: 4724274 - DNA, 22 bp, Homo sapiens
aaagaagagcgagagatcaaag

SEQ ID NO: 4724275 - DNA, 16 bp, Homo sapiens
aaagacaaatcaaagc

SEQ ID NO: 4724276 - DNA, 14 bp, Homo sapiens
aaagacagagctgg

SEQ ID NO: 4724277 - DNA, 16 bp, Homo sapiens
aaagaccaaattttga

SEQ ID NO: 4724278 - DNA, 10 bp, Homo sapiens
aaagactcat

SEQ ID NO: 4724279 - DNA, 15 bp, Homo sapiens
aaagactcatccgtc

SEQ ID NO: 4724280 - DNA, 13 bp, Homo sapiens
aaagactgttatt

SEQ ID NO: 4724281 - DNA, 18 bp, Homo sapiens
aaagagagaaaaacaaat

SEQ ID NO: 4724282 - DNA, 14 bp, Homo sapiens
aaagagatacagag

SEQ ID NO: 4724283 - DNA, 14 bp, Homo sapiens
aaagagtaggaaga

SEQ ID NO: 4724284 - DNA, 16 bp, Homo sapiens
aaagataataaattga

SEQ ID NO: 4724285 - DNA, 21 bp, Homo sapiens
aaagatacagaactctttcaa

SEQ ID NO: 4724286 - DNA, 17 bp, Homo sapiens
aaagcaaaaagatgtat

SEQ ID NO: 4724287 - DNA, 22 bp, Homo sapiens
aaagcaactgatcatatttgtg

SEQ ID NO: 4724288 - DNA, 22 bp, Homo sapiens
aaagcagcgctagtggagggtt

SEQ ID NO: 4724289 - DNA, 21 bp, Homo sapiens
aaagcaggcttgtgctttata

SEQ ID NO: 4724290 - DNA, 16 bp, Homo sapiens
aaagcatcacttggga

SEQ ID NO: 4724291 - DNA, 21 bp, Homo sapiens
aaagccagcgtcctcctctgt

SEQ ID NO: 4724292 - DNA, 17 bp, Homo sapiens
aaagcccattcattcca

SEQ ID NO: 4724293 - DNA, 24 bp, Homo sapiens
aaagcctctgtgtcactggctgcc

SEQ ID NO: 4724294 - DNA, 12 bp, Homo sapiens
aaagcctgctca

SEQ ID NO: 4724295 - DNA, 13 bp, Homo sapiens
aaagcctgctcaa

SEQ ID NO: 4724296 - DNA, 20 bp, Homo sapiens
aaagctattagccaggatca

SEQ ID NO: 4724297 - DNA, 15 bp, Homo sapiens
aaagctgtgtctctg

SEQ ID NO: 4724298 - DNA, 17 bp, Homo sapiens
aaagcttcagtgctgcc

SEQ ID NO: 4724299 - DNA, 20 bp, Homo sapiens
aaagcttcagtgctgccgat

SEQ ID NO: 4724300 - DNA, 15 bp, Homo sapiens
aatttctactttgaa

SEQ ID NO: 4724301 - DNA, 11 bp, Homo sapiens
aatttctcccc

SEQ ID NO: 4724302 - DNA, 21 bp, Homo sapiens
aatttgatagtattgtgcata

SEQ ID NO: 4724303 - DNA, 15 bp, Homo sapiens
aatttgccctcccat

SEQ ID NO: 4724304 - DNA, 22 bp, Homo sapiens
aatttgctgaaaacattacatg

SEQ ID NO: 4724305 - DNA, 12 bp, Homo sapiens
aatttggattta

SEQ ID NO: 4724306 - DNA, 17 bp, Homo sapiens
aatttgggatactaaag

SEQ ID NO: 4724307 - DNA, 18 bp, Homo sapiens
aatttgtaagtttcaggt

SEQ ID NO: 4724308 - DNA, 19 bp, Homo sapiens
aatttgtaagtttcaggtg

SEQ ID NO: 4724309 - DNA, 23 bp, Homo sapiens
aatttgtaagtttcaggtgacat

SEQ ID NO: 4724310 - DNA, 18 bp, Homo sapiens
aatttgtatgctaaatga

SEQ ID NO: 4724311 - DNA, 15 bp, Homo sapiens
aatttgtccattgta

SEQ ID NO: 4724312 - DNA, 18 bp, Homo sapiens
aatttgtccattgtaaat

SEQ ID NO: 4724313 - DNA, 17 bp, Homo sapiens
aatttgttttggatata

SEQ ID NO: 4724314 - DNA, 19 bp, Homo sapiens
aattttaaagtaatttcta

SEQ ID NO: 4724315 - DNA, 23 bp, Homo sapiens
aattttacaagggcataaagtaa

SEQ ID NO: 4724316 - DNA, 21 bp, Homo sapiens
aattttcacttttggcaatga

SEQ ID NO: 4724317 - DNA, 19 bp, Homo sapiens
aattttcctaataaagttc

SEQ ID NO: 4724318 - DNA, 15 bp, Homo sapiens
aattttgaggtcttt

SEQ ID NO: 4724319 - DNA, 11 bp, Homo sapiens
aattttgtcac

SEQ ID NO: 4724320 - DNA, 13 bp, Homo sapiens
aattttgtgatga

SEQ ID NO: 4724321 - DNA, 14 bp, Homo sapiens
acagtctcaatttt

SEQ ID NO: 4724322 - DNA, 20 bp, Homo sapiens
acagtctcaattttgtattt

SEQ ID NO: 4724323 - DNA, 21 bp, Homo sapiens
acagtctcaattttgtattta

SEQ ID NO: 4724324 - DNA, 20 bp, Homo sapiens
acagtctttgatcatcatgt

SEQ ID NO: 4724325 - DNA, 16 bp, Homo sapiens
acagtgaatttaagca

SEQ ID NO: 4724326 - DNA, 19 bp, Homo sapiens
acagtgactcgggctcctg

SEQ ID NO: 4724327 - DNA, 22 bp, Homo sapiens
acagtgagtcgaggacagggag

SEQ ID NO: 4724328 - DNA, 20 bp, Homo sapiens
acagtgctgaccagacagcc

SEQ ID NO: 4724329 - DNA, 18 bp, Homo sapiens
acagtggaaccagcccag

SEQ ID NO: 4724330 - DNA, 19 bp, Homo sapiens
acagtgtctgggctgactg

SEQ ID NO: 4724331 - DNA, 21 bp, Homo sapiens
acagtgttaggcctggcacag

SEQ ID NO: 4724332 - DNA, 16 bp, Homo sapiens
acagttcataaatttg

SEQ ID NO: 4724333 - DNA, 22 bp, Homo sapiens
acagttcataaatttgttgtca

SEQ ID NO: 4724334 - DNA, 22 bp, Homo sapiens
acagttccctttatttcacata

SEQ ID NO: 4724335 - DNA, 15 bp, Homo sapiens
acagttccttgcatg

SEQ ID NO: 4724336 - DNA, 21 bp, Homo sapiens
acagttgccacatttagtcct

SEQ ID NO: 4724337 - DNA, 12 bp, Homo sapiens
acagtttcttag

SEQ ID NO: 4724338 - DNA, 18 bp, Homo sapiens
acagtttcttagcttttt

SEQ ID NO: 4724339 - DNA, 19 bp, Homo sapiens
acagttttaactgtggata

SEQ ID NO: 4724340 - DNA, 15 bp, Homo sapiens
acataaaagaaataa

SEQ ID NO: 4724341 - DNA, 14 bp, Homo sapiens
acataaaattttct

SEQ ID NO: 4724342 - DNA, 20 bp, Homo sapiens
acataacaacctttcccatt

SEQ ID NO: 4724343 - DNA, 21 bp, Homo sapiens
acataacaacctttcccattt

SEQ ID NO: 4724344 - DNA, 22 bp, Homo sapiens
acataacaccaaacttcatttt

SEQ ID NO: 4724345 - DNA, 14 bp, Homo sapiens
acataacgtttttc

SEQ ID NO: 4724346 - DNA, 18 bp, Homo sapiens
acataagtccattaactg

SEQ ID NO: 4724347 - DNA, 13 bp, Homo sapiens
acatacacacacg

SEQ ID NO: 4724348 - DNA, 14 bp, Homo sapiens
acatacagacacat

SEQ ID NO: 4724349 - DNA, 12 bp, Homo sapiens
acatacagtgat

SEQ ID NO: 4724350 - DNA, 16 bp, Homo sapiens
acatagcccaagaaca

SEQ ID NO: 4724351 - DNA, 16 bp, Homo sapiens
acatatcatttgtgaa

SEQ ID NO: 4724352 - DNA, 17 bp, Homo sapiens
acatatcatttgtgaag

SEQ ID NO: 4724353 - DNA, 18 bp, Homo sapiens
acatatcatttgtgaaga

SEQ ID NO: 4724354 - DNA, 22 bp, Homo sapiens
acatattaagaatagtctctgg

SEQ ID NO: 4724355 - DNA, 17 bp, Homo sapiens
acatattatgcctgaat

SEQ ID NO: 4724356 - DNA, 19 bp, Homo sapiens
acatcatcaaggcactgcc

SEQ ID NO: 4724357 - DNA, 19 bp, Homo sapiens
acatcattggataaatttg

SEQ ID NO: 4724358 - DNA, 21 bp, Homo sapiens
acatctaaattgatcattcat

SEQ ID NO: 4724359 - DNA, 17 bp, Homo sapiens
acatctaacctcatctt

SEQ ID NO: 4724360 - DNA, 15 bp, Homo sapiens
acatctgaatctcct

SEQ ID NO: 4724361 - DNA, 20 bp, Homo sapiens
acatctgaatctccttgttg

SEQ ID NO: 4724362 - DNA, 24 bp, Homo sapiens
acatctgaatctccttgttgttct

SEQ ID NO: 4724363 - DNA, 21 bp, Homo sapiens
acatctgtgatgactggttgt

SEQ ID NO: 4724364 - DNA, 16 bp, Homo sapiens
acatctgtgtcttgtt

SEQ ID NO: 4724365 - DNA, 13 bp, Homo sapiens
acatctgttttgt

SEQ ID NO: 4724366 - DNA, 14 bp, Homo sapiens
acatcttgctctgc

SEQ ID NO: 4724367 - DNA, 18 bp, Homo sapiens
acatcttgctctgctgac

SEQ ID NO: 4724368 - DNA, 24 bp, Homo sapiens
acatcttggcacatttaagagaca

SEQ ID NO: 4724369 - DNA, 15 bp, Homo sapiens
acatctttactcagg

SEQ ID NO: 4724370 - DNA, 24 bp, Homo sapiens
acatcttttcttgcctctgtcccc

SEQ ID NO: 4724371 - DNA, 18 bp, Homo sapiens
acatgaagattctttccc

SEQ ID NO: 4724372 - DNA, 21 bp, Homo sapiens
acatgaccctaaatcttgact

SEQ ID NO: 4724373 - DNA, 19 bp, Homo sapiens
acatgagcatcaggccagg

SEQ ID NO: 4724374 - DNA, 23 bp, Homo sapiens
acatgagcatcaggccaggccct

SEQ ID NO: 4724375 - DNA, 15 bp, Homo sapiens
acatgagttattcat

SEQ ID NO: 4724376 - DNA, 19 bp, Homo sapiens
acatgagttattcataaag

SEQ ID NO: 4724377 - DNA, 16 bp, Homo sapiens
acatgcagctctgcag

SEQ ID NO: 4724378 - DNA, 21 bp, Homo sapiens
acatgcagtagcactttggta

SEQ ID NO: 4724379 - DNA, 16 bp, Homo sapiens
acatgcatataatgaa

SEQ ID NO: 4724380 - DNA, 14 bp, Homo sapiens
acatgccaagcact

SEQ ID NO: 4724381 - DNA, 14 bp, Homo sapiens
acatgccagggaaa

SEQ ID NO: 4724382 - DNA, 17 bp, Homo sapiens
acatgcggagaacaaat

SEQ ID NO: 4724383 - DNA, 17 bp, Homo sapiens
acatgctgaagccaaag

SEQ ID NO: 4724384 - DNA, 16 bp, Homo sapiens
acatgcttttcttcct

SEQ ID NO: 4724385 - DNA, 16 bp, Homo sapiens
acatggaaaacagagt

SEQ ID NO: 4724386 - DNA, 20 bp, Homo sapiens
acatggattccaaagcattt

SEQ ID NO: 4724387 - DNA, 11 bp, Homo sapiens
acatggggagg

SEQ ID NO: 4724388 - DNA, 17 bp, Homo sapiens
acatggtctgtcaatga

SEQ ID NO: 4724389 - DNA, 19 bp, Homo sapiens
acatgtataatatttttaa

SEQ ID NO: 4724390 - DNA, 15 bp, Homo sapiens
acatgtatgtggata

SEQ ID NO: 4724391 - DNA, 19 bp, Homo sapiens
acatgtccaagaagcccag

SEQ ID NO: 4724392 - DNA, 16 bp, Homo sapiens
acatgtgcacatgcac

SEQ ID NO: 4724393 - DNA, 11 bp, Homo sapiens
acatgttcata

SEQ ID NO: 4724394 - DNA, 22 bp, Homo sapiens
acatgttctaatactttgttta

SEQ ID NO: 4724395 - DNA, 13 bp, Homo sapiens
acattaaagttaa

SEQ ID NO: 4724396 - DNA, 22 bp, Homo sapiens
acattacaaagttaaaattgtt

SEQ ID NO: 4724397 - DNA, 16 bp, Homo sapiens
acattagttttaaaaa

SEQ ID NO: 4724398 - DNA, 18 bp, Homo sapiens
acattcaacagagactga

SEQ ID NO: 4724399 - DNA, 19 bp, Homo sapiens
acattcaggaattcttgga

SEQ ID NO: 4724400 - DNA, 15 bp, Homo sapiens
acattcatgcctggc

SEQ ID NO: 4724401 - DNA, 17 bp, Homo sapiens
acattccttgcctgcac

SEQ ID NO: 4724402 - DNA, 14 bp, Homo sapiens
acattgatgaatga

SEQ ID NO: 4724403 - DNA, 21 bp, Homo sapiens
acattgcggacagccacggcc

SEQ ID NO: 4724404 - DNA, 17 bp, Homo sapiens
acatttaggagaagttg

SEQ ID NO: 4724405 - DNA, 14 bp, Homo sapiens
acatttagtcctgt

SEQ ID NO: 4724406 - DNA, 15 bp, Homo sapiens
acatttagtcctgta

SEQ ID NO: 4724407 - DNA, 15 bp, Homo sapiens
acatttatgatttaa

SEQ ID NO: 4724408 - DNA, 19 bp, Homo sapiens
acatttatgatttaataaa

SEQ ID NO: 4724409 - DNA, 22 bp, Homo sapiens
acatttatgatttaataaaata

SEQ ID NO: 4724410 - DNA, 11 bp, Homo sapiens
acatttatgtg

SEQ ID NO: 4724411 - DNA, 17 bp, Homo sapiens
acatttctcatgttgaa

SEQ ID NO: 4724412 - DNA, 17 bp, Homo sapiens
acattttaaaggataat

SEQ ID NO: 4724413 - DNA, 14 bp, Homo sapiens
acattttaatgggt

SEQ ID NO: 4724414 - DNA, 18 bp, Homo sapiens
acattttcatgcacagta

SEQ ID NO: 4724415 - DNA, 17 bp, Homo sapiens
acattttcatgcttcca

SEQ ID NO: 4724416 - DNA, 16 bp, Homo sapiens
acattttctcagtgtg

SEQ ID NO: 4724417 - DNA, 19 bp, Homo sapiens
accaataaatgtttgttat

SEQ ID NO: 4724418 - DNA, 16 bp, Homo sapiens
accaatattgtacagt

SEQ ID NO: 4724419 - DNA, 17 bp, Homo sapiens
accaatattgtacagtt

SEQ ID NO: 4724420 - DNA, 14 bp, Homo sapiens
accaatgaaaaaat

SEQ ID NO: 4724421 - DNA, 21 bp, Homo sapiens
accaattataacttattagca

SEQ ID NO: 4724422 - DNA, 20 bp, Homo sapiens
accacacccagcccacttct

SEQ ID NO: 4724423 - DNA, 10 bp, Homo sapiens
accacagcaa

SEQ ID NO: 4724424 - DNA, 14 bp, Homo sapiens
accacagctgctgg

SEQ ID NO: 4724425 - DNA, 16 bp, Homo sapiens
accacatcttgctctg

SEQ ID NO: 4724426 - DNA, 21 bp, Homo sapiens
accacatcttgctctgctgac

SEQ ID NO: 4724427 - DNA, 20 bp, Homo sapiens
accacatgccaagcactgtg

SEQ ID NO: 4724428 - DNA, 22 bp, Homo sapiens
accacatgccaagcactgtgct

SEQ ID NO: 4724429 - DNA, 15 bp, Homo sapiens
accaccacacccagc

SEQ ID NO: 4724430 - DNA, 19 bp, Homo sapiens
accacctaccttacagtga

SEQ ID NO: 4724431 - DNA, 16 bp, Homo sapiens
accacctgctcactgg

SEQ ID NO: 4724432 - DNA, 17 bp, Homo sapiens
accacctttgtctctgc

SEQ ID NO: 4724433 - DNA, 14 bp, Homo sapiens
accacgctggacct

SEQ ID NO: 4724434 - DNA, 16 bp, Homo sapiens
accacgctggaccttg

SEQ ID NO: 4724435 - DNA, 15 bp, Homo sapiens
accactgtcttcttc

SEQ ID NO: 4724436 - DNA, 19 bp, Homo sapiens
accactgtggaagtccctc

SEQ ID NO: 4724437 - DNA, 20 bp, Homo sapiens
accactgtggaagtccctca

SEQ ID NO: 4724438 - DNA, 21 bp, Homo sapiens
accactgtggaagtccctcag

SEQ ID NO: 4724439 - DNA, 17 bp, Homo sapiens
accactttttgcagctt

SEQ ID NO: 4724440 - DNA, 18 bp, Homo sapiens
accactttttgcagcttt

SEQ ID NO: 4724441 - DNA, 17 bp, Homo sapiens
accagacaccttgacag

SEQ ID NO: 4724442 - DNA, 21 bp, Homo sapiens
accagactacttgggagcacc

SEQ ID NO: 4724443 - DNA, 23 bp, Homo sapiens
accagactacttgggagcaccgc

SEQ ID NO: 4724444 - DNA, 12 bp, Homo sapiens
accagagcagat

SEQ ID NO: 4724445 - DNA, 22 bp, Homo sapiens
accagagcagatgcagagagcc

SEQ ID NO: 4724446 - DNA, 12 bp, Homo sapiens
accagagcccac

SEQ ID NO: 4724447 - DNA, 19 bp, Homo sapiens
accagagcccaccttggct

SEQ ID NO: 4724448 - DNA, 22 bp, Homo sapiens
accagagcccaccttggctcaa

SEQ ID NO: 4724449 - DNA, 13 bp, Homo sapiens
accagcagagcac

SEQ ID NO: 4724450 - DNA, 17 bp, Homo sapiens
accagccccagtgccca

SEQ ID NO: 4724451 - DNA, 18 bp, Homo sapiens
accagccccagtgcccac

SEQ ID NO: 4724452 - DNA, 17 bp, Homo sapiens
accagcctggccaacat

SEQ ID NO: 4724453 - DNA, 14 bp, Homo sapiens
accagcctggccca

SEQ ID NO: 4724454 - DNA, 23 bp, Homo sapiens
accagcgaggaggctccagaggg

SEQ ID NO: 4724455 - DNA, 21 bp, Homo sapiens
accagggttgaccccagagga

SEQ ID NO: 4724456 - DNA, 16 bp, Homo sapiens
accagtgggcatgtat

SEQ ID NO: 4724457 - DNA, 20 bp, Homo sapiens
accagtttaacctgatgcag

SEQ ID NO: 4724458 - DNA, 13 bp, Homo sapiens
accataaatcaat

SEQ ID NO: 4724459 - DNA, 22 bp, Homo sapiens
accataaatcaattcatgttta

SEQ ID NO: 4724460 - DNA, 15 bp, Homo sapiens
accataatccctgtc

SEQ ID NO: 4724461 - DNA, 15 bp, Homo sapiens
accatagctacatca

SEQ ID NO: 4724462 - DNA, 14 bp, Homo sapiens
accatcaagccacc

SEQ ID NO: 4724463 - DNA, 14 bp, Homo sapiens
accatcatgtctgg

SEQ ID NO: 4724464 - DNA, 18 bp, Homo sapiens
accattatgaagaagaga

SEQ ID NO: 4724465 - DNA, 19 bp, Homo sapiens
accattctccacctgccag

SEQ ID NO: 4724466 - DNA, 18 bp, Homo sapiens
accattgaattcttggtt

SEQ ID NO: 4724467 - DNA, 21 bp, Homo sapiens
accattttggggtacccactg

SEQ ID NO: 4724468 - DNA, 23 bp, Homo sapiens
accattttggggtacccactgct

SEQ ID NO: 4724469 - DNA, 21 bp, Homo sapiens
acccaaaagctcagccagccc

SEQ ID NO: 4724470 - DNA, 23 bp, Homo sapiens
acccaagggcctggcctgagctg

SEQ ID NO: 4724471 - DNA, 17 bp, Homo sapiens
acccacagcctccaagt

SEQ ID NO: 4724472 - DNA, 15 bp, Homo sapiens
acccacccccaccca

SEQ ID NO: 4724473 - DNA, 16 bp, Homo sapiens
acccacctcagcctcc

SEQ ID NO: 4724474 - DNA, 11 bp, Homo sapiens
acccactgctc

SEQ ID NO: 4724475 - DNA, 14 bp, Homo sapiens
acccactgctctgg

SEQ ID NO: 4724476 - DNA, 11 bp, Homo sapiens
acccactgctt

SEQ ID NO: 4724477 - DNA, 20 bp, Homo sapiens
acccactgcttttggtctgt

SEQ ID NO: 4724478 - DNA, 17 bp, Homo sapiens
acccactggactcacct

SEQ ID NO: 4724479 - DNA, 13 bp, Homo sapiens
acccacttctgca

SEQ ID NO: 4724480 - DNA, 14 bp, Homo sapiens
acccacttctgcac

SEQ ID NO: 4724481 - DNA, 22 bp, Homo sapiens
acccagatgggggaaagcacag

SEQ ID NO: 4724482 - DNA, 17 bp, Homo sapiens
acccagattttatttat

SEQ ID NO: 4724483 - DNA, 17 bp, Homo sapiens
acccagcccacttctgc

SEQ ID NO: 4724484 - DNA, 18 bp, Homo sapiens
acccagcccacttctgcc

SEQ ID NO: 4724485 - DNA, 18 bp, Homo sapiens
acccagccccaaggggtg

SEQ ID NO: 4724486 - DNA, 16 bp, Homo sapiens
acccagccctcatccc

SEQ ID NO: 4724487 - DNA, 13 bp, Homo sapiens
acccagccgctgc

SEQ ID NO: 4724488 - DNA, 17 bp, Homo sapiens
acccagcgagccctggt

SEQ ID NO: 4724489 - DNA, 19 bp, Homo sapiens
acccagcgagccctggtgg

SEQ ID NO: 4724490 - DNA, 15 bp, Homo sapiens
acccagctctggtcc

SEQ ID NO: 4724491 - DNA, 23 bp, Homo sapiens
acccaggagcatccacctccttc

SEQ ID NO: 4724492 - DNA, 23 bp, Homo sapiens
acccaggagccccgaggccttct

SEQ ID NO: 4724493 - DNA, 20 bp, Homo sapiens
acccaggctgggcaaggagg

SEQ ID NO: 4724494 - DNA, 19 bp, Homo sapiens
acccatgctgccctgtgag

SEQ ID NO: 4724495 - DNA, 14 bp, Homo sapiens
accccacccctcat

SEQ ID NO: 4724496 - DNA, 23 bp, Homo sapiens
acccccacagacctgctctggac

SEQ ID NO: 4724497 - DNA, 21 bp, Homo sapiens
acccccagcacccgggctcag

SEQ ID NO: 4724498 - DNA, 16 bp, Homo sapiens
accccccactctgtgc

SEQ ID NO: 4724499 - DNA, 14 bp, Homo sapiens
accccccagcactg

SEQ ID NO: 4724500 - DNA, 23 bp, Homo sapiens
acccccgcccaggctggccagcc

SEQ ID NO: 4724501 - DNA, 13 bp, Homo sapiens
accccctcctgct

SEQ ID NO: 4724502 - DNA, 14 bp, Homo sapiens
accccctgcaaagc

SEQ ID NO: 4724503 - DNA, 20 bp, Homo sapiens
accccctgcaaagcccagct

SEQ ID NO: 4724504 - DNA, 15 bp, Homo sapiens
accccggccacctgc

SEQ ID NO: 4724505 - DNA, 17 bp, Homo sapiens
acccctcatagccctca

SEQ ID NO: 4724506 - DNA, 16 bp, Homo sapiens
acccctccatgtgggc

SEQ ID NO: 4724507 - DNA, 13 bp, Homo sapiens
acccctcccagct

SEQ ID NO: 4724508 - DNA, 14 bp, Homo sapiens
acccctcccagctg

SEQ ID NO: 4724509 - DNA, 15 bp, Homo sapiens
acccctcccagctga

SEQ ID NO: 4724510 - DNA, 13 bp, Homo sapiens
acccctccctttc

SEQ ID NO: 4724511 - DNA, 18 bp, Homo sapiens
acccctccctttctcccc

SEQ ID NO: 4724512 - DNA, 23 bp, Homo sapiens
acccctccctttctcccctgccc

SEQ ID NO: 4724513 - DNA, 23 bp, Homo sapiens
acccctcctccctttttccttgt

SEQ ID NO: 4724514 - DNA, 15 bp, Homo sapiens
acccctgagcttgca

SEQ ID NO: 4724515 - DNA, 10 bp, Homo sapiens
acccctgcat

SEQ ID NO: 4724516 - DNA, 14 bp, Homo sapiens
aagataaaaatcag

SEQ ID NO: 4724517 - DNA, 20 bp, Homo sapiens
aagatactaaggacgttgtt

SEQ ID NO: 4724518 - DNA, 23 bp, Homo sapiens
aagatccaaatgctgtgcaaaca

SEQ ID NO: 4724519 - DNA, 18 bp, Homo sapiens
aagatccaattcatcttt

SEQ ID NO: 4724520 - DNA, 23 bp, Homo sapiens
aagatcctaccccaattccttgt

SEQ ID NO: 4724521 - DNA, 23 bp, Homo sapiens
aagatggcacttataaccaaagc

SEQ ID NO: 4724522 - DNA, 16 bp, Homo sapiens
aagattctttcccaat

SEQ ID NO: 4724523 - DNA, 17 bp, Homo sapiens
aagattgtaaaaataat

SEQ ID NO: 4724524 - DNA, 15 bp, Homo sapiens
aagatttttctcaaa

SEQ ID NO: 4724525 - DNA, 21 bp, Homo sapiens
aagatttttctcaaagttttg

SEQ ID NO: 4724526 - DNA, 18 bp, Homo sapiens
aagcaaaaagatgtatat

SEQ ID NO: 4724527 - DNA, 20 bp, Homo sapiens
aagcaaatcccaacatttct

SEQ ID NO: 4724528 - DNA, 16 bp, Homo sapiens
aagcaacaagctattt

SEQ ID NO: 4724529 - DNA, 15 bp, Homo sapiens
aagcaagatttcaga

SEQ ID NO: 4724530 - DNA, 19 bp, Homo sapiens
aagcaatatgcatttaaat

SEQ ID NO: 4724531 - DNA, 13 bp, Homo sapiens
aagcaatggttga

SEQ ID NO: 4724532 - DNA, 16 bp, Homo sapiens
aagcacatattgagca

SEQ ID NO: 4724533 - DNA, 16 bp, Homo sapiens
aagcacctcctgcctc

SEQ ID NO: 4724534 - DNA, 16 bp, Homo sapiens
aagcagagttctttgc

SEQ ID NO: 4724535 - DNA, 14 bp, Homo sapiens
aagcagattacctc

SEQ ID NO: 4724536 - DNA, 16 bp, Homo sapiens
aagcagattacctctt

SEQ ID NO: 4724537 - DNA, 21 bp, Homo sapiens
aagcagcgctagtggagggtt

SEQ ID NO: 4724538 - DNA, 16 bp, Homo sapiens
aagcaggctacactga

SEQ ID NO: 4724539 - DNA, 17 bp, Homo sapiens
aagcaggtttcttgctt

SEQ ID NO: 4724540 - DNA, 20 bp, Homo sapiens
aagcaggtttcttgcttctg

SEQ ID NO: 4724541 - DNA, 19 bp, Homo sapiens
aagcatttaatgtagccat

SEQ ID NO: 4724542 - DNA, 20 bp, Homo sapiens
aagcatttaatgtagccatg

SEQ ID NO: 4724543 - DNA, 21 bp, Homo sapiens
aagcattttcagcatcaaaca

SEQ ID NO: 4724544 - DNA, 13 bp, Homo sapiens
aagccaaagccaa

SEQ ID NO: 4724545 - DNA, 18 bp, Homo sapiens
aagccaataacacacagc

SEQ ID NO: 4724546 - DNA, 20 bp, Homo sapiens
aagccaataacacacagcta

SEQ ID NO: 4724547 - DNA, 16 bp, Homo sapiens
attaatttgtgaattt

SEQ ID NO: 4724548 - DNA, 17 bp, Homo sapiens
attaatttgtgaatttg

SEQ ID NO: 4724549 - DNA, 19 bp, Homo sapiens
attaatttgtgaatttgca

SEQ ID NO: 4724550 - DNA, 23 bp, Homo sapiens
attaatttttgtactttgcttct

SEQ ID NO: 4724551 - DNA, 22 bp, Homo sapiens
attacaagcgtgagccactgca

SEQ ID NO: 4724552 - DNA, 15 bp, Homo sapiens
attacaggctcctgc

SEQ ID NO: 4724553 - DNA, 17 bp, Homo sapiens
attacaggctcctgcca

SEQ ID NO: 4724554 - DNA, 15 bp, Homo sapiens
attacatttttgcag

SEQ ID NO: 4724555 - DNA, 20 bp, Homo sapiens
attaccaagcgcttctttct

SEQ ID NO: 4724556 - DNA, 17 bp, Homo sapiens
attaccaccacctgctc

SEQ ID NO: 4724557 - DNA, 14 bp, Homo sapiens
attacctgtggata

SEQ ID NO: 4724558 - DNA, 15 bp, Homo sapiens
attacctgtggatat

SEQ ID NO: 4724559 - DNA, 13 bp, Homo sapiens
attaccttactgt

SEQ ID NO: 4724560 - DNA, 11 bp, Homo sapiens
attactccaag

SEQ ID NO: 4724561 - DNA, 15 bp, Homo sapiens
attactccaaggttt

SEQ ID NO: 4724562 - DNA, 18 bp, Homo sapiens
attactccaaggtttata

SEQ ID NO: 4724563 - DNA, 20 bp, Homo sapiens
attactgtttgtcttctccc

SEQ ID NO: 4724564 - DNA, 22 bp, Homo sapiens
attactgtttgtcttctcccca

SEQ ID NO: 4724565 - DNA, 13 bp, Homo sapiens
attacttctgcta

SEQ ID NO: 4724566 - DNA, 21 bp, Homo sapiens
attacttgcctatctgacttc

SEQ ID NO: 4724567 - DNA, 23 bp, Homo sapiens
attactttggggctaatttaaca

SEQ ID NO: 4724568 - DNA, 21 bp, Homo sapiens
attagaaaaatagcaacttgt

SEQ ID NO: 4724569 - DNA, 13 bp, Homo sapiens
attagaaatcaac

SEQ ID NO: 4724570 - DNA, 17 bp, Homo sapiens
attagagtgtctttcca

SEQ ID NO: 4724571 - DNA, 21 bp, Homo sapiens
attagatggaaaaatgtgaaa

SEQ ID NO: 4724572 - DNA, 19 bp, Homo sapiens
attagattatttctgtatt

SEQ ID NO: 4724573 - DNA, 16 bp, Homo sapiens
attagcagttgctcac

SEQ ID NO: 4724574 - DNA, 15 bp, Homo sapiens
attagccaggatcat

SEQ ID NO: 4724575 - DNA, 14 bp, Homo sapiens
attagccagtcatt

SEQ ID NO: 4724576 - DNA, 20 bp, Homo sapiens
attagctggttggagagcta

SEQ ID NO: 4724577 - DNA, 20 bp, Homo sapiens
attagtaaatatgtgaagaa

SEQ ID NO: 4724578 - DNA, 13 bp, Homo sapiens
attagtaacatgt

SEQ ID NO: 4724579 - DNA, 16 bp, Homo sapiens
attagtaacatgtgtt

SEQ ID NO: 4724580 - DNA, 17 bp, Homo sapiens
attagtgtagtgttaaa

SEQ ID NO: 4724581 - DNA, 21 bp, Homo sapiens
attagttttgaagattctatg

SEQ ID NO: 4724582 - DNA, 13 bp, Homo sapiens
attataaaatatt

SEQ ID NO: 4724583 - DNA, 19 bp, Homo sapiens
atgccatggacagaagaag

SEQ ID NO: 4724584 - DNA, 13 bp, Homo sapiens
atgcccagcccct

SEQ ID NO: 4724585 - DNA, 15 bp, Homo sapiens
atgcctaccttgtga

SEQ ID NO: 4724586 - DNA, 16 bp, Homo sapiens
atgcctatggtggatc

SEQ ID NO: 4724587 - DNA, 19 bp, Homo sapiens
atgcctatggtggatccaa

SEQ ID NO: 4724588 - DNA, 16 bp, Homo sapiens
atgcctgagtgcctgg

SEQ ID NO: 4724589 - DNA, 19 bp, Homo sapiens
atgcctgagtgcctggcca

SEQ ID NO: 4724590 - DNA, 20 bp, Homo sapiens
atgcctgagtgcctggccaa

SEQ ID NO: 4724591 - DNA, 21 bp, Homo sapiens
atgcctgattgccaagctcag

SEQ ID NO: 4724592 - DNA, 20 bp, Homo sapiens
atgcctggatggggctgcac

SEQ ID NO: 4724593 - DNA, 13 bp, Homo sapiens
atgcctggtggca

SEQ ID NO: 4724594 - DNA, 15 bp, Homo sapiens
atgcctggtggcagc

SEQ ID NO: 4724595 - DNA, 16 bp, Homo sapiens
atgcctggtggcagct

SEQ ID NO: 4724596 - DNA, 17 bp, Homo sapiens
atgcctggtggcagctg

SEQ ID NO: 4724597 - DNA, 16 bp, Homo sapiens
atgcctgtaaagtctg

SEQ ID NO: 4724598 - DNA, 14 bp, Homo sapiens
atgcctttgagaca

SEQ ID NO: 4724599 - DNA, 20 bp, Homo sapiens
atgcctttgagacagtttct

SEQ ID NO: 4724600 - DNA, 16 bp, Homo sapiens
atgcctttttgtttac

SEQ ID NO: 4724601 - DNA, 12 bp, Homo sapiens
atgcgtgtgtgt

SEQ ID NO: 4724602 - DNA, 16 bp, Homo sapiens
atgctaagactcagtg

SEQ ID NO: 4724603 - DNA, 16 bp, Homo sapiens
atgctccttgggccct

SEQ ID NO: 4724604 - DNA, 19 bp, Homo sapiens
atgctctccaaaccacttt

SEQ ID NO: 4724605 - DNA, 11 bp, Homo sapiens
atgctgccctg

SEQ ID NO: 4724606 - DNA, 13 bp, Homo sapiens
atgctgccctgtg

SEQ ID NO: 4724607 - DNA, 14 bp, Homo sapiens
atgctgccctgtga

SEQ ID NO: 4724608 - DNA, 15 bp, Homo sapiens
atgctgccctgtgag

SEQ ID NO: 4724609 - DNA, 19 bp, Homo sapiens
atgctggctgttggctggg

SEQ ID NO: 4724610 - DNA, 14 bp, Homo sapiens
atgctgggctgggt

SEQ ID NO: 4724611 - DNA, 13 bp, Homo sapiens
atgctggtttttc

SEQ ID NO: 4724612 - DNA, 12 bp, Homo sapiens
atgctgtgaata

SEQ ID NO: 4724613 - DNA, 12 bp, Homo sapiens
atgctgtgcaaa

SEQ ID NO: 4724614 - DNA, 17 bp, Homo sapiens
atgctgtgcaaacagtg

SEQ ID NO: 4724615 - DNA, 18 bp, Homo sapiens
atgcttatgcttgtgtat

SEQ ID NO: 4724616 - DNA, 19 bp, Homo sapiens
atgcttccattaacaaatg

SEQ ID NO: 4724617 - DNA, 13 bp, Homo sapiens
atgcttctgattt

SEQ ID NO: 4724618 - DNA, 20 bp, Homo sapiens
agggcacattccttgcctgc

SEQ ID NO: 4724619 - DNA, 21 bp, Homo sapiens
agggcacattccttgcctgca

SEQ ID NO: 4724620 - DNA, 13 bp, Homo sapiens
agggcagccaggg

SEQ ID NO: 4724621 - DNA, 21 bp, Homo sapiens
agggcagccagggagagccca

SEQ ID NO: 4724622 - DNA, 16 bp, Homo sapiens
agggcatgggtcggga

SEQ ID NO: 4724623 - DNA, 20 bp, Homo sapiens
agggcatgggtcgggagagg

SEQ ID NO: 4724624 - DNA, 12 bp, Homo sapiens
agggcccagaga

SEQ ID NO: 4724625 - DNA, 18 bp, Homo sapiens
agggcccagagagggtgg

SEQ ID NO: 4724626 - DNA, 14 bp, Homo sapiens
agggcctgcaaggg

SEQ ID NO: 4724627 - DNA, 14 bp, Homo sapiens
agggcctggcctga

SEQ ID NO: 4724628 - DNA, 15 bp, Homo sapiens
agggcctggcctgag

SEQ ID NO: 4724629 - DNA, 13 bp, Homo sapiens
agggcctggctca

SEQ ID NO: 4724630 - DNA, 19 bp, Homo sapiens
agggcgggaggatgttctg

SEQ ID NO: 4724631 - DNA, 13 bp, Homo sapiens
agggctaattaga

SEQ ID NO: 4724632 - DNA, 19 bp, Homo sapiens
agggctacaaaggaggaca

SEQ ID NO: 4724633 - DNA, 21 bp, Homo sapiens
agggctaccctgagctgaggc

SEQ ID NO: 4724634 - DNA, 22 bp, Homo sapiens
agggctaccctgagctgaggca

SEQ ID NO: 4724635 - DNA, 23 bp, Homo sapiens
agggctaccctgagctgaggcag

SEQ ID NO: 4724636 - DNA, 17 bp, Homo sapiens
agggctagaacctagaa

SEQ ID NO: 4724637 - DNA, 19 bp, Homo sapiens
agggctagaacctggaagg

SEQ ID NO: 4724638 - DNA, 18 bp, Homo sapiens
agggctagaacctggaga

SEQ ID NO: 4724639 - DNA, 19 bp, Homo sapiens
agggctagaacctggagag

SEQ ID NO: 4724640 - DNA, 22 bp, Homo sapiens
agggctagaacctggagggctg

SEQ ID NO: 4724641 - DNA, 22 bp, Homo sapiens
agggctagaacctgtagagcta

SEQ ID NO: 4724642 - DNA, 18 bp, Homo sapiens
agggctagaactggagag

SEQ ID NO: 4724643 - DNA, 23 bp, Homo sapiens
agggctagtcttcccttacctca

SEQ ID NO: 4724644 - DNA, 17 bp, Homo sapiens
agggctcagagaggaca

SEQ ID NO: 4724645 - DNA, 20 bp, Homo sapiens
agggctccagacacatgtcc

SEQ ID NO: 4724646 - DNA, 14 bp, Homo sapiens
agggctctgaccag

SEQ ID NO: 4724647 - DNA, 14 bp, Homo sapiens
agggctggactgag

SEQ ID NO: 4724648 - DNA, 19 bp, Homo sapiens
aggggaatgtttgcctctg

SEQ ID NO: 4724649 - DNA, 21 bp, Homo sapiens
aggggatagagagagaccact

SEQ ID NO: 4724650 - DNA, 17 bp, Homo sapiens
aggggcaggcacagcac

SEQ ID NO: 4724651 - DNA, 15 bp, Homo sapiens
aggggcaggccctgc

SEQ ID NO: 4724652 - DNA, 20 bp, Homo sapiens
aggggcctcttatgggctgg

SEQ ID NO: 4724653 - DNA, 21 bp, Homo sapiens
aggggcctcttatgggctggg

SEQ ID NO: 4724654 - DNA, 22 bp, Homo sapiens
aggggcctgccacctggacccc

SEQ ID NO: 4724655 - DNA, 13 bp, Homo sapiens
aggggctgcccgc

SEQ ID NO: 4724656 - DNA, 17 bp, Homo sapiens
aggggctgcccgctccc

SEQ ID NO: 4724657 - DNA, 16 bp, Homo sapiens
agggggctggaggagc

SEQ ID NO: 4724658 - DNA, 17 bp, Homo sapiens
agggggctggaggagcc

SEQ ID NO: 4724659 - DNA, 18 bp, Homo sapiens
agggggtggcctcccaac

SEQ ID NO: 4724660 - DNA, 17 bp, Homo sapiens
aggggtggccgtcctga

SEQ ID NO: 4724661 - DNA, 20 bp, Homo sapiens
aggggtgggacaccctgtga

SEQ ID NO: 4724662 - DNA, 22 bp, Homo sapiens
aggggtgggacaccctgtgatg

SEQ ID NO: 4724663 - DNA, 13 bp, Homo sapiens
aggggtgttgtat

SEQ ID NO: 4724664 - DNA, 15 bp, Homo sapiens
aggggtgttgtatgg

SEQ ID NO: 4724665 - DNA, 18 bp, Homo sapiens
agggtatcaggtgctgcc

SEQ ID NO: 4724666 - DNA, 19 bp, Homo sapiens
agggtcagacgcctgagga

SEQ ID NO: 4724667 - DNA, 23 bp, Homo sapiens
agggtccacaggaagtgaagaat

SEQ ID NO: 4724668 - DNA, 16 bp, Homo sapiens
agggtccctggtggca

SEQ ID NO: 4724669 - DNA, 21 bp, Homo sapiens
agggtctcactatgttgccca

SEQ ID NO: 4724670 - DNA, 16 bp, Homo sapiens
agggtctcactctgtc

SEQ ID NO: 4724671 - DNA, 15 bp, Homo sapiens
agggtctctgctgcc

SEQ ID NO: 4724672 - DNA, 17 bp, Homo sapiens
agggtctgggcaggact

SEQ ID NO: 4724673 - DNA, 17 bp, Homo sapiens
agggtctttgcagatgt

SEQ ID NO: 4724674 - DNA, 23 bp, Homo sapiens
agggtgctacgtacatgtgaggc

SEQ ID NO: 4724675 - DNA, 15 bp, Homo sapiens
agggtggtggagcca

SEQ ID NO: 4724676 - DNA, 14 bp, Homo sapiens
agggtgtgtgttca

SEQ ID NO: 4724677 - DNA, 18 bp, Homo sapiens
agggttcatcatccctcc

SEQ ID NO: 4724678 - DNA, 13 bp, Homo sapiens
agggttggcccct

SEQ ID NO: 4724679 - DNA, 14 bp, Homo sapiens
agggttggcccctg

SEQ ID NO: 4724680 - DNA, 14 bp, Homo sapiens
agggtttagtgctt

SEQ ID NO: 4724681 - DNA, 16 bp, Homo sapiens
aggtaaaggatgaggg

SEQ ID NO: 4724682 - DNA, 17 bp, Homo sapiens
aggtaacagaacagctt

SEQ ID NO: 4724683 - DNA, 21 bp, Homo sapiens
aggtaacagaacagcttcagg

SEQ ID NO: 4724684 - DNA, 14 bp, Homo sapiens
aggtaacaggcaga

SEQ ID NO: 4724685 - DNA, 18 bp, Homo sapiens
aggtaatcgacctgcctc

SEQ ID NO: 4724686 - DNA, 19 bp, Homo sapiens
aggtacgatgacagtgttc

SEQ ID NO: 4724687 - DNA, 16 bp, Homo sapiens
aggtagccttgtgttc

SEQ ID NO: 4724688 - DNA, 19 bp, Homo sapiens
aggtagccttgtgttctga

SEQ ID NO: 4724689 - DNA, 19 bp, Homo sapiens
aggtataagtggtgtgtgt

SEQ ID NO: 4724690 - DNA, 20 bp, Homo sapiens
aggtataagtggtgtgtgta

SEQ ID NO: 4724691 - DNA, 18 bp, Homo sapiens
aggtatctggtatctgca

SEQ ID NO: 4724692 - DNA, 20 bp, Homo sapiens
aggtatgaccttctaggaag

SEQ ID NO: 4724693 - DNA, 23 bp, Homo sapiens
aggtatgaccttctaggaagctc

SEQ ID NO: 4724694 - DNA, 13 bp, Homo sapiens
aggtatttttcca

SEQ ID NO: 4724695 - DNA, 20 bp, Homo sapiens
aggtcatacaatccattctt

SEQ ID NO: 4724696 - DNA, 21 bp, Homo sapiens
aggtccagccctggctgaagg

SEQ ID NO: 4724697 - DNA, 13 bp, Homo sapiens
aggtctcctccac

SEQ ID NO: 4724698 - DNA, 19 bp, Homo sapiens
aggtctcgctgatgctggg

SEQ ID NO: 4724699 - DNA, 20 bp, Homo sapiens
aggtgacatgtgaaaccttt

SEQ ID NO: 4724700 - DNA, 22 bp, Homo sapiens
aggtgaccaaaatccccttctc

SEQ ID NO: 4724701 - DNA, 20 bp, Homo sapiens
aggtgatccacccacctcag

SEQ ID NO: 4724702 - DNA, 22 bp, Homo sapiens
aggtgatccactcgccttcatc

SEQ ID NO: 4724703 - DNA, 17 bp, Homo sapiens
aggtgctaatttgtttt

SEQ ID NO: 4724704 - DNA, 15 bp, Homo sapiens
aggtgctcattggct

SEQ ID NO: 4724705 - DNA, 20 bp, Homo sapiens
aggtgctgctaccctccctg

SEQ ID NO: 4724706 - DNA, 23 bp, Homo sapiens
aggtgctgctaccctccctgctg

SEQ ID NO: 4724707 - DNA, 14 bp, Homo sapiens
aggtggcaaggctg

SEQ ID NO: 4724708 - DNA, 15 bp, Homo sapiens
aggtgggatcctcca

SEQ ID NO: 4724709 - DNA, 16 bp, Homo sapiens
atcccaacatggtcct

SEQ ID NO: 4724710 - DNA, 13 bp, Homo sapiens
atcccatgagcct

SEQ ID NO: 4724711 - DNA, 19 bp, Homo sapiens
atcccatgagcctcagcat

SEQ ID NO: 4724712 - DNA, 13 bp, Homo sapiens
atccccaagcctg

SEQ ID NO: 4724713 - DNA, 20 bp, Homo sapiens
atccccagacttcatagaat

SEQ ID NO: 4724714 - DNA, 18 bp, Homo sapiens
atccccagatatttatgt

SEQ ID NO: 4724715 - DNA, 16 bp, Homo sapiens
atcccctagaaatcct

SEQ ID NO: 4724716 - DNA, 17 bp, Homo sapiens
atcccctagaaatcctg

SEQ ID NO: 4724717 - DNA, 20 bp, Homo sapiens
atcccctagaaatcctggga

SEQ ID NO: 4724718 - DNA, 21 bp, Homo sapiens
atccccttctcatcactcccc

SEQ ID NO: 4724719 - DNA, 14 bp, Homo sapiens
atcccgagcacctc

SEQ ID NO: 4724720 - DNA, 21 bp, Homo sapiens
atcccggtgcatgcaggtctc

SEQ ID NO: 4724721 - DNA, 14 bp, Homo sapiens
atccctcatcctca

SEQ ID NO: 4724722 - DNA, 21 bp, Homo sapiens
atccctcatcctcatacccac

SEQ ID NO: 4724723 - DNA, 23 bp, Homo sapiens
atccctcatcctcatacccaccc

SEQ ID NO: 4724724 - DNA, 12 bp, Homo sapiens
atccctccctgc

SEQ ID NO: 4724725 - DNA, 13 bp, Homo sapiens
atccctccctgcc

SEQ ID NO: 4724726 - DNA, 17 bp, Homo sapiens
atccctctacagagctt

SEQ ID NO: 4724727 - DNA, 20 bp, Homo sapiens
atccctctacagagcttccc

SEQ ID NO: 4724728 - DNA, 22 bp, Homo sapiens
atccctctacagagcttccctg

SEQ ID NO: 4724729 - DNA, 18 bp, Homo sapiens
atccctgaggactgattt

SEQ ID NO: 4724730 - DNA, 13 bp, Homo sapiens
atccctgtcttct

SEQ ID NO: 4724731 - DNA, 18 bp, Homo sapiens
atccctgtcttctttcca

SEQ ID NO: 4724732 - DNA, 18 bp, Homo sapiens
atcccttgaccaggcctg

SEQ ID NO: 4724733 - DNA, 19 bp, Homo sapiens
atcctacaagacacagtga

SEQ ID NO: 4724734 - DNA, 12 bp, Homo sapiens
atcctatgtttt

SEQ ID NO: 4724735 - DNA, 20 bp, Homo sapiens
atcctatgtttttgttcaaa

SEQ ID NO: 4724736 - DNA, 16 bp, Homo sapiens
atcctcaaacactgca

SEQ ID NO: 4724737 - DNA, 17 bp, Homo sapiens
atcctcaaacactgcag

SEQ ID NO: 4724738 - DNA, 21 bp, Homo sapiens
cagcctcccgagtagctggga

SEQ ID NO: 4724739 - DNA, 14 bp, Homo sapiens
cagcctctagggac

SEQ ID NO: 4724740 - DNA, 19 bp, Homo sapiens
cagcctctagggacccctc

SEQ ID NO: 4724741 - DNA, 20 bp, Homo sapiens
cagcctctagggacccctcc

SEQ ID NO: 4724742 - DNA, 21 bp, Homo sapiens
cagcctctagggacccctcct

SEQ ID NO: 4724743 - DNA, 16 bp, Homo sapiens
cagcctgacaacagcc

SEQ ID NO: 4724744 - DNA, 20 bp, Homo sapiens
cagcctgacaacagcctgag

SEQ ID NO: 4724745 - DNA, 21 bp, Homo sapiens
cagcctgacaacagcctgaga

SEQ ID NO: 4724746 - DNA, 23 bp, Homo sapiens
cagcctgacaacagcctgagaaa

SEQ ID NO: 4724747 - DNA, 21 bp, Homo sapiens
cagcctgctccttcccaggag

SEQ ID NO: 4724748 - DNA, 22 bp, Homo sapiens
cagcctgctccttcccaggagt

SEQ ID NO: 4724749 - DNA, 16 bp, Homo sapiens
cagcctggagatgaaa

SEQ ID NO: 4724750 - DNA, 20 bp, Homo sapiens
cagcctggcccaccccaccc

SEQ ID NO: 4724751 - DNA, 15 bp, Homo sapiens
cagcctggcccagct

SEQ ID NO: 4724752 - DNA, 16 bp, Homo sapiens
cagcctggcccagctc

SEQ ID NO: 4724753 - DNA, 18 bp, Homo sapiens
cagcctggcccagctccc

SEQ ID NO: 4724754 - DNA, 20 bp, Homo sapiens
cagcctgggtgacagagtga

SEQ ID NO: 4724755 - DNA, 20 bp, Homo sapiens
cagccttgaccattctccac

SEQ ID NO: 4724756 - DNA, 24 bp, Homo sapiens
cagccttgaccattctccacctgc

SEQ ID NO: 4724757 - DNA, 17 bp, Homo sapiens
cagccttggcatctaga

SEQ ID NO: 4724758 - DNA, 20 bp, Homo sapiens
cagcctttctcctgtttatg

SEQ ID NO: 4724759 - DNA, 14 bp, Homo sapiens
cagcggggacagct

SEQ ID NO: 4724760 - DNA, 15 bp, Homo sapiens
cagcggggacagctc

SEQ ID NO: 4724761 - DNA, 19 bp, Homo sapiens
cagcggggacagctccttc

SEQ ID NO: 4724762 - DNA, 15 bp, Homo sapiens
cagcgtgtcaacttt

SEQ ID NO: 4724763 - DNA, 19 bp, Homo sapiens
cagctaaagcaatatgcat

SEQ ID NO: 4724764 - DNA, 16 bp, Homo sapiens
cagctaacacacagct

SEQ ID NO: 4724765 - DNA, 17 bp, Homo sapiens
cagctaacacacagctc

SEQ ID NO: 4724766 - DNA, 21 bp, Homo sapiens
cagctaagatgccatgtgcag

SEQ ID NO: 4724767 - DNA, 16 bp, Homo sapiens
cagctaattgagacca

SEQ ID NO: 4724768 - DNA, 18 bp, Homo sapiens
cagctactttccatttgg

SEQ ID NO: 4724769 - DNA, 13 bp, Homo sapiens
cagctcaccagcc

SEQ ID NO: 4724770 - DNA, 20 bp, Homo sapiens
cagctcaccagccccagtgc

SEQ ID NO: 4724771 - DNA, 15 bp, Homo sapiens
cagctcacctctccc

SEQ ID NO: 4724772 - DNA, 17 bp, Homo sapiens
cagctcacctctccctt

SEQ ID NO: 4724773 - DNA, 19 bp, Homo sapiens
cagctcacctctcccttgg

SEQ ID NO: 4724774 - DNA, 20 bp, Homo sapiens
cagctcacctctcccttgga

SEQ ID NO: 4724775 - DNA, 15 bp, Homo sapiens
cagctcactgcaacc

SEQ ID NO: 4724776 - DNA, 12 bp, Homo sapiens
cagctcagagag

SEQ ID NO: 4724777 - DNA, 13 bp, Homo sapiens
cagctccagctca

SEQ ID NO: 4724778 - DNA, 15 bp, Homo sapiens
cagctccagctcacc

SEQ ID NO: 4724779 - DNA, 18 bp, Homo sapiens
cagctccagctcaccagc

SEQ ID NO: 4724780 - DNA, 24 bp, Homo sapiens
cagctccccagagtcctctatgaa

SEQ ID NO: 4724781 - DNA, 12 bp, Homo sapiens
cagctcccccgg

SEQ ID NO: 4724782 - DNA, 15 bp, Homo sapiens
cagctcctcatccag

SEQ ID NO: 4724783 - DNA, 20 bp, Homo sapiens
cagctcctcatccagggctc

SEQ ID NO: 4724784 - DNA, 16 bp, Homo sapiens
cagctccttcctggag

SEQ ID NO: 4724785 - DNA, 17 bp, Homo sapiens
cagctccttctgtccta

SEQ ID NO: 4724786 - DNA, 18 bp, Homo sapiens
cagctctgaaaccagtgt

SEQ ID NO: 4724787 - DNA, 19 bp, Homo sapiens
cagctctgaaaccagtgtt

SEQ ID NO: 4724788 - DNA, 13 bp, Homo sapiens
cagctctggtcca

SEQ ID NO: 4724789 - DNA, 18 bp, Homo sapiens
attttccataagctattt

SEQ ID NO: 4724790 - DNA, 14 bp, Homo sapiens
attttcccactgca

SEQ ID NO: 4724791 - DNA, 13 bp, Homo sapiens
attttccctgcta

SEQ ID NO: 4724792 - DNA, 14 bp, Homo sapiens
attttgaggctttc

SEQ ID NO: 4724793 - DNA, 20 bp, Homo sapiens
attttgagggtgtaaccagt

SEQ ID NO: 4724794 - DNA, 18 bp, Homo sapiens
attttgatccaagctggt

SEQ ID NO: 4724795 - DNA, 19 bp, Homo sapiens
attttgatccaagctggtc

SEQ ID NO: 4724796 - DNA, 21 bp, Homo sapiens
attttgctgactttaaaagga

SEQ ID NO: 4724797 - DNA, 20 bp, Homo sapiens
attttgctgtagaagatggc

SEQ ID NO: 4724798 - DNA, 15 bp, Homo sapiens
attttggattaattt

SEQ ID NO: 4724799 - DNA, 20 bp, Homo sapiens
attttggattaatttgtgaa

SEQ ID NO: 4724800 - DNA, 21 bp, Homo sapiens
attttggggtacccactgctc

SEQ ID NO: 4724801 - DNA, 23 bp, Homo sapiens
attttggggtacccactgctctg

SEQ ID NO: 4724802 - DNA, 22 bp, Homo sapiens
attttgtaattattgtgatttc

SEQ ID NO: 4724803 - DNA, 16 bp, Homo sapiens
attttgtagcctctct

SEQ ID NO: 4724804 - DNA, 17 bp, Homo sapiens
attttgtcacagctctt

SEQ ID NO: 4724805 - DNA, 20 bp, Homo sapiens
attttgtcacagctcttgtt

SEQ ID NO: 4724806 - DNA, 14 bp, Homo sapiens
attttgtcgaattt

SEQ ID NO: 4724807 - DNA, 15 bp, Homo sapiens
attttgtgaatggat

SEQ ID NO: 4724808 - DNA, 19 bp, Homo sapiens
attttgtgatgaataaaat

SEQ ID NO: 4724809 - DNA, 22 bp, Homo sapiens
attttgtgatgaataaaataat

SEQ ID NO: 4724810 - DNA, 22 bp, Homo sapiens
attttgttaccttttacagaat

SEQ ID NO: 4724811 - DNA, 12 bp, Homo sapiens
attttgttactg

SEQ ID NO: 4724812 - DNA, 18 bp, Homo sapiens
attttgttactgtctgta

SEQ ID NO: 4724813 - DNA, 13 bp, Homo sapiens
atttttaaagaaa

SEQ ID NO: 4724814 - DNA, 19 bp, Homo sapiens
atttttaaaggacaaacag

SEQ ID NO: 4724815 - DNA, 20 bp, Homo sapiens
atttttaaaggacaaacagt

SEQ ID NO: 4724816 - DNA, 18 bp, Homo sapiens
atttttaactactgtatt

SEQ ID NO: 4724817 - DNA, 22 bp, Homo sapiens
atttttaactctggattttgaa

SEQ ID NO: 4724818 - DNA, 16 bp, Homo sapiens
atttttcagatataaa

SEQ ID NO: 4724819 - DNA, 21 bp, Homo sapiens
atttttctcaaagttttgaaa

SEQ ID NO: 4724820 - DNA, 15 bp, Homo sapiens
atttttctttaactg

SEQ ID NO: 4724821 - DNA, 16 bp, Homo sapiens
atttttgtttctacct

SEQ ID NO: 4724822 - DNA, 21 bp, Homo sapiens
attttttaaaaaaaactattt

SEQ ID NO: 4724823 - DNA, 13 bp, Homo sapiens
attttttaaacca

SEQ ID NO: 4724824 - DNA, 12 bp, Homo sapiens
attttttaagag

SEQ ID NO: 4724825 - DNA, 23 bp, Homo sapiens
attttttaatttctatgaaggat

SEQ ID NO: 4724826 - DNA, 16 bp, Homo sapiens
atttttttaaatttca

SEQ ID NO: 4724827 - DNA, 20 bp, Homo sapiens
attttttttaagttcacttt

SEQ ID NO: 4724828 - DNA, 20 bp, Homo sapiens
attttttttcaaaaatgctg

SEQ ID NO: 4724829 - DNA, 15 bp, Homo sapiens
attttttttgtttca

SEQ ID NO: 4724830 - DNA, 19 bp, Homo sapiens
atttttttttaagctctga

SEQ ID NO: 4724831 - DNA, 20 bp, Homo sapiens
atttttttttaagctctgag

SEQ ID NO: 4724832 - DNA, 20 bp, Homo sapiens
cagaacagtgtttgattttt

SEQ ID NO: 4724833 - DNA, 16 bp, Homo sapiens
cagaactgtgagagaa

SEQ ID NO: 4724834 - DNA, 18 bp, Homo sapiens
cagaagacaccagagcag

SEQ ID NO: 4724835 - DNA, 21 bp, Homo sapiens
cagaagacaccagagcagatg

SEQ ID NO: 4724836 - DNA, 21 bp, Homo sapiens
cagaagacactgatgggcaac

SEQ ID NO: 4724837 - DNA, 14 bp, Homo sapiens
cagaagcagctctt

SEQ ID NO: 4724838 - DNA, 18 bp, Homo sapiens
cagaaggcaaacccatca

SEQ ID NO: 4724839 - DNA, 19 bp, Homo sapiens
cagaagggggtggtgtctc

SEQ ID NO: 4724840 - DNA, 17 bp, Homo sapiens
cagaagtattgtttaca

SEQ ID NO: 4724841 - DNA, 22 bp, Homo sapiens
cagaagtcacacattacaaagt

SEQ ID NO: 4724842 - DNA, 13 bp, Homo sapiens
cagaagtgattta

SEQ ID NO: 4724843 - DNA, 15 bp, Homo sapiens
cagaatactggtctc

SEQ ID NO: 4724844 - DNA, 22 bp, Homo sapiens
cagaatatgattcactatttaa

SEQ ID NO: 4724845 - DNA, 20 bp, Homo sapiens
cagaatggctatcaaaagaa

SEQ ID NO: 4724846 - DNA, 14 bp, Homo sapiens
cagacacaggcccg

SEQ ID NO: 4724847 - DNA, 17 bp, Homo sapiens
cagacacaggcccggct

SEQ ID NO: 4724848 - DNA, 21 bp, Homo sapiens
cagacacaggcccggctccag

SEQ ID NO: 4724849 - DNA, 23 bp, Homo sapiens
cagacacaggcccggctccaggc

SEQ ID NO: 4724850 - DNA, 20 bp, Homo sapiens
cagacaccttgacagggcac

SEQ ID NO: 4724851 - DNA, 19 bp, Homo sapiens
cagacactaacgaaatatc

SEQ ID NO: 4724852 - DNA, 12 bp, Homo sapiens
cagacagccccc

SEQ ID NO: 4724853 - DNA, 16 bp, Homo sapiens
cagacagctgcctggg

SEQ ID NO: 4724854 - DNA, 13 bp, Homo sapiens
cagacaggaccag

SEQ ID NO: 4724855 - DNA, 16 bp, Homo sapiens
cagacaggaccaggga

SEQ ID NO: 4724856 - DNA, 11 bp, Homo sapiens
cagacaggcaa

SEQ ID NO: 4724857 - DNA, 17 bp, Homo sapiens
cagaccctgccctgtgg

SEQ ID NO: 4724858 - DNA, 15 bp, Homo sapiens
cagacctgctctgga

SEQ ID NO: 4724859 - DNA, 16 bp, Homo sapiens
cagacctgctctggac

SEQ ID NO: 4724860 - DNA, 15 bp, Homo sapiens
cagactaagccagca

SEQ ID NO: 4724861 - DNA, 21 bp, Homo sapiens
cagactaagccagcaccggac

SEQ ID NO: 4724862 - DNA, 23 bp, Homo sapiens
cagactaagccagcaccggacca

SEQ ID NO: 4724863 - DNA, 20 bp, Homo sapiens
cagactctacagaggccatg

SEQ ID NO: 4724864 - DNA, 23 bp, Homo sapiens
cagactctttttgtacctggtga

SEQ ID NO: 4724865 - DNA, 16 bp, Homo sapiens
cagactggaagcacag

SEQ ID NO: 4724866 - DNA, 21 bp, Homo sapiens
cagactgtgtaaaaagagagc

SEQ ID NO: 4724867 - DNA, 15 bp, Homo sapiens
cagagaaagaggaag

SEQ ID NO: 4724868 - DNA, 17 bp, Homo sapiens
cagagaaagaggaagct

SEQ ID NO: 4724869 - DNA, 18 bp, Homo sapiens
cagagaaagaggaagctt

SEQ ID NO: 4724870 - DNA, 19 bp, Homo sapiens
cagagaaagtacttctcca

SEQ ID NO: 4724871 - DNA, 23 bp, Homo sapiens
cagagaaagtacttctccaccct

SEQ ID NO: 4724872 - DNA, 21 bp, Homo sapiens
cagagaatgaaagggcccaga

SEQ ID NO: 4724873 - DNA, 23 bp, Homo sapiens
cagagacatcagcccttgggggt

SEQ ID NO: 4724874 - DNA, 13 bp, Homo sapiens
cagagaccatccc

SEQ ID NO: 4724875 - DNA, 16 bp, Homo sapiens
cagagaccatccctga

SEQ ID NO: 4724876 - DNA, 17 bp, Homo sapiens
cagagaccatccctgaa

SEQ ID NO: 4724877 - DNA, 16 bp, Homo sapiens
cagagacctcctgcct

SEQ ID NO: 4724878 - DNA, 14 bp, Homo sapiens
cagagactcctgca

SEQ ID NO: 4724879 - DNA, 17 bp, Homo sapiens
cagagactcctgcaggc

SEQ ID NO: 4724880 - DNA, 21 bp, Homo sapiens
cagagactcctgcaggcagcc

SEQ ID NO: 4724881 - DNA, 23 bp, Homo sapiens
cagagactcctgcaggcagccag

SEQ ID NO: 4724882 - DNA, 16 bp, Homo sapiens
cagagagcacagtgat

SEQ ID NO: 4724883 - DNA, 14 bp, Homo sapiens
cagagagggcaggc

SEQ ID NO: 4724884 - DNA, 16 bp, Homo sapiens
cagagagggcaggcat

SEQ ID NO: 4724885 - DNA, 12 bp, Homo sapiens
cagagagggtgg

SEQ ID NO: 4724886 - DNA, 16 bp, Homo sapiens
cagagagggtgggagt

SEQ ID NO: 4724887 - DNA, 17 bp, Homo sapiens
catgggcttcactgtat

SEQ ID NO: 4724888 - DNA, 20 bp, Homo sapiens
catgggcttcactgtataaa

SEQ ID NO: 4724889 - DNA, 23 bp, Homo sapiens
catgggcttcactgtataaatag

SEQ ID NO: 4724890 - DNA, 12 bp, Homo sapiens
catggggaggag

SEQ ID NO: 4724891 - DNA, 15 bp, Homo sapiens
catggggaggaggag

SEQ ID NO: 4724892 - DNA, 13 bp, Homo sapiens
catgggggagggg

SEQ ID NO: 4724893 - DNA, 16 bp, Homo sapiens
catgggggctcagcca

SEQ ID NO: 4724894 - DNA, 16 bp, Homo sapiens
catgggtcgggagagg

SEQ ID NO: 4724895 - DNA, 14 bp, Homo sapiens
catggtctgtcctg

SEQ ID NO: 4724896 - DNA, 15 bp, Homo sapiens
catggtctgtcctga

SEQ ID NO: 4724897 - DNA, 13 bp, Homo sapiens
catggtgaaactc

SEQ ID NO: 4724898 - DNA, 22 bp, Homo sapiens
catggtgggtccatgggcagag

SEQ ID NO: 4724899 - DNA, 14 bp, Homo sapiens
catggtgtaataag

SEQ ID NO: 4724900 - DNA, 21 bp, Homo sapiens
catggtgtaataagacataac

SEQ ID NO: 4724901 - DNA, 18 bp, Homo sapiens
catggtgtgatcgtctga

SEQ ID NO: 4724902 - DNA, 20 bp, Homo sapiens
catgtactgttactgtgtca

SEQ ID NO: 4724903 - DNA, 13 bp, Homo sapiens
catgtagaagctg

SEQ ID NO: 4724904 - DNA, 18 bp, Homo sapiens
catgtataatatttttaa

SEQ ID NO: 4724905 - DNA, 19 bp, Homo sapiens
catgtattagccagtcatt

SEQ ID NO: 4724906 - DNA, 14 bp, Homo sapiens
catgtcaaacgtga

SEQ ID NO: 4724907 - DNA, 19 bp, Homo sapiens
catgtcaaacgtgaaaatg

SEQ ID NO: 4724908 - DNA, 15 bp, Homo sapiens
catgtccaagaagcc

SEQ ID NO: 4724909 - DNA, 18 bp, Homo sapiens
catgtccaagaagcccag

SEQ ID NO: 4724910 - DNA, 12 bp, Homo sapiens
catgtctggcta

SEQ ID NO: 4724911 - DNA, 14 bp, Homo sapiens
catgtcttttcttg

SEQ ID NO: 4724912 - DNA, 12 bp, Homo sapiens
catgtgaaacct

SEQ ID NO: 4724913 - DNA, 18 bp, Homo sapiens
catgtgaaacctttttta

SEQ ID NO: 4724914 - DNA, 24 bp, Homo sapiens
catgtgaaaccttttttaagattt

SEQ ID NO: 4724915 - DNA, 16 bp, Homo sapiens
catgtgcaactcttgt

SEQ ID NO: 4724916 - DNA, 17 bp, Homo sapiens
catgtgcaactcttgta

SEQ ID NO: 4724917 - DNA, 15 bp, Homo sapiens
catgtgcacatgcac

SEQ ID NO: 4724918 - DNA, 17 bp, Homo sapiens
catctcattgaggacaa

SEQ ID NO: 4724919 - DNA, 20 bp, Homo sapiens
catctccagtatcctgctgg

SEQ ID NO: 4724920 - DNA, 18 bp, Homo sapiens
catctcccagataatgtg

SEQ ID NO: 4724921 - DNA, 16 bp, Homo sapiens
catctcctgccttcct

SEQ ID NO: 4724922 - DNA, 19 bp, Homo sapiens
catctcctgccttcctcct

SEQ ID NO: 4724923 - DNA, 18 bp, Homo sapiens
catctcttagctcccctc

SEQ ID NO: 4724924 - DNA, 21 bp, Homo sapiens
catctcttagctcccctccaa

SEQ ID NO: 4724925 - DNA, 22 bp, Homo sapiens
catctgcccaggacggggccgg

SEQ ID NO: 4724926 - DNA, 16 bp, Homo sapiens
catctgctctccttcc

SEQ ID NO: 4724927 - DNA, 17 bp, Homo sapiens
catctggaaccatcaga

SEQ ID NO: 4724928 - DNA, 13 bp, Homo sapiens
catctgggctcct

SEQ ID NO: 4724929 - DNA, 19 bp, Homo sapiens
catctgtgaaaggaaagag

SEQ ID NO: 4724930 - DNA, 21 bp, Homo sapiens
catctgtgccatacttgttct

SEQ ID NO: 4724931 - DNA, 18 bp, Homo sapiens
catcttacattagtgatt

SEQ ID NO: 4724932 - DNA, 14 bp, Homo sapiens
catcttgctctgct

SEQ ID NO: 4724933 - DNA, 15 bp, Homo sapiens
catcttgctctgctg

SEQ ID NO: 4724934 - DNA, 16 bp, Homo sapiens
catcttgctctgctga

SEQ ID NO: 4724935 - DNA, 19 bp, Homo sapiens
catcttgctctgctgacag

SEQ ID NO: 4724936 - DNA, 20 bp, Homo sapiens
catctttaacagcttacact

SEQ ID NO: 4724937 - DNA, 19 bp, Homo sapiens
catctttgtatatttacat

SEQ ID NO: 4724938 - DNA, 18 bp, Homo sapiens
catgaaaacattgatgaa

SEQ ID NO: 4724939 - DNA, 21 bp, Homo sapiens
catgaaataaaatatatctta

SEQ ID NO: 4724940 - DNA, 23 bp, Homo sapiens
catgaactacgtgacctctgcaa

SEQ ID NO: 4724941 - DNA, 12 bp, Homo sapiens
catgaagaagct

SEQ ID NO: 4724942 - DNA, 18 bp, Homo sapiens
catgaagattctttccca

SEQ ID NO: 4724943 - DNA, 18 bp, Homo sapiens
catgaaggtttctgaaaa

SEQ ID NO: 4724944 - DNA, 18 bp, Homo sapiens
catgaagtttccttggct

SEQ ID NO: 4724945 - DNA, 22 bp, Homo sapiens
catgaagtttccttggctggtg

SEQ ID NO: 4724946 - DNA, 13 bp, Homo sapiens
catgacagcctcc

SEQ ID NO: 4724947 - DNA, 15 bp, Homo sapiens
catgacccaggctgg

SEQ ID NO: 4724948 - DNA, 18 bp, Homo sapiens
catgactgcccagctctg

SEQ ID NO: 4724949 - DNA, 22 bp, Homo sapiens
catgagaagttgatatagaaca

SEQ ID NO: 4724950 - DNA, 18 bp, Homo sapiens
catgagactatgtaaaaa

SEQ ID NO: 4724951 - DNA, 13 bp, Homo sapiens
catgagcatcagg

SEQ ID NO: 4724952 - DNA, 17 bp, Homo sapiens
catgagcatcaggccag

SEQ ID NO: 4724953 - DNA, 22 bp, Homo sapiens
catgagcatcaggccaggccct

SEQ ID NO: 4724954 - DNA, 15 bp, Homo sapiens
catgagcctcagcat

SEQ ID NO: 4724955 - DNA, 20 bp, Homo sapiens
catgagcctcagcatcctgg

SEQ ID NO: 4724956 - DNA, 21 bp, Homo sapiens
catgagcctcagcatcctggc

SEQ ID NO: 4724957 - DNA, 23 bp, Homo sapiens
catgagtcccctgtttgtttctg

SEQ ID NO: 4724958 - DNA, 21 bp, Homo sapiens
catgagtggccttaataaata

SEQ ID NO: 4724959 - DNA, 23 bp, Homo sapiens
catgagttattcataaagagaaa

SEQ ID NO: 4724960 - DNA, 16 bp, Homo sapiens
catgatgaaactgtca

SEQ ID NO: 4724961 - DNA, 15 bp, Homo sapiens
catgcaaaggctggg

SEQ ID NO: 4724962 - DNA, 16 bp, Homo sapiens
catgcaaaggctggga

SEQ ID NO: 4724963 - DNA, 16 bp, Homo sapiens
catgcaccctcataca

SEQ ID NO: 4724964 - DNA, 20 bp, Homo sapiens
catgcaccctcatacacaga

SEQ ID NO: 4724965 - DNA, 12 bp, Homo sapiens
catgcatataat

SEQ ID NO: 4724966 - DNA, 19 bp, Homo sapiens
catgccccctcgtgccagt

SEQ ID NO: 4724967 - DNA, 21 bp, Homo sapiens
catgcctggatggggctgcac

SEQ ID NO: 4724968 - DNA, 14 bp, Homo sapiens
catgcctggcttcg

SEQ ID NO: 4724969 - DNA, 23 bp, Homo sapiens
catgcggagaacaaatgtgaagg

SEQ ID NO: 4724970 - DNA, 20 bp, Homo sapiens
catgctctcatatatatttt

SEQ ID NO: 4724971 - DNA, 18 bp, Homo sapiens
catgctgagagctgggct

SEQ ID NO: 4724972 - DNA, 14 bp, Homo sapiens
catgctgccctgtg

SEQ ID NO: 4724973 - DNA, 21 bp, Homo sapiens
catgctgtgtgactcaaacca

SEQ ID NO: 4724974 - DNA, 20 bp, Homo sapiens
catgcttccaggtaaaaaca

SEQ ID NO: 4724975 - DNA, 13 bp, Homo sapiens
catggaaaacaga

SEQ ID NO: 4724976 - DNA, 16 bp, Homo sapiens
catggaaaacagagta

SEQ ID NO: 4724977 - DNA, 23 bp, Homo sapiens
catggacaatggaccggagagtg

SEQ ID NO: 4724978 - DNA, 21 bp, Homo sapiens
catggacatgtgtcccagcca

SEQ ID NO: 4724979 - DNA, 13 bp, Homo sapiens
catggactttgtt

SEQ ID NO: 4724980 - DNA, 16 bp, Homo sapiens
catggagagctggagc

SEQ ID NO: 4724981 - DNA, 21 bp, Homo sapiens
catggagagctggagcctggt

SEQ ID NO: 4724982 - DNA, 23 bp, Homo sapiens
catggaggagacaggaagcctca

SEQ ID NO: 4724983 - DNA, 13 bp, Homo sapiens
catggagtgtttg

SEQ ID NO: 4724984 - DNA, 19 bp, Homo sapiens
catggattccaaagcattt

SEQ ID NO: 4724985 - DNA, 23 bp, Homo sapiens
catggcagtgggaaaaatgtagg

SEQ ID NO: 4724986 - DNA, 23 bp, Homo sapiens
catggccctcccagtacctcctg

SEQ ID NO: 4724987 - DNA, 15 bp, Homo sapiens
catggctggtgcctg

SEQ ID NO: 4724988 - DNA, 14 bp, Homo sapiens
catgggaggctcac

SEQ ID NO: 4724989 - DNA, 19 bp, Homo sapiens
catgggcactgctgggtgg

SEQ ID NO: 4724990 - DNA, 17 bp, Homo sapiens
catgggcctcctgtgtg

SEQ ID NO: 4724991 - DNA, 16 bp, Homo sapiens
catgggcttcactgta

SEQ ID NO: 4724992 - DNA, 14 bp, Homo sapiens
ccaggttcagcttg

SEQ ID NO: 4724993 - DNA, 16 bp, Homo sapiens
ccaggtttctatgtgt

SEQ ID NO: 4724994 - DNA, 22 bp, Homo sapiens
ccagtacctcctgtctctggcc

SEQ ID NO: 4724995 - DNA, 15 bp, Homo sapiens
ccagtatgagcccta

SEQ ID NO: 4724996 - DNA, 22 bp, Homo sapiens
ccagtattatattatcatatct

SEQ ID NO: 4724997 - DNA, 14 bp, Homo sapiens
ccagtcaacctggg

SEQ ID NO: 4724998 - DNA, 22 bp, Homo sapiens
ccagtcattatgttaatatttc

SEQ ID NO: 4724999 - DNA, 21 bp, Homo sapiens
ccagtcgcgctgcctgtgtgg

SEQ ID NO: 4725000 - DNA, 19 bp, Homo sapiens
ccagtctggaatgcagtgg

SEQ ID NO: 4725001 - DNA, 20 bp, Homo sapiens
ccagtctggaatgcagtggt

SEQ ID NO: 4725002 - DNA, 15 bp, Homo sapiens
ccagtgaggctctgc

SEQ ID NO: 4725003 - DNA, 16 bp, Homo sapiens
ccagtggctgctgccc

SEQ ID NO: 4725004 - DNA, 17 bp, Homo sapiens
ccagtggctgctgccca

SEQ ID NO: 4725005 - DNA, 14 bp, Homo sapiens
ccagtgtcttcctg

SEQ ID NO: 4725006 - DNA, 23 bp, Homo sapiens
ccagtgtgacaaggattgctact

SEQ ID NO: 4725007 - DNA, 23 bp, Homo sapiens
ccagtgttacaatcagtgtgaat

SEQ ID NO: 4725008 - DNA, 22 bp, Homo sapiens
ccagttagaaggaggttctaat

SEQ ID NO: 4725009 - DNA, 17 bp, Homo sapiens
ccagttccctccctcaa

SEQ ID NO: 4725010 - DNA, 20 bp, Homo sapiens
ccagttgggtggatgcctgg

SEQ ID NO: 4725011 - DNA, 18 bp, Homo sapiens
ccagttggtcccccttcc

SEQ ID NO: 4725012 - DNA, 14 bp, Homo sapiens
ccagtttgactgtg

SEQ ID NO: 4725013 - DNA, 12 bp, Homo sapiens
ccataaatcaat

SEQ ID NO: 4725014 - DNA, 16 bp, Homo sapiens
ccataaccgctgattc

SEQ ID NO: 4725015 - DNA, 22 bp, Homo sapiens
ccataaccgctgattctcaggg

SEQ ID NO: 4725016 - DNA, 12 bp, Homo sapiens
ccataagctatt

SEQ ID NO: 4725017 - DNA, 15 bp, Homo sapiens
ccatagctcctgctc

SEQ ID NO: 4725018 - DNA, 16 bp, Homo sapiens
ccatagctcctgctcc

SEQ ID NO: 4725019 - DNA, 19 bp, Homo sapiens
ccatagctcctgctccaca

SEQ ID NO: 4725020 - DNA, 15 bp, Homo sapiens
ccatattctgttggc

SEQ ID NO: 4725021 - DNA, 23 bp, Homo sapiens
ccatattctgttggccagtgtga

SEQ ID NO: 4725022 - DNA, 14 bp, Homo sapiens
ccatcaagccacca

SEQ ID NO: 4725023 - DNA, 17 bp, Homo sapiens
ccatcaggactcttgtg

SEQ ID NO: 4725024 - DNA, 14 bp, Homo sapiens
ccatcagtgccagc

SEQ ID NO: 4725025 - DNA, 18 bp, Homo sapiens
ccatcagtgccagcccct

SEQ ID NO: 4725026 - DNA, 12 bp, Homo sapiens
ccatcagtgctc

SEQ ID NO: 4725027 - DNA, 18 bp, Homo sapiens
ccatcagtgtacccccgc

SEQ ID NO: 4725028 - DNA, 13 bp, Homo sapiens
ccatcatgtctgg

SEQ ID NO: 4725029 - DNA, 17 bp, Homo sapiens
ccatccacatgggagcc

SEQ ID NO: 4725030 - DNA, 15 bp, Homo sapiens
ccatcccagccttgg

SEQ ID NO: 4725031 - DNA, 14 bp, Homo sapiens
ccatcctggcccat

SEQ ID NO: 4725032 - DNA, 16 bp, Homo sapiens
ccatcctgtcccacca

SEQ ID NO: 4725033 - DNA, 14 bp, Homo sapiens
ccatctcacacatg

SEQ ID NO: 4725034 - DNA, 20 bp, Homo sapiens
ccatctcacacatgagcatc

SEQ ID NO: 4725035 - DNA, 22 bp, Homo sapiens
ccatctctaggatgtcgtcttt

SEQ ID NO: 4725036 - DNA, 18 bp, Homo sapiens
ccatctctggatgcctga

SEQ ID NO: 4725037 - DNA, 16 bp, Homo sapiens
ccatctgcccaggacg

SEQ ID NO: 4725038 - DNA, 20 bp, Homo sapiens
ccatctgcgtgacaataaaa

SEQ ID NO: 4725039 - DNA, 14 bp, Homo sapiens
ccatctgtccctgc

SEQ ID NO: 4725040 - DNA, 16 bp, Homo sapiens
ccatctgtgcacgcag

SEQ ID NO: 4725041 - DNA, 22 bp, Homo sapiens
ccatcttccctggcgtcctctc

SEQ ID NO: 4725042 - DNA, 15 bp, Homo sapiens
ccatgaaccaagacc

SEQ ID NO: 4725043 - DNA, 17 bp, Homo sapiens
ccatgacccaggctggg

SEQ ID NO: 4725044 - DNA, 14 bp, Homo sapiens
ccatgagcctcagc

SEQ ID NO: 4725045 - DNA, 21 bp, Homo sapiens
ccatgagcctcagcatcctgg

SEQ ID NO: 4725046 - DNA, 18 bp, Homo sapiens
ccatgagtcccctgtttg

SEQ ID NO: 4725047 - DNA, 20 bp, Homo sapiens
ccatgagtggcatggccacc

SEQ ID NO: 4725048 - DNA, 12 bp, Homo sapiens
ccatgatgctgg

SEQ ID NO: 4725049 - DNA, 21 bp, Homo sapiens
ccatgcaccctcatacacaga

SEQ ID NO: 4725050 - DNA, 16 bp, Homo sapiens
ccatgcatttaaagta

SEQ ID NO: 4725051 - DNA, 16 bp, Homo sapiens
ccatgctgccctgtga

SEQ ID NO: 4725052 - DNA, 17 bp, Homo sapiens
ccatgctgccctgtgag

SEQ ID NO: 4725053 - DNA, 19 bp, Homo sapiens
ccatggagagctggagcct

SEQ ID NO: 4725054 - DNA, 22 bp, Homo sapiens
ccatggaggagacaggaagcct

SEQ ID NO: 4725055 - DNA, 23 bp, Homo sapiens
ccatggagtgagacccaggagcc

SEQ ID NO: 4725056 - DNA, 13 bp, Homo sapiens
ccatggccctgcc

SEQ ID NO: 4725057 - DNA, 17 bp, Homo sapiens
ccatggccttggcaggc

SEQ ID NO: 4725058 - DNA, 15 bp, Homo sapiens
ccatgggcctcctgt

SEQ ID NO: 4725059 - DNA, 20 bp, Homo sapiens
ccatgggcttcactgtataa

SEQ ID NO: 4725060 - DNA, 21 bp, Homo sapiens
ccatgggcttcactgtataaa

SEQ ID NO: 4725061 - DNA, 18 bp, Homo sapiens
ccatgggggctcagccag

SEQ ID NO: 4725062 - DNA, 20 bp, Homo sapiens
ccatgtctctgagcattaga

SEQ ID NO: 4725063 - DNA, 15 bp, Homo sapiens
ccatgttctgtccct

SEQ ID NO: 4725064 - DNA, 22 bp, Homo sapiens
ccatgttctgtcccttgccccc

SEQ ID NO: 4725065 - DNA, 15 bp, Homo sapiens
ccatgttggccaggc

SEQ ID NO: 4725066 - DNA, 18 bp, Homo sapiens
ccatgttggccaggctgc

SEQ ID NO: 4725067 - DNA, 21 bp, Homo sapiens
ccatgttggccaggctgctct

SEQ ID NO: 4725068 - DNA, 23 bp, Homo sapiens
ccattatgactgttgttcttata

SEQ ID NO: 4725069 - DNA, 18 bp, Homo sapiens
ccattatttaatttgtat

SEQ ID NO: 4725070 - DNA, 16 bp, Homo sapiens
ccattctccacctgcc

SEQ ID NO: 4725071 - DNA, 15 bp, Homo sapiens
ccattctgcctgccc

SEQ ID NO: 4725072 - DNA, 16 bp, Homo sapiens
ccattctgcctgccca

SEQ ID NO: 4725073 - DNA, 20 bp, Homo sapiens
ccattctgcctgcccaggcc

SEQ ID NO: 4725074 - DNA, 21 bp, Homo sapiens
ccatttgcgttccatgatgct

SEQ ID NO: 4725075 - DNA, 21 bp, Homo sapiens
ccattttattaaacattttca

SEQ ID NO: 4725076 - DNA, 12 bp, Homo sapiens
cccaaagaagga

SEQ ID NO: 4725077 - DNA, 13 bp, Homo sapiens
cccaaagtgctgg

SEQ ID NO: 4725078 - DNA, 21 bp, Homo sapiens
cccaaattaaacgtaaatgtt

SEQ ID NO: 4725079 - DNA, 14 bp, Homo sapiens
cccaacccccagca

SEQ ID NO: 4725080 - DNA, 15 bp, Homo sapiens
cccaacccccagcac

SEQ ID NO: 4725081 - DNA, 20 bp, Homo sapiens
cccaacccccagcccccacc

SEQ ID NO: 4725082 - DNA, 16 bp, Homo sapiens
cccaactcaccccagc

SEQ ID NO: 4725083 - DNA, 20 bp, Homo sapiens
cccaactcaccccagcccca

SEQ ID NO: 4725084 - DNA, 14 bp, Homo sapiens
cccaagctctgctc

SEQ ID NO: 4725085 - DNA, 12 bp, Homo sapiens
cccaagggcctg

SEQ ID NO: 4725086 - DNA, 18 bp, Homo sapiens
cccaagggcctggcctga

SEQ ID NO: 4725087 - DNA, 19 bp, Homo sapiens
cccaagggcctggcctgag

SEQ ID NO: 4725088 - DNA, 23 bp, Homo sapiens
cccaagtgatccttccacctcag

SEQ ID NO: 4725089 - DNA, 13 bp, Homo sapiens
cccaatccctcaa

SEQ ID NO: 4725090 - DNA, 16 bp, Homo sapiens
cccaatgcactttgtt

SEQ ID NO: 4725091 - DNA, 21 bp, Homo sapiens
cccaattcttacaaacatgtg

SEQ ID NO: 4725092 - DNA, 19 bp, Homo sapiens
cccacaacccaaaaggttt

SEQ ID NO: 4725093 - DNA, 11 bp, Homo sapiens
cccacactcct

SEQ ID NO: 4725094 - DNA, 18 bp, Homo sapiens
cccacagcccacgtcctg

SEQ ID NO: 4725095 - DNA, 15 bp, Homo sapiens
cccacccaagggcct

SEQ ID NO: 4725096 - DNA, 22 bp, Homo sapiens
cccacccaagggcctggcctga

SEQ ID NO: 4725097 - DNA, 17 bp, Homo sapiens
cccacccccacccaagg

SEQ ID NO: 4725098 - DNA, 11 bp, Homo sapiens
cccacccctca

SEQ ID NO: 4725099 - DNA, 22 bp, Homo sapiens
cccacccggtggttcttcctgt

SEQ ID NO: 4725100 - DNA, 18 bp, Homo sapiens
cccaccgcagacaggacc

SEQ ID NO: 4725101 - DNA, 18 bp, Homo sapiens
cccaccgcatgccccctc

SEQ ID NO: 4725102 - DNA, 12 bp, Homo sapiens
cccacctcagcc

SEQ ID NO: 4725103 - DNA, 23 bp, Homo sapiens
catttcacccctccctttctccc

SEQ ID NO: 4725104 - DNA, 22 bp, Homo sapiens
catttccctccctctcttcccc

SEQ ID NO: 4725105 - DNA, 20 bp, Homo sapiens
catttcctctgagctgttat

SEQ ID NO: 4725106 - DNA, 20 bp, Homo sapiens
catttctagcgcatggcctg

SEQ ID NO: 4725107 - DNA, 19 bp, Homo sapiens
catttgcaatatggatttc

SEQ ID NO: 4725108 - DNA, 23 bp, Homo sapiens
catttggagtgttccccttccac

SEQ ID NO: 4725109 - DNA, 18 bp, Homo sapiens
catttggcatttatttgt

SEQ ID NO: 4725110 - DNA, 17 bp, Homo sapiens
catttggggtaatactt

SEQ ID NO: 4725111 - DNA, 12 bp, Homo sapiens
catttggtgaag

SEQ ID NO: 4725112 - DNA, 14 bp, Homo sapiens
catttgtaacttta

SEQ ID NO: 4725113 - DNA, 17 bp, Homo sapiens
catttgtcacacacttt

SEQ ID NO: 4725114 - DNA, 16 bp, Homo sapiens
cattttaaaggataat

SEQ ID NO: 4725115 - DNA, 22 bp, Homo sapiens
cattttcagcatcaaacatgaa

SEQ ID NO: 4725116 - DNA, 23 bp, Homo sapiens
cattttcgttacattgtgtcctg

SEQ ID NO: 4725117 - DNA, 15 bp, Homo sapiens
cattttctcagtgtg

SEQ ID NO: 4725118 - DNA, 18 bp, Homo sapiens
cattttcttgtcaatgga

SEQ ID NO: 4725119 - DNA, 18 bp, Homo sapiens
cattttgaatgtgatcat

SEQ ID NO: 4725120 - DNA, 20 bp, Homo sapiens
cattttgaatgtgatcatct

SEQ ID NO: 4725121 - DNA, 13 bp, Homo sapiens
cattttgccaaaa

SEQ ID NO: 4725122 - DNA, 20 bp, Homo sapiens
cattttgccaaaattattaa

SEQ ID NO: 4725123 - DNA, 20 bp, Homo sapiens
cattttggggtacccactgc

SEQ ID NO: 4725124 - DNA, 14 bp, Homo sapiens
cattttgtgaatgg

SEQ ID NO: 4725125 - DNA, 21 bp, Homo sapiens
cattttgtgaatggattggat

SEQ ID NO: 4725126 - DNA, 23 bp, Homo sapiens
catttttaactactgtattccca

SEQ ID NO: 4725127 - DNA, 19 bp, Homo sapiens
catttttagtagagacagg

SEQ ID NO: 4725128 - DNA, 20 bp, Homo sapiens
catttttcagatataaaaga

SEQ ID NO: 4725129 - DNA, 18 bp, Homo sapiens
catttttgaatacaggca

SEQ ID NO: 4725130 - DNA, 20 bp, Homo sapiens
catttttgaatacaggcata

SEQ ID NO: 4725131 - DNA, 13 bp, Homo sapiens
ccaccccttgctc

SEQ ID NO: 4725132 - DNA, 20 bp, Homo sapiens
ccaccctcaccgcggctgga

SEQ ID NO: 4725133 - DNA, 11 bp, Homo sapiens
ccaccctgctc

SEQ ID NO: 4725134 - DNA, 12 bp, Homo sapiens
ccaccctgctct

SEQ ID NO: 4725135 - DNA, 12 bp, Homo sapiens
ccaccctgggct

SEQ ID NO: 4725136 - DNA, 13 bp, Homo sapiens
ccaccctgggctc

SEQ ID NO: 4725137 - DNA, 18 bp, Homo sapiens
ccaccgcagacaggacca

SEQ ID NO: 4725138 - DNA, 19 bp, Homo sapiens
ccaccgcagacaggaccag

SEQ ID NO: 4725139 - DNA, 14 bp, Homo sapiens
ccaccgccatggct

SEQ ID NO: 4725140 - DNA, 17 bp, Homo sapiens
ccaccgccatggcttcc

SEQ ID NO: 4725141 - DNA, 17 bp, Homo sapiens
ccacctactcctgggtc

SEQ ID NO: 4725142 - DNA, 14 bp, Homo sapiens
ccacctagtctgta

SEQ ID NO: 4725143 - DNA, 23 bp, Homo sapiens
ccacctagtggctgtccagtgcc

SEQ ID NO: 4725144 - DNA, 14 bp, Homo sapiens
ccacctcagcctcc

SEQ ID NO: 4725145 - DNA, 12 bp, Homo sapiens
ccacctccttct

SEQ ID NO: 4725146 - DNA, 13 bp, Homo sapiens
ccacctccttctc

SEQ ID NO: 4725147 - DNA, 18 bp, Homo sapiens
ccacctccttctctgtct

SEQ ID NO: 4725148 - DNA, 13 bp, Homo sapiens
ccacctgccaggg

SEQ ID NO: 4725149 - DNA, 20 bp, Homo sapiens
ccacctggacccctgcattg

SEQ ID NO: 4725150 - DNA, 16 bp, Homo sapiens
ccaccttggctcaagt

SEQ ID NO: 4725151 - DNA, 16 bp, Homo sapiens
ccaccttggctgcagg

SEQ ID NO: 4725152 - DNA, 16 bp, Homo sapiens
ccacctttgtttctcc

SEQ ID NO: 4725153 - DNA, 21 bp, Homo sapiens
ccacggagccactcctctgac

SEQ ID NO: 4725154 - DNA, 12 bp, Homo sapiens
ccacggccaggc

SEQ ID NO: 4725155 - DNA, 23 bp, Homo sapiens
ccacggccaggccagagggagtg

SEQ ID NO: 4725156 - DNA, 17 bp, Homo sapiens
ccacggtggtcactgga

SEQ ID NO: 4725157 - DNA, 15 bp, Homo sapiens
ccacgtcctgtcagt

SEQ ID NO: 4725158 - DNA, 19 bp, Homo sapiens
ccacgtcctgtcagtgccg

SEQ ID NO: 4725159 - DNA, 23 bp, Homo sapiens
ccacgttctgctcatcattctct

SEQ ID NO: 4725160 - DNA, 20 bp, Homo sapiens
ccactaactagagcagccct

SEQ ID NO: 4725161 - DNA, 22 bp, Homo sapiens
ccactaactagagcagccctgg

SEQ ID NO: 4725162 - DNA, 14 bp, Homo sapiens
ccactcattccttc

SEQ ID NO: 4725163 - DNA, 11 bp, Homo sapiens
ccactcccact

SEQ ID NO: 4725164 - DNA, 17 bp, Homo sapiens
ccactcccacttccctg

SEQ ID NO: 4725165 - DNA, 19 bp, Homo sapiens
ccactcccctaaactccag

SEQ ID NO: 4725166 - DNA, 22 bp, Homo sapiens
ccactctgtgcctgaccttgag

SEQ ID NO: 4725167 - DNA, 13 bp, Homo sapiens
ccactgagggcag

SEQ ID NO: 4725168 - DNA, 17 bp, Homo sapiens
ccactgcaacttgtgaa

SEQ ID NO: 4725169 - DNA, 22 bp, Homo sapiens
ccactgcaacttgtgaactcca

SEQ ID NO: 4725170 - DNA, 11 bp, Homo sapiens
ccactgcaccc

SEQ ID NO: 4725171 - DNA, 14 bp, Homo sapiens
ccactgcaccccct

SEQ ID NO: 4725172 - DNA, 17 bp, Homo sapiens
ccactgcaccccctcct

SEQ ID NO: 4725173 - DNA, 18 bp, Homo sapiens
ccactgcaccccctcctg

SEQ ID NO: 4725174 - DNA, 20 bp, Homo sapiens
ccactgcaccccctcctgct

SEQ ID NO: 4725175 - DNA, 22 bp, Homo sapiens
ccactgcctttgacctgcctcc

SEQ ID NO: 4725176 - DNA, 11 bp, Homo sapiens
ccactgctctg

SEQ ID NO: 4725177 - DNA, 22 bp, Homo sapiens
ccactgcttttggtctgtgtga

SEQ ID NO: 4725178 - DNA, 16 bp, Homo sapiens
ccactgtgccatgtgc

SEQ ID NO: 4725179 - DNA, 18 bp, Homo sapiens
ccactgtggaagtccctc

SEQ ID NO: 4725180 - DNA, 18 bp, Homo sapiens
ccactgttgggtgggtgg

SEQ ID NO: 4725181 - DNA, 13 bp, Homo sapiens
ccacttaaaatgt

SEQ ID NO: 4725182 - DNA, 13 bp, Homo sapiens
ccacttcccctcc

SEQ ID NO: 4725183 - DNA, 16 bp, Homo sapiens
ccacttgttcattctg

SEQ ID NO: 4725184 - DNA, 20 bp, Homo sapiens
ccacttgttcattctgtgac

SEQ ID NO: 4725185 - DNA, 16 bp, Homo sapiens
ccactttctttctttc

SEQ ID NO: 4725186 - DNA, 15 bp, Homo sapiens
ccactttttgcagct

SEQ ID NO: 4725187 - DNA, 22 bp, Homo sapiens
ccagaaacctgggagagacttg

SEQ ID NO: 4725188 - DNA, 16 bp, Homo sapiens
ccagaagtattgttta

SEQ ID NO: 4725189 - DNA, 19 bp, Homo sapiens
ccagaagtattgtttacat

SEQ ID NO: 4725190 - DNA, 20 bp, Homo sapiens
ccagaagtattgtttacatt

SEQ ID NO: 4725191 - DNA, 21 bp, Homo sapiens
ccagaagtattgtttacatta

SEQ ID NO: 4725192 - DNA, 17 bp, Homo sapiens
ccagacacatgtccaag

SEQ ID NO: 4725193 - DNA, 22 bp, Homo sapiens
ccagacacatgtccaagaagcc

SEQ ID NO: 4725194 - DNA, 17 bp, Homo sapiens
ccagacaccttgacagg

SEQ ID NO: 4725195 - DNA, 20 bp, Homo sapiens
ccagacaccttgacagggca

SEQ ID NO: 4725196 - DNA, 17 bp, Homo sapiens
ccagacccggctgcgtg

SEQ ID NO: 4725197 - DNA, 21 bp, Homo sapiens
ccagagagggtggtgacctct

SEQ ID NO: 4725198 - DNA, 23 bp, Homo sapiens
ccagagagggtggtgacctctgc

SEQ ID NO: 4725199 - DNA, 14 bp, Homo sapiens
ccagagcaccctct

SEQ ID NO: 4725200 - DNA, 16 bp, Homo sapiens
ccagagcagatgcaga

SEQ ID NO: 4725201 - DNA, 22 bp, Homo sapiens
ccagagcccaccttggctcaag

SEQ ID NO: 4725202 - DNA, 16 bp, Homo sapiens
ccagagctctgaccca

SEQ ID NO: 4725203 - DNA, 11 bp, Homo sapiens
ccagaggctcg

SEQ ID NO: 4725204 - DNA, 19 bp, Homo sapiens
ccagagggagtgacagagg

SEQ ID NO: 4725205 - DNA, 22 bp, Homo sapiens
ccagagggagtgacagaggcag

SEQ ID NO: 4725206 - DNA, 18 bp, Homo sapiens
ccagaggggcctgccacc

SEQ ID NO: 4725207 - DNA, 18 bp, Homo sapiens
ccagagttccccatgcag

SEQ ID NO: 4725208 - DNA, 21 bp, Homo sapiens
ccagagttccccatgcagaca

SEQ ID NO: 4725209 - DNA, 13 bp, Homo sapiens
ccagatgcaccag

SEQ ID NO: 4725210 - DNA, 18 bp, Homo sapiens
ccagatgcaccagccctt

SEQ ID NO: 4725211 - DNA, 20 bp, Homo sapiens
ccagattctttcctgaggct

SEQ ID NO: 4725212 - DNA, 20 bp, Homo sapiens
ccagattgcaacaggctggg

SEQ ID NO: 4725213 - DNA, 19 bp, Homo sapiens
ccagattggctcacactga

SEQ ID NO: 4725214 - DNA, 20 bp, Homo sapiens
ccagattggctcacactgag

SEQ ID NO: 4725215 - DNA, 14 bp, Homo sapiens
ccagattttattta

SEQ ID NO: 4725216 - DNA, 15 bp, Homo sapiens
ccagcaagtgagagc

SEQ ID NO: 4725217 - DNA, 23 bp, Homo sapiens
ctgaggcccttctctccagcccc

SEQ ID NO: 4725218 - DNA, 15 bp, Homo sapiens
ctgaggctgggctcc

SEQ ID NO: 4725219 - DNA, 20 bp, Homo sapiens
ctgagtagctgggattacag

SEQ ID NO: 4725220 - DNA, 20 bp, Homo sapiens
ctgagtcagctgaccccctc

SEQ ID NO: 4725221 - DNA, 22 bp, Homo sapiens
ctgagtcagctgaccccctccc

SEQ ID NO: 4725222 - DNA, 13 bp, Homo sapiens
ctgagtctgaagg

SEQ ID NO: 4725223 - DNA, 15 bp, Homo sapiens
ctgagtctgaaggct

SEQ ID NO: 4725224 - DNA, 17 bp, Homo sapiens
ctgagtctgaaggctgg

SEQ ID NO: 4725225 - DNA, 14 bp, Homo sapiens
ctgagtctggcaaa

SEQ ID NO: 4725226 - DNA, 15 bp, Homo sapiens
ctgagtctggcaaac

SEQ ID NO: 4725227 - DNA, 18 bp, Homo sapiens
ctgagtctggcaaacatg

SEQ ID NO: 4725228 - DNA, 13 bp, Homo sapiens
ctgagtgcctggc

SEQ ID NO: 4725229 - DNA, 22 bp, Homo sapiens
ctgagttgcaccattctttctt

SEQ ID NO: 4725230 - DNA, 22 bp, Homo sapiens
ctgataacaacctggagaccag

SEQ ID NO: 4725231 - DNA, 15 bp, Homo sapiens
ctgatacgtgtatga

SEQ ID NO: 4725232 - DNA, 18 bp, Homo sapiens
ctgatagctaagtgagtt

SEQ ID NO: 4725233 - DNA, 14 bp, Homo sapiens
ctgatcagagccgt

SEQ ID NO: 4725234 - DNA, 12 bp, Homo sapiens
ctgatccctcta

SEQ ID NO: 4725235 - DNA, 23 bp, Homo sapiens
ctgatcctgtgaagtaaggatgt

SEQ ID NO: 4725236 - DNA, 17 bp, Homo sapiens
ctgatgaaaataaagaa

SEQ ID NO: 4725237 - DNA, 19 bp, Homo sapiens
ctgatgaaaataaagaatg

SEQ ID NO: 4725238 - DNA, 20 bp, Homo sapiens
ctgatgaaaataaagaatgg

SEQ ID NO: 4725239 - DNA, 23 bp, Homo sapiens
ctgatgcagtcacgtggaggagc

SEQ ID NO: 4725240 - DNA, 14 bp, Homo sapiens
ctgatggacaagga

SEQ ID NO: 4725241 - DNA, 15 bp, Homo sapiens
ctgatggacctgtca

SEQ ID NO: 4725242 - DNA, 18 bp, Homo sapiens
ctgatggcttctccaggg

SEQ ID NO: 4725243 - DNA, 19 bp, Homo sapiens
ctgatggcttctccagggt

SEQ ID NO: 4725244 - DNA, 20 bp, Homo sapiens
ctgatgtttataaactgaga

SEQ ID NO: 4725245 - DNA, 18 bp, Homo sapiens
ctgattcccaagctctgc

SEQ ID NO: 4725246 - DNA, 19 bp, Homo sapiens
ctgattcccaagctctgct

SEQ ID NO: 4725247 - DNA, 14 bp, Homo sapiens
ctgattctcagggt

SEQ ID NO: 4725248 - DNA, 22 bp, Homo sapiens
ctgattcttgttgctgtacaaa

SEQ ID NO: 4725249 - DNA, 21 bp, Homo sapiens
ctgatttagcaatgctgtgaa

SEQ ID NO: 4725250 - DNA, 23 bp, Homo sapiens
ctgatttagcaatgctgtgaata

SEQ ID NO: 4725251 - DNA, 21 bp, Homo sapiens
ctgatttgctgggcagttttt

SEQ ID NO: 4725252 - DNA, 18 bp, Homo sapiens
ctgcaaaaggactctcag

SEQ ID NO: 4725253 - DNA, 21 bp, Homo sapiens
ctgcaaagggtatcaggtgct

SEQ ID NO: 4725254 - DNA, 22 bp, Homo sapiens
ctgcaaagggtatcaggtgctg

SEQ ID NO: 4725255 - DNA, 19 bp, Homo sapiens
ctgcaaatactgtatattc

SEQ ID NO: 4725256 - DNA, 12 bp, Homo sapiens
ctgcaacatgga

SEQ ID NO: 4725257 - DNA, 19 bp, Homo sapiens
ctgcaacctgattgtgtct

SEQ ID NO: 4725258 - DNA, 20 bp, Homo sapiens
ctgcaacttgtgaactccat

SEQ ID NO: 4725259 - DNA, 18 bp, Homo sapiens
ctgcaatgtgggcagaga

SEQ ID NO: 4725260 - DNA, 17 bp, Homo sapiens
ctgcaatgtttttgtgt

SEQ ID NO: 4725261 - DNA, 22 bp, Homo sapiens
ctgcacaataaaaccaagcctc

SEQ ID NO: 4725262 - DNA, 23 bp, Homo sapiens
ctgcacaataaaaccaagcctct

SEQ ID NO: 4725263 - DNA, 13 bp, Homo sapiens
ctgcacacagcac

SEQ ID NO: 4725264 - DNA, 19 bp, Homo sapiens
ctgcacactcagttctgct

SEQ ID NO: 4725265 - DNA, 22 bp, Homo sapiens
ctgcacagggtttggcccaagt

SEQ ID NO: 4725266 - DNA, 21 bp, Homo sapiens
ctgcaccaacccagccgctgc

SEQ ID NO: 4725267 - DNA, 14 bp, Homo sapiens
ctgcaccccctcct

SEQ ID NO: 4725268 - DNA, 17 bp, Homo sapiens
ctgcaccccctcctgct

SEQ ID NO: 4725269 - DNA, 20 bp, Homo sapiens
ctgcaccccctcctgctgca

SEQ ID NO: 4725270 - DNA, 14 bp, Homo sapiens
ctgcaccgggccac

SEQ ID NO: 4725271 - DNA, 15 bp, Homo sapiens
ctgcaccgggccaca

SEQ ID NO: 4725272 - DNA, 18 bp, Homo sapiens
ctgcaccgggccacagag

SEQ ID NO: 4725273 - DNA, 23 bp, Homo sapiens
ctgcaccgggccacagagaaagt

SEQ ID NO: 4725274 - DNA, 11 bp, Homo sapiens
ctgcacctgca

SEQ ID NO: 4725275 - DNA, 22 bp, Homo sapiens
ctgcaccttctgacgcagcctg

SEQ ID NO: 4725276 - DNA, 23 bp, Homo sapiens
ctgcaccttctgacgcagcctga

SEQ ID NO: 4725277 - DNA, 17 bp, Homo sapiens
ctgcactaacagagtgg

SEQ ID NO: 4725278 - DNA, 17 bp, Homo sapiens
ctgcactatagcctagg

SEQ ID NO: 4725279 - DNA, 22 bp, Homo sapiens
ctgcactatagcctaggtgaca

SEQ ID NO: 4725280 - DNA, 16 bp, Homo sapiens
ctgcactcccctgctg

SEQ ID NO: 4725281 - DNA, 17 bp, Homo sapiens
ctgcactcccctgctgg

SEQ ID NO: 4725282 - DNA, 19 bp, Homo sapiens
ctgcactcccctgctgggt

SEQ ID NO: 4725283 - DNA, 13 bp, Homo sapiens
ctgcactctgtgc

SEQ ID NO: 4725284 - DNA, 14 bp, Homo sapiens
ctgcactctgtgcc

SEQ ID NO: 4725285 - DNA, 15 bp, Homo sapiens
ctgcactctgtgccc

SEQ ID NO: 4725286 - DNA, 20 bp, Homo sapiens
ctgcactctgtgcccatggg

SEQ ID NO: 4725287 - DNA, 22 bp, Homo sapiens
ctgcactctgtgcccatgggca

SEQ ID NO: 4725288 - DNA, 13 bp, Homo sapiens
ctgcactgtcctg

SEQ ID NO: 4725289 - DNA, 14 bp, Homo sapiens
ctgcactgtcctgc

SEQ ID NO: 4725290 - DNA, 16 bp, Homo sapiens
ctgcactgtcctgctc

SEQ ID NO: 4725291 - DNA, 14 bp, Homo sapiens
ctgcacttgcagac

SEQ ID NO: 4725292 - DNA, 16 bp, Homo sapiens
ctgcacttgcagactc

SEQ ID NO: 4725293 - DNA, 23 bp, Homo sapiens
ctgcacttgcagactctacagag

SEQ ID NO: 4725294 - DNA, 14 bp, Homo sapiens
ctgcagaggggcag

SEQ ID NO: 4725295 - DNA, 22 bp, Homo sapiens
ctgcagcagggcaggaagggga

SEQ ID NO: 4725296 - DNA, 22 bp, Homo sapiens
ctgcagcctcaacctcctgggc

SEQ ID NO: 4725297 - DNA, 13 bp, Homo sapiens
ctgcaggaaggag

SEQ ID NO: 4725298 - DNA, 17 bp, Homo sapiens
ctgcaggcagccaggcc

SEQ ID NO: 4725299 - DNA, 23 bp, Homo sapiens
ctgcagggaaaattatttgcata

SEQ ID NO: 4725300 - DNA, 19 bp, Homo sapiens
ctgcagtcacttcgtggga

SEQ ID NO: 4725301 - DNA, 21 bp, Homo sapiens
ctgcagtgtggcaagcaagag

SEQ ID NO: 4725302 - DNA, 16 bp, Homo sapiens
ctgcagttgccagtca

SEQ ID NO: 4725303 - DNA, 17 bp, Homo sapiens
ctgcagttgccagtcac

SEQ ID NO: 4725304 - DNA, 22 bp, Homo sapiens
ctgcagttgccagtcaccccgg

SEQ ID NO: 4725305 - DNA, 18 bp, Homo sapiens
ctgcatgtaaaatcttca

SEQ ID NO: 4725306 - DNA, 20 bp, Homo sapiens
ctgcatgtaaaatcttcagc

SEQ ID NO: 4725307 - DNA, 21 bp, Homo sapiens
ctgcatgtaaaatcttcagct

SEQ ID NO: 4725308 - DNA, 22 bp, Homo sapiens
ctgcatgtaaaatcttcagctg

SEQ ID NO: 4725309 - DNA, 22 bp, Homo sapiens
ctgccaacttcttcagagctga

SEQ ID NO: 4725310 - DNA, 15 bp, Homo sapiens
ctgccacacctgagc

SEQ ID NO: 4725311 - DNA, 16 bp, Homo sapiens
ctgccacacctgagcc

SEQ ID NO: 4725312 - DNA, 18 bp, Homo sapiens
ctgccaccaccagaaagc

SEQ ID NO: 4725313 - DNA, 12 bp, Homo sapiens
ctgccacctgga

SEQ ID NO: 4725314 - DNA, 18 bp, Homo sapiens
ctgctgcagaggggcagg

SEQ ID NO: 4725315 - DNA, 21 bp, Homo sapiens
ctgctgcagaggggcaggccc

SEQ ID NO: 4725316 - DNA, 22 bp, Homo sapiens
ctgctgcagaggggcaggccct

SEQ ID NO: 4725317 - DNA, 13 bp, Homo sapiens
ctgctgcagttgc

SEQ ID NO: 4725318 - DNA, 15 bp, Homo sapiens
ctgctgcccctccct

SEQ ID NO: 4725319 - DNA, 17 bp, Homo sapiens
ctgctgcccctccctgc

SEQ ID NO: 4725320 - DNA, 18 bp, Homo sapiens
ctgctgcccctccctgcc

SEQ ID NO: 4725321 - DNA, 19 bp, Homo sapiens
ctgctgcccctccctgcct

SEQ ID NO: 4725322 - DNA, 22 bp, Homo sapiens
ctgctgcccctccctgcctcca

SEQ ID NO: 4725323 - DNA, 11 bp, Homo sapiens
ctgctgcctgc

SEQ ID NO: 4725324 - DNA, 13 bp, Homo sapiens
ctgctgctggctg

SEQ ID NO: 4725325 - DNA, 22 bp, Homo sapiens
ctgctggctggtgcctgagccc

SEQ ID NO: 4725326 - DNA, 16 bp, Homo sapiens
ctgctggctgtgacaa

SEQ ID NO: 4725327 - DNA, 15 bp, Homo sapiens
ctgctgggctggggc

SEQ ID NO: 4725328 - DNA, 21 bp, Homo sapiens
ctgctgggtggcccatccccc

SEQ ID NO: 4725329 - DNA, 16 bp, Homo sapiens
ctcccctccccaactg

SEQ ID NO: 4725330 - DNA, 12 bp, Homo sapiens
ctcccctcctct

SEQ ID NO: 4725331 - DNA, 15 bp, Homo sapiens
ctcccctgccagggc

SEQ ID NO: 4725332 - DNA, 18 bp, Homo sapiens
ctcccctgcccccaggac

SEQ ID NO: 4725333 - DNA, 22 bp, Homo sapiens
ctcccctgcccccaggactggg

SEQ ID NO: 4725334 - DNA, 18 bp, Homo sapiens
ctcccctgccccctgcag

SEQ ID NO: 4725335 - DNA, 19 bp, Homo sapiens
ctcccctgccccctgcagg

SEQ ID NO: 4725336 - DNA, 17 bp, Homo sapiens
ctcatagccctcaccct

SEQ ID NO: 4725337 - DNA, 21 bp, Homo sapiens
ctcatagccctcaccctgggg

SEQ ID NO: 4725338 - DNA, 18 bp, Homo sapiens
ctcatagtatggtggctg

SEQ ID NO: 4725339 - DNA, 20 bp, Homo sapiens
ctcatagtatggtggctggg

SEQ ID NO: 4725340 - DNA, 14 bp, Homo sapiens
cccacctcagcctc

SEQ ID NO: 4725341 - DNA, 15 bp, Homo sapiens
cccacctcagcctcc

SEQ ID NO: 4725342 - DNA, 14 bp, Homo sapiens
cccacctctctcac

SEQ ID NO: 4725343 - DNA, 15 bp, Homo sapiens
cccacctggcctctg

SEQ ID NO: 4725344 - DNA, 16 bp, Homo sapiens
cccacctggcctctgc

SEQ ID NO: 4725345 - DNA, 16 bp, Homo sapiens
cccaccttggctgcag

SEQ ID NO: 4725346 - DNA, 19 bp, Homo sapiens
cccaccttggctgcaggga

SEQ ID NO: 4725347 - DNA, 20 bp, Homo sapiens
cccaccttggctgcagggag

SEQ ID NO: 4725348 - DNA, 15 bp, Homo sapiens
cccacgcccccactg

SEQ ID NO: 4725349 - DNA, 17 bp, Homo sapiens
cccacgcccccactggt

SEQ ID NO: 4725350 - DNA, 15 bp, Homo sapiens
cccacgtcctgtcag

SEQ ID NO: 4725351 - DNA, 22 bp, Homo sapiens
cccacgtcctgtcagtgccgcc

SEQ ID NO: 4725352 - DNA, 12 bp, Homo sapiens
cccactccctgc

SEQ ID NO: 4725353 - DNA, 13 bp, Homo sapiens
cccactccctgca

SEQ ID NO: 4725354 - DNA, 19 bp, Homo sapiens
cccactgcaacttgtgaac

SEQ ID NO: 4725355 - DNA, 14 bp, Homo sapiens
cccactgcaccccc

SEQ ID NO: 4725356 - DNA, 15 bp, Homo sapiens
cccactgcaccccct

SEQ ID NO: 4725357 - DNA, 21 bp, Homo sapiens
cccactgcaccccctcctgct

SEQ ID NO: 4725358 - DNA, 14 bp, Homo sapiens
cccactgcctttga

SEQ ID NO: 4725359 - DNA, 16 bp, Homo sapiens
cccactggactcacct

SEQ ID NO: 4725360 - DNA, 23 bp, Homo sapiens
ccagccgctgcccggcgccctct

SEQ ID NO: 4725361 - DNA, 18 bp, Homo sapiens
ccagcctgacaacagcct

SEQ ID NO: 4725362 - DNA, 20 bp, Homo sapiens
ccagcctgacaacagcctga

SEQ ID NO: 4725363 - DNA, 21 bp, Homo sapiens
ccagcctgacaacagcctgag

SEQ ID NO: 4725364 - DNA, 23 bp, Homo sapiens
ccagccttgaccattctccacct

SEQ ID NO: 4725365 - DNA, 16 bp, Homo sapiens
ccagcgagccctggtg

SEQ ID NO: 4725366 - DNA, 21 bp, Homo sapiens
ccagcgagccctggtggcagt

SEQ ID NO: 4725367 - DNA, 17 bp, Homo sapiens
ccagcgtcctcctctgt

SEQ ID NO: 4725368 - DNA, 22 bp, Homo sapiens
ccagctatgttatattgaaaaa

SEQ ID NO: 4725369 - DNA, 12 bp, Homo sapiens
ccagctcctcat

SEQ ID NO: 4725370 - DNA, 23 bp, Homo sapiens
ccagctcctcatccagggctctg

SEQ ID NO: 4725371 - DNA, 11 bp, Homo sapiens
ccagctctggt

SEQ ID NO: 4725372 - DNA, 21 bp, Homo sapiens
ccagctctggtccatagagag

SEQ ID NO: 4725373 - DNA, 22 bp, Homo sapiens
ccagctctggtccatagagagc

SEQ ID NO: 4725374 - DNA, 20 bp, Homo sapiens
ccagctgacagtcctctcca

SEQ ID NO: 4725375 - DNA, 22 bp, Homo sapiens
ccagctgacagtcctctccacc

SEQ ID NO: 4725376 - DNA, 14 bp, Homo sapiens
ccagctggccggga

SEQ ID NO: 4725377 - DNA, 20 bp, Homo sapiens
ccagctgtgctctggacagg

SEQ ID NO: 4725378 - DNA, 22 bp, Homo sapiens
ccagctgtgctctggacaggca

SEQ ID NO: 4725379 - DNA, 23 bp, Homo sapiens
ccagctgtgctctggacaggcat

SEQ ID NO: 4725380 - DNA, 18 bp, Homo sapiens
ccagcttgaaaccttcac

SEQ ID NO: 4725381 - DNA, 20 bp, Homo sapiens
ccagcttgaaaccttcactt

SEQ ID NO: 4725382 - DNA, 16 bp, Homo sapiens
ccaggaaaggctccag

SEQ ID NO: 4725383 - DNA, 19 bp, Homo sapiens
ccaggaaaggctccaggag

SEQ ID NO: 4725384 - DNA, 15 bp, Homo sapiens
ccaggaagaaggtgt

SEQ ID NO: 4725385 - DNA, 11 bp, Homo sapiens
ccaggacccca

SEQ ID NO: 4725386 - DNA, 12 bp, Homo sapiens
ccaggactctgc

SEQ ID NO: 4725387 - DNA, 13 bp, Homo sapiens
ccaggactctgca

SEQ ID NO: 4725388 - DNA, 15 bp, Homo sapiens
ccaggactctgcagc

SEQ ID NO: 4725389 - DNA, 18 bp, Homo sapiens
ccaggactctgcagcctc

SEQ ID NO: 4725390 - DNA, 13 bp, Homo sapiens
ccaggactgagat

SEQ ID NO: 4725391 - DNA, 21 bp, Homo sapiens
ccaggactgagatgcaaatgt

SEQ ID NO: 4725392 - DNA, 12 bp, Homo sapiens
ccaggactgggc

SEQ ID NO: 4725393 - DNA, 12 bp, Homo sapiens
ccaggagaactg

SEQ ID NO: 4725394 - DNA, 13 bp, Homo sapiens
ccaggagcagcca

SEQ ID NO: 4725395 - DNA, 19 bp, Homo sapiens
ccaggagccccgaggcctt

SEQ ID NO: 4725396 - DNA, 20 bp, Homo sapiens
ccaggagccccgaggccttc

SEQ ID NO: 4725397 - DNA, 19 bp, Homo sapiens
ccaggagctcccctcccca

SEQ ID NO: 4725398 - DNA, 18 bp, Homo sapiens
ccaggaggccagccttga

SEQ ID NO: 4725399 - DNA, 20 bp, Homo sapiens
ccaggaggccagccttgacc

SEQ ID NO: 4725400 - DNA, 14 bp, Homo sapiens
ccaggatcatggtg

SEQ ID NO: 4725401 - DNA, 20 bp, Homo sapiens
ccaggatgagcatcccagga

SEQ ID NO: 4725402 - DNA, 22 bp, Homo sapiens
ccaggattggggacctgatgga

SEQ ID NO: 4725403 - DNA, 23 bp, Homo sapiens
ccaggcaggtcttgaactcctgg

SEQ ID NO: 4725404 - DNA, 22 bp, Homo sapiens
ccaggcattccccaggaggcca

SEQ ID NO: 4725405 - DNA, 16 bp, Homo sapiens
ccaggcattgccaagg

SEQ ID NO: 4725406 - DNA, 17 bp, Homo sapiens
ccaggccaggactctgc

SEQ ID NO: 4725407 - DNA, 20 bp, Homo sapiens
ccaggccaggactctgcagc

SEQ ID NO: 4725408 - DNA, 22 bp, Homo sapiens
ccaggccaggactctgcagcct

SEQ ID NO: 4725409 - DNA, 23 bp, Homo sapiens
ccaggccaggactctgcagcctc

SEQ ID NO: 4725410 - DNA, 13 bp, Homo sapiens
ccaggcccctgcc

SEQ ID NO: 4725411 - DNA, 19 bp, Homo sapiens
ccaggcccctgccaccctg

SEQ ID NO: 4725412 - DNA, 13 bp, Homo sapiens
ccaggcctgggcc

SEQ ID NO: 4725413 - DNA, 21 bp, Homo sapiens
ccaggctcctttagcgcccag

SEQ ID NO: 4725414 - DNA, 14 bp, Homo sapiens
ccaggctgagcctc

SEQ ID NO: 4725415 - DNA, 13 bp, Homo sapiens
ccaggctggccag

SEQ ID NO: 4725416 - DNA, 18 bp, Homo sapiens
ccaggctggccagcccca

SEQ ID NO: 4725417 - DNA, 19 bp, Homo sapiens
ccaggctggcgtgcagtgg

SEQ ID NO: 4725418 - DNA, 14 bp, Homo sapiens
ccaggctgggagag

SEQ ID NO: 4725419 - DNA, 15 bp, Homo sapiens
ccaggctgggagagc

SEQ ID NO: 4725420 - DNA, 23 bp, Homo sapiens
ccaggctgggagagccttccagg

SEQ ID NO: 4725421 - DNA, 20 bp, Homo sapiens
ccaggctgggcaaggaggcc

SEQ ID NO: 4725422 - DNA, 24 bp, Homo sapiens
ccaggctgtatcccatgagcctca

SEQ ID NO: 4725423 - DNA, 20 bp, Homo sapiens
ccaggcttagtcactgagac

SEQ ID NO: 4725424 - DNA, 21 bp, Homo sapiens
ccaggcttagtcactgagaca

SEQ ID NO: 4725425 - DNA, 22 bp, Homo sapiens
ccaggcttagtcactgagacag

SEQ ID NO: 4725426 - DNA, 23 bp, Homo sapiens
ccaggcttagtcactgagacagc

SEQ ID NO: 4725427 - DNA, 14 bp, Homo sapiens
ccagggaaaaagac

SEQ ID NO: 4725428 - DNA, 17 bp, Homo sapiens
ccagggagagcccagga

SEQ ID NO: 4725429 - DNA, 20 bp, Homo sapiens
ccagggagagcccaggagct

SEQ ID NO: 4725430 - DNA, 21 bp, Homo sapiens
ccagggagagcccaggagctc

SEQ ID NO: 4725431 - DNA, 23 bp, Homo sapiens
ccagggagagcccaggagctccc

SEQ ID NO: 4725432 - DNA, 13 bp, Homo sapiens
ccagggcagccag

SEQ ID NO: 4725433 - DNA, 17 bp, Homo sapiens
ccagggcctggaagaca

SEQ ID NO: 4725434 - DNA, 20 bp, Homo sapiens
ccagggcctggaagacagag

SEQ ID NO: 4725435 - DNA, 16 bp, Homo sapiens
ccagggctggactgag

SEQ ID NO: 4725436 - DNA, 18 bp, Homo sapiens
ccaggggacgcgctggaa

SEQ ID NO: 4725437 - DNA, 16 bp, Homo sapiens
ccaggggcaggcacag

SEQ ID NO: 4725438 - DNA, 17 bp, Homo sapiens
ccaggggcaggcacagc

SEQ ID NO: 4725439 - DNA, 20 bp, Homo sapiens
ccaggggtgggacaccctgt

SEQ ID NO: 4725440 - DNA, 18 bp, Homo sapiens
ccagggttgaccccagag

SEQ ID NO: 4725441 - DNA, 23 bp, Homo sapiens
ccaggtaagcaggaggaggtgcc

SEQ ID NO: 4725442 - DNA, 14 bp, Homo sapiens
ccaggtctcctcca

SEQ ID NO: 4725443 - DNA, 15 bp, Homo sapiens
ccaggtctcctccac

SEQ ID NO: 4725444 - DNA, 22 bp, Homo sapiens
ccaggtgggcgggcagcacagc

SEQ ID NO: 4725445 - DNA, 23 bp, Homo sapiens
ccaggtgggcgggcagcacagca

SEQ ID NO: 4725446 - DNA, 18 bp, Homo sapiens
cgatgtcctcctctgtga

SEQ ID NO: 4725447 - DNA, 13 bp, Homo sapiens
cgattcttctgct

SEQ ID NO: 4725448 - DNA, 19 bp, Homo sapiens
cgattcttctgcttcagcc

SEQ ID NO: 4725449 - DNA, 16 bp, Homo sapiens
cgggctctgcctccca

SEQ ID NO: 4725450 - DNA, 23 bp, Homo sapiens
cggggacagctccttctgtccta

SEQ ID NO: 4725451 - DNA, 22 bp, Homo sapiens
cggggaggagagagcagcttct

SEQ ID NO: 4725452 - DNA, 17 bp, Homo sapiens
cggggcgtttctttgcc

SEQ ID NO: 4725453 - DNA, 16 bp, Homo sapiens
cggggctcttctcatt

SEQ ID NO: 4725454 - DNA, 12 bp, Homo sapiens
cggggctgggtt

SEQ ID NO: 4725455 - DNA, 15 bp, Homo sapiens
cggggcttggctgag

SEQ ID NO: 4725456 - DNA, 14 bp, Homo sapiens
cggtccacccagga

SEQ ID NO: 4725457 - DNA, 15 bp, Homo sapiens
cggtccacccaggag

SEQ ID NO: 4725458 - DNA, 16 bp, Homo sapiens
cggtccacccaggagc

SEQ ID NO: 4725459 - DNA, 19 bp, Homo sapiens
cggtgggggtagggggctg

SEQ ID NO: 4725460 - DNA, 12 bp, Homo sapiens
cgtaatttaact

SEQ ID NO: 4725461 - DNA, 18 bp, Homo sapiens
cgtatgaagacagaggca

SEQ ID NO: 4725462 - DNA, 15 bp, Homo sapiens
cgtcagtattttccc

SEQ ID NO: 4725463 - DNA, 13 bp, Homo sapiens
cgtcctcctctgt

SEQ ID NO: 4725464 - DNA, 14 bp, Homo sapiens
cgtcctgaggggga

SEQ ID NO: 4725465 - DNA, 18 bp, Homo sapiens
cgtcctgatgatttttat

SEQ ID NO: 4725466 - DNA, 14 bp, Homo sapiens
cgtcctgtcagtgc

SEQ ID NO: 4725467 - DNA, 16 bp, Homo sapiens
cgtcctgtcagtgccg

SEQ ID NO: 4725468 - DNA, 14 bp, Homo sapiens
cgtctacctgaggg

SEQ ID NO: 4725469 - DNA, 19 bp, Homo sapiens
cgtctgacaaatgtgtatg

SEQ ID NO: 4725470 - DNA, 19 bp, Homo sapiens
cgtctgtgtgtgcctgtgt

SEQ ID NO: 4725471 - DNA, 18 bp, Homo sapiens
cgtcttttcctgtttcct

SEQ ID NO: 4725472 - DNA, 13 bp, Homo sapiens
cgtgaagggattt

SEQ ID NO: 4725473 - DNA, 15 bp, Homo sapiens
cgtgacaacacttgt

SEQ ID NO: 4725474 - DNA, 17 bp, Homo sapiens
cgtgacaataaaacatt

SEQ ID NO: 4725475 - DNA, 19 bp, Homo sapiens
cgtgacaataaaacattaa

SEQ ID NO: 4725476 - DNA, 14 bp, Homo sapiens
cgtgagacctgccc

SEQ ID NO: 4725477 - DNA, 14 bp, Homo sapiens
cgtgagccactgca

SEQ ID NO: 4725478 - DNA, 13 bp, Homo sapiens
cgtgattctgttc

SEQ ID NO: 4725479 - DNA, 21 bp, Homo sapiens
cgtgccagtcgcgctgcctgt

SEQ ID NO: 4725480 - DNA, 16 bp, Homo sapiens
cgtggacaggtgtgcc

SEQ ID NO: 4725481 - DNA, 17 bp, Homo sapiens
cgtggagcagaatcagt

SEQ ID NO: 4725482 - DNA, 18 bp, Homo sapiens
cgtggagcagaatcagta

SEQ ID NO: 4725483 - DNA, 13 bp, Homo sapiens
cgtggccccagcc

SEQ ID NO: 4725484 - DNA, 17 bp, Homo sapiens
cgtggccccagcctggc

SEQ ID NO: 4725485 - DNA, 16 bp, Homo sapiens
cgtgtaatattctctg

SEQ ID NO: 4725486 - DNA, 18 bp, Homo sapiens
cgtgtatgtacctaggat

SEQ ID NO: 4725487 - DNA, 22 bp, Homo sapiens
cgtgtgtgtgtgtgtgtgtgaa

SEQ ID NO: 4725488 - DNA, 23 bp, Homo sapiens
cgtgtgtttttctattaaaagac

SEQ ID NO: 4725489 - DNA, 14 bp, Homo sapiens
cgttctgctcatca

SEQ ID NO: 4725490 - DNA, 18 bp, Homo sapiens
cgttgtctccctggccct

SEQ ID NO: 4725491 - DNA, 18 bp, Homo sapiens
cgttgttcccactgaaat

SEQ ID NO: 4725492 - DNA, 20 bp, Homo sapiens
cgtttaatatattttttgaa

SEQ ID NO: 4725493 - DNA, 12 bp, Homo sapiens
cgtttcctaccg

SEQ ID NO: 4725494 - DNA, 21 bp, Homo sapiens
cgtttgatagtgcttcttgta

SEQ ID NO: 4725495 - DNA, 23 bp, Homo sapiens
cgtttttataaaaaatggtgcct

SEQ ID NO: 4725496 - DNA, 13 bp, Homo sapiens
cgtttttccttta

SEQ ID NO: 4725497 - DNA, 13 bp, Homo sapiens
ctaaaaagtataa

SEQ ID NO: 4725498 - DNA, 17 bp, Homo sapiens
ctaaaaagtataaaata

SEQ ID NO: 4725499 - DNA, 22 bp, Homo sapiens
ctaaaaatttttacaaaactgc

SEQ ID NO: 4725500 - DNA, 22 bp, Homo sapiens
ctaaaacctgagctagaagctg

SEQ ID NO: 4725501 - DNA, 22 bp, Homo sapiens
ctaaaataagggcagagtcaca

SEQ ID NO: 4725502 - DNA, 19 bp, Homo sapiens
ctaaaatcattgtcaaaat

SEQ ID NO: 4725503 - DNA, 13 bp, Homo sapiens
ctaaaatttaatt

SEQ ID NO: 4725504 - DNA, 15 bp, Homo sapiens
ctaaaccctctgtga

SEQ ID NO: 4725505 - DNA, 21 bp, Homo sapiens
ctaaactgccccctctgccct

SEQ ID NO: 4725506 - DNA, 22 bp, Homo sapiens
ctaaagaaatatattattcatc

SEQ ID NO: 4725507 - DNA, 21 bp, Homo sapiens
ctaaagtagtttaagtctcct

SEQ ID NO: 4725508 - DNA, 23 bp, Homo sapiens
ctaaattatttactgcaaaaaga

SEQ ID NO: 4725509 - DNA, 14 bp, Homo sapiens
ctaaatttcttcct

SEQ ID NO: 4725510 - DNA, 17 bp, Homo sapiens
ctaacatttaggagaag

SEQ ID NO: 4725511 - DNA, 12 bp, Homo sapiens
ctaaccacgctg

SEQ ID NO: 4725512 - DNA, 14 bp, Homo sapiens
ctaaccacgctgga

SEQ ID NO: 4725513 - DNA, 15 bp, Homo sapiens
ctaacctcatcttct

SEQ ID NO: 4725514 - DNA, 17 bp, Homo sapiens
ctaacctcgggcctgct

SEQ ID NO: 4725515 - DNA, 20 bp, Homo sapiens
ctaactagagcagccctgga

SEQ ID NO: 4725516 - DNA, 15 bp, Homo sapiens
ctaactcacctaact

SEQ ID NO: 4725517 - DNA, 20 bp, Homo sapiens
ctaactcatactgtgctgga

SEQ ID NO: 4725518 - DNA, 23 bp, Homo sapiens
ctaagcacgggccatatgaataa

SEQ ID NO: 4725519 - DNA, 19 bp, Homo sapiens
ctaagccagcaccggacca

SEQ ID NO: 4725520 - DNA, 18 bp, Homo sapiens
ctaaggaagctaaaagca

SEQ ID NO: 4725521 - DNA, 20 bp, Homo sapiens
ctaaggcatgtgtgaaacat

SEQ ID NO: 4725522 - DNA, 21 bp, Homo sapiens
ctaaggcgtggagctgcctga

SEQ ID NO: 4725523 - DNA, 23 bp, Homo sapiens
ctaagggaggcacttcctcccct

SEQ ID NO: 4725524 - DNA, 15 bp, Homo sapiens
ctaaggtgtgctctg

SEQ ID NO: 4725525 - DNA, 16 bp, Homo sapiens
ctaaggtgtgctctga

SEQ ID NO: 4725526 - DNA, 14 bp, Homo sapiens
ctaagtctttccat

SEQ ID NO: 4725527 - DNA, 16 bp, Homo sapiens
ctaagtctttccattg

SEQ ID NO: 4725528 - DNA, 17 bp, Homo sapiens
ctaatactttgtttatt

SEQ ID NO: 4725529 - DNA, 21 bp, Homo sapiens
ctaatcataacatagttgaaa

SEQ ID NO: 4725530 - DNA, 22 bp, Homo sapiens
ctaatgaatgcataaaatgtta

SEQ ID NO: 4725531 - DNA, 15 bp, Homo sapiens
ctaatgacattcaat

SEQ ID NO: 4725532 - DNA, 13 bp, Homo sapiens
ctaatgagtattt

SEQ ID NO: 4725533 - DNA, 12 bp, Homo sapiens
ctaatgggacac

SEQ ID NO: 4725534 - DNA, 16 bp, Homo sapiens
ctaatgtttgtgagaa

SEQ ID NO: 4725535 - DNA, 14 bp, Homo sapiens
ctaattagaaatca

SEQ ID NO: 4725536 - DNA, 16 bp, Homo sapiens
ctaattagaaatcaac

SEQ ID NO: 4725537 - DNA, 22 bp, Homo sapiens
ctaattataccccctgcaaagc

SEQ ID NO: 4725538 - DNA, 18 bp, Homo sapiens
ctaattatttaattgtcc

SEQ ID NO: 4725539 - DNA, 19 bp, Homo sapiens
ctaattttccataagctat

SEQ ID NO: 4725540 - DNA, 21 bp, Homo sapiens
ctaattttccataagctattt

SEQ ID NO: 4725541 - DNA, 22 bp, Homo sapiens
ctaattttggataatattcatt

SEQ ID NO: 4725542 - DNA, 20 bp, Homo sapiens
ctacaaacaaaatttctatt

SEQ ID NO: 4725543 - DNA, 13 bp, Homo sapiens
ctacacaacatgt

SEQ ID NO: 4725544 - DNA, 22 bp, Homo sapiens
ctacacagctgtttcctcacgt

SEQ ID NO: 4725545 - DNA, 15 bp, Homo sapiens
ctacactcacctgca

SEQ ID NO: 4725546 - DNA, 17 bp, Homo sapiens
ctacagagcttccctga

SEQ ID NO: 4725547 - DNA, 20 bp, Homo sapiens
ctacagagcttccctgactc

SEQ ID NO: 4725548 - DNA, 15 bp, Homo sapiens
ctacagaggccatgg

SEQ ID NO: 4725549 - DNA, 17 bp, Homo sapiens
ctacaggcacccaccat

SEQ ID NO: 4725550 - DNA, 14 bp, Homo sapiens
ctacaggtgtgagt

SEQ ID NO: 4725551 - DNA, 16 bp, Homo sapiens
ctacaggtgtgagtca

SEQ ID NO: 4725552 - DNA, 14 bp, Homo sapiens
ctacagtcaggaaa

SEQ ID NO: 4725553 - DNA, 21 bp, Homo sapiens
ctacagtcaggaaaggaatca

SEQ ID NO: 4725554 - DNA, 18 bp, Homo sapiens
ctacagtcctcccatctc

SEQ ID NO: 4725555 - DNA, 20 bp, Homo sapiens
ctacagtcctcccatctcac

SEQ ID NO: 4725556 - DNA, 15 bp, Homo sapiens
ctacagtgtacagtc

SEQ ID NO: 4725557 - DNA, 17 bp, Homo sapiens
ctacagttttaactgtg

SEQ ID NO: 4725558 - DNA, 18 bp, Homo sapiens
ctattaaaattgccattt

SEQ ID NO: 4725559 - DNA, 17 bp, Homo sapiens
ctattcatgttttgaga

SEQ ID NO: 4725560 - DNA, 18 bp, Homo sapiens
ctattctcaaagttaaaa

SEQ ID NO: 4725561 - DNA, 18 bp, Homo sapiens
cttactgaagaaatcttt

SEQ ID NO: 4725562 - DNA, 14 bp, Homo sapiens
cttacttagtgtta

SEQ ID NO: 4725563 - DNA, 23 bp, Homo sapiens
cttactttgtgcaaaagcaggct

SEQ ID NO: 4725564 - DNA, 22 bp, Homo sapiens
cttagaaaacaatggaatgaga

SEQ ID NO: 4725565 - DNA, 19 bp, Homo sapiens
cttagaaaattcactattg

SEQ ID NO: 4725566 - DNA, 20 bp, Homo sapiens
cttagaagtcacacagtatt

SEQ ID NO: 4725567 - DNA, 18 bp, Homo sapiens
cttagaagtttgttgtga

SEQ ID NO: 4725568 - DNA, 11 bp, Homo sapiens
cttagacagtc

SEQ ID NO: 4725569 - DNA, 19 bp, Homo sapiens
cttagacagtccctgccaa

SEQ ID NO: 4725570 - DNA, 22 bp, Homo sapiens
cttagagcagtttctgtcctgc

SEQ ID NO: 4725571 - DNA, 14 bp, Homo sapiens
cttagatgttctaa

SEQ ID NO: 4725572 - DNA, 14 bp, Homo sapiens
cttagctttttaat

SEQ ID NO: 4725573 - DNA, 14 bp, Homo sapiens
cttagtcactgaga

SEQ ID NO: 4725574 - DNA, 22 bp, Homo sapiens
cttagtcactgagacagcccgg

SEQ ID NO: 4725575 - DNA, 18 bp, Homo sapiens
cttataaagtggaagtat

SEQ ID NO: 4725576 - DNA, 22 bp, Homo sapiens
cttataagaagaagagaggcat

SEQ ID NO: 4725577 - DNA, 14 bp, Homo sapiens
cttataatttaaaa

SEQ ID NO: 4725578 - DNA, 17 bp, Homo sapiens
cttatacttttctcaat

SEQ ID NO: 4725579 - DNA, 14 bp, Homo sapiens
cttatcaaaggaca

SEQ ID NO: 4725580 - DNA, 17 bp, Homo sapiens
cttatcaactggttgta

SEQ ID NO: 4725581 - DNA, 23 bp, Homo sapiens
cttatctcagtcatgcataaata

SEQ ID NO: 4725582 - DNA, 14 bp, Homo sapiens
cttatctgccatgt

SEQ ID NO: 4725583 - DNA, 22 bp, Homo sapiens
cttatctttctaaaactgcctt

SEQ ID NO: 4725584 - DNA, 15 bp, Homo sapiens
cttatgagaacatgg

SEQ ID NO: 4725585 - DNA, 23 bp, Homo sapiens
cttatgggctgggttctacccag

SEQ ID NO: 4725586 - DNA, 17 bp, Homo sapiens
cttattagagtgtcttt

SEQ ID NO: 4725587 - DNA, 22 bp, Homo sapiens
cttattcaggaagataaaaatc

SEQ ID NO: 4725588 - DNA, 13 bp, Homo sapiens
cttattgcccacg

SEQ ID NO: 4725589 - DNA, 18 bp, Homo sapiens
cttattgcccacgctgga

SEQ ID NO: 4725590 - DNA, 22 bp, Homo sapiens
cttattttgtttcaatctctga

SEQ ID NO: 4725591 - DNA, 17 bp, Homo sapiens
cttcaaaatgttctatt

SEQ ID NO: 4725592 - DNA, 16 bp, Homo sapiens
cttcaaagcttaaaaa

SEQ ID NO: 4725593 - DNA, 18 bp, Homo sapiens
cttcaagaaaacaggcac

SEQ ID NO: 4725594 - DNA, 23 bp, Homo sapiens
cttcacagatgggtgcttggagg

SEQ ID NO: 4725595 - DNA, 19 bp, Homo sapiens
cttcaccacctcatgtcat

SEQ ID NO: 4725596 - DNA, 23 bp, Homo sapiens
cttcaccacctcatgtcatttct

SEQ ID NO: 4725597 - DNA, 17 bp, Homo sapiens
cttcacctttgtcccca

SEQ ID NO: 4725598 - DNA, 17 bp, Homo sapiens
cttcactgtataaatag

SEQ ID NO: 4725599 - DNA, 17 bp, Homo sapiens
cttcagagactcctgca

SEQ ID NO: 4725600 - DNA, 18 bp, Homo sapiens
cttcagagactcctgcag

SEQ ID NO: 4725601 - DNA, 23 bp, Homo sapiens
cttcagagactcctgcaggcagc

SEQ ID NO: 4725602 - DNA, 24 bp, Homo sapiens
cttcagagactcctgcaggcagcc

SEQ ID NO: 4725603 - DNA, 12 bp, Homo sapiens
cttcagagctga

SEQ ID NO: 4725604 - DNA, 14 bp, Homo sapiens
cttcagagctgaca

SEQ ID NO: 4725605 - DNA, 16 bp, Homo sapiens
cttcagcctcccgagt

SEQ ID NO: 4725606 - DNA, 20 bp, Homo sapiens
cttcagcctcccgagtagct

SEQ ID NO: 4725607 - DNA, 11 bp, Homo sapiens
cttcagctggt

SEQ ID NO: 4725608 - DNA, 12 bp, Homo sapiens
cttcagctggtg

SEQ ID NO: 4725609 - DNA, 15 bp, Homo sapiens
cttcagggagtgagg

SEQ ID NO: 4725610 - DNA, 15 bp, Homo sapiens
cttcaggggctgccc

SEQ ID NO: 4725611 - DNA, 22 bp, Homo sapiens
cttcaggggctgcccgctccca

SEQ ID NO: 4725612 - DNA, 14 bp, Homo sapiens
cttcagtggcagct

SEQ ID NO: 4725613 - DNA, 16 bp, Homo sapiens
cttcagtggcagctgc

SEQ ID NO: 4725614 - DNA, 16 bp, Homo sapiens
cttcataaaactcatg

SEQ ID NO: 4725615 - DNA, 22 bp, Homo sapiens
cttcatctcccaaagtgctggg

SEQ ID NO: 4725616 - DNA, 13 bp, Homo sapiens
cttcatctggaac

SEQ ID NO: 4725617 - DNA, 21 bp, Homo sapiens
cttcatgcatggaaattccct

SEQ ID NO: 4725618 - DNA, 23 bp, Homo sapiens
cttcatgcatggaaattcccttc

SEQ ID NO: 4725619 - DNA, 20 bp, Homo sapiens
cttcatttcctctgagctgt

SEQ ID NO: 4725620 - DNA, 23 bp, Homo sapiens
cttcatttcctctgagctgttat

SEQ ID NO: 4725621 - DNA, 15 bp, Homo sapiens
cttccaaacaaaagc

SEQ ID NO: 4725622 - DNA, 19 bp, Homo sapiens
cttccaaatcccctaagca

SEQ ID NO: 4725623 - DNA, 18 bp, Homo sapiens
cttccaaggtggtctgct

SEQ ID NO: 4725624 - DNA, 20 bp, Homo sapiens
cttccaaggtggtctgctcg

SEQ ID NO: 4725625 - DNA, 14 bp, Homo sapiens
cttccacaccccca

SEQ ID NO: 4725626 - DNA, 23 bp, Homo sapiens
cttccaccaagttggaacatcct

SEQ ID NO: 4725627 - DNA, 15 bp, Homo sapiens
cttccactgagggca

SEQ ID NO: 4725628 - DNA, 17 bp, Homo sapiens
cttccagaactgtgaga

SEQ ID NO: 4725629 - DNA, 12 bp, Homo sapiens
cttccagagctc

SEQ ID NO: 4725630 - DNA, 18 bp, Homo sapiens
cttccagagctctgaccc

SEQ ID NO: 4725631 - DNA, 15 bp, Homo sapiens
cttccaggggtggga

SEQ ID NO: 4725632 - DNA, 21 bp, Homo sapiens
cttccaggggtgggacaccct

SEQ ID NO: 4725633 - DNA, 24 bp, Homo sapiens
cttccaggggtgggacaccctgtg

SEQ ID NO: 4725634 - DNA, 17 bp, Homo sapiens
cttccagtgaggctctg

SEQ ID NO: 4725635 - DNA, 21 bp, Homo sapiens
cttccatctgtgccatacttg

SEQ ID NO: 4725636 - DNA, 16 bp, Homo sapiens
cttccatggactttgt

SEQ ID NO: 4725637 - DNA, 17 bp, Homo sapiens
cttccatggactttgtt

SEQ ID NO: 4725638 - DNA, 14 bp, Homo sapiens
cttccatttgcaag

SEQ ID NO: 4725639 - DNA, 21 bp, Homo sapiens
cttcccaggtaagcaggagga

SEQ ID NO: 4725640 - DNA, 15 bp, Homo sapiens
cttcccagtggctgc

SEQ ID NO: 4725641 - DNA, 19 bp, Homo sapiens
cttgtaaaggaatttaaaa

SEQ ID NO: 4725642 - DNA, 18 bp, Homo sapiens
cttgtaaatagctcaggt

SEQ ID NO: 4725643 - DNA, 22 bp, Homo sapiens
cttgtaatttttttaatttaca

SEQ ID NO: 4725644 - DNA, 17 bp, Homo sapiens
cttgtcaatactgagcc

SEQ ID NO: 4725645 - DNA, 19 bp, Homo sapiens
cttgtcaatactgagccat

SEQ ID NO: 4725646 - DNA, 23 bp, Homo sapiens
cttgtcatcagtaagtataacaa

SEQ ID NO: 4725647 - DNA, 23 bp, Homo sapiens
cttgtccaattaatgaagttgat

SEQ ID NO: 4725648 - DNA, 20 bp, Homo sapiens
cttgtccccacactcctaca

SEQ ID NO: 4725649 - DNA, 21 bp, Homo sapiens
cttgtctttggaccctgaggc

SEQ ID NO: 4725650 - DNA, 22 bp, Homo sapiens
cttgtctttggaccctgaggcc

SEQ ID NO: 4725651 - DNA, 18 bp, Homo sapiens
cttgtgaactccatcatt

SEQ ID NO: 4725652 - DNA, 21 bp, Homo sapiens
cttgtgaatattgtggctccc

SEQ ID NO: 4725653 - DNA, 15 bp, Homo sapiens
cttgtgagggagaga

SEQ ID NO: 4725654 - DNA, 18 bp, Homo sapiens
cttgtgccaacactcaag

SEQ ID NO: 4725655 - DNA, 21 bp, Homo sapiens
cttgtggacacagctcttctc

SEQ ID NO: 4725656 - DNA, 19 bp, Homo sapiens
cttgtggtcccaccccaca

SEQ ID NO: 4725657 - DNA, 17 bp, Homo sapiens
cttgtgtggtttggccc

SEQ ID NO: 4725658 - DNA, 18 bp, Homo sapiens
cttgttcattctgtgacc

SEQ ID NO: 4725659 - DNA, 14 bp, Homo sapiens
cttgtttctttctg

SEQ ID NO: 4725660 - DNA, 16 bp, Homo sapiens
cttgtttctttctgaa

SEQ ID NO: 4725661 - DNA, 23 bp, Homo sapiens
cttgtttggagggatcattttct

SEQ ID NO: 4725662 - DNA, 17 bp, Homo sapiens
cttgttttctctgtgtg

SEQ ID NO: 4725663 - DNA, 12 bp, Homo sapiens
ctttaaaaggat

SEQ ID NO: 4725664 - DNA, 13 bp, Homo sapiens
ctttaaatgatgt

SEQ ID NO: 4725665 - DNA, 17 bp, Homo sapiens
ctttaacagcttacact

SEQ ID NO: 4725666 - DNA, 19 bp, Homo sapiens
ctttaaccctcactgggac

SEQ ID NO: 4725667 - DNA, 23 bp, Homo sapiens
ctttaactgccgtaatttaactt

SEQ ID NO: 4725668 - DNA, 15 bp, Homo sapiens
ctttaagaactaaaa

SEQ ID NO: 4725669 - DNA, 20 bp, Homo sapiens
ctttaagttttatttaactt

SEQ ID NO: 4725670 - DNA, 19 bp, Homo sapiens
ctttaatgtcacaggcagg

SEQ ID NO: 4725671 - DNA, 14 bp, Homo sapiens
ctttaccaccccca

SEQ ID NO: 4725672 - DNA, 19 bp, Homo sapiens
gaaaacactgttctctgcc

SEQ ID NO: 4725673 - DNA, 20 bp, Homo sapiens
gaaaacactgttctctgccc

SEQ ID NO: 4725674 - DNA, 18 bp, Homo sapiens
gaaaacattacatgctca

SEQ ID NO: 4725675 - DNA, 19 bp, Homo sapiens
gaaaacattacatgctcag

SEQ ID NO: 4725676 - DNA, 18 bp, Homo sapiens
gaaaagaaatcaattttt

SEQ ID NO: 4725677 - DNA, 13 bp, Homo sapiens
gaaaagcctctgt

SEQ ID NO: 4725678 - DNA, 14 bp, Homo sapiens
gaaaagcctctgtg

SEQ ID NO: 4725679 - DNA, 14 bp, Homo sapiens
gaaaagctattagc

SEQ ID NO: 4725680 - DNA, 17 bp, Homo sapiens
gaaaagctattagccag

SEQ ID NO: 4725681 - DNA, 20 bp, Homo sapiens
gaaaagctattagccaggat

SEQ ID NO: 4725682 - DNA, 17 bp, Homo sapiens
gaaaagctgctgacagt

SEQ ID NO: 4725683 - DNA, 11 bp, Homo sapiens
gaaaaggcagg

SEQ ID NO: 4725684 - DNA, 14 bp, Homo sapiens
gaaaaggttttatt

SEQ ID NO: 4725685 - DNA, 15 bp, Homo sapiens
gaaaataaagaatgg

SEQ ID NO: 4725686 - DNA, 23 bp, Homo sapiens
gaaaataaatcaatgctataact

SEQ ID NO: 4725687 - DNA, 14 bp, Homo sapiens
gaaaataattctct

SEQ ID NO: 4725688 - DNA, 11 bp, Homo sapiens
gaaaatatgtt

SEQ ID NO: 4725689 - DNA, 20 bp, Homo sapiens
gaaaatcctgaataaaccag

SEQ ID NO: 4725690 - DNA, 19 bp, Homo sapiens
gaaaatctttataaatgta

SEQ ID NO: 4725691 - DNA, 18 bp, Homo sapiens
gaaaatgaaatgcatatt

SEQ ID NO: 4725692 - DNA, 13 bp, Homo sapiens
gaaaatgaatttg

SEQ ID NO: 4725693 - DNA, 18 bp, Homo sapiens
gaaaatgatgagttttta

SEQ ID NO: 4725694 - DNA, 23 bp, Homo sapiens
gaaaatgctgtattagtcacaga

SEQ ID NO: 4725695 - DNA, 22 bp, Homo sapiens
gaaaatgtctgtaataatagac

SEQ ID NO: 4725696 - DNA, 14 bp, Homo sapiens
gaaaatgtcttgtg

SEQ ID NO: 4725697 - DNA, 18 bp, Homo sapiens
gaaaatgtgtctgcaaca

SEQ ID NO: 4725698 - DNA, 18 bp, Homo sapiens
gaaaattaattatatttc

SEQ ID NO: 4725699 - DNA, 19 bp, Homo sapiens
gaaaattaattatatttct

SEQ ID NO: 4725700 - DNA, 15 bp, Homo sapiens
gaaaattatttgcat

SEQ ID NO: 4725701 - DNA, 16 bp, Homo sapiens
gaaaattatttgcata

SEQ ID NO: 4725702 - DNA, 14 bp, Homo sapiens
gaaaatttgtttga

SEQ ID NO: 4725703 - DNA, 17 bp, Homo sapiens
gaaacaactctttgaga

SEQ ID NO: 4725704 - DNA, 14 bp, Homo sapiens
gaaacaatttaaat

SEQ ID NO: 4725705 - DNA, 19 bp, Homo sapiens
gaaacaccctcacactggg

SEQ ID NO: 4725706 - DNA, 22 bp, Homo sapiens
gaaacactgggcttctagaacc

SEQ ID NO: 4725707 - DNA, 17 bp, Homo sapiens
gaaaccacagctgctgg

SEQ ID NO: 4725708 - DNA, 13 bp, Homo sapiens
gaaacccagctct

SEQ ID NO: 4725709 - DNA, 16 bp, Homo sapiens
gaaacccagctctggt

SEQ ID NO: 4725710 - DNA, 18 bp, Homo sapiens
gaaacccagctctggtcc

SEQ ID NO: 4725711 - DNA, 19 bp, Homo sapiens
gaaacccagctctggtcca

SEQ ID NO: 4725712 - DNA, 15 bp, Homo sapiens
gaaacctgggagaga

SEQ ID NO: 4725713 - DNA, 14 bp, Homo sapiens
gaaaccttttttaa

SEQ ID NO: 4725714 - DNA, 23 bp, Homo sapiens
gaaaccttttttaagatttttct

SEQ ID NO: 4725715 - DNA, 18 bp, Homo sapiens
gaaactaccagtgggcat

SEQ ID NO: 4725716 - DNA, 20 bp, Homo sapiens
gaaactaccagtgggcatgt

SEQ ID NO: 4725717 - DNA, 22 bp, Homo sapiens
gaaactaccagtgggcatgtat

SEQ ID NO: 4725718 - DNA, 15 bp, Homo sapiens
gaaactgcagggaaa

SEQ ID NO: 4725719 - DNA, 12 bp, Homo sapiens
gaaactgtgaat

SEQ ID NO: 4725720 - DNA, 19 bp, Homo sapiens
gaaactgtgaatgcttctg

SEQ ID NO: 4725721 - DNA, 11 bp, Homo sapiens
gaaagaactta

SEQ ID NO: 4725722 - DNA, 19 bp, Homo sapiens
gaaagacttttccaaccct

SEQ ID NO: 4725723 - DNA, 12 bp, Homo sapiens
gaaagcaacttt

SEQ ID NO: 4725724 - DNA, 23 bp, Homo sapiens
gaaagcacaggtgggcttcccag

SEQ ID NO: 4725725 - DNA, 21 bp, Homo sapiens
gaaagcagcgctagtggaggg

SEQ ID NO: 4725726 - DNA, 18 bp, Homo sapiens
gaaaggattctaaacaga

SEQ ID NO: 4725727 - DNA, 14 bp, Homo sapiens
gaaaggctccagga

SEQ ID NO: 4725728 - DNA, 17 bp, Homo sapiens
gaaaggctccaggagca

SEQ ID NO: 4725729 - DNA, 22 bp, Homo sapiens
gaaagggacttggaagctccgc

SEQ ID NO: 4725730 - DNA, 18 bp, Homo sapiens
gaaagttgcacggctgct

SEQ ID NO: 4725731 - DNA, 14 bp, Homo sapiens
gaaagttttgttct

SEQ ID NO: 4725732 - DNA, 16 bp, Homo sapiens
gaaataacaatgttaa

SEQ ID NO: 4725733 - DNA, 14 bp, Homo sapiens
gaaatacacttttt

SEQ ID NO: 4725734 - DNA, 21 bp, Homo sapiens
gaaatacacttttttccaaag

SEQ ID NO: 4725735 - DNA, 21 bp, Homo sapiens
gaaatactttcgaaatttcat

SEQ ID NO: 4725736 - DNA, 15 bp, Homo sapiens
gaaatagaaaaggaa

SEQ ID NO: 4725737 - DNA, 16 bp, Homo sapiens
gaaatagaaaaggaag

SEQ ID NO: 4725738 - DNA, 16 bp, Homo sapiens
gaaatagaattataac

SEQ ID NO: 4725739 - DNA, 14 bp, Homo sapiens
gaaatcaacttgtg

SEQ ID NO: 4725740 - DNA, 13 bp, Homo sapiens
gaaatccagggtg

SEQ ID NO: 4725741 - DNA, 11 bp, Homo sapiens
gaaatccagta

SEQ ID NO: 4725742 - DNA, 20 bp, Homo sapiens
gaaatcgccttatgagaaca

SEQ ID NO: 4725743 - DNA, 13 bp, Homo sapiens
gaaatctttccag

SEQ ID NO: 4725744 - DNA, 21 bp, Homo sapiens
gaaatgagcatgcattttctt

SEQ ID NO: 4725745 - DNA, 21 bp, Homo sapiens
gaaatgctaaccttgtagcat

SEQ ID NO: 4725746 - DNA, 20 bp, Homo sapiens
gaaatgctcgtcatacagta

SEQ ID NO: 4725747 - DNA, 18 bp, Homo sapiens
gaattagattatttctgt

SEQ ID NO: 4725748 - DNA, 13 bp, Homo sapiens
gaattataactgt

SEQ ID NO: 4725749 - DNA, 14 bp, Homo sapiens
gaattataactgta

SEQ ID NO: 4725750 - DNA, 15 bp, Homo sapiens
gaattattcagtgaa

SEQ ID NO: 4725751 - DNA, 17 bp, Homo sapiens
gaattattcagtgaatt

SEQ ID NO: 4725752 - DNA, 21 bp, Homo sapiens
gaattctaattgtcagtgatt

SEQ ID NO: 4725753 - DNA, 19 bp, Homo sapiens
gaattctgtttaattttca

SEQ ID NO: 4725754 - DNA, 19 bp, Homo sapiens
gaattcttggttgaggaaa

SEQ ID NO: 4725755 - DNA, 16 bp, Homo sapiens
gaattgtaactgttct

SEQ ID NO: 4725756 - DNA, 22 bp, Homo sapiens
gaatttaagcctcaaatttgaa

SEQ ID NO: 4725757 - DNA, 20 bp, Homo sapiens
gaatttataaaaattaagtt

SEQ ID NO: 4725758 - DNA, 15 bp, Homo sapiens
gaatttataacaaat

SEQ ID NO: 4725759 - DNA, 17 bp, Homo sapiens
gaatttcccacataccc

SEQ ID NO: 4725760 - DNA, 21 bp, Homo sapiens
gaatttcttcaactccctgcc

SEQ ID NO: 4725761 - DNA, 17 bp, Homo sapiens
gaatttgagtgctctga

SEQ ID NO: 4725762 - DNA, 21 bp, Homo sapiens
gaattttattttttgggaaaa

SEQ ID NO: 4725763 - DNA, 19 bp, Homo sapiens
gacaaagaaaactgcacaa

SEQ ID NO: 4725764 - DNA, 13 bp, Homo sapiens
gacaaaggcaagc

SEQ ID NO: 4725765 - DNA, 11 bp, Homo sapiens
gacaaatattc

SEQ ID NO: 4725766 - DNA, 22 bp, Homo sapiens
gacaaatattcctttgcatatt

SEQ ID NO: 4725767 - DNA, 13 bp, Homo sapiens
gacaacagcctga

SEQ ID NO: 4725768 - DNA, 13 bp, Homo sapiens
gacaagaccctct

SEQ ID NO: 4725769 - DNA, 19 bp, Homo sapiens
gacaagcaattagacaaga

SEQ ID NO: 4725770 - DNA, 17 bp, Homo sapiens
gacaaggaaaggcaaat

SEQ ID NO: 4725771 - DNA, 19 bp, Homo sapiens
gacaaggaaaggcaaatgc

SEQ ID NO: 4725772 - DNA, 18 bp, Homo sapiens
gacaaggattgctactgt

SEQ ID NO: 4725773 - DNA, 22 bp, Homo sapiens
gacaatactccctttaaagaga

SEQ ID NO: 4725774 - DNA, 14 bp, Homo sapiens
gacaatggaccgga

SEQ ID NO: 4725775 - DNA, 16 bp, Homo sapiens
gacaatggaccggaga

SEQ ID NO: 4725776 - DNA, 14 bp, Homo sapiens
gacacaaacctgcc

SEQ ID NO: 4725777 - DNA, 18 bp, Homo sapiens
gacacaaacctgcctggg

SEQ ID NO: 4725778 - DNA, 14 bp, Homo sapiens
gacacaacaactcc

SEQ ID NO: 4725779 - DNA, 15 bp, Homo sapiens
gacacacagaaatgt

SEQ ID NO: 4725780 - DNA, 17 bp, Homo sapiens
gacacacagaaatgtgt

SEQ ID NO: 4725781 - DNA, 14 bp, Homo sapiens
gacacacagctctg

SEQ ID NO: 4725782 - DNA, 13 bp, Homo sapiens
gacacagctcttc

SEQ ID NO: 4725783 - DNA, 17 bp, Homo sapiens
gacacagctcttctcca

SEQ ID NO: 4725784 - DNA, 20 bp, Homo sapiens
gacacaggcccggctccagg

SEQ ID NO: 4725785 - DNA, 15 bp, Homo sapiens
gacacatgtccaaga

SEQ ID NO: 4725786 - DNA, 13 bp, Homo sapiens
gacaccaataaat

SEQ ID NO: 4725787 - DNA, 13 bp, Homo sapiens
gacaccagagcag

SEQ ID NO: 4725788 - DNA, 12 bp, Homo sapiens
gacaccctgtga

SEQ ID NO: 4725789 - DNA, 22 bp, Homo sapiens
gacaccctgtgatggggccctg

SEQ ID NO: 4725790 - DNA, 23 bp, Homo sapiens
gacacctagagtttggacttcca

SEQ ID NO: 4725791 - DNA, 15 bp, Homo sapiens
gacaccttgacaggg

SEQ ID NO: 4725792 - DNA, 20 bp, Homo sapiens
gacactaaccacgctggacc

SEQ ID NO: 4725793 - DNA, 15 bp, Homo sapiens
gacactcccttgggc

SEQ ID NO: 4725794 - DNA, 15 bp, Homo sapiens
gacactgatgggcaa

SEQ ID NO: 4725795 - DNA, 17 bp, Homo sapiens
gacactgccactctccc

SEQ ID NO: 4725796 - DNA, 19 bp, Homo sapiens
gacactgcggggcttggct

SEQ ID NO: 4725797 - DNA, 20 bp, Homo sapiens
gacactgcggggcttggctg

SEQ ID NO: 4725798 - DNA, 19 bp, Homo sapiens
gacactggtattcctgcct

SEQ ID NO: 4725799 - DNA, 18 bp, Homo sapiens
gacactgttgataaaaac

SEQ ID NO: 4725800 - DNA, 13 bp, Homo sapiens
gacagaacactgt

SEQ ID NO: 4725801 - DNA, 14 bp, Homo sapiens
gacagaacactgtc

SEQ ID NO: 4725802 - DNA, 16 bp, Homo sapiens
gacagaagcagctctt

SEQ ID NO: 4725803 - DNA, 14 bp, Homo sapiens
gacagacacaggcc

SEQ ID NO: 4725804 - DNA, 15 bp, Homo sapiens
gacagacacaggccc

SEQ ID NO: 4725805 - DNA, 16 bp, Homo sapiens
gacagacacaggcccg

SEQ ID NO: 4725806 - DNA, 17 bp, Homo sapiens
gacagacacaggcccgg

SEQ ID NO: 4725807 - DNA, 20 bp, Homo sapiens
gacagacacaggcccggctc

SEQ ID NO: 4725808 - DNA, 22 bp, Homo sapiens
gacagacacaggcccggctcca

SEQ ID NO: 4725809 - DNA, 16 bp, Homo sapiens
gacagacagccctcca

SEQ ID NO: 4725810 - DNA, 15 bp, Homo sapiens
gacagaggcagagat

SEQ ID NO: 4725811 - DNA, 21 bp, Homo sapiens
gacagagtctcactgttgccc

SEQ ID NO: 4725812 - DNA, 14 bp, Homo sapiens
gacagccacggcca

SEQ ID NO: 4725813 - DNA, 19 bp, Homo sapiens
gacagccacggccaggcca

SEQ ID NO: 4725814 - DNA, 20 bp, Homo sapiens
gacagccacggccaggccag

SEQ ID NO: 4725815 - DNA, 20 bp, Homo sapiens
gacagcccgggctctgcctc

SEQ ID NO: 4725816 - DNA, 21 bp, Homo sapiens
gacagcccgggctctgcctcc

SEQ ID NO: 4725817 - DNA, 14 bp, Homo sapiens
gacgcctgaggaac

SEQ ID NO: 4725818 - DNA, 16 bp, Homo sapiens
gacgctacccgggaag

SEQ ID NO: 4725819 - DNA, 18 bp, Homo sapiens
gacgctacccgggaaggg

SEQ ID NO: 4725820 - DNA, 13 bp, Homo sapiens
gacgctgtgctgc

SEQ ID NO: 4725821 - DNA, 21 bp, Homo sapiens
gacggagtcccaccttggctg

SEQ ID NO: 4725822 - DNA, 17 bp, Homo sapiens
gacgtgattttgctgta

SEQ ID NO: 4725823 - DNA, 23 bp, Homo sapiens
gactaacttgtctttggaccctg

SEQ ID NO: 4725824 - DNA, 18 bp, Homo sapiens
gactacagtcaggaaagg

SEQ ID NO: 4725825 - DNA, 18 bp, Homo sapiens
gactacttgggagcaccg

SEQ ID NO: 4725826 - DNA, 20 bp, Homo sapiens
gactagaacctggagggctg

SEQ ID NO: 4725827 - DNA, 15 bp, Homo sapiens
gactagggtcctggg

SEQ ID NO: 4725828 - DNA, 13 bp, Homo sapiens
gactatcagccca

SEQ ID NO: 4725829 - DNA, 20 bp, Homo sapiens
gactatgcgtggctggaacc

SEQ ID NO: 4725830 - DNA, 14 bp, Homo sapiens
gactcaaaccaaat

SEQ ID NO: 4725831 - DNA, 17 bp, Homo sapiens
gactcaatgcactgaca

SEQ ID NO: 4725832 - DNA, 16 bp, Homo sapiens
gactcaatttctcccc

SEQ ID NO: 4725833 - DNA, 17 bp, Homo sapiens
gactcaatttctcccca

SEQ ID NO: 4725834 - DNA, 17 bp, Homo sapiens
gactcagctccccagag

SEQ ID NO: 4725835 - DNA, 15 bp, Homo sapiens
gactcattcttctgt

SEQ ID NO: 4725836 - DNA, 13 bp, Homo sapiens
gactccaggaaga

SEQ ID NO: 4725837 - DNA, 15 bp, Homo sapiens
gactccaggaagaag

SEQ ID NO: 4725838 - DNA, 12 bp, Homo sapiens
gactcctgcagg

SEQ ID NO: 4725839 - DNA, 14 bp, Homo sapiens
gactcctgcaggca

SEQ ID NO: 4725840 - DNA, 16 bp, Homo sapiens
gactcctgcaggcagc

SEQ ID NO: 4725841 - DNA, 16 bp, Homo sapiens
gactcgagaactttca

SEQ ID NO: 4725842 - DNA, 15 bp, Homo sapiens
gactctacagaggcc

SEQ ID NO: 4725843 - DNA, 14 bp, Homo sapiens
gactctcagtctct

SEQ ID NO: 4725844 - DNA, 14 bp, Homo sapiens
gactctgcagcctc

SEQ ID NO: 4725845 - DNA, 15 bp, Homo sapiens
gactctgcagcctca

SEQ ID NO: 4725846 - DNA, 13 bp, Homo sapiens
gactgaggcctga

SEQ ID NO: 4725847 - DNA, 23 bp, Homo sapiens
gactgaggcctgagcgctcctgc

SEQ ID NO: 4725848 - DNA, 14 bp, Homo sapiens
gactgatttagaaa

SEQ ID NO: 4725849 - DNA, 14 bp, Homo sapiens
gactggaagcacag

SEQ ID NO: 4725850 - DNA, 15 bp, Homo sapiens
gactggaagcacagc

SEQ ID NO: 4725851 - DNA, 14 bp, Homo sapiens
gactgggctgaggg

SEQ ID NO: 4725852 - DNA, 15 bp, Homo sapiens
gactgggctgaggga

SEQ ID NO: 4725853 - DNA, 21 bp, Homo sapiens
gactgggctgagggagcctgg

SEQ ID NO: 4725854 - DNA, 18 bp, Homo sapiens
gactgtctccatggccct

SEQ ID NO: 4725855 - DNA, 13 bp, Homo sapiens
gactgtttggaaa

SEQ ID NO: 4725856 - DNA, 16 bp, Homo sapiens
gacttatttatataaa

SEQ ID NO: 4725857 - DNA, 17 bp, Homo sapiens
gacttcaggggctgccc

SEQ ID NO: 4725858 - DNA, 23 bp, Homo sapiens
gacttcaggggctgcccgctccc

SEQ ID NO: 4725859 - DNA, 19 bp, Homo sapiens
gacttctatcctgttaaca

SEQ ID NO: 4725860 - DNA, 14 bp, Homo sapiens
ctctgtctcatgtg

SEQ ID NO: 4725861 - DNA, 16 bp, Homo sapiens
ctctgtctcatgtgtg

SEQ ID NO: 4725862 - DNA, 14 bp, Homo sapiens
ctctgtgcccatgg

SEQ ID NO: 4725863 - DNA, 19 bp, Homo sapiens
ctctgtgtaatagaataaa

SEQ ID NO: 4725864 - DNA, 16 bp, Homo sapiens
ctctgtgtcactggct

SEQ ID NO: 4725865 - DNA, 23 bp, Homo sapiens
ctctgtgtcactggctgcctcca

SEQ ID NO: 4725866 - DNA, 20 bp, Homo sapiens
ctctgtgtcaggtggggcag

SEQ ID NO: 4725867 - DNA, 21 bp, Homo sapiens
ctctgtgtcaggtggggcagc

SEQ ID NO: 4725868 - DNA, 19 bp, Homo sapiens
ctctgttctgcacacagca

SEQ ID NO: 4725869 - DNA, 14 bp, Homo sapiens
ctcttagttcttac

SEQ ID NO: 4725870 - DNA, 11 bp, Homo sapiens
ctcttatctca

SEQ ID NO: 4725871 - DNA, 23 bp, Homo sapiens
gagagttcgtgaagagggaagcc

SEQ ID NO: 4725872 - DNA, 17 bp, Homo sapiens
gagatacagaattttat

SEQ ID NO: 4725873 - DNA, 13 bp, Homo sapiens
gagatcaaagatg

SEQ ID NO: 4725874 - DNA, 18 bp, Homo sapiens
gagatcgtgccattgcac

SEQ ID NO: 4725875 - DNA, 12 bp, Homo sapiens
gagatgaaaacc

SEQ ID NO: 4725876 - DNA, 17 bp, Homo sapiens
gagatgaggccgccatg

SEQ ID NO: 4725877 - DNA, 19 bp, Homo sapiens
gagatttcatctgctctcc

SEQ ID NO: 4725878 - DNA, 16 bp, Homo sapiens
gagcaaaggctgagaa

SEQ ID NO: 4725879 - DNA, 22 bp, Homo sapiens
gagcaaaggctgagaacactgt

SEQ ID NO: 4725880 - DNA, 22 bp, Homo sapiens
gagcacaagaggagatccaggg

SEQ ID NO: 4725881 - DNA, 15 bp, Homo sapiens
gagcacagccctccc

SEQ ID NO: 4725882 - DNA, 18 bp, Homo sapiens
gagcacagccctcccgcc

SEQ ID NO: 4725883 - DNA, 19 bp, Homo sapiens
gagcacaggttagggcatg

SEQ ID NO: 4725884 - DNA, 22 bp, Homo sapiens
gagcaccgcctgtgaaatacca

SEQ ID NO: 4725885 - DNA, 21 bp, Homo sapiens
gagcactaaggtgtgctctga

SEQ ID NO: 4725886 - DNA, 23 bp, Homo sapiens
gagcagagaccatccctgaaggc

SEQ ID NO: 4725887 - DNA, 14 bp, Homo sapiens
gagcagatgcagag

SEQ ID NO: 4725888 - DNA, 18 bp, Homo sapiens
gagcagccacattcctga

SEQ ID NO: 4725889 - DNA, 21 bp, Homo sapiens
gagcagccacattcctgatgc

SEQ ID NO: 4725890 - DNA, 22 bp, Homo sapiens
gagcagccacattcctgatgct

SEQ ID NO: 4725891 - DNA, 16 bp, Homo sapiens
gagcagcttctgccac

SEQ ID NO: 4725892 - DNA, 17 bp, Homo sapiens
gagcagcttctgccact

SEQ ID NO: 4725893 - DNA, 20 bp, Homo sapiens
gagcagcttctgccacttcc

SEQ ID NO: 4725894 - DNA, 14 bp, Homo sapiens
gagcagggctcagc

SEQ ID NO: 4725895 - DNA, 14 bp, Homo sapiens
gagcagtgcaggca

SEQ ID NO: 4725896 - DNA, 15 bp, Homo sapiens
gagcagtgcaggcac

SEQ ID NO: 4725897 - DNA, 22 bp, Homo sapiens
gagcagtttctgtcctgctggt

SEQ ID NO: 4725898 - DNA, 12 bp, Homo sapiens
gagcataattta

SEQ ID NO: 4725899 - DNA, 13 bp, Homo sapiens
gagcatcaggcca

SEQ ID NO: 4725900 - DNA, 14 bp, Homo sapiens
gagcatcaggccag

SEQ ID NO: 4725901 - DNA, 15 bp, Homo sapiens
gagcatcaggccagg

SEQ ID NO: 4725902 - DNA, 22 bp, Homo sapiens
gagcatcaggccaggccctctg

SEQ ID NO: 4725903 - DNA, 19 bp, Homo sapiens
gagcatgcattttcttgta

SEQ ID NO: 4725904 - DNA, 21 bp, Homo sapiens
gagcatggctgtgaggatggg

SEQ ID NO: 4725905 - DNA, 14 bp, Homo sapiens
gagccactaactag

SEQ ID NO: 4725906 - DNA, 22 bp, Homo sapiens
gagccactgcaccgggccacag

SEQ ID NO: 4725907 - DNA, 16 bp, Homo sapiens
gagccagaacctggag

SEQ ID NO: 4725908 - DNA, 21 bp, Homo sapiens
gagccagcagcctggctctcc

SEQ ID NO: 4725909 - DNA, 12 bp, Homo sapiens
gagcccacgccc

SEQ ID NO: 4725910 - DNA, 14 bp, Homo sapiens
gagcccagctctga

SEQ ID NO: 4725911 - DNA, 21 bp, Homo sapiens
gagcccaggagctcccctccc

SEQ ID NO: 4725912 - DNA, 18 bp, Homo sapiens
gagcccaggccaggactc

SEQ ID NO: 4725913 - DNA, 15 bp, Homo sapiens
gagccctggtggcag

SEQ ID NO: 4725914 - DNA, 17 bp, Homo sapiens
gagccctggtggcagtg

SEQ ID NO: 4725915 - DNA, 21 bp, Homo sapiens
gagccgagatcacgccactgc

SEQ ID NO: 4725916 - DNA, 17 bp, Homo sapiens
tcccgtctactcattcc

SEQ ID NO: 4725917 - DNA, 16 bp, Homo sapiens
tcccgtggaacgtttt

SEQ ID NO: 4725918 - DNA, 22 bp, Homo sapiens
tcccgtggaacgtttttcctgt

SEQ ID NO: 4725919 - DNA, 14 bp, Homo sapiens
tcccgtggccccag

SEQ ID NO: 4725920 - DNA, 15 bp, Homo sapiens
tcccgtggccccagc

SEQ ID NO: 4725921 - DNA, 24 bp, Homo sapiens
tcccgtggccccagcctggcccag

SEQ ID NO: 4725922 - DNA, 22 bp, Homo sapiens
tccctaggagagtttactgatg

SEQ ID NO: 4725923 - DNA, 20 bp, Homo sapiens
tccctcatatgcatgccctt

SEQ ID NO: 4725924 - DNA, 22 bp, Homo sapiens
tccctcatcctcatacccaccc

SEQ ID NO: 4725925 - DNA, 19 bp, Homo sapiens
tccctcatttcaggagcag

SEQ ID NO: 4725926 - DNA, 23 bp, Homo sapiens
tccctcatttcaggagcagcctc

SEQ ID NO: 4725927 - DNA, 13 bp, Homo sapiens
tccctccagtgaa

SEQ ID NO: 4725928 - DNA, 15 bp, Homo sapiens
tccctccgggacctg

SEQ ID NO: 4725929 - DNA, 15 bp, Homo sapiens
tccctcctggccaga

SEQ ID NO: 4725930 - DNA, 14 bp, Homo sapiens
tcattgaggacaaa

SEQ ID NO: 4725931 - DNA, 18 bp, Homo sapiens
tcattggatttttgttaa

SEQ ID NO: 4725932 - DNA, 22 bp, Homo sapiens
tcattggcctggcaaaataaaa

SEQ ID NO: 4725933 - DNA, 15 bp, Homo sapiens
tcattgtattaacgc

SEQ ID NO: 4725934 - DNA, 16 bp, Homo sapiens
tcattgtcaaaattaa

SEQ ID NO: 4725935 - DNA, 12 bp, Homo sapiens
tcatttcaggat

SEQ ID NO: 4725936 - DNA, 18 bp, Homo sapiens
tcatttccaatcatacaa

SEQ ID NO: 4725937 - DNA, 16 bp, Homo sapiens
tcatttcctgtgtctt

SEQ ID NO: 4725938 - DNA, 13 bp, Homo sapiens
tcatttctatttc

SEQ ID NO: 4725939 - DNA, 17 bp, Homo sapiens
tattacttgcctatctg

SEQ ID NO: 4725940 - DNA, 15 bp, Homo sapiens
tattactttttaaaa

SEQ ID NO: 4725941 - DNA, 12 bp, Homo sapiens
tattagaataat

SEQ ID NO: 4725942 - DNA, 15 bp, Homo sapiens
tattagagtgtcttt

SEQ ID NO: 4725943 - DNA, 18 bp, Homo sapiens
tattagattttcctcctt

SEQ ID NO: 4725944 - DNA, 17 bp, Homo sapiens
tattagccaggatcatg

SEQ ID NO: 4725945 - DNA, 18 bp, Homo sapiens
tattagccaggatcatgg

SEQ ID NO: 4725946 - DNA, 19 bp, Homo sapiens
tattaggaagtgtttatgt

SEQ ID NO: 4725947 - DNA, 16 bp, Homo sapiens
tattagtcttggggca

SEQ ID NO: 4725948 - DNA, 18 bp, Homo sapiens
tattataaaggataaaga

SEQ ID NO: 4725949 - DNA, 20 bp, Homo sapiens
tattataaaggataaagaag

SEQ ID NO: 4725950 - DNA, 13 bp, Homo sapiens
tattatattcatt

SEQ ID NO: 4725951 - DNA, 20 bp, Homo sapiens
tattatgtccattattcaag

SEQ ID NO: 4725952 - DNA, 21 bp, Homo sapiens
tattattactttttaaaatgt

SEQ ID NO: 4725953 - DNA, 21 bp, Homo sapiens
tattattccgtattacatttt

SEQ ID NO: 4725954 - DNA, 14 bp, Homo sapiens
tattcacatgttct

SEQ ID NO: 4725955 - DNA, 17 bp, Homo sapiens
tattcacatgttctaat

SEQ ID NO: 4725956 - DNA, 15 bp, Homo sapiens
tattcagaactttag

SEQ ID NO: 4725957 - DNA, 20 bp, Homo sapiens
tattcagaactttagtatta

SEQ ID NO: 4725958 - DNA, 16 bp, Homo sapiens
tattcaggaagataaa

SEQ ID NO: 4725959 - DNA, 19 bp, Homo sapiens
tattcaggaagataaaaat

SEQ ID NO: 4725960 - DNA, 14 bp, Homo sapiens
tattcaggaagctc

SEQ ID NO: 4725961 - DNA, 16 bp, Homo sapiens
tattcaggaagctcag

SEQ ID NO: 4725962 - DNA, 23 bp, Homo sapiens
tattcagttcttacacattccat

SEQ ID NO: 4725963 - DNA, 18 bp, Homo sapiens
tattcatcaaataaacct

SEQ ID NO: 4725964 - DNA, 23 bp, Homo sapiens
tattcatgctctcatatatattt

SEQ ID NO: 4725965 - DNA, 18 bp, Homo sapiens
tattcattctttttgaaa

SEQ ID NO: 4725966 - DNA, 11 bp, Homo sapiens
tattcctgcct

SEQ ID NO: 4725967 - DNA, 19 bp, Homo sapiens
tattctcgaatcacctcct

SEQ ID NO: 4725968 - DNA, 13 bp, Homo sapiens
tattctgataatg

SEQ ID NO: 4725969 - DNA, 20 bp, Homo sapiens
tattcttttccagaaagaaa

SEQ ID NO: 4725970 - DNA, 20 bp, Homo sapiens
tattgaagggtctgtttaaa

SEQ ID NO: 4725971 - DNA, 13 bp, Homo sapiens
tattgaattattt

SEQ ID NO: 4725972 - DNA, 15 bp, Homo sapiens
tattgaattattttg

SEQ ID NO: 4725973 - DNA, 22 bp, Homo sapiens
tattgactaacaggccaaagag

SEQ ID NO: 4725974 - DNA, 14 bp, Homo sapiens
tattgatgttttca

SEQ ID NO: 4725975 - DNA, 12 bp, Homo sapiens
tattgctggggt

SEQ ID NO: 4725976 - DNA, 19 bp, Homo sapiens
tattgcttgttggattttt

SEQ ID NO: 4725977 - DNA, 19 bp, Homo sapiens
tattggaggatttggtcag

SEQ ID NO: 4725978 - DNA, 14 bp, Homo sapiens
tattggctgggagt

SEQ ID NO: 4725979 - DNA, 15 bp, Homo sapiens
tattgggtttggtca

SEQ ID NO: 4725980 - DNA, 13 bp, Homo sapiens
tattggtaattaa

SEQ ID NO: 4725981 - DNA, 15 bp, Homo sapiens
tattggtaattaaaa

SEQ ID NO: 4725982 - DNA, 22 bp, Homo sapiens
tattggtaattaaaagactcca

SEQ ID NO: 4725983 - DNA, 19 bp, Homo sapiens
tattgtaaaacagctaaat

SEQ ID NO: 4725984 - DNA, 14 bp, Homo sapiens
tattgtaaatactg

SEQ ID NO: 4725985 - DNA, 11 bp, Homo sapiens
tattgtacagt

SEQ ID NO: 4725986 - DNA, 13 bp, Homo sapiens
tattgtacagttt

SEQ ID NO: 4725987 - DNA, 17 bp, Homo sapiens
tattgtacagtttttat

SEQ ID NO: 4725988 - DNA, 15 bp, Homo sapiens
tattgtggctccctg

SEQ ID NO: 4725989 - DNA, 16 bp, Homo sapiens
tattgtggctccctgg

SEQ ID NO: 4725990 - DNA, 22 bp, Homo sapiens
tattgttttgtctcctaaattg

SEQ ID NO: 4725991 - DNA, 18 bp, Homo sapiens
tatttaaaacaacttgtt

SEQ ID NO: 4725992 - DNA, 13 bp, Homo sapiens
tatttaaagcaca

SEQ ID NO: 4725993 - DNA, 21 bp, Homo sapiens
tatttaaatcctgaagagcat

SEQ ID NO: 4725994 - DNA, 18 bp, Homo sapiens
tatttaacctatttccac

SEQ ID NO: 4725995 - DNA, 14 bp, Homo sapiens
tatttaagactaaa

SEQ ID NO: 4725996 - DNA, 16 bp, Homo sapiens
tatttaatgatttttg

SEQ ID NO: 4725997 - DNA, 23 bp, Homo sapiens
tatttaatttgaaggtagaatgt

SEQ ID NO: 4725998 - DNA, 16 bp, Homo sapiens
tatttactatttcaat

SEQ ID NO: 4725999 - DNA, 15 bp, Homo sapiens
tatttatatacaagt

SEQ ID NO: 4726000 - DNA, 23 bp, Homo sapiens
tatttattaaatgcccagcccct

SEQ ID NO: 4726001 - DNA, 12 bp, Homo sapiens
tatttattgaaa

SEQ ID NO: 4726002 - DNA, 16 bp, Homo sapiens
tatttattgaaatgat

SEQ ID NO: 4726003 - DNA, 13 bp, Homo sapiens
tatttcaccattt

SEQ ID NO: 4726004 - DNA, 21 bp, Homo sapiens
tatttcaggcattggatattt

SEQ ID NO: 4726005 - DNA, 13 bp, Homo sapiens
tatttccacaaat

SEQ ID NO: 4726006 - DNA, 12 bp, Homo sapiens
tatttcctttgc

SEQ ID NO: 4726007 - DNA, 23 bp, Homo sapiens
tatttctgggttctcaattctgt

SEQ ID NO: 4726008 - DNA, 20 bp, Homo sapiens
tatttcttaaacaaatgtat

SEQ ID NO: 4726009 - DNA, 21 bp, Homo sapiens
tatttctttaatctgttgttt

SEQ ID NO: 4726010 - DNA, 15 bp, Homo sapiens
tatttgataacattt

SEQ ID NO: 4726011 - DNA, 13 bp, Homo sapiens
tatttgcagaggc

SEQ ID NO: 4726012 - DNA, 14 bp, Homo sapiens
tatttgcagaggct

SEQ ID NO: 4726013 - DNA, 15 bp, Homo sapiens
tatttgcattgagga

SEQ ID NO: 4726014 - DNA, 21 bp, Homo sapiens
tatttggctatggatctgatt

SEQ ID NO: 4726015 - DNA, 22 bp, Homo sapiens
tatttgttaatggtttgaatat

SEQ ID NO: 4726016 - DNA, 13 bp, Homo sapiens
tattttaatcctg

SEQ ID NO: 4726017 - DNA, 22 bp, Homo sapiens
tattttagactcaaagaatata

SEQ ID NO: 4726018 - DNA, 22 bp, Homo sapiens
tattttaggtgtaaaataatta

SEQ ID NO: 4726019 - DNA, 23 bp, Homo sapiens
tattttatctttgattctccttc

SEQ ID NO: 4726020 - DNA, 15 bp, Homo sapiens
tattttatgttattt

SEQ ID NO: 4726021 - DNA, 17 bp, Homo sapiens
tattttctccaaataaa

SEQ ID NO: 4726022 - DNA, 20 bp, Homo sapiens
tattttctccaaataaaaat

SEQ ID NO: 4726023 - DNA, 14 bp, Homo sapiens
tattttgctgttta

SEQ ID NO: 4726024 - DNA, 16 bp, Homo sapiens
tattttgtaattattg

SEQ ID NO: 4726025 - DNA, 19 bp, Homo sapiens
tattttgttaccttttaca

SEQ ID NO: 4726026 - DNA, 12 bp, Homo sapiens
tattttgttact

SEQ ID NO: 4726027 - DNA, 16 bp, Homo sapiens
tattttgttactgtct

SEQ ID NO: 4726028 - DNA, 20 bp, Homo sapiens
tattttgtttcaatctctga

SEQ ID NO: 4726029 - DNA, 19 bp, Homo sapiens
tatttttatagatttgacc

SEQ ID NO: 4726030 - DNA, 14 bp, Homo sapiens
tatttttctcatga

SEQ ID NO: 4726031 - DNA, 17 bp, Homo sapiens
tatttttgtagagccag

SEQ ID NO: 4726032 - DNA, 18 bp, Homo sapiens
tatttttttttaagctct

SEQ ID NO: 4726033 - DNA, 23 bp, Homo sapiens
tcaaaaactaaaatcattgtcaa

SEQ ID NO: 4726034 - DNA, 16 bp, Homo sapiens
tcaaaaagtataaatt

SEQ ID NO: 4726035 - DNA, 23 bp, Homo sapiens
tcaaaaccagcctcatgctctga

SEQ ID NO: 4726036 - DNA, 17 bp, Homo sapiens
tcaaaaccaggtaatgt

SEQ ID NO: 4726037 - DNA, 15 bp, Homo sapiens
tcaaaaccttttgaa

SEQ ID NO: 4726038 - DNA, 16 bp, Homo sapiens
tcaaaatgttctattt

SEQ ID NO: 4726039 - DNA, 21 bp, Homo sapiens
tcaaacacaatggagtgtgta

SEQ ID NO: 4726040 - DNA, 16 bp, Homo sapiens
tcaaacactgcaggca

SEQ ID NO: 4726041 - DNA, 17 bp, Homo sapiens
tcaaagaaaaacaatga

SEQ ID NO: 4726042 - DNA, 13 bp, Homo sapiens
tcaaagaaatcct

SEQ ID NO: 4726043 - DNA, 19 bp, Homo sapiens
tcaaagaaatttccactca

SEQ ID NO: 4726044 - DNA, 20 bp, Homo sapiens
tcaaagaaatttccactcag

SEQ ID NO: 4726045 - DNA, 16 bp, Homo sapiens
tcaaagcaaggaaact

SEQ ID NO: 4726046 - DNA, 13 bp, Homo sapiens
tcaaagttttgaa

SEQ ID NO: 4726047 - DNA, 22 bp, Homo sapiens
tcacgcagcaacgtttttaata

SEQ ID NO: 4726048 - DNA, 18 bp, Homo sapiens
tcacgtaaagctagaaat

SEQ ID NO: 4726049 - DNA, 13 bp, Homo sapiens
tcacgtctgacaa

SEQ ID NO: 4726050 - DNA, 21 bp, Homo sapiens
tcacgtggaggagcagtgcag

SEQ ID NO: 4726051 - DNA, 19 bp, Homo sapiens
tcacgtgtaaacaggatta

SEQ ID NO: 4726052 - DNA, 15 bp, Homo sapiens
tcactactacatctg

SEQ ID NO: 4726053 - DNA, 15 bp, Homo sapiens
tagattttaagcttc

SEQ ID NO: 4726054 - DNA, 15 bp, Homo sapiens
tagcaaccctgtgat

SEQ ID NO: 4726055 - DNA, 17 bp, Homo sapiens
tacctgacactcccttg

SEQ ID NO: 4726056 - DNA, 16 bp, Homo sapiens
tacctgaggggcctct

SEQ ID NO: 4726057 - DNA, 21 bp, Homo sapiens
tacctgctcacgtcaaatgca

SEQ ID NO: 4726058 - DNA, 13 bp, Homo sapiens
taaatttgttgaa

SEQ ID NO: 4726059 - DNA, 13 bp, Homo sapiens
taaatttgttgtc

SEQ ID NO: 4726060 - DNA, 19 bp, Homo sapiens
taaatttgttgtcatgtgt

SEQ ID NO: 4726061 - DNA, 21 bp, Homo sapiens
taaatttgttgtcatgtgtat

SEQ ID NO: 4726062 - DNA, 14 bp, Homo sapiens
taaattttgtgatg

SEQ ID NO: 4726063 - DNA, 15 bp, Homo sapiens
taaattttgtgtctc

SEQ ID NO: 4726064 - DNA, 19 bp, Homo sapiens
taaattttttttgtttcat

SEQ ID NO: 4726065 - DNA, 12 bp, Homo sapiens
gtgtgtctctga

SEQ ID NO: 4726066 - DNA, 21 bp, Homo sapiens
gtgtgtgcgcctacaggagtg

SEQ ID NO: 4726067 - DNA, 16 bp, Homo sapiens
gtgtgttgatactgtt

SEQ ID NO: 4726068 - DNA, 21 bp, Homo sapiens
gtgtgttgatactgttgcacg

SEQ ID NO: 4726069 - DNA, 14 bp, Homo sapiens
gtgtgtttttctat

SEQ ID NO: 4726070 - DNA, 15 bp, Homo sapiens
gtgtgtttttctatt

SEQ ID NO: 4726071 - DNA, 20 bp, Homo sapiens
gtgtgtttttctattaaaag

SEQ ID NO: 4726072 - DNA, 21 bp, Homo sapiens
gtgttaaatgtgatgaatact

SEQ ID NO: 4726073 - DNA, 21 bp, Homo sapiens
gtgttacaatcagtgtgaatg

SEQ ID NO: 4726074 - DNA, 14 bp, Homo sapiens
gtgttaggcctggc

SEQ ID NO: 4726075 - DNA, 24 bp, Homo sapiens
gtgttaggcctggcacagtgtctg

SEQ ID NO: 4726076 - DNA, 23 bp, Homo sapiens
gtgttagggaagggcctgccaca

SEQ ID NO: 4726077 - DNA, 24 bp, Homo sapiens
gtgttcaccttcaaaatgttctat

SEQ ID NO: 4726078 - DNA, 17 bp, Homo sapiens
gtgttccattgcctctt

SEQ ID NO: 4726079 - DNA, 19 bp, Homo sapiens
gtgttccccttccactgag

SEQ ID NO: 4726080 - DNA, 14 bp, Homo sapiens
gtgtttagctattt

SEQ ID NO: 4726081 - DNA, 15 bp, Homo sapiens
gtgtttagctattta

SEQ ID NO: 4726082 - DNA, 15 bp, Homo sapiens
gtgttttgaaagaat

SEQ ID NO: 4726083 - DNA, 17 bp, Homo sapiens
gtgtttttctattaaaa

SEQ ID NO: 4726084 - DNA, 19 bp, Homo sapiens
gttaaacttacttagtgtt

SEQ ID NO: 4726085 - DNA, 18 bp, Homo sapiens
gttaaaggcaatggtttg

SEQ ID NO: 4726086 - DNA, 11 bp, Homo sapiens
gttaaatgtat

SEQ ID NO: 4726087 - DNA, 13 bp, Homo sapiens
gttaaatgtatca

SEQ ID NO: 4726088 - DNA, 13 bp, Homo sapiens
gttaaatttgtaa

SEQ ID NO: 4726089 - DNA, 16 bp, Homo sapiens
gttaaatttgtaagtt

SEQ ID NO: 4726090 - DNA, 17 bp, Homo sapiens
gttaaatttgtaagttt

SEQ ID NO: 4726091 - DNA, 18 bp, Homo sapiens
gttaaccttgaagtgact

SEQ ID NO: 4726092 - DNA, 21 bp, Homo sapiens
gttaaccttgaagtgactgtt

SEQ ID NO: 4726093 - DNA, 19 bp, Homo sapiens
gttaagaagctgttgtaca

SEQ ID NO: 4726094 - DNA, 19 bp, Homo sapiens
gttaagatactcaagcagg

SEQ ID NO: 4726095 - DNA, 16 bp, Homo sapiens
gttaaggaaactctta

SEQ ID NO: 4726096 - DNA, 12 bp, Homo sapiens
gttaataaaagt

SEQ ID NO: 4726097 - DNA, 19 bp, Homo sapiens
gttacaatcagtgtgaatg

SEQ ID NO: 4726098 - DNA, 16 bp, Homo sapiens
gttacaattacatctc

SEQ ID NO: 4726099 - DNA, 15 bp, Homo sapiens
gttacagcacaaaat

SEQ ID NO: 4726100 - DNA, 21 bp, Homo sapiens
gttacagcacaaaatgatggc

SEQ ID NO: 4726101 - DNA, 13 bp, Homo sapiens
gttacccaacaga

SEQ ID NO: 4726102 - DNA, 20 bp, Homo sapiens
gttactggcacctgaaatta

SEQ ID NO: 4726103 - DNA, 16 bp, Homo sapiens
gttactgtctgtagtg

SEQ ID NO: 4726104 - DNA, 23 bp, Homo sapiens
gttagggaaaacattccatcctt

SEQ ID NO: 4726105 - DNA, 13 bp, Homo sapiens
gttagggaatggc

SEQ ID NO: 4726106 - DNA, 14 bp, Homo sapiens
gttagtattttaat

SEQ ID NO: 4726107 - DNA, 19 bp, Homo sapiens
gttagtattttaatcctgt

SEQ ID NO: 4726108 - DNA, 21 bp, Homo sapiens
gttagtattttaatcctgtac

SEQ ID NO: 4726109 - DNA, 17 bp, Homo sapiens
gttataacttcataaaa

SEQ ID NO: 4726110 - DNA, 22 bp, Homo sapiens
gttatccagaagtattgtttac

SEQ ID NO: 4726111 - DNA, 21 bp, Homo sapiens
gttattcataaagagaaaatg

SEQ ID NO: 4726112 - DNA, 21 bp, Homo sapiens
gttattttgcatatatgttct

SEQ ID NO: 4726113 - DNA, 12 bp, Homo sapiens
gttcaaagccag

SEQ ID NO: 4726114 - DNA, 16 bp, Homo sapiens
gttcaattctcatttg

SEQ ID NO: 4726115 - DNA, 20 bp, Homo sapiens
gttcacatcccatgtagaaa

SEQ ID NO: 4726116 - DNA, 21 bp, Homo sapiens
gttcaccttcaaaatgttcta

SEQ ID NO: 4726117 - DNA, 12 bp, Homo sapiens
gttcactttttt

SEQ ID NO: 4726118 - DNA, 22 bp, Homo sapiens
gttcagcgctgtcaggattgcg

SEQ ID NO: 4726119 - DNA, 17 bp, Homo sapiens
gttcagctactttccat

SEQ ID NO: 4726120 - DNA, 23 bp, Homo sapiens
gttcagctactttccatttggta

SEQ ID NO: 4726121 - DNA, 13 bp, Homo sapiens
gttcagctccagc

SEQ ID NO: 4726122 - DNA, 18 bp, Homo sapiens
gttcagctccagctcacc

SEQ ID NO: 4726123 - DNA, 18 bp, Homo sapiens
gttcagggttggcccctg

SEQ ID NO: 4726124 - DNA, 19 bp, Homo sapiens
gttcagggttggcccctgc

SEQ ID NO: 4726125 - DNA, 23 bp, Homo sapiens
gttcataaatttgttgtcatgtg

SEQ ID NO: 4726126 - DNA, 14 bp, Homo sapiens
gttcatcatccctc

SEQ ID NO: 4726127 - DNA, 15 bp, Homo sapiens
gttcatcatccctcc

SEQ ID NO: 4726128 - DNA, 16 bp, Homo sapiens
gttcatcatccctccc

SEQ ID NO: 4726129 - DNA, 19 bp, Homo sapiens
gttcatgtctaagaactct

SEQ ID NO: 4726130 - DNA, 14 bp, Homo sapiens
gttccagagctgct

SEQ ID NO: 4726131 - DNA, 20 bp, Homo sapiens
gttccagcaattctcctgcc

SEQ ID NO: 4726132 - DNA, 12 bp, Homo sapiens
gttccagtgctg

SEQ ID NO: 4726133 - DNA, 22 bp, Homo sapiens
gttcccctcctccactctcccc

SEQ ID NO: 4726134 - DNA, 22 bp, Homo sapiens
gttccccttccactgagggcag

SEQ ID NO: 4726135 - DNA, 21 bp, Homo sapiens
gttccctttgacgccatccca

SEQ ID NO: 4726136 - DNA, 14 bp, Homo sapiens
gttccggcatggac

SEQ ID NO: 4726137 - DNA, 22 bp, Homo sapiens
gttcgacgagacggtcgagcag

SEQ ID NO: 4726138 - DNA, 18 bp, Homo sapiens
gttcggatttggggtgga

SEQ ID NO: 4726139 - DNA, 15 bp, Homo sapiens
gttcggcctgtgtcc

SEQ ID NO: 4726140 - DNA, 16 bp, Homo sapiens
gttctaagtctttcca

SEQ ID NO: 4726141 - DNA, 16 bp, Homo sapiens
gttctacccaggtgct

SEQ ID NO: 4726142 - DNA, 15 bp, Homo sapiens
gttctacttgatatt

SEQ ID NO: 4726143 - DNA, 18 bp, Homo sapiens
gttctacttgatatttcc

SEQ ID NO: 4726144 - DNA, 18 bp, Homo sapiens
gttctatttcagtgccaa

SEQ ID NO: 4726145 - DNA, 18 bp, Homo sapiens
gttctccagtcattatgt

SEQ ID NO: 4726146 - DNA, 20 bp, Homo sapiens
gttctccagtcattatgtta

SEQ ID NO: 4726147 - DNA, 17 bp, Homo sapiens
gttctctgccctccaag

SEQ ID NO: 4726148 - DNA, 18 bp, Homo sapiens
gttctctgccctccaaga

SEQ ID NO: 4726149 - DNA, 23 bp, Homo sapiens
gttctgagtagagcttgtaataa

SEQ ID NO: 4726150 - DNA, 17 bp, Homo sapiens
gttctgatgatgtgcct

SEQ ID NO: 4726151 - DNA, 12 bp, Homo sapiens
gttctggctctt

SEQ ID NO: 4726152 - DNA, 11 bp, Homo sapiens
gttctgggaca

SEQ ID NO: 4726153 - DNA, 12 bp, Homo sapiens
gttctgggacac

SEQ ID NO: 4726154 - DNA, 23 bp, Homo sapiens
gttctgggacacagttcaattct

SEQ ID NO: 4726155 - DNA, 14 bp, Homo sapiens
gttctgtatatttt

SEQ ID NO: 4726156 - DNA, 11 bp, Homo sapiens
gttctgtccct

SEQ ID NO: 4726157 - DNA, 10 bp, Homo sapiens
gttctgtgac

SEQ ID NO: 4726158 - DNA, 14 bp, Homo sapiens
gttctgtgtacatt

SEQ ID NO: 4726159 - DNA, 16 bp, Homo sapiens
gttcttaagacgtgat

SEQ ID NO: 4726160 - DNA, 20 bp, Homo sapiens
gttcttcctgttctgtgact

SEQ ID NO: 4726161 - DNA, 13 bp, Homo sapiens
gttgaaaaaagaa

SEQ ID NO: 4726162 - DNA, 10 bp, Homo sapiens
gttgaagaaa

SEQ ID NO: 4726163 - DNA, 22 bp, Homo sapiens
gtagggtgggccttcagggagt

SEQ ID NO: 4726164 - DNA, 20 bp, Homo sapiens
gtaggttggaagctagctcc

SEQ ID NO: 4726165 - DNA, 10 bp, Homo sapiens
gtagttgttt

SEQ ID NO: 4726166 - DNA, 18 bp, Homo sapiens
gtataaataggagaggat

SEQ ID NO: 4726167 - DNA, 18 bp, Homo sapiens
gtataacaaactatgtaa

SEQ ID NO: 4726168 - DNA, 16 bp, Homo sapiens
gtataagatttttgaa

SEQ ID NO: 4726169 - DNA, 19 bp, Homo sapiens
gtataattttaaagtaatt

SEQ ID NO: 4726170 - DNA, 17 bp, Homo sapiens
gtatatattttttttta

SEQ ID NO: 4726171 - DNA, 12 bp, Homo sapiens
gtatatgaaaac

SEQ ID NO: 4726172 - DNA, 19 bp, Homo sapiens
gtatatgggcttttacctg

SEQ ID NO: 4726173 - DNA, 12 bp, Homo sapiens
gtatattcagga

SEQ ID NO: 4726174 - DNA, 11 bp, Homo sapiens
gtatatttggt

SEQ ID NO: 4726175 - DNA, 14 bp, Homo sapiens
gtatattttgttac

SEQ ID NO: 4726176 - DNA, 15 bp, Homo sapiens
gtatattttgttacc

SEQ ID NO: 4726177 - DNA, 15 bp, Homo sapiens
gtatcaaataaaatt

SEQ ID NO: 4726178 - DNA, 18 bp, Homo sapiens
gtatccctgttactgata

SEQ ID NO: 4726179 - DNA, 15 bp, Homo sapiens
gtatctgcatgtaaa

SEQ ID NO: 4726180 - DNA, 20 bp, Homo sapiens
gtatctgcatgtaaaatctt

SEQ ID NO: 4726181 - DNA, 19 bp, Homo sapiens
gtatctggtgactttcctc

SEQ ID NO: 4726182 - DNA, 15 bp, Homo sapiens
gtatgaagacagagg

SEQ ID NO: 4726183 - DNA, 19 bp, Homo sapiens
gtatgattttgatgcacaa

SEQ ID NO: 4726184 - DNA, 14 bp, Homo sapiens
gtatggaaacactg

SEQ ID NO: 4726185 - DNA, 15 bp, Homo sapiens
gtatggaatgcttct

SEQ ID NO: 4726186 - DNA, 13 bp, Homo sapiens
gtatggtggctgg

SEQ ID NO: 4726187 - DNA, 15 bp, Homo sapiens
gtatgtacagttcat

SEQ ID NO: 4726188 - DNA, 15 bp, Homo sapiens
gtatgtggatacagt

SEQ ID NO: 4726189 - DNA, 19 bp, Homo sapiens
gtatgtttttgtgtatttg

SEQ ID NO: 4726190 - DNA, 19 bp, Homo sapiens
gtattacacagtcaaattt

SEQ ID NO: 4726191 - DNA, 15 bp, Homo sapiens
gtattagccagtcat

SEQ ID NO: 4726192 - DNA, 20 bp, Homo sapiens
gtatttaatgatttttgtgt

SEQ ID NO: 4726193 - DNA, 19 bp, Homo sapiens
gtatttattttttcttttc

SEQ ID NO: 4726194 - DNA, 14 bp, Homo sapiens
gtatttgttaatgg

SEQ ID NO: 4726195 - DNA, 15 bp, Homo sapiens
gtcaaaactggttta

SEQ ID NO: 4726196 - DNA, 19 bp, Homo sapiens
gtcaaaattaatatgatta

SEQ ID NO: 4726197 - DNA, 15 bp, Homo sapiens
gtcaaacgtgaaaat

SEQ ID NO: 4726198 - DNA, 17 bp, Homo sapiens
gtcaacatttctcatgt

SEQ ID NO: 4726199 - DNA, 14 bp, Homo sapiens
gtcaacctgggcaa

SEQ ID NO: 4726200 - DNA, 18 bp, Homo sapiens
gtcaagagggtctgagga

SEQ ID NO: 4726201 - DNA, 17 bp, Homo sapiens
gtcaagtgcgtccacga

SEQ ID NO: 4726202 - DNA, 20 bp, Homo sapiens
gtcacacagtattacttctg

SEQ ID NO: 4726203 - DNA, 15 bp, Homo sapiens
gtcacaggcaggtcc

SEQ ID NO: 4726204 - DNA, 15 bp, Homo sapiens
gtcaccccggccacc

SEQ ID NO: 4726205 - DNA, 17 bp, Homo sapiens
gtcaccccggccacctg

SEQ ID NO: 4726206 - DNA, 22 bp, Homo sapiens
gtcaccccggccacctgcggtg

SEQ ID NO: 4726207 - DNA, 13 bp, Homo sapiens
gtcactctggcag

SEQ ID NO: 4726208 - DNA, 17 bp, Homo sapiens
gtcactctggcagctca

SEQ ID NO: 4726209 - DNA, 23 bp, Homo sapiens
gtcactctggcagctcagagagg

SEQ ID NO: 4726210 - DNA, 21 bp, Homo sapiens
gtcactgagacagcccgggct

SEQ ID NO: 4726211 - DNA, 14 bp, Homo sapiens
gtcactggctgcct

SEQ ID NO: 4726212 - DNA, 19 bp, Homo sapiens
gtcactggctgcctccact

SEQ ID NO: 4726213 - DNA, 23 bp, Homo sapiens
gtcactggctgcctccactccca

SEQ ID NO: 4726214 - DNA, 13 bp, Homo sapiens
gtcacttcaccat

SEQ ID NO: 4726215 - DNA, 20 bp, Homo sapiens
gtcacttgctggctgtgaaa

SEQ ID NO: 4726216 - DNA, 17 bp, Homo sapiens
gtcagacgcctgaggaa

SEQ ID NO: 4726217 - DNA, 15 bp, Homo sapiens
gtcagagcctgcagt

SEQ ID NO: 4726218 - DNA, 14 bp, Homo sapiens
gtcagcaaatgtaa

SEQ ID NO: 4726219 - DNA, 18 bp, Homo sapiens
gtcaggattgcgagagat

SEQ ID NO: 4726220 - DNA, 22 bp, Homo sapiens
gtcaggattgcgagagatgtgt

SEQ ID NO: 4726221 - DNA, 17 bp, Homo sapiens
gtcagtgtccaaagcag

SEQ ID NO: 4726222 - DNA, 23 bp, Homo sapiens
gtcagtgtccaaagcagggtctg

SEQ ID NO: 4726223 - DNA, 18 bp, Homo sapiens
gtcagttgttatttattg

SEQ ID NO: 4726224 - DNA, 21 bp, Homo sapiens
gtcagttgttatttattgaaa

SEQ ID NO: 4726225 - DNA, 13 bp, Homo sapiens
gtcataactagaa

SEQ ID NO: 4726226 - DNA, 17 bp, Homo sapiens
gtcatcaggagaaaaag

SEQ ID NO: 4726227 - DNA, 21 bp, Homo sapiens
gtcatctgataatttcacaga

SEQ ID NO: 4726228 - DNA, 17 bp, Homo sapiens
gtcatgcataaatatgc

SEQ ID NO: 4726229 - DNA, 18 bp, Homo sapiens
gtcatgcataaatatgca

SEQ ID NO: 4726230 - DNA, 18 bp, Homo sapiens
gtcatgtgcatctggtgt

SEQ ID NO: 4726231 - DNA, 22 bp, Homo sapiens
gtcatgtgcatctggtgtagga

SEQ ID NO: 4726232 - DNA, 17 bp, Homo sapiens
gtcatgtgtatgagaag

SEQ ID NO: 4726233 - DNA, 19 bp, Homo sapiens
gtcattatgttaatatttc

SEQ ID NO: 4726234 - DNA, 22 bp, Homo sapiens
gtcattatttgataacattttg

SEQ ID NO: 4726235 - DNA, 17 bp, Homo sapiens
gtcattcctaatgcatt

SEQ ID NO: 4726236 - DNA, 18 bp, Homo sapiens
gtcattcctaatgcatta

SEQ ID NO: 4726237 - DNA, 17 bp, Homo sapiens
gtcatttgagcagggct

SEQ ID NO: 4726238 - DNA, 19 bp, Homo sapiens
gtcatttttaactactgta

SEQ ID NO: 4726239 - DNA, 15 bp, Homo sapiens
gtccaagaagcccag

SEQ ID NO: 4726240 - DNA, 17 bp, Homo sapiens
gtccaagaagcccagga

SEQ ID NO: 4726241 - DNA, 16 bp, Homo sapiens
gtccaagtggctgtga

SEQ ID NO: 4726242 - DNA, 17 bp, Homo sapiens
gtccaatcctatgtttt

SEQ ID NO: 4726243 - DNA, 13 bp, Homo sapiens
gtccacccaggag

SEQ ID NO: 4726244 - DNA, 15 bp, Homo sapiens
gtccacccaggagcc

SEQ ID NO: 4726245 - DNA, 17 bp, Homo sapiens
gtccacgcggccacctc

SEQ ID NO: 4726246 - DNA, 16 bp, Homo sapiens
gtccagccctggctga

SEQ ID NO: 4726247 - DNA, 12 bp, Homo sapiens
gtccagtgccca

SEQ ID NO: 4726248 - DNA, 13 bp, Homo sapiens
gtccatagagagc

SEQ ID NO: 4726249 - DNA, 16 bp, Homo sapiens
gtccatgggcagagcc

SEQ ID NO: 4726250 - DNA, 16 bp, Homo sapiens
gtccattgtccaatcc

SEQ ID NO: 4726251 - DNA, 17 bp, Homo sapiens
gtcccaccttggctgca

SEQ ID NO: 4726252 - DNA, 21 bp, Homo sapiens
gtcccaccttggctgcaggga

SEQ ID NO: 4726253 - DNA, 22 bp, Homo sapiens
gagccgagatcacgccactgca

SEQ ID NO: 4726254 - DNA, 23 bp, Homo sapiens
gagccggacacttctcaggaaat

SEQ ID NO: 4726255 - DNA, 17 bp, Homo sapiens
gagccgggtctgcctct

SEQ ID NO: 4726256 - DNA, 21 bp, Homo sapiens
gagccgggtctgcctcttctg

SEQ ID NO: 4726257 - DNA, 13 bp, Homo sapiens
gagccgtggtcct

SEQ ID NO: 4726258 - DNA, 13 bp, Homo sapiens
gagcctcagcatc

SEQ ID NO: 4726259 - DNA, 17 bp, Homo sapiens
gagcctcagcatcctgg

SEQ ID NO: 4726260 - DNA, 20 bp, Homo sapiens
gagcctcagcatcctggcac

SEQ ID NO: 4726261 - DNA, 18 bp, Homo sapiens
gagcctcagtctccctcc

SEQ ID NO: 4726262 - DNA, 20 bp, Homo sapiens
gagcctccctcaattccccc

SEQ ID NO: 4726263 - DNA, 12 bp, Homo sapiens
gagcctgaggga

SEQ ID NO: 4726264 - DNA, 12 bp, Homo sapiens
gagccttccagg

SEQ ID NO: 4726265 - DNA, 18 bp, Homo sapiens
gagcgaggagatgctcct

SEQ ID NO: 4726266 - DNA, 21 bp, Homo sapiens
gagcgaggagatgctccttgg

SEQ ID NO: 4726267 - DNA, 13 bp, Homo sapiens
gagctacaaatgc

SEQ ID NO: 4726268 - DNA, 19 bp, Homo sapiens
gagctagaacctggagagc

SEQ ID NO: 4726269 - DNA, 21 bp, Homo sapiens
gagctagaacctggagggcta

SEQ ID NO: 4726270 - DNA, 18 bp, Homo sapiens
gagctcagagagggcagg

SEQ ID NO: 4726271 - DNA, 18 bp, Homo sapiens
gagctcccctccccaact

SEQ ID NO: 4726272 - DNA, 18 bp, Homo sapiens
gagctgacacaaacctgc

SEQ ID NO: 4726273 - DNA, 22 bp, Homo sapiens
gagctgacacaaacctgcctgg

SEQ ID NO: 4726274 - DNA, 17 bp, Homo sapiens
gagctgaggcaattcta

SEQ ID NO: 4726275 - DNA, 22 bp, Homo sapiens
gagctgcacagggtttggccca

SEQ ID NO: 4726276 - DNA, 22 bp, Homo sapiens
gagctgcctgttcagctccagc

SEQ ID NO: 4726277 - DNA, 23 bp, Homo sapiens
gagctggccgcgccaaataatgt

SEQ ID NO: 4726278 - DNA, 17 bp, Homo sapiens
gagctgtttactaggga

SEQ ID NO: 4726279 - DNA, 13 bp, Homo sapiens
gagcttccctgac

SEQ ID NO: 4726280 - DNA, 13 bp, Homo sapiens
gagcttgcttctt

SEQ ID NO: 4726281 - DNA, 19 bp, Homo sapiens
gaggaagaacggggctctt

SEQ ID NO: 4726282 - DNA, 23 bp, Homo sapiens
gaggaagaacggggctcttctca

SEQ ID NO: 4726283 - DNA, 20 bp, Homo sapiens
gaggaaggaaacccagctct

SEQ ID NO: 4726284 - DNA, 14 bp, Homo sapiens
gaggaatccagacc

SEQ ID NO: 4726285 - DNA, 15 bp, Homo sapiens
gaggagaagtgggga

SEQ ID NO: 4726286 - DNA, 18 bp, Homo sapiens
gaggagcccaggccagga

SEQ ID NO: 4726287 - DNA, 20 bp, Homo sapiens
gaggagcctgggggctcctc

SEQ ID NO: 4726288 - DNA, 12 bp, Homo sapiens
gaggaggagaaa

SEQ ID NO: 4726289 - DNA, 20 bp, Homo sapiens
gaggagtcaatttgcctctg

SEQ ID NO: 4726290 - DNA, 17 bp, Homo sapiens
gaggatccctctctgga

SEQ ID NO: 4726291 - DNA, 17 bp, Homo sapiens
gaggatgagagcccaga

SEQ ID NO: 4726292 - DNA, 19 bp, Homo sapiens
gaggcacaagccaaggaag

SEQ ID NO: 4726293 - DNA, 21 bp, Homo sapiens
gaggcacttcctcccctcgcc

SEQ ID NO: 4726294 - DNA, 21 bp, Homo sapiens
gaggcagcagtgtgaggccag

SEQ ID NO: 4726295 - DNA, 18 bp, Homo sapiens
gaggcagccccattctgc

SEQ ID NO: 4726296 - DNA, 21 bp, Homo sapiens
gaggcagccccattctgcctg

SEQ ID NO: 4726297 - DNA, 22 bp, Homo sapiens
gaggcagccccattctgcctgc

SEQ ID NO: 4726298 - DNA, 23 bp, Homo sapiens
gaggcagccccattctgcctgcc

SEQ ID NO: 4726299 - DNA, 15 bp, Homo sapiens
gaggcagggtctcac

SEQ ID NO: 4726300 - DNA, 19 bp, Homo sapiens
gaggcagtgggtcccactt

SEQ ID NO: 4726301 - DNA, 22 bp, Homo sapiens
gaggcagtgggtcccacttccc

SEQ ID NO: 4726302 - DNA, 17 bp, Homo sapiens
gaggcatagtcacctag

SEQ ID NO: 4726303 - DNA, 12 bp, Homo sapiens
gaggccagcctt

SEQ ID NO: 4726304 - DNA, 11 bp, Homo sapiens
gaggccaggga

SEQ ID NO: 4726305 - DNA, 15 bp, Homo sapiens
gaggccagggcagag

SEQ ID NO: 4726306 - DNA, 23 bp, Homo sapiens
gaggccatgggcctcctgtgtgt

SEQ ID NO: 4726307 - DNA, 13 bp, Homo sapiens
gaggcccagaggg

SEQ ID NO: 4726308 - DNA, 14 bp, Homo sapiens
gaggcccttctctc

SEQ ID NO: 4726309 - DNA, 24 bp, Homo sapiens
gaggcccttctctccagcccctgg

SEQ ID NO: 4726310 - DNA, 19 bp, Homo sapiens
gaggccgagtctgtcctgg

SEQ ID NO: 4726311 - DNA, 22 bp, Homo sapiens
gaggccgtatgaagacagaggc

SEQ ID NO: 4726312 - DNA, 21 bp, Homo sapiens
gaggcctgcctccagggctgg

SEQ ID NO: 4726313 - DNA, 22 bp, Homo sapiens
gaggcctgcctccagggctgga

SEQ ID NO: 4726314 - DNA, 16 bp, Homo sapiens
gaggccttctctgaag

SEQ ID NO: 4726315 - DNA, 18 bp, Homo sapiens
gaggccttctctgaagga

SEQ ID NO: 4726316 - DNA, 21 bp, Homo sapiens
gctgagtcccaggctgagcct

SEQ ID NO: 4726317 - DNA, 18 bp, Homo sapiens
gctgagtctgaaggctgg

SEQ ID NO: 4726318 - DNA, 13 bp, Homo sapiens
gctgattctcagg

SEQ ID NO: 4726319 - DNA, 15 bp, Homo sapiens
gctgcaaaactagaa

SEQ ID NO: 4726320 - DNA, 23 bp, Homo sapiens
gctgcacagggtttggcccaagt

SEQ ID NO: 4726321 - DNA, 19 bp, Homo sapiens
gctgcaccaacccagccgc

SEQ ID NO: 4726322 - DNA, 16 bp, Homo sapiens
gctgcaccggctggcc

SEQ ID NO: 4726323 - DNA, 22 bp, Homo sapiens
gctgcaccggctggcctggccc

SEQ ID NO: 4726324 - DNA, 14 bp, Homo sapiens
gctgcactctgtgc

SEQ ID NO: 4726325 - DNA, 13 bp, Homo sapiens
gctgcagaggggc

SEQ ID NO: 4726326 - DNA, 20 bp, Homo sapiens
gctgcagaggggcaggccct

SEQ ID NO: 4726327 - DNA, 22 bp, Homo sapiens
gctgcagaggggcaggccctgc

SEQ ID NO: 4726328 - DNA, 17 bp, Homo sapiens
gctgcagatttgggctg

SEQ ID NO: 4726329 - DNA, 21 bp, Homo sapiens
gctgcagatttgggctggaac

SEQ ID NO: 4726330 - DNA, 20 bp, Homo sapiens
gctgcagttgccagtcaccc

SEQ ID NO: 4726331 - DNA, 23 bp, Homo sapiens
gctgccatccaggttcagcttgt

SEQ ID NO: 4726332 - DNA, 12 bp, Homo sapiens
gctgcccaggcc

SEQ ID NO: 4726333 - DNA, 20 bp, Homo sapiens
gctgcccctccctgcctcca

SEQ ID NO: 4726334 - DNA, 17 bp, Homo sapiens
gctgcccggcgccctct

SEQ ID NO: 4726335 - DNA, 16 bp, Homo sapiens
gctgccctgcccacct

SEQ ID NO: 4726336 - DNA, 22 bp, Homo sapiens
gctgccctgcccacctggcctc

SEQ ID NO: 4726337 - DNA, 17 bp, Homo sapiens
gctgccctttctgggca

SEQ ID NO: 4726338 - DNA, 17 bp, Homo sapiens
gctgccgccccacccag

SEQ ID NO: 4726339 - DNA, 16 bp, Homo sapiens
gctgcctccactccca

SEQ ID NO: 4726340 - DNA, 17 bp, Homo sapiens
gctgcctccactcccac

SEQ ID NO: 4726341 - DNA, 12 bp, Homo sapiens
gctgcctgggag

SEQ ID NO: 4726342 - DNA, 13 bp, Homo sapiens
gctgcctgggagc

SEQ ID NO: 4726343 - DNA, 12 bp, Homo sapiens
gctgcctgttca

SEQ ID NO: 4726344 - DNA, 16 bp, Homo sapiens
gctgcggtccacccag

SEQ ID NO: 4726345 - DNA, 17 bp, Homo sapiens
gctgcggtccacccagg

SEQ ID NO: 4726346 - DNA, 19 bp, Homo sapiens
gctgcggtccacccaggag

SEQ ID NO: 4726347 - DNA, 22 bp, Homo sapiens
gctgcggtccacccaggagccc

SEQ ID NO: 4726348 - DNA, 21 bp, Homo sapiens
gctgctaccctccctgctgtc

SEQ ID NO: 4726349 - DNA, 22 bp, Homo sapiens
gctgctaccctccctgctgtcc

SEQ ID NO: 4726350 - DNA, 23 bp, Homo sapiens
gctgctcttgaactcctgacctc

SEQ ID NO: 4726351 - DNA, 19 bp, Homo sapiens
gctgctgaactaatttctg

SEQ ID NO: 4726352 - DNA, 15 bp, Homo sapiens
gctgctgaaggctcg

SEQ ID NO: 4726353 - DNA, 12 bp, Homo sapiens
gctgctgacagt

SEQ ID NO: 4726354 - DNA, 13 bp, Homo sapiens
gctgctgcccagg

SEQ ID NO: 4726355 - DNA, 14 bp, Homo sapiens
gctgctggagactc

SEQ ID NO: 4726356 - DNA, 17 bp, Homo sapiens
gctgctggctgtgacaa

SEQ ID NO: 4726357 - DNA, 13 bp, Homo sapiens
gctgcttctgtct

SEQ ID NO: 4726358 - DNA, 22 bp, Homo sapiens
gctgcttttgtctatgggactc

SEQ ID NO: 4726359 - DNA, 16 bp, Homo sapiens
gctggaatctggagag

SEQ ID NO: 4726360 - DNA, 21 bp, Homo sapiens
gctggaatctggagagctaga

SEQ ID NO: 4726361 - DNA, 23 bp, Homo sapiens
gctggaatgatttcagctcactg

SEQ ID NO: 4726362 - DNA, 16 bp, Homo sapiens
gctggaccttgaactg

SEQ ID NO: 4726363 - DNA, 18 bp, Homo sapiens
gctggaccttgaactggg

SEQ ID NO: 4726364 - DNA, 21 bp, Homo sapiens
gctggactctcagtctctgag

SEQ ID NO: 4726365 - DNA, 20 bp, Homo sapiens
gctggagactcctaggcagg

SEQ ID NO: 4726366 - DNA, 16 bp, Homo sapiens
gctggagccactaact

SEQ ID NO: 4726367 - DNA, 19 bp, Homo sapiens
gctggagccactaactaga

SEQ ID NO: 4726368 - DNA, 17 bp, Homo sapiens
gctggagcctggtgccc

SEQ ID NO: 4726369 - DNA, 21 bp, Homo sapiens
gctggaggactagaacctgga

SEQ ID NO: 4726370 - DNA, 23 bp, Homo sapiens
gctggaggactagaacctggagg

SEQ ID NO: 4726371 - DNA, 14 bp, Homo sapiens
gctggaggagccca

SEQ ID NO: 4726372 - DNA, 15 bp, Homo sapiens
gctggaggagcccag

SEQ ID NO: 4726373 - DNA, 17 bp, Homo sapiens
gctggagggagaaccca

SEQ ID NO: 4726374 - DNA, 12 bp, Homo sapiens
gctggagtgcag

SEQ ID NO: 4726375 - DNA, 17 bp, Homo sapiens
gctggcagagagcacag

SEQ ID NO: 4726376 - DNA, 18 bp, Homo sapiens
gctggcagagagcacagt

SEQ ID NO: 4726377 - DNA, 13 bp, Homo sapiens
gctggccagcccc

SEQ ID NO: 4726378 - DNA, 15 bp, Homo sapiens
gctggccagccccac

SEQ ID NO: 4726379 - DNA, 21 bp, Homo sapiens
gctggccagccccacagccca

SEQ ID NO: 4726380 - DNA, 14 bp, Homo sapiens
gctggccctgccct

SEQ ID NO: 4726381 - DNA, 18 bp, Homo sapiens
gctggccgtgggcctggg

SEQ ID NO: 4726382 - DNA, 23 bp, Homo sapiens
gctggcctctctgacatatgcta

SEQ ID NO: 4726383 - DNA, 15 bp, Homo sapiens
gctggcctggcccct

SEQ ID NO: 4726384 - DNA, 20 bp, Homo sapiens
gctggcctggcccctcaggg

SEQ ID NO: 4726385 - DNA, 14 bp, Homo sapiens
gctggctggggcct

SEQ ID NO: 4726386 - DNA, 20 bp, Homo sapiens
gctggctggtgcctgagccc

SEQ ID NO: 4726387 - DNA, 14 bp, Homo sapiens
gctggctgtgaaac

SEQ ID NO: 4726388 - DNA, 16 bp, Homo sapiens
gctggctgtgaaacca

SEQ ID NO: 4726389 - DNA, 20 bp, Homo sapiens
gctgggacatgggaaagggg

SEQ ID NO: 4726390 - DNA, 12 bp, Homo sapiens
gctgggagagcc

SEQ ID NO: 4726391 - DNA, 13 bp, Homo sapiens
gctgggagagcct

SEQ ID NO: 4726392 - DNA, 14 bp, Homo sapiens
gctgggagcaggac

SEQ ID NO: 4726393 - DNA, 19 bp, Homo sapiens
gctgggattacaggctcct

SEQ ID NO: 4726394 - DNA, 22 bp, Homo sapiens
gctgggattacaggctcctgcc

SEQ ID NO: 4726395 - DNA, 23 bp, Homo sapiens
gctgggattacaggctcctgcca

SEQ ID NO: 4726396 - DNA, 16 bp, Homo sapiens
gctgggattacaggtg

SEQ ID NO: 4726397 - DNA, 19 bp, Homo sapiens
gctgggattacaggtgtga

SEQ ID NO: 4726398 - DNA, 17 bp, Homo sapiens
gctgggctcccttccca

SEQ ID NO: 4726399 - DNA, 12 bp, Homo sapiens
gctgggctgggg

SEQ ID NO: 4726400 - DNA, 14 bp, Homo sapiens
gctgggctggggcc

SEQ ID NO: 4726401 - DNA, 15 bp, Homo sapiens
gctgggctggggcct

SEQ ID NO: 4726402 - DNA, 21 bp, Homo sapiens
gctgggcttcagtggcagctg

SEQ ID NO: 4726403 - DNA, 22 bp, Homo sapiens
gctgggcttcagtggcagctgc

SEQ ID NO: 4726404 - DNA, 13 bp, Homo sapiens
gctgggggcctca

SEQ ID NO: 4726405 - DNA, 18 bp, Homo sapiens
gctgggggcctcagtgcc

SEQ ID NO: 4726406 - DNA, 18 bp, Homo sapiens
gctgggtaagagcacagg

SEQ ID NO: 4726407 - DNA, 19 bp, Homo sapiens
gctgggtcctctgcagtgt

SEQ ID NO: 4726408 - DNA, 22 bp, Homo sapiens
gctgggtgcgaccccatctgcc

SEQ ID NO: 4726409 - DNA, 14 bp, Homo sapiens
gctgggtggcactg

SEQ ID NO: 4726410 - DNA, 16 bp, Homo sapiens
gctgggtggcccatcc

SEQ ID NO: 4726411 - DNA, 15 bp, Homo sapiens
gctgggttctgatcc

SEQ ID NO: 4726412 - DNA, 22 bp, Homo sapiens
gctgggttggcgcaccctcccc

SEQ ID NO: 4726413 - DNA, 22 bp, Homo sapiens
gctggtcatgtgtttgaacttc

SEQ ID NO: 4726414 - DNA, 14 bp, Homo sapiens
gctggtcccactca

SEQ ID NO: 4726415 - DNA, 15 bp, Homo sapiens
gctggtcccactcag

SEQ ID NO: 4726416 - DNA, 19 bp, Homo sapiens
gctggtctcgaactcctga

SEQ ID NO: 4726417 - DNA, 18 bp, Homo sapiens
gctggtgagtgatgcggc

SEQ ID NO: 4726418 - DNA, 12 bp, Homo sapiens
gctggtgcctga

SEQ ID NO: 4726419 - DNA, 18 bp, Homo sapiens
gctggtggatggtgactt

SEQ ID NO: 4726420 - DNA, 14 bp, Homo sapiens
gctggtgtcacctg

SEQ ID NO: 4726421 - DNA, 15 bp, Homo sapiens
gctggtgtcacctga

SEQ ID NO: 4726422 - DNA, 16 bp, Homo sapiens
gctggtgtcacctgaa

SEQ ID NO: 4726423 - DNA, 18 bp, Homo sapiens
gctggtgtcacctgaaga

SEQ ID NO: 4726424 - DNA, 13 bp, Homo sapiens
gctggttcactct

SEQ ID NO: 4726425 - DNA, 22 bp, Homo sapiens
gctggttcagggttggcccctg

SEQ ID NO: 4726426 - DNA, 20 bp, Homo sapiens
gctggttcggatttggggtg

SEQ ID NO: 4726427 - DNA, 15 bp, Homo sapiens
gggacttggaagctc

SEQ ID NO: 4726428 - DNA, 14 bp, Homo sapiens
gggagactgggctg

SEQ ID NO: 4726429 - DNA, 16 bp, Homo sapiens
gggagactgggctgag

SEQ ID NO: 4726430 - DNA, 18 bp, Homo sapiens
gggagagcccaggagctc

SEQ ID NO: 4726431 - DNA, 20 bp, Homo sapiens
gggagagcccaggagctccc

SEQ ID NO: 4726432 - DNA, 18 bp, Homo sapiens
gggagccacatttacata

SEQ ID NO: 4726433 - DNA, 21 bp, Homo sapiens
gggagcctgatcacctgccct

SEQ ID NO: 4726434 - DNA, 13 bp, Homo sapiens
gggagctgcctgt

SEQ ID NO: 4726435 - DNA, 14 bp, Homo sapiens
gggaggccggcgca

SEQ ID NO: 4726436 - DNA, 16 bp, Homo sapiens
gggagggagggctcca

SEQ ID NO: 4726437 - DNA, 13 bp, Homo sapiens
gggagggcctggg

SEQ ID NO: 4726438 - DNA, 13 bp, Homo sapiens
gggagggctccag

SEQ ID NO: 4726439 - DNA, 18 bp, Homo sapiens
gggagggctccagacaca

SEQ ID NO: 4726440 - DNA, 17 bp, Homo sapiens
gggaggtgggatcctcc

SEQ ID NO: 4726441 - DNA, 14 bp, Homo sapiens
gggagtgagctggt

SEQ ID NO: 4726442 - DNA, 16 bp, Homo sapiens
gggatcctccaggtgc

SEQ ID NO: 4726443 - DNA, 15 bp, Homo sapiens
gggatgaaagagaag

SEQ ID NO: 4726444 - DNA, 20 bp, Homo sapiens
gggatgagcatggagctggc

SEQ ID NO: 4726445 - DNA, 21 bp, Homo sapiens
gggatgagcatggagctggcc

SEQ ID NO: 4726446 - DNA, 17 bp, Homo sapiens
gggatggtggagggcca

SEQ ID NO: 4726447 - DNA, 18 bp, Homo sapiens
gggatggtggagggccac

SEQ ID NO: 4726448 - DNA, 13 bp, Homo sapiens
gggattacaggct

SEQ ID NO: 4726449 - DNA, 21 bp, Homo sapiens
gggattacaggctcctgccac

SEQ ID NO: 4726450 - DNA, 15 bp, Homo sapiens
gggattacaggtgtg

SEQ ID NO: 4726451 - DNA, 12 bp, Homo sapiens
gggcacacactg

SEQ ID NO: 4726452 - DNA, 13 bp, Homo sapiens
gggcacacactgt

SEQ ID NO: 4726453 - DNA, 14 bp, Homo sapiens
gggcactgctgggt

SEQ ID NO: 4726454 - DNA, 16 bp, Homo sapiens
gggcactgctgggtgg

SEQ ID NO: 4726455 - DNA, 12 bp, Homo sapiens
gggcagagcaga

SEQ ID NO: 4726456 - DNA, 16 bp, Homo sapiens
gggcagagtcacacgg

SEQ ID NO: 4726457 - DNA, 19 bp, Homo sapiens
gggtcatttttaactactg

SEQ ID NO: 4726458 - DNA, 12 bp, Homo sapiens
gggtccatgggc

SEQ ID NO: 4726459 - DNA, 22 bp, Homo sapiens
gggtccctctcttgaccctgtc

SEQ ID NO: 4726460 - DNA, 15 bp, Homo sapiens
gggtcctcctccagg

SEQ ID NO: 4726461 - DNA, 12 bp, Homo sapiens
gggtctctgctg

SEQ ID NO: 4726462 - DNA, 13 bp, Homo sapiens
gggtctctgctgc

SEQ ID NO: 4726463 - DNA, 21 bp, Homo sapiens
gggtctgaggaatccagaccc

SEQ ID NO: 4726464 - DNA, 18 bp, Homo sapiens
gggtgatatggacagcag

SEQ ID NO: 4726465 - DNA, 17 bp, Homo sapiens
gggtggatgcctggtgg

SEQ ID NO: 4726466 - DNA, 17 bp, Homo sapiens
gggtgtggcgcagcata

SEQ ID NO: 4726467 - DNA, 23 bp, Homo sapiens
gggttcccttttttggctgctga

SEQ ID NO: 4726468 - DNA, 19 bp, Homo sapiens
gggttccttcctctgagcc

SEQ ID NO: 4726469 - DNA, 20 bp, Homo sapiens
gggttccttcctctgagcct

SEQ ID NO: 4726470 - DNA, 21 bp, Homo sapiens
gggttccttcctctgagcctt

SEQ ID NO: 4726471 - DNA, 22 bp, Homo sapiens
gggttctacccaggtgctagga

SEQ ID NO: 4726472 - DNA, 15 bp, Homo sapiens
gggttgggctggtgt

SEQ ID NO: 4726473 - DNA, 17 bp, Homo sapiens
gggtttacaacaaacac

SEQ ID NO: 4726474 - DNA, 20 bp, Homo sapiens
gggttttgccatgttggcca

SEQ ID NO: 4726475 - DNA, 18 bp, Homo sapiens
gggttttgtattctctga

SEQ ID NO: 4726476 - DNA, 20 bp, Homo sapiens
ggtaacaggcagatacagga

SEQ ID NO: 4726477 - DNA, 18 bp, Homo sapiens
ggtaatcgacctgcctcg

SEQ ID NO: 4726478 - DNA, 13 bp, Homo sapiens
ggtaccagccact

SEQ ID NO: 4726479 - DNA, 16 bp, Homo sapiens
ggtacttgtggacaca

SEQ ID NO: 4726480 - DNA, 17 bp, Homo sapiens
ggtacttgtggacacag

SEQ ID NO: 4726481 - DNA, 11 bp, Homo sapiens
ggtagaacaca

SEQ ID NO: 4726482 - DNA, 17 bp, Homo sapiens
ggtagggggctggagga

SEQ ID NO: 4726483 - DNA, 13 bp, Homo sapiens
ggtatatttctgg

SEQ ID NO: 4726484 - DNA, 16 bp, Homo sapiens
ggtatgatcaataaag

SEQ ID NO: 4726485 - DNA, 22 bp, Homo sapiens
ggtatgatcacggctcactgca

SEQ ID NO: 4726486 - DNA, 22 bp, Homo sapiens
ggtattaactttatacacttgg

SEQ ID NO: 4726487 - DNA, 15 bp, Homo sapiens
ggtcagagcctgcag

SEQ ID NO: 4726488 - DNA, 13 bp, Homo sapiens
ggtcatccttgcc

SEQ ID NO: 4726489 - DNA, 17 bp, Homo sapiens
ggtcatccttgcccatc

SEQ ID NO: 4726490 - DNA, 15 bp, Homo sapiens
ggtcatttatgaaaa

SEQ ID NO: 4726491 - DNA, 16 bp, Homo sapiens
ggtccacaacacacag

SEQ ID NO: 4726492 - DNA, 17 bp, Homo sapiens
ggtccacccaggagccc

SEQ ID NO: 4726493 - DNA, 20 bp, Homo sapiens
ggtccagccctggctgaagg

SEQ ID NO: 4726494 - DNA, 21 bp, Homo sapiens
ggtccagccctggctgaagga

SEQ ID NO: 4726495 - DNA, 22 bp, Homo sapiens
ggtccagccctggctgaaggac

SEQ ID NO: 4726496 - DNA, 12 bp, Homo sapiens
ggtcccacccca

SEQ ID NO: 4726497 - DNA, 14 bp, Homo sapiens
ggtcccaccccaca

SEQ ID NO: 4726498 - DNA, 14 bp, Homo sapiens
ggtcccactcagtc

SEQ ID NO: 4726499 - DNA, 13 bp, Homo sapiens
ggtcccacttccc

SEQ ID NO: 4726500 - DNA, 18 bp, Homo sapiens
ggtcccccttccatggac

SEQ ID NO: 4726501 - DNA, 23 bp, Homo sapiens
ggtcccccttccatggactttgt

SEQ ID NO: 4726502 - DNA, 14 bp, Homo sapiens
ggtccctggtggca

SEQ ID NO: 4726503 - DNA, 17 bp, Homo sapiens
ggtcctcctccagggac

SEQ ID NO: 4726504 - DNA, 21 bp, Homo sapiens
ggtcctgctgcagttgccagt

SEQ ID NO: 4726505 - DNA, 15 bp, Homo sapiens
ggtcctttggggtga

SEQ ID NO: 4726506 - DNA, 14 bp, Homo sapiens
ggtcggaccagctt

SEQ ID NO: 4726507 - DNA, 18 bp, Homo sapiens
ggtctaaagtgagctcta

SEQ ID NO: 4726508 - DNA, 22 bp, Homo sapiens
ggtctcactatgttgcccaggc

SEQ ID NO: 4726509 - DNA, 16 bp, Homo sapiens
ggtctcactctgtcgc

SEQ ID NO: 4726510 - DNA, 20 bp, Homo sapiens
ggtctcgctgatgctgggct

SEQ ID NO: 4726511 - DNA, 21 bp, Homo sapiens
ggtctcgctgatgctgggctg

SEQ ID NO: 4726512 - DNA, 15 bp, Homo sapiens
ggtctgacccactgc

SEQ ID NO: 4726513 - DNA, 16 bp, Homo sapiens
ggtctgacccactgct

SEQ ID NO: 4726514 - DNA, 22 bp, Homo sapiens
ggtctgaggggcaactgagtct

SEQ ID NO: 4726515 - DNA, 23 bp, Homo sapiens
ggtctgcctcttctgggagggca

SEQ ID NO: 4726516 - DNA, 16 bp, Homo sapiens
ggtctgctcgggccca

SEQ ID NO: 4726517 - DNA, 22 bp, Homo sapiens
ggtctgctcgggcccaggccat

SEQ ID NO: 4726518 - DNA, 16 bp, Homo sapiens
ggtctgtcctgacagc

SEQ ID NO: 4726519 - DNA, 22 bp, Homo sapiens
ggtctgtgccaaagaagaatcc

SEQ ID NO: 4726520 - DNA, 23 bp, Homo sapiens
ggtcttactttgtgcaaaagcag

SEQ ID NO: 4726521 - DNA, 16 bp, Homo sapiens
ggtcttatgcttccat

SEQ ID NO: 4726522 - DNA, 14 bp, Homo sapiens
ggtgaacattgcaa

SEQ ID NO: 4726523 - DNA, 18 bp, Homo sapiens
ggtgacatgtgaaacctt

SEQ ID NO: 4726524 - DNA, 19 bp, Homo sapiens
ggtgactgggccctgcctc

SEQ ID NO: 4726525 - DNA, 19 bp, Homo sapiens
ggtgagcccatggccctcc

SEQ ID NO: 4726526 - DNA, 19 bp, Homo sapiens
ggtgaggacccgccggatg

SEQ ID NO: 4726527 - DNA, 22 bp, Homo sapiens
ggtgataggtataagtggtgtg

SEQ ID NO: 4726528 - DNA, 24 bp, Homo sapiens
ggtgatccacccacctcagcctcc

SEQ ID NO: 4726529 - DNA, 22 bp, Homo sapiens
ggtgcacaagctccaagctccc

SEQ ID NO: 4726530 - DNA, 16 bp, Homo sapiens
ggtgcatgcaggtctc

SEQ ID NO: 4726531 - DNA, 22 bp, Homo sapiens
ggtgccaacagtgttaggcctg

SEQ ID NO: 4726532 - DNA, 19 bp, Homo sapiens
ggtgccctgttctctacca

SEQ ID NO: 4726533 - DNA, 18 bp, Homo sapiens
ggtgcctgattcggctgt

SEQ ID NO: 4726534 - DNA, 21 bp, Homo sapiens
ggtgcctgattcggctgtctc

SEQ ID NO: 4726535 - DNA, 14 bp, Homo sapiens
ggtgcgaccccatc

SEQ ID NO: 4726536 - DNA, 19 bp, Homo sapiens
ggtgcgaccccatctgccc

SEQ ID NO: 4726537 - DNA, 21 bp, Homo sapiens
ggtgcgaccccatctgcccag

SEQ ID NO: 4726538 - DNA, 23 bp, Homo sapiens
ggtgctacacccttttccagctg

SEQ ID NO: 4726539 - DNA, 19 bp, Homo sapiens
ggtgctatctcccccagcc

SEQ ID NO: 4726540 - DNA, 22 bp, Homo sapiens
ggtgctatctcccccagcccca

SEQ ID NO: 4726541 - DNA, 18 bp, Homo sapiens
ggccatcttccaggtggg

SEQ ID NO: 4726542 - DNA, 16 bp, Homo sapiens
ggccatgctgagagct

SEQ ID NO: 4726543 - DNA, 16 bp, Homo sapiens
ggccatggagagctgg

SEQ ID NO: 4726544 - DNA, 17 bp, Homo sapiens
ggccatggagagctgga

SEQ ID NO: 4726545 - DNA, 20 bp, Homo sapiens
ggccattctattgtggcaag

SEQ ID NO: 4726546 - DNA, 18 bp, Homo sapiens
ggcccaccccacccactt

SEQ ID NO: 4726547 - DNA, 23 bp, Homo sapiens
ggcccaccccacccacttctgca

SEQ ID NO: 4726548 - DNA, 11 bp, Homo sapiens
ggcccagagag

SEQ ID NO: 4726549 - DNA, 16 bp, Homo sapiens
ggcccagctcccccgg

SEQ ID NO: 4726550 - DNA, 22 bp, Homo sapiens
ggcccatcagtgtacccccgcc

SEQ ID NO: 4726551 - DNA, 16 bp, Homo sapiens
ggcccatcccccctca

SEQ ID NO: 4726552 - DNA, 12 bp, Homo sapiens
ggccccagcctg

SEQ ID NO: 4726553 - DNA, 17 bp, Homo sapiens
ggccccagcctggccca

SEQ ID NO: 4726554 - DNA, 20 bp, Homo sapiens
ggccccagcctggcccagct

SEQ ID NO: 4726555 - DNA, 16 bp, Homo sapiens
ggcccctcagggtccc

SEQ ID NO: 4726556 - DNA, 12 bp, Homo sapiens
ggcccctgccac

SEQ ID NO: 4726557 - DNA, 17 bp, Homo sapiens
ggcccctgccaccctgg

SEQ ID NO: 4726558 - DNA, 13 bp, Homo sapiens
ggcccctgcccgg

SEQ ID NO: 4726559 - DNA, 23 bp, Homo sapiens
ggcccctgctggttcagggttgg

SEQ ID NO: 4726560 - DNA, 17 bp, Homo sapiens
ggcccgcttgcctcggc

SEQ ID NO: 4726561 - DNA, 20 bp, Homo sapiens
ggcccgttgtctccctggcc

SEQ ID NO: 4726562 - DNA, 22 bp, Homo sapiens
ggcccgttgtctccctggccct

SEQ ID NO: 4726563 - DNA, 19 bp, Homo sapiens
ggccctcaaggcctcccac

SEQ ID NO: 4726564 - DNA, 14 bp, Homo sapiens
ggccctccacacct

SEQ ID NO: 4726565 - DNA, 17 bp, Homo sapiens
ggccctccacacctgcg

SEQ ID NO: 4726566 - DNA, 16 bp, Homo sapiens
ggccctcgctgccagc

SEQ ID NO: 4726567 - DNA, 23 bp, Homo sapiens
ggccctcgctgccagctctgtat

SEQ ID NO: 4726568 - DNA, 21 bp, Homo sapiens
ggccctctgcccactccctgc

SEQ ID NO: 4726569 - DNA, 14 bp, Homo sapiens
ggccctgcactgtc

SEQ ID NO: 4726570 - DNA, 18 bp, Homo sapiens
ggccctgcactgtcctgc

SEQ ID NO: 4726571 - DNA, 21 bp, Homo sapiens
ggccctgcactgtcctgctcc

SEQ ID NO: 4726572 - DNA, 13 bp, Homo sapiens
ggccctgcctcct

SEQ ID NO: 4726573 - DNA, 21 bp, Homo sapiens
ggcccttctctccagcccctg

SEQ ID NO: 4726574 - DNA, 23 bp, Homo sapiens
ggcccttctctccagcccctgga

SEQ ID NO: 4726575 - DNA, 13 bp, Homo sapiens
ggccgagtctgtc

SEQ ID NO: 4726576 - DNA, 14 bp, Homo sapiens
ggccggccaggtgg

SEQ ID NO: 4726577 - DNA, 17 bp, Homo sapiens
ggccggccaggtgggcg

SEQ ID NO: 4726578 - DNA, 22 bp, Homo sapiens
ggccgggaccccgagcctggct

SEQ ID NO: 4726579 - DNA, 17 bp, Homo sapiens
ggccgtgggcctggggt

SEQ ID NO: 4726580 - DNA, 22 bp, Homo sapiens
ggcctaccttgtgagggagaga

SEQ ID NO: 4726581 - DNA, 15 bp, Homo sapiens
ggcctagtcccttcc

SEQ ID NO: 4726582 - DNA, 15 bp, Homo sapiens
ggcctatcagtgtgc

SEQ ID NO: 4726583 - DNA, 16 bp, Homo sapiens
ggcctatcagtgtgcc

SEQ ID NO: 4726584 - DNA, 23 bp, Homo sapiens
ggcctatcagtgtgccccccatc

SEQ ID NO: 4726585 - DNA, 17 bp, Homo sapiens
ggcctcattactttacc

SEQ ID NO: 4726586 - DNA, 13 bp, Homo sapiens
ggcctcccaactc

SEQ ID NO: 4726587 - DNA, 17 bp, Homo sapiens
ggcctcccaactcaccc

SEQ ID NO: 4726588 - DNA, 20 bp, Homo sapiens
ggcctcccaactcaccccag

SEQ ID NO: 4726589 - DNA, 23 bp, Homo sapiens
ggcctcccaactcaccccagccc

SEQ ID NO: 4726590 - DNA, 15 bp, Homo sapiens
ggcctcccacagtga

SEQ ID NO: 4726591 - DNA, 15 bp, Homo sapiens
ggcctcgcctggcct

SEQ ID NO: 4726592 - DNA, 19 bp, Homo sapiens
ggcctctccttgtggcctg

SEQ ID NO: 4726593 - DNA, 18 bp, Homo sapiens
ggcctctgcactcccctg

SEQ ID NO: 4726594 - DNA, 17 bp, Homo sapiens
ggcctcttatgggctgg

SEQ ID NO: 4726595 - DNA, 18 bp, Homo sapiens
ggcctcttatgggctggg

SEQ ID NO: 4726596 - DNA, 15 bp, Homo sapiens
ggcctgagctgggat

SEQ ID NO: 4726597 - DNA, 18 bp, Homo sapiens
ggcctgaggtctcgctga

SEQ ID NO: 4726598 - DNA, 21 bp, Homo sapiens
ggcctgaggtctcgctgatgc

SEQ ID NO: 4726599 - DNA, 22 bp, Homo sapiens
ggcctgaggtctcgctgatgct

SEQ ID NO: 4726600 - DNA, 17 bp, Homo sapiens
ggcctgccacctggacc

SEQ ID NO: 4726601 - DNA, 22 bp, Homo sapiens
ggcctgccacctggacccctgc

SEQ ID NO: 4726602 - DNA, 20 bp, Homo sapiens
ggcctgcgtgtgtctgtgtt

SEQ ID NO: 4726603 - DNA, 20 bp, Homo sapiens
ggcctggcaaaataaaacat

SEQ ID NO: 4726604 - DNA, 22 bp, Homo sapiens
ggcctggcacagtgtctgggct

SEQ ID NO: 4726605 - DNA, 15 bp, Homo sapiens
ggcctggccagatgc

SEQ ID NO: 4726606 - DNA, 14 bp, Homo sapiens
ggcctggccatgtg

SEQ ID NO: 4726607 - DNA, 17 bp, Homo sapiens
ggcctggcccctcaggg

SEQ ID NO: 4726608 - DNA, 18 bp, Homo sapiens
ggcctggcccctcagggt

SEQ ID NO: 4726609 - DNA, 10 bp, Homo sapiens
ggcctggcct

SEQ ID NO: 4726610 - DNA, 19 bp, Homo sapiens
ggcctggcctgagctggga

SEQ ID NO: 4726611 - DNA, 18 bp, Homo sapiens
ggcctgggggcagggaga

SEQ ID NO: 4726612 - DNA, 21 bp, Homo sapiens
ggcctgtgtctagttgtttga

SEQ ID NO: 4726613 - DNA, 21 bp, Homo sapiens
ggcctgttttagaaggttctc

SEQ ID NO: 4726614 - DNA, 17 bp, Homo sapiens
ggccttcagggagtgag

SEQ ID NO: 4726615 - DNA, 12 bp, Homo sapiens
ggccttctctga

SEQ ID NO: 4726616 - DNA, 15 bp, Homo sapiens
ggccttctctgaagg

SEQ ID NO: 4726617 - DNA, 23 bp, Homo sapiens
ggcgacaagagtgagactccacc

SEQ ID NO: 4726618 - DNA, 15 bp, Homo sapiens
ggcgcaaagggcatg

SEQ ID NO: 4726619 - DNA, 21 bp, Homo sapiens
ggaccctactattcatgtttt

SEQ ID NO: 4726620 - DNA, 11 bp, Homo sapiens
ggaccctgagg

SEQ ID NO: 4726621 - DNA, 13 bp, Homo sapiens
ggaccctgaggcc

SEQ ID NO: 4726622 - DNA, 15 bp, Homo sapiens
ggaccctgaggccca

SEQ ID NO: 4726623 - DNA, 20 bp, Homo sapiens
ggacctaggatatcttctcc

SEQ ID NO: 4726624 - DNA, 22 bp, Homo sapiens
ggacgcaggcccctctcctccg

SEQ ID NO: 4726625 - DNA, 15 bp, Homo sapiens
ggacgccacccagca

SEQ ID NO: 4726626 - DNA, 14 bp, Homo sapiens
ggacgcctgggggt

SEQ ID NO: 4726627 - DNA, 20 bp, Homo sapiens
ggacgcctgggggtgccagg

SEQ ID NO: 4726628 - DNA, 19 bp, Homo sapiens
ggacgctacccgggaaggg

SEQ ID NO: 4726629 - DNA, 14 bp, Homo sapiens
ggacgttgttttgg

SEQ ID NO: 4726630 - DNA, 20 bp, Homo sapiens
ggactaacttgtctttggac

SEQ ID NO: 4726631 - DNA, 20 bp, Homo sapiens
ggactacaggtgtgagtcac

SEQ ID NO: 4726632 - DNA, 15 bp, Homo sapiens
ggactcaatgcactg

SEQ ID NO: 4726633 - DNA, 18 bp, Homo sapiens
ggactcaatgcactgaca

SEQ ID NO: 4726634 - DNA, 18 bp, Homo sapiens
ggactcaatttctcccca

SEQ ID NO: 4726635 - DNA, 13 bp, Homo sapiens
ggactcagctccc

SEQ ID NO: 4726636 - DNA, 15 bp, Homo sapiens
ggactcaggaacttt

SEQ ID NO: 4726637 - DNA, 15 bp, Homo sapiens
ggactctgcagcctc

SEQ ID NO: 4726638 - DNA, 13 bp, Homo sapiens
ggactggtaaaat

SEQ ID NO: 4726639 - DNA, 21 bp, Homo sapiens
ggactgtgacaggcagcagag

SEQ ID NO: 4726640 - DNA, 17 bp, Homo sapiens
ggacttggaagctccgc

SEQ ID NO: 4726641 - DNA, 9 bp, Homo sapiens
ggactttgt

SEQ ID NO: 4726642 - DNA, 18 bp, Homo sapiens
ggagaagccacaggcctg

SEQ ID NO: 4726643 - DNA, 19 bp, Homo sapiens
ggagaagccacaggcctga

SEQ ID NO: 4726644 - DNA, 22 bp, Homo sapiens
ggagaatggtgttccattgcct

SEQ ID NO: 4726645 - DNA, 17 bp, Homo sapiens
ggagactatcagcccaa

SEQ ID NO: 4726646 - DNA, 21 bp, Homo sapiens
ggagactcctaggcaggacat

SEQ ID NO: 4726647 - DNA, 15 bp, Homo sapiens
ggagactgcccagct

SEQ ID NO: 4726648 - DNA, 22 bp, Homo sapiens
ggagactgctgagtcaacccaa

SEQ ID NO: 4726649 - DNA, 22 bp, Homo sapiens
ggagagccaccaagagggacgc

SEQ ID NO: 4726650 - DNA, 16 bp, Homo sapiens
ggagagccagaacctg

SEQ ID NO: 4726651 - DNA, 19 bp, Homo sapiens
ggagagccagaacctggag

SEQ ID NO: 4726652 - DNA, 20 bp, Homo sapiens
ggagagccagaacctggagg

SEQ ID NO: 4726653 - DNA, 12 bp, Homo sapiens
ggagagcccagg

SEQ ID NO: 4726654 - DNA, 13 bp, Homo sapiens
ggagagcccagga

SEQ ID NO: 4726655 - DNA, 15 bp, Homo sapiens
ggagagcccaggagc

SEQ ID NO: 4726656 - DNA, 22 bp, Homo sapiens
ggagagcccaggagctcccctc

SEQ ID NO: 4726657 - DNA, 13 bp, Homo sapiens
ggagagccttcca

SEQ ID NO: 4726658 - DNA, 16 bp, Homo sapiens
ggagagccttccaggg

SEQ ID NO: 4726659 - DNA, 17 bp, Homo sapiens
ggagagccttccagggg

SEQ ID NO: 4726660 - DNA, 20 bp, Homo sapiens
ggagagctagaacccggcag

SEQ ID NO: 4726661 - DNA, 16 bp, Homo sapiens
ggagagctagaacctg

SEQ ID NO: 4726662 - DNA, 18 bp, Homo sapiens
ggagagctagaacctgga

SEQ ID NO: 4726663 - DNA, 20 bp, Homo sapiens
ggagagctagaacctggaga

SEQ ID NO: 4726664 - DNA, 22 bp, Homo sapiens
ggagagctagaacctggagagc

SEQ ID NO: 4726665 - DNA, 22 bp, Homo sapiens
ggagagctggagcctggtgccc

SEQ ID NO: 4726666 - DNA, 17 bp, Homo sapiens
ggagaggggacgcaggc

SEQ ID NO: 4726667 - DNA, 20 bp, Homo sapiens
ggagaggggacgcaggcccc

SEQ ID NO: 4726668 - DNA, 13 bp, Homo sapiens
ggagatgtctctg

SEQ ID NO: 4726669 - DNA, 23 bp, Homo sapiens
ggagcagaatcagtattgggagc

SEQ ID NO: 4726670 - DNA, 17 bp, Homo sapiens
ggagcagagctctgccg

SEQ ID NO: 4726671 - DNA, 14 bp, Homo sapiens
ggagcagtgcaggc

SEQ ID NO: 4726672 - DNA, 18 bp, Homo sapiens
ggagcagtgcaggcacag

SEQ ID NO: 4726673 - DNA, 17 bp, Homo sapiens
ggagcatccacctcctt

SEQ ID NO: 4726674 - DNA, 19 bp, Homo sapiens
ggagcatccacctccttct

SEQ ID NO: 4726675 - DNA, 22 bp, Homo sapiens
ggagccaatccactccttcctt

SEQ ID NO: 4726676 - DNA, 16 bp, Homo sapiens
ggagccactcctctga

SEQ ID NO: 4726677 - DNA, 21 bp, Homo sapiens
ggagccactcctctgactcag

SEQ ID NO: 4726678 - DNA, 16 bp, Homo sapiens
ggagcccagctctgaa

SEQ ID NO: 4726679 - DNA, 14 bp, Homo sapiens
ggagcccaggccag

SEQ ID NO: 4726680 - DNA, 16 bp, Homo sapiens
ggagcccaggccagga

SEQ ID NO: 4726681 - DNA, 24 bp, Homo sapiens
ggagcccaggccaggactctgcag

SEQ ID NO: 4726682 - DNA, 18 bp, Homo sapiens
ggagcctgggggctcctc

SEQ ID NO: 4726683 - DNA, 20 bp, Homo sapiens
ggagctcagagagggcaggc

SEQ ID NO: 4726684 - DNA, 13 bp, Homo sapiens
ggagctgcctgga

SEQ ID NO: 4726685 - DNA, 14 bp, Homo sapiens
ggagctgcctggac

SEQ ID NO: 4726686 - DNA, 15 bp, Homo sapiens
ggagctgcctggacc

SEQ ID NO: 4726687 - DNA, 19 bp, Homo sapiens
ggaggaaggaaacccagct

SEQ ID NO: 4726688 - DNA, 13 bp, Homo sapiens
ggaggaaggattg

SEQ ID NO: 4726689 - DNA, 18 bp, Homo sapiens
ggaggacaagaccctctc

SEQ ID NO: 4726690 - DNA, 17 bp, Homo sapiens
ggaggagcagtgcaggc

SEQ ID NO: 4726691 - DNA, 17 bp, Homo sapiens
ggaggaggtgccaacag

SEQ ID NO: 4726692 - DNA, 21 bp, Homo sapiens
ggaggatgttctgggacacag

SEQ ID NO: 4726693 - DNA, 13 bp, Homo sapiens
tgaggcccagagg

SEQ ID NO: 4726694 - DNA, 15 bp, Homo sapiens
tgaggcccagagggc

SEQ ID NO: 4726695 - DNA, 17 bp, Homo sapiens
tgaggcccagagggcct

SEQ ID NO: 4726696 - DNA, 21 bp, Homo sapiens
tgaggcccagagggcctgcaa

SEQ ID NO: 4726697 - DNA, 23 bp, Homo sapiens
tgaggcccagagggcctgcaagg

SEQ ID NO: 4726698 - DNA, 21 bp, Homo sapiens
tgaggccccttctaggtggca

SEQ ID NO: 4726699 - DNA, 17 bp, Homo sapiens
tgaggccctccacacct

SEQ ID NO: 4726700 - DNA, 16 bp, Homo sapiens
tgaggcccttctctcc

SEQ ID NO: 4726701 - DNA, 18 bp, Homo sapiens
tgaggcccttctctccag

SEQ ID NO: 4726702 - DNA, 20 bp, Homo sapiens
tgaggcccttctctccagcc

SEQ ID NO: 4726703 - DNA, 24 bp, Homo sapiens
tgaggcccttctctccagcccctg

SEQ ID NO: 4726704 - DNA, 17 bp, Homo sapiens
tgaggctagtgtggtgt

SEQ ID NO: 4726705 - DNA, 13 bp, Homo sapiens
tgaggctctgccc

SEQ ID NO: 4726706 - DNA, 11 bp, Homo sapiens
tgaggctgggc

SEQ ID NO: 4726707 - DNA, 16 bp, Homo sapiens
tgaggctgggctccct

SEQ ID NO: 4726708 - DNA, 15 bp, Homo sapiens
tgagggattatcttt

SEQ ID NO: 4726709 - DNA, 14 bp, Homo sapiens
tgagggggaagtga

SEQ ID NO: 4726710 - DNA, 13 bp, Homo sapiens
tgaggtcagagcc

SEQ ID NO: 4726711 - DNA, 14 bp, Homo sapiens
tgaggtcagagcct

SEQ ID NO: 4726712 - DNA, 16 bp, Homo sapiens
tgaggtcagagcctgc

SEQ ID NO: 4726713 - DNA, 17 bp, Homo sapiens
tgaggtcagagcctgca

SEQ ID NO: 4726714 - DNA, 18 bp, Homo sapiens
tgaggtcagagcctgcag

SEQ ID NO: 4726715 - DNA, 14 bp, Homo sapiens
tgaggtctcgctga

SEQ ID NO: 4726716 - DNA, 17 bp, Homo sapiens
tgagtactacagtcctc

SEQ ID NO: 4726717 - DNA, 19 bp, Homo sapiens
tgagtcccaggctgagcct

SEQ ID NO: 4726718 - DNA, 15 bp, Homo sapiens
tgagtcgaggacagg

SEQ ID NO: 4726719 - DNA, 16 bp, Homo sapiens
tgagtcgaggacaggg

SEQ ID NO: 4726720 - DNA, 20 bp, Homo sapiens
tgagtgatgcggcagattga

SEQ ID NO: 4726721 - DNA, 15 bp, Homo sapiens
tgagtgcagtcctga

SEQ ID NO: 4726722 - DNA, 19 bp, Homo sapiens
tgagtgctctgatccctct

SEQ ID NO: 4726723 - DNA, 15 bp, Homo sapiens
tgagtggcatggcca

SEQ ID NO: 4726724 - DNA, 13 bp, Homo sapiens
tgcagggagtccg

SEQ ID NO: 4726725 - DNA, 20 bp, Homo sapiens
tgcaggtctccatgaagaag

SEQ ID NO: 4726726 - DNA, 17 bp, Homo sapiens
tgcagtcacgtgtaaac

SEQ ID NO: 4726727 - DNA, 19 bp, Homo sapiens
tgcagtcctgatcagagcc

SEQ ID NO: 4726728 - DNA, 18 bp, Homo sapiens
tgcagtctctctctgcca

SEQ ID NO: 4726729 - DNA, 21 bp, Homo sapiens
tgcagtgatatggcagaagac

SEQ ID NO: 4726730 - DNA, 14 bp, Homo sapiens
tgcagtgcggctca

SEQ ID NO: 4726731 - DNA, 22 bp, Homo sapiens
tgcagtggtatgatcacggctc

SEQ ID NO: 4726732 - DNA, 20 bp, Homo sapiens
tgcagtggtgcgatctgggt

SEQ ID NO: 4726733 - DNA, 21 bp, Homo sapiens
tgcagtggtgcgatctgggtt

SEQ ID NO: 4726734 - DNA, 22 bp, Homo sapiens
tgcagtgtggcaagcaagagct

SEQ ID NO: 4726735 - DNA, 13 bp, Homo sapiens
tgcagttgccagt

SEQ ID NO: 4726736 - DNA, 12 bp, Homo sapiens
tgcataaatatg

SEQ ID NO: 4726737 - DNA, 13 bp, Homo sapiens
tgcataaatatgc

SEQ ID NO: 4726738 - DNA, 14 bp, Homo sapiens
tgcataaatatgca

SEQ ID NO: 4726739 - DNA, 17 bp, Homo sapiens
tgcataacaattcctct

SEQ ID NO: 4726740 - DNA, 18 bp, Homo sapiens
tgcataacaattcctcta

SEQ ID NO: 4726741 - DNA, 17 bp, Homo sapiens
tgcatagagccacgtat

SEQ ID NO: 4726742 - DNA, 15 bp, Homo sapiens
tgcatataaatatat

SEQ ID NO: 4726743 - DNA, 13 bp, Homo sapiens
tgcatattataaa

SEQ ID NO: 4726744 - DNA, 17 bp, Homo sapiens
tgcatcatagtttgctt

SEQ ID NO: 4726745 - DNA, 18 bp, Homo sapiens
tgcatcctccgcctcccg

SEQ ID NO: 4726746 - DNA, 13 bp, Homo sapiens
tgcatctcccaga

SEQ ID NO: 4726747 - DNA, 13 bp, Homo sapiens
tgcatgaaggttt

SEQ ID NO: 4726748 - DNA, 21 bp, Homo sapiens
tgcatgcaggtctccatgaag

SEQ ID NO: 4726749 - DNA, 11 bp, Homo sapiens
tgcatggaaat

SEQ ID NO: 4726750 - DNA, 20 bp, Homo sapiens
tgcatgtaaaatcttcagct

SEQ ID NO: 4726751 - DNA, 23 bp, Homo sapiens
tgcatgtaaaatcttcagctggt

SEQ ID NO: 4726752 - DNA, 18 bp, Homo sapiens
tgcattaatctaagaaaa

SEQ ID NO: 4726753 - DNA, 23 bp, Homo sapiens
tgcattcgcggttaagatactca

SEQ ID NO: 4726754 - DNA, 20 bp, Homo sapiens
tgcattcttggttggctggc

SEQ ID NO: 4726755 - DNA, 22 bp, Homo sapiens
tgcattggaactggaggcaggg

SEQ ID NO: 4726756 - DNA, 15 bp, Homo sapiens
tgcatttaaagtatt

SEQ ID NO: 4726757 - DNA, 24 bp, Homo sapiens
tgcatttaaatacagtcttccatt

SEQ ID NO: 4726758 - DNA, 18 bp, Homo sapiens
tgcatttgggtggttttt

SEQ ID NO: 4726759 - DNA, 22 bp, Homo sapiens
tgcatttgggtggtttttattt

SEQ ID NO: 4726760 - DNA, 23 bp, Homo sapiens
tgccaacactcaagaagcaggct

SEQ ID NO: 4726761 - DNA, 15 bp, Homo sapiens
tgccaacatggtgaa

SEQ ID NO: 4726762 - DNA, 13 bp, Homo sapiens
tgccaagaaatcg

SEQ ID NO: 4726763 - DNA, 19 bp, Homo sapiens
tgccaagaaatcgccttat

SEQ ID NO: 4726764 - DNA, 17 bp, Homo sapiens
tgccaagcactgtgctc

SEQ ID NO: 4726765 - DNA, 18 bp, Homo sapiens
tgccaagctcaggaccag

SEQ ID NO: 4726766 - DNA, 16 bp, Homo sapiens
tgccaataattacatc

SEQ ID NO: 4726767 - DNA, 21 bp, Homo sapiens
tgccaattttgtcacagctct

SEQ ID NO: 4726768 - DNA, 22 bp, Homo sapiens
tgccacaccaagctgtgccacc

SEQ ID NO: 4726769 - DNA, 23 bp, Homo sapiens
tgccacaccaagctgtgccaccc

SEQ ID NO: 4726770 - DNA, 15 bp, Homo sapiens
tgccacagagcgggg

SEQ ID NO: 4726771 - DNA, 22 bp, Homo sapiens
tgccacagcctcccctgccagg

SEQ ID NO: 4726772 - DNA, 16 bp, Homo sapiens
tgccaccctcatgctg

SEQ ID NO: 4726773 - DNA, 20 bp, Homo sapiens
tgccaccctgggctctgtgg

SEQ ID NO: 4726774 - DNA, 13 bp, Homo sapiens
tgccacctggacc

SEQ ID NO: 4726775 - DNA, 14 bp, Homo sapiens
tgccacctggaccc

SEQ ID NO: 4726776 - DNA, 15 bp, Homo sapiens
tgccacctggacccc

SEQ ID NO: 4726777 - DNA, 12 bp, Homo sapiens
tgccactgttgt

SEQ ID NO: 4726778 - DNA, 24 bp, Homo sapiens
tgccagcccctgctggctggtgcc

SEQ ID NO: 4726779 - DNA, 22 bp, Homo sapiens
tgccagctctgtatcaggaccc

SEQ ID NO: 4726780 - DNA, 12 bp, Homo sapiens
tgccagggcagg

SEQ ID NO: 4726781 - DNA, 15 bp, Homo sapiens
tgccagggcagggcc

SEQ ID NO: 4726782 - DNA, 17 bp, Homo sapiens
tgccaggtttttggtct

SEQ ID NO: 4726783 - DNA, 19 bp, Homo sapiens
tgccaggtttttggtctga

SEQ ID NO: 4726784 - DNA, 22 bp, Homo sapiens
tgccaggtttttggtctgaccc

SEQ ID NO: 4726785 - DNA, 24 bp, Homo sapiens
tgccaggtttttggtctgacccac

SEQ ID NO: 4726786 - DNA, 18 bp, Homo sapiens
tgccatacttgttctgta

SEQ ID NO: 4726787 - DNA, 19 bp, Homo sapiens
tgccatcctcaaacactgc

SEQ ID NO: 4726788 - DNA, 22 bp, Homo sapiens
tgccatgggcttcactgtataa

SEQ ID NO: 4726789 - DNA, 23 bp, Homo sapiens
tgccatgggcttcactgtataaa

SEQ ID NO: 4726790 - DNA, 15 bp, Homo sapiens
tgccatgtgccaggt

SEQ ID NO: 4726791 - DNA, 12 bp, Homo sapiens
tgccatgttggc

SEQ ID NO: 4726792 - DNA, 17 bp, Homo sapiens
tgccatgttggccaggc

SEQ ID NO: 4726793 - DNA, 18 bp, Homo sapiens
tgccatgttggccaggct

SEQ ID NO: 4726794 - DNA, 23 bp, Homo sapiens
tgccattttattaaacattttca

SEQ ID NO: 4726795 - DNA, 14 bp, Homo sapiens
tgcccaagggaaag

SEQ ID NO: 4726796 - DNA, 16 bp, Homo sapiens
tgcccactccctgcaa

SEQ ID NO: 4726797 - DNA, 10 bp, Homo sapiens
tgcccagccc

SEQ ID NO: 4726798 - DNA, 11 bp, Homo sapiens
tgcccagcccc

SEQ ID NO: 4726799 - DNA, 12 bp, Homo sapiens
tgcccagcccct

SEQ ID NO: 4726800 - DNA, 17 bp, Homo sapiens
tgcccagccccttctga

SEQ ID NO: 4726801 - DNA, 20 bp, Homo sapiens
tgcccagccccttctgaccc

SEQ ID NO: 4726802 - DNA, 12 bp, Homo sapiens
tgcccaggcagg

SEQ ID NO: 4726803 - DNA, 11 bp, Homo sapiens
tgcccaggctg

SEQ ID NO: 4726804 - DNA, 18 bp, Homo sapiens
tgcccaggctggcgtgca

SEQ ID NO: 4726805 - DNA, 17 bp, Homo sapiens
tgcccagggtcagtgta

SEQ ID NO: 4726806 - DNA, 20 bp, Homo sapiens
tgcccagggtcagtgtatct

SEQ ID NO: 4726807 - DNA, 16 bp, Homo sapiens
tgcccatgggcactgc

SEQ ID NO: 4726808 - DNA, 17 bp, Homo sapiens
tgcccatgggcactgct

SEQ ID NO: 4726809 - DNA, 22 bp, Homo sapiens
tgcccatgggcactgctgggtg

SEQ ID NO: 4726810 - DNA, 15 bp, Homo sapiens
tgcccattcctcacc

SEQ ID NO: 4726811 - DNA, 15 bp, Homo sapiens
tgccccaacccccag

SEQ ID NO: 4726812 - DNA, 12 bp, Homo sapiens
tgccccccatcc

SEQ ID NO: 4726813 - DNA, 21 bp, Homo sapiens
tgccccccatcctggcccatc

SEQ ID NO: 4726814 - DNA, 18 bp, Homo sapiens
tgccccctcgtgccagtc

SEQ ID NO: 4726815 - DNA, 23 bp, Homo sapiens
tgccccctgcaggaaggagctgc

SEQ ID NO: 4726816 - DNA, 23 bp, Homo sapiens
tgcccctccctgcctccacccac

SEQ ID NO: 4726817 - DNA, 15 bp, Homo sapiens
tgcccctccctgctt

SEQ ID NO: 4726818 - DNA, 17 bp, Homo sapiens
tgcccctccctgcttca

SEQ ID NO: 4726819 - DNA, 13 bp, Homo sapiens
tgcccgctcccag

SEQ ID NO: 4726820 - DNA, 15 bp, Homo sapiens
tgcccgctcccagtg

SEQ ID NO: 4726821 - DNA, 12 bp, Homo sapiens
tgcccggctgcg

SEQ ID NO: 4726822 - DNA, 14 bp, Homo sapiens
tgcccggctgcgga

SEQ ID NO: 4726823 - DNA, 20 bp, Homo sapiens
tgccctaatgcgcaggctgg

SEQ ID NO: 4726824 - DNA, 14 bp, Homo sapiens
tgccctcaggaaag

SEQ ID NO: 4726825 - DNA, 19 bp, Homo sapiens
tgccctccaagaccttctc

SEQ ID NO: 4726826 - DNA, 14 bp, Homo sapiens
tgccctgcccacct

SEQ ID NO: 4726827 - DNA, 23 bp, Homo sapiens
tgccctgctgagtcccaggctga

SEQ ID NO: 4726828 - DNA, 18 bp, Homo sapiens
tgccctgggaggcagtga

SEQ ID NO: 4726829 - DNA, 21 bp, Homo sapiens
tgccctggtggccctctcccc

SEQ ID NO: 4726830 - DNA, 22 bp, Homo sapiens
tgccctggtggccctctcccct

SEQ ID NO: 4726831 - DNA, 15 bp, Homo sapiens
tgccctggtttcctg

SEQ ID NO: 4726832 - DNA, 15 bp, Homo sapiens
tgccctgtgggcccc

SEQ ID NO: 4726833 - DNA, 12 bp, Homo sapiens
tgccctttccat

SEQ ID NO: 4726834 - DNA, 13 bp, Homo sapiens
tgccgcagagctg

SEQ ID NO: 4726835 - DNA, 17 bp, Homo sapiens
tgccgcagagctggccg

SEQ ID NO: 4726836 - DNA, 15 bp, Homo sapiens
tgccgccgcctcgcc

SEQ ID NO: 4726837 - DNA, 21 bp, Homo sapiens
tgccgccgcctcgcccaccgc

SEQ ID NO: 4726838 - DNA, 17 bp, Homo sapiens
tgccgtctacctgaggg

SEQ ID NO: 4726839 - DNA, 19 bp, Homo sapiens
tgccgtctacctgaggggc

SEQ ID NO: 4726840 - DNA, 13 bp, Homo sapiens
tgcctaccttgtg

SEQ ID NO: 4726841 - DNA, 21 bp, Homo sapiens
tgcctacgtgacaacacaaat

SEQ ID NO: 4726842 - DNA, 15 bp, Homo sapiens
tgcctccagggctgg

SEQ ID NO: 4726843 - DNA, 16 bp, Homo sapiens
tgcctccagggctgga

SEQ ID NO: 4726844 - DNA, 18 bp, Homo sapiens
tgcctccagggctggact

SEQ ID NO: 4726845 - DNA, 19 bp, Homo sapiens
tgcctccagggctggactg

SEQ ID NO: 4726846 - DNA, 13 bp, Homo sapiens
tgcctcccatcac

SEQ ID NO: 4726847 - DNA, 22 bp, Homo sapiens
tgcctcctttgtgaggaagccg

SEQ ID NO: 4726848 - DNA, 13 bp, Homo sapiens
tgcctcggctcct

SEQ ID NO: 4726849 - DNA, 22 bp, Homo sapiens
tgcctcggctcctgctgcacca

SEQ ID NO: 4726850 - DNA, 17 bp, Homo sapiens
tgcctctacctgacact

SEQ ID NO: 4726851 - DNA, 22 bp, Homo sapiens
tgcctctgacacacagctctgt

SEQ ID NO: 4726852 - DNA, 14 bp, Homo sapiens
tgcctctgtcccct

SEQ ID NO: 4726853 - DNA, 13 bp, Homo sapiens
tgcctcttctggg

SEQ ID NO: 4726854 - DNA, 15 bp, Homo sapiens
tgcctcttctgggag

SEQ ID NO: 4726855 - DNA, 19 bp, Homo sapiens
tgcctcttttccccatgaa

SEQ ID NO: 4726856 - DNA, 17 bp, Homo sapiens
tgcctgaagaccccaga

SEQ ID NO: 4726857 - DNA, 13 bp, Homo sapiens
tgcctgagcccct

SEQ ID NO: 4726858 - DNA, 22 bp, Homo sapiens
tgcctgatatttccctcccctg

SEQ ID NO: 4726859 - DNA, 18 bp, Homo sapiens
tgcctgattcggctgtct

SEQ ID NO: 4726860 - DNA, 19 bp, Homo sapiens
tgcctgattcggctgtctc

SEQ ID NO: 4726861 - DNA, 14 bp, Homo sapiens
tgcctgcccaggcc

SEQ ID NO: 4726862 - DNA, 24 bp, Homo sapiens
tgcctgcccaggcccctgccaccc

SEQ ID NO: 4726863 - DNA, 12 bp, Homo sapiens
tgcctggacccg

SEQ ID NO: 4726864 - DNA, 21 bp, Homo sapiens
tgcctgggatccctcatcctc

SEQ ID NO: 4726865 - DNA, 16 bp, Homo sapiens
tgcctggtggcagctg

SEQ ID NO: 4726866 - DNA, 19 bp, Homo sapiens
tgcctgtgtgcgagtctga

SEQ ID NO: 4726867 - DNA, 20 bp, Homo sapiens
tgccttcaactaaaaacaaa

SEQ ID NO: 4726868 - DNA, 12 bp, Homo sapiens
tgccttcaagaa

SEQ ID NO: 4726869 - DNA, 20 bp, Homo sapiens
tggtgaagtgaaaaacagaa

SEQ ID NO: 4726870 - DNA, 14 bp, Homo sapiens
tggtgacattgaaa

SEQ ID NO: 4726871 - DNA, 22 bp, Homo sapiens
tggtgaccccttttcagcttct

SEQ ID NO: 4726872 - DNA, 18 bp, Homo sapiens
tggtgcaattaactctgg

SEQ ID NO: 4726873 - DNA, 11 bp, Homo sapiens
tggtgcattcg

SEQ ID NO: 4726874 - DNA, 17 bp, Homo sapiens
tggtgccaatggaacct

SEQ ID NO: 4726875 - DNA, 17 bp, Homo sapiens
tggtgccacaaataaaa

SEQ ID NO: 4726876 - DNA, 17 bp, Homo sapiens
tggtgcctgaagacccc

SEQ ID NO: 4726877 - DNA, 19 bp, Homo sapiens
tggtgcctgaagaccccag

SEQ ID NO: 4726878 - DNA, 14 bp, Homo sapiens
tggtgcctgagccc

SEQ ID NO: 4726879 - DNA, 17 bp, Homo sapiens
tggtgcctgagcccctc

SEQ ID NO: 4726880 - DNA, 18 bp, Homo sapiens
tggtgcctgagcccctca

SEQ ID NO: 4726881 - DNA, 13 bp, Homo sapiens
tggtgcttagttt

SEQ ID NO: 4726882 - DNA, 22 bp, Homo sapiens
tggtggaccctactattcatgt

SEQ ID NO: 4726883 - DNA, 12 bp, Homo sapiens
tggtggcagtgg

SEQ ID NO: 4726884 - DNA, 16 bp, Homo sapiens
tggtggccctctcccc

SEQ ID NO: 4726885 - DNA, 18 bp, Homo sapiens
tggtggggtaccagccac

SEQ ID NO: 4726886 - DNA, 15 bp, Homo sapiens
tggtggtatctgagt

SEQ ID NO: 4726887 - DNA, 13 bp, Homo sapiens
tggtgtaataaga

SEQ ID NO: 4726888 - DNA, 17 bp, Homo sapiens
tggtgtaataagacata

SEQ ID NO: 4726889 - DNA, 16 bp, Homo sapiens
tggtgtcacctgaaga

SEQ ID NO: 4726890 - DNA, 18 bp, Homo sapiens
tggtgtcgcgccttctcc

SEQ ID NO: 4726891 - DNA, 20 bp, Homo sapiens
tggtgtctccaaccccccag

SEQ ID NO: 4726892 - DNA, 16 bp, Homo sapiens
tggtgtgatcgtctga

SEQ ID NO: 4726893 - DNA, 19 bp, Homo sapiens
tggtgttatttgaaacttt

SEQ ID NO: 4726894 - DNA, 18 bp, Homo sapiens
tggtgttggcagtgtttg

SEQ ID NO: 4726895 - DNA, 23 bp, Homo sapiens
tggttaacaataaagtgacaaaa

SEQ ID NO: 4726896 - DNA, 20 bp, Homo sapiens
tggttaggcattgtgggaag

SEQ ID NO: 4726897 - DNA, 16 bp, Homo sapiens
tggttcagctactttc

SEQ ID NO: 4726898 - DNA, 22 bp, Homo sapiens
tggttcagctactttccatttg

SEQ ID NO: 4726899 - DNA, 15 bp, Homo sapiens
tggttccaatgaaat

SEQ ID NO: 4726900 - DNA, 15 bp, Homo sapiens
tggttctcatctttc

SEQ ID NO: 4726901 - DNA, 13 bp, Homo sapiens
tggttctgtgaac

SEQ ID NO: 4726902 - DNA, 13 bp, Homo sapiens
tggttctgtgcca

SEQ ID NO: 4726903 - DNA, 16 bp, Homo sapiens
tggttgggctgtgcct

SEQ ID NO: 4726904 - DNA, 18 bp, Homo sapiens
tggttgggctgtgcctgg

SEQ ID NO: 4726905 - DNA, 12 bp, Homo sapiens
tggttggggtgg

SEQ ID NO: 4726906 - DNA, 15 bp, Homo sapiens
tggttgtgcacatgc

SEQ ID NO: 4726907 - DNA, 20 bp, Homo sapiens
tggttgtgcacatgcttcag

SEQ ID NO: 4726908 - DNA, 20 bp, Homo sapiens
tggtttatattcttatgtta

SEQ ID NO: 4726909 - DNA, 21 bp, Homo sapiens
tggtttcagttctgtgtacat

SEQ ID NO: 4726910 - DNA, 15 bp, Homo sapiens
tggtttcctgccctg

SEQ ID NO: 4726911 - DNA, 17 bp, Homo sapiens
tggtttgcaaggaagcc

SEQ ID NO: 4726912 - DNA, 22 bp, Homo sapiens
tggtttgcctgcttaaaaggta

SEQ ID NO: 4726913 - DNA, 20 bp, Homo sapiens
tggtttgtgtcaaaactggt

SEQ ID NO: 4726914 - DNA, 22 bp, Homo sapiens
tggtttgtgtcaaaactggttt

SEQ ID NO: 4726915 - DNA, 13 bp, Homo sapiens
tggtttgttattc

SEQ ID NO: 4726916 - DNA, 16 bp, Homo sapiens
tggttttgttcccctc

SEQ ID NO: 4726917 - DNA, 16 bp, Homo sapiens
tgtaaaatcttcagct

SEQ ID NO: 4726918 - DNA, 15 bp, Homo sapiens
tgtaaactgtgcacc

SEQ ID NO: 4726919 - DNA, 17 bp, Homo sapiens
tgtaaatactggactca

SEQ ID NO: 4726920 - DNA, 18 bp, Homo sapiens
tgtaaatactggactcag

SEQ ID NO: 4726921 - DNA, 19 bp, Homo sapiens
tgtaaatactggactcagg

SEQ ID NO: 4726922 - DNA, 20 bp, Homo sapiens
tgtaaatactggactcagga

SEQ ID NO: 4726923 - DNA, 21 bp, Homo sapiens
tgtaaatgaagggtcatttct

SEQ ID NO: 4726924 - DNA, 16 bp, Homo sapiens
tgtaaatgttatgact

SEQ ID NO: 4726925 - DNA, 13 bp, Homo sapiens
tgtaacctcgtgt

SEQ ID NO: 4726926 - DNA, 18 bp, Homo sapiens
tgtaacctcgtgtctagt

SEQ ID NO: 4726927 - DNA, 19 bp, Homo sapiens
tgtaacctcttcagaggcc

SEQ ID NO: 4726928 - DNA, 15 bp, Homo sapiens
tggactgaggcctga

SEQ ID NO: 4726929 - DNA, 13 bp, Homo sapiens
tggacttatttaa

SEQ ID NO: 4726930 - DNA, 11 bp, Homo sapiens
tggactttgtt

SEQ ID NO: 4726931 - DNA, 20 bp, Homo sapiens
tggagaagccacaggcctga

SEQ ID NO: 4726932 - DNA, 21 bp, Homo sapiens
tggagaagccacaggcctgag

SEQ ID NO: 4726933 - DNA, 22 bp, Homo sapiens
tggagaagccacaggcctgaga

SEQ ID NO: 4726934 - DNA, 23 bp, Homo sapiens
tggagaagccacaggcctgagat

SEQ ID NO: 4726935 - DNA, 21 bp, Homo sapiens
tggagagctagaacctggagg

SEQ ID NO: 4726936 - DNA, 15 bp, Homo sapiens
tggagagctggagcc

SEQ ID NO: 4726937 - DNA, 18 bp, Homo sapiens
tggagagctggagcctgg

SEQ ID NO: 4726938 - DNA, 18 bp, Homo sapiens
tggagatgtctctgtgtg

SEQ ID NO: 4726939 - DNA, 14 bp, Homo sapiens
tggagcagaatcag

SEQ ID NO: 4726940 - DNA, 15 bp, Homo sapiens
tggagcagaatcagt

SEQ ID NO: 4726941 - DNA, 13 bp, Homo sapiens
tggagcagagggg

SEQ ID NO: 4726942 - DNA, 17 bp, Homo sapiens
tggagcagaggggctga

SEQ ID NO: 4726943 - DNA, 16 bp, Homo sapiens
tggagccactaactag

SEQ ID NO: 4726944 - DNA, 19 bp, Homo sapiens
tggagcccagaggagggca

SEQ ID NO: 4726945 - DNA, 23 bp, Homo sapiens
tggagcccagaggagggcagcag

SEQ ID NO: 4726946 - DNA, 13 bp, Homo sapiens
tggagcctggtgc

SEQ ID NO: 4726947 - DNA, 12 bp, Homo sapiens
tggagcggctca

SEQ ID NO: 4726948 - DNA, 18 bp, Homo sapiens
tggagctcagagagggca

SEQ ID NO: 4726949 - DNA, 13 bp, Homo sapiens
tggagctgcctga

SEQ ID NO: 4726950 - DNA, 12 bp, Homo sapiens
tggaggaaggaa

SEQ ID NO: 4726951 - DNA, 21 bp, Homo sapiens
tggaggaaggaaacccagctc

SEQ ID NO: 4726952 - DNA, 13 bp, Homo sapiens
tggaggaaggatt

SEQ ID NO: 4726953 - DNA, 19 bp, Homo sapiens
tggaggaaggattgtaaaa

SEQ ID NO: 4726954 - DNA, 19 bp, Homo sapiens
tggaggagacaggaagcct

SEQ ID NO: 4726955 - DNA, 21 bp, Homo sapiens
tggaggagcaaaggctgagaa

SEQ ID NO: 4726956 - DNA, 22 bp, Homo sapiens
tggaggagcagtgcaggcacag

SEQ ID NO: 4726957 - DNA, 22 bp, Homo sapiens
tggaggagctcaggacactaat

SEQ ID NO: 4726958 - DNA, 21 bp, Homo sapiens
tggagggaatgaacctggagg

SEQ ID NO: 4726959 - DNA, 22 bp, Homo sapiens
tggagggctagaacctggagag

SEQ ID NO: 4726960 - DNA, 21 bp, Homo sapiens
tggagggctagaatctggaga

SEQ ID NO: 4726961 - DNA, 12 bp, Homo sapiens
tggagggctgga

SEQ ID NO: 4726962 - DNA, 22 bp, Homo sapiens
tggagggctggaatctggagag

SEQ ID NO: 4726963 - DNA, 14 bp, Homo sapiens
tggagtgcagtgag

SEQ ID NO: 4726964 - DNA, 19 bp, Homo sapiens
tggagtgttccccttccac

SEQ ID NO: 4726965 - DNA, 12 bp, Homo sapiens
tggagtgtttga

SEQ ID NO: 4726966 - DNA, 19 bp, Homo sapiens
tggatatataggctatttt

SEQ ID NO: 4726967 - DNA, 13 bp, Homo sapiens
tggatatttgtat

SEQ ID NO: 4726968 - DNA, 14 bp, Homo sapiens
tggatcacaaagtg

SEQ ID NO: 4726969 - DNA, 18 bp, Homo sapiens
tggatctcattggaccct

SEQ ID NO: 4726970 - DNA, 13 bp, Homo sapiens
tggatgcagcctc

SEQ ID NO: 4726971 - DNA, 18 bp, Homo sapiens
tggatgcctggtggcagc

SEQ ID NO: 4726972 - DNA, 15 bp, Homo sapiens
tgtatgctaaatgag

SEQ ID NO: 4726973 - DNA, 17 bp, Homo sapiens
tgtatgtgtggtttcag

SEQ ID NO: 4726974 - DNA, 14 bp, Homo sapiens
tgtattaacgcaaa

SEQ ID NO: 4726975 - DNA, 21 bp, Homo sapiens
tgtattagccagtcattgtaa

SEQ ID NO: 4726976 - DNA, 22 bp, Homo sapiens
tgtattgctccattttcttgtc

SEQ ID NO: 4726977 - DNA, 16 bp, Homo sapiens
tgtattgttttactcc

SEQ ID NO: 4726978 - DNA, 14 bp, Homo sapiens
tgtatttaatgatt

SEQ ID NO: 4726979 - DNA, 16 bp, Homo sapiens
tgtatttaatgatttt

SEQ ID NO: 4726980 - DNA, 22 bp, Homo sapiens
tgtatttattaatttgaaacca

SEQ ID NO: 4726981 - DNA, 20 bp, Homo sapiens
tgtatttatttagtatttat

SEQ ID NO: 4726982 - DNA, 18 bp, Homo sapiens
tgtatttgttaatggttt

SEQ ID NO: 4726983 - DNA, 14 bp, Homo sapiens
tgtattttgtattg

SEQ ID NO: 4726984 - DNA, 17 bp, Homo sapiens
tgtatttttaaagcatg

SEQ ID NO: 4726985 - DNA, 15 bp, Homo sapiens
tgtcaactttcattt

SEQ ID NO: 4726986 - DNA, 18 bp, Homo sapiens
tgtcaactttcatttgaa

SEQ ID NO: 4726987 - DNA, 22 bp, Homo sapiens
tgtcaactttcatttgaaagtg

SEQ ID NO: 4726988 - DNA, 17 bp, Homo sapiens
tgtcacacactttggct

SEQ ID NO: 4726989 - DNA, 15 bp, Homo sapiens
tgtcacacagggcag

SEQ ID NO: 4726990 - DNA, 15 bp, Homo sapiens
tgtcacactaaaatt

SEQ ID NO: 4726991 - DNA, 15 bp, Homo sapiens
tgtcacagctcttgt

SEQ ID NO: 4726992 - DNA, 12 bp, Homo sapiens
tgtcacaggcag

SEQ ID NO: 4726993 - DNA, 13 bp, Homo sapiens
tgtcacaggcagg

SEQ ID NO: 4726994 - DNA, 16 bp, Homo sapiens
tgtcacaggcaggtcc

SEQ ID NO: 4726995 - DNA, 20 bp, Homo sapiens
tgtcacatgaaacatttgca

SEQ ID NO: 4726996 - DNA, 13 bp, Homo sapiens
tgtcacctgaaga

SEQ ID NO: 4726997 - DNA, 17 bp, Homo sapiens
tgtcactggctgcctcc

SEQ ID NO: 4726998 - DNA, 19 bp, Homo sapiens
tgtcactggctgcctccac

SEQ ID NO: 4726999 - DNA, 21 bp, Homo sapiens
tgtcaggaaacatatttaaga

SEQ ID NO: 4727000 - DNA, 21 bp, Homo sapiens
tgtcaggattgcgagagatgt

SEQ ID NO: 4727001 - DNA, 17 bp, Homo sapiens
tgtcaggtggggcagct

SEQ ID NO: 4727002 - DNA, 18 bp, Homo sapiens
tgtcaggtggggcagctt

SEQ ID NO: 4727003 - DNA, 20 bp, Homo sapiens
tgtcaggtggggcagcttga

SEQ ID NO: 4727004 - DNA, 13 bp, Homo sapiens
tgtcagtgccgcc

SEQ ID NO: 4727005 - DNA, 16 bp, Homo sapiens
tgtcagtgccgccgcc

SEQ ID NO: 4727006 - DNA, 17 bp, Homo sapiens
tgtcagttgttatttat

SEQ ID NO: 4727007 - DNA, 22 bp, Homo sapiens
tgtcagttgttatttattgaaa

SEQ ID NO: 4727008 - DNA, 18 bp, Homo sapiens
tgtcatgtgtatgagaag

SEQ ID NO: 4727009 - DNA, 21 bp, Homo sapiens
tgtcattatttgataacattt

SEQ ID NO: 4727010 - DNA, 16 bp, Homo sapiens
tgtcatttgagcaggg

SEQ ID NO: 4727011 - DNA, 19 bp, Homo sapiens
tgtccaaagcagggtctgg

SEQ ID NO: 4727012 - DNA, 14 bp, Homo sapiens
tgtccaagaagccc

SEQ ID NO: 4727013 - DNA, 17 bp, Homo sapiens
tgtccaagaagcccagg

SEQ ID NO: 4727014 - DNA, 18 bp, Homo sapiens
tgtccaagaagcccagga

SEQ ID NO: 4727015 - DNA, 16 bp, Homo sapiens
tgtccacgactgtctc

SEQ ID NO: 4727016 - DNA, 17 bp, Homo sapiens
tgtccacgactgtctcc

SEQ ID NO: 4727017 - DNA, 18 bp, Homo sapiens
tgtccacgactgtctcca

SEQ ID NO: 4727018 - DNA, 20 bp, Homo sapiens
tgtccattgtaaatctgaag

SEQ ID NO: 4727019 - DNA, 17 bp, Homo sapiens
tgtccattgtccaatcc

SEQ ID NO: 4727020 - DNA, 23 bp, Homo sapiens
tgtcccaaaaagaaaggagggga

SEQ ID NO: 4727021 - DNA, 13 bp, Homo sapiens
tgtcccagtgaac

SEQ ID NO: 4727022 - DNA, 13 bp, Homo sapiens
tgtccccaccgca

SEQ ID NO: 4727023 - DNA, 22 bp, Homo sapiens
tgtccccaccgcagacaggacc

SEQ ID NO: 4727024 - DNA, 16 bp, Homo sapiens
tgtccccttctctcat

SEQ ID NO: 4727025 - DNA, 20 bp, Homo sapiens
tgtccctatttatgatttca

SEQ ID NO: 4727026 - DNA, 20 bp, Homo sapiens
tgtccctgcacttgcagact

SEQ ID NO: 4727027 - DNA, 23 bp, Homo sapiens
tgtccctgcacttgcagactcta

SEQ ID NO: 4727028 - DNA, 17 bp, Homo sapiens
ttaccagggtctttgca

SEQ ID NO: 4727029 - DNA, 17 bp, Homo sapiens
ttaccattagcataatt

SEQ ID NO: 4727030 - DNA, 19 bp, Homo sapiens
ttaccattagcataatttt

SEQ ID NO: 4727031 - DNA, 19 bp, Homo sapiens
ttacctaccacatgccaag

SEQ ID NO: 4727032 - DNA, 21 bp, Homo sapiens
ttacctagctaattatttaat

SEQ ID NO: 4727033 - DNA, 20 bp, Homo sapiens
ttacctgaaaacactgtgca

SEQ ID NO: 4727034 - DNA, 22 bp, Homo sapiens
ttacctgaaaacactgtgcaca

SEQ ID NO: 4727035 - DNA, 23 bp, Homo sapiens
ttaccttattgagcgtgattctg

SEQ ID NO: 4727036 - DNA, 14 bp, Homo sapiens
ttacgtagtaaaag

SEQ ID NO: 4727037 - DNA, 17 bp, Homo sapiens
ttactaaaaaaaagatg

SEQ ID NO: 4727038 - DNA, 22 bp, Homo sapiens
ttactccaaggtttataaagca

SEQ ID NO: 4727039 - DNA, 23 bp, Homo sapiens
ttactgaagaaatctttccagtt

SEQ ID NO: 4727040 - DNA, 12 bp, Homo sapiens
ttactgagatgt

SEQ ID NO: 4727041 - DNA, 13 bp, Homo sapiens
ttactgagatgtt

SEQ ID NO: 4727042 - DNA, 18 bp, Homo sapiens
ttactgtctgtagtgttt

SEQ ID NO: 4727043 - DNA, 12 bp, Homo sapiens
ttacttctgcta

SEQ ID NO: 4727044 - DNA, 17 bp, Homo sapiens
ttacttgcctatctgac

SEQ ID NO: 4727045 - DNA, 17 bp, Homo sapiens
ttactttaaaaggagcc

SEQ ID NO: 4727046 - DNA, 17 bp, Homo sapiens
ttactttttaaacagtg

SEQ ID NO: 4727047 - DNA, 18 bp, Homo sapiens
ttactttttaaacagtgt

SEQ ID NO: 4727048 - DNA, 21 bp, Homo sapiens
ttagaaaggaaatgaatggtt

SEQ ID NO: 4727049 - DNA, 19 bp, Homo sapiens
ttagaaattacctgtggat

SEQ ID NO: 4727050 - DNA, 19 bp, Homo sapiens
ttagaaattataattttag

SEQ ID NO: 4727051 - DNA, 13 bp, Homo sapiens
ttagaacatttaa

SEQ ID NO: 4727052 - DNA, 13 bp, Homo sapiens
ttagaagcctgca

SEQ ID NO: 4727053 - DNA, 18 bp, Homo sapiens
ttagaaggttctctcctc

SEQ ID NO: 4727054 - DNA, 21 bp, Homo sapiens
ttagaagtaaggattataaac

SEQ ID NO: 4727055 - DNA, 14 bp, Homo sapiens
ttagaataatttta

SEQ ID NO: 4727056 - DNA, 18 bp, Homo sapiens
ttagactaaggccattat

SEQ ID NO: 4727057 - DNA, 14 bp, Homo sapiens
ttagactcaaagaa

SEQ ID NO: 4727058 - DNA, 16 bp, Homo sapiens
ttagacttctaaataa

SEQ ID NO: 4727059 - DNA, 21 bp, Homo sapiens
ttagacttctaaataaggtgt

SEQ ID NO: 4727060 - DNA, 13 bp, Homo sapiens
ttagagcctccct

SEQ ID NO: 4727061 - DNA, 14 bp, Homo sapiens
ttagagcctccctc

SEQ ID NO: 4727062 - DNA, 20 bp, Homo sapiens
ttagagtcaatttgctgaaa

SEQ ID NO: 4727063 - DNA, 19 bp, Homo sapiens
ttagataatcttttacatt

SEQ ID NO: 4727064 - DNA, 19 bp, Homo sapiens
ttagatggaaaaatgtgaa

SEQ ID NO: 4727065 - DNA, 22 bp, Homo sapiens
ttagatgttctaagtctttcca

SEQ ID NO: 4727066 - DNA, 14 bp, Homo sapiens
ttagattatttctg

SEQ ID NO: 4727067 - DNA, 19 bp, Homo sapiens
ttagattatttctgtattt

SEQ ID NO: 4727068 - DNA, 15 bp, Homo sapiens
ttagcaactagggct

SEQ ID NO: 4727069 - DNA, 12 bp, Homo sapiens
ttagcaccaggg

SEQ ID NO: 4727070 - DNA, 19 bp, Homo sapiens
ttagcagttgctcacatgt

SEQ ID NO: 4727071 - DNA, 23 bp, Homo sapiens
ttagcataattttgtgttgtaca

SEQ ID NO: 4727072 - DNA, 23 bp, Homo sapiens
ttagccaggatcatggtgtaata

SEQ ID NO: 4727073 - DNA, 13 bp, Homo sapiens
ttagcccccaccc

SEQ ID NO: 4727074 - DNA, 17 bp, Homo sapiens
ttagcccccacccactt

SEQ ID NO: 4727075 - DNA, 18 bp, Homo sapiens
ttagcgcacccagagaaa

SEQ ID NO: 4727076 - DNA, 12 bp, Homo sapiens
ttagctaaagga

SEQ ID NO: 4727077 - DNA, 14 bp, Homo sapiens
ttagctcccctcca

SEQ ID NO: 4727078 - DNA, 18 bp, Homo sapiens
ttagctcccctccaacct

SEQ ID NO: 4727079 - DNA, 19 bp, Homo sapiens
ttagctttgctctgccaac

SEQ ID NO: 4727080 - DNA, 16 bp, Homo sapiens
ttagctttttaattgt

SEQ ID NO: 4727081 - DNA, 18 bp, Homo sapiens
ttagctttttaattgttg

SEQ ID NO: 4727082 - DNA, 20 bp, Homo sapiens
ttaggagaagtcttctattt

SEQ ID NO: 4727083 - DNA, 13 bp, Homo sapiens
ttaggagaagttg

SEQ ID NO: 4727084 - DNA, 18 bp, Homo sapiens
ttaggagaagttggtctt

SEQ ID NO: 4727085 - DNA, 15 bp, Homo sapiens
ttaggcctggcacag

SEQ ID NO: 4727086 - DNA, 16 bp, Homo sapiens
ttagggtgtgtgttca

SEQ ID NO: 4727087 - DNA, 14 bp, Homo sapiens
ttaggtctcttccc

SEQ ID NO: 4727088 - DNA, 20 bp, Homo sapiens
ttaggtttgctaaatactgt

SEQ ID NO: 4727089 - DNA, 17 bp, Homo sapiens
ttccctgacactgcggg

SEQ ID NO: 4727090 - DNA, 16 bp, Homo sapiens
ttccctgactcattct

SEQ ID NO: 4727091 - DNA, 17 bp, Homo sapiens
ttccctttatttcacat

SEQ ID NO: 4727092 - DNA, 20 bp, Homo sapiens
ttcctaagactgctgctgaa

SEQ ID NO: 4727093 - DNA, 15 bp, Homo sapiens
ttcctaatgcattag

SEQ ID NO: 4727094 - DNA, 19 bp, Homo sapiens
ttcctatacgcagcgtgct

SEQ ID NO: 4727095 - DNA, 22 bp, Homo sapiens
ttcctatttgccatgggcttca

SEQ ID NO: 4727096 - DNA, 12 bp, Homo sapiens
ttcctcccctcg

SEQ ID NO: 4727097 - DNA, 20 bp, Homo sapiens
ttcctcctttcctatttccc

SEQ ID NO: 4727098 - DNA, 14 bp, Homo sapiens
ttcctctgagctgt

SEQ ID NO: 4727099 - DNA, 15 bp, Homo sapiens
ttcctgaggctgggc

SEQ ID NO: 4727100 - DNA, 18 bp, Homo sapiens
ttcctgatgcttcttcag

SEQ ID NO: 4727101 - DNA, 11 bp, Homo sapiens
ttcctgccctg

SEQ ID NO: 4727102 - DNA, 16 bp, Homo sapiens
ttcctgccctgggagg

SEQ ID NO: 4727103 - DNA, 22 bp, Homo sapiens
ttcctgccctgggaggcagtga

SEQ ID NO: 4727104 - DNA, 15 bp, Homo sapiens
ttcctggagcccaga

SEQ ID NO: 4727105 - DNA, 11 bp, Homo sapiens
ttcctgtgtct

SEQ ID NO: 4727106 - DNA, 12 bp, Homo sapiens
ttccttctttga

SEQ ID NO: 4727107 - DNA, 13 bp, Homo sapiens
ttccttgcctgca

SEQ ID NO: 4727108 - DNA, 15 bp, Homo sapiens
ttccttggctggtgc

SEQ ID NO: 4727109 - DNA, 17 bp, Homo sapiens
ttcctttaaaaaaattt

SEQ ID NO: 4727110 - DNA, 16 bp, Homo sapiens
ttcctttcatttactg

SEQ ID NO: 4727111 - DNA, 21 bp, Homo sapiens
ttcctttcatttactgtggct

SEQ ID NO: 4727112 - DNA, 22 bp, Homo sapiens
ttcctttctatatccttgacac

SEQ ID NO: 4727113 - DNA, 17 bp, Homo sapiens
ttcggatttggggtgga

SEQ ID NO: 4727114 - DNA, 19 bp, Homo sapiens
ttctaaaatataatcaacc

SEQ ID NO: 4727115 - DNA, 23 bp, Homo sapiens
ttctaaacaagaaccatttgcaa

SEQ ID NO: 4727116 - DNA, 23 bp, Homo sapiens
ttctaaggactttttcttaggtt

SEQ ID NO: 4727117 - DNA, 12 bp, Homo sapiens
ttctaagtcttt

SEQ ID NO: 4727118 - DNA, 13 bp, Homo sapiens
ttctaattgtcag

SEQ ID NO: 4727119 - DNA, 21 bp, Homo sapiens
ttctacccagcgagccctggt

SEQ ID NO: 4727120 - DNA, 16 bp, Homo sapiens
ttctactttgtttatt

SEQ ID NO: 4727121 - DNA, 14 bp, Homo sapiens
ttctagaatggttt

SEQ ID NO: 4727122 - DNA, 22 bp, Homo sapiens
ttctagatcactgtgcttattt

SEQ ID NO: 4727123 - DNA, 15 bp, Homo sapiens
ttctagtggtctttg

SEQ ID NO: 4727124 - DNA, 22 bp, Homo sapiens
ttctagtggtctttgtaagagt

SEQ ID NO: 4727125 - DNA, 17 bp, Homo sapiens
ttctattaaaagactca

SEQ ID NO: 4727126 - DNA, 22 bp, Homo sapiens
ttctattaaaagactcatccgt

SEQ ID NO: 4727127 - DNA, 19 bp, Homo sapiens
ttctatttctcctccatgg

SEQ ID NO: 4727128 - DNA, 14 bp, Homo sapiens
ttctattttcacaa

SEQ ID NO: 4727129 - DNA, 13 bp, Homo sapiens
ttctcaaagaaat

SEQ ID NO: 4727130 - DNA, 12 bp, Homo sapiens
ttctcaatttca

SEQ ID NO: 4727131 - DNA, 23 bp, Homo sapiens
ttctcacctaaaccctctgtgaa

SEQ ID NO: 4727132 - DNA, 12 bp, Homo sapiens
ttctcaggaaat

SEQ ID NO: 4727133 - DNA, 13 bp, Homo sapiens
ttctcagggtctc

SEQ ID NO: 4727134 - DNA, 16 bp, Homo sapiens
ttctcagggtctctgc

SEQ ID NO: 4727135 - DNA, 12 bp, Homo sapiens
ttctcagtgtgc

SEQ ID NO: 4727136 - DNA, 16 bp, Homo sapiens
ttctcatcactcccct

SEQ ID NO: 4727137 - DNA, 12 bp, Homo sapiens
ttctcatgcctc

SEQ ID NO: 4727138 - DNA, 14 bp, Homo sapiens
ttctcatggatttg

SEQ ID NO: 4727139 - DNA, 16 bp, Homo sapiens
ttctcatttcacccct

SEQ ID NO: 4727140 - DNA, 21 bp, Homo sapiens
ttctccaaataaaaattagat

SEQ ID NO: 4727141 - DNA, 16 bp, Homo sapiens
ttctccaagcaggaca

SEQ ID NO: 4727142 - DNA, 18 bp, Homo sapiens
ttctccacctgccaggga

SEQ ID NO: 4727143 - DNA, 20 bp, Homo sapiens
ttctccacctgccagggaca

SEQ ID NO: 4727144 - DNA, 17 bp, Homo sapiens
ttctccagtcattatgt

SEQ ID NO: 4727145 - DNA, 21 bp, Homo sapiens
ttctcccctgcccccaggact

SEQ ID NO: 4727146 - DNA, 22 bp, Homo sapiens
ttctcccctgcccccaggactg

SEQ ID NO: 4727147 - DNA, 23 bp, Homo sapiens
ttctcctccatgggagaaaatag

SEQ ID NO: 4727148 - DNA, 16 bp, Homo sapiens
ttctccttttgaaaag

SEQ ID NO: 4727149 - DNA, 23 bp, Homo sapiens
ttctctcatctcttagctcccct

SEQ ID NO: 4727150 - DNA, 15 bp, Homo sapiens
ttctctccagcccct

SEQ ID NO: 4727151 - DNA, 16 bp, Homo sapiens
ttctctccagcccctg

SEQ ID NO: 4727152 - DNA, 18 bp, Homo sapiens
ttctctccagcccctgga

SEQ ID NO: 4727153 - DNA, 14 bp, Homo sapiens
ttctctgaggacac

SEQ ID NO: 4727154 - DNA, 20 bp, Homo sapiens
ttctctgaggacactaacca

SEQ ID NO: 4727155 - DNA, 17 bp, Homo sapiens
ttctctgccctccaaga

SEQ ID NO: 4727156 - DNA, 17 bp, Homo sapiens
ttctctgtctcatccat

SEQ ID NO: 4727157 - DNA, 12 bp, Homo sapiens
ttctctgtgtgg

SEQ ID NO: 4727158 - DNA, 21 bp, Homo sapiens
ttctctgtgtggttcagctac

SEQ ID NO: 4727159 - DNA, 13 bp, Homo sapiens
ttctcttcagtgt

SEQ ID NO: 4727160 - DNA, 15 bp, Homo sapiens
ttctcttttcctttg

SEQ ID NO: 4727161 - DNA, 18 bp, Homo sapiens
ttctgacccatgctgccc

SEQ ID NO: 4727162 - DNA, 20 bp, Homo sapiens
ttctgacccatgctgccctg

SEQ ID NO: 4727163 - DNA, 18 bp, Homo sapiens
ttctgacgcagcctgaga

SEQ ID NO: 4727164 - DNA, 15 bp, Homo sapiens
ttctgataatgtatt

SEQ ID NO: 4727165 - DNA, 19 bp, Homo sapiens
ttctgatcctagttccacc

SEQ ID NO: 4727166 - DNA, 17 bp, Homo sapiens
ttctgatgttactgaga

SEQ ID NO: 4727167 - DNA, 20 bp, Homo sapiens
ttctgatttagcaatgctgt

SEQ ID NO: 4727168 - DNA, 17 bp, Homo sapiens
ttctgatttgtattaaa

SEQ ID NO: 4727169 - DNA, 22 bp, Homo sapiens
ttctgcacttgcggttccggca

SEQ ID NO: 4727170 - DNA, 14 bp, Homo sapiens
ttctgccacttccc

SEQ ID NO: 4727171 - DNA, 16 bp, Homo sapiens
ttctgcccaaattatg

SEQ ID NO: 4727172 - DNA, 18 bp, Homo sapiens
ttctgcctgcccaggccc

SEQ ID NO: 4727173 - DNA, 19 bp, Homo sapiens
ttctgcggggcctgaggca

SEQ ID NO: 4727174 - DNA, 21 bp, Homo sapiens
ttctgctcatcattctctgtc

SEQ ID NO: 4727175 - DNA, 22 bp, Homo sapiens
ttctggaagggcagcatataaa

SEQ ID NO: 4727176 - DNA, 15 bp, Homo sapiens
ttctggctcttccag

SEQ ID NO: 4727177 - DNA, 17 bp, Homo sapiens
ttctggctcttccaggc

SEQ ID NO: 4727178 - DNA, 16 bp, Homo sapiens
ttctggctttgttctt

SEQ ID NO: 4727179 - DNA, 21 bp, Homo sapiens
ttctggctttgttcttgtcat

SEQ ID NO: 4727180 - DNA, 21 bp, Homo sapiens
ttctgggagggcagcagggct

SEQ ID NO: 4727181 - DNA, 19 bp, Homo sapiens
ttctgggtggggcagtggg

SEQ ID NO: 4727182 - DNA, 23 bp, Homo sapiens
ttctgggttctcaattctgtctc

SEQ ID NO: 4727183 - DNA, 21 bp, Homo sapiens
ttctggtctctaggctgggga

SEQ ID NO: 4727184 - DNA, 17 bp, Homo sapiens
ttctgtcccttggagct

SEQ ID NO: 4727185 - DNA, 17 bp, Homo sapiens
ttctgtcctactctgtg

SEQ ID NO: 4727186 - DNA, 13 bp, Homo sapiens
ttctgtgcagcca

SEQ ID NO: 4727187 - DNA, 14 bp, Homo sapiens
ttctgtgtacattt

SEQ ID NO: 4727188 - DNA, 15 bp, Homo sapiens
ttctgtgtacatttt

SEQ ID NO: 4727189 - DNA, 21 bp, Homo sapiens
ttctgtgtttagctatttaat

SEQ ID NO: 4727190 - DNA, 23 bp, Homo sapiens
ttctgttaactgaagatattcca

SEQ ID NO: 4727191 - DNA, 11 bp, Homo sapiens
ttctgttgaag

SEQ ID NO: 4727192 - DNA, 17 bp, Homo sapiens
ttctgttgctgcctcat

SEQ ID NO: 4727193 - DNA, 16 bp, Homo sapiens
ttctgtttggaggagc

SEQ ID NO: 4727194 - DNA, 12 bp, Homo sapiens
ttcttaaaatgt

SEQ ID NO: 4727195 - DNA, 20 bp, Homo sapiens
ttcttaaaatgtcctatgta

SEQ ID NO: 4727196 - DNA, 22 bp, Homo sapiens
ttcttaatcttttcacaaataa

SEQ ID NO: 4727197 - DNA, 15 bp, Homo sapiens
ttcttactaaaaagt

SEQ ID NO: 4727198 - DNA, 13 bp, Homo sapiens
ttcttcagagact

SEQ ID NO: 4727199 - DNA, 15 bp, Homo sapiens
ttcttctgcttcagc

SEQ ID NO: 4727200 - DNA, 15 bp, Homo sapiens
ttatgccttttattt

SEQ ID NO: 4727201 - DNA, 19 bp, Homo sapiens
ttatgcttccattaacaaa

SEQ ID NO: 4727202 - DNA, 23 bp, Homo sapiens
ttatgcttgtgtatatgtataaa

SEQ ID NO: 4727203 - DNA, 15 bp, Homo sapiens
ttatggcctttttaa

SEQ ID NO: 4727204 - DNA, 17 bp, Homo sapiens
ttatgtatcttgatgtt

SEQ ID NO: 4727205 - DNA, 20 bp, Homo sapiens
ttattaaaacagaaattaat

SEQ ID NO: 4727206 - DNA, 14 bp, Homo sapiens
ttattaaacatttt

SEQ ID NO: 4727207 - DNA, 17 bp, Homo sapiens
ttattaaacattttcat

SEQ ID NO: 4727208 - DNA, 14 bp, Homo sapiens
ttattaaattgtgt

SEQ ID NO: 4727209 - DNA, 16 bp, Homo sapiens
ttattaccaaaacagg

SEQ ID NO: 4727210 - DNA, 18 bp, Homo sapiens
ttattactgtttgtcttc

SEQ ID NO: 4727211 - DNA, 17 bp, Homo sapiens
ttattagagtgtctttc

SEQ ID NO: 4727212 - DNA, 20 bp, Homo sapiens
ttattcacttttatttagca

SEQ ID NO: 4727213 - DNA, 21 bp, Homo sapiens
ttattcagtgaatttgtccat

SEQ ID NO: 4727214 - DNA, 18 bp, Homo sapiens
ttattcattagttttgaa

SEQ ID NO: 4727215 - DNA, 17 bp, Homo sapiens
ttattccgtattacatt

SEQ ID NO: 4727216 - DNA, 12 bp, Homo sapiens
ttattcttttcc

SEQ ID NO: 4727217 - DNA, 15 bp, Homo sapiens
ttattcttttccaga

SEQ ID NO: 4727218 - DNA, 19 bp, Homo sapiens
ttatttaaagcacatgcca

SEQ ID NO: 4727219 - DNA, 14 bp, Homo sapiens
ttatttaaatgtac

SEQ ID NO: 4727220 - DNA, 18 bp, Homo sapiens
ttatttaaatgtacttat

SEQ ID NO: 4727221 - DNA, 10 bp, Homo sapiens
ttatttaata

SEQ ID NO: 4727222 - DNA, 12 bp, Homo sapiens
ttatttaataac

SEQ ID NO: 4727223 - DNA, 18 bp, Homo sapiens
ttatttaatttgtatgct

SEQ ID NO: 4727224 - DNA, 19 bp, Homo sapiens
ttatttaccttttaagaca

SEQ ID NO: 4727225 - DNA, 17 bp, Homo sapiens
ttatttagcaccaggga

SEQ ID NO: 4727226 - DNA, 19 bp, Homo sapiens
ttatttcccagtaattatt

SEQ ID NO: 4727227 - DNA, 14 bp, Homo sapiens
ttatttctgtattt

SEQ ID NO: 4727228 - DNA, 20 bp, Homo sapiens
ttatttgattatttaagact

SEQ ID NO: 4727229 - DNA, 21 bp, Homo sapiens
ttatttgtcggggaagatgaa

SEQ ID NO: 4727230 - DNA, 14 bp, Homo sapiens
ttattttctccaaa

SEQ ID NO: 4727231 - DNA, 13 bp, Homo sapiens
ttattttgtaatt

SEQ ID NO: 4727232 - DNA, 18 bp, Homo sapiens
ttatttttagacagagtc

SEQ ID NO: 4727233 - DNA, 20 bp, Homo sapiens
ttcaaaaaaaatcaaactgt

SEQ ID NO: 4727234 - DNA, 12 bp, Homo sapiens
ttcaaaaatgct

SEQ ID NO: 4727235 - DNA, 13 bp, Homo sapiens
ttcaaagccagcg

SEQ ID NO: 4727236 - DNA, 22 bp, Homo sapiens
ttcaaagcttaaaaagagctca

SEQ ID NO: 4727237 - DNA, 20 bp, Homo sapiens
ttcaaattaggcaaatcttt

SEQ ID NO: 4727238 - DNA, 16 bp, Homo sapiens
ttcaacggaaagtgct

SEQ ID NO: 4727239 - DNA, 18 bp, Homo sapiens
ttcaagaaagatatctat

SEQ ID NO: 4727240 - DNA, 14 bp, Homo sapiens
ttcaagatccaaat

SEQ ID NO: 4727241 - DNA, 22 bp, Homo sapiens
ttcaagggaattaaataaataa

SEQ ID NO: 4727242 - DNA, 21 bp, Homo sapiens
ttcaagtactgtaactgtgtc

SEQ ID NO: 4727243 - DNA, 17 bp, Homo sapiens
ttcaagtgattctcatg

SEQ ID NO: 4727244 - DNA, 17 bp, Homo sapiens
ttcaagttaaattttat

SEQ ID NO: 4727245 - DNA, 19 bp, Homo sapiens
ttcaagttgtgtctgaaaa

SEQ ID NO: 4727246 - DNA, 23 bp, Homo sapiens
ttcaatacttacatatctgactt

SEQ ID NO: 4727247 - DNA, 19 bp, Homo sapiens
ttcaatctggattcatatt

SEQ ID NO: 4727248 - DNA, 20 bp, Homo sapiens
ttcaatctggattcatattt

SEQ ID NO: 4727249 - DNA, 22 bp, Homo sapiens
ttcaatggtttgcaaggaagcc

SEQ ID NO: 4727250 - DNA, 18 bp, Homo sapiens
ttcaattctcatttgtca

SEQ ID NO: 4727251 - DNA, 21 bp, Homo sapiens
ttcaatttactttttaaacag

SEQ ID NO: 4727252 - DNA, 12 bp, Homo sapiens
ttcacaacctgg

SEQ ID NO: 4727253 - DNA, 16 bp, Homo sapiens
ttcacaattattaaat

SEQ ID NO: 4727254 - DNA, 19 bp, Homo sapiens
ttcacaattattaaattgt

SEQ ID NO: 4727255 - DNA, 12 bp, Homo sapiens
ttcacacatgcc

SEQ ID NO: 4727256 - DNA, 20 bp, Homo sapiens
ttcacagatgggtgcttgga

SEQ ID NO: 4727257 - DNA, 23 bp, Homo sapiens
ttcacagtacccaaactgctttt

SEQ ID NO: 4727258 - DNA, 22 bp, Homo sapiens
ttcaccatgttggccaggctgg

SEQ ID NO: 4727259 - DNA, 12 bp, Homo sapiens
ttcacccctccc

SEQ ID NO: 4727260 - DNA, 15 bp, Homo sapiens
ttcacccctcccttt

SEQ ID NO: 4727261 - DNA, 16 bp, Homo sapiens
ttcacccctccctttc

SEQ ID NO: 4727262 - DNA, 18 bp, Homo sapiens
ttcacccctccctttctc

SEQ ID NO: 4727263 - DNA, 20 bp, Homo sapiens
ttcacccctccctttctccc

SEQ ID NO: 4727264 - DNA, 19 bp, Homo sapiens
ttcacctttgtccccaccg

SEQ ID NO: 4727265 - DNA, 22 bp, Homo sapiens
ttcaccttttcttcaaaatcga

SEQ ID NO: 4727266 - DNA, 19 bp, Homo sapiens
ttcactggtctctaagtgt

SEQ ID NO: 4727267 - DNA, 14 bp, Homo sapiens
ttcactttcatttt

SEQ ID NO: 4727268 - DNA, 19 bp, Homo sapiens
ttcagaatcacttctgaga

SEQ ID NO: 4727269 - DNA, 17 bp, Homo sapiens
ttcagaatcctatggaa

SEQ ID NO: 4727270 - DNA, 15 bp, Homo sapiens
ttcagacagctgcct

SEQ ID NO: 4727271 - DNA, 23 bp, Homo sapiens
ttcagaggccctcgctgccagct

SEQ ID NO: 4727272 - DNA, 15 bp, Homo sapiens
ttcagatataaaaga

SEQ ID NO: 4727273 - DNA, 20 bp, Homo sapiens
ttcagcatcaaacatgaaaa

SEQ ID NO: 4727274 - DNA, 16 bp, Homo sapiens
ttcagctactttccat

SEQ ID NO: 4727275 - DNA, 20 bp, Homo sapiens
ttcagctactttccatttgg

SEQ ID NO: 4727276 - DNA, 23 bp, Homo sapiens
ttcagctggtggatggtgacttt

SEQ ID NO: 4727277 - DNA, 14 bp, Homo sapiens
ttcagcttctgttg

SEQ ID NO: 4727278 - DNA, 11 bp, Homo sapiens
ttcaggaagct

SEQ ID NO: 4727279 - DNA, 15 bp, Homo sapiens
ttcaggaagctcagg

SEQ ID NO: 4727280 - DNA, 19 bp, Homo sapiens
ttcaggaagctcagggcct

SEQ ID NO: 4727281 - DNA, 14 bp, Homo sapiens
ttcaggctctgaga

SEQ ID NO: 4727282 - DNA, 16 bp, Homo sapiens
ttcagggtcctgagat

SEQ ID NO: 4727283 - DNA, 16 bp, Homo sapiens
ttcagggttggcccct

SEQ ID NO: 4727284 - DNA, 22 bp, Homo sapiens
ttcagggttggcccctgcccgg

SEQ ID NO: 4727285 - DNA, 16 bp, Homo sapiens
ttcaggtaacaggcag

SEQ ID NO: 4727286 - DNA, 17 bp, Homo sapiens
ttcaggtaacaggcaga

SEQ ID NO: 4727287 - DNA, 22 bp, Homo sapiens
ttcaggtagattaaggtatctt

SEQ ID NO: 4727288 - DNA, 14 bp, Homo sapiens
ttcaggtgacatgt

SEQ ID NO: 4727289 - DNA, 23 bp, Homo sapiens
ttcaggtgacatgtgaaaccttt

SEQ ID NO: 4727290 - DNA, 24 bp, Homo sapiens
ttcaggttatcgaaataacaatgt

SEQ ID NO: 4727291 - DNA, 15 bp, Homo sapiens
ttcagtcaattctga

SEQ ID NO: 4727292 - DNA, 16 bp, Homo sapiens
ttcagtgaaagcatca

SEQ ID NO: 4727293 - DNA, 13 bp, Homo sapiens
ttcagtgccaata

SEQ ID NO: 4727294 - DNA, 13 bp, Homo sapiens
ttcagtggcagct

SEQ ID NO: 4727295 - DNA, 14 bp, Homo sapiens
ttcagtggcagctg

SEQ ID NO: 4727296 - DNA, 16 bp, Homo sapiens
ttcagtggcagctgct

SEQ ID NO: 4727297 - DNA, 17 bp, Homo sapiens
ttcagtggcagctgctt

SEQ ID NO: 4727298 - DNA, 14 bp, Homo sapiens
ttcagtggggcagt

SEQ ID NO: 4727299 - DNA, 18 bp, Homo sapiens
ttcagtgttaaatgtgat

SEQ ID NO: 4727300 - DNA, 17 bp, Homo sapiens
ttcagttctgtgtacat

SEQ ID NO: 4727301 - DNA, 18 bp, Homo sapiens
ttcagttctttctttttc

SEQ ID NO: 4727302 - DNA, 13 bp, Homo sapiens
ttcataaagagaa

SEQ ID NO: 4727303 - DNA, 22 bp, Homo sapiens
ttcataaatttgttgtcatgtg

SEQ ID NO: 4727304 - DNA, 15 bp, Homo sapiens
ttcatagaatactca

SEQ ID NO: 4727305 - DNA, 11 bp, Homo sapiens
ttcatagagaa

SEQ ID NO: 4727306 - DNA, 16 bp, Homo sapiens
ttcatatattattccg

SEQ ID NO: 4727307 - DNA, 20 bp, Homo sapiens
ttcatatgacattcatgcct

SEQ ID NO: 4727308 - DNA, 19 bp, Homo sapiens
ttcatattgcatcatagtt

SEQ ID NO: 4727309 - DNA, 13 bp, Homo sapiens
ttcatatttaatt

SEQ ID NO: 4727310 - DNA, 16 bp, Homo sapiens
ttcatcaaatggaaga

SEQ ID NO: 4727311 - DNA, 17 bp, Homo sapiens
ttcatcatccctccctg

SEQ ID NO: 4727312 - DNA, 17 bp, Homo sapiens
ttcatccaggactgaga

SEQ ID NO: 4727313 - DNA, 19 bp, Homo sapiens
ttcatctgctctccttcct

SEQ ID NO: 4727314 - DNA, 21 bp, Homo sapiens
ttcatctgctctccttcctgg

SEQ ID NO: 4727315 - DNA, 12 bp, Homo sapiens
ttcatctggaac

SEQ ID NO: 4727316 - DNA, 23 bp, Homo sapiens
ttcatctggaaccatcagaaaca

SEQ ID NO: 4727317 - DNA, 15 bp, Homo sapiens
ttcatgacagcctcc

SEQ ID NO: 4727318 - DNA, 15 bp, Homo sapiens
ttcatgattagaaat

SEQ ID NO: 4727319 - DNA, 23 bp, Homo sapiens
ttcatgattagaaattacctgtg

SEQ ID NO: 4727320 - DNA, 18 bp, Homo sapiens
ttcatgcacagtagattc

SEQ ID NO: 4727321 - DNA, 14 bp, Homo sapiens
ttcatgcatggaaa

SEQ ID NO: 4727322 - DNA, 16 bp, Homo sapiens
ttcatgcatggaaatt

SEQ ID NO: 4727323 - DNA, 18 bp, Homo sapiens
ttcatgtaaactgtgcac

SEQ ID NO: 4727324 - DNA, 14 bp, Homo sapiens
ttcattacttttaa

SEQ ID NO: 4727325 - DNA, 22 bp, Homo sapiens
ttcattacttttaaaaatgtag

SEQ ID NO: 4727326 - DNA, 13 bp, Homo sapiens
ttcattagagcag

SEQ ID NO: 4727327 - DNA, 13 bp, Homo sapiens
ttcattagcagtt

SEQ ID NO: 4727328 - DNA, 18 bp, Homo sapiens
ttcattagcagttgctca

SEQ ID NO: 4727329 - DNA, 16 bp, Homo sapiens
ttcattccattctgga

SEQ ID NO: 4727330 - DNA, 18 bp, Homo sapiens
ttcattggatttttgtta

SEQ ID NO: 4727331 - DNA, 16 bp, Homo sapiens
ttcatttactgtggct

SEQ ID NO: 4727332 - DNA, 17 bp, Homo sapiens
ttcatttcctctgagct

SEQ ID NO: 4727333 - DNA, 21 bp, Homo sapiens
ttcatttcctctgagctgtta

SEQ ID NO: 4727334 - DNA, 22 bp, Homo sapiens
ttcattttgcactgaggatatt

SEQ ID NO: 4727335 - DNA, 15 bp, Homo sapiens
ttccaaagcattttc

SEQ ID NO: 4727336 - DNA, 16 bp, Homo sapiens
ttccaaataaataatt

SEQ ID NO: 4727337 - DNA, 19 bp, Homo sapiens
ttccaaccctcatcaccaa

SEQ ID NO: 4727338 - DNA, 16 bp, Homo sapiens
ttccaatcacagtgtt

SEQ ID NO: 4727339 - DNA, 18 bp, Homo sapiens
ttccacccagcttcaaag

SEQ ID NO: 4727340 - DNA, 15 bp, Homo sapiens
ttccacggagccact

SEQ ID NO: 4727341 - DNA, 15 bp, Homo sapiens
ttccactgagggcag

SEQ ID NO: 4727342 - DNA, 13 bp, Homo sapiens
ttccagagcctca

SEQ ID NO: 4727343 - DNA, 16 bp, Homo sapiens
ttccagagctctgacc

SEQ ID NO: 4727344 - DNA, 20 bp, Homo sapiens
ttccagagctgcttctgtct

SEQ ID NO: 4727345 - DNA, 18 bp, Homo sapiens
ttccagctggatgagaat

SEQ ID NO: 4727346 - DNA, 18 bp, Homo sapiens
ttccagcttccagaactg

SEQ ID NO: 4727347 - DNA, 21 bp, Homo sapiens
ttccaggggtgggacaccctg

SEQ ID NO: 4727348 - DNA, 17 bp, Homo sapiens
ttccagtgaggctctgc

SEQ ID NO: 4727349 - DNA, 22 bp, Homo sapiens
ttccagtgaggctctgcccttg

SEQ ID NO: 4727350 - DNA, 22 bp, Homo sapiens
ttccatatttaacctatttcca

SEQ ID NO: 4727351 - DNA, 11 bp, Homo sapiens
ttccatctgtg

SEQ ID NO: 4727352 - DNA, 17 bp, Homo sapiens
ttccatgagtcccctgt

SEQ ID NO: 4727353 - DNA, 15 bp, Homo sapiens
ttccattaacaaatg

SEQ ID NO: 4727354 - DNA, 17 bp, Homo sapiens
ttccattaacaaatgct

SEQ ID NO: 4727355 - DNA, 13 bp, Homo sapiens
ttcccaagctctg

SEQ ID NO: 4727356 - DNA, 12 bp, Homo sapiens
ttcccacctctc

SEQ ID NO: 4727357 - DNA, 11 bp, Homo sapiens
ttcccactgca

SEQ ID NO: 4727358 - DNA, 18 bp, Homo sapiens
ttcccactgcaccccctc

SEQ ID NO: 4727359 - DNA, 20 bp, Homo sapiens
ttcccactgcaccccctcct

SEQ ID NO: 4727360 - DNA, 23 bp, Homo sapiens
ttcccactgcaccccctcctgct

SEQ ID NO: 4727361 - DNA, 24 bp, Homo sapiens
ttcccactgcaccccctcctgctg

SEQ ID NO: 4727362 - DNA, 11 bp, Homo sapiens
ttcccagaggg

SEQ ID NO: 4727363 - DNA, 18 bp, Homo sapiens
ttcccatgacccaggctg

SEQ ID NO: 4727364 - DNA, 18 bp, Homo sapiens
ttccccaggaggccagcc

SEQ ID NO: 4727365 - DNA, 15 bp, Homo sapiens
ttcccccactgatca

SEQ ID NO: 4727366 - DNA, 23 bp, Homo sapiens
ttccccgagggatgatgccacac

SEQ ID NO: 4727367 - DNA, 13 bp, Homo sapiens
ttcccctcctacc

SEQ ID NO: 4727368 - DNA, 16 bp, Homo sapiens
ttcccctcctacccct

SEQ ID NO: 4727369 - DNA, 20 bp, Homo sapiens
ttcccctcctacccctccca

SEQ ID NO: 4727370 - DNA, 21 bp, Homo sapiens
ttcccctcctacccctcccag

SEQ ID NO: 4727371 - DNA, 15 bp, Homo sapiens
ttccccttccactga

SEQ ID NO: 4727372 - DNA, 13 bp, Homo sapiens
ttcccgtggcccc

SEQ ID NO: 4727373 - DNA, 19 bp, Homo sapiens
ttcccgtggccccagcctg

SEQ ID NO: 4727374 - DNA, 16 bp, Homo sapiens
ttccctatctttgcca

SEQ ID NO: 4727375 - DNA, 13 bp, Homo sapiens
aaaaaaaagcttc

SEQ ID NO: 4727376 - DNA, 12 bp, Homo sapiens
aaaaaaagatga

SEQ ID NO: 4727377 - DNA, 11 bp, Homo sapiens
aaaaaaatgcc

SEQ ID NO: 4727378 - DNA, 15 bp, Homo sapiens
aaaaaagaagtttgg

SEQ ID NO: 4727379 - DNA, 11 bp, Homo sapiens
aaaaaagatga

SEQ ID NO: 4727380 - DNA, 12 bp, Homo sapiens
aaaaaatgcttc

SEQ ID NO: 4727381 - DNA, 12 bp, Homo sapiens
aaaaaatttaag

SEQ ID NO: 4727382 - DNA, 14 bp, Homo sapiens
aaaaaatttaagtg

SEQ ID NO: 4727383 - DNA, 19 bp, Homo sapiens
aaaaacctgaactttcatt

SEQ ID NO: 4727384 - DNA, 13 bp, Homo sapiens
aaaaactatttaa

SEQ ID NO: 4727385 - DNA, 13 bp, Homo sapiens
aaaaagaacttcc

SEQ ID NO: 4727386 - DNA, 15 bp, Homo sapiens
aaaaagagacatcca

SEQ ID NO: 4727387 - DNA, 20 bp, Homo sapiens
aaaaagatgttcagtcattt

SEQ ID NO: 4727388 - DNA, 17 bp, Homo sapiens
aaaaatacaaaaatttg

SEQ ID NO: 4727389 - DNA, 15 bp, Homo sapiens
aaaaatagcaacttg

SEQ ID NO: 4727390 - DNA, 12 bp, Homo sapiens
aaaaatgccttt

SEQ ID NO: 4727391 - DNA, 15 bp, Homo sapiens
aaaaatgcctttgag

SEQ ID NO: 4727392 - DNA, 22 bp, Homo sapiens
aaaaatgtagaaattcttcatg

SEQ ID NO: 4727393 - DNA, 11 bp, Homo sapiens
aaaaatgtagg

SEQ ID NO: 4727394 - DNA, 12 bp, Homo sapiens
aaaaattaaaat

SEQ ID NO: 4727395 - DNA, 20 bp, Homo sapiens
aaaaattatcagttatattt

SEQ ID NO: 4727396 - DNA, 14 bp, Homo sapiens
aaaaattattcatg

SEQ ID NO: 4727397 - DNA, 17 bp, Homo sapiens
aaaaattgaaagaactt

SEQ ID NO: 4727398 - DNA, 13 bp, Homo sapiens
aaaacacacaggt

SEQ ID NO: 4727399 - DNA, 18 bp, Homo sapiens
aaaacactacttttgctt

SEQ ID NO: 4727400 - DNA, 17 bp, Homo sapiens
aaaacagaaaaataaga

SEQ ID NO: 4727401 - DNA, 19 bp, Homo sapiens
aaaacagtggatcacaaag

SEQ ID NO: 4727402 - DNA, 18 bp, Homo sapiens
aaaacatagctggttaac

SEQ ID NO: 4727403 - DNA, 18 bp, Homo sapiens
aaaaccaagcctctggaa

SEQ ID NO: 4727404 - DNA, 23 bp, Homo sapiens
aaaactcaggcaaagaaaatgaa

SEQ ID NO: 4727405 - DNA, 22 bp, Homo sapiens
aaaagaaaatctttataaatgt

SEQ ID NO: 4727406 - DNA, 17 bp, Homo sapiens
aaaagaaatagaaaagg

SEQ ID NO: 4727407 - DNA, 13 bp, Homo sapiens
aaaagacaaacac

SEQ ID NO: 4727408 - DNA, 15 bp, Homo sapiens
aaaagacctgcattt

SEQ ID NO: 4727409 - DNA, 23 bp, Homo sapiens
aaaagcaggcttgtgctttatac

SEQ ID NO: 4727410 - DNA, 21 bp, Homo sapiens
aaaagcgggtaaaaaacctgg

SEQ ID NO: 4727411 - DNA, 22 bp, Homo sapiens
aaaagctccatttttagtgaaa

SEQ ID NO: 4727412 - DNA, 16 bp, Homo sapiens
aaaagctgtgtctctg

SEQ ID NO: 4727413 - DNA, 14 bp, Homo sapiens
aaaaggtataatta

SEQ ID NO: 4727414 - DNA, 15 bp, Homo sapiens
aaaaggttttatttt

SEQ ID NO: 4727415 - DNA, 17 bp, Homo sapiens
aaaagttgcattttaac

SEQ ID NO: 4727416 - DNA, 16 bp, Homo sapiens
aaaataaagaatggaa

SEQ ID NO: 4727417 - DNA, 11 bp, Homo sapiens
aaaataaagtg

SEQ ID NO: 4727418 - DNA, 12 bp, Homo sapiens
aaaataaagtgt

SEQ ID NO: 4727419 - DNA, 17 bp, Homo sapiens
aaaataagaaaaatatt

SEQ ID NO: 4727420 - DNA, 14 bp, Homo sapiens
aaaataattctaaa

SEQ ID NO: 4727421 - DNA, 16 bp, Homo sapiens
aaaatacggtgggggt

SEQ ID NO: 4727422 - DNA, 16 bp, Homo sapiens
aaaatagggtccttga

SEQ ID NO: 4727423 - DNA, 13 bp, Homo sapiens
aaaatataattct

SEQ ID NO: 4727424 - DNA, 12 bp, Homo sapiens
aaaatatatctt

SEQ ID NO: 4727425 - DNA, 13 bp, Homo sapiens
aaaatatcaagta

SEQ ID NO: 4727426 - DNA, 13 bp, Homo sapiens
aaaatcactgtca

SEQ ID NO: 4727427 - DNA, 20 bp, Homo sapiens
aaaatctgtcacgtagaact

SEQ ID NO: 4727428 - DNA, 16 bp, Homo sapiens
aaaatcttcagctggt

SEQ ID NO: 4727429 - DNA, 14 bp, Homo sapiens
aaaatgaaatgcat

SEQ ID NO: 4727430 - DNA, 18 bp, Homo sapiens
aaaatgaaatgcatattt

SEQ ID NO: 4727431 - DNA, 12 bp, Homo sapiens
aaaatgaatttg

SEQ ID NO: 4727432 - DNA, 18 bp, Homo sapiens
aaaatgcaacaacatgta

SEQ ID NO: 4727433 - DNA, 12 bp, Homo sapiens
aaaatgcttctt

SEQ ID NO: 4727434 - DNA, 20 bp, Homo sapiens
aaaatggaagccaacacatc

SEQ ID NO: 4727435 - DNA, 14 bp, Homo sapiens
aaaatggatttaat

SEQ ID NO: 4727436 - DNA, 19 bp, Homo sapiens
aaaatggatttaatccatt

SEQ ID NO: 4727437 - DNA, 21 bp, Homo sapiens
aaaatggatttaatccatttt

SEQ ID NO: 4727438 - DNA, 14 bp, Homo sapiens
aaaatggtgcctga

SEQ ID NO: 4727439 - DNA, 18 bp, Homo sapiens
aaaatgtctgtaataata

SEQ ID NO: 4727440 - DNA, 18 bp, Homo sapiens
aaaatgtgtctgcaacat

SEQ ID NO: 4727441 - DNA, 20 bp, Homo sapiens
aaaatgtgtctgcaacatgg

SEQ ID NO: 4727442 - DNA, 12 bp, Homo sapiens
aaaatgtgtgtg

SEQ ID NO: 4727443 - DNA, 16 bp, Homo sapiens
aaaatgttctatttaa

SEQ ID NO: 4727444 - DNA, 14 bp, Homo sapiens
aaaattaacactgc

SEQ ID NO: 4727445 - DNA, 13 bp, Homo sapiens
aaaattaactgct

SEQ ID NO: 4727446 - DNA, 21 bp, Homo sapiens
aaaattaatatgattattaat

SEQ ID NO: 4727447 - DNA, 14 bp, Homo sapiens
aaaattatatttgg

SEQ ID NO: 4727448 - DNA, 19 bp, Homo sapiens
aaaattatgtttttcagtt

SEQ ID NO: 4727449 - DNA, 13 bp, Homo sapiens
aaaattatttgca

SEQ ID NO: 4727450 - DNA, 13 bp, Homo sapiens
aaaattcagtgga

SEQ ID NO: 4727451 - DNA, 16 bp, Homo sapiens
aaaattgaaagaactt

SEQ ID NO: 4727452 - DNA, 20 bp, Homo sapiens
aaacaagcactaaacaaaga

SEQ ID NO: 4727453 - DNA, 22 bp, Homo sapiens
aaacaatagtaattctcaggcc

SEQ ID NO: 4727454 - DNA, 22 bp, Homo sapiens
aaacaatccaaatgcattcatg

SEQ ID NO: 4727455 - DNA, 20 bp, Homo sapiens
aaacacaatggagtgtgtaa

SEQ ID NO: 4727456 - DNA, 21 bp, Homo sapiens
aaacacagcatcgtgatcact

SEQ ID NO: 4727457 - DNA, 15 bp, Homo sapiens
aaacaccctcacact

SEQ ID NO: 4727458 - DNA, 15 bp, Homo sapiens
aaacactgcaggcat

SEQ ID NO: 4727459 - DNA, 13 bp, Homo sapiens
aaacactgtgcac

SEQ ID NO: 4727460 - DNA, 16 bp, Homo sapiens
aaacactgttctctgc

SEQ ID NO: 4727461 - DNA, 15 bp, Homo sapiens
aaacagctaaatttg

SEQ ID NO: 4727462 - DNA, 17 bp, Homo sapiens
aaacagctggacttatt

SEQ ID NO: 4727463 - DNA, 23 bp, Homo sapiens
aaacagtggatcacaaagtggaa

SEQ ID NO: 4727464 - DNA, 15 bp, Homo sapiens
aaacagtgtttatga

SEQ ID NO: 4727465 - DNA, 21 bp, Homo sapiens
aaacatgaccctaaatcttga

SEQ ID NO: 4727466 - DNA, 16 bp, Homo sapiens
aaacatgagttattca

SEQ ID NO: 4727467 - DNA, 22 bp, Homo sapiens
aaacatgagttattcataaaga

SEQ ID NO: 4727468 - DNA, 21 bp, Homo sapiens
aaacatgtgcaactcttgtat

SEQ ID NO: 4727469 - DNA, 12 bp, Homo sapiens
aaacattgaaga

SEQ ID NO: 4727470 - DNA, 19 bp, Homo sapiens
aaacattttcagaaatatt

SEQ ID NO: 4727471 - DNA, 12 bp, Homo sapiens
aaacattttcat

SEQ ID NO: 4727472 - DNA, 18 bp, Homo sapiens
aaaccaaatcactgaact

SEQ ID NO: 4727473 - DNA, 17 bp, Homo sapiens
aaaccaacccatgtata

SEQ ID NO: 4727474 - DNA, 21 bp, Homo sapiens
aaaccaatcttaaacataata

SEQ ID NO: 4727475 - DNA, 14 bp, Homo sapiens
aaaccacagctgct

SEQ ID NO: 4727476 - DNA, 20 bp, Homo sapiens
aaaccactttttgcagcttt

SEQ ID NO: 4727477 - DNA, 15 bp, Homo sapiens
aaaccagtatcgtta

SEQ ID NO: 4727478 - DNA, 14 bp, Homo sapiens
aaaccatcttctgt

SEQ ID NO: 4727479 - DNA, 16 bp, Homo sapiens
aaacccagctctggtc

SEQ ID NO: 4727480 - DNA, 18 bp, Homo sapiens
aaacccagctctggtcca

SEQ ID NO: 4727481 - DNA, 17 bp, Homo sapiens
aaacccagttgccatct

SEQ ID NO: 4727482 - DNA, 16 bp, Homo sapiens
aaaccctattggtaaa

SEQ ID NO: 4727483 - DNA, 13 bp, Homo sapiens
aaaccctcgaggc

SEQ ID NO: 4727484 - DNA, 14 bp, Homo sapiens
aaaccctctgtgaa

SEQ ID NO: 4727485 - DNA, 13 bp, Homo sapiens
aaaccgtccctga

SEQ ID NO: 4727486 - DNA, 20 bp, Homo sapiens
aaacctctaatttattttgt

SEQ ID NO: 4727487 - DNA, 20 bp, Homo sapiens
aaacctgcatttttaaagga

SEQ ID NO: 4727488 - DNA, 12 bp, Homo sapiens
aaacctgcctgg

SEQ ID NO: 4727489 - DNA, 14 bp, Homo sapiens
aaacctgggagaga

SEQ ID NO: 4727490 - DNA, 14 bp, Homo sapiens
aaaccttgaggaga

SEQ ID NO: 4727491 - DNA, 16 bp, Homo sapiens
aaaccttttttaagat

SEQ ID NO: 4727492 - DNA, 21 bp, Homo sapiens
aaaccttttttaagatttttc

SEQ ID NO: 4727493 - DNA, 13 bp, Homo sapiens
aaacgtaaatgtt

SEQ ID NO: 4727494 - DNA, 18 bp, Homo sapiens
aaacgtatggaatgcttc

SEQ ID NO: 4727495 - DNA, 19 bp, Homo sapiens
aaacgtatggaatgcttct

SEQ ID NO: 4727496 - DNA, 20 bp, Homo sapiens
aaactaccagtgggcatgta

SEQ ID NO: 4727497 - DNA, 13 bp, Homo sapiens
aaactactaattt

SEQ ID NO: 4727498 - DNA, 20 bp, Homo sapiens
aaactagaattgttgcatcc

SEQ ID NO: 4727499 - DNA, 18 bp, Homo sapiens
aaactagggccaagccca

SEQ ID NO: 4727500 - DNA, 19 bp, Homo sapiens
aaactcaggcaaagaaaat

SEQ ID NO: 4727501 - DNA, 19 bp, Homo sapiens
aaactccaggatttataaa

SEQ ID NO: 4727502 - DNA, 16 bp, Homo sapiens
aaactcctactgcttc

SEQ ID NO: 4727503 - DNA, 23 bp, Homo sapiens
aaactcctactgcttcctctgaa

SEQ ID NO: 4727504 - DNA, 13 bp, Homo sapiens
aaactctcctctg

SEQ ID NO: 4727505 - DNA, 13 bp, Homo sapiens
aaactcttatctc

SEQ ID NO: 4727506 - DNA, 22 bp, Homo sapiens
aaactgatccagtataagacta

SEQ ID NO: 4727507 - DNA, 16 bp, Homo sapiens
aaactgcacaataaaa

SEQ ID NO: 4727508 - DNA, 21 bp, Homo sapiens
aaactgccaaactattttctg

SEQ ID NO: 4727509 - DNA, 17 bp, Homo sapiens
aaactgccccctctgcc

SEQ ID NO: 4727510 - DNA, 22 bp, Homo sapiens
aaactgccccctctgccctgcg

SEQ ID NO: 4727511 - DNA, 11 bp, Homo sapiens
aaactgtgaat

SEQ ID NO: 4727512 - DNA, 18 bp, Homo sapiens
aaactgtgaatgcttctg

SEQ ID NO: 4727513 - DNA, 20 bp, Homo sapiens
aaactgtgaatgcttctgat

SEQ ID NO: 4727514 - DNA, 12 bp, Homo sapiens
aaactgtgcacc

SEQ ID NO: 4727515 - DNA, 21 bp, Homo sapiens
aaactgtgggattctgatttg

SEQ ID NO: 4727516 - DNA, 19 bp, Homo sapiens
aaactgttggaatggattt

SEQ ID NO: 4727517 - DNA, 20 bp, Homo sapiens
aaacttcttttctcttctac

SEQ ID NO: 4727518 - DNA, 16 bp, Homo sapiens
aaacttgtaatttttt

SEQ ID NO: 4727519 - DNA, 12 bp, Homo sapiens
aaagaaatatga

SEQ ID NO: 4727520 - DNA, 11 bp, Homo sapiens
aaagaaatcct

SEQ ID NO: 4727521 - DNA, 20 bp, Homo sapiens
aaagaaggtttcagaaagaa

SEQ ID NO: 4727522 - DNA, 23 bp, Homo sapiens
aaagaagtttgggctaacattta

SEQ ID NO: 4727523 - DNA, 17 bp, Homo sapiens
aaagacaaacaccttat

SEQ ID NO: 4727524 - DNA, 14 bp, Homo sapiens
aaagactcatccgt

SEQ ID NO: 4727525 - DNA, 22 bp, Homo sapiens
aaagactccacataagtccatt

SEQ ID NO: 4727526 - DNA, 19 bp, Homo sapiens
aaagactgaccaatattgt

SEQ ID NO: 4727527 - DNA, 14 bp, Homo sapiens
aaagagaaggagcc

SEQ ID NO: 4727528 - DNA, 20 bp, Homo sapiens
aaagagctcaggcttttcca

SEQ ID NO: 4727529 - DNA, 18 bp, Homo sapiens
aaagatatctatgactgt

SEQ ID NO: 4727530 - DNA, 22 bp, Homo sapiens
aaagatgtatatttgcatattt

SEQ ID NO: 4727531 - DNA, 15 bp, Homo sapiens
aaagcaaaaagatgt

SEQ ID NO: 4727532 - DNA, 15 bp, Homo sapiens
aacaaagttaattgt

SEQ ID NO: 4727533 - DNA, 19 bp, Homo sapiens
aacaaatgctctgtcttca

SEQ ID NO: 4727534 - DNA, 14 bp, Homo sapiens
aacaaatgtgaagg

SEQ ID NO: 4727535 - DNA, 22 bp, Homo sapiens
aacaaattcatcaaatggaaga

SEQ ID NO: 4727536 - DNA, 13 bp, Homo sapiens
aacaacctggaga

SEQ ID NO: 4727537 - DNA, 21 bp, Homo sapiens
aacaactcctagggccactga

SEQ ID NO: 4727538 - DNA, 12 bp, Homo sapiens
aacaactgggtc

SEQ ID NO: 4727539 - DNA, 19 bp, Homo sapiens
aacaagcaagctcccaagg

SEQ ID NO: 4727540 - DNA, 21 bp, Homo sapiens
aacaagcctccttttaaagta

SEQ ID NO: 4727541 - DNA, 12 bp, Homo sapiens
aacaagctattt

SEQ ID NO: 4727542 - DNA, 14 bp, Homo sapiens
aacaagcttcagta

SEQ ID NO: 4727543 - DNA, 14 bp, Homo sapiens
aacaatccaaatgc

SEQ ID NO: 4727544 - DNA, 18 bp, Homo sapiens
aacaatgttaaggaaact

SEQ ID NO: 4727545 - DNA, 21 bp, Homo sapiens
aacaatgttaaggaaactctt

SEQ ID NO: 4727546 - DNA, 22 bp, Homo sapiens
aacaatgttaaggaaactctta

SEQ ID NO: 4727547 - DNA, 21 bp, Homo sapiens
aacacacaggtgcaacagact

SEQ ID NO: 4727548 - DNA, 17 bp, Homo sapiens
aacactcaagaagcagg

SEQ ID NO: 4727549 - DNA, 15 bp, Homo sapiens
aacactcatttccaa

SEQ ID NO: 4727550 - DNA, 12 bp, Homo sapiens
aacactccttca

SEQ ID NO: 4727551 - DNA, 19 bp, Homo sapiens
aacactgtaatatctttaa

SEQ ID NO: 4727552 - DNA, 20 bp, Homo sapiens
aacactgtgcacatctgtgt

SEQ ID NO: 4727553 - DNA, 22 bp, Homo sapiens
aacactgtgcacatctgtgtct

SEQ ID NO: 4727554 - DNA, 20 bp, Homo sapiens
aacactgttctctgccctcc

SEQ ID NO: 4727555 - DNA, 15 bp, Homo sapiens
aacagaacagcttca

SEQ ID NO: 4727556 - DNA, 19 bp, Homo sapiens
aacagactggaagcacagc

SEQ ID NO: 4727557 - DNA, 19 bp, Homo sapiens
aacagagactgaatagata

SEQ ID NO: 4727558 - DNA, 15 bp, Homo sapiens
aacagatgtccctga

SEQ ID NO: 4727559 - DNA, 15 bp, Homo sapiens
aacagattcacactg

SEQ ID NO: 4727560 - DNA, 20 bp, Homo sapiens
aacagcctttgggaaatgct

SEQ ID NO: 4727561 - DNA, 18 bp, Homo sapiens
aacaggtgttggtgacaa

SEQ ID NO: 4727562 - DNA, 12 bp, Homo sapiens
aacagtgaattt

SEQ ID NO: 4727563 - DNA, 20 bp, Homo sapiens
aacagtgttaggcctggcac

SEQ ID NO: 4727564 - DNA, 23 bp, Homo sapiens
aacagtgttaggcctggcacagt

SEQ ID NO: 4727565 - DNA, 13 bp, Homo sapiens
aacagtgtttaaa

SEQ ID NO: 4727566 - DNA, 15 bp, Homo sapiens
aacataacaaccttt

SEQ ID NO: 4727567 - DNA, 15 bp, Homo sapiens
aacatacagacacat

SEQ ID NO: 4727568 - DNA, 18 bp, Homo sapiens
aacatatcatttgtgaag

SEQ ID NO: 4727569 - DNA, 14 bp, Homo sapiens
aacatattttacat

SEQ ID NO: 4727570 - DNA, 16 bp, Homo sapiens
aacatcatcaaggcac

SEQ ID NO: 4727571 - DNA, 13 bp, Homo sapiens
aacatcctgactt

SEQ ID NO: 4727572 - DNA, 14 bp, Homo sapiens
aacatcctgacttc

SEQ ID NO: 4727573 - DNA, 22 bp, Homo sapiens
aacatctgtcctgtgaaagact

SEQ ID NO: 4727574 - DNA, 20 bp, Homo sapiens
aacatgaccctaaatcttga

SEQ ID NO: 4727575 - DNA, 13 bp, Homo sapiens
aacatgagttatt

SEQ ID NO: 4727576 - DNA, 15 bp, Homo sapiens
aacatggattccaaa

SEQ ID NO: 4727577 - DNA, 17 bp, Homo sapiens
aacatggtgtgtgtctc

SEQ ID NO: 4727578 - DNA, 14 bp, Homo sapiens
aacatgtatgtgga

SEQ ID NO: 4727579 - DNA, 22 bp, Homo sapiens
aacatgtgcaactcttgtattg

SEQ ID NO: 4727580 - DNA, 19 bp, Homo sapiens
aacattaccttactgtgga

SEQ ID NO: 4727581 - DNA, 19 bp, Homo sapiens
aacattagttttaaaaagg

SEQ ID NO: 4727582 - DNA, 13 bp, Homo sapiens
aacattccatcct

SEQ ID NO: 4727583 - DNA, 14 bp, Homo sapiens
aacattccatcctt

SEQ ID NO: 4727584 - DNA, 15 bp, Homo sapiens
aacattgcaatagaa

SEQ ID NO: 4727585 - DNA, 16 bp, Homo sapiens
aacattgcaatagaaa

SEQ ID NO: 4727586 - DNA, 19 bp, Homo sapiens
aacatttaggagaagttgg

SEQ ID NO: 4727587 - DNA, 11 bp, Homo sapiens
aacattttgtt

SEQ ID NO: 4727588 - DNA, 16 bp, Homo sapiens
aaccaaaggaaaatgt

SEQ ID NO: 4727589 - DNA, 15 bp, Homo sapiens
aaccaacccatgtat

SEQ ID NO: 4727590 - DNA, 15 bp, Homo sapiens
aaccaagcctctgga

SEQ ID NO: 4727591 - DNA, 22 bp, Homo sapiens
aaccaattataacttattagca

SEQ ID NO: 4727592 - DNA, 23 bp, Homo sapiens
aaccacatgaactacgtgacctc

SEQ ID NO: 4727593 - DNA, 16 bp, Homo sapiens
aaccacattgaagaat

SEQ ID NO: 4727594 - DNA, 19 bp, Homo sapiens
aaccaccacacccagccca

SEQ ID NO: 4727595 - DNA, 21 bp, Homo sapiens
aaccaccacacccagcccact

SEQ ID NO: 4727596 - DNA, 15 bp, Homo sapiens
aaccactttttgcag

SEQ ID NO: 4727597 - DNA, 18 bp, Homo sapiens
aaccagcctcatgctctg

SEQ ID NO: 4727598 - DNA, 17 bp, Homo sapiens
aaccaggcttgcctggg

SEQ ID NO: 4727599 - DNA, 14 bp, Homo sapiens
aaccataaatcaat

SEQ ID NO: 4727600 - DNA, 21 bp, Homo sapiens
aaccataaatcaattcatgtt

SEQ ID NO: 4727601 - DNA, 20 bp, Homo sapiens
aaccatgcagaggaatatta

SEQ ID NO: 4727602 - DNA, 16 bp, Homo sapiens
aaccatggcacttgat

SEQ ID NO: 4727603 - DNA, 13 bp, Homo sapiens
aacccaatagttg

SEQ ID NO: 4727604 - DNA, 10 bp, Homo sapiens
aacccagccg

SEQ ID NO: 4727605 - DNA, 16 bp, Homo sapiens
aacccagccgctgccc

SEQ ID NO: 4727606 - DNA, 11 bp, Homo sapiens
aacccagctct

SEQ ID NO: 4727607 - DNA, 22 bp, Homo sapiens
aacccaggagcatccacctcct

SEQ ID NO: 4727608 - DNA, 21 bp, Homo sapiens
aacccaggccacaaatgtgtc

SEQ ID NO: 4727609 - DNA, 20 bp, Homo sapiens
aacccatcaacaaaaattgt

SEQ ID NO: 4727610 - DNA, 16 bp, Homo sapiens
aaccccaagttagttc

SEQ ID NO: 4727611 - DNA, 16 bp, Homo sapiens
aacccccagcccctcc

SEQ ID NO: 4727612 - DNA, 19 bp, Homo sapiens
aaccccccagcactgagga

SEQ ID NO: 4727613 - DNA, 19 bp, Homo sapiens
aaccctcctgggcccaagt

SEQ ID NO: 4727614 - DNA, 16 bp, Homo sapiens
aaccgaacatatcatt

SEQ ID NO: 4727615 - DNA, 14 bp, Homo sapiens
aacctagaagggct

SEQ ID NO: 4727616 - DNA, 22 bp, Homo sapiens
aacctatttccacattctctct

SEQ ID NO: 4727617 - DNA, 16 bp, Homo sapiens
aacctcatcttcttca

SEQ ID NO: 4727618 - DNA, 14 bp, Homo sapiens
aacctcctgggcta

SEQ ID NO: 4727619 - DNA, 19 bp, Homo sapiens
aacctcctttctcttctct

SEQ ID NO: 4727620 - DNA, 22 bp, Homo sapiens
aacctcgaggtttctcaaagaa

SEQ ID NO: 4727621 - DNA, 18 bp, Homo sapiens
aacctcttcagaggccct

SEQ ID NO: 4727622 - DNA, 23 bp, Homo sapiens
aacctgatgaaaataaagaatgg

SEQ ID NO: 4727623 - DNA, 23 bp, Homo sapiens
aacctgcatttttaaaggacaaa

SEQ ID NO: 4727624 - DNA, 19 bp, Homo sapiens
aacctgcctgacatttgga

SEQ ID NO: 4727625 - DNA, 10 bp, Homo sapiens
aacctggaga

SEQ ID NO: 4727626 - DNA, 19 bp, Homo sapiens
aacctggcaagctagaacc

SEQ ID NO: 4727627 - DNA, 21 bp, Homo sapiens
aacctgtggcgctgcagcagg

SEQ ID NO: 4727628 - DNA, 20 bp, Homo sapiens
aaccttgaagtgactgttgt

SEQ ID NO: 4727629 - DNA, 21 bp, Homo sapiens
aacgattgacaccaaaatgaa

SEQ ID NO: 4727630 - DNA, 20 bp, Homo sapiens
aacgctctaggtacgatgac

SEQ ID NO: 4727631 - DNA, 13 bp, Homo sapiens
aacgtctgtgcca

SEQ ID NO: 4727632 - DNA, 12 bp, Homo sapiens
aactaaaatcat

SEQ ID NO: 4727633 - DNA, 14 bp, Homo sapiens
aactaaatgtagtt

SEQ ID NO: 4727634 - DNA, 18 bp, Homo sapiens
aactaccagtgggcatgt

SEQ ID NO: 4727635 - DNA, 19 bp, Homo sapiens
aactaccagtgggcatgta

SEQ ID NO: 4727636 - DNA, 22 bp, Homo sapiens
aactaccagtgggcatgtatta

SEQ ID NO: 4727637 - DNA, 22 bp, Homo sapiens
aactagagcagccctggagtca

SEQ ID NO: 4727638 - DNA, 18 bp, Homo sapiens
aactagcttggaaactgg

SEQ ID NO: 4727639 - DNA, 17 bp, Homo sapiens
aactagggccaagccca

SEQ ID NO: 4727640 - DNA, 14 bp, Homo sapiens
aactatgataaatt

SEQ ID NO: 4727641 - DNA, 21 bp, Homo sapiens
aactatgatttggaaaataaa

SEQ ID NO: 4727642 - DNA, 20 bp, Homo sapiens
aaagcaaggaaactatgtaa

SEQ ID NO: 4727643 - DNA, 22 bp, Homo sapiens
aaagcacaggtgggcttcccag

SEQ ID NO: 4727644 - DNA, 19 bp, Homo sapiens
aaagcacatgccagggaaa

SEQ ID NO: 4727645 - DNA, 13 bp, Homo sapiens
aaagcagaaaata

SEQ ID NO: 4727646 - DNA, 18 bp, Homo sapiens
aaagcatggccctgctgc

SEQ ID NO: 4727647 - DNA, 19 bp, Homo sapiens
aaagcccttaggaagaatt

SEQ ID NO: 4727648 - DNA, 13 bp, Homo sapiens
aaagcctctgtgt

SEQ ID NO: 4727649 - DNA, 14 bp, Homo sapiens
aaagctaggcctgg

SEQ ID NO: 4727650 - DNA, 15 bp, Homo sapiens
aaagctattagccag

SEQ ID NO: 4727651 - DNA, 17 bp, Homo sapiens
aaagctattagccagga

SEQ ID NO: 4727652 - DNA, 18 bp, Homo sapiens
aaagctattagccaggat

SEQ ID NO: 4727653 - DNA, 19 bp, Homo sapiens
aaagctattagccaggatc

SEQ ID NO: 4727654 - DNA, 14 bp, Homo sapiens
aaagctgatttttt

SEQ ID NO: 4727655 - DNA, 13 bp, Homo sapiens
aaagctgtgtctc

SEQ ID NO: 4727656 - DNA, 16 bp, Homo sapiens
aaagctgtgtctctgt

SEQ ID NO: 4727657 - DNA, 19 bp, Homo sapiens
aaagctgtgtctctgtata

SEQ ID NO: 4727658 - DNA, 21 bp, Homo sapiens
aaagctgtgtctctgtatata

SEQ ID NO: 4727659 - DNA, 22 bp, Homo sapiens
aaaggaaagagggaggtaagga

SEQ ID NO: 4727660 - DNA, 21 bp, Homo sapiens
aaaggaatccactcccaggca

SEQ ID NO: 4727661 - DNA, 13 bp, Homo sapiens
aaaggaatttaaa

SEQ ID NO: 4727662 - DNA, 15 bp, Homo sapiens
aaaggacaaacagtg

SEQ ID NO: 4727663 - DNA, 14 bp, Homo sapiens
aaaggataaagaag

SEQ ID NO: 4727664 - DNA, 14 bp, Homo sapiens
aaaggcaagcactt

SEQ ID NO: 4727665 - DNA, 18 bp, Homo sapiens
aaaggcaatggtttgtgt

SEQ ID NO: 4727666 - DNA, 20 bp, Homo sapiens
aaaggctccaggagcagcca

SEQ ID NO: 4727667 - DNA, 14 bp, Homo sapiens
aaagggcagccctc

SEQ ID NO: 4727668 - DNA, 20 bp, Homo sapiens
aaagggcgcaaagggcatgg

SEQ ID NO: 4727669 - DNA, 14 bp, Homo sapiens
aaaggtatattgtg

SEQ ID NO: 4727670 - DNA, 15 bp, Homo sapiens
aaaggtatattgtga

SEQ ID NO: 4727671 - DNA, 16 bp, Homo sapiens
aaaggttttattttgt

SEQ ID NO: 4727672 - DNA, 17 bp, Homo sapiens
aaaggttttattttgta

SEQ ID NO: 4727673 - DNA, 13 bp, Homo sapiens
aaagtaaactgtg

SEQ ID NO: 4727674 - DNA, 18 bp, Homo sapiens
aaagtaaatacatgcata

SEQ ID NO: 4727675 - DNA, 16 bp, Homo sapiens
aaagtaagaaaacaat

SEQ ID NO: 4727676 - DNA, 16 bp, Homo sapiens
aaagtacatgttaaac

SEQ ID NO: 4727677 - DNA, 14 bp, Homo sapiens
aaagtatcaaagaa

SEQ ID NO: 4727678 - DNA, 14 bp, Homo sapiens
aaagtattctccat

SEQ ID NO: 4727679 - DNA, 12 bp, Homo sapiens
aaagtcataaat

SEQ ID NO: 4727680 - DNA, 15 bp, Homo sapiens
aaagtcataaatgca

SEQ ID NO: 4727681 - DNA, 19 bp, Homo sapiens
aaagtcatgcaaaggctgg

SEQ ID NO: 4727682 - DNA, 16 bp, Homo sapiens
aaagtcattaaagaca

SEQ ID NO: 4727683 - DNA, 11 bp, Homo sapiens
aaagtgctggg

SEQ ID NO: 4727684 - DNA, 14 bp, Homo sapiens
aaagtgctgggatt

SEQ ID NO: 4727685 - DNA, 20 bp, Homo sapiens
aaagtggaaaacaaggaagt

SEQ ID NO: 4727686 - DNA, 17 bp, Homo sapiens
aaagtgggtttcaattt

SEQ ID NO: 4727687 - DNA, 17 bp, Homo sapiens
aaagtggtatagaaatg

SEQ ID NO: 4727688 - DNA, 17 bp, Homo sapiens
aaagttaaaattgttat

SEQ ID NO: 4727689 - DNA, 19 bp, Homo sapiens
aaagtttgtggtaatttgt

SEQ ID NO: 4727690 - DNA, 22 bp, Homo sapiens
aaagttttgttctgtatatttt

SEQ ID NO: 4727691 - DNA, 22 bp, Homo sapiens
aaataaaattaaagctgaaaac

SEQ ID NO: 4727692 - DNA, 21 bp, Homo sapiens
aaataaaccttgtttctttct

SEQ ID NO: 4727693 - DNA, 13 bp, Homo sapiens
aaataaagtgtgt

SEQ ID NO: 4727694 - DNA, 18 bp, Homo sapiens
aaataacaatgttaagga

SEQ ID NO: 4727695 - DNA, 19 bp, Homo sapiens
aaataacaatgttaaggaa

SEQ ID NO: 4727696 - DNA, 22 bp, Homo sapiens
aaataacatcattgtattaacg

SEQ ID NO: 4727697 - DNA, 18 bp, Homo sapiens
aaataagggcagagtcac

SEQ ID NO: 4727698 - DNA, 13 bp, Homo sapiens
aaataatgtctct

SEQ ID NO: 4727699 - DNA, 13 bp, Homo sapiens
aaatacacttttt

SEQ ID NO: 4727700 - DNA, 22 bp, Homo sapiens
aaatacagtcttccatttgcaa

SEQ ID NO: 4727701 - DNA, 23 bp, Homo sapiens
aaatacagtcttccatttgcaag

SEQ ID NO: 4727702 - DNA, 20 bp, Homo sapiens
aaatacagtttgtcacatga

SEQ ID NO: 4727703 - DNA, 22 bp, Homo sapiens
aaatacagtttgtcacatgaaa

SEQ ID NO: 4727704 - DNA, 20 bp, Homo sapiens
aaatactaactgctgatttt

SEQ ID NO: 4727705 - DNA, 15 bp, Homo sapiens
aaatactatccaaat

SEQ ID NO: 4727706 - DNA, 14 bp, Homo sapiens
aaatactggactca

SEQ ID NO: 4727707 - DNA, 22 bp, Homo sapiens
aaatactgtttttaacaactat

SEQ ID NO: 4727708 - DNA, 19 bp, Homo sapiens
aaatacttaaatttggttt

SEQ ID NO: 4727709 - DNA, 21 bp, Homo sapiens
aaatactttcgaaatttcatt

SEQ ID NO: 4727710 - DNA, 22 bp, Homo sapiens
aaatactttcgaaatttcattt

SEQ ID NO: 4727711 - DNA, 24 bp, Homo sapiens
aaatagctcaggtgtccctgcact

SEQ ID NO: 4727712 - DNA, 24 bp, Homo sapiens
aaataggagaggatgagagcccag

SEQ ID NO: 4727713 - DNA, 19 bp, Homo sapiens
aaatagggtccttgaaaca

SEQ ID NO: 4727714 - DNA, 16 bp, Homo sapiens
aaatagtaaaaataaa

SEQ ID NO: 4727715 - DNA, 13 bp, Homo sapiens
aaatataaaatat

SEQ ID NO: 4727716 - DNA, 20 bp, Homo sapiens
aaatatacatttgttggtaa

SEQ ID NO: 4727717 - DNA, 19 bp, Homo sapiens
aaatatagttgtctttctt

SEQ ID NO: 4727718 - DNA, 12 bp, Homo sapiens
aaatatcaaagt

SEQ ID NO: 4727719 - DNA, 14 bp, Homo sapiens
aaatatcaaagtca

SEQ ID NO: 4727720 - DNA, 21 bp, Homo sapiens
aaatatcatataaacatttta

SEQ ID NO: 4727721 - DNA, 21 bp, Homo sapiens
aaatatccctttttcacatat

SEQ ID NO: 4727722 - DNA, 18 bp, Homo sapiens
aaatatgcagtgatatgg

SEQ ID NO: 4727723 - DNA, 17 bp, Homo sapiens
aaatatggctagttttc

SEQ ID NO: 4727724 - DNA, 19 bp, Homo sapiens
aaatattcctttgcatatt

SEQ ID NO: 4727725 - DNA, 17 bp, Homo sapiens
aaatattggtttgttat

SEQ ID NO: 4727726 - DNA, 15 bp, Homo sapiens
aaatatttttataga

SEQ ID NO: 4727727 - DNA, 23 bp, Homo sapiens
aaatatttttatagatttgacct

SEQ ID NO: 4727728 - DNA, 12 bp, Homo sapiens
aaatcaaagtag

SEQ ID NO: 4727729 - DNA, 17 bp, Homo sapiens
aaatcaaagtagaaact

SEQ ID NO: 4727730 - DNA, 14 bp, Homo sapiens
aaatcagttctcaa

SEQ ID NO: 4727731 - DNA, 16 bp, Homo sapiens
aaatcatcaaaaagaa

SEQ ID NO: 4727732 - DNA, 19 bp, Homo sapiens
aaatcattcttactaaaaa

SEQ ID NO: 4727733 - DNA, 17 bp, Homo sapiens
aaatcctgaagagcatt

SEQ ID NO: 4727734 - DNA, 12 bp, Homo sapiens
aaatcctgggag

SEQ ID NO: 4727735 - DNA, 16 bp, Homo sapiens
aaatcgccttatgaga

SEQ ID NO: 4727736 - DNA, 19 bp, Homo sapiens
aaatctaatgacattcaat

SEQ ID NO: 4727737 - DNA, 11 bp, Homo sapiens
aaatcttcagc

SEQ ID NO: 4727738 - DNA, 13 bp, Homo sapiens
aaatcttcagctg

SEQ ID NO: 4727739 - DNA, 15 bp, Homo sapiens
aaatcttcagctggt

SEQ ID NO: 4727740 - DNA, 16 bp, Homo sapiens
aaatgaaaatgtcttg

SEQ ID NO: 4727741 - DNA, 14 bp, Homo sapiens
aaatgaaagctact

SEQ ID NO: 4727742 - DNA, 19 bp, Homo sapiens
aaatgaaccttgctatcaa

SEQ ID NO: 4727743 - DNA, 16 bp, Homo sapiens
aaatgaatggctcact

SEQ ID NO: 4727744 - DNA, 21 bp, Homo sapiens
aaatgaatgtgcaaaaaaaga

SEQ ID NO: 4727745 - DNA, 14 bp, Homo sapiens
aaatgaatttggga

SEQ ID NO: 4727746 - DNA, 17 bp, Homo sapiens
aaatgatggggagtgag

SEQ ID NO: 4727747 - DNA, 15 bp, Homo sapiens
aaatgatttcacagt

SEQ ID NO: 4727748 - DNA, 11 bp, Homo sapiens
aaatgcattca

SEQ ID NO: 4727749 - DNA, 15 bp, Homo sapiens
aaatgcattcatgtt

SEQ ID NO: 4727750 - DNA, 15 bp, Homo sapiens
aaatgcccagcccct

SEQ ID NO: 4727751 - DNA, 22 bp, Homo sapiens
aaatgcccttacacttactgtt

SEQ ID NO: 4727752 - DNA, 13 bp, Homo sapiens
aaatgcctttgag

SEQ ID NO: 4727753 - DNA, 17 bp, Homo sapiens
aaatgcctttgagacag

SEQ ID NO: 4727754 - DNA, 21 bp, Homo sapiens
aagaactacaaacaaaatttc

SEQ ID NO: 4727755 - DNA, 23 bp, Homo sapiens
aagaactattgtgctcagagaca

SEQ ID NO: 4727756 - DNA, 19 bp, Homo sapiens
aagaactgtcatgtaaaca

SEQ ID NO: 4727757 - DNA, 14 bp, Homo sapiens
aagaagaattggcc

SEQ ID NO: 4727758 - DNA, 16 bp, Homo sapiens
aagaagagaggcatag

SEQ ID NO: 4727759 - DNA, 20 bp, Homo sapiens
aagaagagctatcaggagaa

SEQ ID NO: 4727760 - DNA, 19 bp, Homo sapiens
aagaagatcctaaaacaaa

SEQ ID NO: 4727761 - DNA, 12 bp, Homo sapiens
aagaagcaggct

SEQ ID NO: 4727762 - DNA, 19 bp, Homo sapiens
aagaagcaggctacactga

SEQ ID NO: 4727763 - DNA, 17 bp, Homo sapiens
aagaagcccaggaaagg

SEQ ID NO: 4727764 - DNA, 14 bp, Homo sapiens
aagaagctgttgta

SEQ ID NO: 4727765 - DNA, 21 bp, Homo sapiens
aagaagctgttgtacatttat

SEQ ID NO: 4727766 - DNA, 14 bp, Homo sapiens
aagaaggaaaaatt

SEQ ID NO: 4727767 - DNA, 22 bp, Homo sapiens
aagaagggctagaacctggagg

SEQ ID NO: 4727768 - DNA, 21 bp, Homo sapiens
aagaaggggacaatggcagaa

SEQ ID NO: 4727769 - DNA, 19 bp, Homo sapiens
aagaagtttgggctaacat

SEQ ID NO: 4727770 - DNA, 15 bp, Homo sapiens
aagaatgttagagta

SEQ ID NO: 4727771 - DNA, 15 bp, Homo sapiens
aagacaatactccct

SEQ ID NO: 4727772 - DNA, 12 bp, Homo sapiens
aagacagaggca

SEQ ID NO: 4727773 - DNA, 16 bp, Homo sapiens
aagacagcatttaaag

SEQ ID NO: 4727774 - DNA, 20 bp, Homo sapiens
aagacagcatttaaagttgt

SEQ ID NO: 4727775 - DNA, 23 bp, Homo sapiens
aagacagtgaaagaaaataacaa

SEQ ID NO: 4727776 - DNA, 19 bp, Homo sapiens
aagacataacgtttttcct

SEQ ID NO: 4727777 - DNA, 22 bp, Homo sapiens
aagacataacgtttttccttta

SEQ ID NO: 4727778 - DNA, 11 bp, Homo sapiens
aagacattttc

SEQ ID NO: 4727779 - DNA, 13 bp, Homo sapiens
aagacattttcat

SEQ ID NO: 4727780 - DNA, 18 bp, Homo sapiens
aagacccttgtggtccca

SEQ ID NO: 4727781 - DNA, 21 bp, Homo sapiens
aagacctggcaaggacacaga

SEQ ID NO: 4727782 - DNA, 13 bp, Homo sapiens
aagacgctgtgct

SEQ ID NO: 4727783 - DNA, 15 bp, Homo sapiens
aagacgctgtgctgc

SEQ ID NO: 4727784 - DNA, 18 bp, Homo sapiens
aagacgctgtgctgccct

SEQ ID NO: 4727785 - DNA, 19 bp, Homo sapiens
aagacgctgtgctgccctg

SEQ ID NO: 4727786 - DNA, 23 bp, Homo sapiens
aagactcaagtgggaacgactgg

SEQ ID NO: 4727787 - DNA, 16 bp, Homo sapiens
aagacttccagagcct

SEQ ID NO: 4727788 - DNA, 16 bp, Homo sapiens
aagactttggaaagag

SEQ ID NO: 4727789 - DNA, 22 bp, Homo sapiens
aagagagcttaatgataatatt

SEQ ID NO: 4727790 - DNA, 14 bp, Homo sapiens
aagagatacagagg

SEQ ID NO: 4727791 - DNA, 20 bp, Homo sapiens
aagagattagaacatttaat

SEQ ID NO: 4727792 - DNA, 14 bp, Homo sapiens
aagagcatctgatt

SEQ ID NO: 4727793 - DNA, 19 bp, Homo sapiens
aagagctcaggcttttcca

SEQ ID NO: 4727794 - DNA, 11 bp, Homo sapiens
aagagctgagg

SEQ ID NO: 4727795 - DNA, 18 bp, Homo sapiens
aagagctgaggcaattct

SEQ ID NO: 4727796 - DNA, 11 bp, Homo sapiens
aagaggcaggg

SEQ ID NO: 4727797 - DNA, 23 bp, Homo sapiens
aagagggaagaaagagaaggagc

SEQ ID NO: 4727798 - DNA, 22 bp, Homo sapiens
aagagggagggagggctccaga

SEQ ID NO: 4727799 - DNA, 11 bp, Homo sapiens
acacagctctg

SEQ ID NO: 4727800 - DNA, 11 bp, Homo sapiens
acacagctctt

SEQ ID NO: 4727801 - DNA, 13 bp, Homo sapiens
acacagctcttct

SEQ ID NO: 4727802 - DNA, 21 bp, Homo sapiens
acacagctcttctccaggctg

SEQ ID NO: 4727803 - DNA, 22 bp, Homo sapiens
acacagctcttctccaggctgt

SEQ ID NO: 4727804 - DNA, 16 bp, Homo sapiens
acacaggcccggctcc

SEQ ID NO: 4727805 - DNA, 19 bp, Homo sapiens
acacaggcccggctccagg

SEQ ID NO: 4727806 - DNA, 24 bp, Homo sapiens
acacaggcccggctccaggctcct

SEQ ID NO: 4727807 - DNA, 17 bp, Homo sapiens
acacagtgaccatacta

SEQ ID NO: 4727808 - DNA, 17 bp, Homo sapiens
acacagtgattccctcc

SEQ ID NO: 4727809 - DNA, 22 bp, Homo sapiens
acacagtgctgaccagacagcc

SEQ ID NO: 4727810 - DNA, 15 bp, Homo sapiens
acacatgtggagaag

SEQ ID NO: 4727811 - DNA, 12 bp, Homo sapiens
acacatgtgtgc

SEQ ID NO: 4727812 - DNA, 14 bp, Homo sapiens
acacattacaaagt

SEQ ID NO: 4727813 - DNA, 23 bp, Homo sapiens
acacattacaaagttaaaattgt

SEQ ID NO: 4727814 - DNA, 16 bp, Homo sapiens
acacatttacactaga

SEQ ID NO: 4727815 - DNA, 15 bp, Homo sapiens
acaccaaaaattgcg

SEQ ID NO: 4727816 - DNA, 13 bp, Homo sapiens
acaccaaacttca

SEQ ID NO: 4727817 - DNA, 18 bp, Homo sapiens
acaccaaacttcattttt

SEQ ID NO: 4727818 - DNA, 23 bp, Homo sapiens
acaccaataaatgtttgttattt

SEQ ID NO: 4727819 - DNA, 20 bp, Homo sapiens
acaccacccagagcaccctc

SEQ ID NO: 4727820 - DNA, 18 bp, Homo sapiens
acaccagagcagatgcag

SEQ ID NO: 4727821 - DNA, 12 bp, Homo sapiens
acaccagagccc

SEQ ID NO: 4727822 - DNA, 23 bp, Homo sapiens
acaccagagcccaccttggctca

SEQ ID NO: 4727823 - DNA, 15 bp, Homo sapiens
acaccagctgttctg

SEQ ID NO: 4727824 - DNA, 15 bp, Homo sapiens
acaccccccttctga

SEQ ID NO: 4727825 - DNA, 16 bp, Homo sapiens
acaccccccttctgaa

SEQ ID NO: 4727826 - DNA, 13 bp, Homo sapiens
acaccctcacact

SEQ ID NO: 4727827 - DNA, 15 bp, Homo sapiens
acacgaactgaaatg

SEQ ID NO: 4727828 - DNA, 16 bp, Homo sapiens
acacgggggcagctga

SEQ ID NO: 4727829 - DNA, 23 bp, Homo sapiens
acacgggggcagctgatacaaat

SEQ ID NO: 4727830 - DNA, 14 bp, Homo sapiens
acactaaaatttaa

SEQ ID NO: 4727831 - DNA, 17 bp, Homo sapiens
acactaaccacgctgga

SEQ ID NO: 4727832 - DNA, 19 bp, Homo sapiens
acactaaccacgctggacc

SEQ ID NO: 4727833 - DNA, 20 bp, Homo sapiens
acactaaccacgctggacct

SEQ ID NO: 4727834 - DNA, 16 bp, Homo sapiens
acactagaggccaggg

SEQ ID NO: 4727835 - DNA, 17 bp, Homo sapiens
acactcaagaagcaggc

SEQ ID NO: 4727836 - DNA, 22 bp, Homo sapiens
acactcacatttattctgctca

SEQ ID NO: 4727837 - DNA, 16 bp, Homo sapiens
acactcattgacctga

SEQ ID NO: 4727838 - DNA, 23 bp, Homo sapiens
acactcattgacctgaggccctt

SEQ ID NO: 4727839 - DNA, 14 bp, Homo sapiens
acactcccttgggc

SEQ ID NO: 4727840 - DNA, 21 bp, Homo sapiens
acactgcaggcatcacagcta

SEQ ID NO: 4727841 - DNA, 19 bp, Homo sapiens
acactgcggggcttggctg

SEQ ID NO: 4727842 - DNA, 18 bp, Homo sapiens
acactgggacttgcaaaa

SEQ ID NO: 4727843 - DNA, 21 bp, Homo sapiens
acactggtattcctgcctcca

SEQ ID NO: 4727844 - DNA, 10 bp, Homo sapiens
acactggtct

SEQ ID NO: 4727845 - DNA, 11 bp, Homo sapiens
acactggtcta

SEQ ID NO: 4727846 - DNA, 15 bp, Homo sapiens
acactggtctaatgt

SEQ ID NO: 4727847 - DNA, 18 bp, Homo sapiens
acactgtcctattatatt

SEQ ID NO: 4727848 - DNA, 17 bp, Homo sapiens
acactgtgctgagtctg

SEQ ID NO: 4727849 - DNA, 16 bp, Homo sapiens
acactgttctctgccc

SEQ ID NO: 4727850 - DNA, 17 bp, Homo sapiens
acactgttctctgccct

SEQ ID NO: 4727851 - DNA, 23 bp, Homo sapiens
acactgttctctgccctccaaga

SEQ ID NO: 4727852 - DNA, 16 bp, Homo sapiens
acacttttaattttgt

SEQ ID NO: 4727853 - DNA, 17 bp, Homo sapiens
acagaaaacaattgttc

SEQ ID NO: 4727854 - DNA, 21 bp, Homo sapiens
acagaacacagccaaagtaaa

SEQ ID NO: 4727855 - DNA, 12 bp, Homo sapiens
acagaacactgt

SEQ ID NO: 4727856 - DNA, 12 bp, Homo sapiens
acagaacagctt

SEQ ID NO: 4727857 - DNA, 13 bp, Homo sapiens
acagaacagcttc

SEQ ID NO: 4727858 - DNA, 18 bp, Homo sapiens
acagaacagcttcaggtt

SEQ ID NO: 4727859 - DNA, 20 bp, Homo sapiens
acagaacagcttcaggttat

SEQ ID NO: 4727860 - DNA, 18 bp, Homo sapiens
acagaactctttcaaaac

SEQ ID NO: 4727861 - DNA, 13 bp, Homo sapiens
acagaagcagctc

SEQ ID NO: 4727862 - DNA, 14 bp, Homo sapiens
acagaagcagctct

SEQ ID NO: 4727863 - DNA, 19 bp, Homo sapiens
acagaatggctatcaaaag

SEQ ID NO: 4727864 - DNA, 14 bp, Homo sapiens
acagacacaggccc

SEQ ID NO: 4727865 - DNA, 15 bp, Homo sapiens
acagacacaggcccg

SEQ ID NO: 4727866 - DNA, 17 bp, Homo sapiens
acagacacaggcccggc

SEQ ID NO: 4727867 - DNA, 22 bp, Homo sapiens
acagacactaacgaaatatcaa

SEQ ID NO: 4727868 - DNA, 13 bp, Homo sapiens
acagaccctgccc

SEQ ID NO: 4727869 - DNA, 17 bp, Homo sapiens
acagaccctgccctgtg

SEQ ID NO: 4727870 - DNA, 20 bp, Homo sapiens
acagaccctgccctgtgggc

SEQ ID NO: 4727871 - DNA, 14 bp, Homo sapiens
acagactggaagca

SEQ ID NO: 4727872 - DNA, 22 bp, Homo sapiens
acagactggaagcacagcttca

SEQ ID NO: 4727873 - DNA, 14 bp, Homo sapiens
acagagaaaagcag

SEQ ID NO: 4727874 - DNA, 17 bp, Homo sapiens
acagagaaaatgaattt

SEQ ID NO: 4727875 - DNA, 11 bp, Homo sapiens
acagagaaagt

SEQ ID NO: 4727876 - DNA, 20 bp, Homo sapiens
acagagcccacgcccccact

SEQ ID NO: 4727877 - DNA, 21 bp, Homo sapiens
acagagctgggatgtttctgt

SEQ ID NO: 4727878 - DNA, 15 bp, Homo sapiens
acagagcttccctga

SEQ ID NO: 4727879 - DNA, 19 bp, Homo sapiens
acagaggcagccccattct

SEQ ID NO: 4727880 - DNA, 23 bp, Homo sapiens
acagaggcagccccattctgcct

SEQ ID NO: 4727881 - DNA, 19 bp, Homo sapiens
acagagggggtggcctccc

SEQ ID NO: 4727882 - DNA, 14 bp, Homo sapiens
acagagtatttctg

SEQ ID NO: 4727883 - DNA, 19 bp, Homo sapiens
acagagtctcactgttgcc

SEQ ID NO: 4727884 - DNA, 15 bp, Homo sapiens
acagagtgagactct

SEQ ID NO: 4727885 - DNA, 18 bp, Homo sapiens
acagagttttcactctta

SEQ ID NO: 4727886 - DNA, 20 bp, Homo sapiens
acagatgaaacacaaacaat

SEQ ID NO: 4727887 - DNA, 15 bp, Homo sapiens
acagatgctgtgtaa

SEQ ID NO: 4727888 - DNA, 17 bp, Homo sapiens
acagattcacactgtct

SEQ ID NO: 4727889 - DNA, 23 bp, Homo sapiens
acagcaaggaggctggctggggc

SEQ ID NO: 4727890 - DNA, 16 bp, Homo sapiens
acagcaaggcacctgc

SEQ ID NO: 4727891 - DNA, 14 bp, Homo sapiens
acagccaaatttaa

SEQ ID NO: 4727892 - DNA, 14 bp, Homo sapiens
acagccaccctcac

SEQ ID NO: 4727893 - DNA, 15 bp, Homo sapiens
acagccacggccagg

SEQ ID NO: 4727894 - DNA, 17 bp, Homo sapiens
acagccacggccaggcc

SEQ ID NO: 4727895 - DNA, 18 bp, Homo sapiens
acagcccaaagaaggaaa

SEQ ID NO: 4727896 - DNA, 16 bp, Homo sapiens
acagcccacgtcctgt

SEQ ID NO: 4727897 - DNA, 19 bp, Homo sapiens
acagcccacgtcctgtcag

SEQ ID NO: 4727898 - DNA, 20 bp, Homo sapiens
acagcccacgtcctgtcagt

SEQ ID NO: 4727899 - DNA, 16 bp, Homo sapiens
acagcccgggctctgc

SEQ ID NO: 4727900 - DNA, 17 bp, Homo sapiens
acagcccgggctctgcc

SEQ ID NO: 4727901 - DNA, 21 bp, Homo sapiens
acagcccgggctctgcctccc

SEQ ID NO: 4727902 - DNA, 14 bp, Homo sapiens
acagccctcccgcc

SEQ ID NO: 4727903 - DNA, 18 bp, Homo sapiens
acagccctcccgcccctt

SEQ ID NO: 4727904 - DNA, 19 bp, Homo sapiens
acagcctcccctgccaggg

SEQ ID NO: 4727905 - DNA, 22 bp, Homo sapiens
acagcctcccctgccagggcag

SEQ ID NO: 4727906 - DNA, 11 bp, Homo sapiens
acagcctgaga

SEQ ID NO: 4727907 - DNA, 20 bp, Homo sapiens
acagcgtgtcaactttcatt

SEQ ID NO: 4727908 - DNA, 17 bp, Homo sapiens
acagctaatagcatggt

SEQ ID NO: 4727909 - DNA, 15 bp, Homo sapiens
acagctaatgggaca

SEQ ID NO: 4727910 - DNA, 14 bp, Homo sapiens
acagctccttctgt

SEQ ID NO: 4727911 - DNA, 21 bp, Homo sapiens
aataaaccttgtttctttctg

SEQ ID NO: 4727912 - DNA, 14 bp, Homo sapiens
aataaatatagttg

SEQ ID NO: 4727913 - DNA, 13 bp, Homo sapiens
aataaatcacaca

SEQ ID NO: 4727914 - DNA, 15 bp, Homo sapiens
aataacaataaaaga

SEQ ID NO: 4727915 - DNA, 13 bp, Homo sapiens
aataacaatgtta

SEQ ID NO: 4727916 - DNA, 20 bp, Homo sapiens
aataacattaccttactgtg

SEQ ID NO: 4727917 - DNA, 12 bp, Homo sapiens
aataactttttt

SEQ ID NO: 4727918 - DNA, 21 bp, Homo sapiens
aataatcctaaacatatgaat

SEQ ID NO: 4727919 - DNA, 15 bp, Homo sapiens
aataatctatgatga

SEQ ID NO: 4727920 - DNA, 21 bp, Homo sapiens
aataatctcacaaaacatatt

SEQ ID NO: 4727921 - DNA, 19 bp, Homo sapiens
aataatgtatgtacagctg

SEQ ID NO: 4727922 - DNA, 11 bp, Homo sapiens
aataatgtctc

SEQ ID NO: 4727923 - DNA, 13 bp, Homo sapiens
aataatgtctctg

SEQ ID NO: 4727924 - DNA, 14 bp, Homo sapiens
aataatttcatact

SEQ ID NO: 4727925 - DNA, 23 bp, Homo sapiens
aataatttcatactgaaattatt

SEQ ID NO: 4727926 - DNA, 14 bp, Homo sapiens
aatacaaaaatttg

SEQ ID NO: 4727927 - DNA, 17 bp, Homo sapiens
aatacaaacacctggac

SEQ ID NO: 4727928 - DNA, 19 bp, Homo sapiens
aatacacttttttccaaag

SEQ ID NO: 4727929 - DNA, 20 bp, Homo sapiens
aatacagagtacgttaaaag

SEQ ID NO: 4727930 - DNA, 13 bp, Homo sapiens
aatacagatttgt

SEQ ID NO: 4727931 - DNA, 19 bp, Homo sapiens
aatacaggattattttgat

SEQ ID NO: 4727932 - DNA, 15 bp, Homo sapiens
aatacatgcatataa

SEQ ID NO: 4727933 - DNA, 13 bp, Homo sapiens
aatacattgtact

SEQ ID NO: 4727934 - DNA, 21 bp, Homo sapiens
aatacctgtccccctgacaac

SEQ ID NO: 4727935 - DNA, 18 bp, Homo sapiens
aatactccctttaaagag

SEQ ID NO: 4727936 - DNA, 19 bp, Homo sapiens
aatactccctttaaagaga

SEQ ID NO: 4727937 - DNA, 12 bp, Homo sapiens
aatactggactc

SEQ ID NO: 4727938 - DNA, 16 bp, Homo sapiens
aatactggactcagga

SEQ ID NO: 4727939 - DNA, 16 bp, Homo sapiens
aatactgtattttgta

SEQ ID NO: 4727940 - DNA, 12 bp, Homo sapiens
aatacttccaga

SEQ ID NO: 4727941 - DNA, 15 bp, Homo sapiens
aatacttccagaagt

SEQ ID NO: 4727942 - DNA, 20 bp, Homo sapiens
aatactttcgaaatttcatt

SEQ ID NO: 4727943 - DNA, 22 bp, Homo sapiens
aatactttgtttattgtaaaac

SEQ ID NO: 4727944 - DNA, 21 bp, Homo sapiens
aatagactgtaacttccaaat

SEQ ID NO: 4727945 - DNA, 18 bp, Homo sapiens
aatagatatgaaagctga

SEQ ID NO: 4727946 - DNA, 19 bp, Homo sapiens
aatagatatgaaagctgat

SEQ ID NO: 4727947 - DNA, 13 bp, Homo sapiens
aatagctgggact

SEQ ID NO: 4727948 - DNA, 20 bp, Homo sapiens
aataggagaggatgagagcc

SEQ ID NO: 4727949 - DNA, 13 bp, Homo sapiens
aatagtatatcta

SEQ ID NO: 4727950 - DNA, 18 bp, Homo sapiens
aatagtatgaaaatggaa

SEQ ID NO: 4727951 - DNA, 15 bp, Homo sapiens
aatagttaaaatgct

SEQ ID NO: 4727952 - DNA, 22 bp, Homo sapiens
aatatagtaggggttgaagaaa

SEQ ID NO: 4727953 - DNA, 23 bp, Homo sapiens
aatatagtaggggttgaagaaaa

SEQ ID NO: 4727954 - DNA, 21 bp, Homo sapiens
aatatatcttataaagtggaa

SEQ ID NO: 4727955 - DNA, 16 bp, Homo sapiens
aatatatgaacattag

SEQ ID NO: 4727956 - DNA, 22 bp, Homo sapiens
aatatattattcatcttttcat

SEQ ID NO: 4727957 - DNA, 13 bp, Homo sapiens
aatatatttaact

SEQ ID NO: 4727958 - DNA, 21 bp, Homo sapiens
aatatatttataaggaaattt

SEQ ID NO: 4727959 - DNA, 19 bp, Homo sapiens
aatatcagaatatgattca

SEQ ID NO: 4727960 - DNA, 21 bp, Homo sapiens
aatatcccttggacattttat

SEQ ID NO: 4727961 - DNA, 19 bp, Homo sapiens
aatatgaggcatttggcat

SEQ ID NO: 4727962 - DNA, 21 bp, Homo sapiens
aatatgattattaatcagaat

SEQ ID NO: 4727963 - DNA, 22 bp, Homo sapiens
aatatgcagtgatatggcagaa

SEQ ID NO: 4727964 - DNA, 18 bp, Homo sapiens
aatattaagaaacaattt

SEQ ID NO: 4727965 - DNA, 16 bp, Homo sapiens
aatattcattggttaa

SEQ ID NO: 4727966 - DNA, 12 bp, Homo sapiens
aatattccagag

SEQ ID NO: 4727967 - DNA, 17 bp, Homo sapiens
aatattccctagaaact

SEQ ID NO: 4727968 - DNA, 21 bp, Homo sapiens
aatattcctttgcatattata

SEQ ID NO: 4727969 - DNA, 22 bp, Homo sapiens
aatattctacacatatcttgtt

SEQ ID NO: 4727970 - DNA, 18 bp, Homo sapiens
aatattggtaattaaaag

SEQ ID NO: 4727971 - DNA, 13 bp, Homo sapiens
aatattggtttgt

SEQ ID NO: 4727972 - DNA, 10 bp, Homo sapiens
aatattgtaa

SEQ ID NO: 4727973 - DNA, 18 bp, Homo sapiens
aatattgtaaatactgga

SEQ ID NO: 4727974 - DNA, 21 bp, Homo sapiens
aatattgtaaatactggactc

SEQ ID NO: 4727975 - DNA, 13 bp, Homo sapiens
aatattgtacagt

SEQ ID NO: 4727976 - DNA, 23 bp, Homo sapiens
aatattgtacagtttttattgct

SEQ ID NO: 4727977 - DNA, 13 bp, Homo sapiens
aatattgtccatt

SEQ ID NO: 4727978 - DNA, 22 bp, Homo sapiens
aatcaatgctataactatgttg

SEQ ID NO: 4727979 - DNA, 18 bp, Homo sapiens
aatcagtgagtaaataga

SEQ ID NO: 4727980 - DNA, 20 bp, Homo sapiens
aatcagtgggttaattttgg

SEQ ID NO: 4727981 - DNA, 21 bp, Homo sapiens
aatcataaagtgcacaccttt

SEQ ID NO: 4727982 - DNA, 19 bp, Homo sapiens
aatcataacatagttgaaa

SEQ ID NO: 4727983 - DNA, 15 bp, Homo sapiens
aatcatcaagtcttt

SEQ ID NO: 4727984 - DNA, 14 bp, Homo sapiens
aatcattctgtaaa

SEQ ID NO: 4727985 - DNA, 17 bp, Homo sapiens
aatcattcttactaaaa

SEQ ID NO: 4727986 - DNA, 12 bp, Homo sapiens
aatcatttctat

SEQ ID NO: 4727987 - DNA, 19 bp, Homo sapiens
aatcatttctatttctcct

SEQ ID NO: 4727988 - DNA, 16 bp, Homo sapiens
aatccaaatgcattca

SEQ ID NO: 4727989 - DNA, 17 bp, Homo sapiens
aatccactcccaggcag

SEQ ID NO: 4727990 - DNA, 14 bp, Homo sapiens
aatccactccttcc

SEQ ID NO: 4727991 - DNA, 19 bp, Homo sapiens
aatcccaacatttctcttc

SEQ ID NO: 4727992 - DNA, 18 bp, Homo sapiens
aatcctgaataaaccagt

SEQ ID NO: 4727993 - DNA, 13 bp, Homo sapiens
aatctgacatatt

SEQ ID NO: 4727994 - DNA, 14 bp, Homo sapiens
aatctgacatatta

SEQ ID NO: 4727995 - DNA, 19 bp, Homo sapiens
aatctgctaccaaaacagt

SEQ ID NO: 4727996 - DNA, 20 bp, Homo sapiens
aatctgtgtaagaaaacaaa

SEQ ID NO: 4727997 - DNA, 15 bp, Homo sapiens
aatctgttgtttgaa

SEQ ID NO: 4727998 - DNA, 18 bp, Homo sapiens
aatcttacagctgggtgg

SEQ ID NO: 4727999 - DNA, 23 bp, Homo sapiens
aatcttacagctgggtggcactg

SEQ ID NO: 4728000 - DNA, 19 bp, Homo sapiens
aatcttataatttaaaata

SEQ ID NO: 4728001 - DNA, 17 bp, Homo sapiens
aatcttcacctcagagt

SEQ ID NO: 4728002 - DNA, 12 bp, Homo sapiens
aatcttcagctg

SEQ ID NO: 4728003 - DNA, 15 bp, Homo sapiens
aatcttcagctggtg

SEQ ID NO: 4728004 - DNA, 23 bp, Homo sapiens
aatcttcagctggtggatggtga

SEQ ID NO: 4728005 - DNA, 22 bp, Homo sapiens
aatcttgactacagtcaggaaa

SEQ ID NO: 4728006 - DNA, 16 bp, Homo sapiens
aatctttataaatgta

SEQ ID NO: 4728007 - DNA, 15 bp, Homo sapiens
aatcttttcacaaat

SEQ ID NO: 4728008 - DNA, 18 bp, Homo sapiens
aatcttttcacaaataaa

SEQ ID NO: 4728009 - DNA, 23 bp, Homo sapiens
aatcttttccaggaaaaagaact

SEQ ID NO: 4728010 - DNA, 16 bp, Homo sapiens
aatgaaaatgtcttgt

SEQ ID NO: 4728011 - DNA, 23 bp, Homo sapiens
aatgaaatatgttggggtttttt

SEQ ID NO: 4728012 - DNA, 11 bp, Homo sapiens
aatgaagaaag

SEQ ID NO: 4728013 - DNA, 16 bp, Homo sapiens
aatgaagggtcatttc

SEQ ID NO: 4728014 - DNA, 14 bp, Homo sapiens
aatgagactatgcg

SEQ ID NO: 4728015 - DNA, 17 bp, Homo sapiens
aatgagctacttcttat

SEQ ID NO: 4728016 - DNA, 19 bp, Homo sapiens
aatgaggaacaatcacaaa

SEQ ID NO: 4728017 - DNA, 22 bp, Homo sapiens
aatgaggaacaatcacaaaagc

SEQ ID NO: 4728018 - DNA, 19 bp, Homo sapiens
aatgaggaggtacattgaa

SEQ ID NO: 4728019 - DNA, 16 bp, Homo sapiens
aatgaggtcagagcct

SEQ ID NO: 4728020 - DNA, 14 bp, Homo sapiens
aatgagtatttggt

SEQ ID NO: 4728021 - DNA, 20 bp, Homo sapiens
aatgataatattgtggtgcc

SEQ ID NO: 4728022 - DNA, 15 bp, Homo sapiens
aatgatcaaattttg

SEQ ID NO: 4728023 - DNA, 19 bp, Homo sapiens
aatgatccccagctgttta

SEQ ID NO: 4728024 - DNA, 20 bp, Homo sapiens
aatgatctggtggttattta

SEQ ID NO: 4728025 - DNA, 21 bp, Homo sapiens
aatgatgtacaggcagatgaa

SEQ ID NO: 4728026 - DNA, 16 bp, Homo sapiens
aatgatttttgtgtat

SEQ ID NO: 4728027 - DNA, 17 bp, Homo sapiens
aatgatttttgtgtatc

SEQ ID NO: 4728028 - DNA, 16 bp, Homo sapiens
aatgcactttgttctg

SEQ ID NO: 4728029 - DNA, 14 bp, Homo sapiens
aatgcagcgtgaag

SEQ ID NO: 4728030 - DNA, 14 bp, Homo sapiens
aatgcatacaagtt

SEQ ID NO: 4728031 - DNA, 17 bp, Homo sapiens
aatgcatatttgcaaag

SEQ ID NO: 4728032 - DNA, 17 bp, Homo sapiens
aatgccatcctcaaaca

SEQ ID NO: 4728033 - DNA, 20 bp, Homo sapiens
aatgcccagccccttctgac

SEQ ID NO: 4728034 - DNA, 23 bp, Homo sapiens
aatgcccagccccttctgaccca

SEQ ID NO: 4728035 - DNA, 19 bp, Homo sapiens
aatgcctgagtgcctggcc

SEQ ID NO: 4728036 - DNA, 18 bp, Homo sapiens
aatgcctttgagacagtt

SEQ ID NO: 4728037 - DNA, 23 bp, Homo sapiens
aatgcctttgagacagtttctta

SEQ ID NO: 4728038 - DNA, 17 bp, Homo sapiens
aatgcctttttgtttac

SEQ ID NO: 4728039 - DNA, 15 bp, Homo sapiens
aatgcgcaggctggc

SEQ ID NO: 4728040 - DNA, 19 bp, Homo sapiens
aatgcgcaggctggccctg

SEQ ID NO: 4728041 - DNA, 20 bp, Homo sapiens
aatgcgtggcacatctaaat

SEQ ID NO: 4728042 - DNA, 20 bp, Homo sapiens
aatgctaaccttgtagcatg

SEQ ID NO: 4728043 - DNA, 23 bp, Homo sapiens
aatgctataactatgttgataaa

SEQ ID NO: 4728044 - DNA, 13 bp, Homo sapiens
aatgctctgatta

SEQ ID NO: 4728045 - DNA, 18 bp, Homo sapiens
aatgctggagaaaaatga

SEQ ID NO: 4728046 - DNA, 13 bp, Homo sapiens
aatggaagacaca

SEQ ID NO: 4728047 - DNA, 19 bp, Homo sapiens
aatggaggatctctaaaga

SEQ ID NO: 4728048 - DNA, 22 bp, Homo sapiens
aatggattggattatttaataa

SEQ ID NO: 4728049 - DNA, 23 bp, Homo sapiens
aatggcacaatctcggctcactg

SEQ ID NO: 4728050 - DNA, 17 bp, Homo sapiens
aatggcacagcccaaag

SEQ ID NO: 4728051 - DNA, 21 bp, Homo sapiens
aatggcttatccagctggtga

SEQ ID NO: 4728052 - DNA, 15 bp, Homo sapiens
aatgggcagagcaga

SEQ ID NO: 4728053 - DNA, 22 bp, Homo sapiens
aatggtacttaaacatttttgt

SEQ ID NO: 4728054 - DNA, 18 bp, Homo sapiens
aatggtagttagcaacta

SEQ ID NO: 4728055 - DNA, 15 bp, Homo sapiens
aatggtgaatgttca

SEQ ID NO: 4728056 - DNA, 10 bp, Homo sapiens
aatggtgcct

SEQ ID NO: 4728057 - DNA, 14 bp, Homo sapiens
aatggtttgaatat

SEQ ID NO: 4728058 - DNA, 18 bp, Homo sapiens
aatggtttgcaaggaagc

SEQ ID NO: 4728059 - DNA, 19 bp, Homo sapiens
aatggtttgcaaggaagcc

SEQ ID NO: 4728060 - DNA, 15 bp, Homo sapiens
aatgtacttatatta

SEQ ID NO: 4728061 - DNA, 23 bp, Homo sapiens
aatgtacttatattaagaaaaat

SEQ ID NO: 4728062 - DNA, 13 bp, Homo sapiens
aatgtagccatgg

SEQ ID NO: 4728063 - DNA, 22 bp, Homo sapiens
aatgtaggagactgtttggaaa

SEQ ID NO: 4728064 - DNA, 14 bp, Homo sapiens
aatgtatatgcact

SEQ ID NO: 4728065 - DNA, 21 bp, Homo sapiens
aatgtattttggttgctgatg

SEQ ID NO: 4728066 - DNA, 19 bp, Homo sapiens
aatgtcacaggcaggtcca

SEQ ID NO: 4728067 - DNA, 20 bp, Homo sapiens
aatgtcattatttgataaca

SEQ ID NO: 4728068 - DNA, 22 bp, Homo sapiens
aatgtcattatttgataacatt

SEQ ID NO: 4728069 - DNA, 16 bp, Homo sapiens
aatgtctgtaataata

SEQ ID NO: 4728070 - DNA, 17 bp, Homo sapiens
aatgtctgtaataatag

SEQ ID NO: 4728071 - DNA, 20 bp, Homo sapiens
aatgtcttgatgcatgcact

SEQ ID NO: 4728072 - DNA, 21 bp, Homo sapiens
aatgtgataatatattgctaa

SEQ ID NO: 4728073 - DNA, 23 bp, Homo sapiens
aatgtgataatatattgctaaaa

SEQ ID NO: 4728074 - DNA, 20 bp, Homo sapiens
aatgtgatgaatactgtatt

SEQ ID NO: 4728075 - DNA, 17 bp, Homo sapiens
aatgtgcaatagaaggt

SEQ ID NO: 4728076 - DNA, 14 bp, Homo sapiens
aatgtgggcagaga

SEQ ID NO: 4728077 - DNA, 16 bp, Homo sapiens
aatgtggtcctattta

SEQ ID NO: 4728078 - DNA, 10 bp, Homo sapiens
aatgtgtctg

SEQ ID NO: 4728079 - DNA, 20 bp, Homo sapiens
aatgtgtctgcaacatggat

SEQ ID NO: 4728080 - DNA, 11 bp, Homo sapiens
aatgtgtgtgt

SEQ ID NO: 4728081 - DNA, 12 bp, Homo sapiens
aatgttaaattt

SEQ ID NO: 4728082 - DNA, 13 bp, Homo sapiens
aatgttaaatttg

SEQ ID NO: 4728083 - DNA, 18 bp, Homo sapiens
aatgttaaatttgtaagt

SEQ ID NO: 4728084 - DNA, 21 bp, Homo sapiens
aatgttaaatttgtaagtttc

SEQ ID NO: 4728085 - DNA, 13 bp, Homo sapiens
aatgttctattta

SEQ ID NO: 4728086 - DNA, 15 bp, Homo sapiens
aatgttggtgcaatt

SEQ ID NO: 4728087 - DNA, 16 bp, Homo sapiens
aatgttggtgcaatta

SEQ ID NO: 4728088 - DNA, 17 bp, Homo sapiens
aatgttggtgcaattaa

SEQ ID NO: 4728089 - DNA, 23 bp, Homo sapiens
aatgttggtgcaattaactctgg

SEQ ID NO: 4728090 - DNA, 16 bp, Homo sapiens
aatgtttgcctctgcc

SEQ ID NO: 4728091 - DNA, 18 bp, Homo sapiens
aatgtttgcctctgcctc

SEQ ID NO: 4728092 - DNA, 19 bp, Homo sapiens
aatgtttgcctctgcctct

SEQ ID NO: 4728093 - DNA, 17 bp, Homo sapiens
aattaaattttgtgtct

SEQ ID NO: 4728094 - DNA, 18 bp, Homo sapiens
aattaaattttgtgtctc

SEQ ID NO: 4728095 - DNA, 22 bp, Homo sapiens
aattaagttagggaatggcaca

SEQ ID NO: 4728096 - DNA, 16 bp, Homo sapiens
aattaagtttgtgaat

SEQ ID NO: 4728097 - DNA, 16 bp, Homo sapiens
aattaatatgattatt

SEQ ID NO: 4728098 - DNA, 17 bp, Homo sapiens
aattaatttgtgaattt

SEQ ID NO: 4728099 - DNA, 18 bp, Homo sapiens
aattaatttgtgaatttg

SEQ ID NO: 4728100 - DNA, 17 bp, Homo sapiens
aattagtaacatgtgtt

SEQ ID NO: 4728101 - DNA, 20 bp, Homo sapiens
aattataactgtaaagatgt

SEQ ID NO: 4728102 - DNA, 19 bp, Homo sapiens
aattataccccctgcaaag

SEQ ID NO: 4728103 - DNA, 12 bp, Homo sapiens
aattatatttct

SEQ ID NO: 4728104 - DNA, 20 bp, Homo sapiens
aattatatttctacagagaa

SEQ ID NO: 4728105 - DNA, 23 bp, Homo sapiens
aattatgtttttcagtttaattc

SEQ ID NO: 4728106 - DNA, 15 bp, Homo sapiens
aattattcagtgaat

SEQ ID NO: 4728107 - DNA, 16 bp, Homo sapiens
aattattgtgatttcc

SEQ ID NO: 4728108 - DNA, 15 bp, Homo sapiens
aattatttaaatgta

SEQ ID NO: 4728109 - DNA, 18 bp, Homo sapiens
aattatttaaatgtactt

SEQ ID NO: 4728110 - DNA, 16 bp, Homo sapiens
aattatttaattgtcc

SEQ ID NO: 4728111 - DNA, 21 bp, Homo sapiens
aattatttattaaatgcccag

SEQ ID NO: 4728112 - DNA, 15 bp, Homo sapiens
aattattttgttact

SEQ ID NO: 4728113 - DNA, 19 bp, Homo sapiens
aattattttgttactgtct

SEQ ID NO: 4728114 - DNA, 21 bp, Homo sapiens
aattattttgttactgtctgt

SEQ ID NO: 4728115 - DNA, 22 bp, Homo sapiens
aattattttgttactgtctgta

SEQ ID NO: 4728116 - DNA, 12 bp, Homo sapiens
aattcaatgaaa

SEQ ID NO: 4728117 - DNA, 21 bp, Homo sapiens
aattcacatctaacctcatct

SEQ ID NO: 4728118 - DNA, 23 bp, Homo sapiens
aattcatcaaatggaagacacat

SEQ ID NO: 4728119 - DNA, 18 bp, Homo sapiens
aattccaagtgattgaaa

SEQ ID NO: 4728120 - DNA, 13 bp, Homo sapiens
aattccacagctg

SEQ ID NO: 4728121 - DNA, 12 bp, Homo sapiens
aattccccagat

SEQ ID NO: 4728122 - DNA, 20 bp, Homo sapiens
aattcgttgaaacgatttca

SEQ ID NO: 4728123 - DNA, 14 bp, Homo sapiens
aattctaacttttt

SEQ ID NO: 4728124 - DNA, 12 bp, Homo sapiens
aattctaattgt

SEQ ID NO: 4728125 - DNA, 14 bp, Homo sapiens
aattctaattgtca

SEQ ID NO: 4728126 - DNA, 22 bp, Homo sapiens
aattctagctttgagcttaaga

SEQ ID NO: 4728127 - DNA, 21 bp, Homo sapiens
aattctcatttgtcacacact

SEQ ID NO: 4728128 - DNA, 15 bp, Homo sapiens
aattctgtttaattt

SEQ ID NO: 4728129 - DNA, 12 bp, Homo sapiens
aattcttatttt

SEQ ID NO: 4728130 - DNA, 19 bp, Homo sapiens
aattcttattttagaaatt

SEQ ID NO: 4728131 - DNA, 18 bp, Homo sapiens
aattcttggttgaggaaa

SEQ ID NO: 4728132 - DNA, 20 bp, Homo sapiens
aattcttggttgaggaaaca

SEQ ID NO: 4728133 - DNA, 13 bp, Homo sapiens
aattctttaatga

SEQ ID NO: 4728134 - DNA, 12 bp, Homo sapiens
aattctttctat

SEQ ID NO: 4728135 - DNA, 15 bp, Homo sapiens
aattgaaagaactta

SEQ ID NO: 4728136 - DNA, 23 bp, Homo sapiens
aattgcaaaatgcgtatttgcat

SEQ ID NO: 4728137 - DNA, 22 bp, Homo sapiens
aattgccattttattaaacatt

SEQ ID NO: 4728138 - DNA, 23 bp, Homo sapiens
aattggaatcttcacctcagagt

SEQ ID NO: 4728139 - DNA, 22 bp, Homo sapiens
aattggatacgacaacttgcac

SEQ ID NO: 4728140 - DNA, 13 bp, Homo sapiens
aattggtcattcc

SEQ ID NO: 4728141 - DNA, 15 bp, Homo sapiens
aattgtatttatgta

SEQ ID NO: 4728142 - DNA, 15 bp, Homo sapiens
aattgtgtggattct

SEQ ID NO: 4728143 - DNA, 18 bp, Homo sapiens
aattgttctgggtgattt

SEQ ID NO: 4728144 - DNA, 14 bp, Homo sapiens
aattgttgacaaat

SEQ ID NO: 4728145 - DNA, 17 bp, Homo sapiens
aattgttgtttctttct

SEQ ID NO: 4728146 - DNA, 18 bp, Homo sapiens
aattgttgtttctttcta

SEQ ID NO: 4728147 - DNA, 21 bp, Homo sapiens
aattgttgtttctttctagtg

SEQ ID NO: 4728148 - DNA, 21 bp, Homo sapiens
aattgtttcagagtcacagtt

SEQ ID NO: 4728149 - DNA, 22 bp, Homo sapiens
aattgtttggggatgagaaagg

SEQ ID NO: 4728150 - DNA, 15 bp, Homo sapiens
aatttaaaaatatat

SEQ ID NO: 4728151 - DNA, 12 bp, Homo sapiens
aatttaaagcaa

SEQ ID NO: 4728152 - DNA, 18 bp, Homo sapiens
aatttaaccataaatcaa

SEQ ID NO: 4728153 - DNA, 20 bp, Homo sapiens
aatttaagcatgagtggcct

SEQ ID NO: 4728154 - DNA, 14 bp, Homo sapiens
aatttaagtgcgtg

SEQ ID NO: 4728155 - DNA, 16 bp, Homo sapiens
aatttaagtgcgtgtg

SEQ ID NO: 4728156 - DNA, 20 bp, Homo sapiens
aatttaagtgcgtgtgtaga

SEQ ID NO: 4728157 - DNA, 13 bp, Homo sapiens
aatttacttttta

SEQ ID NO: 4728158 - DNA, 15 bp, Homo sapiens
aatttagtcattatt

SEQ ID NO: 4728159 - DNA, 17 bp, Homo sapiens
aatttattttgtcgaat

SEQ ID NO: 4728160 - DNA, 15 bp, Homo sapiens
aatttcagtcaattc

SEQ ID NO: 4728161 - DNA, 22 bp, Homo sapiens
aatttcagtcaattctgatgtt

SEQ ID NO: 4728162 - DNA, 16 bp, Homo sapiens
aatttctactttgaag

SEQ ID NO: 4728163 - DNA, 23 bp, Homo sapiens
aatttctatgaaggatccatctt

SEQ ID NO: 4728164 - DNA, 13 bp, Homo sapiens
aatttctattaaa

SEQ ID NO: 4728165 - DNA, 12 bp, Homo sapiens
aatttctcccca

SEQ ID NO: 4728166 - DNA, 13 bp, Homo sapiens
aatttctccccag

SEQ ID NO: 4728167 - DNA, 19 bp, Homo sapiens
aatttctccccagggtgga

SEQ ID NO: 4728168 - DNA, 22 bp, Homo sapiens
aatttctgtgtctaaatttctt

SEQ ID NO: 4728169 - DNA, 13 bp, Homo sapiens
aatttcttcctat

SEQ ID NO: 4728170 - DNA, 22 bp, Homo sapiens
aatttgaagtattagacttcta

SEQ ID NO: 4728171 - DNA, 16 bp, Homo sapiens
aatttgctgaaaacat

SEQ ID NO: 4728172 - DNA, 16 bp, Homo sapiens
aatttgggagggtgag

SEQ ID NO: 4728173 - DNA, 13 bp, Homo sapiens
aatttgtaagttt

SEQ ID NO: 4728174 - DNA, 16 bp, Homo sapiens
aatttgtaagtttcag

SEQ ID NO: 4728175 - DNA, 12 bp, Homo sapiens
aatttgtgaatt

SEQ ID NO: 4728176 - DNA, 13 bp, Homo sapiens
aatttgtgaattt

SEQ ID NO: 4728177 - DNA, 16 bp, Homo sapiens
aatttgtgaatttgca

SEQ ID NO: 4728178 - DNA, 18 bp, Homo sapiens
aatttgttattttgcaac

SEQ ID NO: 4728179 - DNA, 18 bp, Homo sapiens
aatttgttgtcatgtgta

SEQ ID NO: 4728180 - DNA, 21 bp, Homo sapiens
aatttgttgtcatgtgtatga

SEQ ID NO: 4728181 - DNA, 16 bp, Homo sapiens
aattttaatgaagaaa

SEQ ID NO: 4728182 - DNA, 19 bp, Homo sapiens
aattttcattttgcactga

SEQ ID NO: 4728183 - DNA, 20 bp, Homo sapiens
aattttgtgatgaataaaat

SEQ ID NO: 4728184 - DNA, 21 bp, Homo sapiens
aattttgtgatgaataaaata

SEQ ID NO: 4728185 - DNA, 16 bp, Homo sapiens
aattttttaaaccact

SEQ ID NO: 4728186 - DNA, 17 bp, Homo sapiens
aattttttataaaagtg

SEQ ID NO: 4728187 - DNA, 20 bp, Homo sapiens
aattttttttcaaaaatgct

SEQ ID NO: 4728188 - DNA, 14 bp, Homo sapiens
acaaaaattaaaat

SEQ ID NO: 4728189 - DNA, 18 bp, Homo sapiens
acaaaacatattttacat

SEQ ID NO: 4728190 - DNA, 16 bp, Homo sapiens
acaaaagctgtgtctc

SEQ ID NO: 4728191 - DNA, 12 bp, Homo sapiens
acaaaaggcttt

SEQ ID NO: 4728192 - DNA, 18 bp, Homo sapiens
acaaaataaagtgtgtgt

SEQ ID NO: 4728193 - DNA, 22 bp, Homo sapiens
acaaaataaccaatcctggaca

SEQ ID NO: 4728194 - DNA, 21 bp, Homo sapiens
acaaaatgacattttgccaaa

SEQ ID NO: 4728195 - DNA, 21 bp, Homo sapiens
acaaaatgcctttttgtttac

SEQ ID NO: 4728196 - DNA, 14 bp, Homo sapiens
acaaaatttctatt

SEQ ID NO: 4728197 - DNA, 18 bp, Homo sapiens
acaaacaaaatttctatt

SEQ ID NO: 4728198 - DNA, 19 bp, Homo sapiens
acaaacaaaatttctatta

SEQ ID NO: 4728199 - DNA, 21 bp, Homo sapiens
acaaacagtgaatttaagcat

SEQ ID NO: 4728200 - DNA, 14 bp, Homo sapiens
acaaacatgaccct

SEQ ID NO: 4728201 - DNA, 14 bp, Homo sapiens
acaaacctgcctgg

SEQ ID NO: 4728202 - DNA, 11 bp, Homo sapiens
acaaaggcaag

SEQ ID NO: 4728203 - DNA, 18 bp, Homo sapiens
acaaagttaaaattgtta

SEQ ID NO: 4728204 - DNA, 14 bp, Homo sapiens
acaaataggtatgt

SEQ ID NO: 4728205 - DNA, 12 bp, Homo sapiens
acaacactcaca

SEQ ID NO: 4728206 - DNA, 22 bp, Homo sapiens
acaacatgtataatatttttaa

SEQ ID NO: 4728207 - DNA, 14 bp, Homo sapiens
acaaccaggtcttg

SEQ ID NO: 4728208 - DNA, 19 bp, Homo sapiens
acaactggaatagtttttt

SEQ ID NO: 4728209 - DNA, 24 bp, Homo sapiens
acaacttgcacgtattttaatagc

SEQ ID NO: 4728210 - DNA, 17 bp, Homo sapiens
acaagaaccatttgcaa

SEQ ID NO: 4728211 - DNA, 19 bp, Homo sapiens
acaagagcttaacagtgtg

SEQ ID NO: 4728212 - DNA, 15 bp, Homo sapiens
acaagcaagctccca

SEQ ID NO: 4728213 - DNA, 22 bp, Homo sapiens
acaagcaattagacaagaactt

SEQ ID NO: 4728214 - DNA, 12 bp, Homo sapiens
acaagccacccc

SEQ ID NO: 4728215 - DNA, 17 bp, Homo sapiens
acaagcgtgagccactg

SEQ ID NO: 4728216 - DNA, 21 bp, Homo sapiens
acaagcgtgagccactgcacc

SEQ ID NO: 4728217 - DNA, 12 bp, Homo sapiens
acaagctactta

SEQ ID NO: 4728218 - DNA, 16 bp, Homo sapiens
acaagctccaagctcc

SEQ ID NO: 4728219 - DNA, 17 bp, Homo sapiens
acaagctccaagctccc

SEQ ID NO: 4728220 - DNA, 22 bp, Homo sapiens
acaagctccaagctcccaggca

SEQ ID NO: 4728221 - DNA, 22 bp, Homo sapiens
acaagtgagttgttgccctggg

SEQ ID NO: 4728222 - DNA, 14 bp, Homo sapiens
acaagtgataatac

SEQ ID NO: 4728223 - DNA, 18 bp, Homo sapiens
acaagtgataatacagat

SEQ ID NO: 4728224 - DNA, 18 bp, Homo sapiens
acaagttaaggtatctgg

SEQ ID NO: 4728225 - DNA, 20 bp, Homo sapiens
acaagttaaggtatctggta

SEQ ID NO: 4728226 - DNA, 12 bp, Homo sapiens
acaataaaacat

SEQ ID NO: 4728227 - DNA, 16 bp, Homo sapiens
acaataaccttattct

SEQ ID NO: 4728228 - DNA, 15 bp, Homo sapiens
acaatcagtgtgaat

SEQ ID NO: 4728229 - DNA, 12 bp, Homo sapiens
acaatccaaatg

SEQ ID NO: 4728230 - DNA, 12 bp, Homo sapiens
acaatgaaattg

SEQ ID NO: 4728231 - DNA, 20 bp, Homo sapiens
acaatgcgtggcacatctaa

SEQ ID NO: 4728232 - DNA, 21 bp, Homo sapiens
acaatgcgtggcacatctaaa

SEQ ID NO: 4728233 - DNA, 19 bp, Homo sapiens
acaatgttaaggaaactct

SEQ ID NO: 4728234 - DNA, 21 bp, Homo sapiens
acaattacatctctaattttg

SEQ ID NO: 4728235 - DNA, 12 bp, Homo sapiens
acaattattaaa

SEQ ID NO: 4728236 - DNA, 14 bp, Homo sapiens
acaatttaaagcaa

SEQ ID NO: 4728237 - DNA, 15 bp, Homo sapiens
acaatttaaattgtt

SEQ ID NO: 4728238 - DNA, 16 bp, Homo sapiens
acacaaacctgcctgg

SEQ ID NO: 4728239 - DNA, 16 bp, Homo sapiens
acacaacatgtatgtg

SEQ ID NO: 4728240 - DNA, 14 bp, Homo sapiens
acacacacatacac

SEQ ID NO: 4728241 - DNA, 23 bp, Homo sapiens
acacacagatttgagctcagccc

SEQ ID NO: 4728242 - DNA, 12 bp, Homo sapiens
acacacagctct

SEQ ID NO: 4728243 - DNA, 13 bp, Homo sapiens
acacacatacaga

SEQ ID NO: 4728244 - DNA, 21 bp, Homo sapiens
acacagatgaaacacaaacaa

SEQ ID NO: 4728245 - DNA, 12 bp, Homo sapiens
catacacacacg

SEQ ID NO: 4728246 - DNA, 23 bp, Homo sapiens
catacagcacaatgttattacct

SEQ ID NO: 4728247 - DNA, 15 bp, Homo sapiens
catacataaaagaaa

SEQ ID NO: 4728248 - DNA, 20 bp, Homo sapiens
catacataaaagaaataaac

SEQ ID NO: 4728249 - DNA, 12 bp, Homo sapiens
cataccagtcag

SEQ ID NO: 4728250 - DNA, 12 bp, Homo sapiens
catacccacccc

SEQ ID NO: 4728251 - DNA, 15 bp, Homo sapiens
catactcccatctgt

SEQ ID NO: 4728252 - DNA, 18 bp, Homo sapiens
catactcccatctgtgaa

SEQ ID NO: 4728253 - DNA, 12 bp, Homo sapiens
catactggcctc

SEQ ID NO: 4728254 - DNA, 18 bp, Homo sapiens
catactggcctcgcctgg

SEQ ID NO: 4728255 - DNA, 19 bp, Homo sapiens
catactggcctcgcctggc

SEQ ID NO: 4728256 - DNA, 21 bp, Homo sapiens
catactggcctcgcctggcct

SEQ ID NO: 4728257 - DNA, 19 bp, Homo sapiens
catagagagcaagacgctg

SEQ ID NO: 4728258 - DNA, 22 bp, Homo sapiens
catagagatatttaaaagacaa

SEQ ID NO: 4728259 - DNA, 15 bp, Homo sapiens
catagctcctgctcc

SEQ ID NO: 4728260 - DNA, 20 bp, Homo sapiens
catagctcctgctccacagc

SEQ ID NO: 4728261 - DNA, 14 bp, Homo sapiens
catagctggttaac

SEQ ID NO: 4728262 - DNA, 16 bp, Homo sapiens
cataggaggggtctgg

SEQ ID NO: 4728263 - DNA, 13 bp, Homo sapiens
cataggcccagtg

SEQ ID NO: 4728264 - DNA, 16 bp, Homo sapiens
cataggtttaataatt

SEQ ID NO: 4728265 - DNA, 17 bp, Homo sapiens
catagtatggtggctgg

SEQ ID NO: 4728266 - DNA, 19 bp, Homo sapiens
catagtatggtggctgggt

SEQ ID NO: 4728267 - DNA, 22 bp, Homo sapiens
catagtttgctttgtttaagca

SEQ ID NO: 4728268 - DNA, 20 bp, Homo sapiens
catataagacaaatattcct

SEQ ID NO: 4728269 - DNA, 19 bp, Homo sapiens
catatcatttgtgaagaat

SEQ ID NO: 4728270 - DNA, 24 bp, Homo sapiens
catatctctagtccctgtgttctg

SEQ ID NO: 4728271 - DNA, 22 bp, Homo sapiens
catatgacattcatgcctggct

SEQ ID NO: 4728272 - DNA, 19 bp, Homo sapiens
catatgcatgcccttcctt

SEQ ID NO: 4728273 - DNA, 15 bp, Homo sapiens
catattatgcctgaa

SEQ ID NO: 4728274 - DNA, 17 bp, Homo sapiens
catattctgttggccag

SEQ ID NO: 4728275 - DNA, 11 bp, Homo sapiens
catatttaaga

SEQ ID NO: 4728276 - DNA, 12 bp, Homo sapiens
catatttcaatt

SEQ ID NO: 4728277 - DNA, 13 bp, Homo sapiens
catattttacatc

SEQ ID NO: 4728278 - DNA, 20 bp, Homo sapiens
catattttgccactgccttt

SEQ ID NO: 4728279 - DNA, 21 bp, Homo sapiens
catcaaaaagaaaaatcaaag

SEQ ID NO: 4728280 - DNA, 13 bp, Homo sapiens
catcaaacatgaa

SEQ ID NO: 4728281 - DNA, 14 bp, Homo sapiens
catcaaacatgaaa

SEQ ID NO: 4728282 - DNA, 22 bp, Homo sapiens
catcaaacatgaaaacattgat

SEQ ID NO: 4728283 - DNA, 15 bp, Homo sapiens
catcaacaaaaattg

SEQ ID NO: 4728284 - DNA, 15 bp, Homo sapiens
catcacatcatgctg

SEQ ID NO: 4728285 - DNA, 15 bp, Homo sapiens
catcaccaacgtctg

SEQ ID NO: 4728286 - DNA, 12 bp, Homo sapiens
catcacccgcta

SEQ ID NO: 4728287 - DNA, 14 bp, Homo sapiens
catcacctccacca

SEQ ID NO: 4728288 - DNA, 14 bp, Homo sapiens
catcactcccctcc

SEQ ID NO: 4728289 - DNA, 15 bp, Homo sapiens
catcactcccctcca

SEQ ID NO: 4728290 - DNA, 19 bp, Homo sapiens
catcactgtatccattcta

SEQ ID NO: 4728291 - DNA, 15 bp, Homo sapiens
catcactttgaccta

SEQ ID NO: 4728292 - DNA, 19 bp, Homo sapiens
catcagaaacaccctcaca

SEQ ID NO: 4728293 - DNA, 19 bp, Homo sapiens
catcaggagaaaaagcctc

SEQ ID NO: 4728294 - DNA, 15 bp, Homo sapiens
catcaggccaggccc

SEQ ID NO: 4728295 - DNA, 22 bp, Homo sapiens
catcaggccaggccctctgccc

SEQ ID NO: 4728296 - DNA, 17 bp, Homo sapiens
catcagtgccagcccct

SEQ ID NO: 4728297 - DNA, 13 bp, Homo sapiens
catcatcaaggca

SEQ ID NO: 4728298 - DNA, 12 bp, Homo sapiens
catcatgtagaa

SEQ ID NO: 4728299 - DNA, 14 bp, Homo sapiens
catcattctctgtc

SEQ ID NO: 4728300 - DNA, 15 bp, Homo sapiens
catcattctctgtct

SEQ ID NO: 4728301 - DNA, 24 bp, Homo sapiens
catcattctctgtctcatccatca

SEQ ID NO: 4728302 - DNA, 14 bp, Homo sapiens
catcatttcctggg

SEQ ID NO: 4728303 - DNA, 15 bp, Homo sapiens
catccacctccttct

SEQ ID NO: 4728304 - DNA, 17 bp, Homo sapiens
catccactgtgccatgt

SEQ ID NO: 4728305 - DNA, 19 bp, Homo sapiens
catccagggctctgaccag

SEQ ID NO: 4728306 - DNA, 15 bp, Homo sapiens
catccaggttcagct

SEQ ID NO: 4728307 - DNA, 14 bp, Homo sapiens
catccatcatcatg

SEQ ID NO: 4728308 - DNA, 23 bp, Homo sapiens
catcccatgtagaaaaataaaga

SEQ ID NO: 4728309 - DNA, 12 bp, Homo sapiens
catcccccctca

SEQ ID NO: 4728310 - DNA, 13 bp, Homo sapiens
catcccccctcac

SEQ ID NO: 4728311 - DNA, 18 bp, Homo sapiens
catcccccctcaccaggg

SEQ ID NO: 4728312 - DNA, 17 bp, Homo sapiens
catcccgagcacctcca

SEQ ID NO: 4728313 - DNA, 16 bp, Homo sapiens
catcccggtgcatgca

SEQ ID NO: 4728314 - DNA, 18 bp, Homo sapiens
catccctaatgctgcaga

SEQ ID NO: 4728315 - DNA, 14 bp, Homo sapiens
catccctccctgcc

SEQ ID NO: 4728316 - DNA, 19 bp, Homo sapiens
catccctgaaggccccgcc

SEQ ID NO: 4728317 - DNA, 19 bp, Homo sapiens
catcccttgaccaggcctg

SEQ ID NO: 4728318 - DNA, 21 bp, Homo sapiens
catcctaactccatgtctctg

SEQ ID NO: 4728319 - DNA, 16 bp, Homo sapiens
catcctacaagacaca

SEQ ID NO: 4728320 - DNA, 19 bp, Homo sapiens
catcctcaaacactgcagg

SEQ ID NO: 4728321 - DNA, 22 bp, Homo sapiens
catcctcaaacactgcaggcat

SEQ ID NO: 4728322 - DNA, 15 bp, Homo sapiens
catcctcatacccac

SEQ ID NO: 4728323 - DNA, 21 bp, Homo sapiens
catcctcatacccacccccac

SEQ ID NO: 4728324 - DNA, 20 bp, Homo sapiens
catcctccgcctcccgggtt

SEQ ID NO: 4728325 - DNA, 11 bp, Homo sapiens
catcctgactt

SEQ ID NO: 4728326 - DNA, 14 bp, Homo sapiens
catcctggcccatc

SEQ ID NO: 4728327 - DNA, 19 bp, Homo sapiens
catcctggcccatcagtgt

SEQ ID NO: 4728328 - DNA, 15 bp, Homo sapiens
catcctgtcccacca

SEQ ID NO: 4728329 - DNA, 17 bp, Homo sapiens
catccttacaatgtaaa

SEQ ID NO: 4728330 - DNA, 15 bp, Homo sapiens
catctaacctcatct

SEQ ID NO: 4728331 - DNA, 18 bp, Homo sapiens
catctaacctcatcttct

SEQ ID NO: 4728332 - DNA, 19 bp, Homo sapiens
catctaacctcatcttctt

SEQ ID NO: 4728333 - DNA, 22 bp, Homo sapiens
catctacgtatggctccacacc

SEQ ID NO: 4728334 - DNA, 19 bp, Homo sapiens
catctagagcttgatgcca

SEQ ID NO: 4728335 - DNA, 23 bp, Homo sapiens
catctattttaccatatgtttat

SEQ ID NO: 4728336 - DNA, 16 bp, Homo sapiens
catctcacacatgagc

SEQ ID NO: 4728337 - DNA, 17 bp, Homo sapiens
catctcacacatgagca

SEQ ID NO: 4728338 - DNA, 21 bp, Homo sapiens
catctccagcattctcagcca

SEQ ID NO: 4728339 - DNA, 22 bp, Homo sapiens
catctccagcattctcagccac

SEQ ID NO: 4728340 - DNA, 17 bp, Homo sapiens
catctcccagataatgt

SEQ ID NO: 4728341 - DNA, 14 bp, Homo sapiens
catctctaattttg

SEQ ID NO: 4728342 - DNA, 15 bp, Homo sapiens
catctctaattttgg

SEQ ID NO: 4728343 - DNA, 16 bp, Homo sapiens
catctctaattttgga

SEQ ID NO: 4728344 - DNA, 14 bp, Homo sapiens
catctctctttaat

SEQ ID NO: 4728345 - DNA, 23 bp, Homo sapiens
catctcttagctcccctccaacc

SEQ ID NO: 4728346 - DNA, 18 bp, Homo sapiens
catctgcagcctcctctg

SEQ ID NO: 4728347 - DNA, 11 bp, Homo sapiens
catctgcccag

SEQ ID NO: 4728348 - DNA, 13 bp, Homo sapiens
catctgcccagga

SEQ ID NO: 4728349 - DNA, 16 bp, Homo sapiens
catctgcgtgacaata

SEQ ID NO: 4728350 - DNA, 19 bp, Homo sapiens
catctgcgtgacaataaaa

SEQ ID NO: 4728351 - DNA, 23 bp, Homo sapiens
catctgcgtgacaataaaacatt

SEQ ID NO: 4728352 - DNA, 15 bp, Homo sapiens
catctgctctccttc

SEQ ID NO: 4728353 - DNA, 19 bp, Homo sapiens
catctggaaccatcagaaa

SEQ ID NO: 4728354 - DNA, 16 bp, Homo sapiens
catctgtccctccggg

SEQ ID NO: 4728355 - DNA, 17 bp, Homo sapiens
catctgtccctgcctca

SEQ ID NO: 4728356 - DNA, 14 bp, Homo sapiens
catcttccaggtgg

SEQ ID NO: 4728357 - DNA, 21 bp, Homo sapiens
catcttccaggtggggtgagg

SEQ ID NO: 4728358 - DNA, 22 bp, Homo sapiens
catcttccctggcgtcctctcc

SEQ ID NO: 4728359 - DNA, 19 bp, Homo sapiens
catcttcttcaccatttgg

SEQ ID NO: 4728360 - DNA, 17 bp, Homo sapiens
catcttgctctgctgac

SEQ ID NO: 4728361 - DNA, 12 bp, Homo sapiens
catctttgctga

SEQ ID NO: 4728362 - DNA, 23 bp, Homo sapiens
catctttgctgaatgtcattatt

SEQ ID NO: 4728363 - DNA, 13 bp, Homo sapiens
catgaaaatgcaa

SEQ ID NO: 4728364 - DNA, 14 bp, Homo sapiens
catgaaaatttgtt

SEQ ID NO: 4728365 - DNA, 17 bp, Homo sapiens
catgaaaatttgtttga

SEQ ID NO: 4728366 - DNA, 18 bp, Homo sapiens
catgaaataaaatatatc

SEQ ID NO: 4728367 - DNA, 14 bp, Homo sapiens
catgaagaagctgg

SEQ ID NO: 4728368 - DNA, 15 bp, Homo sapiens
catgaaggtttctga

SEQ ID NO: 4728369 - DNA, 14 bp, Homo sapiens
catgacagcctcca

SEQ ID NO: 4728370 - DNA, 15 bp, Homo sapiens
catgaccacatagaa

SEQ ID NO: 4728371 - DNA, 13 bp, Homo sapiens
catgacccaggct

SEQ ID NO: 4728372 - DNA, 16 bp, Homo sapiens
catgacccaggctggg

SEQ ID NO: 4728373 - DNA, 15 bp, Homo sapiens
catgagcatcaggcc

SEQ ID NO: 4728374 - DNA, 23 bp, Homo sapiens
catgagcatcaggccaggccctc

SEQ ID NO: 4728375 - DNA, 23 bp, Homo sapiens
catgagcctcagcatcctggcac

SEQ ID NO: 4728376 - DNA, 14 bp, Homo sapiens
catgagtgcgtgct

SEQ ID NO: 4728377 - DNA, 17 bp, Homo sapiens
catgagttattcataaa

SEQ ID NO: 4728378 - DNA, 16 bp, Homo sapiens
catgatgctgggattt

SEQ ID NO: 4728379 - DNA, 13 bp, Homo sapiens
catgatgttttcc

SEQ ID NO: 4728380 - DNA, 16 bp, Homo sapiens
catgcacgtgtgtgca

SEQ ID NO: 4728381 - DNA, 23 bp, Homo sapiens
catgcactgttccccctgtgcag

SEQ ID NO: 4728382 - DNA, 19 bp, Homo sapiens
catgcagacatgagtgcgt

SEQ ID NO: 4728383 - DNA, 18 bp, Homo sapiens
catgcaggtctccatgaa

SEQ ID NO: 4728384 - DNA, 12 bp, Homo sapiens
catgcataaata

SEQ ID NO: 4728385 - DNA, 16 bp, Homo sapiens
catgcataaatatgca

SEQ ID NO: 4728386 - DNA, 19 bp, Homo sapiens
catgcataaatatgcagtg

SEQ ID NO: 4728387 - DNA, 22 bp, Homo sapiens
catgcataaatatgcagtgata

SEQ ID NO: 4728388 - DNA, 17 bp, Homo sapiens
catgcatggaaattccc

SEQ ID NO: 4728389 - DNA, 19 bp, Homo sapiens
catgcattttcttgtatga

SEQ ID NO: 4728390 - DNA, 15 bp, Homo sapiens
catgccccctcgtgc

SEQ ID NO: 4728391 - DNA, 17 bp, Homo sapiens
catgccccctcgtgcca

SEQ ID NO: 4728392 - DNA, 10 bp, Homo sapiens
catgcctgca

SEQ ID NO: 4728393 - DNA, 14 bp, Homo sapiens
catgcggagaacaa

SEQ ID NO: 4728394 - DNA, 16 bp, Homo sapiens
catgcggagaacaaat

SEQ ID NO: 4728395 - DNA, 20 bp, Homo sapiens
catgctgaagccaaagccaa

SEQ ID NO: 4728396 - DNA, 17 bp, Homo sapiens
catgctgagagctgggc

SEQ ID NO: 4728397 - DNA, 12 bp, Homo sapiens
catgctgccctg

SEQ ID NO: 4728398 - DNA, 16 bp, Homo sapiens
catgctgccctgtgag

SEQ ID NO: 4728399 - DNA, 18 bp, Homo sapiens
catgctgccctgtgagta

SEQ ID NO: 4728400 - DNA, 14 bp, Homo sapiens
catgctgtgtgact

SEQ ID NO: 4728401 - DNA, 22 bp, Homo sapiens
catgctgtgtgactcaaaccaa

SEQ ID NO: 4728402 - DNA, 14 bp, Homo sapiens
catggacaatggac

SEQ ID NO: 4728403 - DNA, 17 bp, Homo sapiens
catggacaatggaccgg

SEQ ID NO: 4728404 - DNA, 13 bp, Homo sapiens
catggagagctgg

SEQ ID NO: 4728405 - DNA, 17 bp, Homo sapiens
catggagagctggagcc

SEQ ID NO: 4728406 - DNA, 14 bp, Homo sapiens
catggagctggccg

SEQ ID NO: 4728407 - DNA, 12 bp, Homo sapiens
catggaggagac

SEQ ID NO: 4728408 - DNA, 17 bp, Homo sapiens
catggaggagacaggaa

SEQ ID NO: 4728409 - DNA, 21 bp, Homo sapiens
catggagggtttagtgcttat

SEQ ID NO: 4728410 - DNA, 22 bp, Homo sapiens
catggagtgagacccaggagcc

SEQ ID NO: 4728411 - DNA, 21 bp, Homo sapiens
catggagtgtttgacgaagaa

SEQ ID NO: 4728412 - DNA, 18 bp, Homo sapiens
catggattccaaagcatt

SEQ ID NO: 4728413 - DNA, 13 bp, Homo sapiens
catggcagaaggc

SEQ ID NO: 4728414 - DNA, 17 bp, Homo sapiens
catggcatccctttttc

SEQ ID NO: 4728415 - DNA, 23 bp, Homo sapiens
catggcatccctttttcataaat

SEQ ID NO: 4728416 - DNA, 16 bp, Homo sapiens
catggcccctgtgagt

SEQ ID NO: 4728417 - DNA, 14 bp, Homo sapiens
catggccctcccag

SEQ ID NO: 4728418 - DNA, 15 bp, Homo sapiens
catggccctgctgcc

SEQ ID NO: 4728419 - DNA, 16 bp, Homo sapiens
catggccctgctgccc

SEQ ID NO: 4728420 - DNA, 21 bp, Homo sapiens
catggccctgctgcccctccc

SEQ ID NO: 4728421 - DNA, 16 bp, Homo sapiens
catggctggtgcctga

SEQ ID NO: 4728422 - DNA, 18 bp, Homo sapiens
catgggaaaggggaagtt

SEQ ID NO: 4728423 - DNA, 14 bp, Homo sapiens
catgggcactgctg

SEQ ID NO: 4728424 - DNA, 18 bp, Homo sapiens
catgggcactgctgggtg

SEQ ID NO: 4728425 - DNA, 23 bp, Homo sapiens
catgggcactgctgggtggccca

SEQ ID NO: 4728426 - DNA, 16 bp, Homo sapiens
catgggcctcctgtgt

SEQ ID NO: 4728427 - DNA, 19 bp, Homo sapiens
catggggaggaggagggtc

SEQ ID NO: 4728428 - DNA, 19 bp, Homo sapiens
catgggggagggggcagaa

SEQ ID NO: 4728429 - DNA, 21 bp, Homo sapiens
catgggggagggggcagaagt

SEQ ID NO: 4728430 - DNA, 13 bp, Homo sapiens
catgggtcgggag

SEQ ID NO: 4728431 - DNA, 14 bp, Homo sapiens
catgggtcgggaga

SEQ ID NO: 4728432 - DNA, 23 bp, Homo sapiens
catgggtcgggagaggggacgca

SEQ ID NO: 4728433 - DNA, 11 bp, Homo sapiens
catggtcctag

SEQ ID NO: 4728434 - DNA, 21 bp, Homo sapiens
catggtgggtccatgggcaga

SEQ ID NO: 4728435 - DNA, 15 bp, Homo sapiens
catggtgtaataaga

SEQ ID NO: 4728436 - DNA, 15 bp, Homo sapiens
catggtgtgtgtctc

SEQ ID NO: 4728437 - DNA, 23 bp, Homo sapiens
catggttccaattttttttaagt

SEQ ID NO: 4728438 - DNA, 18 bp, Homo sapiens
catgtaaaatcttcagct

SEQ ID NO: 4728439 - DNA, 19 bp, Homo sapiens
catgtacctaatccaaata

SEQ ID NO: 4728440 - DNA, 21 bp, Homo sapiens
catgtactgttactgtgtcag

SEQ ID NO: 4728441 - DNA, 15 bp, Homo sapiens
catgtagaagctgca

SEQ ID NO: 4728442 - DNA, 19 bp, Homo sapiens
catgtagaagctgcatctt

SEQ ID NO: 4728443 - DNA, 18 bp, Homo sapiens
catgtaggaagtaggaag

SEQ ID NO: 4728444 - DNA, 20 bp, Homo sapiens
catgtataatatttttaatt

SEQ ID NO: 4728445 - DNA, 16 bp, Homo sapiens
catgtatgtggataca

SEQ ID NO: 4728446 - DNA, 22 bp, Homo sapiens
catgtatgtggatacagtcatt

SEQ ID NO: 4728447 - DNA, 20 bp, Homo sapiens
catgtattagccagtcattg

SEQ ID NO: 4728448 - DNA, 15 bp, Homo sapiens
catgtcatttctcat

SEQ ID NO: 4728449 - DNA, 20 bp, Homo sapiens
catgtccaagaagcccagga

SEQ ID NO: 4728450 - DNA, 14 bp, Homo sapiens
catgtgaaaccttt

SEQ ID NO: 4728451 - DNA, 21 bp, Homo sapiens
catgtgaaaccttttttaaga

SEQ ID NO: 4728452 - DNA, 20 bp, Homo sapiens
catgtgcaactcttgtattg

SEQ ID NO: 4728453 - DNA, 15 bp, Homo sapiens
catgtggagaaggtg

SEQ ID NO: 4728454 - DNA, 22 bp, Homo sapiens
catgtggccctccagtgtatga

SEQ ID NO: 4728455 - DNA, 22 bp, Homo sapiens
catgtggttaatgccatggaca

SEQ ID NO: 4728456 - DNA, 17 bp, Homo sapiens
catgtgtgctcttcttc

SEQ ID NO: 4728457 - DNA, 18 bp, Homo sapiens
catgtgtgctcttcttct

SEQ ID NO: 4728458 - DNA, 12 bp, Homo sapiens
catgtgtgtcca

SEQ ID NO: 4728459 - DNA, 16 bp, Homo sapiens
catgtgttaagtattt

SEQ ID NO: 4728460 - DNA, 20 bp, Homo sapiens
catgttcctggacaccaccc

SEQ ID NO: 4728461 - DNA, 18 bp, Homo sapiens
catgttctgtcccttgcc

SEQ ID NO: 4728462 - DNA, 16 bp, Homo sapiens
catgttggccaggctg

SEQ ID NO: 4728463 - DNA, 18 bp, Homo sapiens
catgttggccaggctggt

SEQ ID NO: 4728464 - DNA, 18 bp, Homo sapiens
catgttttaaagcttgct

SEQ ID NO: 4728465 - DNA, 21 bp, Homo sapiens
catgttttctgaaaatataac

SEQ ID NO: 4728466 - DNA, 20 bp, Homo sapiens
catgttttgagacataaatg

SEQ ID NO: 4728467 - DNA, 16 bp, Homo sapiens
cattaaggcagtatga

SEQ ID NO: 4728468 - DNA, 16 bp, Homo sapiens
cattaattcaatgaaa

SEQ ID NO: 4728469 - DNA, 21 bp, Homo sapiens
cattactttaccacccccaca

SEQ ID NO: 4728470 - DNA, 23 bp, Homo sapiens
cattagagcaggcgttcagctca

SEQ ID NO: 4728471 - DNA, 17 bp, Homo sapiens
cattagattatcaaaaa

SEQ ID NO: 4728472 - DNA, 14 bp, Homo sapiens
cattagcagttgct

SEQ ID NO: 4728473 - DNA, 15 bp, Homo sapiens
cattagcataatttt

SEQ ID NO: 4728474 - DNA, 16 bp, Homo sapiens
cattagcataattttg

SEQ ID NO: 4728475 - DNA, 13 bp, Homo sapiens
cattagttttgaa

SEQ ID NO: 4728476 - DNA, 15 bp, Homo sapiens
cattagttttgaaga

SEQ ID NO: 4728477 - DNA, 19 bp, Homo sapiens
cattataaaataagaaaaa

SEQ ID NO: 4728478 - DNA, 15 bp, Homo sapiens
cattatgtaaaagaa

SEQ ID NO: 4728479 - DNA, 16 bp, Homo sapiens
cattatgtaaaagaaa

SEQ ID NO: 4728480 - DNA, 16 bp, Homo sapiens
cattatgttaatattt

SEQ ID NO: 4728481 - DNA, 13 bp, Homo sapiens
cattatttgataa

SEQ ID NO: 4728482 - DNA, 13 bp, Homo sapiens
cattcacatttca

SEQ ID NO: 4728483 - DNA, 16 bp, Homo sapiens
cattcatgttttaaaa

SEQ ID NO: 4728484 - DNA, 12 bp, Homo sapiens
cattccatcctt

SEQ ID NO: 4728485 - DNA, 14 bp, Homo sapiens
cattccattctgga

SEQ ID NO: 4728486 - DNA, 19 bp, Homo sapiens
cattccccaggaggccagc

SEQ ID NO: 4728487 - DNA, 20 bp, Homo sapiens
cattccccaggaggccagcc

SEQ ID NO: 4728488 - DNA, 16 bp, Homo sapiens
cattcctgatgcttct

SEQ ID NO: 4728489 - DNA, 16 bp, Homo sapiens
cattccttctttgata

SEQ ID NO: 4728490 - DNA, 18 bp, Homo sapiens
cattccttctttgataat

SEQ ID NO: 4728491 - DNA, 17 bp, Homo sapiens
cattctccacctgccag

SEQ ID NO: 4728492 - DNA, 19 bp, Homo sapiens
cattctccacctgccaggg

SEQ ID NO: 4728493 - DNA, 15 bp, Homo sapiens
cattctgcctgccca

SEQ ID NO: 4728494 - DNA, 17 bp, Homo sapiens
cattctgcctgcccagg

SEQ ID NO: 4728495 - DNA, 20 bp, Homo sapiens
cattctgcctgcccaggccc

SEQ ID NO: 4728496 - DNA, 15 bp, Homo sapiens
cattctgggctggga

SEQ ID NO: 4728497 - DNA, 16 bp, Homo sapiens
cattctgggctgggaa

SEQ ID NO: 4728498 - DNA, 12 bp, Homo sapiens
cattcttactaa

SEQ ID NO: 4728499 - DNA, 19 bp, Homo sapiens
cattcttactaaaaagtat

SEQ ID NO: 4728500 - DNA, 22 bp, Homo sapiens
cattcttactaaaaagtataaa

SEQ ID NO: 4728501 - DNA, 17 bp, Homo sapiens
cattcttggttggctgg

SEQ ID NO: 4728502 - DNA, 17 bp, Homo sapiens
cattctttcttggtgca

SEQ ID NO: 4728503 - DNA, 13 bp, Homo sapiens
cattctttttgaa

SEQ ID NO: 4728504 - DNA, 14 bp, Homo sapiens
cattctttttgaaa

SEQ ID NO: 4728505 - DNA, 21 bp, Homo sapiens
cattgaattcttggttgagga

SEQ ID NO: 4728506 - DNA, 20 bp, Homo sapiens
cattgaatttagtcattatt

SEQ ID NO: 4728507 - DNA, 14 bp, Homo sapiens
cattgacctgaggc

SEQ ID NO: 4728508 - DNA, 18 bp, Homo sapiens
cattgacctgaggccctt

SEQ ID NO: 4728509 - DNA, 15 bp, Homo sapiens
cattgaggaaatatt

SEQ ID NO: 4728510 - DNA, 19 bp, Homo sapiens
cattgaggaaatattaatt

SEQ ID NO: 4728511 - DNA, 15 bp, Homo sapiens
cattgccccatgaga

SEQ ID NO: 4728512 - DNA, 21 bp, Homo sapiens
cattgcggacagccacggcca

SEQ ID NO: 4728513 - DNA, 13 bp, Homo sapiens
cattgctttctaa

SEQ ID NO: 4728514 - DNA, 14 bp, Homo sapiens
cattggatttttgt

SEQ ID NO: 4728515 - DNA, 22 bp, Homo sapiens
cattggatttttgttaattttc

SEQ ID NO: 4728516 - DNA, 17 bp, Homo sapiens
cattggcagcaggtgct

SEQ ID NO: 4728517 - DNA, 20 bp, Homo sapiens
cattggcagcaggtgctgct

SEQ ID NO: 4728518 - DNA, 21 bp, Homo sapiens
cattggcagcaggtgctgcta

SEQ ID NO: 4728519 - DNA, 21 bp, Homo sapiens
cattgtaaatctgaagaaagt

SEQ ID NO: 4728520 - DNA, 22 bp, Homo sapiens
cattgtaacctcgtgtctagta

SEQ ID NO: 4728521 - DNA, 14 bp, Homo sapiens
cattgtatatgtga

SEQ ID NO: 4728522 - DNA, 18 bp, Homo sapiens
cattgtcaaaattaatat

SEQ ID NO: 4728523 - DNA, 21 bp, Homo sapiens
cattgtcaaaattaatatgat

SEQ ID NO: 4728524 - DNA, 11 bp, Homo sapiens
cattgtcttta

SEQ ID NO: 4728525 - DNA, 17 bp, Homo sapiens
cattgttggccaaagcc

SEQ ID NO: 4728526 - DNA, 23 bp, Homo sapiens
catttaaagttgtataaaaacat

SEQ ID NO: 4728527 - DNA, 20 bp, Homo sapiens
catttaaatacagtcttcca

SEQ ID NO: 4728528 - DNA, 23 bp, Homo sapiens
catttaagagacagtcaccccag

SEQ ID NO: 4728529 - DNA, 20 bp, Homo sapiens
catttaatgtagccatggga

SEQ ID NO: 4728530 - DNA, 24 bp, Homo sapiens
catttaatgtagccatgggaccaa

SEQ ID NO: 4728531 - DNA, 17 bp, Homo sapiens
catttactttgtgttca

SEQ ID NO: 4728532 - DNA, 18 bp, Homo sapiens
catttagagtttcacaga

SEQ ID NO: 4728533 - DNA, 13 bp, Homo sapiens
catttaggagaag

SEQ ID NO: 4728534 - DNA, 15 bp, Homo sapiens
catttattctgctca

SEQ ID NO: 4728535 - DNA, 13 bp, Homo sapiens
catttcacccctc

SEQ ID NO: 4728536 - DNA, 15 bp, Homo sapiens
catttcacccctccc

SEQ ID NO: 4728537 - DNA, 17 bp, Homo sapiens
catttcacccctccctt

SEQ ID NO: 4728538 - DNA, 21 bp, Homo sapiens
catttcacccctccctttctc

SEQ ID NO: 4728539 - DNA, 15 bp, Homo sapiens
catttcaggagcagc

SEQ ID NO: 4728540 - DNA, 17 bp, Homo sapiens
catttcctgggagaaag

SEQ ID NO: 4728541 - DNA, 16 bp, Homo sapiens
catttcgtgtaatatt

SEQ ID NO: 4728542 - DNA, 19 bp, Homo sapiens
catttctatttctcctcca

SEQ ID NO: 4728543 - DNA, 16 bp, Homo sapiens
catttctcatgttgaa

SEQ ID NO: 4728544 - DNA, 15 bp, Homo sapiens
catttctctaagaga

SEQ ID NO: 4728545 - DNA, 17 bp, Homo sapiens
catttgagcagggctca

SEQ ID NO: 4728546 - DNA, 20 bp, Homo sapiens
catttgagcagggctcagcg

SEQ ID NO: 4728547 - DNA, 14 bp, Homo sapiens
catttgatttcgat

SEQ ID NO: 4728548 - DNA, 22 bp, Homo sapiens
catttgcgttccatgatgctgg

SEQ ID NO: 4728549 - DNA, 20 bp, Homo sapiens
catttgctaactagcttgga

SEQ ID NO: 4728550 - DNA, 20 bp, Homo sapiens
catttggcaatgccatcatc

SEQ ID NO: 4728551 - DNA, 16 bp, Homo sapiens
catttggtattacaca

SEQ ID NO: 4728552 - DNA, 21 bp, Homo sapiens
catttgtattgtacataaaat

SEQ ID NO: 4728553 - DNA, 13 bp, Homo sapiens
catttgtgaagaa

SEQ ID NO: 4728554 - DNA, 18 bp, Homo sapiens
catttgttggtaactaat

SEQ ID NO: 4728555 - DNA, 19 bp, Homo sapiens
catttgttggtaactaatg

SEQ ID NO: 4728556 - DNA, 18 bp, Homo sapiens
cattttaaccctatttta

SEQ ID NO: 4728557 - DNA, 19 bp, Homo sapiens
cattttattaaaacagaaa

SEQ ID NO: 4728558 - DNA, 14 bp, Homo sapiens
cattttattaaaca

SEQ ID NO: 4728559 - DNA, 18 bp, Homo sapiens
cattttattaaacatttt

SEQ ID NO: 4728560 - DNA, 12 bp, Homo sapiens
cattttatttat

SEQ ID NO: 4728561 - DNA, 23 bp, Homo sapiens
cattttcagcatcaaacatgaaa

SEQ ID NO: 4728562 - DNA, 20 bp, Homo sapiens
cattttcttgtatgatagtg

SEQ ID NO: 4728563 - DNA, 21 bp, Homo sapiens
cattttcttttgttcttgata

SEQ ID NO: 4728564 - DNA, 12 bp, Homo sapiens
cattttgaatgt

SEQ ID NO: 4728565 - DNA, 15 bp, Homo sapiens
cattttgtgaatgga

SEQ ID NO: 4728566 - DNA, 23 bp, Homo sapiens
catttttaaaggacaaacagtga

SEQ ID NO: 4728567 - DNA, 23 bp, Homo sapiens
catttttgtttctacctcccaga

SEQ ID NO: 4728568 - DNA, 20 bp, Homo sapiens
ccaaacatcctacaagacac

SEQ ID NO: 4728569 - DNA, 14 bp, Homo sapiens
ccaaaccacttttt

SEQ ID NO: 4728570 - DNA, 17 bp, Homo sapiens
ccaaactgatccagtat

SEQ ID NO: 4728571 - DNA, 15 bp, Homo sapiens
ccaaagcagggtctg

SEQ ID NO: 4728572 - DNA, 17 bp, Homo sapiens
ccaaagctaggcctggc

SEQ ID NO: 4728573 - DNA, 21 bp, Homo sapiens
ccaaagctaggcctggccaga

SEQ ID NO: 4728574 - DNA, 14 bp, Homo sapiens
ccaaaggaaaatgt

SEQ ID NO: 4728575 - DNA, 18 bp, Homo sapiens
ccaaagtaaactgtgtag

SEQ ID NO: 4728576 - DNA, 15 bp, Homo sapiens
ccaaatcccctaagc

SEQ ID NO: 4728577 - DNA, 22 bp, Homo sapiens
ccaaatctgacatattatgcct

SEQ ID NO: 4728578 - DNA, 18 bp, Homo sapiens
ccaaatgcattcatgttt

SEQ ID NO: 4728579 - DNA, 17 bp, Homo sapiens
caggctggccagcccca

SEQ ID NO: 4728580 - DNA, 18 bp, Homo sapiens
caggctggccagccccac

SEQ ID NO: 4728581 - DNA, 20 bp, Homo sapiens
caggctggccagccccacag

SEQ ID NO: 4728582 - DNA, 23 bp, Homo sapiens
caggctggccagccccacagccc

SEQ ID NO: 4728583 - DNA, 14 bp, Homo sapiens
caggctggccctgc

SEQ ID NO: 4728584 - DNA, 19 bp, Homo sapiens
caggctggccctgccctgg

SEQ ID NO: 4728585 - DNA, 20 bp, Homo sapiens
caggctggccctgccctggt

SEQ ID NO: 4728586 - DNA, 19 bp, Homo sapiens
caggctggcgtgcagtggt

SEQ ID NO: 4728587 - DNA, 22 bp, Homo sapiens
caggctgggagagccttccagg

SEQ ID NO: 4728588 - DNA, 14 bp, Homo sapiens
caggctgggcttca

SEQ ID NO: 4728589 - DNA, 21 bp, Homo sapiens
caggctgggcttcagtggcag

SEQ ID NO: 4728590 - DNA, 20 bp, Homo sapiens
caggctggtctcgaactcct

SEQ ID NO: 4728591 - DNA, 23 bp, Homo sapiens
caggctggtctcgaactcctgac

SEQ ID NO: 4728592 - DNA, 14 bp, Homo sapiens
caggctgtcccaag

SEQ ID NO: 4728593 - DNA, 15 bp, Homo sapiens
caggctgtcccaagc

SEQ ID NO: 4728594 - DNA, 22 bp, Homo sapiens
caggcttagtcactgagacagc

SEQ ID NO: 4728595 - DNA, 23 bp, Homo sapiens
caggcttagtcactgagacagcc

SEQ ID NO: 4728596 - DNA, 12 bp, Homo sapiens
caggcttctcag

SEQ ID NO: 4728597 - DNA, 16 bp, Homo sapiens
cagggaaacagctaat

SEQ ID NO: 4728598 - DNA, 22 bp, Homo sapiens
cagggaaacagctaatgggaca

SEQ ID NO: 4728599 - DNA, 20 bp, Homo sapiens
cagggaacatggggaggagg

SEQ ID NO: 4728600 - DNA, 20 bp, Homo sapiens
cagggacagagggggtggcc

SEQ ID NO: 4728601 - DNA, 14 bp, Homo sapiens
cagggacagcaact

SEQ ID NO: 4728602 - DNA, 23 bp, Homo sapiens
cagggactgttcctgtctcagca

SEQ ID NO: 4728603 - DNA, 19 bp, Homo sapiens
cagggagagcccaggagct

SEQ ID NO: 4728604 - DNA, 20 bp, Homo sapiens
cagggagagcccaggagctc

SEQ ID NO: 4728605 - DNA, 19 bp, Homo sapiens
cagggagcatggctgtgag

SEQ ID NO: 4728606 - DNA, 12 bp, Homo sapiens
cagggagggcct

SEQ ID NO: 4728607 - DNA, 18 bp, Homo sapiens
cagggagggcctgggccc

SEQ ID NO: 4728608 - DNA, 15 bp, Homo sapiens
cagggcaaggccatt

SEQ ID NO: 4728609 - DNA, 19 bp, Homo sapiens
cagggcacaccgggcactc

SEQ ID NO: 4728610 - DNA, 14 bp, Homo sapiens
cagggcagccaggg

SEQ ID NO: 4728611 - DNA, 16 bp, Homo sapiens
cagggcagccagggag

SEQ ID NO: 4728612 - DNA, 20 bp, Homo sapiens
cagggcagccagggagagcc

SEQ ID NO: 4728613 - DNA, 19 bp, Homo sapiens
cagggcctggaagacagag

SEQ ID NO: 4728614 - DNA, 15 bp, Homo sapiens
cagggcctggctcag

SEQ ID NO: 4728615 - DNA, 16 bp, Homo sapiens
cagggcctggctcagg

SEQ ID NO: 4728616 - DNA, 23 bp, Homo sapiens
cagggctaccctgagctgaggca

SEQ ID NO: 4728617 - DNA, 24 bp, Homo sapiens
cagggctaccctgagctgaggcag

SEQ ID NO: 4728618 - DNA, 12 bp, Homo sapiens
cagggctcagcg

SEQ ID NO: 4728619 - DNA, 14 bp, Homo sapiens
cagggctgctagac

SEQ ID NO: 4728620 - DNA, 15 bp, Homo sapiens
cagggctggactgag

SEQ ID NO: 4728621 - DNA, 16 bp, Homo sapiens
cagggctggactgagg

SEQ ID NO: 4728622 - DNA, 18 bp, Homo sapiens
cagggctggactgaggcc

SEQ ID NO: 4728623 - DNA, 19 bp, Homo sapiens
cagggctggactgaggcct

SEQ ID NO: 4728624 - DNA, 22 bp, Homo sapiens
cagggctggactgaggcctgag

SEQ ID NO: 4728625 - DNA, 22 bp, Homo sapiens
caggggcaggcacagcacaggg

SEQ ID NO: 4728626 - DNA, 14 bp, Homo sapiens
caggggctgcccgc

SEQ ID NO: 4728627 - DNA, 19 bp, Homo sapiens
caggggctgcccgctccca

SEQ ID NO: 4728628 - DNA, 15 bp, Homo sapiens
caggggtgggacacc

SEQ ID NO: 4728629 - DNA, 15 bp, Homo sapiens
cagggtccctggtgg

SEQ ID NO: 4728630 - DNA, 16 bp, Homo sapiens
cagggtctcactctgt

SEQ ID NO: 4728631 - DNA, 21 bp, Homo sapiens
cagggtctcactctgtcgccc

SEQ ID NO: 4728632 - DNA, 22 bp, Homo sapiens
cagggtctcactctgtcgccca

SEQ ID NO: 4728633 - DNA, 23 bp, Homo sapiens
cagggtctcactctgtcgcccag

SEQ ID NO: 4728634 - DNA, 21 bp, Homo sapiens
cagggtgaggacccgccggat

SEQ ID NO: 4728635 - DNA, 14 bp, Homo sapiens
cagggttggcccct

SEQ ID NO: 4728636 - DNA, 16 bp, Homo sapiens
cagggttggcccctgc

SEQ ID NO: 4728637 - DNA, 17 bp, Homo sapiens
cagggttggcccctgcc

SEQ ID NO: 4728638 - DNA, 15 bp, Homo sapiens
caggtaacaggcaga

SEQ ID NO: 4728639 - DNA, 21 bp, Homo sapiens
caggtaacaggcagatacagg

SEQ ID NO: 4728640 - DNA, 18 bp, Homo sapiens
caggtaatcgacctgcct

SEQ ID NO: 4728641 - DNA, 18 bp, Homo sapiens
caggtcaactctgaagag

SEQ ID NO: 4728642 - DNA, 19 bp, Homo sapiens
caggtcttgaactcctggc

SEQ ID NO: 4728643 - DNA, 22 bp, Homo sapiens
caggtcttgaactcctggcctc

SEQ ID NO: 4728644 - DNA, 18 bp, Homo sapiens
caggtgacatgtgaaacc

SEQ ID NO: 4728645 - DNA, 21 bp, Homo sapiens
caggtgacatgtgaaaccttt

SEQ ID NO: 4728646 - DNA, 19 bp, Homo sapiens
caggtgcacaagctccaag

SEQ ID NO: 4728647 - DNA, 22 bp, Homo sapiens
caggtgcacaagctccaagctc

SEQ ID NO: 4728648 - DNA, 23 bp, Homo sapiens
caggtgcagcccccactgccttt

SEQ ID NO: 4728649 - DNA, 18 bp, Homo sapiens
caggtgctaggaacactc

SEQ ID NO: 4728650 - DNA, 14 bp, Homo sapiens
caggtgctgccatc

SEQ ID NO: 4728651 - DNA, 14 bp, Homo sapiens
caggtgctgtgaca

SEQ ID NO: 4728652 - DNA, 19 bp, Homo sapiens
caggtgggcttcccagtgg

SEQ ID NO: 4728653 - DNA, 16 bp, Homo sapiens
caggtggggcagcttg

SEQ ID NO: 4728654 - DNA, 18 bp, Homo sapiens
caggtggggtcactctgg

SEQ ID NO: 4728655 - DNA, 17 bp, Homo sapiens
caggtggggtgaggcag

SEQ ID NO: 4728656 - DNA, 16 bp, Homo sapiens
caggtgtccctgcact

SEQ ID NO: 4728657 - DNA, 19 bp, Homo sapiens
caggttagaacctagaagg

SEQ ID NO: 4728658 - DNA, 19 bp, Homo sapiens
caggttatcgaaataacaa

SEQ ID NO: 4728659 - DNA, 14 bp, Homo sapiens
caggttggaaaaga

SEQ ID NO: 4728660 - DNA, 16 bp, Homo sapiens
caggttggaaaagaaa

SEQ ID NO: 4728661 - DNA, 17 bp, Homo sapiens
caggttgggccatactg

SEQ ID NO: 4728662 - DNA, 22 bp, Homo sapiens
cagtaagtagcaaccctgtgat

SEQ ID NO: 4728663 - DNA, 24 bp, Homo sapiens
cagtaagtagcaaccctgtgatac

SEQ ID NO: 4728664 - DNA, 16 bp, Homo sapiens
cagtacatcaaaggaa

SEQ ID NO: 4728665 - DNA, 14 bp, Homo sapiens
cagtaccaaatttc

SEQ ID NO: 4728666 - DNA, 20 bp, Homo sapiens
cagtacctcctgtctctggc

SEQ ID NO: 4728667 - DNA, 15 bp, Homo sapiens
cagtactcaaattca

SEQ ID NO: 4728668 - DNA, 23 bp, Homo sapiens
cagtagattcaagttgtgtctga

SEQ ID NO: 4728669 - DNA, 12 bp, Homo sapiens
cagtaggagccc

SEQ ID NO: 4728670 - DNA, 18 bp, Homo sapiens
cagtagtcacctctgggc

SEQ ID NO: 4728671 - DNA, 19 bp, Homo sapiens
cagtataagatttttgaaa

SEQ ID NO: 4728672 - DNA, 14 bp, Homo sapiens
cagtatatttggtt

SEQ ID NO: 4728673 - DNA, 16 bp, Homo sapiens
cagtatcctgctggtt

SEQ ID NO: 4728674 - DNA, 18 bp, Homo sapiens
cagtatgatatcatgctt

SEQ ID NO: 4728675 - DNA, 16 bp, Homo sapiens
cagtatgggttaggga

SEQ ID NO: 4728676 - DNA, 18 bp, Homo sapiens
cagtattacttctgctac

SEQ ID NO: 4728677 - DNA, 23 bp, Homo sapiens
cagtattgaaaaattatcagtta

SEQ ID NO: 4728678 - DNA, 16 bp, Homo sapiens
cagtattttccctgct

SEQ ID NO: 4728679 - DNA, 18 bp, Homo sapiens
cagtcaaatttacattta

SEQ ID NO: 4728680 - DNA, 15 bp, Homo sapiens
cagtcaacctgggca

SEQ ID NO: 4728681 - DNA, 16 bp, Homo sapiens
cagtcaacctgggcaa

SEQ ID NO: 4728682 - DNA, 21 bp, Homo sapiens
cagtcaacctgggcaaagcct

SEQ ID NO: 4728683 - DNA, 17 bp, Homo sapiens
cagtcaccccaggactc

SEQ ID NO: 4728684 - DNA, 19 bp, Homo sapiens
cagtcaccccggccacctg

SEQ ID NO: 4728685 - DNA, 23 bp, Homo sapiens
cagtcacgtggaggagcagtgca

SEQ ID NO: 4728686 - DNA, 16 bp, Homo sapiens
cagtcatgcataaata

SEQ ID NO: 4728687 - DNA, 21 bp, Homo sapiens
cagtcatttttgtttctacct

SEQ ID NO: 4728688 - DNA, 19 bp, Homo sapiens
cagtccaaggaaaccacag

SEQ ID NO: 4728689 - DNA, 24 bp, Homo sapiens
cagtccaaggaaaccacagctgct

SEQ ID NO: 4728690 - DNA, 15 bp, Homo sapiens
cagtccagcctggag

SEQ ID NO: 4728691 - DNA, 21 bp, Homo sapiens
cagtcccagaacacggcagct

SEQ ID NO: 4728692 - DNA, 15 bp, Homo sapiens
cagtccctgccaatg

SEQ ID NO: 4728693 - DNA, 16 bp, Homo sapiens
cagtccctgccaatgg

SEQ ID NO: 4728694 - DNA, 16 bp, Homo sapiens
cagtcctcccatctca

SEQ ID NO: 4728695 - DNA, 20 bp, Homo sapiens
cagtcctctccacctagtgg

SEQ ID NO: 4728696 - DNA, 22 bp, Homo sapiens
cagtcctctccacctagtggct

SEQ ID NO: 4728697 - DNA, 22 bp, Homo sapiens
cagtcctgatcagagccgtggt

SEQ ID NO: 4728698 - DNA, 18 bp, Homo sapiens
cagtccttaccagcagag

SEQ ID NO: 4728699 - DNA, 14 bp, Homo sapiens
cagtcgcgctgcct

SEQ ID NO: 4728700 - DNA, 16 bp, Homo sapiens
cagtctcaattttgta

SEQ ID NO: 4728701 - DNA, 22 bp, Homo sapiens
cagtctgattcccaagctctgc

SEQ ID NO: 4728702 - DNA, 15 bp, Homo sapiens
cagtctggaatgcag

SEQ ID NO: 4728703 - DNA, 19 bp, Homo sapiens
cagtcttatcaactggttg

SEQ ID NO: 4728704 - DNA, 17 bp, Homo sapiens
cagtcttccatttgcaa

SEQ ID NO: 4728705 - DNA, 18 bp, Homo sapiens
cagtcttccatttgcaag

SEQ ID NO: 4728706 - DNA, 14 bp, Homo sapiens
cagtcttgcagcag

SEQ ID NO: 4728707 - DNA, 15 bp, Homo sapiens
cagtcttgcagcagg

SEQ ID NO: 4728708 - DNA, 20 bp, Homo sapiens
cagtgaaagaaaataacaat

SEQ ID NO: 4728709 - DNA, 15 bp, Homo sapiens
cagtgaatttgtcca

SEQ ID NO: 4728710 - DNA, 17 bp, Homo sapiens
cagtgaatttgtccatt

SEQ ID NO: 4728711 - DNA, 17 bp, Homo sapiens
cagtgactcgggctcct

SEQ ID NO: 4728712 - DNA, 20 bp, Homo sapiens
cagtgactcgggctcctgtg

SEQ ID NO: 4728713 - DNA, 22 bp, Homo sapiens
cagtgactcgggctcctgtgcc

SEQ ID NO: 4728714 - DNA, 23 bp, Homo sapiens
cagtgactcgggctcctgtgccc

SEQ ID NO: 4728715 - DNA, 14 bp, Homo sapiens
cagtgaggctctgc

SEQ ID NO: 4728716 - DNA, 16 bp, Homo sapiens
cagtgaggctctgccc

SEQ ID NO: 4728717 - DNA, 18 bp, Homo sapiens
cagtgaggctctgccctt

SEQ ID NO: 4728718 - DNA, 20 bp, Homo sapiens
cagtgaggctctgcccttgg

SEQ ID NO: 4728719 - DNA, 18 bp, Homo sapiens
cagtgatatggcagaaga

SEQ ID NO: 4728720 - DNA, 20 bp, Homo sapiens
cagtgatatggcagaagaca

SEQ ID NO: 4728721 - DNA, 21 bp, Homo sapiens
cagtgatatggcagaagacac

SEQ ID NO: 4728722 - DNA, 14 bp, Homo sapiens
cagtgccagcccct

SEQ ID NO: 4728723 - DNA, 15 bp, Homo sapiens
cagtgccagcccctg

SEQ ID NO: 4728724 - DNA, 13 bp, Homo sapiens
cagtgcccacagg

SEQ ID NO: 4728725 - DNA, 17 bp, Homo sapiens
cagtgccgccgcctcgc

SEQ ID NO: 4728726 - DNA, 20 bp, Homo sapiens
cagtgccgccgcctcgccca

SEQ ID NO: 4728727 - DNA, 23 bp, Homo sapiens
cagtgctgaccagacagcctccc

SEQ ID NO: 4728728 - DNA, 19 bp, Homo sapiens
cagtgcttgattgcgtgga

SEQ ID NO: 4728729 - DNA, 14 bp, Homo sapiens
cagtgcttgccaca

SEQ ID NO: 4728730 - DNA, 17 bp, Homo sapiens
cagtgcttgccacagag

SEQ ID NO: 4728731 - DNA, 11 bp, Homo sapiens
cagtggagagg

SEQ ID NO: 4728732 - DNA, 17 bp, Homo sapiens
cagtggatcacaaagtg

SEQ ID NO: 4728733 - DNA, 15 bp, Homo sapiens
cagtggcagctgctt

SEQ ID NO: 4728734 - DNA, 14 bp, Homo sapiens
cagtggctgctgcc

SEQ ID NO: 4728735 - DNA, 17 bp, Homo sapiens
cagtggctgctgcccag

SEQ ID NO: 4728736 - DNA, 19 bp, Homo sapiens
cagtgggaaaaatgtagga

SEQ ID NO: 4728737 - DNA, 11 bp, Homo sapiens
cagtgggagct

SEQ ID NO: 4728738 - DNA, 16 bp, Homo sapiens
cagtgggagctgcctg

SEQ ID NO: 4728739 - DNA, 16 bp, Homo sapiens
cagtgggcatgtatta

SEQ ID NO: 4728740 - DNA, 22 bp, Homo sapiens
cagtgggtcccacttcccctcc

SEQ ID NO: 4728741 - DNA, 23 bp, Homo sapiens
cagtgggtcccacttcccctcct

SEQ ID NO: 4728742 - DNA, 17 bp, Homo sapiens
cagtggtaagaatagta

SEQ ID NO: 4728743 - DNA, 20 bp, Homo sapiens
cagtggtatgatcacggctc

SEQ ID NO: 4728744 - DNA, 15 bp, Homo sapiens
cagtgtacagtcttg

SEQ ID NO: 4728745 - DNA, 18 bp, Homo sapiens
cagtgtacagtcttgtat

SEQ ID NO: 4728746 - DNA, 14 bp, Homo sapiens
cagtgtacccccgc

SEQ ID NO: 4728747 - DNA, 14 bp, Homo sapiens
cagtgtatctaatt

SEQ ID NO: 4728748 - DNA, 16 bp, Homo sapiens
cagtgtccaaagcagg

SEQ ID NO: 4728749 - DNA, 17 bp, Homo sapiens
cagtgtccaaagcaggg

SEQ ID NO: 4728750 - DNA, 14 bp, Homo sapiens
cagtgtctgggctg

SEQ ID NO: 4728751 - DNA, 15 bp, Homo sapiens
cagtgtctgggctga

SEQ ID NO: 4728752 - DNA, 13 bp, Homo sapiens
cagtgtctgtgtt

SEQ ID NO: 4728753 - DNA, 13 bp, Homo sapiens
cagtgtcttcctg

SEQ ID NO: 4728754 - DNA, 11 bp, Homo sapiens
cagtgtgaatg

SEQ ID NO: 4728755 - DNA, 12 bp, Homo sapiens
cagtgtgaatgg

SEQ ID NO: 4728756 - DNA, 16 bp, Homo sapiens
cagtgtgaggccaggg

SEQ ID NO: 4728757 - DNA, 14 bp, Homo sapiens
cagtgtgcccccca

SEQ ID NO: 4728758 - DNA, 17 bp, Homo sapiens
cagtgtggcaagcaaga

SEQ ID NO: 4728759 - DNA, 21 bp, Homo sapiens
cagtgtgtggtcaacatttct

SEQ ID NO: 4728760 - DNA, 22 bp, Homo sapiens
cagtgttaggcctggcacagtg

SEQ ID NO: 4728761 - DNA, 23 bp, Homo sapiens
cagtgttaggcctggcacagtgt

SEQ ID NO: 4728762 - DNA, 19 bp, Homo sapiens
cagtgttagggaagggcct

SEQ ID NO: 4728763 - DNA, 15 bp, Homo sapiens
cagttattactgttt

SEQ ID NO: 4728764 - DNA, 21 bp, Homo sapiens
cagttattatatttacaaatg

SEQ ID NO: 4728765 - DNA, 22 bp, Homo sapiens
cagttattatatttacaaatgg

SEQ ID NO: 4728766 - DNA, 13 bp, Homo sapiens
cagttcataaatt

SEQ ID NO: 4728767 - DNA, 20 bp, Homo sapiens
cagttccctttatttcacat

SEQ ID NO: 4728768 - DNA, 15 bp, Homo sapiens
cagttctgtgtacat

SEQ ID NO: 4728769 - DNA, 16 bp, Homo sapiens
cagttctgtgtacatt

SEQ ID NO: 4728770 - DNA, 19 bp, Homo sapiens
cagttctgtgtacatttta

SEQ ID NO: 4728771 - DNA, 20 bp, Homo sapiens
cagttctgtgtacattttaa

SEQ ID NO: 4728772 - DNA, 18 bp, Homo sapiens
cagttggtcccccttcca

SEQ ID NO: 4728773 - DNA, 19 bp, Homo sapiens
cagttgttatttattgaaa

SEQ ID NO: 4728774 - DNA, 11 bp, Homo sapiens
cagtttaattc

SEQ ID NO: 4728775 - DNA, 18 bp, Homo sapiens
cagtttaattctgttaac

SEQ ID NO: 4728776 - DNA, 19 bp, Homo sapiens
cagtttctgtcctgctggt

SEQ ID NO: 4728777 - DNA, 15 bp, Homo sapiens
cagtttggtttatat

SEQ ID NO: 4728778 - DNA, 22 bp, Homo sapiens
cagttttaactgtggatattgt

SEQ ID NO: 4728779 - DNA, 13 bp, Homo sapiens
cagttttgttttg

SEQ ID NO: 4728780 - DNA, 14 bp, Homo sapiens
cataaagtaaatac

SEQ ID NO: 4728781 - DNA, 15 bp, Homo sapiens
cataaagtaaataca

SEQ ID NO: 4728782 - DNA, 21 bp, Homo sapiens
cataaatcaattcatgtttaa

SEQ ID NO: 4728783 - DNA, 13 bp, Homo sapiens
cataaatgttcac

SEQ ID NO: 4728784 - DNA, 12 bp, Homo sapiens
cataaattattt

SEQ ID NO: 4728785 - DNA, 16 bp, Homo sapiens
cataacctagccttag

SEQ ID NO: 4728786 - DNA, 20 bp, Homo sapiens
cataacgtttttcctttaaa

SEQ ID NO: 4728787 - DNA, 12 bp, Homo sapiens
cataagctattt

SEQ ID NO: 4728788 - DNA, 15 bp, Homo sapiens
cataagtatttcaaa

SEQ ID NO: 4728789 - DNA, 21 bp, Homo sapiens
cataagtgacaccaataaatg

SEQ ID NO: 4728790 - DNA, 22 bp, Homo sapiens
cataagtgacaccaataaatgt

SEQ ID NO: 4728791 - DNA, 22 bp, Homo sapiens
cataatcagtatatttggtttc

SEQ ID NO: 4728792 - DNA, 20 bp, Homo sapiens
cataatctaccaacgaaaga

SEQ ID NO: 4728793 - DNA, 18 bp, Homo sapiens
cataatgtttctggattt

SEQ ID NO: 4728794 - DNA, 22 bp, Homo sapiens
cataatgtttctggatttcata

SEQ ID NO: 4728795 - DNA, 18 bp, Homo sapiens
cataattctaagactaat

SEQ ID NO: 4728796 - DNA, 15 bp, Homo sapiens
cataatttaaaaata

SEQ ID NO: 4728797 - DNA, 18 bp, Homo sapiens
cataatttaaaaatatat

SEQ ID NO: 4728798 - DNA, 20 bp, Homo sapiens
cataatttaaaaatatattt

SEQ ID NO: 4728799 - DNA, 14 bp, Homo sapiens
cataattttatcta

SEQ ID NO: 4728800 - DNA, 16 bp, Homo sapiens
cagccctggctgaagg

SEQ ID NO: 4728801 - DNA, 21 bp, Homo sapiens
cagcccttagcagggaaacag

SEQ ID NO: 4728802 - DNA, 20 bp, Homo sapiens
cagcccttgggggtcctcct

SEQ ID NO: 4728803 - DNA, 12 bp, Homo sapiens
cagccgctgccc

SEQ ID NO: 4728804 - DNA, 13 bp, Homo sapiens
cagccgctgcccg

SEQ ID NO: 4728805 - DNA, 22 bp, Homo sapiens
cagccgctgcccggcgccctct

SEQ ID NO: 4728806 - DNA, 15 bp, Homo sapiens
cagccggtacctggg

SEQ ID NO: 4728807 - DNA, 21 bp, Homo sapiens
cagccggtacctgggaagggg

SEQ ID NO: 4728808 - DNA, 22 bp, Homo sapiens
cagcctaacccccagcccctcc

SEQ ID NO: 4728809 - DNA, 19 bp, Homo sapiens
cagcctcaataagccttgt

SEQ ID NO: 4728810 - DNA, 20 bp, Homo sapiens
cagcctcccctgccagggca

SEQ ID NO: 4728811 - DNA, 22 bp, Homo sapiens
cagcctcccgaatagctgggac

SEQ ID NO: 4728812 - DNA, 18 bp, Homo sapiens
cagcctgacaacagcctg

SEQ ID NO: 4728813 - DNA, 12 bp, Homo sapiens
cagcctgagaaa

SEQ ID NO: 4728814 - DNA, 19 bp, Homo sapiens
cagcctgctaattccccag

SEQ ID NO: 4728815 - DNA, 12 bp, Homo sapiens
cagcctggccca

SEQ ID NO: 4728816 - DNA, 13 bp, Homo sapiens
cagcctggcccag

SEQ ID NO: 4728817 - DNA, 19 bp, Homo sapiens
cagcctggcccagctcccc

SEQ ID NO: 4728818 - DNA, 17 bp, Homo sapiens
cagccttgaccattctc

SEQ ID NO: 4728819 - DNA, 21 bp, Homo sapiens
cagccttgaccattctccacc

SEQ ID NO: 4728820 - DNA, 17 bp, Homo sapiens
cagcgagccctggtggc

SEQ ID NO: 4728821 - DNA, 19 bp, Homo sapiens
cagcgagccctggtggcag

SEQ ID NO: 4728822 - DNA, 20 bp, Homo sapiens
cagcgagccctggtggcagt

SEQ ID NO: 4728823 - DNA, 21 bp, Homo sapiens
cagcgagccctggtggcagtg

SEQ ID NO: 4728824 - DNA, 17 bp, Homo sapiens
cagcgaggaggctccag

SEQ ID NO: 4728825 - DNA, 18 bp, Homo sapiens
cagcgaggaggctccaga

SEQ ID NO: 4728826 - DNA, 16 bp, Homo sapiens
cagcgcagagcgggct

SEQ ID NO: 4728827 - DNA, 20 bp, Homo sapiens
cagcgctgtcaggattgcga

SEQ ID NO: 4728828 - DNA, 16 bp, Homo sapiens
cagcggggacagctcc

SEQ ID NO: 4728829 - DNA, 17 bp, Homo sapiens
cagcggggacagctcct

SEQ ID NO: 4728830 - DNA, 15 bp, Homo sapiens
cagcgtgctttaaaa

SEQ ID NO: 4728831 - DNA, 17 bp, Homo sapiens
cagctaacaattgtgaa

SEQ ID NO: 4728832 - DNA, 15 bp, Homo sapiens
cagctaatgggacac

SEQ ID NO: 4728833 - DNA, 15 bp, Homo sapiens
cagctactttccatt

SEQ ID NO: 4728834 - DNA, 16 bp, Homo sapiens
cagctactttccattt

SEQ ID NO: 4728835 - DNA, 18 bp, Homo sapiens
cagctataacagtaggga

SEQ ID NO: 4728836 - DNA, 20 bp, Homo sapiens
cagctatgttatattgaaaa

SEQ ID NO: 4728837 - DNA, 22 bp, Homo sapiens
cagctcaagggaccctgggtgg

SEQ ID NO: 4728838 - DNA, 19 bp, Homo sapiens
cagctcaccagccccagtg

SEQ ID NO: 4728839 - DNA, 21 bp, Homo sapiens
cagctcactgcaaccttcgcc

SEQ ID NO: 4728840 - DNA, 13 bp, Homo sapiens
cagctcagagagg

SEQ ID NO: 4728841 - DNA, 17 bp, Homo sapiens
cagctcagagagggtgg

SEQ ID NO: 4728842 - DNA, 17 bp, Homo sapiens
cagctccagctcaccag

SEQ ID NO: 4728843 - DNA, 23 bp, Homo sapiens
cagctcccataaccgctgattct

SEQ ID NO: 4728844 - DNA, 15 bp, Homo sapiens
cagctccccagagtc

SEQ ID NO: 4728845 - DNA, 13 bp, Homo sapiens
cagctccttcctg

SEQ ID NO: 4728846 - DNA, 12 bp, Homo sapiens
cagctctgaggc

SEQ ID NO: 4728847 - DNA, 19 bp, Homo sapiens
cagctctgcagcaatattc

SEQ ID NO: 4728848 - DNA, 17 bp, Homo sapiens
cagctctggtccataga

SEQ ID NO: 4728849 - DNA, 18 bp, Homo sapiens
cagctctggtccatagag

SEQ ID NO: 4728850 - DNA, 22 bp, Homo sapiens
cagctctggtccatagagagca

SEQ ID NO: 4728851 - DNA, 23 bp, Homo sapiens
cagctctggtccatagagagcaa

SEQ ID NO: 4728852 - DNA, 12 bp, Homo sapiens
cagctctgtcct

SEQ ID NO: 4728853 - DNA, 13 bp, Homo sapiens
cagctctgtcctg

SEQ ID NO: 4728854 - DNA, 16 bp, Homo sapiens
cagctctgtcctggga

SEQ ID NO: 4728855 - DNA, 17 bp, Homo sapiens
cagctctgtcctgggag

SEQ ID NO: 4728856 - DNA, 18 bp, Homo sapiens
cagctctgtcctgggagt

SEQ ID NO: 4728857 - DNA, 13 bp, Homo sapiens
cagctcttctcca

SEQ ID NO: 4728858 - DNA, 17 bp, Homo sapiens
cagctcttctccaggct

SEQ ID NO: 4728859 - DNA, 15 bp, Homo sapiens
cagctgacagtcctc

SEQ ID NO: 4728860 - DNA, 13 bp, Homo sapiens
cagctgcctggga

SEQ ID NO: 4728861 - DNA, 23 bp, Homo sapiens
cagctgcctgggatccctcatcc

SEQ ID NO: 4728862 - DNA, 22 bp, Homo sapiens
cagctgcggtccacccaggagc

SEQ ID NO: 4728863 - DNA, 24 bp, Homo sapiens
cagctgcggtccacccaggagccc

SEQ ID NO: 4728864 - DNA, 21 bp, Homo sapiens
cagctgctcaataaagtacaa

SEQ ID NO: 4728865 - DNA, 23 bp, Homo sapiens
cagctgctggagactcctaggca

SEQ ID NO: 4728866 - DNA, 16 bp, Homo sapiens
cagctgctggctgtga

SEQ ID NO: 4728867 - DNA, 21 bp, Homo sapiens
cagctgctggctgtgacaatg

SEQ ID NO: 4728868 - DNA, 22 bp, Homo sapiens
cagctgcttttgtctatgggac

SEQ ID NO: 4728869 - DNA, 23 bp, Homo sapiens
cagctggaagtggctctggggtc

SEQ ID NO: 4728870 - DNA, 19 bp, Homo sapiens
cagctggccgggagcctga

SEQ ID NO: 4728871 - DNA, 17 bp, Homo sapiens
cagctgggtggcactgc

SEQ ID NO: 4728872 - DNA, 21 bp, Homo sapiens
cagctgggtggcactgccatg

SEQ ID NO: 4728873 - DNA, 22 bp, Homo sapiens
cagctgggtggcactgccatgc

SEQ ID NO: 4728874 - DNA, 15 bp, Homo sapiens
cagctggtggatggt

SEQ ID NO: 4728875 - DNA, 14 bp, Homo sapiens
cagcttcaggttat

SEQ ID NO: 4728876 - DNA, 18 bp, Homo sapiens
cagcttcatttcctgtgt

SEQ ID NO: 4728877 - DNA, 19 bp, Homo sapiens
cagcttcatttcctgtgtc

SEQ ID NO: 4728878 - DNA, 19 bp, Homo sapiens
cagcttctgccacttccca

SEQ ID NO: 4728879 - DNA, 20 bp, Homo sapiens
cagcttctgccacttcccag

SEQ ID NO: 4728880 - DNA, 23 bp, Homo sapiens
cagcttctgccacttcccaggta

SEQ ID NO: 4728881 - DNA, 16 bp, Homo sapiens
cagcttctgctgggct

SEQ ID NO: 4728882 - DNA, 18 bp, Homo sapiens
cagcttgagtttttagtg

SEQ ID NO: 4728883 - DNA, 21 bp, Homo sapiens
cagcttgtaaatagctcaggt

SEQ ID NO: 4728884 - DNA, 17 bp, Homo sapiens
caggaaagagattagaa

SEQ ID NO: 4728885 - DNA, 14 bp, Homo sapiens
caggaaaggctcca

SEQ ID NO: 4728886 - DNA, 16 bp, Homo sapiens
caggaaaggctccagg

SEQ ID NO: 4728887 - DNA, 19 bp, Homo sapiens
caggaaaggctccaggagc

SEQ ID NO: 4728888 - DNA, 22 bp, Homo sapiens
caggaaaggctccaggagcagc

SEQ ID NO: 4728889 - DNA, 21 bp, Homo sapiens
caggaaatgaaaatgtcttgt

SEQ ID NO: 4728890 - DNA, 14 bp, Homo sapiens
caggaacatacaga

SEQ ID NO: 4728891 - DNA, 18 bp, Homo sapiens
caggaacatacagacaca

SEQ ID NO: 4728892 - DNA, 22 bp, Homo sapiens
caggaaccgaacatatcatttg

SEQ ID NO: 4728893 - DNA, 15 bp, Homo sapiens
caggaagcctcaagt

SEQ ID NO: 4728894 - DNA, 16 bp, Homo sapiens
caggaagctcagggcc

SEQ ID NO: 4728895 - DNA, 20 bp, Homo sapiens
caggaagctcagggcctggc

SEQ ID NO: 4728896 - DNA, 21 bp, Homo sapiens
caggaagctcagggcctggct

SEQ ID NO: 4728897 - DNA, 12 bp, Homo sapiens
caggaaggagct

SEQ ID NO: 4728898 - DNA, 13 bp, Homo sapiens
caggaaggagctg

SEQ ID NO: 4728899 - DNA, 14 bp, Homo sapiens
caggaaggagctgc

SEQ ID NO: 4728900 - DNA, 16 bp, Homo sapiens
caggaaggagctgcct

SEQ ID NO: 4728901 - DNA, 20 bp, Homo sapiens
caggaaggagctgcctggac

SEQ ID NO: 4728902 - DNA, 21 bp, Homo sapiens
caggaaggagctgcctggacc

SEQ ID NO: 4728903 - DNA, 21 bp, Homo sapiens
caggaatgccaaggagacatc

SEQ ID NO: 4728904 - DNA, 15 bp, Homo sapiens
caggacattaaaaat

SEQ ID NO: 4728905 - DNA, 17 bp, Homo sapiens
caggaccaagggcagag

SEQ ID NO: 4728906 - DNA, 19 bp, Homo sapiens
caggaccaagggcagaggg

SEQ ID NO: 4728907 - DNA, 13 bp, Homo sapiens
caggaccagggat

SEQ ID NO: 4728908 - DNA, 14 bp, Homo sapiens
caggacccagagga

SEQ ID NO: 4728909 - DNA, 18 bp, Homo sapiens
caccctgtgatggggccc

SEQ ID NO: 4728910 - DNA, 20 bp, Homo sapiens
caccctgtgatggggccctg

SEQ ID NO: 4728911 - DNA, 21 bp, Homo sapiens
cacccttttccagctggatga

SEQ ID NO: 4728912 - DNA, 12 bp, Homo sapiens
caccgcagacag

SEQ ID NO: 4728913 - DNA, 14 bp, Homo sapiens
caccgcagacagga

SEQ ID NO: 4728914 - DNA, 17 bp, Homo sapiens
caccgcagacaggacca

SEQ ID NO: 4728915 - DNA, 18 bp, Homo sapiens
caccgcagacaggaccag

SEQ ID NO: 4728916 - DNA, 18 bp, Homo sapiens
caccgcatgccccctcgt

SEQ ID NO: 4728917 - DNA, 19 bp, Homo sapiens
caccgcatgccccctcgtg

SEQ ID NO: 4728918 - DNA, 13 bp, Homo sapiens
caccgccatggct

SEQ ID NO: 4728919 - DNA, 16 bp, Homo sapiens
caccgccatggcttcc

SEQ ID NO: 4728920 - DNA, 15 bp, Homo sapiens
caccggctggcctgg

SEQ ID NO: 4728921 - DNA, 17 bp, Homo sapiens
caccggctggcctggcc

SEQ ID NO: 4728922 - DNA, 20 bp, Homo sapiens
caccggctggcctggcccct

SEQ ID NO: 4728923 - DNA, 22 bp, Homo sapiens
caccgggcactcagaagacact

SEQ ID NO: 4728924 - DNA, 13 bp, Homo sapiens
caccgtgggctcc

SEQ ID NO: 4728925 - DNA, 14 bp, Homo sapiens
caccgttcattcag

SEQ ID NO: 4728926 - DNA, 18 bp, Homo sapiens
cacctaaaccctctgtga

SEQ ID NO: 4728927 - DNA, 20 bp, Homo sapiens
cacctaaaccctctgtgaaa

SEQ ID NO: 4728928 - DNA, 20 bp, Homo sapiens
cacctagtctgtaactcttt

SEQ ID NO: 4728929 - DNA, 22 bp, Homo sapiens
cacctagtggctgtccagtgcc

SEQ ID NO: 4728930 - DNA, 23 bp, Homo sapiens
cacctagtggctgtccagtgccc

SEQ ID NO: 4728931 - DNA, 19 bp, Homo sapiens
cacctcagagtatggagct

SEQ ID NO: 4728932 - DNA, 17 bp, Homo sapiens
cacctcagagtggagtt

SEQ ID NO: 4728933 - DNA, 21 bp, Homo sapiens
cacctcagagtggagttgaaa

SEQ ID NO: 4728934 - DNA, 14 bp, Homo sapiens
cacctcagcctccc

SEQ ID NO: 4728935 - DNA, 12 bp, Homo sapiens
cacctcccacca

SEQ ID NO: 4728936 - DNA, 11 bp, Homo sapiens
cacctcctgcc

SEQ ID NO: 4728937 - DNA, 15 bp, Homo sapiens
cacctcctgcctcag

SEQ ID NO: 4728938 - DNA, 14 bp, Homo sapiens
cacctcctgcctcg

SEQ ID NO: 4728939 - DNA, 13 bp, Homo sapiens
cacctctcccttg

SEQ ID NO: 4728940 - DNA, 15 bp, Homo sapiens
cacctctctcactcc

SEQ ID NO: 4728941 - DNA, 19 bp, Homo sapiens
cacctctctcactccttga

SEQ ID NO: 4728942 - DNA, 11 bp, Homo sapiens
cacctgccagg

SEQ ID NO: 4728943 - DNA, 12 bp, Homo sapiens
cacctgccaggg

SEQ ID NO: 4728944 - DNA, 16 bp, Homo sapiens
cacctgccagggacag

SEQ ID NO: 4728945 - DNA, 17 bp, Homo sapiens
cacctgccagggacaga

SEQ ID NO: 4728946 - DNA, 14 bp, Homo sapiens
cacctgctcactgg

SEQ ID NO: 4728947 - DNA, 16 bp, Homo sapiens
cacctgctcactggtc

SEQ ID NO: 4728948 - DNA, 17 bp, Homo sapiens
cacctggacccctgcat

SEQ ID NO: 4728949 - DNA, 18 bp, Homo sapiens
cacctggacccctgcatt

SEQ ID NO: 4728950 - DNA, 15 bp, Homo sapiens
cacctggcctctgca

SEQ ID NO: 4728951 - DNA, 18 bp, Homo sapiens
cacctggcctctgcactc

SEQ ID NO: 4728952 - DNA, 19 bp, Homo sapiens
cacctggcctctgcactcc

SEQ ID NO: 4728953 - DNA, 15 bp, Homo sapiens
caccttatatttacg

SEQ ID NO: 4728954 - DNA, 14 bp, Homo sapiens
caccttcaaaatgt

SEQ ID NO: 4728955 - DNA, 21 bp, Homo sapiens
caccttctgacgcagcctgag

SEQ ID NO: 4728956 - DNA, 23 bp, Homo sapiens
caccttctgacgcagcctgagaa

SEQ ID NO: 4728957 - DNA, 15 bp, Homo sapiens
cactgtgatgttggg

SEQ ID NO: 4728958 - DNA, 14 bp, Homo sapiens
cactgtgccatgtg

SEQ ID NO: 4728959 - DNA, 15 bp, Homo sapiens
cactgtgccatgtgc

SEQ ID NO: 4728960 - DNA, 13 bp, Homo sapiens
cactgtgctcagg

SEQ ID NO: 4728961 - DNA, 16 bp, Homo sapiens
cactgtgctcagggct

SEQ ID NO: 4728962 - DNA, 20 bp, Homo sapiens
cactgtgctgagtctgaagg

SEQ ID NO: 4728963 - DNA, 21 bp, Homo sapiens
cactgtgctgagtctgaaggc

SEQ ID NO: 4728964 - DNA, 20 bp, Homo sapiens
cactgtggaagtccctcaga

SEQ ID NO: 4728965 - DNA, 19 bp, Homo sapiens
cactgttccccctgtgcag

SEQ ID NO: 4728966 - DNA, 19 bp, Homo sapiens
cactgttctctgccctcca

SEQ ID NO: 4728967 - DNA, 21 bp, Homo sapiens
cactgttctctgccctccaag

SEQ ID NO: 4728968 - DNA, 22 bp, Homo sapiens
cactgttctctgccctccaaga

SEQ ID NO: 4728969 - DNA, 17 bp, Homo sapiens
cactgttgataaaaact

SEQ ID NO: 4728970 - DNA, 16 bp, Homo sapiens
cactgttgggtgggtg

SEQ ID NO: 4728971 - DNA, 17 bp, Homo sapiens
cactgttgggtgggtgg

SEQ ID NO: 4728972 - DNA, 22 bp, Homo sapiens
cactgttgggtgggtgggccct

SEQ ID NO: 4728973 - DNA, 18 bp, Homo sapiens
cacttactgttgtcctat

SEQ ID NO: 4728974 - DNA, 19 bp, Homo sapiens
cacttataaatatcctgct

SEQ ID NO: 4728975 - DNA, 15 bp, Homo sapiens
cacttattgaatata

SEQ ID NO: 4728976 - DNA, 20 bp, Homo sapiens
cacttccctgacactgcggg

SEQ ID NO: 4728977 - DNA, 19 bp, Homo sapiens
cacttccctgggcaaatga

SEQ ID NO: 4728978 - DNA, 12 bp, Homo sapiens
cacttcctcccc

SEQ ID NO: 4728979 - DNA, 13 bp, Homo sapiens
cacttctatttaa

SEQ ID NO: 4728980 - DNA, 14 bp, Homo sapiens
cacttctgcacttg

SEQ ID NO: 4728981 - DNA, 13 bp, Homo sapiens
cacttgcagactc

SEQ ID NO: 4728982 - DNA, 22 bp, Homo sapiens
cacttgcagactctacagaggc

SEQ ID NO: 4728983 - DNA, 22 bp, Homo sapiens
cacttgctcatgccctgccaag

SEQ ID NO: 4728984 - DNA, 18 bp, Homo sapiens
cacttgctggctgtgaaa

SEQ ID NO: 4728985 - DNA, 22 bp, Homo sapiens
cacttggagtttgcattcttat

SEQ ID NO: 4728986 - DNA, 22 bp, Homo sapiens
cacttgtgccaacactcaagaa

SEQ ID NO: 4728987 - DNA, 19 bp, Homo sapiens
cactttaaagcaattgcat

SEQ ID NO: 4728988 - DNA, 18 bp, Homo sapiens
cactttcagtgaaagcat

SEQ ID NO: 4728989 - DNA, 23 bp, Homo sapiens
cactttgttctggctcttccagg

SEQ ID NO: 4728990 - DNA, 17 bp, Homo sapiens
cacttttgacaaaggca

SEQ ID NO: 4728991 - DNA, 18 bp, Homo sapiens
cacttttgacaaaggcaa

SEQ ID NO: 4728992 - DNA, 20 bp, Homo sapiens
cagaaacaccctcacactgg

SEQ ID NO: 4728993 - DNA, 21 bp, Homo sapiens
cagaaacaccctcacactggg

SEQ ID NO: 4728994 - DNA, 24 bp, Homo sapiens
cagaaagaagtggggacagagcag

SEQ ID NO: 4728995 - DNA, 17 bp, Homo sapiens
cagaacagcttcaggtt

SEQ ID NO: 4728996 - DNA, 24 bp, Homo sapiens
cagaacagcttcaggttatcgaaa

SEQ ID NO: 4728997 - DNA, 15 bp, Homo sapiens
cagaacagtgtttga

SEQ ID NO: 4728998 - DNA, 12 bp, Homo sapiens
cagaacctggag

SEQ ID NO: 4728999 - DNA, 16 bp, Homo sapiens
cagaactctttcaaaa

SEQ ID NO: 4729000 - DNA, 17 bp, Homo sapiens
cagaactttagtattaa

SEQ ID NO: 4729001 - DNA, 19 bp, Homo sapiens
cagaagacacatgtggaga

SEQ ID NO: 4729002 - DNA, 16 bp, Homo sapiens
cagaagacaccagagc

SEQ ID NO: 4729003 - DNA, 17 bp, Homo sapiens
cagaagacaccagagca

SEQ ID NO: 4729004 - DNA, 23 bp, Homo sapiens
cagaagacagcagcaagtgtgct

SEQ ID NO: 4729005 - DNA, 21 bp, Homo sapiens
cagaagggggtggtgtctcca

SEQ ID NO: 4729006 - DNA, 12 bp, Homo sapiens
cagaagtgattt

SEQ ID NO: 4729007 - DNA, 15 bp, Homo sapiens
cagaagtgatttagt

SEQ ID NO: 4729008 - DNA, 14 bp, Homo sapiens
cagaatctccatcc

SEQ ID NO: 4729009 - DNA, 21 bp, Homo sapiens
cagaatggctatcaaaagaaa

SEQ ID NO: 4729010 - DNA, 22 bp, Homo sapiens
cagaatggctatcaaaagaaat

SEQ ID NO: 4729011 - DNA, 18 bp, Homo sapiens
cagaatggggtgcatgaa

SEQ ID NO: 4729012 - DNA, 15 bp, Homo sapiens
cagacacaggcccgg

SEQ ID NO: 4729013 - DNA, 18 bp, Homo sapiens
cagacacaggcccggctc

SEQ ID NO: 4729014 - DNA, 22 bp, Homo sapiens
cagacacaggcccggctccagg

SEQ ID NO: 4729015 - DNA, 14 bp, Homo sapiens
cagacacatgtcca

SEQ ID NO: 4729016 - DNA, 22 bp, Homo sapiens
cagacacatgtccaagaagccc

SEQ ID NO: 4729017 - DNA, 23 bp, Homo sapiens
cagacacatgtccaagaagccca

SEQ ID NO: 4729018 - DNA, 21 bp, Homo sapiens
cagacagccccctgccccgca

SEQ ID NO: 4729019 - DNA, 14 bp, Homo sapiens
cagacagccctcca

SEQ ID NO: 4729020 - DNA, 14 bp, Homo sapiens
cagacagctgcctg

SEQ ID NO: 4729021 - DNA, 15 bp, Homo sapiens
cagacagctgcctgg

SEQ ID NO: 4729022 - DNA, 18 bp, Homo sapiens
cagacagctgcctgggat

SEQ ID NO: 4729023 - DNA, 21 bp, Homo sapiens
cagacaggcaagcacctcctg

SEQ ID NO: 4729024 - DNA, 22 bp, Homo sapiens
cagacaggcaagcacctcctgc

SEQ ID NO: 4729025 - DNA, 17 bp, Homo sapiens
cagacatgaaataaaag

SEQ ID NO: 4729026 - DNA, 17 bp, Homo sapiens
cagacattatgtaaaag

SEQ ID NO: 4729027 - DNA, 12 bp, Homo sapiens
cagacccggctg

SEQ ID NO: 4729028 - DNA, 13 bp, Homo sapiens
cagaccctgccct

SEQ ID NO: 4729029 - DNA, 14 bp, Homo sapiens
cagaccctgccctg

SEQ ID NO: 4729030 - DNA, 21 bp, Homo sapiens
cagaccctgccctgtgggccc

SEQ ID NO: 4729031 - DNA, 22 bp, Homo sapiens
cagactaagccagcaccggacc

SEQ ID NO: 4729032 - DNA, 18 bp, Homo sapiens
cagactctacagaggcca

SEQ ID NO: 4729033 - DNA, 19 bp, Homo sapiens
cagactctacagaggccat

SEQ ID NO: 4729034 - DNA, 14 bp, Homo sapiens
cagactggaagcac

SEQ ID NO: 4729035 - DNA, 21 bp, Homo sapiens
cagactggaagcacagcttca

SEQ ID NO: 4729036 - DNA, 13 bp, Homo sapiens
cagagaaaatgaa

SEQ ID NO: 4729037 - DNA, 15 bp, Homo sapiens
cagagaaaatgaatt

SEQ ID NO: 4729038 - DNA, 17 bp, Homo sapiens
cagagaaaatgaatttg

SEQ ID NO: 4729039 - DNA, 20 bp, Homo sapiens
cagagaatgaaagggcccag

SEQ ID NO: 4729040 - DNA, 23 bp, Homo sapiens
cagagacactgttgataaaaact

SEQ ID NO: 4729041 - DNA, 14 bp, Homo sapiens
cagagaccatccct

SEQ ID NO: 4729042 - DNA, 18 bp, Homo sapiens
cagagaccatccctgaag

SEQ ID NO: 4729043 - DNA, 19 bp, Homo sapiens
cagagaccatccctgaagg

SEQ ID NO: 4729044 - DNA, 18 bp, Homo sapiens
cagagacctcctgcctcc

SEQ ID NO: 4729045 - DNA, 13 bp, Homo sapiens
cagagactcctgc

SEQ ID NO: 4729046 - DNA, 15 bp, Homo sapiens
cagagactcctgcag

SEQ ID NO: 4729047 - DNA, 19 bp, Homo sapiens
cagagactcctgcaggcag

SEQ ID NO: 4729048 - DNA, 20 bp, Homo sapiens
cagagactcctgcaggcagc

SEQ ID NO: 4729049 - DNA, 15 bp, Homo sapiens
cagagacttgggaca

SEQ ID NO: 4729050 - DNA, 18 bp, Homo sapiens
cagagagccattttgtga

SEQ ID NO: 4729051 - DNA, 19 bp, Homo sapiens
cagagagccattttgtgaa

SEQ ID NO: 4729052 - DNA, 20 bp, Homo sapiens
cagagagccattttgtgaat

SEQ ID NO: 4729053 - DNA, 21 bp, Homo sapiens
cagagagccattttgtgaatg

SEQ ID NO: 4729054 - DNA, 18 bp, Homo sapiens
cagagaggacaaaataaa

SEQ ID NO: 4729055 - DNA, 21 bp, Homo sapiens
cagagagggcaggcatgaagt

SEQ ID NO: 4729056 - DNA, 22 bp, Homo sapiens
cagagatcctacttctctgagt

SEQ ID NO: 4729057 - DNA, 22 bp, Homo sapiens
cagagcaccttagacagtccct

SEQ ID NO: 4729058 - DNA, 11 bp, Homo sapiens
cagagcagaga

SEQ ID NO: 4729059 - DNA, 15 bp, Homo sapiens
cagagcagagaccat

SEQ ID NO: 4729060 - DNA, 20 bp, Homo sapiens
cagagcccaccttggctcaa

SEQ ID NO: 4729061 - DNA, 19 bp, Homo sapiens
cagagcccacgcccccact

SEQ ID NO: 4729062 - DNA, 23 bp, Homo sapiens
cagagcgggctcgaagaaaataa

SEQ ID NO: 4729063 - DNA, 16 bp, Homo sapiens
cagagctacttgggcc

SEQ ID NO: 4729064 - DNA, 15 bp, Homo sapiens
cagagctctgaccca

SEQ ID NO: 4729065 - DNA, 13 bp, Homo sapiens
cagagctgcacag

SEQ ID NO: 4729066 - DNA, 16 bp, Homo sapiens
cacagcccacgtcctg

SEQ ID NO: 4729067 - DNA, 11 bp, Homo sapiens
cacagccctcc

SEQ ID NO: 4729068 - DNA, 14 bp, Homo sapiens
cacagcctcccctg

SEQ ID NO: 4729069 - DNA, 22 bp, Homo sapiens
cacagctaagatgccatgtgca

SEQ ID NO: 4729070 - DNA, 20 bp, Homo sapiens
cacagctctgtcctgggagt

SEQ ID NO: 4729071 - DNA, 23 bp, Homo sapiens
cacagctctgtcctgggagtgag

SEQ ID NO: 4729072 - DNA, 15 bp, Homo sapiens
cacagctcttctcca

SEQ ID NO: 4729073 - DNA, 13 bp, Homo sapiens
cacagctcttgtt

SEQ ID NO: 4729074 - DNA, 22 bp, Homo sapiens
cacagctgctcaataaagtaca

SEQ ID NO: 4729075 - DNA, 12 bp, Homo sapiens
cacagctgctgg

SEQ ID NO: 4729076 - DNA, 18 bp, Homo sapiens
cacagcttatggcatctc

SEQ ID NO: 4729077 - DNA, 15 bp, Homo sapiens
cacaggacatttctc

SEQ ID NO: 4729078 - DNA, 12 bp, Homo sapiens
cacaggatcagt

SEQ ID NO: 4729079 - DNA, 16 bp, Homo sapiens
cacaggatcagtctga

SEQ ID NO: 4729080 - DNA, 10 bp, Homo sapiens
cacaggcagg

SEQ ID NO: 4729081 - DNA, 14 bp, Homo sapiens
cacaggcaggtcca

SEQ ID NO: 4729082 - DNA, 19 bp, Homo sapiens
cacaggcccggctccaggc

SEQ ID NO: 4729083 - DNA, 13 bp, Homo sapiens
cacaggcctgaga

SEQ ID NO: 4729084 - DNA, 14 bp, Homo sapiens
cacaggcctgagat

SEQ ID NO: 4729085 - DNA, 22 bp, Homo sapiens
cacaggcctgagatttcatctg

SEQ ID NO: 4729086 - DNA, 23 bp, Homo sapiens
cacaggcctgagatttcatctgc

SEQ ID NO: 4729087 - DNA, 21 bp, Homo sapiens
cacagggcctttggcaggtgc

SEQ ID NO: 4729088 - DNA, 18 bp, Homo sapiens
cacagtattacttctgct

SEQ ID NO: 4729089 - DNA, 22 bp, Homo sapiens
cacagtccttaccagcagagca

SEQ ID NO: 4729090 - DNA, 19 bp, Homo sapiens
cacagtgactcgggctcct

SEQ ID NO: 4729091 - DNA, 21 bp, Homo sapiens
cacagtgactcgggctcctgt

SEQ ID NO: 4729092 - DNA, 19 bp, Homo sapiens
cacagtggaaccagcccag

SEQ ID NO: 4729093 - DNA, 16 bp, Homo sapiens
cacagtggagagggct

SEQ ID NO: 4729094 - DNA, 17 bp, Homo sapiens
cacagtggagagggcta

SEQ ID NO: 4729095 - DNA, 20 bp, Homo sapiens
cacagtgtctgggctgactg

SEQ ID NO: 4729096 - DNA, 21 bp, Homo sapiens
cacagtgtgtggtcaacattt

SEQ ID NO: 4729097 - DNA, 23 bp, Homo sapiens
cacagtgtgtggtcaacatttct

SEQ ID NO: 4729098 - DNA, 17 bp, Homo sapiens
cacagtgttggcgagag

SEQ ID NO: 4729099 - DNA, 18 bp, Homo sapiens
cacagtttcttctgtaaa

SEQ ID NO: 4729100 - DNA, 14 bp, Homo sapiens
cacatatctgtcat

SEQ ID NO: 4729101 - DNA, 24 bp, Homo sapiens
cacatcagctccactttcagtgaa

SEQ ID NO: 4729102 - DNA, 22 bp, Homo sapiens
cacatctaaattgatcattcat

SEQ ID NO: 4729103 - DNA, 23 bp, Homo sapiens
cacatctgtgtcttgtttggaat

SEQ ID NO: 4729104 - DNA, 15 bp, Homo sapiens
cacatctgttttgta

SEQ ID NO: 4729105 - DNA, 14 bp, Homo sapiens
cacatcttgctctg

SEQ ID NO: 4729106 - DNA, 15 bp, Homo sapiens
cacatcttgctctgc

SEQ ID NO: 4729107 - DNA, 21 bp, Homo sapiens
cacatcttgctctgctgacag

SEQ ID NO: 4729108 - DNA, 13 bp, Homo sapiens
cacatcttggcac

SEQ ID NO: 4729109 - DNA, 13 bp, Homo sapiens
cacatgagcatca

SEQ ID NO: 4729110 - DNA, 17 bp, Homo sapiens
cacatgagcatcaggcc

SEQ ID NO: 4729111 - DNA, 18 bp, Homo sapiens
cacatgagcatcaggcca

SEQ ID NO: 4729112 - DNA, 20 bp, Homo sapiens
cacatgagcatcaggccagg

SEQ ID NO: 4729113 - DNA, 21 bp, Homo sapiens
cacatgagcatcaggccaggc

SEQ ID NO: 4729114 - DNA, 18 bp, Homo sapiens
cacatgcacgtgtgtgca

SEQ ID NO: 4729115 - DNA, 18 bp, Homo sapiens
cacatgcggagaacaaat

SEQ ID NO: 4729116 - DNA, 18 bp, Homo sapiens
cacatggctatgttttag

SEQ ID NO: 4729117 - DNA, 21 bp, Homo sapiens
atggacggtgctccaggcagg

SEQ ID NO: 4729118 - DNA, 15 bp, Homo sapiens
atggacttggggcct

SEQ ID NO: 4729119 - DNA, 17 bp, Homo sapiens
atggacttggggcctct

SEQ ID NO: 4729120 - DNA, 11 bp, Homo sapiens
atggactttgt

SEQ ID NO: 4729121 - DNA, 16 bp, Homo sapiens
atggagggtttagtgc

SEQ ID NO: 4729122 - DNA, 21 bp, Homo sapiens
atggagtgagacccaggagcc

SEQ ID NO: 4729123 - DNA, 13 bp, Homo sapiens
atggagtgtttga

SEQ ID NO: 4729124 - DNA, 22 bp, Homo sapiens
atggatatgtgtaaatgttatg

SEQ ID NO: 4729125 - DNA, 15 bp, Homo sapiens
atggattggattatt

SEQ ID NO: 4729126 - DNA, 15 bp, Homo sapiens
atggattggtaagat

SEQ ID NO: 4729127 - DNA, 18 bp, Homo sapiens
atggattggtaagatgtc

SEQ ID NO: 4729128 - DNA, 20 bp, Homo sapiens
atggatttaatccattttta

SEQ ID NO: 4729129 - DNA, 18 bp, Homo sapiens
atggatttcttagagatt

SEQ ID NO: 4729130 - DNA, 17 bp, Homo sapiens
atggatttggttatgat

SEQ ID NO: 4729131 - DNA, 22 bp, Homo sapiens
atggatttggttatgatggaaa

SEQ ID NO: 4729132 - DNA, 19 bp, Homo sapiens
atggcaaataaacagtttg

SEQ ID NO: 4729133 - DNA, 23 bp, Homo sapiens
atggcacagcccaaagaaggaaa

SEQ ID NO: 4729134 - DNA, 17 bp, Homo sapiens
atggcagaagacaccag

SEQ ID NO: 4729135 - DNA, 21 bp, Homo sapiens
atggcagaagacaccagagca

SEQ ID NO: 4729136 - DNA, 21 bp, Homo sapiens
atggcagaaggcaaacccatc

SEQ ID NO: 4729137 - DNA, 17 bp, Homo sapiens
atggcatccctttttca

SEQ ID NO: 4729138 - DNA, 13 bp, Homo sapiens
atggccctgctgc

SEQ ID NO: 4729139 - DNA, 15 bp, Homo sapiens
atggccctgctgccc

SEQ ID NO: 4729140 - DNA, 19 bp, Homo sapiens
atggccctgctgcccctcc

SEQ ID NO: 4729141 - DNA, 20 bp, Homo sapiens
atggccctgctgcccctccc

SEQ ID NO: 4729142 - DNA, 17 bp, Homo sapiens
atggctatcaaaagaaa

SEQ ID NO: 4729143 - DNA, 18 bp, Homo sapiens
atggctatcaaaagaaat

SEQ ID NO: 4729144 - DNA, 16 bp, Homo sapiens
atggcttccaaggtgg

SEQ ID NO: 4729145 - DNA, 16 bp, Homo sapiens
atgggattgtgttaaa

SEQ ID NO: 4729146 - DNA, 23 bp, Homo sapiens
atgggcaactggctgaaaggtta

SEQ ID NO: 4729147 - DNA, 15 bp, Homo sapiens
atgggcctcctgtgt

SEQ ID NO: 4729148 - DNA, 17 bp, Homo sapiens
atgggcctcctgtgtgt

SEQ ID NO: 4729149 - DNA, 23 bp, Homo sapiens
atgggctgggttctacccaggtg

SEQ ID NO: 4729150 - DNA, 20 bp, Homo sapiens
atgggcttcactgtataaat

SEQ ID NO: 4729151 - DNA, 20 bp, Homo sapiens
atgggcttttacctgtgcac

SEQ ID NO: 4729152 - DNA, 23 bp, Homo sapiens
atggggagtgagtgatcactggt

SEQ ID NO: 4729153 - DNA, 14 bp, Homo sapiens
atggggccctgcct

SEQ ID NO: 4729154 - DNA, 20 bp, Homo sapiens
atggggccctgcctcctttg

SEQ ID NO: 4729155 - DNA, 11 bp, Homo sapiens
atgggggaaag

SEQ ID NO: 4729156 - DNA, 16 bp, Homo sapiens
atgggggaaagcacag

SEQ ID NO: 4729157 - DNA, 22 bp, Homo sapiens
atgggggaaagcacaggtgggc

SEQ ID NO: 4729158 - DNA, 13 bp, Homo sapiens
atgggtcgggaga

SEQ ID NO: 4729159 - DNA, 21 bp, Homo sapiens
atgggtgcttggaggaaggaa

SEQ ID NO: 4729160 - DNA, 17 bp, Homo sapiens
atggtactaaggagaat

SEQ ID NO: 4729161 - DNA, 18 bp, Homo sapiens
atggtccaggagaaggcc

SEQ ID NO: 4729162 - DNA, 19 bp, Homo sapiens
atggtccaggagaaggcca

SEQ ID NO: 4729163 - DNA, 17 bp, Homo sapiens
atggtgatgaaatgtaa

SEQ ID NO: 4729164 - DNA, 9 bp, Homo sapiens
atggtgcct

SEQ ID NO: 4729165 - DNA, 22 bp, Homo sapiens
atggtgcctgattcggctgtct

SEQ ID NO: 4729166 - DNA, 17 bp, Homo sapiens
atggtgctgcagatttg

SEQ ID NO: 4729167 - DNA, 15 bp, Homo sapiens
atggtggctgggttg

SEQ ID NO: 4729168 - DNA, 17 bp, Homo sapiens
atggtggctgggttgga

SEQ ID NO: 4729169 - DNA, 18 bp, Homo sapiens
atggtgtaataagacata

SEQ ID NO: 4729170 - DNA, 17 bp, Homo sapiens
atggtgtgtgtctctga

SEQ ID NO: 4729171 - DNA, 21 bp, Homo sapiens
atggtttgaatataaacacta

SEQ ID NO: 4729172 - DNA, 17 bp, Homo sapiens
atggtttgcaaggaagc

SEQ ID NO: 4729173 - DNA, 19 bp, Homo sapiens
atgtaaaaatacactaatg

SEQ ID NO: 4729174 - DNA, 14 bp, Homo sapiens
atgtaaaagaaaat

SEQ ID NO: 4729175 - DNA, 17 bp, Homo sapiens
atgtaaaatcttcagct

SEQ ID NO: 4729176 - DNA, 19 bp, Homo sapiens
atgtaaaggtatattgtga

SEQ ID NO: 4729177 - DNA, 12 bp, Homo sapiens
atgtaattggaa

SEQ ID NO: 4729178 - DNA, 13 bp, Homo sapiens
atgtaattggaat

SEQ ID NO: 4729179 - DNA, 14 bp, Homo sapiens
atgtaattggaatc

SEQ ID NO: 4729180 - DNA, 15 bp, Homo sapiens
atgtacaaggtatgt

SEQ ID NO: 4729181 - DNA, 17 bp, Homo sapiens
atgtacagctggtgctt

SEQ ID NO: 4729182 - DNA, 15 bp, Homo sapiens
atgtacagttcataa

SEQ ID NO: 4729183 - DNA, 22 bp, Homo sapiens
atgtactctactgatatctaaa

SEQ ID NO: 4729184 - DNA, 16 bp, Homo sapiens
atgtacttatattaag

SEQ ID NO: 4729185 - DNA, 16 bp, Homo sapiens
atgtagaaattcttca

SEQ ID NO: 4729186 - DNA, 13 bp, Homo sapiens
atgtagaagctgc

SEQ ID NO: 4729187 - DNA, 16 bp, Homo sapiens
atgtagattagtgatc

SEQ ID NO: 4729188 - DNA, 16 bp, Homo sapiens
atgtagccatgggacc

SEQ ID NO: 4729189 - DNA, 13 bp, Homo sapiens
atgtataaattaa

SEQ ID NO: 4729190 - DNA, 14 bp, Homo sapiens
atgtataatatttt

SEQ ID NO: 4729191 - DNA, 20 bp, Homo sapiens
atgtatattaaaaaagagac

SEQ ID NO: 4729192 - DNA, 21 bp, Homo sapiens
atgtatattaaaaaagagaca

SEQ ID NO: 4729193 - DNA, 15 bp, Homo sapiens
atgtatgctttgaat

SEQ ID NO: 4729194 - DNA, 18 bp, Homo sapiens
atgtatgtgccaattttg

SEQ ID NO: 4729195 - DNA, 18 bp, Homo sapiens
atgtattagccagtcatt

SEQ ID NO: 4729196 - DNA, 14 bp, Homo sapiens
atgtattgataaga

SEQ ID NO: 4729197 - DNA, 17 bp, Homo sapiens
atgtattgttttactcc

SEQ ID NO: 4729198 - DNA, 13 bp, Homo sapiens
atgtcacaggcag

SEQ ID NO: 4729199 - DNA, 19 bp, Homo sapiens
atgtcacaggcaggtccag

SEQ ID NO: 4729200 - DNA, 20 bp, Homo sapiens
atgtcagcaaatgtaaaaat

SEQ ID NO: 4729201 - DNA, 12 bp, Homo sapiens
atgtcatttctc

SEQ ID NO: 4729202 - DNA, 20 bp, Homo sapiens
atgtccctgaagtcttgcat

SEQ ID NO: 4729203 - DNA, 20 bp, Homo sapiens
atgtcctatgtatatcttct

SEQ ID NO: 4729204 - DNA, 17 bp, Homo sapiens
atgtcctcaaagaagtg

SEQ ID NO: 4729205 - DNA, 17 bp, Homo sapiens
atgtcctcaccacatgc

SEQ ID NO: 4729206 - DNA, 15 bp, Homo sapiens
atgtcctcctctgtg

SEQ ID NO: 4729207 - DNA, 15 bp, Homo sapiens
atgtcgctgggtcct

SEQ ID NO: 4729208 - DNA, 14 bp, Homo sapiens
atgtcgctgtaaat

SEQ ID NO: 4729209 - DNA, 23 bp, Homo sapiens
atgtcgtcaaagctgaaatggac

SEQ ID NO: 4729210 - DNA, 18 bp, Homo sapiens
atgtctaagaactctttg

SEQ ID NO: 4729211 - DNA, 19 bp, Homo sapiens
atgtctcgtggtaggactg

SEQ ID NO: 4729212 - DNA, 21 bp, Homo sapiens
atgtctctgtgagactcgaga

SEQ ID NO: 4729213 - DNA, 10 bp, Homo sapiens
atgtcttgtg

SEQ ID NO: 4729214 - DNA, 22 bp, Homo sapiens
atgtctttttattaaaatattt

SEQ ID NO: 4729215 - DNA, 22 bp, Homo sapiens
atgtgaaaatggtccaggagaa

SEQ ID NO: 4729216 - DNA, 13 bp, Homo sapiens
atgtgaaaccttt

SEQ ID NO: 4729217 - DNA, 16 bp, Homo sapiens
atgtgaagaaaaagac

SEQ ID NO: 4729218 - DNA, 18 bp, Homo sapiens
atgtgactttgcatcagc

SEQ ID NO: 4729219 - DNA, 21 bp, Homo sapiens
atgtgataatatattgctaaa

SEQ ID NO: 4729220 - DNA, 18 bp, Homo sapiens
atgtgatcatctttgctg

SEQ ID NO: 4729221 - DNA, 23 bp, Homo sapiens
atgtgatgtggcaggagggcagt

SEQ ID NO: 4729222 - DNA, 18 bp, Homo sapiens
atgtgcaatagaaggtga

SEQ ID NO: 4729223 - DNA, 23 bp, Homo sapiens
atgtgcacatgcacgtgtgtgca

SEQ ID NO: 4729224 - DNA, 14 bp, Homo sapiens
atgtgccaattttg

SEQ ID NO: 4729225 - DNA, 22 bp, Homo sapiens
atgtgccaggtttttggtctga

SEQ ID NO: 4729226 - DNA, 21 bp, Homo sapiens
atgtggaaaacatcctgactt

SEQ ID NO: 4729227 - DNA, 14 bp, Homo sapiens
atgttggccaggct

SEQ ID NO: 4729228 - DNA, 16 bp, Homo sapiens
atgttggccaggctgg

SEQ ID NO: 4729229 - DNA, 12 bp, Homo sapiens
atgttggctggg

SEQ ID NO: 4729230 - DNA, 18 bp, Homo sapiens
atgttggggtttttttaa

SEQ ID NO: 4729231 - DNA, 19 bp, Homo sapiens
atgttggggtttttttaag

SEQ ID NO: 4729232 - DNA, 20 bp, Homo sapiens
atgttggtgcaattaactct

SEQ ID NO: 4729233 - DNA, 17 bp, Homo sapiens
atgttgtttataataaa

SEQ ID NO: 4729234 - DNA, 15 bp, Homo sapiens
atgtttataaactga

SEQ ID NO: 4729235 - DNA, 17 bp, Homo sapiens
atgtttataaactgaga

SEQ ID NO: 4729236 - DNA, 14 bp, Homo sapiens
atgtttatttcagg

SEQ ID NO: 4729237 - DNA, 15 bp, Homo sapiens
atgtttgcctctgcc

SEQ ID NO: 4729238 - DNA, 16 bp, Homo sapiens
atgttttccagctcct

SEQ ID NO: 4729239 - DNA, 18 bp, Homo sapiens
atgttttccagctcctca

SEQ ID NO: 4729240 - DNA, 14 bp, Homo sapiens
atgttttccatgag

SEQ ID NO: 4729241 - DNA, 18 bp, Homo sapiens
atgttttctgaaaatata

SEQ ID NO: 4729242 - DNA, 20 bp, Homo sapiens
atgttttctgaaaatataac

SEQ ID NO: 4729243 - DNA, 21 bp, Homo sapiens
atgttttgagacataaatgtt

SEQ ID NO: 4729244 - DNA, 16 bp, Homo sapiens
attaaaaaagagacat

SEQ ID NO: 4729245 - DNA, 11 bp, Homo sapiens
attaaaagact

SEQ ID NO: 4729246 - DNA, 12 bp, Homo sapiens
attaaaagactc

SEQ ID NO: 4729247 - DNA, 17 bp, Homo sapiens
attaaaagactccacat

SEQ ID NO: 4729248 - DNA, 12 bp, Homo sapiens
attaaaatattt

SEQ ID NO: 4729249 - DNA, 19 bp, Homo sapiens
attaaaattgccattttat

SEQ ID NO: 4729250 - DNA, 18 bp, Homo sapiens
attaaacttcttttctct

SEQ ID NO: 4729251 - DNA, 15 bp, Homo sapiens
attaaagactccagt

SEQ ID NO: 4729252 - DNA, 17 bp, Homo sapiens
attaaatgcccagcccc

SEQ ID NO: 4729253 - DNA, 24 bp, Homo sapiens
attaaattctctctaacataacaa

SEQ ID NO: 4729254 - DNA, 14 bp, Homo sapiens
attaacaaatgctc

SEQ ID NO: 4729255 - DNA, 13 bp, Homo sapiens
attaacctctcac

SEQ ID NO: 4729256 - DNA, 14 bp, Homo sapiens
attaagaagaaaat

SEQ ID NO: 4729257 - DNA, 17 bp, Homo sapiens
attaagaatagtctctg

SEQ ID NO: 4729258 - DNA, 17 bp, Homo sapiens
attaagccacttaaaat

SEQ ID NO: 4729259 - DNA, 15 bp, Homo sapiens
attaaggcagtatga

SEQ ID NO: 4729260 - DNA, 17 bp, Homo sapiens
attaatcttttatattg

SEQ ID NO: 4729261 - DNA, 14 bp, Homo sapiens
attaatgaagttga

SEQ ID NO: 4729262 - DNA, 15 bp, Homo sapiens
attaatggaaatgtt

SEQ ID NO: 4729263 - DNA, 13 bp, Homo sapiens
attaatttgaaac

SEQ ID NO: 4729264 - DNA, 13 bp, Homo sapiens
attaatttgtgaa

SEQ ID NO: 4729265 - DNA, 13 bp, Homo sapiens
attacaaagttaa

SEQ ID NO: 4729266 - DNA, 22 bp, Homo sapiens
attacacagtcaaatttacatt

SEQ ID NO: 4729267 - DNA, 16 bp, Homo sapiens
attacaggctcctgcc

SEQ ID NO: 4729268 - DNA, 13 bp, Homo sapiens
attacaggtgtga

SEQ ID NO: 4729269 - DNA, 16 bp, Homo sapiens
attacaggtgtgaacc

SEQ ID NO: 4729270 - DNA, 13 bp, Homo sapiens
attaccaaaacag

SEQ ID NO: 4729271 - DNA, 21 bp, Homo sapiens
attaccaagcgcttctttctg

SEQ ID NO: 4729272 - DNA, 13 bp, Homo sapiens
attacctcctgag

SEQ ID NO: 4729273 - DNA, 17 bp, Homo sapiens
attacctcctgagaaaa

SEQ ID NO: 4729274 - DNA, 16 bp, Homo sapiens
attacctgtggatatt

SEQ ID NO: 4729275 - DNA, 13 bp, Homo sapiens
attactgtttgtc

SEQ ID NO: 4729276 - DNA, 14 bp, Homo sapiens
attacttctgctac

SEQ ID NO: 4729277 - DNA, 17 bp, Homo sapiens
attacttgcctatctga

SEQ ID NO: 4729278 - DNA, 12 bp, Homo sapiens
attactttacca

SEQ ID NO: 4729279 - DNA, 22 bp, Homo sapiens
attacttttaaaaatgtagaaa

SEQ ID NO: 4729280 - DNA, 19 bp, Homo sapiens
attactttttaaaatgttg

SEQ ID NO: 4729281 - DNA, 22 bp, Homo sapiens
attagaaattacctgtggatat

SEQ ID NO: 4729282 - DNA, 16 bp, Homo sapiens
attagagtgtctttcc

SEQ ID NO: 4729283 - DNA, 23 bp, Homo sapiens
attagagtgtctttccacggagc

SEQ ID NO: 4729284 - DNA, 22 bp, Homo sapiens
attagatcaattacttatttta

SEQ ID NO: 4729285 - DNA, 19 bp, Homo sapiens
attagatggaaaaatgtga

SEQ ID NO: 4729286 - DNA, 16 bp, Homo sapiens
attagattatttctgt

SEQ ID NO: 4729287 - DNA, 18 bp, Homo sapiens
attagattatttctgtat

SEQ ID NO: 4729288 - DNA, 17 bp, Homo sapiens
attagattttcctcctt

SEQ ID NO: 4729289 - DNA, 21 bp, Homo sapiens
attagattttcctcctttcct

SEQ ID NO: 4729290 - DNA, 14 bp, Homo sapiens
attagcagttgctc

SEQ ID NO: 4729291 - DNA, 20 bp, Homo sapiens
attagcagttgctcacatgt

SEQ ID NO: 4729292 - DNA, 19 bp, Homo sapiens
attagcatttgtcaacaaa

SEQ ID NO: 4729293 - DNA, 21 bp, Homo sapiens
attagccaggatcatggtgta

SEQ ID NO: 4729294 - DNA, 15 bp, Homo sapiens
attaggaagtgttta

SEQ ID NO: 4729295 - DNA, 14 bp, Homo sapiens
attagtaaatatgt

SEQ ID NO: 4729296 - DNA, 22 bp, Homo sapiens
attataaaggataaagaaggat

SEQ ID NO: 4729297 - DNA, 15 bp, Homo sapiens
attataaatgacaac

SEQ ID NO: 4729298 - DNA, 17 bp, Homo sapiens
attataacttattagca

SEQ ID NO: 4729299 - DNA, 19 bp, Homo sapiens
attataccccctgcaaagc

SEQ ID NO: 4729300 - DNA, 21 bp, Homo sapiens
attatatttctacagagaaaa

SEQ ID NO: 4729301 - DNA, 15 bp, Homo sapiens
attatctacccacgt

SEQ ID NO: 4729302 - DNA, 17 bp, Homo sapiens
attatctcacttgtgcc

SEQ ID NO: 4729303 - DNA, 21 bp, Homo sapiens
attatgatgtgggtcaaggaa

SEQ ID NO: 4729304 - DNA, 15 bp, Homo sapiens
attatgtccattatt

SEQ ID NO: 4729305 - DNA, 16 bp, Homo sapiens
attatgttaatatttc

SEQ ID NO: 4729306 - DNA, 14 bp, Homo sapiens
attattaatcagaa

SEQ ID NO: 4729307 - DNA, 18 bp, Homo sapiens
attattaatcagaatatc

SEQ ID NO: 4729308 - DNA, 13 bp, Homo sapiens
attattcagtgtc

SEQ ID NO: 4729309 - DNA, 19 bp, Homo sapiens
attattccgtattacattt

SEQ ID NO: 4729310 - DNA, 21 bp, Homo sapiens
attattccgtattacattttt

SEQ ID NO: 4729311 - DNA, 19 bp, Homo sapiens
attattgtgatttcccgtg

SEQ ID NO: 4729312 - DNA, 21 bp, Homo sapiens
attatttaaatgtacttatat

SEQ ID NO: 4729313 - DNA, 14 bp, Homo sapiens
attatttaagacta

SEQ ID NO: 4729314 - DNA, 19 bp, Homo sapiens
attatttaagactaaaagt

SEQ ID NO: 4729315 - DNA, 14 bp, Homo sapiens
attatttaatttgt

SEQ ID NO: 4729316 - DNA, 16 bp, Homo sapiens
attatttgattattta

SEQ ID NO: 4729317 - DNA, 21 bp, Homo sapiens
attatttgattatttaagact

SEQ ID NO: 4729318 - DNA, 11 bp, Homo sapiens
attatttgcat

SEQ ID NO: 4729319 - DNA, 13 bp, Homo sapiens
attattttgttac

SEQ ID NO: 4729320 - DNA, 20 bp, Homo sapiens
attattttgttactgtctgt

SEQ ID NO: 4729321 - DNA, 22 bp, Homo sapiens
attcaacactcccttcccatga

SEQ ID NO: 4729322 - DNA, 15 bp, Homo sapiens
attcaagaaagatat

SEQ ID NO: 4729323 - DNA, 18 bp, Homo sapiens
attcaagaaagatatcta

SEQ ID NO: 4729324 - DNA, 16 bp, Homo sapiens
attcacatgttctaat

SEQ ID NO: 4729325 - DNA, 21 bp, Homo sapiens
attcacatttcaagatccaaa

SEQ ID NO: 4729326 - DNA, 17 bp, Homo sapiens
attcaccttttcttcaa

SEQ ID NO: 4729327 - DNA, 20 bp, Homo sapiens
attcactattggctgggagt

SEQ ID NO: 4729328 - DNA, 14 bp, Homo sapiens
attcactcagaaga

SEQ ID NO: 4729329 - DNA, 14 bp, Homo sapiens
attcagaactttag

SEQ ID NO: 4729330 - DNA, 17 bp, Homo sapiens
attcagaactttagtat

SEQ ID NO: 4729331 - DNA, 16 bp, Homo sapiens
attcagacagctgcct

SEQ ID NO: 4729332 - DNA, 12 bp, Homo sapiens
attcaggaagct

SEQ ID NO: 4729333 - DNA, 14 bp, Homo sapiens
attcaggaagctca

SEQ ID NO: 4729334 - DNA, 17 bp, Homo sapiens
attcaggaagctcaggg

SEQ ID NO: 4729335 - DNA, 21 bp, Homo sapiens
attcaggaagctcagggcctg

SEQ ID NO: 4729336 - DNA, 22 bp, Homo sapiens
attcaggaagctcagggcctgg

SEQ ID NO: 4729337 - DNA, 22 bp, Homo sapiens
attcagtaagtagcaaccctgt

SEQ ID NO: 4729338 - DNA, 14 bp, Homo sapiens
attcagtgaatttg

SEQ ID NO: 4729339 - DNA, 14 bp, Homo sapiens
attcagtgtcactg

SEQ ID NO: 4729340 - DNA, 19 bp, Homo sapiens
attcagtgttaaatgtgat

SEQ ID NO: 4729341 - DNA, 18 bp, Homo sapiens
attcataaagagaaaatg

SEQ ID NO: 4729342 - DNA, 20 bp, Homo sapiens
attcataaagagaaaatgat

SEQ ID NO: 4729343 - DNA, 17 bp, Homo sapiens
attcatattgcatcata

SEQ ID NO: 4729344 - DNA, 12 bp, Homo sapiens
attcatcaaata

SEQ ID NO: 4729345 - DNA, 19 bp, Homo sapiens
attcatcaaatggaagaca

SEQ ID NO: 4729346 - DNA, 14 bp, Homo sapiens
attcatgcctggct

SEQ ID NO: 4729347 - DNA, 22 bp, Homo sapiens
attcatgtttaacgtttctcat

SEQ ID NO: 4729348 - DNA, 13 bp, Homo sapiens
attcatgttttga

SEQ ID NO: 4729349 - DNA, 15 bp, Homo sapiens
attcattctttttga

SEQ ID NO: 4729350 - DNA, 16 bp, Homo sapiens
attcattctttttgaa

SEQ ID NO: 4729351 - DNA, 17 bp, Homo sapiens
attcattggttaacaat

SEQ ID NO: 4729352 - DNA, 17 bp, Homo sapiens
attccaagtgattgaaa

SEQ ID NO: 4729353 - DNA, 20 bp, Homo sapiens
attccactatttgcagaggc

SEQ ID NO: 4729354 - DNA, 23 bp, Homo sapiens
attccacttgttcattctgtgac

SEQ ID NO: 4729355 - DNA, 19 bp, Homo sapiens
attccagagcgtgtagtga

SEQ ID NO: 4729356 - DNA, 15 bp, Homo sapiens
attcccaagctctgc

SEQ ID NO: 4729357 - DNA, 16 bp, Homo sapiens
attcccaagctctgct

SEQ ID NO: 4729358 - DNA, 18 bp, Homo sapiens
attcccaagctctgctcc

SEQ ID NO: 4729359 - DNA, 20 bp, Homo sapiens
attccctagaaacttccaaa

SEQ ID NO: 4729360 - DNA, 21 bp, Homo sapiens
attcctgatgcttcttcagag

SEQ ID NO: 4729361 - DNA, 22 bp, Homo sapiens
attcctgggaaatattccctag

SEQ ID NO: 4729362 - DNA, 15 bp, Homo sapiens
attccttctttgata

SEQ ID NO: 4729363 - DNA, 17 bp, Homo sapiens
attccttctttgataat

SEQ ID NO: 4729364 - DNA, 15 bp, Homo sapiens
attcgaaatgagctc

SEQ ID NO: 4729365 - DNA, 21 bp, Homo sapiens
attctcaaagttaaaagtaaa

SEQ ID NO: 4729366 - DNA, 23 bp, Homo sapiens
attctcaaagttaaaagtaaaat

SEQ ID NO: 4729367 - DNA, 21 bp, Homo sapiens
attctcacctaaaccctctgt

SEQ ID NO: 4729368 - DNA, 23 bp, Homo sapiens
attctcacctaaaccctctgtga

SEQ ID NO: 4729369 - DNA, 14 bp, Homo sapiens
attctcatgcctca

SEQ ID NO: 4729370 - DNA, 17 bp, Homo sapiens
attctccacctgccagg

SEQ ID NO: 4729371 - DNA, 13 bp, Homo sapiens
attctccttcagc

SEQ ID NO: 4729372 - DNA, 15 bp, Homo sapiens
attctccttcagccc

SEQ ID NO: 4729373 - DNA, 17 bp, Homo sapiens
attctccttcagccctc

SEQ ID NO: 4729374 - DNA, 16 bp, Homo sapiens
attctgacccagggcc

SEQ ID NO: 4729375 - DNA, 17 bp, Homo sapiens
attctgacccagggcct

SEQ ID NO: 4729376 - DNA, 17 bp, Homo sapiens
attctgataatgtattg

SEQ ID NO: 4729377 - DNA, 18 bp, Homo sapiens
attctgatgttactgaga

SEQ ID NO: 4729378 - DNA, 14 bp, Homo sapiens
attctgatttgtat

SEQ ID NO: 4729379 - DNA, 20 bp, Homo sapiens
attctgatttgtattaaaat

SEQ ID NO: 4729380 - DNA, 20 bp, Homo sapiens
attctgcctgcccaggcccc

SEQ ID NO: 4729381 - DNA, 22 bp, Homo sapiens
attctgctcacatatctgtcat

SEQ ID NO: 4729382 - DNA, 17 bp, Homo sapiens
attctggcctagtccct

SEQ ID NO: 4729383 - DNA, 23 bp, Homo sapiens
attctggcctagtcccttccaca

SEQ ID NO: 4729384 - DNA, 14 bp, Homo sapiens
attctgtctttcaa

SEQ ID NO: 4729385 - DNA, 17 bp, Homo sapiens
attctgtctttcaaaag

SEQ ID NO: 4729386 - DNA, 19 bp, Homo sapiens
attctgttctacttgatat

SEQ ID NO: 4729387 - DNA, 19 bp, Homo sapiens
attctgttggccagtgtga

SEQ ID NO: 4729388 - DNA, 19 bp, Homo sapiens
attcttaaagtacttgtta

SEQ ID NO: 4729389 - DNA, 22 bp, Homo sapiens
attcttactaaaaagtataaaa

SEQ ID NO: 4729390 - DNA, 14 bp, Homo sapiens
attcttatgttatc

SEQ ID NO: 4729391 - DNA, 14 bp, Homo sapiens
attcttccttttat

SEQ ID NO: 4729392 - DNA, 14 bp, Homo sapiens
attcttctgcttca

SEQ ID NO: 4729393 - DNA, 20 bp, Homo sapiens
attcttctgcttcagcctcc

SEQ ID NO: 4729394 - DNA, 17 bp, Homo sapiens
attcttgccaaatataa

SEQ ID NO: 4729395 - DNA, 17 bp, Homo sapiens
attcttggttgaggaaa

SEQ ID NO: 4729396 - DNA, 18 bp, Homo sapiens
attcttggttgaggaaac

SEQ ID NO: 4729397 - DNA, 13 bp, Homo sapiens
attctttcctgag

SEQ ID NO: 4729398 - DNA, 19 bp, Homo sapiens
attctttctattttcacaa

SEQ ID NO: 4729399 - DNA, 20 bp, Homo sapiens
attctttctattttcacaat

SEQ ID NO: 4729400 - DNA, 14 bp, Homo sapiens
attcttttccagaa

SEQ ID NO: 4729401 - DNA, 13 bp, Homo sapiens
attgaaagaactt

SEQ ID NO: 4729402 - DNA, 19 bp, Homo sapiens
attgaattattttgttact

SEQ ID NO: 4729403 - DNA, 20 bp, Homo sapiens
attgaattcttggttgagga

SEQ ID NO: 4729404 - DNA, 23 bp, Homo sapiens
attgaattcttggttgaggaaac

SEQ ID NO: 4729405 - DNA, 16 bp, Homo sapiens
attgaatttagtcatt

SEQ ID NO: 4729406 - DNA, 17 bp, Homo sapiens
attgaccatgtgattat

SEQ ID NO: 4729407 - DNA, 15 bp, Homo sapiens
attgagcgtgattct

SEQ ID NO: 4729408 - DNA, 13 bp, Homo sapiens
attgatgttttca

SEQ ID NO: 4729409 - DNA, 16 bp, Homo sapiens
attgatgttttcatag

SEQ ID NO: 4729410 - DNA, 20 bp, Homo sapiens
attgatttctgccttccttg

SEQ ID NO: 4729411 - DNA, 13 bp, Homo sapiens
attgattttgaac

SEQ ID NO: 4729412 - DNA, 23 bp, Homo sapiens
attgcaaaatgcgtatttgcatt

SEQ ID NO: 4729413 - DNA, 12 bp, Homo sapiens
attgcaatagaa

SEQ ID NO: 4729414 - DNA, 22 bp, Homo sapiens
attgcagatttctgccttgaaa

SEQ ID NO: 4729415 - DNA, 17 bp, Homo sapiens
attgcagtctaaaactt

SEQ ID NO: 4729416 - DNA, 22 bp, Homo sapiens
attgcagtctaaaacttcaaaa

SEQ ID NO: 4729417 - DNA, 15 bp, Homo sapiens
attgcatctcccaga

SEQ ID NO: 4729418 - DNA, 13 bp, Homo sapiens
attgcattcattg

SEQ ID NO: 4729419 - DNA, 17 bp, Homo sapiens
attgcattcattgactt

SEQ ID NO: 4729420 - DNA, 18 bp, Homo sapiens
attgccattttattaaac

SEQ ID NO: 4729421 - DNA, 15 bp, Homo sapiens
attgccccatgagac

SEQ ID NO: 4729422 - DNA, 21 bp, Homo sapiens
attgcgagagatgtgtgttga

SEQ ID NO: 4729423 - DNA, 19 bp, Homo sapiens
attgcggacagccacggcc

SEQ ID NO: 4729424 - DNA, 14 bp, Homo sapiens
attgctactgtcct

SEQ ID NO: 4729425 - DNA, 19 bp, Homo sapiens
attgctccattttcttgtc

SEQ ID NO: 4729426 - DNA, 20 bp, Homo sapiens
attgctgccccatcagtgct

SEQ ID NO: 4729427 - DNA, 18 bp, Homo sapiens
attggaactggaggcagg

SEQ ID NO: 4729428 - DNA, 18 bp, Homo sapiens
attggaatgggcagctca

SEQ ID NO: 4729429 - DNA, 14 bp, Homo sapiens
attggacccttcca

SEQ ID NO: 4729430 - DNA, 22 bp, Homo sapiens
attggagaagtaatcctaggga

SEQ ID NO: 4729431 - DNA, 21 bp, Homo sapiens
attggatatttgatatttggt

SEQ ID NO: 4729432 - DNA, 16 bp, Homo sapiens
attggattatttaata

SEQ ID NO: 4729433 - DNA, 13 bp, Homo sapiens
attggctcacact

SEQ ID NO: 4729434 - DNA, 21 bp, Homo sapiens
attggctcacactgagaatgt

SEQ ID NO: 4729435 - DNA, 13 bp, Homo sapiens
attggtaattaaa

SEQ ID NO: 4729436 - DNA, 14 bp, Homo sapiens
attggtaattaaaa

SEQ ID NO: 4729437 - DNA, 23 bp, Homo sapiens
attggtttgttattcttttccag

SEQ ID NO: 4729438 - DNA, 20 bp, Homo sapiens
attgtaaaaaaaaatgcctt

SEQ ID NO: 4729439 - DNA, 13 bp, Homo sapiens
attgtaaatactg

SEQ ID NO: 4729440 - DNA, 17 bp, Homo sapiens
attgtaaatctgaagaa

SEQ ID NO: 4729441 - DNA, 20 bp, Homo sapiens
attgtaaatctgaagaaagt

SEQ ID NO: 4729442 - DNA, 13 bp, Homo sapiens
attgtattaacgc

SEQ ID NO: 4729443 - DNA, 15 bp, Homo sapiens
attgtattacaaatc

SEQ ID NO: 4729444 - DNA, 17 bp, Homo sapiens
attgtatttatgtatgt

SEQ ID NO: 4729445 - DNA, 17 bp, Homo sapiens
attgtccccgacccttg

SEQ ID NO: 4729446 - DNA, 15 bp, Homo sapiens
attgtgctcagagac

SEQ ID NO: 4729447 - DNA, 13 bp, Homo sapiens
attgtgggaaggg

SEQ ID NO: 4729448 - DNA, 14 bp, Homo sapiens
attgtgggaagggg

SEQ ID NO: 4729449 - DNA, 19 bp, Homo sapiens
attgttacgtagcctaagg

SEQ ID NO: 4729450 - DNA, 17 bp, Homo sapiens
ataaattatttgattat

SEQ ID NO: 4729451 - DNA, 19 bp, Homo sapiens
ataaattttttttgtttca

SEQ ID NO: 4729452 - DNA, 14 bp, Homo sapiens
ataacaatgaaagt

SEQ ID NO: 4729453 - DNA, 14 bp, Homo sapiens
ataacacacagcta

SEQ ID NO: 4729454 - DNA, 19 bp, Homo sapiens
ataacattaccttactgtg

SEQ ID NO: 4729455 - DNA, 22 bp, Homo sapiens
ataacattttgtttatgttact

SEQ ID NO: 4729456 - DNA, 20 bp, Homo sapiens
ataaccaaagcccaaagtgg

SEQ ID NO: 4729457 - DNA, 20 bp, Homo sapiens
ataactctgctgaatgtaaa

SEQ ID NO: 4729458 - DNA, 14 bp, Homo sapiens
ataagaagaagaga

SEQ ID NO: 4729459 - DNA, 23 bp, Homo sapiens
ataagacaaatattcctttgcat

SEQ ID NO: 4729460 - DNA, 23 bp, Homo sapiens
ataagacataacgtttttccttt

SEQ ID NO: 4729461 - DNA, 14 bp, Homo sapiens
ataagattatatgg

SEQ ID NO: 4729462 - DNA, 15 bp, Homo sapiens
ataagctattttggt

SEQ ID NO: 4729463 - DNA, 15 bp, Homo sapiens
ataagggcagagtca

SEQ ID NO: 4729464 - DNA, 16 bp, Homo sapiens
ataagtccattaactg

SEQ ID NO: 4729465 - DNA, 19 bp, Homo sapiens
ataagtccattaactgctt

SEQ ID NO: 4729466 - DNA, 20 bp, Homo sapiens
ataagtgacaccaataaatg

SEQ ID NO: 4729467 - DNA, 14 bp, Homo sapiens
ataatatttttaat

SEQ ID NO: 4729468 - DNA, 19 bp, Homo sapiens
ataatcagtatatttggtt

SEQ ID NO: 4729469 - DNA, 18 bp, Homo sapiens
ataatctctccattcccg

SEQ ID NO: 4729470 - DNA, 14 bp, Homo sapiens
ataatcttttacat

SEQ ID NO: 4729471 - DNA, 14 bp, Homo sapiens
ataatgaataaatc

SEQ ID NO: 4729472 - DNA, 17 bp, Homo sapiens
ataatggtgaacatttt

SEQ ID NO: 4729473 - DNA, 18 bp, Homo sapiens
ataatggtgaacatttta

SEQ ID NO: 4729474 - DNA, 18 bp, Homo sapiens
ataatggtgaatgttcaa

SEQ ID NO: 4729475 - DNA, 15 bp, Homo sapiens
ataatgtatgtacag

SEQ ID NO: 4729476 - DNA, 15 bp, Homo sapiens
ataatgtctctgtga

SEQ ID NO: 4729477 - DNA, 10 bp, Homo sapiens
ataatgttaa

SEQ ID NO: 4729478 - DNA, 18 bp, Homo sapiens
ataatgttaaatttgtaa

SEQ ID NO: 4729479 - DNA, 23 bp, Homo sapiens
ataatgttaaatttgtaagtttc

SEQ ID NO: 4729480 - DNA, 14 bp, Homo sapiens
ataattctattgaa

SEQ ID NO: 4729481 - DNA, 14 bp, Homo sapiens
ataattttaaagta

SEQ ID NO: 4729482 - DNA, 15 bp, Homo sapiens
ataattttagtttat

SEQ ID NO: 4729483 - DNA, 16 bp, Homo sapiens
ataattttcctgtgac

SEQ ID NO: 4729484 - DNA, 17 bp, Homo sapiens
ataattttcctgtgaca

SEQ ID NO: 4729485 - DNA, 13 bp, Homo sapiens
ataattttttaat

SEQ ID NO: 4729486 - DNA, 16 bp, Homo sapiens
ataattttttaattat

SEQ ID NO: 4729487 - DNA, 21 bp, Homo sapiens
atacactaatgagtatttggt

SEQ ID NO: 4729488 - DNA, 22 bp, Homo sapiens
atacactaatgagtatttggta

SEQ ID NO: 4729489 - DNA, 20 bp, Homo sapiens
atacagaactctttcaaaac

SEQ ID NO: 4729490 - DNA, 17 bp, Homo sapiens
atacagagtacgttaaa

SEQ ID NO: 4729491 - DNA, 16 bp, Homo sapiens
atacagatttgtaaca

SEQ ID NO: 4729492 - DNA, 14 bp, Homo sapiens
atacaggaaaagct

SEQ ID NO: 4729493 - DNA, 22 bp, Homo sapiens
atacaggaaaagctgctgacag

SEQ ID NO: 4729494 - DNA, 22 bp, Homo sapiens
atacagggtgctccttgtcaat

SEQ ID NO: 4729495 - DNA, 21 bp, Homo sapiens
atacagtcattatttaaagca

SEQ ID NO: 4729496 - DNA, 24 bp, Homo sapiens
atacagtcattatttaaagcacat

SEQ ID NO: 4729497 - DNA, 19 bp, Homo sapiens
atacagtcttccatttgca

SEQ ID NO: 4729498 - DNA, 20 bp, Homo sapiens
atacatataaagattaacac

SEQ ID NO: 4729499 - DNA, 22 bp, Homo sapiens
atacatgaaaatttgtttgaca

SEQ ID NO: 4729500 - DNA, 13 bp, Homo sapiens
atacatgcatata

SEQ ID NO: 4729501 - DNA, 15 bp, Homo sapiens
atacatgcatataat

SEQ ID NO: 4729502 - DNA, 20 bp, Homo sapiens
atacatgcatataatgaata

SEQ ID NO: 4729503 - DNA, 21 bp, Homo sapiens
atacattgtctctaaattgtg

SEQ ID NO: 4729504 - DNA, 19 bp, Homo sapiens
ataccaatgaaaaaatgta

SEQ ID NO: 4729505 - DNA, 16 bp, Homo sapiens
ataccagcgaggaggc

SEQ ID NO: 4729506 - DNA, 14 bp, Homo sapiens
atacccaaatcctc

SEQ ID NO: 4729507 - DNA, 23 bp, Homo sapiens
atacccaaatcctctccagctat

SEQ ID NO: 4729508 - DNA, 14 bp, Homo sapiens
atacccacccccac

SEQ ID NO: 4729509 - DNA, 19 bp, Homo sapiens
ataccccctgcaaagccca

SEQ ID NO: 4729510 - DNA, 21 bp, Homo sapiens
ataccccctgcaaagcccagc

SEQ ID NO: 4729511 - DNA, 16 bp, Homo sapiens
atacctgtccccctga

SEQ ID NO: 4729512 - DNA, 15 bp, Homo sapiens
atacggtgggggtag

SEQ ID NO: 4729513 - DNA, 16 bp, Homo sapiens
atacgttcactggtct

SEQ ID NO: 4729514 - DNA, 23 bp, Homo sapiens
atactacctcactactacatctg

SEQ ID NO: 4729515 - DNA, 18 bp, Homo sapiens
atactgccttgtttaatg

SEQ ID NO: 4729516 - DNA, 15 bp, Homo sapiens
atactggactcagga

SEQ ID NO: 4729517 - DNA, 20 bp, Homo sapiens
atactggactcaggaacttt

SEQ ID NO: 4729518 - DNA, 17 bp, Homo sapiens
atactggcctcgcctgg

SEQ ID NO: 4729519 - DNA, 22 bp, Homo sapiens
atactgtagggaaaaaaatgct

SEQ ID NO: 4729520 - DNA, 14 bp, Homo sapiens
atactgttgcacgt

SEQ ID NO: 4729521 - DNA, 14 bp, Homo sapiens
atacttgttctgta

SEQ ID NO: 4729522 - DNA, 18 bp, Homo sapiens
atacttgttgtttaatgt

SEQ ID NO: 4729523 - DNA, 19 bp, Homo sapiens
atactttcgaaatttcatt

SEQ ID NO: 4729524 - DNA, 19 bp, Homo sapiens
atactttgtttattgtaaa

SEQ ID NO: 4729525 - DNA, 13 bp, Homo sapiens
atagaagtaaaaa

SEQ ID NO: 4729526 - DNA, 21 bp, Homo sapiens
atagacagtaacggtgtttag

SEQ ID NO: 4729527 - DNA, 16 bp, Homo sapiens
atagagatatttaaaa

SEQ ID NO: 4729528 - DNA, 18 bp, Homo sapiens
atagagatatttaaaaga

SEQ ID NO: 4729529 - DNA, 21 bp, Homo sapiens
atagagatatttaaaagacaa

SEQ ID NO: 4729530 - DNA, 15 bp, Homo sapiens
atagagcctgaggga

SEQ ID NO: 4729531 - DNA, 13 bp, Homo sapiens
atagagctgtatt

SEQ ID NO: 4729532 - DNA, 20 bp, Homo sapiens
atagataagagtagaaactg

SEQ ID NO: 4729533 - DNA, 22 bp, Homo sapiens
atagatacccaattgtttcagt

SEQ ID NO: 4729534 - DNA, 14 bp, Homo sapiens
atagcacagaccct

SEQ ID NO: 4729535 - DNA, 15 bp, Homo sapiens
atagcacagaccctg

SEQ ID NO: 4729536 - DNA, 17 bp, Homo sapiens
atagcacagaccctgcc

SEQ ID NO: 4729537 - DNA, 18 bp, Homo sapiens
atagcacagaccctgccc

SEQ ID NO: 4729538 - DNA, 13 bp, Homo sapiens
atagcatgaaata

SEQ ID NO: 4729539 - DNA, 16 bp, Homo sapiens
atagcatgaaataaaa

SEQ ID NO: 4729540 - DNA, 17 bp, Homo sapiens
atagcctaggtgacaga

SEQ ID NO: 4729541 - DNA, 21 bp, Homo sapiens
atagctagctatttctatgta

SEQ ID NO: 4729542 - DNA, 19 bp, Homo sapiens
atagctctacacaacatgt

SEQ ID NO: 4729543 - DNA, 14 bp, Homo sapiens
atagctgtgtgaac

SEQ ID NO: 4729544 - DNA, 19 bp, Homo sapiens
ataggagaggatgagagcc

SEQ ID NO: 4729545 - DNA, 22 bp, Homo sapiens
ataggcacctaccaccacgccc

SEQ ID NO: 4729546 - DNA, 17 bp, Homo sapiens
ataggctattttctaaa

SEQ ID NO: 4729547 - DNA, 21 bp, Homo sapiens
ataggctattttctaaagact

SEQ ID NO: 4729548 - DNA, 22 bp, Homo sapiens
ataggctattttctaaagactt

SEQ ID NO: 4729549 - DNA, 23 bp, Homo sapiens
atagtagccaaagttaaatgtat

SEQ ID NO: 4729550 - DNA, 19 bp, Homo sapiens
atagtaggggttgaagaaa

SEQ ID NO: 4729551 - DNA, 13 bp, Homo sapiens
atagtatttaatt

SEQ ID NO: 4729552 - DNA, 19 bp, Homo sapiens
atagtatttaattgtttca

SEQ ID NO: 4729553 - DNA, 21 bp, Homo sapiens
atagtgaggcatcgcaatgta

SEQ ID NO: 4729554 - DNA, 20 bp, Homo sapiens
atagtgatgtaatcttgaat

SEQ ID NO: 4729555 - DNA, 15 bp, Homo sapiens
atagtgcttcttgta

SEQ ID NO: 4729556 - DNA, 22 bp, Homo sapiens
atagttggctaggacccctcca

SEQ ID NO: 4729557 - DNA, 19 bp, Homo sapiens
atagttgtctttctttgct

SEQ ID NO: 4729558 - DNA, 15 bp, Homo sapiens
atataaacactatat

SEQ ID NO: 4729559 - DNA, 15 bp, Homo sapiens
atataaacattttat

SEQ ID NO: 4729560 - DNA, 16 bp, Homo sapiens
atataaagattaacac

SEQ ID NO: 4729561 - DNA, 19 bp, Homo sapiens
atataatgaataaatcatt

SEQ ID NO: 4729562 - DNA, 23 bp, Homo sapiens
atatacatttgttggtaactaat

SEQ ID NO: 4729563 - DNA, 20 bp, Homo sapiens
atatacttgttgtttaatgt

SEQ ID NO: 4729564 - DNA, 15 bp, Homo sapiens
atatagaacagtgct

SEQ ID NO: 4729565 - DNA, 19 bp, Homo sapiens
atatagatacccaattgtt

SEQ ID NO: 4729566 - DNA, 22 bp, Homo sapiens
atatagctctacacaacatgta

SEQ ID NO: 4729567 - DNA, 13 bp, Homo sapiens
atataggctattt

SEQ ID NO: 4729568 - DNA, 20 bp, Homo sapiens
atatataggctattttctaa

SEQ ID NO: 4729569 - DNA, 13 bp, Homo sapiens
atatatatattga

SEQ ID NO: 4729570 - DNA, 17 bp, Homo sapiens
atatatctaaatttaga

SEQ ID NO: 4729571 - DNA, 22 bp, Homo sapiens
atatatgttttaagaggcaggg

SEQ ID NO: 4729572 - DNA, 21 bp, Homo sapiens
atatattcactttcatttttg

SEQ ID NO: 4729573 - DNA, 18 bp, Homo sapiens
atatattttaaaaacact

SEQ ID NO: 4729574 - DNA, 13 bp, Homo sapiens
atatcaaagtcat

SEQ ID NO: 4729575 - DNA, 18 bp, Homo sapiens
atatcaagtactacattt

SEQ ID NO: 4729576 - DNA, 14 bp, Homo sapiens
atatcatttgtgaa

SEQ ID NO: 4729577 - DNA, 20 bp, Homo sapiens
atatcccttggacattttat

SEQ ID NO: 4729578 - DNA, 17 bp, Homo sapiens
atatcttaagagtgcta

SEQ ID NO: 4729579 - DNA, 22 bp, Homo sapiens
atatctttattcaccttttctt

SEQ ID NO: 4729580 - DNA, 14 bp, Homo sapiens
atatcttttgacct

SEQ ID NO: 4729581 - DNA, 13 bp, Homo sapiens
atatgaaagctga

SEQ ID NO: 4729582 - DNA, 15 bp, Homo sapiens
atatgaagacataaa

SEQ ID NO: 4729583 - DNA, 15 bp, Homo sapiens
atatggcagaagaca

SEQ ID NO: 4729584 - DNA, 17 bp, Homo sapiens
atatggcagaagacacc

SEQ ID NO: 4729585 - DNA, 17 bp, Homo sapiens
atatggctagttttcaa

SEQ ID NO: 4729586 - DNA, 22 bp, Homo sapiens
atatggctcttcataattctaa

SEQ ID NO: 4729587 - DNA, 20 bp, Homo sapiens
atatggggatgcagcattat

SEQ ID NO: 4729588 - DNA, 15 bp, Homo sapiens
atatgtataaattaa

SEQ ID NO: 4729589 - DNA, 13 bp, Homo sapiens
atatgtgaagaaa

SEQ ID NO: 4729590 - DNA, 14 bp, Homo sapiens
atatgtgaagaaaa

SEQ ID NO: 4729591 - DNA, 16 bp, Homo sapiens
atatgtgtaaatgtta

SEQ ID NO: 4729592 - DNA, 20 bp, Homo sapiens
atatgtgtaaatgttatgac

SEQ ID NO: 4729593 - DNA, 20 bp, Homo sapiens
atatgttggggtttttttaa

SEQ ID NO: 4729594 - DNA, 23 bp, Homo sapiens
atatgttggggtttttttaagat

SEQ ID NO: 4729595 - DNA, 16 bp, Homo sapiens
atattaagaaaaatat

SEQ ID NO: 4729596 - DNA, 14 bp, Homo sapiens
atattaagaaacaa

SEQ ID NO: 4729597 - DNA, 16 bp, Homo sapiens
atattacttgcctatc

SEQ ID NO: 4729598 - DNA, 17 bp, Homo sapiens
atattcactttcatttt

SEQ ID NO: 4729599 - DNA, 13 bp, Homo sapiens
atattcaggaagc

SEQ ID NO: 4729600 - DNA, 16 bp, Homo sapiens
atattcaggaagctca

SEQ ID NO: 4729601 - DNA, 19 bp, Homo sapiens
atattcattggttaacaat

SEQ ID NO: 4729602 - DNA, 17 bp, Homo sapiens
atattccctagaaactt

SEQ ID NO: 4729603 - DNA, 15 bp, Homo sapiens
atattctctgatgtt

SEQ ID NO: 4729604 - DNA, 20 bp, Homo sapiens
atattctgataatgtattgc

SEQ ID NO: 4729605 - DNA, 21 bp, Homo sapiens
atattgctaaaatattttaga

SEQ ID NO: 4729606 - DNA, 21 bp, Homo sapiens
atattgggtctcagccctagg

SEQ ID NO: 4729607 - DNA, 15 bp, Homo sapiens
atattggtaattaaa

SEQ ID NO: 4729608 - DNA, 18 bp, Homo sapiens
atattggtaattaaaaga

SEQ ID NO: 4729609 - DNA, 22 bp, Homo sapiens
atattgtaaatactggactcag

SEQ ID NO: 4729610 - DNA, 12 bp, Homo sapiens
atattgtacagt

SEQ ID NO: 4729611 - DNA, 21 bp, Homo sapiens
atatttaaaagacaaacacct

SEQ ID NO: 4729612 - DNA, 14 bp, Homo sapiens
atatttaagcctta

SEQ ID NO: 4729613 - DNA, 20 bp, Homo sapiens
atatttaagccttataaacc

SEQ ID NO: 4729614 - DNA, 13 bp, Homo sapiens
atatttacaaatg

SEQ ID NO: 4729615 - DNA, 14 bp, Homo sapiens
atatttacgtatga

SEQ ID NO: 4729616 - DNA, 22 bp, Homo sapiens
atatttctacagagaaaatgaa

SEQ ID NO: 4729617 - DNA, 16 bp, Homo sapiens
atatttcttcaagtga

SEQ ID NO: 4729618 - DNA, 17 bp, Homo sapiens
atatttgatatttggtt

SEQ ID NO: 4729619 - DNA, 23 bp, Homo sapiens
atatttgcattgaggaaatatta

SEQ ID NO: 4729620 - DNA, 17 bp, Homo sapiens
atatttgtgctatttaa

SEQ ID NO: 4729621 - DNA, 14 bp, Homo sapiens
atattttaaaaaca

SEQ ID NO: 4729622 - DNA, 21 bp, Homo sapiens
atattttcaccatttgattat

SEQ ID NO: 4729623 - DNA, 18 bp, Homo sapiens
atattttccatgaaaatg

SEQ ID NO: 4729624 - DNA, 20 bp, Homo sapiens
atattttgccactgcctttc

SEQ ID NO: 4729625 - DNA, 16 bp, Homo sapiens
atatttttctaaagaa

SEQ ID NO: 4729626 - DNA, 18 bp, Homo sapiens
atatttttttttaagctc

SEQ ID NO: 4729627 - DNA, 21 bp, Homo sapiens
atatttttttttaagctctga

SEQ ID NO: 4729628 - DNA, 12 bp, Homo sapiens
atcaaacatgaa

SEQ ID NO: 4729629 - DNA, 24 bp, Homo sapiens
atcaaagaaaaacaatgaaattga

SEQ ID NO: 4729630 - DNA, 22 bp, Homo sapiens
atcaaagtcattaaagacagga

SEQ ID NO: 4729631 - DNA, 17 bp, Homo sapiens
atcaaatggaagacaca

SEQ ID NO: 4729632 - DNA, 19 bp, Homo sapiens
atcaaatgtggctgtatcc

SEQ ID NO: 4729633 - DNA, 16 bp, Homo sapiens
atcaagaaatactttc

SEQ ID NO: 4729634 - DNA, 18 bp, Homo sapiens
atcaagaaatactttcga

SEQ ID NO: 4729635 - DNA, 15 bp, Homo sapiens
atcaagactggaagg

SEQ ID NO: 4729636 - DNA, 16 bp, Homo sapiens
atcaagggaagaacta

SEQ ID NO: 4729637 - DNA, 19 bp, Homo sapiens
atcaagtactacattttct

SEQ ID NO: 4729638 - DNA, 22 bp, Homo sapiens
atcaagttggcttctaatcaaa

SEQ ID NO: 4729639 - DNA, 23 bp, Homo sapiens
atcaagttggcttctaatcaaag

SEQ ID NO: 4729640 - DNA, 20 bp, Homo sapiens
atcaataaaggacaggctgg

SEQ ID NO: 4729641 - DNA, 14 bp, Homo sapiens
atcaatcacagctt

SEQ ID NO: 4729642 - DNA, 14 bp, Homo sapiens
atcaattttttaaa

SEQ ID NO: 4729643 - DNA, 14 bp, Homo sapiens
atcacaaaagctgt

SEQ ID NO: 4729644 - DNA, 19 bp, Homo sapiens
atcacaaaagctgtgtctc

SEQ ID NO: 4729645 - DNA, 14 bp, Homo sapiens
atcacagcagcttc

SEQ ID NO: 4729646 - DNA, 20 bp, Homo sapiens
atcacagtgttatgtagtat

SEQ ID NO: 4729647 - DNA, 23 bp, Homo sapiens
atcacagtgttatgtagtattgt

SEQ ID NO: 4729648 - DNA, 18 bp, Homo sapiens
atcaccaacgtctgtgcc

SEQ ID NO: 4729649 - DNA, 12 bp, Homo sapiens
atcacctgccct

SEQ ID NO: 4729650 - DNA, 14 bp, Homo sapiens
atcacgccactgca

SEQ ID NO: 4729651 - DNA, 15 bp, Homo sapiens
atcacggctcactgc

SEQ ID NO: 4729652 - DNA, 18 bp, Homo sapiens
atcacggctcactgcagc

SEQ ID NO: 4729653 - DNA, 21 bp, Homo sapiens
atcactgaactttgctgagcc

SEQ ID NO: 4729654 - DNA, 16 bp, Homo sapiens
atcactgtcaatattt

SEQ ID NO: 4729655 - DNA, 16 bp, Homo sapiens
atcagaaacaccctca

SEQ ID NO: 4729656 - DNA, 17 bp, Homo sapiens
atcagaatatcagaata

SEQ ID NO: 4729657 - DNA, 17 bp, Homo sapiens
atcagactaagccagca

SEQ ID NO: 4729658 - DNA, 20 bp, Homo sapiens
atcagactaagccagcaccg

SEQ ID NO: 4729659 - DNA, 14 bp, Homo sapiens
atcagagttaccat

SEQ ID NO: 4729660 - DNA, 17 bp, Homo sapiens
atcagattttaacagct

SEQ ID NO: 4729661 - DNA, 13 bp, Homo sapiens
atcagctccttcc

SEQ ID NO: 4729662 - DNA, 17 bp, Homo sapiens
atcagctccttcctgga

SEQ ID NO: 4729663 - DNA, 16 bp, Homo sapiens
atcaggacccagagga

SEQ ID NO: 4729664 - DNA, 18 bp, Homo sapiens
atcaggacccagaggaag

SEQ ID NO: 4729665 - DNA, 23 bp, Homo sapiens
atcaggagaaagcttggttctgt

SEQ ID NO: 4729666 - DNA, 22 bp, Homo sapiens
atcaggccaggccctctgccca

SEQ ID NO: 4729667 - DNA, 23 bp, Homo sapiens
atcagggaggaaagtttctttga

SEQ ID NO: 4729668 - DNA, 14 bp, Homo sapiens
atcaggtgctgcca

SEQ ID NO: 4729669 - DNA, 17 bp, Homo sapiens
atcaggtgctgccatcc

SEQ ID NO: 4729670 - DNA, 16 bp, Homo sapiens
atcagtatatttggtt

SEQ ID NO: 4729671 - DNA, 19 bp, Homo sapiens
atcagtctgattcccaagc

SEQ ID NO: 4729672 - DNA, 15 bp, Homo sapiens
atcagtgaagcagtt

SEQ ID NO: 4729673 - DNA, 19 bp, Homo sapiens
atcagtgccagcccctgct

SEQ ID NO: 4729674 - DNA, 13 bp, Homo sapiens
atcagtggagcca

SEQ ID NO: 4729675 - DNA, 21 bp, Homo sapiens
atcagttatattttgctgttt

SEQ ID NO: 4729676 - DNA, 17 bp, Homo sapiens
atcataacatagttgaa

SEQ ID NO: 4729677 - DNA, 17 bp, Homo sapiens
atcatactgatttttaa

SEQ ID NO: 4729678 - DNA, 13 bp, Homo sapiens
atcatataaacat

SEQ ID NO: 4729679 - DNA, 23 bp, Homo sapiens
atcatcaaaaagaaaaatcaaag

SEQ ID NO: 4729680 - DNA, 18 bp, Homo sapiens
atcatcaaggcactgcct

SEQ ID NO: 4729681 - DNA, 15 bp, Homo sapiens
atcatcatgtagaat

SEQ ID NO: 4729682 - DNA, 22 bp, Homo sapiens
atcatcatgtagaatatggcta

SEQ ID NO: 4729683 - DNA, 18 bp, Homo sapiens
atcatcatgtgtgtccac

SEQ ID NO: 4729684 - DNA, 21 bp, Homo sapiens
atcatccactgtgccatgtgc

SEQ ID NO: 4729685 - DNA, 12 bp, Homo sapiens
atcatccctccc

SEQ ID NO: 4729686 - DNA, 23 bp, Homo sapiens
atcatccctccctgcctaaggaa

SEQ ID NO: 4729687 - DNA, 23 bp, Homo sapiens
atcatcctggaggggtgttgtat

SEQ ID NO: 4729688 - DNA, 23 bp, Homo sapiens
atcatctcctgccttcctcctgg

SEQ ID NO: 4729689 - DNA, 18 bp, Homo sapiens
atcatctgtggaacccat

SEQ ID NO: 4729690 - DNA, 12 bp, Homo sapiens
atcatctttgct

SEQ ID NO: 4729691 - DNA, 14 bp, Homo sapiens
atcatggtgtaata

SEQ ID NO: 4729692 - DNA, 19 bp, Homo sapiens
atcatggtgtaataagaca

SEQ ID NO: 4729693 - DNA, 20 bp, Homo sapiens
atcatggtgtaataagacat

SEQ ID NO: 4729694 - DNA, 14 bp, Homo sapiens
atcatgtctggcta

SEQ ID NO: 4729695 - DNA, 15 bp, Homo sapiens
atcattcataatttt

SEQ ID NO: 4729696 - DNA, 14 bp, Homo sapiens
atcattctctgtct

SEQ ID NO: 4729697 - DNA, 12 bp, Homo sapiens
atcattctgtaa

SEQ ID NO: 4729698 - DNA, 18 bp, Homo sapiens
atcattcttactaaaaag

SEQ ID NO: 4729699 - DNA, 23 bp, Homo sapiens
atcattcttactaaaaagtataa

SEQ ID NO: 4729700 - DNA, 15 bp, Homo sapiens
atccaaataaaaata

SEQ ID NO: 4729701 - DNA, 22 bp, Homo sapiens
atccaaataaaaataacatcat

SEQ ID NO: 4729702 - DNA, 23 bp, Homo sapiens
atccaaatgctgtgcaaacagtg

SEQ ID NO: 4729703 - DNA, 18 bp, Homo sapiens
atccaatgtcgctgtaaa

SEQ ID NO: 4729704 - DNA, 13 bp, Homo sapiens
atccaattggata

SEQ ID NO: 4729705 - DNA, 16 bp, Homo sapiens
atccacccacctcagc

SEQ ID NO: 4729706 - DNA, 20 bp, Homo sapiens
atccacccacctcagcctcc

SEQ ID NO: 4729707 - DNA, 17 bp, Homo sapiens
atccaccgccagcttcc

SEQ ID NO: 4729708 - DNA, 13 bp, Homo sapiens
atccacctccttc

SEQ ID NO: 4729709 - DNA, 15 bp, Homo sapiens
atccacctccttctc

SEQ ID NO: 4729710 - DNA, 13 bp, Homo sapiens
atccactcgcctt

SEQ ID NO: 4729711 - DNA, 22 bp, Homo sapiens
atccagaagtattgtttacatt

SEQ ID NO: 4729712 - DNA, 23 bp, Homo sapiens
atccagaagtattgtttacatta

SEQ ID NO: 4729713 - DNA, 15 bp, Homo sapiens
atccagctatgttat

SEQ ID NO: 4729714 - DNA, 14 bp, Homo sapiens
atccagctggtgag

SEQ ID NO: 4729715 - DNA, 17 bp, Homo sapiens
atccagggtggtggtga

SEQ ID NO: 4729716 - DNA, 17 bp, Homo sapiens
atccaggttcagcttgt

SEQ ID NO: 4729717 - DNA, 17 bp, Homo sapiens
atcccaacatggtccta

SEQ ID NO: 4729718 - DNA, 11 bp, Homo sapiens
atcccagcccc

SEQ ID NO: 4729719 - DNA, 16 bp, Homo sapiens
atccccaagcctggca

SEQ ID NO: 4729720 - DNA, 18 bp, Homo sapiens
atccccaagcctggcaag

SEQ ID NO: 4729721 - DNA, 14 bp, Homo sapiens
atcccccctcacca

SEQ ID NO: 4729722 - DNA, 17 bp, Homo sapiens
atcccgagcacctccac

SEQ ID NO: 4729723 - DNA, 14 bp, Homo sapiens
atcccggctgccct

SEQ ID NO: 4729724 - DNA, 15 bp, Homo sapiens
atcccggctgccctt

SEQ ID NO: 4729725 - DNA, 23 bp, Homo sapiens
atccctcaaaccttgaggagaag

SEQ ID NO: 4729726 - DNA, 13 bp, Homo sapiens
atccctcatcctc

SEQ ID NO: 4729727 - DNA, 22 bp, Homo sapiens
atccctgaaggccccgcccagg

SEQ ID NO: 4729728 - DNA, 15 bp, Homo sapiens
atccctgaggactga

SEQ ID NO: 4729729 - DNA, 22 bp, Homo sapiens
atccctgaggactgatttcaga

SEQ ID NO: 4729730 - DNA, 17 bp, Homo sapiens
atcccttggacatttta

SEQ ID NO: 4729731 - DNA, 21 bp, Homo sapiens
atcccttggacattttatgtc

SEQ ID NO: 4729732 - DNA, 14 bp, Homo sapiens
atccgaatctcttt

SEQ ID NO: 4729733 - DNA, 13 bp, Homo sapiens
atccggaaagaag

SEQ ID NO: 4729734 - DNA, 21 bp, Homo sapiens
atccgtctttggcctcctcca

SEQ ID NO: 4729735 - DNA, 18 bp, Homo sapiens
atcctacaagacacagtg

SEQ ID NO: 4729736 - DNA, 18 bp, Homo sapiens
atcctcatacccaccccc

SEQ ID NO: 4729737 - DNA, 22 bp, Homo sapiens
atcctcatacccacccccaccc

SEQ ID NO: 4729738 - DNA, 19 bp, Homo sapiens
atcctccacgttctgctca

SEQ ID NO: 4729739 - DNA, 13 bp, Homo sapiens
atcctccaggtgc

SEQ ID NO: 4729740 - DNA, 19 bp, Homo sapiens
atcctcccacctcagcctc

SEQ ID NO: 4729741 - DNA, 16 bp, Homo sapiens
atcctgctcacatctg

SEQ ID NO: 4729742 - DNA, 14 bp, Homo sapiens
atcctggcccatca

SEQ ID NO: 4729743 - DNA, 16 bp, Homo sapiens
atcctgtaccaaatct

SEQ ID NO: 4729744 - DNA, 18 bp, Homo sapiens
atcctgtaccaaatctga

SEQ ID NO: 4729745 - DNA, 16 bp, Homo sapiens
atccttccacctcagt

SEQ ID NO: 4729746 - DNA, 13 bp, Homo sapiens
atcgaaaagaagg

SEQ ID NO: 4729747 - DNA, 17 bp, Homo sapiens
atcgatatgaaaaataa

SEQ ID NO: 4729748 - DNA, 21 bp, Homo sapiens
atcgccttatgagaacatggt

SEQ ID NO: 4729749 - DNA, 21 bp, Homo sapiens
atcggccatcaagggaagaac

SEQ ID NO: 4729750 - DNA, 14 bp, Homo sapiens
atcgtgacaacact

SEQ ID NO: 4729751 - DNA, 13 bp, Homo sapiens
atcgttactggca

SEQ ID NO: 4729752 - DNA, 17 bp, Homo sapiens
atctaaatttagaaatc

SEQ ID NO: 4729753 - DNA, 13 bp, Homo sapiens
atctaacctcatc

SEQ ID NO: 4729754 - DNA, 15 bp, Homo sapiens
atctaacctcatctt

SEQ ID NO: 4729755 - DNA, 18 bp, Homo sapiens
atctaatgacattcaata

SEQ ID NO: 4729756 - DNA, 16 bp, Homo sapiens
atctatgactgtgttt

SEQ ID NO: 4729757 - DNA, 18 bp, Homo sapiens
atctatgactgtgtttaa

SEQ ID NO: 4729758 - DNA, 22 bp, Homo sapiens
atctatgtcatattttgccact

SEQ ID NO: 4729759 - DNA, 13 bp, Homo sapiens
atctattctcaaa

SEQ ID NO: 4729760 - DNA, 19 bp, Homo sapiens
atctattctcaaagttaaa

SEQ ID NO: 4729761 - DNA, 21 bp, Homo sapiens
atctattttgagttaattttt

SEQ ID NO: 4729762 - DNA, 16 bp, Homo sapiens
atctcaattcttccct

SEQ ID NO: 4729763 - DNA, 23 bp, Homo sapiens
atctcacaaaacatattttacat

SEQ ID NO: 4729764 - DNA, 15 bp, Homo sapiens
atctcacacatgagc

SEQ ID NO: 4729765 - DNA, 15 bp, Homo sapiens
atctcagtcatgcat

SEQ ID NO: 4729766 - DNA, 22 bp, Homo sapiens
atctcattgctgttttaatttg

SEQ ID NO: 4729767 - DNA, 20 bp, Homo sapiens
atctcattggacccttccat

SEQ ID NO: 4729768 - DNA, 19 bp, Homo sapiens
atctccatccctgaaattt

SEQ ID NO: 4729769 - DNA, 19 bp, Homo sapiens
atctcccagataatgtgaa

SEQ ID NO: 4729770 - DNA, 15 bp, Homo sapiens
atctcccccagcccc

SEQ ID NO: 4729771 - DNA, 16 bp, Homo sapiens
atctcccccagcccca

SEQ ID NO: 4729772 - DNA, 15 bp, Homo sapiens
atctctaaagagcat

SEQ ID NO: 4729773 - DNA, 15 bp, Homo sapiens
atctctaattttgga

SEQ ID NO: 4729774 - DNA, 17 bp, Homo sapiens
atctctattatatcttg

SEQ ID NO: 4729775 - DNA, 16 bp, Homo sapiens
atctcttagctcccct

SEQ ID NO: 4729776 - DNA, 22 bp, Homo sapiens
atctcttagctcccctccaacc

SEQ ID NO: 4729777 - DNA, 23 bp, Homo sapiens
atctcttagctcccctccaacct

SEQ ID NO: 4729778 - DNA, 19 bp, Homo sapiens
atctcttctgggttccttc

SEQ ID NO: 4729779 - DNA, 21 bp, Homo sapiens
atctcttctgggttccttcct

SEQ ID NO: 4729780 - DNA, 21 bp, Homo sapiens
atctgaagaaagttattcttg

SEQ ID NO: 4729781 - DNA, 13 bp, Homo sapiens
atctgacatatta

SEQ ID NO: 4729782 - DNA, 18 bp, Homo sapiens
atctgacatattatgcct

SEQ ID NO: 4729783 - DNA, 19 bp, Homo sapiens
agtgtatgagagggccctg

SEQ ID NO: 4729784 - DNA, 14 bp, Homo sapiens
agtgtccaaagcag

SEQ ID NO: 4729785 - DNA, 21 bp, Homo sapiens
agtgtccaaagcagggtctgg

SEQ ID NO: 4729786 - DNA, 17 bp, Homo sapiens
agtgtcctataattcta

SEQ ID NO: 4729787 - DNA, 16 bp, Homo sapiens
agtgtctggcacacag

SEQ ID NO: 4729788 - DNA, 14 bp, Homo sapiens
agtgtctgggctga

SEQ ID NO: 4729789 - DNA, 14 bp, Homo sapiens
agtgtcttcctgtg

SEQ ID NO: 4729790 - DNA, 15 bp, Homo sapiens
agtgtgaggccaggg

SEQ ID NO: 4729791 - DNA, 17 bp, Homo sapiens
agtgtgccccccatcct

SEQ ID NO: 4729792 - DNA, 19 bp, Homo sapiens
agtgtgccccccatcctgg

SEQ ID NO: 4729793 - DNA, 16 bp, Homo sapiens
agtgtgcccttctctt

SEQ ID NO: 4729794 - DNA, 17 bp, Homo sapiens
agtgtgcccttctctta

SEQ ID NO: 4729795 - DNA, 19 bp, Homo sapiens
agtgtgtaaggtatatgtt

SEQ ID NO: 4729796 - DNA, 16 bp, Homo sapiens
agtgttaggcctggca

SEQ ID NO: 4729797 - DNA, 15 bp, Homo sapiens
agtgttagggaaggg

SEQ ID NO: 4729798 - DNA, 18 bp, Homo sapiens
agtgttagggaagggcct

SEQ ID NO: 4729799 - DNA, 19 bp, Homo sapiens
agtgttatgtagtattgtt

SEQ ID NO: 4729800 - DNA, 23 bp, Homo sapiens
agtgttcacaacctggaagtgct

SEQ ID NO: 4729801 - DNA, 16 bp, Homo sapiens
agtgttccccttccac

SEQ ID NO: 4729802 - DNA, 12 bp, Homo sapiens
agttaaaagtaa

SEQ ID NO: 4729803 - DNA, 22 bp, Homo sapiens
agttaaaagtaaaattgtttca

SEQ ID NO: 4729804 - DNA, 12 bp, Homo sapiens
agttaagaagct

SEQ ID NO: 4729805 - DNA, 17 bp, Homo sapiens
agttaagaagctgttgt

SEQ ID NO: 4729806 - DNA, 16 bp, Homo sapiens
agttaaggtatctggt

SEQ ID NO: 4729807 - DNA, 22 bp, Homo sapiens
agttaattgtatttatgtatgt

SEQ ID NO: 4729808 - DNA, 15 bp, Homo sapiens
agttacaattacatc

SEQ ID NO: 4729809 - DNA, 20 bp, Homo sapiens
agttacataatcagtatatt

SEQ ID NO: 4729810 - DNA, 22 bp, Homo sapiens
agttacccaacagaaacattct

SEQ ID NO: 4729811 - DNA, 21 bp, Homo sapiens
agttagaaggaggttctaata

SEQ ID NO: 4729812 - DNA, 18 bp, Homo sapiens
agttatctttgaatatgt

SEQ ID NO: 4729813 - DNA, 20 bp, Homo sapiens
agttattatatttacaaatg

SEQ ID NO: 4729814 - DNA, 16 bp, Homo sapiens
agttcaggctctgaga

SEQ ID NO: 4729815 - DNA, 18 bp, Homo sapiens
agttcaggtaacaggcag

SEQ ID NO: 4729816 - DNA, 19 bp, Homo sapiens
agttcaggtaacaggcaga

SEQ ID NO: 4729817 - DNA, 17 bp, Homo sapiens
agttccccatgcagaca

SEQ ID NO: 4729818 - DNA, 22 bp, Homo sapiens
agttctgcccaaattatgtgaa

SEQ ID NO: 4729819 - DNA, 15 bp, Homo sapiens
agttctgtgtacatt

SEQ ID NO: 4729820 - DNA, 17 bp, Homo sapiens
agttctgtgtacatttt

SEQ ID NO: 4729821 - DNA, 21 bp, Homo sapiens
agttcttagttgctgtatgtc

SEQ ID NO: 4729822 - DNA, 15 bp, Homo sapiens
agttctttgcaagct

SEQ ID NO: 4729823 - DNA, 23 bp, Homo sapiens
agttgaaaatcttataatttaaa

SEQ ID NO: 4729824 - DNA, 14 bp, Homo sapiens
agttgatagcacag

SEQ ID NO: 4729825 - DNA, 15 bp, Homo sapiens
agttgatagcacaga

SEQ ID NO: 4729826 - DNA, 19 bp, Homo sapiens
agttgatagcacagaccct

SEQ ID NO: 4729827 - DNA, 15 bp, Homo sapiens
agttgatatagaaca

SEQ ID NO: 4729828 - DNA, 22 bp, Homo sapiens
agttgattcatattgcatcata

SEQ ID NO: 4729829 - DNA, 15 bp, Homo sapiens
agttgcaatagaaca

SEQ ID NO: 4729830 - DNA, 17 bp, Homo sapiens
agttgcacggctgctga

SEQ ID NO: 4729831 - DNA, 22 bp, Homo sapiens
agttgcataggtttaataattt

SEQ ID NO: 4729832 - DNA, 14 bp, Homo sapiens
agttgcattttaac

SEQ ID NO: 4729833 - DNA, 14 bp, Homo sapiens
agttgctcacatgt

SEQ ID NO: 4729834 - DNA, 16 bp, Homo sapiens
agttggctaggacccc

SEQ ID NO: 4729835 - DNA, 19 bp, Homo sapiens
agttgggcttcctcatagt

SEQ ID NO: 4729836 - DNA, 11 bp, Homo sapiens
agttggtcccc

SEQ ID NO: 4729837 - DNA, 18 bp, Homo sapiens
agttggtcccccttccat

SEQ ID NO: 4729838 - DNA, 15 bp, Homo sapiens
agttggtcttacttt

SEQ ID NO: 4729839 - DNA, 22 bp, Homo sapiens
agttggtcttactttgtgcaaa

SEQ ID NO: 4729840 - DNA, 17 bp, Homo sapiens
agttgtctttctttgct

SEQ ID NO: 4729841 - DNA, 20 bp, Homo sapiens
agttgtctttctttgctgct

SEQ ID NO: 4729842 - DNA, 14 bp, Homo sapiens
agttgtggaaagat

SEQ ID NO: 4729843 - DNA, 16 bp, Homo sapiens
agttgttaataaaagt

SEQ ID NO: 4729844 - DNA, 15 bp, Homo sapiens
agttgttgccctggg

SEQ ID NO: 4729845 - DNA, 23 bp, Homo sapiens
agttgtttgattcagacagctgc

SEQ ID NO: 4729846 - DNA, 13 bp, Homo sapiens
agtttaacttttt

SEQ ID NO: 4729847 - DNA, 22 bp, Homo sapiens
agtttaagtctcctttactgaa

SEQ ID NO: 4729848 - DNA, 11 bp, Homo sapiens
agtttcaggtg

SEQ ID NO: 4729849 - DNA, 21 bp, Homo sapiens
agtttcaggtgacatgtgaaa

SEQ ID NO: 4729850 - DNA, 22 bp, Homo sapiens
agtttcaggtgacatgtgaaac

SEQ ID NO: 4729851 - DNA, 15 bp, Homo sapiens
agtttccttggctgg

SEQ ID NO: 4729852 - DNA, 15 bp, Homo sapiens
agtttctccaagcag

SEQ ID NO: 4729853 - DNA, 15 bp, Homo sapiens
agtttcttagctttt

SEQ ID NO: 4729854 - DNA, 16 bp, Homo sapiens
agtttgatgaggccct

SEQ ID NO: 4729855 - DNA, 18 bp, Homo sapiens
agtttgatgaggccctcc

SEQ ID NO: 4729856 - DNA, 17 bp, Homo sapiens
agtttgattattcagtg

SEQ ID NO: 4729857 - DNA, 22 bp, Homo sapiens
agtttgccactcccctaaactc

SEQ ID NO: 4729858 - DNA, 19 bp, Homo sapiens
agtttgctttgtttaagca

SEQ ID NO: 4729859 - DNA, 13 bp, Homo sapiens
agtttgtccttta

SEQ ID NO: 4729860 - DNA, 19 bp, Homo sapiens
agtttgtgaatgtgactac

SEQ ID NO: 4729861 - DNA, 18 bp, Homo sapiens
agttttaactgtggatat

SEQ ID NO: 4729862 - DNA, 12 bp, Homo sapiens
agttttcagtgg

SEQ ID NO: 4729863 - DNA, 12 bp, Homo sapiens
agttttgaaaag

SEQ ID NO: 4729864 - DNA, 14 bp, Homo sapiens
agttttgaaaagct

SEQ ID NO: 4729865 - DNA, 17 bp, Homo sapiens
agttttgaagattctat

SEQ ID NO: 4729866 - DNA, 11 bp, Homo sapiens
agttttgttct

SEQ ID NO: 4729867 - DNA, 16 bp, Homo sapiens
agtttttatggttcca

SEQ ID NO: 4729868 - DNA, 16 bp, Homo sapiens
agtgcttcttgtaata

SEQ ID NO: 4729869 - DNA, 17 bp, Homo sapiens
agtgcttgccacagagc

SEQ ID NO: 4729870 - DNA, 14 bp, Homo sapiens
agtggaagcttcta

SEQ ID NO: 4729871 - DNA, 22 bp, Homo sapiens
agtggaagtatgtatattaaaa

SEQ ID NO: 4729872 - DNA, 23 bp, Homo sapiens
agtggctgtccagtgcccattcc

SEQ ID NO: 4729873 - DNA, 20 bp, Homo sapiens
agtggcttcattagagcagg

SEQ ID NO: 4729874 - DNA, 14 bp, Homo sapiens
agtgggaaaaatgt

SEQ ID NO: 4729875 - DNA, 15 bp, Homo sapiens
agtgggagatgaaaa

SEQ ID NO: 4729876 - DNA, 15 bp, Homo sapiens
agtgggagctgcctg

SEQ ID NO: 4729877 - DNA, 15 bp, Homo sapiens
agtgggcatgtatta

SEQ ID NO: 4729878 - DNA, 16 bp, Homo sapiens
agtgggggtggggggt

SEQ ID NO: 4729879 - DNA, 14 bp, Homo sapiens
agtgggtcccactt

SEQ ID NO: 4729880 - DNA, 16 bp, Homo sapiens
agtgggtcccacttcc

SEQ ID NO: 4729881 - DNA, 14 bp, Homo sapiens
agtgggtcccagat

SEQ ID NO: 4729882 - DNA, 13 bp, Homo sapiens
agtggtctttgta

SEQ ID NO: 4729883 - DNA, 16 bp, Homo sapiens
agtggtctttgtaaga

SEQ ID NO: 4729884 - DNA, 19 bp, Homo sapiens
agtggtctttgtaagagtg

SEQ ID NO: 4729885 - DNA, 17 bp, Homo sapiens
agtgtacagtcttgtat

SEQ ID NO: 4729886 - DNA, 22 bp, Homo sapiens
agtgtacccccgcccaggctgg

SEQ ID NO: 4729887 - DNA, 12 bp, Homo sapiens
agtgtagaagca

SEQ ID NO: 4729888 - DNA, 13 bp, Homo sapiens
agtgtagaagcat

SEQ ID NO: 4729889 - DNA, 19 bp, Homo sapiens
agtgtagaagcattccttc

SEQ ID NO: 4729890 - DNA, 20 bp, Homo sapiens
agtgtagaagcattccttct

SEQ ID NO: 4729891 - DNA, 16 bp, Homo sapiens
aggccccgcccaggct

SEQ ID NO: 4729892 - DNA, 15 bp, Homo sapiens
aggcccctgccaccc

SEQ ID NO: 4729893 - DNA, 18 bp, Homo sapiens
aggcccctgccaccctgg

SEQ ID NO: 4729894 - DNA, 21 bp, Homo sapiens
aggcccctgccaccctgggga

SEQ ID NO: 4729895 - DNA, 14 bp, Homo sapiens
aggcccggctccag

SEQ ID NO: 4729896 - DNA, 15 bp, Homo sapiens
aggcccggctccagg

SEQ ID NO: 4729897 - DNA, 20 bp, Homo sapiens
aggcccggctccaggctcct

SEQ ID NO: 4729898 - DNA, 16 bp, Homo sapiens
aggccctccacacctg

SEQ ID NO: 4729899 - DNA, 18 bp, Homo sapiens
aggccctccacacctgcg

SEQ ID NO: 4729900 - DNA, 19 bp, Homo sapiens
aggccctccacacctgcgg

SEQ ID NO: 4729901 - DNA, 21 bp, Homo sapiens
aggccctccacacctgcggcc

SEQ ID NO: 4729902 - DNA, 15 bp, Homo sapiens
aggccctcgctgcca

SEQ ID NO: 4729903 - DNA, 17 bp, Homo sapiens
aggccctcgctgccagc

SEQ ID NO: 4729904 - DNA, 13 bp, Homo sapiens
aggccctctgccc

SEQ ID NO: 4729905 - DNA, 16 bp, Homo sapiens
aggccctgcactgtcc

SEQ ID NO: 4729906 - DNA, 23 bp, Homo sapiens
aggccctgcactgtcctgctcca

SEQ ID NO: 4729907 - DNA, 24 bp, Homo sapiens
aggccctgcactgtcctgctccac

SEQ ID NO: 4729908 - DNA, 12 bp, Homo sapiens
aggcccttctct

SEQ ID NO: 4729909 - DNA, 15 bp, Homo sapiens
aggcccttctctcca

SEQ ID NO: 4729910 - DNA, 23 bp, Homo sapiens
aggcccttctctccagcccctgg

SEQ ID NO: 4729911 - DNA, 14 bp, Homo sapiens
aggccgagtctgtc

SEQ ID NO: 4729912 - DNA, 13 bp, Homo sapiens
aggcctcccacag

SEQ ID NO: 4729913 - DNA, 16 bp, Homo sapiens
aggcctgagatttcat

SEQ ID NO: 4729914 - DNA, 20 bp, Homo sapiens
aggcctgagatttcatctgc

SEQ ID NO: 4729915 - DNA, 21 bp, Homo sapiens
aggcctgagcgctcctgccgc

SEQ ID NO: 4729916 - DNA, 17 bp, Homo sapiens
aggcctgcctccagggc

SEQ ID NO: 4729917 - DNA, 15 bp, Homo sapiens
aggcctgccttctca

SEQ ID NO: 4729918 - DNA, 16 bp, Homo sapiens
aggcctgccttctcag

SEQ ID NO: 4729919 - DNA, 15 bp, Homo sapiens
aggcctgctcaggga

SEQ ID NO: 4729920 - DNA, 16 bp, Homo sapiens
aggcctggcacagtgt

SEQ ID NO: 4729921 - DNA, 13 bp, Homo sapiens
aggcctggccaga

SEQ ID NO: 4729922 - DNA, 23 bp, Homo sapiens
aggcctggccagatgcaccagcc

SEQ ID NO: 4729923 - DNA, 17 bp, Homo sapiens
aggcctgggggcaggga

SEQ ID NO: 4729924 - DNA, 23 bp, Homo sapiens
aggccttggggcatgacccagtg

SEQ ID NO: 4729925 - DNA, 15 bp, Homo sapiens
aggcgtggagctgcc

SEQ ID NO: 4729926 - DNA, 18 bp, Homo sapiens
aggctaaggcgtggagct

SEQ ID NO: 4729927 - DNA, 20 bp, Homo sapiens
aggctaaggcgtggagctgc

SEQ ID NO: 4729928 - DNA, 23 bp, Homo sapiens
aggctaaggcgtggagctgcctg

SEQ ID NO: 4729929 - DNA, 13 bp, Homo sapiens
aggctacactgac

SEQ ID NO: 4729930 - DNA, 18 bp, Homo sapiens
aggctacactgacactgg

SEQ ID NO: 4729931 - DNA, 18 bp, Homo sapiens
aggctattttctaaagac

SEQ ID NO: 4729932 - DNA, 15 bp, Homo sapiens
aggctccagagggca

SEQ ID NO: 4729933 - DNA, 13 bp, Homo sapiens
aggctccaggagc

SEQ ID NO: 4729934 - DNA, 14 bp, Homo sapiens
aggctccaggagca

SEQ ID NO: 4729935 - DNA, 18 bp, Homo sapiens
aggctccaggagcagcca

SEQ ID NO: 4729936 - DNA, 20 bp, Homo sapiens
aggctcctgccaccacgccc

SEQ ID NO: 4729937 - DNA, 19 bp, Homo sapiens
aggctcctttagcgcccag

SEQ ID NO: 4729938 - DNA, 12 bp, Homo sapiens
aggctcgagcat

SEQ ID NO: 4729939 - DNA, 15 bp, Homo sapiens
aggctcgagcatgcc

SEQ ID NO: 4729940 - DNA, 17 bp, Homo sapiens
aggctcgagcatgcctg

SEQ ID NO: 4729941 - DNA, 21 bp, Homo sapiens
aggctcgagcatgcctggatg

SEQ ID NO: 4729942 - DNA, 17 bp, Homo sapiens
aggctctgagacacacc

SEQ ID NO: 4729943 - DNA, 14 bp, Homo sapiens
aggctctgcccttg

SEQ ID NO: 4729944 - DNA, 19 bp, Homo sapiens
aggctgagaacactgtgaa

SEQ ID NO: 4729945 - DNA, 11 bp, Homo sapiens
aggctgagcct

SEQ ID NO: 4729946 - DNA, 19 bp, Homo sapiens
aggctgaggttgcgccact

SEQ ID NO: 4729947 - DNA, 23 bp, Homo sapiens
aggctgctcttgaactcctgacc

SEQ ID NO: 4729948 - DNA, 13 bp, Homo sapiens
aggctggccagcc

SEQ ID NO: 4729949 - DNA, 14 bp, Homo sapiens
aggctggccagccc

SEQ ID NO: 4729950 - DNA, 15 bp, Homo sapiens
aggctggccagcccc

SEQ ID NO: 4729951 - DNA, 17 bp, Homo sapiens
aggctggccagccccac

SEQ ID NO: 4729952 - DNA, 16 bp, Homo sapiens
aggctggccctgccct

SEQ ID NO: 4729953 - DNA, 13 bp, Homo sapiens
aggctggctgggg

SEQ ID NO: 4729954 - DNA, 22 bp, Homo sapiens
aggctgggagagccttccaggg

SEQ ID NO: 4729955 - DNA, 13 bp, Homo sapiens
aggctgggcaagg

SEQ ID NO: 4729956 - DNA, 20 bp, Homo sapiens
aggctgggcttcagtggcag

SEQ ID NO: 4729957 - DNA, 22 bp, Homo sapiens
aggctggggaagtcctctgggt

SEQ ID NO: 4729958 - DNA, 18 bp, Homo sapiens
aggctgtatcccatgagc

SEQ ID NO: 4729959 - DNA, 21 bp, Homo sapiens
aggctgtatcccatgagcctc

SEQ ID NO: 4729960 - DNA, 22 bp, Homo sapiens
aggctgtatcccatgagcctca

SEQ ID NO: 4729961 - DNA, 14 bp, Homo sapiens
aggctgtgctccct

SEQ ID NO: 4729962 - DNA, 24 bp, Homo sapiens
aggctgtgctccctggttctgatg

SEQ ID NO: 4729963 - DNA, 18 bp, Homo sapiens
aggcttagtcactgagac

SEQ ID NO: 4729964 - DNA, 21 bp, Homo sapiens
aggcttagtcactgagacagc

SEQ ID NO: 4729965 - DNA, 23 bp, Homo sapiens
aggcttagtcactgagacagccc

SEQ ID NO: 4729966 - DNA, 19 bp, Homo sapiens
aggcttctcagtctctgtc

SEQ ID NO: 4729967 - DNA, 13 bp, Homo sapiens
aggcttgcctggg

SEQ ID NO: 4729968 - DNA, 13 bp, Homo sapiens
aggcttttaccat

SEQ ID NO: 4729969 - DNA, 19 bp, Homo sapiens
agggaaaaaaatgcttctt

SEQ ID NO: 4729970 - DNA, 23 bp, Homo sapiens
agggaaagaaagttgcacggctg

SEQ ID NO: 4729971 - DNA, 22 bp, Homo sapiens
agggaaagttttgttctgtata

SEQ ID NO: 4729972 - DNA, 23 bp, Homo sapiens
agggaaagttttgttctgtatat

SEQ ID NO: 4729973 - DNA, 18 bp, Homo sapiens
agggaacatatttaagga

SEQ ID NO: 4729974 - DNA, 16 bp, Homo sapiens
agggaaggctggtctc

SEQ ID NO: 4729975 - DNA, 13 bp, Homo sapiens
agggaagggcctg

SEQ ID NO: 4729976 - DNA, 14 bp, Homo sapiens
agggaagggcctgc

SEQ ID NO: 4729977 - DNA, 16 bp, Homo sapiens
agggaagggcctgcca

SEQ ID NO: 4729978 - DNA, 19 bp, Homo sapiens
agggaagttcaggctctga

SEQ ID NO: 4729979 - DNA, 22 bp, Homo sapiens
agggaatgcctgagtgcctggc

SEQ ID NO: 4729980 - DNA, 18 bp, Homo sapiens
agggaatggagaatggtg

SEQ ID NO: 4729981 - DNA, 22 bp, Homo sapiens
agggacagagggggtggcctcc

SEQ ID NO: 4729982 - DNA, 23 bp, Homo sapiens
agggacagagggggtggcctccc

SEQ ID NO: 4729983 - DNA, 13 bp, Homo sapiens
agggacccctcct

SEQ ID NO: 4729984 - DNA, 14 bp, Homo sapiens
agggacccctcctc

SEQ ID NO: 4729985 - DNA, 15 bp, Homo sapiens
agggacgcctggggg

SEQ ID NO: 4729986 - DNA, 20 bp, Homo sapiens
agggactcatcatttccatt

SEQ ID NO: 4729987 - DNA, 13 bp, Homo sapiens
agggagaggagtg

SEQ ID NO: 4729988 - DNA, 16 bp, Homo sapiens
agggagcgagggagaa

SEQ ID NO: 4729989 - DNA, 15 bp, Homo sapiens
agggagggagggctc

SEQ ID NO: 4729990 - DNA, 16 bp, Homo sapiens
acagctccttctgtcc

SEQ ID NO: 4729991 - DNA, 13 bp, Homo sapiens
acagctctgtcct

SEQ ID NO: 4729992 - DNA, 14 bp, Homo sapiens
acagctctgtcctg

SEQ ID NO: 4729993 - DNA, 12 bp, Homo sapiens
acagctcttgtt

SEQ ID NO: 4729994 - DNA, 19 bp, Homo sapiens
acagctgggtggcactgcc

SEQ ID NO: 4729995 - DNA, 20 bp, Homo sapiens
acagctgggtggcactgcca

SEQ ID NO: 4729996 - DNA, 23 bp, Homo sapiens
acagctgggtggcactgccatgc

SEQ ID NO: 4729997 - DNA, 13 bp, Homo sapiens
acagcttcaggtt

SEQ ID NO: 4729998 - DNA, 22 bp, Homo sapiens
acagcttcaggttatcgaaata

SEQ ID NO: 4729999 - DNA, 17 bp, Homo sapiens
acagcttcatttcctgt

SEQ ID NO: 4730000 - DNA, 19 bp, Homo sapiens
acaggaaaagctgctgaca

SEQ ID NO: 4730001 - DNA, 16 bp, Homo sapiens
acaggaagcctcaagt

SEQ ID NO: 4730002 - DNA, 23 bp, Homo sapiens
acaggcaatgctggctgttggct

SEQ ID NO: 4730003 - DNA, 23 bp, Homo sapiens
acaggcacccaccatcatgtctg

SEQ ID NO: 4730004 - DNA, 14 bp, Homo sapiens
acaggcatgttctc

SEQ ID NO: 4730005 - DNA, 18 bp, Homo sapiens
acaggcatgttctctgag

SEQ ID NO: 4730006 - DNA, 20 bp, Homo sapiens
acaggcatgttctctgagga

SEQ ID NO: 4730007 - DNA, 16 bp, Homo sapiens
acaggcccggctccag

SEQ ID NO: 4730008 - DNA, 17 bp, Homo sapiens
acaggcctgagatttca

SEQ ID NO: 4730009 - DNA, 21 bp, Homo sapiens
acaggcctgagatttcatctg

SEQ ID NO: 4730010 - DNA, 12 bp, Homo sapiens
acaggctgggct

SEQ ID NO: 4730011 - DNA, 13 bp, Homo sapiens
acagggatgagca

SEQ ID NO: 4730012 - DNA, 20 bp, Homo sapiens
acagggcacaccgggcactc

SEQ ID NO: 4730013 - DNA, 22 bp, Homo sapiens
acagggcacaccgggcactcag

SEQ ID NO: 4730014 - DNA, 19 bp, Homo sapiens
acagggttttgccatgttg

SEQ ID NO: 4730015 - DNA, 20 bp, Homo sapiens
acaggtgggcttcccagtgg

SEQ ID NO: 4730016 - DNA, 20 bp, Homo sapiens
acaggtgtgaaccaccacac

SEQ ID NO: 4730017 - DNA, 23 bp, Homo sapiens
acaggtgtgagtcaccaagccca

SEQ ID NO: 4730018 - DNA, 18 bp, Homo sapiens
acaggttataacagtgtt

SEQ ID NO: 4730019 - DNA, 21 bp, Homo sapiens
aggccatggagagctggagcc

SEQ ID NO: 4730020 - DNA, 22 bp, Homo sapiens
aggccatggagagctggagcct

SEQ ID NO: 4730021 - DNA, 22 bp, Homo sapiens
aggccatggcatccctttttca

SEQ ID NO: 4730022 - DNA, 17 bp, Homo sapiens
aggccatgggcctcctg

SEQ ID NO: 4730023 - DNA, 13 bp, Homo sapiens
aggcccagagggc

SEQ ID NO: 4730024 - DNA, 20 bp, Homo sapiens
aggcccagagggcctgcaag

SEQ ID NO: 4730025 - DNA, 21 bp, Homo sapiens
aggcccagagggcctgcaagg

SEQ ID NO: 4730026 - DNA, 17 bp, Homo sapiens
aggcccagtgagatgca

SEQ ID NO: 4730027 - DNA, 18 bp, Homo sapiens
ggaggctccagagggcac

SEQ ID NO: 4730028 - DNA, 21 bp, Homo sapiens
ggagggaatgaacctggaggg

SEQ ID NO: 4730029 - DNA, 12 bp, Homo sapiens
ggagggagggct

SEQ ID NO: 4730030 - DNA, 16 bp, Homo sapiens
ggagggcagcagaagg

SEQ ID NO: 4730031 - DNA, 13 bp, Homo sapiens
ggagggcagcagg

SEQ ID NO: 4730032 - DNA, 16 bp, Homo sapiens
ggagggcagcagggct

SEQ ID NO: 4730033 - DNA, 17 bp, Homo sapiens
ggagggcagcagggcta

SEQ ID NO: 4730034 - DNA, 23 bp, Homo sapiens
ggagggccacatgggaggctcac

SEQ ID NO: 4730035 - DNA, 16 bp, Homo sapiens
ggagggctagaaccta

SEQ ID NO: 4730036 - DNA, 22 bp, Homo sapiens
ggagggctagaatctggagagc

SEQ ID NO: 4730037 - DNA, 13 bp, Homo sapiens
ggagggctccaga

SEQ ID NO: 4730038 - DNA, 17 bp, Homo sapiens
ggagggctccagacaca

SEQ ID NO: 4730039 - DNA, 13 bp, Homo sapiens
ggaggggggaggt

SEQ ID NO: 4730040 - DNA, 15 bp, Homo sapiens
ggagtctgactgtgc

SEQ ID NO: 4730041 - DNA, 23 bp, Homo sapiens
ggagtgagttgatagcacagacc

SEQ ID NO: 4730042 - DNA, 12 bp, Homo sapiens
ggagtgggccca

SEQ ID NO: 4730043 - DNA, 19 bp, Homo sapiens
ggagttcttcttctcctag

SEQ ID NO: 4730044 - DNA, 13 bp, Homo sapiens
ggataaagcagct

SEQ ID NO: 4730045 - DNA, 19 bp, Homo sapiens
ggataatggtgaacatttt

SEQ ID NO: 4730046 - DNA, 16 bp, Homo sapiens
ggataggtattttata

SEQ ID NO: 4730047 - DNA, 13 bp, Homo sapiens
ggatcagaagtat

SEQ ID NO: 4730048 - DNA, 19 bp, Homo sapiens
ggatcatggtgtaataaga

SEQ ID NO: 4730049 - DNA, 17 bp, Homo sapiens
ggatccctcatcctcat

SEQ ID NO: 4730050 - DNA, 12 bp, Homo sapiens
ggatcctccagg

SEQ ID NO: 4730051 - DNA, 14 bp, Homo sapiens
ggatctgcccctcc

SEQ ID NO: 4730052 - DNA, 17 bp, Homo sapiens
ggatctgcccctccctg

SEQ ID NO: 4730053 - DNA, 19 bp, Homo sapiens
ggatgagcatggagctggc

SEQ ID NO: 4730054 - DNA, 23 bp, Homo sapiens
ggatgagtacccaaaagctcagc

SEQ ID NO: 4730055 - DNA, 21 bp, Homo sapiens
ggatgattggaggggggaggt

SEQ ID NO: 4730056 - DNA, 16 bp, Homo sapiens
ggatgcagcctcacag

SEQ ID NO: 4730057 - DNA, 21 bp, Homo sapiens
ggatgcatgttttccagctcc

SEQ ID NO: 4730058 - DNA, 13 bp, Homo sapiens
ggatgcctggtgg

SEQ ID NO: 4730059 - DNA, 17 bp, Homo sapiens
ggatgcctggtggcagc

SEQ ID NO: 4730060 - DNA, 15 bp, Homo sapiens
ggatggtgacttttg

SEQ ID NO: 4730061 - DNA, 20 bp, Homo sapiens
ggattaatttgtgaaaatgt

SEQ ID NO: 4730062 - DNA, 17 bp, Homo sapiens
ggattatttaataacat

SEQ ID NO: 4730063 - DNA, 19 bp, Homo sapiens
ggattcctaagactgctgc

SEQ ID NO: 4730064 - DNA, 18 bp, Homo sapiens
ggattggattatttaata

SEQ ID NO: 4730065 - DNA, 22 bp, Homo sapiens
ggattgtaaaaaaaaatgcctt

SEQ ID NO: 4730066 - DNA, 23 bp, Homo sapiens
ggattgtaaaaaaaaatgccttt

SEQ ID NO: 4730067 - DNA, 20 bp, Homo sapiens
ggattgtccccgacccttgc

SEQ ID NO: 4730068 - DNA, 16 bp, Homo sapiens
ggatttaaaagcctgc

SEQ ID NO: 4730069 - DNA, 14 bp, Homo sapiens
ggatttttgtcttg

SEQ ID NO: 4730070 - DNA, 13 bp, Homo sapiens
ggcaaatgcccaa

SEQ ID NO: 4730071 - DNA, 16 bp, Homo sapiens
ggcaacccccagcctg

SEQ ID NO: 4730072 - DNA, 17 bp, Homo sapiens
ggcaacccccagcctgc

SEQ ID NO: 4730073 - DNA, 19 bp, Homo sapiens
ggcaacccccagcctgcta

SEQ ID NO: 4730074 - DNA, 23 bp, Homo sapiens
ggcaagagaatcgcttgaaccca

SEQ ID NO: 4730075 - DNA, 15 bp, Homo sapiens
ggcaagcaagagctc

SEQ ID NO: 4730076 - DNA, 18 bp, Homo sapiens
ggcaagcacctcctgcct

SEQ ID NO: 4730077 - DNA, 19 bp, Homo sapiens
ggcaagcacctcctgcctc

SEQ ID NO: 4730078 - DNA, 15 bp, Homo sapiens
ggcaatgctggctgt

SEQ ID NO: 4730079 - DNA, 15 bp, Homo sapiens
ggcacagtgtctggg

SEQ ID NO: 4730080 - DNA, 18 bp, Homo sapiens
ggcacccggcccctgctg

SEQ ID NO: 4730081 - DNA, 18 bp, Homo sapiens
ggcaccggggcctcggac

SEQ ID NO: 4730082 - DNA, 16 bp, Homo sapiens
ggcacctgcaggttgg

SEQ ID NO: 4730083 - DNA, 14 bp, Homo sapiens
ggcactatttttat

SEQ ID NO: 4730084 - DNA, 14 bp, Homo sapiens
ggcacttcctcccc

SEQ ID NO: 4730085 - DNA, 15 bp, Homo sapiens
ggcagaagacaccag

SEQ ID NO: 4730086 - DNA, 20 bp, Homo sapiens
ggcagaagacaccagagcag

SEQ ID NO: 4730087 - DNA, 17 bp, Homo sapiens
ggcagaaggcaaaccca

SEQ ID NO: 4730088 - DNA, 12 bp, Homo sapiens
ggcagagcagag

SEQ ID NO: 4730089 - DNA, 21 bp, Homo sapiens
ggcagagcttggactggatgc

SEQ ID NO: 4730090 - DNA, 19 bp, Homo sapiens
ggcagaggttgcagtgagc

SEQ ID NO: 4730091 - DNA, 21 bp, Homo sapiens
ggcagaggttgcagtgagccg

SEQ ID NO: 4730092 - DNA, 19 bp, Homo sapiens
ggcagcaggtgctgctacc

SEQ ID NO: 4730093 - DNA, 22 bp, Homo sapiens
ggcagcagtgtgaggccagggc

SEQ ID NO: 4730094 - DNA, 13 bp, Homo sapiens
ggcagccaggcca

SEQ ID NO: 4730095 - DNA, 20 bp, Homo sapiens
ggcagccagggagagcccag

SEQ ID NO: 4730096 - DNA, 22 bp, Homo sapiens
ggcagccccattctgcctgccc

SEQ ID NO: 4730097 - DNA, 13 bp, Homo sapiens
ggcagccctcctt

SEQ ID NO: 4730098 - DNA, 16 bp, Homo sapiens
ggcagctcacctctcc

SEQ ID NO: 4730099 - DNA, 18 bp, Homo sapiens
ggcagctcacctctccct

SEQ ID NO: 4730100 - DNA, 21 bp, Homo sapiens
ggcagctcacctctcccttgg

SEQ ID NO: 4730101 - DNA, 22 bp, Homo sapiens
ggcagctcacctctcccttgga

SEQ ID NO: 4730102 - DNA, 21 bp, Homo sapiens
ggcagctgcggtccacccagg

SEQ ID NO: 4730103 - DNA, 23 bp, Homo sapiens
ggcagctgcggtccacccaggag

SEQ ID NO: 4730104 - DNA, 16 bp, Homo sapiens
ggcagctgctggctgt

SEQ ID NO: 4730105 - DNA, 21 bp, Homo sapiens
ggcagctgctggctgtgacaa

SEQ ID NO: 4730106 - DNA, 17 bp, Homo sapiens
ggcagcttgagggttgg

SEQ ID NO: 4730107 - DNA, 21 bp, Homo sapiens
ggcagcttgagggttgggctg

SEQ ID NO: 4730108 - DNA, 14 bp, Homo sapiens
ggcaggaaggctga

SEQ ID NO: 4730109 - DNA, 23 bp, Homo sapiens
ggcaggacatgctgaagccaaag

SEQ ID NO: 4730110 - DNA, 21 bp, Homo sapiens
ggcaggactcagctccccaga

SEQ ID NO: 4730111 - DNA, 19 bp, Homo sapiens
ggcaggatggcctggccag

SEQ ID NO: 4730112 - DNA, 21 bp, Homo sapiens
ggcaggccctgcactgtcctg

SEQ ID NO: 4730113 - DNA, 17 bp, Homo sapiens
ggcaggctaaggcgtgg

SEQ ID NO: 4730114 - DNA, 17 bp, Homo sapiens
ggcagggaacatgggga

SEQ ID NO: 4730115 - DNA, 10 bp, Homo sapiens
ggcagggagg

SEQ ID NO: 4730116 - DNA, 20 bp, Homo sapiens
ggcagggagggcctgggccc

SEQ ID NO: 4730117 - DNA, 18 bp, Homo sapiens
ggcagggtctcactctgt

SEQ ID NO: 4730118 - DNA, 13 bp, Homo sapiens
ggcaggtccaggg

SEQ ID NO: 4730119 - DNA, 23 bp, Homo sapiens
ggcaggtcttgaactcctggcct

SEQ ID NO: 4730120 - DNA, 16 bp, Homo sapiens
ggcaggttagaaccta

SEQ ID NO: 4730121 - DNA, 20 bp, Homo sapiens
ggcaggttagaacctagaag

SEQ ID NO: 4730122 - DNA, 15 bp, Homo sapiens
ggcagtgggaaaaat

SEQ ID NO: 4730123 - DNA, 13 bp, Homo sapiens
ggcagtgggagct

SEQ ID NO: 4730124 - DNA, 19 bp, Homo sapiens
ggcagtgggagctgcctgt

SEQ ID NO: 4730125 - DNA, 16 bp, Homo sapiens
ggcatcagctggcgtc

SEQ ID NO: 4730126 - DNA, 20 bp, Homo sapiens
ggcatctcattgaggacaaa

SEQ ID NO: 4730127 - DNA, 23 bp, Homo sapiens
ggcatgaagtttccttggctggt

SEQ ID NO: 4730128 - DNA, 13 bp, Homo sapiens
ggcatgacccagt

SEQ ID NO: 4730129 - DNA, 19 bp, Homo sapiens
ggcatgggtcgggagaggg

SEQ ID NO: 4730130 - DNA, 20 bp, Homo sapiens
ggcatgtattagccagtcat

SEQ ID NO: 4730131 - DNA, 20 bp, Homo sapiens
ggcatgttctctgaggacac

SEQ ID NO: 4730132 - DNA, 23 bp, Homo sapiens
ggcatgttctctgaggacactaa

SEQ ID NO: 4730133 - DNA, 21 bp, Homo sapiens
ggcattggcagcaggtgctgc

SEQ ID NO: 4730134 - DNA, 12 bp, Homo sapiens
ggcattgtggga

SEQ ID NO: 4730135 - DNA, 19 bp, Homo sapiens
ggccacatgggaggctcac

SEQ ID NO: 4730136 - DNA, 19 bp, Homo sapiens
ggccacctcaccctctccg

SEQ ID NO: 4730137 - DNA, 18 bp, Homo sapiens
ggccacgtgatgtggagg

SEQ ID NO: 4730138 - DNA, 15 bp, Homo sapiens
ggccacttctgggtg

SEQ ID NO: 4730139 - DNA, 23 bp, Homo sapiens
ggccagatgcacatccctggaag

SEQ ID NO: 4730140 - DNA, 17 bp, Homo sapiens
ggccagatgcaccagcc

SEQ ID NO: 4730141 - DNA, 19 bp, Homo sapiens
ggccagatgcaccagccct

SEQ ID NO: 4730142 - DNA, 20 bp, Homo sapiens
ggccagatgcaccagccctt

SEQ ID NO: 4730143 - DNA, 23 bp, Homo sapiens
ggccagccccacagcccacgtcc

SEQ ID NO: 4730144 - DNA, 20 bp, Homo sapiens
ggccagccttgaccattctc

SEQ ID NO: 4730145 - DNA, 22 bp, Homo sapiens
ggccagccttgaccattctcca

SEQ ID NO: 4730146 - DNA, 15 bp, Homo sapiens
ggccaggactctgca

SEQ ID NO: 4730147 - DNA, 21 bp, Homo sapiens
ggccaggactctgcagcctca

SEQ ID NO: 4730148 - DNA, 14 bp, Homo sapiens
ggccaggccctctg

SEQ ID NO: 4730149 - DNA, 14 bp, Homo sapiens
ggccaggctgctct

SEQ ID NO: 4730150 - DNA, 15 bp, Homo sapiens
ggccaggctgctctt

SEQ ID NO: 4730151 - DNA, 13 bp, Homo sapiens
ggccagggcagag

SEQ ID NO: 4730152 - DNA, 23 bp, Homo sapiens
ggccagggcctggaagacagaga

SEQ ID NO: 4730153 - DNA, 17 bp, Homo sapiens
ggccagttggtccccct

SEQ ID NO: 4730154 - DNA, 17 bp, Homo sapiens
ggccatcttccaggtgg

SEQ ID NO: 4730155 - DNA, 14 bp, Homo sapiens
ggccatggagagct

SEQ ID NO: 4730156 - DNA, 21 bp, Homo sapiens
ggccatggagagctggagcct

SEQ ID NO: 4730157 - DNA, 17 bp, Homo sapiens
ggcccaagtttctaagg

SEQ ID NO: 4730158 - DNA, 19 bp, Homo sapiens
ggcccaagtttctaaggga

SEQ ID NO: 4730159 - DNA, 21 bp, Homo sapiens
ggcccaatccaaggtggggtg

SEQ ID NO: 4730160 - DNA, 14 bp, Homo sapiens
ggcccagagggcct

SEQ ID NO: 4730161 - DNA, 17 bp, Homo sapiens
ggcccagagggcctgca

SEQ ID NO: 4730162 - DNA, 12 bp, Homo sapiens
ggcccagctccc

SEQ ID NO: 4730163 - DNA, 14 bp, Homo sapiens
ggcccagctccccc

SEQ ID NO: 4730164 - DNA, 22 bp, Homo sapiens
ggcccagtatgagccctagaag

SEQ ID NO: 4730165 - DNA, 18 bp, Homo sapiens
ggcccatcccccctcacc

SEQ ID NO: 4730166 - DNA, 19 bp, Homo sapiens
ggcccatcccccctcacca

SEQ ID NO: 4730167 - DNA, 11 bp, Homo sapiens
ggccccagcct

SEQ ID NO: 4730168 - DNA, 15 bp, Homo sapiens
ggccccagcctggcc

SEQ ID NO: 4730169 - DNA, 16 bp, Homo sapiens
ggccccagcctggccc

SEQ ID NO: 4730170 - DNA, 19 bp, Homo sapiens
ggccccagcctggcccagc

SEQ ID NO: 4730171 - DNA, 22 bp, Homo sapiens
ggccccagcctggcccagctcc

SEQ ID NO: 4730172 - DNA, 21 bp, Homo sapiens
ggcccctcagggtccctggtg

SEQ ID NO: 4730173 - DNA, 14 bp, Homo sapiens
ggcccctctcctcc

SEQ ID NO: 4730174 - DNA, 13 bp, Homo sapiens
ggcccctgccacc

SEQ ID NO: 4730175 - DNA, 16 bp, Homo sapiens
ggcccctgccaccctg

SEQ ID NO: 4730176 - DNA, 18 bp, Homo sapiens
ggcccctgccaccctggg

SEQ ID NO: 4730177 - DNA, 20 bp, Homo sapiens
ggcccctgcccggctgcgga

SEQ ID NO: 4730178 - DNA, 14 bp, Homo sapiens
ggcccgcttgcctc

SEQ ID NO: 4730179 - DNA, 19 bp, Homo sapiens
ggcccgcttgcctcggctc

SEQ ID NO: 4730180 - DNA, 22 bp, Homo sapiens
ggcccgcttgcctcggctcctg

SEQ ID NO: 4730181 - DNA, 15 bp, Homo sapiens
ggcccggctccaggc

SEQ ID NO: 4730182 - DNA, 16 bp, Homo sapiens
ggcccggctgggcccc

SEQ ID NO: 4730183 - DNA, 19 bp, Homo sapiens
ggcccgttgtctccctggc

SEQ ID NO: 4730184 - DNA, 21 bp, Homo sapiens
ggcccgttgtctccctggccc

SEQ ID NO: 4730185 - DNA, 20 bp, Homo sapiens
ggccctcaaggcctcccaca

SEQ ID NO: 4730186 - DNA, 19 bp, Homo sapiens
ggccctccacacctgcggc

SEQ ID NO: 4730187 - DNA, 12 bp, Homo sapiens
ggccctcccagt

SEQ ID NO: 4730188 - DNA, 19 bp, Homo sapiens
ggccctcgctgccagctct

SEQ ID NO: 4730189 - DNA, 22 bp, Homo sapiens
ggccctcgctgccagctctgta

SEQ ID NO: 4730190 - DNA, 12 bp, Homo sapiens
ggccctctcccc

SEQ ID NO: 4730191 - DNA, 15 bp, Homo sapiens
ggccctctcccctgc

SEQ ID NO: 4730192 - DNA, 15 bp, Homo sapiens
ggccctctctgctct

SEQ ID NO: 4730193 - DNA, 15 bp, Homo sapiens
ggccctctgcccact

SEQ ID NO: 4730194 - DNA, 17 bp, Homo sapiens
ggccctctgcccactcc

SEQ ID NO: 4730195 - DNA, 15 bp, Homo sapiens
ggccctgcactgtcc

SEQ ID NO: 4730196 - DNA, 16 bp, Homo sapiens
ggccctgcactgtcct

SEQ ID NO: 4730197 - DNA, 13 bp, Homo sapiens
ggccctgccctgg

SEQ ID NO: 4730198 - DNA, 17 bp, Homo sapiens
ggccctgctgcccctcc

SEQ ID NO: 4730199 - DNA, 18 bp, Homo sapiens
ggccctgctgcccctccc

SEQ ID NO: 4730200 - DNA, 13 bp, Homo sapiens
ggccctgggcccg

SEQ ID NO: 4730201 - DNA, 22 bp, Homo sapiens
ggcccttctctccagcccctgg

SEQ ID NO: 4730202 - DNA, 16 bp, Homo sapiens
ggccgagtctgtcctg

SEQ ID NO: 4730203 - DNA, 18 bp, Homo sapiens
ggccgagtctgtcctgga

SEQ ID NO: 4730204 - DNA, 19 bp, Homo sapiens
ggccgagtctgtcctggaa

SEQ ID NO: 4730205 - DNA, 20 bp, Homo sapiens
ggccgatgtgggtccctctc

SEQ ID NO: 4730206 - DNA, 16 bp, Homo sapiens
ggccggccaggtgggc

SEQ ID NO: 4730207 - DNA, 23 bp, Homo sapiens
ggccggcgcagcgcagagcgggc

SEQ ID NO: 4730208 - DNA, 14 bp, Homo sapiens
ggccgtgggcctgg

SEQ ID NO: 4730209 - DNA, 19 bp, Homo sapiens
ggccgttgatgttggctgg

SEQ ID NO: 4730210 - DNA, 14 bp, Homo sapiens
ggcctcaagtgatt

SEQ ID NO: 4730211 - DNA, 22 bp, Homo sapiens
ggcctcaagtgattctcctgcc

SEQ ID NO: 4730212 - DNA, 13 bp, Homo sapiens
ggcctcagtgcca

SEQ ID NO: 4730213 - DNA, 22 bp, Homo sapiens
ggcctcccaactcaccccagcc

SEQ ID NO: 4730214 - DNA, 12 bp, Homo sapiens
ggcctcccccac

SEQ ID NO: 4730215 - DNA, 15 bp, Homo sapiens
ggcctcccccacttt

SEQ ID NO: 4730216 - DNA, 22 bp, Homo sapiens
ggcctcctcacaacatggtgtc

SEQ ID NO: 4730217 - DNA, 14 bp, Homo sapiens
ggcctcgcctggcc

SEQ ID NO: 4730218 - DNA, 18 bp, Homo sapiens
ggcctcgcctggcctgag

SEQ ID NO: 4730219 - DNA, 16 bp, Homo sapiens
ggcctctgcactcccc

SEQ ID NO: 4730220 - DNA, 19 bp, Homo sapiens
ggcctctgcactcccctgc

SEQ ID NO: 4730221 - DNA, 17 bp, Homo sapiens
ggcctgactccttctgc

SEQ ID NO: 4730222 - DNA, 22 bp, Homo sapiens
ggcctgagatttcatctgctct

SEQ ID NO: 4730223 - DNA, 16 bp, Homo sapiens
ggcctgcaagggagtg

SEQ ID NO: 4730224 - DNA, 15 bp, Homo sapiens
ggcctgcccagttgc

SEQ ID NO: 4730225 - DNA, 16 bp, Homo sapiens
ggcctggaagacagag

SEQ ID NO: 4730226 - DNA, 17 bp, Homo sapiens
ggcctggccagggcctg

SEQ ID NO: 4730227 - DNA, 18 bp, Homo sapiens
ggcctggccagggcctgg

SEQ ID NO: 4730228 - DNA, 16 bp, Homo sapiens
ggcctggccatgtggc

SEQ ID NO: 4730229 - DNA, 13 bp, Homo sapiens
ggcctggcccctc

SEQ ID NO: 4730230 - DNA, 23 bp, Homo sapiens
ggcctggcccctcagggtccctg

SEQ ID NO: 4730231 - DNA, 14 bp, Homo sapiens
ggcctggcctgagc

SEQ ID NO: 4730232 - DNA, 14 bp, Homo sapiens
ggcctgggccagag

SEQ ID NO: 4730233 - DNA, 11 bp, Homo sapiens
ggcctgggccc

SEQ ID NO: 4730234 - DNA, 18 bp, Homo sapiens
ggcctggggtaccaagag

SEQ ID NO: 4730235 - DNA, 12 bp, Homo sapiens
ggcctgtgtccc

SEQ ID NO: 4730236 - DNA, 17 bp, Homo sapiens
ggcgacaagagtgagac

SEQ ID NO: 4730237 - DNA, 14 bp, Homo sapiens
ggcgagaggagggg

SEQ ID NO: 4730238 - DNA, 17 bp, Homo sapiens
ggcgcaaagggcatggg

SEQ ID NO: 4730239 - DNA, 18 bp, Homo sapiens
ggcgcaccctcccctccc

SEQ ID NO: 4730240 - DNA, 14 bp, Homo sapiens
ggcgcagcgcagag

SEQ ID NO: 4730241 - DNA, 13 bp, Homo sapiens
ggcgccctctgtc

SEQ ID NO: 4730242 - DNA, 16 bp, Homo sapiens
ggcgccctctgtcctg

SEQ ID NO: 4730243 - DNA, 22 bp, Homo sapiens
ggcgcggggaggccggcgcagc

SEQ ID NO: 4730244 - DNA, 17 bp, Homo sapiens
ggcgtgagacctgcccc

SEQ ID NO: 4730245 - DNA, 18 bp, Homo sapiens
ggcgtgagacctgcccct

SEQ ID NO: 4730246 - DNA, 19 bp, Homo sapiens
ggcgtgcagtggtgcgatc

SEQ ID NO: 4730247 - DNA, 12 bp, Homo sapiens
ggcgtggagctg

SEQ ID NO: 4730248 - DNA, 20 bp, Homo sapiens
ggctaagtgatcctcccacc

SEQ ID NO: 4730249 - DNA, 12 bp, Homo sapiens
ggctaatttaac

SEQ ID NO: 4730250 - DNA, 20 bp, Homo sapiens
gctgtgtgaatacctgctca

SEQ ID NO: 4730251 - DNA, 20 bp, Homo sapiens
gctgttggctgggggcctca

SEQ ID NO: 4730252 - DNA, 21 bp, Homo sapiens
gctgttggctgggggcctcag

SEQ ID NO: 4730253 - DNA, 22 bp, Homo sapiens
gctgttggctgggggcctcagt

SEQ ID NO: 4730254 - DNA, 15 bp, Homo sapiens
gctgttgtaaagaat

SEQ ID NO: 4730255 - DNA, 13 bp, Homo sapiens
gctgttgtacatt

SEQ ID NO: 4730256 - DNA, 15 bp, Homo sapiens
gctgtttactgcttt

SEQ ID NO: 4730257 - DNA, 21 bp, Homo sapiens
gctgtttactgcttttcatta

SEQ ID NO: 4730258 - DNA, 22 bp, Homo sapiens
gcttaattattgatgttttcat

SEQ ID NO: 4730259 - DNA, 23 bp, Homo sapiens
gcttactgaagaaatctttccag

SEQ ID NO: 4730260 - DNA, 17 bp, Homo sapiens
gcttagctttgctctgc

SEQ ID NO: 4730261 - DNA, 20 bp, Homo sapiens
gcttagtcactgagacagcc

SEQ ID NO: 4730262 - DNA, 15 bp, Homo sapiens
gcttatgcttgtgta

SEQ ID NO: 4730263 - DNA, 16 bp, Homo sapiens
gcttatgcttgtgtat

SEQ ID NO: 4730264 - DNA, 17 bp, Homo sapiens
gcttatgcttgtgtata

SEQ ID NO: 4730265 - DNA, 20 bp, Homo sapiens
gcttatttagcacattttga

SEQ ID NO: 4730266 - DNA, 14 bp, Homo sapiens
gcttcactgtataa

SEQ ID NO: 4730267 - DNA, 21 bp, Homo sapiens
gcttcaggttatcgaaataac

SEQ ID NO: 4730268 - DNA, 22 bp, Homo sapiens
gcttcaggttatcgaaataaca

SEQ ID NO: 4730269 - DNA, 18 bp, Homo sapiens
gcttcagtggcagctgct

SEQ ID NO: 4730270 - DNA, 20 bp, Homo sapiens
gcttcagtggcagctgcttt

SEQ ID NO: 4730271 - DNA, 17 bp, Homo sapiens
gcttcatggcagaaggc

SEQ ID NO: 4730272 - DNA, 15 bp, Homo sapiens
gcttcattagagcag

SEQ ID NO: 4730273 - DNA, 16 bp, Homo sapiens
gcttcattagagcagg

SEQ ID NO: 4730274 - DNA, 18 bp, Homo sapiens
gcttcattagagcaggcg

SEQ ID NO: 4730275 - DNA, 13 bp, Homo sapiens
gcttcatttcctg

SEQ ID NO: 4730276 - DNA, 19 bp, Homo sapiens
gcttccagagctctgaccc

SEQ ID NO: 4730277 - DNA, 15 bp, Homo sapiens
gcttccagtgaggct

SEQ ID NO: 4730278 - DNA, 16 bp, Homo sapiens
gcttccagtgaggctc

SEQ ID NO: 4730279 - DNA, 20 bp, Homo sapiens
gcttccagtgaggctctgcc

SEQ ID NO: 4730280 - DNA, 21 bp, Homo sapiens
gcttccagtgaggctctgccc

SEQ ID NO: 4730281 - DNA, 22 bp, Homo sapiens
gcttccagtgaggctctgccct

SEQ ID NO: 4730282 - DNA, 15 bp, Homo sapiens
gcttccattaacaaa

SEQ ID NO: 4730283 - DNA, 13 bp, Homo sapiens
gcttcctctgaat

SEQ ID NO: 4730284 - DNA, 21 bp, Homo sapiens
gcttctaaatggtgctgcaga

SEQ ID NO: 4730285 - DNA, 16 bp, Homo sapiens
gcttctctctgtggga

SEQ ID NO: 4730286 - DNA, 12 bp, Homo sapiens
gcttctgccact

SEQ ID NO: 4730287 - DNA, 16 bp, Homo sapiens
gcttctgctgggctgg

SEQ ID NO: 4730288 - DNA, 18 bp, Homo sapiens
gcttctggctttgttctt

SEQ ID NO: 4730289 - DNA, 18 bp, Homo sapiens
gcttctgttgctgcctca

SEQ ID NO: 4730290 - DNA, 21 bp, Homo sapiens
gcttcttaatcttttcacaaa

SEQ ID NO: 4730291 - DNA, 22 bp, Homo sapiens
gcttcttaatcttttcacaaat

SEQ ID NO: 4730292 - DNA, 12 bp, Homo sapiens
gcttcttcagag

SEQ ID NO: 4730293 - DNA, 16 bp, Homo sapiens
gcttcttcagagactc

SEQ ID NO: 4730294 - DNA, 21 bp, Homo sapiens
gcttcttcagagactcctgca

SEQ ID NO: 4730295 - DNA, 13 bp, Homo sapiens
gcttgaacccagg

SEQ ID NO: 4730296 - DNA, 18 bp, Homo sapiens
gcttgagggttgggctgg

SEQ ID NO: 4730297 - DNA, 22 bp, Homo sapiens
gcttgcctcggctcctgctgca

SEQ ID NO: 4730298 - DNA, 22 bp, Homo sapiens
gcttgcctgggacggctgagct

SEQ ID NO: 4730299 - DNA, 18 bp, Homo sapiens
gcttggaaactggatgag

SEQ ID NO: 4730300 - DNA, 16 bp, Homo sapiens
gcttggagcagagggg

SEQ ID NO: 4730301 - DNA, 14 bp, Homo sapiens
gcttggaggaagga

SEQ ID NO: 4730302 - DNA, 15 bp, Homo sapiens
gcttggaggaaggaa

SEQ ID NO: 4730303 - DNA, 17 bp, Homo sapiens
gcttggattctctgaga

SEQ ID NO: 4730304 - DNA, 18 bp, Homo sapiens
gcttgtaaatagctcagg

SEQ ID NO: 4730305 - DNA, 21 bp, Homo sapiens
gcttgtgtatatgtataaatt

SEQ ID NO: 4730306 - DNA, 12 bp, Homo sapiens
gctttcatgtaa

SEQ ID NO: 4730307 - DNA, 16 bp, Homo sapiens
gctttcgaactgctag

SEQ ID NO: 4730308 - DNA, 14 bp, Homo sapiens
gctttctccttcac

SEQ ID NO: 4730309 - DNA, 11 bp, Homo sapiens
gctttctgtct

SEQ ID NO: 4730310 - DNA, 16 bp, Homo sapiens
gctttcttctcctgtg

SEQ ID NO: 4730311 - DNA, 13 bp, Homo sapiens
gctttgctctgcc

SEQ ID NO: 4730312 - DNA, 20 bp, Homo sapiens
gctttgggtcatttttaact

SEQ ID NO: 4730313 - DNA, 16 bp, Homo sapiens
gctttgttcttgtcat

SEQ ID NO: 4730314 - DNA, 22 bp, Homo sapiens
gctttgttcttgtcatcagtaa

SEQ ID NO: 4730315 - DNA, 20 bp, Homo sapiens
gcttttacgtagtaaaagtc

SEQ ID NO: 4730316 - DNA, 16 bp, Homo sapiens
gcttttcccaaaagcc

SEQ ID NO: 4730317 - DNA, 14 bp, Homo sapiens
gcttttcccaaccc

SEQ ID NO: 4730318 - DNA, 14 bp, Homo sapiens
gcttttcttcctag

SEQ ID NO: 4730319 - DNA, 20 bp, Homo sapiens
gctttttaattgttgtttct

SEQ ID NO: 4730320 - DNA, 21 bp, Homo sapiens
gctttttaattgttgtttctt

SEQ ID NO: 4730321 - DNA, 22 bp, Homo sapiens
gcttttttatttaccttttaag

SEQ ID NO: 4730322 - DNA, 20 bp, Homo sapiens
gctttttttgcctaccattt

SEQ ID NO: 4730323 - DNA, 16 bp, Homo sapiens
ggaaaaaataacaatg

SEQ ID NO: 4730324 - DNA, 15 bp, Homo sapiens
ggaaaaatgtaggag

SEQ ID NO: 4730325 - DNA, 13 bp, Homo sapiens
ggaaaagaaatca

SEQ ID NO: 4730326 - DNA, 18 bp, Homo sapiens
ggaaaagaaatcaatttt

SEQ ID NO: 4730327 - DNA, 14 bp, Homo sapiens
ggaaaagctgctga

SEQ ID NO: 4730328 - DNA, 20 bp, Homo sapiens
ggaaaagctgctgacagtgt

SEQ ID NO: 4730329 - DNA, 20 bp, Homo sapiens
ggaaaaggcagggagcgagg

SEQ ID NO: 4730330 - DNA, 18 bp, Homo sapiens
ggaaaaggttttattttg

SEQ ID NO: 4730331 - DNA, 20 bp, Homo sapiens
ggaaacatatttaagaaata

SEQ ID NO: 4730332 - DNA, 16 bp, Homo sapiens
ggaaaccacagctgct

SEQ ID NO: 4730333 - DNA, 21 bp, Homo sapiens
ggaaaccacagctgctggaga

SEQ ID NO: 4730334 - DNA, 16 bp, Homo sapiens
ggaaacccagctctgg

SEQ ID NO: 4730335 - DNA, 17 bp, Homo sapiens
ggaaactcttatctcag

SEQ ID NO: 4730336 - DNA, 17 bp, Homo sapiens
ggaaactggatgaggtc

SEQ ID NO: 4730337 - DNA, 23 bp, Homo sapiens
ggaaagataataaattgatttgt

SEQ ID NO: 4730338 - DNA, 20 bp, Homo sapiens
ggaaaggcaaatgcccaagg

SEQ ID NO: 4730339 - DNA, 19 bp, Homo sapiens
ggaaaggctccaggagcag

SEQ ID NO: 4730340 - DNA, 19 bp, Homo sapiens
ggaaagtgtgtatttaact

SEQ ID NO: 4730341 - DNA, 14 bp, Homo sapiens
ggaaatgggcagag

SEQ ID NO: 4730342 - DNA, 17 bp, Homo sapiens
ggaaatgggcagagcag

SEQ ID NO: 4730343 - DNA, 21 bp, Homo sapiens
ggaaatgtggtcctatttaag

SEQ ID NO: 4730344 - DNA, 18 bp, Homo sapiens
ggaaattgagtctgaagc

SEQ ID NO: 4730345 - DNA, 16 bp, Homo sapiens
ggaaattgattttgaa

SEQ ID NO: 4730346 - DNA, 23 bp, Homo sapiens
ggaaattttacaagggcataaag

SEQ ID NO: 4730347 - DNA, 15 bp, Homo sapiens
ggaacactccttcac

SEQ ID NO: 4730348 - DNA, 19 bp, Homo sapiens
ggaacactccttcacagat

SEQ ID NO: 4730349 - DNA, 22 bp, Homo sapiens
ggaacatcatcaaggcactgcc

SEQ ID NO: 4730350 - DNA, 16 bp, Homo sapiens
ggaacatgcagctctg

SEQ ID NO: 4730351 - DNA, 14 bp, Homo sapiens
ggaacatggggagg

SEQ ID NO: 4730352 - DNA, 12 bp, Homo sapiens
ggaacctccttt

SEQ ID NO: 4730353 - DNA, 17 bp, Homo sapiens
ggaactgaacattccag

SEQ ID NO: 4730354 - DNA, 12 bp, Homo sapiens
ggaagacagaga

SEQ ID NO: 4730355 - DNA, 23 bp, Homo sapiens
ggaagacagagacctcctgcctc

SEQ ID NO: 4730356 - DNA, 20 bp, Homo sapiens
ggaagacccattccttccca

SEQ ID NO: 4730357 - DNA, 17 bp, Homo sapiens
ggaagagcacagccctc

SEQ ID NO: 4730358 - DNA, 19 bp, Homo sapiens
ggaagagcacagccctccc

SEQ ID NO: 4730359 - DNA, 17 bp, Homo sapiens
ggaagcacagcttcatt

SEQ ID NO: 4730360 - DNA, 15 bp, Homo sapiens
ggaagccgctggggc

SEQ ID NO: 4730361 - DNA, 23 bp, Homo sapiens
ggaagctaaaagcatggccctgc

SEQ ID NO: 4730362 - DNA, 15 bp, Homo sapiens
ggaagctcagggcct

SEQ ID NO: 4730363 - DNA, 17 bp, Homo sapiens
ggaagctcagggcctgg

SEQ ID NO: 4730364 - DNA, 15 bp, Homo sapiens
ggaaggagctgcctg

SEQ ID NO: 4730365 - DNA, 18 bp, Homo sapiens
ggaaggagctgcctggac

SEQ ID NO: 4730366 - DNA, 14 bp, Homo sapiens
ggaaggcagggagg

SEQ ID NO: 4730367 - DNA, 23 bp, Homo sapiens
ggaagggaagttcaggctctgag

SEQ ID NO: 4730368 - DNA, 17 bp, Homo sapiens
ggaaggggccagaggct

SEQ ID NO: 4730369 - DNA, 13 bp, Homo sapiens
ggaagggtggtgg

SEQ ID NO: 4730370 - DNA, 11 bp, Homo sapiens
ggaaggtgggg

SEQ ID NO: 4730371 - DNA, 16 bp, Homo sapiens
ggaaggtggggacagg

SEQ ID NO: 4730372 - DNA, 23 bp, Homo sapiens
ggaagtaacagtaacgcagggga

SEQ ID NO: 4730373 - DNA, 22 bp, Homo sapiens
ggaagtgagaagggctcagaga

SEQ ID NO: 4730374 - DNA, 16 bp, Homo sapiens
ggaatacctgtccccc

SEQ ID NO: 4730375 - DNA, 24 bp, Homo sapiens
ggaatcatttctatttctcctcca

SEQ ID NO: 4730376 - DNA, 14 bp, Homo sapiens
ggaatccactccca

SEQ ID NO: 4730377 - DNA, 19 bp, Homo sapiens
ggaatccactcccaggcag

SEQ ID NO: 4730378 - DNA, 16 bp, Homo sapiens
ggaatccagacccggc

SEQ ID NO: 4730379 - DNA, 15 bp, Homo sapiens
ggaatcttcacctca

SEQ ID NO: 4730380 - DNA, 22 bp, Homo sapiens
ggaatcttcacctcagagtgga

SEQ ID NO: 4730381 - DNA, 23 bp, Homo sapiens
ggaatgcctgagtgcctggccaa

SEQ ID NO: 4730382 - DNA, 19 bp, Homo sapiens
ggaatggatttttctttaa

SEQ ID NO: 4730383 - DNA, 20 bp, Homo sapiens
ggaatggatttttctttaac

SEQ ID NO: 4730384 - DNA, 21 bp, Homo sapiens
ggacaaaataaagtgtgtgtg

SEQ ID NO: 4730385 - DNA, 13 bp, Homo sapiens
ggacaagaccctc

SEQ ID NO: 4730386 - DNA, 18 bp, Homo sapiens
ggacaagaccctctcagg

SEQ ID NO: 4730387 - DNA, 16 bp, Homo sapiens
ggacaatggaccggag

SEQ ID NO: 4730388 - DNA, 13 bp, Homo sapiens
ggacaccctgtga

SEQ ID NO: 4730389 - DNA, 23 bp, Homo sapiens
ggacaccctgtgatggggccctg

SEQ ID NO: 4730390 - DNA, 16 bp, Homo sapiens
ggacacttctcaggaa

SEQ ID NO: 4730391 - DNA, 15 bp, Homo sapiens
ggacagaagcagctc

SEQ ID NO: 4730392 - DNA, 16 bp, Homo sapiens
ggacagagggggtggc

SEQ ID NO: 4730393 - DNA, 19 bp, Homo sapiens
ggacagcaactatcagact

SEQ ID NO: 4730394 - DNA, 19 bp, Homo sapiens
ggacagccacggccaggcc

SEQ ID NO: 4730395 - DNA, 11 bp, Homo sapiens
ggacagctcct

SEQ ID NO: 4730396 - DNA, 15 bp, Homo sapiens
ggacagctccttctg

SEQ ID NO: 4730397 - DNA, 16 bp, Homo sapiens
ggacagctccttctgt

SEQ ID NO: 4730398 - DNA, 19 bp, Homo sapiens
ggacagctccttctgtcct

SEQ ID NO: 4730399 - DNA, 22 bp, Homo sapiens
ggacagttgcttttcagcatgg

SEQ ID NO: 4730400 - DNA, 19 bp, Homo sapiens
ggacatgctgaagccaaag

SEQ ID NO: 4730401 - DNA, 20 bp, Homo sapiens
ggacattgcggacagccacg

SEQ ID NO: 4730402 - DNA, 16 bp, Homo sapiens
ggaccaagggcagagg

SEQ ID NO: 4730403 - DNA, 20 bp, Homo sapiens
ggaccacagcaaggcacctg

SEQ ID NO: 4730404 - DNA, 21 bp, Homo sapiens
ggaccagaaacctgggagaga

SEQ ID NO: 4730405 - DNA, 13 bp, Homo sapiens
ggaccaggcaatg

SEQ ID NO: 4730406 - DNA, 21 bp, Homo sapiens
ggaccagggtgaggacccgcc

SEQ ID NO: 4730407 - DNA, 18 bp, Homo sapiens
ggaccccgagcctggctc

SEQ ID NO: 4730408 - DNA, 21 bp, Homo sapiens
ggaccccgagcctggctccaa

SEQ ID NO: 4730409 - DNA, 12 bp, Homo sapiens
ggaccctgaggc

SEQ ID NO: 4730410 - DNA, 15 bp, Homo sapiens
ggacctgatggagag

SEQ ID NO: 4730411 - DNA, 17 bp, Homo sapiens
ggacctggtgctgcctc

SEQ ID NO: 4730412 - DNA, 17 bp, Homo sapiens
ggaccttgaactgggta

SEQ ID NO: 4730413 - DNA, 13 bp, Homo sapiens
ggacgcaggcccc

SEQ ID NO: 4730414 - DNA, 17 bp, Homo sapiens
ggacgcaggcccctctc

SEQ ID NO: 4730415 - DNA, 19 bp, Homo sapiens
ggacgcctgggggtgccag

SEQ ID NO: 4730416 - DNA, 20 bp, Homo sapiens
ggacgctacccgggaagggg

SEQ ID NO: 4730417 - DNA, 14 bp, Homo sapiens
ggacggtgctccag

SEQ ID NO: 4730418 - DNA, 15 bp, Homo sapiens
ggacggtgctccagg

SEQ ID NO: 4730419 - DNA, 18 bp, Homo sapiens
ggacggtgctccaggcag

SEQ ID NO: 4730420 - DNA, 24 bp, Homo sapiens
ggactaacttgtctttggaccctg

SEQ ID NO: 4730421 - DNA, 22 bp, Homo sapiens
ggactcaatgcactgacattgt

SEQ ID NO: 4730422 - DNA, 19 bp, Homo sapiens
ggactcaatttctccccag

SEQ ID NO: 4730423 - DNA, 24 bp, Homo sapiens
ggactcaggaacttttgttaggaa

SEQ ID NO: 4730424 - DNA, 21 bp, Homo sapiens
ggactctcagtctctgagcag

SEQ ID NO: 4730425 - DNA, 17 bp, Homo sapiens
ggacttccagcttccag

SEQ ID NO: 4730426 - DNA, 18 bp, Homo sapiens
ggagaagaagaattggcc

SEQ ID NO: 4730427 - DNA, 19 bp, Homo sapiens
ggagaagtcttctatttat

SEQ ID NO: 4730428 - DNA, 20 bp, Homo sapiens
ggagaagtcttctatttatt

SEQ ID NO: 4730429 - DNA, 20 bp, Homo sapiens
ggagaagtggggaccccacc

SEQ ID NO: 4730430 - DNA, 19 bp, Homo sapiens
ggagaagttggtcttactt

SEQ ID NO: 4730431 - DNA, 17 bp, Homo sapiens
ggagaattaaactccta

SEQ ID NO: 4730432 - DNA, 15 bp, Homo sapiens
ggagacaaaagagca

SEQ ID NO: 4730433 - DNA, 21 bp, Homo sapiens
ggagacacaacaactcctagg

SEQ ID NO: 4730434 - DNA, 13 bp, Homo sapiens
ggagactcctagg

SEQ ID NO: 4730435 - DNA, 18 bp, Homo sapiens
ggagactcctaggcagga

SEQ ID NO: 4730436 - DNA, 17 bp, Homo sapiens
ggagactgggctgaggg

SEQ ID NO: 4730437 - DNA, 20 bp, Homo sapiens
ggagactgggctgagggagc

SEQ ID NO: 4730438 - DNA, 21 bp, Homo sapiens
ggagagcccaggagctcccct

SEQ ID NO: 4730439 - DNA, 22 bp, Homo sapiens
ggagagccttccaggggtggga

SEQ ID NO: 4730440 - DNA, 22 bp, Homo sapiens
ggagagctagaacccggcaggc

SEQ ID NO: 4730441 - DNA, 19 bp, Homo sapiens
ggagagctagaacctggag

SEQ ID NO: 4730442 - DNA, 22 bp, Homo sapiens
ggagagctagaacctggagggc

SEQ ID NO: 4730443 - DNA, 18 bp, Homo sapiens
ggagagctggagcctggt

SEQ ID NO: 4730444 - DNA, 20 bp, Homo sapiens
ggagaggagtgactgagctt

SEQ ID NO: 4730445 - DNA, 14 bp, Homo sapiens
ggagatagggaaag

SEQ ID NO: 4730446 - DNA, 20 bp, Homo sapiens
ggagatcaaggagaggaggc

SEQ ID NO: 4730447 - DNA, 23 bp, Homo sapiens
ggagatgaaatcttacagctggg

SEQ ID NO: 4730448 - DNA, 13 bp, Homo sapiens
ggagcagaatcag

SEQ ID NO: 4730449 - DNA, 21 bp, Homo sapiens
ggagcagccacattcctgatg

SEQ ID NO: 4730450 - DNA, 13 bp, Homo sapiens
ggagcagcctcag

SEQ ID NO: 4730451 - DNA, 18 bp, Homo sapiens
ggagcatccacctccttc

SEQ ID NO: 4730452 - DNA, 15 bp, Homo sapiens
ggagcatttggagag

SEQ ID NO: 4730453 - DNA, 19 bp, Homo sapiens
ggagcatttggagagaagg

SEQ ID NO: 4730454 - DNA, 17 bp, Homo sapiens
ggagccacatttacata

SEQ ID NO: 4730455 - DNA, 19 bp, Homo sapiens
ggagccactcctctgactc

SEQ ID NO: 4730456 - DNA, 22 bp, Homo sapiens
ggagcccaggccaggactctgc

SEQ ID NO: 4730457 - DNA, 17 bp, Homo sapiens
ggagccccattcctggg

SEQ ID NO: 4730458 - DNA, 16 bp, Homo sapiens
ggagccccgaggcctt

SEQ ID NO: 4730459 - DNA, 20 bp, Homo sapiens
ggagccggacacttctcagg

SEQ ID NO: 4730460 - DNA, 17 bp, Homo sapiens
ggagccgggtctgcctc

SEQ ID NO: 4730461 - DNA, 18 bp, Homo sapiens
ggagccgggtctgcctct

SEQ ID NO: 4730462 - DNA, 13 bp, Homo sapiens
ggagctcccctcc

SEQ ID NO: 4730463 - DNA, 17 bp, Homo sapiens
ggagctgcctggacccg

SEQ ID NO: 4730464 - DNA, 23 bp, Homo sapiens
ggaggacaagaccctctcaggct

SEQ ID NO: 4730465 - DNA, 19 bp, Homo sapiens
ggaggactagaacctggag

SEQ ID NO: 4730466 - DNA, 12 bp, Homo sapiens
ggaggagcaaag

SEQ ID NO: 4730467 - DNA, 17 bp, Homo sapiens
ggaggagcaaaggctga

SEQ ID NO: 4730468 - DNA, 15 bp, Homo sapiens
ggaggaggtgccaac

SEQ ID NO: 4730469 - DNA, 18 bp, Homo sapiens
ggaggatgttctgggaca

SEQ ID NO: 4730470 - DNA, 19 bp, Homo sapiens
ggaggccgagtctgtcctg

SEQ ID NO: 4730471 - DNA, 14 bp, Homo sapiens
gctgacagtcctct

SEQ ID NO: 4730472 - DNA, 14 bp, Homo sapiens
gctgagaacactgt

SEQ ID NO: 4730473 - DNA, 16 bp, Homo sapiens
gctgagagctgggctt

SEQ ID NO: 4730474 - DNA, 16 bp, Homo sapiens
gctgagcctcagtctc

SEQ ID NO: 4730475 - DNA, 18 bp, Homo sapiens
gctgaggaggcacctaca

SEQ ID NO: 4730476 - DNA, 15 bp, Homo sapiens
gctgaggcaattcta

SEQ ID NO: 4730477 - DNA, 22 bp, Homo sapiens
gctgaggccccttctaggtggc

SEQ ID NO: 4730478 - DNA, 14 bp, Homo sapiens
gctgagggagcctg

SEQ ID NO: 4730479 - DNA, 16 bp, Homo sapiens
gctgagtctgaaggct

SEQ ID NO: 4730480 - DNA, 13 bp, Homo sapiens
gctgagttggtgt

SEQ ID NO: 4730481 - DNA, 14 bp, Homo sapiens
gctgatgctgggct

SEQ ID NO: 4730482 - DNA, 16 bp, Homo sapiens
gctgatgctgggctgg

SEQ ID NO: 4730483 - DNA, 19 bp, Homo sapiens
gctgatgtttataaactga

SEQ ID NO: 4730484 - DNA, 23 bp, Homo sapiens
gctgcaaagggtatcaggtgctg

SEQ ID NO: 4730485 - DNA, 13 bp, Homo sapiens
gctgcaccaaccc

SEQ ID NO: 4730486 - DNA, 19 bp, Homo sapiens
gctgcactctgtgcccatg

SEQ ID NO: 4730487 - DNA, 23 bp, Homo sapiens
gctgcactctgtgcccatgggca

SEQ ID NO: 4730488 - DNA, 17 bp, Homo sapiens
gctgcagcagggcagga

SEQ ID NO: 4730489 - DNA, 18 bp, Homo sapiens
gctgcagttgccagtcac

SEQ ID NO: 4730490 - DNA, 16 bp, Homo sapiens
gctgccacacctgagc

SEQ ID NO: 4730491 - DNA, 17 bp, Homo sapiens
gctgccagctctgtatc

SEQ ID NO: 4730492 - DNA, 18 bp, Homo sapiens
gctgccagctctgtatca

SEQ ID NO: 4730493 - DNA, 14 bp, Homo sapiens
gctgcccaggccca

SEQ ID NO: 4730494 - DNA, 18 bp, Homo sapiens
gctgccccatcagtgctc

SEQ ID NO: 4730495 - DNA, 15 bp, Homo sapiens
gctgcccgctcccag

SEQ ID NO: 4730496 - DNA, 16 bp, Homo sapiens
gctgcccgctcccagt

SEQ ID NO: 4730497 - DNA, 20 bp, Homo sapiens
gctgcccgctcccagtgtct

SEQ ID NO: 4730498 - DNA, 18 bp, Homo sapiens
gctgcccggcgccctctg

SEQ ID NO: 4730499 - DNA, 20 bp, Homo sapiens
gctgcccggcgccctctgtc

SEQ ID NO: 4730500 - DNA, 21 bp, Homo sapiens
gctgccctgcccacctggcct

SEQ ID NO: 4730501 - DNA, 12 bp, Homo sapiens
gctgccctgtga

SEQ ID NO: 4730502 - DNA, 12 bp, Homo sapiens
gctgcctccact

SEQ ID NO: 4730503 - DNA, 18 bp, Homo sapiens
gctgcctccactcccact

SEQ ID NO: 4730504 - DNA, 21 bp, Homo sapiens
gctgcctccactcccacttcc

SEQ ID NO: 4730505 - DNA, 21 bp, Homo sapiens
gctgcctctacctgacactcc

SEQ ID NO: 4730506 - DNA, 13 bp, Homo sapiens
gctgcctgtgtgg

SEQ ID NO: 4730507 - DNA, 17 bp, Homo sapiens
gctgcctgttcagctcc

SEQ ID NO: 4730508 - DNA, 19 bp, Homo sapiens
gctgcctgttcagctccag

SEQ ID NO: 4730509 - DNA, 20 bp, Homo sapiens
gctgcctgttcagctccagc

SEQ ID NO: 4730510 - DNA, 22 bp, Homo sapiens
gctgcctgttcagctccagctc

SEQ ID NO: 4730511 - DNA, 14 bp, Homo sapiens
gctgcggtccaccc

SEQ ID NO: 4730512 - DNA, 16 bp, Homo sapiens
gctgctaccctccctg

SEQ ID NO: 4730513 - DNA, 17 bp, Homo sapiens
gctgctaccctccctgc

SEQ ID NO: 4730514 - DNA, 23 bp, Homo sapiens
gctgctaccctccctgctgtccc

SEQ ID NO: 4730515 - DNA, 12 bp, Homo sapiens
gctgctgaaggc

SEQ ID NO: 4730516 - DNA, 12 bp, Homo sapiens
gctgctgcccag

SEQ ID NO: 4730517 - DNA, 15 bp, Homo sapiens
gctgctgcccaggcc

SEQ ID NO: 4730518 - DNA, 16 bp, Homo sapiens
gctgctgttcaggagc

SEQ ID NO: 4730519 - DNA, 13 bp, Homo sapiens
gctggaaagcaaa

SEQ ID NO: 4730520 - DNA, 18 bp, Homo sapiens
gctggactgaggcctgag

SEQ ID NO: 4730521 - DNA, 19 bp, Homo sapiens
gctggactgaggcctgagc

SEQ ID NO: 4730522 - DNA, 13 bp, Homo sapiens
gctggagactcct

SEQ ID NO: 4730523 - DNA, 13 bp, Homo sapiens
gctggaggagccc

SEQ ID NO: 4730524 - DNA, 17 bp, Homo sapiens
gctggaggagcccaggc

SEQ ID NO: 4730525 - DNA, 21 bp, Homo sapiens
gctggaggagcccaggccagg

SEQ ID NO: 4730526 - DNA, 15 bp, Homo sapiens
gctggagtgcagtga

SEQ ID NO: 4730527 - DNA, 20 bp, Homo sapiens
gctggatgagaatttgagtg

SEQ ID NO: 4730528 - DNA, 15 bp, Homo sapiens
gctggatgggggctc

SEQ ID NO: 4730529 - DNA, 16 bp, Homo sapiens
gctggccagccccaca

SEQ ID NO: 4730530 - DNA, 18 bp, Homo sapiens
gctggccagccccacagc

SEQ ID NO: 4730531 - DNA, 17 bp, Homo sapiens
gctggccgggagcctga

SEQ ID NO: 4730532 - DNA, 12 bp, Homo sapiens
gctggcctggcc

SEQ ID NO: 4730533 - DNA, 16 bp, Homo sapiens
gctggcctggcccctc

SEQ ID NO: 4730534 - DNA, 14 bp, Homo sapiens
gctggcgtgcagtg

SEQ ID NO: 4730535 - DNA, 18 bp, Homo sapiens
gctggcgtgcagtggtgc

SEQ ID NO: 4730536 - DNA, 20 bp, Homo sapiens
gctggcgtgcagtggtgcga

SEQ ID NO: 4730537 - DNA, 11 bp, Homo sapiens
gctggctcacc

SEQ ID NO: 4730538 - DNA, 22 bp, Homo sapiens
gctggctggtgcctgagcccct

SEQ ID NO: 4730539 - DNA, 17 bp, Homo sapiens
gctggctgttggctggg

SEQ ID NO: 4730540 - DNA, 18 bp, Homo sapiens
gctggctgttggctgggg

SEQ ID NO: 4730541 - DNA, 23 bp, Homo sapiens
gctgggaactcacctggggctgc

SEQ ID NO: 4730542 - DNA, 19 bp, Homo sapiens
gctgggactacaggcaccc

SEQ ID NO: 4730543 - DNA, 18 bp, Homo sapiens
gctgggagagccttccag

SEQ ID NO: 4730544 - DNA, 19 bp, Homo sapiens
gctgggagagccttccagg

SEQ ID NO: 4730545 - DNA, 19 bp, Homo sapiens
gctgggatgattggagggg

SEQ ID NO: 4730546 - DNA, 21 bp, Homo sapiens
gctgggatgattggagggggg

SEQ ID NO: 4730547 - DNA, 18 bp, Homo sapiens
gctgggattacaggcgtg

SEQ ID NO: 4730548 - DNA, 18 bp, Homo sapiens
gctgggattacaggtgtg

SEQ ID NO: 4730549 - DNA, 14 bp, Homo sapiens
gctgggcagttttt

SEQ ID NO: 4730550 - DNA, 21 bp, Homo sapiens
gctgggctcccttcccacctc

SEQ ID NO: 4730551 - DNA, 18 bp, Homo sapiens
gctgggcttcagtggcag

SEQ ID NO: 4730552 - DNA, 20 bp, Homo sapiens
gctgggcttcagtggcagct

SEQ ID NO: 4730553 - DNA, 12 bp, Homo sapiens
gctggggccagt

SEQ ID NO: 4730554 - DNA, 12 bp, Homo sapiens
gctggggcctga

SEQ ID NO: 4730555 - DNA, 15 bp, Homo sapiens
gctggggcctgatgg

SEQ ID NO: 4730556 - DNA, 19 bp, Homo sapiens
gctggggcctgatggggag

SEQ ID NO: 4730557 - DNA, 20 bp, Homo sapiens
gctgggggcctcagtgccac

SEQ ID NO: 4730558 - DNA, 15 bp, Homo sapiens
gctgggtcctctgca

SEQ ID NO: 4730559 - DNA, 18 bp, Homo sapiens
gctgggtcctctgcagtg

SEQ ID NO: 4730560 - DNA, 18 bp, Homo sapiens
gctgggtgcgaccccatc

SEQ ID NO: 4730561 - DNA, 15 bp, Homo sapiens
gctgggtggcactgc

SEQ ID NO: 4730562 - DNA, 20 bp, Homo sapiens
gctggtgagtgatgcggcag

SEQ ID NO: 4730563 - DNA, 18 bp, Homo sapiens
gctggtgcctgaagaccc

SEQ ID NO: 4730564 - DNA, 23 bp, Homo sapiens
gctggtgcctgaagaccccagat

SEQ ID NO: 4730565 - DNA, 23 bp, Homo sapiens
gctggttcagggttggcccctgc

SEQ ID NO: 4730566 - DNA, 15 bp, Homo sapiens
gctggtttttcagtt

SEQ ID NO: 4730567 - DNA, 15 bp, Homo sapiens
gctgtaatattgtaa

SEQ ID NO: 4730568 - DNA, 22 bp, Homo sapiens
gctgtaatattgtaaatactgg

SEQ ID NO: 4730569 - DNA, 14 bp, Homo sapiens
gctgtcccaagctc

SEQ ID NO: 4730570 - DNA, 12 bp, Homo sapiens
gctgtcccctct

SEQ ID NO: 4730571 - DNA, 21 bp, Homo sapiens
gctgtcttaaactaaatgtgc

SEQ ID NO: 4730572 - DNA, 13 bp, Homo sapiens
gctgtgccaccct

SEQ ID NO: 4730573 - DNA, 14 bp, Homo sapiens
gctgtgccaccctg

SEQ ID NO: 4730574 - DNA, 15 bp, Homo sapiens
gctgtgccaccctgg

SEQ ID NO: 4730575 - DNA, 13 bp, Homo sapiens
gctgtgctgccct

SEQ ID NO: 4730576 - DNA, 17 bp, Homo sapiens
gctgtgctgccctgccc

SEQ ID NO: 4730577 - DNA, 20 bp, Homo sapiens
gctgtgggcgtgagacctgc

SEQ ID NO: 4730578 - DNA, 18 bp, Homo sapiens
gctgtggtacaaatgtga

SEQ ID NO: 4730579 - DNA, 22 bp, Homo sapiens
gctgtggtacaaatgtgataat

SEQ ID NO: 4730580 - DNA, 11 bp, Homo sapiens
gctgtgtctct

SEQ ID NO: 4730581 - DNA, 13 bp, Homo sapiens
gctgtgtctctgt

SEQ ID NO: 4730582 - DNA, 15 bp, Homo sapiens
gctgtgtctctgtat

SEQ ID NO: 4730583 - DNA, 12 bp, Homo sapiens
gccctgcctcct

SEQ ID NO: 4730584 - DNA, 13 bp, Homo sapiens
gccctgcctcctt

SEQ ID NO: 4730585 - DNA, 13 bp, Homo sapiens
gccctgcctctgt

SEQ ID NO: 4730586 - DNA, 17 bp, Homo sapiens
gccctgctgcccctccc

SEQ ID NO: 4730587 - DNA, 18 bp, Homo sapiens
gccctgctgctgcctgcc

SEQ ID NO: 4730588 - DNA, 15 bp, Homo sapiens
gccctggctgaagga

SEQ ID NO: 4730589 - DNA, 18 bp, Homo sapiens
gccctggctgaaggactg

SEQ ID NO: 4730590 - DNA, 14 bp, Homo sapiens
gccctggtggcagt

SEQ ID NO: 4730591 - DNA, 19 bp, Homo sapiens
gccctggtggcagtgggag

SEQ ID NO: 4730592 - DNA, 21 bp, Homo sapiens
gccctggtggcagtgggagct

SEQ ID NO: 4730593 - DNA, 13 bp, Homo sapiens
gccctggtggccc

SEQ ID NO: 4730594 - DNA, 14 bp, Homo sapiens
gccctggtggccct

SEQ ID NO: 4730595 - DNA, 15 bp, Homo sapiens
gccctggtggccctc

SEQ ID NO: 4730596 - DNA, 19 bp, Homo sapiens
gccctggtggccctctccc

SEQ ID NO: 4730597 - DNA, 20 bp, Homo sapiens
gccctggtggccctctcccc

SEQ ID NO: 4730598 - DNA, 23 bp, Homo sapiens
gccctggtttcctgccctgggag

SEQ ID NO: 4730599 - DNA, 16 bp, Homo sapiens
gccctgtgggccccca

SEQ ID NO: 4730600 - DNA, 17 bp, Homo sapiens
gccctgtgggcccccaa

SEQ ID NO: 4730601 - DNA, 21 bp, Homo sapiens
gccctgtgggcccccaaatgg

SEQ ID NO: 4730602 - DNA, 16 bp, Homo sapiens
gcccttacacttactg

SEQ ID NO: 4730603 - DNA, 20 bp, Homo sapiens
gcccttagcagggaaacagc

SEQ ID NO: 4730604 - DNA, 22 bp, Homo sapiens
gcccttagcagggaaacagcta

SEQ ID NO: 4730605 - DNA, 18 bp, Homo sapiens
gcccttctctccagcccc

SEQ ID NO: 4730606 - DNA, 16 bp, Homo sapiens
gcccttgctccagcct

SEQ ID NO: 4730607 - DNA, 15 bp, Homo sapiens
gccgagatcacacca

SEQ ID NO: 4730608 - DNA, 22 bp, Homo sapiens
gccgagatcacgccactgcact

SEQ ID NO: 4730609 - DNA, 14 bp, Homo sapiens
gccgagtctgtcct

SEQ ID NO: 4730610 - DNA, 18 bp, Homo sapiens
gccgagtctgtcctggaa

SEQ ID NO: 4730611 - DNA, 14 bp, Homo sapiens
gccgccgcctcgcc

SEQ ID NO: 4730612 - DNA, 15 bp, Homo sapiens
gccgccgcctcgccc

SEQ ID NO: 4730613 - DNA, 15 bp, Homo sapiens
gccgcctcgcccacc

SEQ ID NO: 4730614 - DNA, 21 bp, Homo sapiens
gccggacacttctcaggaaat

SEQ ID NO: 4730615 - DNA, 13 bp, Homo sapiens
gccggccaggtgg

SEQ ID NO: 4730616 - DNA, 19 bp, Homo sapiens
gccgggaccccgagcctgg

SEQ ID NO: 4730617 - DNA, 23 bp, Homo sapiens
gccgggaccccgagcctggctcc

SEQ ID NO: 4730618 - DNA, 14 bp, Homo sapiens
gccgggtctgcctc

SEQ ID NO: 4730619 - DNA, 14 bp, Homo sapiens
gccggtacctggga

SEQ ID NO: 4730620 - DNA, 13 bp, Homo sapiens
gccgtaatttaac

SEQ ID NO: 4730621 - DNA, 13 bp, Homo sapiens
gccgtcctgaggg

SEQ ID NO: 4730622 - DNA, 14 bp, Homo sapiens
gccgtcctgagggg

SEQ ID NO: 4730623 - DNA, 15 bp, Homo sapiens
gccgtctacctgagg

SEQ ID NO: 4730624 - DNA, 17 bp, Homo sapiens
gccgtctacctgagggg

SEQ ID NO: 4730625 - DNA, 18 bp, Homo sapiens
gccgtctacctgaggggc

SEQ ID NO: 4730626 - DNA, 23 bp, Homo sapiens
gccgtctacctgaggggcctctt

SEQ ID NO: 4730627 - DNA, 12 bp, Homo sapiens
gccgtgggcccg

SEQ ID NO: 4730628 - DNA, 17 bp, Homo sapiens
gcctaccttgtgaggga

SEQ ID NO: 4730629 - DNA, 15 bp, Homo sapiens
gcctaggtgacagag

SEQ ID NO: 4730630 - DNA, 19 bp, Homo sapiens
gcctagtcccttccacacc

SEQ ID NO: 4730631 - DNA, 19 bp, Homo sapiens
gcctagtgaaggcttctct

SEQ ID NO: 4730632 - DNA, 15 bp, Homo sapiens
gcctatcagtgtgcc

SEQ ID NO: 4730633 - DNA, 22 bp, Homo sapiens
gcctcaagtgattctcctgcct

SEQ ID NO: 4730634 - DNA, 24 bp, Homo sapiens
gcctcaagtgattctcctgcctca

SEQ ID NO: 4730635 - DNA, 17 bp, Homo sapiens
gcctcacagtccttacc

SEQ ID NO: 4730636 - DNA, 18 bp, Homo sapiens
gcctcacagtccttacca

SEQ ID NO: 4730637 - DNA, 18 bp, Homo sapiens
gcctcagcatcctggcac

SEQ ID NO: 4730638 - DNA, 12 bp, Homo sapiens
gcctcagcctcc

SEQ ID NO: 4730639 - DNA, 15 bp, Homo sapiens
gcctcagtctccctc

SEQ ID NO: 4730640 - DNA, 15 bp, Homo sapiens
gcctcagtgccacta

SEQ ID NO: 4730641 - DNA, 12 bp, Homo sapiens
gcctccactccc

SEQ ID NO: 4730642 - DNA, 15 bp, Homo sapiens
gcctccactcccact

SEQ ID NO: 4730643 - DNA, 21 bp, Homo sapiens
gcctccactcccacttccctg

SEQ ID NO: 4730644 - DNA, 19 bp, Homo sapiens
gcctcccaactcaccccag

SEQ ID NO: 4730645 - DNA, 23 bp, Homo sapiens
gcctcccaactcaccccagcccc

SEQ ID NO: 4730646 - DNA, 12 bp, Homo sapiens
gcctcccacagt

SEQ ID NO: 4730647 - DNA, 20 bp, Homo sapiens
gcctcccccactttctttct

SEQ ID NO: 4730648 - DNA, 18 bp, Homo sapiens
gcctcccgaatagctggg

SEQ ID NO: 4730649 - DNA, 23 bp, Homo sapiens
gcctcccgaatagctgggactac

SEQ ID NO: 4730650 - DNA, 15 bp, Homo sapiens
gcctcccttcatgca

SEQ ID NO: 4730651 - DNA, 22 bp, Homo sapiens
gcctcccttcatgcatggaaat

SEQ ID NO: 4730652 - DNA, 20 bp, Homo sapiens
gcctcctttgtgaggaagcc

SEQ ID NO: 4730653 - DNA, 22 bp, Homo sapiens
gcctcctttgtgaggaagccgc

SEQ ID NO: 4730654 - DNA, 22 bp, Homo sapiens
gcctcgaactggctgcaaaggg

SEQ ID NO: 4730655 - DNA, 21 bp, Homo sapiens
gcctcgatgtcctcctctgtg

SEQ ID NO: 4730656 - DNA, 14 bp, Homo sapiens
gcctcgcccaccgc

SEQ ID NO: 4730657 - DNA, 15 bp, Homo sapiens
gcctcgcccaccgca

SEQ ID NO: 4730658 - DNA, 21 bp, Homo sapiens
gcctcggacttagctgggaga

SEQ ID NO: 4730659 - DNA, 15 bp, Homo sapiens
gcctcggctcctgct

SEQ ID NO: 4730660 - DNA, 18 bp, Homo sapiens
gcctcggctcctgctgca

SEQ ID NO: 4730661 - DNA, 20 bp, Homo sapiens
gcctctccttgtggcctggg

SEQ ID NO: 4730662 - DNA, 18 bp, Homo sapiens
gcctctgacacacagctc

SEQ ID NO: 4730663 - DNA, 21 bp, Homo sapiens
gcctctgacacacagctctgt

SEQ ID NO: 4730664 - DNA, 19 bp, Homo sapiens
gcctctgcactcccctgct

SEQ ID NO: 4730665 - DNA, 20 bp, Homo sapiens
gcctctgcactcccctgctg

SEQ ID NO: 4730666 - DNA, 12 bp, Homo sapiens
gcctctgcctct

SEQ ID NO: 4730667 - DNA, 22 bp, Homo sapiens
gcctctgtccccttctctcatc

SEQ ID NO: 4730668 - DNA, 15 bp, Homo sapiens
gcctctgtgtcactg

SEQ ID NO: 4730669 - DNA, 21 bp, Homo sapiens
gcctcttatgggctgggttct

SEQ ID NO: 4730670 - DNA, 15 bp, Homo sapiens
gcctgaagtcacaca

SEQ ID NO: 4730671 - DNA, 18 bp, Homo sapiens
gcctgaagtcacacagtg

SEQ ID NO: 4730672 - DNA, 14 bp, Homo sapiens
gcctgacaacagcc

SEQ ID NO: 4730673 - DNA, 18 bp, Homo sapiens
gcctgacaacagcctgag

SEQ ID NO: 4730674 - DNA, 21 bp, Homo sapiens
gcctgacaacagcctgagaaa

SEQ ID NO: 4730675 - DNA, 16 bp, Homo sapiens
gcctgactccttctgc

SEQ ID NO: 4730676 - DNA, 16 bp, Homo sapiens
gcctgagaatgacctg

SEQ ID NO: 4730677 - DNA, 22 bp, Homo sapiens
gcctgagatttcatctgctctc

SEQ ID NO: 4730678 - DNA, 23 bp, Homo sapiens
gcctgagatttcatctgctctcc

SEQ ID NO: 4730679 - DNA, 22 bp, Homo sapiens
gcctgagcccctcagacagccc

SEQ ID NO: 4730680 - DNA, 22 bp, Homo sapiens
gcctgagcgctcctgccgcaga

SEQ ID NO: 4730681 - DNA, 21 bp, Homo sapiens
gcctgaggtctcgctgatgct

SEQ ID NO: 4730682 - DNA, 14 bp, Homo sapiens
gcctgatggacctg

SEQ ID NO: 4730683 - DNA, 17 bp, Homo sapiens
gcctgattcggctgtct

SEQ ID NO: 4730684 - DNA, 22 bp, Homo sapiens
gcctgccacctggacccctgca

SEQ ID NO: 4730685 - DNA, 23 bp, Homo sapiens
gcctgccacctggacccctgcat

SEQ ID NO: 4730686 - DNA, 15 bp, Homo sapiens
gcctgcccaggcccc

SEQ ID NO: 4730687 - DNA, 20 bp, Homo sapiens
gcctgcccaggcccctgcca

SEQ ID NO: 4730688 - DNA, 22 bp, Homo sapiens
gcctgcctccagggctggactg

SEQ ID NO: 4730689 - DNA, 17 bp, Homo sapiens
gcctgctaattccccag

SEQ ID NO: 4730690 - DNA, 14 bp, Homo sapiens
gcctggaagacaga

SEQ ID NO: 4730691 - DNA, 14 bp, Homo sapiens
gcctggatggggct

SEQ ID NO: 4730692 - DNA, 18 bp, Homo sapiens
gcctggatggggctgcac

SEQ ID NO: 4730693 - DNA, 23 bp, Homo sapiens
gcctggcacagtgtctgggctga

SEQ ID NO: 4730694 - DNA, 14 bp, Homo sapiens
gcctggccagatgc

SEQ ID NO: 4730695 - DNA, 22 bp, Homo sapiens
gcctggccagatgcaccagccc

SEQ ID NO: 4730696 - DNA, 14 bp, Homo sapiens
gcctggcccacccc

SEQ ID NO: 4730697 - DNA, 13 bp, Homo sapiens
gcctggcccagct

SEQ ID NO: 4730698 - DNA, 17 bp, Homo sapiens
gcctggcccagctcccc

SEQ ID NO: 4730699 - DNA, 10 bp, Homo sapiens
gcctggcctg

SEQ ID NO: 4730700 - DNA, 20 bp, Homo sapiens
gcctggcctgagctgggatg

SEQ ID NO: 4730701 - DNA, 14 bp, Homo sapiens
gcctggcctgaggt

SEQ ID NO: 4730702 - DNA, 21 bp, Homo sapiens
gcctgggatccctcatcctca

SEQ ID NO: 4730703 - DNA, 16 bp, Homo sapiens
gcctgggggtgccagg

SEQ ID NO: 4730704 - DNA, 15 bp, Homo sapiens
gcctgggtggacatg

SEQ ID NO: 4730705 - DNA, 20 bp, Homo sapiens
gcctgggtttaaggggagag

SEQ ID NO: 4730706 - DNA, 16 bp, Homo sapiens
gcctggtggcagctgc

SEQ ID NO: 4730707 - DNA, 21 bp, Homo sapiens
gcctggtggcagctgcggtcc

SEQ ID NO: 4730708 - DNA, 20 bp, Homo sapiens
gcctgttttagaaggttctc

SEQ ID NO: 4730709 - DNA, 20 bp, Homo sapiens
gccttataaaccaatcttaa

SEQ ID NO: 4730710 - DNA, 13 bp, Homo sapiens
gccttatgagaac

SEQ ID NO: 4730711 - DNA, 19 bp, Homo sapiens
gccttattagagtgtcttt

SEQ ID NO: 4730712 - DNA, 20 bp, Homo sapiens
gccttcaagaaaacaggcac

SEQ ID NO: 4730713 - DNA, 21 bp, Homo sapiens
gccttcagggagtgagggatt

SEQ ID NO: 4730714 - DNA, 17 bp, Homo sapiens
gccttcctcctgggccc

SEQ ID NO: 4730715 - DNA, 22 bp, Homo sapiens
gccttcctcctgggccctctct

SEQ ID NO: 4730716 - DNA, 23 bp, Homo sapiens
gccttgtttaatggtagttttac

SEQ ID NO: 4730717 - DNA, 14 bp, Homo sapiens
gccttgttttctct

SEQ ID NO: 4730718 - DNA, 19 bp, Homo sapiens
gcctttagcttaagaggcc

SEQ ID NO: 4730719 - DNA, 13 bp, Homo sapiens
gcctttatttgct

SEQ ID NO: 4730720 - DNA, 14 bp, Homo sapiens
gcctttgagacagt

SEQ ID NO: 4730721 - DNA, 13 bp, Homo sapiens
gcctttgggaaat

SEQ ID NO: 4730722 - DNA, 14 bp, Homo sapiens
gccttttctagccc

SEQ ID NO: 4730723 - DNA, 20 bp, Homo sapiens
gcgaccccatctgcccagga

SEQ ID NO: 4730724 - DNA, 16 bp, Homo sapiens
gcgagagatgtgtgtt

SEQ ID NO: 4730725 - DNA, 15 bp, Homo sapiens
gcgaggaggctccag

SEQ ID NO: 4730726 - DNA, 18 bp, Homo sapiens
gcgaggaggctccagagg

SEQ ID NO: 4730727 - DNA, 23 bp, Homo sapiens
gcgattcttctgcttcagcctcc

SEQ ID NO: 4730728 - DNA, 13 bp, Homo sapiens
gcgattgaatgct

SEQ ID NO: 4730729 - DNA, 22 bp, Homo sapiens
gcgcaaagggcatgggtcggga

SEQ ID NO: 4730730 - DNA, 22 bp, Homo sapiens
gcgcacacgcacgcacacacac

SEQ ID NO: 4730731 - DNA, 21 bp, Homo sapiens
gcgcacccagagaaaattaat

SEQ ID NO: 4730732 - DNA, 17 bp, Homo sapiens
gcgcaggctggccctgc

SEQ ID NO: 4730733 - DNA, 18 bp, Homo sapiens
gcgcaggctggccctgcc

SEQ ID NO: 4730734 - DNA, 22 bp, Homo sapiens
gcgccactacactccagcctgg

SEQ ID NO: 4730735 - DNA, 23 bp, Homo sapiens
gcgcccagttgggtggatgcctg

SEQ ID NO: 4730736 - DNA, 14 bp, Homo sapiens
gcgccctctgtcct

SEQ ID NO: 4730737 - DNA, 15 bp, Homo sapiens
gcgccctctgtcctg

SEQ ID NO: 4730738 - DNA, 16 bp, Homo sapiens
gcgccctctgtcctga

SEQ ID NO: 4730739 - DNA, 18 bp, Homo sapiens
gcgcctacaggagtgagc

SEQ ID NO: 4730740 - DNA, 21 bp, Homo sapiens
gcgctcctgccgcagagctgg

SEQ ID NO: 4730741 - DNA, 14 bp, Homo sapiens
gcgctgcctgtgtg

SEQ ID NO: 4730742 - DNA, 19 bp, Homo sapiens
gcgctggccgggaccccga

SEQ ID NO: 4730743 - DNA, 23 bp, Homo sapiens
gcgctgtcaggattgcgagagat

SEQ ID NO: 4730744 - DNA, 13 bp, Homo sapiens
gcggacagccacg

SEQ ID NO: 4730745 - DNA, 19 bp, Homo sapiens
gcggacagccacggccagg

SEQ ID NO: 4730746 - DNA, 19 bp, Homo sapiens
gcggagacggagtcccacc

SEQ ID NO: 4730747 - DNA, 20 bp, Homo sapiens
gcggccagccctcccagcag

SEQ ID NO: 4730748 - DNA, 16 bp, Homo sapiens
gcggcccaatccaagg

SEQ ID NO: 4730749 - DNA, 18 bp, Homo sapiens
gcggctggatgggggctc

SEQ ID NO: 4730750 - DNA, 21 bp, Homo sapiens
gcggctggatgggggctctgc

SEQ ID NO: 4730751 - DNA, 20 bp, Homo sapiens
gcgggaggatgttctgggac

SEQ ID NO: 4730752 - DNA, 15 bp, Homo sapiens
gcgggcagcacagca

SEQ ID NO: 4730753 - DNA, 13 bp, Homo sapiens
gcggggacagctc

SEQ ID NO: 4730754 - DNA, 17 bp, Homo sapiens
gcggggacagctccttc

SEQ ID NO: 4730755 - DNA, 18 bp, Homo sapiens
gcggggacagctccttct

SEQ ID NO: 4730756 - DNA, 19 bp, Homo sapiens
gcggggacagctccttctg

SEQ ID NO: 4730757 - DNA, 22 bp, Homo sapiens
gcgggtaaaaaacctgggttag

SEQ ID NO: 4730758 - DNA, 19 bp, Homo sapiens
gcgggtcacaggagggagg

SEQ ID NO: 4730759 - DNA, 20 bp, Homo sapiens
gcgggtggatcacaaggtca

SEQ ID NO: 4730760 - DNA, 13 bp, Homo sapiens
gcggtccacccag

SEQ ID NO: 4730761 - DNA, 14 bp, Homo sapiens
gcggtccacccagg

SEQ ID NO: 4730762 - DNA, 16 bp, Homo sapiens
gcggtccacccaggag

SEQ ID NO: 4730763 - DNA, 19 bp, Homo sapiens
gcggtgctatctcccccag

SEQ ID NO: 4730764 - DNA, 22 bp, Homo sapiens
gcggtgctatctcccccagccc

SEQ ID NO: 4730765 - DNA, 20 bp, Homo sapiens
gcggtttactcactgctgca

SEQ ID NO: 4730766 - DNA, 14 bp, Homo sapiens
gcgtcctctccctc

SEQ ID NO: 4730767 - DNA, 18 bp, Homo sapiens
gcgtcctctccctcctgg

SEQ ID NO: 4730768 - DNA, 23 bp, Homo sapiens
gcgtcctctccctcctggccaga

SEQ ID NO: 4730769 - DNA, 22 bp, Homo sapiens
gcgtctgtgtgtgcctgtgtgc

SEQ ID NO: 4730770 - DNA, 14 bp, Homo sapiens
gcgtgagccactgc

SEQ ID NO: 4730771 - DNA, 12 bp, Homo sapiens
gcgtggctgact

SEQ ID NO: 4730772 - DNA, 18 bp, Homo sapiens
gcgtgtcaactttcattt

SEQ ID NO: 4730773 - DNA, 21 bp, Homo sapiens
gcgtgtgtagagttaagaagc

SEQ ID NO: 4730774 - DNA, 18 bp, Homo sapiens
gcgttccatgatgctggg

SEQ ID NO: 4730775 - DNA, 17 bp, Homo sapiens
gctaaagcaatatgcat

SEQ ID NO: 4730776 - DNA, 15 bp, Homo sapiens
gctaaatttttaact

SEQ ID NO: 4730777 - DNA, 18 bp, Homo sapiens
gctaacatttaggagaag

SEQ ID NO: 4730778 - DNA, 13 bp, Homo sapiens
gctaagagggagg

SEQ ID NO: 4730779 - DNA, 20 bp, Homo sapiens
gctaagagggagggagggct

SEQ ID NO: 4730780 - DNA, 22 bp, Homo sapiens
gctaagagggagggagggctcc

SEQ ID NO: 4730781 - DNA, 21 bp, Homo sapiens
gctaaggcgtggagctgcctg

SEQ ID NO: 4730782 - DNA, 13 bp, Homo sapiens
gctaatgggacac

SEQ ID NO: 4730783 - DNA, 16 bp, Homo sapiens
gctaattagaaatcaa

SEQ ID NO: 4730784 - DNA, 21 bp, Homo sapiens
gctaattagaaatcaacttgt

SEQ ID NO: 4730785 - DNA, 12 bp, Homo sapiens
gctaattgagac

SEQ ID NO: 4730786 - DNA, 14 bp, Homo sapiens
gctacccgggaagg

SEQ ID NO: 4730787 - DNA, 14 bp, Homo sapiens
gctaccctccctgc

SEQ ID NO: 4730788 - DNA, 23 bp, Homo sapiens
gctaccctccctgctgtcccctc

SEQ ID NO: 4730789 - DNA, 12 bp, Homo sapiens
gctaccctgagc

SEQ ID NO: 4730790 - DNA, 18 bp, Homo sapiens
gctacgtacatgtgaggc

SEQ ID NO: 4730791 - DNA, 20 bp, Homo sapiens
gctactgtcctacccaccct

SEQ ID NO: 4730792 - DNA, 12 bp, Homo sapiens
gctactttccat

SEQ ID NO: 4730793 - DNA, 16 bp, Homo sapiens
gctagaaaaaaagaat

SEQ ID NO: 4730794 - DNA, 18 bp, Homo sapiens
gctagaacctagaagggc

SEQ ID NO: 4730795 - DNA, 20 bp, Homo sapiens
gctagaacctggaagggcta

SEQ ID NO: 4730796 - DNA, 20 bp, Homo sapiens
gctagaacctggagagctag

SEQ ID NO: 4730797 - DNA, 15 bp, Homo sapiens
gctagaacctggagg

SEQ ID NO: 4730798 - DNA, 19 bp, Homo sapiens
gctagaacctggagggctg

SEQ ID NO: 4730799 - DNA, 15 bp, Homo sapiens
gctagaagctggagg

SEQ ID NO: 4730800 - DNA, 19 bp, Homo sapiens
gctagaatctggagagcta

SEQ ID NO: 4730801 - DNA, 15 bp, Homo sapiens
gctaggaacactcct

SEQ ID NO: 4730802 - DNA, 18 bp, Homo sapiens
gctaggaacactccttca

SEQ ID NO: 4730803 - DNA, 20 bp, Homo sapiens
gctataactatgttgataaa

SEQ ID NO: 4730804 - DNA, 15 bp, Homo sapiens
gctatagcaaaaata

SEQ ID NO: 4730805 - DNA, 16 bp, Homo sapiens
gctatcaggagaaagc

SEQ ID NO: 4730806 - DNA, 17 bp, Homo sapiens
gctatctcccccagccc

SEQ ID NO: 4730807 - DNA, 23 bp, Homo sapiens
gctatctcccccagccccatcct

SEQ ID NO: 4730808 - DNA, 15 bp, Homo sapiens
gctatggatctgatt

SEQ ID NO: 4730809 - DNA, 17 bp, Homo sapiens
gctattagccaggatca

SEQ ID NO: 4730810 - DNA, 18 bp, Homo sapiens
gctattagccaggatcat

SEQ ID NO: 4730811 - DNA, 14 bp, Homo sapiens
gctatttaaaactt

SEQ ID NO: 4730812 - DNA, 22 bp, Homo sapiens
gctatttctatgtatgtgccaa

SEQ ID NO: 4730813 - DNA, 17 bp, Homo sapiens
gctattttctaaagact

SEQ ID NO: 4730814 - DNA, 18 bp, Homo sapiens
gctattttctaaagactt

SEQ ID NO: 4730815 - DNA, 19 bp, Homo sapiens
gctcaaagagcctcacagt

SEQ ID NO: 4730816 - DNA, 12 bp, Homo sapiens
gctcaacctaac

SEQ ID NO: 4730817 - DNA, 18 bp, Homo sapiens
gctcaagtcctcttttct

SEQ ID NO: 4730818 - DNA, 14 bp, Homo sapiens
gctcacactgagaa

SEQ ID NO: 4730819 - DNA, 13 bp, Homo sapiens
gctcacagctgtg

SEQ ID NO: 4730820 - DNA, 12 bp, Homo sapiens
gctcaccagccc

SEQ ID NO: 4730821 - DNA, 19 bp, Homo sapiens
gctcaccagccccagtgcc

SEQ ID NO: 4730822 - DNA, 22 bp, Homo sapiens
gctcacccccttctccatccac

SEQ ID NO: 4730823 - DNA, 14 bp, Homo sapiens
gctcacctctccct

SEQ ID NO: 4730824 - DNA, 18 bp, Homo sapiens
gctcactatggtgccaat

SEQ ID NO: 4730825 - DNA, 17 bp, Homo sapiens
gctcactgcagcctcaa

SEQ ID NO: 4730826 - DNA, 16 bp, Homo sapiens
gctcactgcatcctcc

SEQ ID NO: 4730827 - DNA, 20 bp, Homo sapiens
gctcactgcatcctccgcct

SEQ ID NO: 4730828 - DNA, 14 bp, Homo sapiens
gctcagagaggaca

SEQ ID NO: 4730829 - DNA, 15 bp, Homo sapiens
gctcagagaggacaa

SEQ ID NO: 4730830 - DNA, 19 bp, Homo sapiens
gctcagagagggcaggcat

SEQ ID NO: 4730831 - DNA, 13 bp, Homo sapiens
gctcagagagggt

SEQ ID NO: 4730832 - DNA, 14 bp, Homo sapiens
gctcagagagggtg

SEQ ID NO: 4730833 - DNA, 15 bp, Homo sapiens
gctcagagagggtgg

SEQ ID NO: 4730834 - DNA, 22 bp, Homo sapiens
gctcagccaggtgctgtgacac

SEQ ID NO: 4730835 - DNA, 22 bp, Homo sapiens
gctcagcggggacagctccttc

SEQ ID NO: 4730836 - DNA, 14 bp, Homo sapiens
gctcaggaccaggc

SEQ ID NO: 4730837 - DNA, 17 bp, Homo sapiens
gctcagggaccacagca

SEQ ID NO: 4730838 - DNA, 18 bp, Homo sapiens
gctcagggaccacagcaa

SEQ ID NO: 4730839 - DNA, 20 bp, Homo sapiens
gctcagggaccacagcaagg

SEQ ID NO: 4730840 - DNA, 19 bp, Homo sapiens
gctcagggcctggctcagg

SEQ ID NO: 4730841 - DNA, 20 bp, Homo sapiens
gctcagggcctggctcaggt

SEQ ID NO: 4730842 - DNA, 18 bp, Homo sapiens
gctcaggtgtccctgcac

SEQ ID NO: 4730843 - DNA, 19 bp, Homo sapiens
gctcaggtgtccctgcact

SEQ ID NO: 4730844 - DNA, 18 bp, Homo sapiens
gctcatcattctctgtct

SEQ ID NO: 4730845 - DNA, 16 bp, Homo sapiens
gctcatctctgtccca

SEQ ID NO: 4730846 - DNA, 14 bp, Homo sapiens
gctcatttcaggat

SEQ ID NO: 4730847 - DNA, 19 bp, Homo sapiens
gctccaaaccctcgaggcg

SEQ ID NO: 4730848 - DNA, 14 bp, Homo sapiens
gctccaagctccca

SEQ ID NO: 4730849 - DNA, 16 bp, Homo sapiens
gctccacagccatccc

SEQ ID NO: 4730850 - DNA, 18 bp, Homo sapiens
gctccagacacatgtcca

SEQ ID NO: 4730851 - DNA, 15 bp, Homo sapiens
gctccagcctgacaa

SEQ ID NO: 4730852 - DNA, 23 bp, Homo sapiens
gctccagcctgacaacagcctga

SEQ ID NO: 4730853 - DNA, 14 bp, Homo sapiens
gctccagctcacca

SEQ ID NO: 4730854 - DNA, 12 bp, Homo sapiens
gctccaggagca

SEQ ID NO: 4730855 - DNA, 16 bp, Homo sapiens
gctccaggagcagcca

SEQ ID NO: 4730856 - DNA, 17 bp, Homo sapiens
gctccaggagcagccac

SEQ ID NO: 4730857 - DNA, 21 bp, Homo sapiens
gctccaggcaggctaaggcgt

SEQ ID NO: 4730858 - DNA, 20 bp, Homo sapiens
gctccatttttagtgaaata

SEQ ID NO: 4730859 - DNA, 23 bp, Homo sapiens
gctcccaggcattccccaggagg

SEQ ID NO: 4730860 - DNA, 22 bp, Homo sapiens
gctcccagtgtcttcctgtggg

SEQ ID NO: 4730861 - DNA, 15 bp, Homo sapiens
gctcccccgggaggg

SEQ ID NO: 4730862 - DNA, 21 bp, Homo sapiens
gctcccccgggaggggcccgc

SEQ ID NO: 4730863 - DNA, 18 bp, Homo sapiens
gctcccctcctctcccct

SEQ ID NO: 4730864 - DNA, 21 bp, Homo sapiens
gctccctgtaacctcttcaga

SEQ ID NO: 4730865 - DNA, 15 bp, Homo sapiens
gctcccttcccacct

SEQ ID NO: 4730866 - DNA, 18 bp, Homo sapiens
gctccgctttctacccag

SEQ ID NO: 4730867 - DNA, 23 bp, Homo sapiens
gctcctcactggtatactatcat

SEQ ID NO: 4730868 - DNA, 16 bp, Homo sapiens
gctcctctccccagca

SEQ ID NO: 4730869 - DNA, 12 bp, Homo sapiens
gctcctgccacc

SEQ ID NO: 4730870 - DNA, 22 bp, Homo sapiens
gctcctgccaccacgcccggct

SEQ ID NO: 4730871 - DNA, 15 bp, Homo sapiens
gctcctgccgcagag

SEQ ID NO: 4730872 - DNA, 22 bp, Homo sapiens
gctcctgccgcagagctggccg

SEQ ID NO: 4730873 - DNA, 17 bp, Homo sapiens
gctcctgctccacagcc

SEQ ID NO: 4730874 - DNA, 20 bp, Homo sapiens
gctcctgctccacagccatc

SEQ ID NO: 4730875 - DNA, 12 bp, Homo sapiens
gctcctgtgccc

SEQ ID NO: 4730876 - DNA, 15 bp, Homo sapiens
gctcctgtgccctta

SEQ ID NO: 4730877 - DNA, 13 bp, Homo sapiens
gctcctgtgtctt

SEQ ID NO: 4730878 - DNA, 22 bp, Homo sapiens
gctcctgttttgcacagccaaa

SEQ ID NO: 4730879 - DNA, 19 bp, Homo sapiens
gctccttgggccctttgag

SEQ ID NO: 4730880 - DNA, 17 bp, Homo sapiens
gctcgagcatgcctgga

SEQ ID NO: 4730881 - DNA, 19 bp, Homo sapiens
gctctaagaagctgcaata

SEQ ID NO: 4730882 - DNA, 20 bp, Homo sapiens
gctctaagaagctgcaataa

SEQ ID NO: 4730883 - DNA, 18 bp, Homo sapiens
gctctacacaacatgtat

SEQ ID NO: 4730884 - DNA, 17 bp, Homo sapiens
gctctccgaccagacac

SEQ ID NO: 4730885 - DNA, 12 bp, Homo sapiens
gctctccttcct

SEQ ID NO: 4730886 - DNA, 11 bp, Homo sapiens
gctctctgagg

SEQ ID NO: 4730887 - DNA, 14 bp, Homo sapiens
gctctgagacacac

SEQ ID NO: 4730888 - DNA, 12 bp, Homo sapiens
gctctgagctgt

SEQ ID NO: 4730889 - DNA, 14 bp, Homo sapiens
gctctgagctgtca

SEQ ID NO: 4730890 - DNA, 20 bp, Homo sapiens
gctctgatcatccactgtgc

SEQ ID NO: 4730891 - DNA, 22 bp, Homo sapiens
gctctgatcatccactgtgcca

SEQ ID NO: 4730892 - DNA, 13 bp, Homo sapiens
gctctgatccctc

SEQ ID NO: 4730893 - DNA, 17 bp, Homo sapiens
gctctgcaccttctgac

SEQ ID NO: 4730894 - DNA, 13 bp, Homo sapiens
gctctgcccttgg

SEQ ID NO: 4730895 - DNA, 14 bp, Homo sapiens
gctctgcctcccat

SEQ ID NO: 4730896 - DNA, 22 bp, Homo sapiens
gctctgcctcccatcacccgct

SEQ ID NO: 4730897 - DNA, 21 bp, Homo sapiens
gctctgctcctctccccagca

SEQ ID NO: 4730898 - DNA, 14 bp, Homo sapiens
gctctggacaggca

SEQ ID NO: 4730899 - DNA, 18 bp, Homo sapiens
gctctgtatcaggaccca

SEQ ID NO: 4730900 - DNA, 22 bp, Homo sapiens
gctctgtatcaggacccagagg

SEQ ID NO: 4730901 - DNA, 23 bp, Homo sapiens
gctctgtgggctgcactctgtgc

SEQ ID NO: 4730902 - DNA, 19 bp, Homo sapiens
gctcttcataattctaaga

SEQ ID NO: 4730903 - DNA, 12 bp, Homo sapiens
gctcttccaggc

SEQ ID NO: 4730904 - DNA, 19 bp, Homo sapiens
gctcttccaggctgggaga

SEQ ID NO: 4730905 - DNA, 12 bp, Homo sapiens
gctcttctcatt

SEQ ID NO: 4730906 - DNA, 20 bp, Homo sapiens
gctcttctcatttcacccct

SEQ ID NO: 4730907 - DNA, 23 bp, Homo sapiens
gctcttctcatttcacccctccc

SEQ ID NO: 4730908 - DNA, 14 bp, Homo sapiens
gctcttctccaggc

SEQ ID NO: 4730909 - DNA, 12 bp, Homo sapiens
gctgaaggctcg

SEQ ID NO: 4730910 - DNA, 19 bp, Homo sapiens
gctgacacaaacctgcctg

SEQ ID NO: 4730911 - DNA, 13 bp, Homo sapiens
gctgacagacaca

SEQ ID NO: 4730912 - DNA, 14 bp, Homo sapiens
gctgacagacacag

SEQ ID NO: 4730913 - DNA, 17 bp, Homo sapiens
gctgacagacacaggcc

SEQ ID NO: 4730914 - DNA, 18 bp, Homo sapiens
gctgacagacacaggccc

SEQ ID NO: 4730915 - DNA, 20 bp, Homo sapiens
gctgacagacacaggcccgg

SEQ ID NO: 4730916 - DNA, 13 bp, Homo sapiens
gcattccttcttt

SEQ ID NO: 4730917 - DNA, 15 bp, Homo sapiens
gcattccttctttga

SEQ ID NO: 4730918 - DNA, 19 bp, Homo sapiens
gcattccttctttgataat

SEQ ID NO: 4730919 - DNA, 22 bp, Homo sapiens
gcattccttctttgataatgtt

SEQ ID NO: 4730920 - DNA, 21 bp, Homo sapiens
gcattcttggttggctggcct

SEQ ID NO: 4730921 - DNA, 16 bp, Homo sapiens
gcattgccaagggctt

SEQ ID NO: 4730922 - DNA, 18 bp, Homo sapiens
gcattggatattttttac

SEQ ID NO: 4730923 - DNA, 16 bp, Homo sapiens
gcatttaaagtattct

SEQ ID NO: 4730924 - DNA, 19 bp, Homo sapiens
gcatttaaagttgtataaa

SEQ ID NO: 4730925 - DNA, 15 bp, Homo sapiens
gcattttcagcatca

SEQ ID NO: 4730926 - DNA, 18 bp, Homo sapiens
gcattttccagcactttg

SEQ ID NO: 4730927 - DNA, 22 bp, Homo sapiens
gccaaagctaggcctggccaga

SEQ ID NO: 4730928 - DNA, 17 bp, Homo sapiens
gccaaagttaaatgtat

SEQ ID NO: 4730929 - DNA, 22 bp, Homo sapiens
gccaaataatgtctctgtgaga

SEQ ID NO: 4730930 - DNA, 20 bp, Homo sapiens
gccaacagtgttaggcctgg

SEQ ID NO: 4730931 - DNA, 15 bp, Homo sapiens
gccaagcactgtgct

SEQ ID NO: 4730932 - DNA, 23 bp, Homo sapiens
gccaagctcaggaccaggcaatg

SEQ ID NO: 4730933 - DNA, 18 bp, Homo sapiens
gccaaggaagtctgtgtc

SEQ ID NO: 4730934 - DNA, 23 bp, Homo sapiens
gccaaggaagtctgtgtctacca

SEQ ID NO: 4730935 - DNA, 17 bp, Homo sapiens
gccaatggaacctcctt

SEQ ID NO: 4730936 - DNA, 22 bp, Homo sapiens
gccaatgtattgataagagggc

SEQ ID NO: 4730937 - DNA, 15 bp, Homo sapiens
gccacaaataaaatg

SEQ ID NO: 4730938 - DNA, 16 bp, Homo sapiens
gccacaagacccttgt

SEQ ID NO: 4730939 - DNA, 15 bp, Homo sapiens
gccacaccaagctgt

SEQ ID NO: 4730940 - DNA, 14 bp, Homo sapiens
gccacacctgagcc

SEQ ID NO: 4730941 - DNA, 20 bp, Homo sapiens
gccacagagaaagtacttct

SEQ ID NO: 4730942 - DNA, 12 bp, Homo sapiens
gccacaggcctg

SEQ ID NO: 4730943 - DNA, 22 bp, Homo sapiens
gccacaggcctgagatttcatc

SEQ ID NO: 4730944 - DNA, 20 bp, Homo sapiens
gccacattcctgatgcttct

SEQ ID NO: 4730945 - DNA, 20 bp, Homo sapiens
gccaccaacatactcccatc

SEQ ID NO: 4730946 - DNA, 22 bp, Homo sapiens
gccaccaccccccactctgtgc

SEQ ID NO: 4730947 - DNA, 12 bp, Homo sapiens
gccaccctgggc

SEQ ID NO: 4730948 - DNA, 13 bp, Homo sapiens
gccaccctgggga

SEQ ID NO: 4730949 - DNA, 19 bp, Homo sapiens
gccaccctggggagaaagt

SEQ ID NO: 4730950 - DNA, 22 bp, Homo sapiens
gccacctgcggtgctatctccc

SEQ ID NO: 4730951 - DNA, 18 bp, Homo sapiens
gccacctggacccctgca

SEQ ID NO: 4730952 - DNA, 19 bp, Homo sapiens
gccacctggacccctgcat

SEQ ID NO: 4730953 - DNA, 15 bp, Homo sapiens
gccacggccaggcca

SEQ ID NO: 4730954 - DNA, 19 bp, Homo sapiens
gccacggccaggccagagg

SEQ ID NO: 4730955 - DNA, 21 bp, Homo sapiens
gccactcccctaaactccagg

SEQ ID NO: 4730956 - DNA, 13 bp, Homo sapiens
gccactcctctga

SEQ ID NO: 4730957 - DNA, 23 bp, Homo sapiens
gccactcctctgactcagggctc

SEQ ID NO: 4730958 - DNA, 20 bp, Homo sapiens
gccactgcaccgggccacag

SEQ ID NO: 4730959 - DNA, 21 bp, Homo sapiens
gccactgcactatagcctagg

SEQ ID NO: 4730960 - DNA, 23 bp, Homo sapiens
gccactgcctttcagaagtgatt

SEQ ID NO: 4730961 - DNA, 20 bp, Homo sapiens
gccacttctgggtggggcag

SEQ ID NO: 4730962 - DNA, 17 bp, Homo sapiens
gccagagggagtgacag

SEQ ID NO: 4730963 - DNA, 18 bp, Homo sapiens
gccagagggagtgacaga

SEQ ID NO: 4730964 - DNA, 18 bp, Homo sapiens
gccagatgcaccagccct

SEQ ID NO: 4730965 - DNA, 19 bp, Homo sapiens
gccagatgtcgctgggtcc

SEQ ID NO: 4730966 - DNA, 15 bp, Homo sapiens
gccagcaccggacca

SEQ ID NO: 4730967 - DNA, 19 bp, Homo sapiens
gccagcaccggaccagcct

SEQ ID NO: 4730968 - DNA, 22 bp, Homo sapiens
gccagcaccggaccagcctggc

SEQ ID NO: 4730969 - DNA, 19 bp, Homo sapiens
gccagcccctgctggctgg

SEQ ID NO: 4730970 - DNA, 15 bp, Homo sapiens
gccagccctcccagc

SEQ ID NO: 4730971 - DNA, 16 bp, Homo sapiens
gccagccctcccagca

SEQ ID NO: 4730972 - DNA, 12 bp, Homo sapiens
gccagccttgac

SEQ ID NO: 4730973 - DNA, 12 bp, Homo sapiens
gccagcgtcctc

SEQ ID NO: 4730974 - DNA, 13 bp, Homo sapiens
gccagcgtcctcc

SEQ ID NO: 4730975 - DNA, 23 bp, Homo sapiens
gccagctctgtatcaggacccag

SEQ ID NO: 4730976 - DNA, 14 bp, Homo sapiens
gccaggactctgca

SEQ ID NO: 4730977 - DNA, 18 bp, Homo sapiens
gccaggactctgcagcct

SEQ ID NO: 4730978 - DNA, 17 bp, Homo sapiens
gccaggatcatggtgta

SEQ ID NO: 4730979 - DNA, 15 bp, Homo sapiens
gccaggccctctgcc

SEQ ID NO: 4730980 - DNA, 21 bp, Homo sapiens
gccaggccctctgcccactcc

SEQ ID NO: 4730981 - DNA, 13 bp, Homo sapiens
gccaggctgctct

SEQ ID NO: 4730982 - DNA, 22 bp, Homo sapiens
gccaggctgctcttgaactcct

SEQ ID NO: 4730983 - DNA, 15 bp, Homo sapiens
gccaggctggtctca

SEQ ID NO: 4730984 - DNA, 22 bp, Homo sapiens
gccaggctggtctcgaactcct

SEQ ID NO: 4730985 - DNA, 15 bp, Homo sapiens
gccagggcagagtga

SEQ ID NO: 4730986 - DNA, 21 bp, Homo sapiens
gccagggcagagtgagaccca

SEQ ID NO: 4730987 - DNA, 19 bp, Homo sapiens
gccagggtgagagtctggg

SEQ ID NO: 4730988 - DNA, 19 bp, Homo sapiens
gccaggtgggcgggcagca

SEQ ID NO: 4730989 - DNA, 17 bp, Homo sapiens
gccagtcaccccggcca

SEQ ID NO: 4730990 - DNA, 15 bp, Homo sapiens
gccagtcgcgctgcc

SEQ ID NO: 4730991 - DNA, 18 bp, Homo sapiens
gccagttggtcccccttc

SEQ ID NO: 4730992 - DNA, 21 bp, Homo sapiens
gccagttggtcccccttccat

SEQ ID NO: 4730993 - DNA, 19 bp, Homo sapiens
gccatacataaaagaaata

SEQ ID NO: 4730994 - DNA, 14 bp, Homo sapiens
gccatactggcctc

SEQ ID NO: 4730995 - DNA, 21 bp, Homo sapiens
gccatactggcctcgcctggc

SEQ ID NO: 4730996 - DNA, 15 bp, Homo sapiens
gccatagctcctgct

SEQ ID NO: 4730997 - DNA, 19 bp, Homo sapiens
gccatcatcagtggagcca

SEQ ID NO: 4730998 - DNA, 14 bp, Homo sapiens
gccatcccagcccc

SEQ ID NO: 4730999 - DNA, 15 bp, Homo sapiens
gccatcccagcccca

SEQ ID NO: 4731000 - DNA, 17 bp, Homo sapiens
gccatcccagccccaat

SEQ ID NO: 4731001 - DNA, 16 bp, Homo sapiens
gccatcccagccttgg

SEQ ID NO: 4731002 - DNA, 18 bp, Homo sapiens
gccatcctcaaacactgc

SEQ ID NO: 4731003 - DNA, 19 bp, Homo sapiens
gccatcctcaaacactgca

SEQ ID NO: 4731004 - DNA, 12 bp, Homo sapiens
gccatcctgtcc

SEQ ID NO: 4731005 - DNA, 16 bp, Homo sapiens
gccatctctggatgcc

SEQ ID NO: 4731006 - DNA, 19 bp, Homo sapiens
gccatctctggatgcctga

SEQ ID NO: 4731007 - DNA, 15 bp, Homo sapiens
gccatggagagctgg

SEQ ID NO: 4731008 - DNA, 20 bp, Homo sapiens
gccatggagagctggagcct

SEQ ID NO: 4731009 - DNA, 23 bp, Homo sapiens
gccatggagagctggagcctggt

SEQ ID NO: 4731010 - DNA, 14 bp, Homo sapiens
gccatggagtgaga

SEQ ID NO: 4731011 - DNA, 18 bp, Homo sapiens
gccatggccttggcaggc

SEQ ID NO: 4731012 - DNA, 13 bp, Homo sapiens
gccatgggaccaa

SEQ ID NO: 4731013 - DNA, 16 bp, Homo sapiens
gccatgtagaagctgc

SEQ ID NO: 4731014 - DNA, 14 bp, Homo sapiens
gccatgtgccaggt

SEQ ID NO: 4731015 - DNA, 16 bp, Homo sapiens
gccatgtgttccaagg

SEQ ID NO: 4731016 - DNA, 23 bp, Homo sapiens
gccatgttaatgtaatctgatgg

SEQ ID NO: 4731017 - DNA, 17 bp, Homo sapiens
gccatgttggccaggct

SEQ ID NO: 4731018 - DNA, 19 bp, Homo sapiens
gccatgttggccaggctgg

SEQ ID NO: 4731019 - DNA, 22 bp, Homo sapiens
gccatgttggccaggctggtct

SEQ ID NO: 4731020 - DNA, 24 bp, Homo sapiens
gccatgttggccaggctggtctca

SEQ ID NO: 4731021 - DNA, 19 bp, Homo sapiens
gccatttatacctttgaaa

SEQ ID NO: 4731022 - DNA, 22 bp, Homo sapiens
gccatttatacctttgaaatat

SEQ ID NO: 4731023 - DNA, 23 bp, Homo sapiens
gccattttattaaacattttcat

SEQ ID NO: 4731024 - DNA, 19 bp, Homo sapiens
gcccaaagtggtatagaaa

SEQ ID NO: 4731025 - DNA, 23 bp, Homo sapiens
gcccaagggaaagaaaaggaagg

SEQ ID NO: 4731026 - DNA, 21 bp, Homo sapiens
gcccaccccacccacttctgc

SEQ ID NO: 4731027 - DNA, 14 bp, Homo sapiens
gcccaccgcatgcc

SEQ ID NO: 4731028 - DNA, 17 bp, Homo sapiens
gcccaccgcatgccccc

SEQ ID NO: 4731029 - DNA, 18 bp, Homo sapiens
gcccaccgcatgccccct

SEQ ID NO: 4731030 - DNA, 16 bp, Homo sapiens
gcccacctggcctctg

SEQ ID NO: 4731031 - DNA, 15 bp, Homo sapiens
gcccaccttggctca

SEQ ID NO: 4731032 - DNA, 16 bp, Homo sapiens
gcccacgcccccactg

SEQ ID NO: 4731033 - DNA, 21 bp, Homo sapiens
gcccacgcccccactggtgac

SEQ ID NO: 4731034 - DNA, 15 bp, Homo sapiens
gcccacgctggagtg

SEQ ID NO: 4731035 - DNA, 17 bp, Homo sapiens
gcccacgctggagtgca

SEQ ID NO: 4731036 - DNA, 23 bp, Homo sapiens
gcccactagacccactggactca

SEQ ID NO: 4731037 - DNA, 15 bp, Homo sapiens
gcccactcattcctt

SEQ ID NO: 4731038 - DNA, 19 bp, Homo sapiens
gcccactccctgcaacctg

SEQ ID NO: 4731039 - DNA, 13 bp, Homo sapiens
gcccacttctgcc

SEQ ID NO: 4731040 - DNA, 20 bp, Homo sapiens
gcccagagggcctgcaaggg

SEQ ID NO: 4731041 - DNA, 12 bp, Homo sapiens
gcccagaggtaa

SEQ ID NO: 4731042 - DNA, 16 bp, Homo sapiens
gcccagaggtaacaga

SEQ ID NO: 4731043 - DNA, 22 bp, Homo sapiens
gcccagaggtaacagaacagct

SEQ ID NO: 4731044 - DNA, 13 bp, Homo sapiens
gcccagccccttc

SEQ ID NO: 4731045 - DNA, 13 bp, Homo sapiens
gcccagctccccc

SEQ ID NO: 4731046 - DNA, 17 bp, Homo sapiens
gcccagctcccccggga

SEQ ID NO: 4731047 - DNA, 13 bp, Homo sapiens
gcccagctctgaa

SEQ ID NO: 4731048 - DNA, 12 bp, Homo sapiens
gcccaggaaagg

SEQ ID NO: 4731049 - DNA, 15 bp, Homo sapiens
gcccaggaaaggctc

SEQ ID NO: 4731050 - DNA, 18 bp, Homo sapiens
gcccaggacggggccggc

SEQ ID NO: 4731051 - DNA, 23 bp, Homo sapiens
gcccaggacggggccggccaggt

SEQ ID NO: 4731052 - DNA, 14 bp, Homo sapiens
gcccaggagctccc

SEQ ID NO: 4731053 - DNA, 17 bp, Homo sapiens
gcccaggagctcccctc

SEQ ID NO: 4731054 - DNA, 13 bp, Homo sapiens
gcccaggccatct

SEQ ID NO: 4731055 - DNA, 22 bp, Homo sapiens
gcccaggccatcttccaggtgg

SEQ ID NO: 4731056 - DNA, 20 bp, Homo sapiens
gcccaggcccctgccaccct

SEQ ID NO: 4731057 - DNA, 14 bp, Homo sapiens
gcccaggctggcca

SEQ ID NO: 4731058 - DNA, 16 bp, Homo sapiens
gcccaggctggccagc

SEQ ID NO: 4731059 - DNA, 21 bp, Homo sapiens
gcccaggcttagtcactgaga

SEQ ID NO: 4731060 - DNA, 14 bp, Homo sapiens
gcccaggtttctgg

SEQ ID NO: 4731061 - DNA, 15 bp, Homo sapiens
gcccatcccccctca

SEQ ID NO: 4731062 - DNA, 15 bp, Homo sapiens
gcccatggaggagac

SEQ ID NO: 4731063 - DNA, 22 bp, Homo sapiens
gcccatggccctcccagtacct

SEQ ID NO: 4731064 - DNA, 17 bp, Homo sapiens
gcccatgggcactgctg

SEQ ID NO: 4731065 - DNA, 23 bp, Homo sapiens
gcccatgggcactgctgggtggc

SEQ ID NO: 4731066 - DNA, 11 bp, Homo sapiens
gccccacagcc

SEQ ID NO: 4731067 - DNA, 13 bp, Homo sapiens
gccccacagccca

SEQ ID NO: 4731068 - DNA, 13 bp, Homo sapiens
gccccacccagat

SEQ ID NO: 4731069 - DNA, 18 bp, Homo sapiens
gccccaccccagggcagc

SEQ ID NO: 4731070 - DNA, 22 bp, Homo sapiens
gccccaccccagggcagccagg

SEQ ID NO: 4731071 - DNA, 19 bp, Homo sapiens
gccccagatggctttgtga

SEQ ID NO: 4731072 - DNA, 10 bp, Homo sapiens
gccccagcct

SEQ ID NO: 4731073 - DNA, 13 bp, Homo sapiens
gccccagcctggc

SEQ ID NO: 4731074 - DNA, 16 bp, Homo sapiens
gccccagcctggccca

SEQ ID NO: 4731075 - DNA, 18 bp, Homo sapiens
gccccagcctggcccagc

SEQ ID NO: 4731076 - DNA, 20 bp, Homo sapiens
gccccagcctggcccagctc

SEQ ID NO: 4731077 - DNA, 21 bp, Homo sapiens
gccccagcctggcccagctcc

SEQ ID NO: 4731078 - DNA, 22 bp, Homo sapiens
gccccagcctggcccagctccc

SEQ ID NO: 4731079 - DNA, 16 bp, Homo sapiens
gccccagtgcccacag

SEQ ID NO: 4731080 - DNA, 21 bp, Homo sapiens
gccccagtgcccacaggatca

SEQ ID NO: 4731081 - DNA, 19 bp, Homo sapiens
gccccagttgtatttattt

SEQ ID NO: 4731082 - DNA, 13 bp, Homo sapiens
gccccatcctctg

SEQ ID NO: 4731083 - DNA, 14 bp, Homo sapiens
gccccatcctctgt

SEQ ID NO: 4731084 - DNA, 12 bp, Homo sapiens
gccccattcctg

SEQ ID NO: 4731085 - DNA, 22 bp, Homo sapiens
gccccattctgcctgcccaggc

SEQ ID NO: 4731086 - DNA, 17 bp, Homo sapiens
gcccccacccacttccc

SEQ ID NO: 4731087 - DNA, 17 bp, Homo sapiens
gcccccaggactgggcc

SEQ ID NO: 4731088 - DNA, 19 bp, Homo sapiens
gccccccatcctggcccat

SEQ ID NO: 4731089 - DNA, 14 bp, Homo sapiens
gccccctcgtgcca

SEQ ID NO: 4731090 - DNA, 17 bp, Homo sapiens
gccccctcgtgccagtc

SEQ ID NO: 4731091 - DNA, 12 bp, Homo sapiens
gccccctgcagg

SEQ ID NO: 4731092 - DNA, 22 bp, Homo sapiens
gccccctgcaggaaggagctgc

SEQ ID NO: 4731093 - DNA, 14 bp, Homo sapiens
gcccctcagggtcc

SEQ ID NO: 4731094 - DNA, 16 bp, Homo sapiens
gcccctcagggtccct

SEQ ID NO: 4731095 - DNA, 13 bp, Homo sapiens
gcccctccctgcc

SEQ ID NO: 4731096 - DNA, 18 bp, Homo sapiens
gcccctcctctctgccct

SEQ ID NO: 4731097 - DNA, 13 bp, Homo sapiens
gcccctctcctcc

SEQ ID NO: 4731098 - DNA, 21 bp, Homo sapiens
gcccctctcctccgtggcaca

SEQ ID NO: 4731099 - DNA, 14 bp, Homo sapiens
gcccctgccaccct

SEQ ID NO: 4731100 - DNA, 16 bp, Homo sapiens
gcccctgccaccctgg

SEQ ID NO: 4731101 - DNA, 17 bp, Homo sapiens
gcccctgccaccctggg

SEQ ID NO: 4731102 - DNA, 12 bp, Homo sapiens
gcccctgctggt

SEQ ID NO: 4731103 - DNA, 16 bp, Homo sapiens
gcccctgctggttcag

SEQ ID NO: 4731104 - DNA, 22 bp, Homo sapiens
gcccctggatgcagcctcacag

SEQ ID NO: 4731105 - DNA, 22 bp, Homo sapiens
gccccttagcccccacccactt

SEQ ID NO: 4731106 - DNA, 23 bp, Homo sapiens
gccccttctaggtggcaaggctg

SEQ ID NO: 4731107 - DNA, 13 bp, Homo sapiens
gcccgctcccagt

SEQ ID NO: 4731108 - DNA, 14 bp, Homo sapiens
gcccgcttgcctcg

SEQ ID NO: 4731109 - DNA, 22 bp, Homo sapiens
gcccgcttgcctcggctcctgc

SEQ ID NO: 4731110 - DNA, 21 bp, Homo sapiens
gcccggacgcccaggacccca

SEQ ID NO: 4731111 - DNA, 15 bp, Homo sapiens
gcccggctccaggct

SEQ ID NO: 4731112 - DNA, 16 bp, Homo sapiens
gcccggctccaggctc

SEQ ID NO: 4731113 - DNA, 18 bp, Homo sapiens
gcccggctccaggctcct

SEQ ID NO: 4731114 - DNA, 19 bp, Homo sapiens
gcccgggctctgcctccca

SEQ ID NO: 4731115 - DNA, 20 bp, Homo sapiens
gcccgggctctgcctcccat

SEQ ID NO: 4731116 - DNA, 23 bp, Homo sapiens
gcccgggctctgcctcccatcac

SEQ ID NO: 4731117 - DNA, 17 bp, Homo sapiens
gcccgttgtctccctgg

SEQ ID NO: 4731118 - DNA, 23 bp, Homo sapiens
gcccgttgtctccctggccctca

SEQ ID NO: 4731119 - DNA, 16 bp, Homo sapiens
gccctaatgcgcaggc

SEQ ID NO: 4731120 - DNA, 17 bp, Homo sapiens
gccctaatgcgcaggct

SEQ ID NO: 4731121 - DNA, 23 bp, Homo sapiens
gccctaatgcgcaggctggccct

SEQ ID NO: 4731122 - DNA, 21 bp, Homo sapiens
gccctacttctttgctttgcc

SEQ ID NO: 4731123 - DNA, 18 bp, Homo sapiens
gccctcaaggcctcccac

SEQ ID NO: 4731124 - DNA, 19 bp, Homo sapiens
gccctcaaggcctcccaca

SEQ ID NO: 4731125 - DNA, 22 bp, Homo sapiens
gccctcaaggcctcccacagtg

SEQ ID NO: 4731126 - DNA, 23 bp, Homo sapiens
gccctcaaggcctcccacagtga

SEQ ID NO: 4731127 - DNA, 21 bp, Homo sapiens
gccctcacccctggttctcat

SEQ ID NO: 4731128 - DNA, 15 bp, Homo sapiens
gccctcaccctgggg

SEQ ID NO: 4731129 - DNA, 17 bp, Homo sapiens
gccctcaccctggggct

SEQ ID NO: 4731130 - DNA, 13 bp, Homo sapiens
gccctccacacct

SEQ ID NO: 4731131 - DNA, 15 bp, Homo sapiens
gccctcgctgccagc

SEQ ID NO: 4731132 - DNA, 20 bp, Homo sapiens
gccctctcccctgccccctg

SEQ ID NO: 4731133 - DNA, 12 bp, Homo sapiens
gccctctgccca

SEQ ID NO: 4731134 - DNA, 14 bp, Homo sapiens
gccctgatttgctg

SEQ ID NO: 4731135 - DNA, 15 bp, Homo sapiens
gccctgcactgtcct

SEQ ID NO: 4731136 - DNA, 17 bp, Homo sapiens
gccctgcactgtcctgc

SEQ ID NO: 4731137 - DNA, 20 bp, Homo sapiens
gccctgcactgtcctgctcc

SEQ ID NO: 4731138 - DNA, 23 bp, Homo sapiens
gcagcagtgtgaggccagggcag

SEQ ID NO: 4731139 - DNA, 23 bp, Homo sapiens
gcagcatattcaggaagctcagg

SEQ ID NO: 4731140 - DNA, 14 bp, Homo sapiens
gcagccaggccaca

SEQ ID NO: 4731141 - DNA, 24 bp, Homo sapiens
gcagccccattctgcctgcccagg

SEQ ID NO: 4731142 - DNA, 14 bp, Homo sapiens
gcagccctggagtc

SEQ ID NO: 4731143 - DNA, 19 bp, Homo sapiens
gcagcctcaacctcctggg

SEQ ID NO: 4731144 - DNA, 15 bp, Homo sapiens
gcagcctcacagtcc

SEQ ID NO: 4731145 - DNA, 17 bp, Homo sapiens
gcagcctcacagtcctt

SEQ ID NO: 4731146 - DNA, 16 bp, Homo sapiens
gcagcctgagaatgac

SEQ ID NO: 4731147 - DNA, 15 bp, Homo sapiens
gcagccttggcaaac

SEQ ID NO: 4731148 - DNA, 16 bp, Homo sapiens
gcagcgcagagcgggc

SEQ ID NO: 4731149 - DNA, 14 bp, Homo sapiens
gcagctcacctctc

SEQ ID NO: 4731150 - DNA, 16 bp, Homo sapiens
gcagctcacctctccc

SEQ ID NO: 4731151 - DNA, 21 bp, Homo sapiens
gcagctcacctctcccttgga

SEQ ID NO: 4731152 - DNA, 14 bp, Homo sapiens
gcagctcagagagg

SEQ ID NO: 4731153 - DNA, 18 bp, Homo sapiens
gcagctcagagagggtgg

SEQ ID NO: 4731154 - DNA, 19 bp, Homo sapiens
gcagctcagagagggtggg

SEQ ID NO: 4731155 - DNA, 21 bp, Homo sapiens
gcagctcatctctgtcccact

SEQ ID NO: 4731156 - DNA, 16 bp, Homo sapiens
gcagctgatacaaatt

SEQ ID NO: 4731157 - DNA, 17 bp, Homo sapiens
gcagctgcggtccaccc

SEQ ID NO: 4731158 - DNA, 20 bp, Homo sapiens
gcagcttctgccacttccca

SEQ ID NO: 4731159 - DNA, 16 bp, Homo sapiens
gcagcttgagggttgg

SEQ ID NO: 4731160 - DNA, 21 bp, Homo sapiens
gcagcttgagggttgggctgg

SEQ ID NO: 4731161 - DNA, 19 bp, Homo sapiens
gcaggaaggagctgcctgg

SEQ ID NO: 4731162 - DNA, 22 bp, Homo sapiens
gcaggaaggagctgcctggacc

SEQ ID NO: 4731163 - DNA, 21 bp, Homo sapiens
gcaggacctagctgttgtaaa

SEQ ID NO: 4731164 - DNA, 15 bp, Homo sapiens
gcaggaggaggtgcc

SEQ ID NO: 4731165 - DNA, 20 bp, Homo sapiens
gcaggaggaggtgccaacag

SEQ ID NO: 4731166 - DNA, 12 bp, Homo sapiens
gcaggcacagca

SEQ ID NO: 4731167 - DNA, 18 bp, Homo sapiens
gcaggcagccaggccaca

SEQ ID NO: 4731168 - DNA, 13 bp, Homo sapiens
gcaggcccctctc

SEQ ID NO: 4731169 - DNA, 16 bp, Homo sapiens
gcaggcccctctcctc

SEQ ID NO: 4731170 - DNA, 21 bp, Homo sapiens
gcaggccctgcactgtcctgc

SEQ ID NO: 4731171 - DNA, 17 bp, Homo sapiens
gcaggcctgccttctca

SEQ ID NO: 4731172 - DNA, 18 bp, Homo sapiens
gcaggcctgccttctcag

SEQ ID NO: 4731173 - DNA, 19 bp, Homo sapiens
gcaggcgttcagctcactg

SEQ ID NO: 4731174 - DNA, 17 bp, Homo sapiens
gcaggctaaggcgtgga

SEQ ID NO: 4731175 - DNA, 16 bp, Homo sapiens
gcaggctacactgaca

SEQ ID NO: 4731176 - DNA, 16 bp, Homo sapiens
gcaggctagaacctgg

SEQ ID NO: 4731177 - DNA, 13 bp, Homo sapiens
gcaggctggccct

SEQ ID NO: 4731178 - DNA, 13 bp, Homo sapiens
gcagggaaacagc

SEQ ID NO: 4731179 - DNA, 21 bp, Homo sapiens
gcagggagcatggctgtgagg

SEQ ID NO: 4731180 - DNA, 22 bp, Homo sapiens
gcagggagggcctgggccccag

SEQ ID NO: 4731181 - DNA, 21 bp, Homo sapiens
gcagggctcagcggggacagc

SEQ ID NO: 4731182 - DNA, 17 bp, Homo sapiens
gcagggtctcactctgt

SEQ ID NO: 4731183 - DNA, 14 bp, Homo sapiens
gcagggtctgggca

SEQ ID NO: 4731184 - DNA, 17 bp, Homo sapiens
gcagggtctgggcagga

SEQ ID NO: 4731185 - DNA, 14 bp, Homo sapiens
gcaggtgctgctac

SEQ ID NO: 4731186 - DNA, 13 bp, Homo sapiens
gcagtattgagca

SEQ ID NO: 4731187 - DNA, 24 bp, Homo sapiens
gcagtcacgtggaggagcagtgca

SEQ ID NO: 4731188 - DNA, 19 bp, Homo sapiens
gcagtctaaaacttcaaaa

SEQ ID NO: 4731189 - DNA, 23 bp, Homo sapiens
gcagtgcccctagcttagagcct

SEQ ID NO: 4731190 - DNA, 19 bp, Homo sapiens
gcagtgggaaaaatgtagg

SEQ ID NO: 4731191 - DNA, 13 bp, Homo sapiens
gcagtgggagctg

SEQ ID NO: 4731192 - DNA, 17 bp, Homo sapiens
gcagtgggagctgcctg

SEQ ID NO: 4731193 - DNA, 19 bp, Homo sapiens
gcagtgggtcccacttccc

SEQ ID NO: 4731194 - DNA, 21 bp, Homo sapiens
gcagtgggtcccacttcccct

SEQ ID NO: 4731195 - DNA, 19 bp, Homo sapiens
gcagtggtgcgatctgggt

SEQ ID NO: 4731196 - DNA, 20 bp, Homo sapiens
gcagtggtgcgatctgggtt

SEQ ID NO: 4731197 - DNA, 21 bp, Homo sapiens
gcagtggtgcgatctgggttc

SEQ ID NO: 4731198 - DNA, 18 bp, Homo sapiens
gcagtgtctgtgttttga

SEQ ID NO: 4731199 - DNA, 22 bp, Homo sapiens
gcagttacccaacagaaacatt

SEQ ID NO: 4731200 - DNA, 17 bp, Homo sapiens
gcagttattaacactaa

SEQ ID NO: 4731201 - DNA, 23 bp, Homo sapiens
gcagttgccagtcaccccggcca

SEQ ID NO: 4731202 - DNA, 13 bp, Homo sapiens
gcagtttattata

SEQ ID NO: 4731203 - DNA, 20 bp, Homo sapiens
gcagtttctgtcctgctggt

SEQ ID NO: 4731204 - DNA, 21 bp, Homo sapiens
gcagtttggtttatattctta

SEQ ID NO: 4731205 - DNA, 19 bp, Homo sapiens
gcataatttaaaaatatat

SEQ ID NO: 4731206 - DNA, 19 bp, Homo sapiens
gcataattttgtgttgtac

SEQ ID NO: 4731207 - DNA, 16 bp, Homo sapiens
gcatagatgcaggtga

SEQ ID NO: 4731208 - DNA, 17 bp, Homo sapiens
gcataggtttaataatt

SEQ ID NO: 4731209 - DNA, 18 bp, Homo sapiens
gcatatctctagtccctg

SEQ ID NO: 4731210 - DNA, 18 bp, Homo sapiens
gcatcaaacatgaaaaca

SEQ ID NO: 4731211 - DNA, 19 bp, Homo sapiens
gcatcaaacatgaaaacat

SEQ ID NO: 4731212 - DNA, 18 bp, Homo sapiens
gcatcaggccaggccctc

SEQ ID NO: 4731213 - DNA, 23 bp, Homo sapiens
gcatcaggccaggccctctgccc

SEQ ID NO: 4731214 - DNA, 12 bp, Homo sapiens
gcatccacctcc

SEQ ID NO: 4731215 - DNA, 16 bp, Homo sapiens
gcatccacctccttct

SEQ ID NO: 4731216 - DNA, 20 bp, Homo sapiens
gcatcccttgaccaggcctg

SEQ ID NO: 4731217 - DNA, 14 bp, Homo sapiens
gcatcctggcaccc

SEQ ID NO: 4731218 - DNA, 21 bp, Homo sapiens
gcatcctggcacccggcccct

SEQ ID NO: 4731219 - DNA, 22 bp, Homo sapiens
gcatcctggcacccggcccctg

SEQ ID NO: 4731220 - DNA, 13 bp, Homo sapiens
gcatcgcaatgta

SEQ ID NO: 4731221 - DNA, 12 bp, Homo sapiens
gcatctcccaga

SEQ ID NO: 4731222 - DNA, 21 bp, Homo sapiens
gcatctcccagataatgtgaa

SEQ ID NO: 4731223 - DNA, 14 bp, Homo sapiens
gcatgaaataaaat

SEQ ID NO: 4731224 - DNA, 13 bp, Homo sapiens
gcatgaaggtttc

SEQ ID NO: 4731225 - DNA, 13 bp, Homo sapiens
gcatgaccacata

SEQ ID NO: 4731226 - DNA, 15 bp, Homo sapiens
gcatgaccacataga

SEQ ID NO: 4731227 - DNA, 11 bp, Homo sapiens
gcatgacccag

SEQ ID NO: 4731228 - DNA, 22 bp, Homo sapiens
gcatgagtggccttaataaata

SEQ ID NO: 4731229 - DNA, 23 bp, Homo sapiens
gcatgcactgttccccctgtgca

SEQ ID NO: 4731230 - DNA, 12 bp, Homo sapiens
gcatgccccctc

SEQ ID NO: 4731231 - DNA, 17 bp, Homo sapiens
gcatgcctggatggggc

SEQ ID NO: 4731232 - DNA, 14 bp, Homo sapiens
gcatggacaatgga

SEQ ID NO: 4731233 - DNA, 18 bp, Homo sapiens
gcatggacaatggaccgg

SEQ ID NO: 4731234 - DNA, 21 bp, Homo sapiens
gcatggacaatggaccggaga

SEQ ID NO: 4731235 - DNA, 15 bp, Homo sapiens
gcatggccctgctgc

SEQ ID NO: 4731236 - DNA, 16 bp, Homo sapiens
gcatggctggtgcctg

SEQ ID NO: 4731237 - DNA, 17 bp, Homo sapiens
gcatggctggtgcctga

SEQ ID NO: 4731238 - DNA, 20 bp, Homo sapiens
gcatgggtcgggagagggga

SEQ ID NO: 4731239 - DNA, 21 bp, Homo sapiens
gcatgggtcgggagaggggac

SEQ ID NO: 4731240 - DNA, 17 bp, Homo sapiens
gcatgtaaaatcttcag

SEQ ID NO: 4731241 - DNA, 21 bp, Homo sapiens
gcatgtaaaatcttcagctgg

SEQ ID NO: 4731242 - DNA, 15 bp, Homo sapiens
gcatgttctctgagg

SEQ ID NO: 4731243 - DNA, 20 bp, Homo sapiens
gcattagatttctcatttgc

SEQ ID NO: 4731244 - DNA, 12 bp, Homo sapiens
gcattccccagg

SEQ ID NO: 4731245 - DNA, 17 bp, Homo sapiens
gcattccccaggaggcc

SEQ ID NO: 4731246 - DNA, 18 bp, Homo sapiens
gcattccccaggaggcca

SEQ ID NO: 4731247 - DNA, 20 bp, Homo sapiens
gcattccccaggaggccagc

SEQ ID NO: 4731248 - DNA, 21 bp, Homo sapiens
gcattccccaggaggccagcc

SEQ ID NO: 4731249 - DNA, 20 bp, Homo sapiens
gcaagtgggagatgaaaacc

SEQ ID NO: 4731250 - DNA, 22 bp, Homo sapiens
gcaagtgtgctggcctctctga

SEQ ID NO: 4731251 - DNA, 21 bp, Homo sapiens
gcaatctattaatagctgcct

SEQ ID NO: 4731252 - DNA, 18 bp, Homo sapiens
gcaatgccatcatctcct

SEQ ID NO: 4731253 - DNA, 15 bp, Homo sapiens
gcaatgctgtgaata

SEQ ID NO: 4731254 - DNA, 12 bp, Homo sapiens
gcaatggcagcc

SEQ ID NO: 4731255 - DNA, 13 bp, Homo sapiens
gcaatggcagcct

SEQ ID NO: 4731256 - DNA, 18 bp, Homo sapiens
gcaatgggggagggaggg

SEQ ID NO: 4731257 - DNA, 13 bp, Homo sapiens
gcaattaactctg

SEQ ID NO: 4731258 - DNA, 14 bp, Homo sapiens
gcaattaactctgg

SEQ ID NO: 4731259 - DNA, 16 bp, Homo sapiens
gcaattctcctgcctc

SEQ ID NO: 4731260 - DNA, 20 bp, Homo sapiens
gcacaaaatgatggcagtgg

SEQ ID NO: 4731261 - DNA, 21 bp, Homo sapiens
gcacaagctccaagctcccag

SEQ ID NO: 4731262 - DNA, 15 bp, Homo sapiens
gcacaatagtaacct

SEQ ID NO: 4731263 - DNA, 21 bp, Homo sapiens
gcacaatctcggctcactgca

SEQ ID NO: 4731264 - DNA, 17 bp, Homo sapiens
gcacacaccagagccca

SEQ ID NO: 4731265 - DNA, 23 bp, Homo sapiens
gcacacagcacgggggccaagga

SEQ ID NO: 4731266 - DNA, 21 bp, Homo sapiens
gcacacctttattcagaactt

SEQ ID NO: 4731267 - DNA, 14 bp, Homo sapiens
gcacacttggccca

SEQ ID NO: 4731268 - DNA, 13 bp, Homo sapiens
gcacactttgcca

SEQ ID NO: 4731269 - DNA, 14 bp, Homo sapiens
gcacactttgccat

SEQ ID NO: 4731270 - DNA, 14 bp, Homo sapiens
gcacagaccctgcc

SEQ ID NO: 4731271 - DNA, 20 bp, Homo sapiens
gcacagaccctgccctgtgg

SEQ ID NO: 4731272 - DNA, 17 bp, Homo sapiens
gcacagccaaatttaaa

SEQ ID NO: 4731273 - DNA, 17 bp, Homo sapiens
gcacagccctcccgccc

SEQ ID NO: 4731274 - DNA, 19 bp, Homo sapiens
gcacagccctcccgcccct

SEQ ID NO: 4731275 - DNA, 22 bp, Homo sapiens
gcacagccctcccgccccttcc

SEQ ID NO: 4731276 - DNA, 18 bp, Homo sapiens
gcacagggtttggcccaa

SEQ ID NO: 4731277 - DNA, 15 bp, Homo sapiens
gcacagtgtctgggc

SEQ ID NO: 4731278 - DNA, 19 bp, Homo sapiens
gcacagtgtctgggctgac

SEQ ID NO: 4731279 - DNA, 17 bp, Homo sapiens
gcacatctgtgtcttgt

SEQ ID NO: 4731280 - DNA, 15 bp, Homo sapiens
gcacatctgttttgt

SEQ ID NO: 4731281 - DNA, 16 bp, Homo sapiens
gcacatgccagggaaa

SEQ ID NO: 4731282 - DNA, 20 bp, Homo sapiens
gcacatgttaccatgtctga

SEQ ID NO: 4731283 - DNA, 17 bp, Homo sapiens
gcacatttaagagacag

SEQ ID NO: 4731284 - DNA, 17 bp, Homo sapiens
gcaccaacccagccgct

SEQ ID NO: 4731285 - DNA, 22 bp, Homo sapiens
gcacccaccatcatgtctggct

SEQ ID NO: 4731286 - DNA, 19 bp, Homo sapiens
gcacccagagaaaattaat

SEQ ID NO: 4731287 - DNA, 12 bp, Homo sapiens
gcaccccctcct

SEQ ID NO: 4731288 - DNA, 15 bp, Homo sapiens
gcaccccctcctgct

SEQ ID NO: 4731289 - DNA, 18 bp, Homo sapiens
gcaccccctcctgctgca

SEQ ID NO: 4731290 - DNA, 22 bp, Homo sapiens
gcacccgggctcagggaccaca

SEQ ID NO: 4731291 - DNA, 14 bp, Homo sapiens
gcaccctcccctcc

SEQ ID NO: 4731292 - DNA, 17 bp, Homo sapiens
gcaccctcccctcccgt

SEQ ID NO: 4731293 - DNA, 17 bp, Homo sapiens
gcaccggaccagcctgg

SEQ ID NO: 4731294 - DNA, 21 bp, Homo sapiens
gcaccggaccagcctggccca

SEQ ID NO: 4731295 - DNA, 15 bp, Homo sapiens
gcaccggctggcctg

SEQ ID NO: 4731296 - DNA, 18 bp, Homo sapiens
gcaccggctggcctggcc

SEQ ID NO: 4731297 - DNA, 23 bp, Homo sapiens
gcaccgggccacagagaaagtac

SEQ ID NO: 4731298 - DNA, 18 bp, Homo sapiens
gcacctacagtgtacagt

SEQ ID NO: 4731299 - DNA, 21 bp, Homo sapiens
gcacctacagtgtacagtctt

SEQ ID NO: 4731300 - DNA, 12 bp, Homo sapiens
gcacctcctgcc

SEQ ID NO: 4731301 - DNA, 14 bp, Homo sapiens
gcaccttagacagt

SEQ ID NO: 4731302 - DNA, 20 bp, Homo sapiens
gcaccttagacagtccctgc

SEQ ID NO: 4731303 - DNA, 14 bp, Homo sapiens
gcacgcacacacac

SEQ ID NO: 4731304 - DNA, 22 bp, Homo sapiens
gcacgcacacacacatacagag

SEQ ID NO: 4731305 - DNA, 22 bp, Homo sapiens
gcacggacatggtctgtcctga

SEQ ID NO: 4731306 - DNA, 14 bp, Homo sapiens
gcacgtgtgtgcac

SEQ ID NO: 4731307 - DNA, 18 bp, Homo sapiens
gcacgtgtgtttttctat

SEQ ID NO: 4731308 - DNA, 19 bp, Homo sapiens
gcacgtgtgtttttctatt

SEQ ID NO: 4731309 - DNA, 23 bp, Homo sapiens
gcacgtgtgtttttctattaaaa

SEQ ID NO: 4731310 - DNA, 19 bp, Homo sapiens
gcactcagccgtgggcccg

SEQ ID NO: 4731311 - DNA, 13 bp, Homo sapiens
gcactcccctgct

SEQ ID NO: 4731312 - DNA, 13 bp, Homo sapiens
gcactctgtgccc

SEQ ID NO: 4731313 - DNA, 19 bp, Homo sapiens
gcactctgtgcccatgggc

SEQ ID NO: 4731314 - DNA, 12 bp, Homo sapiens
gcactgaaaacc

SEQ ID NO: 4731315 - DNA, 18 bp, Homo sapiens
gcactgaggaagaacggg

SEQ ID NO: 4731316 - DNA, 10 bp, Homo sapiens
gcactgcatg

SEQ ID NO: 4731317 - DNA, 15 bp, Homo sapiens
gcactgccatgcagg

SEQ ID NO: 4731318 - DNA, 12 bp, Homo sapiens
gcactgccctgg

SEQ ID NO: 4731319 - DNA, 13 bp, Homo sapiens
gcactgccctggt

SEQ ID NO: 4731320 - DNA, 13 bp, Homo sapiens
gcactgctgggtg

SEQ ID NO: 4731321 - DNA, 22 bp, Homo sapiens
gcactgctgggtggcccatccc

SEQ ID NO: 4731322 - DNA, 13 bp, Homo sapiens
gcactgcttccag

SEQ ID NO: 4731323 - DNA, 15 bp, Homo sapiens
gcactgcttccagtg

SEQ ID NO: 4731324 - DNA, 16 bp, Homo sapiens
gcactgcttccagtga

SEQ ID NO: 4731325 - DNA, 17 bp, Homo sapiens
gcactgcttgaggaaaa

SEQ ID NO: 4731326 - DNA, 20 bp, Homo sapiens
gcactgtcctgctccacagt

SEQ ID NO: 4731327 - DNA, 16 bp, Homo sapiens
gcactgtgctcagggc

SEQ ID NO: 4731328 - DNA, 18 bp, Homo sapiens
gcactgtgctcagggcta

SEQ ID NO: 4731329 - DNA, 16 bp, Homo sapiens
gcacttggagaggctg

SEQ ID NO: 4731330 - DNA, 14 bp, Homo sapiens
gcagaagacaccag

SEQ ID NO: 4731331 - DNA, 22 bp, Homo sapiens
gcagaagggggtggtgtctcca

SEQ ID NO: 4731332 - DNA, 16 bp, Homo sapiens
gcagaagtgtttttta

SEQ ID NO: 4731333 - DNA, 16 bp, Homo sapiens
gcagaatactggtctc

SEQ ID NO: 4731334 - DNA, 15 bp, Homo sapiens
gcagactctacagag

SEQ ID NO: 4731335 - DNA, 19 bp, Homo sapiens
gcagagaatgaaagggccc

SEQ ID NO: 4731336 - DNA, 17 bp, Homo sapiens
gcagagaccatccctga

SEQ ID NO: 4731337 - DNA, 19 bp, Homo sapiens
gcagagaccatccctgaag

SEQ ID NO: 4731338 - DNA, 20 bp, Homo sapiens
gcagagaccatccctgaagg

SEQ ID NO: 4731339 - DNA, 21 bp, Homo sapiens
gcagagaccatccctgaaggc

SEQ ID NO: 4731340 - DNA, 22 bp, Homo sapiens
gcagagattggaatgggcagct

SEQ ID NO: 4731341 - DNA, 19 bp, Homo sapiens
gcagagcagagaccatccc

SEQ ID NO: 4731342 - DNA, 16 bp, Homo sapiens
gcagagcccaagggaa

SEQ ID NO: 4731343 - DNA, 14 bp, Homo sapiens
gcagagctctgccg

SEQ ID NO: 4731344 - DNA, 17 bp, Homo sapiens
gcagaggggcaggccct

SEQ ID NO: 4731345 - DNA, 18 bp, Homo sapiens
gcagaggggcaggccctg

SEQ ID NO: 4731346 - DNA, 20 bp, Homo sapiens
gcagaggggcaggccctgca

SEQ ID NO: 4731347 - DNA, 23 bp, Homo sapiens
gcagagtcacacgggggcagctg

SEQ ID NO: 4731348 - DNA, 15 bp, Homo sapiens
gcagagttctttgca

SEQ ID NO: 4731349 - DNA, 17 bp, Homo sapiens
gcagatgcagagagcca

SEQ ID NO: 4731350 - DNA, 13 bp, Homo sapiens
gcagatttctgcc

SEQ ID NO: 4731351 - DNA, 16 bp, Homo sapiens
gcagatttgggctgga

SEQ ID NO: 4731352 - DNA, 16 bp, Homo sapiens
gcagcaacgtttttaa

SEQ ID NO: 4731353 - DNA, 12 bp, Homo sapiens
gcagcacagcaa

SEQ ID NO: 4731354 - DNA, 13 bp, Homo sapiens
gcagcagaagggg

SEQ ID NO: 4731355 - DNA, 22 bp, Homo sapiens
gcagcagaagggggtggtgtct

SEQ ID NO: 4731356 - DNA, 20 bp, Homo sapiens
gcagcagggctaccctgagc

SEQ ID NO: 4731357 - DNA, 12 bp, Homo sapiens
gcagcaggtgct

SEQ ID NO: 4731358 - DNA, 15 bp, Homo sapiens
gcagcaggtgctgct

SEQ ID NO: 4731359 - DNA, 20 bp, Homo sapiens
gcagcaggtgctgctaccct

SEQ ID NO: 4731360 - DNA, 15 bp, Homo sapiens
gcagcagtgtgaggc

SEQ ID NO: 4731361 - DNA, 23 bp, Homo sapiens
gagtacgttaaaagcaaaaagat

SEQ ID NO: 4731362 - DNA, 22 bp, Homo sapiens
gagtagctgggactacaggcac

SEQ ID NO: 4731363 - DNA, 14 bp, Homo sapiens
gagtattggtctcc

SEQ ID NO: 4731364 - DNA, 16 bp, Homo sapiens
gagtcaccaagcccag

SEQ ID NO: 4731365 - DNA, 17 bp, Homo sapiens
gagtccaggtaaatggt

SEQ ID NO: 4731366 - DNA, 16 bp, Homo sapiens
gagtcccaccttggct

SEQ ID NO: 4731367 - DNA, 12 bp, Homo sapiens
gagtcccagagc

SEQ ID NO: 4731368 - DNA, 14 bp, Homo sapiens
gagtcccagagctg

SEQ ID NO: 4731369 - DNA, 22 bp, Homo sapiens
gagtcccagagctgcacagggt

SEQ ID NO: 4731370 - DNA, 14 bp, Homo sapiens
gagtcccctgtttg

SEQ ID NO: 4731371 - DNA, 19 bp, Homo sapiens
gagtccgaaagggacttgg

SEQ ID NO: 4731372 - DNA, 19 bp, Homo sapiens
gagtctcactgttgcccag

SEQ ID NO: 4731373 - DNA, 20 bp, Homo sapiens
gagtctcactgttgcccagg

SEQ ID NO: 4731374 - DNA, 22 bp, Homo sapiens
gagtctcactgttgcccaggct

SEQ ID NO: 4731375 - DNA, 20 bp, Homo sapiens
gagtctggcaaacatgtgca

SEQ ID NO: 4731376 - DNA, 15 bp, Homo sapiens
gagtgacagaggcag

SEQ ID NO: 4731377 - DNA, 18 bp, Homo sapiens
gagtgacagaggcagccc

SEQ ID NO: 4731378 - DNA, 20 bp, Homo sapiens
gagtgacagaggcagcccca

SEQ ID NO: 4731379 - DNA, 15 bp, Homo sapiens
gagtgagacccagga

SEQ ID NO: 4731380 - DNA, 18 bp, Homo sapiens
gagtgagactccacctca

SEQ ID NO: 4731381 - DNA, 19 bp, Homo sapiens
gagtgcaggcctgctcagg

SEQ ID NO: 4731382 - DNA, 14 bp, Homo sapiens
gagtgcagtcctga

SEQ ID NO: 4731383 - DNA, 18 bp, Homo sapiens
gagtgcagtcctgatcag

SEQ ID NO: 4731384 - DNA, 14 bp, Homo sapiens
gagtgcctggccaa

SEQ ID NO: 4731385 - DNA, 18 bp, Homo sapiens
gagtggaggaggcctggg

SEQ ID NO: 4731386 - DNA, 20 bp, Homo sapiens
gagtggcatggccaccacca

SEQ ID NO: 4731387 - DNA, 18 bp, Homo sapiens
gagtggcattggcagcag

SEQ ID NO: 4731388 - DNA, 23 bp, Homo sapiens
gagtggcattggcagcaggtgct

SEQ ID NO: 4731389 - DNA, 15 bp, Homo sapiens
gagtgggttgatttc

SEQ ID NO: 4731390 - DNA, 19 bp, Homo sapiens
gagtggtggctcatgcctg

SEQ ID NO: 4731391 - DNA, 20 bp, Homo sapiens
gagtggttgggctgtgcctg

SEQ ID NO: 4731392 - DNA, 20 bp, Homo sapiens
gagtgtagaagcattccttc

SEQ ID NO: 4731393 - DNA, 22 bp, Homo sapiens
gagtgtctttccacggagccac

SEQ ID NO: 4731394 - DNA, 21 bp, Homo sapiens
gagttaagaagctgttgtaca

SEQ ID NO: 4731395 - DNA, 23 bp, Homo sapiens
gagttaccattatttaatttgta

SEQ ID NO: 4731396 - DNA, 22 bp, Homo sapiens
gagttattcataaagagaaaat

SEQ ID NO: 4731397 - DNA, 23 bp, Homo sapiens
gagttcgtgaagagggaagccag

SEQ ID NO: 4731398 - DNA, 22 bp, Homo sapiens
gagttgatagcacagaccctgc

SEQ ID NO: 4731399 - DNA, 12 bp, Homo sapiens
gataaaaatcag

SEQ ID NO: 4731400 - DNA, 14 bp, Homo sapiens
gataaaaatcagta

SEQ ID NO: 4731401 - DNA, 21 bp, Homo sapiens
gataaataacttttttttaag

SEQ ID NO: 4731402 - DNA, 19 bp, Homo sapiens
gataaatttgttgaatatt

SEQ ID NO: 4731403 - DNA, 16 bp, Homo sapiens
gataacagcactgact

SEQ ID NO: 4731404 - DNA, 20 bp, Homo sapiens
gataagagggcacacactgt

SEQ ID NO: 4731405 - DNA, 18 bp, Homo sapiens
gataatggtgaacatttt

SEQ ID NO: 4731406 - DNA, 19 bp, Homo sapiens
gatacagtcaacaagcctg

SEQ ID NO: 4731407 - DNA, 22 bp, Homo sapiens
gatacagtcattatttaaagca

SEQ ID NO: 4731408 - DNA, 19 bp, Homo sapiens
gataccatgctgtaaggat

SEQ ID NO: 4731409 - DNA, 21 bp, Homo sapiens
gatactgttgcacgtgtgttt

SEQ ID NO: 4731410 - DNA, 19 bp, Homo sapiens
gatacttcccacaccacaa

SEQ ID NO: 4731411 - DNA, 15 bp, Homo sapiens
gatagcacagaccct

SEQ ID NO: 4731412 - DNA, 22 bp, Homo sapiens
gatagcacagaccctgccctgt

SEQ ID NO: 4731413 - DNA, 23 bp, Homo sapiens
gataggcaggaacatacagacac

SEQ ID NO: 4731414 - DNA, 18 bp, Homo sapiens
gatataaaagactgacca

SEQ ID NO: 4731415 - DNA, 16 bp, Homo sapiens
gatatagaacagtgct

SEQ ID NO: 4731416 - DNA, 17 bp, Homo sapiens
gatatgaaaaataaata

SEQ ID NO: 4731417 - DNA, 22 bp, Homo sapiens
gatatgtgtaaatgttatgact

SEQ ID NO: 4731418 - DNA, 13 bp, Homo sapiens
gatatttatgtat

SEQ ID NO: 4731419 - DNA, 20 bp, Homo sapiens
gatatttatgtatcttgatg

SEQ ID NO: 4731420 - DNA, 22 bp, Homo sapiens
gatatttgcattgaggaaatat

SEQ ID NO: 4731421 - DNA, 14 bp, Homo sapiens
gatcaacatctttt

SEQ ID NO: 4731422 - DNA, 16 bp, Homo sapiens
gatcaacatcttttct

SEQ ID NO: 4731423 - DNA, 18 bp, Homo sapiens
gatcaaggagaggaggca

SEQ ID NO: 4731424 - DNA, 16 bp, Homo sapiens
gatcacagcagcttct

SEQ ID NO: 4731425 - DNA, 12 bp, Homo sapiens
gatcacggctca

SEQ ID NO: 4731426 - DNA, 23 bp, Homo sapiens
gatcacggctcactgcagcctca

SEQ ID NO: 4731427 - DNA, 22 bp, Homo sapiens
gatcagtctgattcccaagctc

SEQ ID NO: 4731428 - DNA, 19 bp, Homo sapiens
gatccaaatgctgtgcaaa

SEQ ID NO: 4731429 - DNA, 19 bp, Homo sapiens
gatccaagtttactcaacc

SEQ ID NO: 4731430 - DNA, 22 bp, Homo sapiens
gatccaataattttcctgtgac

SEQ ID NO: 4731431 - DNA, 17 bp, Homo sapiens
gatccagtataagacta

SEQ ID NO: 4731432 - DNA, 24 bp, Homo sapiens
gatcccatcttgataagaccacca

SEQ ID NO: 4731433 - DNA, 20 bp, Homo sapiens
gatccccaagcctggcaagg

SEQ ID NO: 4731434 - DNA, 12 bp, Homo sapiens
gatccctcatct

SEQ ID NO: 4731435 - DNA, 18 bp, Homo sapiens
gatcctacttctctgagt

SEQ ID NO: 4731436 - DNA, 12 bp, Homo sapiens
gatcctccaggt

SEQ ID NO: 4731437 - DNA, 20 bp, Homo sapiens
gatcctcccacctcagcctc

SEQ ID NO: 4731438 - DNA, 21 bp, Homo sapiens
gatcctcccacctcagcctcc

SEQ ID NO: 4731439 - DNA, 17 bp, Homo sapiens
gatccttccacctcagt

SEQ ID NO: 4731440 - DNA, 18 bp, Homo sapiens
gatcgtctgactggtgtt

SEQ ID NO: 4731441 - DNA, 17 bp, Homo sapiens
gatctaccccttactta

SEQ ID NO: 4731442 - DNA, 18 bp, Homo sapiens
gatctaggaagactttgg

SEQ ID NO: 4731443 - DNA, 14 bp, Homo sapiens
gatctgcccctccc

SEQ ID NO: 4731444 - DNA, 20 bp, Homo sapiens
gatctgcccctccctgcttc

SEQ ID NO: 4731445 - DNA, 15 bp, Homo sapiens
gatctgctagtgctg

SEQ ID NO: 4731446 - DNA, 17 bp, Homo sapiens
gatctttgcagacaggc

SEQ ID NO: 4731447 - DNA, 18 bp, Homo sapiens
gatctttgcagacaggca

SEQ ID NO: 4731448 - DNA, 16 bp, Homo sapiens
gatcttttcaagttaa

SEQ ID NO: 4731449 - DNA, 14 bp, Homo sapiens
gatgaaaataaaga

SEQ ID NO: 4731450 - DNA, 15 bp, Homo sapiens
gatgaaaataaagaa

SEQ ID NO: 4731451 - DNA, 19 bp, Homo sapiens
gatgaaagagaaggtgggt

SEQ ID NO: 4731452 - DNA, 15 bp, Homo sapiens
gatgacagccaccct

SEQ ID NO: 4731453 - DNA, 22 bp, Homo sapiens
gatgagaaaggttgaagcacca

SEQ ID NO: 4731454 - DNA, 14 bp, Homo sapiens
gatgagagcccaga

SEQ ID NO: 4731455 - DNA, 18 bp, Homo sapiens
gatgagagcccagaggta

SEQ ID NO: 4731456 - DNA, 20 bp, Homo sapiens
gatgaggccctccacacctg

SEQ ID NO: 4731457 - DNA, 21 bp, Homo sapiens
gatgaggccctccacacctgc

SEQ ID NO: 4731458 - DNA, 22 bp, Homo sapiens
gatgaggccctccacacctgcg

SEQ ID NO: 4731459 - DNA, 21 bp, Homo sapiens
gatgatctttgcagacaggca

SEQ ID NO: 4731460 - DNA, 13 bp, Homo sapiens
gatgatgccacac

SEQ ID NO: 4731461 - DNA, 15 bp, Homo sapiens
gatgatgccacacca

SEQ ID NO: 4731462 - DNA, 15 bp, Homo sapiens
gatgcacatccctgg

SEQ ID NO: 4731463 - DNA, 16 bp, Homo sapiens
gatgcacatccctgga

SEQ ID NO: 4731464 - DNA, 12 bp, Homo sapiens
gatgcagcctca

SEQ ID NO: 4731465 - DNA, 14 bp, Homo sapiens
gatgcagcctcaca

SEQ ID NO: 4731466 - DNA, 22 bp, Homo sapiens
gatgcaggtgagcccatggccc

SEQ ID NO: 4731467 - DNA, 22 bp, Homo sapiens
gatgcaggtttgaccaggaaag

SEQ ID NO: 4731468 - DNA, 16 bp, Homo sapiens
gatgccacaccaagct

SEQ ID NO: 4731469 - DNA, 21 bp, Homo sapiens
gatgccacaccaagctgtgcc

SEQ ID NO: 4731470 - DNA, 22 bp, Homo sapiens
gatgccacaccaagctgtgcca

SEQ ID NO: 4731471 - DNA, 19 bp, Homo sapiens
gatgcctggtggcagctgc

SEQ ID NO: 4731472 - DNA, 21 bp, Homo sapiens
gatgcttcttcagagactcct

SEQ ID NO: 4731473 - DNA, 21 bp, Homo sapiens
gatgctttaagtgcacaacat

SEQ ID NO: 4731474 - DNA, 21 bp, Homo sapiens
gatggcacttataaccaaagc

SEQ ID NO: 4731475 - DNA, 13 bp, Homo sapiens
gatggcaggatgg

SEQ ID NO: 4731476 - DNA, 21 bp, Homo sapiens
gatggcaggatggcctggcca

SEQ ID NO: 4731477 - DNA, 19 bp, Homo sapiens
gatgggatggtggagggcc

SEQ ID NO: 4731478 - DNA, 20 bp, Homo sapiens
gatgggatggtggagggcca

SEQ ID NO: 4731479 - DNA, 16 bp, Homo sapiens
gatgggcccaattctt

SEQ ID NO: 4731480 - DNA, 14 bp, Homo sapiens
gatggggccctgcc

SEQ ID NO: 4731481 - DNA, 13 bp, Homo sapiens
gatggggctgcac

SEQ ID NO: 4731482 - DNA, 15 bp, Homo sapiens
gatggggctgcaccg

SEQ ID NO: 4731483 - DNA, 14 bp, Homo sapiens
gatgggggctctgc

SEQ ID NO: 4731484 - DNA, 17 bp, Homo sapiens
gatgtacaggcagatga

SEQ ID NO: 4731485 - DNA, 17 bp, Homo sapiens
gatgtatatttgcatat

SEQ ID NO: 4731486 - DNA, 17 bp, Homo sapiens
gatgtcctcaccacatg

SEQ ID NO: 4731487 - DNA, 21 bp, Homo sapiens
gatgtcctcaccacatgcgga

SEQ ID NO: 4731488 - DNA, 16 bp, Homo sapiens
gatgtcctcctctgtg

SEQ ID NO: 4731489 - DNA, 17 bp, Homo sapiens
gatgtcctcctctgtga

SEQ ID NO: 4731490 - DNA, 15 bp, Homo sapiens
gatgtgatgtggcag

SEQ ID NO: 4731491 - DNA, 14 bp, Homo sapiens
gatgtggcaggagg

SEQ ID NO: 4731492 - DNA, 20 bp, Homo sapiens
gatgtgtgttgatactgttg

SEQ ID NO: 4731493 - DNA, 22 bp, Homo sapiens
gatgttctattttttgttttgt

SEQ ID NO: 4731494 - DNA, 15 bp, Homo sapiens
gatgttggctgggaa

SEQ ID NO: 4731495 - DNA, 20 bp, Homo sapiens
gattaacactcatttccaat

SEQ ID NO: 4731496 - DNA, 21 bp, Homo sapiens
gattacaggctcctgccacca

SEQ ID NO: 4731497 - DNA, 13 bp, Homo sapiens
gattacctcctga

SEQ ID NO: 4731498 - DNA, 14 bp, Homo sapiens
gattacctcctgag

SEQ ID NO: 4731499 - DNA, 14 bp, Homo sapiens
gattagaacattta

SEQ ID NO: 4731500 - DNA, 23 bp, Homo sapiens
gattagataatcttttacattga

SEQ ID NO: 4731501 - DNA, 22 bp, Homo sapiens
gattagtaaatatgtgaagaaa

SEQ ID NO: 4731502 - DNA, 22 bp, Homo sapiens
gattataaacaacctagacagt

SEQ ID NO: 4731503 - DNA, 20 bp, Homo sapiens
gattataggcacctaccacc

SEQ ID NO: 4731504 - DNA, 13 bp, Homo sapiens
gattattcagtgt

SEQ ID NO: 4731505 - DNA, 21 bp, Homo sapiens
gattatttaataacattacct

SEQ ID NO: 4731506 - DNA, 15 bp, Homo sapiens
gattatttgttttac

SEQ ID NO: 4731507 - DNA, 12 bp, Homo sapiens
gattcacacatg

SEQ ID NO: 4731508 - DNA, 12 bp, Homo sapiens
gattcagacagc

SEQ ID NO: 4731509 - DNA, 17 bp, Homo sapiens
gattcccaagctctgct

SEQ ID NO: 4731510 - DNA, 17 bp, Homo sapiens
gattcccaggatgagca

SEQ ID NO: 4731511 - DNA, 12 bp, Homo sapiens
gattctcagggt

SEQ ID NO: 4731512 - DNA, 23 bp, Homo sapiens
gattctcagggtctctgctgccg

SEQ ID NO: 4731513 - DNA, 19 bp, Homo sapiens
gattctcctgcctcagcct

SEQ ID NO: 4731514 - DNA, 20 bp, Homo sapiens
gattctcctgcctcagcctc

SEQ ID NO: 4731515 - DNA, 11 bp, Homo sapiens
gattctccttc

SEQ ID NO: 4731516 - DNA, 16 bp, Homo sapiens
gattctgatttgtatt

SEQ ID NO: 4731517 - DNA, 18 bp, Homo sapiens
gattctgttctacttgat

SEQ ID NO: 4731518 - DNA, 12 bp, Homo sapiens
gattctttcctg

SEQ ID NO: 4731519 - DNA, 17 bp, Homo sapiens
gattctttcctgaggct

SEQ ID NO: 4731520 - DNA, 20 bp, Homo sapiens
gattctttcctgaggctggg

SEQ ID NO: 4731521 - DNA, 16 bp, Homo sapiens
gattgagtctgtgcca

SEQ ID NO: 4731522 - DNA, 20 bp, Homo sapiens
gattgcaacaggctgggctt

SEQ ID NO: 4731523 - DNA, 21 bp, Homo sapiens
gattgcaacaggctgggcttc

SEQ ID NO: 4731524 - DNA, 14 bp, Homo sapiens
gattgcgagagatg

SEQ ID NO: 4731525 - DNA, 19 bp, Homo sapiens
gattgcgagagatgtgtgt

SEQ ID NO: 4731526 - DNA, 22 bp, Homo sapiens
gattgcgtggaattgtgctgag

SEQ ID NO: 4731527 - DNA, 16 bp, Homo sapiens
gattgctgccccatca

SEQ ID NO: 4731528 - DNA, 20 bp, Homo sapiens
gattggattatttaataaca

SEQ ID NO: 4731529 - DNA, 21 bp, Homo sapiens
gattggattatttaataacat

SEQ ID NO: 4731530 - DNA, 18 bp, Homo sapiens
gattggctcacactgaga

SEQ ID NO: 4731531 - DNA, 20 bp, Homo sapiens
gattggctcacactgagaat

SEQ ID NO: 4731532 - DNA, 16 bp, Homo sapiens
gattggtgttttatct

SEQ ID NO: 4731533 - DNA, 13 bp, Homo sapiens
gattgtaaaaaaa

SEQ ID NO: 4731534 - DNA, 18 bp, Homo sapiens
gattgtaaaaaaaaatgc

SEQ ID NO: 4731535 - DNA, 20 bp, Homo sapiens
gattgtgttcctgaagaaaa

SEQ ID NO: 4731536 - DNA, 14 bp, Homo sapiens
gatttaataaaata

SEQ ID NO: 4731537 - DNA, 19 bp, Homo sapiens
gatttaataaaataattct

SEQ ID NO: 4731538 - DNA, 23 bp, Homo sapiens
gatttaataaaataattctaaag

SEQ ID NO: 4731539 - DNA, 21 bp, Homo sapiens
gatttagcaatgctgtgaata

SEQ ID NO: 4731540 - DNA, 15 bp, Homo sapiens
gatttaggtagcctt

SEQ ID NO: 4731541 - DNA, 15 bp, Homo sapiens
gatttcagctcactg

SEQ ID NO: 4731542 - DNA, 18 bp, Homo sapiens
gatttccagccagggctg

SEQ ID NO: 4731543 - DNA, 13 bp, Homo sapiens
gatttctgccttc

SEQ ID NO: 4731544 - DNA, 16 bp, Homo sapiens
gatttctgccttcctt

SEQ ID NO: 4731545 - DNA, 16 bp, Homo sapiens
gatttctgccttgaaa

SEQ ID NO: 4731546 - DNA, 15 bp, Homo sapiens
gatttcttagagatt

SEQ ID NO: 4731547 - DNA, 16 bp, Homo sapiens
gatttgagctcagccc

SEQ ID NO: 4731548 - DNA, 14 bp, Homo sapiens
gatttgtattaaaa

SEQ ID NO: 4731549 - DNA, 22 bp, Homo sapiens
gattttaaagagtgaaaaatga

SEQ ID NO: 4731550 - DNA, 22 bp, Homo sapiens
gattttgtaaagttgcctttat

SEQ ID NO: 4731551 - DNA, 13 bp, Homo sapiens
gatttttctcaaa

SEQ ID NO: 4731552 - DNA, 13 bp, Homo sapiens
gatttttctttaa

SEQ ID NO: 4731553 - DNA, 15 bp, Homo sapiens
gatttttgtcttgtg

SEQ ID NO: 4731554 - DNA, 19 bp, Homo sapiens
gcaaaatcaagcaagcctc

SEQ ID NO: 4731555 - DNA, 12 bp, Homo sapiens
gcaaactttaac

SEQ ID NO: 4731556 - DNA, 13 bp, Homo sapiens
gcaaagcccagct

SEQ ID NO: 4731557 - DNA, 14 bp, Homo sapiens
gcaaagggcatggg

SEQ ID NO: 4731558 - DNA, 20 bp, Homo sapiens
gcaaagggcatgggtcggga

SEQ ID NO: 4731559 - DNA, 22 bp, Homo sapiens
gcaaagggcatgggtcgggaga

SEQ ID NO: 4731560 - DNA, 22 bp, Homo sapiens
gcaaagtcatgcaaaggctggg

SEQ ID NO: 4731561 - DNA, 14 bp, Homo sapiens
gcaaattaaacaat

SEQ ID NO: 4731562 - DNA, 14 bp, Homo sapiens
gcaaattactccaa

SEQ ID NO: 4731563 - DNA, 15 bp, Homo sapiens
gcaacaagctatttt

SEQ ID NO: 4731564 - DNA, 21 bp, Homo sapiens
gcaacatggattccaaagcat

SEQ ID NO: 4731565 - DNA, 19 bp, Homo sapiens
gcaacctccgcctcttggg

SEQ ID NO: 4731566 - DNA, 21 bp, Homo sapiens
gcaactcgccctgtttggcat

SEQ ID NO: 4731567 - DNA, 13 bp, Homo sapiens
gcaacttgtgaac

SEQ ID NO: 4731568 - DNA, 14 bp, Homo sapiens
gcaagacgctgtgc

SEQ ID NO: 4731569 - DNA, 22 bp, Homo sapiens
gcaagacgctgtgctgccctgc

SEQ ID NO: 4731570 - DNA, 18 bp, Homo sapiens
gcaagcaacaagctattt

SEQ ID NO: 4731571 - DNA, 16 bp, Homo sapiens
gcaagcacctcctgcc

SEQ ID NO: 4731572 - DNA, 19 bp, Homo sapiens
gcaagctagaacctggagg

SEQ ID NO: 4731573 - DNA, 19 bp, Homo sapiens
gcaagctcccaagggatgg

SEQ ID NO: 4731574 - DNA, 21 bp, Homo sapiens
gcaagcttatttagcacattt

SEQ ID NO: 4731575 - DNA, 15 bp, Homo sapiens
gcaaggaggctggct

SEQ ID NO: 4731576 - DNA, 12 bp, Homo sapiens
gcaaggctgtgc

SEQ ID NO: 4731577 - DNA, 13 bp, Homo sapiens
gcaaggctgtgct

SEQ ID NO: 4731578 - DNA, 16 bp, Homo sapiens
gcaagtgagagctggg

SEQ ID NO: 4731579 - DNA, 18 bp, Homo sapiens
gcaagtgagagctgggtg

SEQ ID NO: 4731580 - DNA, 19 bp, Homo sapiens
gcaagtgagagctgggtgt

SEQ ID NO: 4731581 - DNA, 19 bp, Homo sapiens
gcaagtgattgggacagag

SEQ ID NO: 4731582 - DNA, 24 bp, Homo sapiens
gagacagcccgggctctgcctccc

SEQ ID NO: 4731583 - DNA, 21 bp, Homo sapiens
gagacagccgggaggagcctg

SEQ ID NO: 4731584 - DNA, 22 bp, Homo sapiens
gagacagggttttgccatgttg

SEQ ID NO: 4731585 - DNA, 19 bp, Homo sapiens
gagacataaatgttcactt

SEQ ID NO: 4731586 - DNA, 14 bp, Homo sapiens
gagaccaggcaaag

SEQ ID NO: 4731587 - DNA, 13 bp, Homo sapiens
gagacctcctgcc

SEQ ID NO: 4731588 - DNA, 15 bp, Homo sapiens
gagacctcctgcctc

SEQ ID NO: 4731589 - DNA, 16 bp, Homo sapiens
gagacctcctgcctcc

SEQ ID NO: 4731590 - DNA, 13 bp, Homo sapiens
gagacctgcccct

SEQ ID NO: 4731591 - DNA, 19 bp, Homo sapiens
gagacggagtcccaccttg

SEQ ID NO: 4731592 - DNA, 20 bp, Homo sapiens
gagactcctgcaggcagcca

SEQ ID NO: 4731593 - DNA, 14 bp, Homo sapiens
gagactcgagaact

SEQ ID NO: 4731594 - DNA, 15 bp, Homo sapiens
gagactcgagaactt

SEQ ID NO: 4731595 - DNA, 16 bp, Homo sapiens
gagactcgagaacttt

SEQ ID NO: 4731596 - DNA, 19 bp, Homo sapiens
gagactctcttaggagcag

SEQ ID NO: 4731597 - DNA, 22 bp, Homo sapiens
gagactctgtttgcttgtgttt

SEQ ID NO: 4731598 - DNA, 21 bp, Homo sapiens
gagacttggatgaggagtggt

SEQ ID NO: 4731599 - DNA, 16 bp, Homo sapiens
gagagaccaggcaaag

SEQ ID NO: 4731600 - DNA, 13 bp, Homo sapiens
gagagactgtgtg

SEQ ID NO: 4731601 - DNA, 15 bp, Homo sapiens
gagagagcagcttct

SEQ ID NO: 4731602 - DNA, 19 bp, Homo sapiens
gagagagcagcttctgcca

SEQ ID NO: 4731603 - DNA, 22 bp, Homo sapiens
gagagcagcttctgccacttcc

SEQ ID NO: 4731604 - DNA, 16 bp, Homo sapiens
gagagcataatttaaa

SEQ ID NO: 4731605 - DNA, 16 bp, Homo sapiens
gagagccagaacctgg

SEQ ID NO: 4731606 - DNA, 14 bp, Homo sapiens
gagagcccaggagc

SEQ ID NO: 4731607 - DNA, 16 bp, Homo sapiens
gagagcccaggagctc

SEQ ID NO: 4731608 - DNA, 20 bp, Homo sapiens
gagagccttccaggggtggg

SEQ ID NO: 4731609 - DNA, 17 bp, Homo sapiens
gagagctagaacctaga

SEQ ID NO: 4731610 - DNA, 13 bp, Homo sapiens
gagagctggagcc

SEQ ID NO: 4731611 - DNA, 21 bp, Homo sapiens
gagaggaaatattgctggggt

SEQ ID NO: 4731612 - DNA, 16 bp, Homo sapiens
gagaggacaaaataaa

SEQ ID NO: 4731613 - DNA, 19 bp, Homo sapiens
gagaggatgagagcccaga

SEQ ID NO: 4731614 - DNA, 12 bp, Homo sapiens
gagaggatttga

SEQ ID NO: 4731615 - DNA, 13 bp, Homo sapiens
gagaggggaacag

SEQ ID NO: 4731616 - DNA, 18 bp, Homo sapiens
gagaggggaacagactgg

SEQ ID NO: 4731617 - DNA, 17 bp, Homo sapiens
gagaggggacgcaggcc

SEQ ID NO: 4731618 - DNA, 14 bp, Homo sapiens
gagagtgagagcat

SEQ ID NO: 4731619 - DNA, 17 bp, Homo sapiens
gagagttcgtgaagagg

SEQ ID NO: 4731620 - DNA, 15 bp, Homo sapiens
gagataaatctagta

SEQ ID NO: 4731621 - DNA, 19 bp, Homo sapiens
gagatatttaaaagacaaa

SEQ ID NO: 4731622 - DNA, 14 bp, Homo sapiens
gagatcaaagatga

SEQ ID NO: 4731623 - DNA, 20 bp, Homo sapiens
gagatcaaccccttcgctcc

SEQ ID NO: 4731624 - DNA, 19 bp, Homo sapiens
gagatcacgccactgcact

SEQ ID NO: 4731625 - DNA, 18 bp, Homo sapiens
gagatccagggcaaggcc

SEQ ID NO: 4731626 - DNA, 17 bp, Homo sapiens
gagatgtgtgttgatac

SEQ ID NO: 4731627 - DNA, 22 bp, Homo sapiens
gagatgtgtgttgatactgttg

SEQ ID NO: 4731628 - DNA, 23 bp, Homo sapiens
gagattagtaaatatgtgaagaa

SEQ ID NO: 4731629 - DNA, 22 bp, Homo sapiens
gagattcttcgtgtatagctgt

SEQ ID NO: 4731630 - DNA, 13 bp, Homo sapiens
gagatttcatctg

SEQ ID NO: 4731631 - DNA, 17 bp, Homo sapiens
gagatttcatctgctct

SEQ ID NO: 4731632 - DNA, 21 bp, Homo sapiens
gagcaagacgctgtgctgccc

SEQ ID NO: 4731633 - DNA, 12 bp, Homo sapiens
gagcacagccct

SEQ ID NO: 4731634 - DNA, 20 bp, Homo sapiens
gagcacagccctcccgcccc

SEQ ID NO: 4731635 - DNA, 20 bp, Homo sapiens
gagcaccttagacagtccct

SEQ ID NO: 4731636 - DNA, 21 bp, Homo sapiens
gagcaccttagacagtccctg

SEQ ID NO: 4731637 - DNA, 22 bp, Homo sapiens
gagcaccttagacagtccctgc

SEQ ID NO: 4731638 - DNA, 16 bp, Homo sapiens
gagcagagaccatccc

SEQ ID NO: 4731639 - DNA, 17 bp, Homo sapiens
gagcagagaccatccct

SEQ ID NO: 4731640 - DNA, 18 bp, Homo sapiens
gagcagagaccatccctg

SEQ ID NO: 4731641 - DNA, 16 bp, Homo sapiens
gagcagaggggctgaa

SEQ ID NO: 4731642 - DNA, 16 bp, Homo sapiens
gagcagatgcagagag

SEQ ID NO: 4731643 - DNA, 21 bp, Homo sapiens
gagcagatgcagagagccatt

SEQ ID NO: 4731644 - DNA, 21 bp, Homo sapiens
gagcagcttctgccacttccc

SEQ ID NO: 4731645 - DNA, 20 bp, Homo sapiens
gagcaggaggggggctgggt

SEQ ID NO: 4731646 - DNA, 16 bp, Homo sapiens
gagcagggtgctgtgg

SEQ ID NO: 4731647 - DNA, 20 bp, Homo sapiens
gagcagtttctgtcctgctg

SEQ ID NO: 4731648 - DNA, 21 bp, Homo sapiens
gagcagtttctgtcctgctgg

SEQ ID NO: 4731649 - DNA, 17 bp, Homo sapiens
gagcataatttaaaaat

SEQ ID NO: 4731650 - DNA, 20 bp, Homo sapiens
gagcataatttaaaaatata

SEQ ID NO: 4731651 - DNA, 18 bp, Homo sapiens
gagcataggaggggtctg

SEQ ID NO: 4731652 - DNA, 12 bp, Homo sapiens
gagcatcaggcc

SEQ ID NO: 4731653 - DNA, 17 bp, Homo sapiens
gagcatcaggccaggcc

SEQ ID NO: 4731654 - DNA, 20 bp, Homo sapiens
gagcatcaggccaggccctc

SEQ ID NO: 4731655 - DNA, 18 bp, Homo sapiens
gagcatccacctccttct

SEQ ID NO: 4731656 - DNA, 21 bp, Homo sapiens
gagcatgcctggatggggctg

SEQ ID NO: 4731657 - DNA, 14 bp, Homo sapiens
gagcatggagctgg

SEQ ID NO: 4731658 - DNA, 17 bp, Homo sapiens
gagcatggagctggccg

SEQ ID NO: 4731659 - DNA, 15 bp, Homo sapiens
gagcattagatttct

SEQ ID NO: 4731660 - DNA, 19 bp, Homo sapiens
gagccaatttaaagaaaac

SEQ ID NO: 4731661 - DNA, 16 bp, Homo sapiens
gagccacatttacata

SEQ ID NO: 4731662 - DNA, 14 bp, Homo sapiens
gagccaccgtgcct

SEQ ID NO: 4731663 - DNA, 20 bp, Homo sapiens
gagccaccgtgcctggccac

SEQ ID NO: 4731664 - DNA, 14 bp, Homo sapiens
gagccactcctctg

SEQ ID NO: 4731665 - DNA, 19 bp, Homo sapiens
gagccactgcaccgggcca

SEQ ID NO: 4731666 - DNA, 20 bp, Homo sapiens
gagccactgcaccgggccac

SEQ ID NO: 4731667 - DNA, 15 bp, Homo sapiens
gagccagcctgctcc

SEQ ID NO: 4731668 - DNA, 13 bp, Homo sapiens
gagccagggtgag

SEQ ID NO: 4731669 - DNA, 14 bp, Homo sapiens
gagccatacataaa

SEQ ID NO: 4731670 - DNA, 16 bp, Homo sapiens
gagccattttgtgaat

SEQ ID NO: 4731671 - DNA, 21 bp, Homo sapiens
gagccattttgtgaatggatt

SEQ ID NO: 4731672 - DNA, 13 bp, Homo sapiens
gagcccaccttgg

SEQ ID NO: 4731673 - DNA, 17 bp, Homo sapiens
gagcccaccttggctca

SEQ ID NO: 4731674 - DNA, 11 bp, Homo sapiens
gagcccacgcc

SEQ ID NO: 4731675 - DNA, 15 bp, Homo sapiens
gagcccacgccccca

SEQ ID NO: 4731676 - DNA, 16 bp, Homo sapiens
gagcccacgcccccac

SEQ ID NO: 4731677 - DNA, 18 bp, Homo sapiens
gagcccacgcccccactg

SEQ ID NO: 4731678 - DNA, 22 bp, Homo sapiens
gagcccagaggagggcagcaga

SEQ ID NO: 4731679 - DNA, 12 bp, Homo sapiens
gagcccaggagc

SEQ ID NO: 4731680 - DNA, 16 bp, Homo sapiens
gagcccaggccaggac

SEQ ID NO: 4731681 - DNA, 23 bp, Homo sapiens
gagcccaggccaggactctgcag

SEQ ID NO: 4731682 - DNA, 16 bp, Homo sapiens
gagccccattcctggg

SEQ ID NO: 4731683 - DNA, 21 bp, Homo sapiens
gagcccctcagacagccccct

SEQ ID NO: 4731684 - DNA, 13 bp, Homo sapiens
gagccctggtggc

SEQ ID NO: 4731685 - DNA, 18 bp, Homo sapiens
gagccggacacttctcag

SEQ ID NO: 4731686 - DNA, 20 bp, Homo sapiens
gagccggacacttctcagga

SEQ ID NO: 4731687 - DNA, 20 bp, Homo sapiens
gagccgggtctgcctcttct

SEQ ID NO: 4731688 - DNA, 21 bp, Homo sapiens
gagcctcagcatcctggcacc

SEQ ID NO: 4731689 - DNA, 15 bp, Homo sapiens
gagcctgcagttatt

SEQ ID NO: 4731690 - DNA, 18 bp, Homo sapiens
gagcctgggggctcctca

SEQ ID NO: 4731691 - DNA, 13 bp, Homo sapiens
gagccttccaggg

SEQ ID NO: 4731692 - DNA, 17 bp, Homo sapiens
gagccttccaggggtgg

SEQ ID NO: 4731693 - DNA, 19 bp, Homo sapiens
gagcgagagatcaaagatg

SEQ ID NO: 4731694 - DNA, 15 bp, Homo sapiens
gagcgctcctgccgc

SEQ ID NO: 4731695 - DNA, 21 bp, Homo sapiens
gagcgctcctgccgcagagct

SEQ ID NO: 4731696 - DNA, 23 bp, Homo sapiens
gagcgctcctgccgcagagctgg

SEQ ID NO: 4731697 - DNA, 20 bp, Homo sapiens
gagctacttgggccatagct

SEQ ID NO: 4731698 - DNA, 14 bp, Homo sapiens
gagctagaacctgg

SEQ ID NO: 4731699 - DNA, 17 bp, Homo sapiens
gagctagaacctggaga

SEQ ID NO: 4731700 - DNA, 14 bp, Homo sapiens
gagctcaggacact

SEQ ID NO: 4731701 - DNA, 17 bp, Homo sapiens
gagctcccctccccaac

SEQ ID NO: 4731702 - DNA, 19 bp, Homo sapiens
gagctctgacccacagcct

SEQ ID NO: 4731703 - DNA, 16 bp, Homo sapiens
gagctgacacaggatg

SEQ ID NO: 4731704 - DNA, 14 bp, Homo sapiens
gagctgcctggacc

SEQ ID NO: 4731705 - DNA, 15 bp, Homo sapiens
gagctgcctgttcag

SEQ ID NO: 4731706 - DNA, 20 bp, Homo sapiens
gagctggagcctggtgccct

SEQ ID NO: 4731707 - DNA, 19 bp, Homo sapiens
gagctggccgtgggcctgg

SEQ ID NO: 4731708 - DNA, 20 bp, Homo sapiens
gagctggccgtgggcctggg

SEQ ID NO: 4731709 - DNA, 22 bp, Homo sapiens
gagctgggctttcctctgtgac

SEQ ID NO: 4731710 - DNA, 18 bp, Homo sapiens
gagctgggtgtcaagagg

SEQ ID NO: 4731711 - DNA, 18 bp, Homo sapiens
gagctgtattaagccact

SEQ ID NO: 4731712 - DNA, 15 bp, Homo sapiens
gagcttaacagtgtg

SEQ ID NO: 4731713 - DNA, 16 bp, Homo sapiens
gagcttgtaataaata

SEQ ID NO: 4731714 - DNA, 13 bp, Homo sapiens
gaggaaggaaacc

SEQ ID NO: 4731715 - DNA, 22 bp, Homo sapiens
gaggaaggaaacccagctctgg

SEQ ID NO: 4731716 - DNA, 19 bp, Homo sapiens
gaggaatttataacaaata

SEQ ID NO: 4731717 - DNA, 17 bp, Homo sapiens
gaggacaaaataaagtg

SEQ ID NO: 4731718 - DNA, 21 bp, Homo sapiens
gaggacaaaataaagtgtgtg

SEQ ID NO: 4731719 - DNA, 23 bp, Homo sapiens
gaggacaaaataaagtgtgtgtg

SEQ ID NO: 4731720 - DNA, 17 bp, Homo sapiens
gaggacaagaccctctc

SEQ ID NO: 4731721 - DNA, 22 bp, Homo sapiens
gaggacagggaggtgaccccag

SEQ ID NO: 4731722 - DNA, 23 bp, Homo sapiens
gaggacagggaggtgaccccagg

SEQ ID NO: 4731723 - DNA, 23 bp, Homo sapiens
gaggacttttctttgtggcttcc

SEQ ID NO: 4731724 - DNA, 22 bp, Homo sapiens
gaggagaaaagtgacagatcct

SEQ ID NO: 4731725 - DNA, 15 bp, Homo sapiens
gaggagacaggaagc

SEQ ID NO: 4731726 - DNA, 17 bp, Homo sapiens
gaggagatgctccttgg

SEQ ID NO: 4731727 - DNA, 16 bp, Homo sapiens
gaggagcaaaggctga

SEQ ID NO: 4731728 - DNA, 12 bp, Homo sapiens
gaggagcccagg

SEQ ID NO: 4731729 - DNA, 18 bp, Homo sapiens
gaggagctcaggacacta

SEQ ID NO: 4731730 - DNA, 18 bp, Homo sapiens
gaggaggctccagagggc

SEQ ID NO: 4731731 - DNA, 21 bp, Homo sapiens
gaggagggtcggtgccttcaa

SEQ ID NO: 4731732 - DNA, 23 bp, Homo sapiens
gaggagtggttgggctgtgcctg

SEQ ID NO: 4731733 - DNA, 19 bp, Homo sapiens
gaggatcacagtgctgaga

SEQ ID NO: 4731734 - DNA, 14 bp, Homo sapiens
gaggatgagagccc

SEQ ID NO: 4731735 - DNA, 18 bp, Homo sapiens
gaggatgagagcccagag

SEQ ID NO: 4731736 - DNA, 12 bp, Homo sapiens
gaggatgttctg

SEQ ID NO: 4731737 - DNA, 17 bp, Homo sapiens
gaggatgttctgggaca

SEQ ID NO: 4731738 - DNA, 20 bp, Homo sapiens
gaggatgttctgggacacag

SEQ ID NO: 4731739 - DNA, 20 bp, Homo sapiens
gaggcaagccatggagtgag

SEQ ID NO: 4731740 - DNA, 13 bp, Homo sapiens
gaggcagcagtgt

SEQ ID NO: 4731741 - DNA, 23 bp, Homo sapiens
gaggcagggaacatggggaggag

SEQ ID NO: 4731742 - DNA, 14 bp, Homo sapiens
gaggcagggtctca

SEQ ID NO: 4731743 - DNA, 19 bp, Homo sapiens
gaggcagggtctcactctg

SEQ ID NO: 4731744 - DNA, 22 bp, Homo sapiens
gaggcagggtctcactctgtcg

SEQ ID NO: 4731745 - DNA, 13 bp, Homo sapiens
gaggccagccttg

SEQ ID NO: 4731746 - DNA, 12 bp, Homo sapiens
gaggccagggat

SEQ ID NO: 4731747 - DNA, 18 bp, Homo sapiens
gaggccatgggcctcctg

SEQ ID NO: 4731748 - DNA, 20 bp, Homo sapiens
gaggccatgggcctcctgtg

SEQ ID NO: 4731749 - DNA, 14 bp, Homo sapiens
gaggcccagagggc

SEQ ID NO: 4731750 - DNA, 19 bp, Homo sapiens
gaggcccagagggcctgca

SEQ ID NO: 4731751 - DNA, 19 bp, Homo sapiens
gaggccctccacacctgcg

SEQ ID NO: 4731752 - DNA, 21 bp, Homo sapiens
gaggccctccacacctgcggc

SEQ ID NO: 4731753 - DNA, 17 bp, Homo sapiens
gaggccctcgctgccag

SEQ ID NO: 4731754 - DNA, 20 bp, Homo sapiens
gaggcccttctctccagccc

SEQ ID NO: 4731755 - DNA, 21 bp, Homo sapiens
gaggccgagtctgtcctggaa

SEQ ID NO: 4731756 - DNA, 18 bp, Homo sapiens
gaggcctactcttccatc

SEQ ID NO: 4731757 - DNA, 20 bp, Homo sapiens
gaggcctgagcgctcctgcc

SEQ ID NO: 4731758 - DNA, 19 bp, Homo sapiens
gaggcctgcctccagggct

SEQ ID NO: 4731759 - DNA, 20 bp, Homo sapiens
gaggcctgcctccagggctg

SEQ ID NO: 4731760 - DNA, 12 bp, Homo sapiens
gaggctctgccc

SEQ ID NO: 4731761 - DNA, 13 bp, Homo sapiens
gaggctctgccct

SEQ ID NO: 4731762 - DNA, 15 bp, Homo sapiens
gaggctctgcccttg

SEQ ID NO: 4731763 - DNA, 17 bp, Homo sapiens
gaggctctgcccttggt

SEQ ID NO: 4731764 - DNA, 16 bp, Homo sapiens
gaggctggctggggcc

SEQ ID NO: 4731765 - DNA, 15 bp, Homo sapiens
gaggctgggctccct

SEQ ID NO: 4731766 - DNA, 16 bp, Homo sapiens
gagggaaactgtgaat

SEQ ID NO: 4731767 - DNA, 22 bp, Homo sapiens
gagggaaactgtgaatgcttct

SEQ ID NO: 4731768 - DNA, 23 bp, Homo sapiens
gagggaaactgtgaatgcttctg

SEQ ID NO: 4731769 - DNA, 23 bp, Homo sapiens
gagggacgcctgggggtgccagg

SEQ ID NO: 4731770 - DNA, 18 bp, Homo sapiens
gagggagagaactgagca

SEQ ID NO: 4731771 - DNA, 14 bp, Homo sapiens
gagggagggagggc

SEQ ID NO: 4731772 - DNA, 20 bp, Homo sapiens
gagggagggggaaggcaggg

SEQ ID NO: 4731773 - DNA, 13 bp, Homo sapiens
gagggagtgacag

SEQ ID NO: 4731774 - DNA, 21 bp, Homo sapiens
gagggagtgacagaggcagcc

SEQ ID NO: 4731775 - DNA, 15 bp, Homo sapiens
gagggcaccaccaag

SEQ ID NO: 4731776 - DNA, 16 bp, Homo sapiens
gagggccacatgggag

SEQ ID NO: 4731777 - DNA, 21 bp, Homo sapiens
gagggcctgcaagggagtgag

SEQ ID NO: 4731778 - DNA, 12 bp, Homo sapiens
gagggcctgggc

SEQ ID NO: 4731779 - DNA, 20 bp, Homo sapiens
gagggctagaacctggaagg

SEQ ID NO: 4731780 - DNA, 21 bp, Homo sapiens
gagggctagaacctggagagc

SEQ ID NO: 4731781 - DNA, 19 bp, Homo sapiens
gagggctagaactggagag

SEQ ID NO: 4731782 - DNA, 13 bp, Homo sapiens
gagggctccagac

SEQ ID NO: 4731783 - DNA, 14 bp, Homo sapiens
gaggggacgcaggc

SEQ ID NO: 4731784 - DNA, 16 bp, Homo sapiens
gaggggacgcaggccc

SEQ ID NO: 4731785 - DNA, 15 bp, Homo sapiens
gaggggcaggccctg

SEQ ID NO: 4731786 - DNA, 21 bp, Homo sapiens
gaggggcccgttgtctccctg

SEQ ID NO: 4731787 - DNA, 22 bp, Homo sapiens
gaggggcctcttatgggctggg

SEQ ID NO: 4731788 - DNA, 13 bp, Homo sapiens
gaggggcctgcca

SEQ ID NO: 4731789 - DNA, 21 bp, Homo sapiens
gaggggcctgccacctggacc

SEQ ID NO: 4731790 - DNA, 19 bp, Homo sapiens
gaggggggatttccagcca

SEQ ID NO: 4731791 - DNA, 12 bp, Homo sapiens
gaggggggctgg

SEQ ID NO: 4731792 - DNA, 13 bp, Homo sapiens
gagggtctgagga

SEQ ID NO: 4731793 - DNA, 21 bp, Homo sapiens
gagggtggtgacctctgcctg

SEQ ID NO: 4731794 - DNA, 20 bp, Homo sapiens
gagggtggttcaacaaagaa

SEQ ID NO: 4731795 - DNA, 15 bp, Homo sapiens
gaggtaacagaacag

SEQ ID NO: 4731796 - DNA, 16 bp, Homo sapiens
gaggtaacagaacagc

SEQ ID NO: 4731797 - DNA, 17 bp, Homo sapiens
gaggtcagagcctgcag

SEQ ID NO: 4731798 - DNA, 20 bp, Homo sapiens
gaggtcagagcctgcagtta

SEQ ID NO: 4731799 - DNA, 19 bp, Homo sapiens
gaggtccagccctggctga

SEQ ID NO: 4731800 - DNA, 16 bp, Homo sapiens
gaggtgggatcctcca

SEQ ID NO: 4731801 - DNA, 21 bp, Homo sapiens
gaggtgggatcctccaggtgc

SEQ ID NO: 4731802 - DNA, 14 bp, Homo sapiens
gaggttccctttga

SEQ ID NO: 4731803 - DNA, 14 bp, Homo sapiens
gaccatccctgaag

SEQ ID NO: 4731804 - DNA, 18 bp, Homo sapiens
gaccatccctgaaggccc

SEQ ID NO: 4731805 - DNA, 20 bp, Homo sapiens
gaccatgtgattatggacat

SEQ ID NO: 4731806 - DNA, 11 bp, Homo sapiens
gacccactgct

SEQ ID NO: 4731807 - DNA, 20 bp, Homo sapiens
gacccatgctgccctgtgag

SEQ ID NO: 4731808 - DNA, 15 bp, Homo sapiens
gaccccatctgccca

SEQ ID NO: 4731809 - DNA, 20 bp, Homo sapiens
gaccccccaccaccagccgg

SEQ ID NO: 4731810 - DNA, 23 bp, Homo sapiens
gaccccctccccccaatccctca

SEQ ID NO: 4731811 - DNA, 22 bp, Homo sapiens
gacccctcatagccctcaccct

SEQ ID NO: 4731812 - DNA, 13 bp, Homo sapiens
gacccctcctccc

SEQ ID NO: 4731813 - DNA, 16 bp, Homo sapiens
gacccctcctcccttt

SEQ ID NO: 4731814 - DNA, 16 bp, Homo sapiens
gacccctgagcttgca

SEQ ID NO: 4731815 - DNA, 11 bp, Homo sapiens
gacccctgcat

SEQ ID NO: 4731816 - DNA, 16 bp, Homo sapiens
gacccgccggatgaca

SEQ ID NO: 4731817 - DNA, 23 bp, Homo sapiens
gacccgttcatgggggagggggc

SEQ ID NO: 4731818 - DNA, 18 bp, Homo sapiens
gaccctactattcatgtt

SEQ ID NO: 4731819 - DNA, 15 bp, Homo sapiens
gaccctctcaggctg

SEQ ID NO: 4731820 - DNA, 12 bp, Homo sapiens
gaccctgaggcc

SEQ ID NO: 4731821 - DNA, 20 bp, Homo sapiens
gaccctgaggcccagagggc

SEQ ID NO: 4731822 - DNA, 21 bp, Homo sapiens
gaccctgaggcccagagggcc

SEQ ID NO: 4731823 - DNA, 23 bp, Homo sapiens
gaccctgaggcccagagggcctg

SEQ ID NO: 4731824 - DNA, 22 bp, Homo sapiens
gaccctgccctgtgggccccca

SEQ ID NO: 4731825 - DNA, 16 bp, Homo sapiens
gaccctgtggagaaat

SEQ ID NO: 4731826 - DNA, 19 bp, Homo sapiens
gacccttgtggtcccaccc

SEQ ID NO: 4731827 - DNA, 20 bp, Homo sapiens
gacctaaaatttgccctccc

SEQ ID NO: 4731828 - DNA, 22 bp, Homo sapiens
gacctcaggtaatcgacctgcc

SEQ ID NO: 4731829 - DNA, 21 bp, Homo sapiens
gacctcaggtgatccacccac

SEQ ID NO: 4731830 - DNA, 12 bp, Homo sapiens
gacctcctgcct

SEQ ID NO: 4731831 - DNA, 13 bp, Homo sapiens
gacctctgcctga

SEQ ID NO: 4731832 - DNA, 14 bp, Homo sapiens
gacctgaggccctt

SEQ ID NO: 4731833 - DNA, 15 bp, Homo sapiens
gacctgaggcccttc

SEQ ID NO: 4731834 - DNA, 18 bp, Homo sapiens
gacctgaggcccttctct

SEQ ID NO: 4731835 - DNA, 14 bp, Homo sapiens
gacctgatgacctg

SEQ ID NO: 4731836 - DNA, 11 bp, Homo sapiens
gacctgcctcc

SEQ ID NO: 4731837 - DNA, 15 bp, Homo sapiens
gacctgcctcggcct

SEQ ID NO: 4731838 - DNA, 12 bp, Homo sapiens
gacctgctctgg

SEQ ID NO: 4731839 - DNA, 16 bp, Homo sapiens
gacctggcaaggacac

SEQ ID NO: 4731840 - DNA, 22 bp, Homo sapiens
gacctggtgctgcctctacctg

SEQ ID NO: 4731841 - DNA, 16 bp, Homo sapiens
gaccttcaccaaacat

SEQ ID NO: 4731842 - DNA, 19 bp, Homo sapiens
gaccttcaccaaacatact

SEQ ID NO: 4731843 - DNA, 23 bp, Homo sapiens
gaccttctaggacgccacccagc

SEQ ID NO: 4731844 - DNA, 14 bp, Homo sapiens
gaccttctccttca

SEQ ID NO: 4731845 - DNA, 20 bp, Homo sapiens
gaccttctccttcacctttg

SEQ ID NO: 4731846 - DNA, 23 bp, Homo sapiens
gaccttgaactgggtacttgtgg

SEQ ID NO: 4731847 - DNA, 12 bp, Homo sapiens
gacgcagcctga

SEQ ID NO: 4731848 - DNA, 15 bp, Homo sapiens
gacgcagcctgagaa

SEQ ID NO: 4731849 - DNA, 14 bp, Homo sapiens
gacgcaggcccctc

SEQ ID NO: 4731850 - DNA, 19 bp, Homo sapiens
gacgcaggcccctctcctc

SEQ ID NO: 4731851 - DNA, 16 bp, Homo sapiens
gacgccatcccagccc

SEQ ID NO: 4731852 - DNA, 19 bp, Homo sapiens
gacgcctgggggtgccagg

SEQ ID NO: 4731853 - DNA, 17 bp, Homo sapiens
gacgctgtgctgccctg

SEQ ID NO: 4731854 - DNA, 22 bp, Homo sapiens
gacgctgtgctgccctgcccac

SEQ ID NO: 4731855 - DNA, 14 bp, Homo sapiens
gacggagtcccacc

SEQ ID NO: 4731856 - DNA, 18 bp, Homo sapiens
gacggagtcccaccttgg

SEQ ID NO: 4731857 - DNA, 16 bp, Homo sapiens
gacggctgagctgggc

SEQ ID NO: 4731858 - DNA, 13 bp, Homo sapiens
gactacaggcacc

SEQ ID NO: 4731859 - DNA, 15 bp, Homo sapiens
gactacaggcaccca

SEQ ID NO: 4731860 - DNA, 21 bp, Homo sapiens
gactacaggtgtgagtcacca

SEQ ID NO: 4731861 - DNA, 16 bp, Homo sapiens
gactagaacctggagg

SEQ ID NO: 4731862 - DNA, 20 bp, Homo sapiens
gactagcactagacatgtca

SEQ ID NO: 4731863 - DNA, 23 bp, Homo sapiens
gactagcactagacatgtcatgg

SEQ ID NO: 4731864 - DNA, 23 bp, Homo sapiens
gactagggaaatgatcagttttt

SEQ ID NO: 4731865 - DNA, 16 bp, Homo sapiens
gactagggtcctgggg

SEQ ID NO: 4731866 - DNA, 19 bp, Homo sapiens
gactatgcgtttttataaa

SEQ ID NO: 4731867 - DNA, 18 bp, Homo sapiens
gactcagctccccagagt

SEQ ID NO: 4731868 - DNA, 14 bp, Homo sapiens
gactcaggaacttt

SEQ ID NO: 4731869 - DNA, 12 bp, Homo sapiens
gactcagggctc

SEQ ID NO: 4731870 - DNA, 16 bp, Homo sapiens
gactcattctgaagga

SEQ ID NO: 4731871 - DNA, 17 bp, Homo sapiens
gactcattctgaaggag

SEQ ID NO: 4731872 - DNA, 14 bp, Homo sapiens
gactccagctgtga

SEQ ID NO: 4731873 - DNA, 16 bp, Homo sapiens
gactccaggaagaagg

SEQ ID NO: 4731874 - DNA, 23 bp, Homo sapiens
gactcctaggcaggacatgctga

SEQ ID NO: 4731875 - DNA, 15 bp, Homo sapiens
gactcctgcaggcag

SEQ ID NO: 4731876 - DNA, 17 bp, Homo sapiens
gactcctgcaggcagcc

SEQ ID NO: 4731877 - DNA, 19 bp, Homo sapiens
gactcgggctcctgtgccc

SEQ ID NO: 4731878 - DNA, 14 bp, Homo sapiens
gactctaaaatatg

SEQ ID NO: 4731879 - DNA, 20 bp, Homo sapiens
gactctcagtctctgagcag

SEQ ID NO: 4731880 - DNA, 13 bp, Homo sapiens
gactctgcagcct

SEQ ID NO: 4731881 - DNA, 16 bp, Homo sapiens
gactctgcagcctcag

SEQ ID NO: 4731882 - DNA, 12 bp, Homo sapiens
gactctgtctca

SEQ ID NO: 4731883 - DNA, 21 bp, Homo sapiens
gactctttttgtacctggtga

SEQ ID NO: 4731884 - DNA, 22 bp, Homo sapiens
gactggtgttatcaccgtgggc

SEQ ID NO: 4731885 - DNA, 18 bp, Homo sapiens
gactgttcaagagcacac

SEQ ID NO: 4731886 - DNA, 14 bp, Homo sapiens
gactgttcctgtct

SEQ ID NO: 4731887 - DNA, 16 bp, Homo sapiens
gacttaatagaaacat

SEQ ID NO: 4731888 - DNA, 19 bp, Homo sapiens
gacttcaggggctgcccgc

SEQ ID NO: 4731889 - DNA, 20 bp, Homo sapiens
gacttcaggggctgcccgct

SEQ ID NO: 4731890 - DNA, 21 bp, Homo sapiens
gacttcaggggctgcccgctc

SEQ ID NO: 4731891 - DNA, 16 bp, Homo sapiens
gacttctatcctgtta

SEQ ID NO: 4731892 - DNA, 16 bp, Homo sapiens
gacttgacagaacact

SEQ ID NO: 4731893 - DNA, 13 bp, Homo sapiens
gacttggaagctc

SEQ ID NO: 4731894 - DNA, 15 bp, Homo sapiens
gacttggggcctctg

SEQ ID NO: 4731895 - DNA, 23 bp, Homo sapiens
gacttgtatagcatgaaataaaa

SEQ ID NO: 4731896 - DNA, 13 bp, Homo sapiens
gactttactgggt

SEQ ID NO: 4731897 - DNA, 16 bp, Homo sapiens
gagaaaggttgaagca

SEQ ID NO: 4731898 - DNA, 22 bp, Homo sapiens
gagaaagtacttctccaccctg

SEQ ID NO: 4731899 - DNA, 23 bp, Homo sapiens
gagaaagtacttctccaccctgc

SEQ ID NO: 4731900 - DNA, 19 bp, Homo sapiens
gagaacatggtgtgtgtct

SEQ ID NO: 4731901 - DNA, 19 bp, Homo sapiens
gagaactagaacctggagg

SEQ ID NO: 4731902 - DNA, 22 bp, Homo sapiens
gagaagccacaggcctgagatt

SEQ ID NO: 4731903 - DNA, 19 bp, Homo sapiens
gagaagctaaaacctgagc

SEQ ID NO: 4731904 - DNA, 20 bp, Homo sapiens
gagaagctaaaacctgagct

SEQ ID NO: 4731905 - DNA, 20 bp, Homo sapiens
gagaagtggggaccccaccc

SEQ ID NO: 4731906 - DNA, 15 bp, Homo sapiens
gagaatgaaagggcc

SEQ ID NO: 4731907 - DNA, 16 bp, Homo sapiens
gagaatgtaagaacta

SEQ ID NO: 4731908 - DNA, 15 bp, Homo sapiens
gagaattaaactcct

SEQ ID NO: 4731909 - DNA, 20 bp, Homo sapiens
gagacactgttgataaaaac

SEQ ID NO: 4731910 - DNA, 12 bp, Homo sapiens
gagacagcccgg

SEQ ID NO: 4731911 - DNA, 19 bp, Homo sapiens
gagacagcccgggctctgc

SEQ ID NO: 4731912 - DNA, 20 bp, Homo sapiens
gagacagcccgggctctgcc

SEQ ID NO: 4731913 - DNA, 22 bp, Homo sapiens
gagacagcccgggctctgcctc

SEQ ID NO: 4731914 - DNA, 16 bp, Homo sapiens
gaatgtcattatttga

SEQ ID NO: 4731915 - DNA, 15 bp, Homo sapiens
gaatgtttgcctctg

SEQ ID NO: 4731916 - DNA, 16 bp, Homo sapiens
gaatgtttgcctctgc

SEQ ID NO: 4731917 - DNA, 18 bp, Homo sapiens
gaatgtttgcctctgcct

SEQ ID NO: 4731918 - DNA, 19 bp, Homo sapiens
gaatgtttgcctctgcctc

SEQ ID NO: 4731919 - DNA, 22 bp, Homo sapiens
gaattaaactcctactgcttcc

SEQ ID NO: 4731920 - DNA, 17 bp, Homo sapiens
gaattacatatgaaaaa

SEQ ID NO: 4731921 - DNA, 21 bp, Homo sapiens
gaattactgaaaaaggtgatt

SEQ ID NO: 4731922 - DNA, 14 bp, Homo sapiens
gaattattttgtta

SEQ ID NO: 4731923 - DNA, 17 bp, Homo sapiens
gaattcggtgtgcacca

SEQ ID NO: 4731924 - DNA, 23 bp, Homo sapiens
gaattctaattgtcagtgatttt

SEQ ID NO: 4731925 - DNA, 23 bp, Homo sapiens
gaattggtcttaatgttgaatgt

SEQ ID NO: 4731926 - DNA, 13 bp, Homo sapiens
gaatttaagcatg

SEQ ID NO: 4731927 - DNA, 14 bp, Homo sapiens
gaatttagtcatta

SEQ ID NO: 4731928 - DNA, 14 bp, Homo sapiens
gaatttgactggtt

SEQ ID NO: 4731929 - DNA, 21 bp, Homo sapiens
gaatttgggatactaaagtag

SEQ ID NO: 4731930 - DNA, 18 bp, Homo sapiens
gaatttgtccattgtaaa

SEQ ID NO: 4731931 - DNA, 22 bp, Homo sapiens
gacaaaataaagtgtgtgtgca

SEQ ID NO: 4731932 - DNA, 12 bp, Homo sapiens
gacaaatgtgta

SEQ ID NO: 4731933 - DNA, 15 bp, Homo sapiens
gacaacagcctgaga

SEQ ID NO: 4731934 - DNA, 14 bp, Homo sapiens
gacaagaccctctc

SEQ ID NO: 4731935 - DNA, 17 bp, Homo sapiens
gacaagaccctctcagg

SEQ ID NO: 4731936 - DNA, 14 bp, Homo sapiens
gacaagagtgagac

SEQ ID NO: 4731937 - DNA, 16 bp, Homo sapiens
gacaaggaaaaaataa

SEQ ID NO: 4731938 - DNA, 21 bp, Homo sapiens
gacaaggatgatctaggaaga

SEQ ID NO: 4731939 - DNA, 19 bp, Homo sapiens
gacaaggattgctactgtc

SEQ ID NO: 4731940 - DNA, 17 bp, Homo sapiens
gacaatgcgtggcacat

SEQ ID NO: 4731941 - DNA, 17 bp, Homo sapiens
gacacaaacctgcctgg

SEQ ID NO: 4731942 - DNA, 23 bp, Homo sapiens
gacacaatgttgcactgaaaacc

SEQ ID NO: 4731943 - DNA, 19 bp, Homo sapiens
gacacacagaaatgtgtca

SEQ ID NO: 4731944 - DNA, 12 bp, Homo sapiens
gacacagctctt

SEQ ID NO: 4731945 - DNA, 14 bp, Homo sapiens
gacacagctcttct

SEQ ID NO: 4731946 - DNA, 20 bp, Homo sapiens
gacacaggatgaaggcaatg

SEQ ID NO: 4731947 - DNA, 17 bp, Homo sapiens
gacacaggcccggctcc

SEQ ID NO: 4731948 - DNA, 15 bp, Homo sapiens
gacaccaaaatgaac

SEQ ID NO: 4731949 - DNA, 16 bp, Homo sapiens
gacaccaataaatgtt

SEQ ID NO: 4731950 - DNA, 17 bp, Homo sapiens
gacaccaataaatgttt

SEQ ID NO: 4731951 - DNA, 18 bp, Homo sapiens
gacaccaataaatgtttg

SEQ ID NO: 4731952 - DNA, 12 bp, Homo sapiens
gacaccagagca

SEQ ID NO: 4731953 - DNA, 15 bp, Homo sapiens
gacaccagagcagat

SEQ ID NO: 4731954 - DNA, 18 bp, Homo sapiens
gacaccagagcagatgca

SEQ ID NO: 4731955 - DNA, 19 bp, Homo sapiens
gacaccagagcagatgcag

SEQ ID NO: 4731956 - DNA, 15 bp, Homo sapiens
gacaccccccttctg

SEQ ID NO: 4731957 - DNA, 13 bp, Homo sapiens
gacaccctgtgat

SEQ ID NO: 4731958 - DNA, 23 bp, Homo sapiens
gacaccctgtgatggggccctgc

SEQ ID NO: 4731959 - DNA, 18 bp, Homo sapiens
gacaccttgacagggcac

SEQ ID NO: 4731960 - DNA, 18 bp, Homo sapiens
gacactaaccacgctgga

SEQ ID NO: 4731961 - DNA, 15 bp, Homo sapiens
gacactgagggtcac

SEQ ID NO: 4731962 - DNA, 22 bp, Homo sapiens
gacactgcacagaagacagcag

SEQ ID NO: 4731963 - DNA, 20 bp, Homo sapiens
gacactggtattcctgcctc

SEQ ID NO: 4731964 - DNA, 17 bp, Homo sapiens
gacactgttgataaaaa

SEQ ID NO: 4731965 - DNA, 17 bp, Homo sapiens
gacacttctcaggaaat

SEQ ID NO: 4731966 - DNA, 13 bp, Homo sapiens
gacagaagaaggc

SEQ ID NO: 4731967 - DNA, 22 bp, Homo sapiens
gacagaatggctatcaaaagaa

SEQ ID NO: 4731968 - DNA, 19 bp, Homo sapiens
gacagagggggtggcctcc

SEQ ID NO: 4731969 - DNA, 22 bp, Homo sapiens
gacagagggggtggcctcccaa

SEQ ID NO: 4731970 - DNA, 23 bp, Homo sapiens
gacagagggggtggcctcccaac

SEQ ID NO: 4731971 - DNA, 14 bp, Homo sapiens
gacagagtctcact

SEQ ID NO: 4731972 - DNA, 16 bp, Homo sapiens
gacagagtgagactct

SEQ ID NO: 4731973 - DNA, 22 bp, Homo sapiens
gacagagtgagactctgtctca

SEQ ID NO: 4731974 - DNA, 14 bp, Homo sapiens
gacagatatattta

SEQ ID NO: 4731975 - DNA, 15 bp, Homo sapiens
gacagatatatttaa

SEQ ID NO: 4731976 - DNA, 21 bp, Homo sapiens
gacagatctctgctttggaaa

SEQ ID NO: 4731977 - DNA, 17 bp, Homo sapiens
gacagccacggccaggc

SEQ ID NO: 4731978 - DNA, 21 bp, Homo sapiens
gacagccccctgccccgcagg

SEQ ID NO: 4731979 - DNA, 22 bp, Homo sapiens
gacagccccctgccccgcaggc

SEQ ID NO: 4731980 - DNA, 14 bp, Homo sapiens
gacagcccgggctc

SEQ ID NO: 4731981 - DNA, 18 bp, Homo sapiens
gacagcccgggctctgcc

SEQ ID NO: 4731982 - DNA, 20 bp, Homo sapiens
gacagccgggaggagcctgg

SEQ ID NO: 4731983 - DNA, 16 bp, Homo sapiens
gacagctccttctgtc

SEQ ID NO: 4731984 - DNA, 17 bp, Homo sapiens
gacagctccttctgtcc

SEQ ID NO: 4731985 - DNA, 17 bp, Homo sapiens
gacagctgcctgggatc

SEQ ID NO: 4731986 - DNA, 12 bp, Homo sapiens
gacaggaagcct

SEQ ID NO: 4731987 - DNA, 23 bp, Homo sapiens
gacaggaccagggatttccatga

SEQ ID NO: 4731988 - DNA, 21 bp, Homo sapiens
gacaggcaagcacctcctgcc

SEQ ID NO: 4731989 - DNA, 14 bp, Homo sapiens
gacaggcaatgctg

SEQ ID NO: 4731990 - DNA, 16 bp, Homo sapiens
gacaggcaatgctggc

SEQ ID NO: 4731991 - DNA, 19 bp, Homo sapiens
gacaggcaatgctggctgt

SEQ ID NO: 4731992 - DNA, 23 bp, Homo sapiens
gacaggcaatgctggctgttggc

SEQ ID NO: 4731993 - DNA, 20 bp, Homo sapiens
gacaggcatgttctctgagg

SEQ ID NO: 4731994 - DNA, 14 bp, Homo sapiens
gacaggctggtgct

SEQ ID NO: 4731995 - DNA, 16 bp, Homo sapiens
gacagggaggtgaccc

SEQ ID NO: 4731996 - DNA, 21 bp, Homo sapiens
gacagggatgagcatggagct

SEQ ID NO: 4731997 - DNA, 17 bp, Homo sapiens
gacagggtttcaccatg

SEQ ID NO: 4731998 - DNA, 20 bp, Homo sapiens
gacagggttttgccatgttg

SEQ ID NO: 4731999 - DNA, 17 bp, Homo sapiens
gacagtccagcctggag

SEQ ID NO: 4732000 - DNA, 21 bp, Homo sapiens
gacagtttcttagctttttaa

SEQ ID NO: 4732001 - DNA, 23 bp, Homo sapiens
gacagtttcttagctttttaatt

SEQ ID NO: 4732002 - DNA, 16 bp, Homo sapiens
gacataacgtttttcc

SEQ ID NO: 4732003 - DNA, 21 bp, Homo sapiens
gacataacgtttttcctttaa

SEQ ID NO: 4732004 - DNA, 13 bp, Homo sapiens
gacatattatgcc

SEQ ID NO: 4732005 - DNA, 20 bp, Homo sapiens
gacatattatgcctgaatga

SEQ ID NO: 4732006 - DNA, 16 bp, Homo sapiens
gacatcgatatgaaaa

SEQ ID NO: 4732007 - DNA, 15 bp, Homo sapiens
gacatgctgaagcca

SEQ ID NO: 4732008 - DNA, 16 bp, Homo sapiens
gacatggtctgtcctg

SEQ ID NO: 4732009 - DNA, 14 bp, Homo sapiens
gacatgtgaaacct

SEQ ID NO: 4732010 - DNA, 14 bp, Homo sapiens
gacattgcggacag

SEQ ID NO: 4732011 - DNA, 15 bp, Homo sapiens
gacattgcggacagc

SEQ ID NO: 4732012 - DNA, 23 bp, Homo sapiens
gacattgcggacagccacggcca

SEQ ID NO: 4732013 - DNA, 16 bp, Homo sapiens
gacatttatgtgttga

SEQ ID NO: 4732014 - DNA, 13 bp, Homo sapiens
gacatttctctaa

SEQ ID NO: 4732015 - DNA, 17 bp, Homo sapiens
gacattttgccaaaatt

SEQ ID NO: 4732016 - DNA, 13 bp, Homo sapiens
gaccaagggcaga

SEQ ID NO: 4732017 - DNA, 17 bp, Homo sapiens
gaccaatattgtacagt

SEQ ID NO: 4732018 - DNA, 20 bp, Homo sapiens
gaccacagcaaggcacctgc

SEQ ID NO: 4732019 - DNA, 15 bp, Homo sapiens
gaccacatagaacat

SEQ ID NO: 4732020 - DNA, 17 bp, Homo sapiens
gaccagaaacctgggag

SEQ ID NO: 4732021 - DNA, 19 bp, Homo sapiens
gaccagaaacctgggagag

SEQ ID NO: 4732022 - DNA, 22 bp, Homo sapiens
gaccagacaccttgacagggca

SEQ ID NO: 4732023 - DNA, 14 bp, Homo sapiens
gaccagcctggccc

SEQ ID NO: 4732024 - DNA, 13 bp, Homo sapiens
gaccatactaatt

SEQ ID NO: 4732025 - DNA, 22 bp, Homo sapiens
cttgtgtttttaactcaatatt

SEQ ID NO: 4732026 - DNA, 16 bp, Homo sapiens
cttgttattaccaaaa

SEQ ID NO: 4732027 - DNA, 15 bp, Homo sapiens
cttgttgtttaatgt

SEQ ID NO: 4732028 - DNA, 13 bp, Homo sapiens
ctttaaattgtgt

SEQ ID NO: 4732029 - DNA, 21 bp, Homo sapiens
ctttaactgccgtaatttaac

SEQ ID NO: 4732030 - DNA, 16 bp, Homo sapiens
ctttaccacccccaca

SEQ ID NO: 4732031 - DNA, 17 bp, Homo sapiens
ctttaccacccccacac

SEQ ID NO: 4732032 - DNA, 23 bp, Homo sapiens
ctttagcagggaagtcacttcac

SEQ ID NO: 4732033 - DNA, 15 bp, Homo sapiens
ctttaggatgtaaag

SEQ ID NO: 4732034 - DNA, 20 bp, Homo sapiens
ctttagtgatcacagcagct

SEQ ID NO: 4732035 - DNA, 13 bp, Homo sapiens
ctttagtttttgt

SEQ ID NO: 4732036 - DNA, 15 bp, Homo sapiens
ctttagtttttgtga

SEQ ID NO: 4732037 - DNA, 17 bp, Homo sapiens
ctttattaaatgtagaa

SEQ ID NO: 4732038 - DNA, 17 bp, Homo sapiens
ctttattcagaacttta

SEQ ID NO: 4732039 - DNA, 21 bp, Homo sapiens
ctttattcagaactttagtat

SEQ ID NO: 4732040 - DNA, 23 bp, Homo sapiens
ctttattgaagggtctgtttaaa

SEQ ID NO: 4732041 - DNA, 21 bp, Homo sapiens
ctttattttctataatttaaa

SEQ ID NO: 4732042 - DNA, 19 bp, Homo sapiens
ctttcaaaaccttttgaaa

SEQ ID NO: 4732043 - DNA, 21 bp, Homo sapiens
ctttcaatggtttgcaaggaa

SEQ ID NO: 4732044 - DNA, 22 bp, Homo sapiens
ctttcaatggtttgcaaggaag

SEQ ID NO: 4732045 - DNA, 17 bp, Homo sapiens
ctttcatgtaaactgtg

SEQ ID NO: 4732046 - DNA, 19 bp, Homo sapiens
ctttcatgtaaactgtgca

SEQ ID NO: 4732047 - DNA, 20 bp, Homo sapiens
ctttcatgtaaactgtgcac

SEQ ID NO: 4732048 - DNA, 17 bp, Homo sapiens
ctttcatttactgtggc

SEQ ID NO: 4732049 - DNA, 18 bp, Homo sapiens
ctttcatttactgtggct

SEQ ID NO: 4732050 - DNA, 14 bp, Homo sapiens
ctttcatttttgac

SEQ ID NO: 4732051 - DNA, 20 bp, Homo sapiens
ctttcatttttttccaggct

SEQ ID NO: 4732052 - DNA, 21 bp, Homo sapiens
ctttccacggagccactcctc

SEQ ID NO: 4732053 - DNA, 15 bp, Homo sapiens
ctttccatttggtat

SEQ ID NO: 4732054 - DNA, 21 bp, Homo sapiens
ctttcccatttcgtgtaatat

SEQ ID NO: 4732055 - DNA, 16 bp, Homo sapiens
ctttcctctttggtct

SEQ ID NO: 4732056 - DNA, 17 bp, Homo sapiens
ctttcctgaggctgggc

SEQ ID NO: 4732057 - DNA, 18 bp, Homo sapiens
ctttcgaaatttcatttt

SEQ ID NO: 4732058 - DNA, 19 bp, Homo sapiens
ctttctacagtattatgta

SEQ ID NO: 4732059 - DNA, 15 bp, Homo sapiens
ctttctacccagcga

SEQ ID NO: 4732060 - DNA, 21 bp, Homo sapiens
ctttctagtggtctttgtaag

SEQ ID NO: 4732061 - DNA, 23 bp, Homo sapiens
ctttctattttcacaattattaa

SEQ ID NO: 4732062 - DNA, 19 bp, Homo sapiens
ctttctcccctgcccccag

SEQ ID NO: 4732063 - DNA, 22 bp, Homo sapiens
ctttctcccctgcccccaggac

SEQ ID NO: 4732064 - DNA, 23 bp, Homo sapiens
ctttctcccctgcccccaggact

SEQ ID NO: 4732065 - DNA, 15 bp, Homo sapiens
ctttctcttctctgt

SEQ ID NO: 4732066 - DNA, 20 bp, Homo sapiens
ctttctcttttcctctacca

SEQ ID NO: 4732067 - DNA, 19 bp, Homo sapiens
ctttctgactctaaaatat

SEQ ID NO: 4732068 - DNA, 15 bp, Homo sapiens
ctttcttctcctgtg

SEQ ID NO: 4732069 - DNA, 14 bp, Homo sapiens
ctttctttgctgct

SEQ ID NO: 4732070 - DNA, 19 bp, Homo sapiens
ctttcttttttttttttga

SEQ ID NO: 4732071 - DNA, 23 bp, Homo sapiens
ctttgaatatgtagtatctatat

SEQ ID NO: 4732072 - DNA, 14 bp, Homo sapiens
ctttgacctgcctc

SEQ ID NO: 4732073 - DNA, 15 bp, Homo sapiens
ctttgacctgcctcc

SEQ ID NO: 4732074 - DNA, 21 bp, Homo sapiens
ctttgacgccatcccagcccc

SEQ ID NO: 4732075 - DNA, 22 bp, Homo sapiens
ctttgacgccatcccagcccca

SEQ ID NO: 4732076 - DNA, 16 bp, Homo sapiens
ctttgagcttaagaat

SEQ ID NO: 4732077 - DNA, 21 bp, Homo sapiens
ctttgagtgcagtcctgatca

SEQ ID NO: 4732078 - DNA, 13 bp, Homo sapiens
ctttgataatgtt

SEQ ID NO: 4732079 - DNA, 14 bp, Homo sapiens
ctttgataatgtta

SEQ ID NO: 4732080 - DNA, 16 bp, Homo sapiens
ctttgataatgttaaa

SEQ ID NO: 4732081 - DNA, 15 bp, Homo sapiens
ctttgatcatcatgt

SEQ ID NO: 4732082 - DNA, 13 bp, Homo sapiens
ctttgattctcct

SEQ ID NO: 4732083 - DNA, 18 bp, Homo sapiens
ctttgattctccttcagc

SEQ ID NO: 4732084 - DNA, 18 bp, Homo sapiens
ctttgccaccctcatgct

SEQ ID NO: 4732085 - DNA, 20 bp, Homo sapiens
ctttgcgcaaactttaacag

SEQ ID NO: 4732086 - DNA, 14 bp, Homo sapiens
ctttgctgctgtgg

SEQ ID NO: 4732087 - DNA, 16 bp, Homo sapiens
ctttgctgctgtggaa

SEQ ID NO: 4732088 - DNA, 12 bp, Homo sapiens
ctttggaaagac

SEQ ID NO: 4732089 - DNA, 19 bp, Homo sapiens
ctttggacagaagcagctc

SEQ ID NO: 4732090 - DNA, 20 bp, Homo sapiens
ctttggacagaagcagctct

SEQ ID NO: 4732091 - DNA, 16 bp, Homo sapiens
ctttggaccctgaggc

SEQ ID NO: 4732092 - DNA, 16 bp, Homo sapiens
ctttggagatcaagga

SEQ ID NO: 4732093 - DNA, 23 bp, Homo sapiens
ctttggagatcaaggagaggagg

SEQ ID NO: 4732094 - DNA, 13 bp, Homo sapiens
ctttggcaggtgc

SEQ ID NO: 4732095 - DNA, 24 bp, Homo sapiens
ctttggcaggtgcagcccccactg

SEQ ID NO: 4732096 - DNA, 19 bp, Homo sapiens
ctttggctattagagatca

SEQ ID NO: 4732097 - DNA, 13 bp, Homo sapiens
ctttgggaagggg

SEQ ID NO: 4732098 - DNA, 22 bp, Homo sapiens
ctttggggttcggcctgtgtcc

SEQ ID NO: 4732099 - DNA, 14 bp, Homo sapiens
ctttgggtcatttt

SEQ ID NO: 4732100 - DNA, 20 bp, Homo sapiens
ctttgggtcatttttaacta

SEQ ID NO: 4732101 - DNA, 14 bp, Homo sapiens
ctttggtccttcaa

SEQ ID NO: 4732102 - DNA, 16 bp, Homo sapiens
ctttggtctacactgt

SEQ ID NO: 4732103 - DNA, 21 bp, Homo sapiens
ctttgtaagagtgtagaagca

SEQ ID NO: 4732104 - DNA, 23 bp, Homo sapiens
ctttgtaagagtgtagaagcatt

SEQ ID NO: 4732105 - DNA, 15 bp, Homo sapiens
ctttgtatatttaca

SEQ ID NO: 4732106 - DNA, 15 bp, Homo sapiens
ctttgtccccaccgc

SEQ ID NO: 4732107 - DNA, 15 bp, Homo sapiens
ctttgtgaggaagcc

SEQ ID NO: 4732108 - DNA, 17 bp, Homo sapiens
ctttgtgcaaaagcagg

SEQ ID NO: 4732109 - DNA, 15 bp, Homo sapiens
ctttgtttctccccc

SEQ ID NO: 4732110 - DNA, 21 bp, Homo sapiens
cttttaaaaatgtagaaattc

SEQ ID NO: 4732111 - DNA, 22 bp, Homo sapiens
cttttaaaaatgtagaaattct

SEQ ID NO: 4732112 - DNA, 12 bp, Homo sapiens
cttttaccatta

SEQ ID NO: 4732113 - DNA, 16 bp, Homo sapiens
cttttaccattagcat

SEQ ID NO: 4732114 - DNA, 12 bp, Homo sapiens
cttttatacatg

SEQ ID NO: 4732115 - DNA, 17 bp, Homo sapiens
cttttatagactgattt

SEQ ID NO: 4732116 - DNA, 17 bp, Homo sapiens
cttttatttcttaaaca

SEQ ID NO: 4732117 - DNA, 15 bp, Homo sapiens
cttttcacaaataaa

SEQ ID NO: 4732118 - DNA, 18 bp, Homo sapiens
cttttcagcttctgctgg

SEQ ID NO: 4732119 - DNA, 13 bp, Homo sapiens
cttttccaaccct

SEQ ID NO: 4732120 - DNA, 23 bp, Homo sapiens
cttttccaaccctcatcaccaac

SEQ ID NO: 4732121 - DNA, 22 bp, Homo sapiens
cttttccagaaagaaaatgaat

SEQ ID NO: 4732122 - DNA, 18 bp, Homo sapiens
cttttcttgcatgaggct

SEQ ID NO: 4732123 - DNA, 15 bp, Homo sapiens
cttttgaagaacaaa

SEQ ID NO: 4732124 - DNA, 15 bp, Homo sapiens
cttttgccctttgat

SEQ ID NO: 4732125 - DNA, 18 bp, Homo sapiens
cttttgtctatgggactc

SEQ ID NO: 4732126 - DNA, 21 bp, Homo sapiens
cttttgtggttctcaataaaa

SEQ ID NO: 4732127 - DNA, 20 bp, Homo sapiens
cttttgttaggaaaaaattg

SEQ ID NO: 4732128 - DNA, 20 bp, Homo sapiens
ctttttaaaatgttggtgca

SEQ ID NO: 4732129 - DNA, 15 bp, Homo sapiens
ctttttaattgttgt

SEQ ID NO: 4732130 - DNA, 12 bp, Homo sapiens
ctttttattcat

SEQ ID NO: 4732131 - DNA, 12 bp, Homo sapiens
ctttttgcagct

SEQ ID NO: 4732132 - DNA, 23 bp, Homo sapiens
ctttttgtcgagtcaaactgtgg

SEQ ID NO: 4732133 - DNA, 16 bp, Homo sapiens
cttttttggctgctga

SEQ ID NO: 4732134 - DNA, 22 bp, Homo sapiens
cttttttggctgctgaaggctc

SEQ ID NO: 4732135 - DNA, 22 bp, Homo sapiens
ctttttttctctgcatttaaaa

SEQ ID NO: 4732136 - DNA, 20 bp, Homo sapiens
cttttttttttttgagacag

SEQ ID NO: 4732137 - DNA, 12 bp, Homo sapiens
gaaaaaattaac

SEQ ID NO: 4732138 - DNA, 19 bp, Homo sapiens
gaaaaaattgaaagaactt

SEQ ID NO: 4732139 - DNA, 12 bp, Homo sapiens
gaaaaataaaga

SEQ ID NO: 4732140 - DNA, 14 bp, Homo sapiens
gaaaaatgtaggag

SEQ ID NO: 4732141 - DNA, 17 bp, Homo sapiens
gaaaaatgtaggagact

SEQ ID NO: 4732142 - DNA, 18 bp, Homo sapiens
gaaaaatgtgaaaaaaat

SEQ ID NO: 4732143 - DNA, 12 bp, Homo sapiens
gaaaacaaggaa

SEQ ID NO: 4732144 - DNA, 14 bp, Homo sapiens
gaaaacaaggaagt

SEQ ID NO: 4732145 - DNA, 16 bp, Homo sapiens
gaaaacaattgttctg

SEQ ID NO: 4732146 - DNA, 22 bp, Homo sapiens
gaaaacaattgttctgggtgat

SEQ ID NO: 4732147 - DNA, 18 bp, Homo sapiens
gaaaacactgttctctgc

SEQ ID NO: 4732148 - DNA, 21 bp, Homo sapiens
gaaaacactgttctctgccct

SEQ ID NO: 4732149 - DNA, 17 bp, Homo sapiens
gaaaacattgatgaatg

SEQ ID NO: 4732150 - DNA, 18 bp, Homo sapiens
gaaaacattgatgaatga

SEQ ID NO: 4732151 - DNA, 19 bp, Homo sapiens
gaaaagctattagccagga

SEQ ID NO: 4732152 - DNA, 22 bp, Homo sapiens
gaaaagctattagccaggatca

SEQ ID NO: 4732153 - DNA, 19 bp, Homo sapiens
gaaaagctgctgacagtgt

SEQ ID NO: 4732154 - DNA, 18 bp, Homo sapiens
gaaaagggaactgaacat

SEQ ID NO: 4732155 - DNA, 16 bp, Homo sapiens
gaaaaggggagagaag

SEQ ID NO: 4732156 - DNA, 17 bp, Homo sapiens
gaaaaggttttattttg

SEQ ID NO: 4732157 - DNA, 18 bp, Homo sapiens
gaaaaggttttattttgt

SEQ ID NO: 4732158 - DNA, 12 bp, Homo sapiens
gaaaataaagaa

SEQ ID NO: 4732159 - DNA, 13 bp, Homo sapiens
gaaaataaagaat

SEQ ID NO: 4732160 - DNA, 19 bp, Homo sapiens
gaaaataacaataaaagac

SEQ ID NO: 4732161 - DNA, 18 bp, Homo sapiens
gaaaataattctctatta

SEQ ID NO: 4732162 - DNA, 20 bp, Homo sapiens
gaaaatagggtccttgaaac

SEQ ID NO: 4732163 - DNA, 16 bp, Homo sapiens
gaaaatagttattcag

SEQ ID NO: 4732164 - DNA, 14 bp, Homo sapiens
gaaaatgaaatgca

SEQ ID NO: 4732165 - DNA, 17 bp, Homo sapiens
gaaaatgaaatgcatat

SEQ ID NO: 4732166 - DNA, 12 bp, Homo sapiens
gaaaatgaattt

SEQ ID NO: 4732167 - DNA, 17 bp, Homo sapiens
gaaaatgaatttgactg

SEQ ID NO: 4732168 - DNA, 18 bp, Homo sapiens
gaaaatggtccaggagaa

SEQ ID NO: 4732169 - DNA, 21 bp, Homo sapiens
gaaaatgtgtctgcaacatgg

SEQ ID NO: 4732170 - DNA, 22 bp, Homo sapiens
gaaaatgtgtctgcaacatgga

SEQ ID NO: 4732171 - DNA, 15 bp, Homo sapiens
gaaaatgtgtgtgtg

SEQ ID NO: 4732172 - DNA, 18 bp, Homo sapiens
gaaaattcactattggct

SEQ ID NO: 4732173 - DNA, 21 bp, Homo sapiens
gaaacaaaaaacaccaaaaat

SEQ ID NO: 4732174 - DNA, 12 bp, Homo sapiens
gaaacaaagatg

SEQ ID NO: 4732175 - DNA, 15 bp, Homo sapiens
gaaacacttctattt

SEQ ID NO: 4732176 - DNA, 15 bp, Homo sapiens
gaaaccacagctgct

SEQ ID NO: 4732177 - DNA, 17 bp, Homo sapiens
gaaaccaggacattaaa

SEQ ID NO: 4732178 - DNA, 15 bp, Homo sapiens
gaaacccagctctgg

SEQ ID NO: 4732179 - DNA, 14 bp, Homo sapiens
gaaaccgtccctga

SEQ ID NO: 4732180 - DNA, 20 bp, Homo sapiens
gaaaccttttttaagatttt

SEQ ID NO: 4732181 - DNA, 21 bp, Homo sapiens
gaaaccttttttaagattttt

SEQ ID NO: 4732182 - DNA, 21 bp, Homo sapiens
gaaactccaccttgcggggat

SEQ ID NO: 4732183 - DNA, 13 bp, Homo sapiens
gaaactgtgaatg

SEQ ID NO: 4732184 - DNA, 16 bp, Homo sapiens
gaaactgtgaatgctt

SEQ ID NO: 4732185 - DNA, 22 bp, Homo sapiens
gaaactgtgaatgcttctgatt

SEQ ID NO: 4732186 - DNA, 22 bp, Homo sapiens
gaaagaactgtcatgtaaacat

SEQ ID NO: 4732187 - DNA, 18 bp, Homo sapiens
gaaagaagtggggacaga

SEQ ID NO: 4732188 - DNA, 13 bp, Homo sapiens
gaaagaatagaac

SEQ ID NO: 4732189 - DNA, 15 bp, Homo sapiens
gaaagagaaggtggg

SEQ ID NO: 4732190 - DNA, 17 bp, Homo sapiens
gaaagataataaattga

SEQ ID NO: 4732191 - DNA, 12 bp, Homo sapiens
gaaaggctccag

SEQ ID NO: 4732192 - DNA, 15 bp, Homo sapiens
gaaaggctccaggag

SEQ ID NO: 4732193 - DNA, 16 bp, Homo sapiens
gaaaggctccaggagc

SEQ ID NO: 4732194 - DNA, 20 bp, Homo sapiens
gaaaggctccaggagcagcc

SEQ ID NO: 4732195 - DNA, 15 bp, Homo sapiens
gaaagggcccagaga

SEQ ID NO: 4732196 - DNA, 16 bp, Homo sapiens
gaaagtaagaaaacaa

SEQ ID NO: 4732197 - DNA, 18 bp, Homo sapiens
gaaagtgggtttcaattt

SEQ ID NO: 4732198 - DNA, 19 bp, Homo sapiens
gaaagttgcacggctgctg

SEQ ID NO: 4732199 - DNA, 20 bp, Homo sapiens
gaaagttgcacggctgctga

SEQ ID NO: 4732200 - DNA, 16 bp, Homo sapiens
gaaagttttgttctgt

SEQ ID NO: 4732201 - DNA, 16 bp, Homo sapiens
gaaataaaatatatct

SEQ ID NO: 4732202 - DNA, 19 bp, Homo sapiens
gaaataaaccaaaggaaaa

SEQ ID NO: 4732203 - DNA, 17 bp, Homo sapiens
gaaataacaatgttaag

SEQ ID NO: 4732204 - DNA, 16 bp, Homo sapiens
gaaatatcaaagtcat

SEQ ID NO: 4732205 - DNA, 16 bp, Homo sapiens
gaaatattgctggggt

SEQ ID NO: 4732206 - DNA, 17 bp, Homo sapiens
gaaatcatcaaaaagaa

SEQ ID NO: 4732207 - DNA, 18 bp, Homo sapiens
gaaatccagggtggtggt

SEQ ID NO: 4732208 - DNA, 18 bp, Homo sapiens
gaaatgaggtcagagcct

SEQ ID NO: 4732209 - DNA, 14 bp, Homo sapiens
gaaatgatcagttt

SEQ ID NO: 4732210 - DNA, 20 bp, Homo sapiens
gaaatgcttatgcttgtgta

SEQ ID NO: 4732211 - DNA, 20 bp, Homo sapiens
gaaatggcttttcccaaccc

SEQ ID NO: 4732212 - DNA, 20 bp, Homo sapiens
gaaatgggcagagcagagac

SEQ ID NO: 4732213 - DNA, 18 bp, Homo sapiens
gaaattacctgtggatat

SEQ ID NO: 4732214 - DNA, 17 bp, Homo sapiens
gaaattcccttcatctg

SEQ ID NO: 4732215 - DNA, 18 bp, Homo sapiens
gaacaagcttcagtaagt

SEQ ID NO: 4732216 - DNA, 19 bp, Homo sapiens
gaacaatcacaaaagctgt

SEQ ID NO: 4732217 - DNA, 23 bp, Homo sapiens
gaacacaatacatgttttcactt

SEQ ID NO: 4732218 - DNA, 23 bp, Homo sapiens
gaacacagccaaagtaaactgtg

SEQ ID NO: 4732219 - DNA, 14 bp, Homo sapiens
gaacacatggcaga

SEQ ID NO: 4732220 - DNA, 16 bp, Homo sapiens
gaacagcttcaggtta

SEQ ID NO: 4732221 - DNA, 17 bp, Homo sapiens
gaacagcttcaggttat

SEQ ID NO: 4732222 - DNA, 17 bp, Homo sapiens
gaacagtctctggaaga

SEQ ID NO: 4732223 - DNA, 15 bp, Homo sapiens
gaacagtttggatgt

SEQ ID NO: 4732224 - DNA, 13 bp, Homo sapiens
gaacatacttggt

SEQ ID NO: 4732225 - DNA, 19 bp, Homo sapiens
gaacatatcatttgtgaag

SEQ ID NO: 4732226 - DNA, 20 bp, Homo sapiens
gaacatatcatttgtgaaga

SEQ ID NO: 4732227 - DNA, 21 bp, Homo sapiens
gaacatatcatttgtgaagaa

SEQ ID NO: 4732228 - DNA, 22 bp, Homo sapiens
gaacatatcatttgtgaagaat

SEQ ID NO: 4732229 - DNA, 15 bp, Homo sapiens
gaacatggagagcta

SEQ ID NO: 4732230 - DNA, 17 bp, Homo sapiens
gaacattgcaatagaaa

SEQ ID NO: 4732231 - DNA, 18 bp, Homo sapiens
gaaccacatcttgctctg

SEQ ID NO: 4732232 - DNA, 21 bp, Homo sapiens
gaaccacatcttgctctgctg

SEQ ID NO: 4732233 - DNA, 17 bp, Homo sapiens
gaaccaccacacccagc

SEQ ID NO: 4732234 - DNA, 12 bp, Homo sapiens
gaaccatcagaa

SEQ ID NO: 4732235 - DNA, 19 bp, Homo sapiens
gaaccatttgcaatatgga

SEQ ID NO: 4732236 - DNA, 16 bp, Homo sapiens
gaacctgatgaaaata

SEQ ID NO: 4732237 - DNA, 12 bp, Homo sapiens
gaacctggagag

SEQ ID NO: 4732238 - DNA, 15 bp, Homo sapiens
gaacctggagggcta

SEQ ID NO: 4732239 - DNA, 15 bp, Homo sapiens
gaacctgtagagcta

SEQ ID NO: 4732240 - DNA, 16 bp, Homo sapiens
gaacgaaaatgaaagc

SEQ ID NO: 4732241 - DNA, 12 bp, Homo sapiens
gaacgtttttcc

SEQ ID NO: 4732242 - DNA, 15 bp, Homo sapiens
gaacgtttttcctgt

SEQ ID NO: 4732243 - DNA, 22 bp, Homo sapiens
gaactacaaacaaaatttctat

SEQ ID NO: 4732244 - DNA, 23 bp, Homo sapiens
gaactacaaacaaaatttctatt

SEQ ID NO: 4732245 - DNA, 19 bp, Homo sapiens
gaactaccttggttccccc

SEQ ID NO: 4732246 - DNA, 20 bp, Homo sapiens
gaactaccttggttccccca

SEQ ID NO: 4732247 - DNA, 13 bp, Homo sapiens
gaactcctgacct

SEQ ID NO: 4732248 - DNA, 15 bp, Homo sapiens
gaactgagcatctcc

SEQ ID NO: 4732249 - DNA, 18 bp, Homo sapiens
gaactgagcatctccagc

SEQ ID NO: 4732250 - DNA, 19 bp, Homo sapiens
gaacttaagtctcgaatgt

SEQ ID NO: 4732251 - DNA, 13 bp, Homo sapiens
gaactttcatttt

SEQ ID NO: 4732252 - DNA, 23 bp, Homo sapiens
gaactttcatttttttccaggct

SEQ ID NO: 4732253 - DNA, 19 bp, Homo sapiens
gaactttgctgagcctgta

SEQ ID NO: 4732254 - DNA, 17 bp, Homo sapiens
gaagaaagagaaggagc

SEQ ID NO: 4732255 - DNA, 23 bp, Homo sapiens
gaagaacggggctcttctcattt

SEQ ID NO: 4732256 - DNA, 14 bp, Homo sapiens
gaagaagagaggca

SEQ ID NO: 4732257 - DNA, 20 bp, Homo sapiens
gaagaatctgtttcccagca

SEQ ID NO: 4732258 - DNA, 14 bp, Homo sapiens
gaagaatgtctgta

SEQ ID NO: 4732259 - DNA, 21 bp, Homo sapiens
gaagaattattcagtgaattt

SEQ ID NO: 4732260 - DNA, 17 bp, Homo sapiens
gaagacaccagagcaga

SEQ ID NO: 4732261 - DNA, 18 bp, Homo sapiens
gaagactcattcttctgt

SEQ ID NO: 4732262 - DNA, 19 bp, Homo sapiens
gaagactcattcttctgta

SEQ ID NO: 4732263 - DNA, 11 bp, Homo sapiens
gaagactttgg

SEQ ID NO: 4732264 - DNA, 13 bp, Homo sapiens
gaagagcacagcc

SEQ ID NO: 4732265 - DNA, 14 bp, Homo sapiens
gaagagcacagccc

SEQ ID NO: 4732266 - DNA, 20 bp, Homo sapiens
gaagagcacagccctcccgc

SEQ ID NO: 4732267 - DNA, 21 bp, Homo sapiens
gaagatgtatgctttgaatgc

SEQ ID NO: 4732268 - DNA, 17 bp, Homo sapiens
gaagattctatgttaat

SEQ ID NO: 4732269 - DNA, 20 bp, Homo sapiens
gaagattctatgttaatatt

SEQ ID NO: 4732270 - DNA, 23 bp, Homo sapiens
gaagattctatgttaatatttta

SEQ ID NO: 4732271 - DNA, 19 bp, Homo sapiens
gaagcaggctacactgaca

SEQ ID NO: 4732272 - DNA, 16 bp, Homo sapiens
gaagccacaggcctga

SEQ ID NO: 4732273 - DNA, 13 bp, Homo sapiens
gaagcccaggaaa

SEQ ID NO: 4732274 - DNA, 15 bp, Homo sapiens
gaagcccaggaaagg

SEQ ID NO: 4732275 - DNA, 19 bp, Homo sapiens
gaagcccaggaaaggctcc

SEQ ID NO: 4732276 - DNA, 20 bp, Homo sapiens
gaagcccaggaaaggctcca

SEQ ID NO: 4732277 - DNA, 19 bp, Homo sapiens
gaagcctcaagttccagtg

SEQ ID NO: 4732278 - DNA, 22 bp, Homo sapiens
gaagctagctcccctcctctcc

SEQ ID NO: 4732279 - DNA, 14 bp, Homo sapiens
gaagctcagggcct

SEQ ID NO: 4732280 - DNA, 15 bp, Homo sapiens
gaagctcagggcctg

SEQ ID NO: 4732281 - DNA, 20 bp, Homo sapiens
gaagctcagggcctggctca

SEQ ID NO: 4732282 - DNA, 22 bp, Homo sapiens
gaagctccgctttctacccagc

SEQ ID NO: 4732283 - DNA, 19 bp, Homo sapiens
gaagctgggactcattcac

SEQ ID NO: 4732284 - DNA, 16 bp, Homo sapiens
gaagctgttgtacatt

SEQ ID NO: 4732285 - DNA, 18 bp, Homo sapiens
gaagctgttgtacattta

SEQ ID NO: 4732286 - DNA, 19 bp, Homo sapiens
gaagcttggggaagaccca

SEQ ID NO: 4732287 - DNA, 20 bp, Homo sapiens
gaaggaaaaggcagggagcg

SEQ ID NO: 4732288 - DNA, 20 bp, Homo sapiens
gaaggaaacccagctctggt

SEQ ID NO: 4732289 - DNA, 21 bp, Homo sapiens
gaaggaaacccagctctggtc

SEQ ID NO: 4732290 - DNA, 21 bp, Homo sapiens
gaaggactgtgacaggcagca

SEQ ID NO: 4732291 - DNA, 20 bp, Homo sapiens
gaaggagccccattcctggg

SEQ ID NO: 4732292 - DNA, 21 bp, Homo sapiens
gaaggagccccattcctggga

SEQ ID NO: 4732293 - DNA, 12 bp, Homo sapiens
gaaggagctgcc

SEQ ID NO: 4732294 - DNA, 16 bp, Homo sapiens
gaaggagctgcctgga

SEQ ID NO: 4732295 - DNA, 21 bp, Homo sapiens
gaaggaggtaaaggatgaggg

SEQ ID NO: 4732296 - DNA, 21 bp, Homo sapiens
gaaggatgatgtctttttatt

SEQ ID NO: 4732297 - DNA, 18 bp, Homo sapiens
gaaggcagggagggcctg

SEQ ID NO: 4732298 - DNA, 23 bp, Homo sapiens
gaaggcagggagggcctgggccc

SEQ ID NO: 4732299 - DNA, 15 bp, Homo sapiens
gaaggccccgcccag

SEQ ID NO: 4732300 - DNA, 16 bp, Homo sapiens
gaaggctcgagcatgc

SEQ ID NO: 4732301 - DNA, 18 bp, Homo sapiens
gaaggctcttctccccag

SEQ ID NO: 4732302 - DNA, 20 bp, Homo sapiens
gaaggctgggttctgatcct

SEQ ID NO: 4732303 - DNA, 20 bp, Homo sapiens
gaagggattttagtcacacg

SEQ ID NO: 4732304 - DNA, 20 bp, Homo sapiens
gaagggctagaacctggaga

SEQ ID NO: 4732305 - DNA, 22 bp, Homo sapiens
gaagggctagaacctggagagc

SEQ ID NO: 4732306 - DNA, 19 bp, Homo sapiens
gaagggctcagagaggaca

SEQ ID NO: 4732307 - DNA, 20 bp, Homo sapiens
gaagggctcagagaggacaa

SEQ ID NO: 4732308 - DNA, 13 bp, Homo sapiens
gaagggggctggg

SEQ ID NO: 4732309 - DNA, 19 bp, Homo sapiens
gaagggggctgggacatgg

SEQ ID NO: 4732310 - DNA, 12 bp, Homo sapiens
gaagggggtggt

SEQ ID NO: 4732311 - DNA, 17 bp, Homo sapiens
gaagggtggtggagcca

SEQ ID NO: 4732312 - DNA, 17 bp, Homo sapiens
gaaggtagaatgttttc

SEQ ID NO: 4732313 - DNA, 19 bp, Homo sapiens
gaaggtgatgttgccatcc

SEQ ID NO: 4732314 - DNA, 14 bp, Homo sapiens
gaagtaacagtaac

SEQ ID NO: 4732315 - DNA, 21 bp, Homo sapiens
gaagtatgtatattaaaaaag

SEQ ID NO: 4732316 - DNA, 14 bp, Homo sapiens
gaagtattgtttac

SEQ ID NO: 4732317 - DNA, 18 bp, Homo sapiens
gaagtcataccaatgaaa

SEQ ID NO: 4732318 - DNA, 15 bp, Homo sapiens
gaagtccctcagagg

SEQ ID NO: 4732319 - DNA, 18 bp, Homo sapiens
gaagtcgtcttaactcac

SEQ ID NO: 4732320 - DNA, 16 bp, Homo sapiens
gaagtgactgttgtac

SEQ ID NO: 4732321 - DNA, 15 bp, Homo sapiens
gaagtgactttggct

SEQ ID NO: 4732322 - DNA, 21 bp, Homo sapiens
gaagtgactttggctgcatgc

SEQ ID NO: 4732323 - DNA, 15 bp, Homo sapiens
gaagtggggacagag

SEQ ID NO: 4732324 - DNA, 20 bp, Homo sapiens
gaagtggggaccccacccct

SEQ ID NO: 4732325 - DNA, 21 bp, Homo sapiens
gaagtggggaccccacccctc

SEQ ID NO: 4732326 - DNA, 23 bp, Homo sapiens
gaagtggggaccccacccctcat

SEQ ID NO: 4732327 - DNA, 16 bp, Homo sapiens
gaagtgtttatgttgt

SEQ ID NO: 4732328 - DNA, 17 bp, Homo sapiens
gaataatttctgttgtt

SEQ ID NO: 4732329 - DNA, 15 bp, Homo sapiens
gaatacctgtccccc

SEQ ID NO: 4732330 - DNA, 13 bp, Homo sapiens
gaatactggtctc

SEQ ID NO: 4732331 - DNA, 14 bp, Homo sapiens
gaatactttataaa

SEQ ID NO: 4732332 - DNA, 19 bp, Homo sapiens
gaatagatatgaaagctga

SEQ ID NO: 4732333 - DNA, 13 bp, Homo sapiens
gaatagtctctgg

SEQ ID NO: 4732334 - DNA, 12 bp, Homo sapiens
gaatataatctg

SEQ ID NO: 4732335 - DNA, 23 bp, Homo sapiens
gaatatgtagtatctatatgact

SEQ ID NO: 4732336 - DNA, 15 bp, Homo sapiens
gaatattaagaaaca

SEQ ID NO: 4732337 - DNA, 21 bp, Homo sapiens
gaatattggtaattaaaagac

SEQ ID NO: 4732338 - DNA, 18 bp, Homo sapiens
gaatattgtggctccctg

SEQ ID NO: 4732339 - DNA, 19 bp, Homo sapiens
gaatcctatggaagagaat

SEQ ID NO: 4732340 - DNA, 12 bp, Homo sapiens
gaatctaccaac

SEQ ID NO: 4732341 - DNA, 15 bp, Homo sapiens
gaatcttcacctcag

SEQ ID NO: 4732342 - DNA, 16 bp, Homo sapiens
gaatcttcacctcaga

SEQ ID NO: 4732343 - DNA, 23 bp, Homo sapiens
gaatgaaccacatcttgctctgc

SEQ ID NO: 4732344 - DNA, 17 bp, Homo sapiens
gaatgactccaggaaga

SEQ ID NO: 4732345 - DNA, 11 bp, Homo sapiens
gaatgagagag

SEQ ID NO: 4732346 - DNA, 16 bp, Homo sapiens
gaatgaggaacaatca

SEQ ID NO: 4732347 - DNA, 15 bp, Homo sapiens
gaatgattcagtgtt

SEQ ID NO: 4732348 - DNA, 16 bp, Homo sapiens
gaatgcctgagtgcct

SEQ ID NO: 4732349 - DNA, 19 bp, Homo sapiens
gaatgcctgagtgcctggc

SEQ ID NO: 4732350 - DNA, 23 bp, Homo sapiens
gaatgctgcccagggtcagtgta

SEQ ID NO: 4732351 - DNA, 15 bp, Homo sapiens
gaatggaaagcttca

SEQ ID NO: 4732352 - DNA, 16 bp, Homo sapiens
gaatggagaatggtgt

SEQ ID NO: 4732353 - DNA, 16 bp, Homo sapiens
gaatggtttttgttga

SEQ ID NO: 4732354 - DNA, 13 bp, Homo sapiens
gaatgtaattgga

SEQ ID NO: 4732355 - DNA, 14 bp, Homo sapiens
gaatgtaattggaa

SEQ ID NO: 4732356 - DNA, 12 bp, Homo sapiens
gaatgtattttg

SEQ ID NO: 4732357 - DNA, 22 bp, Homo sapiens
gaatgtcagttgttatttattg

SEQ ID NO: 4732358 - DNA, 20 bp, Homo sapiens
cttatctcagtcatgcataa

SEQ ID NO: 4732359 - DNA, 21 bp, Homo sapiens
cttatctcagtcatgcataaa

SEQ ID NO: 4732360 - DNA, 21 bp, Homo sapiens
cttatctttctaaaactgcct

SEQ ID NO: 4732361 - DNA, 23 bp, Homo sapiens
cttatgtgggtcttatgcttcca

SEQ ID NO: 4732362 - DNA, 20 bp, Homo sapiens
cttattagagtgtctttcca

SEQ ID NO: 4732363 - DNA, 15 bp, Homo sapiens
cttattatagaattg

SEQ ID NO: 4732364 - DNA, 12 bp, Homo sapiens
cttattcacttt

SEQ ID NO: 4732365 - DNA, 21 bp, Homo sapiens
cttattcaggaaaagcctctg

SEQ ID NO: 4732366 - DNA, 12 bp, Homo sapiens
cttattgcccac

SEQ ID NO: 4732367 - DNA, 17 bp, Homo sapiens
cttattggatatttgat

SEQ ID NO: 4732368 - DNA, 23 bp, Homo sapiens
cttatttgtcggggaagatgaaa

SEQ ID NO: 4732369 - DNA, 14 bp, Homo sapiens
cttattttagaaat

SEQ ID NO: 4732370 - DNA, 21 bp, Homo sapiens
cttattttagaaattataatt

SEQ ID NO: 4732371 - DNA, 16 bp, Homo sapiens
cttattttaggaaatt

SEQ ID NO: 4732372 - DNA, 18 bp, Homo sapiens
cttattttaggaaattta

SEQ ID NO: 4732373 - DNA, 18 bp, Homo sapiens
cttatttttaatttttcc

SEQ ID NO: 4732374 - DNA, 14 bp, Homo sapiens
cttcaaaaactaaa

SEQ ID NO: 4732375 - DNA, 17 bp, Homo sapiens
cttcaaaaactaaaatc

SEQ ID NO: 4732376 - DNA, 20 bp, Homo sapiens
cttcaaaaactaaaatcatt

SEQ ID NO: 4732377 - DNA, 18 bp, Homo sapiens
cttcaaaatgttctattt

SEQ ID NO: 4732378 - DNA, 22 bp, Homo sapiens
cttcaatacccaaatcctctcc

SEQ ID NO: 4732379 - DNA, 14 bp, Homo sapiens
cttcacacagacac

SEQ ID NO: 4732380 - DNA, 17 bp, Homo sapiens
cttcaccatttggcaat

SEQ ID NO: 4732381 - DNA, 11 bp, Homo sapiens
cttcacctcag

SEQ ID NO: 4732382 - DNA, 12 bp, Homo sapiens
cttcacctcaga

SEQ ID NO: 4732383 - DNA, 22 bp, Homo sapiens
cttcacctttgtccccaccgca

SEQ ID NO: 4732384 - DNA, 23 bp, Homo sapiens
cttcactgtataaataggagagg

SEQ ID NO: 4732385 - DNA, 16 bp, Homo sapiens
cttcagagactcctgc

SEQ ID NO: 4732386 - DNA, 20 bp, Homo sapiens
cttcagagactcctgcaggc

SEQ ID NO: 4732387 - DNA, 15 bp, Homo sapiens
cttcagccctcaccc

SEQ ID NO: 4732388 - DNA, 17 bp, Homo sapiens
cttcagccctcacccct

SEQ ID NO: 4732389 - DNA, 17 bp, Homo sapiens
cttcaggggctgcccgc

SEQ ID NO: 4732390 - DNA, 13 bp, Homo sapiens
cttcagtggcagc

SEQ ID NO: 4732391 - DNA, 14 bp, Homo sapiens
cttcagtgtgttga

SEQ ID NO: 4732392 - DNA, 14 bp, Homo sapiens
cttcatacatccct

SEQ ID NO: 4732393 - DNA, 15 bp, Homo sapiens
cttcatctggaacca

SEQ ID NO: 4732394 - DNA, 15 bp, Homo sapiens
cttcatgcatggaaa

SEQ ID NO: 4732395 - DNA, 13 bp, Homo sapiens
cttcatgctggcc

SEQ ID NO: 4732396 - DNA, 21 bp, Homo sapiens
cttcatggcagaaggcaaacc

SEQ ID NO: 4732397 - DNA, 21 bp, Homo sapiens
cttccaaggtggtctgctcgg

SEQ ID NO: 4732398 - DNA, 18 bp, Homo sapiens
cttccactgagggcagtc

SEQ ID NO: 4732399 - DNA, 23 bp, Homo sapiens
cttccagagctctgacccacagc

SEQ ID NO: 4732400 - DNA, 15 bp, Homo sapiens
cttccaggctgggag

SEQ ID NO: 4732401 - DNA, 19 bp, Homo sapiens
cttccaggctgggagagcc

SEQ ID NO: 4732402 - DNA, 17 bp, Homo sapiens
cttccaggggtgggaca

SEQ ID NO: 4732403 - DNA, 18 bp, Homo sapiens
cttccagtgaggctctgc

SEQ ID NO: 4732404 - DNA, 19 bp, Homo sapiens
cttccagtgaggctctgcc

SEQ ID NO: 4732405 - DNA, 16 bp, Homo sapiens
cttccatccaaagaat

SEQ ID NO: 4732406 - DNA, 15 bp, Homo sapiens
cttccattaacaaat

SEQ ID NO: 4732407 - DNA, 23 bp, Homo sapiens
cttcccacctctctcactccttg

SEQ ID NO: 4732408 - DNA, 18 bp, Homo sapiens
cttcccagaggggcctgc

SEQ ID NO: 4732409 - DNA, 19 bp, Homo sapiens
cttcccagaggggcctgcc

SEQ ID NO: 4732410 - DNA, 21 bp, Homo sapiens
cttcccagaggggcctgccac

SEQ ID NO: 4732411 - DNA, 19 bp, Homo sapiens
cttcccagtggctgctgcc

SEQ ID NO: 4732412 - DNA, 15 bp, Homo sapiens
cttcccatgacccag

SEQ ID NO: 4732413 - DNA, 19 bp, Homo sapiens
cttcccatgacccaggctg

SEQ ID NO: 4732414 - DNA, 20 bp, Homo sapiens
cttcccatgacccaggctgg

SEQ ID NO: 4732415 - DNA, 13 bp, Homo sapiens
cttcccctcctac

SEQ ID NO: 4732416 - DNA, 18 bp, Homo sapiens
cttccctatctttgccac

SEQ ID NO: 4732417 - DNA, 22 bp, Homo sapiens
cttccctatctttgccaccctc

SEQ ID NO: 4732418 - DNA, 20 bp, Homo sapiens
cttccctggcgtcctctccc

SEQ ID NO: 4732419 - DNA, 15 bp, Homo sapiens
cttcccttacctcaa

SEQ ID NO: 4732420 - DNA, 13 bp, Homo sapiens
cttcctaattcca

SEQ ID NO: 4732421 - DNA, 19 bp, Homo sapiens
cttcctaattccacagctg

SEQ ID NO: 4732422 - DNA, 15 bp, Homo sapiens
cttcctcctgggccc

SEQ ID NO: 4732423 - DNA, 22 bp, Homo sapiens
cttcctcctgggccctctctgc

SEQ ID NO: 4732424 - DNA, 22 bp, Homo sapiens
cttcctggagactgcccagcta

SEQ ID NO: 4732425 - DNA, 16 bp, Homo sapiens
cttcctggagcccaga

SEQ ID NO: 4732426 - DNA, 14 bp, Homo sapiens
cttcgccacctggg

SEQ ID NO: 4732427 - DNA, 13 bp, Homo sapiens
cttcgctcctgtg

SEQ ID NO: 4732428 - DNA, 14 bp, Homo sapiens
cttcgctcctgtgt

SEQ ID NO: 4732429 - DNA, 15 bp, Homo sapiens
cttcgctcctgtgtc

SEQ ID NO: 4732430 - DNA, 16 bp, Homo sapiens
cttcgggcccttccca

SEQ ID NO: 4732431 - DNA, 17 bp, Homo sapiens
cttcgggcccttcccac

SEQ ID NO: 4732432 - DNA, 22 bp, Homo sapiens
cttcgtgggatctgcccctccc

SEQ ID NO: 4732433 - DNA, 23 bp, Homo sapiens
cttctaaataaggtgtgaaatca

SEQ ID NO: 4732434 - DNA, 16 bp, Homo sapiens
cttctaggacgccacc

SEQ ID NO: 4732435 - DNA, 22 bp, Homo sapiens
cttctaggtggcaaggctgtgc

SEQ ID NO: 4732436 - DNA, 13 bp, Homo sapiens
cttctcacattta

SEQ ID NO: 4732437 - DNA, 20 bp, Homo sapiens
cttctcacatttatattttt

SEQ ID NO: 4732438 - DNA, 11 bp, Homo sapiens
cttctcaggaa

SEQ ID NO: 4732439 - DNA, 13 bp, Homo sapiens
cttctcaggaaat

SEQ ID NO: 4732440 - DNA, 13 bp, Homo sapiens
cttctcatcactc

SEQ ID NO: 4732441 - DNA, 14 bp, Homo sapiens
cttctcatttcacc

SEQ ID NO: 4732442 - DNA, 14 bp, Homo sapiens
cttctccaccctgc

SEQ ID NO: 4732443 - DNA, 15 bp, Homo sapiens
cttctccaccctgct

SEQ ID NO: 4732444 - DNA, 16 bp, Homo sapiens
cttctccaccctgctc

SEQ ID NO: 4732445 - DNA, 17 bp, Homo sapiens
cttctccaccctgctct

SEQ ID NO: 4732446 - DNA, 21 bp, Homo sapiens
cttctccaccctgctctccga

SEQ ID NO: 4732447 - DNA, 13 bp, Homo sapiens
cttctccaggctg

SEQ ID NO: 4732448 - DNA, 17 bp, Homo sapiens
cttctccaggctgtatc

SEQ ID NO: 4732449 - DNA, 13 bp, Homo sapiens
cttctccagggtc

SEQ ID NO: 4732450 - DNA, 19 bp, Homo sapiens
cttctccatggccctgcca

SEQ ID NO: 4732451 - DNA, 18 bp, Homo sapiens
cttctcccccccggggct

SEQ ID NO: 4732452 - DNA, 20 bp, Homo sapiens
cttctcccccccggggctgg

SEQ ID NO: 4732453 - DNA, 11 bp, Homo sapiens
cttctcctgtg

SEQ ID NO: 4732454 - DNA, 12 bp, Homo sapiens
cttctcctgtga

SEQ ID NO: 4732455 - DNA, 20 bp, Homo sapiens
cttctccttagaagtggaag

SEQ ID NO: 4732456 - DNA, 22 bp, Homo sapiens
cttctccttcacctttgtcccc

SEQ ID NO: 4732457 - DNA, 16 bp, Homo sapiens
cttctctcatctctta

SEQ ID NO: 4732458 - DNA, 13 bp, Homo sapiens
cttctctccagcc

SEQ ID NO: 4732459 - DNA, 17 bp, Homo sapiens
cttctctccagcccctg

SEQ ID NO: 4732460 - DNA, 19 bp, Homo sapiens
cttctctccagcccctgga

SEQ ID NO: 4732461 - DNA, 19 bp, Homo sapiens
cttctctgagtcagctgac

SEQ ID NO: 4732462 - DNA, 13 bp, Homo sapiens
cttctgaatgaag

SEQ ID NO: 4732463 - DNA, 16 bp, Homo sapiens
cttctgacgcagcctg

SEQ ID NO: 4732464 - DNA, 18 bp, Homo sapiens
cttctgacgcagcctgag

SEQ ID NO: 4732465 - DNA, 20 bp, Homo sapiens
cttctgacgcagcctgagaa

SEQ ID NO: 4732466 - DNA, 21 bp, Homo sapiens
cttctgacgcagcctgagaat

SEQ ID NO: 4732467 - DNA, 12 bp, Homo sapiens
cttctgccactt

SEQ ID NO: 4732468 - DNA, 20 bp, Homo sapiens
cttctgccacttcccaggta

SEQ ID NO: 4732469 - DNA, 17 bp, Homo sapiens
cttctgccatattctgt

SEQ ID NO: 4732470 - DNA, 21 bp, Homo sapiens
cttctgccatattctgttggc

SEQ ID NO: 4732471 - DNA, 16 bp, Homo sapiens
cttctgctgggctggg

SEQ ID NO: 4732472 - DNA, 17 bp, Homo sapiens
cttctgcttcagcctcc

SEQ ID NO: 4732473 - DNA, 15 bp, Homo sapiens
cttctggctttgttc

SEQ ID NO: 4732474 - DNA, 22 bp, Homo sapiens
cttctggctttgttcttgtcat

SEQ ID NO: 4732475 - DNA, 22 bp, Homo sapiens
cttctgggagggcagcagggct

SEQ ID NO: 4732476 - DNA, 15 bp, Homo sapiens
cttctgggtggggca

SEQ ID NO: 4732477 - DNA, 14 bp, Homo sapiens
cttctgtacgtctg

SEQ ID NO: 4732478 - DNA, 18 bp, Homo sapiens
cttctgtacgtctgacag

SEQ ID NO: 4732479 - DNA, 18 bp, Homo sapiens
cttctgttgctgcctcat

SEQ ID NO: 4732480 - DNA, 21 bp, Homo sapiens
cttctgttgctgcctcatgct

SEQ ID NO: 4732481 - DNA, 21 bp, Homo sapiens
cttcttaatcttttcacaaat

SEQ ID NO: 4732482 - DNA, 22 bp, Homo sapiens
cttcttaatcttttcacaaata

SEQ ID NO: 4732483 - DNA, 23 bp, Homo sapiens
cttcttaatcttttcacaaataa

SEQ ID NO: 4732484 - DNA, 22 bp, Homo sapiens
cttcttcagagactcctgcagg

SEQ ID NO: 4732485 - DNA, 23 bp, Homo sapiens
cttcttcagagactcctgcaggc

SEQ ID NO: 4732486 - DNA, 16 bp, Homo sapiens
cttcttcagagctgac

SEQ ID NO: 4732487 - DNA, 20 bp, Homo sapiens
cttcttgtaatatttcttca

SEQ ID NO: 4732488 - DNA, 14 bp, Homo sapiens
cttctttgataatg

SEQ ID NO: 4732489 - DNA, 19 bp, Homo sapiens
cttctttgataatgttaaa

SEQ ID NO: 4732490 - DNA, 19 bp, Homo sapiens
cttctttgctttgcccagc

SEQ ID NO: 4732491 - DNA, 13 bp, Homo sapiens
cttcttttctctt

SEQ ID NO: 4732492 - DNA, 20 bp, Homo sapiens
cttgaaaaaaaacagtggat

SEQ ID NO: 4732493 - DNA, 14 bp, Homo sapiens
cttgaaaacactgt

SEQ ID NO: 4732494 - DNA, 23 bp, Homo sapiens
cttgaaaacactgttctctgccc

SEQ ID NO: 4732495 - DNA, 13 bp, Homo sapiens
cttgaaagaaatg

SEQ ID NO: 4732496 - DNA, 15 bp, Homo sapiens
cttgaattaagaaga

SEQ ID NO: 4732497 - DNA, 17 bp, Homo sapiens
cttgaattgtaactgtt

SEQ ID NO: 4732498 - DNA, 21 bp, Homo sapiens
cttgaattgtaactgttcttg

SEQ ID NO: 4732499 - DNA, 18 bp, Homo sapiens
cttgaattttcccactgc

SEQ ID NO: 4732500 - DNA, 21 bp, Homo sapiens
cttgaattttcccactgcacc

SEQ ID NO: 4732501 - DNA, 19 bp, Homo sapiens
cttgacaaacttctttcac

SEQ ID NO: 4732502 - DNA, 14 bp, Homo sapiens
cttgacagaacact

SEQ ID NO: 4732503 - DNA, 17 bp, Homo sapiens
cttgacagaacactgtc

SEQ ID NO: 4732504 - DNA, 14 bp, Homo sapiens
cttgacagggcaca

SEQ ID NO: 4732505 - DNA, 17 bp, Homo sapiens
cttgaccaggcctgggc

SEQ ID NO: 4732506 - DNA, 23 bp, Homo sapiens
cttgaccattctccacctgccag

SEQ ID NO: 4732507 - DNA, 13 bp, Homo sapiens
cttgacctcaggt

SEQ ID NO: 4732508 - DNA, 15 bp, Homo sapiens
cttgacctgaactct

SEQ ID NO: 4732509 - DNA, 16 bp, Homo sapiens
cttgagagaccaggca

SEQ ID NO: 4732510 - DNA, 19 bp, Homo sapiens
cttgagcctgtcaagaggc

SEQ ID NO: 4732511 - DNA, 17 bp, Homo sapiens
cttgagggttgggctgg

SEQ ID NO: 4732512 - DNA, 23 bp, Homo sapiens
cttgatcaacatcttttcttgcc

SEQ ID NO: 4732513 - DNA, 21 bp, Homo sapiens
cttgatgcatgcactgttccc

SEQ ID NO: 4732514 - DNA, 22 bp, Homo sapiens
cttgatgccagtaggctcaact

SEQ ID NO: 4732515 - DNA, 20 bp, Homo sapiens
cttgatgttcagacatttat

SEQ ID NO: 4732516 - DNA, 14 bp, Homo sapiens
cttgattttgcaaa

SEQ ID NO: 4732517 - DNA, 16 bp, Homo sapiens
cttgcaaaaagggtca

SEQ ID NO: 4732518 - DNA, 14 bp, Homo sapiens
cttgcaatggcagc

SEQ ID NO: 4732519 - DNA, 17 bp, Homo sapiens
cttgcaatggcagcctt

SEQ ID NO: 4732520 - DNA, 18 bp, Homo sapiens
cttgcaatggcagccttg

SEQ ID NO: 4732521 - DNA, 23 bp, Homo sapiens
cttgcagcaggatctagaggggg

SEQ ID NO: 4732522 - DNA, 21 bp, Homo sapiens
cttgcatgaggctagtgtggt

SEQ ID NO: 4732523 - DNA, 14 bp, Homo sapiens
cttgccccaacccc

SEQ ID NO: 4732524 - DNA, 21 bp, Homo sapiens
cttgccccaacccccagcacc

SEQ ID NO: 4732525 - DNA, 18 bp, Homo sapiens
cttgcccttgggtgctat

SEQ ID NO: 4732526 - DNA, 23 bp, Homo sapiens
cttgccgtctacctgaggggcct

SEQ ID NO: 4732527 - DNA, 21 bp, Homo sapiens
cttgcctatctgacttcatac

SEQ ID NO: 4732528 - DNA, 16 bp, Homo sapiens
cttgcctcggctcctg

SEQ ID NO: 4732529 - DNA, 22 bp, Homo sapiens
cttgcctcggctcctgctgcac

SEQ ID NO: 4732530 - DNA, 20 bp, Homo sapiens
cttgcctgggacggctgagc

SEQ ID NO: 4732531 - DNA, 21 bp, Homo sapiens
cttgccttattagagtgtctt

SEQ ID NO: 4732532 - DNA, 20 bp, Homo sapiens
cttgcggttccggcatggac

SEQ ID NO: 4732533 - DNA, 15 bp, Homo sapiens
cttgctccagcctga

SEQ ID NO: 4732534 - DNA, 12 bp, Homo sapiens
cttgctctgctg

SEQ ID NO: 4732535 - DNA, 17 bp, Homo sapiens
cttgctctgctgacaga

SEQ ID NO: 4732536 - DNA, 15 bp, Homo sapiens
cttgctggctgtgaa

SEQ ID NO: 4732537 - DNA, 16 bp, Homo sapiens
cttggaaagaaatgta

SEQ ID NO: 4732538 - DNA, 16 bp, Homo sapiens
cttggacattttatgt

SEQ ID NO: 4732539 - DNA, 18 bp, Homo sapiens
cttggacattttatgtct

SEQ ID NO: 4732540 - DNA, 19 bp, Homo sapiens
cttggacattttatgtctt

SEQ ID NO: 4732541 - DNA, 22 bp, Homo sapiens
cttggaggaaggaaacccagct

SEQ ID NO: 4732542 - DNA, 22 bp, Homo sapiens
cttggatatataggctattttc

SEQ ID NO: 4732543 - DNA, 18 bp, Homo sapiens
cttggatgtacctgcccc

SEQ ID NO: 4732544 - DNA, 18 bp, Homo sapiens
cttggattctctgagaaa

SEQ ID NO: 4732545 - DNA, 23 bp, Homo sapiens
cttggattgtccccgacccttgc

SEQ ID NO: 4732546 - DNA, 20 bp, Homo sapiens
cttggcacttattgaatata

SEQ ID NO: 4732547 - DNA, 17 bp, Homo sapiens
cttggctacacagggat

SEQ ID NO: 4732548 - DNA, 16 bp, Homo sapiens
cttggctgcagggagt

SEQ ID NO: 4732549 - DNA, 17 bp, Homo sapiens
cttggctgcagggagtc

SEQ ID NO: 4732550 - DNA, 13 bp, Homo sapiens
cttggctggtgca

SEQ ID NO: 4732551 - DNA, 17 bp, Homo sapiens
cttgggccatagctcct

SEQ ID NO: 4732552 - DNA, 14 bp, Homo sapiens
cttgggccctttga

SEQ ID NO: 4732553 - DNA, 16 bp, Homo sapiens
cttgggccctttgagt

SEQ ID NO: 4732554 - DNA, 17 bp, Homo sapiens
cttgggccctttgagtg

SEQ ID NO: 4732555 - DNA, 19 bp, Homo sapiens
cttgggccctttgagtgca

SEQ ID NO: 4732556 - DNA, 18 bp, Homo sapiens
cttggggcatgacccagt

SEQ ID NO: 4732557 - DNA, 21 bp, Homo sapiens
cttgggggtcctcctccaggg

SEQ ID NO: 4732558 - DNA, 22 bp, Homo sapiens
cttgggggtcctcctccaggga

SEQ ID NO: 4732559 - DNA, 17 bp, Homo sapiens
cttgggtttctgtgcag

SEQ ID NO: 4732560 - DNA, 17 bp, Homo sapiens
cttggtcctgctgcagt

SEQ ID NO: 4732561 - DNA, 22 bp, Homo sapiens
cttggtcctgctgcagttgcca

SEQ ID NO: 4732562 - DNA, 16 bp, Homo sapiens
cttggttctgtgaaca

SEQ ID NO: 4732563 - DNA, 16 bp, Homo sapiens
cttgtaaatagctcag

SEQ ID NO: 4732564 - DNA, 17 bp, Homo sapiens
cttgtaaatagctcagg

SEQ ID NO: 4732565 - DNA, 16 bp, Homo sapiens
cttgtaataaatactg

SEQ ID NO: 4732566 - DNA, 17 bp, Homo sapiens
cttgtaataaatactgc

SEQ ID NO: 4732567 - DNA, 17 bp, Homo sapiens
cttgtactttattttct

SEQ ID NO: 4732568 - DNA, 22 bp, Homo sapiens
cttgtattaagttgttaataaa

SEQ ID NO: 4732569 - DNA, 23 bp, Homo sapiens
cttgtattaagttgttaataaaa

SEQ ID NO: 4732570 - DNA, 21 bp, Homo sapiens
cttgtccaattaatgaagttg

SEQ ID NO: 4732571 - DNA, 15 bp, Homo sapiens
cttgtctttggaccc

SEQ ID NO: 4732572 - DNA, 20 bp, Homo sapiens
cttgtctttggaccctgagg

SEQ ID NO: 4732573 - DNA, 18 bp, Homo sapiens
cttgtgagggttgcttca

SEQ ID NO: 4732574 - DNA, 15 bp, Homo sapiens
cttgtggacacagct

SEQ ID NO: 4732575 - DNA, 17 bp, Homo sapiens
cttgtggacacagctct

SEQ ID NO: 4732576 - DNA, 16 bp, Homo sapiens
cttgtggtcccacccc

SEQ ID NO: 4732577 - DNA, 12 bp, Homo sapiens
cttgtgtatatg

SEQ ID NO: 4732578 - DNA, 23 bp, Homo sapiens
cttgtgtatatgtataaattaat

SEQ ID NO: 4732579 - DNA, 14 bp, Homo sapiens
ctcaagaagcaggc

SEQ ID NO: 4732580 - DNA, 15 bp, Homo sapiens
ctcaagaagcaggct

SEQ ID NO: 4732581 - DNA, 23 bp, Homo sapiens
ctcaagaagcaggctacactgac

SEQ ID NO: 4732582 - DNA, 23 bp, Homo sapiens
ctcaaggaataatgggcttagag

SEQ ID NO: 4732583 - DNA, 23 bp, Homo sapiens
ctcaaggggccatcctgtcccac

SEQ ID NO: 4732584 - DNA, 20 bp, Homo sapiens
ctcaagtgattctcctgcct

SEQ ID NO: 4732585 - DNA, 24 bp, Homo sapiens
ctcaagttccagtgcagagatcct

SEQ ID NO: 4732586 - DNA, 14 bp, Homo sapiens
ctcaataaagtaca

SEQ ID NO: 4732587 - DNA, 15 bp, Homo sapiens
ctcaataagccttgt

SEQ ID NO: 4732588 - DNA, 11 bp, Homo sapiens
ctcaatatttt

SEQ ID NO: 4732589 - DNA, 18 bp, Homo sapiens
ctcaatattttccatgaa

SEQ ID NO: 4732590 - DNA, 22 bp, Homo sapiens
ctcaatattttccatgaaaatg

SEQ ID NO: 4732591 - DNA, 14 bp, Homo sapiens
ctcaatccatgttc

SEQ ID NO: 4732592 - DNA, 15 bp, Homo sapiens
ctcaatgcactgaca

SEQ ID NO: 4732593 - DNA, 14 bp, Homo sapiens
ctcaattcttccct

SEQ ID NO: 4732594 - DNA, 13 bp, Homo sapiens
ctcaattttgtat

SEQ ID NO: 4732595 - DNA, 21 bp, Homo sapiens
ctcaattttgtatttaatgat

SEQ ID NO: 4732596 - DNA, 19 bp, Homo sapiens
ctcacaacatggtgtctgg

SEQ ID NO: 4732597 - DNA, 14 bp, Homo sapiens
ctcacactgagaat

SEQ ID NO: 4732598 - DNA, 20 bp, Homo sapiens
ctcacactgagaatgtaaga

SEQ ID NO: 4732599 - DNA, 15 bp, Homo sapiens
ctcacagtccttacc

SEQ ID NO: 4732600 - DNA, 22 bp, Homo sapiens
ctcacagtccttaccagcagag

SEQ ID NO: 4732601 - DNA, 23 bp, Homo sapiens
ctcacagtccttaccagcagagc

SEQ ID NO: 4732602 - DNA, 15 bp, Homo sapiens
ctcacatttattctg

SEQ ID NO: 4732603 - DNA, 18 bp, Homo sapiens
ctcaccagccccagtgcc

SEQ ID NO: 4732604 - DNA, 20 bp, Homo sapiens
ctcaccagccccagtgccca

SEQ ID NO: 4732605 - DNA, 21 bp, Homo sapiens
ctcaccagccccagtgcccac

SEQ ID NO: 4732606 - DNA, 14 bp, Homo sapiens
ctcaccaggggcag

SEQ ID NO: 4732607 - DNA, 20 bp, Homo sapiens
ctcaccaggggcaggcacag

SEQ ID NO: 4732608 - DNA, 21 bp, Homo sapiens
ctcaccaggggcaggcacagc

SEQ ID NO: 4732609 - DNA, 15 bp, Homo sapiens
ctcaccccagcccca

SEQ ID NO: 4732610 - DNA, 17 bp, Homo sapiens
ctcacccctggttctca

SEQ ID NO: 4732611 - DNA, 14 bp, Homo sapiens
ctcaccctggggct

SEQ ID NO: 4732612 - DNA, 13 bp, Homo sapiens
ctcacctctccct

SEQ ID NO: 4732613 - DNA, 15 bp, Homo sapiens
ctcacctctcccttg

SEQ ID NO: 4732614 - DNA, 17 bp, Homo sapiens
ctcacctctcccttgga

SEQ ID NO: 4732615 - DNA, 20 bp, Homo sapiens
ctcacctgcactaacagagt

SEQ ID NO: 4732616 - DNA, 21 bp, Homo sapiens
ctcacctggggctgctggcct

SEQ ID NO: 4732617 - DNA, 16 bp, Homo sapiens
ctcaccttttcccggg

SEQ ID NO: 4732618 - DNA, 17 bp, Homo sapiens
ctcactaccgtggacca

SEQ ID NO: 4732619 - DNA, 17 bp, Homo sapiens
ctcactataccagtata

SEQ ID NO: 4732620 - DNA, 17 bp, Homo sapiens
ctcactatggtgccaat

SEQ ID NO: 4732621 - DNA, 19 bp, Homo sapiens
ctcactatgttgcccaggc

SEQ ID NO: 4732622 - DNA, 12 bp, Homo sapiens
ctcactgcagcc

SEQ ID NO: 4732623 - DNA, 14 bp, Homo sapiens
ctcactgcagcctc

SEQ ID NO: 4732624 - DNA, 14 bp, Homo sapiens
ctcactgttgccca

SEQ ID NO: 4732625 - DNA, 16 bp, Homo sapiens
ctcactgttgcccagg

SEQ ID NO: 4732626 - DNA, 19 bp, Homo sapiens
ctcactgttgcccaggctg

SEQ ID NO: 4732627 - DNA, 22 bp, Homo sapiens
ctcactgttgcccaggctggcg

SEQ ID NO: 4732628 - DNA, 14 bp, Homo sapiens
ctcagaatatattc

SEQ ID NO: 4732629 - DNA, 14 bp, Homo sapiens
ctcagagaggacaa

SEQ ID NO: 4732630 - DNA, 15 bp, Homo sapiens
ctcagagagggcagg

SEQ ID NO: 4732631 - DNA, 14 bp, Homo sapiens
ctcagagagggtgg

SEQ ID NO: 4732632 - DNA, 17 bp, Homo sapiens
ctcagagtatggagctc

SEQ ID NO: 4732633 - DNA, 12 bp, Homo sapiens
ctcagagtggag

SEQ ID NO: 4732634 - DNA, 20 bp, Homo sapiens
ctcagccaggtgctgtgaca

SEQ ID NO: 4732635 - DNA, 21 bp, Homo sapiens
ctcagccccaccccagggcag

SEQ ID NO: 4732636 - DNA, 20 bp, Homo sapiens
ctcagcccctgatcctgtga

SEQ ID NO: 4732637 - DNA, 22 bp, Homo sapiens
ctcagcccctgatcctgtgaag

SEQ ID NO: 4732638 - DNA, 16 bp, Homo sapiens
ctcagccgtgggcccg

SEQ ID NO: 4732639 - DNA, 20 bp, Homo sapiens
ctcagcctcaataagccttg

SEQ ID NO: 4732640 - DNA, 21 bp, Homo sapiens
ctcagcctcccgaatagctgg

SEQ ID NO: 4732641 - DNA, 13 bp, Homo sapiens
ctcagcctcctga

SEQ ID NO: 4732642 - DNA, 20 bp, Homo sapiens
ctcagcggggacagctcctt

SEQ ID NO: 4732643 - DNA, 21 bp, Homo sapiens
ctcagcggggacagctccttc

SEQ ID NO: 4732644 - DNA, 12 bp, Homo sapiens
ctcagctcccca

SEQ ID NO: 4732645 - DNA, 20 bp, Homo sapiens
ctcagctctcagttgcagcc

SEQ ID NO: 4732646 - DNA, 16 bp, Homo sapiens
ctcagggaccacagca

SEQ ID NO: 4732647 - DNA, 18 bp, Homo sapiens
ctcagggaccacagcaag

SEQ ID NO: 4732648 - DNA, 19 bp, Homo sapiens
ctcagggaccacagcaagg

SEQ ID NO: 4732649 - DNA, 13 bp, Homo sapiens
ctcagggcctggc

SEQ ID NO: 4732650 - DNA, 18 bp, Homo sapiens
ctcagggcctggctcagg

SEQ ID NO: 4732651 - DNA, 15 bp, Homo sapiens
ctcagggtccctggt

SEQ ID NO: 4732652 - DNA, 16 bp, Homo sapiens
ctcagggtccctggtg

SEQ ID NO: 4732653 - DNA, 16 bp, Homo sapiens
ctcagggtctctgctg

SEQ ID NO: 4732654 - DNA, 24 bp, Homo sapiens
ctcaggtaatcgacctgcctcggc

SEQ ID NO: 4732655 - DNA, 15 bp, Homo sapiens
ctcaggtctgttttc

SEQ ID NO: 4732656 - DNA, 19 bp, Homo sapiens
ctcaggtgatccacccacc

SEQ ID NO: 4732657 - DNA, 23 bp, Homo sapiens
ctcaggtgatccacccacctcag

SEQ ID NO: 4732658 - DNA, 21 bp, Homo sapiens
ctcaggtggggtcactctggc

SEQ ID NO: 4732659 - DNA, 23 bp, Homo sapiens
ctcaggtggggtcactctggcag

SEQ ID NO: 4732660 - DNA, 15 bp, Homo sapiens
ctcaggtgtccctgc

SEQ ID NO: 4732661 - DNA, 19 bp, Homo sapiens
ctcaggtgtccctgcactt

SEQ ID NO: 4732662 - DNA, 15 bp, Homo sapiens
ctcagtcatgcataa

SEQ ID NO: 4732663 - DNA, 16 bp, Homo sapiens
ctcagtcatgcataaa

SEQ ID NO: 4732664 - DNA, 22 bp, Homo sapiens
ctcccccgggaggggcccgctt

SEQ ID NO: 4732665 - DNA, 15 bp, Homo sapiens
ctcccctaccactgt

SEQ ID NO: 4732666 - DNA, 15 bp, Homo sapiens
ctcccctccccaact

SEQ ID NO: 4732667 - DNA, 17 bp, Homo sapiens
ctcccctcctctcccct

SEQ ID NO: 4732668 - DNA, 14 bp, Homo sapiens
ctcccctgccccca

SEQ ID NO: 4732669 - DNA, 20 bp, Homo sapiens
ctcccctgcccccaggactg

SEQ ID NO: 4732670 - DNA, 17 bp, Homo sapiens
ctcccctgccccctgca

SEQ ID NO: 4732671 - DNA, 13 bp, Homo sapiens
ctcccctgctggg

SEQ ID NO: 4732672 - DNA, 23 bp, Homo sapiens
ctcccctgctgggtgtggcgcag

SEQ ID NO: 4732673 - DNA, 17 bp, Homo sapiens
ctcccgaatagctggga

SEQ ID NO: 4732674 - DNA, 19 bp, Homo sapiens
ctcccgaatagctgggact

SEQ ID NO: 4732675 - DNA, 16 bp, Homo sapiens
ctccctcaaagaaatc

SEQ ID NO: 4732676 - DNA, 21 bp, Homo sapiens
ctccctcagatcccagttcct

SEQ ID NO: 4732677 - DNA, 22 bp, Homo sapiens
ctccctcatttcaggagcagcc

SEQ ID NO: 4732678 - DNA, 20 bp, Homo sapiens
ctccctgaagtaagcaaaga

SEQ ID NO: 4732679 - DNA, 15 bp, Homo sapiens
ctccctgcctccacc

SEQ ID NO: 4732680 - DNA, 18 bp, Homo sapiens
ctccctgcctccacccac

SEQ ID NO: 4732681 - DNA, 19 bp, Homo sapiens
ctccctgcctccacccaca

SEQ ID NO: 4732682 - DNA, 20 bp, Homo sapiens
ctccctgcctccacccacag

SEQ ID NO: 4732683 - DNA, 14 bp, Homo sapiens
ctccctgctgtccc

SEQ ID NO: 4732684 - DNA, 13 bp, Homo sapiens
ctccctggccctc

SEQ ID NO: 4732685 - DNA, 14 bp, Homo sapiens
ctccctggccctca

SEQ ID NO: 4732686 - DNA, 17 bp, Homo sapiens
ctcccttggattgtccc

SEQ ID NO: 4732687 - DNA, 14 bp, Homo sapiens
ctcccttgggctcc

SEQ ID NO: 4732688 - DNA, 16 bp, Homo sapiens
ctccctttttccttgt

SEQ ID NO: 4732689 - DNA, 20 bp, Homo sapiens
ctccctttttccttgtcccc

SEQ ID NO: 4732690 - DNA, 22 bp, Homo sapiens
ctccctttttccttgtccccac

SEQ ID NO: 4732691 - DNA, 17 bp, Homo sapiens
ctccgcacacctctggc

SEQ ID NO: 4732692 - DNA, 19 bp, Homo sapiens
ctacccagcgagccctggt

SEQ ID NO: 4732693 - DNA, 18 bp, Homo sapiens
ctacccagtcatgtactg

SEQ ID NO: 4732694 - DNA, 14 bp, Homo sapiens
ctacccgggaaggg

SEQ ID NO: 4732695 - DNA, 21 bp, Homo sapiens
ctacccgggaagggggctggg

SEQ ID NO: 4732696 - DNA, 13 bp, Homo sapiens
ctaccctccctgc

SEQ ID NO: 4732697 - DNA, 14 bp, Homo sapiens
ctaccctccctgct

SEQ ID NO: 4732698 - DNA, 18 bp, Homo sapiens
ctaccctccctgctgtcc

SEQ ID NO: 4732699 - DNA, 23 bp, Homo sapiens
ctaccctccctgctgtcccctct

SEQ ID NO: 4732700 - DNA, 20 bp, Homo sapiens
ctacccttggaaagaaatgt

SEQ ID NO: 4732701 - DNA, 19 bp, Homo sapiens
ctacctcactactacatct

SEQ ID NO: 4732702 - DNA, 20 bp, Homo sapiens
ctacctgacactcccttggg

SEQ ID NO: 4732703 - DNA, 14 bp, Homo sapiens
ctacctgaggggcc

SEQ ID NO: 4732704 - DNA, 19 bp, Homo sapiens
ctacctgaggggcctctta

SEQ ID NO: 4732705 - DNA, 18 bp, Homo sapiens
ctaccttccagttcctca

SEQ ID NO: 4732706 - DNA, 21 bp, Homo sapiens
ctaccttggttcccccactga

SEQ ID NO: 4732707 - DNA, 15 bp, Homo sapiens
ctactattcatgttt

SEQ ID NO: 4732708 - DNA, 14 bp, Homo sapiens
ctacttccccttcc

SEQ ID NO: 4732709 - DNA, 15 bp, Homo sapiens
ctacttccccttcct

SEQ ID NO: 4732710 - DNA, 19 bp, Homo sapiens
ctacttgatatttccttca

SEQ ID NO: 4732711 - DNA, 13 bp, Homo sapiens
ctactttgtttat

SEQ ID NO: 4732712 - DNA, 14 bp, Homo sapiens
ctagaaacttccaa

SEQ ID NO: 4732713 - DNA, 19 bp, Homo sapiens
ctagaaagtaagaaaacaa

SEQ ID NO: 4732714 - DNA, 17 bp, Homo sapiens
ctagaacctagaagggc

SEQ ID NO: 4732715 - DNA, 15 bp, Homo sapiens
ctagaacctggagag

SEQ ID NO: 4732716 - DNA, 14 bp, Homo sapiens
ctagaacctggagg

SEQ ID NO: 4732717 - DNA, 15 bp, Homo sapiens
ctagaactgaatttt

SEQ ID NO: 4732718 - DNA, 21 bp, Homo sapiens
ctagaagggctagaacctgga

SEQ ID NO: 4732719 - DNA, 16 bp, Homo sapiens
ctagaataatcttgct

SEQ ID NO: 4732720 - DNA, 17 bp, Homo sapiens
ctagaataatcttgctc

SEQ ID NO: 4732721 - DNA, 19 bp, Homo sapiens
ctagaatatcctacttctc

SEQ ID NO: 4732722 - DNA, 20 bp, Homo sapiens
ctagaatctggagagctaga

SEQ ID NO: 4732723 - DNA, 19 bp, Homo sapiens
ctagagaatgttagaggat

SEQ ID NO: 4732724 - DNA, 21 bp, Homo sapiens
ctagattgctaaggagctgat

SEQ ID NO: 4732725 - DNA, 23 bp, Homo sapiens
ctagcacggacatggtctgtcct

SEQ ID NO: 4732726 - DNA, 21 bp, Homo sapiens
ctagcactttgggaggccaag

SEQ ID NO: 4732727 - DNA, 16 bp, Homo sapiens
ctagcccgaatacaaa

SEQ ID NO: 4732728 - DNA, 21 bp, Homo sapiens
ctagccttagaagtcacacag

SEQ ID NO: 4732729 - DNA, 22 bp, Homo sapiens
ctagccttagaagtcacacagt

SEQ ID NO: 4732730 - DNA, 23 bp, Homo sapiens
ctagccttagaagtcacacagta

SEQ ID NO: 4732731 - DNA, 14 bp, Homo sapiens
ctagctaattattt

SEQ ID NO: 4732732 - DNA, 21 bp, Homo sapiens
ctagctatttctatgtatgtg

SEQ ID NO: 4732733 - DNA, 15 bp, Homo sapiens
ctagctgttgtaaag

SEQ ID NO: 4732734 - DNA, 18 bp, Homo sapiens
ctagctgttgtaaagaat

SEQ ID NO: 4732735 - DNA, 15 bp, Homo sapiens
ctagcttagagcctc

SEQ ID NO: 4732736 - DNA, 16 bp, Homo sapiens
ctaggaaatccagggt

SEQ ID NO: 4732737 - DNA, 13 bp, Homo sapiens
ctaggaacactcc

SEQ ID NO: 4732738 - DNA, 19 bp, Homo sapiens
ctaggaatggagtctccca

SEQ ID NO: 4732739 - DNA, 13 bp, Homo sapiens
ctaggcaggacat

SEQ ID NO: 4732740 - DNA, 11 bp, Homo sapiens
ctaggctgggg

SEQ ID NO: 4732741 - DNA, 13 bp, Homo sapiens
ctagggatccctc

SEQ ID NO: 4732742 - DNA, 23 bp, Homo sapiens
ctagggatccctcatctgtccct

SEQ ID NO: 4732743 - DNA, 17 bp, Homo sapiens
ctagggccaagcccagc

SEQ ID NO: 4732744 - DNA, 19 bp, Homo sapiens
ctaggtacgatgacagtgt

SEQ ID NO: 4732745 - DNA, 19 bp, Homo sapiens
ctaggtggcaaggctgtgc

SEQ ID NO: 4732746 - DNA, 23 bp, Homo sapiens
ctaggtggcaaggctgtgctccc

SEQ ID NO: 4732747 - DNA, 15 bp, Homo sapiens
ctagtagaacaatgt

SEQ ID NO: 4732748 - DNA, 17 bp, Homo sapiens
ctagtgaaggcttctct

SEQ ID NO: 4732749 - DNA, 17 bp, Homo sapiens
ctagtgctgtaatattg

SEQ ID NO: 4732750 - DNA, 21 bp, Homo sapiens
ctagtggagggttggagaagg

SEQ ID NO: 4732751 - DNA, 14 bp, Homo sapiens
ctagtggctgtcca

SEQ ID NO: 4732752 - DNA, 17 bp, Homo sapiens
ctagtggctgtccagtg

SEQ ID NO: 4732753 - DNA, 20 bp, Homo sapiens
ctagtggctgtccagtgccc

SEQ ID NO: 4732754 - DNA, 19 bp, Homo sapiens
ctagtggtctttgtaagag

SEQ ID NO: 4732755 - DNA, 22 bp, Homo sapiens
ctagtggtctttgtaagagtgt

SEQ ID NO: 4732756 - DNA, 23 bp, Homo sapiens
ctagtgtggtgtttcctggcact

SEQ ID NO: 4732757 - DNA, 16 bp, Homo sapiens
ctagttatacttattt

SEQ ID NO: 4732758 - DNA, 17 bp, Homo sapiens
ctataactttttttcaa

SEQ ID NO: 4732759 - DNA, 15 bp, Homo sapiens
ctataattctattga

SEQ ID NO: 4732760 - DNA, 12 bp, Homo sapiens
ctataatttaaa

SEQ ID NO: 4732761 - DNA, 18 bp, Homo sapiens
ctatagcctaggtgacag

SEQ ID NO: 4732762 - DNA, 20 bp, Homo sapiens
ctatagcctaggtgacagag

SEQ ID NO: 4732763 - DNA, 19 bp, Homo sapiens
ctataggtcatacaatcca

SEQ ID NO: 4732764 - DNA, 19 bp, Homo sapiens
ctatatttgtgctatttaa

SEQ ID NO: 4732765 - DNA, 23 bp, Homo sapiens
ctatcagtgtgccccccatcctg

SEQ ID NO: 4732766 - DNA, 18 bp, Homo sapiens
ctatcatgtcaaacgtga

SEQ ID NO: 4732767 - DNA, 13 bp, Homo sapiens
ctatccaaataaa

SEQ ID NO: 4732768 - DNA, 17 bp, Homo sapiens
ctatcctacttcccctt

SEQ ID NO: 4732769 - DNA, 15 bp, Homo sapiens
ctatctcccccagcc

SEQ ID NO: 4732770 - DNA, 16 bp, Homo sapiens
ctatctcccccagccc

SEQ ID NO: 4732771 - DNA, 18 bp, Homo sapiens
ctatctcccccagcccca

SEQ ID NO: 4732772 - DNA, 20 bp, Homo sapiens
ctatctcccccagccccatc

SEQ ID NO: 4732773 - DNA, 13 bp, Homo sapiens
ctatcttccaaac

SEQ ID NO: 4732774 - DNA, 16 bp, Homo sapiens
ctatgacagatatatt

SEQ ID NO: 4732775 - DNA, 23 bp, Homo sapiens
ctatgacagatatatttaagcct

SEQ ID NO: 4732776 - DNA, 17 bp, Homo sapiens
ctatgataaattatgat

SEQ ID NO: 4732777 - DNA, 23 bp, Homo sapiens
ctatgatgaaggtaattaaagta

SEQ ID NO: 4732778 - DNA, 13 bp, Homo sapiens
ctatgcacacttt

SEQ ID NO: 4732779 - DNA, 14 bp, Homo sapiens
ctatgctccctctg

SEQ ID NO: 4732780 - DNA, 22 bp, Homo sapiens
ctatgggactcaatgcactgac

SEQ ID NO: 4732781 - DNA, 21 bp, Homo sapiens
ctatgtatgtgccaattttgt

SEQ ID NO: 4732782 - DNA, 14 bp, Homo sapiens
ctatgttaatattt

SEQ ID NO: 4732783 - DNA, 13 bp, Homo sapiens
ctattaaaagact

SEQ ID NO: 4732784 - DNA, 14 bp, Homo sapiens
ctattaaaagactc

SEQ ID NO: 4732785 - DNA, 11 bp, Homo sapiens
ctattaaaatt

SEQ ID NO: 4732786 - DNA, 21 bp, Homo sapiens
ctattgaaagtttttaatatt

SEQ ID NO: 4732787 - DNA, 17 bp, Homo sapiens
ctatttaaaacttgtaa

SEQ ID NO: 4732788 - DNA, 20 bp, Homo sapiens
ctatttaattctttctattt

SEQ ID NO: 4732789 - DNA, 16 bp, Homo sapiens
ctatttatgatttcaa

SEQ ID NO: 4732790 - DNA, 19 bp, Homo sapiens
ctatttatttatttattca

SEQ ID NO: 4732791 - DNA, 20 bp, Homo sapiens
ctatttcaatacttacatat

SEQ ID NO: 4732792 - DNA, 21 bp, Homo sapiens
ctatttgtagattaggattaa

SEQ ID NO: 4732793 - DNA, 23 bp, Homo sapiens
ctattttaccatatgtttatcac

SEQ ID NO: 4732794 - DNA, 12 bp, Homo sapiens
ctcaaacactgc

SEQ ID NO: 4732795 - DNA, 16 bp, Homo sapiens
ctcaaacactgcaggc

SEQ ID NO: 4732796 - DNA, 18 bp, Homo sapiens
ctcaaacactgcaggcat

SEQ ID NO: 4732797 - DNA, 22 bp, Homo sapiens
ctcaaaccaaatcactgaactt

SEQ ID NO: 4732798 - DNA, 16 bp, Homo sapiens
ctcaaagaatataatc

SEQ ID NO: 4732799 - DNA, 19 bp, Homo sapiens
ctcaaagttttgaaaagct

SEQ ID NO: 4732800 - DNA, 21 bp, Homo sapiens
ctcaaagttttgaaaagctat

SEQ ID NO: 4732801 - DNA, 15 bp, Homo sapiens
ctcaacaacatcttt

SEQ ID NO: 4732802 - DNA, 13 bp, Homo sapiens
ctcaacctcctgg

SEQ ID NO: 4732803 - DNA, 23 bp, Homo sapiens
ccaaatggaaatgggcagagcag

SEQ ID NO: 4732804 - DNA, 19 bp, Homo sapiens
ccaaattaaacgtaaatgt

SEQ ID NO: 4732805 - DNA, 22 bp, Homo sapiens
ccaaattaaacgtaaatgtttt

SEQ ID NO: 4732806 - DNA, 18 bp, Homo sapiens
ccaaatttaaaactgttg

SEQ ID NO: 4732807 - DNA, 20 bp, Homo sapiens
ccaacagtgttaggcctggc

SEQ ID NO: 4732808 - DNA, 21 bp, Homo sapiens
ccaacagtgttaggcctggca

SEQ ID NO: 4732809 - DNA, 14 bp, Homo sapiens
ccaacatactccca

SEQ ID NO: 4732810 - DNA, 16 bp, Homo sapiens
ccaacatactcccatc

SEQ ID NO: 4732811 - DNA, 20 bp, Homo sapiens
ccaacatactcccatctgtg

SEQ ID NO: 4732812 - DNA, 12 bp, Homo sapiens
ccaacccagccg

SEQ ID NO: 4732813 - DNA, 16 bp, Homo sapiens
ccaacccagccgctgc

SEQ ID NO: 4732814 - DNA, 21 bp, Homo sapiens
ccaacccagccgctgcccggc

SEQ ID NO: 4732815 - DNA, 13 bp, Homo sapiens
ccaacccccagca

SEQ ID NO: 4732816 - DNA, 16 bp, Homo sapiens
ccaacccccagccccc

SEQ ID NO: 4732817 - DNA, 18 bp, Homo sapiens
ccaacccccagcccccac

SEQ ID NO: 4732818 - DNA, 17 bp, Homo sapiens
ccaaccccccagcactg

SEQ ID NO: 4732819 - DNA, 18 bp, Homo sapiens
ccaaccccccagcactga

SEQ ID NO: 4732820 - DNA, 10 bp, Homo sapiens
cggggctggg

SEQ ID NO: 4732821 - DNA, 14 bp, Homo sapiens
cggggcttggctga

SEQ ID NO: 4732822 - DNA, 12 bp, Homo sapiens
cgggggcagctg

SEQ ID NO: 4732823 - DNA, 16 bp, Homo sapiens
cggggtggattggatt

SEQ ID NO: 4732824 - DNA, 20 bp, Homo sapiens
cggtgagaggggaacagact

SEQ ID NO: 4732825 - DNA, 18 bp, Homo sapiens
cggtgctatctcccccag

SEQ ID NO: 4732826 - DNA, 13 bp, Homo sapiens
cggtgctccaggc

SEQ ID NO: 4732827 - DNA, 22 bp, Homo sapiens
cggtgggggtagggggctggag

SEQ ID NO: 4732828 - DNA, 16 bp, Homo sapiens
cggtgtgcaccagggt

SEQ ID NO: 4732829 - DNA, 15 bp, Homo sapiens
cggtttgaagcctgg

SEQ ID NO: 4732830 - DNA, 21 bp, Homo sapiens
cgtaacttattatcactttgg

SEQ ID NO: 4732831 - DNA, 23 bp, Homo sapiens
cgtaacttattatcactttgggg

SEQ ID NO: 4732832 - DNA, 14 bp, Homo sapiens
cgtacatgtgaggc

SEQ ID NO: 4732833 - DNA, 17 bp, Homo sapiens
cgtagcgtatacatttg

SEQ ID NO: 4732834 - DNA, 18 bp, Homo sapiens
cgtagtaaaagtcataaa

SEQ ID NO: 4732835 - DNA, 22 bp, Homo sapiens
cgtataatttagtcccttaaaa

SEQ ID NO: 4732836 - DNA, 17 bp, Homo sapiens
cgtatggaatgcttctt

SEQ ID NO: 4732837 - DNA, 15 bp, Homo sapiens
cgtattacatttttg

SEQ ID NO: 4732838 - DNA, 22 bp, Homo sapiens
cgtcactccacgcagctggcag

SEQ ID NO: 4732839 - DNA, 17 bp, Homo sapiens
cgtcataactagaactg

SEQ ID NO: 4732840 - DNA, 14 bp, Homo sapiens
cgtccatcactggc

SEQ ID NO: 4732841 - DNA, 12 bp, Homo sapiens
cgtcctcctctg

SEQ ID NO: 4732842 - DNA, 17 bp, Homo sapiens
cgtcctctccctcctgg

SEQ ID NO: 4732843 - DNA, 11 bp, Homo sapiens
cgtcctgaggg

SEQ ID NO: 4732844 - DNA, 23 bp, Homo sapiens
cgtcctgcccttgctccagcctg

SEQ ID NO: 4732845 - DNA, 16 bp, Homo sapiens
cgtcgacgtagaacct

SEQ ID NO: 4732846 - DNA, 14 bp, Homo sapiens
cgtctgacaggcaa

SEQ ID NO: 4732847 - DNA, 12 bp, Homo sapiens
cgtgacaacaca

SEQ ID NO: 4732848 - DNA, 15 bp, Homo sapiens
cgtgacaacacaaat

SEQ ID NO: 4732849 - DNA, 15 bp, Homo sapiens
cgtgattctgttcta

SEQ ID NO: 4732850 - DNA, 18 bp, Homo sapiens
cgtgattttgctgtagaa

SEQ ID NO: 4732851 - DNA, 18 bp, Homo sapiens
cgtgcacacaccagagcc

SEQ ID NO: 4732852 - DNA, 21 bp, Homo sapiens
cgtgcacacaccagagcccac

SEQ ID NO: 4732853 - DNA, 21 bp, Homo sapiens
cgtgcagtggtgcgatctggg

SEQ ID NO: 4732854 - DNA, 22 bp, Homo sapiens
cgtgcagtggtgcgatctgggt

SEQ ID NO: 4732855 - DNA, 17 bp, Homo sapiens
cgtgccagtcgcgctgc

SEQ ID NO: 4732856 - DNA, 20 bp, Homo sapiens
cgtgccagtcgcgctgcctg

SEQ ID NO: 4732857 - DNA, 22 bp, Homo sapiens
cgtgccagtcgcgctgcctgtg

SEQ ID NO: 4732858 - DNA, 12 bp, Homo sapiens
cgtgcctggcca

SEQ ID NO: 4732859 - DNA, 19 bp, Homo sapiens
cgtgcgtctgtgtgtgcct

SEQ ID NO: 4732860 - DNA, 14 bp, Homo sapiens
cgtggaccacctag

SEQ ID NO: 4732861 - DNA, 14 bp, Homo sapiens
cgtggagctgcctg

SEQ ID NO: 4732862 - DNA, 10 bp, Homo sapiens
cgtggcacat

SEQ ID NO: 4732863 - DNA, 13 bp, Homo sapiens
cgtggcaggactt

SEQ ID NO: 4732864 - DNA, 12 bp, Homo sapiens
cgtggccccagc

SEQ ID NO: 4732865 - DNA, 15 bp, Homo sapiens
cgtggccccagcctg

SEQ ID NO: 4732866 - DNA, 16 bp, Homo sapiens
cgtggccccagcctgg

SEQ ID NO: 4732867 - DNA, 22 bp, Homo sapiens
cgtggccccagcctggcccagc

SEQ ID NO: 4732868 - DNA, 15 bp, Homo sapiens
cgtgtgtagagttaa

SEQ ID NO: 4732869 - DNA, 18 bp, Homo sapiens
cgtgtgtagagttaagaa

SEQ ID NO: 4732870 - DNA, 12 bp, Homo sapiens
cgtgtgtctgtg

SEQ ID NO: 4732871 - DNA, 20 bp, Homo sapiens
cgttccatgatgctgggatt

SEQ ID NO: 4732872 - DNA, 13 bp, Homo sapiens
cgttgtctccctg

SEQ ID NO: 4732873 - DNA, 16 bp, Homo sapiens
cgttgtctccctggcc

SEQ ID NO: 4732874 - DNA, 15 bp, Homo sapiens
cgttttctgtttgga

SEQ ID NO: 4732875 - DNA, 14 bp, Homo sapiens
ctaaaaaaaagatg

SEQ ID NO: 4732876 - DNA, 18 bp, Homo sapiens
ctaaaaatttttacaaaa

SEQ ID NO: 4732877 - DNA, 16 bp, Homo sapiens
ctaaaagacaaattta

SEQ ID NO: 4732878 - DNA, 15 bp, Homo sapiens
ctaaaatattttaga

SEQ ID NO: 4732879 - DNA, 19 bp, Homo sapiens
ctaaaatattttagatgtt

SEQ ID NO: 4732880 - DNA, 13 bp, Homo sapiens
ctaaaatgttcta

SEQ ID NO: 4732881 - DNA, 21 bp, Homo sapiens
ctaaaatttgccctcccatcc

SEQ ID NO: 4732882 - DNA, 23 bp, Homo sapiens
ctaaaatttgccctcccatcccg

SEQ ID NO: 4732883 - DNA, 18 bp, Homo sapiens
ctaaacagatgtccctga

SEQ ID NO: 4732884 - DNA, 14 bp, Homo sapiens
ctaaaccctctgtg

SEQ ID NO: 4732885 - DNA, 12 bp, Homo sapiens
ctaaactgcccc

SEQ ID NO: 4732886 - DNA, 13 bp, Homo sapiens
ctaaactgccccc

SEQ ID NO: 4732887 - DNA, 23 bp, Homo sapiens
ctaaactgccccctctgccctgc

SEQ ID NO: 4732888 - DNA, 19 bp, Homo sapiens
ctaaatggtgctgcagatt

SEQ ID NO: 4732889 - DNA, 18 bp, Homo sapiens
ctaaatgtgcaatagaag

SEQ ID NO: 4732890 - DNA, 21 bp, Homo sapiens
ctaaatgtgcaatagaaggtg

SEQ ID NO: 4732891 - DNA, 17 bp, Homo sapiens
ctaaattgaaacctgga

SEQ ID NO: 4732892 - DNA, 18 bp, Homo sapiens
ctaaatttaattacctta

SEQ ID NO: 4732893 - DNA, 19 bp, Homo sapiens
ctaaatttttaactgcctt

SEQ ID NO: 4732894 - DNA, 20 bp, Homo sapiens
ctaacgaaatatcaaagtca

SEQ ID NO: 4732895 - DNA, 21 bp, Homo sapiens
ctaactagagcagccctggag

SEQ ID NO: 4732896 - DNA, 15 bp, Homo sapiens
ctaagagggagggag

SEQ ID NO: 4732897 - DNA, 23 bp, Homo sapiens
ctaagagggagggagggctccag

SEQ ID NO: 4732898 - DNA, 18 bp, Homo sapiens
ctaagatgccatgtgcag

SEQ ID NO: 4732899 - DNA, 15 bp, Homo sapiens
ctaagattaatagca

SEQ ID NO: 4732900 - DNA, 18 bp, Homo sapiens
ctaagcggctgtttactg

SEQ ID NO: 4732901 - DNA, 14 bp, Homo sapiens
ctaaggactttttc

SEQ ID NO: 4732902 - DNA, 18 bp, Homo sapiens
ctaaggcgtggagctgcc

SEQ ID NO: 4732903 - DNA, 16 bp, Homo sapiens
ctaaggctcctgtttt

SEQ ID NO: 4732904 - DNA, 19 bp, Homo sapiens
ctaagggaggcacttcctc

SEQ ID NO: 4732905 - DNA, 23 bp, Homo sapiens
ctaagtgtaaaagtagtaaattt

SEQ ID NO: 4732906 - DNA, 17 bp, Homo sapiens
ctaatagagagattagt

SEQ ID NO: 4732907 - DNA, 23 bp, Homo sapiens
ctaatatagtaggggttgaagaa

SEQ ID NO: 4732908 - DNA, 19 bp, Homo sapiens
ctaatgaatgcataaaatg

SEQ ID NO: 4732909 - DNA, 13 bp, Homo sapiens
ctaatgatgcttt

SEQ ID NO: 4732910 - DNA, 15 bp, Homo sapiens
ctaatgcgcaggctg

SEQ ID NO: 4732911 - DNA, 19 bp, Homo sapiens
ctaatgcgcaggctggccc

SEQ ID NO: 4732912 - DNA, 22 bp, Homo sapiens
ctaatgcgcaggctggccctgc

SEQ ID NO: 4732913 - DNA, 21 bp, Homo sapiens
ctaatgcttgccaagaaatcg

SEQ ID NO: 4732914 - DNA, 13 bp, Homo sapiens
ctaatgggacact

SEQ ID NO: 4732915 - DNA, 15 bp, Homo sapiens
ctaattccacagctg

SEQ ID NO: 4732916 - DNA, 16 bp, Homo sapiens
ctaattccacagctgc

SEQ ID NO: 4732917 - DNA, 15 bp, Homo sapiens
ctaattctttaatga

SEQ ID NO: 4732918 - DNA, 17 bp, Homo sapiens
ctaattgtcagtgattt

SEQ ID NO: 4732919 - DNA, 15 bp, Homo sapiens
ctaatttctgtgtct

SEQ ID NO: 4732920 - DNA, 19 bp, Homo sapiens
ctaatttgttttggatata

SEQ ID NO: 4732921 - DNA, 22 bp, Homo sapiens
ctaattttccataagctatttt

SEQ ID NO: 4732922 - DNA, 13 bp, Homo sapiens
ctacaaacaaaat

SEQ ID NO: 4732923 - DNA, 15 bp, Homo sapiens
ctacaaacaaaattt

SEQ ID NO: 4732924 - DNA, 21 bp, Homo sapiens
ctacaaacaaaatttctatta

SEQ ID NO: 4732925 - DNA, 22 bp, Homo sapiens
ctacacaacatgtatgtggata

SEQ ID NO: 4732926 - DNA, 17 bp, Homo sapiens
ctacacagctgtttcct

SEQ ID NO: 4732927 - DNA, 17 bp, Homo sapiens
ctacactccagcctggg

SEQ ID NO: 4732928 - DNA, 15 bp, Homo sapiens
ctacactgacactgg

SEQ ID NO: 4732929 - DNA, 13 bp, Homo sapiens
ctacactgtgctg

SEQ ID NO: 4732930 - DNA, 14 bp, Homo sapiens
ctgaaggccccgcc

SEQ ID NO: 4732931 - DNA, 14 bp, Homo sapiens
ctgaataaaccagt

SEQ ID NO: 4732932 - DNA, 15 bp, Homo sapiens
ctgaatagatatgaa

SEQ ID NO: 4732933 - DNA, 14 bp, Homo sapiens
ctgaatattaagaa

SEQ ID NO: 4732934 - DNA, 15 bp, Homo sapiens
ctgaatctgctacca

SEQ ID NO: 4732935 - DNA, 22 bp, Homo sapiens
ctgaatctgctaccaaaacagt

SEQ ID NO: 4732936 - DNA, 21 bp, Homo sapiens
ctgaatgaagccttctgacct

SEQ ID NO: 4732937 - DNA, 23 bp, Homo sapiens
ctgaatgactccactgtttttct

SEQ ID NO: 4732938 - DNA, 18 bp, Homo sapiens
ctgaattatctatttcat

SEQ ID NO: 4732939 - DNA, 19 bp, Homo sapiens
ctgacaacagcctgagaaa

SEQ ID NO: 4732940 - DNA, 16 bp, Homo sapiens
ctgacacaaacctgcc

SEQ ID NO: 4732941 - DNA, 18 bp, Homo sapiens
ctgacacaaacctgcctg

SEQ ID NO: 4732942 - DNA, 20 bp, Homo sapiens
ctgacacaaacctgcctggg

SEQ ID NO: 4732943 - DNA, 13 bp, Homo sapiens
ctgacacacagct

SEQ ID NO: 4732944 - DNA, 17 bp, Homo sapiens
ctgacacacagctctgt

SEQ ID NO: 4732945 - DNA, 19 bp, Homo sapiens
ctgacacacagctctgtcc

SEQ ID NO: 4732946 - DNA, 23 bp, Homo sapiens
ctgacacacagctctgtcctggg

SEQ ID NO: 4732947 - DNA, 21 bp, Homo sapiens
ctgacactgcggggcttggct

SEQ ID NO: 4732948 - DNA, 23 bp, Homo sapiens
ctgacactgcggggcttggctga

SEQ ID NO: 4732949 - DNA, 15 bp, Homo sapiens
ctgacagacacaggc

SEQ ID NO: 4732950 - DNA, 19 bp, Homo sapiens
ctgacagacacaggcccgg

SEQ ID NO: 4732951 - DNA, 21 bp, Homo sapiens
ctgacagacacaggcccggct

SEQ ID NO: 4732952 - DNA, 18 bp, Homo sapiens
ctgacaggcaatgctggc

SEQ ID NO: 4732953 - DNA, 19 bp, Homo sapiens
ctgacaggcaatgctggct

SEQ ID NO: 4732954 - DNA, 22 bp, Homo sapiens
ctgacatattatgcctgaatga

SEQ ID NO: 4732955 - DNA, 17 bp, Homo sapiens
ctgacattgttggccaa

SEQ ID NO: 4732956 - DNA, 18 bp, Homo sapiens
ctgacatttggagtgttc

SEQ ID NO: 4732957 - DNA, 15 bp, Homo sapiens
ctgaccaatattgta

SEQ ID NO: 4732958 - DNA, 20 bp, Homo sapiens
ctgaccaatattgtacagtt

SEQ ID NO: 4732959 - DNA, 15 bp, Homo sapiens
ctgacccacagcctc

SEQ ID NO: 4732960 - DNA, 11 bp, Homo sapiens
ctgacccactg

SEQ ID NO: 4732961 - DNA, 12 bp, Homo sapiens
ctgacccactgc

SEQ ID NO: 4732962 - DNA, 13 bp, Homo sapiens
ctgacccactgct

SEQ ID NO: 4732963 - DNA, 14 bp, Homo sapiens
ctgacccactgctt

SEQ ID NO: 4732964 - DNA, 14 bp, Homo sapiens
ctgacccatgctgc

SEQ ID NO: 4732965 - DNA, 16 bp, Homo sapiens
ctgacccatgctgccc

SEQ ID NO: 4732966 - DNA, 17 bp, Homo sapiens
ctgaccccctcccccca

SEQ ID NO: 4732967 - DNA, 20 bp, Homo sapiens
ctgacccctcatagccctca

SEQ ID NO: 4732968 - DNA, 21 bp, Homo sapiens
ctgacccctcatagccctcac

SEQ ID NO: 4732969 - DNA, 14 bp, Homo sapiens
ctgacgcagcctga

SEQ ID NO: 4732970 - DNA, 15 bp, Homo sapiens
ctgacgcagcctgag

SEQ ID NO: 4732971 - DNA, 17 bp, Homo sapiens
ctgacgcagcctgagaa

SEQ ID NO: 4732972 - DNA, 12 bp, Homo sapiens
ctgactcagggc

SEQ ID NO: 4732973 - DNA, 18 bp, Homo sapiens
ctgactcagggctcctgg

SEQ ID NO: 4732974 - DNA, 19 bp, Homo sapiens
ctgactcagggctcctggg

SEQ ID NO: 4732975 - DNA, 11 bp, Homo sapiens
ctgactctaaa

SEQ ID NO: 4732976 - DNA, 14 bp, Homo sapiens
ctgactctaaaata

SEQ ID NO: 4732977 - DNA, 12 bp, Homo sapiens
ctgactgggagt

SEQ ID NO: 4732978 - DNA, 15 bp, Homo sapiens
ctgactgtaacgatt

SEQ ID NO: 4732979 - DNA, 15 bp, Homo sapiens
ctgactgtgcccaag

SEQ ID NO: 4732980 - DNA, 19 bp, Homo sapiens
ctgacttcaggggctgccc

SEQ ID NO: 4732981 - DNA, 21 bp, Homo sapiens
ctgacttcaggggctgcccgc

SEQ ID NO: 4732982 - DNA, 15 bp, Homo sapiens
ctgacttttctgacc

SEQ ID NO: 4732983 - DNA, 18 bp, Homo sapiens
ctgagacagcccgggctc

SEQ ID NO: 4732984 - DNA, 20 bp, Homo sapiens
ctgagacagcccgggctctg

SEQ ID NO: 4732985 - DNA, 21 bp, Homo sapiens
ctgagacagcccgggctctgc

SEQ ID NO: 4732986 - DNA, 22 bp, Homo sapiens
ctgagacagcccgggctctgcc

SEQ ID NO: 4732987 - DNA, 14 bp, Homo sapiens
ctgagagagtggca

SEQ ID NO: 4732988 - DNA, 24 bp, Homo sapiens
ctgagagagtggcattggcagcag

SEQ ID NO: 4732989 - DNA, 13 bp, Homo sapiens
ctgagagctgggc

SEQ ID NO: 4732990 - DNA, 21 bp, Homo sapiens
ctgagatttcatctgctctcc

SEQ ID NO: 4732991 - DNA, 16 bp, Homo sapiens
ctgagcagaatactgg

SEQ ID NO: 4732992 - DNA, 20 bp, Homo sapiens
ctgagcagtgaatgattcag

SEQ ID NO: 4732993 - DNA, 14 bp, Homo sapiens
ctgagcccctcaga

SEQ ID NO: 4732994 - DNA, 15 bp, Homo sapiens
ctgagcccctcagac

SEQ ID NO: 4732995 - DNA, 23 bp, Homo sapiens
ctgagcccctcagacagccccct

SEQ ID NO: 4732996 - DNA, 12 bp, Homo sapiens
ctgagctgaggc

SEQ ID NO: 4732997 - DNA, 15 bp, Homo sapiens
ctgagctgaggcagc

SEQ ID NO: 4732998 - DNA, 20 bp, Homo sapiens
ctgagctgggcagctggaag

SEQ ID NO: 4732999 - DNA, 22 bp, Homo sapiens
ctctccgcacacctctggctgt

SEQ ID NO: 4733000 - DNA, 20 bp, Homo sapiens
ctctcctccccaaggagaca

SEQ ID NO: 4733001 - DNA, 17 bp, Homo sapiens
ctctcctccgtggcaca

SEQ ID NO: 4733002 - DNA, 18 bp, Homo sapiens
ctctcctccgtggcacat

SEQ ID NO: 4733003 - DNA, 10 bp, Homo sapiens
ctctcctctg

SEQ ID NO: 4733004 - DNA, 15 bp, Homo sapiens
ctctcctctgctgct

SEQ ID NO: 4733005 - DNA, 18 bp, Homo sapiens
ctctcctctgctgctggc

SEQ ID NO: 4733006 - DNA, 16 bp, Homo sapiens
ctctccttcctggagc

SEQ ID NO: 4733007 - DNA, 13 bp, Homo sapiens
ctctctaacataa

SEQ ID NO: 4733008 - DNA, 18 bp, Homo sapiens
ctctctcactcacatttt

SEQ ID NO: 4733009 - DNA, 12 bp, Homo sapiens
ctctctcactcc

SEQ ID NO: 4733010 - DNA, 16 bp, Homo sapiens
ctctctcactccttga

SEQ ID NO: 4733011 - DNA, 14 bp, Homo sapiens
ctctctgctctgcg

SEQ ID NO: 4733012 - DNA, 20 bp, Homo sapiens
ctctcttaggagcagagctc

SEQ ID NO: 4733013 - DNA, 15 bp, Homo sapiens
ctctgaaggacattg

SEQ ID NO: 4733014 - DNA, 22 bp, Homo sapiens
ctctgaaggacattgcggacag

SEQ ID NO: 4733015 - DNA, 14 bp, Homo sapiens
ctctgacacacagc

SEQ ID NO: 4733016 - DNA, 13 bp, Homo sapiens
ctctgagcagtga

SEQ ID NO: 4733017 - DNA, 12 bp, Homo sapiens
ctctgaggacac

SEQ ID NO: 4733018 - DNA, 17 bp, Homo sapiens
ctctgattagaaaggaa

SEQ ID NO: 4733019 - DNA, 16 bp, Homo sapiens
ctctgcaccttctgac

SEQ ID NO: 4733020 - DNA, 17 bp, Homo sapiens
ctctgcagcaatattct

SEQ ID NO: 4733021 - DNA, 14 bp, Homo sapiens
ctctgcagcctcag

SEQ ID NO: 4733022 - DNA, 19 bp, Homo sapiens
ctctgcagcctcagagaca

SEQ ID NO: 4733023 - DNA, 20 bp, Homo sapiens
ctctgccatggccttggcag

SEQ ID NO: 4733024 - DNA, 16 bp, Homo sapiens
ctctgcccactccctg

SEQ ID NO: 4733025 - DNA, 23 bp, Homo sapiens
ctctgccctaatgcgcaggctgg

SEQ ID NO: 4733026 - DNA, 15 bp, Homo sapiens
ctctgccctccaaga

SEQ ID NO: 4733027 - DNA, 13 bp, Homo sapiens
ctctgcctcccat

SEQ ID NO: 4733028 - DNA, 14 bp, Homo sapiens
ctctgcctcccatc

SEQ ID NO: 4733029 - DNA, 14 bp, Homo sapiens
ctctgcctctgaca

SEQ ID NO: 4733030 - DNA, 20 bp, Homo sapiens
ctctgcctctgacacacagc

SEQ ID NO: 4733031 - DNA, 22 bp, Homo sapiens
ctctgcgtgtcacctgtgcttc

SEQ ID NO: 4733032 - DNA, 21 bp, Homo sapiens
ctctgctcctctccccagcaa

SEQ ID NO: 4733033 - DNA, 13 bp, Homo sapiens
ctctgctgacaga

SEQ ID NO: 4733034 - DNA, 16 bp, Homo sapiens
ctctgctgacagacac

SEQ ID NO: 4733035 - DNA, 22 bp, Homo sapiens
ctctgctgacagacacaggccc

SEQ ID NO: 4733036 - DNA, 13 bp, Homo sapiens
ctctgctgctggc

SEQ ID NO: 4733037 - DNA, 14 bp, Homo sapiens
ctctgctgctggct

SEQ ID NO: 4733038 - DNA, 15 bp, Homo sapiens
ctctggacaggcatg

SEQ ID NO: 4733039 - DNA, 22 bp, Homo sapiens
ctctggacaggcatgttctctg

SEQ ID NO: 4733040 - DNA, 15 bp, Homo sapiens
ctctggcagctcaga

SEQ ID NO: 4733041 - DNA, 20 bp, Homo sapiens
ctctggcagctcagagaggg

SEQ ID NO: 4733042 - DNA, 16 bp, Homo sapiens
ctctggctccagctgg

SEQ ID NO: 4733043 - DNA, 19 bp, Homo sapiens
ctctgggccaggttggaaa

SEQ ID NO: 4733044 - DNA, 23 bp, Homo sapiens
ctctgggtttacaacaaacactg

SEQ ID NO: 4733045 - DNA, 14 bp, Homo sapiens
ctctggtatctaat

SEQ ID NO: 4733046 - DNA, 21 bp, Homo sapiens
ctctggtatctaattctttaa

SEQ ID NO: 4733047 - DNA, 20 bp, Homo sapiens
ctctgtaagaaactgccaaa

SEQ ID NO: 4733048 - DNA, 14 bp, Homo sapiens
ctctgtacagagcc

SEQ ID NO: 4733049 - DNA, 18 bp, Homo sapiens
ctctgtccccttctctca

SEQ ID NO: 4733050 - DNA, 18 bp, Homo sapiens
ctctgtcctgacttcagg

SEQ ID NO: 4733051 - DNA, 14 bp, Homo sapiens
ctctgtcctgggag

SEQ ID NO: 4733052 - DNA, 13 bp, Homo sapiens
ctctgtcgcccag

SEQ ID NO: 4733053 - DNA, 15 bp, Homo sapiens
ctctgtcgcccaggc

SEQ ID NO: 4733054 - DNA, 22 bp, Homo sapiens
ctctgtcgcccaggctggagtg

SEQ ID NO: 4733055 - DNA, 14 bp, Homo sapiens
ctctgtctcatcca

SEQ ID NO: 4733056 - DNA, 20 bp, Homo sapiens
ctctgtctcatgtgtgctct

SEQ ID NO: 4733057 - DNA, 14 bp, Homo sapiens
ctctgtgaccaatg

SEQ ID NO: 4733058 - DNA, 17 bp, Homo sapiens
ctctgtgaccaatgtct

SEQ ID NO: 4733059 - DNA, 17 bp, Homo sapiens
ctctgtgagactcgaga

SEQ ID NO: 4733060 - DNA, 13 bp, Homo sapiens
ctctgtgggctgc

SEQ ID NO: 4733061 - DNA, 16 bp, Homo sapiens
ctctgtgggctgcact

SEQ ID NO: 4733062 - DNA, 18 bp, Homo sapiens
ctctgtgtcactggctgc

SEQ ID NO: 4733063 - DNA, 20 bp, Homo sapiens
ctctgtgtcactggctgcct

SEQ ID NO: 4733064 - DNA, 15 bp, Homo sapiens
ctctgtgtcaggtgg

SEQ ID NO: 4733065 - DNA, 19 bp, Homo sapiens
ctctgtgtcaggtggggca

SEQ ID NO: 4733066 - DNA, 20 bp, Homo sapiens
ctctgttctgcacacagcac

SEQ ID NO: 4733067 - DNA, 21 bp, Homo sapiens
ctctgttctgcacacagcacg

SEQ ID NO: 4733068 - DNA, 17 bp, Homo sapiens
ctcttagctcccctcca

SEQ ID NO: 4733069 - DNA, 15 bp, Homo sapiens
ctcttatctcagtca

SEQ ID NO: 4733070 - DNA, 21 bp, Homo sapiens
ctcttatctcagtcatgcata

SEQ ID NO: 4733071 - DNA, 22 bp, Homo sapiens
ctcttatctcagtcatgcataa

SEQ ID NO: 4733072 - DNA, 17 bp, Homo sapiens
ctcttcagtgtgttgac

SEQ ID NO: 4733073 - DNA, 16 bp, Homo sapiens
ctcttcccctctcaga

SEQ ID NO: 4733074 - DNA, 11 bp, Homo sapiens
ctcttctcatt

SEQ ID NO: 4733075 - DNA, 14 bp, Homo sapiens
ctcttctccccaga

SEQ ID NO: 4733076 - DNA, 15 bp, Homo sapiens
ctcttgaactcctga

SEQ ID NO: 4733077 - DNA, 22 bp, Homo sapiens
ctcttgaccctgtcacttgctg

SEQ ID NO: 4733078 - DNA, 15 bp, Homo sapiens
ctcttgacctcaggt

SEQ ID NO: 4733079 - DNA, 19 bp, Homo sapiens
ctcttgccccaacccccag

SEQ ID NO: 4733080 - DNA, 15 bp, Homo sapiens
ctcttggtcctgctg

SEQ ID NO: 4733081 - DNA, 17 bp, Homo sapiens
ctcttggtcctgctgca

SEQ ID NO: 4733082 - DNA, 22 bp, Homo sapiens
ctcttgtattgctccattttct

SEQ ID NO: 4733083 - DNA, 22 bp, Homo sapiens
ctcttgtttggagggatcattt

SEQ ID NO: 4733084 - DNA, 10 bp, Homo sapiens
ctctttgaga

SEQ ID NO: 4733085 - DNA, 19 bp, Homo sapiens
ctctttggtctacactgtg

SEQ ID NO: 4733086 - DNA, 21 bp, Homo sapiens
ctctttggtctacactgtgct

SEQ ID NO: 4733087 - DNA, 23 bp, Homo sapiens
ctctttggtctacactgtgctga

SEQ ID NO: 4733088 - DNA, 14 bp, Homo sapiens
ctcttttcaaaaca

SEQ ID NO: 4733089 - DNA, 14 bp, Homo sapiens
ctcttttcacattt

SEQ ID NO: 4733090 - DNA, 15 bp, Homo sapiens
ctcttttcacatttt

SEQ ID NO: 4733091 - DNA, 17 bp, Homo sapiens
ctcttttcacatttttt

SEQ ID NO: 4733092 - DNA, 22 bp, Homo sapiens
ctcttttcctttggtccttcaa

SEQ ID NO: 4733093 - DNA, 19 bp, Homo sapiens
ctctttttgtacctggtga

SEQ ID NO: 4733094 - DNA, 21 bp, Homo sapiens
ctctttttttttttttttaaa

SEQ ID NO: 4733095 - DNA, 15 bp, Homo sapiens
ctgaaaatataacca

SEQ ID NO: 4733096 - DNA, 22 bp, Homo sapiens
ctgaaaatataaccagccattg

SEQ ID NO: 4733097 - DNA, 17 bp, Homo sapiens
ctgaaaatatctcttgt

SEQ ID NO: 4733098 - DNA, 16 bp, Homo sapiens
ctgaaaggttaattct

SEQ ID NO: 4733099 - DNA, 22 bp, Homo sapiens
ctgaaatgagcatgcattttct

SEQ ID NO: 4733100 - DNA, 23 bp, Homo sapiens
ctgaaatgagcatgcattttctt

SEQ ID NO: 4733101 - DNA, 13 bp, Homo sapiens
ctgaaattatttt

SEQ ID NO: 4733102 - DNA, 15 bp, Homo sapiens
ctgaaattattttct

SEQ ID NO: 4733103 - DNA, 15 bp, Homo sapiens
ctgaacattccagag

SEQ ID NO: 4733104 - DNA, 13 bp, Homo sapiens
ctgaactttcatt

SEQ ID NO: 4733105 - DNA, 13 bp, Homo sapiens
ctgaactttgctg

SEQ ID NO: 4733106 - DNA, 21 bp, Homo sapiens
ctgaagactcattcttctgta

SEQ ID NO: 4733107 - DNA, 17 bp, Homo sapiens
ctgaagatattccaact

SEQ ID NO: 4733108 - DNA, 16 bp, Homo sapiens
ctgaagccaaagccaa

SEQ ID NO: 4733109 - DNA, 12 bp, Homo sapiens
ctgaaggactgt

SEQ ID NO: 4733110 - DNA, 13 bp, Homo sapiens
ctgaaggccccgc

SEQ ID NO: 4733111 - DNA, 20 bp, Homo sapiens
ctggattgggttatgaatat

SEQ ID NO: 4733112 - DNA, 15 bp, Homo sapiens
ctggcaaaataaaac

SEQ ID NO: 4733113 - DNA, 17 bp, Homo sapiens
ctggcaaaataaaacat

SEQ ID NO: 4733114 - DNA, 16 bp, Homo sapiens
ctggcaaggacacaga

SEQ ID NO: 4733115 - DNA, 12 bp, Homo sapiens
ctggcacagtgt

SEQ ID NO: 4733116 - DNA, 15 bp, Homo sapiens
ctggcacagtgtctg

SEQ ID NO: 4733117 - DNA, 21 bp, Homo sapiens
ctggcacagtgtctgggctga

SEQ ID NO: 4733118 - DNA, 20 bp, Homo sapiens
ctggcacccggcccctgctg

SEQ ID NO: 4733119 - DNA, 16 bp, Homo sapiens
ctggcacctgaaatta

SEQ ID NO: 4733120 - DNA, 20 bp, Homo sapiens
ctggcactactcagttatta

SEQ ID NO: 4733121 - DNA, 16 bp, Homo sapiens
ctggcactgcttccag

SEQ ID NO: 4733122 - DNA, 23 bp, Homo sapiens
ctggcactgcttccagtgaggct

SEQ ID NO: 4733123 - DNA, 19 bp, Homo sapiens
ctggcagagagcacagtga

SEQ ID NO: 4733124 - DNA, 19 bp, Homo sapiens
ctggcagctcagagagggt

SEQ ID NO: 4733125 - DNA, 13 bp, Homo sapiens
ctggccaccaccc

SEQ ID NO: 4733126 - DNA, 14 bp, Homo sapiens
ctggccaccacccc

SEQ ID NO: 4733127 - DNA, 16 bp, Homo sapiens
ctggccaccacccccc

SEQ ID NO: 4733128 - DNA, 14 bp, Homo sapiens
ctggccagatgcac

SEQ ID NO: 4733129 - DNA, 19 bp, Homo sapiens
ctggccagatgcaccagcc

SEQ ID NO: 4733130 - DNA, 21 bp, Homo sapiens
ctggccagatgcaccagccct

SEQ ID NO: 4733131 - DNA, 15 bp, Homo sapiens
ctggccagccccaca

SEQ ID NO: 4733132 - DNA, 16 bp, Homo sapiens
ctggccagccccacag

SEQ ID NO: 4733133 - DNA, 19 bp, Homo sapiens
ctggccagccccacagccc

SEQ ID NO: 4733134 - DNA, 21 bp, Homo sapiens
ctggccagccccacagcccac

SEQ ID NO: 4733135 - DNA, 14 bp, Homo sapiens
ctggccagggcctg

SEQ ID NO: 4733136 - DNA, 14 bp, Homo sapiens
ctggcccaccccac

SEQ ID NO: 4733137 - DNA, 15 bp, Homo sapiens
ctggcccagctcccc

SEQ ID NO: 4733138 - DNA, 16 bp, Homo sapiens
ctggcccatcagtgta

SEQ ID NO: 4733139 - DNA, 21 bp, Homo sapiens
ctggccccagccctactctgt

SEQ ID NO: 4733140 - DNA, 17 bp, Homo sapiens
ctggccctcaaggcctc

SEQ ID NO: 4733141 - DNA, 19 bp, Homo sapiens
ctggccctcaaggcctccc

SEQ ID NO: 4733142 - DNA, 21 bp, Homo sapiens
ctggccctcaaggcctcccac

SEQ ID NO: 4733143 - DNA, 14 bp, Homo sapiens
ctggccctgccctg

SEQ ID NO: 4733144 - DNA, 15 bp, Homo sapiens
ctggccctgccctgg

SEQ ID NO: 4733145 - DNA, 22 bp, Homo sapiens
ctggccgatgtgggtccctctc

SEQ ID NO: 4733146 - DNA, 23 bp, Homo sapiens
ctggccgatgtgggtccctctct

SEQ ID NO: 4733147 - DNA, 15 bp, Homo sapiens
ctggccgtgggcctg

SEQ ID NO: 4733148 - DNA, 22 bp, Homo sapiens
ctggcctcaagtgattctcctg

SEQ ID NO: 4733149 - DNA, 17 bp, Homo sapiens
ctggcctcccccacttt

SEQ ID NO: 4733150 - DNA, 12 bp, Homo sapiens
ctggcctcgcct

SEQ ID NO: 4733151 - DNA, 17 bp, Homo sapiens
ctggcctcgcctggcct

SEQ ID NO: 4733152 - DNA, 18 bp, Homo sapiens
ctggcctcgcctggcctg

SEQ ID NO: 4733153 - DNA, 19 bp, Homo sapiens
ctggcctcgcctggcctga

SEQ ID NO: 4733154 - DNA, 20 bp, Homo sapiens
ctggcctcgcctggcctgag

SEQ ID NO: 4733155 - DNA, 20 bp, Homo sapiens
ctggcctgaggtctcgctga

SEQ ID NO: 4733156 - DNA, 16 bp, Homo sapiens
ctggcctggcccctca

SEQ ID NO: 4733157 - DNA, 17 bp, Homo sapiens
ctggcctggcccctcag

SEQ ID NO: 4733158 - DNA, 17 bp, Homo sapiens
ctggccttccacttggc

SEQ ID NO: 4733159 - DNA, 19 bp, Homo sapiens
ctggctccaaaccctcgag

SEQ ID NO: 4733160 - DNA, 20 bp, Homo sapiens
ctggctccaaaccctcgagg

SEQ ID NO: 4733161 - DNA, 17 bp, Homo sapiens
ctggctcttccaggctg

SEQ ID NO: 4733162 - DNA, 18 bp, Homo sapiens
ctggctcttccaggctgg

SEQ ID NO: 4733163 - DNA, 22 bp, Homo sapiens
ctggctcttccaggctgggaga

SEQ ID NO: 4733164 - DNA, 24 bp, Homo sapiens
ctggctcttccaggctgggagagc

SEQ ID NO: 4733165 - DNA, 13 bp, Homo sapiens
ctggctgaaggac

SEQ ID NO: 4733166 - DNA, 23 bp, Homo sapiens
ctggctggggcctatcagtgtgc

SEQ ID NO: 4733167 - DNA, 24 bp, Homo sapiens
ctggctggggcctatcagtgtgcc

SEQ ID NO: 4733168 - DNA, 20 bp, Homo sapiens
ctggctgttggctgggggcc

SEQ ID NO: 4733169 - DNA, 18 bp, Homo sapiens
ctggctttgttcttgtca

SEQ ID NO: 4733170 - DNA, 19 bp, Homo sapiens
ctgtcaggattgcgagaga

SEQ ID NO: 4733171 - DNA, 23 bp, Homo sapiens
ctgtcaggattgcgagagatgtg

SEQ ID NO: 4733172 - DNA, 14 bp, Homo sapiens
ctgtcagtgccgcc

SEQ ID NO: 4733173 - DNA, 17 bp, Homo sapiens
ctgtcatttgagcaggg

SEQ ID NO: 4733174 - DNA, 18 bp, Homo sapiens
ctgtcatttgagcagggc

SEQ ID NO: 4733175 - DNA, 22 bp, Homo sapiens
ctgtcatttgagcagggctcag

SEQ ID NO: 4733176 - DNA, 23 bp, Homo sapiens
ctgtcatttgagcagggctcagc

SEQ ID NO: 4733177 - DNA, 16 bp, Homo sapiens
ctgtccaggcactgag

SEQ ID NO: 4733178 - DNA, 19 bp, Homo sapiens
ctgtccaggcactgagata

SEQ ID NO: 4733179 - DNA, 14 bp, Homo sapiens
ctgtccagtgccca

SEQ ID NO: 4733180 - DNA, 15 bp, Homo sapiens
ctgtccagtgcccat

SEQ ID NO: 4733181 - DNA, 19 bp, Homo sapiens
ctgtcccaccatgcagtgc

SEQ ID NO: 4733182 - DNA, 19 bp, Homo sapiens
ctgtcccaggttatctggg

SEQ ID NO: 4733183 - DNA, 14 bp, Homo sapiens
ctgtccccttctct

SEQ ID NO: 4733184 - DNA, 20 bp, Homo sapiens
ctgtcccttgcccccctggc

SEQ ID NO: 4733185 - DNA, 16 bp, Homo sapiens
ctgtccgagacagccg

SEQ ID NO: 4733186 - DNA, 21 bp, Homo sapiens
ctgtcctattatattcattct

SEQ ID NO: 4733187 - DNA, 20 bp, Homo sapiens
ctgtcctgacttcaggggct

SEQ ID NO: 4733188 - DNA, 17 bp, Homo sapiens
ctgtcctgctccacagt

SEQ ID NO: 4733189 - DNA, 12 bp, Homo sapiens
ctgtcctggaac

SEQ ID NO: 4733190 - DNA, 21 bp, Homo sapiens
ctgtcctggaaccaggcttgc

SEQ ID NO: 4733191 - DNA, 14 bp, Homo sapiens
ctgtcctgggagtg

SEQ ID NO: 4733192 - DNA, 20 bp, Homo sapiens
ctgtcctgggagtgagctgg

SEQ ID NO: 4733193 - DNA, 15 bp, Homo sapiens
ctgtcgcccagtctg

SEQ ID NO: 4733194 - DNA, 20 bp, Homo sapiens
ctgtctccatggccctgcaa

SEQ ID NO: 4733195 - DNA, 21 bp, Homo sapiens
ctgtcttaaactaaatgtgca

SEQ ID NO: 4733196 - DNA, 21 bp, Homo sapiens
ctgtcttcttcagggtcctga

SEQ ID NO: 4733197 - DNA, 16 bp, Homo sapiens
ctgtgaagagactctg

SEQ ID NO: 4733198 - DNA, 14 bp, Homo sapiens
ctgtgaagtaagga

SEQ ID NO: 4733199 - DNA, 15 bp, Homo sapiens
ctgtgaatgcttctg

SEQ ID NO: 4733200 - DNA, 19 bp, Homo sapiens
ctgtgaatttgtgtaagga

SEQ ID NO: 4733201 - DNA, 21 bp, Homo sapiens
ctgtgacaccccccttctgaa

SEQ ID NO: 4733202 - DNA, 16 bp, Homo sapiens
ctgtgacaggcagcag

SEQ ID NO: 4733203 - DNA, 17 bp, Homo sapiens
ctgtgacaggcagcaga

SEQ ID NO: 4733204 - DNA, 16 bp, Homo sapiens
ctgtgaccaatgtctt

SEQ ID NO: 4733205 - DNA, 14 bp, Homo sapiens
ctgtgaccctagtt

SEQ ID NO: 4733206 - DNA, 14 bp, Homo sapiens
ctgtgatgtcccag

SEQ ID NO: 4733207 - DNA, 15 bp, Homo sapiens
ctgtgcaaacagtgt

SEQ ID NO: 4733208 - DNA, 20 bp, Homo sapiens
ctgtgcacatctgtgtcttg

SEQ ID NO: 4733209 - DNA, 17 bp, Homo sapiens
ctgtgcacgcagtggcc

SEQ ID NO: 4733210 - DNA, 19 bp, Homo sapiens
ctgtgcagccgctgagcga

SEQ ID NO: 4733211 - DNA, 15 bp, Homo sapiens
ctgtgccaccctggg

SEQ ID NO: 4733212 - DNA, 16 bp, Homo sapiens
ctgtgccaccctgggc

SEQ ID NO: 4733213 - DNA, 20 bp, Homo sapiens
ctgtgccaccctgggctctg

SEQ ID NO: 4733214 - DNA, 22 bp, Homo sapiens
ctgtgccatacttgttctgtat

SEQ ID NO: 4733215 - DNA, 14 bp, Homo sapiens
ctgtgccatgtgcc

SEQ ID NO: 4733216 - DNA, 15 bp, Homo sapiens
ctgtgccatgtgcca

SEQ ID NO: 4733217 - DNA, 12 bp, Homo sapiens
ctgtgcccatgg

SEQ ID NO: 4733218 - DNA, 13 bp, Homo sapiens
ctgtgcccatggg

SEQ ID NO: 4733219 - DNA, 15 bp, Homo sapiens
ctgtgcccatgggca

SEQ ID NO: 4733220 - DNA, 20 bp, Homo sapiens
ctgtgcccatgggcactgct

SEQ ID NO: 4733221 - DNA, 17 bp, Homo sapiens
ctgtgcctgaccttgag

SEQ ID NO: 4733222 - DNA, 15 bp, Homo sapiens
ctgtgctctggacag

SEQ ID NO: 4733223 - DNA, 17 bp, Homo sapiens
ctgtgctctggacaggc

SEQ ID NO: 4733224 - DNA, 20 bp, Homo sapiens
ctgccctgcccacctggcct

SEQ ID NO: 4733225 - DNA, 22 bp, Homo sapiens
ctgccctgctgagtcccaggct

SEQ ID NO: 4733226 - DNA, 22 bp, Homo sapiens
ctgccctggtttcctgccctgg

SEQ ID NO: 4733227 - DNA, 13 bp, Homo sapiens
ctgccctgtgagt

SEQ ID NO: 4733228 - DNA, 14 bp, Homo sapiens
ctgccctgtgggcc

SEQ ID NO: 4733229 - DNA, 15 bp, Homo sapiens
ctgccctgtgggccc

SEQ ID NO: 4733230 - DNA, 16 bp, Homo sapiens
ctgccgcagagctggc

SEQ ID NO: 4733231 - DNA, 16 bp, Homo sapiens
ctgccgccccacccag

SEQ ID NO: 4733232 - DNA, 15 bp, Homo sapiens
ctgccgtaatttaac

SEQ ID NO: 4733233 - DNA, 14 bp, Homo sapiens
ctgcctccactccc

SEQ ID NO: 4733234 - DNA, 15 bp, Homo sapiens
ctgcctccactccca

SEQ ID NO: 4733235 - DNA, 16 bp, Homo sapiens
ctgcctccactcccac

SEQ ID NO: 4733236 - DNA, 14 bp, Homo sapiens
ctgcctcccatcac

SEQ ID NO: 4733237 - DNA, 16 bp, Homo sapiens
ctgcctcccatcaccc

SEQ ID NO: 4733238 - DNA, 15 bp, Homo sapiens
ctgcctcccttcatg

SEQ ID NO: 4733239 - DNA, 18 bp, Homo sapiens
ctgcctcccttcatgcat

SEQ ID NO: 4733240 - DNA, 14 bp, Homo sapiens
ctgcctcctttgtg

SEQ ID NO: 4733241 - DNA, 23 bp, Homo sapiens
ctgcctcctttgtgaggaagccg

SEQ ID NO: 4733242 - DNA, 22 bp, Homo sapiens
ctgcctctgacacacagctctg

SEQ ID NO: 4733243 - DNA, 13 bp, Homo sapiens
ctgcctgctgcag

SEQ ID NO: 4733244 - DNA, 15 bp, Homo sapiens
ctgcctgctgcagtc

SEQ ID NO: 4733245 - DNA, 21 bp, Homo sapiens
ctgcctgggatccctcatcct

SEQ ID NO: 4733246 - DNA, 23 bp, Homo sapiens
ctgcctgggatccctcatcctca

SEQ ID NO: 4733247 - DNA, 18 bp, Homo sapiens
ctgccttcctcctgggcc

SEQ ID NO: 4733248 - DNA, 15 bp, Homo sapiens
ctgccttctcaggga

SEQ ID NO: 4733249 - DNA, 20 bp, Homo sapiens
ctgcggaatgaaccacatct

SEQ ID NO: 4733250 - DNA, 22 bp, Homo sapiens
ctgcgggtcacaggagggaggg

SEQ ID NO: 4733251 - DNA, 23 bp, Homo sapiens
ctgcgggtcacaggagggagggg

SEQ ID NO: 4733252 - DNA, 19 bp, Homo sapiens
ctgcggtccacccaggagc

SEQ ID NO: 4733253 - DNA, 21 bp, Homo sapiens
ctgcggtgctatctcccccag

SEQ ID NO: 4733254 - DNA, 12 bp, Homo sapiens
ctgcgtgtgtct

SEQ ID NO: 4733255 - DNA, 15 bp, Homo sapiens
ctgcgtgtgtctgtg

SEQ ID NO: 4733256 - DNA, 16 bp, Homo sapiens
ctgctaccctccctgc

SEQ ID NO: 4733257 - DNA, 19 bp, Homo sapiens
ctgctcacatatctgtcat

SEQ ID NO: 4733258 - DNA, 13 bp, Homo sapiens
ctgctcactggtc

SEQ ID NO: 4733259 - DNA, 12 bp, Homo sapiens
ctgctccacagt

SEQ ID NO: 4733260 - DNA, 20 bp, Homo sapiens
ctgctcctctccccagcaag

SEQ ID NO: 4733261 - DNA, 23 bp, Homo sapiens
ctgctcctctccccagcaagtga

SEQ ID NO: 4733262 - DNA, 14 bp, Homo sapiens
ctgctcgggcccag

SEQ ID NO: 4733263 - DNA, 23 bp, Homo sapiens
ctgctctaagaagctgcaataaa

SEQ ID NO: 4733264 - DNA, 17 bp, Homo sapiens
ctgctctcatataagac

SEQ ID NO: 4733265 - DNA, 19 bp, Homo sapiens
ctgctctccgaccagacac

SEQ ID NO: 4733266 - DNA, 20 bp, Homo sapiens
ctgctctccttcctggagcc

SEQ ID NO: 4733267 - DNA, 16 bp, Homo sapiens
ctgctcttgaactcct

SEQ ID NO: 4733268 - DNA, 18 bp, Homo sapiens
ctgctcttgaactcctga

SEQ ID NO: 4733269 - DNA, 12 bp, Homo sapiens
ctgctgaaggct

SEQ ID NO: 4733270 - DNA, 14 bp, Homo sapiens
ctgctgaaggctcg

SEQ ID NO: 4733271 - DNA, 18 bp, Homo sapiens
ctgctgaaggctcgagca

SEQ ID NO: 4733272 - DNA, 19 bp, Homo sapiens
ctgctgacagacacaggcc

SEQ ID NO: 4733273 - DNA, 15 bp, Homo sapiens
ctgctgcaccaaccc

SEQ ID NO: 4733274 - DNA, 23 bp, Homo sapiens
ctgctgcagaggggcaggccctg

SEQ ID NO: 4733275 - DNA, 14 bp, Homo sapiens
ctgctgcagttgcc

SEQ ID NO: 4733276 - DNA, 12 bp, Homo sapiens
ctgctgcccctc

SEQ ID NO: 4733277 - DNA, 14 bp, Homo sapiens
ctgctgcccctccc

SEQ ID NO: 4733278 - DNA, 15 bp, Homo sapiens
ctgctgctgcctgcc

SEQ ID NO: 4733279 - DNA, 16 bp, Homo sapiens
ctgctggctggtgcct

SEQ ID NO: 4733280 - DNA, 15 bp, Homo sapiens
ctgctggctgtgaca

SEQ ID NO: 4733281 - DNA, 12 bp, Homo sapiens
ctgctgggctgg

SEQ ID NO: 4733282 - DNA, 18 bp, Homo sapiens
ctgctgggctggggcctg

SEQ ID NO: 4733283 - DNA, 21 bp, Homo sapiens
ctgctgggctggggcctgatg

SEQ ID NO: 4733284 - DNA, 16 bp, Homo sapiens
ctgctgggtggcccat

SEQ ID NO: 4733285 - DNA, 21 bp, Homo sapiens
ctgctgtcccctcttgcccca

SEQ ID NO: 4733286 - DNA, 13 bp, Homo sapiens
ctgcttcagcctc

SEQ ID NO: 4733287 - DNA, 15 bp, Homo sapiens
ctgcttccagtgagg

SEQ ID NO: 4733288 - DNA, 20 bp, Homo sapiens
atgaggtcagagcctgcagt

SEQ ID NO: 4733289 - DNA, 19 bp, Homo sapiens
atgagtgcgtggtgcgagt

SEQ ID NO: 4733290 - DNA, 13 bp, Homo sapiens
atgatcaataaag

SEQ ID NO: 4733291 - DNA, 15 bp, Homo sapiens
atgatcacggctcac

SEQ ID NO: 4733292 - DNA, 18 bp, Homo sapiens
atgatcacggctcactgc

SEQ ID NO: 4733293 - DNA, 15 bp, Homo sapiens
atgatctaggaagac

SEQ ID NO: 4733294 - DNA, 17 bp, Homo sapiens
atgatctttgcagacag

SEQ ID NO: 4733295 - DNA, 15 bp, Homo sapiens
atgatcttttcaagt

SEQ ID NO: 4733296 - DNA, 23 bp, Homo sapiens
atgatgaaatgaggtcagagcct

SEQ ID NO: 4733297 - DNA, 15 bp, Homo sapiens
atgatgcatggagtg

SEQ ID NO: 4733298 - DNA, 18 bp, Homo sapiens
atgatgccacaccaagct

SEQ ID NO: 4733299 - DNA, 18 bp, Homo sapiens
atgatgcttttatagctg

SEQ ID NO: 4733300 - DNA, 19 bp, Homo sapiens
atgatgtgggtcaaggaat

SEQ ID NO: 4733301 - DNA, 21 bp, Homo sapiens
atgattcttccagataatgtc

SEQ ID NO: 4733302 - DNA, 16 bp, Homo sapiens
atgatttaataaaata

SEQ ID NO: 4733303 - DNA, 22 bp, Homo sapiens
atgatttaataaaataattcta

SEQ ID NO: 4733304 - DNA, 13 bp, Homo sapiens
atgatttcacagt

SEQ ID NO: 4733305 - DNA, 14 bp, Homo sapiens
atgatttttaaaga

SEQ ID NO: 4733306 - DNA, 21 bp, Homo sapiens
atgatttttgtgtatccagta

SEQ ID NO: 4733307 - DNA, 13 bp, Homo sapiens
atgcaaaggctgg

SEQ ID NO: 4733308 - DNA, 15 bp, Homo sapiens
atgcaaaggctggga

SEQ ID NO: 4733309 - DNA, 14 bp, Homo sapiens
atgcaacaacatgt

SEQ ID NO: 4733310 - DNA, 16 bp, Homo sapiens
atgcaacaacatgtat

SEQ ID NO: 4733311 - DNA, 21 bp, Homo sapiens
atgcaacaacatgtataatat

SEQ ID NO: 4733312 - DNA, 19 bp, Homo sapiens
atgcaagtgggagatgaaa

SEQ ID NO: 4733313 - DNA, 21 bp, Homo sapiens
atgcacacttttaattttgtc

SEQ ID NO: 4733314 - DNA, 22 bp, Homo sapiens
atgcaccagcccttagcaggga

SEQ ID NO: 4733315 - DNA, 20 bp, Homo sapiens
atgcaccctcatacacagaa

SEQ ID NO: 4733316 - DNA, 14 bp, Homo sapiens
atgcacgttaacag

SEQ ID NO: 4733317 - DNA, 18 bp, Homo sapiens
atgcacgttaacagcgtg

SEQ ID NO: 4733318 - DNA, 21 bp, Homo sapiens
atgcactgttccccctgtgca

SEQ ID NO: 4733319 - DNA, 19 bp, Homo sapiens
atgcactttgttctggctc

SEQ ID NO: 4733320 - DNA, 21 bp, Homo sapiens
atgcactttgttctggctctt

SEQ ID NO: 4733321 - DNA, 23 bp, Homo sapiens
atgcactttgttctggctcttcc

SEQ ID NO: 4733322 - DNA, 19 bp, Homo sapiens
atgcagagagccattttgt

SEQ ID NO: 4733323 - DNA, 13 bp, Homo sapiens
aaaaaaacacaaa

SEQ ID NO: 4733324 - DNA, 18 bp, Homo sapiens
aaaaaaacagtggatcac

SEQ ID NO: 4733325 - DNA, 21 bp, Homo sapiens
aaaaaattattcatgctctca

SEQ ID NO: 4733326 - DNA, 15 bp, Homo sapiens
aaaaagaaaggaggg

SEQ ID NO: 4733327 - DNA, 23 bp, Homo sapiens
aaaaagagctcaggcttttccag

SEQ ID NO: 4733328 - DNA, 14 bp, Homo sapiens
aaaaagtataaaat

SEQ ID NO: 4733329 - DNA, 14 bp, Homo sapiens
aaaaataacaatga

SEQ ID NO: 4733330 - DNA, 14 bp, Homo sapiens
aaaaatagcaactt

SEQ ID NO: 4733331 - DNA, 11 bp, Homo sapiens
aaaaatatatt

SEQ ID NO: 4733332 - DNA, 21 bp, Homo sapiens
aaaaatatcaagtactacatt

SEQ ID NO: 4733333 - DNA, 13 bp, Homo sapiens
aaaaatgcctttg

SEQ ID NO: 4733334 - DNA, 20 bp, Homo sapiens
aaaaatgcctttgagacagt

SEQ ID NO: 4733335 - DNA, 24 bp, Homo sapiens
aaaaatgcctttgagacagtttct

SEQ ID NO: 4733336 - DNA, 19 bp, Homo sapiens
aaaaatgtgaaaaaaatta

SEQ ID NO: 4733337 - DNA, 13 bp, Homo sapiens
aaaaatttaagtg

SEQ ID NO: 4733338 - DNA, 20 bp, Homo sapiens
aaaacaattgttctgggtga

SEQ ID NO: 4733339 - DNA, 15 bp, Homo sapiens
aaaacagaaaaataa

SEQ ID NO: 4733340 - DNA, 20 bp, Homo sapiens
aaaacatgttagtcaaggac

SEQ ID NO: 4733341 - DNA, 15 bp, Homo sapiens
aaaacatgtttctgc

SEQ ID NO: 4733342 - DNA, 21 bp, Homo sapiens
aaaaccatcttctgtgtttat

SEQ ID NO: 4733343 - DNA, 17 bp, Homo sapiens
aaaacccattgtcttta

SEQ ID NO: 4733344 - DNA, 18 bp, Homo sapiens
aaaacctgaactttcatt

SEQ ID NO: 4733345 - DNA, 14 bp, Homo sapiens
aaaactatttaaca

SEQ ID NO: 4733346 - DNA, 12 bp, Homo sapiens
aaaagaaaattt

SEQ ID NO: 4733347 - DNA, 21 bp, Homo sapiens
aaaagaaaggttgcgtttaat

SEQ ID NO: 4733348 - DNA, 15 bp, Homo sapiens
aaaagaaatcaattt

SEQ ID NO: 4733349 - DNA, 10 bp, Homo sapiens
aaaagactca

SEQ ID NO: 4733350 - DNA, 11 bp, Homo sapiens
aaaagactcat

SEQ ID NO: 4733351 - DNA, 21 bp, Homo sapiens
aaaagagcagtggtaagaata

SEQ ID NO: 4733352 - DNA, 14 bp, Homo sapiens
aaaagatgtatatt

SEQ ID NO: 4733353 - DNA, 23 bp, Homo sapiens
aaaagatgtatatttgcatattt

SEQ ID NO: 4733354 - DNA, 22 bp, Homo sapiens
aaaagcaggcttctatgaaaga

SEQ ID NO: 4733355 - DNA, 18 bp, Homo sapiens
aaaagcatggccctgctg

SEQ ID NO: 4733356 - DNA, 14 bp, Homo sapiens
aaaagcctctgtgt

SEQ ID NO: 4733357 - DNA, 17 bp, Homo sapiens
aaaagctattagccagg

SEQ ID NO: 4733358 - DNA, 21 bp, Homo sapiens
aaaagctattagccaggatca

SEQ ID NO: 4733359 - DNA, 22 bp, Homo sapiens
aaaaggagccaatttaaagaaa

SEQ ID NO: 4733360 - DNA, 16 bp, Homo sapiens
aaaaggttttattttg

SEQ ID NO: 4733361 - DNA, 19 bp, Homo sapiens
aaaaggttttattttgtaa

SEQ ID NO: 4733362 - DNA, 23 bp, Homo sapiens
aaaaggttttattttgtaattat

SEQ ID NO: 4733363 - DNA, 17 bp, Homo sapiens
aaaagtcataaatgcat

SEQ ID NO: 4733364 - DNA, 14 bp, Homo sapiens
aaaagtgtcctata

SEQ ID NO: 4733365 - DNA, 19 bp, Homo sapiens
aaaagtgtcctataattct

SEQ ID NO: 4733366 - DNA, 12 bp, Homo sapiens
aaaagtttgtcc

SEQ ID NO: 4733367 - DNA, 15 bp, Homo sapiens
aaaagttttgttctt

SEQ ID NO: 4733368 - DNA, 18 bp, Homo sapiens
aaagcttggttctgtgaa

SEQ ID NO: 4733369 - DNA, 13 bp, Homo sapiens
aaaggataaagaa

SEQ ID NO: 4733370 - DNA, 22 bp, Homo sapiens
aaaggataaagaaggatgatgt

SEQ ID NO: 4733371 - DNA, 16 bp, Homo sapiens
aaaggatgagggttca

SEQ ID NO: 4733372 - DNA, 20 bp, Homo sapiens
aaaggcaatggtttgtgtca

SEQ ID NO: 4733373 - DNA, 19 bp, Homo sapiens
aaaggccatggagagctgg

SEQ ID NO: 4733374 - DNA, 21 bp, Homo sapiens
aaaggctccaggagcagccac

SEQ ID NO: 4733375 - DNA, 22 bp, Homo sapiens
aaaggctccaggagcagccaca

SEQ ID NO: 4733376 - DNA, 17 bp, Homo sapiens
aaagggcagccctcctt

SEQ ID NO: 4733377 - DNA, 21 bp, Homo sapiens
aaagtacttctccaccctgct

SEQ ID NO: 4733378 - DNA, 23 bp, Homo sapiens
aaagtagattatggcctttttaa

SEQ ID NO: 4733379 - DNA, 18 bp, Homo sapiens
aaagtgaattgttgacaa

SEQ ID NO: 4733380 - DNA, 22 bp, Homo sapiens
aaagtgcacacctttattcaga

SEQ ID NO: 4733381 - DNA, 16 bp, Homo sapiens
aaagtggtatagaaat

SEQ ID NO: 4733382 - DNA, 13 bp, Homo sapiens
aaagttccagttt

SEQ ID NO: 4733383 - DNA, 16 bp, Homo sapiens
aaagttccagttttgt

SEQ ID NO: 4733384 - DNA, 23 bp, Homo sapiens
aaagttgcctttatttgctgtta

SEQ ID NO: 4733385 - DNA, 17 bp, Homo sapiens
aaagttgtataaaaaca

SEQ ID NO: 4733386 - DNA, 13 bp, Homo sapiens
aaagttttgaaaa

SEQ ID NO: 4733387 - DNA, 16 bp, Homo sapiens
aaagttttgaaaagct

SEQ ID NO: 4733388 - DNA, 19 bp, Homo sapiens
aaagttttgaaaagctatt

SEQ ID NO: 4733389 - DNA, 17 bp, Homo sapiens
aaagttttgttctgtat

SEQ ID NO: 4733390 - DNA, 23 bp, Homo sapiens
aaataaaaagggcagccctcctt

SEQ ID NO: 4733391 - DNA, 14 bp, Homo sapiens
aaataaaatatatc

SEQ ID NO: 4733392 - DNA, 15 bp, Homo sapiens
aaataaaatggattt

SEQ ID NO: 4733393 - DNA, 14 bp, Homo sapiens
aaataaagaatgga

SEQ ID NO: 4733394 - DNA, 15 bp, Homo sapiens
aaataaagtgtgtgt

SEQ ID NO: 4733395 - DNA, 16 bp, Homo sapiens
aaataaagtgtgtgtg

SEQ ID NO: 4733396 - DNA, 15 bp, Homo sapiens
aaataacaatgttaa

SEQ ID NO: 4733397 - DNA, 19 bp, Homo sapiens
aaataaccaatcctggaca

SEQ ID NO: 4733398 - DNA, 13 bp, Homo sapiens
aaataattctaaa

SEQ ID NO: 4733399 - DNA, 15 bp, Homo sapiens
aaataattctaaagg

SEQ ID NO: 4733400 - DNA, 17 bp, Homo sapiens
aaatacacttttttcca

SEQ ID NO: 4733401 - DNA, 14 bp, Homo sapiens
aaatactatccaaa

SEQ ID NO: 4733402 - DNA, 17 bp, Homo sapiens
aaatactatccaaataa

SEQ ID NO: 4733403 - DNA, 18 bp, Homo sapiens
aaatactggactcaggaa

SEQ ID NO: 4733404 - DNA, 21 bp, Homo sapiens
aaatactggactcaggaactt

SEQ ID NO: 4733405 - DNA, 13 bp, Homo sapiens
aaatagattttaa

SEQ ID NO: 4733406 - DNA, 14 bp, Homo sapiens
aaataggagaggat

SEQ ID NO: 4733407 - DNA, 22 bp, Homo sapiens
aaatagggtccttgaaacagaa

SEQ ID NO: 4733408 - DNA, 16 bp, Homo sapiens
aaatagtatgaaaatg

SEQ ID NO: 4733409 - DNA, 14 bp, Homo sapiens
aaatatacatttgt

SEQ ID NO: 4733410 - DNA, 15 bp, Homo sapiens
aaatatatgaacatt

SEQ ID NO: 4733411 - DNA, 22 bp, Homo sapiens
aaatatcccttggacattttat

SEQ ID NO: 4733412 - DNA, 19 bp, Homo sapiens
aaatatccctttttcacat

SEQ ID NO: 4733413 - DNA, 19 bp, Homo sapiens
aaatatctcttgtgctttt

SEQ ID NO: 4733414 - DNA, 16 bp, Homo sapiens
aaatatcttttgacct

SEQ ID NO: 4733415 - DNA, 23 bp, Homo sapiens
aaatatgcagtgatatggcagaa

SEQ ID NO: 4733416 - DNA, 13 bp, Homo sapiens
aaatatgtgaaga

SEQ ID NO: 4733417 - DNA, 18 bp, Homo sapiens
aaatattccctagaaact

SEQ ID NO: 4733418 - DNA, 16 bp, Homo sapiens
aaatattcctttgcat

SEQ ID NO: 4733419 - DNA, 13 bp, Homo sapiens
aaatattgctggg

SEQ ID NO: 4733420 - DNA, 23 bp, Homo sapiens
aaatcaacttgtggttgaccgct

SEQ ID NO: 4733421 - DNA, 17 bp, Homo sapiens
aaatcaagcaagcctct

SEQ ID NO: 4733422 - DNA, 13 bp, Homo sapiens
aaatcaatttttt

SEQ ID NO: 4733423 - DNA, 18 bp, Homo sapiens
aaatcagtgggttaattt

SEQ ID NO: 4733424 - DNA, 17 bp, Homo sapiens
aaatccagtattatatt

SEQ ID NO: 4733425 - DNA, 13 bp, Homo sapiens
aaatccccttctc

SEQ ID NO: 4733426 - DNA, 13 bp, Homo sapiens
aaatcctgaataa

SEQ ID NO: 4733427 - DNA, 17 bp, Homo sapiens
aaatcgccttatgagaa

SEQ ID NO: 4733428 - DNA, 22 bp, Homo sapiens
aaatcgccttatgagaacatgg

SEQ ID NO: 4733429 - DNA, 13 bp, Homo sapiens
aaatctgaagaaa

SEQ ID NO: 4733430 - DNA, 23 bp, Homo sapiens
aaatctgttgttccaaatgtgta

SEQ ID NO: 4733431 - DNA, 16 bp, Homo sapiens
aaatcttcagctggtg

SEQ ID NO: 4733432 - DNA, 19 bp, Homo sapiens
aaatcttcagctggtggat

SEQ ID NO: 4733433 - DNA, 17 bp, Homo sapiens
aaatgaaaatcgtgaca

SEQ ID NO: 4733434 - DNA, 14 bp, Homo sapiens
aaatgaacacatgg

SEQ ID NO: 4733435 - DNA, 22 bp, Homo sapiens
aaatgaaccttgctatcaagaa

SEQ ID NO: 4733436 - DNA, 16 bp, Homo sapiens
aaatgaatttgactgg

SEQ ID NO: 4733437 - DNA, 15 bp, Homo sapiens
aaatgatcagttttt

SEQ ID NO: 4733438 - DNA, 16 bp, Homo sapiens
aaatgatcagtttttt

SEQ ID NO: 4733439 - DNA, 16 bp, Homo sapiens
aaatgatcttttcaag

SEQ ID NO: 4733440 - DNA, 16 bp, Homo sapiens
aaatgcaacaacatgt

SEQ ID NO: 4733441 - DNA, 14 bp, Homo sapiens
aaatgcatttctaa

SEQ ID NO: 4733442 - DNA, 18 bp, Homo sapiens
aaatgcccagccccttct

SEQ ID NO: 4733443 - DNA, 16 bp, Homo sapiens
aaatgcctttgagaca

SEQ ID NO: 4733444 - DNA, 18 bp, Homo sapiens
aaatgctcgtcatacagt

SEQ ID NO: 4733445 - DNA, 21 bp, Homo sapiens
aaatgctcgtcatacagtaaa

SEQ ID NO: 4733446 - DNA, 13 bp, Homo sapiens
aaatgctctgatt

SEQ ID NO: 4733447 - DNA, 15 bp, Homo sapiens
aaatgggaatttata

SEQ ID NO: 4733448 - DNA, 18 bp, Homo sapiens
aaatgggcagagcagaga

SEQ ID NO: 4733449 - DNA, 14 bp, Homo sapiens
aaatggtgccttca

SEQ ID NO: 4733450 - DNA, 17 bp, Homo sapiens
aaatgtaattataagct

SEQ ID NO: 4733451 - DNA, 18 bp, Homo sapiens
aaatgtatgattacatca

SEQ ID NO: 4733452 - DNA, 21 bp, Homo sapiens
aaatgtctctttaatgtcaca

SEQ ID NO: 4733453 - DNA, 13 bp, Homo sapiens
aaatgtgaaaaaa

SEQ ID NO: 4733454 - DNA, 16 bp, Homo sapiens
aaatgttcacttttga

SEQ ID NO: 4733455 - DNA, 17 bp, Homo sapiens
aaatgtttaaacatttt

SEQ ID NO: 4733456 - DNA, 18 bp, Homo sapiens
aaatgtttgttatttaca

SEQ ID NO: 4733457 - DNA, 21 bp, Homo sapiens
aaattaacactgcttgtgttt

SEQ ID NO: 4733458 - DNA, 14 bp, Homo sapiens
aaattaattatatt

SEQ ID NO: 4733459 - DNA, 13 bp, Homo sapiens
aaattactccaag

SEQ ID NO: 4733460 - DNA, 14 bp, Homo sapiens
aaattatcagttat

SEQ ID NO: 4733461 - DNA, 13 bp, Homo sapiens
aaattatgtgaaa

SEQ ID NO: 4733462 - DNA, 12 bp, Homo sapiens
aaattatgtttt

SEQ ID NO: 4733463 - DNA, 13 bp, Homo sapiens
aaattatttgcat

SEQ ID NO: 4733464 - DNA, 13 bp, Homo sapiens
aaattcaatgatt

SEQ ID NO: 4733465 - DNA, 15 bp, Homo sapiens
aaattcaatgattct

SEQ ID NO: 4733466 - DNA, 12 bp, Homo sapiens
aaattcccatga

SEQ ID NO: 4733467 - DNA, 14 bp, Homo sapiens
aaattgatcattca

SEQ ID NO: 4733468 - DNA, 23 bp, Homo sapiens
aaattgatttgttatggttacat

SEQ ID NO: 4733469 - DNA, 21 bp, Homo sapiens
aaattgtcccttaaacaaaaa

SEQ ID NO: 4733470 - DNA, 19 bp, Homo sapiens
aaattgtgggtctatttct

SEQ ID NO: 4733471 - DNA, 16 bp, Homo sapiens
aaattgtgtacacttt

SEQ ID NO: 4733472 - DNA, 23 bp, Homo sapiens
aaattgtgtacactttcattact

SEQ ID NO: 4733473 - DNA, 14 bp, Homo sapiens
aaatttccactcag

SEQ ID NO: 4733474 - DNA, 14 bp, Homo sapiens
aaatttgaagtatt

SEQ ID NO: 4733475 - DNA, 22 bp, Homo sapiens
aaatttgaagtattagacttct

SEQ ID NO: 4733476 - DNA, 12 bp, Homo sapiens
aaatttgtaagt

SEQ ID NO: 4733477 - DNA, 17 bp, Homo sapiens
aaatttgtaagtttcag

SEQ ID NO: 4733478 - DNA, 22 bp, Homo sapiens
aaatttgttgtcatgtgtatga

SEQ ID NO: 4733479 - DNA, 23 bp, Homo sapiens
aaattttgagcaaagaaacttgt

SEQ ID NO: 4733480 - DNA, 17 bp, Homo sapiens
aaattttgaggtctttt

SEQ ID NO: 4733481 - DNA, 23 bp, Homo sapiens
aaattttgtgatgaataaaataa

SEQ ID NO: 4733482 - DNA, 21 bp, Homo sapiens
aaatttttgttggcttgcttg

SEQ ID NO: 4733483 - DNA, 18 bp, Homo sapiens
aaattttttttgtttcat

SEQ ID NO: 4733484 - DNA, 20 bp, Homo sapiens
aacaaatgctctgtcttcaa

SEQ ID NO: 4733485 - DNA, 21 bp, Homo sapiens
aacaaatgctctgtcttcaat

SEQ ID NO: 4733486 - DNA, 15 bp, Homo sapiens
aacaactctttgaga

SEQ ID NO: 4733487 - DNA, 12 bp, Homo sapiens
aacaagcttcag

SEQ ID NO: 4733488 - DNA, 14 bp, Homo sapiens
aacaaggaagtcaa

SEQ ID NO: 4733489 - DNA, 18 bp, Homo sapiens
aacaatagtaattctcag

SEQ ID NO: 4733490 - DNA, 15 bp, Homo sapiens
aacaatcacaaaagc

SEQ ID NO: 4733491 - DNA, 20 bp, Homo sapiens
aacaatcacaaaagctgtgt

SEQ ID NO: 4733492 - DNA, 15 bp, Homo sapiens
aacaatgaaattgac

SEQ ID NO: 4733493 - DNA, 12 bp, Homo sapiens
aacaatgttaag

SEQ ID NO: 4733494 - DNA, 13 bp, Homo sapiens
aacaatgttaagg

SEQ ID NO: 4733495 - DNA, 13 bp, Homo sapiens
aacacatggcaga

SEQ ID NO: 4733496 - DNA, 17 bp, Homo sapiens
aacaccctcacactggg

SEQ ID NO: 4733497 - DNA, 17 bp, Homo sapiens
aacactatatattttat

SEQ ID NO: 4733498 - DNA, 20 bp, Homo sapiens
aacactatatggcagtgtct

SEQ ID NO: 4733499 - DNA, 21 bp, Homo sapiens
aacactcattgacctgaggcc

SEQ ID NO: 4733500 - DNA, 14 bp, Homo sapiens
aacactcatttcca

SEQ ID NO: 4733501 - DNA, 17 bp, Homo sapiens
aacactgcttgtgtttt

SEQ ID NO: 4733502 - DNA, 15 bp, Homo sapiens
aacactgttctctgc

SEQ ID NO: 4733503 - DNA, 17 bp, Homo sapiens
aacactgttctctgccc

SEQ ID NO: 4733504 - DNA, 19 bp, Homo sapiens
aacactgttctctgccctc

SEQ ID NO: 4733505 - DNA, 13 bp, Homo sapiens
aacagaaaaataa

SEQ ID NO: 4733506 - DNA, 18 bp, Homo sapiens
aacagaaatgctctgatt

SEQ ID NO: 4733507 - DNA, 19 bp, Homo sapiens
aacagaaatgctctgatta

SEQ ID NO: 4733508 - DNA, 13 bp, Homo sapiens
aacagaacagctt

SEQ ID NO: 4733509 - DNA, 22 bp, Homo sapiens
aacagatgtccctgaagtcttg

SEQ ID NO: 4733510 - DNA, 18 bp, Homo sapiens
aacagattcacactgtct

SEQ ID NO: 4733511 - DNA, 12 bp, Homo sapiens
aacagcctgaga

SEQ ID NO: 4733512 - DNA, 15 bp, Homo sapiens
aacagcctgagaaat

SEQ ID NO: 4733513 - DNA, 22 bp, Homo sapiens
aacagcgtgtcaactttcattt

SEQ ID NO: 4733514 - DNA, 14 bp, Homo sapiens
aacagcttcaggtt

SEQ ID NO: 4733515 - DNA, 15 bp, Homo sapiens
aacagcttcaggtta

SEQ ID NO: 4733516 - DNA, 17 bp, Homo sapiens
aacaggcactgccctgg

SEQ ID NO: 4733517 - DNA, 22 bp, Homo sapiens
aactgtgaatgcttctgattta

SEQ ID NO: 4733518 - DNA, 13 bp, Homo sapiens
aactgtgagagaa

SEQ ID NO: 4733519 - DNA, 20 bp, Homo sapiens
aactgttaactatgacagat

SEQ ID NO: 4733520 - DNA, 17 bp, Homo sapiens
aacttaacccagatttt

SEQ ID NO: 4733521 - DNA, 14 bp, Homo sapiens
aacttacttagtgt

SEQ ID NO: 4733522 - DNA, 21 bp, Homo sapiens
aacttcaaaaactaaaatcat

SEQ ID NO: 4733523 - DNA, 22 bp, Homo sapiens
aacttctcccctggtagaaaga

SEQ ID NO: 4733524 - DNA, 19 bp, Homo sapiens
aacttcttcagagctgaca

SEQ ID NO: 4733525 - DNA, 13 bp, Homo sapiens
aacttctttcact

SEQ ID NO: 4733526 - DNA, 21 bp, Homo sapiens
aacttgagcctgtcaagaggc

SEQ ID NO: 4733527 - DNA, 14 bp, Homo sapiens
aacttggaaatagt

SEQ ID NO: 4733528 - DNA, 18 bp, Homo sapiens
aacttgtctttggaccct

SEQ ID NO: 4733529 - DNA, 20 bp, Homo sapiens
aacttgtgaactccatcatt

SEQ ID NO: 4733530 - DNA, 22 bp, Homo sapiens
aacttgtgaactccatcattca

SEQ ID NO: 4733531 - DNA, 17 bp, Homo sapiens
aactttagtattaaatc

SEQ ID NO: 4733532 - DNA, 14 bp, Homo sapiens
aactttcatttttt

SEQ ID NO: 4733533 - DNA, 23 bp, Homo sapiens
aacttttgttaggaaaaaattga

SEQ ID NO: 4733534 - DNA, 12 bp, Homo sapiens
aagaaaaatcaa

SEQ ID NO: 4733535 - DNA, 22 bp, Homo sapiens
aagaaaagttttgtaaatttct

SEQ ID NO: 4733536 - DNA, 14 bp, Homo sapiens
aagaaacaaagatg

SEQ ID NO: 4733537 - DNA, 19 bp, Homo sapiens
aagaaacaactctttgaga

SEQ ID NO: 4733538 - DNA, 21 bp, Homo sapiens
aagaaacccttccacgtgtat

SEQ ID NO: 4733539 - DNA, 14 bp, Homo sapiens
aagaaagcaacttt

SEQ ID NO: 4733540 - DNA, 19 bp, Homo sapiens
aagaaagttattcttggta

SEQ ID NO: 4733541 - DNA, 17 bp, Homo sapiens
aagaaataaaccaaagg

SEQ ID NO: 4733542 - DNA, 20 bp, Homo sapiens
aagaaatcgccttatgagaa

SEQ ID NO: 4733543 - DNA, 15 bp, Homo sapiens
aagaaatctttccag

SEQ ID NO: 4733544 - DNA, 15 bp, Homo sapiens
aagaaccatttgcaa

SEQ ID NO: 4733545 - DNA, 15 bp, Homo sapiens
aagaaccgcattttg

SEQ ID NO: 4733546 - DNA, 17 bp, Homo sapiens
aagaacggggctcttct

SEQ ID NO: 4733547 - DNA, 15 bp, Homo sapiens
aagaacttaagtctc

SEQ ID NO: 4733548 - DNA, 19 bp, Homo sapiens
aagaacttccccatacaaa

SEQ ID NO: 4733549 - DNA, 23 bp, Homo sapiens
aagaagagcgagagatcaaagat

SEQ ID NO: 4733550 - DNA, 15 bp, Homo sapiens
aagaagagctatcag

SEQ ID NO: 4733551 - DNA, 15 bp, Homo sapiens
aagaagctgcaataa

SEQ ID NO: 4733552 - DNA, 11 bp, Homo sapiens
aagaatagaac

SEQ ID NO: 4733553 - DNA, 16 bp, Homo sapiens
aagaatccaatactgc

SEQ ID NO: 4733554 - DNA, 16 bp, Homo sapiens
aagaatgagtaatgtg

SEQ ID NO: 4733555 - DNA, 16 bp, Homo sapiens
aagaatgttagagtaa

SEQ ID NO: 4733556 - DNA, 18 bp, Homo sapiens
aagaattattcagtgaat

SEQ ID NO: 4733557 - DNA, 20 bp, Homo sapiens
aagacaaacaccttatttgt

SEQ ID NO: 4733558 - DNA, 20 bp, Homo sapiens
aagacaaatattcctttgca

SEQ ID NO: 4733559 - DNA, 17 bp, Homo sapiens
aagacaaatcaaagcag

SEQ ID NO: 4733560 - DNA, 14 bp, Homo sapiens
aagacaccagagca

SEQ ID NO: 4733561 - DNA, 20 bp, Homo sapiens
aagacaccagagcagatgca

SEQ ID NO: 4733562 - DNA, 15 bp, Homo sapiens
aagacagaggcagag

SEQ ID NO: 4733563 - DNA, 18 bp, Homo sapiens
aagacataacgtttttcc

SEQ ID NO: 4733564 - DNA, 20 bp, Homo sapiens
aagacattttcatgcttcca

SEQ ID NO: 4733565 - DNA, 19 bp, Homo sapiens
aagaccaccacctcagagt

SEQ ID NO: 4733566 - DNA, 22 bp, Homo sapiens
aagacgctgtgctgccctgccc

SEQ ID NO: 4733567 - DNA, 23 bp, Homo sapiens
aagacgctgtgctgccctgccca

SEQ ID NO: 4733568 - DNA, 21 bp, Homo sapiens
aagactcaagtgggaacgact

SEQ ID NO: 4733569 - DNA, 11 bp, Homo sapiens
aagactcatcc

SEQ ID NO: 4733570 - DNA, 12 bp, Homo sapiens
aagactcatccg

SEQ ID NO: 4733571 - DNA, 17 bp, Homo sapiens
aagactcattcttctgt

SEQ ID NO: 4733572 - DNA, 21 bp, Homo sapiens
aagacttttccaaccctcatc

SEQ ID NO: 4733573 - DNA, 13 bp, Homo sapiens
aagagaaaatgat

SEQ ID NO: 4733574 - DNA, 20 bp, Homo sapiens
aagagaatattcctacttgc

SEQ ID NO: 4733575 - DNA, 21 bp, Homo sapiens
aagagacagtcaccccaggac

SEQ ID NO: 4733576 - DNA, 22 bp, Homo sapiens
aagagacagtcaccccaggact

SEQ ID NO: 4733577 - DNA, 16 bp, Homo sapiens
aagagagaaaaacaaa

SEQ ID NO: 4733578 - DNA, 16 bp, Homo sapiens
aagagagtttgccact

SEQ ID NO: 4733579 - DNA, 19 bp, Homo sapiens
aagagcaatgtgtggctga

SEQ ID NO: 4733580 - DNA, 13 bp, Homo sapiens
aagagcacacttg

SEQ ID NO: 4733581 - DNA, 13 bp, Homo sapiens
aagagcacagccc

SEQ ID NO: 4733582 - DNA, 21 bp, Homo sapiens
aagagcttccagagctctgac

SEQ ID NO: 4733583 - DNA, 21 bp, Homo sapiens
aagaggaatttataacaaata

SEQ ID NO: 4733584 - DNA, 23 bp, Homo sapiens
aagagggagggagggctccagac

SEQ ID NO: 4733585 - DNA, 20 bp, Homo sapiens
aagagtagaaactgcaggga

SEQ ID NO: 4733586 - DNA, 20 bp, Homo sapiens
aagagtccaggtaaatggta

SEQ ID NO: 4733587 - DNA, 15 bp, Homo sapiens
aagagtgaaaaatga

SEQ ID NO: 4733588 - DNA, 21 bp, Homo sapiens
aagagtgagactccacctcaa

SEQ ID NO: 4733589 - DNA, 16 bp, Homo sapiens
aagagtgtagaagcat

SEQ ID NO: 4733590 - DNA, 22 bp, Homo sapiens
aagagtgtagaagcattccttc

SEQ ID NO: 4733591 - DNA, 15 bp, Homo sapiens
aagagttaaagagta

SEQ ID NO: 4733592 - DNA, 20 bp, Homo sapiens
aagagtttgatgaggccctc

SEQ ID NO: 4733593 - DNA, 15 bp, Homo sapiens
aaaataaaaaatgtg

SEQ ID NO: 4733594 - DNA, 14 bp, Homo sapiens
aaaataaaacatgt

SEQ ID NO: 4733595 - DNA, 12 bp, Homo sapiens
aaaataaagaat

SEQ ID NO: 4733596 - DNA, 10 bp, Homo sapiens
aaaataaagt

SEQ ID NO: 4733597 - DNA, 18 bp, Homo sapiens
aaaataaccttgcagaag

SEQ ID NO: 4733598 - DNA, 17 bp, Homo sapiens
aaaatacaaaaatttgc

SEQ ID NO: 4733599 - DNA, 16 bp, Homo sapiens
aaaatacaaacacatg

SEQ ID NO: 4733600 - DNA, 21 bp, Homo sapiens
aaaatacagtttgtcacatga

SEQ ID NO: 4733601 - DNA, 16 bp, Homo sapiens
aaaatacatataaaga

SEQ ID NO: 4733602 - DNA, 22 bp, Homo sapiens
aaaatagataagagtagaaact

SEQ ID NO: 4733603 - DNA, 18 bp, Homo sapiens
aaaatagcttattataga

SEQ ID NO: 4733604 - DNA, 13 bp, Homo sapiens
aaaatataaaata

SEQ ID NO: 4733605 - DNA, 14 bp, Homo sapiens
aaaatatacatttg

SEQ ID NO: 4733606 - DNA, 18 bp, Homo sapiens
aaaatatatttataagga

SEQ ID NO: 4733607 - DNA, 17 bp, Homo sapiens
aaaatattttagatgtt

SEQ ID NO: 4733608 - DNA, 18 bp, Homo sapiens
aaaatccagtattatatt

SEQ ID NO: 4733609 - DNA, 17 bp, Homo sapiens
aaaatcccccagcactt

SEQ ID NO: 4733610 - DNA, 12 bp, Homo sapiens
aaaatcttcagc

SEQ ID NO: 4733611 - DNA, 13 bp, Homo sapiens
aaaatcttcagct

SEQ ID NO: 4733612 - DNA, 19 bp, Homo sapiens
aaaatcttcagctggtgga

SEQ ID NO: 4733613 - DNA, 19 bp, Homo sapiens
aaaatgaaagctactcata

SEQ ID NO: 4733614 - DNA, 22 bp, Homo sapiens
aaaatgagactatgcgttttta

SEQ ID NO: 4733615 - DNA, 22 bp, Homo sapiens
aaaatgagctacttcttattca

SEQ ID NO: 4733616 - DNA, 15 bp, Homo sapiens
aaaatgatactgtgt

SEQ ID NO: 4733617 - DNA, 15 bp, Homo sapiens
aaaatgcctttgaga

SEQ ID NO: 4733618 - DNA, 21 bp, Homo sapiens
aaaatgctgtattagtcacag

SEQ ID NO: 4733619 - DNA, 11 bp, Homo sapiens
aaaatgcttct

SEQ ID NO: 4733620 - DNA, 16 bp, Homo sapiens
aaaatggaggtggaaa

SEQ ID NO: 4733621 - DNA, 21 bp, Homo sapiens
aaaatggcagggggtggaatt

SEQ ID NO: 4733622 - DNA, 12 bp, Homo sapiens
aaaatgtaggag

SEQ ID NO: 4733623 - DNA, 17 bp, Homo sapiens
aaaatgtctgtaataat

SEQ ID NO: 4733624 - DNA, 18 bp, Homo sapiens
aaaatgtcttgtgttacc

SEQ ID NO: 4733625 - DNA, 13 bp, Homo sapiens
aaaatgtctttat

SEQ ID NO: 4733626 - DNA, 23 bp, Homo sapiens
aaaatgtgaaaaaaattattcat

SEQ ID NO: 4733627 - DNA, 12 bp, Homo sapiens
aaaatgtgtctg

SEQ ID NO: 4733628 - DNA, 23 bp, Homo sapiens
aaaatgttctatttaacaactgg

SEQ ID NO: 4733629 - DNA, 15 bp, Homo sapiens
aaaatttaagtgcgt

SEQ ID NO: 4733630 - DNA, 15 bp, Homo sapiens
aaaatttctattaaa

SEQ ID NO: 4733631 - DNA, 20 bp, Homo sapiens
aaaatttcttagaaaacaat

SEQ ID NO: 4733632 - DNA, 16 bp, Homo sapiens
aaaatttgccctccca

SEQ ID NO: 4733633 - DNA, 18 bp, Homo sapiens
aaaatttgttattttgca

SEQ ID NO: 4733634 - DNA, 19 bp, Homo sapiens
aaggctcttctccccagag

SEQ ID NO: 4733635 - DNA, 20 bp, Homo sapiens
aaggctgtgtgaatttttct

SEQ ID NO: 4733636 - DNA, 22 bp, Homo sapiens
aagggattttagtcacacgtgg

SEQ ID NO: 4733637 - DNA, 15 bp, Homo sapiens
aagggcagagtcaca

SEQ ID NO: 4733638 - DNA, 13 bp, Homo sapiens
aagggcagccctc

SEQ ID NO: 4733639 - DNA, 14 bp, Homo sapiens
aagggcataaagta

SEQ ID NO: 4733640 - DNA, 15 bp, Homo sapiens
aagggcataaagtaa

SEQ ID NO: 4733641 - DNA, 20 bp, Homo sapiens
aagggcatgggtcgggagag

SEQ ID NO: 4733642 - DNA, 23 bp, Homo sapiens
aagggcattggccattctattgt

SEQ ID NO: 4733643 - DNA, 15 bp, Homo sapiens
aagggcccagagagg

SEQ ID NO: 4733644 - DNA, 14 bp, Homo sapiens
aagggcctggcctg

SEQ ID NO: 4733645 - DNA, 19 bp, Homo sapiens
aagggcgcaaagggcatgg

SEQ ID NO: 4733646 - DNA, 17 bp, Homo sapiens
aagggctagaacctgga

SEQ ID NO: 4733647 - DNA, 23 bp, Homo sapiens
aaggggaatgtttgcctctgcct

SEQ ID NO: 4733648 - DNA, 17 bp, Homo sapiens
aagggtatcaggtgctg

SEQ ID NO: 4733649 - DNA, 19 bp, Homo sapiens
aagggtgatgtacacatgt

SEQ ID NO: 4733650 - DNA, 16 bp, Homo sapiens
aaggtatctttttatt

SEQ ID NO: 4733651 - DNA, 14 bp, Homo sapiens
aaggtcggaccagc

SEQ ID NO: 4733652 - DNA, 20 bp, Homo sapiens
aaggtggtgggggtgcagat

SEQ ID NO: 4733653 - DNA, 23 bp, Homo sapiens
aaggtttcagaaagaagtgggga

SEQ ID NO: 4733654 - DNA, 15 bp, Homo sapiens
aaggttttattttgt

SEQ ID NO: 4733655 - DNA, 16 bp, Homo sapiens
aaggttttattttgta

SEQ ID NO: 4733656 - DNA, 16 bp, Homo sapiens
aagtaaaattgtttca

SEQ ID NO: 4733657 - DNA, 18 bp, Homo sapiens
aagtaaatacatgcatat

SEQ ID NO: 4733658 - DNA, 19 bp, Homo sapiens
aagtacttctccaccctgc

SEQ ID NO: 4733659 - DNA, 11 bp, Homo sapiens
aagtacttctt

SEQ ID NO: 4733660 - DNA, 13 bp, Homo sapiens
aagtaggaagtaa

SEQ ID NO: 4733661 - DNA, 20 bp, Homo sapiens
aagtagtttaagtctccttt

SEQ ID NO: 4733662 - DNA, 19 bp, Homo sapiens
aagtatgtatattaaaaaa

SEQ ID NO: 4733663 - DNA, 20 bp, Homo sapiens
aatattcctttgcatattat

SEQ ID NO: 4733664 - DNA, 20 bp, Homo sapiens
aatattgatttctgccttcc

SEQ ID NO: 4733665 - DNA, 14 bp, Homo sapiens
aatattgtacagtt

SEQ ID NO: 4733666 - DNA, 17 bp, Homo sapiens
aatattgtacagttttt

SEQ ID NO: 4733667 - DNA, 15 bp, Homo sapiens
aatattgtggctccc

SEQ ID NO: 4733668 - DNA, 18 bp, Homo sapiens
aatattgtggctccctgg

SEQ ID NO: 4733669 - DNA, 18 bp, Homo sapiens
aatattttctacatcttt

SEQ ID NO: 4733670 - DNA, 19 bp, Homo sapiens
aatattttctacatctttt

SEQ ID NO: 4733671 - DNA, 22 bp, Homo sapiens
aatatttttatagatttgacct

SEQ ID NO: 4733672 - DNA, 21 bp, Homo sapiens
aatcaaacaagtgagtagctc

SEQ ID NO: 4733673 - DNA, 23 bp, Homo sapiens
aatcaaagtagaaactactaatt

SEQ ID NO: 4733674 - DNA, 20 bp, Homo sapiens
aatcaaatgtggctgtatcc

SEQ ID NO: 4733675 - DNA, 23 bp, Homo sapiens
aatcaagttggcttctaatcaaa

SEQ ID NO: 4733676 - DNA, 19 bp, Homo sapiens
aatcacagcttgtattttg

SEQ ID NO: 4733677 - DNA, 12 bp, Homo sapiens
aatcacagtgtt

SEQ ID NO: 4733678 - DNA, 13 bp, Homo sapiens
aatcagaattaga

SEQ ID NO: 4733679 - DNA, 20 bp, Homo sapiens
aatcagctccttcctggaga

SEQ ID NO: 4733680 - DNA, 24 bp, Homo sapiens
aatcaggaaagagattagaacatt

SEQ ID NO: 4733681 - DNA, 14 bp, Homo sapiens
aatcagtgtgaatg

SEQ ID NO: 4733682 - DNA, 14 bp, Homo sapiens
aatcataacatagt

SEQ ID NO: 4733683 - DNA, 21 bp, Homo sapiens
aatcataacatagttgaaaaa

SEQ ID NO: 4733684 - DNA, 16 bp, Homo sapiens
aatcatcaaaaagaaa

SEQ ID NO: 4733685 - DNA, 21 bp, Homo sapiens
aatcatcaaaaagaaaaatca

SEQ ID NO: 4733686 - DNA, 20 bp, Homo sapiens
aatcatttctatttctcctc

SEQ ID NO: 4733687 - DNA, 22 bp, Homo sapiens
aatccaagatattttaaaatct

SEQ ID NO: 4733688 - DNA, 17 bp, Homo sapiens
aatccaatattgtaatc

SEQ ID NO: 4733689 - DNA, 15 bp, Homo sapiens
aatccaatgaaatga

SEQ ID NO: 4733690 - DNA, 21 bp, Homo sapiens
aatccacatctttactcaggc

SEQ ID NO: 4733691 - DNA, 17 bp, Homo sapiens
aatccagacccggctgc

SEQ ID NO: 4733692 - DNA, 19 bp, Homo sapiens
aatccagacccggctgcgt

SEQ ID NO: 4733693 - DNA, 15 bp, Homo sapiens
aatccccagatattt

SEQ ID NO: 4733694 - DNA, 14 bp, Homo sapiens
aatcctacatacag

SEQ ID NO: 4733695 - DNA, 20 bp, Homo sapiens
aatcctcagtttttgtgaaa

SEQ ID NO: 4733696 - DNA, 21 bp, Homo sapiens
aatcctggggaacatagaact

SEQ ID NO: 4733697 - DNA, 17 bp, Homo sapiens
aatcctgtaccaaatct

SEQ ID NO: 4733698 - DNA, 17 bp, Homo sapiens
aatctaatgacattcaa

SEQ ID NO: 4733699 - DNA, 16 bp, Homo sapiens
aatctagcttattttg

SEQ ID NO: 4733700 - DNA, 18 bp, Homo sapiens
aatctattctcaaagtta

SEQ ID NO: 4733701 - DNA, 17 bp, Homo sapiens
aatctcaattcttccct

SEQ ID NO: 4733702 - DNA, 23 bp, Homo sapiens
aatctcgctctgtcgcccaggct

SEQ ID NO: 4733703 - DNA, 13 bp, Homo sapiens
aatctgaagaaag

SEQ ID NO: 4733704 - DNA, 18 bp, Homo sapiens
aatctgaagaaagttatt

SEQ ID NO: 4733705 - DNA, 21 bp, Homo sapiens
aatctgaagaaagttattctt

SEQ ID NO: 4733706 - DNA, 17 bp, Homo sapiens
aatctgatggcttctcc

SEQ ID NO: 4733707 - DNA, 19 bp, Homo sapiens
aatctggagagctagaacc

SEQ ID NO: 4733708 - DNA, 19 bp, Homo sapiens
aatctggattcatatttaa

SEQ ID NO: 4733709 - DNA, 18 bp, Homo sapiens
aatctggcactactcagt

SEQ ID NO: 4733710 - DNA, 18 bp, Homo sapiens
aatctgggcagacattat

SEQ ID NO: 4733711 - DNA, 21 bp, Homo sapiens
aatctgttgttccaaatgtgt

SEQ ID NO: 4733712 - DNA, 22 bp, Homo sapiens
aatctgttgttccaaatgtgta

SEQ ID NO: 4733713 - DNA, 19 bp, Homo sapiens
aatctgttgtttgaagaac

SEQ ID NO: 4733714 - DNA, 15 bp, Homo sapiens
aatcttaaacataat

SEQ ID NO: 4733715 - DNA, 14 bp, Homo sapiens
aatcttcacctcag

SEQ ID NO: 4733716 - DNA, 15 bp, Homo sapiens
aatcttcacctcaga

SEQ ID NO: 4733717 - DNA, 11 bp, Homo sapiens
aatcttcagct

SEQ ID NO: 4733718 - DNA, 14 bp, Homo sapiens
aatcttcagctggt

SEQ ID NO: 4733719 - DNA, 17 bp, Homo sapiens
aatcttcagctggtgga

SEQ ID NO: 4733720 - DNA, 20 bp, Homo sapiens
aatcttcagctggtggatgg

SEQ ID NO: 4733721 - DNA, 11 bp, Homo sapiens
aatctttccag

SEQ ID NO: 4733722 - DNA, 14 bp, Homo sapiens
aatgaaaaaatgta

SEQ ID NO: 4733723 - DNA, 14 bp, Homo sapiens
aatgaaatgcatat

SEQ ID NO: 4733724 - DNA, 17 bp, Homo sapiens
aatgaacacatggcaga

SEQ ID NO: 4733725 - DNA, 18 bp, Homo sapiens
aatgaaccgctgaatatg

SEQ ID NO: 4733726 - DNA, 15 bp, Homo sapiens
aatgacattttgcca

SEQ ID NO: 4733727 - DNA, 20 bp, Homo sapiens
aatgacctgccctggcccca

SEQ ID NO: 4733728 - DNA, 15 bp, Homo sapiens
aatgactcaaagtct

SEQ ID NO: 4733729 - DNA, 16 bp, Homo sapiens
aatgactccactgttt

SEQ ID NO: 4733730 - DNA, 14 bp, Homo sapiens
aatgactccaggaa

SEQ ID NO: 4733731 - DNA, 18 bp, Homo sapiens
aatgaggaggtacattga

SEQ ID NO: 4733732 - DNA, 18 bp, Homo sapiens
aatgaggtcagagcctgc

SEQ ID NO: 4733733 - DNA, 12 bp, Homo sapiens
aatgatcaaatt

SEQ ID NO: 4733734 - DNA, 19 bp, Homo sapiens
aatgatcaaattttgagca

SEQ ID NO: 4733735 - DNA, 21 bp, Homo sapiens
aatgatcagctatatactatt

SEQ ID NO: 4733736 - DNA, 17 bp, Homo sapiens
aatgatgagtttttatg

SEQ ID NO: 4733737 - DNA, 21 bp, Homo sapiens
aatgatggcagtggtttgaaa

SEQ ID NO: 4733738 - DNA, 22 bp, Homo sapiens
aatgattcagtgttaaatgtga

SEQ ID NO: 4733739 - DNA, 12 bp, Homo sapiens
aatgattcttcc

SEQ ID NO: 4733740 - DNA, 24 bp, Homo sapiens
aatgatttcagctcactgcaacct

SEQ ID NO: 4733741 - DNA, 22 bp, Homo sapiens
aatgcaagcaaagtatcaaaga

SEQ ID NO: 4733742 - DNA, 21 bp, Homo sapiens
aatgcacagttgccacattta

SEQ ID NO: 4733743 - DNA, 22 bp, Homo sapiens
aatgcactttgttctggctctt

SEQ ID NO: 4733744 - DNA, 17 bp, Homo sapiens
aatgcagaggaggagaa

SEQ ID NO: 4733745 - DNA, 13 bp, Homo sapiens
aatgcataaaatg

SEQ ID NO: 4733746 - DNA, 14 bp, Homo sapiens
aatgcatatttgca

SEQ ID NO: 4733747 - DNA, 19 bp, Homo sapiens
atcctcaaacactgcaggc

SEQ ID NO: 4733748 - DNA, 19 bp, Homo sapiens
atcctcagtttttgtgaaa

SEQ ID NO: 4733749 - DNA, 23 bp, Homo sapiens
atcctcatacccacccccaccca

SEQ ID NO: 4733750 - DNA, 14 bp, Homo sapiens
atcctccaggtgca

SEQ ID NO: 4733751 - DNA, 23 bp, Homo sapiens
atcctccatgggggctcagccag

SEQ ID NO: 4733752 - DNA, 16 bp, Homo sapiens
atcctctgtacagagc

SEQ ID NO: 4733753 - DNA, 13 bp, Homo sapiens
atcctgaagagca

SEQ ID NO: 4733754 - DNA, 16 bp, Homo sapiens
atcctgaataaaccag

SEQ ID NO: 4733755 - DNA, 22 bp, Homo sapiens
atcctggacatgaagattcttt

SEQ ID NO: 4733756 - DNA, 20 bp, Homo sapiens
atcctggcacccggcccctg

SEQ ID NO: 4733757 - DNA, 22 bp, Homo sapiens
atcctggcacccggcccctgct

SEQ ID NO: 4733758 - DNA, 23 bp, Homo sapiens
atcctggcacccggcccctgctg

SEQ ID NO: 4733759 - DNA, 13 bp, Homo sapiens
atcctggcccatc

SEQ ID NO: 4733760 - DNA, 24 bp, Homo sapiens
atcctggctctttggagatcaagg

SEQ ID NO: 4733761 - DNA, 18 bp, Homo sapiens
atcgaaataacaatgtta

SEQ ID NO: 4733762 - DNA, 20 bp, Homo sapiens
atcgaaataacaatgttaag

SEQ ID NO: 4733763 - DNA, 18 bp, Homo sapiens
atcgccttatttatattc

SEQ ID NO: 4733764 - DNA, 12 bp, Homo sapiens
atcgcctttccc

SEQ ID NO: 4733765 - DNA, 17 bp, Homo sapiens
atcgtgatcactgagcc

SEQ ID NO: 4733766 - DNA, 17 bp, Homo sapiens
atctaaatttaattacc

SEQ ID NO: 4733767 - DNA, 14 bp, Homo sapiens
atctaacctcatct

SEQ ID NO: 4733768 - DNA, 18 bp, Homo sapiens
atctaacctcatcttctt

SEQ ID NO: 4733769 - DNA, 18 bp, Homo sapiens
atctaatatgtaacaagc

SEQ ID NO: 4733770 - DNA, 16 bp, Homo sapiens
atctaattcttatttt

SEQ ID NO: 4733771 - DNA, 13 bp, Homo sapiens
atctaattcttta

SEQ ID NO: 4733772 - DNA, 15 bp, Homo sapiens
atctaattctttaat

SEQ ID NO: 4733773 - DNA, 17 bp, Homo sapiens
atctaattctttaatga

SEQ ID NO: 4733774 - DNA, 18 bp, Homo sapiens
atctacccagtcatgtac

SEQ ID NO: 4733775 - DNA, 17 bp, Homo sapiens
atctagcagtaaaagat

SEQ ID NO: 4733776 - DNA, 18 bp, Homo sapiens
atctagcagtaaaagata

SEQ ID NO: 4733777 - DNA, 18 bp, Homo sapiens
atctaggaagactttgga

SEQ ID NO: 4733778 - DNA, 23 bp, Homo sapiens
atctaggaagactttggaaagag

SEQ ID NO: 4733779 - DNA, 15 bp, Homo sapiens
atctataaactataa

SEQ ID NO: 4733780 - DNA, 14 bp, Homo sapiens
atctatgactgtgt

SEQ ID NO: 4733781 - DNA, 22 bp, Homo sapiens
atctatgatgaaggtaattaaa

SEQ ID NO: 4733782 - DNA, 15 bp, Homo sapiens
atctatgtcatattt

SEQ ID NO: 4733783 - DNA, 16 bp, Homo sapiens
atctattaaaattgcc

SEQ ID NO: 4733784 - DNA, 13 bp, Homo sapiens
atctcacttgtgc

SEQ ID NO: 4733785 - DNA, 18 bp, Homo sapiens
atctcacttgtgccaaca

SEQ ID NO: 4733786 - DNA, 18 bp, Homo sapiens
atctcagtcatgcataaa

SEQ ID NO: 4733787 - DNA, 21 bp, Homo sapiens
atctcagtcatgcataaatat

SEQ ID NO: 4733788 - DNA, 14 bp, Homo sapiens
atctcattggaccc

SEQ ID NO: 4733789 - DNA, 12 bp, Homo sapiens
atctcccccagc

SEQ ID NO: 4733790 - DNA, 14 bp, Homo sapiens
atctcccccagccc

SEQ ID NO: 4733791 - DNA, 21 bp, Homo sapiens
atctcccccagccccatcctc

SEQ ID NO: 4733792 - DNA, 20 bp, Homo sapiens
atctcctgccttcctcctgg

SEQ ID NO: 4733793 - DNA, 16 bp, Homo sapiens
atctcggctcactgca

SEQ ID NO: 4733794 - DNA, 17 bp, Homo sapiens
atctctctttaatataa

SEQ ID NO: 4733795 - DNA, 13 bp, Homo sapiens
atctcttagctcc

SEQ ID NO: 4733796 - DNA, 18 bp, Homo sapiens
atctcttagctcccctcc

SEQ ID NO: 4733797 - DNA, 13 bp, Homo sapiens
atctgatttttaa

SEQ ID NO: 4733798 - DNA, 13 bp, Homo sapiens
atctgcagtcact

SEQ ID NO: 4733799 - DNA, 16 bp, Homo sapiens
atctgcagtcacttcg

SEQ ID NO: 4733800 - DNA, 18 bp, Homo sapiens
atctgcatgtaaaatctt

SEQ ID NO: 4733801 - DNA, 21 bp, Homo sapiens
atctgcatgtaaaatcttcag

SEQ ID NO: 4733802 - DNA, 13 bp, Homo sapiens
atctgcccaggac

SEQ ID NO: 4733803 - DNA, 21 bp, Homo sapiens
atctgcgtgacaataaaacat

SEQ ID NO: 4733804 - DNA, 22 bp, Homo sapiens
atctgcgtgacaataaaacatt

SEQ ID NO: 4733805 - DNA, 23 bp, Homo sapiens
atctgctagtgctgtaatattgt

SEQ ID NO: 4733806 - DNA, 21 bp, Homo sapiens
atctgctctccttcctggagc

SEQ ID NO: 4733807 - DNA, 18 bp, Homo sapiens
atctggaaccatcagaaa

SEQ ID NO: 4733808 - DNA, 21 bp, Homo sapiens
atctggcactactcagttatt

SEQ ID NO: 4733809 - DNA, 23 bp, Homo sapiens
atctgtaaatagtgagatggact

SEQ ID NO: 4733810 - DNA, 12 bp, Homo sapiens
atctgtcatttg

SEQ ID NO: 4733811 - DNA, 17 bp, Homo sapiens
atctgtcatttgagcag

SEQ ID NO: 4733812 - DNA, 22 bp, Homo sapiens
atctgtcatttgagcagggctc

SEQ ID NO: 4733813 - DNA, 23 bp, Homo sapiens
atctgtgaaaggaaagagggagg

SEQ ID NO: 4733814 - DNA, 22 bp, Homo sapiens
atctgtggattcagcttctgtt

SEQ ID NO: 4733815 - DNA, 16 bp, Homo sapiens
atctgttgttccaaat

SEQ ID NO: 4733816 - DNA, 22 bp, Homo sapiens
atctgttgttccaaatgtgtat

SEQ ID NO: 4733817 - DNA, 14 bp, Homo sapiens
atctgttgtttgaa

SEQ ID NO: 4733818 - DNA, 22 bp, Homo sapiens
atcttaaacataataaatcaca

SEQ ID NO: 4733819 - DNA, 13 bp, Homo sapiens
atcttacagctgg

SEQ ID NO: 4733820 - DNA, 24 bp, Homo sapiens
atcttataaagtggaagtatgtat

SEQ ID NO: 4733821 - DNA, 14 bp, Homo sapiens
atcttataatttaa

SEQ ID NO: 4733822 - DNA, 16 bp, Homo sapiens
atcttataatttaaaa

SEQ ID NO: 4733823 - DNA, 17 bp, Homo sapiens
atcttctacatgcaatt

SEQ ID NO: 4733824 - DNA, 19 bp, Homo sapiens
atcttctgctaaatttttg

SEQ ID NO: 4733825 - DNA, 16 bp, Homo sapiens
atcttgaattgtaact

SEQ ID NO: 4733826 - DNA, 14 bp, Homo sapiens
atacctgtccccct

SEQ ID NO: 4733827 - DNA, 22 bp, Homo sapiens
atactaattttccataagctat

SEQ ID NO: 4733828 - DNA, 14 bp, Homo sapiens
atactatccaaata

SEQ ID NO: 4733829 - DNA, 21 bp, Homo sapiens
atactatccaaataaaaataa

SEQ ID NO: 4733830 - DNA, 19 bp, Homo sapiens
atactatttatatacaagt

SEQ ID NO: 4733831 - DNA, 15 bp, Homo sapiens
atactccctttaaag

SEQ ID NO: 4733832 - DNA, 17 bp, Homo sapiens
atactccctttaaagag

SEQ ID NO: 4733833 - DNA, 23 bp, Homo sapiens
atactgcccaaggataggtattt

SEQ ID NO: 4733834 - DNA, 16 bp, Homo sapiens
atactggactcaggaa

SEQ ID NO: 4733835 - DNA, 19 bp, Homo sapiens
atactgtatattcaggact

SEQ ID NO: 4733836 - DNA, 16 bp, Homo sapiens
atactgtgctggagcc

SEQ ID NO: 4733837 - DNA, 17 bp, Homo sapiens
atactgtgctggagcca

SEQ ID NO: 4733838 - DNA, 21 bp, Homo sapiens
atactgtgttccctcatatgc

SEQ ID NO: 4733839 - DNA, 13 bp, Homo sapiens
atactgttgcacg

SEQ ID NO: 4733840 - DNA, 18 bp, Homo sapiens
atactgttgcacgtgtgt

SEQ ID NO: 4733841 - DNA, 19 bp, Homo sapiens
atactgttgcacgtgtgtt

SEQ ID NO: 4733842 - DNA, 13 bp, Homo sapiens
atacttgttctgt

SEQ ID NO: 4733843 - DNA, 15 bp, Homo sapiens
atacttgttctgtat

SEQ ID NO: 4733844 - DNA, 16 bp, Homo sapiens
atacttgttctgtatt

SEQ ID NO: 4733845 - DNA, 18 bp, Homo sapiens
atactttcgaaatttcat

SEQ ID NO: 4733846 - DNA, 12 bp, Homo sapiens
atagaaaaggaa

SEQ ID NO: 4733847 - DNA, 13 bp, Homo sapiens
atagaaaaggaag

SEQ ID NO: 4733848 - DNA, 19 bp, Homo sapiens
atagaaatgctggtttttc

SEQ ID NO: 4733849 - DNA, 22 bp, Homo sapiens
atagaaatgctggtttttcagt

SEQ ID NO: 4733850 - DNA, 14 bp, Homo sapiens
atagagagagacca

SEQ ID NO: 4733851 - DNA, 13 bp, Homo sapiens
atagatttgacct

SEQ ID NO: 4733852 - DNA, 20 bp, Homo sapiens
atagcctaagcggctgttta

SEQ ID NO: 4733853 - DNA, 20 bp, Homo sapiens
atagcgtcataactagaact

SEQ ID NO: 4733854 - DNA, 18 bp, Homo sapiens
atagctacatcagtttga

SEQ ID NO: 4733855 - DNA, 14 bp, Homo sapiens
atagctactaattt

SEQ ID NO: 4733856 - DNA, 21 bp, Homo sapiens
atagctcaggtgtccctgcac

SEQ ID NO: 4733857 - DNA, 22 bp, Homo sapiens
atagctcaggtgtccctgcact

SEQ ID NO: 4733858 - DNA, 22 bp, Homo sapiens
atagctctacacaacatgtatg

SEQ ID NO: 4733859 - DNA, 23 bp, Homo sapiens
atagctgcttggattctctgaga

SEQ ID NO: 4733860 - DNA, 16 bp, Homo sapiens
atagcttactgaagaa

SEQ ID NO: 4733861 - DNA, 21 bp, Homo sapiens
atagcttattatagaattgca

SEQ ID NO: 4733862 - DNA, 13 bp, Homo sapiens
ataggatttttag

SEQ ID NO: 4733863 - DNA, 17 bp, Homo sapiens
ataggcgtaactaattt

SEQ ID NO: 4733864 - DNA, 18 bp, Homo sapiens
ataggctattttctaaag

SEQ ID NO: 4733865 - DNA, 16 bp, Homo sapiens
atagggttaaatggta

SEQ ID NO: 4733866 - DNA, 13 bp, Homo sapiens
ataggtggcctct

SEQ ID NO: 4733867 - DNA, 15 bp, Homo sapiens
ataggtttaataatt

SEQ ID NO: 4733868 - DNA, 14 bp, Homo sapiens
atagtaaaaataaa

SEQ ID NO: 4733869 - DNA, 16 bp, Homo sapiens
atagtaacctgggtaa

SEQ ID NO: 4733870 - DNA, 22 bp, Homo sapiens
atagtagccaaagttaaatgta

SEQ ID NO: 4733871 - DNA, 17 bp, Homo sapiens
atagtaggggttgaaga

SEQ ID NO: 4733872 - DNA, 15 bp, Homo sapiens
atagtatggtggctg

SEQ ID NO: 4733873 - DNA, 13 bp, Homo sapiens
atagtcaatgtaa

SEQ ID NO: 4733874 - DNA, 18 bp, Homo sapiens
atagtgcttcttgtaata

SEQ ID NO: 4733875 - DNA, 19 bp, Homo sapiens
atagtgtagctgaggaggc

SEQ ID NO: 4733876 - DNA, 14 bp, Homo sapiens
atagttaaaatgct

SEQ ID NO: 4733877 - DNA, 18 bp, Homo sapiens
atagttgtctttctttgc

SEQ ID NO: 4733878 - DNA, 16 bp, Homo sapiens
atataaaaacatcagt

SEQ ID NO: 4733879 - DNA, 14 bp, Homo sapiens
atataaaatatgaa

SEQ ID NO: 4733880 - DNA, 14 bp, Homo sapiens
atataaacatttta

SEQ ID NO: 4733881 - DNA, 21 bp, Homo sapiens
atataaacattttatttatag

SEQ ID NO: 4733882 - DNA, 22 bp, Homo sapiens
atataaattgagcttgcttctt

SEQ ID NO: 4733883 - DNA, 18 bp, Homo sapiens
atataactattgcccagg

SEQ ID NO: 4733884 - DNA, 13 bp, Homo sapiens
atataagacaaat

SEQ ID NO: 4733885 - DNA, 11 bp, Homo sapiens
atatacatttg

SEQ ID NO: 4733886 - DNA, 22 bp, Homo sapiens
atatacgtttatataaatatat

SEQ ID NO: 4733887 - DNA, 19 bp, Homo sapiens
atatacttgttgtttaatg

SEQ ID NO: 4733888 - DNA, 17 bp, Homo sapiens
atatagctctacacaac

SEQ ID NO: 4733889 - DNA, 20 bp, Homo sapiens
atatagctctacacaacatg

SEQ ID NO: 4733890 - DNA, 22 bp, Homo sapiens
atataggctattttctaaagac

SEQ ID NO: 4733891 - DNA, 20 bp, Homo sapiens
atatagtaggggttgaagaa

SEQ ID NO: 4733892 - DNA, 21 bp, Homo sapiens
atatagtaggggttgaagaaa

SEQ ID NO: 4733893 - DNA, 17 bp, Homo sapiens
atatagttgtctttctt

SEQ ID NO: 4733894 - DNA, 21 bp, Homo sapiens
atatatgttttaagaggcagg

SEQ ID NO: 4733895 - DNA, 13 bp, Homo sapiens
atatattcacttt

SEQ ID NO: 4733896 - DNA, 14 bp, Homo sapiens
atatattcactttc

SEQ ID NO: 4733897 - DNA, 13 bp, Homo sapiens
atatatttaagcc

SEQ ID NO: 4733898 - DNA, 21 bp, Homo sapiens
atatcaaagtcattaaagaca

SEQ ID NO: 4733899 - DNA, 20 bp, Homo sapiens
atatcaagtactacattttc

SEQ ID NO: 4733900 - DNA, 22 bp, Homo sapiens
atatcccttggacattttatgt

SEQ ID NO: 4733901 - DNA, 23 bp, Homo sapiens
atatcccttggacattttatgtc

SEQ ID NO: 4733902 - DNA, 14 bp, Homo sapiens
atatctaaatttag

SEQ ID NO: 4733903 - DNA, 15 bp, Homo sapiens
atatctcttgtgctt

SEQ ID NO: 4733904 - DNA, 14 bp, Homo sapiens
atatgaagacataa

SEQ ID NO: 4733905 - DNA, 19 bp, Homo sapiens
atatgacattcatgcctgg

SEQ ID NO: 4733906 - DNA, 13 bp, Homo sapiens
atatgagactttc

SEQ ID NO: 4733907 - DNA, 16 bp, Homo sapiens
atatggatttcttaga

SEQ ID NO: 4733908 - DNA, 12 bp, Homo sapiens
atatggcagaag

SEQ ID NO: 4733909 - DNA, 17 bp, Homo sapiens
atatgtaacaagccacc

SEQ ID NO: 4733910 - DNA, 15 bp, Homo sapiens
atatgtagtatctat

SEQ ID NO: 4733911 - DNA, 14 bp, Homo sapiens
atatgtataaatta

SEQ ID NO: 4733912 - DNA, 21 bp, Homo sapiens
atatgtataaattaatacaga

SEQ ID NO: 4733913 - DNA, 11 bp, Homo sapiens
atatgtgaaga

SEQ ID NO: 4733914 - DNA, 18 bp, Homo sapiens
atatgtgaagaaaaagac

SEQ ID NO: 4733915 - DNA, 19 bp, Homo sapiens
atatgtgtaaatgttatga

SEQ ID NO: 4733916 - DNA, 22 bp, Homo sapiens
atatgttggggtttttttaaga

SEQ ID NO: 4733917 - DNA, 13 bp, Homo sapiens
atattataaagga

SEQ ID NO: 4733918 - DNA, 23 bp, Homo sapiens
atattattccgtattacattttt

SEQ ID NO: 4733919 - DNA, 16 bp, Homo sapiens
atattcagatgtatgt

SEQ ID NO: 4733920 - DNA, 14 bp, Homo sapiens
atattcaggaagct

SEQ ID NO: 4733921 - DNA, 19 bp, Homo sapiens
atattcaggaagctcaggg

SEQ ID NO: 4733922 - DNA, 20 bp, Homo sapiens
atattcatcaaataaacctt

SEQ ID NO: 4733923 - DNA, 17 bp, Homo sapiens
atattcattctttttga

SEQ ID NO: 4733924 - DNA, 21 bp, Homo sapiens
atattcctacttgcagtacat

SEQ ID NO: 4733925 - DNA, 12 bp, Homo sapiens
atattcctttgc

SEQ ID NO: 4733926 - DNA, 23 bp, Homo sapiens
atattcctttgcatattataaag

SEQ ID NO: 4733927 - DNA, 14 bp, Homo sapiens
atattctctgatgt

SEQ ID NO: 4733928 - DNA, 24 bp, Homo sapiens
atattctgataatgtattgcagtg

SEQ ID NO: 4733929 - DNA, 14 bp, Homo sapiens
atattgaccatgtg

SEQ ID NO: 4733930 - DNA, 16 bp, Homo sapiens
atattgtaaatactgg

SEQ ID NO: 4733931 - DNA, 14 bp, Homo sapiens
atattgtacagttt

SEQ ID NO: 4733932 - DNA, 14 bp, Homo sapiens
atattgtggctccc

SEQ ID NO: 4733933 - DNA, 18 bp, Homo sapiens
atattgtttttgtattta

SEQ ID NO: 4733934 - DNA, 22 bp, Homo sapiens
atatttaaaagacaaacacctt

SEQ ID NO: 4733935 - DNA, 19 bp, Homo sapiens
atatttaacctatttccac

SEQ ID NO: 4733936 - DNA, 12 bp, Homo sapiens
atatttaagcct

SEQ ID NO: 4733937 - DNA, 13 bp, Homo sapiens
atttcaatactta

SEQ ID NO: 4733938 - DNA, 21 bp, Homo sapiens
atttcaatttccaagagctga

SEQ ID NO: 4733939 - DNA, 17 bp, Homo sapiens
atttcacagatgctgtg

SEQ ID NO: 4733940 - DNA, 20 bp, Homo sapiens
atttcacagatgctgtgtaa

SEQ ID NO: 4733941 - DNA, 17 bp, Homo sapiens
atttcacagtgcccaag

SEQ ID NO: 4733942 - DNA, 23 bp, Homo sapiens
atttcagagtgactacacacagt

SEQ ID NO: 4733943 - DNA, 15 bp, Homo sapiens
atttcatctgctctc

SEQ ID NO: 4733944 - DNA, 17 bp, Homo sapiens
atttcatctgctctcct

SEQ ID NO: 4733945 - DNA, 18 bp, Homo sapiens
atttcatctgctctcctt

SEQ ID NO: 4733946 - DNA, 19 bp, Homo sapiens
atttcatctgctctccttc

SEQ ID NO: 4733947 - DNA, 22 bp, Homo sapiens
atttcccagtaattattttctt

SEQ ID NO: 4733948 - DNA, 19 bp, Homo sapiens
atttcccgtggccccagcc

SEQ ID NO: 4733949 - DNA, 22 bp, Homo sapiens
atttcccgtggccccagcctgg

SEQ ID NO: 4733950 - DNA, 21 bp, Homo sapiens
atttcctctgagctgttatct

SEQ ID NO: 4733951 - DNA, 18 bp, Homo sapiens
atttcctgggagaaagac

SEQ ID NO: 4733952 - DNA, 20 bp, Homo sapiens
atttcctgggagaaagacca

SEQ ID NO: 4733953 - DNA, 14 bp, Homo sapiens
atttcctgtgtctt

SEQ ID NO: 4733954 - DNA, 15 bp, Homo sapiens
atttcgatgtacagt

SEQ ID NO: 4733955 - DNA, 16 bp, Homo sapiens
atttctacagagaaaa

SEQ ID NO: 4733956 - DNA, 15 bp, Homo sapiens
atttctatttctcct

SEQ ID NO: 4733957 - DNA, 21 bp, Homo sapiens
atttctcttcagtgtgttgac

SEQ ID NO: 4733958 - DNA, 16 bp, Homo sapiens
atttctgccttccttg

SEQ ID NO: 4733959 - DNA, 17 bp, Homo sapiens
atttctgccttccttgc

SEQ ID NO: 4733960 - DNA, 15 bp, Homo sapiens
atttctgccttgaaa

SEQ ID NO: 4733961 - DNA, 15 bp, Homo sapiens
atttctggaatggaa

SEQ ID NO: 4733962 - DNA, 17 bp, Homo sapiens
atttcttagagattaaa

SEQ ID NO: 4733963 - DNA, 18 bp, Homo sapiens
atttcttagagattaaac

SEQ ID NO: 4733964 - DNA, 20 bp, Homo sapiens
atttcttgaggtaaaagcat

SEQ ID NO: 4733965 - DNA, 11 bp, Homo sapiens
atttctttata

SEQ ID NO: 4733966 - DNA, 22 bp, Homo sapiens
atttgaataagatccaattcat

SEQ ID NO: 4733967 - DNA, 13 bp, Homo sapiens
atttgacctacaa

SEQ ID NO: 4733968 - DNA, 16 bp, Homo sapiens
atttgagcagggctca

SEQ ID NO: 4733969 - DNA, 19 bp, Homo sapiens
atttgattatttaagacta

SEQ ID NO: 4733970 - DNA, 20 bp, Homo sapiens
atttgcaagggaaaagtctc

SEQ ID NO: 4733971 - DNA, 22 bp, Homo sapiens
atttgcataacaattcctctac

SEQ ID NO: 4733972 - DNA, 21 bp, Homo sapiens
atttgcatatttttctaaaga

SEQ ID NO: 4733973 - DNA, 24 bp, Homo sapiens
atttgccatgggcttcactgtata

SEQ ID NO: 4733974 - DNA, 18 bp, Homo sapiens
atttgctgggcagttttt

SEQ ID NO: 4733975 - DNA, 12 bp, Homo sapiens
atttggaaaata

SEQ ID NO: 4733976 - DNA, 18 bp, Homo sapiens
atttggatttaaaagcct

SEQ ID NO: 4733977 - DNA, 21 bp, Homo sapiens
atttggcccaaactcatcttg

SEQ ID NO: 4733978 - DNA, 17 bp, Homo sapiens
atttgggtggtttttat

SEQ ID NO: 4733979 - DNA, 12 bp, Homo sapiens
atttggtttcta

SEQ ID NO: 4733980 - DNA, 18 bp, Homo sapiens
atttggtttgttaattct

SEQ ID NO: 4733981 - DNA, 17 bp, Homo sapiens
atttgtaagtttcaggt

SEQ ID NO: 4733982 - DNA, 18 bp, Homo sapiens
atttgtaagtttcaggtg

SEQ ID NO: 4733983 - DNA, 21 bp, Homo sapiens
atttgtaagtttcaggtgaca

SEQ ID NO: 4733984 - DNA, 16 bp, Homo sapiens
atttgtatatggtatt

SEQ ID NO: 4733985 - DNA, 21 bp, Homo sapiens
atttgtgatgacaactggaat

SEQ ID NO: 4733986 - DNA, 12 bp, Homo sapiens
atttgttaatgg

SEQ ID NO: 4733987 - DNA, 16 bp, Homo sapiens
atttgttattttgcaa

SEQ ID NO: 4733988 - DNA, 13 bp, Homo sapiens
atttgttttcccg

SEQ ID NO: 4733989 - DNA, 16 bp, Homo sapiens
attttaaaagttttgt

SEQ ID NO: 4733990 - DNA, 16 bp, Homo sapiens
attttaaaggataatg

SEQ ID NO: 4733991 - DNA, 13 bp, Homo sapiens
attttaatcctgt

SEQ ID NO: 4733992 - DNA, 17 bp, Homo sapiens
attttacatctgaacaa

SEQ ID NO: 4733993 - DNA, 18 bp, Homo sapiens
attttatacccttgactt

SEQ ID NO: 4733994 - DNA, 17 bp, Homo sapiens
attttatagctactaat

SEQ ID NO: 4733995 - DNA, 19 bp, Homo sapiens
attttatagctactaattt

SEQ ID NO: 4733996 - DNA, 21 bp, Homo sapiens
attttatgccttttatttctt

SEQ ID NO: 4733997 - DNA, 20 bp, Homo sapiens
attttcacaattattaaatt

SEQ ID NO: 4733998 - DNA, 22 bp, Homo sapiens
attttcacttttggcaatgact

SEQ ID NO: 4733999 - DNA, 16 bp, Homo sapiens
attttcagcatcaaac

SEQ ID NO: 4734000 - DNA, 21 bp, Homo sapiens
attttcagcatcaaacatgaa

SEQ ID NO: 4734001 - DNA, 20 bp, Homo sapiens
attttcataagtatttcaaa

SEQ ID NO: 4734002 - DNA, 15 bp, Homo sapiens
attttcatgcttcca

SEQ ID NO: 4734003 - DNA, 17 bp, Homo sapiens
attttccataagctatt

SEQ ID NO: 4734004 - DNA, 18 bp, Homo sapiens
caaatgcccaagggaaag

SEQ ID NO: 4734005 - DNA, 19 bp, Homo sapiens
caaatgcccaagggaaaga

SEQ ID NO: 4734006 - DNA, 20 bp, Homo sapiens
caaatgctgtgcaaacagtg

SEQ ID NO: 4734007 - DNA, 20 bp, Homo sapiens
caaatggaaatgggcagagc

SEQ ID NO: 4734008 - DNA, 21 bp, Homo sapiens
caaatggaaatgggcagagca

SEQ ID NO: 4734009 - DNA, 15 bp, Homo sapiens
caaatttacatttat

SEQ ID NO: 4734010 - DNA, 15 bp, Homo sapiens
caacaaacactgtga

SEQ ID NO: 4734011 - DNA, 21 bp, Homo sapiens
caacaacatgtataatatttt

SEQ ID NO: 4734012 - DNA, 22 bp, Homo sapiens
caacaacatgtataatattttt

SEQ ID NO: 4734013 - DNA, 14 bp, Homo sapiens
caacaagctatttt

SEQ ID NO: 4734014 - DNA, 21 bp, Homo sapiens
caacacacagatttgagctca

SEQ ID NO: 4734015 - DNA, 17 bp, Homo sapiens
caacactatatatttta

SEQ ID NO: 4734016 - DNA, 22 bp, Homo sapiens
caacactcacatttattctgct

SEQ ID NO: 4734017 - DNA, 20 bp, Homo sapiens
caacactcattgacctgagg

SEQ ID NO: 4734018 - DNA, 22 bp, Homo sapiens
caacactcattgacctgaggcc

SEQ ID NO: 4734019 - DNA, 13 bp, Homo sapiens
caacagcctgaga

SEQ ID NO: 4734020 - DNA, 14 bp, Homo sapiens
caacagcctgagaa

SEQ ID NO: 4734021 - DNA, 15 bp, Homo sapiens
caacagcctgagaaa

SEQ ID NO: 4734022 - DNA, 17 bp, Homo sapiens
caacaggctgggcttca

SEQ ID NO: 4734023 - DNA, 23 bp, Homo sapiens
caacaggctgggcttcagtggca

SEQ ID NO: 4734024 - DNA, 22 bp, Homo sapiens
caacagtgttaggcctggcaca

SEQ ID NO: 4734025 - DNA, 23 bp, Homo sapiens
caacagtgttaggcctggcacag

SEQ ID NO: 4734026 - DNA, 14 bp, Homo sapiens
caacatactcccat

SEQ ID NO: 4734027 - DNA, 16 bp, Homo sapiens
caacatactcccatct

SEQ ID NO: 4734028 - DNA, 20 bp, Homo sapiens
caacatgcctgcacctgcag

SEQ ID NO: 4734029 - DNA, 20 bp, Homo sapiens
caacatggattccaaagcat

SEQ ID NO: 4734030 - DNA, 21 bp, Homo sapiens
caacatggattccaaagcatt

SEQ ID NO: 4734031 - DNA, 18 bp, Homo sapiens
caacatgtataatatttt

SEQ ID NO: 4734032 - DNA, 23 bp, Homo sapiens
caaccatgagtggcatggccacc

SEQ ID NO: 4734033 - DNA, 20 bp, Homo sapiens
caacccccagcacccgggct

SEQ ID NO: 4734034 - DNA, 14 bp, Homo sapiens
caacccccagcccc

SEQ ID NO: 4734035 - DNA, 15 bp, Homo sapiens
caacccccagccccc

SEQ ID NO: 4734036 - DNA, 15 bp, Homo sapiens
caacccccagcctgc

SEQ ID NO: 4734037 - DNA, 14 bp, Homo sapiens
caaccccccagcac

SEQ ID NO: 4734038 - DNA, 16 bp, Homo sapiens
caaccccccagcactg

SEQ ID NO: 4734039 - DNA, 16 bp, Homo sapiens
caaccccttcgctcct

SEQ ID NO: 4734040 - DNA, 22 bp, Homo sapiens
caaccgccacacacacaggagc

SEQ ID NO: 4734041 - DNA, 16 bp, Homo sapiens
caacctgattgtgtct

SEQ ID NO: 4734042 - DNA, 21 bp, Homo sapiens
caacctgcctgacatttggag

SEQ ID NO: 4734043 - DNA, 11 bp, Homo sapiens
caacctggaga

SEQ ID NO: 4734044 - DNA, 18 bp, Homo sapiens
caaccttagatgttctaa

SEQ ID NO: 4734045 - DNA, 22 bp, Homo sapiens
caacctttcccatttcgtgtaa

SEQ ID NO: 4734046 - DNA, 13 bp, Homo sapiens
caacgtctgtgcc

SEQ ID NO: 4734047 - DNA, 14 bp, Homo sapiens
caacgtctgtgcca

SEQ ID NO: 4734048 - DNA, 21 bp, Homo sapiens
caactatcagactaagccagc

SEQ ID NO: 4734049 - DNA, 22 bp, Homo sapiens
caactatgatttggaaaataaa

SEQ ID NO: 4734050 - DNA, 13 bp, Homo sapiens
caactctttgaga

SEQ ID NO: 4734051 - DNA, 16 bp, Homo sapiens
caactctttgagaaac

SEQ ID NO: 4734052 - DNA, 13 bp, Homo sapiens
caactggctgaaa

SEQ ID NO: 4734053 - DNA, 24 bp, Homo sapiens
caactggttgtatatttttatatt

SEQ ID NO: 4734054 - DNA, 18 bp, Homo sapiens
caacttcttcagagctga

SEQ ID NO: 4734055 - DNA, 16 bp, Homo sapiens
caacttgtaaatgtgg

SEQ ID NO: 4734056 - DNA, 22 bp, Homo sapiens
caacttgtgaactccatcattc

SEQ ID NO: 4734057 - DNA, 16 bp, Homo sapiens
caagaaaacaggcact

SEQ ID NO: 4734058 - DNA, 22 bp, Homo sapiens
caagaaagatatctatgactgt

SEQ ID NO: 4734059 - DNA, 23 bp, Homo sapiens
caagaaatcgccttatgagaaca

SEQ ID NO: 4734060 - DNA, 14 bp, Homo sapiens
caagaaccatttgc

SEQ ID NO: 4734061 - DNA, 20 bp, Homo sapiens
caagaagcaggctacactga

SEQ ID NO: 4734062 - DNA, 23 bp, Homo sapiens
caagaagggctagaacctggagg

SEQ ID NO: 4734063 - DNA, 13 bp, Homo sapiens
caagaccctctca

SEQ ID NO: 4734064 - DNA, 15 bp, Homo sapiens
caagaccctctcagg

SEQ ID NO: 4734065 - DNA, 18 bp, Homo sapiens
caagacccttgtggtccc

SEQ ID NO: 4734066 - DNA, 19 bp, Homo sapiens
caagacgctgtgctgccct

SEQ ID NO: 4734067 - DNA, 23 bp, Homo sapiens
caagacgctgtgctgccctgccc

SEQ ID NO: 4734068 - DNA, 17 bp, Homo sapiens
caagagcttaacagtgt

SEQ ID NO: 4734069 - DNA, 17 bp, Homo sapiens
caagaggcaaaggaatc

SEQ ID NO: 4734070 - DNA, 17 bp, Homo sapiens
caagagggtctgaggaa

SEQ ID NO: 4734071 - DNA, 22 bp, Homo sapiens
caagagtgagactccacctcaa

SEQ ID NO: 4734072 - DNA, 14 bp, Homo sapiens
caagcacctcctgc

SEQ ID NO: 4734073 - DNA, 15 bp, Homo sapiens
caagcacctcctgcc

SEQ ID NO: 4734074 - DNA, 18 bp, Homo sapiens
caagcacctcctgcctcg

SEQ ID NO: 4734075 - DNA, 12 bp, Homo sapiens
caagcagccaag

SEQ ID NO: 4734076 - DNA, 17 bp, Homo sapiens
caagcaggaaatgaaaa

SEQ ID NO: 4734077 - DNA, 16 bp, Homo sapiens
caagcagtagacaagc

SEQ ID NO: 4734078 - DNA, 22 bp, Homo sapiens
caagccaccaacatactcccat

SEQ ID NO: 4734079 - DNA, 12 bp, Homo sapiens
caagcctctgga

SEQ ID NO: 4734080 - DNA, 14 bp, Homo sapiens
caagcctgtccatt

SEQ ID NO: 4734081 - DNA, 19 bp, Homo sapiens
caagcgattcttctgcttc

SEQ ID NO: 4734082 - DNA, 22 bp, Homo sapiens
caagcgattcttctgcttcagc

SEQ ID NO: 4734083 - DNA, 16 bp, Homo sapiens
caagcgtgagccactg

SEQ ID NO: 4734084 - DNA, 18 bp, Homo sapiens
caagcgtgagccactgca

SEQ ID NO: 4734085 - DNA, 16 bp, Homo sapiens
caagctcaaagcgtgg

SEQ ID NO: 4734086 - DNA, 18 bp, Homo sapiens
caagctccaagctcccag

SEQ ID NO: 4734087 - DNA, 18 bp, Homo sapiens
caagctcccaagggatgg

SEQ ID NO: 4734088 - DNA, 19 bp, Homo sapiens
caagctctatcaccaagga

SEQ ID NO: 4734089 - DNA, 21 bp, Homo sapiens
caagctggtcccactcagtcc

SEQ ID NO: 4734090 - DNA, 16 bp, Homo sapiens
caagctgtgccaccct

SEQ ID NO: 4734091 - DNA, 20 bp, Homo sapiens
caaggaaaccacagctgctg

SEQ ID NO: 4734092 - DNA, 12 bp, Homo sapiens
caaggaagtcaa

SEQ ID NO: 4734093 - DNA, 21 bp, Homo sapiens
caaggaagtctgtgtctacca

SEQ ID NO: 4734094 - DNA, 14 bp, Homo sapiens
caaggactagggtc

SEQ ID NO: 4734095 - DNA, 14 bp, Homo sapiens
caaggactggtaaa

SEQ ID NO: 4734096 - DNA, 15 bp, Homo sapiens
caaggagaggaggca

SEQ ID NO: 4734097 - DNA, 18 bp, Homo sapiens
caaggagaggaggcaact

SEQ ID NO: 4734098 - DNA, 21 bp, Homo sapiens
caaggaggctggctggggcct

SEQ ID NO: 4734099 - DNA, 21 bp, Homo sapiens
caaggatgatctaggaagact

SEQ ID NO: 4734100 - DNA, 15 bp, Homo sapiens
caaggattgctactg

SEQ ID NO: 4734101 - DNA, 15 bp, Homo sapiens
caaggcacctgcagg

SEQ ID NO: 4734102 - DNA, 17 bp, Homo sapiens
caaggctgtgctccctg

SEQ ID NO: 4734103 - DNA, 16 bp, Homo sapiens
caagggaaaagtctct

SEQ ID NO: 4734104 - DNA, 23 bp, Homo sapiens
caagggaatttcttcaactccct

SEQ ID NO: 4734105 - DNA, 13 bp, Homo sapiens
caagggatggtgc

SEQ ID NO: 4734106 - DNA, 20 bp, Homo sapiens
caagggctttgttttgcaca

SEQ ID NO: 4734107 - DNA, 21 bp, Homo sapiens
caaggggtggccgtcctgagg

SEQ ID NO: 4734108 - DNA, 20 bp, Homo sapiens
caaggtggtctgctcgggcc

SEQ ID NO: 4734109 - DNA, 23 bp, Homo sapiens
caaggtggtctgctcgggcccag

SEQ ID NO: 4734110 - DNA, 17 bp, Homo sapiens
caaggtttataaagcag

SEQ ID NO: 4734111 - DNA, 22 bp, Homo sapiens
caaggtttataaagcagattac

SEQ ID NO: 4734112 - DNA, 20 bp, Homo sapiens
caagtactacattttctttt

SEQ ID NO: 4734113 - DNA, 15 bp, Homo sapiens
cagccacggccaggc

SEQ ID NO: 4734114 - DNA, 16 bp, Homo sapiens
cagccacggccaggcc

SEQ ID NO: 4734115 - DNA, 19 bp, Homo sapiens
cagccacggccaggccaga

SEQ ID NO: 4734116 - DNA, 23 bp, Homo sapiens
cagccacggccaggccagaggga

SEQ ID NO: 4734117 - DNA, 12 bp, Homo sapiens
cagccaggccac

SEQ ID NO: 4734118 - DNA, 17 bp, Homo sapiens
cagccagggagagccca

SEQ ID NO: 4734119 - DNA, 20 bp, Homo sapiens
cagccagggagagcccagga

SEQ ID NO: 4734120 - DNA, 12 bp, Homo sapiens
cagccagggctg

SEQ ID NO: 4734121 - DNA, 18 bp, Homo sapiens
cagccaggtgctgtgaca

SEQ ID NO: 4734122 - DNA, 17 bp, Homo sapiens
cagccatcccagccttg

SEQ ID NO: 4734123 - DNA, 21 bp, Homo sapiens
cagccccaaaactctcctctg

SEQ ID NO: 4734124 - DNA, 22 bp, Homo sapiens
cagccccaaaactctcctctgc

SEQ ID NO: 4734125 - DNA, 15 bp, Homo sapiens
cagccccacagccca

SEQ ID NO: 4734126 - DNA, 16 bp, Homo sapiens
cagccccacagcccac

SEQ ID NO: 4734127 - DNA, 14 bp, Homo sapiens
cagccccaccccag

SEQ ID NO: 4734128 - DNA, 18 bp, Homo sapiens
cagccccaccccagggca

SEQ ID NO: 4734129 - DNA, 22 bp, Homo sapiens
cagccccaccccagggcagcca

SEQ ID NO: 4734130 - DNA, 16 bp, Homo sapiens
cagccccatcctctgt

SEQ ID NO: 4734131 - DNA, 19 bp, Homo sapiens
cagccccattctgcctgcc

SEQ ID NO: 4734132 - DNA, 22 bp, Homo sapiens
cagccccattctgcctgcccag

SEQ ID NO: 4734133 - DNA, 23 bp, Homo sapiens
cagccccattctgcctgcccagg

SEQ ID NO: 4734134 - DNA, 24 bp, Homo sapiens
cagccccattctgcctgcccaggc

SEQ ID NO: 4734135 - DNA, 21 bp, Homo sapiens
cagcccccactgcctttgacc

SEQ ID NO: 4734136 - DNA, 20 bp, Homo sapiens
cagcccctgatcctgtgaag

SEQ ID NO: 4734137 - DNA, 17 bp, Homo sapiens
cagcccctgctggctgg

SEQ ID NO: 4734138 - DNA, 18 bp, Homo sapiens
cagcccctggatgcagcc

SEQ ID NO: 4734139 - DNA, 21 bp, Homo sapiens
cagcccctggatgcagcctca

SEQ ID NO: 4734140 - DNA, 17 bp, Homo sapiens
cagccccttctgaccca

SEQ ID NO: 4734141 - DNA, 19 bp, Homo sapiens
cagccccttctgacccatg

SEQ ID NO: 4734142 - DNA, 14 bp, Homo sapiens
cagcccgggctctg

SEQ ID NO: 4734143 - DNA, 16 bp, Homo sapiens
cagcccgggctctgcc

SEQ ID NO: 4734144 - DNA, 19 bp, Homo sapiens
cagcccgggctctgcctcc

SEQ ID NO: 4734145 - DNA, 18 bp, Homo sapiens
cagccctagggtggagag

SEQ ID NO: 4734146 - DNA, 13 bp, Homo sapiens
cagccctcacccc

SEQ ID NO: 4734147 - DNA, 14 bp, Homo sapiens
cagccctcatcccg

SEQ ID NO: 4734148 - DNA, 17 bp, Homo sapiens
cagccctcatcccgagc

SEQ ID NO: 4734149 - DNA, 22 bp, Homo sapiens
cagccctccatctaaactgccc

SEQ ID NO: 4734150 - DNA, 20 bp, Homo sapiens
cagccctcccgccccttccc

SEQ ID NO: 4734151 - DNA, 12 bp, Homo sapiens
cagccctcctta

SEQ ID NO: 4734152 - DNA, 21 bp, Homo sapiens
cagccctccttaccactgtgg

SEQ ID NO: 4734153 - DNA, 20 bp, Homo sapiens
cagccctgctgctgcctgcc

SEQ ID NO: 4734154 - DNA, 13 bp, Homo sapiens
cagccctggctga

SEQ ID NO: 4734155 - DNA, 20 bp, Homo sapiens
cagccctggctgaaggactg

SEQ ID NO: 4734156 - DNA, 13 bp, Homo sapiens
cagcccttagcag

SEQ ID NO: 4734157 - DNA, 15 bp, Homo sapiens
cagcccttagcaggg

SEQ ID NO: 4734158 - DNA, 20 bp, Homo sapiens
cagccgctgagcgaggagat

SEQ ID NO: 4734159 - DNA, 17 bp, Homo sapiens
cagccggtacctgggaa

SEQ ID NO: 4734160 - DNA, 18 bp, Homo sapiens
cagcctcaacctcctggg

SEQ ID NO: 4734161 - DNA, 20 bp, Homo sapiens
cagcctcaataagccttgtc

SEQ ID NO: 4734162 - DNA, 14 bp, Homo sapiens
cagcctcacagtcc

SEQ ID NO: 4734163 - DNA, 20 bp, Homo sapiens
cagcctcacagtccttacca

SEQ ID NO: 4734164 - DNA, 21 bp, Homo sapiens
cagcctcagagacatcagccc

SEQ ID NO: 4734165 - DNA, 19 bp, Homo sapiens
cagcctcccaaagtgctgg

SEQ ID NO: 4734166 - DNA, 17 bp, Homo sapiens
cagcctcccctgccagg

SEQ ID NO: 4734167 - DNA, 22 bp, Homo sapiens
cagcctcccctgccagggcagg

SEQ ID NO: 4734168 - DNA, 19 bp, Homo sapiens
cagcctcccgagtagctgg

SEQ ID NO: 4734169 - DNA, 20 bp, Homo sapiens
cagcctcccgagtagctggg

SEQ ID NO: 4734170 - DNA, 13 bp, Homo sapiens
caggccaggactc

SEQ ID NO: 4734171 - DNA, 11 bp, Homo sapiens
caggccaggcc

SEQ ID NO: 4734172 - DNA, 14 bp, Homo sapiens
caggccaggccctc

SEQ ID NO: 4734173 - DNA, 15 bp, Homo sapiens
caggccaggccctct

SEQ ID NO: 4734174 - DNA, 18 bp, Homo sapiens
caggccaggccctctgcc

SEQ ID NO: 4734175 - DNA, 20 bp, Homo sapiens
caggccaggccctctgccca

SEQ ID NO: 4734176 - DNA, 21 bp, Homo sapiens
caggccaggccctctgcccac

SEQ ID NO: 4734177 - DNA, 13 bp, Homo sapiens
caggcccctctcc

SEQ ID NO: 4734178 - DNA, 15 bp, Homo sapiens
caggcccctctcctc

SEQ ID NO: 4734179 - DNA, 17 bp, Homo sapiens
caggcccctctcctccg

SEQ ID NO: 4734180 - DNA, 15 bp, Homo sapiens
caggcccctgccacc

SEQ ID NO: 4734181 - DNA, 16 bp, Homo sapiens
caggcccggctccagg

SEQ ID NO: 4734182 - DNA, 19 bp, Homo sapiens
caggcccggctccaggctc

SEQ ID NO: 4734183 - DNA, 22 bp, Homo sapiens
caggcccggctccaggctcctt

SEQ ID NO: 4734184 - DNA, 13 bp, Homo sapiens
caggccctctgcc

SEQ ID NO: 4734185 - DNA, 16 bp, Homo sapiens
caggccctctgcccac

SEQ ID NO: 4734186 - DNA, 17 bp, Homo sapiens
caggccctctgcccact

SEQ ID NO: 4734187 - DNA, 22 bp, Homo sapiens
caggccctctgcccactccctg

SEQ ID NO: 4734188 - DNA, 17 bp, Homo sapiens
caggccctgcactgtcc

SEQ ID NO: 4734189 - DNA, 20 bp, Homo sapiens
caggccctgcactgtcctgc

SEQ ID NO: 4734190 - DNA, 14 bp, Homo sapiens
caggcctgagattt

SEQ ID NO: 4734191 - DNA, 21 bp, Homo sapiens
caggcctgccttctcagggac

SEQ ID NO: 4734192 - DNA, 12 bp, Homo sapiens
caggcctgggcc

SEQ ID NO: 4734193 - DNA, 18 bp, Homo sapiens
caggctcctgccaccacg

SEQ ID NO: 4734194 - DNA, 14 bp, Homo sapiens
caggctcctttagc

SEQ ID NO: 4734195 - DNA, 21 bp, Homo sapiens
caggctcctttagcgcccagt

SEQ ID NO: 4734196 - DNA, 18 bp, Homo sapiens
caggctctgagacacacc

SEQ ID NO: 4734197 - DNA, 14 bp, Homo sapiens
caggctgagcctca

SEQ ID NO: 4734198 - DNA, 18 bp, Homo sapiens
caggctgctggaaggcag

SEQ ID NO: 4734199 - DNA, 11 bp, Homo sapiens
caggctggcca

SEQ ID NO: 4734200 - DNA, 12 bp, Homo sapiens
caggctggccct

SEQ ID NO: 4734201 - DNA, 16 bp, Homo sapiens
caggctggccctgccc

SEQ ID NO: 4734202 - DNA, 12 bp, Homo sapiens
caggctgggaga

SEQ ID NO: 4734203 - DNA, 16 bp, Homo sapiens
caggctgggagagcct

SEQ ID NO: 4734204 - DNA, 18 bp, Homo sapiens
caggctgggcaaggaggc

SEQ ID NO: 4734205 - DNA, 15 bp, Homo sapiens
caggctgggcttcag

SEQ ID NO: 4734206 - DNA, 16 bp, Homo sapiens
caggctgggcttcagt

SEQ ID NO: 4734207 - DNA, 20 bp, Homo sapiens
caggctgggcttcagtggca

SEQ ID NO: 4734208 - DNA, 14 bp, Homo sapiens
caggctgtatccca

SEQ ID NO: 4734209 - DNA, 20 bp, Homo sapiens
caggctgtatcccatgagcc

SEQ ID NO: 4734210 - DNA, 21 bp, Homo sapiens
caggctgtatcccatgagcct

SEQ ID NO: 4734211 - DNA, 21 bp, Homo sapiens
caggctgtcccaagctcccaa

SEQ ID NO: 4734212 - DNA, 16 bp, Homo sapiens
caggcttagtcactga

SEQ ID NO: 4734213 - DNA, 20 bp, Homo sapiens
caggcttagtcactgagaca

SEQ ID NO: 4734214 - DNA, 13 bp, Homo sapiens
caggcttgcctgg

SEQ ID NO: 4734215 - DNA, 15 bp, Homo sapiens
caggcttgcctggga

SEQ ID NO: 4734216 - DNA, 19 bp, Homo sapiens
cagggaaaaagaccaaatt

SEQ ID NO: 4734217 - DNA, 15 bp, Homo sapiens
cagggaaaatatata

SEQ ID NO: 4734218 - DNA, 17 bp, Homo sapiens
cagggaaggggacaagg

SEQ ID NO: 4734219 - DNA, 15 bp, Homo sapiens
cagggaccacagcaa

SEQ ID NO: 4734220 - DNA, 17 bp, Homo sapiens
cagggaccacagcaagg

SEQ ID NO: 4734221 - DNA, 18 bp, Homo sapiens
cagggactgttcctgtct

SEQ ID NO: 4734222 - DNA, 13 bp, Homo sapiens
cagggagggcctg

SEQ ID NO: 4734223 - DNA, 16 bp, Homo sapiens
cagggagggcctgggc

SEQ ID NO: 4734224 - DNA, 17 bp, Homo sapiens
cagggagggcctgggcc

SEQ ID NO: 4734225 - DNA, 18 bp, Homo sapiens
cagggaggtgaccccagg

SEQ ID NO: 4734226 - DNA, 22 bp, Homo sapiens
cagggagtccgaaagggacttg

SEQ ID NO: 4734227 - DNA, 19 bp, Homo sapiens
cagggatgagcatggagct

SEQ ID NO: 4734228 - DNA, 20 bp, Homo sapiens
cagggatgagcatggagctg

SEQ ID NO: 4734229 - DNA, 23 bp, Homo sapiens
cagggatgagcatggagctggcc

SEQ ID NO: 4734230 - DNA, 18 bp, Homo sapiens
cagggatgtacaaggcga

SEQ ID NO: 4734231 - DNA, 11 bp, Homo sapiens
cagggatttgc

SEQ ID NO: 4734232 - DNA, 14 bp, Homo sapiens
cagggcacaccggg

SEQ ID NO: 4734233 - DNA, 23 bp, Homo sapiens
cagggcacaccgggcactcagaa

SEQ ID NO: 4734234 - DNA, 12 bp, Homo sapiens
cagggcagccag

SEQ ID NO: 4734235 - DNA, 17 bp, Homo sapiens
cagggcagccagggaga

SEQ ID NO: 4734236 - DNA, 23 bp, Homo sapiens
cagggcagccagggagagcccag

SEQ ID NO: 4734237 - DNA, 22 bp, Homo sapiens
atgcttcttcagagactcctgc

SEQ ID NO: 4734238 - DNA, 12 bp, Homo sapiens
atgcttggtttt

SEQ ID NO: 4734239 - DNA, 13 bp, Homo sapiens
atgcttgtgtata

SEQ ID NO: 4734240 - DNA, 23 bp, Homo sapiens
atgctttgaatgcaaaagaaatt

SEQ ID NO: 4734241 - DNA, 16 bp, Homo sapiens
atggaaacactgattt

SEQ ID NO: 4734242 - DNA, 13 bp, Homo sapiens
atggaagacacat

SEQ ID NO: 4734243 - DNA, 14 bp, Homo sapiens
atggaagccaacac

SEQ ID NO: 4734244 - DNA, 20 bp, Homo sapiens
atggaatctaccaactgttt

SEQ ID NO: 4734245 - DNA, 20 bp, Homo sapiens
atggacatgtgtcccagcca

SEQ ID NO: 4734246 - DNA, 13 bp, Homo sapiens
atggaccggagag

SEQ ID NO: 4734247 - DNA, 17 bp, Homo sapiens
atggacggtgctccagg

SEQ ID NO: 4734248 - DNA, 22 bp, Homo sapiens
atggacggtgctccaggcaggc

SEQ ID NO: 4734249 - DNA, 19 bp, Homo sapiens
atggactgactgtaacgat

SEQ ID NO: 4734250 - DNA, 16 bp, Homo sapiens
atggagaatggtgttc

SEQ ID NO: 4734251 - DNA, 14 bp, Homo sapiens
atggagctcagaga

SEQ ID NO: 4734252 - DNA, 13 bp, Homo sapiens
atggagctggccg

SEQ ID NO: 4734253 - DNA, 21 bp, Homo sapiens
atggaggatctctaaagagca

SEQ ID NO: 4734254 - DNA, 19 bp, Homo sapiens
atggatatgtgtaaatgtt

SEQ ID NO: 4734255 - DNA, 22 bp, Homo sapiens
atggatggtggaccctactatt

SEQ ID NO: 4734256 - DNA, 16 bp, Homo sapiens
atggattccaaagcat

SEQ ID NO: 4734257 - DNA, 22 bp, Homo sapiens
atggattggattatttaataac

SEQ ID NO: 4734258 - DNA, 16 bp, Homo sapiens
atggatttttctttaa

SEQ ID NO: 4734259 - DNA, 19 bp, Homo sapiens
atggatttttctttaactg

SEQ ID NO: 4734260 - DNA, 16 bp, Homo sapiens
atggcactatttttat

SEQ ID NO: 4734261 - DNA, 15 bp, Homo sapiens
atggcagaaggcaaa

SEQ ID NO: 4734262 - DNA, 20 bp, Homo sapiens
atggcagaaggcaaacccat

SEQ ID NO: 4734263 - DNA, 22 bp, Homo sapiens
atggcaggatggcctggccagg

SEQ ID NO: 4734264 - DNA, 21 bp, Homo sapiens
atggcatccctttttcataaa

SEQ ID NO: 4734265 - DNA, 17 bp, Homo sapiens
atggccctgctgcccct

SEQ ID NO: 4734266 - DNA, 12 bp, Homo sapiens
atggcctggcca

SEQ ID NO: 4734267 - DNA, 22 bp, Homo sapiens
atggctcactatggtgccaatg

SEQ ID NO: 4734268 - DNA, 12 bp, Homo sapiens
atggctcttcat

SEQ ID NO: 4734269 - DNA, 13 bp, Homo sapiens
atggctgtgagga

SEQ ID NO: 4734270 - DNA, 14 bp, Homo sapiens
atggctgtgaggat

SEQ ID NO: 4734271 - DNA, 21 bp, Homo sapiens
atggcttccaaggtggtctgc

SEQ ID NO: 4734272 - DNA, 14 bp, Homo sapiens
atggctttttttgc

SEQ ID NO: 4734273 - DNA, 24 bp, Homo sapiens
atggctttttttgcctaccatttc

SEQ ID NO: 4734274 - DNA, 17 bp, Homo sapiens
atgggagccgggtctgc

SEQ ID NO: 4734275 - DNA, 19 bp, Homo sapiens
atgggcaacccccagcctg

SEQ ID NO: 4734276 - DNA, 15 bp, Homo sapiens
atgggcagagcagag

SEQ ID NO: 4734277 - DNA, 18 bp, Homo sapiens
atgggcctcctgtgtgtg

SEQ ID NO: 4734278 - DNA, 20 bp, Homo sapiens
atgggctgggttctacccag

SEQ ID NO: 4734279 - DNA, 16 bp, Homo sapiens
atgggcttagagcagt

SEQ ID NO: 4734280 - DNA, 12 bp, Homo sapiens
atggggagtgag

SEQ ID NO: 4734281 - DNA, 24 bp, Homo sapiens
atggggctgcaccggctggcctgg

SEQ ID NO: 4734282 - DNA, 20 bp, Homo sapiens
atgggtcgggagaggggacg

SEQ ID NO: 4734283 - DNA, 17 bp, Homo sapiens
atggtatgatcaataaa

SEQ ID NO: 4734284 - DNA, 18 bp, Homo sapiens
atggtcagccctagggtg

SEQ ID NO: 4734285 - DNA, 23 bp, Homo sapiens
atggtcctcatggtgcatataaa

SEQ ID NO: 4734286 - DNA, 15 bp, Homo sapiens
atggtgacttttgaa

SEQ ID NO: 4734287 - DNA, 21 bp, Homo sapiens
atggtgagagaagcctgtgcc

SEQ ID NO: 4734288 - DNA, 16 bp, Homo sapiens
atggtgatgaaatgta

SEQ ID NO: 4734289 - DNA, 12 bp, Homo sapiens
atggtggctggg

SEQ ID NO: 4734290 - DNA, 20 bp, Homo sapiens
atggtgtaataagacataac

SEQ ID NO: 4734291 - DNA, 16 bp, Homo sapiens
atggtgtgtgtctctg

SEQ ID NO: 4734292 - DNA, 18 bp, Homo sapiens
atggtgtgtgtctctgac

SEQ ID NO: 4734293 - DNA, 13 bp, Homo sapiens
atggttctgtgcc

SEQ ID NO: 4734294 - DNA, 17 bp, Homo sapiens
atggttgatgatacttc

SEQ ID NO: 4734295 - DNA, 22 bp, Homo sapiens
atggtttgaatataaacactat

SEQ ID NO: 4734296 - DNA, 16 bp, Homo sapiens
atggtttgcaaggaag

SEQ ID NO: 4734297 - DNA, 15 bp, Homo sapiens
atgtaaaagaaaatt

SEQ ID NO: 4734298 - DNA, 15 bp, Homo sapiens
atgtaaaatcttcag

SEQ ID NO: 4734299 - DNA, 16 bp, Homo sapiens
atgtaaaatcttcagc

SEQ ID NO: 4734300 - DNA, 18 bp, Homo sapiens
atgtaaaatcttcagctg

SEQ ID NO: 4734301 - DNA, 20 bp, Homo sapiens
atgtaaaatcttcagctggt

SEQ ID NO: 4734302 - DNA, 23 bp, Homo sapiens
atgtaaaatcttcagctggtgga

SEQ ID NO: 4734303 - DNA, 24 bp, Homo sapiens
atgtaaaatcttcagctggtggat

SEQ ID NO: 4734304 - DNA, 20 bp, Homo sapiens
atgtaaacataccaacatgt

SEQ ID NO: 4734305 - DNA, 20 bp, Homo sapiens
atgtaaagccaaaaccatct

SEQ ID NO: 4734306 - DNA, 23 bp, Homo sapiens
atgtaatctgatggcttctccag

SEQ ID NO: 4734307 - DNA, 19 bp, Homo sapiens
atgtaatgcttatgtgttg

SEQ ID NO: 4734308 - DNA, 22 bp, Homo sapiens
atgtaatggactatgcacactt

SEQ ID NO: 4734309 - DNA, 22 bp, Homo sapiens
atgtacctaatccaaatatcat

SEQ ID NO: 4734310 - DNA, 19 bp, Homo sapiens
atgtagaaattcttcatga

SEQ ID NO: 4734311 - DNA, 15 bp, Homo sapiens
atgtagcttgacaat

SEQ ID NO: 4734312 - DNA, 16 bp, Homo sapiens
aatttttattatttgt

SEQ ID NO: 4734313 - DNA, 14 bp, Homo sapiens
aatttttgtatttt

SEQ ID NO: 4734314 - DNA, 19 bp, Homo sapiens
aatttttttaaatttcagt

SEQ ID NO: 4734315 - DNA, 20 bp, Homo sapiens
aatttttttaaatttcagtc

SEQ ID NO: 4734316 - DNA, 11 bp, Homo sapiens
acaaaagcaat

SEQ ID NO: 4734317 - DNA, 18 bp, Homo sapiens
acaaaagcacttactttt

SEQ ID NO: 4734318 - DNA, 18 bp, Homo sapiens
acaaaaggataatgaata

SEQ ID NO: 4734319 - DNA, 22 bp, Homo sapiens
acaaaaggctttggcaacagaa

SEQ ID NO: 4734320 - DNA, 12 bp, Homo sapiens
acaaaataaagt

SEQ ID NO: 4734321 - DNA, 13 bp, Homo sapiens
acaaaataaagtg

SEQ ID NO: 4734322 - DNA, 19 bp, Homo sapiens
acaaaataaagtgtgtgtg

SEQ ID NO: 4734323 - DNA, 15 bp, Homo sapiens
acaaaatgccttttt

SEQ ID NO: 4734324 - DNA, 16 bp, Homo sapiens
acaaacaaaatttcta

SEQ ID NO: 4734325 - DNA, 12 bp, Homo sapiens
acaaacagtgaa

SEQ ID NO: 4734326 - DNA, 13 bp, Homo sapiens
acaaacagtgaat

SEQ ID NO: 4734327 - DNA, 17 bp, Homo sapiens
acaaacagtgaatttaa

SEQ ID NO: 4734328 - DNA, 17 bp, Homo sapiens
acaaacatggaaaacag

SEQ ID NO: 4734329 - DNA, 18 bp, Homo sapiens
acaaaccaaccatttcta

SEQ ID NO: 4734330 - DNA, 18 bp, Homo sapiens
acaaacctgcctgggttt

SEQ ID NO: 4734331 - DNA, 16 bp, Homo sapiens
acaaactaaatgtagt

SEQ ID NO: 4734332 - DNA, 22 bp, Homo sapiens
acaaagcggctttctaatagag

SEQ ID NO: 4734333 - DNA, 21 bp, Homo sapiens
acaaaggaggacaagaccctc

SEQ ID NO: 4734334 - DNA, 17 bp, Homo sapiens
acaaaggggcttaatta

SEQ ID NO: 4734335 - DNA, 20 bp, Homo sapiens
acaaatactatccaaataaa

SEQ ID NO: 4734336 - DNA, 21 bp, Homo sapiens
acaaatatggctagttttcaa

SEQ ID NO: 4734337 - DNA, 17 bp, Homo sapiens
acaaatgtaaacatttt

SEQ ID NO: 4734338 - DNA, 12 bp, Homo sapiens
acaaatgtgtat

SEQ ID NO: 4734339 - DNA, 15 bp, Homo sapiens
acaaatgtgtatgtg

SEQ ID NO: 4734340 - DNA, 11 bp, Homo sapiens
acaacaaacac

SEQ ID NO: 4734341 - DNA, 14 bp, Homo sapiens
acaacaaacactgt

SEQ ID NO: 4734342 - DNA, 17 bp, Homo sapiens
acaacaatactacctca

SEQ ID NO: 4734343 - DNA, 21 bp, Homo sapiens
acaacactcattgacctgagg

SEQ ID NO: 4734344 - DNA, 23 bp, Homo sapiens
acaacactcattgacctgaggcc

SEQ ID NO: 4734345 - DNA, 13 bp, Homo sapiens
acaacagcctgag

SEQ ID NO: 4734346 - DNA, 22 bp, Homo sapiens
acaacctttcccatttcgtgta

SEQ ID NO: 4734347 - DNA, 17 bp, Homo sapiens
acaactcagtttcatat

SEQ ID NO: 4734348 - DNA, 20 bp, Homo sapiens
acaactggaatagttttttt

SEQ ID NO: 4734349 - DNA, 14 bp, Homo sapiens
acaagacacagtga

SEQ ID NO: 4734350 - DNA, 18 bp, Homo sapiens
acaagagcttaacagtgt

SEQ ID NO: 4734351 - DNA, 13 bp, Homo sapiens
acaagcaagctcc

SEQ ID NO: 4734352 - DNA, 18 bp, Homo sapiens
acaagcactaaacaaaga

SEQ ID NO: 4734353 - DNA, 13 bp, Homo sapiens
acaagctccaagc

SEQ ID NO: 4734354 - DNA, 19 bp, Homo sapiens
acaagcttcagtaagttat

SEQ ID NO: 4734355 - DNA, 21 bp, Homo sapiens
acaaggaagtcaaagcaagga

SEQ ID NO: 4734356 - DNA, 17 bp, Homo sapiens
acaaggattgctactgt

SEQ ID NO: 4734357 - DNA, 19 bp, Homo sapiens
acaatactccctttaaaga

SEQ ID NO: 4734358 - DNA, 21 bp, Homo sapiens
acaatcacaaaagctgtgtct

SEQ ID NO: 4734359 - DNA, 22 bp, Homo sapiens
acaatcagctccttcctggaga

SEQ ID NO: 4734360 - DNA, 22 bp, Homo sapiens
acaatccaaatgcattcatgtt

SEQ ID NO: 4734361 - DNA, 16 bp, Homo sapiens
acaatggaccggagag

SEQ ID NO: 4734362 - DNA, 22 bp, Homo sapiens
acaatggtgttatttgaaactt

SEQ ID NO: 4734363 - DNA, 22 bp, Homo sapiens
acaatgttaaggaaactcttat

SEQ ID NO: 4734364 - DNA, 17 bp, Homo sapiens
acaattaagttacaatt

SEQ ID NO: 4734365 - DNA, 22 bp, Homo sapiens
acaattcctctactaacaatca

SEQ ID NO: 4734366 - DNA, 23 bp, Homo sapiens
acaattcctctactaacaatcag

SEQ ID NO: 4734367 - DNA, 13 bp, Homo sapiens
acaatttaaagca

SEQ ID NO: 4734368 - DNA, 14 bp, Homo sapiens
acaatttaaattgt

SEQ ID NO: 4734369 - DNA, 19 bp, Homo sapiens
acacaaaagtttctctttt

SEQ ID NO: 4734370 - DNA, 17 bp, Homo sapiens
acacaaacctgcctggg

SEQ ID NO: 4734371 - DNA, 21 bp, Homo sapiens
acacaatgttgcactgaaaac

SEQ ID NO: 4734372 - DNA, 14 bp, Homo sapiens
acacacacatacag

SEQ ID NO: 4734373 - DNA, 19 bp, Homo sapiens
acacacagaaatgtgtcaa

SEQ ID NO: 4734374 - DNA, 14 bp, Homo sapiens
acacacagctctgt

SEQ ID NO: 4734375 - DNA, 17 bp, Homo sapiens
acacacagctctgtcct

SEQ ID NO: 4734376 - DNA, 19 bp, Homo sapiens
acacacagctctgtcctgg

SEQ ID NO: 4734377 - DNA, 20 bp, Homo sapiens
acacagctaacacacagctc

SEQ ID NO: 4734378 - DNA, 21 bp, Homo sapiens
acacagctaacacacagctcc

SEQ ID NO: 4734379 - DNA, 23 bp, Homo sapiens
acacagctaacacacagctccca

SEQ ID NO: 4734380 - DNA, 17 bp, Homo sapiens
acacaggcccggctcca

SEQ ID NO: 4734381 - DNA, 18 bp, Homo sapiens
acacaggcccggctccag

SEQ ID NO: 4734382 - DNA, 22 bp, Homo sapiens
acacaggcccggctccaggctc

SEQ ID NO: 4734383 - DNA, 23 bp, Homo sapiens
acacaggcccggctccaggctcc

SEQ ID NO: 4734384 - DNA, 16 bp, Homo sapiens
acacagtattacttct

SEQ ID NO: 4734385 - DNA, 11 bp, Homo sapiens
acacagtgagt

SEQ ID NO: 4734386 - DNA, 22 bp, Homo sapiens
acacatacagagctctctgagg

SEQ ID NO: 4734387 - DNA, 21 bp, Homo sapiens
acacatgagcatcaggccagg

SEQ ID NO: 4734388 - DNA, 22 bp, Homo sapiens
acacatgtccaagaagcccagg

SEQ ID NO: 4734389 - DNA, 18 bp, Homo sapiens
acacattacaaagttaaa

SEQ ID NO: 4734390 - DNA, 14 bp, Homo sapiens
acacatttttcaga

SEQ ID NO: 4734391 - DNA, 18 bp, Homo sapiens
acaccaagctgtgccacc

SEQ ID NO: 4734392 - DNA, 20 bp, Homo sapiens
acaccaagctgtgccaccct

SEQ ID NO: 4734393 - DNA, 22 bp, Homo sapiens
acaccaagctgtgccaccctgg

SEQ ID NO: 4734394 - DNA, 14 bp, Homo sapiens
acaccacccagagc

SEQ ID NO: 4734395 - DNA, 19 bp, Homo sapiens
acaccagagcagatgcaga

SEQ ID NO: 4734396 - DNA, 20 bp, Homo sapiens
acaccagagcagatgcagag

SEQ ID NO: 4734397 - DNA, 13 bp, Homo sapiens
acaccagagccca

SEQ ID NO: 4734398 - DNA, 12 bp, Homo sapiens
acacccagccca

SEQ ID NO: 4734399 - DNA, 19 bp, Homo sapiens
acacccagcccacttctgc

SEQ ID NO: 4734400 - DNA, 18 bp, Homo sapiens
acaccctgtgatggggcc

SEQ ID NO: 4734401 - DNA, 19 bp, Homo sapiens
acaccctgtgatggggccc

SEQ ID NO: 4734402 - DNA, 20 bp, Homo sapiens
catgtggcttgaattaagaa

SEQ ID NO: 4734403 - DNA, 20 bp, Homo sapiens
catgtggttactagtacagg

SEQ ID NO: 4734404 - DNA, 14 bp, Homo sapiens
catgtgtatgagaa

SEQ ID NO: 4734405 - DNA, 22 bp, Homo sapiens
catgtgtgtccacgactgtctc

SEQ ID NO: 4734406 - DNA, 23 bp, Homo sapiens
catgtgtgtccacgactgtctcc

SEQ ID NO: 4734407 - DNA, 14 bp, Homo sapiens
catgtgttccaagg

SEQ ID NO: 4734408 - DNA, 18 bp, Homo sapiens
catgttctaatactttgt

SEQ ID NO: 4734409 - DNA, 15 bp, Homo sapiens
catgttctctgagga

SEQ ID NO: 4734410 - DNA, 14 bp, Homo sapiens
catgttctgtccct

SEQ ID NO: 4734411 - DNA, 20 bp, Homo sapiens
catgttggccaggctgctct

SEQ ID NO: 4734412 - DNA, 17 bp, Homo sapiens
catgttggccaggctgg

SEQ ID NO: 4734413 - DNA, 14 bp, Homo sapiens
catgtttaaacctg

SEQ ID NO: 4734414 - DNA, 21 bp, Homo sapiens
catgttttaaaagtttgtcct

SEQ ID NO: 4734415 - DNA, 19 bp, Homo sapiens
cattaaaggaaacgtggca

SEQ ID NO: 4734416 - DNA, 17 bp, Homo sapiens
cattaattcaatgaaat

SEQ ID NO: 4734417 - DNA, 13 bp, Homo sapiens
cattaccttactg

SEQ ID NO: 4734418 - DNA, 19 bp, Homo sapiens
cattagaaaaatagcaact

SEQ ID NO: 4734419 - DNA, 14 bp, Homo sapiens
cattagagcaggcg

SEQ ID NO: 4734420 - DNA, 23 bp, Homo sapiens
cattagcagttgctcacatgtct

SEQ ID NO: 4734421 - DNA, 20 bp, Homo sapiens
cattatgactgttgttctta

SEQ ID NO: 4734422 - DNA, 21 bp, Homo sapiens
cattatgatgtgggtcaagga

SEQ ID NO: 4734423 - DNA, 22 bp, Homo sapiens
cattatgatgtgggtcaaggaa

SEQ ID NO: 4734424 - DNA, 15 bp, Homo sapiens
cattatgttaatatt

SEQ ID NO: 4734425 - DNA, 17 bp, Homo sapiens
cattatgttaatatttc

SEQ ID NO: 4734426 - DNA, 21 bp, Homo sapiens
cattattattactttttaaaa

SEQ ID NO: 4734427 - DNA, 15 bp, Homo sapiens
cattattcaagaaag

SEQ ID NO: 4734428 - DNA, 20 bp, Homo sapiens
cattatttaatttgtatgct

SEQ ID NO: 4734429 - DNA, 21 bp, Homo sapiens
cattcatccaggactgagatg

SEQ ID NO: 4734430 - DNA, 14 bp, Homo sapiens
cattcatgcctggc

SEQ ID NO: 4734431 - DNA, 16 bp, Homo sapiens
cattcatgcctggctt

SEQ ID NO: 4734432 - DNA, 15 bp, Homo sapiens
cattcattccattct

SEQ ID NO: 4734433 - DNA, 22 bp, Homo sapiens
cattccgtcctgatgattttta

SEQ ID NO: 4734434 - DNA, 23 bp, Homo sapiens
cattcctcaccttttcccgggga

SEQ ID NO: 4734435 - DNA, 14 bp, Homo sapiens
cattcctgatgctt

SEQ ID NO: 4734436 - DNA, 19 bp, Homo sapiens
cattcctgatgcttcttca

SEQ ID NO: 4734437 - DNA, 12 bp, Homo sapiens
cattccttccca

SEQ ID NO: 4734438 - DNA, 22 bp, Homo sapiens
cattccttcccagaggggcctg

SEQ ID NO: 4734439 - DNA, 14 bp, Homo sapiens
cattccttctttga

SEQ ID NO: 4734440 - DNA, 22 bp, Homo sapiens
cattcgaagatccccagacttc

SEQ ID NO: 4734441 - DNA, 21 bp, Homo sapiens
cattctcacctaaaccctctg

SEQ ID NO: 4734442 - DNA, 22 bp, Homo sapiens
cattctcacctaaaccctctgt

SEQ ID NO: 4734443 - DNA, 16 bp, Homo sapiens
cattctccacctgcca

SEQ ID NO: 4734444 - DNA, 21 bp, Homo sapiens
cattctccacctgccagggac

SEQ ID NO: 4734445 - DNA, 13 bp, Homo sapiens
cattctgcctgcc

SEQ ID NO: 4734446 - DNA, 18 bp, Homo sapiens
cattctgcctgcccaggc

SEQ ID NO: 4734447 - DNA, 12 bp, Homo sapiens
cattctggaagt

SEQ ID NO: 4734448 - DNA, 21 bp, Homo sapiens
cattctgtctttcaaaaggta

SEQ ID NO: 4734449 - DNA, 23 bp, Homo sapiens
cattcttctgtacgtctgacagg

SEQ ID NO: 4734450 - DNA, 21 bp, Homo sapiens
cattcttggttggctggcctt

SEQ ID NO: 4734451 - DNA, 20 bp, Homo sapiens
cattctttcttggtgcattc

SEQ ID NO: 4734452 - DNA, 21 bp, Homo sapiens
cattgaagaatgttagagtaa

SEQ ID NO: 4734453 - DNA, 22 bp, Homo sapiens
cattgaattcttggttgaggaa

SEQ ID NO: 4734454 - DNA, 13 bp, Homo sapiens
cattgacctgagg

SEQ ID NO: 4734455 - DNA, 15 bp, Homo sapiens
cattgacctgaggcc

SEQ ID NO: 4734456 - DNA, 13 bp, Homo sapiens
cattgcaatagaa

SEQ ID NO: 4734457 - DNA, 17 bp, Homo sapiens
cattgccccatgagaca

SEQ ID NO: 4734458 - DNA, 13 bp, Homo sapiens
cattgccttttct

SEQ ID NO: 4734459 - DNA, 14 bp, Homo sapiens
cattgcggacagcc

SEQ ID NO: 4734460 - DNA, 16 bp, Homo sapiens
cattgctgttttaatt

SEQ ID NO: 4734461 - DNA, 21 bp, Homo sapiens
cattgctgttttaatttgtat

SEQ ID NO: 4734462 - DNA, 14 bp, Homo sapiens
cattggaactggag

SEQ ID NO: 4734463 - DNA, 16 bp, Homo sapiens
cattggacccttccat

SEQ ID NO: 4734464 - DNA, 11 bp, Homo sapiens
cattggatatt

SEQ ID NO: 4734465 - DNA, 20 bp, Homo sapiens
cattggatttttgttaattt

SEQ ID NO: 4734466 - DNA, 14 bp, Homo sapiens
cattggcagcaggt

SEQ ID NO: 4734467 - DNA, 14 bp, Homo sapiens
cattggctatttaa

SEQ ID NO: 4734468 - DNA, 17 bp, Homo sapiens
cattggttaaaatatta

SEQ ID NO: 4734469 - DNA, 15 bp, Homo sapiens
cattgtaaatctgaa

SEQ ID NO: 4734470 - DNA, 18 bp, Homo sapiens
cattgttggccaaagcca

SEQ ID NO: 4734471 - DNA, 18 bp, Homo sapiens
catttaaatacagtcttc

SEQ ID NO: 4734472 - DNA, 17 bp, Homo sapiens
catttaagagacagtca

SEQ ID NO: 4734473 - DNA, 18 bp, Homo sapiens
catttaataatgtatgta

SEQ ID NO: 4734474 - DNA, 21 bp, Homo sapiens
catttaatgtagccatgggac

SEQ ID NO: 4734475 - DNA, 22 bp, Homo sapiens
catttacccttcttttctgact

SEQ ID NO: 4734476 - DNA, 18 bp, Homo sapiens
catttagcccctctctta

SEQ ID NO: 4734477 - DNA, 15 bp, Homo sapiens
catttatgatttaat

SEQ ID NO: 4734478 - DNA, 21 bp, Homo sapiens
catttatgatttaataaaata

SEQ ID NO: 4734479 - DNA, 13 bp, Homo sapiens
catttatttgtga

SEQ ID NO: 4734480 - DNA, 18 bp, Homo sapiens
catttatttttctcatga

SEQ ID NO: 4734481 - DNA, 20 bp, Homo sapiens
catttcacccctccctttct

SEQ ID NO: 4734482 - DNA, 17 bp, Homo sapiens
cagtttcttctgtaaat

SEQ ID NO: 4734483 - DNA, 19 bp, Homo sapiens
cagtttggtttatattctt

SEQ ID NO: 4734484 - DNA, 16 bp, Homo sapiens
cagtttgtcacatgaa

SEQ ID NO: 4734485 - DNA, 14 bp, Homo sapiens
cagttttaactgtg

SEQ ID NO: 4734486 - DNA, 16 bp, Homo sapiens
cagttttaactgtgga

SEQ ID NO: 4734487 - DNA, 20 bp, Homo sapiens
cagttttaactgtggatatt

SEQ ID NO: 4734488 - DNA, 10 bp, Homo sapiens
cagtttttct

SEQ ID NO: 4734489 - DNA, 16 bp, Homo sapiens
cagtttttctgtattt

SEQ ID NO: 4734490 - DNA, 19 bp, Homo sapiens
cataaaagatatgttgaag

SEQ ID NO: 4734491 - DNA, 21 bp, Homo sapiens
cataaaatccaatattgtaat

SEQ ID NO: 4734492 - DNA, 15 bp, Homo sapiens
cataaatatgcagtg

SEQ ID NO: 4734493 - DNA, 20 bp, Homo sapiens
cataaatatgcagtgatatg

SEQ ID NO: 4734494 - DNA, 16 bp, Homo sapiens
cataaatttgttgtca

SEQ ID NO: 4734495 - DNA, 15 bp, Homo sapiens
cataacaattcctct

SEQ ID NO: 4734496 - DNA, 21 bp, Homo sapiens
cataagtccattaactgcttt

SEQ ID NO: 4734497 - DNA, 19 bp, Homo sapiens
cataagtgacaccaataaa

SEQ ID NO: 4734498 - DNA, 23 bp, Homo sapiens
cataagtgacaccaataaatgtt

SEQ ID NO: 4734499 - DNA, 19 bp, Homo sapiens
cataatcagtatatttggt

SEQ ID NO: 4734500 - DNA, 20 bp, Homo sapiens
cataatcagtatatttggtt

SEQ ID NO: 4734501 - DNA, 23 bp, Homo sapiens
cataatgtttctggatttcatac

SEQ ID NO: 4734502 - DNA, 13 bp, Homo sapiens
cataatttaaaaa

SEQ ID NO: 4734503 - DNA, 13 bp, Homo sapiens
cataattttgtgt

SEQ ID NO: 4734504 - DNA, 17 bp, Homo sapiens
cataattttgtgttgta

SEQ ID NO: 4734505 - DNA, 21 bp, Homo sapiens
cataattttgtgttgtacaat

SEQ ID NO: 4734506 - DNA, 20 bp, Homo sapiens
catacagatcaggcagtgtt

SEQ ID NO: 4734507 - DNA, 13 bp, Homo sapiens
catacataaaaga

SEQ ID NO: 4734508 - DNA, 21 bp, Homo sapiens
catacccacccccacccaagg

SEQ ID NO: 4734509 - DNA, 20 bp, Homo sapiens
catactaattataccccctg

SEQ ID NO: 4734510 - DNA, 16 bp, Homo sapiens
catactggcctcgcct

SEQ ID NO: 4734511 - DNA, 17 bp, Homo sapiens
catactgtaacattcag

SEQ ID NO: 4734512 - DNA, 18 bp, Homo sapiens
catactgtgctggagcca

SEQ ID NO: 4734513 - DNA, 15 bp, Homo sapiens
catacttgttctgta

SEQ ID NO: 4734514 - DNA, 23 bp, Homo sapiens
catagagagcaagacgctgtgct

SEQ ID NO: 4734515 - DNA, 16 bp, Homo sapiens
catagatcctaagcca

SEQ ID NO: 4734516 - DNA, 15 bp, Homo sapiens
catagatgcaggtga

SEQ ID NO: 4734517 - DNA, 23 bp, Homo sapiens
catagcagagaatgaaagggccc

SEQ ID NO: 4734518 - DNA, 15 bp, Homo sapiens
catagccctcaccct

SEQ ID NO: 4734519 - DNA, 14 bp, Homo sapiens
catagctcctgctc

SEQ ID NO: 4734520 - DNA, 13 bp, Homo sapiens
catagttgaaaaa

SEQ ID NO: 4734521 - DNA, 23 bp, Homo sapiens
catagttgaaaaaagaagtttgg

SEQ ID NO: 4734522 - DNA, 15 bp, Homo sapiens
catataaacatttta

SEQ ID NO: 4734523 - DNA, 16 bp, Homo sapiens
catataaagattaaca

SEQ ID NO: 4734524 - DNA, 15 bp, Homo sapiens
catataaatatattt

SEQ ID NO: 4734525 - DNA, 16 bp, Homo sapiens
catataatgaataaat

SEQ ID NO: 4734526 - DNA, 14 bp, Homo sapiens
catatcatttgtga

SEQ ID NO: 4734527 - DNA, 16 bp, Homo sapiens
catatcatttgtgaag

SEQ ID NO: 4734528 - DNA, 12 bp, Homo sapiens
catatctgactt

SEQ ID NO: 4734529 - DNA, 15 bp, Homo sapiens
catatcttgttagat

SEQ ID NO: 4734530 - DNA, 16 bp, Homo sapiens
catatcttgttagatt

SEQ ID NO: 4734531 - DNA, 17 bp, Homo sapiens
catatttaatttgaagg

SEQ ID NO: 4734532 - DNA, 18 bp, Homo sapiens
catattttcaccatttga

SEQ ID NO: 4734533 - DNA, 17 bp, Homo sapiens
catatttttctaaagaa

SEQ ID NO: 4734534 - DNA, 18 bp, Homo sapiens
catatttttctaaagaaa

SEQ ID NO: 4734535 - DNA, 12 bp, Homo sapiens
catcaaacatga

SEQ ID NO: 4734536 - DNA, 21 bp, Homo sapiens
catcaaataaaccttgtttct

SEQ ID NO: 4734537 - DNA, 19 bp, Homo sapiens
catcaaatggaagacacat

SEQ ID NO: 4734538 - DNA, 17 bp, Homo sapiens
catcaagaaatactttc

SEQ ID NO: 4734539 - DNA, 13 bp, Homo sapiens
catcaagactgga

SEQ ID NO: 4734540 - DNA, 16 bp, Homo sapiens
catcaagactggaagg

SEQ ID NO: 4734541 - DNA, 16 bp, Homo sapiens
catcaaggcactgcct

SEQ ID NO: 4734542 - DNA, 17 bp, Homo sapiens
catcaaggcactgcctg

SEQ ID NO: 4734543 - DNA, 13 bp, Homo sapiens
catcactcccctc

SEQ ID NO: 4734544 - DNA, 13 bp, Homo sapiens
catcaggactctt

SEQ ID NO: 4734545 - DNA, 18 bp, Homo sapiens
catcaggagttccagtgc

SEQ ID NO: 4734546 - DNA, 19 bp, Homo sapiens
catcaggccaggccctctg

SEQ ID NO: 4734547 - DNA, 23 bp, Homo sapiens
catcaggccaggccctctgccca

SEQ ID NO: 4734548 - DNA, 15 bp, Homo sapiens
catcagtgccagccc

SEQ ID NO: 4734549 - DNA, 19 bp, Homo sapiens
catcagtgccagcccctgc

SEQ ID NO: 4734550 - DNA, 16 bp, Homo sapiens
catcagtgctccctca

SEQ ID NO: 4734551 - DNA, 22 bp, Homo sapiens
catcagtgtacccccgcccagg

SEQ ID NO: 4734552 - DNA, 23 bp, Homo sapiens
catcagtgtacccccgcccaggc

SEQ ID NO: 4734553 - DNA, 19 bp, Homo sapiens
catcatagtttgctttgtt

SEQ ID NO: 4734554 - DNA, 18 bp, Homo sapiens
attgaaactacactaaat

SEQ ID NO: 4734555 - DNA, 21 bp, Homo sapiens
attgaattattttgttactgt

SEQ ID NO: 4734556 - DNA, 22 bp, Homo sapiens
attgaattattttgttactgtc

SEQ ID NO: 4734557 - DNA, 11 bp, Homo sapiens
attgaatttag

SEQ ID NO: 4734558 - DNA, 20 bp, Homo sapiens
attgacacacagaaatgtgt

SEQ ID NO: 4734559 - DNA, 20 bp, Homo sapiens
attgacctagttcagataca

SEQ ID NO: 4734560 - DNA, 13 bp, Homo sapiens
attgacctgaggc

SEQ ID NO: 4734561 - DNA, 16 bp, Homo sapiens
attgagcttgcttctt

SEQ ID NO: 4734562 - DNA, 19 bp, Homo sapiens
attgagtctgaagcactct

SEQ ID NO: 4734563 - DNA, 19 bp, Homo sapiens
attgataacagcactgact

SEQ ID NO: 4734564 - DNA, 16 bp, Homo sapiens
attgataagagggcac

SEQ ID NO: 4734565 - DNA, 18 bp, Homo sapiens
attgattatttgttttac

SEQ ID NO: 4734566 - DNA, 16 bp, Homo sapiens
attgcaacaggctggg

SEQ ID NO: 4734567 - DNA, 17 bp, Homo sapiens
attgcaacaggctgggc

SEQ ID NO: 4734568 - DNA, 18 bp, Homo sapiens
attgcaacaggctgggct

SEQ ID NO: 4734569 - DNA, 22 bp, Homo sapiens
attgcatctcccagataatgtg

SEQ ID NO: 4734570 - DNA, 14 bp, Homo sapiens
attgccaagggctt

SEQ ID NO: 4734571 - DNA, 21 bp, Homo sapiens
attgcctcttttcacattttt

SEQ ID NO: 4734572 - DNA, 13 bp, Homo sapiens
attgcgagagatg

SEQ ID NO: 4734573 - DNA, 16 bp, Homo sapiens
attgcgagagatgtgt

SEQ ID NO: 4734574 - DNA, 16 bp, Homo sapiens
attgcggacagccacg

SEQ ID NO: 4734575 - DNA, 21 bp, Homo sapiens
attgctactacttacctacca

SEQ ID NO: 4734576 - DNA, 21 bp, Homo sapiens
attgctgccccatcagtgctc

SEQ ID NO: 4734577 - DNA, 20 bp, Homo sapiens
attgctgttttaatttgtat

SEQ ID NO: 4734578 - DNA, 14 bp, Homo sapiens
attgcttgcacaaa

SEQ ID NO: 4734579 - DNA, 15 bp, Homo sapiens
attggaatcttcacc

SEQ ID NO: 4734580 - DNA, 22 bp, Homo sapiens
attggaatcttcacctcagagt

SEQ ID NO: 4734581 - DNA, 19 bp, Homo sapiens
attggacagtaaaatccac

SEQ ID NO: 4734582 - DNA, 19 bp, Homo sapiens
attggattatttaataaca

SEQ ID NO: 4734583 - DNA, 20 bp, Homo sapiens
attggattatttaataacat

SEQ ID NO: 4734584 - DNA, 16 bp, Homo sapiens
attggatttgtctttg

SEQ ID NO: 4734585 - DNA, 22 bp, Homo sapiens
attggcagcaggtgctgctacc

SEQ ID NO: 4734586 - DNA, 22 bp, Homo sapiens
attggccattctattgtggcaa

SEQ ID NO: 4734587 - DNA, 15 bp, Homo sapiens
attggctcacactga

SEQ ID NO: 4734588 - DNA, 16 bp, Homo sapiens
attggctcacactgag

SEQ ID NO: 4734589 - DNA, 13 bp, Homo sapiens
attggggtagttg

SEQ ID NO: 4734590 - DNA, 13 bp, Homo sapiens
attgggttatgaa

SEQ ID NO: 4734591 - DNA, 18 bp, Homo sapiens
attggtaaagaatggaag

SEQ ID NO: 4734592 - DNA, 15 bp, Homo sapiens
attggtaattaaaag

SEQ ID NO: 4734593 - DNA, 16 bp, Homo sapiens
attggtaattaaaaga

SEQ ID NO: 4734594 - DNA, 23 bp, Homo sapiens
attggtcatttagagtttcacag

SEQ ID NO: 4734595 - DNA, 21 bp, Homo sapiens
attggtcttaatgttgaatgt

SEQ ID NO: 4734596 - DNA, 22 bp, Homo sapiens
attggtcttaatgttgaatgta

SEQ ID NO: 4734597 - DNA, 17 bp, Homo sapiens
attgtaaaaaaaaatgc

SEQ ID NO: 4734598 - DNA, 14 bp, Homo sapiens
attgtaaaaataat

SEQ ID NO: 4734599 - DNA, 14 bp, Homo sapiens
attgtaaatactgg

SEQ ID NO: 4734600 - DNA, 19 bp, Homo sapiens
attgtaaatactggactca

SEQ ID NO: 4734601 - DNA, 15 bp, Homo sapiens
attgtaaatctgaag

SEQ ID NO: 4734602 - DNA, 18 bp, Homo sapiens
attgtaaatctgaagaaa

SEQ ID NO: 4734603 - DNA, 19 bp, Homo sapiens
attgtaactgttcttgaat

SEQ ID NO: 4734604 - DNA, 23 bp, Homo sapiens
attgtaataggcgtaactaattt

SEQ ID NO: 4734605 - DNA, 14 bp, Homo sapiens
attgtacagttttt

SEQ ID NO: 4734606 - DNA, 18 bp, Homo sapiens
attgtccaatcctatgtt

SEQ ID NO: 4734607 - DNA, 14 bp, Homo sapiens
attgtgatttcccg

SEQ ID NO: 4734608 - DNA, 13 bp, Homo sapiens
attgtggctccct

SEQ ID NO: 4734609 - DNA, 19 bp, Homo sapiens
attgtggctccctgggggc

SEQ ID NO: 4734610 - DNA, 14 bp, Homo sapiens
attgtggtgccaca

SEQ ID NO: 4734611 - DNA, 20 bp, Homo sapiens
attgttaatgcctataactt

SEQ ID NO: 4734612 - DNA, 21 bp, Homo sapiens
attgttaatgcctataacttt

SEQ ID NO: 4734613 - DNA, 13 bp, Homo sapiens
attgttcctgtca

SEQ ID NO: 4734614 - DNA, 10 bp, Homo sapiens
attgttctgg

SEQ ID NO: 4734615 - DNA, 23 bp, Homo sapiens
attgtttcagtgccatttgttaa

SEQ ID NO: 4734616 - DNA, 23 bp, Homo sapiens
attgttttactcctttttattca

SEQ ID NO: 4734617 - DNA, 13 bp, Homo sapiens
attgtttttgtat

SEQ ID NO: 4734618 - DNA, 15 bp, Homo sapiens
attgtttttgtattt

SEQ ID NO: 4734619 - DNA, 17 bp, Homo sapiens
attgtttttgtatttat

SEQ ID NO: 4734620 - DNA, 16 bp, Homo sapiens
atttaaaagacaaaca

SEQ ID NO: 4734621 - DNA, 17 bp, Homo sapiens
atttaaaagacaaacac

SEQ ID NO: 4734622 - DNA, 15 bp, Homo sapiens
atttaaaagcctgct

SEQ ID NO: 4734623 - DNA, 17 bp, Homo sapiens
atttaaaagcctgctca

SEQ ID NO: 4734624 - DNA, 22 bp, Homo sapiens
ccctggttctgatgatgtgcct

SEQ ID NO: 4734625 - DNA, 17 bp, Homo sapiens
ccctggtttcctgccct

SEQ ID NO: 4734626 - DNA, 21 bp, Homo sapiens
ccctgtcacttgctggctgtg

SEQ ID NO: 4734627 - DNA, 23 bp, Homo sapiens
ccctgtgagtttgtacagtcttg

SEQ ID NO: 4734628 - DNA, 22 bp, Homo sapiens
ccctgtgatggggccctgcctc

SEQ ID NO: 4734629 - DNA, 23 bp, Homo sapiens
ccctgtgatggggccctgcctcc

SEQ ID NO: 4734630 - DNA, 16 bp, Homo sapiens
ccctgtttgtttctga

SEQ ID NO: 4734631 - DNA, 22 bp, Homo sapiens
cccttaaaaattaaattctctc

SEQ ID NO: 4734632 - DNA, 20 bp, Homo sapiens
cccttagaagtttgttgtga

SEQ ID NO: 4734633 - DNA, 23 bp, Homo sapiens
cccttagcagggaaggctggtct

SEQ ID NO: 4734634 - DNA, 17 bp, Homo sapiens
cccttccacacccccac

SEQ ID NO: 4734635 - DNA, 13 bp, Homo sapiens
cccttccactgag

SEQ ID NO: 4734636 - DNA, 14 bp, Homo sapiens
cccttccccgaggg

SEQ ID NO: 4734637 - DNA, 12 bp, Homo sapiens
cccttcctttct

SEQ ID NO: 4734638 - DNA, 16 bp, Homo sapiens
cccttcgctcctgtgt

SEQ ID NO: 4734639 - DNA, 15 bp, Homo sapiens
cccttctcatcactc

SEQ ID NO: 4734640 - DNA, 22 bp, Homo sapiens
cccttctctccagcccctggat

SEQ ID NO: 4734641 - DNA, 23 bp, Homo sapiens
cccttctgacccatgctgccctg

SEQ ID NO: 4734642 - DNA, 18 bp, Homo sapiens
cccttgccgtctacctga

SEQ ID NO: 4734643 - DNA, 15 bp, Homo sapiens
cccttgctccagcct

SEQ ID NO: 4734644 - DNA, 18 bp, Homo sapiens
cccttgctccagcctgac

SEQ ID NO: 4734645 - DNA, 15 bp, Homo sapiens
cccttggacatttta

SEQ ID NO: 4734646 - DNA, 12 bp, Homo sapiens
cccttgggggtc

SEQ ID NO: 4734647 - DNA, 16 bp, Homo sapiens
cccttgtggtcccacc

SEQ ID NO: 4734648 - DNA, 22 bp, Homo sapiens
ccctttctgggcaccggggcct

SEQ ID NO: 4734649 - DNA, 21 bp, Homo sapiens
cccttttctttaagttttatt

SEQ ID NO: 4734650 - DNA, 19 bp, Homo sapiens
cccttttttggctgctgaa

SEQ ID NO: 4734651 - DNA, 21 bp, Homo sapiens
cccttttttggctgctgaagg

SEQ ID NO: 4734652 - DNA, 19 bp, Homo sapiens
ccgaaagggacttggaagc

SEQ ID NO: 4734653 - DNA, 17 bp, Homo sapiens
ccgaatagctgggacta

SEQ ID NO: 4734654 - DNA, 20 bp, Homo sapiens
ccgaatagctgggactacag

SEQ ID NO: 4734655 - DNA, 23 bp, Homo sapiens
ccgaatctctttttgctttcgaa

SEQ ID NO: 4734656 - DNA, 21 bp, Homo sapiens
ccgacttgaattttcccactg

SEQ ID NO: 4734657 - DNA, 22 bp, Homo sapiens
ccgacttgaattttcccactgc

SEQ ID NO: 4734658 - DNA, 13 bp, Homo sapiens
ccgagaagaacag

SEQ ID NO: 4734659 - DNA, 15 bp, Homo sapiens
ccgagatcacaccac

SEQ ID NO: 4734660 - DNA, 18 bp, Homo sapiens
ccgagatcacgccactgc

SEQ ID NO: 4734661 - DNA, 19 bp, Homo sapiens
ccgagcctggctccaaacc

SEQ ID NO: 4734662 - DNA, 16 bp, Homo sapiens
ccgagtagctgggact

SEQ ID NO: 4734663 - DNA, 17 bp, Homo sapiens
ccgagtagctgggacta

SEQ ID NO: 4734664 - DNA, 20 bp, Homo sapiens
ccgagtagctgggactacag

SEQ ID NO: 4734665 - DNA, 15 bp, Homo sapiens
ccgcagagctggccg

SEQ ID NO: 4734666 - DNA, 20 bp, Homo sapiens
ccgcaggcctgccttctcag

SEQ ID NO: 4734667 - DNA, 13 bp, Homo sapiens
ccgcatgccccct

SEQ ID NO: 4734668 - DNA, 18 bp, Homo sapiens
ccgcatgccccctcgtgc

SEQ ID NO: 4734669 - DNA, 20 bp, Homo sapiens
ccgcccaggctggccagccc

SEQ ID NO: 4734670 - DNA, 22 bp, Homo sapiens
ccgcccaggctggccagcccca

SEQ ID NO: 4734671 - DNA, 17 bp, Homo sapiens
ccgccccttccccgagg

SEQ ID NO: 4734672 - DNA, 17 bp, Homo sapiens
ccgccgcctcgcccacc

SEQ ID NO: 4734673 - DNA, 15 bp, Homo sapiens
ccgctgattctcagg

SEQ ID NO: 4734674 - DNA, 14 bp, Homo sapiens
ccgctggggccagt

SEQ ID NO: 4734675 - DNA, 21 bp, Homo sapiens
ccgcttgcctcggctcctgct

SEQ ID NO: 4734676 - DNA, 22 bp, Homo sapiens
ccgcttgcctcggctcctgctg

SEQ ID NO: 4734677 - DNA, 15 bp, Homo sapiens
ccgcttggagcagag

SEQ ID NO: 4734678 - DNA, 19 bp, Homo sapiens
ccgctttctacccagcgag

SEQ ID NO: 4734679 - DNA, 23 bp, Homo sapiens
ccgctttctacccagcgagccct

SEQ ID NO: 4734680 - DNA, 11 bp, Homo sapiens
ccggaaagaag

SEQ ID NO: 4734681 - DNA, 17 bp, Homo sapiens
ccggacacttctcagga

SEQ ID NO: 4734682 - DNA, 17 bp, Homo sapiens
ccggcatggacaatgga

SEQ ID NO: 4734683 - DNA, 16 bp, Homo sapiens
ccggccacctgcggtg

SEQ ID NO: 4734684 - DNA, 15 bp, Homo sapiens
ccggccaggtgggcg

SEQ ID NO: 4734685 - DNA, 15 bp, Homo sapiens
ccggcccctgctggt

SEQ ID NO: 4734686 - DNA, 21 bp, Homo sapiens
ccggcgccctctgtcctgact

SEQ ID NO: 4734687 - DNA, 13 bp, Homo sapiens
ccggctccaggct

SEQ ID NO: 4734688 - DNA, 14 bp, Homo sapiens
ccggctccaggctc

SEQ ID NO: 4734689 - DNA, 12 bp, Homo sapiens
ccggctgccctt

SEQ ID NO: 4734690 - DNA, 12 bp, Homo sapiens
ccggctggcctg

SEQ ID NO: 4734691 - DNA, 13 bp, Homo sapiens
ccggctggcctgg

SEQ ID NO: 4734692 - DNA, 17 bp, Homo sapiens
ccgggaagggggctggg

SEQ ID NO: 4734693 - DNA, 20 bp, Homo sapiens
ccgggaagggggctgggaca

SEQ ID NO: 4734694 - DNA, 13 bp, Homo sapiens
ccgggccacagag

SEQ ID NO: 4734695 - DNA, 15 bp, Homo sapiens
ccgggctctgcctcc

SEQ ID NO: 4734696 - DNA, 13 bp, Homo sapiens
ccggggctgggtt

SEQ ID NO: 4734697 - DNA, 14 bp, Homo sapiens
ccgggtctgcctct

SEQ ID NO: 4734698 - DNA, 22 bp, Homo sapiens
ccggtgcatgcaggtctccatg

SEQ ID NO: 4734699 - DNA, 20 bp, Homo sapiens
ccgtatgaagacagaggcag

SEQ ID NO: 4734700 - DNA, 10 bp, Homo sapiens
ccgtccctga

SEQ ID NO: 4734701 - DNA, 16 bp, Homo sapiens
ccgtcttttcctgttt

SEQ ID NO: 4734702 - DNA, 14 bp, Homo sapiens
ccgtggccccagcc

SEQ ID NO: 4734703 - DNA, 15 bp, Homo sapiens
ccgtggccccagcct

SEQ ID NO: 4734704 - DNA, 13 bp, Homo sapiens
ccgtgggcctggg

SEQ ID NO: 4734705 - DNA, 23 bp, Homo sapiens
ccgttcatgggggagggggcaga

SEQ ID NO: 4734706 - DNA, 14 bp, Homo sapiens
ccgttgtctccctg

SEQ ID NO: 4734707 - DNA, 18 bp, Homo sapiens
cctaaaacaaaagctcat

SEQ ID NO: 4734708 - DNA, 16 bp, Homo sapiens
cctaaaattcagtgga

SEQ ID NO: 4734709 - DNA, 17 bp, Homo sapiens
cctaaaccctctgtgaa

SEQ ID NO: 4734710 - DNA, 22 bp, Homo sapiens
cctaaatcaagcatctttctgt

SEQ ID NO: 4734711 - DNA, 18 bp, Homo sapiens
cctaacctcgggcctgct

SEQ ID NO: 4734712 - DNA, 13 bp, Homo sapiens
cctaactcatact

SEQ ID NO: 4734713 - DNA, 15 bp, Homo sapiens
cctaactcatactgt

SEQ ID NO: 4734714 - DNA, 20 bp, Homo sapiens
cctaagcggctgtttactgc

SEQ ID NO: 4734715 - DNA, 22 bp, Homo sapiens
cctaaggcatgtgtgaaacata

SEQ ID NO: 4734716 - DNA, 16 bp, Homo sapiens
cctaataaagttctgt

SEQ ID NO: 4734717 - DNA, 21 bp, Homo sapiens
cctaataaagttctgtactca

SEQ ID NO: 4734718 - DNA, 20 bp, Homo sapiens
cctaatgcgcaggctggccc

SEQ ID NO: 4734719 - DNA, 16 bp, Homo sapiens
cctaattccacagctg

SEQ ID NO: 4734720 - DNA, 17 bp, Homo sapiens
cctacacagctgtttcc

SEQ ID NO: 4734721 - DNA, 15 bp, Homo sapiens
cctacagtgtacagt

SEQ ID NO: 4734722 - DNA, 15 bp, Homo sapiens
cctacagttttaact

SEQ ID NO: 4734723 - DNA, 17 bp, Homo sapiens
cctacagttttaactgt

SEQ ID NO: 4734724 - DNA, 19 bp, Homo sapiens
cctacagttttaactgtgg

SEQ ID NO: 4734725 - DNA, 22 bp, Homo sapiens
cctacagttttaactgtggata

SEQ ID NO: 4734726 - DNA, 18 bp, Homo sapiens
cctacccaccctcctttc

SEQ ID NO: 4734727 - DNA, 14 bp, Homo sapiens
cctacccctcccag

SEQ ID NO: 4734728 - DNA, 16 bp, Homo sapiens
cctacccctcccagct

SEQ ID NO: 4734729 - DNA, 21 bp, Homo sapiens
cctacccctcccagctgacag

SEQ ID NO: 4734730 - DNA, 16 bp, Homo sapiens
cctacttccccttcct

SEQ ID NO: 4734731 - DNA, 22 bp, Homo sapiens
cctacttctctgagtcagctga

SEQ ID NO: 4734732 - DNA, 22 bp, Homo sapiens
cctagaagggctagaacctgga

SEQ ID NO: 4734733 - DNA, 22 bp, Homo sapiens
cctagccttagaagtcacacag

SEQ ID NO: 4734734 - DNA, 15 bp, Homo sapiens
cctagctaattattt

SEQ ID NO: 4734735 - DNA, 18 bp, Homo sapiens
catttttttccaggctgg

SEQ ID NO: 4734736 - DNA, 11 bp, Homo sapiens
ccaaaaccatc

SEQ ID NO: 4734737 - DNA, 20 bp, Homo sapiens
ccaaaactctcctctgctgc

SEQ ID NO: 4734738 - DNA, 21 bp, Homo sapiens
ccaaaactctcctctgctgct

SEQ ID NO: 4734739 - DNA, 19 bp, Homo sapiens
ccaaacatcctacaagaca

SEQ ID NO: 4734740 - DNA, 11 bp, Homo sapiens
ccaaaccactt

SEQ ID NO: 4734741 - DNA, 22 bp, Homo sapiens
ccaaaccactttttgcagcttt

SEQ ID NO: 4734742 - DNA, 14 bp, Homo sapiens
ccaaacctagcccc

SEQ ID NO: 4734743 - DNA, 14 bp, Homo sapiens
ccaaactcatcttg

SEQ ID NO: 4734744 - DNA, 15 bp, Homo sapiens
ccaaagagtgtggaa

SEQ ID NO: 4734745 - DNA, 12 bp, Homo sapiens
ccaaagcagggt

SEQ ID NO: 4734746 - DNA, 20 bp, Homo sapiens
ccaaaggaaaatgtctgtaa

SEQ ID NO: 4734747 - DNA, 20 bp, Homo sapiens
ccaaaggccatggagagctg

SEQ ID NO: 4734748 - DNA, 15 bp, Homo sapiens
ccaaataatgtctct

SEQ ID NO: 4734749 - DNA, 16 bp, Homo sapiens
ccaaataatgtctctg

SEQ ID NO: 4734750 - DNA, 20 bp, Homo sapiens
ccaaatcactgaactttgct

SEQ ID NO: 4734751 - DNA, 16 bp, Homo sapiens
ccaaatcatagtggct

SEQ ID NO: 4734752 - DNA, 22 bp, Homo sapiens
ccaaatggaaatgggcagagca

SEQ ID NO: 4734753 - DNA, 14 bp, Homo sapiens
ccaaattatgtgaa

SEQ ID NO: 4734754 - DNA, 11 bp, Homo sapiens
ccaaatttaaa

SEQ ID NO: 4734755 - DNA, 14 bp, Homo sapiens
ccaacactcaagaa

SEQ ID NO: 4734756 - DNA, 21 bp, Homo sapiens
ccaacactcaagaagcaggct

SEQ ID NO: 4734757 - DNA, 18 bp, Homo sapiens
ccaacagagaaaagcagg

SEQ ID NO: 4734758 - DNA, 18 bp, Homo sapiens
ccaacatactcccatctg

SEQ ID NO: 4734759 - DNA, 16 bp, Homo sapiens
ccaacatgcctgcacc

SEQ ID NO: 4734760 - DNA, 13 bp, Homo sapiens
ccaacatggtcct

SEQ ID NO: 4734761 - DNA, 19 bp, Homo sapiens
ccaacccagccgctgcccg

SEQ ID NO: 4734762 - DNA, 15 bp, Homo sapiens
ccaacccccagcacc

SEQ ID NO: 4734763 - DNA, 14 bp, Homo sapiens
ccaaccccccagca

SEQ ID NO: 4734764 - DNA, 19 bp, Homo sapiens
ccaaccccccagcactgag

SEQ ID NO: 4734765 - DNA, 15 bp, Homo sapiens
ccaaccctcatcacc

SEQ ID NO: 4734766 - DNA, 20 bp, Homo sapiens
ccaacctgtggcgctgcagc

SEQ ID NO: 4734767 - DNA, 13 bp, Homo sapiens
ccaacgtctgtgc

SEQ ID NO: 4734768 - DNA, 16 bp, Homo sapiens
ccaacgtctgtgccat

SEQ ID NO: 4734769 - DNA, 16 bp, Homo sapiens
ccaactcaccccagcc

SEQ ID NO: 4734770 - DNA, 13 bp, Homo sapiens
ccaagaagcccag

SEQ ID NO: 4734771 - DNA, 12 bp, Homo sapiens
ccaagaagggct

SEQ ID NO: 4734772 - DNA, 22 bp, Homo sapiens
ccaagaagggctagaacctgga

SEQ ID NO: 4734773 - DNA, 15 bp, Homo sapiens
ccaagaccttctcct

SEQ ID NO: 4734774 - DNA, 22 bp, Homo sapiens
ccaagagctgaggcaattctaa

SEQ ID NO: 4734775 - DNA, 20 bp, Homo sapiens
ccaagagcttccagagctct

SEQ ID NO: 4734776 - DNA, 13 bp, Homo sapiens
ccaagcctctgga

SEQ ID NO: 4734777 - DNA, 18 bp, Homo sapiens
ccaagctcaaagcgtgga

SEQ ID NO: 4734778 - DNA, 15 bp, Homo sapiens
ccaagctcccaagag

SEQ ID NO: 4734779 - DNA, 22 bp, Homo sapiens
ccaagctcccaggcattcccca

SEQ ID NO: 4734780 - DNA, 12 bp, Homo sapiens
ccaagctggtcc

SEQ ID NO: 4734781 - DNA, 18 bp, Homo sapiens
ccaagctgtgccaccctg

SEQ ID NO: 4734782 - DNA, 20 bp, Homo sapiens
ccaaggaaaccacagctgct

SEQ ID NO: 4734783 - DNA, 21 bp, Homo sapiens
ccaaggaaaccacagctgctg

SEQ ID NO: 4734784 - DNA, 19 bp, Homo sapiens
ccaaggataggtattttat

SEQ ID NO: 4734785 - DNA, 19 bp, Homo sapiens
ccaagggatgaaagagaag

SEQ ID NO: 4734786 - DNA, 21 bp, Homo sapiens
ccaagggatgggacctgatga

SEQ ID NO: 4734787 - DNA, 22 bp, Homo sapiens
ccaagggatgggacctgatgac

SEQ ID NO: 4734788 - DNA, 15 bp, Homo sapiens
ccaagggcctggcct

SEQ ID NO: 4734789 - DNA, 18 bp, Homo sapiens
ccaagggcctggcctgag

SEQ ID NO: 4734790 - DNA, 22 bp, Homo sapiens
ccaaggggaatgtttgcctctg

SEQ ID NO: 4734791 - DNA, 21 bp, Homo sapiens
ccaaggggtggccgtcctgag

SEQ ID NO: 4734792 - DNA, 14 bp, Homo sapiens
ccaaggtttataaa

SEQ ID NO: 4734793 - DNA, 23 bp, Homo sapiens
ccaagtctaggaactccctcaga

SEQ ID NO: 4734794 - DNA, 15 bp, Homo sapiens
ccaagtggcagagct

SEQ ID NO: 4734795 - DNA, 14 bp, Homo sapiens
ccaataaatgtttg

SEQ ID NO: 4734796 - DNA, 21 bp, Homo sapiens
ccaataaatgtttgttattta

SEQ ID NO: 4734797 - DNA, 14 bp, Homo sapiens
ccaataacacacag

SEQ ID NO: 4734798 - DNA, 12 bp, Homo sapiens
ccaatattgtaa

SEQ ID NO: 4734799 - DNA, 15 bp, Homo sapiens
ccaatattgtacagt

SEQ ID NO: 4734800 - DNA, 23 bp, Homo sapiens
ccaatcaaaatcacctcccacca

SEQ ID NO: 4734801 - DNA, 14 bp, Homo sapiens
ccaatgcactttgt

SEQ ID NO: 4734802 - DNA, 22 bp, Homo sapiens
ccaatgcactttgttctggctc

SEQ ID NO: 4734803 - DNA, 17 bp, Homo sapiens
ccaatgctgatgtcctc

SEQ ID NO: 4734804 - DNA, 18 bp, Homo sapiens
ccaatgctgcctgggagc

SEQ ID NO: 4734805 - DNA, 18 bp, Homo sapiens
ccaatggaacctcctttc

SEQ ID NO: 4734806 - DNA, 23 bp, Homo sapiens
ccaatggactaacttgtctttgg

SEQ ID NO: 4734807 - DNA, 18 bp, Homo sapiens
ccaattcttacaaacatg

SEQ ID NO: 4734808 - DNA, 15 bp, Homo sapiens
ccaattttttttaag

SEQ ID NO: 4734809 - DNA, 22 bp, Homo sapiens
ccacaaatgggaaaaccagact

SEQ ID NO: 4734810 - DNA, 13 bp, Homo sapiens
ccacaacacacag

SEQ ID NO: 4734811 - DNA, 12 bp, Homo sapiens
ccacaccaagct

SEQ ID NO: 4734812 - DNA, 14 bp, Homo sapiens
ccacaccaagctgt

SEQ ID NO: 4734813 - DNA, 18 bp, Homo sapiens
ccacaccaagctgtgcca

SEQ ID NO: 4734814 - DNA, 23 bp, Homo sapiens
ccacaccaagctgtgccaccctg

SEQ ID NO: 4734815 - DNA, 13 bp, Homo sapiens
ccacacccagccc

SEQ ID NO: 4734816 - DNA, 20 bp, Homo sapiens
ccacacccagcccacttctg

SEQ ID NO: 4734817 - DNA, 13 bp, Homo sapiens
ccacacccccacc

SEQ ID NO: 4734818 - DNA, 20 bp, Homo sapiens
cctctagggacccctcctcc

SEQ ID NO: 4734819 - DNA, 15 bp, Homo sapiens
cctctcagagctact

SEQ ID NO: 4734820 - DNA, 15 bp, Homo sapiens
cctctccccagcaag

SEQ ID NO: 4734821 - DNA, 16 bp, Homo sapiens
cctctcccctgccccc

SEQ ID NO: 4734822 - DNA, 21 bp, Homo sapiens
cctctcccctgccccctgcag

SEQ ID NO: 4734823 - DNA, 20 bp, Homo sapiens
cctctccgcacacctctggc

SEQ ID NO: 4734824 - DNA, 13 bp, Homo sapiens
cctctcctccgtg

SEQ ID NO: 4734825 - DNA, 19 bp, Homo sapiens
cctctcctccgtggcacat

SEQ ID NO: 4734826 - DNA, 12 bp, Homo sapiens
cctctctgctct

SEQ ID NO: 4734827 - DNA, 17 bp, Homo sapiens
ccttataaaccaatctt

SEQ ID NO: 4734828 - DNA, 18 bp, Homo sapiens
ccttatcaaaggacacca

SEQ ID NO: 4734829 - DNA, 15 bp, Homo sapiens
ccttattcaggaaaa

SEQ ID NO: 4734830 - DNA, 19 bp, Homo sapiens
ccttattgagcgtgattct

SEQ ID NO: 4734831 - DNA, 19 bp, Homo sapiens
ccttattggatatttgata

SEQ ID NO: 4734832 - DNA, 23 bp, Homo sapiens
ccttatttgtcggggaagatgaa

SEQ ID NO: 4734833 - DNA, 13 bp, Homo sapiens
ccttcaagacctt

SEQ ID NO: 4734834 - DNA, 18 bp, Homo sapiens
ccttcaagaccttcacca

SEQ ID NO: 4734835 - DNA, 15 bp, Homo sapiens
ccttcaccacctcat

SEQ ID NO: 4734836 - DNA, 18 bp, Homo sapiens
ccttcagccctcacccct

SEQ ID NO: 4734837 - DNA, 15 bp, Homo sapiens
ccttccacaccccca

SEQ ID NO: 4734838 - DNA, 15 bp, Homo sapiens
ccttccactgagggc

SEQ ID NO: 4734839 - DNA, 13 bp, Homo sapiens
ccttccaggggtg

SEQ ID NO: 4734840 - DNA, 15 bp, Homo sapiens
ccttccaggggtggg

SEQ ID NO: 4734841 - DNA, 14 bp, Homo sapiens
ccttcccacctctc

SEQ ID NO: 4734842 - DNA, 24 bp, Homo sapiens
ccttcccagaggggcctgccacct

SEQ ID NO: 4734843 - DNA, 21 bp, Homo sapiens
ccttcccatgacccaggctgg

SEQ ID NO: 4734844 - DNA, 18 bp, Homo sapiens
ccttcctaattccacagc

SEQ ID NO: 4734845 - DNA, 13 bp, Homo sapiens
ccttcgctcctgt

SEQ ID NO: 4734846 - DNA, 14 bp, Homo sapiens
ccttctaggaagct

SEQ ID NO: 4734847 - DNA, 11 bp, Homo sapiens
ccttctccatc

SEQ ID NO: 4734848 - DNA, 19 bp, Homo sapiens
ccttctccatggccctgcc

SEQ ID NO: 4734849 - DNA, 19 bp, Homo sapiens
ccttctccttcacctttgt

SEQ ID NO: 4734850 - DNA, 16 bp, Homo sapiens
ccttctctcatctctt

SEQ ID NO: 4734851 - DNA, 21 bp, Homo sapiens
ccttctctcatctcttagctc

SEQ ID NO: 4734852 - DNA, 12 bp, Homo sapiens
ccttctctccag

SEQ ID NO: 4734853 - DNA, 16 bp, Homo sapiens
ccttctctgaaggaca

SEQ ID NO: 4734854 - DNA, 12 bp, Homo sapiens
ccttctgaccca

SEQ ID NO: 4734855 - DNA, 23 bp, Homo sapiens
ccttctgacccatgctgccctgt

SEQ ID NO: 4734856 - DNA, 11 bp, Homo sapiens
ccttctgacct

SEQ ID NO: 4734857 - DNA, 17 bp, Homo sapiens
ccttctgacgcagcctg

SEQ ID NO: 4734858 - DNA, 19 bp, Homo sapiens
ccttctgacgcagcctgag

SEQ ID NO: 4734859 - DNA, 22 bp, Homo sapiens
ccttctgtcctactctgtgtca

SEQ ID NO: 4734860 - DNA, 18 bp, Homo sapiens
ccttgaaatacctgtttc

SEQ ID NO: 4734861 - DNA, 13 bp, Homo sapiens
ccttgacagggca

SEQ ID NO: 4734862 - DNA, 21 bp, Homo sapiens
ccttgacagggcacaccgggc

SEQ ID NO: 4734863 - DNA, 12 bp, Homo sapiens
ccttgaccaggc

SEQ ID NO: 4734864 - DNA, 16 bp, Homo sapiens
ccttgaccaggcctgg

SEQ ID NO: 4734865 - DNA, 19 bp, Homo sapiens
ccttgaccattctccacct

SEQ ID NO: 4734866 - DNA, 22 bp, Homo sapiens
ccttgaccattctccacctgcc

SEQ ID NO: 4734867 - DNA, 14 bp, Homo sapiens
ccttgaggagaagt

SEQ ID NO: 4734868 - DNA, 18 bp, Homo sapiens
ccttgcacactcagaagc

SEQ ID NO: 4734869 - DNA, 16 bp, Homo sapiens
ccttgccgtctacctg

SEQ ID NO: 4734870 - DNA, 21 bp, Homo sapiens
ccttgcggggataaagagaga

SEQ ID NO: 4734871 - DNA, 16 bp, Homo sapiens
ccttgctatcaagaaa

SEQ ID NO: 4734872 - DNA, 18 bp, Homo sapiens
ccttgctccagcctgaca

SEQ ID NO: 4734873 - DNA, 18 bp, Homo sapiens
ccttggcaggctgctgga

SEQ ID NO: 4734874 - DNA, 13 bp, Homo sapiens
ccttggctgcagg

SEQ ID NO: 4734875 - DNA, 12 bp, Homo sapiens
ccttggctggtg

SEQ ID NO: 4734876 - DNA, 13 bp, Homo sapiens
ccttggctggtgc

SEQ ID NO: 4734877 - DNA, 12 bp, Homo sapiens
ccttgggccctt

SEQ ID NO: 4734878 - DNA, 21 bp, Homo sapiens
ccttgggggtcctcctccagg

SEQ ID NO: 4734879 - DNA, 21 bp, Homo sapiens
ccttggttaggcattgtggga

SEQ ID NO: 4734880 - DNA, 16 bp, Homo sapiens
ccttggttcccccact

SEQ ID NO: 4734881 - DNA, 15 bp, Homo sapiens
ccttgtccccacact

SEQ ID NO: 4734882 - DNA, 19 bp, Homo sapiens
ccttgtccccacactccta

SEQ ID NO: 4734883 - DNA, 15 bp, Homo sapiens
ccttgtttctttctg

SEQ ID NO: 4734884 - DNA, 15 bp, Homo sapiens
ccttgttttctctgt

SEQ ID NO: 4734885 - DNA, 20 bp, Homo sapiens
cctttaaaaaaatttaagtg

SEQ ID NO: 4734886 - DNA, 14 bp, Homo sapiens
cctttactgaatgt

SEQ ID NO: 4734887 - DNA, 18 bp, Homo sapiens
cctttcatttactgtggc

SEQ ID NO: 4734888 - DNA, 15 bp, Homo sapiens
cctttcccatttcgt

SEQ ID NO: 4734889 - DNA, 16 bp, Homo sapiens
cctttgacctgcctcc

SEQ ID NO: 4734890 - DNA, 22 bp, Homo sapiens
cctttgacctgcctcccttcat

SEQ ID NO: 4734891 - DNA, 20 bp, Homo sapiens
cctttgacgccatcccagcc

SEQ ID NO: 4734892 - DNA, 21 bp, Homo sapiens
cctttgacgccatcccagccc

SEQ ID NO: 4734893 - DNA, 22 bp, Homo sapiens
cctttgacgccatcccagcccc

SEQ ID NO: 4734894 - DNA, 13 bp, Homo sapiens
cctttgagacagt

SEQ ID NO: 4734895 - DNA, 15 bp, Homo sapiens
cctttgagacagttt

SEQ ID NO: 4734896 - DNA, 18 bp, Homo sapiens
cctttggcaggtgcagcc

SEQ ID NO: 4734897 - DNA, 18 bp, Homo sapiens
cctttgtccccaccgcag

SEQ ID NO: 4734898 - DNA, 23 bp, Homo sapiens
cctttgtgaggaagccgctgggg

SEQ ID NO: 4734899 - DNA, 15 bp, Homo sapiens
ccttttaagacattt

SEQ ID NO: 4734900 - DNA, 17 bp, Homo sapiens
ccttttaagacattttc

SEQ ID NO: 4734901 - DNA, 20 bp, Homo sapiens
ccttttctttaagttttatt

SEQ ID NO: 4734902 - DNA, 14 bp, Homo sapiens
cctttttaagtatt

SEQ ID NO: 4734903 - DNA, 19 bp, Homo sapiens
cctttttcataaattattt

SEQ ID NO: 4734904 - DNA, 14 bp, Homo sapiens
ccttttttaagatt

SEQ ID NO: 4734905 - DNA, 20 bp, Homo sapiens
ccttttttggctgctgaagg

SEQ ID NO: 4734906 - DNA, 19 bp, Homo sapiens
cgaaagggacttggaagct

SEQ ID NO: 4734907 - DNA, 22 bp, Homo sapiens
cgaaagggacttggaagctccg

SEQ ID NO: 4734908 - DNA, 20 bp, Homo sapiens
cgaaataacaatgttaagga

SEQ ID NO: 4734909 - DNA, 15 bp, Homo sapiens
cgaaatatcaaagtc

SEQ ID NO: 4734910 - DNA, 17 bp, Homo sapiens
cgaaatatcaaagtcat

SEQ ID NO: 4734911 - DNA, 19 bp, Homo sapiens
cgaacatatcatttgtgaa

SEQ ID NO: 4734912 - DNA, 20 bp, Homo sapiens
cgaacgctctgcaccttctg

SEQ ID NO: 4734913 - DNA, 18 bp, Homo sapiens
cgaagaaaataattctct

SEQ ID NO: 4734914 - DNA, 19 bp, Homo sapiens
cgaatacttttgccctttg

SEQ ID NO: 4734915 - DNA, 14 bp, Homo sapiens
cgaatagctgggac

SEQ ID NO: 4734916 - DNA, 16 bp, Homo sapiens
cgaccccatctgccca

SEQ ID NO: 4734917 - DNA, 16 bp, Homo sapiens
cgacctgcctcggcct

SEQ ID NO: 4734918 - DNA, 17 bp, Homo sapiens
cgactgccatcttggac

SEQ ID NO: 4734919 - DNA, 20 bp, Homo sapiens
cgacttgaattttcccactg

SEQ ID NO: 4734920 - DNA, 13 bp, Homo sapiens
cgagagatgtgtg

SEQ ID NO: 4734921 - DNA, 14 bp, Homo sapiens
cgagagatgtgtgt

SEQ ID NO: 4734922 - DNA, 17 bp, Homo sapiens
cgagagatgtgtgttga

SEQ ID NO: 4734923 - DNA, 14 bp, Homo sapiens
cgagaggaggggcc

SEQ ID NO: 4734924 - DNA, 15 bp, Homo sapiens
cgagcacatgttcat

SEQ ID NO: 4734925 - DNA, 12 bp, Homo sapiens
cgaggacaggga

SEQ ID NO: 4734926 - DNA, 18 bp, Homo sapiens
cgaggccttctctgaagg

SEQ ID NO: 4734927 - DNA, 13 bp, Homo sapiens
cgagggatgatgc

SEQ ID NO: 4734928 - DNA, 19 bp, Homo sapiens
cgagtagctgagattatag

SEQ ID NO: 4734929 - DNA, 14 bp, Homo sapiens
cgagtagctgggac

SEQ ID NO: 4734930 - DNA, 13 bp, Homo sapiens
cgagtctgtcctg

SEQ ID NO: 4734931 - DNA, 16 bp, Homo sapiens
cgagtttggtccctgg

SEQ ID NO: 4734932 - DNA, 21 bp, Homo sapiens
cgatgggcccaattcttacaa

SEQ ID NO: 4734933 - DNA, 17 bp, Homo sapiens
cgatgtcctcctctgtg

SEQ ID NO: 4734934 - DNA, 21 bp, Homo sapiens
cgattcttctgcttcagcctc

SEQ ID NO: 4734935 - DNA, 19 bp, Homo sapiens
cgattgacaccaaaatgaa

SEQ ID NO: 4734936 - DNA, 21 bp, Homo sapiens
cgattgacaccaaaatgaacc

SEQ ID NO: 4734937 - DNA, 23 bp, Homo sapiens
cgcaaagggcatgggtcgggaga

SEQ ID NO: 4734938 - DNA, 16 bp, Homo sapiens
cgcacacctctggctg

SEQ ID NO: 4734939 - DNA, 13 bp, Homo sapiens
cgcagacaggacc

SEQ ID NO: 4734940 - DNA, 12 bp, Homo sapiens
cgcagagcgggc

SEQ ID NO: 4734941 - DNA, 14 bp, Homo sapiens
cgcagagcgggctc

SEQ ID NO: 4734942 - DNA, 19 bp, Homo sapiens
cgcagcatattcaggaagc

SEQ ID NO: 4734943 - DNA, 12 bp, Homo sapiens
cgcagcctgaga

SEQ ID NO: 4734944 - DNA, 23 bp, Homo sapiens
cgcaggcccctctcctccgtggc

SEQ ID NO: 4734945 - DNA, 14 bp, Homo sapiens
cgcaggctggccct

SEQ ID NO: 4734946 - DNA, 20 bp, Homo sapiens
cgcaggctggccctgccctg

SEQ ID NO: 4734947 - DNA, 13 bp, Homo sapiens
cgcatgccccctc

SEQ ID NO: 4734948 - DNA, 20 bp, Homo sapiens
cgccagattctttcctgagg

SEQ ID NO: 4734949 - DNA, 21 bp, Homo sapiens
cgccagattctttcctgaggc

SEQ ID NO: 4734950 - DNA, 22 bp, Homo sapiens
cgccagattctttcctgaggct

SEQ ID NO: 4734951 - DNA, 16 bp, Homo sapiens
cgccatcccagcccca

SEQ ID NO: 4734952 - DNA, 20 bp, Homo sapiens
cgccatcccagccccaatga

SEQ ID NO: 4734953 - DNA, 17 bp, Homo sapiens
cgcccaccgcatgcccc

SEQ ID NO: 4734954 - DNA, 18 bp, Homo sapiens
cgcccaccgcatgccccc

SEQ ID NO: 4734955 - DNA, 23 bp, Homo sapiens
cgcccaccgcatgccccctcgtg

SEQ ID NO: 4734956 - DNA, 14 bp, Homo sapiens
cgcccaggacccca

SEQ ID NO: 4734957 - DNA, 12 bp, Homo sapiens
cgcccaggctgg

SEQ ID NO: 4734958 - DNA, 17 bp, Homo sapiens
cgcccaggctggccagc

SEQ ID NO: 4734959 - DNA, 12 bp, Homo sapiens
cgcccagtctgg

SEQ ID NO: 4734960 - DNA, 13 bp, Homo sapiens
cgcccagtctgga

SEQ ID NO: 4734961 - DNA, 21 bp, Homo sapiens
cgcccagtctggaatgcagtg

SEQ ID NO: 4734962 - DNA, 23 bp, Homo sapiens
cgcccagttgggtggatgcctgg

SEQ ID NO: 4734963 - DNA, 13 bp, Homo sapiens
cgccccacccaga

SEQ ID NO: 4734964 - DNA, 18 bp, Homo sapiens
cgcccggctaatttttgt

SEQ ID NO: 4734965 - DNA, 17 bp, Homo sapiens
cgccctctgtcctgact

SEQ ID NO: 4734966 - DNA, 18 bp, Homo sapiens
cgccgcctcgcccaccgc

SEQ ID NO: 4734967 - DNA, 16 bp, Homo sapiens
cgccggatgacagcca

SEQ ID NO: 4734968 - DNA, 21 bp, Homo sapiens
cgcctccgggcgcgcgggcct

SEQ ID NO: 4734969 - DNA, 20 bp, Homo sapiens
cgcctgaggaacccttacag

SEQ ID NO: 4734970 - DNA, 15 bp, Homo sapiens
cgccttatttatatt

SEQ ID NO: 4734971 - DNA, 19 bp, Homo sapiens
cgccttctcccccccgggg

SEQ ID NO: 4734972 - DNA, 17 bp, Homo sapiens
cgcgagcacatgttcat

SEQ ID NO: 4734973 - DNA, 23 bp, Homo sapiens
cgcgccaaataatgtctctgtga

SEQ ID NO: 4734974 - DNA, 15 bp, Homo sapiens
cgcgctgcctgtgtg

SEQ ID NO: 4734975 - DNA, 14 bp, Homo sapiens
cgctaagagggagg

SEQ ID NO: 4734976 - DNA, 20 bp, Homo sapiens
cgctcctgccgcagagctgg

SEQ ID NO: 4734977 - DNA, 13 bp, Homo sapiens
cgctcctgtgtct

SEQ ID NO: 4734978 - DNA, 12 bp, Homo sapiens
cgctgatgctgg

SEQ ID NO: 4734979 - DNA, 13 bp, Homo sapiens
cgctgatgctggg

SEQ ID NO: 4734980 - DNA, 14 bp, Homo sapiens
cgctgatgctgggc

SEQ ID NO: 4734981 - DNA, 17 bp, Homo sapiens
cgctgatgctgggctgg

SEQ ID NO: 4734982 - DNA, 19 bp, Homo sapiens
cgctgatgctgggctgggt

SEQ ID NO: 4734983 - DNA, 16 bp, Homo sapiens
cgctgattctcagggt

SEQ ID NO: 4734984 - DNA, 20 bp, Homo sapiens
cgctgcccggcgccctctgt

SEQ ID NO: 4734985 - DNA, 18 bp, Homo sapiens
cgctggccgggaccccga

SEQ ID NO: 4734986 - DNA, 23 bp, Homo sapiens
cgctggccgggaccccgagcctg

SEQ ID NO: 4734987 - DNA, 20 bp, Homo sapiens
cgctggggccagttggtccc

SEQ ID NO: 4734988 - DNA, 13 bp, Homo sapiens
cgctgtgctgccc

SEQ ID NO: 4734989 - DNA, 23 bp, Homo sapiens
cgctgtgctgccctgcccacctg

SEQ ID NO: 4734990 - DNA, 15 bp, Homo sapiens
cgcttgcctcggctc

SEQ ID NO: 4734991 - DNA, 16 bp, Homo sapiens
cgcttgcctcggctcc

SEQ ID NO: 4734992 - DNA, 21 bp, Homo sapiens
cgcttgcctcggctcctgctg

SEQ ID NO: 4734993 - DNA, 23 bp, Homo sapiens
cgcttgcctcggctcctgctgca

SEQ ID NO: 4734994 - DNA, 14 bp, Homo sapiens
cgcttggagcagag

SEQ ID NO: 4734995 - DNA, 19 bp, Homo sapiens
cggacacttctcaggaaat

SEQ ID NO: 4734996 - DNA, 17 bp, Homo sapiens
cggacatggtctgtcct

SEQ ID NO: 4734997 - DNA, 16 bp, Homo sapiens
cggacgcccaggaccc

SEQ ID NO: 4734998 - DNA, 15 bp, Homo sapiens
cggagacggagtccc

SEQ ID NO: 4734999 - DNA, 11 bp, Homo sapiens
cggagccactc

SEQ ID NO: 4735000 - DNA, 13 bp, Homo sapiens
cggagccactcct

SEQ ID NO: 4735001 - DNA, 19 bp, Homo sapiens
cggagggaaactgtgaatg

SEQ ID NO: 4735002 - DNA, 16 bp, Homo sapiens
cggagtcccaccttgg

SEQ ID NO: 4735003 - DNA, 23 bp, Homo sapiens
cggagtcccaccttggctgcagg

SEQ ID NO: 4735004 - DNA, 15 bp, Homo sapiens
cggatctgttgcaaa

SEQ ID NO: 4735005 - DNA, 13 bp, Homo sapiens
cggatgacagcca

SEQ ID NO: 4735006 - DNA, 18 bp, Homo sapiens
cggatgacagccaccctc

SEQ ID NO: 4735007 - DNA, 21 bp, Homo sapiens
cggcaggcatggctggtgcct

SEQ ID NO: 4735008 - DNA, 21 bp, Homo sapiens
cggcatggacaatggaccgga

SEQ ID NO: 4735009 - DNA, 15 bp, Homo sapiens
cggccacctcaccct

SEQ ID NO: 4735010 - DNA, 19 bp, Homo sapiens
cggccacctcaccctctcc

SEQ ID NO: 4735011 - DNA, 11 bp, Homo sapiens
cggccacctgc

SEQ ID NO: 4735012 - DNA, 17 bp, Homo sapiens
cggccacctgcggtgct

SEQ ID NO: 4735013 - DNA, 12 bp, Homo sapiens
cggccaggccag

SEQ ID NO: 4735014 - DNA, 15 bp, Homo sapiens
cggcccaatccaagg

SEQ ID NO: 4735015 - DNA, 18 bp, Homo sapiens
cggcccctgctggttcag

SEQ ID NO: 4735016 - DNA, 14 bp, Homo sapiens
cggccctatgcatg

SEQ ID NO: 4735017 - DNA, 15 bp, Homo sapiens
cggcctgtgtccccc

SEQ ID NO: 4735018 - DNA, 17 bp, Homo sapiens
cggcgccctctgtcctg

SEQ ID NO: 4735019 - DNA, 15 bp, Homo sapiens
cggctcactgcagcc

SEQ ID NO: 4735020 - DNA, 16 bp, Homo sapiens
cggctcactgcagcct

SEQ ID NO: 4735021 - DNA, 12 bp, Homo sapiens
cggctccaggct

SEQ ID NO: 4735022 - DNA, 14 bp, Homo sapiens
cggctccaggctcc

SEQ ID NO: 4735023 - DNA, 20 bp, Homo sapiens
cggctgagctgggcagctgg

SEQ ID NO: 4735024 - DNA, 12 bp, Homo sapiens
cggctgcccttt

SEQ ID NO: 4735025 - DNA, 11 bp, Homo sapiens
cggctgctgag

SEQ ID NO: 4735026 - DNA, 22 bp, Homo sapiens
cggctggatgggggctctgcac

SEQ ID NO: 4735027 - DNA, 15 bp, Homo sapiens
cggctggcctggccc

SEQ ID NO: 4735028 - DNA, 23 bp, Homo sapiens
cggctggcctggcccctcagggt

SEQ ID NO: 4735029 - DNA, 20 bp, Homo sapiens
cgggaagggggctgggacat

SEQ ID NO: 4735030 - DNA, 13 bp, Homo sapiens
cgggaccagaaac

SEQ ID NO: 4735031 - DNA, 23 bp, Homo sapiens
cgggaccctgctcacaggcaggc

SEQ ID NO: 4735032 - DNA, 17 bp, Homo sapiens
cgggacgcggcaggctt

SEQ ID NO: 4735033 - DNA, 21 bp, Homo sapiens
cgggagaggggacgcaggccc

SEQ ID NO: 4735034 - DNA, 22 bp, Homo sapiens
cgggagcctgatcacctgccct

SEQ ID NO: 4735035 - DNA, 15 bp, Homo sapiens
cgggaggggcccgct

SEQ ID NO: 4735036 - DNA, 14 bp, Homo sapiens
cgggcactcagaag

SEQ ID NO: 4735037 - DNA, 12 bp, Homo sapiens
cgggccacagag

SEQ ID NO: 4735038 - DNA, 13 bp, Homo sapiens
cgggcccaggcca

SEQ ID NO: 4735039 - DNA, 21 bp, Homo sapiens
cgggcccttcccacaggacat

SEQ ID NO: 4735040 - DNA, 20 bp, Homo sapiens
cgggctcagggaccacagca

SEQ ID NO: 4735041 - DNA, 16 bp, Homo sapiens
cgggctcctgtgccct

SEQ ID NO: 4735042 - DNA, 13 bp, Homo sapiens
cgggctctgcctc

SEQ ID NO: 4735043 - DNA, 11 bp, Homo sapiens
ccccagcctgg

SEQ ID NO: 4735044 - DNA, 12 bp, Homo sapiens
ccccagcctggc

SEQ ID NO: 4735045 - DNA, 13 bp, Homo sapiens
ccccagcctggcc

SEQ ID NO: 4735046 - DNA, 15 bp, Homo sapiens
ccccagcctggccca

SEQ ID NO: 4735047 - DNA, 21 bp, Homo sapiens
ccccagcctggcccagctccc

SEQ ID NO: 4735048 - DNA, 22 bp, Homo sapiens
ccccagcctggcccagctcccc

SEQ ID NO: 4735049 - DNA, 12 bp, Homo sapiens
ccccaggaggcc

SEQ ID NO: 4735050 - DNA, 13 bp, Homo sapiens
ccccaggaggcca

SEQ ID NO: 4735051 - DNA, 16 bp, Homo sapiens
ccccagggcagccagg

SEQ ID NO: 4735052 - DNA, 15 bp, Homo sapiens
ccccagtgcccacag

SEQ ID NO: 4735053 - DNA, 13 bp, Homo sapiens
ccccatcagtgct

SEQ ID NO: 4735054 - DNA, 14 bp, Homo sapiens
ccccatcctggccc

SEQ ID NO: 4735055 - DNA, 18 bp, Homo sapiens
ccccatctgcccaggacg

SEQ ID NO: 4735056 - DNA, 15 bp, Homo sapiens
ccccattctgcctgc

SEQ ID NO: 4735057 - DNA, 22 bp, Homo sapiens
cccccaaatggaaatgggcaga

SEQ ID NO: 4735058 - DNA, 14 bp, Homo sapiens
cccccaatccctca

SEQ ID NO: 4735059 - DNA, 15 bp, Homo sapiens
cccccaatccctcaa

SEQ ID NO: 4735060 - DNA, 24 bp, Homo sapiens
cccccacccaagggcctggcctga

SEQ ID NO: 4735061 - DNA, 11 bp, Homo sapiens
cccccactggt

SEQ ID NO: 4735062 - DNA, 18 bp, Homo sapiens
cccccagcactgaggaag

SEQ ID NO: 4735063 - DNA, 12 bp, Homo sapiens
cccccagccccc

SEQ ID NO: 4735064 - DNA, 12 bp, Homo sapiens
cccccagcctgc

SEQ ID NO: 4735065 - DNA, 11 bp, Homo sapiens
cccccaggact

SEQ ID NO: 4735066 - DNA, 15 bp, Homo sapiens
cccccaggactgggc

SEQ ID NO: 4735067 - DNA, 17 bp, Homo sapiens
cccccaggactgggcca

SEQ ID NO: 4735068 - DNA, 13 bp, Homo sapiens
cccccatcctggc

SEQ ID NO: 4735069 - DNA, 17 bp, Homo sapiens
cccccatcctggcccat

SEQ ID NO: 4735070 - DNA, 12 bp, Homo sapiens
ccccccagcact

SEQ ID NO: 4735071 - DNA, 12 bp, Homo sapiens
cccccctggcct

SEQ ID NO: 4735072 - DNA, 18 bp, Homo sapiens
cccccgcccaggctggcc

SEQ ID NO: 4735073 - DNA, 20 bp, Homo sapiens
cccccgggaggggcccgctt

SEQ ID NO: 4735074 - DNA, 12 bp, Homo sapiens
ccccctcctgct

SEQ ID NO: 4735075 - DNA, 14 bp, Homo sapiens
ccccctcctgctgc

SEQ ID NO: 4735076 - DNA, 19 bp, Homo sapiens
ccccctctggctccagctg

SEQ ID NO: 4735077 - DNA, 16 bp, Homo sapiens
ccccgaacgctctgca

SEQ ID NO: 4735078 - DNA, 23 bp, Homo sapiens
ccccgacccttgccgtctacctg

SEQ ID NO: 4735079 - DNA, 21 bp, Homo sapiens
ccccgcaggcctgccttctca

SEQ ID NO: 4735080 - DNA, 14 bp, Homo sapiens
ccccgcccaggctg

SEQ ID NO: 4735081 - DNA, 19 bp, Homo sapiens
ccccgcccaggctggccag

SEQ ID NO: 4735082 - DNA, 21 bp, Homo sapiens
ccccggggcgtttctttgccg

SEQ ID NO: 4735083 - DNA, 15 bp, Homo sapiens
ccccggggctgggtt

SEQ ID NO: 4735084 - DNA, 16 bp, Homo sapiens
ccccgtccccctctgg

SEQ ID NO: 4735085 - DNA, 15 bp, Homo sapiens
cccctaccactgtct

SEQ ID NO: 4735086 - DNA, 13 bp, Homo sapiens
cccctagaaatcc

SEQ ID NO: 4735087 - DNA, 21 bp, Homo sapiens
cccctagcttagagcctccct

SEQ ID NO: 4735088 - DNA, 17 bp, Homo sapiens
cccctcagggtccctgg

SEQ ID NO: 4735089 - DNA, 14 bp, Homo sapiens
cccctccaacctgg

SEQ ID NO: 4735090 - DNA, 12 bp, Homo sapiens
cccctccatgtg

SEQ ID NO: 4735091 - DNA, 22 bp, Homo sapiens
cccctcccagctgacagtcctc

SEQ ID NO: 4735092 - DNA, 22 bp, Homo sapiens
cccctcccgtctactcattccc

SEQ ID NO: 4735093 - DNA, 12 bp, Homo sapiens
cccctccctgcc

SEQ ID NO: 4735094 - DNA, 13 bp, Homo sapiens
cccctccctgcct

SEQ ID NO: 4735095 - DNA, 14 bp, Homo sapiens
cccctccctgcttc

SEQ ID NO: 4735096 - DNA, 12 bp, Homo sapiens
cccctccctttc

SEQ ID NO: 4735097 - DNA, 15 bp, Homo sapiens
cccctccctttctcc

SEQ ID NO: 4735098 - DNA, 19 bp, Homo sapiens
cccctcctacccctcccag

SEQ ID NO: 4735099 - DNA, 13 bp, Homo sapiens
cccctcctccctt

SEQ ID NO: 4735100 - DNA, 11 bp, Homo sapiens
cccctcctctc

SEQ ID NO: 4735101 - DNA, 11 bp, Homo sapiens
cccctctcctc

SEQ ID NO: 4735102 - DNA, 14 bp, Homo sapiens
cccctctgccctgc

SEQ ID NO: 4735103 - DNA, 20 bp, Homo sapiens
cccctctgccctgcgggtca

SEQ ID NO: 4735104 - DNA, 16 bp, Homo sapiens
cccctctggctccagc

SEQ ID NO: 4735105 - DNA, 12 bp, Homo sapiens
cccctctgtcca

SEQ ID NO: 4735106 - DNA, 13 bp, Homo sapiens
cccctcttgcccc

SEQ ID NO: 4735107 - DNA, 14 bp, Homo sapiens
cccctcttgcccca

SEQ ID NO: 4735108 - DNA, 15 bp, Homo sapiens
cccctcttgccccaa

SEQ ID NO: 4735109 - DNA, 15 bp, Homo sapiens
cccctgacaacactc

SEQ ID NO: 4735110 - DNA, 17 bp, Homo sapiens
cccctgcaaagcccagc

SEQ ID NO: 4735111 - DNA, 23 bp, Homo sapiens
cccctgcaggaaggagctgcctg

SEQ ID NO: 4735112 - DNA, 14 bp, Homo sapiens
cccctgccaccctg

SEQ ID NO: 4735113 - DNA, 15 bp, Homo sapiens
cccctgccagggcag

SEQ ID NO: 4735114 - DNA, 18 bp, Homo sapiens
cccctgcccccaggactg

SEQ ID NO: 4735115 - DNA, 17 bp, Homo sapiens
cccctgccccctgcagg

SEQ ID NO: 4735116 - DNA, 14 bp, Homo sapiens
cccctgctgggtgt

SEQ ID NO: 4735117 - DNA, 11 bp, Homo sapiens
cccctgctggt

SEQ ID NO: 4735118 - DNA, 19 bp, Homo sapiens
cccctggatgcagcctcac

SEQ ID NO: 4735119 - DNA, 19 bp, Homo sapiens
cccctggcctcccccactt

SEQ ID NO: 4735120 - DNA, 15 bp, Homo sapiens
cccctggttctcatc

SEQ ID NO: 4735121 - DNA, 20 bp, Homo sapiens
ccccttccatggactttgtt

SEQ ID NO: 4735122 - DNA, 14 bp, Homo sapiens
ccccttcgctcctg

SEQ ID NO: 4735123 - DNA, 15 bp, Homo sapiens
ccccttcgctcctgt

SEQ ID NO: 4735124 - DNA, 22 bp, Homo sapiens
ccccttctaggtggcaaggctg

SEQ ID NO: 4735125 - DNA, 14 bp, Homo sapiens
cccgaatagctggg

SEQ ID NO: 4735126 - DNA, 16 bp, Homo sapiens
cccgaatagctgggac

SEQ ID NO: 4735127 - DNA, 13 bp, Homo sapiens
cccgagcctggct

SEQ ID NO: 4735128 - DNA, 16 bp, Homo sapiens
cccgagtagctgggac

SEQ ID NO: 4735129 - DNA, 19 bp, Homo sapiens
cccgcaggcctgccttctc

SEQ ID NO: 4735130 - DNA, 14 bp, Homo sapiens
cccgcccaggctgg

SEQ ID NO: 4735131 - DNA, 15 bp, Homo sapiens
cccgcccaggctggc

SEQ ID NO: 4735132 - DNA, 13 bp, Homo sapiens
cccgctcccagtg

SEQ ID NO: 4735133 - DNA, 14 bp, Homo sapiens
cccgctcccagtgt

SEQ ID NO: 4735134 - DNA, 12 bp, Homo sapiens
cccgcttgcctc

SEQ ID NO: 4735135 - DNA, 19 bp, Homo sapiens
cccgcttgcctcggctcct

SEQ ID NO: 4735136 - DNA, 20 bp, Homo sapiens
cccggacgcccaggacccca

SEQ ID NO: 4735137 - DNA, 17 bp, Homo sapiens
cccggagggaaactgtg

SEQ ID NO: 4735138 - DNA, 13 bp, Homo sapiens
cccggcactccag

SEQ ID NO: 4735139 - DNA, 14 bp, Homo sapiens
ctgaggaatccaga

SEQ ID NO: 4735140 - DNA, 14 bp, Homo sapiens
ctgaggactgattt

SEQ ID NO: 4735141 - DNA, 22 bp, Homo sapiens
ctgaggactgatttcagagtga

SEQ ID NO: 4735142 - DNA, 20 bp, Homo sapiens
ctgaggagctgttactgaat

SEQ ID NO: 4735143 - DNA, 15 bp, Homo sapiens
ctgaggcacctgcat

SEQ ID NO: 4735144 - DNA, 15 bp, Homo sapiens
ctgaggcagcagtgt

SEQ ID NO: 4735145 - DNA, 17 bp, Homo sapiens
ctgaggcagcagtgtga

SEQ ID NO: 4735146 - DNA, 12 bp, Homo sapiens
ctgaggcccaga

SEQ ID NO: 4735147 - DNA, 13 bp, Homo sapiens
ctgaggcccagag

SEQ ID NO: 4735148 - DNA, 14 bp, Homo sapiens
ctgaggcccagagg

SEQ ID NO: 4735149 - DNA, 19 bp, Homo sapiens
ctgaggcccagagggcctg

SEQ ID NO: 4735150 - DNA, 21 bp, Homo sapiens
ctgaggcccagagggcctgca

SEQ ID NO: 4735151 - DNA, 14 bp, Homo sapiens
ctcccctgctgggt

SEQ ID NO: 4735152 - DNA, 16 bp, Homo sapiens
ctcccgaatagctggg

SEQ ID NO: 4735153 - DNA, 18 bp, Homo sapiens
ctcccgaatagctgggac

SEQ ID NO: 4735154 - DNA, 20 bp, Homo sapiens
ctcccgaatagctgggacta

SEQ ID NO: 4735155 - DNA, 18 bp, Homo sapiens
ctcccgagtagctgggac

SEQ ID NO: 4735156 - DNA, 20 bp, Homo sapiens
ctcccgagtagctgggacta

SEQ ID NO: 4735157 - DNA, 21 bp, Homo sapiens
ctcccgccccttccccgaggg

SEQ ID NO: 4735158 - DNA, 21 bp, Homo sapiens
ctccctaaggcatgtgtgaaa

SEQ ID NO: 4735159 - DNA, 15 bp, Homo sapiens
ctccctcctggccag

SEQ ID NO: 4735160 - DNA, 17 bp, Homo sapiens
ctccctgccccccagcc

SEQ ID NO: 4735161 - DNA, 16 bp, Homo sapiens
ctccctgcctccaccc

SEQ ID NO: 4735162 - DNA, 21 bp, Homo sapiens
ctccctgcctccacccacagt

SEQ ID NO: 4735163 - DNA, 15 bp, Homo sapiens
ctccctggccctcaa

SEQ ID NO: 4735164 - DNA, 18 bp, Homo sapiens
ctccctggttctgatgat

SEQ ID NO: 4735165 - DNA, 16 bp, Homo sapiens
ctcccttcccacctct

SEQ ID NO: 4735166 - DNA, 20 bp, Homo sapiens
ctcccttggattgtccccga

SEQ ID NO: 4735167 - DNA, 13 bp, Homo sapiens
ctcccttgggctc

SEQ ID NO: 4735168 - DNA, 18 bp, Homo sapiens
ctccctttttccttgtcc

SEQ ID NO: 4735169 - DNA, 15 bp, Homo sapiens
ctccgaccagacacc

SEQ ID NO: 4735170 - DNA, 22 bp, Homo sapiens
ctccgcacacctctggctgtct

SEQ ID NO: 4735171 - DNA, 19 bp, Homo sapiens
ctccgctttctacccagcg

SEQ ID NO: 4735172 - DNA, 21 bp, Homo sapiens
ctccgctttctacccagcgag

SEQ ID NO: 4735173 - DNA, 22 bp, Homo sapiens
ctccgctttctacccagcgagc

SEQ ID NO: 4735174 - DNA, 15 bp, Homo sapiens
ctccgggacctggtg

SEQ ID NO: 4735175 - DNA, 20 bp, Homo sapiens
ctccggtaaaacaccggaga

SEQ ID NO: 4735176 - DNA, 16 bp, Homo sapiens
ctcctacccctcccag

SEQ ID NO: 4735177 - DNA, 15 bp, Homo sapiens
ctcctccaccgccat

SEQ ID NO: 4735178 - DNA, 16 bp, Homo sapiens
ctcctccaccgccatg

SEQ ID NO: 4735179 - DNA, 17 bp, Homo sapiens
ctcctccactctccccc

SEQ ID NO: 4735180 - DNA, 19 bp, Homo sapiens
ctcctccctttttccttgt

SEQ ID NO: 4735181 - DNA, 14 bp, Homo sapiens
ctcctccgtggcac

SEQ ID NO: 4735182 - DNA, 15 bp, Homo sapiens
ctcctccgtggcaca

SEQ ID NO: 4735183 - DNA, 14 bp, Homo sapiens
ctcctctatttctt

SEQ ID NO: 4735184 - DNA, 13 bp, Homo sapiens
ctcctctcagccc

SEQ ID NO: 4735185 - DNA, 13 bp, Homo sapiens
ctcctctccccag

SEQ ID NO: 4735186 - DNA, 14 bp, Homo sapiens
ctcctctcccctac

SEQ ID NO: 4735187 - DNA, 19 bp, Homo sapiens
ctcctctctgccctaatgc

SEQ ID NO: 4735188 - DNA, 13 bp, Homo sapiens
ctcctctgactca

SEQ ID NO: 4735189 - DNA, 22 bp, Homo sapiens
ctcctgagtagctgggattaca

SEQ ID NO: 4735190 - DNA, 14 bp, Homo sapiens
ctcctgcaggcagc

SEQ ID NO: 4735191 - DNA, 21 bp, Homo sapiens
ctcctgcaggcagccaggcca

SEQ ID NO: 4735192 - DNA, 16 bp, Homo sapiens
ctcctgccgcagagct

SEQ ID NO: 4735193 - DNA, 17 bp, Homo sapiens
ctcctgccgcagagctg

SEQ ID NO: 4735194 - DNA, 14 bp, Homo sapiens
ctcctgcctcagcc

SEQ ID NO: 4735195 - DNA, 19 bp, Homo sapiens
ctcctgcctcagcctcccg

SEQ ID NO: 4735196 - DNA, 20 bp, Homo sapiens
ctcctgcctcgaactggctg

SEQ ID NO: 4735197 - DNA, 22 bp, Homo sapiens
ctcctgcctcgaactggctgca

SEQ ID NO: 4735198 - DNA, 18 bp, Homo sapiens
ctcctgccttcctcctgg

SEQ ID NO: 4735199 - DNA, 19 bp, Homo sapiens
ctcctgccttcctcctggg

SEQ ID NO: 4735200 - DNA, 20 bp, Homo sapiens
ctcctgccttcctcctgggc

SEQ ID NO: 4735201 - DNA, 12 bp, Homo sapiens
ctcctgctgcag

SEQ ID NO: 4735202 - DNA, 16 bp, Homo sapiens
ctcctgctgcagaggg

SEQ ID NO: 4735203 - DNA, 15 bp, Homo sapiens
ctcctgggccctctc

SEQ ID NO: 4735204 - DNA, 17 bp, Homo sapiens
ctcctgggccctctctg

SEQ ID NO: 4735205 - DNA, 18 bp, Homo sapiens
ctcctgggctaagtgatc

SEQ ID NO: 4735206 - DNA, 21 bp, Homo sapiens
ctcctgggttttgtattctct

SEQ ID NO: 4735207 - DNA, 22 bp, Homo sapiens
ctcctgggttttgtattctctg

SEQ ID NO: 4735208 - DNA, 11 bp, Homo sapiens
ctcctgtgccc

SEQ ID NO: 4735209 - DNA, 12 bp, Homo sapiens
ctcctgtgccct

SEQ ID NO: 4735210 - DNA, 14 bp, Homo sapiens
ctcctgtgtgtgcg

SEQ ID NO: 4735211 - DNA, 19 bp, Homo sapiens
ctcctgtgtgtgcgcctac

SEQ ID NO: 4735212 - DNA, 20 bp, Homo sapiens
ctcctgtgtgtgcgcctaca

SEQ ID NO: 4735213 - DNA, 23 bp, Homo sapiens
ctcctgtgtgtgcgcctacagga

SEQ ID NO: 4735214 - DNA, 20 bp, Homo sapiens
ctcctgtgttgtgctgggag

SEQ ID NO: 4735215 - DNA, 20 bp, Homo sapiens
ctccttaacactgagctgtc

SEQ ID NO: 4735216 - DNA, 22 bp, Homo sapiens
ctccttatcaaaggacaccatt

SEQ ID NO: 4735217 - DNA, 17 bp, Homo sapiens
ctccttcacagatgggt

SEQ ID NO: 4735218 - DNA, 16 bp, Homo sapiens
ctccttcacctttgtc

SEQ ID NO: 4735219 - DNA, 15 bp, Homo sapiens
ctccttcagccctca

SEQ ID NO: 4735220 - DNA, 20 bp, Homo sapiens
ctccttcctggagcccagag

SEQ ID NO: 4735221 - DNA, 23 bp, Homo sapiens
ctccttcctggagcccagaggag

SEQ ID NO: 4735222 - DNA, 16 bp, Homo sapiens
ctccttctctgtctca

SEQ ID NO: 4735223 - DNA, 21 bp, Homo sapiens
ctccttctctgtctcatgtgt

SEQ ID NO: 4735224 - DNA, 14 bp, Homo sapiens
ctccttctgtccta

SEQ ID NO: 4735225 - DNA, 15 bp, Homo sapiens
ctccttctgtcctac

SEQ ID NO: 4735226 - DNA, 17 bp, Homo sapiens
ctccttgagagaccagg

SEQ ID NO: 4735227 - DNA, 19 bp, Homo sapiens
ctccttgggccctttgagt

SEQ ID NO: 4735228 - DNA, 20 bp, Homo sapiens
ctccttgtcaatactgagcc

SEQ ID NO: 4735229 - DNA, 22 bp, Homo sapiens
ctcctttagcgcccagttgggt

SEQ ID NO: 4735230 - DNA, 16 bp, Homo sapiens
ctcctttctcttctct

SEQ ID NO: 4735231 - DNA, 18 bp, Homo sapiens
ctcctttgtgaggaagcc

SEQ ID NO: 4735232 - DNA, 15 bp, Homo sapiens
ctcgaactggctgca

SEQ ID NO: 4735233 - DNA, 13 bp, Homo sapiens
ctcgaagaaaata

SEQ ID NO: 4735234 - DNA, 13 bp, Homo sapiens
ctcgaatgtaatt

SEQ ID NO: 4735235 - DNA, 15 bp, Homo sapiens
ctcgatgtcctcctc

SEQ ID NO: 4735236 - DNA, 13 bp, Homo sapiens
ctcgccctgtttg

SEQ ID NO: 4735237 - DNA, 17 bp, Homo sapiens
ctcgcctggcctgaggt

SEQ ID NO: 4735238 - DNA, 20 bp, Homo sapiens
ctcgcctggcctgaggtctc

SEQ ID NO: 4735239 - DNA, 22 bp, Homo sapiens
ctcgctattgtcaccagggctg

SEQ ID NO: 4735240 - DNA, 16 bp, Homo sapiens
ctcgctgatgctgggc

SEQ ID NO: 4735241 - DNA, 18 bp, Homo sapiens
ctcgctgatgctgggctg

SEQ ID NO: 4735242 - DNA, 19 bp, Homo sapiens
ctcgctgccagctctgtat

SEQ ID NO: 4735243 - DNA, 21 bp, Homo sapiens
ctcgctgtaggtcaggcccgc

SEQ ID NO: 4735244 - DNA, 18 bp, Homo sapiens
ctcggacttagctgggag

SEQ ID NO: 4735245 - DNA, 22 bp, Homo sapiens
ctcggcctcccaaagtgctggg

SEQ ID NO: 4735246 - DNA, 14 bp, Homo sapiens
ctcggctcactgca

SEQ ID NO: 4735247 - DNA, 13 bp, Homo sapiens
ctcggctcctgct

SEQ ID NO: 4735248 - DNA, 14 bp, Homo sapiens
ctcggctcctgctg

SEQ ID NO: 4735249 - DNA, 16 bp, Homo sapiens
ctcggctcctgctgca

SEQ ID NO: 4735250 - DNA, 17 bp, Homo sapiens
ctcggctcctgctgcac

SEQ ID NO: 4735251 - DNA, 19 bp, Homo sapiens
ctcggctcctgctgcacca

SEQ ID NO: 4735252 - DNA, 14 bp, Homo sapiens
ctcgggctcctgtg

SEQ ID NO: 4735253 - DNA, 22 bp, Homo sapiens
ctcgtgccagtcgcgctgcctg

SEQ ID NO: 4735254 - DNA, 17 bp, Homo sapiens
ctctaaaattataaatg

SEQ ID NO: 4735255 - DNA, 17 bp, Homo sapiens
ctctaagaagctgcaat

SEQ ID NO: 4735256 - DNA, 13 bp, Homo sapiens
ctctaattttgga

SEQ ID NO: 4735257 - DNA, 23 bp, Homo sapiens
ctctaattttggataatattcat

SEQ ID NO: 4735258 - DNA, 15 bp, Homo sapiens
ctctacacaacatgt

SEQ ID NO: 4735259 - DNA, 23 bp, Homo sapiens
ctctacacaacatgtatgtggat

SEQ ID NO: 4735260 - DNA, 16 bp, Homo sapiens
ctctacagaggccatg

SEQ ID NO: 4735261 - DNA, 21 bp, Homo sapiens
ctctactaacaatcagctcct

SEQ ID NO: 4735262 - DNA, 14 bp, Homo sapiens
ctcatcactcccct

SEQ ID NO: 4735263 - DNA, 15 bp, Homo sapiens
ctcatcactcccctc

SEQ ID NO: 4735264 - DNA, 16 bp, Homo sapiens
ctcatcactcccctcc

SEQ ID NO: 4735265 - DNA, 21 bp, Homo sapiens
ctcatcaggagttccagtgct

SEQ ID NO: 4735266 - DNA, 22 bp, Homo sapiens
ctcatcaggagttccagtgctg

SEQ ID NO: 4735267 - DNA, 20 bp, Homo sapiens
ctcatcattctctgtctcat

SEQ ID NO: 4735268 - DNA, 22 bp, Homo sapiens
ctcatcattctctgtctcatcc

SEQ ID NO: 4735269 - DNA, 16 bp, Homo sapiens
ctcatccagggctctg

SEQ ID NO: 4735270 - DNA, 22 bp, Homo sapiens
ctcatcccgagcacctccacat

SEQ ID NO: 4735271 - DNA, 18 bp, Homo sapiens
ctcatccctaatgctgca

SEQ ID NO: 4735272 - DNA, 22 bp, Homo sapiens
ctcatctcttagctcccctcca

SEQ ID NO: 4735273 - DNA, 15 bp, Homo sapiens
ctcatctgtccctcc

SEQ ID NO: 4735274 - DNA, 13 bp, Homo sapiens
ctcatgaatctgc

SEQ ID NO: 4735275 - DNA, 15 bp, Homo sapiens
ctcatgccctgccaa

SEQ ID NO: 4735276 - DNA, 12 bp, Homo sapiens
ctcatgcctcag

SEQ ID NO: 4735277 - DNA, 17 bp, Homo sapiens
ctcatggtgcatataaa

SEQ ID NO: 4735278 - DNA, 19 bp, Homo sapiens
ctcatggtgcatataaata

SEQ ID NO: 4735279 - DNA, 19 bp, Homo sapiens
ctcatgtgtgctcttcttc

SEQ ID NO: 4735280 - DNA, 14 bp, Homo sapiens
ctcattaaaatcca

SEQ ID NO: 4735281 - DNA, 18 bp, Homo sapiens
ctcattccctccccagaa

SEQ ID NO: 4735282 - DNA, 15 bp, Homo sapiens
ctcattgacctgagg

SEQ ID NO: 4735283 - DNA, 17 bp, Homo sapiens
ctcattgacctgaggcc

SEQ ID NO: 4735284 - DNA, 20 bp, Homo sapiens
ctcattgctgttttaatttg

SEQ ID NO: 4735285 - DNA, 22 bp, Homo sapiens
ctcatttcacccctccctttct

SEQ ID NO: 4735286 - DNA, 12 bp, Homo sapiens
ctcatttcagga

SEQ ID NO: 4735287 - DNA, 21 bp, Homo sapiens
ctcatttcaggagcagcctca

SEQ ID NO: 4735288 - DNA, 13 bp, Homo sapiens
ctcatttcaggat

SEQ ID NO: 4735289 - DNA, 17 bp, Homo sapiens
ctcatttgtcacacact

SEQ ID NO: 4735290 - DNA, 13 bp, Homo sapiens
ctccaaaccactt

SEQ ID NO: 4735291 - DNA, 15 bp, Homo sapiens
ctccaaaccctcgag

SEQ ID NO: 4735292 - DNA, 17 bp, Homo sapiens
ctccaaaccctcgaggc

SEQ ID NO: 4735293 - DNA, 21 bp, Homo sapiens
ctccaaaccctcgaggcggat

SEQ ID NO: 4735294 - DNA, 23 bp, Homo sapiens
ctccaaatttaaccataaatcaa

SEQ ID NO: 4735295 - DNA, 14 bp, Homo sapiens
ctccaaccccccag

SEQ ID NO: 4735296 - DNA, 17 bp, Homo sapiens
ctccaaccccccagcac

SEQ ID NO: 4735297 - DNA, 20 bp, Homo sapiens
ctccaaccccccagcactga

SEQ ID NO: 4735298 - DNA, 22 bp, Homo sapiens
ctccaaccccccagcactgagg

SEQ ID NO: 4735299 - DNA, 17 bp, Homo sapiens
ctccaacctgtggcgct

SEQ ID NO: 4735300 - DNA, 21 bp, Homo sapiens
ctccaagaccttctccttcac

SEQ ID NO: 4735301 - DNA, 22 bp, Homo sapiens
ctccaagaccttctccttcacc

SEQ ID NO: 4735302 - DNA, 13 bp, Homo sapiens
ctccaagcaggac

SEQ ID NO: 4735303 - DNA, 22 bp, Homo sapiens
ctccaagcaggacatggacaag

SEQ ID NO: 4735304 - DNA, 24 bp, Homo sapiens
ctccaagcaggacatggacaagga

SEQ ID NO: 4735305 - DNA, 16 bp, Homo sapiens
ctccaaggtttataaa

SEQ ID NO: 4735306 - DNA, 22 bp, Homo sapiens
ctccaagtccacagtggaacca

SEQ ID NO: 4735307 - DNA, 15 bp, Homo sapiens
ctccacacctgcggc

SEQ ID NO: 4735308 - DNA, 16 bp, Homo sapiens
ctccacacctgcggcc

SEQ ID NO: 4735309 - DNA, 13 bp, Homo sapiens
ctccacagtgttg

SEQ ID NO: 4735310 - DNA, 22 bp, Homo sapiens
ctccacctagtggctgtccagt

SEQ ID NO: 4735311 - DNA, 12 bp, Homo sapiens
ctccacctgcca

SEQ ID NO: 4735312 - DNA, 15 bp, Homo sapiens
ctccacctgccaggg

SEQ ID NO: 4735313 - DNA, 17 bp, Homo sapiens
ctccacctgccagggac

SEQ ID NO: 4735314 - DNA, 21 bp, Homo sapiens
ctccacctgccagggacagag

SEQ ID NO: 4735315 - DNA, 17 bp, Homo sapiens
ctccacgttctgctcat

SEQ ID NO: 4735316 - DNA, 13 bp, Homo sapiens
ctccactcccact

SEQ ID NO: 4735317 - DNA, 16 bp, Homo sapiens
ctccactctcccccac

SEQ ID NO: 4735318 - DNA, 16 bp, Homo sapiens
ctccagcattctcagc

SEQ ID NO: 4735319 - DNA, 20 bp, Homo sapiens
ctccagcccctggatgcagc

SEQ ID NO: 4735320 - DNA, 14 bp, Homo sapiens
ctccagcctcagct

SEQ ID NO: 4735321 - DNA, 23 bp, Homo sapiens
ctccagcctgacaacagcctgag

SEQ ID NO: 4735322 - DNA, 15 bp, Homo sapiens
ctccagctcaccagc

SEQ ID NO: 4735323 - DNA, 18 bp, Homo sapiens
ctccagctcaccagcccc

SEQ ID NO: 4735324 - DNA, 19 bp, Homo sapiens
ctccagctcaccagcccca

SEQ ID NO: 4735325 - DNA, 14 bp, Homo sapiens
ctccaggaagaagg

SEQ ID NO: 4735326 - DNA, 11 bp, Homo sapiens
ctccaggagca

SEQ ID NO: 4735327 - DNA, 13 bp, Homo sapiens
ctccaggagcagc

SEQ ID NO: 4735328 - DNA, 15 bp, Homo sapiens
ctccaggagcagcca

SEQ ID NO: 4735329 - DNA, 23 bp, Homo sapiens
ctccaggagcagccacattcctg

SEQ ID NO: 4735330 - DNA, 22 bp, Homo sapiens
ctccaggctgtatcccatgagc

SEQ ID NO: 4735331 - DNA, 23 bp, Homo sapiens
ctccagggacagcaactatcaga

SEQ ID NO: 4735332 - DNA, 15 bp, Homo sapiens
ctccagggctggact

SEQ ID NO: 4735333 - DNA, 19 bp, Homo sapiens
ctccagggctggactgagg

SEQ ID NO: 4735334 - DNA, 20 bp, Homo sapiens
ctccaggtgcacaagctcca

SEQ ID NO: 4735335 - DNA, 23 bp, Homo sapiens
ctccaggtgcacaagctccaagc

SEQ ID NO: 4735336 - DNA, 16 bp, Homo sapiens
ctccagtccaaggaaa

SEQ ID NO: 4735337 - DNA, 22 bp, Homo sapiens
ctccagtgaagcagcctcctta

SEQ ID NO: 4735338 - DNA, 20 bp, Homo sapiens
ctccatcgctgtcatctcag

SEQ ID NO: 4735339 - DNA, 17 bp, Homo sapiens
ctccatctaaactgccc

SEQ ID NO: 4735340 - DNA, 18 bp, Homo sapiens
ctccatctaaactgcccc

SEQ ID NO: 4735341 - DNA, 19 bp, Homo sapiens
ctccatgggggctcagcca

SEQ ID NO: 4735342 - DNA, 21 bp, Homo sapiens
ctccatgggggctcagccagg

SEQ ID NO: 4735343 - DNA, 22 bp, Homo sapiens
ctccatgtctctgagcattaga

SEQ ID NO: 4735344 - DNA, 16 bp, Homo sapiens
ctccattttcttgtca

SEQ ID NO: 4735345 - DNA, 16 bp, Homo sapiens
ctcccaaagtgctggg

SEQ ID NO: 4735346 - DNA, 18 bp, Homo sapiens
ctcccaaagtgctgggat

SEQ ID NO: 4735347 - DNA, 20 bp, Homo sapiens
ctcccaagagcttccagagc

SEQ ID NO: 4735348 - DNA, 22 bp, Homo sapiens
ctcccacagtgactcgggctcc

SEQ ID NO: 4735349 - DNA, 13 bp, Homo sapiens
ctcccacctcagc

SEQ ID NO: 4735350 - DNA, 18 bp, Homo sapiens
ctcccagcagtggcttgc

SEQ ID NO: 4735351 - DNA, 11 bp, Homo sapiens
ctcccagctga

SEQ ID NO: 4735352 - DNA, 17 bp, Homo sapiens
ctcccaggcattcccca

SEQ ID NO: 4735353 - DNA, 19 bp, Homo sapiens
ctcccaggcattccccagg

SEQ ID NO: 4735354 - DNA, 21 bp, Homo sapiens
ctcccaggcattccccaggag

SEQ ID NO: 4735355 - DNA, 12 bp, Homo sapiens
ctcccagtgtct

SEQ ID NO: 4735356 - DNA, 20 bp, Homo sapiens
ctcccagtgtcttcctgtgg

SEQ ID NO: 4735357 - DNA, 21 bp, Homo sapiens
ctcccagtgtcttcctgtggg

SEQ ID NO: 4735358 - DNA, 15 bp, Homo sapiens
ctcccatctcacaca

SEQ ID NO: 4735359 - DNA, 15 bp, Homo sapiens
ctcccatctgtgaaa

SEQ ID NO: 4735360 - DNA, 18 bp, Homo sapiens
ctcccatctgtgaaagga

SEQ ID NO: 4735361 - DNA, 13 bp, Homo sapiens
ctcccccatctct

SEQ ID NO: 4735362 - DNA, 12 bp, Homo sapiens
ctccccccaatc

SEQ ID NO: 4735363 - DNA, 14 bp, Homo sapiens
ctccccccaatccc

SEQ ID NO: 4735364 - DNA, 19 bp, Homo sapiens
ctcccccccggggctgggt

SEQ ID NO: 4735365 - DNA, 15 bp, Homo sapiens
ctcccctccaacctg

SEQ ID NO: 4735366 - DNA, 12 bp, Homo sapiens
ctggcctctgca

SEQ ID NO: 4735367 - DNA, 14 bp, Homo sapiens
ctggcctctgcact

SEQ ID NO: 4735368 - DNA, 20 bp, Homo sapiens
ctggcctctgcactcccctg

SEQ ID NO: 4735369 - DNA, 21 bp, Homo sapiens
ctggcctctgcactcccctgc

SEQ ID NO: 4735370 - DNA, 24 bp, Homo sapiens
ctggcctgaggtctcgctgatgct

SEQ ID NO: 4735371 - DNA, 13 bp, Homo sapiens
ctggcctggcccc

SEQ ID NO: 4735372 - DNA, 14 bp, Homo sapiens
ctggcctggcccct

SEQ ID NO: 4735373 - DNA, 19 bp, Homo sapiens
ctggcctggcccctcaggg

SEQ ID NO: 4735374 - DNA, 17 bp, Homo sapiens
ctggcgacaagagtgag

SEQ ID NO: 4735375 - DNA, 22 bp, Homo sapiens
ctggcgacacgtagcagcttag

SEQ ID NO: 4735376 - DNA, 15 bp, Homo sapiens
ctggctcttccaggc

SEQ ID NO: 4735377 - DNA, 20 bp, Homo sapiens
ctggctcttccaggctggga

SEQ ID NO: 4735378 - DNA, 22 bp, Homo sapiens
ctggctctttggagatcaagga

SEQ ID NO: 4735379 - DNA, 14 bp, Homo sapiens
ctggctgaaggact

SEQ ID NO: 4735380 - DNA, 21 bp, Homo sapiens
ctggctgcctccactcccact

SEQ ID NO: 4735381 - DNA, 18 bp, Homo sapiens
ctggctggggcctatcag

SEQ ID NO: 4735382 - DNA, 21 bp, Homo sapiens
ctggctggggcctatcagtgt

SEQ ID NO: 4735383 - DNA, 16 bp, Homo sapiens
ctggctggtgcctgag

SEQ ID NO: 4735384 - DNA, 19 bp, Homo sapiens
ctggctggtgcctgagccc

SEQ ID NO: 4735385 - DNA, 20 bp, Homo sapiens
ctggctggttagaggttccc

SEQ ID NO: 4735386 - DNA, 12 bp, Homo sapiens
ctggctgtgaaa

SEQ ID NO: 4735387 - DNA, 19 bp, Homo sapiens
ctggctgttggctgggggc

SEQ ID NO: 4735388 - DNA, 20 bp, Homo sapiens
ctgtcccctcttgccccaac

SEQ ID NO: 4735389 - DNA, 19 bp, Homo sapiens
ctgtccccttctctcatct

SEQ ID NO: 4735390 - DNA, 23 bp, Homo sapiens
ctgtccccttctctcatctctta

SEQ ID NO: 4735391 - DNA, 17 bp, Homo sapiens
ctgtccctccgggacct

SEQ ID NO: 4735392 - DNA, 21 bp, Homo sapiens
ctgtccctccgggacctggtg

SEQ ID NO: 4735393 - DNA, 22 bp, Homo sapiens
ctgtcccttgcccccctggcct

SEQ ID NO: 4735394 - DNA, 18 bp, Homo sapiens
ctgtcctactctgtgtca

SEQ ID NO: 4735395 - DNA, 15 bp, Homo sapiens
ctgtcctattatatt

SEQ ID NO: 4735396 - DNA, 20 bp, Homo sapiens
ctgtcctgacagcactcctc

SEQ ID NO: 4735397 - DNA, 13 bp, Homo sapiens
ctgtcctgctcca

SEQ ID NO: 4735398 - DNA, 15 bp, Homo sapiens
ctgtcctgctccaca

SEQ ID NO: 4735399 - DNA, 13 bp, Homo sapiens
ctgtcctgctggt

SEQ ID NO: 4735400 - DNA, 13 bp, Homo sapiens
ctgtcctgggagt

SEQ ID NO: 4735401 - DNA, 16 bp, Homo sapiens
ctgtcgcccaggctgg

SEQ ID NO: 4735402 - DNA, 13 bp, Homo sapiens
ctgtcgcccagtc

SEQ ID NO: 4735403 - DNA, 23 bp, Homo sapiens
ctgtctcaaaaaaacacaaaagt

SEQ ID NO: 4735404 - DNA, 13 bp, Homo sapiens
ctgtctcagactc

SEQ ID NO: 4735405 - DNA, 15 bp, Homo sapiens
ctgtctcatccatca

SEQ ID NO: 4735406 - DNA, 21 bp, Homo sapiens
ctgtctcatccatcatcatgt

SEQ ID NO: 4735407 - DNA, 23 bp, Homo sapiens
ctgtctggtttcaccgaggacat

SEQ ID NO: 4735408 - DNA, 14 bp, Homo sapiens
ctgtctgtagtgtt

SEQ ID NO: 4735409 - DNA, 19 bp, Homo sapiens
ctgtcttaaactaaatgtg

SEQ ID NO: 4735410 - DNA, 15 bp, Homo sapiens
ctgtgaaaggaaaga

SEQ ID NO: 4735411 - DNA, 16 bp, Homo sapiens
ctgtgaaaggaaagag

SEQ ID NO: 4735412 - DNA, 21 bp, Homo sapiens
ctgtgaacaagcttcagtaag

SEQ ID NO: 4735413 - DNA, 20 bp, Homo sapiens
ctgtgacaccccccttctga

SEQ ID NO: 4735414 - DNA, 15 bp, Homo sapiens
ctgtgaccaatgtct

SEQ ID NO: 4735415 - DNA, 21 bp, Homo sapiens
ctgtgagtactacagtcctcc

SEQ ID NO: 4735416 - DNA, 16 bp, Homo sapiens
ctgtgatggggccctg

SEQ ID NO: 4735417 - DNA, 20 bp, Homo sapiens
ctgtgatggggccctgcctc

SEQ ID NO: 4735418 - DNA, 23 bp, Homo sapiens
ctgtgatggggccctgcctcctt

SEQ ID NO: 4735419 - DNA, 14 bp, Homo sapiens
ctgtgcaaacagtg

SEQ ID NO: 4735420 - DNA, 18 bp, Homo sapiens
ctgtgcacatctgtgtct

SEQ ID NO: 4735421 - DNA, 21 bp, Homo sapiens
ctgtgcacatctgtgtcttgt

SEQ ID NO: 4735422 - DNA, 14 bp, Homo sapiens
ctgtgcaccaagca

SEQ ID NO: 4735423 - DNA, 17 bp, Homo sapiens
ctgtgcagccgctgagc

SEQ ID NO: 4735424 - DNA, 17 bp, Homo sapiens
ctgtgccaccctgggct

SEQ ID NO: 4735425 - DNA, 22 bp, Homo sapiens
ctgtgccattttgtattttact

SEQ ID NO: 4735426 - DNA, 23 bp, Homo sapiens
ctgtgcccaagtgggtccaagtg

SEQ ID NO: 4735427 - DNA, 19 bp, Homo sapiens
ctgtgcctgggcctagcac

SEQ ID NO: 4735428 - DNA, 22 bp, Homo sapiens
ctgtgctccctggttctgatga

SEQ ID NO: 4735429 - DNA, 22 bp, Homo sapiens
ctgtgctgagtctgaaggctgg

SEQ ID NO: 4735430 - DNA, 11 bp, Homo sapiens
ctgtgctgccc

SEQ ID NO: 4735431 - DNA, 21 bp, Homo sapiens
ctgtgctgccctgcccacctg

SEQ ID NO: 4735432 - DNA, 22 bp, Homo sapiens
ctgtgctgccctgcccacctgg

SEQ ID NO: 4735433 - DNA, 13 bp, Homo sapiens
ctgtgctggagcc

SEQ ID NO: 4735434 - DNA, 20 bp, Homo sapiens
ctgtggaggaaggattgtaa

SEQ ID NO: 4735435 - DNA, 19 bp, Homo sapiens
ctgtggaggccgagtctgt

SEQ ID NO: 4735436 - DNA, 22 bp, Homo sapiens
ctgtggaggccgagtctgtcct

SEQ ID NO: 4735437 - DNA, 17 bp, Homo sapiens
ctgtggcattgttgatg

SEQ ID NO: 4735438 - DNA, 16 bp, Homo sapiens
ctgtggccaagttctt

SEQ ID NO: 4735439 - DNA, 14 bp, Homo sapiens
ctgtgggatgggat

SEQ ID NO: 4735440 - DNA, 14 bp, Homo sapiens
ctgtgggcccccaa

SEQ ID NO: 4735441 - DNA, 21 bp, Homo sapiens
ctgtgggcgtgagacctgccc

SEQ ID NO: 4735442 - DNA, 22 bp, Homo sapiens
ctgtgggctgcactctgtgccc

SEQ ID NO: 4735443 - DNA, 19 bp, Homo sapiens
ctgtgggggaagagcacag

SEQ ID NO: 4735444 - DNA, 22 bp, Homo sapiens
ctgtggtgcaaaagcagaaaat

SEQ ID NO: 4735445 - DNA, 23 bp, Homo sapiens
ctgtggtgcaaaagcagaaaata

SEQ ID NO: 4735446 - DNA, 15 bp, Homo sapiens
ctgtgtaatagaata

SEQ ID NO: 4735447 - DNA, 18 bp, Homo sapiens
ctgtgtaatagaataaag

SEQ ID NO: 4735448 - DNA, 16 bp, Homo sapiens
ctgtgtcactggctgc

SEQ ID NO: 4735449 - DNA, 17 bp, Homo sapiens
ctgtgtcactggctgcc

SEQ ID NO: 4735450 - DNA, 19 bp, Homo sapiens
ctgtgtcaggtggggcagc

SEQ ID NO: 4735451 - DNA, 21 bp, Homo sapiens
ctgtgtcaggtggggcagctt

SEQ ID NO: 4735452 - DNA, 19 bp, Homo sapiens
ctgtgtcttgcaatggcag

SEQ ID NO: 4735453 - DNA, 21 bp, Homo sapiens
ctgtgtcttgcaatggcagcc

SEQ ID NO: 4735454 - DNA, 16 bp, Homo sapiens
ctgtgtgcgagtctga

SEQ ID NO: 4735455 - DNA, 18 bp, Homo sapiens
ctgtgtggcaaattaaac

SEQ ID NO: 4735456 - DNA, 19 bp, Homo sapiens
ctgtgtggcaaattaaaca

SEQ ID NO: 4735457 - DNA, 22 bp, Homo sapiens
ctgtgtggtgtcgcgccttctc

SEQ ID NO: 4735458 - DNA, 18 bp, Homo sapiens
ctgtgtgtgcctgtgtgc

SEQ ID NO: 4735459 - DNA, 18 bp, Homo sapiens
ctgtgtgtgcgcctacag

SEQ ID NO: 4735460 - DNA, 13 bp, Homo sapiens
ctgtgttccctca

SEQ ID NO: 4735461 - DNA, 20 bp, Homo sapiens
ctgtgttgtgctgggagcag

SEQ ID NO: 4735462 - DNA, 19 bp, Homo sapiens
ctgtgtttagctatttaat

SEQ ID NO: 4735463 - DNA, 14 bp, Homo sapiens
ctgttatcttgtgt

SEQ ID NO: 4735464 - DNA, 15 bp, Homo sapiens
ctgttcagctccagc

SEQ ID NO: 4735465 - DNA, 18 bp, Homo sapiens
ctgttcagctccagctca

SEQ ID NO: 4735466 - DNA, 15 bp, Homo sapiens
ctgttgaagattaac

SEQ ID NO: 4735467 - DNA, 14 bp, Homo sapiens
ctgttgataaaaac

SEQ ID NO: 4735468 - DNA, 14 bp, Homo sapiens
ctgttgcccaggct

SEQ ID NO: 4735469 - DNA, 16 bp, Homo sapiens
ctgttgcccaggctgg

SEQ ID NO: 4735470 - DNA, 20 bp, Homo sapiens
cttcccagtggctgctgccc

SEQ ID NO: 4735471 - DNA, 22 bp, Homo sapiens
cttcccatgacccaggctgggc

SEQ ID NO: 4735472 - DNA, 23 bp, Homo sapiens
cttccccgagggatgatgccaca

SEQ ID NO: 4735473 - DNA, 16 bp, Homo sapiens
cttccctatctttgcc

SEQ ID NO: 4735474 - DNA, 14 bp, Homo sapiens
cttccctgactcat

SEQ ID NO: 4735475 - DNA, 17 bp, Homo sapiens
cttcccttacctcaaag

SEQ ID NO: 4735476 - DNA, 14 bp, Homo sapiens
cttcctatttctgg

SEQ ID NO: 4735477 - DNA, 14 bp, Homo sapiens
cttcctctgagcct

SEQ ID NO: 4735478 - DNA, 17 bp, Homo sapiens
cttcctggagcccagag

SEQ ID NO: 4735479 - DNA, 16 bp, Homo sapiens
cttcgctcctgtgtct

SEQ ID NO: 4735480 - DNA, 13 bp, Homo sapiens
cttctaggaagct

SEQ ID NO: 4735481 - DNA, 19 bp, Homo sapiens
cttctaggacgccacccag

SEQ ID NO: 4735482 - DNA, 22 bp, Homo sapiens
cttctatttatttatttattca

SEQ ID NO: 4735483 - DNA, 20 bp, Homo sapiens
cttctcagccacaaaccctg

SEQ ID NO: 4735484 - DNA, 23 bp, Homo sapiens
cttctcagccacaaaccctgcct

SEQ ID NO: 4735485 - DNA, 19 bp, Homo sapiens
cttctcaggaaatggcttt

SEQ ID NO: 4735486 - DNA, 18 bp, Homo sapiens
cttctcatttcacccctc

SEQ ID NO: 4735487 - DNA, 21 bp, Homo sapiens
cttctcatttcacccctccct

SEQ ID NO: 4735488 - DNA, 14 bp, Homo sapiens
cttctccatccaca

SEQ ID NO: 4735489 - DNA, 16 bp, Homo sapiens
cttctccatccacatg

SEQ ID NO: 4735490 - DNA, 17 bp, Homo sapiens
cttctccatggccctgc

SEQ ID NO: 4735491 - DNA, 17 bp, Homo sapiens
cttctcctgtgatgtcc

SEQ ID NO: 4735492 - DNA, 14 bp, Homo sapiens
cttctctcatctct

SEQ ID NO: 4735493 - DNA, 17 bp, Homo sapiens
cttctctgagtcagctg

SEQ ID NO: 4735494 - DNA, 17 bp, Homo sapiens
cttctcttttcccagag

SEQ ID NO: 4735495 - DNA, 15 bp, Homo sapiens
cttctgacccatgct

SEQ ID NO: 4735496 - DNA, 20 bp, Homo sapiens
cttctgacccatgctgccct

SEQ ID NO: 4735497 - DNA, 23 bp, Homo sapiens
cttctgacccatgctgccctgtg

SEQ ID NO: 4735498 - DNA, 17 bp, Homo sapiens
cttctgacgcagcctga

SEQ ID NO: 4735499 - DNA, 19 bp, Homo sapiens
cttctgacgcagcctgaga

SEQ ID NO: 4735500 - DNA, 17 bp, Homo sapiens
gcactcagaagacactg

SEQ ID NO: 4735501 - DNA, 15 bp, Homo sapiens
gcactcccctgctgg

SEQ ID NO: 4735502 - DNA, 16 bp, Homo sapiens
gcactcccctgctggg

SEQ ID NO: 4735503 - DNA, 12 bp, Homo sapiens
gcactgacattg

SEQ ID NO: 4735504 - DNA, 11 bp, Homo sapiens
gcactgaggaa

SEQ ID NO: 4735505 - DNA, 14 bp, Homo sapiens
gcactgccatgcag

SEQ ID NO: 4735506 - DNA, 17 bp, Homo sapiens
gcactgccatgcagggc

SEQ ID NO: 4735507 - DNA, 15 bp, Homo sapiens
gcactgctgggtggc

SEQ ID NO: 4735508 - DNA, 17 bp, Homo sapiens
gcactgctgggtggccc

SEQ ID NO: 4735509 - DNA, 18 bp, Homo sapiens
gcactgctgggtggccca

SEQ ID NO: 4735510 - DNA, 18 bp, Homo sapiens
gcactgcttccagtgagg

SEQ ID NO: 4735511 - DNA, 20 bp, Homo sapiens
gcactgcttccagtgaggct

SEQ ID NO: 4735512 - DNA, 23 bp, Homo sapiens
gcactgcttccagtgaggctctg

SEQ ID NO: 4735513 - DNA, 14 bp, Homo sapiens
gcactgtcctgctc

SEQ ID NO: 4735514 - DNA, 15 bp, Homo sapiens
gcactgtcctgctcc

SEQ ID NO: 4735515 - DNA, 18 bp, Homo sapiens
gcactgtcctgctccaca

SEQ ID NO: 4735516 - DNA, 19 bp, Homo sapiens
gcactgtcctgctccacag

SEQ ID NO: 4735517 - DNA, 22 bp, Homo sapiens
gcactgtcctgctccacagtgt

SEQ ID NO: 4735518 - DNA, 23 bp, Homo sapiens
gcacttacaccagtttgactgtg

SEQ ID NO: 4735519 - DNA, 14 bp, Homo sapiens
gcacttcctcccct

SEQ ID NO: 4735520 - DNA, 19 bp, Homo sapiens
gcacttcctcccctcgccc

SEQ ID NO: 4735521 - DNA, 22 bp, Homo sapiens
gcacttgatgtgatgtggcagg

SEQ ID NO: 4735522 - DNA, 18 bp, Homo sapiens
gcactttgttctggctct

SEQ ID NO: 4735523 - DNA, 18 bp, Homo sapiens
gcagaagacaccagagca

SEQ ID NO: 4735524 - DNA, 15 bp, Homo sapiens
gcagaagggggtggt

SEQ ID NO: 4735525 - DNA, 19 bp, Homo sapiens
gcagaatactggtctcagg

SEQ ID NO: 4735526 - DNA, 12 bp, Homo sapiens
gcagacaggacc

SEQ ID NO: 4735527 - DNA, 12 bp, Homo sapiens
gcagacaggcaa

SEQ ID NO: 4735528 - DNA, 14 bp, Homo sapiens
gcagacaggcaagc

SEQ ID NO: 4735529 - DNA, 23 bp, Homo sapiens
gcagacaggcaagcacctcctgc

SEQ ID NO: 4735530 - DNA, 14 bp, Homo sapiens
gcagacgtccatca

SEQ ID NO: 4735531 - DNA, 22 bp, Homo sapiens
gcagactctacagaggccatgg

SEQ ID NO: 4735532 - DNA, 23 bp, Homo sapiens
gcagagaatgaaagggcccagag

SEQ ID NO: 4735533 - DNA, 22 bp, Homo sapiens
gcagagcaccttagacagtccc

SEQ ID NO: 4735534 - DNA, 23 bp, Homo sapiens
gcagagcaccttagacagtccct

SEQ ID NO: 4735535 - DNA, 12 bp, Homo sapiens
gcagagcagaga

SEQ ID NO: 4735536 - DNA, 20 bp, Homo sapiens
gcagagcagagaccatccct

SEQ ID NO: 4735537 - DNA, 17 bp, Homo sapiens
gcagagcttggactgga

SEQ ID NO: 4735538 - DNA, 21 bp, Homo sapiens
gcagaggtccacaacacacag

SEQ ID NO: 4735539 - DNA, 14 bp, Homo sapiens
gcagagtcacacgg

SEQ ID NO: 4735540 - DNA, 14 bp, Homo sapiens
gcagagttctttgc

SEQ ID NO: 4735541 - DNA, 15 bp, Homo sapiens
gcagatgcagagagc

SEQ ID NO: 4735542 - DNA, 18 bp, Homo sapiens
gcagatgcagagagccat

SEQ ID NO: 4735543 - DNA, 15 bp, Homo sapiens
gcagatgctggtcat

SEQ ID NO: 4735544 - DNA, 18 bp, Homo sapiens
gcagatgtccttgatgct

SEQ ID NO: 4735545 - DNA, 19 bp, Homo sapiens
gcagatttctgccttgaaa

SEQ ID NO: 4735546 - DNA, 12 bp, Homo sapiens
gcagcagggcta

SEQ ID NO: 4735547 - DNA, 19 bp, Homo sapiens
gcagcagggctaccctgag

SEQ ID NO: 4735548 - DNA, 14 bp, Homo sapiens
gcagcaggtgctgc

SEQ ID NO: 4735549 - DNA, 19 bp, Homo sapiens
gcagcaggtgctgctaccc

SEQ ID NO: 4735550 - DNA, 22 bp, Homo sapiens
gcagcaggtgctgctaccctcc

SEQ ID NO: 4735551 - DNA, 20 bp, Homo sapiens
gcagcaggtggcagaatggg

SEQ ID NO: 4735552 - DNA, 20 bp, Homo sapiens
gcagcagtgtgaggccaggg

SEQ ID NO: 4735553 - DNA, 21 bp, Homo sapiens
gcagcagtgtgaggccagggc

SEQ ID NO: 4735554 - DNA, 22 bp, Homo sapiens
gcagcagtgtgaggccagggca

SEQ ID NO: 4735555 - DNA, 12 bp, Homo sapiens
gcagccaaggga

SEQ ID NO: 4735556 - DNA, 15 bp, Homo sapiens
gcagccacattcctg

SEQ ID NO: 4735557 - DNA, 16 bp, Homo sapiens
gcagccagggagagcc

SEQ ID NO: 4735558 - DNA, 17 bp, Homo sapiens
gcagccagggagagccc

SEQ ID NO: 4735559 - DNA, 18 bp, Homo sapiens
gcagccagggagagccca

SEQ ID NO: 4735560 - DNA, 20 bp, Homo sapiens
gcagccagggagagcccagg

SEQ ID NO: 4735561 - DNA, 17 bp, Homo sapiens
gcagccccattctgcct

SEQ ID NO: 4735562 - DNA, 19 bp, Homo sapiens
gcagccccattctgcctgc

SEQ ID NO: 4735563 - DNA, 20 bp, Homo sapiens
gcagccctgctgctgcctgc

SEQ ID NO: 4735564 - DNA, 16 bp, Homo sapiens
gcagccctggagtcat

SEQ ID NO: 4735565 - DNA, 18 bp, Homo sapiens
gcagccctggagtcatgc

SEQ ID NO: 4735566 - DNA, 16 bp, Homo sapiens
gcagccgctgagcgag

SEQ ID NO: 4735567 - DNA, 19 bp, Homo sapiens
gcagcctcacagtccttac

SEQ ID NO: 4735568 - DNA, 16 bp, Homo sapiens
gcagcgctagtggagg

SEQ ID NO: 4735569 - DNA, 13 bp, Homo sapiens
gcagctaaaacct

SEQ ID NO: 4735570 - DNA, 15 bp, Homo sapiens
gcagctcacctctcc

SEQ ID NO: 4735571 - DNA, 17 bp, Homo sapiens
gcagctcacctctccct

SEQ ID NO: 4735572 - DNA, 19 bp, Homo sapiens
gcagctcaggttgtagtgg

SEQ ID NO: 4735573 - DNA, 23 bp, Homo sapiens
gcagctgcggtccacccaggagc

SEQ ID NO: 4735574 - DNA, 14 bp, Homo sapiens
gcagctggcagaga

SEQ ID NO: 4735575 - DNA, 17 bp, Homo sapiens
gcagcttctgccacttc

SEQ ID NO: 4735576 - DNA, 21 bp, Homo sapiens
gcaggaaatgaaaatgtcttg

SEQ ID NO: 4735577 - DNA, 16 bp, Homo sapiens
gcaggaacatacagac

SEQ ID NO: 4735578 - DNA, 13 bp, Homo sapiens
gcaggaaggagct

SEQ ID NO: 4735579 - DNA, 14 bp, Homo sapiens
gcaggaaggagctg

SEQ ID NO: 4735580 - DNA, 16 bp, Homo sapiens
gcaggaaggagctgcc

SEQ ID NO: 4735581 - DNA, 20 bp, Homo sapiens
gcaggaaggagctgcctgga

SEQ ID NO: 4735582 - DNA, 17 bp, Homo sapiens
gcaggaggggggctggg

SEQ ID NO: 4735583 - DNA, 24 bp, Homo sapiens
gcaggatggcctggccagggcctg

SEQ ID NO: 4735584 - DNA, 15 bp, Homo sapiens
gcaggcagccaggcc

SEQ ID NO: 4735585 - DNA, 16 bp, Homo sapiens
gcaggcagccaggcca

SEQ ID NO: 4735586 - DNA, 19 bp, Homo sapiens
gcaggcatggctggtgcct

SEQ ID NO: 4735587 - DNA, 22 bp, Homo sapiens
gcaggcatggctggtgcctgaa

SEQ ID NO: 4735588 - DNA, 15 bp, Homo sapiens
gcaggccctgcactg

SEQ ID NO: 4735589 - DNA, 23 bp, Homo sapiens
gcaggccctgcactgtcctgctc

SEQ ID NO: 4735590 - DNA, 14 bp, Homo sapiens
gcaggcctgccttc

SEQ ID NO: 4735591 - DNA, 14 bp, Homo sapiens
gcaggctggccctg

SEQ ID NO: 4735592 - DNA, 15 bp, Homo sapiens
gcaggctggccctgc

SEQ ID NO: 4735593 - DNA, 16 bp, Homo sapiens
gcaggctggccctgcc

SEQ ID NO: 4735594 - DNA, 21 bp, Homo sapiens
gcaggctggccctgccctggt

SEQ ID NO: 4735595 - DNA, 21 bp, Homo sapiens
gcaggcttctcagtctctgtc

SEQ ID NO: 4735596 - DNA, 21 bp, Homo sapiens
gcagggaaaattatttgcata

SEQ ID NO: 4735597 - DNA, 22 bp, Homo sapiens
gcagggagaggagtgactgagc

SEQ ID NO: 4735598 - DNA, 18 bp, Homo sapiens
gcagggagggcctgggcc

SEQ ID NO: 4735599 - DNA, 23 bp, Homo sapiens
gcagggctaccctgagctgaggc

SEQ ID NO: 4735600 - DNA, 12 bp, Homo sapiens
gcagggctcagc

SEQ ID NO: 4735601 - DNA, 19 bp, Homo sapiens
gcagggctcagcggggaca

SEQ ID NO: 4735602 - DNA, 22 bp, Homo sapiens
gcagggctcagcggggacagct

SEQ ID NO: 4735603 - DNA, 16 bp, Homo sapiens
gcagggtctcactctg

SEQ ID NO: 4735604 - DNA, 15 bp, Homo sapiens
gcaggtaaacagttc

SEQ ID NO: 4735605 - DNA, 22 bp, Homo sapiens
gcaggtccagggtttgagttca

SEQ ID NO: 4735606 - DNA, 15 bp, Homo sapiens
gcaggtgctgctacc

SEQ ID NO: 4735607 - DNA, 22 bp, Homo sapiens
gcaggttgggccatactggcct

SEQ ID NO: 4735608 - DNA, 15 bp, Homo sapiens
gcaggtttgaccagg

SEQ ID NO: 4735609 - DNA, 19 bp, Homo sapiens
gcagtcattatccaggtaa

SEQ ID NO: 4735610 - DNA, 15 bp, Homo sapiens
gcagtgcaggcacag

SEQ ID NO: 4735611 - DNA, 18 bp, Homo sapiens
gcagtgcaggcacagtat

SEQ ID NO: 4735612 - DNA, 17 bp, Homo sapiens
gcagtgggaaaaatgta

SEQ ID NO: 4735613 - DNA, 11 bp, Homo sapiens
gcagtgggagc

SEQ ID NO: 4735614 - DNA, 15 bp, Homo sapiens
gcagtgggagctgcc

SEQ ID NO: 4735615 - DNA, 16 bp, Homo sapiens
gcagtgggagctgcct

SEQ ID NO: 4735616 - DNA, 18 bp, Homo sapiens
gcagtgggagctgcctgt

SEQ ID NO: 4735617 - DNA, 19 bp, Homo sapiens
gcagtgtgaggccagggca

SEQ ID NO: 4735618 - DNA, 18 bp, Homo sapiens
gcagttacccaacagaaa

SEQ ID NO: 4735619 - DNA, 14 bp, Homo sapiens
gcagttgccagtca

SEQ ID NO: 4735620 - DNA, 14 bp, Homo sapiens
gcataaatatgcag

SEQ ID NO: 4735621 - DNA, 17 bp, Homo sapiens
gcataacaattcctcta

SEQ ID NO: 4735622 - DNA, 16 bp, Homo sapiens
gcataatttaaaaata

SEQ ID NO: 4735623 - DNA, 17 bp, Homo sapiens
gcataatttaaaaatat

SEQ ID NO: 4735624 - DNA, 21 bp, Homo sapiens
gcataattttgtgttgtacaa

SEQ ID NO: 4735625 - DNA, 22 bp, Homo sapiens
gcatactgccttgtttaatggt

SEQ ID NO: 4735626 - DNA, 13 bp, Homo sapiens
gcatagaagtaaa

SEQ ID NO: 4735627 - DNA, 19 bp, Homo sapiens
gcatagatgcaggtgagcc

SEQ ID NO: 4735628 - DNA, 12 bp, Homo sapiens
gcatataaatat

SEQ ID NO: 4735629 - DNA, 17 bp, Homo sapiens
gcatataaatatattta

SEQ ID NO: 4735630 - DNA, 17 bp, Homo sapiens
gcatataatgaataaat

SEQ ID NO: 4735631 - DNA, 18 bp, Homo sapiens
gcatataatgaataaatc

SEQ ID NO: 4735632 - DNA, 19 bp, Homo sapiens
gcatataatgaataaatca

SEQ ID NO: 4735633 - DNA, 19 bp, Homo sapiens
gcatatattaaaagcaggc

SEQ ID NO: 4735634 - DNA, 17 bp, Homo sapiens
gcatattcaggaagctc

SEQ ID NO: 4735635 - DNA, 19 bp, Homo sapiens
gcatatttttctaaagaaa

SEQ ID NO: 4735636 - DNA, 15 bp, Homo sapiens
gcatcaaacatgaaa

SEQ ID NO: 4735637 - DNA, 17 bp, Homo sapiens
gcatcagctggcgtcat

SEQ ID NO: 4735638 - DNA, 21 bp, Homo sapiens
gcatcagctggcgtcatgcaa

SEQ ID NO: 4735639 - DNA, 13 bp, Homo sapiens
gcatcaggccagg

SEQ ID NO: 4735640 - DNA, 16 bp, Homo sapiens
gcatcaggccaggccc

SEQ ID NO: 4735641 - DNA, 17 bp, Homo sapiens
gcatccacctccttctc

SEQ ID NO: 4735642 - DNA, 17 bp, Homo sapiens
gcatcctccgcctcccg

SEQ ID NO: 4735643 - DNA, 13 bp, Homo sapiens
gcatcctggcacc

SEQ ID NO: 4735644 - DNA, 23 bp, Homo sapiens
gcatcctggcacccggcccctgc

SEQ ID NO: 4735645 - DNA, 16 bp, Homo sapiens
gcatctaattcttatt

SEQ ID NO: 4735646 - DNA, 13 bp, Homo sapiens
gcatctcccagat

SEQ ID NO: 4735647 - DNA, 16 bp, Homo sapiens
gcatctggtgtaggaa

SEQ ID NO: 4735648 - DNA, 22 bp, Homo sapiens
gcatgacccagtgaagatgcag

SEQ ID NO: 4735649 - DNA, 16 bp, Homo sapiens
gcatgcactgttcccc

SEQ ID NO: 4735650 - DNA, 22 bp, Homo sapiens
gcatgcactgttccccctgtgc

SEQ ID NO: 4735651 - DNA, 19 bp, Homo sapiens
gcatgccccctcgtgccag

SEQ ID NO: 4735652 - DNA, 20 bp, Homo sapiens
gcatgccccctcgtgccagt

SEQ ID NO: 4735653 - DNA, 22 bp, Homo sapiens
gcatgcctggatggggctgcac

SEQ ID NO: 4735654 - DNA, 12 bp, Homo sapiens
gcatggagctgg

SEQ ID NO: 4735655 - DNA, 15 bp, Homo sapiens
gcatggagctggccg

SEQ ID NO: 4735656 - DNA, 15 bp, Homo sapiens
gcatggagtgtttga

SEQ ID NO: 4735657 - DNA, 16 bp, Homo sapiens
gcatgggtcgggagag

SEQ ID NO: 4735658 - DNA, 23 bp, Homo sapiens
gcatgggtcgggagaggggacgc

SEQ ID NO: 4735659 - DNA, 16 bp, Homo sapiens
gcatgtgggttgtgat

SEQ ID NO: 4735660 - DNA, 21 bp, Homo sapiens
gcatgttctctgaggacacta

SEQ ID NO: 4735661 - DNA, 18 bp, Homo sapiens
gcatgttttccagctcct

SEQ ID NO: 4735662 - DNA, 15 bp, Homo sapiens
gcattcatgttttaa

SEQ ID NO: 4735663 - DNA, 14 bp, Homo sapiens
gcattccccaggag

SEQ ID NO: 4735664 - DNA, 23 bp, Homo sapiens
gcattccttctttgataatgtta

SEQ ID NO: 4735665 - DNA, 14 bp, Homo sapiens
gcattcttattcat

SEQ ID NO: 4735666 - DNA, 17 bp, Homo sapiens
gcattcttggttggctg

SEQ ID NO: 4735667 - DNA, 12 bp, Homo sapiens
gcattggatatt

SEQ ID NO: 4735668 - DNA, 15 bp, Homo sapiens
gcattggcagcaggt

SEQ ID NO: 4735669 - DNA, 13 bp, Homo sapiens
gcattgtgggaag

SEQ ID NO: 4735670 - DNA, 15 bp, Homo sapiens
gcattgtgggaaggg

SEQ ID NO: 4735671 - DNA, 23 bp, Homo sapiens
gcatttaaagttgtataaaaaca

SEQ ID NO: 4735672 - DNA, 15 bp, Homo sapiens
gcatttactttgtgt

SEQ ID NO: 4735673 - DNA, 16 bp, Homo sapiens
gcatttatttgtgatg

SEQ ID NO: 4735674 - DNA, 20 bp, Homo sapiens
gcatttcacaaaacagcctt

SEQ ID NO: 4735675 - DNA, 22 bp, Homo sapiens
gcatttcacaaaacagcctttg

SEQ ID NO: 4735676 - DNA, 20 bp, Homo sapiens
gcatttggcaggaagatgta

SEQ ID NO: 4735677 - DNA, 14 bp, Homo sapiens
gcatttttaaagga

SEQ ID NO: 4735678 - DNA, 20 bp, Homo sapiens
gccaaagccaaagctaggcc

SEQ ID NO: 4735679 - DNA, 16 bp, Homo sapiens
gccaaagctaggcctg

SEQ ID NO: 4735680 - DNA, 21 bp, Homo sapiens
gccaagggatgaaagagaagg

SEQ ID NO: 4735681 - DNA, 18 bp, Homo sapiens
gccaatggaacctccttt

SEQ ID NO: 4735682 - DNA, 11 bp, Homo sapiens
gccaattttgt

SEQ ID NO: 4735683 - DNA, 16 bp, Homo sapiens
gccacaccaagctgtg

SEQ ID NO: 4735684 - DNA, 18 bp, Homo sapiens
gccacaccaagctgtgcc

SEQ ID NO: 4735685 - DNA, 22 bp, Homo sapiens
gccacaccaagctgtgccaccc

SEQ ID NO: 4735686 - DNA, 23 bp, Homo sapiens
gccacaccaagctgtgccaccct

SEQ ID NO: 4735687 - DNA, 13 bp, Homo sapiens
gccacagagaaag

SEQ ID NO: 4735688 - DNA, 23 bp, Homo sapiens
gccacagagaaagtacttctcca

SEQ ID NO: 4735689 - DNA, 16 bp, Homo sapiens
gccacagcctcccctg

SEQ ID NO: 4735690 - DNA, 21 bp, Homo sapiens
gccacagcctcccctgccagg

SEQ ID NO: 4735691 - DNA, 15 bp, Homo sapiens
gccacaggcctgaga

SEQ ID NO: 4735692 - DNA, 21 bp, Homo sapiens
gccacagtgttatgctctgtg

SEQ ID NO: 4735693 - DNA, 14 bp, Homo sapiens
gccacatttacata

SEQ ID NO: 4735694 - DNA, 14 bp, Homo sapiens
gccaccaagaggga

SEQ ID NO: 4735695 - DNA, 19 bp, Homo sapiens
gccaccaagagggacgcct

SEQ ID NO: 4735696 - DNA, 22 bp, Homo sapiens
gccaccaagagggacgcctggg

SEQ ID NO: 4735697 - DNA, 13 bp, Homo sapiens
gccaccacccccc

SEQ ID NO: 4735698 - DNA, 16 bp, Homo sapiens
gccaccaccccccact

SEQ ID NO: 4735699 - DNA, 13 bp, Homo sapiens
gccaccacgcccg

SEQ ID NO: 4735700 - DNA, 14 bp, Homo sapiens
gccaccacgcccgg

SEQ ID NO: 4735701 - DNA, 23 bp, Homo sapiens
gccaccctcaccgcggctggatg

SEQ ID NO: 4735702 - DNA, 18 bp, Homo sapiens
gccaccctgggctctgtg

SEQ ID NO: 4735703 - DNA, 21 bp, Homo sapiens
gccaccctgggctctgtgggc

SEQ ID NO: 4735704 - DNA, 13 bp, Homo sapiens
gccacctcaccct

SEQ ID NO: 4735705 - DNA, 13 bp, Homo sapiens
gccacctggaccc

SEQ ID NO: 4735706 - DNA, 15 bp, Homo sapiens
gccacctggacccct

SEQ ID NO: 4735707 - DNA, 20 bp, Homo sapiens
gccacgcccaactaattttt

SEQ ID NO: 4735708 - DNA, 14 bp, Homo sapiens
gccacggccaggcc

SEQ ID NO: 4735709 - DNA, 23 bp, Homo sapiens
gccacgtgtttgtgctgtggtgt

SEQ ID NO: 4735710 - DNA, 15 bp, Homo sapiens
gccactcctctgact

SEQ ID NO: 4735711 - DNA, 21 bp, Homo sapiens
gccactcctctgactcagggc

SEQ ID NO: 4735712 - DNA, 18 bp, Homo sapiens
gccactgcaccgggccac

SEQ ID NO: 4735713 - DNA, 21 bp, Homo sapiens
gccactgcaccgggccacaga

SEQ ID NO: 4735714 - DNA, 22 bp, Homo sapiens
gccactgcaccgggccacagag

SEQ ID NO: 4735715 - DNA, 17 bp, Homo sapiens
gccactgcctttcagaa

SEQ ID NO: 4735716 - DNA, 13 bp, Homo sapiens
gccactggagggg

SEQ ID NO: 4735717 - DNA, 15 bp, Homo sapiens
gccacttcccaggta

SEQ ID NO: 4735718 - DNA, 17 bp, Homo sapiens
gccagaacctggagggc

SEQ ID NO: 4735719 - DNA, 21 bp, Homo sapiens
gccagagggagtgacagaggc

SEQ ID NO: 4735720 - DNA, 21 bp, Homo sapiens
gccagatgcacatccctggaa

SEQ ID NO: 4735721 - DNA, 16 bp, Homo sapiens
gccagattctttcctg

SEQ ID NO: 4735722 - DNA, 20 bp, Homo sapiens
gattgctgccccatcagtgc

SEQ ID NO: 4735723 - DNA, 13 bp, Homo sapiens
gattggattattt

SEQ ID NO: 4735724 - DNA, 17 bp, Homo sapiens
gattggctcacactgag

SEQ ID NO: 4735725 - DNA, 20 bp, Homo sapiens
gattgtgtctcttggtcctg

SEQ ID NO: 4735726 - DNA, 18 bp, Homo sapiens
gatttaaaagcctgctca

SEQ ID NO: 4735727 - DNA, 15 bp, Homo sapiens
gatttaataaaataa

SEQ ID NO: 4735728 - DNA, 20 bp, Homo sapiens
gatttagttgtggaaagata

SEQ ID NO: 4735729 - DNA, 20 bp, Homo sapiens
gatttcagctcactgcaacc

SEQ ID NO: 4735730 - DNA, 15 bp, Homo sapiens
gatttcatactgtaa

SEQ ID NO: 4735731 - DNA, 17 bp, Homo sapiens
gatttcatctgctctcc

SEQ ID NO: 4735732 - DNA, 15 bp, Homo sapiens
gatttccagccaggg

SEQ ID NO: 4735733 - DNA, 22 bp, Homo sapiens
gatttcccgtggccccagcctg

SEQ ID NO: 4735734 - DNA, 18 bp, Homo sapiens
gatttggagatgtctctg

SEQ ID NO: 4735735 - DNA, 22 bp, Homo sapiens
gatttggagatgtctctgtgtg

SEQ ID NO: 4735736 - DNA, 14 bp, Homo sapiens
gatttgtaacatta

SEQ ID NO: 4735737 - DNA, 22 bp, Homo sapiens
gatttgtctttggtgaacattg

SEQ ID NO: 4735738 - DNA, 21 bp, Homo sapiens
gattttaaaagttttgttctt

SEQ ID NO: 4735739 - DNA, 23 bp, Homo sapiens
gattttgaacctgatgaaaataa

SEQ ID NO: 4735740 - DNA, 10 bp, Homo sapiens
gattttgctg

SEQ ID NO: 4735741 - DNA, 16 bp, Homo sapiens
gattttgctgtagaag

SEQ ID NO: 4735742 - DNA, 19 bp, Homo sapiens
gattttggcctcattactt

SEQ ID NO: 4735743 - DNA, 19 bp, Homo sapiens
gattttggttttgttcccc

SEQ ID NO: 4735744 - DNA, 21 bp, Homo sapiens
gattttgtaaagttgccttta

SEQ ID NO: 4735745 - DNA, 12 bp, Homo sapiens
gatttttctcaa

SEQ ID NO: 4735746 - DNA, 22 bp, Homo sapiens
gatttttgaaaatcctgaataa

SEQ ID NO: 4735747 - DNA, 19 bp, Homo sapiens
gcaaaatgcgtatttgcat

SEQ ID NO: 4735748 - DNA, 21 bp, Homo sapiens
gcaaaattgtttttggttgga

SEQ ID NO: 4735749 - DNA, 19 bp, Homo sapiens
gcaaacccatcaacaaaaa

SEQ ID NO: 4735750 - DNA, 21 bp, Homo sapiens
gcaaactcaagcttcttcact

SEQ ID NO: 4735751 - DNA, 13 bp, Homo sapiens
gcaaaggctggga

SEQ ID NO: 4735752 - DNA, 16 bp, Homo sapiens
gcaaagtataaaatta

SEQ ID NO: 4735753 - DNA, 16 bp, Homo sapiens
gcaaagtcatgcaaag

SEQ ID NO: 4735754 - DNA, 21 bp, Homo sapiens
gcaaagtcatgcaaaggctgg

SEQ ID NO: 4735755 - DNA, 20 bp, Homo sapiens
gcaaatgcccaagggaaaga

SEQ ID NO: 4735756 - DNA, 22 bp, Homo sapiens
gcaaatgtcacagtaatgcaag

SEQ ID NO: 4735757 - DNA, 16 bp, Homo sapiens
gcaaattactccaagg

SEQ ID NO: 4735758 - DNA, 19 bp, Homo sapiens
gcaacaggctgggcttcag

SEQ ID NO: 4735759 - DNA, 15 bp, Homo sapiens
gcaacccccagcctg

SEQ ID NO: 4735760 - DNA, 16 bp, Homo sapiens
gcaacccccagcctgc

SEQ ID NO: 4735761 - DNA, 17 bp, Homo sapiens
gcaacccccagcctgct

SEQ ID NO: 4735762 - DNA, 20 bp, Homo sapiens
gcaaccttcgccacctgggt

SEQ ID NO: 4735763 - DNA, 19 bp, Homo sapiens
gcaactatcagactaagcc

SEQ ID NO: 4735764 - DNA, 13 bp, Homo sapiens
gcaactcttgtat

SEQ ID NO: 4735765 - DNA, 18 bp, Homo sapiens
gcaactgagtctgcggga

SEQ ID NO: 4735766 - DNA, 12 bp, Homo sapiens
gcaacttgtgaa

SEQ ID NO: 4735767 - DNA, 20 bp, Homo sapiens
gcaagacgctgtgctgccct

SEQ ID NO: 4735768 - DNA, 21 bp, Homo sapiens
gcaagacgctgtgctgccctg

SEQ ID NO: 4735769 - DNA, 23 bp, Homo sapiens
gcaagacgctgtgctgccctgcc

SEQ ID NO: 4735770 - DNA, 15 bp, Homo sapiens
gcaagcacctcctgc

SEQ ID NO: 4735771 - DNA, 13 bp, Homo sapiens
gcaagctcccaag

SEQ ID NO: 4735772 - DNA, 18 bp, Homo sapiens
gcaaggctgtgctccctg

SEQ ID NO: 4735773 - DNA, 21 bp, Homo sapiens
gcaagggaatttcttcaactc

SEQ ID NO: 4735774 - DNA, 15 bp, Homo sapiens
gcaagtgagagctgg

SEQ ID NO: 4735775 - DNA, 20 bp, Homo sapiens
gcaagtgattgggacagagg

SEQ ID NO: 4735776 - DNA, 15 bp, Homo sapiens
gcaatgccatcatct

SEQ ID NO: 4735777 - DNA, 23 bp, Homo sapiens
gcaatgccatcctcaaacactgc

SEQ ID NO: 4735778 - DNA, 13 bp, Homo sapiens
gcaatgctggctg

SEQ ID NO: 4735779 - DNA, 14 bp, Homo sapiens
gcaatgctgtgaat

SEQ ID NO: 4735780 - DNA, 15 bp, Homo sapiens
gcaatggcagccttg

SEQ ID NO: 4735781 - DNA, 18 bp, Homo sapiens
gcaatggtttgtgtcaaa

SEQ ID NO: 4735782 - DNA, 15 bp, Homo sapiens
gcaatgtgggcagag

SEQ ID NO: 4735783 - DNA, 17 bp, Homo sapiens
gcaattctcctgcctca

SEQ ID NO: 4735784 - DNA, 17 bp, Homo sapiens
gcacaagctccaagctc

SEQ ID NO: 4735785 - DNA, 22 bp, Homo sapiens
gcacaagctccaagctcccagg

SEQ ID NO: 4735786 - DNA, 12 bp, Homo sapiens
gcacaataaaac

SEQ ID NO: 4735787 - DNA, 22 bp, Homo sapiens
gcacaatctcggctcactgcat

SEQ ID NO: 4735788 - DNA, 15 bp, Homo sapiens
gcacacacacataca

SEQ ID NO: 4735789 - DNA, 16 bp, Homo sapiens
gcacacacacatacag

SEQ ID NO: 4735790 - DNA, 20 bp, Homo sapiens
gcacacaccagagcccacct

SEQ ID NO: 4735791 - DNA, 15 bp, Homo sapiens
gcacagaccctgccc

SEQ ID NO: 4735792 - DNA, 14 bp, Homo sapiens
gcacagatgcccac

SEQ ID NO: 4735793 - DNA, 17 bp, Homo sapiens
gcacagcaaggaggctg

SEQ ID NO: 4735794 - DNA, 22 bp, Homo sapiens
gcacagcaaggaggctggctgg

SEQ ID NO: 4735795 - DNA, 23 bp, Homo sapiens
gcacagcaaggaggctggctggg

SEQ ID NO: 4735796 - DNA, 17 bp, Homo sapiens
gcacagcccaaagaagg

SEQ ID NO: 4735797 - DNA, 18 bp, Homo sapiens
gcacagccctcccgcccc

SEQ ID NO: 4735798 - DNA, 20 bp, Homo sapiens
gcacaggtgggcttcccagt

SEQ ID NO: 4735799 - DNA, 21 bp, Homo sapiens
gcacaggtgggcttcccagtg

SEQ ID NO: 4735800 - DNA, 17 bp, Homo sapiens
gcacagtgtctgggctg

SEQ ID NO: 4735801 - DNA, 21 bp, Homo sapiens
gcacagtgtctgggctgactg

SEQ ID NO: 4735802 - DNA, 23 bp, Homo sapiens
gcacagtgtctgggctgactggg

SEQ ID NO: 4735803 - DNA, 14 bp, Homo sapiens
gcacatattgagca

SEQ ID NO: 4735804 - DNA, 12 bp, Homo sapiens
gcacatgttcat

SEQ ID NO: 4735805 - DNA, 21 bp, Homo sapiens
gcacatttaagagacagtcac

SEQ ID NO: 4735806 - DNA, 14 bp, Homo sapiens
gcaccaacccagcc

SEQ ID NO: 4735807 - DNA, 20 bp, Homo sapiens
gcaccaacccagccgctgcc

SEQ ID NO: 4735808 - DNA, 22 bp, Homo sapiens
gcaccattctttcttggtgcat

SEQ ID NO: 4735809 - DNA, 21 bp, Homo sapiens
gcacccagccccaaggggtgg

SEQ ID NO: 4735810 - DNA, 19 bp, Homo sapiens
gcacccagcctctagggac

SEQ ID NO: 4735811 - DNA, 18 bp, Homo sapiens
gcacccggcccctgctgg

SEQ ID NO: 4735812 - DNA, 23 bp, Homo sapiens
gcacccgggctcagggaccacag

SEQ ID NO: 4735813 - DNA, 20 bp, Homo sapiens
gcaccctcatacacagaaac

SEQ ID NO: 4735814 - DNA, 13 bp, Homo sapiens
gcaccctcccctc

SEQ ID NO: 4735815 - DNA, 15 bp, Homo sapiens
gcaccggaccagcct

SEQ ID NO: 4735816 - DNA, 19 bp, Homo sapiens
gcaccggctggcctggccc

SEQ ID NO: 4735817 - DNA, 23 bp, Homo sapiens
gcaccggctggcctggcccctca

SEQ ID NO: 4735818 - DNA, 14 bp, Homo sapiens
gcaccgggccacag

SEQ ID NO: 4735819 - DNA, 22 bp, Homo sapiens
gcacctaccaccacgcccggct

SEQ ID NO: 4735820 - DNA, 18 bp, Homo sapiens
gcacctccacatcctcca

SEQ ID NO: 4735821 - DNA, 15 bp, Homo sapiens
gcacctgaaattaat

SEQ ID NO: 4735822 - DNA, 15 bp, Homo sapiens
gcacctgcaggttgg

SEQ ID NO: 4735823 - DNA, 19 bp, Homo sapiens
gcaccttctgacgcagcct

SEQ ID NO: 4735824 - DNA, 21 bp, Homo sapiens
gcaccttctgacgcagcctga

SEQ ID NO: 4735825 - DNA, 17 bp, Homo sapiens
gcacgcacacacacata

SEQ ID NO: 4735826 - DNA, 19 bp, Homo sapiens
gcacggacatggtctgtcc

SEQ ID NO: 4735827 - DNA, 13 bp, Homo sapiens
gcacggctgctga

SEQ ID NO: 4735828 - DNA, 14 bp, Homo sapiens
gcacgtattttaat

SEQ ID NO: 4735829 - DNA, 14 bp, Homo sapiens
gcacgtgtgttttt

SEQ ID NO: 4735830 - DNA, 19 bp, Homo sapiens
gcactaaggtgtgctctga

SEQ ID NO: 4735831 - DNA, 22 bp, Homo sapiens
gcactatagcctaggtgacaga

SEQ ID NO: 4735832 - DNA, 23 bp, Homo sapiens
ctttactgggttggaagaaatat

SEQ ID NO: 4735833 - DNA, 14 bp, Homo sapiens
ctttagaagcctgc

SEQ ID NO: 4735834 - DNA, 15 bp, Homo sapiens
ctttagaagcctgca

SEQ ID NO: 4735835 - DNA, 14 bp, Homo sapiens
ctttagcgcccagt

SEQ ID NO: 4735836 - DNA, 21 bp, Homo sapiens
ctttagggactcaatttctcc

SEQ ID NO: 4735837 - DNA, 14 bp, Homo sapiens
ctttagtggcttca

SEQ ID NO: 4735838 - DNA, 20 bp, Homo sapiens
ctttataccccatttgattt

SEQ ID NO: 4735839 - DNA, 20 bp, Homo sapiens
ctttatgaggtcgtataatt

SEQ ID NO: 4735840 - DNA, 12 bp, Homo sapiens
ctttatttcaca

SEQ ID NO: 4735841 - DNA, 14 bp, Homo sapiens
ctttatttcacata

SEQ ID NO: 4735842 - DNA, 15 bp, Homo sapiens
ctttcagtgaaagca

SEQ ID NO: 4735843 - DNA, 17 bp, Homo sapiens
ctttcagtgaaagcatc

SEQ ID NO: 4735844 - DNA, 20 bp, Homo sapiens
ctttcattggatttttgtta

SEQ ID NO: 4735845 - DNA, 18 bp, Homo sapiens
ctttccattggatctcat

SEQ ID NO: 4735846 - DNA, 16 bp, Homo sapiens
ctttccatttggtatt

SEQ ID NO: 4735847 - DNA, 15 bp, Homo sapiens
ctttcctgaggctgg

SEQ ID NO: 4735848 - DNA, 20 bp, Homo sapiens
ctttcgaaatttcattttcc

SEQ ID NO: 4735849 - DNA, 17 bp, Homo sapiens
ctttctaatagagagat

SEQ ID NO: 4735850 - DNA, 23 bp, Homo sapiens
ctttctacagtattatgtactct

SEQ ID NO: 4735851 - DNA, 17 bp, Homo sapiens
ctttctacccagcgagc

SEQ ID NO: 4735852 - DNA, 18 bp, Homo sapiens
ctttctagtggtctttgt

SEQ ID NO: 4735853 - DNA, 19 bp, Homo sapiens
ctttctagtggtctttgta

SEQ ID NO: 4735854 - DNA, 23 bp, Homo sapiens
ctttctagtggtctttgtaagag

SEQ ID NO: 4735855 - DNA, 15 bp, Homo sapiens
ctttctatatccttg

SEQ ID NO: 4735856 - DNA, 18 bp, Homo sapiens
ctttctatatccttgaca

SEQ ID NO: 4735857 - DNA, 18 bp, Homo sapiens
ctttctcccctgccccca

SEQ ID NO: 4735858 - DNA, 24 bp, Homo sapiens
ctttctcccctgcccccaggactg

SEQ ID NO: 4735859 - DNA, 14 bp, Homo sapiens
ctttctcctgttta

SEQ ID NO: 4735860 - DNA, 17 bp, Homo sapiens
ctttctcttctctgttc

SEQ ID NO: 4735861 - DNA, 22 bp, Homo sapiens
ctttcttacaaggaaggtggtg

SEQ ID NO: 4735862 - DNA, 16 bp, Homo sapiens
ctttcttctcctgtga

SEQ ID NO: 4735863 - DNA, 17 bp, Homo sapiens
ctttgaaatattaaaat

SEQ ID NO: 4735864 - DNA, 19 bp, Homo sapiens
ctttgaccatggaaagaaa

SEQ ID NO: 4735865 - DNA, 23 bp, Homo sapiens
ctttgacctgcctcccttcatgc

SEQ ID NO: 4735866 - DNA, 16 bp, Homo sapiens
ctttgacgccatccca

SEQ ID NO: 4735867 - DNA, 18 bp, Homo sapiens
ctttgagacagtttctta

SEQ ID NO: 4735868 - DNA, 15 bp, Homo sapiens
ctttgataatgttaa

SEQ ID NO: 4735869 - DNA, 22 bp, Homo sapiens
ctttgatacagtcaacaagcct

SEQ ID NO: 4735870 - DNA, 14 bp, Homo sapiens
ctttgattctcctt

SEQ ID NO: 4735871 - DNA, 19 bp, Homo sapiens
ctttgattctccttcagcc

SEQ ID NO: 4735872 - DNA, 20 bp, Homo sapiens
ctttgattctccttcagccc

SEQ ID NO: 4735873 - DNA, 16 bp, Homo sapiens
ctttgcagacaggcaa

SEQ ID NO: 4735874 - DNA, 15 bp, Homo sapiens
ctttgcatattataa

SEQ ID NO: 4735875 - DNA, 16 bp, Homo sapiens
ctttgccaccctcatg

SEQ ID NO: 4735876 - DNA, 19 bp, Homo sapiens
ctttgctgaatgtcattat

SEQ ID NO: 4735877 - DNA, 19 bp, Homo sapiens
ctttggaaagagtaggaag

SEQ ID NO: 4735878 - DNA, 23 bp, Homo sapiens
ctttggaaagagtaggaagactt

SEQ ID NO: 4735879 - DNA, 18 bp, Homo sapiens
ctttggacagaagcagct

SEQ ID NO: 4735880 - DNA, 15 bp, Homo sapiens
ctttggaccctgagg

SEQ ID NO: 4735881 - DNA, 19 bp, Homo sapiens
ctttggaccctgaggccca

SEQ ID NO: 4735882 - DNA, 14 bp, Homo sapiens
ctttggctgcatgc

SEQ ID NO: 4735883 - DNA, 18 bp, Homo sapiens
ctttggggctaatttaac

SEQ ID NO: 4735884 - DNA, 20 bp, Homo sapiens
ctttggggcttttacaccag

SEQ ID NO: 4735885 - DNA, 21 bp, Homo sapiens
ctttggggcttttacaccagt

SEQ ID NO: 4735886 - DNA, 13 bp, Homo sapiens
ctttgggtcattt

SEQ ID NO: 4735887 - DNA, 15 bp, Homo sapiens
ctttggtgaacattg

SEQ ID NO: 4735888 - DNA, 17 bp, Homo sapiens
ctttgtaagagtgtaga

SEQ ID NO: 4735889 - DNA, 18 bp, Homo sapiens
ctttgtaagagtgtagaa

SEQ ID NO: 4735890 - DNA, 20 bp, Homo sapiens
ctttgtaagagtgtagaagc

SEQ ID NO: 4735891 - DNA, 15 bp, Homo sapiens
ctttgtaggacaaaa

SEQ ID NO: 4735892 - DNA, 22 bp, Homo sapiens
ctttgtccccaccgcagacagg

SEQ ID NO: 4735893 - DNA, 23 bp, Homo sapiens
ctttgtgaggaagccgctggggc

SEQ ID NO: 4735894 - DNA, 18 bp, Homo sapiens
ctttgttagtttctccaa

SEQ ID NO: 4735895 - DNA, 14 bp, Homo sapiens
ctttgttctggctc

SEQ ID NO: 4735896 - DNA, 15 bp, Homo sapiens
ctttgttctggctct

SEQ ID NO: 4735897 - DNA, 15 bp, Homo sapiens
ctttgttcttgtcat

SEQ ID NO: 4735898 - DNA, 18 bp, Homo sapiens
ctttgttcttgtcatcag

SEQ ID NO: 4735899 - DNA, 13 bp, Homo sapiens
ctttgtttaagca

SEQ ID NO: 4735900 - DNA, 14 bp, Homo sapiens
ctttgtttctcccc

SEQ ID NO: 4735901 - DNA, 19 bp, Homo sapiens
ctttgttttgcacactttg

SEQ ID NO: 4735902 - DNA, 15 bp, Homo sapiens
cttttaaagaatttc

SEQ ID NO: 4735903 - DNA, 21 bp, Homo sapiens
cttttaagacattttcatgct

SEQ ID NO: 4735904 - DNA, 19 bp, Homo sapiens
cttttaccattagcataat

SEQ ID NO: 4735905 - DNA, 14 bp, Homo sapiens
cttttataaacctc

SEQ ID NO: 4735906 - DNA, 12 bp, Homo sapiens
cttttcacaaat

SEQ ID NO: 4735907 - DNA, 16 bp, Homo sapiens
cttttcagcttctgct

SEQ ID NO: 4735908 - DNA, 19 bp, Homo sapiens
cttttcagcttctgctggg

SEQ ID NO: 4735909 - DNA, 19 bp, Homo sapiens
gatgtctttttattaaaat

SEQ ID NO: 4735910 - DNA, 23 bp, Homo sapiens
gatgtctttttattaaaatattt

SEQ ID NO: 4735911 - DNA, 18 bp, Homo sapiens
gatgtggcaggagggcag

SEQ ID NO: 4735912 - DNA, 19 bp, Homo sapiens
gatgtggcaggagggcagt

SEQ ID NO: 4735913 - DNA, 18 bp, Homo sapiens
gatgtgggtccctctctt

SEQ ID NO: 4735914 - DNA, 17 bp, Homo sapiens
gatgtgtgttgatactg

SEQ ID NO: 4735915 - DNA, 22 bp, Homo sapiens
gatgtgtgttgatactgttgca

SEQ ID NO: 4735916 - DNA, 23 bp, Homo sapiens
gatgtgtgttgatactgttgcac

SEQ ID NO: 4735917 - DNA, 14 bp, Homo sapiens
gatgtttataaact

SEQ ID NO: 4735918 - DNA, 21 bp, Homo sapiens
gattacaagcgtgagccactg

SEQ ID NO: 4735919 - DNA, 22 bp, Homo sapiens
gattacaagcgtgagccactgc

SEQ ID NO: 4735920 - DNA, 23 bp, Homo sapiens
gattacaagcgtgagccactgca

SEQ ID NO: 4735921 - DNA, 18 bp, Homo sapiens
gattacaggctcctgcca

SEQ ID NO: 4735922 - DNA, 14 bp, Homo sapiens
gattaggattaaaa

SEQ ID NO: 4735923 - DNA, 19 bp, Homo sapiens
gattagtaaatatgtgaag

SEQ ID NO: 4735924 - DNA, 22 bp, Homo sapiens
gattagtgtagtgttaaagtga

SEQ ID NO: 4735925 - DNA, 13 bp, Homo sapiens
gattatctaccca

SEQ ID NO: 4735926 - DNA, 17 bp, Homo sapiens
gattatggcctttttaa

SEQ ID NO: 4735927 - DNA, 14 bp, Homo sapiens
gattattcagtgtc

SEQ ID NO: 4735928 - DNA, 15 bp, Homo sapiens
gattattcagtgtca

SEQ ID NO: 4735929 - DNA, 14 bp, Homo sapiens
gattatttaataac

SEQ ID NO: 4735930 - DNA, 17 bp, Homo sapiens
gattatttaataacatt

SEQ ID NO: 4735931 - DNA, 22 bp, Homo sapiens
gattatttaataacattacctt

SEQ ID NO: 4735932 - DNA, 21 bp, Homo sapiens
gattcacacatgccactatga

SEQ ID NO: 4735933 - DNA, 15 bp, Homo sapiens
gattcactcagaaga

SEQ ID NO: 4735934 - DNA, 16 bp, Homo sapiens
gattcccaagctctgc

SEQ ID NO: 4735935 - DNA, 18 bp, Homo sapiens
gattcccaagctctgctc

SEQ ID NO: 4735936 - DNA, 21 bp, Homo sapiens
gattcccggagggaaactgtg

SEQ ID NO: 4735937 - DNA, 13 bp, Homo sapiens
gattcggctgtct

SEQ ID NO: 4735938 - DNA, 17 bp, Homo sapiens
gattctatgttaatatt

SEQ ID NO: 4735939 - DNA, 20 bp, Homo sapiens
gattctatgttaatatttta

SEQ ID NO: 4735940 - DNA, 22 bp, Homo sapiens
gattctcagggtctctgctgcc

SEQ ID NO: 4735941 - DNA, 16 bp, Homo sapiens
gattctcatgcctcag

SEQ ID NO: 4735942 - DNA, 15 bp, Homo sapiens
gattctcctgcctca

SEQ ID NO: 4735943 - DNA, 17 bp, Homo sapiens
gattctcctgcctcagc

SEQ ID NO: 4735944 - DNA, 18 bp, Homo sapiens
gattctcctgcctcagcc

SEQ ID NO: 4735945 - DNA, 17 bp, Homo sapiens
gattctccttcagccct

SEQ ID NO: 4735946 - DNA, 15 bp, Homo sapiens
gattctgatttgtat

SEQ ID NO: 4735947 - DNA, 12 bp, Homo sapiens
gattcttctgct

SEQ ID NO: 4735948 - DNA, 13 bp, Homo sapiens
gattcttctgctt

SEQ ID NO: 4735949 - DNA, 21 bp, Homo sapiens
gattcttctgcttcagcctcc

SEQ ID NO: 4735950 - DNA, 20 bp, Homo sapiens
gattctttcccaattcacat

SEQ ID NO: 4735951 - DNA, 16 bp, Homo sapiens
gattctttcctgaggc

SEQ ID NO: 4735952 - DNA, 18 bp, Homo sapiens
gattctttcctgaggctg

SEQ ID NO: 4735953 - DNA, 19 bp, Homo sapiens
gattctttcctgaggctgg

SEQ ID NO: 4735954 - DNA, 14 bp, Homo sapiens
gattgaatgctgcc

SEQ ID NO: 4735955 - DNA, 16 bp, Homo sapiens
gattgaattacggaaa

SEQ ID NO: 4735956 - DNA, 18 bp, Homo sapiens
gattgcaacaggctgggc

SEQ ID NO: 4735957 - DNA, 13 bp, Homo sapiens
gattgcgagagat

SEQ ID NO: 4735958 - DNA, 15 bp, Homo sapiens
gattgcgagagatgt

SEQ ID NO: 4735959 - DNA, 16 bp, Homo sapiens
gattgcgagagatgtg

SEQ ID NO: 4735960 - DNA, 17 bp, Homo sapiens
gattgcgagagatgtgt

SEQ ID NO: 4735961 - DNA, 18 bp, Homo sapiens
gattgcgagagatgtgtg

SEQ ID NO: 4735962 - DNA, 12 bp, Homo sapiens
gccttccagggg

SEQ ID NO: 4735963 - DNA, 11 bp, Homo sapiens
gccttccttgc

SEQ ID NO: 4735964 - DNA, 13 bp, Homo sapiens
gccttccttgcta

SEQ ID NO: 4735965 - DNA, 17 bp, Homo sapiens
gccttctcccccccggg

SEQ ID NO: 4735966 - DNA, 15 bp, Homo sapiens
gccttctctgaagga

SEQ ID NO: 4735967 - DNA, 16 bp, Homo sapiens
gccttctctgaaggac

SEQ ID NO: 4735968 - DNA, 21 bp, Homo sapiens
gccttgaccattctccacctg

SEQ ID NO: 4735969 - DNA, 22 bp, Homo sapiens
gccttgaccattctccacctgc

SEQ ID NO: 4735970 - DNA, 22 bp, Homo sapiens
gccttggcaggctgctggaagg

SEQ ID NO: 4735971 - DNA, 19 bp, Homo sapiens
gcctttagtgatcacagca

SEQ ID NO: 4735972 - DNA, 23 bp, Homo sapiens
gcctttatttttggcgtggctga

SEQ ID NO: 4735973 - DNA, 19 bp, Homo sapiens
gcctttcagaagtgattta

SEQ ID NO: 4735974 - DNA, 19 bp, Homo sapiens
gcctttcataccagtcagt

SEQ ID NO: 4735975 - DNA, 23 bp, Homo sapiens
gcctttgagacagtttcttagct

SEQ ID NO: 4735976 - DNA, 13 bp, Homo sapiens
gcctttggcaggt

SEQ ID NO: 4735977 - DNA, 18 bp, Homo sapiens
gccttttataaacctcta

SEQ ID NO: 4735978 - DNA, 16 bp, Homo sapiens
gccttttatttcttaa

SEQ ID NO: 4735979 - DNA, 15 bp, Homo sapiens
gcgacaagagtgaga

SEQ ID NO: 4735980 - DNA, 14 bp, Homo sapiens
gcgaccccatctgc

SEQ ID NO: 4735981 - DNA, 16 bp, Homo sapiens
gcgaccccatctgccc

SEQ ID NO: 4735982 - DNA, 17 bp, Homo sapiens
gcgaccccatctgccca

SEQ ID NO: 4735983 - DNA, 18 bp, Homo sapiens
gcgaccccatctgcccag

SEQ ID NO: 4735984 - DNA, 19 bp, Homo sapiens
gcgaccccatctgcccagg

SEQ ID NO: 4735985 - DNA, 21 bp, Homo sapiens
gcgaccccatctgcccaggac

SEQ ID NO: 4735986 - DNA, 16 bp, Homo sapiens
gcgagaggaggggccc

SEQ ID NO: 4735987 - DNA, 19 bp, Homo sapiens
gcgaggagatgctccttgg

SEQ ID NO: 4735988 - DNA, 17 bp, Homo sapiens
gcgattcttctgcttca

SEQ ID NO: 4735989 - DNA, 22 bp, Homo sapiens
gcgattcttctgcttcagcctc

SEQ ID NO: 4735990 - DNA, 12 bp, Homo sapiens
gcgcaaacttta

SEQ ID NO: 4735991 - DNA, 15 bp, Homo sapiens
gcgcaaagggcatgg

SEQ ID NO: 4735992 - DNA, 20 bp, Homo sapiens
gcgcacaatagtaacctggg

SEQ ID NO: 4735993 - DNA, 13 bp, Homo sapiens
gcgcaccctcccc

SEQ ID NO: 4735994 - DNA, 18 bp, Homo sapiens
gcgcaccctcccctcccg

SEQ ID NO: 4735995 - DNA, 21 bp, Homo sapiens
gcgcaccctcccctcccgtct

SEQ ID NO: 4735996 - DNA, 21 bp, Homo sapiens
gcgcagcatattcaggaagct

SEQ ID NO: 4735997 - DNA, 13 bp, Homo sapiens
gcgccctctgtcc

SEQ ID NO: 4735998 - DNA, 13 bp, Homo sapiens
gcgccttctcccc

SEQ ID NO: 4735999 - DNA, 20 bp, Homo sapiens
gcgctcctgccgcagagctg

SEQ ID NO: 4736000 - DNA, 15 bp, Homo sapiens
gcgctgcctgtgtgg

SEQ ID NO: 4736001 - DNA, 19 bp, Homo sapiens
gcgctgcctgtgtggtgtc

SEQ ID NO: 4736002 - DNA, 15 bp, Homo sapiens
gcggacagccacggc

SEQ ID NO: 4736003 - DNA, 16 bp, Homo sapiens
gcggcattaaagccat

SEQ ID NO: 4736004 - DNA, 19 bp, Homo sapiens
gcggccacctcaccctctc

SEQ ID NO: 4736005 - DNA, 21 bp, Homo sapiens
gcggccacctcaccctctccg

SEQ ID NO: 4736006 - DNA, 22 bp, Homo sapiens
gcggcccaatccaaggtggggt

SEQ ID NO: 4736007 - DNA, 22 bp, Homo sapiens
gcgggaggatgttctgggacac

SEQ ID NO: 4736008 - DNA, 14 bp, Homo sapiens
gcgggcagcacagc

SEQ ID NO: 4736009 - DNA, 16 bp, Homo sapiens
gcgggcagcacagcaa

SEQ ID NO: 4736010 - DNA, 14 bp, Homo sapiens
gcggggacagctcc

SEQ ID NO: 4736011 - DNA, 23 bp, Homo sapiens
gcggggacagctccttctgtcct

SEQ ID NO: 4736012 - DNA, 19 bp, Homo sapiens
gcggggactcggtaagcac

SEQ ID NO: 4736013 - DNA, 18 bp, Homo sapiens
gcggtccacccaggagcc

SEQ ID NO: 4736014 - DNA, 19 bp, Homo sapiens
gcggtccacccaggagccc

SEQ ID NO: 4736015 - DNA, 20 bp, Homo sapiens
gcggtccacccaggagcccc

SEQ ID NO: 4736016 - DNA, 15 bp, Homo sapiens
gcgtcctcctctgtg

SEQ ID NO: 4736017 - DNA, 21 bp, Homo sapiens
gcgtcctctccctcctggcca

SEQ ID NO: 4736018 - DNA, 22 bp, Homo sapiens
gcgtcctctccctcctggccag

SEQ ID NO: 4736019 - DNA, 13 bp, Homo sapiens
gcgtgacaataaa

SEQ ID NO: 4736020 - DNA, 23 bp, Homo sapiens
gcgtgagccactgcaccgggcca

SEQ ID NO: 4736021 - DNA, 18 bp, Homo sapiens
gcgtgcacacaccagagc

SEQ ID NO: 4736022 - DNA, 19 bp, Homo sapiens
gcgtgcacacaccagagcc

SEQ ID NO: 4736023 - DNA, 15 bp, Homo sapiens
gcgtggagctgcctg

SEQ ID NO: 4736024 - DNA, 15 bp, Homo sapiens
gcgtggtagtgcaag

SEQ ID NO: 4736025 - DNA, 13 bp, Homo sapiens
gcgtggtgcgagt

SEQ ID NO: 4736026 - DNA, 20 bp, Homo sapiens
gcgtgtcaactttcatttga

SEQ ID NO: 4736027 - DNA, 17 bp, Homo sapiens
gcgtgtcacctgtgctt

SEQ ID NO: 4736028 - DNA, 21 bp, Homo sapiens
gctaaaagcatggccctgctg

SEQ ID NO: 4736029 - DNA, 22 bp, Homo sapiens
gctaaaagcatggccctgctgc

SEQ ID NO: 4736030 - DNA, 19 bp, Homo sapiens
gctaaagcaatatgcattt

SEQ ID NO: 4736031 - DNA, 20 bp, Homo sapiens
gctaacacacagctcccata

SEQ ID NO: 4736032 - DNA, 17 bp, Homo sapiens
gctaacatttaggagaa

SEQ ID NO: 4736033 - DNA, 22 bp, Homo sapiens
gctaagtgatcctcccacctca

SEQ ID NO: 4736034 - DNA, 23 bp, Homo sapiens
gctaagtgatcctcccacctcag

SEQ ID NO: 4736035 - DNA, 18 bp, Homo sapiens
gctaattgagaccacagg

SEQ ID NO: 4736036 - DNA, 15 bp, Homo sapiens
gctacaaaggaggac

SEQ ID NO: 4736037 - DNA, 22 bp, Homo sapiens
gctacaaaggaggacaagaccc

SEQ ID NO: 4736038 - DNA, 23 bp, Homo sapiens
gctacaaaggaggacaagaccct

SEQ ID NO: 4736039 - DNA, 14 bp, Homo sapiens
gctacacagggatg

SEQ ID NO: 4736040 - DNA, 19 bp, Homo sapiens
gctacacccttttccagct

SEQ ID NO: 4736041 - DNA, 14 bp, Homo sapiens
gctaccaaaacagt

SEQ ID NO: 4736042 - DNA, 21 bp, Homo sapiens
gctacccgggaagggggctgg

SEQ ID NO: 4736043 - DNA, 13 bp, Homo sapiens
gctaccctccctg

SEQ ID NO: 4736044 - DNA, 19 bp, Homo sapiens
gctaccctccctgctgtcc

SEQ ID NO: 4736045 - DNA, 19 bp, Homo sapiens
gctaccctgagctgaggca

SEQ ID NO: 4736046 - DNA, 23 bp, Homo sapiens
gctacttcttattcacttttgta

SEQ ID NO: 4736047 - DNA, 15 bp, Homo sapiens
gctactttccatttg

SEQ ID NO: 4736048 - DNA, 18 bp, Homo sapiens
gctagaaccaagaagggc

SEQ ID NO: 4736049 - DNA, 19 bp, Homo sapiens
gctagaacctagaagggct

SEQ ID NO: 4736050 - DNA, 20 bp, Homo sapiens
gctagaacctagaagggcta

SEQ ID NO: 4736051 - DNA, 18 bp, Homo sapiens
gctagaacctggaagggc

SEQ ID NO: 4736052 - DNA, 20 bp, Homo sapiens
gctagaacctgtagagctag

SEQ ID NO: 4736053 - DNA, 17 bp, Homo sapiens
gctagaatatcctactt

SEQ ID NO: 4736054 - DNA, 21 bp, Homo sapiens
gctagctcccctcctctcccc

SEQ ID NO: 4736055 - DNA, 22 bp, Homo sapiens
gctagctcccctcctctcccct

SEQ ID NO: 4736056 - DNA, 19 bp, Homo sapiens
gctaggaaatccagggtgg

SEQ ID NO: 4736057 - DNA, 19 bp, Homo sapiens
gctaggaacactccttcac

SEQ ID NO: 4736058 - DNA, 23 bp, Homo sapiens
gctaggcctggccagatgcacca

SEQ ID NO: 4736059 - DNA, 14 bp, Homo sapiens
gctagttgggcttc

SEQ ID NO: 4736060 - DNA, 16 bp, Homo sapiens
gctagttgggcttcct

SEQ ID NO: 4736061 - DNA, 20 bp, Homo sapiens
gctatcaaaagaaatagaaa

SEQ ID NO: 4736062 - DNA, 13 bp, Homo sapiens
gctatctccccca

SEQ ID NO: 4736063 - DNA, 14 bp, Homo sapiens
gctatctcccccag

SEQ ID NO: 4736064 - DNA, 15 bp, Homo sapiens
gctatctcccccagc

SEQ ID NO: 4736065 - DNA, 16 bp, Homo sapiens
gctatctcccccagcc

SEQ ID NO: 4736066 - DNA, 18 bp, Homo sapiens
gctatctcccccagcccc

SEQ ID NO: 4736067 - DNA, 20 bp, Homo sapiens
gctatctcccccagccccat

SEQ ID NO: 4736068 - DNA, 20 bp, Homo sapiens
gctattagaagggctgaata

SEQ ID NO: 4736069 - DNA, 19 bp, Homo sapiens
gctattagccaggatcatg

SEQ ID NO: 4736070 - DNA, 13 bp, Homo sapiens
gctatttaaaact

SEQ ID NO: 4736071 - DNA, 22 bp, Homo sapiens
gctattttctaaagacttgtat

SEQ ID NO: 4736072 - DNA, 19 bp, Homo sapiens
gctcaagggaccctgggtg

SEQ ID NO: 4736073 - DNA, 22 bp, Homo sapiens
gctcaagtcctcttttctgaga

SEQ ID NO: 4736074 - DNA, 13 bp, Homo sapiens
gctcacactgaga

SEQ ID NO: 4736075 - DNA, 22 bp, Homo sapiens
gctcacactgagaatgtaagaa

SEQ ID NO: 4736076 - DNA, 15 bp, Homo sapiens
gctcaccagccccag

SEQ ID NO: 4736077 - DNA, 18 bp, Homo sapiens
gctcacccccttctccat

SEQ ID NO: 4736078 - DNA, 20 bp, Homo sapiens
gctcacccccttctccatcc

SEQ ID NO: 4736079 - DNA, 18 bp, Homo sapiens
gctcacctctcccttgga

SEQ ID NO: 4736080 - DNA, 16 bp, Homo sapiens
gctcactatggtgcca

SEQ ID NO: 4736081 - DNA, 12 bp, Homo sapiens
gctcactgcagc

SEQ ID NO: 4736082 - DNA, 13 bp, Homo sapiens
gctcactgcagcc

SEQ ID NO: 4736083 - DNA, 13 bp, Homo sapiens
gctcagagaggac

SEQ ID NO: 4736084 - DNA, 17 bp, Homo sapiens
gctcagagaggacaaaa

SEQ ID NO: 4736085 - DNA, 16 bp, Homo sapiens
gctcagagagggcagg

SEQ ID NO: 4736086 - DNA, 18 bp, Homo sapiens
gctcagagagggtgggag

SEQ ID NO: 4736087 - DNA, 22 bp, Homo sapiens
gctcagagagggtgggagtggg

SEQ ID NO: 4736088 - DNA, 15 bp, Homo sapiens
gctcagccccacccc

SEQ ID NO: 4736089 - DNA, 21 bp, Homo sapiens
gctcagccccaccccagggca

SEQ ID NO: 4736090 - DNA, 16 bp, Homo sapiens
gctcagcggggacagc

SEQ ID NO: 4736091 - DNA, 17 bp, Homo sapiens
gctcagcggggacagct

SEQ ID NO: 4736092 - DNA, 19 bp, Homo sapiens
gctcagcggggacagctcc

SEQ ID NO: 4736093 - DNA, 15 bp, Homo sapiens
gctcaggaccaggca

SEQ ID NO: 4736094 - DNA, 12 bp, Homo sapiens
gctcagggcctg

SEQ ID NO: 4736095 - DNA, 13 bp, Homo sapiens
gctcagggcctgg

SEQ ID NO: 4736096 - DNA, 16 bp, Homo sapiens
gctcaggtgtccctgc

SEQ ID NO: 4736097 - DNA, 16 bp, Homo sapiens
gctcagttcagaatca

SEQ ID NO: 4736098 - DNA, 17 bp, Homo sapiens
gctcagttcagaatcac

SEQ ID NO: 4736099 - DNA, 16 bp, Homo sapiens
gctcatcagaactgaa

SEQ ID NO: 4736100 - DNA, 22 bp, Homo sapiens
gctcatctctgtcccacttggc

SEQ ID NO: 4736101 - DNA, 15 bp, Homo sapiens
gctcatgccctgcca

SEQ ID NO: 4736102 - DNA, 18 bp, Homo sapiens
gctccaaaccctcgaggc

SEQ ID NO: 4736103 - DNA, 15 bp, Homo sapiens
gctccaagctcccag

SEQ ID NO: 4736104 - DNA, 18 bp, Homo sapiens
gctccaagctcccaggca

SEQ ID NO: 4736105 - DNA, 19 bp, Homo sapiens
gctccaagctcccaggcat

SEQ ID NO: 4736106 - DNA, 9 bp, Homo sapiens
gctccagac

SEQ ID NO: 4736107 - DNA, 20 bp, Homo sapiens
gctccagagggcactctgct

SEQ ID NO: 4736108 - DNA, 21 bp, Homo sapiens
gctccagagggcactctgctt

SEQ ID NO: 4736109 - DNA, 13 bp, Homo sapiens
gctccagctcacc

SEQ ID NO: 4736110 - DNA, 18 bp, Homo sapiens
gctccagctcaccagccc

SEQ ID NO: 4736111 - DNA, 20 bp, Homo sapiens
gctccagctcaccagcccca

SEQ ID NO: 4736112 - DNA, 23 bp, Homo sapiens
gctccaggctcctttagcgccca

SEQ ID NO: 4736113 - DNA, 24 bp, Homo sapiens
gctccaggctcctttagcgcccag

SEQ ID NO: 4736114 - DNA, 12 bp, Homo sapiens
gctcccaaggga

SEQ ID NO: 4736115 - DNA, 23 bp, Homo sapiens
gctcccaagggatggtgccctgt

SEQ ID NO: 4736116 - DNA, 17 bp, Homo sapiens
gctcccaggcattcccc

SEQ ID NO: 4736117 - DNA, 19 bp, Homo sapiens
gctcccagtgtcttcctgt

SEQ ID NO: 4736118 - DNA, 23 bp, Homo sapiens
gctcccagtgtcttcctgtgggg

SEQ ID NO: 4736119 - DNA, 17 bp, Homo sapiens
gctcccccgggaggggc

SEQ ID NO: 4736120 - DNA, 21 bp, Homo sapiens
gctcccctccccaactgacca

SEQ ID NO: 4736121 - DNA, 16 bp, Homo sapiens
gctccctgactgggag

SEQ ID NO: 4736122 - DNA, 19 bp, Homo sapiens
gctccctgggggcggccag

SEQ ID NO: 4736123 - DNA, 16 bp, Homo sapiens
gctcccttcccacctc

SEQ ID NO: 4736124 - DNA, 18 bp, Homo sapiens
gctcccttcccacctctc

SEQ ID NO: 4736125 - DNA, 22 bp, Homo sapiens
gctccgctttctacccagcgag

SEQ ID NO: 4736126 - DNA, 21 bp, Homo sapiens
gctcctcaccacgtggggcca

SEQ ID NO: 4736127 - DNA, 21 bp, Homo sapiens
gctcctcatccagggctctga

SEQ ID NO: 4736128 - DNA, 15 bp, Homo sapiens
gctcctctccccagc

SEQ ID NO: 4736129 - DNA, 18 bp, Homo sapiens
gctcctgccgcagagctg

SEQ ID NO: 4736130 - DNA, 15 bp, Homo sapiens
gctcctgctgcacca

SEQ ID NO: 4736131 - DNA, 18 bp, Homo sapiens
gctcctgctgcaccaacc

SEQ ID NO: 4736132 - DNA, 22 bp, Homo sapiens
gctcctgctgcaccaacccagc

SEQ ID NO: 4736133 - DNA, 12 bp, Homo sapiens
gctcctgtgtct

SEQ ID NO: 4736134 - DNA, 14 bp, Homo sapiens
gctccttcctggag

SEQ ID NO: 4736135 - DNA, 21 bp, Homo sapiens
gctccttctgtcctactctgt

SEQ ID NO: 4736136 - DNA, 11 bp, Homo sapiens
gctccttgggc

SEQ ID NO: 4736137 - DNA, 17 bp, Homo sapiens
gctcctttagcgcccag

SEQ ID NO: 4736138 - DNA, 21 bp, Homo sapiens
gctcgagcatgcctggatggg

SEQ ID NO: 4736139 - DNA, 15 bp, Homo sapiens
gctcgggcccaggcc

SEQ ID NO: 4736140 - DNA, 23 bp, Homo sapiens
gctctaagaagctgcaataaagt

SEQ ID NO: 4736141 - DNA, 20 bp, Homo sapiens
gctctacacaacatgtatgt

SEQ ID NO: 4736142 - DNA, 21 bp, Homo sapiens
gctctatgggcagatctaccc

SEQ ID NO: 4736143 - DNA, 22 bp, Homo sapiens
gctctccaaaccactttttgca

SEQ ID NO: 4736144 - DNA, 20 bp, Homo sapiens
gctctgacccacagcctcca

SEQ ID NO: 4736145 - DNA, 22 bp, Homo sapiens
gctctgacccacagcctccaag

SEQ ID NO: 4736146 - DNA, 17 bp, Homo sapiens
gctctgcacccagcccc

SEQ ID NO: 4736147 - DNA, 20 bp, Homo sapiens
gctctgcacccagccccaag

SEQ ID NO: 4736148 - DNA, 22 bp, Homo sapiens
gctctgcacccagccccaaggg

SEQ ID NO: 4736149 - DNA, 23 bp, Homo sapiens
gctctgcccttggttaggcattg

SEQ ID NO: 4736150 - DNA, 11 bp, Homo sapiens
gctctgcctcc

SEQ ID NO: 4736151 - DNA, 17 bp, Homo sapiens
gctctgcgtgtcacctg

SEQ ID NO: 4736152 - DNA, 14 bp, Homo sapiens
gctctgctgacaga

SEQ ID NO: 4736153 - DNA, 23 bp, Homo sapiens
gctctgctgacagacacaggccc

SEQ ID NO: 4736154 - DNA, 16 bp, Homo sapiens
gctctggacaggcatg

SEQ ID NO: 4736155 - DNA, 21 bp, Homo sapiens
gctctggacaggcatgttctc

SEQ ID NO: 4736156 - DNA, 23 bp, Homo sapiens
gctctggtccatagagagcaaga

SEQ ID NO: 4736157 - DNA, 23 bp, Homo sapiens
gctctgtatcaggacccagagga

SEQ ID NO: 4736158 - DNA, 12 bp, Homo sapiens
gctctgtgggct

SEQ ID NO: 4736159 - DNA, 14 bp, Homo sapiens
gctctgtgggctgc

SEQ ID NO: 4736160 - DNA, 24 bp, Homo sapiens
gctctgtgggctgcactctgtgcc

SEQ ID NO: 4736161 - DNA, 16 bp, Homo sapiens
gctcttccaggctggg

SEQ ID NO: 4736162 - DNA, 14 bp, Homo sapiens
gctcttctcatttc

SEQ ID NO: 4736163 - DNA, 15 bp, Homo sapiens
gctcttctcatttca

SEQ ID NO: 4736164 - DNA, 16 bp, Homo sapiens
gctcttctcatttcac

SEQ ID NO: 4736165 - DNA, 16 bp, Homo sapiens
gctcttctccaggctg

SEQ ID NO: 4736166 - DNA, 14 bp, Homo sapiens
gctcttgaactcct

SEQ ID NO: 4736167 - DNA, 16 bp, Homo sapiens
gctcttgaactcctga

SEQ ID NO: 4736168 - DNA, 23 bp, Homo sapiens
gctgaaggactgtgacaggcagc

SEQ ID NO: 4736169 - DNA, 23 bp, Homo sapiens
gctgaaggctcgagcatgcctgg

SEQ ID NO: 4736170 - DNA, 18 bp, Homo sapiens
gctgacacaaacctgcct

SEQ ID NO: 4736171 - DNA, 20 bp, Homo sapiens
gctgacacaaacctgcctgg

SEQ ID NO: 4736172 - DNA, 16 bp, Homo sapiens
gctgacagacacaggc

SEQ ID NO: 4736173 - DNA, 17 bp, Homo sapiens
gctgacagacagccctc

SEQ ID NO: 4736174 - DNA, 16 bp, Homo sapiens
gctgacagtcctctcc

SEQ ID NO: 4736175 - DNA, 19 bp, Homo sapiens
gctgacagtcctctccacc

SEQ ID NO: 4736176 - DNA, 14 bp, Homo sapiens
gctgaccccctccc

SEQ ID NO: 4736177 - DNA, 15 bp, Homo sapiens
gctgagagctgggct

SEQ ID NO: 4736178 - DNA, 21 bp, Homo sapiens
gctgagcaggaggggggctgg

SEQ ID NO: 4736179 - DNA, 14 bp, Homo sapiens
gctgaggcaattct

SEQ ID NO: 4736180 - DNA, 13 bp, Homo sapiens
gctgaggcagcag

SEQ ID NO: 4736181 - DNA, 23 bp, Homo sapiens
gctgaggcagcagtgtgaggcca

SEQ ID NO: 4736182 - DNA, 20 bp, Homo sapiens
gccagattctttcctgaggc

SEQ ID NO: 4736183 - DNA, 24 bp, Homo sapiens
gccagattctttcctgaggctggg

SEQ ID NO: 4736184 - DNA, 18 bp, Homo sapiens
gccagcaccggaccagcc

SEQ ID NO: 4736185 - DNA, 14 bp, Homo sapiens
gccagccccacagc

SEQ ID NO: 4736186 - DNA, 15 bp, Homo sapiens
gccagccccacagcc

SEQ ID NO: 4736187 - DNA, 24 bp, Homo sapiens
gccagcccctgctggctggtgcct

SEQ ID NO: 4736188 - DNA, 18 bp, Homo sapiens
gccagccctcccagcagt

SEQ ID NO: 4736189 - DNA, 19 bp, Homo sapiens
gccagcctgctccttccca

SEQ ID NO: 4736190 - DNA, 21 bp, Homo sapiens
gccagccttgaccattctcca

SEQ ID NO: 4736191 - DNA, 22 bp, Homo sapiens
gccagccttgaccattctccac

SEQ ID NO: 4736192 - DNA, 19 bp, Homo sapiens
gccagcgtcctcctctgtg

SEQ ID NO: 4736193 - DNA, 13 bp, Homo sapiens
gccagctctgtat

SEQ ID NO: 4736194 - DNA, 19 bp, Homo sapiens
gccaggatcatggtgtaat

SEQ ID NO: 4736195 - DNA, 24 bp, Homo sapiens
gccaggatcatggtgtaataagac

SEQ ID NO: 4736196 - DNA, 18 bp, Homo sapiens
gccaggccacaagaccct

SEQ ID NO: 4736197 - DNA, 21 bp, Homo sapiens
gccaggccacaagacccttgt

SEQ ID NO: 4736198 - DNA, 13 bp, Homo sapiens
gccaggccagagg

SEQ ID NO: 4736199 - DNA, 22 bp, Homo sapiens
gccaggccagagggagtgacag

SEQ ID NO: 4736200 - DNA, 17 bp, Homo sapiens
gccaggccctctgccca

SEQ ID NO: 4736201 - DNA, 19 bp, Homo sapiens
gccaggccctctgcccact

SEQ ID NO: 4736202 - DNA, 13 bp, Homo sapiens
gccagggacagag

SEQ ID NO: 4736203 - DNA, 18 bp, Homo sapiens
gccagggacagagggggt

SEQ ID NO: 4736204 - DNA, 16 bp, Homo sapiens
gccagggagagcccag

SEQ ID NO: 4736205 - DNA, 20 bp, Homo sapiens
gccagggagagcccaggagc

SEQ ID NO: 4736206 - DNA, 16 bp, Homo sapiens
gccagggcagagtgag

SEQ ID NO: 4736207 - DNA, 19 bp, Homo sapiens
gccagggcagggccccagg

SEQ ID NO: 4736208 - DNA, 22 bp, Homo sapiens
gccagggcctggaagacagaga

SEQ ID NO: 4736209 - DNA, 17 bp, Homo sapiens
gccaggtgctgtgacac

SEQ ID NO: 4736210 - DNA, 18 bp, Homo sapiens
gccaggtgggcgggcagc

SEQ ID NO: 4736211 - DNA, 17 bp, Homo sapiens
gccaggtttttggtctg

SEQ ID NO: 4736212 - DNA, 18 bp, Homo sapiens
gccagtcaccccggccac

SEQ ID NO: 4736213 - DNA, 16 bp, Homo sapiens
gccagtcgcgctgcct

SEQ ID NO: 4736214 - DNA, 17 bp, Homo sapiens
gccagtcgcgctgcctg

SEQ ID NO: 4736215 - DNA, 13 bp, Homo sapiens
gccagtgtgacaa

SEQ ID NO: 4736216 - DNA, 18 bp, Homo sapiens
gccatactggcctcgcct

SEQ ID NO: 4736217 - DNA, 23 bp, Homo sapiens
gccatactggcctcgcctggcct

SEQ ID NO: 4736218 - DNA, 16 bp, Homo sapiens
gccatacttgttctgt

SEQ ID NO: 4736219 - DNA, 18 bp, Homo sapiens
gccatagctcctgctcca

SEQ ID NO: 4736220 - DNA, 23 bp, Homo sapiens
gccatagctcctgctccacagcc

SEQ ID NO: 4736221 - DNA, 16 bp, Homo sapiens
gccatatgaaaaggct

SEQ ID NO: 4736222 - DNA, 19 bp, Homo sapiens
gccatattctgttggccag

SEQ ID NO: 4736223 - DNA, 17 bp, Homo sapiens
gccatattttcaccatt

SEQ ID NO: 4736224 - DNA, 19 bp, Homo sapiens
gccatccaggttcagcttg

SEQ ID NO: 4736225 - DNA, 17 bp, Homo sapiens
gccatcccagccttggc

SEQ ID NO: 4736226 - DNA, 23 bp, Homo sapiens
gccatcctcaaacactgcaggca

SEQ ID NO: 4736227 - DNA, 12 bp, Homo sapiens
gccatctctgga

SEQ ID NO: 4736228 - DNA, 17 bp, Homo sapiens
gccatcttccaggtggg

SEQ ID NO: 4736229 - DNA, 16 bp, Homo sapiens
gccatggagagctgga

SEQ ID NO: 4736230 - DNA, 22 bp, Homo sapiens
gccatggagagctggagcctgg

SEQ ID NO: 4736231 - DNA, 21 bp, Homo sapiens
gccatggagtgagacccagga

SEQ ID NO: 4736232 - DNA, 24 bp, Homo sapiens
gccatggcttccaaggtggtctgc

SEQ ID NO: 4736233 - DNA, 21 bp, Homo sapiens
gccatgggaccaaacctagcc

SEQ ID NO: 4736234 - DNA, 15 bp, Homo sapiens
gccatgggcctcctg

SEQ ID NO: 4736235 - DNA, 15 bp, Homo sapiens
gccatgtagaagctg

SEQ ID NO: 4736236 - DNA, 13 bp, Homo sapiens
gcccacaggatca

SEQ ID NO: 4736237 - DNA, 16 bp, Homo sapiens
gcccaccccacccact

SEQ ID NO: 4736238 - DNA, 22 bp, Homo sapiens
gcccaccccacccacttctgca

SEQ ID NO: 4736239 - DNA, 21 bp, Homo sapiens
gcccacctggcctctgcactc

SEQ ID NO: 4736240 - DNA, 16 bp, Homo sapiens
gcccaccttggctcaa

SEQ ID NO: 4736241 - DNA, 17 bp, Homo sapiens
gcccaccttggctcaag

SEQ ID NO: 4736242 - DNA, 13 bp, Homo sapiens
gcccacgccccca

SEQ ID NO: 4736243 - DNA, 14 bp, Homo sapiens
gcccacgcccccac

SEQ ID NO: 4736244 - DNA, 17 bp, Homo sapiens
gcccactcattccttct

SEQ ID NO: 4736245 - DNA, 15 bp, Homo sapiens
gcccagagagggtgg

SEQ ID NO: 4736246 - DNA, 21 bp, Homo sapiens
gcccagagagggtggtgacct

SEQ ID NO: 4736247 - DNA, 12 bp, Homo sapiens
gcccagagggcc

SEQ ID NO: 4736248 - DNA, 20 bp, Homo sapiens
gcccagaggtaacagaacag

SEQ ID NO: 4736249 - DNA, 14 bp, Homo sapiens
gcccagccccttct

SEQ ID NO: 4736250 - DNA, 23 bp, Homo sapiens
gcccaggaaaggctccaggagca

SEQ ID NO: 4736251 - DNA, 24 bp, Homo sapiens
gcccaggaaaggctccaggagcag

SEQ ID NO: 4736252 - DNA, 20 bp, Homo sapiens
gcccaggacggggccggcca

SEQ ID NO: 4736253 - DNA, 21 bp, Homo sapiens
gcccaggacggggccggccag

SEQ ID NO: 4736254 - DNA, 15 bp, Homo sapiens
gcccaggagctcccc

SEQ ID NO: 4736255 - DNA, 24 bp, Homo sapiens
gcccaggagctcccctccccaact

SEQ ID NO: 4736256 - DNA, 12 bp, Homo sapiens
gcccaggcaggt

SEQ ID NO: 4736257 - DNA, 15 bp, Homo sapiens
gcccaggccaggact

SEQ ID NO: 4736258 - DNA, 22 bp, Homo sapiens
gcccaggccaggactctgcagc

SEQ ID NO: 4736259 - DNA, 24 bp, Homo sapiens
gcccaggccaggactctgcagcct

SEQ ID NO: 4736260 - DNA, 18 bp, Homo sapiens
gcccaggcccctgccacc

SEQ ID NO: 4736261 - DNA, 20 bp, Homo sapiens
gcccaggctggagtgcaatg

SEQ ID NO: 4736262 - DNA, 19 bp, Homo sapiens
gcccaggctggagtgcagt

SEQ ID NO: 4736263 - DNA, 12 bp, Homo sapiens
gcccaggctggc

SEQ ID NO: 4736264 - DNA, 18 bp, Homo sapiens
gcccaggctggccagccc

SEQ ID NO: 4736265 - DNA, 19 bp, Homo sapiens
gcccaggctggccagcccc

SEQ ID NO: 4736266 - DNA, 20 bp, Homo sapiens
gcccaggctggccagcccca

SEQ ID NO: 4736267 - DNA, 14 bp, Homo sapiens
gcccaggctggcgt

SEQ ID NO: 4736268 - DNA, 15 bp, Homo sapiens
gcccaggctggcgtg

SEQ ID NO: 4736269 - DNA, 22 bp, Homo sapiens
gcccaggctggcgtgcagtggt

SEQ ID NO: 4736270 - DNA, 20 bp, Homo sapiens
gcccagtctggaatgcagtg

SEQ ID NO: 4736271 - DNA, 15 bp, Homo sapiens
gcccagttgggtgga

SEQ ID NO: 4736272 - DNA, 19 bp, Homo sapiens
gcccagttgggtggatgcc

SEQ ID NO: 4736273 - DNA, 18 bp, Homo sapiens
gcccatcagtgccagccc

SEQ ID NO: 4736274 - DNA, 14 bp, Homo sapiens
gcccatcccccctc

SEQ ID NO: 4736275 - DNA, 17 bp, Homo sapiens
gcccatcccccctcacc

SEQ ID NO: 4736276 - DNA, 18 bp, Homo sapiens
gcccatggaggagacagg

SEQ ID NO: 4736277 - DNA, 20 bp, Homo sapiens
gcccatgggcactgctgggt

SEQ ID NO: 4736278 - DNA, 18 bp, Homo sapiens
gccccaaaactctcctct

SEQ ID NO: 4736279 - DNA, 20 bp, Homo sapiens
gccccaaaactctcctctgc

SEQ ID NO: 4736280 - DNA, 14 bp, Homo sapiens
gccccaaggggtgg

SEQ ID NO: 4736281 - DNA, 16 bp, Homo sapiens
gccccaaggggtggcc

SEQ ID NO: 4736282 - DNA, 14 bp, Homo sapiens
gccccacagcccac

SEQ ID NO: 4736283 - DNA, 23 bp, Homo sapiens
gccccacagcccacgtcctgtca

SEQ ID NO: 4736284 - DNA, 15 bp, Homo sapiens
gccccaccccagggc

SEQ ID NO: 4736285 - DNA, 19 bp, Homo sapiens
gccccaccccagggcagcc

SEQ ID NO: 4736286 - DNA, 20 bp, Homo sapiens
gccccaccccagggcagcca

SEQ ID NO: 4736287 - DNA, 15 bp, Homo sapiens
gccccagcctggccc

SEQ ID NO: 4736288 - DNA, 13 bp, Homo sapiens
gccccagtgccca

SEQ ID NO: 4736289 - DNA, 18 bp, Homo sapiens
gccccattctgcctgccc

SEQ ID NO: 4736290 - DNA, 21 bp, Homo sapiens
gccccattctgcctgcccagg

SEQ ID NO: 4736291 - DNA, 12 bp, Homo sapiens
gcccccactggt

SEQ ID NO: 4736292 - DNA, 12 bp, Homo sapiens
gcccccaggact

SEQ ID NO: 4736293 - DNA, 15 bp, Homo sapiens
gcccccaggactggg

SEQ ID NO: 4736294 - DNA, 18 bp, Homo sapiens
gcccccaggactgggcca

SEQ ID NO: 4736295 - DNA, 15 bp, Homo sapiens
gccccccatcctggc

SEQ ID NO: 4736296 - DNA, 16 bp, Homo sapiens
gccccccatcctggcc

SEQ ID NO: 4736297 - DNA, 18 bp, Homo sapiens
gccccccatcctggccca

SEQ ID NO: 4736298 - DNA, 19 bp, Homo sapiens
gcccccctggcctccccca

SEQ ID NO: 4736299 - DNA, 12 bp, Homo sapiens
gccccctcgtgc

SEQ ID NO: 4736300 - DNA, 16 bp, Homo sapiens
gccccctcgtgccagt

SEQ ID NO: 4736301 - DNA, 15 bp, Homo sapiens
gccccctctgccctg

SEQ ID NO: 4736302 - DNA, 17 bp, Homo sapiens
gccccctctgccctgcg

SEQ ID NO: 4736303 - DNA, 18 bp, Homo sapiens
gccccctgcaggaaggag

SEQ ID NO: 4736304 - DNA, 20 bp, Homo sapiens
gccccctgcaggaaggagct

SEQ ID NO: 4736305 - DNA, 14 bp, Homo sapiens
gccccgcaggcctg

SEQ ID NO: 4736306 - DNA, 15 bp, Homo sapiens
gccccgcaggcctgc

SEQ ID NO: 4736307 - DNA, 21 bp, Homo sapiens
gccccgccacgcttgtgtctt

SEQ ID NO: 4736308 - DNA, 14 bp, Homo sapiens
gccccgcccaggct

SEQ ID NO: 4736309 - DNA, 19 bp, Homo sapiens
gcccctcagggtccctggt

SEQ ID NO: 4736310 - DNA, 12 bp, Homo sapiens
gcccctctcctc

SEQ ID NO: 4736311 - DNA, 15 bp, Homo sapiens
gcccctgccaccctg

SEQ ID NO: 4736312 - DNA, 15 bp, Homo sapiens
gcccctgctctggtg

SEQ ID NO: 4736313 - DNA, 22 bp, Homo sapiens
gcccctgctggttcagggttgg

SEQ ID NO: 4736314 - DNA, 16 bp, Homo sapiens
gcccctggatgcagcc

SEQ ID NO: 4736315 - DNA, 17 bp, Homo sapiens
gccccttagcccccacc

SEQ ID NO: 4736316 - DNA, 20 bp, Homo sapiens
gccccttctgacccatgctg

SEQ ID NO: 4736317 - DNA, 21 bp, Homo sapiens
gcccgaatacaaacacctgga

SEQ ID NO: 4736318 - DNA, 19 bp, Homo sapiens
gcccgcttgcctcggctcc

SEQ ID NO: 4736319 - DNA, 21 bp, Homo sapiens
gcccgcttgcctcggctcctg

SEQ ID NO: 4736320 - DNA, 23 bp, Homo sapiens
gcccgcttgcctcggctcctgct

SEQ ID NO: 4736321 - DNA, 19 bp, Homo sapiens
gcccggacgcccaggaccc

SEQ ID NO: 4736322 - DNA, 15 bp, Homo sapiens
gcccggcgccctctg

SEQ ID NO: 4736323 - DNA, 14 bp, Homo sapiens
gcccggctccaggc

SEQ ID NO: 4736324 - DNA, 12 bp, Homo sapiens
gcccgggctctg

SEQ ID NO: 4736325 - DNA, 15 bp, Homo sapiens
gccctactctgtgta

SEQ ID NO: 4736326 - DNA, 21 bp, Homo sapiens
gccctactctgtgtaatagaa

SEQ ID NO: 4736327 - DNA, 17 bp, Homo sapiens
gccctcaaggcctccca

SEQ ID NO: 4736328 - DNA, 19 bp, Homo sapiens
gccctccaagaccttctcc

SEQ ID NO: 4736329 - DNA, 22 bp, Homo sapiens
gccctccaagaccttctccttc

SEQ ID NO: 4736330 - DNA, 16 bp, Homo sapiens
gccctccacacctgcg

SEQ ID NO: 4736331 - DNA, 19 bp, Homo sapiens
gccctccacacctgcggcc

SEQ ID NO: 4736332 - DNA, 21 bp, Homo sapiens
gccctccatctaaactgcccc

SEQ ID NO: 4736333 - DNA, 14 bp, Homo sapiens
gccctcgctgccag

SEQ ID NO: 4736334 - DNA, 15 bp, Homo sapiens
gccctctcccctgcc

SEQ ID NO: 4736335 - DNA, 16 bp, Homo sapiens
gccctctctgctctgc

SEQ ID NO: 4736336 - DNA, 13 bp, Homo sapiens
gccctctgtcctg

SEQ ID NO: 4736337 - DNA, 21 bp, Homo sapiens
gccctgcaaaaggactctcag

SEQ ID NO: 4736338 - DNA, 22 bp, Homo sapiens
gccctgcactgtcctgctccac

SEQ ID NO: 4736339 - DNA, 18 bp, Homo sapiens
gccctgccaagcagcaga

SEQ ID NO: 4736340 - DNA, 14 bp, Homo sapiens
gccctgcccacctg

SEQ ID NO: 4736341 - DNA, 15 bp, Homo sapiens
gccctgcccacctgg

SEQ ID NO: 4736342 - DNA, 17 bp, Homo sapiens
gccctgcccacctggcc

SEQ ID NO: 4736343 - DNA, 22 bp, Homo sapiens
gccctgcccacctggcctctgc

SEQ ID NO: 4736344 - DNA, 11 bp, Homo sapiens
gccctgccctg

SEQ ID NO: 4736345 - DNA, 12 bp, Homo sapiens
gccctgccctgg

SEQ ID NO: 4736346 - DNA, 18 bp, Homo sapiens
gccctgccctggtttcct

SEQ ID NO: 4736347 - DNA, 23 bp, Homo sapiens
gccctgccgggaccctgctcaca

SEQ ID NO: 4736348 - DNA, 11 bp, Homo sapiens
gccctgcctcc

SEQ ID NO: 4736349 - DNA, 16 bp, Homo sapiens
gccctgcctcctttgt

SEQ ID NO: 4736350 - DNA, 15 bp, Homo sapiens
gccctgcctgctgca

SEQ ID NO: 4736351 - DNA, 16 bp, Homo sapiens
gccctgctgagtccca

SEQ ID NO: 4736352 - DNA, 23 bp, Homo sapiens
gccctgctgagtcccaggctgag

SEQ ID NO: 4736353 - DNA, 15 bp, Homo sapiens
gccctggccccagcc

SEQ ID NO: 4736354 - DNA, 20 bp, Homo sapiens
gccctggctgaaggactgtg

SEQ ID NO: 4736355 - DNA, 14 bp, Homo sapiens
gccctgggaggcag

SEQ ID NO: 4736356 - DNA, 17 bp, Homo sapiens
gccctggtggcagtggg

SEQ ID NO: 4736357 - DNA, 20 bp, Homo sapiens
gccctggtggcagtgggagc

SEQ ID NO: 4736358 - DNA, 23 bp, Homo sapiens
gccctggtggcagtgggagctgc

SEQ ID NO: 4736359 - DNA, 15 bp, Homo sapiens
gccctggtttcctgc

SEQ ID NO: 4736360 - DNA, 21 bp, Homo sapiens
gccctggtttcctgccctggg

SEQ ID NO: 4736361 - DNA, 22 bp, Homo sapiens
gccctgttctctaccaagctat

SEQ ID NO: 4736362 - DNA, 20 bp, Homo sapiens
gcccttacacttactgttgt

SEQ ID NO: 4736363 - DNA, 13 bp, Homo sapiens
gcccttctctcca

SEQ ID NO: 4736364 - DNA, 14 bp, Homo sapiens
gcccttctctccag

SEQ ID NO: 4736365 - DNA, 22 bp, Homo sapiens
gcccttctctccagcccctgga

SEQ ID NO: 4736366 - DNA, 23 bp, Homo sapiens
gcccttctctccagcccctggat

SEQ ID NO: 4736367 - DNA, 15 bp, Homo sapiens
gcccttctcttatct

SEQ ID NO: 4736368 - DNA, 18 bp, Homo sapiens
gccctttgagtgcagtcc

SEQ ID NO: 4736369 - DNA, 18 bp, Homo sapiens
gccgagatcacgccactg

SEQ ID NO: 4736370 - DNA, 20 bp, Homo sapiens
gccgagatcacgccactgca

SEQ ID NO: 4736371 - DNA, 21 bp, Homo sapiens
gccgatgtgggtccctctctt

SEQ ID NO: 4736372 - DNA, 14 bp, Homo sapiens
gccgccccacccag

SEQ ID NO: 4736373 - DNA, 24 bp, Homo sapiens
gccgccgcctcgcccaccgcatgc

SEQ ID NO: 4736374 - DNA, 13 bp, Homo sapiens
gccgcctcgccca

SEQ ID NO: 4736375 - DNA, 17 bp, Homo sapiens
gccgcctcgcccaccgc

SEQ ID NO: 4736376 - DNA, 15 bp, Homo sapiens
gccgctgagcgagga

SEQ ID NO: 4736377 - DNA, 19 bp, Homo sapiens
gccgctgcccggcgccctc

SEQ ID NO: 4736378 - DNA, 16 bp, Homo sapiens
gccggacacttctcag

SEQ ID NO: 4736379 - DNA, 18 bp, Homo sapiens
gccggacacttctcagga

SEQ ID NO: 4736380 - DNA, 13 bp, Homo sapiens
gccggcactgcat

SEQ ID NO: 4736381 - DNA, 18 bp, Homo sapiens
gccggccaggtgggcggg

SEQ ID NO: 4736382 - DNA, 13 bp, Homo sapiens
gccgggaggagcc

SEQ ID NO: 4736383 - DNA, 12 bp, Homo sapiens
gccggggtggat

SEQ ID NO: 4736384 - DNA, 20 bp, Homo sapiens
gccgtctacctgaggggcct

SEQ ID NO: 4736385 - DNA, 15 bp, Homo sapiens
gccgtgggcctgggg

SEQ ID NO: 4736386 - DNA, 17 bp, Homo sapiens
gccgttgatgttggctg

SEQ ID NO: 4736387 - DNA, 20 bp, Homo sapiens
gccgttgatgttggctggga

SEQ ID NO: 4736388 - DNA, 13 bp, Homo sapiens
gcctaaggaagct

SEQ ID NO: 4736389 - DNA, 17 bp, Homo sapiens
gcctacaggagtgagca

SEQ ID NO: 4736390 - DNA, 14 bp, Homo sapiens
gcctaccatttcac

SEQ ID NO: 4736391 - DNA, 21 bp, Homo sapiens
gcctaccttgtgagggagaga

SEQ ID NO: 4736392 - DNA, 13 bp, Homo sapiens
gcctaggtgacag

SEQ ID NO: 4736393 - DNA, 20 bp, Homo sapiens
gcctaggtgacagagtgaga

SEQ ID NO: 4736394 - DNA, 22 bp, Homo sapiens
gcctagtgaaggcttctctctg

SEQ ID NO: 4736395 - DNA, 23 bp, Homo sapiens
gcctagtgaaggcttctctctgt

SEQ ID NO: 4736396 - DNA, 14 bp, Homo sapiens
gcctataacttttt

SEQ ID NO: 4736397 - DNA, 15 bp, Homo sapiens
gcctataactttttt

SEQ ID NO: 4736398 - DNA, 14 bp, Homo sapiens
gcctatcagtgtgc

SEQ ID NO: 4736399 - DNA, 16 bp, Homo sapiens
gcctatcagtgtgccc

SEQ ID NO: 4736400 - DNA, 19 bp, Homo sapiens
gcctatcagtgtgcccccc

SEQ ID NO: 4736401 - DNA, 15 bp, Homo sapiens
gcctattgatacttg

SEQ ID NO: 4736402 - DNA, 17 bp, Homo sapiens
gcctcaacctcctgggc

SEQ ID NO: 4736403 - DNA, 20 bp, Homo sapiens
gcctcaagtgattctcctgc

SEQ ID NO: 4736404 - DNA, 23 bp, Homo sapiens
gcctcacacggtttgaagcctgg

SEQ ID NO: 4736405 - DNA, 21 bp, Homo sapiens
gcctcacagtccttaccagca

SEQ ID NO: 4736406 - DNA, 16 bp, Homo sapiens
gcctcagcatcctggc

SEQ ID NO: 4736407 - DNA, 17 bp, Homo sapiens
gcctcagcatcctggca

SEQ ID NO: 4736408 - DNA, 21 bp, Homo sapiens
gcctcagcatcctggcacccg

SEQ ID NO: 4736409 - DNA, 14 bp, Homo sapiens
gcctcagcctcccg

SEQ ID NO: 4736410 - DNA, 20 bp, Homo sapiens
gcctcagtaagacgacaagg

SEQ ID NO: 4736411 - DNA, 19 bp, Homo sapiens
gcctcatgctaagactcag

SEQ ID NO: 4736412 - DNA, 15 bp, Homo sapiens
gcctccacccacagt

SEQ ID NO: 4736413 - DNA, 21 bp, Homo sapiens
gcctccacccacagtggagag

SEQ ID NO: 4736414 - DNA, 13 bp, Homo sapiens
gcctccagggctg

SEQ ID NO: 4736415 - DNA, 17 bp, Homo sapiens
gcctccagggctggact

SEQ ID NO: 4736416 - DNA, 20 bp, Homo sapiens
gcctccagggctggactgag

SEQ ID NO: 4736417 - DNA, 21 bp, Homo sapiens
gcctccagggctggactgagg

SEQ ID NO: 4736418 - DNA, 23 bp, Homo sapiens
gcctccagggctggactgaggcc

SEQ ID NO: 4736419 - DNA, 17 bp, Homo sapiens
gcctcccaaagtgctgg

SEQ ID NO: 4736420 - DNA, 17 bp, Homo sapiens
gcctcccaactcacccc

SEQ ID NO: 4736421 - DNA, 18 bp, Homo sapiens
gcctcccaactcacccca

SEQ ID NO: 4736422 - DNA, 14 bp, Homo sapiens
gcctcccacagtga

SEQ ID NO: 4736423 - DNA, 11 bp, Homo sapiens
gcctcccccac

SEQ ID NO: 4736424 - DNA, 13 bp, Homo sapiens
gcctcccccactt

SEQ ID NO: 4736425 - DNA, 14 bp, Homo sapiens
gcctcccctgccag

SEQ ID NO: 4736426 - DNA, 18 bp, Homo sapiens
gcctcccctgccagggca

SEQ ID NO: 4736427 - DNA, 19 bp, Homo sapiens
gcctcccgaatagctggga

SEQ ID NO: 4736428 - DNA, 21 bp, Homo sapiens
gcctcccgaatagctgggact

SEQ ID NO: 4736429 - DNA, 17 bp, Homo sapiens
gcctcccgagtagctgg

SEQ ID NO: 4736430 - DNA, 19 bp, Homo sapiens
gcctcccgagtagctggga

SEQ ID NO: 4736431 - DNA, 20 bp, Homo sapiens
gcctcccttcatgcatggaa

SEQ ID NO: 4736432 - DNA, 19 bp, Homo sapiens
gcctcctgtgtgtgcgcct

SEQ ID NO: 4736433 - DNA, 23 bp, Homo sapiens
gcctcctgtgtgtgcgcctacag

SEQ ID NO: 4736434 - DNA, 21 bp, Homo sapiens
gcctcctttgtgaggaagccg

SEQ ID NO: 4736435 - DNA, 20 bp, Homo sapiens
gcctcgaactggctgcaaag

SEQ ID NO: 4736436 - DNA, 18 bp, Homo sapiens
gcctcgatgtcctcctct

SEQ ID NO: 4736437 - DNA, 22 bp, Homo sapiens
gcctcgatgtcctcctctgtga

SEQ ID NO: 4736438 - DNA, 16 bp, Homo sapiens
gcctcgcccaccgcat

SEQ ID NO: 4736439 - DNA, 20 bp, Homo sapiens
gcctcgcccaccgcatgccc

SEQ ID NO: 4736440 - DNA, 23 bp, Homo sapiens
gcctcgcccaccgcatgccccct

SEQ ID NO: 4736441 - DNA, 14 bp, Homo sapiens
gcctcggctcctgc

SEQ ID NO: 4736442 - DNA, 16 bp, Homo sapiens
gcctcggctcctgctg

SEQ ID NO: 4736443 - DNA, 15 bp, Homo sapiens
gcctctgacacacag

SEQ ID NO: 4736444 - DNA, 17 bp, Homo sapiens
gcctctgacacacagct

SEQ ID NO: 4736445 - DNA, 20 bp, Homo sapiens
gcctctgacacacagctctg

SEQ ID NO: 4736446 - DNA, 15 bp, Homo sapiens
gcctctgcactcccc

SEQ ID NO: 4736447 - DNA, 17 bp, Homo sapiens
gcctctgcactcccctg

SEQ ID NO: 4736448 - DNA, 21 bp, Homo sapiens
gcctctgcactcccctgctgg

SEQ ID NO: 4736449 - DNA, 13 bp, Homo sapiens
gcctctgcctctg

SEQ ID NO: 4736450 - DNA, 20 bp, Homo sapiens
gcctctgtccccttctctca

SEQ ID NO: 4736451 - DNA, 22 bp, Homo sapiens
gcctctgtgtcactggctgcct

SEQ ID NO: 4736452 - DNA, 16 bp, Homo sapiens
gcctcttatgggctgg

SEQ ID NO: 4736453 - DNA, 14 bp, Homo sapiens
gcctgaagacccca

SEQ ID NO: 4736454 - DNA, 22 bp, Homo sapiens
gcctgaatgcttataggtggcc

SEQ ID NO: 4736455 - DNA, 19 bp, Homo sapiens
gcctgacaacagcctgaga

SEQ ID NO: 4736456 - DNA, 20 bp, Homo sapiens
gcctgacaacagcctgagaa

SEQ ID NO: 4736457 - DNA, 22 bp, Homo sapiens
gcctgacaacagcctgagaaat

SEQ ID NO: 4736458 - DNA, 13 bp, Homo sapiens
gcctgaccttgag

SEQ ID NO: 4736459 - DNA, 16 bp, Homo sapiens
gcctgagatttcatct

SEQ ID NO: 4736460 - DNA, 23 bp, Homo sapiens
gcctgagcgctcctgccgcagag

SEQ ID NO: 4736461 - DNA, 17 bp, Homo sapiens
gcctgaggtctcgctga

SEQ ID NO: 4736462 - DNA, 15 bp, Homo sapiens
gcctgagtgcctggc

SEQ ID NO: 4736463 - DNA, 20 bp, Homo sapiens
gcctgattcggctgtctcag

SEQ ID NO: 4736464 - DNA, 23 bp, Homo sapiens
gcctgattctcgcgattattctc

SEQ ID NO: 4736465 - DNA, 13 bp, Homo sapiens
gcctgcaagggag

SEQ ID NO: 4736466 - DNA, 15 bp, Homo sapiens
gcctgcaagggagtg

SEQ ID NO: 4736467 - DNA, 13 bp, Homo sapiens
gcctgcccaggcc

SEQ ID NO: 4736468 - DNA, 19 bp, Homo sapiens
gcctgcccaggcccctgcc

SEQ ID NO: 4736469 - DNA, 16 bp, Homo sapiens
gcctgcctccagggct

SEQ ID NO: 4736470 - DNA, 17 bp, Homo sapiens
gcctgcctccagggctg

SEQ ID NO: 4736471 - DNA, 18 bp, Homo sapiens
gcctgcctccagggctgg

SEQ ID NO: 4736472 - DNA, 14 bp, Homo sapiens
gcctgccttctcag

SEQ ID NO: 4736473 - DNA, 19 bp, Homo sapiens
gcctgcgtgtgtctgtgtt

SEQ ID NO: 4736474 - DNA, 22 bp, Homo sapiens
gcctgctgcagtcacgtgtaaa

SEQ ID NO: 4736475 - DNA, 15 bp, Homo sapiens
gcctggaagacagag

SEQ ID NO: 4736476 - DNA, 23 bp, Homo sapiens
gcctggaagacagagacctcctg

SEQ ID NO: 4736477 - DNA, 16 bp, Homo sapiens
gcctggatggggctgc

SEQ ID NO: 4736478 - DNA, 14 bp, Homo sapiens
gcctggcacagtgt

SEQ ID NO: 4736479 - DNA, 16 bp, Homo sapiens
gcctggcacagtgtct

SEQ ID NO: 4736480 - DNA, 22 bp, Homo sapiens
gcctggcacagtgtctgggctg

SEQ ID NO: 4736481 - DNA, 20 bp, Homo sapiens
gcctggccagatgcaccagc

SEQ ID NO: 4736482 - DNA, 11 bp, Homo sapiens
gcctggcccag

SEQ ID NO: 4736483 - DNA, 14 bp, Homo sapiens
gcctggcccagctc

SEQ ID NO: 4736484 - DNA, 15 bp, Homo sapiens
gcctggcccagctcc

SEQ ID NO: 4736485 - DNA, 16 bp, Homo sapiens
gcctggcccagctccc

SEQ ID NO: 4736486 - DNA, 13 bp, Homo sapiens
gcctggcccctca

SEQ ID NO: 4736487 - DNA, 17 bp, Homo sapiens
gcctggcccctcagggt

SEQ ID NO: 4736488 - DNA, 20 bp, Homo sapiens
gcctggcccctcagggtccc

SEQ ID NO: 4736489 - DNA, 13 bp, Homo sapiens
gcctggctcaggt

SEQ ID NO: 4736490 - DNA, 23 bp, Homo sapiens
gcctggctccaaaccctcgaggc

SEQ ID NO: 4736491 - DNA, 14 bp, Homo sapiens
gcctgggatccctc

SEQ ID NO: 4736492 - DNA, 18 bp, Homo sapiens
gcctgggatccctcatcc

SEQ ID NO: 4736493 - DNA, 23 bp, Homo sapiens
gcctgggatccctcatcctcata

SEQ ID NO: 4736494 - DNA, 22 bp, Homo sapiens
gcctgggggcagggagaggagt

SEQ ID NO: 4736495 - DNA, 17 bp, Homo sapiens
gcctgggggtgccagga

SEQ ID NO: 4736496 - DNA, 22 bp, Homo sapiens
gcctggggtaccaagagactcc

SEQ ID NO: 4736497 - DNA, 20 bp, Homo sapiens
gcctgggtgacaaagcgaga

SEQ ID NO: 4736498 - DNA, 23 bp, Homo sapiens
gcctgggtgacagagtgagactc

SEQ ID NO: 4736499 - DNA, 15 bp, Homo sapiens
gcctggtggcagctg

SEQ ID NO: 4736500 - DNA, 14 bp, Homo sapiens
gcctggttagaggc

SEQ ID NO: 4736501 - DNA, 18 bp, Homo sapiens
gcctgtaatcccagcact

SEQ ID NO: 4736502 - DNA, 19 bp, Homo sapiens
gcctgtaatcccagcactt

SEQ ID NO: 4736503 - DNA, 11 bp, Homo sapiens
gcctgtgtccc

SEQ ID NO: 4736504 - DNA, 19 bp, Homo sapiens
gcctgtgtgcgagtctgag

SEQ ID NO: 4736505 - DNA, 14 bp, Homo sapiens
gcctgttcagctcc

SEQ ID NO: 4736506 - DNA, 15 bp, Homo sapiens
gcctgttcagctcca

SEQ ID NO: 4736507 - DNA, 17 bp, Homo sapiens
gcctgttcagctccagc

SEQ ID NO: 4736508 - DNA, 13 bp, Homo sapiens
gccttaataaata

SEQ ID NO: 4736509 - DNA, 18 bp, Homo sapiens
gccttagaagtcacacag

SEQ ID NO: 4736510 - DNA, 19 bp, Homo sapiens
gccttagaagtcacacagt

SEQ ID NO: 4736511 - DNA, 17 bp, Homo sapiens
gccttataaaccaatct

SEQ ID NO: 4736512 - DNA, 18 bp, Homo sapiens
gccttataaaccaatctt

SEQ ID NO: 4736513 - DNA, 21 bp, Homo sapiens
gccttatgagaacatggtgtg

SEQ ID NO: 4736514 - DNA, 17 bp, Homo sapiens
tcatttctatttctcct

SEQ ID NO: 4736515 - DNA, 21 bp, Homo sapiens
tcatttctatttctcctccat

SEQ ID NO: 4736516 - DNA, 19 bp, Homo sapiens
tcatttgagcagggctcag

SEQ ID NO: 4736517 - DNA, 12 bp, Homo sapiens
tcatttgtgaag

SEQ ID NO: 4736518 - DNA, 14 bp, Homo sapiens
tcatttgtgaagaa

SEQ ID NO: 4736519 - DNA, 15 bp, Homo sapiens
tcatttgtgaagaat

SEQ ID NO: 4736520 - DNA, 20 bp, Homo sapiens
tcattttgaattatgtgcac

SEQ ID NO: 4736521 - DNA, 21 bp, Homo sapiens
tcattttgaattatgtgcact

SEQ ID NO: 4736522 - DNA, 13 bp, Homo sapiens
tcatttttaacta

SEQ ID NO: 4736523 - DNA, 19 bp, Homo sapiens
tcatttttgtttctacctc

SEQ ID NO: 4736524 - DNA, 16 bp, Homo sapiens
tcatttttttccaggc

SEQ ID NO: 4736525 - DNA, 23 bp, Homo sapiens
tccaaagaattatgcatctgcta

SEQ ID NO: 4736526 - DNA, 21 bp, Homo sapiens
tccaaaggccatggagagctg

SEQ ID NO: 4736527 - DNA, 23 bp, Homo sapiens
tccaaaggccatggagagctgga

SEQ ID NO: 4736528 - DNA, 14 bp, Homo sapiens
tccaaagtgtaagt

SEQ ID NO: 4736529 - DNA, 18 bp, Homo sapiens
tccaaataaaaataacat

SEQ ID NO: 4736530 - DNA, 16 bp, Homo sapiens
tccaaatgcattcatg

SEQ ID NO: 4736531 - DNA, 23 bp, Homo sapiens
tccaaatgctgtgcaaacagtgt

SEQ ID NO: 4736532 - DNA, 21 bp, Homo sapiens
tccaaatgtgtataattttaa

SEQ ID NO: 4736533 - DNA, 23 bp, Homo sapiens
tccaaatttaaccataaatcaat

SEQ ID NO: 4736534 - DNA, 23 bp, Homo sapiens
tccaaccctcatcaccaacgtct

SEQ ID NO: 4736535 - DNA, 15 bp, Homo sapiens
tccaagaagcccagg

SEQ ID NO: 4736536 - DNA, 22 bp, Homo sapiens
tccaagaagcccaggaaaggct

SEQ ID NO: 4736537 - DNA, 12 bp, Homo sapiens
tccaagagctga

SEQ ID NO: 4736538 - DNA, 18 bp, Homo sapiens
tccaagatattttaaaat

SEQ ID NO: 4736539 - DNA, 22 bp, Homo sapiens
tccaagatattttaaaatctgt

SEQ ID NO: 4736540 - DNA, 13 bp, Homo sapiens
tccaagctcccag

SEQ ID NO: 4736541 - DNA, 16 bp, Homo sapiens
tccaagctggtcccac

SEQ ID NO: 4736542 - DNA, 21 bp, Homo sapiens
tccaagctggtcccactcagt

SEQ ID NO: 4736543 - DNA, 12 bp, Homo sapiens
tccaagcttttg

SEQ ID NO: 4736544 - DNA, 21 bp, Homo sapiens
tccaaggaaaccacagctgct

SEQ ID NO: 4736545 - DNA, 15 bp, Homo sapiens
tccaaggtggtctgc

SEQ ID NO: 4736546 - DNA, 23 bp, Homo sapiens
tccaaggtggtctgctcgggccc

SEQ ID NO: 4736547 - DNA, 19 bp, Homo sapiens
tccaaggtttataaagcag

SEQ ID NO: 4736548 - DNA, 16 bp, Homo sapiens
tccaatactgcccaag

SEQ ID NO: 4736549 - DNA, 14 bp, Homo sapiens
tccaatgcacagtt

SEQ ID NO: 4736550 - DNA, 22 bp, Homo sapiens
tccaatgcacagttgccacatt

SEQ ID NO: 4736551 - DNA, 19 bp, Homo sapiens
tccaatgtcgctgtaaatt

SEQ ID NO: 4736552 - DNA, 18 bp, Homo sapiens
tccaattaatgaagttga

SEQ ID NO: 4736553 - DNA, 19 bp, Homo sapiens
tccaattaatgaagttgat

SEQ ID NO: 4736554 - DNA, 12 bp, Homo sapiens
tccacaaaataa

SEQ ID NO: 4736555 - DNA, 12 bp, Homo sapiens
tccacaccccca

SEQ ID NO: 4736556 - DNA, 22 bp, Homo sapiens
tccacagccatcccagccttgg

SEQ ID NO: 4736557 - DNA, 16 bp, Homo sapiens
tccacagtggaaccag

SEQ ID NO: 4736558 - DNA, 19 bp, Homo sapiens
tccacatcctccacgttct

SEQ ID NO: 4736559 - DNA, 15 bp, Homo sapiens
tccacatgggagccg

SEQ ID NO: 4736560 - DNA, 12 bp, Homo sapiens
tccacccacctc

SEQ ID NO: 4736561 - DNA, 14 bp, Homo sapiens
tccacccaggagcc

SEQ ID NO: 4736562 - DNA, 15 bp, Homo sapiens
tccacccaggagccc

SEQ ID NO: 4736563 - DNA, 21 bp, Homo sapiens
tccaccctgctctccgaccag

SEQ ID NO: 4736564 - DNA, 17 bp, Homo sapiens
tccacctagtggctgtc

SEQ ID NO: 4736565 - DNA, 13 bp, Homo sapiens
tccacctgccagg

SEQ ID NO: 4736566 - DNA, 15 bp, Homo sapiens
tccacctgccaggga

SEQ ID NO: 4736567 - DNA, 17 bp, Homo sapiens
tccacctgccagggaca

SEQ ID NO: 4736568 - DNA, 18 bp, Homo sapiens
tccacgactgtctccatg

SEQ ID NO: 4736569 - DNA, 19 bp, Homo sapiens
tccacgcggccacctcacc

SEQ ID NO: 4736570 - DNA, 18 bp, Homo sapiens
tccacgtgtatgcaagtg

SEQ ID NO: 4736571 - DNA, 21 bp, Homo sapiens
tccacgttctgctcatcattc

SEQ ID NO: 4736572 - DNA, 15 bp, Homo sapiens
tccactcaaatgtcc

SEQ ID NO: 4736573 - DNA, 14 bp, Homo sapiens
tccactcccaggca

SEQ ID NO: 4736574 - DNA, 16 bp, Homo sapiens
tccactctcccccacc

SEQ ID NO: 4736575 - DNA, 22 bp, Homo sapiens
tccacttgttcattctgtgacc

SEQ ID NO: 4736576 - DNA, 19 bp, Homo sapiens
tccagacccggctgcgtgg

SEQ ID NO: 4736577 - DNA, 13 bp, Homo sapiens
tccagagctctga

SEQ ID NO: 4736578 - DNA, 14 bp, Homo sapiens
tccagagctgcttc

SEQ ID NO: 4736579 - DNA, 18 bp, Homo sapiens
tccagagctgcttctgtc

SEQ ID NO: 4736580 - DNA, 12 bp, Homo sapiens
tccagagggcac

SEQ ID NO: 4736581 - DNA, 17 bp, Homo sapiens
tccagagggcactctgc

SEQ ID NO: 4736582 - DNA, 21 bp, Homo sapiens
tccagcaattctcctgcctca

SEQ ID NO: 4736583 - DNA, 20 bp, Homo sapiens
tccagcattctcagccacaa

SEQ ID NO: 4736584 - DNA, 17 bp, Homo sapiens
tccagccagggctgcta

SEQ ID NO: 4736585 - DNA, 12 bp, Homo sapiens
tccagcccctgg

SEQ ID NO: 4736586 - DNA, 16 bp, Homo sapiens
tccagcccctggatgc

SEQ ID NO: 4736587 - DNA, 17 bp, Homo sapiens
tccagcccctggatgca

SEQ ID NO: 4736588 - DNA, 22 bp, Homo sapiens
tccagcccctggatgcagcctc

SEQ ID NO: 4736589 - DNA, 20 bp, Homo sapiens
tccagccctggctgaaggac

SEQ ID NO: 4736590 - DNA, 14 bp, Homo sapiens
tccagcctcagctc

SEQ ID NO: 4736591 - DNA, 20 bp, Homo sapiens
tccagctataacagtaggga

SEQ ID NO: 4736592 - DNA, 17 bp, Homo sapiens
tccagctcaccagcccc

SEQ ID NO: 4736593 - DNA, 23 bp, Homo sapiens
tccagctcctcatccagggctct

SEQ ID NO: 4736594 - DNA, 22 bp, Homo sapiens
tccagctggccgggagcctgat

SEQ ID NO: 4736595 - DNA, 19 bp, Homo sapiens
tccagctgggttggaaaac

SEQ ID NO: 4736596 - DNA, 12 bp, Homo sapiens
tccaggagcagc

SEQ ID NO: 4736597 - DNA, 13 bp, Homo sapiens
tccaggagcagcc

SEQ ID NO: 4736598 - DNA, 16 bp, Homo sapiens
tccaggagcagccaca

SEQ ID NO: 4736599 - DNA, 17 bp, Homo sapiens
tccaggagcagccacat

SEQ ID NO: 4736600 - DNA, 21 bp, Homo sapiens
tccaggagggctaattagaaa

SEQ ID NO: 4736601 - DNA, 17 bp, Homo sapiens
tccaggatttataaagc

SEQ ID NO: 4736602 - DNA, 14 bp, Homo sapiens
tccaggcactgaga

SEQ ID NO: 4736603 - DNA, 16 bp, Homo sapiens
tccaggcactgagata

SEQ ID NO: 4736604 - DNA, 14 bp, Homo sapiens
tccaggcaggctaa

SEQ ID NO: 4736605 - DNA, 10 bp, Homo sapiens
tccaggctcc

SEQ ID NO: 4736606 - DNA, 12 bp, Homo sapiens
tccaggctcctt

SEQ ID NO: 4736607 - DNA, 22 bp, Homo sapiens
tccaggctcctttagcgcccag

SEQ ID NO: 4736608 - DNA, 13 bp, Homo sapiens
tccaggctggttc

SEQ ID NO: 4736609 - DNA, 21 bp, Homo sapiens
tccaggctgtatcccatgagc

SEQ ID NO: 4736610 - DNA, 19 bp, Homo sapiens
tccagggctggactgaggc

SEQ ID NO: 4736611 - DNA, 22 bp, Homo sapiens
tccagggctggactgaggcctg

SEQ ID NO: 4736612 - DNA, 20 bp, Homo sapiens
tccaggggtgggacaccctg

SEQ ID NO: 4736613 - DNA, 15 bp, Homo sapiens
tccaggtgcacaagc

SEQ ID NO: 4736614 - DNA, 10 bp, Homo sapiens
tacctgtccc

SEQ ID NO: 4736615 - DNA, 19 bp, Homo sapiens
tacctgtgcaccagtgtga

SEQ ID NO: 4736616 - DNA, 20 bp, Homo sapiens
taccttattggatatttgat

SEQ ID NO: 4736617 - DNA, 22 bp, Homo sapiens
taccttctccctcatttcagga

SEQ ID NO: 4736618 - DNA, 14 bp, Homo sapiens
tacctttgaaatat

SEQ ID NO: 4736619 - DNA, 16 bp, Homo sapiens
taccttttacagaata

SEQ ID NO: 4736620 - DNA, 24 bp, Homo sapiens
tacgctccatcgctgtcatctcag

SEQ ID NO: 4736621 - DNA, 16 bp, Homo sapiens
tacgtacatgtgaggc

SEQ ID NO: 4736622 - DNA, 21 bp, Homo sapiens
tacgtagcctaaggctcctgt

SEQ ID NO: 4736623 - DNA, 16 bp, Homo sapiens
tactaaaaaaaagatg

SEQ ID NO: 4736624 - DNA, 16 bp, Homo sapiens
tactaaaaagtataaa

SEQ ID NO: 4736625 - DNA, 18 bp, Homo sapiens
tactaactgctgattttg

SEQ ID NO: 4736626 - DNA, 23 bp, Homo sapiens
tactaattttccataagctattt

SEQ ID NO: 4736627 - DNA, 20 bp, Homo sapiens
tactaattttttaagaggaa

SEQ ID NO: 4736628 - DNA, 12 bp, Homo sapiens
tactacagtcct

SEQ ID NO: 4736629 - DNA, 22 bp, Homo sapiens
tactattcatgttttgagacat

SEQ ID NO: 4736630 - DNA, 15 bp, Homo sapiens
tactcagggaaagca

SEQ ID NO: 4736631 - DNA, 17 bp, Homo sapiens
tactcagggaaagcatt

SEQ ID NO: 4736632 - DNA, 15 bp, Homo sapiens
tactcattaattcaa

SEQ ID NO: 4736633 - DNA, 21 bp, Homo sapiens
tactcattaattcaatgaaat

SEQ ID NO: 4736634 - DNA, 12 bp, Homo sapiens
tactcccatctg

SEQ ID NO: 4736635 - DNA, 12 bp, Homo sapiens
tactcctgggtc

SEQ ID NO: 4736636 - DNA, 17 bp, Homo sapiens
tactcctttttattcat

SEQ ID NO: 4736637 - DNA, 12 bp, Homo sapiens
tactctgtgtca

SEQ ID NO: 4736638 - DNA, 15 bp, Homo sapiens
tactctgtgtgtgta

SEQ ID NO: 4736639 - DNA, 17 bp, Homo sapiens
tactctgtgtgtgtatg

SEQ ID NO: 4736640 - DNA, 20 bp, Homo sapiens
tactgaaaatacaaaaatta

SEQ ID NO: 4736641 - DNA, 20 bp, Homo sapiens
tactgaagaaatctttccag

SEQ ID NO: 4736642 - DNA, 13 bp, Homo sapiens
tactgaatctgct

SEQ ID NO: 4736643 - DNA, 22 bp, Homo sapiens
tactgatgaaacagcctctgca

SEQ ID NO: 4736644 - DNA, 14 bp, Homo sapiens
tactggactcagga

SEQ ID NO: 4736645 - DNA, 18 bp, Homo sapiens
tactggactcaggaactt

SEQ ID NO: 4736646 - DNA, 21 bp, Homo sapiens
tactggcctcgcctggcctga

SEQ ID NO: 4736647 - DNA, 16 bp, Homo sapiens
tactgtaacattcagg

SEQ ID NO: 4736648 - DNA, 15 bp, Homo sapiens
tactgtatattcagg

SEQ ID NO: 4736649 - DNA, 18 bp, Homo sapiens
tactgtatggaaacactg

SEQ ID NO: 4736650 - DNA, 17 bp, Homo sapiens
tactgtattttgtattg

SEQ ID NO: 4736651 - DNA, 15 bp, Homo sapiens
tactgtctgtagtgt

SEQ ID NO: 4736652 - DNA, 16 bp, Homo sapiens
tactgtgctggagcca

SEQ ID NO: 4736653 - DNA, 18 bp, Homo sapiens
tactgtggaggaaggatt

SEQ ID NO: 4736654 - DNA, 13 bp, Homo sapiens
tactgttgcacgt

SEQ ID NO: 4736655 - DNA, 17 bp, Homo sapiens
tactgttgtcctatggg

SEQ ID NO: 4736656 - DNA, 19 bp, Homo sapiens
tacttaaacatttttgttt

SEQ ID NO: 4736657 - DNA, 22 bp, Homo sapiens
tacttaaatttggtttgttaat

SEQ ID NO: 4736658 - DNA, 23 bp, Homo sapiens
tacttaaatttggtttgttaatt

SEQ ID NO: 4736659 - DNA, 17 bp, Homo sapiens
tacttagattgtgttcc

SEQ ID NO: 4736660 - DNA, 17 bp, Homo sapiens
tacttagtggtgtatat

SEQ ID NO: 4736661 - DNA, 13 bp, Homo sapiens
tacttatacacct

SEQ ID NO: 4736662 - DNA, 14 bp, Homo sapiens
tacttccccttcct

SEQ ID NO: 4736663 - DNA, 20 bp, Homo sapiens
tacttccccttcctaattcc

SEQ ID NO: 4736664 - DNA, 23 bp, Homo sapiens
tacttgccttattagagtgtctt

SEQ ID NO: 4736665 - DNA, 13 bp, Homo sapiens
tacttgtggacac

SEQ ID NO: 4736666 - DNA, 12 bp, Homo sapiens
tacttgttctgt

SEQ ID NO: 4736667 - DNA, 13 bp, Homo sapiens
tacttgttgttta

SEQ ID NO: 4736668 - DNA, 20 bp, Homo sapiens
tactttgacagtgtttttag

SEQ ID NO: 4736669 - DNA, 12 bp, Homo sapiens
tactttgcttct

SEQ ID NO: 4736670 - DNA, 11 bp, Homo sapiens
tactttgtgct

SEQ ID NO: 4736671 - DNA, 14 bp, Homo sapiens
tactttgtgctgat

SEQ ID NO: 4736672 - DNA, 15 bp, Homo sapiens
tacttttaaagaatt

SEQ ID NO: 4736673 - DNA, 20 bp, Homo sapiens
tacttttaaagaatttcttt

SEQ ID NO: 4736674 - DNA, 15 bp, Homo sapiens
tacttttgccctttg

SEQ ID NO: 4736675 - DNA, 16 bp, Homo sapiens
tactttttaaaatgtt

SEQ ID NO: 4736676 - DNA, 23 bp, Homo sapiens
tactttttttggaagttatttat

SEQ ID NO: 4736677 - DNA, 18 bp, Homo sapiens
tagaaaaatagcaacttg

SEQ ID NO: 4736678 - DNA, 15 bp, Homo sapiens
tagaaacttccaaat

SEQ ID NO: 4736679 - DNA, 17 bp, Homo sapiens
tagaaagacagagctgg

SEQ ID NO: 4736680 - DNA, 18 bp, Homo sapiens
tagaaagagatacagagg

SEQ ID NO: 4736681 - DNA, 13 bp, Homo sapiens
tagaaagcagtta

SEQ ID NO: 4736682 - DNA, 22 bp, Homo sapiens
tagaaagtaagaaaacaatatg

SEQ ID NO: 4736683 - DNA, 11 bp, Homo sapiens
tagaacattta

SEQ ID NO: 4736684 - DNA, 20 bp, Homo sapiens
tagaaccaccaacaagcaag

SEQ ID NO: 4736685 - DNA, 22 bp, Homo sapiens
tagaaccaccaacaagcaagct

SEQ ID NO: 4736686 - DNA, 23 bp, Homo sapiens
tagaacctggaagggctagaacc

SEQ ID NO: 4736687 - DNA, 22 bp, Homo sapiens
tagaacctggagagctagaacc

SEQ ID NO: 4736688 - DNA, 13 bp, Homo sapiens
tagaacctggagg

SEQ ID NO: 4736689 - DNA, 13 bp, Homo sapiens
tagaactgaattt

SEQ ID NO: 4736690 - DNA, 22 bp, Homo sapiens
tagaactgaattttgtctttat

SEQ ID NO: 4736691 - DNA, 14 bp, Homo sapiens
tagaagcattcctt

SEQ ID NO: 4736692 - DNA, 23 bp, Homo sapiens
tagaagcattccttctttgataa

SEQ ID NO: 4736693 - DNA, 17 bp, Homo sapiens
tagaagctggaggacta

SEQ ID NO: 4736694 - DNA, 24 bp, Homo sapiens
tagaagggctagaacctggagagc

SEQ ID NO: 4736695 - DNA, 19 bp, Homo sapiens
tagaaggttctctcctccc

SEQ ID NO: 4736696 - DNA, 16 bp, Homo sapiens
tagaagtcacacagta

SEQ ID NO: 4736697 - DNA, 17 bp, Homo sapiens
tagaataatcttgctca

SEQ ID NO: 4736698 - DNA, 22 bp, Homo sapiens
tagaatacattgtacttataca

SEQ ID NO: 4736699 - DNA, 10 bp, Homo sapiens
tagacagagt

SEQ ID NO: 4736700 - DNA, 21 bp, Homo sapiens
tagacagagtctcactgttgc

SEQ ID NO: 4736701 - DNA, 16 bp, Homo sapiens
tagacagtccctgcca

SEQ ID NO: 4736702 - DNA, 12 bp, Homo sapiens
tagacatgtcat

SEQ ID NO: 4736703 - DNA, 23 bp, Homo sapiens
tagactaaggccattattgtact

SEQ ID NO: 4736704 - DNA, 11 bp, Homo sapiens
tagagacaggg

SEQ ID NO: 4736705 - DNA, 20 bp, Homo sapiens
tagagagtctccttactcat

SEQ ID NO: 4736706 - DNA, 14 bp, Homo sapiens
tagagatatttaaa

SEQ ID NO: 4736707 - DNA, 19 bp, Homo sapiens
tagagattacctcctgaga

SEQ ID NO: 4736708 - DNA, 17 bp, Homo sapiens
tagagcagtttctgtcc

SEQ ID NO: 4736709 - DNA, 20 bp, Homo sapiens
tagagctgtattaagccact

SEQ ID NO: 4736710 - DNA, 18 bp, Homo sapiens
tagagcttgtaataaata

SEQ ID NO: 4736711 - DNA, 23 bp, Homo sapiens
tagaggggggatttccagccagg

SEQ ID NO: 4736712 - DNA, 15 bp, Homo sapiens
tagagtaatgaaatg

SEQ ID NO: 4736713 - DNA, 17 bp, Homo sapiens
tagagtaatgaaatgga

SEQ ID NO: 4736714 - DNA, 19 bp, Homo sapiens
tagagtcaatttgctgaaa

SEQ ID NO: 4736715 - DNA, 13 bp, Homo sapiens
tagagttaagaag

SEQ ID NO: 4736716 - DNA, 15 bp, Homo sapiens
tagagttaagaagct

SEQ ID NO: 4736717 - DNA, 15 bp, Homo sapiens
tagatatcctctgct

SEQ ID NO: 4736718 - DNA, 19 bp, Homo sapiens
tagatctccaggagaactg

SEQ ID NO: 4736719 - DNA, 21 bp, Homo sapiens
tagatgttctaagtctttcca

SEQ ID NO: 4736720 - DNA, 19 bp, Homo sapiens
tagattatttctgtatttg

SEQ ID NO: 4736721 - DNA, 12 bp, Homo sapiens
tagatttgacct

SEQ ID NO: 4736722 - DNA, 23 bp, Homo sapiens
tcactataggtcatacaatccat

SEQ ID NO: 4736723 - DNA, 21 bp, Homo sapiens
tcactatctgaaaatacattt

SEQ ID NO: 4736724 - DNA, 14 bp, Homo sapiens
tcactatggtgcca

SEQ ID NO: 4736725 - DNA, 17 bp, Homo sapiens
tcactatgttgcccagg

SEQ ID NO: 4736726 - DNA, 21 bp, Homo sapiens
tcactatgttgcccaggcagg

SEQ ID NO: 4736727 - DNA, 15 bp, Homo sapiens
tcactatttaaacta

SEQ ID NO: 4736728 - DNA, 13 bp, Homo sapiens
tcactcacatctt

SEQ ID NO: 4736729 - DNA, 17 bp, Homo sapiens
tcactcatacatctggc

SEQ ID NO: 4736730 - DNA, 17 bp, Homo sapiens
tcactctggcagctcag

SEQ ID NO: 4736731 - DNA, 19 bp, Homo sapiens
tcactctggcagctcagag

SEQ ID NO: 4736732 - DNA, 20 bp, Homo sapiens
tcactctggcagctcagaga

SEQ ID NO: 4736733 - DNA, 21 bp, Homo sapiens
tcactgaactttgctgagcct

SEQ ID NO: 4736734 - DNA, 17 bp, Homo sapiens
tcactgacctttgtttc

SEQ ID NO: 4736735 - DNA, 17 bp, Homo sapiens
tcactgagacagcccgg

SEQ ID NO: 4736736 - DNA, 21 bp, Homo sapiens
tcactgagacagcccgggctc

SEQ ID NO: 4736737 - DNA, 22 bp, Homo sapiens
tcactgagacagcccgggctct

SEQ ID NO: 4736738 - DNA, 21 bp, Homo sapiens
tcactgcaaccttcgccacct

SEQ ID NO: 4736739 - DNA, 18 bp, Homo sapiens
tcactgcaagctccgcct

SEQ ID NO: 4736740 - DNA, 12 bp, Homo sapiens
tcactgcagcct

SEQ ID NO: 4736741 - DNA, 19 bp, Homo sapiens
tcactgcatcctccgcctc

SEQ ID NO: 4736742 - DNA, 19 bp, Homo sapiens
tcactggattggtcattta

SEQ ID NO: 4736743 - DNA, 20 bp, Homo sapiens
tcactggcgacacgtagcag

SEQ ID NO: 4736744 - DNA, 18 bp, Homo sapiens
tcactggctgcctccact

SEQ ID NO: 4736745 - DNA, 20 bp, Homo sapiens
tcactggctgcctccactcc

SEQ ID NO: 4736746 - DNA, 18 bp, Homo sapiens
tcactgggactttgtaaa

SEQ ID NO: 4736747 - DNA, 16 bp, Homo sapiens
tcactggtctctaagt

SEQ ID NO: 4736748 - DNA, 19 bp, Homo sapiens
tcactgtataaataggaga

SEQ ID NO: 4736749 - DNA, 14 bp, Homo sapiens
tcactgttgcccag

SEQ ID NO: 4736750 - DNA, 18 bp, Homo sapiens
tcactgttgcccaggctg

SEQ ID NO: 4736751 - DNA, 14 bp, Homo sapiens
tcacttcaccatca

SEQ ID NO: 4736752 - DNA, 16 bp, Homo sapiens
tcacttcgtgggatct

SEQ ID NO: 4736753 - DNA, 20 bp, Homo sapiens
tcacttggtgatatgtccta

SEQ ID NO: 4736754 - DNA, 21 bp, Homo sapiens
tcacttgtgccaacactcaag

SEQ ID NO: 4736755 - DNA, 20 bp, Homo sapiens
tcactttggggttcggcctg

SEQ ID NO: 4736756 - DNA, 21 bp, Homo sapiens
tcagaatatgattcactattt

SEQ ID NO: 4736757 - DNA, 16 bp, Homo sapiens
tcagacagctgcctgg

SEQ ID NO: 4736758 - DNA, 16 bp, Homo sapiens
tcagacgcctgaggaa

SEQ ID NO: 4736759 - DNA, 17 bp, Homo sapiens
tcagactaagccagcac

SEQ ID NO: 4736760 - DNA, 17 bp, Homo sapiens
tcagagactcctgcagg

SEQ ID NO: 4736761 - DNA, 22 bp, Homo sapiens
tcagagactcctgcaggcagcc

SEQ ID NO: 4736762 - DNA, 19 bp, Homo sapiens
tcagagaggacaaaataaa

SEQ ID NO: 4736763 - DNA, 22 bp, Homo sapiens
tcagagaggacaaaataaagtg

SEQ ID NO: 4736764 - DNA, 21 bp, Homo sapiens
tcagagagggtgggagtgggc

SEQ ID NO: 4736765 - DNA, 12 bp, Homo sapiens
tcagagcctgca

SEQ ID NO: 4736766 - DNA, 18 bp, Homo sapiens
tcagagctacttgggcca

SEQ ID NO: 4736767 - DNA, 14 bp, Homo sapiens
tcagagctgacaca

SEQ ID NO: 4736768 - DNA, 22 bp, Homo sapiens
tcagaggccctcgctgccagct

SEQ ID NO: 4736769 - DNA, 16 bp, Homo sapiens
tcagagtggagttgaa

SEQ ID NO: 4736770 - DNA, 23 bp, Homo sapiens
tcagagtggagttgaaactgcta

SEQ ID NO: 4736771 - DNA, 17 bp, Homo sapiens
tcagatataaaagactg

SEQ ID NO: 4736772 - DNA, 15 bp, Homo sapiens
tcagattcacacatg

SEQ ID NO: 4736773 - DNA, 22 bp, Homo sapiens
tcagcacctacagtgtacagtc

SEQ ID NO: 4736774 - DNA, 19 bp, Homo sapiens
tcagcatcaaacatgaaaa

SEQ ID NO: 4736775 - DNA, 21 bp, Homo sapiens
tcagcatcaaacatgaaaaca

SEQ ID NO: 4736776 - DNA, 23 bp, Homo sapiens
tcagcatcaaacatgaaaacatt

SEQ ID NO: 4736777 - DNA, 17 bp, Homo sapiens
tcagcatcctggcaccc

SEQ ID NO: 4736778 - DNA, 15 bp, Homo sapiens
tcagccgtgggcccg

SEQ ID NO: 4736779 - DNA, 22 bp, Homo sapiens
tcagcctcccaaagtgctggga

SEQ ID NO: 4736780 - DNA, 12 bp, Homo sapiens
tcagcctcccga

SEQ ID NO: 4736781 - DNA, 20 bp, Homo sapiens
tcagcctcccgaatagctgg

SEQ ID NO: 4736782 - DNA, 20 bp, Homo sapiens
tcagcctcccgagtagctgg

SEQ ID NO: 4736783 - DNA, 14 bp, Homo sapiens
tcagcggggacagc

SEQ ID NO: 4736784 - DNA, 17 bp, Homo sapiens
tcagcggggacagctcc

SEQ ID NO: 4736785 - DNA, 21 bp, Homo sapiens
tcagcggggacagctccttct

SEQ ID NO: 4736786 - DNA, 23 bp, Homo sapiens
tcagcggggacagctccttctgt

SEQ ID NO: 4736787 - DNA, 20 bp, Homo sapiens
tcagctactttccatttggt

SEQ ID NO: 4736788 - DNA, 14 bp, Homo sapiens
tcagctcactgttc

SEQ ID NO: 4736789 - DNA, 12 bp, Homo sapiens
tcagctccagct

SEQ ID NO: 4736790 - DNA, 23 bp, Homo sapiens
tcagctccagctcaccagcccca

SEQ ID NO: 4736791 - DNA, 15 bp, Homo sapiens
tcagctccccagagt

SEQ ID NO: 4736792 - DNA, 14 bp, Homo sapiens
tcagctccttcctg

SEQ ID NO: 4736793 - DNA, 15 bp, Homo sapiens
tcagctgaccccctc

SEQ ID NO: 4736794 - DNA, 16 bp, Homo sapiens
tcagctgaccccctcc

SEQ ID NO: 4736795 - DNA, 14 bp, Homo sapiens
tcagcttctgctgg

SEQ ID NO: 4736796 - DNA, 23 bp, Homo sapiens
tcagcttctgctgggctggggcc

SEQ ID NO: 4736797 - DNA, 12 bp, Homo sapiens
tcagcttctgtt

SEQ ID NO: 4736798 - DNA, 20 bp, Homo sapiens
tcagcttgtaaatagctcag

SEQ ID NO: 4736799 - DNA, 21 bp, Homo sapiens
tcagcttgtaaatagctcagg

SEQ ID NO: 4736800 - DNA, 22 bp, Homo sapiens
tcagcttgtaaatagctcaggt

SEQ ID NO: 4736801 - DNA, 22 bp, Homo sapiens
tcaggaaaggaatcatttctat

SEQ ID NO: 4736802 - DNA, 12 bp, Homo sapiens
tcaggaagctca

SEQ ID NO: 4736803 - DNA, 17 bp, Homo sapiens
tcaggaagctcagggcc

SEQ ID NO: 4736804 - DNA, 20 bp, Homo sapiens
tcaggaagctcagggcctgg

SEQ ID NO: 4736805 - DNA, 23 bp, Homo sapiens
tcaggaagctcagggcctggctc

SEQ ID NO: 4736806 - DNA, 13 bp, Homo sapiens
tcaggaccaggca

SEQ ID NO: 4736807 - DNA, 15 bp, Homo sapiens
tcaggattgcgagag

SEQ ID NO: 4736808 - DNA, 20 bp, Homo sapiens
tcaggattgcgagagatgtg

SEQ ID NO: 4736809 - DNA, 20 bp, Homo sapiens
tcaggcattggatatttttt

SEQ ID NO: 4736810 - DNA, 13 bp, Homo sapiens
tcaggccaggccc

SEQ ID NO: 4736811 - DNA, 14 bp, Homo sapiens
tcaggccaggccct

SEQ ID NO: 4736812 - DNA, 18 bp, Homo sapiens
tcaggccaggccctctgc

SEQ ID NO: 4736813 - DNA, 21 bp, Homo sapiens
tcaggccaggccctctgccca

SEQ ID NO: 4736814 - DNA, 15 bp, Homo sapiens
tcagggaccacagca

SEQ ID NO: 4736815 - DNA, 16 bp, Homo sapiens
tcagggaccacagcaa

SEQ ID NO: 4736816 - DNA, 14 bp, Homo sapiens
tcaggggctgcccg

SEQ ID NO: 4736817 - DNA, 21 bp, Homo sapiens
tcaggggctgcccgctcccag

SEQ ID NO: 4736818 - DNA, 14 bp, Homo sapiens
tcagggtccctggt

SEQ ID NO: 4736819 - DNA, 17 bp, Homo sapiens
tcagggtctctgctgcc

SEQ ID NO: 4736820 - DNA, 18 bp, Homo sapiens
tcagggtctctgctgccg

SEQ ID NO: 4736821 - DNA, 23 bp, Homo sapiens
tcagggttggcccctgcccggct

SEQ ID NO: 4736822 - DNA, 13 bp, Homo sapiens
tcaggtaacaggc

SEQ ID NO: 4736823 - DNA, 20 bp, Homo sapiens
tcaggtaatcgacctgcctc

SEQ ID NO: 4736824 - DNA, 15 bp, Homo sapiens
tcaggtgacatgtga

SEQ ID NO: 4736825 - DNA, 15 bp, Homo sapiens
taatgtcacaggcag

SEQ ID NO: 4736826 - DNA, 18 bp, Homo sapiens
taatgtcacaggcaggtc

SEQ ID NO: 4736827 - DNA, 11 bp, Homo sapiens
taatgtctctg

SEQ ID NO: 4736828 - DNA, 13 bp, Homo sapiens
taatgttaaattt

SEQ ID NO: 4736829 - DNA, 16 bp, Homo sapiens
taatgttaaatttgta

SEQ ID NO: 4736830 - DNA, 18 bp, Homo sapiens
taatgttaaatttgtaag

SEQ ID NO: 4736831 - DNA, 13 bp, Homo sapiens
taatgttgaatgt

SEQ ID NO: 4736832 - DNA, 14 bp, Homo sapiens
taatgttgaatgta

SEQ ID NO: 4736833 - DNA, 19 bp, Homo sapiens
taatgttgaatgtattttg

SEQ ID NO: 4736834 - DNA, 12 bp, Homo sapiens
taattataagct

SEQ ID NO: 4736835 - DNA, 14 bp, Homo sapiens
taattatatttcta

SEQ ID NO: 4736836 - DNA, 23 bp, Homo sapiens
taattatatttctacagagaaaa

SEQ ID NO: 4736837 - DNA, 19 bp, Homo sapiens
taattatctcctaattgta

SEQ ID NO: 4736838 - DNA, 18 bp, Homo sapiens
taattattgatgttttca

SEQ ID NO: 4736839 - DNA, 15 bp, Homo sapiens
taattatttaaatgt

SEQ ID NO: 4736840 - DNA, 17 bp, Homo sapiens
taattatttaaatgtac

SEQ ID NO: 4736841 - DNA, 17 bp, Homo sapiens
taattattttcttcctt

SEQ ID NO: 4736842 - DNA, 15 bp, Homo sapiens
taattctcaggccat

SEQ ID NO: 4736843 - DNA, 17 bp, Homo sapiens
taattggatattgatga

SEQ ID NO: 4736844 - DNA, 16 bp, Homo sapiens
taattgttgtttcttt

SEQ ID NO: 4736845 - DNA, 22 bp, Homo sapiens
taattgttgtttctttctagtg

SEQ ID NO: 4736846 - DNA, 16 bp, Homo sapiens
taattgtttcaaaaaa

SEQ ID NO: 4736847 - DNA, 22 bp, Homo sapiens
taatttacaaaaatataaaata

SEQ ID NO: 4736848 - DNA, 14 bp, Homo sapiens
taatttattttgtc

SEQ ID NO: 4736849 - DNA, 14 bp, Homo sapiens
taatttcggttata

SEQ ID NO: 4736850 - DNA, 15 bp, Homo sapiens
taatttctgttgttt

SEQ ID NO: 4736851 - DNA, 14 bp, Homo sapiens
taatttgtgaattt

SEQ ID NO: 4736852 - DNA, 13 bp, Homo sapiens
taattttcctgtg

SEQ ID NO: 4736853 - DNA, 16 bp, Homo sapiens
taattttgtgttgtac

SEQ ID NO: 4736854 - DNA, 21 bp, Homo sapiens
taatttttgtatttttagtag

SEQ ID NO: 4736855 - DNA, 18 bp, Homo sapiens
tacaaaaatataaaatat

SEQ ID NO: 4736856 - DNA, 16 bp, Homo sapiens
tacaaacaaaatttct

SEQ ID NO: 4736857 - DNA, 18 bp, Homo sapiens
tacaaacaaaatttctat

SEQ ID NO: 4736858 - DNA, 17 bp, Homo sapiens
tacaaaggaggacaaga

SEQ ID NO: 4736859 - DNA, 17 bp, Homo sapiens
tacaaagttaaaattgt

SEQ ID NO: 4736860 - DNA, 12 bp, Homo sapiens
tacaacaaacac

SEQ ID NO: 4736861 - DNA, 15 bp, Homo sapiens
tacaaccaggtcttg

SEQ ID NO: 4736862 - DNA, 19 bp, Homo sapiens
tacaagagcttaacagtgt

SEQ ID NO: 4736863 - DNA, 16 bp, Homo sapiens
tacaagcgtgagccac

SEQ ID NO: 4736864 - DNA, 19 bp, Homo sapiens
tacaagcgtgagccactgc

SEQ ID NO: 4736865 - DNA, 19 bp, Homo sapiens
tacaagttaaggtatctgg

SEQ ID NO: 4736866 - DNA, 22 bp, Homo sapiens
tacaattacatctctaattttg

SEQ ID NO: 4736867 - DNA, 21 bp, Homo sapiens
tacacacacacgcgtgcacac

SEQ ID NO: 4736868 - DNA, 20 bp, Homo sapiens
tacacatgtatcctttcaca

SEQ ID NO: 4736869 - DNA, 15 bp, Homo sapiens
tacacccttttccag

SEQ ID NO: 4736870 - DNA, 18 bp, Homo sapiens
tacactggtctaatgttt

SEQ ID NO: 4736871 - DNA, 21 bp, Homo sapiens
tacactgtgctgagtctgaag

SEQ ID NO: 4736872 - DNA, 17 bp, Homo sapiens
tacacttttttccaaag

SEQ ID NO: 4736873 - DNA, 16 bp, Homo sapiens
tacagaactctttcaa

SEQ ID NO: 4736874 - DNA, 18 bp, Homo sapiens
tacagagaaaatgaattt

SEQ ID NO: 4736875 - DNA, 19 bp, Homo sapiens
tacagagcccacgccccca

SEQ ID NO: 4736876 - DNA, 20 bp, Homo sapiens
tacagatcaggcagtgttta

SEQ ID NO: 4736877 - DNA, 20 bp, Homo sapiens
tacagctgggtggcactgcc

SEQ ID NO: 4736878 - DNA, 24 bp, Homo sapiens
tacagctgggtggcactgccatgc

SEQ ID NO: 4736879 - DNA, 19 bp, Homo sapiens
tacagctttgggtcatttt

SEQ ID NO: 4736880 - DNA, 21 bp, Homo sapiens
tacagggtgctccttgtcaat

SEQ ID NO: 4736881 - DNA, 14 bp, Homo sapiens
tacagtaggagccc

SEQ ID NO: 4736882 - DNA, 22 bp, Homo sapiens
tacagtaggagcccagctctga

SEQ ID NO: 4736883 - DNA, 15 bp, Homo sapiens
tacagtcctcccatc

SEQ ID NO: 4736884 - DNA, 17 bp, Homo sapiens
tacagtcctcccatctc

SEQ ID NO: 4736885 - DNA, 19 bp, Homo sapiens
tacagtctcaattttgtat

SEQ ID NO: 4736886 - DNA, 13 bp, Homo sapiens
tacatcagtttga

SEQ ID NO: 4736887 - DNA, 16 bp, Homo sapiens
tacatcagtttgatac

SEQ ID NO: 4736888 - DNA, 17 bp, Homo sapiens
tacatcagtttgataca

SEQ ID NO: 4736889 - DNA, 14 bp, Homo sapiens
tacatctgtgatga

SEQ ID NO: 4736890 - DNA, 20 bp, Homo sapiens
tacatgcatataatgaataa

SEQ ID NO: 4736891 - DNA, 17 bp, Homo sapiens
tacatgcttagaggggt

SEQ ID NO: 4736892 - DNA, 13 bp, Homo sapiens
tacatgttttcac

SEQ ID NO: 4736893 - DNA, 23 bp, Homo sapiens
tacattagtgattccatcaaaga

SEQ ID NO: 4736894 - DNA, 21 bp, Homo sapiens
tacattgacacacagaaatgt

SEQ ID NO: 4736895 - DNA, 19 bp, Homo sapiens
tacattgtctctaaattgt

SEQ ID NO: 4736896 - DNA, 16 bp, Homo sapiens
tacattgtgtcctgct

SEQ ID NO: 4736897 - DNA, 12 bp, Homo sapiens
tacatttatgat

SEQ ID NO: 4736898 - DNA, 22 bp, Homo sapiens
tacatttatgatttaataaaat

SEQ ID NO: 4736899 - DNA, 18 bp, Homo sapiens
tacattttaaaggataat

SEQ ID NO: 4736900 - DNA, 21 bp, Homo sapiens
tacattttgtatatttgtatt

SEQ ID NO: 4736901 - DNA, 18 bp, Homo sapiens
taccaaatctgacatatt

SEQ ID NO: 4736902 - DNA, 21 bp, Homo sapiens
taccaagcgcttctttctgac

SEQ ID NO: 4736903 - DNA, 13 bp, Homo sapiens
taccaatgaaaaa

SEQ ID NO: 4736904 - DNA, 15 bp, Homo sapiens
taccacccaatgctg

SEQ ID NO: 4736905 - DNA, 12 bp, Homo sapiens
taccagcagagc

SEQ ID NO: 4736906 - DNA, 13 bp, Homo sapiens
taccagcgaggag

SEQ ID NO: 4736907 - DNA, 15 bp, Homo sapiens
taccagcgaggaggc

SEQ ID NO: 4736908 - DNA, 21 bp, Homo sapiens
taccataaaatgtcagcaaat

SEQ ID NO: 4736909 - DNA, 17 bp, Homo sapiens
taccatccttacaatgt

SEQ ID NO: 4736910 - DNA, 17 bp, Homo sapiens
taccatggttgtgcaca

SEQ ID NO: 4736911 - DNA, 12 bp, Homo sapiens
taccattagcat

SEQ ID NO: 4736912 - DNA, 14 bp, Homo sapiens
taccattagcataa

SEQ ID NO: 4736913 - DNA, 19 bp, Homo sapiens
taccattatttaatttgta

SEQ ID NO: 4736914 - DNA, 23 bp, Homo sapiens
taccattttggggtacccactgc

SEQ ID NO: 4736915 - DNA, 15 bp, Homo sapiens
tacccaaactgcttt

SEQ ID NO: 4736916 - DNA, 12 bp, Homo sapiens
tacccaccccca

SEQ ID NO: 4736917 - DNA, 23 bp, Homo sapiens
tacccacccccacccaagggcct

SEQ ID NO: 4736918 - DNA, 16 bp, Homo sapiens
tacccagcgagccctg

SEQ ID NO: 4736919 - DNA, 16 bp, Homo sapiens
taccccaattccttgt

SEQ ID NO: 4736920 - DNA, 17 bp, Homo sapiens
taccccaattccttgta

SEQ ID NO: 4736921 - DNA, 18 bp, Homo sapiens
taccccatgaagatattt

SEQ ID NO: 4736922 - DNA, 14 bp, Homo sapiens
taccccatttgatt

SEQ ID NO: 4736923 - DNA, 12 bp, Homo sapiens
tacccccgccca

SEQ ID NO: 4736924 - DNA, 23 bp, Homo sapiens
tacccgggaagggggctgggaca

SEQ ID NO: 4736925 - DNA, 12 bp, Homo sapiens
taccctccctgc

SEQ ID NO: 4736926 - DNA, 18 bp, Homo sapiens
taccctccctgctgtccc

SEQ ID NO: 4736927 - DNA, 18 bp, Homo sapiens
tacctaatccaaatatca

SEQ ID NO: 4736928 - DNA, 17 bp, Homo sapiens
tacctagctaattattt

SEQ ID NO: 4736929 - DNA, 18 bp, Homo sapiens
tacctagctaattattta

SEQ ID NO: 4736930 - DNA, 16 bp, Homo sapiens
tacctcactactacat

SEQ ID NO: 4736931 - DNA, 19 bp, Homo sapiens
tacctcactactacatctg

SEQ ID NO: 4736932 - DNA, 23 bp, Homo sapiens
taacaaatatggctagttttcaa

SEQ ID NO: 4736933 - DNA, 13 bp, Homo sapiens
taacaagccaccc

SEQ ID NO: 4736934 - DNA, 16 bp, Homo sapiens
taacaatgttaaggaa

SEQ ID NO: 4736935 - DNA, 13 bp, Homo sapiens
taacacacagcta

SEQ ID NO: 4736936 - DNA, 15 bp, Homo sapiens
taacacacagctccc

SEQ ID NO: 4736937 - DNA, 13 bp, Homo sapiens
taacactgtaata

SEQ ID NO: 4736938 - DNA, 14 bp, Homo sapiens
taacactgtaatat

SEQ ID NO: 4736939 - DNA, 18 bp, Homo sapiens
taacactgtaatatcttt

SEQ ID NO: 4736940 - DNA, 14 bp, Homo sapiens
taacagaacagctt

SEQ ID NO: 4736941 - DNA, 17 bp, Homo sapiens
taacagaacagcttcag

SEQ ID NO: 4736942 - DNA, 14 bp, Homo sapiens
taacaggcttctgg

SEQ ID NO: 4736943 - DNA, 17 bp, Homo sapiens
taacaggttttcttcta

SEQ ID NO: 4736944 - DNA, 14 bp, Homo sapiens
taacagtgtttaaa

SEQ ID NO: 4736945 - DNA, 13 bp, Homo sapiens
taacatcattgta

SEQ ID NO: 4736946 - DNA, 19 bp, Homo sapiens
taacatcattgtattaacg

SEQ ID NO: 4736947 - DNA, 18 bp, Homo sapiens
taacatggtgtgcttctt

SEQ ID NO: 4736948 - DNA, 20 bp, Homo sapiens
taacattagttttaaaaagg

SEQ ID NO: 4736949 - DNA, 22 bp, Homo sapiens
taaccaagttgtttattccaaa

SEQ ID NO: 4736950 - DNA, 14 bp, Homo sapiens
taaccttgaagtga

SEQ ID NO: 4736951 - DNA, 18 bp, Homo sapiens
taacgtttctcattaaaa

SEQ ID NO: 4736952 - DNA, 15 bp, Homo sapiens
taacgtttttccttt

SEQ ID NO: 4736953 - DNA, 20 bp, Homo sapiens
taacgtttttcctttaaaaa

SEQ ID NO: 4736954 - DNA, 14 bp, Homo sapiens
taactagaactgaa

SEQ ID NO: 4736955 - DNA, 14 bp, Homo sapiens
taactgctgatttt

SEQ ID NO: 4736956 - DNA, 23 bp, Homo sapiens
taacttaacccagattttattta

SEQ ID NO: 4736957 - DNA, 19 bp, Homo sapiens
taacttccaaataaataat

SEQ ID NO: 4736958 - DNA, 13 bp, Homo sapiens
taactttctgggt

SEQ ID NO: 4736959 - DNA, 20 bp, Homo sapiens
taagaaacaactctttgaga

SEQ ID NO: 4736960 - DNA, 21 bp, Homo sapiens
taagaaacaactctttgagaa

SEQ ID NO: 4736961 - DNA, 21 bp, Homo sapiens
taagaactacaaacaaaattt

SEQ ID NO: 4736962 - DNA, 12 bp, Homo sapiens
taagaatagtct

SEQ ID NO: 4736963 - DNA, 15 bp, Homo sapiens
taagacattttcatg

SEQ ID NO: 4736964 - DNA, 21 bp, Homo sapiens
taagacattttcatgcttcca

SEQ ID NO: 4736965 - DNA, 12 bp, Homo sapiens
taagagggaggg

SEQ ID NO: 4736966 - DNA, 22 bp, Homo sapiens
taagagtgtagaagcattcctt

SEQ ID NO: 4736967 - DNA, 20 bp, Homo sapiens
taagatactcaagcaggttt

SEQ ID NO: 4736968 - DNA, 16 bp, Homo sapiens
taagattgtaaaaata

SEQ ID NO: 4736969 - DNA, 17 bp, Homo sapiens
taagattgtaaaaataa

SEQ ID NO: 4736970 - DNA, 17 bp, Homo sapiens
taagcagaccactgata

SEQ ID NO: 4736971 - DNA, 15 bp, Homo sapiens
taagcagagttcttt

SEQ ID NO: 4736972 - DNA, 16 bp, Homo sapiens
taagcagagttctttg

SEQ ID NO: 4736973 - DNA, 18 bp, Homo sapiens
taagcagtgtctgtgttt

SEQ ID NO: 4736974 - DNA, 18 bp, Homo sapiens
taagccacaaagtttgtg

SEQ ID NO: 4736975 - DNA, 20 bp, Homo sapiens
taagccacttaaaatgttca

SEQ ID NO: 4736976 - DNA, 17 bp, Homo sapiens
taagccagcaccggacc

SEQ ID NO: 4736977 - DNA, 22 bp, Homo sapiens
taagccagcaccggaccagcct

SEQ ID NO: 4736978 - DNA, 10 bp, Homo sapiens
taagctctga

SEQ ID NO: 4736979 - DNA, 9 bp, Homo sapiens
taaggaata

SEQ ID NO: 4736980 - DNA, 17 bp, Homo sapiens
taaggaatacctgtccc

SEQ ID NO: 4736981 - DNA, 18 bp, Homo sapiens
taaggcatgtgtgaaaca

SEQ ID NO: 4736982 - DNA, 16 bp, Homo sapiens
taaggcgtggagctgc

SEQ ID NO: 4736983 - DNA, 20 bp, Homo sapiens
taaggcgtggagctgcctga

SEQ ID NO: 4736984 - DNA, 14 bp, Homo sapiens
taagggcagagtca

SEQ ID NO: 4736985 - DNA, 13 bp, Homo sapiens
taagtatttcaaa

SEQ ID NO: 4736986 - DNA, 17 bp, Homo sapiens
taagtcaacctgcctga

SEQ ID NO: 4736987 - DNA, 19 bp, Homo sapiens
taagtctcgaatgtaattg

SEQ ID NO: 4736988 - DNA, 22 bp, Homo sapiens
taagtcttatcaagcagccaag

SEQ ID NO: 4736989 - DNA, 21 bp, Homo sapiens
taagtgacaccaataaatgtt

SEQ ID NO: 4736990 - DNA, 23 bp, Homo sapiens
taagtgacaccaataaatgtttg

SEQ ID NO: 4736991 - DNA, 16 bp, Homo sapiens
taagtgcgtgtgtaga

SEQ ID NO: 4736992 - DNA, 19 bp, Homo sapiens
taagtgcgtgtgtagagtt

SEQ ID NO: 4736993 - DNA, 15 bp, Homo sapiens
taagtggtgtgtgta

SEQ ID NO: 4736994 - DNA, 16 bp, Homo sapiens
taagtggtgtgtgtat

SEQ ID NO: 4736995 - DNA, 16 bp, Homo sapiens
taagtgtaaaagtagt

SEQ ID NO: 4736996 - DNA, 19 bp, Homo sapiens
taagttacaattacatctc

SEQ ID NO: 4736997 - DNA, 13 bp, Homo sapiens
taagttatctttg

SEQ ID NO: 4736998 - DNA, 15 bp, Homo sapiens
taagttcactttttt

SEQ ID NO: 4736999 - DNA, 16 bp, Homo sapiens
taagtttcaggtgaca

SEQ ID NO: 4737000 - DNA, 22 bp, Homo sapiens
taagttttttttttctcctctc

SEQ ID NO: 4737001 - DNA, 13 bp, Homo sapiens
taataaaataatt

SEQ ID NO: 4737002 - DNA, 16 bp, Homo sapiens
taataaaataattcta

SEQ ID NO: 4737003 - DNA, 18 bp, Homo sapiens
taataaaataattctaaa

SEQ ID NO: 4737004 - DNA, 17 bp, Homo sapiens
taataagacataacgtt

SEQ ID NO: 4737005 - DNA, 19 bp, Homo sapiens
taataagacataacgtttt

SEQ ID NO: 4737006 - DNA, 20 bp, Homo sapiens
taataatgcctaccttgtga

SEQ ID NO: 4737007 - DNA, 21 bp, Homo sapiens
taatagcgtcataactagaac

SEQ ID NO: 4737008 - DNA, 21 bp, Homo sapiens
taatagttcaggtaacaggca

SEQ ID NO: 4737009 - DNA, 21 bp, Homo sapiens
taatatagtaggggttgaaga

SEQ ID NO: 4737010 - DNA, 16 bp, Homo sapiens
taatatggggatgcag

SEQ ID NO: 4737011 - DNA, 18 bp, Homo sapiens
taatattcacatgttcta

SEQ ID NO: 4737012 - DNA, 12 bp, Homo sapiens
taatattctctg

SEQ ID NO: 4737013 - DNA, 14 bp, Homo sapiens
taatattctctgat

SEQ ID NO: 4737014 - DNA, 15 bp, Homo sapiens
taatatttattgaat

SEQ ID NO: 4737015 - DNA, 13 bp, Homo sapiens
taatatttcttca

SEQ ID NO: 4737016 - DNA, 15 bp, Homo sapiens
taatatttttaatta

SEQ ID NO: 4737017 - DNA, 15 bp, Homo sapiens
taatcagaatatcag

SEQ ID NO: 4737018 - DNA, 13 bp, Homo sapiens
taatcataacata

SEQ ID NO: 4737019 - DNA, 19 bp, Homo sapiens
taatcctgtaccaaatctg

SEQ ID NO: 4737020 - DNA, 16 bp, Homo sapiens
taatcgacctgcctcg

SEQ ID NO: 4737021 - DNA, 21 bp, Homo sapiens
taatctaaatttaattacctt

SEQ ID NO: 4737022 - DNA, 19 bp, Homo sapiens
taatctggcactactcagt

SEQ ID NO: 4737023 - DNA, 17 bp, Homo sapiens
taatctgggcagacatt

SEQ ID NO: 4737024 - DNA, 20 bp, Homo sapiens
taatctgggcagacattatg

SEQ ID NO: 4737025 - DNA, 15 bp, Homo sapiens
taatctgtaaatgaa

SEQ ID NO: 4737026 - DNA, 15 bp, Homo sapiens
taatctgttgtttga

SEQ ID NO: 4737027 - DNA, 16 bp, Homo sapiens
taatcttgaattgtaa

SEQ ID NO: 4737028 - DNA, 15 bp, Homo sapiens
taatcttttcacaaa

SEQ ID NO: 4737029 - DNA, 16 bp, Homo sapiens
taatcttttcacaaat

SEQ ID NO: 4737030 - DNA, 17 bp, Homo sapiens
taatcttttcacaaata

SEQ ID NO: 4737031 - DNA, 19 bp, Homo sapiens
taatcttttcacaaataaa

SEQ ID NO: 4737032 - DNA, 16 bp, Homo sapiens
taatgaaccgctgaat

SEQ ID NO: 4737033 - DNA, 18 bp, Homo sapiens
taatgaaccgctgaatat

SEQ ID NO: 4737034 - DNA, 20 bp, Homo sapiens
taatgaatcgtaatgaagtt

SEQ ID NO: 4737035 - DNA, 15 bp, Homo sapiens
taatgaatgcataaa

SEQ ID NO: 4737036 - DNA, 16 bp, Homo sapiens
taatgatttttgtgta

SEQ ID NO: 4737037 - DNA, 23 bp, Homo sapiens
gtcccaccttggctgcagggagt

SEQ ID NO: 4737038 - DNA, 15 bp, Homo sapiens
gtcccactcagtcca

SEQ ID NO: 4737039 - DNA, 21 bp, Homo sapiens
gtcccacttcccctcctaccc

SEQ ID NO: 4737040 - DNA, 17 bp, Homo sapiens
gtcccaggctgagcctc

SEQ ID NO: 4737041 - DNA, 19 bp, Homo sapiens
gtcccaggctgagcctcag

SEQ ID NO: 4737042 - DNA, 18 bp, Homo sapiens
gtcccataggcccagtga

SEQ ID NO: 4737043 - DNA, 11 bp, Homo sapiens
gtccccacact

SEQ ID NO: 4737044 - DNA, 24 bp, Homo sapiens
gtccccacactcctacacctaact

SEQ ID NO: 4737045 - DNA, 18 bp, Homo sapiens
gtccccaccgcagacagg

SEQ ID NO: 4737046 - DNA, 22 bp, Homo sapiens
gtccccaccgcagacaggacca

SEQ ID NO: 4737047 - DNA, 12 bp, Homo sapiens
gtccccctctgg

SEQ ID NO: 4737048 - DNA, 18 bp, Homo sapiens
gtccccctgacaacactc

SEQ ID NO: 4737049 - DNA, 16 bp, Homo sapiens
gtcccccttccatgga

SEQ ID NO: 4737050 - DNA, 18 bp, Homo sapiens
gtcccccttccatggact

SEQ ID NO: 4737051 - DNA, 19 bp, Homo sapiens
gtccccttctctcatctct

SEQ ID NO: 4737052 - DNA, 18 bp, Homo sapiens
gtccctcagaggccttgg

SEQ ID NO: 4737053 - DNA, 23 bp, Homo sapiens
gtccctccgggacctggtgctgc

SEQ ID NO: 4737054 - DNA, 18 bp, Homo sapiens
gtccctgaagtcttgcat

SEQ ID NO: 4737055 - DNA, 23 bp, Homo sapiens
gtccctgaagtcttgcattgaat

SEQ ID NO: 4737056 - DNA, 19 bp, Homo sapiens
gtccctgcacttgcagact

SEQ ID NO: 4737057 - DNA, 15 bp, Homo sapiens
gttgcccaggctggc

SEQ ID NO: 4737058 - DNA, 17 bp, Homo sapiens
gttgcccaggctggcgt

SEQ ID NO: 4737059 - DNA, 20 bp, Homo sapiens
gttgcctttatttgctgtta

SEQ ID NO: 4737060 - DNA, 12 bp, Homo sapiens
gttggaaaagaa

SEQ ID NO: 4737061 - DNA, 15 bp, Homo sapiens
gttggaatggatttt

SEQ ID NO: 4737062 - DNA, 14 bp, Homo sapiens
gttggccaggctgg

SEQ ID NO: 4737063 - DNA, 17 bp, Homo sapiens
gttggccaggctggtct

SEQ ID NO: 4737064 - DNA, 18 bp, Homo sapiens
gttggccaggctggtctc

SEQ ID NO: 4737065 - DNA, 20 bp, Homo sapiens
gttggcccctgcccggctgc

SEQ ID NO: 4737066 - DNA, 13 bp, Homo sapiens
gttggctggcctt

SEQ ID NO: 4737067 - DNA, 18 bp, Homo sapiens
gttgggccatactggcct

SEQ ID NO: 4737068 - DNA, 19 bp, Homo sapiens
gttgggccatactggcctc

SEQ ID NO: 4737069 - DNA, 20 bp, Homo sapiens
gttgggccatactggcctcg

SEQ ID NO: 4737070 - DNA, 17 bp, Homo sapiens
gttgggctggtgtcacc

SEQ ID NO: 4737071 - DNA, 14 bp, Homo sapiens
gttgggctgtgcct

SEQ ID NO: 4737072 - DNA, 18 bp, Homo sapiens
gttggggaagggcctgcc

SEQ ID NO: 4737073 - DNA, 19 bp, Homo sapiens
gttgggtgggtgggccctg

SEQ ID NO: 4737074 - DNA, 18 bp, Homo sapiens
gttggttatttgtgttat

SEQ ID NO: 4737075 - DNA, 23 bp, Homo sapiens
gttgtacatttatgatttaataa

SEQ ID NO: 4737076 - DNA, 23 bp, Homo sapiens
gttgtatggctgagcaagagaga

SEQ ID NO: 4737077 - DNA, 15 bp, Homo sapiens
gttgtcatgtgtatg

SEQ ID NO: 4737078 - DNA, 14 bp, Homo sapiens
gttgtctccctggc

SEQ ID NO: 4737079 - DNA, 17 bp, Homo sapiens
gttgtctccctggccct

SEQ ID NO: 4737080 - DNA, 19 bp, Homo sapiens
gttgtctccctggccctca

SEQ ID NO: 4737081 - DNA, 22 bp, Homo sapiens
gttgtctttctttgctgctgtg

SEQ ID NO: 4737082 - DNA, 15 bp, Homo sapiens
gttgttaataaaagt

SEQ ID NO: 4737083 - DNA, 21 bp, Homo sapiens
gttgttcccactgaaatggac

SEQ ID NO: 4737084 - DNA, 15 bp, Homo sapiens
gttgtttataataaa

SEQ ID NO: 4737085 - DNA, 14 bp, Homo sapiens
gttgtttctttcta

SEQ ID NO: 4737086 - DNA, 15 bp, Homo sapiens
gttgtttctttctag

SEQ ID NO: 4737087 - DNA, 18 bp, Homo sapiens
gtttaacttttttcttta

SEQ ID NO: 4737088 - DNA, 18 bp, Homo sapiens
gtttacaacaaacactgt

SEQ ID NO: 4737089 - DNA, 23 bp, Homo sapiens
gtttaccgtagcgtatacatttg

SEQ ID NO: 4737090 - DNA, 12 bp, Homo sapiens
gtttactgcttt

SEQ ID NO: 4737091 - DNA, 13 bp, Homo sapiens
gtttagctattta

SEQ ID NO: 4737092 - DNA, 15 bp, Homo sapiens
gtttatgggtttctt

SEQ ID NO: 4737093 - DNA, 16 bp, Homo sapiens
gtttattccaaagagt

SEQ ID NO: 4737094 - DNA, 16 bp, Homo sapiens
gtttcaattgcatctc

SEQ ID NO: 4737095 - DNA, 17 bp, Homo sapiens
gtttcaattgcatctcc

SEQ ID NO: 4737096 - DNA, 22 bp, Homo sapiens
gtttcaatttactttttaaaca

SEQ ID NO: 4737097 - DNA, 10 bp, Homo sapiens
gtttcaggtg

SEQ ID NO: 4737098 - DNA, 15 bp, Homo sapiens
gtttcaggtgacatg

SEQ ID NO: 4737099 - DNA, 18 bp, Homo sapiens
gtttcagttctgtgtaca

SEQ ID NO: 4737100 - DNA, 15 bp, Homo sapiens
gtttcccttgccctt

SEQ ID NO: 4737101 - DNA, 20 bp, Homo sapiens
gtttcctggcactgcttcca

SEQ ID NO: 4737102 - DNA, 15 bp, Homo sapiens
gtttctacctcccag

SEQ ID NO: 4737103 - DNA, 17 bp, Homo sapiens
gtttctcaaagaaattt

SEQ ID NO: 4737104 - DNA, 11 bp, Homo sapiens
gtttctccccc

SEQ ID NO: 4737105 - DNA, 20 bp, Homo sapiens
gtttctgaaaattaacactg

SEQ ID NO: 4737106 - DNA, 18 bp, Homo sapiens
gtttctgaaagggacgct

SEQ ID NO: 4737107 - DNA, 14 bp, Homo sapiens
gtttctggtctcta

SEQ ID NO: 4737108 - DNA, 16 bp, Homo sapiens
gtttcttagcttttta

SEQ ID NO: 4737109 - DNA, 14 bp, Homo sapiens
gtttcttgcttctg

SEQ ID NO: 4737110 - DNA, 14 bp, Homo sapiens
gtttgaagcctgga

SEQ ID NO: 4737111 - DNA, 20 bp, Homo sapiens
gtttgatagtgcttcttgta

SEQ ID NO: 4737112 - DNA, 16 bp, Homo sapiens
gtttgattcagacagc

SEQ ID NO: 4737113 - DNA, 22 bp, Homo sapiens
gtttgattcagacagctgcctg

SEQ ID NO: 4737114 - DNA, 14 bp, Homo sapiens
gtttgatttttatt

SEQ ID NO: 4737115 - DNA, 15 bp, Homo sapiens
gtttgcaaggaagcc

SEQ ID NO: 4737116 - DNA, 17 bp, Homo sapiens
gtttgcctctgcctctg

SEQ ID NO: 4737117 - DNA, 13 bp, Homo sapiens
gtttggagacaga

SEQ ID NO: 4737118 - DNA, 15 bp, Homo sapiens
gtttggccatctctg

SEQ ID NO: 4737119 - DNA, 18 bp, Homo sapiens
gtttggggatgagaaagg

SEQ ID NO: 4737120 - DNA, 17 bp, Homo sapiens
gtttgtcacatgaaaca

SEQ ID NO: 4737121 - DNA, 16 bp, Homo sapiens
gtttgtcctttaacta

SEQ ID NO: 4737122 - DNA, 15 bp, Homo sapiens
gtttgttatttacac

SEQ ID NO: 4737123 - DNA, 22 bp, Homo sapiens
gtttgttatttacactggtcta

SEQ ID NO: 4737124 - DNA, 20 bp, Homo sapiens
gtttgtttctgaaagggacg

SEQ ID NO: 4737125 - DNA, 14 bp, Homo sapiens
gttttacagtgttt

SEQ ID NO: 4737126 - DNA, 20 bp, Homo sapiens
gttttactcctttttattca

SEQ ID NO: 4737127 - DNA, 24 bp, Homo sapiens
gttttcaggagtgggttgatttca

SEQ ID NO: 4737128 - DNA, 17 bp, Homo sapiens
gttttctgaaaatataa

SEQ ID NO: 4737129 - DNA, 15 bp, Homo sapiens
gttttcttctaatca

SEQ ID NO: 4737130 - DNA, 13 bp, Homo sapiens
gttttgaaaagct

SEQ ID NO: 4737131 - DNA, 17 bp, Homo sapiens
gttttgaagattctatg

SEQ ID NO: 4737132 - DNA, 16 bp, Homo sapiens
gttttgccatgttggc

SEQ ID NO: 4737133 - DNA, 20 bp, Homo sapiens
gttttgccatgttggccagg

SEQ ID NO: 4737134 - DNA, 12 bp, Homo sapiens
gttttgtaaatt

SEQ ID NO: 4737135 - DNA, 14 bp, Homo sapiens
gttttgtaaatttc

SEQ ID NO: 4737136 - DNA, 16 bp, Homo sapiens
gttttgttcccctcct

SEQ ID NO: 4737137 - DNA, 22 bp, Homo sapiens
gttttgttctgtatattttgtt

SEQ ID NO: 4737138 - DNA, 15 bp, Homo sapiens
gtttttaactcaata

SEQ ID NO: 4737139 - DNA, 18 bp, Homo sapiens
gtttttataaaaaatggt

SEQ ID NO: 4737140 - DNA, 23 bp, Homo sapiens
gtttttataaaaaatggtgcctg

SEQ ID NO: 4737141 - DNA, 14 bp, Homo sapiens
gtttttcctttaaa

SEQ ID NO: 4737142 - DNA, 15 bp, Homo sapiens
gtttttcctttaaaa

SEQ ID NO: 4737143 - DNA, 11 bp, Homo sapiens
gtttttctatt

SEQ ID NO: 4737144 - DNA, 13 bp, Homo sapiens
gtttttctattaa

SEQ ID NO: 4737145 - DNA, 18 bp, Homo sapiens
gtttttctattaaaagac

SEQ ID NO: 4737146 - DNA, 19 bp, Homo sapiens
gtttttctattaaaagact

SEQ ID NO: 4737147 - DNA, 20 bp, Homo sapiens
gtttttctattaaaagactc

SEQ ID NO: 4737148 - DNA, 18 bp, Homo sapiens
gtttttggtttttaaaac

SEQ ID NO: 4737149 - DNA, 20 bp, Homo sapiens
gtttttttttatacactgta

SEQ ID NO: 4737150 - DNA, 23 bp, Homo sapiens
gtttttttttatacactgtaatg

SEQ ID NO: 4737151 - DNA, 16 bp, Homo sapiens
gttttttttttctcct

SEQ ID NO: 4737152 - DNA, 16 bp, Homo sapiens
taaaaaaaaatgcctt

SEQ ID NO: 4737153 - DNA, 18 bp, Homo sapiens
taaaaaaaaatgcctttg

SEQ ID NO: 4737154 - DNA, 17 bp, Homo sapiens
taaaaaaatttaagtgc

SEQ ID NO: 4737155 - DNA, 15 bp, Homo sapiens
taaaaaatggtgcct

SEQ ID NO: 4737156 - DNA, 14 bp, Homo sapiens
taaaaaatttatta

SEQ ID NO: 4737157 - DNA, 22 bp, Homo sapiens
taaaaacaaaggagataaatct

SEQ ID NO: 4737158 - DNA, 14 bp, Homo sapiens
ggaagtcctctggg

SEQ ID NO: 4737159 - DNA, 13 bp, Homo sapiens
ggaagtctgtgtc

SEQ ID NO: 4737160 - DNA, 14 bp, Homo sapiens
ggaagtgagaaggg

SEQ ID NO: 4737161 - DNA, 17 bp, Homo sapiens
ggaagttcaggctctga

SEQ ID NO: 4737162 - DNA, 16 bp, Homo sapiens
ggaatccactcccagg

SEQ ID NO: 4737163 - DNA, 19 bp, Homo sapiens
ggaatctggagagctagaa

SEQ ID NO: 4737164 - DNA, 19 bp, Homo sapiens
ggaatcttcacctcagagt

SEQ ID NO: 4737165 - DNA, 14 bp, Homo sapiens
ggaatgcctgagtg

SEQ ID NO: 4737166 - DNA, 20 bp, Homo sapiens
ggaattcatctctctttaat

SEQ ID NO: 4737167 - DNA, 17 bp, Homo sapiens
ggaatttataacaaata

SEQ ID NO: 4737168 - DNA, 15 bp, Homo sapiens
ggacaaaataaagtg

SEQ ID NO: 4737169 - DNA, 19 bp, Homo sapiens
ggacaaaataaagtgtgtg

SEQ ID NO: 4737170 - DNA, 20 bp, Homo sapiens
ggacaaaataaagtgtgtgt

SEQ ID NO: 4737171 - DNA, 21 bp, Homo sapiens
ggacaaacagtgaatttaagc

SEQ ID NO: 4737172 - DNA, 20 bp, Homo sapiens
ggacaagaccctctcaggct

SEQ ID NO: 4737173 - DNA, 20 bp, Homo sapiens
ggacaaggaggtctgtgcca

SEQ ID NO: 4737174 - DNA, 23 bp, Homo sapiens
ggacaaggatgatctaggaagac

SEQ ID NO: 4737175 - DNA, 23 bp, Homo sapiens
ggacaatggaccggagagtgggg

SEQ ID NO: 4737176 - DNA, 21 bp, Homo sapiens
ggacacagctcttctccaggc

SEQ ID NO: 4737177 - DNA, 22 bp, Homo sapiens
ggacactaaccacgctggacct

SEQ ID NO: 4737178 - DNA, 14 bp, Homo sapiens
ggacagaagaaggc

SEQ ID NO: 4737179 - DNA, 17 bp, Homo sapiens
ggacagaagcagctctt

SEQ ID NO: 4737180 - DNA, 15 bp, Homo sapiens
ggacagccacggcca

SEQ ID NO: 4737181 - DNA, 22 bp, Homo sapiens
ggacagccacggccaggccaga

SEQ ID NO: 4737182 - DNA, 23 bp, Homo sapiens
ggacaggcatgttctctgaggac

SEQ ID NO: 4737183 - DNA, 17 bp, Homo sapiens
ggacagggaggtgaccc

SEQ ID NO: 4737184 - DNA, 13 bp, Homo sapiens
ggacatggacaag

SEQ ID NO: 4737185 - DNA, 14 bp, Homo sapiens
ggacatttctctaa

SEQ ID NO: 4737186 - DNA, 15 bp, Homo sapiens
ggaccaagggcagag

SEQ ID NO: 4737187 - DNA, 13 bp, Homo sapiens
ggaccagcctggc

SEQ ID NO: 4737188 - DNA, 15 bp, Homo sapiens
ggaccagcctggccc

SEQ ID NO: 4737189 - DNA, 19 bp, Homo sapiens
ggaccagtcaacctgggca

SEQ ID NO: 4737190 - DNA, 15 bp, Homo sapiens
ggaccccgagcctgg

SEQ ID NO: 4737191 - DNA, 12 bp, Homo sapiens
ggacccctgcat

SEQ ID NO: 4737192 - DNA, 13 bp, Homo sapiens
ggacccgccggat

SEQ ID NO: 4737193 - DNA, 17 bp, Homo sapiens
ggacccgttcatggggg

SEQ ID NO: 4737194 - DNA, 19 bp, Homo sapiens
ggacccgttcatgggggag

SEQ ID NO: 4737195 - DNA, 22 bp, Homo sapiens
ggatccaataattttcctgtga

SEQ ID NO: 4737196 - DNA, 15 bp, Homo sapiens
ggatccacacctggt

SEQ ID NO: 4737197 - DNA, 13 bp, Homo sapiens
ggatccctcatcc

SEQ ID NO: 4737198 - DNA, 14 bp, Homo sapiens
ggatcctccaggtg

SEQ ID NO: 4737199 - DNA, 15 bp, Homo sapiens
ggatctgcccctccc

SEQ ID NO: 4737200 - DNA, 17 bp, Homo sapiens
ggatgacagccaccctc

SEQ ID NO: 4737201 - DNA, 23 bp, Homo sapiens
ggatgacagccaccctcaccgcg

SEQ ID NO: 4737202 - DNA, 12 bp, Homo sapiens
ggatgagaaagg

SEQ ID NO: 4737203 - DNA, 21 bp, Homo sapiens
ggatgagaatttgagtgctct

SEQ ID NO: 4737204 - DNA, 18 bp, Homo sapiens
ggatgagagcccagaggt

SEQ ID NO: 4737205 - DNA, 23 bp, Homo sapiens
ggatgagagcccagaggtaacag

SEQ ID NO: 4737206 - DNA, 23 bp, Homo sapiens
ggatgatgtctttttattaaaat

SEQ ID NO: 4737207 - DNA, 21 bp, Homo sapiens
ggatgcctggtggcagctgcg

SEQ ID NO: 4737208 - DNA, 21 bp, Homo sapiens
ggatggcctggccagggcctg

SEQ ID NO: 4737209 - DNA, 19 bp, Homo sapiens
ggatgggggctctgcaccc

SEQ ID NO: 4737210 - DNA, 20 bp, Homo sapiens
ggatggtgacttttgaagaa

SEQ ID NO: 4737211 - DNA, 21 bp, Homo sapiens
ggatggtgacttttgaagaac

SEQ ID NO: 4737212 - DNA, 14 bp, Homo sapiens
ggatgtcgtctttg

SEQ ID NO: 4737213 - DNA, 16 bp, Homo sapiens
ggatgttctgggacac

SEQ ID NO: 4737214 - DNA, 21 bp, Homo sapiens
ggattattattagtgttttat

SEQ ID NO: 4737215 - DNA, 16 bp, Homo sapiens
ggattccaaagcattt

SEQ ID NO: 4737216 - DNA, 21 bp, Homo sapiens
ggattctggcctagtcccttc

SEQ ID NO: 4737217 - DNA, 13 bp, Homo sapiens
ggattgagtctgt

SEQ ID NO: 4737218 - DNA, 17 bp, Homo sapiens
ggattgcgagagatgtg

SEQ ID NO: 4737219 - DNA, 22 bp, Homo sapiens
ggattggattatttaataacat

SEQ ID NO: 4737220 - DNA, 23 bp, Homo sapiens
ggattgtgcctaatgtgtttgag

SEQ ID NO: 4737221 - DNA, 18 bp, Homo sapiens
ggatttaaaagcctgctc

SEQ ID NO: 4737222 - DNA, 19 bp, Homo sapiens
ggatttccagccagggctg

SEQ ID NO: 4737223 - DNA, 23 bp, Homo sapiens
ggattttgaattagattatttct

SEQ ID NO: 4737224 - DNA, 16 bp, Homo sapiens
ggatttttgtcttgtg

SEQ ID NO: 4737225 - DNA, 23 bp, Homo sapiens
ggcaaaagtctgaggcacctgca

SEQ ID NO: 4737226 - DNA, 15 bp, Homo sapiens
ggcaaattaaacaat

SEQ ID NO: 4737227 - DNA, 19 bp, Homo sapiens
ggcaaattaaacaatataa

SEQ ID NO: 4737228 - DNA, 23 bp, Homo sapiens
ggcaacttgggaactagactccc

SEQ ID NO: 4737229 - DNA, 12 bp, Homo sapiens
ggcaagcaagag

SEQ ID NO: 4737230 - DNA, 16 bp, Homo sapiens
ggcaaggacacagatg

SEQ ID NO: 4737231 - DNA, 14 bp, Homo sapiens
ggcaatgctggctg

SEQ ID NO: 4737232 - DNA, 18 bp, Homo sapiens
ggcacaccgggcactcag

SEQ ID NO: 4737233 - DNA, 18 bp, Homo sapiens
ggcacagtgtctgggctg

SEQ ID NO: 4737234 - DNA, 23 bp, Homo sapiens
ggcacatctaaattgatcattca

SEQ ID NO: 4737235 - DNA, 20 bp, Homo sapiens
ggcacccaccatcatgtctg

SEQ ID NO: 4737236 - DNA, 23 bp, Homo sapiens
ggcacccaccatcatgtctggct

SEQ ID NO: 4737237 - DNA, 15 bp, Homo sapiens
ggcacccggcccctg

SEQ ID NO: 4737238 - DNA, 16 bp, Homo sapiens
ggcacccggcccctgc

SEQ ID NO: 4737239 - DNA, 19 bp, Homo sapiens
ggcacccggcccctgctgg

SEQ ID NO: 4737240 - DNA, 22 bp, Homo sapiens
ggcacccggcccctgctggttc

SEQ ID NO: 4737241 - DNA, 22 bp, Homo sapiens
ggcacctgaaattaatttgtga

SEQ ID NO: 4737242 - DNA, 23 bp, Homo sapiens
ggcactcagaagacactgatggg

SEQ ID NO: 4737243 - DNA, 15 bp, Homo sapiens
ggcactgcatgttcc

SEQ ID NO: 4737244 - DNA, 20 bp, Homo sapiens
ggcactgccctggtggccct

SEQ ID NO: 4737245 - DNA, 15 bp, Homo sapiens
ggcactgctgggtgg

SEQ ID NO: 4737246 - DNA, 21 bp, Homo sapiens
ggcactgctgggtggcccatc

SEQ ID NO: 4737247 - DNA, 22 bp, Homo sapiens
ggcactgctgggtggcccatcc

SEQ ID NO: 4737248 - DNA, 24 bp, Homo sapiens
ggcactgcttccagtgaggctctg

SEQ ID NO: 4737249 - DNA, 17 bp, Homo sapiens
ggcagaagacaccagag

SEQ ID NO: 4737250 - DNA, 21 bp, Homo sapiens
ggcagaagacaccagagcaga

SEQ ID NO: 4737251 - DNA, 22 bp, Homo sapiens
ggcagaagacaccagagcagat

SEQ ID NO: 4737252 - DNA, 22 bp, Homo sapiens
ggcagagcagagaccatccctg

SEQ ID NO: 4737253 - DNA, 17 bp, Homo sapiens
ggcagagcttggactgg

SEQ ID NO: 4737254 - DNA, 20 bp, Homo sapiens
ggcagaggttgcagtgagcc

SEQ ID NO: 4737255 - DNA, 13 bp, Homo sapiens
ggcagcagggcta

SEQ ID NO: 4737256 - DNA, 18 bp, Homo sapiens
ggcagcagggctaccctg

SEQ ID NO: 4737257 - DNA, 16 bp, Homo sapiens
ggcagcaggtgctgct

SEQ ID NO: 4737258 - DNA, 21 bp, Homo sapiens
ggcagcaggtgctgctaccct

SEQ ID NO: 4737259 - DNA, 13 bp, Homo sapiens
ggcagcagtgtga

SEQ ID NO: 4737260 - DNA, 14 bp, Homo sapiens
ggcagcagtgtgag

SEQ ID NO: 4737261 - DNA, 19 bp, Homo sapiens
ggcagcagtgtgaggccag

SEQ ID NO: 4737262 - DNA, 14 bp, Homo sapiens
ggcagccaggccac

SEQ ID NO: 4737263 - DNA, 13 bp, Homo sapiens
ggcagccagggag

SEQ ID NO: 4737264 - DNA, 20 bp, Homo sapiens
ggcagccccattctgcctgc

SEQ ID NO: 4737265 - DNA, 12 bp, Homo sapiens
ggcagctcacct

SEQ ID NO: 4737266 - DNA, 13 bp, Homo sapiens
ggcagctcagaga

SEQ ID NO: 4737267 - DNA, 15 bp, Homo sapiens
ggcagctcatctctg

SEQ ID NO: 4737268 - DNA, 23 bp, Homo sapiens
ggcagctggaagtggctctgggg

SEQ ID NO: 4737269 - DNA, 16 bp, Homo sapiens
ggcaggactcagctcc

SEQ ID NO: 4737270 - DNA, 23 bp, Homo sapiens
ggcaggactcagctccccagagt

SEQ ID NO: 4737271 - DNA, 17 bp, Homo sapiens
gctggttggagagctag

SEQ ID NO: 4737272 - DNA, 18 bp, Homo sapiens
gctggttggagagctaga

SEQ ID NO: 4737273 - DNA, 23 bp, Homo sapiens
gctgtaaggatccggaaagaaga

SEQ ID NO: 4737274 - DNA, 19 bp, Homo sapiens
gctgtatcccatgagcctc

SEQ ID NO: 4737275 - DNA, 17 bp, Homo sapiens
gctgtattaagccactt

SEQ ID NO: 4737276 - DNA, 19 bp, Homo sapiens
gctgtattagtcacagaga

SEQ ID NO: 4737277 - DNA, 16 bp, Homo sapiens
gctgtccagtgcccat

SEQ ID NO: 4737278 - DNA, 18 bp, Homo sapiens
gctgtccagtgcccattc

SEQ ID NO: 4737279 - DNA, 20 bp, Homo sapiens
gctgtcccaagctcccaaga

SEQ ID NO: 4737280 - DNA, 15 bp, Homo sapiens
gctgtcccctcttgc

SEQ ID NO: 4737281 - DNA, 17 bp, Homo sapiens
gctgtcccctcttgccc

SEQ ID NO: 4737282 - DNA, 20 bp, Homo sapiens
gctgtcccctcttgccccaa

SEQ ID NO: 4737283 - DNA, 23 bp, Homo sapiens
gctgtcccctcttgccccaaccc

SEQ ID NO: 4737284 - DNA, 22 bp, Homo sapiens
gctgtgaataaaaagaaagatt

SEQ ID NO: 4737285 - DNA, 22 bp, Homo sapiens
gctgtgccaccctgggctctgt

SEQ ID NO: 4737286 - DNA, 15 bp, Homo sapiens
gctgtgctctggaca

SEQ ID NO: 4737287 - DNA, 18 bp, Homo sapiens
gctgtgctctggacaggc

SEQ ID NO: 4737288 - DNA, 12 bp, Homo sapiens
gctgtgctgccc

SEQ ID NO: 4737289 - DNA, 15 bp, Homo sapiens
gctgtgctgccctgc

SEQ ID NO: 4737290 - DNA, 16 bp, Homo sapiens
gctgtgctgccctgcc

SEQ ID NO: 4737291 - DNA, 22 bp, Homo sapiens
gctgtgctgccctgcccacctg

SEQ ID NO: 4737292 - DNA, 23 bp, Homo sapiens
gctgtggtgtgtccccctctgtc

SEQ ID NO: 4737293 - DNA, 13 bp, Homo sapiens
gctgttgtaaaga

SEQ ID NO: 4737294 - DNA, 15 bp, Homo sapiens
gctgttgtacattta

SEQ ID NO: 4737295 - DNA, 15 bp, Homo sapiens
gctgttttaatttgt

SEQ ID NO: 4737296 - DNA, 20 bp, Homo sapiens
gcttaaaaggtataattaaa

SEQ ID NO: 4737297 - DNA, 15 bp, Homo sapiens
gcttaacagttttag

SEQ ID NO: 4737298 - DNA, 12 bp, Homo sapiens
gcttagagcagt

SEQ ID NO: 4737299 - DNA, 17 bp, Homo sapiens
gcttagattttctgtaa

SEQ ID NO: 4737300 - DNA, 19 bp, Homo sapiens
gcttagctttgctctgcca

SEQ ID NO: 4737301 - DNA, 21 bp, Homo sapiens
gcttaggagaagtcttctatt

SEQ ID NO: 4737302 - DNA, 15 bp, Homo sapiens
gcttagtcactgaga

SEQ ID NO: 4737303 - DNA, 21 bp, Homo sapiens
gcttagtcactgagacagccc

SEQ ID NO: 4737304 - DNA, 16 bp, Homo sapiens
gcttcactgtataaat

SEQ ID NO: 4737305 - DNA, 12 bp, Homo sapiens
gcttcagcctcc

SEQ ID NO: 4737306 - DNA, 20 bp, Homo sapiens
gcttcaggttatcgaaataa

SEQ ID NO: 4737307 - DNA, 14 bp, Homo sapiens
gcttcagtggcagc

SEQ ID NO: 4737308 - DNA, 15 bp, Homo sapiens
gcttcagtggcagct

SEQ ID NO: 4737309 - DNA, 17 bp, Homo sapiens
gcttcattagagcaggc

SEQ ID NO: 4737310 - DNA, 22 bp, Homo sapiens
ggctcccttcccacctctctca

SEQ ID NO: 4737311 - DNA, 12 bp, Homo sapiens
ggctcctgccac

SEQ ID NO: 4737312 - DNA, 13 bp, Homo sapiens
ggctcctgccacc

SEQ ID NO: 4737313 - DNA, 22 bp, Homo sapiens
ggctcctgctgcaccaacccag

SEQ ID NO: 4737314 - DNA, 15 bp, Homo sapiens
ggctcctgttttgca

SEQ ID NO: 4737315 - DNA, 13 bp, Homo sapiens
ggctctgaccagt

SEQ ID NO: 4737316 - DNA, 13 bp, Homo sapiens
ggctctgcctccc

SEQ ID NO: 4737317 - DNA, 15 bp, Homo sapiens
ggctctgtgggctgc

SEQ ID NO: 4737318 - DNA, 18 bp, Homo sapiens
ggctctgtgggctgcact

SEQ ID NO: 4737319 - DNA, 15 bp, Homo sapiens
ggctcttccaggctg

SEQ ID NO: 4737320 - DNA, 20 bp, Homo sapiens
ggctcttctcatttcacccc

SEQ ID NO: 4737321 - DNA, 17 bp, Homo sapiens
ggctcttctccccagag

SEQ ID NO: 4737322 - DNA, 14 bp, Homo sapiens
ggctgaaggactgt

SEQ ID NO: 4737323 - DNA, 23 bp, Homo sapiens
ggctgcaaagggtatcaggtgct

SEQ ID NO: 4737324 - DNA, 17 bp, Homo sapiens
ggctgcaccggctggcc

SEQ ID NO: 4737325 - DNA, 16 bp, Homo sapiens
ggctgcactctgtgcc

SEQ ID NO: 4737326 - DNA, 19 bp, Homo sapiens
ggctgcactctgtgcccat

SEQ ID NO: 4737327 - DNA, 14 bp, Homo sapiens
ggctgcccgctccc

SEQ ID NO: 4737328 - DNA, 21 bp, Homo sapiens
ggctgcccgctcccagtgtct

SEQ ID NO: 4737329 - DNA, 10 bp, Homo sapiens
ggctgccctt

SEQ ID NO: 4737330 - DNA, 18 bp, Homo sapiens
ggctgccctttctgggca

SEQ ID NO: 4737331 - DNA, 16 bp, Homo sapiens
ggctgcctccactccc

SEQ ID NO: 4737332 - DNA, 19 bp, Homo sapiens
ggctgcctccactcccact

SEQ ID NO: 4737333 - DNA, 20 bp, Homo sapiens
ggctgcctccactcccactt

SEQ ID NO: 4737334 - DNA, 12 bp, Homo sapiens
ggctgctgccca

SEQ ID NO: 4737335 - DNA, 22 bp, Homo sapiens
ggctggaacagattcacactgt

SEQ ID NO: 4737336 - DNA, 14 bp, Homo sapiens
ggctggaatctgga

SEQ ID NO: 4737337 - DNA, 14 bp, Homo sapiens
ggctggaggagccc

SEQ ID NO: 4737338 - DNA, 18 bp, Homo sapiens
ggctggatgggggctctg

SEQ ID NO: 4737339 - DNA, 19 bp, Homo sapiens
ggctggccagccccacagc

SEQ ID NO: 4737340 - DNA, 17 bp, Homo sapiens
ggctggccctgccctgg

SEQ ID NO: 4737341 - DNA, 14 bp, Homo sapiens
ggctggcgtgcagt

SEQ ID NO: 4737342 - DNA, 18 bp, Homo sapiens
ggctgggctcccttccca

SEQ ID NO: 4737343 - DNA, 21 bp, Homo sapiens
ggctgggctcccttcccacct

SEQ ID NO: 4737344 - DNA, 12 bp, Homo sapiens
ggctgggcttca

SEQ ID NO: 4737345 - DNA, 21 bp, Homo sapiens
ggctgggcttcagtggcagct

SEQ ID NO: 4737346 - DNA, 21 bp, Homo sapiens
ggctggggaagtcctctgggt

SEQ ID NO: 4737347 - DNA, 15 bp, Homo sapiens
ggctgggggcctcag

SEQ ID NO: 4737348 - DNA, 10 bp, Homo sapiens
ggctgggtgc

SEQ ID NO: 4737349 - DNA, 19 bp, Homo sapiens
ggctgggttctacccaggt

SEQ ID NO: 4737350 - DNA, 14 bp, Homo sapiens
ggctgggttggagg

SEQ ID NO: 4737351 - DNA, 13 bp, Homo sapiens
ggctgtcccaagc

SEQ ID NO: 4737352 - DNA, 18 bp, Homo sapiens
ggctgtcccaagctccca

SEQ ID NO: 4737353 - DNA, 18 bp, Homo sapiens
ggctgtgtgaatttttct

SEQ ID NO: 4737354 - DNA, 20 bp, Homo sapiens
ggctgttggctgggggcctc

SEQ ID NO: 4737355 - DNA, 12 bp, Homo sapiens
ggctgtttactg

SEQ ID NO: 4737356 - DNA, 14 bp, Homo sapiens
ggcttagtcactga

SEQ ID NO: 4737357 - DNA, 21 bp, Homo sapiens
ggcttagtcactgagacagcc

SEQ ID NO: 4737358 - DNA, 19 bp, Homo sapiens
ggcttcactgtataaatag

SEQ ID NO: 4737359 - DNA, 22 bp, Homo sapiens
ggcttcactgtataaataggag

SEQ ID NO: 4737360 - DNA, 19 bp, Homo sapiens
ggcttcagtggcagctgct

SEQ ID NO: 4737361 - DNA, 18 bp, Homo sapiens
ggcttcattagagcaggc

SEQ ID NO: 4737362 - DNA, 20 bp, Homo sapiens
ggcttcccagtggctgctgc

SEQ ID NO: 4737363 - DNA, 22 bp, Homo sapiens
ggcttgagtttaaattgtaata

SEQ ID NO: 4737364 - DNA, 20 bp, Homo sapiens
ggcttgctttcttctcctgt

SEQ ID NO: 4737365 - DNA, 17 bp, Homo sapiens
ggctttggcaacagaaa

SEQ ID NO: 4737366 - DNA, 23 bp, Homo sapiens
ggcttttaccattagcataattt

SEQ ID NO: 4737367 - DNA, 18 bp, Homo sapiens
gggaaaattatttgcata

SEQ ID NO: 4737368 - DNA, 14 bp, Homo sapiens
gggaacagactgga

SEQ ID NO: 4737369 - DNA, 16 bp, Homo sapiens
gggaacatggggagga

SEQ ID NO: 4737370 - DNA, 22 bp, Homo sapiens
gggaactcacctggggctgctg

SEQ ID NO: 4737371 - DNA, 16 bp, Homo sapiens
gggaagagcacagccc

SEQ ID NO: 4737372 - DNA, 16 bp, Homo sapiens
gggaagggcctgccca

SEQ ID NO: 4737373 - DNA, 14 bp, Homo sapiens
gggaagggggctgg

SEQ ID NO: 4737374 - DNA, 23 bp, Homo sapiens
gggaagtgacttagcagatgctg

SEQ ID NO: 4737375 - DNA, 22 bp, Homo sapiens
gggaatatgagtgcgtggtgcg

SEQ ID NO: 4737376 - DNA, 14 bp, Homo sapiens
gggaatgaacctgg

SEQ ID NO: 4737377 - DNA, 21 bp, Homo sapiens
gggaatgcctgagtgcctggc

SEQ ID NO: 4737378 - DNA, 19 bp, Homo sapiens
gggaatgtttgcctctgcc

SEQ ID NO: 4737379 - DNA, 17 bp, Homo sapiens
gggaattaaataaataa

SEQ ID NO: 4737380 - DNA, 17 bp, Homo sapiens
gggaatttcttcaactc

SEQ ID NO: 4737381 - DNA, 13 bp, Homo sapiens
gggacagctcctt

SEQ ID NO: 4737382 - DNA, 22 bp, Homo sapiens
gggaccagaaacctgggagaga

SEQ ID NO: 4737383 - DNA, 23 bp, Homo sapiens
gggaccagaaacctgggagagac

SEQ ID NO: 4737384 - DNA, 18 bp, Homo sapiens
gggaccccgagcctggct

SEQ ID NO: 4737385 - DNA, 13 bp, Homo sapiens
gggacccctcctc

SEQ ID NO: 4737386 - DNA, 14 bp, Homo sapiens
gggacccctgagct

SEQ ID NO: 4737387 - DNA, 17 bp, Homo sapiens
gggacctgatggagagt

SEQ ID NO: 4737388 - DNA, 16 bp, Homo sapiens
gggacgcaggcccctc

SEQ ID NO: 4737389 - DNA, 19 bp, Homo sapiens
gggactcaatgcactgaca

SEQ ID NO: 4737390 - DNA, 14 bp, Homo sapiens
gggcagcagggcta

SEQ ID NO: 4737391 - DNA, 11 bp, Homo sapiens
gggcagccagg

SEQ ID NO: 4737392 - DNA, 19 bp, Homo sapiens
gggcagccagggagagccc

SEQ ID NO: 4737393 - DNA, 13 bp, Homo sapiens
gggcagccctcct

SEQ ID NO: 4737394 - DNA, 18 bp, Homo sapiens
gggcagccctccttacca

SEQ ID NO: 4737395 - DNA, 15 bp, Homo sapiens
gggcaggaaggggaa

SEQ ID NO: 4737396 - DNA, 22 bp, Homo sapiens
gggcaggactcagctccccaga

SEQ ID NO: 4737397 - DNA, 14 bp, Homo sapiens
gggcaggccctgca

SEQ ID NO: 4737398 - DNA, 18 bp, Homo sapiens
gggcatgggtcgggagag

SEQ ID NO: 4737399 - DNA, 21 bp, Homo sapiens
gggcatgggtcgggagagggg

SEQ ID NO: 4737400 - DNA, 19 bp, Homo sapiens
gggcatgtattagccagtc

SEQ ID NO: 4737401 - DNA, 14 bp, Homo sapiens
gggccagttggtcc

SEQ ID NO: 4737402 - DNA, 18 bp, Homo sapiens
gggccagttggtccccct

SEQ ID NO: 4737403 - DNA, 23 bp, Homo sapiens
gggccagttggtcccccttccat

SEQ ID NO: 4737404 - DNA, 14 bp, Homo sapiens
gggcccgcttgcct

SEQ ID NO: 4737405 - DNA, 20 bp, Homo sapiens
gggcccgcttgcctcggctc

SEQ ID NO: 4737406 - DNA, 20 bp, Homo sapiens
gggcccgttgtctccctggc

SEQ ID NO: 4737407 - DNA, 22 bp, Homo sapiens
gggcccgttgtctccctggccc

SEQ ID NO: 4737408 - DNA, 23 bp, Homo sapiens
gggcccgttgtctccctggccct

SEQ ID NO: 4737409 - DNA, 16 bp, Homo sapiens
gggccctctctgctct

SEQ ID NO: 4737410 - DNA, 12 bp, Homo sapiens
gggccctgcctg

SEQ ID NO: 4737411 - DNA, 14 bp, Homo sapiens
gggccggccaggtg

SEQ ID NO: 4737412 - DNA, 15 bp, Homo sapiens
gggccggccaggtgg

SEQ ID NO: 4737413 - DNA, 14 bp, Homo sapiens
gggcctatcagtgt

SEQ ID NO: 4737414 - DNA, 14 bp, Homo sapiens
gggcctcagtgcca

SEQ ID NO: 4737415 - DNA, 15 bp, Homo sapiens
gggcctcagtgccac

SEQ ID NO: 4737416 - DNA, 19 bp, Homo sapiens
gggcctcttatgggctggg

SEQ ID NO: 4737417 - DNA, 12 bp, Homo sapiens
gggcctggcctg

SEQ ID NO: 4737418 - DNA, 14 bp, Homo sapiens
gggcctggcctgag

SEQ ID NO: 4737419 - DNA, 19 bp, Homo sapiens
gggcctggcctgagctggg

SEQ ID NO: 4737420 - DNA, 14 bp, Homo sapiens
gggcctggctcagg

SEQ ID NO: 4737421 - DNA, 13 bp, Homo sapiens
gggcgcaaagggc

SEQ ID NO: 4737422 - DNA, 18 bp, Homo sapiens
gggcgcaaagggcatggg

SEQ ID NO: 4737423 - DNA, 15 bp, Homo sapiens
gggcgggaggatgtt

SEQ ID NO: 4737424 - DNA, 13 bp, Homo sapiens
gggctaatttaac

SEQ ID NO: 4737425 - DNA, 13 bp, Homo sapiens
gggctaccctgag

SEQ ID NO: 4737426 - DNA, 20 bp, Homo sapiens
gggctaccctgagctgaggc

SEQ ID NO: 4737427 - DNA, 17 bp, Homo sapiens
gggctagaacctggaga

SEQ ID NO: 4737428 - DNA, 16 bp, Homo sapiens
gggctagaacctggca

SEQ ID NO: 4737429 - DNA, 18 bp, Homo sapiens
gggctagttgggcttcct

SEQ ID NO: 4737430 - DNA, 15 bp, Homo sapiens
gggctcagagaggac

SEQ ID NO: 4737431 - DNA, 18 bp, Homo sapiens
gggctcagagaggacaaa

SEQ ID NO: 4737432 - DNA, 21 bp, Homo sapiens
gggctcagcggggacagctcc

SEQ ID NO: 4737433 - DNA, 10 bp, Homo sapiens
gggctccaga

SEQ ID NO: 4737434 - DNA, 12 bp, Homo sapiens
gggctccctgac

SEQ ID NO: 4737435 - DNA, 13 bp, Homo sapiens
gggctcccttccc

SEQ ID NO: 4737436 - DNA, 23 bp, Homo sapiens
gggctcgaagaaaataattctct

SEQ ID NO: 4737437 - DNA, 16 bp, Homo sapiens
gggctctgcctcccat

SEQ ID NO: 4737438 - DNA, 11 bp, Homo sapiens
gggctctgtgg

SEQ ID NO: 4737439 - DNA, 19 bp, Homo sapiens
gggctctgtgggctgcact

SEQ ID NO: 4737440 - DNA, 12 bp, Homo sapiens
gggctgagggag

SEQ ID NO: 4737441 - DNA, 14 bp, Homo sapiens
gggctgagggagcc

SEQ ID NO: 4737442 - DNA, 14 bp, Homo sapiens
gggctgcaccggct

SEQ ID NO: 4737443 - DNA, 17 bp, Homo sapiens
gggctgcaccggctggc

SEQ ID NO: 4737444 - DNA, 16 bp, Homo sapiens
gggctgcactctgtgc

SEQ ID NO: 4737445 - DNA, 14 bp, Homo sapiens
gggctgcccgctcc

SEQ ID NO: 4737446 - DNA, 21 bp, Homo sapiens
gggctggaatctggagagcta

SEQ ID NO: 4737447 - DNA, 14 bp, Homo sapiens
gggctggactgagg

SEQ ID NO: 4737448 - DNA, 14 bp, Homo sapiens
gggctggaggagcc

SEQ ID NO: 4737449 - DNA, 18 bp, Homo sapiens
gggctggaggagcccagg

SEQ ID NO: 4737450 - DNA, 22 bp, Homo sapiens
gggctggaggagcccaggccag

SEQ ID NO: 4737451 - DNA, 17 bp, Homo sapiens
gggctgggttctaccca

SEQ ID NO: 4737452 - DNA, 19 bp, Homo sapiens
gggctgggttggcgcaccc

SEQ ID NO: 4737453 - DNA, 13 bp, Homo sapiens
gggcttagagcag

SEQ ID NO: 4737454 - DNA, 15 bp, Homo sapiens
gggcttcagtggcag

SEQ ID NO: 4737455 - DNA, 20 bp, Homo sapiens
gggcttcagtggcagctgct

SEQ ID NO: 4737456 - DNA, 20 bp, Homo sapiens
gggcttcccagtggctgctg

SEQ ID NO: 4737457 - DNA, 21 bp, Homo sapiens
ggggaagacccattccttccc

SEQ ID NO: 4737458 - DNA, 22 bp, Homo sapiens
ggggaagacccattccttccca

SEQ ID NO: 4737459 - DNA, 23 bp, Homo sapiens
ggggaagatgaaaccgtccctga

SEQ ID NO: 4737460 - DNA, 13 bp, Homo sapiens
ggggaaggcaggg

SEQ ID NO: 4737461 - DNA, 18 bp, Homo sapiens
ggggaatgtttgcctctg

SEQ ID NO: 4737462 - DNA, 22 bp, Homo sapiens
ggggaatgtttgcctctgcctc

SEQ ID NO: 4737463 - DNA, 17 bp, Homo sapiens
ggggagactgggctgag

SEQ ID NO: 4737464 - DNA, 18 bp, Homo sapiens
ggggaggggctgtgggcg

SEQ ID NO: 4737465 - DNA, 11 bp, Homo sapiens
ggggagtgagt

SEQ ID NO: 4737466 - DNA, 21 bp, Homo sapiens
ggggatttccagccagggctg

SEQ ID NO: 4737467 - DNA, 20 bp, Homo sapiens
ggggcagctgatacaaattg

SEQ ID NO: 4737468 - DNA, 14 bp, Homo sapiens
ggggcaggcacagc

SEQ ID NO: 4737469 - DNA, 13 bp, Homo sapiens
ggggccagaggct

SEQ ID NO: 4737470 - DNA, 15 bp, Homo sapiens
ggggccatgctgaga

SEQ ID NO: 4737471 - DNA, 16 bp, Homo sapiens
ggggcccatggaggag

SEQ ID NO: 4737472 - DNA, 19 bp, Homo sapiens
ggggcccatggaggagaca

SEQ ID NO: 4737473 - DNA, 15 bp, Homo sapiens
ggtgtaataagacat

SEQ ID NO: 4737474 - DNA, 18 bp, Homo sapiens
ggtgtaataagacataac

SEQ ID NO: 4737475 - DNA, 19 bp, Homo sapiens
ggtgtcacctgaagactca

SEQ ID NO: 4737476 - DNA, 17 bp, Homo sapiens
ggtgtcgcgccttctcc

SEQ ID NO: 4737477 - DNA, 23 bp, Homo sapiens
ggtgtctccaaccccccagcact

SEQ ID NO: 4737478 - DNA, 15 bp, Homo sapiens
ggtgtgatcgtctga

SEQ ID NO: 4737479 - DNA, 23 bp, Homo sapiens
ggtgtgtccccctctgtccaggc

SEQ ID NO: 4737480 - DNA, 15 bp, Homo sapiens
ggtgtgtgtctctga

SEQ ID NO: 4737481 - DNA, 16 bp, Homo sapiens
ggtgttgtatggctga

SEQ ID NO: 4737482 - DNA, 10 bp, Homo sapiens
ggtgtttcta

SEQ ID NO: 4737483 - DNA, 21 bp, Homo sapiens
ggttaacaataaagtgacaaa

SEQ ID NO: 4737484 - DNA, 16 bp, Homo sapiens
ggttagggaaaacatt

SEQ ID NO: 4737485 - DNA, 23 bp, Homo sapiens
ggttatcgaaataacaatgttaa

SEQ ID NO: 4737486 - DNA, 23 bp, Homo sapiens
ggttcaacaaagaaacaaagatg

SEQ ID NO: 4737487 - DNA, 21 bp, Homo sapiens
ggttcaagcgattcttctgct

SEQ ID NO: 4737488 - DNA, 23 bp, Homo sapiens
ggttcaagcgattcttctgcttc

SEQ ID NO: 4737489 - DNA, 22 bp, Homo sapiens
ggttcagggttggcccctgccc

SEQ ID NO: 4737490 - DNA, 15 bp, Homo sapiens
ggttcatcatccctc

SEQ ID NO: 4737491 - DNA, 22 bp, Homo sapiens
ggttccctttgacgccatccca

SEQ ID NO: 4737492 - DNA, 22 bp, Homo sapiens
ggttcccttttttggctgctga

SEQ ID NO: 4737493 - DNA, 22 bp, Homo sapiens
ggttccgcttggagcagagggg

SEQ ID NO: 4737494 - DNA, 23 bp, Homo sapiens
ggttccgcttggagcagaggggc

SEQ ID NO: 4737495 - DNA, 16 bp, Homo sapiens
ggttccggcatggaca

SEQ ID NO: 4737496 - DNA, 21 bp, Homo sapiens
ggttctgatgatgtgcctggg

SEQ ID NO: 4737497 - DNA, 16 bp, Homo sapiens
ggttgaccccagagga

SEQ ID NO: 4737498 - DNA, 15 bp, Homo sapiens
ggttggagagctaga

SEQ ID NO: 4737499 - DNA, 17 bp, Homo sapiens
ggttggcgcaccctccc

SEQ ID NO: 4737500 - DNA, 18 bp, Homo sapiens
ggttggcgcaccctcccc

SEQ ID NO: 4737501 - DNA, 11 bp, Homo sapiens
ggttggctggc

SEQ ID NO: 4737502 - DNA, 16 bp, Homo sapiens
ggtttacaacaaacac

SEQ ID NO: 4737503 - DNA, 12 bp, Homo sapiens
ggtttcaattta

SEQ ID NO: 4737504 - DNA, 12 bp, Homo sapiens
ggtttcctgccc

SEQ ID NO: 4737505 - DNA, 17 bp, Homo sapiens
ggtttgaagcctggaac

SEQ ID NO: 4737506 - DNA, 18 bp, Homo sapiens
ggtttgcaaaagggcttc

SEQ ID NO: 4737507 - DNA, 14 bp, Homo sapiens
ggtttgcaaggaag

SEQ ID NO: 4737508 - DNA, 23 bp, Homo sapiens
ggtttggccatctctggatgcct

SEQ ID NO: 4737509 - DNA, 17 bp, Homo sapiens
ggttttgtattctctga

SEQ ID NO: 4737510 - DNA, 16 bp, Homo sapiens
gtaaaaacagatattg

SEQ ID NO: 4737511 - DNA, 16 bp, Homo sapiens
gtaaaagttttatagt

SEQ ID NO: 4737512 - DNA, 14 bp, Homo sapiens
gtaaaatcttcagc

SEQ ID NO: 4737513 - DNA, 16 bp, Homo sapiens
gtaaacataccaacat

SEQ ID NO: 4737514 - DNA, 16 bp, Homo sapiens
gtaaagccaaaaccat

SEQ ID NO: 4737515 - DNA, 17 bp, Homo sapiens
gtaaatactggactcag

SEQ ID NO: 4737516 - DNA, 16 bp, Homo sapiens
gtaaatatatgaacat

SEQ ID NO: 4737517 - DNA, 15 bp, Homo sapiens
gtaaatatgtgaaga

SEQ ID NO: 4737518 - DNA, 17 bp, Homo sapiens
gtaaatatgtgaagaaa

SEQ ID NO: 4737519 - DNA, 21 bp, Homo sapiens
gtaaatgaacacatggcagaa

SEQ ID NO: 4737520 - DNA, 17 bp, Homo sapiens
gtaaatgcagcgtgaag

SEQ ID NO: 4737521 - DNA, 14 bp, Homo sapiens
gtaaattttatggc

SEQ ID NO: 4737522 - DNA, 16 bp, Homo sapiens
gtaaattttgtgatga

SEQ ID NO: 4737523 - DNA, 15 bp, Homo sapiens
gtaacagaacagctt

SEQ ID NO: 4737524 - DNA, 21 bp, Homo sapiens
gtaacagaacagcttcaggtt

SEQ ID NO: 4737525 - DNA, 16 bp, Homo sapiens
gtaacattagttttaa

SEQ ID NO: 4737526 - DNA, 15 bp, Homo sapiens
gtaactaatgttatt

SEQ ID NO: 4737527 - DNA, 22 bp, Homo sapiens
gtaacttattatcactttgggg

SEQ ID NO: 4737528 - DNA, 22 bp, Homo sapiens
gtaagagtgtagaagcattcct

SEQ ID NO: 4737529 - DNA, 16 bp, Homo sapiens
gtaagctctatctgca

SEQ ID NO: 4737530 - DNA, 18 bp, Homo sapiens
gtaaggaatacctgtccc

SEQ ID NO: 4737531 - DNA, 16 bp, Homo sapiens
gtaagtataacaaact

SEQ ID NO: 4737532 - DNA, 16 bp, Homo sapiens
gtaagttatctttgaa

SEQ ID NO: 4737533 - DNA, 13 bp, Homo sapiens
gtaataagacata

SEQ ID NO: 4737534 - DNA, 13 bp, Homo sapiens
gtaataatagact

SEQ ID NO: 4737535 - DNA, 23 bp, Homo sapiens
gtaatattgtaaatactggactc

SEQ ID NO: 4737536 - DNA, 17 bp, Homo sapiens
gtaatcgacctgcctcg

SEQ ID NO: 4737537 - DNA, 17 bp, Homo sapiens
gtaatgaaccgctgaat

SEQ ID NO: 4737538 - DNA, 18 bp, Homo sapiens
gtaatgatgtcgtttgaa

SEQ ID NO: 4737539 - DNA, 16 bp, Homo sapiens
gtaatgcttatgtgtt

SEQ ID NO: 4737540 - DNA, 15 bp, Homo sapiens
gtaattagtaacatg

SEQ ID NO: 4737541 - DNA, 23 bp, Homo sapiens
gtaattagtaacatgtgttaagt

SEQ ID NO: 4737542 - DNA, 13 bp, Homo sapiens
gtaattggaatct

SEQ ID NO: 4737543 - DNA, 16 bp, Homo sapiens
gtaattggaatcttca

SEQ ID NO: 4737544 - DNA, 18 bp, Homo sapiens
gtaatttctaaagcagtt

SEQ ID NO: 4737545 - DNA, 18 bp, Homo sapiens
gtacaaggtatgtacagt

SEQ ID NO: 4737546 - DNA, 17 bp, Homo sapiens
gtacagtctcaattttg

SEQ ID NO: 4737547 - DNA, 22 bp, Homo sapiens
gtacagtctcaattttgtattt

SEQ ID NO: 4737548 - DNA, 12 bp, Homo sapiens
gtacagttttta

SEQ ID NO: 4737549 - DNA, 13 bp, Homo sapiens
gtacagtttttat

SEQ ID NO: 4737550 - DNA, 19 bp, Homo sapiens
gtacatttatgatttaata

SEQ ID NO: 4737551 - DNA, 20 bp, Homo sapiens
gtacatttatgatttaataa

SEQ ID NO: 4737552 - DNA, 22 bp, Homo sapiens
gtacatttatgatttaataaaa

SEQ ID NO: 4737553 - DNA, 18 bp, Homo sapiens
gtaccaaatctgacatat

SEQ ID NO: 4737554 - DNA, 18 bp, Homo sapiens
gtaccatggttgtgcaca

SEQ ID NO: 4737555 - DNA, 18 bp, Homo sapiens
gtacccaaaagctcagcc

SEQ ID NO: 4737556 - DNA, 13 bp, Homo sapiens
gtacccactgctc

SEQ ID NO: 4737557 - DNA, 15 bp, Homo sapiens
gtacccactgctctg

SEQ ID NO: 4737558 - DNA, 16 bp, Homo sapiens
gtacccactgctctgg

SEQ ID NO: 4737559 - DNA, 23 bp, Homo sapiens
gtacgaacctacagttttaactg

SEQ ID NO: 4737560 - DNA, 19 bp, Homo sapiens
tccatctgtgccatacttg

SEQ ID NO: 4737561 - DNA, 12 bp, Homo sapiens
tccatgaaaatg

SEQ ID NO: 4737562 - DNA, 14 bp, Homo sapiens
tccatgatgctggg

SEQ ID NO: 4737563 - DNA, 16 bp, Homo sapiens
tccatgggcagagccc

SEQ ID NO: 4737564 - DNA, 22 bp, Homo sapiens
tccatgggcagagcccaaggga

SEQ ID NO: 4737565 - DNA, 15 bp, Homo sapiens
tccattaactgcttt

SEQ ID NO: 4737566 - DNA, 12 bp, Homo sapiens
tccattctggaa

SEQ ID NO: 4737567 - DNA, 13 bp, Homo sapiens
tccattctggaag

SEQ ID NO: 4737568 - DNA, 12 bp, Homo sapiens
tccatttgcaag

SEQ ID NO: 4737569 - DNA, 13 bp, Homo sapiens
tccatttttgttg

SEQ ID NO: 4737570 - DNA, 16 bp, Homo sapiens
tcccaaagtgctggga

SEQ ID NO: 4737571 - DNA, 15 bp, Homo sapiens
tcccaacatggtcct

SEQ ID NO: 4737572 - DNA, 13 bp, Homo sapiens
tcccaacccccag

SEQ ID NO: 4737573 - DNA, 19 bp, Homo sapiens
tcccaacccccagccccca

SEQ ID NO: 4737574 - DNA, 21 bp, Homo sapiens
tcccaacccccagcccccacc

SEQ ID NO: 4737575 - DNA, 16 bp, Homo sapiens
tcccaactcaccccag

SEQ ID NO: 4737576 - DNA, 19 bp, Homo sapiens
tcccaagctcccaagagct

SEQ ID NO: 4737577 - DNA, 15 bp, Homo sapiens
tcccaagctctgctc

SEQ ID NO: 4737578 - DNA, 17 bp, Homo sapiens
tcccaagctctgctcct

SEQ ID NO: 4737579 - DNA, 14 bp, Homo sapiens
tcccacctcagcct

SEQ ID NO: 4737580 - DNA, 14 bp, Homo sapiens
tcccacctctctca

SEQ ID NO: 4737581 - DNA, 18 bp, Homo sapiens
tcccacctctctcactcc

SEQ ID NO: 4737582 - DNA, 22 bp, Homo sapiens
tcccacctctctcactccttga

SEQ ID NO: 4737583 - DNA, 16 bp, Homo sapiens
tcccaccttgccaaag

SEQ ID NO: 4737584 - DNA, 19 bp, Homo sapiens
tcccaccttggctgcaggg

SEQ ID NO: 4737585 - DNA, 20 bp, Homo sapiens
tcccactgcaccccctcctg

SEQ ID NO: 4737586 - DNA, 18 bp, Homo sapiens
tcccagagctgcacaggg

SEQ ID NO: 4737587 - DNA, 23 bp, Homo sapiens
tcccagaggggcctgccacctgg

SEQ ID NO: 4737588 - DNA, 19 bp, Homo sapiens
tcccagattggctcacact

SEQ ID NO: 4737589 - DNA, 21 bp, Homo sapiens
tcccagattggctcacactga

SEQ ID NO: 4737590 - DNA, 22 bp, Homo sapiens
tcccagattggctcacactgag

SEQ ID NO: 4737591 - DNA, 23 bp, Homo sapiens
tcccagattggctcacactgaga

SEQ ID NO: 4737592 - DNA, 21 bp, Homo sapiens
tcccagccttggcatctagag

SEQ ID NO: 4737593 - DNA, 23 bp, Homo sapiens
tcccagctgtgctctggacaggc

SEQ ID NO: 4737594 - DNA, 20 bp, Homo sapiens
tcccaggcattccccaggag

SEQ ID NO: 4737595 - DNA, 16 bp, Homo sapiens
tcccaggctgagcctc

SEQ ID NO: 4737596 - DNA, 19 bp, Homo sapiens
tcccaggtaagcaggagga

SEQ ID NO: 4737597 - DNA, 23 bp, Homo sapiens
tcccagtacctcctgtctctggc

SEQ ID NO: 4737598 - DNA, 22 bp, Homo sapiens
tcccagtataagatttttgaaa

SEQ ID NO: 4737599 - DNA, 16 bp, Homo sapiens
tcccagtggctgctgc

SEQ ID NO: 4737600 - DNA, 21 bp, Homo sapiens
tcccagtggctgctgcccagg

SEQ ID NO: 4737601 - DNA, 22 bp, Homo sapiens
tcccagtggctgctgcccaggc

SEQ ID NO: 4737602 - DNA, 18 bp, Homo sapiens
tcccagtttcccactctg

SEQ ID NO: 4737603 - DNA, 18 bp, Homo sapiens
tcccataaccgctgattc

SEQ ID NO: 4737604 - DNA, 15 bp, Homo sapiens
tcccataggcccagt

SEQ ID NO: 4737605 - DNA, 16 bp, Homo sapiens
tcccatgagcctcagc

SEQ ID NO: 4737606 - DNA, 17 bp, Homo sapiens
tcccatgagcctcagca

SEQ ID NO: 4737607 - DNA, 17 bp, Homo sapiens
tcccatttcgtgtaata

SEQ ID NO: 4737608 - DNA, 14 bp, Homo sapiens
tccccaactgacca

SEQ ID NO: 4737609 - DNA, 18 bp, Homo sapiens
tccccaactgaccacctt

SEQ ID NO: 4737610 - DNA, 14 bp, Homo sapiens
tccccacactccta

SEQ ID NO: 4737611 - DNA, 17 bp, Homo sapiens
tccccaccgcagacagg

SEQ ID NO: 4737612 - DNA, 22 bp, Homo sapiens
tccccaccgcagacaggaccag

SEQ ID NO: 4737613 - DNA, 17 bp, Homo sapiens
tccccagaatggaggca

SEQ ID NO: 4737614 - DNA, 19 bp, Homo sapiens
tccccagagtcctctatga

SEQ ID NO: 4737615 - DNA, 20 bp, Homo sapiens
tccccagagttccccatgca

SEQ ID NO: 4737616 - DNA, 22 bp, Homo sapiens
tccccagattgcaacaggctgg

SEQ ID NO: 4737617 - DNA, 17 bp, Homo sapiens
tccccaggaggccagcc

SEQ ID NO: 4737618 - DNA, 21 bp, Homo sapiens
tccccaggaggccagccttga

SEQ ID NO: 4737619 - DNA, 16 bp, Homo sapiens
tccccatgcagacatg

SEQ ID NO: 4737620 - DNA, 15 bp, Homo sapiens
tcccccagccccatc

SEQ ID NO: 4737621 - DNA, 22 bp, Homo sapiens
tcccccagccccatcctctgta

SEQ ID NO: 4737622 - DNA, 17 bp, Homo sapiens
tcccccatctcttctgg

SEQ ID NO: 4737623 - DNA, 19 bp, Homo sapiens
tcccccatgttctgtccct

SEQ ID NO: 4737624 - DNA, 14 bp, Homo sapiens
tcccccccggggct

SEQ ID NO: 4737625 - DNA, 12 bp, Homo sapiens
tcccccctcacc

SEQ ID NO: 4737626 - DNA, 14 bp, Homo sapiens
tcccccctcaccag

SEQ ID NO: 4737627 - DNA, 22 bp, Homo sapiens
tcccccgggaggggcccgcttg

SEQ ID NO: 4737628 - DNA, 21 bp, Homo sapiens
tcccccttccatggactttgt

SEQ ID NO: 4737629 - DNA, 20 bp, Homo sapiens
tccccgagggatgatgccac

SEQ ID NO: 4737630 - DNA, 23 bp, Homo sapiens
tccccgataccatgctgtaagga

SEQ ID NO: 4737631 - DNA, 22 bp, Homo sapiens
tccccggagccggcactgcatg

SEQ ID NO: 4737632 - DNA, 17 bp, Homo sapiens
tcccctaccactgtctt

SEQ ID NO: 4737633 - DNA, 13 bp, Homo sapiens
tcccctccaacct

SEQ ID NO: 4737634 - DNA, 17 bp, Homo sapiens
tcccctcctacccctcc

SEQ ID NO: 4737635 - DNA, 14 bp, Homo sapiens
tcccctcctctccc

SEQ ID NO: 4737636 - DNA, 15 bp, Homo sapiens
tcccctcttgcccca

SEQ ID NO: 4737637 - DNA, 21 bp, Homo sapiens
tcccctcttgccccaaccccc

SEQ ID NO: 4737638 - DNA, 15 bp, Homo sapiens
tcccctgcccccagg

SEQ ID NO: 4737639 - DNA, 17 bp, Homo sapiens
tcccctgcccccaggac

SEQ ID NO: 4737640 - DNA, 19 bp, Homo sapiens
tcccctgccccctgcagga

SEQ ID NO: 4737641 - DNA, 21 bp, Homo sapiens
tcccctgccccctgcaggaag

SEQ ID NO: 4737642 - DNA, 23 bp, Homo sapiens
tcccctgccccctgcaggaagga

SEQ ID NO: 4737643 - DNA, 15 bp, Homo sapiens
tcccctgctgggtgt

SEQ ID NO: 4737644 - DNA, 20 bp, Homo sapiens
tcccctgtttgtttctgaaa

SEQ ID NO: 4737645 - DNA, 17 bp, Homo sapiens
tccccttatctttctaa

SEQ ID NO: 4737646 - DNA, 13 bp, Homo sapiens
tccccttcactcc

SEQ ID NO: 4737647 - DNA, 17 bp, Homo sapiens
tccccttccactgaggg

SEQ ID NO: 4737648 - DNA, 15 bp, Homo sapiens
tccccttctcatcac

SEQ ID NO: 4737649 - DNA, 15 bp, Homo sapiens
tcccgagtagctggg

SEQ ID NO: 4737650 - DNA, 16 bp, Homo sapiens
tcccgagtagctggga

SEQ ID NO: 4737651 - DNA, 21 bp, Homo sapiens
tcccggagggaaactgtgaat

SEQ ID NO: 4737652 - DNA, 14 bp, Homo sapiens
tcccggctgccctt

SEQ ID NO: 4737653 - DNA, 15 bp, Homo sapiens
tcccggctgcccttt

SEQ ID NO: 4737654 - DNA, 18 bp, Homo sapiens
tcccggctgccctttctg

SEQ ID NO: 4737655 - DNA, 22 bp, Homo sapiens
tcccggctgccctttctgggca

SEQ ID NO: 4737656 - DNA, 13 bp, Homo sapiens
tattacttctgct

SEQ ID NO: 4737657 - DNA, 14 bp, Homo sapiens
tattacttctgcta

SEQ ID NO: 4737658 - DNA, 17 bp, Homo sapiens
ctacatttagcccctct

SEQ ID NO: 4737659 - DNA, 17 bp, Homo sapiens
ctacattttcttttgtt

SEQ ID NO: 4737660 - DNA, 12 bp, Homo sapiens
aaaaaagagaca

SEQ ID NO: 4737661 - DNA, 13 bp, Homo sapiens
aaaaaattaactg

SEQ ID NO: 4737662 - DNA, 14 bp, Homo sapiens
aaaaagaagtttgg

SEQ ID NO: 4737663 - DNA, 12 bp, Homo sapiens
aaaaagagacat

SEQ ID NO: 4737664 - DNA, 17 bp, Homo sapiens
aaaaagcctccagtcca

SEQ ID NO: 4737665 - DNA, 17 bp, Homo sapiens
aaaaagggaaagttttg

SEQ ID NO: 4737666 - DNA, 17 bp, Homo sapiens
aaaaatagcaacttgtg

SEQ ID NO: 4737667 - DNA, 14 bp, Homo sapiens
aaaaatgcctttga

SEQ ID NO: 4737668 - DNA, 11 bp, Homo sapiens
aaaaatgctgg

SEQ ID NO: 4737669 - DNA, 12 bp, Homo sapiens
aaaaatgcttct

SEQ ID NO: 4737670 - DNA, 21 bp, Homo sapiens
aaaaatgtagaaattcttcat

SEQ ID NO: 4737671 - DNA, 18 bp, Homo sapiens
aaaaatgtaggagactgt

SEQ ID NO: 4737672 - DNA, 16 bp, Homo sapiens
aaaaatgtatatgcac

SEQ ID NO: 4737673 - DNA, 23 bp, Homo sapiens
aaaaatgttagtattttaatcct

SEQ ID NO: 4737674 - DNA, 19 bp, Homo sapiens
aaaaattaaattctctcta

SEQ ID NO: 4737675 - DNA, 14 bp, Homo sapiens
aaaaattgaaagaa

SEQ ID NO: 4737676 - DNA, 11 bp, Homo sapiens
aaaaattgtta

SEQ ID NO: 4737677 - DNA, 17 bp, Homo sapiens
aaaacaggcactgccct

SEQ ID NO: 4737678 - DNA, 18 bp, Homo sapiens
aaaacaggcactgccctg

SEQ ID NO: 4737679 - DNA, 18 bp, Homo sapiens
aaaacatattttacatct

SEQ ID NO: 4737680 - DNA, 14 bp, Homo sapiens
aaaacatcctgact

SEQ ID NO: 4737681 - DNA, 13 bp, Homo sapiens
aaaacatgttgaa

SEQ ID NO: 4737682 - DNA, 16 bp, Homo sapiens
aaaacattccatcctt

SEQ ID NO: 4737683 - DNA, 13 bp, Homo sapiens
aaaacccattgtc

SEQ ID NO: 4737684 - DNA, 18 bp, Homo sapiens
aaaactcaggcaaagaaa

SEQ ID NO: 4737685 - DNA, 18 bp, Homo sapiens
aaaactctcctctgctgc

SEQ ID NO: 4737686 - DNA, 17 bp, Homo sapiens
aaaacttcaaaaactaa

SEQ ID NO: 4737687 - DNA, 16 bp, Homo sapiens
aaaagaaaagtcaagg

SEQ ID NO: 4737688 - DNA, 13 bp, Homo sapiens
aaaagaaatcaat

SEQ ID NO: 4737689 - DNA, 24 bp, Homo sapiens
aaaagaaggtatttttccaatcac

SEQ ID NO: 4737690 - DNA, 23 bp, Homo sapiens
aaaagaagtttgggctaacattt

SEQ ID NO: 4737691 - DNA, 20 bp, Homo sapiens
aaaagacaaggaaaaaataa

SEQ ID NO: 4737692 - DNA, 17 bp, Homo sapiens
aaaagaccaaattttga

SEQ ID NO: 4737693 - DNA, 12 bp, Homo sapiens
aaaagactcatc

SEQ ID NO: 4737694 - DNA, 13 bp, Homo sapiens
aaaagataaattt

SEQ ID NO: 4737695 - DNA, 18 bp, Homo sapiens
aaaagcaaaaagatgtat

SEQ ID NO: 4737696 - DNA, 15 bp, Homo sapiens
aaaagcaatggttga

SEQ ID NO: 4737697 - DNA, 18 bp, Homo sapiens
aaaagcacttactttttt

SEQ ID NO: 4737698 - DNA, 19 bp, Homo sapiens
aaaagcaggcctttgcaga

SEQ ID NO: 4737699 - DNA, 15 bp, Homo sapiens
aaaagcatttgggca

SEQ ID NO: 4737700 - DNA, 11 bp, Homo sapiens
aaaagcctgct

SEQ ID NO: 4737701 - DNA, 15 bp, Homo sapiens
aaaagctattagcca

SEQ ID NO: 4737702 - DNA, 20 bp, Homo sapiens
aaaagctattagccaggatc

SEQ ID NO: 4737703 - DNA, 11 bp, Homo sapiens
aaaaggattaa

SEQ ID NO: 4737704 - DNA, 15 bp, Homo sapiens
aaaagggcagccctc

SEQ ID NO: 4737705 - DNA, 17 bp, Homo sapiens
aaaaggttttattttgt

SEQ ID NO: 4737706 - DNA, 16 bp, Homo sapiens
aaaagtataaaatagt

SEQ ID NO: 4737707 - DNA, 14 bp, Homo sapiens
aaaagtcataaatg

SEQ ID NO: 4737708 - DNA, 13 bp, Homo sapiens
aaaataaaacatg

SEQ ID NO: 4737709 - DNA, 15 bp, Homo sapiens
aaaataaagaatgga

SEQ ID NO: 4737710 - DNA, 13 bp, Homo sapiens
aaaataattctaa

SEQ ID NO: 4737711 - DNA, 16 bp, Homo sapiens
aaaatacaaaaatttg

SEQ ID NO: 4737712 - DNA, 14 bp, Homo sapiens
aaaatacatataaa

SEQ ID NO: 4737713 - DNA, 23 bp, Homo sapiens
aaaatacatataaagattaacac

SEQ ID NO: 4737714 - DNA, 20 bp, Homo sapiens
aaaatagggtccttgaaaca

SEQ ID NO: 4737715 - DNA, 19 bp, Homo sapiens
aaaatatcaagtactacat

SEQ ID NO: 4737716 - DNA, 14 bp, Homo sapiens
aaaatcaaactgta

SEQ ID NO: 4737717 - DNA, 14 bp, Homo sapiens
aaaatcctgaataa

SEQ ID NO: 4737718 - DNA, 16 bp, Homo sapiens
aaaatgaaatgcatat

SEQ ID NO: 4737719 - DNA, 12 bp, Homo sapiens
aaaatgcctttg

SEQ ID NO: 4737720 - DNA, 14 bp, Homo sapiens
aaaatgcctttgag

SEQ ID NO: 4737721 - DNA, 17 bp, Homo sapiens
aaaatgcctttgagaca

SEQ ID NO: 4737722 - DNA, 22 bp, Homo sapiens
aaaatgcctttgagacagtttc

SEQ ID NO: 4737723 - DNA, 13 bp, Homo sapiens
aaaatggaaattt

SEQ ID NO: 4737724 - DNA, 17 bp, Homo sapiens
aaaatgtaggagactgt

SEQ ID NO: 4737725 - DNA, 20 bp, Homo sapiens
aaaatgtgaaaaaaattatt

SEQ ID NO: 4737726 - DNA, 18 bp, Homo sapiens
aaaatgttctatttaaca

SEQ ID NO: 4737727 - DNA, 20 bp, Homo sapiens
aaaatgttctatttaacaac

SEQ ID NO: 4737728 - DNA, 16 bp, Homo sapiens
aaaatgttggtgcaat

SEQ ID NO: 4737729 - DNA, 18 bp, Homo sapiens
aaaatgttggtgcaatta

SEQ ID NO: 4737730 - DNA, 15 bp, Homo sapiens
aaaattaactgctcc

SEQ ID NO: 4737731 - DNA, 14 bp, Homo sapiens
aaaattatttgcat

SEQ ID NO: 4737732 - DNA, 18 bp, Homo sapiens
aaaatttaagtgcgtgtg

SEQ ID NO: 4737733 - DNA, 23 bp, Homo sapiens
aaaatttaagtgcgtgtgtagag

SEQ ID NO: 4737734 - DNA, 14 bp, Homo sapiens
aaaatttgtttgac

SEQ ID NO: 4737735 - DNA, 15 bp, Homo sapiens
aaaatttgtttgaca

SEQ ID NO: 4737736 - DNA, 21 bp, Homo sapiens
aaaatttttacaaaactgcca

SEQ ID NO: 4737737 - DNA, 19 bp, Homo sapiens
aaacaaaaattaaaatcct

SEQ ID NO: 4737738 - DNA, 12 bp, Homo sapiens
aaacaaagatgt

SEQ ID NO: 4737739 - DNA, 17 bp, Homo sapiens
aaacaactctttgagaa

SEQ ID NO: 4737740 - DNA, 15 bp, Homo sapiens
aaacaatttaaattg

SEQ ID NO: 4737741 - DNA, 14 bp, Homo sapiens
aaacactgcaggca

SEQ ID NO: 4737742 - DNA, 15 bp, Homo sapiens
aaacagaaattaatc

SEQ ID NO: 4737743 - DNA, 14 bp, Homo sapiens
aaacagagtatttc

SEQ ID NO: 4737744 - DNA, 14 bp, Homo sapiens
aaacagatgtccct

SEQ ID NO: 4737745 - DNA, 15 bp, Homo sapiens
aaacagatgtccctg

SEQ ID NO: 4737746 - DNA, 18 bp, Homo sapiens
aaacagtgaatttaagca

SEQ ID NO: 4737747 - DNA, 12 bp, Homo sapiens
aaacataataaa

SEQ ID NO: 4737748 - DNA, 22 bp, Homo sapiens
aaacataataaatcacacattc

SEQ ID NO: 4737749 - DNA, 15 bp, Homo sapiens
aaacatattttacat

SEQ ID NO: 4737750 - DNA, 22 bp, Homo sapiens
aaacatattttacatctgaaca

SEQ ID NO: 4737751 - DNA, 18 bp, Homo sapiens
aaacatcctacaagacac

SEQ ID NO: 4737752 - DNA, 22 bp, Homo sapiens
aaacatcctacaagacacagtg

SEQ ID NO: 4737753 - DNA, 12 bp, Homo sapiens
aaacatgaaaac

SEQ ID NO: 4737754 - DNA, 13 bp, Homo sapiens
aaacatgaaaaca

SEQ ID NO: 4737755 - DNA, 17 bp, Homo sapiens
aaacatgaaaacattga

SEQ ID NO: 4737756 - DNA, 19 bp, Homo sapiens
aaacatgaccctaaatctt

SEQ ID NO: 4737757 - DNA, 18 bp, Homo sapiens
aaacatggaaaacagagt

SEQ ID NO: 4737758 - DNA, 13 bp, Homo sapiens
aaacatgtgcaac

SEQ ID NO: 4737759 - DNA, 15 bp, Homo sapiens
aaacatgttagtcaa

SEQ ID NO: 4737760 - DNA, 15 bp, Homo sapiens
aaaccaggacattaa

SEQ ID NO: 4737761 - DNA, 19 bp, Homo sapiens
aaaccagtgttagggaagg

SEQ ID NO: 4737762 - DNA, 20 bp, Homo sapiens
aaaccattatgaagaagaga

SEQ ID NO: 4737763 - DNA, 24 bp, Homo sapiens
aaaccctcgaggcggatctttgga

SEQ ID NO: 4737764 - DNA, 19 bp, Homo sapiens
aaacctgaactttcattgg

SEQ ID NO: 4737765 - DNA, 12 bp, Homo sapiens
aaacctgcattt

SEQ ID NO: 4737766 - DNA, 14 bp, Homo sapiens
aaacctgcattttt

SEQ ID NO: 4737767 - DNA, 18 bp, Homo sapiens
aaaccttttttaagattt

SEQ ID NO: 4737768 - DNA, 19 bp, Homo sapiens
aaaccttttttaagatttt

SEQ ID NO: 4737769 - DNA, 22 bp, Homo sapiens
aaaccttttttaagatttttct

SEQ ID NO: 4737770 - DNA, 23 bp, Homo sapiens
aaaccttttttaagatttttctc

SEQ ID NO: 4737771 - DNA, 20 bp, Homo sapiens
aaacgtatggaatgcttctt

SEQ ID NO: 4737772 - DNA, 13 bp, Homo sapiens
aaactatttaaca

SEQ ID NO: 4737773 - DNA, 16 bp, Homo sapiens
aaactatttaacattc

SEQ ID NO: 4737774 - DNA, 14 bp, Homo sapiens
aaactcaagcttct

SEQ ID NO: 4737775 - DNA, 17 bp, Homo sapiens
aaactcaggcaaagaaa

SEQ ID NO: 4737776 - DNA, 23 bp, Homo sapiens
aaactccaggatttataaagcaa

SEQ ID NO: 4737777 - DNA, 15 bp, Homo sapiens
aaactcttatctcag

SEQ ID NO: 4737778 - DNA, 17 bp, Homo sapiens
aaactgcacaataaaac

SEQ ID NO: 4737779 - DNA, 12 bp, Homo sapiens
aaactgccccct

SEQ ID NO: 4737780 - DNA, 20 bp, Homo sapiens
aaactgccccctctgccctg

SEQ ID NO: 4737781 - DNA, 21 bp, Homo sapiens
aaactgccccctctgccctgc

SEQ ID NO: 4737782 - DNA, 12 bp, Homo sapiens
aaactgtgaatg

SEQ ID NO: 4737783 - DNA, 16 bp, Homo sapiens
aaactgtgaatgcttc

SEQ ID NO: 4737784 - DNA, 21 bp, Homo sapiens
aaactgtgaatgcttctgatt

SEQ ID NO: 4737785 - DNA, 14 bp, Homo sapiens
aaacttcttttctc

SEQ ID NO: 4737786 - DNA, 13 bp, Homo sapiens
aaagaaaatgaaa

SEQ ID NO: 4737787 - DNA, 16 bp, Homo sapiens
aaagaaaatgtgtctg

SEQ ID NO: 4737788 - DNA, 13 bp, Homo sapiens
aaagaaaattttt

SEQ ID NO: 4737789 - DNA, 19 bp, Homo sapiens
aaagaaaattttttttcaa

SEQ ID NO: 4737790 - DNA, 18 bp, Homo sapiens
aaagaaacttgtgcttta

SEQ ID NO: 4737791 - DNA, 13 bp, Homo sapiens
aaagaaataaacc

SEQ ID NO: 4737792 - DNA, 19 bp, Homo sapiens
aaagaaatagaaaaggaag

SEQ ID NO: 4737793 - DNA, 20 bp, Homo sapiens
aaagaaatttagagtcaatt

SEQ ID NO: 4737794 - DNA, 18 bp, Homo sapiens
aaagaaggtatttttcca

SEQ ID NO: 4737795 - DNA, 14 bp, Homo sapiens
aaagaatctatcac

SEQ ID NO: 4737796 - DNA, 14 bp, Homo sapiens
aaagaccatgcatt

SEQ ID NO: 4737797 - DNA, 21 bp, Homo sapiens
aaagaccatgcatttaaagta

SEQ ID NO: 4737798 - DNA, 10 bp, Homo sapiens
aaagactcca

SEQ ID NO: 4737799 - DNA, 19 bp, Homo sapiens
aaagacttttccaaccctc

SEQ ID NO: 4737800 - DNA, 20 bp, Homo sapiens
aaagagattagaacatttaa

SEQ ID NO: 4737801 - DNA, 24 bp, Homo sapiens
aaagaggtgactgggccctgcctc

SEQ ID NO: 4737802 - DNA, 14 bp, Homo sapiens
aaagatatctatga

SEQ ID NO: 4737803 - DNA, 17 bp, Homo sapiens
aaagatgtatatttgca

SEQ ID NO: 4737804 - DNA, 22 bp, Homo sapiens
aaagcaaaaagatgtatatttg

SEQ ID NO: 4737805 - DNA, 14 bp, Homo sapiens
aaagcaaggaaact

SEQ ID NO: 4737806 - DNA, 22 bp, Homo sapiens
aaagcaagtgattgggacagag

SEQ ID NO: 4737807 - DNA, 23 bp, Homo sapiens
aaagcatggccctgctgcccctc

SEQ ID NO: 4737808 - DNA, 19 bp, Homo sapiens
aaagccaataacacacagc

SEQ ID NO: 4737809 - DNA, 17 bp, Homo sapiens
aaagccttgttttctct

SEQ ID NO: 4737810 - DNA, 13 bp, Homo sapiens
aaagctagaaatg

SEQ ID NO: 4737811 - DNA, 14 bp, Homo sapiens
aaagctagaaatga

SEQ ID NO: 4737812 - DNA, 16 bp, Homo sapiens
aaagctaggcctggcc

SEQ ID NO: 4737813 - DNA, 18 bp, Homo sapiens
aaagctaggcctggccag

SEQ ID NO: 4737814 - DNA, 15 bp, Homo sapiens
aaagctgaaaactgc

SEQ ID NO: 4737815 - DNA, 18 bp, Homo sapiens
aaagctgtgtctctgtat

SEQ ID NO: 4737816 - DNA, 16 bp, Homo sapiens
aaagcttcacagtacc

SEQ ID NO: 4737817 - DNA, 11 bp, Homo sapiens
aaaggaaagag

SEQ ID NO: 4737818 - DNA, 16 bp, Homo sapiens
aaaggacaaacagtga

SEQ ID NO: 4737819 - DNA, 17 bp, Homo sapiens
aaaggacaaacagtgaa

SEQ ID NO: 4737820 - DNA, 14 bp, Homo sapiens
aaaggatgagggtt

SEQ ID NO: 4737821 - DNA, 14 bp, Homo sapiens
aaaggccatggaga

SEQ ID NO: 4737822 - DNA, 14 bp, Homo sapiens
aaaggctccaggag

SEQ ID NO: 4737823 - DNA, 19 bp, Homo sapiens
aaaggctccaggagcagcc

SEQ ID NO: 4737824 - DNA, 19 bp, Homo sapiens
aaaggctttggcaacagaa

SEQ ID NO: 4737825 - DNA, 22 bp, Homo sapiens
aaaggctttggcaacagaaaac

SEQ ID NO: 4737826 - DNA, 14 bp, Homo sapiens
aaagggaacatgca

SEQ ID NO: 4737827 - DNA, 16 bp, Homo sapiens
aaagggaactgaacat

SEQ ID NO: 4737828 - DNA, 21 bp, Homo sapiens
aaagggaactgaacattccag

SEQ ID NO: 4737829 - DNA, 22 bp, Homo sapiens
aaagggacttggaagctccgct

SEQ ID NO: 4737830 - DNA, 15 bp, Homo sapiens
aaaggtataattaaa

SEQ ID NO: 4737831 - DNA, 17 bp, Homo sapiens
aaagtaaaattgtttca

SEQ ID NO: 4737832 - DNA, 14 bp, Homo sapiens
aaagtaatttctaa

SEQ ID NO: 4737833 - DNA, 23 bp, Homo sapiens
aaagtacttctccaccctgctct

SEQ ID NO: 4737834 - DNA, 20 bp, Homo sapiens
aaagtataaattcgctgtga

SEQ ID NO: 4737835 - DNA, 16 bp, Homo sapiens
aaagtattctccatcc

SEQ ID NO: 4737836 - DNA, 20 bp, Homo sapiens
aaagtcatgcaaaggctggg

SEQ ID NO: 4737837 - DNA, 21 bp, Homo sapiens
aaagtcatgcaaaggctggga

SEQ ID NO: 4737838 - DNA, 17 bp, Homo sapiens
aaagtcattaaagacag

SEQ ID NO: 4737839 - DNA, 12 bp, Homo sapiens
aaagtctcttgt

SEQ ID NO: 4737840 - DNA, 20 bp, Homo sapiens
aaagtgcacacctttattca

SEQ ID NO: 4737841 - DNA, 19 bp, Homo sapiens
aaagtggaaaacaaggaag

SEQ ID NO: 4737842 - DNA, 13 bp, Homo sapiens
aaagtggaacgaa

SEQ ID NO: 4737843 - DNA, 16 bp, Homo sapiens
aaagtgggtttcaatt

SEQ ID NO: 4737844 - DNA, 21 bp, Homo sapiens
aaagtgtgaaataaatttttt

SEQ ID NO: 4737845 - DNA, 13 bp, Homo sapiens
aaagttaaatgta

SEQ ID NO: 4737846 - DNA, 14 bp, Homo sapiens
aaagttctgtactc

SEQ ID NO: 4737847 - DNA, 21 bp, Homo sapiens
aaagttctgtactcaaatgta

SEQ ID NO: 4737848 - DNA, 18 bp, Homo sapiens
aaagttgcacggctgctg

SEQ ID NO: 4737849 - DNA, 21 bp, Homo sapiens
aaagtttctcttttcaaaaca

SEQ ID NO: 4737850 - DNA, 23 bp, Homo sapiens
aaagtttctcttttcaaaacatt

SEQ ID NO: 4737851 - DNA, 18 bp, Homo sapiens
aaagttttgaaaagctat

SEQ ID NO: 4737852 - DNA, 21 bp, Homo sapiens
aaataaaactaaggaaccctg

SEQ ID NO: 4737853 - DNA, 13 bp, Homo sapiens
aaataaagaatgg

SEQ ID NO: 4737854 - DNA, 16 bp, Homo sapiens
aaataaagaatggaaa

SEQ ID NO: 4737855 - DNA, 14 bp, Homo sapiens
aaataaataatttt

SEQ ID NO: 4737856 - DNA, 14 bp, Homo sapiens
aaataacaatgtta

SEQ ID NO: 4737857 - DNA, 16 bp, Homo sapiens
aaataacaatgttaag

SEQ ID NO: 4737858 - DNA, 17 bp, Homo sapiens
aaataacaatgttaagg

SEQ ID NO: 4737859 - DNA, 13 bp, Homo sapiens
aaataacatcatt

SEQ ID NO: 4737860 - DNA, 20 bp, Homo sapiens
aaataacatcattgtattaa

SEQ ID NO: 4737861 - DNA, 15 bp, Homo sapiens
aaataagaaaaatat

SEQ ID NO: 4737862 - DNA, 24 bp, Homo sapiens
aaataagaaacaactctttgagaa

SEQ ID NO: 4737863 - DNA, 14 bp, Homo sapiens
aaataattctaaag

SEQ ID NO: 4737864 - DNA, 22 bp, Homo sapiens
aaatacatataaagattaacac

SEQ ID NO: 4737865 - DNA, 19 bp, Homo sapiens
aaatacatgcatataatga

SEQ ID NO: 4737866 - DNA, 18 bp, Homo sapiens
aaatactatccaaataaa

SEQ ID NO: 4737867 - DNA, 17 bp, Homo sapiens
aaatactggactcagga

SEQ ID NO: 4737868 - DNA, 22 bp, Homo sapiens
aaatactggactcaggaacttt

SEQ ID NO: 4737869 - DNA, 21 bp, Homo sapiens
aaatagataagagtagaaact

SEQ ID NO: 4737870 - DNA, 16 bp, Homo sapiens
aaatagattttaagct

SEQ ID NO: 4737871 - DNA, 19 bp, Homo sapiens
aaatagctccgtggagcag

SEQ ID NO: 4737872 - DNA, 23 bp, Homo sapiens
aaataggagaggatgagagccca

SEQ ID NO: 4737873 - DNA, 13 bp, Homo sapiens
aaatagtaaaaat

SEQ ID NO: 4737874 - DNA, 16 bp, Homo sapiens
aaatatagttgtcttt

SEQ ID NO: 4737875 - DNA, 22 bp, Homo sapiens
aaatatagttgtctttctttgc

SEQ ID NO: 4737876 - DNA, 23 bp, Homo sapiens
aaatatagttgtctttctttgct

SEQ ID NO: 4737877 - DNA, 22 bp, Homo sapiens
aaatatatatctaaatttagaa

SEQ ID NO: 4737878 - DNA, 14 bp, Homo sapiens
aaatatcctgctca

SEQ ID NO: 4737879 - DNA, 17 bp, Homo sapiens
aaatatcttttgacctg

SEQ ID NO: 4737880 - DNA, 22 bp, Homo sapiens
aaatatgcagtgatatggcaga

SEQ ID NO: 4737881 - DNA, 19 bp, Homo sapiens
aaatatggctagttttcaa

SEQ ID NO: 4737882 - DNA, 15 bp, Homo sapiens
aaatatgtgaagaaa

SEQ ID NO: 4737883 - DNA, 13 bp, Homo sapiens
aaatattactgat

SEQ ID NO: 4737884 - DNA, 21 bp, Homo sapiens
aaatattactgatcttacctt

SEQ ID NO: 4737885 - DNA, 19 bp, Homo sapiens
aaatattccctagaaactt

SEQ ID NO: 4737886 - DNA, 12 bp, Homo sapiens
aaatattgttaa

SEQ ID NO: 4737887 - DNA, 19 bp, Homo sapiens
aaatattttagatgttatt

SEQ ID NO: 4737888 - DNA, 21 bp, Homo sapiens
aaatcaaactgtagttgtttt

SEQ ID NO: 4737889 - DNA, 11 bp, Homo sapiens
aaatcaatttt

SEQ ID NO: 4737890 - DNA, 19 bp, Homo sapiens
aaatcaattttttaaacca

SEQ ID NO: 4737891 - DNA, 14 bp, Homo sapiens
aaatcacacattca

SEQ ID NO: 4737892 - DNA, 21 bp, Homo sapiens
aaatcagtgggttaattttgg

SEQ ID NO: 4737893 - DNA, 15 bp, Homo sapiens
aaatcagttctcaat

SEQ ID NO: 4737894 - DNA, 13 bp, Homo sapiens
aaatcatcaaaaa

SEQ ID NO: 4737895 - DNA, 21 bp, Homo sapiens
aaatcattcttactaaaaagt

SEQ ID NO: 4737896 - DNA, 18 bp, Homo sapiens
aaatcattgtcaaaatta

SEQ ID NO: 4737897 - DNA, 12 bp, Homo sapiens
aaatcatttggg

SEQ ID NO: 4737898 - DNA, 23 bp, Homo sapiens
aaatcatttgggttaatatggct

SEQ ID NO: 4737899 - DNA, 15 bp, Homo sapiens
aaatccaatattgta

SEQ ID NO: 4737900 - DNA, 22 bp, Homo sapiens
aaatccagtattatattatcat

SEQ ID NO: 4737901 - DNA, 15 bp, Homo sapiens
aaatcctccaatcaa

SEQ ID NO: 4737902 - DNA, 16 bp, Homo sapiens
aaatctcaattcttcc

SEQ ID NO: 4737903 - DNA, 11 bp, Homo sapiens
aaatctgaaga

SEQ ID NO: 4737904 - DNA, 12 bp, Homo sapiens
aaatctgaagaa

SEQ ID NO: 4737905 - DNA, 14 bp, Homo sapiens
aaatctgacatatt

SEQ ID NO: 4737906 - DNA, 17 bp, Homo sapiens
aaatcttataatttaaa

SEQ ID NO: 4737907 - DNA, 21 bp, Homo sapiens
aaatcttcagctggtggatgg

SEQ ID NO: 4737908 - DNA, 21 bp, Homo sapiens
aaatcttctgctaaatttttg

SEQ ID NO: 4737909 - DNA, 12 bp, Homo sapiens
aaatctttccag

SEQ ID NO: 4737910 - DNA, 23 bp, Homo sapiens
aaatcttttccaggaaaaagaac

SEQ ID NO: 4737911 - DNA, 15 bp, Homo sapiens
aaatgaaaatgtctt

SEQ ID NO: 4737912 - DNA, 17 bp, Homo sapiens
aaatgaaaatgtcttgt

SEQ ID NO: 4737913 - DNA, 13 bp, Homo sapiens
aaatgaaagctac

SEQ ID NO: 4737914 - DNA, 12 bp, Homo sapiens
aaatgaaatgca

SEQ ID NO: 4737915 - DNA, 14 bp, Homo sapiens
aaatgaaatgcata

SEQ ID NO: 4737916 - DNA, 23 bp, Homo sapiens
aaatgaaccttgctatcaagaaa

SEQ ID NO: 4737917 - DNA, 16 bp, Homo sapiens
aaatgaggaggtacat

SEQ ID NO: 4737918 - DNA, 19 bp, Homo sapiens
aaatgaggtcagagcctgc

SEQ ID NO: 4737919 - DNA, 14 bp, Homo sapiens
aaatgcattcatgt

SEQ ID NO: 4737920 - DNA, 18 bp, Homo sapiens
aaatgcattcatgtttta

SEQ ID NO: 4737921 - DNA, 18 bp, Homo sapiens
aaatgcctttgagacagt

SEQ ID NO: 4737922 - DNA, 19 bp, Homo sapiens
aaatgcctttgagacagtt

SEQ ID NO: 4737923 - DNA, 16 bp, Homo sapiens
aaatgcgtatttgcat

SEQ ID NO: 4737924 - DNA, 17 bp, Homo sapiens
aaatgctctgtcttcaa

SEQ ID NO: 4737925 - DNA, 14 bp, Homo sapiens
aaatgctgtgcaaa

SEQ ID NO: 4737926 - DNA, 19 bp, Homo sapiens
aaatgctgtgcaaacagtg

SEQ ID NO: 4737927 - DNA, 11 bp, Homo sapiens
aaatgcttctt

SEQ ID NO: 4737928 - DNA, 15 bp, Homo sapiens
aaatggaagacacat

SEQ ID NO: 4737929 - DNA, 18 bp, Homo sapiens
aaatggaagacacattga

SEQ ID NO: 4737930 - DNA, 23 bp, Homo sapiens
aaatggaggatctctaaagagca

SEQ ID NO: 4737931 - DNA, 22 bp, Homo sapiens
aaatggtacttaaacatttttg

SEQ ID NO: 4737932 - DNA, 14 bp, Homo sapiens
aaatggtccaggag

SEQ ID NO: 4737933 - DNA, 19 bp, Homo sapiens
aaatggtgctgcagatttg

SEQ ID NO: 4737934 - DNA, 14 bp, Homo sapiens
aaatgtacttatat

SEQ ID NO: 4737935 - DNA, 14 bp, Homo sapiens
aaatgtatatgcac

SEQ ID NO: 4737936 - DNA, 12 bp, Homo sapiens
aaatgtcttgtg

SEQ ID NO: 4737937 - DNA, 14 bp, Homo sapiens
aaatgtgaaaaaaa

SEQ ID NO: 4737938 - DNA, 19 bp, Homo sapiens
aaatgtgaaaaaaattatt

SEQ ID NO: 4737939 - DNA, 17 bp, Homo sapiens
aaatgtgataatatatt

SEQ ID NO: 4737940 - DNA, 16 bp, Homo sapiens
aaatgtgtataatttt

SEQ ID NO: 4737941 - DNA, 20 bp, Homo sapiens
aaatgtgtctgcaacatgga

SEQ ID NO: 4737942 - DNA, 20 bp, Homo sapiens
aaatgttaagttgatggtga

SEQ ID NO: 4737943 - DNA, 11 bp, Homo sapiens
aaatgttatga

SEQ ID NO: 4737944 - DNA, 19 bp, Homo sapiens
aaatgttctatttaacaac

SEQ ID NO: 4737945 - DNA, 13 bp, Homo sapiens
aaattaaagctga

SEQ ID NO: 4737946 - DNA, 17 bp, Homo sapiens
aaattaaagctgaaaac

SEQ ID NO: 4737947 - DNA, 17 bp, Homo sapiens
aaattaaattctctcta

SEQ ID NO: 4737948 - DNA, 13 bp, Homo sapiens
aaattaacactgc

SEQ ID NO: 4737949 - DNA, 13 bp, Homo sapiens
aaattaactgctc

SEQ ID NO: 4737950 - DNA, 16 bp, Homo sapiens
aaattaatatgattat

SEQ ID NO: 4737951 - DNA, 19 bp, Homo sapiens
aaattaattatatttctac

SEQ ID NO: 4737952 - DNA, 16 bp, Homo sapiens
aaattaatttgtgaat

SEQ ID NO: 4737953 - DNA, 18 bp, Homo sapiens
aaattacctgtggatatt

SEQ ID NO: 4737954 - DNA, 18 bp, Homo sapiens
aaattactccaaggttta

SEQ ID NO: 4737955 - DNA, 13 bp, Homo sapiens
aaattagctgggc

SEQ ID NO: 4737956 - DNA, 22 bp, Homo sapiens
aaattatcagttatattttgct

SEQ ID NO: 4737957 - DNA, 17 bp, Homo sapiens
aaattatttgattattt

SEQ ID NO: 4737958 - DNA, 16 bp, Homo sapiens
aaattcactattggct

SEQ ID NO: 4737959 - DNA, 18 bp, Homo sapiens
aaattcactattggctgg

SEQ ID NO: 4737960 - DNA, 17 bp, Homo sapiens
aaattccaagtgattga

SEQ ID NO: 4737961 - DNA, 18 bp, Homo sapiens
aaattcccttcatctgga

SEQ ID NO: 4737962 - DNA, 18 bp, Homo sapiens
aaattgagcttgcttctt

SEQ ID NO: 4737963 - DNA, 13 bp, Homo sapiens
aaattgccatttt

SEQ ID NO: 4737964 - DNA, 16 bp, Homo sapiens
aaattgttatcaaaat

SEQ ID NO: 4737965 - DNA, 14 bp, Homo sapiens
aaatttacatttat

SEQ ID NO: 4737966 - DNA, 15 bp, Homo sapiens
aaatttacatttatc

SEQ ID NO: 4737967 - DNA, 13 bp, Homo sapiens
aaatttattatgt

SEQ ID NO: 4737968 - DNA, 13 bp, Homo sapiens
aaatttcattttc

SEQ ID NO: 4737969 - DNA, 15 bp, Homo sapiens
aaatttctcattagt

SEQ ID NO: 4737970 - DNA, 18 bp, Homo sapiens
aaatttctgtaaaacagg

SEQ ID NO: 4737971 - DNA, 14 bp, Homo sapiens
aaatttgtaagttt

SEQ ID NO: 4737972 - DNA, 19 bp, Homo sapiens
aaatttgtaagtttcaggt

SEQ ID NO: 4737973 - DNA, 21 bp, Homo sapiens
aaattttgtgatgaataaaat

SEQ ID NO: 4737974 - DNA, 12 bp, Homo sapiens
aaatttttacaa

SEQ ID NO: 4737975 - DNA, 22 bp, Homo sapiens
aaattttttttcaaaaatgctg

SEQ ID NO: 4737976 - DNA, 13 bp, Homo sapiens
aacaaaaggcttt

SEQ ID NO: 4737977 - DNA, 20 bp, Homo sapiens
aacaaaatagcttattatag

SEQ ID NO: 4737978 - DNA, 23 bp, Homo sapiens
aacaaaatgcctttttgtttacc

SEQ ID NO: 4737979 - DNA, 15 bp, Homo sapiens
aacaaaatttctatt

SEQ ID NO: 4737980 - DNA, 15 bp, Homo sapiens
aacaaactaaatgta

SEQ ID NO: 4737981 - DNA, 22 bp, Homo sapiens
aacaaatatggctagttttcaa

SEQ ID NO: 4737982 - DNA, 17 bp, Homo sapiens
aacaagaaccatttgca

SEQ ID NO: 4737983 - DNA, 22 bp, Homo sapiens
aacaagcctgaccctgtaaaat

SEQ ID NO: 4737984 - DNA, 19 bp, Homo sapiens
aacaatatgaggagacatt

SEQ ID NO: 4737985 - DNA, 23 bp, Homo sapiens
aacaatcacaaaagctgtgtctc

SEQ ID NO: 4737986 - DNA, 18 bp, Homo sapiens
aacaatccaaatgcattc

SEQ ID NO: 4737987 - DNA, 18 bp, Homo sapiens
aacaatgaaattgaccta

SEQ ID NO: 4737988 - DNA, 11 bp, Homo sapiens
aacaatgttaa

SEQ ID NO: 4737989 - DNA, 14 bp, Homo sapiens
aacaattgtgaagt

SEQ ID NO: 4737990 - DNA, 19 bp, Homo sapiens
aacacaatggagtgtgtaa

SEQ ID NO: 4737991 - DNA, 14 bp, Homo sapiens
aacacatggcagaa

SEQ ID NO: 4737992 - DNA, 18 bp, Homo sapiens
aacactatatggcagtgt

SEQ ID NO: 4737993 - DNA, 21 bp, Homo sapiens
aacactatatggcagtgtctt

SEQ ID NO: 4737994 - DNA, 21 bp, Homo sapiens
aacactcacatttattctgct

SEQ ID NO: 4737995 - DNA, 17 bp, Homo sapiens
aacactcattgacctga

SEQ ID NO: 4737996 - DNA, 15 bp, Homo sapiens
aacactgagctgtca

SEQ ID NO: 4737997 - DNA, 14 bp, Homo sapiens
aacactgcaggcat

SEQ ID NO: 4737998 - DNA, 14 bp, Homo sapiens
aacactgcttgtgt

SEQ ID NO: 4737999 - DNA, 16 bp, Homo sapiens
aacactgtcttgaaga

SEQ ID NO: 4738000 - DNA, 14 bp, Homo sapiens
aacagaacagcttc

SEQ ID NO: 4738001 - DNA, 16 bp, Homo sapiens
aacagaacagcttcag

SEQ ID NO: 4738002 - DNA, 14 bp, Homo sapiens
aacagcctgagaaa

SEQ ID NO: 4738003 - DNA, 16 bp, Homo sapiens
aacagctaaatttgga

SEQ ID NO: 4738004 - DNA, 16 bp, Homo sapiens
aacagctaatgggaca

SEQ ID NO: 4738005 - DNA, 23 bp, Homo sapiens
aacagctctcttcaatgacatag

SEQ ID NO: 4738006 - DNA, 16 bp, Homo sapiens
aacagcttcaggttat

SEQ ID NO: 4738007 - DNA, 10 bp, Homo sapiens
aacaggaagc

SEQ ID NO: 4738008 - DNA, 18 bp, Homo sapiens
aacaggcactgccctggt

SEQ ID NO: 4738009 - DNA, 11 bp, Homo sapiens
aacaggcagat

SEQ ID NO: 4738010 - DNA, 13 bp, Homo sapiens
aacaggctgggct

SEQ ID NO: 4738011 - DNA, 22 bp, Homo sapiens
aacaggctgggcttcagtggca

SEQ ID NO: 4738012 - DNA, 23 bp, Homo sapiens
aacaggctgggcttcagtggcag

SEQ ID NO: 4738013 - DNA, 19 bp, Homo sapiens
aacaggttataacagtgtt

SEQ ID NO: 4738014 - DNA, 16 bp, Homo sapiens
aacagtctctggaaga

SEQ ID NO: 4738015 - DNA, 18 bp, Homo sapiens
aacagtctctggaagaag

SEQ ID NO: 4738016 - DNA, 20 bp, Homo sapiens
aacagtgcttgccacagagc

SEQ ID NO: 4738017 - DNA, 11 bp, Homo sapiens
aacagttttag

SEQ ID NO: 4738018 - DNA, 14 bp, Homo sapiens
aacatacagacaca

SEQ ID NO: 4738019 - DNA, 21 bp, Homo sapiens
aacatatcatttgtgaagaat

SEQ ID NO: 4738020 - DNA, 20 bp, Homo sapiens
aacatatctgtaaatagtga

SEQ ID NO: 4738021 - DNA, 15 bp, Homo sapiens
aacatattttacatc

SEQ ID NO: 4738022 - DNA, 21 bp, Homo sapiens
aacatcatcaaggcactgcct

SEQ ID NO: 4738023 - DNA, 22 bp, Homo sapiens
aacatcatcaaggcactgcctg

SEQ ID NO: 4738024 - DNA, 15 bp, Homo sapiens
aacatcctacaagac

SEQ ID NO: 4738025 - DNA, 15 bp, Homo sapiens
aacatcttttcttgc

SEQ ID NO: 4738026 - DNA, 21 bp, Homo sapiens
aacatgaaaacattgatgaat

SEQ ID NO: 4738027 - DNA, 21 bp, Homo sapiens
aacatgaagtcgttgtgaggg

SEQ ID NO: 4738028 - DNA, 16 bp, Homo sapiens
aacatgagttattcat

SEQ ID NO: 4738029 - DNA, 20 bp, Homo sapiens
aacatgagttattcataaag

SEQ ID NO: 4738030 - DNA, 17 bp, Homo sapiens
aacatggaaaacagagt

SEQ ID NO: 4738031 - DNA, 18 bp, Homo sapiens
aacatggattccaaagca

SEQ ID NO: 4738032 - DNA, 18 bp, Homo sapiens
aacatggtgtctggattc

SEQ ID NO: 4738033 - DNA, 15 bp, Homo sapiens
aacatgtaggaagta

SEQ ID NO: 4738034 - DNA, 17 bp, Homo sapiens
aacatgtataatatttt

SEQ ID NO: 4738035 - DNA, 16 bp, Homo sapiens
aacattaccttactgt

SEQ ID NO: 4738036 - DNA, 17 bp, Homo sapiens
aacattaccttactgtg

SEQ ID NO: 4738037 - DNA, 10 bp, Homo sapiens
aacattccat

SEQ ID NO: 4738038 - DNA, 23 bp, Homo sapiens
aacattccatccttgagtcaaaa

SEQ ID NO: 4738039 - DNA, 18 bp, Homo sapiens
aacattgatgaatgagga

SEQ ID NO: 4738040 - DNA, 14 bp, Homo sapiens
aacattttatttat

SEQ ID NO: 4738041 - DNA, 22 bp, Homo sapiens
aaccaaatcactgaactttgct

SEQ ID NO: 4738042 - DNA, 16 bp, Homo sapiens
aaccaagttgtttatt

SEQ ID NO: 4738043 - DNA, 13 bp, Homo sapiens
aaccacagctgct

SEQ ID NO: 4738044 - DNA, 15 bp, Homo sapiens
aaccacagctgctgg

SEQ ID NO: 4738045 - DNA, 13 bp, Homo sapiens
aaccacatcttgc

SEQ ID NO: 4738046 - DNA, 20 bp, Homo sapiens
aaccacatcttgctctgctg

SEQ ID NO: 4738047 - DNA, 22 bp, Homo sapiens
aaccacatcttgctctgctgac

SEQ ID NO: 4738048 - DNA, 17 bp, Homo sapiens
aaccactttttgcagct

SEQ ID NO: 4738049 - DNA, 21 bp, Homo sapiens
aaccagcatcccttgaccagg

SEQ ID NO: 4738050 - DNA, 20 bp, Homo sapiens
aaccagcctcatgctctgat

SEQ ID NO: 4738051 - DNA, 22 bp, Homo sapiens
aaccagcctcatgctctgatta

SEQ ID NO: 4738052 - DNA, 12 bp, Homo sapiens
aaccatcttctg

SEQ ID NO: 4738053 - DNA, 23 bp, Homo sapiens
aaccatgagtggcatggccacca

SEQ ID NO: 4738054 - DNA, 21 bp, Homo sapiens
aacccaaagagacagctcttc

SEQ ID NO: 4738055 - DNA, 14 bp, Homo sapiens
aacccagccgctgc

SEQ ID NO: 4738056 - DNA, 10 bp, Homo sapiens
aacccagctc

SEQ ID NO: 4738057 - DNA, 15 bp, Homo sapiens
aacccattgtcttta

SEQ ID NO: 4738058 - DNA, 19 bp, Homo sapiens
aacccccagcacccgggct

SEQ ID NO: 4738059 - DNA, 11 bp, Homo sapiens
aacccccagcc

SEQ ID NO: 4738060 - DNA, 13 bp, Homo sapiens
aacccccagcctg

SEQ ID NO: 4738061 - DNA, 11 bp, Homo sapiens
aaccccccagc

SEQ ID NO: 4738062 - DNA, 18 bp, Homo sapiens
aaccccccagcactgagg

SEQ ID NO: 4738063 - DNA, 14 bp, Homo sapiens
aaccctagctgtgt

SEQ ID NO: 4738064 - DNA, 12 bp, Homo sapiens
aaccctcactgg

SEQ ID NO: 4738065 - DNA, 14 bp, Homo sapiens
aaccctctgtgaaa

SEQ ID NO: 4738066 - DNA, 16 bp, Homo sapiens
aaccctggaaactacc

SEQ ID NO: 4738067 - DNA, 14 bp, Homo sapiens
aaccgctgaatatg

SEQ ID NO: 4738068 - DNA, 12 bp, Homo sapiens
aaccgtccctga

SEQ ID NO: 4738069 - DNA, 20 bp, Homo sapiens
aacctacacagctgtttcct

SEQ ID NO: 4738070 - DNA, 20 bp, Homo sapiens
aacctacagttttaactgtg

SEQ ID NO: 4738071 - DNA, 18 bp, Homo sapiens
aacctcctttctcttctc

SEQ ID NO: 4738072 - DNA, 19 bp, Homo sapiens
aacctcgctggactctcag

SEQ ID NO: 4738073 - DNA, 19 bp, Homo sapiens
aacctgatgaaaataaaga

SEQ ID NO: 4738074 - DNA, 22 bp, Homo sapiens
aacctgatgaaaataaagaatg

SEQ ID NO: 4738075 - DNA, 17 bp, Homo sapiens
aacctgatgcagtcacg

SEQ ID NO: 4738076 - DNA, 19 bp, Homo sapiens
aacctgattgtgtctcttg

SEQ ID NO: 4738077 - DNA, 19 bp, Homo sapiens
aacctggagggctagaacc

SEQ ID NO: 4738078 - DNA, 22 bp, Homo sapiens
aacctggagggctagaatctgg

SEQ ID NO: 4738079 - DNA, 12 bp, Homo sapiens
aacctggggggc

SEQ ID NO: 4738080 - DNA, 13 bp, Homo sapiens
aacctgggttagg

SEQ ID NO: 4738081 - DNA, 21 bp, Homo sapiens
aaccttgaagtgactgttgta

SEQ ID NO: 4738082 - DNA, 14 bp, Homo sapiens
aaccttgctatcaa

SEQ ID NO: 4738083 - DNA, 22 bp, Homo sapiens
aaccttttttaagatttttctc

SEQ ID NO: 4738084 - DNA, 16 bp, Homo sapiens
aacgaaaatgaaagct

SEQ ID NO: 4738085 - DNA, 18 bp, Homo sapiens
aacgactgggcactgcca

SEQ ID NO: 4738086 - DNA, 16 bp, Homo sapiens
aacggggctcttctca

SEQ ID NO: 4738087 - DNA, 23 bp, Homo sapiens
aacgtttttcctttaaaaaaatt

SEQ ID NO: 4738088 - DNA, 17 bp, Homo sapiens
aactaaaatcattgtca

SEQ ID NO: 4738089 - DNA, 18 bp, Homo sapiens
aactaaaatcattgtcaa

SEQ ID NO: 4738090 - DNA, 19 bp, Homo sapiens
aactacaaacaaaatttct

SEQ ID NO: 4738091 - DNA, 15 bp, Homo sapiens
aactacgtgacctct

SEQ ID NO: 4738092 - DNA, 16 bp, Homo sapiens
aactagaacctggagg

SEQ ID NO: 4738093 - DNA, 20 bp, Homo sapiens
aactagactcccaagctgga

SEQ ID NO: 4738094 - DNA, 23 bp, Homo sapiens
aactagagcagccctggagtcat

SEQ ID NO: 4738095 - DNA, 15 bp, Homo sapiens
aactagcattgtaaa

SEQ ID NO: 4738096 - DNA, 14 bp, Homo sapiens
aactagcctcatct

SEQ ID NO: 4738097 - DNA, 12 bp, Homo sapiens
aactagggctag

SEQ ID NO: 4738098 - DNA, 16 bp, Homo sapiens
aactagttaaaagcct

SEQ ID NO: 4738099 - DNA, 21 bp, Homo sapiens
aactatgtaatgcttatgtgt

SEQ ID NO: 4738100 - DNA, 14 bp, Homo sapiens
aactattgcccagg

SEQ ID NO: 4738101 - DNA, 12 bp, Homo sapiens
aactcaatattt

SEQ ID NO: 4738102 - DNA, 21 bp, Homo sapiens
aactcaatattttccatgaaa

SEQ ID NO: 4738103 - DNA, 12 bp, Homo sapiens
aactcaccccag

SEQ ID NO: 4738104 - DNA, 15 bp, Homo sapiens
aactcaccccagccc

SEQ ID NO: 4738105 - DNA, 22 bp, Homo sapiens
aactcagcctcaataagccttg

SEQ ID NO: 4738106 - DNA, 16 bp, Homo sapiens
aactcatactgtgctg

SEQ ID NO: 4738107 - DNA, 23 bp, Homo sapiens
aactcatactgtgctggagccac

SEQ ID NO: 4738108 - DNA, 19 bp, Homo sapiens
aactcatgactgagtctgg

SEQ ID NO: 4738109 - DNA, 19 bp, Homo sapiens
aactccaccttgcggggat

SEQ ID NO: 4738110 - DNA, 17 bp, Homo sapiens
aactcctactgcttcct

SEQ ID NO: 4738111 - DNA, 21 bp, Homo sapiens
aactcctagggccactgaaga

SEQ ID NO: 4738112 - DNA, 12 bp, Homo sapiens
aactcctgacct

SEQ ID NO: 4738113 - DNA, 19 bp, Homo sapiens
aactctcctctgctgctgg

SEQ ID NO: 4738114 - DNA, 23 bp, Homo sapiens
aactctggatgattcttccagat

SEQ ID NO: 4738115 - DNA, 17 bp, Homo sapiens
aactctggattttgaat

SEQ ID NO: 4738116 - DNA, 20 bp, Homo sapiens
aactcttaattagacctagg

SEQ ID NO: 4738117 - DNA, 14 bp, Homo sapiens
aactcttatctcag

SEQ ID NO: 4738118 - DNA, 21 bp, Homo sapiens
aactcttgtattgctccattt

SEQ ID NO: 4738119 - DNA, 22 bp, Homo sapiens
aactgaaatgagcatgcatttt

SEQ ID NO: 4738120 - DNA, 14 bp, Homo sapiens
aactgaattttgtc

SEQ ID NO: 4738121 - DNA, 17 bp, Homo sapiens
aactgccccctctgccc

SEQ ID NO: 4738122 - DNA, 18 bp, Homo sapiens
aactgccccctctgccct

SEQ ID NO: 4738123 - DNA, 20 bp, Homo sapiens
aactgccccctctgccctgc

SEQ ID NO: 4738124 - DNA, 15 bp, Homo sapiens
aactgctccaaattt

SEQ ID NO: 4738125 - DNA, 18 bp, Homo sapiens
aactgctccaaatttaac

SEQ ID NO: 4738126 - DNA, 17 bp, Homo sapiens
aactggaatagtttttt

SEQ ID NO: 4738127 - DNA, 23 bp, Homo sapiens
aactggctgaaaggttaattctc

SEQ ID NO: 4738128 - DNA, 21 bp, Homo sapiens
aactgggtacttgtggacaca

SEQ ID NO: 4738129 - DNA, 16 bp, Homo sapiens
aactggttgtatattt

SEQ ID NO: 4738130 - DNA, 15 bp, Homo sapiens
aactgtgaatgcttc

SEQ ID NO: 4738131 - DNA, 14 bp, Homo sapiens
aactgtggatattg

SEQ ID NO: 4738132 - DNA, 18 bp, Homo sapiens
aactgtggatattgttac

SEQ ID NO: 4738133 - DNA, 19 bp, Homo sapiens
aactgtgggattctgattt

SEQ ID NO: 4738134 - DNA, 15 bp, Homo sapiens
aactgtggtgccaca

SEQ ID NO: 4738135 - DNA, 13 bp, Homo sapiens
aactgtttagatg

SEQ ID NO: 4738136 - DNA, 20 bp, Homo sapiens
aacttcaaaaactaaaatca

SEQ ID NO: 4738137 - DNA, 23 bp, Homo sapiens
aacttccaaataaataattttca

SEQ ID NO: 4738138 - DNA, 16 bp, Homo sapiens
aacttccccatacaaa

SEQ ID NO: 4738139 - DNA, 20 bp, Homo sapiens
aacttgtaatttttttaatt

SEQ ID NO: 4738140 - DNA, 21 bp, Homo sapiens
aacttgtgaactccatcattc

SEQ ID NO: 4738141 - DNA, 19 bp, Homo sapiens
aacttgtgtccctaatgtg

SEQ ID NO: 4738142 - DNA, 18 bp, Homo sapiens
aactttatacacttggat

SEQ ID NO: 4738143 - DNA, 15 bp, Homo sapiens
aactttgctgagcct

SEQ ID NO: 4738144 - DNA, 20 bp, Homo sapiens
aacttttttttaagttacac

SEQ ID NO: 4738145 - DNA, 12 bp, Homo sapiens
aagaaaacaaac

SEQ ID NO: 4738146 - DNA, 16 bp, Homo sapiens
aagaaaacaaactaaa

SEQ ID NO: 4738147 - DNA, 15 bp, Homo sapiens
aagaaaagttttgta

SEQ ID NO: 4738148 - DNA, 19 bp, Homo sapiens
aagaaaatgaatttgactg

SEQ ID NO: 4738149 - DNA, 22 bp, Homo sapiens
aagaaaatgaatttgactggtt

SEQ ID NO: 4738150 - DNA, 15 bp, Homo sapiens
aagaaaatgtgtctg

SEQ ID NO: 4738151 - DNA, 12 bp, Homo sapiens
aagaaacaaaaa

SEQ ID NO: 4738152 - DNA, 14 bp, Homo sapiens
aagaaacaatttaa

SEQ ID NO: 4738153 - DNA, 12 bp, Homo sapiens
aagaaagcaact

SEQ ID NO: 4738154 - DNA, 19 bp, Homo sapiens
aagaaagcccttaggaaga

SEQ ID NO: 4738155 - DNA, 15 bp, Homo sapiens
aagaaatcaattttt

SEQ ID NO: 4738156 - DNA, 21 bp, Homo sapiens
aagaacggggctcttctcatt

SEQ ID NO: 4738157 - DNA, 20 bp, Homo sapiens
aagaactacaaacaaaattt

SEQ ID NO: 4738158 - DNA, 14 bp, Homo sapiens
aagaactagcataa

SEQ ID NO: 4738159 - DNA, 20 bp, Homo sapiens
aagaactgtcatgtaaacat

SEQ ID NO: 4738160 - DNA, 22 bp, Homo sapiens
aagaactgtcatgtaaacatac

SEQ ID NO: 4738161 - DNA, 17 bp, Homo sapiens
aagaactttaaattgtg

SEQ ID NO: 4738162 - DNA, 19 bp, Homo sapiens
aagaagagcgagagatcaa

SEQ ID NO: 4738163 - DNA, 22 bp, Homo sapiens
aagaagagcgagagatcaaaga

SEQ ID NO: 4738164 - DNA, 16 bp, Homo sapiens
aagaagcccaggaaag

SEQ ID NO: 4738165 - DNA, 18 bp, Homo sapiens
aagaagctgttgtacatt

SEQ ID NO: 4738166 - DNA, 19 bp, Homo sapiens
aagaagctgttgtacattt

SEQ ID NO: 4738167 - DNA, 23 bp, Homo sapiens
aagaagctgttgtacatttatga

SEQ ID NO: 4738168 - DNA, 15 bp, Homo sapiens
aagaaggaaaaattt

SEQ ID NO: 4738169 - DNA, 17 bp, Homo sapiens
aagaaggaaaaggcagg

SEQ ID NO: 4738170 - DNA, 12 bp, Homo sapiens
aagaagtttggg

SEQ ID NO: 4738171 - DNA, 14 bp, Homo sapiens
aagaatgtctgtac

SEQ ID NO: 4738172 - DNA, 21 bp, Homo sapiens
aagaatgttagagtaatgaaa

SEQ ID NO: 4738173 - DNA, 20 bp, Homo sapiens
aagaattattcagtgaattt

SEQ ID NO: 4738174 - DNA, 21 bp, Homo sapiens
aagaattattcagtgaatttg

SEQ ID NO: 4738175 - DNA, 23 bp, Homo sapiens
aagaattattcagtgaatttgtc

SEQ ID NO: 4738176 - DNA, 21 bp, Homo sapiens
aagacaaggaaaaaataacaa

SEQ ID NO: 4738177 - DNA, 23 bp, Homo sapiens
aagacaatggcttactccaggag

SEQ ID NO: 4738178 - DNA, 18 bp, Homo sapiens
aagacacatgtggagaag

SEQ ID NO: 4738179 - DNA, 15 bp, Homo sapiens
aagacaccagagcag

SEQ ID NO: 4738180 - DNA, 23 bp, Homo sapiens
aagacaccagagcagatgcagag

SEQ ID NO: 4738181 - DNA, 18 bp, Homo sapiens
aagacaccgttcattcag

SEQ ID NO: 4738182 - DNA, 15 bp, Homo sapiens
aagacagagctggga

SEQ ID NO: 4738183 - DNA, 16 bp, Homo sapiens
aagacagagctgggat

SEQ ID NO: 4738184 - DNA, 18 bp, Homo sapiens
aagacaggagacaaaaga

SEQ ID NO: 4738185 - DNA, 14 bp, Homo sapiens
aagacataacgttt

SEQ ID NO: 4738186 - DNA, 21 bp, Homo sapiens
aagacataacgtttttccttt

SEQ ID NO: 4738187 - DNA, 14 bp, Homo sapiens
aagaccaaattttg

SEQ ID NO: 4738188 - DNA, 16 bp, Homo sapiens
aagaccaccacctcag

SEQ ID NO: 4738189 - DNA, 14 bp, Homo sapiens
aagaccctctcagg

SEQ ID NO: 4738190 - DNA, 21 bp, Homo sapiens
aagacccttgtggtcccaccc

SEQ ID NO: 4738191 - DNA, 12 bp, Homo sapiens
aagacctggcaa

SEQ ID NO: 4738192 - DNA, 15 bp, Homo sapiens
aagaccttctccttc

SEQ ID NO: 4738193 - DNA, 18 bp, Homo sapiens
aagaccttctccttcacc

SEQ ID NO: 4738194 - DNA, 17 bp, Homo sapiens
aagacgctgtgctgccc

SEQ ID NO: 4738195 - DNA, 20 bp, Homo sapiens
aagacgctgtgctgccctgc

SEQ ID NO: 4738196 - DNA, 21 bp, Homo sapiens
aagacgctgtgctgccctgcc

SEQ ID NO: 4738197 - DNA, 22 bp, Homo sapiens
aagacgtgattttgctgtagaa

SEQ ID NO: 4738198 - DNA, 10 bp, Homo sapiens
aagactcatc

SEQ ID NO: 4738199 - DNA, 21 bp, Homo sapiens
aagactggaaggtggggacag

SEQ ID NO: 4738200 - DNA, 17 bp, Homo sapiens
aagacttttccaaccct

SEQ ID NO: 4738201 - DNA, 21 bp, Homo sapiens
aagagaatattcctacttgca

SEQ ID NO: 4738202 - DNA, 14 bp, Homo sapiens
aagagacagtcacc

SEQ ID NO: 4738203 - DNA, 12 bp, Homo sapiens
aagagagaaaaa

SEQ ID NO: 4738204 - DNA, 14 bp, Homo sapiens
aagagagtttgcca

SEQ ID NO: 4738205 - DNA, 13 bp, Homo sapiens
aagagatagagac

SEQ ID NO: 4738206 - DNA, 23 bp, Homo sapiens
aagagattcactcagaagacaca

SEQ ID NO: 4738207 - DNA, 12 bp, Homo sapiens
aagagcacagcc

SEQ ID NO: 4738208 - DNA, 14 bp, Homo sapiens
aagagcacagccct

SEQ ID NO: 4738209 - DNA, 18 bp, Homo sapiens
aagagcgagagatcaaag

SEQ ID NO: 4738210 - DNA, 23 bp, Homo sapiens
aagagcgagagatcaaagatgaa

SEQ ID NO: 4738211 - DNA, 14 bp, Homo sapiens
aagagcttccagag

SEQ ID NO: 4738212 - DNA, 18 bp, Homo sapiens
aagagcttccagagctct

SEQ ID NO: 4738213 - DNA, 14 bp, Homo sapiens
aagaggcagggtct

SEQ ID NO: 4738214 - DNA, 16 bp, Homo sapiens
aagagggacgcctggg

SEQ ID NO: 4738215 - DNA, 16 bp, Homo sapiens
aagaggtgactgggcc

SEQ ID NO: 4738216 - DNA, 14 bp, Homo sapiens
aagagtaggaagac

SEQ ID NO: 4738217 - DNA, 16 bp, Homo sapiens
aagagtaggaagactt

SEQ ID NO: 4738218 - DNA, 19 bp, Homo sapiens
aagagtaggaagactttgg

SEQ ID NO: 4738219 - DNA, 12 bp, Homo sapiens
aagagtgtagaa

SEQ ID NO: 4738220 - DNA, 13 bp, Homo sapiens
aagagtgtagaag

SEQ ID NO: 4738221 - DNA, 15 bp, Homo sapiens
aagagtgtagaagca

SEQ ID NO: 4738222 - DNA, 22 bp, Homo sapiens
aagagtttgatgaggccctcca

SEQ ID NO: 4738223 - DNA, 13 bp, Homo sapiens
aagataaaaatca

SEQ ID NO: 4738224 - DNA, 18 bp, Homo sapiens
aagataataaattgattt

SEQ ID NO: 4738225 - DNA, 20 bp, Homo sapiens
aagatataactattgcccag

SEQ ID NO: 4738226 - DNA, 19 bp, Homo sapiens
aagatcccaacatggtcct

SEQ ID NO: 4738227 - DNA, 13 bp, Homo sapiens
aagatgtatgctt

SEQ ID NO: 4738228 - DNA, 16 bp, Homo sapiens
aagattaacactaatt

SEQ ID NO: 4738229 - DNA, 20 bp, Homo sapiens
aagattaacactcatttcca

SEQ ID NO: 4738230 - DNA, 19 bp, Homo sapiens
aagattaatagcattcgaa

SEQ ID NO: 4738231 - DNA, 21 bp, Homo sapiens
aagattctatgttaatatttt

SEQ ID NO: 4738232 - DNA, 19 bp, Homo sapiens
aagatttttctcaaagttt

SEQ ID NO: 4738233 - DNA, 15 bp, Homo sapiens
aagcaaaaagatgta

SEQ ID NO: 4738234 - DNA, 16 bp, Homo sapiens
aagcaagatttcagat

SEQ ID NO: 4738235 - DNA, 22 bp, Homo sapiens
aagcaagtgattgggacagagg

SEQ ID NO: 4738236 - DNA, 13 bp, Homo sapiens
aagcaatatgcat

SEQ ID NO: 4738237 - DNA, 15 bp, Homo sapiens
aagcaattagacaag

SEQ ID NO: 4738238 - DNA, 14 bp, Homo sapiens
aagcaccaagctca

SEQ ID NO: 4738239 - DNA, 13 bp, Homo sapiens
aagcacctcctgc

SEQ ID NO: 4738240 - DNA, 14 bp, Homo sapiens
aagcacctcctgcc

SEQ ID NO: 4738241 - DNA, 15 bp, Homo sapiens
aagcacctcctgcct

SEQ ID NO: 4738242 - DNA, 16 bp, Homo sapiens
aagcactaaacaaaga

SEQ ID NO: 4738243 - DNA, 12 bp, Homo sapiens
aagcactgtgct

SEQ ID NO: 4738244 - DNA, 16 bp, Homo sapiens
aagcactgtgctcagg

SEQ ID NO: 4738245 - DNA, 13 bp, Homo sapiens
aagcagaaaatac

SEQ ID NO: 4738246 - DNA, 15 bp, Homo sapiens
aagcagagttctttg

SEQ ID NO: 4738247 - DNA, 17 bp, Homo sapiens
aagcagagttctttgca

SEQ ID NO: 4738248 - DNA, 16 bp, Homo sapiens
aagcaggcctttgcag

SEQ ID NO: 4738249 - DNA, 22 bp, Homo sapiens
aagcaggctacactgacactgg

SEQ ID NO: 4738250 - DNA, 17 bp, Homo sapiens
aagcagggtctgggcag

SEQ ID NO: 4738251 - DNA, 14 bp, Homo sapiens
aagcagtagacaag

SEQ ID NO: 4738252 - DNA, 13 bp, Homo sapiens
aagcattcacaac

SEQ ID NO: 4738253 - DNA, 13 bp, Homo sapiens
aagcattccttct

SEQ ID NO: 4738254 - DNA, 16 bp, Homo sapiens
aagcattccttctttg

SEQ ID NO: 4738255 - DNA, 17 bp, Homo sapiens
aagcattccttctttga

SEQ ID NO: 4738256 - DNA, 16 bp, Homo sapiens
aagcatttactttgtg

SEQ ID NO: 4738257 - DNA, 19 bp, Homo sapiens
aagcattttcgttacattg

SEQ ID NO: 4738258 - DNA, 22 bp, Homo sapiens
aagcattttcgttacattgtgt

SEQ ID NO: 4738259 - DNA, 20 bp, Homo sapiens
aagccaaagctaggcctggc

SEQ ID NO: 4738260 - DNA, 23 bp, Homo sapiens
aagccacaggcctgagatttcat

SEQ ID NO: 4738261 - DNA, 21 bp, Homo sapiens
aagccaccaacatactcccat

SEQ ID NO: 4738262 - DNA, 14 bp, Homo sapiens
aagccagcgtcctc

SEQ ID NO: 4738263 - DNA, 17 bp, Homo sapiens
aagccagcgtcctcctc

SEQ ID NO: 4738264 - DNA, 17 bp, Homo sapiens
aagccaggattggggac

SEQ ID NO: 4738265 - DNA, 14 bp, Homo sapiens
aagcccaggaaagg

SEQ ID NO: 4738266 - DNA, 12 bp, Homo sapiens
aagccctgaggg

SEQ ID NO: 4738267 - DNA, 22 bp, Homo sapiens
aagcctagtgaaggcttctctc

SEQ ID NO: 4738268 - DNA, 17 bp, Homo sapiens
aagcctcaaatttgaac

SEQ ID NO: 4738269 - DNA, 17 bp, Homo sapiens
aagcctctgtgtcactg

SEQ ID NO: 4738270 - DNA, 18 bp, Homo sapiens
aagcctctgtgtcactgg

SEQ ID NO: 4738271 - DNA, 23 bp, Homo sapiens
aagcctctgtgtcactggctgcc

SEQ ID NO: 4738272 - DNA, 24 bp, Homo sapiens
aagcctctgtgtcactggctgcct

SEQ ID NO: 4738273 - DNA, 12 bp, Homo sapiens
aagccttctgac

SEQ ID NO: 4738274 - DNA, 16 bp, Homo sapiens
aagccttgttttctct

SEQ ID NO: 4738275 - DNA, 15 bp, Homo sapiens
aagcgattcttctgc

SEQ ID NO: 4738276 - DNA, 16 bp, Homo sapiens
aagcgattcttctgct

SEQ ID NO: 4738277 - DNA, 21 bp, Homo sapiens
aagcgattcttctgcttcagc

SEQ ID NO: 4738278 - DNA, 16 bp, Homo sapiens
aagcgcttctttctga

SEQ ID NO: 4738279 - DNA, 17 bp, Homo sapiens
aagcgtgagccactgca

SEQ ID NO: 4738280 - DNA, 16 bp, Homo sapiens
aagctaaaacctgagc

SEQ ID NO: 4738281 - DNA, 12 bp, Homo sapiens
aagctagctccc

SEQ ID NO: 4738282 - DNA, 15 bp, Homo sapiens
aagctagctcccctc

SEQ ID NO: 4738283 - DNA, 17 bp, Homo sapiens
aagctatcctggctctt

SEQ ID NO: 4738284 - DNA, 19 bp, Homo sapiens
aagctattagccaggatca

SEQ ID NO: 4738285 - DNA, 21 bp, Homo sapiens
aagctattagccaggatcatg

SEQ ID NO: 4738286 - DNA, 13 bp, Homo sapiens
aagctatttcctt

SEQ ID NO: 4738287 - DNA, 12 bp, Homo sapiens
aagctcagggcc

SEQ ID NO: 4738288 - DNA, 17 bp, Homo sapiens
aagctcagggcctggct

SEQ ID NO: 4738289 - DNA, 22 bp, Homo sapiens
aagctcccaagagcttccagag

SEQ ID NO: 4738290 - DNA, 23 bp, Homo sapiens
aagctcccaggcattccccagga

SEQ ID NO: 4738291 - DNA, 11 bp, Homo sapiens
aagctctgagc

SEQ ID NO: 4738292 - DNA, 18 bp, Homo sapiens
aagctgagagtgctatga

SEQ ID NO: 4738293 - DNA, 14 bp, Homo sapiens
aagctgctgacagt

SEQ ID NO: 4738294 - DNA, 16 bp, Homo sapiens
aagctgctgacagtgt

SEQ ID NO: 4738295 - DNA, 19 bp, Homo sapiens
aagctggaggactagaacc

SEQ ID NO: 4738296 - DNA, 21 bp, Homo sapiens
aagctggtcccactcagtcca

SEQ ID NO: 4738297 - DNA, 21 bp, Homo sapiens
aagctgtgccaccctgggctc

SEQ ID NO: 4738298 - DNA, 20 bp, Homo sapiens
aagctgtgtctctgtatata

SEQ ID NO: 4738299 - DNA, 12 bp, Homo sapiens
aagctgttgtac

SEQ ID NO: 4738300 - DNA, 13 bp, Homo sapiens
aagctgttgtaca

SEQ ID NO: 4738301 - DNA, 17 bp, Homo sapiens
aagctgttgtacattta

SEQ ID NO: 4738302 - DNA, 13 bp, Homo sapiens
aagcttaaaaaga

SEQ ID NO: 4738303 - DNA, 15 bp, Homo sapiens
aagcttaaaaagagc

SEQ ID NO: 4738304 - DNA, 18 bp, Homo sapiens
aagcttagattttctgta

SEQ ID NO: 4738305 - DNA, 19 bp, Homo sapiens
aagcttcagtgctgccgat

SEQ ID NO: 4738306 - DNA, 19 bp, Homo sapiens
aagcttcattataaaatat

SEQ ID NO: 4738307 - DNA, 15 bp, Homo sapiens
aagcttctaaatggt

SEQ ID NO: 4738308 - DNA, 13 bp, Homo sapiens
aagcttctaatta

SEQ ID NO: 4738309 - DNA, 17 bp, Homo sapiens
aagcttggttctgtgaa

SEQ ID NO: 4738310 - DNA, 15 bp, Homo sapiens
aagctttctgtctcc

SEQ ID NO: 4738311 - DNA, 15 bp, Homo sapiens
aaggaaaaaattatg

SEQ ID NO: 4738312 - DNA, 23 bp, Homo sapiens
aaggaaaaaattatgtttttcag

SEQ ID NO: 4738313 - DNA, 12 bp, Homo sapiens
aaggaaactctt

SEQ ID NO: 4738314 - DNA, 15 bp, Homo sapiens
aaggaaagagggagg

SEQ ID NO: 4738315 - DNA, 16 bp, Homo sapiens
aaggaagctaaaagca

SEQ ID NO: 4738316 - DNA, 15 bp, Homo sapiens
aaggactagggtcct

SEQ ID NO: 4738317 - DNA, 20 bp, Homo sapiens
aaggactgtgacaggcagca

SEQ ID NO: 4738318 - DNA, 12 bp, Homo sapiens
aaggagacacaa

SEQ ID NO: 4738319 - DNA, 14 bp, Homo sapiens
aaggagaggaggca

SEQ ID NO: 4738320 - DNA, 13 bp, Homo sapiens
aaggagctgcctg

SEQ ID NO: 4738321 - DNA, 17 bp, Homo sapiens
aaggagctgcctggacc

SEQ ID NO: 4738322 - DNA, 15 bp, Homo sapiens
aaggaggctggctgg

SEQ ID NO: 4738323 - DNA, 18 bp, Homo sapiens
aaggaggctggctggggc

SEQ ID NO: 4738324 - DNA, 13 bp, Homo sapiens
aaggataatgaat

SEQ ID NO: 4738325 - DNA, 21 bp, Homo sapiens
aaggatcagaagtatggaatt

SEQ ID NO: 4738326 - DNA, 13 bp, Homo sapiens
aaggatccatctt

SEQ ID NO: 4738327 - DNA, 18 bp, Homo sapiens
aaggatgatctaggaaga

SEQ ID NO: 4738328 - DNA, 14 bp, Homo sapiens
aaggattgtaaaaa

SEQ ID NO: 4738329 - DNA, 16 bp, Homo sapiens
aaggcaaatgcccaag

SEQ ID NO: 4738330 - DNA, 17 bp, Homo sapiens
aaggcaaatgcccaagg

SEQ ID NO: 4738331 - DNA, 22 bp, Homo sapiens
aaggcaatgccatcctcaaaca

SEQ ID NO: 4738332 - DNA, 12 bp, Homo sapiens
aaggcactgcct

SEQ ID NO: 4738333 - DNA, 22 bp, Homo sapiens
aaggcagggagggcctgggccc

SEQ ID NO: 4738334 - DNA, 18 bp, Homo sapiens
aaggcatgtgtgaaacat

SEQ ID NO: 4738335 - DNA, 19 bp, Homo sapiens
aaggcatgtgtgaaacata

SEQ ID NO: 4738336 - DNA, 15 bp, Homo sapiens
aaggcctcccacagt

SEQ ID NO: 4738337 - DNA, 22 bp, Homo sapiens
aaggcctgcgtgtgtctgtgtt

SEQ ID NO: 4738338 - DNA, 15 bp, Homo sapiens
aaggcgggtggatca

SEQ ID NO: 4738339 - DNA, 14 bp, Homo sapiens
aaggcgtggagctg

SEQ ID NO: 4738340 - DNA, 16 bp, Homo sapiens
aaggcgtggagctgcc

SEQ ID NO: 4738341 - DNA, 19 bp, Homo sapiens
aaggcgtggagctgcctga

SEQ ID NO: 4738342 - DNA, 14 bp, Homo sapiens
aaggctccaggagc

SEQ ID NO: 4738343 - DNA, 15 bp, Homo sapiens
aaggctccaggagca

SEQ ID NO: 4738344 - DNA, 19 bp, Homo sapiens
aaggctcgagcatgcctgg

SEQ ID NO: 4738345 - DNA, 16 bp, Homo sapiens
aaggctgtgctccctg

SEQ ID NO: 4738346 - DNA, 22 bp, Homo sapiens
aaggctgtgctccctggttctg

SEQ ID NO: 4738347 - DNA, 17 bp, Homo sapiens
aaggcttctctctgtgg

SEQ ID NO: 4738348 - DNA, 18 bp, Homo sapiens
aaggcttctctctgtggg

SEQ ID NO: 4738349 - DNA, 16 bp, Homo sapiens
aagggaaaagtctctt

SEQ ID NO: 4738350 - DNA, 20 bp, Homo sapiens
aagggacttggaagctccgc

SEQ ID NO: 4738351 - DNA, 17 bp, Homo sapiens
aagggattttagtcaca

SEQ ID NO: 4738352 - DNA, 20 bp, Homo sapiens
aagggattttagtcacacgt

SEQ ID NO: 4738353 - DNA, 11 bp, Homo sapiens
aagggcagagg

SEQ ID NO: 4738354 - DNA, 15 bp, Homo sapiens
aagggcagaggggtg

SEQ ID NO: 4738355 - DNA, 13 bp, Homo sapiens
aagggcccagaga

SEQ ID NO: 4738356 - DNA, 23 bp, Homo sapiens
aagggcctgcccagttgcactca

SEQ ID NO: 4738357 - DNA, 13 bp, Homo sapiens
aagggcctggcct

SEQ ID NO: 4738358 - DNA, 19 bp, Homo sapiens
aagggctagaacctggagg

SEQ ID NO: 4738359 - DNA, 17 bp, Homo sapiens
aaggggccagaggctcg

SEQ ID NO: 4738360 - DNA, 12 bp, Homo sapiens
aaggggtggccg

SEQ ID NO: 4738361 - DNA, 19 bp, Homo sapiens
aagggtatcaggtgctgcc

SEQ ID NO: 4738362 - DNA, 16 bp, Homo sapiens
aagggtatctggtgac

SEQ ID NO: 4738363 - DNA, 13 bp, Homo sapiens
aaggtagaatgtt

SEQ ID NO: 4738364 - DNA, 17 bp, Homo sapiens
aaggtataattaaactt

SEQ ID NO: 4738365 - DNA, 15 bp, Homo sapiens
aaggtatattgtgaa

SEQ ID NO: 4738366 - DNA, 15 bp, Homo sapiens
aaggtgcttgttatg

SEQ ID NO: 4738367 - DNA, 22 bp, Homo sapiens
aaggtggtctgctcgggcccag

SEQ ID NO: 4738368 - DNA, 22 bp, Homo sapiens
aaggttaattctctagggctag

SEQ ID NO: 4738369 - DNA, 23 bp, Homo sapiens
aaggttccgcttggagcagaggg

SEQ ID NO: 4738370 - DNA, 17 bp, Homo sapiens
aaggttgtattgcatat

SEQ ID NO: 4738371 - DNA, 17 bp, Homo sapiens
aaggtttataaagcaga

SEQ ID NO: 4738372 - DNA, 22 bp, Homo sapiens
aagtacttctccaccctgctct

SEQ ID NO: 4738373 - DNA, 21 bp, Homo sapiens
aagtagaaactactaattttt

SEQ ID NO: 4738374 - DNA, 19 bp, Homo sapiens
aagtagcaaccctgtgata

SEQ ID NO: 4738375 - DNA, 16 bp, Homo sapiens
aagtagtaaattttgt

SEQ ID NO: 4738376 - DNA, 20 bp, Homo sapiens
aagtatgtatattaaaaaag

SEQ ID NO: 4738377 - DNA, 22 bp, Homo sapiens
aagtatgtatattaaaaaagag

SEQ ID NO: 4738378 - DNA, 14 bp, Homo sapiens
aagtattgtttaca

SEQ ID NO: 4738379 - DNA, 21 bp, Homo sapiens
aagtatttcaaattggagctt

SEQ ID NO: 4738380 - DNA, 17 bp, Homo sapiens
aagtattttcataagta

SEQ ID NO: 4738381 - DNA, 16 bp, Homo sapiens
aagtcaacctgcctga

SEQ ID NO: 4738382 - DNA, 21 bp, Homo sapiens
aagtcacacattacaaagtta

SEQ ID NO: 4738383 - DNA, 14 bp, Homo sapiens
aagtcaggtggggt

SEQ ID NO: 4738384 - DNA, 20 bp, Homo sapiens
aagtcatgcaaaggctggga

SEQ ID NO: 4738385 - DNA, 21 bp, Homo sapiens
aagtcatgcgtttaatcacat

SEQ ID NO: 4738386 - DNA, 14 bp, Homo sapiens
aagtccacagtgga

SEQ ID NO: 4738387 - DNA, 13 bp, Homo sapiens
aagtccctcagag

SEQ ID NO: 4738388 - DNA, 18 bp, Homo sapiens
aagtctcctttactgaat

SEQ ID NO: 4738389 - DNA, 20 bp, Homo sapiens
aagtctcctttactgaatgt

SEQ ID NO: 4738390 - DNA, 18 bp, Homo sapiens
aagtctcgaatgtaattg

SEQ ID NO: 4738391 - DNA, 22 bp, Homo sapiens
aagtctgctctcatataagaca

SEQ ID NO: 4738392 - DNA, 22 bp, Homo sapiens
aagtcttatatattgtagataa

SEQ ID NO: 4738393 - DNA, 12 bp, Homo sapiens
aagtcttgcatt

SEQ ID NO: 4738394 - DNA, 17 bp, Homo sapiens
aagtgaaaaacagaaaa

SEQ ID NO: 4738395 - DNA, 17 bp, Homo sapiens
aagtgacaccaataaat

SEQ ID NO: 4738396 - DNA, 19 bp, Homo sapiens
aagtgactttggctgcatg

SEQ ID NO: 4738397 - DNA, 22 bp, Homo sapiens
aagtgagacagtccagcctgga

SEQ ID NO: 4738398 - DNA, 18 bp, Homo sapiens
aagtgagactttgagggt

SEQ ID NO: 4738399 - DNA, 15 bp, Homo sapiens
aagtgagagctgggt

SEQ ID NO: 4738400 - DNA, 13 bp, Homo sapiens
aagtgagtggcat

SEQ ID NO: 4738401 - DNA, 20 bp, Homo sapiens
aagtgatcctcccacctcag

SEQ ID NO: 4738402 - DNA, 23 bp, Homo sapiens
aagtgatcctcccacctcagcct

SEQ ID NO: 4738403 - DNA, 20 bp, Homo sapiens
aagtgatccttccacctcag

SEQ ID NO: 4738404 - DNA, 20 bp, Homo sapiens
aagtgattctcatgcctcag

SEQ ID NO: 4738405 - DNA, 21 bp, Homo sapiens
aagtgattctcatgcctcagc

SEQ ID NO: 4738406 - DNA, 18 bp, Homo sapiens
aagtgcgtgtgtagagtt

SEQ ID NO: 4738407 - DNA, 23 bp, Homo sapiens
aagtgcgtgtgtagagttaagaa

SEQ ID NO: 4738408 - DNA, 15 bp, Homo sapiens
aagtggctgtgacat

SEQ ID NO: 4738409 - DNA, 18 bp, Homo sapiens
aagtgggagatgaaaacc

SEQ ID NO: 4738410 - DNA, 14 bp, Homo sapiens
aagtgtaagtttgt

SEQ ID NO: 4738411 - DNA, 12 bp, Homo sapiens
aagttaaatgta

SEQ ID NO: 4738412 - DNA, 13 bp, Homo sapiens
aagttaaatgtat

SEQ ID NO: 4738413 - DNA, 11 bp, Homo sapiens
aagttaagaat

SEQ ID NO: 4738414 - DNA, 18 bp, Homo sapiens
aagttaaggtatctggta

SEQ ID NO: 4738415 - DNA, 16 bp, Homo sapiens
aagttcaggctctgag

SEQ ID NO: 4738416 - DNA, 20 bp, Homo sapiens
aagttccagttttgttttga

SEQ ID NO: 4738417 - DNA, 17 bp, Homo sapiens
aagttgatatagaacag

SEQ ID NO: 4738418 - DNA, 14 bp, Homo sapiens
aagttgattcatat

SEQ ID NO: 4738419 - DNA, 16 bp, Homo sapiens
aagttgcacggctgct

SEQ ID NO: 4738420 - DNA, 23 bp, Homo sapiens
aagttggtcttactttgtgcaaa

SEQ ID NO: 4738421 - DNA, 22 bp, Homo sapiens
aagttgtaggcataaagtcagg

SEQ ID NO: 4738422 - DNA, 17 bp, Homo sapiens
aagttgtataaaaacat

SEQ ID NO: 4738423 - DNA, 16 bp, Homo sapiens
aagttgtgtctgaaaa

SEQ ID NO: 4738424 - DNA, 14 bp, Homo sapiens
aagtttcaggtgac

SEQ ID NO: 4738425 - DNA, 15 bp, Homo sapiens
aagtttcaggtgaca

SEQ ID NO: 4738426 - DNA, 21 bp, Homo sapiens
aagtttcaggtgacatgtgaa

SEQ ID NO: 4738427 - DNA, 22 bp, Homo sapiens
aagtttctttgaaaatagttat

SEQ ID NO: 4738428 - DNA, 18 bp, Homo sapiens
aagtttgggctaacattt

SEQ ID NO: 4738429 - DNA, 18 bp, Homo sapiens
aagtttgtcctttaacta

SEQ ID NO: 4738430 - DNA, 16 bp, Homo sapiens
aagttttatttaactt

SEQ ID NO: 4738431 - DNA, 15 bp, Homo sapiens
aagttttgtaaattt

SEQ ID NO: 4738432 - DNA, 11 bp, Homo sapiens
aataaaaatat

SEQ ID NO: 4738433 - DNA, 15 bp, Homo sapiens
aataaaataattcta

SEQ ID NO: 4738434 - DNA, 17 bp, Homo sapiens
aataaaataattctaaa

SEQ ID NO: 4738435 - DNA, 20 bp, Homo sapiens
aataaaatatatcttataaa

SEQ ID NO: 4738436 - DNA, 18 bp, Homo sapiens
aataaaccaaaggaaaat

SEQ ID NO: 4738437 - DNA, 18 bp, Homo sapiens
aataaagccttcaaactc

SEQ ID NO: 4738438 - DNA, 15 bp, Homo sapiens
aataaaggcctgcgt

SEQ ID NO: 4738439 - DNA, 16 bp, Homo sapiens
aataaagtacaagagc

SEQ ID NO: 4738440 - DNA, 16 bp, Homo sapiens
aataaagtgtgtgtgc

SEQ ID NO: 4738441 - DNA, 16 bp, Homo sapiens
aataaataattttcat

SEQ ID NO: 4738442 - DNA, 12 bp, Homo sapiens
aataaatactgc

SEQ ID NO: 4738443 - DNA, 23 bp, Homo sapiens
aataaatactgcagcttgagttt

SEQ ID NO: 4738444 - DNA, 22 bp, Homo sapiens
aataaatgtttgttatttacac

SEQ ID NO: 4738445 - DNA, 15 bp, Homo sapiens
aataaattgatttgt

SEQ ID NO: 4738446 - DNA, 20 bp, Homo sapiens
aataacaatgttaaggaaac

SEQ ID NO: 4738447 - DNA, 13 bp, Homo sapiens
aataacattacct

SEQ ID NO: 4738448 - DNA, 14 bp, Homo sapiens
aataacattacctt

SEQ ID NO: 4738449 - DNA, 20 bp, Homo sapiens
aataaccttattctatactt

SEQ ID NO: 4738450 - DNA, 15 bp, Homo sapiens
aataacgataaaaga

SEQ ID NO: 4738451 - DNA, 19 bp, Homo sapiens
aataatgggcttagagcag

SEQ ID NO: 4738452 - DNA, 14 bp, Homo sapiens
aataatgtatgtac

SEQ ID NO: 4738453 - DNA, 12 bp, Homo sapiens
aataatgtctct

SEQ ID NO: 4738454 - DNA, 16 bp, Homo sapiens
aataattttcctgtga

SEQ ID NO: 4738455 - DNA, 21 bp, Homo sapiens
aatacaccaggtagaacacaa

SEQ ID NO: 4738456 - DNA, 17 bp, Homo sapiens
aatacagatttgtaaca

SEQ ID NO: 4738457 - DNA, 18 bp, Homo sapiens
aatacctgtccccctgac

SEQ ID NO: 4738458 - DNA, 19 bp, Homo sapiens
aatacctgtccccctgaca

SEQ ID NO: 4738459 - DNA, 15 bp, Homo sapiens
aatactatccaaata

SEQ ID NO: 4738460 - DNA, 21 bp, Homo sapiens
aatactcagggaaagcattta

SEQ ID NO: 4738461 - DNA, 13 bp, Homo sapiens
aatactggactca

SEQ ID NO: 4738462 - DNA, 20 bp, Homo sapiens
aatactggactcaggaactt

SEQ ID NO: 4738463 - DNA, 15 bp, Homo sapiens
aatactggtctcagg

SEQ ID NO: 4738464 - DNA, 16 bp, Homo sapiens
aatagaattataactg

SEQ ID NO: 4738465 - DNA, 20 bp, Homo sapiens
aatagataagagtagaaact

SEQ ID NO: 4738466 - DNA, 18 bp, Homo sapiens
aatagcgtcataactaga

SEQ ID NO: 4738467 - DNA, 18 bp, Homo sapiens
aataggaaagactttctc

SEQ ID NO: 4738468 - DNA, 23 bp, Homo sapiens
aataggagaggatgagagcccag

SEQ ID NO: 4738469 - DNA, 13 bp, Homo sapiens
aatagtagatgtg

SEQ ID NO: 4738470 - DNA, 22 bp, Homo sapiens
aatagtagatgtggcctttgaa

SEQ ID NO: 4738471 - DNA, 21 bp, Homo sapiens
aatagttcaggtaacaggcag

SEQ ID NO: 4738472 - DNA, 23 bp, Homo sapiens
aatataaaatatgaagacataaa

SEQ ID NO: 4738473 - DNA, 13 bp, Homo sapiens
aatatagttgtct

SEQ ID NO: 4738474 - DNA, 16 bp, Homo sapiens
aatatatataaattga

SEQ ID NO: 4738475 - DNA, 19 bp, Homo sapiens
aatatattttgtttacaaa

SEQ ID NO: 4738476 - DNA, 18 bp, Homo sapiens
aatatcaagtactacatt

SEQ ID NO: 4738477 - DNA, 20 bp, Homo sapiens
aatatcaagtactacatttt

SEQ ID NO: 4738478 - DNA, 19 bp, Homo sapiens
aatatcatataaacatttt

SEQ ID NO: 4738479 - DNA, 20 bp, Homo sapiens
aatatcccttggacatttta

SEQ ID NO: 4738480 - DNA, 22 bp, Homo sapiens
aatatcccttggacattttatg

SEQ ID NO: 4738481 - DNA, 23 bp, Homo sapiens
aatatccctttttcacatattaa

SEQ ID NO: 4738482 - DNA, 22 bp, Homo sapiens
aatatctcttgtgcttttttga

SEQ ID NO: 4738483 - DNA, 15 bp, Homo sapiens
aatatcttttgacct

SEQ ID NO: 4738484 - DNA, 14 bp, Homo sapiens
aatatggatttctt

SEQ ID NO: 4738485 - DNA, 16 bp, Homo sapiens
aatatgtagtatctat

SEQ ID NO: 4738486 - DNA, 14 bp, Homo sapiens
aatatgtgaagaaa

SEQ ID NO: 4738487 - DNA, 15 bp, Homo sapiens
aatatgtgaagaaaa

SEQ ID NO: 4738488 - DNA, 23 bp, Homo sapiens
aatatgtttggaatattccacta

SEQ ID NO: 4738489 - DNA, 16 bp, Homo sapiens
aatattaaaatcactg

SEQ ID NO: 4738490 - DNA, 16 bp, Homo sapiens
aatattcacatgttct

SEQ ID NO: 4738491 - DNA, 21 bp, Homo sapiens
aatattctacacatatcttgt

SEQ ID NO: 4738492 - DNA, 19 bp, Homo sapiens
aatattctgataatgtatt

SEQ ID NO: 4738493 - DNA, 17 bp, Homo sapiens
aatattgtggctccctg

SEQ ID NO: 4738494 - DNA, 16 bp, Homo sapiens
aatatttactatttca

SEQ ID NO: 4738495 - DNA, 20 bp, Homo sapiens
aatatttcaggttcttcaga

SEQ ID NO: 4738496 - DNA, 18 bp, Homo sapiens
aatattttagatgttatt

SEQ ID NO: 4738497 - DNA, 21 bp, Homo sapiens
aatattttccatgaaaatgca

SEQ ID NO: 4738498 - DNA, 16 bp, Homo sapiens
aatcaagcaagcctct

SEQ ID NO: 4738499 - DNA, 14 bp, Homo sapiens
aatcaattttttaa

SEQ ID NO: 4738500 - DNA, 21 bp, Homo sapiens
aatcacagcttgtattttgtg

SEQ ID NO: 4738501 - DNA, 15 bp, Homo sapiens
aatcacgtaaagcta

SEQ ID NO: 4738502 - DNA, 20 bp, Homo sapiens
aatcacgtaaagctagaaat

SEQ ID NO: 4738503 - DNA, 21 bp, Homo sapiens
aatcacgtaaagctagaaatg

SEQ ID NO: 4738504 - DNA, 14 bp, Homo sapiens
aatcactgtcaata

SEQ ID NO: 4738505 - DNA, 19 bp, Homo sapiens
aatcagagttaccattatt

SEQ ID NO: 4738506 - DNA, 14 bp, Homo sapiens
aatcagcaagaaga

SEQ ID NO: 4738507 - DNA, 18 bp, Homo sapiens
aatcattcttactaaaaa

SEQ ID NO: 4738508 - DNA, 21 bp, Homo sapiens
aatcattggcctggcaaaata

SEQ ID NO: 4738509 - DNA, 17 bp, Homo sapiens
aatcattgtcaaaatta

SEQ ID NO: 4738510 - DNA, 19 bp, Homo sapiens
aatccaatactgcccaagg

SEQ ID NO: 4738511 - DNA, 18 bp, Homo sapiens
aatccagggtggtggtga

SEQ ID NO: 4738512 - DNA, 22 bp, Homo sapiens
aatccatttttaaggctgtgtg

SEQ ID NO: 4738513 - DNA, 10 bp, Homo sapiens
aatccctcaa

SEQ ID NO: 4738514 - DNA, 11 bp, Homo sapiens
aatcctgtacc

SEQ ID NO: 4738515 - DNA, 18 bp, Homo sapiens
aatcctgtaccaaatctg

SEQ ID NO: 4738516 - DNA, 15 bp, Homo sapiens
aatcgacctgcctcg

SEQ ID NO: 4738517 - DNA, 13 bp, Homo sapiens
aatctaatgacat

SEQ ID NO: 4738518 - DNA, 23 bp, Homo sapiens
aatctatcactaaaaatttttac

SEQ ID NO: 4738519 - DNA, 20 bp, Homo sapiens
aatctctttttgctttcgaa

SEQ ID NO: 4738520 - DNA, 17 bp, Homo sapiens
aatctggattcatattt

SEQ ID NO: 4738521 - DNA, 18 bp, Homo sapiens
aatctggattcatattta

SEQ ID NO: 4738522 - DNA, 17 bp, Homo sapiens
aatctgttgttccaaat

SEQ ID NO: 4738523 - DNA, 20 bp, Homo sapiens
aatcttaaacataataaatc

SEQ ID NO: 4738524 - DNA, 14 bp, Homo sapiens
aatcttataattta

SEQ ID NO: 4738525 - DNA, 16 bp, Homo sapiens
aatcttataatttaaa

SEQ ID NO: 4738526 - DNA, 13 bp, Homo sapiens
aatcttcagctgg

SEQ ID NO: 4738527 - DNA, 21 bp, Homo sapiens
aatcttctgctaaatttttgt

SEQ ID NO: 4738528 - DNA, 16 bp, Homo sapiens
aatgaaccacatcttg

SEQ ID NO: 4738529 - DNA, 23 bp, Homo sapiens
aatgaaccacatcttgctctgct

SEQ ID NO: 4738530 - DNA, 19 bp, Homo sapiens
aatgaagttgattcatatt

SEQ ID NO: 4738531 - DNA, 14 bp, Homo sapiens
aatgaagttggggt

SEQ ID NO: 4738532 - DNA, 20 bp, Homo sapiens
aatgaatactttataaagga

SEQ ID NO: 4738533 - DNA, 20 bp, Homo sapiens
aatgaatcgtaatgaagttg

SEQ ID NO: 4738534 - DNA, 17 bp, Homo sapiens
aatgaatgcataaaatg

SEQ ID NO: 4738535 - DNA, 17 bp, Homo sapiens
aatgactccactgtttt

SEQ ID NO: 4738536 - DNA, 19 bp, Homo sapiens
aatgactccactgtttttc

SEQ ID NO: 4738537 - DNA, 16 bp, Homo sapiens
aatgactccaggaaga

SEQ ID NO: 4738538 - DNA, 21 bp, Homo sapiens
aatgactccaggaagaaggtg

SEQ ID NO: 4738539 - DNA, 20 bp, Homo sapiens
aatgagaaaatgtctttatt

SEQ ID NO: 4738540 - DNA, 20 bp, Homo sapiens
aatgagagagagactgtgtg

SEQ ID NO: 4738541 - DNA, 12 bp, Homo sapiens
aatgagagcata

SEQ ID NO: 4738542 - DNA, 21 bp, Homo sapiens
aatgagtaatgtgatcgcttg

SEQ ID NO: 4738543 - DNA, 15 bp, Homo sapiens
aatgatagctactgt

SEQ ID NO: 4738544 - DNA, 16 bp, Homo sapiens
aatgatcaaattttga

SEQ ID NO: 4738545 - DNA, 16 bp, Homo sapiens
aatgatccccagctgt

SEQ ID NO: 4738546 - DNA, 17 bp, Homo sapiens
aatgatcttttcaagtt

SEQ ID NO: 4738547 - DNA, 13 bp, Homo sapiens
aatgattcagtgt

SEQ ID NO: 4738548 - DNA, 14 bp, Homo sapiens
aatgattcagtgtt

SEQ ID NO: 4738549 - DNA, 23 bp, Homo sapiens
aatgattcagtgttaaatgtgat

SEQ ID NO: 4738550 - DNA, 15 bp, Homo sapiens
aatgcaacaacatgt

SEQ ID NO: 4738551 - DNA, 18 bp, Homo sapiens
aatgcaacaacatgtata

SEQ ID NO: 4738552 - DNA, 19 bp, Homo sapiens
aatgcactttgttctggct

SEQ ID NO: 4738553 - DNA, 20 bp, Homo sapiens
aatgcactttgttctggctc

SEQ ID NO: 4738554 - DNA, 16 bp, Homo sapiens
aatgcataaaatgtta

SEQ ID NO: 4738555 - DNA, 14 bp, Homo sapiens
aatgcattcatgtt

SEQ ID NO: 4738556 - DNA, 15 bp, Homo sapiens
aatgcattcatgttt

SEQ ID NO: 4738557 - DNA, 15 bp, Homo sapiens
aatgccatcatctcc

SEQ ID NO: 4738558 - DNA, 21 bp, Homo sapiens
aatgccatcctcaaacactgc

SEQ ID NO: 4738559 - DNA, 22 bp, Homo sapiens
aatgccatcctcaaacactgca

SEQ ID NO: 4738560 - DNA, 12 bp, Homo sapiens
aatgcccagccc

SEQ ID NO: 4738561 - DNA, 14 bp, Homo sapiens
aatgcccagcccct

SEQ ID NO: 4738562 - DNA, 15 bp, Homo sapiens
aatgcccagcccctt

SEQ ID NO: 4738563 - DNA, 22 bp, Homo sapiens
aatgcccagccccttctgaccc

SEQ ID NO: 4738564 - DNA, 24 bp, Homo sapiens
aatgcccagccccttctgacccat

SEQ ID NO: 4738565 - DNA, 22 bp, Homo sapiens
aatgcctttgagacagtttctt

SEQ ID NO: 4738566 - DNA, 17 bp, Homo sapiens
aatgcgcaggctggccc

SEQ ID NO: 4738567 - DNA, 16 bp, Homo sapiens
aatgcgtatttgcatt

SEQ ID NO: 4738568 - DNA, 19 bp, Homo sapiens
aatgctctgtcttcaatga

SEQ ID NO: 4738569 - DNA, 20 bp, Homo sapiens
aatgctgcagatttgggctg

SEQ ID NO: 4738570 - DNA, 21 bp, Homo sapiens
aatgctggctgttggctgggg

SEQ ID NO: 4738571 - DNA, 18 bp, Homo sapiens
aatgctggtttttcagtt

SEQ ID NO: 4738572 - DNA, 12 bp, Homo sapiens
aatgctgtgaat

SEQ ID NO: 4738573 - DNA, 20 bp, Homo sapiens
aatgctgtgcaaacagtgta

SEQ ID NO: 4738574 - DNA, 15 bp, Homo sapiens
aatgcttatgtgttg

SEQ ID NO: 4738575 - DNA, 19 bp, Homo sapiens
aatgcttgccaagaaatcg

SEQ ID NO: 4738576 - DNA, 13 bp, Homo sapiens
aatggaagaaacc

SEQ ID NO: 4738577 - DNA, 21 bp, Homo sapiens
aatggaccggagagtgggggt

SEQ ID NO: 4738578 - DNA, 20 bp, Homo sapiens
aatggactaacttgtctttg

SEQ ID NO: 4738579 - DNA, 20 bp, Homo sapiens
aatggactatgcacactttt

SEQ ID NO: 4738580 - DNA, 20 bp, Homo sapiens
aatggaggatctctaaagag

SEQ ID NO: 4738581 - DNA, 16 bp, Homo sapiens
aatggattggattatt

SEQ ID NO: 4738582 - DNA, 20 bp, Homo sapiens
aatggattggattatttaat

SEQ ID NO: 4738583 - DNA, 20 bp, Homo sapiens
aatggatttttctttaactg

SEQ ID NO: 4738584 - DNA, 19 bp, Homo sapiens
aatggcacagcccaaagaa

SEQ ID NO: 4738585 - DNA, 16 bp, Homo sapiens
aatggcagccttggca

SEQ ID NO: 4738586 - DNA, 19 bp, Homo sapiens
aatggcttttcccaacccc

SEQ ID NO: 4738587 - DNA, 17 bp, Homo sapiens
aatgggcttagagcagt

SEQ ID NO: 4738588 - DNA, 15 bp, Homo sapiens
aatgggggagggagg

SEQ ID NO: 4738589 - DNA, 19 bp, Homo sapiens
aatggtccaggagaaggcc

SEQ ID NO: 4738590 - DNA, 17 bp, Homo sapiens
aatggtgttatttgaaa

SEQ ID NO: 4738591 - DNA, 17 bp, Homo sapiens
aatggttgatgatactt

SEQ ID NO: 4738592 - DNA, 14 bp, Homo sapiens
aatggtttgtgtca

SEQ ID NO: 4738593 - DNA, 12 bp, Homo sapiens
aatgtaaaagaa

SEQ ID NO: 4738594 - DNA, 19 bp, Homo sapiens
aatgtaaaagaaaattttt

SEQ ID NO: 4738595 - DNA, 14 bp, Homo sapiens
aatgtaaacatttt

SEQ ID NO: 4738596 - DNA, 15 bp, Homo sapiens
aatgtaaaccacatg

SEQ ID NO: 4738597 - DNA, 13 bp, Homo sapiens
aatgtaattggaa

SEQ ID NO: 4738598 - DNA, 15 bp, Homo sapiens
aatgtaattggaatc

SEQ ID NO: 4738599 - DNA, 16 bp, Homo sapiens
aatgtaattggaatct

SEQ ID NO: 4738600 - DNA, 20 bp, Homo sapiens
aatgtaattggaatcttcac

SEQ ID NO: 4738601 - DNA, 16 bp, Homo sapiens
aatgtagaaattcttc

SEQ ID NO: 4738602 - DNA, 23 bp, Homo sapiens
aatgtagttgtcacactaaaatt

SEQ ID NO: 4738603 - DNA, 14 bp, Homo sapiens
aatgtcacaggcag

SEQ ID NO: 4738604 - DNA, 16 bp, Homo sapiens
aatgtcacaggcaggt

SEQ ID NO: 4738605 - DNA, 19 bp, Homo sapiens
aatgtcacagtaatgcaag

SEQ ID NO: 4738606 - DNA, 17 bp, Homo sapiens
aatgtcagcaaatgtaa

SEQ ID NO: 4738607 - DNA, 19 bp, Homo sapiens
aatgtcagttgttatttat

SEQ ID NO: 4738608 - DNA, 12 bp, Homo sapiens
aatgtcattatt

SEQ ID NO: 4738609 - DNA, 16 bp, Homo sapiens
aatgtcgctgtaaatt

SEQ ID NO: 4738610 - DNA, 18 bp, Homo sapiens
aatgtctctgtgagactc

SEQ ID NO: 4738611 - DNA, 18 bp, Homo sapiens
aatgtctgtaataataga

SEQ ID NO: 4738612 - DNA, 18 bp, Homo sapiens
aatgtgaaaaaaattatt

SEQ ID NO: 4738613 - DNA, 15 bp, Homo sapiens
aatgtgatcatcttt

SEQ ID NO: 4738614 - DNA, 19 bp, Homo sapiens
aatgtgatcatctttgctg

SEQ ID NO: 4738615 - DNA, 22 bp, Homo sapiens
aatgtgatcgcttggttatcca

SEQ ID NO: 4738616 - DNA, 20 bp, Homo sapiens
aatgtgtcaatgtaaagcca

SEQ ID NO: 4738617 - DNA, 19 bp, Homo sapiens
aatgtgtctgcaacatgga

SEQ ID NO: 4738618 - DNA, 21 bp, Homo sapiens
aatgtgtctgcaacatggatt

SEQ ID NO: 4738619 - DNA, 22 bp, Homo sapiens
aatgttaaatttgtaagtttca

SEQ ID NO: 4738620 - DNA, 22 bp, Homo sapiens
aatgttaaggaaactcttatct

SEQ ID NO: 4738621 - DNA, 12 bp, Homo sapiens
aatgttagagta

SEQ ID NO: 4738622 - DNA, 13 bp, Homo sapiens
aatgttgcactga

SEQ ID NO: 4738623 - DNA, 22 bp, Homo sapiens
aatgtttacagatccccaagcc

SEQ ID NO: 4738624 - DNA, 16 bp, Homo sapiens
aatgtttctggatttc

SEQ ID NO: 4738625 - DNA, 13 bp, Homo sapiens
aatgtttgtgaga

SEQ ID NO: 4738626 - DNA, 14 bp, Homo sapiens
aatgtttttgtgta

SEQ ID NO: 4738627 - DNA, 15 bp, Homo sapiens
aatgttttttttcag

SEQ ID NO: 4738628 - DNA, 20 bp, Homo sapiens
aattaactgctccaaattta

SEQ ID NO: 4738629 - DNA, 22 bp, Homo sapiens
aattaagtcctacttttaaaga

SEQ ID NO: 4738630 - DNA, 15 bp, Homo sapiens
aattaagttacaatt

SEQ ID NO: 4738631 - DNA, 21 bp, Homo sapiens
aattaccatgcttcacaatgt

SEQ ID NO: 4738632 - DNA, 23 bp, Homo sapiens
aattactttggggctaatttaac

SEQ ID NO: 4738633 - DNA, 18 bp, Homo sapiens
aattagattatttctgta

SEQ ID NO: 4738634 - DNA, 21 bp, Homo sapiens
aattagattatttctgtattt

SEQ ID NO: 4738635 - DNA, 23 bp, Homo sapiens
aattagggtgggctctaaatcca

SEQ ID NO: 4738636 - DNA, 22 bp, Homo sapiens
aattatagtgatgtaatcttga

SEQ ID NO: 4738637 - DNA, 20 bp, Homo sapiens
aattatctcctaattgtatg

SEQ ID NO: 4738638 - DNA, 17 bp, Homo sapiens
aattattcagtgaattt

SEQ ID NO: 4738639 - DNA, 13 bp, Homo sapiens
aattattgtgatt

SEQ ID NO: 4738640 - DNA, 17 bp, Homo sapiens
aattatttaaatgtact

SEQ ID NO: 4738641 - DNA, 22 bp, Homo sapiens
aattatttattaaatgcccagc

SEQ ID NO: 4738642 - DNA, 22 bp, Homo sapiens
aattatttcatgattagaaatt

SEQ ID NO: 4738643 - DNA, 14 bp, Homo sapiens
aattatttgattat

SEQ ID NO: 4738644 - DNA, 12 bp, Homo sapiens
aattcaatgatt

SEQ ID NO: 4738645 - DNA, 18 bp, Homo sapiens
aattcatacctgtgaata

SEQ ID NO: 4738646 - DNA, 12 bp, Homo sapiens
aattccacagct

SEQ ID NO: 4738647 - DNA, 15 bp, Homo sapiens
aattcggtgtgcacc

SEQ ID NO: 4738648 - DNA, 20 bp, Homo sapiens
aattctgatgttactgagat

SEQ ID NO: 4738649 - DNA, 18 bp, Homo sapiens
aattcttattttagaaat

SEQ ID NO: 4738650 - DNA, 19 bp, Homo sapiens
aattctttaatgattccta

SEQ ID NO: 4738651 - DNA, 21 bp, Homo sapiens
aattgaaagaacttaagtctc

SEQ ID NO: 4738652 - DNA, 13 bp, Homo sapiens
aattgatcattca

SEQ ID NO: 4738653 - DNA, 13 bp, Homo sapiens
aattgattttgaa

SEQ ID NO: 4738654 - DNA, 21 bp, Homo sapiens
aattgcattcattgacttcag

SEQ ID NO: 4738655 - DNA, 13 bp, Homo sapiens
aattggaatcttc

SEQ ID NO: 4738656 - DNA, 18 bp, Homo sapiens
aattggaatcttcacctc

SEQ ID NO: 4738657 - DNA, 19 bp, Homo sapiens
aattggaatcttcacctca

SEQ ID NO: 4738658 - DNA, 11 bp, Homo sapiens
aattgtccctt

SEQ ID NO: 4738659 - DNA, 18 bp, Homo sapiens
aattgtcccttaaacaaa

SEQ ID NO: 4738660 - DNA, 16 bp, Homo sapiens
aattgtgggtctattt

SEQ ID NO: 4738661 - DNA, 21 bp, Homo sapiens
aattgtgggtctatttctagt

SEQ ID NO: 4738662 - DNA, 20 bp, Homo sapiens
aattgtgttttaattgtaaa

SEQ ID NO: 4738663 - DNA, 14 bp, Homo sapiens
aattgttctgggtg

SEQ ID NO: 4738664 - DNA, 15 bp, Homo sapiens
aattgttgtttcttt

SEQ ID NO: 4738665 - DNA, 14 bp, Homo sapiens
aatttaaaaatata

SEQ ID NO: 4738666 - DNA, 13 bp, Homo sapiens
aatttaaaagtct

SEQ ID NO: 4738667 - DNA, 17 bp, Homo sapiens
aatttaaccataaatca

SEQ ID NO: 4738668 - DNA, 18 bp, Homo sapiens
aatttacaaaaatataaa

SEQ ID NO: 4738669 - DNA, 21 bp, Homo sapiens
aatttacaaaaatataaaata

SEQ ID NO: 4738670 - DNA, 14 bp, Homo sapiens
aatttacatggcaa

SEQ ID NO: 4738671 - DNA, 13 bp, Homo sapiens
aatttacatttat

SEQ ID NO: 4738672 - DNA, 19 bp, Homo sapiens
aatttagagtcaatttgct

SEQ ID NO: 4738673 - DNA, 14 bp, Homo sapiens
aatttataacaaat

SEQ ID NO: 4738674 - DNA, 19 bp, Homo sapiens
aatttcagtcaattctgat

SEQ ID NO: 4738675 - DNA, 20 bp, Homo sapiens
aatttcagtcaattctgatg

SEQ ID NO: 4738676 - DNA, 21 bp, Homo sapiens
aatttccactcaggtctgttt

SEQ ID NO: 4738677 - DNA, 16 bp, Homo sapiens
aatttctctactgtct

SEQ ID NO: 4738678 - DNA, 17 bp, Homo sapiens
aatttctgttgttttaa

SEQ ID NO: 4738679 - DNA, 16 bp, Homo sapiens
aatttctttataaaat

SEQ ID NO: 4738680 - DNA, 22 bp, Homo sapiens
aatttctttataaaatttactg

SEQ ID NO: 4738681 - DNA, 19 bp, Homo sapiens
aatttgggatactaaagta

SEQ ID NO: 4738682 - DNA, 16 bp, Homo sapiens
aatttggtttgttaat

SEQ ID NO: 4738683 - DNA, 14 bp, Homo sapiens
aatttgtaagtttc

SEQ ID NO: 4738684 - DNA, 16 bp, Homo sapiens
aatttgtatgctaaat

SEQ ID NO: 4738685 - DNA, 19 bp, Homo sapiens
aatttgtatgctaaatgag

SEQ ID NO: 4738686 - DNA, 16 bp, Homo sapiens
aatttgtccattgtaa

SEQ ID NO: 4738687 - DNA, 17 bp, Homo sapiens
aatttgtgaaaatgtaa

SEQ ID NO: 4738688 - DNA, 15 bp, Homo sapiens
aatttgtgaatttgc

SEQ ID NO: 4738689 - DNA, 19 bp, Homo sapiens
aatttgttgtcatgtgtat

SEQ ID NO: 4738690 - DNA, 22 bp, Homo sapiens
aattttagtttatattaatttc

SEQ ID NO: 4738691 - DNA, 23 bp, Homo sapiens
aattttatctacccagtcatgta

SEQ ID NO: 4738692 - DNA, 18 bp, Homo sapiens
aattttatggcactattt

SEQ ID NO: 4738693 - DNA, 19 bp, Homo sapiens
aattttccataagctattt

SEQ ID NO: 4738694 - DNA, 17 bp, Homo sapiens
aattttgaggtctttta

SEQ ID NO: 4738695 - DNA, 21 bp, Homo sapiens
aattttgaggtcttttacata

SEQ ID NO: 4738696 - DNA, 17 bp, Homo sapiens
aattttgtatttaatga

SEQ ID NO: 4738697 - DNA, 12 bp, Homo sapiens
aattttgtgatg

SEQ ID NO: 4738698 - DNA, 18 bp, Homo sapiens
aatttttgtataaggtga

SEQ ID NO: 4738699 - DNA, 23 bp, Homo sapiens
aattttttaattatttaaatgta

SEQ ID NO: 4738700 - DNA, 15 bp, Homo sapiens
aatttttttaaattt

SEQ ID NO: 4738701 - DNA, 13 bp, Homo sapiens
acaaaaatataaa

SEQ ID NO: 4738702 - DNA, 15 bp, Homo sapiens
acaaaagctgtgtct

SEQ ID NO: 4738703 - DNA, 19 bp, Homo sapiens
acaaacatggaaaacagag

SEQ ID NO: 4738704 - DNA, 19 bp, Homo sapiens
acaaacatgtggttaatgc

SEQ ID NO: 4738705 - DNA, 12 bp, Homo sapiens
acaaacctgcct

SEQ ID NO: 4738706 - DNA, 17 bp, Homo sapiens
acaaagaaacaaagatg

SEQ ID NO: 4738707 - DNA, 18 bp, Homo sapiens
acaaagaaacaaagatgt

SEQ ID NO: 4738708 - DNA, 18 bp, Homo sapiens
acaaagtgagacagtcca

SEQ ID NO: 4738709 - DNA, 18 bp, Homo sapiens
acaaagtttgtggtaatt

SEQ ID NO: 4738710 - DNA, 13 bp, Homo sapiens
acaaatgtatgat

SEQ ID NO: 4738711 - DNA, 12 bp, Homo sapiens
acaaatgtgata

SEQ ID NO: 4738712 - DNA, 14 bp, Homo sapiens
acaacatgtataat

SEQ ID NO: 4738713 - DNA, 13 bp, Homo sapiens
acaacatgtatgt

SEQ ID NO: 4738714 - DNA, 12 bp, Homo sapiens
acaacctggaga

SEQ ID NO: 4738715 - DNA, 16 bp, Homo sapiens
acaacctttcccattt

SEQ ID NO: 4738716 - DNA, 13 bp, Homo sapiens
acaagaccctctc

SEQ ID NO: 4738717 - DNA, 16 bp, Homo sapiens
acaagaccctctcagg

SEQ ID NO: 4738718 - DNA, 21 bp, Homo sapiens
acaagagtgagactccacctc

SEQ ID NO: 4738719 - DNA, 19 bp, Homo sapiens
acaagctccaagctcccag

SEQ ID NO: 4738720 - DNA, 16 bp, Homo sapiens
acaaggattgctactg

SEQ ID NO: 4738721 - DNA, 16 bp, Homo sapiens
acaataaaacattaat

SEQ ID NO: 4738722 - DNA, 16 bp, Homo sapiens
acaataaagtgacaaa

SEQ ID NO: 4738723 - DNA, 18 bp, Homo sapiens
acaatacatgttttcact

SEQ ID NO: 4738724 - DNA, 16 bp, Homo sapiens
acaatcagtgtgaatg

SEQ ID NO: 4738725 - DNA, 18 bp, Homo sapiens
acaatctcggctcactgc

SEQ ID NO: 4738726 - DNA, 20 bp, Homo sapiens
acaatctcggctcactgcat

SEQ ID NO: 4738727 - DNA, 22 bp, Homo sapiens
acaatgtaaaccacatgaacta

SEQ ID NO: 4738728 - DNA, 14 bp, Homo sapiens
acaatgttaaggaa

SEQ ID NO: 4738729 - DNA, 21 bp, Homo sapiens
acaatgttaaggaaactctta

SEQ ID NO: 4738730 - DNA, 13 bp, Homo sapiens
acacaacatgtat

SEQ ID NO: 4738731 - DNA, 18 bp, Homo sapiens
acacaatacatgttttca

SEQ ID NO: 4738732 - DNA, 22 bp, Homo sapiens
acacaatgttgcactgaaaacc

SEQ ID NO: 4738733 - DNA, 13 bp, Homo sapiens
acacacacacata

SEQ ID NO: 4738734 - DNA, 13 bp, Homo sapiens
acacacagaaatg

SEQ ID NO: 4738735 - DNA, 20 bp, Homo sapiens
acacacagaaatgtgtcaat

SEQ ID NO: 4738736 - DNA, 13 bp, Homo sapiens
acacacagctctg

SEQ ID NO: 4738737 - DNA, 12 bp, Homo sapiens
acacacagtacg

SEQ ID NO: 4738738 - DNA, 12 bp, Homo sapiens
acacacatacag

SEQ ID NO: 4738739 - DNA, 21 bp, Homo sapiens
acacacgcgtgcacacaccag

SEQ ID NO: 4738740 - DNA, 16 bp, Homo sapiens
acacagatgaaacaca

SEQ ID NO: 4738741 - DNA, 17 bp, Homo sapiens
acacagatttgagctca

SEQ ID NO: 4738742 - DNA, 17 bp, Homo sapiens
acacagcattgtatatg

SEQ ID NO: 4738743 - DNA, 12 bp, Homo sapiens
acacagctctgt

SEQ ID NO: 4738744 - DNA, 14 bp, Homo sapiens
acacagctcttctc

SEQ ID NO: 4738745 - DNA, 21 bp, Homo sapiens
acacaggcccggctccaggct

SEQ ID NO: 4738746 - DNA, 18 bp, Homo sapiens
acacagtattacttctgc

SEQ ID NO: 4738747 - DNA, 19 bp, Homo sapiens
acacagtattacttctgct

SEQ ID NO: 4738748 - DNA, 21 bp, Homo sapiens
acacagtcaaatttacattta

SEQ ID NO: 4738749 - DNA, 12 bp, Homo sapiens
acacatacacac

SEQ ID NO: 4738750 - DNA, 16 bp, Homo sapiens
acacatgccactatga

SEQ ID NO: 4738751 - DNA, 13 bp, Homo sapiens
acacatgtccaag

SEQ ID NO: 4738752 - DNA, 22 bp, Homo sapiens
acacattacaaagttaaaattg

SEQ ID NO: 4738753 - DNA, 18 bp, Homo sapiens
acacattgccccatgaga

SEQ ID NO: 4738754 - DNA, 15 bp, Homo sapiens
acaccaaaatgaacc

SEQ ID NO: 4738755 - DNA, 14 bp, Homo sapiens
acaccaataaatgt

SEQ ID NO: 4738756 - DNA, 16 bp, Homo sapiens
acaccaataaatgttt

SEQ ID NO: 4738757 - DNA, 21 bp, Homo sapiens
acaccacccagagcaccctct

SEQ ID NO: 4738758 - DNA, 23 bp, Homo sapiens
acaccagctgttctgtcccttgg

SEQ ID NO: 4738759 - DNA, 13 bp, Homo sapiens
acacccagcccac

SEQ ID NO: 4738760 - DNA, 20 bp, Homo sapiens
acacccagcccacttctgcc

SEQ ID NO: 4738761 - DNA, 21 bp, Homo sapiens
acacccagcccacttctgcca

SEQ ID NO: 4738762 - DNA, 16 bp, Homo sapiens
acaccctcacactggg

SEQ ID NO: 4738763 - DNA, 11 bp, Homo sapiens
acaccctgtga

SEQ ID NO: 4738764 - DNA, 12 bp, Homo sapiens
acaccctgtgat

SEQ ID NO: 4738765 - DNA, 16 bp, Homo sapiens
acaccgggcactcaga

SEQ ID NO: 4738766 - DNA, 16 bp, Homo sapiens
acacctctggctgtct

SEQ ID NO: 4738767 - DNA, 22 bp, Homo sapiens
acacctttattcagaactttag

SEQ ID NO: 4738768 - DNA, 20 bp, Homo sapiens
acacgcacgcacacacacat

SEQ ID NO: 4738769 - DNA, 19 bp, Homo sapiens
acacggtttgaagcctgga

SEQ ID NO: 4738770 - DNA, 15 bp, Homo sapiens
acactaaccacgctg

SEQ ID NO: 4738771 - DNA, 16 bp, Homo sapiens
acactaacgaaatatc

SEQ ID NO: 4738772 - DNA, 21 bp, Homo sapiens
acactaacgaaatatcaaagt

SEQ ID NO: 4738773 - DNA, 16 bp, Homo sapiens
acactcctacacctaa

SEQ ID NO: 4738774 - DNA, 13 bp, Homo sapiens
acactccttcaca

SEQ ID NO: 4738775 - DNA, 19 bp, Homo sapiens
acactgagaatgtaagaac

SEQ ID NO: 4738776 - DNA, 20 bp, Homo sapiens
acactgagaatgtaagaact

SEQ ID NO: 4738777 - DNA, 22 bp, Homo sapiens
acactgagaatgtaagaactac

SEQ ID NO: 4738778 - DNA, 20 bp, Homo sapiens
acactgcaggcatcacagct

SEQ ID NO: 4738779 - DNA, 18 bp, Homo sapiens
acactgcggggcttggct

SEQ ID NO: 4738780 - DNA, 19 bp, Homo sapiens
acactgcttgtgtttttaa

SEQ ID NO: 4738781 - DNA, 23 bp, Homo sapiens
acactgcttgtgtttttaactca

SEQ ID NO: 4738782 - DNA, 13 bp, Homo sapiens
acactgggacttg

SEQ ID NO: 4738783 - DNA, 19 bp, Homo sapiens
acactgggacttgcaaaaa

SEQ ID NO: 4738784 - DNA, 18 bp, Homo sapiens
acactgtgcacatctgtg

SEQ ID NO: 4738785 - DNA, 20 bp, Homo sapiens
acactgtgcacatctgtgtc

SEQ ID NO: 4738786 - DNA, 19 bp, Homo sapiens
acactgttgataaaaactc

SEQ ID NO: 4738787 - DNA, 14 bp, Homo sapiens
acacttactgttgt

SEQ ID NO: 4738788 - DNA, 17 bp, Homo sapiens
acacttataaatatcct

SEQ ID NO: 4738789 - DNA, 23 bp, Homo sapiens
acacttataaatatcctgctcac

SEQ ID NO: 4738790 - DNA, 16 bp, Homo sapiens
acacttctcaggaaat

SEQ ID NO: 4738791 - DNA, 20 bp, Homo sapiens
acacttgttgattaatggaa

SEQ ID NO: 4738792 - DNA, 12 bp, Homo sapiens
acagaaacattc

SEQ ID NO: 4738793 - DNA, 14 bp, Homo sapiens
acagaacactgtct

SEQ ID NO: 4738794 - DNA, 16 bp, Homo sapiens
acagaagaaggcagca

SEQ ID NO: 4738795 - DNA, 15 bp, Homo sapiens
acagaagcagctctt

SEQ ID NO: 4738796 - DNA, 22 bp, Homo sapiens
acagaatggctatcaaaagaaa

SEQ ID NO: 4738797 - DNA, 13 bp, Homo sapiens
acagacacaggcc

SEQ ID NO: 4738798 - DNA, 15 bp, Homo sapiens
acagaccctgccctg

SEQ ID NO: 4738799 - DNA, 19 bp, Homo sapiens
acagactggaagcacagct

SEQ ID NO: 4738800 - DNA, 14 bp, Homo sapiens
acagagcttccctg

SEQ ID NO: 4738801 - DNA, 15 bp, Homo sapiens
acagaggcagcccca

SEQ ID NO: 4738802 - DNA, 17 bp, Homo sapiens
acagaggccatgggcct

SEQ ID NO: 4738803 - DNA, 21 bp, Homo sapiens
acagaggccatgggcctcctg

SEQ ID NO: 4738804 - DNA, 18 bp, Homo sapiens
acagagtacgttaaaagc

SEQ ID NO: 4738805 - DNA, 14 bp, Homo sapiens
acagagtctcactg

SEQ ID NO: 4738806 - DNA, 21 bp, Homo sapiens
acagagtgagactctgtctca

SEQ ID NO: 4738807 - DNA, 17 bp, Homo sapiens
acagatccccaagcctg

SEQ ID NO: 4738808 - DNA, 19 bp, Homo sapiens
acagatgaaacacaaacaa

SEQ ID NO: 4738809 - DNA, 14 bp, Homo sapiens
acagatgtccctga

SEQ ID NO: 4738810 - DNA, 22 bp, Homo sapiens
acagcaaacaggtgctaatttg

SEQ ID NO: 4738811 - DNA, 17 bp, Homo sapiens
acagcaaggaggctggc

SEQ ID NO: 4738812 - DNA, 20 bp, Homo sapiens
acagcaaggaggctggctgg

SEQ ID NO: 4738813 - DNA, 21 bp, Homo sapiens
acagcaaggaggctggctggg

SEQ ID NO: 4738814 - DNA, 16 bp, Homo sapiens
acagcccaaagaagga

SEQ ID NO: 4738815 - DNA, 17 bp, Homo sapiens
acagcccaaagaaggaa

SEQ ID NO: 4738816 - DNA, 14 bp, Homo sapiens
acagccccctgccc

SEQ ID NO: 4738817 - DNA, 15 bp, Homo sapiens
acagcccgggctctg

SEQ ID NO: 4738818 - DNA, 19 bp, Homo sapiens
acagcccgggctctgcctc

SEQ ID NO: 4738819 - DNA, 20 bp, Homo sapiens
acagcccgggctctgcctcc

SEQ ID NO: 4738820 - DNA, 22 bp, Homo sapiens
acagcccgggctctgcctccca

SEQ ID NO: 4738821 - DNA, 23 bp, Homo sapiens
acagccctccatctaaactgccc

SEQ ID NO: 4738822 - DNA, 18 bp, Homo sapiens
acagctaacacacagctc

SEQ ID NO: 4738823 - DNA, 19 bp, Homo sapiens
acagctaacacacagctcc

SEQ ID NO: 4738824 - DNA, 17 bp, Homo sapiens
acagctaatgggacact

SEQ ID NO: 4738825 - DNA, 18 bp, Homo sapiens
acagctcttctccaggct

SEQ ID NO: 4738826 - DNA, 14 bp, Homo sapiens
acagctgcctggga

SEQ ID NO: 4738827 - DNA, 18 bp, Homo sapiens
acagctggtgcttagttt

SEQ ID NO: 4738828 - DNA, 15 bp, Homo sapiens
acagcttcaggttat

SEQ ID NO: 4738829 - DNA, 21 bp, Homo sapiens
acagcttcatttcctgtgtct

SEQ ID NO: 4738830 - DNA, 15 bp, Homo sapiens
acaggaaaagctgct

SEQ ID NO: 4738831 - DNA, 20 bp, Homo sapiens
acaggaaaagctgctgacag

SEQ ID NO: 4738832 - DNA, 15 bp, Homo sapiens
acaggaagtgaagaa

SEQ ID NO: 4738833 - DNA, 23 bp, Homo sapiens
acaggaccagggatttccatgat

SEQ ID NO: 4738834 - DNA, 15 bp, Homo sapiens
acaggagacaaaaga

SEQ ID NO: 4738835 - DNA, 14 bp, Homo sapiens
acaggatgaaggca

SEQ ID NO: 4738836 - DNA, 15 bp, Homo sapiens
acaggattattttga

SEQ ID NO: 4738837 - DNA, 18 bp, Homo sapiens
acaggcaagcacctcctg

SEQ ID NO: 4738838 - DNA, 18 bp, Homo sapiens
acaggcaatgctggctgt

SEQ ID NO: 4738839 - DNA, 19 bp, Homo sapiens
acaggcaatgctggctgtt

SEQ ID NO: 4738840 - DNA, 15 bp, Homo sapiens
acaggcactgccctg

SEQ ID NO: 4738841 - DNA, 16 bp, Homo sapiens
acaggcactgccctgg

SEQ ID NO: 4738842 - DNA, 15 bp, Homo sapiens
acaggcagatacagg

SEQ ID NO: 4738843 - DNA, 13 bp, Homo sapiens
acaggcagcagag

SEQ ID NO: 4738844 - DNA, 14 bp, Homo sapiens
acaggcagcagaga

SEQ ID NO: 4738845 - DNA, 14 bp, Homo sapiens
acaggcaggtccag

SEQ ID NO: 4738846 - DNA, 17 bp, Homo sapiens
acaggcccggctccagg

SEQ ID NO: 4738847 - DNA, 21 bp, Homo sapiens
acaggcccggctccaggctcc

SEQ ID NO: 4738848 - DNA, 22 bp, Homo sapiens
acaggcccggctccaggctcct

SEQ ID NO: 4738849 - DNA, 22 bp, Homo sapiens
acaggcgtgagccaccgtgcct

SEQ ID NO: 4738850 - DNA, 13 bp, Homo sapiens
acaggctcctgcc

SEQ ID NO: 4738851 - DNA, 15 bp, Homo sapiens
acaggctcctgccac

SEQ ID NO: 4738852 - DNA, 17 bp, Homo sapiens
acaggctgggcttcagt

SEQ ID NO: 4738853 - DNA, 21 bp, Homo sapiens
acagggatgagcatggagctg

SEQ ID NO: 4738854 - DNA, 23 bp, Homo sapiens
acagggatgagcatggagctggc

SEQ ID NO: 4738855 - DNA, 21 bp, Homo sapiens
acagggcctttggcaggtgca

SEQ ID NO: 4738856 - DNA, 22 bp, Homo sapiens
acaggtgggcttcccagtggct

SEQ ID NO: 4738857 - DNA, 21 bp, Homo sapiens
acaggtgtgagccaccacgcc

SEQ ID NO: 4738858 - DNA, 17 bp, Homo sapiens
acagtaacgcaggggaa

SEQ ID NO: 4738859 - DNA, 17 bp, Homo sapiens
acagtaacggtgtttag

SEQ ID NO: 4738860 - DNA, 13 bp, Homo sapiens
acagtaatcagag

SEQ ID NO: 4738861 - DNA, 22 bp, Homo sapiens
acagtaggagcccagctctgaa

SEQ ID NO: 4738862 - DNA, 19 bp, Homo sapiens
acagtattgaaaaattatc

SEQ ID NO: 4738863 - DNA, 15 bp, Homo sapiens
acagtcaacaagcct

SEQ ID NO: 4738864 - DNA, 15 bp, Homo sapiens
acagtcagcacagaa

SEQ ID NO: 4738865 - DNA, 18 bp, Homo sapiens
acagtcattatttaaagc

SEQ ID NO: 4738866 - DNA, 15 bp, Homo sapiens
acagtccagcctgga

SEQ ID NO: 4738867 - DNA, 16 bp, Homo sapiens
acagtccagcctggag

SEQ ID NO: 4738868 - DNA, 18 bp, Homo sapiens
acagtccagcctggagat

SEQ ID NO: 4738869 - DNA, 15 bp, Homo sapiens
acagtcctcccatct

SEQ ID NO: 4738870 - DNA, 22 bp, Homo sapiens
acagtccttaccagcagagcac

SEQ ID NO: 4738871 - DNA, 15 bp, Homo sapiens
acagtctcaattttg

SEQ ID NO: 4738872 - DNA, 16 bp, Homo sapiens
acagtctcaattttgt

SEQ ID NO: 4738873 - DNA, 18 bp, Homo sapiens
acagtcttgtattaagtt

SEQ ID NO: 4738874 - DNA, 22 bp, Homo sapiens
acagtcttgtattaagttgtta

SEQ ID NO: 4738875 - DNA, 20 bp, Homo sapiens
acagtgaaagaaaataacaa

SEQ ID NO: 4738876 - DNA, 18 bp, Homo sapiens
acagtgactcgggctcct

SEQ ID NO: 4738877 - DNA, 20 bp, Homo sapiens
acagtgactcgggctcctgt

SEQ ID NO: 4738878 - DNA, 20 bp, Homo sapiens
acagtgcttgccacagagcg

SEQ ID NO: 4738879 - DNA, 15 bp, Homo sapiens
acagtggatcacaaa

SEQ ID NO: 4738880 - DNA, 17 bp, Homo sapiens
acagtggatcacaaagt

SEQ ID NO: 4738881 - DNA, 13 bp, Homo sapiens
acagtgtaagctt

SEQ ID NO: 4738882 - DNA, 23 bp, Homo sapiens
acagtgtaagcttagattttctg

SEQ ID NO: 4738883 - DNA, 15 bp, Homo sapiens
acagtgtacagtctt

SEQ ID NO: 4738884 - DNA, 17 bp, Homo sapiens
acagtgtacagtcttgt

SEQ ID NO: 4738885 - DNA, 15 bp, Homo sapiens
acagtgtctgggctg

SEQ ID NO: 4738886 - DNA, 22 bp, Homo sapiens
acagtgtgtggtcaacatttct

SEQ ID NO: 4738887 - DNA, 22 bp, Homo sapiens
acagtgttaggcctggcacagt

SEQ ID NO: 4738888 - DNA, 23 bp, Homo sapiens
acagtgttaggcctggcacagtg

SEQ ID NO: 4738889 - DNA, 21 bp, Homo sapiens
acagttccctttatttcacat

SEQ ID NO: 4738890 - DNA, 17 bp, Homo sapiens
acagttcttgtgtggtt

SEQ ID NO: 4738891 - DNA, 17 bp, Homo sapiens
acagtttcttagctttt

SEQ ID NO: 4738892 - DNA, 20 bp, Homo sapiens
acagtttcttagctttttaa

SEQ ID NO: 4738893 - DNA, 14 bp, Homo sapiens
acagtttcttccat

SEQ ID NO: 4738894 - DNA, 15 bp, Homo sapiens
acagtttttattgct

SEQ ID NO: 4738895 - DNA, 17 bp, Homo sapiens
acataaaggaacatggt

SEQ ID NO: 4738896 - DNA, 18 bp, Homo sapiens
acataacgtttttccttt

SEQ ID NO: 4738897 - DNA, 20 bp, Homo sapiens
acataacgtttttcctttaa

SEQ ID NO: 4738898 - DNA, 23 bp, Homo sapiens
acataacgtttttcctttaaaaa

SEQ ID NO: 4738899 - DNA, 21 bp, Homo sapiens
acataagtccattaactgctt

SEQ ID NO: 4738900 - DNA, 20 bp, Homo sapiens
acataatcagtatatttggt

SEQ ID NO: 4738901 - DNA, 17 bp, Homo sapiens
acatacagagctctctg

SEQ ID NO: 4738902 - DNA, 16 bp, Homo sapiens
acatacagtgatatgg

SEQ ID NO: 4738903 - DNA, 17 bp, Homo sapiens
acatactcccatctgtg

SEQ ID NO: 4738904 - DNA, 16 bp, Homo sapiens
acatagaacatgtgtc

SEQ ID NO: 4738905 - DNA, 19 bp, Homo sapiens
acatagcccaagaacagaa

SEQ ID NO: 4738906 - DNA, 21 bp, Homo sapiens
acatagttgaaaaaagaagtt

SEQ ID NO: 4738907 - DNA, 15 bp, Homo sapiens
acatataaagattaa

SEQ ID NO: 4738908 - DNA, 19 bp, Homo sapiens
acatataaagattaacact

SEQ ID NO: 4738909 - DNA, 13 bp, Homo sapiens
acatattttacat

SEQ ID NO: 4738910 - DNA, 23 bp, Homo sapiens
acatcagtttgatacagtattga

SEQ ID NO: 4738911 - DNA, 20 bp, Homo sapiens
acatcatcaaggcactgcct

SEQ ID NO: 4738912 - DNA, 15 bp, Homo sapiens
acatcctacaagaca

SEQ ID NO: 4738913 - DNA, 12 bp, Homo sapiens
acatcctgactt

SEQ ID NO: 4738914 - DNA, 18 bp, Homo sapiens
acatctaaattgatcatt

SEQ ID NO: 4738915 - DNA, 22 bp, Homo sapiens
acatctaaattgatcattcata

SEQ ID NO: 4738916 - DNA, 17 bp, Homo sapiens
acatctgaatctccttg

SEQ ID NO: 4738917 - DNA, 19 bp, Homo sapiens
acatctgaatctccttgtt

SEQ ID NO: 4738918 - DNA, 15 bp, Homo sapiens
acatctgtcctgtga

SEQ ID NO: 4738919 - DNA, 15 bp, Homo sapiens
acatctgtgtcttgt

SEQ ID NO: 4738920 - DNA, 15 bp, Homo sapiens
acatcttgctctgct

SEQ ID NO: 4738921 - DNA, 16 bp, Homo sapiens
acatcttgctctgctg

SEQ ID NO: 4738922 - DNA, 17 bp, Homo sapiens
acatcttgctctgctga

SEQ ID NO: 4738923 - DNA, 21 bp, Homo sapiens
acatcttgctctgctgacaga

SEQ ID NO: 4738924 - DNA, 13 bp, Homo sapiens
acatcttggcaca

SEQ ID NO: 4738925 - DNA, 12 bp, Homo sapiens
acatgaaaacat

SEQ ID NO: 4738926 - DNA, 13 bp, Homo sapiens
acatgaaaacatt

SEQ ID NO: 4738927 - DNA, 15 bp, Homo sapiens
acatgaaaacattga

SEQ ID NO: 4738928 - DNA, 17 bp, Homo sapiens
acatgaagattctttcc

SEQ ID NO: 4738929 - DNA, 22 bp, Homo sapiens
acatgaagattctttcccaatt

SEQ ID NO: 4738930 - DNA, 20 bp, Homo sapiens
acatgagcatcaggccaggc

SEQ ID NO: 4738931 - DNA, 22 bp, Homo sapiens
acatgagttattcataaagaga

SEQ ID NO: 4738932 - DNA, 23 bp, Homo sapiens
acatgcatataatgaataaatca

SEQ ID NO: 4738933 - DNA, 11 bp, Homo sapiens
acatgcctgca

SEQ ID NO: 4738934 - DNA, 19 bp, Homo sapiens
acatgctcttagaaaattc

SEQ ID NO: 4738935 - DNA, 14 bp, Homo sapiens
acatggaaaacaga

SEQ ID NO: 4738936 - DNA, 20 bp, Homo sapiens
acatgggagccgggtctgcc

SEQ ID NO: 4738937 - DNA, 13 bp, Homo sapiens
acatggggaggag

SEQ ID NO: 4738938 - DNA, 15 bp, Homo sapiens
acatggtgtgtgtct

SEQ ID NO: 4738939 - DNA, 19 bp, Homo sapiens
acatggtgtgtgtctctga

SEQ ID NO: 4738940 - DNA, 14 bp, Homo sapiens
acatgtatgtggat

SEQ ID NO: 4738941 - DNA, 18 bp, Homo sapiens
acatgtcagtaccttcaa

SEQ ID NO: 4738942 - DNA, 15 bp, Homo sapiens
acatgtccaagaagc

SEQ ID NO: 4738943 - DNA, 21 bp, Homo sapiens
acatgtccaagaagcccagga

SEQ ID NO: 4738944 - DNA, 23 bp, Homo sapiens
acatgtcttttcttgcatgaggc

SEQ ID NO: 4738945 - DNA, 13 bp, Homo sapiens
acatgtgaaacct

SEQ ID NO: 4738946 - DNA, 14 bp, Homo sapiens
acatgtgaaacctt

SEQ ID NO: 4738947 - DNA, 15 bp, Homo sapiens
acatgtgaaaccttt

SEQ ID NO: 4738948 - DNA, 20 bp, Homo sapiens
acatgtgaaaccttttttaa

SEQ ID NO: 4738949 - DNA, 21 bp, Homo sapiens
acatgtgaaaccttttttaag

SEQ ID NO: 4738950 - DNA, 23 bp, Homo sapiens
acatgtgaaaccttttttaagat

SEQ ID NO: 4738951 - DNA, 11 bp, Homo sapiens
acatgtgcaac

SEQ ID NO: 4738952 - DNA, 20 bp, Homo sapiens
acatgtggcttgaattaaga

SEQ ID NO: 4738953 - DNA, 19 bp, Homo sapiens
acatgtgtcccagccacag

SEQ ID NO: 4738954 - DNA, 19 bp, Homo sapiens
acatgttaccatgtctgac

SEQ ID NO: 4738955 - DNA, 17 bp, Homo sapiens
acatgttagtcaaggac

SEQ ID NO: 4738956 - DNA, 16 bp, Homo sapiens
acattaccttactgtg

SEQ ID NO: 4738957 - DNA, 19 bp, Homo sapiens
acattaccttactgtggag

SEQ ID NO: 4738958 - DNA, 13 bp, Homo sapiens
acattagttttaa

SEQ ID NO: 4738959 - DNA, 16 bp, Homo sapiens
acattccgtcctgatg

SEQ ID NO: 4738960 - DNA, 18 bp, Homo sapiens
acattctgtctttcaaaa

SEQ ID NO: 4738961 - DNA, 14 bp, Homo sapiens
acattgcaatagaa

SEQ ID NO: 4738962 - DNA, 16 bp, Homo sapiens
acattgcaatagaaat

SEQ ID NO: 4738963 - DNA, 19 bp, Homo sapiens
acattgtgtcctgcttata

SEQ ID NO: 4738964 - DNA, 14 bp, Homo sapiens
acatttaggagaag

SEQ ID NO: 4738965 - DNA, 16 bp, Homo sapiens
acatttatgtgttgat

SEQ ID NO: 4738966 - DNA, 22 bp, Homo sapiens
acatttatgtgttgataatttt

SEQ ID NO: 4738967 - DNA, 19 bp, Homo sapiens
acatttctcttcagtgtgt

SEQ ID NO: 4738968 - DNA, 20 bp, Homo sapiens
acatttctcttcagtgtgtt

SEQ ID NO: 4738969 - DNA, 13 bp, Homo sapiens
acattttatgtct

SEQ ID NO: 4738970 - DNA, 15 bp, Homo sapiens
acattttatgtcttt

SEQ ID NO: 4738971 - DNA, 14 bp, Homo sapiens
acattttgccaaaa

SEQ ID NO: 4738972 - DNA, 11 bp, Homo sapiens
acattttgtat

SEQ ID NO: 4738973 - DNA, 18 bp, Homo sapiens
acatttttgtatgtgtgt

SEQ ID NO: 4738974 - DNA, 20 bp, Homo sapiens
accaaaaattgcgagccttt

SEQ ID NO: 4738975 - DNA, 16 bp, Homo sapiens
accaaaatccccttct

SEQ ID NO: 4738976 - DNA, 19 bp, Homo sapiens
accaaaggaaaatgtctgt

SEQ ID NO: 4738977 - DNA, 14 bp, Homo sapiens
accaaatctgacat

SEQ ID NO: 4738978 - DNA, 19 bp, Homo sapiens
accaacatactcccatctg

SEQ ID NO: 4738979 - DNA, 18 bp, Homo sapiens
accaacattgttcattct

SEQ ID NO: 4738980 - DNA, 12 bp, Homo sapiens
accaacccagcc

SEQ ID NO: 4738981 - DNA, 19 bp, Homo sapiens
accaacctgaagacaccgt

SEQ ID NO: 4738982 - DNA, 17 bp, Homo sapiens
accaacgtctgtgccat

SEQ ID NO: 4738983 - DNA, 12 bp, Homo sapiens
accaagcctctg

SEQ ID NO: 4738984 - DNA, 15 bp, Homo sapiens
accaagcctctggaa

SEQ ID NO: 4738985 - DNA, 17 bp, Homo sapiens
accaagctatcctggct

SEQ ID NO: 4738986 - DNA, 13 bp, Homo sapiens
accaagctgtgcc

SEQ ID NO: 4738987 - DNA, 18 bp, Homo sapiens
accaagggatgggacctg

SEQ ID NO: 4738988 - DNA, 19 bp, Homo sapiens
accaagggatgggacctga

SEQ ID NO: 4738989 - DNA, 15 bp, Homo sapiens
accaagttgtttatt

SEQ ID NO: 4738990 - DNA, 19 bp, Homo sapiens
accaagttgtttattccaa

SEQ ID NO: 4738991 - DNA, 15 bp, Homo sapiens
accaataaatgtttg

SEQ ID NO: 4738992 - DNA, 18 bp, Homo sapiens
accaatattgtacagttt

SEQ ID NO: 4738993 - DNA, 20 bp, Homo sapiens
accaatcttaaacataataa

SEQ ID NO: 4738994 - DNA, 17 bp, Homo sapiens
accaatgaaaaaatgta

SEQ ID NO: 4738995 - DNA, 13 bp, Homo sapiens
accaatgtcttga

SEQ ID NO: 4738996 - DNA, 16 bp, Homo sapiens
accacacccagcccac

SEQ ID NO: 4738997 - DNA, 23 bp, Homo sapiens
accacacccagcccacttctgcc

SEQ ID NO: 4738998 - DNA, 13 bp, Homo sapiens
accacagctgctg

SEQ ID NO: 4738999 - DNA, 15 bp, Homo sapiens
accacagctgctgga

SEQ ID NO: 4739000 - DNA, 16 bp, Homo sapiens
accacagctgctggag

SEQ ID NO: 4739001 - DNA, 14 bp, Homo sapiens
accacatagaacat

SEQ ID NO: 4739002 - DNA, 14 bp, Homo sapiens
accacatcttgctc

SEQ ID NO: 4739003 - DNA, 17 bp, Homo sapiens
accacatcttgctctgc

SEQ ID NO: 4739004 - DNA, 20 bp, Homo sapiens
accacatcttgctctgctga

SEQ ID NO: 4739005 - DNA, 18 bp, Homo sapiens
accacatgtgcacatgca

SEQ ID NO: 4739006 - DNA, 18 bp, Homo sapiens
accacgctggaccttgaa

SEQ ID NO: 4739007 - DNA, 16 bp, Homo sapiens
accacgtggggccatg

SEQ ID NO: 4739008 - DNA, 13 bp, Homo sapiens
accactgtcttct

SEQ ID NO: 4739009 - DNA, 23 bp, Homo sapiens
accactgtggaagtccctcagag

SEQ ID NO: 4739010 - DNA, 14 bp, Homo sapiens
accactttttgcag

SEQ ID NO: 4739011 - DNA, 22 bp, Homo sapiens
accagacaccttgacagggcac

SEQ ID NO: 4739012 - DNA, 23 bp, Homo sapiens
accagacaccttgacagggcaca

SEQ ID NO: 4739013 - DNA, 15 bp, Homo sapiens
accagagagagttgt

SEQ ID NO: 4739014 - DNA, 15 bp, Homo sapiens
accagagcagatgca

SEQ ID NO: 4739015 - DNA, 17 bp, Homo sapiens
accagagcagatgcaga

SEQ ID NO: 4739016 - DNA, 16 bp, Homo sapiens
accagagcccaccttg

SEQ ID NO: 4739017 - DNA, 12 bp, Homo sapiens
accagcagagca

SEQ ID NO: 4739018 - DNA, 10 bp, Homo sapiens
accagccact

SEQ ID NO: 4739019 - DNA, 15 bp, Homo sapiens
accagcccagaccct

SEQ ID NO: 4739020 - DNA, 16 bp, Homo sapiens
accagccccagtgccc

SEQ ID NO: 4739021 - DNA, 20 bp, Homo sapiens
accagccccagtgcccacag

SEQ ID NO: 4739022 - DNA, 22 bp, Homo sapiens
accagctgttctgtcccttgga

SEQ ID NO: 4739023 - DNA, 19 bp, Homo sapiens
accaggcaacttgggaact

SEQ ID NO: 4739024 - DNA, 20 bp, Homo sapiens
accaggcttgcctgggacgg

SEQ ID NO: 4739025 - DNA, 18 bp, Homo sapiens
accaggggcaggcacagc

SEQ ID NO: 4739026 - DNA, 19 bp, Homo sapiens
accaggggcaggcacagca

SEQ ID NO: 4739027 - DNA, 20 bp, Homo sapiens
accagtagtcacctctgggc

SEQ ID NO: 4739028 - DNA, 17 bp, Homo sapiens
accagtttgactgtgct

SEQ ID NO: 4739029 - DNA, 19 bp, Homo sapiens
accataatccctgtcttct

SEQ ID NO: 4739030 - DNA, 16 bp, Homo sapiens
accatactaattatac

SEQ ID NO: 4739031 - DNA, 21 bp, Homo sapiens
accatactaattataccccct

SEQ ID NO: 4739032 - DNA, 15 bp, Homo sapiens
accatcaagccacca

SEQ ID NO: 4739033 - DNA, 17 bp, Homo sapiens
accatcatgtctggcta

SEQ ID NO: 4739034 - DNA, 21 bp, Homo sapiens
accatccctgaaggccccgcc

SEQ ID NO: 4739035 - DNA, 18 bp, Homo sapiens
accatcttctgtgtttat

SEQ ID NO: 4739036 - DNA, 20 bp, Homo sapiens
accatctttgccaacatggt

SEQ ID NO: 4739037 - DNA, 18 bp, Homo sapiens
accatgcatttaaagtat

SEQ ID NO: 4739038 - DNA, 14 bp, Homo sapiens
accatggcacttga

SEQ ID NO: 4739039 - DNA, 11 bp, Homo sapiens
accattagcat

SEQ ID NO: 4739040 - DNA, 13 bp, Homo sapiens
accattctccacc

SEQ ID NO: 4739041 - DNA, 20 bp, Homo sapiens
accattctccacctgccagg

SEQ ID NO: 4739042 - DNA, 21 bp, Homo sapiens
accattctccacctgccaggg

SEQ ID NO: 4739043 - DNA, 23 bp, Homo sapiens
accattttgttattgactaacag

SEQ ID NO: 4739044 - DNA, 21 bp, Homo sapiens
acccaaagagacagctcttct

SEQ ID NO: 4739045 - DNA, 17 bp, Homo sapiens
acccaaatcctctccag

SEQ ID NO: 4739046 - DNA, 15 bp, Homo sapiens
acccacctcagcctc

SEQ ID NO: 4739047 - DNA, 22 bp, Homo sapiens
acccacgtccacgcggccacct

SEQ ID NO: 4739048 - DNA, 10 bp, Homo sapiens
acccactgct

SEQ ID NO: 4739049 - DNA, 21 bp, Homo sapiens
acccactggactcacctcccc

SEQ ID NO: 4739050 - DNA, 14 bp, Homo sapiens
acccagattttatt

SEQ ID NO: 4739051 - DNA, 20 bp, Homo sapiens
acccagccccaaggggtggc

SEQ ID NO: 4739052 - DNA, 22 bp, Homo sapiens
acccagccccaaggggtggccg

SEQ ID NO: 4739053 - DNA, 13 bp, Homo sapiens
acccagctctggt

SEQ ID NO: 4739054 - DNA, 15 bp, Homo sapiens
acccagcttcaaagc

SEQ ID NO: 4739055 - DNA, 22 bp, Homo sapiens
acccaggagcatccacctcctt

SEQ ID NO: 4739056 - DNA, 19 bp, Homo sapiens
acccaggagccccgaggcc

SEQ ID NO: 4739057 - DNA, 16 bp, Homo sapiens
acccatgctgccctgt

SEQ ID NO: 4739058 - DNA, 17 bp, Homo sapiens
acccatgctgccctgtg

SEQ ID NO: 4739059 - DNA, 13 bp, Homo sapiens
acccattccttcc

SEQ ID NO: 4739060 - DNA, 15 bp, Homo sapiens
acccattccttccca

SEQ ID NO: 4739061 - DNA, 17 bp, Homo sapiens
accccaattccttgtag

SEQ ID NO: 4739062 - DNA, 16 bp, Homo sapiens
accccacacacgccag

SEQ ID NO: 4739063 - DNA, 18 bp, Homo sapiens
accccacccacttctgca

SEQ ID NO: 4739064 - DNA, 20 bp, Homo sapiens
accccacccctcatcaggag

SEQ ID NO: 4739065 - DNA, 17 bp, Homo sapiens
accccagggcagccagg

SEQ ID NO: 4739066 - DNA, 21 bp, Homo sapiens
accccagggcagccagggaga

SEQ ID NO: 4739067 - DNA, 13 bp, Homo sapiens
accccaggtttct

SEQ ID NO: 4739068 - DNA, 14 bp, Homo sapiens
accccatctgccca

SEQ ID NO: 4739069 - DNA, 15 bp, Homo sapiens
accccatctgcccag

SEQ ID NO: 4739070 - DNA, 18 bp, Homo sapiens
acccccaaatactctgaa

SEQ ID NO: 4739071 - DNA, 16 bp, Homo sapiens
acccccaccccttgct

SEQ ID NO: 4739072 - DNA, 22 bp, Homo sapiens
acccccagcacccgggctcagg

SEQ ID NO: 4739073 - DNA, 14 bp, Homo sapiens
acccccagccccca

SEQ ID NO: 4739074 - DNA, 15 bp, Homo sapiens
acccccagcccctcc

SEQ ID NO: 4739075 - DNA, 13 bp, Homo sapiens
accccccagcact

SEQ ID NO: 4739076 - DNA, 17 bp, Homo sapiens
accccccagcactgagg

SEQ ID NO: 4739077 - DNA, 22 bp, Homo sapiens
acccccgagtttggtccctggg

SEQ ID NO: 4739078 - DNA, 19 bp, Homo sapiens
acccccgcccaggctggcc

SEQ ID NO: 4739079 - DNA, 20 bp, Homo sapiens
acccccgcccaggctggcca

SEQ ID NO: 4739080 - DNA, 15 bp, Homo sapiens
accccctccccccaa

SEQ ID NO: 4739081 - DNA, 15 bp, Homo sapiens
accccctccccgccc

SEQ ID NO: 4739082 - DNA, 17 bp, Homo sapiens
accccctgcaaagccca

SEQ ID NO: 4739083 - DNA, 18 bp, Homo sapiens
accccctgcaaagcccag

SEQ ID NO: 4739084 - DNA, 22 bp, Homo sapiens
accccctgcaaagcccagcttg

SEQ ID NO: 4739085 - DNA, 16 bp, Homo sapiens
acccctccctttctcc

SEQ ID NO: 4739086 - DNA, 18 bp, Homo sapiens
acccctcctccctttttc

SEQ ID NO: 4739087 - DNA, 20 bp, Homo sapiens
acccctggttctcatctttc

SEQ ID NO: 4739088 - DNA, 16 bp, Homo sapiens
accccttttcagcttc

SEQ ID NO: 4739089 - DNA, 20 bp, Homo sapiens
accccttttcagcttctgct

SEQ ID NO: 4739090 - DNA, 17 bp, Homo sapiens
acccggcccctgctggt

SEQ ID NO: 4739091 - DNA, 20 bp, Homo sapiens
acccggcccctgctggttca

SEQ ID NO: 4739092 - DNA, 12 bp, Homo sapiens
acccgggaaggg

SEQ ID NO: 4739093 - DNA, 13 bp, Homo sapiens
acccgggaagggg

SEQ ID NO: 4739094 - DNA, 22 bp, Homo sapiens
acccgggaagggggctgggaca

SEQ ID NO: 4739095 - DNA, 13 bp, Homo sapiens
acccgggctcagg

SEQ ID NO: 4739096 - DNA, 23 bp, Homo sapiens
acccgggctcagggaccacagca

SEQ ID NO: 4739097 - DNA, 17 bp, Homo sapiens
acccgttcatgggggag

SEQ ID NO: 4739098 - DNA, 15 bp, Homo sapiens
accctcacactggga

SEQ ID NO: 4739099 - DNA, 16 bp, Homo sapiens
accctcaccgcggctg

SEQ ID NO: 4739100 - DNA, 11 bp, Homo sapiens
accctcactgg

SEQ ID NO: 4739101 - DNA, 18 bp, Homo sapiens
accctcatacacagaaac

SEQ ID NO: 4739102 - DNA, 15 bp, Homo sapiens
accctccctgctgtc

SEQ ID NO: 4739103 - DNA, 19 bp, Homo sapiens
accctcctctatttcttta

SEQ ID NO: 4739104 - DNA, 19 bp, Homo sapiens
accctctcaggtgaccaaa

SEQ ID NO: 4739105 - DNA, 23 bp, Homo sapiens
accctctggttgtgggcttggac

SEQ ID NO: 4739106 - DNA, 20 bp, Homo sapiens
accctctgtgaaatttgtaa

SEQ ID NO: 4739107 - DNA, 17 bp, Homo sapiens
accctgagctgaggcag

SEQ ID NO: 4739108 - DNA, 14 bp, Homo sapiens
accctgaggcccag

SEQ ID NO: 4739109 - DNA, 17 bp, Homo sapiens
accctgaggcccagagg

SEQ ID NO: 4739110 - DNA, 11 bp, Homo sapiens
accctgccctg

SEQ ID NO: 4739111 - DNA, 13 bp, Homo sapiens
accctgccctgtg

SEQ ID NO: 4739112 - DNA, 14 bp, Homo sapiens
accctgccctgtgg

SEQ ID NO: 4739113 - DNA, 17 bp, Homo sapiens
accctgggctctgtggg

SEQ ID NO: 4739114 - DNA, 16 bp, Homo sapiens
accctggggagaaagt

SEQ ID NO: 4739115 - DNA, 19 bp, Homo sapiens
accctgtgatggggccctg

SEQ ID NO: 4739116 - DNA, 22 bp, Homo sapiens
accctgtgatggggccctgcct

SEQ ID NO: 4739117 - DNA, 19 bp, Homo sapiens
acccttacagtaggagccc

SEQ ID NO: 4739118 - DNA, 17 bp, Homo sapiens
acccttgccgtctacct

SEQ ID NO: 4739119 - DNA, 19 bp, Homo sapiens
acccttgtggtcccacccc

SEQ ID NO: 4739120 - DNA, 12 bp, Homo sapiens
acccttttccag

SEQ ID NO: 4739121 - DNA, 15 bp, Homo sapiens
accgaggacatgaaa

SEQ ID NO: 4739122 - DNA, 12 bp, Homo sapiens
accgcagacagg

SEQ ID NO: 4739123 - DNA, 18 bp, Homo sapiens
accggaccagcctggccc

SEQ ID NO: 4739124 - DNA, 14 bp, Homo sapiens
accgggcactcaga

SEQ ID NO: 4739125 - DNA, 16 bp, Homo sapiens
accgggcactcagaag

SEQ ID NO: 4739126 - DNA, 20 bp, Homo sapiens
accgggcactcagaagacac

SEQ ID NO: 4739127 - DNA, 15 bp, Homo sapiens
accgggccacagaga

SEQ ID NO: 4739128 - DNA, 16 bp, Homo sapiens
acctaaaccctctgtg

SEQ ID NO: 4739129 - DNA, 19 bp, Homo sapiens
acctaaaccctctgtgaaa

SEQ ID NO: 4739130 - DNA, 16 bp, Homo sapiens
acctacagtgtacagt

SEQ ID NO: 4739131 - DNA, 16 bp, Homo sapiens
acctacagttttaact

SEQ ID NO: 4739132 - DNA, 15 bp, Homo sapiens
acctaccacatgcca

SEQ ID NO: 4739133 - DNA, 13 bp, Homo sapiens
acctagccttaga

SEQ ID NO: 4739134 - DNA, 16 bp, Homo sapiens
acctagcgtcagtatt

SEQ ID NO: 4739135 - DNA, 16 bp, Homo sapiens
acctagctaattattt

SEQ ID NO: 4739136 - DNA, 19 bp, Homo sapiens
acctagctgttgtaaagaa

SEQ ID NO: 4739137 - DNA, 17 bp, Homo sapiens
acctaggatatcttctc

SEQ ID NO: 4739138 - DNA, 17 bp, Homo sapiens
acctagtggctgtccag

SEQ ID NO: 4739139 - DNA, 22 bp, Homo sapiens
acctagtggctgtccagtgccc

SEQ ID NO: 4739140 - DNA, 23 bp, Homo sapiens
acctagtggctgtccagtgccca

SEQ ID NO: 4739141 - DNA, 18 bp, Homo sapiens
acctcagagtatggagct

SEQ ID NO: 4739142 - DNA, 11 bp, Homo sapiens
acctcagcctc

SEQ ID NO: 4739143 - DNA, 20 bp, Homo sapiens
acctcaggtgatccacccac

SEQ ID NO: 4739144 - DNA, 21 bp, Homo sapiens
acctcaggtgatccacccacc

SEQ ID NO: 4739145 - DNA, 16 bp, Homo sapiens
acctcatgtcatttct

SEQ ID NO: 4739146 - DNA, 14 bp, Homo sapiens
acctccacatcctc

SEQ ID NO: 4739147 - DNA, 13 bp, Homo sapiens
acctcctgggcta

SEQ ID NO: 4739148 - DNA, 18 bp, Homo sapiens
acctcctttctcttctct

SEQ ID NO: 4739149 - DNA, 20 bp, Homo sapiens
acctctccagcctcagctct

SEQ ID NO: 4739150 - DNA, 15 bp, Homo sapiens
acctctcccttggat

SEQ ID NO: 4739151 - DNA, 23 bp, Homo sapiens
acctctcccttggattgtccccg

SEQ ID NO: 4739152 - DNA, 19 bp, Homo sapiens
acctctctcactccttgaa

SEQ ID NO: 4739153 - DNA, 20 bp, Homo sapiens
acctctgcctgaagtcacac

SEQ ID NO: 4739154 - DNA, 23 bp, Homo sapiens
acctctgcctgaagtcacacagt

SEQ ID NO: 4739155 - DNA, 15 bp, Homo sapiens
acctcttcagaggcc

SEQ ID NO: 4739156 - DNA, 17 bp, Homo sapiens
acctcttcagaggccct

SEQ ID NO: 4739157 - DNA, 18 bp, Homo sapiens
acctcttcagaggccctc

SEQ ID NO: 4739158 - DNA, 18 bp, Homo sapiens
acctgaaaacactgtgca

SEQ ID NO: 4739159 - DNA, 20 bp, Homo sapiens
acctgaaaacactgtgcaca

SEQ ID NO: 4739160 - DNA, 18 bp, Homo sapiens
acctgaaattaatttgtg

SEQ ID NO: 4739161 - DNA, 22 bp, Homo sapiens
acctgaaattaatttgtgaatt

SEQ ID NO: 4739162 - DNA, 15 bp, Homo sapiens
acctgaactttcatt

SEQ ID NO: 4739163 - DNA, 20 bp, Homo sapiens
acctgagctagaagctggag

SEQ ID NO: 4739164 - DNA, 16 bp, Homo sapiens
acctgaggcccttctc

SEQ ID NO: 4739165 - DNA, 13 bp, Homo sapiens
acctgatgaaaat

SEQ ID NO: 4739166 - DNA, 15 bp, Homo sapiens
acctgatgaaaataa

SEQ ID NO: 4739167 - DNA, 22 bp, Homo sapiens
acctgatgaaaataaagaatgg

SEQ ID NO: 4739168 - DNA, 15 bp, Homo sapiens
acctgatgacctggg

SEQ ID NO: 4739169 - DNA, 14 bp, Homo sapiens
acctgatggagagt

SEQ ID NO: 4739170 - DNA, 20 bp, Homo sapiens
acctgcacactgtcctatta

SEQ ID NO: 4739171 - DNA, 15 bp, Homo sapiens
acctgcatttttaaa

SEQ ID NO: 4739172 - DNA, 11 bp, Homo sapiens
acctgccaggg

SEQ ID NO: 4739173 - DNA, 12 bp, Homo sapiens
acctgccaggga

SEQ ID NO: 4739174 - DNA, 23 bp, Homo sapiens
acctgcccctcctctctgcccta

SEQ ID NO: 4739175 - DNA, 19 bp, Homo sapiens
acctgccctggccccagcc

SEQ ID NO: 4739176 - DNA, 21 bp, Homo sapiens
acctgcctcccttcatgcatg

SEQ ID NO: 4739177 - DNA, 18 bp, Homo sapiens
acctgcggtgctatctcc

SEQ ID NO: 4739178 - DNA, 22 bp, Homo sapiens
acctgcggtgctatctccccca

SEQ ID NO: 4739179 - DNA, 23 bp, Homo sapiens
acctgcggtgctatctcccccag

SEQ ID NO: 4739180 - DNA, 16 bp, Homo sapiens
acctgctcacgtcaaa

SEQ ID NO: 4739181 - DNA, 16 bp, Homo sapiens
acctggacccctgcat

SEQ ID NO: 4739182 - DNA, 20 bp, Homo sapiens
acctggacccctgcattgga

SEQ ID NO: 4739183 - DNA, 13 bp, Homo sapiens
acctggagaccag

SEQ ID NO: 4739184 - DNA, 21 bp, Homo sapiens
acctggagagctagaacctag

SEQ ID NO: 4739185 - DNA, 23 bp, Homo sapiens
acctggagagctagaacctggag

SEQ ID NO: 4739186 - DNA, 22 bp, Homo sapiens
acctggaggggctagaacctag

SEQ ID NO: 4739187 - DNA, 22 bp, Homo sapiens
acctggattgtgcctaatgtgt

SEQ ID NO: 4739188 - DNA, 20 bp, Homo sapiens
acctggcaagctagaacctg

SEQ ID NO: 4739189 - DNA, 12 bp, Homo sapiens
acctggcctctg

SEQ ID NO: 4739190 - DNA, 13 bp, Homo sapiens
acctggcctctgc

SEQ ID NO: 4739191 - DNA, 20 bp, Homo sapiens
acctggcctctgcactcccc

SEQ ID NO: 4739192 - DNA, 23 bp, Homo sapiens
acctggcctctgcactcccctgc

SEQ ID NO: 4739193 - DNA, 13 bp, Homo sapiens
acctgggaagggg

SEQ ID NO: 4739194 - DNA, 19 bp, Homo sapiens
acctgtgcttcgggccctt

SEQ ID NO: 4739195 - DNA, 18 bp, Homo sapiens
acctgtggccaagttctt

SEQ ID NO: 4739196 - DNA, 16 bp, Homo sapiens
acctgtggtgcaaaag

SEQ ID NO: 4739197 - DNA, 15 bp, Homo sapiens
accttactgtggagg

SEQ ID NO: 4739198 - DNA, 19 bp, Homo sapiens
accttagacagtccctgcc

SEQ ID NO: 4739199 - DNA, 20 bp, Homo sapiens
accttagacagtccctgcca

SEQ ID NO: 4739200 - DNA, 22 bp, Homo sapiens
accttagatgttctaagtcttt

SEQ ID NO: 4739201 - DNA, 16 bp, Homo sapiens
accttattctatactt

SEQ ID NO: 4739202 - DNA, 19 bp, Homo sapiens
accttcaaaatgttctatt

SEQ ID NO: 4739203 - DNA, 20 bp, Homo sapiens
accttcaaaatgttctattt

SEQ ID NO: 4739204 - DNA, 11 bp, Homo sapiens
accttccaaac

SEQ ID NO: 4739205 - DNA, 16 bp, Homo sapiens
accttccaaacaaaag

SEQ ID NO: 4739206 - DNA, 15 bp, Homo sapiens
accttcgccacctgg

SEQ ID NO: 4739207 - DNA, 17 bp, Homo sapiens
accttcgccacctgggt

SEQ ID NO: 4739208 - DNA, 22 bp, Homo sapiens
accttctccttcacctttgtcc

SEQ ID NO: 4739209 - DNA, 18 bp, Homo sapiens
accttctgacgcagcctg

SEQ ID NO: 4739210 - DNA, 22 bp, Homo sapiens
accttgaaaaaaaacagtggat

SEQ ID NO: 4739211 - DNA, 23 bp, Homo sapiens
accttgaaaaaaaacagtggatc

SEQ ID NO: 4739212 - DNA, 20 bp, Homo sapiens
accttgaactgggtacttgt

SEQ ID NO: 4739213 - DNA, 15 bp, Homo sapiens
accttgacagggcac

SEQ ID NO: 4739214 - DNA, 19 bp, Homo sapiens
accttgaggagtcttgtgt

SEQ ID NO: 4739215 - DNA, 14 bp, Homo sapiens
accttggctgcagg

SEQ ID NO: 4739216 - DNA, 18 bp, Homo sapiens
accttgtgagggagagaa

SEQ ID NO: 4739217 - DNA, 14 bp, Homo sapiens
acctttattcagaa

SEQ ID NO: 4739218 - DNA, 15 bp, Homo sapiens
accttttttaagatt

SEQ ID NO: 4739219 - DNA, 17 bp, Homo sapiens
acgaaatatcaaagtca

SEQ ID NO: 4739220 - DNA, 22 bp, Homo sapiens
acgaatacttttgccctttgat

SEQ ID NO: 4739221 - DNA, 19 bp, Homo sapiens
acgacaaggaaaggcaaat

SEQ ID NO: 4739222 - DNA, 14 bp, Homo sapiens
acgagaaaacaata

SEQ ID NO: 4739223 - DNA, 15 bp, Homo sapiens
acgcagctggcagag

SEQ ID NO: 4739224 - DNA, 15 bp, Homo sapiens
acgcaggcccctctc

SEQ ID NO: 4739225 - DNA, 21 bp, Homo sapiens
acgcaggcccctctcctccgt

SEQ ID NO: 4739226 - DNA, 14 bp, Homo sapiens
acgccatcccagcc

SEQ ID NO: 4739227 - DNA, 16 bp, Homo sapiens
acgccatcccagcccc

SEQ ID NO: 4739228 - DNA, 14 bp, Homo sapiens
acgcccccactggt

SEQ ID NO: 4739229 - DNA, 13 bp, Homo sapiens
acgcctgaggaac

SEQ ID NO: 4739230 - DNA, 18 bp, Homo sapiens
acgcctgggggtgccagg

SEQ ID NO: 4739231 - DNA, 18 bp, Homo sapiens
acgctacccgggaagggg

SEQ ID NO: 4739232 - DNA, 15 bp, Homo sapiens
acgctggagtgcagt

SEQ ID NO: 4739233 - DNA, 19 bp, Homo sapiens
acgctgtgctgccctgccc

SEQ ID NO: 4739234 - DNA, 15 bp, Homo sapiens
acggaaagtgctgtc

SEQ ID NO: 4739235 - DNA, 20 bp, Homo sapiens
acggagccactcctctgact

SEQ ID NO: 4739236 - DNA, 17 bp, Homo sapiens
acggaggagaattaagt

SEQ ID NO: 4739237 - DNA, 19 bp, Homo sapiens
acggagtcccaccttggct

SEQ ID NO: 4739238 - DNA, 16 bp, Homo sapiens
acggccaggccagagg

SEQ ID NO: 4739239 - DNA, 16 bp, Homo sapiens
acggctcactgcagcc

SEQ ID NO: 4739240 - DNA, 17 bp, Homo sapiens
acggctcactgcagcct

SEQ ID NO: 4739241 - DNA, 14 bp, Homo sapiens
acggggccggccag

SEQ ID NO: 4739242 - DNA, 18 bp, Homo sapiens
acggggctcttctcattt

SEQ ID NO: 4739243 - DNA, 21 bp, Homo sapiens
acggtggtcactggaactcag

SEQ ID NO: 4739244 - DNA, 21 bp, Homo sapiens
acgtaaagccttgttttctct

SEQ ID NO: 4739245 - DNA, 22 bp, Homo sapiens
acgtaaagccttgttttctctg

SEQ ID NO: 4739246 - DNA, 17 bp, Homo sapiens
acgtaaagctagaaatg

SEQ ID NO: 4739247 - DNA, 18 bp, Homo sapiens
acgtaaagctagaaatga

SEQ ID NO: 4739248 - DNA, 13 bp, Homo sapiens
acgtaaatgtttt

SEQ ID NO: 4739249 - DNA, 14 bp, Homo sapiens
acgtaaatgttttt

SEQ ID NO: 4739250 - DNA, 13 bp, Homo sapiens
acgtacacacaca

SEQ ID NO: 4739251 - DNA, 18 bp, Homo sapiens
acgtatggaatgcttctt

SEQ ID NO: 4739252 - DNA, 20 bp, Homo sapiens
acgtatgtttttgtgtattt

SEQ ID NO: 4739253 - DNA, 15 bp, Homo sapiens
acgtcctgtcagtgc

SEQ ID NO: 4739254 - DNA, 13 bp, Homo sapiens
acgtctgacaggc

SEQ ID NO: 4739255 - DNA, 15 bp, Homo sapiens
acgtctgacaggcaa

SEQ ID NO: 4739256 - DNA, 23 bp, Homo sapiens
acgtctgacaggcaatgctggct

SEQ ID NO: 4739257 - DNA, 12 bp, Homo sapiens
acgtctgtgcca

SEQ ID NO: 4739258 - DNA, 22 bp, Homo sapiens
acgtgattcaattcaacactcc

SEQ ID NO: 4739259 - DNA, 13 bp, Homo sapiens
acgtggaggagca

SEQ ID NO: 4739260 - DNA, 18 bp, Homo sapiens
acgtggaggagcagtgca

SEQ ID NO: 4739261 - DNA, 11 bp, Homo sapiens
acgtggcagga

SEQ ID NO: 4739262 - DNA, 18 bp, Homo sapiens
acgtgtactacaatttaa

SEQ ID NO: 4739263 - DNA, 14 bp, Homo sapiens
acgtgtgtttttct

SEQ ID NO: 4739264 - DNA, 16 bp, Homo sapiens
acgtgtgtttttctat

SEQ ID NO: 4739265 - DNA, 17 bp, Homo sapiens
acgtgtgtttttctatt

SEQ ID NO: 4739266 - DNA, 16 bp, Homo sapiens
acgtttttaataggat

SEQ ID NO: 4739267 - DNA, 14 bp, Homo sapiens
acgtttttccttta

SEQ ID NO: 4739268 - DNA, 17 bp, Homo sapiens
actaaaaagtataaaat

SEQ ID NO: 4739269 - DNA, 16 bp, Homo sapiens
actaaaaatttttaca

SEQ ID NO: 4739270 - DNA, 12 bp, Homo sapiens
actaaccacgct

SEQ ID NO: 4739271 - DNA, 23 bp, Homo sapiens
actaactagagcagccctggagt

SEQ ID NO: 4739272 - DNA, 17 bp, Homo sapiens
actaatgagtatttggt

SEQ ID NO: 4739273 - DNA, 15 bp, Homo sapiens
actaatgatgctttt

SEQ ID NO: 4739274 - DNA, 22 bp, Homo sapiens
actaattatcacgtctgacaaa

SEQ ID NO: 4739275 - DNA, 15 bp, Homo sapiens
actaattttaaaatg

SEQ ID NO: 4739276 - DNA, 22 bp, Homo sapiens
actaattttccataagctattt

SEQ ID NO: 4739277 - DNA, 19 bp, Homo sapiens
actaattttttaagaggaa

SEQ ID NO: 4739278 - DNA, 21 bp, Homo sapiens
actacaaacaaaatttctatt

SEQ ID NO: 4739279 - DNA, 22 bp, Homo sapiens
actacaaacaaaatttctatta

SEQ ID NO: 4739280 - DNA, 11 bp, Homo sapiens
actacaggcac

SEQ ID NO: 4739281 - DNA, 20 bp, Homo sapiens
actacatttagcccctctct

SEQ ID NO: 4739282 - DNA, 21 bp, Homo sapiens
actacatttagcccctctctt

SEQ ID NO: 4739283 - DNA, 23 bp, Homo sapiens
actacccccacagacctgctctg

SEQ ID NO: 4739284 - DNA, 18 bp, Homo sapiens
actaccttggttccccca

SEQ ID NO: 4739285 - DNA, 18 bp, Homo sapiens
actacggaatagttggct

SEQ ID NO: 4739286 - DNA, 14 bp, Homo sapiens
actagaacctggag

SEQ ID NO: 4739287 - DNA, 17 bp, Homo sapiens
actagaactgaattttg

SEQ ID NO: 4739288 - DNA, 18 bp, Homo sapiens
actagaactgaattttgt

SEQ ID NO: 4739289 - DNA, 23 bp, Homo sapiens
actagaactgaattttgtcttta

SEQ ID NO: 4739290 - DNA, 19 bp, Homo sapiens
actagactcccaagctgga

SEQ ID NO: 4739291 - DNA, 21 bp, Homo sapiens
actagagcagccctggagtca

SEQ ID NO: 4739292 - DNA, 14 bp, Homo sapiens
actagctatggtgt

SEQ ID NO: 4739293 - DNA, 16 bp, Homo sapiens
actagggtcctgggga

SEQ ID NO: 4739294 - DNA, 17 bp, Homo sapiens
actatagcctaggtgac

SEQ ID NO: 4739295 - DNA, 20 bp, Homo sapiens
actatagcctaggtgacaga

SEQ ID NO: 4739296 - DNA, 22 bp, Homo sapiens
actatagcctaggtgacagagt

SEQ ID NO: 4739297 - DNA, 20 bp, Homo sapiens
actatcagcccaagatgctt

SEQ ID NO: 4739298 - DNA, 17 bp, Homo sapiens
actatcccggctgccct

SEQ ID NO: 4739299 - DNA, 15 bp, Homo sapiens
actatgatttggaaa

SEQ ID NO: 4739300 - DNA, 15 bp, Homo sapiens
actatgcacactttt

SEQ ID NO: 4739301 - DNA, 19 bp, Homo sapiens
actatgcgtggctggaacc

SEQ ID NO: 4739302 - DNA, 14 bp, Homo sapiens
actatgcgttttta

SEQ ID NO: 4739303 - DNA, 18 bp, Homo sapiens
actatgtaaaaataacct

SEQ ID NO: 4739304 - DNA, 15 bp, Homo sapiens
actatgttgcccagg

SEQ ID NO: 4739305 - DNA, 17 bp, Homo sapiens
actattgcttgcacaaa

SEQ ID NO: 4739306 - DNA, 23 bp, Homo sapiens
actattgtgctcagagacactgt

SEQ ID NO: 4739307 - DNA, 16 bp, Homo sapiens
actatttgcagaggct

SEQ ID NO: 4739308 - DNA, 21 bp, Homo sapiens
actcaatattttccatgaaaa

SEQ ID NO: 4739309 - DNA, 22 bp, Homo sapiens
actcaatattttccatgaaaat

SEQ ID NO: 4739310 - DNA, 23 bp, Homo sapiens
actcaatattttccatgaaaatg

SEQ ID NO: 4739311 - DNA, 16 bp, Homo sapiens
actcaatttctcccca

SEQ ID NO: 4739312 - DNA, 16 bp, Homo sapiens
actcacatggctatgt

SEQ ID NO: 4739313 - DNA, 20 bp, Homo sapiens
actcacatttattctgctca

SEQ ID NO: 4739314 - DNA, 21 bp, Homo sapiens
actcacatttattctgctcac

SEQ ID NO: 4739315 - DNA, 15 bp, Homo sapiens
actcacattttctca

SEQ ID NO: 4739316 - DNA, 14 bp, Homo sapiens
actcaccatctgtg

SEQ ID NO: 4739317 - DNA, 20 bp, Homo sapiens
actcacctcccccatctctt

SEQ ID NO: 4739318 - DNA, 19 bp, Homo sapiens
actcacctggggctgctgg

SEQ ID NO: 4739319 - DNA, 13 bp, Homo sapiens
actcagaaattca

SEQ ID NO: 4739320 - DNA, 14 bp, Homo sapiens
actcagctccccag

SEQ ID NO: 4739321 - DNA, 18 bp, Homo sapiens
actcaggaacttttgtta

SEQ ID NO: 4739322 - DNA, 13 bp, Homo sapiens
actcagttattac

SEQ ID NO: 4739323 - DNA, 15 bp, Homo sapiens
actcatacatctggc

SEQ ID NO: 4739324 - DNA, 20 bp, Homo sapiens
actcattaattcaatgaaat

SEQ ID NO: 4739325 - DNA, 16 bp, Homo sapiens
actcattgacctgagg

SEQ ID NO: 4739326 - DNA, 17 bp, Homo sapiens
actcattgacctgaggc

SEQ ID NO: 4739327 - DNA, 12 bp, Homo sapiens
actccacctcaa

SEQ ID NO: 4739328 - DNA, 18 bp, Homo sapiens
actccacgcagctggcag

SEQ ID NO: 4739329 - DNA, 20 bp, Homo sapiens
actccacgcagctggcagag

SEQ ID NO: 4739330 - DNA, 14 bp, Homo sapiens
actccaggaagaag

SEQ ID NO: 4739331 - DNA, 16 bp, Homo sapiens
actccaggatttataa

SEQ ID NO: 4739332 - DNA, 21 bp, Homo sapiens
actccaggatttataaagcaa

SEQ ID NO: 4739333 - DNA, 20 bp, Homo sapiens
actccagttaaaaaaaattt

SEQ ID NO: 4739334 - DNA, 22 bp, Homo sapiens
actcccatctgtgaaaggaaag

SEQ ID NO: 4739335 - DNA, 18 bp, Homo sapiens
actccctgccccccagcc

SEQ ID NO: 4739336 - DNA, 13 bp, Homo sapiens
actcccttcccat

SEQ ID NO: 4739337 - DNA, 14 bp, Homo sapiens
actccctttaaaga

SEQ ID NO: 4739338 - DNA, 16 bp, Homo sapiens
actcctacacctaact

SEQ ID NO: 4739339 - DNA, 22 bp, Homo sapiens
actcctactgcttcctctgaat

SEQ ID NO: 4739340 - DNA, 13 bp, Homo sapiens
actcctaggcagg

SEQ ID NO: 4739341 - DNA, 12 bp, Homo sapiens
actcctgcaggc

SEQ ID NO: 4739342 - DNA, 19 bp, Homo sapiens
actcctgcaggcagccagg

SEQ ID NO: 4739343 - DNA, 11 bp, Homo sapiens
actcctggcct

SEQ ID NO: 4739344 - DNA, 13 bp, Homo sapiens
actcctggcctca

SEQ ID NO: 4739345 - DNA, 23 bp, Homo sapiens
actccttctgccagttccctccc

SEQ ID NO: 4739346 - DNA, 13 bp, Homo sapiens
actctaaaatatg

SEQ ID NO: 4739347 - DNA, 14 bp, Homo sapiens
actctaaaatatgg

SEQ ID NO: 4739348 - DNA, 15 bp, Homo sapiens
actctaaaattataa

SEQ ID NO: 4739349 - DNA, 16 bp, Homo sapiens
actctaattggtcatt

SEQ ID NO: 4739350 - DNA, 14 bp, Homo sapiens
actctcagtctctg

SEQ ID NO: 4739351 - DNA, 12 bp, Homo sapiens
actctcctctgc

SEQ ID NO: 4739352 - DNA, 13 bp, Homo sapiens
actctcctctgct

SEQ ID NO: 4739353 - DNA, 14 bp, Homo sapiens
actctcctctgctg

SEQ ID NO: 4739354 - DNA, 19 bp, Homo sapiens
actctcgcacacacagtga

SEQ ID NO: 4739355 - DNA, 13 bp, Homo sapiens
actctgcagcctc

SEQ ID NO: 4739356 - DNA, 18 bp, Homo sapiens
actctgctgaatgtaaaa

SEQ ID NO: 4739357 - DNA, 21 bp, Homo sapiens
actctgctgaatgtaaaagaa

SEQ ID NO: 4739358 - DNA, 22 bp, Homo sapiens
actctgctgaatgtaaaagaaa

SEQ ID NO: 4739359 - DNA, 19 bp, Homo sapiens
actctggcagctcagagag

SEQ ID NO: 4739360 - DNA, 20 bp, Homo sapiens
actctggcagctcagagagg

SEQ ID NO: 4739361 - DNA, 13 bp, Homo sapiens
actctgtgcccat

SEQ ID NO: 4739362 - DNA, 15 bp, Homo sapiens
actctgtgcccatgg

SEQ ID NO: 4739363 - DNA, 23 bp, Homo sapiens
actctgtgcccatgggcactgct

SEQ ID NO: 4739364 - DNA, 19 bp, Homo sapiens
actctgtgtaatagaataa

SEQ ID NO: 4739365 - DNA, 19 bp, Homo sapiens
actcttgtattgctccatt

SEQ ID NO: 4739366 - DNA, 20 bp, Homo sapiens
actcttgtattgctccattt

SEQ ID NO: 4739367 - DNA, 16 bp, Homo sapiens
actctttgagaaacaa

SEQ ID NO: 4739368 - DNA, 20 bp, Homo sapiens
actctttttgtacctggtga

SEQ ID NO: 4739369 - DNA, 23 bp, Homo sapiens
actgaaatgagcatgcattttct

SEQ ID NO: 4739370 - DNA, 16 bp, Homo sapiens
actgaactttgctgag

SEQ ID NO: 4739371 - DNA, 19 bp, Homo sapiens
actgaagaaatctttccag

SEQ ID NO: 4739372 - DNA, 21 bp, Homo sapiens
actgaagaaatctttccagtt

SEQ ID NO: 4739373 - DNA, 15 bp, Homo sapiens
actgaagatattcca

SEQ ID NO: 4739374 - DNA, 16 bp, Homo sapiens
actgaatacttgaagt

SEQ ID NO: 4739375 - DNA, 21 bp, Homo sapiens
actgaatacttgaagtaggaa

SEQ ID NO: 4739376 - DNA, 20 bp, Homo sapiens
actgaccaatattgtacagt

SEQ ID NO: 4739377 - DNA, 15 bp, Homo sapiens
actgagacagcccgg

SEQ ID NO: 4739378 - DNA, 22 bp, Homo sapiens
actgagacagcccgggctctgc

SEQ ID NO: 4739379 - DNA, 19 bp, Homo sapiens
actgagataccagcgagga

SEQ ID NO: 4739380 - DNA, 12 bp, Homo sapiens
actgagatgttt

SEQ ID NO: 4739381 - DNA, 17 bp, Homo sapiens
actgagatgttttacca

SEQ ID NO: 4739382 - DNA, 13 bp, Homo sapiens
actgagcatctcc

SEQ ID NO: 4739383 - DNA, 12 bp, Homo sapiens
actgagggcagt

SEQ ID NO: 4739384 - DNA, 16 bp, Homo sapiens
actgatcatatttgtg

SEQ ID NO: 4739385 - DNA, 23 bp, Homo sapiens
actgatgggcaacccccagcctg

SEQ ID NO: 4739386 - DNA, 20 bp, Homo sapiens
actgatgtatgaggaatttc

SEQ ID NO: 4739387 - DNA, 15 bp, Homo sapiens
actgatttcagagtg

SEQ ID NO: 4739388 - DNA, 16 bp, Homo sapiens
actgatttttaagtca

SEQ ID NO: 4739389 - DNA, 13 bp, Homo sapiens
actgcaacctccg

SEQ ID NO: 4739390 - DNA, 15 bp, Homo sapiens
actgcaacttgtgaa

SEQ ID NO: 4739391 - DNA, 16 bp, Homo sapiens
actgcaacttgtgaac

SEQ ID NO: 4739392 - DNA, 15 bp, Homo sapiens
actgcaccccctcct

SEQ ID NO: 4739393 - DNA, 22 bp, Homo sapiens
actgcaccccctcctgctgcag

SEQ ID NO: 4739394 - DNA, 21 bp, Homo sapiens
actgcactatagcctaggtga

SEQ ID NO: 4739395 - DNA, 20 bp, Homo sapiens
actgcagcttgagtttttag

SEQ ID NO: 4739396 - DNA, 21 bp, Homo sapiens
actgcattttgtagcctctct

SEQ ID NO: 4739397 - DNA, 15 bp, Homo sapiens
actgccgtaatttaa

SEQ ID NO: 4739398 - DNA, 17 bp, Homo sapiens
actgccgtaatttaact

SEQ ID NO: 4739399 - DNA, 13 bp, Homo sapiens
actgcctttgacc

SEQ ID NO: 4739400 - DNA, 12 bp, Homo sapiens
actgctgggtgg

SEQ ID NO: 4739401 - DNA, 13 bp, Homo sapiens
actgctgggtggc

SEQ ID NO: 4739402 - DNA, 18 bp, Homo sapiens
actgctgggtggcccatc

SEQ ID NO: 4739403 - DNA, 19 bp, Homo sapiens
actgctgggtggcccatcc

SEQ ID NO: 4739404 - DNA, 21 bp, Homo sapiens
actgcttccagtgaggctctg

SEQ ID NO: 4739405 - DNA, 16 bp, Homo sapiens
actgcttgtgttttta

SEQ ID NO: 4739406 - DNA, 18 bp, Homo sapiens
actgcttgtgtttttaac

SEQ ID NO: 4739407 - DNA, 19 bp, Homo sapiens
actgcttttcattagcagt

SEQ ID NO: 4739408 - DNA, 14 bp, Homo sapiens
actggaagcacagc

SEQ ID NO: 4739409 - DNA, 16 bp, Homo sapiens
actggaagcacagctt

SEQ ID NO: 4739410 - DNA, 17 bp, Homo sapiens
actggaagcacagcttc

SEQ ID NO: 4739411 - DNA, 22 bp, Homo sapiens
actggaggggtcatccttgccc

SEQ ID NO: 4739412 - DNA, 19 bp, Homo sapiens
actggcctcgcctggcctg

SEQ ID NO: 4739413 - DNA, 19 bp, Homo sapiens
actggctgcctccactccc

SEQ ID NO: 4739414 - DNA, 21 bp, Homo sapiens
actggctgcctccactcccac

SEQ ID NO: 4739415 - DNA, 16 bp, Homo sapiens
actgggaagtgactta

SEQ ID NO: 4739416 - DNA, 15 bp, Homo sapiens
actgggactttgtaa

SEQ ID NO: 4739417 - DNA, 16 bp, Homo sapiens
actgggccctgcctct

SEQ ID NO: 4739418 - DNA, 17 bp, Homo sapiens
actgggtacttgtggac

SEQ ID NO: 4739419 - DNA, 18 bp, Homo sapiens
actgggtacttgtggaca

SEQ ID NO: 4739420 - DNA, 19 bp, Homo sapiens
actgggtacttgtggacac

SEQ ID NO: 4739421 - DNA, 20 bp, Homo sapiens
actgggtacttgtggacaca

SEQ ID NO: 4739422 - DNA, 18 bp, Homo sapiens
actgggttggaagaaata

SEQ ID NO: 4739423 - DNA, 17 bp, Homo sapiens
actggtctcaggccaag

SEQ ID NO: 4739424 - DNA, 22 bp, Homo sapiens
actggtgttatcaccgtgggct

SEQ ID NO: 4739425 - DNA, 14 bp, Homo sapiens
actggttgtatatt

SEQ ID NO: 4739426 - DNA, 13 bp, Homo sapiens
actgtaaagatgt

SEQ ID NO: 4739427 - DNA, 15 bp, Homo sapiens
actgtataaatagga

SEQ ID NO: 4739428 - DNA, 20 bp, Homo sapiens
actgtataaataggagagga

SEQ ID NO: 4739429 - DNA, 21 bp, Homo sapiens
actgtataaataggagaggat

SEQ ID NO: 4739430 - DNA, 14 bp, Homo sapiens
actgtatattcagg

SEQ ID NO: 4739431 - DNA, 16 bp, Homo sapiens
actgtatggaaacact

SEQ ID NO: 4739432 - DNA, 21 bp, Homo sapiens
actgtatggaaacactgattt

SEQ ID NO: 4739433 - DNA, 22 bp, Homo sapiens
actgtatggaaacactgatttt

SEQ ID NO: 4739434 - DNA, 14 bp, Homo sapiens
actgtcataatggt

SEQ ID NO: 4739435 - DNA, 17 bp, Homo sapiens
actgtcctgctccacag

SEQ ID NO: 4739436 - DNA, 18 bp, Homo sapiens
actgtcctgctccacagt

SEQ ID NO: 4739437 - DNA, 19 bp, Homo sapiens
actgtcctgctccacagtg

SEQ ID NO: 4739438 - DNA, 14 bp, Homo sapiens
actgtgacaggcag

SEQ ID NO: 4739439 - DNA, 20 bp, Homo sapiens
actgtgcacatctgtgtctt

SEQ ID NO: 4739440 - DNA, 17 bp, Homo sapiens
actgtgccatgtgccag

SEQ ID NO: 4739441 - DNA, 14 bp, Homo sapiens
actgtgctcagggc

SEQ ID NO: 4739442 - DNA, 22 bp, Homo sapiens
actgtgctgagtctgaaggctg

SEQ ID NO: 4739443 - DNA, 20 bp, Homo sapiens
actgtggaagtccctcagag

SEQ ID NO: 4739444 - DNA, 12 bp, Homo sapiens
actgtggaggaa

SEQ ID NO: 4739445 - DNA, 17 bp, Homo sapiens
actgtggaggaaggatt

SEQ ID NO: 4739446 - DNA, 22 bp, Homo sapiens
actgtggaggaaggattgtaaa

SEQ ID NO: 4739447 - DNA, 23 bp, Homo sapiens
actgtggaggaaggattgtaaaa

SEQ ID NO: 4739448 - DNA, 17 bp, Homo sapiens
actgttaatagttcagg

SEQ ID NO: 4739449 - DNA, 13 bp, Homo sapiens
actgttcaagagc

SEQ ID NO: 4739450 - DNA, 15 bp, Homo sapiens
actgttctctgccct

SEQ ID NO: 4739451 - DNA, 16 bp, Homo sapiens
actgttctctgccctc

SEQ ID NO: 4739452 - DNA, 17 bp, Homo sapiens
actgttctctgccctcc

SEQ ID NO: 4739453 - DNA, 11 bp, Homo sapiens
actgttgcacg

SEQ ID NO: 4739454 - DNA, 14 bp, Homo sapiens
actgttgcacgtgt

SEQ ID NO: 4739455 - DNA, 18 bp, Homo sapiens
actgttgcacgtgtgttt

SEQ ID NO: 4739456 - DNA, 13 bp, Homo sapiens
actgttgcccagg

SEQ ID NO: 4739457 - DNA, 23 bp, Homo sapiens
actgtttggaaattgattttgaa

SEQ ID NO: 4739458 - DNA, 18 bp, Homo sapiens
actgtttgtcttctcccc

SEQ ID NO: 4739459 - DNA, 19 bp, Homo sapiens
actgtttttctctaatgct

SEQ ID NO: 4739460 - DNA, 10 bp, Homo sapiens
acttaaacat

SEQ ID NO: 4739461 - DNA, 23 bp, Homo sapiens
acttaaatttggtttgttaattc

SEQ ID NO: 4739462 - DNA, 19 bp, Homo sapiens
acttaacccagattttatt

SEQ ID NO: 4739463 - DNA, 24 bp, Homo sapiens
acttacaccagtttgactgtgcta

SEQ ID NO: 4739464 - DNA, 16 bp, Homo sapiens
acttacatatctgact

SEQ ID NO: 4739465 - DNA, 15 bp, Homo sapiens
acttacatcatgtgt

SEQ ID NO: 4739466 - DNA, 22 bp, Homo sapiens
acttattaatctgtatgaagat

SEQ ID NO: 4739467 - DNA, 12 bp, Homo sapiens
acttattagcag

SEQ ID NO: 4739468 - DNA, 13 bp, Homo sapiens
acttattgaatat

SEQ ID NO: 4739469 - DNA, 15 bp, Homo sapiens
acttcaaaaactaaa

SEQ ID NO: 4739470 - DNA, 15 bp, Homo sapiens
acttcaggggctgcc

SEQ ID NO: 4739471 - DNA, 19 bp, Homo sapiens
acttcaggggctgcccgct

SEQ ID NO: 4739472 - DNA, 22 bp, Homo sapiens
acttcattttttaaaaaatctg

SEQ ID NO: 4739473 - DNA, 16 bp, Homo sapiens
acttccaagtcattct

SEQ ID NO: 4739474 - DNA, 13 bp, Homo sapiens
acttccccttcct

SEQ ID NO: 4739475 - DNA, 22 bp, Homo sapiens
acttccctgacactgcggggct

SEQ ID NO: 4739476 - DNA, 13 bp, Homo sapiens
acttccctgggca

SEQ ID NO: 4739477 - DNA, 17 bp, Homo sapiens
acttcctcccctcgccc

SEQ ID NO: 4739478 - DNA, 13 bp, Homo sapiens
acttcgtgggatc

SEQ ID NO: 4739479 - DNA, 22 bp, Homo sapiens
acttcgtgggatctgcccctcc

SEQ ID NO: 4739480 - DNA, 14 bp, Homo sapiens
acttctcaggaaat

SEQ ID NO: 4739481 - DNA, 18 bp, Homo sapiens
acttctccaccctgctct

SEQ ID NO: 4739482 - DNA, 16 bp, Homo sapiens
acttctgggtggggca

SEQ ID NO: 4739483 - DNA, 17 bp, Homo sapiens
acttctgggtggggcag

SEQ ID NO: 4739484 - DNA, 21 bp, Homo sapiens
acttctgtaattgtgtggatt

SEQ ID NO: 4739485 - DNA, 20 bp, Homo sapiens
acttcttcagagctgacaca

SEQ ID NO: 4739486 - DNA, 12 bp, Homo sapiens
acttctttcact

SEQ ID NO: 4739487 - DNA, 15 bp, Homo sapiens
acttgatatttcctt

SEQ ID NO: 4739488 - DNA, 23 bp, Homo sapiens
acttgcaaaaagggtcagtatgg

SEQ ID NO: 4739489 - DNA, 19 bp, Homo sapiens
acttgcagactctacagag

SEQ ID NO: 4739490 - DNA, 14 bp, Homo sapiens
acttgcctatctga

SEQ ID NO: 4739491 - DNA, 16 bp, Homo sapiens
acttgctggctgtgaa

SEQ ID NO: 4739492 - DNA, 18 bp, Homo sapiens
acttggcatcagctggcg

SEQ ID NO: 4739493 - DNA, 18 bp, Homo sapiens
acttgggccatagctcct

SEQ ID NO: 4739494 - DNA, 19 bp, Homo sapiens
acttggggcctctgacgcc

SEQ ID NO: 4739495 - DNA, 18 bp, Homo sapiens
acttgtaaaggaatttaa

SEQ ID NO: 4739496 - DNA, 18 bp, Homo sapiens
acttgtctttggaccctg

SEQ ID NO: 4739497 - DNA, 21 bp, Homo sapiens
acttgtctttggaccctgagg

SEQ ID NO: 4739498 - DNA, 16 bp, Homo sapiens
acttgtgctttaccaa

SEQ ID NO: 4739499 - DNA, 17 bp, Homo sapiens
acttgttcattctgtga

SEQ ID NO: 4739500 - DNA, 21 bp, Homo sapiens
acttgttgattaatggaaatg

SEQ ID NO: 4739501 - DNA, 18 bp, Homo sapiens
acttgttgtttaatgttt

SEQ ID NO: 4739502 - DNA, 16 bp, Homo sapiens
actttaaaaggattaa

SEQ ID NO: 4739503 - DNA, 19 bp, Homo sapiens
actttaaaaggattaatct

SEQ ID NO: 4739504 - DNA, 16 bp, Homo sapiens
actttaccacccccac

SEQ ID NO: 4739505 - DNA, 17 bp, Homo sapiens
actttcatttttttcca

SEQ ID NO: 4739506 - DNA, 15 bp, Homo sapiens
actttccatttggta

SEQ ID NO: 4739507 - DNA, 16 bp, Homo sapiens
actttcgaaatttcat

SEQ ID NO: 4739508 - DNA, 17 bp, Homo sapiens
actttcgaaatttcatt

SEQ ID NO: 4739509 - DNA, 12 bp, Homo sapiens
actttgaaggac

SEQ ID NO: 4739510 - DNA, 14 bp, Homo sapiens
actttgacagtgtt

SEQ ID NO: 4739511 - DNA, 18 bp, Homo sapiens
actttgacagtgttttta

SEQ ID NO: 4739512 - DNA, 19 bp, Homo sapiens
actttgagggtgtatattt

SEQ ID NO: 4739513 - DNA, 13 bp, Homo sapiens
actttggaaagac

SEQ ID NO: 4739514 - DNA, 21 bp, Homo sapiens
actttgttagtttctccaagc

SEQ ID NO: 4739515 - DNA, 16 bp, Homo sapiens
actttgttctggctct

SEQ ID NO: 4739516 - DNA, 19 bp, Homo sapiens
actttgttctggctcttcc

SEQ ID NO: 4739517 - DNA, 21 bp, Homo sapiens
acttttaaagaatttctttat

SEQ ID NO: 4739518 - DNA, 18 bp, Homo sapiens
acttttctcaatattaag

SEQ ID NO: 4739519 - DNA, 22 bp, Homo sapiens
acttttgaagaacaaaaggctt

SEQ ID NO: 4739520 - DNA, 15 bp, Homo sapiens
acttttgccctttga

SEQ ID NO: 4739521 - DNA, 22 bp, Homo sapiens
actttttaaacagtgtttatga

SEQ ID NO: 4739522 - DNA, 12 bp, Homo sapiens
actttttgcagc

SEQ ID NO: 4739523 - DNA, 13 bp, Homo sapiens
actttttgcagct

SEQ ID NO: 4739524 - DNA, 13 bp, Homo sapiens
acttttttccaaa

SEQ ID NO: 4739525 - DNA, 19 bp, Homo sapiens
actttttttggaagttatt

SEQ ID NO: 4739526 - DNA, 14 bp, Homo sapiens
agaaaacaatggaa

SEQ ID NO: 4739527 - DNA, 23 bp, Homo sapiens
agaaaacaattgttctgggtgat

SEQ ID NO: 4739528 - DNA, 15 bp, Homo sapiens
agaaaatgaatttga

SEQ ID NO: 4739529 - DNA, 20 bp, Homo sapiens
agaaaatgatgagtttttat

SEQ ID NO: 4739530 - DNA, 21 bp, Homo sapiens
agaaaatgatgagtttttatg

SEQ ID NO: 4739531 - DNA, 14 bp, Homo sapiens
agaaaatgtgtctg

SEQ ID NO: 4739532 - DNA, 17 bp, Homo sapiens
agaaaattaattatatt

SEQ ID NO: 4739533 - DNA, 22 bp, Homo sapiens
agaaaattttttttcaaaaatg

SEQ ID NO: 4739534 - DNA, 13 bp, Homo sapiens
agaaacaaagatg

SEQ ID NO: 4739535 - DNA, 18 bp, Homo sapiens
agaaacaacaatttctac

SEQ ID NO: 4739536 - DNA, 17 bp, Homo sapiens
agaaacaccctcacact

SEQ ID NO: 4739537 - DNA, 15 bp, Homo sapiens
agaaacattgaagat

SEQ ID NO: 4739538 - DNA, 15 bp, Homo sapiens
agaaactgcagggaa

SEQ ID NO: 4739539 - DNA, 23 bp, Homo sapiens
agaaagaccatgcatttaaagta

SEQ ID NO: 4739540 - DNA, 13 bp, Homo sapiens
agaaagatatcta

SEQ ID NO: 4739541 - DNA, 23 bp, Homo sapiens
agaaagtacttctccaccctgct

SEQ ID NO: 4739542 - DNA, 19 bp, Homo sapiens
agaaagtggaaaacaagga

SEQ ID NO: 4739543 - DNA, 20 bp, Homo sapiens
agaaagttattcttggtact

SEQ ID NO: 4739544 - DNA, 16 bp, Homo sapiens
agaaatagaattataa

SEQ ID NO: 4739545 - DNA, 19 bp, Homo sapiens
agaaatagctccgtggagc

SEQ ID NO: 4739546 - DNA, 18 bp, Homo sapiens
agaaatcgccttatgaga

SEQ ID NO: 4739547 - DNA, 20 bp, Homo sapiens
agaaatcgccttatgagaac

SEQ ID NO: 4739548 - DNA, 18 bp, Homo sapiens
agaaatgtagatgatatg

SEQ ID NO: 4739549 - DNA, 20 bp, Homo sapiens
agaaatgtgtcaatgtaaag

SEQ ID NO: 4739550 - DNA, 18 bp, Homo sapiens
agaaattacctgtggata

SEQ ID NO: 4739551 - DNA, 16 bp, Homo sapiens
agaacaaagtgagaca

SEQ ID NO: 4739552 - DNA, 15 bp, Homo sapiens
agaacaatgtgctat

SEQ ID NO: 4739553 - DNA, 21 bp, Homo sapiens
agaacagtgtttgatttttat

SEQ ID NO: 4739554 - DNA, 18 bp, Homo sapiens
agaacatctgtcctgtga

SEQ ID NO: 4739555 - DNA, 22 bp, Homo sapiens
agaacatggtgtgtgtctctga

SEQ ID NO: 4739556 - DNA, 21 bp, Homo sapiens
agaacatttaataatgtatgt

SEQ ID NO: 4739557 - DNA, 20 bp, Homo sapiens
agaaccaggcaacttgggaa

SEQ ID NO: 4739558 - DNA, 14 bp, Homo sapiens
agaaccatttgcaa

SEQ ID NO: 4739559 - DNA, 16 bp, Homo sapiens
agaacctagaagggct

SEQ ID NO: 4739560 - DNA, 17 bp, Homo sapiens
agaacctggagagctag

SEQ ID NO: 4739561 - DNA, 12 bp, Homo sapiens
agaacctggagg

SEQ ID NO: 4739562 - DNA, 19 bp, Homo sapiens
agaacggggctcttctcat

SEQ ID NO: 4739563 - DNA, 20 bp, Homo sapiens
agaacggggctcttctcatt

SEQ ID NO: 4739564 - DNA, 17 bp, Homo sapiens
agaactaaaatgttcta

SEQ ID NO: 4739565 - DNA, 18 bp, Homo sapiens
agaactacaaacaaaatt

SEQ ID NO: 4739566 - DNA, 21 bp, Homo sapiens
agaactattgtgctcagagac

SEQ ID NO: 4739567 - DNA, 21 bp, Homo sapiens
agaactcatgacggaagagtt

SEQ ID NO: 4739568 - DNA, 24 bp, Homo sapiens
agaacttccccatacaaataagca

SEQ ID NO: 4739569 - DNA, 14 bp, Homo sapiens
agaactttcatttt

SEQ ID NO: 4739570 - DNA, 16 bp, Homo sapiens
agaactttcatttttt

SEQ ID NO: 4739571 - DNA, 18 bp, Homo sapiens
agaactttcatttttttc

SEQ ID NO: 4739572 - DNA, 15 bp, Homo sapiens
agaagaagagaggca

SEQ ID NO: 4739573 - DNA, 17 bp, Homo sapiens
agaagacaccagagcag

SEQ ID NO: 4739574 - DNA, 22 bp, Homo sapiens
agaagacaccagagcagatgca

SEQ ID NO: 4739575 - DNA, 13 bp, Homo sapiens
agaagacactgat

SEQ ID NO: 4739576 - DNA, 21 bp, Homo sapiens
agaagacactgatgggcaacc

SEQ ID NO: 4739577 - DNA, 13 bp, Homo sapiens
agaagagaggcat

SEQ ID NO: 4739578 - DNA, 24 bp, Homo sapiens
agaagagcgagagatcaaagatga

SEQ ID NO: 4739579 - DNA, 17 bp, Homo sapiens
agaagatcctaaaacaa

SEQ ID NO: 4739580 - DNA, 18 bp, Homo sapiens
agaagatgaatgagcaaa

SEQ ID NO: 4739581 - DNA, 12 bp, Homo sapiens
agaagcagctct

SEQ ID NO: 4739582 - DNA, 13 bp, Homo sapiens
agaagcagctctt

SEQ ID NO: 4739583 - DNA, 17 bp, Homo sapiens
agaagcattccttcttt

SEQ ID NO: 4739584 - DNA, 18 bp, Homo sapiens
agaagcccaggaaaggct

SEQ ID NO: 4739585 - DNA, 23 bp, Homo sapiens
agaagcccaggaaaggctccagg

SEQ ID NO: 4739586 - DNA, 11 bp, Homo sapiens
agaagcctgca

SEQ ID NO: 4739587 - DNA, 18 bp, Homo sapiens
agaagctaaaacctgagc

SEQ ID NO: 4739588 - DNA, 22 bp, Homo sapiens
agaagctgggactcattcacat

SEQ ID NO: 4739589 - DNA, 14 bp, Homo sapiens
agaagctgttgtac

SEQ ID NO: 4739590 - DNA, 23 bp, Homo sapiens
agaagctgttgtacatttatgat

SEQ ID NO: 4739591 - DNA, 22 bp, Homo sapiens
agaaggaggtaaaggatgaggg

SEQ ID NO: 4739592 - DNA, 19 bp, Homo sapiens
agaaggctagaaaaaaaga

SEQ ID NO: 4739593 - DNA, 21 bp, Homo sapiens
agaagggctagaacctggagg

SEQ ID NO: 4739594 - DNA, 16 bp, Homo sapiens
agaagggctgaataaa

SEQ ID NO: 4739595 - DNA, 14 bp, Homo sapiens
agaagtaagcagag

SEQ ID NO: 4739596 - DNA, 21 bp, Homo sapiens
agaagtcttctatttatttat

SEQ ID NO: 4739597 - DNA, 11 bp, Homo sapiens
agaagtgattt

SEQ ID NO: 4739598 - DNA, 18 bp, Homo sapiens
agaagtggggaccccacc

SEQ ID NO: 4739599 - DNA, 21 bp, Homo sapiens
agaataatttcatactgaaat

SEQ ID NO: 4739600 - DNA, 14 bp, Homo sapiens
agaataattttatt

SEQ ID NO: 4739601 - DNA, 17 bp, Homo sapiens
agaatcagtgtgttact

SEQ ID NO: 4739602 - DNA, 16 bp, Homo sapiens
agaatctggagagcta

SEQ ID NO: 4739603 - DNA, 19 bp, Homo sapiens
agaatctgtttcccagcag

SEQ ID NO: 4739604 - DNA, 18 bp, Homo sapiens
agaatgaaagggcccaga

SEQ ID NO: 4739605 - DNA, 13 bp, Homo sapiens
agaatgacctgcc

SEQ ID NO: 4739606 - DNA, 16 bp, Homo sapiens
agaatgtctgtacctt

SEQ ID NO: 4739607 - DNA, 16 bp, Homo sapiens
agaatgttagagtaat

SEQ ID NO: 4739608 - DNA, 21 bp, Homo sapiens
agaatgttttcaaatgttctc

SEQ ID NO: 4739609 - DNA, 16 bp, Homo sapiens
agaattatgcatctgc

SEQ ID NO: 4739610 - DNA, 15 bp, Homo sapiens
agaattttgagcagg

SEQ ID NO: 4739611 - DNA, 12 bp, Homo sapiens
agacaaatattc

SEQ ID NO: 4739612 - DNA, 16 bp, Homo sapiens
agacaaatcaaagcag

SEQ ID NO: 4739613 - DNA, 18 bp, Homo sapiens
agacacaacaactcctag

SEQ ID NO: 4739614 - DNA, 20 bp, Homo sapiens
agacacaggcccggctccag

SEQ ID NO: 4739615 - DNA, 23 bp, Homo sapiens
agacacaggcccggctccaggct

SEQ ID NO: 4739616 - DNA, 16 bp, Homo sapiens
agacacatgtccaaga

SEQ ID NO: 4739617 - DNA, 20 bp, Homo sapiens
agacacatgtccaagaagcc

SEQ ID NO: 4739618 - DNA, 21 bp, Homo sapiens
agacacatgtccaagaagccc

SEQ ID NO: 4739619 - DNA, 24 bp, Homo sapiens
agacacatgtccaagaagcccagg

SEQ ID NO: 4739620 - DNA, 15 bp, Homo sapiens
agacaccagagcaga

SEQ ID NO: 4739621 - DNA, 17 bp, Homo sapiens
agacaccgttcattcag

SEQ ID NO: 4739622 - DNA, 14 bp, Homo sapiens
agacactgttgata

SEQ ID NO: 4739623 - DNA, 18 bp, Homo sapiens
agacactgttgataaaaa

SEQ ID NO: 4739624 - DNA, 18 bp, Homo sapiens
agacagaatctcgctctg

SEQ ID NO: 4739625 - DNA, 19 bp, Homo sapiens
agacagagacctcctgcct

SEQ ID NO: 4739626 - DNA, 12 bp, Homo sapiens
agacagagctgg

SEQ ID NO: 4739627 - DNA, 23 bp, Homo sapiens
agacagagtctcactgttgccca

SEQ ID NO: 4739628 - DNA, 17 bp, Homo sapiens
agacagccccctgcccc

SEQ ID NO: 4739629 - DNA, 14 bp, Homo sapiens
agacagcccgggct

SEQ ID NO: 4739630 - DNA, 15 bp, Homo sapiens
agacagcccgggctc

SEQ ID NO: 4739631 - DNA, 18 bp, Homo sapiens
agacagcccgggctctgc

SEQ ID NO: 4739632 - DNA, 16 bp, Homo sapiens
agacaggacctaggat

SEQ ID NO: 4739633 - DNA, 23 bp, Homo sapiens
agacaggcaagcacctcctgcct

SEQ ID NO: 4739634 - DNA, 17 bp, Homo sapiens
agacagtcaccccagga

SEQ ID NO: 4739635 - DNA, 12 bp, Homo sapiens
agacagtccctg

SEQ ID NO: 4739636 - DNA, 15 bp, Homo sapiens
agacagtccctgcca

SEQ ID NO: 4739637 - DNA, 15 bp, Homo sapiens
agacagtttcttagc

SEQ ID NO: 4739638 - DNA, 18 bp, Homo sapiens
agacagtttcttagcttt

SEQ ID NO: 4739639 - DNA, 22 bp, Homo sapiens
agacagtttcttagctttttaa

SEQ ID NO: 4739640 - DNA, 20 bp, Homo sapiens
agacataacgtttttccttt

SEQ ID NO: 4739641 - DNA, 13 bp, Homo sapiens
agacatttatgtg

SEQ ID NO: 4739642 - DNA, 14 bp, Homo sapiens
agaccaaattttga

SEQ ID NO: 4739643 - DNA, 21 bp, Homo sapiens
agaccaaattttgaggtcttt

SEQ ID NO: 4739644 - DNA, 19 bp, Homo sapiens
agaccagcctggccaacat

SEQ ID NO: 4739645 - DNA, 16 bp, Homo sapiens
agaccaggcaaagcaa

SEQ ID NO: 4739646 - DNA, 14 bp, Homo sapiens
agaccatccctgaa

SEQ ID NO: 4739647 - DNA, 17 bp, Homo sapiens
agaccatccctgaaggc

SEQ ID NO: 4739648 - DNA, 18 bp, Homo sapiens
agaccatccctgaaggcc

SEQ ID NO: 4739649 - DNA, 21 bp, Homo sapiens
agaccatccctgaaggccccg

SEQ ID NO: 4739650 - DNA, 14 bp, Homo sapiens
agacccggctgcgt

SEQ ID NO: 4739651 - DNA, 14 bp, Homo sapiens
agaccctctcaggc

SEQ ID NO: 4739652 - DNA, 19 bp, Homo sapiens
agaccctctcaggctgtcc

SEQ ID NO: 4739653 - DNA, 19 bp, Homo sapiens
agaccctgccctgtgggcc

SEQ ID NO: 4739654 - DNA, 21 bp, Homo sapiens
agaccctgccctgtgggcccc

SEQ ID NO: 4739655 - DNA, 23 bp, Homo sapiens
agaccctgccctgtgggccccca

SEQ ID NO: 4739656 - DNA, 20 bp, Homo sapiens
agacccttgtggtcccaccc

SEQ ID NO: 4739657 - DNA, 13 bp, Homo sapiens
agacctgcatttg

SEQ ID NO: 4739658 - DNA, 23 bp, Homo sapiens
agacctgcccctcctctctgccc

SEQ ID NO: 4739659 - DNA, 12 bp, Homo sapiens
agacctgctctg

SEQ ID NO: 4739660 - DNA, 22 bp, Homo sapiens
agacctggcaaggacacagatg

SEQ ID NO: 4739661 - DNA, 16 bp, Homo sapiens
agaccttcaccaaaca

SEQ ID NO: 4739662 - DNA, 21 bp, Homo sapiens
agaccttctccttcacctttg

SEQ ID NO: 4739663 - DNA, 16 bp, Homo sapiens
agacgctgtgctgccc

SEQ ID NO: 4739664 - DNA, 20 bp, Homo sapiens
agacgctgtgctgccctgcc

SEQ ID NO: 4739665 - DNA, 21 bp, Homo sapiens
agacgctgtgctgccctgccc

SEQ ID NO: 4739666 - DNA, 18 bp, Homo sapiens
agacggagtcccaccttg

SEQ ID NO: 4739667 - DNA, 17 bp, Homo sapiens
agacgtgattttgctgt

SEQ ID NO: 4739668 - DNA, 15 bp, Homo sapiens
agactaagccagcac

SEQ ID NO: 4739669 - DNA, 17 bp, Homo sapiens
agactatattgtacaca

SEQ ID NO: 4739670 - DNA, 18 bp, Homo sapiens
agactcattcttctgtac

SEQ ID NO: 4739671 - DNA, 16 bp, Homo sapiens
agactcctgcaggcag

SEQ ID NO: 4739672 - DNA, 14 bp, Homo sapiens
agactctcttagga

SEQ ID NO: 4739673 - DNA, 18 bp, Homo sapiens
agactctgtctcaaaaaa

SEQ ID NO: 4739674 - DNA, 19 bp, Homo sapiens
agactctgtttgcttgtgt

SEQ ID NO: 4739675 - DNA, 21 bp, Homo sapiens
agactctttttgtacctggtg

SEQ ID NO: 4739676 - DNA, 22 bp, Homo sapiens
agactctttttgtacctggtga

SEQ ID NO: 4739677 - DNA, 21 bp, Homo sapiens
agactgaatagatatgaaagc

SEQ ID NO: 4739678 - DNA, 22 bp, Homo sapiens
agactgaatagatatgaaagct

SEQ ID NO: 4739679 - DNA, 20 bp, Homo sapiens
agactgctgctgaatttata

SEQ ID NO: 4739680 - DNA, 22 bp, Homo sapiens
agactgtaacttccaaataaat

SEQ ID NO: 4739681 - DNA, 14 bp, Homo sapiens
agacttggatgagg

SEQ ID NO: 4739682 - DNA, 15 bp, Homo sapiens
agactttggaaagag

SEQ ID NO: 4739683 - DNA, 14 bp, Homo sapiens
agagaaaagcaggc

SEQ ID NO: 4739684 - DNA, 18 bp, Homo sapiens
agagaaatgctaaccttg

SEQ ID NO: 4739685 - DNA, 19 bp, Homo sapiens
agagaaatgctaaccttgt

SEQ ID NO: 4739686 - DNA, 13 bp, Homo sapiens
agagaagcctgtg

SEQ ID NO: 4739687 - DNA, 18 bp, Homo sapiens
agagaatgaaagggccca

SEQ ID NO: 4739688 - DNA, 12 bp, Homo sapiens
agagacagtcac

SEQ ID NO: 4739689 - DNA, 19 bp, Homo sapiens
agagaccaggcaaagcaag

SEQ ID NO: 4739690 - DNA, 16 bp, Homo sapiens
agagactccagctggg

SEQ ID NO: 4739691 - DNA, 13 bp, Homo sapiens
agagactcctgca

SEQ ID NO: 4739692 - DNA, 18 bp, Homo sapiens
agagacttggatgaggag

SEQ ID NO: 4739693 - DNA, 16 bp, Homo sapiens
agagagaccacttttc

SEQ ID NO: 4739694 - DNA, 11 bp, Homo sapiens
agagagcaaga

SEQ ID NO: 4739695 - DNA, 19 bp, Homo sapiens
agagagcaagacgctgtgc

SEQ ID NO: 4739696 - DNA, 18 bp, Homo sapiens
agagagcttaatgataat

SEQ ID NO: 4739697 - DNA, 18 bp, Homo sapiens
agagaggacaaaataaag

SEQ ID NO: 4739698 - DNA, 21 bp, Homo sapiens
agagagggtggtgacctctgc

SEQ ID NO: 4739699 - DNA, 23 bp, Homo sapiens
agagagggtggtgacctctgcct

SEQ ID NO: 4739700 - DNA, 15 bp, Homo sapiens
agagagtttgccact

SEQ ID NO: 4739701 - DNA, 13 bp, Homo sapiens
agagatacagagg

SEQ ID NO: 4739702 - DNA, 23 bp, Homo sapiens
agagatatttaaaagacaaacac

SEQ ID NO: 4739703 - DNA, 14 bp, Homo sapiens
agagatcaaagatg

SEQ ID NO: 4739704 - DNA, 22 bp, Homo sapiens
agagatcctacttctctgagtc

SEQ ID NO: 4739705 - DNA, 23 bp, Homo sapiens
agagatgtgtgttgatactgttg

SEQ ID NO: 4739706 - DNA, 24 bp, Homo sapiens
agagatgtgtgttgatactgttgc

SEQ ID NO: 4739707 - DNA, 16 bp, Homo sapiens
agagattacctcctga

SEQ ID NO: 4739708 - DNA, 21 bp, Homo sapiens
agagattagtaaatatgtgaa

SEQ ID NO: 4739709 - DNA, 20 bp, Homo sapiens
agagattggaatgggcagct

SEQ ID NO: 4739710 - DNA, 21 bp, Homo sapiens
agagattggaatgggcagctc

SEQ ID NO: 4739711 - DNA, 21 bp, Homo sapiens
agagcaccttagacagtccct

SEQ ID NO: 4739712 - DNA, 17 bp, Homo sapiens
agagcagagaccatccc

SEQ ID NO: 4739713 - DNA, 12 bp, Homo sapiens
agagcagatgca

SEQ ID NO: 4739714 - DNA, 20 bp, Homo sapiens
agagcagcttctgccacttc

SEQ ID NO: 4739715 - DNA, 23 bp, Homo sapiens
agagcagcttctgccacttccca

SEQ ID NO: 4739716 - DNA, 19 bp, Homo sapiens
agagcagtggtaagaatag

SEQ ID NO: 4739717 - DNA, 22 bp, Homo sapiens
agagcagtttctgtcctgctgg

SEQ ID NO: 4739718 - DNA, 20 bp, Homo sapiens
agagcataatttaaaaatat

SEQ ID NO: 4739719 - DNA, 18 bp, Homo sapiens
agagcatgtgaggggtag

SEQ ID NO: 4739720 - DNA, 15 bp, Homo sapiens
agagccatacataaa

SEQ ID NO: 4739721 - DNA, 19 bp, Homo sapiens
agagccatacataaaagaa

SEQ ID NO: 4739722 - DNA, 18 bp, Homo sapiens
agagcccacgcccccact

SEQ ID NO: 4739723 - DNA, 14 bp, Homo sapiens
agagcccagaggta

SEQ ID NO: 4739724 - DNA, 16 bp, Homo sapiens
agagcccagaggtaac

SEQ ID NO: 4739725 - DNA, 22 bp, Homo sapiens
agagcccagaggtaacagaaca

SEQ ID NO: 4739726 - DNA, 19 bp, Homo sapiens
agagcccaggagctcccct

SEQ ID NO: 4739727 - DNA, 14 bp, Homo sapiens
agagcctcaaatga

SEQ ID NO: 4739728 - DNA, 17 bp, Homo sapiens
agagcctcaaatgagaa

SEQ ID NO: 4739729 - DNA, 15 bp, Homo sapiens
agagccttccagggg

SEQ ID NO: 4739730 - DNA, 22 bp, Homo sapiens
agagccttccaggggtgggaca

SEQ ID NO: 4739731 - DNA, 17 bp, Homo sapiens
agagctagaacatggag

SEQ ID NO: 4739732 - DNA, 18 bp, Homo sapiens
agagctagaacatggaga

SEQ ID NO: 4739733 - DNA, 22 bp, Homo sapiens
agagctagaacatggagagcta

SEQ ID NO: 4739734 - DNA, 19 bp, Homo sapiens
agagctagaacctggagag

SEQ ID NO: 4739735 - DNA, 22 bp, Homo sapiens
agagctagaacctggagggcta

SEQ ID NO: 4739736 - DNA, 22 bp, Homo sapiens
agagctctgacccacagcctcc

SEQ ID NO: 4739737 - DNA, 20 bp, Homo sapiens
agagctgacacaaacctgcc

SEQ ID NO: 4739738 - DNA, 13 bp, Homo sapiens
agagctgcacagg

SEQ ID NO: 4739739 - DNA, 17 bp, Homo sapiens
agagctggagcctggtg

SEQ ID NO: 4739740 - DNA, 19 bp, Homo sapiens
agagctggagcctggtgcc

SEQ ID NO: 4739741 - DNA, 19 bp, Homo sapiens
agagctgtattaagccact

SEQ ID NO: 4739742 - DNA, 15 bp, Homo sapiens
agagcttaacagtgt

SEQ ID NO: 4739743 - DNA, 21 bp, Homo sapiens
agagcttccagagctctgacc

SEQ ID NO: 4739744 - DNA, 13 bp, Homo sapiens
agagcttccctga

SEQ ID NO: 4739745 - DNA, 14 bp, Homo sapiens
agagcttggactgg

SEQ ID NO: 4739746 - DNA, 19 bp, Homo sapiens
agagcttgtaataaatact

SEQ ID NO: 4739747 - DNA, 19 bp, Homo sapiens
agaggaaatattgctgggg

SEQ ID NO: 4739748 - DNA, 20 bp, Homo sapiens
agaggaaggggccagaggct

SEQ ID NO: 4739749 - DNA, 19 bp, Homo sapiens
agaggaatttataacaaat

SEQ ID NO: 4739750 - DNA, 22 bp, Homo sapiens
agaggacttttctttgtggctt

SEQ ID NO: 4739751 - DNA, 13 bp, Homo sapiens
agaggatgagagc

SEQ ID NO: 4739752 - DNA, 14 bp, Homo sapiens
agaggatgagagcc

SEQ ID NO: 4739753 - DNA, 21 bp, Homo sapiens
agaggcagccccattctgcct

SEQ ID NO: 4739754 - DNA, 22 bp, Homo sapiens
agaggcagccccattctgcctg

SEQ ID NO: 4739755 - DNA, 22 bp, Homo sapiens
agaggcctgcctccagggctgg

SEQ ID NO: 4739756 - DNA, 21 bp, Homo sapiens
agagggacgcctgggggtgcc

SEQ ID NO: 4739757 - DNA, 22 bp, Homo sapiens
agagggagggagggctccagac

SEQ ID NO: 4739758 - DNA, 15 bp, Homo sapiens
agagggagtgacaga

SEQ ID NO: 4739759 - DNA, 16 bp, Homo sapiens
agagggcacacactgt

SEQ ID NO: 4739760 - DNA, 16 bp, Homo sapiens
agaggggacgcaggcc

SEQ ID NO: 4739761 - DNA, 18 bp, Homo sapiens
agaggggacgcaggcccc

SEQ ID NO: 4739762 - DNA, 22 bp, Homo sapiens
agaggggcctgccacctggacc

SEQ ID NO: 4739763 - DNA, 23 bp, Homo sapiens
agaggggcctgccacctggaccc

SEQ ID NO: 4739764 - DNA, 23 bp, Homo sapiens
agagggggtggcctcccaactca

SEQ ID NO: 4739765 - DNA, 18 bp, Homo sapiens
agaggtaacagaacagct

SEQ ID NO: 4739766 - DNA, 22 bp, Homo sapiens
agaggtaacagaacagcttcag

SEQ ID NO: 4739767 - DNA, 19 bp, Homo sapiens
agaggtccacaacacacag

SEQ ID NO: 4739768 - DNA, 23 bp, Homo sapiens
agagtattggtctcctctcagcc

SEQ ID NO: 4739769 - DNA, 22 bp, Homo sapiens
agagtctcactgttgcccaggc

SEQ ID NO: 4739770 - DNA, 15 bp, Homo sapiens
agagtgagactctgt

SEQ ID NO: 4739771 - DNA, 19 bp, Homo sapiens
agagtgagactctgtctca

SEQ ID NO: 4739772 - DNA, 12 bp, Homo sapiens
agagtgtagaag

SEQ ID NO: 4739773 - DNA, 22 bp, Homo sapiens
agagtgtagaagcattccttct

SEQ ID NO: 4739774 - DNA, 16 bp, Homo sapiens
agagttaagaagctgt

SEQ ID NO: 4739775 - DNA, 18 bp, Homo sapiens
agagttaagaagctgttg

SEQ ID NO: 4739776 - DNA, 20 bp, Homo sapiens
agagttaagaagctgttgta

SEQ ID NO: 4739777 - DNA, 19 bp, Homo sapiens
agagttccccatgcagaca

SEQ ID NO: 4739778 - DNA, 14 bp, Homo sapiens
agagttcgtgaaga

SEQ ID NO: 4739779 - DNA, 23 bp, Homo sapiens
agagtttgatgaggccctccaca

SEQ ID NO: 4739780 - DNA, 20 bp, Homo sapiens
agataaacagaaatgctctg

SEQ ID NO: 4739781 - DNA, 14 bp, Homo sapiens
agataaatctagta

SEQ ID NO: 4739782 - DNA, 17 bp, Homo sapiens
agataaatttgttgaat

SEQ ID NO: 4739783 - DNA, 18 bp, Homo sapiens
agataaatttgttgaata

SEQ ID NO: 4739784 - DNA, 21 bp, Homo sapiens
agataataaattgatttgtta

SEQ ID NO: 4739785 - DNA, 16 bp, Homo sapiens
agataatcttttacat

SEQ ID NO: 4739786 - DNA, 23 bp, Homo sapiens
agataatgtccttgctttacaaa

SEQ ID NO: 4739787 - DNA, 20 bp, Homo sapiens
agatacagaactctttcaaa

SEQ ID NO: 4739788 - DNA, 19 bp, Homo sapiens
agatacaggaaaagctgct

SEQ ID NO: 4739789 - DNA, 18 bp, Homo sapiens
agatatatttaagcctta

SEQ ID NO: 4739790 - DNA, 19 bp, Homo sapiens
agatatcatactgattttt

SEQ ID NO: 4739791 - DNA, 19 bp, Homo sapiens
agatatcctctgcttaaaa

SEQ ID NO: 4739792 - DNA, 16 bp, Homo sapiens
agatatttaaaagaca

SEQ ID NO: 4739793 - DNA, 21 bp, Homo sapiens
agatatttaaaagacaaacac

SEQ ID NO: 4739794 - DNA, 13 bp, Homo sapiens
agatcaaagatga

SEQ ID NO: 4739795 - DNA, 23 bp, Homo sapiens
agatcaattacttattttaggaa

SEQ ID NO: 4739796 - DNA, 14 bp, Homo sapiens
agatcacgccactg

SEQ ID NO: 4739797 - DNA, 16 bp, Homo sapiens
agatcacgccactgca

SEQ ID NO: 4739798 - DNA, 18 bp, Homo sapiens
agatcacgccactgcact

SEQ ID NO: 4739799 - DNA, 19 bp, Homo sapiens
agatccaaatgctgtgcaa

SEQ ID NO: 4739800 - DNA, 19 bp, Homo sapiens
agatcccaacatggtccta

SEQ ID NO: 4739801 - DNA, 13 bp, Homo sapiens
agatcctaaaaca

SEQ ID NO: 4739802 - DNA, 19 bp, Homo sapiens
agatcctacttctctgagt

SEQ ID NO: 4739803 - DNA, 23 bp, Homo sapiens
agatctctgctttggaaatcaca

SEQ ID NO: 4739804 - DNA, 11 bp, Homo sapiens
agatgaatgtc

SEQ ID NO: 4739805 - DNA, 17 bp, Homo sapiens
agatgaatgtcctgaaa

SEQ ID NO: 4739806 - DNA, 19 bp, Homo sapiens
agatgactacatttagccc

SEQ ID NO: 4739807 - DNA, 16 bp, Homo sapiens
agatgcaaatgtcaca

SEQ ID NO: 4739808 - DNA, 14 bp, Homo sapiens
agatgcaccagccc

SEQ ID NO: 4739809 - DNA, 22 bp, Homo sapiens
agatgcaggtttgaccaggaaa

SEQ ID NO: 4739810 - DNA, 20 bp, Homo sapiens
agatggggagggtgccctcc

SEQ ID NO: 4739811 - DNA, 22 bp, Homo sapiens
agatgggtgcttggaggaagga

SEQ ID NO: 4739812 - DNA, 22 bp, Homo sapiens
agatgggtggatcacttgaggt

SEQ ID NO: 4739813 - DNA, 16 bp, Homo sapiens
agatgtatatttgcat

SEQ ID NO: 4739814 - DNA, 12 bp, Homo sapiens
agatgtccctga

SEQ ID NO: 4739815 - DNA, 21 bp, Homo sapiens
agatgtccctgaagtcttgca

SEQ ID NO: 4739816 - DNA, 19 bp, Homo sapiens
agatgtgtgttgatactgt

SEQ ID NO: 4739817 - DNA, 21 bp, Homo sapiens
agatgtgtgttgatactgttg

SEQ ID NO: 4739818 - DNA, 18 bp, Homo sapiens
agatgttcagtcattttt

SEQ ID NO: 4739819 - DNA, 21 bp, Homo sapiens
agatgttctaagtctttccat

SEQ ID NO: 4739820 - DNA, 20 bp, Homo sapiens
agattaaaccaattataact

SEQ ID NO: 4739821 - DNA, 15 bp, Homo sapiens
agattaacactaatt

SEQ ID NO: 4739822 - DNA, 14 bp, Homo sapiens
agattaaggtatct

SEQ ID NO: 4739823 - DNA, 17 bp, Homo sapiens
agattagaacatttaat

SEQ ID NO: 4739824 - DNA, 22 bp, Homo sapiens
agattagaacatttaataatgt

SEQ ID NO: 4739825 - DNA, 21 bp, Homo sapiens
agattagtaaatatgtgaaga

SEQ ID NO: 4739826 - DNA, 21 bp, Homo sapiens
agattcaagttgtgtctgaaa

SEQ ID NO: 4739827 - DNA, 12 bp, Homo sapiens
agattctttccc

SEQ ID NO: 4739828 - DNA, 18 bp, Homo sapiens
agattctttcctgaggct

SEQ ID NO: 4739829 - DNA, 19 bp, Homo sapiens
agattgcaacaggctgggc

SEQ ID NO: 4739830 - DNA, 22 bp, Homo sapiens
agattggctcacactgagaatg

SEQ ID NO: 4739831 - DNA, 14 bp, Homo sapiens
agatttgggctgga

SEQ ID NO: 4739832 - DNA, 17 bp, Homo sapiens
agatttgggctggaaca

SEQ ID NO: 4739833 - DNA, 22 bp, Homo sapiens
agatttgtaacattagttttaa

SEQ ID NO: 4739834 - DNA, 19 bp, Homo sapiens
agattttctgtaaatgaag

SEQ ID NO: 4739835 - DNA, 13 bp, Homo sapiens
agatttttctcaa

SEQ ID NO: 4739836 - DNA, 17 bp, Homo sapiens
agcaaaaagatgtatat

SEQ ID NO: 4739837 - DNA, 21 bp, Homo sapiens
agcaaaaccaaatattccaga

SEQ ID NO: 4739838 - DNA, 22 bp, Homo sapiens
agcaaatgtaaaaatttaattt

SEQ ID NO: 4739839 - DNA, 13 bp, Homo sapiens
agcaacaagctat

SEQ ID NO: 4739840 - DNA, 16 bp, Homo sapiens
agcaacaagctatttt

SEQ ID NO: 4739841 - DNA, 16 bp, Homo sapiens
agcaactatcagacta

SEQ ID NO: 4739842 - DNA, 21 bp, Homo sapiens
agcaagaagatcctaaaacaa

SEQ ID NO: 4739843 - DNA, 13 bp, Homo sapiens
agcaagacgctgt

SEQ ID NO: 4739844 - DNA, 17 bp, Homo sapiens
agcaagacgctgtgctg

SEQ ID NO: 4739845 - DNA, 22 bp, Homo sapiens
agcaagacgctgtgctgccctg

SEQ ID NO: 4739846 - DNA, 14 bp, Homo sapiens
agcaagatttcaga

SEQ ID NO: 4739847 - DNA, 11 bp, Homo sapiens
agcaagctccc

SEQ ID NO: 4739848 - DNA, 16 bp, Homo sapiens
agcaaggaggctggct

SEQ ID NO: 4739849 - DNA, 17 bp, Homo sapiens
agcaaggaggctggctg

SEQ ID NO: 4739850 - DNA, 13 bp, Homo sapiens
agcaaggcacctg

SEQ ID NO: 4739851 - DNA, 16 bp, Homo sapiens
agcaaggcacctgcag

SEQ ID NO: 4739852 - DNA, 15 bp, Homo sapiens
agcaagtgagagctg

SEQ ID NO: 4739853 - DNA, 17 bp, Homo sapiens
agcaagtgagagctggg

SEQ ID NO: 4739854 - DNA, 15 bp, Homo sapiens
agcaatgctgtgaat

SEQ ID NO: 4739855 - DNA, 20 bp, Homo sapiens
agcaattctcctgcctcagc

SEQ ID NO: 4739856 - DNA, 16 bp, Homo sapiens
agcacagaccctgccc

SEQ ID NO: 4739857 - DNA, 19 bp, Homo sapiens
agcacagaccctgccctgt

SEQ ID NO: 4739858 - DNA, 21 bp, Homo sapiens
agcacagaccctgccctgtgg

SEQ ID NO: 4739859 - DNA, 24 bp, Homo sapiens
agcacagcaaggaggctggctggg

SEQ ID NO: 4739860 - DNA, 16 bp, Homo sapiens
agcacagccctcccgc

SEQ ID NO: 4739861 - DNA, 22 bp, Homo sapiens
agcacagccctcccgccccttc

SEQ ID NO: 4739862 - DNA, 21 bp, Homo sapiens
agcacagcttcatttcctgtg

SEQ ID NO: 4739863 - DNA, 15 bp, Homo sapiens
agcacatgccaggga

SEQ ID NO: 4739864 - DNA, 23 bp, Homo sapiens
agcacatgccagggaaaaagacc

SEQ ID NO: 4739865 - DNA, 13 bp, Homo sapiens
agcacatgttcat

SEQ ID NO: 4739866 - DNA, 17 bp, Homo sapiens
agcaccaagctcaaagc

SEQ ID NO: 4739867 - DNA, 13 bp, Homo sapiens
agcaccagggaag

SEQ ID NO: 4739868 - DNA, 20 bp, Homo sapiens
agcaccttagacagtccctg

SEQ ID NO: 4739869 - DNA, 19 bp, Homo sapiens
agcactagacatgtcatgg

SEQ ID NO: 4739870 - DNA, 23 bp, Homo sapiens
agcactagacatgtcatggtcct

SEQ ID NO: 4739871 - DNA, 23 bp, Homo sapiens
agcactgcacactcagttctgct

SEQ ID NO: 4739872 - DNA, 14 bp, Homo sapiens
agcactgtgctcag

SEQ ID NO: 4739873 - DNA, 15 bp, Homo sapiens
agcactgtgctcagg

SEQ ID NO: 4739874 - DNA, 16 bp, Homo sapiens
agcagaatactggtct

SEQ ID NO: 4739875 - DNA, 22 bp, Homo sapiens
agcagagaatgaaagggcccag

SEQ ID NO: 4739876 - DNA, 23 bp, Homo sapiens
agcagagaatgaaagggcccaga

SEQ ID NO: 4739877 - DNA, 15 bp, Homo sapiens
agcagagttctttgc

SEQ ID NO: 4739878 - DNA, 13 bp, Homo sapiens
agcagatgcagag

SEQ ID NO: 4739879 - DNA, 18 bp, Homo sapiens
agcagatgcagagagcca

SEQ ID NO: 4739880 - DNA, 21 bp, Homo sapiens
agcagatgcagagagccattt

SEQ ID NO: 4739881 - DNA, 16 bp, Homo sapiens
agcagatggggagggt

SEQ ID NO: 4739882 - DNA, 13 bp, Homo sapiens
agcagcaagtgtg

SEQ ID NO: 4739883 - DNA, 15 bp, Homo sapiens
agcagccacattcct

SEQ ID NO: 4739884 - DNA, 16 bp, Homo sapiens
agcagccctggagtca

SEQ ID NO: 4739885 - DNA, 19 bp, Homo sapiens
agcagccctggagtcatgc

SEQ ID NO: 4739886 - DNA, 19 bp, Homo sapiens
agcagcctccttatatttg

SEQ ID NO: 4739887 - DNA, 20 bp, Homo sapiens
agcagcttctgccacttccc

SEQ ID NO: 4739888 - DNA, 22 bp, Homo sapiens
agcagcttctgccacttcccag

SEQ ID NO: 4739889 - DNA, 23 bp, Homo sapiens
agcaggaaatgaaaatgtcttgt

SEQ ID NO: 4739890 - DNA, 16 bp, Homo sapiens
agcaggaggaggtgcc

SEQ ID NO: 4739891 - DNA, 19 bp, Homo sapiens
agcaggaggggggctgggt

SEQ ID NO: 4739892 - DNA, 21 bp, Homo sapiens
agcaggcgttcagctcactgt

SEQ ID NO: 4739893 - DNA, 16 bp, Homo sapiens
agcaggctacactgac

SEQ ID NO: 4739894 - DNA, 22 bp, Homo sapiens
agcaggctacactgacactggt

SEQ ID NO: 4739895 - DNA, 22 bp, Homo sapiens
agcaggcttctatgaaagactc

SEQ ID NO: 4739896 - DNA, 15 bp, Homo sapiens
agcagggaaacagct

SEQ ID NO: 4739897 - DNA, 17 bp, Homo sapiens
agcagggaaggctggtc

SEQ ID NO: 4739898 - DNA, 23 bp, Homo sapiens
agcagggctaccctgagctgagg

SEQ ID NO: 4739899 - DNA, 16 bp, Homo sapiens
agcaggtgctgctacc

SEQ ID NO: 4739900 - DNA, 22 bp, Homo sapiens
agcagtaaaagataaatttgtt

SEQ ID NO: 4739901 - DNA, 23 bp, Homo sapiens
agcagtcgcgagcacatgttcat

SEQ ID NO: 4739902 - DNA, 21 bp, Homo sapiens
agcagtgaatgattcagtgtt

SEQ ID NO: 4739903 - DNA, 15 bp, Homo sapiens
agcagtgcaggcaca

SEQ ID NO: 4739904 - DNA, 14 bp, Homo sapiens
agcagtggcttgct

SEQ ID NO: 4739905 - DNA, 21 bp, Homo sapiens
agcagtgtgaggccagggcag

SEQ ID NO: 4739906 - DNA, 20 bp, Homo sapiens
agcagtttctgtcctgctgg

SEQ ID NO: 4739907 - DNA, 21 bp, Homo sapiens
agcataatttaaaaatatatt

SEQ ID NO: 4739908 - DNA, 14 bp, Homo sapiens
agcatattcaggaa

SEQ ID NO: 4739909 - DNA, 16 bp, Homo sapiens
agcatattcaggaagc

SEQ ID NO: 4739910 - DNA, 20 bp, Homo sapiens
agcatcaggccaggccctct

SEQ ID NO: 4739911 - DNA, 15 bp, Homo sapiens
agcatccacctcctt

SEQ ID NO: 4739912 - DNA, 18 bp, Homo sapiens
agcatccacctccttctc

SEQ ID NO: 4739913 - DNA, 20 bp, Homo sapiens
agcatccacctccttctctg

SEQ ID NO: 4739914 - DNA, 22 bp, Homo sapiens
agcatcccaggatcgcaagagc

SEQ ID NO: 4739915 - DNA, 21 bp, Homo sapiens
agcatcccttgaccaggcctg

SEQ ID NO: 4739916 - DNA, 18 bp, Homo sapiens
agcatcctggcacccggc

SEQ ID NO: 4739917 - DNA, 17 bp, Homo sapiens
agcatcgtgatcactga

SEQ ID NO: 4739918 - DNA, 23 bp, Homo sapiens
agcatctccagcattctcagcca

SEQ ID NO: 4739919 - DNA, 21 bp, Homo sapiens
agcatctgcagtacagtctta

SEQ ID NO: 4739920 - DNA, 17 bp, Homo sapiens
agcatgaaataaaatat

SEQ ID NO: 4739921 - DNA, 13 bp, Homo sapiens
agcatggagctgg

SEQ ID NO: 4739922 - DNA, 14 bp, Homo sapiens
agcatggagctggc

SEQ ID NO: 4739923 - DNA, 22 bp, Homo sapiens
agcatggccctgctgcccctcc

SEQ ID NO: 4739924 - DNA, 23 bp, Homo sapiens
agcatggccctgctgcccctccc

SEQ ID NO: 4739925 - DNA, 20 bp, Homo sapiens
agcatgtcgtcaaagctgaa

SEQ ID NO: 4739926 - DNA, 18 bp, Homo sapiens
agcattcacaacttgttt

SEQ ID NO: 4739927 - DNA, 16 bp, Homo sapiens
agcattccttctttga

SEQ ID NO: 4739928 - DNA, 19 bp, Homo sapiens
agcattccttctttgataa

SEQ ID NO: 4739929 - DNA, 22 bp, Homo sapiens
agcattccttctttgataatgt

SEQ ID NO: 4739930 - DNA, 14 bp, Homo sapiens
agcattctcagcca

SEQ ID NO: 4739931 - DNA, 16 bp, Homo sapiens
agcattctcagccaca

SEQ ID NO: 4739932 - DNA, 22 bp, Homo sapiens
agcattgtaaaattatttcatg

SEQ ID NO: 4739933 - DNA, 20 bp, Homo sapiens
agcattttccagcactttgc

SEQ ID NO: 4739934 - DNA, 18 bp, Homo sapiens
agccaaacatcctacaag

SEQ ID NO: 4739935 - DNA, 16 bp, Homo sapiens
agccaaagttaaatgt

SEQ ID NO: 4739936 - DNA, 13 bp, Homo sapiens
agccacaggcctg

SEQ ID NO: 4739937 - DNA, 18 bp, Homo sapiens
agccacattcctgatgct

SEQ ID NO: 4739938 - DNA, 13 bp, Homo sapiens
agccaccacgccc

SEQ ID NO: 4739939 - DNA, 18 bp, Homo sapiens
agccacggccaggccaga

SEQ ID NO: 4739940 - DNA, 22 bp, Homo sapiens
agccactgcaccgggccacaga

SEQ ID NO: 4739941 - DNA, 14 bp, Homo sapiens
agccagaacctgga

SEQ ID NO: 4739942 - DNA, 22 bp, Homo sapiens
agccagcaccggaccagcctgg

SEQ ID NO: 4739943 - DNA, 23 bp, Homo sapiens
agccagcaccggaccagcctggc

SEQ ID NO: 4739944 - DNA, 16 bp, Homo sapiens
agccagcgtcctcctc

SEQ ID NO: 4739945 - DNA, 14 bp, Homo sapiens
agccaggatcatgg

SEQ ID NO: 4739946 - DNA, 20 bp, Homo sapiens
agccaggatcatggtgtaat

SEQ ID NO: 4739947 - DNA, 21 bp, Homo sapiens
agccaggccacaagacccttg

SEQ ID NO: 4739948 - DNA, 16 bp, Homo sapiens
agccagggagagccca

SEQ ID NO: 4739949 - DNA, 17 bp, Homo sapiens
agccagggagagcccag

SEQ ID NO: 4739950 - DNA, 22 bp, Homo sapiens
agccagggagagcccaggagct

SEQ ID NO: 4739951 - DNA, 11 bp, Homo sapiens
agccagggctg

SEQ ID NO: 4739952 - DNA, 12 bp, Homo sapiens
agccagggctgc

SEQ ID NO: 4739953 - DNA, 14 bp, Homo sapiens
agccagggctgcta

SEQ ID NO: 4739954 - DNA, 17 bp, Homo sapiens
agccatacataaaagaa

SEQ ID NO: 4739955 - DNA, 18 bp, Homo sapiens
agccatagagatatttaa

SEQ ID NO: 4739956 - DNA, 19 bp, Homo sapiens
agccatcccagccttggca

SEQ ID NO: 4739957 - DNA, 12 bp, Homo sapiens
agccatgggacc

SEQ ID NO: 4739958 - DNA, 17 bp, Homo sapiens
agccatgggaccaaacc

SEQ ID NO: 4739959 - DNA, 21 bp, Homo sapiens
agccatttatacctttgaaat

SEQ ID NO: 4739960 - DNA, 23 bp, Homo sapiens
agccatttatacctttgaaatat

SEQ ID NO: 4739961 - DNA, 16 bp, Homo sapiens
agccattttgtgaatg

SEQ ID NO: 4739962 - DNA, 16 bp, Homo sapiens
agcccaaagaaggaaa

SEQ ID NO: 4739963 - DNA, 13 bp, Homo sapiens
agcccaccttggc

SEQ ID NO: 4739964 - DNA, 14 bp, Homo sapiens
agcccacgccccca

SEQ ID NO: 4739965 - DNA, 14 bp, Homo sapiens
agcccacgtcctgt

SEQ ID NO: 4739966 - DNA, 13 bp, Homo sapiens
agcccacttctgc

SEQ ID NO: 4739967 - DNA, 20 bp, Homo sapiens
agcccagaggtaacagaaca

SEQ ID NO: 4739968 - DNA, 15 bp, Homo sapiens
agcccagcactgctt

SEQ ID NO: 4739969 - DNA, 19 bp, Homo sapiens
agcccaggaaaggctccag

SEQ ID NO: 4739970 - DNA, 22 bp, Homo sapiens
agcccaggaaaggctccaggag

SEQ ID NO: 4739971 - DNA, 16 bp, Homo sapiens
agccccaaaactctcc

SEQ ID NO: 4739972 - DNA, 20 bp, Homo sapiens
agccccaaaactctcctctg

SEQ ID NO: 4739973 - DNA, 15 bp, Homo sapiens
agccccaaggggtgg

SEQ ID NO: 4739974 - DNA, 12 bp, Homo sapiens
agccccacagcc

SEQ ID NO: 4739975 - DNA, 13 bp, Homo sapiens
agccccacagccc

SEQ ID NO: 4739976 - DNA, 14 bp, Homo sapiens
agccccacagccca

SEQ ID NO: 4739977 - DNA, 13 bp, Homo sapiens
agccccattcctg

SEQ ID NO: 4739978 - DNA, 19 bp, Homo sapiens
agccccattctgcctgccc

SEQ ID NO: 4739979 - DNA, 20 bp, Homo sapiens
agccccattctgcctgccca

SEQ ID NO: 4739980 - DNA, 22 bp, Homo sapiens
agccccctgccccgcaggcctg

SEQ ID NO: 4739981 - DNA, 22 bp, Homo sapiens
agccccgaggccttctctgaag

SEQ ID NO: 4739982 - DNA, 12 bp, Homo sapiens
agcccctcagac

SEQ ID NO: 4739983 - DNA, 20 bp, Homo sapiens
agcccctcagacagccccct

SEQ ID NO: 4739984 - DNA, 17 bp, Homo sapiens
agcccctggatgcagcc

SEQ ID NO: 4739985 - DNA, 16 bp, Homo sapiens
agccccttctgaccca

SEQ ID NO: 4739986 - DNA, 18 bp, Homo sapiens
agcccgggctctgcctcc

SEQ ID NO: 4739987 - DNA, 21 bp, Homo sapiens
agcccgggctctgcctcccat

SEQ ID NO: 4739988 - DNA, 16 bp, Homo sapiens
agccctagggtggaga

SEQ ID NO: 4739989 - DNA, 23 bp, Homo sapiens
agccctcacccctggttctcatc

SEQ ID NO: 4739990 - DNA, 16 bp, Homo sapiens
agccctcatcccgagc

SEQ ID NO: 4739991 - DNA, 23 bp, Homo sapiens
agccctccatctaaactgccccc

SEQ ID NO: 4739992 - DNA, 19 bp, Homo sapiens
agccctggagtcatgccaa

SEQ ID NO: 4739993 - DNA, 12 bp, Homo sapiens
agccctggctga

SEQ ID NO: 4739994 - DNA, 20 bp, Homo sapiens
agccctggctgaaggactgt

SEQ ID NO: 4739995 - DNA, 15 bp, Homo sapiens
agccctggtggcagt

SEQ ID NO: 4739996 - DNA, 16 bp, Homo sapiens
agccctggtggcagtg

SEQ ID NO: 4739997 - DNA, 22 bp, Homo sapiens
agccctggtggcagtgggagct

SEQ ID NO: 4739998 - DNA, 21 bp, Homo sapiens
agcccttagcagggaaacagc

SEQ ID NO: 4739999 - DNA, 22 bp, Homo sapiens
agcccttgggggtcctcctcca

SEQ ID NO: 4740000 - DNA, 18 bp, Homo sapiens
agccgctgcccggcgccc

SEQ ID NO: 4740001 - DNA, 22 bp, Homo sapiens
agccgctgcccggcgccctctg

SEQ ID NO: 4740002 - DNA, 22 bp, Homo sapiens
agccgctggggccagttggtcc

SEQ ID NO: 4740003 - DNA, 14 bp, Homo sapiens
agccggcactgcat

SEQ ID NO: 4740004 - DNA, 15 bp, Homo sapiens
agccggcactgcatg

SEQ ID NO: 4740005 - DNA, 21 bp, Homo sapiens
agccgggtctgcctcttctgg

SEQ ID NO: 4740006 - DNA, 22 bp, Homo sapiens
agccgggtctgcctcttctggg

SEQ ID NO: 4740007 - DNA, 13 bp, Homo sapiens
agccgtgggcccg

SEQ ID NO: 4740008 - DNA, 15 bp, Homo sapiens
agcctaggtgacaga

SEQ ID NO: 4740009 - DNA, 18 bp, Homo sapiens
agcctcacagtccttacc

SEQ ID NO: 4740010 - DNA, 15 bp, Homo sapiens
agcctcagcatcctg

SEQ ID NO: 4740011 - DNA, 20 bp, Homo sapiens
agcctcagcatcctggcacc

SEQ ID NO: 4740012 - DNA, 23 bp, Homo sapiens
agcctcagcatcctggcacccgg

SEQ ID NO: 4740013 - DNA, 23 bp, Homo sapiens
agcctcagctctcagttgcagcc

SEQ ID NO: 4740014 - DNA, 19 bp, Homo sapiens
agcctcagtctccctccct

SEQ ID NO: 4740015 - DNA, 20 bp, Homo sapiens
agcctcagtctccctccctt

SEQ ID NO: 4740016 - DNA, 15 bp, Homo sapiens
agcctcatgctctga

SEQ ID NO: 4740017 - DNA, 16 bp, Homo sapiens
agcctcccaaagtgct

SEQ ID NO: 4740018 - DNA, 20 bp, Homo sapiens
agcctcccaaagtgctggga

SEQ ID NO: 4740019 - DNA, 21 bp, Homo sapiens
agcctcccaaagtgctgggat

SEQ ID NO: 4740020 - DNA, 17 bp, Homo sapiens
agcctcccctgccaggg

SEQ ID NO: 4740021 - DNA, 20 bp, Homo sapiens
agcctcccctgccagggcag

SEQ ID NO: 4740022 - DNA, 18 bp, Homo sapiens
agcctcccgaatagctgg

SEQ ID NO: 4740023 - DNA, 20 bp, Homo sapiens
agcctcccgaatagctggga

SEQ ID NO: 4740024 - DNA, 22 bp, Homo sapiens
agcctcccgaatagctgggact

SEQ ID NO: 4740025 - DNA, 21 bp, Homo sapiens
agcctcgatgtcctcctctgt

SEQ ID NO: 4740026 - DNA, 20 bp, Homo sapiens
agcctctagggacccctcct

SEQ ID NO: 4740027 - DNA, 11 bp, Homo sapiens
agcctctgtgt

SEQ ID NO: 4740028 - DNA, 19 bp, Homo sapiens
agcctctgtgtcactggct

SEQ ID NO: 4740029 - DNA, 20 bp, Homo sapiens
agcctgacaacagcctgaga

SEQ ID NO: 4740030 - DNA, 11 bp, Homo sapiens
agcctgagaat

SEQ ID NO: 4740031 - DNA, 18 bp, Homo sapiens
agcctgatcacctgccct

SEQ ID NO: 4740032 - DNA, 20 bp, Homo sapiens
agcctgctccttcccaggag

SEQ ID NO: 4740033 - DNA, 22 bp, Homo sapiens
agcctgctccttcccaggagtg

SEQ ID NO: 4740034 - DNA, 19 bp, Homo sapiens
agcctggaacatcatcaag

SEQ ID NO: 4740035 - DNA, 20 bp, Homo sapiens
agcctggaacatcatcaagg

SEQ ID NO: 4740036 - DNA, 17 bp, Homo sapiens
agcctggcccagctccc

SEQ ID NO: 4740037 - DNA, 18 bp, Homo sapiens
agcctggcccagctcccc

SEQ ID NO: 4740038 - DNA, 16 bp, Homo sapiens
agcctggccccatggt

SEQ ID NO: 4740039 - DNA, 13 bp, Homo sapiens
agcctggctccaa

SEQ ID NO: 4740040 - DNA, 14 bp, Homo sapiens
agcctgggtgacaa

SEQ ID NO: 4740041 - DNA, 21 bp, Homo sapiens
agcctgggtgacagagtgaga

SEQ ID NO: 4740042 - DNA, 18 bp, Homo sapiens
agccttataaaccaatct

SEQ ID NO: 4740043 - DNA, 14 bp, Homo sapiens
agccttccaggggt

SEQ ID NO: 4740044 - DNA, 16 bp, Homo sapiens
agccttccaggggtgg

SEQ ID NO: 4740045 - DNA, 17 bp, Homo sapiens
agcctttgggaaatgct

SEQ ID NO: 4740046 - DNA, 19 bp, Homo sapiens
agcgagccctggtggcagt

SEQ ID NO: 4740047 - DNA, 15 bp, Homo sapiens
agcgaggaggctcca

SEQ ID NO: 4740048 - DNA, 17 bp, Homo sapiens
agcgattcttctgcttc

SEQ ID NO: 4740049 - DNA, 17 bp, Homo sapiens
agcgctcctgccgcaga

SEQ ID NO: 4740050 - DNA, 20 bp, Homo sapiens
agcgctcctgccgcagagct

SEQ ID NO: 4740051 - DNA, 21 bp, Homo sapiens
agcgctcctgccgcagagctg

SEQ ID NO: 4740052 - DNA, 16 bp, Homo sapiens
agcgctgtcaggattg

SEQ ID NO: 4740053 - DNA, 14 bp, Homo sapiens
agcggctgtttact

SEQ ID NO: 4740054 - DNA, 15 bp, Homo sapiens
agcgtcctcctctgt

SEQ ID NO: 4740055 - DNA, 19 bp, Homo sapiens
agcgtgagccactgcaccg

SEQ ID NO: 4740056 - DNA, 22 bp, Homo sapiens
agcgtgagccactgcaccgggc

SEQ ID NO: 4740057 - DNA, 22 bp, Homo sapiens
agcgtgcgtctgtgtgtgcctg

SEQ ID NO: 4740058 - DNA, 15 bp, Homo sapiens
agctaaaacctgagc

SEQ ID NO: 4740059 - DNA, 17 bp, Homo sapiens
agctaacacacagctcc

SEQ ID NO: 4740060 - DNA, 12 bp, Homo sapiens
agctacaaatgc

SEQ ID NO: 4740061 - DNA, 19 bp, Homo sapiens
agctactaattttaaaatg

SEQ ID NO: 4740062 - DNA, 19 bp, Homo sapiens
agctacttgggccatagct

SEQ ID NO: 4740063 - DNA, 13 bp, Homo sapiens
agctactttccat

SEQ ID NO: 4740064 - DNA, 16 bp, Homo sapiens
agctactttccatttg

SEQ ID NO: 4740065 - DNA, 17 bp, Homo sapiens
agctactttccatttgg

SEQ ID NO: 4740066 - DNA, 12 bp, Homo sapiens
agctagaaatga

SEQ ID NO: 4740067 - DNA, 16 bp, Homo sapiens
agctagaacccggcag

SEQ ID NO: 4740068 - DNA, 18 bp, Homo sapiens
agctagaacctggagagc

SEQ ID NO: 4740069 - DNA, 22 bp, Homo sapiens
agctagctatttctatgtatgt

SEQ ID NO: 4740070 - DNA, 15 bp, Homo sapiens
agctagctcccctcc

SEQ ID NO: 4740071 - DNA, 16 bp, Homo sapiens
agctagctcccctcct

SEQ ID NO: 4740072 - DNA, 18 bp, Homo sapiens
agctagctcccctcctct

SEQ ID NO: 4740073 - DNA, 14 bp, Homo sapiens
agctaggcctggcc

SEQ ID NO: 4740074 - DNA, 20 bp, Homo sapiens
agctattagccaggatcatg

SEQ ID NO: 4740075 - DNA, 22 bp, Homo sapiens
agctattagccaggatcatggt

SEQ ID NO: 4740076 - DNA, 23 bp, Homo sapiens
agctcaagggaccctgggtggga

SEQ ID NO: 4740077 - DNA, 16 bp, Homo sapiens
agctcaccagccccag

SEQ ID NO: 4740078 - DNA, 12 bp, Homo sapiens
agctcacctctc

SEQ ID NO: 4740079 - DNA, 19 bp, Homo sapiens
agctcacctctcccttgga

SEQ ID NO: 4740080 - DNA, 16 bp, Homo sapiens
agctcagagagggcag

SEQ ID NO: 4740081 - DNA, 14 bp, Homo sapiens
agctcagggcctgg

SEQ ID NO: 4740082 - DNA, 15 bp, Homo sapiens
agctcagggcctggc

SEQ ID NO: 4740083 - DNA, 14 bp, Homo sapiens
agctcatctctgtc

SEQ ID NO: 4740084 - DNA, 17 bp, Homo sapiens
agctccaagctcccagg

SEQ ID NO: 4740085 - DNA, 19 bp, Homo sapiens
agctccaagctcccaggca

SEQ ID NO: 4740086 - DNA, 21 bp, Homo sapiens
agctccagctcaccagcccca

SEQ ID NO: 4740087 - DNA, 18 bp, Homo sapiens
agctcccaagagcttcca

SEQ ID NO: 4740088 - DNA, 21 bp, Homo sapiens
agctcccaagagcttccagag

SEQ ID NO: 4740089 - DNA, 20 bp, Homo sapiens
agctcccaagggatggtgcc

SEQ ID NO: 4740090 - DNA, 23 bp, Homo sapiens
agctcccaggcattccccaggag

SEQ ID NO: 4740091 - DNA, 23 bp, Homo sapiens
agctcccccgggaggggcccgct

SEQ ID NO: 4740092 - DNA, 15 bp, Homo sapiens
agctcccctccccaa

SEQ ID NO: 4740093 - DNA, 18 bp, Homo sapiens
agctcccctccccaactg

SEQ ID NO: 4740094 - DNA, 14 bp, Homo sapiens
agctcccctcctct

SEQ ID NO: 4740095 - DNA, 18 bp, Homo sapiens
agctcctcatccagggct

SEQ ID NO: 4740096 - DNA, 13 bp, Homo sapiens
agctccttcctgg

SEQ ID NO: 4740097 - DNA, 12 bp, Homo sapiens
agctccttctgt

SEQ ID NO: 4740098 - DNA, 16 bp, Homo sapiens
agctccttctgtccta

SEQ ID NO: 4740099 - DNA, 23 bp, Homo sapiens
agctccttctgtcctactctgtg

SEQ ID NO: 4740100 - DNA, 17 bp, Homo sapiens
agctctacacaacatgt

SEQ ID NO: 4740101 - DNA, 18 bp, Homo sapiens
agctctacacaacatgta

SEQ ID NO: 4740102 - DNA, 21 bp, Homo sapiens
agctctacacaacatgtatgt

SEQ ID NO: 4740103 - DNA, 19 bp, Homo sapiens
agctctcttcaatgacata

SEQ ID NO: 4740104 - DNA, 18 bp, Homo sapiens
agctctgaaaccagtgtt

SEQ ID NO: 4740105 - DNA, 14 bp, Homo sapiens
agctctgacccaca

SEQ ID NO: 4740106 - DNA, 15 bp, Homo sapiens
agctctgacccacag

SEQ ID NO: 4740107 - DNA, 16 bp, Homo sapiens
agctctgacccacagc

SEQ ID NO: 4740108 - DNA, 17 bp, Homo sapiens
agctctgccgcaatggc

SEQ ID NO: 4740109 - DNA, 20 bp, Homo sapiens
agctctggtccatagagagc

SEQ ID NO: 4740110 - DNA, 22 bp, Homo sapiens
agctctgtatcaggacccagag

SEQ ID NO: 4740111 - DNA, 15 bp, Homo sapiens
agctcttctccaggc

SEQ ID NO: 4740112 - DNA, 17 bp, Homo sapiens
agctcttctccaggctg

SEQ ID NO: 4740113 - DNA, 16 bp, Homo sapiens
agctctttatatgttg

SEQ ID NO: 4740114 - DNA, 22 bp, Homo sapiens
agctgacacaaacctgcctggg

SEQ ID NO: 4740115 - DNA, 21 bp, Homo sapiens
agctgacagtcctctccacct

SEQ ID NO: 4740116 - DNA, 13 bp, Homo sapiens
agctgaccccctc

SEQ ID NO: 4740117 - DNA, 16 bp, Homo sapiens
agctgaccccctcccc

SEQ ID NO: 4740118 - DNA, 15 bp, Homo sapiens
agctgaggcagcagt

SEQ ID NO: 4740119 - DNA, 20 bp, Homo sapiens
agctgagtctccctaaggca

SEQ ID NO: 4740120 - DNA, 21 bp, Homo sapiens
agctgatacaaattgcagact

SEQ ID NO: 4740121 - DNA, 15 bp, Homo sapiens
agctgcctggacccg

SEQ ID NO: 4740122 - DNA, 21 bp, Homo sapiens
agctgcctgggatccctcatc

SEQ ID NO: 4740123 - DNA, 14 bp, Homo sapiens
agctgcctgttcag

SEQ ID NO: 4740124 - DNA, 22 bp, Homo sapiens
agctgcctgttcagctccagct

SEQ ID NO: 4740125 - DNA, 16 bp, Homo sapiens
agctgcggtccaccca

SEQ ID NO: 4740126 - DNA, 21 bp, Homo sapiens
agctgcggtccacccaggagc

SEQ ID NO: 4740127 - DNA, 18 bp, Homo sapiens
agctgctggctgtgacaa

SEQ ID NO: 4740128 - DNA, 23 bp, Homo sapiens
agctgcttttgtctatgggactc

SEQ ID NO: 4740129 - DNA, 14 bp, Homo sapiens
agctggatgagaat

SEQ ID NO: 4740130 - DNA, 21 bp, Homo sapiens
agctggcagagagcacagtga

SEQ ID NO: 4740131 - DNA, 19 bp, Homo sapiens
agctggccgggagcctgat

SEQ ID NO: 4740132 - DNA, 16 bp, Homo sapiens
agctggccgtgggcct

SEQ ID NO: 4740133 - DNA, 17 bp, Homo sapiens
agctggccgtgggcctg

SEQ ID NO: 4740134 - DNA, 15 bp, Homo sapiens
agctgggactacagg

SEQ ID NO: 4740135 - DNA, 20 bp, Homo sapiens
agctgggactacaggcaccc

SEQ ID NO: 4740136 - DNA, 16 bp, Homo sapiens
agctgggactacaggt

SEQ ID NO: 4740137 - DNA, 17 bp, Homo sapiens
agctgggactacaggtg

SEQ ID NO: 4740138 - DNA, 17 bp, Homo sapiens
agctgggatgtttctgt

SEQ ID NO: 4740139 - DNA, 22 bp, Homo sapiens
agctgggattacaggctcctgc

SEQ ID NO: 4740140 - DNA, 23 bp, Homo sapiens
agctgggattacaggctcctgcc

SEQ ID NO: 4740141 - DNA, 19 bp, Homo sapiens
agctgggctttcctctgtg

SEQ ID NO: 4740142 - DNA, 18 bp, Homo sapiens
agctgggtggcactgcca

SEQ ID NO: 4740143 - DNA, 17 bp, Homo sapiens
agctgggtgtcaagagg

SEQ ID NO: 4740144 - DNA, 22 bp, Homo sapiens
agctgggtgtcaagagggtctg

SEQ ID NO: 4740145 - DNA, 15 bp, Homo sapiens
agctggtcccactca

SEQ ID NO: 4740146 - DNA, 19 bp, Homo sapiens
agctggtcccactcagtcc

SEQ ID NO: 4740147 - DNA, 22 bp, Homo sapiens
agctggtttttagcggagacgg

SEQ ID NO: 4740148 - DNA, 16 bp, Homo sapiens
agctgtaaaccagaga

SEQ ID NO: 4740149 - DNA, 17 bp, Homo sapiens
agctgtaaaccagagag

SEQ ID NO: 4740150 - DNA, 15 bp, Homo sapiens
agctgtgaagagact

SEQ ID NO: 4740151 - DNA, 12 bp, Homo sapiens
agctgtgcaggt

SEQ ID NO: 4740152 - DNA, 18 bp, Homo sapiens
agctgtgcaggtggggag

SEQ ID NO: 4740153 - DNA, 18 bp, Homo sapiens
agctgtgccaccctgggc

SEQ ID NO: 4740154 - DNA, 20 bp, Homo sapiens
agctgtgccaccctgggctc

SEQ ID NO: 4740155 - DNA, 21 bp, Homo sapiens
agctgtgctctggacaggcat

SEQ ID NO: 4740156 - DNA, 20 bp, Homo sapiens
agctgtggtacaaatgtgat

SEQ ID NO: 4740157 - DNA, 21 bp, Homo sapiens
agctgtggtacaaatgtgata

SEQ ID NO: 4740158 - DNA, 18 bp, Homo sapiens
agctgttatcttgtgtat

SEQ ID NO: 4740159 - DNA, 15 bp, Homo sapiens
agctgttctgtccct

SEQ ID NO: 4740160 - DNA, 20 bp, Homo sapiens
agctgttctgtcccttggag

SEQ ID NO: 4740161 - DNA, 14 bp, Homo sapiens
agctgttgtaaaga

SEQ ID NO: 4740162 - DNA, 18 bp, Homo sapiens
agctgttgtacatttatg

SEQ ID NO: 4740163 - DNA, 20 bp, Homo sapiens
agctgttgtacatttatgat

SEQ ID NO: 4740164 - DNA, 13 bp, Homo sapiens
agcttaaaaagag

SEQ ID NO: 4740165 - DNA, 15 bp, Homo sapiens
agcttagagcctccc

SEQ ID NO: 4740166 - DNA, 19 bp, Homo sapiens
agcttagattttctgtaaa

SEQ ID NO: 4740167 - DNA, 19 bp, Homo sapiens
agcttattatagaattgca

SEQ ID NO: 4740168 - DNA, 19 bp, Homo sapiens
agcttatttagcacatttt

SEQ ID NO: 4740169 - DNA, 21 bp, Homo sapiens
agcttatttagcacattttga

SEQ ID NO: 4740170 - DNA, 13 bp, Homo sapiens
agcttcaggttat

SEQ ID NO: 4740171 - DNA, 22 bp, Homo sapiens
agcttcagtaagttatctttga

SEQ ID NO: 4740172 - DNA, 19 bp, Homo sapiens
agcttcatggcagaaggca

SEQ ID NO: 4740173 - DNA, 19 bp, Homo sapiens
agcttccagaactgtgaga

SEQ ID NO: 4740174 - DNA, 13 bp, Homo sapiens
agcttctgccact

SEQ ID NO: 4740175 - DNA, 16 bp, Homo sapiens
agcttctgctgggctg

SEQ ID NO: 4740176 - DNA, 19 bp, Homo sapiens
agcttctgttgctgcctca

SEQ ID NO: 4740177 - DNA, 21 bp, Homo sapiens
agcttctgttgctgcctcatg

SEQ ID NO: 4740178 - DNA, 22 bp, Homo sapiens
agcttctgttgctgcctcatgc

SEQ ID NO: 4740179 - DNA, 14 bp, Homo sapiens
agcttgagggttgg

SEQ ID NO: 4740180 - DNA, 18 bp, Homo sapiens
agcttgtaaatagctcag

SEQ ID NO: 4740181 - DNA, 18 bp, Homo sapiens
agcttgtaataaatactg

SEQ ID NO: 4740182 - DNA, 12 bp, Homo sapiens
agcttgtatttt

SEQ ID NO: 4740183 - DNA, 22 bp, Homo sapiens
agcttttacgtagtaaaagtca

SEQ ID NO: 4740184 - DNA, 18 bp, Homo sapiens
aggaaaaaataacaatga

SEQ ID NO: 4740185 - DNA, 15 bp, Homo sapiens
aggaaaaaattgaaa

SEQ ID NO: 4740186 - DNA, 14 bp, Homo sapiens
aggaaaatgtctgt

SEQ ID NO: 4740187 - DNA, 17 bp, Homo sapiens
aggaaacacttctattt

SEQ ID NO: 4740188 - DNA, 16 bp, Homo sapiens
aggaaaccacagctgc

SEQ ID NO: 4740189 - DNA, 15 bp, Homo sapiens
aggaaacgtggcagg

SEQ ID NO: 4740190 - DNA, 13 bp, Homo sapiens
aggaaactcttat

SEQ ID NO: 4740191 - DNA, 22 bp, Homo sapiens
aggaaactcttatctcagtcat

SEQ ID NO: 4740192 - DNA, 16 bp, Homo sapiens
aggaaagattcatgtc

SEQ ID NO: 4740193 - DNA, 20 bp, Homo sapiens
aggaaaggctccaggagcag

SEQ ID NO: 4740194 - DNA, 14 bp, Homo sapiens
aggaaatattaatt

SEQ ID NO: 4740195 - DNA, 17 bp, Homo sapiens
aggaaatccagggtggt

SEQ ID NO: 4740196 - DNA, 15 bp, Homo sapiens
aggaacttttgttag

SEQ ID NO: 4740197 - DNA, 12 bp, Homo sapiens
aggaagaacggg

SEQ ID NO: 4740198 - DNA, 13 bp, Homo sapiens
aggaagactttgg

SEQ ID NO: 4740199 - DNA, 21 bp, Homo sapiens
aggaagatgtatgctttgaat

SEQ ID NO: 4740200 - DNA, 20 bp, Homo sapiens
aggaagccgctggggccagt

SEQ ID NO: 4740201 - DNA, 13 bp, Homo sapiens
aggaagctcaggg

SEQ ID NO: 4740202 - DNA, 18 bp, Homo sapiens
aggaaggaaacccagctc

SEQ ID NO: 4740203 - DNA, 22 bp, Homo sapiens
aggaaggaaacccagctctggt

SEQ ID NO: 4740204 - DNA, 13 bp, Homo sapiens
aggaaggagctgc

SEQ ID NO: 4740205 - DNA, 16 bp, Homo sapiens
aggaaggagctgcctg

SEQ ID NO: 4740206 - DNA, 17 bp, Homo sapiens
aggaaggagctgcctgg

SEQ ID NO: 4740207 - DNA, 14 bp, Homo sapiens
aggaaggattgtaa

SEQ ID NO: 4740208 - DNA, 17 bp, Homo sapiens
aggaaggattgtaaaaa

SEQ ID NO: 4740209 - DNA, 20 bp, Homo sapiens
aggaaggctcttctccccag

SEQ ID NO: 4740210 - DNA, 21 bp, Homo sapiens
aggaaggctcttctccccaga

SEQ ID NO: 4740211 - DNA, 22 bp, Homo sapiens
aggaaggctgagaggagagaga

SEQ ID NO: 4740212 - DNA, 20 bp, Homo sapiens
aggaaggggccagaggctcg

SEQ ID NO: 4740213 - DNA, 14 bp, Homo sapiens
aggaaggtggtggg

SEQ ID NO: 4740214 - DNA, 14 bp, Homo sapiens
aggaagtgtttatg

SEQ ID NO: 4740215 - DNA, 22 bp, Homo sapiens
aggaatacctgtccccctgaca

SEQ ID NO: 4740216 - DNA, 18 bp, Homo sapiens
aggaatcattctgtaaag

SEQ ID NO: 4740217 - DNA, 20 bp, Homo sapiens
aggaatccagacccggctgc

SEQ ID NO: 4740218 - DNA, 22 bp, Homo sapiens
aggaatgttttgtagctctagg

SEQ ID NO: 4740219 - DNA, 11 bp, Homo sapiens
aggaatttaaa

SEQ ID NO: 4740220 - DNA, 15 bp, Homo sapiens
aggacaaaataaagt

SEQ ID NO: 4740221 - DNA, 16 bp, Homo sapiens
aggacaaaataaagtg

SEQ ID NO: 4740222 - DNA, 22 bp, Homo sapiens
aggacaaaataaagtgtgtgtg

SEQ ID NO: 4740223 - DNA, 14 bp, Homo sapiens
aggacaagaccctc

SEQ ID NO: 4740224 - DNA, 18 bp, Homo sapiens
aggacactaaccacgctg

SEQ ID NO: 4740225 - DNA, 13 bp, Homo sapiens
aggacatgaaact

SEQ ID NO: 4740226 - DNA, 18 bp, Homo sapiens
aggacatgaaactccacc

SEQ ID NO: 4740227 - DNA, 18 bp, Homo sapiens
aggacattgcggacagcc

SEQ ID NO: 4740228 - DNA, 19 bp, Homo sapiens
aggacattgcggacagcca

SEQ ID NO: 4740229 - DNA, 14 bp, Homo sapiens
aggacatttctcta

SEQ ID NO: 4740230 - DNA, 20 bp, Homo sapiens
aggaccagtcaacctgggca

SEQ ID NO: 4740231 - DNA, 20 bp, Homo sapiens
aggacccctccatgtgggct

SEQ ID NO: 4740232 - DNA, 15 bp, Homo sapiens
aggacggggccggcc

SEQ ID NO: 4740233 - DNA, 21 bp, Homo sapiens
aggacggggccggccaggtgg

SEQ ID NO: 4740234 - DNA, 17 bp, Homo sapiens
aggactagaacctggag

SEQ ID NO: 4740235 - DNA, 18 bp, Homo sapiens
aggactagaacctggagg

SEQ ID NO: 4740236 - DNA, 18 bp, Homo sapiens
aggactagggtcctgggg

SEQ ID NO: 4740237 - DNA, 14 bp, Homo sapiens
aggactctgcagcc

SEQ ID NO: 4740238 - DNA, 17 bp, Homo sapiens
aggactctgcagcctca

SEQ ID NO: 4740239 - DNA, 16 bp, Homo sapiens
aggactgtgacaggca

SEQ ID NO: 4740240 - DNA, 20 bp, Homo sapiens
aggactgtgacaggcagcag

SEQ ID NO: 4740241 - DNA, 15 bp, Homo sapiens
aggacttccatctgt

SEQ ID NO: 4740242 - DNA, 17 bp, Homo sapiens
aggacttttctttgtgg

SEQ ID NO: 4740243 - DNA, 19 bp, Homo sapiens
aggacttttctttgtggct

SEQ ID NO: 4740244 - DNA, 23 bp, Homo sapiens
aggacttttctttgtggcttcct

SEQ ID NO: 4740245 - DNA, 22 bp, Homo sapiens
aggagaagtcttctatttattt

SEQ ID NO: 4740246 - DNA, 23 bp, Homo sapiens
aggagaagtcttctatttattta

SEQ ID NO: 4740247 - DNA, 22 bp, Homo sapiens
aggagaagtggggaccccaccc

SEQ ID NO: 4740248 - DNA, 23 bp, Homo sapiens
aggagaagtggggaccccacccc

SEQ ID NO: 4740249 - DNA, 20 bp, Homo sapiens
aggagaatcactcgaacccg

SEQ ID NO: 4740250 - DNA, 17 bp, Homo sapiens
aggagagagcagcttct

SEQ ID NO: 4740251 - DNA, 20 bp, Homo sapiens
aggagagagcagcttctgcc

SEQ ID NO: 4740252 - DNA, 13 bp, Homo sapiens
aggagaggatgag

SEQ ID NO: 4740253 - DNA, 17 bp, Homo sapiens
aggagaggatgagagcc

SEQ ID NO: 4740254 - DNA, 17 bp, Homo sapiens
aggagatgctccttggg

SEQ ID NO: 4740255 - DNA, 16 bp, Homo sapiens
aggagcatccacctcc

SEQ ID NO: 4740256 - DNA, 21 bp, Homo sapiens
aggagcatttggagagaaggc

SEQ ID NO: 4740257 - DNA, 17 bp, Homo sapiens
aggagcccaggccagga

SEQ ID NO: 4740258 - DNA, 20 bp, Homo sapiens
aggagcccaggccaggactc

SEQ ID NO: 4740259 - DNA, 22 bp, Homo sapiens
aggagccccgaggccttctctg

SEQ ID NO: 4740260 - DNA, 17 bp, Homo sapiens
aggagcctgggggctcc

SEQ ID NO: 4740261 - DNA, 15 bp, Homo sapiens
aggagctgatacttt

SEQ ID NO: 4740262 - DNA, 22 bp, Homo sapiens
aggaggacaagaccctctcagg

SEQ ID NO: 4740263 - DNA, 19 bp, Homo sapiens
aggaggacacttggatttt

SEQ ID NO: 4740264 - DNA, 20 bp, Homo sapiens
aggaggcagaggttgcagtg

SEQ ID NO: 4740265 - DNA, 14 bp, Homo sapiens
aggaggccacgtga

SEQ ID NO: 4740266 - DNA, 15 bp, Homo sapiens
aggaggccagccttg

SEQ ID NO: 4740267 - DNA, 17 bp, Homo sapiens
aggaggggatagagaga

SEQ ID NO: 4740268 - DNA, 20 bp, Homo sapiens
aggaggggcccgttgtctcc

SEQ ID NO: 4740269 - DNA, 17 bp, Homo sapiens
aggagggtcggtgcctt

SEQ ID NO: 4740270 - DNA, 23 bp, Homo sapiens
aggaggtaaaggatgagggttca

SEQ ID NO: 4740271 - DNA, 19 bp, Homo sapiens
aggagtcaatttgcctctg

SEQ ID NO: 4740272 - DNA, 19 bp, Homo sapiens
aggatattcagatgtatgt

SEQ ID NO: 4740273 - DNA, 14 bp, Homo sapiens
aggatctagagggg

SEQ ID NO: 4740274 - DNA, 14 bp, Homo sapiens
aggatctctaaaga

SEQ ID NO: 4740275 - DNA, 17 bp, Homo sapiens
aggatctctaaagagca

SEQ ID NO: 4740276 - DNA, 22 bp, Homo sapiens
aggatgagggttcatcatccct

SEQ ID NO: 4740277 - DNA, 16 bp, Homo sapiens
aggatgatctaggaag

SEQ ID NO: 4740278 - DNA, 17 bp, Homo sapiens
aggatgatctaggaaga

SEQ ID NO: 4740279 - DNA, 23 bp, Homo sapiens
aggatgatctaggaagactttgg

SEQ ID NO: 4740280 - DNA, 13 bp, Homo sapiens
aggatggcctggc

SEQ ID NO: 4740281 - DNA, 17 bp, Homo sapiens
aggatggcctggccagg

SEQ ID NO: 4740282 - DNA, 21 bp, Homo sapiens
aggatgtgggggaagacctgg

SEQ ID NO: 4740283 - DNA, 16 bp, Homo sapiens
aggatgttctgggaca

SEQ ID NO: 4740284 - DNA, 20 bp, Homo sapiens
aggatgttctgggacacagt

SEQ ID NO: 4740285 - DNA, 20 bp, Homo sapiens
aggattaaaatggatttaat

SEQ ID NO: 4740286 - DNA, 20 bp, Homo sapiens
aggattaaataatgtaaata

SEQ ID NO: 4740287 - DNA, 16 bp, Homo sapiens
aggattgcgagagatg

SEQ ID NO: 4740288 - DNA, 17 bp, Homo sapiens
aggattgcgagagatgt

SEQ ID NO: 4740289 - DNA, 20 bp, Homo sapiens
aggattgcgagagatgtgtg

SEQ ID NO: 4740290 - DNA, 15 bp, Homo sapiens
aggattgctactgtc

SEQ ID NO: 4740291 - DNA, 18 bp, Homo sapiens
aggattgctactgtccta

SEQ ID NO: 4740292 - DNA, 17 bp, Homo sapiens
aggcaaagaaaatgaaa

SEQ ID NO: 4740293 - DNA, 15 bp, Homo sapiens
aggcaaatgcccaag

SEQ ID NO: 4740294 - DNA, 18 bp, Homo sapiens
aggcaatggtttgtgtca

SEQ ID NO: 4740295 - DNA, 12 bp, Homo sapiens
aggcacagcaca

SEQ ID NO: 4740296 - DNA, 21 bp, Homo sapiens
aggcacctacactcacctgca

SEQ ID NO: 4740297 - DNA, 20 bp, Homo sapiens
aggcacctaccaccacgccc

SEQ ID NO: 4740298 - DNA, 14 bp, Homo sapiens
aggcacctgcaggt

SEQ ID NO: 4740299 - DNA, 18 bp, Homo sapiens
aggcacctgcaggttggg

SEQ ID NO: 4740300 - DNA, 14 bp, Homo sapiens
aggcactgccctgg

SEQ ID NO: 4740301 - DNA, 13 bp, Homo sapiens
aggcactgcctga

SEQ ID NO: 4740302 - DNA, 20 bp, Homo sapiens
aggcacttcctcccctcgcc

SEQ ID NO: 4740303 - DNA, 21 bp, Homo sapiens
aggcacttcctcccctcgccc

SEQ ID NO: 4740304 - DNA, 16 bp, Homo sapiens
aggcagccaggccaca

SEQ ID NO: 4740305 - DNA, 18 bp, Homo sapiens
aggcagccaggccacaag

SEQ ID NO: 4740306 - DNA, 16 bp, Homo sapiens
aggcagccccattctg

SEQ ID NO: 4740307 - DNA, 19 bp, Homo sapiens
aggcagccccattctgcct

SEQ ID NO: 4740308 - DNA, 23 bp, Homo sapiens
aggcaggacatgctgaagccaaa

SEQ ID NO: 4740309 - DNA, 16 bp, Homo sapiens
aggcaggggaatgtat

SEQ ID NO: 4740310 - DNA, 20 bp, Homo sapiens
aggcagggtctcactctgtc

SEQ ID NO: 4740311 - DNA, 21 bp, Homo sapiens
aggcaggtcttgaactcctgg

SEQ ID NO: 4740312 - DNA, 15 bp, Homo sapiens
aggcataaagtcagg

SEQ ID NO: 4740313 - DNA, 22 bp, Homo sapiens
aggcataaagtcaggggttccc

SEQ ID NO: 4740314 - DNA, 17 bp, Homo sapiens
aggcatggctggtgcct

SEQ ID NO: 4740315 - DNA, 19 bp, Homo sapiens
aggcatggctggtgcctga

SEQ ID NO: 4740316 - DNA, 20 bp, Homo sapiens
aggcatggctggtgcctgaa

SEQ ID NO: 4740317 - DNA, 22 bp, Homo sapiens
aggcatgttctctgaggacact

SEQ ID NO: 4740318 - DNA, 18 bp, Homo sapiens
aggcattccccaggaggc

SEQ ID NO: 4740319 - DNA, 18 bp, Homo sapiens
aggcattgccaagggctt

SEQ ID NO: 4740320 - DNA, 21 bp, Homo sapiens
aggcattgccaagggctttgt

SEQ ID NO: 4740321 - DNA, 15 bp, Homo sapiens
aggccacaagaccct

SEQ ID NO: 4740322 - DNA, 17 bp, Homo sapiens
aggccaggaccaagggc

SEQ ID NO: 4740323 - DNA, 22 bp, Homo sapiens
aggccaggaccaagggcagagg

SEQ ID NO: 4740324 - DNA, 21 bp, Homo sapiens
aggccaggactctgcagcctc

SEQ ID NO: 4740325 - DNA, 14 bp, Homo sapiens
aggccaggccctct

SEQ ID NO: 4740326 - DNA, 17 bp, Homo sapiens
aggccaggccctctgcc

SEQ ID NO: 4740327 - DNA, 18 bp, Homo sapiens
aggccaggccctctgccc

SEQ ID NO: 4740328 - DNA, 23 bp, Homo sapiens
aggccaggccctctgcccactcc

SEQ ID NO: 4740329 - DNA, 15 bp, Homo sapiens
aggcccagagggcct

SEQ ID NO: 4740330 - DNA, 16 bp, Homo sapiens
aggcccagagggcctg

SEQ ID NO: 4740331 - DNA, 13 bp, Homo sapiens
aggcccagtgaga

SEQ ID NO: 4740332 - DNA, 14 bp, Homo sapiens
aggccccgcccagg

SEQ ID NO: 4740333 - DNA, 14 bp, Homo sapiens
aggcccctctcctc

SEQ ID NO: 4740334 - DNA, 16 bp, Homo sapiens
aggcccctctcctccg

SEQ ID NO: 4740335 - DNA, 12 bp, Homo sapiens
aggcccctgcca

SEQ ID NO: 4740336 - DNA, 18 bp, Homo sapiens
aggcccggctccaggctc

SEQ ID NO: 4740337 - DNA, 17 bp, Homo sapiens
aggccctccacacctgc

SEQ ID NO: 4740338 - DNA, 23 bp, Homo sapiens
aggccctccacacctgcggccca

SEQ ID NO: 4740339 - DNA, 22 bp, Homo sapiens
aggccctcgctgccagctctgt

SEQ ID NO: 4740340 - DNA, 19 bp, Homo sapiens
aggccctctgcccactccc

SEQ ID NO: 4740341 - DNA, 21 bp, Homo sapiens
aggccctctgcccactccctg

SEQ ID NO: 4740342 - DNA, 22 bp, Homo sapiens
aggccctctgcccactccctgc

SEQ ID NO: 4740343 - DNA, 19 bp, Homo sapiens
aggccctgcactgtcctgc

SEQ ID NO: 4740344 - DNA, 22 bp, Homo sapiens
aggcccttctctccagcccctg

SEQ ID NO: 4740345 - DNA, 23 bp, Homo sapiens
aggccgtatgaagacagaggcag

SEQ ID NO: 4740346 - DNA, 17 bp, Homo sapiens
aggcctgagatttcatc

SEQ ID NO: 4740347 - DNA, 22 bp, Homo sapiens
aggcctgagatttcatctgctc

SEQ ID NO: 4740348 - DNA, 19 bp, Homo sapiens
aggcctgagcgctcctgcc

SEQ ID NO: 4740349 - DNA, 22 bp, Homo sapiens
aggcctgagcgctcctgccgca

SEQ ID NO: 4740350 - DNA, 19 bp, Homo sapiens
aggcctgcctccagggctg

SEQ ID NO: 4740351 - DNA, 20 bp, Homo sapiens
aggcctgcctccagggctgg

SEQ ID NO: 4740352 - DNA, 19 bp, Homo sapiens
aggcctgccttctcaggga

SEQ ID NO: 4740353 - DNA, 16 bp, Homo sapiens
aggcctgcgtgtgtct

SEQ ID NO: 4740354 - DNA, 14 bp, Homo sapiens
aggcctggcacagt

SEQ ID NO: 4740355 - DNA, 12 bp, Homo sapiens
aggcctggccag

SEQ ID NO: 4740356 - DNA, 18 bp, Homo sapiens
aggccttctctgaaggac

SEQ ID NO: 4740357 - DNA, 21 bp, Homo sapiens
aggccttggggcatgacccag

SEQ ID NO: 4740358 - DNA, 21 bp, Homo sapiens
aggcgtgagccaccgtgcctg

SEQ ID NO: 4740359 - DNA, 19 bp, Homo sapiens
aggctaaggcgtggagctg

SEQ ID NO: 4740360 - DNA, 23 bp, Homo sapiens
aggctagtgtggtgtttcctggc

SEQ ID NO: 4740361 - DNA, 14 bp, Homo sapiens
aggctattttctaa

SEQ ID NO: 4740362 - DNA, 17 bp, Homo sapiens
aggctattttctaaaga

SEQ ID NO: 4740363 - DNA, 16 bp, Homo sapiens
aggctcaactagggag

SEQ ID NO: 4740364 - DNA, 19 bp, Homo sapiens
aggctcacccccttctcca

SEQ ID NO: 4740365 - DNA, 19 bp, Homo sapiens
aggctccaggagcagccac

SEQ ID NO: 4740366 - DNA, 16 bp, Homo sapiens
aggctcctgttttgca

SEQ ID NO: 4740367 - DNA, 12 bp, Homo sapiens
aggctctgccct

SEQ ID NO: 4740368 - DNA, 13 bp, Homo sapiens
aggctctgccctt

SEQ ID NO: 4740369 - DNA, 16 bp, Homo sapiens
aggctctgcccttggt

SEQ ID NO: 4740370 - DNA, 16 bp, Homo sapiens
aggctcttctccccag

SEQ ID NO: 4740371 - DNA, 17 bp, Homo sapiens
aggctcttctccccaga

SEQ ID NO: 4740372 - DNA, 13 bp, Homo sapiens
aggctgagcctca

SEQ ID NO: 4740373 - DNA, 15 bp, Homo sapiens
aggctgatcatttgg

SEQ ID NO: 4740374 - DNA, 19 bp, Homo sapiens
aggctggccagccccacag

SEQ ID NO: 4740375 - DNA, 20 bp, Homo sapiens
aggctggccagccccacagc

SEQ ID NO: 4740376 - DNA, 17 bp, Homo sapiens
aggctggccctgccctg

SEQ ID NO: 4740377 - DNA, 17 bp, Homo sapiens
aggctggcgtgcagtgg

SEQ ID NO: 4740378 - DNA, 17 bp, Homo sapiens
aggctgggaccacgtga

SEQ ID NO: 4740379 - DNA, 20 bp, Homo sapiens
aggctgggagagccttccag

SEQ ID NO: 4740380 - DNA, 13 bp, Homo sapiens
aggctgggctccc

SEQ ID NO: 4740381 - DNA, 18 bp, Homo sapiens
aggctgggctcccttccc

SEQ ID NO: 4740382 - DNA, 21 bp, Homo sapiens
aggctgggctcccttcccacc

SEQ ID NO: 4740383 - DNA, 18 bp, Homo sapiens
aggctgggcttcagtggc

SEQ ID NO: 4740384 - DNA, 21 bp, Homo sapiens
aggctgggcttcagtggcagc

SEQ ID NO: 4740385 - DNA, 22 bp, Homo sapiens
aggctgggcttcagtggcagct

SEQ ID NO: 4740386 - DNA, 23 bp, Homo sapiens
aggctgggcttcagtggcagctg

SEQ ID NO: 4740387 - DNA, 14 bp, Homo sapiens
aggctgggttctga

SEQ ID NO: 4740388 - DNA, 17 bp, Homo sapiens
aggctgggttctgatcc

SEQ ID NO: 4740389 - DNA, 22 bp, Homo sapiens
aggctggttcggatttggggtg

SEQ ID NO: 4740390 - DNA, 23 bp, Homo sapiens
aggctgtatcccatgagcctcag

SEQ ID NO: 4740391 - DNA, 15 bp, Homo sapiens
aggctgtcccaagct

SEQ ID NO: 4740392 - DNA, 20 bp, Homo sapiens
aggctgtgctccctggttct

SEQ ID NO: 4740393 - DNA, 16 bp, Homo sapiens
aggctgtgtgaatttt

SEQ ID NO: 4740394 - DNA, 20 bp, Homo sapiens
aggctgtgtgaatttttcta

SEQ ID NO: 4740395 - DNA, 21 bp, Homo sapiens
aggctgtgtgaatttttctaa

SEQ ID NO: 4740396 - DNA, 15 bp, Homo sapiens
aggcttagctttgct

SEQ ID NO: 4740397 - DNA, 19 bp, Homo sapiens
aggcttagctttgctctgc

SEQ ID NO: 4740398 - DNA, 17 bp, Homo sapiens
aggcttagtcactgaga

SEQ ID NO: 4740399 - DNA, 15 bp, Homo sapiens
agggaaaacattcca

SEQ ID NO: 4740400 - DNA, 23 bp, Homo sapiens
agggaaactgtgaatgcttctga

SEQ ID NO: 4740401 - DNA, 16 bp, Homo sapiens
agggaaagcatttaaa

SEQ ID NO: 4740402 - DNA, 19 bp, Homo sapiens
agggaaagttttgttctgt

SEQ ID NO: 4740403 - DNA, 13 bp, Homo sapiens
agggaaatttcag

SEQ ID NO: 4740404 - DNA, 12 bp, Homo sapiens
agggaagggtgg

SEQ ID NO: 4740405 - DNA, 16 bp, Homo sapiens
agggaagtaacagtaa

SEQ ID NO: 4740406 - DNA, 21 bp, Homo sapiens
agggaatgcctgagtgcctgg

SEQ ID NO: 4740407 - DNA, 15 bp, Homo sapiens
agggaatggcacagc

SEQ ID NO: 4740408 - DNA, 13 bp, Homo sapiens
agggacagagggg

SEQ ID NO: 4740409 - DNA, 20 bp, Homo sapiens
agggacagagggggtggcct

SEQ ID NO: 4740410 - DNA, 23 bp, Homo sapiens
agggaccacagcaaggcacctgc

SEQ ID NO: 4740411 - DNA, 12 bp, Homo sapiens
agggacccctcc

SEQ ID NO: 4740412 - DNA, 15 bp, Homo sapiens
agggacccctcctcc

SEQ ID NO: 4740413 - DNA, 21 bp, Homo sapiens
agggacgctacccgggaaggg

SEQ ID NO: 4740414 - DNA, 15 bp, Homo sapiens
agggacttggaagct

SEQ ID NO: 4740415 - DNA, 19 bp, Homo sapiens
agggacttggaagctccgc

SEQ ID NO: 4740416 - DNA, 20 bp, Homo sapiens
agggagagaactgagcatct

SEQ ID NO: 4740417 - DNA, 12 bp, Homo sapiens
agggagagccca

SEQ ID NO: 4740418 - DNA, 13 bp, Homo sapiens
agggagagcccag

SEQ ID NO: 4740419 - DNA, 20 bp, Homo sapiens
agggaggcacttcctcccct

SEQ ID NO: 4740420 - DNA, 17 bp, Homo sapiens
agggagggagggctcca

SEQ ID NO: 4740421 - DNA, 13 bp, Homo sapiens
agggagggcctgg

SEQ ID NO: 4740422 - DNA, 13 bp, Homo sapiens
agggagggctcca

SEQ ID NO: 4740423 - DNA, 15 bp, Homo sapiens
agggagggctccaga

SEQ ID NO: 4740424 - DNA, 17 bp, Homo sapiens
agggagggctccagaca

SEQ ID NO: 4740425 - DNA, 17 bp, Homo sapiens
agggaggtgaccccagg

SEQ ID NO: 4740426 - DNA, 20 bp, Homo sapiens
agggagtgacagaggcagcc

SEQ ID NO: 4740427 - DNA, 19 bp, Homo sapiens
agggatccctcatctgtcc

SEQ ID NO: 4740428 - DNA, 19 bp, Homo sapiens
agggatgagcatggagctg

SEQ ID NO: 4740429 - DNA, 19 bp, Homo sapiens
agggattttagtcacacgt

SEQ ID NO: 4740430 - DNA, 20 bp, Homo sapiens
agggcacaccgggcactcag

SEQ ID NO: 4740431 - DNA, 21 bp, Homo sapiens
agggcacaccgggcactcaga

SEQ ID NO: 4740432 - DNA, 15 bp, Homo sapiens
agggcaccaccaaga

SEQ ID NO: 4740433 - DNA, 19 bp, Homo sapiens
agggcagagtgagacccag

SEQ ID NO: 4740434 - DNA, 14 bp, Homo sapiens
agggcagcagggct

SEQ ID NO: 4740435 - DNA, 14 bp, Homo sapiens
agggcagccaggga

SEQ ID NO: 4740436 - DNA, 19 bp, Homo sapiens
agggcagccagggagagcc

SEQ ID NO: 4740437 - DNA, 22 bp, Homo sapiens
agggcagccagggagagcccag

SEQ ID NO: 4740438 - DNA, 23 bp, Homo sapiens
agggcagccagggagagcccagg

SEQ ID NO: 4740439 - DNA, 11 bp, Homo sapiens
agggcaggcat

SEQ ID NO: 4740440 - DNA, 13 bp, Homo sapiens
agggcattggcca

SEQ ID NO: 4740441 - DNA, 21 bp, Homo sapiens
agggccaagcccagcactgct

SEQ ID NO: 4740442 - DNA, 21 bp, Homo sapiens
agggccacatgggaggctcac

SEQ ID NO: 4740443 - DNA, 14 bp, Homo sapiens
agggccactgaaga

SEQ ID NO: 4740444 - DNA, 14 bp, Homo sapiens
agggcccagagagg

SEQ ID NO: 4740445 - DNA, 12 bp, Homo sapiens
agggcctgactc

SEQ ID NO: 4740446 - DNA, 19 bp, Homo sapiens
agggcctggaagacagaga

SEQ ID NO: 4740447 - DNA, 17 bp, Homo sapiens
agggcctggcctgagct

SEQ ID NO: 4740448 - DNA, 15 bp, Homo sapiens
agggcgcaaagggca

SEQ ID NO: 4740449 - DNA, 17 bp, Homo sapiens
agggctaccctgagctg

SEQ ID NO: 4740450 - DNA, 18 bp, Homo sapiens
agggctaccctgagctga

SEQ ID NO: 4740451 - DNA, 20 bp, Homo sapiens
agggctaccctgagctgagg

SEQ ID NO: 4740452 - DNA, 21 bp, Homo sapiens
agggctagaacctagaagggc

SEQ ID NO: 4740453 - DNA, 22 bp, Homo sapiens
agggctagaacctagaagggct

SEQ ID NO: 4740454 - DNA, 17 bp, Homo sapiens
agggctagaacctggag

SEQ ID NO: 4740455 - DNA, 19 bp, Homo sapiens
agggctagaacctggagaa

SEQ ID NO: 4740456 - DNA, 18 bp, Homo sapiens
agggctagaacctggagg

SEQ ID NO: 4740457 - DNA, 17 bp, Homo sapiens
agggctagaactggaga

SEQ ID NO: 4740458 - DNA, 18 bp, Homo sapiens
agggctagaatctggaga

SEQ ID NO: 4740459 - DNA, 20 bp, Homo sapiens
agggctagaatctggagagc

SEQ ID NO: 4740460 - DNA, 20 bp, Homo sapiens
agggctagtagaactggatc

SEQ ID NO: 4740461 - DNA, 21 bp, Homo sapiens
agggctcagagaggacaaaat

SEQ ID NO: 4740462 - DNA, 22 bp, Homo sapiens
agggctcagagaggacaaaata

SEQ ID NO: 4740463 - DNA, 19 bp, Homo sapiens
agggctcagcggggacagc

SEQ ID NO: 4740464 - DNA, 22 bp, Homo sapiens
agggctcagcggggacagctcc

SEQ ID NO: 4740465 - DNA, 15 bp, Homo sapiens
agggctccagacaca

SEQ ID NO: 4740466 - DNA, 15 bp, Homo sapiens
agggctctgaccagt

SEQ ID NO: 4740467 - DNA, 18 bp, Homo sapiens
agggctgaataaagggaa

SEQ ID NO: 4740468 - DNA, 17 bp, Homo sapiens
agggctgctagacggag

SEQ ID NO: 4740469 - DNA, 16 bp, Homo sapiens
agggctggactgaggc

SEQ ID NO: 4740470 - DNA, 16 bp, Homo sapiens
aggggaaatgaatgtg

SEQ ID NO: 4740471 - DNA, 20 bp, Homo sapiens
aggggacgcaggcccctctc

SEQ ID NO: 4740472 - DNA, 16 bp, Homo sapiens
aggggatagagagaga

SEQ ID NO: 4740473 - DNA, 13 bp, Homo sapiens
aggggcaggcaca

SEQ ID NO: 4740474 - DNA, 16 bp, Homo sapiens
aggggcaggcacagca

SEQ ID NO: 4740475 - DNA, 23 bp, Homo sapiens
aggggcatttcacagtgcccaag

SEQ ID NO: 4740476 - DNA, 12 bp, Homo sapiens
aggggccagagg

SEQ ID NO: 4740477 - DNA, 17 bp, Homo sapiens
aggggccagaggctcgt

SEQ ID NO: 4740478 - DNA, 20 bp, Homo sapiens
aggggcccgcttgcctcggc

SEQ ID NO: 4740479 - DNA, 20 bp, Homo sapiens
aggggcccgttgtctccctg

SEQ ID NO: 4740480 - DNA, 15 bp, Homo sapiens
aggggcctgccacct

SEQ ID NO: 4740481 - DNA, 17 bp, Homo sapiens
aggggcctgccacctgg

SEQ ID NO: 4740482 - DNA, 20 bp, Homo sapiens
aggggctagaacctagagaa

SEQ ID NO: 4740483 - DNA, 12 bp, Homo sapiens
aggggctgcccg

SEQ ID NO: 4740484 - DNA, 15 bp, Homo sapiens
aggggctgcccgctc

SEQ ID NO: 4740485 - DNA, 16 bp, Homo sapiens
aggggctgcccgctcc

SEQ ID NO: 4740486 - DNA, 21 bp, Homo sapiens
aggggcttaattattgatgtt

SEQ ID NO: 4740487 - DNA, 23 bp, Homo sapiens
agggggaagtgagaagggctcag

SEQ ID NO: 4740488 - DNA, 14 bp, Homo sapiens
agggggctggagga

SEQ ID NO: 4740489 - DNA, 20 bp, Homo sapiens
aggggttttaggtctcttcc

SEQ ID NO: 4740490 - DNA, 16 bp, Homo sapiens
agggtatcaggtgctg

SEQ ID NO: 4740491 - DNA, 21 bp, Homo sapiens
agggtatcaggtgctgccatc

SEQ ID NO: 4740492 - DNA, 12 bp, Homo sapiens
agggtccctggt

SEQ ID NO: 4740493 - DNA, 17 bp, Homo sapiens
agggtccctggtggcag

SEQ ID NO: 4740494 - DNA, 20 bp, Homo sapiens
agggtccctggtggcagctc

SEQ ID NO: 4740495 - DNA, 12 bp, Homo sapiens
agggtcctgggg

SEQ ID NO: 4740496 - DNA, 15 bp, Homo sapiens
agggtcctggggaac

SEQ ID NO: 4740497 - DNA, 16 bp, Homo sapiens
agggtcggtgccttca

SEQ ID NO: 4740498 - DNA, 20 bp, Homo sapiens
agggtctcactatgttgccc

SEQ ID NO: 4740499 - DNA, 22 bp, Homo sapiens
agggtctcactatgttgcccag

SEQ ID NO: 4740500 - DNA, 14 bp, Homo sapiens
agggtctcactctg

SEQ ID NO: 4740501 - DNA, 16 bp, Homo sapiens
agggtctttgcagatg

SEQ ID NO: 4740502 - DNA, 22 bp, Homo sapiens
agggtgggctctaaatccatta

SEQ ID NO: 4740503 - DNA, 18 bp, Homo sapiens
agggtggtgacctctgcc

SEQ ID NO: 4740504 - DNA, 20 bp, Homo sapiens
agggtggttcaacaaagaaa

SEQ ID NO: 4740505 - DNA, 19 bp, Homo sapiens
agggtgtgtgttcaccttc

SEQ ID NO: 4740506 - DNA, 16 bp, Homo sapiens
agggttgaccccagag

SEQ ID NO: 4740507 - DNA, 22 bp, Homo sapiens
agggttttgccatgttggccag

SEQ ID NO: 4740508 - DNA, 20 bp, Homo sapiens
aggtaaaagcatcacatgaa

SEQ ID NO: 4740509 - DNA, 13 bp, Homo sapiens
aggtaaacagttc

SEQ ID NO: 4740510 - DNA, 14 bp, Homo sapiens
aggtaaacagttct

SEQ ID NO: 4740511 - DNA, 13 bp, Homo sapiens
aggtaacagaaca

SEQ ID NO: 4740512 - DNA, 18 bp, Homo sapiens
aggtaacagaacagcttc

SEQ ID NO: 4740513 - DNA, 19 bp, Homo sapiens
aggtaacagaacagcttca

SEQ ID NO: 4740514 - DNA, 23 bp, Homo sapiens
aggtaacagaacagcttcaggtt

SEQ ID NO: 4740515 - DNA, 17 bp, Homo sapiens
aggtaaggaatacctgt

SEQ ID NO: 4740516 - DNA, 16 bp, Homo sapiens
aggtaaggtgaaggtg

SEQ ID NO: 4740517 - DNA, 15 bp, Homo sapiens
aggtaattaaagtag

SEQ ID NO: 4740518 - DNA, 17 bp, Homo sapiens
aggtacaacctgttctg

SEQ ID NO: 4740519 - DNA, 13 bp, Homo sapiens
aggtataattaaa

SEQ ID NO: 4740520 - DNA, 15 bp, Homo sapiens
aggtatattgtgaac

SEQ ID NO: 4740521 - DNA, 21 bp, Homo sapiens
aggtatttttccaatcacagt

SEQ ID NO: 4740522 - DNA, 18 bp, Homo sapiens
aggtcagagcctgcagtt

SEQ ID NO: 4740523 - DNA, 16 bp, Homo sapiens
aggtccagccctggct

SEQ ID NO: 4740524 - DNA, 22 bp, Homo sapiens
aggtccagccctggctgaagga

SEQ ID NO: 4740525 - DNA, 17 bp, Homo sapiens
aggtcgtataatttagt

SEQ ID NO: 4740526 - DNA, 16 bp, Homo sapiens
aggtcgttcttatcta

SEQ ID NO: 4740527 - DNA, 15 bp, Homo sapiens
aggtctcctccaccg

SEQ ID NO: 4740528 - DNA, 18 bp, Homo sapiens
aggtctcctccaccgcca

SEQ ID NO: 4740529 - DNA, 23 bp, Homo sapiens
aggtctcgctgatgctgggctgg

SEQ ID NO: 4740530 - DNA, 12 bp, Homo sapiens
aggtctcttccc

SEQ ID NO: 4740531 - DNA, 13 bp, Homo sapiens
aggtctcttcccc

SEQ ID NO: 4740532 - DNA, 16 bp, Homo sapiens
aggtcttgacctgaac

SEQ ID NO: 4740533 - DNA, 23 bp, Homo sapiens
aggtcttgacctgaactctgcaa

SEQ ID NO: 4740534 - DNA, 14 bp, Homo sapiens
aggtcttttacata

SEQ ID NO: 4740535 - DNA, 21 bp, Homo sapiens
aggtcttttacatacagtgat

SEQ ID NO: 4740536 - DNA, 22 bp, Homo sapiens
aggtgacagagtgagactctgt

SEQ ID NO: 4740537 - DNA, 14 bp, Homo sapiens
aggtgacatgtgaa

SEQ ID NO: 4740538 - DNA, 15 bp, Homo sapiens
aggtgacatgtgaaa

SEQ ID NO: 4740539 - DNA, 16 bp, Homo sapiens
aggtgacatgtgaaac

SEQ ID NO: 4740540 - DNA, 20 bp, Homo sapiens
aggtgaccaaaatccccttc

SEQ ID NO: 4740541 - DNA, 20 bp, Homo sapiens
aggtgagcccatggccctcc

SEQ ID NO: 4740542 - DNA, 14 bp, Homo sapiens
aggtgatccaccca

SEQ ID NO: 4740543 - DNA, 21 bp, Homo sapiens
aggtgatccacccacctcagc

SEQ ID NO: 4740544 - DNA, 21 bp, Homo sapiens
aggtgcaacagacttgaatgc

SEQ ID NO: 4740545 - DNA, 16 bp, Homo sapiens
aggtgcacaagctcca

SEQ ID NO: 4740546 - DNA, 17 bp, Homo sapiens
aggtgcacaagctccaa

SEQ ID NO: 4740547 - DNA, 18 bp, Homo sapiens
aggtgcacaagctccaag

SEQ ID NO: 4740548 - DNA, 20 bp, Homo sapiens
aggtgctaatttgttttgga

SEQ ID NO: 4740549 - DNA, 22 bp, Homo sapiens
aggtgctaggaacactccttca

SEQ ID NO: 4740550 - DNA, 23 bp, Homo sapiens
aggtgctaggaacactccttcac

SEQ ID NO: 4740551 - DNA, 16 bp, Homo sapiens
aggtgctgccatccag

SEQ ID NO: 4740552 - DNA, 17 bp, Homo sapiens
aggtgctgccatccagg

SEQ ID NO: 4740553 - DNA, 18 bp, Homo sapiens
aggtggcaaggctgtgct

SEQ ID NO: 4740554 - DNA, 23 bp, Homo sapiens
aggtggcctctccttgtggcctg

SEQ ID NO: 4740555 - DNA, 16 bp, Homo sapiens
aggtgggcgggcagca

SEQ ID NO: 4740556 - DNA, 15 bp, Homo sapiens
aggtgggcttcccag

SEQ ID NO: 4740557 - DNA, 14 bp, Homo sapiens
aggtggggacaggg

SEQ ID NO: 4740558 - DNA, 18 bp, Homo sapiens
aggtggggagactgggct

SEQ ID NO: 4740559 - DNA, 19 bp, Homo sapiens
aggtggggagactgggctg

SEQ ID NO: 4740560 - DNA, 21 bp, Homo sapiens
aggtggggagactgggctgag

SEQ ID NO: 4740561 - DNA, 16 bp, Homo sapiens
aggtggggcagcttga

SEQ ID NO: 4740562 - DNA, 21 bp, Homo sapiens
aggtggggtggagtcccagag

SEQ ID NO: 4740563 - DNA, 22 bp, Homo sapiens
aggtggtctgctcgggcccagg

SEQ ID NO: 4740564 - DNA, 22 bp, Homo sapiens
aggtgtgaaccaccacacccag

SEQ ID NO: 4740565 - DNA, 23 bp, Homo sapiens
aggtgtgaaccaccacacccagc

SEQ ID NO: 4740566 - DNA, 20 bp, Homo sapiens
aggtgtgagtcaccaagccc

SEQ ID NO: 4740567 - DNA, 22 bp, Homo sapiens
aggtgtgagtcaccaagcccag

SEQ ID NO: 4740568 - DNA, 16 bp, Homo sapiens
aggtgttggtgacaat

SEQ ID NO: 4740569 - DNA, 19 bp, Homo sapiens
aggttatcgaaataacaat

SEQ ID NO: 4740570 - DNA, 16 bp, Homo sapiens
aggttatctgtcccag

SEQ ID NO: 4740571 - DNA, 22 bp, Homo sapiens
aggttccctttgacgccatccc

SEQ ID NO: 4740572 - DNA, 23 bp, Homo sapiens
aggttccgcttggagcagagggg

SEQ ID NO: 4740573 - DNA, 21 bp, Homo sapiens
aggttctaatattcacatgtt

SEQ ID NO: 4740574 - DNA, 18 bp, Homo sapiens
aggttggaaaagaaatca

SEQ ID NO: 4740575 - DNA, 22 bp, Homo sapiens
aggttgggccatactggcctcg

SEQ ID NO: 4740576 - DNA, 19 bp, Homo sapiens
aggtttcacttgcacatca

SEQ ID NO: 4740577 - DNA, 16 bp, Homo sapiens
aggtttctcaaagaaa

SEQ ID NO: 4740578 - DNA, 17 bp, Homo sapiens
aggtttgaccaggaaag

SEQ ID NO: 4740579 - DNA, 16 bp, Homo sapiens
aggttttatccttcct

SEQ ID NO: 4740580 - DNA, 20 bp, Homo sapiens
aggttttctgtgtttagcta

SEQ ID NO: 4740581 - DNA, 13 bp, Homo sapiens
agtaaaatccaca

SEQ ID NO: 4740582 - DNA, 15 bp, Homo sapiens
agtaaaattgtttca

SEQ ID NO: 4740583 - DNA, 17 bp, Homo sapiens
agtaaatatgtgaagaa

SEQ ID NO: 4740584 - DNA, 18 bp, Homo sapiens
agtaaatatgtgaagaaa

SEQ ID NO: 4740585 - DNA, 12 bp, Homo sapiens
agtaacctgggt

SEQ ID NO: 4740586 - DNA, 15 bp, Homo sapiens
agtacaagggctgag

SEQ ID NO: 4740587 - DNA, 15 bp, Homo sapiens
agtacccaaaagctc

SEQ ID NO: 4740588 - DNA, 19 bp, Homo sapiens
agtacttctccaccctgct

SEQ ID NO: 4740589 - DNA, 20 bp, Homo sapiens
agtacttctccaccctgctc

SEQ ID NO: 4740590 - DNA, 12 bp, Homo sapiens
agtacttctttt

SEQ ID NO: 4740591 - DNA, 12 bp, Homo sapiens
agtagagacagg

SEQ ID NO: 4740592 - DNA, 22 bp, Homo sapiens
agtagagcttgtaataaatact

SEQ ID NO: 4740593 - DNA, 20 bp, Homo sapiens
agtagatgtggcctttgaat

SEQ ID NO: 4740594 - DNA, 22 bp, Homo sapiens
agtagattatggcctttttaag

SEQ ID NO: 4740595 - DNA, 23 bp, Homo sapiens
agtagattatggcctttttaagt

SEQ ID NO: 4740596 - DNA, 20 bp, Homo sapiens
agtagccaaagttaaatgta

SEQ ID NO: 4740597 - DNA, 17 bp, Homo sapiens
agtaggaagactttgga

SEQ ID NO: 4740598 - DNA, 22 bp, Homo sapiens
agtaggaagactttggaaagac

SEQ ID NO: 4740599 - DNA, 17 bp, Homo sapiens
agtaggggttgaagaaa

SEQ ID NO: 4740600 - DNA, 13 bp, Homo sapiens
agtataaaatagt

SEQ ID NO: 4740601 - DNA, 13 bp, Homo sapiens
agtataaaattat

SEQ ID NO: 4740602 - DNA, 14 bp, Homo sapiens
agtataacaaacta

SEQ ID NO: 4740603 - DNA, 12 bp, Homo sapiens
agtataagattt

SEQ ID NO: 4740604 - DNA, 18 bp, Homo sapiens
agtataagatttttgaaa

SEQ ID NO: 4740605 - DNA, 14 bp, Homo sapiens
agtatggagctcag

SEQ ID NO: 4740606 - DNA, 14 bp, Homo sapiens
agtatggtggctgg

SEQ ID NO: 4740607 - DNA, 20 bp, Homo sapiens
agtatgtatattaaaaaaga

SEQ ID NO: 4740608 - DNA, 22 bp, Homo sapiens
agtatgtatattaaaaaagaga

SEQ ID NO: 4740609 - DNA, 16 bp, Homo sapiens
agtattagacttctaa

SEQ ID NO: 4740610 - DNA, 15 bp, Homo sapiens
agtattgtttacatt

SEQ ID NO: 4740611 - DNA, 14 bp, Homo sapiens
agtattttaatcct

SEQ ID NO: 4740612 - DNA, 15 bp, Homo sapiens
agtcaaactgtgcca

SEQ ID NO: 4740613 - DNA, 14 bp, Homo sapiens
agtcaaatttacat

SEQ ID NO: 4740614 - DNA, 15 bp, Homo sapiens
agtcaaatttacatt

SEQ ID NO: 4740615 - DNA, 14 bp, Homo sapiens
agtcaacctgggca

SEQ ID NO: 4740616 - DNA, 23 bp, Homo sapiens
agtcaaggactggtaaaatacat

SEQ ID NO: 4740617 - DNA, 23 bp, Homo sapiens
agtcacacagtattacttctgct

SEQ ID NO: 4740618 - DNA, 23 bp, Homo sapiens
agtcacacagtgagtcgaggaca

SEQ ID NO: 4740619 - DNA, 18 bp, Homo sapiens
agtcacacattacaaagt

SEQ ID NO: 4740620 - DNA, 13 bp, Homo sapiens
agtcaccaagccc

SEQ ID NO: 4740621 - DNA, 18 bp, Homo sapiens
agtcacgtggaggagcag

SEQ ID NO: 4740622 - DNA, 21 bp, Homo sapiens
agtcacgtggaggagcagtgc

SEQ ID NO: 4740623 - DNA, 16 bp, Homo sapiens
agtcactgagacagcc

SEQ ID NO: 4740624 - DNA, 24 bp, Homo sapiens
agtcacttcgtgggatctgcccct

SEQ ID NO: 4740625 - DNA, 16 bp, Homo sapiens
agtcagctgaccccct

SEQ ID NO: 4740626 - DNA, 19 bp, Homo sapiens
agtcagctgaccccctccc

SEQ ID NO: 4740627 - DNA, 23 bp, Homo sapiens
agtcagctgaccccctcccccca

SEQ ID NO: 4740628 - DNA, 12 bp, Homo sapiens
agtcagtattcc

SEQ ID NO: 4740629 - DNA, 13 bp, Homo sapiens
agtcatgcataaa

SEQ ID NO: 4740630 - DNA, 14 bp, Homo sapiens
agtcatgcataaat

SEQ ID NO: 4740631 - DNA, 17 bp, Homo sapiens
agtcatgcataaatatg

SEQ ID NO: 4740632 - DNA, 21 bp, Homo sapiens
agtcatgcataaatatgcagt

SEQ ID NO: 4740633 - DNA, 14 bp, Homo sapiens
agtcatttttgttt

SEQ ID NO: 4740634 - DNA, 18 bp, Homo sapiens
agtccaaggaaaccacag

SEQ ID NO: 4740635 - DNA, 13 bp, Homo sapiens
agtccattaactg

SEQ ID NO: 4740636 - DNA, 20 bp, Homo sapiens
agtcccaccttggctgcagg

SEQ ID NO: 4740637 - DNA, 12 bp, Homo sapiens
agtcccagagct

SEQ ID NO: 4740638 - DNA, 15 bp, Homo sapiens
agtcccagagctgca

SEQ ID NO: 4740639 - DNA, 21 bp, Homo sapiens
agtcccagagctgcacagggt

SEQ ID NO: 4740640 - DNA, 19 bp, Homo sapiens
agtcccctgtttgtttctg

SEQ ID NO: 4740641 - DNA, 13 bp, Homo sapiens
agtccctgccaat

SEQ ID NO: 4740642 - DNA, 16 bp, Homo sapiens
agtccctgtgttctgc

SEQ ID NO: 4740643 - DNA, 19 bp, Homo sapiens
agtcccttccacaccccca

SEQ ID NO: 4740644 - DNA, 20 bp, Homo sapiens
agtcctcaaggggccatcct

SEQ ID NO: 4740645 - DNA, 13 bp, Homo sapiens
agtcctctccacc

SEQ ID NO: 4740646 - DNA, 12 bp, Homo sapiens
agtcctgtaatg

SEQ ID NO: 4740647 - DNA, 18 bp, Homo sapiens
agtccttaccagcagagc

SEQ ID NO: 4740648 - DNA, 20 bp, Homo sapiens
agtccttaccagcagagcac

SEQ ID NO: 4740649 - DNA, 18 bp, Homo sapiens
agtcgcgctgcctgtgtg

SEQ ID NO: 4740650 - DNA, 11 bp, Homo sapiens
agtctatggcc

SEQ ID NO: 4740651 - DNA, 16 bp, Homo sapiens
agtctcaattttgtat

SEQ ID NO: 4740652 - DNA, 17 bp, Homo sapiens
agtctcaattttgtatt

SEQ ID NO: 4740653 - DNA, 18 bp, Homo sapiens
agtctcaattttgtattt

SEQ ID NO: 4740654 - DNA, 19 bp, Homo sapiens
agtctcaattttgtattta

SEQ ID NO: 4740655 - DNA, 21 bp, Homo sapiens
agtctcaattttgtatttaat

SEQ ID NO: 4740656 - DNA, 16 bp, Homo sapiens
agtctcactgttgccc

SEQ ID NO: 4740657 - DNA, 14 bp, Homo sapiens
agtctcgaatgtaa

SEQ ID NO: 4740658 - DNA, 12 bp, Homo sapiens
agtctctgaaca

SEQ ID NO: 4740659 - DNA, 16 bp, Homo sapiens
agtctgaaggctgggt

SEQ ID NO: 4740660 - DNA, 17 bp, Homo sapiens
agtctgaaggctgggtt

SEQ ID NO: 4740661 - DNA, 18 bp, Homo sapiens
agtctgaggcacctgcat

SEQ ID NO: 4740662 - DNA, 15 bp, Homo sapiens
agtctgagtaagaaa

SEQ ID NO: 4740663 - DNA, 21 bp, Homo sapiens
agtctggcaaacatgtgcaac

SEQ ID NO: 4740664 - DNA, 21 bp, Homo sapiens
agtctgtatttttaaagcatg

SEQ ID NO: 4740665 - DNA, 14 bp, Homo sapiens
agtctgtcctggaa

SEQ ID NO: 4740666 - DNA, 16 bp, Homo sapiens
agtcttgcagcaggat

SEQ ID NO: 4740667 - DNA, 12 bp, Homo sapiens
agtcttgcattg

SEQ ID NO: 4740668 - DNA, 13 bp, Homo sapiens
agtcttttccatg

SEQ ID NO: 4740669 - DNA, 15 bp, Homo sapiens
agtgaaagaaaataa

SEQ ID NO: 4740670 - DNA, 17 bp, Homo sapiens
agtgaaagaaaataaca

SEQ ID NO: 4740671 - DNA, 14 bp, Homo sapiens
agtgaaagcatcac

SEQ ID NO: 4740672 - DNA, 15 bp, Homo sapiens
agtgaacagtttgga

SEQ ID NO: 4740673 - DNA, 16 bp, Homo sapiens
agtgaatgattcagtg

SEQ ID NO: 4740674 - DNA, 17 bp, Homo sapiens
agtgaatgattcagtgt

SEQ ID NO: 4740675 - DNA, 19 bp, Homo sapiens
agtgaatttgtccattgta

SEQ ID NO: 4740676 - DNA, 14 bp, Homo sapiens
agtgacaaaagctc

SEQ ID NO: 4740677 - DNA, 15 bp, Homo sapiens
agtgactcgggctcc

SEQ ID NO: 4740678 - DNA, 19 bp, Homo sapiens
agtgactcgggctcctgtg

SEQ ID NO: 4740679 - DNA, 22 bp, Homo sapiens
agtgactcgggctcctgtgccc

SEQ ID NO: 4740680 - DNA, 15 bp, Homo sapiens
agtgactgttgtacc

SEQ ID NO: 4740681 - DNA, 22 bp, Homo sapiens
agtgagaagggctcagagagga

SEQ ID NO: 4740682 - DNA, 21 bp, Homo sapiens
agtgagacagtccagcctgga

SEQ ID NO: 4740683 - DNA, 17 bp, Homo sapiens
agtgagactctgtctca

SEQ ID NO: 4740684 - DNA, 16 bp, Homo sapiens
agtgagctctatgggc

SEQ ID NO: 4740685 - DNA, 17 bp, Homo sapiens
agtgagctctatgggca

SEQ ID NO: 4740686 - DNA, 12 bp, Homo sapiens
agtgagctggtt

SEQ ID NO: 4740687 - DNA, 19 bp, Homo sapiens
agtgaggctctgcccttgg

SEQ ID NO: 4740688 - DNA, 14 bp, Homo sapiens
agtgagggattatc

SEQ ID NO: 4740689 - DNA, 16 bp, Homo sapiens
agtgagtcgaggacag

SEQ ID NO: 4740690 - DNA, 22 bp, Homo sapiens
agtgagttgatagcacagaccc

SEQ ID NO: 4740691 - DNA, 14 bp, Homo sapiens
agtgatatggcaga

SEQ ID NO: 4740692 - DNA, 19 bp, Homo sapiens
agtgatatggcagaagaca

SEQ ID NO: 4740693 - DNA, 21 bp, Homo sapiens
agtgatatggcagaagacacc

SEQ ID NO: 4740694 - DNA, 17 bp, Homo sapiens
agtgatcaccagcgtga

SEQ ID NO: 4740695 - DNA, 22 bp, Homo sapiens
agtgatcctcccacctcagcct

SEQ ID NO: 4740696 - DNA, 18 bp, Homo sapiens
agtgattctcatgcctca

SEQ ID NO: 4740697 - DNA, 15 bp, Homo sapiens
agtgattctcctgcc

SEQ ID NO: 4740698 - DNA, 24 bp, Homo sapiens
agtgattctcctgcctcagcctcc

SEQ ID NO: 4740699 - DNA, 15 bp, Homo sapiens
agtgccagcccctgc

SEQ ID NO: 4740700 - DNA, 14 bp, Homo sapiens
agtgcccacaggat

SEQ ID NO: 4740701 - DNA, 13 bp, Homo sapiens
agtgcccattcct

SEQ ID NO: 4740702 - DNA, 16 bp, Homo sapiens
agtgccgccgcctcgc

SEQ ID NO: 4740703 - DNA, 19 bp, Homo sapiens
agtgcggtttactcactgc

SEQ ID NO: 4740704 - DNA, 15 bp, Homo sapiens
agtgcgtccacgagc

SEQ ID NO: 4740705 - DNA, 15 bp, Homo sapiens
agtgctatgaagaca

SEQ ID NO: 4740706 - DNA, 14 bp, Homo sapiens
agtgctccctcaca

SEQ ID NO: 4740707 - DNA, 16 bp, Homo sapiens
agtgctctgatccctc

SEQ ID NO: 4740708 - DNA, 17 bp, Homo sapiens
agtgctctgatccctct

SEQ ID NO: 4740709 - DNA, 19 bp, Homo sapiens
agtgctgggattacaggtg

SEQ ID NO: 4740710 - DNA, 13 bp, Homo sapiens
agtgcttcttgta

SEQ ID NO: 4740711 - DNA, 18 bp, Homo sapiens
agtgcttcttgtaatatt

SEQ ID NO: 4740712 - DNA, 15 bp, Homo sapiens
agtgcttgccacaga

SEQ ID NO: 4740713 - DNA, 20 bp, Homo sapiens
agtggaagtatgtatattaa

SEQ ID NO: 4740714 - DNA, 21 bp, Homo sapiens
agtggaagtatgtatattaaa

SEQ ID NO: 4740715 - DNA, 14 bp, Homo sapiens
agtggagagggcta

SEQ ID NO: 4740716 - DNA, 19 bp, Homo sapiens
agtggagttgaaactgcta

SEQ ID NO: 4740717 - DNA, 20 bp, Homo sapiens
agtggagttgaaactgctat

SEQ ID NO: 4740718 - DNA, 15 bp, Homo sapiens
agtggatcacaaagt

SEQ ID NO: 4740719 - DNA, 16 bp, Homo sapiens
agtggatcacaaagtg

SEQ ID NO: 4740720 - DNA, 17 bp, Homo sapiens
agtggatggaaggggct

SEQ ID NO: 4740721 - DNA, 11 bp, Homo sapiens
agtggcagctg

SEQ ID NO: 4740722 - DNA, 12 bp, Homo sapiens
agtggcagctgc

SEQ ID NO: 4740723 - DNA, 13 bp, Homo sapiens
agtggcagctgct

SEQ ID NO: 4740724 - DNA, 23 bp, Homo sapiens
agtggcatgtgggttgtgatatt

SEQ ID NO: 4740725 - DNA, 20 bp, Homo sapiens
agtggcattggcagcaggtg

SEQ ID NO: 4740726 - DNA, 13 bp, Homo sapiens
agtggctgctgcc

SEQ ID NO: 4740727 - DNA, 14 bp, Homo sapiens
agtggctgctgccc

SEQ ID NO: 4740728 - DNA, 17 bp, Homo sapiens
agtggctgctgcccagg

SEQ ID NO: 4740729 - DNA, 13 bp, Homo sapiens
agtggctgtccag

SEQ ID NO: 4740730 - DNA, 18 bp, Homo sapiens
agtggctgtccagtgccc

SEQ ID NO: 4740731 - DNA, 19 bp, Homo sapiens
agtggctgtccagtgccca

SEQ ID NO: 4740732 - DNA, 19 bp, Homo sapiens
agtggcttcattagagcag

SEQ ID NO: 4740733 - DNA, 17 bp, Homo sapiens
agtgggagatgaaaacc

SEQ ID NO: 4740734 - DNA, 14 bp, Homo sapiens
agtgggagctgcct

SEQ ID NO: 4740735 - DNA, 21 bp, Homo sapiens
agtgggtcccacttcccctcc

SEQ ID NO: 4740736 - DNA, 14 bp, Homo sapiens
agtggtatagaaat

SEQ ID NO: 4740737 - DNA, 17 bp, Homo sapiens
agtggtctttgtaagag

SEQ ID NO: 4740738 - DNA, 18 bp, Homo sapiens
agtggtctttgtaagagt

SEQ ID NO: 4740739 - DNA, 21 bp, Homo sapiens
agtggtctttgtaagagtgta

SEQ ID NO: 4740740 - DNA, 22 bp, Homo sapiens
agtggtctttgtaagagtgtag

SEQ ID NO: 4740741 - DNA, 21 bp, Homo sapiens
agtggtgttggcagtgtttgt

SEQ ID NO: 4740742 - DNA, 18 bp, Homo sapiens
agtggttgggctgtgcct

SEQ ID NO: 4740743 - DNA, 13 bp, Homo sapiens
agtgtacagtctt

SEQ ID NO: 4740744 - DNA, 15 bp, Homo sapiens
agtgtacagtcttgt

SEQ ID NO: 4740745 - DNA, 20 bp, Homo sapiens
agtgtacccccgcccaggct

SEQ ID NO: 4740746 - DNA, 23 bp, Homo sapiens
agtgtacccccgcccaggctggc

SEQ ID NO: 4740747 - DNA, 16 bp, Homo sapiens
agtgtagaagcattcc

SEQ ID NO: 4740748 - DNA, 18 bp, Homo sapiens
agtgtagaagcattcctt

SEQ ID NO: 4740749 - DNA, 22 bp, Homo sapiens
agtgtagaagcattccttcttt

SEQ ID NO: 4740750 - DNA, 17 bp, Homo sapiens
agtgtattaggaagtgt

SEQ ID NO: 4740751 - DNA, 16 bp, Homo sapiens
agtgtctgtgttttga

SEQ ID NO: 4740752 - DNA, 23 bp, Homo sapiens
agtgtctttccacggagccactc

SEQ ID NO: 4740753 - DNA, 23 bp, Homo sapiens
agtgtgacaaggattgctactgt

SEQ ID NO: 4740754 - DNA, 17 bp, Homo sapiens
agtgtggtgtttcctgg

SEQ ID NO: 4740755 - DNA, 20 bp, Homo sapiens
agtgtggtgtttcctggcac

SEQ ID NO: 4740756 - DNA, 22 bp, Homo sapiens
agtgtggtgtttcctggcactg

SEQ ID NO: 4740757 - DNA, 19 bp, Homo sapiens
agtgtgtatttaactctgt

SEQ ID NO: 4740758 - DNA, 19 bp, Homo sapiens
agtgtgtggtcaacatttc

SEQ ID NO: 4740759 - DNA, 13 bp, Homo sapiens
agtgttaaagtga

SEQ ID NO: 4740760 - DNA, 18 bp, Homo sapiens
agttaaatgtatcacatt

SEQ ID NO: 4740761 - DNA, 15 bp, Homo sapiens
agttaagaagctgtt

SEQ ID NO: 4740762 - DNA, 16 bp, Homo sapiens
agttaagaagctgttg

SEQ ID NO: 4740763 - DNA, 11 bp, Homo sapiens
agttaattttt

SEQ ID NO: 4740764 - DNA, 13 bp, Homo sapiens
agttacacatttt

SEQ ID NO: 4740765 - DNA, 16 bp, Homo sapiens
agttacacatttttca

SEQ ID NO: 4740766 - DNA, 22 bp, Homo sapiens
agttaccattatttaatttgta

SEQ ID NO: 4740767 - DNA, 23 bp, Homo sapiens
agttactatcatgtcaaacgtga

SEQ ID NO: 4740768 - DNA, 18 bp, Homo sapiens
agttagcaactagggcta

SEQ ID NO: 4740769 - DNA, 17 bp, Homo sapiens
agttagggaatggcaca

SEQ ID NO: 4740770 - DNA, 20 bp, Homo sapiens
agttatacttatttgtatat

SEQ ID NO: 4740771 - DNA, 18 bp, Homo sapiens
agttattcataaagagaa

SEQ ID NO: 4740772 - DNA, 23 bp, Homo sapiens
agttattcttggtactgttgctt

SEQ ID NO: 4740773 - DNA, 11 bp, Homo sapiens
agttcactttt

SEQ ID NO: 4740774 - DNA, 16 bp, Homo sapiens
agttcagatacagggt

SEQ ID NO: 4740775 - DNA, 21 bp, Homo sapiens
agttcagcgctgtcaggattg

SEQ ID NO: 4740776 - DNA, 15 bp, Homo sapiens
agttcataaatttgt

SEQ ID NO: 4740777 - DNA, 14 bp, Homo sapiens
agttcataccctgt

SEQ ID NO: 4740778 - DNA, 15 bp, Homo sapiens
agttccagtgctgca

SEQ ID NO: 4740779 - DNA, 19 bp, Homo sapiens
agttccagttttgttttga

SEQ ID NO: 4740780 - DNA, 16 bp, Homo sapiens
agttccccatgcagac

SEQ ID NO: 4740781 - DNA, 20 bp, Homo sapiens
agttccctttatttcacata

SEQ ID NO: 4740782 - DNA, 21 bp, Homo sapiens
agttcgatgggcccaattctt

SEQ ID NO: 4740783 - DNA, 20 bp, Homo sapiens
agttcggtgagctacaaatg

SEQ ID NO: 4740784 - DNA, 18 bp, Homo sapiens
agttgaaaaaagaagttt

SEQ ID NO: 4740785 - DNA, 23 bp, Homo sapiens
agttgatagcacagaccctgccc

SEQ ID NO: 4740786 - DNA, 19 bp, Homo sapiens
agttgatatagaacagtgc

SEQ ID NO: 4740787 - DNA, 19 bp, Homo sapiens
agttgcaccattctttctt

SEQ ID NO: 4740788 - DNA, 15 bp, Homo sapiens
agttgcactcaggtg

SEQ ID NO: 4740789 - DNA, 10 bp, Homo sapiens
agttgcagcc

SEQ ID NO: 4740790 - DNA, 22 bp, Homo sapiens
agttgcatgaccacatagaaca

SEQ ID NO: 4740791 - DNA, 21 bp, Homo sapiens
agttgcatggcatcacctcca

SEQ ID NO: 4740792 - DNA, 15 bp, Homo sapiens
agttgccacatttag

SEQ ID NO: 4740793 - DNA, 20 bp, Homo sapiens
agttgccagtcaccccggcc

SEQ ID NO: 4740794 - DNA, 13 bp, Homo sapiens
agttggcttctaa

SEQ ID NO: 4740795 - DNA, 13 bp, Homo sapiens
agttgggcttcct

SEQ ID NO: 4740796 - DNA, 21 bp, Homo sapiens
agttgggtggatgcctggtgg

SEQ ID NO: 4740797 - DNA, 14 bp, Homo sapiens
agttgtctttcttt

SEQ ID NO: 4740798 - DNA, 20 bp, Homo sapiens
agttgtttgattcagacagc

SEQ ID NO: 4740799 - DNA, 21 bp, Homo sapiens
agttgtttgattcagacagct

SEQ ID NO: 4740800 - DNA, 14 bp, Homo sapiens
agtttaagtctcct

SEQ ID NO: 4740801 - DNA, 14 bp, Homo sapiens
agtttaattctgtt

SEQ ID NO: 4740802 - DNA, 18 bp, Homo sapiens
agtttaattgacttattt

SEQ ID NO: 4740803 - DNA, 13 bp, Homo sapiens
agtttctccaagc

SEQ ID NO: 4740804 - DNA, 14 bp, Homo sapiens
agtttctcttttca

SEQ ID NO: 4740805 - DNA, 17 bp, Homo sapiens
agtttcttagcttttta

SEQ ID NO: 4740806 - DNA, 13 bp, Homo sapiens
agtttcttgcttg

SEQ ID NO: 4740807 - DNA, 18 bp, Homo sapiens
agtttgattattcagtgt

SEQ ID NO: 4740808 - DNA, 18 bp, Homo sapiens
agtttgtcacatgaaaca

SEQ ID NO: 4740809 - DNA, 17 bp, Homo sapiens
agtttgtggtaatttgt

SEQ ID NO: 4740810 - DNA, 20 bp, Homo sapiens
agttttacacgaactgaaat

SEQ ID NO: 4740811 - DNA, 15 bp, Homo sapiens
agttttgaaaagcta

SEQ ID NO: 4740812 - DNA, 16 bp, Homo sapiens
agttttgaaaagctat

SEQ ID NO: 4740813 - DNA, 18 bp, Homo sapiens
agttttgaagattctatg

SEQ ID NO: 4740814 - DNA, 15 bp, Homo sapiens
agttttgtaaatttc

SEQ ID NO: 4740815 - DNA, 16 bp, Homo sapiens
agttttgttctgtata

SEQ ID NO: 4740816 - DNA, 19 bp, Homo sapiens
agtttttaatatttattga

SEQ ID NO: 4740817 - DNA, 16 bp, Homo sapiens
ataaaaccaagcctct

SEQ ID NO: 4740818 - DNA, 17 bp, Homo sapiens
ataaaaccaagcctctg

SEQ ID NO: 4740819 - DNA, 20 bp, Homo sapiens
ataaaaggtcggaccagctt

SEQ ID NO: 4740820 - DNA, 21 bp, Homo sapiens
ataaaagtacatgttaaactt

SEQ ID NO: 4740821 - DNA, 16 bp, Homo sapiens
ataaaataattctaaa

SEQ ID NO: 4740822 - DNA, 18 bp, Homo sapiens
ataaaataattctaaagg

SEQ ID NO: 4740823 - DNA, 18 bp, Homo sapiens
ataaaatccaatattgta

SEQ ID NO: 4740824 - DNA, 12 bp, Homo sapiens
ataaaattttct

SEQ ID NO: 4740825 - DNA, 16 bp, Homo sapiens
ataaacaatccaaatg

SEQ ID NO: 4740826 - DNA, 21 bp, Homo sapiens
ataaacagaaatgctctgatt

SEQ ID NO: 4740827 - DNA, 23 bp, Homo sapiens
ataaagaaggatgatgtcttttt

SEQ ID NO: 4740828 - DNA, 11 bp, Homo sapiens
ataaagaatgg

SEQ ID NO: 4740829 - DNA, 12 bp, Homo sapiens
ataaagagaaaa

SEQ ID NO: 4740830 - DNA, 23 bp, Homo sapiens
ataaagattaacactcatttcca

SEQ ID NO: 4740831 - DNA, 16 bp, Homo sapiens
ataaagcaaattactc

SEQ ID NO: 4740832 - DNA, 18 bp, Homo sapiens
ataaagtaaatacatgca

SEQ ID NO: 4740833 - DNA, 13 bp, Homo sapiens
ataaagtgacaaa

SEQ ID NO: 4740834 - DNA, 23 bp, Homo sapiens
ataaagtgcacacctttattcag

SEQ ID NO: 4740835 - DNA, 17 bp, Homo sapiens
ataaatatagttgtctt

SEQ ID NO: 4740836 - DNA, 17 bp, Homo sapiens
ataaatcaattcatgtt

SEQ ID NO: 4740837 - DNA, 19 bp, Homo sapiens
ataaatcattcttactaaa

SEQ ID NO: 4740838 - DNA, 20 bp, Homo sapiens
ataaatcattcttactaaaa

SEQ ID NO: 4740839 - DNA, 21 bp, Homo sapiens
ataaatctaatgacattcaat

SEQ ID NO: 4740840 - DNA, 18 bp, Homo sapiens
ataaatgtaccagagaga

SEQ ID NO: 4740841 - DNA, 15 bp, Homo sapiens
ataaattatgataat

SEQ ID NO: 4740842 - DNA, 14 bp, Homo sapiens
ataaattgatttgt

SEQ ID NO: 4740843 - DNA, 20 bp, Homo sapiens
ataaatttgaactccatggg

SEQ ID NO: 4740844 - DNA, 17 bp, Homo sapiens
ataaatttgttgtcatg

SEQ ID NO: 4740845 - DNA, 22 bp, Homo sapiens
ataaatttgttgtcatgtgtat

SEQ ID NO: 4740846 - DNA, 15 bp, Homo sapiens
ataaattttttataa

SEQ ID NO: 4740847 - DNA, 22 bp, Homo sapiens
ataaattttttttgtttcatat

SEQ ID NO: 4740848 - DNA, 14 bp, Homo sapiens
ataacaatgttaag

SEQ ID NO: 4740849 - DNA, 18 bp, Homo sapiens
ataacaatgttaaggaaa

SEQ ID NO: 4740850 - DNA, 13 bp, Homo sapiens
ataacacacagct

SEQ ID NO: 4740851 - DNA, 23 bp, Homo sapiens
ataacacacagctaacacacagc

SEQ ID NO: 4740852 - DNA, 17 bp, Homo sapiens
ataacatagttgaaaaa

SEQ ID NO: 4740853 - DNA, 23 bp, Homo sapiens
ataacatagttgaaaaaagaagt

SEQ ID NO: 4740854 - DNA, 15 bp, Homo sapiens
ataacattttgttta

SEQ ID NO: 4740855 - DNA, 16 bp, Homo sapiens
ataacattttgtttat

SEQ ID NO: 4740856 - DNA, 15 bp, Homo sapiens
ataacgtttttcctt

SEQ ID NO: 4740857 - DNA, 17 bp, Homo sapiens
ataacgtttttccttta

SEQ ID NO: 4740858 - DNA, 15 bp, Homo sapiens
ataactatgttgata

SEQ ID NO: 4740859 - DNA, 18 bp, Homo sapiens
ataacttttttttaagtt

SEQ ID NO: 4740860 - DNA, 15 bp, Homo sapiens
ataagaagaagagag

SEQ ID NO: 4740861 - DNA, 22 bp, Homo sapiens
ataagaccaccacctcagagta

SEQ ID NO: 4740862 - DNA, 16 bp, Homo sapiens
ataagagtagaaactg

SEQ ID NO: 4740863 - DNA, 14 bp, Homo sapiens
ataagatttttgaa

SEQ ID NO: 4740864 - DNA, 23 bp, Homo sapiens
ataagatttttgaaaatcctgaa

SEQ ID NO: 4740865 - DNA, 16 bp, Homo sapiens
ataagccatttctact

SEQ ID NO: 4740866 - DNA, 14 bp, Homo sapiens
ataagctattttgg

SEQ ID NO: 4740867 - DNA, 18 bp, Homo sapiens
ataagtatttcaaattgg

SEQ ID NO: 4740868 - DNA, 19 bp, Homo sapiens
ataagtatttcaaattgga

SEQ ID NO: 4740869 - DNA, 23 bp, Homo sapiens
ataagtgacaccaataaatgttt

SEQ ID NO: 4740870 - DNA, 15 bp, Homo sapiens
ataagtggtgtgtgt

SEQ ID NO: 4740871 - DNA, 13 bp, Homo sapiens
ataataaatcaca

SEQ ID NO: 4740872 - DNA, 14 bp, Homo sapiens
ataataaatcacac

SEQ ID NO: 4740873 - DNA, 14 bp, Homo sapiens
ataataaattgatt

SEQ ID NO: 4740874 - DNA, 20 bp, Homo sapiens
ataatacagatttgtaacat

SEQ ID NO: 4740875 - DNA, 16 bp, Homo sapiens
ataatatattgctaaa

SEQ ID NO: 4740876 - DNA, 12 bp, Homo sapiens
ataatattcatt

SEQ ID NO: 4740877 - DNA, 14 bp, Homo sapiens
ataatattcattgg

SEQ ID NO: 4740878 - DNA, 16 bp, Homo sapiens
ataatattcattggtt

SEQ ID NO: 4740879 - DNA, 17 bp, Homo sapiens
ataatcttttacattga

SEQ ID NO: 4740880 - DNA, 17 bp, Homo sapiens
ataatgcctaccttgtg

SEQ ID NO: 4740881 - DNA, 16 bp, Homo sapiens
ataatgtgaaaatggt

SEQ ID NO: 4740882 - DNA, 12 bp, Homo sapiens
ataatgttaaat

SEQ ID NO: 4740883 - DNA, 14 bp, Homo sapiens
ataattaaacttct

SEQ ID NO: 4740884 - DNA, 21 bp, Homo sapiens
ataatttaaaaatatatttat

SEQ ID NO: 4740885 - DNA, 15 bp, Homo sapiens
ataattttaaagtaa

SEQ ID NO: 4740886 - DNA, 15 bp, Homo sapiens
atacaaaaatttgcc

SEQ ID NO: 4740887 - DNA, 22 bp, Homo sapiens
atacaagtgataatacagattt

SEQ ID NO: 4740888 - DNA, 15 bp, Homo sapiens
atacagaactctttc

SEQ ID NO: 4740889 - DNA, 16 bp, Homo sapiens
atacagaactctttca

SEQ ID NO: 4740890 - DNA, 23 bp, Homo sapiens
atacagacacatttacactagag

SEQ ID NO: 4740891 - DNA, 21 bp, Homo sapiens
atacagagtacgttaaaagca

SEQ ID NO: 4740892 - DNA, 19 bp, Homo sapiens
atacaggattattttgatt

SEQ ID NO: 4740893 - DNA, 21 bp, Homo sapiens
atacagttcggtgagctacaa

SEQ ID NO: 4740894 - DNA, 16 bp, Homo sapiens
atacataaaagaaata

SEQ ID NO: 4740895 - DNA, 18 bp, Homo sapiens
atacataaaagaaataaa

SEQ ID NO: 4740896 - DNA, 20 bp, Homo sapiens
atacataaaagaaataaacc

SEQ ID NO: 4740897 - DNA, 12 bp, Homo sapiens
atacatatttca

SEQ ID NO: 4740898 - DNA, 13 bp, Homo sapiens
atacatttgttgg

SEQ ID NO: 4740899 - DNA, 21 bp, Homo sapiens
ataccaatgaaaaaatgtata

SEQ ID NO: 4740900 - DNA, 16 bp, Homo sapiens
ataccacccaatgctg

SEQ ID NO: 4740901 - DNA, 11 bp, Homo sapiens
atacccacccc

SEQ ID NO: 4740902 - DNA, 12 bp, Homo sapiens
atacccaccccc

SEQ ID NO: 4740903 - DNA, 13 bp, Homo sapiens
atacccaccccca

SEQ ID NO: 4740904 - DNA, 20 bp, Homo sapiens
ataccccctgcaaagcccag

SEQ ID NO: 4740905 - DNA, 17 bp, Homo sapiens
atacctgtccccctgac

SEQ ID NO: 4740906 - DNA, 18 bp, Homo sapiens
atacctgtccccctgaca

SEQ ID NO: 4740907 - DNA, 12 bp, Homo sapiens
atacctttgaaa

SEQ ID NO: 4740908 - DNA, 13 bp, Homo sapiens
atacgataaataa

SEQ ID NO: 4740909 - DNA, 14 bp, Homo sapiens
atactcaagcaggt

SEQ ID NO: 4740910 - DNA, 14 bp, Homo sapiens
atactcccatctgt

SEQ ID NO: 4740911 - DNA, 16 bp, Homo sapiens
atactccctttaaaga

SEQ ID NO: 4740912 - DNA, 16 bp, Homo sapiens
atactgatttttaagt

SEQ ID NO: 4740913 - DNA, 20 bp, Homo sapiens
atactgccttgtttaatggt

SEQ ID NO: 4740914 - DNA, 12 bp, Homo sapiens
atactggactca

SEQ ID NO: 4740915 - DNA, 20 bp, Homo sapiens
atactgtgctggagccacta

SEQ ID NO: 4740916 - DNA, 11 bp, Homo sapiens
atactgttgca

SEQ ID NO: 4740917 - DNA, 15 bp, Homo sapiens
atactgttgcacgtg

SEQ ID NO: 4740918 - DNA, 16 bp, Homo sapiens
atacttttgccctttg

SEQ ID NO: 4740919 - DNA, 18 bp, Homo sapiens
atagaaaaggaagacagc

SEQ ID NO: 4740920 - DNA, 13 bp, Homo sapiens
atagaaggtgatg

SEQ ID NO: 4740921 - DNA, 17 bp, Homo sapiens
atagaataaaggcctgc

SEQ ID NO: 4740922 - DNA, 20 bp, Homo sapiens
atagacagtaacggtgttta

SEQ ID NO: 4740923 - DNA, 19 bp, Homo sapiens
atagactgtaacttccaaa

SEQ ID NO: 4740924 - DNA, 14 bp, Homo sapiens
atagagatatttaa

SEQ ID NO: 4740925 - DNA, 13 bp, Homo sapiens
atagagcctgagg

SEQ ID NO: 4740926 - DNA, 14 bp, Homo sapiens
atagagctgtatta

SEQ ID NO: 4740927 - DNA, 15 bp, Homo sapiens
atagcatgaaataaa

SEQ ID NO: 4740928 - DNA, 18 bp, Homo sapiens
atagcgtcataactagaa

SEQ ID NO: 4740929 - DNA, 19 bp, Homo sapiens
atagctcaggtgtccctgc

SEQ ID NO: 4740930 - DNA, 20 bp, Homo sapiens
atagctcctgctccacagcc

SEQ ID NO: 4740931 - DNA, 17 bp, Homo sapiens
atagctctacacaacat

SEQ ID NO: 4740932 - DNA, 20 bp, Homo sapiens
atagctctacacaacatgta

SEQ ID NO: 4740933 - DNA, 23 bp, Homo sapiens
atagctctacacaacatgtatgt

SEQ ID NO: 4740934 - DNA, 12 bp, Homo sapiens
atagctgggact

SEQ ID NO: 4740935 - DNA, 17 bp, Homo sapiens
atagctgggactacagg

SEQ ID NO: 4740936 - DNA, 23 bp, Homo sapiens
atagctgtgtgaacgtgtatgta

SEQ ID NO: 4740937 - DNA, 14 bp, Homo sapiens
ataggagaggatga

SEQ ID NO: 4740938 - DNA, 22 bp, Homo sapiens
atagtaggggttgaagaaaaca

SEQ ID NO: 4740939 - DNA, 16 bp, Homo sapiens
atagtatggtggctgg

SEQ ID NO: 4740940 - DNA, 14 bp, Homo sapiens
atagtatttaattg

SEQ ID NO: 4740941 - DNA, 23 bp, Homo sapiens
atagtgactagcactagacatgt

SEQ ID NO: 4740942 - DNA, 17 bp, Homo sapiens
atagtggcttaaaacaa

SEQ ID NO: 4740943 - DNA, 15 bp, Homo sapiens
atagttgtctttctt

SEQ ID NO: 4740944 - DNA, 23 bp, Homo sapiens
atagttgtctttctttgctgctg

SEQ ID NO: 4740945 - DNA, 21 bp, Homo sapiens
atagtttgctttgtttaagca

SEQ ID NO: 4740946 - DNA, 17 bp, Homo sapiens
atataaattttttttgt

SEQ ID NO: 4740947 - DNA, 21 bp, Homo sapiens
atatagctctacacaacatgt

SEQ ID NO: 4740948 - DNA, 23 bp, Homo sapiens
atatagctctacacaacatgtat

SEQ ID NO: 4740949 - DNA, 19 bp, Homo sapiens
atatagtatttaattgttt

SEQ ID NO: 4740950 - DNA, 22 bp, Homo sapiens
atatagttgtctttctttgctg

SEQ ID NO: 4740951 - DNA, 13 bp, Homo sapiens
atatatgctaagt

SEQ ID NO: 4740952 - DNA, 20 bp, Homo sapiens
atatattcactttcattttt

SEQ ID NO: 4740953 - DNA, 14 bp, Homo sapiens
atatattgctaaaa

SEQ ID NO: 4740954 - DNA, 16 bp, Homo sapiens
atatattttaaaaaca

SEQ ID NO: 4740955 - DNA, 20 bp, Homo sapiens
atatattttttgaactttgt

SEQ ID NO: 4740956 - DNA, 23 bp, Homo sapiens
atatatttttttttaagctctga

SEQ ID NO: 4740957 - DNA, 22 bp, Homo sapiens
atatcatactgatttttaagtc

SEQ ID NO: 4740958 - DNA, 17 bp, Homo sapiens
atatcatataaacattt

SEQ ID NO: 4740959 - DNA, 12 bp, Homo sapiens
atatcatttgtg

SEQ ID NO: 4740960 - DNA, 13 bp, Homo sapiens
atatcatttgtga

SEQ ID NO: 4740961 - DNA, 14 bp, Homo sapiens
atatcctgctcaca

SEQ ID NO: 4740962 - DNA, 17 bp, Homo sapiens
atatccttataagagat

SEQ ID NO: 4740963 - DNA, 18 bp, Homo sapiens
atatctgacttctaggat

SEQ ID NO: 4740964 - DNA, 13 bp, Homo sapiens
atatcttctacat

SEQ ID NO: 4740965 - DNA, 24 bp, Homo sapiens
atatctttattcaccttttcttca

SEQ ID NO: 4740966 - DNA, 13 bp, Homo sapiens
atatgaaaacaag

SEQ ID NO: 4740967 - DNA, 17 bp, Homo sapiens
atatgaaagctgatttt

SEQ ID NO: 4740968 - DNA, 16 bp, Homo sapiens
atatgagagctctagt

SEQ ID NO: 4740969 - DNA, 17 bp, Homo sapiens
atatgattattaatcag

SEQ ID NO: 4740970 - DNA, 13 bp, Homo sapiens
atatgcacttata

SEQ ID NO: 4740971 - DNA, 20 bp, Homo sapiens
atatgcagtgatatggcaga

SEQ ID NO: 4740972 - DNA, 13 bp, Homo sapiens
atatggatttctt

SEQ ID NO: 4740973 - DNA, 16 bp, Homo sapiens
atatggctagttttca

SEQ ID NO: 4740974 - DNA, 16 bp, Homo sapiens
atatggggatgcagca

SEQ ID NO: 4740975 - DNA, 19 bp, Homo sapiens
atatggtactaaggagaat

SEQ ID NO: 4740976 - DNA, 22 bp, Homo sapiens
atatggtactaaggagaattaa

SEQ ID NO: 4740977 - DNA, 16 bp, Homo sapiens
atatgtaacaagccac

SEQ ID NO: 4740978 - DNA, 17 bp, Homo sapiens
atattaaaaaagagaca

SEQ ID NO: 4740979 - DNA, 13 bp, Homo sapiens
atattaaaatcac

SEQ ID NO: 4740980 - DNA, 22 bp, Homo sapiens
atattaagaaaaatatcaagta

SEQ ID NO: 4740981 - DNA, 18 bp, Homo sapiens
atattaagaaacaattta

SEQ ID NO: 4740982 - DNA, 14 bp, Homo sapiens
atattaattttcca

SEQ ID NO: 4740983 - DNA, 18 bp, Homo sapiens
atattatgcctgaatgac

SEQ ID NO: 4740984 - DNA, 20 bp, Homo sapiens
atattattccgtattacatt

SEQ ID NO: 4740985 - DNA, 21 bp, Homo sapiens
atattattccgtattacattt

SEQ ID NO: 4740986 - DNA, 15 bp, Homo sapiens
atattcacatgttct

SEQ ID NO: 4740987 - DNA, 21 bp, Homo sapiens
atattcactttcatttttgac

SEQ ID NO: 4740988 - DNA, 17 bp, Homo sapiens
atattcaggaagctcag

SEQ ID NO: 4740989 - DNA, 21 bp, Homo sapiens
atattcatcaaataaaccttg

SEQ ID NO: 4740990 - DNA, 23 bp, Homo sapiens
atattccctagaaacttccaaat

SEQ ID NO: 4740991 - DNA, 19 bp, Homo sapiens
atattctacacatatcttg

SEQ ID NO: 4740992 - DNA, 17 bp, Homo sapiens
atattcttatgttatca

SEQ ID NO: 4740993 - DNA, 16 bp, Homo sapiens
atattgaccatgtgat

SEQ ID NO: 4740994 - DNA, 18 bp, Homo sapiens
atattgaccatgtgatta

SEQ ID NO: 4740995 - DNA, 19 bp, Homo sapiens
atattgaccatgtgattat

SEQ ID NO: 4740996 - DNA, 13 bp, Homo sapiens
atattgatgtgtg

SEQ ID NO: 4740997 - DNA, 16 bp, Homo sapiens
atattgatttctgcct

SEQ ID NO: 4740998 - DNA, 22 bp, Homo sapiens
atattgatttctgccttccttg

SEQ ID NO: 4740999 - DNA, 20 bp, Homo sapiens
atattgcatcatagtttgct

SEQ ID NO: 4741000 - DNA, 20 bp, Homo sapiens
atattggtttgttattcttt

SEQ ID NO: 4741001 - DNA, 14 bp, Homo sapiens
atattgtaaatact

SEQ ID NO: 4741002 - DNA, 15 bp, Homo sapiens
atatttaaaagacaa

SEQ ID NO: 4741003 - DNA, 22 bp, Homo sapiens
atatttaaggtatacaacatga

SEQ ID NO: 4741004 - DNA, 15 bp, Homo sapiens
atatttatgtatctt

SEQ ID NO: 4741005 - DNA, 14 bp, Homo sapiens
atatttattgaatt

SEQ ID NO: 4741006 - DNA, 21 bp, Homo sapiens
atatttccctcccctggggac

SEQ ID NO: 4741007 - DNA, 19 bp, Homo sapiens
atatttcttcaagtgagtg

SEQ ID NO: 4741008 - DNA, 23 bp, Homo sapiens
atatttcttcaagtgagtggcat

SEQ ID NO: 4741009 - DNA, 17 bp, Homo sapiens
atatttgcaaagtgtat

SEQ ID NO: 4741010 - DNA, 11 bp, Homo sapiens
atattttaatt

SEQ ID NO: 4741011 - DNA, 16 bp, Homo sapiens
atattttccatgaaaa

SEQ ID NO: 4741012 - DNA, 14 bp, Homo sapiens
atattttgctgttt

SEQ ID NO: 4741013 - DNA, 15 bp, Homo sapiens
atattttgttacctt

SEQ ID NO: 4741014 - DNA, 22 bp, Homo sapiens
atattttgttaccttttacaga

SEQ ID NO: 4741015 - DNA, 14 bp, Homo sapiens
atatttttatattg

SEQ ID NO: 4741016 - DNA, 15 bp, Homo sapiens
atatttttctaaaga

SEQ ID NO: 4741017 - DNA, 13 bp, Homo sapiens
atcaaaaagaaaa

SEQ ID NO: 4741018 - DNA, 13 bp, Homo sapiens
atcaaaagaaata

SEQ ID NO: 4741019 - DNA, 18 bp, Homo sapiens
atcaaaagaaatagaaaa

SEQ ID NO: 4741020 - DNA, 15 bp, Homo sapiens
atcaaacatgaaaac

SEQ ID NO: 4741021 - DNA, 16 bp, Homo sapiens
atcaaagaaaaacaat

SEQ ID NO: 4741022 - DNA, 19 bp, Homo sapiens
atcaaagtcattaaagaca

SEQ ID NO: 4741023 - DNA, 21 bp, Homo sapiens
atcaaatggaagacacattga

SEQ ID NO: 4741024 - DNA, 16 bp, Homo sapiens
atcaacaaaaattgtc

SEQ ID NO: 4741025 - DNA, 19 bp, Homo sapiens
atcaaccccttcgctcctg

SEQ ID NO: 4741026 - DNA, 13 bp, Homo sapiens
atcaagaaatgct

SEQ ID NO: 4741027 - DNA, 16 bp, Homo sapiens
atcaattcatgtttaa

SEQ ID NO: 4741028 - DNA, 21 bp, Homo sapiens
atcacaaaagctgtgtctctg

SEQ ID NO: 4741029 - DNA, 14 bp, Homo sapiens
atcacaaagtggaa

SEQ ID NO: 4741030 - DNA, 15 bp, Homo sapiens
atcacaaagtggaac
